United States Patent 7,691,997 (FUNCTIONAL AND HYPERFUNCTIONAL SIRNA) - sequence listing, part 3

SEQ ID NO: 79019 - RNA, 19 nt, Homo sapiens
gaucaccuuugaccugaag

SEQ ID NO: 79020 - RNA, 19 nt, Homo sapiens
agaaggaggaggugcaauu

SEQ ID NO: 79021 - RNA, 19 nt, Homo sapiens
uaacuaaagguccauccaa

SEQ ID NO: 79022 - RNA, 19 nt, Homo sapiens
aaaucagggcuccuucuua

SEQ ID NO: 79023 - RNA, 19 nt, Homo sapiens
cuagaugauugauuaccaa

SEQ ID NO: 79024 - RNA, 19 nt, Homo sapiens
gaagacauguagccccauu

SEQ ID NO: 79025 - RNA, 19 nt, Homo sapiens
ugaucgcgcugacucaaga

SEQ ID NO: 79026 - RNA, 19 nt, Homo sapiens
cagaggcccugccauuucu

SEQ ID NO: 79027 - RNA, 19 nt, Homo sapiens
ccaaccagauaaagauucu

SEQ ID NO: 79028 - RNA, 19 nt, Homo sapiens
agauacgccuguuugagaa

SEQ ID NO: 79029 - RNA, 19 nt, Homo sapiens
ccagaggcccugccauuuc

SEQ ID NO: 79030 - RNA, 19 nt, Homo sapiens
cagaagaagagcauacaau

SEQ ID NO: 79031 - RNA, 19 nt, Homo sapiens
gggaaggguccaucucaga

SEQ ID NO: 79032 - RNA, 19 nt, Homo sapiens
gagaagcagcgggcaagaa

SEQ ID NO: 79033 - RNA, 19 nt, Homo sapiens
ucucacauccucugucuau

SEQ ID NO: 79034 - RNA, 19 nt, Homo sapiens
gcggaugucucagaucaag

SEQ ID NO: 79035 - RNA, 19 nt, Homo sapiens
ggaggaggugcaauugcua

SEQ ID NO: 79036 - RNA, 19 nt, Homo sapiens
auagaagacucagauacuu

SEQ ID NO: 79037 - RNA, 19 nt, Homo sapiens
cagggcuccuucuuaacua

SEQ ID NO: 79038 - RNA, 19 nt, Homo sapiens
gaaggccucccugucuaaa

SEQ ID NO: 79039 - RNA, 19 nt, Homo sapiens
augaucaucuccaguuuau

SEQ ID NO: 79040 - RNA, 19 nt, Homo sapiens
agacucacauccugaccuu

SEQ ID NO: 79041 - RNA, 19 nt, Homo sapiens
gaaaguggugcugggcaaa

SEQ ID NO: 79042 - RNA, 19 nt, Homo sapiens
aaacaggaaaguugcauca

SEQ ID NO: 79043 - RNA, 19 nt, Homo sapiens
aaaucaggguuacaaaucu

SEQ ID NO: 79044 - RNA, 19 nt, Homo sapiens
ccaaguccucacacagaua

SEQ ID NO: 79045 - RNA, 19 nt, Homo sapiens
gcagugacagaacuaagau

SEQ ID NO: 79046 - RNA, 19 nt, Homo sapiens
ucucauuauuucucucuga

SEQ ID NO: 79047 - RNA, 19 nt, Homo sapiens
ggaauccaacaucaagguu

SEQ ID NO: 79048 - RNA, 19 nt, Homo sapiens
gagcuugcacgaaaucaca

SEQ ID NO: 79049 - RNA, 19 nt, Homo sapiens
cggauugacugccaacucu

SEQ ID NO: 79050 - RNA, 19 nt, Homo sapiens
ggcagugacagaacuaaga

SEQ ID NO: 79051 - RNA, 19 nt, Homo sapiens
gauaguggcaccuggacau

SEQ ID NO: 79052 - RNA, 19 nt, Homo sapiens
aaucaggguuacaaaucuu

SEQ ID NO: 79053 - RNA, 19 nt, Homo sapiens
gggaaaucaggguuacaaa

SEQ ID NO: 79054 - RNA, 19 nt, Homo sapiens
acaagaagcuagugaagaa

SEQ ID NO: 79055 - RNA, 19 nt, Homo sapiens
gguccaagccgcauaauaa

SEQ ID NO: 79056 - RNA, 19 nt, Homo sapiens
gaacacauccuaagacaca

SEQ ID NO: 79057 - RNA, 19 nt, Homo sapiens
gcucagaggcuguaaagaa

SEQ ID NO: 79058 - RNA, 19 nt, Homo sapiens
aaagacagcucugcacauu

SEQ ID NO: 79059 - RNA, 19 nt, Homo sapiens
gaauaacucccuugacgaa

SEQ ID NO: 79060 - RNA, 19 nt, Homo sapiens
cagcagaaaugacaugugu

SEQ ID NO: 79061 - RNA, 19 nt, Homo sapiens
ccucagagcucaaucaucu

SEQ ID NO: 79062 - RNA, 19 nt, Homo sapiens
gcucuuucaucuauaguuu

SEQ ID NO: 79063 - RNA, 19 nt, Homo sapiens
caucacaguucaucuucua

SEQ ID NO: 79064 - RNA, 19 nt, Homo sapiens
gguaaggagugacaaggaa

SEQ ID NO: 79065 - RNA, 19 nt, Homo sapiens
guaaagaacugggauccau

SEQ ID NO: 79066 - RNA, 19 nt, Homo sapiens
aaagggaguuacuaggaua

SEQ ID NO: 79067 - RNA, 19 nt, Homo sapiens
agacagcucugcacauuca

SEQ ID NO: 79068 - RNA, 19 nt, Homo sapiens
cuaagaaggugaagcaaca

SEQ ID NO: 79069 - RNA, 19 nt, Homo sapiens
gaacuuugggagagaaauu

SEQ ID NO: 79070 - RNA, 19 nt, Homo sapiens
uaagacacauccuaagaca

SEQ ID NO: 79071 - RNA, 19 nt, Homo sapiens
gaucuuggacguacaccua

SEQ ID NO: 79072 - RNA, 19 nt, Homo sapiens
acaagcagccuuccaacua

SEQ ID NO: 79073 - RNA, 19 nt, Homo sapiens
gggaacacauccuaagaca

SEQ ID NO: 79074 - RNA, 19 nt, Homo sapiens
gaguuuaguugaggagaaa

SEQ ID NO: 79075 - RNA, 19 nt, Homo sapiens
caagcagccuuccaacuag

SEQ ID NO: 79076 - RNA, 19 nt, Homo sapiens
ccacguggauaacgaauac

SEQ ID NO: 79077 - RNA, 19 nt, Homo sapiens
gaagaaauuccgccagaag

SEQ ID NO: 79078 - RNA, 19 nt, Homo sapiens
gaagcaacaugggaacaca

SEQ ID NO: 79079 - RNA, 19 nt, Homo sapiens
ggacggauggcacaugguu

SEQ ID NO: 79080 - RNA, 19 nt, Homo sapiens
agaaauuccuacugcaaga

SEQ ID NO: 79081 - RNA, 19 nt, Homo sapiens
cauaauaagucuggaagag

SEQ ID NO: 79082 - RNA, 19 nt, Homo sapiens
ggcaagagaaggccagaaa

SEQ ID NO: 79083 - RNA, 19 nt, Homo sapiens
caguguggcuccuucuuga

SEQ ID NO: 79084 - RNA, 19 nt, Homo sapiens
aaaacagacuccucuagua

SEQ ID NO: 79085 - RNA, 19 nt, Homo sapiens
aaucaugucccuauuucua

SEQ ID NO: 79086 - RNA, 19 nt, Homo sapiens
ccauuugucuucccauauc

SEQ ID NO: 79087 - RNA, 19 nt, Homo sapiens
caacgggaaugaaccaaaa

SEQ ID NO: 79088 - RNA, 19 nt, Homo sapiens
ucacugcggccucuaagaa

SEQ ID NO: 79089 - RNA, 19 nt, Homo sapiens
ggucauguuccuuugguuu

SEQ ID NO: 79090 - RNA, 19 nt, Homo sapiens
ggucagaggcugcucaucu

SEQ ID NO: 79091 - RNA, 19 nt, Homo sapiens
gagcggcgucucagugaaa

SEQ ID NO: 79092 - RNA, 19 nt, Homo sapiens
agaagcuagugaagaaauu

SEQ ID NO: 79093 - RNA, 19 nt, Homo sapiens
caaccauggccuacuuaaa

SEQ ID NO: 79094 - RNA, 19 nt, Homo sapiens
gcaaccauggccuacuuaa

SEQ ID NO: 79095 - RNA, 19 nt, Homo sapiens
gucccaagcugagguaguu

SEQ ID NO: 79096 - RNA, 19 nt, Homo sapiens
ucacaugccaggauccaaa

SEQ ID NO: 79097 - RNA, 19 nt, Homo sapiens
gaaauuccuacugcaagaa

SEQ ID NO: 79098 - RNA, 19 nt, Homo sapiens
ccacgaacuuugggagaga

SEQ ID NO: 79099 - RNA, 19 nt, Homo sapiens
ggacgcuggugacccaaca

SEQ ID NO: 79100 - RNA, 19 nt, Homo sapiens
gcuaugaggcccaggacaa

SEQ ID NO: 79101 - RNA, 19 nt, Homo sapiens
ggccugaccugcuuagaac

SEQ ID NO: 79102 - RNA, 19 nt, Homo sapiens
aagcaaccauggccuacuu

SEQ ID NO: 79103 - RNA, 19 nt, Homo sapiens
gggcuggucauguuccuuu

SEQ ID NO: 79104 - RNA, 19 nt, Homo sapiens
uaguaaaccuuaaccaacu

SEQ ID NO: 79105 - RNA, 19 nt, Homo sapiens
ugaagaaauuccgccagaa

SEQ ID NO: 79106 - RNA, 19 nt, Homo sapiens
gaaaaucaagccccagaaa

SEQ ID NO: 79107 - RNA, 19 nt, Homo sapiens
auccagaacucaagcugua

SEQ ID NO: 79108 - RNA, 19 nt, Homo sapiens
gccagugucucccaucagu

SEQ ID NO: 79109 - RNA, 19 nt, Homo sapiens
ggacggcucagcugguaug

SEQ ID NO: 79110 - RNA, 19 nt, Homo sapiens
ggagcggcgucucagugaa

SEQ ID NO: 79111 - RNA, 19 nt, Homo sapiens
gccauuugaugcuguaucu

SEQ ID NO: 79112 - RNA, 19 nt, Homo sapiens
ccuaagacacauccuaaga

SEQ ID NO: 79113 - RNA, 19 nt, Homo sapiens
ugagguaguuucaguccau

SEQ ID NO: 79114 - RNA, 19 nt, Homo sapiens
cagcugggcgagugcauuu

SEQ ID NO: 79115 - RNA, 19 nt, Homo sapiens
ugacaacuccuccgacagu

SEQ ID NO: 79116 - RNA, 19 nt, Homo sapiens
ggaaugaaccaaaacaugu

SEQ ID NO: 79117 - RNA, 19 nt, Homo sapiens
gaaauuccgccagaagaag

SEQ ID NO: 79118 - RNA, 19 nt, Homo sapiens
gggccugaccugcuuagaa

SEQ ID NO: 79119 - RNA, 19 nt, Homo sapiens
aaagaacugggauccauga

SEQ ID NO: 79120 - RNA, 19 nt, Homo sapiens
ggccucggcuuccuuaacu

SEQ ID NO: 79121 - RNA, 19 nt, Homo sapiens
acagacuccucuaguacuu

SEQ ID NO: 79122 - RNA, 19 nt, Homo sapiens
aaacagacuccucuaguac

SEQ ID NO: 79123 - RNA, 19 nt, Homo sapiens
agaagguguuugucacaug

SEQ ID NO: 79124 - RNA, 19 nt, Homo sapiens
gaacuuccucugcaacaac

SEQ ID NO: 79125 - RNA, 19 nt, Homo sapiens
gaaaacagacuccucuagu

SEQ ID NO: 79126 - RNA, 19 nt, Homo sapiens
aagcagcgccaguggauug

SEQ ID NO: 79127 - RNA, 19 nt, Homo sapiens
agaaauuccgccagaagaa

SEQ ID NO: 79128 - RNA, 19 nt, Homo sapiens
ccagaaaaguggccgaguu

SEQ ID NO: 79129 - RNA, 19 nt, Homo sapiens
agagcucaaucaucugcua

SEQ ID NO: 79130 - RNA, 19 nt, Homo sapiens
gaagcuagugaagaaauuc

SEQ ID NO: 79131 - RNA, 19 nt, Homo sapiens
caagaagguguuugucaca

SEQ ID NO: 79132 - RNA, 19 nt, Homo sapiens
ggaagauccagaacucaag

SEQ ID NO: 79133 - RNA, 19 nt, Homo sapiens
ccaagccgcauaauaaguc

SEQ ID NO: 79134 - RNA, 19 nt, Homo sapiens
acuguccgcucuucacuug

SEQ ID NO: 79135 - RNA, 19 nt, Homo sapiens
gagaacuuccucugcaaca

SEQ ID NO: 79136 - RNA, 19 nt, Homo sapiens
caacaccuccaacgacaag

SEQ ID NO: 79137 - RNA, 19 nt, Homo sapiens
agaguuuaguugaggagaa

SEQ ID NO: 79138 - RNA, 19 nt, Homo sapiens
ucuaguacuuggagaucuu

SEQ ID NO: 79139 - RNA, 19 nt, Homo sapiens
cagaagacaacaccuccaa

SEQ ID NO: 79140 - RNA, 19 nt, Homo sapiens
cagccagugucucccauca

SEQ ID NO: 79141 - RNA, 19 nt, Homo sapiens
gcauaauaagucuggaaga

SEQ ID NO: 79142 - RNA, 19 nt, Homo sapiens
gagcacaggcaucaauggu

SEQ ID NO: 79143 - RNA, 19 nt, Homo sapiens
ucggacggcucagcuggua

SEQ ID NO: 79144 - RNA, 19 nt, Homo sapiens
ucauguuccuuugguuuga

SEQ ID NO: 79145 - RNA, 19 nt, Homo sapiens
ccuaguaaaccuuaaccaa

SEQ ID NO: 79146 - RNA, 19 nt, Homo sapiens
gcgagugcauuuugaauag

SEQ ID NO: 79147 - RNA, 19 nt, Homo sapiens
cagaggcuguaaagaacug

SEQ ID NO: 79148 - RNA, 19 nt, Homo sapiens
caaaagggaguuacuagga

SEQ ID NO: 79149 - RNA, 19 nt, Homo sapiens
caaagacagcucugcacau

SEQ ID NO: 79150 - RNA, 19 nt, Homo sapiens
ccgagagccagaccuguuu

SEQ ID NO: 79151 - RNA, 19 nt, Homo sapiens
gccgagagccagaccuguu

SEQ ID NO: 79152 - RNA, 19 nt, Homo sapiens
cgacagugacuaugaucug

SEQ ID NO: 79153 - RNA, 19 nt, Homo sapiens
acucccgccugucagcuua

SEQ ID NO: 79154 - RNA, 19 nt, Homo sapiens
gggcuaaaguugugucuua

SEQ ID NO: 79155 - RNA, 19 nt, Homo sapiens
gaaaggaacauuugaaaga

SEQ ID NO: 79156 - RNA, 19 nt, Homo sapiens
gaugugagcuguugaguuc

SEQ ID NO: 79157 - RNA, 19 nt, Homo sapiens
acacugggcuuaugccuua

SEQ ID NO: 79158 - RNA, 19 nt, Homo sapiens
gaagaucccuuugacuuga

SEQ ID NO: 79159 - RNA, 19 nt, Homo sapiens
gaugacggcugggacauua

SEQ ID NO: 79160 - RNA, 19 nt, Homo sapiens
aagaugagcuuccauguau

SEQ ID NO: 79161 - RNA, 19 nt, Homo sapiens
gacaauuucuugcaacuug

SEQ ID NO: 79162 - RNA, 19 nt, Homo sapiens
ggucauggcucugcuauuc

SEQ ID NO: 79163 - RNA, 19 nt, Homo sapiens
gcagagcagcguccuauaa

SEQ ID NO: 79164 - RNA, 19 nt, Homo sapiens
gaagauacauuggcucagu

SEQ ID NO: 79165 - RNA, 19 nt, Homo sapiens
ggaccuccuucuagccuua

SEQ ID NO: 79166 - RNA, 19 nt, Homo sapiens
caagaaagaggcagaaaga

SEQ ID NO: 79167 - RNA, 19 nt, Homo sapiens
gcucaacccugacccuuug

SEQ ID NO: 79168 - RNA, 19 nt, Homo sapiens
gcaucuggcuggauaaugu

SEQ ID NO: 79169 - RNA, 19 nt, Homo sapiens
gaaagaggcagaaagagau

SEQ ID NO: 79170 - RNA, 19 nt, Homo sapiens
acaccucccuauucuguua

SEQ ID NO: 79171 - RNA, 19 nt, Homo sapiens
gggaaaaggucaagaaaga

SEQ ID NO: 79172 - RNA, 19 nt, Homo sapiens
gcaagaagaaguuuaugau

SEQ ID NO: 79173 - RNA, 19 nt, Homo sapiens
aagcaacccuucaggauug

SEQ ID NO: 79174 - RNA, 19 nt, Homo sapiens
acacgugggucgaauguga

SEQ ID NO: 79175 - RNA, 19 nt, Homo sapiens
gcaacaagcaugccuaugg

SEQ ID NO: 79176 - RNA, 19 nt, Homo sapiens
uaaggucuaugucugcaaa

SEQ ID NO: 79177 - RNA, 19 nt, Homo sapiens
ggccgcaucuggcuggaua

SEQ ID NO: 79178 - RNA, 19 nt, Homo sapiens
aggcuaggcugaguacuua

SEQ ID NO: 79179 - RNA, 19 nt, Homo sapiens
ugacaacuuuagauucuga

SEQ ID NO: 79180 - RNA, 19 nt, Homo sapiens
caacugggcugugggaagu

SEQ ID NO: 79181 - RNA, 19 nt, Homo sapiens
gaagaacaccugcaaccau

SEQ ID NO: 79182 - RNA, 19 nt, Homo sapiens
gcucugcuauucuccuuga

SEQ ID NO: 79183 - RNA, 19 nt, Homo sapiens
gaaauaagagaaucaagac

SEQ ID NO: 79184 - RNA, 19 nt, Homo sapiens
uauacaaccugccaacaug

SEQ ID NO: 79185 - RNA, 19 nt, Homo sapiens
gguagacaauuucuugcaa

SEQ ID NO: 79186 - RNA, 19 nt, Homo sapiens
gaagacacgugggucgaau

SEQ ID NO: 79187 - RNA, 19 nt, Homo sapiens
caacaccucccuauucugu

SEQ ID NO: 79188 - RNA, 19 nt, Homo sapiens
gcuguugaguucccucuug

SEQ ID NO: 79189 - RNA, 19 nt, Homo sapiens
ggguggagguggaacagaa

SEQ ID NO: 79190 - RNA, 19 nt, Homo sapiens
cggcuacauuuacacauuu

SEQ ID NO: 79191 - RNA, 19 nt, Homo sapiens
gagcagagcagcguccuau

SEQ ID NO: 79192 - RNA, 19 nt, Homo sapiens
ggaaugaaacaaugaaagg

SEQ ID NO: 79193 - RNA, 19 nt, Homo sapiens
gugaagaucccuuugacuu

SEQ ID NO: 79194 - RNA, 19 nt, Homo sapiens
ucagaugugcagaccauua

SEQ ID NO: 79195 - RNA, 19 nt, Homo sapiens
ucagagaccggaaaugcua

SEQ ID NO: 79196 - RNA, 19 nt, Homo sapiens
ggcuacauuuacacauuua

SEQ ID NO: 79197 - RNA, 19 nt, Homo sapiens
gcagcguccuauaauccua

SEQ ID NO: 79198 - RNA, 19 nt, Homo sapiens
ggagggcuguacugacuca

SEQ ID NO: 79199 - RNA, 19 nt, Homo sapiens
caagacagaaauaagagaa

SEQ ID NO: 79200 - RNA, 19 nt, Homo sapiens
agaaagaggcagaaagaga

SEQ ID NO: 79201 - RNA, 19 nt, Homo sapiens
cuucuagccuuaaauuuca

SEQ ID NO: 79202 - RNA, 19 nt, Homo sapiens
uagcaacaccucccuauuc

SEQ ID NO: 79203 - RNA, 19 nt, Homo sapiens
gaaagaaaauguggguaga

SEQ ID NO: 79204 - RNA, 19 nt, Homo sapiens
gaucagggagggcuaaagu

SEQ ID NO: 79205 - RNA, 19 nt, Homo sapiens
cugcaaacauuaaaggaau

SEQ ID NO: 79206 - RNA, 19 nt, Homo sapiens
gggaaaguuuagaauucuu

SEQ ID NO: 79207 - RNA, 19 nt, Homo sapiens
acuaaucuaugucugcaaa

SEQ ID NO: 79208 - RNA, 19 nt, Homo sapiens
gcugucaucugcucaggau

SEQ ID NO: 79209 - RNA, 19 nt, Homo sapiens
uaguguagguagacaauuc

SEQ ID NO: 79210 - RNA, 19 nt, Homo sapiens
ucagucaguugcacaggaa

SEQ ID NO: 79211 - RNA, 19 nt, Homo sapiens
guagguagacaauucuuuc

SEQ ID NO: 79212 - RNA, 19 nt, Homo sapiens
uuaaggacguggcuguguu

SEQ ID NO: 79213 - RNA, 19 nt, Homo sapiens
gcaagacagaaauaagaga

SEQ ID NO: 79214 - RNA, 19 nt, Homo sapiens
gaaugaaacaaugaaagga

SEQ ID NO: 79215 - RNA, 19 nt, Homo sapiens
cgacugcacccaccaggaa

SEQ ID NO: 79216 - RNA, 19 nt, Homo sapiens
gcacaggaacagaagauac

SEQ ID NO: 79217 - RNA, 19 nt, Homo sapiens
gaggcuaggcugaguacuu

SEQ ID NO: 79218 - RNA, 19 nt, Homo sapiens
agacagaaauaagagaauc

SEQ ID NO: 79219 - RNA, 19 nt, Homo sapiens
uauauugguuacugggaaa

SEQ ID NO: 79220 - RNA, 19 nt, Homo sapiens
ccuauaauccuagaccuuu

SEQ ID NO: 79221 - RNA, 19 nt, Homo sapiens
ugaagaucccuuugacuug

SEQ ID NO: 79222 - RNA, 19 nt, Homo sapiens
gaugugcagaccauuacua

SEQ ID NO: 79223 - RNA, 19 nt, Homo sapiens
cuaaaguugugucuuaugc

SEQ ID NO: 79224 - RNA, 19 nt, Homo sapiens
ucagggagggcuaaaguug

SEQ ID NO: 79225 - RNA, 19 nt, Homo sapiens
gaacaccugcaaccaugau

SEQ ID NO: 79226 - RNA, 19 nt, Homo sapiens
gcaagggacgcguggaagu

SEQ ID NO: 79227 - RNA, 19 nt, Homo sapiens
uaugauuguucacaugaug

SEQ ID NO: 79228 - RNA, 19 nt, Homo sapiens
caucugcucaggauaguau

SEQ ID NO: 79229 - RNA, 19 nt, Homo sapiens
gcacccaccaggaagaugu

SEQ ID NO: 79230 - RNA, 19 nt, Homo sapiens
gaugacaacuggggagaaa

SEQ ID NO: 79231 - RNA, 19 nt, Homo sapiens
cgaaugugaagaucccuuu

SEQ ID NO: 79232 - RNA, 19 nt, Homo sapiens
aauuucagcucaucaccuu

SEQ ID NO: 79233 - RNA, 19 nt, Homo sapiens
cagagcagcguccuauaau

SEQ ID NO: 79234 - RNA, 19 nt, Homo sapiens
guggguagacaauuucuug

SEQ ID NO: 79235 - RNA, 19 nt, Homo sapiens
cugauuauccucauacuca

SEQ ID NO: 79236 - RNA, 19 nt, Homo sapiens
cuuauuauacggcuacauu

SEQ ID NO: 79237 - RNA, 19 nt, Homo sapiens
cuaggcugaguacuuauua

SEQ ID NO: 79238 - RNA, 19 nt, Homo sapiens
gcuaggcugaguacuuauu

SEQ ID NO: 79239 - RNA, 19 nt, Homo sapiens
gugcagaccauuacuaagg

SEQ ID NO: 79240 - RNA, 19 nt, Homo sapiens
ggaauccucaaaccuguca

SEQ ID NO: 79241 - RNA, 19 nt, Homo sapiens
ugagcaagaagaaguuuau

SEQ ID NO: 79242 - RNA, 19 nt, Homo sapiens
gcugaguacuuauuauacg

SEQ ID NO: 79243 - RNA, 19 nt, Homo sapiens
aggcugaguacuuauuaua

SEQ ID NO: 79244 - RNA, 19 nt, Homo sapiens
gaaaauguggguagacaau

SEQ ID NO: 79245 - RNA, 19 nt, Homo sapiens
uaaucuaugucugcaaaca

SEQ ID NO: 79246 - RNA, 19 nt, Homo sapiens
guuuaugauuguucacaug

SEQ ID NO: 79247 - RNA, 19 nt, Homo sapiens
ggcuaaaguugugucuuau

SEQ ID NO: 79248 - RNA, 19 nt, Homo sapiens
gacacugguucuggccuuu

SEQ ID NO: 79249 - RNA, 19 nt, Homo sapiens
gcuaaaguugugucuuaug

SEQ ID NO: 79250 - RNA, 19 nt, Homo sapiens
cuagugguauuuuguauga

SEQ ID NO: 79251 - RNA, 19 nt, Homo sapiens
ggaagaacaccugcaacca

SEQ ID NO: 79252 - RNA, 19 nt, Homo sapiens
acggcuacauuuacacauu

SEQ ID NO: 79253 - RNA, 19 nt, Homo sapiens
aggcaagacagaaauaaga

SEQ ID NO: 79254 - RNA, 19 nt, Homo sapiens
ggaaggacuugaagaguug

SEQ ID NO: 79255 - RNA, 19 nt, Homo sapiens
caaggaaucucgggagcua

SEQ ID NO: 79256 - RNA, 19 nt, Homo sapiens
cgacaacgaugacuacgau

SEQ ID NO: 79257 - RNA, 19 nt, Homo sapiens
cgaagucccugcaaguguu

SEQ ID NO: 79258 - RNA, 19 nt, Homo sapiens
gaggauuacugcaauaguc

SEQ ID NO: 79259 - RNA, 19 nt, Homo sapiens
gcacuacugcggccacaaa

SEQ ID NO: 79260 - RNA, 19 nt, Homo sapiens
gacagucacuauagaaucu

SEQ ID NO: 79261 - RNA, 19 nt, Homo sapiens
uucauccucuugagaauua

SEQ ID NO: 79262 - RNA, 19 nt, Homo sapiens
gcaaagcagguuccagaug

SEQ ID NO: 79263 - RNA, 19 nt, Homo sapiens
gaaaauagagaacaaggaa

SEQ ID NO: 79264 - RNA, 19 nt, Homo sapiens
aggaaggacuugaagaguu

SEQ ID NO: 79265 - RNA, 19 nt, Homo sapiens
gcaagcugccuccauggaa

SEQ ID NO: 79266 - RNA, 19 nt, Homo sapiens
ggaggaaggacuugaagag

SEQ ID NO: 79267 - RNA, 19 nt, Homo sapiens
ugaccaccuucuacaauuc

SEQ ID NO: 79268 - RNA, 19 nt, Homo sapiens
guucagacagucacuauag

SEQ ID NO: 79269 - RNA, 19 nt, Homo sapiens
gcagguggagguacacuuc

SEQ ID NO: 79270 - RNA, 19 nt, Homo sapiens
gcagggagcaauagcuauc

SEQ ID NO: 79271 - RNA, 19 nt, Homo sapiens
cugaccaccuucuacaauu

SEQ ID NO: 79272 - RNA, 19 nt, Homo sapiens
gcucggacucagacuauga

SEQ ID NO: 79273 - RNA, 19 nt, Homo sapiens
uuacugcaauagucccaaa

SEQ ID NO: 79274 - RNA, 19 nt, Homo sapiens
cagacuaugagcacuauga

SEQ ID NO: 79275 - RNA, 19 nt, Homo sapiens
aaauagagaacaaggaauc

SEQ ID NO: 79276 - RNA, 19 nt, Homo sapiens
ucagacagucacuauagaa

SEQ ID NO: 79277 - RNA, 19 nt, Homo sapiens
ccucucaggucauccaucu

SEQ ID NO: 79278 - RNA, 19 nt, Homo sapiens
gaugaggagguccagcaaa

SEQ ID NO: 79279 - RNA, 19 nt, Homo sapiens
gcaaguguucagacaguca

SEQ ID NO: 79280 - RNA, 19 nt, Homo sapiens
gcaauagucccaaaagcaa

SEQ ID NO: 79281 - RNA, 19 nt, Homo sapiens
gcuccuggcgguucaacaa

SEQ ID NO: 79282 - RNA, 19 nt, Homo sapiens
gauguacuacucaugcaau

SEQ ID NO: 79283 - RNA, 19 nt, Homo sapiens
ccaccgacaacgaugacua

SEQ ID NO: 79284 - RNA, 19 nt, Homo sapiens
gaggagguccagcaaagca

SEQ ID NO: 79285 - RNA, 19 nt, Homo sapiens
caccagcagugcagagagu

SEQ ID NO: 79286 - RNA, 19 nt, Homo sapiens
gagcucacccucuccaacu

SEQ ID NO: 79287 - RNA, 19 nt, Homo sapiens
ggagugguaccagaacuuc

SEQ ID NO: 79288 - RNA, 19 nt, Homo sapiens
gaggaaggacuugaagagu

SEQ ID NO: 79289 - RNA, 19 nt, Homo sapiens
acaacgaugacuacgauga

SEQ ID NO: 79290 - RNA, 19 nt, Homo sapiens
acuaugagcacuaugacuu

SEQ ID NO: 79291 - RNA, 19 nt, Homo sapiens
cggcagggagcaauagcua

SEQ ID NO: 79292 - RNA, 19 nt, Homo sapiens
gcucagcuucccggaguuu

SEQ ID NO: 79293 - RNA, 19 nt, Homo sapiens
cugcaaguguucagacagu

SEQ ID NO: 79294 - RNA, 19 nt, Homo sapiens
ggaggauuacugcaauagu

SEQ ID NO: 79295 - RNA, 19 nt, Homo sapiens
uaugagcacuaugacuuca

SEQ ID NO: 79296 - RNA, 19 nt, Homo sapiens
ccaaagaaguuuucaugcu

SEQ ID NO: 79297 - RNA, 19 nt, Homo sapiens
gcagcccucucaggucauc

SEQ ID NO: 79298 - RNA, 19 nt, Homo sapiens
ggauguacuacucaugcaa

SEQ ID NO: 79299 - RNA, 19 nt, Homo sapiens
gcaggauguacuacucaug

SEQ ID NO: 79300 - RNA, 19 nt, Homo sapiens
gaagucccugcaaguguuc

SEQ ID NO: 79301 - RNA, 19 nt, Homo sapiens
cgugucaccugugcagaga

SEQ ID NO: 79302 - RNA, 19 nt, Homo sapiens
gggagugguaccagaacuu

SEQ ID NO: 79303 - RNA, 19 nt, Homo sapiens
ggggaggauuacugcaaua

SEQ ID NO: 79304 - RNA, 19 nt, Homo sapiens
ccuggacacugcauuacag

SEQ ID NO: 79305 - RNA, 19 nt, Homo sapiens
cagacagucacuauagaau

SEQ ID NO: 79306 - RNA, 19 nt, Homo sapiens
ucccggaguuugcacaauc

SEQ ID NO: 79307 - RNA, 19 nt, Homo sapiens
gcuguggaacugcgguuga

SEQ ID NO: 79308 - RNA, 19 nt, Homo sapiens
augaggagguccagcaaag

SEQ ID NO: 79309 - RNA, 19 nt, Homo sapiens
ggacacagauaaagaaacu

SEQ ID NO: 79310 - RNA, 19 nt, Homo sapiens
ucacggaggucaaugucua

SEQ ID NO: 79311 - RNA, 19 nt, Homo sapiens
cccaagacaucauuuacua

SEQ ID NO: 79312 - RNA, 19 nt, Homo sapiens
gaggaacagucccaaggau

SEQ ID NO: 79313 - RNA, 19 nt, Homo sapiens
gcucguggcgggauaagaa

SEQ ID NO: 79314 - RNA, 19 nt, Homo sapiens
cgaggacacagauaaagaa

SEQ ID NO: 79315 - RNA, 19 nt, Homo sapiens
gcgaggacacagauaaaga

SEQ ID NO: 79316 - RNA, 19 nt, Homo sapiens
gaggacacagauaaagaaa

SEQ ID NO: 79317 - RNA, 19 nt, Homo sapiens
cggcaugugugguguacga

SEQ ID NO: 79318 - RNA, 19 nt, Homo sapiens
ucccaaggauggcacagau

SEQ ID NO: 79319 - RNA, 19 nt, Homo sapiens
ggaauaaucuccuguuaau

SEQ ID NO: 79320 - RNA, 19 nt, Homo sapiens
gaaauaagaaccacucaua

SEQ ID NO: 79321 - RNA, 19 nt, Homo sapiens
gcagaguucuauaauguaa

SEQ ID NO: 79322 - RNA, 19 nt, Homo sapiens
aaacugagauccuuccuuu

SEQ ID NO: 79323 - RNA, 19 nt, Homo sapiens
cuacauuacuucaaacuga

SEQ ID NO: 79324 - RNA, 19 nt, Homo sapiens
gaacgagggcuacuauuuc

SEQ ID NO: 79325 - RNA, 19 nt, Homo sapiens
guacuaugcuguuaugagu

SEQ ID NO: 79326 - RNA, 19 nt, Homo sapiens
gagcaucagugagguuaaa

SEQ ID NO: 79327 - RNA, 19 nt, Homo sapiens
gaagacguguuugcaaaug

SEQ ID NO: 79328 - RNA, 19 nt, Homo sapiens
gcaacuccaucauguacuu

SEQ ID NO: 79329 - RNA, 19 nt, Homo sapiens
ggacuucgccugugauauc

SEQ ID NO: 79330 - RNA, 19 nt, Homo sapiens
ugaguggcuuuaaugaaua

SEQ ID NO: 79331 - RNA, 19 nt, Homo sapiens
guacauucuuccugauuau

SEQ ID NO: 79332 - RNA, 19 nt, Homo sapiens
gaaccacucauaauucuuc

SEQ ID NO: 79333 - RNA, 19 nt, Homo sapiens
uggcagaguucuauaaugu

SEQ ID NO: 79334 - RNA, 19 nt, Homo sapiens
ccgaagacguguuugcaaa

SEQ ID NO: 79335 - RNA, 19 nt, Homo sapiens
agagacagcuugaucaaag

SEQ ID NO: 79336 - RNA, 19 nt, Homo sapiens
gccacuacauuacuucaaa

SEQ ID NO: 79337 - RNA, 19 nt, Homo sapiens
aaacuaaggcccucuugaa

SEQ ID NO: 79338 - RNA, 19 nt, Homo sapiens
gaguggcuuuaaugaauaa

SEQ ID NO: 79339 - RNA, 19 nt, Homo sapiens
uguacauucuuccugauua

SEQ ID NO: 79340 - RNA, 19 nt, Homo sapiens
uaagaaccacucauaauuc

SEQ ID NO: 79341 - RNA, 19 nt, Homo sapiens
gaucaaaggcacacagcaa

SEQ ID NO: 79342 - RNA, 19 nt, Homo sapiens
ccacaagggucacaauacu

SEQ ID NO: 79343 - RNA, 19 nt, Homo sapiens
ggagacaagcccagccuuu

SEQ ID NO: 79344 - RNA, 19 nt, Homo sapiens
gagcaaguccuucccuuuc

SEQ ID NO: 79345 - RNA, 19 nt, Homo sapiens
ccucuugaaucucugaauu

SEQ ID NO: 79346 - RNA, 19 nt, Homo sapiens
cuaaggcccucuugaaucu

SEQ ID NO: 79347 - RNA, 19 nt, Homo sapiens
ucagugagguuaaacuaag

SEQ ID NO: 79348 - RNA, 19 nt, Homo sapiens
gaaaaugaaucccucuauc

SEQ ID NO: 79349 - RNA, 19 nt, Homo sapiens
gucauggccuuaccaguga

SEQ ID NO: 79350 - RNA, 19 nt, Homo sapiens
gaaucccucuaucucuaaa

SEQ ID NO: 79351 - RNA, 19 nt, Homo sapiens
ggagcaaguccuucccuuu

SEQ ID NO: 79352 - RNA, 19 nt, Homo sapiens
ugcaacagccacuacauua

SEQ ID NO: 79353 - RNA, 19 nt, Homo sapiens
agaacgagggcuacuauuu

SEQ ID NO: 79354 - RNA, 19 nt, Homo sapiens
ccacaccauucaggucuuu

SEQ ID NO: 79355 - RNA, 19 nt, Homo sapiens
gcaaguccuucccuuucau

SEQ ID NO: 79356 - RNA, 19 nt, Homo sapiens
aaacugcugucccaaacau

SEQ ID NO: 79357 - RNA, 19 nt, Homo sapiens
ccauucaggucuuucuuuc

SEQ ID NO: 79358 - RNA, 19 nt, Homo sapiens
guuaauaugguguacauuc

SEQ ID NO: 79359 - RNA, 19 nt, Homo sapiens
ccaaacugcugucccaaac

SEQ ID NO: 79360 - RNA, 19 nt, Homo sapiens
ggucaaaucgggagacaag

SEQ ID NO: 79361 - RNA, 19 nt, Homo sapiens
guagcauccucuuuaaugg

SEQ ID NO: 79362 - RNA, 19 nt, Homo sapiens
gcgagacaguggagcugaa

SEQ ID NO: 79363 - RNA, 19 nt, Homo sapiens
gcuuaacccuggaaaauga

SEQ ID NO: 79364 - RNA, 19 nt, Homo sapiens
agucaggguuggagcagua

SEQ ID NO: 79365 - RNA, 19 nt, Homo sapiens
gagcaacuccaucauguac

SEQ ID NO: 79366 - RNA, 19 nt, Homo sapiens
gcagaccugacucucuuaa

SEQ ID NO: 79367 - RNA, 19 nt, Homo sapiens
caucagugagguuaaacua

SEQ ID NO: 79368 - RNA, 19 nt, Homo sapiens
augaguggcuuuaaugaau

SEQ ID NO: 79369 - RNA, 19 nt, Homo sapiens
guuguacuaugcuguuaug

SEQ ID NO: 79370 - RNA, 19 nt, Homo sapiens
ggccgaagggcgcaacuuu

SEQ ID NO: 79371 - RNA, 19 nt, Homo sapiens
guuaugaguggcuuuaaug

SEQ ID NO: 79372 - RNA, 19 nt, Homo sapiens
ggguuguacuaugcuguua

SEQ ID NO: 79373 - RNA, 19 nt, Homo sapiens
ucauaauucuucaccuuag

SEQ ID NO: 79374 - RNA, 19 nt, Homo sapiens
acaugcacuuccuugcuua

SEQ ID NO: 79375 - RNA, 19 nt, Homo sapiens
aggcagaccugacucucuu

SEQ ID NO: 79376 - RNA, 19 nt, Homo sapiens
gugcaacagccacuacauu

SEQ ID NO: 79377 - RNA, 19 nt, Homo sapiens
acucauaauucuucaccuu

SEQ ID NO: 79378 - RNA, 19 nt, Homo sapiens
gagagaacgagggcuacua

SEQ ID NO: 79379 - RNA, 19 nt, Homo sapiens
augaaucccucuaucucua

SEQ ID NO: 79380 - RNA, 19 nt, Homo sapiens
gccaggugcugcuguccaa

SEQ ID NO: 79381 - RNA, 19 nt, Homo sapiens
caacagccacuacauuacu

SEQ ID NO: 79382 - RNA, 19 nt, Homo sapiens
uguagcauccucuuuaaug

SEQ ID NO: 79383 - RNA, 19 nt, Homo sapiens
cugagcaacuccaucaugu

SEQ ID NO: 79384 - RNA, 19 nt, Homo sapiens
gauaaggaaauaagaacca

SEQ ID NO: 79385 - RNA, 19 nt, Homo sapiens
ccuggccucugcucaacua

SEQ ID NO: 79386 - RNA, 19 nt, Homo sapiens
ucuugaaucucugaauuug

SEQ ID NO: 79387 - RNA, 19 nt, Homo sapiens
gaauuaaagaagagaacug

SEQ ID NO: 79388 - RNA, 19 nt, Homo sapiens
gagacaagcccagccuuuc

SEQ ID NO: 79389 - RNA, 19 nt, Homo sapiens
cuucuccugucacugguua

SEQ ID NO: 79390 - RNA, 19 nt, Homo sapiens
uuuguagcauccucuuuaa

SEQ ID NO: 79391 - RNA, 19 nt, Homo sapiens
gaccugacucucuuaagga

SEQ ID NO: 79392 - RNA, 19 nt, Homo sapiens
agaccugacucucuuaagg

SEQ ID NO: 79393 - RNA, 19 nt, Homo sapiens
uaaacuaaggcccucuuga

SEQ ID NO: 79394 - RNA, 19 nt, Homo sapiens
cccucuaucucuaaagaaa

SEQ ID NO: 79395 - RNA, 19 nt, Homo sapiens
caccacaagggucacaaua

SEQ ID NO: 79396 - RNA, 19 nt, Homo sapiens
gcuguuaugaguggcuuua

SEQ ID NO: 79397 - RNA, 19 nt, Homo sapiens
ggaaauaagaaccacucau

SEQ ID NO: 79398 - RNA, 19 nt, Homo sapiens
gcaacagccacuacauuac

SEQ ID NO: 79399 - RNA, 19 nt, Homo sapiens
aauaugguguacauucuuc

SEQ ID NO: 79400 - RNA, 19 nt, Homo sapiens
uaagguaugguacaagcaa

SEQ ID NO: 79401 - RNA, 19 nt, Homo sapiens
gcucuuuccuccacaccau

SEQ ID NO: 79402 - RNA, 19 nt, Homo sapiens
gagacagcuugaucaaagg

SEQ ID NO: 79403 - RNA, 19 nt, Homo sapiens
ccagagacagcuugaucaa

SEQ ID NO: 79404 - RNA, 19 nt, Homo sapiens
cauccucuuuaauggguaa

SEQ ID NO: 79405 - RNA, 19 nt, Homo sapiens
gagaacgagggcuacuauu

SEQ ID NO: 79406 - RNA, 19 nt, Homo sapiens
uugaaucucugaauuugag

SEQ ID NO: 79407 - RNA, 19 nt, Homo sapiens
ugaaucccucuaucucuaa

SEQ ID NO: 79408 - RNA, 19 nt, Homo sapiens
ggcagaguucuauaaugua

SEQ ID NO: 79409 - RNA, 19 nt, Homo sapiens
ggcaagggaacaaguacuu

SEQ ID NO: 79410 - RNA, 19 nt, Homo sapiens
gaaccgaagacguguuugc

SEQ ID NO: 79411 - RNA, 19 nt, Homo sapiens
aacaugcacuuccuugcuu

SEQ ID NO: 79412 - RNA, 19 nt, Homo sapiens
ggcuaccccuuuacaaaua

SEQ ID NO: 79413 - RNA, 19 nt, Homo sapiens
aaaaugaaguggugagcuu

SEQ ID NO: 79414 - RNA, 19 nt, Homo sapiens
ggaaacaaaacuagguaaa

SEQ ID NO: 79415 - RNA, 19 nt, Homo sapiens
ccugugauaucuacaucug

SEQ ID NO: 79416 - RNA, 19 nt, Homo sapiens
cgucuaacccugugcaaca

SEQ ID NO: 79417 - RNA, 19 nt, Homo sapiens
gcccugagcaacuccauca

SEQ ID NO: 79418 - RNA, 19 nt, Homo sapiens
gcaagggaacaaguacuuc

SEQ ID NO: 79419 - RNA, 19 nt, Homo sapiens
ggaauaaucuccuguuaau

SEQ ID NO: 79420 - RNA, 19 nt, Homo sapiens
gaaauaagaaccacucaua

SEQ ID NO: 79421 - RNA, 19 nt, Homo sapiens
gcagaguucuauaauguaa

SEQ ID NO: 79422 - RNA, 19 nt, Homo sapiens
aaacugagauccuuccuuu

SEQ ID NO: 79423 - RNA, 19 nt, Homo sapiens
cuacauuacuucaaacuga

SEQ ID NO: 79424 - RNA, 19 nt, Homo sapiens
gaacgagggcuacuauuuc

SEQ ID NO: 79425 - RNA, 19 nt, Homo sapiens
guacuaugcuguuaugagu

SEQ ID NO: 79426 - RNA, 19 nt, Homo sapiens
gagcaucagugagguuaaa

SEQ ID NO: 79427 - RNA, 19 nt, Homo sapiens
gaagacguguuugcaaaug

SEQ ID NO: 79428 - RNA, 19 nt, Homo sapiens
gcaacuccaucauguacuu

SEQ ID NO: 79429 - RNA, 19 nt, Homo sapiens
ugaguggcuuuaaugaaua

SEQ ID NO: 79430 - RNA, 19 nt, Homo sapiens
guacauucuuccugauuau

SEQ ID NO: 79431 - RNA, 19 nt, Homo sapiens
gaaccacucauaauucuuc

SEQ ID NO: 79432 - RNA, 19 nt, Homo sapiens
uggcagaguucuauaaugu

SEQ ID NO: 79433 - RNA, 19 nt, Homo sapiens
ccgaagacguguuugcaaa

SEQ ID NO: 79434 - RNA, 19 nt, Homo sapiens
agagacagcuugaucaaag

SEQ ID NO: 79435 - RNA, 19 nt, Homo sapiens
gccacuacauuacuucaaa

SEQ ID NO: 79436 - RNA, 19 nt, Homo sapiens
aaacuaaggcccucuugaa

SEQ ID NO: 79437 - RNA, 19 nt, Homo sapiens
gaguggcuuuaaugaauaa

SEQ ID NO: 79438 - RNA, 19 nt, Homo sapiens
uguacauucuuccugauua

SEQ ID NO: 79439 - RNA, 19 nt, Homo sapiens
uaagaaccacucauaauuc

SEQ ID NO: 79440 - RNA, 19 nt, Homo sapiens
gaucaaaggcacacagcaa

SEQ ID NO: 79441 - RNA, 19 nt, Homo sapiens
ccacaagggucacaauacu

SEQ ID NO: 79442 - RNA, 19 nt, Homo sapiens
ggagacaagcccagccuuu

SEQ ID NO: 79443 - RNA, 19 nt, Homo sapiens
gagcaaguccuucccuuuc

SEQ ID NO: 79444 - RNA, 19 nt, Homo sapiens
ccucuugaaucucugaauu

SEQ ID NO: 79445 - RNA, 19 nt, Homo sapiens
cuaaggcccucuugaaucu

SEQ ID NO: 79446 - RNA, 19 nt, Homo sapiens
ucagugagguuaaacuaag

SEQ ID NO: 79447 - RNA, 19 nt, Homo sapiens
gaaaaugaaucccucuauc

SEQ ID NO: 79448 - RNA, 19 nt, Homo sapiens
gucauggccuuaccaguga

SEQ ID NO: 79449 - RNA, 19 nt, Homo sapiens
gaaucccucuaucucuaaa

SEQ ID NO: 79450 - RNA, 19 nt, Homo sapiens
ggagcaaguccuucccuuu

SEQ ID NO: 79451 - RNA, 19 nt, Homo sapiens
ugcaacagccacuacauua

SEQ ID NO: 79452 - RNA, 19 nt, Homo sapiens
agaacgagggcuacuauuu

SEQ ID NO: 79453 - RNA, 19 nt, Homo sapiens
ccacaccauucaggucuuu

SEQ ID NO: 79454 - RNA, 19 nt, Homo sapiens
gcaaguccuucccuuucau

SEQ ID NO: 79455 - RNA, 19 nt, Homo sapiens
aaacugcugucccaaacau

SEQ ID NO: 79456 - RNA, 19 nt, Homo sapiens
ccauucaggucuuucuuuc

SEQ ID NO: 79457 - RNA, 19 nt, Homo sapiens
guuaauaugguguacauuc

SEQ ID NO: 79458 - RNA, 19 nt, Homo sapiens
ccaaacugcugucccaaac

SEQ ID NO: 79459 - RNA, 19 nt, Homo sapiens
ggucaaaucgggagacaag

SEQ ID NO: 79460 - RNA, 19 nt, Homo sapiens
gggaaccgaagacguguuu

SEQ ID NO: 79461 - RNA, 19 nt, Homo sapiens
guagcauccucuuuaaugg

SEQ ID NO: 79462 - RNA, 19 nt, Homo sapiens
gcuuaacccuggaaaauga

SEQ ID NO: 79463 - RNA, 19 nt, Homo sapiens
gcgagacaguggagcugaa

SEQ ID NO: 79464 - RNA, 19 nt, Homo sapiens
agucaggguuggagcagua

SEQ ID NO: 79465 - RNA, 19 nt, Homo sapiens
gagcaacuccaucauguac

SEQ ID NO: 79466 - RNA, 19 nt, Homo sapiens
gcagaccugacucucuuaa

SEQ ID NO: 79467 - RNA, 19 nt, Homo sapiens
caucagugagguuaaacua

SEQ ID NO: 79468 - RNA, 19 nt, Homo sapiens
augaguggcuuuaaugaau

SEQ ID NO: 79469 - RNA, 19 nt, Homo sapiens
guuguacuaugcuguuaug

SEQ ID NO: 79470 - RNA, 19 nt, Homo sapiens
ggccgaagggcgcaacuuu

SEQ ID NO: 79471 - RNA, 19 nt, Homo sapiens
guuaugaguggcuuuaaug

SEQ ID NO: 79472 - RNA, 19 nt, Homo sapiens
ggguuguacuaugcuguua

SEQ ID NO: 79473 - RNA, 19 nt, Homo sapiens
ucauaauucuucaccuuag

SEQ ID NO: 79474 - RNA, 19 nt, Homo sapiens
acaugcacuuccuugcuua

SEQ ID NO: 79475 - RNA, 19 nt, Homo sapiens
aggcagaccugacucucuu

SEQ ID NO: 79476 - RNA, 19 nt, Homo sapiens
gugcaacagccacuacauu

SEQ ID NO: 79477 - RNA, 19 nt, Homo sapiens
acucauaauucuucaccuu

SEQ ID NO: 79478 - RNA, 19 nt, Homo sapiens
gccaggugcugcuguccaa

SEQ ID NO: 79479 - RNA, 19 nt, Homo sapiens
augaaucccucuaucucua

SEQ ID NO: 79480 - RNA, 19 nt, Homo sapiens
caacagccacuacauuacu

SEQ ID NO: 79481 - RNA, 19 nt, Homo sapiens
gagagaacgagggcuacua

SEQ ID NO: 79482 - RNA, 19 nt, Homo sapiens
uguagcauccucuuuaaug

SEQ ID NO: 79483 - RNA, 19 nt, Homo sapiens
cugagcaacuccaucaugu

SEQ ID NO: 79484 - RNA, 19 nt, Homo sapiens
gauaaggaaauaagaacca

SEQ ID NO: 79485 - RNA, 19 nt, Homo sapiens
ccuggccucugcucaacua

SEQ ID NO: 79486 - RNA, 19 nt, Homo sapiens
ucuugaaucucugaauuug

SEQ ID NO: 79487 - RNA, 19 nt, Homo sapiens
gaauuaaagaagagaacug

SEQ ID NO: 79488 - RNA, 19 nt, Homo sapiens
gagacaagcccagccuuuc

SEQ ID NO: 79489 - RNA, 19 nt, Homo sapiens
uuuguagcauccucuuuaa

SEQ ID NO: 79490 - RNA, 19 nt, Homo sapiens
gaccugacucucuuaagga

SEQ ID NO: 79491 - RNA, 19 nt, Homo sapiens
agaccugacucucuuaagg

SEQ ID NO: 79492 - RNA, 19 nt, Homo sapiens
uaaacuaaggcccucuuga

SEQ ID NO: 79493 - RNA, 19 nt, Homo sapiens
cccucuaucucuaaagaaa

SEQ ID NO: 79494 - RNA, 19 nt, Homo sapiens
caccacaagggucacaaua

SEQ ID NO: 79495 - RNA, 19 nt, Homo sapiens
gcuguuaugaguggcuuua

SEQ ID NO: 79496 - RNA, 19 nt, Homo sapiens
ggaaauaagaaccacucau

SEQ ID NO: 79497 - RNA, 19 nt, Homo sapiens
gcaacagccacuacauuac

SEQ ID NO: 79498 - RNA, 19 nt, Homo sapiens
aauaugguguacauucuuc

SEQ ID NO: 79499 - RNA, 19 nt, Homo sapiens
uaagguaugguacaagcaa

SEQ ID NO: 79500 - RNA, 19 nt, Homo sapiens
gcucuuuccuccacaccau

SEQ ID NO: 79501 - RNA, 19 nt, Homo sapiens
gagacagcuugaucaaagg

SEQ ID NO: 79502 - RNA, 19 nt, Homo sapiens
ccagagacagcuugaucaa

SEQ ID NO: 79503 - RNA, 19 nt, Homo sapiens
cauccucuuuaauggguaa

SEQ ID NO: 79504 - RNA, 19 nt, Homo sapiens
gagaacgagggcuacuauu

SEQ ID NO: 79505 - RNA, 19 nt, Homo sapiens
uugaaucucugaauuugag

SEQ ID NO: 79506 - RNA, 19 nt, Homo sapiens
ugaaucccucuaucucuaa

SEQ ID NO: 79507 - RNA, 19 nt, Homo sapiens
ggcagaguucuauaaugua

SEQ ID NO: 79508 - RNA, 19 nt, Homo sapiens
gaaccgaagacguguuugc

SEQ ID NO: 79509 - RNA, 19 nt, Homo sapiens
ggcaagggaacaaguacuu

SEQ ID NO: 79510 - RNA, 19 nt, Homo sapiens
aacaugcacuuccuugcuu

SEQ ID NO: 79511 - RNA, 19 nt, Homo sapiens
ggcuaccccuuuacaaaua

SEQ ID NO: 79512 - RNA, 19 nt, Homo sapiens
aaaaugaaguggugagcuu

SEQ ID NO: 79513 - RNA, 19 nt, Homo sapiens
ggaaacaaaacuagguaaa

SEQ ID NO: 79514 - RNA, 19 nt, Homo sapiens
cgucuaacccugugcaaca

SEQ ID NO: 79515 - RNA, 19 nt, Homo sapiens
cgaagacguguuugcaaau

SEQ ID NO: 79516 - RNA, 19 nt, Homo sapiens
agagaacgagggcuacuau

SEQ ID NO: 79517 - RNA, 19 nt, Homo sapiens
gcccugagcaacuccauca

SEQ ID NO: 79518 - RNA, 19 nt, Homo sapiens
gcaagggaacaaguacuuc

SEQ ID NO: 79519 - RNA, 19 nt, Homo sapiens
caaauaaagucccagguua

SEQ ID NO: 79520 - RNA, 19 nt, Homo sapiens
gaagagagugugccgguua

SEQ ID NO: 79521 - RNA, 19 nt, Homo sapiens
gauaggaguucacuucauc

SEQ ID NO: 79522 - RNA, 19 nt, Homo sapiens
gcaagccgguucauucuca

SEQ ID NO: 79523 - RNA, 19 nt, Homo sapiens
gcuaaaaucucccucagua

SEQ ID NO: 79524 - RNA, 19 nt, Homo sapiens
cagaagggcccacuuugua

SEQ ID NO: 79525 - RNA, 19 nt, Homo sapiens
gcucccauuucuacucuua

SEQ ID NO: 79526 - RNA, 19 nt, Homo sapiens
ggaguucacuucaucuucu

SEQ ID NO: 79527 - RNA, 19 nt, Homo sapiens
ggaagacaguggcaucuac

SEQ ID NO: 79528 - RNA, 19 nt, Homo sapiens
gcaaggccuuucugugugu

SEQ ID NO: 79529 - RNA, 19 nt, Homo sapiens
ggaaugaggcuugcugaga

SEQ ID NO: 79530 - RNA, 19 nt, Homo sapiens
ccauuuagccaccaucuuu

SEQ ID NO: 79531 - RNA, 19 nt, Homo sapiens
gccgggaacuugcggguuu

SEQ ID NO: 79532 - RNA, 19 nt, Homo sapiens
uaaagucccagguuaaaga

SEQ ID NO: 79533 - RNA, 19 nt, Homo sapiens
acauaaaggugcaaaccaa

SEQ ID NO: 79534 - RNA, 19 nt, Homo sapiens
gaggauaggaguucacuuc

SEQ ID NO: 79535 - RNA, 19 nt, Homo sapiens
gaugcaagccgguucauuc

SEQ ID NO: 79536 - RNA, 19 nt, Homo sapiens
ggagaagauagcuguguuu

SEQ ID NO: 79537 - RNA, 19 nt, Homo sapiens
aaauaaagucccagguuaa

SEQ ID NO: 79538 - RNA, 19 nt, Homo sapiens
ggauaggaguucacuucau

SEQ ID NO: 79539 - RNA, 19 nt, Homo sapiens
agucccagguuaaagauaa

SEQ ID NO: 79540 - RNA, 19 nt, Homo sapiens
ccagggcacuucacagagu

SEQ ID NO: 79541 - RNA, 19 nt, Homo sapiens
ucaguaacaugcgcaucua

SEQ ID NO: 79542 - RNA, 19 nt, Homo sapiens
gagaggggcuguccaguuc

SEQ ID NO: 79543 - RNA, 19 nt, Homo sapiens
gagagaagggacacauuca

SEQ ID NO: 79544 - RNA, 19 nt, Homo sapiens
acaaauaaagucccagguu

SEQ ID NO: 79545 - RNA, 19 nt, Homo sapiens
cuuuagugguggccauuua

SEQ ID NO: 79546 - RNA, 19 nt, Homo sapiens
agacaucggucaguaacga

SEQ ID NO: 79547 - RNA, 19 nt, Homo sapiens
gaaguccacccucaagaag

SEQ ID NO: 79548 - RNA, 19 nt, Homo sapiens
ggcaucuacuucugcauga

SEQ ID NO: 79549 - RNA, 19 nt, Homo sapiens
ccaacaagauggugaugcu

SEQ ID NO: 79550 - RNA, 19 nt, Homo sapiens
ccaguucccagaaggcaua

SEQ ID NO: 79551 - RNA, 19 nt, Homo sapiens
gcuggaggacugaguaaga

SEQ ID NO: 79552 - RNA, 19 nt, Homo sapiens
uaacgagcacgauguggaa

SEQ ID NO: 79553 - RNA, 19 nt, Homo sapiens
gagcagagaauacgguuuu

SEQ ID NO: 79554 - RNA, 19 nt, Homo sapiens
gagugugguugauuuccuu

SEQ ID NO: 79555 - RNA, 19 nt, Homo sapiens
cuagggagaagguuucauu

SEQ ID NO: 79556 - RNA, 19 nt, Homo sapiens
ccagaaggcauaucagucu

SEQ ID NO: 79557 - RNA, 19 nt, Homo sapiens
caucuuugcagguugcuuu

SEQ ID NO: 79558 - RNA, 19 nt, Homo sapiens
ccagaagggcccacuuugu

SEQ ID NO: 79559 - RNA, 19 nt, Homo sapiens
aauaaagucccagguuaaa

SEQ ID NO: 79560 - RNA, 19 nt, Homo sapiens
ccauuucuacucuuaaguu

SEQ ID NO: 79561 - RNA, 19 nt, Homo sapiens
cuucucagcucccauuucu

SEQ ID NO: 79562 - RNA, 19 nt, Homo sapiens
ggaggacugaguaagaaau

SEQ ID NO: 79563 - RNA, 19 nt, Homo sapiens
ggaauacuagggagaaggu

SEQ ID NO: 79564 - RNA, 19 nt, Homo sapiens
gagaagauagcuguguuuc

SEQ ID NO: 79565 - RNA, 19 nt, Homo sapiens
uaaaggugcaaaccaacaa

SEQ ID NO: 79566 - RNA, 19 nt, Homo sapiens
auucaacccuggagaguuc

SEQ ID NO: 79567 - RNA, 19 nt, Homo sapiens
uuacaaaugagcagagaau

SEQ ID NO: 79568 - RNA, 19 nt, Homo sapiens
caagaaguccacccucaag

SEQ ID NO: 79569 - RNA, 19 nt, Homo sapiens
gagaagggacacauucaac

SEQ ID NO: 79570 - RNA, 19 nt, Homo sapiens
ugagagaagggacacauuc

SEQ ID NO: 79571 - RNA, 19 nt, Homo sapiens
ucuacucucccauggcuua

SEQ ID NO: 79572 - RNA, 19 nt, Homo sapiens
cuggaggacugaguaagaa

SEQ ID NO: 79573 - RNA, 19 nt, Homo sapiens
agaaguccacccucaagaa

SEQ ID NO: 79574 - RNA, 19 nt, Homo sapiens
ccaagaaguccacccucaa

SEQ ID NO: 79575 - RNA, 19 nt, Homo sapiens
gguggaacaggagaagaua

SEQ ID NO: 79576 - RNA, 19 nt, Homo sapiens
ccgcgcagcugacaguucu

SEQ ID NO: 79577 - RNA, 19 nt, Homo sapiens
uuucucagcucccauuucu

SEQ ID NO: 79578 - RNA, 19 nt, Homo sapiens
gaggacugaguaagaaaug

SEQ ID NO: 79579 - RNA, 19 nt, Homo sapiens
cugcaaggccuuucugugu

SEQ ID NO: 79580 - RNA, 19 nt, Homo sapiens
aggagaagauagcuguguu

SEQ ID NO: 79581 - RNA, 19 nt, Homo sapiens
caucuucucagcucccauu

SEQ ID NO: 79582 - RNA, 19 nt, Homo sapiens
caaaugagcagagaauacg

SEQ ID NO: 79583 - RNA, 19 nt, Homo sapiens
caaaugucuuaguuguaca

SEQ ID NO: 79584 - RNA, 19 nt, Homo sapiens
ggugcaaaccaacaagaug

SEQ ID NO: 79585 - RNA, 19 nt, Homo sapiens
gccaccaucuuugcagguu

SEQ ID NO: 79586 - RNA, 19 nt, Homo sapiens
ggacuauccacggugaaga

SEQ ID NO: 79587 - RNA, 19 nt, Homo sapiens
gaagacaguggcaucuacu

SEQ ID NO: 79588 - RNA, 19 nt, Homo sapiens
gucccagguuaaagauaaa

SEQ ID NO: 79589 - RNA, 19 nt, Homo sapiens
cagcucccauuucuacucu

SEQ ID NO: 79590 - RNA, 19 nt, Homo sapiens
cagcucccauuucuacucu

SEQ ID NO: 79591 - RNA, 19 nt, Homo sapiens
guaacaugcgcaucuacug

SEQ ID NO: 79592 - RNA, 19 nt, Homo sapiens
acaaaugagcagagaauac

SEQ ID NO: 79593 - RNA, 19 nt, Homo sapiens
gacaguggcaucuacuucu

SEQ ID NO: 79594 - RNA, 19 nt, Homo sapiens
gcgcaucuacuggcugaga

SEQ ID NO: 79595 - RNA, 19 nt, Homo sapiens
caagccgguucauucucaa

SEQ ID NO: 79596 - RNA, 19 nt, Homo sapiens
ggaugcaagccgguucauu

SEQ ID NO: 79597 - RNA, 19 nt, Homo sapiens
gcaucuacuucugcaugau

SEQ ID NO: 79598 - RNA, 19 nt, Homo sapiens
acucucccauggcuuaaug

SEQ ID NO: 79599 - RNA, 19 nt, Homo sapiens
ucucagcucccauuucuac

SEQ ID NO: 79600 - RNA, 19 nt, Homo sapiens
ucucagcucccauuucuac

SEQ ID NO: 79601 - RNA, 19 nt, Homo sapiens
gcaugggagcaacuuguuc

SEQ ID NO: 79602 - RNA, 19 nt, Homo sapiens
ccucugggauuccgcaaaa

SEQ ID NO: 79603 - RNA, 19 nt, Homo sapiens
cagcugagugugguugauu

SEQ ID NO: 79604 - RNA, 19 nt, Homo sapiens
acaguggcaucuacuucug

SEQ ID NO: 79605 - RNA, 19 nt, Homo sapiens
ucucugagggcuuccuuug

SEQ ID NO: 79606 - RNA, 19 nt, Homo sapiens
ugguagggcaguaacauug

SEQ ID NO: 79607 - RNA, 19 nt, Homo sapiens
ugaacugggaccuuuagug

SEQ ID NO: 79608 - RNA, 19 nt, Homo sapiens
ggacugaguaagaaaugcu

SEQ ID NO: 79609 - RNA, 19 nt, Homo sapiens
agagaagggacacauucaa

SEQ ID NO: 79610 - RNA, 19 nt, Homo sapiens
ucaguaacgagcacgaugu

SEQ ID NO: 79611 - RNA, 19 nt, Homo sapiens
caaauaaagucccagguua

SEQ ID NO: 79612 - RNA, 19 nt, Homo sapiens
gaagagagugugccgguua

SEQ ID NO: 79613 - RNA, 19 nt, Homo sapiens
gauaggaguucacuucauc

SEQ ID NO: 79614 - RNA, 19 nt, Homo sapiens
caauaucguuugccugaaa

SEQ ID NO: 79615 - RNA, 19 nt, Homo sapiens
gcaagccgguucauucuca

SEQ ID NO: 79616 - RNA, 19 nt, Homo sapiens
gcuaaaaucucccucagua

SEQ ID NO: 79617 - RNA, 19 nt, Homo sapiens
cagaagggcccacuuugua

SEQ ID NO: 79618 - RNA, 19 nt, Homo sapiens
gcucccauuucuacucuua

SEQ ID NO: 79619 - RNA, 19 nt, Homo sapiens
gaaauucaauaucguuugc

SEQ ID NO: 79620 - RNA, 19 nt, Homo sapiens
ggaguucacuucaucuucu

SEQ ID NO: 79621 - RNA, 19 nt, Homo sapiens
ggaagacaguggcaucuac

SEQ ID NO: 79622 - RNA, 19 nt, Homo sapiens
gcaaggccuuucugugugu

SEQ ID NO: 79623 - RNA, 19 nt, Homo sapiens
ggaaugaggcuugcugaga

SEQ ID NO: 79624 - RNA, 19 nt, Homo sapiens
ccauuuagccaccaucuuu

SEQ ID NO: 79625 - RNA, 19 nt, Homo sapiens
gccgggaacuugcggguuu

SEQ ID NO: 79626 - RNA, 19 nt, Homo sapiens
uaaagucccagguuaaaga

SEQ ID NO: 79627 - RNA, 19 nt, Homo sapiens
gaggauaggaguucacuuc

SEQ ID NO: 79628 - RNA, 19 nt, Homo sapiens
acauaaaggugcaaaccaa

SEQ ID NO: 79629 - RNA, 19 nt, Homo sapiens
gaugcaagccgguucauuc

SEQ ID NO: 79630 - RNA, 19 nt, Homo sapiens
ggagaagauagcuguguuu

SEQ ID NO: 79631 - RNA, 19 nt, Homo sapiens
aaauaaagucccagguuaa

SEQ ID NO: 79632 - RNA, 19 nt, Homo sapiens
ggauaggaguucacuucau

SEQ ID NO: 79633 - RNA, 19 nt, Homo sapiens
agucccagguuaaagauaa

SEQ ID NO: 79634 - RNA, 19 nt, Homo sapiens
ccagggcacuucacagagu

SEQ ID NO: 79635 - RNA, 19 nt, Homo sapiens
ucaguaacaugcgcaucua

SEQ ID NO: 79636 - RNA, 19 nt, Homo sapiens
gagaggggcuguccaguuc

SEQ ID NO: 79637 - RNA, 19 nt, Homo sapiens
gagagaagggacacauuca

SEQ ID NO: 79638 - RNA, 19 nt, Homo sapiens
acaaauaaagucccagguu

SEQ ID NO: 79639 - RNA, 19 nt, Homo sapiens
cuuuagugguggccauuua

SEQ ID NO: 79640 - RNA, 19 nt, Homo sapiens
agacaucggucaguaacga

SEQ ID NO: 79641 - RNA, 19 nt, Homo sapiens
gaaguccacccucaagaag

SEQ ID NO: 79642 - RNA, 19 nt, Homo sapiens
ggcaucuacuucugcauga

SEQ ID NO: 79643 - RNA, 19 nt, Homo sapiens
ccaacaagauggugaugcu

SEQ ID NO: 79644 - RNA, 19 nt, Homo sapiens
ccaguucccagaaggcaua

SEQ ID NO: 79645 - RNA, 19 nt, Homo sapiens
gcuggaggacugaguaaga

SEQ ID NO: 79646 - RNA, 19 nt, Homo sapiens
uaacgagcacgauguggaa

SEQ ID NO: 79647 - RNA, 19 nt, Homo sapiens
gagcagagaauacgguuuu

SEQ ID NO: 79648 - RNA, 19 nt, Homo sapiens
gagugugguugauuuccuu

SEQ ID NO: 79649 - RNA, 19 nt, Homo sapiens
cuagggagaagguuucauu

SEQ ID NO: 79650 - RNA, 19 nt, Homo sapiens
ccagaaggcauaucagucu

SEQ ID NO: 79651 - RNA, 19 nt, Homo sapiens
caucuuugcagguugcuuu

SEQ ID NO: 79652 - RNA, 19 nt, Homo sapiens
ccagaagggcccacuuugu

SEQ ID NO: 79653 - RNA, 19 nt, Homo sapiens
aauaaagucccagguuaaa

SEQ ID NO: 79654 - RNA, 19 nt, Homo sapiens
ccauuucuacucuuaaguu

SEQ ID NO: 79655 - RNA, 19 nt, Homo sapiens
cuucucagcucccauuucu

SEQ ID NO: 79656 - RNA, 19 nt, Homo sapiens
ggaggacugaguaagaaau

SEQ ID NO: 79657 - RNA, 19 nt, Homo sapiens
ggaauacuagggagaaggu

SEQ ID NO: 79658 - RNA, 19 nt, Homo sapiens
gagaagauagcuguguuuc

SEQ ID NO: 79659 - RNA, 19 nt, Homo sapiens
uaaaggugcaaaccaacaa

SEQ ID NO: 79660 - RNA, 19 nt, Homo sapiens
auucaacccuggagaguuc

SEQ ID NO: 79661 - RNA, 19 nt, Homo sapiens
uuacaaaugagcagagaau

SEQ ID NO: 79662 - RNA, 19 nt, Homo sapiens
caagaaguccacccucaag

SEQ ID NO: 79663 - RNA, 19 nt, Homo sapiens
gagaagggacacauucaac

SEQ ID NO: 79664 - RNA, 19 nt, Homo sapiens
ugagagaagggacacauuc

SEQ ID NO: 79665 - RNA, 19 nt, Homo sapiens
ucuacucucccauggcuua

SEQ ID NO: 79666 - RNA, 19 nt, Homo sapiens
cuggaggacugaguaagaa

SEQ ID NO: 79667 - RNA, 19 nt, Homo sapiens
agaaguccacccucaagaa

SEQ ID NO: 79668 - RNA, 19 nt, Homo sapiens
ccaagaaguccacccucaa

SEQ ID NO: 79669 - RNA, 19 nt, Homo sapiens
gguggaacaggagaagaua

SEQ ID NO: 79670 - RNA, 19 nt, Homo sapiens
ccgcgcagcugacaguucu

SEQ ID NO: 79671 - RNA, 19 nt, Homo sapiens
uuucucagcucccauuucu

SEQ ID NO: 79672 - RNA, 19 nt, Homo sapiens
gaggacugaguaagaaaug

SEQ ID NO: 79673 - RNA, 19 nt, Homo sapiens
cugcaaggccuuucugugu

SEQ ID NO: 79674 - RNA, 19 nt, Homo sapiens
aggagaagauagcuguguu

SEQ ID NO: 79675 - RNA, 19 nt, Homo sapiens
caucuucucagcucccauu

SEQ ID NO: 79676 - RNA, 19 nt, Homo sapiens
caaaugagcagagaauacg

SEQ ID NO: 79677 - RNA, 19 nt, Homo sapiens
aauaagugguuucacaacu

SEQ ID NO: 79678 - RNA, 19 nt, Homo sapiens
caaaugucuuaguuguaca

SEQ ID NO: 79679 - RNA, 19 nt, Homo sapiens
gccaccaucuuugcagguu

SEQ ID NO: 79680 - RNA, 19 nt, Homo sapiens
gcuguuguuuucagauuuu

SEQ ID NO: 79681 - RNA, 19 nt, Homo sapiens
ggugcaaaccaacaagaug

SEQ ID NO: 79682 - RNA, 19 nt, Homo sapiens
ggacuauccacggugaaga

SEQ ID NO: 79683 - RNA, 19 nt, Homo sapiens
gaagacaguggcaucuacu

SEQ ID NO: 79684 - RNA, 19 nt, Homo sapiens
gucccagguuaaagauaaa

SEQ ID NO: 79685 - RNA, 19 nt, Homo sapiens
cagcucccauuucuacucu

SEQ ID NO: 79686 - RNA, 19 nt, Homo sapiens
cagcucccauuucuacucu

SEQ ID NO: 79687 - RNA, 19 nt, Homo sapiens
guaacaugcgcaucuacug

SEQ ID NO: 79688 - RNA, 19 nt, Homo sapiens
acaaaugagcagagaauac

SEQ ID NO: 79689 - RNA, 19 nt, Homo sapiens
gacaguggcaucuacuucu

SEQ ID NO: 79690 - RNA, 19 nt, Homo sapiens
gcgcaucuacuggcugaga

SEQ ID NO: 79691 - RNA, 19 nt, Homo sapiens
ucaauaucguuugccugaa

SEQ ID NO: 79692 - RNA, 19 nt, Homo sapiens
ggaugcaagccgguucauu

SEQ ID NO: 79693 - RNA, 19 nt, Homo sapiens
caagccgguucauucucaa

SEQ ID NO: 79694 - RNA, 19 nt, Homo sapiens
gcaucuacuucugcaugau

SEQ ID NO: 79695 - RNA, 19 nt, Homo sapiens
acucucccauggcuuaaug

SEQ ID NO: 79696 - RNA, 19 nt, Homo sapiens
ucucagcucccauuucuac

SEQ ID NO: 79697 - RNA, 19 nt, Homo sapiens
ucucagcucccauuucuac

SEQ ID NO: 79698 - RNA, 19 nt, Homo sapiens
gcaugggagcaacuuguuc

SEQ ID NO: 79699 - RNA, 19 nt, Homo sapiens
cagcugagugugguugauu

SEQ ID NO: 79700 - RNA, 19 nt, Homo sapiens
acaguggcaucuacuucug

SEQ ID NO: 79701 - RNA, 19 nt, Homo sapiens
ccucugggauuccgcaaaa

SEQ ID NO: 79702 - RNA, 19 nt, Homo sapiens
ucucugagggcuuccuuug

SEQ ID NO: 79703 - RNA, 19 nt, Homo sapiens
ugguagggcaguaacauug

SEQ ID NO: 79704 - RNA, 19 nt, Homo sapiens
ugaacugggaccuuuagug

SEQ ID NO: 79705 - RNA, 19 nt, Homo sapiens
ggacugaguaagaaaugcu

SEQ ID NO: 79706 - RNA, 19 nt, Homo sapiens
agagaagggacacauucaa

SEQ ID NO: 79707 - RNA, 19 nt, Homo sapiens
ucaguaacgagcacgaugu

SEQ ID NO: 79708 - RNA, 19 nt, Homo sapiens
aaacaaaggucuucagauu

SEQ ID NO: 79709 - RNA, 19 nt, Homo sapiens
gaaacaaccugccaccaaa

SEQ ID NO: 79710 - RNA, 19 nt, Homo sapiens
gaagcaaucugcccauuca

SEQ ID NO: 79711 - RNA, 19 nt, Homo sapiens
gaagagagugugccgguua

SEQ ID NO: 79712 - RNA, 19 nt, Homo sapiens
acaaaggucuucagauuuc

SEQ ID NO: 79713 - RNA, 19 nt, Homo sapiens
gcacuaaauucgagaagca

SEQ ID NO: 79714 - RNA, 19 nt, Homo sapiens
gaagggcagacuacaauaa

SEQ ID NO: 79715 - RNA, 19 nt, Homo sapiens
gcaagccgguucauucuca

SEQ ID NO: 79716 - RNA, 19 nt, Homo sapiens
gcuaaaaucucccucagua

SEQ ID NO: 79717 - RNA, 19 nt, Homo sapiens
cuucagauuucuugcauaa

SEQ ID NO: 79718 - RNA, 19 nt, Homo sapiens
caauagagccacuaagaug

SEQ ID NO: 79719 - RNA, 19 nt, Homo sapiens
ggaagacaguggcaucuac

SEQ ID NO: 79720 - RNA, 19 nt, Homo sapiens
gagaagcaaucugcccauu

SEQ ID NO: 79721 - RNA, 19 nt, Homo sapiens
gcccauucaucuucaugua

SEQ ID NO: 79722 - RNA, 19 nt, Homo sapiens
acauaaaggugcaaaccaa

SEQ ID NO: 79723 - RNA, 19 nt, Homo sapiens
gaugcaagccgguucauuc

SEQ ID NO: 79724 - RNA, 19 nt, Homo sapiens
ggagaagauagcuguguuu

SEQ ID NO: 79725 - RNA, 19 nt, Homo sapiens
gcaaacucagucauacuuu

SEQ ID NO: 79726 - RNA, 19 nt, Homo sapiens
ggagaacccggcaacauca

SEQ ID NO: 79727 - RNA, 19 nt, Homo sapiens
aagaaccgguugugugcua

SEQ ID NO: 79728 - RNA, 19 nt, Homo sapiens
ucaguaacaugcgcaucua

SEQ ID NO: 79729 - RNA, 19 nt, Homo sapiens
uacaauagagccacuaaga

SEQ ID NO: 79730 - RNA, 19 nt, Homo sapiens
cagaagggcagacuacaau

SEQ ID NO: 79731 - RNA, 19 nt, Homo sapiens
gacggcaaacucagucaua

SEQ ID NO: 79732 - RNA, 19 nt, Homo sapiens
gggaagaccccaaguugua

SEQ ID NO: 79733 - RNA, 19 nt, Homo sapiens
gaaguccacccucaagaag

SEQ ID NO: 79734 - RNA, 19 nt, Homo sapiens
ggcaucuacuucugcauga

SEQ ID NO: 79735 - RNA, 19 nt, Homo sapiens
caaacucagucauacuuuu

SEQ ID NO: 79736 - RNA, 19 nt, Homo sapiens
uguaaggacagcugaauga

SEQ ID NO: 79737 - RNA, 19 nt, Homo sapiens
gagugugguugauuuccuu

SEQ ID NO: 79738 - RNA, 19 nt, Homo sapiens
ccaacaagauggugaugcu

SEQ ID NO: 79739 - RNA, 19 nt, Homo sapiens
ccauucaucuucauguaag

SEQ ID NO: 79740 - RNA, 19 nt, Homo sapiens
gcaaucugcccauucaucu

SEQ ID NO: 79741 - RNA, 19 nt, Homo sapiens
ggcaacaucaguuuaaaca

SEQ ID NO: 79742 - RNA, 19 nt, Homo sapiens
gaacccggcaacaucaguu

SEQ ID NO: 79743 - RNA, 19 nt, Homo sapiens
agaaacaaccugccaccaa

SEQ ID NO: 79744 - RNA, 19 nt, Homo sapiens
ggcaaacucagucauacuu

SEQ ID NO: 79745 - RNA, 19 nt, Homo sapiens
aacaaaggucuucagauuu

SEQ ID NO: 79746 - RNA, 19 nt, Homo sapiens
gagaagauagcuguguuuc

SEQ ID NO: 79747 - RNA, 19 nt, Homo sapiens
ccagaagggcagacuacaa

SEQ ID NO: 79748 - RNA, 19 nt, Homo sapiens
caagaaguccacccucaag

SEQ ID NO: 79749 - RNA, 19 nt, Homo sapiens
uaaaggugcaaaccaacaa

SEQ ID NO: 79750 - RNA, 19 nt, Homo sapiens
aaaggcaaauacaauagag

SEQ ID NO: 79751 - RNA, 19 nt, Homo sapiens
gaaugacggcaaacucagu

SEQ ID NO: 79752 - RNA, 19 nt, Homo sapiens
gcaacaucaguuuaaacaa

SEQ ID NO: 79753 - RNA, 19 nt, Homo sapiens
agaaguccacccucaagaa

SEQ ID NO: 79754 - RNA, 19 nt, Homo sapiens
ccaagaaguccacccucaa

SEQ ID NO: 79755 - RNA, 19 nt, Homo sapiens
gguggaacaggagaagaua

SEQ ID NO: 79756 - RNA, 19 nt, Homo sapiens
ccgcgcagcugacaguucu

SEQ ID NO: 79757 - RNA, 19 nt, Homo sapiens
aauagagccacuaagauga

SEQ ID NO: 79758 - RNA, 19 nt, Homo sapiens
aggagaagauagcuguguu

SEQ ID NO: 79759 - RNA, 19 nt, Homo sapiens
gugcuacggcuguggagaa

SEQ ID NO: 79760 - RNA, 19 nt, Homo sapiens
ggugcaaaccaacaagaug

SEQ ID NO: 79761 - RNA, 19 nt, Homo sapiens
aagggcagacuacaauaaa

SEQ ID NO: 79762 - RNA, 19 nt, Homo sapiens
acagcugaaugacggcaaa

SEQ ID NO: 79763 - RNA, 19 nt, Homo sapiens
acaauagagccacuaagau

SEQ ID NO: 79764 - RNA, 19 nt, Homo sapiens
agaagggcagacuacaaua

SEQ ID NO: 79765 - RNA, 19 nt, Homo sapiens
gaagacaguggcaucuacu

SEQ ID NO: 79766 - RNA, 19 nt, Homo sapiens
ggacuauccacggugaaga

SEQ ID NO: 79767 - RNA, 19 nt, Homo sapiens
ccagugauagaaagaaaca

SEQ ID NO: 79768 - RNA, 19 nt, Homo sapiens
ccggcaacaucaguuuaaa

SEQ ID NO: 79769 - RNA, 19 nt, Homo sapiens
gacaguggcaucuacuucu

SEQ ID NO: 79770 - RNA, 19 nt, Homo sapiens
guaacaugcgcaucuacug

SEQ ID NO: 79771 - RNA, 19 nt, Homo sapiens
uaagaugagggcgcaagaa

SEQ ID NO: 79772 - RNA, 19 nt, Homo sapiens
gcgcaucuacuggcugaga

SEQ ID NO: 79773 - RNA, 19 nt, Homo sapiens
caagccgguucauucucaa

SEQ ID NO: 79774 - RNA, 19 nt, Homo sapiens
ggaugcaagccgguucauu

SEQ ID NO: 79775 - RNA, 19 nt, Homo sapiens
caaaggucuucagauuucu

SEQ ID NO: 79776 - RNA, 19 nt, Homo sapiens
cauccuagcacuaaauucg

SEQ ID NO: 79777 - RNA, 19 nt, Homo sapiens
gcaucuacuucugcaugau

SEQ ID NO: 79778 - RNA, 19 nt, Homo sapiens
cagcugagugugguugauu

SEQ ID NO: 79779 - RNA, 19 nt, Homo sapiens
acaguggcaucuacuucug

SEQ ID NO: 79780 - RNA, 19 nt, Homo sapiens
ccucugggauuccgcaaaa

SEQ ID NO: 79781 - RNA, 19 nt, Homo sapiens
cccauucaucuucauguaa

SEQ ID NO: 79782 - RNA, 19 nt, Homo sapiens
uggagaacccggcaacauc

SEQ ID NO: 79783 - RNA, 19 nt, Homo sapiens
ggagaaauguuccagaaug

SEQ ID NO: 79784 - RNA, 19 nt, Homo sapiens
gaagagagugugccgguua

SEQ ID NO: 79785 - RNA, 19 nt, Homo sapiens
ccaaauguauccaucuuga

SEQ ID NO: 79786 - RNA, 19 nt, Homo sapiens
gaguggaucuuuacuacuu

SEQ ID NO: 79787 - RNA, 19 nt, Homo sapiens
cagaauggacuacugaaua

SEQ ID NO: 79788 - RNA, 19 nt, Homo sapiens
gcaagccgguucauucuca

SEQ ID NO: 79789 - RNA, 19 nt, Homo sapiens
gcuaaaaucucccucagua

SEQ ID NO: 79790 - RNA, 19 nt, Homo sapiens
agaauggacuacugaauau

SEQ ID NO: 79791 - RNA, 19 nt, Homo sapiens
cagaagggcccacuuugua

SEQ ID NO: 79792 - RNA, 19 nt, Homo sapiens
ccugaugaguggaucuuua

SEQ ID NO: 79793 - RNA, 19 nt, Homo sapiens
ggaagacaguggcaucuac

SEQ ID NO: 79794 - RNA, 19 nt, Homo sapiens
gagaaauguuccagaaugg

SEQ ID NO: 79795 - RNA, 19 nt, Homo sapiens
acauaaaggugcaaaccaa

SEQ ID NO: 79796 - RNA, 19 nt, Homo sapiens
gaugcaagccgguucauuc

SEQ ID NO: 79797 - RNA, 19 nt, Homo sapiens
cauggauacuacagcaaua

SEQ ID NO: 79798 - RNA, 19 nt, Homo sapiens
ggagaagauagcuguguuu

SEQ ID NO: 79799 - RNA, 19 nt, Homo sapiens
gaugaguggaucuuuacua

SEQ ID NO: 79800 - RNA, 19 nt, Homo sapiens
gaauggacuacugaauaua

SEQ ID NO: 79801 - RNA, 19 nt, Homo sapiens
ucaguaacaugcgcaucua

SEQ ID NO: 79802 - RNA, 19 nt, Homo sapiens
gaaguccacccucaagaag

SEQ ID NO: 79803 - RNA, 19 nt, Homo sapiens
ggcaucuacuucugcauga

SEQ ID NO: 79804 - RNA, 19 nt, Homo sapiens
gagugugguugauuuccuu

SEQ ID NO: 79805 - RNA, 19 nt, Homo sapiens
ccaacaagauggugaugcu

SEQ ID NO: 79806 - RNA, 19 nt, Homo sapiens
ggauacuacagcaauacua

SEQ ID NO: 79807 - RNA, 19 nt, Homo sapiens
gaaccaaauguauccaucu

SEQ ID NO: 79808 - RNA, 19 nt, Homo sapiens
gcaauacuacaaccucaca

SEQ ID NO: 79809 - RNA, 19 nt, Homo sapiens
gcauggauacuacagcaau

SEQ ID NO: 79810 - RNA, 19 nt, Homo sapiens
ccagaagggcccacuuugu

SEQ ID NO: 79811 - RNA, 19 nt, Homo sapiens
gagaagauagcuguguuuc

SEQ ID NO: 79812 - RNA, 19 nt, Homo sapiens
caaauguauccaucuugaa

SEQ ID NO: 79813 - RNA, 19 nt, Homo sapiens
caagaaguccacccucaag

SEQ ID NO: 79814 - RNA, 19 nt, Homo sapiens
uaaaggugcaaaccaacaa

SEQ ID NO: 79815 - RNA, 19 nt, Homo sapiens
aaccaaauguauccaucuu

SEQ ID NO: 79816 - RNA, 19 nt, Homo sapiens
aaagggaaccauugagcuu

SEQ ID NO: 79817 - RNA, 19 nt, Homo sapiens
agaaguccacccucaagaa

SEQ ID NO: 79818 - RNA, 19 nt, Homo sapiens
ccaagaaguccacccucaa

SEQ ID NO: 79819 - RNA, 19 nt, Homo sapiens
gguggaacaggagaagaua

SEQ ID NO: 79820 - RNA, 19 nt, Homo sapiens
cauggauccugaaaacaua

SEQ ID NO: 79821 - RNA, 19 nt, Homo sapiens
gauacuacagcaauacuac

SEQ ID NO: 79822 - RNA, 19 nt, Homo sapiens
ccgcgcagcugacaguucu

SEQ ID NO: 79823 - RNA, 19 nt, Homo sapiens
aggagaagauagcuguguu

SEQ ID NO: 79824 - RNA, 19 nt, Homo sapiens
ggugcaaaccaacaagaug

SEQ ID NO: 79825 - RNA, 19 nt, Homo sapiens
gaagacaguggcaucuacu

SEQ ID NO: 79826 - RNA, 19 nt, Homo sapiens
ggacuauccacggugaaga

SEQ ID NO: 79827 - RNA, 19 nt, Homo sapiens
guaacaugcgcaucuacug

SEQ ID NO: 79828 - RNA, 19 nt, Homo sapiens
ccagaauggacuacugaau

SEQ ID NO: 79829 - RNA, 19 nt, Homo sapiens
gacaguggcaucuacuucu

SEQ ID NO: 79830 - RNA, 19 nt, Homo sapiens
gcgcaucuacuggcugaga

SEQ ID NO: 79831 - RNA, 19 nt, Homo sapiens
caagccgguucauucucaa

SEQ ID NO: 79832 - RNA, 19 nt, Homo sapiens
ggaugcaagccgguucauu

SEQ ID NO: 79833 - RNA, 19 nt, Homo sapiens
gcaucuacuucugcaugau

SEQ ID NO: 79834 - RNA, 19 nt, Homo sapiens
ccucugggauuccgcaaaa

SEQ ID NO: 79835 - RNA, 19 nt, Homo sapiens
cagcugagugugguugauu

SEQ ID NO: 79836 - RNA, 19 nt, Homo sapiens
acaguggcaucuacuucug

SEQ ID NO: 79837 - RNA, 19 nt, Homo sapiens
gggaaaagggaaccauuga

SEQ ID NO: 79838 - RNA, 19 nt, Homo sapiens
uaacccauggauccugaaa

SEQ ID NO: 79839 - RNA, 19 nt, Homo sapiens
auacuacaaccucacagaa

SEQ ID NO: 79840 - RNA, 19 nt, Homo sapiens
gaagagagugugccgguua

SEQ ID NO: 79841 - RNA, 19 nt, Homo sapiens
ccaaauguauccaucuuga

SEQ ID NO: 79842 - RNA, 19 nt, Homo sapiens
gaguggaucuuuacuacuu

SEQ ID NO: 79843 - RNA, 19 nt, Homo sapiens
gcaagccgguucauucuca

SEQ ID NO: 79844 - RNA, 19 nt, Homo sapiens
gcuaaaaucucccucagua

SEQ ID NO: 79845 - RNA, 19 nt, Homo sapiens
ccugaugaguggaucuuua

SEQ ID NO: 79846 - RNA, 19 nt, Homo sapiens
ggaagacaguggcaucuac

SEQ ID NO: 79847 - RNA, 19 nt, Homo sapiens
acauaaaggugcaaaccaa

SEQ ID NO: 79848 - RNA, 19 nt, Homo sapiens
gaugcaagccgguucauuc

SEQ ID NO: 79849 - RNA, 19 nt, Homo sapiens
cauggauacuacagcaaua

SEQ ID NO: 79850 - RNA, 19 nt, Homo sapiens
ggagaagauagcuguguuu

SEQ ID NO: 79851 - RNA, 19 nt, Homo sapiens
gaugaguggaucuuuacua

SEQ ID NO: 79852 - RNA, 19 nt, Homo sapiens
ucaguaacaugcgcaucua

SEQ ID NO: 79853 - RNA, 19 nt, Homo sapiens
gaaguccacccucaagaag

SEQ ID NO: 79854 - RNA, 19 nt, Homo sapiens
ggcaucuacuucugcauga

SEQ ID NO: 79855 - RNA, 19 nt, Homo sapiens
gagugugguugauuuccuu

SEQ ID NO: 79856 - RNA, 19 nt, Homo sapiens
ccaacaagauggugaugcu

SEQ ID NO: 79857 - RNA, 19 nt, Homo sapiens
ggauacuacagcaauacua

SEQ ID NO: 79858 - RNA, 19 nt, Homo sapiens
gaaccaaauguauccaucu

SEQ ID NO: 79859 - RNA, 19 nt, Homo sapiens
gcaauacuacaaccucaca

SEQ ID NO: 79860 - RNA, 19 nt, Homo sapiens
gcauggauacuacagcaau

SEQ ID NO: 79861 - RNA, 19 nt, Homo sapiens
gagaagauagcuguguuuc

SEQ ID NO: 79862 - RNA, 19 nt, Homo sapiens
caaauguauccaucuugaa

SEQ ID NO: 79863 - RNA, 19 nt, Homo sapiens
caagaaguccacccucaag

SEQ ID NO: 79864 - RNA, 19 nt, Homo sapiens
uaaaggugcaaaccaacaa

SEQ ID NO: 79865 - RNA, 19 nt, Homo sapiens
aaccaaauguauccaucuu

SEQ ID NO: 79866 - RNA, 19 nt, Homo sapiens
agaaguccacccucaagaa

SEQ ID NO: 79867 - RNA, 19 nt, Homo sapiens
ccaagaaguccacccucaa

SEQ ID NO: 79868 - RNA, 19 nt, Homo sapiens
gguggaacaggagaagaua

SEQ ID NO: 79869 - RNA, 19 nt, Homo sapiens
cauggauccugaaaacaua

SEQ ID NO: 79870 - RNA, 19 nt, Homo sapiens
gauacuacagcaauacuac

SEQ ID NO: 79871 - RNA, 19 nt, Homo sapiens
ccgcgcagcugacaguucu

SEQ ID NO: 79872 - RNA, 19 nt, Homo sapiens
aggagaagauagcuguguu

SEQ ID NO: 79873 - RNA, 19 nt, Homo sapiens
ggugcaaaccaacaagaug

SEQ ID NO: 79874 - RNA, 19 nt, Homo sapiens
gaagacaguggcaucuacu

SEQ ID NO: 79875 - RNA, 19 nt, Homo sapiens
ggacuauccacggugaaga

SEQ ID NO: 79876 - RNA, 19 nt, Homo sapiens
gacaguggcaucuacuucu

SEQ ID NO: 79877 - RNA, 19 nt, Homo sapiens
guaacaugcgcaucuacug

SEQ ID NO: 79878 - RNA, 19 nt, Homo sapiens
caagccgguucauucucaa

SEQ ID NO: 79879 - RNA, 19 nt, Homo sapiens
ggaugcaagccgguucauu

SEQ ID NO: 79880 - RNA, 19 nt, Homo sapiens
gcgcaucuacuggcugaga

SEQ ID NO: 79881 - RNA, 19 nt, Homo sapiens
gcaucuacuucugcaugau

SEQ ID NO: 79882 - RNA, 19 nt, Homo sapiens
cagcugagugugguugauu

SEQ ID NO: 79883 - RNA, 19 nt, Homo sapiens
acaguggcaucuacuucug

SEQ ID NO: 79884 - RNA, 19 nt, Homo sapiens
ccucugggauuccgcaaaa

SEQ ID NO: 79885 - RNA, 19 nt, Homo sapiens
uaacccauggauccugaaa

SEQ ID NO: 79886 - RNA, 19 nt, Homo sapiens
auacuacaaccucacagaa

SEQ ID NO: 79887 - RNA, 19 nt, Homo sapiens
gaagagagugugccgguua

SEQ ID NO: 79888 - RNA, 19 nt, Homo sapiens
ccaaauguauccaucuuga

SEQ ID NO: 79889 - RNA, 19 nt, Homo sapiens
gaguggaucuuuacuacuu

SEQ ID NO: 79890 - RNA, 19 nt, Homo sapiens
gcaagccgguucauucuca

SEQ ID NO: 79891 - RNA, 19 nt, Homo sapiens
gcuaaaaucucccucagua

SEQ ID NO: 79892 - RNA, 19 nt, Homo sapiens
cagaagggcccacuuugua

SEQ ID NO: 79893 - RNA, 19 nt, Homo sapiens
ccugaugaguggaucuuua

SEQ ID NO: 79894 - RNA, 19 nt, Homo sapiens
ggaagacaguggcaucuac

SEQ ID NO: 79895 - RNA, 19 nt, Homo sapiens
acauaaaggugcaaaccaa

SEQ ID NO: 79896 - RNA, 19 nt, Homo sapiens
gaugcaagccgguucauuc

SEQ ID NO: 79897 - RNA, 19 nt, Homo sapiens
cauggauacuacagcaaua

SEQ ID NO: 79898 - RNA, 19 nt, Homo sapiens
ggagaagauagcuguguuu

SEQ ID NO: 79899 - RNA, 19 nt, Homo sapiens
gaugaguggaucuuuacua

SEQ ID NO: 79900 - RNA, 19 nt, Homo sapiens
ucaguaacaugcgcaucua

SEQ ID NO: 79901 - RNA, 19 nt, Homo sapiens
gaaguccacccucaagaag

SEQ ID NO: 79902 - RNA, 19 nt, Homo sapiens
ggcaucuacuucugcauga

SEQ ID NO: 79903 - RNA, 19 nt, Homo sapiens
gagugugguugauuuccuu

SEQ ID NO: 79904 - RNA, 19 nt, Homo sapiens
ccaacaagauggugaugcu

SEQ ID NO: 79905 - RNA, 19 nt, Homo sapiens
ggauacuacagcaauacua

SEQ ID NO: 79906 - RNA, 19 nt, Homo sapiens
gaaccaaauguauccaucu

SEQ ID NO: 79907 - RNA, 19 nt, Homo sapiens
gcaauacuacaaccucaca

SEQ ID NO: 79908 - RNA, 19 nt, Homo sapiens
gcauggauacuacagcaau

SEQ ID NO: 79909 - RNA, 19 nt, Homo sapiens
ccagaagggcccacuuugu

SEQ ID NO: 79910 - RNA, 19 nt, Homo sapiens
gagaagauagcuguguuuc

SEQ ID NO: 79911 - RNA, 19 nt, Homo sapiens
caaauguauccaucuugaa

SEQ ID NO: 79912 - RNA, 19 nt, Homo sapiens
caagaaguccacccucaag

SEQ ID NO: 79913 - RNA, 19 nt, Homo sapiens
uaaaggugcaaaccaacaa

SEQ ID NO: 79914 - RNA, 19 nt, Homo sapiens
aaccaaauguauccaucuu

SEQ ID NO: 79915 - RNA, 19 nt, Homo sapiens
aaagggaaccauugagcuu

SEQ ID NO: 79916 - RNA, 19 nt, Homo sapiens
agaaguccacccucaagaa

SEQ ID NO: 79917 - RNA, 19 nt, Homo sapiens
ccaagaaguccacccucaa

SEQ ID NO: 79918 - RNA, 19 nt, Homo sapiens
gguggaacaggagaagaua

SEQ ID NO: 79919 - RNA, 19 nt, Homo sapiens
cauggauccugaaaacaua

SEQ ID NO: 79920 - RNA, 19 nt, Homo sapiens
gauacuacagcaauacuac

SEQ ID NO: 79921 - RNA, 19 nt, Homo sapiens
ccgcgcagcugacaguucu

SEQ ID NO: 79922 - RNA, 19 nt, Homo sapiens
aggagaagauagcuguguu

SEQ ID NO: 79923 - RNA, 19 nt, Homo sapiens
ggugcaaaccaacaagaug

SEQ ID NO: 79924 - RNA, 19 nt, Homo sapiens
gaagacaguggcaucuacu

SEQ ID NO: 79925 - RNA, 19 nt, Homo sapiens
ggacuauccacggugaaga

SEQ ID NO: 79926 - RNA, 19 nt, Homo sapiens
gacaguggcaucuacuucu

SEQ ID NO: 79927 - RNA, 19 nt, Homo sapiens
guaacaugcgcaucuacug

SEQ ID NO: 79928 - RNA, 19 nt, Homo sapiens
gcgcaucuacuggcugaga

SEQ ID NO: 79929 - RNA, 19 nt, Homo sapiens
caagccgguucauucucaa

SEQ ID NO: 79930 - RNA, 19 nt, Homo sapiens
ggaugcaagccgguucauu

SEQ ID NO: 79931 - RNA, 19 nt, Homo sapiens
gcaucuacuucugcaugau

SEQ ID NO: 79932 - RNA, 19 nt, Homo sapiens
cagcugagugugguugauu

SEQ ID NO: 79933 - RNA, 19 nt, Homo sapiens
acaguggcaucuacuucug

SEQ ID NO: 79934 - RNA, 19 nt, Homo sapiens
ccucugggauuccgcaaaa

SEQ ID NO: 79935 - RNA, 19 nt, Homo sapiens
gggaaaagggaaccauuga

SEQ ID NO: 79936 - RNA, 19 nt, Homo sapiens
uaacccauggauccugaaa

SEQ ID NO: 79937 - RNA, 19 nt, Homo sapiens
auacuacaaccucacagaa

SEQ ID NO: 79938 - RNA, 19 nt, Homo sapiens
ggcaugaucuucaguauga

SEQ ID NO: 79939 - RNA, 19 nt, Homo sapiens
gacaauaaauuccacauca

SEQ ID NO: 79940 - RNA, 19 nt, Homo sapiens
gcaaugaaagguacuauau

SEQ ID NO: 79941 - RNA, 19 nt, Homo sapiens
caggaaaguuuacccauga

SEQ ID NO: 79942 - RNA, 19 nt, Homo sapiens
cagaaauccugcaaugaaa

SEQ ID NO: 79943 - RNA, 19 nt, Homo sapiens
ccacaaggaugaggugauu

SEQ ID NO: 79944 - RNA, 19 nt, Homo sapiens
ggauuuaacuucaucuucu

SEQ ID NO: 79945 - RNA, 19 nt, Homo sapiens
gauaaaagcugaaguuacu

SEQ ID NO: 79946 - RNA, 19 nt, Homo sapiens
gcugaaagccauccacuau

SEQ ID NO: 79947 - RNA, 19 nt, Homo sapiens
gaaaguuuacccaugaaga

SEQ ID NO: 79948 - RNA, 19 nt, Homo sapiens
caagaaggacguacucgaa

SEQ ID NO: 79949 - RNA, 19 nt, Homo sapiens
gauauucccacaaggauga

SEQ ID NO: 79950 - RNA, 19 nt, Homo sapiens
gcguugaacugcugugguu

SEQ ID NO: 79951 - RNA, 19 nt, Homo sapiens
gaaagguacuauauuugcu

SEQ ID NO: 79952 - RNA, 19 nt, Homo sapiens
uuaaggaaguccaggaguu

SEQ ID NO: 79953 - RNA, 19 nt, Homo sapiens
acaggagucuauauucuga

SEQ ID NO: 79954 - RNA, 19 nt, Homo sapiens
aggaugaggugauuaagga

SEQ ID NO: 79955 - RNA, 19 nt, Homo sapiens
ugaaagccauccacuaugc

SEQ ID NO: 79956 - RNA, 19 nt, Homo sapiens
gcgagauggucuagaguca

SEQ ID NO: 79957 - RNA, 19 nt, Homo sapiens
gugaaguccuguccugaug

SEQ ID NO: 79958 - RNA, 19 nt, Homo sapiens
uggaacaguuuaucucaga

SEQ ID NO: 79959 - RNA, 19 nt, Homo sapiens
ggucuucgacaauaaauuc

SEQ ID NO: 79960 - RNA, 19 nt, Homo sapiens
cuacacaggagucuauauu

SEQ ID NO: 79961 - RNA, 19 nt, Homo sapiens
gguuugcuuugguuuauau

SEQ ID NO: 79962 - RNA, 19 nt, Homo sapiens
acaaggaugaggugauuaa

SEQ ID NO: 79963 - RNA, 19 nt, Homo sapiens
acacaggagucuauauucu

SEQ ID NO: 79964 - RNA, 19 nt, Homo sapiens
uaaggaaguccaggaguuu

SEQ ID NO: 79965 - RNA, 19 nt, Homo sapiens
cauucugcauugcuagaua

SEQ ID NO: 79966 - RNA, 19 nt, Homo sapiens
uaccugcuguucggauuua

SEQ ID NO: 79967 - RNA, 19 nt, Homo sapiens
caugaagauuggugggauu

SEQ ID NO: 79968 - RNA, 19 nt, Homo sapiens
gcauugccguggucaugau

SEQ ID NO: 79969 - RNA, 19 nt, Homo sapiens
gcagugggcaucggcauug

SEQ ID NO: 79970 - RNA, 19 nt, Homo sapiens
gauuuaacuucaucuucug

SEQ ID NO: 79971 - RNA, 19 nt, Homo sapiens
caauaaauuccacaucauc

SEQ ID NO: 79972 - RNA, 19 nt, Homo sapiens
caaggacaccuacaacaag

SEQ ID NO: 79973 - RNA, 19 nt, Homo sapiens
ggugauauucgccauugaa

SEQ ID NO: 79974 - RNA, 19 nt, Homo sapiens
acaaggacaccuacaacaa

SEQ ID NO: 79975 - RNA, 19 nt, Homo sapiens
gaacaguuuaucucagaca

SEQ ID NO: 79976 - RNA, 19 nt, Homo sapiens
guucuucggcuuccucuug

SEQ ID NO: 79977 - RNA, 19 nt, Homo sapiens
caucaaauaccugcuguuc

SEQ ID NO: 79978 - RNA, 19 nt, Homo sapiens
gaaauccugcaaugaaagg

SEQ ID NO: 79979 - RNA, 19 nt, Homo sapiens
uaguauucauucugcauug

SEQ ID NO: 79980 - RNA, 19 nt, Homo sapiens
ccaagugcaucaaauaccu

SEQ ID NO: 79981 - RNA, 19 nt, Homo sapiens
acaacaagcugaaaaccaa

SEQ ID NO: 79982 - RNA, 19 nt, Homo sapiens
guucggauuuaacuucauc

SEQ ID NO: 79983 - RNA, 19 nt, Homo sapiens
gcaggaaccgcgagauggu

SEQ ID NO: 79984 - RNA, 19 nt, Homo sapiens
gacuauggcuccgauucga

SEQ ID NO: 79985 - RNA, 19 nt, Homo sapiens
ugaaagguacuauauuugc

SEQ ID NO: 79986 - RNA, 19 nt, Homo sapiens
ggucuagagucagcuuaca

SEQ ID NO: 79987 - RNA, 19 nt, Homo sapiens
guacuauauuugcuagacu

SEQ ID NO: 79988 - RNA, 19 nt, Homo sapiens
gguuugguuugcuuugguu

SEQ ID NO: 79989 - RNA, 19 nt, Homo sapiens
gcuguucggauuuaacuuc

SEQ ID NO: 79990 - RNA, 19 nt, Homo sapiens
aagaaggacguacucgaaa

SEQ ID NO: 79991 - RNA, 19 nt, Homo sapiens
caguuuaucucagacaucu

SEQ ID NO: 79992 - RNA, 19 nt, Homo sapiens
gguacuauauuugcuagac

SEQ ID NO: 79993 - RNA, 19 nt, Homo sapiens
auucugcauugcuagauaa

SEQ ID NO: 79994 - RNA, 19 nt, Homo sapiens
aaaguuuacccaugaagau

SEQ ID NO: 79995 - RNA, 19 nt, Homo sapiens
gaucuugugcugugcuauc

SEQ ID NO: 79996 - RNA, 19 nt, Homo sapiens
ucaaaggaggcaccaagug

SEQ ID NO: 79997 - RNA, 19 nt, Homo sapiens
gugauauucgccauugaaa

SEQ ID NO: 79998 - RNA, 19 nt, Homo sapiens
gcugugcuauccgcaggaa

SEQ ID NO: 79999 - RNA, 19 nt, Homo sapiens
agaaggacguacucgaaac

SEQ ID NO: 80000 - RNA, 19 nt, Homo sapiens
guucggcccaggcuaaguu

SEQ ID NO: 80001 - RNA, 19 nt, Homo sapiens
aauaccugcuguucggauu

SEQ ID NO: 80002 - RNA, 19 nt, Homo sapiens
gccguggucaugauauuug

SEQ ID NO: 80003 - RNA, 19 nt, Homo sapiens
ggacuauggcuccgauucg

SEQ ID NO: 80004 - RNA, 19 nt, Homo sapiens
uauucauucugcauugcua

SEQ ID NO: 80005 - RNA, 19 nt, Homo sapiens
ggaaaguuuacccaugaag

SEQ ID NO: 80006 - RNA, 19 nt, Homo sapiens
cgacaauaaauuccacauc

SEQ ID NO: 80007 - RNA, 19 nt, Homo sapiens
guugaacugcugugguuug

SEQ ID NO: 80008 - RNA, 19 nt, Homo sapiens
cgagcaagaaacuaauaau

SEQ ID NO: 80009 - RNA, 19 nt, Homo sapiens
caccaugccggucaaagga

SEQ ID NO: 80010 - RNA, 19 nt, Homo sapiens
ucgagcaagaaacuaauaa

SEQ ID NO: 80011 - RNA, 19 nt, Homo sapiens
guuuguuguuuguuguuug

SEQ ID NO: 80012 - RNA, 19 nt, Homo sapiens
gauauuuggcaugaucuuc

SEQ ID NO: 80013 - RNA, 19 nt, Homo sapiens
ugcaaugaaagguacuaua

SEQ ID NO: 80014 - RNA, 19 nt, Homo sapiens
aggaaaguuuacccaugaa

SEQ ID NO: 80015 - RNA, 19 nt, Homo sapiens
ggaugaggugauuaaggaa

SEQ ID NO: 80016 - RNA, 19 nt, Homo sapiens
gaaagaagcuaaagcacuu

SEQ ID NO: 80017 - RNA, 19 nt, Homo sapiens
ccacaggacuugcacuuuc

SEQ ID NO: 80018 - RNA, 19 nt, Homo sapiens
gcucgaggaccuaaagaua

SEQ ID NO: 80019 - RNA, 19 nt, Homo sapiens
uaagauccaagacagaaua

SEQ ID NO: 80020 - RNA, 19 nt, Homo sapiens
caagacagaauaaugaaug

SEQ ID NO: 80021 - RNA, 19 nt, Homo sapiens
cuugugagcuggacgauga

SEQ ID NO: 80022 - RNA, 19 nt, Homo sapiens
gauccaagacagaauaaug

SEQ ID NO: 80023 - RNA, 19 nt, Homo sapiens
ccgaagaguucacaagugu

SEQ ID NO: 80024 - RNA, 19 nt, Homo sapiens
gcuggacgaugaagauuuc

SEQ ID NO: 80025 - RNA, 19 nt, Homo sapiens
gcccugaacucccucaauc

SEQ ID NO: 80026 - RNA, 19 nt, Homo sapiens
guagaaagaagcuaaagca

SEQ ID NO: 80027 - RNA, 19 nt, Homo sapiens
gcucagagguucggaagac

SEQ ID NO: 80028 - RNA, 19 nt, Homo sapiens
cagagguucggaagacuua

SEQ ID NO: 80029 - RNA, 19 nt, Homo sapiens
caagccaggccucaaggua

SEQ ID NO: 80030 - RNA, 19 nt, Homo sapiens
ucaggacguugaggacuuu

SEQ ID NO: 80031 - RNA, 19 nt, Homo sapiens
gccgaagaguucacaagug

SEQ ID NO: 80032 - RNA, 19 nt, Homo sapiens
gacuugcacuuuccagcuu

SEQ ID NO: 80033 - RNA, 19 nt, Homo sapiens
gugccgcuguguagaaaga

SEQ ID NO: 80034 - RNA, 19 nt, Homo sapiens
uggaacaggugccuaaagg

SEQ ID NO: 80035 - RNA, 19 nt, Homo sapiens
cacgagggcucaaugaacu

SEQ ID NO: 80036 - RNA, 19 nt, Homo sapiens
gucaggacguugaggacuu

SEQ ID NO: 80037 - RNA, 19 nt, Homo sapiens
gggugccgcuguguagaaa

SEQ ID NO: 80038 - RNA, 19 nt, Homo sapiens
ggaacaggugccuaaagga

SEQ ID NO: 80039 - RNA, 19 nt, Homo sapiens
ccuaagauccaagacagaa

SEQ ID NO: 80040 - RNA, 19 nt, Homo sapiens
gccuagaccucagccacaa

SEQ ID NO: 80041 - RNA, 19 nt, Homo sapiens
ucgaggaccuaaagauaac

SEQ ID NO: 80042 - RNA, 19 nt, Homo sapiens
gagcuggacgaugaagauu

SEQ ID NO: 80043 - RNA, 19 nt, Homo sapiens
cucgaggaccuaaagauaa

SEQ ID NO: 80044 - RNA, 19 nt, Homo sapiens
guacucccgccucaaggaa

SEQ ID NO: 80045 - RNA, 19 nt, Homo sapiens
gcucaagccaggccucaag

SEQ ID NO: 80046 - RNA, 19 nt, Homo sapiens
caaacugccuuggcuucag

SEQ ID NO: 80047 - RNA, 19 nt, Homo sapiens
ccaagacagaauaaugaau

SEQ ID NO: 80048 - RNA, 19 nt, Homo sapiens
ccacgagggcucaaugaac

SEQ ID NO: 80049 - RNA, 19 nt, Homo sapiens
gagcugcccgagguggaua

SEQ ID NO: 80050 - RNA, 19 nt, Homo sapiens
ggaagccacaggacuugca

SEQ ID NO: 80051 - RNA, 19 nt, Homo sapiens
ucgaccaauucaacccuuu

SEQ ID NO: 80052 - RNA, 19 nt, Homo sapiens
gucguucgcugggcuggaa

SEQ ID NO: 80053 - RNA, 19 nt, Homo sapiens
ggccgaagaguucacaagu

SEQ ID NO: 80054 - RNA, 19 nt, Homo sapiens
gugugugucugcaguagag

SEQ ID NO: 80055 - RNA, 19 nt, Homo sapiens
gaauaaugaauggacucaa

SEQ ID NO: 80056 - RNA, 19 nt, Homo sapiens
ggcuggaacaggugccuaa

SEQ ID NO: 80057 - RNA, 19 nt, Homo sapiens
cggaagacuuaucgaccau

SEQ ID NO: 80058 - RNA, 19 nt, Homo sapiens
ucaaugagcucuuccaauc

SEQ ID NO: 80059 - RNA, 19 nt, Homo sapiens
ucaagacgcuggaaaguau

SEQ ID NO: 80060 - RNA, 19 nt, Homo sapiens
caacgucucucaacagaug

SEQ ID NO: 80061 - RNA, 19 nt, Homo sapiens
gcagugagcuauggucaug

SEQ ID NO: 80062 - RNA, 19 nt, Homo sapiens
gaggauugcuugaguuaag

SEQ ID NO: 80063 - RNA, 19 nt, Homo sapiens
gaugcagacucuuaugaga

SEQ ID NO: 80064 - RNA, 19 nt, Homo sapiens
aaagaaagcgaaugacuga

SEQ ID NO: 80065 - RNA, 19 nt, Homo sapiens
ggucucagcugugacuuug

SEQ ID NO: 80066 - RNA, 19 nt, Homo sapiens
gaugugugcauguguguaa

SEQ ID NO: 80067 - RNA, 19 nt, Homo sapiens
gacuuuggcuuaucugauc

SEQ ID NO: 80068 - RNA, 19 nt, Homo sapiens
gaagaccucgagcagauga

SEQ ID NO: 80069 - RNA, 19 nt, Homo sapiens
ugaggaagaugcagacucu

SEQ ID NO: 80070 - RNA, 19 nt, Homo sapiens
gccaaccucuggagcaaug

SEQ ID NO: 80071 - RNA, 19 nt, Homo sapiens
ccagagauauguggguaau

SEQ ID NO: 80072 - RNA, 19 nt, Homo sapiens
cugaagaccucgagcagau

SEQ ID NO: 80073 - RNA, 19 nt, Homo sapiens
cagcugugacuuuggcuua

SEQ ID NO: 80074 - RNA, 19 nt, Homo sapiens
ccaaagaccgcccugagau

SEQ ID NO: 80075 - RNA, 19 nt, Homo sapiens
gggagugggcccagaagaa

SEQ ID NO: 80076 - RNA, 19 nt, Homo sapiens
uggcuuaucugaucuucug

SEQ ID NO: 80077 - RNA, 19 nt, Homo sapiens
uggaaggucucagcuguga

SEQ ID NO: 80078 - RNA, 19 nt, Homo sapiens
agagauauguggguaaugg

SEQ ID NO: 80079 - RNA, 19 nt, Homo sapiens
aggagauucuucaaaguga

SEQ ID NO: 80080 - RNA, 19 nt, Homo sapiens
ccaggagauucuucaaagu

SEQ ID NO: 80081 - RNA, 19 nt, Homo sapiens
aagaggauugcuugaguua

SEQ ID NO: 80082 - RNA, 19 nt, Homo sapiens
gcuggaaaguauuauuguc

SEQ ID NO: 80083 - RNA, 19 nt, Homo sapiens
acaggaggcugaggcaaga

SEQ ID NO: 80084 - RNA, 19 nt, Homo sapiens
caauguugcuuaggaugug

SEQ ID NO: 80085 - RNA, 19 nt, Homo sapiens
ggaagucaggcccgaggaa

SEQ ID NO: 80086 - RNA, 19 nt, Homo sapiens
ucuccaacgcugagucuua

SEQ ID NO: 80087 - RNA, 19 nt, Homo sapiens
gggcauucuucaucuucaa

SEQ ID NO: 80088 - RNA, 19 nt, Homo sapiens
gaagucaaggcugcaguga

SEQ ID NO: 80089 - RNA, 19 nt, Homo sapiens
gacccaaucaugaggaaga

SEQ ID NO: 80090 - RNA, 19 nt, Homo sapiens
gccaaagaccgcccugaga

SEQ ID NO: 80091 - RNA, 19 nt, Homo sapiens
gauucacaccugacucuga

SEQ ID NO: 80092 - RNA, 19 nt, Homo sapiens
gccuggaucuccucaaguc

SEQ ID NO: 80093 - RNA, 19 nt, Homo sapiens
ugaagaacagguccucaga

SEQ ID NO: 80094 - RNA, 19 nt, Homo sapiens
ccaacgcugagucuuauga

SEQ ID NO: 80095 - RNA, 19 nt, Homo sapiens
acgagaacccugaggauga

SEQ ID NO: 80096 - RNA, 19 nt, Homo sapiens
ugagaacgacuccaaccuu

SEQ ID NO: 80097 - RNA, 19 nt, Homo sapiens
gaaggucucagcugugacu

SEQ ID NO: 80098 - RNA, 19 nt, Homo sapiens
caaagaccgcccugagauc

SEQ ID NO: 80099 - RNA, 19 nt, Homo sapiens
ggagugggcccagaagaag

SEQ ID NO: 80100 - RNA, 19 nt, Homo sapiens
caggagauucuucaaagug

SEQ ID NO: 80101 - RNA, 19 nt, Homo sapiens
cgagaacccugaggaugag

SEQ ID NO: 80102 - RNA, 19 nt, Homo sapiens
ccaaggggccuaagucauu

SEQ ID NO: 80103 - RNA, 19 nt, Homo sapiens
cagccuggaucuccucaag

SEQ ID NO: 80104 - RNA, 19 nt, Homo sapiens
cuuaugagaacgaggauga

SEQ ID NO: 80105 - RNA, 19 nt, Homo sapiens
aaauuagccaggcauaguu

SEQ ID NO: 80106 - RNA, 19 nt, Homo sapiens
guguguguguguauacaug

SEQ ID NO: 80107 - RNA, 19 nt, Homo sapiens
acaccugacucugaaaucu

SEQ ID NO: 80108 - RNA, 19 nt, Homo sapiens
cuccaacgcugagucuuau

SEQ ID NO: 80109 - RNA, 19 nt, Homo sapiens
accaggagauucuucaaag

SEQ ID NO: 80110 - RNA, 19 nt, Homo sapiens
gaaaagaaagcgaaugacu

SEQ ID NO: 80111 - RNA, 19 nt, Homo sapiens
gugugugccuacagugcua

SEQ ID NO: 80112 - RNA, 19 nt, Homo sapiens
cggagagucugaccaccau

SEQ ID NO: 80113 - RNA, 19 nt, Homo sapiens
uaugagaacauggauaauc

SEQ ID NO: 80114 - RNA, 19 nt, Homo sapiens
caccaggagauucuucaaa

SEQ ID NO: 80115 - RNA, 19 nt, Homo sapiens
ggccugggaauccacauga

SEQ ID NO: 80116 - RNA, 19 nt, Homo sapiens
aaugagcucuuccaaucca

SEQ ID NO: 80117 - RNA, 19 nt, Homo sapiens
gaagguggaagagggagau

SEQ ID NO: 80118 - RNA, 19 nt, Homo sapiens
guggcaaccugaccauguc

SEQ ID NO: 80119 - RNA, 19 nt, Homo sapiens
augaggaaccugacaguga

SEQ ID NO: 80120 - RNA, 19 nt, Homo sapiens
gcugugacuuuggcuuauc

SEQ ID NO: 80121 - RNA, 19 nt, Homo sapiens
gcucaagacgcuggaaagu

SEQ ID NO: 80122 - RNA, 19 nt, Homo sapiens
guguguguguguguguaua

SEQ ID NO: 80123 - RNA, 19 nt, Homo sapiens
uucaacgucucucaacaga

SEQ ID NO: 80124 - RNA, 19 nt, Homo sapiens
gaauguuucggaccuaggu

SEQ ID NO: 80125 - RNA, 19 nt, Homo sapiens
gagcagaugaugccaaccu

SEQ ID NO: 80126 - RNA, 19 nt, Homo sapiens
aagacgcuggaaaguauua

SEQ ID NO: 80127 - RNA, 19 nt, Homo sapiens
ucaaggcugcagugagcua

SEQ ID NO: 80128 - RNA, 19 nt, Homo sapiens
cccuuuguauuccuuaaau

SEQ ID NO: 80129 - RNA, 19 nt, Homo sapiens
ugagaacgaggaugaagag

SEQ ID NO: 80130 - RNA, 19 nt, Homo sapiens
gcacugccccgucuuaugg

SEQ ID NO: 80131 - RNA, 19 nt, Homo sapiens
agucauugcugagccuaga

SEQ ID NO: 80132 - RNA, 19 nt, Homo sapiens
cagccuggacccaaucaug

SEQ ID NO: 80133 - RNA, 19 nt, Homo sapiens
acgcugagucuuaugagaa

SEQ ID NO: 80134 - RNA, 19 nt, Homo sapiens
gagugggcccagaagaaga

SEQ ID NO: 80135 - RNA, 19 nt, Homo sapiens
guggaauguuucggaccua

SEQ ID NO: 80136 - RNA, 19 nt, Homo sapiens
caagacgcuggaaaguauu

SEQ ID NO: 80137 - RNA, 19 nt, Homo sapiens
caagagacaugcugacuuu

SEQ ID NO: 80138 - RNA, 19 nt, Homo sapiens
guucauagcuuccaagaga

SEQ ID NO: 80139 - RNA, 19 nt, Homo sapiens
uaacauaguucuccuguca

SEQ ID NO: 80140 - RNA, 19 nt, Homo sapiens
gcucacacaccauauauua

SEQ ID NO: 80141 - RNA, 19 nt, Homo sapiens
gaaugugauuuccuacuaa

SEQ ID NO: 80142 - RNA, 19 nt, Homo sapiens
acgcaaagcuucuucauga

SEQ ID NO: 80143 - RNA, 19 nt, Homo sapiens
gaaaggcccuauugcuaug

SEQ ID NO: 80144 - RNA, 19 nt, Homo sapiens
uguaauagcuggcaucguu

SEQ ID NO: 80145 - RNA, 19 nt, Homo sapiens
ugacagcucuccuuaagug

SEQ ID NO: 80146 - RNA, 19 nt, Homo sapiens
ggaggcauuauguauauua

SEQ ID NO: 80147 - RNA, 19 nt, Homo sapiens
cuacagggcugacauugug

SEQ ID NO: 80148 - RNA, 19 nt, Homo sapiens
gaagaaaggcagaaugagu

SEQ ID NO: 80149 - RNA, 19 nt, Homo sapiens
cauagcuccuucucucuua

SEQ ID NO: 80150 - RNA, 19 nt, Homo sapiens
ccacugaacuccgcagcua

SEQ ID NO: 80151 - RNA, 19 nt, Homo sapiens
gcaacuuucuuacacugaa

SEQ ID NO: 80152 - RNA, 19 nt, Homo sapiens
gcagcuagcauccaaauca

SEQ ID NO: 80153 - RNA, 19 nt, Homo sapiens
gagggaagcucuaaauagc

SEQ ID NO: 80154 - RNA, 19 nt, Homo sapiens
agaaugugauuuccuacua

SEQ ID NO: 80155 - RNA, 19 nt, Homo sapiens
cagaaugagugcuucagaa

SEQ ID NO: 80156 - RNA, 19 nt, Homo sapiens
ccaagaagaggaagaagaa

SEQ ID NO: 80157 - RNA, 19 nt, Homo sapiens
ugaaacaucuucccaacca

SEQ ID NO: 80158 - RNA, 19 nt, Homo sapiens
cauacaaucucuguucuug

SEQ ID NO: 80159 - RNA, 19 nt, Homo sapiens
acagaacccauuccauuua

SEQ ID NO: 80160 - RNA, 19 nt, Homo sapiens
gagacgaacuuuccagaac

SEQ ID NO: 80161 - RNA, 19 nt, Homo sapiens
gagaaugaauggaaaagaa

SEQ ID NO: 80162 - RNA, 19 nt, Homo sapiens
ccagugugcuugagaaaca

SEQ ID NO: 80163 - RNA, 19 nt, Homo sapiens
ggaauccucaccaauagaa

SEQ ID NO: 80164 - RNA, 19 nt, Homo sapiens
ggacaauacagaacccauu

SEQ ID NO: 80165 - RNA, 19 nt, Homo sapiens
gagggaaucuaagacuuug

SEQ ID NO: 80166 - RNA, 19 nt, Homo sapiens
cagaacccauuccauuuau

SEQ ID NO: 80167 - RNA, 19 nt, Homo sapiens
ugaaugggcucuuccacau

SEQ ID NO: 80168 - RNA, 19 nt, Homo sapiens
aaugagugcuucagaaugu

SEQ ID NO: 80169 - RNA, 19 nt, Homo sapiens
caacuagggacaauacaga

SEQ ID NO: 80170 - RNA, 19 nt, Homo sapiens
ugacauuccuaaacuaucu

SEQ ID NO: 80171 - RNA, 19 nt, Homo sapiens
gaagaagaagaaacagaga

SEQ ID NO: 80172 - RNA, 19 nt, Homo sapiens
acccaaaucuaacauaguu

SEQ ID NO: 80173 - RNA, 19 nt, Homo sapiens
gcuccagacccaaaucuaa

SEQ ID NO: 80174 - RNA, 19 nt, Homo sapiens
caucuacccaauacuguua

SEQ ID NO: 80175 - RNA, 19 nt, Homo sapiens
cagcuaaucccucugagaa

SEQ ID NO: 80176 - RNA, 19 nt, Homo sapiens
ugaaaggcccuauugcuau

SEQ ID NO: 80177 - RNA, 19 nt, Homo sapiens
auacagaacccauuccauu

SEQ ID NO: 80178 - RNA, 19 nt, Homo sapiens
gaagaagugguugggcuaa

SEQ ID NO: 80179 - RNA, 19 nt, Homo sapiens
gaaugagugcuucagaaug

SEQ ID NO: 80180 - RNA, 19 nt, Homo sapiens
gcacauacgcaccacaucu

SEQ ID NO: 80181 - RNA, 19 nt, Homo sapiens
aaugacagcucuccuuaag

SEQ ID NO: 80182 - RNA, 19 nt, Homo sapiens
gaaacaucuucccaaccaa

SEQ ID NO: 80183 - RNA, 19 nt, Homo sapiens
ucaaucauggacauacuua

SEQ ID NO: 80184 - RNA, 19 nt, Homo sapiens
gagacaugcugacuuucau

SEQ ID NO: 80185 - RNA, 19 nt, Homo sapiens
cagcucuccuuaagugauu

SEQ ID NO: 80186 - RNA, 19 nt, Homo sapiens
gcugaucuuugccuucuuc

SEQ ID NO: 80187 - RNA, 19 nt, Homo sapiens
ugacaacacccagaaauuc

SEQ ID NO: 80188 - RNA, 19 nt, Homo sapiens
gagcucacacaccauauau

SEQ ID NO: 80189 - RNA, 19 nt, Homo sapiens
acccagaaauucaguaaau

SEQ ID NO: 80190 - RNA, 19 nt, Homo sapiens
gcagaaugagugcuucaga

SEQ ID NO: 80191 - RNA, 19 nt, Homo sapiens
gacaugcugacuuucauuu

SEQ ID NO: 80192 - RNA, 19 nt, Homo sapiens
gacaacacccagaaauuca

SEQ ID NO: 80193 - RNA, 19 nt, Homo sapiens
ugagggaaucuaagacuuu

SEQ ID NO: 80194 - RNA, 19 nt, Homo sapiens
uggcacauucuuagaguua

SEQ ID NO: 80195 - RNA, 19 nt, Homo sapiens
gaacccauuccauuuaucu

SEQ ID NO: 80196 - RNA, 19 nt, Homo sapiens
ucaugacauuccuaaacua

SEQ ID NO: 80197 - RNA, 19 nt, Homo sapiens
gaagaggaagaagaagaaa

SEQ ID NO: 80198 - RNA, 19 nt, Homo sapiens
uacagaacccauuccauuu

SEQ ID NO: 80199 - RNA, 19 nt, Homo sapiens
uaacaacuagggacaauac

SEQ ID NO: 80200 - RNA, 19 nt, Homo sapiens
uagcuggcaucguugagaa

SEQ ID NO: 80201 - RNA, 19 nt, Homo sapiens
gauuaugaaugggcucuuc

SEQ ID NO: 80202 - RNA, 19 nt, Homo sapiens
cagcauacaaucucuguuc

SEQ ID NO: 80203 - RNA, 19 nt, Homo sapiens
gagccucuuugcugccauu

SEQ ID NO: 80204 - RNA, 19 nt, Homo sapiens
ugagggaagcucuaaauag

SEQ ID NO: 80205 - RNA, 19 nt, Homo sapiens
cuccuucucucuuacauug

SEQ ID NO: 80206 - RNA, 19 nt, Homo sapiens
cuuaagugauuucuucugu

SEQ ID NO: 80207 - RNA, 19 nt, Homo sapiens
aaacaucuucccaaccaaa

SEQ ID NO: 80208 - RNA, 19 nt, Homo sapiens
gcuaaucccucugagaaaa

SEQ ID NO: 80209 - RNA, 19 nt, Homo sapiens
gaucuaugcacccaucugu

SEQ ID NO: 80210 - RNA, 19 nt, Homo sapiens
uguagcagcuuguguuguc

SEQ ID NO: 80211 - RNA, 19 nt, Homo sapiens
agaagaggaagaagaagaa

SEQ ID NO: 80212 - RNA, 19 nt, Homo sapiens
guauauuauuuccggauca

SEQ ID NO: 80213 - RNA, 19 nt, Homo sapiens
agacugcaccugauggaaa

SEQ ID NO: 80214 - RNA, 19 nt, Homo sapiens
gaaaaugacagcucuccuu

SEQ ID NO: 80215 - RNA, 19 nt, Homo sapiens
aaacagagacgaacuuucc

SEQ ID NO: 80216 - RNA, 19 nt, Homo sapiens
gaagaaacagagacgaacu

SEQ ID NO: 80217 - RNA, 19 nt, Homo sapiens
agacccaaaucuaacauag

SEQ ID NO: 80218 - RNA, 19 nt, Homo sapiens
gacaauacagaacccauuc

SEQ ID NO: 80219 - RNA, 19 nt, Homo sapiens
cugaagaaaggcagaauga

SEQ ID NO: 80220 - RNA, 19 nt, Homo sapiens
gagguacucugcacauacg

SEQ ID NO: 80221 - RNA, 19 nt, Homo sapiens
ccaaaucagcccuugagau

SEQ ID NO: 80222 - RNA, 19 nt, Homo sapiens
uuagagcucacacaccaua

SEQ ID NO: 80223 - RNA, 19 nt, Homo sapiens
ggggaggcauuauguauau

SEQ ID NO: 80224 - RNA, 19 nt, Homo sapiens
gaauucauugagccucuuu

SEQ ID NO: 80225 - RNA, 19 nt, Homo sapiens
aauaacaacuagggacaau

SEQ ID NO: 80226 - RNA, 19 nt, Homo sapiens
uucagaaugugauuuccua

SEQ ID NO: 80227 - RNA, 19 nt, Homo sapiens
cuccuuaagugauuucuuc

SEQ ID NO: 80228 - RNA, 19 nt, Homo sapiens
gcuaugcaaucugguccaa

SEQ ID NO: 80229 - RNA, 19 nt, Homo sapiens
ccaggaacuuguaauagcu

SEQ ID NO: 80230 - RNA, 19 nt, Homo sapiens
ccucuuugcugccauuucu

SEQ ID NO: 80231 - RNA, 19 nt, Homo sapiens
caugagggaagcucuaaau

SEQ ID NO: 80232 - RNA, 19 nt, Homo sapiens
caugcugacuuucauuucu

SEQ ID NO: 80233 - RNA, 19 nt, Homo sapiens
ccaagagacaugcugacuu

SEQ ID NO: 80234 - RNA, 19 nt, Homo sapiens
aaccaaagaaugaagaaga

SEQ ID NO: 80235 - RNA, 19 nt, Homo sapiens
ucucuguucuugggcauuu

SEQ ID NO: 80236 - RNA, 19 nt, Homo sapiens
ccagaaauucaguaaaugg

SEQ ID NO: 80237 - RNA, 19 nt, Homo sapiens
caagagacaugcugacuuu

SEQ ID NO: 80238 - RNA, 19 nt, Homo sapiens
guucauagcuuccaagaga

SEQ ID NO: 80239 - RNA, 19 nt, Homo sapiens
gggaagagacugacaauaa

SEQ ID NO: 80240 - RNA, 19 nt, Homo sapiens
uaacauaguucuccuguca

SEQ ID NO: 80241 - RNA, 19 nt, Homo sapiens
gcucacacaccauauauua

SEQ ID NO: 80242 - RNA, 19 nt, Homo sapiens
gaaugugauuuccuacuaa

SEQ ID NO: 80243 - RNA, 19 nt, Homo sapiens
acgcaaagcuucuucauga

SEQ ID NO: 80244 - RNA, 19 nt, Homo sapiens
ggaagagacugacaauaag

SEQ ID NO: 80245 - RNA, 19 nt, Homo sapiens
gaaaggcccuauugcuaug

SEQ ID NO: 80246 - RNA, 19 nt, Homo sapiens
uguaauagcuggcaucguu

SEQ ID NO: 80247 - RNA, 19 nt, Homo sapiens
ugacagcucuccuuaagug

SEQ ID NO: 80248 - RNA, 19 nt, Homo sapiens
ggaggcauuauguauauua

SEQ ID NO: 80249 - RNA, 19 nt, Homo sapiens
cuacagggcugacauugug

SEQ ID NO: 80250 - RNA, 19 nt, Homo sapiens
gaagaaaggcagaaugagu

SEQ ID NO: 80251 - RNA, 19 nt, Homo sapiens
cauagcuccuucucucuua

SEQ ID NO: 80252 - RNA, 19 nt, Homo sapiens
ccacugaacuccgcagcua

SEQ ID NO: 80253 - RNA, 19 nt, Homo sapiens
gcaacuuucuuacacugaa

SEQ ID NO: 80254 - RNA, 19 nt, Homo sapiens
gcagcuagcauccaaauca

SEQ ID NO: 80255 - RNA, 19 nt, Homo sapiens
gagggaagcucuaaauagc

SEQ ID NO: 80256 - RNA, 19 nt, Homo sapiens
agaaugugauuuccuacua

SEQ ID NO: 80257 - RNA, 19 nt, Homo sapiens
cagaaugagugcuucagaa

SEQ ID NO: 80258 - RNA, 19 nt, Homo sapiens
ccaagaagaggaagaagaa

SEQ ID NO: 80259 - RNA, 19 nt, Homo sapiens
ugaaacaucuucccaacca

SEQ ID NO: 80260 - RNA, 19 nt, Homo sapiens
cauacaaucucuguucuug

SEQ ID NO: 80261 - RNA, 19 nt, Homo sapiens
acagaacccauuccauuua

SEQ ID NO: 80262 - RNA, 19 nt, Homo sapiens
gagacgaacuuuccagaac

SEQ ID NO: 80263 - RNA, 19 nt, Homo sapiens
gagaaugaauggaaaagaa

SEQ ID NO: 80264 - RNA, 19 nt, Homo sapiens
ccagugugcuugagaaaca

SEQ ID NO: 80265 - RNA, 19 nt, Homo sapiens
ggaauccucaccaauagaa

SEQ ID NO: 80266 - RNA, 19 nt, Homo sapiens
ggacaauacagaacccauu

SEQ ID NO: 80267 - RNA, 19 nt, Homo sapiens
gagggaaucuaagacuuug

SEQ ID NO: 80268 - RNA, 19 nt, Homo sapiens
cagaacccauuccauuuau

SEQ ID NO: 80269 - RNA, 19 nt, Homo sapiens
ugaaugggcucuuccacau

SEQ ID NO: 80270 - RNA, 19 nt, Homo sapiens
aauaagaacucagcaguag

SEQ ID NO: 80271 - RNA, 19 nt, Homo sapiens
aaugagugcuucagaaugu

SEQ ID NO: 80272 - RNA, 19 nt, Homo sapiens
caacuagggacaauacaga

SEQ ID NO: 80273 - RNA, 19 nt, Homo sapiens
ugacauuccuaaacuaucu

SEQ ID NO: 80274 - RNA, 19 nt, Homo sapiens
gaagaagaagaaacagaga

SEQ ID NO: 80275 - RNA, 19 nt, Homo sapiens
acccaaaucuaacauaguu

SEQ ID NO: 80276 - RNA, 19 nt, Homo sapiens
gcuccagacccaaaucuaa

SEQ ID NO: 80277 - RNA, 19 nt, Homo sapiens
caucuacccaauacuguua

SEQ ID NO: 80278 - RNA, 19 nt, Homo sapiens
cagcuaaucccucugagaa

SEQ ID NO: 80279 - RNA, 19 nt, Homo sapiens
ugaaaggcccuauugcuau

SEQ ID NO: 80280 - RNA, 19 nt, Homo sapiens
auacagaacccauuccauu

SEQ ID NO: 80281 - RNA, 19 nt, Homo sapiens
gacugacaauaagcaauua

SEQ ID NO: 80282 - RNA, 19 nt, Homo sapiens
gaagaagugguugggcuaa

SEQ ID NO: 80283 - RNA, 19 nt, Homo sapiens
gaaugagugcuucagaaug

SEQ ID NO: 80284 - RNA, 19 nt, Homo sapiens
gcacauacgcaccacaucu

SEQ ID NO: 80285 - RNA, 19 nt, Homo sapiens
aaugacagcucuccuuaag

SEQ ID NO: 80286 - RNA, 19 nt, Homo sapiens
gaaacaucuucccaaccaa

SEQ ID NO: 80287 - RNA, 19 nt, Homo sapiens
ucaaucauggacauacuua

SEQ ID NO: 80288 - RNA, 19 nt, Homo sapiens
ggccaugucuacccucaau

SEQ ID NO: 80289 - RNA, 19 nt, Homo sapiens
gagacaugcugacuuucau

SEQ ID NO: 80290 - RNA, 19 nt, Homo sapiens
cagcucuccuuaagugauu

SEQ ID NO: 80291 - RNA, 19 nt, Homo sapiens
gcugaucuuugccuucuuc

SEQ ID NO: 80292 - RNA, 19 nt, Homo sapiens
gagcucacacaccauauau

SEQ ID NO: 80293 - RNA, 19 nt, Homo sapiens
acccagaaauucaguaaau

SEQ ID NO: 80294 - RNA, 19 nt, Homo sapiens
ugacaacacccagaaauuc

SEQ ID NO: 80295 - RNA, 19 nt, Homo sapiens
gcagaaugagugcuucaga

SEQ ID NO: 80296 - RNA, 19 nt, Homo sapiens
gacaugcugacuuucauuu

SEQ ID NO: 80297 - RNA, 19 nt, Homo sapiens
ugagggaaucuaagacuuu

SEQ ID NO: 80298 - RNA, 19 nt, Homo sapiens
gacaacacccagaaauuca

SEQ ID NO: 80299 - RNA, 19 nt, Homo sapiens
gaggaaaugcugagagaag

SEQ ID NO: 80300 - RNA, 19 nt, Homo sapiens
uggaggaaaugcugagaga

SEQ ID NO: 80301 - RNA, 19 nt, Homo sapiens
aaauaagaacucagcagua

SEQ ID NO: 80302 - RNA, 19 nt, Homo sapiens
uggcacauucuuagaguua

SEQ ID NO: 80303 - RNA, 19 nt, Homo sapiens
gaacccauuccauuuaucu

SEQ ID NO: 80304 - RNA, 19 nt, Homo sapiens
ucaugacauuccuaaacua

SEQ ID NO: 80305 - RNA, 19 nt, Homo sapiens
gaagaggaagaagaagaaa

SEQ ID NO: 80306 - RNA, 19 nt, Homo sapiens
uacagaacccauuccauuu

SEQ ID NO: 80307 - RNA, 19 nt, Homo sapiens
uaacaacuagggacaauac

SEQ ID NO: 80308 - RNA, 19 nt, Homo sapiens
gaacaagagagaacaaaau

SEQ ID NO: 80309 - RNA, 19 nt, Homo sapiens
uagcuggcaucguugagaa

SEQ ID NO: 80310 - RNA, 19 nt, Homo sapiens
gauuaugaaugggcucuuc

SEQ ID NO: 80311 - RNA, 19 nt, Homo sapiens
agacugacaauaagcaauu

SEQ ID NO: 80312 - RNA, 19 nt, Homo sapiens
cagcauacaaucucuguuc

SEQ ID NO: 80313 - RNA, 19 nt, Homo sapiens
gagccucuuugcugccauu

SEQ ID NO: 80314 - RNA, 19 nt, Homo sapiens
ugagggaagcucuaaauag

SEQ ID NO: 80315 - RNA, 19 nt, Homo sapiens
cuccuucucucuuacauug

SEQ ID NO: 80316 - RNA, 19 nt, Homo sapiens
cuuaagugauuucuucugu

SEQ ID NO: 80317 - RNA, 19 nt, Homo sapiens
aaacaucuucccaaccaaa

SEQ ID NO: 80318 - RNA, 19 nt, Homo sapiens
gcuaaucccucugagaaaa

SEQ ID NO: 80319 - RNA, 19 nt, Homo sapiens
gaucuaugcacccaucugu

SEQ ID NO: 80320 - RNA, 19 nt, Homo sapiens
uguagcagcuuguguuguc

SEQ ID NO: 80321 - RNA, 19 nt, Homo sapiens
agaagaggaagaagaagaa

SEQ ID NO: 80322 - RNA, 19 nt, Homo sapiens
guauauuauuuccggauca

SEQ ID NO: 80323 - RNA, 19 nt, Homo sapiens
agacugcaccugauggaaa

SEQ ID NO: 80324 - RNA, 19 nt, Homo sapiens
gaaaaugacagcucuccuu

SEQ ID NO: 80325 - RNA, 19 nt, Homo sapiens
aaacagagacgaacuuucc

SEQ ID NO: 80326 - RNA, 19 nt, Homo sapiens
gaagaaacagagacgaacu

SEQ ID NO: 80327 - RNA, 19 nt, Homo sapiens
agacccaaaucuaacauag

SEQ ID NO: 80328 - RNA, 19 nt, Homo sapiens
gacaauacagaacccauuc

SEQ ID NO: 80329 - RNA, 19 nt, Homo sapiens
ccaaaucagcccuugagau

SEQ ID NO: 80330 - RNA, 19 nt, Homo sapiens
cugaagaaaggcagaauga

SEQ ID NO: 80331 - RNA, 19 nt, Homo sapiens
gagguacucugcacauacg

SEQ ID NO: 80332 - RNA, 19 nt, Homo sapiens
uuagagcucacacaccaua

SEQ ID NO: 80333 - RNA, 19 nt, Homo sapiens
ggggaggcauuauguauau

SEQ ID NO: 80334 - RNA, 19 nt, Homo sapiens
ugacacucauggaggaaau

SEQ ID NO: 80335 - RNA, 19 nt, Homo sapiens
gaauucauugagccucuuu

SEQ ID NO: 80336 - RNA, 19 nt, Homo sapiens
aauaacaacuagggacaau

SEQ ID NO: 80337 - RNA, 19 nt, Homo sapiens
caagagacaugcugacuuu

SEQ ID NO: 80338 - RNA, 19 nt, Homo sapiens
guucauagcuuccaagaga

SEQ ID NO: 80339 - RNA, 19 nt, Homo sapiens
uaacauaguucuccuguca

SEQ ID NO: 80340 - RNA, 19 nt, Homo sapiens
gcucacacaccauauauua

SEQ ID NO: 80341 - RNA, 19 nt, Homo sapiens
gaaugugauuuccuacuaa

SEQ ID NO: 80342 - RNA, 19 nt, Homo sapiens
acgcaaagcuucuucauga

SEQ ID NO: 80343 - RNA, 19 nt, Homo sapiens
gaaaggcccuauugcuaug

SEQ ID NO: 80344 - RNA, 19 nt, Homo sapiens
uguaauagcuggcaucguu

SEQ ID NO: 80345 - RNA, 19 nt, Homo sapiens
ugacagcucuccuuaagug

SEQ ID NO: 80346 - RNA, 19 nt, Homo sapiens
ggaggcauuauguauauua

SEQ ID NO: 80347 - RNA, 19 nt, Homo sapiens
cuacagggcugacauugug

SEQ ID NO: 80348 - RNA, 19 nt, Homo sapiens
gaagaaaggcagaaugagu

SEQ ID NO: 80349 - RNA, 19 nt, Homo sapiens
cauagcuccuucucucuua

SEQ ID NO: 80350 - RNA, 19 nt, Homo sapiens
ccacugaacuccgcagcua

SEQ ID NO: 80351 - RNA, 19 nt, Homo sapiens
gcaacuuucuuacacugaa

SEQ ID NO: 80352 - RNA, 19 nt, Homo sapiens
gcagcuagcauccaaauca

SEQ ID NO: 80353 - RNA, 19 nt, Homo sapiens
gagggaagcucuaaauagc

SEQ ID NO: 80354 - RNA, 19 nt, Homo sapiens
agaaugugauuuccuacua

SEQ ID NO: 80355 - RNA, 19 nt, Homo sapiens
cagaaugagugcuucagaa

SEQ ID NO: 80356 - RNA, 19 nt, Homo sapiens
ccaagaagaggaagaagaa

SEQ ID NO: 80357 - RNA, 19 nt, Homo sapiens
ugaaacaucuucccaacca

SEQ ID NO: 80358 - RNA, 19 nt, Homo sapiens
cauacaaucucuguucuug

SEQ ID NO: 80359 - RNA, 19 nt, Homo sapiens
acagaacccauuccauuua

SEQ ID NO: 80360 - RNA, 19 nt, Homo sapiens
gagacgaacuuuccagaac

SEQ ID NO: 80361 - RNA, 19 nt, Homo sapiens
gagaaugaauggaaaagaa

SEQ ID NO: 80362 - RNA, 19 nt, Homo sapiens
ccagugugcuugagaaaca

SEQ ID NO: 80363 - RNA, 19 nt, Homo sapiens
ggaauccucaccaauagaa

SEQ ID NO: 80364 - RNA, 19 nt, Homo sapiens
ggacaauacagaacccauu

SEQ ID NO: 80365 - RNA, 19 nt, Homo sapiens
gagggaaucuaagacuuug

SEQ ID NO: 80366 - RNA, 19 nt, Homo sapiens
cagaacccauuccauuuau

SEQ ID NO: 80367 - RNA, 19 nt, Homo sapiens
ugaaugggcucuuccacau

SEQ ID NO: 80368 - RNA, 19 nt, Homo sapiens
aaugagugcuucagaaugu

SEQ ID NO: 80369 - RNA, 19 nt, Homo sapiens
caacuagggacaauacaga

SEQ ID NO: 80370 - RNA, 19 nt, Homo sapiens
ugacauuccuaaacuaucu

SEQ ID NO: 80371 - RNA, 19 nt, Homo sapiens
gaagaagaagaaacagaga

SEQ ID NO: 80372 - RNA, 19 nt, Homo sapiens
acccaaaucuaacauaguu

SEQ ID NO: 80373 - RNA, 19 nt, Homo sapiens
gcuccagacccaaaucuaa

SEQ ID NO: 80374 - RNA, 19 nt, Homo sapiens
caucuacccaauacuguua

SEQ ID NO: 80375 - RNA, 19 nt, Homo sapiens
cagcuaaucccucugagaa

SEQ ID NO: 80376 - RNA, 19 nt, Homo sapiens
ugaaaggcccuauugcuau

SEQ ID NO: 80377 - RNA, 19 nt, Homo sapiens
auacagaacccauuccauu

SEQ ID NO: 80378 - RNA, 19 nt, Homo sapiens
gaagaagugguugggcuaa

SEQ ID NO: 80379 - RNA, 19 nt, Homo sapiens
gaaugagugcuucagaaug

SEQ ID NO: 80380 - RNA, 19 nt, Homo sapiens
gcacauacgcaccacaucu

SEQ ID NO: 80381 - RNA, 19 nt, Homo sapiens
aaugacagcucuccuuaag

SEQ ID NO: 80382 - RNA, 19 nt, Homo sapiens
gaaacaucuucccaaccaa

SEQ ID NO: 80383 - RNA, 19 nt, Homo sapiens
ucaaucauggacauacuua

SEQ ID NO: 80384 - RNA, 19 nt, Homo sapiens
ggccaugucuacccucaau

SEQ ID NO: 80385 - RNA, 19 nt, Homo sapiens
gagacaugcugacuuucau

SEQ ID NO: 80386 - RNA, 19 nt, Homo sapiens
cagcucuccuuaagugauu

SEQ ID NO: 80387 - RNA, 19 nt, Homo sapiens
gcugaucuuugccuucuuc

SEQ ID NO: 80388 - RNA, 19 nt, Homo sapiens
gagcucacacaccauauau

SEQ ID NO: 80389 - RNA, 19 nt, Homo sapiens
acccagaaauucaguaaau

SEQ ID NO: 80390 - RNA, 19 nt, Homo sapiens
ugacaacacccagaaauuc

SEQ ID NO: 80391 - RNA, 19 nt, Homo sapiens
gcagaaugagugcuucaga

SEQ ID NO: 80392 - RNA, 19 nt, Homo sapiens
gacaugcugacuuucauuu

SEQ ID NO: 80393 - RNA, 19 nt, Homo sapiens
ugagggaaucuaagacuuu

SEQ ID NO: 80394 - RNA, 19 nt, Homo sapiens
gacaacacccagaaauuca

SEQ ID NO: 80395 - RNA, 19 nt, Homo sapiens
gaggaaaugcugagagaag

SEQ ID NO: 80396 - RNA, 19 nt, Homo sapiens
uggaggaaaugcugagaga

SEQ ID NO: 80397 - RNA, 19 nt, Homo sapiens
uggcacauucuuagaguua

SEQ ID NO: 80398 - RNA, 19 nt, Homo sapiens
gaacccauuccauuuaucu

SEQ ID NO: 80399 - RNA, 19 nt, Homo sapiens
ucaugacauuccuaaacua

SEQ ID NO: 80400 - RNA, 19 nt, Homo sapiens
gaagaggaagaagaagaaa

SEQ ID NO: 80401 - RNA, 19 nt, Homo sapiens
uacagaacccauuccauuu

SEQ ID NO: 80402 - RNA, 19 nt, Homo sapiens
uaacaacuagggacaauac

SEQ ID NO: 80403 - RNA, 19 nt, Homo sapiens
uagcuggcaucguugagaa

SEQ ID NO: 80404 - RNA, 19 nt, Homo sapiens
gauuaugaaugggcucuuc

SEQ ID NO: 80405 - RNA, 19 nt, Homo sapiens
cagcauacaaucucuguuc

SEQ ID NO: 80406 - RNA, 19 nt, Homo sapiens
gagccucuuugcugccauu

SEQ ID NO: 80407 - RNA, 19 nt, Homo sapiens
ugagggaagcucuaaauag

SEQ ID NO: 80408 - RNA, 19 nt, Homo sapiens
cuccuucucucuuacauug

SEQ ID NO: 80409 - RNA, 19 nt, Homo sapiens
cuuaagugauuucuucugu

SEQ ID NO: 80410 - RNA, 19 nt, Homo sapiens
aaacaucuucccaaccaaa

SEQ ID NO: 80411 - RNA, 19 nt, Homo sapiens
gcuaaucccucugagaaaa

SEQ ID NO: 80412 - RNA, 19 nt, Homo sapiens
gaucuaugcacccaucugu

SEQ ID NO: 80413 - RNA, 19 nt, Homo sapiens
uguagcagcuuguguuguc

SEQ ID NO: 80414 - RNA, 19 nt, Homo sapiens
acucagaacucagcaguag

SEQ ID NO: 80415 - RNA, 19 nt, Homo sapiens
agaagaggaagaagaagaa

SEQ ID NO: 80416 - RNA, 19 nt, Homo sapiens
guauauuauuuccggauca

SEQ ID NO: 80417 - RNA, 19 nt, Homo sapiens
agacugcaccugauggaaa

SEQ ID NO: 80418 - RNA, 19 nt, Homo sapiens
gaaaaugacagcucuccuu

SEQ ID NO: 80419 - RNA, 19 nt, Homo sapiens
aaacagagacgaacuuucc

SEQ ID NO: 80420 - RNA, 19 nt, Homo sapiens
gaagaaacagagacgaacu

SEQ ID NO: 80421 - RNA, 19 nt, Homo sapiens
agacccaaaucuaacauag

SEQ ID NO: 80422 - RNA, 19 nt, Homo sapiens
gacaauacagaacccauuc

SEQ ID NO: 80423 - RNA, 19 nt, Homo sapiens
cugaagaaaggcagaauga

SEQ ID NO: 80424 - RNA, 19 nt, Homo sapiens
gagguacucugcacauacg

SEQ ID NO: 80425 - RNA, 19 nt, Homo sapiens
ccaaaucagcccuugagau

SEQ ID NO: 80426 - RNA, 19 nt, Homo sapiens
uuagagcucacacaccaua

SEQ ID NO: 80427 - RNA, 19 nt, Homo sapiens
ggggaggcauuauguauau

SEQ ID NO: 80428 - RNA, 19 nt, Homo sapiens
ugacacucauggaggaaau

SEQ ID NO: 80429 - RNA, 19 nt, Homo sapiens
gaauucauugagccucuuu

SEQ ID NO: 80430 - RNA, 19 nt, Homo sapiens
ccaugucuacccucaauga

SEQ ID NO: 80431 - RNA, 19 nt, Homo sapiens
aauaacaacuagggacaau

SEQ ID NO: 80432 - RNA, 19 nt, Homo sapiens
uucagaaugugauuuccua

SEQ ID NO: 80433 - RNA, 19 nt, Homo sapiens
cuccuuaagugauuucuuc

SEQ ID NO: 80434 - RNA, 19 nt, Homo sapiens
ugagagaagcauucagaug

SEQ ID NO: 80435 - RNA, 19 nt, Homo sapiens
ccaggaacuuguaauagcu

SEQ ID NO: 80436 - RNA, 19 nt, Homo sapiens
ccucuuugcugccauuucu

SEQ ID NO: 80437 - RNA, 19 nt, Homo sapiens
gaucauuacuccaaaguug

SEQ ID NO: 80438 - RNA, 19 nt, Homo sapiens
gcaugaauauuugaccuua

SEQ ID NO: 80439 - RNA, 19 nt, Homo sapiens
gcaaacugcuguaauucaa

SEQ ID NO: 80440 - RNA, 19 nt, Homo sapiens
gaacauaagccugcucgua

SEQ ID NO: 80441 - RNA, 19 nt, Homo sapiens
cugaaacugucacuuauua

SEQ ID NO: 80442 - RNA, 19 nt, Homo sapiens
gaccuuaaaucuccaguga

SEQ ID NO: 80443 - RNA, 19 nt, Homo sapiens
gaacauggauacagaacag

SEQ ID NO: 80444 - RNA, 19 nt, Homo sapiens
aagaauaccuccuuaugaa

SEQ ID NO: 80445 - RNA, 19 nt, Homo sapiens
gaaggaaggcgguauaauc

SEQ ID NO: 80446 - RNA, 19 nt, Homo sapiens
gaauaaggccuuuagaauc

SEQ ID NO: 80447 - RNA, 19 nt, Homo sapiens
ucaggaaccuugucuguug

SEQ ID NO: 80448 - RNA, 19 nt, Homo sapiens
gaacaugggcaaauuaucu

SEQ ID NO: 80449 - RNA, 19 nt, Homo sapiens
ugacacaucuggguucaaa

SEQ ID NO: 80450 - RNA, 19 nt, Homo sapiens
caagaauaccuccuuauga

SEQ ID NO: 80451 - RNA, 19 nt, Homo sapiens
auaaauggaucaccagauu

SEQ ID NO: 80452 - RNA, 19 nt, Homo sapiens
gaaaugcuucuugacuuua

SEQ ID NO: 80453 - RNA, 19 nt, Homo sapiens
ggauaucuguaacuucuau

SEQ ID NO: 80454 - RNA, 19 nt, Homo sapiens
gcucaauccuucuaucaug

SEQ ID NO: 80455 - RNA, 19 nt, Homo sapiens
caccggaccuaugcaauua

SEQ ID NO: 80456 - RNA, 19 nt, Homo sapiens
gguuaaggcucagggauuu

SEQ ID NO: 80457 - RNA, 19 nt, Homo sapiens
ucugagagcaugaauauuu

SEQ ID NO: 80458 - RNA, 19 nt, Homo sapiens
cagcaaugauucuggcuuu

SEQ ID NO: 80459 - RNA, 19 nt, Homo sapiens
ugaaacagcaccacaggua

SEQ ID NO: 80460 - RNA, 19 nt, Homo sapiens
ccaaauguguucuucaaag

SEQ ID NO: 80461 - RNA, 19 nt, Homo sapiens
gguauaaucccuauucaau

SEQ ID NO: 80462 - RNA, 19 nt, Homo sapiens
acaagaacauggauacaga

SEQ ID NO: 80463 - RNA, 19 nt, Homo sapiens
gacuuuaacaucagcauua

SEQ ID NO: 80464 - RNA, 19 nt, Homo sapiens
aaucaagaauaccuccuua

SEQ ID NO: 80465 - RNA, 19 nt, Homo sapiens
uaucuaaucucucugaucu

SEQ ID NO: 80466 - RNA, 19 nt, Homo sapiens
gcccaaauguguucuucaa

SEQ ID NO: 80467 - RNA, 19 nt, Homo sapiens
aaugcaaacugcuguaauu

SEQ ID NO: 80468 - RNA, 19 nt, Homo sapiens
guaugaacaugggcaaauu

SEQ ID NO: 80469 - RNA, 19 nt, Homo sapiens
ggacaaugggaaacuguaa

SEQ ID NO: 80470 - RNA, 19 nt, Homo sapiens
aauaaggccuuuagaaucu

SEQ ID NO: 80471 - RNA, 19 nt, Homo sapiens
ccugauauguaaaugauga

SEQ ID NO: 80472 - RNA, 19 nt, Homo sapiens
ggaauuaugcguaacuauc

SEQ ID NO: 80473 - RNA, 19 nt, Homo sapiens
ccacgaaguugauaaugca

SEQ ID NO: 80474 - RNA, 19 nt, Homo sapiens
gcaauacccauaccacuuc

SEQ ID NO: 80475 - RNA, 19 nt, Homo sapiens
caguuaauauccagucauu

SEQ ID NO: 80476 - RNA, 19 nt, Homo sapiens
ccaauucuguguaaucaag

SEQ ID NO: 80477 - RNA, 19 nt, Homo sapiens
caaauggcauggugucucu

SEQ ID NO: 80478 - RNA, 19 nt, Homo sapiens
uaaauggaucaccagauua

SEQ ID NO: 80479 - RNA, 19 nt, Homo sapiens
aaacugcuguaauucaaga

SEQ ID NO: 80480 - RNA, 19 nt, Homo sapiens
gaacauugccagugcuaca

SEQ ID NO: 80481 - RNA, 19 nt, Homo sapiens
gauccugaaugcagcaaug

SEQ ID NO: 80482 - RNA, 19 nt, Homo sapiens
acucacacaugcccugaua

SEQ ID NO: 80483 - RNA, 19 nt, Homo sapiens
uggaaggacagauauauuu

SEQ ID NO: 80484 - RNA, 19 nt, Homo sapiens
guaaagcucaauccuucua

SEQ ID NO: 80485 - RNA, 19 nt, Homo sapiens
cuuauuaccuguaugaaca

SEQ ID NO: 80486 - RNA, 19 nt, Homo sapiens
ggaaggacagauauauuuc

SEQ ID NO: 80487 - RNA, 19 nt, Homo sapiens
ucaccuugcuggaauuaug

SEQ ID NO: 80488 - RNA, 19 nt, Homo sapiens
ggaaagccgucugccaaag

SEQ ID NO: 80489 - RNA, 19 nt, Homo sapiens
cagauuaucagaaagcaaa

SEQ ID NO: 80490 - RNA, 19 nt, Homo sapiens
gcucugaggguuaaaugaa

SEQ ID NO: 80491 - RNA, 19 nt, Homo sapiens
ucuaaucucucugaucuau

SEQ ID NO: 80492 - RNA, 19 nt, Homo sapiens
agaauaaggccuuuagaau

SEQ ID NO: 80493 - RNA, 19 nt, Homo sapiens
caaauguguucuucaaagg

SEQ ID NO: 80494 - RNA, 19 nt, Homo sapiens
gcccugauauguaaaugau

SEQ ID NO: 80495 - RNA, 19 nt, Homo sapiens
gcuuuucucucacuaaaua

SEQ ID NO: 80496 - RNA, 19 nt, Homo sapiens
acauaagccugcucguaaa

SEQ ID NO: 80497 - RNA, 19 nt, Homo sapiens
cuucuugacuuuaacauca

SEQ ID NO: 80498 - RNA, 19 nt, Homo sapiens
cuacuccauugcuuuauga

SEQ ID NO: 80499 - RNA, 19 nt, Homo sapiens
gcaaugcaaacugcuguaa

SEQ ID NO: 80500 - RNA, 19 nt, Homo sapiens
gcugaauacuucugucuac

SEQ ID NO: 80501 - RNA, 19 nt, Homo sapiens
ucacuuauuaccuguauga

SEQ ID NO: 80502 - RNA, 19 nt, Homo sapiens
aacauaagccugcucguaa

SEQ ID NO: 80503 - RNA, 19 nt, Homo sapiens
ucaagaauaccuccuuaug

SEQ ID NO: 80504 - RNA, 19 nt, Homo sapiens
gaauuaugcguaacuaucu

SEQ ID NO: 80505 - RNA, 19 nt, Homo sapiens
ggaccuaugcaauuacaug

SEQ ID NO: 80506 - RNA, 19 nt, Homo sapiens
gggaaacuguaaaguagag

SEQ ID NO: 80507 - RNA, 19 nt, Homo sapiens
gagcaagcccaaauguguu

SEQ ID NO: 80508 - RNA, 19 nt, Homo sapiens
gcucagggauuuuauuuca

SEQ ID NO: 80509 - RNA, 19 nt, Homo sapiens
uaugaacaugggcaaauua

SEQ ID NO: 80510 - RNA, 19 nt, Homo sapiens
acacaucuggguucaaauu

SEQ ID NO: 80511 - RNA, 19 nt, Homo sapiens
aaugggaaacuguaaagua

SEQ ID NO: 80512 - RNA, 19 nt, Homo sapiens
uacacaggcuacccgauuu

SEQ ID NO: 80513 - RNA, 19 nt, Homo sapiens
gaaacuguaaaguagagaa

SEQ ID NO: 80514 - RNA, 19 nt, Homo sapiens
ggaccagaagagcugaaua

SEQ ID NO: 80515 - RNA, 19 nt, Homo sapiens
ggguauggaaggacagaua

SEQ ID NO: 80516 - RNA, 19 nt, Homo sapiens
aagaauaaggccuuuagaa

SEQ ID NO: 80517 - RNA, 19 nt, Homo sapiens
cuacacaggcuacccgauu

SEQ ID NO: 80518 - RNA, 19 nt, Homo sapiens
gaaggacagauauauuucu

SEQ ID NO: 80519 - RNA, 19 nt, Homo sapiens
ccagaagagcugaauacuu

SEQ ID NO: 80520 - RNA, 19 nt, Homo sapiens
cugagagcaugaauauuug

SEQ ID NO: 80521 - RNA, 19 nt, Homo sapiens
auucugaaacugucacuua

SEQ ID NO: 80522 - RNA, 19 nt, Homo sapiens
uuuagaaucugacacaucu

SEQ ID NO: 80523 - RNA, 19 nt, Homo sapiens
caccuacuccauugcuuua

SEQ ID NO: 80524 - RNA, 19 nt, Homo sapiens
gaucaccagauuaucagaa

SEQ ID NO: 80525 - RNA, 19 nt, Homo sapiens
aaauggaucaccagauuau

SEQ ID NO: 80526 - RNA, 19 nt, Homo sapiens
ucacacaugcccugauaug

SEQ ID NO: 80527 - RNA, 19 nt, Homo sapiens
guauggaaggacagauaua

SEQ ID NO: 80528 - RNA, 19 nt, Homo sapiens
gaccagaagagcugaauac

SEQ ID NO: 80529 - RNA, 19 nt, Homo sapiens
caaacucaggagaacauaa

SEQ ID NO: 80530 - RNA, 19 nt, Homo sapiens
gaauaccuccuuaugaaaa

SEQ ID NO: 80531 - RNA, 19 nt, Homo sapiens
ucaccggaccuaugcaauu

SEQ ID NO: 80532 - RNA, 19 nt, Homo sapiens
acuguaaaguagagaacua

SEQ ID NO: 80533 - RNA, 19 nt, Homo sapiens
gacaaugggaaacuguaaa

SEQ ID NO: 80534 - RNA, 19 nt, Homo sapiens
gagcuucacccacaaacuc

SEQ ID NO: 80535 - RNA, 19 nt, Homo sapiens
caucuggguucaaauucug

SEQ ID NO: 80536 - RNA, 19 nt, Homo sapiens
ggaaggaaggcgguauaau

SEQ ID NO: 80537 - RNA, 19 nt, Homo sapiens
agacagagcucacaauaaa

SEQ ID NO: 80538 - RNA, 19 nt, Homo sapiens
ggccagagcuucuuuguga

SEQ ID NO: 80539 - RNA, 19 nt, Homo sapiens
ggacaagacucuaugaaag

SEQ ID NO: 80540 - RNA, 19 nt, Homo sapiens
ggacagaaacgaaguagaa

SEQ ID NO: 80541 - RNA, 19 nt, Homo sapiens
aauaagaacugcacacuga

SEQ ID NO: 80542 - RNA, 19 nt, Homo sapiens
ggagacagagcucacaaua

SEQ ID NO: 80543 - RNA, 19 nt, Homo sapiens
gaugggaccucgcugaaga

SEQ ID NO: 80544 - RNA, 19 nt, Homo sapiens
ccaauccucuuccaacaaa

SEQ ID NO: 80545 - RNA, 19 nt, Homo sapiens
ggaccucgcugaagaagca

SEQ ID NO: 80546 - RNA, 19 nt, Homo sapiens
cuaaauaccugcccugaca

SEQ ID NO: 80547 - RNA, 19 nt, Homo sapiens
ugaagaagcagaauacauu

SEQ ID NO: 80548 - RNA, 19 nt, Homo sapiens
gaaauggauggaacgaaua

SEQ ID NO: 80549 - RNA, 19 nt, Homo sapiens
gcugucaggucuccaauga

SEQ ID NO: 80550 - RNA, 19 nt, Homo sapiens
aaagaaagccagcugaauu

SEQ ID NO: 80551 - RNA, 19 nt, Homo sapiens
cgaauauuaugcccaguuu

SEQ ID NO: 80552 - RNA, 19 nt, Homo sapiens
gugcaacccugaccuguga

SEQ ID NO: 80553 - RNA, 19 nt, Homo sapiens
gaacgaauacaccucaaug

SEQ ID NO: 80554 - RNA, 19 nt, Homo sapiens
ccaagaaggugaccacagu

SEQ ID NO: 80555 - RNA, 19 nt, Homo sapiens
caacaaauuacacguggua

SEQ ID NO: 80556 - RNA, 19 nt, Homo sapiens
gaagucaagucgaguuucu

SEQ ID NO: 80557 - RNA, 19 nt, Homo sapiens
gcucagaugccacuucaaa

SEQ ID NO: 80558 - RNA, 19 nt, Homo sapiens
gaagauggcauuagcuaca

SEQ ID NO: 80559 - RNA, 19 nt, Homo sapiens
gaaggugaccacagugauu

SEQ ID NO: 80560 - RNA, 19 nt, Homo sapiens
gaacgucauuccagauuuu

SEQ ID NO: 80561 - RNA, 19 nt, Homo sapiens
gagaugaacauaccacgaa

SEQ ID NO: 80562 - RNA, 19 nt, Homo sapiens
ccagcucccuccagaaauu

SEQ ID NO: 80563 - RNA, 19 nt, Homo sapiens
gaaguuugaugggacaaga

SEQ ID NO: 80564 - RNA, 19 nt, Homo sapiens
caagaacaccucgaaguuu

SEQ ID NO: 80565 - RNA, 19 nt, Homo sapiens
ggaaagaaagccagcugaa

SEQ ID NO: 80566 - RNA, 19 nt, Homo sapiens
agaaauggauggaacgaau

SEQ ID NO: 80567 - RNA, 19 nt, Homo sapiens
gagacagagcucacaauaa

SEQ ID NO: 80568 - RNA, 19 nt, Homo sapiens
cagaagaugcugggaguua

SEQ ID NO: 80569 - RNA, 19 nt, Homo sapiens
gaaagaaagccagcugaau

SEQ ID NO: 80570 - RNA, 19 nt, Homo sapiens
guaacuacaauuccaguaa

SEQ ID NO: 80571 - RNA, 19 nt, Homo sapiens
aagaacaccucgaaguuug

SEQ ID NO: 80572 - RNA, 19 nt, Homo sapiens
ccagaaaucaucuaaauac

SEQ ID NO: 80573 - RNA, 19 nt, Homo sapiens
cagugacccuuuccuguaa

SEQ ID NO: 80574 - RNA, 19 nt, Homo sapiens
gggacaagacucuaugaaa

SEQ ID NO: 80575 - RNA, 19 nt, Homo sapiens
caaugugacuucucaagca

SEQ ID NO: 80576 - RNA, 19 nt, Homo sapiens
ugaccugcuugcugaauuu

SEQ ID NO: 80577 - RNA, 19 nt, Homo sapiens
gagaacgucauuccagauu

SEQ ID NO: 80578 - RNA, 19 nt, Homo sapiens
gccagaagcugagauugga

SEQ ID NO: 80579 - RNA, 19 nt, Homo sapiens
ggucacuuauucagcauug

SEQ ID NO: 80580 - RNA, 19 nt, Homo sapiens
aagaaagccagcugaauuu

SEQ ID NO: 80581 - RNA, 19 nt, Homo sapiens
gauggaagauggcauuagc

SEQ ID NO: 80582 - RNA, 19 nt, Homo sapiens
gagauucacucuggaaacu

SEQ ID NO: 80583 - RNA, 19 nt, Homo sapiens
ggagacacagugacccuuu

SEQ ID NO: 80584 - RNA, 19 nt, Homo sapiens
guaccacaaugggaaagaa

SEQ ID NO: 80585 - RNA, 19 nt, Homo sapiens
ggaugcagaugggaaguuc

SEQ ID NO: 80586 - RNA, 19 nt, Homo sapiens
acccagaaaucaucuaaau

SEQ ID NO: 80587 - RNA, 19 nt, Homo sapiens
cuacagagcccuagauggu

SEQ ID NO: 80588 - RNA, 19 nt, Homo sapiens
gcacaaaggaugggaaggu

SEQ ID NO: 80589 - RNA, 19 nt, Homo sapiens
acaagaacaccucgaaguu

SEQ ID NO: 80590 - RNA, 19 nt, Homo sapiens
ucagaugccacuucaaaga

SEQ ID NO: 80591 - RNA, 19 nt, Homo sapiens
uaacuacaauuccaguaac

SEQ ID NO: 80592 - RNA, 19 nt, Homo sapiens
gaugcagaguccucagaga

SEQ ID NO: 80593 - RNA, 19 nt, Homo sapiens
gagacacagugacccuuuc

SEQ ID NO: 80594 - RNA, 19 nt, Homo sapiens
gagacaagaauaagaacug

SEQ ID NO: 80595 - RNA, 19 nt, Homo sapiens
ggaaagcuucauccuguuc

SEQ ID NO: 80596 - RNA, 19 nt, Homo sapiens
agaacgucauuccagauuu

SEQ ID NO: 80597 - RNA, 19 nt, Homo sapiens
gaaaguccacaucccaaag

SEQ ID NO: 80598 - RNA, 19 nt, Homo sapiens
agaugccacuucaaagaaa

SEQ ID NO: 80599 - RNA, 19 nt, Homo sapiens
gcuccugguucuagaauac

SEQ ID NO: 80600 - RNA, 19 nt, Homo sapiens
gcacacacacacacacaca

SEQ ID NO: 80601 - RNA, 19 nt, Homo sapiens
ucagcacccuuacugucua

SEQ ID NO: 80602 - RNA, 19 nt, Homo sapiens
gaaggacagaggagaaagu

SEQ ID NO: 80603 - RNA, 19 nt, Homo sapiens
ggccaauccucuuccaaca

SEQ ID NO: 80604 - RNA, 19 nt, Homo sapiens
gcaugucacuggccaaucc

SEQ ID NO: 80605 - RNA, 19 nt, Homo sapiens
gggaaggucggaagaagug

SEQ ID NO: 80606 - RNA, 19 nt, Homo sapiens
cgaauacaccucaaugucu

SEQ ID NO: 80607 - RNA, 19 nt, Homo sapiens
cacaaaggaugggaagguu

SEQ ID NO: 80608 - RNA, 19 nt, Homo sapiens
uccacaauccugaguauaa

SEQ ID NO: 80609 - RNA, 19 nt, Homo sapiens
gauuggagccggugaaggu

SEQ ID NO: 80610 - RNA, 19 nt, Homo sapiens
guuccacaauccugaguau

SEQ ID NO: 80611 - RNA, 19 nt, Homo sapiens
cagaugccacuucaaagaa

SEQ ID NO: 80612 - RNA, 19 nt, Homo sapiens
ggacuccggguuugagaug

SEQ ID NO: 80613 - RNA, 19 nt, Homo sapiens
gaucugacauccccacuca

SEQ ID NO: 80614 - RNA, 19 nt, Homo sapiens
caagugggcgacuaugaga

SEQ ID NO: 80615 - RNA, 19 nt, Homo sapiens
ccuccaaugugacuucuca

SEQ ID NO: 80616 - RNA, 19 nt, Homo sapiens
gguauccgauccaauugca

SEQ ID NO: 80617 - RNA, 19 nt, Homo sapiens
aaagccagcugaauuuuga

SEQ ID NO: 80618 - RNA, 19 nt, Homo sapiens
gguuugagauggacacacu

SEQ ID NO: 80619 - RNA, 19 nt, Homo sapiens
uggccuggcuucuccuuug

SEQ ID NO: 80620 - RNA, 19 nt, Homo sapiens
ggugaacaacuccauagga

SEQ ID NO: 80621 - RNA, 19 nt, Homo sapiens
gaaggucggaagaaguguu

SEQ ID NO: 80622 - RNA, 19 nt, Homo sapiens
ccacaauccugaguauaac

SEQ ID NO: 80623 - RNA, 19 nt, Homo sapiens
gacagaaacgaaguagaaa

SEQ ID NO: 80624 - RNA, 19 nt, Homo sapiens
gaaaauguggacuauguga

SEQ ID NO: 80625 - RNA, 19 nt, Homo sapiens
acaccugguuugacuggaa

SEQ ID NO: 80626 - RNA, 19 nt, Homo sapiens
gaagaugcugggaguuaca

SEQ ID NO: 80627 - RNA, 19 nt, Homo sapiens
ccaguauccucccaagaag

SEQ ID NO: 80628 - RNA, 19 nt, Homo sapiens
gggaaggacagaggagaaa

SEQ ID NO: 80629 - RNA, 19 nt, Homo sapiens
caagucgaguuucuuugca

SEQ ID NO: 80630 - RNA, 19 nt, Homo sapiens
gggaagucaagucgaguuu

SEQ ID NO: 80631 - RNA, 19 nt, Homo sapiens
guccaagacugagaaaugg

SEQ ID NO: 80632 - RNA, 19 nt, Homo sapiens
gaacugcacacugaguauc

SEQ ID NO: 80633 - RNA, 19 nt, Homo sapiens
aagaaaauguggacuaugu

SEQ ID NO: 80634 - RNA, 19 nt, Homo sapiens
cgagaaggagacacaguga

SEQ ID NO: 80635 - RNA, 19 nt, Homo sapiens
ccacaaugggaaagaaaug

SEQ ID NO: 80636 - RNA, 19 nt, Homo sapiens
ggaacgaauacaccucaau

SEQ ID NO: 80637 - RNA, 19 nt, Homo sapiens
gaauguggcuugagaaaua

SEQ ID NO: 80638 - RNA, 19 nt, Homo sapiens
ugagaaauauggacacuua

SEQ ID NO: 80639 - RNA, 19 nt, Homo sapiens
guaaaggagucaaacuaua

SEQ ID NO: 80640 - RNA, 19 nt, Homo sapiens
gaugaugaaugccaauauu

SEQ ID NO: 80641 - RNA, 19 nt, Homo sapiens
ggaauugauuugcauugaa

SEQ ID NO: 80642 - RNA, 19 nt, Homo sapiens
gauauacucuagaugaaug

SEQ ID NO: 80643 - RNA, 19 nt, Homo sapiens
ccagaaugcuguacaucua

SEQ ID NO: 80644 - RNA, 19 nt, Homo sapiens
aaugaacacucuugcuuua

SEQ ID NO: 80645 - RNA, 19 nt, Homo sapiens
gaacugaacucacuuuccu

SEQ ID NO: 80646 - RNA, 19 nt, Homo sapiens
gaacgacaaacuguaaaua

SEQ ID NO: 80647 - RNA, 19 nt, Homo sapiens
aaacaacuauggaucagaa

SEQ ID NO: 80648 - RNA, 19 nt, Homo sapiens
gauuugacauugcauuuga

SEQ ID NO: 80649 - RNA, 19 nt, Homo sapiens
gaacacucuugcuuuauuc

SEQ ID NO: 80650 - RNA, 19 nt, Homo sapiens
ucagaucaguguaccauuu

SEQ ID NO: 80651 - RNA, 19 nt, Homo sapiens
acaaacagaucgaacaguu

SEQ ID NO: 80652 - RNA, 19 nt, Homo sapiens
cgacggcacuaauuuaaug

SEQ ID NO: 80653 - RNA, 19 nt, Homo sapiens
aaacaggucuucaucgaau

SEQ ID NO: 80654 - RNA, 19 nt, Homo sapiens
gaaugaacacucuugcuuu

SEQ ID NO: 80655 - RNA, 19 nt, Homo sapiens
ugaacacucuugcuuuauu

SEQ ID NO: 80656 - RNA, 19 nt, Homo sapiens
gaucagaauagcaacauuu

SEQ ID NO: 80657 - RNA, 19 nt, Homo sapiens
gagcaacucuugauuaucc

SEQ ID NO: 80658 - RNA, 19 nt, Homo sapiens
ccaaguagcugggauuaca

SEQ ID NO: 80659 - RNA, 19 nt, Homo sapiens
gaccacgacuaauuucaaa

SEQ ID NO: 80660 - RNA, 19 nt, Homo sapiens
gggcaaugaugaaugagaa

SEQ ID NO: 80661 - RNA, 19 nt, Homo sapiens
ccagggcaaugaugaauga

SEQ ID NO: 80662 - RNA, 19 nt, Homo sapiens
guuaagacaugauuuccuu

SEQ ID NO: 80663 - RNA, 19 nt, Homo sapiens
gcauugaccacgacuaauu

SEQ ID NO: 80664 - RNA, 19 nt, Homo sapiens
ggucacacacugaugcuua

SEQ ID NO: 80665 - RNA, 19 nt, Homo sapiens
gcagauuuauuccagugaa

SEQ ID NO: 80666 - RNA, 19 nt, Homo sapiens
uaaaucugcuggaguuuca

SEQ ID NO: 80667 - RNA, 19 nt, Homo sapiens
uauuaaaucugcuggaguu

SEQ ID NO: 80668 - RNA, 19 nt, Homo sapiens
ggagucaaacuauaaauca

SEQ ID NO: 80669 - RNA, 19 nt, Homo sapiens
gacaugauuuccuugaaug

SEQ ID NO: 80670 - RNA, 19 nt, Homo sapiens
cagaauagcaacauuuaga

SEQ ID NO: 80671 - RNA, 19 nt, Homo sapiens
gaacaugugagagguuuga

SEQ ID NO: 80672 - RNA, 19 nt, Homo sapiens
gaauugauuugcauugaac

SEQ ID NO: 80673 - RNA, 19 nt, Homo sapiens
guacaucuauuuuggauug

SEQ ID NO: 80674 - RNA, 19 nt, Homo sapiens
ggacaugggcagagcaaug

SEQ ID NO: 80675 - RNA, 19 nt, Homo sapiens
gaagacuggaagcuaauuu

SEQ ID NO: 80676 - RNA, 19 nt, Homo sapiens
ggaguuucauguacaagau

SEQ ID NO: 80677 - RNA, 19 nt, Homo sapiens
gauuguauauugugguugu

SEQ ID NO: 80678 - RNA, 19 nt, Homo sapiens
gcuaaacggauuccaaaga

SEQ ID NO: 80679 - RNA, 19 nt, Homo sapiens
ccuaucaccuguuuccauu

SEQ ID NO: 80680 - RNA, 19 nt, Homo sapiens
gaaauaaaggaugggauug

SEQ ID NO: 80681 - RNA, 19 nt, Homo sapiens
augcuuagauguuccagua

SEQ ID NO: 80682 - RNA, 19 nt, Homo sapiens
ggaagcuaauuugcauaaa

SEQ ID NO: 80683 - RNA, 19 nt, Homo sapiens
ucaaguauuugggaaguga

SEQ ID NO: 80684 - RNA, 19 nt, Homo sapiens
aaacggauuccaaagagua

SEQ ID NO: 80685 - RNA, 19 nt, Homo sapiens
gacauugcauuugaccuuu

SEQ ID NO: 80686 - RNA, 19 nt, Homo sapiens
ggaacaaacagaucgaaca

SEQ ID NO: 80687 - RNA, 19 nt, Homo sapiens
ccaaagugcugggauuaca

SEQ ID NO: 80688 - RNA, 19 nt, Homo sapiens
caacuaaugccaccaccaa

SEQ ID NO: 80689 - RNA, 19 nt, Homo sapiens
gauuauccauauugaguca

SEQ ID NO: 80690 - RNA, 19 nt, Homo sapiens
gguuguguauuuacgcuuu

SEQ ID NO: 80691 - RNA, 19 nt, Homo sapiens
gcuuagauguuccaguaau

SEQ ID NO: 80692 - RNA, 19 nt, Homo sapiens
agacaggguuucaccaugu

SEQ ID NO: 80693 - RNA, 19 nt, Homo sapiens
agugaagacuggaagcuaa

SEQ ID NO: 80694 - RNA, 19 nt, Homo sapiens
ccaucgaucuauuuauaug

SEQ ID NO: 80695 - RNA, 19 nt, Homo sapiens
agacaugauuuccuugaau

SEQ ID NO: 80696 - RNA, 19 nt, Homo sapiens
gaacaaacagaucgaacag

SEQ ID NO: 80697 - RNA, 19 nt, Homo sapiens
caacaagagcacuacauuc

SEQ ID NO: 80698 - RNA, 19 nt, Homo sapiens
cugagcaacucuugauuau

SEQ ID NO: 80699 - RNA, 19 nt, Homo sapiens
ccugagcaacucuugauua

SEQ ID NO: 80700 - RNA, 19 nt, Homo sapiens
uguaauuccucaacguauu

SEQ ID NO: 80701 - RNA, 19 nt, Homo sapiens
gaagaacaugugagagguu

SEQ ID NO: 80702 - RNA, 19 nt, Homo sapiens
acgcuuugauucauaguaa

SEQ ID NO: 80703 - RNA, 19 nt, Homo sapiens
ggaucagaauagcaacauu

SEQ ID NO: 80704 - RNA, 19 nt, Homo sapiens
cuaaacggauuccaaagag

SEQ ID NO: 80705 - RNA, 19 nt, Homo sapiens
gccgauauacucuagauga

SEQ ID NO: 80706 - RNA, 19 nt, Homo sapiens
gggcuugauucugcaguaa

SEQ ID NO: 80707 - RNA, 19 nt, Homo sapiens
ccaaauggcgucuggaagu

SEQ ID NO: 80708 - RNA, 19 nt, Homo sapiens
gaagcuacuguguguguga

SEQ ID NO: 80709 - RNA, 19 nt, Homo sapiens
ucaacaagagcacuacauu

SEQ ID NO: 80710 - RNA, 19 nt, Homo sapiens
ccgauauacucuagaugaa

SEQ ID NO: 80711 - RNA, 19 nt, Homo sapiens
agaaauaaaggaugggauu

SEQ ID NO: 80712 - RNA, 19 nt, Homo sapiens
ugagagguuugacuagaug

SEQ ID NO: 80713 - RNA, 19 nt, Homo sapiens
gcuugauucugcaguaaau

SEQ ID NO: 80714 - RNA, 19 nt, Homo sapiens
uuacauuguugagcuauug

SEQ ID NO: 80715 - RNA, 19 nt, Homo sapiens
gaaacaacaacuggaacuu

SEQ ID NO: 80716 - RNA, 19 nt, Homo sapiens
agaaugcuguacaucuauu

SEQ ID NO: 80717 - RNA, 19 nt, Homo sapiens
ugaaugaacacucuugcuu

SEQ ID NO: 80718 - RNA, 19 nt, Homo sapiens
acacacugaugcuuagaug

SEQ ID NO: 80719 - RNA, 19 nt, Homo sapiens
cagauuuauuccagugaaa

SEQ ID NO: 80720 - RNA, 19 nt, Homo sapiens
gacaggguuucaccauguu

SEQ ID NO: 80721 - RNA, 19 nt, Homo sapiens
uaucaccuguuuccauuca

SEQ ID NO: 80722 - RNA, 19 nt, Homo sapiens
guaauuccucaacguauug

SEQ ID NO: 80723 - RNA, 19 nt, Homo sapiens
uauggacacuuaauacuac

SEQ ID NO: 80724 - RNA, 19 nt, Homo sapiens
gugagagguuugacuagau

SEQ ID NO: 80725 - RNA, 19 nt, Homo sapiens
uguugagaaucccaaauuu

SEQ ID NO: 80726 - RNA, 19 nt, Homo sapiens
guauuuacgcuuugauuca

SEQ ID NO: 80727 - RNA, 19 nt, Homo sapiens
aacaacaacuggaacuuca

SEQ ID NO: 80728 - RNA, 19 nt, Homo sapiens
uagcuaaacggauuccaaa

SEQ ID NO: 80729 - RNA, 19 nt, Homo sapiens
aagaacaugugagagguuu

SEQ ID NO: 80730 - RNA, 19 nt, Homo sapiens
cuacuaauuccacaccuuu

SEQ ID NO: 80731 - RNA, 19 nt, Homo sapiens
caaauggcgucuggaaguc

SEQ ID NO: 80732 - RNA, 19 nt, Homo sapiens
gaaugcuguacaucuauuu

SEQ ID NO: 80733 - RNA, 19 nt, Homo sapiens
aaucuaauauggccacagu

SEQ ID NO: 80734 - RNA, 19 nt, Homo sapiens
acacugaugcuuagauguu

SEQ ID NO: 80735 - RNA, 19 nt, Homo sapiens
gcaguggugcgaucucaga

SEQ ID NO: 80736 - RNA, 19 nt, Homo sapiens
uaagacaugauuuccuuga

SEQ ID NO: 80737 - RNA, 19 nt, Homo sapiens
gaucuucucuggaauguuc

SEQ ID NO: 80738 - RNA, 19 nt, Homo sapiens
ccacuuaccuuaugucagu

SEQ ID NO: 80739 - RNA, 19 nt, Homo sapiens
ggagguugcugcuaugaga

SEQ ID NO: 80740 - RNA, 19 nt, Homo sapiens
gcagggacgaggacaaaua

SEQ ID NO: 80741 - RNA, 19 nt, Homo sapiens
gaaaggcugcucaguguga

SEQ ID NO: 80742 - RNA, 19 nt, Homo sapiens
uagaaaggcugcucagugu

SEQ ID NO: 80743 - RNA, 19 nt, Homo sapiens
caucaacgaaggaaauaua

SEQ ID NO: 80744 - RNA, 19 nt, Homo sapiens
cgaaggaaauauagaucaa

SEQ ID NO: 80745 - RNA, 19 nt, Homo sapiens
cccaagagcugcccagaga

SEQ ID NO: 80746 - RNA, 19 nt, Homo sapiens
gcgaaagacccacaugcua

SEQ ID NO: 80747 - RNA, 19 nt, Homo sapiens
ucagugugauccuugcaua

SEQ ID NO: 80748 - RNA, 19 nt, Homo sapiens
gaaggacugugaccagcau

SEQ ID NO: 80749 - RNA, 19 nt, Homo sapiens
uagagauucugccuucaaa

SEQ ID NO: 80750 - RNA, 19 nt, Homo sapiens
gcagagccuugucguuaca

SEQ ID NO: 80751 - RNA, 19 nt, Homo sapiens
caacgaaggaaauauagau

SEQ ID NO: 80752 - RNA, 19 nt, Homo sapiens
guucgcaacugcaccauca

SEQ ID NO: 80753 - RNA, 19 nt, Homo sapiens
gagugugccugucgcaaug

SEQ ID NO: 80754 - RNA, 19 nt, Homo sapiens
gaaagacccacaugcuaca

SEQ ID NO: 80755 - RNA, 19 nt, Homo sapiens
cugcagagccuugucguua

SEQ ID NO: 80756 - RNA, 19 nt, Homo sapiens
uaacucuggucuucucguu

SEQ ID NO: 80757 - RNA, 19 nt, Homo sapiens
ggacgaggacaaauaugga

SEQ ID NO: 80758 - RNA, 19 nt, Homo sapiens
cuugugaucuucucuggaa

SEQ ID NO: 80759 - RNA, 19 nt, Homo sapiens
caggacagcugggcacaug

SEQ ID NO: 80760 - RNA, 19 nt, Homo sapiens
caacugggcacagaaagga

SEQ ID NO: 80761 - RNA, 19 nt, Homo sapiens
cagaugaccacccugcaaa

SEQ ID NO: 80762 - RNA, 19 nt, Homo sapiens
aagcugugcugccagaugu

SEQ ID NO: 80763 - RNA, 19 nt, Homo sapiens
cuacugggcucagggaaag

SEQ ID NO: 80764 - RNA, 19 nt, Homo sapiens
caaaauaaagugacagaug

SEQ ID NO: 80765 - RNA, 19 nt, Homo sapiens
agacccacaugcuacaaga

SEQ ID NO: 80766 - RNA, 19 nt, Homo sapiens
ccaggaggauuaccgaaaa

SEQ ID NO: 80767 - RNA, 19 nt, Homo sapiens
cuacaagacgggcaaaaua

SEQ ID NO: 80768 - RNA, 19 nt, Homo sapiens
gcagucccauccucuuguc

SEQ ID NO: 80769 - RNA, 19 nt, Homo sapiens
ggacugugaccagcauaga

SEQ ID NO: 80770 - RNA, 19 nt, Homo sapiens
cgaggacaaauauggauga

SEQ ID NO: 80771 - RNA, 19 nt, Homo sapiens
cagcaacugggcacagaaa

SEQ ID NO: 80772 - RNA, 19 nt, Homo sapiens
ccacccacuuaccuuaugu

SEQ ID NO: 80773 - RNA, 19 nt, Homo sapiens
cagggacgaggacaaauau

SEQ ID NO: 80774 - RNA, 19 nt, Homo sapiens
gggacgaggacaaauaugg

SEQ ID NO: 80775 - RNA, 19 nt, Homo sapiens
ggacagcugggcacaugca

SEQ ID NO: 80776 - RNA, 19 nt, Homo sapiens
gcccagagaggcacuacug

SEQ ID NO: 80777 - RNA, 19 nt, Homo sapiens
aaacagccacaauagagau

SEQ ID NO: 80778 - RNA, 19 nt, Homo sapiens
uuuauucgcauccuuguga

SEQ ID NO: 80779 - RNA, 19 nt, Homo sapiens
caccaucacugccaaugcu

SEQ ID NO: 80780 - RNA, 19 nt, Homo sapiens
gcacuguaacucuggucuu

SEQ ID NO: 80781 - RNA, 19 nt, Homo sapiens
ugagagcugucggcacugu

SEQ ID NO: 80782 - RNA, 19 nt, Homo sapiens
gcaacugggcacagaaagg

SEQ ID NO: 80783 - RNA, 19 nt, Homo sapiens
cacuguaacucuggucuuc

SEQ ID NO: 80784 - RNA, 19 nt, Homo sapiens
cacacuuccugcugcgaaa

SEQ ID NO: 80785 - RNA, 19 nt, Homo sapiens
gaggacaaauauggaugag

SEQ ID NO: 80786 - RNA, 19 nt, Homo sapiens
gaucaaacaaaggagaaag

SEQ ID NO: 80787 - RNA, 19 nt, Homo sapiens
gugaucuucucuggaaugu

SEQ ID NO: 80788 - RNA, 19 nt, Homo sapiens
agugugauccucuuccaaa

SEQ ID NO: 80789 - RNA, 19 nt, Homo sapiens
gacugugaccagcauagaa

SEQ ID NO: 80790 - RNA, 19 nt, Homo sapiens
ucaacgaaggaaauauaga

SEQ ID NO: 80791 - RNA, 19 nt, Homo sapiens
uaccuuaugucagugagau

SEQ ID NO: 80792 - RNA, 19 nt, Homo sapiens
uagaucaaacaaaggagaa

SEQ ID NO: 80793 - RNA, 19 nt, Homo sapiens
gugcagcuccgauuuuauu

SEQ ID NO: 80794 - RNA, 19 nt, Homo sapiens
cgagugugauccucuucca

SEQ ID NO: 80795 - RNA, 19 nt, Homo sapiens
agagcugucggcacuguaa

SEQ ID NO: 80796 - RNA, 19 nt, Homo sapiens
acugugaccagcauagaaa

SEQ ID NO: 80797 - RNA, 19 nt, Homo sapiens
ugacagagcuggagaguuu

SEQ ID NO: 80798 - RNA, 19 nt, Homo sapiens
gaaagaauaugucaggaaa

SEQ ID NO: 80799 - RNA, 19 nt, Homo sapiens
gggaugaggugcuauaaua

SEQ ID NO: 80800 - RNA, 19 nt, Homo sapiens
gcucuuggcucucaacuua

SEQ ID NO: 80801 - RNA, 19 nt, Homo sapiens
ggaagucuguguuguauau

SEQ ID NO: 80802 - RNA, 19 nt, Homo sapiens
ccacguaguuccuauuuaa

SEQ ID NO: 80803 - RNA, 19 nt, Homo sapiens
acaaaugucucuuccuaua

SEQ ID NO: 80804 - RNA, 19 nt, Homo sapiens
gaagagagcaucagaguuc

SEQ ID NO: 80805 - RNA, 19 nt, Homo sapiens
ggaaagacuugaucuaugg

SEQ ID NO: 80806 - RNA, 19 nt, Homo sapiens
gcaagucacugcccaccua

SEQ ID NO: 80807 - RNA, 19 nt, Homo sapiens
ggaaagagcguccauagga

SEQ ID NO: 80808 - RNA, 19 nt, Homo sapiens
gaugaugguucuucaacua

SEQ ID NO: 80809 - RNA, 19 nt, Homo sapiens
guacuugggugcugaagaa

SEQ ID NO: 80810 - RNA, 19 nt, Homo sapiens
cugaagaacuguuggauuu

SEQ ID NO: 80811 - RNA, 19 nt, Homo sapiens
acaguggccuuuauuauuu

SEQ ID NO: 80812 - RNA, 19 nt, Homo sapiens
gcacagaaacaaagaagaa

SEQ ID NO: 80813 - RNA, 19 nt, Homo sapiens
gguuaagcaugccaauuua

SEQ ID NO: 80814 - RNA, 19 nt, Homo sapiens
gaaaagggauguuagcauu

SEQ ID NO: 80815 - RNA, 19 nt, Homo sapiens
gaaacuccgucuguacuaa

SEQ ID NO: 80816 - RNA, 19 nt, Homo sapiens
ucaugagacuucaguguua

SEQ ID NO: 80817 - RNA, 19 nt, Homo sapiens
ccaaacagauauuuacuuc

SEQ ID NO: 80818 - RNA, 19 nt, Homo sapiens
ugaguacugugaaggauua

SEQ ID NO: 80819 - RNA, 19 nt, Homo sapiens
uaaaagagauuuccuguga

SEQ ID NO: 80820 - RNA, 19 nt, Homo sapiens
uuacaaaugucucuuccua

SEQ ID NO: 80821 - RNA, 19 nt, Homo sapiens
ggaaggaggacgaauagaa

SEQ ID NO: 80822 - RNA, 19 nt, Homo sapiens
gagcuuuccuguuucauau

SEQ ID NO: 80823 - RNA, 19 nt, Homo sapiens
gggcucagcugcuccugua

SEQ ID NO: 80824 - RNA, 19 nt, Homo sapiens
gaggagauagccagcauua

SEQ ID NO: 80825 - RNA, 19 nt, Homo sapiens
cgaauagaauggaguaaug

SEQ ID NO: 80826 - RNA, 19 nt, Homo sapiens
gaaucacacuugagauguu

SEQ ID NO: 80827 - RNA, 19 nt, Homo sapiens
gaagaaaggcuaggaaauc

SEQ ID NO: 80828 - RNA, 19 nt, Homo sapiens
gaaaugagccacguaguuc

SEQ ID NO: 80829 - RNA, 19 nt, Homo sapiens
gaaauggcaguggcaaaua

SEQ ID NO: 80830 - RNA, 19 nt, Homo sapiens
ugaaggagcuuagguuuua

SEQ ID NO: 80831 - RNA, 19 nt, Homo sapiens
gauguuagcauucauuaga

SEQ ID NO: 80832 - RNA, 19 nt, Homo sapiens
ucaaagcaauaucagguaa

SEQ ID NO: 80833 - RNA, 19 nt, Homo sapiens
gaaaggcuaggaaaucauu

SEQ ID NO: 80834 - RNA, 19 nt, Homo sapiens
ggugagagcuccuuuacag

SEQ ID NO: 80835 - RNA, 19 nt, Homo sapiens
caaaguggguuguggaaag

SEQ ID NO: 80836 - RNA, 19 nt, Homo sapiens
ggagggauaggaagacaua

SEQ ID NO: 80837 - RNA, 19 nt, Homo sapiens
caacugugaugggaaauug

SEQ ID NO: 80838 - RNA, 19 nt, Homo sapiens
gacuugaucuaugguaaua

SEQ ID NO: 80839 - RNA, 19 nt, Homo sapiens
gaagugagaauacugugaa

SEQ ID NO: 80840 - RNA, 19 nt, Homo sapiens
cccagcagcuucagguuua

SEQ ID NO: 80841 - RNA, 19 nt, Homo sapiens
gcaaugcuuucauaguuuc

SEQ ID NO: 80842 - RNA, 19 nt, Homo sapiens
aaagaugaaucacacuuga

SEQ ID NO: 80843 - RNA, 19 nt, Homo sapiens
gaugguucuucaacuauaa

SEQ ID NO: 80844 - RNA, 19 nt, Homo sapiens
guucaagucucguuaguag

SEQ ID NO: 80845 - RNA, 19 nt, Homo sapiens
ucacugcucuggauaggaa

SEQ ID NO: 80846 - RNA, 19 nt, Homo sapiens
gaaacaagauuuuggugaa

SEQ ID NO: 80847 - RNA, 19 nt, Homo sapiens
caacuuauucccuucaauu

SEQ ID NO: 80848 - RNA, 19 nt, Homo sapiens
gcacacagaguucuucaau

SEQ ID NO: 80849 - RNA, 19 nt, Homo sapiens
gaagaacuguuggauuuac

SEQ ID NO: 80850 - RNA, 19 nt, Homo sapiens
gguaaggccugacccugaa

SEQ ID NO: 80851 - RNA, 19 nt, Homo sapiens
gaaggaggacgaauagaau

SEQ ID NO: 80852 - RNA, 19 nt, Homo sapiens
gcaggugcgucuuucaguu

SEQ ID NO: 80853 - RNA, 19 nt, Homo sapiens
gaccaaauaucaagaucau

SEQ ID NO: 80854 - RNA, 19 nt, Homo sapiens
ggguuaagcaugccaauuu

SEQ ID NO: 80855 - RNA, 19 nt, Homo sapiens
aaauggcaguggcaaauaa

SEQ ID NO: 80856 - RNA, 19 nt, Homo sapiens
gagauaaugguuacaaaug

SEQ ID NO: 80857 - RNA, 19 nt, Homo sapiens
caacaacaacaacaacaaa

SEQ ID NO: 80858 - RNA, 19 nt, Homo sapiens
gggauaggaagacauauuu

SEQ ID NO: 80859 - RNA, 19 nt, Homo sapiens
guaacaguggccuuuauua

SEQ ID NO: 80860 - RNA, 19 nt, Homo sapiens
cuccagaauuuguauguua

SEQ ID NO: 80861 - RNA, 19 nt, Homo sapiens
uuaaagagaccaaguguau

SEQ ID NO: 80862 - RNA, 19 nt, Homo sapiens
ggacgaauagaauggagua

SEQ ID NO: 80863 - RNA, 19 nt, Homo sapiens
caauaucacugcucuggau

SEQ ID NO: 80864 - RNA, 19 nt, Homo sapiens
aaccuuagcugcaaguauu

SEQ ID NO: 80865 - RNA, 19 nt, Homo sapiens
gagagcaucagaguucuua

SEQ ID NO: 80866 - RNA, 19 nt, Homo sapiens
guacugugaaggauuauuu

SEQ ID NO: 80867 - RNA, 19 nt, Homo sapiens
aaauaguucuccuacauga

SEQ ID NO: 80868 - RNA, 19 nt, Homo sapiens
gaaccauuauccaugugaa

SEQ ID NO: 80869 - RNA, 19 nt, Homo sapiens
gcacaguuggucucuuuaa

SEQ ID NO: 80870 - RNA, 19 nt, Homo sapiens
uaaggucacuuuaugucaa

SEQ ID NO: 80871 - RNA, 19 nt, Homo sapiens
ggauaggaagacauauuua

SEQ ID NO: 80872 - RNA, 19 nt, Homo sapiens
gcacaucucagucaagcaa

SEQ ID NO: 80873 - RNA, 19 nt, Homo sapiens
gucauuugcugcuauuauu

SEQ ID NO: 80874 - RNA, 19 nt, Homo sapiens
gauaaugguuacaaauguc

SEQ ID NO: 80875 - RNA, 19 nt, Homo sapiens
gcagugagccgagauagug

SEQ ID NO: 80876 - RNA, 19 nt, Homo sapiens
caggaugccuugugguuug

SEQ ID NO: 80877 - RNA, 19 nt, Homo sapiens
uaacaguggccuuuauuau

SEQ ID NO: 80878 - RNA, 19 nt, Homo sapiens
guucaacugugaugggaaa

SEQ ID NO: 80879 - RNA, 19 nt, Homo sapiens
ggagcuuuccuguuucaua

SEQ ID NO: 80880 - RNA, 19 nt, Homo sapiens
ccaggaggcugaggcauga

SEQ ID NO: 80881 - RNA, 19 nt, Homo sapiens
caacuuaccauguacuuag

SEQ ID NO: 80882 - RNA, 19 nt, Homo sapiens
gaaacaccuuuguccaagu

SEQ ID NO: 80883 - RNA, 19 nt, Homo sapiens
gcaaguauuccuacaaucu

SEQ ID NO: 80884 - RNA, 19 nt, Homo sapiens
gaagggaggaguaggaauc

SEQ ID NO: 80885 - RNA, 19 nt, Homo sapiens
gcagggaugaggugcuaua

SEQ ID NO: 80886 - RNA, 19 nt, Homo sapiens
aaauuaaacugggcaauag

SEQ ID NO: 80887 - RNA, 19 nt, Homo sapiens
ggagauagccagcauuagg

SEQ ID NO: 80888 - RNA, 19 nt, Homo sapiens
gaauagaauggaguaauga

SEQ ID NO: 80889 - RNA, 19 nt, Homo sapiens
ggcaguggcaaauaaauaa

SEQ ID NO: 80890 - RNA, 19 nt, Homo sapiens
gccaugugcugaggagaua

SEQ ID NO: 80891 - RNA, 19 nt, Homo sapiens
agacuucaguguuaauguu

SEQ ID NO: 80892 - RNA, 19 nt, Homo sapiens
gcaugccaauuuaaagaga

SEQ ID NO: 80893 - RNA, 19 nt, Homo sapiens
gagaaggaagggaggagua

SEQ ID NO: 80894 - RNA, 19 nt, Homo sapiens
ggagauaaugguuacaaau

SEQ ID NO: 80895 - RNA, 19 nt, Homo sapiens
gcacguagacuugguucaa

SEQ ID NO: 80896 - RNA, 19 nt, Homo sapiens
uaacaguucauuccaauca

SEQ ID NO: 80897 - RNA, 19 nt, Homo sapiens
agauuaagcugaacaguua

SEQ ID NO: 80898 - RNA, 19 nt, Homo sapiens
caucaaguauggacauuua

SEQ ID NO: 80899 - RNA, 19 nt, Homo sapiens
ucucagaaguggagucuua

SEQ ID NO: 80900 - RNA, 19 nt, Homo sapiens
caaacuggauuucaauaug

SEQ ID NO: 80901 - RNA, 19 nt, Homo sapiens
gcagcaaacuggauuucaa

SEQ ID NO: 80902 - RNA, 19 nt, Homo sapiens
gaagguagccuccgucauc

SEQ ID NO: 80903 - RNA, 19 nt, Homo sapiens
gaacaucaccauccaagug

SEQ ID NO: 80904 - RNA, 19 nt, Homo sapiens
cgucaucucuucugggaua

SEQ ID NO: 80905 - RNA, 19 nt, Homo sapiens
cuaauaaccucuccauugu

SEQ ID NO: 80906 - RNA, 19 nt, Homo sapiens
ggaaaugucgccucucuga

SEQ ID NO: 80907 - RNA, 19 nt, Homo sapiens
ucaugugucucaucaagua

SEQ ID NO: 80908 - RNA, 19 nt, Homo sapiens
gaaaguguacgcccuguau

SEQ ID NO: 80909 - RNA, 19 nt, Homo sapiens
caaccaagcaagagcauuu

SEQ ID NO: 80910 - RNA, 19 nt, Homo sapiens
gaaggaggaaugagagauu

SEQ ID NO: 80911 - RNA, 19 nt, Homo sapiens
ccaaggaagugaaagaagu

SEQ ID NO: 80912 - RNA, 19 nt, Homo sapiens
guccauaccucaauuucuu

SEQ ID NO: 80913 - RNA, 19 nt, Homo sapiens
gaagugcccuggucuuacu

SEQ ID NO: 80914 - RNA, 19 nt, Homo sapiens
gaaacuaaauccacaaccu

SEQ ID NO: 80915 - RNA, 19 nt, Homo sapiens
ggaaaauggagaagaauua

SEQ ID NO: 80916 - RNA, 19 nt, Homo sapiens
ggaacacccuccaaucucu

SEQ ID NO: 80917 - RNA, 19 nt, Homo sapiens
gcugaacaguuacaagaug

SEQ ID NO: 80918 - RNA, 19 nt, Homo sapiens
ggaauacaaccaagcaaga

SEQ ID NO: 80919 - RNA, 19 nt, Homo sapiens
gcaaacuggauuucaauau

SEQ ID NO: 80920 - RNA, 19 nt, Homo sapiens
gggaacaccuggcugaagu

SEQ ID NO: 80921 - RNA, 19 nt, Homo sapiens
aauaaccucuccauuguga

SEQ ID NO: 80922 - RNA, 19 nt, Homo sapiens
acacaacaguuucccaaga

SEQ ID NO: 80923 - RNA, 19 nt, Homo sapiens
ucacaauguuucuguugaa

SEQ ID NO: 80924 - RNA, 19 nt, Homo sapiens
gggaagugcccuggucuua

SEQ ID NO: 80925 - RNA, 19 nt, Homo sapiens
gagagaaggaggaaugaga

SEQ ID NO: 80926 - RNA, 19 nt, Homo sapiens
gcaaggggcugaaaagauc

SEQ ID NO: 80927 - RNA, 19 nt, Homo sapiens
caagagcauuuuccugaua

SEQ ID NO: 80928 - RNA, 19 nt, Homo sapiens
acuaauaaccucuccauug

SEQ ID NO: 80929 - RNA, 19 nt, Homo sapiens
ggaaugagagauugagaag

SEQ ID NO: 80930 - RNA, 19 nt, Homo sapiens
cccaagauccugaaacuga

SEQ ID NO: 80931 - RNA, 19 nt, Homo sapiens
uaaaugccaucaacacaac

SEQ ID NO: 80932 - RNA, 19 nt, Homo sapiens
gaagauuacccaaagaaaa

SEQ ID NO: 80933 - RNA, 19 nt, Homo sapiens
agaauuaaaugccaucaac

SEQ ID NO: 80934 - RNA, 19 nt, Homo sapiens
ucacuucuguucagguguu

SEQ ID NO: 80935 - RNA, 19 nt, Homo sapiens
cagauuaagcugaacaguu

SEQ ID NO: 80936 - RNA, 19 nt, Homo sapiens
cacaacaguuucccaagau

SEQ ID NO: 80937 - RNA, 19 nt, Homo sapiens
guguuguucugaaguauga

SEQ ID NO: 80938 - RNA, 19 nt, Homo sapiens
ccacuaccucaccuucuua

SEQ ID NO: 80939 - RNA, 19 nt, Homo sapiens
gaaaugucgccucucugaa

SEQ ID NO: 80940 - RNA, 19 nt, Homo sapiens
gccaucaacacaacaguuu

SEQ ID NO: 80941 - RNA, 19 nt, Homo sapiens
gaauauauggcccgaguac

SEQ ID NO: 80942 - RNA, 19 nt, Homo sapiens
caaguauggacauuuaaga

SEQ ID NO: 80943 - RNA, 19 nt, Homo sapiens
gaacaccuggcugaaguga

SEQ ID NO: 80944 - RNA, 19 nt, Homo sapiens
ggcacaaacucgcaucuac

SEQ ID NO: 80945 - RNA, 19 nt, Homo sapiens
uugaagagcuggcacaaac

SEQ ID NO: 80946 - RNA, 19 nt, Homo sapiens
caauguuucuguugaagag

SEQ ID NO: 80947 - RNA, 19 nt, Homo sapiens
cuugucagccaauucauua

SEQ ID NO: 80948 - RNA, 19 nt, Homo sapiens
ggaaaguguacgcccugua

SEQ ID NO: 80949 - RNA, 19 nt, Homo sapiens
ccuaguauaucugacuuug

SEQ ID NO: 80950 - RNA, 19 nt, Homo sapiens
gaaccggaccaucuuugau

SEQ ID NO: 80951 - RNA, 19 nt, Homo sapiens
uauggacauuuaagaguga

SEQ ID NO: 80952 - RNA, 19 nt, Homo sapiens
acugagcucuaugcuguua

SEQ ID NO: 80953 - RNA, 19 nt, Homo sapiens
gucacaauguuucuguuga

SEQ ID NO: 80954 - RNA, 19 nt, Homo sapiens
caucuugaauugucuuguc

SEQ ID NO: 80955 - RNA, 19 nt, Homo sapiens
gcuggcaucccucuccuuu

SEQ ID NO: 80956 - RNA, 19 nt, Homo sapiens
gucuuacccugaaaucaaa

SEQ ID NO: 80957 - RNA, 19 nt, Homo sapiens
caucagcccugccuguuuu

SEQ ID NO: 80958 - RNA, 19 nt, Homo sapiens
gcagagagagaaggaggaa

SEQ ID NO: 80959 - RNA, 19 nt, Homo sapiens
gaccaucuuugauaucacu

SEQ ID NO: 80960 - RNA, 19 nt, Homo sapiens
ugucauugcuuuauagacu

SEQ ID NO: 80961 - RNA, 19 nt, Homo sapiens
gcauucuucccuuaacaaa

SEQ ID NO: 80962 - RNA, 19 nt, Homo sapiens
gaauuaaaugccaucaaca

SEQ ID NO: 80963 - RNA, 19 nt, Homo sapiens
aaccggaccaucuuugaua

SEQ ID NO: 80964 - RNA, 19 nt, Homo sapiens
aaauggugcugacuaugau

SEQ ID NO: 80965 - RNA, 19 nt, Homo sapiens
gaccaaggaagugaaagaa

SEQ ID NO: 80966 - RNA, 19 nt, Homo sapiens
ggugcuggcuggucuuucu

SEQ ID NO: 80967 - RNA, 19 nt, Homo sapiens
caauuucuuucagcucuug

SEQ ID NO: 80968 - RNA, 19 nt, Homo sapiens
aaacuaaauccacaaccuu

SEQ ID NO: 80969 - RNA, 19 nt, Homo sapiens
gcacaaacucgcaucuacu

SEQ ID NO: 80970 - RNA, 19 nt, Homo sapiens
gaagagcuggcacaaacuc

SEQ ID NO: 80971 - RNA, 19 nt, Homo sapiens
ggucacaauguuucuguug

SEQ ID NO: 80972 - RNA, 19 nt, Homo sapiens
uggcuggucuuucucacuu

SEQ ID NO: 80973 - RNA, 19 nt, Homo sapiens
ucagccaauucauuaucua

SEQ ID NO: 80974 - RNA, 19 nt, Homo sapiens
uggcaucccucuccuuucu

SEQ ID NO: 80975 - RNA, 19 nt, Homo sapiens
ugaagauuacccaaagaaa

SEQ ID NO: 80976 - RNA, 19 nt, Homo sapiens
gagagagaaggaggaauga

SEQ ID NO: 80977 - RNA, 19 nt, Homo sapiens
agagagagaaggaggaaug

SEQ ID NO: 80978 - RNA, 19 nt, Homo sapiens
gaaggauaauuugcucaac

SEQ ID NO: 80979 - RNA, 19 nt, Homo sapiens
aagcugaacaguuacaaga

SEQ ID NO: 80980 - RNA, 19 nt, Homo sapiens
gagaaggaggaaugagaga

SEQ ID NO: 80981 - RNA, 19 nt, Homo sapiens
ugacuucccuacaccuagu

SEQ ID NO: 80982 - RNA, 19 nt, Homo sapiens
uggcugaagugacguuauc

SEQ ID NO: 80983 - RNA, 19 nt, Homo sapiens
cggaccaucuuugauauca

SEQ ID NO: 80984 - RNA, 19 nt, Homo sapiens
uuaaaugccaucaacacaa

SEQ ID NO: 80985 - RNA, 19 nt, Homo sapiens
caaggaagugaaagaagug

SEQ ID NO: 80986 - RNA, 19 nt, Homo sapiens
aauguaaccucuucuuuug

SEQ ID NO: 80987 - RNA, 19 nt, Homo sapiens
gaauacaaccaagcaagag

SEQ ID NO: 80988 - RNA, 19 nt, Homo sapiens
cauuuaagagugaaucaga

SEQ ID NO: 80989 - RNA, 19 nt, Homo sapiens
cagcaaacuggauuucaau

SEQ ID NO: 80990 - RNA, 19 nt, Homo sapiens
cuacaccuaguauaucuga

SEQ ID NO: 80991 - RNA, 19 nt, Homo sapiens
ugaccaaggaagugaaaga

SEQ ID NO: 80992 - RNA, 19 nt, Homo sapiens
agcaagcugugaaacuaaa

SEQ ID NO: 80993 - RNA, 19 nt, Homo sapiens
aaguguacgcccuguauaa

SEQ ID NO: 80994 - RNA, 19 nt, Homo sapiens
aaggaggaaugagagauug

SEQ ID NO: 80995 - RNA, 19 nt, Homo sapiens
ugccugaccuacugcuuug

SEQ ID NO: 80996 - RNA, 19 nt, Homo sapiens
agugauuugucauugcuuu

SEQ ID NO: 80997 - RNA, 19 nt, Homo sapiens
ggagagaacugaauaaaca

SEQ ID NO: 80998 - RNA, 19 nt, Homo sapiens
gcauagggcuagcaaauuu

SEQ ID NO: 80999 - RNA, 19 nt, Homo sapiens
gaaggaggcuuaggacuuu

SEQ ID NO: 81000 - RNA, 19 nt, Homo sapiens
gcaccuggcuaguuucuaa

SEQ ID NO: 81001 - RNA, 19 nt, Homo sapiens
gaauucaacuaucgaguau

SEQ ID NO: 81002 - RNA, 19 nt, Homo sapiens
ggaaauggaagaagaagaa

SEQ ID NO: 81003 - RNA, 19 nt, Homo sapiens
gaaccaagaauucaacuau

SEQ ID NO: 81004 - RNA, 19 nt, Homo sapiens
gcucaucuauacacgguua

SEQ ID NO: 81005 - RNA, 19 nt, Homo sapiens
ccacagaaauacaugaaau

SEQ ID NO: 81006 - RNA, 19 nt, Homo sapiens
gggugggacuuauguauuu

SEQ ID NO: 81007 - RNA, 19 nt, Homo sapiens
gagcagaccaaccuaaauu

SEQ ID NO: 81008 - RNA, 19 nt, Homo sapiens
gaucagauucuucucuuaa

SEQ ID NO: 81009 - RNA, 19 nt, Homo sapiens
gaggaaacuugcauacaga

SEQ ID NO: 81010 - RNA, 19 nt, Homo sapiens
agagaucuauguacuguaa

SEQ ID NO: 81011 - RNA, 19 nt, Homo sapiens
ugagugagcuaguaguauu

SEQ ID NO: 81012 - RNA, 19 nt, Homo sapiens
gaugaauucugaacuguca

SEQ ID NO: 81013 - RNA, 19 nt, Homo sapiens
gcuaguuucuaacauguuu

SEQ ID NO: 81014 - RNA, 19 nt, Homo sapiens
uggaauagccucccuguaa

SEQ ID NO: 81015 - RNA, 19 nt, Homo sapiens
uugaagaacugacuaguga

SEQ ID NO: 81016 - RNA, 19 nt, Homo sapiens
uuacuaugcucuagagaaa

SEQ ID NO: 81017 - RNA, 19 nt, Homo sapiens
gcucaugaccuggaaauaa

SEQ ID NO: 81018 - RNA, 19 nt, Homo sapiens
ucgcaacucuuauaaaugu

SEQ ID NO: 81019 - RNA, 19 nt, Homo sapiens
cagucaaccugaaauagua

SEQ ID NO: 81020 - RNA, 19 nt, Homo sapiens
ggaaggaggcuuaggacuu

SEQ ID NO: 81021 - RNA, 19 nt, Homo sapiens
ccauauaccugaaagaucu

SEQ ID NO: 81022 - RNA, 19 nt, Homo sapiens
guuauagacugccaugcua

SEQ ID NO: 81023 - RNA, 19 nt, Homo sapiens
cagcuugucuguuucauuc

SEQ ID NO: 81024 - RNA, 19 nt, Homo sapiens
gaagaugaguguuuugcua

SEQ ID NO: 81025 - RNA, 19 nt, Homo sapiens
gaaacaagcaacagaugga

SEQ ID NO: 81026 - RNA, 19 nt, Homo sapiens
gaccacauuccuuggauua

SEQ ID NO: 81027 - RNA, 19 nt, Homo sapiens
gauaaugggaugaauggaa

SEQ ID NO: 81028 - RNA, 19 nt, Homo sapiens
ccucgcaacucuuauaaau

SEQ ID NO: 81029 - RNA, 19 nt, Homo sapiens
guacuuccaacaguuauua

SEQ ID NO: 81030 - RNA, 19 nt, Homo sapiens
uccaucagcuugucuguuu

SEQ ID NO: 81031 - RNA, 19 nt, Homo sapiens
ggaauuaggaagaccaaga

SEQ ID NO: 81032 - RNA, 19 nt, Homo sapiens
gaagagcugcaacggaauu

SEQ ID NO: 81033 - RNA, 19 nt, Homo sapiens
ggacuuauguauuuaugac

SEQ ID NO: 81034 - RNA, 19 nt, Homo sapiens
ugaguaacauucucuuugu

SEQ ID NO: 81035 - RNA, 19 nt, Homo sapiens
gcauacagagacagauaua

SEQ ID NO: 81036 - RNA, 19 nt, Homo sapiens
gaagaacugacuagugaga

SEQ ID NO: 81037 - RNA, 19 nt, Homo sapiens
ggaauagccucccuguaac

SEQ ID NO: 81038 - RNA, 19 nt, Homo sapiens
gaguaaagcccauacaagu

SEQ ID NO: 81039 - RNA, 19 nt, Homo sapiens
gauguuacgagcaauauga

SEQ ID NO: 81040 - RNA, 19 nt, Homo sapiens
caaauggacauaagacaga

SEQ ID NO: 81041 - RNA, 19 nt, Homo sapiens
gaccugccaugccaauuug

SEQ ID NO: 81042 - RNA, 19 nt, Homo sapiens
gcaaauuugaguuggauga

SEQ ID NO: 81043 - RNA, 19 nt, Homo sapiens
guacuguaauagugugauu

SEQ ID NO: 81044 - RNA, 19 nt, Homo sapiens
gaugaagcccagcguguuu

SEQ ID NO: 81045 - RNA, 19 nt, Homo sapiens
uuacuuagccuacagaugu

SEQ ID NO: 81046 - RNA, 19 nt, Homo sapiens
aaagagaucacaauacuca

SEQ ID NO: 81047 - RNA, 19 nt, Homo sapiens
gaacugaauaaacaggaaa

SEQ ID NO: 81048 - RNA, 19 nt, Homo sapiens
uaucugggcuguugcuaau

SEQ ID NO: 81049 - RNA, 19 nt, Homo sapiens
gaaccuggagccacuucua

SEQ ID NO: 81050 - RNA, 19 nt, Homo sapiens
gcagaccaaccuaaauuug

SEQ ID NO: 81051 - RNA, 19 nt, Homo sapiens
ggugggacuuauguauuua

SEQ ID NO: 81052 - RNA, 19 nt, Homo sapiens
gaagcggccucgcaacucu

SEQ ID NO: 81053 - RNA, 19 nt, Homo sapiens
ccaccuugcuucuguguuc

SEQ ID NO: 81054 - RNA, 19 nt, Homo sapiens
caaaagagaucacaauacu

SEQ ID NO: 81055 - RNA, 19 nt, Homo sapiens
gaacccuguuucucuugaa

SEQ ID NO: 81056 - RNA, 19 nt, Homo sapiens
uuaugcaucuggucucuuu

SEQ ID NO: 81057 - RNA, 19 nt, Homo sapiens
cucaugaccuggaaauaaa

SEQ ID NO: 81058 - RNA, 19 nt, Homo sapiens
cgaguaugaugguauuaug

SEQ ID NO: 81059 - RNA, 19 nt, Homo sapiens
ugucagugcuugcuaacuu

SEQ ID NO: 81060 - RNA, 19 nt, Homo sapiens
ucacuucagagcacacuua

SEQ ID NO: 81061 - RNA, 19 nt, Homo sapiens
caagaggagacuuuaauuc

SEQ ID NO: 81062 - RNA, 19 nt, Homo sapiens
cuaauucuauggaaaugga

SEQ ID NO: 81063 - RNA, 19 nt, Homo sapiens
ggaaugcugcugugcuuau

SEQ ID NO: 81064 - RNA, 19 nt, Homo sapiens
gcuuguccauguaauauuc

SEQ ID NO: 81065 - RNA, 19 nt, Homo sapiens
ugggagaaaugacuuugaa

SEQ ID NO: 81066 - RNA, 19 nt, Homo sapiens
ggugauacccaaguuauug

SEQ ID NO: 81067 - RNA, 19 nt, Homo sapiens
cagaucagauucuucucuu

SEQ ID NO: 81068 - RNA, 19 nt, Homo sapiens
cgacaaaagugauacaugu

SEQ ID NO: 81069 - RNA, 19 nt, Homo sapiens
ucaagauaaugucacagaa

SEQ ID NO: 81070 - RNA, 19 nt, Homo sapiens
uaucgaguaugaugguauu

SEQ ID NO: 81071 - RNA, 19 nt, Homo sapiens
ccuaagaagaugaguguuu

SEQ ID NO: 81072 - RNA, 19 nt, Homo sapiens
ugaaugagguauacuuagg

SEQ ID NO: 81073 - RNA, 19 nt, Homo sapiens
gaagauucaagcuuauuuc

SEQ ID NO: 81074 - RNA, 19 nt, Homo sapiens
aaagagagagagagagaaa

SEQ ID NO: 81075 - RNA, 19 nt, Homo sapiens
ccaagaggagacuuuaauu

SEQ ID NO: 81076 - RNA, 19 nt, Homo sapiens
agagaaauuugacaguguu

SEQ ID NO: 81077 - RNA, 19 nt, Homo sapiens
gcacuaugggacugaguaa

SEQ ID NO: 81078 - RNA, 19 nt, Homo sapiens
auucaacuaucgaguauga

SEQ ID NO: 81079 - RNA, 19 nt, Homo sapiens
aauuugaccugcucaucua

SEQ ID NO: 81080 - RNA, 19 nt, Homo sapiens
caagcuuguccauguaaua

SEQ ID NO: 81081 - RNA, 19 nt, Homo sapiens
gaaugcugcugugcuuaug

SEQ ID NO: 81082 - RNA, 19 nt, Homo sapiens
cuauggaaauggaagaaga

SEQ ID NO: 81083 - RNA, 19 nt, Homo sapiens
agaauucaacuaucgagua

SEQ ID NO: 81084 - RNA, 19 nt, Homo sapiens
ccacauuccuuggauuaca

SEQ ID NO: 81085 - RNA, 19 nt, Homo sapiens
uaucuucaccuuucucuau

SEQ ID NO: 81086 - RNA, 19 nt, Homo sapiens
caucuucuguauucuggaa

SEQ ID NO: 81087 - RNA, 19 nt, Homo sapiens
cgagcaauaugaccaucuu

SEQ ID NO: 81088 - RNA, 19 nt, Homo sapiens
gcuaagaaccaagaauuca

SEQ ID NO: 81089 - RNA, 19 nt, Homo sapiens
agaggaaacuugcauacag

SEQ ID NO: 81090 - RNA, 19 nt, Homo sapiens
cagcauagggcuagcaaau

SEQ ID NO: 81091 - RNA, 19 nt, Homo sapiens
caugaaaugucuggucugu

SEQ ID NO: 81092 - RNA, 19 nt, Homo sapiens
acaacuaccuccucagucu

SEQ ID NO: 81093 - RNA, 19 nt, Homo sapiens
uauacacgguuacccagaa

SEQ ID NO: 81094 - RNA, 19 nt, Homo sapiens
gggcuuguaucaauguauc

SEQ ID NO: 81095 - RNA, 19 nt, Homo sapiens
guaacauucucuuugugau

SEQ ID NO: 81096 - RNA, 19 nt, Homo sapiens
aauuugaguuggaugauug

SEQ ID NO: 81097 - RNA, 19 nt, Homo sapiens
ggagagaacugaauaaaca

SEQ ID NO: 81098 - RNA, 19 nt, Homo sapiens
gcauagggcuagcaaauuu

SEQ ID NO: 81099 - RNA, 19 nt, Homo sapiens
gaaggaggcuuaggacuuu

SEQ ID NO: 81100 - RNA, 19 nt, Homo sapiens
gcaccuggcuaguuucuaa

SEQ ID NO: 81101 - RNA, 19 nt, Homo sapiens
gaauucaacuaucgaguau

SEQ ID NO: 81102 - RNA, 19 nt, Homo sapiens
ggaaauggaagaagaagaa

SEQ ID NO: 81103 - RNA, 19 nt, Homo sapiens
gaaccaagaauucaacuau

SEQ ID NO: 81104 - RNA, 19 nt, Homo sapiens
gcucaucuauacacgguua

SEQ ID NO: 81105 - RNA, 19 nt, Homo sapiens
ccacagaaauacaugaaau

SEQ ID NO: 81106 - RNA, 19 nt, Homo sapiens
gggugggacuuauguauuu

SEQ ID NO: 81107 - RNA, 19 nt, Homo sapiens
gagcagaccaaccuaaauu

SEQ ID NO: 81108 - RNA, 19 nt, Homo sapiens
gaucagauucuucucuuaa

SEQ ID NO: 81109 - RNA, 19 nt, Homo sapiens
gaggaaacuugcauacaga

SEQ ID NO: 81110 - RNA, 19 nt, Homo sapiens
agagaucuauguacuguaa

SEQ ID NO: 81111 - RNA, 19 nt, Homo sapiens
ugagugagcuaguaguauu

SEQ ID NO: 81112 - RNA, 19 nt, Homo sapiens
gaugaauucugaacuguca

SEQ ID NO: 81113 - RNA, 19 nt, Homo sapiens
gcuaguuucuaacauguuu

SEQ ID NO: 81114 - RNA, 19 nt, Homo sapiens
uggaauagccucccuguaa

SEQ ID NO: 81115 - RNA, 19 nt, Homo sapiens
uugaagaacugacuaguga

SEQ ID NO: 81116 - RNA, 19 nt, Homo sapiens
uuacuaugcucuagagaaa

SEQ ID NO: 81117 - RNA, 19 nt, Homo sapiens
gcucaugaccuggaaauaa

SEQ ID NO: 81118 - RNA, 19 nt, Homo sapiens
ucgcaacucuuauaaaugu

SEQ ID NO: 81119 - RNA, 19 nt, Homo sapiens
cagucaaccugaaauagua

SEQ ID NO: 81120 - RNA, 19 nt, Homo sapiens
ggaaggaggcuuaggacuu

SEQ ID NO: 81121 - RNA, 19 nt, Homo sapiens
ccauauaccugaaagaucu

SEQ ID NO: 81122 - RNA, 19 nt, Homo sapiens
guuauagacugccaugcua

SEQ ID NO: 81123 - RNA, 19 nt, Homo sapiens
cagcuugucuguuucauuc

SEQ ID NO: 81124 - RNA, 19 nt, Homo sapiens
gaagaugaguguuuugcua

SEQ ID NO: 81125 - RNA, 19 nt, Homo sapiens
gaaacaagcaacagaugga

SEQ ID NO: 81126 - RNA, 19 nt, Homo sapiens
gaccacauuccuuggauua

SEQ ID NO: 81127 - RNA, 19 nt, Homo sapiens
gauaaugggaugaauggaa

SEQ ID NO: 81128 - RNA, 19 nt, Homo sapiens
ccucgcaacucuuauaaau

SEQ ID NO: 81129 - RNA, 19 nt, Homo sapiens
guacuuccaacaguuauua

SEQ ID NO: 81130 - RNA, 19 nt, Homo sapiens
uccaucagcuugucuguuu

SEQ ID NO: 81131 - RNA, 19 nt, Homo sapiens
ggaauuaggaagaccaaga

SEQ ID NO: 81132 - RNA, 19 nt, Homo sapiens
gaagagcugcaacggaauu

SEQ ID NO: 81133 - RNA, 19 nt, Homo sapiens
ggacuuauguauuuaugac

SEQ ID NO: 81134 - RNA, 19 nt, Homo sapiens
ugaguaacauucucuuugu

SEQ ID NO: 81135 - RNA, 19 nt, Homo sapiens
gcauacagagacagauaua

SEQ ID NO: 81136 - RNA, 19 nt, Homo sapiens
gaagaacugacuagugaga

SEQ ID NO: 81137 - RNA, 19 nt, Homo sapiens
ggaauagccucccuguaac

SEQ ID NO: 81138 - RNA, 19 nt, Homo sapiens
gaguaaagcccauacaagu

SEQ ID NO: 81139 - RNA, 19 nt, Homo sapiens
gauguuacgagcaauauga

SEQ ID NO: 81140 - RNA, 19 nt, Homo sapiens
caaauggacauaagacaga

SEQ ID NO: 81141 - RNA, 19 nt, Homo sapiens
gaccugccaugccaauuug

SEQ ID NO: 81142 - RNA, 19 nt, Homo sapiens
gcaaauuugaguuggauga

SEQ ID NO: 81143 - RNA, 19 nt, Homo sapiens
guacuguaauagugugauu

SEQ ID NO: 81144 - RNA, 19 nt, Homo sapiens
gaugaagcccagcguguuu

SEQ ID NO: 81145 - RNA, 19 nt, Homo sapiens
uuacuuagccuacagaugu

SEQ ID NO: 81146 - RNA, 19 nt, Homo sapiens
aaagagaucacaauacuca

SEQ ID NO: 81147 - RNA, 19 nt, Homo sapiens
gaacugaauaaacaggaaa

SEQ ID NO: 81148 - RNA, 19 nt, Homo sapiens
uaucugggcuguugcuaau

SEQ ID NO: 81149 - RNA, 19 nt, Homo sapiens
gaaccuggagccacuucua

SEQ ID NO: 81150 - RNA, 19 nt, Homo sapiens
gcagaccaaccuaaauuug

SEQ ID NO: 81151 - RNA, 19 nt, Homo sapiens
ggugggacuuauguauuua

SEQ ID NO: 81152 - RNA, 19 nt, Homo sapiens
gaagcggccucgcaacucu

SEQ ID NO: 81153 - RNA, 19 nt, Homo sapiens
caaaagagaucacaauacu

SEQ ID NO: 81154 - RNA, 19 nt, Homo sapiens
gaacccuguuucucuugaa

SEQ ID NO: 81155 - RNA, 19 nt, Homo sapiens
cucaugaccuggaaauaaa

SEQ ID NO: 81156 - RNA, 19 nt, Homo sapiens
cgaguaugaugguauuaug

SEQ ID NO: 81157 - RNA, 19 nt, Homo sapiens
ugucagugcuugcuaacuu

SEQ ID NO: 81158 - RNA, 19 nt, Homo sapiens
ucacuucagagcacacuua

SEQ ID NO: 81159 - RNA, 19 nt, Homo sapiens
caagaggagacuuuaauuc

SEQ ID NO: 81160 - RNA, 19 nt, Homo sapiens
cuaauucuauggaaaugga

SEQ ID NO: 81161 - RNA, 19 nt, Homo sapiens
gcuuguccauguaauauuc

SEQ ID NO: 81162 - RNA, 19 nt, Homo sapiens
ugggagaaaugacuuugaa

SEQ ID NO: 81163 - RNA, 19 nt, Homo sapiens
ggugauacccaaguuauug

SEQ ID NO: 81164 - RNA, 19 nt, Homo sapiens
cagaucagauucuucucuu

SEQ ID NO: 81165 - RNA, 19 nt, Homo sapiens
cgacaaaagugauacaugu

SEQ ID NO: 81166 - RNA, 19 nt, Homo sapiens
ucaagauaaugucacagaa

SEQ ID NO: 81167 - RNA, 19 nt, Homo sapiens
uaucgaguaugaugguauu

SEQ ID NO: 81168 - RNA, 19 nt, Homo sapiens
gaagauucaagcuuauuuc

SEQ ID NO: 81169 - RNA, 19 nt, Homo sapiens
ccuaagaagaugaguguuu

SEQ ID NO: 81170 - RNA, 19 nt, Homo sapiens
ugaaugagguauacuuagg

SEQ ID NO: 81171 - RNA, 19 nt, Homo sapiens
aaagagagagagagagaaa

SEQ ID NO: 81172 - RNA, 19 nt, Homo sapiens
ccaagaggagacuuuaauu

SEQ ID NO: 81173 - RNA, 19 nt, Homo sapiens
agagaaauuugacaguguu

SEQ ID NO: 81174 - RNA, 19 nt, Homo sapiens
auucaacuaucgaguauga

SEQ ID NO: 81175 - RNA, 19 nt, Homo sapiens
aauuugaccugcucaucua

SEQ ID NO: 81176 - RNA, 19 nt, Homo sapiens
gcacuaugggacugaguaa

SEQ ID NO: 81177 - RNA, 19 nt, Homo sapiens
caagcuuguccauguaaua

SEQ ID NO: 81178 - RNA, 19 nt, Homo sapiens
cuauggaaauggaagaaga

SEQ ID NO: 81179 - RNA, 19 nt, Homo sapiens
agaauucaacuaucgagua

SEQ ID NO: 81180 - RNA, 19 nt, Homo sapiens
ccacauuccuuggauuaca

SEQ ID NO: 81181 - RNA, 19 nt, Homo sapiens
uaucuucaccuuucucuau

SEQ ID NO: 81182 - RNA, 19 nt, Homo sapiens
caucuucuguauucuggaa

SEQ ID NO: 81183 - RNA, 19 nt, Homo sapiens
cgagcaauaugaccaucuu

SEQ ID NO: 81184 - RNA, 19 nt, Homo sapiens
gcuaagaaccaagaauuca

SEQ ID NO: 81185 - RNA, 19 nt, Homo sapiens
agaggaaacuugcauacag

SEQ ID NO: 81186 - RNA, 19 nt, Homo sapiens
cagcauagggcuagcaaau

SEQ ID NO: 81187 - RNA, 19 nt, Homo sapiens
caugaaaugucuggucugu

SEQ ID NO: 81188 - RNA, 19 nt, Homo sapiens
uaacagggacuagcacaga

SEQ ID NO: 81189 - RNA, 19 nt, Homo sapiens
acaacuaccuccucagucu

SEQ ID NO: 81190 - RNA, 19 nt, Homo sapiens
uauacacgguuacccagaa

SEQ ID NO: 81191 - RNA, 19 nt, Homo sapiens
gggcuuguaucaauguauc

SEQ ID NO: 81192 - RNA, 19 nt, Homo sapiens
aauuugaguuggaugauug

SEQ ID NO: 81193 - RNA, 19 nt, Homo sapiens
gaguaacauucucuuugug

SEQ ID NO: 81194 - RNA, 19 nt, Homo sapiens
gcuccaggacucccucuaa

SEQ ID NO: 81195 - RNA, 19 nt, Homo sapiens
guaacauucucuuugugau

SEQ ID NO: 81196 - RNA, 19 nt, Homo sapiens
gauauacugggagaaauga

SEQ ID NO: 81197 - RNA, 19 nt, Homo sapiens
gcaaaugagugauggauaa

SEQ ID NO: 81198 - RNA, 19 nt, Homo sapiens
gagaugaccuuguggagaa

SEQ ID NO: 81199 - RNA, 19 nt, Homo sapiens
gagaugaccucguggagaa

SEQ ID NO: 81200 - RNA, 19 nt, Homo sapiens
ccacggagcacaccaauaa

SEQ ID NO: 81201 - RNA, 19 nt, Homo sapiens
gaagagcgaggguuaauga

SEQ ID NO: 81202 - RNA, 19 nt, Homo sapiens
gcacaccaauaacaagauu

SEQ ID NO: 81203 - RNA, 19 nt, Homo sapiens
cagagaaccugcuuuacuu

SEQ ID NO: 81204 - RNA, 19 nt, Homo sapiens
gaaggcugcuguuuacuca

SEQ ID NO: 81205 - RNA, 19 nt, Homo sapiens
gagaaaaucuacaucauga

SEQ ID NO: 81206 - RNA, 19 nt, Homo sapiens
ucaagucacucaucucaga

SEQ ID NO: 81207 - RNA, 19 nt, Homo sapiens
ggucugcccugcuugcaaa

SEQ ID NO: 81208 - RNA, 19 nt, Homo sapiens
gggagggauugacauguuu

SEQ ID NO: 81209 - RNA, 19 nt, Homo sapiens
gaucaagucacucaucuca

SEQ ID NO: 81210 - RNA, 19 nt, Homo sapiens
cagcagugauguugguuga

SEQ ID NO: 81211 - RNA, 19 nt, Homo sapiens
ggagguuucaucaggauuu

SEQ ID NO: 81212 - RNA, 19 nt, Homo sapiens
cagcagagcccgaguugga

SEQ ID NO: 81213 - RNA, 19 nt, Homo sapiens
cuucagacguguaugcaaa

SEQ ID NO: 81214 - RNA, 19 nt, Homo sapiens
gggaaggccuaguucagau

SEQ ID NO: 81215 - RNA, 19 nt, Homo sapiens
caagaccguuuggagguuu

SEQ ID NO: 81216 - RNA, 19 nt, Homo sapiens
uuaaugagccagccacuga

SEQ ID NO: 81217 - RNA, 19 nt, Homo sapiens
gagcacaccaauaacaaga

SEQ ID NO: 81218 - RNA, 19 nt, Homo sapiens
acacagcagugcccacaga

SEQ ID NO: 81219 - RNA, 19 nt, Homo sapiens
ggaagaggaagggaaagaa

SEQ ID NO: 81220 - RNA, 19 nt, Homo sapiens
ggaagcgaauucggcagaa

SEQ ID NO: 81221 - RNA, 19 nt, Homo sapiens
cagggaugauugucaaguu

SEQ ID NO: 81222 - RNA, 19 nt, Homo sapiens
gcuuuacucuggaccauag

SEQ ID NO: 81223 - RNA, 19 nt, Homo sapiens
gagaaccugcuuuacuuug

SEQ ID NO: 81224 - RNA, 19 nt, Homo sapiens
ccaggcaucugcuuuacuc

SEQ ID NO: 81225 - RNA, 19 nt, Homo sapiens
gaagaggaagggaaagaag

SEQ ID NO: 81226 - RNA, 19 nt, Homo sapiens
cagcagagacggucaccaa

SEQ ID NO: 81227 - RNA, 19 nt, Homo sapiens
gaaugucgaccuggcauga

SEQ ID NO: 81228 - RNA, 19 nt, Homo sapiens
agaagaacacggucuguga

SEQ ID NO: 81229 - RNA, 19 nt, Homo sapiens
ucacacaacuuuugaaucu

SEQ ID NO: 81230 - RNA, 19 nt, Homo sapiens
cgggaaggcugcuguuuac

SEQ ID NO: 81231 - RNA, 19 nt, Homo sapiens
ccgggaaggcugcuguuua

SEQ ID NO: 81232 - RNA, 19 nt, Homo sapiens
uaaugcacuuccuuaccua

SEQ ID NO: 81233 - RNA, 19 nt, Homo sapiens
ccacagcugccucuggaaa

SEQ ID NO: 81234 - RNA, 19 nt, Homo sapiens
gagaagacgccaugugcau

SEQ ID NO: 81235 - RNA, 19 nt, Homo sapiens
ugggagggauugacauguu

SEQ ID NO: 81236 - RNA, 19 nt, Homo sapiens
cggcagggaugauugucaa

SEQ ID NO: 81237 - RNA, 19 nt, Homo sapiens
ccacagaggccuacugacu

SEQ ID NO: 81238 - RNA, 19 nt, Homo sapiens
ccagagaaccugcuuuacu

SEQ ID NO: 81239 - RNA, 19 nt, Homo sapiens
caccuucccuguccuguag

SEQ ID NO: 81240 - RNA, 19 nt, Homo sapiens
agugugagccugacuacua

SEQ ID NO: 81241 - RNA, 19 nt, Homo sapiens
uggaggaagugauaguuuc

SEQ ID NO: 81242 - RNA, 19 nt, Homo sapiens
aaugagugauggauaagga

SEQ ID NO: 81243 - RNA, 19 nt, Homo sapiens
gagaagacgccgugugcau

SEQ ID NO: 81244 - RNA, 19 nt, Homo sapiens
aaggaugagucuuggaguu

SEQ ID NO: 81245 - RNA, 19 nt, Homo sapiens
cagaacccgucgcggaaga

SEQ ID NO: 81246 - RNA, 19 nt, Homo sapiens
cccaggauauggcugagaa

SEQ ID NO: 81247 - RNA, 19 nt, Homo sapiens
ggaaggcugcuguuuacuc

SEQ ID NO: 81248 - RNA, 19 nt, Homo sapiens
ucacucaucucagaauguc

SEQ ID NO: 81249 - RNA, 19 nt, Homo sapiens
gaagcgaauucggcagaag

SEQ ID NO: 81250 - RNA, 19 nt, Homo sapiens
agugugagcccgacuacua

SEQ ID NO: 81251 - RNA, 19 nt, Homo sapiens
gcccgcugcuucuuccauu

SEQ ID NO: 81252 - RNA, 19 nt, Homo sapiens
gacccggcauguucuguuc

SEQ ID NO: 81253 - RNA, 19 nt, Homo sapiens
gccagaagaagcuuaagug

SEQ ID NO: 81254 - RNA, 19 nt, Homo sapiens
ggaagugauaguuucugaa

SEQ ID NO: 81255 - RNA, 19 nt, Homo sapiens
aggaagugauaguuucuga

SEQ ID NO: 81256 - RNA, 19 nt, Homo sapiens
gccagcaccaugccuguaa

SEQ ID NO: 81257 - RNA, 19 nt, Homo sapiens
gguuguuucuccagaguca

SEQ ID NO: 81258 - RNA, 19 nt, Homo sapiens
guacagccugcgugacuug

SEQ ID NO: 81259 - RNA, 19 nt, Homo sapiens
gccagugccugugguuguu

SEQ ID NO: 81260 - RNA, 19 nt, Homo sapiens
gaucccagcagugauguug

SEQ ID NO: 81261 - RNA, 19 nt, Homo sapiens
gagcuguucucgagaugac

SEQ ID NO: 81262 - RNA, 19 nt, Homo sapiens
gaugggagggauugacaug

SEQ ID NO: 81263 - RNA, 19 nt, Homo sapiens
uggauaaggaugagucuug

SEQ ID NO: 81264 - RNA, 19 nt, Homo sapiens
ucacauuucacgcuaagga

SEQ ID NO: 81265 - RNA, 19 nt, Homo sapiens
cacccaggcaucugcuuua

SEQ ID NO: 81266 - RNA, 19 nt, Homo sapiens
ccugggaaaugaagaagca

SEQ ID NO: 81267 - RNA, 19 nt, Homo sapiens
gcccacagaggccuacuga

SEQ ID NO: 81268 - RNA, 19 nt, Homo sapiens
ggaagagcgaggguuaaug

SEQ ID NO: 81269 - RNA, 19 nt, Homo sapiens
acccagagaaccugcuuua

SEQ ID NO: 81270 - RNA, 19 nt, Homo sapiens
ggacauuggccagaagaag

SEQ ID NO: 81271 - RNA, 19 nt, Homo sapiens
cagccugcgugacuuguuc

SEQ ID NO: 81272 - RNA, 19 nt, Homo sapiens
gcacggcgcagaagaacac

SEQ ID NO: 81273 - RNA, 19 nt, Homo sapiens
gaugaggccgaccgcugua

SEQ ID NO: 81274 - RNA, 19 nt, Homo sapiens
agacguguaugcaaaugag

SEQ ID NO: 81275 - RNA, 19 nt, Homo sapiens
acaagaccguuuggagguu

SEQ ID NO: 81276 - RNA, 19 nt, Homo sapiens
ccuggagacucguggacuu

SEQ ID NO: 81277 - RNA, 19 nt, Homo sapiens
gcgaugucaugcucucagu

SEQ ID NO: 81278 - RNA, 19 nt, Homo sapiens
gaaugucgacccggcaugu

SEQ ID NO: 81279 - RNA, 19 nt, Homo sapiens
gcuugcaaauccacuagca

SEQ ID NO: 81280 - RNA, 19 nt, Homo sapiens
gaaaaucuacaucaugaag

SEQ ID NO: 81281 - RNA, 19 nt, Homo sapiens
cuucuuccauucugucugu

SEQ ID NO: 81282 - RNA, 19 nt, Homo sapiens
ggaggaagugauaguuucu

SEQ ID NO: 81283 - RNA, 19 nt, Homo sapiens
cgggagaacuaaggcugaa

SEQ ID NO: 81284 - RNA, 19 nt, Homo sapiens
ccuuaggucugcccugcuu

SEQ ID NO: 81285 - RNA, 19 nt, Homo sapiens
agagaaccugcuuuacuuu

SEQ ID NO: 81286 - RNA, 19 nt, Homo sapiens
ggagaacuaaggcugaaac

SEQ ID NO: 81287 - RNA, 19 nt, Homo sapiens
ccuaguggcccuucacaca

SEQ ID NO: 81288 - RNA, 19 nt, Homo sapiens
gguugaggcagcaaacaga

SEQ ID NO: 81289 - RNA, 19 nt, Homo sapiens
ggagcacaccaauaacaag

SEQ ID NO: 81290 - RNA, 19 nt, Homo sapiens
ccacaucagccaccaacuc

SEQ ID NO: 81291 - RNA, 19 nt, Homo sapiens
cgugagcuguucucgagau

SEQ ID NO: 81292 - RNA, 19 nt, Homo sapiens
ucagacguguaugcaaaug

SEQ ID NO: 81293 - RNA, 19 nt, Homo sapiens
acucuguccugggaaauga

SEQ ID NO: 81294 - RNA, 19 nt, Homo sapiens
ccaccuucccuguccugua

SEQ ID NO: 81295 - RNA, 19 nt, Homo sapiens
uaacccuacucuccucucu

SEQ ID NO: 81296 - RNA, 19 nt, Homo sapiens
ggaaggccuaguucagauc

SEQ ID NO: 81297 - RNA, 19 nt, Homo sapiens
gcaaaugagugauggauaa

SEQ ID NO: 81298 - RNA, 19 nt, Homo sapiens
ccacggagcacaccaauaa

SEQ ID NO: 81299 - RNA, 19 nt, Homo sapiens
gaagagcgaggguuaauga

SEQ ID NO: 81300 - RNA, 19 nt, Homo sapiens
gcacaccaauaacaagauu

SEQ ID NO: 81301 - RNA, 19 nt, Homo sapiens
cagagaaccugcuuuacuu

SEQ ID NO: 81302 - RNA, 19 nt, Homo sapiens
gaaggcugcuguuuacuca

SEQ ID NO: 81303 - RNA, 19 nt, Homo sapiens
gagaaaaucuacaucauga

SEQ ID NO: 81304 - RNA, 19 nt, Homo sapiens
ucaagucacucaucucaga

SEQ ID NO: 81305 - RNA, 19 nt, Homo sapiens
ggucugcccugcuugcaaa

SEQ ID NO: 81306 - RNA, 19 nt, Homo sapiens
gggagggauugacauguuu

SEQ ID NO: 81307 - RNA, 19 nt, Homo sapiens
gaucaagucacucaucuca

SEQ ID NO: 81308 - RNA, 19 nt, Homo sapiens
cagcagugauguugguuga

SEQ ID NO: 81309 - RNA, 19 nt, Homo sapiens
ggagguuucaucaggauuu

SEQ ID NO: 81310 - RNA, 19 nt, Homo sapiens
cagcagagcccgaguugga

SEQ ID NO: 81311 - RNA, 19 nt, Homo sapiens
cuucagacguguaugcaaa

SEQ ID NO: 81312 - RNA, 19 nt, Homo sapiens
caagaccguuuggagguuu

SEQ ID NO: 81313 - RNA, 19 nt, Homo sapiens
uuaaugagccagccacuga

SEQ ID NO: 81314 - RNA, 19 nt, Homo sapiens
gagcacaccaauaacaaga

SEQ ID NO: 81315 - RNA, 19 nt, Homo sapiens
ggaagaggaagggaaagaa

SEQ ID NO: 81316 - RNA, 19 nt, Homo sapiens
ggaagcgaauucggcagaa

SEQ ID NO: 81317 - RNA, 19 nt, Homo sapiens
gcuuuacucuggaccauag

SEQ ID NO: 81318 - RNA, 19 nt, Homo sapiens
gagaaccugcuuuacuuug

SEQ ID NO: 81319 - RNA, 19 nt, Homo sapiens
ccaggcaucugcuuuacuc

SEQ ID NO: 81320 - RNA, 19 nt, Homo sapiens
gaagaggaagggaaagaag

SEQ ID NO: 81321 - RNA, 19 nt, Homo sapiens
ucacacaacuuuugaaucu

SEQ ID NO: 81322 - RNA, 19 nt, Homo sapiens
cgggaaggcugcuguuuac

SEQ ID NO: 81323 - RNA, 19 nt, Homo sapiens
ccgggaaggcugcuguuua

SEQ ID NO: 81324 - RNA, 19 nt, Homo sapiens
uaaugcacuuccuuaccua

SEQ ID NO: 81325 - RNA, 19 nt, Homo sapiens
ccacagcugccucuggaaa

SEQ ID NO: 81326 - RNA, 19 nt, Homo sapiens
ugggagggauugacauguu

SEQ ID NO: 81327 - RNA, 19 nt, Homo sapiens
ccagagaaccugcuuuacu

SEQ ID NO: 81328 - RNA, 19 nt, Homo sapiens
caccuucccuguccuguag

SEQ ID NO: 81329 - RNA, 19 nt, Homo sapiens
uggaggaagugauaguuuc

SEQ ID NO: 81330 - RNA, 19 nt, Homo sapiens
aaugagugauggauaagga

SEQ ID NO: 81331 - RNA, 19 nt, Homo sapiens
gcagcaaggcaaagagugu

SEQ ID NO: 81332 - RNA, 19 nt, Homo sapiens
aaggaugagucuuggaguu

SEQ ID NO: 81333 - RNA, 19 nt, Homo sapiens
cagaacccgucgcggaaga

SEQ ID NO: 81334 - RNA, 19 nt, Homo sapiens
gaagcgaauucggcagaag

SEQ ID NO: 81335 - RNA, 19 nt, Homo sapiens
ggaaggcugcuguuuacuc

SEQ ID NO: 81336 - RNA, 19 nt, Homo sapiens
ucacucaucucagaauguc

SEQ ID NO: 81337 - RNA, 19 nt, Homo sapiens
gccagaagaagcuuaagug

SEQ ID NO: 81338 - RNA, 19 nt, Homo sapiens
ggaagugauaguuucugaa

SEQ ID NO: 81339 - RNA, 19 nt, Homo sapiens
aggaagugauaguuucuga

SEQ ID NO: 81340 - RNA, 19 nt, Homo sapiens
gguuguuucuccagaguca

SEQ ID NO: 81341 - RNA, 19 nt, Homo sapiens
gccagugccugugguuguu

SEQ ID NO: 81342 - RNA, 19 nt, Homo sapiens
gaucccagcagugauguug

SEQ ID NO: 81343 - RNA, 19 nt, Homo sapiens
gaugggagggauugacaug

SEQ ID NO: 81344 - RNA, 19 nt, Homo sapiens
uggauaaggaugagucuug

SEQ ID NO: 81345 - RNA, 19 nt, Homo sapiens
ucacauuucacgcuaagga

SEQ ID NO: 81346 - RNA, 19 nt, Homo sapiens
cacccaggcaucugcuuua

SEQ ID NO: 81347 - RNA, 19 nt, Homo sapiens
ccugggaaaugaagaagca

SEQ ID NO: 81348 - RNA, 19 nt, Homo sapiens
ggaagagcgaggguuaaug

SEQ ID NO: 81349 - RNA, 19 nt, Homo sapiens
acccagagaaccugcuuua

SEQ ID NO: 81350 - RNA, 19 nt, Homo sapiens
ggacauuggccagaagaag

SEQ ID NO: 81351 - RNA, 19 nt, Homo sapiens
agacguguaugcaaaugag

SEQ ID NO: 81352 - RNA, 19 nt, Homo sapiens
acaagaccguuuggagguu

SEQ ID NO: 81353 - RNA, 19 nt, Homo sapiens
ccuggagacucguggacuu

SEQ ID NO: 81354 - RNA, 19 nt, Homo sapiens
gcgaugucaugcucucagu

SEQ ID NO: 81355 - RNA, 19 nt, Homo sapiens
gcuugcaaauccacuagca

SEQ ID NO: 81356 - RNA, 19 nt, Homo sapiens
gaaaaucuacaucaugaag

SEQ ID NO: 81357 - RNA, 19 nt, Homo sapiens
ggaggaagugauaguuucu

SEQ ID NO: 81358 - RNA, 19 nt, Homo sapiens
ccuuaggucugcccugcuu

SEQ ID NO: 81359 - RNA, 19 nt, Homo sapiens
agagaaccugcuuuacuuu

SEQ ID NO: 81360 - RNA, 19 nt, Homo sapiens
ccuaguggcccuucacaca

SEQ ID NO: 81361 - RNA, 19 nt, Homo sapiens
gguugaggcagcaaacaga

SEQ ID NO: 81362 - RNA, 19 nt, Homo sapiens
ggagcacaccaauaacaag

SEQ ID NO: 81363 - RNA, 19 nt, Homo sapiens
ucagacguguaugcaaaug

SEQ ID NO: 81364 - RNA, 19 nt, Homo sapiens
acucuguccugggaaauga

SEQ ID NO: 81365 - RNA, 19 nt, Homo sapiens
ccaccuucccuguccugua

SEQ ID NO: 81366 - RNA, 19 nt, Homo sapiens
uaacccuacucuccucucu

SEQ ID NO: 81367 - RNA, 19 nt, Homo sapiens
auaaugcacuuccuuaccu

SEQ ID NO: 81368 - RNA, 19 nt, Homo sapiens
gagugauggauaaggauga

SEQ ID NO: 81369 - RNA, 19 nt, Homo sapiens
gaguaguggcccugacuuc

SEQ ID NO: 81370 - RNA, 19 nt, Homo sapiens
ggaguaguggcccugacuu

SEQ ID NO: 81371 - RNA, 19 nt, Homo sapiens
cauuucacgcuaaggagua

SEQ ID NO: 81372 - RNA, 19 nt, Homo sapiens
ucacccaggcaucugcuuu

SEQ ID NO: 81373 - RNA, 19 nt, Homo sapiens
gagcuggaggcggaccaua

SEQ ID NO: 81374 - RNA, 19 nt, Homo sapiens
uuccggcucugcacgcuuu

SEQ ID NO: 81375 - RNA, 19 nt, Homo sapiens
caagucacucaucucagaa

SEQ ID NO: 81376 - RNA, 19 nt, Homo sapiens
aagcuuaagugggcagaca

SEQ ID NO: 81377 - RNA, 19 nt, Homo sapiens
cgcggaagagcgaggguua

SEQ ID NO: 81378 - RNA, 19 nt, Homo sapiens
cagcugcagcgaugucaug

SEQ ID NO: 81379 - RNA, 19 nt, Homo sapiens
gcggaagagcgaggguuaa

SEQ ID NO: 81380 - RNA, 19 nt, Homo sapiens
gggaaaugaagaagcaucu

SEQ ID NO: 81381 - RNA, 19 nt, Homo sapiens
guacucugcacugguguga

SEQ ID NO: 81382 - RNA, 19 nt, Homo sapiens
cuaguggcccuucacacaa

SEQ ID NO: 81383 - RNA, 19 nt, Homo sapiens
ggagggauugacauguuuc

SEQ ID NO: 81384 - RNA, 19 nt, Homo sapiens
cacgugcucucuggaggaa

SEQ ID NO: 81385 - RNA, 19 nt, Homo sapiens
gauaaggaugagucuugga

SEQ ID NO: 81386 - RNA, 19 nt, Homo sapiens
cugcagcggccacacugua

SEQ ID NO: 81387 - RNA, 19 nt, Homo sapiens
gcacugccgagaacagcau

SEQ ID NO: 81388 - RNA, 19 nt, Homo sapiens
aagaggaagggaaagaaga

SEQ ID NO: 81389 - RNA, 19 nt, Homo sapiens
gcagauggccuaauacuua

SEQ ID NO: 81390 - RNA, 19 nt, Homo sapiens
gaacaaagauggcauucuc

SEQ ID NO: 81391 - RNA, 19 nt, Homo sapiens
gaagagagauaagguguga

SEQ ID NO: 81392 - RNA, 19 nt, Homo sapiens
gcaagacaguuaacaaugu

SEQ ID NO: 81393 - RNA, 19 nt, Homo sapiens
ggaaagaugccucuaaguu

SEQ ID NO: 81394 - RNA, 19 nt, Homo sapiens
guacaaugcccaaauaauu

SEQ ID NO: 81395 - RNA, 19 nt, Homo sapiens
caagacaguuaacaaugua

SEQ ID NO: 81396 - RNA, 19 nt, Homo sapiens
gaaagaugccucuaaguuc

SEQ ID NO: 81397 - RNA, 19 nt, Homo sapiens
agauacagcuccaggguua

SEQ ID NO: 81398 - RNA, 19 nt, Homo sapiens
gaagaaagcgccucucuac

SEQ ID NO: 81399 - RNA, 19 nt, Homo sapiens
ggacagaaagggcauaaug

SEQ ID NO: 81400 - RNA, 19 nt, Homo sapiens
cagauacacuugugacuga

SEQ ID NO: 81401 - RNA, 19 nt, Homo sapiens
cuaggaggcugaucuugua

SEQ ID NO: 81402 - RNA, 19 nt, Homo sapiens
ggaaucuggugauccaauu

SEQ ID NO: 81403 - RNA, 19 nt, Homo sapiens
gaaaagggcuccauucaag

SEQ ID NO: 81404 - RNA, 19 nt, Homo sapiens
gauggaaagcacaaauuua

SEQ ID NO: 81405 - RNA, 19 nt, Homo sapiens
ugaaucagaugaagagaga

SEQ ID NO: 81406 - RNA, 19 nt, Homo sapiens
uagcaacucugcccuaaug

SEQ ID NO: 81407 - RNA, 19 nt, Homo sapiens
ggcaaagcaucuaaacaaa

SEQ ID NO: 81408 - RNA, 19 nt, Homo sapiens
ccagaggugugguauagaa

SEQ ID NO: 81409 - RNA, 19 nt, Homo sapiens
gaucuuguacuccauauga

SEQ ID NO: 81410 - RNA, 19 nt, Homo sapiens
gaaagggcauaaugagucu

SEQ ID NO: 81411 - RNA, 19 nt, Homo sapiens
gaaagcgccucucuaccau

SEQ ID NO: 81412 - RNA, 19 nt, Homo sapiens
gagaauguguuguccaucu

SEQ ID NO: 81413 - RNA, 19 nt, Homo sapiens
gcaggaaagaugccucuaa

SEQ ID NO: 81414 - RNA, 19 nt, Homo sapiens
cgaaacacguauaccagaa

SEQ ID NO: 81415 - RNA, 19 nt, Homo sapiens
caaacuacacaggguauua

SEQ ID NO: 81416 - RNA, 19 nt, Homo sapiens
ccaauucccugguuuguac

SEQ ID NO: 81417 - RNA, 19 nt, Homo sapiens
ggaagaaagcgccucucua

SEQ ID NO: 81418 - RNA, 19 nt, Homo sapiens
gguuuguacuucaucauuu

SEQ ID NO: 81419 - RNA, 19 nt, Homo sapiens
gaaauaggguguggucacu

SEQ ID NO: 81420 - RNA, 19 nt, Homo sapiens
gcuagcaacucugcccuaa

SEQ ID NO: 81421 - RNA, 19 nt, Homo sapiens
ccgcagcuauuucuauuug

SEQ ID NO: 81422 - RNA, 19 nt, Homo sapiens
ggaggaaauugcucagaag

SEQ ID NO: 81423 - RNA, 19 nt, Homo sapiens
ggccagaggugugguauag

SEQ ID NO: 81424 - RNA, 19 nt, Homo sapiens
gaaggaagcaacagagaag

SEQ ID NO: 81425 - RNA, 19 nt, Homo sapiens
ucaauucacuggcaaaugc

SEQ ID NO: 81426 - RNA, 19 nt, Homo sapiens
agagacagcaagacaguua

SEQ ID NO: 81427 - RNA, 19 nt, Homo sapiens
gggcaguccuccuucucua

SEQ ID NO: 81428 - RNA, 19 nt, Homo sapiens
gacagaaagggcauaauga

SEQ ID NO: 81429 - RNA, 19 nt, Homo sapiens
gagauggaaagcacaaauu

SEQ ID NO: 81430 - RNA, 19 nt, Homo sapiens
gaucaaggacucucucaca

SEQ ID NO: 81431 - RNA, 19 nt, Homo sapiens
ccucuuauguauccugaaa

SEQ ID NO: 81432 - RNA, 19 nt, Homo sapiens
gagaugggcccagaacuga

SEQ ID NO: 81433 - RNA, 19 nt, Homo sapiens
uguauggucuugaucuauu

SEQ ID NO: 81434 - RNA, 19 nt, Homo sapiens
gggaagacuauauaaagaa

SEQ ID NO: 81435 - RNA, 19 nt, Homo sapiens
gaaccagaaacccauauca

SEQ ID NO: 81436 - RNA, 19 nt, Homo sapiens
aaagaugccucuaaguucu

SEQ ID NO: 81437 - RNA, 19 nt, Homo sapiens
gaauaagaagucagacaga

SEQ ID NO: 81438 - RNA, 19 nt, Homo sapiens
gcaggaauaagaagucaga

SEQ ID NO: 81439 - RNA, 19 nt, Homo sapiens
guauggucuugaucuauuu

SEQ ID NO: 81440 - RNA, 19 nt, Homo sapiens
caggaaagaugccucuaag

SEQ ID NO: 81441 - RNA, 19 nt, Homo sapiens
ggucaacaccaccauauca

SEQ ID NO: 81442 - RNA, 19 nt, Homo sapiens
accagaaucucucucaauu

SEQ ID NO: 81443 - RNA, 19 nt, Homo sapiens
cuuguacaaugcccaaaua

SEQ ID NO: 81444 - RNA, 19 nt, Homo sapiens
ggacuccauucccaacuca

SEQ ID NO: 81445 - RNA, 19 nt, Homo sapiens
gaaaacaaguucaaagacu

SEQ ID NO: 81446 - RNA, 19 nt, Homo sapiens
uggcaaagcaucuaaacaa

SEQ ID NO: 81447 - RNA, 19 nt, Homo sapiens
gagcugggugugaguguuu

SEQ ID NO: 81448 - RNA, 19 nt, Homo sapiens
ucucaauucuugcuggauu

SEQ ID NO: 81449 - RNA, 19 nt, Homo sapiens
gaaccaugcccaguuuaug

SEQ ID NO: 81450 - RNA, 19 nt, Homo sapiens
gaaacacguauaccagaau

SEQ ID NO: 81451 - RNA, 19 nt, Homo sapiens
caucaacaagcauaucaaa

SEQ ID NO: 81452 - RNA, 19 nt, Homo sapiens
caaauaauucugucgaucu

SEQ ID NO: 81453 - RNA, 19 nt, Homo sapiens
gcacuaggaggcugaucuu

SEQ ID NO: 81454 - RNA, 19 nt, Homo sapiens
aaacuacacaggguauuaa

SEQ ID NO: 81455 - RNA, 19 nt, Homo sapiens
gcaccuuuccucuugagaa

SEQ ID NO: 81456 - RNA, 19 nt, Homo sapiens
ggauacauuccaguacaua

SEQ ID NO: 81457 - RNA, 19 nt, Homo sapiens
gcaggucaacaccaccaua

SEQ ID NO: 81458 - RNA, 19 nt, Homo sapiens
uuugagagccuccaguuaa

SEQ ID NO: 81459 - RNA, 19 nt, Homo sapiens
gcagggaagcaauguagug

SEQ ID NO: 81460 - RNA, 19 nt, Homo sapiens
uugagagccuccaguuaaa

SEQ ID NO: 81461 - RNA, 19 nt, Homo sapiens
gcaaacgaaacacguauac

SEQ ID NO: 81462 - RNA, 19 nt, Homo sapiens
guuuguacuucaucauuug

SEQ ID NO: 81463 - RNA, 19 nt, Homo sapiens
ccucuaaguucuugucucu

SEQ ID NO: 81464 - RNA, 19 nt, Homo sapiens
cagcaagacaguuaacaau

SEQ ID NO: 81465 - RNA, 19 nt, Homo sapiens
aaucagaugaagagagaua

SEQ ID NO: 81466 - RNA, 19 nt, Homo sapiens
ccacgagccgcagcuauuu

SEQ ID NO: 81467 - RNA, 19 nt, Homo sapiens
gaggaaauugcucagaaga

SEQ ID NO: 81468 - RNA, 19 nt, Homo sapiens
aggaggaaauugcucagaa

SEQ ID NO: 81469 - RNA, 19 nt, Homo sapiens
uacagauccuggacagaaa

SEQ ID NO: 81470 - RNA, 19 nt, Homo sapiens
uuacagauccuggacagaa

SEQ ID NO: 81471 - RNA, 19 nt, Homo sapiens
ucacaugauucaggauuca

SEQ ID NO: 81472 - RNA, 19 nt, Homo sapiens
uguuguccaucuucuuaua

SEQ ID NO: 81473 - RNA, 19 nt, Homo sapiens
aaacacguauaccagaauc

SEQ ID NO: 81474 - RNA, 19 nt, Homo sapiens
ggggaagacuauauaaaga

SEQ ID NO: 81475 - RNA, 19 nt, Homo sapiens
gcaaagcaucuaaacaaaa

SEQ ID NO: 81476 - RNA, 19 nt, Homo sapiens
ccaaggcaacauaaaauua

SEQ ID NO: 81477 - RNA, 19 nt, Homo sapiens
ccauaucaagggugacuaa

SEQ ID NO: 81478 - RNA, 19 nt, Homo sapiens
agauggaaagcacaaauuu

SEQ ID NO: 81479 - RNA, 19 nt, Homo sapiens
gcagcuauuucuauuugac

SEQ ID NO: 81480 - RNA, 19 nt, Homo sapiens
caaccucuaauucacugua

SEQ ID NO: 81481 - RNA, 19 nt, Homo sapiens
uguggucacucucaauuca

SEQ ID NO: 81482 - RNA, 19 nt, Homo sapiens
ggagcugggugugaguguu

SEQ ID NO: 81483 - RNA, 19 nt, Homo sapiens
uguguuguccaucuucuua

SEQ ID NO: 81484 - RNA, 19 nt, Homo sapiens
gagccgcagcuauuucuau

SEQ ID NO: 81485 - RNA, 19 nt, Homo sapiens
aaacgaaacacguauacca

SEQ ID NO: 81486 - RNA, 19 nt, Homo sapiens
auaauucugucgaucugaa

SEQ ID NO: 81487 - RNA, 19 nt, Homo sapiens
aaauaauucugucgaucug

SEQ ID NO: 81488 - RNA, 19 nt, Homo sapiens
gcaguuucuuguacaaugc

SEQ ID NO: 81489 - RNA, 19 nt, Homo sapiens
caagcuagaucaagaagua

SEQ ID NO: 81490 - RNA, 19 nt, Homo sapiens
caaacaagcuagaucaaga

SEQ ID NO: 81491 - RNA, 19 nt, Homo sapiens
ugaguuuccugcuauauua

SEQ ID NO: 81492 - RNA, 19 nt, Homo sapiens
uaagaaguccuaucucaua

SEQ ID NO: 81493 - RNA, 19 nt, Homo sapiens
aaucaaaucugugcucuuu

SEQ ID NO: 81494 - RNA, 19 nt, Homo sapiens
gaccaaaggcugauucuug

SEQ ID NO: 81495 - RNA, 19 nt, Homo sapiens
gaaguaccaaauacaguua

SEQ ID NO: 81496 - RNA, 19 nt, Homo sapiens
uauaagaaguccuaucuca

SEQ ID NO: 81497 - RNA, 19 nt, Homo sapiens
ggauaaugguucauacuuc

SEQ ID NO: 81498 - RNA, 19 nt, Homo sapiens
aaucugugcucuuucauuu

SEQ ID NO: 81499 - RNA, 19 nt, Homo sapiens
cccaacaacugguaucuuu

SEQ ID NO: 81500 - RNA, 19 nt, Homo sapiens
gcugugagcauuaaauaaa

SEQ ID NO: 81501 - RNA, 19 nt, Homo sapiens
ucaaaucugugcucuuuca

SEQ ID NO: 81502 - RNA, 19 nt, Homo sapiens
gcugauucuuggagauuua

SEQ ID NO: 81503 - RNA, 19 nt, Homo sapiens
gcaauggguuuauagacau

SEQ ID NO: 81504 - RNA, 19 nt, Homo sapiens
ggaaguaccaaauacaguu

SEQ ID NO: 81505 - RNA, 19 nt, Homo sapiens
gagaggaaguaccaaauac

SEQ ID NO: 81506 - RNA, 19 nt, Homo sapiens
gauaaugguucauacuucu

SEQ ID NO: 81507 - RNA, 19 nt, Homo sapiens
ugaaguagguauaagaagu

SEQ ID NO: 81508 - RNA, 19 nt, Homo sapiens
aacaucaucuugagacuuu

SEQ ID NO: 81509 - RNA, 19 nt, Homo sapiens
ccacagaacccaacaacug

SEQ ID NO: 81510 - RNA, 19 nt, Homo sapiens
ggcaauggguuuauagaca

SEQ ID NO: 81511 - RNA, 19 nt, Homo sapiens
ccaaauacaguuacaaauc

SEQ ID NO: 81512 - RNA, 19 nt, Homo sapiens
ggagauggcucagggaaac

SEQ ID NO: 81513 - RNA, 19 nt, Homo sapiens
aaauaaagguacacaugga

SEQ ID NO: 81514 - RNA, 19 nt, Homo sapiens
gcaucaggcucagcuagaa

SEQ ID NO: 81515 - RNA, 19 nt, Homo sapiens
ucaccuauguuccacagaa

SEQ ID NO: 81516 - RNA, 19 nt, Homo sapiens
ggagagaggaaguaccaaa

SEQ ID NO: 81517 - RNA, 19 nt, Homo sapiens
ggaaggagccauuauaucc

SEQ ID NO: 81518 - RNA, 19 nt, Homo sapiens
gaggagggauaaugguuca

SEQ ID NO: 81519 - RNA, 19 nt, Homo sapiens
ggagggauaaugguucaua

SEQ ID NO: 81520 - RNA, 19 nt, Homo sapiens
gcagagagucguggaauca

SEQ ID NO: 81521 - RNA, 19 nt, Homo sapiens
ggacagcagugggcagcaa

SEQ ID NO: 81522 - RNA, 19 nt, Homo sapiens
uggaggagcugguguuaca

SEQ ID NO: 81523 - RNA, 19 nt, Homo sapiens
ccucaucccuggcacucua

SEQ ID NO: 81524 - RNA, 19 nt, Homo sapiens
ccacaaacaagcuagauca

SEQ ID NO: 81525 - RNA, 19 nt, Homo sapiens
uggaugaggagcugcauua

SEQ ID NO: 81526 - RNA, 19 nt, Homo sapiens
agagaggaaguaccaaaua

SEQ ID NO: 81527 - RNA, 19 nt, Homo sapiens
gguauaagaaguccuaucu

SEQ ID NO: 81528 - RNA, 19 nt, Homo sapiens
ggcuauggauccaaauuuc

SEQ ID NO: 81529 - RNA, 19 nt, Homo sapiens
uaugugaguuuccugcuau

SEQ ID NO: 81530 - RNA, 19 nt, Homo sapiens
cuaaguguaugaugucaca

SEQ ID NO: 81531 - RNA, 19 nt, Homo sapiens
gaaguagguauaagaaguc

SEQ ID NO: 81532 - RNA, 19 nt, Homo sapiens
acugaaaccucaagcuguu

SEQ ID NO: 81533 - RNA, 19 nt, Homo sapiens
agagagucguggaaucaaa

SEQ ID NO: 81534 - RNA, 19 nt, Homo sapiens
cacaggcaauggguuuaua

SEQ ID NO: 81535 - RNA, 19 nt, Homo sapiens
ggacaccuccaccgaauac

SEQ ID NO: 81536 - RNA, 19 nt, Homo sapiens
gaugaggagcugcauuaug

SEQ ID NO: 81537 - RNA, 19 nt, Homo sapiens
gcagugggcagcaaugaca

SEQ ID NO: 81538 - RNA, 19 nt, Homo sapiens
aaccuuaccugcucugugu

SEQ ID NO: 81539 - RNA, 19 nt, Homo sapiens
gagagaggaaguaccaaau

SEQ ID NO: 81540 - RNA, 19 nt, Homo sapiens
gggauaaugguucauacuu

SEQ ID NO: 81541 - RNA, 19 nt, Homo sapiens
gaagauccacauccucuac

SEQ ID NO: 81542 - RNA, 19 nt, Homo sapiens
gcuagaagauccacauccu

SEQ ID NO: 81543 - RNA, 19 nt, Homo sapiens
gaucuucuccugguuguca

SEQ ID NO: 81544 - RNA, 19 nt, Homo sapiens
aaacaagcuagaucaagaa

SEQ ID NO: 81545 - RNA, 19 nt, Homo sapiens
gggaaggagccauuauauc

SEQ ID NO: 81546 - RNA, 19 nt, Homo sapiens
ccgggaaggagccauuaua

SEQ ID NO: 81547 - RNA, 19 nt, Homo sapiens
gcccugcacuuucuuccau

SEQ ID NO: 81548 - RNA, 19 nt, Homo sapiens
caacgucaccuauguucca

SEQ ID NO: 81549 - RNA, 19 nt, Homo sapiens
gagggauaaugguucauac

SEQ ID NO: 81550 - RNA, 19 nt, Homo sapiens
gagagucguggaaucaaau

SEQ ID NO: 81551 - RNA, 19 nt, Homo sapiens
gugaguuuccugcuauauu

SEQ ID NO: 81552 - RNA, 19 nt, Homo sapiens
cgaaacaccagaagaacuc

SEQ ID NO: 81553 - RNA, 19 nt, Homo sapiens
ugccucaucuucuucauag

SEQ ID NO: 81554 - RNA, 19 nt, Homo sapiens
aaggacaccuccaccgaau

SEQ ID NO: 81555 - RNA, 19 nt, Homo sapiens
gcucaacgucaccuauguu

SEQ ID NO: 81556 - RNA, 19 nt, Homo sapiens
cacacaagcuccuuaaccu

SEQ ID NO: 81557 - RNA, 19 nt, Homo sapiens
uuaugugaguuuccugcua

SEQ ID NO: 81558 - RNA, 19 nt, Homo sapiens
agagaaccauccagcucaa

SEQ ID NO: 81559 - RNA, 19 nt, Homo sapiens
cgggaaggagccauuauau

SEQ ID NO: 81560 - RNA, 19 nt, Homo sapiens
gcucuuucauuugcuaagu

SEQ ID NO: 81561 - RNA, 19 nt, Homo sapiens
gaguuuccugcuauauuaa

SEQ ID NO: 81562 - RNA, 19 nt, Homo sapiens
gaacccaacaacugguauc

SEQ ID NO: 81563 - RNA, 19 nt, Homo sapiens
gaggaaguaccaaauacag

SEQ ID NO: 81564 - RNA, 19 nt, Homo sapiens
gggcagauuccgccuccuu

SEQ ID NO: 81565 - RNA, 19 nt, Homo sapiens
cagaacccaacaacuggua

SEQ ID NO: 81566 - RNA, 19 nt, Homo sapiens
aaccuuccaugucuccauu

SEQ ID NO: 81567 - RNA, 19 nt, Homo sapiens
ggcugauucuuggagauuu

SEQ ID NO: 81568 - RNA, 19 nt, Homo sapiens
augcuucccucaacuuuca

SEQ ID NO: 81569 - RNA, 19 nt, Homo sapiens
gaaucaaaucugugcucuu

SEQ ID NO: 81570 - RNA, 19 nt, Homo sapiens
uaacaucaucuugagacuu

SEQ ID NO: 81571 - RNA, 19 nt, Homo sapiens
cagcccugcucgcucuuug

SEQ ID NO: 81572 - RNA, 19 nt, Homo sapiens
uggcuauggauccaaauuu

SEQ ID NO: 81573 - RNA, 19 nt, Homo sapiens
gucguggaaucaaaucugu

SEQ ID NO: 81574 - RNA, 19 nt, Homo sapiens
ccacaggcaauggguuuau

SEQ ID NO: 81575 - RNA, 19 nt, Homo sapiens
uuacauggccccacugaaa

SEQ ID NO: 81576 - RNA, 19 nt, Homo sapiens
gaagacccacaggaggaaa

SEQ ID NO: 81577 - RNA, 19 nt, Homo sapiens
caagugcaggagucaguga

SEQ ID NO: 81578 - RNA, 19 nt, Homo sapiens
ugacgguacaggaggguuu

SEQ ID NO: 81579 - RNA, 19 nt, Homo sapiens
aauaaagguacacauggaa

SEQ ID NO: 81580 - RNA, 19 nt, Homo sapiens
ggaugaggagcugcauuau

SEQ ID NO: 81581 - RNA, 19 nt, Homo sapiens
ucacuccucggugcucaua

SEQ ID NO: 81582 - RNA, 19 nt, Homo sapiens
ggaccaaaggcugauucuu

SEQ ID NO: 81583 - RNA, 19 nt, Homo sapiens
cuacuguggagauggauga

SEQ ID NO: 81584 - RNA, 19 nt, Homo sapiens
caacaacugguaucuuucc

SEQ ID NO: 81585 - RNA, 19 nt, Homo sapiens
ccagcucucugugcaugug

SEQ ID NO: 81586 - RNA, 19 nt, Homo sapiens
auaaagguacacauggaaa

SEQ ID NO: 81587 - RNA, 19 nt, Homo sapiens
ugucacacaagcuccuuaa

SEQ ID NO: 81588 - RNA, 19 nt, Homo sapiens
ccugcuauauuaacaucau

SEQ ID NO: 81589 - RNA, 19 nt, Homo sapiens
gaaauacgguuauacaucu

SEQ ID NO: 81590 - RNA, 19 nt, Homo sapiens
gcaccaaccucaccuguca

SEQ ID NO: 81591 - RNA, 19 nt, Homo sapiens
ggaauuguccaaagcauaa

SEQ ID NO: 81592 - RNA, 19 nt, Homo sapiens
ccacaaaccgagugacaua

SEQ ID NO: 81593 - RNA, 19 nt, Homo sapiens
ccacagcaauguaccacaa

SEQ ID NO: 81594 - RNA, 19 nt, Homo sapiens
aaacagcgcagccuucaaa

SEQ ID NO: 81595 - RNA, 19 nt, Homo sapiens
ucuaaggccucucuuguug

SEQ ID NO: 81596 - RNA, 19 nt, Homo sapiens
guacucagaaaucaagaua

SEQ ID NO: 81597 - RNA, 19 nt, Homo sapiens
cacauggucuuuccucuga

SEQ ID NO: 81598 - RNA, 19 nt, Homo sapiens
gcauacuucuuucgguuga

SEQ ID NO: 81599 - RNA, 19 nt, Homo sapiens
gacauaaacacagaacuuu

SEQ ID NO: 81600 - RNA, 19 nt, Homo sapiens
cgagugacauaaacacaga

SEQ ID NO: 81601 - RNA, 19 nt, Homo sapiens
gaugaaauacgguuauaca

SEQ ID NO: 81602 - RNA, 19 nt, Homo sapiens
guccuaaucuucucuucuu

SEQ ID NO: 81603 - RNA, 19 nt, Homo sapiens
cccaugaccuaauuuaaau

SEQ ID NO: 81604 - RNA, 19 nt, Homo sapiens
gaaaucaagauacacaagu

SEQ ID NO: 81605 - RNA, 19 nt, Homo sapiens
ccucugggcucccugcaaa

SEQ ID NO: 81606 - RNA, 19 nt, Homo sapiens
gauguuagaggucugagaa

SEQ ID NO: 81607 - RNA, 19 nt, Homo sapiens
caaagcauaaccuugauug

SEQ ID NO: 81608 - RNA, 19 nt, Homo sapiens
ugacauaaacacagaacuu

SEQ ID NO: 81609 - RNA, 19 nt, Homo sapiens
guccaaagcauaaccuuga

SEQ ID NO: 81610 - RNA, 19 nt, Homo sapiens
ccacuacgcuguccuacac

SEQ ID NO: 81611 - RNA, 19 nt, Homo sapiens
auacacaagugaggaauug

SEQ ID NO: 81612 - RNA, 19 nt, Homo sapiens
agacaggcauaguuucaga

SEQ ID NO: 81613 - RNA, 19 nt, Homo sapiens
aaacacggaugaugugaac

SEQ ID NO: 81614 - RNA, 19 nt, Homo sapiens
ggaaacagcgcagccuuca

SEQ ID NO: 81615 - RNA, 19 nt, Homo sapiens
caaacgacccagacgaaga

SEQ ID NO: 81616 - RNA, 19 nt, Homo sapiens
acucagaaaucaagauaca

SEQ ID NO: 81617 - RNA, 19 nt, Homo sapiens
aguagggucugcagaagaa

SEQ ID NO: 81618 - RNA, 19 nt, Homo sapiens
gaaccauccagcucaaugu

SEQ ID NO: 81619 - RNA, 19 nt, Homo sapiens
ucaaguagggucugcagaa

SEQ ID NO: 81620 - RNA, 19 nt, Homo sapiens
ugaaauacgguuauacauc

SEQ ID NO: 81621 - RNA, 19 nt, Homo sapiens
uggaugaaauacgguuaua

SEQ ID NO: 81622 - RNA, 19 nt, Homo sapiens
ccucguacccugcagauug

SEQ ID NO: 81623 - RNA, 19 nt, Homo sapiens
gauaguuucagauguuaga

SEQ ID NO: 81624 - RNA, 19 nt, Homo sapiens
ucgauaguuucagauguua

SEQ ID NO: 81625 - RNA, 19 nt, Homo sapiens
aaaucaagauacacaagug

SEQ ID NO: 81626 - RNA, 19 nt, Homo sapiens
aaacgacccagacgaagaa

SEQ ID NO: 81627 - RNA, 19 nt, Homo sapiens
caaaggucaccgacacuga

SEQ ID NO: 81628 - RNA, 19 nt, Homo sapiens
caaguagggucugcagaag

SEQ ID NO: 81629 - RNA, 19 nt, Homo sapiens
ugaguguguuuguguccua

SEQ ID NO: 81630 - RNA, 19 nt, Homo sapiens
caaaccgagugacauaaac

SEQ ID NO: 81631 - RNA, 19 nt, Homo sapiens
gauacacaagugaggaauu

SEQ ID NO: 81632 - RNA, 19 nt, Homo sapiens
gagccggugugaccaugga

SEQ ID NO: 81633 - RNA, 19 nt, Homo sapiens
acaaaccgagugacauaaa

SEQ ID NO: 81634 - RNA, 19 nt, Homo sapiens
gaggaauuguccaaagcau

SEQ ID NO: 81635 - RNA, 19 nt, Homo sapiens
ccagcucaaugucuccuau

SEQ ID NO: 81636 - RNA, 19 nt, Homo sapiens
caagugaggaauuguccaa

SEQ ID NO: 81637 - RNA, 19 nt, Homo sapiens
ccagacaggcauaguuuca

SEQ ID NO: 81638 - RNA, 19 nt, Homo sapiens
ucagaaaucaagauacaca

SEQ ID NO: 81639 - RNA, 19 nt, Homo sapiens
gagugaagacuagaaggaa

SEQ ID NO: 81640 - RNA, 19 nt, Homo sapiens
acacagaacuuuauuuucg

SEQ ID NO: 81641 - RNA, 19 nt, Homo sapiens
ccucucaguguauugguua

SEQ ID NO: 81642 - RNA, 19 nt, Homo sapiens
cacaaacgacccagacgaa

SEQ ID NO: 81643 - RNA, 19 nt, Homo sapiens
cuccuaugcuccacagaaa

SEQ ID NO: 81644 - RNA, 19 nt, Homo sapiens
gaguguguuuguguccuaa

SEQ ID NO: 81645 - RNA, 19 nt, Homo sapiens
auggguaccucucagugua

SEQ ID NO: 81646 - RNA, 19 nt, Homo sapiens
gcagaagaaggagauuuca

SEQ ID NO: 81647 - RNA, 19 nt, Homo sapiens
cgacccagacgaagaagug

SEQ ID NO: 81648 - RNA, 19 nt, Homo sapiens
gaaacagcgcagccuucaa

SEQ ID NO: 81649 - RNA, 19 nt, Homo sapiens
agagaaccauccagcucaa

SEQ ID NO: 81650 - RNA, 19 nt, Homo sapiens
ggguaccucucaguguauu

SEQ ID NO: 81651 - RNA, 19 nt, Homo sapiens
aagcauaaccuugauugga

SEQ ID NO: 81652 - RNA, 19 nt, Homo sapiens
ccaaagcauaaccuugauu

SEQ ID NO: 81653 - RNA, 19 nt, Homo sapiens
uguguuugcuucaucuuca

SEQ ID NO: 81654 - RNA, 19 nt, Homo sapiens
uuagaggucugagaacaag

SEQ ID NO: 81655 - RNA, 19 nt, Homo sapiens
uucgauaguuucagauguu

SEQ ID NO: 81656 - RNA, 19 nt, Homo sapiens
gugaagacuagaaggaaga

SEQ ID NO: 81657 - RNA, 19 nt, Homo sapiens
cugagucucuuugugcauu

SEQ ID NO: 81658 - RNA, 19 nt, Homo sapiens
caucagcaucuuccaagga

SEQ ID NO: 81659 - RNA, 19 nt, Homo sapiens
guuagaggucugagaacaa

SEQ ID NO: 81660 - RNA, 19 nt, Homo sapiens
gugaggaauuguccaaagc

SEQ ID NO: 81661 - RNA, 19 nt, Homo sapiens
gcaaaacacggaugaugug

SEQ ID NO: 81662 - RNA, 19 nt, Homo sapiens
cugcacaccugagcugguu

SEQ ID NO: 81663 - RNA, 19 nt, Homo sapiens
cagccucguacuaugguua

SEQ ID NO: 81664 - RNA, 19 nt, Homo sapiens
ugcuucaucuucagaguga

SEQ ID NO: 81665 - RNA, 19 nt, Homo sapiens
gauauaugugcgugugaug

SEQ ID NO: 81666 - RNA, 19 nt, Homo sapiens
gauuagggccuccccauga

SEQ ID NO: 81667 - RNA, 19 nt, Homo sapiens
ccuaaucuucucuucuuau

SEQ ID NO: 81668 - RNA, 19 nt, Homo sapiens
uccuaaucuucucuucuua

SEQ ID NO: 81669 - RNA, 19 nt, Homo sapiens
ucaguguauugguuacuag

SEQ ID NO: 81670 - RNA, 19 nt, Homo sapiens
guguuuguguccuaaucuu

SEQ ID NO: 81671 - RNA, 19 nt, Homo sapiens
gcuccacuacgcuguccua

SEQ ID NO: 81672 - RNA, 19 nt, Homo sapiens
ggugugaccauggagagaa

SEQ ID NO: 81673 - RNA, 19 nt, Homo sapiens
aaucaagauacacaaguga

SEQ ID NO: 81674 - RNA, 19 nt, Homo sapiens
ggugcaaccucaggaacca

SEQ ID NO: 81675 - RNA, 19 nt, Homo sapiens
guuccagacaggcauaguu

SEQ ID NO: 81676 - RNA, 19 nt, Homo sapiens
agagugaagacuagaagga

SEQ ID NO: 81677 - RNA, 19 nt, Homo sapiens
ugagucucuuugugcauug

SEQ ID NO: 81678 - RNA, 19 nt, Homo sapiens
gaacaggccucccaaguuu

SEQ ID NO: 81679 - RNA, 19 nt, Homo sapiens
gaacagaaauuuccagcaa

SEQ ID NO: 81680 - RNA, 19 nt, Homo sapiens
gcaccaaucugaccugaaa

SEQ ID NO: 81681 - RNA, 19 nt, Homo sapiens
gaucagcuccuaacccuua

SEQ ID NO: 81682 - RNA, 19 nt, Homo sapiens
gcaaugaggccacaacaaa

SEQ ID NO: 81683 - RNA, 19 nt, Homo sapiens
guaaugauauagccagaaa

SEQ ID NO: 81684 - RNA, 19 nt, Homo sapiens
gcacuagccuugcaacauc

SEQ ID NO: 81685 - RNA, 19 nt, Homo sapiens
gcaauuaaagugauacuga

SEQ ID NO: 81686 - RNA, 19 nt, Homo sapiens
caacaaacaucacagaaac

SEQ ID NO: 81687 - RNA, 19 nt, Homo sapiens
gggcaucacuggcuauuuc

SEQ ID NO: 81688 - RNA, 19 nt, Homo sapiens
caccagagcuauucccaaa

SEQ ID NO: 81689 - RNA, 19 nt, Homo sapiens
caucaaggcagaaaucaaa

SEQ ID NO: 81690 - RNA, 19 nt, Homo sapiens
ccagcaaacuccaacuuau

SEQ ID NO: 81691 - RNA, 19 nt, Homo sapiens
gcgcuuugcuugcugaguu

SEQ ID NO: 81692 - RNA, 19 nt, Homo sapiens
acaaacagcucaguucuag

SEQ ID NO: 81693 - RNA, 19 nt, Homo sapiens
uaaccucaguuuauggaaa

SEQ ID NO: 81694 - RNA, 19 nt, Homo sapiens
gaaacgacagucaaauuca

SEQ ID NO: 81695 - RNA, 19 nt, Homo sapiens
ccucaucucuccuccaaga

SEQ ID NO: 81696 - RNA, 19 nt, Homo sapiens
ccacuaaacccuauacauc

SEQ ID NO: 81697 - RNA, 19 nt, Homo sapiens
caccugcucucuuguaaug

SEQ ID NO: 81698 - RNA, 19 nt, Homo sapiens
gugcggaguuuaagaagga

SEQ ID NO: 81699 - RNA, 19 nt, Homo sapiens
aaacggccauucagcaaga

SEQ ID NO: 81700 - RNA, 19 nt, Homo sapiens
cagaaacgacagucaaauu

SEQ ID NO: 81701 - RNA, 19 nt, Homo sapiens
aaauguauccuaccaagaa

SEQ ID NO: 81702 - RNA, 19 nt, Homo sapiens
ccuccucucugccgcaaua

SEQ ID NO: 81703 - RNA, 19 nt, Homo sapiens
caucagagaagugaaauug

SEQ ID NO: 81704 - RNA, 19 nt, Homo sapiens
aggcagaaaucaaauguuc

SEQ ID NO: 81705 - RNA, 19 nt, Homo sapiens
gcuccucccuuguucucua

SEQ ID NO: 81706 - RNA, 19 nt, Homo sapiens
cagcccugcuuaccagaua

SEQ ID NO: 81707 - RNA, 19 nt, Homo sapiens
ucaugagucuugacaacaa

SEQ ID NO: 81708 - RNA, 19 nt, Homo sapiens
caaugacgguuggaaauag

SEQ ID NO: 81709 - RNA, 19 nt, Homo sapiens
ucaaugacgguuggaaaua

SEQ ID NO: 81710 - RNA, 19 nt, Homo sapiens
acagucaaauucacaucua

SEQ ID NO: 81711 - RNA, 19 nt, Homo sapiens
caagaaacuacaacaccua

SEQ ID NO: 81712 - RNA, 19 nt, Homo sapiens
gacaacaacgguacugcua

SEQ ID NO: 81713 - RNA, 19 nt, Homo sapiens
ccucucaccuguacucuuc

SEQ ID NO: 81714 - RNA, 19 nt, Homo sapiens
gacaaacagcucaguucua

SEQ ID NO: 81715 - RNA, 19 nt, Homo sapiens
gcucucuuguaaugauaua

SEQ ID NO: 81716 - RNA, 19 nt, Homo sapiens
caacagaacagaaauuucc

SEQ ID NO: 81717 - RNA, 19 nt, Homo sapiens
gaauacaaagugauguguu

SEQ ID NO: 81718 - RNA, 19 nt, Homo sapiens
gagaguauuggguagauau

SEQ ID NO: 81719 - RNA, 19 nt, Homo sapiens
gaagagaguauuggguaga

SEQ ID NO: 81720 - RNA, 19 nt, Homo sapiens
gagaagcucccaggaacaa

SEQ ID NO: 81721 - RNA, 19 nt, Homo sapiens
gaaacacaaacucuucugu

SEQ ID NO: 81722 - RNA, 19 nt, Homo sapiens
gaaauuuccagagaagaga

SEQ ID NO: 81723 - RNA, 19 nt, Homo sapiens
ggacaaacagcucaguucu

SEQ ID NO: 81724 - RNA, 19 nt, Homo sapiens
gcuauuuccugaugaaucg

SEQ ID NO: 81725 - RNA, 19 nt, Homo sapiens
gccaacagaacagaaauuu

SEQ ID NO: 81726 - RNA, 19 nt, Homo sapiens
ugcaacaucucccacuaaa

SEQ ID NO: 81727 - RNA, 19 nt, Homo sapiens
ccuaguacccuuggaagua

SEQ ID NO: 81728 - RNA, 19 nt, Homo sapiens
caaacuccaacuuaugaaa

SEQ ID NO: 81729 - RNA, 19 nt, Homo sapiens
aaacucuucuguccaguca

SEQ ID NO: 81730 - RNA, 19 nt, Homo sapiens
acaucuaccucugugauaa

SEQ ID NO: 81731 - RNA, 19 nt, Homo sapiens
acaacaaacaucacagaaa

SEQ ID NO: 81732 - RNA, 19 nt, Homo sapiens
uaccagauaaugcuacuuu

SEQ ID NO: 81733 - RNA, 19 nt, Homo sapiens
ucagagaagugaaauugac

SEQ ID NO: 81734 - RNA, 19 nt, Homo sapiens
ccugucaccuggaaauguu

SEQ ID NO: 81735 - RNA, 19 nt, Homo sapiens
ccacaacaaacaucacaga

SEQ ID NO: 81736 - RNA, 19 nt, Homo sapiens
gcgaagacccuuauuacac

SEQ ID NO: 81737 - RNA, 19 nt, Homo sapiens
gggcgaagacccuuauuac

SEQ ID NO: 81738 - RNA, 19 nt, Homo sapiens
gcaagccaccagagcuauu

SEQ ID NO: 81739 - RNA, 19 nt, Homo sapiens
caaauguucaggcaucaga

SEQ ID NO: 81740 - RNA, 19 nt, Homo sapiens
gcucaguucuagucucucu

SEQ ID NO: 81741 - RNA, 19 nt, Homo sapiens
aaacagcucaguucuaguc

SEQ ID NO: 81742 - RNA, 19 nt, Homo sapiens
cagcaaacuccaacuuaug

SEQ ID NO: 81743 - RNA, 19 nt, Homo sapiens
caacaucucccacuaaacc

SEQ ID NO: 81744 - RNA, 19 nt, Homo sapiens
ucacagaaacgacagucaa

SEQ ID NO: 81745 - RNA, 19 nt, Homo sapiens
agaacaggccucccaaguu

SEQ ID NO: 81746 - RNA, 19 nt, Homo sapiens
gccaaggucuggagaagcu

SEQ ID NO: 81747 - RNA, 19 nt, Homo sapiens
agaaaggagucugcacaug

SEQ ID NO: 81748 - RNA, 19 nt, Homo sapiens
ucagaccuuucaaccacua

SEQ ID NO: 81749 - RNA, 19 nt, Homo sapiens
caccuguacucuuccgaaa

SEQ ID NO: 81750 - RNA, 19 nt, Homo sapiens
guucaugagucuugacaac

SEQ ID NO: 81751 - RNA, 19 nt, Homo sapiens
gcaaacuccaacuuaugaa

SEQ ID NO: 81752 - RNA, 19 nt, Homo sapiens
gcagaaaucaaauguucag

SEQ ID NO: 81753 - RNA, 19 nt, Homo sapiens
caaggcagaaaucaaaugu

SEQ ID NO: 81754 - RNA, 19 nt, Homo sapiens
agaaacgacagucaaauuc

SEQ ID NO: 81755 - RNA, 19 nt, Homo sapiens
aaagugauacugaaacaca

SEQ ID NO: 81756 - RNA, 19 nt, Homo sapiens
gaguauuggguagauauuu

SEQ ID NO: 81757 - RNA, 19 nt, Homo sapiens
caacacgugguggcugaua

SEQ ID NO: 81758 - RNA, 19 nt, Homo sapiens
uauccuaagugacaucaag

SEQ ID NO: 81759 - RNA, 19 nt, Homo sapiens
cagcucaguucuagucucu

SEQ ID NO: 81760 - RNA, 19 nt, Homo sapiens
uaccguuucuucccuguau

SEQ ID NO: 81761 - RNA, 19 nt, Homo sapiens
ccacugcacacaccucaga

SEQ ID NO: 81762 - RNA, 19 nt, Homo sapiens
aacagaaauuuccagcaaa

SEQ ID NO: 81763 - RNA, 19 nt, Homo sapiens
acagaaauuuccagcaaac

SEQ ID NO: 81764 - RNA, 19 nt, Homo sapiens
ggucuuggccaacagaaca

SEQ ID NO: 81765 - RNA, 19 nt, Homo sapiens
gcugugcggaguuuaagaa

SEQ ID NO: 81766 - RNA, 19 nt, Homo sapiens
gagaagugaaauugacuca

SEQ ID NO: 81767 - RNA, 19 nt, Homo sapiens
cacuaaacccuauacauca

SEQ ID NO: 81768 - RNA, 19 nt, Homo sapiens
guaaucagcacaguguuca

SEQ ID NO: 81769 - RNA, 19 nt, Homo sapiens
gugauguguuuaaauacug

SEQ ID NO: 81770 - RNA, 19 nt, Homo sapiens
auagaaauuuccagagaag

SEQ ID NO: 81771 - RNA, 19 nt, Homo sapiens
cuuguuugcuguugauuuc

SEQ ID NO: 81772 - RNA, 19 nt, Homo sapiens
gguccuuguuugcuguuga

SEQ ID NO: 81773 - RNA, 19 nt, Homo sapiens
gguggcugauaccgaauug

SEQ ID NO: 81774 - RNA, 19 nt, Homo sapiens
ugacaucaaggcagaaauc

SEQ ID NO: 81775 - RNA, 19 nt, Homo sapiens
uacaucaucuucuccuauc

SEQ ID NO: 81776 - RNA, 19 nt, Homo sapiens
ggaccgcgcuuugcuugcu

SEQ ID NO: 81777 - RNA, 19 nt, Homo sapiens
agagaguauuggguagaua

SEQ ID NO: 81778 - RNA, 19 nt, Homo sapiens
gcagaucacuaaaguauau

SEQ ID NO: 81779 - RNA, 19 nt, Homo sapiens
uaaagaaucugaagaggaa

SEQ ID NO: 81780 - RNA, 19 nt, Homo sapiens
gaacagaggcugacaacuu

SEQ ID NO: 81781 - RNA, 19 nt, Homo sapiens
ggacauacuuggauauuca

SEQ ID NO: 81782 - RNA, 19 nt, Homo sapiens
gaaagucacugcgacauga

SEQ ID NO: 81783 - RNA, 19 nt, Homo sapiens
gcacagaaguuuacagaca

SEQ ID NO: 81784 - RNA, 19 nt, Homo sapiens
gcagcaacauucaaguuaa

SEQ ID NO: 81785 - RNA, 19 nt, Homo sapiens
gcaaacauguucagaaguc

SEQ ID NO: 81786 - RNA, 19 nt, Homo sapiens
ggaacuauauugugccuau

SEQ ID NO: 81787 - RNA, 19 nt, Homo sapiens
gcaagaaacaggugcuuaa

SEQ ID NO: 81788 - RNA, 19 nt, Homo sapiens
gcaaagagguccuuauacg

SEQ ID NO: 81789 - RNA, 19 nt, Homo sapiens
gaagagagaugaggaacca

SEQ ID NO: 81790 - RNA, 19 nt, Homo sapiens
gaagucaaguaacuggaaa

SEQ ID NO: 81791 - RNA, 19 nt, Homo sapiens
gucaaucuaugcuguauuu

SEQ ID NO: 81792 - RNA, 19 nt, Homo sapiens
caacaauacugcagaugga

SEQ ID NO: 81793 - RNA, 19 nt, Homo sapiens
gaaaggaaucccuguguau

SEQ ID NO: 81794 - RNA, 19 nt, Homo sapiens
guagaaaccacuuuaauca

SEQ ID NO: 81795 - RNA, 19 nt, Homo sapiens
gauccucaauucacuuauu

SEQ ID NO: 81796 - RNA, 19 nt, Homo sapiens
ugaaaggaaucccugugua

SEQ ID NO: 81797 - RNA, 19 nt, Homo sapiens
cauaggacauacuuggaua

SEQ ID NO: 81798 - RNA, 19 nt, Homo sapiens
cgacacauauaaagguaaa

SEQ ID NO: 81799 - RNA, 19 nt, Homo sapiens
gauaaaagauguacuugug

SEQ ID NO: 81800 - RNA, 19 nt, Homo sapiens
ggagaccuguguacauuuc

SEQ ID NO: 81801 - RNA, 19 nt, Homo sapiens
aaagagguccuuauacgua

SEQ ID NO: 81802 - RNA, 19 nt, Homo sapiens
gaagaggaacuauauugug

SEQ ID NO: 81803 - RNA, 19 nt, Homo sapiens
ggauucacuuuacaauuug

SEQ ID NO: 81804 - RNA, 19 nt, Homo sapiens
acauuucacuuccucauuu

SEQ ID NO: 81805 - RNA, 19 nt, Homo sapiens
ucacgcagaucacuaaagu

SEQ ID NO: 81806 - RNA, 19 nt, Homo sapiens
aaacccaaaugaagaagaa

SEQ ID NO: 81807 - RNA, 19 nt, Homo sapiens
guacagaguucguuuucua

SEQ ID NO: 81808 - RNA, 19 nt, Homo sapiens
cuucgaaccuucacuauca

SEQ ID NO: 81809 - RNA, 19 nt, Homo sapiens
guacagaugcagccucauu

SEQ ID NO: 81810 - RNA, 19 nt, Homo sapiens
gcagauggaguuuauaaag

SEQ ID NO: 81811 - RNA, 19 nt, Homo sapiens
ggacaacacagucucuuuc

SEQ ID NO: 81812 - RNA, 19 nt, Homo sapiens
aagcaaagagguccuuaua

SEQ ID NO: 81813 - RNA, 19 nt, Homo sapiens
ggccauauauauuucuaga

SEQ ID NO: 81814 - RNA, 19 nt, Homo sapiens
gaacagcagcaacauucaa

SEQ ID NO: 81815 - RNA, 19 nt, Homo sapiens
guucagaagucaaguaacu

SEQ ID NO: 81816 - RNA, 19 nt, Homo sapiens
gauuaaacccaaaugaaga

SEQ ID NO: 81817 - RNA, 19 nt, Homo sapiens
guacuugugaccauuguaa

SEQ ID NO: 81818 - RNA, 19 nt, Homo sapiens
gaacuauauugugccuauu

SEQ ID NO: 81819 - RNA, 19 nt, Homo sapiens
guauuugaauccgacguua

SEQ ID NO: 81820 - RNA, 19 nt, Homo sapiens
ggauuaaacccaaaugaag

SEQ ID NO: 81821 - RNA, 19 nt, Homo sapiens
cagauggaguuuauaaagu

SEQ ID NO: 81822 - RNA, 19 nt, Homo sapiens
aacaggugcuuaacacuaa

SEQ ID NO: 81823 - RNA, 19 nt, Homo sapiens
cagaaccuauugauggauu

SEQ ID NO: 81824 - RNA, 19 nt, Homo sapiens
aaacaggugcuuaacacua

SEQ ID NO: 81825 - RNA, 19 nt, Homo sapiens
ggaaccagagcuuguagaa

SEQ ID NO: 81826 - RNA, 19 nt, Homo sapiens
gaagaagguacaauugcuu

SEQ ID NO: 81827 - RNA, 19 nt, Homo sapiens
gagaccugcuuauccagaa

SEQ ID NO: 81828 - RNA, 19 nt, Homo sapiens
aaaccuccuuggccugaua

SEQ ID NO: 81829 - RNA, 19 nt, Homo sapiens
gccauaaucgacacauaua

SEQ ID NO: 81830 - RNA, 19 nt, Homo sapiens
cacaggaagugaugaugaa

SEQ ID NO: 81831 - RNA, 19 nt, Homo sapiens
uaacuggauucacuuuaca

SEQ ID NO: 81832 - RNA, 19 nt, Homo sapiens
gaaccuucacuaucaguug

SEQ ID NO: 81833 - RNA, 19 nt, Homo sapiens
aaaggaaucccuguguaua

SEQ ID NO: 81834 - RNA, 19 nt, Homo sapiens
aaccagagcuuguagaaac

SEQ ID NO: 81835 - RNA, 19 nt, Homo sapiens
agucagaacuuugagagaa

SEQ ID NO: 81836 - RNA, 19 nt, Homo sapiens
guucaaaugauccucaauu

SEQ ID NO: 81837 - RNA, 19 nt, Homo sapiens
uuaaucauauccaggaguu

SEQ ID NO: 81838 - RNA, 19 nt, Homo sapiens
gcaaguuguccucgaagaa

SEQ ID NO: 81839 - RNA, 19 nt, Homo sapiens
aaagcaaguuguccucgaa

SEQ ID NO: 81840 - RNA, 19 nt, Homo sapiens
aagaagaacauaggacaua

SEQ ID NO: 81841 - RNA, 19 nt, Homo sapiens
gaaccagagcuuguagaaa

SEQ ID NO: 81842 - RNA, 19 nt, Homo sapiens
ggaaagucacugcgacaug

SEQ ID NO: 81843 - RNA, 19 nt, Homo sapiens
ccacaggaagugaugauga

SEQ ID NO: 81844 - RNA, 19 nt, Homo sapiens
guuuggagguauucuaaug

SEQ ID NO: 81845 - RNA, 19 nt, Homo sapiens
gaugagaaggcaaacaugu

SEQ ID NO: 81846 - RNA, 19 nt, Homo sapiens
gauauucaaccuauaacug

SEQ ID NO: 81847 - RNA, 19 nt, Homo sapiens
guaugcaaguccugauguu

SEQ ID NO: 81848 - RNA, 19 nt, Homo sapiens
gcagcugcaucccauaucu

SEQ ID NO: 81849 - RNA, 19 nt, Homo sapiens
guguauagauucguucuuc

SEQ ID NO: 81850 - RNA, 19 nt, Homo sapiens
caaucuaugcuguauuuga

SEQ ID NO: 81851 - RNA, 19 nt, Homo sapiens
aacagaggcugacaacuuc

SEQ ID NO: 81852 - RNA, 19 nt, Homo sapiens
caaaugaagaagaacauag

SEQ ID NO: 81853 - RNA, 19 nt, Homo sapiens
cgaagaagguacaauugcu

SEQ ID NO: 81854 - RNA, 19 nt, Homo sapiens
uccaggaguuugcaagaaa

SEQ ID NO: 81855 - RNA, 19 nt, Homo sapiens
ccuauucuuuggcuuaaug

SEQ ID NO: 81856 - RNA, 19 nt, Homo sapiens
gaaccuauugauggauuaa

SEQ ID NO: 81857 - RNA, 19 nt, Homo sapiens
gauauuugcaggucaaucu

SEQ ID NO: 81858 - RNA, 19 nt, Homo sapiens
aaguaaaguugccauaauc

SEQ ID NO: 81859 - RNA, 19 nt, Homo sapiens
caaaugauccucaauucac

SEQ ID NO: 81860 - RNA, 19 nt, Homo sapiens
gaugaacagcagcaacauu

SEQ ID NO: 81861 - RNA, 19 nt, Homo sapiens
gaagguacaauugcuuuua

SEQ ID NO: 81862 - RNA, 19 nt, Homo sapiens
gucaaaaucuucuauguuc

SEQ ID NO: 81863 - RNA, 19 nt, Homo sapiens
cagcaacauucaaguuaag

SEQ ID NO: 81864 - RNA, 19 nt, Homo sapiens
ggagaaaugagauaaaaga

SEQ ID NO: 81865 - RNA, 19 nt, Homo sapiens
gaagaagaacauaggacau

SEQ ID NO: 81866 - RNA, 19 nt, Homo sapiens
ccaaaugaagaagaacaua

SEQ ID NO: 81867 - RNA, 19 nt, Homo sapiens
gaagggagaccuguguaca

SEQ ID NO: 81868 - RNA, 19 nt, Homo sapiens
caucagcaaaugcaaagaa

SEQ ID NO: 81869 - RNA, 19 nt, Homo sapiens
uacaucauauggugugcua

SEQ ID NO: 81870 - RNA, 19 nt, Homo sapiens
agaaacaggugcuuaacac

SEQ ID NO: 81871 - RNA, 19 nt, Homo sapiens
gcuuguagaaaccacuuua

SEQ ID NO: 81872 - RNA, 19 nt, Homo sapiens
ccugauagaaaugaucuua

SEQ ID NO: 81873 - RNA, 19 nt, Homo sapiens
agggagaccuguguacauu

SEQ ID NO: 81874 - RNA, 19 nt, Homo sapiens
gaacuuugagagaacuguu

SEQ ID NO: 81875 - RNA, 19 nt, Homo sapiens
ccucgaagaagguacaauu

SEQ ID NO: 81876 - RNA, 19 nt, Homo sapiens
gccuuugccucuccaguug

SEQ ID NO: 81877 - RNA, 19 nt, Homo sapiens
aggcaaacauguucagaag

SEQ ID NO: 81878 - RNA, 19 nt, Homo sapiens
ggacaaguucggauuauuu

SEQ ID NO: 81879 - RNA, 19 nt, Homo sapiens
ggauggagcugcugcugaa

SEQ ID NO: 81880 - RNA, 19 nt, Homo sapiens
gggagacucuucacacauu

SEQ ID NO: 81881 - RNA, 19 nt, Homo sapiens
gaacugcucugugaaacug

SEQ ID NO: 81882 - RNA, 19 nt, Homo sapiens
gggagaggcucgucaacaa

SEQ ID NO: 81883 - RNA, 19 nt, Homo sapiens
ccaugaagcuaauguacaa

SEQ ID NO: 81884 - RNA, 19 nt, Homo sapiens
cagcugagccucuacauga

SEQ ID NO: 81885 - RNA, 19 nt, Homo sapiens
ugacuggccugcacccuaa

SEQ ID NO: 81886 - RNA, 19 nt, Homo sapiens
aaacugacaucauccuaug

SEQ ID NO: 81887 - RNA, 19 nt, Homo sapiens
ggacaaacugggaagauug

SEQ ID NO: 81888 - RNA, 19 nt, Homo sapiens
caaggacaaguucggauua

SEQ ID NO: 81889 - RNA, 19 nt, Homo sapiens
cccaugaacugcucuguga

SEQ ID NO: 81890 - RNA, 19 nt, Homo sapiens
ugaaucucaucaacaagua

SEQ ID NO: 81891 - RNA, 19 nt, Homo sapiens
caacaucaccuucaacaac

SEQ ID NO: 81892 - RNA, 19 nt, Homo sapiens
gcugggcgcugucaugauc

SEQ ID NO: 81893 - RNA, 19 nt, Homo sapiens
ccaguagccuguccuucaa

SEQ ID NO: 81894 - RNA, 19 nt, Homo sapiens
ggaacgggcugagcaaggu

SEQ ID NO: 81895 - RNA, 19 nt, Homo sapiens
ucaagcagcagguccuuaa

SEQ ID NO: 81896 - RNA, 19 nt, Homo sapiens
gcaaaccugugacccuuuu

SEQ ID NO: 81897 - RNA, 19 nt, Homo sapiens
ccacuacucugccuguucu

SEQ ID NO: 81898 - RNA, 19 nt, Homo sapiens
gaacuucugggcaaaugug

SEQ ID NO: 81899 - RNA, 19 nt, Homo sapiens
gacaaguucggauuauuug

SEQ ID NO: 81900 - RNA, 19 nt, Homo sapiens
gacaaacugggaagauuga

SEQ ID NO: 81901 - RNA, 19 nt, Homo sapiens
aaagcaacaucaccuucaa

SEQ ID NO: 81902 - RNA, 19 nt, Homo sapiens
ccaaauccggagccaagua

SEQ ID NO: 81903 - RNA, 19 nt, Homo sapiens
ccaaggugaugcacuaugc

SEQ ID NO: 81904 - RNA, 19 nt, Homo sapiens
ggagacucuucacacauuc

SEQ ID NO: 81905 - RNA, 19 nt, Homo sapiens
cggugaugauggagaauaa

SEQ ID NO: 81906 - RNA, 19 nt, Homo sapiens
aagguugacuucuggcauu

SEQ ID NO: 81907 - RNA, 19 nt, Homo sapiens
cggcgaacgugccuucaug

SEQ ID NO: 81908 - RNA, 19 nt, Homo sapiens
cuacuucuuugacgucaug

SEQ ID NO: 81909 - RNA, 19 nt, Homo sapiens
gaaaucugucgcaggcauu

SEQ ID NO: 81910 - RNA, 19 nt, Homo sapiens
uggacaaacugggaagauu

SEQ ID NO: 81911 - RNA, 19 nt, Homo sapiens
caugaacugcucugugaaa

SEQ ID NO: 81912 - RNA, 19 nt, Homo sapiens
uaaacugacaucauccuau

SEQ ID NO: 81913 - RNA, 19 nt, Homo sapiens
gauccaugaagcuaaugua

SEQ ID NO: 81914 - RNA, 19 nt, Homo sapiens
ugagcaagguugacuucug

SEQ ID NO: 81915 - RNA, 19 nt, Homo sapiens
uugcugagcucaacaacuc

SEQ ID NO: 81916 - RNA, 19 nt, Homo sapiens
guaccgcaccuuccaguuc

SEQ ID NO: 81917 - RNA, 19 nt, Homo sapiens
aguccucgcuggaguucua

SEQ ID NO: 81918 - RNA, 19 nt, Homo sapiens
ugaagcuaauguacaagga

SEQ ID NO: 81919 - RNA, 19 nt, Homo sapiens
ucaaggacaaguucggauu

SEQ ID NO: 81920 - RNA, 19 nt, Homo sapiens
gagcuuuggccuuggucua

SEQ ID NO: 81921 - RNA, 19 nt, Homo sapiens
caugaucaauggaacuucu

SEQ ID NO: 81922 - RNA, 19 nt, Homo sapiens
gcaacaucaccuucaacaa

SEQ ID NO: 81923 - RNA, 19 nt, Homo sapiens
agccuaaacugacaucauc

SEQ ID NO: 81924 - RNA, 19 nt, Homo sapiens
gcugagccucuacaugaaa

SEQ ID NO: 81925 - RNA, 19 nt, Homo sapiens
gccgauccaugaagcuaau

SEQ ID NO: 81926 - RNA, 19 nt, Homo sapiens
caucaugaccuuggcauuc

SEQ ID NO: 81927 - RNA, 19 nt, Homo sapiens
aacaucaccuucaacaaca

SEQ ID NO: 81928 - RNA, 19 nt, Homo sapiens
ugcccaaggugaugcacua

SEQ ID NO: 81929 - RNA, 19 nt, Homo sapiens
agcagcagguccuuaagaa

SEQ ID NO: 81930 - RNA, 19 nt, Homo sapiens
guacuuuccaggcauguuc

SEQ ID NO: 81931 - RNA, 19 nt, Homo sapiens
gaugcacuaugcccaguac

SEQ ID NO: 81932 - RNA, 19 nt, Homo sapiens
gcggugaugauggagaaua

SEQ ID NO: 81933 - RNA, 19 nt, Homo sapiens
cggcggugaugauggagaa

SEQ ID NO: 81934 - RNA, 19 nt, Homo sapiens
uggcacacauacacacaug

SEQ ID NO: 81935 - RNA, 19 nt, Homo sapiens
caaauccggagccaaguag

SEQ ID NO: 81936 - RNA, 19 nt, Homo sapiens
uccgaucagugcaacauga

SEQ ID NO: 81937 - RNA, 19 nt, Homo sapiens
gugaaucucaucaacaagu

SEQ ID NO: 81938 - RNA, 19 nt, Homo sapiens
gcgaacgugccuucaugaa

SEQ ID NO: 81939 - RNA, 19 nt, Homo sapiens
gagcgacuacaucgucaug

SEQ ID NO: 81940 - RNA, 19 nt, Homo sapiens
ccuucuaucucuccgucua

SEQ ID NO: 81941 - RNA, 19 nt, Homo sapiens
gcagcugagccucuacaug

SEQ ID NO: 81942 - RNA, 19 nt, Homo sapiens
ggagaggcucgucaacaag

SEQ ID NO: 81943 - RNA, 19 nt, Homo sapiens
caucuacccacccaacgaa

SEQ ID NO: 81944 - RNA, 19 nt, Homo sapiens
gaacgggcugagcaagguu

SEQ ID NO: 81945 - RNA, 19 nt, Homo sapiens
ugccgucgcucaucaagca

SEQ ID NO: 81946 - RNA, 19 nt, Homo sapiens
gcucaacaacuccgacucu

SEQ ID NO: 81947 - RNA, 19 nt, Homo sapiens
aaggacaaguucggauuau

SEQ ID NO: 81948 - RNA, 19 nt, Homo sapiens
guagggagaggcucgucaa

SEQ ID NO: 81949 - RNA, 19 nt, Homo sapiens
gccucuacaugaaaucugu

SEQ ID NO: 81950 - RNA, 19 nt, Homo sapiens
cccaguagccuguccuuca

SEQ ID NO: 81951 - RNA, 19 nt, Homo sapiens
cuacuggaauagaaaugag

SEQ ID NO: 81952 - RNA, 19 nt, Homo sapiens
gcugagcaagguugacuuc

SEQ ID NO: 81953 - RNA, 19 nt, Homo sapiens
aggacaaguucggauuauu

SEQ ID NO: 81954 - RNA, 19 nt, Homo sapiens
acagggaguucaggcacaa

SEQ ID NO: 81955 - RNA, 19 nt, Homo sapiens
uagccuguccuucaacaug

SEQ ID NO: 81956 - RNA, 19 nt, Homo sapiens
cuaaacugacaucauccua

SEQ ID NO: 81957 - RNA, 19 nt, Homo sapiens
uuaagaacgugcgcaucga

SEQ ID NO: 81958 - RNA, 19 nt, Homo sapiens
gcgcugucaugaucgugau

SEQ ID NO: 81959 - RNA, 19 nt, Homo sapiens
gaggccugccgauccauga

SEQ ID NO: 81960 - RNA, 19 nt, Homo sapiens
caacaugaucaauggaacu

SEQ ID NO: 81961 - RNA, 19 nt, Homo sapiens
aagcagcagguccuuaaga

SEQ ID NO: 81962 - RNA, 19 nt, Homo sapiens
caauggagugagcacaaga

SEQ ID NO: 81963 - RNA, 19 nt, Homo sapiens
gcuaauguacaaggaguca

SEQ ID NO: 81964 - RNA, 19 nt, Homo sapiens
gugcugggcgcugucauga

SEQ ID NO: 81965 - RNA, 19 nt, Homo sapiens
uggaacuucugggcaaaug

SEQ ID NO: 81966 - RNA, 19 nt, Homo sapiens
gcacugugggugagaucau

SEQ ID NO: 81967 - RNA, 19 nt, Homo sapiens
gaugaaaucuugucccuua

SEQ ID NO: 81968 - RNA, 19 nt, Homo sapiens
uaaaguuccugcagaaaua

SEQ ID NO: 81969 - RNA, 19 nt, Homo sapiens
gaacagauggagauucuuu

SEQ ID NO: 81970 - RNA, 19 nt, Homo sapiens
ucacuugacugguggauaa

SEQ ID NO: 81971 - RNA, 19 nt, Homo sapiens
gaucuucaguucauaauuc

SEQ ID NO: 81972 - RNA, 19 nt, Homo sapiens
gccaagagguuccaaauca

SEQ ID NO: 81973 - RNA, 19 nt, Homo sapiens
ggagaagacaguuaccuua

SEQ ID NO: 81974 - RNA, 19 nt, Homo sapiens
ggaagaccaugagacauuu

SEQ ID NO: 81975 - RNA, 19 nt, Homo sapiens
ucacacaguugacgaauug

SEQ ID NO: 81976 - RNA, 19 nt, Homo sapiens
ggucuaacuucauucagua

SEQ ID NO: 81977 - RNA, 19 nt, Homo sapiens
caacauacccuacaucauc

SEQ ID NO: 81978 - RNA, 19 nt, Homo sapiens
gaacgagaccaaucuguug

SEQ ID NO: 81979 - RNA, 19 nt, Homo sapiens
guauaaaguuccugcagaa

SEQ ID NO: 81980 - RNA, 19 nt, Homo sapiens
gagaagacaguuaccuuaa

SEQ ID NO: 81981 - RNA, 19 nt, Homo sapiens
gaaccuaaacauugccuuu

SEQ ID NO: 81982 - RNA, 19 nt, Homo sapiens
acagacaagugcaauauga

SEQ ID NO: 81983 - RNA, 19 nt, Homo sapiens
acacggcgcuggcaaguga

SEQ ID NO: 81984 - RNA, 19 nt, Homo sapiens
gacaagugcaauaugauua

SEQ ID NO: 81985 - RNA, 19 nt, Homo sapiens
agacauuuguggacauuaa

SEQ ID NO: 81986 - RNA, 19 nt, Homo sapiens
aagaugagguccuuuaugu

SEQ ID NO: 81987 - RNA, 19 nt, Homo sapiens
gcagaugagagguuuguuu

SEQ ID NO: 81988 - RNA, 19 nt, Homo sapiens
cuacuggucuaacuucauu

SEQ ID NO: 81989 - RNA, 19 nt, Homo sapiens
gggaacagcggaugaaaga

SEQ ID NO: 81990 - RNA, 19 nt, Homo sapiens
ccaagcagaugagagguuu

SEQ ID NO: 81991 - RNA, 19 nt, Homo sapiens
caugugggcucugaaauug

SEQ ID NO: 81992 - RNA, 19 nt, Homo sapiens
gagguuuguuucugccaua

SEQ ID NO: 81993 - RNA, 19 nt, Homo sapiens
gaugagagguuuguuucug

SEQ ID NO: 81994 - RNA, 19 nt, Homo sapiens
gcaggucaguguauauuac

SEQ ID NO: 81995 - RNA, 19 nt, Homo sapiens
gaucaucgaggccauguug

SEQ ID NO: 81996 - RNA, 19 nt, Homo sapiens
gauuaacacuacuuugauc

SEQ ID NO: 81997 - RNA, 19 nt, Homo sapiens
ggacauuaauccuuugacu

SEQ ID NO: 81998 - RNA, 19 nt, Homo sapiens
cagcagaagcucuuuguga

SEQ ID NO: 81999 - RNA, 19 nt, Homo sapiens
ccaagagguuccaaaucaa

SEQ ID NO: 82000 - RNA, 19 nt, Homo sapiens
aaugguagcuucauccaau

SEQ ID NO: 82001 - RNA, 19 nt, Homo sapiens
gaaacgggagacauuagaa

SEQ ID NO: 82002 - RNA, 19 nt, Homo sapiens
uaacagacaagugcaauau

SEQ ID NO: 82003 - RNA, 19 nt, Homo sapiens
ggagauaauggaacaacaa

SEQ ID NO: 82004 - RNA, 19 nt, Homo sapiens
gaacucagaaacaaagcaa

SEQ ID NO: 82005 - RNA, 19 nt, Homo sapiens
guagcuucauccaauauau

SEQ ID NO: 82006 - RNA, 19 nt, Homo sapiens
gcucugaaauuguucuuuu

SEQ ID NO: 82007 - RNA, 19 nt, Homo sapiens
ccagugauguaccucaaug

SEQ ID NO: 82008 - RNA, 19 nt, Homo sapiens
ugacuggaauaauccuaaa

SEQ ID NO: 82009 - RNA, 19 nt, Homo sapiens
uagaaggcaugcacccaaa

SEQ ID NO: 82010 - RNA, 19 nt, Homo sapiens
cccgauaucucucccuauu

SEQ ID NO: 82011 - RNA, 19 nt, Homo sapiens
gccaauacgucagacaaug

SEQ ID NO: 82012 - RNA, 19 nt, Homo sapiens
gacuaaugauggagacuau

SEQ ID NO: 82013 - RNA, 19 nt, Homo sapiens
gagaguguucacauugaua

SEQ ID NO: 82014 - RNA, 19 nt, Homo sapiens
caaaucaggaagaccauga

SEQ ID NO: 82015 - RNA, 19 nt, Homo sapiens
ggacuaaugauggagacua

SEQ ID NO: 82016 - RNA, 19 nt, Homo sapiens
cgauaucucucccuauuuu

SEQ ID NO: 82017 - RNA, 19 nt, Homo sapiens
gaaagccuaucagcagaag

SEQ ID NO: 82018 - RNA, 19 nt, Homo sapiens
acagggaacucagaaacaa

SEQ ID NO: 82019 - RNA, 19 nt, Homo sapiens
gacaaugccggcuucugua

SEQ ID NO: 82020 - RNA, 19 nt, Homo sapiens
gaugagguccuuuaugucu

SEQ ID NO: 82021 - RNA, 19 nt, Homo sapiens
ccacuaauaaccaaagaug

SEQ ID NO: 82022 - RNA, 19 nt, Homo sapiens
aaaugucucugcaucacuu

SEQ ID NO: 82023 - RNA, 19 nt, Homo sapiens
gucagcaucugcaagaaug

SEQ ID NO: 82024 - RNA, 19 nt, Homo sapiens
ggucaguguauauuacuuu

SEQ ID NO: 82025 - RNA, 19 nt, Homo sapiens
guaggaaucaaaugggaaa

SEQ ID NO: 82026 - RNA, 19 nt, Homo sapiens
ggcuggccauuaagcuuua

SEQ ID NO: 82027 - RNA, 19 nt, Homo sapiens
uaacacuacuuugaucauc

SEQ ID NO: 82028 - RNA, 19 nt, Homo sapiens
gaaaucuugucccuuaucc

SEQ ID NO: 82029 - RNA, 19 nt, Homo sapiens
uauguuguauuccuccauu

SEQ ID NO: 82030 - RNA, 19 nt, Homo sapiens
cuuguugccuguugaaaga

SEQ ID NO: 82031 - RNA, 19 nt, Homo sapiens
guguucacauugauaaaga

SEQ ID NO: 82032 - RNA, 19 nt, Homo sapiens
caucugauuucuaaaccau

SEQ ID NO: 82033 - RNA, 19 nt, Homo sapiens
gagauaauggaacaacaau

SEQ ID NO: 82034 - RNA, 19 nt, Homo sapiens
guugaaacgggagacauua

SEQ ID NO: 82035 - RNA, 19 nt, Homo sapiens
ugagacauuuguggacauu

SEQ ID NO: 82036 - RNA, 19 nt, Homo sapiens
gaaggcaugcacccaaauc

SEQ ID NO: 82037 - RNA, 19 nt, Homo sapiens
uggaacagauggagauucu

SEQ ID NO: 82038 - RNA, 19 nt, Homo sapiens
gcaagugauaggaacauuc

SEQ ID NO: 82039 - RNA, 19 nt, Homo sapiens
agacaagugcaauaugauu

SEQ ID NO: 82040 - RNA, 19 nt, Homo sapiens
gguagcuucauccaauaua

SEQ ID NO: 82041 - RNA, 19 nt, Homo sapiens
ugugggcucugaaauuguu

SEQ ID NO: 82042 - RNA, 19 nt, Homo sapiens
ucaugugggcucugaaauu

SEQ ID NO: 82043 - RNA, 19 nt, Homo sapiens
caaugccggcuucuguaua

SEQ ID NO: 82044 - RNA, 19 nt, Homo sapiens
ugaaagagcaccccucauu

SEQ ID NO: 82045 - RNA, 19 nt, Homo sapiens
aggaagaccaugagacauu

SEQ ID NO: 82046 - RNA, 19 nt, Homo sapiens
cugccugccuuucgguaua

SEQ ID NO: 82047 - RNA, 19 nt, Homo sapiens
ugagguccuuuaugucuuc

SEQ ID NO: 82048 - RNA, 19 nt, Homo sapiens
ugaacgagaccaaucuguu

SEQ ID NO: 82049 - RNA, 19 nt, Homo sapiens
gaagaaaauuguguuaagg

SEQ ID NO: 82050 - RNA, 19 nt, Homo sapiens
uuaaagagcaggcugacau

SEQ ID NO: 82051 - RNA, 19 nt, Homo sapiens
ugaagucuaugauuaacac

SEQ ID NO: 82052 - RNA, 19 nt, Homo sapiens
cagaugagagguuuguuuc

SEQ ID NO: 82053 - RNA, 19 nt, Homo sapiens
agacaaugccggcuucugu

SEQ ID NO: 82054 - RNA, 19 nt, Homo sapiens
aaaugggacuaaugaugga

SEQ ID NO: 82055 - RNA, 19 nt, Homo sapiens
uuaugugucuagcaaguau

SEQ ID NO: 82056 - RNA, 19 nt, Homo sapiens
ggcaagugauaggaacauu

SEQ ID NO: 82057 - RNA, 19 nt, Homo sapiens
cauucgaaccuaaacauug

SEQ ID NO: 82058 - RNA, 19 nt, Homo sapiens
ucaggaagaccaugagaca

SEQ ID NO: 82059 - RNA, 19 nt, Homo sapiens
cacccaucauuaugucuuu

SEQ ID NO: 82060 - RNA, 19 nt, Homo sapiens
gcacccaucauuaugucuu

SEQ ID NO: 82061 - RNA, 19 nt, Homo sapiens
caagugauaggaacauucu

SEQ ID NO: 82062 - RNA, 19 nt, Homo sapiens
ugagaguguucacauugau

SEQ ID NO: 82063 - RNA, 19 nt, Homo sapiens
uagaugacuuuguugaaac

SEQ ID NO: 82064 - RNA, 19 nt, Homo sapiens
gaagaccaugagacauuug

SEQ ID NO: 82065 - RNA, 19 nt, Homo sapiens
aaccaaagaugagguccuu

SEQ ID NO: 82066 - RNA, 19 nt, Homo sapiens
gucucugcaucacuuguua

SEQ ID NO: 82067 - RNA, 19 nt, Homo sapiens
caacaaccuuauuuccaua

SEQ ID NO: 82068 - RNA, 19 nt, Homo sapiens
gaggagagcugggacuaug

SEQ ID NO: 82069 - RNA, 19 nt, Homo sapiens
agaaguggcugcacaacaa

SEQ ID NO: 82070 - RNA, 19 nt, Homo sapiens
ucaugacgcucucgauauu

SEQ ID NO: 82071 - RNA, 19 nt, Homo sapiens
caacgacuccacaauccua

SEQ ID NO: 82072 - RNA, 19 nt, Homo sapiens
acaaccggcucgcucgaua

SEQ ID NO: 82073 - RNA, 19 nt, Homo sapiens
agaaaaccauccaaaagua

SEQ ID NO: 82074 - RNA, 19 nt, Homo sapiens
acaacaaccuuauuuccau

SEQ ID NO: 82075 - RNA, 19 nt, Homo sapiens
ccacaauccuagauaaggu

SEQ ID NO: 82076 - RNA, 19 nt, Homo sapiens
guucaugacgcucucgaua

SEQ ID NO: 82077 - RNA, 19 nt, Homo sapiens
cugcagaucugguccaaag

SEQ ID NO: 82078 - RNA, 19 nt, Homo sapiens
cgauauuccugugcagaaa

SEQ ID NO: 82079 - RNA, 19 nt, Homo sapiens
gccucagccucaucaagua

SEQ ID NO: 82080 - RNA, 19 nt, Homo sapiens
ccugcugccuguaaauauu

SEQ ID NO: 82081 - RNA, 19 nt, Homo sapiens
caaccuuauuuccauagug

SEQ ID NO: 82082 - RNA, 19 nt, Homo sapiens
gaccaacgacuccacaauc

SEQ ID NO: 82083 - RNA, 19 nt, Homo sapiens
ggaugcugcugcuccuguu

SEQ ID NO: 82084 - RNA, 19 nt, Homo sapiens
caucaaguacuuccucuuc

SEQ ID NO: 82085 - RNA, 19 nt, Homo sapiens
gucagcaccucuucugugu

SEQ ID NO: 82086 - RNA, 19 nt, Homo sapiens
gcacaacaaccuuauuucc

SEQ ID NO: 82087 - RNA, 19 nt, Homo sapiens
ccaaaguccuggccaucuc

SEQ ID NO: 82088 - RNA, 19 nt, Homo sapiens
gcaucuggauccucaucga

SEQ ID NO: 82089 - RNA, 19 nt, Homo sapiens
acuccacaauccuagauaa

SEQ ID NO: 82090 - RNA, 19 nt, Homo sapiens
gagaaaaccauccaaaagu

SEQ ID NO: 82091 - RNA, 19 nt, Homo sapiens
gcagaucugguccaaaguc

SEQ ID NO: 82092 - RNA, 19 nt, Homo sapiens
cugcacaacaaccuuauuu

SEQ ID NO: 82093 - RNA, 19 nt, Homo sapiens
ggagagcugggacuaugug

SEQ ID NO: 82094 - RNA, 19 nt, Homo sapiens
ggccaucucaggaaucuuc

SEQ ID NO: 82095 - RNA, 19 nt, Homo sapiens
caaguacuuccucuucguu

SEQ ID NO: 82096 - RNA, 19 nt, Homo sapiens
guggugaguggaccgcuua

SEQ ID NO: 82097 - RNA, 19 nt, Homo sapiens
ucaaguacuuccucuucgu

SEQ ID NO: 82098 - RNA, 19 nt, Homo sapiens
gggcuuucguccacagcuu

SEQ ID NO: 82099 - RNA, 19 nt, Homo sapiens
gggacuaugugcaguucca

SEQ ID NO: 82100 - RNA, 19 nt, Homo sapiens
gaauccucaucuccacuca

SEQ ID NO: 82101 - RNA, 19 nt, Homo sapiens
cugcagagagccacaucua

SEQ ID NO: 82102 - RNA, 19 nt, Homo sapiens
gcgggacgucguagagaaa

SEQ ID NO: 82103 - RNA, 19 nt, Homo sapiens
cagacacagugcagacauc

SEQ ID NO: 82104 - RNA, 19 nt, Homo sapiens
gcccuccgccuucacauuc

SEQ ID NO: 82105 - RNA, 19 nt, Homo sapiens
ucucaggaaucuucaccau

SEQ ID NO: 82106 - RNA, 19 nt, Homo sapiens
caaaguccuggccaucuca

SEQ ID NO: 82107 - RNA, 19 nt, Homo sapiens
gaaaccuggaccacgucua

SEQ ID NO: 82108 - RNA, 19 nt, Homo sapiens
uggcugcacaacaaccuua

SEQ ID NO: 82109 - RNA, 19 nt, Homo sapiens
cagaaguggcugcacaaca

SEQ ID NO: 82110 - RNA, 19 nt, Homo sapiens
cgaccaacgacuccacaau

SEQ ID NO: 82111 - RNA, 19 nt, Homo sapiens
gaccagcuucguguccuuu

SEQ ID NO: 82112 - RNA, 19 nt, Homo sapiens
cacaacaaccuuauuucca

SEQ ID NO: 82113 - RNA, 19 nt, Homo sapiens
cccacuaggugaagauguc

SEQ ID NO: 82114 - RNA, 19 nt, Homo sapiens
cuacagaccugacaaguuu

SEQ ID NO: 82115 - RNA, 19 nt, Homo sapiens
cagcauaccuuuauuguga

SEQ ID NO: 82116 - RNA, 19 nt, Homo sapiens
gagcuggaaucgauuauaa

SEQ ID NO: 82117 - RNA, 19 nt, Homo sapiens
aaacauccuugcaacauua

SEQ ID NO: 82118 - RNA, 19 nt, Homo sapiens
gugcagagcugaagauuuu

SEQ ID NO: 82119 - RNA, 19 nt, Homo sapiens
gaagagaagauuccagaga

SEQ ID NO: 82120 - RNA, 19 nt, Homo sapiens
ggugauacaugguggaaga

SEQ ID NO: 82121 - RNA, 19 nt, Homo sapiens
uaaaagagcuggaaucgau

SEQ ID NO: 82122 - RNA, 19 nt, Homo sapiens
ggaaguccauaauuugcaa

SEQ ID NO: 82123 - RNA, 19 nt, Homo sapiens
caacauuacugaagaagac

SEQ ID NO: 82124 - RNA, 19 nt, Homo sapiens
uaaaagaucuggcccauca

SEQ ID NO: 82125 - RNA, 19 nt, Homo sapiens
ggauucaucuugcacaucu

SEQ ID NO: 82126 - RNA, 19 nt, Homo sapiens
agaaaggacugcagcaaca

SEQ ID NO: 82127 - RNA, 19 nt, Homo sapiens
ggaaucgauuauaagcaaa

SEQ ID NO: 82128 - RNA, 19 nt, Homo sapiens
gauacaugguggaagagaa

SEQ ID NO: 82129 - RNA, 19 nt, Homo sapiens
ugacaaguuucuucagugu

SEQ ID NO: 82130 - RNA, 19 nt, Homo sapiens
uggaaucgauuauaagcaa

SEQ ID NO: 82131 - RNA, 19 nt, Homo sapiens
uuucaagggugcauuuauu

SEQ ID NO: 82132 - RNA, 19 nt, Homo sapiens
uaggcuaccuugcugauga

SEQ ID NO: 82133 - RNA, 19 nt, Homo sapiens
cauguagacugccaaagug

SEQ ID NO: 82134 - RNA, 19 nt, Homo sapiens
gccaggaucccaccauaaa

SEQ ID NO: 82135 - RNA, 19 nt, Homo sapiens
caauggaucccgcaguaaa

SEQ ID NO: 82136 - RNA, 19 nt, Homo sapiens
cagagaagguucagacacu

SEQ ID NO: 82137 - RNA, 19 nt, Homo sapiens
gcaguaaaaucuuugacaa

SEQ ID NO: 82138 - RNA, 19 nt, Homo sapiens
caaaguguaugggaugcuu

SEQ ID NO: 82139 - RNA, 19 nt, Homo sapiens
acaaguuucuucagugugu

SEQ ID NO: 82140 - RNA, 19 nt, Homo sapiens
uaucaucagcauaccuuua

SEQ ID NO: 82141 - RNA, 19 nt, Homo sapiens
aaagagcuggaaucgauua

SEQ ID NO: 82142 - RNA, 19 nt, Homo sapiens
agaagauuccagagacuua

SEQ ID NO: 82143 - RNA, 19 nt, Homo sapiens
gccagucgcugugguuguu

SEQ ID NO: 82144 - RNA, 19 nt, Homo sapiens
cucaauggaucccgcagua

SEQ ID NO: 82145 - RNA, 19 nt, Homo sapiens
caauuuuccugcaagaaua

SEQ ID NO: 82146 - RNA, 19 nt, Homo sapiens
caacccuguuucaguauuc

SEQ ID NO: 82147 - RNA, 19 nt, Homo sapiens
caagggugcauuuauuuca

SEQ ID NO: 82148 - RNA, 19 nt, Homo sapiens
gaaaggacugcagcaacaa

SEQ ID NO: 82149 - RNA, 19 nt, Homo sapiens
ggagaaaggacugcagcaa

SEQ ID NO: 82150 - RNA, 19 nt, Homo sapiens
gacuaucagccacuaauga

SEQ ID NO: 82151 - RNA, 19 nt, Homo sapiens
gaagauuccagagacuuau

SEQ ID NO: 82152 - RNA, 19 nt, Homo sapiens
guggugaauucaacacuuc

SEQ ID NO: 82153 - RNA, 19 nt, Homo sapiens
gcaacauuacugaagaaga

SEQ ID NO: 82154 - RNA, 19 nt, Homo sapiens
caucagcauaccuuuauug

SEQ ID NO: 82155 - RNA, 19 nt, Homo sapiens
cuugacuccuugugguuua

SEQ ID NO: 82156 - RNA, 19 nt, Homo sapiens
agagaagguucagacacua

SEQ ID NO: 82157 - RNA, 19 nt, Homo sapiens
gaagacuaucagccacuaa

SEQ ID NO: 82158 - RNA, 19 nt, Homo sapiens
agaagacuaucagccacua

SEQ ID NO: 82159 - RNA, 19 nt, Homo sapiens
gaggauucaucuugcacau

SEQ ID NO: 82160 - RNA, 19 nt, Homo sapiens
cgucaaguacacugaaauu

SEQ ID NO: 82161 - RNA, 19 nt, Homo sapiens
guagacugccaaaguguau

SEQ ID NO: 82162 - RNA, 19 nt, Homo sapiens
ccugugaugugguccaugu

SEQ ID NO: 82163 - RNA, 19 nt, Homo sapiens
gagaagauuccagagacuu

SEQ ID NO: 82164 - RNA, 19 nt, Homo sapiens
uguaugggaugcuuucaag

SEQ ID NO: 82165 - RNA, 19 nt, Homo sapiens
cugcaagaauaucuacaga

SEQ ID NO: 82166 - RNA, 19 nt, Homo sapiens
gaucuggcccaucaguuca

SEQ ID NO: 82167 - RNA, 19 nt, Homo sapiens
gcauaccuuuauugugauc

SEQ ID NO: 82168 - RNA, 19 nt, Homo sapiens
gaauucaacacuuccaaaa

SEQ ID NO: 82169 - RNA, 19 nt, Homo sapiens
ugaauucaacacuuccaaa

SEQ ID NO: 82170 - RNA, 19 nt, Homo sapiens
ggugcagagcugaagauuu

SEQ ID NO: 82171 - RNA, 19 nt, Homo sapiens
gccagagacggaagccuuu

SEQ ID NO: 82172 - RNA, 19 nt, Homo sapiens
gaccugacaaguuucuuca

SEQ ID NO: 82173 - RNA, 19 nt, Homo sapiens
gagaagguucagacacuag

SEQ ID NO: 82174 - RNA, 19 nt, Homo sapiens
acaacccuguuucaguauu

SEQ ID NO: 82175 - RNA, 19 nt, Homo sapiens
ggagcccuauggccaacug

SEQ ID NO: 82176 - RNA, 19 nt, Homo sapiens
aagggugcauuuauuucaa

SEQ ID NO: 82177 - RNA, 19 nt, Homo sapiens
ccccaaagucuuaaaauaa

SEQ ID NO: 82178 - RNA, 19 nt, Homo sapiens
cuagaggccugggugauac

SEQ ID NO: 82179 - RNA, 19 nt, Homo sapiens
acuagaggccugggugaua

SEQ ID NO: 82180 - RNA, 19 nt, Homo sapiens
cuugcaacauuacugaaga

SEQ ID NO: 82181 - RNA, 19 nt, Homo sapiens
ucaagggugcauuuauuuc

SEQ ID NO: 82182 - RNA, 19 nt, Homo sapiens
ucaucagcauaccuuuauu

SEQ ID NO: 82183 - RNA, 19 nt, Homo sapiens
aaaacauccuugcaacauu

SEQ ID NO: 82184 - RNA, 19 nt, Homo sapiens
gcugaugaccucacauggu

SEQ ID NO: 82185 - RNA, 19 nt, Homo sapiens
uugcaacauuacugaagaa

SEQ ID NO: 82186 - RNA, 19 nt, Homo sapiens
uauaucaucagcauaccuu

SEQ ID NO: 82187 - RNA, 19 nt, Homo sapiens
agggugcauuuauuucaaa

SEQ ID NO: 82188 - RNA, 19 nt, Homo sapiens
acauguagacugccaaagu

SEQ ID NO: 82189 - RNA, 19 nt, Homo sapiens
uaucagccacuaaugaagu

SEQ ID NO: 82190 - RNA, 19 nt, Homo sapiens
uuacugaagaagacuauca

SEQ ID NO: 82191 - RNA, 19 nt, Homo sapiens
uccccaaagucuuaaaaua

SEQ ID NO: 82192 - RNA, 19 nt, Homo sapiens
ucuacagaccugacaaguu

SEQ ID NO: 82193 - RNA, 19 nt, Homo sapiens
caugugaugcucaauggau

SEQ ID NO: 82194 - RNA, 19 nt, Homo sapiens
gugaugugguccaugugau

SEQ ID NO: 82195 - RNA, 19 nt, Homo sapiens
uguggugaauucaacacuu

SEQ ID NO: 82196 - RNA, 19 nt, Homo sapiens
acuaucagccacuaaugaa

SEQ ID NO: 82197 - RNA, 19 nt, Homo sapiens
augccaggaucccaccaua

SEQ ID NO: 82198 - RNA, 19 nt, Homo sapiens
ucaauggaucccgcaguaa

SEQ ID NO: 82199 - RNA, 19 nt, Homo sapiens
gagaugagacauguagacu

SEQ ID NO: 82200 - RNA, 19 nt, Homo sapiens
gcuuucaagggugcauuua

SEQ ID NO: 82201 - RNA, 19 nt, Homo sapiens
cauaauuugcaaccagaga

SEQ ID NO: 82202 - RNA, 19 nt, Homo sapiens
ggaaagauaugguauagca

SEQ ID NO: 82203 - RNA, 19 nt, Homo sapiens
gcauuuaccugacugauug

SEQ ID NO: 82204 - RNA, 19 nt, Homo sapiens
ggaaagagcuagggaagug

SEQ ID NO: 82205 - RNA, 19 nt, Homo sapiens
guagaagaaugcaggguua

SEQ ID NO: 82206 - RNA, 19 nt, Homo sapiens
gaacaaagcauugccagaa

SEQ ID NO: 82207 - RNA, 19 nt, Homo sapiens
gauacugucucuuucauga

SEQ ID NO: 82208 - RNA, 19 nt, Homo sapiens
ucacaagccuucauauuuc

SEQ ID NO: 82209 - RNA, 19 nt, Homo sapiens
agaaguaccugagugaaua

SEQ ID NO: 82210 - RNA, 19 nt, Homo sapiens
gauggaaagugaagaguug

SEQ ID NO: 82211 - RNA, 19 nt, Homo sapiens
uaccaaagcugcucuguuc

SEQ ID NO: 82212 - RNA, 19 nt, Homo sapiens
gcaaggcuaucauuucaca

SEQ ID NO: 82213 - RNA, 19 nt, Homo sapiens
ggacuacaaugucuacaca

SEQ ID NO: 82214 - RNA, 19 nt, Homo sapiens
uaucaacaaugccaucaaa

SEQ ID NO: 82215 - RNA, 19 nt, Homo sapiens
ugagaugacucuuccauuc

SEQ ID NO: 82216 - RNA, 19 nt, Homo sapiens
gccuauggcuggauuacua

SEQ ID NO: 82217 - RNA, 19 nt, Homo sapiens
gaaggagucuaacgugaag

SEQ ID NO: 82218 - RNA, 19 nt, Homo sapiens
gagcacauccauuucauug

SEQ ID NO: 82219 - RNA, 19 nt, Homo sapiens
ggaaaccuuuggagcuuug

SEQ ID NO: 82220 - RNA, 19 nt, Homo sapiens
gaccugacaccuuucauaa

SEQ ID NO: 82221 - RNA, 19 nt, Homo sapiens
uaagugaccuuuacaagac

SEQ ID NO: 82222 - RNA, 19 nt, Homo sapiens
ggcagaaacuggccaagga

SEQ ID NO: 82223 - RNA, 19 nt, Homo sapiens
ucacacaaguuuauacauc

SEQ ID NO: 82224 - RNA, 19 nt, Homo sapiens
gaucauuacuggccaagag

SEQ ID NO: 82225 - RNA, 19 nt, Homo sapiens
uaaagguccuggaaucuca

SEQ ID NO: 82226 - RNA, 19 nt, Homo sapiens
ugucagcgauugucaguga

SEQ ID NO: 82227 - RNA, 19 nt, Homo sapiens
ggauuacuaucaacuaucu

SEQ ID NO: 82228 - RNA, 19 nt, Homo sapiens
gauauaagaagguagugaa

SEQ ID NO: 82229 - RNA, 19 nt, Homo sapiens
agauaaugcucugcaauuu

SEQ ID NO: 82230 - RNA, 19 nt, Homo sapiens
gguuaaagguccuggaauc

SEQ ID NO: 82231 - RNA, 19 nt, Homo sapiens
gaauacugcuuuucuggua

SEQ ID NO: 82232 - RNA, 19 nt, Homo sapiens
acauucagguugcaaguaa

SEQ ID NO: 82233 - RNA, 19 nt, Homo sapiens
ucaaggacuucggcagaua

SEQ ID NO: 82234 - RNA, 19 nt, Homo sapiens
cuacacacauagcuucuug

SEQ ID NO: 82235 - RNA, 19 nt, Homo sapiens
gaaacuggccaaggacauu

SEQ ID NO: 82236 - RNA, 19 nt, Homo sapiens
ccugacaccuuucauaauc

SEQ ID NO: 82237 - RNA, 19 nt, Homo sapiens
ggguguacguguaaaauua

SEQ ID NO: 82238 - RNA, 19 nt, Homo sapiens
cggcagauacugucucuuu

SEQ ID NO: 82239 - RNA, 19 nt, Homo sapiens
aaacuugacaucagagaaa

SEQ ID NO: 82240 - RNA, 19 nt, Homo sapiens
gagaaguaccugagugaau

SEQ ID NO: 82241 - RNA, 19 nt, Homo sapiens
ccaauaaucaggaaaccuu

SEQ ID NO: 82242 - RNA, 19 nt, Homo sapiens
caaagcugcucuguucuuc

SEQ ID NO: 82243 - RNA, 19 nt, Homo sapiens
ugaaaccaauaaucaggaa

SEQ ID NO: 82244 - RNA, 19 nt, Homo sapiens
gaaccaaggaccugacaag

SEQ ID NO: 82245 - RNA, 19 nt, Homo sapiens
gcagauacugucucuuuca

SEQ ID NO: 82246 - RNA, 19 nt, Homo sapiens
cugcaaggcuaucauuuca

SEQ ID NO: 82247 - RNA, 19 nt, Homo sapiens
caacaaugccaucaaagca

SEQ ID NO: 82248 - RNA, 19 nt, Homo sapiens
gguugcaaguaaugaaauu

SEQ ID NO: 82249 - RNA, 19 nt, Homo sapiens
gauaaugcucugcaauuuc

SEQ ID NO: 82250 - RNA, 19 nt, Homo sapiens
caggaaaccuuuggagcuu

SEQ ID NO: 82251 - RNA, 19 nt, Homo sapiens
ggacuucggcagauacugu

SEQ ID NO: 82252 - RNA, 19 nt, Homo sapiens
gaaagucucucaggaaaag

SEQ ID NO: 82253 - RNA, 19 nt, Homo sapiens
gaaccugaccaacaugauc

SEQ ID NO: 82254 - RNA, 19 nt, Homo sapiens
gcaaggacuacaaugucua

SEQ ID NO: 82255 - RNA, 19 nt, Homo sapiens
gaagaaugcaggguuaaag

SEQ ID NO: 82256 - RNA, 19 nt, Homo sapiens
acacaggcguggugcauca

SEQ ID NO: 82257 - RNA, 19 nt, Homo sapiens
guucuucucacacaaguuu

SEQ ID NO: 82258 - RNA, 19 nt, Homo sapiens
aacaaagcauugccagaaa

SEQ ID NO: 82259 - RNA, 19 nt, Homo sapiens
aaaggugacugagaugaug

SEQ ID NO: 82260 - RNA, 19 nt, Homo sapiens
gaagguagugaacguaagu

SEQ ID NO: 82261 - RNA, 19 nt, Homo sapiens
gcaaguaaugaaauucuca

SEQ ID NO: 82262 - RNA, 19 nt, Homo sapiens
gggcaaauucagucagaaa

SEQ ID NO: 82263 - RNA, 19 nt, Homo sapiens
ucuggaagcugcaaugaag

SEQ ID NO: 82264 - RNA, 19 nt, Homo sapiens
uggcuucuccucuaucaua

SEQ ID NO: 82265 - RNA, 19 nt, Homo sapiens
ccugggagcacauccauuu

SEQ ID NO: 82266 - RNA, 19 nt, Homo sapiens
accaagagauuugagauga

SEQ ID NO: 82267 - RNA, 19 nt, Homo sapiens
cagggugccaggaucauua

SEQ ID NO: 82268 - RNA, 19 nt, Homo sapiens
ggcaaggacuacaaugucu

SEQ ID NO: 82269 - RNA, 19 nt, Homo sapiens
ugacaccuuucauaaucuu

SEQ ID NO: 82270 - RNA, 19 nt, Homo sapiens
uucacaagccuucauauuu

SEQ ID NO: 82271 - RNA, 19 nt, Homo sapiens
ggauggaaagugaagaguu

SEQ ID NO: 82272 - RNA, 19 nt, Homo sapiens
caauauugacuuugucuag

SEQ ID NO: 82273 - RNA, 19 nt, Homo sapiens
caauauccuuugccucaag

SEQ ID NO: 82274 - RNA, 19 nt, Homo sapiens
caagagauuugagaugacu

SEQ ID NO: 82275 - RNA, 19 nt, Homo sapiens
ugacaagccagcagaagga

SEQ ID NO: 82276 - RNA, 19 nt, Homo sapiens
aaaagcagcugaaauaugc

SEQ ID NO: 82277 - RNA, 19 nt, Homo sapiens
ccaaagcugcucuguucuu

SEQ ID NO: 82278 - RNA, 19 nt, Homo sapiens
acaaggugguucagcauag

SEQ ID NO: 82279 - RNA, 19 nt, Homo sapiens
cguggugcaucaaguagaa

SEQ ID NO: 82280 - RNA, 19 nt, Homo sapiens
cagaaaacguuaaguaugg

SEQ ID NO: 82281 - RNA, 19 nt, Homo sapiens
agaccugacaccuuucaua

SEQ ID NO: 82282 - RNA, 19 nt, Homo sapiens
gaucccagcugagcaacca

SEQ ID NO: 82283 - RNA, 19 nt, Homo sapiens
gcaccaagagauuugagau

SEQ ID NO: 82284 - RNA, 19 nt, Homo sapiens
gaaagagcuagggaaguga

SEQ ID NO: 82285 - RNA, 19 nt, Homo sapiens
ggcagauacugucucuuuc

SEQ ID NO: 82286 - RNA, 19 nt, Homo sapiens
caucauaggcuugcuuauc

SEQ ID NO: 82287 - RNA, 19 nt, Homo sapiens
ccacuccaccuaugucuuc

SEQ ID NO: 82288 - RNA, 19 nt, Homo sapiens
gggagcacauccauuucau

SEQ ID NO: 82289 - RNA, 19 nt, Homo sapiens
uggaaacuaucaacaaugc

SEQ ID NO: 82290 - RNA, 19 nt, Homo sapiens
gccagcagaaggagucuaa

SEQ ID NO: 82291 - RNA, 19 nt, Homo sapiens
gcuacaccuuucuccuuug

SEQ ID NO: 82292 - RNA, 19 nt, Homo sapiens
cagauacugucucuuucau

SEQ ID NO: 82293 - RNA, 19 nt, Homo sapiens
gaaagauaugguauagcaa

SEQ ID NO: 82294 - RNA, 19 nt, Homo sapiens
gccaucauaggcuugcuua

SEQ ID NO: 82295 - RNA, 19 nt, Homo sapiens
ggagcacauccauuucauu

SEQ ID NO: 82296 - RNA, 19 nt, Homo sapiens
caaggucccagcaccaaga

SEQ ID NO: 82297 - RNA, 19 nt, Homo sapiens
cuacaccuuucuccuuugu

SEQ ID NO: 82298 - RNA, 19 nt, Homo sapiens
uaggcuugcuuaucuuuca

SEQ ID NO: 82299 - RNA, 19 nt, Homo sapiens
ccaggguauuggaaacuau

SEQ ID NO: 82300 - RNA, 19 nt, Homo sapiens
ggauauaagaagguaguga

SEQ ID NO: 82301 - RNA, 19 nt, Homo sapiens
ucucagggacccaugcuuu

SEQ ID NO: 82302 - RNA, 19 nt, Homo sapiens
ucacacacguccauguuua

SEQ ID NO: 82303 - RNA, 19 nt, Homo sapiens
ccaacuaccugcuggagaa

SEQ ID NO: 82304 - RNA, 19 nt, Homo sapiens
acacguccauguuuaucua

SEQ ID NO: 82305 - RNA, 19 nt, Homo sapiens
ggaggcagccgcagugaau

SEQ ID NO: 82306 - RNA, 19 nt, Homo sapiens
ggccuucucugccuucuuc

SEQ ID NO: 82307 - RNA, 19 nt, Homo sapiens
ggagaacgacacaggcauu

SEQ ID NO: 82308 - RNA, 19 nt, Homo sapiens
gaaccugaccaaccugauc

SEQ ID NO: 82309 - RNA, 19 nt, Homo sapiens
cuucuacacuguggacuuu

SEQ ID NO: 82310 - RNA, 19 nt, Homo sapiens
aacaggcgcuucaggaugu

SEQ ID NO: 82311 - RNA, 19 nt, Homo sapiens
gaugcugguucuucacaca

SEQ ID NO: 82312 - RNA, 19 nt, Homo sapiens
ccucuacccagaucacuuu

SEQ ID NO: 82313 - RNA, 19 nt, Homo sapiens
uuucugggcucuucagcuu

SEQ ID NO: 82314 - RNA, 19 nt, Homo sapiens
ggaugugcccaaagagaga

SEQ ID NO: 82315 - RNA, 19 nt, Homo sapiens
gcgcaagggcacagacuuc

SEQ ID NO: 82316 - RNA, 19 nt, Homo sapiens
ccagaucacuuuugagaca

SEQ ID NO: 82317 - RNA, 19 nt, Homo sapiens
gagaacgacacaggcauug

SEQ ID NO: 82318 - RNA, 19 nt, Homo sapiens
ccauguuuaucuacaagug

SEQ ID NO: 82319 - RNA, 19 nt, Homo sapiens
ggccagcacuaccgagucu

SEQ ID NO: 82320 - RNA, 19 nt, Homo sapiens
ccacagcuuccucugcuau

SEQ ID NO: 82321 - RNA, 19 nt, Homo sapiens
ucccgaugcucuuucaaug

SEQ ID NO: 82322 - RNA, 19 nt, Homo sapiens
gaacuuuguggccuucucu

SEQ ID NO: 82323 - RNA, 19 nt, Homo sapiens
ccuggaugcugguucuuca

SEQ ID NO: 82324 - RNA, 19 nt, Homo sapiens
gcggcgugaucuuccagaa

SEQ ID NO: 82325 - RNA, 19 nt, Homo sapiens
gcugggugacugccaacua

SEQ ID NO: 82326 - RNA, 19 nt, Homo sapiens
uucaggaugugcccaaaga

SEQ ID NO: 82327 - RNA, 19 nt, Homo sapiens
cagccagagucuuguugga

SEQ ID NO: 82328 - RNA, 19 nt, Homo sapiens
ggaacuuuguggccuucuc

SEQ ID NO: 82329 - RNA, 19 nt, Homo sapiens
caggaugugcccaaagaga

SEQ ID NO: 82330 - RNA, 19 nt, Homo sapiens
cuacccagaucacuuuuga

SEQ ID NO: 82331 - RNA, 19 nt, Homo sapiens
cgaacaggcgcuucaggau

SEQ ID NO: 82332 - RNA, 19 nt, Homo sapiens
cguccauguuuaucuacaa

SEQ ID NO: 82333 - RNA, 19 nt, Homo sapiens
cauccucucgggccaagaa

SEQ ID NO: 82334 - RNA, 19 nt, Homo sapiens
cagagaaacucccacguua

SEQ ID NO: 82335 - RNA, 19 nt, Homo sapiens
ggagacaccucuucauaga

SEQ ID NO: 82336 - RNA, 19 nt, Homo sapiens
gagcugcuguaaacuauuu

SEQ ID NO: 82337 - RNA, 19 nt, Homo sapiens
gaaggugaaagaaguauuu

SEQ ID NO: 82338 - RNA, 19 nt, Homo sapiens
gaagucacguacaggguuu

SEQ ID NO: 82339 - RNA, 19 nt, Homo sapiens
ggaaugggcuaugugaaug

SEQ ID NO: 82340 - RNA, 19 nt, Homo sapiens
gaauguaucgcuacuguga

SEQ ID NO: 82341 - RNA, 19 nt, Homo sapiens
ccuacaagcucuauuccua

SEQ ID NO: 82342 - RNA, 19 nt, Homo sapiens
guacacgucuuccaguuca

SEQ ID NO: 82343 - RNA, 19 nt, Homo sapiens
aaagguauccguuaugaaa

SEQ ID NO: 82344 - RNA, 19 nt, Homo sapiens
ggcaugagcugcuguaaac

SEQ ID NO: 82345 - RNA, 19 nt, Homo sapiens
gagcugaaccucauguguu

SEQ ID NO: 82346 - RNA, 19 nt, Homo sapiens
ggucagcccuugcuugucu

SEQ ID NO: 82347 - RNA, 19 nt, Homo sapiens
gcagaaggugaaagaagua

SEQ ID NO: 82348 - RNA, 19 nt, Homo sapiens
gcauggaccucaccuacgu

SEQ ID NO: 82349 - RNA, 19 nt, Homo sapiens
gaguacacgucuuccaguu

SEQ ID NO: 82350 - RNA, 19 nt, Homo sapiens
gugaauguaucgcuacugu

SEQ ID NO: 82351 - RNA, 19 nt, Homo sapiens
gcagugaagccaggucuuu

SEQ ID NO: 82352 - RNA, 19 nt, Homo sapiens
ccacgaaaccuucaaagca

SEQ ID NO: 82353 - RNA, 19 nt, Homo sapiens
caccaacuguguccuguga

SEQ ID NO: 82354 - RNA, 19 nt, Homo sapiens
ggaccuacaagcucuauuc

SEQ ID NO: 82355 - RNA, 19 nt, Homo sapiens
guuaugaaacuuccagaaa

SEQ ID NO: 82356 - RNA, 19 nt, Homo sapiens
ggacauuccguucgacuuc

SEQ ID NO: 82357 - RNA, 19 nt, Homo sapiens
gcacgguccuuggcaaaca

SEQ ID NO: 82358 - RNA, 19 nt, Homo sapiens
aaagagcgcucagggaauc

SEQ ID NO: 82359 - RNA, 19 nt, Homo sapiens
cauguggacuucuaugcuu

SEQ ID NO: 82360 - RNA, 19 nt, Homo sapiens
gagaaaaggcccagaaguu

SEQ ID NO: 82361 - RNA, 19 nt, Homo sapiens
gaagaguccagccucauag

SEQ ID NO: 82362 - RNA, 19 nt, Homo sapiens
ccagagaaacucccacguu

SEQ ID NO: 82363 - RNA, 19 nt, Homo sapiens
gaagcucacucggaaaauu

SEQ ID NO: 82364 - RNA, 19 nt, Homo sapiens
gagaaacucccacguuaac

SEQ ID NO: 82365 - RNA, 19 nt, Homo sapiens
ccaacuguguccugugaau

SEQ ID NO: 82366 - RNA, 19 nt, Homo sapiens
agaagaguccagccucaua

SEQ ID NO: 82367 - RNA, 19 nt, Homo sapiens
cggaggaagugaagcaugu

SEQ ID NO: 82368 - RNA, 19 nt, Homo sapiens
gaaugggcuaugugaauga

SEQ ID NO: 82369 - RNA, 19 nt, Homo sapiens
uagccagggccaugucuua

SEQ ID NO: 82370 - RNA, 19 nt, Homo sapiens
caugagcugcuguaaacua

SEQ ID NO: 82371 - RNA, 19 nt, Homo sapiens
ggugugggccucauagaug

SEQ ID NO: 82372 - RNA, 19 nt, Homo sapiens
gcacaggacggaggaagug

SEQ ID NO: 82373 - RNA, 19 nt, Homo sapiens
ugacuguguuuccaucaug

SEQ ID NO: 82374 - RNA, 19 nt, Homo sapiens
ucuacgggaucauguuuga

SEQ ID NO: 82375 - RNA, 19 nt, Homo sapiens
gggcaugagcugcuguaaa

SEQ ID NO: 82376 - RNA, 19 nt, Homo sapiens
gggagacaccucuucauag

SEQ ID NO: 82377 - RNA, 19 nt, Homo sapiens
ugacggcacugcggauguu

SEQ ID NO: 82378 - RNA, 19 nt, Homo sapiens
ccucauagaugcggagaag

SEQ ID NO: 82379 - RNA, 19 nt, Homo sapiens
ucuaugcuuucuccuacua

SEQ ID NO: 82380 - RNA, 19 nt, Homo sapiens
ggacggaggaagugaagca

SEQ ID NO: 82381 - RNA, 19 nt, Homo sapiens
ugucagagguccuucaaaa

SEQ ID NO: 82382 - RNA, 19 nt, Homo sapiens
gaacagaugaaggcguuuc

SEQ ID NO: 82383 - RNA, 19 nt, Homo sapiens
ggccugcucuccucacaca

SEQ ID NO: 82384 - RNA, 19 nt, Homo sapiens
ggcggaggauccacucaga

SEQ ID NO: 82385 - RNA, 19 nt, Homo sapiens
gacuguguuuccaucauga

SEQ ID NO: 82386 - RNA, 19 nt, Homo sapiens
agaaguuacugcagaaggu

SEQ ID NO: 82387 - RNA, 19 nt, Homo sapiens
agaaaaggcccagaaguua

SEQ ID NO: 82388 - RNA, 19 nt, Homo sapiens
gaacuacuggauguugcua

SEQ ID NO: 82389 - RNA, 19 nt, Homo sapiens
agagaaacucccacguuaa

SEQ ID NO: 82390 - RNA, 19 nt, Homo sapiens
guguuccacucccaauaaa

SEQ ID NO: 82391 - RNA, 19 nt, Homo sapiens
ggcaaacaaggaugagaaa

SEQ ID NO: 82392 - RNA, 19 nt, Homo sapiens
cggcguggaucaccaucaa

SEQ ID NO: 82393 - RNA, 19 nt, Homo sapiens
ggcacgagcugaaccucau

SEQ ID NO: 82394 - RNA, 19 nt, Homo sapiens
agggagacaccucuucaua

SEQ ID NO: 82395 - RNA, 19 nt, Homo sapiens
ugcagaaggugaaagaagu

SEQ ID NO: 82396 - RNA, 19 nt, Homo sapiens
ccagggccaugucuuaggu

SEQ ID NO: 82397 - RNA, 19 nt, Homo sapiens
gugcuuguguagaaacugu

SEQ ID NO: 82398 - RNA, 19 nt, Homo sapiens
ggguaugaaugugugaguu

SEQ ID NO: 82399 - RNA, 19 nt, Homo sapiens
ucucccagccugucaguuu

SEQ ID NO: 82400 - RNA, 19 nt, Homo sapiens
cgagaucgcagccaaguac

SEQ ID NO: 82401 - RNA, 19 nt, Homo sapiens
aagcaucgccuuuccuugu

SEQ ID NO: 82402 - RNA, 19 nt, Homo sapiens
ggacuugaguguguuugcu

SEQ ID NO: 82403 - RNA, 19 nt, Homo sapiens
ugccuaugcugaugauguu

SEQ ID NO: 82404 - RNA, 19 nt, Homo sapiens
gguaugaaugugugaguuc

SEQ ID NO: 82405 - RNA, 19 nt, Homo sapiens
gcucuuccuuggguaugaa

SEQ ID NO: 82406 - RNA, 19 nt, Homo sapiens
acuacuggauguugcuaaa

SEQ ID NO: 82407 - RNA, 19 nt, Homo sapiens
cauggaaugggcuauguga

SEQ ID NO: 82408 - RNA, 19 nt, Homo sapiens
uacaagcucuauuccuaca

SEQ ID NO: 82409 - RNA, 19 nt, Homo sapiens
cccagaaguuacugcagaa

SEQ ID NO: 82410 - RNA, 19 nt, Homo sapiens
uggaaugggcuaugugaau

SEQ ID NO: 82411 - RNA, 19 nt, Homo sapiens
acugggaacucuggacuug

SEQ ID NO: 82412 - RNA, 19 nt, Homo sapiens
uaugcuuucuccuacuauu

SEQ ID NO: 82413 - RNA, 19 nt, Homo sapiens
caucaugaacggaacagau

SEQ ID NO: 82414 - RNA, 19 nt, Homo sapiens
gcaucgccuuuccuuguag

SEQ ID NO: 82415 - RNA, 19 nt, Homo sapiens
gacaggggcuucuccuuca

SEQ ID NO: 82416 - RNA, 19 nt, Homo sapiens
uguguuccacucccaauaa

SEQ ID NO: 82417 - RNA, 19 nt, Homo sapiens
cggcacugcggauguuuaa

SEQ ID NO: 82418 - RNA, 19 nt, Homo sapiens
ccacucagaucgccuuccu

SEQ ID NO: 82419 - RNA, 19 nt, Homo sapiens
agcaucgccuuuccuugua

SEQ ID NO: 82420 - RNA, 19 nt, Homo sapiens
gaccugggcccugcucaau

SEQ ID NO: 82421 - RNA, 19 nt, Homo sapiens
gugucugugugucugcaua

SEQ ID NO: 82422 - RNA, 19 nt, Homo sapiens
uggcaaacaaggaugagaa

SEQ ID NO: 82423 - RNA, 19 nt, Homo sapiens
gguauccguuaugaaacuu

SEQ ID NO: 82424 - RNA, 19 nt, Homo sapiens
gugugggcguguucaucua

SEQ ID NO: 82425 - RNA, 19 nt, Homo sapiens
uugcuugucucccaguuuc

SEQ ID NO: 82426 - RNA, 19 nt, Homo sapiens
guggaucaccaucaacuuc

SEQ ID NO: 82427 - RNA, 19 nt, Homo sapiens
acgcagaagucacguacag

SEQ ID NO: 82428 - RNA, 19 nt, Homo sapiens
ugggaacucuggacuugag

SEQ ID NO: 82429 - RNA, 19 nt, Homo sapiens
caucagccucuuccaguca

SEQ ID NO: 82430 - RNA, 19 nt, Homo sapiens
caucgacucccugaacaga

SEQ ID NO: 82431 - RNA, 19 nt, Homo sapiens
uacaucgacucccugaaca

SEQ ID NO: 82432 - RNA, 19 nt, Homo sapiens
gaaaaggcccagaaguuac

SEQ ID NO: 82433 - RNA, 19 nt, Homo sapiens
augagcugcuguaaacuau

SEQ ID NO: 82434 - RNA, 19 nt, Homo sapiens
aaaggaagcugcaggaaua

SEQ ID NO: 82435 - RNA, 19 nt, Homo sapiens
gaaauuuccuggagaagaa

SEQ ID NO: 82436 - RNA, 19 nt, Homo sapiens
gaacgaacauccuacucua

SEQ ID NO: 82437 - RNA, 19 nt, Homo sapiens
ggaaugaggcugagaagaa

SEQ ID NO: 82438 - RNA, 19 nt, Homo sapiens
gaagguaucaguuuaaugu

SEQ ID NO: 82439 - RNA, 19 nt, Homo sapiens
agaaagaacuccagcaaau

SEQ ID NO: 82440 - RNA, 19 nt, Homo sapiens
ucauagaccucucugcaua

SEQ ID NO: 82441 - RNA, 19 nt, Homo sapiens
gcagaauucuccuaccaaa

SEQ ID NO: 82442 - RNA, 19 nt, Homo sapiens
gauuacagccaacuauuua

SEQ ID NO: 82443 - RNA, 19 nt, Homo sapiens
agucaaaccuucaaaugua

SEQ ID NO: 82444 - RNA, 19 nt, Homo sapiens
gaaccacagucuacgugua

SEQ ID NO: 82445 - RNA, 19 nt, Homo sapiens
ggacugaaguaugguauug

SEQ ID NO: 82446 - RNA, 19 nt, Homo sapiens
ggucaggcucuuuauauua

SEQ ID NO: 82447 - RNA, 19 nt, Homo sapiens
gcaaugcuccugcagaauu

SEQ ID NO: 82448 - RNA, 19 nt, Homo sapiens
ggaguccaauggcugcuua

SEQ ID NO: 82449 - RNA, 19 nt, Homo sapiens
caaauccaauggcuacaaa

SEQ ID NO: 82450 - RNA, 19 nt, Homo sapiens
gucaggcucuuuauauuaa

SEQ ID NO: 82451 - RNA, 19 nt, Homo sapiens
gaagcugcaggaauauuua

SEQ ID NO: 82452 - RNA, 19 nt, Homo sapiens
ggaagcugcaggaauauuu

SEQ ID NO: 82453 - RNA, 19 nt, Homo sapiens
gguaucaguuuaauguuga

SEQ ID NO: 82454 - RNA, 19 nt, Homo sapiens
gagaaaagauguucacugu

SEQ ID NO: 82455 - RNA, 19 nt, Homo sapiens
cuacacagccagugcuuua

SEQ ID NO: 82456 - RNA, 19 nt, Homo sapiens
uccaauggcuacaaacuaa

SEQ ID NO: 82457 - RNA, 19 nt, Homo sapiens
gagaagguaucaguuuaau

SEQ ID NO: 82458 - RNA, 19 nt, Homo sapiens
ggauuacagccaacuauuu

SEQ ID NO: 82459 - RNA, 19 nt, Homo sapiens
caaagucgaaugagaaaga

SEQ ID NO: 82460 - RNA, 19 nt, Homo sapiens
ccauuucccucccucagua

SEQ ID NO: 82461 - RNA, 19 nt, Homo sapiens
cuucaaagcuugccaugau

SEQ ID NO: 82462 - RNA, 19 nt, Homo sapiens
gaaugaggcugagaagaag

SEQ ID NO: 82463 - RNA, 19 nt, Homo sapiens
gcauauuguucuucagaga

SEQ ID NO: 82464 - RNA, 19 nt, Homo sapiens
ucacgugccucucaaauac

SEQ ID NO: 82465 - RNA, 19 nt, Homo sapiens
uugagaagguaucaguuua

SEQ ID NO: 82466 - RNA, 19 nt, Homo sapiens
gcuauucugugcauauugu

SEQ ID NO: 82467 - RNA, 19 nt, Homo sapiens
cauagaaccaccugucuuu

SEQ ID NO: 82468 - RNA, 19 nt, Homo sapiens
gaacaccagcgacaucaug

SEQ ID NO: 82469 - RNA, 19 nt, Homo sapiens
ugaaacagcagcuaaugaa

SEQ ID NO: 82470 - RNA, 19 nt, Homo sapiens
gagaaagaacuccagcaaa

SEQ ID NO: 82471 - RNA, 19 nt, Homo sapiens
ccucagaucaguagaauau

SEQ ID NO: 82472 - RNA, 19 nt, Homo sapiens
uuucuuagcugaauaugga

SEQ ID NO: 82473 - RNA, 19 nt, Homo sapiens
ccaauuacuuucccagauc

SEQ ID NO: 82474 - RNA, 19 nt, Homo sapiens
gggcugacuuuccauuguu

SEQ ID NO: 82475 - RNA, 19 nt, Homo sapiens
cuacaucuaccacuuguuu

SEQ ID NO: 82476 - RNA, 19 nt, Homo sapiens
gccagugcuuuaaaucuuu

SEQ ID NO: 82477 - RNA, 19 nt, Homo sapiens
cgaacauccuacucuauga

SEQ ID NO: 82478 - RNA, 19 nt, Homo sapiens
ugacugagccuucaaagca

SEQ ID NO: 82479 - RNA, 19 nt, Homo sapiens
ugugaacgguuacaaauuc

SEQ ID NO: 82480 - RNA, 19 nt, Homo sapiens
ccaacuacaucuaccacuu

SEQ ID NO: 82481 - RNA, 19 nt, Homo sapiens
gauugcaaccuguguguuu

SEQ ID NO: 82482 - RNA, 19 nt, Homo sapiens
ucagaucaguagaauauag

SEQ ID NO: 82483 - RNA, 19 nt, Homo sapiens
gauuauagcaucagcuuca

SEQ ID NO: 82484 - RNA, 19 nt, Homo sapiens
cuaaugaaguccuugaaag

SEQ ID NO: 82485 - RNA, 19 nt, Homo sapiens
cauccuacucuaugauuua

SEQ ID NO: 82486 - RNA, 19 nt, Homo sapiens
gugaaaggcucuggaaucu

SEQ ID NO: 82487 - RNA, 19 nt, Homo sapiens
gaaagaacuccagcaaauc

SEQ ID NO: 82488 - RNA, 19 nt, Homo sapiens
agaguaaguugagaaggua

SEQ ID NO: 82489 - RNA, 19 nt, Homo sapiens
gaccagaggccagaaaguu

SEQ ID NO: 82490 - RNA, 19 nt, Homo sapiens
guauauggauggauuacag

SEQ ID NO: 82491 - RNA, 19 nt, Homo sapiens
ccuacucuaugauuuacua

SEQ ID NO: 82492 - RNA, 19 nt, Homo sapiens
ccaacuauuuaaugggaaa

SEQ ID NO: 82493 - RNA, 19 nt, Homo sapiens
gcuaaugaaguccuugaaa

SEQ ID NO: 82494 - RNA, 19 nt, Homo sapiens
ucauauugcuguuucuuag

SEQ ID NO: 82495 - RNA, 19 nt, Homo sapiens
gauuauugcauuccagauu

SEQ ID NO: 82496 - RNA, 19 nt, Homo sapiens
gcaagauacccauuaagca

SEQ ID NO: 82497 - RNA, 19 nt, Homo sapiens
gagaagagacaggccacua

SEQ ID NO: 82498 - RNA, 19 nt, Homo sapiens
caggaaauacaacuaacua

SEQ ID NO: 82499 - RNA, 19 nt, Homo sapiens
caacuacaucuaccacuug

SEQ ID NO: 82500 - RNA, 19 nt, Homo sapiens
guuuaucagccaaagauua

SEQ ID NO: 82501 - RNA, 19 nt, Homo sapiens
gaacauccuacucuaugau

SEQ ID NO: 82502 - RNA, 19 nt, Homo sapiens
acacauugaucccuagcaa

SEQ ID NO: 82503 - RNA, 19 nt, Homo sapiens
agauacccauuaagcauuu

SEQ ID NO: 82504 - RNA, 19 nt, Homo sapiens
caagauacccauuaagcau

SEQ ID NO: 82505 - RNA, 19 nt, Homo sapiens
gcauaccuguguucagcaa

SEQ ID NO: 82506 - RNA, 19 nt, Homo sapiens
uggcaaugcuccugcagaa

SEQ ID NO: 82507 - RNA, 19 nt, Homo sapiens
guugagaagguaucaguuu

SEQ ID NO: 82508 - RNA, 19 nt, Homo sapiens
uaaggucaggcucuuuaua

SEQ ID NO: 82509 - RNA, 19 nt, Homo sapiens
ccacuaaggucaggcucuu

SEQ ID NO: 82510 - RNA, 19 nt, Homo sapiens
gcacuccgagcaugccuuu

SEQ ID NO: 82511 - RNA, 19 nt, Homo sapiens
uauacacgcucuacacaca

SEQ ID NO: 82512 - RNA, 19 nt, Homo sapiens
ucauaggucuugacuuugg

SEQ ID NO: 82513 - RNA, 19 nt, Homo sapiens
ggcugacuuuccauuguua

SEQ ID NO: 82514 - RNA, 19 nt, Homo sapiens
gggcucuggucacuagauu

SEQ ID NO: 82515 - RNA, 19 nt, Homo sapiens
acagguagaucccgaagca

SEQ ID NO: 82516 - RNA, 19 nt, Homo sapiens
gcauuucgccaaucagaau

SEQ ID NO: 82517 - RNA, 19 nt, Homo sapiens
ugagaagguaucaguuuaa

SEQ ID NO: 82518 - RNA, 19 nt, Homo sapiens
ccaaauuugaugagguaua

SEQ ID NO: 82519 - RNA, 19 nt, Homo sapiens
gcacccgcauggaguggaa

SEQ ID NO: 82520 - RNA, 19 nt, Homo sapiens
ucccagcccuuugacuuua

SEQ ID NO: 82521 - RNA, 19 nt, Homo sapiens
caauuacuuucccagauca

SEQ ID NO: 82522 - RNA, 19 nt, Homo sapiens
ucccauuggucuuuaacua

SEQ ID NO: 82523 - RNA, 19 nt, Homo sapiens
gaagagacaggccacuaag

SEQ ID NO: 82524 - RNA, 19 nt, Homo sapiens
agaccucucugcauaguag

SEQ ID NO: 82525 - RNA, 19 nt, Homo sapiens
gaggaagaguaaguugaga

SEQ ID NO: 82526 - RNA, 19 nt, Homo sapiens
caaugcuccugcagaauuc

SEQ ID NO: 82527 - RNA, 19 nt, Homo sapiens
gcaaauccaauggcuacaa

SEQ ID NO: 82528 - RNA, 19 nt, Homo sapiens
uuaagcauuucgccaauca

SEQ ID NO: 82529 - RNA, 19 nt, Homo sapiens
agaagagacaggccacuaa

SEQ ID NO: 82530 - RNA, 19 nt, Homo sapiens
aagaguaaguugagaaggu

SEQ ID NO: 82531 - RNA, 19 nt, Homo sapiens
cccacaugcugaucuauug

SEQ ID NO: 82532 - RNA, 19 nt, Homo sapiens
uccaauggcugcuuagagu

SEQ ID NO: 82533 - RNA, 19 nt, Homo sapiens
gauuaaagggccauuugug

SEQ ID NO: 82534 - RNA, 19 nt, Homo sapiens
gaacucgaauucauguuua

SEQ ID NO: 82535 - RNA, 19 nt, Homo sapiens
acacagacaugauugauua

SEQ ID NO: 82536 - RNA, 19 nt, Homo sapiens
gaagucaccuuuccuggua

SEQ ID NO: 82537 - RNA, 19 nt, Homo sapiens
ggacuuguauccagaugua

SEQ ID NO: 82538 - RNA, 19 nt, Homo sapiens
uaaaggagaucuucaggaa

SEQ ID NO: 82539 - RNA, 19 nt, Homo sapiens
gaacuuaaccuuggaguga

SEQ ID NO: 82540 - RNA, 19 nt, Homo sapiens
ccagagagguuccuucuau

SEQ ID NO: 82541 - RNA, 19 nt, Homo sapiens
caaagaaagugaacaacau

SEQ ID NO: 82542 - RNA, 19 nt, Homo sapiens
ccaaggcucugcucuuuga

SEQ ID NO: 82543 - RNA, 19 nt, Homo sapiens
ggagagagcacuuaguuuc

SEQ ID NO: 82544 - RNA, 19 nt, Homo sapiens
ggacugaugggcacacuuu

SEQ ID NO: 82545 - RNA, 19 nt, Homo sapiens
gaauucauguuuacaccuu

SEQ ID NO: 82546 - RNA, 19 nt, Homo sapiens
gaagcagaguggaucuuug

SEQ ID NO: 82547 - RNA, 19 nt, Homo sapiens
ggaacucgaauucauguuu

SEQ ID NO: 82548 - RNA, 19 nt, Homo sapiens
gaggguaucuuccugucuu

SEQ ID NO: 82549 - RNA, 19 nt, Homo sapiens
gaggagagagcacuuaguu

SEQ ID NO: 82550 - RNA, 19 nt, Homo sapiens
ggacuugagccuagagauu

SEQ ID NO: 82551 - RNA, 19 nt, Homo sapiens
ccagggaagugugugauaa

SEQ ID NO: 82552 - RNA, 19 nt, Homo sapiens
ugaccgagcuguugacaca

SEQ ID NO: 82553 - RNA, 19 nt, Homo sapiens
gcucugcucuuugagguaa

SEQ ID NO: 82554 - RNA, 19 nt, Homo sapiens
aaugugaacugcugccuaa

SEQ ID NO: 82555 - RNA, 19 nt, Homo sapiens
guaccaaagggcaguguua

SEQ ID NO: 82556 - RNA, 19 nt, Homo sapiens
cagacaugauugauuauga

SEQ ID NO: 82557 - RNA, 19 nt, Homo sapiens
aaagaaauguggagugucu

SEQ ID NO: 82558 - RNA, 19 nt, Homo sapiens
gagguuccuucuaugcuuu

SEQ ID NO: 82559 - RNA, 19 nt, Homo sapiens
auugaaagcugcaagacua

SEQ ID NO: 82560 - RNA, 19 nt, Homo sapiens
gagagcacuuaguuucuga

SEQ ID NO: 82561 - RNA, 19 nt, Homo sapiens
caggacagcuuccaauucu

SEQ ID NO: 82562 - RNA, 19 nt, Homo sapiens
ggaagcagaguggaucuuu

SEQ ID NO: 82563 - RNA, 19 nt, Homo sapiens
gccagcaccuuguauggaa

SEQ ID NO: 82564 - RNA, 19 nt, Homo sapiens
acaaagaaauguggagugu

SEQ ID NO: 82565 - RNA, 19 nt, Homo sapiens
augguaaacugacuuauug

SEQ ID NO: 82566 - RNA, 19 nt, Homo sapiens
gcauggaucucagcuacau

SEQ ID NO: 82567 - RNA, 19 nt, Homo sapiens
ggaaaagaauggccacuuc

SEQ ID NO: 82568 - RNA, 19 nt, Homo sapiens
cauauuagcuuggguuacu

SEQ ID NO: 82569 - RNA, 19 nt, Homo sapiens
ggacagcuuccaauucuag

SEQ ID NO: 82570 - RNA, 19 nt, Homo sapiens
uaaaggaaccaaggagaaa

SEQ ID NO: 82571 - RNA, 19 nt, Homo sapiens
ccaagacccaucaauauca

SEQ ID NO: 82572 - RNA, 19 nt, Homo sapiens
ccucuuaaaugguaaacug

SEQ ID NO: 82573 - RNA, 19 nt, Homo sapiens
gacuugagccuagagauuu

SEQ ID NO: 82574 - RNA, 19 nt, Homo sapiens
gaaagugaacaacauagag

SEQ ID NO: 82575 - RNA, 19 nt, Homo sapiens
ucacuuccuuugagauguu

SEQ ID NO: 82576 - RNA, 19 nt, Homo sapiens
uagcuuggguuacugugaa

SEQ ID NO: 82577 - RNA, 19 nt, Homo sapiens
aaacugacuuauugcaauc

SEQ ID NO: 82578 - RNA, 19 nt, Homo sapiens
caccagagcaucacagaga

SEQ ID NO: 82579 - RNA, 19 nt, Homo sapiens
cagacaagaucauuauggu

SEQ ID NO: 82580 - RNA, 19 nt, Homo sapiens
cauaguuacuugggauuug

SEQ ID NO: 82581 - RNA, 19 nt, Homo sapiens
agacuugguuugaggguau

SEQ ID NO: 82582 - RNA, 19 nt, Homo sapiens
cauacagacaagaucauua

SEQ ID NO: 82583 - RNA, 19 nt, Homo sapiens
ucuaugcuuucucuuacua

SEQ ID NO: 82584 - RNA, 19 nt, Homo sapiens
agccaggacuuucugcuuu

SEQ ID NO: 82585 - RNA, 19 nt, Homo sapiens
caccuuguauggaauuaug

SEQ ID NO: 82586 - RNA, 19 nt, Homo sapiens
gcacccaccuccccugaaa

SEQ ID NO: 82587 - RNA, 19 nt, Homo sapiens
guaaacugacuuauugcaa

SEQ ID NO: 82588 - RNA, 19 nt, Homo sapiens
aaggauggcuuuggcuuug

SEQ ID NO: 82589 - RNA, 19 nt, Homo sapiens
cagagagguuccuucuaug

SEQ ID NO: 82590 - RNA, 19 nt, Homo sapiens
gacgaaggcauauuagcuu

SEQ ID NO: 82591 - RNA, 19 nt, Homo sapiens
gaucauuauggugcuguua

SEQ ID NO: 82592 - RNA, 19 nt, Homo sapiens
aaucgcauuucaacccuuu

SEQ ID NO: 82593 - RNA, 19 nt, Homo sapiens
acuugagccuagagauuua

SEQ ID NO: 82594 - RNA, 19 nt, Homo sapiens
gaggagguccagagagguu

SEQ ID NO: 82595 - RNA, 19 nt, Homo sapiens
aaagugaacaacauagaga

SEQ ID NO: 82596 - RNA, 19 nt, Homo sapiens
gacacagacaugauugauu

SEQ ID NO: 82597 - RNA, 19 nt, Homo sapiens
gggcaguguuagcaucaug

SEQ ID NO: 82598 - RNA, 19 nt, Homo sapiens
caccuuuccugguaccaaa

SEQ ID NO: 82599 - RNA, 19 nt, Homo sapiens
gcacuggaacucgaauuca

SEQ ID NO: 82600 - RNA, 19 nt, Homo sapiens
ccagccacaucuugggaaa

SEQ ID NO: 82601 - RNA, 19 nt, Homo sapiens
acaaagaaagugaacaaca

SEQ ID NO: 82602 - RNA, 19 nt, Homo sapiens
ggagaaaauucagaaggaa

SEQ ID NO: 82603 - RNA, 19 nt, Homo sapiens
ccauugaggccacguacuu

SEQ ID NO: 82604 - RNA, 19 nt, Homo sapiens
gcccugcuaugccgaagug

SEQ ID NO: 82605 - RNA, 19 nt, Homo sapiens
ugggagcccuggagacaga

SEQ ID NO: 82606 - RNA, 19 nt, Homo sapiens
gaaccaaggagaaaauuca

SEQ ID NO: 82607 - RNA, 19 nt, Homo sapiens
caagacccaucaauaucag

SEQ ID NO: 82608 - RNA, 19 nt, Homo sapiens
ucccaagacccaucaauau

SEQ ID NO: 82609 - RNA, 19 nt, Homo sapiens
ggccaccuuucaccuguug

SEQ ID NO: 82610 - RNA, 19 nt, Homo sapiens
cuugggauuuggauugaaa

SEQ ID NO: 82611 - RNA, 19 nt, Homo sapiens
gaaaaugccaggacagcuu

SEQ ID NO: 82612 - RNA, 19 nt, Homo sapiens
gagagagcacuuaguuucu

SEQ ID NO: 82613 - RNA, 19 nt, Homo sapiens
uuacuugggauuuggauug

SEQ ID NO: 82614 - RNA, 19 nt, Homo sapiens
ugagaaaacucuggaacaa

SEQ ID NO: 82615 - RNA, 19 nt, Homo sapiens
ccaggacagcuuccaauuc

SEQ ID NO: 82616 - RNA, 19 nt, Homo sapiens
ggagugucuuggcugaauc

SEQ ID NO: 82617 - RNA, 19 nt, Homo sapiens
acaggaaccagcagacuug

SEQ ID NO: 82618 - RNA, 19 nt, Homo sapiens
cuggugguauccuguguuu

SEQ ID NO: 82619 - RNA, 19 nt, Homo sapiens
ccuucuaugcuuucucuua

SEQ ID NO: 82620 - RNA, 19 nt, Homo sapiens
gaaagcugcaagacuagca

SEQ ID NO: 82621 - RNA, 19 nt, Homo sapiens
ccaaagggcaguguuagca

SEQ ID NO: 82622 - RNA, 19 nt, Homo sapiens
gugaacugcugccuaacca

SEQ ID NO: 82623 - RNA, 19 nt, Homo sapiens
gccagggaagugugugaua

SEQ ID NO: 82624 - RNA, 19 nt, Homo sapiens
agagguuccuucuaugcuu

SEQ ID NO: 82625 - RNA, 19 nt, Homo sapiens
aaaggcaacagcaggacua

SEQ ID NO: 82626 - RNA, 19 nt, Homo sapiens
gcuguuagguaggacuugu

SEQ ID NO: 82627 - RNA, 19 nt, Homo sapiens
gcaaucccaagacccauca

SEQ ID NO: 82628 - RNA, 19 nt, Homo sapiens
agagagcacuuaguuucug

SEQ ID NO: 82629 - RNA, 19 nt, Homo sapiens
agaaagugaacaacauaga

SEQ ID NO: 82630 - RNA, 19 nt, Homo sapiens
gccaggacagcuuccaauu

SEQ ID NO: 82631 - RNA, 19 nt, Homo sapiens
ggcugaauccucauacaga

SEQ ID NO: 82632 - RNA, 19 nt, Homo sapiens
auaaaggaaccaaggagaa

SEQ ID NO: 82633 - RNA, 19 nt, Homo sapiens
gcagggagcacuggaacuc

SEQ ID NO: 82634 - RNA, 19 nt, Homo sapiens
gaagaaggcuggcacugua

SEQ ID NO: 82635 - RNA, 19 nt, Homo sapiens
ccaagaagccaaccaauaa

SEQ ID NO: 82636 - RNA, 19 nt, Homo sapiens
gacagaaacuggugaguga

SEQ ID NO: 82637 - RNA, 19 nt, Homo sapiens
gcaggagacuuuacaugga

SEQ ID NO: 82638 - RNA, 19 nt, Homo sapiens
gaaagcgaauuccuagaca

SEQ ID NO: 82639 - RNA, 19 nt, Homo sapiens
gcacaaacaagacugaugu

SEQ ID NO: 82640 - RNA, 19 nt, Homo sapiens
gccaagaagccaaccaaua

SEQ ID NO: 82641 - RNA, 19 nt, Homo sapiens
cagaaacaguucaccuuga

SEQ ID NO: 82642 - RNA, 19 nt, Homo sapiens
gaagggcaccucagaaaca

SEQ ID NO: 82643 - RNA, 19 nt, Homo sapiens
cauccagucucccaacuug

SEQ ID NO: 82644 - RNA, 19 nt, Homo sapiens
cagaagggcaccucagaaa

SEQ ID NO: 82645 - RNA, 19 nt, Homo sapiens
ucucccaacuuguauuaaa

SEQ ID NO: 82646 - RNA, 19 nt, Homo sapiens
gacaagcugugagaccaaa

SEQ ID NO: 82647 - RNA, 19 nt, Homo sapiens
gcagaagggcaccucagaa

SEQ ID NO: 82648 - RNA, 19 nt, Homo sapiens
caucugcaccugugaagaa

SEQ ID NO: 82649 - RNA, 19 nt, Homo sapiens
ccaggaggauggcaaagag

SEQ ID NO: 82650 - RNA, 19 nt, Homo sapiens
ggucucaccucgcuauggu

SEQ ID NO: 82651 - RNA, 19 nt, Homo sapiens
caggagacuuuacauggau

SEQ ID NO: 82652 - RNA, 19 nt, Homo sapiens
caacaggcaggcacaaaca

SEQ ID NO: 82653 - RNA, 19 nt, Homo sapiens
gugagugacugcacagagu

SEQ ID NO: 82654 - RNA, 19 nt, Homo sapiens
agucagugcuguucuuugu

SEQ ID NO: 82655 - RNA, 19 nt, Homo sapiens
ugugucaucugcuuucgaa

SEQ ID NO: 82656 - RNA, 19 nt, Homo sapiens
ggcacuggaugcagaaaca

SEQ ID NO: 82657 - RNA, 19 nt, Homo sapiens
ugagagcccugguggugau

SEQ ID NO: 82658 - RNA, 19 nt, Homo sapiens
gugcuggucuuuaucaaaa

SEQ ID NO: 82659 - RNA, 19 nt, Homo sapiens
ggacaagcugugagaccaa

SEQ ID NO: 82660 - RNA, 19 nt, Homo sapiens
guacgagugaggccuguga

SEQ ID NO: 82661 - RNA, 19 nt, Homo sapiens
gcugaccgcuguccaucca

SEQ ID NO: 82662 - RNA, 19 nt, Homo sapiens
caucuucgggauccuguuu

SEQ ID NO: 82663 - RNA, 19 nt, Homo sapiens
acaggcaguuggccagaga

SEQ ID NO: 82664 - RNA, 19 nt, Homo sapiens
gcaacaggcaggcacaaac

SEQ ID NO: 82665 - RNA, 19 nt, Homo sapiens
caagaagccaaccaauaag

SEQ ID NO: 82666 - RNA, 19 nt, Homo sapiens
ugaagaaggcuggcacugu

SEQ ID NO: 82667 - RNA, 19 nt, Homo sapiens
ggugcuggucuuuaucaaa

SEQ ID NO: 82668 - RNA, 19 nt, Homo sapiens
ucuuggugcuggucuuuau

SEQ ID NO: 82669 - RNA, 19 nt, Homo sapiens
aacaguaccuaauaaacag

SEQ ID NO: 82670 - RNA, 19 nt, Homo sapiens
caagcugugagaccaaaga

SEQ ID NO: 82671 - RNA, 19 nt, Homo sapiens
caaugugucaucugcuuuc

SEQ ID NO: 82672 - RNA, 19 nt, Homo sapiens
ccaaugugucaucugcuuu

SEQ ID NO: 82673 - RNA, 19 nt, Homo sapiens
uccaaugugucaucugcuu

SEQ ID NO: 82674 - RNA, 19 nt, Homo sapiens
ugaaagcgaauuccuagac

SEQ ID NO: 82675 - RNA, 19 nt, Homo sapiens
agucucccaacuuguauua

SEQ ID NO: 82676 - RNA, 19 nt, Homo sapiens
uccagucucccaacuugua

SEQ ID NO: 82677 - RNA, 19 nt, Homo sapiens
gugcaggagacuuuacaug

SEQ ID NO: 82678 - RNA, 19 nt, Homo sapiens
caaagaccugguugugcaa

SEQ ID NO: 82679 - RNA, 19 nt, Homo sapiens
cuacagggguuucugauac

SEQ ID NO: 82680 - RNA, 19 nt, Homo sapiens
gcacugacugggcauagcu

SEQ ID NO: 82681 - RNA, 19 nt, Homo sapiens
gaagaaggcuggcacugua

SEQ ID NO: 82682 - RNA, 19 nt, Homo sapiens
ccaagaagccaaccaauaa

SEQ ID NO: 82683 - RNA, 19 nt, Homo sapiens
gacagaaacuggugaguga

SEQ ID NO: 82684 - RNA, 19 nt, Homo sapiens
gcaggagacuuuacaugga

SEQ ID NO: 82685 - RNA, 19 nt, Homo sapiens
gaaagcgaauuccuagaca

SEQ ID NO: 82686 - RNA, 19 nt, Homo sapiens
gccaagaagccaaccaaua

SEQ ID NO: 82687 - RNA, 19 nt, Homo sapiens
cagaaacaguucaccuuga

SEQ ID NO: 82688 - RNA, 19 nt, Homo sapiens
gaagggcaccucagaaaca

SEQ ID NO: 82689 - RNA, 19 nt, Homo sapiens
cauccagucucccaacuug

SEQ ID NO: 82690 - RNA, 19 nt, Homo sapiens
cagaagggcaccucagaaa

SEQ ID NO: 82691 - RNA, 19 nt, Homo sapiens
ucucccaacuuguauuaaa

SEQ ID NO: 82692 - RNA, 19 nt, Homo sapiens
gcagaagggcaccucagaa

SEQ ID NO: 82693 - RNA, 19 nt, Homo sapiens
caucugcaccugugaagaa

SEQ ID NO: 82694 - RNA, 19 nt, Homo sapiens
ccaggaggauggcaaagag

SEQ ID NO: 82695 - RNA, 19 nt, Homo sapiens
ggucucaccucgcuauggu

SEQ ID NO: 82696 - RNA, 19 nt, Homo sapiens
caggagacuuuacauggau

SEQ ID NO: 82697 - RNA, 19 nt, Homo sapiens
gugagugacugcacagagu

SEQ ID NO: 82698 - RNA, 19 nt, Homo sapiens
agucagugcuguucuuugu

SEQ ID NO: 82699 - RNA, 19 nt, Homo sapiens
ugugucaucugcuuucgaa

SEQ ID NO: 82700 - RNA, 19 nt, Homo sapiens
ggcacuggaugcagaaaca

SEQ ID NO: 82701 - RNA, 19 nt, Homo sapiens
ugagagcccugguggugau

SEQ ID NO: 82702 - RNA, 19 nt, Homo sapiens
gugcuggucuuuaucaaaa

SEQ ID NO: 82703 - RNA, 19 nt, Homo sapiens
guacgagugaggccuguga

SEQ ID NO: 82704 - RNA, 19 nt, Homo sapiens
gcugaccgcuguccaucca

SEQ ID NO: 82705 - RNA, 19 nt, Homo sapiens
caucuucgggauccuguuu

SEQ ID NO: 82706 - RNA, 19 nt, Homo sapiens
acaggcaguuggccagaga

SEQ ID NO: 82707 - RNA, 19 nt, Homo sapiens
caagaagccaaccaauaag

SEQ ID NO: 82708 - RNA, 19 nt, Homo sapiens
ugaagaaggcuggcacugu

SEQ ID NO: 82709 - RNA, 19 nt, Homo sapiens
aacaguaccuaauaaacag

SEQ ID NO: 82710 - RNA, 19 nt, Homo sapiens
ggugcuggucuuuaucaaa

SEQ ID NO: 82711 - RNA, 19 nt, Homo sapiens
ucuuggugcuggucuuuau

SEQ ID NO: 82712 - RNA, 19 nt, Homo sapiens
caaugugucaucugcuuuc

SEQ ID NO: 82713 - RNA, 19 nt, Homo sapiens
ccaaugugucaucugcuuu

SEQ ID NO: 82714 - RNA, 19 nt, Homo sapiens
uccaaugugucaucugcuu

SEQ ID NO: 82715 - RNA, 19 nt, Homo sapiens
ugaaagcgaauuccuagac

SEQ ID NO: 82716 - RNA, 19 nt, Homo sapiens
agucucccaacuuguauua

SEQ ID NO: 82717 - RNA, 19 nt, Homo sapiens
uccagucucccaacuugua

SEQ ID NO: 82718 - RNA, 19 nt, Homo sapiens
gugcaggagacuuuacaug

SEQ ID NO: 82719 - RNA, 19 nt, Homo sapiens
cuacagggguuucugauac

SEQ ID NO: 82720 - RNA, 19 nt, Homo sapiens
gcacugacugggcauagcu

SEQ ID NO: 82721 - RNA, 19 nt, Homo sapiens
ggaaacagcugaccguuaa

SEQ ID NO: 82722 - RNA, 19 nt, Homo sapiens
gacaaggacucuauuauau

SEQ ID NO: 82723 - RNA, 19 nt, Homo sapiens
gagucaagcuccauuuaua

SEQ ID NO: 82724 - RNA, 19 nt, Homo sapiens
ccuguuaacugccuauuua

SEQ ID NO: 82725 - RNA, 19 nt, Homo sapiens
agaaagauccuuauccuua

SEQ ID NO: 82726 - RNA, 19 nt, Homo sapiens
gaagauaccauuucaacuu

SEQ ID NO: 82727 - RNA, 19 nt, Homo sapiens
gauagaagaugaaaggaau

SEQ ID NO: 82728 - RNA, 19 nt, Homo sapiens
ggaaaucuauuguaucuac

SEQ ID NO: 82729 - RNA, 19 nt, Homo sapiens
guaaacagcagauaacuug

SEQ ID NO: 82730 - RNA, 19 nt, Homo sapiens
gaucagaauccucaaauug

SEQ ID NO: 82731 - RNA, 19 nt, Homo sapiens
guagaacuguaauaaguga

SEQ ID NO: 82732 - RNA, 19 nt, Homo sapiens
gaaagauccuuauccuuac

SEQ ID NO: 82733 - RNA, 19 nt, Homo sapiens
agacaaggacucuauuaua

SEQ ID NO: 82734 - RNA, 19 nt, Homo sapiens
uaacacagcaugaucgaaa

SEQ ID NO: 82735 - RNA, 19 nt, Homo sapiens
gcaacaauccauucacuug

SEQ ID NO: 82736 - RNA, 19 nt, Homo sapiens
gcugggagucuucauaaua

SEQ ID NO: 82737 - RNA, 19 nt, Homo sapiens
ggacaguuauucauucucu

SEQ ID NO: 82738 - RNA, 19 nt, Homo sapiens
caaggacucuauuauaucu

SEQ ID NO: 82739 - RNA, 19 nt, Homo sapiens
ggagaaagauccuuauccu

SEQ ID NO: 82740 - RNA, 19 nt, Homo sapiens
gcauguagaacuguaauaa

SEQ ID NO: 82741 - RNA, 19 nt, Homo sapiens
gaaaacagcuuugaaaugc

SEQ ID NO: 82742 - RNA, 19 nt, Homo sapiens
cagguugaauucugaguaa

SEQ ID NO: 82743 - RNA, 19 nt, Homo sapiens
gggaaacagcugaccguua

SEQ ID NO: 82744 - RNA, 19 nt, Homo sapiens
cuagucaguucucuucuuu

SEQ ID NO: 82745 - RNA, 19 nt, Homo sapiens
ggacugcccaucagcauga

SEQ ID NO: 82746 - RNA, 19 nt, Homo sapiens
cauagaagguuggacaaga

SEQ ID NO: 82747 - RNA, 19 nt, Homo sapiens
cggcacaugucauaaguga

SEQ ID NO: 82748 - RNA, 19 nt, Homo sapiens
gaucgaaacauacaaccaa

SEQ ID NO: 82749 - RNA, 19 nt, Homo sapiens
caaggcauguagaacugua

SEQ ID NO: 82750 - RNA, 19 nt, Homo sapiens
gccagaagauaccauuuca

SEQ ID NO: 82751 - RNA, 19 nt, Homo sapiens
aaagacaaggacucuauua

SEQ ID NO: 82752 - RNA, 19 nt, Homo sapiens
aaacagcuuugaaaugcaa

SEQ ID NO: 82753 - RNA, 19 nt, Homo sapiens
cagagugaacuuguaauua

SEQ ID NO: 82754 - RNA, 19 nt, Homo sapiens
ucacuugggaggaguauuu

SEQ ID NO: 82755 - RNA, 19 nt, Homo sapiens
acaaagaggagacgaagaa

SEQ ID NO: 82756 - RNA, 19 nt, Homo sapiens
gggaggaguauuugaauug

SEQ ID NO: 82757 - RNA, 19 nt, Homo sapiens
caagauagaagaugaaagg

SEQ ID NO: 82758 - RNA, 19 nt, Homo sapiens
aaacauacaaccaaacuuc

SEQ ID NO: 82759 - RNA, 19 nt, Homo sapiens
gcacuggcuucacguccuu

SEQ ID NO: 82760 - RNA, 19 nt, Homo sapiens
uaagugaggccagcaguaa

SEQ ID NO: 82761 - RNA, 19 nt, Homo sapiens
gcuagucaguucucuucuu

SEQ ID NO: 82762 - RNA, 19 nt, Homo sapiens
cagcucacauucaguuaug

SEQ ID NO: 82763 - RNA, 19 nt, Homo sapiens
aauuacaggucacaugaaa

SEQ ID NO: 82764 - RNA, 19 nt, Homo sapiens
ggacaagauagaagaugaa

SEQ ID NO: 82765 - RNA, 19 nt, Homo sapiens
gucccuaucucuaccacua

SEQ ID NO: 82766 - RNA, 19 nt, Homo sapiens
gaaaagacaaggccauuau

SEQ ID NO: 82767 - RNA, 19 nt, Homo sapiens
gaacugugaggagauuaaa

SEQ ID NO: 82768 - RNA, 19 nt, Homo sapiens
caaucucucuuucucaauc

SEQ ID NO: 82769 - RNA, 19 nt, Homo sapiens
ugaauuacaggucacauga

SEQ ID NO: 82770 - RNA, 19 nt, Homo sapiens
uaauacagcacagcgguua

SEQ ID NO: 82771 - RNA, 19 nt, Homo sapiens
aaaggauacuacaccauga

SEQ ID NO: 82772 - RNA, 19 nt, Homo sapiens
gagugaacuuguaauuauc

SEQ ID NO: 82773 - RNA, 19 nt, Homo sapiens
acagcaugaucgaaacaua

SEQ ID NO: 82774 - RNA, 19 nt, Homo sapiens
caagucaccuucuguucca

SEQ ID NO: 82775 - RNA, 19 nt, Homo sapiens
ccugcagucuccauuguuu

SEQ ID NO: 82776 - RNA, 19 nt, Homo sapiens
uggacaagauagaagauga

SEQ ID NO: 82777 - RNA, 19 nt, Homo sapiens
ccagagugaacuuguaauu

SEQ ID NO: 82778 - RNA, 19 nt, Homo sapiens
cacauucaguuaugguuga

SEQ ID NO: 82779 - RNA, 19 nt, Homo sapiens
gaggagacgaagaaagaaa

SEQ ID NO: 82780 - RNA, 19 nt, Homo sapiens
aagaggagacgaagaaaga

SEQ ID NO: 82781 - RNA, 19 nt, Homo sapiens
gaagguuggacaagauaga

SEQ ID NO: 82782 - RNA, 19 nt, Homo sapiens
uagaugagggugaggagua

SEQ ID NO: 82783 - RNA, 19 nt, Homo sapiens
caggucacaugaaaccaaa

SEQ ID NO: 82784 - RNA, 19 nt, Homo sapiens
gggcaacaauccauucacu

SEQ ID NO: 82785 - RNA, 19 nt, Homo sapiens
cgagagaaucuuacucaga

SEQ ID NO: 82786 - RNA, 19 nt, Homo sapiens
ugaucagaauccucaaauu

SEQ ID NO: 82787 - RNA, 19 nt, Homo sapiens
uauccuuacugaacuguga

SEQ ID NO: 82788 - RNA, 19 nt, Homo sapiens
caaccucuuucuuccaauc

SEQ ID NO: 82789 - RNA, 19 nt, Homo sapiens
gaauuacaggucacaugaa

SEQ ID NO: 82790 - RNA, 19 nt, Homo sapiens
gagaaagauccuuauccuu

SEQ ID NO: 82791 - RNA, 19 nt, Homo sapiens
uuccauggauaaugcauuu

SEQ ID NO: 82792 - RNA, 19 nt, Homo sapiens
gauacuacaccaugagcaa

SEQ ID NO: 82793 - RNA, 19 nt, Homo sapiens
gcccacuccucauuacgaa

SEQ ID NO: 82794 - RNA, 19 nt, Homo sapiens
gugcuucgguguuugucaa

SEQ ID NO: 82795 - RNA, 19 nt, Homo sapiens
gaaacauacaaccaaacuu

SEQ ID NO: 82796 - RNA, 19 nt, Homo sapiens
gggccaggcucuagaacgu

SEQ ID NO: 82797 - RNA, 19 nt, Homo sapiens
caacuuuaacacagcauga

SEQ ID NO: 82798 - RNA, 19 nt, Homo sapiens
cucaaacucugaacagugu

SEQ ID NO: 82799 - RNA, 19 nt, Homo sapiens
caaauugcggcacauguca

SEQ ID NO: 82800 - RNA, 19 nt, Homo sapiens
uaaacaaagaggagacgaa

SEQ ID NO: 82801 - RNA, 19 nt, Homo sapiens
ggccguugcuagucaguuc

SEQ ID NO: 82802 - RNA, 19 nt, Homo sapiens
cccagucucucuucucaau

SEQ ID NO: 82803 - RNA, 19 nt, Homo sapiens
cuucacguccuuuggcuua

SEQ ID NO: 82804 - RNA, 19 nt, Homo sapiens
ggaggaguauuugaauugc

SEQ ID NO: 82805 - RNA, 19 nt, Homo sapiens
uuacucagagcugcaaaua

SEQ ID NO: 82806 - RNA, 19 nt, Homo sapiens
ccacuggacugcccaucag

SEQ ID NO: 82807 - RNA, 19 nt, Homo sapiens
gacaagauagaagaugaaa

SEQ ID NO: 82808 - RNA, 19 nt, Homo sapiens
guugaauucugaguaaaca

SEQ ID NO: 82809 - RNA, 19 nt, Homo sapiens
uagaagguuggacaagaua

SEQ ID NO: 82810 - RNA, 19 nt, Homo sapiens
gccagccucugccuaaagu

SEQ ID NO: 82811 - RNA, 19 nt, Homo sapiens
cgagucaagcuccauuuau

SEQ ID NO: 82812 - RNA, 19 nt, Homo sapiens
auagaagguuggacaagau

SEQ ID NO: 82813 - RNA, 19 nt, Homo sapiens
cagaagauaccauuucaac

SEQ ID NO: 82814 - RNA, 19 nt, Homo sapiens
uccaaucucucuuucucaa

SEQ ID NO: 82815 - RNA, 19 nt, Homo sapiens
gguugacucuggguuccua

SEQ ID NO: 82816 - RNA, 19 nt, Homo sapiens
ugaagaugcagaagggaaa

SEQ ID NO: 82817 - RNA, 19 nt, Homo sapiens
ccauggauaaugcauuuga

SEQ ID NO: 82818 - RNA, 19 nt, Homo sapiens
cagugucuuuccauggaua

SEQ ID NO: 82819 - RNA, 19 nt, Homo sapiens
gagaugcaacacaggagaa

SEQ ID NO: 82820 - RNA, 19 nt, Homo sapiens
ugggaggaguauuugaauu

SEQ ID NO: 82821 - RNA, 19 nt, Homo sapiens
gcagaucgauuugaauaua

SEQ ID NO: 82822 - RNA, 19 nt, Homo sapiens
gaagaaggauggauaugga

SEQ ID NO: 82823 - RNA, 19 nt, Homo sapiens
gcugguacgucuucaaaua

SEQ ID NO: 82824 - RNA, 19 nt, Homo sapiens
gaauauaaccugccgcuuu

SEQ ID NO: 82825 - RNA, 19 nt, Homo sapiens
caaggaaccugcagaaugu

SEQ ID NO: 82826 - RNA, 19 nt, Homo sapiens
gaaauggcaccacugcuua

SEQ ID NO: 82827 - RNA, 19 nt, Homo sapiens
ugaagaagauuguacauca

SEQ ID NO: 82828 - RNA, 19 nt, Homo sapiens
gggcauugcuuuccacuga

SEQ ID NO: 82829 - RNA, 19 nt, Homo sapiens
gaagagacccaaaucauuc

SEQ ID NO: 82830 - RNA, 19 nt, Homo sapiens
gacaggaccucuuucaaug

SEQ ID NO: 82831 - RNA, 19 nt, Homo sapiens
gcaagaauuugaucguuca

SEQ ID NO: 82832 - RNA, 19 nt, Homo sapiens
ccacaaggaugacugaugu

SEQ ID NO: 82833 - RNA, 19 nt, Homo sapiens
cagaauggcugaucaucuu

SEQ ID NO: 82834 - RNA, 19 nt, Homo sapiens
ggaagaagauaaagaccau

SEQ ID NO: 82835 - RNA, 19 nt, Homo sapiens
cuacuuuacuggaagguua

SEQ ID NO: 82836 - RNA, 19 nt, Homo sapiens
ggacaggaccucuuucaau

SEQ ID NO: 82837 - RNA, 19 nt, Homo sapiens
gaacgaauccugaagacau

SEQ ID NO: 82838 - RNA, 19 nt, Homo sapiens
uaaugucaaucguuccuua

SEQ ID NO: 82839 - RNA, 19 nt, Homo sapiens
gcaggaagaaggauggaua

SEQ ID NO: 82840 - RNA, 19 nt, Homo sapiens
gcgcagaucgauuugaaua

SEQ ID NO: 82841 - RNA, 19 nt, Homo sapiens
gugaagcuauuuaucugua

SEQ ID NO: 82842 - RNA, 19 nt, Homo sapiens
gaucaacaguggcaaugga

SEQ ID NO: 82843 - RNA, 19 nt, Homo sapiens
ugacaacgcagcagaguaa

SEQ ID NO: 82844 - RNA, 19 nt, Homo sapiens
gaacagugguuuggcaaca

SEQ ID NO: 82845 - RNA, 19 nt, Homo sapiens
ugacugauguagacagaaa

SEQ ID NO: 82846 - RNA, 19 nt, Homo sapiens
ucacagaccugcccaaugc

SEQ ID NO: 82847 - RNA, 19 nt, Homo sapiens
ggguguacauccucacaua

SEQ ID NO: 82848 - RNA, 19 nt, Homo sapiens
gacccaagcuucuagagau

SEQ ID NO: 82849 - RNA, 19 nt, Homo sapiens
guuggaaacauaaccauua

SEQ ID NO: 82850 - RNA, 19 nt, Homo sapiens
ugaaucagauggacacuca

SEQ ID NO: 82851 - RNA, 19 nt, Homo sapiens
ccagugaccucagcuaaga

SEQ ID NO: 82852 - RNA, 19 nt, Homo sapiens
gaagaagagacccaaauca

SEQ ID NO: 82853 - RNA, 19 nt, Homo sapiens
acucugacaucaagcaaua

SEQ ID NO: 82854 - RNA, 19 nt, Homo sapiens
ccaacaacuucuacucuga

SEQ ID NO: 82855 - RNA, 19 nt, Homo sapiens
cagcaagucucaggaaaug

SEQ ID NO: 82856 - RNA, 19 nt, Homo sapiens
gauaaagaccauccaacaa

SEQ ID NO: 82857 - RNA, 19 nt, Homo sapiens
aauauaaccugccgcuuug

SEQ ID NO: 82858 - RNA, 19 nt, Homo sapiens
uaacagaugcaaugugcua

SEQ ID NO: 82859 - RNA, 19 nt, Homo sapiens
gaacaaggagucgucagaa

SEQ ID NO: 82860 - RNA, 19 nt, Homo sapiens
gaagacagucccuggauca

SEQ ID NO: 82861 - RNA, 19 nt, Homo sapiens
caaagggugaagcuauuua

SEQ ID NO: 82862 - RNA, 19 nt, Homo sapiens
cacaaccucugguccuaua

SEQ ID NO: 82863 - RNA, 19 nt, Homo sapiens
aaagucagguccaauuugu

SEQ ID NO: 82864 - RNA, 19 nt, Homo sapiens
uaugacagcugaugagaca

SEQ ID NO: 82865 - RNA, 19 nt, Homo sapiens
gaagagaccccacauucua

SEQ ID NO: 82866 - RNA, 19 nt, Homo sapiens
gaaaggagcagcacuucag

SEQ ID NO: 82867 - RNA, 19 nt, Homo sapiens
gcagucaacagucgaagaa

SEQ ID NO: 82868 - RNA, 19 nt, Homo sapiens
ucugaaggcucaacuacuu

SEQ ID NO: 82869 - RNA, 19 nt, Homo sapiens
cgagauccauugugcucua

SEQ ID NO: 82870 - RNA, 19 nt, Homo sapiens
ggguuuaaacugauucaua

SEQ ID NO: 82871 - RNA, 19 nt, Homo sapiens
ggacauuucccaggguuaa

SEQ ID NO: 82872 - RNA, 19 nt, Homo sapiens
ggaagaagagacccaaauc

SEQ ID NO: 82873 - RNA, 19 nt, Homo sapiens
caauaggaaugaugucaca

SEQ ID NO: 82874 - RNA, 19 nt, Homo sapiens
gaagauaaagaccauccaa

SEQ ID NO: 82875 - RNA, 19 nt, Homo sapiens
gaugacugauguagacaga

SEQ ID NO: 82876 - RNA, 19 nt, Homo sapiens
gcaagaagccugggauugg

SEQ ID NO: 82877 - RNA, 19 nt, Homo sapiens
gaagaagauuguacaucag

SEQ ID NO: 82878 - RNA, 19 nt, Homo sapiens
ucaagaagguggagcaaac

SEQ ID NO: 82879 - RNA, 19 nt, Homo sapiens
agaaacagcuacccagaag

SEQ ID NO: 82880 - RNA, 19 nt, Homo sapiens
ccagaaaggagaauacaga

SEQ ID NO: 82881 - RNA, 19 nt, Homo sapiens
ggaccaauuaccauaacua

SEQ ID NO: 82882 - RNA, 19 nt, Homo sapiens
agaauuugaucguucaguu

SEQ ID NO: 82883 - RNA, 19 nt, Homo sapiens
gcauugcuuuguaaauuag

SEQ ID NO: 82884 - RNA, 19 nt, Homo sapiens
gauuccaacucuaauguca

SEQ ID NO: 82885 - RNA, 19 nt, Homo sapiens
ugucacagguggaagaaga

SEQ ID NO: 82886 - RNA, 19 nt, Homo sapiens
ggaccucuuucaaugacaa

SEQ ID NO: 82887 - RNA, 19 nt, Homo sapiens
ugagggauaucgccaaaca

SEQ ID NO: 82888 - RNA, 19 nt, Homo sapiens
gaacccaagccauucaaau

SEQ ID NO: 82889 - RNA, 19 nt, Homo sapiens
gaaggugugggcagaagaa

SEQ ID NO: 82890 - RNA, 19 nt, Homo sapiens
gagcuucucuacaucacau

SEQ ID NO: 82891 - RNA, 19 nt, Homo sapiens
caacgcagcagaguaauuc

SEQ ID NO: 82892 - RNA, 19 nt, Homo sapiens
gggacgaggucaucaagca

SEQ ID NO: 82893 - RNA, 19 nt, Homo sapiens
caacugagacagcaaccaa

SEQ ID NO: 82894 - RNA, 19 nt, Homo sapiens
uucaggagguuacaucuuu

SEQ ID NO: 82895 - RNA, 19 nt, Homo sapiens
acaaaaggguuuaaacuga

SEQ ID NO: 82896 - RNA, 19 nt, Homo sapiens
auggauggcuucuaacaaa

SEQ ID NO: 82897 - RNA, 19 nt, Homo sapiens
gcuacugauuguuucauug

SEQ ID NO: 82898 - RNA, 19 nt, Homo sapiens
gaagguggagcaaacacaa

SEQ ID NO: 82899 - RNA, 19 nt, Homo sapiens
agaagagacccaaaucauu

SEQ ID NO: 82900 - RNA, 19 nt, Homo sapiens
gagacagacaccucaguuu

SEQ ID NO: 82901 - RNA, 19 nt, Homo sapiens
cagcaagaauuugaucguu

SEQ ID NO: 82902 - RNA, 19 nt, Homo sapiens
ggacaccauggacaaguuu

SEQ ID NO: 82903 - RNA, 19 nt, Homo sapiens
caugagggauaucgccaaa

SEQ ID NO: 82904 - RNA, 19 nt, Homo sapiens
acagauggcaugagggaua

SEQ ID NO: 82905 - RNA, 19 nt, Homo sapiens
caucagagucaaagaauca

SEQ ID NO: 82906 - RNA, 19 nt, Homo sapiens
gagauccauugugcucuaa

SEQ ID NO: 82907 - RNA, 19 nt, Homo sapiens
acaaggaaccugcagaaug

SEQ ID NO: 82908 - RNA, 19 nt, Homo sapiens
ugaaggcucaacuacuuua

SEQ ID NO: 82909 - RNA, 19 nt, Homo sapiens
ggaagaaggauggauaugg

SEQ ID NO: 82910 - RNA, 19 nt, Homo sapiens
gcucauaccagccauccaa

SEQ ID NO: 82911 - RNA, 19 nt, Homo sapiens
ccagcaacccuacugauga

SEQ ID NO: 82912 - RNA, 19 nt, Homo sapiens
gaagcuauuuaucuguagu

SEQ ID NO: 82913 - RNA, 19 nt, Homo sapiens
gggugaagcuauuuaucug

SEQ ID NO: 82914 - RNA, 19 nt, Homo sapiens
uaaagaccauccaacaacu

SEQ ID NO: 82915 - RNA, 19 nt, Homo sapiens
gacaggacaggaccucuuu

SEQ ID NO: 82916 - RNA, 19 nt, Homo sapiens
gcaaauccaaacacagguu

SEQ ID NO: 82917 - RNA, 19 nt, Homo sapiens
gcugggagccaaaugaaga

SEQ ID NO: 82918 - RNA, 19 nt, Homo sapiens
cagcaacccuacugaugau

SEQ ID NO: 82919 - RNA, 19 nt, Homo sapiens
gaagauuguacaucaguca

SEQ ID NO: 82920 - RNA, 19 nt, Homo sapiens
acacauauguauuccugau

SEQ ID NO: 82921 - RNA, 19 nt, Homo sapiens
ggaauacacuucuguuuaa

SEQ ID NO: 82922 - RNA, 19 nt, Homo sapiens
gaagagauauuuacaccuu

SEQ ID NO: 82923 - RNA, 19 nt, Homo sapiens
caaagcagcuguaauuuag

SEQ ID NO: 82924 - RNA, 19 nt, Homo sapiens
uaacugaagugaagugaug

SEQ ID NO: 82925 - RNA, 19 nt, Homo sapiens
uaggaaagcuguagaggaa

SEQ ID NO: 82926 - RNA, 19 nt, Homo sapiens
ucaaagcagcuguaauuua

SEQ ID NO: 82927 - RNA, 19 nt, Homo sapiens
uaucuuagcucuagcacaa

SEQ ID NO: 82928 - RNA, 19 nt, Homo sapiens
gcauggcccucuucugauu

SEQ ID NO: 82929 - RNA, 19 nt, Homo sapiens
uaacagaauuaaccagaga

SEQ ID NO: 82930 - RNA, 19 nt, Homo sapiens
caaaaggaaugaugaauga

SEQ ID NO: 82931 - RNA, 19 nt, Homo sapiens
aaauauagauccgguggua

SEQ ID NO: 82932 - RNA, 19 nt, Homo sapiens
gucauuccaugcuuuguua

SEQ ID NO: 82933 - RNA, 19 nt, Homo sapiens
gaugaaugaugaauaacug

SEQ ID NO: 82934 - RNA, 19 nt, Homo sapiens
acaauuacuuggacuaguu

SEQ ID NO: 82935 - RNA, 19 nt, Homo sapiens
uauacaaccuccuaggaaa

SEQ ID NO: 82936 - RNA, 19 nt, Homo sapiens
uaagagugaugcugucuca

SEQ ID NO: 82937 - RNA, 19 nt, Homo sapiens
gaaaggaauacacuucugu

SEQ ID NO: 82938 - RNA, 19 nt, Homo sapiens
ggccuugguuuaauuguga

SEQ ID NO: 82939 - RNA, 19 nt, Homo sapiens
ugauggagcucuaaacaag

SEQ ID NO: 82940 - RNA, 19 nt, Homo sapiens
gaagauggauaagagugau

SEQ ID NO: 82941 - RNA, 19 nt, Homo sapiens
ugaagucucacaauuacua

SEQ ID NO: 82942 - RNA, 19 nt, Homo sapiens
guaacugguugucaccuau

SEQ ID NO: 82943 - RNA, 19 nt, Homo sapiens
aggaauacacuucuguuua

SEQ ID NO: 82944 - RNA, 19 nt, Homo sapiens
gcuaaaauaucguguuguu

SEQ ID NO: 82945 - RNA, 19 nt, Homo sapiens
guacagcgauuggauuaac

SEQ ID NO: 82946 - RNA, 19 nt, Homo sapiens
cuuacgugauuguuaguua

SEQ ID NO: 82947 - RNA, 19 nt, Homo sapiens
aaggaaugaugaaugauga

SEQ ID NO: 82948 - RNA, 19 nt, Homo sapiens
aagcagcuguaauuuaguu

SEQ ID NO: 82949 - RNA, 19 nt, Homo sapiens
gaauucacguuuuguaaug

SEQ ID NO: 82950 - RNA, 19 nt, Homo sapiens
guaagacgugaaaggaaua

SEQ ID NO: 82951 - RNA, 19 nt, Homo sapiens
gggacaguuugguauuaaa

SEQ ID NO: 82952 - RNA, 19 nt, Homo sapiens
auucaaagcagcuguaauu

SEQ ID NO: 82953 - RNA, 19 nt, Homo sapiens
ugaaauuuguggcuuccaa

SEQ ID NO: 82954 - RNA, 19 nt, Homo sapiens
uuacuucacuacuaugugu

SEQ ID NO: 82955 - RNA, 19 nt, Homo sapiens
gaauacacuucuguuuaag

SEQ ID NO: 82956 - RNA, 19 nt, Homo sapiens
gaagugauggacuccgauu

SEQ ID NO: 82957 - RNA, 19 nt, Homo sapiens
gagcuaaaauaucguguug

SEQ ID NO: 82958 - RNA, 19 nt, Homo sapiens
gcuacuggccuugguuuaa

SEQ ID NO: 82959 - RNA, 19 nt, Homo sapiens
gaagucucacaauuacuaa

SEQ ID NO: 82960 - RNA, 19 nt, Homo sapiens
agagauauuuacaccuuug

SEQ ID NO: 82961 - RNA, 19 nt, Homo sapiens
guggaaauuuaaaggaaga

SEQ ID NO: 82962 - RNA, 19 nt, Homo sapiens
guaguaagacgugaaagga

SEQ ID NO: 82963 - RNA, 19 nt, Homo sapiens
augaauaacugaagugaag

SEQ ID NO: 82964 - RNA, 19 nt, Homo sapiens
uaguacagcgauuggauua

SEQ ID NO: 82965 - RNA, 19 nt, Homo sapiens
acaggaaacuacacuugug

SEQ ID NO: 82966 - RNA, 19 nt, Homo sapiens
gcagcuguaauuuaguuaa

SEQ ID NO: 82967 - RNA, 19 nt, Homo sapiens
gauauuuacaccuuugaug

SEQ ID NO: 82968 - RNA, 19 nt, Homo sapiens
gacccuuacgugauuguua

SEQ ID NO: 82969 - RNA, 19 nt, Homo sapiens
cuacuggccuugguuuaau

SEQ ID NO: 82970 - RNA, 19 nt, Homo sapiens
ugaaaggaauacacuucug

SEQ ID NO: 82971 - RNA, 19 nt, Homo sapiens
aguaagacgugaaaggaau

SEQ ID NO: 82972 - RNA, 19 nt, Homo sapiens
gucauugccauauugguua

SEQ ID NO: 82973 - RNA, 19 nt, Homo sapiens
ucacugucauugucauugu

SEQ ID NO: 82974 - RNA, 19 nt, Homo sapiens
gaucaucgagcuaaaauau

SEQ ID NO: 82975 - RNA, 19 nt, Homo sapiens
gaaguaacagaauuaacca

SEQ ID NO: 82976 - RNA, 19 nt, Homo sapiens
caccauggccuugaugauu

SEQ ID NO: 82977 - RNA, 19 nt, Homo sapiens
gaauaacugaagugaagug

SEQ ID NO: 82978 - RNA, 19 nt, Homo sapiens
gaaauuuguggcuuccaau

SEQ ID NO: 82979 - RNA, 19 nt, Homo sapiens
gcacaaaacacuacugaag

SEQ ID NO: 82980 - RNA, 19 nt, Homo sapiens
augagacccuuacgugauu

SEQ ID NO: 82981 - RNA, 19 nt, Homo sapiens
ggaaugaugaaugaugaau

SEQ ID NO: 82982 - RNA, 19 nt, Homo sapiens
aaaggaaugaugaaugaug

SEQ ID NO: 82983 - RNA, 19 nt, Homo sapiens
ccaaucagaagacuauaca

SEQ ID NO: 82984 - RNA, 19 nt, Homo sapiens
gcacaauuacuuggacuag

SEQ ID NO: 82985 - RNA, 19 nt, Homo sapiens
gcucuagcacaauuacuug

SEQ ID NO: 82986 - RNA, 19 nt, Homo sapiens
ucuuagcucuagcacaauu

SEQ ID NO: 82987 - RNA, 19 nt, Homo sapiens
cuucgucauugccauauug

SEQ ID NO: 82988 - RNA, 19 nt, Homo sapiens
cuugugaaguaacagaauu

SEQ ID NO: 82989 - RNA, 19 nt, Homo sapiens
gaugaauaacugaagugaa

SEQ ID NO: 82990 - RNA, 19 nt, Homo sapiens
aaguauacguaaaguggaa

SEQ ID NO: 82991 - RNA, 19 nt, Homo sapiens
ggaaacuacacuugugaag

SEQ ID NO: 82992 - RNA, 19 nt, Homo sapiens
acacaggaaacuacacuug

SEQ ID NO: 82993 - RNA, 19 nt, Homo sapiens
uuccaugcuuuguuacuaa

SEQ ID NO: 82994 - RNA, 19 nt, Homo sapiens
caauuacuuggacuaguuu

SEQ ID NO: 82995 - RNA, 19 nt, Homo sapiens
ugucgucauuccaugcuuu

SEQ ID NO: 82996 - RNA, 19 nt, Homo sapiens
aauaucguguuguuucaug

SEQ ID NO: 82997 - RNA, 19 nt, Homo sapiens
ugaagauggauaagaguga

SEQ ID NO: 82998 - RNA, 19 nt, Homo sapiens
cgugauuguuaguuaaguu

SEQ ID NO: 82999 - RNA, 19 nt, Homo sapiens
cuauacaaccuccuaggaa

SEQ ID NO: 83000 - RNA, 19 nt, Homo sapiens
agaauuaaccagagaaggu

SEQ ID NO: 83001 - RNA, 19 nt, Homo sapiens
auacacuucuguuuaagca

SEQ ID NO: 83002 - RNA, 19 nt, Homo sapiens
gagaguaguaagacgugaa

SEQ ID NO: 83003 - RNA, 19 nt, Homo sapiens
caccuuugauggagcucua

SEQ ID NO: 83004 - RNA, 19 nt, Homo sapiens
ucagaagacuauacaaccu

SEQ ID NO: 83005 - RNA, 19 nt, Homo sapiens
uugaguaucuuagcucuag

SEQ ID NO: 83006 - RNA, 19 nt, Homo sapiens
gauuucagguuugaguauc

SEQ ID NO: 83007 - RNA, 19 nt, Homo sapiens
gaaugcuacuggccuuggu

SEQ ID NO: 83008 - RNA, 19 nt, Homo sapiens
ugucauuguuggagccauu

SEQ ID NO: 83009 - RNA, 19 nt, Homo sapiens
gaucacugucauugucauu

SEQ ID NO: 83010 - RNA, 19 nt, Homo sapiens
caggaaacuacacuuguga

SEQ ID NO: 83011 - RNA, 19 nt, Homo sapiens
gaaugaugaauaacugaag

SEQ ID NO: 83012 - RNA, 19 nt, Homo sapiens
ccagagaaggugaaacgau

SEQ ID NO: 83013 - RNA, 19 nt, Homo sapiens
uaagcaccauggccuugau

SEQ ID NO: 83014 - RNA, 19 nt, Homo sapiens
gauuuggagaguaguaaga

SEQ ID NO: 83015 - RNA, 19 nt, Homo sapiens
gagauauuuacaccuuuga

SEQ ID NO: 83016 - RNA, 19 nt, Homo sapiens
augcauggcccucuucuga

SEQ ID NO: 83017 - RNA, 19 nt, Homo sapiens
cgucauugccauauugguu

SEQ ID NO: 83018 - RNA, 19 nt, Homo sapiens
ccggugguauggaugagaa

SEQ ID NO: 83019 - RNA, 19 nt, Homo sapiens
uaugagacccuuacgugau

SEQ ID NO: 83020 - RNA, 19 nt, Homo sapiens
aguaacugguugucaccua

SEQ ID NO: 83021 - RNA, 19 nt, Homo sapiens
gaugacaacuguuauuuga

SEQ ID NO: 83022 - RNA, 19 nt, Homo sapiens
acacagagauauagagaua

SEQ ID NO: 83023 - RNA, 19 nt, Homo sapiens
cagaagaucuugccuguug

SEQ ID NO: 83024 - RNA, 19 nt, Homo sapiens
gaaacugucaugugugaua

SEQ ID NO: 83025 - RNA, 19 nt, Homo sapiens
caaaggagcuccagaacag

SEQ ID NO: 83026 - RNA, 19 nt, Homo sapiens
gagcaagaauggaagauca

SEQ ID NO: 83027 - RNA, 19 nt, Homo sapiens
uagaauggauugcaaguug

SEQ ID NO: 83028 - RNA, 19 nt, Homo sapiens
ggaaugagcaagaauggaa

SEQ ID NO: 83029 - RNA, 19 nt, Homo sapiens
gaagauagaagacauggau

SEQ ID NO: 83030 - RNA, 19 nt, Homo sapiens
caacagcaccuacaucaug

SEQ ID NO: 83031 - RNA, 19 nt, Homo sapiens
ggaguagaauggauugcaa

SEQ ID NO: 83032 - RNA, 19 nt, Homo sapiens
agacauggaugacaacugu

SEQ ID NO: 83033 - RNA, 19 nt, Homo sapiens
ucucuaagguccagaaaga

SEQ ID NO: 83034 - RNA, 19 nt, Homo sapiens
gcaugcugcugaauuauca

SEQ ID NO: 83035 - RNA, 19 nt, Homo sapiens
uagaagacauggaugacaa

SEQ ID NO: 83036 - RNA, 19 nt, Homo sapiens
caacgaggauuuucaaguu

SEQ ID NO: 83037 - RNA, 19 nt, Homo sapiens
gaucuugccuguuggugau

SEQ ID NO: 83038 - RNA, 19 nt, Homo sapiens
gagaugagcucuuuuaacu

SEQ ID NO: 83039 - RNA, 19 nt, Homo sapiens
caacgugacucugaacauc

SEQ ID NO: 83040 - RNA, 19 nt, Homo sapiens
gcagcaacgugacucugaa

SEQ ID NO: 83041 - RNA, 19 nt, Homo sapiens
cauaauuacuccagguguu

SEQ ID NO: 83042 - RNA, 19 nt, Homo sapiens
gcaauucugugagcagcaa

SEQ ID NO: 83043 - RNA, 19 nt, Homo sapiens
uaccugagaugagcucuuu

SEQ ID NO: 83044 - RNA, 19 nt, Homo sapiens
gacaacagcaccuacauca

SEQ ID NO: 83045 - RNA, 19 nt, Homo sapiens
caagucagcaauucuguga

SEQ ID NO: 83046 - RNA, 19 nt, Homo sapiens
cuaaguacuuugaauccaa

SEQ ID NO: 83047 - RNA, 19 nt, Homo sapiens
guacacagagauauagaga

SEQ ID NO: 83048 - RNA, 19 nt, Homo sapiens
caccauucuuggccuguua

SEQ ID NO: 83049 - RNA, 19 nt, Homo sapiens
ccagaagauuguagaaugg

SEQ ID NO: 83050 - RNA, 19 nt, Homo sapiens
ggaugacaacuguuauuug

SEQ ID NO: 83051 - RNA, 19 nt, Homo sapiens
auucuuggccuguuacuua

SEQ ID NO: 83052 - RNA, 19 nt, Homo sapiens
acagagauauagagauaca

SEQ ID NO: 83053 - RNA, 19 nt, Homo sapiens
gaauuaucaacgaggauuu

SEQ ID NO: 83054 - RNA, 19 nt, Homo sapiens
gagaacuacaaacaacuaa

SEQ ID NO: 83055 - RNA, 19 nt, Homo sapiens
ccagaacagugugcuugaa

SEQ ID NO: 83056 - RNA, 19 nt, Homo sapiens
uugaaacugucauguguga

SEQ ID NO: 83057 - RNA, 19 nt, Homo sapiens
uguauaggcugaccagaag

SEQ ID NO: 83058 - RNA, 19 nt, Homo sapiens
acccaagccugucaucaaa

SEQ ID NO: 83059 - RNA, 19 nt, Homo sapiens
caacuguuauuugaaacug

SEQ ID NO: 83060 - RNA, 19 nt, Homo sapiens
ggacaacagcaccuacauc

SEQ ID NO: 83061 - RNA, 19 nt, Homo sapiens
accagaagauuguagaaug

SEQ ID NO: 83062 - RNA, 19 nt, Homo sapiens
ugagaacuacaaacaacua

SEQ ID NO: 83063 - RNA, 19 nt, Homo sapiens
gaagaucaagcugcaagug

SEQ ID NO: 83064 - RNA, 19 nt, Homo sapiens
ucuaguacacagagauaua

SEQ ID NO: 83065 - RNA, 19 nt, Homo sapiens
cagaacagugugcuugaaa

SEQ ID NO: 83066 - RNA, 19 nt, Homo sapiens
ugugauaccuggcgagucu

SEQ ID NO: 83067 - RNA, 19 nt, Homo sapiens
acauggaugacaacuguua

SEQ ID NO: 83068 - RNA, 19 nt, Homo sapiens
ucugagagccugccugaga

SEQ ID NO: 83069 - RNA, 19 nt, Homo sapiens
uaacucaagcgaaacuuca

SEQ ID NO: 83070 - RNA, 19 nt, Homo sapiens
aacagcaccuacaucauga

SEQ ID NO: 83071 - RNA, 19 nt, Homo sapiens
ccugagaacuacaaacaac

SEQ ID NO: 83072 - RNA, 19 nt, Homo sapiens
ccaaaggagcuccagaaca

SEQ ID NO: 83073 - RNA, 19 nt, Homo sapiens
auaauuacuccagguguua

SEQ ID NO: 83074 - RNA, 19 nt, Homo sapiens
cugagagccugccugagaa

SEQ ID NO: 83075 - RNA, 19 nt, Homo sapiens
gcugcugaauuaucaacga

SEQ ID NO: 83076 - RNA, 19 nt, Homo sapiens
gugcuugaaaccacccuua

SEQ ID NO: 83077 - RNA, 19 nt, Homo sapiens
gagccugccugagaacuac

SEQ ID NO: 83078 - RNA, 19 nt, Homo sapiens
uggcgagucuguaaacuac

SEQ ID NO: 83079 - RNA, 19 nt, Homo sapiens
gcacuguacaucucuaagg

SEQ ID NO: 83080 - RNA, 19 nt, Homo sapiens
gaacuacaaacaacuaacc

SEQ ID NO: 83081 - RNA, 19 nt, Homo sapiens
gugucuggcucuggaauug

SEQ ID NO: 83082 - RNA, 19 nt, Homo sapiens
auagagauacacaugcuuu

SEQ ID NO: 83083 - RNA, 19 nt, Homo sapiens
ggucacuugguacauauga

SEQ ID NO: 83084 - RNA, 19 nt, Homo sapiens
ggcagcaacgugacucuga

SEQ ID NO: 83085 - RNA, 19 nt, Homo sapiens
gauugcaaguuggcuagug

SEQ ID NO: 83086 - RNA, 19 nt, Homo sapiens
agauagaagacauggauga

SEQ ID NO: 83087 - RNA, 19 nt, Homo sapiens
aaaggcagggucagacuug

SEQ ID NO: 83088 - RNA, 19 nt, Homo sapiens
gaccagaagauuguagaau

SEQ ID NO: 83089 - RNA, 19 nt, Homo sapiens
gcaacgugacucugaacau

SEQ ID NO: 83090 - RNA, 19 nt, Homo sapiens
ugaauuaucaacgaggauu

SEQ ID NO: 83091 - RNA, 19 nt, Homo sapiens
guagaauggauugcaaguu

SEQ ID NO: 83092 - RNA, 19 nt, Homo sapiens
uggaugacaacuguuauuu

SEQ ID NO: 83093 - RNA, 19 nt, Homo sapiens
gaagaucuugccuguuggu

SEQ ID NO: 83094 - RNA, 19 nt, Homo sapiens
gcuugaaaccacccuuaug

SEQ ID NO: 83095 - RNA, 19 nt, Homo sapiens
gacugggaaugagcaagaa

SEQ ID NO: 83096 - RNA, 19 nt, Homo sapiens
gaggacaacagcaccuaca

SEQ ID NO: 83097 - RNA, 19 nt, Homo sapiens
gccuguuacuuaccugaga

SEQ ID NO: 83098 - RNA, 19 nt, Homo sapiens
aaggucacuugguacauau

SEQ ID NO: 83099 - RNA, 19 nt, Homo sapiens
ucugugagcagcaagaaug

SEQ ID NO: 83100 - RNA, 19 nt, Homo sapiens
guaaacuacaccugguaug

SEQ ID NO: 83101 - RNA, 19 nt, Homo sapiens
agacugggaaugagcaaga

SEQ ID NO: 83102 - RNA, 19 nt, Homo sapiens
gcgcacuguacaucucuaa

SEQ ID NO: 83103 - RNA, 19 nt, Homo sapiens
agauauagagauacacaug

SEQ ID NO: 83104 - RNA, 19 nt, Homo sapiens
uaaacuacaccugguaugg

SEQ ID NO: 83105 - RNA, 19 nt, Homo sapiens
auuugaaacugucaugugu

SEQ ID NO: 83106 - RNA, 19 nt, Homo sapiens
uacccaagccugucaucaa

SEQ ID NO: 83107 - RNA, 19 nt, Homo sapiens
gcaagaauggaagaucaag

SEQ ID NO: 83108 - RNA, 19 nt, Homo sapiens
caucaugaggguguugaaa

SEQ ID NO: 83109 - RNA, 19 nt, Homo sapiens
cagacuugauccucagagu

SEQ ID NO: 83110 - RNA, 19 nt, Homo sapiens
uaaaggcagggucagacuu

SEQ ID NO: 83111 - RNA, 19 nt, Homo sapiens
gaacagugugcuugaaacc

SEQ ID NO: 83112 - RNA, 19 nt, Homo sapiens
ccaccauucuuggccuguu

SEQ ID NO: 83113 - RNA, 19 nt, Homo sapiens
uuuauacuuucgaccagaa

SEQ ID NO: 83114 - RNA, 19 nt, Homo sapiens
aaacugucaugugugauac

SEQ ID NO: 83115 - RNA, 19 nt, Homo sapiens
uugagaagauagaagacau

SEQ ID NO: 83116 - RNA, 19 nt, Homo sapiens
ccaagccugucaucaaaau

SEQ ID NO: 83117 - RNA, 19 nt, Homo sapiens
ggaagaucaagcugcaagu

SEQ ID NO: 83118 - RNA, 19 nt, Homo sapiens
cacuguacaucucuaaggu

SEQ ID NO: 83119 - RNA, 19 nt, Homo sapiens
gcuaugaucugcaguaguu

SEQ ID NO: 83120 - RNA, 19 nt, Homo sapiens
gaaaacaagugucugcuua

SEQ ID NO: 83121 - RNA, 19 nt, Homo sapiens
gcaagacugugguuucauu

SEQ ID NO: 83122 - RNA, 19 nt, Homo sapiens
gcuugaaacugcugaagua

SEQ ID NO: 83123 - RNA, 19 nt, Homo sapiens
gaacccaggauaugaauuu

SEQ ID NO: 83124 - RNA, 19 nt, Homo sapiens
ggcaagaucucauuucaau

SEQ ID NO: 83125 - RNA, 19 nt, Homo sapiens
gaagagacuuguuucaucu

SEQ ID NO: 83126 - RNA, 19 nt, Homo sapiens
gaacagaagcugaaugagu

SEQ ID NO: 83127 - RNA, 19 nt, Homo sapiens
gcaaagacaaacuggauuu

SEQ ID NO: 83128 - RNA, 19 nt, Homo sapiens
aacagaagcugaaugagua

SEQ ID NO: 83129 - RNA, 19 nt, Homo sapiens
gcugaaguauguccuguuu

SEQ ID NO: 83130 - RNA, 19 nt, Homo sapiens
gaauuacacaguucucuuu

SEQ ID NO: 83131 - RNA, 19 nt, Homo sapiens
caugaucacugcaggauga

SEQ ID NO: 83132 - RNA, 19 nt, Homo sapiens
gaggaacggugccuggaaa

SEQ ID NO: 83133 - RNA, 19 nt, Homo sapiens
ccucaaggauaaucacuaa

SEQ ID NO: 83134 - RNA, 19 nt, Homo sapiens
caagagaggcaaagacaaa

SEQ ID NO: 83135 - RNA, 19 nt, Homo sapiens
ugaaacugcugaaguaugu

SEQ ID NO: 83136 - RNA, 19 nt, Homo sapiens
gauaaucacaguaagaaga

SEQ ID NO: 83137 - RNA, 19 nt, Homo sapiens
cuacaggaauuacacaguu

SEQ ID NO: 83138 - RNA, 19 nt, Homo sapiens
caaaguggugaaacuaaua

SEQ ID NO: 83139 - RNA, 19 nt, Homo sapiens
gcaguguugugguauaaau

SEQ ID NO: 83140 - RNA, 19 nt, Homo sapiens
gggcaugaguagcuugaaa

SEQ ID NO: 83141 - RNA, 19 nt, Homo sapiens
gguauuaucucucuaucag

SEQ ID NO: 83142 - RNA, 19 nt, Homo sapiens
gauuucaaccagucacuua

SEQ ID NO: 83143 - RNA, 19 nt, Homo sapiens
uaaauaaugcccagucuuc

SEQ ID NO: 83144 - RNA, 19 nt, Homo sapiens
caaagacaaacuggauuua

SEQ ID NO: 83145 - RNA, 19 nt, Homo sapiens
acaguucucuuucuccaaa

SEQ ID NO: 83146 - RNA, 19 nt, Homo sapiens
ucggagugcucuuccauaa

SEQ ID NO: 83147 - RNA, 19 nt, Homo sapiens
ucaaaguggugaaacuaau

SEQ ID NO: 83148 - RNA, 19 nt, Homo sapiens
gaacugccagauugacaaa

SEQ ID NO: 83149 - RNA, 19 nt, Homo sapiens
uagagggccuuauugaugu

SEQ ID NO: 83150 - RNA, 19 nt, Homo sapiens
aaacaagugucugcuuaug

SEQ ID NO: 83151 - RNA, 19 nt, Homo sapiens
gaaaagggcaagaauauca

SEQ ID NO: 83152 - RNA, 19 nt, Homo sapiens
gaaagcaagacugugguuu

SEQ ID NO: 83153 - RNA, 19 nt, Homo sapiens
ccagucacuuagcugauaa

SEQ ID NO: 83154 - RNA, 19 nt, Homo sapiens
caaagggcaagaucucauu

SEQ ID NO: 83155 - RNA, 19 nt, Homo sapiens
ugaaugaguauguggcuaa

SEQ ID NO: 83156 - RNA, 19 nt, Homo sapiens
ggagugcucuuccauaacc

SEQ ID NO: 83157 - RNA, 19 nt, Homo sapiens
ggaauuacacaguucucuu

SEQ ID NO: 83158 - RNA, 19 nt, Homo sapiens
auaaauggcacgagugauu

SEQ ID NO: 83159 - RNA, 19 nt, Homo sapiens
guauaaauggcacgaguga

SEQ ID NO: 83160 - RNA, 19 nt, Homo sapiens
gacaagagaggcaaagaca

SEQ ID NO: 83161 - RNA, 19 nt, Homo sapiens
ucacuaaauucugccgaaa

SEQ ID NO: 83162 - RNA, 19 nt, Homo sapiens
gggauguccuuugcacuga

SEQ ID NO: 83163 - RNA, 19 nt, Homo sapiens
gaagcugaaugaguaugug

SEQ ID NO: 83164 - RNA, 19 nt, Homo sapiens
acaagugucugcuuauguc

SEQ ID NO: 83165 - RNA, 19 nt, Homo sapiens
uuagagggccuuauugaug

SEQ ID NO: 83166 - RNA, 19 nt, Homo sapiens
guaguucuguggugaagag

SEQ ID NO: 83167 - RNA, 19 nt, Homo sapiens
agucauuucugcaguguug

SEQ ID NO: 83168 - RNA, 19 nt, Homo sapiens
acuaauaucugagcaucuu

SEQ ID NO: 83169 - RNA, 19 nt, Homo sapiens
uggugaaacuaauaucuga

SEQ ID NO: 83170 - RNA, 19 nt, Homo sapiens
ccaggcacaucccaucuca

SEQ ID NO: 83171 - RNA, 19 nt, Homo sapiens
gcaaaaccauuuauagcau

SEQ ID NO: 83172 - RNA, 19 nt, Homo sapiens
caggcucacuggaccauug

SEQ ID NO: 83173 - RNA, 19 nt, Homo sapiens
agacaaacuggauuuaaug

SEQ ID NO: 83174 - RNA, 19 nt, Homo sapiens
gcagccaugucucucaaag

SEQ ID NO: 83175 - RNA, 19 nt, Homo sapiens
uuaggucccugucuuauac

SEQ ID NO: 83176 - RNA, 19 nt, Homo sapiens
acccugaacugccagauug

SEQ ID NO: 83177 - RNA, 19 nt, Homo sapiens
ccgacagcauccaccguua

SEQ ID NO: 83178 - RNA, 19 nt, Homo sapiens
caugggcucuaucaaggaa

SEQ ID NO: 83179 - RNA, 19 nt, Homo sapiens
aagcaagacugugguuuca

SEQ ID NO: 83180 - RNA, 19 nt, Homo sapiens
ccauccugcucuuuguaua

SEQ ID NO: 83181 - RNA, 19 nt, Homo sapiens
cagcagccaugucucucaa

SEQ ID NO: 83182 - RNA, 19 nt, Homo sapiens
gcaauguguuugucaucgu

SEQ ID NO: 83183 - RNA, 19 nt, Homo sapiens
gcaagaucucauuucaauu

SEQ ID NO: 83184 - RNA, 19 nt, Homo sapiens
ggugaacccaggauaugaa

SEQ ID NO: 83185 - RNA, 19 nt, Homo sapiens
gaucuguggcugcugcauu

SEQ ID NO: 83186 - RNA, 19 nt, Homo sapiens
ucggccaccucaaggauaa

SEQ ID NO: 83187 - RNA, 19 nt, Homo sapiens
cguuaccacucagacaaua

SEQ ID NO: 83188 - RNA, 19 nt, Homo sapiens
uauaugaacagaagcugaa

SEQ ID NO: 83189 - RNA, 19 nt, Homo sapiens
ccuuauugauguguucuaa

SEQ ID NO: 83190 - RNA, 19 nt, Homo sapiens
uauuagagggccuuauuga

SEQ ID NO: 83191 - RNA, 19 nt, Homo sapiens
gaaacuaauaucugagcau

SEQ ID NO: 83192 - RNA, 19 nt, Homo sapiens
agccaugucucucaaagug

SEQ ID NO: 83193 - RNA, 19 nt, Homo sapiens
uaaauggcacgagugauug

SEQ ID NO: 83194 - RNA, 19 nt, Homo sapiens
uuucugcaguguuguggua

SEQ ID NO: 83195 - RNA, 19 nt, Homo sapiens
ucacaacccucuguuucuc

SEQ ID NO: 83196 - RNA, 19 nt, Homo sapiens
ucuccagccucuaaauaau

SEQ ID NO: 83197 - RNA, 19 nt, Homo sapiens
uuaauggcccaacaucaaa

SEQ ID NO: 83198 - RNA, 19 nt, Homo sapiens
aaucaucaccaucugugua

SEQ ID NO: 83199 - RNA, 19 nt, Homo sapiens
ucauuccaauuuccuguau

SEQ ID NO: 83200 - RNA, 19 nt, Homo sapiens
gaaugaguauguggcuaag

SEQ ID NO: 83201 - RNA, 19 nt, Homo sapiens
accagucacuuagcugaua

SEQ ID NO: 83202 - RNA, 19 nt, Homo sapiens
caagcaagagacuaguuga

SEQ ID NO: 83203 - RNA, 19 nt, Homo sapiens
guggugaagagacuuguuu

SEQ ID NO: 83204 - RNA, 19 nt, Homo sapiens
cugcaguguugugguauaa

SEQ ID NO: 83205 - RNA, 19 nt, Homo sapiens
cauccaccguuaccacuca

SEQ ID NO: 83206 - RNA, 19 nt, Homo sapiens
cugcuuaugucguucuuca

SEQ ID NO: 83207 - RNA, 19 nt, Homo sapiens
uuacacaguucucuuucuc

SEQ ID NO: 83208 - RNA, 19 nt, Homo sapiens
ucaagcaagagacuaguug

SEQ ID NO: 83209 - RNA, 19 nt, Homo sapiens
cgugggcucuauuaucaug

SEQ ID NO: 83210 - RNA, 19 nt, Homo sapiens
gggcuaugaucugcaguag

SEQ ID NO: 83211 - RNA, 19 nt, Homo sapiens
gacugugguuucauuccaa

SEQ ID NO: 83212 - RNA, 19 nt, Homo sapiens
ccggauaucuguguuacca

SEQ ID NO: 83213 - RNA, 19 nt, Homo sapiens
ggaggguugcuaugcgaaa

SEQ ID NO: 83214 - RNA, 19 nt, Homo sapiens
gcucuauuaucaugguagu

SEQ ID NO: 83215 - RNA, 19 nt, Homo sapiens
gggcaagaucucauuucaa

SEQ ID NO: 83216 - RNA, 19 nt, Homo sapiens
gcagcagccaugucucuca

SEQ ID NO: 83217 - RNA, 19 nt, Homo sapiens
gcaguaguucuguggugaa

SEQ ID NO: 83218 - RNA, 19 nt, Homo sapiens
aaagcaagacugugguuuc

SEQ ID NO: 83219 - RNA, 19 nt, Homo sapiens
gaaauggaaucgccaaaua

SEQ ID NO: 83220 - RNA, 19 nt, Homo sapiens
gaauguaacuuuccaugua

SEQ ID NO: 83221 - RNA, 19 nt, Homo sapiens
aaacguaacucaaccagua

SEQ ID NO: 83222 - RNA, 19 nt, Homo sapiens
acacagauaugcacuuaua

SEQ ID NO: 83223 - RNA, 19 nt, Homo sapiens
caacauguauugugcugua

SEQ ID NO: 83224 - RNA, 19 nt, Homo sapiens
gaagacaacagcauaacua

SEQ ID NO: 83225 - RNA, 19 nt, Homo sapiens
guaaauauguacacaagug

SEQ ID NO: 83226 - RNA, 19 nt, Homo sapiens
gaagaaauacccacuaaca

SEQ ID NO: 83227 - RNA, 19 nt, Homo sapiens
ccaugaaguucuuucuuua

SEQ ID NO: 83228 - RNA, 19 nt, Homo sapiens
caagcaaugugccuuuaaa

SEQ ID NO: 83229 - RNA, 19 nt, Homo sapiens
agacacagauaugcacuua

SEQ ID NO: 83230 - RNA, 19 nt, Homo sapiens
aagaagaaauacccacuaa

SEQ ID NO: 83231 - RNA, 19 nt, Homo sapiens
gaaguucuuucuuuaugug

SEQ ID NO: 83232 - RNA, 19 nt, Homo sapiens
caucugauuucucauuuga

SEQ ID NO: 83233 - RNA, 19 nt, Homo sapiens
gaaccaacuccaauugauu

SEQ ID NO: 83234 - RNA, 19 nt, Homo sapiens
gacaacagcauaacuaaau

SEQ ID NO: 83235 - RNA, 19 nt, Homo sapiens
caacagccaucgaggacuu

SEQ ID NO: 83236 - RNA, 19 nt, Homo sapiens
caaagaacaagcauuaguu

SEQ ID NO: 83237 - RNA, 19 nt, Homo sapiens
uaaaagagguccuauggaa

SEQ ID NO: 83238 - RNA, 19 nt, Homo sapiens
agaaauacccacuaacaaa

SEQ ID NO: 83239 - RNA, 19 nt, Homo sapiens
guauugugcuguauaugaa

SEQ ID NO: 83240 - RNA, 19 nt, Homo sapiens
ucagagcuuucucaucuuu

SEQ ID NO: 83241 - RNA, 19 nt, Homo sapiens
gaaauacccacuaacaaag

SEQ ID NO: 83242 - RNA, 19 nt, Homo sapiens
gaagaugaguaugaaaugg

SEQ ID NO: 83243 - RNA, 19 nt, Homo sapiens
caacuuaacaucaucagau

SEQ ID NO: 83244 - RNA, 19 nt, Homo sapiens
gcacugcuuugguuucauc

SEQ ID NO: 83245 - RNA, 19 nt, Homo sapiens
gcagcugcuuuaagaagaa

SEQ ID NO: 83246 - RNA, 19 nt, Homo sapiens
gaugaagacaacagcauaa

SEQ ID NO: 83247 - RNA, 19 nt, Homo sapiens
gaaguccaaugcaugauac

SEQ ID NO: 83248 - RNA, 19 nt, Homo sapiens
cagguagccucacuaucua

SEQ ID NO: 83249 - RNA, 19 nt, Homo sapiens
aagcagcggucauucaaga

SEQ ID NO: 83250 - RNA, 19 nt, Homo sapiens
uaacuugugcauugacuaa

SEQ ID NO: 83251 - RNA, 19 nt, Homo sapiens
uaacagaagaugaagacaa

SEQ ID NO: 83252 - RNA, 19 nt, Homo sapiens
gcaugauaccagagcauua

SEQ ID NO: 83253 - RNA, 19 nt, Homo sapiens
cugaugauguagauacuuu

SEQ ID NO: 83254 - RNA, 19 nt, Homo sapiens
ggaaauguaacuugaagca

SEQ ID NO: 83255 - RNA, 19 nt, Homo sapiens
gccaucugauuucucauuu

SEQ ID NO: 83256 - RNA, 19 nt, Homo sapiens
aaagccaucugauuucuca

SEQ ID NO: 83257 - RNA, 19 nt, Homo sapiens
gcacuuauacccauaccau

SEQ ID NO: 83258 - RNA, 19 nt, Homo sapiens
cagaugaagaugaguauga

SEQ ID NO: 83259 - RNA, 19 nt, Homo sapiens
accaugaaguucuuucuuu

SEQ ID NO: 83260 - RNA, 19 nt, Homo sapiens
ucagguagccucacuaucu

SEQ ID NO: 83261 - RNA, 19 nt, Homo sapiens
auucagagcuuucucaucu

SEQ ID NO: 83262 - RNA, 19 nt, Homo sapiens
gaaaaugaucuuccacaaa

SEQ ID NO: 83263 - RNA, 19 nt, Homo sapiens
caucgaggacuuauaaugu

SEQ ID NO: 83264 - RNA, 19 nt, Homo sapiens
cauguauugugcuguauau

SEQ ID NO: 83265 - RNA, 19 nt, Homo sapiens
uagcaguaauuacaacaug

SEQ ID NO: 83266 - RNA, 19 nt, Homo sapiens
ugaaguccaaugcaugaua

SEQ ID NO: 83267 - RNA, 19 nt, Homo sapiens
uuacugauaccaugaaguu

SEQ ID NO: 83268 - RNA, 19 nt, Homo sapiens
gacagaaccaacuccaauu

SEQ ID NO: 83269 - RNA, 19 nt, Homo sapiens
acacuaacuugugcauuga

SEQ ID NO: 83270 - RNA, 19 nt, Homo sapiens
uaagaagaaauacccacua

SEQ ID NO: 83271 - RNA, 19 nt, Homo sapiens
uauaugguguuguguaugg

SEQ ID NO: 83272 - RNA, 19 nt, Homo sapiens
guaacucaaccaguauaua

SEQ ID NO: 83273 - RNA, 19 nt, Homo sapiens
cgccaaauauuacugauac

SEQ ID NO: 83274 - RNA, 19 nt, Homo sapiens
guaugggaauguaacuuuc

SEQ ID NO: 83275 - RNA, 19 nt, Homo sapiens
acuuauacccauaccauua

SEQ ID NO: 83276 - RNA, 19 nt, Homo sapiens
auaauguacucaugggauu

SEQ ID NO: 83277 - RNA, 19 nt, Homo sapiens
gaacaagcauuaguuuugg

SEQ ID NO: 83278 - RNA, 19 nt, Homo sapiens
agaaccaacuccaauugau

SEQ ID NO: 83279 - RNA, 19 nt, Homo sapiens
ccaagcagcggucauucaa

SEQ ID NO: 83280 - RNA, 19 nt, Homo sapiens
agaugaagaugaguaugaa

SEQ ID NO: 83281 - RNA, 19 nt, Homo sapiens
ggacuuauaauguacucau

SEQ ID NO: 83282 - RNA, 19 nt, Homo sapiens
agacagaaccaacuccaau

SEQ ID NO: 83283 - RNA, 19 nt, Homo sapiens
ccaagcaaugugccuuuaa

SEQ ID NO: 83284 - RNA, 19 nt, Homo sapiens
gcaauguaaacguaacuca

SEQ ID NO: 83285 - RNA, 19 nt, Homo sapiens
cugcugcacugcuuugguu

SEQ ID NO: 83286 - RNA, 19 nt, Homo sapiens
cagaaccaacuccaauuga

SEQ ID NO: 83287 - RNA, 19 nt, Homo sapiens
uguauugugcuguauauga

SEQ ID NO: 83288 - RNA, 19 nt, Homo sapiens
agaugaguaugaaauggaa

SEQ ID NO: 83289 - RNA, 19 nt, Homo sapiens
aucgaggacuuauaaugua

SEQ ID NO: 83290 - RNA, 19 nt, Homo sapiens
gcuugagucucuuccaucu

SEQ ID NO: 83291 - RNA, 19 nt, Homo sapiens
ugaagaugaguaugaaaug

SEQ ID NO: 83292 - RNA, 19 nt, Homo sapiens
uguaugggaauguaacuuu

SEQ ID NO: 83293 - RNA, 19 nt, Homo sapiens
cucacuaucuacaacuuaa

SEQ ID NO: 83294 - RNA, 19 nt, Homo sapiens
augacuaggugcuugcuuu

SEQ ID NO: 83295 - RNA, 19 nt, Homo sapiens
uguuggaaauguaacuuga

SEQ ID NO: 83296 - RNA, 19 nt, Homo sapiens
caauguaaacguaacucaa

SEQ ID NO: 83297 - RNA, 19 nt, Homo sapiens
aauggaaucgccaaauauu

SEQ ID NO: 83298 - RNA, 19 nt, Homo sapiens
aaauggaaucgccaaauau

SEQ ID NO: 83299 - RNA, 19 nt, Homo sapiens
acaaagaacaagcauuagu

SEQ ID NO: 83300 - RNA, 19 nt, Homo sapiens
agaugaagacaacagcaua

SEQ ID NO: 83301 - RNA, 19 nt, Homo sapiens
ggagcaauguaaacguaac

SEQ ID NO: 83302 - RNA, 19 nt, Homo sapiens
ccaucugauuucucauuug

SEQ ID NO: 83303 - RNA, 19 nt, Homo sapiens
agacaacagcauaacuaaa

SEQ ID NO: 83304 - RNA, 19 nt, Homo sapiens
aacagaagaugaagacaac

SEQ ID NO: 83305 - RNA, 19 nt, Homo sapiens
acagaaccaacuccaauug

SEQ ID NO: 83306 - RNA, 19 nt, Homo sapiens
cccauaccauuagcaguaa

SEQ ID NO: 83307 - RNA, 19 nt, Homo sapiens
uugcagaacuggaaaauuc

SEQ ID NO: 83308 - RNA, 19 nt, Homo sapiens
auggagcaauguaaacgua

SEQ ID NO: 83309 - RNA, 19 nt, Homo sapiens
gaugaagaugaguaugaaa

SEQ ID NO: 83310 - RNA, 19 nt, Homo sapiens
uggcugucaucaacuuauu

SEQ ID NO: 83311 - RNA, 19 nt, Homo sapiens
aauacccacuaacaaagaa

SEQ ID NO: 83312 - RNA, 19 nt, Homo sapiens
aagaaauacccacuaacaa

SEQ ID NO: 83313 - RNA, 19 nt, Homo sapiens
acccauaccauuagcagua

SEQ ID NO: 83314 - RNA, 19 nt, Homo sapiens
acaguguacucuuagcaau

SEQ ID NO: 83315 - RNA, 19 nt, Homo sapiens
gacuuauaauguacucaug

SEQ ID NO: 83316 - RNA, 19 nt, Homo sapiens
gcugucaucaacuuauuau

SEQ ID NO: 83317 - RNA, 19 nt, Homo sapiens
aagacaacagcauaacuaa

SEQ ID NO: 83318 - RNA, 19 nt, Homo sapiens
ggguuuauuuagacacugu

SEQ ID NO: 83319 - RNA, 19 nt, Homo sapiens
ggaggaauuucuugauuaa

SEQ ID NO: 83320 - RNA, 19 nt, Homo sapiens
gaucuuggcuguauuuaau

SEQ ID NO: 83321 - RNA, 19 nt, Homo sapiens
gcaagaaggaccuguguaa

SEQ ID NO: 83322 - RNA, 19 nt, Homo sapiens
gguaggauaucuuggcuuu

SEQ ID NO: 83323 - RNA, 19 nt, Homo sapiens
auacaucaaugguguguua

SEQ ID NO: 83324 - RNA, 19 nt, Homo sapiens
ggaagaagucuaagaguga

SEQ ID NO: 83325 - RNA, 19 nt, Homo sapiens
gaaaggcaguucagguaug

SEQ ID NO: 83326 - RNA, 19 nt, Homo sapiens
ucaguuagcaucauuagua

SEQ ID NO: 83327 - RNA, 19 nt, Homo sapiens
gguagcaacugaaagaaga

SEQ ID NO: 83328 - RNA, 19 nt, Homo sapiens
gaagaagucuaagagugaa

SEQ ID NO: 83329 - RNA, 19 nt, Homo sapiens
uggaggaauuucuugauua

SEQ ID NO: 83330 - RNA, 19 nt, Homo sapiens
ggacauccuuaucagagaa

SEQ ID NO: 83331 - RNA, 19 nt, Homo sapiens
ucagguauguguguauaua

SEQ ID NO: 83332 - RNA, 19 nt, Homo sapiens
ggacaaaccgagugcaaug

SEQ ID NO: 83333 - RNA, 19 nt, Homo sapiens
aaaaugagcuaacguacua

SEQ ID NO: 83334 - RNA, 19 nt, Homo sapiens
guaauagcauacaucaaug

SEQ ID NO: 83335 - RNA, 19 nt, Homo sapiens
ggaaaaguguaauagcaua

SEQ ID NO: 83336 - RNA, 19 nt, Homo sapiens
ggaacgcuuucauaaacuu

SEQ ID NO: 83337 - RNA, 19 nt, Homo sapiens
ugaacuagauugcaugcuu

SEQ ID NO: 83338 - RNA, 19 nt, Homo sapiens
uaccaaagcuggguuacaa

SEQ ID NO: 83339 - RNA, 19 nt, Homo sapiens
gggacacccuuugugguua

SEQ ID NO: 83340 - RNA, 19 nt, Homo sapiens
gaaggaagaagucuaagag

SEQ ID NO: 83341 - RNA, 19 nt, Homo sapiens
ggaaugguaggauaucuug

SEQ ID NO: 83342 - RNA, 19 nt, Homo sapiens
guagucaguuagcaucauu

SEQ ID NO: 83343 - RNA, 19 nt, Homo sapiens
guuggaaguuugagcauug

SEQ ID NO: 83344 - RNA, 19 nt, Homo sapiens
uagaaaggcaguucaggua

SEQ ID NO: 83345 - RNA, 19 nt, Homo sapiens
guucagguauguguguaua

SEQ ID NO: 83346 - RNA, 19 nt, Homo sapiens
acacacaguuacagaguga

SEQ ID NO: 83347 - RNA, 19 nt, Homo sapiens
agaaggaccuguguaacuu

SEQ ID NO: 83348 - RNA, 19 nt, Homo sapiens
gaaggaccuguguaacuuu

SEQ ID NO: 83349 - RNA, 19 nt, Homo sapiens
gagcaaccuggcuaagaua

SEQ ID NO: 83350 - RNA, 19 nt, Homo sapiens
uuugaugcgugucucauua

SEQ ID NO: 83351 - RNA, 19 nt, Homo sapiens
gaagaccaguccuguuugc

SEQ ID NO: 83352 - RNA, 19 nt, Homo sapiens
gcagauggaggaauuucuu

SEQ ID NO: 83353 - RNA, 19 nt, Homo sapiens
uauaugggcuuuguuaucu

SEQ ID NO: 83354 - RNA, 19 nt, Homo sapiens
acaacaagauccuuaaugc

SEQ ID NO: 83355 - RNA, 19 nt, Homo sapiens
ugccaaauguuccauaugu

SEQ ID NO: 83356 - RNA, 19 nt, Homo sapiens
cauccucucucacauggaa

SEQ ID NO: 83357 - RNA, 19 nt, Homo sapiens
ugagcaaccuggcuaagau

SEQ ID NO: 83358 - RNA, 19 nt, Homo sapiens
ggauaugcaguaugcuuaa

SEQ ID NO: 83359 - RNA, 19 nt, Homo sapiens
ccuuggauguagucaguua

SEQ ID NO: 83360 - RNA, 19 nt, Homo sapiens
gcauccagccuccugcuaa

SEQ ID NO: 83361 - RNA, 19 nt, Homo sapiens
gguuacaguuugagacuuc

SEQ ID NO: 83362 - RNA, 19 nt, Homo sapiens
gauccuuaaugcagagcua

SEQ ID NO: 83363 - RNA, 19 nt, Homo sapiens
aaggaccuguguaacuuua

SEQ ID NO: 83364 - RNA, 19 nt, Homo sapiens
gaaacuugcuuaucaaaac

SEQ ID NO: 83365 - RNA, 19 nt, Homo sapiens
cuucagggaucccguguug

SEQ ID NO: 83366 - RNA, 19 nt, Homo sapiens
ggugugacuugaacuagau

SEQ ID NO: 83367 - RNA, 19 nt, Homo sapiens
gcaaaacagccgucaauug

SEQ ID NO: 83368 - RNA, 19 nt, Homo sapiens
caaaccgagugcaaugaau

SEQ ID NO: 83369 - RNA, 19 nt, Homo sapiens
ugacucagcauagauugua

SEQ ID NO: 83370 - RNA, 19 nt, Homo sapiens
ugaacacucuacuacaugu

SEQ ID NO: 83371 - RNA, 19 nt, Homo sapiens
cagguucuguggacaauca

SEQ ID NO: 83372 - RNA, 19 nt, Homo sapiens
gacaacaagauccuuaaug

SEQ ID NO: 83373 - RNA, 19 nt, Homo sapiens
ggacaacaagauccuuaau

SEQ ID NO: 83374 - RNA, 19 nt, Homo sapiens
gucaauuguucaucugauu

SEQ ID NO: 83375 - RNA, 19 nt, Homo sapiens
gggacauccuuaucagaga

SEQ ID NO: 83376 - RNA, 19 nt, Homo sapiens
caaaacagccgucaauugu

SEQ ID NO: 83377 - RNA, 19 nt, Homo sapiens
aaagcuggguuacaagugu

SEQ ID NO: 83378 - RNA, 19 nt, Homo sapiens
gcuuaaugguagcaacuga

SEQ ID NO: 83379 - RNA, 19 nt, Homo sapiens
gauaugcaguaugcuuaau

SEQ ID NO: 83380 - RNA, 19 nt, Homo sapiens
ccagauagcagggcaugaa

SEQ ID NO: 83381 - RNA, 19 nt, Homo sapiens
ggaggcaugccaaauguuc

SEQ ID NO: 83382 - RNA, 19 nt, Homo sapiens
cauggaacgcuuucauaaa

SEQ ID NO: 83383 - RNA, 19 nt, Homo sapiens
caucauuaguacaucuuug

SEQ ID NO: 83384 - RNA, 19 nt, Homo sapiens
acaacccgcuugagggaaa

SEQ ID NO: 83385 - RNA, 19 nt, Homo sapiens
ggacacccuuugugguuac

SEQ ID NO: 83386 - RNA, 19 nt, Homo sapiens
gguauguguguauauagua

SEQ ID NO: 83387 - RNA, 19 nt, Homo sapiens
uuauuggaaugguaggaua

SEQ ID NO: 83388 - RNA, 19 nt, Homo sapiens
caaccuggcuaagauagag

SEQ ID NO: 83389 - RNA, 19 nt, Homo sapiens
ccugagcagugccagcuuu

SEQ ID NO: 83390 - RNA, 19 nt, Homo sapiens
uauaacaagugggugaaug

SEQ ID NO: 83391 - RNA, 19 nt, Homo sapiens
uuuaugaucuuggcuguau

SEQ ID NO: 83392 - RNA, 19 nt, Homo sapiens
caucaaugguguguuaaag

SEQ ID NO: 83393 - RNA, 19 nt, Homo sapiens
acauggaacgcuuucauaa

SEQ ID NO: 83394 - RNA, 19 nt, Homo sapiens
gaccagcuuugcagugaca

SEQ ID NO: 83395 - RNA, 19 nt, Homo sapiens
acaaguguauaacaagugu

SEQ ID NO: 83396 - RNA, 19 nt, Homo sapiens
gcuggugacuccauuucug

SEQ ID NO: 83397 - RNA, 19 nt, Homo sapiens
gagcauccucucucacaug

SEQ ID NO: 83398 - RNA, 19 nt, Homo sapiens
gagcagugccagcuuucuu

SEQ ID NO: 83399 - RNA, 19 nt, Homo sapiens
caugccaaauguuccauau

SEQ ID NO: 83400 - RNA, 19 nt, Homo sapiens
cacauggaacgcuuucaua

SEQ ID NO: 83401 - RNA, 19 nt, Homo sapiens
gaaguuugagcauugcaau

SEQ ID NO: 83402 - RNA, 19 nt, Homo sapiens
cugcagcccucagauuauu

SEQ ID NO: 83403 - RNA, 19 nt, Homo sapiens
aagaccagcuuugcaguga

SEQ ID NO: 83404 - RNA, 19 nt, Homo sapiens
guaggugugacuugaacua

SEQ ID NO: 83405 - RNA, 19 nt, Homo sapiens
uugaagaccaguccuguuu

SEQ ID NO: 83406 - RNA, 19 nt, Homo sapiens
gauacacaccuuucacaag

SEQ ID NO: 83407 - RNA, 19 nt, Homo sapiens
ucaaugguguguuaaagcu

SEQ ID NO: 83408 - RNA, 19 nt, Homo sapiens
ggaccuguguaacuuuaac

SEQ ID NO: 83409 - RNA, 19 nt, Homo sapiens
uaacggcucuuagcacacu

SEQ ID NO: 83410 - RNA, 19 nt, Homo sapiens
aaaggcaguucagguaugu

SEQ ID NO: 83411 - RNA, 19 nt, Homo sapiens
augcagagcuagaggacuu

SEQ ID NO: 83412 - RNA, 19 nt, Homo sapiens
caacaagauccuuaaugca

SEQ ID NO: 83413 - RNA, 19 nt, Homo sapiens
gggacaacaagauccuuaa

SEQ ID NO: 83414 - RNA, 19 nt, Homo sapiens
gccaaauguuccauaugug

SEQ ID NO: 83415 - RNA, 19 nt, Homo sapiens
gaagucuaagagugaagua

SEQ ID NO: 83416 - RNA, 19 nt, Homo sapiens
cacagauguuugaggcuuu

SEQ ID NO: 83417 - RNA, 19 nt, Homo sapiens
caacuguccuaacccaacu

SEQ ID NO: 83418 - RNA, 19 nt, Homo sapiens
ugaaggaagaagucuaaga

SEQ ID NO: 83419 - RNA, 19 nt, Homo sapiens
gagauaaggugaugucaga

SEQ ID NO: 83420 - RNA, 19 nt, Homo sapiens
ggcagcagauggagaauua

SEQ ID NO: 83421 - RNA, 19 nt, Homo sapiens
aaggagaacuauugucuua

SEQ ID NO: 83422 - RNA, 19 nt, Homo sapiens
ggagaacuauugucuuaug

SEQ ID NO: 83423 - RNA, 19 nt, Homo sapiens
gaacuauugucuuaugauc

SEQ ID NO: 83424 - RNA, 19 nt, Homo sapiens
gaucacguuugccaucuuu

SEQ ID NO: 83425 - RNA, 19 nt, Homo sapiens
ggauuaauuucaacgagaa

SEQ ID NO: 83426 - RNA, 19 nt, Homo sapiens
ggaaugaaaugugugaagu

SEQ ID NO: 83427 - RNA, 19 nt, Homo sapiens
gagaacuauugucuuauga

SEQ ID NO: 83428 - RNA, 19 nt, Homo sapiens
cuacacagauugggagaaa

SEQ ID NO: 83429 - RNA, 19 nt, Homo sapiens
ugaaaugugugaaguucuu

SEQ ID NO: 83430 - RNA, 19 nt, Homo sapiens
gauggagaauuacccgaaa

SEQ ID NO: 83431 - RNA, 19 nt, Homo sapiens
ggcuauguguuuagagaua

SEQ ID NO: 83432 - RNA, 19 nt, Homo sapiens
gcugcuaacuacacagauu

SEQ ID NO: 83433 - RNA, 19 nt, Homo sapiens
agaaggcgauccauaagga

SEQ ID NO: 83434 - RNA, 19 nt, Homo sapiens
gcugugggauuaauuucaa

SEQ ID NO: 83435 - RNA, 19 nt, Homo sapiens
gcaaggagaacuauugucu

SEQ ID NO: 83436 - RNA, 19 nt, Homo sapiens
gcuauguguuuagagauaa

SEQ ID NO: 83437 - RNA, 19 nt, Homo sapiens
gaaugaaaugugugaaguu

SEQ ID NO: 83438 - RNA, 19 nt, Homo sapiens
aauaguauccuccagguuu

SEQ ID NO: 83439 - RNA, 19 nt, Homo sapiens
gaaggaggaaugaaaugug

SEQ ID NO: 83440 - RNA, 19 nt, Homo sapiens
ggaggaaugaaauguguga

SEQ ID NO: 83441 - RNA, 19 nt, Homo sapiens
acugugggcugugggauua

SEQ ID NO: 83442 - RNA, 19 nt, Homo sapiens
ggaaggaggaaugaaaugu

SEQ ID NO: 83443 - RNA, 19 nt, Homo sapiens
aaggugaugucagaguuua

SEQ ID NO: 83444 - RNA, 19 nt, Homo sapiens
gguggaaggaggaaugaaa

SEQ ID NO: 83445 - RNA, 19 nt, Homo sapiens
gagaaaaucccuuccaugu

SEQ ID NO: 83446 - RNA, 19 nt, Homo sapiens
acgagaaggcgauccauaa

SEQ ID NO: 83447 - RNA, 19 nt, Homo sapiens
gcagcagcccuuggaauug

SEQ ID NO: 83448 - RNA, 19 nt, Homo sapiens
aaugaaaugugugaaguuc

SEQ ID NO: 83449 - RNA, 19 nt, Homo sapiens
aaggaggaaugaaaugugu

SEQ ID NO: 83450 - RNA, 19 nt, Homo sapiens
gugaagaguaucagaagug

SEQ ID NO: 83451 - RNA, 19 nt, Homo sapiens
cccgacuccugcugcauua

SEQ ID NO: 83452 - RNA, 19 nt, Homo sapiens
auaaggugaugucagaguu

SEQ ID NO: 83453 - RNA, 19 nt, Homo sapiens
gugugaaguucuugcucua

SEQ ID NO: 83454 - RNA, 19 nt, Homo sapiens
gauaaggugaugucagagu

SEQ ID NO: 83455 - RNA, 19 nt, Homo sapiens
guuuagagauaaggugaug

SEQ ID NO: 83456 - RNA, 19 nt, Homo sapiens
gaauaguauccuccagguu

SEQ ID NO: 83457 - RNA, 19 nt, Homo sapiens
uaaggugaugucagaguuu

SEQ ID NO: 83458 - RNA, 19 nt, Homo sapiens
ggagggcuguguggagaag

SEQ ID NO: 83459 - RNA, 19 nt, Homo sapiens
gaaaugugugaaguucuug

SEQ ID NO: 83460 - RNA, 19 nt, Homo sapiens
ccaucuuucugucucuuau

SEQ ID NO: 83461 - RNA, 19 nt, Homo sapiens
caaggagaacuauugucuu

SEQ ID NO: 83462 - RNA, 19 nt, Homo sapiens
cagcagcccuuggaauugc

SEQ ID NO: 83463 - RNA, 19 nt, Homo sapiens
gagaaggcgauccauaagg

SEQ ID NO: 83464 - RNA, 19 nt, Homo sapiens
acaggaugcaggcagauuu

SEQ ID NO: 83465 - RNA, 19 nt, Homo sapiens
gacuccugcugcauuaaug

SEQ ID NO: 83466 - RNA, 19 nt, Homo sapiens
gaugucagaguuuaauaac

SEQ ID NO: 83467 - RNA, 19 nt, Homo sapiens
ugcagcagcccuuggaauu

SEQ ID NO: 83468 - RNA, 19 nt, Homo sapiens
cgagaaggcgauccauaag

SEQ ID NO: 83469 - RNA, 19 nt, Homo sapiens
gugaugucagaguuuaaua

SEQ ID NO: 83470 - RNA, 19 nt, Homo sapiens
ccugcaaggagaacuauug

SEQ ID NO: 83471 - RNA, 19 nt, Homo sapiens
guggaaggaggaaugaaau

SEQ ID NO: 83472 - RNA, 19 nt, Homo sapiens
gggcugcuaacuacacaga

SEQ ID NO: 83473 - RNA, 19 nt, Homo sapiens
ggugaugucagaguuuaau

SEQ ID NO: 83474 - RNA, 19 nt, Homo sapiens
cuggcuauguguuuagaga

SEQ ID NO: 83475 - RNA, 19 nt, Homo sapiens
cgacuccugcugcauuaau

SEQ ID NO: 83476 - RNA, 19 nt, Homo sapiens
cgugaagaguaucagaagu

SEQ ID NO: 83477 - RNA, 19 nt, Homo sapiens
gacaggaugcaggcagauu

SEQ ID NO: 83478 - RNA, 19 nt, Homo sapiens
gccaucuuucugucucuua

SEQ ID NO: 83479 - RNA, 19 nt, Homo sapiens
gaagggagggagagaauuu

SEQ ID NO: 83480 - RNA, 19 nt, Homo sapiens
gaaugacuguccucacaaa

SEQ ID NO: 83481 - RNA, 19 nt, Homo sapiens
uaaacacugucucuacuaa

SEQ ID NO: 83482 - RNA, 19 nt, Homo sapiens
gggcagagcuucaguugca

SEQ ID NO: 83483 - RNA, 19 nt, Homo sapiens
gcucaaagacaauguuauu

SEQ ID NO: 83484 - RNA, 19 nt, Homo sapiens
gggaaugacuguccucaca

SEQ ID NO: 83485 - RNA, 19 nt, Homo sapiens
gggcaucucuguacugaac

SEQ ID NO: 83486 - RNA, 19 nt, Homo sapiens
gcagcaaaguggacauucu

SEQ ID NO: 83487 - RNA, 19 nt, Homo sapiens
guaaacacugucucuacua

SEQ ID NO: 83488 - RNA, 19 nt, Homo sapiens
cuacuuugcugccauccuu

SEQ ID NO: 83489 - RNA, 19 nt, Homo sapiens
guucauccaacaagcaaua

SEQ ID NO: 83490 - RNA, 19 nt, Homo sapiens
gagaagggagggagagaau

SEQ ID NO: 83491 - RNA, 19 nt, Homo sapiens
ugacggcucaugccuguaa

SEQ ID NO: 83492 - RNA, 19 nt, Homo sapiens
gaaugcaucccuucgagau

SEQ ID NO: 83493 - RNA, 19 nt, Homo sapiens
guacugaaccccaacaaaa

SEQ ID NO: 83494 - RNA, 19 nt, Homo sapiens
uauuaaaugugacgaacug

SEQ ID NO: 83495 - RNA, 19 nt, Homo sapiens
gauuaaaaguccaugaguu

SEQ ID NO: 83496 - RNA, 19 nt, Homo sapiens
caggagagcagcaaaauuu

SEQ ID NO: 83497 - RNA, 19 nt, Homo sapiens
caccucagcuuuggauuca

SEQ ID NO: 83498 - RNA, 19 nt, Homo sapiens
ggaaugacuguccucacaa

SEQ ID NO: 83499 - RNA, 19 nt, Homo sapiens
ggacaccucagcuuuggau

SEQ ID NO: 83500 - RNA, 19 nt, Homo sapiens
ggagaccauuggagacuac

SEQ ID NO: 83501 - RNA, 19 nt, Homo sapiens
gacuacacguggaccaaug

SEQ ID NO: 83502 - RNA, 19 nt, Homo sapiens
ggaaaugccacgguucauc

SEQ ID NO: 83503 - RNA, 19 nt, Homo sapiens
cgucacaguucauccaaca

SEQ ID NO: 83504 - RNA, 19 nt, Homo sapiens
ugcaggaccuccagcagaa

SEQ ID NO: 83505 - RNA, 19 nt, Homo sapiens
ccucagcuuuggauucaug

SEQ ID NO: 83506 - RNA, 19 nt, Homo sapiens
gcccaggauucaccaguuc

SEQ ID NO: 83507 - RNA, 19 nt, Homo sapiens
gaaguggagguugcaguga

SEQ ID NO: 83508 - RNA, 19 nt, Homo sapiens
acacgccgcuggcucaaag

SEQ ID NO: 83509 - RNA, 19 nt, Homo sapiens
cagcaacucgagcaucauu

SEQ ID NO: 83510 - RNA, 19 nt, Homo sapiens
ccaccugcuucucucauuc

SEQ ID NO: 83511 - RNA, 19 nt, Homo sapiens
ggagaagggagggagagaa

SEQ ID NO: 83512 - RNA, 19 nt, Homo sapiens
cacuggaggucaggucuuu

SEQ ID NO: 83513 - RNA, 19 nt, Homo sapiens
gccgcuggcucaaagacaa

SEQ ID NO: 83514 - RNA, 19 nt, Homo sapiens
ggccagcccuagccaacau

SEQ ID NO: 83515 - RNA, 19 nt, Homo sapiens
cauggaaacgucacaguuc

SEQ ID NO: 83516 - RNA, 19 nt, Homo sapiens
uagccaacaugguguaaac

SEQ ID NO: 83517 - RNA, 19 nt, Homo sapiens
ccuguaaucccagcacuuu

SEQ ID NO: 83518 - RNA, 19 nt, Homo sapiens
acauggcgguggaguacaa

SEQ ID NO: 83519 - RNA, 19 nt, Homo sapiens
acagagagcacuggaacaa

SEQ ID NO: 83520 - RNA, 19 nt, Homo sapiens
ggaaacgucacaguucauc

SEQ ID NO: 83521 - RNA, 19 nt, Homo sapiens
uguaaacacugucucuacu

SEQ ID NO: 83522 - RNA, 19 nt, Homo sapiens
gcaacucgagcaucauucu

SEQ ID NO: 83523 - RNA, 19 nt, Homo sapiens
gauaaugcagucgggagaa

SEQ ID NO: 83524 - RNA, 19 nt, Homo sapiens
gcgguggaguacaaugugu

SEQ ID NO: 83525 - RNA, 19 nt, Homo sapiens
ccauggaaacgucacaguu

SEQ ID NO: 83526 - RNA, 19 nt, Homo sapiens
ccagugaccgguccaucuu

SEQ ID NO: 83527 - RNA, 19 nt, Homo sapiens
ugcagcaacucgagcauca

SEQ ID NO: 83528 - RNA, 19 nt, Homo sapiens
aaacacugucucuacuaaa

SEQ ID NO: 83529 - RNA, 19 nt, Homo sapiens
gauucagauucgagucaug

SEQ ID NO: 83530 - RNA, 19 nt, Homo sapiens
ggagggagagaauuuuauu

SEQ ID NO: 83531 - RNA, 19 nt, Homo sapiens
ugacacccacgguuacaga

SEQ ID NO: 83532 - RNA, 19 nt, Homo sapiens
uaaccuguaaucccagcua

SEQ ID NO: 83533 - RNA, 19 nt, Homo sapiens
gcuacauggcgguggagua

SEQ ID NO: 83534 - RNA, 19 nt, Homo sapiens
cggcguaaucccaugcuaa

SEQ ID NO: 83535 - RNA, 19 nt, Homo sapiens
cccuggugcuuauugcuuu

SEQ ID NO: 83536 - RNA, 19 nt, Homo sapiens
ccacgacugccacucacaa

SEQ ID NO: 83537 - RNA, 19 nt, Homo sapiens
acaaccagccacaggacua

SEQ ID NO: 83538 - RNA, 19 nt, Homo sapiens
cuauggacaccucagcuuu

SEQ ID NO: 83539 - RNA, 19 nt, Homo sapiens
gagggagagaauuuuauua

SEQ ID NO: 83540 - RNA, 19 nt, Homo sapiens
uggcucaaagacaauguua

SEQ ID NO: 83541 - RNA, 19 nt, Homo sapiens
cuuauugcuuucugcauca

SEQ ID NO: 83542 - RNA, 19 nt, Homo sapiens
uauggacaccucagcuuug

SEQ ID NO: 83543 - RNA, 19 nt, Homo sapiens
gcggcguaaucccaugcua

SEQ ID NO: 83544 - RNA, 19 nt, Homo sapiens
ucacaguucauccaacaag

SEQ ID NO: 83545 - RNA, 19 nt, Homo sapiens
acucgagcaucauucuuuc

SEQ ID NO: 83546 - RNA, 19 nt, Homo sapiens
gacccacgacugccacuca

SEQ ID NO: 83547 - RNA, 19 nt, Homo sapiens
caccacuagucauggaaau

SEQ ID NO: 83548 - RNA, 19 nt, Homo sapiens
gagcagcaaaauuuaugua

SEQ ID NO: 83549 - RNA, 19 nt, Homo sapiens
ggagagcagcaaaauuuau

SEQ ID NO: 83550 - RNA, 19 nt, Homo sapiens
ggacuaccaagagccacaa

SEQ ID NO: 83551 - RNA, 19 nt, Homo sapiens
caacucgagcaucauucuu

SEQ ID NO: 83552 - RNA, 19 nt, Homo sapiens
cagauucagauucgaguca

SEQ ID NO: 83553 - RNA, 19 nt, Homo sapiens
ccaccacuagucauggaaa

SEQ ID NO: 83554 - RNA, 19 nt, Homo sapiens
ggaaacauguucacuuauu

SEQ ID NO: 83555 - RNA, 19 nt, Homo sapiens
gcaaaucucuauuaggaaa

SEQ ID NO: 83556 - RNA, 19 nt, Homo sapiens
gaauaaagaugagcucuga

SEQ ID NO: 83557 - RNA, 19 nt, Homo sapiens
gaauggaacucaaggaaau

SEQ ID NO: 83558 - RNA, 19 nt, Homo sapiens
caucacagguugaccaaua

SEQ ID NO: 83559 - RNA, 19 nt, Homo sapiens
gcaaagaauuuaacaacug

SEQ ID NO: 83560 - RNA, 19 nt, Homo sapiens
uagggaaucuugagaauaa

SEQ ID NO: 83561 - RNA, 19 nt, Homo sapiens
gaaacauguucacuuauug

SEQ ID NO: 83562 - RNA, 19 nt, Homo sapiens
cagaggaaaugcuacuuua

SEQ ID NO: 83563 - RNA, 19 nt, Homo sapiens
cuucagaccuagaauaaua

SEQ ID NO: 83564 - RNA, 19 nt, Homo sapiens
aaggaaacauguucacuua

SEQ ID NO: 83565 - RNA, 19 nt, Homo sapiens
gcaaagacuaugaggaaua

SEQ ID NO: 83566 - RNA, 19 nt, Homo sapiens
gaaugacuaugcaaccuuu

SEQ ID NO: 83567 - RNA, 19 nt, Homo sapiens
ggcguggacuuacuauuua

SEQ ID NO: 83568 - RNA, 19 nt, Homo sapiens
caaagacuaugaggaauau

SEQ ID NO: 83569 - RNA, 19 nt, Homo sapiens
uggcaaaucucuauuagga

SEQ ID NO: 83570 - RNA, 19 nt, Homo sapiens
gaacauggugcuacucuug

SEQ ID NO: 83571 - RNA, 19 nt, Homo sapiens
gaggaaaugcuacuuuauu

SEQ ID NO: 83572 - RNA, 19 nt, Homo sapiens
caauaaccaugcccaagaa

SEQ ID NO: 83573 - RNA, 19 nt, Homo sapiens
uauagugucuugggaauuu

SEQ ID NO: 83574 - RNA, 19 nt, Homo sapiens
gacaaaugcuuaugaaacu

SEQ ID NO: 83575 - RNA, 19 nt, Homo sapiens
gaugguacauauuucuuug

SEQ ID NO: 83576 - RNA, 19 nt, Homo sapiens
cauguucacuuauugacua

SEQ ID NO: 83577 - RNA, 19 nt, Homo sapiens
gguacuagauacugaaugu

SEQ ID NO: 83578 - RNA, 19 nt, Homo sapiens
ugagagcccuucaugcauu

SEQ ID NO: 83579 - RNA, 19 nt, Homo sapiens
ugacuugaccugagauuaa

SEQ ID NO: 83580 - RNA, 19 nt, Homo sapiens
ggauauguaacaaaccuua

SEQ ID NO: 83581 - RNA, 19 nt, Homo sapiens
gaaaagacauaagcaaaga

SEQ ID NO: 83582 - RNA, 19 nt, Homo sapiens
agaaugggaugaucgugua

SEQ ID NO: 83583 - RNA, 19 nt, Homo sapiens
ggacaaaugcuuaugaaac

SEQ ID NO: 83584 - RNA, 19 nt, Homo sapiens
ggaguuagauguugguacu

SEQ ID NO: 83585 - RNA, 19 nt, Homo sapiens
ccauagagacuuugugaaa

SEQ ID NO: 83586 - RNA, 19 nt, Homo sapiens
ccaagaaugagaagaauga

SEQ ID NO: 83587 - RNA, 19 nt, Homo sapiens
gugcaauacuucaauacuu

SEQ ID NO: 83588 - RNA, 19 nt, Homo sapiens
ggucaaauggcaaagaauu

SEQ ID NO: 83589 - RNA, 19 nt, Homo sapiens
ggaugaucguguauuuauu

SEQ ID NO: 83590 - RNA, 19 nt, Homo sapiens
gggaugaucguguauuuau

SEQ ID NO: 83591 - RNA, 19 nt, Homo sapiens
gagagcccuucaugcauuu

SEQ ID NO: 83592 - RNA, 19 nt, Homo sapiens
gcuagaagcaucacagguu

SEQ ID NO: 83593 - RNA, 19 nt, Homo sapiens
caacaagagcuccagcaaa

SEQ ID NO: 83594 - RNA, 19 nt, Homo sapiens
ccauggaaguggucaaaug

SEQ ID NO: 83595 - RNA, 19 nt, Homo sapiens
gaaugacuaccaacaguga

SEQ ID NO: 83596 - RNA, 19 nt, Homo sapiens
uaaccaugcccaagaauga

SEQ ID NO: 83597 - RNA, 19 nt, Homo sapiens
ucaauucuauuacgugcaa

SEQ ID NO: 83598 - RNA, 19 nt, Homo sapiens
ccaaacagaacuauggaaa

SEQ ID NO: 83599 - RNA, 19 nt, Homo sapiens
ggacaugaacuuucuaaaa

SEQ ID NO: 83600 - RNA, 19 nt, Homo sapiens
aacaagagcuccagcaaag

SEQ ID NO: 83601 - RNA, 19 nt, Homo sapiens
ccaauaaccaugcccaaga

SEQ ID NO: 83602 - RNA, 19 nt, Homo sapiens
acacuggguuggacugaaa

SEQ ID NO: 83603 - RNA, 19 nt, Homo sapiens
ggaauauuugcaagacaua

SEQ ID NO: 83604 - RNA, 19 nt, Homo sapiens
ggaaugugagaagaauuua

SEQ ID NO: 83605 - RNA, 19 nt, Homo sapiens
ccaaguuccuguccugugu

SEQ ID NO: 83606 - RNA, 19 nt, Homo sapiens
aagcaaagacuaugaggaa

SEQ ID NO: 83607 - RNA, 19 nt, Homo sapiens
gaaguggucaaauggcaaa

SEQ ID NO: 83608 - RNA, 19 nt, Homo sapiens
gacuuucacuguagcuuga

SEQ ID NO: 83609 - RNA, 19 nt, Homo sapiens
uacagugucuuacagagaa

SEQ ID NO: 83610 - RNA, 19 nt, Homo sapiens
guaaacaaaggaauuaugg

SEQ ID NO: 83611 - RNA, 19 nt, Homo sapiens
agaaugagaagaaugacua

SEQ ID NO: 83612 - RNA, 19 nt, Homo sapiens
guuugugacuuuccuaaau

SEQ ID NO: 83613 - RNA, 19 nt, Homo sapiens
agacagccauguuucuuca

SEQ ID NO: 83614 - RNA, 19 nt, Homo sapiens
gaaaaugugcaauauguga

SEQ ID NO: 83615 - RNA, 19 nt, Homo sapiens
gaauuuaacaacugguuca

SEQ ID NO: 83616 - RNA, 19 nt, Homo sapiens
agacauaagcaaagacuau

SEQ ID NO: 83617 - RNA, 19 nt, Homo sapiens
gcacuacuggaaggaguua

SEQ ID NO: 83618 - RNA, 19 nt, Homo sapiens
gaugagcucugaaaauugu

SEQ ID NO: 83619 - RNA, 19 nt, Homo sapiens
uaaggaaacauguucacuu

SEQ ID NO: 83620 - RNA, 19 nt, Homo sapiens
uaacaacugguucaacguu

SEQ ID NO: 83621 - RNA, 19 nt, Homo sapiens
guggucaaauggcaaagaa

SEQ ID NO: 83622 - RNA, 19 nt, Homo sapiens
ccagaggaaaugcuacuuu

SEQ ID NO: 83623 - RNA, 19 nt, Homo sapiens
cuaauugaaucccuuaaac

SEQ ID NO: 83624 - RNA, 19 nt, Homo sapiens
aacaacugguucaacguua

SEQ ID NO: 83625 - RNA, 19 nt, Homo sapiens
ccaaaaugcuuguucugaa

SEQ ID NO: 83626 - RNA, 19 nt, Homo sapiens
uaugugauguggcaaaucu

SEQ ID NO: 83627 - RNA, 19 nt, Homo sapiens
gacauagaauaguguugga

SEQ ID NO: 83628 - RNA, 19 nt, Homo sapiens
acucagggagcauuuauaa

SEQ ID NO: 83629 - RNA, 19 nt, Homo sapiens
ggaauuauggcugguaaca

SEQ ID NO: 83630 - RNA, 19 nt, Homo sapiens
ggcaaagaauuuaacaacu

SEQ ID NO: 83631 - RNA, 19 nt, Homo sapiens
ucagugggccaauacaauu

SEQ ID NO: 83632 - RNA, 19 nt, Homo sapiens
aagaugagcucugaaaauu

SEQ ID NO: 83633 - RNA, 19 nt, Homo sapiens
ugagaagaaugacuaugca

SEQ ID NO: 83634 - RNA, 19 nt, Homo sapiens
gacaugaacuuucuaaaac

SEQ ID NO: 83635 - RNA, 19 nt, Homo sapiens
ugcaauacuucaauacuuc

SEQ ID NO: 83636 - RNA, 19 nt, Homo sapiens
gaauaguguuggaaaaugu

SEQ ID NO: 83637 - RNA, 19 nt, Homo sapiens
cauagaauaguguuggaaa

SEQ ID NO: 83638 - RNA, 19 nt, Homo sapiens
gagaaaagacauaagcaaa

SEQ ID NO: 83639 - RNA, 19 nt, Homo sapiens
uggaaugugagaagaauuu

SEQ ID NO: 83640 - RNA, 19 nt, Homo sapiens
ucagcagcauggaauguga

SEQ ID NO: 83641 - RNA, 19 nt, Homo sapiens
gaggaauauuugcaagaca

SEQ ID NO: 83642 - RNA, 19 nt, Homo sapiens
auaaagaugagcucugaaa

SEQ ID NO: 83643 - RNA, 19 nt, Homo sapiens
gaacacuggguuggacuga

SEQ ID NO: 83644 - RNA, 19 nt, Homo sapiens
uacgugcaauacuucaaua

SEQ ID NO: 83645 - RNA, 19 nt, Homo sapiens
ccugugugcuguaaugaau

SEQ ID NO: 83646 - RNA, 19 nt, Homo sapiens
gcaagacauagaauagugu

SEQ ID NO: 83647 - RNA, 19 nt, Homo sapiens
aggcguggacuuacuauuu

SEQ ID NO: 83648 - RNA, 19 nt, Homo sapiens
aaucugcacugugggcuuu

SEQ ID NO: 83649 - RNA, 19 nt, Homo sapiens
gcauggaaugugagaagaa

SEQ ID NO: 83650 - RNA, 19 nt, Homo sapiens
uacagggucugacaagugu

SEQ ID NO: 83651 - RNA, 19 nt, Homo sapiens
gcuacuuuauuucuacugu

SEQ ID NO: 83652 - RNA, 19 nt, Homo sapiens
gaaugagaagaaugacuau

SEQ ID NO: 83653 - RNA, 19 nt, Homo sapiens
gcccaagaaugagaagaau

SEQ ID NO: 83654 - RNA, 19 nt, Homo sapiens
ccaccaagguuguaccauu

SEQ ID NO: 83655 - RNA, 19 nt, Homo sapiens
gcaguuuccuuccuuccuu

SEQ ID NO: 83656 - RNA, 19 nt, Homo sapiens
caccaagguuguaccauug

SEQ ID NO: 83657 - RNA, 19 nt, Homo sapiens
gaccacugcugcugauuag

SEQ ID NO: 83658 - RNA, 19 nt, Homo sapiens
gagaaggcauugagcuuuu

SEQ ID NO: 83659 - RNA, 19 nt, Homo sapiens
ugaccacugcugcugauua

SEQ ID NO: 83660 - RNA, 19 nt, Homo sapiens
caaccucacugggacacuu

SEQ ID NO: 83661 - RNA, 19 nt, Homo sapiens
gcaucuacaugguacacau

SEQ ID NO: 83662 - RNA, 19 nt, Homo sapiens
gggcugcuuuggucccauu

SEQ ID NO: 83663 - RNA, 19 nt, Homo sapiens
gaaacacugaugagaccuu

SEQ ID NO: 83664 - RNA, 19 nt, Homo sapiens
ggacaagagaaggcauuga

SEQ ID NO: 83665 - RNA, 19 nt, Homo sapiens
gacaagagaaggcauugag

SEQ ID NO: 83666 - RNA, 19 nt, Homo sapiens
agagaaggcauugagcuuu

SEQ ID NO: 83667 - RNA, 19 nt, Homo sapiens
gggacacacucugcaccaa

SEQ ID NO: 83668 - RNA, 19 nt, Homo sapiens
gcagcuacguauccaucgu

SEQ ID NO: 83669 - RNA, 19 nt, Homo sapiens
ugaugagaccuucuuugga

SEQ ID NO: 83670 - RNA, 19 nt, Homo sapiens
acacugaugagaccuucuu

SEQ ID NO: 83671 - RNA, 19 nt, Homo sapiens
gaugacagcuuucagguuu

SEQ ID NO: 83672 - RNA, 19 nt, Homo sapiens
gaaguugacugaugauaca

SEQ ID NO: 83673 - RNA, 19 nt, Homo sapiens
uaaauucacuguugccaaa

SEQ ID NO: 83674 - RNA, 19 nt, Homo sapiens
gcucaaagcucaaaaugua

SEQ ID NO: 83675 - RNA, 19 nt, Homo sapiens
ggacuggccucagcucuaa

SEQ ID NO: 83676 - RNA, 19 nt, Homo sapiens
uaacaaggauuggaaguug

SEQ ID NO: 83677 - RNA, 19 nt, Homo sapiens
ggaaaucaccuacgagaau

SEQ ID NO: 83678 - RNA, 19 nt, Homo sapiens
gaaaucaccuacgagaaug

SEQ ID NO: 83679 - RNA, 19 nt, Homo sapiens
ccaagaacuucccauggua

SEQ ID NO: 83680 - RNA, 19 nt, Homo sapiens
acacagagccuaguuguaa

SEQ ID NO: 83681 - RNA, 19 nt, Homo sapiens
gagcaucuccagccgguua

SEQ ID NO: 83682 - RNA, 19 nt, Homo sapiens
gaacacagagccuaguugu

SEQ ID NO: 83683 - RNA, 19 nt, Homo sapiens
gugaaacucugucuuccaa

SEQ ID NO: 83684 - RNA, 19 nt, Homo sapiens
gauuggaaguugacugaug

SEQ ID NO: 83685 - RNA, 19 nt, Homo sapiens
gcuuucagguuuccagauu

SEQ ID NO: 83686 - RNA, 19 nt, Homo sapiens
cuucuuaaauucacuguug

SEQ ID NO: 83687 - RNA, 19 nt, Homo sapiens
gguggacacuggagucaga

SEQ ID NO: 83688 - RNA, 19 nt, Homo sapiens
ggacaaagcagcggucaag

SEQ ID NO: 83689 - RNA, 19 nt, Homo sapiens
gcagaucugagguuuguga

SEQ ID NO: 83690 - RNA, 19 nt, Homo sapiens
guucagggaauucauauug

SEQ ID NO: 83691 - RNA, 19 nt, Homo sapiens
cuuccaagcuggccacauu

SEQ ID NO: 83692 - RNA, 19 nt, Homo sapiens
ucagagucauguagaaguu

SEQ ID NO: 83693 - RNA, 19 nt, Homo sapiens
gaugauacacaacgcacua

SEQ ID NO: 83694 - RNA, 19 nt, Homo sapiens
gagcagaagcugagcaaca

SEQ ID NO: 83695 - RNA, 19 nt, Homo sapiens
cagcuccgccucaagauaa

SEQ ID NO: 83696 - RNA, 19 nt, Homo sapiens
gcacaaccugccugcgaua

SEQ ID NO: 83697 - RNA, 19 nt, Homo sapiens
cuacgagaauguucaagug

SEQ ID NO: 83698 - RNA, 19 nt, Homo sapiens
gaacuucccaugguagaau

SEQ ID NO: 83699 - RNA, 19 nt, Homo sapiens
cagaccaucuccuucauuc

SEQ ID NO: 83700 - RNA, 19 nt, Homo sapiens
ggagggccuuggagcagaa

SEQ ID NO: 83701 - RNA, 19 nt, Homo sapiens
gcagcuccgccucaagaua

SEQ ID NO: 83702 - RNA, 19 nt, Homo sapiens
gagucagagucauguagaa

SEQ ID NO: 83703 - RNA, 19 nt, Homo sapiens
cacaaucacacucuuacua

SEQ ID NO: 83704 - RNA, 19 nt, Homo sapiens
ggaaguugacugaugauac

SEQ ID NO: 83705 - RNA, 19 nt, Homo sapiens
ucagggaauucauauugga

SEQ ID NO: 83706 - RNA, 19 nt, Homo sapiens
acaucucacuuacuucaaa

SEQ ID NO: 83707 - RNA, 19 nt, Homo sapiens
cacagagccuaguuguaaa

SEQ ID NO: 83708 - RNA, 19 nt, Homo sapiens
ggagucagagucauguaga

SEQ ID NO: 83709 - RNA, 19 nt, Homo sapiens
gcucuaacaaggauuggaa

SEQ ID NO: 83710 - RNA, 19 nt, Homo sapiens
ucaagugcccgcaguccua

SEQ ID NO: 83711 - RNA, 19 nt, Homo sapiens
cagcagcuccgccucaaga

SEQ ID NO: 83712 - RNA, 19 nt, Homo sapiens
cccaagaacuucccauggu

SEQ ID NO: 83713 - RNA, 19 nt, Homo sapiens
gaccaucuccuucauucug

SEQ ID NO: 83714 - RNA, 19 nt, Homo sapiens
ccucagcucuaacaaggau

SEQ ID NO: 83715 - RNA, 19 nt, Homo sapiens
ggaacacagagccuaguug

SEQ ID NO: 83716 - RNA, 19 nt, Homo sapiens
acacaacgcacuaggacuu

SEQ ID NO: 83717 - RNA, 19 nt, Homo sapiens
acacucuuacuacuucuua

SEQ ID NO: 83718 - RNA, 19 nt, Homo sapiens
ggagccagccaggcaguuu

SEQ ID NO: 83719 - RNA, 19 nt, Homo sapiens
acacucaugccaacaagaa

SEQ ID NO: 83720 - RNA, 19 nt, Homo sapiens
gauacacaacgcacuagga

SEQ ID NO: 83721 - RNA, 19 nt, Homo sapiens
gcagagucaggaagcacua

SEQ ID NO: 83722 - RNA, 19 nt, Homo sapiens
cuaugcagaucugagguuu

SEQ ID NO: 83723 - RNA, 19 nt, Homo sapiens
cagugaaauuuauccacaa

SEQ ID NO: 83724 - RNA, 19 nt, Homo sapiens
ccaggcaguuuuauugaaa

SEQ ID NO: 83725 - RNA, 19 nt, Homo sapiens
gggaaaucaccuacgagaa

SEQ ID NO: 83726 - RNA, 19 nt, Homo sapiens
ggccaucaccuaugcagau

SEQ ID NO: 83727 - RNA, 19 nt, Homo sapiens
auuggaaguugacugauga

SEQ ID NO: 83728 - RNA, 19 nt, Homo sapiens
uuacaucucacuuacuuca

SEQ ID NO: 83729 - RNA, 19 nt, Homo sapiens
caucaccuaugcagaucug

SEQ ID NO: 83730 - RNA, 19 nt, Homo sapiens
cuuucagguuuccagauua

SEQ ID NO: 83731 - RNA, 19 nt, Homo sapiens
guugacugaugauacacaa

SEQ ID NO: 83732 - RNA, 19 nt, Homo sapiens
aacaaggauuggaaguuga

SEQ ID NO: 83733 - RNA, 19 nt, Homo sapiens
ccucagaccaucuccuuca

SEQ ID NO: 83734 - RNA, 19 nt, Homo sapiens
caaagugaggagcaacaga

SEQ ID NO: 83735 - RNA, 19 nt, Homo sapiens
gcacuacagguggaacaga

SEQ ID NO: 83736 - RNA, 19 nt, Homo sapiens
augcagaucugagguuugu

SEQ ID NO: 83737 - RNA, 19 nt, Homo sapiens
gacccacaccugacacuuc

SEQ ID NO: 83738 - RNA, 19 nt, Homo sapiens
guaacaagguacauaaaac

SEQ ID NO: 83739 - RNA, 19 nt, Homo sapiens
cacuaggacuuaugcucaa

SEQ ID NO: 83740 - RNA, 19 nt, Homo sapiens
gggaacacagagccuaguu

SEQ ID NO: 83741 - RNA, 19 nt, Homo sapiens
gugguucagggaauucaua

SEQ ID NO: 83742 - RNA, 19 nt, Homo sapiens
caaucacacucuuacuacu

SEQ ID NO: 83743 - RNA, 19 nt, Homo sapiens
gggacagagugcagaggau

SEQ ID NO: 83744 - RNA, 19 nt, Homo sapiens
ucaccugccugcuguuagg

SEQ ID NO: 83745 - RNA, 19 nt, Homo sapiens
caacgcacuaggacuuaug

SEQ ID NO: 83746 - RNA, 19 nt, Homo sapiens
ugacacucaugccaacaag

SEQ ID NO: 83747 - RNA, 19 nt, Homo sapiens
cacaacgcacuaggacuua

SEQ ID NO: 83748 - RNA, 19 nt, Homo sapiens
acagacagaagacgaagga

SEQ ID NO: 83749 - RNA, 19 nt, Homo sapiens
uccugaaacuggacuguuc

SEQ ID NO: 83750 - RNA, 19 nt, Homo sapiens
cuaacaaggauuggaaguu

SEQ ID NO: 83751 - RNA, 19 nt, Homo sapiens
caagcuggccacauucagu

SEQ ID NO: 83752 - RNA, 19 nt, Homo sapiens
ugagcaacauggagaacag

SEQ ID NO: 83753 - RNA, 19 nt, Homo sapiens
aggagaccuugcaaaguga

SEQ ID NO: 83754 - RNA, 19 nt, Homo sapiens
gcugaggccaucaccuaug

SEQ ID NO: 83755 - RNA, 19 nt, Homo sapiens
aaauggugguucagggaau

SEQ ID NO: 83756 - RNA, 19 nt, Homo sapiens
acaaagcagcggucaaguc

SEQ ID NO: 83757 - RNA, 19 nt, Homo sapiens
aaugugaaacucugucuuc

SEQ ID NO: 83758 - RNA, 19 nt, Homo sapiens
gcagaagcugagcaacaug

SEQ ID NO: 83759 - RNA, 19 nt, Homo sapiens
uuucagguuuccagauuag

SEQ ID NO: 83760 - RNA, 19 nt, Homo sapiens
cuuggcuucuucuguacua

SEQ ID NO: 83761 - RNA, 19 nt, Homo sapiens
aaucacacucuuacuacuu

SEQ ID NO: 83762 - RNA, 19 nt, Homo sapiens
uauccacaaucacacucuu

SEQ ID NO: 83763 - RNA, 19 nt, Homo sapiens
ccucaccugccugcuguua

SEQ ID NO: 83764 - RNA, 19 nt, Homo sapiens
ucagaccaucuccuucauu

SEQ ID NO: 83765 - RNA, 19 nt, Homo sapiens
aauggugguucagggaauu

SEQ ID NO: 83766 - RNA, 19 nt, Homo sapiens
acaaucacacucuuacuac

SEQ ID NO: 83767 - RNA, 19 nt, Homo sapiens
gagcaacauggagaacaga

SEQ ID NO: 83768 - RNA, 19 nt, Homo sapiens
agcagaagcugagcaacau

SEQ ID NO: 83769 - RNA, 19 nt, Homo sapiens
gccaucaccuaugcagauc

SEQ ID NO: 83770 - RNA, 19 nt, Homo sapiens
cagacagacagaagacgaa

SEQ ID NO: 83771 - RNA, 19 nt, Homo sapiens
gaccuuaucuccaacaaug

SEQ ID NO: 83772 - RNA, 19 nt, Homo sapiens
gagccacucucuucccuuu

SEQ ID NO: 83773 - RNA, 19 nt, Homo sapiens
caaggaagagccaauguuu

SEQ ID NO: 83774 - RNA, 19 nt, Homo sapiens
gcagaaugccaccaaguau

SEQ ID NO: 83775 - RNA, 19 nt, Homo sapiens
gaacagcagauaacaaugc

SEQ ID NO: 83776 - RNA, 19 nt, Homo sapiens
ggccaugguucacauuaga

SEQ ID NO: 83777 - RNA, 19 nt, Homo sapiens
gagaaccugagacaccuua

SEQ ID NO: 83778 - RNA, 19 nt, Homo sapiens
gcacagggagaagggauaa

SEQ ID NO: 83779 - RNA, 19 nt, Homo sapiens
caccaaguauggcaacaug

SEQ ID NO: 83780 - RNA, 19 nt, Homo sapiens
cagccaagcuuguuaucag

SEQ ID NO: 83781 - RNA, 19 nt, Homo sapiens
accauuggcuccuguuuga

SEQ ID NO: 83782 - RNA, 19 nt, Homo sapiens
cagaggcggucuucaacau

SEQ ID NO: 83783 - RNA, 19 nt, Homo sapiens
cagcagaggcggucuucaa

SEQ ID NO: 83784 - RNA, 19 nt, Homo sapiens
gaaagagucacuggaacug

SEQ ID NO: 83785 - RNA, 19 nt, Homo sapiens
gaagaucagaagccaguca

SEQ ID NO: 83786 - RNA, 19 nt, Homo sapiens
ugaugcaccugcuccagaa

SEQ ID NO: 83787 - RNA, 19 nt, Homo sapiens
ugagacaccuuaagaacac

SEQ ID NO: 83788 - RNA, 19 nt, Homo sapiens
agagcuggaugcaccauug

SEQ ID NO: 83789 - RNA, 19 nt, Homo sapiens
gacagaggaccaugugaug

SEQ ID NO: 83790 - RNA, 19 nt, Homo sapiens
ccaaggaagagccaauguu

SEQ ID NO: 83791 - RNA, 19 nt, Homo sapiens
gcagauaacaaugcagcaa

SEQ ID NO: 83792 - RNA, 19 nt, Homo sapiens
cggaacagcagauaacaau

SEQ ID NO: 83793 - RNA, 19 nt, Homo sapiens
guacaagacaaaccaaguc

SEQ ID NO: 83794 - RNA, 19 nt, Homo sapiens
uggagaaccugcgcaugaa

SEQ ID NO: 83795 - RNA, 19 nt, Homo sapiens
gccaaaagcuagacagauc

SEQ ID NO: 83796 - RNA, 19 nt, Homo sapiens
gggccaugguucacauuag

SEQ ID NO: 83797 - RNA, 19 nt, Homo sapiens
cacugacgcuccaccgaaa

SEQ ID NO: 83798 - RNA, 19 nt, Homo sapiens
gcaccauuggcuccuguuu

SEQ ID NO: 83799 - RNA, 19 nt, Homo sapiens
ugacagaggaccaugugau

SEQ ID NO: 83800 - RNA, 19 nt, Homo sapiens
cuggagaaccugcgcauga

SEQ ID NO: 83801 - RNA, 19 nt, Homo sapiens
cagcaucacuccccaagga

SEQ ID NO: 83802 - RNA, 19 nt, Homo sapiens
gaccagcgcgaccuuaucu

SEQ ID NO: 83803 - RNA, 19 nt, Homo sapiens
caagucggaacagcagaua

SEQ ID NO: 83804 - RNA, 19 nt, Homo sapiens
gcagaggcggucuucaaca

SEQ ID NO: 83805 - RNA, 19 nt, Homo sapiens
cauuggcuccuguuugaaa

SEQ ID NO: 83806 - RNA, 19 nt, Homo sapiens
gaugaccagcgcgaccuua

SEQ ID NO: 83807 - RNA, 19 nt, Homo sapiens
gaaccugagacaccuuaag

SEQ ID NO: 83808 - RNA, 19 nt, Homo sapiens
ggagcugucgggaagauca

SEQ ID NO: 83809 - RNA, 19 nt, Homo sapiens
cagaaugccaccaaguaug

SEQ ID NO: 83810 - RNA, 19 nt, Homo sapiens
gcucagccaagcuuguuau

SEQ ID NO: 83811 - RNA, 19 nt, Homo sapiens
ugcagaaugccaccaagua

SEQ ID NO: 83812 - RNA, 19 nt, Homo sapiens
gcucuuucgucacccuugu

SEQ ID NO: 83813 - RNA, 19 nt, Homo sapiens
acagcagccuccaacacaa

SEQ ID NO: 83814 - RNA, 19 nt, Homo sapiens
ggaacagcagauaacaaug

SEQ ID NO: 83815 - RNA, 19 nt, Homo sapiens
cagaugcacaggaggagaa

SEQ ID NO: 83816 - RNA, 19 nt, Homo sapiens
ggcuggacaugcugacugu

SEQ ID NO: 83817 - RNA, 19 nt, Homo sapiens
cgaaagagucacuggaacu

SEQ ID NO: 83818 - RNA, 19 nt, Homo sapiens
caacacaaggcuccaagac

SEQ ID NO: 83819 - RNA, 19 nt, Homo sapiens
ccuggugccuggcucuuuc

SEQ ID NO: 83820 - RNA, 19 nt, Homo sapiens
ccaagccugugagcaagau

SEQ ID NO: 83821 - RNA, 19 nt, Homo sapiens
uggcuccuguuugaaauga

SEQ ID NO: 83822 - RNA, 19 nt, Homo sapiens
caacaugacagaggaccau

SEQ ID NO: 83823 - RNA, 19 nt, Homo sapiens
caugguucacauuagaaua

SEQ ID NO: 83824 - RNA, 19 nt, Homo sapiens
uccaagaccuaggcucaug

SEQ ID NO: 83825 - RNA, 19 nt, Homo sapiens
cacagcagccuccaacaca

SEQ ID NO: 83826 - RNA, 19 nt, Homo sapiens
gacaaaccaagucggaaca

SEQ ID NO: 83827 - RNA, 19 nt, Homo sapiens
aaccugagacaccuuaaga

SEQ ID NO: 83828 - RNA, 19 nt, Homo sapiens
caggagcugucgggaagau

SEQ ID NO: 83829 - RNA, 19 nt, Homo sapiens
gaacuggaggacccgucuu

SEQ ID NO: 83830 - RNA, 19 nt, Homo sapiens
uggagaccauagacuggaa

SEQ ID NO: 83831 - RNA, 19 nt, Homo sapiens
ucagaagccagucauggau

SEQ ID NO: 83832 - RNA, 19 nt, Homo sapiens
ucagggccaugguucacau

SEQ ID NO: 83833 - RNA, 19 nt, Homo sapiens
agaaugccaccaaguaugg

SEQ ID NO: 83834 - RNA, 19 nt, Homo sapiens
gcgaccuuaucuccaacaa

SEQ ID NO: 83835 - RNA, 19 nt, Homo sapiens
cagaggaccaugugaugca

SEQ ID NO: 83836 - RNA, 19 nt, Homo sapiens
gacagucaccucccagaac

SEQ ID NO: 83837 - RNA, 19 nt, Homo sapiens
ggaugaauaugaagaugaa

SEQ ID NO: 83838 - RNA, 19 nt, Homo sapiens
gauuguagcagccucguua

SEQ ID NO: 83839 - RNA, 19 nt, Homo sapiens
gcacccagcuccagugucu

SEQ ID NO: 83840 - RNA, 19 nt, Homo sapiens
ccacucuucuucccucuaa

SEQ ID NO: 83841 - RNA, 19 nt, Homo sapiens
gcacaaggucccagcauca

SEQ ID NO: 83842 - RNA, 19 nt, Homo sapiens
ggacgacugcuccauguau

SEQ ID NO: 83843 - RNA, 19 nt, Homo sapiens
guacgcugaucauccagaa

SEQ ID NO: 83844 - RNA, 19 nt, Homo sapiens
guagcagccucguuagugu

SEQ ID NO: 83845 - RNA, 19 nt, Homo sapiens
gaucugucagggccacuua

SEQ ID NO: 83846 - RNA, 19 nt, Homo sapiens
caaggucccagcaucauug

SEQ ID NO: 83847 - RNA, 19 nt, Homo sapiens
aauaaauucuucccaacug

SEQ ID NO: 83848 - RNA, 19 nt, Homo sapiens
gggcuuccuuagucauauu

SEQ ID NO: 83849 - RNA, 19 nt, Homo sapiens
gggaugaauaugaagauga

SEQ ID NO: 83850 - RNA, 19 nt, Homo sapiens
gacgacugcuccauguaug

SEQ ID NO: 83851 - RNA, 19 nt, Homo sapiens
ggacgcugcugcuguucag

SEQ ID NO: 83852 - RNA, 19 nt, Homo sapiens
ccuccucccugaucuguca

SEQ ID NO: 83853 - RNA, 19 nt, Homo sapiens
gaugaaaaccuuuaugaag

SEQ ID NO: 83854 - RNA, 19 nt, Homo sapiens
gaugugggcagccucaaca

SEQ ID NO: 83855 - RNA, 19 nt, Homo sapiens
gguaaugagcccuuaaucg

SEQ ID NO: 83856 - RNA, 19 nt, Homo sapiens
ccugggacauucuccuuuc

SEQ ID NO: 83857 - RNA, 19 nt, Homo sapiens
accaagaaccgaaucauca

SEQ ID NO: 83858 - RNA, 19 nt, Homo sapiens
gugggcagccucaacauag

SEQ ID NO: 83859 - RNA, 19 nt, Homo sapiens
ggaaacgauggcagaacga

SEQ ID NO: 83860 - RNA, 19 nt, Homo sapiens
uccagaaugugaacaagag

SEQ ID NO: 83861 - RNA, 19 nt, Homo sapiens
uuccaaugcccgcacaaua

SEQ ID NO: 83862 - RNA, 19 nt, Homo sapiens
cugggacgcugcugcuguu

SEQ ID NO: 83863 - RNA, 19 nt, Homo sapiens
ccagggcaccuaccaggau

SEQ ID NO: 83864 - RNA, 19 nt, Homo sapiens
uccaaugcccgcacaauag

SEQ ID NO: 83865 - RNA, 19 nt, Homo sapiens
caagaaccgaaucaucaca

SEQ ID NO: 83866 - RNA, 19 nt, Homo sapiens
gcacaauagcagcaacaac

SEQ ID NO: 83867 - RNA, 19 nt, Homo sapiens
gcaccaagaaccgaaucau

SEQ ID NO: 83868 - RNA, 19 nt, Homo sapiens
cugaucauccagaauguga

SEQ ID NO: 83869 - RNA, 19 nt, Homo sapiens
ggaugaauaugaagaugaa

SEQ ID NO: 83870 - RNA, 19 nt, Homo sapiens
gauuguagcagccucguua

SEQ ID NO: 83871 - RNA, 19 nt, Homo sapiens
gcacccagcuccagugucu

SEQ ID NO: 83872 - RNA, 19 nt, Homo sapiens
ccacucuucuucccucuaa

SEQ ID NO: 83873 - RNA, 19 nt, Homo sapiens
gcacaaggucccagcauca

SEQ ID NO: 83874 - RNA, 19 nt, Homo sapiens
ggacgacugcuccauguau

SEQ ID NO: 83875 - RNA, 19 nt, Homo sapiens
guagcagccucguuagugu

SEQ ID NO: 83876 - RNA, 19 nt, Homo sapiens
gaucugucagggccacuua

SEQ ID NO: 83877 - RNA, 19 nt, Homo sapiens
caaggucccagcaucauug

SEQ ID NO: 83878 - RNA, 19 nt, Homo sapiens
aauaaauucuucccaacug

SEQ ID NO: 83879 - RNA, 19 nt, Homo sapiens
gggcuuccuuagucauauu

SEQ ID NO: 83880 - RNA, 19 nt, Homo sapiens
gggaugaauaugaagauga

SEQ ID NO: 83881 - RNA, 19 nt, Homo sapiens
gacgacugcuccauguaug

SEQ ID NO: 83882 - RNA, 19 nt, Homo sapiens
ggacgcugcugcuguucag

SEQ ID NO: 83883 - RNA, 19 nt, Homo sapiens
ccuccucccugaucuguca

SEQ ID NO: 83884 - RNA, 19 nt, Homo sapiens
gaugaaaaccuuuaugaag

SEQ ID NO: 83885 - RNA, 19 nt, Homo sapiens
gaugugggcagccucaaca

SEQ ID NO: 83886 - RNA, 19 nt, Homo sapiens
gguaaugagcccuuaaucg

SEQ ID NO: 83887 - RNA, 19 nt, Homo sapiens
ccugggacauucuccuuuc

SEQ ID NO: 83888 - RNA, 19 nt, Homo sapiens
accaagaaccgaaucauca

SEQ ID NO: 83889 - RNA, 19 nt, Homo sapiens
gugggcagccucaacauag

SEQ ID NO: 83890 - RNA, 19 nt, Homo sapiens
ggaaacgauggcagaacga

SEQ ID NO: 83891 - RNA, 19 nt, Homo sapiens
uuccaaugcccgcacaaua

SEQ ID NO: 83892 - RNA, 19 nt, Homo sapiens
cugggacgcugcugcuguu

SEQ ID NO: 83893 - RNA, 19 nt, Homo sapiens
ccagggcaccuaccaggau

SEQ ID NO: 83894 - RNA, 19 nt, Homo sapiens
caagaaccgaaucaucaca

SEQ ID NO: 83895 - RNA, 19 nt, Homo sapiens
uccaaugcccgcacaauag

SEQ ID NO: 83896 - RNA, 19 nt, Homo sapiens
gcacaauagcagcaacaac

SEQ ID NO: 83897 - RNA, 19 nt, Homo sapiens
gcaccaagaaccgaaucau

SEQ ID NO: 83898 - RNA, 19 nt, Homo sapiens
caaagggccuggaguagaa

SEQ ID NO: 83899 - RNA, 19 nt, Homo sapiens
gaagugaaguggucuguag

SEQ ID NO: 83900 - RNA, 19 nt, Homo sapiens
gaacagcgccuccggcaau

SEQ ID NO: 83901 - RNA, 19 nt, Homo sapiens
gcagagcccacguuucaua

SEQ ID NO: 83902 - RNA, 19 nt, Homo sapiens
caccagagcugccauuugu

SEQ ID NO: 83903 - RNA, 19 nt, Homo sapiens
gcacagagcugcgagucau

SEQ ID NO: 83904 - RNA, 19 nt, Homo sapiens
cagcagaagugcaacaaca

SEQ ID NO: 83905 - RNA, 19 nt, Homo sapiens
uaaacgguguguccugaga

SEQ ID NO: 83906 - RNA, 19 nt, Homo sapiens
ggacaauggcaucuacuuc

SEQ ID NO: 83907 - RNA, 19 nt, Homo sapiens
ggaagagucccagaacgaa

SEQ ID NO: 83908 - RNA, 19 nt, Homo sapiens
aaaaugcacugcuacauga

SEQ ID NO: 83909 - RNA, 19 nt, Homo sapiens
cagaagagccacaggaaca

SEQ ID NO: 83910 - RNA, 19 nt, Homo sapiens
ccaaggagccucggacguu

SEQ ID NO: 83911 - RNA, 19 nt, Homo sapiens
uggcagagcccacguuuca

SEQ ID NO: 83912 - RNA, 19 nt, Homo sapiens
gaaaaugcacugcuacaug

SEQ ID NO: 83913 - RNA, 19 nt, Homo sapiens
guccagagcccgcaaaugg

SEQ ID NO: 83914 - RNA, 19 nt, Homo sapiens
ccaaagggccuggaguaga

SEQ ID NO: 83915 - RNA, 19 nt, Homo sapiens
gaagagucccagaacgaau

SEQ ID NO: 83916 - RNA, 19 nt, Homo sapiens
acgagggccuggacauuga

SEQ ID NO: 83917 - RNA, 19 nt, Homo sapiens
gaucauccucuucaucauc

SEQ ID NO: 83918 - RNA, 19 nt, Homo sapiens
ccaaagguagugcuuguuc

SEQ ID NO: 83919 - RNA, 19 nt, Homo sapiens
guaccggaaucccaaaggu

SEQ ID NO: 83920 - RNA, 19 nt, Homo sapiens
gacaauggcaucuacuucu

SEQ ID NO: 83921 - RNA, 19 nt, Homo sapiens
ggaagugaaguggucugua

SEQ ID NO: 83922 - RNA, 19 nt, Homo sapiens
ccggugcaguuacacguuu

SEQ ID NO: 83923 - RNA, 19 nt, Homo sapiens
gcauggaagagucccagaa

SEQ ID NO: 83924 - RNA, 19 nt, Homo sapiens
acaauggcaucuacuucug

SEQ ID NO: 83925 - RNA, 19 nt, Homo sapiens
agcaggagauggacgagaa

SEQ ID NO: 83926 - RNA, 19 nt, Homo sapiens
ugaggacaauggcaucuac

SEQ ID NO: 83927 - RNA, 19 nt, Homo sapiens
cauccaaggcauccgguuu

SEQ ID NO: 83928 - RNA, 19 nt, Homo sapiens
gaccagacagccaccuaug

SEQ ID NO: 83929 - RNA, 19 nt, Homo sapiens
ucccaaagguagugcuugu

SEQ ID NO: 83930 - RNA, 19 nt, Homo sapiens
ggacaacagggcagcaacu

SEQ ID NO: 83931 - RNA, 19 nt, Homo sapiens
ccaccagagcugccauuug

SEQ ID NO: 83932 - RNA, 19 nt, Homo sapiens
caucaucgugccuaucuuc

SEQ ID NO: 83933 - RNA, 19 nt, Homo sapiens
gaagagccacaggaacauc

SEQ ID NO: 83934 - RNA, 19 nt, Homo sapiens
ugccaaagggccuggagua

SEQ ID NO: 83935 - RNA, 19 nt, Homo sapiens
ccagacagccaccuaugag

SEQ ID NO: 83936 - RNA, 19 nt, Homo sapiens
agaggaacacgcugaagga

SEQ ID NO: 83937 - RNA, 19 nt, Homo sapiens
gcauccgguuugaggacaa

SEQ ID NO: 83938 - RNA, 19 nt, Homo sapiens
gacaacagggcagcaacuu

SEQ ID NO: 83939 - RNA, 19 nt, Homo sapiens
aacgguguguccugagaaa

SEQ ID NO: 83940 - RNA, 19 nt, Homo sapiens
ccagagcugccauuugucu

SEQ ID NO: 83941 - RNA, 19 nt, Homo sapiens
cuacgagggccuggacauu

SEQ ID NO: 83942 - RNA, 19 nt, Homo sapiens
uggaagagucccagaacga

SEQ ID NO: 83943 - RNA, 19 nt, Homo sapiens
gagccacaggaacaucauu

SEQ ID NO: 83944 - RNA, 19 nt, Homo sapiens
aggaagaucacaccuacga

SEQ ID NO: 83945 - RNA, 19 nt, Homo sapiens
aggcuggcauggaggaaga

SEQ ID NO: 83946 - RNA, 19 nt, Homo sapiens
uccagacgcugcugaucau

SEQ ID NO: 83947 - RNA, 19 nt, Homo sapiens
gcaggagauggacgagaau

SEQ ID NO: 83948 - RNA, 19 nt, Homo sapiens
caaagggccuggaguagaa

SEQ ID NO: 83949 - RNA, 19 nt, Homo sapiens
gaagugaaguggucuguag

SEQ ID NO: 83950 - RNA, 19 nt, Homo sapiens
caccagagcugccauuugu

SEQ ID NO: 83951 - RNA, 19 nt, Homo sapiens
uaaacgguguguccugaga

SEQ ID NO: 83952 - RNA, 19 nt, Homo sapiens
guaccggaaucccaaagga

SEQ ID NO: 83953 - RNA, 19 nt, Homo sapiens
cagaagagccacaggaaca

SEQ ID NO: 83954 - RNA, 19 nt, Homo sapiens
ccaaggagccucggacguu

SEQ ID NO: 83955 - RNA, 19 nt, Homo sapiens
guccagagcccgcaaaugg

SEQ ID NO: 83956 - RNA, 19 nt, Homo sapiens
ccaaagggccuggaguaga

SEQ ID NO: 83957 - RNA, 19 nt, Homo sapiens
acgagggccuggacauuga

SEQ ID NO: 83958 - RNA, 19 nt, Homo sapiens
gaucauccucuucaucauc

SEQ ID NO: 83959 - RNA, 19 nt, Homo sapiens
ccggugcaguuacacguuu

SEQ ID NO: 83960 - RNA, 19 nt, Homo sapiens
ggaagugaaguggucugua

SEQ ID NO: 83961 - RNA, 19 nt, Homo sapiens
gaccagacagccaccuaug

SEQ ID NO: 83962 - RNA, 19 nt, Homo sapiens
ggacaacagggcagcaacu

SEQ ID NO: 83963 - RNA, 19 nt, Homo sapiens
ccaccagagcugccauuug

SEQ ID NO: 83964 - RNA, 19 nt, Homo sapiens
caucaucgugccuaucuuc

SEQ ID NO: 83965 - RNA, 19 nt, Homo sapiens
gaagagccacaggaacauc

SEQ ID NO: 83966 - RNA, 19 nt, Homo sapiens
ugccaaagggccuggagua

SEQ ID NO: 83967 - RNA, 19 nt, Homo sapiens
ccagacagccaccuaugag

SEQ ID NO: 83968 - RNA, 19 nt, Homo sapiens
agaggaacacgcugaagga

SEQ ID NO: 83969 - RNA, 19 nt, Homo sapiens
gacaacagggcagcaacuu

SEQ ID NO: 83970 - RNA, 19 nt, Homo sapiens
aacgguguguccugagaaa

SEQ ID NO: 83971 - RNA, 19 nt, Homo sapiens
ccagagcugccauuugucu

SEQ ID NO: 83972 - RNA, 19 nt, Homo sapiens
cuacgagggccuggacauu

SEQ ID NO: 83973 - RNA, 19 nt, Homo sapiens
gagccacaggaacaucauu

SEQ ID NO: 83974 - RNA, 19 nt, Homo sapiens
aggaagaucacaccuacga

SEQ ID NO: 83975 - RNA, 19 nt, Homo sapiens
aggcuggcauggaggaaga

SEQ ID NO: 83976 - RNA, 19 nt, Homo sapiens
uccagacgcugcugaucau

SEQ ID NO: 83977 - RNA, 19 nt, Homo sapiens
gaacuuuccuguuaccuuu

SEQ ID NO: 83978 - RNA, 19 nt, Homo sapiens
gaacagcuccguguacuga

SEQ ID NO: 83979 - RNA, 19 nt, Homo sapiens
ccaaggaugugaagcaguu

SEQ ID NO: 83980 - RNA, 19 nt, Homo sapiens
gaacaucaggcaugcuaaa

SEQ ID NO: 83981 - RNA, 19 nt, Homo sapiens
ccaccaaccuccuguaucu

SEQ ID NO: 83982 - RNA, 19 nt, Homo sapiens
gcagcaacaucaucagcaa

SEQ ID NO: 83983 - RNA, 19 nt, Homo sapiens
uauauaacguuuccgguau

SEQ ID NO: 83984 - RNA, 19 nt, Homo sapiens
gggcugacgucacauguag

SEQ ID NO: 83985 - RNA, 19 nt, Homo sapiens
caucaccgccuguguauau

SEQ ID NO: 83986 - RNA, 19 nt, Homo sapiens
ccucagugcucaagaacaa

SEQ ID NO: 83987 - RNA, 19 nt, Homo sapiens
uauaacguuuccgguauua

SEQ ID NO: 83988 - RNA, 19 nt, Homo sapiens
ucagcaaccucuucaagga

SEQ ID NO: 83989 - RNA, 19 nt, Homo sapiens
gcccaacaccuucuaugua

SEQ ID NO: 83990 - RNA, 19 nt, Homo sapiens
caacuguaaucacaacauc

SEQ ID NO: 83991 - RNA, 19 nt, Homo sapiens
gcaccuguccuuucuaaca

SEQ ID NO: 83992 - RNA, 19 nt, Homo sapiens
cugcacagcucaccuuguu

SEQ ID NO: 83993 - RNA, 19 nt, Homo sapiens
ccaccucagugcucaagaa

SEQ ID NO: 83994 - RNA, 19 nt, Homo sapiens
acauguagguggcguguau

SEQ ID NO: 83995 - RNA, 19 nt, Homo sapiens
ucaaguaccugcucuucgu

SEQ ID NO: 83996 - RNA, 19 nt, Homo sapiens
cccaacaccuucuauguag

SEQ ID NO: 83997 - RNA, 19 nt, Homo sapiens
guggagggcugcaccaagu

SEQ ID NO: 83998 - RNA, 19 nt, Homo sapiens
cgucuucaauuucgucuuc

SEQ ID NO: 83999 - RNA, 19 nt, Homo sapiens
acacgucgccuucaacugu

SEQ ID NO: 84000 - RNA, 19 nt, Homo sapiens
ggccaucaccgccugugua

SEQ ID NO: 84001 - RNA, 19 nt, Homo sapiens
ugugggcgcugucaugaug

SEQ ID NO: 84002 - RNA, 19 nt, Homo sapiens
gcucuucgucuucaauuuc

SEQ ID NO: 84003 - RNA, 19 nt, Homo sapiens
ccaaggcuguggugaagac

SEQ ID NO: 84004 - RNA, 19 nt, Homo sapiens
ucuaacacgucgccuucaa

SEQ ID NO: 84005 - RNA, 19 nt, Homo sapiens
guagguggcguguaugagu

SEQ ID NO: 84006 - RNA, 19 nt, Homo sapiens
gccuucaacuguaaucaca

SEQ ID NO: 84007 - RNA, 19 nt, Homo sapiens
ggaacaucaggcaugcuaa

SEQ ID NO: 84008 - RNA, 19 nt, Homo sapiens
cacgucgccuucaacugua

SEQ ID NO: 84009 - RNA, 19 nt, Homo sapiens
ccaagugcaucaaguaccu

SEQ ID NO: 84010 - RNA, 19 nt, Homo sapiens
auauaacguuuccgguauu

SEQ ID NO: 84011 - RNA, 19 nt, Homo sapiens
cguggucgcugugaucaug

SEQ ID NO: 84012 - RNA, 19 nt, Homo sapiens
ccgggaagcuguaccucau

SEQ ID NO: 84013 - RNA, 19 nt, Homo sapiens
gaccaccaaccuccuguau

SEQ ID NO: 84014 - RNA, 19 nt, Homo sapiens
gaugugaagcaguucuaug

SEQ ID NO: 84015 - RNA, 19 nt, Homo sapiens
augcaccuguccuuucuaa

SEQ ID NO: 84016 - RNA, 19 nt, Homo sapiens
ucaugcaccuguccuuucu

SEQ ID NO: 84017 - RNA, 19 nt, Homo sapiens
gccuguguauauaacguuu

SEQ ID NO: 84018 - RNA, 19 nt, Homo sapiens
agacucagcuuggccaacu

SEQ ID NO: 84019 - RNA, 19 nt, Homo sapiens
ucaccgccuguguauauaa

SEQ ID NO: 84020 - RNA, 19 nt, Homo sapiens
ucagugcucaagaacaauu

SEQ ID NO: 84021 - RNA, 19 nt, Homo sapiens
ggacugccaccagaagauc

SEQ ID NO: 84022 - RNA, 19 nt, Homo sapiens
gaggacugccaccagaaga

SEQ ID NO: 84023 - RNA, 19 nt, Homo sapiens
ggaggacugccaccagaag

SEQ ID NO: 84024 - RNA, 19 nt, Homo sapiens
caucagcaaccucuucaag

SEQ ID NO: 84025 - RNA, 19 nt, Homo sapiens
caucaucagcaaccucuuc

SEQ ID NO: 84026 - RNA, 19 nt, Homo sapiens
gccaucaccgccuguguau

SEQ ID NO: 84027 - RNA, 19 nt, Homo sapiens
uaacguuuccgguauuacu

SEQ ID NO: 84028 - RNA, 19 nt, Homo sapiens
gcugugggcgcugucauga

SEQ ID NO: 84029 - RNA, 19 nt, Homo sapiens
cgccaaggcuguggugaag

SEQ ID NO: 84030 - RNA, 19 nt, Homo sapiens
caucaaguaccugcucuuc

SEQ ID NO: 84031 - RNA, 19 nt, Homo sapiens
aggaacaucaggcaugcua

SEQ ID NO: 84032 - RNA, 19 nt, Homo sapiens
uaacacgucgccuucaacu

SEQ ID NO: 84033 - RNA, 19 nt, Homo sapiens
ggaacagcuccguguacug

SEQ ID NO: 84034 - RNA, 19 nt, Homo sapiens
gcacacugacugcuuugac

SEQ ID NO: 84035 - RNA, 19 nt, Homo sapiens
ccagaucgccaaggaugug

SEQ ID NO: 84036 - RNA, 19 nt, Homo sapiens
gggcucagcuucccucuua

SEQ ID NO: 84037 - RNA, 19 nt, Homo sapiens
gagaacaccugucaagaug

SEQ ID NO: 84038 - RNA, 19 nt, Homo sapiens
gaagcucacucagaaguuu

SEQ ID NO: 84039 - RNA, 19 nt, Homo sapiens
gaagugggccugccuaguu

SEQ ID NO: 84040 - RNA, 19 nt, Homo sapiens
gaacaccugucaagaugug

SEQ ID NO: 84041 - RNA, 19 nt, Homo sapiens
ccugugaccuucaucauuu

SEQ ID NO: 84042 - RNA, 19 nt, Homo sapiens
ccacccagcugcucucaaa

SEQ ID NO: 84043 - RNA, 19 nt, Homo sapiens
gcuauagucuggcaccaaa

SEQ ID NO: 84044 - RNA, 19 nt, Homo sapiens
ugaaaucaauccagacaug

SEQ ID NO: 84045 - RNA, 19 nt, Homo sapiens
acacagagcugacccugau

SEQ ID NO: 84046 - RNA, 19 nt, Homo sapiens
gacacggaaucccgaauaa

SEQ ID NO: 84047 - RNA, 19 nt, Homo sapiens
gagcaaguacucagaauuc

SEQ ID NO: 84048 - RNA, 19 nt, Homo sapiens
gugcugaccuauguguuua

SEQ ID NO: 84049 - RNA, 19 nt, Homo sapiens
gaaccugcauuccaagaag

SEQ ID NO: 84050 - RNA, 19 nt, Homo sapiens
caagaagguucgggaagaa

SEQ ID NO: 84051 - RNA, 19 nt, Homo sapiens
gccagacgcuuucccgauu

SEQ ID NO: 84052 - RNA, 19 nt, Homo sapiens
uuaaacacaugcauacaga

SEQ ID NO: 84053 - RNA, 19 nt, Homo sapiens
gcaggagguucucacuguu

SEQ ID NO: 84054 - RNA, 19 nt, Homo sapiens
ggcaggagguucucacugu

SEQ ID NO: 84055 - RNA, 19 nt, Homo sapiens
ggacaagaacgucacuaug

SEQ ID NO: 84056 - RNA, 19 nt, Homo sapiens
gacguuguguaauguguuu

SEQ ID NO: 84057 - RNA, 19 nt, Homo sapiens
gguuguagacguuguguaa

SEQ ID NO: 84058 - RNA, 19 nt, Homo sapiens
gccaagagccugccuaaag

SEQ ID NO: 84059 - RNA, 19 nt, Homo sapiens
uccagaaugucaucaaauu

SEQ ID NO: 84060 - RNA, 19 nt, Homo sapiens
gaaaucaauccagacauga

SEQ ID NO: 84061 - RNA, 19 nt, Homo sapiens
ccaagagccugccuaaagg

SEQ ID NO: 84062 - RNA, 19 nt, Homo sapiens
ggagggaguggcagcuaua

SEQ ID NO: 84063 - RNA, 19 nt, Homo sapiens
gacaagaacgucacuaugg

SEQ ID NO: 84064 - RNA, 19 nt, Homo sapiens
acaagaagguucgggaaga

SEQ ID NO: 84065 - RNA, 19 nt, Homo sapiens
gaacuccucgugugucaau

SEQ ID NO: 84066 - RNA, 19 nt, Homo sapiens
cauccagaaugucaucaaa

SEQ ID NO: 84067 - RNA, 19 nt, Homo sapiens
ggagcuuggugcugaccua

SEQ ID NO: 84068 - RNA, 19 nt, Homo sapiens
gggcagagacuccaagaca

SEQ ID NO: 84069 - RNA, 19 nt, Homo sapiens
aaacacaugcauacagaaa

SEQ ID NO: 84070 - RNA, 19 nt, Homo sapiens
cagcagcuuuguacacgaa

SEQ ID NO: 84071 - RNA, 19 nt, Homo sapiens
gaggagauauaugaaagca

SEQ ID NO: 84072 - RNA, 19 nt, Homo sapiens
ggcagagacuccaagacaa

SEQ ID NO: 84073 - RNA, 19 nt, Homo sapiens
gugaagauaugacuuucuc

SEQ ID NO: 84074 - RNA, 19 nt, Homo sapiens
ggagcaaguacucagaauu

SEQ ID NO: 84075 - RNA, 19 nt, Homo sapiens
gaacuggaggagauauaug

SEQ ID NO: 84076 - RNA, 19 nt, Homo sapiens
cgagaacaccugucaagau

SEQ ID NO: 84077 - RNA, 19 nt, Homo sapiens
gcuuggugcugaccuaugu

SEQ ID NO: 84078 - RNA, 19 nt, Homo sapiens
auccagacaugaagaaauu

SEQ ID NO: 84079 - RNA, 19 nt, Homo sapiens
cagcauccgugguguccaa

SEQ ID NO: 84080 - RNA, 19 nt, Homo sapiens
gagcagcgcacgcaugaag

SEQ ID NO: 84081 - RNA, 19 nt, Homo sapiens
ucaacaccguggguucaua

SEQ ID NO: 84082 - RNA, 19 nt, Homo sapiens
gaaagugucaugcggaaaa

SEQ ID NO: 84083 - RNA, 19 nt, Homo sapiens
ucgaaggccuggagcucua

SEQ ID NO: 84084 - RNA, 19 nt, Homo sapiens
ucaaauugguggaugaacu

SEQ ID NO: 84085 - RNA, 19 nt, Homo sapiens
ggugcugaccuauguguuu

SEQ ID NO: 84086 - RNA, 19 nt, Homo sapiens
ccagacaugaagaaauuaa

SEQ ID NO: 84087 - RNA, 19 nt, Homo sapiens
uccagaacaugacgacauu

SEQ ID NO: 84088 - RNA, 19 nt, Homo sapiens
gcagagacuccaagacaag

SEQ ID NO: 84089 - RNA, 19 nt, Homo sapiens
gggagcaaguacucagaau

SEQ ID NO: 84090 - RNA, 19 nt, Homo sapiens
ggagacuugugacgacauc

SEQ ID NO: 84091 - RNA, 19 nt, Homo sapiens
gccuggagcucuacuuucu

SEQ ID NO: 84092 - RNA, 19 nt, Homo sapiens
gcacgcaugaagcugaauu

SEQ ID NO: 84093 - RNA, 19 nt, Homo sapiens
gcgcacgcaugaagcugaa

SEQ ID NO: 84094 - RNA, 19 nt, Homo sapiens
cagaacuccucguguguca

SEQ ID NO: 84095 - RNA, 19 nt, Homo sapiens
agacacggaaucccgaaua

SEQ ID NO: 84096 - RNA, 19 nt, Homo sapiens
ugaccuauguguuuaccau

SEQ ID NO: 84097 - RNA, 19 nt, Homo sapiens
ucgcgcagcucuuccuguu

SEQ ID NO: 84098 - RNA, 19 nt, Homo sapiens
cagagcagcgcacgcauga

SEQ ID NO: 84099 - RNA, 19 nt, Homo sapiens
cugcagaacugaagagacu

SEQ ID NO: 84100 - RNA, 19 nt, Homo sapiens
gggacaagaacgucacuau

SEQ ID NO: 84101 - RNA, 19 nt, Homo sapiens
uugaagauaucaugaggau

SEQ ID NO: 84102 - RNA, 19 nt, Homo sapiens
ggaagcucacucagaaguu

SEQ ID NO: 84103 - RNA, 19 nt, Homo sapiens
gagcagcuuugcgauccuu

SEQ ID NO: 84104 - RNA, 19 nt, Homo sapiens
ccacaacaacaccaaggaa

SEQ ID NO: 84105 - RNA, 19 nt, Homo sapiens
gccgucaacuccaucuuuc

SEQ ID NO: 84106 - RNA, 19 nt, Homo sapiens
uggaggagauauaugaaag

SEQ ID NO: 84107 - RNA, 19 nt, Homo sapiens
agaagguucgggaagaaua

SEQ ID NO: 84108 - RNA, 19 nt, Homo sapiens
gggcugcaccugggucuuu

SEQ ID NO: 84109 - RNA, 19 nt, Homo sapiens
gugcaacaccgucgaaagu

SEQ ID NO: 84110 - RNA, 19 nt, Homo sapiens
cuggagcucuacuuucuug

SEQ ID NO: 84111 - RNA, 19 nt, Homo sapiens
ccuugaaccugcauuccaa

SEQ ID NO: 84112 - RNA, 19 nt, Homo sapiens
ugugaagguuguagacguu

SEQ ID NO: 84113 - RNA, 19 nt, Homo sapiens
gcagccaccugagcagcuu

SEQ ID NO: 84114 - RNA, 19 nt, Homo sapiens
ccagaaugucaucaaauug

SEQ ID NO: 84115 - RNA, 19 nt, Homo sapiens
gacuggcgcugucacucuu

SEQ ID NO: 84116 - RNA, 19 nt, Homo sapiens
cgauccuuauggcucauua

SEQ ID NO: 84117 - RNA, 19 nt, Homo sapiens
caaauugguggaugaacug

SEQ ID NO: 84118 - RNA, 19 nt, Homo sapiens
cagaaugucaucaaauugg

SEQ ID NO: 84119 - RNA, 19 nt, Homo sapiens
gaggucaccauccagaaug

SEQ ID NO: 84120 - RNA, 19 nt, Homo sapiens
uuguagacguuguguaaug

SEQ ID NO: 84121 - RNA, 19 nt, Homo sapiens
ugucuuugcugcagaacug

SEQ ID NO: 84122 - RNA, 19 nt, Homo sapiens
gggaguggcagcuauaguc

SEQ ID NO: 84123 - RNA, 19 nt, Homo sapiens
gcagcuuuguacacgaaga

SEQ ID NO: 84124 - RNA, 19 nt, Homo sapiens
guccacagccagacgcuuu

SEQ ID NO: 84125 - RNA, 19 nt, Homo sapiens
ggacuggcgcugucacucu

SEQ ID NO: 84126 - RNA, 19 nt, Homo sapiens
aagccgaacuggaggagau

SEQ ID NO: 84127 - RNA, 19 nt, Homo sapiens
ccagacgcuuucccgauuc

SEQ ID NO: 84128 - RNA, 19 nt, Homo sapiens
gcagaacugaagagacuag

SEQ ID NO: 84129 - RNA, 19 nt, Homo sapiens
ggcaucagaguccggcaua

SEQ ID NO: 84130 - RNA, 19 nt, Homo sapiens
cauaugaaggcgcaugguu

SEQ ID NO: 84131 - RNA, 19 nt, Homo sapiens
gcaucagaguccggcauau

SEQ ID NO: 84132 - RNA, 19 nt, Homo sapiens
ggaccugugaccuucauca

SEQ ID NO: 84133 - RNA, 19 nt, Homo sapiens
cgucucggcugccaucuac

SEQ ID NO: 84134 - RNA, 19 nt, Homo sapiens
ggccaguacucgggacaga

SEQ ID NO: 84135 - RNA, 19 nt, Homo sapiens
gaagguucgggaagaauac

SEQ ID NO: 84136 - RNA, 19 nt, Homo sapiens
gggcucagcuucccucuua

SEQ ID NO: 84137 - RNA, 19 nt, Homo sapiens
gagaacaccugucaagaug

SEQ ID NO: 84138 - RNA, 19 nt, Homo sapiens
gaagcucacucagaaguuu

SEQ ID NO: 84139 - RNA, 19 nt, Homo sapiens
gaagugggccugccuaguu

SEQ ID NO: 84140 - RNA, 19 nt, Homo sapiens
gaacaccugucaagaugug

SEQ ID NO: 84141 - RNA, 19 nt, Homo sapiens
ccugugaccuucaucauuu

SEQ ID NO: 84142 - RNA, 19 nt, Homo sapiens
ccacccagcugcucucaaa

SEQ ID NO: 84143 - RNA, 19 nt, Homo sapiens
gcuauagucuggcaccaaa

SEQ ID NO: 84144 - RNA, 19 nt, Homo sapiens
ugaaaucaauccagacaug

SEQ ID NO: 84145 - RNA, 19 nt, Homo sapiens
gaaugcaccuccggacaaa

SEQ ID NO: 84146 - RNA, 19 nt, Homo sapiens
acacagagcugacccugau

SEQ ID NO: 84147 - RNA, 19 nt, Homo sapiens
gacacggaaucccgaauaa

SEQ ID NO: 84148 - RNA, 19 nt, Homo sapiens
gagcaaguacucagaauuc

SEQ ID NO: 84149 - RNA, 19 nt, Homo sapiens
gugcugaccuauguguuua

SEQ ID NO: 84150 - RNA, 19 nt, Homo sapiens
gaaccugcauuccaagaag

SEQ ID NO: 84151 - RNA, 19 nt, Homo sapiens
caagaagguucgggaagaa

SEQ ID NO: 84152 - RNA, 19 nt, Homo sapiens
gccagacgcuuucccgauu

SEQ ID NO: 84153 - RNA, 19 nt, Homo sapiens
caaacaauaccgucuguga

SEQ ID NO: 84154 - RNA, 19 nt, Homo sapiens
cccaauggcccaaacaaua

SEQ ID NO: 84155 - RNA, 19 nt, Homo sapiens
gcaggagguucucacuguu

SEQ ID NO: 84156 - RNA, 19 nt, Homo sapiens
ggcaggagguucucacugu

SEQ ID NO: 84157 - RNA, 19 nt, Homo sapiens
ggacaagaacgucacuaug

SEQ ID NO: 84158 - RNA, 19 nt, Homo sapiens
gacguuguguaauguguuu

SEQ ID NO: 84159 - RNA, 19 nt, Homo sapiens
gguuguagacguuguguaa

SEQ ID NO: 84160 - RNA, 19 nt, Homo sapiens
gccaagagccugccuaaag

SEQ ID NO: 84161 - RNA, 19 nt, Homo sapiens
uccagaaugucaucaaauu

SEQ ID NO: 84162 - RNA, 19 nt, Homo sapiens
gaaaucaauccagacauga

SEQ ID NO: 84163 - RNA, 19 nt, Homo sapiens
ccaagagccugccuaaagg

SEQ ID NO: 84164 - RNA, 19 nt, Homo sapiens
ggagggaguggcagcuaua

SEQ ID NO: 84165 - RNA, 19 nt, Homo sapiens
gacaagaacgucacuaugg

SEQ ID NO: 84166 - RNA, 19 nt, Homo sapiens
gucaagauguggacgaaug

SEQ ID NO: 84167 - RNA, 19 nt, Homo sapiens
acaagaagguucgggaaga

SEQ ID NO: 84168 - RNA, 19 nt, Homo sapiens
gaacuccucgugugucaau

SEQ ID NO: 84169 - RNA, 19 nt, Homo sapiens
cauccagaaugucaucaaa

SEQ ID NO: 84170 - RNA, 19 nt, Homo sapiens
ggagcuuggugcugaccua

SEQ ID NO: 84171 - RNA, 19 nt, Homo sapiens
gggcagagacuccaagaca

SEQ ID NO: 84172 - RNA, 19 nt, Homo sapiens
caacacccuuggcagcuau

SEQ ID NO: 84173 - RNA, 19 nt, Homo sapiens
ggacgaaugucagcagaac

SEQ ID NO: 84174 - RNA, 19 nt, Homo sapiens
cagcagcuuuguacacgaa

SEQ ID NO: 84175 - RNA, 19 nt, Homo sapiens
gaggagauauaugaaagca

SEQ ID NO: 84176 - RNA, 19 nt, Homo sapiens
ggcagagacuccaagacaa

SEQ ID NO: 84177 - RNA, 19 nt, Homo sapiens
gugaagauaugacuuucuc

SEQ ID NO: 84178 - RNA, 19 nt, Homo sapiens
ggagcaaguacucagaauu

SEQ ID NO: 84179 - RNA, 19 nt, Homo sapiens
gaacuggaggagauauaug

SEQ ID NO: 84180 - RNA, 19 nt, Homo sapiens
cgagaacaccugucaagau

SEQ ID NO: 84181 - RNA, 19 nt, Homo sapiens
gcuuggugcugaccuaugu

SEQ ID NO: 84182 - RNA, 19 nt, Homo sapiens
auccagacaugaagaaauu

SEQ ID NO: 84183 - RNA, 19 nt, Homo sapiens
cagcauccgugguguccaa

SEQ ID NO: 84184 - RNA, 19 nt, Homo sapiens
gagcagcgcacgcaugaag

SEQ ID NO: 84185 - RNA, 19 nt, Homo sapiens
ucaacaccguggguucaua

SEQ ID NO: 84186 - RNA, 19 nt, Homo sapiens
gaacccaaggcucuguaaa

SEQ ID NO: 84187 - RNA, 19 nt, Homo sapiens
gaaagugucaugcggaaaa

SEQ ID NO: 84188 - RNA, 19 nt, Homo sapiens
ucgaaggccuggagcucua

SEQ ID NO: 84189 - RNA, 19 nt, Homo sapiens
ucaaauugguggaugaacu

SEQ ID NO: 84190 - RNA, 19 nt, Homo sapiens
ggugcugaccuauguguuu

SEQ ID NO: 84191 - RNA, 19 nt, Homo sapiens
ccagacaugaagaaauuaa

SEQ ID NO: 84192 - RNA, 19 nt, Homo sapiens
uccagaacaugacgacauu

SEQ ID NO: 84193 - RNA, 19 nt, Homo sapiens
gcagagacuccaagacaag

SEQ ID NO: 84194 - RNA, 19 nt, Homo sapiens
cagaacuccucguguguca

SEQ ID NO: 84195 - RNA, 19 nt, Homo sapiens
gggagcaaguacucagaau

SEQ ID NO: 84196 - RNA, 19 nt, Homo sapiens
gccuggagcucuacuuucu

SEQ ID NO: 84197 - RNA, 19 nt, Homo sapiens
gcacgcaugaagcugaauu

SEQ ID NO: 84198 - RNA, 19 nt, Homo sapiens
gcgcacgcaugaagcugaa

SEQ ID NO: 84199 - RNA, 19 nt, Homo sapiens
ggagacuugugacgacauc

SEQ ID NO: 84200 - RNA, 19 nt, Homo sapiens
agacacggaaucccgaaua

SEQ ID NO: 84201 - RNA, 19 nt, Homo sapiens
aaacaauaccgucugugaa

SEQ ID NO: 84202 - RNA, 19 nt, Homo sapiens
caacaacgugggcagcuau

SEQ ID NO: 84203 - RNA, 19 nt, Homo sapiens
ugaccuauguguuuaccau

SEQ ID NO: 84204 - RNA, 19 nt, Homo sapiens
ucgcgcagcucuuccuguu

SEQ ID NO: 84205 - RNA, 19 nt, Homo sapiens
cagagcagcgcacgcauga

SEQ ID NO: 84206 - RNA, 19 nt, Homo sapiens
cugcagaacugaagagacu

SEQ ID NO: 84207 - RNA, 19 nt, Homo sapiens
gggacaagaacgucacuau

SEQ ID NO: 84208 - RNA, 19 nt, Homo sapiens
uugaagauaucaugaggau

SEQ ID NO: 84209 - RNA, 19 nt, Homo sapiens
ucaacacccuuggcagcua

SEQ ID NO: 84210 - RNA, 19 nt, Homo sapiens
ggaagcucacucagaaguu

SEQ ID NO: 84211 - RNA, 19 nt, Homo sapiens
gagcagcuuugcgauccuu

SEQ ID NO: 84212 - RNA, 19 nt, Homo sapiens
ccacaacaacaccaaggaa

SEQ ID NO: 84213 - RNA, 19 nt, Homo sapiens
gccgucaacuccaucuuuc

SEQ ID NO: 84214 - RNA, 19 nt, Homo sapiens
uggaggagauauaugaaag

SEQ ID NO: 84215 - RNA, 19 nt, Homo sapiens
ucaacaacgugggcagcua

SEQ ID NO: 84216 - RNA, 19 nt, Homo sapiens
agaagguucgggaagaaua

SEQ ID NO: 84217 - RNA, 19 nt, Homo sapiens
gggcugcaccugggucuuu

SEQ ID NO: 84218 - RNA, 19 nt, Homo sapiens
cuggagcucuacuuucuug

SEQ ID NO: 84219 - RNA, 19 nt, Homo sapiens
ccuugaaccugcauuccaa

SEQ ID NO: 84220 - RNA, 19 nt, Homo sapiens
gugcaacaccgucgaaagu

SEQ ID NO: 84221 - RNA, 19 nt, Homo sapiens
ugugaagguuguagacguu

SEQ ID NO: 84222 - RNA, 19 nt, Homo sapiens
gcagccaccugagcagcuu

SEQ ID NO: 84223 - RNA, 19 nt, Homo sapiens
ccagaaugucaucaaauug

SEQ ID NO: 84224 - RNA, 19 nt, Homo sapiens
ccaauggcccaaacaauac

SEQ ID NO: 84225 - RNA, 19 nt, Homo sapiens
gacuggcgcugucacucuu

SEQ ID NO: 84226 - RNA, 19 nt, Homo sapiens
cgauccuuauggcucauua

SEQ ID NO: 84227 - RNA, 19 nt, Homo sapiens
caaauugguggaugaacug

SEQ ID NO: 84228 - RNA, 19 nt, Homo sapiens
cagaaugucaucaaauugg

SEQ ID NO: 84229 - RNA, 19 nt, Homo sapiens
gaggucaccauccagaaug

SEQ ID NO: 84230 - RNA, 19 nt, Homo sapiens
acaauaccgucugugaaga

SEQ ID NO: 84231 - RNA, 19 nt, Homo sapiens
uuguagacguuguguaaug

SEQ ID NO: 84232 - RNA, 19 nt, Homo sapiens
ugucuuugcugcagaacug

SEQ ID NO: 84233 - RNA, 19 nt, Homo sapiens
gggaguggcagcuauaguc

SEQ ID NO: 84234 - RNA, 19 nt, Homo sapiens
gcagcuuuguacacgaaga

SEQ ID NO: 84235 - RNA, 19 nt, Homo sapiens
guccacagccagacgcuuu

SEQ ID NO: 84236 - RNA, 19 nt, Homo sapiens
acacggagcucaaggagaa

SEQ ID NO: 84237 - RNA, 19 nt, Homo sapiens
gcacugcccuguucaugug

SEQ ID NO: 84238 - RNA, 19 nt, Homo sapiens
gagcugagaccacugagua

SEQ ID NO: 84239 - RNA, 19 nt, Homo sapiens
acauacaggugcucaauaa

SEQ ID NO: 84240 - RNA, 19 nt, Homo sapiens
ucaaguaccugcuguuuac

SEQ ID NO: 84241 - RNA, 19 nt, Homo sapiens
gaagccaggugagcucuga

SEQ ID NO: 84242 - RNA, 19 nt, Homo sapiens
gaccaugccuccaacaucu

SEQ ID NO: 84243 - RNA, 19 nt, Homo sapiens
ucacaggacuggcgagaca

SEQ ID NO: 84244 - RNA, 19 nt, Homo sapiens
gugcaggucuuuggcauga

SEQ ID NO: 84245 - RNA, 19 nt, Homo sapiens
caaccaucccugccacaua

SEQ ID NO: 84246 - RNA, 19 nt, Homo sapiens
gagaagaagacaacaugug

SEQ ID NO: 84247 - RNA, 19 nt, Homo sapiens
gcaggucuuuggcaugauc

SEQ ID NO: 84248 - RNA, 19 nt, Homo sapiens
caacauguggcaccguuug

SEQ ID NO: 84249 - RNA, 19 nt, Homo sapiens
ucaauaaacacuuguagag

SEQ ID NO: 84250 - RNA, 19 nt, Homo sapiens
uacaggugcucaauaaaca

SEQ ID NO: 84251 - RNA, 19 nt, Homo sapiens
ucaaggagaaccugaagga

SEQ ID NO: 84252 - RNA, 19 nt, Homo sapiens
ggaaccugcugcgccugua

SEQ ID NO: 84253 - RNA, 19 nt, Homo sapiens
guacccagaugccuacaac

SEQ ID NO: 84254 - RNA, 19 nt, Homo sapiens
ccucaagagugacuacauc

SEQ ID NO: 84255 - RNA, 19 nt, Homo sapiens
ggugcucaauaaacacuug

SEQ ID NO: 84256 - RNA, 19 nt, Homo sapiens
gucucaagcuggagcacua

SEQ ID NO: 84257 - RNA, 19 nt, Homo sapiens
gcggcugcaucaccaaguu

SEQ ID NO: 84258 - RNA, 19 nt, Homo sapiens
ugggugaguucaacgagaa

SEQ ID NO: 84259 - RNA, 19 nt, Homo sapiens
agacggugguggcucuuug

SEQ ID NO: 84260 - RNA, 19 nt, Homo sapiens
ugaaggacaccaugaccaa

SEQ ID NO: 84261 - RNA, 19 nt, Homo sapiens
caagcuggagcacuacuga

SEQ ID NO: 84262 - RNA, 19 nt, Homo sapiens
acacugcuguacccagaug

SEQ ID NO: 84263 - RNA, 19 nt, Homo sapiens
cacauacaggugcucaaua

SEQ ID NO: 84264 - RNA, 19 nt, Homo sapiens
ccacauacaggugcucaau

SEQ ID NO: 84265 - RNA, 19 nt, Homo sapiens
aaccaucccugccacauac

SEQ ID NO: 84266 - RNA, 19 nt, Homo sapiens
ccuccaacaucuacaaggu

SEQ ID NO: 84267 - RNA, 19 nt, Homo sapiens
gcaccguuugccucaagua

SEQ ID NO: 84268 - RNA, 19 nt, Homo sapiens
ggucagaugcagguuggaa

SEQ ID NO: 84269 - RNA, 19 nt, Homo sapiens
ggagaucaucgcugguauc

SEQ ID NO: 84270 - RNA, 19 nt, Homo sapiens
ccucaaguaccugcuguuu

SEQ ID NO: 84271 - RNA, 19 nt, Homo sapiens
cucaaguaccugcuguuua

SEQ ID NO: 84272 - RNA, 19 nt, Homo sapiens
gcucaauaaacacuuguag

SEQ ID NO: 84273 - RNA, 19 nt, Homo sapiens
gaaaugccacguggucacu

SEQ ID NO: 84274 - RNA, 19 nt, Homo sapiens
aaacacuuguagagcagau

SEQ ID NO: 84275 - RNA, 19 nt, Homo sapiens
acugugcacugcccuguuc

SEQ ID NO: 84276 - RNA, 19 nt, Homo sapiens
cauacaggugcucaauaaa

SEQ ID NO: 84277 - RNA, 19 nt, Homo sapiens
caggaugggugaguucaac

SEQ ID NO: 84278 - RNA, 19 nt, Homo sapiens
caaguuggagaccuucauc

SEQ ID NO: 84279 - RNA, 19 nt, Homo sapiens
gaguucaacgagaagaaga

SEQ ID NO: 84280 - RNA, 19 nt, Homo sapiens
ucuggacgcuggcccucaa

SEQ ID NO: 84281 - RNA, 19 nt, Homo sapiens
aguaccugcuguuuaccua

SEQ ID NO: 84282 - RNA, 19 nt, Homo sapiens
gcucaaggagaaccugaag

SEQ ID NO: 84283 - RNA, 19 nt, Homo sapiens
cgcuggcccucaagaguga

SEQ ID NO: 84284 - RNA, 19 nt, Homo sapiens
acacggagcucaaggagaa

SEQ ID NO: 84285 - RNA, 19 nt, Homo sapiens
gcacugcccuguucaugug

SEQ ID NO: 84286 - RNA, 19 nt, Homo sapiens
gagcugagaccacugagua

SEQ ID NO: 84287 - RNA, 19 nt, Homo sapiens
acauacaggugcucaauaa

SEQ ID NO: 84288 - RNA, 19 nt, Homo sapiens
ucaaguaccugcuguuuac

SEQ ID NO: 84289 - RNA, 19 nt, Homo sapiens
gaagccaggugagcucuga

SEQ ID NO: 84290 - RNA, 19 nt, Homo sapiens
gaccaugccuccaacaucu

SEQ ID NO: 84291 - RNA, 19 nt, Homo sapiens
ucacaggacuggcgagaca

SEQ ID NO: 84292 - RNA, 19 nt, Homo sapiens
gugcaggucuuuggcauga

SEQ ID NO: 84293 - RNA, 19 nt, Homo sapiens
caaccaucccugccacaua

SEQ ID NO: 84294 - RNA, 19 nt, Homo sapiens
gagaagaagacaacaugug

SEQ ID NO: 84295 - RNA, 19 nt, Homo sapiens
gcaggucuuuggcaugauc

SEQ ID NO: 84296 - RNA, 19 nt, Homo sapiens
caacauguggcaccguuug

SEQ ID NO: 84297 - RNA, 19 nt, Homo sapiens
ucaauaaacacuuguagag

SEQ ID NO: 84298 - RNA, 19 nt, Homo sapiens
uacaggugcucaauaaaca

SEQ ID NO: 84299 - RNA, 19 nt, Homo sapiens
ucaaggagaaccugaagga

SEQ ID NO: 84300 - RNA, 19 nt, Homo sapiens
ggaaccugcugcgccugua

SEQ ID NO: 84301 - RNA, 19 nt, Homo sapiens
guacccagaugccuacaac

SEQ ID NO: 84302 - RNA, 19 nt, Homo sapiens
ccucaagagugacuacauc

SEQ ID NO: 84303 - RNA, 19 nt, Homo sapiens
ggugcucaauaaacacuug

SEQ ID NO: 84304 - RNA, 19 nt, Homo sapiens
gucucaagcuggagcacua

SEQ ID NO: 84305 - RNA, 19 nt, Homo sapiens
gcggcugcaucaccaaguu

SEQ ID NO: 84306 - RNA, 19 nt, Homo sapiens
ugggugaguucaacgagaa

SEQ ID NO: 84307 - RNA, 19 nt, Homo sapiens
agacggugguggcucuuug

SEQ ID NO: 84308 - RNA, 19 nt, Homo sapiens
ugaaggacaccaugaccaa

SEQ ID NO: 84309 - RNA, 19 nt, Homo sapiens
caagcuggagcacuacuga

SEQ ID NO: 84310 - RNA, 19 nt, Homo sapiens
acacugcuguacccagaug

SEQ ID NO: 84311 - RNA, 19 nt, Homo sapiens
cacauacaggugcucaaua

SEQ ID NO: 84312 - RNA, 19 nt, Homo sapiens
ccacauacaggugcucaau

SEQ ID NO: 84313 - RNA, 19 nt, Homo sapiens
aaccaucccugccacauac

SEQ ID NO: 84314 - RNA, 19 nt, Homo sapiens
ccuccaacaucuacaaggu

SEQ ID NO: 84315 - RNA, 19 nt, Homo sapiens
gcaccguuugccucaagua

SEQ ID NO: 84316 - RNA, 19 nt, Homo sapiens
ggucagaugcagguuggaa

SEQ ID NO: 84317 - RNA, 19 nt, Homo sapiens
ccucaaguaccugcuguuu

SEQ ID NO: 84318 - RNA, 19 nt, Homo sapiens
ggagaucaucgcugguauc

SEQ ID NO: 84319 - RNA, 19 nt, Homo sapiens
cucaaguaccugcuguuua

SEQ ID NO: 84320 - RNA, 19 nt, Homo sapiens
gcucaauaaacacuuguag

SEQ ID NO: 84321 - RNA, 19 nt, Homo sapiens
gaaaugccacguggucacu

SEQ ID NO: 84322 - RNA, 19 nt, Homo sapiens
aaacacuuguagagcagau

SEQ ID NO: 84323 - RNA, 19 nt, Homo sapiens
acugugcacugcccuguuc

SEQ ID NO: 84324 - RNA, 19 nt, Homo sapiens
cauacaggugcucaauaaa

SEQ ID NO: 84325 - RNA, 19 nt, Homo sapiens
caggaugggugaguucaac

SEQ ID NO: 84326 - RNA, 19 nt, Homo sapiens
gaguucaacgagaagaaga

SEQ ID NO: 84327 - RNA, 19 nt, Homo sapiens
caaguuggagaccuucauc

SEQ ID NO: 84328 - RNA, 19 nt, Homo sapiens
ucuggacgcuggcccucaa

SEQ ID NO: 84329 - RNA, 19 nt, Homo sapiens
aguaccugcuguuuaccua

SEQ ID NO: 84330 - RNA, 19 nt, Homo sapiens
gcucaaggagaaccugaag

SEQ ID NO: 84331 - RNA, 19 nt, Homo sapiens
cgcuggcccucaagaguga

SEQ ID NO: 84332 - RNA, 19 nt, Homo sapiens
caaccugccuugggacuua

SEQ ID NO: 84333 - RNA, 19 nt, Homo sapiens
ccagugacaugcaagauga

SEQ ID NO: 84334 - RNA, 19 nt, Homo sapiens
cuggagaacuucauaaaga

SEQ ID NO: 84335 - RNA, 19 nt, Homo sapiens
gcaggcaagucaugagaga

SEQ ID NO: 84336 - RNA, 19 nt, Homo sapiens
aagaugauguuuccagauu

SEQ ID NO: 84337 - RNA, 19 nt, Homo sapiens
gaugguacguauauuguca

SEQ ID NO: 84338 - RNA, 19 nt, Homo sapiens
guaccaacauggcccagaa

SEQ ID NO: 84339 - RNA, 19 nt, Homo sapiens
gggcaaagaugauguuucc

SEQ ID NO: 84340 - RNA, 19 nt, Homo sapiens
caauugcuaucgccaguga

SEQ ID NO: 84341 - RNA, 19 nt, Homo sapiens
guacguauauugucaugac

SEQ ID NO: 84342 - RNA, 19 nt, Homo sapiens
ccagaaggccgucucagaa

SEQ ID NO: 84343 - RNA, 19 nt, Homo sapiens
ucagaaggguacaaggauu

SEQ ID NO: 84344 - RNA, 19 nt, Homo sapiens
cgagcaacuuuucuaauua

SEQ ID NO: 84345 - RNA, 19 nt, Homo sapiens
gaugauguuuccagauuac

SEQ ID NO: 84346 - RNA, 19 nt, Homo sapiens
cuucaaagggugcaacaua

SEQ ID NO: 84347 - RNA, 19 nt, Homo sapiens
agaugauguuuccagauua

SEQ ID NO: 84348 - RNA, 19 nt, Homo sapiens
ccaagguucuauccuguuc

SEQ ID NO: 84349 - RNA, 19 nt, Homo sapiens
caaagggugcaacauagaa

SEQ ID NO: 84350 - RNA, 19 nt, Homo sapiens
gaaugcccacugccuguaa

SEQ ID NO: 84351 - RNA, 19 nt, Homo sapiens
cagaaggguacaaggauuu

SEQ ID NO: 84352 - RNA, 19 nt, Homo sapiens
gcaagucaugagagaguuu

SEQ ID NO: 84353 - RNA, 19 nt, Homo sapiens
ggagaacuucauaaagaug

SEQ ID NO: 84354 - RNA, 19 nt, Homo sapiens
caagccggaugguacguau

SEQ ID NO: 84355 - RNA, 19 nt, Homo sapiens
ccgagcaacuuuucuaauu

SEQ ID NO: 84356 - RNA, 19 nt, Homo sapiens
uggagaacuucauaaagau

SEQ ID NO: 84357 - RNA, 19 nt, Homo sapiens
ggacugggcaaagaugaug

SEQ ID NO: 84358 - RNA, 19 nt, Homo sapiens
gagaacuucauaaagaugu

SEQ ID NO: 84359 - RNA, 19 nt, Homo sapiens
caacuggcccguguacaug

SEQ ID NO: 84360 - RNA, 19 nt, Homo sapiens
ccaccuggagaacuucaua

SEQ ID NO: 84361 - RNA, 19 nt, Homo sapiens
gauuuuaucucuccaugug

SEQ ID NO: 84362 - RNA, 19 nt, Homo sapiens
ucaaagggugcaacauaga

SEQ ID NO: 84363 - RNA, 19 nt, Homo sapiens
acagccaccuggagaacuu

SEQ ID NO: 84364 - RNA, 19 nt, Homo sapiens
gauuucagggcaauugcua

SEQ ID NO: 84365 - RNA, 19 nt, Homo sapiens
guaacagccaccuggagaa

SEQ ID NO: 84366 - RNA, 19 nt, Homo sapiens
uacagggacugggcaaaga

SEQ ID NO: 84367 - RNA, 19 nt, Homo sapiens
ccaacuggcccguguacau

SEQ ID NO: 84368 - RNA, 19 nt, Homo sapiens
gcaccaacuggcccgugua

SEQ ID NO: 84369 - RNA, 19 nt, Homo sapiens
cugcugcccuccuccuuug

SEQ ID NO: 84370 - RNA, 19 nt, Homo sapiens
ccaagaagucagccuacug

SEQ ID NO: 84371 - RNA, 19 nt, Homo sapiens
gugcugaacggaccgcuau

SEQ ID NO: 84372 - RNA, 19 nt, Homo sapiens
uucaaagggugcaacauag

SEQ ID NO: 84373 - RNA, 19 nt, Homo sapiens
ggccugaggaccugcagaa

SEQ ID NO: 84374 - RNA, 19 nt, Homo sapiens
aaagggugcaacauagaaa

SEQ ID NO: 84375 - RNA, 19 nt, Homo sapiens
cugaggaccugcagaagac

SEQ ID NO: 84376 - RNA, 19 nt, Homo sapiens
ccugaggaccugcagaaga

SEQ ID NO: 84377 - RNA, 19 nt, Homo sapiens
gcugcugcccuccuccuuu

SEQ ID NO: 84378 - RNA, 19 nt, Homo sapiens
ggcaagucaugagagaguu

SEQ ID NO: 84379 - RNA, 19 nt, Homo sapiens
ccggaugguacguauauug

SEQ ID NO: 84380 - RNA, 19 nt, Homo sapiens
gccagugacaugcaagaug

SEQ ID NO: 84381 - RNA, 19 nt, Homo sapiens
uaucgccagugacaugcaa

SEQ ID NO: 84382 - RNA, 19 nt, Homo sapiens
acaaggauuucagggcaau

SEQ ID NO: 84383 - RNA, 19 nt, Homo sapiens
ucucagaaggguacaagga

SEQ ID NO: 84384 - RNA, 19 nt, Homo sapiens
cagaaggccgucucagaag

SEQ ID NO: 84385 - RNA, 19 nt, Homo sapiens
gugacaugcaagaugauuu

SEQ ID NO: 84386 - RNA, 19 nt, Homo sapiens
ucagugacagccagagaau

SEQ ID NO: 84387 - RNA, 19 nt, Homo sapiens
ugacaugcaagaugauuuu

SEQ ID NO: 84388 - RNA, 19 nt, Homo sapiens
guacagaucuccagaagua

SEQ ID NO: 84389 - RNA, 19 nt, Homo sapiens
gaucaacucuucaggauuu

SEQ ID NO: 84390 - RNA, 19 nt, Homo sapiens
caauuaaacuggcugauuu

SEQ ID NO: 84391 - RNA, 19 nt, Homo sapiens
ccauggaucugaagaaaua

SEQ ID NO: 84392 - RNA, 19 nt, Homo sapiens
gguuauaucucaucuuuga

SEQ ID NO: 84393 - RNA, 19 nt, Homo sapiens
gaacuucgucauccaaaua

SEQ ID NO: 84394 - RNA, 19 nt, Homo sapiens
guacauggauucuucacuu

SEQ ID NO: 84395 - RNA, 19 nt, Homo sapiens
gaagguaccuauggaguug

SEQ ID NO: 84396 - RNA, 19 nt, Homo sapiens
ggccagaaguggaaucuuu

SEQ ID NO: 84397 - RNA, 19 nt, Homo sapiens
gacuaacuauggaagauua

SEQ ID NO: 84398 - RNA, 19 nt, Homo sapiens
gaugacaaaggaacaauua

SEQ ID NO: 84399 - RNA, 19 nt, Homo sapiens
cagguuauaucucaucuuu

SEQ ID NO: 84400 - RNA, 19 nt, Homo sapiens
guacuucgucuucuaauuu

SEQ ID NO: 84401 - RNA, 19 nt, Homo sapiens
uggaauaccuaucagagua

SEQ ID NO: 84402 - RNA, 19 nt, Homo sapiens
gaguauaggcaccauauuu

SEQ ID NO: 84403 - RNA, 19 nt, Homo sapiens
ccuauggaguuguguauaa

SEQ ID NO: 84404 - RNA, 19 nt, Homo sapiens
ucgggaaauuucucuauua

SEQ ID NO: 84405 - RNA, 19 nt, Homo sapiens
caaacgaauuucuggcaaa

SEQ ID NO: 84406 - RNA, 19 nt, Homo sapiens
guauaaggguagacacaaa

SEQ ID NO: 84407 - RNA, 19 nt, Homo sapiens
caccauauuugcugaacua

SEQ ID NO: 84408 - RNA, 19 nt, Homo sapiens
cgggaaauuucucuauuaa

SEQ ID NO: 84409 - RNA, 19 nt, Homo sapiens
gaucuaccauacccauuga

SEQ ID NO: 84410 - RNA, 19 nt, Homo sapiens
uuaagaagauguagcuuuc

SEQ ID NO: 84411 - RNA, 19 nt, Homo sapiens
gagcgacgcgguuguugua

SEQ ID NO: 84412 - RNA, 19 nt, Homo sapiens
gauguagcuuucugacaaa

SEQ ID NO: 84413 - RNA, 19 nt, Homo sapiens
agaaauugaucaacucuuc

SEQ ID NO: 84414 - RNA, 19 nt, Homo sapiens
agauguagcuuucugacaa

SEQ ID NO: 84415 - RNA, 19 nt, Homo sapiens
gcacugaaucauccauauu

SEQ ID NO: 84416 - RNA, 19 nt, Homo sapiens
ccaaauauagucagucuuc

SEQ ID NO: 84417 - RNA, 19 nt, Homo sapiens
gcaacuaagaaaccacuuu

SEQ ID NO: 84418 - RNA, 19 nt, Homo sapiens
aaagcuggcucuuggaaau

SEQ ID NO: 84419 - RNA, 19 nt, Homo sapiens
uaugcaggauuccagguua

SEQ ID NO: 84420 - RNA, 19 nt, Homo sapiens
uaccauacccauugacuaa

SEQ ID NO: 84421 - RNA, 19 nt, Homo sapiens
ugccagagcuuuuggaaua

SEQ ID NO: 84422 - RNA, 19 nt, Homo sapiens
caaaggaacaauuaaacug

SEQ ID NO: 84423 - RNA, 19 nt, Homo sapiens
ggaacuucgucauccaaau

SEQ ID NO: 84424 - RNA, 19 nt, Homo sapiens
ugaacuagcaacuaagaaa

SEQ ID NO: 84425 - RNA, 19 nt, Homo sapiens
gauuccagguuauaucuca

SEQ ID NO: 84426 - RNA, 19 nt, Homo sapiens
gauccagccaaacgaauuu

SEQ ID NO: 84427 - RNA, 19 nt, Homo sapiens
gccagaaguggaaucuuua

SEQ ID NO: 84428 - RNA, 19 nt, Homo sapiens
cuucacuuguuaagaguua

SEQ ID NO: 84429 - RNA, 19 nt, Homo sapiens
ccaguugacauuuggagua

SEQ ID NO: 84430 - RNA, 19 nt, Homo sapiens
gucaguacauggauucuuc

SEQ ID NO: 84431 - RNA, 19 nt, Homo sapiens
guacugcaauucgggaaau

SEQ ID NO: 84432 - RNA, 19 nt, Homo sapiens
uuaucaaacuucagcugua

SEQ ID NO: 84433 - RNA, 19 nt, Homo sapiens
cugaagaaauacuuggauu

SEQ ID NO: 84434 - RNA, 19 nt, Homo sapiens
ggaucuaccauacccauug

SEQ ID NO: 84435 - RNA, 19 nt, Homo sapiens
gaaauugaucaacucuuca

SEQ ID NO: 84436 - RNA, 19 nt, Homo sapiens
guugacauuuggaguauag

SEQ ID NO: 84437 - RNA, 19 nt, Homo sapiens
cauggauucuucacuuguu

SEQ ID NO: 84438 - RNA, 19 nt, Homo sapiens
acuagaaagugaagaggaa

SEQ ID NO: 84439 - RNA, 19 nt, Homo sapiens
aaaucagacuagaaaguga

SEQ ID NO: 84440 - RNA, 19 nt, Homo sapiens
gaacuagcaacuaagaaac

SEQ ID NO: 84441 - RNA, 19 nt, Homo sapiens
cacugaaucauccauauuu

SEQ ID NO: 84442 - RNA, 19 nt, Homo sapiens
ggcacugaaucauccauau

SEQ ID NO: 84443 - RNA, 19 nt, Homo sapiens
caaauauagucagucuuca

SEQ ID NO: 84444 - RNA, 19 nt, Homo sapiens
gacaaaggaacaauuaaac

SEQ ID NO: 84445 - RNA, 19 nt, Homo sapiens
ucucuugauugaugacaaa

SEQ ID NO: 84446 - RNA, 19 nt, Homo sapiens
gaaauacuuggauucuauc

SEQ ID NO: 84447 - RNA, 19 nt, Homo sapiens
ggagagcgacgcgguuguu

SEQ ID NO: 84448 - RNA, 19 nt, Homo sapiens
aaucuaugauccagccaaa

SEQ ID NO: 84449 - RNA, 19 nt, Homo sapiens
gcuuggauuugcucucgaa

SEQ ID NO: 84450 - RNA, 19 nt, Homo sapiens
ccuagcaucccaugucaaa

SEQ ID NO: 84451 - RNA, 19 nt, Homo sapiens
gcugaacuagcaacuaaga

SEQ ID NO: 84452 - RNA, 19 nt, Homo sapiens
aacuacaggucaaguggua

SEQ ID NO: 84453 - RNA, 19 nt, Homo sapiens
cagaguauauacacaugag

SEQ ID NO: 84454 - RNA, 19 nt, Homo sapiens
acaauuaaacuggcugauu

SEQ ID NO: 84455 - RNA, 19 nt, Homo sapiens
uauagucagucuucaggau

SEQ ID NO: 84456 - RNA, 19 nt, Homo sapiens
gcuguacuucgucuucuaa

SEQ ID NO: 84457 - RNA, 19 nt, Homo sapiens
auauacacaugagguagua

SEQ ID NO: 84458 - RNA, 19 nt, Homo sapiens
uggagaagguaccuaugga

SEQ ID NO: 84459 - RNA, 19 nt, Homo sapiens
cauacccauugacuaacua

SEQ ID NO: 84460 - RNA, 19 nt, Homo sapiens
caguugacauuuggaguau

SEQ ID NO: 84461 - RNA, 19 nt, Homo sapiens
uacauggauucuucacuug

SEQ ID NO: 84462 - RNA, 19 nt, Homo sapiens
caaagcuggcucuuggaaa

SEQ ID NO: 84463 - RNA, 19 nt, Homo sapiens
ccauggggauucagaaauu

SEQ ID NO: 84464 - RNA, 19 nt, Homo sapiens
ggaguauaggcaccauauu

SEQ ID NO: 84465 - RNA, 19 nt, Homo sapiens
guaguaacacucugguaca

SEQ ID NO: 84466 - RNA, 19 nt, Homo sapiens
ucaaagcuggcucuuggaa

SEQ ID NO: 84467 - RNA, 19 nt, Homo sapiens
ucaagugguagccaugaaa

SEQ ID NO: 84468 - RNA, 19 nt, Homo sapiens
cuugauugaugacaaagga

SEQ ID NO: 84469 - RNA, 19 nt, Homo sapiens
ugaagaaauacuuggauuc

SEQ ID NO: 84470 - RNA, 19 nt, Homo sapiens
gcaggauuccagguuauau

SEQ ID NO: 84471 - RNA, 19 nt, Homo sapiens
uguacuucgucuucuaauu

SEQ ID NO: 84472 - RNA, 19 nt, Homo sapiens
uaucaaacuucagcuguac

SEQ ID NO: 84473 - RNA, 19 nt, Homo sapiens
uggaaucuuuacaggacua

SEQ ID NO: 84474 - RNA, 19 nt, Homo sapiens
caacuaagaaaccacuuuu

SEQ ID NO: 84475 - RNA, 19 nt, Homo sapiens
acagaucuccagaaguauu

SEQ ID NO: 84476 - RNA, 19 nt, Homo sapiens
guaccuauggaguugugua

SEQ ID NO: 84477 - RNA, 19 nt, Homo sapiens
gaaaccaggaagccuagca

SEQ ID NO: 84478 - RNA, 19 nt, Homo sapiens
aguauaggcaccauauuug

SEQ ID NO: 84479 - RNA, 19 nt, Homo sapiens
cacaugagguaguaacacu

SEQ ID NO: 84480 - RNA, 19 nt, Homo sapiens
ggggucagcucguuacuca

SEQ ID NO: 84481 - RNA, 19 nt, Homo sapiens
uugaucaacucuucaggau

SEQ ID NO: 84482 - RNA, 19 nt, Homo sapiens
gucaagugguagccaugaa

SEQ ID NO: 84483 - RNA, 19 nt, Homo sapiens
aauaauaagccgggaucua

SEQ ID NO: 84484 - RNA, 19 nt, Homo sapiens
ggaugaaaauggcuuggau

SEQ ID NO: 84485 - RNA, 19 nt, Homo sapiens
gcacucccaauaaugaagu

SEQ ID NO: 84486 - RNA, 19 nt, Homo sapiens
ggauucagaaauugaucaa

SEQ ID NO: 84487 - RNA, 19 nt, Homo sapiens
auggauucuucacuuguua

SEQ ID NO: 84488 - RNA, 19 nt, Homo sapiens
guacagaucuccagaagua

SEQ ID NO: 84489 - RNA, 19 nt, Homo sapiens
gaucaacucuucaggauuu

SEQ ID NO: 84490 - RNA, 19 nt, Homo sapiens
ccauggaucugaagaaaua

SEQ ID NO: 84491 - RNA, 19 nt, Homo sapiens
gguuauaucucaucuuuga

SEQ ID NO: 84492 - RNA, 19 nt, Homo sapiens
gaacuucgucauccaaaua

SEQ ID NO: 84493 - RNA, 19 nt, Homo sapiens
guacauggauucuucacuu

SEQ ID NO: 84494 - RNA, 19 nt, Homo sapiens
gaagguaccuauggaguug

SEQ ID NO: 84495 - RNA, 19 nt, Homo sapiens
ggccagaaguggaaucuuu

SEQ ID NO: 84496 - RNA, 19 nt, Homo sapiens
gacuaacuauggaagauua

SEQ ID NO: 84497 - RNA, 19 nt, Homo sapiens
cagguuauaucucaucuuu

SEQ ID NO: 84498 - RNA, 19 nt, Homo sapiens
guacuucgucuucuaauuu

SEQ ID NO: 84499 - RNA, 19 nt, Homo sapiens
gaguauaggcaccauauuu

SEQ ID NO: 84500 - RNA, 19 nt, Homo sapiens
ccuauggaguuguguauaa

SEQ ID NO: 84501 - RNA, 19 nt, Homo sapiens
ucgggaaauuucucuauua

SEQ ID NO: 84502 - RNA, 19 nt, Homo sapiens
caaacgaauuucuggcaaa

SEQ ID NO: 84503 - RNA, 19 nt, Homo sapiens
guauaaggguagacacaaa

SEQ ID NO: 84504 - RNA, 19 nt, Homo sapiens
caccauauuugcugaacua

SEQ ID NO: 84505 - RNA, 19 nt, Homo sapiens
cgggaaauuucucuauuaa

SEQ ID NO: 84506 - RNA, 19 nt, Homo sapiens
uuaagaagauguagcuuuc

SEQ ID NO: 84507 - RNA, 19 nt, Homo sapiens
gauguagcuuucugacaaa

SEQ ID NO: 84508 - RNA, 19 nt, Homo sapiens
agaaauugaucaacucuuc

SEQ ID NO: 84509 - RNA, 19 nt, Homo sapiens
agauguagcuuucugacaa

SEQ ID NO: 84510 - RNA, 19 nt, Homo sapiens
gcacugaaucauccauauu

SEQ ID NO: 84511 - RNA, 19 nt, Homo sapiens
ccaaauauagucagucuuc

SEQ ID NO: 84512 - RNA, 19 nt, Homo sapiens
gcaacuaagaaaccacuuu

SEQ ID NO: 84513 - RNA, 19 nt, Homo sapiens
uaugcaggauuccagguua

SEQ ID NO: 84514 - RNA, 19 nt, Homo sapiens
ggaacuucgucauccaaau

SEQ ID NO: 84515 - RNA, 19 nt, Homo sapiens
ugaacuagcaacuaagaaa

SEQ ID NO: 84516 - RNA, 19 nt, Homo sapiens
gauuccagguuauaucuca

SEQ ID NO: 84517 - RNA, 19 nt, Homo sapiens
gauccagccaaacgaauuu

SEQ ID NO: 84518 - RNA, 19 nt, Homo sapiens
gccagaaguggaaucuuua

SEQ ID NO: 84519 - RNA, 19 nt, Homo sapiens
ccaguugacauuuggagua

SEQ ID NO: 84520 - RNA, 19 nt, Homo sapiens
gucaguacauggauucuuc

SEQ ID NO: 84521 - RNA, 19 nt, Homo sapiens
guacugcaauucgggaaau

SEQ ID NO: 84522 - RNA, 19 nt, Homo sapiens
uuaucaaacuucagcugua

SEQ ID NO: 84523 - RNA, 19 nt, Homo sapiens
cugaagaaauacuuggauu

SEQ ID NO: 84524 - RNA, 19 nt, Homo sapiens
gaaauugaucaacucuuca

SEQ ID NO: 84525 - RNA, 19 nt, Homo sapiens
guugacauuuggaguauag

SEQ ID NO: 84526 - RNA, 19 nt, Homo sapiens
cauggauucuucacuuguu

SEQ ID NO: 84527 - RNA, 19 nt, Homo sapiens
acuagaaagugaagaggaa

SEQ ID NO: 84528 - RNA, 19 nt, Homo sapiens
aaaucagacuagaaaguga

SEQ ID NO: 84529 - RNA, 19 nt, Homo sapiens
gaacuagcaacuaagaaac

SEQ ID NO: 84530 - RNA, 19 nt, Homo sapiens
cacugaaucauccauauuu

SEQ ID NO: 84531 - RNA, 19 nt, Homo sapiens
ggcacugaaucauccauau

SEQ ID NO: 84532 - RNA, 19 nt, Homo sapiens
caaauauagucagucuuca

SEQ ID NO: 84533 - RNA, 19 nt, Homo sapiens
gaaauacuuggauucuauc

SEQ ID NO: 84534 - RNA, 19 nt, Homo sapiens
aaucuaugauccagccaaa

SEQ ID NO: 84535 - RNA, 19 nt, Homo sapiens
gcuuggauuugcucucgaa

SEQ ID NO: 84536 - RNA, 19 nt, Homo sapiens
ccuagcaucccaugucaaa

SEQ ID NO: 84537 - RNA, 19 nt, Homo sapiens
aacuacaggucaaguggua

SEQ ID NO: 84538 - RNA, 19 nt, Homo sapiens
gcugaacuagcaacuaaga

SEQ ID NO: 84539 - RNA, 19 nt, Homo sapiens
uauagucagucuucaggau

SEQ ID NO: 84540 - RNA, 19 nt, Homo sapiens
gcuguacuucgucuucuaa

SEQ ID NO: 84541 - RNA, 19 nt, Homo sapiens
uggagaagguaccuaugga

SEQ ID NO: 84542 - RNA, 19 nt, Homo sapiens
caguugacauuuggaguau

SEQ ID NO: 84543 - RNA, 19 nt, Homo sapiens
uacauggauucuucacuug

SEQ ID NO: 84544 - RNA, 19 nt, Homo sapiens
ccauggggauucagaaauu

SEQ ID NO: 84545 - RNA, 19 nt, Homo sapiens
ggaguauaggcaccauauu

SEQ ID NO: 84546 - RNA, 19 nt, Homo sapiens
ucaagugguagccaugaaa

SEQ ID NO: 84547 - RNA, 19 nt, Homo sapiens
guaguaacacucugguaca

SEQ ID NO: 84548 - RNA, 19 nt, Homo sapiens
ugaagaaauacuuggauuc

SEQ ID NO: 84549 - RNA, 19 nt, Homo sapiens
gcaggauuccagguuauau

SEQ ID NO: 84550 - RNA, 19 nt, Homo sapiens
uguacuucgucuucuaauu

SEQ ID NO: 84551 - RNA, 19 nt, Homo sapiens
uaucaaacuucagcuguac

SEQ ID NO: 84552 - RNA, 19 nt, Homo sapiens
guaccuauggaguugugua

SEQ ID NO: 84553 - RNA, 19 nt, Homo sapiens
uggaaucuuuacaggacua

SEQ ID NO: 84554 - RNA, 19 nt, Homo sapiens
caacuaagaaaccacuuuu

SEQ ID NO: 84555 - RNA, 19 nt, Homo sapiens
acagaucuccagaaguauu

SEQ ID NO: 84556 - RNA, 19 nt, Homo sapiens
gaaaccaggaagccuagca

SEQ ID NO: 84557 - RNA, 19 nt, Homo sapiens
aguauaggcaccauauuug

SEQ ID NO: 84558 - RNA, 19 nt, Homo sapiens
ggggucagcucguuacuca

SEQ ID NO: 84559 - RNA, 19 nt, Homo sapiens
gucaagugguagccaugaa

SEQ ID NO: 84560 - RNA, 19 nt, Homo sapiens
uugaucaacucuucaggau

SEQ ID NO: 84561 - RNA, 19 nt, Homo sapiens
ggaugaaaauggcuuggau

SEQ ID NO: 84562 - RNA, 19 nt, Homo sapiens
gcacucccaauaaugaagu

SEQ ID NO: 84563 - RNA, 19 nt, Homo sapiens
ggauucagaaauugaucaa

SEQ ID NO: 84564 - RNA, 19 nt, Homo sapiens
agaagguaccuauggaguu

SEQ ID NO: 84565 - RNA, 19 nt, Homo sapiens
uuaaaggaacuucgucauc

SEQ ID NO: 84566 - RNA, 19 nt, Homo sapiens
auggauucuucacuuguua

SEQ ID NO: 84567 - RNA, 19 nt, Homo sapiens
uuccauggaucugaagaaa

SEQ ID NO: 84568 - RNA, 19 nt, Homo sapiens
gcaaaauggcacugaauca

SEQ ID NO: 84569 - RNA, 19 nt, Homo sapiens
aaaggaacuucgucaucca

SEQ ID NO: 84570 - RNA, 19 nt, Homo sapiens
acacaaaacuacaggucaa

SEQ ID NO: 84571 - RNA, 19 nt, Homo sapiens
ggucaagugguagccauga

SEQ ID NO: 84572 - RNA, 19 nt, Homo sapiens
ggucagcucguuacucaac

SEQ ID NO: 84573 - RNA, 19 nt, Homo sapiens
aaacgaauuucuggcaaaa

SEQ ID NO: 84574 - RNA, 19 nt, Homo sapiens
gcaccauauuugcugaacu

SEQ ID NO: 84575 - RNA, 19 nt, Homo sapiens
auucuucacuuguuaaggu

SEQ ID NO: 84576 - RNA, 19 nt, Homo sapiens
ucaaacuucagcuguacuu

SEQ ID NO: 84577 - RNA, 19 nt, Homo sapiens
aaugaaguguggccagaag

SEQ ID NO: 84578 - RNA, 19 nt, Homo sapiens
cagaucuccagaaguauug

SEQ ID NO: 84579 - RNA, 19 nt, Homo sapiens
ugacuaacuauggaagauu

SEQ ID NO: 84580 - RNA, 19 nt, Homo sapiens
uagucagucuucaggaugu

SEQ ID NO: 84581 - RNA, 19 nt, Homo sapiens
ugauccagccaaacgaauu

SEQ ID NO: 84582 - RNA, 19 nt, Homo sapiens
gggcacucccaauaaugaa

SEQ ID NO: 84583 - RNA, 19 nt, Homo sapiens
uacuucgucuucuaauuuc

SEQ ID NO: 84584 - RNA, 19 nt, Homo sapiens
gggauucagaaauugauca

SEQ ID NO: 84585 - RNA, 19 nt, Homo sapiens
uggaguauaggcaccauau

SEQ ID NO: 84586 - RNA, 19 nt, Homo sapiens
ugguacagaucuccagaag

SEQ ID NO: 84587 - RNA, 19 nt, Homo sapiens
ccuggucaguacauggauu

SEQ ID NO: 84588 - RNA, 19 nt, Homo sapiens
gaaacgacaucgagaagaa

SEQ ID NO: 84589 - RNA, 19 nt, Homo sapiens
gcaaaugucucggaaagaa

SEQ ID NO: 84590 - RNA, 19 nt, Homo sapiens
gagacgggcuuccaccuua

SEQ ID NO: 84591 - RNA, 19 nt, Homo sapiens
gcagaagccagcacaguua

SEQ ID NO: 84592 - RNA, 19 nt, Homo sapiens
gaagcaugcuagagugaaa

SEQ ID NO: 84593 - RNA, 19 nt, Homo sapiens
gaaaacagaugaaauugug

SEQ ID NO: 84594 - RNA, 19 nt, Homo sapiens
gagcaccagugaagaauca

SEQ ID NO: 84595 - RNA, 19 nt, Homo sapiens
gcauggagaucacaauaag

SEQ ID NO: 84596 - RNA, 19 nt, Homo sapiens
ugaaacaccugcacgacaa

SEQ ID NO: 84597 - RNA, 19 nt, Homo sapiens
uaaagcggcugaagaugga

SEQ ID NO: 84598 - RNA, 19 nt, Homo sapiens
gaaaaggacucuuggaaag

SEQ ID NO: 84599 - RNA, 19 nt, Homo sapiens
agaaaugagugaagaugaa

SEQ ID NO: 84600 - RNA, 19 nt, Homo sapiens
gcagcaacauggacaagau

SEQ ID NO: 84601 - RNA, 19 nt, Homo sapiens
gagugaagaugaagaacga

SEQ ID NO: 84602 - RNA, 19 nt, Homo sapiens
gaagggagcaccagugaag

SEQ ID NO: 84603 - RNA, 19 nt, Homo sapiens
uaacucaaaugggugauga

SEQ ID NO: 84604 - RNA, 19 nt, Homo sapiens
ggaguggucuacagagcaa

SEQ ID NO: 84605 - RNA, 19 nt, Homo sapiens
gaagaugaagaacgagaaa

SEQ ID NO: 84606 - RNA, 19 nt, Homo sapiens
gcacgaacgucggaaacga

SEQ ID NO: 84607 - RNA, 19 nt, Homo sapiens
gagaagacucuauggaaga

SEQ ID NO: 84608 - RNA, 19 nt, Homo sapiens
ggaaggaacaagaggagaa

SEQ ID NO: 84609 - RNA, 19 nt, Homo sapiens
cagcaaaugucucggaaag

SEQ ID NO: 84610 - RNA, 19 nt, Homo sapiens
gaagaaaugagugaagaug

SEQ ID NO: 84611 - RNA, 19 nt, Homo sapiens
cagaaaagaugaaaagaga

SEQ ID NO: 84612 - RNA, 19 nt, Homo sapiens
agaaguaagugaggaagaa

SEQ ID NO: 84613 - RNA, 19 nt, Homo sapiens
gagaaacguaggcaucgua

SEQ ID NO: 84614 - RNA, 19 nt, Homo sapiens
ggaagacagaggagaagaa

SEQ ID NO: 84615 - RNA, 19 nt, Homo sapiens
ugacagagggcgacuaugu

SEQ ID NO: 84616 - RNA, 19 nt, Homo sapiens
ggacuacagcgacaaagug

SEQ ID NO: 84617 - RNA, 19 nt, Homo sapiens
gaaggaacaagaggagaaa

SEQ ID NO: 84618 - RNA, 19 nt, Homo sapiens
ggaagugucugcacaucac

SEQ ID NO: 84619 - RNA, 19 nt, Homo sapiens
gagaagaacaggauaaagc

SEQ ID NO: 84620 - RNA, 19 nt, Homo sapiens
ggagaaagcagagauaaaa

SEQ ID NO: 84621 - RNA, 19 nt, Homo sapiens
ugaagaagcagaggaagaa

SEQ ID NO: 84622 - RNA, 19 nt, Homo sapiens
gagcauuccaggagagaaa

SEQ ID NO: 84623 - RNA, 19 nt, Homo sapiens
gaggagaaagcagagauaa

SEQ ID NO: 84624 - RNA, 19 nt, Homo sapiens
gcuucgaccucaugaacaa

SEQ ID NO: 84625 - RNA, 19 nt, Homo sapiens
aaggagggcuucccgauca

SEQ ID NO: 84626 - RNA, 19 nt, Homo sapiens
caacaucgucaccguuaga

SEQ ID NO: 84627 - RNA, 19 nt, Homo sapiens
ugagggagaucaacaccau

SEQ ID NO: 84628 - RNA, 19 nt, Homo sapiens
gaaguaagugaggaagaaa

SEQ ID NO: 84629 - RNA, 19 nt, Homo sapiens
cuacagcgacaaagugaaa

SEQ ID NO: 84630 - RNA, 19 nt, Homo sapiens
gaacgaugagagaggacua

SEQ ID NO: 84631 - RNA, 19 nt, Homo sapiens
aaaggacucuuggaaagug

SEQ ID NO: 84632 - RNA, 19 nt, Homo sapiens
ggcugaagauggagaagga

SEQ ID NO: 84633 - RNA, 19 nt, Homo sapiens
gcucuaaagcggcugaaga

SEQ ID NO: 84634 - RNA, 19 nt, Homo sapiens
gaucaacaccauccucaag

SEQ ID NO: 84635 - RNA, 19 nt, Homo sapiens
gaugaaauuguggcucuaa

SEQ ID NO: 84636 - RNA, 19 nt, Homo sapiens
agacagaggagaagaagau

SEQ ID NO: 84637 - RNA, 19 nt, Homo sapiens
gaggugaagacccugauga

SEQ ID NO: 84638 - RNA, 19 nt, Homo sapiens
ggaggaggaggaagaggaa

SEQ ID NO: 84639 - RNA, 19 nt, Homo sapiens
gaaucaggcucagguucug

SEQ ID NO: 84640 - RNA, 19 nt, Homo sapiens
agucagaaaucgaucagau

SEQ ID NO: 84641 - RNA, 19 nt, Homo sapiens
ucacgucgcugagggagau

SEQ ID NO: 84642 - RNA, 19 nt, Homo sapiens
ggaaacgacaucgagaaga

SEQ ID NO: 84643 - RNA, 19 nt, Homo sapiens
gucaguggguugcaucuuc

SEQ ID NO: 84644 - RNA, 19 nt, Homo sapiens
ugaagacccugaugaucca

SEQ ID NO: 84645 - RNA, 19 nt, Homo sapiens
gaaauuguggcucuaaagc

SEQ ID NO: 84646 - RNA, 19 nt, Homo sapiens
ucaaaugggugaugaaaag

SEQ ID NO: 84647 - RNA, 19 nt, Homo sapiens
gaagaacgagaaaaugaaa

SEQ ID NO: 84648 - RNA, 19 nt, Homo sapiens
ggaagaaaugagugaagau

SEQ ID NO: 84649 - RNA, 19 nt, Homo sapiens
agacagaagagaagggaaa

SEQ ID NO: 84650 - RNA, 19 nt, Homo sapiens
gaaugggaaagacagaaga

SEQ ID NO: 84651 - RNA, 19 nt, Homo sapiens
caaaugucucggaaagaaa

SEQ ID NO: 84652 - RNA, 19 nt, Homo sapiens
gaagacagaggagaagaag

SEQ ID NO: 84653 - RNA, 19 nt, Homo sapiens
gcaacauggacaagaucua

SEQ ID NO: 84654 - RNA, 19 nt, Homo sapiens
aggaagaaaugagugaaga

SEQ ID NO: 84655 - RNA, 19 nt, Homo sapiens
gaggagaagaagaugauuc

SEQ ID NO: 84656 - RNA, 19 nt, Homo sapiens
auaaggaacuccccguaua

SEQ ID NO: 84657 - RNA, 19 nt, Homo sapiens
ggagacgggcuuccaccuu

SEQ ID NO: 84658 - RNA, 19 nt, Homo sapiens
ggaagucagaaaucgauca

SEQ ID NO: 84659 - RNA, 19 nt, Homo sapiens
cccaacaucgucaccguua

SEQ ID NO: 84660 - RNA, 19 nt, Homo sapiens
gagugaagaagcagaggaa

SEQ ID NO: 84661 - RNA, 19 nt, Homo sapiens
ccgcauggagaucacaaua

SEQ ID NO: 84662 - RNA, 19 nt, Homo sapiens
caaaagacaagaaaacaga

SEQ ID NO: 84663 - RNA, 19 nt, Homo sapiens
gaucgaggagggcaccuau

SEQ ID NO: 84664 - RNA, 19 nt, Homo sapiens
gaaaugagugaagaugaag

SEQ ID NO: 84665 - RNA, 19 nt, Homo sapiens
ggaagaggaggaggaggaa

SEQ ID NO: 84666 - RNA, 19 nt, Homo sapiens
cagaagccagcacaguuaa

SEQ ID NO: 84667 - RNA, 19 nt, Homo sapiens
gggaaagacagaagagaag

SEQ ID NO: 84668 - RNA, 19 nt, Homo sapiens
gaagagaaaauggaagaaa

SEQ ID NO: 84669 - RNA, 19 nt, Homo sapiens
caugcuagagugaaagaaa

SEQ ID NO: 84670 - RNA, 19 nt, Homo sapiens
cgucaccguuagagagauu

SEQ ID NO: 84671 - RNA, 19 nt, Homo sapiens
gugaagaagcagaggaaga

SEQ ID NO: 84672 - RNA, 19 nt, Homo sapiens
cgaagaaguaagugaggaa

SEQ ID NO: 84673 - RNA, 19 nt, Homo sapiens
gagaucaccgcauggagau

SEQ ID NO: 84674 - RNA, 19 nt, Homo sapiens
gacuacagcgacaaaguga

SEQ ID NO: 84675 - RNA, 19 nt, Homo sapiens
ggaaugggaaagacagaag

SEQ ID NO: 84676 - RNA, 19 nt, Homo sapiens
ggaagcaugcuagagugaa

SEQ ID NO: 84677 - RNA, 19 nt, Homo sapiens
ggaacaagaggagaaagca

SEQ ID NO: 84678 - RNA, 19 nt, Homo sapiens
caacauggacaagaucuac

SEQ ID NO: 84679 - RNA, 19 nt, Homo sapiens
gaaacgaaggaaggaacaa

SEQ ID NO: 84680 - RNA, 19 nt, Homo sapiens
ggaagggagcaccagugaa

SEQ ID NO: 84681 - RNA, 19 nt, Homo sapiens
gggaagcaugcuagaguga

SEQ ID NO: 84682 - RNA, 19 nt, Homo sapiens
guaagugaggaagaaauga

SEQ ID NO: 84683 - RNA, 19 nt, Homo sapiens
gcagaaucaggcucagguu

SEQ ID NO: 84684 - RNA, 19 nt, Homo sapiens
ggaccgcuuggagcaguua

SEQ ID NO: 84685 - RNA, 19 nt, Homo sapiens
cagaggagaagaagaugau

SEQ ID NO: 84686 - RNA, 19 nt, Homo sapiens
aggacggccucaagcauga

SEQ ID NO: 84687 - RNA, 19 nt, Homo sapiens
gcaccuauggaguggucua

SEQ ID NO: 84688 - RNA, 19 nt, Homo sapiens
gaaacgacaucgagaagaa

SEQ ID NO: 84689 - RNA, 19 nt, Homo sapiens
gcaaaugucucggaaagaa

SEQ ID NO: 84690 - RNA, 19 nt, Homo sapiens
gagacgggcuuccaccuua

SEQ ID NO: 84691 - RNA, 19 nt, Homo sapiens
gaagcaugcuagagugaaa

SEQ ID NO: 84692 - RNA, 19 nt, Homo sapiens
gaaaacagaugaaauugug

SEQ ID NO: 84693 - RNA, 19 nt, Homo sapiens
gagcaccagugaagaauca

SEQ ID NO: 84694 - RNA, 19 nt, Homo sapiens
gcauggagaucacaauaag

SEQ ID NO: 84695 - RNA, 19 nt, Homo sapiens
ugaaacaccugcacgacaa

SEQ ID NO: 84696 - RNA, 19 nt, Homo sapiens
uaaagcggcugaagaugga

SEQ ID NO: 84697 - RNA, 19 nt, Homo sapiens
gaaaaggacucuuggaaag

SEQ ID NO: 84698 - RNA, 19 nt, Homo sapiens
agaaaugagugaagaugaa

SEQ ID NO: 84699 - RNA, 19 nt, Homo sapiens
gcagcaacauggacaagau

SEQ ID NO: 84700 - RNA, 19 nt, Homo sapiens
gagugaagaugaagaacga

SEQ ID NO: 84701 - RNA, 19 nt, Homo sapiens
gaagggagcaccagugaag

SEQ ID NO: 84702 - RNA, 19 nt, Homo sapiens
uaacucaaaugggugauga

SEQ ID NO: 84703 - RNA, 19 nt, Homo sapiens
ggaguggucuacagagcaa

SEQ ID NO: 84704 - RNA, 19 nt, Homo sapiens
gaagaugaagaacgagaaa

SEQ ID NO: 84705 - RNA, 19 nt, Homo sapiens
gcacgaacgucggaaacga

SEQ ID NO: 84706 - RNA, 19 nt, Homo sapiens
gagaagacucuauggaaga

SEQ ID NO: 84707 - RNA, 19 nt, Homo sapiens
ggaaggaacaagaggagaa

SEQ ID NO: 84708 - RNA, 19 nt, Homo sapiens
cagcaaaugucucggaaag

SEQ ID NO: 84709 - RNA, 19 nt, Homo sapiens
gaagaaaugagugaagaug

SEQ ID NO: 84710 - RNA, 19 nt, Homo sapiens
cagaaaagaugaaaagaga

SEQ ID NO: 84711 - RNA, 19 nt, Homo sapiens
agaaguaagugaggaagaa

SEQ ID NO: 84712 - RNA, 19 nt, Homo sapiens
gagaaacguaggcaucgua

SEQ ID NO: 84713 - RNA, 19 nt, Homo sapiens
ggaagacagaggagaagaa

SEQ ID NO: 84714 - RNA, 19 nt, Homo sapiens
ugacagagggcgacuaugu

SEQ ID NO: 84715 - RNA, 19 nt, Homo sapiens
ggacuacagcgacaaagug

SEQ ID NO: 84716 - RNA, 19 nt, Homo sapiens
gaaggaacaagaggagaaa

SEQ ID NO: 84717 - RNA, 19 nt, Homo sapiens
ggaagugucugcacaucac

SEQ ID NO: 84718 - RNA, 19 nt, Homo sapiens
gagaagaacaggauaaagc

SEQ ID NO: 84719 - RNA, 19 nt, Homo sapiens
ggagaaagcagagauaaaa

SEQ ID NO: 84720 - RNA, 19 nt, Homo sapiens
ugaagaagcagaggaagaa

SEQ ID NO: 84721 - RNA, 19 nt, Homo sapiens
gagcauuccaggagagaaa

SEQ ID NO: 84722 - RNA, 19 nt, Homo sapiens
gaggagaaagcagagauaa

SEQ ID NO: 84723 - RNA, 19 nt, Homo sapiens
gcuucgaccucaugaacaa

SEQ ID NO: 84724 - RNA, 19 nt, Homo sapiens
aaggagggcuucccgauca

SEQ ID NO: 84725 - RNA, 19 nt, Homo sapiens
caacaucgucaccguuaga

SEQ ID NO: 84726 - RNA, 19 nt, Homo sapiens
ugagggagaucaacaccau

SEQ ID NO: 84727 - RNA, 19 nt, Homo sapiens
gaaguaagugaggaagaaa

SEQ ID NO: 84728 - RNA, 19 nt, Homo sapiens
cuacagcgacaaagugaaa

SEQ ID NO: 84729 - RNA, 19 nt, Homo sapiens
gaacgaugagagaggacua

SEQ ID NO: 84730 - RNA, 19 nt, Homo sapiens
aaaggacucuuggaaagug

SEQ ID NO: 84731 - RNA, 19 nt, Homo sapiens
ggcugaagauggagaagga

SEQ ID NO: 84732 - RNA, 19 nt, Homo sapiens
gcucuaaagcggcugaaga

SEQ ID NO: 84733 - RNA, 19 nt, Homo sapiens
gaucaacaccauccucaag

SEQ ID NO: 84734 - RNA, 19 nt, Homo sapiens
gaugaaauuguggcucuaa

SEQ ID NO: 84735 - RNA, 19 nt, Homo sapiens
agacagaggagaagaagau

SEQ ID NO: 84736 - RNA, 19 nt, Homo sapiens
gaggugaagacccugauga

SEQ ID NO: 84737 - RNA, 19 nt, Homo sapiens
ggaggaggaggaagaggaa

SEQ ID NO: 84738 - RNA, 19 nt, Homo sapiens
gaaucaggcucagguucug

SEQ ID NO: 84739 - RNA, 19 nt, Homo sapiens
agucagaaaucgaucagau

SEQ ID NO: 84740 - RNA, 19 nt, Homo sapiens
ucacgucgcugagggagau

SEQ ID NO: 84741 - RNA, 19 nt, Homo sapiens
ggaaacgacaucgagaaga

SEQ ID NO: 84742 - RNA, 19 nt, Homo sapiens
gucaguggguugcaucuuc

SEQ ID NO: 84743 - RNA, 19 nt, Homo sapiens
ugaagacccugaugaucca

SEQ ID NO: 84744 - RNA, 19 nt, Homo sapiens
gaaauuguggcucuaaagc

SEQ ID NO: 84745 - RNA, 19 nt, Homo sapiens
ucaaaugggugaugaaaag

SEQ ID NO: 84746 - RNA, 19 nt, Homo sapiens
gaagaacgagaaaaugaaa

SEQ ID NO: 84747 - RNA, 19 nt, Homo sapiens
ggaagaaaugagugaagau

SEQ ID NO: 84748 - RNA, 19 nt, Homo sapiens
agacagaagagaagggaaa

SEQ ID NO: 84749 - RNA, 19 nt, Homo sapiens
gaaugggaaagacagaaga

SEQ ID NO: 84750 - RNA, 19 nt, Homo sapiens
caaaugucucggaaagaaa

SEQ ID NO: 84751 - RNA, 19 nt, Homo sapiens
gaagacagaggagaagaag

SEQ ID NO: 84752 - RNA, 19 nt, Homo sapiens
gcaacauggacaagaucua

SEQ ID NO: 84753 - RNA, 19 nt, Homo sapiens
aggaagaaaugagugaaga

SEQ ID NO: 84754 - RNA, 19 nt, Homo sapiens
gaggagaagaagaugauuc

SEQ ID NO: 84755 - RNA, 19 nt, Homo sapiens
auaaggaacuccccguaua

SEQ ID NO: 84756 - RNA, 19 nt, Homo sapiens
ggagacgggcuuccaccuu

SEQ ID NO: 84757 - RNA, 19 nt, Homo sapiens
ggaagucagaaaucgauca

SEQ ID NO: 84758 - RNA, 19 nt, Homo sapiens
cccaacaucgucaccguua

SEQ ID NO: 84759 - RNA, 19 nt, Homo sapiens
gagugaagaagcagaggaa

SEQ ID NO: 84760 - RNA, 19 nt, Homo sapiens
ccgcauggagaucacaaua

SEQ ID NO: 84761 - RNA, 19 nt, Homo sapiens
caaaagacaagaaaacaga

SEQ ID NO: 84762 - RNA, 19 nt, Homo sapiens
gaucgaggagggcaccuau

SEQ ID NO: 84763 - RNA, 19 nt, Homo sapiens
gaaaugagugaagaugaag

SEQ ID NO: 84764 - RNA, 19 nt, Homo sapiens
ggaagaggaggaggaggaa

SEQ ID NO: 84765 - RNA, 19 nt, Homo sapiens
gggaaagacagaagagaag

SEQ ID NO: 84766 - RNA, 19 nt, Homo sapiens
gaagagaaaauggaagaaa

SEQ ID NO: 84767 - RNA, 19 nt, Homo sapiens
caugcuagagugaaagaaa

SEQ ID NO: 84768 - RNA, 19 nt, Homo sapiens
cgucaccguuagagagauu

SEQ ID NO: 84769 - RNA, 19 nt, Homo sapiens
gagaucaccgcauggagau

SEQ ID NO: 84770 - RNA, 19 nt, Homo sapiens
gugaagaagcagaggaaga

SEQ ID NO: 84771 - RNA, 19 nt, Homo sapiens
cgaagaaguaagugaggaa

SEQ ID NO: 84772 - RNA, 19 nt, Homo sapiens
gacuacagcgacaaaguga

SEQ ID NO: 84773 - RNA, 19 nt, Homo sapiens
ggaaugggaaagacagaag

SEQ ID NO: 84774 - RNA, 19 nt, Homo sapiens
ggaagcaugcuagagugaa

SEQ ID NO: 84775 - RNA, 19 nt, Homo sapiens
caacauggacaagaucuac

SEQ ID NO: 84776 - RNA, 19 nt, Homo sapiens
ggaacaagaggagaaagca

SEQ ID NO: 84777 - RNA, 19 nt, Homo sapiens
gaaacgaaggaaggaacaa

SEQ ID NO: 84778 - RNA, 19 nt, Homo sapiens
ggaagggagcaccagugaa

SEQ ID NO: 84779 - RNA, 19 nt, Homo sapiens
gggaagcaugcuagaguga

SEQ ID NO: 84780 - RNA, 19 nt, Homo sapiens
guaagugaggaagaaauga

SEQ ID NO: 84781 - RNA, 19 nt, Homo sapiens
gcagaaucaggcucagguu

SEQ ID NO: 84782 - RNA, 19 nt, Homo sapiens
ggaccgcuuggagcaguua

SEQ ID NO: 84783 - RNA, 19 nt, Homo sapiens
cagaggagaagaagaugau

SEQ ID NO: 84784 - RNA, 19 nt, Homo sapiens
aggacggccucaagcauga

SEQ ID NO: 84785 - RNA, 19 nt, Homo sapiens
gcaccuauggaguggucua

SEQ ID NO: 84786 - RNA, 19 nt, Homo sapiens
gacagagggcgacuaugug

SEQ ID NO: 84787 - RNA, 19 nt, Homo sapiens
aagaaaugagugaagauga

SEQ ID NO: 84788 - RNA, 19 nt, Homo sapiens
gaaacgacaucgagaagaa

SEQ ID NO: 84789 - RNA, 19 nt, Homo sapiens
gcaaaugucucggaaagaa

SEQ ID NO: 84790 - RNA, 19 nt, Homo sapiens
gagacgggcuuccaccuua

SEQ ID NO: 84791 - RNA, 19 nt, Homo sapiens
gaagcaugcuagagugaaa

SEQ ID NO: 84792 - RNA, 19 nt, Homo sapiens
gaaaacagaugaaauugug

SEQ ID NO: 84793 - RNA, 19 nt, Homo sapiens
gagcaccagugaagaauca

SEQ ID NO: 84794 - RNA, 19 nt, Homo sapiens
gcauggagaucacaauaag

SEQ ID NO: 84795 - RNA, 19 nt, Homo sapiens
ugaaacaccugcacgacaa

SEQ ID NO: 84796 - RNA, 19 nt, Homo sapiens
uaaagcggcugaagaugga

SEQ ID NO: 84797 - RNA, 19 nt, Homo sapiens
gaaaaggacucuuggaaag

SEQ ID NO: 84798 - RNA, 19 nt, Homo sapiens
agaaaugagugaagaugaa

SEQ ID NO: 84799 - RNA, 19 nt, Homo sapiens
gcagcaacauggacaagau

SEQ ID NO: 84800 - RNA, 19 nt, Homo sapiens
gagugaagaugaagaacga

SEQ ID NO: 84801 - RNA, 19 nt, Homo sapiens
gaagggagcaccagugaag

SEQ ID NO: 84802 - RNA, 19 nt, Homo sapiens
uaacucaaaugggugauga

SEQ ID NO: 84803 - RNA, 19 nt, Homo sapiens
ggaguggucuacagagcaa

SEQ ID NO: 84804 - RNA, 19 nt, Homo sapiens
gaagaugaagaacgagaaa

SEQ ID NO: 84805 - RNA, 19 nt, Homo sapiens
gcacgaacgucggaaacga

SEQ ID NO: 84806 - RNA, 19 nt, Homo sapiens
gagaagacucuauggaaga

SEQ ID NO: 84807 - RNA, 19 nt, Homo sapiens
ggaaggaacaagaggagaa

SEQ ID NO: 84808 - RNA, 19 nt, Homo sapiens
cagcaaaugucucggaaag

SEQ ID NO: 84809 - RNA, 19 nt, Homo sapiens
gaagaaaugagugaagaug

SEQ ID NO: 84810 - RNA, 19 nt, Homo sapiens
cagaaaagaugaaaagaga

SEQ ID NO: 84811 - RNA, 19 nt, Homo sapiens
agaaguaagugaggaagaa

SEQ ID NO: 84812 - RNA, 19 nt, Homo sapiens
gagaaacguaggcaucgua

SEQ ID NO: 84813 - RNA, 19 nt, Homo sapiens
ggaagacagaggagaagaa

SEQ ID NO: 84814 - RNA, 19 nt, Homo sapiens
ugacagagggcgacuaugu

SEQ ID NO: 84815 - RNA, 19 nt, Homo sapiens
gaaggaacaagaggagaaa

SEQ ID NO: 84816 - RNA, 19 nt, Homo sapiens
gagaagaacaggauaaagc

SEQ ID NO: 84817 - RNA, 19 nt, Homo sapiens
ggagaaagcagagauaaaa

SEQ ID NO: 84818 - RNA, 19 nt, Homo sapiens
ugaagaagcagaggaagaa

SEQ ID NO: 84819 - RNA, 19 nt, Homo sapiens
gagcauuccaggagagaaa

SEQ ID NO: 84820 - RNA, 19 nt, Homo sapiens
gaggagaaagcagagauaa

SEQ ID NO: 84821 - RNA, 19 nt, Homo sapiens
gcuucgaccucaugaacaa

SEQ ID NO: 84822 - RNA, 19 nt, Homo sapiens
aaggagggcuucccgauca

SEQ ID NO: 84823 - RNA, 19 nt, Homo sapiens
caacaucgucaccguuaga

SEQ ID NO: 84824 - RNA, 19 nt, Homo sapiens
ugagggagaucaacaccau

SEQ ID NO: 84825 - RNA, 19 nt, Homo sapiens
gaaguaagugaggaagaaa

SEQ ID NO: 84826 - RNA, 19 nt, Homo sapiens
aaaggacucuuggaaagug

SEQ ID NO: 84827 - RNA, 19 nt, Homo sapiens
ggcugaagauggagaagga

SEQ ID NO: 84828 - RNA, 19 nt, Homo sapiens
gcucuaaagcggcugaaga

SEQ ID NO: 84829 - RNA, 19 nt, Homo sapiens
gaucaacaccauccucaag

SEQ ID NO: 84830 - RNA, 19 nt, Homo sapiens
gaugaaauuguggcucuaa

SEQ ID NO: 84831 - RNA, 19 nt, Homo sapiens
gagagaaaguaaaagaaga

SEQ ID NO: 84832 - RNA, 19 nt, Homo sapiens
agacagaggagaagaagau

SEQ ID NO: 84833 - RNA, 19 nt, Homo sapiens
gaggugaagacccugauga

SEQ ID NO: 84834 - RNA, 19 nt, Homo sapiens
ggaggaggaggaagaggaa

SEQ ID NO: 84835 - RNA, 19 nt, Homo sapiens
gaaucaggcucagguucug

SEQ ID NO: 84836 - RNA, 19 nt, Homo sapiens
agucagaaaucgaucagau

SEQ ID NO: 84837 - RNA, 19 nt, Homo sapiens
ucacgucgcugagggagau

SEQ ID NO: 84838 - RNA, 19 nt, Homo sapiens
ggaaacgacaucgagaaga

SEQ ID NO: 84839 - RNA, 19 nt, Homo sapiens
gucaguggguugcaucuuc

SEQ ID NO: 84840 - RNA, 19 nt, Homo sapiens
ugaagacccugaugaucca

SEQ ID NO: 84841 - RNA, 19 nt, Homo sapiens
gaaauuguggcucuaaagc

SEQ ID NO: 84842 - RNA, 19 nt, Homo sapiens
ucaaaugggugaugaaaag

SEQ ID NO: 84843 - RNA, 19 nt, Homo sapiens
gaagaacgagaaaaugaaa

SEQ ID NO: 84844 - RNA, 19 nt, Homo sapiens
ggaagaaaugagugaagau

SEQ ID NO: 84845 - RNA, 19 nt, Homo sapiens
agacagaagagaagggaaa

SEQ ID NO: 84846 - RNA, 19 nt, Homo sapiens
gaaugggaaagacagaaga

SEQ ID NO: 84847 - RNA, 19 nt, Homo sapiens
caaaugucucggaaagaaa

SEQ ID NO: 84848 - RNA, 19 nt, Homo sapiens
gaagacagaggagaagaag

SEQ ID NO: 84849 - RNA, 19 nt, Homo sapiens
gcaacauggacaagaucua

SEQ ID NO: 84850 - RNA, 19 nt, Homo sapiens
aggaagaaaugagugaaga

SEQ ID NO: 84851 - RNA, 19 nt, Homo sapiens
gaggagaagaagaugauuc

SEQ ID NO: 84852 - RNA, 19 nt, Homo sapiens
auaaggaacuccccguaua

SEQ ID NO: 84853 - RNA, 19 nt, Homo sapiens
ggagacgggcuuccaccuu

SEQ ID NO: 84854 - RNA, 19 nt, Homo sapiens
ggaagucagaaaucgauca

SEQ ID NO: 84855 - RNA, 19 nt, Homo sapiens
cccaacaucgucaccguua

SEQ ID NO: 84856 - RNA, 19 nt, Homo sapiens
gagugaagaagcagaggaa

SEQ ID NO: 84857 - RNA, 19 nt, Homo sapiens
ccgcauggagaucacaaua

SEQ ID NO: 84858 - RNA, 19 nt, Homo sapiens
caaaagacaagaaaacaga

SEQ ID NO: 84859 - RNA, 19 nt, Homo sapiens
gaucgaggagggcaccuau

SEQ ID NO: 84860 - RNA, 19 nt, Homo sapiens
gaaaugagugaagaugaag

SEQ ID NO: 84861 - RNA, 19 nt, Homo sapiens
ggaagaggaggaggaggaa

SEQ ID NO: 84862 - RNA, 19 nt, Homo sapiens
gggaaagacagaagagaag

SEQ ID NO: 84863 - RNA, 19 nt, Homo sapiens
gaagagaaaauggaagaaa

SEQ ID NO: 84864 - RNA, 19 nt, Homo sapiens
caugcuagagugaaagaaa

SEQ ID NO: 84865 - RNA, 19 nt, Homo sapiens
cgucaccguuagagagauu

SEQ ID NO: 84866 - RNA, 19 nt, Homo sapiens
gugaagaagcagaggaaga

SEQ ID NO: 84867 - RNA, 19 nt, Homo sapiens
cgaagaaguaagugaggaa

SEQ ID NO: 84868 - RNA, 19 nt, Homo sapiens
gagaucaccgcauggagau

SEQ ID NO: 84869 - RNA, 19 nt, Homo sapiens
ggaaugggaaagacagaag

SEQ ID NO: 84870 - RNA, 19 nt, Homo sapiens
ggaagcaugcuagagugaa

SEQ ID NO: 84871 - RNA, 19 nt, Homo sapiens
ggaacaagaggagaaagca

SEQ ID NO: 84872 - RNA, 19 nt, Homo sapiens
caacauggacaagaucuac

SEQ ID NO: 84873 - RNA, 19 nt, Homo sapiens
gaaacgaaggaaggaacaa

SEQ ID NO: 84874 - RNA, 19 nt, Homo sapiens
ggaagggagcaccagugaa

SEQ ID NO: 84875 - RNA, 19 nt, Homo sapiens
gggaagcaugcuagaguga

SEQ ID NO: 84876 - RNA, 19 nt, Homo sapiens
guaagugaggaagaaauga

SEQ ID NO: 84877 - RNA, 19 nt, Homo sapiens
gcagaaucaggcucagguu

SEQ ID NO: 84878 - RNA, 19 nt, Homo sapiens
cagaggagaagaagaugau

SEQ ID NO: 84879 - RNA, 19 nt, Homo sapiens
aggacggccucaagcauga

SEQ ID NO: 84880 - RNA, 19 nt, Homo sapiens
gcaccuauggaguggucua

SEQ ID NO: 84881 - RNA, 19 nt, Homo sapiens
gacagagggcgacuaugug

SEQ ID NO: 84882 - RNA, 19 nt, Homo sapiens
aagaaaugagugaagauga

SEQ ID NO: 84883 - RNA, 19 nt, Homo sapiens
cagaagagaagggaaaugg

SEQ ID NO: 84884 - RNA, 19 nt, Homo sapiens
gaagauggagaaggagaag

SEQ ID NO: 84885 - RNA, 19 nt, Homo sapiens
agaggagaaagcagagaua

SEQ ID NO: 84886 - RNA, 19 nt, Homo sapiens
gaggagaccggcagcaacu

SEQ ID NO: 84887 - RNA, 19 nt, Homo sapiens
ggaaauggcaagggagcau

SEQ ID NO: 84888 - RNA, 19 nt, Homo sapiens
gaaacgacaucgagaagaa

SEQ ID NO: 84889 - RNA, 19 nt, Homo sapiens
gcaaaugucucggaaagaa

SEQ ID NO: 84890 - RNA, 19 nt, Homo sapiens
gagacgggcuuccaccuua

SEQ ID NO: 84891 - RNA, 19 nt, Homo sapiens
gaaaacagaugaaauugug

SEQ ID NO: 84892 - RNA, 19 nt, Homo sapiens
gagcaccagugaagaauca

SEQ ID NO: 84893 - RNA, 19 nt, Homo sapiens
gcauggagaucacaauaag

SEQ ID NO: 84894 - RNA, 19 nt, Homo sapiens
ugaaacaccugcacgacaa

SEQ ID NO: 84895 - RNA, 19 nt, Homo sapiens
uaaagcggcugaagaugga

SEQ ID NO: 84896 - RNA, 19 nt, Homo sapiens
gaaaaggacucuuggaaag

SEQ ID NO: 84897 - RNA, 19 nt, Homo sapiens
agaaaugagugaagaugaa

SEQ ID NO: 84898 - RNA, 19 nt, Homo sapiens
gcagcaacauggacaagau

SEQ ID NO: 84899 - RNA, 19 nt, Homo sapiens
gagugaagaugaagaacga

SEQ ID NO: 84900 - RNA, 19 nt, Homo sapiens
gaagggagcaccagugaag

SEQ ID NO: 84901 - RNA, 19 nt, Homo sapiens
uaacucaaaugggugauga

SEQ ID NO: 84902 - RNA, 19 nt, Homo sapiens
ggaguggucuacagagcaa

SEQ ID NO: 84903 - RNA, 19 nt, Homo sapiens
gaagaugaagaacgagaaa

SEQ ID NO: 84904 - RNA, 19 nt, Homo sapiens
gcacgaacgucggaaacga

SEQ ID NO: 84905 - RNA, 19 nt, Homo sapiens
gagaagacucuauggaaga

SEQ ID NO: 84906 - RNA, 19 nt, Homo sapiens
ggaaggaacaagaggagaa

SEQ ID NO: 84907 - RNA, 19 nt, Homo sapiens
cagcaaaugucucggaaag

SEQ ID NO: 84908 - RNA, 19 nt, Homo sapiens
gaagaaaugagugaagaug

SEQ ID NO: 84909 - RNA, 19 nt, Homo sapiens
cagaaaagaugaaaagaga

SEQ ID NO: 84910 - RNA, 19 nt, Homo sapiens
agaaguaagugaggaagaa

SEQ ID NO: 84911 - RNA, 19 nt, Homo sapiens
ggaagacagaggagaagaa

SEQ ID NO: 84912 - RNA, 19 nt, Homo sapiens
ugacagagggcgacuaugu

SEQ ID NO: 84913 - RNA, 19 nt, Homo sapiens
ggacuacagcgacaaagug

SEQ ID NO: 84914 - RNA, 19 nt, Homo sapiens
gaaggaacaagaggagaaa

SEQ ID NO: 84915 - RNA, 19 nt, Homo sapiens
ggaagugucugcacaucac

SEQ ID NO: 84916 - RNA, 19 nt, Homo sapiens
gagaagaacaggauaaagc

SEQ ID NO: 84917 - RNA, 19 nt, Homo sapiens
ggagaaagcagagauaaaa

SEQ ID NO: 84918 - RNA, 19 nt, Homo sapiens
ugaagaagcagaggaagaa

SEQ ID NO: 84919 - RNA, 19 nt, Homo sapiens
gagcauuccaggagagaaa

SEQ ID NO: 84920 - RNA, 19 nt, Homo sapiens
gaggagaaagcagagauaa

SEQ ID NO: 84921 - RNA, 19 nt, Homo sapiens
gcuucgaccucaugaacaa

SEQ ID NO: 84922 - RNA, 19 nt, Homo sapiens
aaggagggcuucccgauca

SEQ ID NO: 84923 - RNA, 19 nt, Homo sapiens
aaagcaugcuagagugaaa

SEQ ID NO: 84924 - RNA, 19 nt, Homo sapiens
caacaucgucaccguuaga

SEQ ID NO: 84925 - RNA, 19 nt, Homo sapiens
ugagggagaucaacaccau

SEQ ID NO: 84926 - RNA, 19 nt, Homo sapiens
gaaguaagugaggaagaaa

SEQ ID NO: 84927 - RNA, 19 nt, Homo sapiens
cuacagcgacaaagugaaa

SEQ ID NO: 84928 - RNA, 19 nt, Homo sapiens
gaacgaugagagaggacua

SEQ ID NO: 84929 - RNA, 19 nt, Homo sapiens
aaaggacucuuggaaagug

SEQ ID NO: 84930 - RNA, 19 nt, Homo sapiens
ggcugaagauggagaagga

SEQ ID NO: 84931 - RNA, 19 nt, Homo sapiens
gcucuaaagcggcugaaga

SEQ ID NO: 84932 - RNA, 19 nt, Homo sapiens
gaucaacaccauccucaag

SEQ ID NO: 84933 - RNA, 19 nt, Homo sapiens
gaugaaauuguggcucuaa

SEQ ID NO: 84934 - RNA, 19 nt, Homo sapiens
agacagaggagaagaagau

SEQ ID NO: 84935 - RNA, 19 nt, Homo sapiens
gaggugaagacccugauga

SEQ ID NO: 84936 - RNA, 19 nt, Homo sapiens
ggaggaggaggaagaggaa

SEQ ID NO: 84937 - RNA, 19 nt, Homo sapiens
gaaucaggcucagguucug

SEQ ID NO: 84938 - RNA, 19 nt, Homo sapiens
agucagaaaucgaucagau

SEQ ID NO: 84939 - RNA, 19 nt, Homo sapiens
ucacgucgcugagggagau

SEQ ID NO: 84940 - RNA, 19 nt, Homo sapiens
ggaaacgacaucgagaaga

SEQ ID NO: 84941 - RNA, 19 nt, Homo sapiens
gucaguggguugcaucuuc

SEQ ID NO: 84942 - RNA, 19 nt, Homo sapiens
ugaagacccugaugaucca

SEQ ID NO: 84943 - RNA, 19 nt, Homo sapiens
gaaauuguggcucuaaagc

SEQ ID NO: 84944 - RNA, 19 nt, Homo sapiens
ucaaaugggugaugaaaag

SEQ ID NO: 84945 - RNA, 19 nt, Homo sapiens
gaagaacgagaaaaugaaa

SEQ ID NO: 84946 - RNA, 19 nt, Homo sapiens
ggaagaaaugagugaagau

SEQ ID NO: 84947 - RNA, 19 nt, Homo sapiens
agacagaagagaagggaaa

SEQ ID NO: 84948 - RNA, 19 nt, Homo sapiens
gaaugggaaagacagaaga

SEQ ID NO: 84949 - RNA, 19 nt, Homo sapiens
caaaugucucggaaagaaa

SEQ ID NO: 84950 - RNA, 19 nt, Homo sapiens
gaagacagaggagaagaag

SEQ ID NO: 84951 - RNA, 19 nt, Homo sapiens
gcaacauggacaagaucua

SEQ ID NO: 84952 - RNA, 19 nt, Homo sapiens
aggaagaaaugagugaaga

SEQ ID NO: 84953 - RNA, 19 nt, Homo sapiens
gaggagaagaagaugauuc

SEQ ID NO: 84954 - RNA, 19 nt, Homo sapiens
auaaggaacuccccguaua

SEQ ID NO: 84955 - RNA, 19 nt, Homo sapiens
aaaugucgcagucugauga

SEQ ID NO: 84956 - RNA, 19 nt, Homo sapiens
ggagacgggcuuccaccuu

SEQ ID NO: 84957 - RNA, 19 nt, Homo sapiens
ggaagucagaaaucgauca

SEQ ID NO: 84958 - RNA, 19 nt, Homo sapiens
cccaacaucgucaccguua

SEQ ID NO: 84959 - RNA, 19 nt, Homo sapiens
gagugaagaagcagaggaa

SEQ ID NO: 84960 - RNA, 19 nt, Homo sapiens
ccgcauggagaucacaaua

SEQ ID NO: 84961 - RNA, 19 nt, Homo sapiens
caaaagacaagaaaacaga

SEQ ID NO: 84962 - RNA, 19 nt, Homo sapiens
gaucgaggagggcaccuau

SEQ ID NO: 84963 - RNA, 19 nt, Homo sapiens
gaaaugagugaagaugaag

SEQ ID NO: 84964 - RNA, 19 nt, Homo sapiens
ggaagaggaggaggaggaa

SEQ ID NO: 84965 - RNA, 19 nt, Homo sapiens
gggaaagacagaagagaag

SEQ ID NO: 84966 - RNA, 19 nt, Homo sapiens
gaagagaaaauggaagaaa

SEQ ID NO: 84967 - RNA, 19 nt, Homo sapiens
caugcuagagugaaagaaa

SEQ ID NO: 84968 - RNA, 19 nt, Homo sapiens
cgucaccguuagagagauu

SEQ ID NO: 84969 - RNA, 19 nt, Homo sapiens
gugaagaagcagaggaaga

SEQ ID NO: 84970 - RNA, 19 nt, Homo sapiens
cgaagaaguaagugaggaa

SEQ ID NO: 84971 - RNA, 19 nt, Homo sapiens
gacuacagcgacaaaguga

SEQ ID NO: 84972 - RNA, 19 nt, Homo sapiens
ggaaugggaaagacagaag

SEQ ID NO: 84973 - RNA, 19 nt, Homo sapiens
gagaucaccgcauggagau

SEQ ID NO: 84974 - RNA, 19 nt, Homo sapiens
caacauggacaagaucuac

SEQ ID NO: 84975 - RNA, 19 nt, Homo sapiens
gaaacgaaggaaggaacaa

SEQ ID NO: 84976 - RNA, 19 nt, Homo sapiens
ggaacaagaggagaaagca

SEQ ID NO: 84977 - RNA, 19 nt, Homo sapiens
ggaagggagcaccagugaa

SEQ ID NO: 84978 - RNA, 19 nt, Homo sapiens
guaagugaggaagaaauga

SEQ ID NO: 84979 - RNA, 19 nt, Homo sapiens
gcagaaucaggcucagguu

SEQ ID NO: 84980 - RNA, 19 nt, Homo sapiens
ggaccgcuuggagcaguua

SEQ ID NO: 84981 - RNA, 19 nt, Homo sapiens
cagaggagaagaagaugau

SEQ ID NO: 84982 - RNA, 19 nt, Homo sapiens
aggacggccucaagcauga

SEQ ID NO: 84983 - RNA, 19 nt, Homo sapiens
gcaccuauggaguggucua

SEQ ID NO: 84984 - RNA, 19 nt, Homo sapiens
gacagagggcgacuaugug

SEQ ID NO: 84985 - RNA, 19 nt, Homo sapiens
aagaaaugagugaagauga

SEQ ID NO: 84986 - RNA, 19 nt, Homo sapiens
cagaagagaagggaaaugg

SEQ ID NO: 84987 - RNA, 19 nt, Homo sapiens
gaagauggagaaggagaag

SEQ ID NO: 84988 - RNA, 19 nt, Homo sapiens
gaaacgacaucgagaagaa

SEQ ID NO: 84989 - RNA, 19 nt, Homo sapiens
gcaaaugucucggaaagaa

SEQ ID NO: 84990 - RNA, 19 nt, Homo sapiens
gagacgggcuuccaccuua

SEQ ID NO: 84991 - RNA, 19 nt, Homo sapiens
gaagcaugcuagagugaaa

SEQ ID NO: 84992 - RNA, 19 nt, Homo sapiens
gaaaacagaugaaauugug

SEQ ID NO: 84993 - RNA, 19 nt, Homo sapiens
gagcaccagugaagaauca

SEQ ID NO: 84994 - RNA, 19 nt, Homo sapiens
gcauggagaucacaauaag

SEQ ID NO: 84995 - RNA, 19 nt, Homo sapiens
ugaaacaccugcacgacaa

SEQ ID NO: 84996 - RNA, 19 nt, Homo sapiens
uaaagcggcugaagaugga

SEQ ID NO: 84997 - RNA, 19 nt, Homo sapiens
gaaaaggacucuuggaaag

SEQ ID NO: 84998 - RNA, 19 nt, Homo sapiens
agaaaugagugaagaugaa

SEQ ID NO: 84999 - RNA, 19 nt, Homo sapiens
gcagcaacauggacaagau

SEQ ID NO: 85000 - RNA, 19 nt, Homo sapiens
gagugaagaugaagaacga

SEQ ID NO: 85001 - RNA, 19 nt, Homo sapiens
gaagggagcaccagugaag

SEQ ID NO: 85002 - RNA, 19 nt, Homo sapiens
uaacucaaaugggugauga

SEQ ID NO: 85003 - RNA, 19 nt, Homo sapiens
ggaguggucuacagagcaa

SEQ ID NO: 85004 - RNA, 19 nt, Homo sapiens
gaagaugaagaacgagaaa

SEQ ID NO: 85005 - RNA, 19 nt, Homo sapiens
gcacgaacgucggaaacga

SEQ ID NO: 85006 - RNA, 19 nt, Homo sapiens
gagaagacucuauggaaga

SEQ ID NO: 85007 - RNA, 19 nt, Homo sapiens
ggaaggaacaagaggagaa

SEQ ID NO: 85008 - RNA, 19 nt, Homo sapiens
cagcaaaugucucggaaag

SEQ ID NO: 85009 - RNA, 19 nt, Homo sapiens
gaagaaaugagugaagaug

SEQ ID NO: 85010 - RNA, 19 nt, Homo sapiens
cagaaaagaugaaaagaga

SEQ ID NO: 85011 - RNA, 19 nt, Homo sapiens
agaaguaagugaggaagaa

SEQ ID NO: 85012 - RNA, 19 nt, Homo sapiens
gagaaacguaggcaucgua

SEQ ID NO: 85013 - RNA, 19 nt, Homo sapiens
ggaagacagaggagaagaa

SEQ ID NO: 85014 - RNA, 19 nt, Homo sapiens
ugacagagggcgacuaugu

SEQ ID NO: 85015 - RNA, 19 nt, Homo sapiens
ggacuacagcgacaaagug

SEQ ID NO: 85016 - RNA, 19 nt, Homo sapiens
gaaggaacaagaggagaaa

SEQ ID NO: 85017 - RNA, 19 nt, Homo sapiens
ggaagugucugcacaucac

SEQ ID NO: 85018 - RNA, 19 nt, Homo sapiens
gagaagaacaggauaaagc

SEQ ID NO: 85019 - RNA, 19 nt, Homo sapiens
ggagaaagcagagauaaaa

SEQ ID NO: 85020 - RNA, 19 nt, Homo sapiens
ugaagaagcagaggaagaa

SEQ ID NO: 85021 - RNA, 19 nt, Homo sapiens
gagcauuccaggagagaaa

SEQ ID NO: 85022 - RNA, 19 nt, Homo sapiens
gaggagaaagcagagauaa

SEQ ID NO: 85023 - RNA, 19 nt, Homo sapiens
gcuucgaccucaugaacaa

SEQ ID NO: 85024 - RNA, 19 nt, Homo sapiens
aaggagggcuucccgauca

SEQ ID NO: 85025 - RNA, 19 nt, Homo sapiens
caacaucgucaccguuaga

SEQ ID NO: 85026 - RNA, 19 nt, Homo sapiens
ugagggagaucaacaccau

SEQ ID NO: 85027 - RNA, 19 nt, Homo sapiens
gaaguaagugaggaagaaa

SEQ ID NO: 85028 - RNA, 19 nt, Homo sapiens
cuacagcgacaaagugaaa

SEQ ID NO: 85029 - RNA, 19 nt, Homo sapiens
gaacgaugagagaggacua

SEQ ID NO: 85030 - RNA, 19 nt, Homo sapiens
aaaggacucuuggaaagug

SEQ ID NO: 85031 - RNA, 19 nt, Homo sapiens
ggcugaagauggagaagga

SEQ ID NO: 85032 - RNA, 19 nt, Homo sapiens
gcucuaaagcggcugaaga

SEQ ID NO: 85033 - RNA, 19 nt, Homo sapiens
gaucaacaccauccucaag

SEQ ID NO: 85034 - RNA, 19 nt, Homo sapiens
gaugaaauuguggcucuaa

SEQ ID NO: 85035 - RNA, 19 nt, Homo sapiens
agacagaggagaagaagau

SEQ ID NO: 85036 - RNA, 19 nt, Homo sapiens
gaggugaagacccugauga

SEQ ID NO: 85037 - RNA, 19 nt, Homo sapiens
ggaggaggaggaagaggaa

SEQ ID NO: 85038 - RNA, 19 nt, Homo sapiens
gaaucaggcucagguucug

SEQ ID NO: 85039 - RNA, 19 nt, Homo sapiens
agucagaaaucgaucagau

SEQ ID NO: 85040 - RNA, 19 nt, Homo sapiens
ucacgucgcugagggagau

SEQ ID NO: 85041 - RNA, 19 nt, Homo sapiens
ggaaacgacaucgagaaga

SEQ ID NO: 85042 - RNA, 19 nt, Homo sapiens
gucaguggguugcaucuuc

SEQ ID NO: 85043 - RNA, 19 nt, Homo sapiens
ugaagacccugaugaucca

SEQ ID NO: 85044 - RNA, 19 nt, Homo sapiens
gaaauuguggcucuaaagc

SEQ ID NO: 85045 - RNA, 19 nt, Homo sapiens
ucaaaugggugaugaaaag

SEQ ID NO: 85046 - RNA, 19 nt, Homo sapiens
gaagaacgagaaaaugaaa

SEQ ID NO: 85047 - RNA, 19 nt, Homo sapiens
ggaagaaaugagugaagau

SEQ ID NO: 85048 - RNA, 19 nt, Homo sapiens
agacagaagagaagggaaa

SEQ ID NO: 85049 - RNA, 19 nt, Homo sapiens
gaaugggaaagacagaaga

SEQ ID NO: 85050 - RNA, 19 nt, Homo sapiens
caaaugucucggaaagaaa

SEQ ID NO: 85051 - RNA, 19 nt, Homo sapiens
gaagacagaggagaagaag

SEQ ID NO: 85052 - RNA, 19 nt, Homo sapiens
gcaacauggacaagaucua

SEQ ID NO: 85053 - RNA, 19 nt, Homo sapiens
aggaagaaaugagugaaga

SEQ ID NO: 85054 - RNA, 19 nt, Homo sapiens
gaggagaagaagaugauuc

SEQ ID NO: 85055 - RNA, 19 nt, Homo sapiens
auaaggaacuccccguaua

SEQ ID NO: 85056 - RNA, 19 nt, Homo sapiens
aaaugucgcagucugauga

SEQ ID NO: 85057 - RNA, 19 nt, Homo sapiens
ggagacgggcuuccaccuu

SEQ ID NO: 85058 - RNA, 19 nt, Homo sapiens
ggaagucagaaaucgauca

SEQ ID NO: 85059 - RNA, 19 nt, Homo sapiens
cccaacaucgucaccguua

SEQ ID NO: 85060 - RNA, 19 nt, Homo sapiens
gagugaagaagcagaggaa

SEQ ID NO: 85061 - RNA, 19 nt, Homo sapiens
ccgcauggagaucacaaua

SEQ ID NO: 85062 - RNA, 19 nt, Homo sapiens
caaaagacaagaaaacaga

SEQ ID NO: 85063 - RNA, 19 nt, Homo sapiens
gaucgaggagggcaccuau

SEQ ID NO: 85064 - RNA, 19 nt, Homo sapiens
gaaaugagugaagaugaag

SEQ ID NO: 85065 - RNA, 19 nt, Homo sapiens
ggaagaggaggaggaggaa

SEQ ID NO: 85066 - RNA, 19 nt, Homo sapiens
gggaaagacagaagagaag

SEQ ID NO: 85067 - RNA, 19 nt, Homo sapiens
gaagagaaaauggaagaaa

SEQ ID NO: 85068 - RNA, 19 nt, Homo sapiens
caugcuagagugaaagaaa

SEQ ID NO: 85069 - RNA, 19 nt, Homo sapiens
cgucaccguuagagagauu

SEQ ID NO: 85070 - RNA, 19 nt, Homo sapiens
gugaagaagcagaggaaga

SEQ ID NO: 85071 - RNA, 19 nt, Homo sapiens
cgaagaaguaagugaggaa

SEQ ID NO: 85072 - RNA, 19 nt, Homo sapiens
gacuacagcgacaaaguga

SEQ ID NO: 85073 - RNA, 19 nt, Homo sapiens
ggaaugggaaagacagaag

SEQ ID NO: 85074 - RNA, 19 nt, Homo sapiens
ggaagcaugcuagagugaa

SEQ ID NO: 85075 - RNA, 19 nt, Homo sapiens
gagaucaccgcauggagau

SEQ ID NO: 85076 - RNA, 19 nt, Homo sapiens
caacauggacaagaucuac

SEQ ID NO: 85077 - RNA, 19 nt, Homo sapiens
ggaacaagaggagaaagca

SEQ ID NO: 85078 - RNA, 19 nt, Homo sapiens
gaaacgaaggaaggaacaa

SEQ ID NO: 85079 - RNA, 19 nt, Homo sapiens
ggaagggagcaccagugaa

SEQ ID NO: 85080 - RNA, 19 nt, Homo sapiens
gggaagcaugcuagaguga

SEQ ID NO: 85081 - RNA, 19 nt, Homo sapiens
guaagugaggaagaaauga

SEQ ID NO: 85082 - RNA, 19 nt, Homo sapiens
gcagaaucaggcucagguu

SEQ ID NO: 85083 - RNA, 19 nt, Homo sapiens
ggaccgcuuggagcaguua

SEQ ID NO: 85084 - RNA, 19 nt, Homo sapiens
cagaggagaagaagaugau

SEQ ID NO: 85085 - RNA, 19 nt, Homo sapiens
aggacggccucaagcauga

SEQ ID NO: 85086 - RNA, 19 nt, Homo sapiens
gcaccuauggaguggucua

SEQ ID NO: 85087 - RNA, 19 nt, Homo sapiens
gacagagggcgacuaugug

SEQ ID NO: 85088 - RNA, 19 nt, Homo sapiens
gaaacgacaucgagaagaa

SEQ ID NO: 85089 - RNA, 19 nt, Homo sapiens
gcaaaugucucggaaagaa

SEQ ID NO: 85090 - RNA, 19 nt, Homo sapiens
gagacgggcuuccaccuua

SEQ ID NO: 85091 - RNA, 19 nt, Homo sapiens
gaagcaugcuagagugaaa

SEQ ID NO: 85092 - RNA, 19 nt, Homo sapiens
gaaaacagaugaaauugug

SEQ ID NO: 85093 - RNA, 19 nt, Homo sapiens
gagcaccagugaagaauca

SEQ ID NO: 85094 - RNA, 19 nt, Homo sapiens
gcauggagaucacaauaag

SEQ ID NO: 85095 - RNA, 19 nt, Homo sapiens
ugaaacaccugcacgacaa

SEQ ID NO: 85096 - RNA, 19 nt, Homo sapiens
uaaagcggcugaagaugga

SEQ ID NO: 85097 - RNA, 19 nt, Homo sapiens
gaaaaggacucuuggaaag

SEQ ID NO: 85098 - RNA, 19 nt, Homo sapiens
agaaaugagugaagaugaa

SEQ ID NO: 85099 - RNA, 19 nt, Homo sapiens
gcagcaacauggacaagau

SEQ ID NO: 85100 - RNA, 19 nt, Homo sapiens
gagugaagaugaagaacga

SEQ ID NO: 85101 - RNA, 19 nt, Homo sapiens
gaaagugucugcacaucac

SEQ ID NO: 85102 - RNA, 19 nt, Homo sapiens
gaagggagcaccagugaag

SEQ ID NO: 85103 - RNA, 19 nt, Homo sapiens
uaacucaaaugggugauga

SEQ ID NO: 85104 - RNA, 19 nt, Homo sapiens
ggaguggucuacagagcaa

SEQ ID NO: 85105 - RNA, 19 nt, Homo sapiens
gaagaugaagaacgagaaa

SEQ ID NO: 85106 - RNA, 19 nt, Homo sapiens
gcacgaacgucggaaacga

SEQ ID NO: 85107 - RNA, 19 nt, Homo sapiens
gagaagacucuauggaaga

SEQ ID NO: 85108 - RNA, 19 nt, Homo sapiens
ggaaggaacaagaggagaa

SEQ ID NO: 85109 - RNA, 19 nt, Homo sapiens
cagcaaaugucucggaaag

SEQ ID NO: 85110 - RNA, 19 nt, Homo sapiens
gaagaaaugagugaagaug

SEQ ID NO: 85111 - RNA, 19 nt, Homo sapiens
cagaaaagaugaaaagaga

SEQ ID NO: 85112 - RNA, 19 nt, Homo sapiens
agaaguaagugaggaagaa

SEQ ID NO: 85113 - RNA, 19 nt, Homo sapiens
gagaaacguaggcaucgua

SEQ ID NO: 85114 - RNA, 19 nt, Homo sapiens
ggaagacagaggagaagaa

SEQ ID NO: 85115 - RNA, 19 nt, Homo sapiens
ugacagagggcgacuaugu

SEQ ID NO: 85116 - RNA, 19 nt, Homo sapiens
ggacuacagcgacaaagug

SEQ ID NO: 85117 - RNA, 19 nt, Homo sapiens
gaaggaacaagaggagaaa

SEQ ID NO: 85118 - RNA, 19 nt, Homo sapiens
gagaaagugucugcacauc

SEQ ID NO: 85119 - RNA, 19 nt, Homo sapiens
gagaagaacaggauaaagc

SEQ ID NO: 85120 - RNA, 19 nt, Homo sapiens
ggagaaagcagagauaaaa

SEQ ID NO: 85121 - RNA, 19 nt, Homo sapiens
ugaagaagcagaggaagaa

SEQ ID NO: 85122 - RNA, 19 nt, Homo sapiens
gagcauuccaggagagaaa

SEQ ID NO: 85123 - RNA, 19 nt, Homo sapiens
gaggagaaagcagagauaa

SEQ ID NO: 85124 - RNA, 19 nt, Homo sapiens
gcuucgaccucaugaacaa

SEQ ID NO: 85125 - RNA, 19 nt, Homo sapiens
aaggagggcuucccgauca

SEQ ID NO: 85126 - RNA, 19 nt, Homo sapiens
caacaucgucaccguuaga

SEQ ID NO: 85127 - RNA, 19 nt, Homo sapiens
ugagggagaucaacaccau

SEQ ID NO: 85128 - RNA, 19 nt, Homo sapiens
gaaguaagugaggaagaaa

SEQ ID NO: 85129 - RNA, 19 nt, Homo sapiens
cuacagcgacaaagugaaa

SEQ ID NO: 85130 - RNA, 19 nt, Homo sapiens
gaacgaugagagaggacua

SEQ ID NO: 85131 - RNA, 19 nt, Homo sapiens
aaaggacucuuggaaagug

SEQ ID NO: 85132 - RNA, 19 nt, Homo sapiens
ggcugaagauggagaagga

SEQ ID NO: 85133 - RNA, 19 nt, Homo sapiens
gcucuaaagcggcugaaga

SEQ ID NO: 85134 - RNA, 19 nt, Homo sapiens
gaucaacaccauccucaag

SEQ ID NO: 85135 - RNA, 19 nt, Homo sapiens
gaugaaauuguggcucuaa

SEQ ID NO: 85136 - RNA, 19 nt, Homo sapiens
agacagaggagaagaagau

SEQ ID NO: 85137 - RNA, 19 nt, Homo sapiens
gaggugaagacccugauga

SEQ ID NO: 85138 - RNA, 19 nt, Homo sapiens
ggaggaggaggaagaggaa

SEQ ID NO: 85139 - RNA, 19 nt, Homo sapiens
gaaucaggcucagguucug

SEQ ID NO: 85140 - RNA, 19 nt, Homo sapiens
agucagaaaucgaucagau

SEQ ID NO: 85141 - RNA, 19 nt, Homo sapiens
ucacgucgcugagggagau

SEQ ID NO: 85142 - RNA, 19 nt, Homo sapiens
ggaaacgacaucgagaaga

SEQ ID NO: 85143 - RNA, 19 nt, Homo sapiens
gucaguggguugcaucuuc

SEQ ID NO: 85144 - RNA, 19 nt, Homo sapiens
ugaagacccugaugaucca

SEQ ID NO: 85145 - RNA, 19 nt, Homo sapiens
gaaauuguggcucuaaagc

SEQ ID NO: 85146 - RNA, 19 nt, Homo sapiens
ucaaaugggugaugaaaag

SEQ ID NO: 85147 - RNA, 19 nt, Homo sapiens
gaagaacgagaaaaugaaa

SEQ ID NO: 85148 - RNA, 19 nt, Homo sapiens
ggaagaaaugagugaagau

SEQ ID NO: 85149 - RNA, 19 nt, Homo sapiens
agacagaagagaagggaaa

SEQ ID NO: 85150 - RNA, 19 nt, Homo sapiens
gaaugggaaagacagaaga

SEQ ID NO: 85151 - RNA, 19 nt, Homo sapiens
caaaugucucggaaagaaa

SEQ ID NO: 85152 - RNA, 19 nt, Homo sapiens
gaagacagaggagaagaag

SEQ ID NO: 85153 - RNA, 19 nt, Homo sapiens
gcaacauggacaagaucua

SEQ ID NO: 85154 - RNA, 19 nt, Homo sapiens
aggaagaaaugagugaaga

SEQ ID NO: 85155 - RNA, 19 nt, Homo sapiens
gaggagaagaagaugauuc

SEQ ID NO: 85156 - RNA, 19 nt, Homo sapiens
auaaggaacuccccguaua

SEQ ID NO: 85157 - RNA, 19 nt, Homo sapiens
ggagacgggcuuccaccuu

SEQ ID NO: 85158 - RNA, 19 nt, Homo sapiens
ggaagucagaaaucgauca

SEQ ID NO: 85159 - RNA, 19 nt, Homo sapiens
cccaacaucgucaccguua

SEQ ID NO: 85160 - RNA, 19 nt, Homo sapiens
gagugaagaagcagaggaa

SEQ ID NO: 85161 - RNA, 19 nt, Homo sapiens
ccgcauggagaucacaaua

SEQ ID NO: 85162 - RNA, 19 nt, Homo sapiens
caaaagacaagaaaacaga

SEQ ID NO: 85163 - RNA, 19 nt, Homo sapiens
gaucgaggagggcaccuau

SEQ ID NO: 85164 - RNA, 19 nt, Homo sapiens
gaaaugagugaagaugaag

SEQ ID NO: 85165 - RNA, 19 nt, Homo sapiens
ggaagaggaggaggaggaa

SEQ ID NO: 85166 - RNA, 19 nt, Homo sapiens
gggaaagacagaagagaag

SEQ ID NO: 85167 - RNA, 19 nt, Homo sapiens
gaagagaaaauggaagaaa

SEQ ID NO: 85168 - RNA, 19 nt, Homo sapiens
caugcuagagugaaagaaa

SEQ ID NO: 85169 - RNA, 19 nt, Homo sapiens
cgucaccguuagagagauu

SEQ ID NO: 85170 - RNA, 19 nt, Homo sapiens
gugaagaagcagaggaaga

SEQ ID NO: 85171 - RNA, 19 nt, Homo sapiens
cgaagaaguaagugaggaa

SEQ ID NO: 85172 - RNA, 19 nt, Homo sapiens
gacuacagcgacaaaguga

SEQ ID NO: 85173 - RNA, 19 nt, Homo sapiens
gagaucaccgcauggagau

SEQ ID NO: 85174 - RNA, 19 nt, Homo sapiens
ggaaugggaaagacagaag

SEQ ID NO: 85175 - RNA, 19 nt, Homo sapiens
ggaagcaugcuagagugaa

SEQ ID NO: 85176 - RNA, 19 nt, Homo sapiens
ggaacaagaggagaaagca

SEQ ID NO: 85177 - RNA, 19 nt, Homo sapiens
caacauggacaagaucuac

SEQ ID NO: 85178 - RNA, 19 nt, Homo sapiens
gaaacgaaggaaggaacaa

SEQ ID NO: 85179 - RNA, 19 nt, Homo sapiens
ggaagggagcaccagugaa

SEQ ID NO: 85180 - RNA, 19 nt, Homo sapiens
gggaagcaugcuagaguga

SEQ ID NO: 85181 - RNA, 19 nt, Homo sapiens
guaagugaggaagaaauga

SEQ ID NO: 85182 - RNA, 19 nt, Homo sapiens
gcagaaucaggcucagguu

SEQ ID NO: 85183 - RNA, 19 nt, Homo sapiens
cagaggagaagaagaugau

SEQ ID NO: 85184 - RNA, 19 nt, Homo sapiens
aggacggccucaagcauga

SEQ ID NO: 85185 - RNA, 19 nt, Homo sapiens
gcaccuauggaguggucua

SEQ ID NO: 85186 - RNA, 19 nt, Homo sapiens
gacagagggcgacuaugug

SEQ ID NO: 85187 - RNA, 19 nt, Homo sapiens
aagaaaugagugaagauga

SEQ ID NO: 85188 - RNA, 19 nt, Homo sapiens
gaaacgacaucgagaagaa

SEQ ID NO: 85189 - RNA, 19 nt, Homo sapiens
gcaaaugucucggaaagaa

SEQ ID NO: 85190 - RNA, 19 nt, Homo sapiens
gagacgggcuuccaccuua

SEQ ID NO: 85191 - RNA, 19 nt, Homo sapiens
gaaaacagaugaaauugug

SEQ ID NO: 85192 - RNA, 19 nt, Homo sapiens
gagcaccagugaagaauca

SEQ ID NO: 85193 - RNA, 19 nt, Homo sapiens
gcauggagaucacaauaag

SEQ ID NO: 85194 - RNA, 19 nt, Homo sapiens
ugaaacaccugcacgacaa

SEQ ID NO: 85195 - RNA, 19 nt, Homo sapiens
uaaagcggcugaagaugga

SEQ ID NO: 85196 - RNA, 19 nt, Homo sapiens
gaaaaggacucuuggaaag

SEQ ID NO: 85197 - RNA, 19 nt, Homo sapiens
agaaaugagugaagaugaa

SEQ ID NO: 85198 - RNA, 19 nt, Homo sapiens
gcagcaacauggacaagau

SEQ ID NO: 85199 - RNA, 19 nt, Homo sapiens
gagugaagaugaagaacga

SEQ ID NO: 85200 - RNA, 19 nt, Homo sapiens
gaagggagcaccagugaag

SEQ ID NO: 85201 - RNA, 19 nt, Homo sapiens
uaacucaaaugggugauga

SEQ ID NO: 85202 - RNA, 19 nt, Homo sapiens
ggaguggucuacagagcaa

SEQ ID NO: 85203 - RNA, 19 nt, Homo sapiens
gaagaugaagaacgagaaa

SEQ ID NO: 85204 - RNA, 19 nt, Homo sapiens
gcacgaacgucggaaacga

SEQ ID NO: 85205 - RNA, 19 nt, Homo sapiens
gagaagacucuauggaaga

SEQ ID NO: 85206 - RNA, 19 nt, Homo sapiens
ggaaggaacaagaggagaa

SEQ ID NO: 85207 - RNA, 19 nt, Homo sapiens
cagcaaaugucucggaaag

SEQ ID NO: 85208 - RNA, 19 nt, Homo sapiens
gaagaaaugagugaagaug

SEQ ID NO: 85209 - RNA, 19 nt, Homo sapiens
cagaaaagaugaaaagaga

SEQ ID NO: 85210 - RNA, 19 nt, Homo sapiens
agaaguaagugaggaagaa

SEQ ID NO: 85211 - RNA, 19 nt, Homo sapiens
ggaagacagaggagaagaa

SEQ ID NO: 85212 - RNA, 19 nt, Homo sapiens
ugacagagggcgacuaugu

SEQ ID NO: 85213 - RNA, 19 nt, Homo sapiens
ggacuacagcgacaaagug

SEQ ID NO: 85214 - RNA, 19 nt, Homo sapiens
gaaggaacaagaggagaaa

SEQ ID NO: 85215 - RNA, 19 nt, Homo sapiens
ggaagugucugcacaucac

SEQ ID NO: 85216 - RNA, 19 nt, Homo sapiens
gagaagaacaggauaaagc

SEQ ID NO: 85217 - RNA, 19 nt, Homo sapiens
ggagaaagcagagauaaaa

SEQ ID NO: 85218 - RNA, 19 nt, Homo sapiens
ugaagaagcagaggaagaa

SEQ ID NO: 85219 - RNA, 19 nt, Homo sapiens
gagcauuccaggagagaaa

SEQ ID NO: 85220 - RNA, 19 nt, Homo sapiens
gaggagaaagcagagauaa

SEQ ID NO: 85221 - RNA, 19 nt, Homo sapiens
gcuucgaccucaugaacaa

SEQ ID NO: 85222 - RNA, 19 nt, Homo sapiens
aaggagggcuucccgauca

SEQ ID NO: 85223 - RNA, 19 nt, Homo sapiens
aaagcaugcuagagugaaa

SEQ ID NO: 85224 - RNA, 19 nt, Homo sapiens
caacaucgucaccguuaga

SEQ ID NO: 85225 - RNA, 19 nt, Homo sapiens
ugagggagaucaacaccau

SEQ ID NO: 85226 - RNA, 19 nt, Homo sapiens
gaaguaagugaggaagaaa

SEQ ID NO: 85227 - RNA, 19 nt, Homo sapiens
cuacagcgacaaagugaaa

SEQ ID NO: 85228 - RNA, 19 nt, Homo sapiens
gaacgaugagagaggacua

SEQ ID NO: 85229 - RNA, 19 nt, Homo sapiens
aaaggacucuuggaaagug

SEQ ID NO: 85230 - RNA, 19 nt, Homo sapiens
ggcugaagauggagaagga

SEQ ID NO: 85231 - RNA, 19 nt, Homo sapiens
gcucuaaagcggcugaaga

SEQ ID NO: 85232 - RNA, 19 nt, Homo sapiens
gaucaacaccauccucaag

SEQ ID NO: 85233 - RNA, 19 nt, Homo sapiens
gaugaaauuguggcucuaa

SEQ ID NO: 85234 - RNA, 19 nt, Homo sapiens
agacagaggagaagaagau

SEQ ID NO: 85235 - RNA, 19 nt, Homo sapiens
gaggugaagacccugauga

SEQ ID NO: 85236 - RNA, 19 nt, Homo sapiens
ggaggaggaggaagaggaa

SEQ ID NO: 85237 - RNA, 19 nt, Homo sapiens
gaaucaggcucagguucug

SEQ ID NO: 85238 - RNA, 19 nt, Homo sapiens
agucagaaaucgaucagau

SEQ ID NO: 85239 - RNA, 19 nt, Homo sapiens
ucacgucgcugagggagau

SEQ ID NO: 85240 - RNA, 19 nt, Homo sapiens
ggaaacgacaucgagaaga

SEQ ID NO: 85241 - RNA, 19 nt, Homo sapiens
gucaguggguugcaucuuc

SEQ ID NO: 85242 - RNA, 19 nt, Homo sapiens
ugaagacccugaugaucca

SEQ ID NO: 85243 - RNA, 19 nt, Homo sapiens
gaaauuguggcucuaaagc

SEQ ID NO: 85244 - RNA, 19 nt, Homo sapiens
ucaaaugggugaugaaaag

SEQ ID NO: 85245 - RNA, 19 nt, Homo sapiens
gaagaacgagaaaaugaaa

SEQ ID NO: 85246 - RNA, 19 nt, Homo sapiens
ggaagaaaugagugaagau

SEQ ID NO: 85247 - RNA, 19 nt, Homo sapiens
agacagaagagaagggaaa

SEQ ID NO: 85248 - RNA, 19 nt, Homo sapiens
gaaugggaaagacagaaga

SEQ ID NO: 85249 - RNA, 19 nt, Homo sapiens
caaaugucucggaaagaaa

SEQ ID NO: 85250 - RNA, 19 nt, Homo sapiens
gaagacagaggagaagaag

SEQ ID NO: 85251 - RNA, 19 nt, Homo sapiens
gcaacauggacaagaucua

SEQ ID NO: 85252 - RNA, 19 nt, Homo sapiens
aggaagaaaugagugaaga

SEQ ID NO: 85253 - RNA, 19 nt, Homo sapiens
gaggagaagaagaugauuc

SEQ ID NO: 85254 - RNA, 19 nt, Homo sapiens
auaaggaacuccccguaua

SEQ ID NO: 85255 - RNA, 19 nt, Homo sapiens
ggagacgggcuuccaccuu

SEQ ID NO: 85256 - RNA, 19 nt, Homo sapiens
ggaagucagaaaucgauca

SEQ ID NO: 85257 - RNA, 19 nt, Homo sapiens
cccaacaucgucaccguua

SEQ ID NO: 85258 - RNA, 19 nt, Homo sapiens
gagugaagaagcagaggaa

SEQ ID NO: 85259 - RNA, 19 nt, Homo sapiens
caaaagacaagaaaacaga

SEQ ID NO: 85260 - RNA, 19 nt, Homo sapiens
gaucgaggagggcaccuau

SEQ ID NO: 85261 - RNA, 19 nt, Homo sapiens
gaaaugagugaagaugaag

SEQ ID NO: 85262 - RNA, 19 nt, Homo sapiens
ggaagaggaggaggaggaa

SEQ ID NO: 85263 - RNA, 19 nt, Homo sapiens
gggaaagacagaagagaag

SEQ ID NO: 85264 - RNA, 19 nt, Homo sapiens
gaagagaaaauggaagaaa

SEQ ID NO: 85265 - RNA, 19 nt, Homo sapiens
caugcuagagugaaagaaa

SEQ ID NO: 85266 - RNA, 19 nt, Homo sapiens
cgucaccguuagagagauu

SEQ ID NO: 85267 - RNA, 19 nt, Homo sapiens
gugaagaagcagaggaaga

SEQ ID NO: 85268 - RNA, 19 nt, Homo sapiens
cgaagaaguaagugaggaa

SEQ ID NO: 85269 - RNA, 19 nt, Homo sapiens
gacuacagcgacaaaguga

SEQ ID NO: 85270 - RNA, 19 nt, Homo sapiens
ggaaugggaaagacagaag

SEQ ID NO: 85271 - RNA, 19 nt, Homo sapiens
caacauggacaagaucuac

SEQ ID NO: 85272 - RNA, 19 nt, Homo sapiens
gaaacgaaggaaggaacaa

SEQ ID NO: 85273 - RNA, 19 nt, Homo sapiens
ggaacaagaggagaaagca

SEQ ID NO: 85274 - RNA, 19 nt, Homo sapiens
ggaagggagcaccagugaa

SEQ ID NO: 85275 - RNA, 19 nt, Homo sapiens
guaagugaggaagaaauga

SEQ ID NO: 85276 - RNA, 19 nt, Homo sapiens
gcagaaucaggcucagguu

SEQ ID NO: 85277 - RNA, 19 nt, Homo sapiens
ggaccgcuuggagcaguua

SEQ ID NO: 85278 - RNA, 19 nt, Homo sapiens
gauggcgugugccucuuca

SEQ ID NO: 85279 - RNA, 19 nt, Homo sapiens
cagaggagaagaagaugau

SEQ ID NO: 85280 - RNA, 19 nt, Homo sapiens
aggacggccucaagcauga

SEQ ID NO: 85281 - RNA, 19 nt, Homo sapiens
gcaccuauggaguggucua

SEQ ID NO: 85282 - RNA, 19 nt, Homo sapiens
gacagagggcgacuaugug

SEQ ID NO: 85283 - RNA, 19 nt, Homo sapiens
aagaaaugagugaagauga

SEQ ID NO: 85284 - RNA, 19 nt, Homo sapiens
cagaagagaagggaaaugg

SEQ ID NO: 85285 - RNA, 19 nt, Homo sapiens
gaagauggagaaggagaag

SEQ ID NO: 85286 - RNA, 19 nt, Homo sapiens
agaggagaaagcagagaua

SEQ ID NO: 85287 - RNA, 19 nt, Homo sapiens
cugcauggagaucacaaua

SEQ ID NO: 85288 - RNA, 19 nt, Homo sapiens
gaaacgacaucgagaagaa

SEQ ID NO: 85289 - RNA, 19 nt, Homo sapiens
gcaaaugucucggaaagaa

SEQ ID NO: 85290 - RNA, 19 nt, Homo sapiens
gagacgggcuuccaccuua

SEQ ID NO: 85291 - RNA, 19 nt, Homo sapiens
gaaaacagaugaaauugug

SEQ ID NO: 85292 - RNA, 19 nt, Homo sapiens
gagcaccagugaagaauca

SEQ ID NO: 85293 - RNA, 19 nt, Homo sapiens
gcauggagaucacaauaag

SEQ ID NO: 85294 - RNA, 19 nt, Homo sapiens
ugaaacaccugcacgacaa

SEQ ID NO: 85295 - RNA, 19 nt, Homo sapiens
uaaagcggcugaagaugga

SEQ ID NO: 85296 - RNA, 19 nt, Homo sapiens
gaaaaggacucuuggaaag

SEQ ID NO: 85297 - RNA, 19 nt, Homo sapiens
agaaaugagugaagaugaa

SEQ ID NO: 85298 - RNA, 19 nt, Homo sapiens
gcagcaacauggacaagau

SEQ ID NO: 85299 - RNA, 19 nt, Homo sapiens
gagugaagaugaagaacga

SEQ ID NO: 85300 - RNA, 19 nt, Homo sapiens
gaagggagcaccagugaag

SEQ ID NO: 85301 - RNA, 19 nt, Homo sapiens
uaacucaaaugggugauga

SEQ ID NO: 85302 - RNA, 19 nt, Homo sapiens
ggaguggucuacagagcaa

SEQ ID NO: 85303 - RNA, 19 nt, Homo sapiens
gaagaugaagaacgagaaa

SEQ ID NO: 85304 - RNA, 19 nt, Homo sapiens
gcacgaacgucggaaacga

SEQ ID NO: 85305 - RNA, 19 nt, Homo sapiens
gagaagacucuauggaaga

SEQ ID NO: 85306 - RNA, 19 nt, Homo sapiens
ggaaggaacaagaggagaa

SEQ ID NO: 85307 - RNA, 19 nt, Homo sapiens
cagcaaaugucucggaaag

SEQ ID NO: 85308 - RNA, 19 nt, Homo sapiens
gaagaaaugagugaagaug

SEQ ID NO: 85309 - RNA, 19 nt, Homo sapiens
cagaaaagaugaaaagaga

SEQ ID NO: 85310 - RNA, 19 nt, Homo sapiens
agaaguaagugaggaagaa

SEQ ID NO: 85311 - RNA, 19 nt, Homo sapiens
ggaagacagaggagaagaa

SEQ ID NO: 85312 - RNA, 19 nt, Homo sapiens
ugacagagggcgacuaugu

SEQ ID NO: 85313 - RNA, 19 nt, Homo sapiens
ggacuacagcgacaaagug

SEQ ID NO: 85314 - RNA, 19 nt, Homo sapiens
gaaggaacaagaggagaaa

SEQ ID NO: 85315 - RNA, 19 nt, Homo sapiens
ggaagugucugcacaucac

SEQ ID NO: 85316 - RNA, 19 nt, Homo sapiens
gagaagaacaggauaaagc

SEQ ID NO: 85317 - RNA, 19 nt, Homo sapiens
ggagaaagcagagauaaaa

SEQ ID NO: 85318 - RNA, 19 nt, Homo sapiens
ugaagaagcagaggaagaa

SEQ ID NO: 85319 - RNA, 19 nt, Homo sapiens
gagcauuccaggagagaaa

SEQ ID NO: 85320 - RNA, 19 nt, Homo sapiens
gaggagaaagcagagauaa

SEQ ID NO: 85321 - RNA, 19 nt, Homo sapiens
gcuucgaccucaugaacaa

SEQ ID NO: 85322 - RNA, 19 nt, Homo sapiens
aaggagggcuucccgauca

SEQ ID NO: 85323 - RNA, 19 nt, Homo sapiens
aaagcaugcuagagugaaa

SEQ ID NO: 85324 - RNA, 19 nt, Homo sapiens
caacaucgucaccguuaga

SEQ ID NO: 85325 - RNA, 19 nt, Homo sapiens
ugagggagaucaacaccau

SEQ ID NO: 85326 - RNA, 19 nt, Homo sapiens
gaaguaagugaggaagaaa

SEQ ID NO: 85327 - RNA, 19 nt, Homo sapiens
cuacagcgacaaagugaaa

SEQ ID NO: 85328 - RNA, 19 nt, Homo sapiens
gaacgaugagagaggacua

SEQ ID NO: 85329 - RNA, 19 nt, Homo sapiens
aaaggacucuuggaaagug

SEQ ID NO: 85330 - RNA, 19 nt, Homo sapiens
ggcugaagauggagaagga

SEQ ID NO: 85331 - RNA, 19 nt, Homo sapiens
gcucuaaagcggcugaaga

SEQ ID NO: 85332 - RNA, 19 nt, Homo sapiens
gaucaacaccauccucaag

SEQ ID NO: 85333 - RNA, 19 nt, Homo sapiens
gaugaaauuguggcucuaa

SEQ ID NO: 85334 - RNA, 19 nt, Homo sapiens
agacagaggagaagaagau

SEQ ID NO: 85335 - RNA, 19 nt, Homo sapiens
gaggugaagacccugauga

SEQ ID NO: 85336 - RNA, 19 nt, Homo sapiens
ggaggaggaggaagaggaa

SEQ ID NO: 85337 - RNA, 19 nt, Homo sapiens
gaaucaggcucagguucug

SEQ ID NO: 85338 - RNA, 19 nt, Homo sapiens
agucagaaaucgaucagau

SEQ ID NO: 85339 - RNA, 19 nt, Homo sapiens
ucacgucgcugagggagau

SEQ ID NO: 85340 - RNA, 19 nt, Homo sapiens
ggaaacgacaucgagaaga

SEQ ID NO: 85341 - RNA, 19 nt, Homo sapiens
gucaguggguugcaucuuc

SEQ ID NO: 85342 - RNA, 19 nt, Homo sapiens
ugaagacccugaugaucca

SEQ ID NO: 85343 - RNA, 19 nt, Homo sapiens
gaaauuguggcucuaaagc

SEQ ID NO: 85344 - RNA, 19 nt, Homo sapiens
ucaaaugggugaugaaaag

SEQ ID NO: 85345 - RNA, 19 nt, Homo sapiens
gaagaacgagaaaaugaaa

SEQ ID NO: 85346 - RNA, 19 nt, Homo sapiens
ggaagaaaugagugaagau

SEQ ID NO: 85347 - RNA, 19 nt, Homo sapiens
agacagaagagaagggaaa

SEQ ID NO: 85348 - RNA, 19 nt, Homo sapiens
gaaugggaaagacagaaga

SEQ ID NO: 85349 - RNA, 19 nt, Homo sapiens
caaaugucucggaaagaaa

SEQ ID NO: 85350 - RNA, 19 nt, Homo sapiens
gaagacagaggagaagaag

SEQ ID NO: 85351 - RNA, 19 nt, Homo sapiens
gcaacauggacaagaucua

SEQ ID NO: 85352 - RNA, 19 nt, Homo sapiens
aggaagaaaugagugaaga

SEQ ID NO: 85353 - RNA, 19 nt, Homo sapiens
gaggagaagaagaugauuc

SEQ ID NO: 85354 - RNA, 19 nt, Homo sapiens
auaaggaacuccccguaua

SEQ ID NO: 85355 - RNA, 19 nt, Homo sapiens
ggagacgggcuuccaccuu

SEQ ID NO: 85356 - RNA, 19 nt, Homo sapiens
ggaagucagaaaucgauca

SEQ ID NO: 85357 - RNA, 19 nt, Homo sapiens
cccaacaucgucaccguua

SEQ ID NO: 85358 - RNA, 19 nt, Homo sapiens
gagugaagaagcagaggaa

SEQ ID NO: 85359 - RNA, 19 nt, Homo sapiens
caaaagacaagaaaacaga

SEQ ID NO: 85360 - RNA, 19 nt, Homo sapiens
gaucgaggagggcaccuau

SEQ ID NO: 85361 - RNA, 19 nt, Homo sapiens
gaaaugagugaagaugaag

SEQ ID NO: 85362 - RNA, 19 nt, Homo sapiens
ggaagaggaggaggaggaa

SEQ ID NO: 85363 - RNA, 19 nt, Homo sapiens
gggaaagacagaagagaag

SEQ ID NO: 85364 - RNA, 19 nt, Homo sapiens
gaagagaaaauggaagaaa

SEQ ID NO: 85365 - RNA, 19 nt, Homo sapiens
caugcuagagugaaagaaa

SEQ ID NO: 85366 - RNA, 19 nt, Homo sapiens
cgucaccguuagagagauu

SEQ ID NO: 85367 - RNA, 19 nt, Homo sapiens
gugaagaagcagaggaaga

SEQ ID NO: 85368 - RNA, 19 nt, Homo sapiens
cgaagaaguaagugaggaa

SEQ ID NO: 85369 - RNA, 19 nt, Homo sapiens
gacuacagcgacaaaguga

SEQ ID NO: 85370 - RNA, 19 nt, Homo sapiens
ggaaugggaaagacagaag

SEQ ID NO: 85371 - RNA, 19 nt, Homo sapiens
caacauggacaagaucuac

SEQ ID NO: 85372 - RNA, 19 nt, Homo sapiens
gaaacgaaggaaggaacaa

SEQ ID NO: 85373 - RNA, 19 nt, Homo sapiens
ggaacaagaggagaaagca

SEQ ID NO: 85374 - RNA, 19 nt, Homo sapiens
ggaagggagcaccagugaa

SEQ ID NO: 85375 - RNA, 19 nt, Homo sapiens
guaagugaggaagaaauga

SEQ ID NO: 85376 - RNA, 19 nt, Homo sapiens
gcagaaucaggcucagguu

SEQ ID NO: 85377 - RNA, 19 nt, Homo sapiens
ggaccgcuuggagcaguua

SEQ ID NO: 85378 - RNA, 19 nt, Homo sapiens
cagaggagaagaagaugau

SEQ ID NO: 85379 - RNA, 19 nt, Homo sapiens
aggacggccucaagcauga

SEQ ID NO: 85380 - RNA, 19 nt, Homo sapiens
gcaccuauggaguggucua

SEQ ID NO: 85381 - RNA, 19 nt, Homo sapiens
gacagagggcgacuaugug

SEQ ID NO: 85382 - RNA, 19 nt, Homo sapiens
aagaaaugagugaagauga

SEQ ID NO: 85383 - RNA, 19 nt, Homo sapiens
cagaagagaagggaaaugg

SEQ ID NO: 85384 - RNA, 19 nt, Homo sapiens
gaagauggagaaggagaag

SEQ ID NO: 85385 - RNA, 19 nt, Homo sapiens
agaggagaaagcagagaua

SEQ ID NO: 85386 - RNA, 19 nt, Homo sapiens
cugcauggagaucacaaua

SEQ ID NO: 85387 - RNA, 19 nt, Homo sapiens
gaggagaccggcagcaacu

SEQ ID NO: 85388 - RNA, 19 nt, Homo sapiens
gaaacgacaucgagaagaa

SEQ ID NO: 85389 - RNA, 19 nt, Homo sapiens
gagacgggcuuccaccuua

SEQ ID NO: 85390 - RNA, 19 nt, Homo sapiens
gaagcaugcuagagugaaa

SEQ ID NO: 85391 - RNA, 19 nt, Homo sapiens
gaaaacagaugaaauugug

SEQ ID NO: 85392 - RNA, 19 nt, Homo sapiens
gagcaccagugaagaauca

SEQ ID NO: 85393 - RNA, 19 nt, Homo sapiens
gcauggagaucacaauaag

SEQ ID NO: 85394 - RNA, 19 nt, Homo sapiens
ugaaacaccugcacgacaa

SEQ ID NO: 85395 - RNA, 19 nt, Homo sapiens
uaaagcggcugaagaugga

SEQ ID NO: 85396 - RNA, 19 nt, Homo sapiens
gaaaaggacucuuggaaag

SEQ ID NO: 85397 - RNA, 19 nt, Homo sapiens
agaaaugagugaagaugaa

SEQ ID NO: 85398 - RNA, 19 nt, Homo sapiens
gcagcaacauggacaagau

SEQ ID NO: 85399 - RNA, 19 nt, Homo sapiens
gagugaagaugaagaacga

SEQ ID NO: 85400 - RNA, 19 nt, Homo sapiens
gaagagaagacucaaugga

SEQ ID NO: 85401 - RNA, 19 nt, Homo sapiens
gaagggagcaccagugaag

SEQ ID NO: 85402 - RNA, 19 nt, Homo sapiens
cagcaaaugucuuggaaag

SEQ ID NO: 85403 - RNA, 19 nt, Homo sapiens
uaacucaaaugggugauga

SEQ ID NO: 85404 - RNA, 19 nt, Homo sapiens
ggaguggucuacagagcaa

SEQ ID NO: 85405 - RNA, 19 nt, Homo sapiens
gaagaugaagaacgagaaa

SEQ ID NO: 85406 - RNA, 19 nt, Homo sapiens
gcacgaacgucggaaacga

SEQ ID NO: 85407 - RNA, 19 nt, Homo sapiens
ggaaggaacaagaggagaa

SEQ ID NO: 85408 - RNA, 19 nt, Homo sapiens
gaagaaaugagugaagaug

SEQ ID NO: 85409 - RNA, 19 nt, Homo sapiens
agaaguaagugaggaagaa

SEQ ID NO: 85410 - RNA, 19 nt, Homo sapiens
gaaagaaagagagcacgaa

SEQ ID NO: 85411 - RNA, 19 nt, Homo sapiens
ggaagacagaggagaagaa

SEQ ID NO: 85412 - RNA, 19 nt, Homo sapiens
ugacagagggcgacuaugu

SEQ ID NO: 85413 - RNA, 19 nt, Homo sapiens
ggacuacagcgacaaagug

SEQ ID NO: 85414 - RNA, 19 nt, Homo sapiens
gaaggaacaagaggagaaa

SEQ ID NO: 85415 - RNA, 19 nt, Homo sapiens
ggaagugucugcacaucac

SEQ ID NO: 85416 - RNA, 19 nt, Homo sapiens
gagaagaacaggauaaagc

SEQ ID NO: 85417 - RNA, 19 nt, Homo sapiens
ggagaaagcagagauaaaa

SEQ ID NO: 85418 - RNA, 19 nt, Homo sapiens
ugaagaagcagaggaagaa

SEQ ID NO: 85419 - RNA, 19 nt, Homo sapiens
gagcauuccaggagagaaa

SEQ ID NO: 85420 - RNA, 19 nt, Homo sapiens
gaggagaaagcagagauaa

SEQ ID NO: 85421 - RNA, 19 nt, Homo sapiens
gcuucgaccucaugaacaa

SEQ ID NO: 85422 - RNA, 19 nt, Homo sapiens
aaggagggcuucccgauca

SEQ ID NO: 85423 - RNA, 19 nt, Homo sapiens
acagugagcucccaguagu

SEQ ID NO: 85424 - RNA, 19 nt, Homo sapiens
gagaagacucaauggaaga

SEQ ID NO: 85425 - RNA, 19 nt, Homo sapiens
ggaauucggaaaucgauca

SEQ ID NO: 85426 - RNA, 19 nt, Homo sapiens
uagaagagaagacucaaug

SEQ ID NO: 85427 - RNA, 19 nt, Homo sapiens
aaaggacucuuggaaagug

SEQ ID NO: 85428 - RNA, 19 nt, Homo sapiens
ugagggagaucaacaccau

SEQ ID NO: 85429 - RNA, 19 nt, Homo sapiens
gaaguaagugaggaagaaa

SEQ ID NO: 85430 - RNA, 19 nt, Homo sapiens
cuacagcgacaaagugaaa

SEQ ID NO: 85431 - RNA, 19 nt, Homo sapiens
gaacgaugagagaggacua

SEQ ID NO: 85432 - RNA, 19 nt, Homo sapiens
ucauagccauucagcagaa

SEQ ID NO: 85433 - RNA, 19 nt, Homo sapiens
ggcugaagauggagaagga

SEQ ID NO: 85434 - RNA, 19 nt, Homo sapiens
gcucuaaagcggcugaaga

SEQ ID NO: 85435 - RNA, 19 nt, Homo sapiens
gaucaacaccauccucaag

SEQ ID NO: 85436 - RNA, 19 nt, Homo sapiens
gaugaaauuguggcucuaa

SEQ ID NO: 85437 - RNA, 19 nt, Homo sapiens
agacagaggagaagaagau

SEQ ID NO: 85438 - RNA, 19 nt, Homo sapiens
gaggugaagacccugauga

SEQ ID NO: 85439 - RNA, 19 nt, Homo sapiens
gaaucaggcucagguucug

SEQ ID NO: 85440 - RNA, 19 nt, Homo sapiens
aagagaagacucaauggaa

SEQ ID NO: 85441 - RNA, 19 nt, Homo sapiens
ggaaacgacaucgagaaga

SEQ ID NO: 85442 - RNA, 19 nt, Homo sapiens
gaaaagaugaaaagaggaa

SEQ ID NO: 85443 - RNA, 19 nt, Homo sapiens
ugaagacccugaugaucca

SEQ ID NO: 85444 - RNA, 19 nt, Homo sapiens
gaaauuguggcucuaaagc

SEQ ID NO: 85445 - RNA, 19 nt, Homo sapiens
ucaaaugggugaugaaaag

SEQ ID NO: 85446 - RNA, 19 nt, Homo sapiens
gaagaacgagaaaaugaaa

SEQ ID NO: 85447 - RNA, 19 nt, Homo sapiens
ggaagaaaugagugaagau

SEQ ID NO: 85448 - RNA, 19 nt, Homo sapiens
agacagaagagaagggaaa

SEQ ID NO: 85449 - RNA, 19 nt, Homo sapiens
gaaugggaaagacagaaga

SEQ ID NO: 85450 - RNA, 19 nt, Homo sapiens
gaagacagaggagaagaag

SEQ ID NO: 85451 - RNA, 19 nt, Homo sapiens
guauagaagagaagacuca

SEQ ID NO: 85452 - RNA, 19 nt, Homo sapiens
gcaacauggacaagaucua

SEQ ID NO: 85453 - RNA, 19 nt, Homo sapiens
aggaagaaaugagugaaga

SEQ ID NO: 85454 - RNA, 19 nt, Homo sapiens
gaggagaagaagaugauuc

SEQ ID NO: 85455 - RNA, 19 nt, Homo sapiens
auaaggaacuccccguaua

SEQ ID NO: 85456 - RNA, 19 nt, Homo sapiens
ggagacgggcuuccaccuu

SEQ ID NO: 85457 - RNA, 19 nt, Homo sapiens
gagugaagaagcagaggaa

SEQ ID NO: 85458 - RNA, 19 nt, Homo sapiens
caacauugucaccguuaga

SEQ ID NO: 85459 - RNA, 19 nt, Homo sapiens
caaaagacaagaaaacaga

SEQ ID NO: 85460 - RNA, 19 nt, Homo sapiens
gaucgaggagggcaccuau

SEQ ID NO: 85461 - RNA, 19 nt, Homo sapiens
gaaaugagugaagaugaag

SEQ ID NO: 85462 - RNA, 19 nt, Homo sapiens
ggaagaggaggaggaggaa

SEQ ID NO: 85463 - RNA, 19 nt, Homo sapiens
gggaaagacagaagagaag

SEQ ID NO: 85464 - RNA, 19 nt, Homo sapiens
ggcccagcaucccaacauu

SEQ ID NO: 85465 - RNA, 19 nt, Homo sapiens
gaagagaaaauggaagaaa

SEQ ID NO: 85466 - RNA, 19 nt, Homo sapiens
caugcuagagugaaagaaa

SEQ ID NO: 85467 - RNA, 19 nt, Homo sapiens
ccaguagucaagaagauga

SEQ ID NO: 85468 - RNA, 19 nt, Homo sapiens
gugaagaagcagaggaaga

SEQ ID NO: 85469 - RNA, 19 nt, Homo sapiens
cgaagaaguaagugaggaa

SEQ ID NO: 85470 - RNA, 19 nt, Homo sapiens
ugaagaaucagaggaggaa

SEQ ID NO: 85471 - RNA, 19 nt, Homo sapiens
gacuacagcgacaaaguga

SEQ ID NO: 85472 - RNA, 19 nt, Homo sapiens
ggaaugggaaagacagaag

SEQ ID NO: 85473 - RNA, 19 nt, Homo sapiens
gagcgcgguugcuguuucu

SEQ ID NO: 85474 - RNA, 19 nt, Homo sapiens
ggaagcaugcuagagugaa

SEQ ID NO: 85475 - RNA, 19 nt, Homo sapiens
cgagcgcgguugcuguuuc

SEQ ID NO: 85476 - RNA, 19 nt, Homo sapiens
cuacagugagcucccagua

SEQ ID NO: 85477 - RNA, 19 nt, Homo sapiens
caacauggacaagaucuac

SEQ ID NO: 85478 - RNA, 19 nt, Homo sapiens
ggaacaagaggagaaagca

SEQ ID NO: 85479 - RNA, 19 nt, Homo sapiens
gaaacgaaggaaggaacaa

SEQ ID NO: 85480 - RNA, 19 nt, Homo sapiens
ggaagggagcaccagugaa

SEQ ID NO: 85481 - RNA, 19 nt, Homo sapiens
gggaagcaugcuagaguga

SEQ ID NO: 85482 - RNA, 19 nt, Homo sapiens
guaagugaggaagaaauga

SEQ ID NO: 85483 - RNA, 19 nt, Homo sapiens
gcagaaucaggcucagguu

SEQ ID NO: 85484 - RNA, 19 nt, Homo sapiens
ggaccgcuuggagcaguua

SEQ ID NO: 85485 - RNA, 19 nt, Homo sapiens
gaugaaaagaggaaagaaa

SEQ ID NO: 85486 - RNA, 19 nt, Homo sapiens
cccagcaaaugucuuggaa

SEQ ID NO: 85487 - RNA, 19 nt, Homo sapiens
cagaggagaagaagaugau

SEQ ID NO: 85488 - RNA, 19 nt, Homo sapiens
gaaacgacaucgagaagaa

SEQ ID NO: 85489 - RNA, 19 nt, Homo sapiens
gagacgggcuuccaccuua

SEQ ID NO: 85490 - RNA, 19 nt, Homo sapiens
gaagcaugcuagagugaaa

SEQ ID NO: 85491 - RNA, 19 nt, Homo sapiens
gaaaacagaugaaauugug

SEQ ID NO: 85492 - RNA, 19 nt, Homo sapiens
gagcaccagugaagaauca

SEQ ID NO: 85493 - RNA, 19 nt, Homo sapiens
gcauggagaucacaauaag

SEQ ID NO: 85494 - RNA, 19 nt, Homo sapiens
ugaaacaccugcacgacaa

SEQ ID NO: 85495 - RNA, 19 nt, Homo sapiens
uaaagcggcugaagaugga

SEQ ID NO: 85496 - RNA, 19 nt, Homo sapiens
gaaaaggacucuuggaaag

SEQ ID NO: 85497 - RNA, 19 nt, Homo sapiens
agaaaugagugaagaugaa

SEQ ID NO: 85498 - RNA, 19 nt, Homo sapiens
gcagcaacauggacaagau

SEQ ID NO: 85499 - RNA, 19 nt, Homo sapiens
gagugaagaugaagaacga

SEQ ID NO: 85500 - RNA, 19 nt, Homo sapiens
gaagagaagacucaaugga

SEQ ID NO: 85501 - RNA, 19 nt, Homo sapiens
gaagggagcaccagugaag

SEQ ID NO: 85502 - RNA, 19 nt, Homo sapiens
cagcaaaugucuuggaaag

SEQ ID NO: 85503 - RNA, 19 nt, Homo sapiens
uaacucaaaugggugauga

SEQ ID NO: 85504 - RNA, 19 nt, Homo sapiens
ggaguggucuacagagcaa

SEQ ID NO: 85505 - RNA, 19 nt, Homo sapiens
gaagaugaagaacgagaaa

SEQ ID NO: 85506 - RNA, 19 nt, Homo sapiens
gcacgaacgucggaaacga

SEQ ID NO: 85507 - RNA, 19 nt, Homo sapiens
ggaaggaacaagaggagaa

SEQ ID NO: 85508 - RNA, 19 nt, Homo sapiens
gaagaaaugagugaagaug

SEQ ID NO: 85509 - RNA, 19 nt, Homo sapiens
agaaguaagugaggaagaa

SEQ ID NO: 85510 - RNA, 19 nt, Homo sapiens
gaaagaaagagagcacgaa

SEQ ID NO: 85511 - RNA, 19 nt, Homo sapiens
ggaagacagaggagaagaa

SEQ ID NO: 85512 - RNA, 19 nt, Homo sapiens
ggacuacagcgacaaagug

SEQ ID NO: 85513 - RNA, 19 nt, Homo sapiens
gaaggaacaagaggagaaa

SEQ ID NO: 85514 - RNA, 19 nt, Homo sapiens
ggaagugucugcacaucac

SEQ ID NO: 85515 - RNA, 19 nt, Homo sapiens
gagaagaacaggauaaagc

SEQ ID NO: 85516 - RNA, 19 nt, Homo sapiens
ggagaaagcagagauaaaa

SEQ ID NO: 85517 - RNA, 19 nt, Homo sapiens
ugaagaagcagaggaagaa

SEQ ID NO: 85518 - RNA, 19 nt, Homo sapiens
gagcauuccaggagagaaa

SEQ ID NO: 85519 - RNA, 19 nt, Homo sapiens
gaggagaaagcagagauaa

SEQ ID NO: 85520 - RNA, 19 nt, Homo sapiens
gcuucgaccucaugaacaa

SEQ ID NO: 85521 - RNA, 19 nt, Homo sapiens
aaggagggcuucccgauca

SEQ ID NO: 85522 - RNA, 19 nt, Homo sapiens
acagugagcucccaguagu

SEQ ID NO: 85523 - RNA, 19 nt, Homo sapiens
gagaagacucaauggaaga

SEQ ID NO: 85524 - RNA, 19 nt, Homo sapiens
ggaauucggaaaucgauca

SEQ ID NO: 85525 - RNA, 19 nt, Homo sapiens
uagaagagaagacucaaug

SEQ ID NO: 85526 - RNA, 19 nt, Homo sapiens
ugagggagaucaacaccau

SEQ ID NO: 85527 - RNA, 19 nt, Homo sapiens
gaaguaagugaggaagaaa

SEQ ID NO: 85528 - RNA, 19 nt, Homo sapiens
cuacagcgacaaagugaaa

SEQ ID NO: 85529 - RNA, 19 nt, Homo sapiens
gaacgaugagagaggacua

SEQ ID NO: 85530 - RNA, 19 nt, Homo sapiens
ucauagccauucagcagaa

SEQ ID NO: 85531 - RNA, 19 nt, Homo sapiens
aaaggacucuuggaaagug

SEQ ID NO: 85532 - RNA, 19 nt, Homo sapiens
ggcugaagauggagaagga

SEQ ID NO: 85533 - RNA, 19 nt, Homo sapiens
gcucuaaagcggcugaaga

SEQ ID NO: 85534 - RNA, 19 nt, Homo sapiens
gaucaacaccauccucaag

SEQ ID NO: 85535 - RNA, 19 nt, Homo sapiens
gaugaaauuguggcucuaa

SEQ ID NO: 85536 - RNA, 19 nt, Homo sapiens
agacagaggagaagaagau

SEQ ID NO: 85537 - RNA, 19 nt, Homo sapiens
gaggugaagacccugauga

SEQ ID NO: 85538 - RNA, 19 nt, Homo sapiens
gaaucaggcucagguucug

SEQ ID NO: 85539 - RNA, 19 nt, Homo sapiens
aagagaagacucaauggaa

SEQ ID NO: 85540 - RNA, 19 nt, Homo sapiens
ggaaacgacaucgagaaga

SEQ ID NO: 85541 - RNA, 19 nt, Homo sapiens
gaaaagaugaaaagaggaa

SEQ ID NO: 85542 - RNA, 19 nt, Homo sapiens
ugaagacccugaugaucca

SEQ ID NO: 85543 - RNA, 19 nt, Homo sapiens
gaaauuguggcucuaaagc

SEQ ID NO: 85544 - RNA, 19 nt, Homo sapiens
ucaaaugggugaugaaaag

SEQ ID NO: 85545 - RNA, 19 nt, Homo sapiens
gaagaacgagaaaaugaaa

SEQ ID NO: 85546 - RNA, 19 nt, Homo sapiens
ggaagaaaugagugaagau

SEQ ID NO: 85547 - RNA, 19 nt, Homo sapiens
agacagaagagaagggaaa

SEQ ID NO: 85548 - RNA, 19 nt, Homo sapiens
gaaugggaaagacagaaga

SEQ ID NO: 85549 - RNA, 19 nt, Homo sapiens
gaagacagaggagaagaag

SEQ ID NO: 85550 - RNA, 19 nt, Homo sapiens
guauagaagagaagacuca

SEQ ID NO: 85551 - RNA, 19 nt, Homo sapiens
gcaacauggacaagaucua

SEQ ID NO: 85552 - RNA, 19 nt, Homo sapiens
aggaagaaaugagugaaga

SEQ ID NO: 85553 - RNA, 19 nt, Homo sapiens
gaggagaagaagaugauuc

SEQ ID NO: 85554 - RNA, 19 nt, Homo sapiens
auaaggaacuccccguaua

SEQ ID NO: 85555 - RNA, 19 nt, Homo sapiens
ggagacgggcuuccaccuu

SEQ ID NO: 85556 - RNA, 19 nt, Homo sapiens
gagugaagaagcagaggaa

SEQ ID NO: 85557 - RNA, 19 nt, Homo sapiens
caacauugucaccguuaga

SEQ ID NO: 85558 - RNA, 19 nt, Homo sapiens
caaaagacaagaaaacaga

SEQ ID NO: 85559 - RNA, 19 nt, Homo sapiens
gaucgaggagggcaccuau

SEQ ID NO: 85560 - RNA, 19 nt, Homo sapiens
gaaaugagugaagaugaag

SEQ ID NO: 85561 - RNA, 19 nt, Homo sapiens
ggaagaggaggaggaggaa

SEQ ID NO: 85562 - RNA, 19 nt, Homo sapiens
gggaaagacagaagagaag

SEQ ID NO: 85563 - RNA, 19 nt, Homo sapiens
ggcccagcaucccaacauu

SEQ ID NO: 85564 - RNA, 19 nt, Homo sapiens
gaagagaaaauggaagaaa

SEQ ID NO: 85565 - RNA, 19 nt, Homo sapiens
caugcuagagugaaagaaa

SEQ ID NO: 85566 - RNA, 19 nt, Homo sapiens
ccaguagucaagaagauga

SEQ ID NO: 85567 - RNA, 19 nt, Homo sapiens
gugaagaagcagaggaaga

SEQ ID NO: 85568 - RNA, 19 nt, Homo sapiens
cgaagaaguaagugaggaa

SEQ ID NO: 85569 - RNA, 19 nt, Homo sapiens
ugaagaaucagaggaggaa

SEQ ID NO: 85570 - RNA, 19 nt, Homo sapiens
gacuacagcgacaaaguga

SEQ ID NO: 85571 - RNA, 19 nt, Homo sapiens
ggaaugggaaagacagaag

SEQ ID NO: 85572 - RNA, 19 nt, Homo sapiens
gagcgcgguugcuguuucu

SEQ ID NO: 85573 - RNA, 19 nt, Homo sapiens
ggaagcaugcuagagugaa

SEQ ID NO: 85574 - RNA, 19 nt, Homo sapiens
cgagcgcgguugcuguuuc

SEQ ID NO: 85575 - RNA, 19 nt, Homo sapiens
cuacagugagcucccagua

SEQ ID NO: 85576 - RNA, 19 nt, Homo sapiens
caacauggacaagaucuac

SEQ ID NO: 85577 - RNA, 19 nt, Homo sapiens
ggaacaagaggagaaagca

SEQ ID NO: 85578 - RNA, 19 nt, Homo sapiens
gaaacgaaggaaggaacaa

SEQ ID NO: 85579 - RNA, 19 nt, Homo sapiens
ggaagggagcaccagugaa

SEQ ID NO: 85580 - RNA, 19 nt, Homo sapiens
gggaagcaugcuagaguga

SEQ ID NO: 85581 - RNA, 19 nt, Homo sapiens
guaagugaggaagaaauga

SEQ ID NO: 85582 - RNA, 19 nt, Homo sapiens
gcagaaucaggcucagguu

SEQ ID NO: 85583 - RNA, 19 nt, Homo sapiens
ggaccgcuuggagcaguua

SEQ ID NO: 85584 - RNA, 19 nt, Homo sapiens
gaugaaaagaggaaagaaa

SEQ ID NO: 85585 - RNA, 19 nt, Homo sapiens
cccagcaaaugucuuggaa

SEQ ID NO: 85586 - RNA, 19 nt, Homo sapiens
cagaggagaagaagaugau

SEQ ID NO: 85587 - RNA, 19 nt, Homo sapiens
aggacggccucaagcauga

SEQ ID NO: 85588 - RNA, 19 nt, Homo sapiens
gaaacgacaucgagaagaa

SEQ ID NO: 85589 - RNA, 19 nt, Homo sapiens
gagacgggcuuccaccuua

SEQ ID NO: 85590 - RNA, 19 nt, Homo sapiens
gaagcaugcuagagugaaa

SEQ ID NO: 85591 - RNA, 19 nt, Homo sapiens
gaaaacagaugaaauugug

SEQ ID NO: 85592 - RNA, 19 nt, Homo sapiens
gagcaccagugaagaauca

SEQ ID NO: 85593 - RNA, 19 nt, Homo sapiens
gcauggagaucacaauaag

SEQ ID NO: 85594 - RNA, 19 nt, Homo sapiens
ugaaacaccugcacgacaa

SEQ ID NO: 85595 - RNA, 19 nt, Homo sapiens
uaaagcggcugaagaugga

SEQ ID NO: 85596 - RNA, 19 nt, Homo sapiens
gaaaaggacucuuggaaag

SEQ ID NO: 85597 - RNA, 19 nt, Homo sapiens
agaaaugagugaagaugaa

SEQ ID NO: 85598 - RNA, 19 nt, Homo sapiens
gcagcaacauggacaagau

SEQ ID NO: 85599 - RNA, 19 nt, Homo sapiens
gagugaagaugaagaacga

SEQ ID NO: 85600 - RNA, 19 nt, Homo sapiens
gaagagaagacucaaugga

SEQ ID NO: 85601 - RNA, 19 nt, Homo sapiens
gaagggagcaccagugaag

SEQ ID NO: 85602 - RNA, 19 nt, Homo sapiens
cagcaaaugucuuggaaag

SEQ ID NO: 85603 - RNA, 19 nt, Homo sapiens
uaacucaaaugggugauga

SEQ ID NO: 85604 - RNA, 19 nt, Homo sapiens
ggaguggucuacagagcaa

SEQ ID NO: 85605 - RNA, 19 nt, Homo sapiens
gaagaugaagaacgagaaa

SEQ ID NO: 85606 - RNA, 19 nt, Homo sapiens
gcacgaacgucggaaacga

SEQ ID NO: 85607 - RNA, 19 nt, Homo sapiens
ggaaggaacaagaggagaa

SEQ ID NO: 85608 - RNA, 19 nt, Homo sapiens
gaagaaaugagugaagaug

SEQ ID NO: 85609 - RNA, 19 nt, Homo sapiens
agaaguaagugaggaagaa

SEQ ID NO: 85610 - RNA, 19 nt, Homo sapiens
gaaagaaagagagcacgaa

SEQ ID NO: 85611 - RNA, 19 nt, Homo sapiens
ggaagacagaggagaagaa

SEQ ID NO: 85612 - RNA, 19 nt, Homo sapiens
ugacagagggcgacuaugu

SEQ ID NO: 85613 - RNA, 19 nt, Homo sapiens
ggacuacagcgacaaagug

SEQ ID NO: 85614 - RNA, 19 nt, Homo sapiens
gaaggaacaagaggagaaa

SEQ ID NO: 85615 - RNA, 19 nt, Homo sapiens
ggaagugucugcacaucac

SEQ ID NO: 85616 - RNA, 19 nt, Homo sapiens
gagaagaacaggauaaagc

SEQ ID NO: 85617 - RNA, 19 nt, Homo sapiens
ggagaaagcagagauaaaa

SEQ ID NO: 85618 - RNA, 19 nt, Homo sapiens
ugaagaagcagaggaagaa

SEQ ID NO: 85619 - RNA, 19 nt, Homo sapiens
gagcauuccaggagagaaa

SEQ ID NO: 85620 - RNA, 19 nt, Homo sapiens
gaggagaaagcagagauaa

SEQ ID NO: 85621 - RNA, 19 nt, Homo sapiens
gcuucgaccucaugaacaa

SEQ ID NO: 85622 - RNA, 19 nt, Homo sapiens
aaggagggcuucccgauca

SEQ ID NO: 85623 - RNA, 19 nt, Homo sapiens
acagugagcucccaguagu

SEQ ID NO: 85624 - RNA, 19 nt, Homo sapiens
gagaagacucaauggaaga

SEQ ID NO: 85625 - RNA, 19 nt, Homo sapiens
ggaauucggaaaucgauca

SEQ ID NO: 85626 - RNA, 19 nt, Homo sapiens
uagaagagaagacucaaug

SEQ ID NO: 85627 - RNA, 19 nt, Homo sapiens
aaaggacucuuggaaagug

SEQ ID NO: 85628 - RNA, 19 nt, Homo sapiens
ugagggagaucaacaccau

SEQ ID NO: 85629 - RNA, 19 nt, Homo sapiens
gaaguaagugaggaagaaa

SEQ ID NO: 85630 - RNA, 19 nt, Homo sapiens
cuacagcgacaaagugaaa

SEQ ID NO: 85631 - RNA, 19 nt, Homo sapiens
gaacgaugagagaggacua

SEQ ID NO: 85632 - RNA, 19 nt, Homo sapiens
ggcugaagauggagaagga

SEQ ID NO: 85633 - RNA, 19 nt, Homo sapiens
gcucuaaagcggcugaaga

SEQ ID NO: 85634 - RNA, 19 nt, Homo sapiens
gaucaacaccauccucaag

SEQ ID NO: 85635 - RNA, 19 nt, Homo sapiens
gaugaaauuguggcucuaa

SEQ ID NO: 85636 - RNA, 19 nt, Homo sapiens
agacagaggagaagaagau

SEQ ID NO: 85637 - RNA, 19 nt, Homo sapiens
gaggugaagacccugauga

SEQ ID NO: 85638 - RNA, 19 nt, Homo sapiens
gaaucaggcucagguucug

SEQ ID NO: 85639 - RNA, 19 nt, Homo sapiens
aagagaagacucaauggaa

SEQ ID NO: 85640 - RNA, 19 nt, Homo sapiens
ggaaacgacaucgagaaga

SEQ ID NO: 85641 - RNA, 19 nt, Homo sapiens
gaaaagaugaaaagaggaa

SEQ ID NO: 85642 - RNA, 19 nt, Homo sapiens
ugaagacccugaugaucca

SEQ ID NO: 85643 - RNA, 19 nt, Homo sapiens
gaaauuguggcucuaaagc

SEQ ID NO: 85644 - RNA, 19 nt, Homo sapiens
ucaaaugggugaugaaaag

SEQ ID NO: 85645 - RNA, 19 nt, Homo sapiens
gaagaacgagaaaaugaaa

SEQ ID NO: 85646 - RNA, 19 nt, Homo sapiens
ggaagaaaugagugaagau

SEQ ID NO: 85647 - RNA, 19 nt, Homo sapiens
agacagaagagaagggaaa

SEQ ID NO: 85648 - RNA, 19 nt, Homo sapiens
gaaugggaaagacagaaga

SEQ ID NO: 85649 - RNA, 19 nt, Homo sapiens
gaagacagaggagaagaag

SEQ ID NO: 85650 - RNA, 19 nt, Homo sapiens
guauagaagagaagacuca

SEQ ID NO: 85651 - RNA, 19 nt, Homo sapiens
gcaacauggacaagaucua

SEQ ID NO: 85652 - RNA, 19 nt, Homo sapiens
aggaagaaaugagugaaga

SEQ ID NO: 85653 - RNA, 19 nt, Homo sapiens
gaggagaagaagaugauuc

SEQ ID NO: 85654 - RNA, 19 nt, Homo sapiens
auaaggaacuccccguaua

SEQ ID NO: 85655 - RNA, 19 nt, Homo sapiens
ggagacgggcuuccaccuu

SEQ ID NO: 85656 - RNA, 19 nt, Homo sapiens
gagugaagaagcagaggaa

SEQ ID NO: 85657 - RNA, 19 nt, Homo sapiens
caacauugucaccguuaga

SEQ ID NO: 85658 - RNA, 19 nt, Homo sapiens
caaaagacaagaaaacaga

SEQ ID NO: 85659 - RNA, 19 nt, Homo sapiens
gaucgaggagggcaccuau

SEQ ID NO: 85660 - RNA, 19 nt, Homo sapiens
gaaaugagugaagaugaag

SEQ ID NO: 85661 - RNA, 19 nt, Homo sapiens
ggaagaggaggaggaggaa

SEQ ID NO: 85662 - RNA, 19 nt, Homo sapiens
gggaaagacagaagagaag

SEQ ID NO: 85663 - RNA, 19 nt, Homo sapiens
ggcccagcaucccaacauu

SEQ ID NO: 85664 - RNA, 19 nt, Homo sapiens
gaagagaaaauggaagaaa

SEQ ID NO: 85665 - RNA, 19 nt, Homo sapiens
caugcuagagugaaagaaa

SEQ ID NO: 85666 - RNA, 19 nt, Homo sapiens
ccaguagucaagaagauga

SEQ ID NO: 85667 - RNA, 19 nt, Homo sapiens
gugaagaagcagaggaaga

SEQ ID NO: 85668 - RNA, 19 nt, Homo sapiens
cgaagaaguaagugaggaa

SEQ ID NO: 85669 - RNA, 19 nt, Homo sapiens
ugaagaaucagaggaggaa

SEQ ID NO: 85670 - RNA, 19 nt, Homo sapiens
gacuacagcgacaaaguga

SEQ ID NO: 85671 - RNA, 19 nt, Homo sapiens
ggaaugggaaagacagaag

SEQ ID NO: 85672 - RNA, 19 nt, Homo sapiens
gagcgcgguugcuguuucu

SEQ ID NO: 85673 - RNA, 19 nt, Homo sapiens
ggaagcaugcuagagugaa

SEQ ID NO: 85674 - RNA, 19 nt, Homo sapiens
cgagcgcgguugcuguuuc

SEQ ID NO: 85675 - RNA, 19 nt, Homo sapiens
cuacagugagcucccagua

SEQ ID NO: 85676 - RNA, 19 nt, Homo sapiens
caacauggacaagaucuac

SEQ ID NO: 85677 - RNA, 19 nt, Homo sapiens
ggaacaagaggagaaagca

SEQ ID NO: 85678 - RNA, 19 nt, Homo sapiens
gaaacgaaggaaggaacaa

SEQ ID NO: 85679 - RNA, 19 nt, Homo sapiens
ggaagggagcaccagugaa

SEQ ID NO: 85680 - RNA, 19 nt, Homo sapiens
guaagugaggaagaaauga

SEQ ID NO: 85681 - RNA, 19 nt, Homo sapiens
gcagaaucaggcucagguu

SEQ ID NO: 85682 - RNA, 19 nt, Homo sapiens
ggaccgcuuggagcaguua

SEQ ID NO: 85683 - RNA, 19 nt, Homo sapiens
gaugaaaagaggaaagaaa

SEQ ID NO: 85684 - RNA, 19 nt, Homo sapiens
cccagcaaaugucuuggaa

SEQ ID NO: 85685 - RNA, 19 nt, Homo sapiens
cagaggagaagaagaugau

SEQ ID NO: 85686 - RNA, 19 nt, Homo sapiens
aggacggccucaagcauga

SEQ ID NO: 85687 - RNA, 19 nt, Homo sapiens
ugucaccguuagagagauu

SEQ ID NO: 85688 - RNA, 19 nt, Homo sapiens
gaaacgacaucgagaagaa

SEQ ID NO: 85689 - RNA, 19 nt, Homo sapiens
gagacgggcuuccaccuua

SEQ ID NO: 85690 - RNA, 19 nt, Homo sapiens
gaagcaugcuagagugaaa

SEQ ID NO: 85691 - RNA, 19 nt, Homo sapiens
gaaaacagaugaaauugug

SEQ ID NO: 85692 - RNA, 19 nt, Homo sapiens
gagcaccagugaagaauca

SEQ ID NO: 85693 - RNA, 19 nt, Homo sapiens
gcauggagaucacaauaag

SEQ ID NO: 85694 - RNA, 19 nt, Homo sapiens
ugaaacaccugcacgacaa

SEQ ID NO: 85695 - RNA, 19 nt, Homo sapiens
uaaagcggcugaagaugga

SEQ ID NO: 85696 - RNA, 19 nt, Homo sapiens
gaaaaggacucuuggaaag

SEQ ID NO: 85697 - RNA, 19 nt, Homo sapiens
agaaaugagugaagaugaa

SEQ ID NO: 85698 - RNA, 19 nt, Homo sapiens
gcagcaacauggacaagau

SEQ ID NO: 85699 - RNA, 19 nt, Homo sapiens
gagugaagaugaagaacga

SEQ ID NO: 85700 - RNA, 19 nt, Homo sapiens
gaagagaagacucaaugga

SEQ ID NO: 85701 - RNA, 19 nt, Homo sapiens
gaagggagcaccagugaag

SEQ ID NO: 85702 - RNA, 19 nt, Homo sapiens
cagcaaaugucuuggaaag

SEQ ID NO: 85703 - RNA, 19 nt, Homo sapiens
uaacucaaaugggugauga

SEQ ID NO: 85704 - RNA, 19 nt, Homo sapiens
ggaguggucuacagagcaa

SEQ ID NO: 85705 - RNA, 19 nt, Homo sapiens
gaagaugaagaacgagaaa

SEQ ID NO: 85706 - RNA, 19 nt, Homo sapiens
gcacgaacgucggaaacga

SEQ ID NO: 85707 - RNA, 19 nt, Homo sapiens
ggaaggaacaagaggagaa

SEQ ID NO: 85708 - RNA, 19 nt, Homo sapiens
gaagaaaugagugaagaug

SEQ ID NO: 85709 - RNA, 19 nt, Homo sapiens
agaaguaagugaggaagaa

SEQ ID NO: 85710 - RNA, 19 nt, Homo sapiens
gaaagaaagagagcacgaa

SEQ ID NO: 85711 - RNA, 19 nt, Homo sapiens
ggaagacagaggagaagaa

SEQ ID NO: 85712 - RNA, 19 nt, Homo sapiens
ugacagagggcgacuaugu

SEQ ID NO: 85713 - RNA, 19 nt, Homo sapiens
ggacuacagcgacaaagug

SEQ ID NO: 85714 - RNA, 19 nt, Homo sapiens
gaaggaacaagaggagaaa

SEQ ID NO: 85715 - RNA, 19 nt, Homo sapiens
ggaagugucugcacaucac

SEQ ID NO: 85716 - RNA, 19 nt, Homo sapiens
gagaagaacaggauaaagc

SEQ ID NO: 85717 - RNA, 19 nt, Homo sapiens
ggagaaagcagagauaaaa

SEQ ID NO: 85718 - RNA, 19 nt, Homo sapiens
ugaagaagcagaggaagaa

SEQ ID NO: 85719 - RNA, 19 nt, Homo sapiens
gagcauuccaggagagaaa

SEQ ID NO: 85720 - RNA, 19 nt, Homo sapiens
gaggagaaagcagagauaa

SEQ ID NO: 85721 - RNA, 19 nt, Homo sapiens
gcuucgaccucaugaacaa

SEQ ID NO: 85722 - RNA, 19 nt, Homo sapiens
aaggagggcuucccgauca

SEQ ID NO: 85723 - RNA, 19 nt, Homo sapiens
acagugagcucccaguagu

SEQ ID NO: 85724 - RNA, 19 nt, Homo sapiens
gagaagacucaauggaaga

SEQ ID NO: 85725 - RNA, 19 nt, Homo sapiens
ggaauucggaaaucgauca

SEQ ID NO: 85726 - RNA, 19 nt, Homo sapiens
uagaagagaagacucaaug

SEQ ID NO: 85727 - RNA, 19 nt, Homo sapiens
aaaggacucuuggaaagug

SEQ ID NO: 85728 - RNA, 19 nt, Homo sapiens
ugagggagaucaacaccau

SEQ ID NO: 85729 - RNA, 19 nt, Homo sapiens
gaaguaagugaggaagaaa

SEQ ID NO: 85730 - RNA, 19 nt, Homo sapiens
cuacagcgacaaagugaaa

SEQ ID NO: 85731 - RNA, 19 nt, Homo sapiens
gaacgaugagagaggacua

SEQ ID NO: 85732 - RNA, 19 nt, Homo sapiens
ggcugaagauggagaagga

SEQ ID NO: 85733 - RNA, 19 nt, Homo sapiens
gcucuaaagcggcugaaga

SEQ ID NO: 85734 - RNA, 19 nt, Homo sapiens
gaucaacaccauccucaag

SEQ ID NO: 85735 - RNA, 19 nt, Homo sapiens
gaugaaauuguggcucuaa

SEQ ID NO: 85736 - RNA, 19 nt, Homo sapiens
agacagaggagaagaagau

SEQ ID NO: 85737 - RNA, 19 nt, Homo sapiens
gaggugaagacccugauga

SEQ ID NO: 85738 - RNA, 19 nt, Homo sapiens
gaaucaggcucagguucug

SEQ ID NO: 85739 - RNA, 19 nt, Homo sapiens
aagagaagacucaauggaa

SEQ ID NO: 85740 - RNA, 19 nt, Homo sapiens
ggaaacgacaucgagaaga

SEQ ID NO: 85741 - RNA, 19 nt, Homo sapiens
gaaaagaugaaaagaggaa

SEQ ID NO: 85742 - RNA, 19 nt, Homo sapiens
ugaagacccugaugaucca

SEQ ID NO: 85743 - RNA, 19 nt, Homo sapiens
gaaauuguggcucuaaagc

SEQ ID NO: 85744 - RNA, 19 nt, Homo sapiens
ucaaaugggugaugaaaag

SEQ ID NO: 85745 - RNA, 19 nt, Homo sapiens
gaagaacgagaaaaugaaa

SEQ ID NO: 85746 - RNA, 19 nt, Homo sapiens
ggaagaaaugagugaagau

SEQ ID NO: 85747 - RNA, 19 nt, Homo sapiens
agacagaagagaagggaaa

SEQ ID NO: 85748 - RNA, 19 nt, Homo sapiens
gaaugggaaagacagaaga

SEQ ID NO: 85749 - RNA, 19 nt, Homo sapiens
gaagacagaggagaagaag

SEQ ID NO: 85750 - RNA, 19 nt, Homo sapiens
guauagaagagaagacuca

SEQ ID NO: 85751 - RNA, 19 nt, Homo sapiens
gcaacauggacaagaucua

SEQ ID NO: 85752 - RNA, 19 nt, Homo sapiens
aggaagaaaugagugaaga

SEQ ID NO: 85753 - RNA, 19 nt, Homo sapiens
gaggagaagaagaugauuc

SEQ ID NO: 85754 - RNA, 19 nt, Homo sapiens
auaaggaacuccccguaua

SEQ ID NO: 85755 - RNA, 19 nt, Homo sapiens
ggagacgggcuuccaccuu

SEQ ID NO: 85756 - RNA, 19 nt, Homo sapiens
gagugaagaagcagaggaa

SEQ ID NO: 85757 - RNA, 19 nt, Homo sapiens
caacauugucaccguuaga

SEQ ID NO: 85758 - RNA, 19 nt, Homo sapiens
caaaagacaagaaaacaga

SEQ ID NO: 85759 - RNA, 19 nt, Homo sapiens
gaucgaggagggcaccuau

SEQ ID NO: 85760 - RNA, 19 nt, Homo sapiens
gaaaugagugaagaugaag

SEQ ID NO: 85761 - RNA, 19 nt, Homo sapiens
ggaagaggaggaggaggaa

SEQ ID NO: 85762 - RNA, 19 nt, Homo sapiens
gggaaagacagaagagaag

SEQ ID NO: 85763 - RNA, 19 nt, Homo sapiens
ggcccagcaucccaacauu

SEQ ID NO: 85764 - RNA, 19 nt, Homo sapiens
gaagagaaaauggaagaaa

SEQ ID NO: 85765 - RNA, 19 nt, Homo sapiens
caugcuagagugaaagaaa

SEQ ID NO: 85766 - RNA, 19 nt, Homo sapiens
ccaguagucaagaagauga

SEQ ID NO: 85767 - RNA, 19 nt, Homo sapiens
gugaagaagcagaggaaga

SEQ ID NO: 85768 - RNA, 19 nt, Homo sapiens
cgaagaaguaagugaggaa

SEQ ID NO: 85769 - RNA, 19 nt, Homo sapiens
ugaagaaucagaggaggaa

SEQ ID NO: 85770 - RNA, 19 nt, Homo sapiens
gacuacagcgacaaaguga

SEQ ID NO: 85771 - RNA, 19 nt, Homo sapiens
ggaaugggaaagacagaag

SEQ ID NO: 85772 - RNA, 19 nt, Homo sapiens
gagcgcgguugcuguuucu

SEQ ID NO: 85773 - RNA, 19 nt, Homo sapiens
ggaagcaugcuagagugaa

SEQ ID NO: 85774 - RNA, 19 nt, Homo sapiens
cgagcgcgguugcuguuuc

SEQ ID NO: 85775 - RNA, 19 nt, Homo sapiens
cuacagugagcucccagua

SEQ ID NO: 85776 - RNA, 19 nt, Homo sapiens
caacauggacaagaucuac

SEQ ID NO: 85777 - RNA, 19 nt, Homo sapiens
ggaacaagaggagaaagca

SEQ ID NO: 85778 - RNA, 19 nt, Homo sapiens
gaaacgaaggaaggaacaa

SEQ ID NO: 85779 - RNA, 19 nt, Homo sapiens
ggaagggagcaccagugaa

SEQ ID NO: 85780 - RNA, 19 nt, Homo sapiens
guaagugaggaagaaauga

SEQ ID NO: 85781 - RNA, 19 nt, Homo sapiens
gcagaaucaggcucagguu

SEQ ID NO: 85782 - RNA, 19 nt, Homo sapiens
ggaccgcuuggagcaguua

SEQ ID NO: 85783 - RNA, 19 nt, Homo sapiens
gaugaaaagaggaaagaaa

SEQ ID NO: 85784 - RNA, 19 nt, Homo sapiens
cccagcaaaugucuuggaa

SEQ ID NO: 85785 - RNA, 19 nt, Homo sapiens
cagaggagaagaagaugau

SEQ ID NO: 85786 - RNA, 19 nt, Homo sapiens
aggacggccucaagcauga

SEQ ID NO: 85787 - RNA, 19 nt, Homo sapiens
ugucaccguuagagagauu

SEQ ID NO: 85788 - RNA, 19 nt, Homo sapiens
gaaacgacaucgagaagaa

SEQ ID NO: 85789 - RNA, 19 nt, Homo sapiens
gagacgggcuuccaccuua

SEQ ID NO: 85790 - RNA, 19 nt, Homo sapiens
gcagaagccagcacaguua

SEQ ID NO: 85791 - RNA, 19 nt, Homo sapiens
gaagcaugcuagagugaaa

SEQ ID NO: 85792 - RNA, 19 nt, Homo sapiens
gaaaacagaugaaauugug

SEQ ID NO: 85793 - RNA, 19 nt, Homo sapiens
gagcaccagugaagaauca

SEQ ID NO: 85794 - RNA, 19 nt, Homo sapiens
gcauggagaucacaauaag

SEQ ID NO: 85795 - RNA, 19 nt, Homo sapiens
ugaaacaccugcacgacaa

SEQ ID NO: 85796 - RNA, 19 nt, Homo sapiens
uaaagcggcugaagaugga

SEQ ID NO: 85797 - RNA, 19 nt, Homo sapiens
gaaaaggacucuuggaaag

SEQ ID NO: 85798 - RNA, 19 nt, Homo sapiens
agaaaugagugaagaugaa

SEQ ID NO: 85799 - RNA, 19 nt, Homo sapiens
gcagcaacauggacaagau

SEQ ID NO: 85800 - RNA, 19 nt, Homo sapiens
gagugaagaugaagaacga

SEQ ID NO: 85801 - RNA, 19 nt, Homo sapiens
gaagagaagacucaaugga

SEQ ID NO: 85802 - RNA, 19 nt, Homo sapiens
gaagggagcaccagugaag

SEQ ID NO: 85803 - RNA, 19 nt, Homo sapiens
cagcaaaugucuuggaaag

SEQ ID NO: 85804 - RNA, 19 nt, Homo sapiens
uaacucaaaugggugauga

SEQ ID NO: 85805 - RNA, 19 nt, Homo sapiens
ggaguggucuacagagcaa

SEQ ID NO: 85806 - RNA, 19 nt, Homo sapiens
gaagaugaagaacgagaaa

SEQ ID NO: 85807 - RNA, 19 nt, Homo sapiens
gcacgaacgucggaaacga

SEQ ID NO: 85808 - RNA, 19 nt, Homo sapiens
ggaaggaacaagaggagaa

SEQ ID NO: 85809 - RNA, 19 nt, Homo sapiens
gaagaaaugagugaagaug

SEQ ID NO: 85810 - RNA, 19 nt, Homo sapiens
agaaguaagugaggaagaa

SEQ ID NO: 85811 - RNA, 19 nt, Homo sapiens
gaaagaaagagagcacgaa

SEQ ID NO: 85812 - RNA, 19 nt, Homo sapiens
ggaagacagaggagaagaa

SEQ ID NO: 85813 - RNA, 19 nt, Homo sapiens
ugacagagggcgacuaugu

SEQ ID NO: 85814 - RNA, 19 nt, Homo sapiens
ggacuacagcgacaaagug

SEQ ID NO: 85815 - RNA, 19 nt, Homo sapiens
gaaggaacaagaggagaaa

SEQ ID NO: 85816 - RNA, 19 nt, Homo sapiens
ggaagugucugcacaucac

SEQ ID NO: 85817 - RNA, 19 nt, Homo sapiens
gagaagaacaggauaaagc

SEQ ID NO: 85818 - RNA, 19 nt, Homo sapiens
ggagaaagcagagauaaaa

SEQ ID NO: 85819 - RNA, 19 nt, Homo sapiens
ugaagaagcagaggaagaa

SEQ ID NO: 85820 - RNA, 19 nt, Homo sapiens
gagcauuccaggagagaaa

SEQ ID NO: 85821 - RNA, 19 nt, Homo sapiens
gaggagaaagcagagauaa

SEQ ID NO: 85822 - RNA, 19 nt, Homo sapiens
gcuucgaccucaugaacaa

SEQ ID NO: 85823 - RNA, 19 nt, Homo sapiens
aaggagggcuucccgauca

SEQ ID NO: 85824 - RNA, 19 nt, Homo sapiens
acagugagcucccaguagu

SEQ ID NO: 85825 - RNA, 19 nt, Homo sapiens
gagaagacucaauggaaga

SEQ ID NO: 85826 - RNA, 19 nt, Homo sapiens
ggaauucggaaaucgauca

SEQ ID NO: 85827 - RNA, 19 nt, Homo sapiens
uagaagagaagacucaaug

SEQ ID NO: 85828 - RNA, 19 nt, Homo sapiens
ugagggagaucaacaccau

SEQ ID NO: 85829 - RNA, 19 nt, Homo sapiens
aaaggacucuuggaaagug

SEQ ID NO: 85830 - RNA, 19 nt, Homo sapiens
gaaguaagugaggaagaaa

SEQ ID NO: 85831 - RNA, 19 nt, Homo sapiens
cuacagcgacaaagugaaa

SEQ ID NO: 85832 - RNA, 19 nt, Homo sapiens
gaacgaugagagaggacua

SEQ ID NO: 85833 - RNA, 19 nt, Homo sapiens
ggcugaagauggagaagga

SEQ ID NO: 85834 - RNA, 19 nt, Homo sapiens
gcucuaaagcggcugaaga

SEQ ID NO: 85835 - RNA, 19 nt, Homo sapiens
gaucaacaccauccucaag

SEQ ID NO: 85836 - RNA, 19 nt, Homo sapiens
gaugaaauuguggcucuaa

SEQ ID NO: 85837 - RNA, 19 nt, Homo sapiens
agacagaggagaagaagau

SEQ ID NO: 85838 - RNA, 19 nt, Homo sapiens
gaggugaagacccugauga

SEQ ID NO: 85839 - RNA, 19 nt, Homo sapiens
gaaucaggcucagguucug

SEQ ID NO: 85840 - RNA, 19 nt, Homo sapiens
aagagaagacucaauggaa

SEQ ID NO: 85841 - RNA, 19 nt, Homo sapiens
ggaaacgacaucgagaaga

SEQ ID NO: 85842 - RNA, 19 nt, Homo sapiens
gaaaagaugaaaagaggaa

SEQ ID NO: 85843 - RNA, 19 nt, Homo sapiens
ugaagacccugaugaucca

SEQ ID NO: 85844 - RNA, 19 nt, Homo sapiens
gaaauuguggcucuaaagc

SEQ ID NO: 85845 - RNA, 19 nt, Homo sapiens
ucaaaugggugaugaaaag

SEQ ID NO: 85846 - RNA, 19 nt, Homo sapiens
gaagaacgagaaaaugaaa

SEQ ID NO: 85847 - RNA, 19 nt, Homo sapiens
ggaagaaaugagugaagau

SEQ ID NO: 85848 - RNA, 19 nt, Homo sapiens
agacagaagagaagggaaa

SEQ ID NO: 85849 - RNA, 19 nt, Homo sapiens
gaaugggaaagacagaaga

SEQ ID NO: 85850 - RNA, 19 nt, Homo sapiens
gaagacagaggagaagaag

SEQ ID NO: 85851 - RNA, 19 nt, Homo sapiens
guauagaagagaagacuca

SEQ ID NO: 85852 - RNA, 19 nt, Homo sapiens
gcaacauggacaagaucua

SEQ ID NO: 85853 - RNA, 19 nt, Homo sapiens
aggaagaaaugagugaaga

SEQ ID NO: 85854 - RNA, 19 nt, Homo sapiens
gaggagaagaagaugauuc

SEQ ID NO: 85855 - RNA, 19 nt, Homo sapiens
auaaggaacuccccguaua

SEQ ID NO: 85856 - RNA, 19 nt, Homo sapiens
ggagacgggcuuccaccuu

SEQ ID NO: 85857 - RNA, 19 nt, Homo sapiens
gagugaagaagcagaggaa

SEQ ID NO: 85858 - RNA, 19 nt, Homo sapiens
caacauugucaccguuaga

SEQ ID NO: 85859 - RNA, 19 nt, Homo sapiens
caaaagacaagaaaacaga

SEQ ID NO: 85860 - RNA, 19 nt, Homo sapiens
gaucgaggagggcaccuau

SEQ ID NO: 85861 - RNA, 19 nt, Homo sapiens
gaaaugagugaagaugaag

SEQ ID NO: 85862 - RNA, 19 nt, Homo sapiens
ggaagaggaggaggaggaa

SEQ ID NO: 85863 - RNA, 19 nt, Homo sapiens
cagaagccagcacaguuaa

SEQ ID NO: 85864 - RNA, 19 nt, Homo sapiens
gggaaagacagaagagaag

SEQ ID NO: 85865 - RNA, 19 nt, Homo sapiens
ggcccagcaucccaacauu

SEQ ID NO: 85866 - RNA, 19 nt, Homo sapiens
gaagagaaaauggaagaaa

SEQ ID NO: 85867 - RNA, 19 nt, Homo sapiens
caugcuagagugaaagaaa

SEQ ID NO: 85868 - RNA, 19 nt, Homo sapiens
ccaguagucaagaagauga

SEQ ID NO: 85869 - RNA, 19 nt, Homo sapiens
gugaagaagcagaggaaga

SEQ ID NO: 85870 - RNA, 19 nt, Homo sapiens
cgaagaaguaagugaggaa

SEQ ID NO: 85871 - RNA, 19 nt, Homo sapiens
ugaagaaucagaggaggaa

SEQ ID NO: 85872 - RNA, 19 nt, Homo sapiens
gagcgcgguugcuguuucu

SEQ ID NO: 85873 - RNA, 19 nt, Homo sapiens
gacuacagcgacaaaguga

SEQ ID NO: 85874 - RNA, 19 nt, Homo sapiens
ggaaugggaaagacagaag

SEQ ID NO: 85875 - RNA, 19 nt, Homo sapiens
ggaagcaugcuagagugaa

SEQ ID NO: 85876 - RNA, 19 nt, Homo sapiens
cgagcgcgguugcuguuuc

SEQ ID NO: 85877 - RNA, 19 nt, Homo sapiens
cuacagugagcucccagua

SEQ ID NO: 85878 - RNA, 19 nt, Homo sapiens
caacauggacaagaucuac

SEQ ID NO: 85879 - RNA, 19 nt, Homo sapiens
ggaacaagaggagaaagca

SEQ ID NO: 85880 - RNA, 19 nt, Homo sapiens
gaaacgaaggaaggaacaa

SEQ ID NO: 85881 - RNA, 19 nt, Homo sapiens
ggaagggagcaccagugaa

SEQ ID NO: 85882 - RNA, 19 nt, Homo sapiens
guaagugaggaagaaauga

SEQ ID NO: 85883 - RNA, 19 nt, Homo sapiens
gcagaaucaggcucagguu

SEQ ID NO: 85884 - RNA, 19 nt, Homo sapiens
ggaccgcuuggagcaguua

SEQ ID NO: 85885 - RNA, 19 nt, Homo sapiens
gaugaaaagaggaaagaaa

SEQ ID NO: 85886 - RNA, 19 nt, Homo sapiens
cccagcaaaugucuuggaa

SEQ ID NO: 85887 - RNA, 19 nt, Homo sapiens
cagaggagaagaagaugau

SEQ ID NO: 85888 - RNA, 19 nt, Homo sapiens
gaaacgacaucgagaagaa

SEQ ID NO: 85889 - RNA, 19 nt, Homo sapiens
gagacgggcuuccaccuua

SEQ ID NO: 85890 - RNA, 19 nt, Homo sapiens
gcagaagccagcacaguua

SEQ ID NO: 85891 - RNA, 19 nt, Homo sapiens
gaagcaugcuagagugaaa

SEQ ID NO: 85892 - RNA, 19 nt, Homo sapiens
gaaaacagaugaaauugug

SEQ ID NO: 85893 - RNA, 19 nt, Homo sapiens
gagcaccagugaagaauca

SEQ ID NO: 85894 - RNA, 19 nt, Homo sapiens
gcauggagaucacaauaag

SEQ ID NO: 85895 - RNA, 19 nt, Homo sapiens
ugaaacaccugcacgacaa

SEQ ID NO: 85896 - RNA, 19 nt, Homo sapiens
uaaagcggcugaagaugga

SEQ ID NO: 85897 - RNA, 19 nt, Homo sapiens
gaaaaggacucuuggaaag

SEQ ID NO: 85898 - RNA, 19 nt, Homo sapiens
agaaaugagugaagaugaa

SEQ ID NO: 85899 - RNA, 19 nt, Homo sapiens
gcagcaacauggacaagau

SEQ ID NO: 85900 - RNA, 19 nt, Homo sapiens
gagugaagaugaagaacga

SEQ ID NO: 85901 - RNA, 19 nt, Homo sapiens
gaagagaagacucaaugga

SEQ ID NO: 85902 - RNA, 19 nt, Homo sapiens
gaagggagcaccagugaag

SEQ ID NO: 85903 - RNA, 19 nt, Homo sapiens
cagcaaaugucuuggaaag

SEQ ID NO: 85904 - RNA, 19 nt, Homo sapiens
uaacucaaaugggugauga

SEQ ID NO: 85905 - RNA, 19 nt, Homo sapiens
ggaguggucuacagagcaa

SEQ ID NO: 85906 - RNA, 19 nt, Homo sapiens
gaagaugaagaacgagaaa

SEQ ID NO: 85907 - RNA, 19 nt, Homo sapiens
gcacgaacgucggaaacga

SEQ ID NO: 85908 - RNA, 19 nt, Homo sapiens
ggaaggaacaagaggagaa

SEQ ID NO: 85909 - RNA, 19 nt, Homo sapiens
gaagaaaugagugaagaug

SEQ ID NO: 85910 - RNA, 19 nt, Homo sapiens
agaaguaagugaggaagaa

SEQ ID NO: 85911 - RNA, 19 nt, Homo sapiens
gaaagaaagagagcacgaa

SEQ ID NO: 85912 - RNA, 19 nt, Homo sapiens
ggaagacagaggagaagaa

SEQ ID NO: 85913 - RNA, 19 nt, Homo sapiens
ggacuacagcgacaaagug

SEQ ID NO: 85914 - RNA, 19 nt, Homo sapiens
gaaggaacaagaggagaaa

SEQ ID NO: 85915 - RNA, 19 nt, Homo sapiens
ggaagugucugcacaucac

SEQ ID NO: 85916 - RNA, 19 nt, Homo sapiens
gagaagaacaggauaaagc

SEQ ID NO: 85917 - RNA, 19 nt, Homo sapiens
ggagaaagcagagauaaaa

SEQ ID NO: 85918 - RNA, 19 nt, Homo sapiens
ugaagaagcagaggaagaa

SEQ ID NO: 85919 - RNA, 19 nt, Homo sapiens
gagcauuccaggagagaaa

SEQ ID NO: 85920 - RNA, 19 nt, Homo sapiens
gaggagaaagcagagauaa

SEQ ID NO: 85921 - RNA, 19 nt, Homo sapiens
gcuucgaccucaugaacaa

SEQ ID NO: 85922 - RNA, 19 nt, Homo sapiens
aaggagggcuucccgauca

SEQ ID NO: 85923 - RNA, 19 nt, Homo sapiens
acagugagcucccaguagu

SEQ ID NO: 85924 - RNA, 19 nt, Homo sapiens
gagaagacucaauggaaga

SEQ ID NO: 85925 - RNA, 19 nt, Homo sapiens
ggaauucggaaaucgauca

SEQ ID NO: 85926 - RNA, 19 nt, Homo sapiens
uagaagagaagacucaaug

SEQ ID NO: 85927 - RNA, 19 nt, Homo sapiens
aaaggacucuuggaaagug

SEQ ID NO: 85928 - RNA, 19 nt, Homo sapiens
ugagggagaucaacaccau

SEQ ID NO: 85929 - RNA, 19 nt, Homo sapiens
gaaguaagugaggaagaaa

SEQ ID NO: 85930 - RNA, 19 nt, Homo sapiens
cuacagcgacaaagugaaa

SEQ ID NO: 85931 - RNA, 19 nt, Homo sapiens
gaacgaugagagaggacua

SEQ ID NO: 85932 - RNA, 19 nt, Homo sapiens
ucauagccauucagcagaa

SEQ ID NO: 85933 - RNA, 19 nt, Homo sapiens
ggcugaagauggagaagga

SEQ ID NO: 85934 - RNA, 19 nt, Homo sapiens
gcucuaaagcggcugaaga

SEQ ID NO: 85935 - RNA, 19 nt, Homo sapiens
gaucaacaccauccucaag

SEQ ID NO: 85936 - RNA, 19 nt, Homo sapiens
gaugaaauuguggcucuaa

SEQ ID NO: 85937 - RNA, 19 nt, Homo sapiens
agacagaggagaagaagau

SEQ ID NO: 85938 - RNA, 19 nt, Homo sapiens
gaggugaagacccugauga

SEQ ID NO: 85939 - RNA, 19 nt, Homo sapiens
gaaucaggcucagguucug

SEQ ID NO: 85940 - RNA, 19 nt, Homo sapiens
aagagaagacucaauggaa

SEQ ID NO: 85941 - RNA, 19 nt, Homo sapiens
ggaaacgacaucgagaaga

SEQ ID NO: 85942 - RNA, 19 nt, Homo sapiens
gaaaagaugaaaagaggaa

SEQ ID NO: 85943 - RNA, 19 nt, Homo sapiens
ugaagacccugaugaucca

SEQ ID NO: 85944 - RNA, 19 nt, Homo sapiens
gaaauuguggcucuaaagc

SEQ ID NO: 85945 - RNA, 19 nt, Homo sapiens
ucaaaugggugaugaaaag

SEQ ID NO: 85946 - RNA, 19 nt, Homo sapiens
gaagaacgagaaaaugaaa

SEQ ID NO: 85947 - RNA, 19 nt, Homo sapiens
ggaagaaaugagugaagau

SEQ ID NO: 85948 - RNA, 19 nt, Homo sapiens
agacagaagagaagggaaa

SEQ ID NO: 85949 - RNA, 19 nt, Homo sapiens
gaaugggaaagacagaaga

SEQ ID NO: 85950 - RNA, 19 nt, Homo sapiens
gaagacagaggagaagaag

SEQ ID NO: 85951 - RNA, 19 nt, Homo sapiens
guauagaagagaagacuca

SEQ ID NO: 85952 - RNA, 19 nt, Homo sapiens
gcaacauggacaagaucua

SEQ ID NO: 85953 - RNA, 19 nt, Homo sapiens
aggaagaaaugagugaaga

SEQ ID NO: 85954 - RNA, 19 nt, Homo sapiens
gaggagaagaagaugauuc

SEQ ID NO: 85955 - RNA, 19 nt, Homo sapiens
auaaggaacuccccguaua

SEQ ID NO: 85956 - RNA, 19 nt, Homo sapiens
ggagacgggcuuccaccuu

SEQ ID NO: 85957 - RNA, 19 nt, Homo sapiens
gagugaagaagcagaggaa

SEQ ID NO: 85958 - RNA, 19 nt, Homo sapiens
caacauugucaccguuaga

SEQ ID NO: 85959 - RNA, 19 nt, Homo sapiens
caaaagacaagaaaacaga

SEQ ID NO: 85960 - RNA, 19 nt, Homo sapiens
gaucgaggagggcaccuau

SEQ ID NO: 85961 - RNA, 19 nt, Homo sapiens
gaaaugagugaagaugaag

SEQ ID NO: 85962 - RNA, 19 nt, Homo sapiens
ggaagaggaggaggaggaa

SEQ ID NO: 85963 - RNA, 19 nt, Homo sapiens
cagaagccagcacaguuaa

SEQ ID NO: 85964 - RNA, 19 nt, Homo sapiens
gggaaagacagaagagaag

SEQ ID NO: 85965 - RNA, 19 nt, Homo sapiens
ggcccagcaucccaacauu

SEQ ID NO: 85966 - RNA, 19 nt, Homo sapiens
gaagagaaaauggaagaaa

SEQ ID NO: 85967 - RNA, 19 nt, Homo sapiens
caugcuagagugaaagaaa

SEQ ID NO: 85968 - RNA, 19 nt, Homo sapiens
ccaguagucaagaagauga

SEQ ID NO: 85969 - RNA, 19 nt, Homo sapiens
gugaagaagcagaggaaga

SEQ ID NO: 85970 - RNA, 19 nt, Homo sapiens
cgaagaaguaagugaggaa

SEQ ID NO: 85971 - RNA, 19 nt, Homo sapiens
ugaagaaucagaggaggaa

SEQ ID NO: 85972 - RNA, 19 nt, Homo sapiens
gagcgcgguugcuguuucu

SEQ ID NO: 85973 - RNA, 19 nt, Homo sapiens
gacuacagcgacaaaguga

SEQ ID NO: 85974 - RNA, 19 nt, Homo sapiens
ggaaugggaaagacagaag

SEQ ID NO: 85975 - RNA, 19 nt, Homo sapiens
ggaagcaugcuagagugaa

SEQ ID NO: 85976 - RNA, 19 nt, Homo sapiens
cgagcgcgguugcuguuuc

SEQ ID NO: 85977 - RNA, 19 nt, Homo sapiens
cuacagugagcucccagua

SEQ ID NO: 85978 - RNA, 19 nt, Homo sapiens
caacauggacaagaucuac

SEQ ID NO: 85979 - RNA, 19 nt, Homo sapiens
ggaacaagaggagaaagca

SEQ ID NO: 85980 - RNA, 19 nt, Homo sapiens
gaaacgaaggaaggaacaa

SEQ ID NO: 85981 - RNA, 19 nt, Homo sapiens
ggaagggagcaccagugaa

SEQ ID NO: 85982 - RNA, 19 nt, Homo sapiens
gggaagcaugcuagaguga

SEQ ID NO: 85983 - RNA, 19 nt, Homo sapiens
guaagugaggaagaaauga

SEQ ID NO: 85984 - RNA, 19 nt, Homo sapiens
gcagaaucaggcucagguu

SEQ ID NO: 85985 - RNA, 19 nt, Homo sapiens
ggaccgcuuggagcaguua

SEQ ID NO: 85986 - RNA, 19 nt, Homo sapiens
gaugaaaagaggaaagaaa

SEQ ID NO: 85987 - RNA, 19 nt, Homo sapiens
cccagcaaaugucuuggaa

SEQ ID NO: 85988 - RNA, 19 nt, Homo sapiens
gaaacgacaucgagaagaa

SEQ ID NO: 85989 - RNA, 19 nt, Homo sapiens
gcaaaugucucggaaagaa

SEQ ID NO: 85990 - RNA, 19 nt, Homo sapiens
gagacgggcuuccaccuua

SEQ ID NO: 85991 - RNA, 19 nt, Homo sapiens
gaagcaugcuagagugaaa

SEQ ID NO: 85992 - RNA, 19 nt, Homo sapiens
gagcagcagucaagaagau

SEQ ID NO: 85993 - RNA, 19 nt, Homo sapiens
gcacgaacgucggaaacga

SEQ ID NO: 85994 - RNA, 19 nt, Homo sapiens
cagcaaaugucucggaaag

SEQ ID NO: 85995 - RNA, 19 nt, Homo sapiens
cagaaaagaugaaaagaga

SEQ ID NO: 85996 - RNA, 19 nt, Homo sapiens
gaaagaaagagagcacgaa

SEQ ID NO: 85997 - RNA, 19 nt, Homo sapiens
gagaagaacaggauaaagc

SEQ ID NO: 85998 - RNA, 19 nt, Homo sapiens
gagcauuccaggagagaaa

SEQ ID NO: 85999 - RNA, 19 nt, Homo sapiens
gcuucgaccucaugaacaa

SEQ ID NO: 86000 - RNA, 19 nt, Homo sapiens
ucauagccauucagcagaa

SEQ ID NO: 86001 - RNA, 19 nt, Homo sapiens
ggaaacgacaucgagaaga

SEQ ID NO: 86002 - RNA, 19 nt, Homo sapiens
agacagaagagaagggaaa

SEQ ID NO: 86003 - RNA, 19 nt, Homo sapiens
gaaugggaaagacagaaga

SEQ ID NO: 86004 - RNA, 19 nt, Homo sapiens
caaaugucucggaaagaaa

SEQ ID NO: 86005 - RNA, 19 nt, Homo sapiens
ggagacgggcuuccaccuu

SEQ ID NO: 86006 - RNA, 19 nt, Homo sapiens
gcagcagucaagaagauga

SEQ ID NO: 86007 - RNA, 19 nt, Homo sapiens
gggaaagacagaagagaag

SEQ ID NO: 86008 - RNA, 19 nt, Homo sapiens
caugcuagagugaaagaaa

SEQ ID NO: 86009 - RNA, 19 nt, Homo sapiens
agaaggagcagcagucaag

SEQ ID NO: 86010 - RNA, 19 nt, Homo sapiens
gcagaaggagcagcaguca

SEQ ID NO: 86011 - RNA, 19 nt, Homo sapiens
ggaaugggaaagacagaag

SEQ ID NO: 86012 - RNA, 19 nt, Homo sapiens
ggaagcaugcuagagugaa

SEQ ID NO: 86013 - RNA, 19 nt, Homo sapiens
gggaagcaugcuagaguga

SEQ ID NO: 86014 - RNA, 19 nt, Homo sapiens
ggaccgcuuggagcaguua

SEQ ID NO: 86015 - RNA, 19 nt, Homo sapiens
aggacggccucaagcauga

SEQ ID NO: 86016 - RNA, 19 nt, Homo sapiens
gaaggagcagcagucaaga

SEQ ID NO: 86017 - RNA, 19 nt, Homo sapiens
cagaagagaagggaaaugg

SEQ ID NO: 86018 - RNA, 19 nt, Homo sapiens
gcuuggagcaguuagaaag

SEQ ID NO: 86019 - RNA, 19 nt, Homo sapiens
ggaaauggcaagggagcau

SEQ ID NO: 86020 - RNA, 19 nt, Homo sapiens
agaaagagagcacgaacgu

SEQ ID NO: 86021 - RNA, 19 nt, Homo sapiens
uggagcaguuagaaaggaa

SEQ ID NO: 86022 - RNA, 19 nt, Homo sapiens
ugggaaagacagaagagaa

SEQ ID NO: 86023 - RNA, 19 nt, Homo sapiens
ggagcagcagucaagaaga

SEQ ID NO: 86024 - RNA, 19 nt, Homo sapiens
gagaaagggaccgcuugga

SEQ ID NO: 86025 - RNA, 19 nt, Homo sapiens
caucgagaagaacaggaua

SEQ ID NO: 86026 - RNA, 19 nt, Homo sapiens
guaggcaucauagccauuc

SEQ ID NO: 86027 - RNA, 19 nt, Homo sapiens
gggcuucgaccucaugaac

SEQ ID NO: 86028 - RNA, 19 nt, Homo sapiens
ucgagaagaacaggauaaa

SEQ ID NO: 86029 - RNA, 19 nt, Homo sapiens
gaaacgacaucgagaagaa

SEQ ID NO: 86030 - RNA, 19 nt, Homo sapiens
gcaaaugucucggaaagaa

SEQ ID NO: 86031 - RNA, 19 nt, Homo sapiens
gagacgggcuuccaccuua

SEQ ID NO: 86032 - RNA, 19 nt, Homo sapiens
gaaaacagaugaaauugug

SEQ ID NO: 86033 - RNA, 19 nt, Homo sapiens
gagcaccagugaagaauca

SEQ ID NO: 86034 - RNA, 19 nt, Homo sapiens
gcauggagaucacaauaag

SEQ ID NO: 86035 - RNA, 19 nt, Homo sapiens
ugaaacaccugcacgacaa

SEQ ID NO: 86036 - RNA, 19 nt, Homo sapiens
uaaagcggcugaagaugga

SEQ ID NO: 86037 - RNA, 19 nt, Homo sapiens
gaaaaggacucuuggaaag

SEQ ID NO: 86038 - RNA, 19 nt, Homo sapiens
agaaaugagugaagaugaa

SEQ ID NO: 86039 - RNA, 19 nt, Homo sapiens
gcagcaacauggacaagau

SEQ ID NO: 86040 - RNA, 19 nt, Homo sapiens
gagugaagaugaagaacga

SEQ ID NO: 86041 - RNA, 19 nt, Homo sapiens
gaagggagcaccagugaag

SEQ ID NO: 86042 - RNA, 19 nt, Homo sapiens
uaacucaaaugggugauga

SEQ ID NO: 86043 - RNA, 19 nt, Homo sapiens
ggaguggucuacagagcaa

SEQ ID NO: 86044 - RNA, 19 nt, Homo sapiens
gaagaugaagaacgagaaa

SEQ ID NO: 86045 - RNA, 19 nt, Homo sapiens
gcacgaacgucggaaacga

SEQ ID NO: 86046 - RNA, 19 nt, Homo sapiens
gagaagacucuauggaaga

SEQ ID NO: 86047 - RNA, 19 nt, Homo sapiens
ggaaggaacaagaggagaa

SEQ ID NO: 86048 - RNA, 19 nt, Homo sapiens
cagcaaaugucucggaaag

SEQ ID NO: 86049 - RNA, 19 nt, Homo sapiens
gaagaaaugagugaagaug

SEQ ID NO: 86050 - RNA, 19 nt, Homo sapiens
cagaaaagaugaaaagaga

SEQ ID NO: 86051 - RNA, 19 nt, Homo sapiens
agaaguaagugaggaagaa

SEQ ID NO: 86052 - RNA, 19 nt, Homo sapiens
gagaaacguaggcaucgua

SEQ ID NO: 86053 - RNA, 19 nt, Homo sapiens
ggaaagagagcacgaacgu

SEQ ID NO: 86054 - RNA, 19 nt, Homo sapiens
ggaagacagaggagaagaa

SEQ ID NO: 86055 - RNA, 19 nt, Homo sapiens
ugacagagggcgacuaugu

SEQ ID NO: 86056 - RNA, 19 nt, Homo sapiens
ggacuacagcgacaaagug

SEQ ID NO: 86057 - RNA, 19 nt, Homo sapiens
gaagcaugcuagagugaag

SEQ ID NO: 86058 - RNA, 19 nt, Homo sapiens
gaaggaacaagaggagaaa

SEQ ID NO: 86059 - RNA, 19 nt, Homo sapiens
ggaagugucugcacaucac

SEQ ID NO: 86060 - RNA, 19 nt, Homo sapiens
gagaagaacaggauaaagc

SEQ ID NO: 86061 - RNA, 19 nt, Homo sapiens
ggagaaagcagagauaaaa

SEQ ID NO: 86062 - RNA, 19 nt, Homo sapiens
ugaagaagcagaggaagaa

SEQ ID NO: 86063 - RNA, 19 nt, Homo sapiens
gagcauuccaggagagaaa

SEQ ID NO: 86064 - RNA, 19 nt, Homo sapiens
gaggagaaagcagagauaa

SEQ ID NO: 86065 - RNA, 19 nt, Homo sapiens
gcuucgaccucaugaacaa

SEQ ID NO: 86066 - RNA, 19 nt, Homo sapiens
ggaauucggaaaucgauca

SEQ ID NO: 86067 - RNA, 19 nt, Homo sapiens
caacaucgucaccguuaga

SEQ ID NO: 86068 - RNA, 19 nt, Homo sapiens
ugagggagaucaacaccau

SEQ ID NO: 86069 - RNA, 19 nt, Homo sapiens
gaaguaagugaggaagaaa

SEQ ID NO: 86070 - RNA, 19 nt, Homo sapiens
cuacagcgacaaagugaaa

SEQ ID NO: 86071 - RNA, 19 nt, Homo sapiens
gaacgaugagagaggacua

SEQ ID NO: 86072 - RNA, 19 nt, Homo sapiens
aaaggacucuuggaaagug

SEQ ID NO: 86073 - RNA, 19 nt, Homo sapiens
ggcugaagauggagaagga

SEQ ID NO: 86074 - RNA, 19 nt, Homo sapiens
gcucuaaagcggcugaaga

SEQ ID NO: 86075 - RNA, 19 nt, Homo sapiens
gaucaacaccauccucaag

SEQ ID NO: 86076 - RNA, 19 nt, Homo sapiens
gaugaaauuguggcucuaa

SEQ ID NO: 86077 - RNA, 19 nt, Homo sapiens
agacagaggagaagaagau

SEQ ID NO: 86078 - RNA, 19 nt, Homo sapiens
cuacagcgagcucccagua

SEQ ID NO: 86079 - RNA, 19 nt, Homo sapiens
gaggugaagacccugauga

SEQ ID NO: 86080 - RNA, 19 nt, Homo sapiens
gaaucaggcucagguucug

SEQ ID NO: 86081 - RNA, 19 nt, Homo sapiens
gaaggaaagagagcacgaa

SEQ ID NO: 86082 - RNA, 19 nt, Homo sapiens
ucacgucgcugagggagau

SEQ ID NO: 86083 - RNA, 19 nt, Homo sapiens
ggaaacgacaucgagaaga

SEQ ID NO: 86084 - RNA, 19 nt, Homo sapiens
ugaagacccugaugaucca

SEQ ID NO: 86085 - RNA, 19 nt, Homo sapiens
gaaauuguggcucuaaagc

SEQ ID NO: 86086 - RNA, 19 nt, Homo sapiens
ucaaaugggugaugaaaag

SEQ ID NO: 86087 - RNA, 19 nt, Homo sapiens
gaagaacgagaaaaugaaa

SEQ ID NO: 86088 - RNA, 19 nt, Homo sapiens
ggaagaaaugagugaagau

SEQ ID NO: 86089 - RNA, 19 nt, Homo sapiens
agacagaagagaagggaaa

SEQ ID NO: 86090 - RNA, 19 nt, Homo sapiens
gaaugggaaagacagaaga

SEQ ID NO: 86091 - RNA, 19 nt, Homo sapiens
caaaugucucggaaagaaa

SEQ ID NO: 86092 - RNA, 19 nt, Homo sapiens
gaagacagaggagaagaag

SEQ ID NO: 86093 - RNA, 19 nt, Homo sapiens
gcaacauggacaagaucua

SEQ ID NO: 86094 - RNA, 19 nt, Homo sapiens
aacgagggcuucccgauca

SEQ ID NO: 86095 - RNA, 19 nt, Homo sapiens
aggaagaaaugagugaaga

SEQ ID NO: 86096 - RNA, 19 nt, Homo sapiens
gaggagaagaagaugauuc

SEQ ID NO: 86097 - RNA, 19 nt, Homo sapiens
auaaggaacuccccguaua

SEQ ID NO: 86098 - RNA, 19 nt, Homo sapiens
ggagacgggcuuccaccuu

SEQ ID NO: 86099 - RNA, 19 nt, Homo sapiens
cccaacaucgucaccguua

SEQ ID NO: 86100 - RNA, 19 nt, Homo sapiens
gagugaagaagcagaggaa

SEQ ID NO: 86101 - RNA, 19 nt, Homo sapiens
caaaagacaagaaaacaga

SEQ ID NO: 86102 - RNA, 19 nt, Homo sapiens
gaucgaggagggcaccuau

SEQ ID NO: 86103 - RNA, 19 nt, Homo sapiens
gaaaugagugaagaugaag

SEQ ID NO: 86104 - RNA, 19 nt, Homo sapiens
ggaagaggaggaggaggaa

SEQ ID NO: 86105 - RNA, 19 nt, Homo sapiens
gggaaagacagaagagaag

SEQ ID NO: 86106 - RNA, 19 nt, Homo sapiens
gaagagaaaauggaagaaa

SEQ ID NO: 86107 - RNA, 19 nt, Homo sapiens
ccaguagucaagaagauga

SEQ ID NO: 86108 - RNA, 19 nt, Homo sapiens
acagcgagcucccaguagu

SEQ ID NO: 86109 - RNA, 19 nt, Homo sapiens
cgucaccguuagagagauu

SEQ ID NO: 86110 - RNA, 19 nt, Homo sapiens
gugaagaagcagaggaaga

SEQ ID NO: 86111 - RNA, 19 nt, Homo sapiens
cgaagaaguaagugaggaa

SEQ ID NO: 86112 - RNA, 19 nt, Homo sapiens
ugaagaaucagaggaggaa

SEQ ID NO: 86113 - RNA, 19 nt, Homo sapiens
gacuacagcgacaaaguga

SEQ ID NO: 86114 - RNA, 19 nt, Homo sapiens
ggaaugggaaagacagaag

SEQ ID NO: 86115 - RNA, 19 nt, Homo sapiens
ggaagcaugcuagagugaa

SEQ ID NO: 86116 - RNA, 19 nt, Homo sapiens
caacauggacaagaucuac

SEQ ID NO: 86117 - RNA, 19 nt, Homo sapiens
gaaacgaaggaaggaacaa

SEQ ID NO: 86118 - RNA, 19 nt, Homo sapiens
ggaacaagaggagaaagca

SEQ ID NO: 86119 - RNA, 19 nt, Homo sapiens
ggaagggagcaccagugaa

SEQ ID NO: 86120 - RNA, 19 nt, Homo sapiens
gggaagcaugcuagaguga

SEQ ID NO: 86121 - RNA, 19 nt, Homo sapiens
guaagugaggaagaaauga

SEQ ID NO: 86122 - RNA, 19 nt, Homo sapiens
gcagaaucaggcucagguu

SEQ ID NO: 86123 - RNA, 19 nt, Homo sapiens
ggaccgcuuggagcaguua

SEQ ID NO: 86124 - RNA, 19 nt, Homo sapiens
cagaggagaagaagaugau

SEQ ID NO: 86125 - RNA, 19 nt, Homo sapiens
aggacggccucaagcauga

SEQ ID NO: 86126 - RNA, 19 nt, Homo sapiens
gcaccuauggaguggucua

SEQ ID NO: 86127 - RNA, 19 nt, Homo sapiens
gacagagggcgacuaugug

SEQ ID NO: 86128 - RNA, 19 nt, Homo sapiens
aagaaaugagugaagauga

SEQ ID NO: 86129 - RNA, 19 nt, Homo sapiens
gaaacgacaucgagaagaa

SEQ ID NO: 86130 - RNA, 19 nt, Homo sapiens
gcaaaugucucggaaagaa

SEQ ID NO: 86131 - RNA, 19 nt, Homo sapiens
gagacgggcuuccaccuua

SEQ ID NO: 86132 - RNA, 19 nt, Homo sapiens
gaaaacagaugaaauugug

SEQ ID NO: 86133 - RNA, 19 nt, Homo sapiens
gagcaccagugaagaauca

SEQ ID NO: 86134 - RNA, 19 nt, Homo sapiens
gcauggagaucacaauaag

SEQ ID NO: 86135 - RNA, 19 nt, Homo sapiens
ugaaacaccugcacgacaa

SEQ ID NO: 86136 - RNA, 19 nt, Homo sapiens
uaaagcggcugaagaugga

SEQ ID NO: 86137 - RNA, 19 nt, Homo sapiens
gaaaaggacucuuggaaag

SEQ ID NO: 86138 - RNA, 19 nt, Homo sapiens
agaaaugagugaagaugaa

SEQ ID NO: 86139 - RNA, 19 nt, Homo sapiens
gcagcaacauggacaagau

SEQ ID NO: 86140 - RNA, 19 nt, Homo sapiens
gagugaagaugaagaacga

SEQ ID NO: 86141 - RNA, 19 nt, Homo sapiens
gaagggagcaccagugaag

SEQ ID NO: 86142 - RNA, 19 nt, Homo sapiens
uaacucaaaugggugauga

SEQ ID NO: 86143 - RNA, 19 nt, Homo sapiens
ggaguggucuacagagcaa

SEQ ID NO: 86144 - RNA, 19 nt, Homo sapiens
gaagaugaagaacgagaaa

SEQ ID NO: 86145 - RNA, 19 nt, Homo sapiens
gcacgaacgucggaaacga

SEQ ID NO: 86146 - RNA, 19 nt, Homo sapiens
gagaagacucuauggaaga

SEQ ID NO: 86147 - RNA, 19 nt, Homo sapiens
ggaaggaacaagaggagaa

SEQ ID NO: 86148 - RNA, 19 nt, Homo sapiens
cagcaaaugucucggaaag

SEQ ID NO: 86149 - RNA, 19 nt, Homo sapiens
gaagaaaugagugaagaug

SEQ ID NO: 86150 - RNA, 19 nt, Homo sapiens
cagaaaagaugaaaagaga

SEQ ID NO: 86151 - RNA, 19 nt, Homo sapiens
agaaguaagugaggaagaa

SEQ ID NO: 86152 - RNA, 19 nt, Homo sapiens
ggaaagagagcacgaacgu

SEQ ID NO: 86153 - RNA, 19 nt, Homo sapiens
ggaagacagaggagaagaa

SEQ ID NO: 86154 - RNA, 19 nt, Homo sapiens
ugacagagggcgacuaugu

SEQ ID NO: 86155 - RNA, 19 nt, Homo sapiens
ggacuacagcgacaaagug

SEQ ID NO: 86156 - RNA, 19 nt, Homo sapiens
gaaggaacaagaggagaaa

SEQ ID NO: 86157 - RNA, 19 nt, Homo sapiens
ggaagugucugcacaucac

SEQ ID NO: 86158 - RNA, 19 nt, Homo sapiens
gagaagaacaggauaaagc

SEQ ID NO: 86159 - RNA, 19 nt, Homo sapiens
ggagaaagcagagauaaaa

SEQ ID NO: 86160 - RNA, 19 nt, Homo sapiens
ugaagaagcagaggaagaa

SEQ ID NO: 86161 - RNA, 19 nt, Homo sapiens
gagcauuccaggagagaaa

SEQ ID NO: 86162 - RNA, 19 nt, Homo sapiens
gaggagaaagcagagauaa

SEQ ID NO: 86163 - RNA, 19 nt, Homo sapiens
gcuucgaccucaugaacaa

SEQ ID NO: 86164 - RNA, 19 nt, Homo sapiens
ggaauucggaaaucgauca

SEQ ID NO: 86165 - RNA, 19 nt, Homo sapiens
caacaucgucaccguuaga

SEQ ID NO: 86166 - RNA, 19 nt, Homo sapiens
ugagggagaucaacaccau

SEQ ID NO: 86167 - RNA, 19 nt, Homo sapiens
aaaggacucuuggaaagug

SEQ ID NO: 86168 - RNA, 19 nt, Homo sapiens
gaaguaagugaggaagaaa

SEQ ID NO: 86169 - RNA, 19 nt, Homo sapiens
cuacagcgacaaagugaaa

SEQ ID NO: 86170 - RNA, 19 nt, Homo sapiens
gaacgaugagagaggacua

SEQ ID NO: 86171 - RNA, 19 nt, Homo sapiens
ggcugaagauggagaagga

SEQ ID NO: 86172 - RNA, 19 nt, Homo sapiens
gcucuaaagcggcugaaga

SEQ ID NO: 86173 - RNA, 19 nt, Homo sapiens
gaucaacaccauccucaag

SEQ ID NO: 86174 - RNA, 19 nt, Homo sapiens
gaugaaauuguggcucuaa

SEQ ID NO: 86175 - RNA, 19 nt, Homo sapiens
agacagaggagaagaagau

SEQ ID NO: 86176 - RNA, 19 nt, Homo sapiens
cuacagcgagcucccagua

SEQ ID NO: 86177 - RNA, 19 nt, Homo sapiens
gaggugaagacccugauga

SEQ ID NO: 86178 - RNA, 19 nt, Homo sapiens
gaaucaggcucagguucug

SEQ ID NO: 86179 - RNA, 19 nt, Homo sapiens
gaaggaaagagagcacgaa

SEQ ID NO: 86180 - RNA, 19 nt, Homo sapiens
ucacgucgcugagggagau

SEQ ID NO: 86181 - RNA, 19 nt, Homo sapiens
ggaaacgacaucgagaaga

SEQ ID NO: 86182 - RNA, 19 nt, Homo sapiens
ugaagacccugaugaucca

SEQ ID NO: 86183 - RNA, 19 nt, Homo sapiens
gaaauuguggcucuaaagc

SEQ ID NO: 86184 - RNA, 19 nt, Homo sapiens
ucaaaugggugaugaaaag

SEQ ID NO: 86185 - RNA, 19 nt, Homo sapiens
gaagaacgagaaaaugaaa

SEQ ID NO: 86186 - RNA, 19 nt, Homo sapiens
ggaagaaaugagugaagau

SEQ ID NO: 86187 - RNA, 19 nt, Homo sapiens
agacagaagagaagggaaa

SEQ ID NO: 86188 - RNA, 19 nt, Homo sapiens
gaaugggaaagacagaaga

SEQ ID NO: 86189 - RNA, 19 nt, Homo sapiens
caaaugucucggaaagaaa

SEQ ID NO: 86190 - RNA, 19 nt, Homo sapiens
gaagacagaggagaagaag

SEQ ID NO: 86191 - RNA, 19 nt, Homo sapiens
gcaacauggacaagaucua

SEQ ID NO: 86192 - RNA, 19 nt, Homo sapiens
aacgagggcuucccgauca

SEQ ID NO: 86193 - RNA, 19 nt, Homo sapiens
aggaagaaaugagugaaga

SEQ ID NO: 86194 - RNA, 19 nt, Homo sapiens
gaggagaagaagaugauuc

SEQ ID NO: 86195 - RNA, 19 nt, Homo sapiens
auaaggaacuccccguaua

SEQ ID NO: 86196 - RNA, 19 nt, Homo sapiens
ggagacgggcuuccaccuu

SEQ ID NO: 86197 - RNA, 19 nt, Homo sapiens
cccaacaucgucaccguua

SEQ ID NO: 86198 - RNA, 19 nt, Homo sapiens
gagugaagaagcagaggaa

SEQ ID NO: 86199 - RNA, 19 nt, Homo sapiens
caaaagacaagaaaacaga

SEQ ID NO: 86200 - RNA, 19 nt, Homo sapiens
gaucgaggagggcaccuau

SEQ ID NO: 86201 - RNA, 19 nt, Homo sapiens
gaaaugagugaagaugaag

SEQ ID NO: 86202 - RNA, 19 nt, Homo sapiens
ggaagaggaggaggaggaa

SEQ ID NO: 86203 - RNA, 19 nt, Homo sapiens
gggaaagacagaagagaag

SEQ ID NO: 86204 - RNA, 19 nt, Homo sapiens
gaagagaaaauggaagaaa

SEQ ID NO: 86205 - RNA, 19 nt, Homo sapiens
ccaguagucaagaagauga

SEQ ID NO: 86206 - RNA, 19 nt, Homo sapiens
acagcgagcucccaguagu

SEQ ID NO: 86207 - RNA, 19 nt, Homo sapiens
cgucaccguuagagagauu

SEQ ID NO: 86208 - RNA, 19 nt, Homo sapiens
gugaagaagcagaggaaga

SEQ ID NO: 86209 - RNA, 19 nt, Homo sapiens
cgaagaaguaagugaggaa

SEQ ID NO: 86210 - RNA, 19 nt, Homo sapiens
ugaagaaucagaggaggaa

SEQ ID NO: 86211 - RNA, 19 nt, Homo sapiens
gacuacagcgacaaaguga

SEQ ID NO: 86212 - RNA, 19 nt, Homo sapiens
ggaaugggaaagacagaag

SEQ ID NO: 86213 - RNA, 19 nt, Homo sapiens
caacauggacaagaucuac

SEQ ID NO: 86214 - RNA, 19 nt, Homo sapiens
gaaacgaaggaaggaacaa

SEQ ID NO: 86215 - RNA, 19 nt, Homo sapiens
ggaacaagaggagaaagca

SEQ ID NO: 86216 - RNA, 19 nt, Homo sapiens
ggaagggagcaccagugaa

SEQ ID NO: 86217 - RNA, 19 nt, Homo sapiens
guaagugaggaagaaauga

SEQ ID NO: 86218 - RNA, 19 nt, Homo sapiens
gcagaaucaggcucagguu

SEQ ID NO: 86219 - RNA, 19 nt, Homo sapiens
ggaccgcuuggagcaguua

SEQ ID NO: 86220 - RNA, 19 nt, Homo sapiens
gauggcgugugccucuuca

SEQ ID NO: 86221 - RNA, 19 nt, Homo sapiens
cagaggagaagaagaugau

SEQ ID NO: 86222 - RNA, 19 nt, Homo sapiens
aggacggccucaagcauga

SEQ ID NO: 86223 - RNA, 19 nt, Homo sapiens
gcaccuauggaguggucua

SEQ ID NO: 86224 - RNA, 19 nt, Homo sapiens
gacagagggcgacuaugug

SEQ ID NO: 86225 - RNA, 19 nt, Homo sapiens
aagaaaugagugaagauga

SEQ ID NO: 86226 - RNA, 19 nt, Homo sapiens
cagaagagaagggaaaugg

SEQ ID NO: 86227 - RNA, 19 nt, Homo sapiens
agaggagaaagcagagaua

SEQ ID NO: 86228 - RNA, 19 nt, Homo sapiens
cugcauggagaucacaaua

SEQ ID NO: 86229 - RNA, 19 nt, Homo sapiens
gagacgggcuuccaccuua

SEQ ID NO: 86230 - RNA, 19 nt, Homo sapiens
gaaaacagaugaaauugug

SEQ ID NO: 86231 - RNA, 19 nt, Homo sapiens
ugaaacaccugcacgacaa

SEQ ID NO: 86232 - RNA, 19 nt, Homo sapiens
uaaagcggcugaagaugga

SEQ ID NO: 86233 - RNA, 19 nt, Homo sapiens
agaaaugagugaagaugaa

SEQ ID NO: 86234 - RNA, 19 nt, Homo sapiens
gcagcaacauggacaagau

SEQ ID NO: 86235 - RNA, 19 nt, Homo sapiens
gagugaagaugaagaacga

SEQ ID NO: 86236 - RNA, 19 nt, Homo sapiens
ggaguggucuacagagcaa

SEQ ID NO: 86237 - RNA, 19 nt, Homo sapiens
gaagaugaagaacgagaaa

SEQ ID NO: 86238 - RNA, 19 nt, Homo sapiens
gcagacgccuccuuucucu

SEQ ID NO: 86239 - RNA, 19 nt, Homo sapiens
ggagugcaauggugagauc

SEQ ID NO: 86240 - RNA, 19 nt, Homo sapiens
gaagaaaugagugaagaug

SEQ ID NO: 86241 - RNA, 19 nt, Homo sapiens
agaaguaagugaggaagaa

SEQ ID NO: 86242 - RNA, 19 nt, Homo sapiens
ccaaagcacugggauuaca

SEQ ID NO: 86243 - RNA, 19 nt, Homo sapiens
ugacagagggcgacuaugu

SEQ ID NO: 86244 - RNA, 19 nt, Homo sapiens
ugaagaagcagaggaagaa

SEQ ID NO: 86245 - RNA, 19 nt, Homo sapiens
gcuucgaccucaugaacaa

SEQ ID NO: 86246 - RNA, 19 nt, Homo sapiens
aaggagggcuucccgauca

SEQ ID NO: 86247 - RNA, 19 nt, Homo sapiens
caacaucgucaccguuaga

SEQ ID NO: 86248 - RNA, 19 nt, Homo sapiens
ugagggagaucaacaccau

SEQ ID NO: 86249 - RNA, 19 nt, Homo sapiens
gaaguaagugaggaagaaa

SEQ ID NO: 86250 - RNA, 19 nt, Homo sapiens
ggcugaagauggagaagga

SEQ ID NO: 86251 - RNA, 19 nt, Homo sapiens
gcucuaaagcggcugaaga

SEQ ID NO: 86252 - RNA, 19 nt, Homo sapiens
gaucaacaccauccucaag

SEQ ID NO: 86253 - RNA, 19 nt, Homo sapiens
gaugaaauuguggcucuaa

SEQ ID NO: 86254 - RNA, 19 nt, Homo sapiens
gagcagacgccuccuuucu

SEQ ID NO: 86255 - RNA, 19 nt, Homo sapiens
gaggugaagacccugauga

SEQ ID NO: 86256 - RNA, 19 nt, Homo sapiens
agucagaaaucgaucagau

SEQ ID NO: 86257 - RNA, 19 nt, Homo sapiens
ucacgucgcugagggagau

SEQ ID NO: 86258 - RNA, 19 nt, Homo sapiens
gucaguggguugcaucuuc

SEQ ID NO: 86259 - RNA, 19 nt, Homo sapiens
ugaagacccugaugaucca

SEQ ID NO: 86260 - RNA, 19 nt, Homo sapiens
gaaauuguggcucuaaagc

SEQ ID NO: 86261 - RNA, 19 nt, Homo sapiens
ccuaguagcugggaguauc

SEQ ID NO: 86262 - RNA, 19 nt, Homo sapiens
gaagaacgagaaaaugaaa

SEQ ID NO: 86263 - RNA, 19 nt, Homo sapiens
ggaagaaaugagugaagau

SEQ ID NO: 86264 - RNA, 19 nt, Homo sapiens
gcaacauggacaagaucua

SEQ ID NO: 86265 - RNA, 19 nt, Homo sapiens
aggaagaaaugagugaaga

SEQ ID NO: 86266 - RNA, 19 nt, Homo sapiens
ggagacgggcuuccaccuu

SEQ ID NO: 86267 - RNA, 19 nt, Homo sapiens
ggaagucagaaaucgauca

SEQ ID NO: 86268 - RNA, 19 nt, Homo sapiens
cccaacaucgucaccguua

SEQ ID NO: 86269 - RNA, 19 nt, Homo sapiens
gagugaagaagcagaggaa

SEQ ID NO: 86270 - RNA, 19 nt, Homo sapiens
caaaagacaagaaaacaga

SEQ ID NO: 86271 - RNA, 19 nt, Homo sapiens
gaucgaggagggcaccuau

SEQ ID NO: 86272 - RNA, 19 nt, Homo sapiens
gaaaugagugaagaugaag

SEQ ID NO: 86273 - RNA, 19 nt, Homo sapiens
cgucaccguuagagagauu

SEQ ID NO: 86274 - RNA, 19 nt, Homo sapiens
gugaagaagcagaggaaga

SEQ ID NO: 86275 - RNA, 19 nt, Homo sapiens
caacauggacaagaucuac

SEQ ID NO: 86276 - RNA, 19 nt, Homo sapiens
agacggguuucaccacguu

SEQ ID NO: 86277 - RNA, 19 nt, Homo sapiens
guaagugaggaagaaauga

SEQ ID NO: 86278 - RNA, 19 nt, Homo sapiens
agacgccuccuuucucuug

SEQ ID NO: 86279 - RNA, 19 nt, Homo sapiens
aggacggccucaagcauga

SEQ ID NO: 86280 - RNA, 19 nt, Homo sapiens
gcaccuauggaguggucua

SEQ ID NO: 86281 - RNA, 19 nt, Homo sapiens
gacagagggcgacuaugug

SEQ ID NO: 86282 - RNA, 19 nt, Homo sapiens
aagaaaugagugaagauga

SEQ ID NO: 86283 - RNA, 19 nt, Homo sapiens
gaagauggagaaggagaag

SEQ ID NO: 86284 - RNA, 19 nt, Homo sapiens
gaggaagaaaugagugaag

SEQ ID NO: 86285 - RNA, 19 nt, Homo sapiens
ucccagcagucaagaagau

SEQ ID NO: 86286 - RNA, 19 nt, Homo sapiens
agaagcagaggaagaagug

SEQ ID NO: 86287 - RNA, 19 nt, Homo sapiens
ugaagaugaagaacgagaa

SEQ ID NO: 86288 - RNA, 19 nt, Homo sapiens
uggccaggauggucucgaa

SEQ ID NO: 86289 - RNA, 19 nt, Homo sapiens
ccaggauggucucgaacuc

SEQ ID NO: 86290 - RNA, 19 nt, Homo sapiens
gugaggaagaaaugaguga

SEQ ID NO: 86291 - RNA, 19 nt, Homo sapiens
ucaccacguuggccaggau

SEQ ID NO: 86292 - RNA, 19 nt, Homo sapiens
acaagguguucaaggaucu

SEQ ID NO: 86293 - RNA, 19 nt, Homo sapiens
gaguacggauccccucuga

SEQ ID NO: 86294 - RNA, 19 nt, Homo sapiens
agaagaaguaagugaggaa

SEQ ID NO: 86295 - RNA, 19 nt, Homo sapiens
ugaagauggagaaggagaa

SEQ ID NO: 86296 - RNA, 19 nt, Homo sapiens
gccuccauauccauucuug

SEQ ID NO: 86297 - RNA, 19 nt, Homo sapiens
gaagucagaaaucgaucag

SEQ ID NO: 86298 - RNA, 19 nt, Homo sapiens
ggugaagacccugaugauc

SEQ ID NO: 86299 - RNA, 19 nt, Homo sapiens
ccaacaucgucaccguuag

SEQ ID NO: 86300 - RNA, 19 nt, Homo sapiens
gggcuucgaccucaugaac

SEQ ID NO: 86301 - RNA, 19 nt, Homo sapiens
ggaggugaagacccugaug

SEQ ID NO: 86302 - RNA, 19 nt, Homo sapiens
ugaaauuguggcucuaaag

SEQ ID NO: 86303 - RNA, 19 nt, Homo sapiens
ggaaacagaugauaacaua

SEQ ID NO: 86304 - RNA, 19 nt, Homo sapiens
ggaaaucgauccucucaua

SEQ ID NO: 86305 - RNA, 19 nt, Homo sapiens
ccacagagcuccaagauaa

SEQ ID NO: 86306 - RNA, 19 nt, Homo sapiens
ccaaauagcuguagaauca

SEQ ID NO: 86307 - RNA, 19 nt, Homo sapiens
gaacuucgauguuauguga

SEQ ID NO: 86308 - RNA, 19 nt, Homo sapiens
gaaaugacuuggacacuaa

SEQ ID NO: 86309 - RNA, 19 nt, Homo sapiens
ggacaaauauucuccaaga

SEQ ID NO: 86310 - RNA, 19 nt, Homo sapiens
gcacaaggaaucuaauuua

SEQ ID NO: 86311 - RNA, 19 nt, Homo sapiens
gaagacaaguucacuagaa

SEQ ID NO: 86312 - RNA, 19 nt, Homo sapiens
gaauggauccuguaaauaa

SEQ ID NO: 86313 - RNA, 19 nt, Homo sapiens
ggaaguggguuacaauauu

SEQ ID NO: 86314 - RNA, 19 nt, Homo sapiens
gaccagaggugcaucauuu

SEQ ID NO: 86315 - RNA, 19 nt, Homo sapiens
gaagaugugugaucauuug

SEQ ID NO: 86316 - RNA, 19 nt, Homo sapiens
gcaaaucacugaccuuuua

SEQ ID NO: 86317 - RNA, 19 nt, Homo sapiens
caacuaaccucacuagaga

SEQ ID NO: 86318 - RNA, 19 nt, Homo sapiens
guacucaggugauacauaa

SEQ ID NO: 86319 - RNA, 19 nt, Homo sapiens
gacaagaacugcuuauaga

SEQ ID NO: 86320 - RNA, 19 nt, Homo sapiens
gaaugcagaugauuuagaa

SEQ ID NO: 86321 - RNA, 19 nt, Homo sapiens
gcucagauauuugcuauuu

SEQ ID NO: 86322 - RNA, 19 nt, Homo sapiens
gaacaagucugguuugcau

SEQ ID NO: 86323 - RNA, 19 nt, Homo sapiens
ggaaguaacuccucacaca

SEQ ID NO: 86324 - RNA, 19 nt, Homo sapiens
gaugaaggauucuggagua

SEQ ID NO: 86325 - RNA, 19 nt, Homo sapiens
ucuacaagcuugagaaaua

SEQ ID NO: 86326 - RNA, 19 nt, Homo sapiens
ggaaaugacuuggacacua

SEQ ID NO: 86327 - RNA, 19 nt, Homo sapiens
gaacugcaaacuacuaaua

SEQ ID NO: 86328 - RNA, 19 nt, Homo sapiens
gaagggauauuaauguuuc

SEQ ID NO: 86329 - RNA, 19 nt, Homo sapiens
gaagaaacacugacaaaug

SEQ ID NO: 86330 - RNA, 19 nt, Homo sapiens
gcaaaggucuuggcuauuc

SEQ ID NO: 86331 - RNA, 19 nt, Homo sapiens
agaaguaccuggagcauaa

SEQ ID NO: 86332 - RNA, 19 nt, Homo sapiens
cgugauaccucugauauua

SEQ ID NO: 86333 - RNA, 19 nt, Homo sapiens
gcagagagcagaagauauu

SEQ ID NO: 86334 - RNA, 19 nt, Homo sapiens
gagagagauuggacaaaua

SEQ ID NO: 86335 - RNA, 19 nt, Homo sapiens
gaaguggguuacaauauug

SEQ ID NO: 86336 - RNA, 19 nt, Homo sapiens
gauaaagccuugaaaccaa

SEQ ID NO: 86337 - RNA, 19 nt, Homo sapiens
gaacagugcuucucaucau

SEQ ID NO: 86338 - RNA, 19 nt, Homo sapiens
gagaagaugugugaucauu

SEQ ID NO: 86339 - RNA, 19 nt, Homo sapiens
uaauuuggguccuguauuu

SEQ ID NO: 86340 - RNA, 19 nt, Homo sapiens
gcucacugaucuauuauuu

SEQ ID NO: 86341 - RNA, 19 nt, Homo sapiens
gagauaacaugguuuguca

SEQ ID NO: 86342 - RNA, 19 nt, Homo sapiens
ucacagacaugcggaauuu

SEQ ID NO: 86343 - RNA, 19 nt, Homo sapiens
ggagagagauuggacaaau

SEQ ID NO: 86344 - RNA, 19 nt, Homo sapiens
aagaaacacugacaaauga

SEQ ID NO: 86345 - RNA, 19 nt, Homo sapiens
caacagcauucacaacuga

SEQ ID NO: 86346 - RNA, 19 nt, Homo sapiens
gcaauugugugaucacguu

SEQ ID NO: 86347 - RNA, 19 nt, Homo sapiens
gaaucugcaucuaauauug

SEQ ID NO: 86348 - RNA, 19 nt, Homo sapiens
gaaacucucuagugccauu

SEQ ID NO: 86349 - RNA, 19 nt, Homo sapiens
gcagugggauuggagauaa

SEQ ID NO: 86350 - RNA, 19 nt, Homo sapiens
cagaagggcugcauggaaa

SEQ ID NO: 86351 - RNA, 19 nt, Homo sapiens
caacucaacuaauccagaa

SEQ ID NO: 86352 - RNA, 19 nt, Homo sapiens
gaaggaucaucuaguaaga

SEQ ID NO: 86353 - RNA, 19 nt, Homo sapiens
cauauaaugugcuguuuga

SEQ ID NO: 86354 - RNA, 19 nt, Homo sapiens
uauaaccgauggaagaaua

SEQ ID NO: 86355 - RNA, 19 nt, Homo sapiens
ggaaguugcugucuguguu

SEQ ID NO: 86356 - RNA, 19 nt, Homo sapiens
ggaaauugcuacauucucu

SEQ ID NO: 86357 - RNA, 19 nt, Homo sapiens
gcaagugaguccauugaug

SEQ ID NO: 86358 - RNA, 19 nt, Homo sapiens
ccucagagaugccagaauu

SEQ ID NO: 86359 - RNA, 19 nt, Homo sapiens
gagcaguacuugaacuuug

SEQ ID NO: 86360 - RNA, 19 nt, Homo sapiens
uguaagggcuucuugguaa

SEQ ID NO: 86361 - RNA, 19 nt, Homo sapiens
cagcaaaggucuuggcuau

SEQ ID NO: 86362 - RNA, 19 nt, Homo sapiens
gaagauauccuugcuaaag

SEQ ID NO: 86363 - RNA, 19 nt, Homo sapiens
gaggugcuaucuacucuuu

SEQ ID NO: 86364 - RNA, 19 nt, Homo sapiens
aggaauggguuacguguua

SEQ ID NO: 86365 - RNA, 19 nt, Homo sapiens
gaaggauucuggaguaaag

SEQ ID NO: 86366 - RNA, 19 nt, Homo sapiens
gcuaucuacucuuucuuua

SEQ ID NO: 86367 - RNA, 19 nt, Homo sapiens
caucucaucucucaaguga

SEQ ID NO: 86368 - RNA, 19 nt, Homo sapiens
gcaugaggaugacaaucua

SEQ ID NO: 86369 - RNA, 19 nt, Homo sapiens
uacaggccauucuuaauua

SEQ ID NO: 86370 - RNA, 19 nt, Homo sapiens
gaaguaggccuuguugaaa

SEQ ID NO: 86371 - RNA, 19 nt, Homo sapiens
ggaagaugaugauuaugug

SEQ ID NO: 86372 - RNA, 19 nt, Homo sapiens
gcaagaaaaucaggaguua

SEQ ID NO: 86373 - RNA, 19 nt, Homo sapiens
uagaauggauccuguaaau

SEQ ID NO: 86374 - RNA, 19 nt, Homo sapiens
gagcauaauucucuucuac

SEQ ID NO: 86375 - RNA, 19 nt, Homo sapiens
ggugacagcuguacaucaa

SEQ ID NO: 86376 - RNA, 19 nt, Homo sapiens
gaacaaauggcacaaccuu

SEQ ID NO: 86377 - RNA, 19 nt, Homo sapiens
ggacaagaacugcuuauag

SEQ ID NO: 86378 - RNA, 19 nt, Homo sapiens
caagauccgguuucaaaua

SEQ ID NO: 86379 - RNA, 19 nt, Homo sapiens
ggcaauauuugucugauga

SEQ ID NO: 86380 - RNA, 19 nt, Homo sapiens
ugaaggagcugucaaucug

SEQ ID NO: 86381 - RNA, 19 nt, Homo sapiens
gcauagccuuauuccuuua

SEQ ID NO: 86382 - RNA, 19 nt, Homo sapiens
ggacauguuugguaaugau

SEQ ID NO: 86383 - RNA, 19 nt, Homo sapiens
agaggaagaugaugauuau

SEQ ID NO: 86384 - RNA, 19 nt, Homo sapiens
guagacacuuuaucaauca

SEQ ID NO: 86385 - RNA, 19 nt, Homo sapiens
gauacaaggguacauuuaa

SEQ ID NO: 86386 - RNA, 19 nt, Homo sapiens
gguugaaguuggagaagua

SEQ ID NO: 86387 - RNA, 19 nt, Homo sapiens
aaccagacguauuucauua

SEQ ID NO: 86388 - RNA, 19 nt, Homo sapiens
gacagcaacucaacuaauc

SEQ ID NO: 86389 - RNA, 19 nt, Homo sapiens
guaguucaguuguggaauu

SEQ ID NO: 86390 - RNA, 19 nt, Homo sapiens
ucucuuggcuuuacugaaa

SEQ ID NO: 86391 - RNA, 19 nt, Homo sapiens
ggagaagccauucaacaaa

SEQ ID NO: 86392 - RNA, 19 nt, Homo sapiens
gaucuacuguguuucguau

SEQ ID NO: 86393 - RNA, 19 nt, Homo sapiens
gaaagcaacuaaccucacu

SEQ ID NO: 86394 - RNA, 19 nt, Homo sapiens
caagcagccucuggcauua

SEQ ID NO: 86395 - RNA, 19 nt, Homo sapiens
gaaauagggcuguguucuu

SEQ ID NO: 86396 - RNA, 19 nt, Homo sapiens
ucacaaugaccacauauaa

SEQ ID NO: 86397 - RNA, 19 nt, Homo sapiens
caaccuugcuggccuuuau

SEQ ID NO: 86398 - RNA, 19 nt, Homo sapiens
auagugaacuucgauguua

SEQ ID NO: 86399 - RNA, 19 nt, Homo sapiens
gcauaugccucagaaguau

SEQ ID NO: 86400 - RNA, 19 nt, Homo sapiens
uaaagcauaugccucagaa

SEQ ID NO: 86401 - RNA, 19 nt, Homo sapiens
gaaggaacaagucugguuu

SEQ ID NO: 86402 - RNA, 19 nt, Homo sapiens
caaagacaguuauggacuu

SEQ ID NO: 86403 - RNA, 19 nt, Homo sapiens
gcauaaagcuguccagaaa

SEQ ID NO: 86404 - RNA, 19 nt, Homo sapiens
ggauaaagcugcccaaaga

SEQ ID NO: 86405 - RNA, 19 nt, Homo sapiens
gaaaugaaacgaaugcaua

SEQ ID NO: 86406 - RNA, 19 nt, Homo sapiens
cgagacaaguuaaacauua

SEQ ID NO: 86407 - RNA, 19 nt, Homo sapiens
gcauagaaauucagaagaa

SEQ ID NO: 86408 - RNA, 19 nt, Homo sapiens
ggaagaacgugaaauagau

SEQ ID NO: 86409 - RNA, 19 nt, Homo sapiens
gaaagcagcgguaaugaaa

SEQ ID NO: 86410 - RNA, 19 nt, Homo sapiens
caagagggcugcaaagaug

SEQ ID NO: 86411 - RNA, 19 nt, Homo sapiens
gaaagaaggccaagaggaa

SEQ ID NO: 86412 - RNA, 19 nt, Homo sapiens
ggacagaauugaaucacuu

SEQ ID NO: 86413 - RNA, 19 nt, Homo sapiens
gaagagaggaguugauuau

SEQ ID NO: 86414 - RNA, 19 nt, Homo sapiens
caagaugccucgaauuaug

SEQ ID NO: 86415 - RNA, 19 nt, Homo sapiens
gagaggaguugauuauaau

SEQ ID NO: 86416 - RNA, 19 nt, Homo sapiens
uuaccuaucuggaacauaa

SEQ ID NO: 86417 - RNA, 19 nt, Homo sapiens
agagaggaguugauuauaa

SEQ ID NO: 86418 - RNA, 19 nt, Homo sapiens
gccaagaugccucgaauua

SEQ ID NO: 86419 - RNA, 19 nt, Homo sapiens
ggaaagagaaucccgagaa

SEQ ID NO: 86420 - RNA, 19 nt, Homo sapiens
gaagaaugcuacagucaag

SEQ ID NO: 86421 - RNA, 19 nt, Homo sapiens
gaaccgccuuuaacagauu

SEQ ID NO: 86422 - RNA, 19 nt, Homo sapiens
aagcagcgguaaugaaaua

SEQ ID NO: 86423 - RNA, 19 nt, Homo sapiens
acuuaaaccuggagaaaua

SEQ ID NO: 86424 - RNA, 19 nt, Homo sapiens
ggucuaggauugccucauu

SEQ ID NO: 86425 - RNA, 19 nt, Homo sapiens
cgaggaaucuggcauaaca

SEQ ID NO: 86426 - RNA, 19 nt, Homo sapiens
ggaagugguuaaacaagga

SEQ ID NO: 86427 - RNA, 19 nt, Homo sapiens
ugaaccaucuggaaauaaa

SEQ ID NO: 86428 - RNA, 19 nt, Homo sapiens
gaaaaggaacuucaacaua

SEQ ID NO: 86429 - RNA, 19 nt, Homo sapiens
gaaucuggcauaacaaauu

SEQ ID NO: 86430 - RNA, 19 nt, Homo sapiens
ccucauugcugcauagaaa

SEQ ID NO: 86431 - RNA, 19 nt, Homo sapiens
gcacauuaccuaucuggaa

SEQ ID NO: 86432 - RNA, 19 nt, Homo sapiens
gaacgugaaauagaugaua

SEQ ID NO: 86433 - RNA, 19 nt, Homo sapiens
gaggaaagcaagagagaaa

SEQ ID NO: 86434 - RNA, 19 nt, Homo sapiens
gcuggaagaacgugaaaua

SEQ ID NO: 86435 - RNA, 19 nt, Homo sapiens
gaaagagaaucccgagaac

SEQ ID NO: 86436 - RNA, 19 nt, Homo sapiens
ugaagcagauggaaagaga

SEQ ID NO: 86437 - RNA, 19 nt, Homo sapiens
gccaagaccaucagaagua

SEQ ID NO: 86438 - RNA, 19 nt, Homo sapiens
ggaagagaggaguugauua

SEQ ID NO: 86439 - RNA, 19 nt, Homo sapiens
gaaaagaggcucgagauaa

SEQ ID NO: 86440 - RNA, 19 nt, Homo sapiens
gaacuccucuucgagacaa

SEQ ID NO: 86441 - RNA, 19 nt, Homo sapiens
gaaauuaagacaacaggau

SEQ ID NO: 86442 - RNA, 19 nt, Homo sapiens
gauccaagcauuaagaaga

SEQ ID NO: 86443 - RNA, 19 nt, Homo sapiens
ugaaacaguugaaugacuu

SEQ ID NO: 86444 - RNA, 19 nt, Homo sapiens
ccaagaccaucagaaguaa

SEQ ID NO: 86445 - RNA, 19 nt, Homo sapiens
gaauaccgaggaugaaauu

SEQ ID NO: 86446 - RNA, 19 nt, Homo sapiens
ggaggaauaccgaggauga

SEQ ID NO: 86447 - RNA, 19 nt, Homo sapiens
gaagaacucaagaaacaug

SEQ ID NO: 86448 - RNA, 19 nt, Homo sapiens
aaagagaagcaaacuagua

SEQ ID NO: 86449 - RNA, 19 nt, Homo sapiens
caacagaugauccacgaaa

SEQ ID NO: 86450 - RNA, 19 nt, Homo sapiens
uaugaaccaucuggaaaua

SEQ ID NO: 86451 - RNA, 19 nt, Homo sapiens
agaaauagauccaaaucca

SEQ ID NO: 86452 - RNA, 19 nt, Homo sapiens
gaaacaguugaaugacuua

SEQ ID NO: 86453 - RNA, 19 nt, Homo sapiens
cagagugguuugaugguuu

SEQ ID NO: 86454 - RNA, 19 nt, Homo sapiens
gaaauugcacgucaaacug

SEQ ID NO: 86455 - RNA, 19 nt, Homo sapiens
ucgagcagcuggcauagaa

SEQ ID NO: 86456 - RNA, 19 nt, Homo sapiens
ggacggacauuuuagaguu

SEQ ID NO: 86457 - RNA, 19 nt, Homo sapiens
gaagaggaaacaacagaug

SEQ ID NO: 86458 - RNA, 19 nt, Homo sapiens
aaaggaacuucaacauaga

SEQ ID NO: 86459 - RNA, 19 nt, Homo sapiens
aaaagaggcucgagauaaa

SEQ ID NO: 86460 - RNA, 19 nt, Homo sapiens
auaaagcuguccagaaaga

SEQ ID NO: 86461 - RNA, 19 nt, Homo sapiens
acaugaagauucugcuauu

SEQ ID NO: 86462 - RNA, 19 nt, Homo sapiens
ggaagaaugcuacagucaa

SEQ ID NO: 86463 - RNA, 19 nt, Homo sapiens
gcucucaagugaagcuuau

SEQ ID NO: 86464 - RNA, 19 nt, Homo sapiens
cuagaaggcugaaacugau

SEQ ID NO: 86465 - RNA, 19 nt, Homo sapiens
ucaagaaacaugaagauuc

SEQ ID NO: 86466 - RNA, 19 nt, Homo sapiens
gaugauacuuacauugaag

SEQ ID NO: 86467 - RNA, 19 nt, Homo sapiens
ccaggaaguuguaaaagua

SEQ ID NO: 86468 - RNA, 19 nt, Homo sapiens
gagaaacaauuggaagaag

SEQ ID NO: 86469 - RNA, 19 nt, Homo sapiens
gagagaaacaauuggaaga

SEQ ID NO: 86470 - RNA, 19 nt, Homo sapiens
gcuuagaacacuaugaauu

SEQ ID NO: 86471 - RNA, 19 nt, Homo sapiens
ugacuuaugggaccaaauu

SEQ ID NO: 86472 - RNA, 19 nt, Homo sapiens
guaaaggaaaugaaacgaa

SEQ ID NO: 86473 - RNA, 19 nt, Homo sapiens
ugaagaugcugcugaugug

SEQ ID NO: 86474 - RNA, 19 nt, Homo sapiens
cuagugguguuucugaauu

SEQ ID NO: 86475 - RNA, 19 nt, Homo sapiens
ggagaaauagauccaaauc

SEQ ID NO: 86476 - RNA, 19 nt, Homo sapiens
aaaaggaacuucaacauag

SEQ ID NO: 86477 - RNA, 19 nt, Homo sapiens
gaagaacgugaaauagaug

SEQ ID NO: 86478 - RNA, 19 nt, Homo sapiens
ggguagaacuccucuucga

SEQ ID NO: 86479 - RNA, 19 nt, Homo sapiens
cagcuauucuucaaacuag

SEQ ID NO: 86480 - RNA, 19 nt, Homo sapiens
ggaaguggcggcuuugagu

SEQ ID NO: 86481 - RNA, 19 nt, Homo sapiens
gugcaaagccagaugguau

SEQ ID NO: 86482 - RNA, 19 nt, Homo sapiens
ggagauggaagugguuaaa

SEQ ID NO: 86483 - RNA, 19 nt, Homo sapiens
caaacacaguucucucuac

SEQ ID NO: 86484 - RNA, 19 nt, Homo sapiens
ccaaagagacaaugaagag

SEQ ID NO: 86485 - RNA, 19 nt, Homo sapiens
caucagaaguaaaugaaac

SEQ ID NO: 86486 - RNA, 19 nt, Homo sapiens
cagcguugcucuuagaaca

SEQ ID NO: 86487 - RNA, 19 nt, Homo sapiens
gagaagcaaacuaguacuu

SEQ ID NO: 86488 - RNA, 19 nt, Homo sapiens
gcagagcguguaaaggaaa

SEQ ID NO: 86489 - RNA, 19 nt, Homo sapiens
gcucuuagaacaccacgaa

SEQ ID NO: 86490 - RNA, 19 nt, Homo sapiens
caagagagaaacaauugga

SEQ ID NO: 86491 - RNA, 19 nt, Homo sapiens
ggaugaggaugaacuugag

SEQ ID NO: 86492 - RNA, 19 nt, Homo sapiens
gaauggcagacuauaguga

SEQ ID NO: 86493 - RNA, 19 nt, Homo sapiens
aaacuuaaaccuggagaaa

SEQ ID NO: 86494 - RNA, 19 nt, Homo sapiens
aaagccagaugguaugaau

SEQ ID NO: 86495 - RNA, 19 nt, Homo sapiens
cagagcacauuaccuaucu

SEQ ID NO: 86496 - RNA, 19 nt, Homo sapiens
auuaugaccuucuacauca

SEQ ID NO: 86497 - RNA, 19 nt, Homo sapiens
caucagcuauucuucaaac

SEQ ID NO: 86498 - RNA, 19 nt, Homo sapiens
gaaagcaagagagaaacaa

SEQ ID NO: 86499 - RNA, 19 nt, Homo sapiens
ggaaagcaagagagaaaca

SEQ ID NO: 86500 - RNA, 19 nt, Homo sapiens
ggaaacaacagaugaucca

SEQ ID NO: 86501 - RNA, 19 nt, Homo sapiens
gguaaugaaauaugggaaa

SEQ ID NO: 86502 - RNA, 19 nt, Homo sapiens
ucuagaaggcugaaacuga

SEQ ID NO: 86503 - RNA, 19 nt, Homo sapiens
gcauuuagcuguauucaua

SEQ ID NO: 86504 - RNA, 19 nt, Homo sapiens
gaagggagcauguagcuaa

SEQ ID NO: 86505 - RNA, 19 nt, Homo sapiens
gaacacacaugcaggacuu

SEQ ID NO: 86506 - RNA, 19 nt, Homo sapiens
gaagagagguuuugaauuc

SEQ ID NO: 86507 - RNA, 19 nt, Homo sapiens
aaacugugcuucucuauga

SEQ ID NO: 86508 - RNA, 19 nt, Homo sapiens
ggacuuaaaccauuggaua

SEQ ID NO: 86509 - RNA, 19 nt, Homo sapiens
cuaauaauguccacuauga

SEQ ID NO: 86510 - RNA, 19 nt, Homo sapiens
agaaacagaugaugaagaa

SEQ ID NO: 86511 - RNA, 19 nt, Homo sapiens
gaggauaaauugccauaau

SEQ ID NO: 86512 - RNA, 19 nt, Homo sapiens
aaaggacucuggaagauuu

SEQ ID NO: 86513 - RNA, 19 nt, Homo sapiens
gugaauaucaucccacuua

SEQ ID NO: 86514 - RNA, 19 nt, Homo sapiens
gaaccaacaaggaaacuuu

SEQ ID NO: 86515 - RNA, 19 nt, Homo sapiens
uaacacaguugacccuauu

SEQ ID NO: 86516 - RNA, 19 nt, Homo sapiens
ugaaagaaauccaagaaca

SEQ ID NO: 86517 - RNA, 19 nt, Homo sapiens
gagaugcaguggauaauag

SEQ ID NO: 86518 - RNA, 19 nt, Homo sapiens
cgacauuaaucaacucauu

SEQ ID NO: 86519 - RNA, 19 nt, Homo sapiens
ugaagaagauggagaugga

SEQ ID NO: 86520 - RNA, 19 nt, Homo sapiens
gaaaguaagagcucuaagu

SEQ ID NO: 86521 - RNA, 19 nt, Homo sapiens
gagcagguguuugagauga

SEQ ID NO: 86522 - RNA, 19 nt, Homo sapiens
caaccuguuucuaccuaua

SEQ ID NO: 86523 - RNA, 19 nt, Homo sapiens
cuaaguaccuuuccuacau

SEQ ID NO: 86524 - RNA, 19 nt, Homo sapiens
aaaguaagagcucuaagua

SEQ ID NO: 86525 - RNA, 19 nt, Homo sapiens
gaaagucgacauuaaucaa

SEQ ID NO: 86526 - RNA, 19 nt, Homo sapiens
ucucauuacugcuucauuu

SEQ ID NO: 86527 - RNA, 19 nt, Homo sapiens
uaagaugccuugaauuguc

SEQ ID NO: 86528 - RNA, 19 nt, Homo sapiens
gcacaaagaauuggaggaa

SEQ ID NO: 86529 - RNA, 19 nt, Homo sapiens
gaggaaugccaacaguuua

SEQ ID NO: 86530 - RNA, 19 nt, Homo sapiens
gcuaaugaccaaccuguuu

SEQ ID NO: 86531 - RNA, 19 nt, Homo sapiens
gaaagaaauccaagaacau

SEQ ID NO: 86532 - RNA, 19 nt, Homo sapiens
caaagaaggugguguucag

SEQ ID NO: 86533 - RNA, 19 nt, Homo sapiens
uagcaucuuucauauggua

SEQ ID NO: 86534 - RNA, 19 nt, Homo sapiens
gaaagaagggagcauguag

SEQ ID NO: 86535 - RNA, 19 nt, Homo sapiens
caugguagcucaacagaag

SEQ ID NO: 86536 - RNA, 19 nt, Homo sapiens
gaagcucaacaacguauuu

SEQ ID NO: 86537 - RNA, 19 nt, Homo sapiens
gagaugaaggucaaagaaa

SEQ ID NO: 86538 - RNA, 19 nt, Homo sapiens
gaagauaagaacacacaug

SEQ ID NO: 86539 - RNA, 19 nt, Homo sapiens
gcaguguuguuuauacuuc

SEQ ID NO: 86540 - RNA, 19 nt, Homo sapiens
cauuauuccucacagauuu

SEQ ID NO: 86541 - RNA, 19 nt, Homo sapiens
uauagcaucuuucauaugg

SEQ ID NO: 86542 - RNA, 19 nt, Homo sapiens
cuaccuaaaugcagaauca

SEQ ID NO: 86543 - RNA, 19 nt, Homo sapiens
ggagaugcaguggauaaua

SEQ ID NO: 86544 - RNA, 19 nt, Homo sapiens
uaaguaccuuuccuacauu

SEQ ID NO: 86545 - RNA, 19 nt, Homo sapiens
ccaguuaacguauuaguug

SEQ ID NO: 86546 - RNA, 19 nt, Homo sapiens
ggaacaauccaaaguuuua

SEQ ID NO: 86547 - RNA, 19 nt, Homo sapiens
uugcagcugugacuuauaa

SEQ ID NO: 86548 - RNA, 19 nt, Homo sapiens
ggguauugcugaaguugaa

SEQ ID NO: 86549 - RNA, 19 nt, Homo sapiens
gaccaccaguuaacguauu

SEQ ID NO: 86550 - RNA, 19 nt, Homo sapiens
ggaagcacagcacaaagaa

SEQ ID NO: 86551 - RNA, 19 nt, Homo sapiens
gcacaaauggaagaagaaa

SEQ ID NO: 86552 - RNA, 19 nt, Homo sapiens
caacagcagcaccauggua

SEQ ID NO: 86553 - RNA, 19 nt, Homo sapiens
aaacagaugaugaagaaga

SEQ ID NO: 86554 - RNA, 19 nt, Homo sapiens
ugaaggcuaugugggauuu

SEQ ID NO: 86555 - RNA, 19 nt, Homo sapiens
gugcuucucuaugauaauu

SEQ ID NO: 86556 - RNA, 19 nt, Homo sapiens
ggaaagucgacauuaauca

SEQ ID NO: 86557 - RNA, 19 nt, Homo sapiens
ugaauucacgcuuauggua

SEQ ID NO: 86558 - RNA, 19 nt, Homo sapiens
agauuaagaugccuugaau

SEQ ID NO: 86559 - RNA, 19 nt, Homo sapiens
gagauuaagaugccuugaa

SEQ ID NO: 86560 - RNA, 19 nt, Homo sapiens
ggagauggagcagguguuu

SEQ ID NO: 86561 - RNA, 19 nt, Homo sapiens
auaaagggcagcugacuaa

SEQ ID NO: 86562 - RNA, 19 nt, Homo sapiens
gaacaacagaacucuucaa

SEQ ID NO: 86563 - RNA, 19 nt, Homo sapiens
acaaauggaagaagaaaga

SEQ ID NO: 86564 - RNA, 19 nt, Homo sapiens
uaugagaacuacagaagca

SEQ ID NO: 86565 - RNA, 19 nt, Homo sapiens
agaaggugguguucaguug

SEQ ID NO: 86566 - RNA, 19 nt, Homo sapiens
ccaaaucaaguauacagaa

SEQ ID NO: 86567 - RNA, 19 nt, Homo sapiens
gguaggaaccaacaaggaa

SEQ ID NO: 86568 - RNA, 19 nt, Homo sapiens
ggauuuaacagcaugacaa

SEQ ID NO: 86569 - RNA, 19 nt, Homo sapiens
ggauccguuugaccaauuu

SEQ ID NO: 86570 - RNA, 19 nt, Homo sapiens
aagcacagcacaaagaauu

SEQ ID NO: 86571 - RNA, 19 nt, Homo sapiens
cauaauaaacgaugguugu

SEQ ID NO: 86572 - RNA, 19 nt, Homo sapiens
ggaaucauggccucuugaa

SEQ ID NO: 86573 - RNA, 19 nt, Homo sapiens
gggaagaucuuuuaaacuc

SEQ ID NO: 86574 - RNA, 19 nt, Homo sapiens
gcugugguagguaguaaua

SEQ ID NO: 86575 - RNA, 19 nt, Homo sapiens
cagugcagcauauacaaua

SEQ ID NO: 86576 - RNA, 19 nt, Homo sapiens
uaagagcucuaaguaccuu

SEQ ID NO: 86577 - RNA, 19 nt, Homo sapiens
ugaccaauuugcaccaguu

SEQ ID NO: 86578 - RNA, 19 nt, Homo sapiens
uggcacaaauggaagaaga

SEQ ID NO: 86579 - RNA, 19 nt, Homo sapiens
ccagaggaaugccaacagu

SEQ ID NO: 86580 - RNA, 19 nt, Homo sapiens
cuuaaaccauuggauauug

SEQ ID NO: 86581 - RNA, 19 nt, Homo sapiens
aauaaacgaugguugugau

SEQ ID NO: 86582 - RNA, 19 nt, Homo sapiens
ucuggugguuugauuguuu

SEQ ID NO: 86583 - RNA, 19 nt, Homo sapiens
gcucuaaguaccuuuccua

SEQ ID NO: 86584 - RNA, 19 nt, Homo sapiens
gauuuaacagcaugacaaa

SEQ ID NO: 86585 - RNA, 19 nt, Homo sapiens
agaggaaugccaacaguuu

SEQ ID NO: 86586 - RNA, 19 nt, Homo sapiens
ugaauaucaucccacuuau

SEQ ID NO: 86587 - RNA, 19 nt, Homo sapiens
ccuauaugcagucucuuua

SEQ ID NO: 86588 - RNA, 19 nt, Homo sapiens
uugggaaagucgacauuaa

SEQ ID NO: 86589 - RNA, 19 nt, Homo sapiens
auacaaagguuccauucag

SEQ ID NO: 86590 - RNA, 19 nt, Homo sapiens
ggaaugccaacaguuuaaa

SEQ ID NO: 86591 - RNA, 19 nt, Homo sapiens
uaaauuugaggacuaccua

SEQ ID NO: 86592 - RNA, 19 nt, Homo sapiens
guaggaaccaacaaggaaa

SEQ ID NO: 86593 - RNA, 19 nt, Homo sapiens
ugacacuuccauuguuuaa

SEQ ID NO: 86594 - RNA, 19 nt, Homo sapiens
ucaguuuaaugcaagagaa

SEQ ID NO: 86595 - RNA, 19 nt, Homo sapiens
ugaauugucuaggguguuc

SEQ ID NO: 86596 - RNA, 19 nt, Homo sapiens
gaaaagaacaagaagaaag

SEQ ID NO: 86597 - RNA, 19 nt, Homo sapiens
gcauguagcuaaaaugaag

SEQ ID NO: 86598 - RNA, 19 nt, Homo sapiens
uugccaaucucccaaauca

SEQ ID NO: 86599 - RNA, 19 nt, Homo sapiens
cgagugaacagacgucaga

SEQ ID NO: 86600 - RNA, 19 nt, Homo sapiens
cuaggguguucuguacuua

SEQ ID NO: 86601 - RNA, 19 nt, Homo sapiens
acaaagaauuggaggaaaa

SEQ ID NO: 86602 - RNA, 19 nt, Homo sapiens
agauggagauggagaugga

SEQ ID NO: 86603 - RNA, 19 nt, Homo sapiens
gaacacagcugucccagau

SEQ ID NO: 86604 - RNA, 19 nt, Homo sapiens
gagcagagauguccacuga

SEQ ID NO: 86605 - RNA, 19 nt, Homo sapiens
ggaaauaucuuagcuacug

SEQ ID NO: 86606 - RNA, 19 nt, Homo sapiens
acaaucagcugacaauuaa

SEQ ID NO: 86607 - RNA, 19 nt, Homo sapiens
ggacgaagauugguauuug

SEQ ID NO: 86608 - RNA, 19 nt, Homo sapiens
caggagagcuauugaaauu

SEQ ID NO: 86609 - RNA, 19 nt, Homo sapiens
gaacaugcucugaaagaua

SEQ ID NO: 86610 - RNA, 19 nt, Homo sapiens
ggaaggacaugaugaggaa

SEQ ID NO: 86611 - RNA, 19 nt, Homo sapiens
ggacaaugcugcaguucaa

SEQ ID NO: 86612 - RNA, 19 nt, Homo sapiens
caagagaucacaacaaauu

SEQ ID NO: 86613 - RNA, 19 nt, Homo sapiens
caaagucucugcuguuuca

SEQ ID NO: 86614 - RNA, 19 nt, Homo sapiens
gacaaucagcugacaauua

SEQ ID NO: 86615 - RNA, 19 nt, Homo sapiens
ggagagcuauugaaauugu

SEQ ID NO: 86616 - RNA, 19 nt, Homo sapiens
gaagaaagaaucugcaugu

SEQ ID NO: 86617 - RNA, 19 nt, Homo sapiens
uaucuuagcuacuggauug

SEQ ID NO: 86618 - RNA, 19 nt, Homo sapiens
gucaagagaucacaacaaa

SEQ ID NO: 86619 - RNA, 19 nt, Homo sapiens
gcuaagcaauucucacuug

SEQ ID NO: 86620 - RNA, 19 nt, Homo sapiens
gaagauugguauuugacaa

SEQ ID NO: 86621 - RNA, 19 nt, Homo sapiens
gcagagauguccacugaag

SEQ ID NO: 86622 - RNA, 19 nt, Homo sapiens
ggaaacgucugggcgauga

SEQ ID NO: 86623 - RNA, 19 nt, Homo sapiens
caagugaucugcccaccuu

SEQ ID NO: 86624 - RNA, 19 nt, Homo sapiens
aagcaaagcugguccugaa

SEQ ID NO: 86625 - RNA, 19 nt, Homo sapiens
gaucuugguuugcucuuug

SEQ ID NO: 86626 - RNA, 19 nt, Homo sapiens
gagaucagguucuggacaa

SEQ ID NO: 86627 - RNA, 19 nt, Homo sapiens
gauguccacugaagaaaga

SEQ ID NO: 86628 - RNA, 19 nt, Homo sapiens
aaagagaacuagccaaagu

SEQ ID NO: 86629 - RNA, 19 nt, Homo sapiens
gcucagccauuaagguauu

SEQ ID NO: 86630 - RNA, 19 nt, Homo sapiens
ucucagaaguugaugguaa

SEQ ID NO: 86631 - RNA, 19 nt, Homo sapiens
caagucaucucagaaguug

SEQ ID NO: 86632 - RNA, 19 nt, Homo sapiens
gaauguaaaucaccuucug

SEQ ID NO: 86633 - RNA, 19 nt, Homo sapiens
gcuggaagccuuuaccuuu

SEQ ID NO: 86634 - RNA, 19 nt, Homo sapiens
gagcugugcugucgucaug

SEQ ID NO: 86635 - RNA, 19 nt, Homo sapiens
guagaggaauguguguaua

SEQ ID NO: 86636 - RNA, 19 nt, Homo sapiens
ccaccaugcucagccauua

SEQ ID NO: 86637 - RNA, 19 nt, Homo sapiens
ccaaugugcuugcaagugu

SEQ ID NO: 86638 - RNA, 19 nt, Homo sapiens
uuagagagcuacagucuuc

SEQ ID NO: 86639 - RNA, 19 nt, Homo sapiens
guauucagcuggcauuuag

SEQ ID NO: 86640 - RNA, 19 nt, Homo sapiens
gcuacuggauugccuuaaa

SEQ ID NO: 86641 - RNA, 19 nt, Homo sapiens
ucaaaccacugucugaaug

SEQ ID NO: 86642 - RNA, 19 nt, Homo sapiens
gcaaaggccaggauguauu

SEQ ID NO: 86643 - RNA, 19 nt, Homo sapiens
aaacuaucaugcugaauug

SEQ ID NO: 86644 - RNA, 19 nt, Homo sapiens
ccuaagugcugggauuaua

SEQ ID NO: 86645 - RNA, 19 nt, Homo sapiens
gccuuaaauucuucucuua

SEQ ID NO: 86646 - RNA, 19 nt, Homo sapiens
aauagaacaugcucugaaa

SEQ ID NO: 86647 - RNA, 19 nt, Homo sapiens
gaagcugucucgggcauug

SEQ ID NO: 86648 - RNA, 19 nt, Homo sapiens
aacaugcucugaaagauaa

SEQ ID NO: 86649 - RNA, 19 nt, Homo sapiens
caagaaggagcacaagauu

SEQ ID NO: 86650 - RNA, 19 nt, Homo sapiens
ucacauaucccaagucauc

SEQ ID NO: 86651 - RNA, 19 nt, Homo sapiens
gacgaagauugguauuuga

SEQ ID NO: 86652 - RNA, 19 nt, Homo sapiens
uauaugaagccuacaguaa

SEQ ID NO: 86653 - RNA, 19 nt, Homo sapiens
gaaugaaaaugauccagaa

SEQ ID NO: 86654 - RNA, 19 nt, Homo sapiens
gcacagaauaauaucuuug

SEQ ID NO: 86655 - RNA, 19 nt, Homo sapiens
ugcaagaccucaagaagga

SEQ ID NO: 86656 - RNA, 19 nt, Homo sapiens
acaauuaagucuccuagca

SEQ ID NO: 86657 - RNA, 19 nt, Homo sapiens
gaggaauguguguauauuu

SEQ ID NO: 86658 - RNA, 19 nt, Homo sapiens
gaaauagaacaugcucuga

SEQ ID NO: 86659 - RNA, 19 nt, Homo sapiens
ucaauucugugcccgcaaa

SEQ ID NO: 86660 - RNA, 19 nt, Homo sapiens
ggccauggcuaagcaauuc

SEQ ID NO: 86661 - RNA, 19 nt, Homo sapiens
gaauggccauggcuaagca

SEQ ID NO: 86662 - RNA, 19 nt, Homo sapiens
caaaggccaggauguauug

SEQ ID NO: 86663 - RNA, 19 nt, Homo sapiens
caaacuagaaccaacaaau

SEQ ID NO: 86664 - RNA, 19 nt, Homo sapiens
gagcuacagucuucauuuu

SEQ ID NO: 86665 - RNA, 19 nt, Homo sapiens
gagagcuauugaaauugua

SEQ ID NO: 86666 - RNA, 19 nt, Homo sapiens
gaaauuguagagucagaug

SEQ ID NO: 86667 - RNA, 19 nt, Homo sapiens
gcuaauacccuggaucuca

SEQ ID NO: 86668 - RNA, 19 nt, Homo sapiens
gaugacaaccuaugcaaca

SEQ ID NO: 86669 - RNA, 19 nt, Homo sapiens
uuaaucagguaucuagaga

SEQ ID NO: 86670 - RNA, 19 nt, Homo sapiens
cagcaaaggccaggaugua

SEQ ID NO: 86671 - RNA, 19 nt, Homo sapiens
ggacugcccaggcuguauu

SEQ ID NO: 86672 - RNA, 19 nt, Homo sapiens
caaagcaaggcaagaaaga

SEQ ID NO: 86673 - RNA, 19 nt, Homo sapiens
acaaauguccaaaccguaa

SEQ ID NO: 86674 - RNA, 19 nt, Homo sapiens
aaacuagaaccaacaaaug

SEQ ID NO: 86675 - RNA, 19 nt, Homo sapiens
cagcagaagaucuugguuu

SEQ ID NO: 86676 - RNA, 19 nt, Homo sapiens
cgcaaagucucugcuguuu

SEQ ID NO: 86677 - RNA, 19 nt, Homo sapiens
gcacugaggagguggaaag

SEQ ID NO: 86678 - RNA, 19 nt, Homo sapiens
agaggaauguguguauauu

SEQ ID NO: 86679 - RNA, 19 nt, Homo sapiens
aaacuccagugaugccaaa

SEQ ID NO: 86680 - RNA, 19 nt, Homo sapiens
auauuuaccucuucguuug

SEQ ID NO: 86681 - RNA, 19 nt, Homo sapiens
caaugugcuugcaagugua

SEQ ID NO: 86682 - RNA, 19 nt, Homo sapiens
cuacuggauugccuuaaau

SEQ ID NO: 86683 - RNA, 19 nt, Homo sapiens
gaagagaaagaaauagaac

SEQ ID NO: 86684 - RNA, 19 nt, Homo sapiens
aauuaagucuccuagcaaa

SEQ ID NO: 86685 - RNA, 19 nt, Homo sapiens
uggauugccuuaaauucuu

SEQ ID NO: 86686 - RNA, 19 nt, Homo sapiens
gauuaaagagaaacaagga

SEQ ID NO: 86687 - RNA, 19 nt, Homo sapiens
ccaagaaggagcacaagau

SEQ ID NO: 86688 - RNA, 19 nt, Homo sapiens
gguaacaggaugaccuuga

SEQ ID NO: 86689 - RNA, 19 nt, Homo sapiens
aaaccacugucugaaugua

SEQ ID NO: 86690 - RNA, 19 nt, Homo sapiens
gcaggagagcuauugaaau

SEQ ID NO: 86691 - RNA, 19 nt, Homo sapiens
ccauuuaccuccuuguucu

SEQ ID NO: 86692 - RNA, 19 nt, Homo sapiens
ccgaguagcugggauuaca

SEQ ID NO: 86693 - RNA, 19 nt, Homo sapiens
gcacaggcuacaaucaguu

SEQ ID NO: 86694 - RNA, 19 nt, Homo sapiens
uaugaagccuacaguaaag

SEQ ID NO: 86695 - RNA, 19 nt, Homo sapiens
gcucuuugaugcucuugau

SEQ ID NO: 86696 - RNA, 19 nt, Homo sapiens
guaacaggaugaccuugag

SEQ ID NO: 86697 - RNA, 19 nt, Homo sapiens
agccacagcuguugaacuu

SEQ ID NO: 86698 - RNA, 19 nt, Homo sapiens
uagaacaugcucugaaaga

SEQ ID NO: 86699 - RNA, 19 nt, Homo sapiens
gggcauugaacaaagcuaa

SEQ ID NO: 86700 - RNA, 19 nt, Homo sapiens
aaagggagauggaugucau

SEQ ID NO: 86701 - RNA, 19 nt, Homo sapiens
gcaaagcugguccugaaca

SEQ ID NO: 86702 - RNA, 19 nt, Homo sapiens
ccauaaaagugaccaggua

SEQ ID NO: 86703 - RNA, 19 nt, Homo sapiens
gcacagaaccagcuaguua

SEQ ID NO: 86704 - RNA, 19 nt, Homo sapiens
caagguggcugaacucaaa

SEQ ID NO: 86705 - RNA, 19 nt, Homo sapiens
cagaaacggcuucgaaaua

SEQ ID NO: 86706 - RNA, 19 nt, Homo sapiens
gcaaggagaaccagucuga

SEQ ID NO: 86707 - RNA, 19 nt, Homo sapiens
gggaauauauauccucugu

SEQ ID NO: 86708 - RNA, 19 nt, Homo sapiens
gaaacggcuucgaaauaug

SEQ ID NO: 86709 - RNA, 19 nt, Homo sapiens
agaaacggcuucgaaauau

SEQ ID NO: 86710 - RNA, 19 nt, Homo sapiens
caagaaggaacaucagaaa

SEQ ID NO: 86711 - RNA, 19 nt, Homo sapiens
gaugagacccugaggcuau

SEQ ID NO: 86712 - RNA, 19 nt, Homo sapiens
caaauccaguuccaagguu

SEQ ID NO: 86713 - RNA, 19 nt, Homo sapiens
gaaggccagugcagccaaa

SEQ ID NO: 86714 - RNA, 19 nt, Homo sapiens
gaagaccugccguuacauu

SEQ ID NO: 86715 - RNA, 19 nt, Homo sapiens
gggccgaacuccuggcaaa

SEQ ID NO: 86716 - RNA, 19 nt, Homo sapiens
agaaccagcuaguuauuug

SEQ ID NO: 86717 - RNA, 19 nt, Homo sapiens
gaaaugacuauuaccugaa

SEQ ID NO: 86718 - RNA, 19 nt, Homo sapiens
ggccauggcuuugcacaga

SEQ ID NO: 86719 - RNA, 19 nt, Homo sapiens
cggaagaccugccguuaca

SEQ ID NO: 86720 - RNA, 19 nt, Homo sapiens
caaagagggcaacuacuug

SEQ ID NO: 86721 - RNA, 19 nt, Homo sapiens
ucaaagagggcaacuacuu

SEQ ID NO: 86722 - RNA, 19 nt, Homo sapiens
gaucaaagagggcaacuac

SEQ ID NO: 86723 - RNA, 19 nt, Homo sapiens
aaaguacucuacagccaaa

SEQ ID NO: 86724 - RNA, 19 nt, Homo sapiens
ucagaccacuccuagcaaa

SEQ ID NO: 86725 - RNA, 19 nt, Homo sapiens
gcagaaacggcuucgaaau

SEQ ID NO: 86726 - RNA, 19 nt, Homo sapiens
aaugauaacuuggucaaug

SEQ ID NO: 86727 - RNA, 19 nt, Homo sapiens
ggugacauccugcagcuuu

SEQ ID NO: 86728 - RNA, 19 nt, Homo sapiens
caccagugaucgacacauu

SEQ ID NO: 86729 - RNA, 19 nt, Homo sapiens
gcguaagccaggcguguua

SEQ ID NO: 86730 - RNA, 19 nt, Homo sapiens
aaacggcuucgaaauauga

SEQ ID NO: 86731 - RNA, 19 nt, Homo sapiens
cagcagaaacggcuucgaa

SEQ ID NO: 86732 - RNA, 19 nt, Homo sapiens
ggauuggaguucugggaau

SEQ ID NO: 86733 - RNA, 19 nt, Homo sapiens
gcaaauccaguuccaaggu

SEQ ID NO: 86734 - RNA, 19 nt, Homo sapiens
acuauuaccugaaccuugu

SEQ ID NO: 86735 - RNA, 19 nt, Homo sapiens
gccagacgcccaccaagaa

SEQ ID NO: 86736 - RNA, 19 nt, Homo sapiens
ggcauccgcugaagaccaa

SEQ ID NO: 86737 - RNA, 19 nt, Homo sapiens
ccaagaaggaacaucagaa

SEQ ID NO: 86738 - RNA, 19 nt, Homo sapiens
caucucaggccauggcuuu

SEQ ID NO: 86739 - RNA, 19 nt, Homo sapiens
cgagugggcucccuaagcu

SEQ ID NO: 86740 - RNA, 19 nt, Homo sapiens
gaacagacugaaaguacuc

SEQ ID NO: 86741 - RNA, 19 nt, Homo sapiens
ggguuccucugcagacauu

SEQ ID NO: 86742 - RNA, 19 nt, Homo sapiens
gauuggaguucugggaaug

SEQ ID NO: 86743 - RNA, 19 nt, Homo sapiens
aaagucaugucucccuuca

SEQ ID NO: 86744 - RNA, 19 nt, Homo sapiens
cccaucaccucaguuguuu

SEQ ID NO: 86745 - RNA, 19 nt, Homo sapiens
gaacucaaaggucacacau

SEQ ID NO: 86746 - RNA, 19 nt, Homo sapiens
guaaugauaacuuggucaa

SEQ ID NO: 86747 - RNA, 19 nt, Homo sapiens
ccaguggugguaaugauaa

SEQ ID NO: 86748 - RNA, 19 nt, Homo sapiens
cgccugaaauccgaaauga

SEQ ID NO: 86749 - RNA, 19 nt, Homo sapiens
ccagaggguuaucagaaca

SEQ ID NO: 86750 - RNA, 19 nt, Homo sapiens
gucaauguguggccuagug

SEQ ID NO: 86751 - RNA, 19 nt, Homo sapiens
cagaacagacugaaaguac

SEQ ID NO: 86752 - RNA, 19 nt, Homo sapiens
cagaaccagcuaguuauuu

SEQ ID NO: 86753 - RNA, 19 nt, Homo sapiens
ccaccaagaaggaacauca

SEQ ID NO: 86754 - RNA, 19 nt, Homo sapiens
aaggagaaccagucugaaa

SEQ ID NO: 86755 - RNA, 19 nt, Homo sapiens
gcgcucccauggcacaguu

SEQ ID NO: 86756 - RNA, 19 nt, Homo sapiens
ggccaguggugguaaugau

SEQ ID NO: 86757 - RNA, 19 nt, Homo sapiens
gaaauccgaaaugacuauu

SEQ ID NO: 86758 - RNA, 19 nt, Homo sapiens
gccaguggugguaaugaua

SEQ ID NO: 86759 - RNA, 19 nt, Homo sapiens
ccagauggacgacauuugg

SEQ ID NO: 86760 - RNA, 19 nt, Homo sapiens
gccauggcuuugcacagaa

SEQ ID NO: 86761 - RNA, 19 nt, Homo sapiens
gaucgacacauucgcaucu

SEQ ID NO: 86762 - RNA, 19 nt, Homo sapiens
uauauccuguccagugguu

SEQ ID NO: 86763 - RNA, 19 nt, Homo sapiens
gccagaggguuaucagaac

SEQ ID NO: 86764 - RNA, 19 nt, Homo sapiens
guucagaccacuccuagca

SEQ ID NO: 86765 - RNA, 19 nt, Homo sapiens
agauggagguggccagcuu

SEQ ID NO: 86766 - RNA, 19 nt, Homo sapiens
gcugaagaccaacccauca

SEQ ID NO: 86767 - RNA, 19 nt, Homo sapiens
ccacauccaccaccaugau

SEQ ID NO: 86768 - RNA, 19 nt, Homo sapiens
aauccgaaaugacuauuac

SEQ ID NO: 86769 - RNA, 19 nt, Homo sapiens
ugaaauccgaaaugacuau

SEQ ID NO: 86770 - RNA, 19 nt, Homo sapiens
uuacaaggagcucaucuca

SEQ ID NO: 86771 - RNA, 19 nt, Homo sapiens
ugcaagcucuggugacauc

SEQ ID NO: 86772 - RNA, 19 nt, Homo sapiens
gccggaagaccugccguua

SEQ ID NO: 86773 - RNA, 19 nt, Homo sapiens
aaaaugcgccagaggguua

SEQ ID NO: 86774 - RNA, 19 nt, Homo sapiens
ccugaacgguuuugaugua

SEQ ID NO: 86775 - RNA, 19 nt, Homo sapiens
guaagccaggcguguuaaa

SEQ ID NO: 86776 - RNA, 19 nt, Homo sapiens
guccugagucugaccauga

SEQ ID NO: 86777 - RNA, 19 nt, Homo sapiens
cacagaaccagcuaguuau

SEQ ID NO: 86778 - RNA, 19 nt, Homo sapiens
gggaugugcagcagcagaa

SEQ ID NO: 86779 - RNA, 19 nt, Homo sapiens
caagauccuucggcucagu

SEQ ID NO: 86780 - RNA, 19 nt, Homo sapiens
acagaaccagcuaguuauu

SEQ ID NO: 86781 - RNA, 19 nt, Homo sapiens
augauaacuuggucaaugu

SEQ ID NO: 86782 - RNA, 19 nt, Homo sapiens
gagcaaggagaaccagucu

SEQ ID NO: 86783 - RNA, 19 nt, Homo sapiens
cgccagaggguuaucagaa

SEQ ID NO: 86784 - RNA, 19 nt, Homo sapiens
caaggcauccgcugaagac

SEQ ID NO: 86785 - RNA, 19 nt, Homo sapiens
ccagcuuccuccugagcaa

SEQ ID NO: 86786 - RNA, 19 nt, Homo sapiens
gaaccagcuaguuauuugg

SEQ ID NO: 86787 - RNA, 19 nt, Homo sapiens
accugaaccuuguggauug

SEQ ID NO: 86788 - RNA, 19 nt, Homo sapiens
aaaugacuauuaccugaac

SEQ ID NO: 86789 - RNA, 19 nt, Homo sapiens
caccaaggcauccgcugaa

SEQ ID NO: 86790 - RNA, 19 nt, Homo sapiens
gguagcagaacaccaugug

SEQ ID NO: 86791 - RNA, 19 nt, Homo sapiens
ccugaaauccgaaaugacu

SEQ ID NO: 86792 - RNA, 19 nt, Homo sapiens
agaacagacugaaaguacu

SEQ ID NO: 86793 - RNA, 19 nt, Homo sapiens
ccaaggcauccgcugaaga

SEQ ID NO: 86794 - RNA, 19 nt, Homo sapiens
gauaacuuggucaaugugu

SEQ ID NO: 86795 - RNA, 19 nt, Homo sapiens
ggagcagccuggggaauau

SEQ ID NO: 86796 - RNA, 19 nt, Homo sapiens
gacauucacccagcaucaa

SEQ ID NO: 86797 - RNA, 19 nt, Homo sapiens
agaaggaacaucagaaagc

SEQ ID NO: 86798 - RNA, 19 nt, Homo sapiens
gaacgguuuugauguagag

SEQ ID NO: 86799 - RNA, 19 nt, Homo sapiens
ggaucaaagagggcaacua

SEQ ID NO: 86800 - RNA, 19 nt, Homo sapiens
ucuguggccuggaucaaag

SEQ ID NO: 86801 - RNA, 19 nt, Homo sapiens
gcagcgcaaagccaaggaa

SEQ ID NO: 86802 - RNA, 19 nt, Homo sapiens
uaccugaaccuuguggauu

SEQ ID NO: 86803 - RNA, 19 nt, Homo sapiens
gagagaaucugaagaauga

SEQ ID NO: 86804 - RNA, 19 nt, Homo sapiens
gaaauuauggcaucuguuu

SEQ ID NO: 86805 - RNA, 19 nt, Homo sapiens
ggacagcugugugacauuu

SEQ ID NO: 86806 - RNA, 19 nt, Homo sapiens
guagagaaguuuacacaga

SEQ ID NO: 86807 - RNA, 19 nt, Homo sapiens
ggaaacaucaggauuuaaa

SEQ ID NO: 86808 - RNA, 19 nt, Homo sapiens
aagaagaccugaagaaguu

SEQ ID NO: 86809 - RNA, 19 nt, Homo sapiens
auacaucucuccagaaauu

SEQ ID NO: 86810 - RNA, 19 nt, Homo sapiens
gcagagaaacuuaagcaaa

SEQ ID NO: 86811 - RNA, 19 nt, Homo sapiens
aaauacaucucuccagaaa

SEQ ID NO: 86812 - RNA, 19 nt, Homo sapiens
ugaaagagauagcagugaa

SEQ ID NO: 86813 - RNA, 19 nt, Homo sapiens
aaaugaagccuuugaguuu

SEQ ID NO: 86814 - RNA, 19 nt, Homo sapiens
cagagaaacuuaagcaaag

SEQ ID NO: 86815 - RNA, 19 nt, Homo sapiens
acaaggaguucuuuaugaa

SEQ ID NO: 86816 - RNA, 19 nt, Homo sapiens
ggacuuccaugccuuaaac

SEQ ID NO: 86817 - RNA, 19 nt, Homo sapiens
uacaaggaguucuuuauga

SEQ ID NO: 86818 - RNA, 19 nt, Homo sapiens
gcacauggaagaagagguu

SEQ ID NO: 86819 - RNA, 19 nt, Homo sapiens
gcagugaaccagggaauuu

SEQ ID NO: 86820 - RNA, 19 nt, Homo sapiens
uagagaaguuuacacagaa

SEQ ID NO: 86821 - RNA, 19 nt, Homo sapiens
gagaucgccuggguaauga

SEQ ID NO: 86822 - RNA, 19 nt, Homo sapiens
aagaagagguugaagacuu

SEQ ID NO: 86823 - RNA, 19 nt, Homo sapiens
ccacguuuguuuggauuua

SEQ ID NO: 86824 - RNA, 19 nt, Homo sapiens
acaguaaucugcagagaau

SEQ ID NO: 86825 - RNA, 19 nt, Homo sapiens
aaaugcugcuggccaaaua

SEQ ID NO: 86826 - RNA, 19 nt, Homo sapiens
caaccucauuaaagaguuu

SEQ ID NO: 86827 - RNA, 19 nt, Homo sapiens
gaaccgcggagucguguuu

SEQ ID NO: 86828 - RNA, 19 nt, Homo sapiens
ccacgaggacuuuaaagaa

SEQ ID NO: 86829 - RNA, 19 nt, Homo sapiens
ugggaaacaucaggauuua

SEQ ID NO: 86830 - RNA, 19 nt, Homo sapiens
caugagaacuacaaaccuu

SEQ ID NO: 86831 - RNA, 19 nt, Homo sapiens
ggagagaaucugaagaaug

SEQ ID NO: 86832 - RNA, 19 nt, Homo sapiens
aaugaagccuuugaguuua

SEQ ID NO: 86833 - RNA, 19 nt, Homo sapiens
gauacaaggaguucuuuau

SEQ ID NO: 86834 - RNA, 19 nt, Homo sapiens
ccacuacccugagcuguau

SEQ ID NO: 86835 - RNA, 19 nt, Homo sapiens
ucagguuucugucuagauu

SEQ ID NO: 86836 - RNA, 19 nt, Homo sapiens
gggcagugauuaugagcaa

SEQ ID NO: 86837 - RNA, 19 nt, Homo sapiens
gcaagcgugucauuguugu

SEQ ID NO: 86838 - RNA, 19 nt, Homo sapiens
gaacuacaaaccuugacaa

SEQ ID NO: 86839 - RNA, 19 nt, Homo sapiens
cuccaaggguuaucucuuu

SEQ ID NO: 86840 - RNA, 19 nt, Homo sapiens
caacaguaaucugcagaga

SEQ ID NO: 86841 - RNA, 19 nt, Homo sapiens
gcaccacgaggacuuuaaa

SEQ ID NO: 86842 - RNA, 19 nt, Homo sapiens
ccaaaggaaccauugagaa

SEQ ID NO: 86843 - RNA, 19 nt, Homo sapiens
cugauucucuugaccauga

SEQ ID NO: 86844 - RNA, 19 nt, Homo sapiens
gaggagccauucugauucu

SEQ ID NO: 86845 - RNA, 19 nt, Homo sapiens
ggauacaaggaguucuuua

SEQ ID NO: 86846 - RNA, 19 nt, Homo sapiens
gucgauacccauaugaaua

SEQ ID NO: 86847 - RNA, 19 nt, Homo sapiens
ggaagaagagguugaagac

SEQ ID NO: 86848 - RNA, 19 nt, Homo sapiens
gaacuugcacauggaagaa

SEQ ID NO: 86849 - RNA, 19 nt, Homo sapiens
gucaacagauucagguuuc

SEQ ID NO: 86850 - RNA, 19 nt, Homo sapiens
uuaaagaagaccugaagaa

SEQ ID NO: 86851 - RNA, 19 nt, Homo sapiens
caaggaguucuuuaugaaa

SEQ ID NO: 86852 - RNA, 19 nt, Homo sapiens
uugccaaccucauuaaaga

SEQ ID NO: 86853 - RNA, 19 nt, Homo sapiens
caaguuugccaaccucauu

SEQ ID NO: 86854 - RNA, 19 nt, Homo sapiens
ccuaugagaagaauacauu

SEQ ID NO: 86855 - RNA, 19 nt, Homo sapiens
gauguacagucgucugaag

SEQ ID NO: 86856 - RNA, 19 nt, Homo sapiens
caucaagggugcagugaac

SEQ ID NO: 86857 - RNA, 19 nt, Homo sapiens
ucauacaguugcugggaaa

SEQ ID NO: 86858 - RNA, 19 nt, Homo sapiens
gguuaucucuuucauacag

SEQ ID NO: 86859 - RNA, 19 nt, Homo sapiens
aagaggagccauucugauu

SEQ ID NO: 86860 - RNA, 19 nt, Homo sapiens
gaagaggagccauucugau

SEQ ID NO: 86861 - RNA, 19 nt, Homo sapiens
gaaaugcugcuggccaaau

SEQ ID NO: 86862 - RNA, 19 nt, Homo sapiens
agagagaucgccuggguaa

SEQ ID NO: 86863 - RNA, 19 nt, Homo sapiens
gcgugucauuguuguguuu

SEQ ID NO: 86864 - RNA, 19 nt, Homo sapiens
caaaggaaccauugagaac

SEQ ID NO: 86865 - RNA, 19 nt, Homo sapiens
gaagaacaacaguaaucug

SEQ ID NO: 86866 - RNA, 19 nt, Homo sapiens
ggacagcuccucucgucau

SEQ ID NO: 86867 - RNA, 19 nt, Homo sapiens
caaaagcuguugggaugua

SEQ ID NO: 86868 - RNA, 19 nt, Homo sapiens
agagaaguuuacacagaaa

SEQ ID NO: 86869 - RNA, 19 nt, Homo sapiens
gaguagagaaguuuacaca

SEQ ID NO: 86870 - RNA, 19 nt, Homo sapiens
gagauguacagucgucuga

SEQ ID NO: 86871 - RNA, 19 nt, Homo sapiens
cacgaggacuuuaaagaag

SEQ ID NO: 86872 - RNA, 19 nt, Homo sapiens
ugaagaaguuccgcaccaa

SEQ ID NO: 86873 - RNA, 19 nt, Homo sapiens
aaagaagaccugaagaagu

SEQ ID NO: 86874 - RNA, 19 nt, Homo sapiens
uaaagaagaccugaagaag

SEQ ID NO: 86875 - RNA, 19 nt, Homo sapiens
ggagucguguuuguguuug

SEQ ID NO: 86876 - RNA, 19 nt, Homo sapiens
gagccauucugauucucuu

SEQ ID NO: 86877 - RNA, 19 nt, Homo sapiens
gaggugaagaacaacagua

SEQ ID NO: 86878 - RNA, 19 nt, Homo sapiens
ugaagaggagccauucuga

SEQ ID NO: 86879 - RNA, 19 nt, Homo sapiens
uggcaagcgugucauuguu

SEQ ID NO: 86880 - RNA, 19 nt, Homo sapiens
gugaagaacaacaguaauc

SEQ ID NO: 86881 - RNA, 19 nt, Homo sapiens
cccaaagagucaacuaauc

SEQ ID NO: 86882 - RNA, 19 nt, Homo sapiens
cacuggaggugaagaacaa

SEQ ID NO: 86883 - RNA, 19 nt, Homo sapiens
agauucagguuucugucua

SEQ ID NO: 86884 - RNA, 19 nt, Homo sapiens
guacaaagaggaggaagag

SEQ ID NO: 86885 - RNA, 19 nt, Homo sapiens
gcccagcucggaaugcuuu

SEQ ID NO: 86886 - RNA, 19 nt, Homo sapiens
gaaaauccuaugagaagaa

SEQ ID NO: 86887 - RNA, 19 nt, Homo sapiens
gaagaagcccauuguaccu

SEQ ID NO: 86888 - RNA, 19 nt, Homo sapiens
cagccacuuugucugauga

SEQ ID NO: 86889 - RNA, 19 nt, Homo sapiens
gaguuuaagaagccaguaa

SEQ ID NO: 86890 - RNA, 19 nt, Homo sapiens
augaagccuuugaguuuaa

SEQ ID NO: 86891 - RNA, 19 nt, Homo sapiens
ggauguaguccagcucuga

SEQ ID NO: 86892 - RNA, 19 nt, Homo sapiens
aggguuaucucuuucauac

SEQ ID NO: 86893 - RNA, 19 nt, Homo sapiens
ggaaccauugagaacauuu

SEQ ID NO: 86894 - RNA, 19 nt, Homo sapiens
ccagagaaggcccaugaga

SEQ ID NO: 86895 - RNA, 19 nt, Homo sapiens
ccaccuggaaguacaaaga

SEQ ID NO: 86896 - RNA, 19 nt, Homo sapiens
caaccgaugcaagcuguuu

SEQ ID NO: 86897 - RNA, 19 nt, Homo sapiens
gacagcuccucucgucaug

SEQ ID NO: 86898 - RNA, 19 nt, Homo sapiens
ccauuggacaguaaagaaa

SEQ ID NO: 86899 - RNA, 19 nt, Homo sapiens
acgaggacuuuaaagaaga

SEQ ID NO: 86900 - RNA, 19 nt, Homo sapiens
agagaucgccuggguaaug

SEQ ID NO: 86901 - RNA, 19 nt, Homo sapiens
gaaguacaaagaggaggaa

SEQ ID NO: 86902 - RNA, 19 nt, Homo sapiens
auacauucccuaccucaaa

SEQ ID NO: 86903 - RNA, 19 nt, Homo sapiens
ugaggaagaugauggauuu

SEQ ID NO: 86904 - RNA, 19 nt, Homo sapiens
gccgagagcuuccuacuga

SEQ ID NO: 86905 - RNA, 19 nt, Homo sapiens
caaggagaaugauggauuu

SEQ ID NO: 86906 - RNA, 19 nt, Homo sapiens
ggucagagcuaaacuccuu

SEQ ID NO: 86907 - RNA, 19 nt, Homo sapiens
guuaaggccugaaucauga

SEQ ID NO: 86908 - RNA, 19 nt, Homo sapiens
gaacagaagcucuuacucu

SEQ ID NO: 86909 - RNA, 19 nt, Homo sapiens
gaagccagcugcccuaugg

SEQ ID NO: 86910 - RNA, 19 nt, Homo sapiens
gcacugagcaaguugagaa

SEQ ID NO: 86911 - RNA, 19 nt, Homo sapiens
caacaucguggauaaguuu

SEQ ID NO: 86912 - RNA, 19 nt, Homo sapiens
ggaagaugauggauuugug

SEQ ID NO: 86913 - RNA, 19 nt, Homo sapiens
gcagauaccccuaugaaua

SEQ ID NO: 86914 - RNA, 19 nt, Homo sapiens
cuaggucgcuucucucuga

SEQ ID NO: 86915 - RNA, 19 nt, Homo sapiens
agaaagggauguuauuauc

SEQ ID NO: 86916 - RNA, 19 nt, Homo sapiens
cagaagcucuuacucuuuc

SEQ ID NO: 86917 - RNA, 19 nt, Homo sapiens
gaggaugggucagagcuaa

SEQ ID NO: 86918 - RNA, 19 nt, Homo sapiens
gagagcugauuggagauua

SEQ ID NO: 86919 - RNA, 19 nt, Homo sapiens
ccagaaagggauguuauua

SEQ ID NO: 86920 - RNA, 19 nt, Homo sapiens
gaagagcccagucuguuga

SEQ ID NO: 86921 - RNA, 19 nt, Homo sapiens
gggcagggcugugcuugaa

SEQ ID NO: 86922 - RNA, 19 nt, Homo sapiens
gaaacgcuccuuugugugu

SEQ ID NO: 86923 - RNA, 19 nt, Homo sapiens
gcaacaucguggauaaguu

SEQ ID NO: 86924 - RNA, 19 nt, Homo sapiens
ucagcaacaucguggauaa

SEQ ID NO: 86925 - RNA, 19 nt, Homo sapiens
ggauaaguuugugauugua

SEQ ID NO: 86926 - RNA, 19 nt, Homo sapiens
ggagaaugauggauuuguc

SEQ ID NO: 86927 - RNA, 19 nt, Homo sapiens
gggaagacaaggagaauga

SEQ ID NO: 86928 - RNA, 19 nt, Homo sapiens
ugagauguauauccugaaa

SEQ ID NO: 86929 - RNA, 19 nt, Homo sapiens
aaaaggaccucgucaugua

SEQ ID NO: 86930 - RNA, 19 nt, Homo sapiens
cagcuuaaaggcaguauuu

SEQ ID NO: 86931 - RNA, 19 nt, Homo sapiens
ggaagagcccagucuguug

SEQ ID NO: 86932 - RNA, 19 nt, Homo sapiens
caagagagucauccucauu

SEQ ID NO: 86933 - RNA, 19 nt, Homo sapiens
ugaaggcccugcugaguca

SEQ ID NO: 86934 - RNA, 19 nt, Homo sapiens
cugaaacgcuccuuugugu

SEQ ID NO: 86935 - RNA, 19 nt, Homo sapiens
guggauaaguuugugauug

SEQ ID NO: 86936 - RNA, 19 nt, Homo sapiens
gauuggagauuacucuaag

SEQ ID NO: 86937 - RNA, 19 nt, Homo sapiens
aagaggaaaugucacagaa

SEQ ID NO: 86938 - RNA, 19 nt, Homo sapiens
gaacgagaccgugcuguca

SEQ ID NO: 86939 - RNA, 19 nt, Homo sapiens
auaaagcacugagcaaguu

SEQ ID NO: 86940 - RNA, 19 nt, Homo sapiens
acacuuccguagacuguuu

SEQ ID NO: 86941 - RNA, 19 nt, Homo sapiens
gauggaagguuggauggau

SEQ ID NO: 86942 - RNA, 19 nt, Homo sapiens
agaacuugcugcugucuug

SEQ ID NO: 86943 - RNA, 19 nt, Homo sapiens
cuacuacccugagauguau

SEQ ID NO: 86944 - RNA, 19 nt, Homo sapiens
gcaccaagaccucaaguac

SEQ ID NO: 86945 - RNA, 19 nt, Homo sapiens
aaacgaugguggcccuauu

SEQ ID NO: 86946 - RNA, 19 nt, Homo sapiens
aaguacaucucaccagaaa

SEQ ID NO: 86947 - RNA, 19 nt, Homo sapiens
ggaagccuuugcccagaga

SEQ ID NO: 86948 - RNA, 19 nt, Homo sapiens
cagaaagggauguuauuau

SEQ ID NO: 86949 - RNA, 19 nt, Homo sapiens
uggauaaguuugugauugu

SEQ ID NO: 86950 - RNA, 19 nt, Homo sapiens
aaaggaugaugaugcaguu

SEQ ID NO: 86951 - RNA, 19 nt, Homo sapiens
aacagaagcucuuacucuu

SEQ ID NO: 86952 - RNA, 19 nt, Homo sapiens
cauccuagagagugacuua

SEQ ID NO: 86953 - RNA, 19 nt, Homo sapiens
gcagccagccggaucauuc

SEQ ID NO: 86954 - RNA, 19 nt, Homo sapiens
gaagacaaggagaaugaug

SEQ ID NO: 86955 - RNA, 19 nt, Homo sapiens
ccugcugagucaucuguua

SEQ ID NO: 86956 - RNA, 19 nt, Homo sapiens
gguuaaggccugaaucaug

SEQ ID NO: 86957 - RNA, 19 nt, Homo sapiens
uccaggagcuucuuguuuc

SEQ ID NO: 86958 - RNA, 19 nt, Homo sapiens
ggacacuuccguagacugu

SEQ ID NO: 86959 - RNA, 19 nt, Homo sapiens
gcuucuuguuuccuuguua

SEQ ID NO: 86960 - RNA, 19 nt, Homo sapiens
uuagggccuugguucaaua

SEQ ID NO: 86961 - RNA, 19 nt, Homo sapiens
aggaugagcuaaagaccuu

SEQ ID NO: 86962 - RNA, 19 nt, Homo sapiens
caagaggaaaugucacaga

SEQ ID NO: 86963 - RNA, 19 nt, Homo sapiens
gcucuuacucuuuccuauu

SEQ ID NO: 86964 - RNA, 19 nt, Homo sapiens
agcccagucuguugaguua

SEQ ID NO: 86965 - RNA, 19 nt, Homo sapiens
agagugacuuaaaggauga

SEQ ID NO: 86966 - RNA, 19 nt, Homo sapiens
acaaggagaaugauggauu

SEQ ID NO: 86967 - RNA, 19 nt, Homo sapiens
aauccucccugucgucuga

SEQ ID NO: 86968 - RNA, 19 nt, Homo sapiens
ugguaugucugccauguug

SEQ ID NO: 86969 - RNA, 19 nt, Homo sapiens
gaaagcaccaagaccucaa

SEQ ID NO: 86970 - RNA, 19 nt, Homo sapiens
cucuuacucuuuccuauuu

SEQ ID NO: 86971 - RNA, 19 nt, Homo sapiens
guuuggagcuauucaagag

SEQ ID NO: 86972 - RNA, 19 nt, Homo sapiens
auauaugugugccuauuug

SEQ ID NO: 86973 - RNA, 19 nt, Homo sapiens
ccuagagagugacuuaaag

SEQ ID NO: 86974 - RNA, 19 nt, Homo sapiens
gggccuugguucaauaaag

SEQ ID NO: 86975 - RNA, 19 nt, Homo sapiens
ucuacuacccugagaugua

SEQ ID NO: 86976 - RNA, 19 nt, Homo sapiens
gauuguagacugcagauac

SEQ ID NO: 86977 - RNA, 19 nt, Homo sapiens
accaagaccucaaguacau

SEQ ID NO: 86978 - RNA, 19 nt, Homo sapiens
ggaaaaggaccucgucaug

SEQ ID NO: 86979 - RNA, 19 nt, Homo sapiens
gaaugauggauuugucuuc

SEQ ID NO: 86980 - RNA, 19 nt, Homo sapiens
guuagggccuugguucaau

SEQ ID NO: 86981 - RNA, 19 nt, Homo sapiens
ccagccggaucauucgaaa

SEQ ID NO: 86982 - RNA, 19 nt, Homo sapiens
gaaccacgaggccuucaag

SEQ ID NO: 86983 - RNA, 19 nt, Homo sapiens
aagagagucauccucauuu

SEQ ID NO: 86984 - RNA, 19 nt, Homo sapiens
cuuaaaggaugaugaugca

SEQ ID NO: 86985 - RNA, 19 nt, Homo sapiens
uggcggagcagacguuuga

SEQ ID NO: 86986 - RNA, 19 nt, Homo sapiens
gcagcaggaauauaugugu

SEQ ID NO: 86987 - RNA, 19 nt, Homo sapiens
gcucccagggcaaggguua

SEQ ID NO: 86988 - RNA, 19 nt, Homo sapiens
acagaagcucuuacucuuu

SEQ ID NO: 86989 - RNA, 19 nt, Homo sapiens
gcaggaggcugaggaaccu

SEQ ID NO: 86990 - RNA, 19 nt, Homo sapiens
ucagcucucugcccugugu

SEQ ID NO: 86991 - RNA, 19 nt, Homo sapiens
gggauacugaggaagauga

SEQ ID NO: 86992 - RNA, 19 nt, Homo sapiens
cagcuaaaccaaggacuga

SEQ ID NO: 86993 - RNA, 19 nt, Homo sapiens
ucaggacacuuccguagac

SEQ ID NO: 86994 - RNA, 19 nt, Homo sapiens
acugugaauucucaucuga

SEQ ID NO: 86995 - RNA, 19 nt, Homo sapiens
gaaacgaugguggcccuau

SEQ ID NO: 86996 - RNA, 19 nt, Homo sapiens
guacaucucaccagaaacg

SEQ ID NO: 86997 - RNA, 19 nt, Homo sapiens
caaguacaucucaccagaa

SEQ ID NO: 86998 - RNA, 19 nt, Homo sapiens
gaaaaggaccucgucaugu

SEQ ID NO: 86999 - RNA, 19 nt, Homo sapiens
agauguauauccugaaagg

SEQ ID NO: 87000 - RNA, 19 nt, Homo sapiens
caucaagacugcggugaac

SEQ ID NO: 87001 - RNA, 19 nt, Homo sapiens
ggcccuaggucgcuucucu

SEQ ID NO: 87002 - RNA, 19 nt, Homo sapiens
ucaauaaagcacugagcaa

SEQ ID NO: 87003 - RNA, 19 nt, Homo sapiens
ugaggaagaugauggauuu

SEQ ID NO: 87004 - RNA, 19 nt, Homo sapiens
gccgagagcuuccuacuga

SEQ ID NO: 87005 - RNA, 19 nt, Homo sapiens
ggucagagcuaaacuccuu

SEQ ID NO: 87006 - RNA, 19 nt, Homo sapiens
guuaaggccugaaucauga

SEQ ID NO: 87007 - RNA, 19 nt, Homo sapiens
gaacagaagcucuuacucu

SEQ ID NO: 87008 - RNA, 19 nt, Homo sapiens
gaagccagcugcccuaugg

SEQ ID NO: 87009 - RNA, 19 nt, Homo sapiens
gcacugagcaaguugagaa

SEQ ID NO: 87010 - RNA, 19 nt, Homo sapiens
caacaucguggauaaguuu

SEQ ID NO: 87011 - RNA, 19 nt, Homo sapiens
ggaagaugauggauuugug

SEQ ID NO: 87012 - RNA, 19 nt, Homo sapiens
gcagauaccccuaugaaua

SEQ ID NO: 87013 - RNA, 19 nt, Homo sapiens
cuaggucgcuucucucuga

SEQ ID NO: 87014 - RNA, 19 nt, Homo sapiens
agaaagggauguuauuauc

SEQ ID NO: 87015 - RNA, 19 nt, Homo sapiens
cagaagcucuuacucuuuc

SEQ ID NO: 87016 - RNA, 19 nt, Homo sapiens
gaggaugggucagagcuaa

SEQ ID NO: 87017 - RNA, 19 nt, Homo sapiens
gagagcugauuggagauua

SEQ ID NO: 87018 - RNA, 19 nt, Homo sapiens
ccagaaagggauguuauua

SEQ ID NO: 87019 - RNA, 19 nt, Homo sapiens
gaagagcccagucuguuga

SEQ ID NO: 87020 - RNA, 19 nt, Homo sapiens
gggcagggcugugcuugaa

SEQ ID NO: 87021 - RNA, 19 nt, Homo sapiens
gaaacgcuccuuugugugu

SEQ ID NO: 87022 - RNA, 19 nt, Homo sapiens
gcaacaucguggauaaguu

SEQ ID NO: 87023 - RNA, 19 nt, Homo sapiens
ucagcaacaucguggauaa

SEQ ID NO: 87024 - RNA, 19 nt, Homo sapiens
ggauaaguuugugauugua

SEQ ID NO: 87025 - RNA, 19 nt, Homo sapiens
ugagauguauauccugaaa

SEQ ID NO: 87026 - RNA, 19 nt, Homo sapiens
aaaaggaccucgucaugua

SEQ ID NO: 87027 - RNA, 19 nt, Homo sapiens
cagcuuaaaggcaguauuu

SEQ ID NO: 87028 - RNA, 19 nt, Homo sapiens
ggaagagcccagucuguug

SEQ ID NO: 87029 - RNA, 19 nt, Homo sapiens
caagagagucauccucauu

SEQ ID NO: 87030 - RNA, 19 nt, Homo sapiens
ugaaggcccugcugaguca

SEQ ID NO: 87031 - RNA, 19 nt, Homo sapiens
cugaaacgcuccuuugugu

SEQ ID NO: 87032 - RNA, 19 nt, Homo sapiens
guggauaaguuugugauug

SEQ ID NO: 87033 - RNA, 19 nt, Homo sapiens
gauuggagauuacucuaag

SEQ ID NO: 87034 - RNA, 19 nt, Homo sapiens
aagaggaaaugucacagaa

SEQ ID NO: 87035 - RNA, 19 nt, Homo sapiens
gaacgagaccgugcuguca

SEQ ID NO: 87036 - RNA, 19 nt, Homo sapiens
auaaagcacugagcaaguu

SEQ ID NO: 87037 - RNA, 19 nt, Homo sapiens
acacuuccguagacuguuu

SEQ ID NO: 87038 - RNA, 19 nt, Homo sapiens
gauggaagguuggauggau

SEQ ID NO: 87039 - RNA, 19 nt, Homo sapiens
agaacuugcugcugucuug

SEQ ID NO: 87040 - RNA, 19 nt, Homo sapiens
cuacuacccugagauguau

SEQ ID NO: 87041 - RNA, 19 nt, Homo sapiens
gcaccaagaccucaaguac

SEQ ID NO: 87042 - RNA, 19 nt, Homo sapiens
aaacgaugguggcccuauu

SEQ ID NO: 87043 - RNA, 19 nt, Homo sapiens
aaguacaucucaccagaaa

SEQ ID NO: 87044 - RNA, 19 nt, Homo sapiens
ggaagccuuugcccagaga

SEQ ID NO: 87045 - RNA, 19 nt, Homo sapiens
ggauggauuugucuucaag

SEQ ID NO: 87046 - RNA, 19 nt, Homo sapiens
cagaaagggauguuauuau

SEQ ID NO: 87047 - RNA, 19 nt, Homo sapiens
uggauaaguuugugauugu

SEQ ID NO: 87048 - RNA, 19 nt, Homo sapiens
aaaggaugaugaugcaguu

SEQ ID NO: 87049 - RNA, 19 nt, Homo sapiens
aacagaagcucuuacucuu

SEQ ID NO: 87050 - RNA, 19 nt, Homo sapiens
cauccuagagagugacuua

SEQ ID NO: 87051 - RNA, 19 nt, Homo sapiens
gcagccagccggaucauuc

SEQ ID NO: 87052 - RNA, 19 nt, Homo sapiens
ccugcugagucaucuguua

SEQ ID NO: 87053 - RNA, 19 nt, Homo sapiens
gguuaaggccugaaucaug

SEQ ID NO: 87054 - RNA, 19 nt, Homo sapiens
uccaggagcuucuuguuuc

SEQ ID NO: 87055 - RNA, 19 nt, Homo sapiens
ggacacuuccguagacugu

SEQ ID NO: 87056 - RNA, 19 nt, Homo sapiens
gcuucuuguuuccuuguua

SEQ ID NO: 87057 - RNA, 19 nt, Homo sapiens
uuagggccuugguucaaua

SEQ ID NO: 87058 - RNA, 19 nt, Homo sapiens
aggaugagcuaaagaccuu

SEQ ID NO: 87059 - RNA, 19 nt, Homo sapiens
caagaggaaaugucacaga

SEQ ID NO: 87060 - RNA, 19 nt, Homo sapiens
gcucuuacucuuuccuauu

SEQ ID NO: 87061 - RNA, 19 nt, Homo sapiens
agcccagucuguugaguua

SEQ ID NO: 87062 - RNA, 19 nt, Homo sapiens
agagugacuuaaaggauga

SEQ ID NO: 87063 - RNA, 19 nt, Homo sapiens
ugguaugucugccauguug

SEQ ID NO: 87064 - RNA, 19 nt, Homo sapiens
aauccucccugucgucuga

SEQ ID NO: 87065 - RNA, 19 nt, Homo sapiens
gaaagcaccaagaccucaa

SEQ ID NO: 87066 - RNA, 19 nt, Homo sapiens
cucuuacucuuuccuauuu

SEQ ID NO: 87067 - RNA, 19 nt, Homo sapiens
guuuggagcuauucaagag

SEQ ID NO: 87068 - RNA, 19 nt, Homo sapiens
auauaugugugccuauuug

SEQ ID NO: 87069 - RNA, 19 nt, Homo sapiens
ccuagagagugacuuaaag

SEQ ID NO: 87070 - RNA, 19 nt, Homo sapiens
gggccuugguucaauaaag

SEQ ID NO: 87071 - RNA, 19 nt, Homo sapiens
ucuacuacccugagaugua

SEQ ID NO: 87072 - RNA, 19 nt, Homo sapiens
gauuguagacugcagauac

SEQ ID NO: 87073 - RNA, 19 nt, Homo sapiens
accaagaccucaaguacau

SEQ ID NO: 87074 - RNA, 19 nt, Homo sapiens
ggaaaaggaccucgucaug

SEQ ID NO: 87075 - RNA, 19 nt, Homo sapiens
guuagggccuugguucaau

SEQ ID NO: 87076 - RNA, 19 nt, Homo sapiens
ccagccggaucauucgaaa

SEQ ID NO: 87077 - RNA, 19 nt, Homo sapiens
gaaccacgaggccuucaag

SEQ ID NO: 87078 - RNA, 19 nt, Homo sapiens
aagagagucauccucauuu

SEQ ID NO: 87079 - RNA, 19 nt, Homo sapiens
cuuaaaggaugaugaugca

SEQ ID NO: 87080 - RNA, 19 nt, Homo sapiens
gcagcaggaauauaugugu

SEQ ID NO: 87081 - RNA, 19 nt, Homo sapiens
gcucccagggcaaggguua

SEQ ID NO: 87082 - RNA, 19 nt, Homo sapiens
acagaagcucuuacucuuu

SEQ ID NO: 87083 - RNA, 19 nt, Homo sapiens
uggcggagcagacguuuga

SEQ ID NO: 87084 - RNA, 19 nt, Homo sapiens
gcaggaggcugaggaaccu

SEQ ID NO: 87085 - RNA, 19 nt, Homo sapiens
ucagcucucugcccugugu

SEQ ID NO: 87086 - RNA, 19 nt, Homo sapiens
gggauacugaggaagauga

SEQ ID NO: 87087 - RNA, 19 nt, Homo sapiens
cagcuaaaccaaggacuga

SEQ ID NO: 87088 - RNA, 19 nt, Homo sapiens
ucaggacacuuccguagac

SEQ ID NO: 87089 - RNA, 19 nt, Homo sapiens
acugugaauucucaucuga

SEQ ID NO: 87090 - RNA, 19 nt, Homo sapiens
gaaacgaugguggcccuau

SEQ ID NO: 87091 - RNA, 19 nt, Homo sapiens
guacaucucaccagaaacg

SEQ ID NO: 87092 - RNA, 19 nt, Homo sapiens
caaguacaucucaccagaa

SEQ ID NO: 87093 - RNA, 19 nt, Homo sapiens
gaaaaggaccucgucaugu

SEQ ID NO: 87094 - RNA, 19 nt, Homo sapiens
agauguauauccugaaagg

SEQ ID NO: 87095 - RNA, 19 nt, Homo sapiens
caucaagacugcggugaac

SEQ ID NO: 87096 - RNA, 19 nt, Homo sapiens
ggcccuaggucgcuucucu

SEQ ID NO: 87097 - RNA, 19 nt, Homo sapiens
ucaauaaagcacugagcaa

SEQ ID NO: 87098 - RNA, 19 nt, Homo sapiens
ugacuuaaaggaugaugau

SEQ ID NO: 87099 - RNA, 19 nt, Homo sapiens
gagcccagucuguugaguu

SEQ ID NO: 87100 - RNA, 19 nt, Homo sapiens
cuucaaggaugagcuaaag

SEQ ID NO: 87101 - RNA, 19 nt, Homo sapiens
ucaagacugcggugaacuu

SEQ ID NO: 87102 - RNA, 19 nt, Homo sapiens
gcccaucucaggacacuuc

SEQ ID NO: 87103 - RNA, 19 nt, Homo sapiens
ugaggaagaugauggauuu

SEQ ID NO: 87104 - RNA, 19 nt, Homo sapiens
gccgagagcuuccuacuga

SEQ ID NO: 87105 - RNA, 19 nt, Homo sapiens
caaggagaaugauggauuu

SEQ ID NO: 87106 - RNA, 19 nt, Homo sapiens
ggucagagcuaaacuccuu

SEQ ID NO: 87107 - RNA, 19 nt, Homo sapiens
guuaaggccugaaucauga

SEQ ID NO: 87108 - RNA, 19 nt, Homo sapiens
gaacagaagcucuuacucu

SEQ ID NO: 87109 - RNA, 19 nt, Homo sapiens
gaagccagcugcccuaugg

SEQ ID NO: 87110 - RNA, 19 nt, Homo sapiens
gcacugagcaaguugagaa

SEQ ID NO: 87111 - RNA, 19 nt, Homo sapiens
caacaucguggauaaguuu

SEQ ID NO: 87112 - RNA, 19 nt, Homo sapiens
ggaagaugauggauuugug

SEQ ID NO: 87113 - RNA, 19 nt, Homo sapiens
gcagauaccccuaugaaua

SEQ ID NO: 87114 - RNA, 19 nt, Homo sapiens
cuaggucgcuucucucuga

SEQ ID NO: 87115 - RNA, 19 nt, Homo sapiens
agaaagggauguuauuauc

SEQ ID NO: 87116 - RNA, 19 nt, Homo sapiens
cagaagcucuuacucuuuc

SEQ ID NO: 87117 - RNA, 19 nt, Homo sapiens
gaggaugggucagagcuaa

SEQ ID NO: 87118 - RNA, 19 nt, Homo sapiens
gagagcugauuggagauua

SEQ ID NO: 87119 - RNA, 19 nt, Homo sapiens
ccagaaagggauguuauua

SEQ ID NO: 87120 - RNA, 19 nt, Homo sapiens
gaagagcccagucuguuga

SEQ ID NO: 87121 - RNA, 19 nt, Homo sapiens
gggcagggcugugcuugaa

SEQ ID NO: 87122 - RNA, 19 nt, Homo sapiens
gaaacgcuccuuugugugu

SEQ ID NO: 87123 - RNA, 19 nt, Homo sapiens
gcaacaucguggauaaguu

SEQ ID NO: 87124 - RNA, 19 nt, Homo sapiens
ucagcaacaucguggauaa

SEQ ID NO: 87125 - RNA, 19 nt, Homo sapiens
ggauaaguuugugauugua

SEQ ID NO: 87126 - RNA, 19 nt, Homo sapiens
ggagaaugauggauuuguc

SEQ ID NO: 87127 - RNA, 19 nt, Homo sapiens
gggaagacaaggagaauga

SEQ ID NO: 87128 - RNA, 19 nt, Homo sapiens
ugagauguauauccugaaa

SEQ ID NO: 87129 - RNA, 19 nt, Homo sapiens
aaaaggaccucgucaugua

SEQ ID NO: 87130 - RNA, 19 nt, Homo sapiens
cagcuuaaaggcaguauuu

SEQ ID NO: 87131 - RNA, 19 nt, Homo sapiens
ggaagagcccagucuguug

SEQ ID NO: 87132 - RNA, 19 nt, Homo sapiens
caagagagucauccucauu

SEQ ID NO: 87133 - RNA, 19 nt, Homo sapiens
ugaaggcccugcugaguca

SEQ ID NO: 87134 - RNA, 19 nt, Homo sapiens
cugaaacgcuccuuugugu

SEQ ID NO: 87135 - RNA, 19 nt, Homo sapiens
guggauaaguuugugauug

SEQ ID NO: 87136 - RNA, 19 nt, Homo sapiens
gauuggagauuacucuaag

SEQ ID NO: 87137 - RNA, 19 nt, Homo sapiens
aagaggaaaugucacagaa

SEQ ID NO: 87138 - RNA, 19 nt, Homo sapiens
gaacgagaccgugcuguca

SEQ ID NO: 87139 - RNA, 19 nt, Homo sapiens
auaaagcacugagcaaguu

SEQ ID NO: 87140 - RNA, 19 nt, Homo sapiens
acacuuccguagacuguuu

SEQ ID NO: 87141 - RNA, 19 nt, Homo sapiens
gauggaagguuggauggau

SEQ ID NO: 87142 - RNA, 19 nt, Homo sapiens
agaacuugcugcugucuug

SEQ ID NO: 87143 - RNA, 19 nt, Homo sapiens
cuacuacccugagauguau

SEQ ID NO: 87144 - RNA, 19 nt, Homo sapiens
gcaccaagaccucaaguac

SEQ ID NO: 87145 - RNA, 19 nt, Homo sapiens
aaacgaugguggcccuauu

SEQ ID NO: 87146 - RNA, 19 nt, Homo sapiens
aaguacaucucaccagaaa

SEQ ID NO: 87147 - RNA, 19 nt, Homo sapiens
ggaagccuuugcccagaga

SEQ ID NO: 87148 - RNA, 19 nt, Homo sapiens
cagaaagggauguuauuau

SEQ ID NO: 87149 - RNA, 19 nt, Homo sapiens
uggauaaguuugugauugu

SEQ ID NO: 87150 - RNA, 19 nt, Homo sapiens
aaaggaugaugaugcaguu

SEQ ID NO: 87151 - RNA, 19 nt, Homo sapiens
aacagaagcucuuacucuu

SEQ ID NO: 87152 - RNA, 19 nt, Homo sapiens
cauccuagagagugacuua

SEQ ID NO: 87153 - RNA, 19 nt, Homo sapiens
gaagacaaggagaaugaug

SEQ ID NO: 87154 - RNA, 19 nt, Homo sapiens
gcagccagccggaucauuc

SEQ ID NO: 87155 - RNA, 19 nt, Homo sapiens
ccugcugagucaucuguua

SEQ ID NO: 87156 - RNA, 19 nt, Homo sapiens
gguuaaggccugaaucaug

SEQ ID NO: 87157 - RNA, 19 nt, Homo sapiens
uccaggagcuucuuguuuc

SEQ ID NO: 87158 - RNA, 19 nt, Homo sapiens
ggacacuuccguagacugu

SEQ ID NO: 87159 - RNA, 19 nt, Homo sapiens
gcuucuuguuuccuuguua

SEQ ID NO: 87160 - RNA, 19 nt, Homo sapiens
uuagggccuugguucaaua

SEQ ID NO: 87161 - RNA, 19 nt, Homo sapiens
aggaugagcuaaagaccuu

SEQ ID NO: 87162 - RNA, 19 nt, Homo sapiens
caagaggaaaugucacaga

SEQ ID NO: 87163 - RNA, 19 nt, Homo sapiens
gcucuuacucuuuccuauu

SEQ ID NO: 87164 - RNA, 19 nt, Homo sapiens
agcccagucuguugaguua

SEQ ID NO: 87165 - RNA, 19 nt, Homo sapiens
agagugacuuaaaggauga

SEQ ID NO: 87166 - RNA, 19 nt, Homo sapiens
acaaggagaaugauggauu

SEQ ID NO: 87167 - RNA, 19 nt, Homo sapiens
ugguaugucugccauguug

SEQ ID NO: 87168 - RNA, 19 nt, Homo sapiens
aauccucccugucgucuga

SEQ ID NO: 87169 - RNA, 19 nt, Homo sapiens
gaaagcaccaagaccucaa

SEQ ID NO: 87170 - RNA, 19 nt, Homo sapiens
cucuuacucuuuccuauuu

SEQ ID NO: 87171 - RNA, 19 nt, Homo sapiens
guuuggagcuauucaagag

SEQ ID NO: 87172 - RNA, 19 nt, Homo sapiens
auauaugugugccuauuug

SEQ ID NO: 87173 - RNA, 19 nt, Homo sapiens
ccuagagagugacuuaaag

SEQ ID NO: 87174 - RNA, 19 nt, Homo sapiens
gggccuugguucaauaaag

SEQ ID NO: 87175 - RNA, 19 nt, Homo sapiens
ucuacuacccugagaugua

SEQ ID NO: 87176 - RNA, 19 nt, Homo sapiens
gauuguagacugcagauac

SEQ ID NO: 87177 - RNA, 19 nt, Homo sapiens
accaagaccucaaguacau

SEQ ID NO: 87178 - RNA, 19 nt, Homo sapiens
ggaaaaggaccucgucaug

SEQ ID NO: 87179 - RNA, 19 nt, Homo sapiens
gaaugauggauuugucuuc

SEQ ID NO: 87180 - RNA, 19 nt, Homo sapiens
guuagggccuugguucaau

SEQ ID NO: 87181 - RNA, 19 nt, Homo sapiens
ccagccggaucauucgaaa

SEQ ID NO: 87182 - RNA, 19 nt, Homo sapiens
gaaccacgaggccuucaag

SEQ ID NO: 87183 - RNA, 19 nt, Homo sapiens
aagagagucauccucauuu

SEQ ID NO: 87184 - RNA, 19 nt, Homo sapiens
cuuaaaggaugaugaugca

SEQ ID NO: 87185 - RNA, 19 nt, Homo sapiens
gcagcaggaauauaugugu

SEQ ID NO: 87186 - RNA, 19 nt, Homo sapiens
gcucccagggcaaggguua

SEQ ID NO: 87187 - RNA, 19 nt, Homo sapiens
acagaagcucuuacucuuu

SEQ ID NO: 87188 - RNA, 19 nt, Homo sapiens
uggcggagcagacguuuga

SEQ ID NO: 87189 - RNA, 19 nt, Homo sapiens
gcaggaggcugaggaaccu

SEQ ID NO: 87190 - RNA, 19 nt, Homo sapiens
ucagcucucugcccugugu

SEQ ID NO: 87191 - RNA, 19 nt, Homo sapiens
gggauacugaggaagauga

SEQ ID NO: 87192 - RNA, 19 nt, Homo sapiens
cagcuaaaccaaggacuga

SEQ ID NO: 87193 - RNA, 19 nt, Homo sapiens
ucaggacacuuccguagac

SEQ ID NO: 87194 - RNA, 19 nt, Homo sapiens
acugugaauucucaucuga

SEQ ID NO: 87195 - RNA, 19 nt, Homo sapiens
gaaacgaugguggcccuau

SEQ ID NO: 87196 - RNA, 19 nt, Homo sapiens
guacaucucaccagaaacg

SEQ ID NO: 87197 - RNA, 19 nt, Homo sapiens
caaguacaucucaccagaa

SEQ ID NO: 87198 - RNA, 19 nt, Homo sapiens
gaaaaggaccucgucaugu

SEQ ID NO: 87199 - RNA, 19 nt, Homo sapiens
agauguauauccugaaagg

SEQ ID NO: 87200 - RNA, 19 nt, Homo sapiens
caucaagacugcggugaac

SEQ ID NO: 87201 - RNA, 19 nt, Homo sapiens
ggcccuaggucgcuucucu

SEQ ID NO: 87202 - RNA, 19 nt, Homo sapiens
ucaauaaagcacugagcaa

SEQ ID NO: 87203 - RNA, 19 nt, Homo sapiens
ugaggaagaugauggauuu

SEQ ID NO: 87204 - RNA, 19 nt, Homo sapiens
gccgagagcuuccuacuga

SEQ ID NO: 87205 - RNA, 19 nt, Homo sapiens
ggucagagcuaaacuccuu

SEQ ID NO: 87206 - RNA, 19 nt, Homo sapiens
guuaaggccugaaucauga

SEQ ID NO: 87207 - RNA, 19 nt, Homo sapiens
gaacagaagcucuuacucu

SEQ ID NO: 87208 - RNA, 19 nt, Homo sapiens
gaagccagcugcccuaugg

SEQ ID NO: 87209 - RNA, 19 nt, Homo sapiens
gcacugagcaaguugagaa

SEQ ID NO: 87210 - RNA, 19 nt, Homo sapiens
caacaucguggauaaguuu

SEQ ID NO: 87211 - RNA, 19 nt, Homo sapiens
ggaagaugauggauuugug

SEQ ID NO: 87212 - RNA, 19 nt, Homo sapiens
gcagauaccccuaugaaua

SEQ ID NO: 87213 - RNA, 19 nt, Homo sapiens
cuaggucgcuucucucuga

SEQ ID NO: 87214 - RNA, 19 nt, Homo sapiens
agaaagggauguuauuauc

SEQ ID NO: 87215 - RNA, 19 nt, Homo sapiens
cagaagcucuuacucuuuc

SEQ ID NO: 87216 - RNA, 19 nt, Homo sapiens
gaggaugggucagagcuaa

SEQ ID NO: 87217 - RNA, 19 nt, Homo sapiens
gagagcugauuggagauua

SEQ ID NO: 87218 - RNA, 19 nt, Homo sapiens
ccagaaagggauguuauua

SEQ ID NO: 87219 - RNA, 19 nt, Homo sapiens
gaagagcccagucuguuga

SEQ ID NO: 87220 - RNA, 19 nt, Homo sapiens
gggcagggcugugcuugaa

SEQ ID NO: 87221 - RNA, 19 nt, Homo sapiens
gaaacgcuccuuugugugu

SEQ ID NO: 87222 - RNA, 19 nt, Homo sapiens
gcaacaucguggauaaguu

SEQ ID NO: 87223 - RNA, 19 nt, Homo sapiens
ucagcaacaucguggauaa

SEQ ID NO: 87224 - RNA, 19 nt, Homo sapiens
ggauaaguuugugauugua

SEQ ID NO: 87225 - RNA, 19 nt, Homo sapiens
ugagauguauauccugaaa

SEQ ID NO: 87226 - RNA, 19 nt, Homo sapiens
aaaaggaccucgucaugua

SEQ ID NO: 87227 - RNA, 19 nt, Homo sapiens
cagcuuaaaggcaguauuu

SEQ ID NO: 87228 - RNA, 19 nt, Homo sapiens
ggaagagcccagucuguug

SEQ ID NO: 87229 - RNA, 19 nt, Homo sapiens
caagagagucauccucauu

SEQ ID NO: 87230 - RNA, 19 nt, Homo sapiens
ugaaggcccugcugaguca

SEQ ID NO: 87231 - RNA, 19 nt, Homo sapiens
cugaaacgcuccuuugugu

SEQ ID NO: 87232 - RNA, 19 nt, Homo sapiens
guggauaaguuugugauug

SEQ ID NO: 87233 - RNA, 19 nt, Homo sapiens
gauuggagauuacucuaag

SEQ ID NO: 87234 - RNA, 19 nt, Homo sapiens
aagaggaaaugucacagaa

SEQ ID NO: 87235 - RNA, 19 nt, Homo sapiens
gaacgagaccgugcuguca

SEQ ID NO: 87236 - RNA, 19 nt, Homo sapiens
auaaagcacugagcaaguu

SEQ ID NO: 87237 - RNA, 19 nt, Homo sapiens
acacuuccguagacuguuu

SEQ ID NO: 87238 - RNA, 19 nt, Homo sapiens
gauggaagguuggauggau

SEQ ID NO: 87239 - RNA, 19 nt, Homo sapiens
agaacuugcugcugucuug

SEQ ID NO: 87240 - RNA, 19 nt, Homo sapiens
cuacuacccugagauguau

SEQ ID NO: 87241 - RNA, 19 nt, Homo sapiens
gcaccaagaccucaaguac

SEQ ID NO: 87242 - RNA, 19 nt, Homo sapiens
aaacgaugguggcccuauu

SEQ ID NO: 87243 - RNA, 19 nt, Homo sapiens
aaguacaucucaccagaaa

SEQ ID NO: 87244 - RNA, 19 nt, Homo sapiens
ggaagccuuugcccagaga

SEQ ID NO: 87245 - RNA, 19 nt, Homo sapiens
ggauggauuugucuucaag

SEQ ID NO: 87246 - RNA, 19 nt, Homo sapiens
gugguucccuggcauguga

SEQ ID NO: 87247 - RNA, 19 nt, Homo sapiens
cagaaagggauguuauuau

SEQ ID NO: 87248 - RNA, 19 nt, Homo sapiens
uggauaaguuugugauugu

SEQ ID NO: 87249 - RNA, 19 nt, Homo sapiens
aaaggaugaugaugcaguu

SEQ ID NO: 87250 - RNA, 19 nt, Homo sapiens
gggaagacaaggagaaugu

SEQ ID NO: 87251 - RNA, 19 nt, Homo sapiens
gcagccagccggaucauuc

SEQ ID NO: 87252 - RNA, 19 nt, Homo sapiens
aacagaagcucuuacucuu

SEQ ID NO: 87253 - RNA, 19 nt, Homo sapiens
cauccuagagagugacuua

SEQ ID NO: 87254 - RNA, 19 nt, Homo sapiens
ccugcugagucaucuguua

SEQ ID NO: 87255 - RNA, 19 nt, Homo sapiens
gguuaaggccugaaucaug

SEQ ID NO: 87256 - RNA, 19 nt, Homo sapiens
uccaggagcuucuuguuuc

SEQ ID NO: 87257 - RNA, 19 nt, Homo sapiens
ggacacuuccguagacugu

SEQ ID NO: 87258 - RNA, 19 nt, Homo sapiens
gcuucuuguuuccuuguua

SEQ ID NO: 87259 - RNA, 19 nt, Homo sapiens
uuagggccuugguucaaua

SEQ ID NO: 87260 - RNA, 19 nt, Homo sapiens
aggaugagcuaaagaccuu

SEQ ID NO: 87261 - RNA, 19 nt, Homo sapiens
caagaggaaaugucacaga

SEQ ID NO: 87262 - RNA, 19 nt, Homo sapiens
gcucuuacucuuuccuauu

SEQ ID NO: 87263 - RNA, 19 nt, Homo sapiens
agcccagucuguugaguua

SEQ ID NO: 87264 - RNA, 19 nt, Homo sapiens
agagugacuuaaaggauga

SEQ ID NO: 87265 - RNA, 19 nt, Homo sapiens
ugguaugucugccauguug

SEQ ID NO: 87266 - RNA, 19 nt, Homo sapiens
aauccucccugucgucuga

SEQ ID NO: 87267 - RNA, 19 nt, Homo sapiens
gaaagcaccaagaccucaa

SEQ ID NO: 87268 - RNA, 19 nt, Homo sapiens
cucuuacucuuuccuauuu

SEQ ID NO: 87269 - RNA, 19 nt, Homo sapiens
guuuggagcuauucaagag

SEQ ID NO: 87270 - RNA, 19 nt, Homo sapiens
auauaugugugccuauuug

SEQ ID NO: 87271 - RNA, 19 nt, Homo sapiens
ccuagagagugacuuaaag

SEQ ID NO: 87272 - RNA, 19 nt, Homo sapiens
gggccuugguucaauaaag

SEQ ID NO: 87273 - RNA, 19 nt, Homo sapiens
ucuacuacccugagaugua

SEQ ID NO: 87274 - RNA, 19 nt, Homo sapiens
gauuguagacugcagauac

SEQ ID NO: 87275 - RNA, 19 nt, Homo sapiens
accaagaccucaaguacau

SEQ ID NO: 87276 - RNA, 19 nt, Homo sapiens
ggaaaaggaccucgucaug

SEQ ID NO: 87277 - RNA, 19 nt, Homo sapiens
caggauggauuugucuuca

SEQ ID NO: 87278 - RNA, 19 nt, Homo sapiens
guuagggccuugguucaau

SEQ ID NO: 87279 - RNA, 19 nt, Homo sapiens
ccagccggaucauucgaaa

SEQ ID NO: 87280 - RNA, 19 nt, Homo sapiens
gaaccacgaggccuucaag

SEQ ID NO: 87281 - RNA, 19 nt, Homo sapiens
aagagagucauccucauuu

SEQ ID NO: 87282 - RNA, 19 nt, Homo sapiens
cuuaaaggaugaugaugca

SEQ ID NO: 87283 - RNA, 19 nt, Homo sapiens
gcagcaggaauauaugugu

SEQ ID NO: 87284 - RNA, 19 nt, Homo sapiens
uggcggagcagacguuuga

SEQ ID NO: 87285 - RNA, 19 nt, Homo sapiens
gcucccagggcaaggguua

SEQ ID NO: 87286 - RNA, 19 nt, Homo sapiens
acagaagcucuuacucuuu

SEQ ID NO: 87287 - RNA, 19 nt, Homo sapiens
gcaggaggcugaggaaccu

SEQ ID NO: 87288 - RNA, 19 nt, Homo sapiens
ucagcucucugcccugugu

SEQ ID NO: 87289 - RNA, 19 nt, Homo sapiens
gggauacugaggaagauga

SEQ ID NO: 87290 - RNA, 19 nt, Homo sapiens
cagcuaaaccaaggacuga

SEQ ID NO: 87291 - RNA, 19 nt, Homo sapiens
ucaggacacuuccguagac

SEQ ID NO: 87292 - RNA, 19 nt, Homo sapiens
acugugaauucucaucuga

SEQ ID NO: 87293 - RNA, 19 nt, Homo sapiens
gaaacgaugguggcccuau

SEQ ID NO: 87294 - RNA, 19 nt, Homo sapiens
guacaucucaccagaaacg

SEQ ID NO: 87295 - RNA, 19 nt, Homo sapiens
gcaggauggauuugucuuc

SEQ ID NO: 87296 - RNA, 19 nt, Homo sapiens
caaguacaucucaccagaa

SEQ ID NO: 87297 - RNA, 19 nt, Homo sapiens
gaaaaggaccucgucaugu

SEQ ID NO: 87298 - RNA, 19 nt, Homo sapiens
agauguauauccugaaagg

SEQ ID NO: 87299 - RNA, 19 nt, Homo sapiens
caucaagacugcggugaac

SEQ ID NO: 87300 - RNA, 19 nt, Homo sapiens
ggcccuaggucgcuucucu

SEQ ID NO: 87301 - RNA, 19 nt, Homo sapiens
ucaauaaagcacugagcaa

SEQ ID NO: 87302 - RNA, 19 nt, Homo sapiens
ugacuuaaaggaugaugau

SEQ ID NO: 87303 - RNA, 19 nt, Homo sapiens
gagcagaaguggccuauau

SEQ ID NO: 87304 - RNA, 19 nt, Homo sapiens
cagaagagauuucagauga

SEQ ID NO: 87305 - RNA, 19 nt, Homo sapiens
ccagggagccuuaaacuua

SEQ ID NO: 87306 - RNA, 19 nt, Homo sapiens
gaaccaguauccugcauug

SEQ ID NO: 87307 - RNA, 19 nt, Homo sapiens
gaaacuugguggacaguga

SEQ ID NO: 87308 - RNA, 19 nt, Homo sapiens
aaagagagaugcaaugugu

SEQ ID NO: 87309 - RNA, 19 nt, Homo sapiens
ccacucagcuuaccacuuc

SEQ ID NO: 87310 - RNA, 19 nt, Homo sapiens
aggaagggcuuauguuuaa

SEQ ID NO: 87311 - RNA, 19 nt, Homo sapiens
gcagaaacccugagcagaa

SEQ ID NO: 87312 - RNA, 19 nt, Homo sapiens
cagcacagcuucuuuguag

SEQ ID NO: 87313 - RNA, 19 nt, Homo sapiens
gcucagaggccguaacuuu

SEQ ID NO: 87314 - RNA, 19 nt, Homo sapiens
ccagagcuauauauccuua

SEQ ID NO: 87315 - RNA, 19 nt, Homo sapiens
gcaaauuucuuggugauuc

SEQ ID NO: 87316 - RNA, 19 nt, Homo sapiens
gcauuuagcugggaugaau

SEQ ID NO: 87317 - RNA, 19 nt, Homo sapiens
ggagagagacacuuccuuu

SEQ ID NO: 87318 - RNA, 19 nt, Homo sapiens
gaacuccagugggcaaauu

SEQ ID NO: 87319 - RNA, 19 nt, Homo sapiens
gaacucuucucauccacaa

SEQ ID NO: 87320 - RNA, 19 nt, Homo sapiens
gagagagacacuuccuuua

SEQ ID NO: 87321 - RNA, 19 nt, Homo sapiens
gcauagagauuuguauugg

SEQ ID NO: 87322 - RNA, 19 nt, Homo sapiens
aggaagaacuguuuaacuu

SEQ ID NO: 87323 - RNA, 19 nt, Homo sapiens
ccaacaggcuaccaacuug

SEQ ID NO: 87324 - RNA, 19 nt, Homo sapiens
gccaaacccaagauuauua

SEQ ID NO: 87325 - RNA, 19 nt, Homo sapiens
gagaagaccaggcagaaga

SEQ ID NO: 87326 - RNA, 19 nt, Homo sapiens
gggcuuauguuuaaagaag

SEQ ID NO: 87327 - RNA, 19 nt, Homo sapiens
cuacggaacucuucucauc

SEQ ID NO: 87328 - RNA, 19 nt, Homo sapiens
cagaaacccugagcagaaa

SEQ ID NO: 87329 - RNA, 19 nt, Homo sapiens
caagagcguugucuaccuu

SEQ ID NO: 87330 - RNA, 19 nt, Homo sapiens
gggaauggauuagguuuca

SEQ ID NO: 87331 - RNA, 19 nt, Homo sapiens
acaggucucugaaccagua

SEQ ID NO: 87332 - RNA, 19 nt, Homo sapiens
caggaagggcuuauguuua

SEQ ID NO: 87333 - RNA, 19 nt, Homo sapiens
uaaaagaugucucugcaaa

SEQ ID NO: 87334 - RNA, 19 nt, Homo sapiens
gauugucgcuauccauaug

SEQ ID NO: 87335 - RNA, 19 nt, Homo sapiens
gguggacagugaaaugaaa

SEQ ID NO: 87336 - RNA, 19 nt, Homo sapiens
gacaacacaauaccagaua

SEQ ID NO: 87337 - RNA, 19 nt, Homo sapiens
accaagaucugaaguaugu

SEQ ID NO: 87338 - RNA, 19 nt, Homo sapiens
guaguucaucugcaaauaa

SEQ ID NO: 87339 - RNA, 19 nt, Homo sapiens
cacaauaccagauaaaguu

SEQ ID NO: 87340 - RNA, 19 nt, Homo sapiens
ccugaaagaucaagaagca

SEQ ID NO: 87341 - RNA, 19 nt, Homo sapiens
gaaguuccagggucugauu

SEQ ID NO: 87342 - RNA, 19 nt, Homo sapiens
ggaagggcuuauguuuaaa

SEQ ID NO: 87343 - RNA, 19 nt, Homo sapiens
caacacaauaccagauaaa

SEQ ID NO: 87344 - RNA, 19 nt, Homo sapiens
ugaaagaucaagaagcaaa

SEQ ID NO: 87345 - RNA, 19 nt, Homo sapiens
gagaugcaauguguaguuc

SEQ ID NO: 87346 - RNA, 19 nt, Homo sapiens
gaccagcaccuaaugaaau

SEQ ID NO: 87347 - RNA, 19 nt, Homo sapiens
ggaaacaccaagaucugaa

SEQ ID NO: 87348 - RNA, 19 nt, Homo sapiens
ucaggaagggcuuauguuu

SEQ ID NO: 87349 - RNA, 19 nt, Homo sapiens
aaaugacaauggaaacuug

SEQ ID NO: 87350 - RNA, 19 nt, Homo sapiens
ccaaacccaagauuauuaa

SEQ ID NO: 87351 - RNA, 19 nt, Homo sapiens
gccuuaaacuuauauaguc

SEQ ID NO: 87352 - RNA, 19 nt, Homo sapiens
cagggagccuuaaacuuau

SEQ ID NO: 87353 - RNA, 19 nt, Homo sapiens
gcaaaggugagcagaagug

SEQ ID NO: 87354 - RNA, 19 nt, Homo sapiens
gggcaaauuucuuggugau

SEQ ID NO: 87355 - RNA, 19 nt, Homo sapiens
ccucaugucuucucacaag

SEQ ID NO: 87356 - RNA, 19 nt, Homo sapiens
gagaauaaucaucguguuc

SEQ ID NO: 87357 - RNA, 19 nt, Homo sapiens
cuguuuaacuucuuucuga

SEQ ID NO: 87358 - RNA, 19 nt, Homo sapiens
acaccaagaucugaaguau

SEQ ID NO: 87359 - RNA, 19 nt, Homo sapiens
gaacaggccaagacugaag

SEQ ID NO: 87360 - RNA, 19 nt, Homo sapiens
gaaagagagaugcaaugug

SEQ ID NO: 87361 - RNA, 19 nt, Homo sapiens
acaacacaauaccagauaa

SEQ ID NO: 87362 - RNA, 19 nt, Homo sapiens
cagaugaauuaauggaguu

SEQ ID NO: 87363 - RNA, 19 nt, Homo sapiens
gcagaagagauuucagaug

SEQ ID NO: 87364 - RNA, 19 nt, Homo sapiens
gagcugcaaucuaguuaac

SEQ ID NO: 87365 - RNA, 19 nt, Homo sapiens
gaccguggccauagaaaga

SEQ ID NO: 87366 - RNA, 19 nt, Homo sapiens
ucagggaacucuggcauuc

SEQ ID NO: 87367 - RNA, 19 nt, Homo sapiens
ggacaacacaauaccagau

SEQ ID NO: 87368 - RNA, 19 nt, Homo sapiens
gaagcaaaggugagcagaa

SEQ ID NO: 87369 - RNA, 19 nt, Homo sapiens
ugaguugcauagagauuug

SEQ ID NO: 87370 - RNA, 19 nt, Homo sapiens
gcacagcuucuuuguagca

SEQ ID NO: 87371 - RNA, 19 nt, Homo sapiens
gcaagagcguugucuaccu

SEQ ID NO: 87372 - RNA, 19 nt, Homo sapiens
agaaacaguggcugccuua

SEQ ID NO: 87373 - RNA, 19 nt, Homo sapiens
ggacagugaaaugaaauau

SEQ ID NO: 87374 - RNA, 19 nt, Homo sapiens
guacuacccagagcuauau

SEQ ID NO: 87375 - RNA, 19 nt, Homo sapiens
gaauaaucaucguguucca

SEQ ID NO: 87376 - RNA, 19 nt, Homo sapiens
gaugcaauguguaguucau

SEQ ID NO: 87377 - RNA, 19 nt, Homo sapiens
guagcacuccgaaugguuu

SEQ ID NO: 87378 - RNA, 19 nt, Homo sapiens
gaaacuggucaccuggauu

SEQ ID NO: 87379 - RNA, 19 nt, Homo sapiens
acacauccagggagccuua

SEQ ID NO: 87380 - RNA, 19 nt, Homo sapiens
ugucauugauugucgcuau

SEQ ID NO: 87381 - RNA, 19 nt, Homo sapiens
cugcagaccuugaugaaac

SEQ ID NO: 87382 - RNA, 19 nt, Homo sapiens
caaauuucuuggugauucu

SEQ ID NO: 87383 - RNA, 19 nt, Homo sapiens
gagagacacuuccuuuacc

SEQ ID NO: 87384 - RNA, 19 nt, Homo sapiens
gaaacccugagcagaaaga

SEQ ID NO: 87385 - RNA, 19 nt, Homo sapiens
uacuuucucuccucuugua

SEQ ID NO: 87386 - RNA, 19 nt, Homo sapiens
uccgaucccuaucuacuuu

SEQ ID NO: 87387 - RNA, 19 nt, Homo sapiens
ggccaaacccaagauuauu

SEQ ID NO: 87388 - RNA, 19 nt, Homo sapiens
gggagcagauugcccuucu

SEQ ID NO: 87389 - RNA, 19 nt, Homo sapiens
ccaguauccugcauuguac

SEQ ID NO: 87390 - RNA, 19 nt, Homo sapiens
gccugcggcuguugauauu

SEQ ID NO: 87391 - RNA, 19 nt, Homo sapiens
agaagcccaucgucccuuu

SEQ ID NO: 87392 - RNA, 19 nt, Homo sapiens
gggaaacaccaagaucuga

SEQ ID NO: 87393 - RNA, 19 nt, Homo sapiens
guucaucugcaaauaaaga

SEQ ID NO: 87394 - RNA, 19 nt, Homo sapiens
uguaguucaucugcaaaua

SEQ ID NO: 87395 - RNA, 19 nt, Homo sapiens
ccagugggcaaauuucuug

SEQ ID NO: 87396 - RNA, 19 nt, Homo sapiens
gccuugaguugcauagaga

SEQ ID NO: 87397 - RNA, 19 nt, Homo sapiens
gaagggcuuauguuuaaag

SEQ ID NO: 87398 - RNA, 19 nt, Homo sapiens
aagcaaaggugagcagaag

SEQ ID NO: 87399 - RNA, 19 nt, Homo sapiens
uugucuaccuucuuucuuu

SEQ ID NO: 87400 - RNA, 19 nt, Homo sapiens
ggacacccagaagagaaua

SEQ ID NO: 87401 - RNA, 19 nt, Homo sapiens
gaaagaucaagaagcaaag

SEQ ID NO: 87402 - RNA, 19 nt, Homo sapiens
cuacagagacuucuuucca

SEQ ID NO: 87403 - RNA, 19 nt, Homo sapiens
gagcagaaguggccuauau

SEQ ID NO: 87404 - RNA, 19 nt, Homo sapiens
cagaagagauuucagauga

SEQ ID NO: 87405 - RNA, 19 nt, Homo sapiens
ccagggagccuuaaacuua

SEQ ID NO: 87406 - RNA, 19 nt, Homo sapiens
gaaccaguauccugcauug

SEQ ID NO: 87407 - RNA, 19 nt, Homo sapiens
gaaacuugguggacaguga

SEQ ID NO: 87408 - RNA, 19 nt, Homo sapiens
aggaagggcuuauguuuaa

SEQ ID NO: 87409 - RNA, 19 nt, Homo sapiens
gcagaaacccugagcagaa

SEQ ID NO: 87410 - RNA, 19 nt, Homo sapiens
gcucagaggccguaacuuu

SEQ ID NO: 87411 - RNA, 19 nt, Homo sapiens
ccagagcuauauauccuua

SEQ ID NO: 87412 - RNA, 19 nt, Homo sapiens
gcaaauuucuuggugauuc

SEQ ID NO: 87413 - RNA, 19 nt, Homo sapiens
ggagagagacacuuccuuu

SEQ ID NO: 87414 - RNA, 19 nt, Homo sapiens
gaacuccagugggcaaauu

SEQ ID NO: 87415 - RNA, 19 nt, Homo sapiens
gaacucuucucauccacaa

SEQ ID NO: 87416 - RNA, 19 nt, Homo sapiens
gagagagacacuuccuuua

SEQ ID NO: 87417 - RNA, 19 nt, Homo sapiens
ggaugacaauggaaacuug

SEQ ID NO: 87418 - RNA, 19 nt, Homo sapiens
gcauagagauuuguauugg

SEQ ID NO: 87419 - RNA, 19 nt, Homo sapiens
aggaagaacuguuuaacuu

SEQ ID NO: 87420 - RNA, 19 nt, Homo sapiens
gcauuuagcugggaugaca

SEQ ID NO: 87421 - RNA, 19 nt, Homo sapiens
ccaacaggcuaccaacuug

SEQ ID NO: 87422 - RNA, 19 nt, Homo sapiens
gccaaacccaagauuauua

SEQ ID NO: 87423 - RNA, 19 nt, Homo sapiens
gagaagaccaggcagaaga

SEQ ID NO: 87424 - RNA, 19 nt, Homo sapiens
gggcuuauguuuaaagaag

SEQ ID NO: 87425 - RNA, 19 nt, Homo sapiens
cuacggaacucuucucauc

SEQ ID NO: 87426 - RNA, 19 nt, Homo sapiens
cagaaacccugagcagaaa

SEQ ID NO: 87427 - RNA, 19 nt, Homo sapiens
caagagcguugucuaccuu

SEQ ID NO: 87428 - RNA, 19 nt, Homo sapiens
gggaauggauuagguuuca

SEQ ID NO: 87429 - RNA, 19 nt, Homo sapiens
acaggucucugaaccagua

SEQ ID NO: 87430 - RNA, 19 nt, Homo sapiens
caggaagggcuuauguuua

SEQ ID NO: 87431 - RNA, 19 nt, Homo sapiens
uaaaagaugucucugcaaa

SEQ ID NO: 87432 - RNA, 19 nt, Homo sapiens
gauugucgcuauccauaug

SEQ ID NO: 87433 - RNA, 19 nt, Homo sapiens
gguggacagugaaaugaaa

SEQ ID NO: 87434 - RNA, 19 nt, Homo sapiens
gacaacacaauaccagaua

SEQ ID NO: 87435 - RNA, 19 nt, Homo sapiens
accaagaucugaaguaugu

SEQ ID NO: 87436 - RNA, 19 nt, Homo sapiens
cacaauaccagauaaaguu

SEQ ID NO: 87437 - RNA, 19 nt, Homo sapiens
ccugaaagaucaagaagca

SEQ ID NO: 87438 - RNA, 19 nt, Homo sapiens
gaaguuccagggucugauu

SEQ ID NO: 87439 - RNA, 19 nt, Homo sapiens
ggaagggcuuauguuuaaa

SEQ ID NO: 87440 - RNA, 19 nt, Homo sapiens
caacacaauaccagauaaa

SEQ ID NO: 87441 - RNA, 19 nt, Homo sapiens
ugaaagaucaagaagcaaa

SEQ ID NO: 87442 - RNA, 19 nt, Homo sapiens
ggaaacaccaagaucugaa

SEQ ID NO: 87443 - RNA, 19 nt, Homo sapiens
ucaggaagggcuuauguuu

SEQ ID NO: 87444 - RNA, 19 nt, Homo sapiens
ccaaacccaagauuauuaa

SEQ ID NO: 87445 - RNA, 19 nt, Homo sapiens
gccuuaaacuuauauaguc

SEQ ID NO: 87446 - RNA, 19 nt, Homo sapiens
cagggagccuuaaacuuau

SEQ ID NO: 87447 - RNA, 19 nt, Homo sapiens
gcaaaggugagcagaagug

SEQ ID NO: 87448 - RNA, 19 nt, Homo sapiens
gggcaaauuucuuggugau

SEQ ID NO: 87449 - RNA, 19 nt, Homo sapiens
ccucaugucuucucacaag

SEQ ID NO: 87450 - RNA, 19 nt, Homo sapiens
gagaauaaucaucguguuc

SEQ ID NO: 87451 - RNA, 19 nt, Homo sapiens
cuguuuaacuucuuucuga

SEQ ID NO: 87452 - RNA, 19 nt, Homo sapiens
acaccaagaucugaaguau

SEQ ID NO: 87453 - RNA, 19 nt, Homo sapiens
gaacaggccaagacugaag

SEQ ID NO: 87454 - RNA, 19 nt, Homo sapiens
acaacacaauaccagauaa

SEQ ID NO: 87455 - RNA, 19 nt, Homo sapiens
cagaugaauuaauggaguu

SEQ ID NO: 87456 - RNA, 19 nt, Homo sapiens
gcagaagagauuucagaug

SEQ ID NO: 87457 - RNA, 19 nt, Homo sapiens
gagcugcaaucuaguuaac

SEQ ID NO: 87458 - RNA, 19 nt, Homo sapiens
ucagggaacucuggcauuc

SEQ ID NO: 87459 - RNA, 19 nt, Homo sapiens
ggacaacacaauaccagau

SEQ ID NO: 87460 - RNA, 19 nt, Homo sapiens
gaagcaaaggugagcagaa

SEQ ID NO: 87461 - RNA, 19 nt, Homo sapiens
ugaguugcauagagauuug

SEQ ID NO: 87462 - RNA, 19 nt, Homo sapiens
gcaagagcguugucuaccu

SEQ ID NO: 87463 - RNA, 19 nt, Homo sapiens
agaaacaguggcugccuua

SEQ ID NO: 87464 - RNA, 19 nt, Homo sapiens
ggacagugaaaugaaauau

SEQ ID NO: 87465 - RNA, 19 nt, Homo sapiens
uagcugggaugacaaugga

SEQ ID NO: 87466 - RNA, 19 nt, Homo sapiens
guacuacccagagcuauau

SEQ ID NO: 87467 - RNA, 19 nt, Homo sapiens
gaauaaucaucguguucca

SEQ ID NO: 87468 - RNA, 19 nt, Homo sapiens
acacauccagggagccuua

SEQ ID NO: 87469 - RNA, 19 nt, Homo sapiens
ugucauugauugucgcuau

SEQ ID NO: 87470 - RNA, 19 nt, Homo sapiens
caaauuucuuggugauucu

SEQ ID NO: 87471 - RNA, 19 nt, Homo sapiens
gagagacacuuccuuuacc

SEQ ID NO: 87472 - RNA, 19 nt, Homo sapiens
gaaacccugagcagaaaga

SEQ ID NO: 87473 - RNA, 19 nt, Homo sapiens
uacuuucucuccucuugua

SEQ ID NO: 87474 - RNA, 19 nt, Homo sapiens
uccgaucccuaucuacuuu

SEQ ID NO: 87475 - RNA, 19 nt, Homo sapiens
ggccaaacccaagauuauu

SEQ ID NO: 87476 - RNA, 19 nt, Homo sapiens
gggagcagauugcccuucu

SEQ ID NO: 87477 - RNA, 19 nt, Homo sapiens
ccaguauccugcauuguac

SEQ ID NO: 87478 - RNA, 19 nt, Homo sapiens
gccugcggcuguugauauu

SEQ ID NO: 87479 - RNA, 19 nt, Homo sapiens
agaagcccaucgucccuuu

SEQ ID NO: 87480 - RNA, 19 nt, Homo sapiens
gggaaacaccaagaucuga

SEQ ID NO: 87481 - RNA, 19 nt, Homo sapiens
ccagugggcaaauuucuug

SEQ ID NO: 87482 - RNA, 19 nt, Homo sapiens
gccuugaguugcauagaga

SEQ ID NO: 87483 - RNA, 19 nt, Homo sapiens
gaagggcuuauguuuaaag

SEQ ID NO: 87484 - RNA, 19 nt, Homo sapiens
aagcaaaggugagcagaag

SEQ ID NO: 87485 - RNA, 19 nt, Homo sapiens
uugucuaccuucuuucuuu

SEQ ID NO: 87486 - RNA, 19 nt, Homo sapiens
ggacacccagaagagaaua

SEQ ID NO: 87487 - RNA, 19 nt, Homo sapiens
gaaagaucaagaagcaaag

SEQ ID NO: 87488 - RNA, 19 nt, Homo sapiens
cuacagagacuucuuucca

SEQ ID NO: 87489 - RNA, 19 nt, Homo sapiens
gaaguaugucaacccagaa

SEQ ID NO: 87490 - RNA, 19 nt, Homo sapiens
gaaacaccaagaucugaag

SEQ ID NO: 87491 - RNA, 19 nt, Homo sapiens
gcucaggaagggcuuaugu

SEQ ID NO: 87492 - RNA, 19 nt, Homo sapiens
ucugcaaaccuaagcauuu

SEQ ID NO: 87493 - RNA, 19 nt, Homo sapiens
agaugucucugcaaaccaa

SEQ ID NO: 87494 - RNA, 19 nt, Homo sapiens
agagaauaaucaucguguu

SEQ ID NO: 87495 - RNA, 19 nt, Homo sapiens
uccagggucugauugagaa

SEQ ID NO: 87496 - RNA, 19 nt, Homo sapiens
uagauuuccuuucauucug

SEQ ID NO: 87497 - RNA, 19 nt, Homo sapiens
cagagcugcaaucuaguua

SEQ ID NO: 87498 - RNA, 19 nt, Homo sapiens
ucauucugcucaagucuuc

SEQ ID NO: 87499 - RNA, 19 nt, Homo sapiens
caaaccaacaggcuaccaa

SEQ ID NO: 87500 - RNA, 19 nt, Homo sapiens
gcuacugcccuaugcauca

SEQ ID NO: 87501 - RNA, 19 nt, Homo sapiens
caagaucugaaguauguca

SEQ ID NO: 87502 - RNA, 19 nt, Homo sapiens
gacauuacuaucacucaga

SEQ ID NO: 87503 - RNA, 19 nt, Homo sapiens
gaaaggcagugcaauauuu

SEQ ID NO: 87504 - RNA, 19 nt, Homo sapiens
uaacugaccuucauuucua

SEQ ID NO: 87505 - RNA, 19 nt, Homo sapiens
ggaaauagccgagagguaa

SEQ ID NO: 87506 - RNA, 19 nt, Homo sapiens
ccagagagcuauccaaguu

SEQ ID NO: 87507 - RNA, 19 nt, Homo sapiens
gcaagaaugcuuuaaugua

SEQ ID NO: 87508 - RNA, 19 nt, Homo sapiens
caugcaagcugaaagaaua

SEQ ID NO: 87509 - RNA, 19 nt, Homo sapiens
caagaacccucuaugcaaa

SEQ ID NO: 87510 - RNA, 19 nt, Homo sapiens
gaaggaagaguuaugcuuu

SEQ ID NO: 87511 - RNA, 19 nt, Homo sapiens
ggacauguauauugcaaga

SEQ ID NO: 87512 - RNA, 19 nt, Homo sapiens
caaaagagccuuaguuuaa

SEQ ID NO: 87513 - RNA, 19 nt, Homo sapiens
uaaaagacguugccuauaa

SEQ ID NO: 87514 - RNA, 19 nt, Homo sapiens
uaggaaagguuuacaagaa

SEQ ID NO: 87515 - RNA, 19 nt, Homo sapiens
caacacaaguaccuaauca

SEQ ID NO: 87516 - RNA, 19 nt, Homo sapiens
ggagauggauccuauuuac

SEQ ID NO: 87517 - RNA, 19 nt, Homo sapiens
aaucaaauaucccuccaua

SEQ ID NO: 87518 - RNA, 19 nt, Homo sapiens
gaaaagccaugaugauauu

SEQ ID NO: 87519 - RNA, 19 nt, Homo sapiens
gaagaguuaugcuuuaucu

SEQ ID NO: 87520 - RNA, 19 nt, Homo sapiens
gaaggaaccauuagauaug

SEQ ID NO: 87521 - RNA, 19 nt, Homo sapiens
aaugauagccuggaaauua

SEQ ID NO: 87522 - RNA, 19 nt, Homo sapiens
gcuguaauuucaccugaua

SEQ ID NO: 87523 - RNA, 19 nt, Homo sapiens
ccaaagaaucccucguuua

SEQ ID NO: 87524 - RNA, 19 nt, Homo sapiens
ccaauaaccagauuaaaga

SEQ ID NO: 87525 - RNA, 19 nt, Homo sapiens
gauaucaacccucaaaguu

SEQ ID NO: 87526 - RNA, 19 nt, Homo sapiens
ucacagagccucaguuuua

SEQ ID NO: 87527 - RNA, 19 nt, Homo sapiens
gccaauaacccaagaagaa

SEQ ID NO: 87528 - RNA, 19 nt, Homo sapiens
uaagucugcuuuacaagaa

SEQ ID NO: 87529 - RNA, 19 nt, Homo sapiens
ggaacaugauauugcaauu

SEQ ID NO: 87530 - RNA, 19 nt, Homo sapiens
ucacgacucuuuacuagug

SEQ ID NO: 87531 - RNA, 19 nt, Homo sapiens
gcacaacacaaguaccuaa

SEQ ID NO: 87532 - RNA, 19 nt, Homo sapiens
uaaagcauauagacucuug

SEQ ID NO: 87533 - RNA, 19 nt, Homo sapiens
gacuagugcugacguguuu

SEQ ID NO: 87534 - RNA, 19 nt, Homo sapiens
gcauggagaucuacucuac

SEQ ID NO: 87535 - RNA, 19 nt, Homo sapiens
gauccugaccaaacauuua

SEQ ID NO: 87536 - RNA, 19 nt, Homo sapiens
gaaaggcauauaaagcaua

SEQ ID NO: 87537 - RNA, 19 nt, Homo sapiens
gaguuaugcuuuaucuuga

SEQ ID NO: 87538 - RNA, 19 nt, Homo sapiens
gaucuacucuacaacacuu

SEQ ID NO: 87539 - RNA, 19 nt, Homo sapiens
gaaguacacucagaagaag

SEQ ID NO: 87540 - RNA, 19 nt, Homo sapiens
aaaugaaguuuccaccuaa

SEQ ID NO: 87541 - RNA, 19 nt, Homo sapiens
gaacaaagucugucuucuc

SEQ ID NO: 87542 - RNA, 19 nt, Homo sapiens
gaugaucucccauaaacaa

SEQ ID NO: 87543 - RNA, 19 nt, Homo sapiens
aaggaagaguuaugcuuua

SEQ ID NO: 87544 - RNA, 19 nt, Homo sapiens
gcacuaaaccacuaugcuu

SEQ ID NO: 87545 - RNA, 19 nt, Homo sapiens
aaauuacgcuuaugccuau

SEQ ID NO: 87546 - RNA, 19 nt, Homo sapiens
caaagucugucuucucaca

SEQ ID NO: 87547 - RNA, 19 nt, Homo sapiens
caaagaaucccucguuuac

SEQ ID NO: 87548 - RNA, 19 nt, Homo sapiens
gaaaugcuaucagagucaa

SEQ ID NO: 87549 - RNA, 19 nt, Homo sapiens
gauggauccuauuuacaaa

SEQ ID NO: 87550 - RNA, 19 nt, Homo sapiens
ugauucagcuguaauuuca

SEQ ID NO: 87551 - RNA, 19 nt, Homo sapiens
acacaaguaccuaaucaua

SEQ ID NO: 87552 - RNA, 19 nt, Homo sapiens
ucagcuugcuuuacucuuu

SEQ ID NO: 87553 - RNA, 19 nt, Homo sapiens
ggaaaggcauauaaagcau

SEQ ID NO: 87554 - RNA, 19 nt, Homo sapiens
aagaaucccucguuuacuu

SEQ ID NO: 87555 - RNA, 19 nt, Homo sapiens
gggcaugaguuugucuuaa

SEQ ID NO: 87556 - RNA, 19 nt, Homo sapiens
uuacagaacuuuagcaacu

SEQ ID NO: 87557 - RNA, 19 nt, Homo sapiens
gcauauagacucuugaaag

SEQ ID NO: 87558 - RNA, 19 nt, Homo sapiens
ucaaauaucccuccauaca

SEQ ID NO: 87559 - RNA, 19 nt, Homo sapiens
ggaaagguuuacaagaagu

SEQ ID NO: 87560 - RNA, 19 nt, Homo sapiens
uaucaacccucaaaguuca

SEQ ID NO: 87561 - RNA, 19 nt, Homo sapiens
uauaaugcaugguaugguu

SEQ ID NO: 87562 - RNA, 19 nt, Homo sapiens
agaauuggacaaagcauua

SEQ ID NO: 87563 - RNA, 19 nt, Homo sapiens
ggcaagcacuaaaccacua

SEQ ID NO: 87564 - RNA, 19 nt, Homo sapiens
guauugagccccacuauua

SEQ ID NO: 87565 - RNA, 19 nt, Homo sapiens
ccaaaggaucagaauguua

SEQ ID NO: 87566 - RNA, 19 nt, Homo sapiens
gcucaggaaaggcauauaa

SEQ ID NO: 87567 - RNA, 19 nt, Homo sapiens
ggacucguauguaggaauc

SEQ ID NO: 87568 - RNA, 19 nt, Homo sapiens
ccacuaugcuuaccgagau

SEQ ID NO: 87569 - RNA, 19 nt, Homo sapiens
gaauuucucuugggcuaug

SEQ ID NO: 87570 - RNA, 19 nt, Homo sapiens
cgaagaaguucacgacucu

SEQ ID NO: 87571 - RNA, 19 nt, Homo sapiens
agagguaacuccaauucuu

SEQ ID NO: 87572 - RNA, 19 nt, Homo sapiens
gcuuuacucuuucauuguu

SEQ ID NO: 87573 - RNA, 19 nt, Homo sapiens
gaucucccauaaacaaaug

SEQ ID NO: 87574 - RNA, 19 nt, Homo sapiens
ugaaggaaccauuagauau

SEQ ID NO: 87575 - RNA, 19 nt, Homo sapiens
uaucaugaaggaagaguua

SEQ ID NO: 87576 - RNA, 19 nt, Homo sapiens
gcuuaugccuauacucuau

SEQ ID NO: 87577 - RNA, 19 nt, Homo sapiens
cauauagacucuugaaagg

SEQ ID NO: 87578 - RNA, 19 nt, Homo sapiens
caaauguaaugggcauauu

SEQ ID NO: 87579 - RNA, 19 nt, Homo sapiens
cagaguaacugaccuucau

SEQ ID NO: 87580 - RNA, 19 nt, Homo sapiens
ggaacuuucuuuucuguuu

SEQ ID NO: 87581 - RNA, 19 nt, Homo sapiens
gagccaauaaccagauuaa

SEQ ID NO: 87582 - RNA, 19 nt, Homo sapiens
ccaagaacccucuaugcaa

SEQ ID NO: 87583 - RNA, 19 nt, Homo sapiens
caacugcaaagaagcuaua

SEQ ID NO: 87584 - RNA, 19 nt, Homo sapiens
gggaaaauauccacaauca

SEQ ID NO: 87585 - RNA, 19 nt, Homo sapiens
ggaggaauaacucaaccua

SEQ ID NO: 87586 - RNA, 19 nt, Homo sapiens
acaaguaccuaaucauagu

SEQ ID NO: 87587 - RNA, 19 nt, Homo sapiens
gcaacugucugcccaacuc

SEQ ID NO: 87588 - RNA, 19 nt, Homo sapiens
uggcaagaaugcuuuaaug

SEQ ID NO: 87589 - RNA, 19 nt, Homo sapiens
gagucaauccuagacauua

SEQ ID NO: 87590 - RNA, 19 nt, Homo sapiens
guucacgacucuuuacuag

SEQ ID NO: 87591 - RNA, 19 nt, Homo sapiens
cagcagcucuuaguccauu

SEQ ID NO: 87592 - RNA, 19 nt, Homo sapiens
gcccaacucuugcacaaca

SEQ ID NO: 87593 - RNA, 19 nt, Homo sapiens
cuauaacagugacuugauu

SEQ ID NO: 87594 - RNA, 19 nt, Homo sapiens
gagagcagcaugacagaug

SEQ ID NO: 87595 - RNA, 19 nt, Homo sapiens
gcaacgggaacaugauauu

SEQ ID NO: 87596 - RNA, 19 nt, Homo sapiens
guacaugcaagcugaaaga

SEQ ID NO: 87597 - RNA, 19 nt, Homo sapiens
gggaaagguuauuuagcuu

SEQ ID NO: 87598 - RNA, 19 nt, Homo sapiens
gaaaauauccacaaucaca

SEQ ID NO: 87599 - RNA, 19 nt, Homo sapiens
ggaucagaauguuaccaaa

SEQ ID NO: 87600 - RNA, 19 nt, Homo sapiens
ugccaaggaauguaaauua

SEQ ID NO: 87601 - RNA, 19 nt, Homo sapiens
gaacagaucaugggaacag

SEQ ID NO: 87602 - RNA, 19 nt, Homo sapiens
uacaagaaguuaggucaaa

SEQ ID NO: 87603 - RNA, 19 nt, Homo sapiens
gcucagaccucuucuacga

SEQ ID NO: 87604 - RNA, 19 nt, Homo sapiens
gagcugagcccgacuucua

SEQ ID NO: 87605 - RNA, 19 nt, Homo sapiens
gcacagaguggacggauuc

SEQ ID NO: 87606 - RNA, 19 nt, Homo sapiens
ggaccauucuccugagugu

SEQ ID NO: 87607 - RNA, 19 nt, Homo sapiens
ggacgagggcgaucuauac

SEQ ID NO: 87608 - RNA, 19 nt, Homo sapiens
ccaugucuguucuggguuu

SEQ ID NO: 87609 - RNA, 19 nt, Homo sapiens
uacaggaaguggaaagaga

SEQ ID NO: 87610 - RNA, 19 nt, Homo sapiens
ccugacaccaccagaauaa

SEQ ID NO: 87611 - RNA, 19 nt, Homo sapiens
gaucgggaguacacagaca

SEQ ID NO: 87612 - RNA, 19 nt, Homo sapiens
ugaacgagcccaacaccuu

SEQ ID NO: 87613 - RNA, 19 nt, Homo sapiens
ggaguacacagacaucauc

SEQ ID NO: 87614 - RNA, 19 nt, Homo sapiens
cgagggcgaucuauacaac

SEQ ID NO: 87615 - RNA, 19 nt, Homo sapiens
ggaaguggaaagagagcaa

SEQ ID NO: 87616 - RNA, 19 nt, Homo sapiens
ggaaggaucgggaguacac

SEQ ID NO: 87617 - RNA, 19 nt, Homo sapiens
ucaaggggcugcaggaaga

SEQ ID NO: 87618 - RNA, 19 nt, Homo sapiens
gcuuugguuuguuugaaau

SEQ ID NO: 87619 - RNA, 19 nt, Homo sapiens
cgucuccucugguuguuuc

SEQ ID NO: 87620 - RNA, 19 nt, Homo sapiens
ucccugcuuugguuuguuu

SEQ ID NO: 87621 - RNA, 19 nt, Homo sapiens
gggcucagaccucuucuac

SEQ ID NO: 87622 - RNA, 19 nt, Homo sapiens
aagagccggucgagggauu

SEQ ID NO: 87623 - RNA, 19 nt, Homo sapiens
ggacgaugaggaugacucu

SEQ ID NO: 87624 - RNA, 19 nt, Homo sapiens
gcagaacgucaggaccauu

SEQ ID NO: 87625 - RNA, 19 nt, Homo sapiens
ucaccguggccgacucuuu

SEQ ID NO: 87626 - RNA, 19 nt, Homo sapiens
cagaacgucaggaccauuc

SEQ ID NO: 87627 - RNA, 19 nt, Homo sapiens
gccgaguacugcgugaaga

SEQ ID NO: 87628 - RNA, 19 nt, Homo sapiens
ccuccgugauguacaggaa

SEQ ID NO: 87629 - RNA, 19 nt, Homo sapiens
ugaucucccuccugaacga

SEQ ID NO: 87630 - RNA, 19 nt, Homo sapiens
acugggagguggccaucuu

SEQ ID NO: 87631 - RNA, 19 nt, Homo sapiens
gacgagggcgaucuauaca

SEQ ID NO: 87632 - RNA, 19 nt, Homo sapiens
ccaagauguggcacccuaa

SEQ ID NO: 87633 - RNA, 19 nt, Homo sapiens
cuccuuagacgacagacua

SEQ ID NO: 87634 - RNA, 19 nt, Homo sapiens
ugacaccaccagaauaaac

SEQ ID NO: 87635 - RNA, 19 nt, Homo sapiens
gguggacgagggcgaucua

SEQ ID NO: 87636 - RNA, 19 nt, Homo sapiens
uggacgagggcgaucuaua

SEQ ID NO: 87637 - RNA, 19 nt, Homo sapiens
ggacgccuccgugauguac

SEQ ID NO: 87638 - RNA, 19 nt, Homo sapiens
gcaagaggauuaugacaga

SEQ ID NO: 87639 - RNA, 19 nt, Homo sapiens
ggagaacacuuaacaacau

SEQ ID NO: 87640 - RNA, 19 nt, Homo sapiens
gaaaugcaccaaaugaauu

SEQ ID NO: 87641 - RNA, 19 nt, Homo sapiens
gaggcucucuaguuuaaua

SEQ ID NO: 87642 - RNA, 19 nt, Homo sapiens
ucucaugucucaauucuuu

SEQ ID NO: 87643 - RNA, 19 nt, Homo sapiens
ggacauuuguuugccauuu

SEQ ID NO: 87644 - RNA, 19 nt, Homo sapiens
ggagaaccauauacucuug

SEQ ID NO: 87645 - RNA, 19 nt, Homo sapiens
gugaggcucucuaguuuaa

SEQ ID NO: 87646 - RNA, 19 nt, Homo sapiens
gaauauguaccgacuguuu

SEQ ID NO: 87647 - RNA, 19 nt, Homo sapiens
aaacaugucuccugauauc

SEQ ID NO: 87648 - RNA, 19 nt, Homo sapiens
uugaguagauccaguauuu

SEQ ID NO: 87649 - RNA, 19 nt, Homo sapiens
agacucuucuuaaguguua

SEQ ID NO: 87650 - RNA, 19 nt, Homo sapiens
gaaccaaugcuuucucaug

SEQ ID NO: 87651 - RNA, 19 nt, Homo sapiens
agacaucuguggaaugauu

SEQ ID NO: 87652 - RNA, 19 nt, Homo sapiens
gaagaccuguuauguagag

SEQ ID NO: 87653 - RNA, 19 nt, Homo sapiens
ucaaguauguggaguguuc

SEQ ID NO: 87654 - RNA, 19 nt, Homo sapiens
agaaaggccuaaagaaugu

SEQ ID NO: 87655 - RNA, 19 nt, Homo sapiens
ccugaaggcugucaaguau

SEQ ID NO: 87656 - RNA, 19 nt, Homo sapiens
uaaaacaugucuccugaua

SEQ ID NO: 87657 - RNA, 19 nt, Homo sapiens
gaauguauuugacgaagca

SEQ ID NO: 87658 - RNA, 19 nt, Homo sapiens
gagacaaggcccauaggua

SEQ ID NO: 87659 - RNA, 19 nt, Homo sapiens
gcugaagaccuguuaugua

SEQ ID NO: 87660 - RNA, 19 nt, Homo sapiens
cagaaaggccuaaagaaug

SEQ ID NO: 87661 - RNA, 19 nt, Homo sapiens
gauggaggccugcuucauu

SEQ ID NO: 87662 - RNA, 19 nt, Homo sapiens
gaaggaguauaguaaaugc

SEQ ID NO: 87663 - RNA, 19 nt, Homo sapiens
gauuacgaccgcugaguua

SEQ ID NO: 87664 - RNA, 19 nt, Homo sapiens
gagaacacuuaacaacaug

SEQ ID NO: 87665 - RNA, 19 nt, Homo sapiens
cugaagaccuguuauguag

SEQ ID NO: 87666 - RNA, 19 nt, Homo sapiens
gaguagauccaguauuuga

SEQ ID NO: 87667 - RNA, 19 nt, Homo sapiens
ggaggaggacggauugauu

SEQ ID NO: 87668 - RNA, 19 nt, Homo sapiens
agaggauuaugacagauua

SEQ ID NO: 87669 - RNA, 19 nt, Homo sapiens
ugaaggcugucaaguaugu

SEQ ID NO: 87670 - RNA, 19 nt, Homo sapiens
guagaugcauuaguguuga

SEQ ID NO: 87671 - RNA, 19 nt, Homo sapiens
gauccaguauuugaugaaa

SEQ ID NO: 87672 - RNA, 19 nt, Homo sapiens
cagcaaugcagacaauuaa

SEQ ID NO: 87673 - RNA, 19 nt, Homo sapiens
gacauuuguuugccauuug

SEQ ID NO: 87674 - RNA, 19 nt, Homo sapiens
ggaaggaguauaguaaaug

SEQ ID NO: 87675 - RNA, 19 nt, Homo sapiens
guaacagacuaauuggaau

SEQ ID NO: 87676 - RNA, 19 nt, Homo sapiens
gcauuaguguugaaccaau

SEQ ID NO: 87677 - RNA, 19 nt, Homo sapiens
auggaggccugcuucauua

SEQ ID NO: 87678 - RNA, 19 nt, Homo sapiens
agacaaggcccauagguau

SEQ ID NO: 87679 - RNA, 19 nt, Homo sapiens
gaggccugcuucauuaaga

SEQ ID NO: 87680 - RNA, 19 nt, Homo sapiens
gaaaacauguuccccaucu

SEQ ID NO: 87681 - RNA, 19 nt, Homo sapiens
gcuuguggaugacucugua

SEQ ID NO: 87682 - RNA, 19 nt, Homo sapiens
ucagcaaugcagacaauua

SEQ ID NO: 87683 - RNA, 19 nt, Homo sapiens
cgauggugcuguugguaaa

SEQ ID NO: 87684 - RNA, 19 nt, Homo sapiens
guauugcaccuuugaaaug

SEQ ID NO: 87685 - RNA, 19 nt, Homo sapiens
ucccaguacuaguuaauuu

SEQ ID NO: 87686 - RNA, 19 nt, Homo sapiens
gcagucacaguuaugauug

SEQ ID NO: 87687 - RNA, 19 nt, Homo sapiens
uaaugcagacucuucuuaa

SEQ ID NO: 87688 - RNA, 19 nt, Homo sapiens
gaggucaucaucagauuug

SEQ ID NO: 87689 - RNA, 19 nt, Homo sapiens
gucauugucuuauaugcuu

SEQ ID NO: 87690 - RNA, 19 nt, Homo sapiens
gcaaugcagacaauuaagu

SEQ ID NO: 87691 - RNA, 19 nt, Homo sapiens
acagaaaggccuaaagaau

SEQ ID NO: 87692 - RNA, 19 nt, Homo sapiens
gaugaccccucuacuauug

SEQ ID NO: 87693 - RNA, 19 nt, Homo sapiens
ccgcugaguuauccacaaa

SEQ ID NO: 87694 - RNA, 19 nt, Homo sapiens
uauaugguguuccuagaau

SEQ ID NO: 87695 - RNA, 19 nt, Homo sapiens
gauuugcagcucaguagua

SEQ ID NO: 87696 - RNA, 19 nt, Homo sapiens
uuaggaaggaguauaguaa

SEQ ID NO: 87697 - RNA, 19 nt, Homo sapiens
acacagaaaggccuaaaga

SEQ ID NO: 87698 - RNA, 19 nt, Homo sapiens
ucaguggucucuccaucuu

SEQ ID NO: 87699 - RNA, 19 nt, Homo sapiens
uuaaugcagacucuucuua

SEQ ID NO: 87700 - RNA, 19 nt, Homo sapiens
gaccuguuauguagaggaa

SEQ ID NO: 87701 - RNA, 19 nt, Homo sapiens
ugaaaugcaccaaaugaau

SEQ ID NO: 87702 - RNA, 19 nt, Homo sapiens
cggaauauguaccgacugu

SEQ ID NO: 87703 - RNA, 19 nt, Homo sapiens
aaccaaugcuuucucaugu

SEQ ID NO: 87704 - RNA, 19 nt, Homo sapiens
ggugaggcucucuaguuua

SEQ ID NO: 87705 - RNA, 19 nt, Homo sapiens
ggaauccccuuauuucugu

SEQ ID NO: 87706 - RNA, 19 nt, Homo sapiens
gaggaggacggauugauuc

SEQ ID NO: 87707 - RNA, 19 nt, Homo sapiens
gcugaguuauccacaaaca

SEQ ID NO: 87708 - RNA, 19 nt, Homo sapiens
caggugaggcucucuaguu

SEQ ID NO: 87709 - RNA, 19 nt, Homo sapiens
ggugucggcaucauacuaa

SEQ ID NO: 87710 - RNA, 19 nt, Homo sapiens
acucaccacuguccaaaga

SEQ ID NO: 87711 - RNA, 19 nt, Homo sapiens
gcagacucuucuuaagugu

SEQ ID NO: 87712 - RNA, 19 nt, Homo sapiens
aggugaggcucucuaguuu

SEQ ID NO: 87713 - RNA, 19 nt, Homo sapiens
gcagcucaguaguauaugg

SEQ ID NO: 87714 - RNA, 19 nt, Homo sapiens
cuaacuucuuucacugaua

SEQ ID NO: 87715 - RNA, 19 nt, Homo sapiens
gccuaaagaauguauuuga

SEQ ID NO: 87716 - RNA, 19 nt, Homo sapiens
acagauguauuucuagucu

SEQ ID NO: 87717 - RNA, 19 nt, Homo sapiens
ugaguuauccacaaacaga

SEQ ID NO: 87718 - RNA, 19 nt, Homo sapiens
gggagaacacuuaacaaca

SEQ ID NO: 87719 - RNA, 19 nt, Homo sapiens
uauaugugacugugacuuu

SEQ ID NO: 87720 - RNA, 19 nt, Homo sapiens
guagauccaguauuugaug

SEQ ID NO: 87721 - RNA, 19 nt, Homo sapiens
uguaacagacuaauuggaa

SEQ ID NO: 87722 - RNA, 19 nt, Homo sapiens
gaguaauuguauugucaga

SEQ ID NO: 87723 - RNA, 19 nt, Homo sapiens
gcgauggugcuguugguaa

SEQ ID NO: 87724 - RNA, 19 nt, Homo sapiens
ccaaugcuuucucaugucu

SEQ ID NO: 87725 - RNA, 19 nt, Homo sapiens
ucuuguagaugcauuagug

SEQ ID NO: 87726 - RNA, 19 nt, Homo sapiens
ugguugcaguuuccaauuu

SEQ ID NO: 87727 - RNA, 19 nt, Homo sapiens
caccaaaugaauugaguuu

SEQ ID NO: 87728 - RNA, 19 nt, Homo sapiens
cugcagggcaagaggauua

SEQ ID NO: 87729 - RNA, 19 nt, Homo sapiens
uggagaagcugaggucauc

SEQ ID NO: 87730 - RNA, 19 nt, Homo sapiens
gcagacaauuaaguguguu

SEQ ID NO: 87731 - RNA, 19 nt, Homo sapiens
ucccaaaccuaauucuugu

SEQ ID NO: 87732 - RNA, 19 nt, Homo sapiens
guauaugguguuccuagaa

SEQ ID NO: 87733 - RNA, 19 nt, Homo sapiens
uagauccaguauuugauga

SEQ ID NO: 87734 - RNA, 19 nt, Homo sapiens
aguaaucugggacaucuua

SEQ ID NO: 87735 - RNA, 19 nt, Homo sapiens
gagaugaccccucuacuau

SEQ ID NO: 87736 - RNA, 19 nt, Homo sapiens
caaaccuaauucuuguaga

SEQ ID NO: 87737 - RNA, 19 nt, Homo sapiens
ugcagacucuucuuaagug

SEQ ID NO: 87738 - RNA, 19 nt, Homo sapiens
gaagugcuguauauucuaa

SEQ ID NO: 87739 - RNA, 19 nt, Homo sapiens
gcaagaggauuaugacaga

SEQ ID NO: 87740 - RNA, 19 nt, Homo sapiens
gaaaaggggugaccuagua

SEQ ID NO: 87741 - RNA, 19 nt, Homo sapiens
gaaaguaacacaaacauca

SEQ ID NO: 87742 - RNA, 19 nt, Homo sapiens
ugaagaauguguuugauga

SEQ ID NO: 87743 - RNA, 19 nt, Homo sapiens
ggagaaccauauacucuug

SEQ ID NO: 87744 - RNA, 19 nt, Homo sapiens
gaucaagaauugcaauauc

SEQ ID NO: 87745 - RNA, 19 nt, Homo sapiens
gaauauguaccgacuguuu

SEQ ID NO: 87746 - RNA, 19 nt, Homo sapiens
aaacaugucuccugauauc

SEQ ID NO: 87747 - RNA, 19 nt, Homo sapiens
ugacaaaccuuauggaaaa

SEQ ID NO: 87748 - RNA, 19 nt, Homo sapiens
ucaaguauguggaguguuc

SEQ ID NO: 87749 - RNA, 19 nt, Homo sapiens
ccugaaggcugucaaguau

SEQ ID NO: 87750 - RNA, 19 nt, Homo sapiens
uaaaacaugucuccugaua

SEQ ID NO: 87751 - RNA, 19 nt, Homo sapiens
agagaggucugaagaaugu

SEQ ID NO: 87752 - RNA, 19 nt, Homo sapiens
uggcuuagauguccucuug

SEQ ID NO: 87753 - RNA, 19 nt, Homo sapiens
gauuacgaccgcugaguua

SEQ ID NO: 87754 - RNA, 19 nt, Homo sapiens
agaggauuaugacagauua

SEQ ID NO: 87755 - RNA, 19 nt, Homo sapiens
ugaaggcugucaaguaugu

SEQ ID NO: 87756 - RNA, 19 nt, Homo sapiens
gaucaguagucaaguugga

SEQ ID NO: 87757 - RNA, 19 nt, Homo sapiens
cagcaaugcagacaauuaa

SEQ ID NO: 87758 - RNA, 19 nt, Homo sapiens
aaaaggaagugcuguauau

SEQ ID NO: 87759 - RNA, 19 nt, Homo sapiens
ucagcaaugcagacaauua

SEQ ID NO: 87760 - RNA, 19 nt, Homo sapiens
ggagaaaguaacacaaaca

SEQ ID NO: 87761 - RNA, 19 nt, Homo sapiens
gcuuagauguccucuugga

SEQ ID NO: 87762 - RNA, 19 nt, Homo sapiens
gaacuuggucuggcuuaga

SEQ ID NO: 87763 - RNA, 19 nt, Homo sapiens
gcagucacaguuaugauug

SEQ ID NO: 87764 - RNA, 19 nt, Homo sapiens
cgauggugcuguugguaaa

SEQ ID NO: 87765 - RNA, 19 nt, Homo sapiens
gcaaugcagacaauuaagu

SEQ ID NO: 87766 - RNA, 19 nt, Homo sapiens
gaugaccccucuacuauug

SEQ ID NO: 87767 - RNA, 19 nt, Homo sapiens
ccgcugaguuauccacaaa

SEQ ID NO: 87768 - RNA, 19 nt, Homo sapiens
gaggucaucaucagauuug

SEQ ID NO: 87769 - RNA, 19 nt, Homo sapiens
ggaagugcuguauauucua

SEQ ID NO: 87770 - RNA, 19 nt, Homo sapiens
ucaguggucucuccaucuu

SEQ ID NO: 87771 - RNA, 19 nt, Homo sapiens
guucagauggagaaaguaa

SEQ ID NO: 87772 - RNA, 19 nt, Homo sapiens
uaacacuucuagaucuuag

SEQ ID NO: 87773 - RNA, 19 nt, Homo sapiens
cggaauauguaccgacugu

SEQ ID NO: 87774 - RNA, 19 nt, Homo sapiens
uagauguccucuuggagaa

SEQ ID NO: 87775 - RNA, 19 nt, Homo sapiens
gcugaguuauccacaaaca

SEQ ID NO: 87776 - RNA, 19 nt, Homo sapiens
acucaccacuguccaaaga

SEQ ID NO: 87777 - RNA, 19 nt, Homo sapiens
guaauugcaugacaaaccu

SEQ ID NO: 87778 - RNA, 19 nt, Homo sapiens
acagauguauuucuagucu

SEQ ID NO: 87779 - RNA, 19 nt, Homo sapiens
ugaguuauccacaaacaga

SEQ ID NO: 87780 - RNA, 19 nt, Homo sapiens
gagaaaguaacacaaacau

SEQ ID NO: 87781 - RNA, 19 nt, Homo sapiens
gcgauggugcuguugguaa

SEQ ID NO: 87782 - RNA, 19 nt, Homo sapiens
cugcagggcaagaggauua

SEQ ID NO: 87783 - RNA, 19 nt, Homo sapiens
gcagacaauuaaguguguu

SEQ ID NO: 87784 - RNA, 19 nt, Homo sapiens
uggagaagcugaggucauc

SEQ ID NO: 87785 - RNA, 19 nt, Homo sapiens
agcaaccucuguauuaguu

SEQ ID NO: 87786 - RNA, 19 nt, Homo sapiens
gagaugaccccucuacuau

SEQ ID NO: 87787 - RNA, 19 nt, Homo sapiens
uccggaaacucaacccaaa

SEQ ID NO: 87788 - RNA, 19 nt, Homo sapiens
gaacaaacagaagccuauc

SEQ ID NO: 87789 - RNA, 19 nt, Homo sapiens
ccugauauccuacacaaca

SEQ ID NO: 87790 - RNA, 19 nt, Homo sapiens
caugacaaaccuuauggaa

SEQ ID NO: 87791 - RNA, 19 nt, Homo sapiens
aggaagugcuguauauucu

SEQ ID NO: 87792 - RNA, 19 nt, Homo sapiens
caugucuccugauauccua

SEQ ID NO: 87793 - RNA, 19 nt, Homo sapiens
ugugaucaguagucaaguu

SEQ ID NO: 87794 - RNA, 19 nt, Homo sapiens
gagcaaccucuguauuagu

SEQ ID NO: 87795 - RNA, 19 nt, Homo sapiens
aaagugggugccugagaua

SEQ ID NO: 87796 - RNA, 19 nt, Homo sapiens
ccauauacucuuggacuuu

SEQ ID NO: 87797 - RNA, 19 nt, Homo sapiens
gaagcugaggucaucauca

SEQ ID NO: 87798 - RNA, 19 nt, Homo sapiens
uaguucagauggagaaagu

SEQ ID NO: 87799 - RNA, 19 nt, Homo sapiens
caaugcagacaauuaagug

SEQ ID NO: 87800 - RNA, 19 nt, Homo sapiens
gcugcuuccugucccacua

SEQ ID NO: 87801 - RNA, 19 nt, Homo sapiens
agauguauuucuagucugu

SEQ ID NO: 87802 - RNA, 19 nt, Homo sapiens
uccacaaacagauguauuu

SEQ ID NO: 87803 - RNA, 19 nt, Homo sapiens
ggaacuuggucuggcuuag

SEQ ID NO: 87804 - RNA, 19 nt, Homo sapiens
uuaacguucugcugcuuga

SEQ ID NO: 87805 - RNA, 19 nt, Homo sapiens
ggaauaaaaccauccuguu

SEQ ID NO: 87806 - RNA, 19 nt, Homo sapiens
caaaaggaagugcuguaua

SEQ ID NO: 87807 - RNA, 19 nt, Homo sapiens
gucaucaucagauuugaaa

SEQ ID NO: 87808 - RNA, 19 nt, Homo sapiens
ccucuacuauugagaaacu

SEQ ID NO: 87809 - RNA, 19 nt, Homo sapiens
uuucagcaaugcagacaau

SEQ ID NO: 87810 - RNA, 19 nt, Homo sapiens
gcuguauauucuaaacugu

SEQ ID NO: 87811 - RNA, 19 nt, Homo sapiens
uaacucaccacuguccaaa

SEQ ID NO: 87812 - RNA, 19 nt, Homo sapiens
ggucucuccaucuucauuu

SEQ ID NO: 87813 - RNA, 19 nt, Homo sapiens
ggucaucaucagauuugaa

SEQ ID NO: 87814 - RNA, 19 nt, Homo sapiens
caaccucuguauuaguuuu

SEQ ID NO: 87815 - RNA, 19 nt, Homo sapiens
gaagaauguguuugaugag

SEQ ID NO: 87816 - RNA, 19 nt, Homo sapiens
agaacaaacagaagccuau

SEQ ID NO: 87817 - RNA, 19 nt, Homo sapiens
ccacaaacagauguauuuc

SEQ ID NO: 87818 - RNA, 19 nt, Homo sapiens
caauuaaguguguuguugu

SEQ ID NO: 87819 - RNA, 19 nt, Homo sapiens
cauauacucuuggacuuuu

SEQ ID NO: 87820 - RNA, 19 nt, Homo sapiens
gggaacuuggucuggcuua

SEQ ID NO: 87821 - RNA, 19 nt, Homo sapiens
acuaugcagucacaguuau

SEQ ID NO: 87822 - RNA, 19 nt, Homo sapiens
caagaggauuaugacagau

SEQ ID NO: 87823 - RNA, 19 nt, Homo sapiens
aaggaagugcuguauauuc

SEQ ID NO: 87824 - RNA, 19 nt, Homo sapiens
aaaggaagugcuguauauu

SEQ ID NO: 87825 - RNA, 19 nt, Homo sapiens
gauggagaaaguaacacaa

SEQ ID NO: 87826 - RNA, 19 nt, Homo sapiens
ucagauggagaaaguaaca

SEQ ID NO: 87827 - RNA, 19 nt, Homo sapiens
aauuaaguguguuguugug

SEQ ID NO: 87828 - RNA, 19 nt, Homo sapiens
ugucaaguauguggagugu

SEQ ID NO: 87829 - RNA, 19 nt, Homo sapiens
gaaaagugggugccugaga

SEQ ID NO: 87830 - RNA, 19 nt, Homo sapiens
guggagaaccauauacucu

SEQ ID NO: 87831 - RNA, 19 nt, Homo sapiens
gggcgauggugcuguuggu

SEQ ID NO: 87832 - RNA, 19 nt, Homo sapiens
cagggcaagaggauuauga

SEQ ID NO: 87833 - RNA, 19 nt, Homo sapiens
cugcuugaguugccugaug

SEQ ID NO: 87834 - RNA, 19 nt, Homo sapiens
gugaucaguagucaaguug

SEQ ID NO: 87835 - RNA, 19 nt, Homo sapiens
gaaacucaacccaaaagga

SEQ ID NO: 87836 - RNA, 19 nt, Homo sapiens
cuccugauauccuacacaa

SEQ ID NO: 87837 - RNA, 19 nt, Homo sapiens
acuccuuucuugcuuguug

SEQ ID NO: 87838 - RNA, 19 nt, Homo sapiens
ggacaacguuuauuacuau

SEQ ID NO: 87839 - RNA, 19 nt, Homo sapiens
gaagucagcuacucuaguu

SEQ ID NO: 87840 - RNA, 19 nt, Homo sapiens
guacacagcccuaaucaua

SEQ ID NO: 87841 - RNA, 19 nt, Homo sapiens
gaacacauuugcccaauuc

SEQ ID NO: 87842 - RNA, 19 nt, Homo sapiens
caggagagcuugucauuga

SEQ ID NO: 87843 - RNA, 19 nt, Homo sapiens
ggagagcgguggucaaaga

SEQ ID NO: 87844 - RNA, 19 nt, Homo sapiens
gaagcaggauugcaaauuc

SEQ ID NO: 87845 - RNA, 19 nt, Homo sapiens
ccaacuggcuggagauuaa

SEQ ID NO: 87846 - RNA, 19 nt, Homo sapiens
gaucauagcucacuguaac

SEQ ID NO: 87847 - RNA, 19 nt, Homo sapiens
gaaagugacugaugcugau

SEQ ID NO: 87848 - RNA, 19 nt, Homo sapiens
gagaacgcauugccacaua

SEQ ID NO: 87849 - RNA, 19 nt, Homo sapiens
guaaguguguucauuaaug

SEQ ID NO: 87850 - RNA, 19 nt, Homo sapiens
gaacaacuuuagcaucaga

SEQ ID NO: 87851 - RNA, 19 nt, Homo sapiens
gaacuauauucuucuguga

SEQ ID NO: 87852 - RNA, 19 nt, Homo sapiens
gaacaacgauggcauuuug

SEQ ID NO: 87853 - RNA, 19 nt, Homo sapiens
gaguaaguguguucauuaa

SEQ ID NO: 87854 - RNA, 19 nt, Homo sapiens
gaagagagacuggguuauu

SEQ ID NO: 87855 - RNA, 19 nt, Homo sapiens
gggacaacguuuauuacua

SEQ ID NO: 87856 - RNA, 19 nt, Homo sapiens
ugacgaaugugguaccuuu

SEQ ID NO: 87857 - RNA, 19 nt, Homo sapiens
gaauauaguucuguguaga

SEQ ID NO: 87858 - RNA, 19 nt, Homo sapiens
agacagagcggaacuauga

SEQ ID NO: 87859 - RNA, 19 nt, Homo sapiens
gaagcuggcugacauguac

SEQ ID NO: 87860 - RNA, 19 nt, Homo sapiens
gcaguacauucuacacgua

SEQ ID NO: 87861 - RNA, 19 nt, Homo sapiens
uggcugagcugaacacauu

SEQ ID NO: 87862 - RNA, 19 nt, Homo sapiens
uuuaauggcuucccucuuu

SEQ ID NO: 87863 - RNA, 19 nt, Homo sapiens
guuggugucuuuauuauug

SEQ ID NO: 87864 - RNA, 19 nt, Homo sapiens
caagauaggaguucucuga

SEQ ID NO: 87865 - RNA, 19 nt, Homo sapiens
gacaaugguucuccaguug

SEQ ID NO: 87866 - RNA, 19 nt, Homo sapiens
aaucauagcuacagacaau

SEQ ID NO: 87867 - RNA, 19 nt, Homo sapiens
ggaggagucucaacaugug

SEQ ID NO: 87868 - RNA, 19 nt, Homo sapiens
gcaaauuccugccauucug

SEQ ID NO: 87869 - RNA, 19 nt, Homo sapiens
ccacuacgcaugacuaauu

SEQ ID NO: 87870 - RNA, 19 nt, Homo sapiens
gagagaguuucccuacgua

SEQ ID NO: 87871 - RNA, 19 nt, Homo sapiens
guagugaggaucuugauuu

SEQ ID NO: 87872 - RNA, 19 nt, Homo sapiens
cuaaagugcugcagccaaa

SEQ ID NO: 87873 - RNA, 19 nt, Homo sapiens
ccacaggcaugcaccacua

SEQ ID NO: 87874 - RNA, 19 nt, Homo sapiens
ucaagaagcuggcugacau

SEQ ID NO: 87875 - RNA, 19 nt, Homo sapiens
acaaagaccaggacuauga

SEQ ID NO: 87876 - RNA, 19 nt, Homo sapiens
gauccugucugaugugaau

SEQ ID NO: 87877 - RNA, 19 nt, Homo sapiens
gacaaaggacagccuauuu

SEQ ID NO: 87878 - RNA, 19 nt, Homo sapiens
gugaggaucuugauuugga

SEQ ID NO: 87879 - RNA, 19 nt, Homo sapiens
aagaacaacuuuagcauca

SEQ ID NO: 87880 - RNA, 19 nt, Homo sapiens
caauacaucucccuucaca

SEQ ID NO: 87881 - RNA, 19 nt, Homo sapiens
cagcaucacuggccaagga

SEQ ID NO: 87882 - RNA, 19 nt, Homo sapiens
caaaaggccucuacgguuu

SEQ ID NO: 87883 - RNA, 19 nt, Homo sapiens
gcucauggauaaccagaau

SEQ ID NO: 87884 - RNA, 19 nt, Homo sapiens
cagcaaagggcuuggauuu

SEQ ID NO: 87885 - RNA, 19 nt, Homo sapiens
ccacaaauccagugaacaa

SEQ ID NO: 87886 - RNA, 19 nt, Homo sapiens
ggccugaagugacucguaa

SEQ ID NO: 87887 - RNA, 19 nt, Homo sapiens
gaacacaggagucaucagu

SEQ ID NO: 87888 - RNA, 19 nt, Homo sapiens
gagaaugucacuguaguuu

SEQ ID NO: 87889 - RNA, 19 nt, Homo sapiens
ugaguaaguguguucauua

SEQ ID NO: 87890 - RNA, 19 nt, Homo sapiens
gaccaggacuuugacuuga

SEQ ID NO: 87891 - RNA, 19 nt, Homo sapiens
ucacugacaccaacgauaa

SEQ ID NO: 87892 - RNA, 19 nt, Homo sapiens
gcaaacugaugcugaggau

SEQ ID NO: 87893 - RNA, 19 nt, Homo sapiens
ccaggacuaugacuacuug

SEQ ID NO: 87894 - RNA, 19 nt, Homo sapiens
ugaaagcggcugauacuga

SEQ ID NO: 87895 - RNA, 19 nt, Homo sapiens
ggaccaggacuuugacuug

SEQ ID NO: 87896 - RNA, 19 nt, Homo sapiens
gaaugaugaugguggacaa

SEQ ID NO: 87897 - RNA, 19 nt, Homo sapiens
gaaugucacuguaguuuug

SEQ ID NO: 87898 - RNA, 19 nt, Homo sapiens
caagauccgugguuuguac

SEQ ID NO: 87899 - RNA, 19 nt, Homo sapiens
gcugggaaaugcagaaauc

SEQ ID NO: 87900 - RNA, 19 nt, Homo sapiens
gagaguuucccuacguaua

SEQ ID NO: 87901 - RNA, 19 nt, Homo sapiens
ccacagacgcggacgauga

SEQ ID NO: 87902 - RNA, 19 nt, Homo sapiens
cagaagagagacuggguua

SEQ ID NO: 87903 - RNA, 19 nt, Homo sapiens
gacacaagauccgugguuu

SEQ ID NO: 87904 - RNA, 19 nt, Homo sapiens
aaacugaugcugaggauga

SEQ ID NO: 87905 - RNA, 19 nt, Homo sapiens
uuuauacucucuccacuuu

SEQ ID NO: 87906 - RNA, 19 nt, Homo sapiens
ugaugaugguggacaauuu

SEQ ID NO: 87907 - RNA, 19 nt, Homo sapiens
ccaagaaucuaucauuuug

SEQ ID NO: 87908 - RNA, 19 nt, Homo sapiens
gggucuaccucaucucuga

SEQ ID NO: 87909 - RNA, 19 nt, Homo sapiens
ggagaagucagcuacucua

SEQ ID NO: 87910 - RNA, 19 nt, Homo sapiens
uauacucucuccacuuuau

SEQ ID NO: 87911 - RNA, 19 nt, Homo sapiens
gaggagagcgguggucaaa

SEQ ID NO: 87912 - RNA, 19 nt, Homo sapiens
agaggugggugacuacaaa

SEQ ID NO: 87913 - RNA, 19 nt, Homo sapiens
agacaaugguucuccaguu

SEQ ID NO: 87914 - RNA, 19 nt, Homo sapiens
caaauccagugaacaacga

SEQ ID NO: 87915 - RNA, 19 nt, Homo sapiens
ggagauggcaggagagcuu

SEQ ID NO: 87916 - RNA, 19 nt, Homo sapiens
caagugauccucccaucuu

SEQ ID NO: 87917 - RNA, 19 nt, Homo sapiens
gagaagaggaccaggacuu

SEQ ID NO: 87918 - RNA, 19 nt, Homo sapiens
gaucaaauccaacaaagac

SEQ ID NO: 87919 - RNA, 19 nt, Homo sapiens
gcagcuauccagugacuug

SEQ ID NO: 87920 - RNA, 19 nt, Homo sapiens
ggccacaucuugacuaggu

SEQ ID NO: 87921 - RNA, 19 nt, Homo sapiens
cccagcaccuugcagauuu

SEQ ID NO: 87922 - RNA, 19 nt, Homo sapiens
caccaacccucaugagugu

SEQ ID NO: 87923 - RNA, 19 nt, Homo sapiens
ggaauucuugcuuugcuaa

SEQ ID NO: 87924 - RNA, 19 nt, Homo sapiens
accagaaccucgaacuaua

SEQ ID NO: 87925 - RNA, 19 nt, Homo sapiens
ggagagacacugccaacug

SEQ ID NO: 87926 - RNA, 19 nt, Homo sapiens
acacauuuauggaacagaa

SEQ ID NO: 87927 - RNA, 19 nt, Homo sapiens
gccgagagcuacacguuca

SEQ ID NO: 87928 - RNA, 19 nt, Homo sapiens
gaugugaacaccuacaaug

SEQ ID NO: 87929 - RNA, 19 nt, Homo sapiens
cauacacucucuucucuca

SEQ ID NO: 87930 - RNA, 19 nt, Homo sapiens
cccaucagcugcccagaaa

SEQ ID NO: 87931 - RNA, 19 nt, Homo sapiens
ccaaagugcugggauugug

SEQ ID NO: 87932 - RNA, 19 nt, Homo sapiens
caccucagccucccaagua

SEQ ID NO: 87933 - RNA, 19 nt, Homo sapiens
gacagggucucauucuauc

SEQ ID NO: 87934 - RNA, 19 nt, Homo sapiens
cgaauauaguucuguguag

SEQ ID NO: 87935 - RNA, 19 nt, Homo sapiens
gguauugucuacucugaag

SEQ ID NO: 87936 - RNA, 19 nt, Homo sapiens
ccaccaaagucacgcugaa

SEQ ID NO: 87937 - RNA, 19 nt, Homo sapiens
ugcccaagcuggucuuaaa

SEQ ID NO: 87938 - RNA, 19 nt, Homo sapiens
caacagaccugaguucuua

SEQ ID NO: 87939 - RNA, 19 nt, Homo sapiens
gaaacuugcugacauguau

SEQ ID NO: 87940 - RNA, 19 nt, Homo sapiens
gaucaaagccuggaacaua

SEQ ID NO: 87941 - RNA, 19 nt, Homo sapiens
ggacaaauaacuacaauug

SEQ ID NO: 87942 - RNA, 19 nt, Homo sapiens
uuacagcacuugauuauga

SEQ ID NO: 87943 - RNA, 19 nt, Homo sapiens
gaacaggguagacaucaua

SEQ ID NO: 87944 - RNA, 19 nt, Homo sapiens
ggacaaguacaaacaauuu

SEQ ID NO: 87945 - RNA, 19 nt, Homo sapiens
gcaguaaguuaaaccauga

SEQ ID NO: 87946 - RNA, 19 nt, Homo sapiens
ccaaucaacuugccagaaa

SEQ ID NO: 87947 - RNA, 19 nt, Homo sapiens
caacugguaucuucauuau

SEQ ID NO: 87948 - RNA, 19 nt, Homo sapiens
ggaaggcaaucccacauau

SEQ ID NO: 87949 - RNA, 19 nt, Homo sapiens
gcacaugcaguagauauua

SEQ ID NO: 87950 - RNA, 19 nt, Homo sapiens
ugacaauccuccagaguuu

SEQ ID NO: 87951 - RNA, 19 nt, Homo sapiens
gaacgcugcagaucuauuu

SEQ ID NO: 87952 - RNA, 19 nt, Homo sapiens
ugaagaagguggaggagaa

SEQ ID NO: 87953 - RNA, 19 nt, Homo sapiens
gaagaugauguaagagaua

SEQ ID NO: 87954 - RNA, 19 nt, Homo sapiens
gcagaucuauuuacuugau

SEQ ID NO: 87955 - RNA, 19 nt, Homo sapiens
ggacccagaucgauauaug

SEQ ID NO: 87956 - RNA, 19 nt, Homo sapiens
gcaacaguauacguuaaua

SEQ ID NO: 87957 - RNA, 19 nt, Homo sapiens
guucuuagcacaaauguuu

SEQ ID NO: 87958 - RNA, 19 nt, Homo sapiens
caggaacgcugcagaucua

SEQ ID NO: 87959 - RNA, 19 nt, Homo sapiens
cagcagaaguugaagaaau

SEQ ID NO: 87960 - RNA, 19 nt, Homo sapiens
gaaguucccaucauaauca

SEQ ID NO: 87961 - RNA, 19 nt, Homo sapiens
gaaauaguguucccaagac

SEQ ID NO: 87962 - RNA, 19 nt, Homo sapiens
ugacaugaaugacaacaga

SEQ ID NO: 87963 - RNA, 19 nt, Homo sapiens
gauauaugcccaagacaaa

SEQ ID NO: 87964 - RNA, 19 nt, Homo sapiens
uuacucagcugguugcaaa

SEQ ID NO: 87965 - RNA, 19 nt, Homo sapiens
cauaguagcuaaucuaacu

SEQ ID NO: 87966 - RNA, 19 nt, Homo sapiens
gcagaaacuucagaacaug

SEQ ID NO: 87967 - RNA, 19 nt, Homo sapiens
uaagaucauucgccaagaa

SEQ ID NO: 87968 - RNA, 19 nt, Homo sapiens
ggucaaaccaaucgacuuu

SEQ ID NO: 87969 - RNA, 19 nt, Homo sapiens
gaaggagucagcagaaguu

SEQ ID NO: 87970 - RNA, 19 nt, Homo sapiens
gugagaagcuuuccacucu

SEQ ID NO: 87971 - RNA, 19 nt, Homo sapiens
gggaugagaccaugagauu

SEQ ID NO: 87972 - RNA, 19 nt, Homo sapiens
cugcagaucuauuuacuug

SEQ ID NO: 87973 - RNA, 19 nt, Homo sapiens
gaaaaguucuuagcacaaa

SEQ ID NO: 87974 - RNA, 19 nt, Homo sapiens
aaacagcaacgacggguua

SEQ ID NO: 87975 - RNA, 19 nt, Homo sapiens
cuuaauccauguacacuuu

SEQ ID NO: 87976 - RNA, 19 nt, Homo sapiens
ccacagcuccaccauauga

SEQ ID NO: 87977 - RNA, 19 nt, Homo sapiens
gaccgagaaucaccaaaug

SEQ ID NO: 87978 - RNA, 19 nt, Homo sapiens
uaucugauccugccaauug

SEQ ID NO: 87979 - RNA, 19 nt, Homo sapiens
ggaacgcaguguacagaau

SEQ ID NO: 87980 - RNA, 19 nt, Homo sapiens
ccacauauggccuuucaaa

SEQ ID NO: 87981 - RNA, 19 nt, Homo sapiens
agcagaaguugaagaaaua

SEQ ID NO: 87982 - RNA, 19 nt, Homo sapiens
uaaugguacugauuucuga

SEQ ID NO: 87983 - RNA, 19 nt, Homo sapiens
gagaagaagaccaggacua

SEQ ID NO: 87984 - RNA, 19 nt, Homo sapiens
guaauccucccaaaucaaa

SEQ ID NO: 87985 - RNA, 19 nt, Homo sapiens
gaacaggaacgcugcagau

SEQ ID NO: 87986 - RNA, 19 nt, Homo sapiens
cuacuuuccuugcuucuga

SEQ ID NO: 87987 - RNA, 19 nt, Homo sapiens
gaagagagacugggucauc

SEQ ID NO: 87988 - RNA, 19 nt, Homo sapiens
ggagucagcagaaguugaa

SEQ ID NO: 87989 - RNA, 19 nt, Homo sapiens
gacagccucuucucaaugu

SEQ ID NO: 87990 - RNA, 19 nt, Homo sapiens
ggugggagcaguaaguuaa

SEQ ID NO: 87991 - RNA, 19 nt, Homo sapiens
gagcucaguuacacuugaa

SEQ ID NO: 87992 - RNA, 19 nt, Homo sapiens
ggcauaggcugcaaaccaa

SEQ ID NO: 87993 - RNA, 19 nt, Homo sapiens
ggacuaugauuaccugaac

SEQ ID NO: 87994 - RNA, 19 nt, Homo sapiens
uuaaagcggcugacaauga

SEQ ID NO: 87995 - RNA, 19 nt, Homo sapiens
uccagaagaugauguaaga

SEQ ID NO: 87996 - RNA, 19 nt, Homo sapiens
gugcaacaguauacguuaa

SEQ ID NO: 87997 - RNA, 19 nt, Homo sapiens
guuaaaccaugauaugcuu

SEQ ID NO: 87998 - RNA, 19 nt, Homo sapiens
guacaaacaauuucaacug

SEQ ID NO: 87999 - RNA, 19 nt, Homo sapiens
ucuugaagcugguaucuau

SEQ ID NO: 88000 - RNA, 19 nt, Homo sapiens
acugguaucuucauuauca

SEQ ID NO: 88001 - RNA, 19 nt, Homo sapiens
ggucaucccuccaaucaac

SEQ ID NO: 88002 - RNA, 19 nt, Homo sapiens
aagaagaccaggacuauga

SEQ ID NO: 88003 - RNA, 19 nt, Homo sapiens
gaccaucacucggcuuaau

SEQ ID NO: 88004 - RNA, 19 nt, Homo sapiens
uaucuccagugacuauuaa

SEQ ID NO: 88005 - RNA, 19 nt, Homo sapiens
gcacuugauuaugacauug

SEQ ID NO: 88006 - RNA, 19 nt, Homo sapiens
gcacaguggccaccuacaa

SEQ ID NO: 88007 - RNA, 19 nt, Homo sapiens
ggagagacuucugacaaca

SEQ ID NO: 88008 - RNA, 19 nt, Homo sapiens
ggacuauggauucagguuu

SEQ ID NO: 88009 - RNA, 19 nt, Homo sapiens
gcuaggcuuuaacuuugua

SEQ ID NO: 88010 - RNA, 19 nt, Homo sapiens
gugagcaggacuaugauua

SEQ ID NO: 88011 - RNA, 19 nt, Homo sapiens
caaugagacuggugacauc

SEQ ID NO: 88012 - RNA, 19 nt, Homo sapiens
gaagauggcaugguguaug

SEQ ID NO: 88013 - RNA, 19 nt, Homo sapiens
guacagaagcacugggauu

SEQ ID NO: 88014 - RNA, 19 nt, Homo sapiens
gugaauggacaaauaacua

SEQ ID NO: 88015 - RNA, 19 nt, Homo sapiens
ccaaucgacuuugaaacaa

SEQ ID NO: 88016 - RNA, 19 nt, Homo sapiens
gcaaguggcaguaaaauug

SEQ ID NO: 88017 - RNA, 19 nt, Homo sapiens
cagcuuugccucuguauug

SEQ ID NO: 88018 - RNA, 19 nt, Homo sapiens
uccuugagcucccuuaauu

SEQ ID NO: 88019 - RNA, 19 nt, Homo sapiens
uaauugauccagaagauga

SEQ ID NO: 88020 - RNA, 19 nt, Homo sapiens
ggacagccucuucucaaug

SEQ ID NO: 88021 - RNA, 19 nt, Homo sapiens
ggaccgagaaucaccaaau

SEQ ID NO: 88022 - RNA, 19 nt, Homo sapiens
gaucauucgccaagaagaa

SEQ ID NO: 88023 - RNA, 19 nt, Homo sapiens
caucauaguagcuaaucua

SEQ ID NO: 88024 - RNA, 19 nt, Homo sapiens
caggguagacaucauagua

SEQ ID NO: 88025 - RNA, 19 nt, Homo sapiens
cacaugcaguagauauuaa

SEQ ID NO: 88026 - RNA, 19 nt, Homo sapiens
ccaacugguaucuucauua

SEQ ID NO: 88027 - RNA, 19 nt, Homo sapiens
ccaaguuccugauauaugc

SEQ ID NO: 88028 - RNA, 19 nt, Homo sapiens
cagaagcacugggauuuua

SEQ ID NO: 88029 - RNA, 19 nt, Homo sapiens
guggugagcaggacuauga

SEQ ID NO: 88030 - RNA, 19 nt, Homo sapiens
ccauaugacucccuguuag

SEQ ID NO: 88031 - RNA, 19 nt, Homo sapiens
gaccaggacuaugacuuga

SEQ ID NO: 88032 - RNA, 19 nt, Homo sapiens
ggguaauccucccaaauca

SEQ ID NO: 88033 - RNA, 19 nt, Homo sapiens
gacaauggaauuccuccua

SEQ ID NO: 88034 - RNA, 19 nt, Homo sapiens
cccaacauguuuacaauca

SEQ ID NO: 88035 - RNA, 19 nt, Homo sapiens
gcagauagcccgguuucau

SEQ ID NO: 88036 - RNA, 19 nt, Homo sapiens
acaauggaauuccuccuau

SEQ ID NO: 88037 - RNA, 19 nt, Homo sapiens
aaauagauccugugaaugg

SEQ ID NO: 88038 - RNA, 19 nt, Homo sapiens
ugaaucagcucaagucuaa

SEQ ID NO: 88039 - RNA, 19 nt, Homo sapiens
gggaggagauugccaagua

SEQ ID NO: 88040 - RNA, 19 nt, Homo sapiens
ggacaaucguguauaugua

SEQ ID NO: 88041 - RNA, 19 nt, Homo sapiens
ugacaaugcucccauguuu

SEQ ID NO: 88042 - RNA, 19 nt, Homo sapiens
gaaaucggcaacuuuauaa

SEQ ID NO: 88043 - RNA, 19 nt, Homo sapiens
gaugaaaucggcaacuuua

SEQ ID NO: 88044 - RNA, 19 nt, Homo sapiens
gaaagaagcggaagaucaa

SEQ ID NO: 88045 - RNA, 19 nt, Homo sapiens
ggaaaggaauccauugaag

SEQ ID NO: 88046 - RNA, 19 nt, Homo sapiens
gaaggucacugaaggaaag

SEQ ID NO: 88047 - RNA, 19 nt, Homo sapiens
ggaggaaugugggcaguuu

SEQ ID NO: 88048 - RNA, 19 nt, Homo sapiens
caagagagauugggugguu

SEQ ID NO: 88049 - RNA, 19 nt, Homo sapiens
gaaaggaauccauugaaga

SEQ ID NO: 88050 - RNA, 19 nt, Homo sapiens
ggaacaacaucuaugaagu

SEQ ID NO: 88051 - RNA, 19 nt, Homo sapiens
gcucaagucuaauaaagau

SEQ ID NO: 88052 - RNA, 19 nt, Homo sapiens
gaaugaggcaccuguguuu

SEQ ID NO: 88053 - RNA, 19 nt, Homo sapiens
agaccaagauuacgauuau

SEQ ID NO: 88054 - RNA, 19 nt, Homo sapiens
gauagagacaccaagauuu

SEQ ID NO: 88055 - RNA, 19 nt, Homo sapiens
ucaagaagcuggcagacau

SEQ ID NO: 88056 - RNA, 19 nt, Homo sapiens
ugaaaucggcaacuuuaua

SEQ ID NO: 88057 - RNA, 19 nt, Homo sapiens
uagagugguugcuuccuua

SEQ ID NO: 88058 - RNA, 19 nt, Homo sapiens
gcugguuguuguugaauaa

SEQ ID NO: 88059 - RNA, 19 nt, Homo sapiens
gaacaacaucuaugaaguc

SEQ ID NO: 88060 - RNA, 19 nt, Homo sapiens
gagacaggcugguuguugu

SEQ ID NO: 88061 - RNA, 19 nt, Homo sapiens
gaccacaagcccaaguuua

SEQ ID NO: 88062 - RNA, 19 nt, Homo sapiens
ggaggagauugccaaguau

SEQ ID NO: 88063 - RNA, 19 nt, Homo sapiens
ugaggacaaucguguauau

SEQ ID NO: 88064 - RNA, 19 nt, Homo sapiens
gacaacgucuucuacuaug

SEQ ID NO: 88065 - RNA, 19 nt, Homo sapiens
cuucggagcuugucaggaa

SEQ ID NO: 88066 - RNA, 19 nt, Homo sapiens
gugacaacgucuucuacua

SEQ ID NO: 88067 - RNA, 19 nt, Homo sapiens
ugaagaaguuccugaagca

SEQ ID NO: 88068 - RNA, 19 nt, Homo sapiens
cagaagacccugacaagga

SEQ ID NO: 88069 - RNA, 19 nt, Homo sapiens
gaaggaaaggaauccauug

SEQ ID NO: 88070 - RNA, 19 nt, Homo sapiens
ccaggaaggguuuggauuu

SEQ ID NO: 88071 - RNA, 19 nt, Homo sapiens
gaugaagggugaggacaau

SEQ ID NO: 88072 - RNA, 19 nt, Homo sapiens
gcacugauaaugaugacuu

SEQ ID NO: 88073 - RNA, 19 nt, Homo sapiens
ggagauccuugaugccaau

SEQ ID NO: 88074 - RNA, 19 nt, Homo sapiens
ggaaagaaggucacugaag

SEQ ID NO: 88075 - RNA, 19 nt, Homo sapiens
gaagaugacacccgugaca

SEQ ID NO: 88076 - RNA, 19 nt, Homo sapiens
gaccucauguucaccauuc

SEQ ID NO: 88077 - RNA, 19 nt, Homo sapiens
gcgaagaggaccaggacua

SEQ ID NO: 88078 - RNA, 19 nt, Homo sapiens
ugaagcaggauacauauga

SEQ ID NO: 88079 - RNA, 19 nt, Homo sapiens
ggaauccauugaagaucuu

SEQ ID NO: 88080 - RNA, 19 nt, Homo sapiens
cauaugacgugcaccuuuc

SEQ ID NO: 88081 - RNA, 19 nt, Homo sapiens
ggagacaggcugguuguug

SEQ ID NO: 88082 - RNA, 19 nt, Homo sapiens
cagcucaagucuaauaaag

SEQ ID NO: 88083 - RNA, 19 nt, Homo sapiens
ggaaguggccguagcaacu

SEQ ID NO: 88084 - RNA, 19 nt, Homo sapiens
ugacaacgucuucuacuau

SEQ ID NO: 88085 - RNA, 19 nt, Homo sapiens
uccaauaucugucccugaa

SEQ ID NO: 88086 - RNA, 19 nt, Homo sapiens
ggugguugcuccaauaucu

SEQ ID NO: 88087 - RNA, 19 nt, Homo sapiens
gaagacacaagagagauug

SEQ ID NO: 88088 - RNA, 19 nt, Homo sapiens
aaucagcucaagucuaaua

SEQ ID NO: 88089 - RNA, 19 nt, Homo sapiens
gaccaggacuaugacauca

SEQ ID NO: 88090 - RNA, 19 nt, Homo sapiens
acaaugcucccauguuuga

SEQ ID NO: 88091 - RNA, 19 nt, Homo sapiens
caggaaagaaggucacuga

SEQ ID NO: 88092 - RNA, 19 nt, Homo sapiens
cagaugaaaucggcaacuu

SEQ ID NO: 88093 - RNA, 19 nt, Homo sapiens
agaaagaagcggaagauca

SEQ ID NO: 88094 - RNA, 19 nt, Homo sapiens
ugaggaacaacaucuauga

SEQ ID NO: 88095 - RNA, 19 nt, Homo sapiens
ggaaggguuuggauuuuga

SEQ ID NO: 88096 - RNA, 19 nt, Homo sapiens
cuaugagucugacguuaga

SEQ ID NO: 88097 - RNA, 19 nt, Homo sapiens
ggaccaggacuaugacauc

SEQ ID NO: 88098 - RNA, 19 nt, Homo sapiens
guuuagcacugauaaugau

SEQ ID NO: 88099 - RNA, 19 nt, Homo sapiens
gagggugucuucgcuguag

SEQ ID NO: 88100 - RNA, 19 nt, Homo sapiens
gaagcuggcagacauguac

SEQ ID NO: 88101 - RNA, 19 nt, Homo sapiens
aagaggaccaggacuauga

SEQ ID NO: 88102 - RNA, 19 nt, Homo sapiens
gaggaugagcaguuuguga

SEQ ID NO: 88103 - RNA, 19 nt, Homo sapiens
gaaguacgaggcccaugug

SEQ ID NO: 88104 - RNA, 19 nt, Homo sapiens
acaauggggugguugcuua

SEQ ID NO: 88105 - RNA, 19 nt, Homo sapiens
aaagauagagacaccaaga

SEQ ID NO: 88106 - RNA, 19 nt, Homo sapiens
aaaggaauccauugaagau

SEQ ID NO: 88107 - RNA, 19 nt, Homo sapiens
ucguguauauguacuagaa

SEQ ID NO: 88108 - RNA, 19 nt, Homo sapiens
gaagcaggauacauaugac

SEQ ID NO: 88109 - RNA, 19 nt, Homo sapiens
gaacccuucugcuaacacu

SEQ ID NO: 88110 - RNA, 19 nt, Homo sapiens
gaccuacaguggacuuucu

SEQ ID NO: 88111 - RNA, 19 nt, Homo sapiens
gaggaacaacaucuaugaa

SEQ ID NO: 88112 - RNA, 19 nt, Homo sapiens
ugaaggaaaggaauccauu

SEQ ID NO: 88113 - RNA, 19 nt, Homo sapiens
cgaagacacaagagagauu

SEQ ID NO: 88114 - RNA, 19 nt, Homo sapiens
ggcuaugagucugacguua

SEQ ID NO: 88115 - RNA, 19 nt, Homo sapiens
gcugaggacuucggagcuu

SEQ ID NO: 88116 - RNA, 19 nt, Homo sapiens
ugaaggcggcuaacacaga

SEQ ID NO: 88117 - RNA, 19 nt, Homo sapiens
gaagaggaccaggacuaug

SEQ ID NO: 88118 - RNA, 19 nt, Homo sapiens
gcgagacaguccaggaaag

SEQ ID NO: 88119 - RNA, 19 nt, Homo sapiens
aggcccagcucacagauga

SEQ ID NO: 88120 - RNA, 19 nt, Homo sapiens
guugcuuacuccauccaua

SEQ ID NO: 88121 - RNA, 19 nt, Homo sapiens
caauaucugucccugaaaa

SEQ ID NO: 88122 - RNA, 19 nt, Homo sapiens
ggauggaucucugcguuuu

SEQ ID NO: 88123 - RNA, 19 nt, Homo sapiens
ugacuucacugugcggaau

SEQ ID NO: 88124 - RNA, 19 nt, Homo sapiens
cguccugcauuucugguuu

SEQ ID NO: 88125 - RNA, 19 nt, Homo sapiens
ggaauggaaccuucuuagg

SEQ ID NO: 88126 - RNA, 19 nt, Homo sapiens
cgaccaagaccaagauuac

SEQ ID NO: 88127 - RNA, 19 nt, Homo sapiens
ccacacgaccucauguuca

SEQ ID NO: 88128 - RNA, 19 nt, Homo sapiens
agauagagacaccaagauu

SEQ ID NO: 88129 - RNA, 19 nt, Homo sapiens
gcuaugagucugacguuag

SEQ ID NO: 88130 - RNA, 19 nt, Homo sapiens
caacgaggaaggugacaca

SEQ ID NO: 88131 - RNA, 19 nt, Homo sapiens
agaaugcagugggccauga

SEQ ID NO: 88132 - RNA, 19 nt, Homo sapiens
gugccuagguugccccuua

SEQ ID NO: 88133 - RNA, 19 nt, Homo sapiens
aagagcagcugacggugau

SEQ ID NO: 88134 - RNA, 19 nt, Homo sapiens
ggacccacacgaccucaug

SEQ ID NO: 88135 - RNA, 19 nt, Homo sapiens
cgaccagaaugaccacaag

SEQ ID NO: 88136 - RNA, 19 nt, Homo sapiens
ggcugguuguuguugaaua

SEQ ID NO: 88137 - RNA, 19 nt, Homo sapiens
ccaaacgucaggccacaga

SEQ ID NO: 88138 - RNA, 19 nt, Homo sapiens
ggaaggaaaucucaacuau

SEQ ID NO: 88139 - RNA, 19 nt, Homo sapiens
gagagaaaguucagcagua

SEQ ID NO: 88140 - RNA, 19 nt, Homo sapiens
caacgaggcucccuacuuc

SEQ ID NO: 88141 - RNA, 19 nt, Homo sapiens
ccacagauauggaaggaaa

SEQ ID NO: 88142 - RNA, 19 nt, Homo sapiens
gcauuaaucucccaaaaua

SEQ ID NO: 88143 - RNA, 19 nt, Homo sapiens
gcgacaacauccucaagua

SEQ ID NO: 88144 - RNA, 19 nt, Homo sapiens
cagaauauguucaccauca

SEQ ID NO: 88145 - RNA, 19 nt, Homo sapiens
ggacaugaauggcaacaag

SEQ ID NO: 88146 - RNA, 19 nt, Homo sapiens
ugacugaccucgcaucuuc

SEQ ID NO: 88147 - RNA, 19 nt, Homo sapiens
ugacagaugugaaugacaa

SEQ ID NO: 88148 - RNA, 19 nt, Homo sapiens
ucacuugaauuuccuagaa

SEQ ID NO: 88149 - RNA, 19 nt, Homo sapiens
cgacaucggugacuucauc

SEQ ID NO: 88150 - RNA, 19 nt, Homo sapiens
cggaagaacuggaccauca

SEQ ID NO: 88151 - RNA, 19 nt, Homo sapiens
ugacaacccgccagaauuu

SEQ ID NO: 88152 - RNA, 19 nt, Homo sapiens
ucaagaagcuggcggacau

SEQ ID NO: 88153 - RNA, 19 nt, Homo sapiens
aaggaaaucucaacuaugg

SEQ ID NO: 88154 - RNA, 19 nt, Homo sapiens
gaagcuggcggacauguau

SEQ ID NO: 88155 - RNA, 19 nt, Homo sapiens
caacacguccaucaucaaa

SEQ ID NO: 88156 - RNA, 19 nt, Homo sapiens
acaacauccucaaguauga

SEQ ID NO: 88157 - RNA, 19 nt, Homo sapiens
gcgagaagcccaaccugaa

SEQ ID NO: 88158 - RNA, 19 nt, Homo sapiens
gaaggaaaucucaacuaug

SEQ ID NO: 88159 - RNA, 19 nt, Homo sapiens
ccaucgaccuguacaucua

SEQ ID NO: 88160 - RNA, 19 nt, Homo sapiens
guugagcugucuagcauga

SEQ ID NO: 88161 - RNA, 19 nt, Homo sapiens
ggaccaagacuacgauuac

SEQ ID NO: 88162 - RNA, 19 nt, Homo sapiens
gaucuuacaacuagagaga

SEQ ID NO: 88163 - RNA, 19 nt, Homo sapiens
cgacaaagacaaugacauc

SEQ ID NO: 88164 - RNA, 19 nt, Homo sapiens
ugaauuuccuagaacagaa

SEQ ID NO: 88165 - RNA, 19 nt, Homo sapiens
guauggagguggugaagag

SEQ ID NO: 88166 - RNA, 19 nt, Homo sapiens
gacaacauccucaaguaug

SEQ ID NO: 88167 - RNA, 19 nt, Homo sapiens
cagagcccgucccagaaua

SEQ ID NO: 88168 - RNA, 19 nt, Homo sapiens
gcaaggcuggguucucuga

SEQ ID NO: 88169 - RNA, 19 nt, Homo sapiens
gcaguacacagucaucguu

SEQ ID NO: 88170 - RNA, 19 nt, Homo sapiens
cagcgagacuggagauauc

SEQ ID NO: 88171 - RNA, 19 nt, Homo sapiens
caacagcauggacuucaaa

SEQ ID NO: 88172 - RNA, 19 nt, Homo sapiens
cgagcuggcugcacaucaa

SEQ ID NO: 88173 - RNA, 19 nt, Homo sapiens
gugagucccucuacaccaa

SEQ ID NO: 88174 - RNA, 19 nt, Homo sapiens
ggacacaagccgcagaaag

SEQ ID NO: 88175 - RNA, 19 nt, Homo sapiens
gcacugaaggacagcaaga

SEQ ID NO: 88176 - RNA, 19 nt, Homo sapiens
cgacaacauccucaaguau

SEQ ID NO: 88177 - RNA, 19 nt, Homo sapiens
acacguccaucaucaaagu

SEQ ID NO: 88178 - RNA, 19 nt, Homo sapiens
agaaggagcgccacacgaa

SEQ ID NO: 88179 - RNA, 19 nt, Homo sapiens
ugaaggcagucgacuacga

SEQ ID NO: 88180 - RNA, 19 nt, Homo sapiens
gggaccaagacuacgauua

SEQ ID NO: 88181 - RNA, 19 nt, Homo sapiens
gcgaggaggaccaggacua

SEQ ID NO: 88182 - RNA, 19 nt, Homo sapiens
gagcuuucaugcugacagu

SEQ ID NO: 88183 - RNA, 19 nt, Homo sapiens
gcacagaccccguaaccaa

SEQ ID NO: 88184 - RNA, 19 nt, Homo sapiens
gacaacccgccagaauuua

SEQ ID NO: 88185 - RNA, 19 nt, Homo sapiens
gauauggaaggaaaucuca

SEQ ID NO: 88186 - RNA, 19 nt, Homo sapiens
guucagcaguacacaguca

SEQ ID NO: 88187 - RNA, 19 nt, Homo sapiens
ccaacagcauggacuucaa

SEQ ID NO: 88188 - RNA, 19 nt, Homo sapiens
ggacacaauaugagaccaa

SEQ ID NO: 88189 - RNA, 19 nt, Homo sapiens
agacuacgauuaccucaac

SEQ ID NO: 88190 - RNA, 19 nt, Homo sapiens
gaauccagauguccuucca

SEQ ID NO: 88191 - RNA, 19 nt, Homo sapiens
augaggaucuuacaacuag

SEQ ID NO: 88192 - RNA, 19 nt, Homo sapiens
ucucaacuauggccucuca

SEQ ID NO: 88193 - RNA, 19 nt, Homo sapiens
caaccgcccugaguucauc

SEQ ID NO: 88194 - RNA, 19 nt, Homo sapiens
uaaugaggaucuuacaacu

SEQ ID NO: 88195 - RNA, 19 nt, Homo sapiens
ggcacucugucuucacuug

SEQ ID NO: 88196 - RNA, 19 nt, Homo sapiens
ggaccaaggggacacaaua

SEQ ID NO: 88197 - RNA, 19 nt, Homo sapiens
ggaugaagcggcgagagaa

SEQ ID NO: 88198 - RNA, 19 nt, Homo sapiens
ccaggcaccuacgugauga

SEQ ID NO: 88199 - RNA, 19 nt, Homo sapiens
ccauggaggucuucagcau

SEQ ID NO: 88200 - RNA, 19 nt, Homo sapiens
gaugauuacacggcauuaa

SEQ ID NO: 88201 - RNA, 19 nt, Homo sapiens
cgacuacgagcucaacaga

SEQ ID NO: 88202 - RNA, 19 nt, Homo sapiens
gacacaagccgcagaaagg

SEQ ID NO: 88203 - RNA, 19 nt, Homo sapiens
ccgggacccuccagaucua

SEQ ID NO: 88204 - RNA, 19 nt, Homo sapiens
ucaacgaggcucccuacuu

SEQ ID NO: 88205 - RNA, 19 nt, Homo sapiens
gcccugaguucaucaacca

SEQ ID NO: 88206 - RNA, 19 nt, Homo sapiens
gaggauccgguccgacaaa

SEQ ID NO: 88207 - RNA, 19 nt, Homo sapiens
ggccacagauauggaagga

SEQ ID NO: 88208 - RNA, 19 nt, Homo sapiens
gacuggagauaucgucaca

SEQ ID NO: 88209 - RNA, 19 nt, Homo sapiens
ccaaggaggcgcagaucug

SEQ ID NO: 88210 - RNA, 19 nt, Homo sapiens
agaauauguucaccaucaa

SEQ ID NO: 88211 - RNA, 19 nt, Homo sapiens
ccaucaacgugcccgagaa

SEQ ID NO: 88212 - RNA, 19 nt, Homo sapiens
gaggcacucugucuucacu

SEQ ID NO: 88213 - RNA, 19 nt, Homo sapiens
ucaacuauggccucucaaa

SEQ ID NO: 88214 - RNA, 19 nt, Homo sapiens
agagaaaguucagcaguac

SEQ ID NO: 88215 - RNA, 19 nt, Homo sapiens
ugacaaccgcccugaguuc

SEQ ID NO: 88216 - RNA, 19 nt, Homo sapiens
auggaggucuucagcauug

SEQ ID NO: 88217 - RNA, 19 nt, Homo sapiens
gcacucugucuucacuuga

SEQ ID NO: 88218 - RNA, 19 nt, Homo sapiens
caacagcgagacuggagau

SEQ ID NO: 88219 - RNA, 19 nt, Homo sapiens
caacuagagagaccugcaa

SEQ ID NO: 88220 - RNA, 19 nt, Homo sapiens
ccaugguccugcuguuugu

SEQ ID NO: 88221 - RNA, 19 nt, Homo sapiens
gaccgugagucccucuaca

SEQ ID NO: 88222 - RNA, 19 nt, Homo sapiens
ggugaaggcagucgacuac

SEQ ID NO: 88223 - RNA, 19 nt, Homo sapiens
gguccgacaaagacaauga

SEQ ID NO: 88224 - RNA, 19 nt, Homo sapiens
cgcagcagcucgugaggau

SEQ ID NO: 88225 - RNA, 19 nt, Homo sapiens
uccaacacguccaucauca

SEQ ID NO: 88226 - RNA, 19 nt, Homo sapiens
ccagacagcagagaaaugg

SEQ ID NO: 88227 - RNA, 19 nt, Homo sapiens
gcccauaaugaggaucuua

SEQ ID NO: 88228 - RNA, 19 nt, Homo sapiens
gcuggguucucugaagaug

SEQ ID NO: 88229 - RNA, 19 nt, Homo sapiens
gucaaggugugcccaugug

SEQ ID NO: 88230 - RNA, 19 nt, Homo sapiens
gauacucaaagcugucaga

SEQ ID NO: 88231 - RNA, 19 nt, Homo sapiens
uggaaggaaaucucaacua

SEQ ID NO: 88232 - RNA, 19 nt, Homo sapiens
cuggagauaucgucacagu

SEQ ID NO: 88233 - RNA, 19 nt, Homo sapiens
cauaaugaggaucuuacaa

SEQ ID NO: 88234 - RNA, 19 nt, Homo sapiens
ucuucgagcugcccuuugu

SEQ ID NO: 88235 - RNA, 19 nt, Homo sapiens
gaaugacaacccgccagaa

SEQ ID NO: 88236 - RNA, 19 nt, Homo sapiens
acaagccgcagaaaggaaa

SEQ ID NO: 88237 - RNA, 19 nt, Homo sapiens
gccaggcaccuacgugaug

SEQ ID NO: 88238 - RNA, 19 nt, Homo sapiens
gggaggagcugcuguauua

SEQ ID NO: 88239 - RNA, 19 nt, Homo sapiens
ggaaauggcuuauuaaacu

SEQ ID NO: 88240 - RNA, 19 nt, Homo sapiens
gcacauugaugaagagaaa

SEQ ID NO: 88241 - RNA, 19 nt, Homo sapiens
ucagggaaauggcuuauua

SEQ ID NO: 88242 - RNA, 19 nt, Homo sapiens
gaauauaugucagugauga

SEQ ID NO: 88243 - RNA, 19 nt, Homo sapiens
gcaaaggccuggacagcuu

SEQ ID NO: 88244 - RNA, 19 nt, Homo sapiens
ggaaccagaugcacauuga

SEQ ID NO: 88245 - RNA, 19 nt, Homo sapiens
agaaagaacuggacagaga

SEQ ID NO: 88246 - RNA, 19 nt, Homo sapiens
ccaugaagccucuggauua

SEQ ID NO: 88247 - RNA, 19 nt, Homo sapiens
gagagaagcaggccaggua

SEQ ID NO: 88248 - RNA, 19 nt, Homo sapiens
aguaauugcucuacagaua

SEQ ID NO: 88249 - RNA, 19 nt, Homo sapiens
accaauaacuagcuucuua

SEQ ID NO: 88250 - RNA, 19 nt, Homo sapiens
ugaagccucuggauuauga

SEQ ID NO: 88251 - RNA, 19 nt, Homo sapiens
ccaggacgcuuucaccauu

SEQ ID NO: 88252 - RNA, 19 nt, Homo sapiens
caugacaaguacuguauuu

SEQ ID NO: 88253 - RNA, 19 nt, Homo sapiens
gccaauccaugcucucuuu

SEQ ID NO: 88254 - RNA, 19 nt, Homo sapiens
caacaucacagucaaguau

SEQ ID NO: 88255 - RNA, 19 nt, Homo sapiens
ccaaguaccugcucaaagg

SEQ ID NO: 88256 - RNA, 19 nt, Homo sapiens
aaacagagcccaggucauu

SEQ ID NO: 88257 - RNA, 19 nt, Homo sapiens
gcaaacacaccuuggagaa

SEQ ID NO: 88258 - RNA, 19 nt, Homo sapiens
ccaccucacugcugucauu

SEQ ID NO: 88259 - RNA, 19 nt, Homo sapiens
ggaccgagguucccacucu

SEQ ID NO: 88260 - RNA, 19 nt, Homo sapiens
ugcaagggauuguagauaa

SEQ ID NO: 88261 - RNA, 19 nt, Homo sapiens
gagcugagaccuugcuuug

SEQ ID NO: 88262 - RNA, 19 nt, Homo sapiens
ugacguggauuacgacuuc

SEQ ID NO: 88263 - RNA, 19 nt, Homo sapiens
augaauacauccagcaaua

SEQ ID NO: 88264 - RNA, 19 nt, Homo sapiens
gaaagaacuggacagagaa

SEQ ID NO: 88265 - RNA, 19 nt, Homo sapiens
agacaucaaugacaacuuc

SEQ ID NO: 88266 - RNA, 19 nt, Homo sapiens
aagcaacugugaauucauu

SEQ ID NO: 88267 - RNA, 19 nt, Homo sapiens
guaauugcucuacagauaa

SEQ ID NO: 88268 - RNA, 19 nt, Homo sapiens
ggacauaacaccacgaaac

SEQ ID NO: 88269 - RNA, 19 nt, Homo sapiens
ggaccucagucaucucugu

SEQ ID NO: 88270 - RNA, 19 nt, Homo sapiens
gagaauaugugggcaaggu

SEQ ID NO: 88271 - RNA, 19 nt, Homo sapiens
cauaauaagcagguuguua

SEQ ID NO: 88272 - RNA, 19 nt, Homo sapiens
gcugagaccuugcuuugag

SEQ ID NO: 88273 - RNA, 19 nt, Homo sapiens
gcucagacauccacauaac

SEQ ID NO: 88274 - RNA, 19 nt, Homo sapiens
gagcccaggucauuaucaa

SEQ ID NO: 88275 - RNA, 19 nt, Homo sapiens
aaagagagauuggauuugg

SEQ ID NO: 88276 - RNA, 19 nt, Homo sapiens
caagggagacugaccauca

SEQ ID NO: 88277 - RNA, 19 nt, Homo sapiens
gcaagagcgugccggagau

SEQ ID NO: 88278 - RNA, 19 nt, Homo sapiens
ucacggauaaucacgauaa

SEQ ID NO: 88279 - RNA, 19 nt, Homo sapiens
gcaaguccacauugaaguu

SEQ ID NO: 88280 - RNA, 19 nt, Homo sapiens
gcaauagacaaggacauaa

SEQ ID NO: 88281 - RNA, 19 nt, Homo sapiens
cgauaauucuggacguauu

SEQ ID NO: 88282 - RNA, 19 nt, Homo sapiens
ggacaaggacacuggugaa

SEQ ID NO: 88283 - RNA, 19 nt, Homo sapiens
gaaguggcaucagucaaca

SEQ ID NO: 88284 - RNA, 19 nt, Homo sapiens
aaacacaccuuggagaagu

SEQ ID NO: 88285 - RNA, 19 nt, Homo sapiens
agaaccggaugaccaagua

SEQ ID NO: 88286 - RNA, 19 nt, Homo sapiens
gaauacauccagcaauaca

SEQ ID NO: 88287 - RNA, 19 nt, Homo sapiens
caugaagccucuggauuau

SEQ ID NO: 88288 - RNA, 19 nt, Homo sapiens
ggagacguguucgccauug

SEQ ID NO: 88289 - RNA, 19 nt, Homo sapiens
gcucaaaggagaauaugug

SEQ ID NO: 88290 - RNA, 19 nt, Homo sapiens
uggccaaacuggugcauga

SEQ ID NO: 88291 - RNA, 19 nt, Homo sapiens
gcagguuguuauuuagguu

SEQ ID NO: 88292 - RNA, 19 nt, Homo sapiens
gcaagggauuguagauaac

SEQ ID NO: 88293 - RNA, 19 nt, Homo sapiens
uagcaaaacuggacaaugu

SEQ ID NO: 88294 - RNA, 19 nt, Homo sapiens
gggcucagacauccacaua

SEQ ID NO: 88295 - RNA, 19 nt, Homo sapiens
gagcauccaggcaguggua

SEQ ID NO: 88296 - RNA, 19 nt, Homo sapiens
caaaagagagauuggauuu

SEQ ID NO: 88297 - RNA, 19 nt, Homo sapiens
ugaugacuauucucaaaug

SEQ ID NO: 88298 - RNA, 19 nt, Homo sapiens
ccaaacuggugcaugacaa

SEQ ID NO: 88299 - RNA, 19 nt, Homo sapiens
gaaccacauucagggaaau

SEQ ID NO: 88300 - RNA, 19 nt, Homo sapiens
cauggcagcuccugaccuu

SEQ ID NO: 88301 - RNA, 19 nt, Homo sapiens
uaagcagguuguuauuuag

SEQ ID NO: 88302 - RNA, 19 nt, Homo sapiens
gauguggccuuuagcaaaa

SEQ ID NO: 88303 - RNA, 19 nt, Homo sapiens
gagauuggauuuggaacca

SEQ ID NO: 88304 - RNA, 19 nt, Homo sapiens
agaagaagccucugauugg

SEQ ID NO: 88305 - RNA, 19 nt, Homo sapiens
gccgagccaugugucuuua

SEQ ID NO: 88306 - RNA, 19 nt, Homo sapiens
acgagcagcuggucaccua

SEQ ID NO: 88307 - RNA, 19 nt, Homo sapiens
gcagaucuccgcaauagac

SEQ ID NO: 88308 - RNA, 19 nt, Homo sapiens
ggccaguucuuccgaguca

SEQ ID NO: 88309 - RNA, 19 nt, Homo sapiens
gagacguguucgccauuga

SEQ ID NO: 88310 - RNA, 19 nt, Homo sapiens
acaccucgcuguugucaca

SEQ ID NO: 88311 - RNA, 19 nt, Homo sapiens
agugaugacuauucucaaa

SEQ ID NO: 88312 - RNA, 19 nt, Homo sapiens
cugcagaucuccgcaauag

SEQ ID NO: 88313 - RNA, 19 nt, Homo sapiens
acgcaucgguuguucaaug

SEQ ID NO: 88314 - RNA, 19 nt, Homo sapiens
aaacaauuccuguaaccuu

SEQ ID NO: 88315 - RNA, 19 nt, Homo sapiens
ugaucgaggugaagaagga

SEQ ID NO: 88316 - RNA, 19 nt, Homo sapiens
gauaacacggccaacauca

SEQ ID NO: 88317 - RNA, 19 nt, Homo sapiens
gaauacugagaacaacuuu

SEQ ID NO: 88318 - RNA, 19 nt, Homo sapiens
ccacgccucugucauguac

SEQ ID NO: 88319 - RNA, 19 nt, Homo sapiens
uggcaucagucaacagaga

SEQ ID NO: 88320 - RNA, 19 nt, Homo sapiens
ggagaaguggcaucaguca

SEQ ID NO: 88321 - RNA, 19 nt, Homo sapiens
gcaacgagcagggcgaguu

SEQ ID NO: 88322 - RNA, 19 nt, Homo sapiens
ucugugggcucucuguuug

SEQ ID NO: 88323 - RNA, 19 nt, Homo sapiens
cccaagauguggccuuuag

SEQ ID NO: 88324 - RNA, 19 nt, Homo sapiens
cuccuuaucccuugguuua

SEQ ID NO: 88325 - RNA, 19 nt, Homo sapiens
ugcaagacaucaaugacaa

SEQ ID NO: 88326 - RNA, 19 nt, Homo sapiens
caguggagaucaggaguga

SEQ ID NO: 88327 - RNA, 19 nt, Homo sapiens
uaacacggccaacaucaca

SEQ ID NO: 88328 - RNA, 19 nt, Homo sapiens
cuggacagcuugacuugug

SEQ ID NO: 88329 - RNA, 19 nt, Homo sapiens
aagaauccauugugcaagu

SEQ ID NO: 88330 - RNA, 19 nt, Homo sapiens
gcgacuaccaggacgcuuu

SEQ ID NO: 88331 - RNA, 19 nt, Homo sapiens
gaccacgccucugucaugu

SEQ ID NO: 88332 - RNA, 19 nt, Homo sapiens
cagcuucaccaucaaaguu

SEQ ID NO: 88333 - RNA, 19 nt, Homo sapiens
gauuacgacuuccuuaacg

SEQ ID NO: 88334 - RNA, 19 nt, Homo sapiens
gcaagaaugccaaguaccu

SEQ ID NO: 88335 - RNA, 19 nt, Homo sapiens
ggcagugguagccaucuua

SEQ ID NO: 88336 - RNA, 19 nt, Homo sapiens
gaacuggacagagaagucu

SEQ ID NO: 88337 - RNA, 19 nt, Homo sapiens
caauuccuguaaccuucua

SEQ ID NO: 88338 - RNA, 19 nt, Homo sapiens
ggagaucucuucauuauua

SEQ ID NO: 88339 - RNA, 19 nt, Homo sapiens
gcaauuagccucauaguua

SEQ ID NO: 88340 - RNA, 19 nt, Homo sapiens
ggaaaccucuacauauuua

SEQ ID NO: 88341 - RNA, 19 nt, Homo sapiens
ggacugugcuuuaaagaua

SEQ ID NO: 88342 - RNA, 19 nt, Homo sapiens
caacugaacugaacuaauc

SEQ ID NO: 88343 - RNA, 19 nt, Homo sapiens
ggagggaaauagcuaauaa

SEQ ID NO: 88344 - RNA, 19 nt, Homo sapiens
ggagauggaucacuuaaau

SEQ ID NO: 88345 - RNA, 19 nt, Homo sapiens
ugaaguggcuauuucuuua

SEQ ID NO: 88346 - RNA, 19 nt, Homo sapiens
gaaaguguauacccuuaaa

SEQ ID NO: 88347 - RNA, 19 nt, Homo sapiens
guaaugaucucaaacuaug

SEQ ID NO: 88348 - RNA, 19 nt, Homo sapiens
gcacaacauuacagugaua

SEQ ID NO: 88349 - RNA, 19 nt, Homo sapiens
caaacuggccuacaucuua

SEQ ID NO: 88350 - RNA, 19 nt, Homo sapiens
caacagagaucaauaaucc

SEQ ID NO: 88351 - RNA, 19 nt, Homo sapiens
gaacugaacuaauccuucu

SEQ ID NO: 88352 - RNA, 19 nt, Homo sapiens
gacagaauauucaacauug

SEQ ID NO: 88353 - RNA, 19 nt, Homo sapiens
caaauccacccauauguua

SEQ ID NO: 88354 - RNA, 19 nt, Homo sapiens
aagagaagaugcucagaua

SEQ ID NO: 88355 - RNA, 19 nt, Homo sapiens
caggagaucucuucauuau

SEQ ID NO: 88356 - RNA, 19 nt, Homo sapiens
caacauugauucuggaaau

SEQ ID NO: 88357 - RNA, 19 nt, Homo sapiens
gaaauugaguacagcauca

SEQ ID NO: 88358 - RNA, 19 nt, Homo sapiens
gaacagugcuaaaguuguc

SEQ ID NO: 88359 - RNA, 19 nt, Homo sapiens
gccuacaucuuacaaauaa

SEQ ID NO: 88360 - RNA, 19 nt, Homo sapiens
gagaagaugcucagauaaa

SEQ ID NO: 88361 - RNA, 19 nt, Homo sapiens
caaugacaaugaaccaaua

SEQ ID NO: 88362 - RNA, 19 nt, Homo sapiens
gaagcaaauuaaacgguaa

SEQ ID NO: 88363 - RNA, 19 nt, Homo sapiens
cagaguacauaccaguuua

SEQ ID NO: 88364 - RNA, 19 nt, Homo sapiens
gaaauuccagcguacuaua

SEQ ID NO: 88365 - RNA, 19 nt, Homo sapiens
ggaugcagaucaagacuau

SEQ ID NO: 88366 - RNA, 19 nt, Homo sapiens
gaacuuaccgcuacuucuu

SEQ ID NO: 88367 - RNA, 19 nt, Homo sapiens
gcacuuaucauuagaaucu

SEQ ID NO: 88368 - RNA, 19 nt, Homo sapiens
ggacagaauauucaacauu

SEQ ID NO: 88369 - RNA, 19 nt, Homo sapiens
gcucaaacuuuaccauuca

SEQ ID NO: 88370 - RNA, 19 nt, Homo sapiens
ucgaguaccucuauauauu

SEQ ID NO: 88371 - RNA, 19 nt, Homo sapiens
ugacaucaaugacaaugaa

SEQ ID NO: 88372 - RNA, 19 nt, Homo sapiens
caagauccaugacaucaau

SEQ ID NO: 88373 - RNA, 19 nt, Homo sapiens
ccaauacgacacugaaaua

SEQ ID NO: 88374 - RNA, 19 nt, Homo sapiens
cauagaggacaacaaauua

SEQ ID NO: 88375 - RNA, 19 nt, Homo sapiens
ucaguaggcuaaugucaaa

SEQ ID NO: 88376 - RNA, 19 nt, Homo sapiens
ggacaucagagauaacauu

SEQ ID NO: 88377 - RNA, 19 nt, Homo sapiens
acacagauauggacagaau

SEQ ID NO: 88378 - RNA, 19 nt, Homo sapiens
acacacuguuguuuaguua

SEQ ID NO: 88379 - RNA, 19 nt, Homo sapiens
caauuagccucauaguuau

SEQ ID NO: 88380 - RNA, 19 nt, Homo sapiens
gaacaguauuuccacuugu

SEQ ID NO: 88381 - RNA, 19 nt, Homo sapiens
gcaggagaucucuucauua

SEQ ID NO: 88382 - RNA, 19 nt, Homo sapiens
caacaccgaugucagagau

SEQ ID NO: 88383 - RNA, 19 nt, Homo sapiens
cccaagagcugcaguuuca

SEQ ID NO: 88384 - RNA, 19 nt, Homo sapiens
ggaguucaguggagagguu

SEQ ID NO: 88385 - RNA, 19 nt, Homo sapiens
gaaaguagcagugugaagu

SEQ ID NO: 88386 - RNA, 19 nt, Homo sapiens
gaugagcaccuaucucuug

SEQ ID NO: 88387 - RNA, 19 nt, Homo sapiens
gaucaauaauccaaagcaa

SEQ ID NO: 88388 - RNA, 19 nt, Homo sapiens
guagaucgacacacagaua

SEQ ID NO: 88389 - RNA, 19 nt, Homo sapiens
cuggaaaccucuacauauu

SEQ ID NO: 88390 - RNA, 19 nt, Homo sapiens
gggcauaucggcucacaaa

SEQ ID NO: 88391 - RNA, 19 nt, Homo sapiens
gacaaagacuccuaaucug

SEQ ID NO: 88392 - RNA, 19 nt, Homo sapiens
cgaguaccucuauauauua

SEQ ID NO: 88393 - RNA, 19 nt, Homo sapiens
aaaguugucuacaguauuc

SEQ ID NO: 88394 - RNA, 19 nt, Homo sapiens
gcagugugaaguacaauaa

SEQ ID NO: 88395 - RNA, 19 nt, Homo sapiens
gcauaucggcucacaaaga

SEQ ID NO: 88396 - RNA, 19 nt, Homo sapiens
gaugucagagauuucauua

SEQ ID NO: 88397 - RNA, 19 nt, Homo sapiens
aagaaaguguauacccuua

SEQ ID NO: 88398 - RNA, 19 nt, Homo sapiens
gauguggaaucaguucuuu

SEQ ID NO: 88399 - RNA, 19 nt, Homo sapiens
uuaagaauaugcugacuuc

SEQ ID NO: 88400 - RNA, 19 nt, Homo sapiens
caaauuaaacgguaacauc

SEQ ID NO: 88401 - RNA, 19 nt, Homo sapiens
ugacaaagacuccuaaucu

SEQ ID NO: 88402 - RNA, 19 nt, Homo sapiens
aaagaggacaucagagaua

SEQ ID NO: 88403 - RNA, 19 nt, Homo sapiens
caaguacucuguagaucga

SEQ ID NO: 88404 - RNA, 19 nt, Homo sapiens
uaucacgggucacuugaaa

SEQ ID NO: 88405 - RNA, 19 nt, Homo sapiens
ccaaagaggacaucagaga

SEQ ID NO: 88406 - RNA, 19 nt, Homo sapiens
ucagauaaacaccacaaua

SEQ ID NO: 88407 - RNA, 19 nt, Homo sapiens
cagccacacuugaaccuaa

SEQ ID NO: 88408 - RNA, 19 nt, Homo sapiens
auacgacacugaaauaugu

SEQ ID NO: 88409 - RNA, 19 nt, Homo sapiens
caaagacuccuaaucuguu

SEQ ID NO: 88410 - RNA, 19 nt, Homo sapiens
ccauagaggacaacaaauu

SEQ ID NO: 88411 - RNA, 19 nt, Homo sapiens
caucagagauaacauuguc

SEQ ID NO: 88412 - RNA, 19 nt, Homo sapiens
gaauugugguggaggaugu

SEQ ID NO: 88413 - RNA, 19 nt, Homo sapiens
gagauggaucacuuaaaua

SEQ ID NO: 88414 - RNA, 19 nt, Homo sapiens
augcugacuucacuuauua

SEQ ID NO: 88415 - RNA, 19 nt, Homo sapiens
acacgacuaaguugaauua

SEQ ID NO: 88416 - RNA, 19 nt, Homo sapiens
uagaggagauggaucacuu

SEQ ID NO: 88417 - RNA, 19 nt, Homo sapiens
cuacuauacuguacaugaa

SEQ ID NO: 88418 - RNA, 19 nt, Homo sapiens
ccguguggauccaauguua

SEQ ID NO: 88419 - RNA, 19 nt, Homo sapiens
ggaggaaugaggcuggaua

SEQ ID NO: 88420 - RNA, 19 nt, Homo sapiens
caagacagcuuugcucaac

SEQ ID NO: 88421 - RNA, 19 nt, Homo sapiens
cuaaaguugucuacaguau

SEQ ID NO: 88422 - RNA, 19 nt, Homo sapiens
ggacccaacugaacugaac

SEQ ID NO: 88423 - RNA, 19 nt, Homo sapiens
guacauuuguuguccaagu

SEQ ID NO: 88424 - RNA, 19 nt, Homo sapiens
aaguaaagauggaaacguu

SEQ ID NO: 88425 - RNA, 19 nt, Homo sapiens
uaaaagaaaugagggcaua

SEQ ID NO: 88426 - RNA, 19 nt, Homo sapiens
ucaagacuaugauuaccuu

SEQ ID NO: 88427 - RNA, 19 nt, Homo sapiens
ggacaccaauuuucguuuu

SEQ ID NO: 88428 - RNA, 19 nt, Homo sapiens
gggagaaaaugcugaaauu

SEQ ID NO: 88429 - RNA, 19 nt, Homo sapiens
ggacaccaauuggcagaau

SEQ ID NO: 88430 - RNA, 19 nt, Homo sapiens
aaacagguauuaucaagac

SEQ ID NO: 88431 - RNA, 19 nt, Homo sapiens
gaaacagguauuaucaaga

SEQ ID NO: 88432 - RNA, 19 nt, Homo sapiens
ggauagaggagauggauca

SEQ ID NO: 88433 - RNA, 19 nt, Homo sapiens
ucaaagaggacuagugguu

SEQ ID NO: 88434 - RNA, 19 nt, Homo sapiens
caacugcccuaacuguaca

SEQ ID NO: 88435 - RNA, 19 nt, Homo sapiens
ucucucaacuccacuauca

SEQ ID NO: 88436 - RNA, 19 nt, Homo sapiens
aaagcaaaguagucgagua

SEQ ID NO: 88437 - RNA, 19 nt, Homo sapiens
caaagaggacuagugguuu

SEQ ID NO: 88438 - RNA, 19 nt, Homo sapiens
gauagaagcugcaaauaaa

SEQ ID NO: 88439 - RNA, 19 nt, Homo sapiens
uaacugaugucaacgauaa

SEQ ID NO: 88440 - RNA, 19 nt, Homo sapiens
gagagauacuucaauauug

SEQ ID NO: 88441 - RNA, 19 nt, Homo sapiens
gaaauggaguacaagauug

SEQ ID NO: 88442 - RNA, 19 nt, Homo sapiens
ucacucagcucuuuagauu

SEQ ID NO: 88443 - RNA, 19 nt, Homo sapiens
uaggaaagcuucacucuga

SEQ ID NO: 88444 - RNA, 19 nt, Homo sapiens
ggaugugacuccagaaauu

SEQ ID NO: 88445 - RNA, 19 nt, Homo sapiens
ggauagaagcugcaaauaa

SEQ ID NO: 88446 - RNA, 19 nt, Homo sapiens
ggagagauacuucaauauu

SEQ ID NO: 88447 - RNA, 19 nt, Homo sapiens
ugacauggcugcacugaga

SEQ ID NO: 88448 - RNA, 19 nt, Homo sapiens
gaaagagacaucagagaaa

SEQ ID NO: 88449 - RNA, 19 nt, Homo sapiens
acacagacuuggagagaua

SEQ ID NO: 88450 - RNA, 19 nt, Homo sapiens
caacggaugcaacaaauaa

SEQ ID NO: 88451 - RNA, 19 nt, Homo sapiens
gaagauaauuguggaagau

SEQ ID NO: 88452 - RNA, 19 nt, Homo sapiens
gaauaucauuggcacugua

SEQ ID NO: 88453 - RNA, 19 nt, Homo sapiens
gaaggaaucauuacuauac

SEQ ID NO: 88454 - RNA, 19 nt, Homo sapiens
ucgaaggucuuaucaauau

SEQ ID NO: 88455 - RNA, 19 nt, Homo sapiens
caacgacaaugaacccaaa

SEQ ID NO: 88456 - RNA, 19 nt, Homo sapiens
ggaacaaucaguuuacuau

SEQ ID NO: 88457 - RNA, 19 nt, Homo sapiens
caacacagccucaauacug

SEQ ID NO: 88458 - RNA, 19 nt, Homo sapiens
gaauccaucucaaguagga

SEQ ID NO: 88459 - RNA, 19 nt, Homo sapiens
cgacaacugugaagauaau

SEQ ID NO: 88460 - RNA, 19 nt, Homo sapiens
ugaaggaaauggcucaguu

SEQ ID NO: 88461 - RNA, 19 nt, Homo sapiens
caacaaauaaccacaacuu

SEQ ID NO: 88462 - RNA, 19 nt, Homo sapiens
gacaaaugcuauucacaau

SEQ ID NO: 88463 - RNA, 19 nt, Homo sapiens
ggaaggaaucauuacuaua

SEQ ID NO: 88464 - RNA, 19 nt, Homo sapiens
ccaccucgcuuuccucgaa

SEQ ID NO: 88465 - RNA, 19 nt, Homo sapiens
gaucaaagcccuauuucca

SEQ ID NO: 88466 - RNA, 19 nt, Homo sapiens
gaacuaugacuaccuaagu

SEQ ID NO: 88467 - RNA, 19 nt, Homo sapiens
ucagaacuaugacuaccua

SEQ ID NO: 88468 - RNA, 19 nt, Homo sapiens
uaacaacggaugcaacaaa

SEQ ID NO: 88469 - RNA, 19 nt, Homo sapiens
cgacaaugaacccaaauuu

SEQ ID NO: 88470 - RNA, 19 nt, Homo sapiens
gacaggaacaaucaguuua

SEQ ID NO: 88471 - RNA, 19 nt, Homo sapiens
ggagugggcugugauugga

SEQ ID NO: 88472 - RNA, 19 nt, Homo sapiens
gguacucaauugacagaaa

SEQ ID NO: 88473 - RNA, 19 nt, Homo sapiens
ccaauagcccugugaggua

SEQ ID NO: 88474 - RNA, 19 nt, Homo sapiens
ccucgaaggucuuaucaau

SEQ ID NO: 88475 - RNA, 19 nt, Homo sapiens
ggaggacugucaggaacua

SEQ ID NO: 88476 - RNA, 19 nt, Homo sapiens
ccagaguggucuacaguau

SEQ ID NO: 88477 - RNA, 19 nt, Homo sapiens
gaaccuuaauucgaaaugu

SEQ ID NO: 88478 - RNA, 19 nt, Homo sapiens
uuggagagauacuucaaua

SEQ ID NO: 88479 - RNA, 19 nt, Homo sapiens
ccaacacucuacagauuau

SEQ ID NO: 88480 - RNA, 19 nt, Homo sapiens
ggacuggccaagagaguuu

SEQ ID NO: 88481 - RNA, 19 nt, Homo sapiens
agacaacacagccucaaua

SEQ ID NO: 88482 - RNA, 19 nt, Homo sapiens
cagaauccaucucaaguag

SEQ ID NO: 88483 - RNA, 19 nt, Homo sapiens
ucacaacugccaagucuuu

SEQ ID NO: 88484 - RNA, 19 nt, Homo sapiens
ugaaauggaguacaagauu

SEQ ID NO: 88485 - RNA, 19 nt, Homo sapiens
ucaaagcccuauuuccaau

SEQ ID NO: 88486 - RNA, 19 nt, Homo sapiens
caucacaacugccaagucu

SEQ ID NO: 88487 - RNA, 19 nt, Homo sapiens
cacgacaacugugaagaua

SEQ ID NO: 88488 - RNA, 19 nt, Homo sapiens
agaaggagcuggauuuuga

SEQ ID NO: 88489 - RNA, 19 nt, Homo sapiens
caaagaaacccaggaagga

SEQ ID NO: 88490 - RNA, 19 nt, Homo sapiens
uaacgucccagagucauua

SEQ ID NO: 88491 - RNA, 19 nt, Homo sapiens
ggcaggaguucccgaaaug

SEQ ID NO: 88492 - RNA, 19 nt, Homo sapiens
gaaggaaauggcucaguug

SEQ ID NO: 88493 - RNA, 19 nt, Homo sapiens
ggaauuuauuugggaaaga

SEQ ID NO: 88494 - RNA, 19 nt, Homo sapiens
gacccagauucuuccaaua

SEQ ID NO: 88495 - RNA, 19 nt, Homo sapiens
ggugaugguuugggcauuu

SEQ ID NO: 88496 - RNA, 19 nt, Homo sapiens
caacuggaacugugccuuu

SEQ ID NO: 88497 - RNA, 19 nt, Homo sapiens
ucauagccuuggaaccuua

SEQ ID NO: 88498 - RNA, 19 nt, Homo sapiens
ucagugcuguggauaaaga

SEQ ID NO: 88499 - RNA, 19 nt, Homo sapiens
uggauaggcucaccaacaa

SEQ ID NO: 88500 - RNA, 19 nt, Homo sapiens
ucacucugauguugauaaa

SEQ ID NO: 88501 - RNA, 19 nt, Homo sapiens
gaaaaucagugcuguggau

SEQ ID NO: 88502 - RNA, 19 nt, Homo sapiens
ucacaguccuugcaaugga

SEQ ID NO: 88503 - RNA, 19 nt, Homo sapiens
cgaaggucuuaucaauaua

SEQ ID NO: 88504 - RNA, 19 nt, Homo sapiens
ccagaucaaagcccuauuu

SEQ ID NO: 88505 - RNA, 19 nt, Homo sapiens
gauaauuguggaagaugua

SEQ ID NO: 88506 - RNA, 19 nt, Homo sapiens
gagcuaaugcugaaaugga

SEQ ID NO: 88507 - RNA, 19 nt, Homo sapiens
ggaggacacggaagcguuu

SEQ ID NO: 88508 - RNA, 19 nt, Homo sapiens
agaaagagacaucagagaa

SEQ ID NO: 88509 - RNA, 19 nt, Homo sapiens
ugacagaaacacagacuug

SEQ ID NO: 88510 - RNA, 19 nt, Homo sapiens
ggaccucagugguacaagu

SEQ ID NO: 88511 - RNA, 19 nt, Homo sapiens
ggauaucaacgacaaugaa

SEQ ID NO: 88512 - RNA, 19 nt, Homo sapiens
gugaggagcaggccuacua

SEQ ID NO: 88513 - RNA, 19 nt, Homo sapiens
cuuggaaccuuaauucgaa

SEQ ID NO: 88514 - RNA, 19 nt, Homo sapiens
gcagacauaugcuuuugaa

SEQ ID NO: 88515 - RNA, 19 nt, Homo sapiens
aaucagugcuguggauaaa

SEQ ID NO: 88516 - RNA, 19 nt, Homo sapiens
ccagaauccaucucaagua

SEQ ID NO: 88517 - RNA, 19 nt, Homo sapiens
caauauugaugccaacagu

SEQ ID NO: 88518 - RNA, 19 nt, Homo sapiens
ugaagauaauuguggaaga

SEQ ID NO: 88519 - RNA, 19 nt, Homo sapiens
ucaguuguggccagaauua

SEQ ID NO: 88520 - RNA, 19 nt, Homo sapiens
gguguggaaucaguucuuu

SEQ ID NO: 88521 - RNA, 19 nt, Homo sapiens
gcagcuggguguggaauca

SEQ ID NO: 88522 - RNA, 19 nt, Homo sapiens
aaaguggaguucugccauu

SEQ ID NO: 88523 - RNA, 19 nt, Homo sapiens
cagcaguggugaccucuuc

SEQ ID NO: 88524 - RNA, 19 nt, Homo sapiens
agacaaaugcuauucacaa

SEQ ID NO: 88525 - RNA, 19 nt, Homo sapiens
ggaauaucauuggcacugu

SEQ ID NO: 88526 - RNA, 19 nt, Homo sapiens
aggaaggaaucauuacuau

SEQ ID NO: 88527 - RNA, 19 nt, Homo sapiens
guggugaccucuuccaauc

SEQ ID NO: 88528 - RNA, 19 nt, Homo sapiens
gacccuaacugaugucaac

SEQ ID NO: 88529 - RNA, 19 nt, Homo sapiens
agaguggucuacaguauuc

SEQ ID NO: 88530 - RNA, 19 nt, Homo sapiens
gcaaguuccauuuucauua

SEQ ID NO: 88531 - RNA, 19 nt, Homo sapiens
ggaaucauuacuauacaga

SEQ ID NO: 88532 - RNA, 19 nt, Homo sapiens
aauuaaagcugcugaugca

SEQ ID NO: 88533 - RNA, 19 nt, Homo sapiens
gcaaugcagaggccuaugu

SEQ ID NO: 88534 - RNA, 19 nt, Homo sapiens
ucacuuagcagcaccaaca

SEQ ID NO: 88535 - RNA, 19 nt, Homo sapiens
ggaucucccucacuuagca

SEQ ID NO: 88536 - RNA, 19 nt, Homo sapiens
gaacaaucaguuuacuauc

SEQ ID NO: 88537 - RNA, 19 nt, Homo sapiens
caggaaggaaucauuacua

SEQ ID NO: 88538 - RNA, 19 nt, Homo sapiens
gauagaagcugcaaauaaa

SEQ ID NO: 88539 - RNA, 19 nt, Homo sapiens
uaacugaugucaacgauaa

SEQ ID NO: 88540 - RNA, 19 nt, Homo sapiens
gagagauacuucaauauug

SEQ ID NO: 88541 - RNA, 19 nt, Homo sapiens
gaaauggaguacaagauug

SEQ ID NO: 88542 - RNA, 19 nt, Homo sapiens
ucacucagcucuuuagauu

SEQ ID NO: 88543 - RNA, 19 nt, Homo sapiens
uaggaaagcuucacucuga

SEQ ID NO: 88544 - RNA, 19 nt, Homo sapiens
ggaugugacuccagaaauu

SEQ ID NO: 88545 - RNA, 19 nt, Homo sapiens
ggauagaagcugcaaauaa

SEQ ID NO: 88546 - RNA, 19 nt, Homo sapiens
ggagagauacuucaauauu

SEQ ID NO: 88547 - RNA, 19 nt, Homo sapiens
ugacauggcugcacugaga

SEQ ID NO: 88548 - RNA, 19 nt, Homo sapiens
gaaagagacaucagagaaa

SEQ ID NO: 88549 - RNA, 19 nt, Homo sapiens
acacagacuuggagagaua

SEQ ID NO: 88550 - RNA, 19 nt, Homo sapiens
caacggaugcaacaaauaa

SEQ ID NO: 88551 - RNA, 19 nt, Homo sapiens
gaagauaauuguggaagau

SEQ ID NO: 88552 - RNA, 19 nt, Homo sapiens
gaauaucauuggcacugua

SEQ ID NO: 88553 - RNA, 19 nt, Homo sapiens
gaaggaaucauuacuauac

SEQ ID NO: 88554 - RNA, 19 nt, Homo sapiens
ucgaaggucuuaucaauau

SEQ ID NO: 88555 - RNA, 19 nt, Homo sapiens
caacgacaaugaacccaaa

SEQ ID NO: 88556 - RNA, 19 nt, Homo sapiens
ggaacaaucaguuuacuau

SEQ ID NO: 88557 - RNA, 19 nt, Homo sapiens
caacacagccucaauacug

SEQ ID NO: 88558 - RNA, 19 nt, Homo sapiens
gaauccaucucaaguagga

SEQ ID NO: 88559 - RNA, 19 nt, Homo sapiens
cgacaacugugaagauaau

SEQ ID NO: 88560 - RNA, 19 nt, Homo sapiens
ugaaggaaauggcucaguu

SEQ ID NO: 88561 - RNA, 19 nt, Homo sapiens
caacaaauaaccacaacuu

SEQ ID NO: 88562 - RNA, 19 nt, Homo sapiens
gacaaaugcuauucacaau

SEQ ID NO: 88563 - RNA, 19 nt, Homo sapiens
ggaaggaaucauuacuaua

SEQ ID NO: 88564 - RNA, 19 nt, Homo sapiens
ccaccucgcuuuccucgaa

SEQ ID NO: 88565 - RNA, 19 nt, Homo sapiens
gaucaaagcccuauuucca

SEQ ID NO: 88566 - RNA, 19 nt, Homo sapiens
gaacuaugacuaccuaagu

SEQ ID NO: 88567 - RNA, 19 nt, Homo sapiens
ucagaacuaugacuaccua

SEQ ID NO: 88568 - RNA, 19 nt, Homo sapiens
uaacaacggaugcaacaaa

SEQ ID NO: 88569 - RNA, 19 nt, Homo sapiens
cgacaaugaacccaaauuu

SEQ ID NO: 88570 - RNA, 19 nt, Homo sapiens
gacaggaacaaucaguuua

SEQ ID NO: 88571 - RNA, 19 nt, Homo sapiens
gcaaaacuaucaagcaaga

SEQ ID NO: 88572 - RNA, 19 nt, Homo sapiens
gguacucaauugacagaaa

SEQ ID NO: 88573 - RNA, 19 nt, Homo sapiens
ccaauagcccugugaggua

SEQ ID NO: 88574 - RNA, 19 nt, Homo sapiens
ccucgaaggucuuaucaau

SEQ ID NO: 88575 - RNA, 19 nt, Homo sapiens
ggaggacugucaggaacua

SEQ ID NO: 88576 - RNA, 19 nt, Homo sapiens
ccagaguggucuacaguau

SEQ ID NO: 88577 - RNA, 19 nt, Homo sapiens
gaaccuuaauucgaaaugu

SEQ ID NO: 88578 - RNA, 19 nt, Homo sapiens
uuggagagauacuucaaua

SEQ ID NO: 88579 - RNA, 19 nt, Homo sapiens
ccaacacucuacagauuau

SEQ ID NO: 88580 - RNA, 19 nt, Homo sapiens
ggacuggccaagagaguuu

SEQ ID NO: 88581 - RNA, 19 nt, Homo sapiens
agacaacacagccucaaua

SEQ ID NO: 88582 - RNA, 19 nt, Homo sapiens
cagaauccaucucaaguag

SEQ ID NO: 88583 - RNA, 19 nt, Homo sapiens
ucacaacugccaagucuuu

SEQ ID NO: 88584 - RNA, 19 nt, Homo sapiens
ugaaauggaguacaagauu

SEQ ID NO: 88585 - RNA, 19 nt, Homo sapiens
ucaaagcccuauuuccaau

SEQ ID NO: 88586 - RNA, 19 nt, Homo sapiens
caucacaacugccaagucu

SEQ ID NO: 88587 - RNA, 19 nt, Homo sapiens
cacgacaacugugaagaua

SEQ ID NO: 88588 - RNA, 19 nt, Homo sapiens
agaaggagcuggauuuuga

SEQ ID NO: 88589 - RNA, 19 nt, Homo sapiens
caaagaaacccaggaagga

SEQ ID NO: 88590 - RNA, 19 nt, Homo sapiens
uaacgucccagagucauua

SEQ ID NO: 88591 - RNA, 19 nt, Homo sapiens
ggcaggaguucccgaaaug

SEQ ID NO: 88592 - RNA, 19 nt, Homo sapiens
gaaggaaauggcucaguug

SEQ ID NO: 88593 - RNA, 19 nt, Homo sapiens
ggaauuuauuugggaaaga

SEQ ID NO: 88594 - RNA, 19 nt, Homo sapiens
gacccagauucuuccaaua

SEQ ID NO: 88595 - RNA, 19 nt, Homo sapiens
ggugaugguuugggcauuu

SEQ ID NO: 88596 - RNA, 19 nt, Homo sapiens
caacuggaacugugccuuu

SEQ ID NO: 88597 - RNA, 19 nt, Homo sapiens
ucauagccuuggaaccuua

SEQ ID NO: 88598 - RNA, 19 nt, Homo sapiens
ucagugcuguggauaaaga

SEQ ID NO: 88599 - RNA, 19 nt, Homo sapiens
uggauaggcucaccaacaa

SEQ ID NO: 88600 - RNA, 19 nt, Homo sapiens
ucacucugauguugauaaa

SEQ ID NO: 88601 - RNA, 19 nt, Homo sapiens
gaaaaucagugcuguggau

SEQ ID NO: 88602 - RNA, 19 nt, Homo sapiens
ucacaguccuugcaaugga

SEQ ID NO: 88603 - RNA, 19 nt, Homo sapiens
cgaaggucuuaucaauaua

SEQ ID NO: 88604 - RNA, 19 nt, Homo sapiens
ccagaucaaagcccuauuu

SEQ ID NO: 88605 - RNA, 19 nt, Homo sapiens
gauaauuguggaagaugua

SEQ ID NO: 88606 - RNA, 19 nt, Homo sapiens
gagcuaaugcugaaaugga

SEQ ID NO: 88607 - RNA, 19 nt, Homo sapiens
ggaggacacggaagcguuu

SEQ ID NO: 88608 - RNA, 19 nt, Homo sapiens
agaaagagacaucagagaa

SEQ ID NO: 88609 - RNA, 19 nt, Homo sapiens
ugacagaaacacagacuug

SEQ ID NO: 88610 - RNA, 19 nt, Homo sapiens
ggaccucagugguacaagu

SEQ ID NO: 88611 - RNA, 19 nt, Homo sapiens
ggauaucaacgacaaugaa

SEQ ID NO: 88612 - RNA, 19 nt, Homo sapiens
gugaggagcaggccuacua

SEQ ID NO: 88613 - RNA, 19 nt, Homo sapiens
cuuggaaccuuaauucgaa

SEQ ID NO: 88614 - RNA, 19 nt, Homo sapiens
gcagacauaugcuuuugaa

SEQ ID NO: 88615 - RNA, 19 nt, Homo sapiens
aaucagugcuguggauaaa

SEQ ID NO: 88616 - RNA, 19 nt, Homo sapiens
ccagaauccaucucaagua

SEQ ID NO: 88617 - RNA, 19 nt, Homo sapiens
caauauugaugccaacagu

SEQ ID NO: 88618 - RNA, 19 nt, Homo sapiens
ugaagauaauuguggaaga

SEQ ID NO: 88619 - RNA, 19 nt, Homo sapiens
ucaguuguggccagaauua

SEQ ID NO: 88620 - RNA, 19 nt, Homo sapiens
gguguggaaucaguucuuu

SEQ ID NO: 88621 - RNA, 19 nt, Homo sapiens
gcagcuggguguggaauca

SEQ ID NO: 88622 - RNA, 19 nt, Homo sapiens
aaaguggaguucugccauu

SEQ ID NO: 88623 - RNA, 19 nt, Homo sapiens
agacaaaugcuauucacaa

SEQ ID NO: 88624 - RNA, 19 nt, Homo sapiens
ggaauaucauuggcacugu

SEQ ID NO: 88625 - RNA, 19 nt, Homo sapiens
aggaaggaaucauuacuau

SEQ ID NO: 88626 - RNA, 19 nt, Homo sapiens
gacccuaacugaugucaac

SEQ ID NO: 88627 - RNA, 19 nt, Homo sapiens
agaguggucuacaguauuc

SEQ ID NO: 88628 - RNA, 19 nt, Homo sapiens
gcaaguuccauuuucauua

SEQ ID NO: 88629 - RNA, 19 nt, Homo sapiens
cagcaguggugaccucuuc

SEQ ID NO: 88630 - RNA, 19 nt, Homo sapiens
guggugaccucuuccaauc

SEQ ID NO: 88631 - RNA, 19 nt, Homo sapiens
ggaaucauuacuauacaga

SEQ ID NO: 88632 - RNA, 19 nt, Homo sapiens
aauuaaagcugcugaugca

SEQ ID NO: 88633 - RNA, 19 nt, Homo sapiens
gcaaugcagaggccuaugu

SEQ ID NO: 88634 - RNA, 19 nt, Homo sapiens
ucacuuagcagcaccaaca

SEQ ID NO: 88635 - RNA, 19 nt, Homo sapiens
ggaucucccucacuuagca

SEQ ID NO: 88636 - RNA, 19 nt, Homo sapiens
gaacaaucaguuuacuauc

SEQ ID NO: 88637 - RNA, 19 nt, Homo sapiens
caggaaggaaucauuacua

SEQ ID NO: 88638 - RNA, 19 nt, Homo sapiens
ggacaaagaugaucccaaa

SEQ ID NO: 88639 - RNA, 19 nt, Homo sapiens
gaagauaauucccucagua

SEQ ID NO: 88640 - RNA, 19 nt, Homo sapiens
gagaggcaguucaacauua

SEQ ID NO: 88641 - RNA, 19 nt, Homo sapiens
gauaauucccucaguauuu

SEQ ID NO: 88642 - RNA, 19 nt, Homo sapiens
gaacugagcauucuguaau

SEQ ID NO: 88643 - RNA, 19 nt, Homo sapiens
ggagauauccaugcuauaa

SEQ ID NO: 88644 - RNA, 19 nt, Homo sapiens
caacaccacuugacagaga

SEQ ID NO: 88645 - RNA, 19 nt, Homo sapiens
caaccaauguggcuauuug

SEQ ID NO: 88646 - RNA, 19 nt, Homo sapiens
uggcagagcuguaaguaaa

SEQ ID NO: 88647 - RNA, 19 nt, Homo sapiens
gcaccagaguuucuuaaug

SEQ ID NO: 88648 - RNA, 19 nt, Homo sapiens
gugcaaaguugguuuauag

SEQ ID NO: 88649 - RNA, 19 nt, Homo sapiens
ucagauauauggcuaugaa

SEQ ID NO: 88650 - RNA, 19 nt, Homo sapiens
gaaaaccucuggacuuuga

SEQ ID NO: 88651 - RNA, 19 nt, Homo sapiens
gaaacuugacaguggauua

SEQ ID NO: 88652 - RNA, 19 nt, Homo sapiens
caaagaugaugaagacguu

SEQ ID NO: 88653 - RNA, 19 nt, Homo sapiens
gcucuaaacuccgugauug

SEQ ID NO: 88654 - RNA, 19 nt, Homo sapiens
gaaaugcucuuggaucucu

SEQ ID NO: 88655 - RNA, 19 nt, Homo sapiens
gcaaaguugguuuauagua

SEQ ID NO: 88656 - RNA, 19 nt, Homo sapiens
gcucggcacugcaugauga

SEQ ID NO: 88657 - RNA, 19 nt, Homo sapiens
guuaggagguuauaaaucu

SEQ ID NO: 88658 - RNA, 19 nt, Homo sapiens
gaaucagucucaaguuuua

SEQ ID NO: 88659 - RNA, 19 nt, Homo sapiens
uagcaccagucaucuauaa

SEQ ID NO: 88660 - RNA, 19 nt, Homo sapiens
cauauuagcaugcaucauu

SEQ ID NO: 88661 - RNA, 19 nt, Homo sapiens
gaaccacagucagauauca

SEQ ID NO: 88662 - RNA, 19 nt, Homo sapiens
gacagagaauuaaguguau

SEQ ID NO: 88663 - RNA, 19 nt, Homo sapiens
ccauaugacuccauucaga

SEQ ID NO: 88664 - RNA, 19 nt, Homo sapiens
ugacagagaauuaagugua

SEQ ID NO: 88665 - RNA, 19 nt, Homo sapiens
uagaaguccuuggauauuu

SEQ ID NO: 88666 - RNA, 19 nt, Homo sapiens
gaguaccuguugcuauuaa

SEQ ID NO: 88667 - RNA, 19 nt, Homo sapiens
gauaucacuuccaguccua

SEQ ID NO: 88668 - RNA, 19 nt, Homo sapiens
ugucgaagcuuauguccuu

SEQ ID NO: 88669 - RNA, 19 nt, Homo sapiens
caacauuaaugcagacgau

SEQ ID NO: 88670 - RNA, 19 nt, Homo sapiens
gcagagcuguaaguaaaug

SEQ ID NO: 88671 - RNA, 19 nt, Homo sapiens
gagugugaauuaaguaugu

SEQ ID NO: 88672 - RNA, 19 nt, Homo sapiens
cagauggaauuaauggauu

SEQ ID NO: 88673 - RNA, 19 nt, Homo sapiens
gaugaagacguucgagaaa

SEQ ID NO: 88674 - RNA, 19 nt, Homo sapiens
ggcccaggauggcauuaua

SEQ ID NO: 88675 - RNA, 19 nt, Homo sapiens
ccagucaucuauaaacuca

SEQ ID NO: 88676 - RNA, 19 nt, Homo sapiens
agaggcaguucaacauuaa

SEQ ID NO: 88677 - RNA, 19 nt, Homo sapiens
ugacaauccuccaaaauuu

SEQ ID NO: 88678 - RNA, 19 nt, Homo sapiens
guacaucugucacuaacgu

SEQ ID NO: 88679 - RNA, 19 nt, Homo sapiens
caccagaguuucuuaaugg

SEQ ID NO: 88680 - RNA, 19 nt, Homo sapiens
gagccuccuucugaauuua

SEQ ID NO: 88681 - RNA, 19 nt, Homo sapiens
ccaauguggcuauuuguuu

SEQ ID NO: 88682 - RNA, 19 nt, Homo sapiens
ugacaaugcaccagaguuu

SEQ ID NO: 88683 - RNA, 19 nt, Homo sapiens
gcuuauguccuuccaauug

SEQ ID NO: 88684 - RNA, 19 nt, Homo sapiens
caagucauucaaacuguua

SEQ ID NO: 88685 - RNA, 19 nt, Homo sapiens
gaagauaacgcuggcaaca

SEQ ID NO: 88686 - RNA, 19 nt, Homo sapiens
ggagauggaacagcacuuu

SEQ ID NO: 88687 - RNA, 19 nt, Homo sapiens
gaaggccaaugaucaggau

SEQ ID NO: 88688 - RNA, 19 nt, Homo sapiens
gaagggugaaggccaauga

SEQ ID NO: 88689 - RNA, 19 nt, Homo sapiens
gaggaguaccugguuguua

SEQ ID NO: 88690 - RNA, 19 nt, Homo sapiens
aaacugcccuucccaacau

SEQ ID NO: 88691 - RNA, 19 nt, Homo sapiens
uuacauggcuccgaugaau

SEQ ID NO: 88692 - RNA, 19 nt, Homo sapiens
ggagaggcaguucaacauu

SEQ ID NO: 88693 - RNA, 19 nt, Homo sapiens
gagccuguaucacuucuca

SEQ ID NO: 88694 - RNA, 19 nt, Homo sapiens
ccugaaacagcuauuauaa

SEQ ID NO: 88695 - RNA, 19 nt, Homo sapiens
ugauguaacuggagauauc

SEQ ID NO: 88696 - RNA, 19 nt, Homo sapiens
uaaaucuuguggaguguga

SEQ ID NO: 88697 - RNA, 19 nt, Homo sapiens
ggaacugagcauucuguaa

SEQ ID NO: 88698 - RNA, 19 nt, Homo sapiens
ggucaacaauccgaauuuc

SEQ ID NO: 88699 - RNA, 19 nt, Homo sapiens
gagaagccaaggaggagua

SEQ ID NO: 88700 - RNA, 19 nt, Homo sapiens
uggaaacagugcaaaguug

SEQ ID NO: 88701 - RNA, 19 nt, Homo sapiens
gagcugggaccauauuuca

SEQ ID NO: 88702 - RNA, 19 nt, Homo sapiens
ggcgaacucuacucuguug

SEQ ID NO: 88703 - RNA, 19 nt, Homo sapiens
gcacuagcaccuugacaau

SEQ ID NO: 88704 - RNA, 19 nt, Homo sapiens
acgaguaccuguugcuauu

SEQ ID NO: 88705 - RNA, 19 nt, Homo sapiens
gcugggaccauauuucaaa

SEQ ID NO: 88706 - RNA, 19 nt, Homo sapiens
uaaacagucugggugaaga

SEQ ID NO: 88707 - RNA, 19 nt, Homo sapiens
uggcaaagcauaauggauu

SEQ ID NO: 88708 - RNA, 19 nt, Homo sapiens
uuaaagugcuggaugucaa

SEQ ID NO: 88709 - RNA, 19 nt, Homo sapiens
gcacaacauaacaaucauu

SEQ ID NO: 88710 - RNA, 19 nt, Homo sapiens
guaccugguuguuauccaa

SEQ ID NO: 88711 - RNA, 19 nt, Homo sapiens
gagauauccaugcuauaaa

SEQ ID NO: 88712 - RNA, 19 nt, Homo sapiens
cagaacggcuagcggaaau

SEQ ID NO: 88713 - RNA, 19 nt, Homo sapiens
agaaguccuuggauauuug

SEQ ID NO: 88714 - RNA, 19 nt, Homo sapiens
gucuagaaguccuuggaua

SEQ ID NO: 88715 - RNA, 19 nt, Homo sapiens
guguugaugucgaugaauu

SEQ ID NO: 88716 - RNA, 19 nt, Homo sapiens
aaacaucauucgcuacgau

SEQ ID NO: 88717 - RNA, 19 nt, Homo sapiens
ccaagucauucaaacuguu

SEQ ID NO: 88718 - RNA, 19 nt, Homo sapiens
cugcuuagaugaugucugu

SEQ ID NO: 88719 - RNA, 19 nt, Homo sapiens
ggcacugcaugaugaauug

SEQ ID NO: 88720 - RNA, 19 nt, Homo sapiens
ggaccugaaccgauucuug

SEQ ID NO: 88721 - RNA, 19 nt, Homo sapiens
ggugaagaacagcgaauuu

SEQ ID NO: 88722 - RNA, 19 nt, Homo sapiens
ugagcauucuguaauauuc

SEQ ID NO: 88723 - RNA, 19 nt, Homo sapiens
ccuauacgcuaaagguaga

SEQ ID NO: 88724 - RNA, 19 nt, Homo sapiens
aggaguaccugguuguuau

SEQ ID NO: 88725 - RNA, 19 nt, Homo sapiens
ucuauaaacucaaccacau

SEQ ID NO: 88726 - RNA, 19 nt, Homo sapiens
acuagcaccuugacaauca

SEQ ID NO: 88727 - RNA, 19 nt, Homo sapiens
ccacugagcagcacuagca

SEQ ID NO: 88728 - RNA, 19 nt, Homo sapiens
ggcaaagcauaauggauuc

SEQ ID NO: 88729 - RNA, 19 nt, Homo sapiens
gcuuagaugaugucuguuu

SEQ ID NO: 88730 - RNA, 19 nt, Homo sapiens
ccacuugacagagaauuaa

SEQ ID NO: 88731 - RNA, 19 nt, Homo sapiens
augaaucagucucaaguuu

SEQ ID NO: 88732 - RNA, 19 nt, Homo sapiens
aaccagauuugcaguuuau

SEQ ID NO: 88733 - RNA, 19 nt, Homo sapiens
ccaauuggacucaguaugg

SEQ ID NO: 88734 - RNA, 19 nt, Homo sapiens
gaccugaaccgauucuugu

SEQ ID NO: 88735 - RNA, 19 nt, Homo sapiens
uagcggaaaugcucuugga

SEQ ID NO: 88736 - RNA, 19 nt, Homo sapiens
gaagaacagcgaauuuuga

SEQ ID NO: 88737 - RNA, 19 nt, Homo sapiens
uuaaguauguggagugucu

SEQ ID NO: 88738 - RNA, 19 nt, Homo sapiens
gaagauauaucccuaauga

SEQ ID NO: 88739 - RNA, 19 nt, Homo sapiens
caacaacccuccucgauuu

SEQ ID NO: 88740 - RNA, 19 nt, Homo sapiens
ucagucaccuuuacaauua

SEQ ID NO: 88741 - RNA, 19 nt, Homo sapiens
ggaaucaguucuucuuauu

SEQ ID NO: 88742 - RNA, 19 nt, Homo sapiens
ccacugaaguugcagauaa

SEQ ID NO: 88743 - RNA, 19 nt, Homo sapiens
caaagaaacuagacagaga

SEQ ID NO: 88744 - RNA, 19 nt, Homo sapiens
ugacaacgauuauccaauu

SEQ ID NO: 88745 - RNA, 19 nt, Homo sapiens
agaaguagaugaagaugua

SEQ ID NO: 88746 - RNA, 19 nt, Homo sapiens
gaaccggaaucggaauuua

SEQ ID NO: 88747 - RNA, 19 nt, Homo sapiens
gcaaccgcuuuguaaauua

SEQ ID NO: 88748 - RNA, 19 nt, Homo sapiens
cagaguacguaucaauuua

SEQ ID NO: 88749 - RNA, 19 nt, Homo sapiens
gaaguacugucuauguuau

SEQ ID NO: 88750 - RNA, 19 nt, Homo sapiens
ggaaguacugucuauguua

SEQ ID NO: 88751 - RNA, 19 nt, Homo sapiens
gaaacuagacagagaagaa

SEQ ID NO: 88752 - RNA, 19 nt, Homo sapiens
aaaggaaccucugauaauu

SEQ ID NO: 88753 - RNA, 19 nt, Homo sapiens
gaacucaucuuggaaggau

SEQ ID NO: 88754 - RNA, 19 nt, Homo sapiens
gacuauuacugccauauuu

SEQ ID NO: 88755 - RNA, 19 nt, Homo sapiens
cagauucgcucaguucuuu

SEQ ID NO: 88756 - RNA, 19 nt, Homo sapiens
caaccgcuuuguaaauuaa

SEQ ID NO: 88757 - RNA, 19 nt, Homo sapiens
gcagaagcccugauccuuu

SEQ ID NO: 88758 - RNA, 19 nt, Homo sapiens
guacaucuguuauacaagu

SEQ ID NO: 88759 - RNA, 19 nt, Homo sapiens
ccacaucccugucuucauc

SEQ ID NO: 88760 - RNA, 19 nt, Homo sapiens
caagugcaccuccauauga

SEQ ID NO: 88761 - RNA, 19 nt, Homo sapiens
gaaccagugccagaauuua

SEQ ID NO: 88762 - RNA, 19 nt, Homo sapiens
caaaguggucuauagcaua

SEQ ID NO: 88763 - RNA, 19 nt, Homo sapiens
ggaagaagauacccaagcu

SEQ ID NO: 88764 - RNA, 19 nt, Homo sapiens
ugacaaggauacacaggaa

SEQ ID NO: 88765 - RNA, 19 nt, Homo sapiens
acaaguaacugcaacagau

SEQ ID NO: 88766 - RNA, 19 nt, Homo sapiens
gaagaagauauaucccuaa

SEQ ID NO: 88767 - RNA, 19 nt, Homo sapiens
agagaagacaguaaacuua

SEQ ID NO: 88768 - RNA, 19 nt, Homo sapiens
uaggcaagcuucacacuga

SEQ ID NO: 88769 - RNA, 19 nt, Homo sapiens
gaauacgaaugauacagau

SEQ ID NO: 88770 - RNA, 19 nt, Homo sapiens
uguaaugccugaaacuauu

SEQ ID NO: 88771 - RNA, 19 nt, Homo sapiens
aaacuuagacgggauguaa

SEQ ID NO: 88772 - RNA, 19 nt, Homo sapiens
ggaaucggaauuuaucauu

SEQ ID NO: 88773 - RNA, 19 nt, Homo sapiens
aaaguggucuauagcauau

SEQ ID NO: 88774 - RNA, 19 nt, Homo sapiens
ccaaggcuauagacagaaa

SEQ ID NO: 88775 - RNA, 19 nt, Homo sapiens
ucaaguagggauuugcuua

SEQ ID NO: 88776 - RNA, 19 nt, Homo sapiens
cagaagcccugauccuuuc

SEQ ID NO: 88777 - RNA, 19 nt, Homo sapiens
gccaggaacaauuuaauaa

SEQ ID NO: 88778 - RNA, 19 nt, Homo sapiens
gcaguaccagguuguuaua

SEQ ID NO: 88779 - RNA, 19 nt, Homo sapiens
caacgauuauccaauucaa

SEQ ID NO: 88780 - RNA, 19 nt, Homo sapiens
agacauggguggccagaug

SEQ ID NO: 88781 - RNA, 19 nt, Homo sapiens
gacaaaagaugacgguaaa

SEQ ID NO: 88782 - RNA, 19 nt, Homo sapiens
gaggauuguuugacuuaau

SEQ ID NO: 88783 - RNA, 19 nt, Homo sapiens
ccagaguacguaucaauuu

SEQ ID NO: 88784 - RNA, 19 nt, Homo sapiens
gcuggcagucuauuuguua

SEQ ID NO: 88785 - RNA, 19 nt, Homo sapiens
gagacuaagaggauuguuu

SEQ ID NO: 88786 - RNA, 19 nt, Homo sapiens
gaauuugccauguauuaug

SEQ ID NO: 88787 - RNA, 19 nt, Homo sapiens
ugaccaugcuccggaauuu

SEQ ID NO: 88788 - RNA, 19 nt, Homo sapiens
gaaugaauacgaaugauac

SEQ ID NO: 88789 - RNA, 19 nt, Homo sapiens
cggaauuugccauguauua

SEQ ID NO: 88790 - RNA, 19 nt, Homo sapiens
caaguagggauuugcuuaa

SEQ ID NO: 88791 - RNA, 19 nt, Homo sapiens
uuauucaucuggaccuaua

SEQ ID NO: 88792 - RNA, 19 nt, Homo sapiens
uaagaggauuguuugacuu

SEQ ID NO: 88793 - RNA, 19 nt, Homo sapiens
acacaggaagggauuauaa

SEQ ID NO: 88794 - RNA, 19 nt, Homo sapiens
ggacccagaaucaggcaua

SEQ ID NO: 88795 - RNA, 19 nt, Homo sapiens
guacugacacacaauaugu

SEQ ID NO: 88796 - RNA, 19 nt, Homo sapiens
gauaauacagcaggaauca

SEQ ID NO: 88797 - RNA, 19 nt, Homo sapiens
ugauagaaguagaugaaga

SEQ ID NO: 88798 - RNA, 19 nt, Homo sapiens
agauacagcuguggucaaa

SEQ ID NO: 88799 - RNA, 19 nt, Homo sapiens
gaagggauuauaacuguca

SEQ ID NO: 88800 - RNA, 19 nt, Homo sapiens
gagcaguaccagguuguua

SEQ ID NO: 88801 - RNA, 19 nt, Homo sapiens
ggagucgguacaucuguua

SEQ ID NO: 88802 - RNA, 19 nt, Homo sapiens
acguagauguugucaagua

SEQ ID NO: 88803 - RNA, 19 nt, Homo sapiens
gagaagacaguaaacuuag

SEQ ID NO: 88804 - RNA, 19 nt, Homo sapiens
gaauuucaccauuguagau

SEQ ID NO: 88805 - RNA, 19 nt, Homo sapiens
gauagaaguagaugaagau

SEQ ID NO: 88806 - RNA, 19 nt, Homo sapiens
gauaaaggagauggaaauu

SEQ ID NO: 88807 - RNA, 19 nt, Homo sapiens
auacguagauguugucaag

SEQ ID NO: 88808 - RNA, 19 nt, Homo sapiens
gacauuggcacauuaagga

SEQ ID NO: 88809 - RNA, 19 nt, Homo sapiens
ggaauuugccauguauuau

SEQ ID NO: 88810 - RNA, 19 nt, Homo sapiens
gaacaucacgcugacagau

SEQ ID NO: 88811 - RNA, 19 nt, Homo sapiens
cccagaaucaggcauaaua

SEQ ID NO: 88812 - RNA, 19 nt, Homo sapiens
ccaaaguggucuauagcau

SEQ ID NO: 88813 - RNA, 19 nt, Homo sapiens
cuaacaaucucggaaggaa

SEQ ID NO: 88814 - RNA, 19 nt, Homo sapiens
guaagucuuugugaaugaa

SEQ ID NO: 88815 - RNA, 19 nt, Homo sapiens
gauguaaugccugaaacua

SEQ ID NO: 88816 - RNA, 19 nt, Homo sapiens
guaaaggagggcaguauca

SEQ ID NO: 88817 - RNA, 19 nt, Homo sapiens
uaagaguggaugcaaguaa

SEQ ID NO: 88818 - RNA, 19 nt, Homo sapiens
aaagauagcgggucugaca

SEQ ID NO: 88819 - RNA, 19 nt, Homo sapiens
gacgccaacuauggaaaua

SEQ ID NO: 88820 - RNA, 19 nt, Homo sapiens
augauucgcuggcaacgua

SEQ ID NO: 88821 - RNA, 19 nt, Homo sapiens
ggcaagagaagacaguaaa

SEQ ID NO: 88822 - RNA, 19 nt, Homo sapiens
aagaagauacccaagcuuu

SEQ ID NO: 88823 - RNA, 19 nt, Homo sapiens
gcauugaagaggcaaagaa

SEQ ID NO: 88824 - RNA, 19 nt, Homo sapiens
gcacugguacacucacuau

SEQ ID NO: 88825 - RNA, 19 nt, Homo sapiens
uaauacagcaggaaucaug

SEQ ID NO: 88826 - RNA, 19 nt, Homo sapiens
ccagaugccaggaacaauu

SEQ ID NO: 88827 - RNA, 19 nt, Homo sapiens
aggaagggauuauaacugu

SEQ ID NO: 88828 - RNA, 19 nt, Homo sapiens
gaauuugacaacccacuga

SEQ ID NO: 88829 - RNA, 19 nt, Homo sapiens
gugccaaaguggucuauag

SEQ ID NO: 88830 - RNA, 19 nt, Homo sapiens
gcagaugacgccaacuaug

SEQ ID NO: 88831 - RNA, 19 nt, Homo sapiens
cgguacaucuguuauacaa

SEQ ID NO: 88832 - RNA, 19 nt, Homo sapiens
gaggacuuaccauuauaua

SEQ ID NO: 88833 - RNA, 19 nt, Homo sapiens
gaaucaguucuucuuauug

SEQ ID NO: 88834 - RNA, 19 nt, Homo sapiens
gagaaggaccgagacagaa

SEQ ID NO: 88835 - RNA, 19 nt, Homo sapiens
aaugagcaccuacuuauug

SEQ ID NO: 88836 - RNA, 19 nt, Homo sapiens
ggagggcaguaucauugga

SEQ ID NO: 88837 - RNA, 19 nt, Homo sapiens
ugaccaagauaaaggagau

SEQ ID NO: 88838 - RNA, 19 nt, Homo sapiens
ggaaauggaucucuuuaua

SEQ ID NO: 88839 - RNA, 19 nt, Homo sapiens
gaagaaaucuauacagcua

SEQ ID NO: 88840 - RNA, 19 nt, Homo sapiens
gaaguagaauaccgaauua

SEQ ID NO: 88841 - RNA, 19 nt, Homo sapiens
gaaauaauguucagaagga

SEQ ID NO: 88842 - RNA, 19 nt, Homo sapiens
gaagugaacuaugacaaua

SEQ ID NO: 88843 - RNA, 19 nt, Homo sapiens
agaaagagcuugaguuaga

SEQ ID NO: 88844 - RNA, 19 nt, Homo sapiens
ccagaaacguuauuuauuc

SEQ ID NO: 88845 - RNA, 19 nt, Homo sapiens
gaacagcgccagagucauu

SEQ ID NO: 88846 - RNA, 19 nt, Homo sapiens
ggagauggaucacucaaau

SEQ ID NO: 88847 - RNA, 19 nt, Homo sapiens
gacaauuucuccuggguua

SEQ ID NO: 88848 - RNA, 19 nt, Homo sapiens
uaggaugucucauggaaua

SEQ ID NO: 88849 - RNA, 19 nt, Homo sapiens
ggauauauguucuguucaa

SEQ ID NO: 88850 - RNA, 19 nt, Homo sapiens
caacuuccauuauccagaa

SEQ ID NO: 88851 - RNA, 19 nt, Homo sapiens
ugagaaagagcuugaguua

SEQ ID NO: 88852 - RNA, 19 nt, Homo sapiens
gucaagaagugaacuauga

SEQ ID NO: 88853 - RNA, 19 nt, Homo sapiens
gaaauacaguguuguccau

SEQ ID NO: 88854 - RNA, 19 nt, Homo sapiens
gccagaaucuuaaccagaa

SEQ ID NO: 88855 - RNA, 19 nt, Homo sapiens
cgaaaugucuguuguaggu

SEQ ID NO: 88856 - RNA, 19 nt, Homo sapiens
ugacgguacugauauguuu

SEQ ID NO: 88857 - RNA, 19 nt, Homo sapiens
gaauauacaggaucugauu

SEQ ID NO: 88858 - RNA, 19 nt, Homo sapiens
uaagcaaccucacaaacaa

SEQ ID NO: 88859 - RNA, 19 nt, Homo sapiens
caggauaguucucccuuaa

SEQ ID NO: 88860 - RNA, 19 nt, Homo sapiens
uaugagagccgaagacuuu

SEQ ID NO: 88861 - RNA, 19 nt, Homo sapiens
caaauucuaucugcuaaug

SEQ ID NO: 88862 - RNA, 19 nt, Homo sapiens
ggguaugccugccacauuu

SEQ ID NO: 88863 - RNA, 19 nt, Homo sapiens
ggaaaccaguugaaacaca

SEQ ID NO: 88864 - RNA, 19 nt, Homo sapiens
agacaaugauuacccaauu

SEQ ID NO: 88865 - RNA, 19 nt, Homo sapiens
caauagacaugaaaucagu

SEQ ID NO: 88866 - RNA, 19 nt, Homo sapiens
cuaggaccauuuaaagaua

SEQ ID NO: 88867 - RNA, 19 nt, Homo sapiens
ugaguuagauugaaguaga

SEQ ID NO: 88868 - RNA, 19 nt, Homo sapiens
ccaaagcuauggaaauaca

SEQ ID NO: 88869 - RNA, 19 nt, Homo sapiens
gcacagccauuggaagugu

SEQ ID NO: 88870 - RNA, 19 nt, Homo sapiens
gauguuaguaggugugaua

SEQ ID NO: 88871 - RNA, 19 nt, Homo sapiens
agccaaagcuauggaaaua

SEQ ID NO: 88872 - RNA, 19 nt, Homo sapiens
uaggauauauguucuguuc

SEQ ID NO: 88873 - RNA, 19 nt, Homo sapiens
gaaagagcuugaguuagau

SEQ ID NO: 88874 - RNA, 19 nt, Homo sapiens
uaacguaggauauauguuc

SEQ ID NO: 88875 - RNA, 19 nt, Homo sapiens
gacaugaaaucaguaccua

SEQ ID NO: 88876 - RNA, 19 nt, Homo sapiens
caguuuagcugcugucaau

SEQ ID NO: 88877 - RNA, 19 nt, Homo sapiens
gaccuugacagaaucuuua

SEQ ID NO: 88878 - RNA, 19 nt, Homo sapiens
gaagauaucagagacaaca

SEQ ID NO: 88879 - RNA, 19 nt, Homo sapiens
cagcuaauacagacuauaa

SEQ ID NO: 88880 - RNA, 19 nt, Homo sapiens
gaaauggaucucuuuauac

SEQ ID NO: 88881 - RNA, 19 nt, Homo sapiens
ucagaaacaugaacaggau

SEQ ID NO: 88882 - RNA, 19 nt, Homo sapiens
auacugaccuugacagaau

SEQ ID NO: 88883 - RNA, 19 nt, Homo sapiens
ugaaguagaauaccgaauu

SEQ ID NO: 88884 - RNA, 19 nt, Homo sapiens
ccagaacacuauucaucuu

SEQ ID NO: 88885 - RNA, 19 nt, Homo sapiens
gaacuaugacaauacauca

SEQ ID NO: 88886 - RNA, 19 nt, Homo sapiens
ccacuucucuucaucuaca

SEQ ID NO: 88887 - RNA, 19 nt, Homo sapiens
guccugcccuugcaaauga

SEQ ID NO: 88888 - RNA, 19 nt, Homo sapiens
uggcauaaucuuacuguua

SEQ ID NO: 88889 - RNA, 19 nt, Homo sapiens
gauggugacgguacugaua

SEQ ID NO: 88890 - RNA, 19 nt, Homo sapiens
cagagucauuuacagcaua

SEQ ID NO: 88891 - RNA, 19 nt, Homo sapiens
gaccacuucucuucaucua

SEQ ID NO: 88892 - RNA, 19 nt, Homo sapiens
gaaccaacuuccauuaucc

SEQ ID NO: 88893 - RNA, 19 nt, Homo sapiens
uaagcuagcagaaauguau

SEQ ID NO: 88894 - RNA, 19 nt, Homo sapiens
uauagaagauguggaugaa

SEQ ID NO: 88895 - RNA, 19 nt, Homo sapiens
gagcuugaguuagauugaa

SEQ ID NO: 88896 - RNA, 19 nt, Homo sapiens
caagcuacauucagaccaa

SEQ ID NO: 88897 - RNA, 19 nt, Homo sapiens
gacaaugauuacccaauuc

SEQ ID NO: 88898 - RNA, 19 nt, Homo sapiens
uaagugcaguagacaaaga

SEQ ID NO: 88899 - RNA, 19 nt, Homo sapiens
gagauggaucacucaaaua

SEQ ID NO: 88900 - RNA, 19 nt, Homo sapiens
caucaucauucuacugguu

SEQ ID NO: 88901 - RNA, 19 nt, Homo sapiens
caagggacccagauucuau

SEQ ID NO: 88902 - RNA, 19 nt, Homo sapiens
cgaagacuuuauacucuga

SEQ ID NO: 88903 - RNA, 19 nt, Homo sapiens
gagagccgaagacuuuaua

SEQ ID NO: 88904 - RNA, 19 nt, Homo sapiens
aaacagagagcaauaccaa

SEQ ID NO: 88905 - RNA, 19 nt, Homo sapiens
gaguuagauugaaguagaa

SEQ ID NO: 88906 - RNA, 19 nt, Homo sapiens
gccacaaggcgaauugaua

SEQ ID NO: 88907 - RNA, 19 nt, Homo sapiens
caucaaauucuaucugcua

SEQ ID NO: 88908 - RNA, 19 nt, Homo sapiens
gaugucucauggaauauau

SEQ ID NO: 88909 - RNA, 19 nt, Homo sapiens
uaauacugccagaaucuua

SEQ ID NO: 88910 - RNA, 19 nt, Homo sapiens
gcaagggacccagauucua

SEQ ID NO: 88911 - RNA, 19 nt, Homo sapiens
ucaugaagauauugaagug

SEQ ID NO: 88912 - RNA, 19 nt, Homo sapiens
gaacacuauucaucuucga

SEQ ID NO: 88913 - RNA, 19 nt, Homo sapiens
ggacaaccacugugaacau

SEQ ID NO: 88914 - RNA, 19 nt, Homo sapiens
gcacaagcuauuaacagaa

SEQ ID NO: 88915 - RNA, 19 nt, Homo sapiens
acagacauuugugcaauuu

SEQ ID NO: 88916 - RNA, 19 nt, Homo sapiens
caguauauccuguucugua

SEQ ID NO: 88917 - RNA, 19 nt, Homo sapiens
uaaaagugaugcugagaaa

SEQ ID NO: 88918 - RNA, 19 nt, Homo sapiens
ucacaguacaggauaauga

SEQ ID NO: 88919 - RNA, 19 nt, Homo sapiens
gaaaucaacaaucccaaag

SEQ ID NO: 88920 - RNA, 19 nt, Homo sapiens
ccagaaauaauguucagaa

SEQ ID NO: 88921 - RNA, 19 nt, Homo sapiens
gaugaaauguuggaaacca

SEQ ID NO: 88922 - RNA, 19 nt, Homo sapiens
ugucuccacuucacaauau

SEQ ID NO: 88923 - RNA, 19 nt, Homo sapiens
ggacguccgggauuucauu

SEQ ID NO: 88924 - RNA, 19 nt, Homo sapiens
gaacaucacgcugacagau

SEQ ID NO: 88925 - RNA, 19 nt, Homo sapiens
aaagugaugcugagaaaga

SEQ ID NO: 88926 - RNA, 19 nt, Homo sapiens
gauggaucacucaaauaua

SEQ ID NO: 88927 - RNA, 19 nt, Homo sapiens
agacauuugugcaauuuca

SEQ ID NO: 88928 - RNA, 19 nt, Homo sapiens
ucucugaguucauuagaau

SEQ ID NO: 88929 - RNA, 19 nt, Homo sapiens
gauaucagagacaacauug

SEQ ID NO: 88930 - RNA, 19 nt, Homo sapiens
ugaagaauauacaggaucu

SEQ ID NO: 88931 - RNA, 19 nt, Homo sapiens
uguaggaugucucauggaa

SEQ ID NO: 88932 - RNA, 19 nt, Homo sapiens
cgagauauuauuccagaaa

SEQ ID NO: 88933 - RNA, 19 nt, Homo sapiens
ucucuugccuguggugaua

SEQ ID NO: 88934 - RNA, 19 nt, Homo sapiens
gaaaucaguaccuaucucu

SEQ ID NO: 88935 - RNA, 19 nt, Homo sapiens
gaagauaauacugccagaa

SEQ ID NO: 88936 - RNA, 19 nt, Homo sapiens
gaaaauaacagccgaaaac

SEQ ID NO: 88937 - RNA, 19 nt, Homo sapiens
gccgaagacuuuauacucu

SEQ ID NO: 88938 - RNA, 19 nt, Homo sapiens
ggaaggagcuggaaccauu

SEQ ID NO: 88939 - RNA, 19 nt, Homo sapiens
gaagggaaauuguuuaugu

SEQ ID NO: 88940 - RNA, 19 nt, Homo sapiens
gaagauguguaaacaggua

SEQ ID NO: 88941 - RNA, 19 nt, Homo sapiens
gugagaacaucauuacuua

SEQ ID NO: 88942 - RNA, 19 nt, Homo sapiens
ggacauggguggacauaug

SEQ ID NO: 88943 - RNA, 19 nt, Homo sapiens
gaaacuagcagauuuguau

SEQ ID NO: 88944 - RNA, 19 nt, Homo sapiens
caaagaagcuuccacaaaa

SEQ ID NO: 88945 - RNA, 19 nt, Homo sapiens
gaaggagaacuacuguuua

SEQ ID NO: 88946 - RNA, 19 nt, Homo sapiens
gaacagcccuacccaacau

SEQ ID NO: 88947 - RNA, 19 nt, Homo sapiens
ggaaauagcgccaaguuag

SEQ ID NO: 88948 - RNA, 19 nt, Homo sapiens
caacaucacugucuuugca

SEQ ID NO: 88949 - RNA, 19 nt, Homo sapiens
gagcuguaauuucgccuua

SEQ ID NO: 88950 - RNA, 19 nt, Homo sapiens
cgauaaugcucccaaguuu

SEQ ID NO: 88951 - RNA, 19 nt, Homo sapiens
acacugaccucgacagauu

SEQ ID NO: 88952 - RNA, 19 nt, Homo sapiens
gccaauggaccaagauuua

SEQ ID NO: 88953 - RNA, 19 nt, Homo sapiens
guacaauuaugucucuuga

SEQ ID NO: 88954 - RNA, 19 nt, Homo sapiens
ggagaagucuaacgcugaa

SEQ ID NO: 88955 - RNA, 19 nt, Homo sapiens
gguauggaaucguuugaaa

SEQ ID NO: 88956 - RNA, 19 nt, Homo sapiens
gagagacgcccuauuucua

SEQ ID NO: 88957 - RNA, 19 nt, Homo sapiens
gaucagaccaagccacuuu

SEQ ID NO: 88958 - RNA, 19 nt, Homo sapiens
gauaagguauuccaucgau

SEQ ID NO: 88959 - RNA, 19 nt, Homo sapiens
gcacaucgacccgaaguuu

SEQ ID NO: 88960 - RNA, 19 nt, Homo sapiens
gagaugguauggaaucguu

SEQ ID NO: 88961 - RNA, 19 nt, Homo sapiens
ccauucaaaucuacgguua

SEQ ID NO: 88962 - RNA, 19 nt, Homo sapiens
ggaaguaggaagagugaaa

SEQ ID NO: 88963 - RNA, 19 nt, Homo sapiens
ucaaagaagcuuccacaaa

SEQ ID NO: 88964 - RNA, 19 nt, Homo sapiens
ucaaggaaaggcucauuua

SEQ ID NO: 88965 - RNA, 19 nt, Homo sapiens
gaaagaaccacucauuguc

SEQ ID NO: 88966 - RNA, 19 nt, Homo sapiens
gcacagacagguaucauca

SEQ ID NO: 88967 - RNA, 19 nt, Homo sapiens
gauauugacucuggugaug

SEQ ID NO: 88968 - RNA, 19 nt, Homo sapiens
uuacagagaggauacauuu

SEQ ID NO: 88969 - RNA, 19 nt, Homo sapiens
caccacagauucagacuug

SEQ ID NO: 88970 - RNA, 19 nt, Homo sapiens
gagaacaucauuacuuaug

SEQ ID NO: 88971 - RNA, 19 nt, Homo sapiens
gaaauuggcagcaaguauc

SEQ ID NO: 88972 - RNA, 19 nt, Homo sapiens
acagaagccuuugauauug

SEQ ID NO: 88973 - RNA, 19 nt, Homo sapiens
caaguuacauccacgaagu

SEQ ID NO: 88974 - RNA, 19 nt, Homo sapiens
gagaagagagagcccagua

SEQ ID NO: 88975 - RNA, 19 nt, Homo sapiens
ugaaggagaacuacuguuu

SEQ ID NO: 88976 - RNA, 19 nt, Homo sapiens
ggaguguguuacagaaauu

SEQ ID NO: 88977 - RNA, 19 nt, Homo sapiens
gcuguaauuucgccuuaaa

SEQ ID NO: 88978 - RNA, 19 nt, Homo sapiens
gaaaggacaacaguucuga

SEQ ID NO: 88979 - RNA, 19 nt, Homo sapiens
caaggaaaggcucauuuaa

SEQ ID NO: 88980 - RNA, 19 nt, Homo sapiens
cacagaagccuuugauauu

SEQ ID NO: 88981 - RNA, 19 nt, Homo sapiens
ggagaacuacuguuuacaa

SEQ ID NO: 88982 - RNA, 19 nt, Homo sapiens
gaacauccaagucuuucuu

SEQ ID NO: 88983 - RNA, 19 nt, Homo sapiens
ggacuaugauuaucuacag

SEQ ID NO: 88984 - RNA, 19 nt, Homo sapiens
aaagaaagaaccacucauu

SEQ ID NO: 88985 - RNA, 19 nt, Homo sapiens
guucugagcuguaauuucg

SEQ ID NO: 88986 - RNA, 19 nt, Homo sapiens
acagagaggauacauuuaa

SEQ ID NO: 88987 - RNA, 19 nt, Homo sapiens
cgauacaaauuuggccuua

SEQ ID NO: 88988 - RNA, 19 nt, Homo sapiens
ccacggcuccuccuuauga

SEQ ID NO: 88989 - RNA, 19 nt, Homo sapiens
ugacaacccaccaaaguuu

SEQ ID NO: 88990 - RNA, 19 nt, Homo sapiens
gagcaucaaucuuguuacu

SEQ ID NO: 88991 - RNA, 19 nt, Homo sapiens
ggagagugcaugccaaaga

SEQ ID NO: 88992 - RNA, 19 nt, Homo sapiens
ggugacagcuucagaugca

SEQ ID NO: 88993 - RNA, 19 nt, Homo sapiens
gugaugggaacauuaaaua

SEQ ID NO: 88994 - RNA, 19 nt, Homo sapiens
cggcaucacacuuauauuu

SEQ ID NO: 88995 - RNA, 19 nt, Homo sapiens
gauacaaauuuggccuuaa

SEQ ID NO: 88996 - RNA, 19 nt, Homo sapiens
gaugguaucaauggauuua

SEQ ID NO: 88997 - RNA, 19 nt, Homo sapiens
ugauggagaugguauggaa

SEQ ID NO: 88998 - RNA, 19 nt, Homo sapiens
gagaacuacuguuuacaag

SEQ ID NO: 88999 - RNA, 19 nt, Homo sapiens
uaggaagagugaaagcuaa

SEQ ID NO: 89000 - RNA, 19 nt, Homo sapiens
ccaaguuaguguacaguau

SEQ ID NO: 89001 - RNA, 19 nt, Homo sapiens
gaagagagagcccaguaca

SEQ ID NO: 89002 - RNA, 19 nt, Homo sapiens
acuaauacgugccagauau

SEQ ID NO: 89003 - RNA, 19 nt, Homo sapiens
ccuuaugacuccauucaaa

SEQ ID NO: 89004 - RNA, 19 nt, Homo sapiens
ucagauggguggagugugu

SEQ ID NO: 89005 - RNA, 19 nt, Homo sapiens
ggcagaagcaggacuugua

SEQ ID NO: 89006 - RNA, 19 nt, Homo sapiens
cagcagaaauccacaaucg

SEQ ID NO: 89007 - RNA, 19 nt, Homo sapiens
gaaaauggcuuagucacau

SEQ ID NO: 89008 - RNA, 19 nt, Homo sapiens
gaaauagcgccaaguuagu

SEQ ID NO: 89009 - RNA, 19 nt, Homo sapiens
gacauuccaucccaagaga

SEQ ID NO: 89010 - RNA, 19 nt, Homo sapiens
gggaaauuguuuauguguu

SEQ ID NO: 89011 - RNA, 19 nt, Homo sapiens
gguaaauacugugaaauac

SEQ ID NO: 89012 - RNA, 19 nt, Homo sapiens
acacagaagccuuugauau

SEQ ID NO: 89013 - RNA, 19 nt, Homo sapiens
gaagagugaaagcuaaaga

SEQ ID NO: 89014 - RNA, 19 nt, Homo sapiens
guaggaagagugaaagcua

SEQ ID NO: 89015 - RNA, 19 nt, Homo sapiens
acauuguacuguugcuuua

SEQ ID NO: 89016 - RNA, 19 nt, Homo sapiens
ucuggacacucuauaugua

SEQ ID NO: 89017 - RNA, 19 nt, Homo sapiens
ucaaagugguaaauacugu

SEQ ID NO: 89018 - RNA, 19 nt, Homo sapiens
ggaaucguuugaaaucaca

SEQ ID NO: 89019 - RNA, 19 nt, Homo sapiens
caagaccaccguacaguug

SEQ ID NO: 89020 - RNA, 19 nt, Homo sapiens
acgcugaacugacaaugaa

SEQ ID NO: 89021 - RNA, 19 nt, Homo sapiens
cagagaggauacauuuaau

SEQ ID NO: 89022 - RNA, 19 nt, Homo sapiens
ugaugacgauucuuaacaa

SEQ ID NO: 89023 - RNA, 19 nt, Homo sapiens
gaagauguccgugagaaca

SEQ ID NO: 89024 - RNA, 19 nt, Homo sapiens
caacgcagaggccuacauu

SEQ ID NO: 89025 - RNA, 19 nt, Homo sapiens
gcaagaccaccguacaguu

SEQ ID NO: 89026 - RNA, 19 nt, Homo sapiens
aaggaaaggcucauuuaaa

SEQ ID NO: 89027 - RNA, 19 nt, Homo sapiens
uccaaugggugaagaagaa

SEQ ID NO: 89028 - RNA, 19 nt, Homo sapiens
ugacaacccuccggaguuc

SEQ ID NO: 89029 - RNA, 19 nt, Homo sapiens
ugacaaaucagggaacauu

SEQ ID NO: 89030 - RNA, 19 nt, Homo sapiens
gaaggagcuggaaccauuu

SEQ ID NO: 89031 - RNA, 19 nt, Homo sapiens
gaugacgauucuuaacaau

SEQ ID NO: 89032 - RNA, 19 nt, Homo sapiens
ucaaaucuacgguuaugaa

SEQ ID NO: 89033 - RNA, 19 nt, Homo sapiens
ccaacacccucaccaucaa

SEQ ID NO: 89034 - RNA, 19 nt, Homo sapiens
gguggaguguguuacagaa

SEQ ID NO: 89035 - RNA, 19 nt, Homo sapiens
gaagguuucaucugugaga

SEQ ID NO: 89036 - RNA, 19 nt, Homo sapiens
ccaacagcccgauaaggua

SEQ ID NO: 89037 - RNA, 19 nt, Homo sapiens
acagacagguaucaucaga

SEQ ID NO: 89038 - RNA, 19 nt, Homo sapiens
ggaaggagcuggaaccauu

SEQ ID NO: 89039 - RNA, 19 nt, Homo sapiens
gaagggaaauuguuuaugu

SEQ ID NO: 89040 - RNA, 19 nt, Homo sapiens
gaagauguguaaacaggua

SEQ ID NO: 89041 - RNA, 19 nt, Homo sapiens
gugagaacaucauuacuua

SEQ ID NO: 89042 - RNA, 19 nt, Homo sapiens
ggacauggguggacauaug

SEQ ID NO: 89043 - RNA, 19 nt, Homo sapiens
gaaacuagcagauuuguau

SEQ ID NO: 89044 - RNA, 19 nt, Homo sapiens
caaagaagcuuccacaaaa

SEQ ID NO: 89045 - RNA, 19 nt, Homo sapiens
gaaggagaacuacuguuua

SEQ ID NO: 89046 - RNA, 19 nt, Homo sapiens
caaccacacuuacgucauu

SEQ ID NO: 89047 - RNA, 19 nt, Homo sapiens
gaacagcccuacccaacau

SEQ ID NO: 89048 - RNA, 19 nt, Homo sapiens
ggaaauagcgccaaguuag

SEQ ID NO: 89049 - RNA, 19 nt, Homo sapiens
caacaucacugucuuugca

SEQ ID NO: 89050 - RNA, 19 nt, Homo sapiens
gagcuguaauuucgccuua

SEQ ID NO: 89051 - RNA, 19 nt, Homo sapiens
cgauaaugcucccaaguuu

SEQ ID NO: 89052 - RNA, 19 nt, Homo sapiens
acacugaccucgacagauu

SEQ ID NO: 89053 - RNA, 19 nt, Homo sapiens
gacaugagauugcuuuauc

SEQ ID NO: 89054 - RNA, 19 nt, Homo sapiens
gccaauggaccaagauuua

SEQ ID NO: 89055 - RNA, 19 nt, Homo sapiens
guacaauuaugucucuuga

SEQ ID NO: 89056 - RNA, 19 nt, Homo sapiens
ggagaagucuaacgcugaa

SEQ ID NO: 89057 - RNA, 19 nt, Homo sapiens
gguauggaaucguuugaaa

SEQ ID NO: 89058 - RNA, 19 nt, Homo sapiens
gagagacgcccuauuucua

SEQ ID NO: 89059 - RNA, 19 nt, Homo sapiens
gaucagaccaagccacuuu

SEQ ID NO: 89060 - RNA, 19 nt, Homo sapiens
gauaagguauuccaucgau

SEQ ID NO: 89061 - RNA, 19 nt, Homo sapiens
gcacaucgacccgaaguuu

SEQ ID NO: 89062 - RNA, 19 nt, Homo sapiens
gaagacaugagauugcuuu

SEQ ID NO: 89063 - RNA, 19 nt, Homo sapiens
gagaugguauggaaucguu

SEQ ID NO: 89064 - RNA, 19 nt, Homo sapiens
ccauucaaaucuacgguua

SEQ ID NO: 89065 - RNA, 19 nt, Homo sapiens
ggaaguaggaagagugaaa

SEQ ID NO: 89066 - RNA, 19 nt, Homo sapiens
ucaaagaagcuuccacaaa

SEQ ID NO: 89067 - RNA, 19 nt, Homo sapiens
ucaaggaaaggcucauuua

SEQ ID NO: 89068 - RNA, 19 nt, Homo sapiens
gaaagaaccacucauuguc

SEQ ID NO: 89069 - RNA, 19 nt, Homo sapiens
gcacagacagguaucauca

SEQ ID NO: 89070 - RNA, 19 nt, Homo sapiens
gauauugacucuggugaug

SEQ ID NO: 89071 - RNA, 19 nt, Homo sapiens
uuacagagaggauacauuu

SEQ ID NO: 89072 - RNA, 19 nt, Homo sapiens
caccacagauucagacuug

SEQ ID NO: 89073 - RNA, 19 nt, Homo sapiens
gagaacaucauuacuuaug

SEQ ID NO: 89074 - RNA, 19 nt, Homo sapiens
gaaauuggcagcaaguauc

SEQ ID NO: 89075 - RNA, 19 nt, Homo sapiens
acagaagccuuugauauug

SEQ ID NO: 89076 - RNA, 19 nt, Homo sapiens
caaguuacauccacgaagu

SEQ ID NO: 89077 - RNA, 19 nt, Homo sapiens
gagaagagagagcccagua

SEQ ID NO: 89078 - RNA, 19 nt, Homo sapiens
ugaaggagaacuacuguuu

SEQ ID NO: 89079 - RNA, 19 nt, Homo sapiens
ggaguguguuacagaaauu

SEQ ID NO: 89080 - RNA, 19 nt, Homo sapiens
gcuguaauuucgccuuaaa

SEQ ID NO: 89081 - RNA, 19 nt, Homo sapiens
gaaaggacaacaguucuga

SEQ ID NO: 89082 - RNA, 19 nt, Homo sapiens
caaggaaaggcucauuuaa

SEQ ID NO: 89083 - RNA, 19 nt, Homo sapiens
cacagaagccuuugauauu

SEQ ID NO: 89084 - RNA, 19 nt, Homo sapiens
ggagaacuacuguuuacaa

SEQ ID NO: 89085 - RNA, 19 nt, Homo sapiens
gaacauccaagucuuucuu

SEQ ID NO: 89086 - RNA, 19 nt, Homo sapiens
ggacuaugauuaucuacag

SEQ ID NO: 89087 - RNA, 19 nt, Homo sapiens
aaagaaagaaccacucauu

SEQ ID NO: 89088 - RNA, 19 nt, Homo sapiens
gagaguccaaccacacuua

SEQ ID NO: 89089 - RNA, 19 nt, Homo sapiens
guucugagcuguaauuucg

SEQ ID NO: 89090 - RNA, 19 nt, Homo sapiens
acagagaggauacauuuaa

SEQ ID NO: 89091 - RNA, 19 nt, Homo sapiens
cgauacaaauuuggccuua

SEQ ID NO: 89092 - RNA, 19 nt, Homo sapiens
ccacggcuccuccuuauga

SEQ ID NO: 89093 - RNA, 19 nt, Homo sapiens
ugacaacccaccaaaguuu

SEQ ID NO: 89094 - RNA, 19 nt, Homo sapiens
gagcaucaaucuuguuacu

SEQ ID NO: 89095 - RNA, 19 nt, Homo sapiens
ggagagugcaugccaaaga

SEQ ID NO: 89096 - RNA, 19 nt, Homo sapiens
ggugacagcuucagaugca

SEQ ID NO: 89097 - RNA, 19 nt, Homo sapiens
gugaugggaacauuaaaua

SEQ ID NO: 89098 - RNA, 19 nt, Homo sapiens
cggcaucacacuuauauuu

SEQ ID NO: 89099 - RNA, 19 nt, Homo sapiens
gauacaaauuuggccuuaa

SEQ ID NO: 89100 - RNA, 19 nt, Homo sapiens
gaugguaucaauggauuua

SEQ ID NO: 89101 - RNA, 19 nt, Homo sapiens
ugauggagaugguauggaa

SEQ ID NO: 89102 - RNA, 19 nt, Homo sapiens
gagaacuacuguuuacaag

SEQ ID NO: 89103 - RNA, 19 nt, Homo sapiens
uaggaagagugaaagcuaa

SEQ ID NO: 89104 - RNA, 19 nt, Homo sapiens
ccaaguuaguguacaguau

SEQ ID NO: 89105 - RNA, 19 nt, Homo sapiens
gaagagagagcccaguaca

SEQ ID NO: 89106 - RNA, 19 nt, Homo sapiens
acuaauacgugccagauau

SEQ ID NO: 89107 - RNA, 19 nt, Homo sapiens
ucagauggguggagugugu

SEQ ID NO: 89108 - RNA, 19 nt, Homo sapiens
ccuuaugacuccauucaaa

SEQ ID NO: 89109 - RNA, 19 nt, Homo sapiens
ggcagaagcaggacuugua

SEQ ID NO: 89110 - RNA, 19 nt, Homo sapiens
cagcagaaauccacaaucg

SEQ ID NO: 89111 - RNA, 19 nt, Homo sapiens
gaaaauggcuuagucacau

SEQ ID NO: 89112 - RNA, 19 nt, Homo sapiens
gaaauagcgccaaguuagu

SEQ ID NO: 89113 - RNA, 19 nt, Homo sapiens
gacauuccaucccaagaga

SEQ ID NO: 89114 - RNA, 19 nt, Homo sapiens
gggaaauuguuuauguguu

SEQ ID NO: 89115 - RNA, 19 nt, Homo sapiens
gguaaauacugugaaauac

SEQ ID NO: 89116 - RNA, 19 nt, Homo sapiens
acacagaagccuuugauau

SEQ ID NO: 89117 - RNA, 19 nt, Homo sapiens
uuacgucauuguaguauug

SEQ ID NO: 89118 - RNA, 19 nt, Homo sapiens
gaagagugaaagcuaaaga

SEQ ID NO: 89119 - RNA, 19 nt, Homo sapiens
guaggaagagugaaagcua

SEQ ID NO: 89120 - RNA, 19 nt, Homo sapiens
acauuguacuguugcuuua

SEQ ID NO: 89121 - RNA, 19 nt, Homo sapiens
ucuggacacucuauaugua

SEQ ID NO: 89122 - RNA, 19 nt, Homo sapiens
ucaaagugguaaauacugu

SEQ ID NO: 89123 - RNA, 19 nt, Homo sapiens
ggaaucguuugaaaucaca

SEQ ID NO: 89124 - RNA, 19 nt, Homo sapiens
caagaccaccguacaguug

SEQ ID NO: 89125 - RNA, 19 nt, Homo sapiens
acgcugaacugacaaugaa

SEQ ID NO: 89126 - RNA, 19 nt, Homo sapiens
cagagaggauacauuuaau

SEQ ID NO: 89127 - RNA, 19 nt, Homo sapiens
ugaugacgauucuuaacaa

SEQ ID NO: 89128 - RNA, 19 nt, Homo sapiens
gaagauguccgugagaaca

SEQ ID NO: 89129 - RNA, 19 nt, Homo sapiens
gcaagaccaccguacaguu

SEQ ID NO: 89130 - RNA, 19 nt, Homo sapiens
caacgcagaggccuacauu

SEQ ID NO: 89131 - RNA, 19 nt, Homo sapiens
aaggaaaggcucauuuaaa

SEQ ID NO: 89132 - RNA, 19 nt, Homo sapiens
uccaaugggugaagaagaa

SEQ ID NO: 89133 - RNA, 19 nt, Homo sapiens
ugacaacccuccggaguuc

SEQ ID NO: 89134 - RNA, 19 nt, Homo sapiens
ugacaaaucagggaacauu

SEQ ID NO: 89135 - RNA, 19 nt, Homo sapiens
gaaggagcuggaaccauuu

SEQ ID NO: 89136 - RNA, 19 nt, Homo sapiens
gaugacgauucuuaacaau

SEQ ID NO: 89137 - RNA, 19 nt, Homo sapiens
ucaaaucuacgguuaugaa

SEQ ID NO: 89138 - RNA, 19 nt, Homo sapiens
gagacaacgucauccauua

SEQ ID NO: 89139 - RNA, 19 nt, Homo sapiens
gaacgaagauagcuaugug

SEQ ID NO: 89140 - RNA, 19 nt, Homo sapiens
ggacagcuacuuuacaaua

SEQ ID NO: 89141 - RNA, 19 nt, Homo sapiens
ggacaagauuccuuugauu

SEQ ID NO: 89142 - RNA, 19 nt, Homo sapiens
gcaauaaggagccuagaua

SEQ ID NO: 89143 - RNA, 19 nt, Homo sapiens
gaagauaacacagacauaa

SEQ ID NO: 89144 - RNA, 19 nt, Homo sapiens
gggcaacaauucuccuuua

SEQ ID NO: 89145 - RNA, 19 nt, Homo sapiens
ggacagagaagucaaagaa

SEQ ID NO: 89146 - RNA, 19 nt, Homo sapiens
caagacagguguuauuaga

SEQ ID NO: 89147 - RNA, 19 nt, Homo sapiens
caacaauucuccuuuagau

SEQ ID NO: 89148 - RNA, 19 nt, Homo sapiens
gaacaacaauagucaacau

SEQ ID NO: 89149 - RNA, 19 nt, Homo sapiens
caagagauacauccuauaa

SEQ ID NO: 89150 - RNA, 19 nt, Homo sapiens
gacaagauuccuuugauua

SEQ ID NO: 89151 - RNA, 19 nt, Homo sapiens
gcaccauccugucuuguaa

SEQ ID NO: 89152 - RNA, 19 nt, Homo sapiens
gcaguauaauuucuccaua

SEQ ID NO: 89153 - RNA, 19 nt, Homo sapiens
caucaucauuucugcaaua

SEQ ID NO: 89154 - RNA, 19 nt, Homo sapiens
ggaagaaaguggugucuac

SEQ ID NO: 89155 - RNA, 19 nt, Homo sapiens
gcacaaacacaaugacuau

SEQ ID NO: 89156 - RNA, 19 nt, Homo sapiens
agagauacauccuauaaug

SEQ ID NO: 89157 - RNA, 19 nt, Homo sapiens
gagagggcacugugaaaua

SEQ ID NO: 89158 - RNA, 19 nt, Homo sapiens
ccuaacagcuuggcucuuu

SEQ ID NO: 89159 - RNA, 19 nt, Homo sapiens
gcgcaaggcugagcuguug

SEQ ID NO: 89160 - RNA, 19 nt, Homo sapiens
ggacagauaauucagauag

SEQ ID NO: 89161 - RNA, 19 nt, Homo sapiens
gaggacagcuuggaggauu

SEQ ID NO: 89162 - RNA, 19 nt, Homo sapiens
gaaccuucuuugaaugaaa

SEQ ID NO: 89163 - RNA, 19 nt, Homo sapiens
gaccacccauggaagauaa

SEQ ID NO: 89164 - RNA, 19 nt, Homo sapiens
ggacaaccuuauuucucua

SEQ ID NO: 89165 - RNA, 19 nt, Homo sapiens
guggaagaguguuagauuu

SEQ ID NO: 89166 - RNA, 19 nt, Homo sapiens
gagacaagcucaggccuau

SEQ ID NO: 89167 - RNA, 19 nt, Homo sapiens
ccauggagguuuaugaaga

SEQ ID NO: 89168 - RNA, 19 nt, Homo sapiens
gaccuuauguugcuacugu

SEQ ID NO: 89169 - RNA, 19 nt, Homo sapiens
gaucuccaccuucuucuaa

SEQ ID NO: 89170 - RNA, 19 nt, Homo sapiens
ggacauucaugcaauaagg

SEQ ID NO: 89171 - RNA, 19 nt, Homo sapiens
aaagcuccauuccgacuua

SEQ ID NO: 89172 - RNA, 19 nt, Homo sapiens
uaaauugccucuaacuuac

SEQ ID NO: 89173 - RNA, 19 nt, Homo sapiens
ucaaagugcaggauauuaa

SEQ ID NO: 89174 - RNA, 19 nt, Homo sapiens
ggacaacggucacauuucc

SEQ ID NO: 89175 - RNA, 19 nt, Homo sapiens
ggaauauaauacagcagaa

SEQ ID NO: 89176 - RNA, 19 nt, Homo sapiens
caucagcuuuguuaccuaa

SEQ ID NO: 89177 - RNA, 19 nt, Homo sapiens
uuacugacaugacaaccua

SEQ ID NO: 89178 - RNA, 19 nt, Homo sapiens
caucaaaggcuacaggaaa

SEQ ID NO: 89179 - RNA, 19 nt, Homo sapiens
uaagggauuucauucauca

SEQ ID NO: 89180 - RNA, 19 nt, Homo sapiens
gcaagccgcucuacaccau

SEQ ID NO: 89181 - RNA, 19 nt, Homo sapiens
cccuuuagauggaauauaa

SEQ ID NO: 89182 - RNA, 19 nt, Homo sapiens
uuauugaucugaaggguaa

SEQ ID NO: 89183 - RNA, 19 nt, Homo sapiens
ucacauuuccaacguguua

SEQ ID NO: 89184 - RNA, 19 nt, Homo sapiens
acacagacauaagggauuu

SEQ ID NO: 89185 - RNA, 19 nt, Homo sapiens
guuagguacuucauagauu

SEQ ID NO: 89186 - RNA, 19 nt, Homo sapiens
gcgaagaagagaguuauaa

SEQ ID NO: 89187 - RNA, 19 nt, Homo sapiens
gaaggcauacacuuucaaa

SEQ ID NO: 89188 - RNA, 19 nt, Homo sapiens
caaccuuauuucucuauug

SEQ ID NO: 89189 - RNA, 19 nt, Homo sapiens
gggacaaccuuauuucucu

SEQ ID NO: 89190 - RNA, 19 nt, Homo sapiens
uaaagugccuauugaaacu

SEQ ID NO: 89191 - RNA, 19 nt, Homo sapiens
caacaagagauacauccua

SEQ ID NO: 89192 - RNA, 19 nt, Homo sapiens
gggacaagauuccuuugau

SEQ ID NO: 89193 - RNA, 19 nt, Homo sapiens
cauaagggauuucauucau

SEQ ID NO: 89194 - RNA, 19 nt, Homo sapiens
guucgugacuucagaaaca

SEQ ID NO: 89195 - RNA, 19 nt, Homo sapiens
gcuguuagguacuucauag

SEQ ID NO: 89196 - RNA, 19 nt, Homo sapiens
uaaggagccuagauagaga

SEQ ID NO: 89197 - RNA, 19 nt, Homo sapiens
acgauucacuggccacaua

SEQ ID NO: 89198 - RNA, 19 nt, Homo sapiens
ggaagauaacacagacaua

SEQ ID NO: 89199 - RNA, 19 nt, Homo sapiens
cugcuaggcucguuuaaug

SEQ ID NO: 89200 - RNA, 19 nt, Homo sapiens
gaccagcaaagucaauaua

SEQ ID NO: 89201 - RNA, 19 nt, Homo sapiens
ggacauagaaaccagaaag

SEQ ID NO: 89202 - RNA, 19 nt, Homo sapiens
gauguccagugcuauagaa

SEQ ID NO: 89203 - RNA, 19 nt, Homo sapiens
agacauguuuggcgaagaa

SEQ ID NO: 89204 - RNA, 19 nt, Homo sapiens
gcaggcagcaagaguugua

SEQ ID NO: 89205 - RNA, 19 nt, Homo sapiens
gaaccaucgccacuaauga

SEQ ID NO: 89206 - RNA, 19 nt, Homo sapiens
gaaauuuguuugacaucgu

SEQ ID NO: 89207 - RNA, 19 nt, Homo sapiens
uaauacagcagaagccuuu

SEQ ID NO: 89208 - RNA, 19 nt, Homo sapiens
gcacagugauuuggaaagg

SEQ ID NO: 89209 - RNA, 19 nt, Homo sapiens
ucaaaggcacgcuguguuu

SEQ ID NO: 89210 - RNA, 19 nt, Homo sapiens
ccauuacgaugaugaagga

SEQ ID NO: 89211 - RNA, 19 nt, Homo sapiens
gaaggaaccaucgccacua

SEQ ID NO: 89212 - RNA, 19 nt, Homo sapiens
aagagggagucaucaaauu

SEQ ID NO: 89213 - RNA, 19 nt, Homo sapiens
acagagaagucaaagaaca

SEQ ID NO: 89214 - RNA, 19 nt, Homo sapiens
uuuccucccuguuguaaua

SEQ ID NO: 89215 - RNA, 19 nt, Homo sapiens
gcagaugacccgaccuaug

SEQ ID NO: 89216 - RNA, 19 nt, Homo sapiens
gagccuagauagagaagag

SEQ ID NO: 89217 - RNA, 19 nt, Homo sapiens
ccugguuucuaguaaguua

SEQ ID NO: 89218 - RNA, 19 nt, Homo sapiens
ggccacauaugccuacgaa

SEQ ID NO: 89219 - RNA, 19 nt, Homo sapiens
agacauaagggauuucauu

SEQ ID NO: 89220 - RNA, 19 nt, Homo sapiens
gcaacaauucuccuuuaga

SEQ ID NO: 89221 - RNA, 19 nt, Homo sapiens
gacagcuacuuuacaauag

SEQ ID NO: 89222 - RNA, 19 nt, Homo sapiens
cagagucguuuacagcauu

SEQ ID NO: 89223 - RNA, 19 nt, Homo sapiens
gcuuugauguccagugcua

SEQ ID NO: 89224 - RNA, 19 nt, Homo sapiens
ugacucuccucauuccuuu

SEQ ID NO: 89225 - RNA, 19 nt, Homo sapiens
ggaaccaucgccacuaaug

SEQ ID NO: 89226 - RNA, 19 nt, Homo sapiens
gcagugcuguuagguacuu

SEQ ID NO: 89227 - RNA, 19 nt, Homo sapiens
ggauggaccuuauguugcu

SEQ ID NO: 89228 - RNA, 19 nt, Homo sapiens
aaacguggcuggguaugga

SEQ ID NO: 89229 - RNA, 19 nt, Homo sapiens
gcagaagccuuuucaucaa

SEQ ID NO: 89230 - RNA, 19 nt, Homo sapiens
gauugaaacccgaagaaau

SEQ ID NO: 89231 - RNA, 19 nt, Homo sapiens
aaggaaccaucgccacuaa

SEQ ID NO: 89232 - RNA, 19 nt, Homo sapiens
uuagguacuucauagauug

SEQ ID NO: 89233 - RNA, 19 nt, Homo sapiens
cagaauucaucaucaaagu

SEQ ID NO: 89234 - RNA, 19 nt, Homo sapiens
gguggaagaguguuagauu

SEQ ID NO: 89235 - RNA, 19 nt, Homo sapiens
aacaagagauacauccuau

SEQ ID NO: 89236 - RNA, 19 nt, Homo sapiens
caaaagugauugaggagaa

SEQ ID NO: 89237 - RNA, 19 nt, Homo sapiens
gagaaaauguuauccaucu

SEQ ID NO: 89238 - RNA, 19 nt, Homo sapiens
gaacagcgauggcggcuua

SEQ ID NO: 89239 - RNA, 19 nt, Homo sapiens
gaauacagauccuuucaaa

SEQ ID NO: 89240 - RNA, 19 nt, Homo sapiens
gaagucauauguugucuuu

SEQ ID NO: 89241 - RNA, 19 nt, Homo sapiens
gcaccaaccugcauuugua

SEQ ID NO: 89242 - RNA, 19 nt, Homo sapiens
ggacugcacuccuggauuu

SEQ ID NO: 89243 - RNA, 19 nt, Homo sapiens
caucaaagcucacaccaaa

SEQ ID NO: 89244 - RNA, 19 nt, Homo sapiens
acaaagagguguacaggua

SEQ ID NO: 89245 - RNA, 19 nt, Homo sapiens
ggucauacaugcauacaaa

SEQ ID NO: 89246 - RNA, 19 nt, Homo sapiens
ggacacagaucaugguaga

SEQ ID NO: 89247 - RNA, 19 nt, Homo sapiens
ggaaggagcugugggaguu

SEQ ID NO: 89248 - RNA, 19 nt, Homo sapiens
gagaaguaaucgcuguuua

SEQ ID NO: 89249 - RNA, 19 nt, Homo sapiens
gaaagggaguggaucaaga

SEQ ID NO: 89250 - RNA, 19 nt, Homo sapiens
caagguggguggaaacuaa

SEQ ID NO: 89251 - RNA, 19 nt, Homo sapiens
cagguuggcugaauauuaa

SEQ ID NO: 89252 - RNA, 19 nt, Homo sapiens
gauaaagucuggaagaucu

SEQ ID NO: 89253 - RNA, 19 nt, Homo sapiens
gcagguuggcugaauauua

SEQ ID NO: 89254 - RNA, 19 nt, Homo sapiens
cuacaucgauccugagaaa

SEQ ID NO: 89255 - RNA, 19 nt, Homo sapiens
ggaaguagaagucauaugu

SEQ ID NO: 89256 - RNA, 19 nt, Homo sapiens
gaagggaugcuuucuguug

SEQ ID NO: 89257 - RNA, 19 nt, Homo sapiens
gaacaaagcaaacuacaac

SEQ ID NO: 89258 - RNA, 19 nt, Homo sapiens
ggagaccacugaugucaau

SEQ ID NO: 89259 - RNA, 19 nt, Homo sapiens
gaggaccagucaauucuaa

SEQ ID NO: 89260 - RNA, 19 nt, Homo sapiens
gagcagagcaggcaauuuc

SEQ ID NO: 89261 - RNA, 19 nt, Homo sapiens
caacuaggccucaauuguu

SEQ ID NO: 89262 - RNA, 19 nt, Homo sapiens
gcaagguagucgauaguga

SEQ ID NO: 89263 - RNA, 19 nt, Homo sapiens
gaaguccuuucucuuuauu

SEQ ID NO: 89264 - RNA, 19 nt, Homo sapiens
caggaacaaugacuacuuu

SEQ ID NO: 89265 - RNA, 19 nt, Homo sapiens
caucgaggcucaagauaug

SEQ ID NO: 89266 - RNA, 19 nt, Homo sapiens
cagaaaguguuccauauca

SEQ ID NO: 89267 - RNA, 19 nt, Homo sapiens
cagauagaguuccauauau

SEQ ID NO: 89268 - RNA, 19 nt, Homo sapiens
gagaacuccugacgucuga

SEQ ID NO: 89269 - RNA, 19 nt, Homo sapiens
ggugacagauucagggaaa

SEQ ID NO: 89270 - RNA, 19 nt, Homo sapiens
uaaugcaguugcuuacuaa

SEQ ID NO: 89271 - RNA, 19 nt, Homo sapiens
gagagacuauccuggagaa

SEQ ID NO: 89272 - RNA, 19 nt, Homo sapiens
ccacaucacuguccuggau

SEQ ID NO: 89273 - RNA, 19 nt, Homo sapiens
ucaagagccuaaaggaauu

SEQ ID NO: 89274 - RNA, 19 nt, Homo sapiens
cauauagaaugcagagauu

SEQ ID NO: 89275 - RNA, 19 nt, Homo sapiens
acagauagaguuccauaua

SEQ ID NO: 89276 - RNA, 19 nt, Homo sapiens
uauuagagcucgccacgaa

SEQ ID NO: 89277 - RNA, 19 nt, Homo sapiens
gguauucuguuuacaagga

SEQ ID NO: 89278 - RNA, 19 nt, Homo sapiens
gagacagccuuucccaaga

SEQ ID NO: 89279 - RNA, 19 nt, Homo sapiens
acacacacacgcuuucuua

SEQ ID NO: 89280 - RNA, 19 nt, Homo sapiens
ggaaaccacccaugacgaa

SEQ ID NO: 89281 - RNA, 19 nt, Homo sapiens
ucaaagcucacaccaaauu

SEQ ID NO: 89282 - RNA, 19 nt, Homo sapiens
ucaaaccauuggacuauga

SEQ ID NO: 89283 - RNA, 19 nt, Homo sapiens
guaggaaguagaagucaua

SEQ ID NO: 89284 - RNA, 19 nt, Homo sapiens
uuaaugcaguugcuuacua

SEQ ID NO: 89285 - RNA, 19 nt, Homo sapiens
acacauauauacccacaug

SEQ ID NO: 89286 - RNA, 19 nt, Homo sapiens
uggacuggauguuggauua

SEQ ID NO: 89287 - RNA, 19 nt, Homo sapiens
caauuucacuuagucugua

SEQ ID NO: 89288 - RNA, 19 nt, Homo sapiens
uggcagaacucgugauugu

SEQ ID NO: 89289 - RNA, 19 nt, Homo sapiens
gaaaguguuccauaucaau

SEQ ID NO: 89290 - RNA, 19 nt, Homo sapiens
gauagaguuccauauauug

SEQ ID NO: 89291 - RNA, 19 nt, Homo sapiens
ugaauugacuaccguuguu

SEQ ID NO: 89292 - RNA, 19 nt, Homo sapiens
gaugcuuucuguugucaaa

SEQ ID NO: 89293 - RNA, 19 nt, Homo sapiens
gggcagagcuuugaaaucc

SEQ ID NO: 89294 - RNA, 19 nt, Homo sapiens
aguaaucgcuguuuaucaa

SEQ ID NO: 89295 - RNA, 19 nt, Homo sapiens
gaacuaggguaaggugagu

SEQ ID NO: 89296 - RNA, 19 nt, Homo sapiens
gaaaguuagugcuuguucu

SEQ ID NO: 89297 - RNA, 19 nt, Homo sapiens
cuaucgaacuucacaacua

SEQ ID NO: 89298 - RNA, 19 nt, Homo sapiens
caagccaucucccaacaug

SEQ ID NO: 89299 - RNA, 19 nt, Homo sapiens
gaucaagagccuaaaggaa

SEQ ID NO: 89300 - RNA, 19 nt, Homo sapiens
ugacgaauaucacagaucu

SEQ ID NO: 89301 - RNA, 19 nt, Homo sapiens
aaaccucaguguagucauu

SEQ ID NO: 89302 - RNA, 19 nt, Homo sapiens
ccauuggacuaugaaauuu

SEQ ID NO: 89303 - RNA, 19 nt, Homo sapiens
gaaguagaagucauauguu

SEQ ID NO: 89304 - RNA, 19 nt, Homo sapiens
agugacagcuuguggcuuu

SEQ ID NO: 89305 - RNA, 19 nt, Homo sapiens
caucaaaccaucagguauu

SEQ ID NO: 89306 - RNA, 19 nt, Homo sapiens
ccagucaauucuaaacuug

SEQ ID NO: 89307 - RNA, 19 nt, Homo sapiens
cagcagaaaguguuccaua

SEQ ID NO: 89308 - RNA, 19 nt, Homo sapiens
gauagugacaggccagaaa

SEQ ID NO: 89309 - RNA, 19 nt, Homo sapiens
gugagugucuuagcauauu

SEQ ID NO: 89310 - RNA, 19 nt, Homo sapiens
ucacgcuguuuguuucaua

SEQ ID NO: 89311 - RNA, 19 nt, Homo sapiens
gcugaagucugugaugaug

SEQ ID NO: 89312 - RNA, 19 nt, Homo sapiens
caagagauguuggcaaggu

SEQ ID NO: 89313 - RNA, 19 nt, Homo sapiens
aaguagaagucauauguug

SEQ ID NO: 89314 - RNA, 19 nt, Homo sapiens
ggacuacaaccaauuuaca

SEQ ID NO: 89315 - RNA, 19 nt, Homo sapiens
ccaggcagguccacagaga

SEQ ID NO: 89316 - RNA, 19 nt, Homo sapiens
ucacagaucucaggguaca

SEQ ID NO: 89317 - RNA, 19 nt, Homo sapiens
acagauccuuucaaauuug

SEQ ID NO: 89318 - RNA, 19 nt, Homo sapiens
caucagguauucuguuuac

SEQ ID NO: 89319 - RNA, 19 nt, Homo sapiens
gcagaaaguguuccauauc

SEQ ID NO: 89320 - RNA, 19 nt, Homo sapiens
gaaguaaucgcuguuuauc

SEQ ID NO: 89321 - RNA, 19 nt, Homo sapiens
agucauauguugucuuugu

SEQ ID NO: 89322 - RNA, 19 nt, Homo sapiens
gacaagccaucucccaaca

SEQ ID NO: 89323 - RNA, 19 nt, Homo sapiens
gaccuuggacagagaagua

SEQ ID NO: 89324 - RNA, 19 nt, Homo sapiens
uaagggaaacgacaagcua

SEQ ID NO: 89325 - RNA, 19 nt, Homo sapiens
guaugaguaucuguaugua

SEQ ID NO: 89326 - RNA, 19 nt, Homo sapiens
gcaggaacaaugacuacuu

SEQ ID NO: 89327 - RNA, 19 nt, Homo sapiens
guuuacagcuaucgaacuu

SEQ ID NO: 89328 - RNA, 19 nt, Homo sapiens
aaaugaagacccacucgua

SEQ ID NO: 89329 - RNA, 19 nt, Homo sapiens
gaucaucgaggcucaagau

SEQ ID NO: 89330 - RNA, 19 nt, Homo sapiens
gaugacagccuuugaugca

SEQ ID NO: 89331 - RNA, 19 nt, Homo sapiens
aaagagguccauuguggua

SEQ ID NO: 89332 - RNA, 19 nt, Homo sapiens
ugacuaccguuguuugcaa

SEQ ID NO: 89333 - RNA, 19 nt, Homo sapiens
gcaucuuccucccuccuuu

SEQ ID NO: 89334 - RNA, 19 nt, Homo sapiens
agucuguacuucaucauuu

SEQ ID NO: 89335 - RNA, 19 nt, Homo sapiens
uagcugaagucugugauga

SEQ ID NO: 89336 - RNA, 19 nt, Homo sapiens
cggcuuaguugcucugaga

SEQ ID NO: 89337 - RNA, 19 nt, Homo sapiens
caaucuauguuugcacuug

SEQ ID NO: 89338 - RNA, 19 nt, Homo sapiens
ugaaggcccuggacuauga

SEQ ID NO: 89339 - RNA, 19 nt, Homo sapiens
ggacaucgccgacuucauc

SEQ ID NO: 89340 - RNA, 19 nt, Homo sapiens
ccacggaccuggagauugu

SEQ ID NO: 89341 - RNA, 19 nt, Homo sapiens
cgacacagcccucaucuau

SEQ ID NO: 89342 - RNA, 19 nt, Homo sapiens
gcuagucucuuucaugcaa

SEQ ID NO: 89343 - RNA, 19 nt, Homo sapiens
caacuacgaugagcaagga

SEQ ID NO: 89344 - RNA, 19 nt, Homo sapiens
ggacuacgacuaccucaga

SEQ ID NO: 89345 - RNA, 19 nt, Homo sapiens
ggacgaccuucgagacaau

SEQ ID NO: 89346 - RNA, 19 nt, Homo sapiens
gguguucuguccauuguga

SEQ ID NO: 89347 - RNA, 19 nt, Homo sapiens
acagcaaccuccuggguaa

SEQ ID NO: 89348 - RNA, 19 nt, Homo sapiens
ggguaaaucugaaugaaaa

SEQ ID NO: 89349 - RNA, 19 nt, Homo sapiens
ccagugaaccucaucuuug

SEQ ID NO: 89350 - RNA, 19 nt, Homo sapiens
cagugaaccucaucuuugu

SEQ ID NO: 89351 - RNA, 19 nt, Homo sapiens
gcgaugaggaccaggacua

SEQ ID NO: 89352 - RNA, 19 nt, Homo sapiens
acaauguccucaacuacga

SEQ ID NO: 89353 - RNA, 19 nt, Homo sapiens
ugagagcugugaacacuac

SEQ ID NO: 89354 - RNA, 19 nt, Homo sapiens
uaugagagcugugaacacu

SEQ ID NO: 89355 - RNA, 19 nt, Homo sapiens
ggaccuggagauuguaguu

SEQ ID NO: 89356 - RNA, 19 nt, Homo sapiens
gcacugcuacccagacaca

SEQ ID NO: 89357 - RNA, 19 nt, Homo sapiens
aagugucggugcagaauga

SEQ ID NO: 89358 - RNA, 19 nt, Homo sapiens
caccagggaugaguucuuc

SEQ ID NO: 89359 - RNA, 19 nt, Homo sapiens
ggaccaggacuacgacuac

SEQ ID NO: 89360 - RNA, 19 nt, Homo sapiens
gcagguggcggacaugucu

SEQ ID NO: 89361 - RNA, 19 nt, Homo sapiens
caggagagauccgcacagu

SEQ ID NO: 89362 - RNA, 19 nt, Homo sapiens
ccaggacgccuacgacauc

SEQ ID NO: 89363 - RNA, 19 nt, Homo sapiens
ugaacacuacgaacucaaa

SEQ ID NO: 89364 - RNA, 19 nt, Homo sapiens
gcaaccuccuggguaaauc

SEQ ID NO: 89365 - RNA, 19 nt, Homo sapiens
gugaaccucaucuuuguau

SEQ ID NO: 89366 - RNA, 19 nt, Homo sapiens
gggcacugcuacccagaca

SEQ ID NO: 89367 - RNA, 19 nt, Homo sapiens
gaacacuacgaacucaaag

SEQ ID NO: 89368 - RNA, 19 nt, Homo sapiens
gagcugugaacacuacgaa

SEQ ID NO: 89369 - RNA, 19 nt, Homo sapiens
caaagugucggugcagaau

SEQ ID NO: 89370 - RNA, 19 nt, Homo sapiens
gaggguguucuguccauug

SEQ ID NO: 89371 - RNA, 19 nt, Homo sapiens
cgucuucucuaucgacaag

SEQ ID NO: 89372 - RNA, 19 nt, Homo sapiens
aaaacgugcuagucucuuu

SEQ ID NO: 89373 - RNA, 19 nt, Homo sapiens
gggcagccuccuuccugua

SEQ ID NO: 89374 - RNA, 19 nt, Homo sapiens
gcgagcagccucugaacgu

SEQ ID NO: 89375 - RNA, 19 nt, Homo sapiens
gcacggaccccaagaccaa

SEQ ID NO: 89376 - RNA, 19 nt, Homo sapiens
ucaaagugucggugcagaa

SEQ ID NO: 89377 - RNA, 19 nt, Homo sapiens
gcuuggaggcugcagauag

SEQ ID NO: 89378 - RNA, 19 nt, Homo sapiens
ggaugugggacgccuggaa

SEQ ID NO: 89379 - RNA, 19 nt, Homo sapiens
cuuggaggcugcagauagu

SEQ ID NO: 89380 - RNA, 19 nt, Homo sapiens
ggacuaugagagcugugaa

SEQ ID NO: 89381 - RNA, 19 nt, Homo sapiens
ggaagacuggcugcaagug

SEQ ID NO: 89382 - RNA, 19 nt, Homo sapiens
ggagauuguaguuguggau

SEQ ID NO: 89383 - RNA, 19 nt, Homo sapiens
gacacagcccucaucuaug

SEQ ID NO: 89384 - RNA, 19 nt, Homo sapiens
ggaggugaacgaccaugca

SEQ ID NO: 89385 - RNA, 19 nt, Homo sapiens
ccagugugccgccuuacga

SEQ ID NO: 89386 - RNA, 19 nt, Homo sapiens
caucgccgacuucaucaau

SEQ ID NO: 89387 - RNA, 19 nt, Homo sapiens
cagccaucaucacccuuga

SEQ ID NO: 89388 - RNA, 19 nt, Homo sapiens
uggguaaaucugaaugaaa

SEQ ID NO: 89389 - RNA, 19 nt, Homo sapiens
cuggguaaaucugaaugaa

SEQ ID NO: 89390 - RNA, 19 nt, Homo sapiens
ccuccuggguaaaucugaa

SEQ ID NO: 89391 - RNA, 19 nt, Homo sapiens
gcagcgucaucuacagcau

SEQ ID NO: 89392 - RNA, 19 nt, Homo sapiens
gaucagcguauccgagaac

SEQ ID NO: 89393 - RNA, 19 nt, Homo sapiens
ucgagauccuggaggugaa

SEQ ID NO: 89394 - RNA, 19 nt, Homo sapiens
ggacuacgacccggaagac

SEQ ID NO: 89395 - RNA, 19 nt, Homo sapiens
gaccaacgaggguguucug

SEQ ID NO: 89396 - RNA, 19 nt, Homo sapiens
ugugaacacuacgaacuca

SEQ ID NO: 89397 - RNA, 19 nt, Homo sapiens
gccacugccucagccauca

SEQ ID NO: 89398 - RNA, 19 nt, Homo sapiens
gcaagaaccucaguuauga

SEQ ID NO: 89399 - RNA, 19 nt, Homo sapiens
guucaucacuucccagauu

SEQ ID NO: 89400 - RNA, 19 nt, Homo sapiens
gaaggcgacugucugaaug

SEQ ID NO: 89401 - RNA, 19 nt, Homo sapiens
gagaggagcaggcagagua

SEQ ID NO: 89402 - RNA, 19 nt, Homo sapiens
ggagccacgugaacacaua

SEQ ID NO: 89403 - RNA, 19 nt, Homo sapiens
caacucggaucuucgauuc

SEQ ID NO: 89404 - RNA, 19 nt, Homo sapiens
gguguuugcccaauaauaa

SEQ ID NO: 89405 - RNA, 19 nt, Homo sapiens
aaacuaugguggaaauuuc

SEQ ID NO: 89406 - RNA, 19 nt, Homo sapiens
ggaagaaggacccggauca

SEQ ID NO: 89407 - RNA, 19 nt, Homo sapiens
guacugaagugacuagacu

SEQ ID NO: 89408 - RNA, 19 nt, Homo sapiens
gaagucgcagucacagaua

SEQ ID NO: 89409 - RNA, 19 nt, Homo sapiens
cuuuauaccugaccaaguu

SEQ ID NO: 89410 - RNA, 19 nt, Homo sapiens
caggguguuugcccaauaa

SEQ ID NO: 89411 - RNA, 19 nt, Homo sapiens
gagcucaguccaccaggua

SEQ ID NO: 89412 - RNA, 19 nt, Homo sapiens
ucaggguguuugcccaaua

SEQ ID NO: 89413 - RNA, 19 nt, Homo sapiens
gcagugggcauccuuguag

SEQ ID NO: 89414 - RNA, 19 nt, Homo sapiens
gaagaaggacccggaucaa

SEQ ID NO: 89415 - RNA, 19 nt, Homo sapiens
ccaauucccacguugugua

SEQ ID NO: 89416 - RNA, 19 nt, Homo sapiens
ggaagucuccaucauagag

SEQ ID NO: 89417 - RNA, 19 nt, Homo sapiens
gcaggcagaguaccagcua

SEQ ID NO: 89418 - RNA, 19 nt, Homo sapiens
cagcacgugugaagucgaa

SEQ ID NO: 89419 - RNA, 19 nt, Homo sapiens
gaaauuucccuuuauaccu

SEQ ID NO: 89420 - RNA, 19 nt, Homo sapiens
gagccuggacaccaacuuu

SEQ ID NO: 89421 - RNA, 19 nt, Homo sapiens
gguucucccuagucaauga

SEQ ID NO: 89422 - RNA, 19 nt, Homo sapiens
gcacgugaaggaugagaau

SEQ ID NO: 89423 - RNA, 19 nt, Homo sapiens
ggaggcaccaucaccauca

SEQ ID NO: 89424 - RNA, 19 nt, Homo sapiens
gcucugcauugagaaauuc

SEQ ID NO: 89425 - RNA, 19 nt, Homo sapiens
ggcuguggcugcuuugugu

SEQ ID NO: 89426 - RNA, 19 nt, Homo sapiens
gcaggauggacaugucuug

SEQ ID NO: 89427 - RNA, 19 nt, Homo sapiens
ggacaggacagaguagaag

SEQ ID NO: 89428 - RNA, 19 nt, Homo sapiens
ugaaggcgacugucugaau

SEQ ID NO: 89429 - RNA, 19 nt, Homo sapiens
cgaagucgcagucacagau

SEQ ID NO: 89430 - RNA, 19 nt, Homo sapiens
gaugcaggauggacauguc

SEQ ID NO: 89431 - RNA, 19 nt, Homo sapiens
gaaggacccggaucaacca

SEQ ID NO: 89432 - RNA, 19 nt, Homo sapiens
ugaggcagcuccaagucau

SEQ ID NO: 89433 - RNA, 19 nt, Homo sapiens
gcaacugagggcccauuug

SEQ ID NO: 89434 - RNA, 19 nt, Homo sapiens
gugauccacuuccuaaagg

SEQ ID NO: 89435 - RNA, 19 nt, Homo sapiens
ugcaagaaccucaguuaug

SEQ ID NO: 89436 - RNA, 19 nt, Homo sapiens
gcacagccaacucggaucu

SEQ ID NO: 89437 - RNA, 19 nt, Homo sapiens
caacugagggcccauuugc

SEQ ID NO: 89438 - RNA, 19 nt, Homo sapiens
gcucuuuccugcugaccau

SEQ ID NO: 89439 - RNA, 19 nt, Homo sapiens
ggcuggcucugcauugaga

SEQ ID NO: 89440 - RNA, 19 nt, Homo sapiens
ucugcaagaaccucaguua

SEQ ID NO: 89441 - RNA, 19 nt, Homo sapiens
gcugggcccuaugggauug

SEQ ID NO: 89442 - RNA, 19 nt, Homo sapiens
ggguguuugcccaauaaua

SEQ ID NO: 89443 - RNA, 19 nt, Homo sapiens
gcuccugguucgagugauc

SEQ ID NO: 89444 - RNA, 19 nt, Homo sapiens
cagccacaaugcccagaug

SEQ ID NO: 89445 - RNA, 19 nt, Homo sapiens
ggugauccacuuccuaaag

SEQ ID NO: 89446 - RNA, 19 nt, Homo sapiens
ggcucugcauugagaaauu

SEQ ID NO: 89447 - RNA, 19 nt, Homo sapiens
gaaucuuccucauccucau

SEQ ID NO: 89448 - RNA, 19 nt, Homo sapiens
acagaugagccgagacuga

SEQ ID NO: 89449 - RNA, 19 nt, Homo sapiens
cauguuagacucagacucu

SEQ ID NO: 89450 - RNA, 19 nt, Homo sapiens
gcagucacagauaucaaug

SEQ ID NO: 89451 - RNA, 19 nt, Homo sapiens
ccgggacccuuugaaguga

SEQ ID NO: 89452 - RNA, 19 nt, Homo sapiens
agagcugucuguggaaguu

SEQ ID NO: 89453 - RNA, 19 nt, Homo sapiens
gagccacgugaacacauaa

SEQ ID NO: 89454 - RNA, 19 nt, Homo sapiens
ccagaaaacuaugguggaa

SEQ ID NO: 89455 - RNA, 19 nt, Homo sapiens
gggacaggacagaguagaa

SEQ ID NO: 89456 - RNA, 19 nt, Homo sapiens
gagcccagcacccaagauc

SEQ ID NO: 89457 - RNA, 19 nt, Homo sapiens
ggcagugggcauccuugua

SEQ ID NO: 89458 - RNA, 19 nt, Homo sapiens
acugagggcccauuugcua

SEQ ID NO: 89459 - RNA, 19 nt, Homo sapiens
gcaccacauggcccaggua

SEQ ID NO: 89460 - RNA, 19 nt, Homo sapiens
gggugucccuagagccuau

SEQ ID NO: 89461 - RNA, 19 nt, Homo sapiens
ccaacucggaucuucgauu

SEQ ID NO: 89462 - RNA, 19 nt, Homo sapiens
agaaaacuaugguggaaau

SEQ ID NO: 89463 - RNA, 19 nt, Homo sapiens
cagguucucccuagucaau

SEQ ID NO: 89464 - RNA, 19 nt, Homo sapiens
gcuaacagccauugaugcu

SEQ ID NO: 89465 - RNA, 19 nt, Homo sapiens
cuauccaccuggcagagaa

SEQ ID NO: 89466 - RNA, 19 nt, Homo sapiens
cagcagcacgugugaaguc

SEQ ID NO: 89467 - RNA, 19 nt, Homo sapiens
agaaugacaacgugccuau

SEQ ID NO: 89468 - RNA, 19 nt, Homo sapiens
gaaucucaaaguccuauac

SEQ ID NO: 89469 - RNA, 19 nt, Homo sapiens
ggagaugcaggauggacau

SEQ ID NO: 89470 - RNA, 19 nt, Homo sapiens
ggugauggaugagaaugac

SEQ ID NO: 89471 - RNA, 19 nt, Homo sapiens
gccuggcuguggcugcuuu

SEQ ID NO: 89472 - RNA, 19 nt, Homo sapiens
ccugaaggcgacugucuga

SEQ ID NO: 89473 - RNA, 19 nt, Homo sapiens
ggacucugguggccaugcu

SEQ ID NO: 89474 - RNA, 19 nt, Homo sapiens
caauucccacguuguguau

SEQ ID NO: 89475 - RNA, 19 nt, Homo sapiens
uggaccaugucaaggaaga

SEQ ID NO: 89476 - RNA, 19 nt, Homo sapiens
gcuaguggagagagugaug

SEQ ID NO: 89477 - RNA, 19 nt, Homo sapiens
ggaccaagggagccagucu

SEQ ID NO: 89478 - RNA, 19 nt, Homo sapiens
guguuugcccaauaauaaa

SEQ ID NO: 89479 - RNA, 19 nt, Homo sapiens
ccuuccgccucauggauuu

SEQ ID NO: 89480 - RNA, 19 nt, Homo sapiens
ugcagagccuggacaccaa

SEQ ID NO: 89481 - RNA, 19 nt, Homo sapiens
gaccaagggagccagucuu

SEQ ID NO: 89482 - RNA, 19 nt, Homo sapiens
gauguggcagcuccugguu

SEQ ID NO: 89483 - RNA, 19 nt, Homo sapiens
gcacgugugaagucgaagu

SEQ ID NO: 89484 - RNA, 19 nt, Homo sapiens
caggugcgggcucagaauu

SEQ ID NO: 89485 - RNA, 19 nt, Homo sapiens
gggacccuuugaagugaau

SEQ ID NO: 89486 - RNA, 19 nt, Homo sapiens
gggagggacuucuguauua

SEQ ID NO: 89487 - RNA, 19 nt, Homo sapiens
gagaauuccuucagugaua

SEQ ID NO: 89488 - RNA, 19 nt, Homo sapiens
gaaugaagcaccucaauuu

SEQ ID NO: 89489 - RNA, 19 nt, Homo sapiens
gcaaauggcuuagcuacuu

SEQ ID NO: 89490 - RNA, 19 nt, Homo sapiens
gaaacaagaucuacucaca

SEQ ID NO: 89491 - RNA, 19 nt, Homo sapiens
caucuaacgugcauuauaa

SEQ ID NO: 89492 - RNA, 19 nt, Homo sapiens
ggaaggcauuguuucuuua

SEQ ID NO: 89493 - RNA, 19 nt, Homo sapiens
gacauaagcuauucacuga

SEQ ID NO: 89494 - RNA, 19 nt, Homo sapiens
ggaaagcccuucuuguaug

SEQ ID NO: 89495 - RNA, 19 nt, Homo sapiens
ggugacaaaucaagaauaa

SEQ ID NO: 89496 - RNA, 19 nt, Homo sapiens
aaacagauauucccucuug

SEQ ID NO: 89497 - RNA, 19 nt, Homo sapiens
gcacccaccuacuuagaua

SEQ ID NO: 89498 - RNA, 19 nt, Homo sapiens
caacaaccaucucauccua

SEQ ID NO: 89499 - RNA, 19 nt, Homo sapiens
gaaagucagugaggaugua

SEQ ID NO: 89500 - RNA, 19 nt, Homo sapiens
cuaagaauccuuccuauaa

SEQ ID NO: 89501 - RNA, 19 nt, Homo sapiens
ggagacagacaacauauuu

SEQ ID NO: 89502 - RNA, 19 nt, Homo sapiens
ucaagcaucugaagucaaa

SEQ ID NO: 89503 - RNA, 19 nt, Homo sapiens
aagagaagcugccaagauu

SEQ ID NO: 89504 - RNA, 19 nt, Homo sapiens
ccaauggccagcuuuauua

SEQ ID NO: 89505 - RNA, 19 nt, Homo sapiens
caagaaccgagucaaauua

SEQ ID NO: 89506 - RNA, 19 nt, Homo sapiens
gcacaauauuccuuaguug

SEQ ID NO: 89507 - RNA, 19 nt, Homo sapiens
gggcaagacagacucauua

SEQ ID NO: 89508 - RNA, 19 nt, Homo sapiens
gauauucccucuuguccuu

SEQ ID NO: 89509 - RNA, 19 nt, Homo sapiens
gaaccgagucaaauuauau

SEQ ID NO: 89510 - RNA, 19 nt, Homo sapiens
caggaaagcccuucuugua

SEQ ID NO: 89511 - RNA, 19 nt, Homo sapiens
gaaagcccuucuuguaugu

SEQ ID NO: 89512 - RNA, 19 nt, Homo sapiens
caagacagacucauuaaau

SEQ ID NO: 89513 - RNA, 19 nt, Homo sapiens
gcuaaacaguccuugaaga

SEQ ID NO: 89514 - RNA, 19 nt, Homo sapiens
gaucaacaaugucauguac

SEQ ID NO: 89515 - RNA, 19 nt, Homo sapiens
ucauagaacugccuggauu

SEQ ID NO: 89516 - RNA, 19 nt, Homo sapiens
ggagauauaucaguguugu

SEQ ID NO: 89517 - RNA, 19 nt, Homo sapiens
cugagaagcugaauuugaa

SEQ ID NO: 89518 - RNA, 19 nt, Homo sapiens
ccacguuucuccagucaaa

SEQ ID NO: 89519 - RNA, 19 nt, Homo sapiens
ccaguuacauucugcaguu

SEQ ID NO: 89520 - RNA, 19 nt, Homo sapiens
aaccuaugcuggaauguua

SEQ ID NO: 89521 - RNA, 19 nt, Homo sapiens
caucucauccuauuacuuu

SEQ ID NO: 89522 - RNA, 19 nt, Homo sapiens
gcaaagauaauguugaaag

SEQ ID NO: 89523 - RNA, 19 nt, Homo sapiens
aaagaaggauaaaggcaaa

SEQ ID NO: 89524 - RNA, 19 nt, Homo sapiens
gggcauggcaguugguaua

SEQ ID NO: 89525 - RNA, 19 nt, Homo sapiens
aaagaguggugacaaauca

SEQ ID NO: 89526 - RNA, 19 nt, Homo sapiens
gcuaagaauccuuccuaua

SEQ ID NO: 89527 - RNA, 19 nt, Homo sapiens
ugccucagcuuccuaagua

SEQ ID NO: 89528 - RNA, 19 nt, Homo sapiens
uggaaggcauuguuucuuu

SEQ ID NO: 89529 - RNA, 19 nt, Homo sapiens
cacaagagguuggcuuaaa

SEQ ID NO: 89530 - RNA, 19 nt, Homo sapiens
gaaguacaaugcaaguucu

SEQ ID NO: 89531 - RNA, 19 nt, Homo sapiens
ugacagagaauauuuggaa

SEQ ID NO: 89532 - RNA, 19 nt, Homo sapiens
gagggaguaugucgucuug

SEQ ID NO: 89533 - RNA, 19 nt, Homo sapiens
cauauccgcuggaaauuca

SEQ ID NO: 89534 - RNA, 19 nt, Homo sapiens
ggaauugaauccugcuaag

SEQ ID NO: 89535 - RNA, 19 nt, Homo sapiens
ucaacaaugucauguacuu

SEQ ID NO: 89536 - RNA, 19 nt, Homo sapiens
gaagucaaaccucugagaa

SEQ ID NO: 89537 - RNA, 19 nt, Homo sapiens
gagguuggcuuaaaauuga

SEQ ID NO: 89538 - RNA, 19 nt, Homo sapiens
ugaaggacaucaacgacaa

SEQ ID NO: 89539 - RNA, 19 nt, Homo sapiens
gcaagacagacucauuaaa

SEQ ID NO: 89540 - RNA, 19 nt, Homo sapiens
caaauggcuuagcuacuug

SEQ ID NO: 89541 - RNA, 19 nt, Homo sapiens
cuaaguagcuggguuuaca

SEQ ID NO: 89542 - RNA, 19 nt, Homo sapiens
ggauaaaggcaaagauaau

SEQ ID NO: 89543 - RNA, 19 nt, Homo sapiens
gcaccuggaagucucauuu

SEQ ID NO: 89544 - RNA, 19 nt, Homo sapiens
agagggaucucaggaauug

SEQ ID NO: 89545 - RNA, 19 nt, Homo sapiens
ccaagaaccgagucaaauu

SEQ ID NO: 89546 - RNA, 19 nt, Homo sapiens
ggacagagaagccggaagu

SEQ ID NO: 89547 - RNA, 19 nt, Homo sapiens
ccacgugacuggugagauc

SEQ ID NO: 89548 - RNA, 19 nt, Homo sapiens
ccaaaccuaugcuggaaug

SEQ ID NO: 89549 - RNA, 19 nt, Homo sapiens
ggaguacaguggugugauc

SEQ ID NO: 89550 - RNA, 19 nt, Homo sapiens
gauaaaggcaaagauaaug

SEQ ID NO: 89551 - RNA, 19 nt, Homo sapiens
gggaguaugucgucuugau

SEQ ID NO: 89552 - RNA, 19 nt, Homo sapiens
gaaauucuucaacuuggaa

SEQ ID NO: 89553 - RNA, 19 nt, Homo sapiens
ccucugagaagcugaauuu

SEQ ID NO: 89554 - RNA, 19 nt, Homo sapiens
aggcaaagauaauguugaa

SEQ ID NO: 89555 - RNA, 19 nt, Homo sapiens
gacacaagagguuggcuua

SEQ ID NO: 89556 - RNA, 19 nt, Homo sapiens
gagcaaacucccaaacuuc

SEQ ID NO: 89557 - RNA, 19 nt, Homo sapiens
gacagagaauauuuggaaa

SEQ ID NO: 89558 - RNA, 19 nt, Homo sapiens
ccucggcaguggaagcuua

SEQ ID NO: 89559 - RNA, 19 nt, Homo sapiens
cagugaggauguagcuaua

SEQ ID NO: 89560 - RNA, 19 nt, Homo sapiens
caguacaacuuaacgauag

SEQ ID NO: 89561 - RNA, 19 nt, Homo sapiens
caaaggaugaguacggaaa

SEQ ID NO: 89562 - RNA, 19 nt, Homo sapiens
gaauaaacacugguuguag

SEQ ID NO: 89563 - RNA, 19 nt, Homo sapiens
acaaccaucucauccuauu

SEQ ID NO: 89564 - RNA, 19 nt, Homo sapiens
ggacuacacgggcuuguuc

SEQ ID NO: 89565 - RNA, 19 nt, Homo sapiens
aaaccugacucuugcugaa

SEQ ID NO: 89566 - RNA, 19 nt, Homo sapiens
gaauguuacaguuagcuaa

SEQ ID NO: 89567 - RNA, 19 nt, Homo sapiens
gcauaaagaaggauaaagg

SEQ ID NO: 89568 - RNA, 19 nt, Homo sapiens
gcuggaauguuacaguuag

SEQ ID NO: 89569 - RNA, 19 nt, Homo sapiens
agaaccgagucaaauuaua

SEQ ID NO: 89570 - RNA, 19 nt, Homo sapiens
uggcuuagcuacuuguguu

SEQ ID NO: 89571 - RNA, 19 nt, Homo sapiens
gauauuucaugugcuauag

SEQ ID NO: 89572 - RNA, 19 nt, Homo sapiens
caaugugacugccaaggau

SEQ ID NO: 89573 - RNA, 19 nt, Homo sapiens
gcaaugugacugccaagga

SEQ ID NO: 89574 - RNA, 19 nt, Homo sapiens
cuaaacaguccuugaagaa

SEQ ID NO: 89575 - RNA, 19 nt, Homo sapiens
uuucuaaacuacaggauug

SEQ ID NO: 89576 - RNA, 19 nt, Homo sapiens
guacgaaggcucaguaagg

SEQ ID NO: 89577 - RNA, 19 nt, Homo sapiens
ggacaucaacgacaaucga

SEQ ID NO: 89578 - RNA, 19 nt, Homo sapiens
aacaagaucuacucacaau

SEQ ID NO: 89579 - RNA, 19 nt, Homo sapiens
gcucaagcaucugaaguca

SEQ ID NO: 89580 - RNA, 19 nt, Homo sapiens
gcugaagacacaaacauug

SEQ ID NO: 89581 - RNA, 19 nt, Homo sapiens
ccuggacgcuaauggaauu

SEQ ID NO: 89582 - RNA, 19 nt, Homo sapiens
caccaugcccagcuaauuu

SEQ ID NO: 89583 - RNA, 19 nt, Homo sapiens
ggacucuuccuaauccaaa

SEQ ID NO: 89584 - RNA, 19 nt, Homo sapiens
gauggacucuuccuaaucc

SEQ ID NO: 89585 - RNA, 19 nt, Homo sapiens
aauaaacacugguuguagu

SEQ ID NO: 89586 - RNA, 19 nt, Homo sapiens
gaucgaaacuggguuauuu

SEQ ID NO: 89587 - RNA, 19 nt, Homo sapiens
gcauagauguucaggaauu

SEQ ID NO: 89588 - RNA, 19 nt, Homo sapiens
aaagagcccuugaucauuu

SEQ ID NO: 89589 - RNA, 19 nt, Homo sapiens
ggaaaguuaucuuacaaug

SEQ ID NO: 89590 - RNA, 19 nt, Homo sapiens
gcaaauacacaucuugauu

SEQ ID NO: 89591 - RNA, 19 nt, Homo sapiens
gagaagaaacuccauggua

SEQ ID NO: 89592 - RNA, 19 nt, Homo sapiens
uaaagaagccacugaacua

SEQ ID NO: 89593 - RNA, 19 nt, Homo sapiens
gaacauuacuccguaguca

SEQ ID NO: 89594 - RNA, 19 nt, Homo sapiens
gaugaacgccugccuguaa

SEQ ID NO: 89595 - RNA, 19 nt, Homo sapiens
gaagaaguguggaaacagu

SEQ ID NO: 89596 - RNA, 19 nt, Homo sapiens
gaauuugcuuccugaguaa

SEQ ID NO: 89597 - RNA, 19 nt, Homo sapiens
gaccauacauuguuacugu

SEQ ID NO: 89598 - RNA, 19 nt, Homo sapiens
ugaacucuauggagaaaua

SEQ ID NO: 89599 - RNA, 19 nt, Homo sapiens
gcacuccaauucugacaaa

SEQ ID NO: 89600 - RNA, 19 nt, Homo sapiens
ugacaguacuaacagcuua

SEQ ID NO: 89601 - RNA, 19 nt, Homo sapiens
ccaccacgcuuuccucaaa

SEQ ID NO: 89602 - RNA, 19 nt, Homo sapiens
gugcagagguguuauggaa

SEQ ID NO: 89603 - RNA, 19 nt, Homo sapiens
gggacuauauuuaucauug

SEQ ID NO: 89604 - RNA, 19 nt, Homo sapiens
ggacagagaagccagagaa

SEQ ID NO: 89605 - RNA, 19 nt, Homo sapiens
aagcauagauguucaggaa

SEQ ID NO: 89606 - RNA, 19 nt, Homo sapiens
ugacaaaggugauggaucu

SEQ ID NO: 89607 - RNA, 19 nt, Homo sapiens
caacauagaaggagcaaau

SEQ ID NO: 89608 - RNA, 19 nt, Homo sapiens
gaucugaccuuucccugau

SEQ ID NO: 89609 - RNA, 19 nt, Homo sapiens
ggaccaagguuuaacuucu

SEQ ID NO: 89610 - RNA, 19 nt, Homo sapiens
gaaacuccaugguacaaca

SEQ ID NO: 89611 - RNA, 19 nt, Homo sapiens
gaccagauccucaguaugu

SEQ ID NO: 89612 - RNA, 19 nt, Homo sapiens
uuacagaucuaucccaaga

SEQ ID NO: 89613 - RNA, 19 nt, Homo sapiens
gugaagaguuggaaucaga

SEQ ID NO: 89614 - RNA, 19 nt, Homo sapiens
ugacagcaguggagauuga

SEQ ID NO: 89615 - RNA, 19 nt, Homo sapiens
uguauuaucugcccauuau

SEQ ID NO: 89616 - RNA, 19 nt, Homo sapiens
cauauacccucaacauaga

SEQ ID NO: 89617 - RNA, 19 nt, Homo sapiens
gaacauaugggaccagauc

SEQ ID NO: 89618 - RNA, 19 nt, Homo sapiens
gggagaacguggucaccua

SEQ ID NO: 89619 - RNA, 19 nt, Homo sapiens
agaagccacugaacuauga

SEQ ID NO: 89620 - RNA, 19 nt, Homo sapiens
gacaugaccuacuccauca

SEQ ID NO: 89621 - RNA, 19 nt, Homo sapiens
uggaaucaguucuuuguuu

SEQ ID NO: 89622 - RNA, 19 nt, Homo sapiens
gagaaaagguugaaaaugg

SEQ ID NO: 89623 - RNA, 19 nt, Homo sapiens
ggagaaauagaaucugaaa

SEQ ID NO: 89624 - RNA, 19 nt, Homo sapiens
agacauggcugggcaaguu

SEQ ID NO: 89625 - RNA, 19 nt, Homo sapiens
gaaggacaaugaagauaac

SEQ ID NO: 89626 - RNA, 19 nt, Homo sapiens
gagaagccagagaacauua

SEQ ID NO: 89627 - RNA, 19 nt, Homo sapiens
aaacagcgcucgggugguu

SEQ ID NO: 89628 - RNA, 19 nt, Homo sapiens
gaugagaaaccaaaccaaa

SEQ ID NO: 89629 - RNA, 19 nt, Homo sapiens
gauggacaguuaaaucaug

SEQ ID NO: 89630 - RNA, 19 nt, Homo sapiens
cggaggagauuuagucgaa

SEQ ID NO: 89631 - RNA, 19 nt, Homo sapiens
aauccaaacuucacucuga

SEQ ID NO: 89632 - RNA, 19 nt, Homo sapiens
gccaauggaccaagguuua

SEQ ID NO: 89633 - RNA, 19 nt, Homo sapiens
gguauggaaucaguucuuu

SEQ ID NO: 89634 - RNA, 19 nt, Homo sapiens
uagcacaucuugcaucugu

SEQ ID NO: 89635 - RNA, 19 nt, Homo sapiens
gaccaagguuuaacuucuu

SEQ ID NO: 89636 - RNA, 19 nt, Homo sapiens
gagcaaauacacaucuuga

SEQ ID NO: 89637 - RNA, 19 nt, Homo sapiens
caguggagauugagagaaa

SEQ ID NO: 89638 - RNA, 19 nt, Homo sapiens
uauacaaccucagcaauga

SEQ ID NO: 89639 - RNA, 19 nt, Homo sapiens
ugacaacgcuccaaaauuc

SEQ ID NO: 89640 - RNA, 19 nt, Homo sapiens
ggaaagcugcacuccaauu

SEQ ID NO: 89641 - RNA, 19 nt, Homo sapiens
ggaaucaguucuuuguuuu

SEQ ID NO: 89642 - RNA, 19 nt, Homo sapiens
uggacacgcuaaacaauuu

SEQ ID NO: 89643 - RNA, 19 nt, Homo sapiens
gaaaaugguugcuuguguu

SEQ ID NO: 89644 - RNA, 19 nt, Homo sapiens
ugauagacguacaaacaaa

SEQ ID NO: 89645 - RNA, 19 nt, Homo sapiens
gaaagcugcacuccaauuc

SEQ ID NO: 89646 - RNA, 19 nt, Homo sapiens
ccaagugguucagaaugua

SEQ ID NO: 89647 - RNA, 19 nt, Homo sapiens
ggucaccuaugaugaugaa

SEQ ID NO: 89648 - RNA, 19 nt, Homo sapiens
ugaaggacaaugaagauaa

SEQ ID NO: 89649 - RNA, 19 nt, Homo sapiens
ggucaguucuugcaaccuu

SEQ ID NO: 89650 - RNA, 19 nt, Homo sapiens
gcagaugacccuaccuaug

SEQ ID NO: 89651 - RNA, 19 nt, Homo sapiens
gcagaagacccacuaugug

SEQ ID NO: 89652 - RNA, 19 nt, Homo sapiens
ggaaaacugugaacuggaa

SEQ ID NO: 89653 - RNA, 19 nt, Homo sapiens
gaacggccuuacauaacau

SEQ ID NO: 89654 - RNA, 19 nt, Homo sapiens
gggaccagauccucaguau

SEQ ID NO: 89655 - RNA, 19 nt, Homo sapiens
gcagagguguuauggaacu

SEQ ID NO: 89656 - RNA, 19 nt, Homo sapiens
guaaauaugaucugaccuu

SEQ ID NO: 89657 - RNA, 19 nt, Homo sapiens
aaacaggaguuauuagaac

SEQ ID NO: 89658 - RNA, 19 nt, Homo sapiens
ucucuugaaugcucacuaa

SEQ ID NO: 89659 - RNA, 19 nt, Homo sapiens
gcugaacucuauggagaaa

SEQ ID NO: 89660 - RNA, 19 nt, Homo sapiens
ccacugauaaagaugauuu

SEQ ID NO: 89661 - RNA, 19 nt, Homo sapiens
gaucagaagcugggucuau

SEQ ID NO: 89662 - RNA, 19 nt, Homo sapiens
agucacugcuucagaaauu

SEQ ID NO: 89663 - RNA, 19 nt, Homo sapiens
gaagaaacuccaugguaca

SEQ ID NO: 89664 - RNA, 19 nt, Homo sapiens
gccaauacugggaccauua

SEQ ID NO: 89665 - RNA, 19 nt, Homo sapiens
guaagauacuucaucaacu

SEQ ID NO: 89666 - RNA, 19 nt, Homo sapiens
caaguugguucagcuguug

SEQ ID NO: 89667 - RNA, 19 nt, Homo sapiens
cauagauguucaggaauuu

SEQ ID NO: 89668 - RNA, 19 nt, Homo sapiens
gagauuuagucgaacuguu

SEQ ID NO: 89669 - RNA, 19 nt, Homo sapiens
gauacuucaucaacuacaa

SEQ ID NO: 89670 - RNA, 19 nt, Homo sapiens
gcacaagauccugacagua

SEQ ID NO: 89671 - RNA, 19 nt, Homo sapiens
gaccgucguugguacaguu

SEQ ID NO: 89672 - RNA, 19 nt, Homo sapiens
uuagaacggccuuacauaa

SEQ ID NO: 89673 - RNA, 19 nt, Homo sapiens
ggugauauccacucaacaa

SEQ ID NO: 89674 - RNA, 19 nt, Homo sapiens
aaaccaaaccaaacacauu

SEQ ID NO: 89675 - RNA, 19 nt, Homo sapiens
ccucagcaaugacaaggaa

SEQ ID NO: 89676 - RNA, 19 nt, Homo sapiens
acaaggcggaggagauuua

SEQ ID NO: 89677 - RNA, 19 nt, Homo sapiens
gaacuugccagggaauaug

SEQ ID NO: 89678 - RNA, 19 nt, Homo sapiens
guagaugaaccaccacuau

SEQ ID NO: 89679 - RNA, 19 nt, Homo sapiens
gaagucauauacccucaac

SEQ ID NO: 89680 - RNA, 19 nt, Homo sapiens
caaagagaccagagaagga

SEQ ID NO: 89681 - RNA, 19 nt, Homo sapiens
guacaaacaaaccucuuga

SEQ ID NO: 89682 - RNA, 19 nt, Homo sapiens
agaaacagggagccaguua

SEQ ID NO: 89683 - RNA, 19 nt, Homo sapiens
gcaaugacaaggaagaagu

SEQ ID NO: 89684 - RNA, 19 nt, Homo sapiens
ggacaaugaagauaacaca

SEQ ID NO: 89685 - RNA, 19 nt, Homo sapiens
gguuuaacuucuuucuuga

SEQ ID NO: 89686 - RNA, 19 nt, Homo sapiens
gcaccaagaucucaagaaa

SEQ ID NO: 89687 - RNA, 19 nt, Homo sapiens
ggugagagauguuugaauu

SEQ ID NO: 89688 - RNA, 19 nt, Homo sapiens
gagcuuaaccauccuaaua

SEQ ID NO: 89689 - RNA, 19 nt, Homo sapiens
guaccgagcuccugaaauc

SEQ ID NO: 89690 - RNA, 19 nt, Homo sapiens
cagguuauauccaauagua

SEQ ID NO: 89691 - RNA, 19 nt, Homo sapiens
ugagugcucuugcuauuaa

SEQ ID NO: 89692 - RNA, 19 nt, Homo sapiens
uuacuucuaugccugauua

SEQ ID NO: 89693 - RNA, 19 nt, Homo sapiens
gaagaggguugguauaaaa

SEQ ID NO: 89694 - RNA, 19 nt, Homo sapiens
ccucugaacuugccuuaaa

SEQ ID NO: 89695 - RNA, 19 nt, Homo sapiens
accaagaucucaagaaauu

SEQ ID NO: 89696 - RNA, 19 nt, Homo sapiens
ccauaggaguuagaaguua

SEQ ID NO: 89697 - RNA, 19 nt, Homo sapiens
guacaaagccagaaacaag

SEQ ID NO: 89698 - RNA, 19 nt, Homo sapiens
gacaagagcgagagguaua

SEQ ID NO: 89699 - RNA, 19 nt, Homo sapiens
gagaggugguggcgcuuaa

SEQ ID NO: 89700 - RNA, 19 nt, Homo sapiens
ggauugugcuucauuccaa

SEQ ID NO: 89701 - RNA, 19 nt, Homo sapiens
cauaguggguggauuuguu

SEQ ID NO: 89702 - RNA, 19 nt, Homo sapiens
ggucauaguggguggauuu

SEQ ID NO: 89703 - RNA, 19 nt, Homo sapiens
gcuuaaccauccuaauauu

SEQ ID NO: 89704 - RNA, 19 nt, Homo sapiens
ugaagaggguugguauaaa

SEQ ID NO: 89705 - RNA, 19 nt, Homo sapiens
gaagauggacggagcuugu

SEQ ID NO: 89706 - RNA, 19 nt, Homo sapiens
cuuaaacacucaccuucua

SEQ ID NO: 89707 - RNA, 19 nt, Homo sapiens
ggccaggaguuacuucuau

SEQ ID NO: 89708 - RNA, 19 nt, Homo sapiens
agacagggauugugcuuca

SEQ ID NO: 89709 - RNA, 19 nt, Homo sapiens
gaccagcucuuccggaucu

SEQ ID NO: 89710 - RNA, 19 nt, Homo sapiens
gcacuacgacccuaacaag

SEQ ID NO: 89711 - RNA, 19 nt, Homo sapiens
ggaugucauucacacagaa

SEQ ID NO: 89712 - RNA, 19 nt, Homo sapiens
ggaaguuucaguauuagau

SEQ ID NO: 89713 - RNA, 19 nt, Homo sapiens
gcuagcagacuuuggacua

SEQ ID NO: 89714 - RNA, 19 nt, Homo sapiens
uaucgcaaaugcugcacua

SEQ ID NO: 89715 - RNA, 19 nt, Homo sapiens
gcacguacggaguugugua

SEQ ID NO: 89716 - RNA, 19 nt, Homo sapiens
uauaaaggccaaaugauag

SEQ ID NO: 89717 - RNA, 19 nt, Homo sapiens
caagaucucaagaaauuca

SEQ ID NO: 89718 - RNA, 19 nt, Homo sapiens
acacucaccuucuagucuu

SEQ ID NO: 89719 - RNA, 19 nt, Homo sapiens
guuucaaguuggccaaauu

SEQ ID NO: 89720 - RNA, 19 nt, Homo sapiens
cauaggaguuagaaguuag

SEQ ID NO: 89721 - RNA, 19 nt, Homo sapiens
gcaggugagagauguuuga

SEQ ID NO: 89722 - RNA, 19 nt, Homo sapiens
gugcuucauuccaaucuau

SEQ ID NO: 89723 - RNA, 19 nt, Homo sapiens
caaguuggccaaauugaca

SEQ ID NO: 89724 - RNA, 19 nt, Homo sapiens
aguauuagaugcacuuaag

SEQ ID NO: 89725 - RNA, 19 nt, Homo sapiens
cuccugggcugcaaauauu

SEQ ID NO: 89726 - RNA, 19 nt, Homo sapiens
caagcuagcagacuuugga

SEQ ID NO: 89727 - RNA, 19 nt, Homo sapiens
ggugggaggcggcaacauu

SEQ ID NO: 89728 - RNA, 19 nt, Homo sapiens
ggugguggcgcuuaagaaa

SEQ ID NO: 89729 - RNA, 19 nt, Homo sapiens
gaaguuucaguauuagaug

SEQ ID NO: 89730 - RNA, 19 nt, Homo sapiens
ccaucaagcuagcagacuu

SEQ ID NO: 89731 - RNA, 19 nt, Homo sapiens
gcucuugcuauuaacguua

SEQ ID NO: 89732 - RNA, 19 nt, Homo sapiens
auucuuaguuguucaguug

SEQ ID NO: 89733 - RNA, 19 nt, Homo sapiens
ggugggcccucugaacuug

SEQ ID NO: 89734 - RNA, 19 nt, Homo sapiens
ugagaaugcugacacuuuu

SEQ ID NO: 89735 - RNA, 19 nt, Homo sapiens
gggcuaaguuggugcuuuu

SEQ ID NO: 89736 - RNA, 19 nt, Homo sapiens
ggagaggugguggcgcuua

SEQ ID NO: 89737 - RNA, 19 nt, Homo sapiens
gccacaauguuuauaaagg

SEQ ID NO: 89738 - RNA, 19 nt, Homo sapiens
gguuauauccaauaguaga

SEQ ID NO: 89739 - RNA, 19 nt, Homo sapiens
ugagugagggcauggguaa

SEQ ID NO: 89740 - RNA, 19 nt, Homo sapiens
guuuauaaaggccaaauga

SEQ ID NO: 89741 - RNA, 19 nt, Homo sapiens
gaccuuaaaccucagaauc

SEQ ID NO: 89742 - RNA, 19 nt, Homo sapiens
caucaagagcuaucuguuc

SEQ ID NO: 89743 - RNA, 19 nt, Homo sapiens
cuugagugcucuugcuauu

SEQ ID NO: 89744 - RNA, 19 nt, Homo sapiens
aguuagaaguuaggguuua

SEQ ID NO: 89745 - RNA, 19 nt, Homo sapiens
gacccuaacaagcggauuu

SEQ ID NO: 89746 - RNA, 19 nt, Homo sapiens
ggaggagucuauuuuaaag

SEQ ID NO: 89747 - RNA, 19 nt, Homo sapiens
cugaagaggguugguauaa

SEQ ID NO: 89748 - RNA, 19 nt, Homo sapiens
gcugaagaggguugguaua

SEQ ID NO: 89749 - RNA, 19 nt, Homo sapiens
gccaggaguuacuucuaug

SEQ ID NO: 89750 - RNA, 19 nt, Homo sapiens
ccuauucccuggagauucu

SEQ ID NO: 89751 - RNA, 19 nt, Homo sapiens
guuguucaguugccaagga

SEQ ID NO: 89752 - RNA, 19 nt, Homo sapiens
cgcaaaugcugcacuacga

SEQ ID NO: 89753 - RNA, 19 nt, Homo sapiens
cccuggagauucugagauu

SEQ ID NO: 89754 - RNA, 19 nt, Homo sapiens
gugagagauguuugaauuu

SEQ ID NO: 89755 - RNA, 19 nt, Homo sapiens
ucucuuaguuauugcugaa

SEQ ID NO: 89756 - RNA, 19 nt, Homo sapiens
uugaauuucugcaccaaga

SEQ ID NO: 89757 - RNA, 19 nt, Homo sapiens
guacugccauccgagagau

SEQ ID NO: 89758 - RNA, 19 nt, Homo sapiens
cuacaggcaugaggaaucu

SEQ ID NO: 89759 - RNA, 19 nt, Homo sapiens
gcugccacaauguuuauaa

SEQ ID NO: 89760 - RNA, 19 nt, Homo sapiens
gagucccuguucguacuua

SEQ ID NO: 89761 - RNA, 19 nt, Homo sapiens
caucaagcuagcagacuuu

SEQ ID NO: 89762 - RNA, 19 nt, Homo sapiens
gaaucugcuuauuaacaca

SEQ ID NO: 89763 - RNA, 19 nt, Homo sapiens
cugccacaauguuuauaaa

SEQ ID NO: 89764 - RNA, 19 nt, Homo sapiens
uagaugcacuuaaguuagc

SEQ ID NO: 89765 - RNA, 19 nt, Homo sapiens
aaauaaacucuaccugguu

SEQ ID NO: 89766 - RNA, 19 nt, Homo sapiens
uaaccauccuaauauuguc

SEQ ID NO: 89767 - RNA, 19 nt, Homo sapiens
ggccuagcuuucugccauu

SEQ ID NO: 89768 - RNA, 19 nt, Homo sapiens
uugagaaugcugacacuuu

SEQ ID NO: 89769 - RNA, 19 nt, Homo sapiens
guuagaaguuaggguuuag

SEQ ID NO: 89770 - RNA, 19 nt, Homo sapiens
agaucucucugcuuaagga

SEQ ID NO: 89771 - RNA, 19 nt, Homo sapiens
ugaggcaggugagagaugu

SEQ ID NO: 89772 - RNA, 19 nt, Homo sapiens
ggagcuuguuaucgcaaau

SEQ ID NO: 89773 - RNA, 19 nt, Homo sapiens
gauggacggagcuuguuau

SEQ ID NO: 89774 - RNA, 19 nt, Homo sapiens
gaguuagaaguuaggguuu

SEQ ID NO: 89775 - RNA, 19 nt, Homo sapiens
aaauccgccuggacacuga

SEQ ID NO: 89776 - RNA, 19 nt, Homo sapiens
ggaugugaccaagccagua

SEQ ID NO: 89777 - RNA, 19 nt, Homo sapiens
ggaugccucugcucucacu

SEQ ID NO: 89778 - RNA, 19 nt, Homo sapiens
gcuuggccuugggcuauuu

SEQ ID NO: 89779 - RNA, 19 nt, Homo sapiens
cugauuacaagccaaguuu

SEQ ID NO: 89780 - RNA, 19 nt, Homo sapiens
gaauuucugcaccaagauc

SEQ ID NO: 89781 - RNA, 19 nt, Homo sapiens
gaugucauucacacagaaa

SEQ ID NO: 89782 - RNA, 19 nt, Homo sapiens
caauaguagaguuggcuuu

SEQ ID NO: 89783 - RNA, 19 nt, Homo sapiens
gaggugguggcgcuuaaga

SEQ ID NO: 89784 - RNA, 19 nt, Homo sapiens
gagggcacguacggaguug

SEQ ID NO: 89785 - RNA, 19 nt, Homo sapiens
uuuauacccuaguuagugu

SEQ ID NO: 89786 - RNA, 19 nt, Homo sapiens
gcaccaagaucucaagaaa

SEQ ID NO: 89787 - RNA, 19 nt, Homo sapiens
ggugagagauguuugaauu

SEQ ID NO: 89788 - RNA, 19 nt, Homo sapiens
gagcuuaaccauccuaaua

SEQ ID NO: 89789 - RNA, 19 nt, Homo sapiens
cagguuauauccaauagua

SEQ ID NO: 89790 - RNA, 19 nt, Homo sapiens
ugagugcucuugcuauuaa

SEQ ID NO: 89791 - RNA, 19 nt, Homo sapiens
uuacuucuaugccugauua

SEQ ID NO: 89792 - RNA, 19 nt, Homo sapiens
gaagaggguugguauaaaa

SEQ ID NO: 89793 - RNA, 19 nt, Homo sapiens
ccucugaacuugccuuaaa

SEQ ID NO: 89794 - RNA, 19 nt, Homo sapiens
accaagaucucaagaaauu

SEQ ID NO: 89795 - RNA, 19 nt, Homo sapiens
ccauaggaguuagaaguua

SEQ ID NO: 89796 - RNA, 19 nt, Homo sapiens
guacaaagccagaaacaag

SEQ ID NO: 89797 - RNA, 19 nt, Homo sapiens
gacaagagcgagagguaua

SEQ ID NO: 89798 - RNA, 19 nt, Homo sapiens
gagaggugguggcgcuuaa

SEQ ID NO: 89799 - RNA, 19 nt, Homo sapiens
ggauugugcuucauuccaa

SEQ ID NO: 89800 - RNA, 19 nt, Homo sapiens
cauaguggguggauuuguu

SEQ ID NO: 89801 - RNA, 19 nt, Homo sapiens
ggucauaguggguggauuu

SEQ ID NO: 89802 - RNA, 19 nt, Homo sapiens
gcuuaaccauccuaauauu

SEQ ID NO: 89803 - RNA, 19 nt, Homo sapiens
ugaagaggguugguauaaa

SEQ ID NO: 89804 - RNA, 19 nt, Homo sapiens
gaagauggacggagcuugu

SEQ ID NO: 89805 - RNA, 19 nt, Homo sapiens
cuuaaacacucaccuucua

SEQ ID NO: 89806 - RNA, 19 nt, Homo sapiens
ggccaggaguuacuucuau

SEQ ID NO: 89807 - RNA, 19 nt, Homo sapiens
agacagggauugugcuuca

SEQ ID NO: 89808 - RNA, 19 nt, Homo sapiens
gaccagcucuuccggaucu

SEQ ID NO: 89809 - RNA, 19 nt, Homo sapiens
gcacuacgacccuuacaag

SEQ ID NO: 89810 - RNA, 19 nt, Homo sapiens
ggaugucauucacacagaa

SEQ ID NO: 89811 - RNA, 19 nt, Homo sapiens
ggaaguuucaguauuagau

SEQ ID NO: 89812 - RNA, 19 nt, Homo sapiens
gcuagcagacuuuggacua

SEQ ID NO: 89813 - RNA, 19 nt, Homo sapiens
uaucgcaaaugcugcacua

SEQ ID NO: 89814 - RNA, 19 nt, Homo sapiens
gcacguacggaguugugua

SEQ ID NO: 89815 - RNA, 19 nt, Homo sapiens
uauaaaggccaaaugauag

SEQ ID NO: 89816 - RNA, 19 nt, Homo sapiens
caagaucucaagaaauuca

SEQ ID NO: 89817 - RNA, 19 nt, Homo sapiens
acacucaccuucuagucuu

SEQ ID NO: 89818 - RNA, 19 nt, Homo sapiens
cauaggaguuagaaguuag

SEQ ID NO: 89819 - RNA, 19 nt, Homo sapiens
gcaggugagagauguuuga

SEQ ID NO: 89820 - RNA, 19 nt, Homo sapiens
gugcuucauuccaaucuau

SEQ ID NO: 89821 - RNA, 19 nt, Homo sapiens
aguauuagaugcacuuaag

SEQ ID NO: 89822 - RNA, 19 nt, Homo sapiens
caaguuggccaaauugaca

SEQ ID NO: 89823 - RNA, 19 nt, Homo sapiens
guuucaaguuggccaaauu

SEQ ID NO: 89824 - RNA, 19 nt, Homo sapiens
caagcuagcagacuuugga

SEQ ID NO: 89825 - RNA, 19 nt, Homo sapiens
ggugggaggcggcaacauu

SEQ ID NO: 89826 - RNA, 19 nt, Homo sapiens
ggugguggcgcuuaagaaa

SEQ ID NO: 89827 - RNA, 19 nt, Homo sapiens
gaaguuucaguauuagaug

SEQ ID NO: 89828 - RNA, 19 nt, Homo sapiens
ccaucaagcuagcagacuu

SEQ ID NO: 89829 - RNA, 19 nt, Homo sapiens
gcucuugcuauuaacguua

SEQ ID NO: 89830 - RNA, 19 nt, Homo sapiens
auucuuaguuguucaguug

SEQ ID NO: 89831 - RNA, 19 nt, Homo sapiens
ggugggcccucugaacuug

SEQ ID NO: 89832 - RNA, 19 nt, Homo sapiens
ugagaaugcugacacuuuu

SEQ ID NO: 89833 - RNA, 19 nt, Homo sapiens
gggcuaaguuggugcuuuu

SEQ ID NO: 89834 - RNA, 19 nt, Homo sapiens
gccacaauguuuauaaagg

SEQ ID NO: 89835 - RNA, 19 nt, Homo sapiens
ggagaggugguggcgcuua

SEQ ID NO: 89836 - RNA, 19 nt, Homo sapiens
gguuauauccaauaguaga

SEQ ID NO: 89837 - RNA, 19 nt, Homo sapiens
ugagugagggcauggguaa

SEQ ID NO: 89838 - RNA, 19 nt, Homo sapiens
guuuauaaaggccaaauga

SEQ ID NO: 89839 - RNA, 19 nt, Homo sapiens
gaccuuaaaccucagaauc

SEQ ID NO: 89840 - RNA, 19 nt, Homo sapiens
caucaagagcuaucuguuc

SEQ ID NO: 89841 - RNA, 19 nt, Homo sapiens
cuugagugcucuugcuauu

SEQ ID NO: 89842 - RNA, 19 nt, Homo sapiens
aguuagaaguuaggguuua

SEQ ID NO: 89843 - RNA, 19 nt, Homo sapiens
ggaggagucuauuuuaaag

SEQ ID NO: 89844 - RNA, 19 nt, Homo sapiens
cugaagaggguugguauaa

SEQ ID NO: 89845 - RNA, 19 nt, Homo sapiens
gcugaagaggguugguaua

SEQ ID NO: 89846 - RNA, 19 nt, Homo sapiens
gccaggaguuacuucuaug

SEQ ID NO: 89847 - RNA, 19 nt, Homo sapiens
ccuauucccuggagauucu

SEQ ID NO: 89848 - RNA, 19 nt, Homo sapiens
guuguucaguugccaagga

SEQ ID NO: 89849 - RNA, 19 nt, Homo sapiens
cgcaaaugcugcacuacga

SEQ ID NO: 89850 - RNA, 19 nt, Homo sapiens
cccuggagauucugagauu

SEQ ID NO: 89851 - RNA, 19 nt, Homo sapiens
gugagagauguuugaauuu

SEQ ID NO: 89852 - RNA, 19 nt, Homo sapiens
ucucuuaguuauugcugaa

SEQ ID NO: 89853 - RNA, 19 nt, Homo sapiens
uugaauuucugcaccaaga

SEQ ID NO: 89854 - RNA, 19 nt, Homo sapiens
cuacaggcaugaggaaucu

SEQ ID NO: 89855 - RNA, 19 nt, Homo sapiens
guacugccauccgagagau

SEQ ID NO: 89856 - RNA, 19 nt, Homo sapiens
gcugccacaauguuuauaa

SEQ ID NO: 89857 - RNA, 19 nt, Homo sapiens
gagucccuguucguacuua

SEQ ID NO: 89858 - RNA, 19 nt, Homo sapiens
caucaagcuagcagacuuu

SEQ ID NO: 89859 - RNA, 19 nt, Homo sapiens
gaaucugcuuauuaacaca

SEQ ID NO: 89860 - RNA, 19 nt, Homo sapiens
cugccacaauguuuauaaa

SEQ ID NO: 89861 - RNA, 19 nt, Homo sapiens
uagaugcacuuaaguuagc

SEQ ID NO: 89862 - RNA, 19 nt, Homo sapiens
aaauaaacucuaccugguu

SEQ ID NO: 89863 - RNA, 19 nt, Homo sapiens
ggccuagcuuucugccauu

SEQ ID NO: 89864 - RNA, 19 nt, Homo sapiens
uaaccauccuaauauuguc

SEQ ID NO: 89865 - RNA, 19 nt, Homo sapiens
uugagaaugcugacacuuu

SEQ ID NO: 89866 - RNA, 19 nt, Homo sapiens
guuagaaguuaggguuuag

SEQ ID NO: 89867 - RNA, 19 nt, Homo sapiens
ugaggcaggugagagaugu

SEQ ID NO: 89868 - RNA, 19 nt, Homo sapiens
ggagcuuguuaucgcaaau

SEQ ID NO: 89869 - RNA, 19 nt, Homo sapiens
gauggacggagcuuguuau

SEQ ID NO: 89870 - RNA, 19 nt, Homo sapiens
agaucucucugcuuaagga

SEQ ID NO: 89871 - RNA, 19 nt, Homo sapiens
gaguuagaaguuaggguuu

SEQ ID NO: 89872 - RNA, 19 nt, Homo sapiens
ggaugugaccaagccagua

SEQ ID NO: 89873 - RNA, 19 nt, Homo sapiens
aaauccgccuggacacuga

SEQ ID NO: 89874 - RNA, 19 nt, Homo sapiens
ggaugccucugcucucacu

SEQ ID NO: 89875 - RNA, 19 nt, Homo sapiens
gcuuggccuugggcuauuu

SEQ ID NO: 89876 - RNA, 19 nt, Homo sapiens
cugauuacaagccaaguuu

SEQ ID NO: 89877 - RNA, 19 nt, Homo sapiens
gaauuucugcaccaagauc

SEQ ID NO: 89878 - RNA, 19 nt, Homo sapiens
gaugucauucacacagaaa

SEQ ID NO: 89879 - RNA, 19 nt, Homo sapiens
caauaguagaguuggcuuu

SEQ ID NO: 89880 - RNA, 19 nt, Homo sapiens
uuuauacccuaguuagugu

SEQ ID NO: 89881 - RNA, 19 nt, Homo sapiens
gaggugguggcgcuuaaga

SEQ ID NO: 89882 - RNA, 19 nt, Homo sapiens
cuuccuacacguuagauuu

SEQ ID NO: 89883 - RNA, 19 nt, Homo sapiens
gagggcacguacggaguug

SEQ ID NO: 89884 - RNA, 19 nt, Homo sapiens
caaagccagaaacaaguug

SEQ ID NO: 89885 - RNA, 19 nt, Homo sapiens
cagggauugugcuucauuc

SEQ ID NO: 89886 - RNA, 19 nt, Homo sapiens
gagcauugguugcaucuuu

SEQ ID NO: 89887 - RNA, 19 nt, Homo sapiens
gcaaagcacuaaggaauuc

SEQ ID NO: 89888 - RNA, 19 nt, Homo sapiens
guggauaucuggagcauug

SEQ ID NO: 89889 - RNA, 19 nt, Homo sapiens
ggaagggacuggaagagau

SEQ ID NO: 89890 - RNA, 19 nt, Homo sapiens
gagcaaagcacuaaggaau

SEQ ID NO: 89891 - RNA, 19 nt, Homo sapiens
gaccagcucuuucguaucu

SEQ ID NO: 89892 - RNA, 19 nt, Homo sapiens
gaagcucuaucugguguuu

SEQ ID NO: 89893 - RNA, 19 nt, Homo sapiens
ucacccagcugccugacua

SEQ ID NO: 89894 - RNA, 19 nt, Homo sapiens
gcagagauggugacucgaa

SEQ ID NO: 89895 - RNA, 19 nt, Homo sapiens
gaagggacuggaagagauu

SEQ ID NO: 89896 - RNA, 19 nt, Homo sapiens
ccaucaagcuggcugacuu

SEQ ID NO: 89897 - RNA, 19 nt, Homo sapiens
gaagaucagacuggauuug

SEQ ID NO: 89898 - RNA, 19 nt, Homo sapiens
ccagcucuuucguaucuuu

SEQ ID NO: 89899 - RNA, 19 nt, Homo sapiens
cagagauggugacucgaaa

SEQ ID NO: 89900 - RNA, 19 nt, Homo sapiens
gaucggagagggcaccuau

SEQ ID NO: 89901 - RNA, 19 nt, Homo sapiens
gcacugccaucagggagau

SEQ ID NO: 89902 - RNA, 19 nt, Homo sapiens
aagaagaucagacuggauu

SEQ ID NO: 89903 - RNA, 19 nt, Homo sapiens
cccagaaccugcucaucaa

SEQ ID NO: 89904 - RNA, 19 nt, Homo sapiens
acuaaggaauucagcauca

SEQ ID NO: 89905 - RNA, 19 nt, Homo sapiens
gcacuaaggaauucagcau

SEQ ID NO: 89906 - RNA, 19 nt, Homo sapiens
cugcagcgauuccgccauu

SEQ ID NO: 89907 - RNA, 19 nt, Homo sapiens
gcagcucuguggccaugga

SEQ ID NO: 89908 - RNA, 19 nt, Homo sapiens
uuucguaucuuucguaugc

SEQ ID NO: 89909 - RNA, 19 nt, Homo sapiens
ugaguugggugccaucaag

SEQ ID NO: 89910 - RNA, 19 nt, Homo sapiens
gcagcgauuccgccauuga

SEQ ID NO: 89911 - RNA, 19 nt, Homo sapiens
gagauugaccagcucuuuc

SEQ ID NO: 89912 - RNA, 19 nt, Homo sapiens
gagagcaaagcacuaagga

SEQ ID NO: 89913 - RNA, 19 nt, Homo sapiens
ccagcugccugacuauaag

SEQ ID NO: 89914 - RNA, 19 nt, Homo sapiens
gaagaagaucagacuggau

SEQ ID NO: 89915 - RNA, 19 nt, Homo sapiens
ggauauguuccagaaggua

SEQ ID NO: 89916 - RNA, 19 nt, Homo sapiens
aguaugugcugcagcgauu

SEQ ID NO: 89917 - RNA, 19 nt, Homo sapiens
agaucucgcugcucaagga

SEQ ID NO: 89918 - RNA, 19 nt, Homo sapiens
gcgauuccgccauugagaa

SEQ ID NO: 89919 - RNA, 19 nt, Homo sapiens
ccuggugacucugagauug

SEQ ID NO: 89920 - RNA, 19 nt, Homo sapiens
gcucuguggccauggauau

SEQ ID NO: 89921 - RNA, 19 nt, Homo sapiens
cagacuggauuuggagaug

SEQ ID NO: 89922 - RNA, 19 nt, Homo sapiens
ggagagcaaagcacuaagg

SEQ ID NO: 89923 - RNA, 19 nt, Homo sapiens
uugaccagcucuuucguau

SEQ ID NO: 89924 - RNA, 19 nt, Homo sapiens
uccagaagguagagaagau

SEQ ID NO: 89925 - RNA, 19 nt, Homo sapiens
ugagauugaccagcucuuu

SEQ ID NO: 89926 - RNA, 19 nt, Homo sapiens
ccacucacaucgggucauc

SEQ ID NO: 89927 - RNA, 19 nt, Homo sapiens
gccaagagaggaugcaucu

SEQ ID NO: 89928 - RNA, 19 nt, Homo sapiens
ugucaaggccacacucaga

SEQ ID NO: 89929 - RNA, 19 nt, Homo sapiens
ggcagcaaguucuauacca

SEQ ID NO: 89930 - RNA, 19 nt, Homo sapiens
gacuggauuuggagaugga

SEQ ID NO: 89931 - RNA, 19 nt, Homo sapiens
gcccagugccuucuguuuc

SEQ ID NO: 89932 - RNA, 19 nt, Homo sapiens
gagggcugagucuggguua

SEQ ID NO: 89933 - RNA, 19 nt, Homo sapiens
cagaaccugcucaucaaug

SEQ ID NO: 89934 - RNA, 19 nt, Homo sapiens
ggagaucucgcugcucaag

SEQ ID NO: 89935 - RNA, 19 nt, Homo sapiens
cccagcugccugacuauaa

SEQ ID NO: 89936 - RNA, 19 nt, Homo sapiens
ucuaucugguguuugaguu

SEQ ID NO: 89937 - RNA, 19 nt, Homo sapiens
gauaucuggagcauugguu

SEQ ID NO: 89938 - RNA, 19 nt, Homo sapiens
agaucagacuggauuugga

SEQ ID NO: 89939 - RNA, 19 nt, Homo sapiens
cccaugagguggugacacu

SEQ ID NO: 89940 - RNA, 19 nt, Homo sapiens
cagcggaucacagccaaga

SEQ ID NO: 89941 - RNA, 19 nt, Homo sapiens
guaccgagcucccgaaguu

SEQ ID NO: 89942 - RNA, 19 nt, Homo sapiens
ugacuggccucgagaugua

SEQ ID NO: 89943 - RNA, 19 nt, Homo sapiens
gaacugaccgggagaucaa

SEQ ID NO: 89944 - RNA, 19 nt, Homo sapiens
uuacuuugcugccuuaaug

SEQ ID NO: 89945 - RNA, 19 nt, Homo sapiens
caagguaacccugguguuu

SEQ ID NO: 89946 - RNA, 19 nt, Homo sapiens
gcagcacucuuaucuacau

SEQ ID NO: 89947 - RNA, 19 nt, Homo sapiens
ggaggaggccuucccauca

SEQ ID NO: 89948 - RNA, 19 nt, Homo sapiens
gaauggcuaccucucgaua

SEQ ID NO: 89949 - RNA, 19 nt, Homo sapiens
cuacagagauuacuuugcu

SEQ ID NO: 89950 - RNA, 19 nt, Homo sapiens
gagcucugcagcacucuua

SEQ ID NO: 89951 - RNA, 19 nt, Homo sapiens
caacaccuguggacaugug

SEQ ID NO: 89952 - RNA, 19 nt, Homo sapiens
ucccauuucucuacacuaa

SEQ ID NO: 89953 - RNA, 19 nt, Homo sapiens
ucgaaagccucucuucugu

SEQ ID NO: 89954 - RNA, 19 nt, Homo sapiens
guggacauguggaguguug

SEQ ID NO: 89955 - RNA, 19 nt, Homo sapiens
ugaggcgacuggaggcuuu

SEQ ID NO: 89956 - RNA, 19 nt, Homo sapiens
ggugacaagugguggaaca

SEQ ID NO: 89957 - RNA, 19 nt, Homo sapiens
gaucugaugcgccaguuuc

SEQ ID NO: 89958 - RNA, 19 nt, Homo sapiens
agauuacuuugcugccuua

SEQ ID NO: 89959 - RNA, 19 nt, Homo sapiens
acauaaggaugaagguaau

SEQ ID NO: 89960 - RNA, 19 nt, Homo sapiens
aguguuggcuguaucuuug

SEQ ID NO: 89961 - RNA, 19 nt, Homo sapiens
gcauguagaccaggaccua

SEQ ID NO: 89962 - RNA, 19 nt, Homo sapiens
uggaaaugcugacuuuuaa

SEQ ID NO: 89963 - RNA, 19 nt, Homo sapiens
gaggaggccuucccaucag

SEQ ID NO: 89964 - RNA, 19 nt, Homo sapiens
uacauaaggaugaagguaa

SEQ ID NO: 89965 - RNA, 19 nt, Homo sapiens
gaguguuggcuguaucuuu

SEQ ID NO: 89966 - RNA, 19 nt, Homo sapiens
uucccuaccuuuauauuug

SEQ ID NO: 89967 - RNA, 19 nt, Homo sapiens
cagcacucuuaucuacaua

SEQ ID NO: 89968 - RNA, 19 nt, Homo sapiens
cugcagcacucuuaucuac

SEQ ID NO: 89969 - RNA, 19 nt, Homo sapiens
caagcgaaucucugccuuu

SEQ ID NO: 89970 - RNA, 19 nt, Homo sapiens
aagccucucuucuguggaa

SEQ ID NO: 89971 - RNA, 19 nt, Homo sapiens
ggccuagauuuccuucaug

SEQ ID NO: 89972 - RNA, 19 nt, Homo sapiens
aagcgaaucucugccuuuc

SEQ ID NO: 89973 - RNA, 19 nt, Homo sapiens
ggcuguaucuuugcagaga

SEQ ID NO: 89974 - RNA, 19 nt, Homo sapiens
agguaacccugguguuuga

SEQ ID NO: 89975 - RNA, 19 nt, Homo sapiens
ccauuucucuacacuaagg

SEQ ID NO: 89976 - RNA, 19 nt, Homo sapiens
gcuaccagauggcacuuac

SEQ ID NO: 89977 - RNA, 19 nt, Homo sapiens
cugaugcgccaguuucuaa

SEQ ID NO: 89978 - RNA, 19 nt, Homo sapiens
ugaagguaauccggaguga

SEQ ID NO: 89979 - RNA, 19 nt, Homo sapiens
gaccaggaccuaaggacau

SEQ ID NO: 89980 - RNA, 19 nt, Homo sapiens
cccuuucccuaccuuuaua

SEQ ID NO: 89981 - RNA, 19 nt, Homo sapiens
cuacauaaggaugaaggua

SEQ ID NO: 89982 - RNA, 19 nt, Homo sapiens
ugcuggaaaugcugacuuu

SEQ ID NO: 89983 - RNA, 19 nt, Homo sapiens
accaggaccuaaggacaua

SEQ ID NO: 89984 - RNA, 19 nt, Homo sapiens
uuuggcagcuggucacaug

SEQ ID NO: 89985 - RNA, 19 nt, Homo sapiens
gcaguccacauaugcaaca

SEQ ID NO: 89986 - RNA, 19 nt, Homo sapiens
uaagaggccuagauuuccu

SEQ ID NO: 89987 - RNA, 19 nt, Homo sapiens
gaccgggagaucaagguaa

SEQ ID NO: 89988 - RNA, 19 nt, Homo sapiens
acacugagagggcaaucuu

SEQ ID NO: 89989 - RNA, 19 nt, Homo sapiens
ggaagaaaagcugccauuu

SEQ ID NO: 89990 - RNA, 19 nt, Homo sapiens
gucgaaagccucucuucug

SEQ ID NO: 89991 - RNA, 19 nt, Homo sapiens
cuucugcaguccacauaug

SEQ ID NO: 89992 - RNA, 19 nt, Homo sapiens
uggccagaaucuacagcua

SEQ ID NO: 89993 - RNA, 19 nt, Homo sapiens
cagccgaaacgaucaagga

SEQ ID NO: 89994 - RNA, 19 nt, Homo sapiens
gaugacuggccucgagaug

SEQ ID NO: 89995 - RNA, 19 nt, Homo sapiens
ugcaacaccuguggacaug

SEQ ID NO: 89996 - RNA, 19 nt, Homo sapiens
gcuugcggccugugucuau

SEQ ID NO: 89997 - RNA, 19 nt, Homo sapiens
gaugcgccaguuucuaaga

SEQ ID NO: 89998 - RNA, 19 nt, Homo sapiens
cuccuucuccuucccauuu

SEQ ID NO: 89999 - RNA, 19 nt, Homo sapiens
ucucuucuguggaaacucu

SEQ ID NO: 90000 - RNA, 19 nt, Homo sapiens
cuccaucuuucuacagaga

SEQ ID NO: 90001 - RNA, 19 nt, Homo sapiens
ggaccuaaggacauaucug

SEQ ID NO: 90002 - RNA, 19 nt, Homo sapiens
ugacuggccucgagaugua

SEQ ID NO: 90003 - RNA, 19 nt, Homo sapiens
gaacugaccgggagaucaa

SEQ ID NO: 90004 - RNA, 19 nt, Homo sapiens
uuacuuugcugccuuaaug

SEQ ID NO: 90005 - RNA, 19 nt, Homo sapiens
gcagcacucuuaucuacau

SEQ ID NO: 90006 - RNA, 19 nt, Homo sapiens
ggaggaggccuucccauca

SEQ ID NO: 90007 - RNA, 19 nt, Homo sapiens
gaauggcuaccucucgaua

SEQ ID NO: 90008 - RNA, 19 nt, Homo sapiens
cuacagagauuacuuugcu

SEQ ID NO: 90009 - RNA, 19 nt, Homo sapiens
gagcucugcagcacucuua

SEQ ID NO: 90010 - RNA, 19 nt, Homo sapiens
ucccauuucucuacacuaa

SEQ ID NO: 90011 - RNA, 19 nt, Homo sapiens
ucgaaagccucucuucugu

SEQ ID NO: 90012 - RNA, 19 nt, Homo sapiens
ugaggcgacuggaggcuuu

SEQ ID NO: 90013 - RNA, 19 nt, Homo sapiens
agauuacuuugcugccuua

SEQ ID NO: 90014 - RNA, 19 nt, Homo sapiens
acauaaggaugaagguaau

SEQ ID NO: 90015 - RNA, 19 nt, Homo sapiens
uggaaaugcugacuuuuaa

SEQ ID NO: 90016 - RNA, 19 nt, Homo sapiens
gaggaggccuucccaucag

SEQ ID NO: 90017 - RNA, 19 nt, Homo sapiens
uacauaaggaugaagguaa

SEQ ID NO: 90018 - RNA, 19 nt, Homo sapiens
uucccuaccuuuauauuug

SEQ ID NO: 90019 - RNA, 19 nt, Homo sapiens
cagcacucuuaucuacaua

SEQ ID NO: 90020 - RNA, 19 nt, Homo sapiens
cugcagcacucuuaucuac

SEQ ID NO: 90021 - RNA, 19 nt, Homo sapiens
caagcgaaucucugccuuu

SEQ ID NO: 90022 - RNA, 19 nt, Homo sapiens
aagccucucuucuguggaa

SEQ ID NO: 90023 - RNA, 19 nt, Homo sapiens
aagcgaaucucugccuuuc

SEQ ID NO: 90024 - RNA, 19 nt, Homo sapiens
ccauuucucuacacuaagg

SEQ ID NO: 90025 - RNA, 19 nt, Homo sapiens
ugaagguaauccggaguga

SEQ ID NO: 90026 - RNA, 19 nt, Homo sapiens
cccuuucccuaccuuuaua

SEQ ID NO: 90027 - RNA, 19 nt, Homo sapiens
ggagaucaagagauguuuc

SEQ ID NO: 90028 - RNA, 19 nt, Homo sapiens
uuuggcagcuggucacaug

SEQ ID NO: 90029 - RNA, 19 nt, Homo sapiens
cuacauaaggaugaaggua

SEQ ID NO: 90030 - RNA, 19 nt, Homo sapiens
ugcuggaaaugcugacuuu

SEQ ID NO: 90031 - RNA, 19 nt, Homo sapiens
acacugagagggcaaucuu

SEQ ID NO: 90032 - RNA, 19 nt, Homo sapiens
ggaagaaaagcugccauuu

SEQ ID NO: 90033 - RNA, 19 nt, Homo sapiens
gucgaaagccucucuucug

SEQ ID NO: 90034 - RNA, 19 nt, Homo sapiens
gcuugcggccugugucuau

SEQ ID NO: 90035 - RNA, 19 nt, Homo sapiens
gaugacuggccucgagaug

SEQ ID NO: 90036 - RNA, 19 nt, Homo sapiens
accgggagaucaagagaug

SEQ ID NO: 90037 - RNA, 19 nt, Homo sapiens
cuccuucuccuucccauuu

SEQ ID NO: 90038 - RNA, 19 nt, Homo sapiens
ucucuucuguggaaacucu

SEQ ID NO: 90039 - RNA, 19 nt, Homo sapiens
cuccaucuuucuacagaga

SEQ ID NO: 90040 - RNA, 19 nt, Homo sapiens
cgggagaucaagagauguu

SEQ ID NO: 90041 - RNA, 19 nt, Homo sapiens
gggcugggauucugucaua

SEQ ID NO: 90042 - RNA, 19 nt, Homo sapiens
ucaaggagcugaagcacaa

SEQ ID NO: 90043 - RNA, 19 nt, Homo sapiens
ugaccaagcugccagacua

SEQ ID NO: 90044 - RNA, 19 nt, Homo sapiens
gagcugaaauuggcugauu

SEQ ID NO: 90045 - RNA, 19 nt, Homo sapiens
caacaucccuggugaacgu

SEQ ID NO: 90046 - RNA, 19 nt, Homo sapiens
acaagaagcugacuuuggu

SEQ ID NO: 90047 - RNA, 19 nt, Homo sapiens
cccagaaccugcuaauaaa

SEQ ID NO: 90048 - RNA, 19 nt, Homo sapiens
gaaauacgagaaacuggaa

SEQ ID NO: 90049 - RNA, 19 nt, Homo sapiens
gagcaguggcccucuauga

SEQ ID NO: 90050 - RNA, 19 nt, Homo sapiens
ugaccucgauccugagauu

SEQ ID NO: 90051 - RNA, 19 nt, Homo sapiens
cgggagaucugccuacuca

SEQ ID NO: 90052 - RNA, 19 nt, Homo sapiens
uauaagcccuauccgaugu

SEQ ID NO: 90053 - RNA, 19 nt, Homo sapiens
gaagaaguauuuugacagu

SEQ ID NO: 90054 - RNA, 19 nt, Homo sapiens
ugaugucgaugaccaguug

SEQ ID NO: 90055 - RNA, 19 nt, Homo sapiens
ggauucccguccgcuguua

SEQ ID NO: 90056 - RNA, 19 nt, Homo sapiens
gcgacaagaagcugacuuu

SEQ ID NO: 90057 - RNA, 19 nt, Homo sapiens
ccaagcugccagacuauaa

SEQ ID NO: 90058 - RNA, 19 nt, Homo sapiens
gaaggcaccuacggaacug

SEQ ID NO: 90059 - RNA, 19 nt, Homo sapiens
gcucgagccuuugggauuc

SEQ ID NO: 90060 - RNA, 19 nt, Homo sapiens
gcagaaauacgagaaacug

SEQ ID NO: 90061 - RNA, 19 nt, Homo sapiens
ccacguccaucgacaugug

SEQ ID NO: 90062 - RNA, 19 nt, Homo sapiens
uugcagagcuggccaaugc

SEQ ID NO: 90063 - RNA, 19 nt, Homo sapiens
cagcguaucucagcagaag

SEQ ID NO: 90064 - RNA, 19 nt, Homo sapiens
cagcugagguggucacacu

SEQ ID NO: 90065 - RNA, 19 nt, Homo sapiens
gacaagaagcugacuuugg

SEQ ID NO: 90066 - RNA, 19 nt, Homo sapiens
ggagaucugccuacucaag

SEQ ID NO: 90067 - RNA, 19 nt, Homo sapiens
ggaaggcaccuacggaacu

SEQ ID NO: 90068 - RNA, 19 nt, Homo sapiens
gaggcuggaugacgaugau

SEQ ID NO: 90069 - RNA, 19 nt, Homo sapiens
cuacuucuccgacuucugu

SEQ ID NO: 90070 - RNA, 19 nt, Homo sapiens
guaacccuguccagcguau

SEQ ID NO: 90071 - RNA, 19 nt, Homo sapiens
ggaauggggagcugaaauu

SEQ ID NO: 90072 - RNA, 19 nt, Homo sapiens
gagcugaagcacaagaaca

SEQ ID NO: 90073 - RNA, 19 nt, Homo sapiens
ccucgauccugagauugua

SEQ ID NO: 90074 - RNA, 19 nt, Homo sapiens
gaacgucgugcccaaacuc

SEQ ID NO: 90075 - RNA, 19 nt, Homo sapiens
uaaagucauuccucuucca

SEQ ID NO: 90076 - RNA, 19 nt, Homo sapiens
caugagaucguggcucuga

SEQ ID NO: 90077 - RNA, 19 nt, Homo sapiens
caccggauguccucuuugg

SEQ ID NO: 90078 - RNA, 19 nt, Homo sapiens
agaaguauuuugacaguug

SEQ ID NO: 90079 - RNA, 19 nt, Homo sapiens
cagaaccugcuaauaaaca

SEQ ID NO: 90080 - RNA, 19 nt, Homo sapiens
ugagaucguggcucugaaa

SEQ ID NO: 90081 - RNA, 19 nt, Homo sapiens
ccgggagacucaugagauc

SEQ ID NO: 90082 - RNA, 19 nt, Homo sapiens
gaugcagaaauacgagaaa

SEQ ID NO: 90083 - RNA, 19 nt, Homo sapiens
ccccagaaccugcuaauaa

SEQ ID NO: 90084 - RNA, 19 nt, Homo sapiens
uguaaagucauuccucuuc

SEQ ID NO: 90085 - RNA, 19 nt, Homo sapiens
gaugagggugugccgaguu

SEQ ID NO: 90086 - RNA, 19 nt, Homo sapiens
ccacaacaucccuggugaa

SEQ ID NO: 90087 - RNA, 19 nt, Homo sapiens
uaaaagggcugggauucug

SEQ ID NO: 90088 - RNA, 19 nt, Homo sapiens
aagaagcugacuuugguuu

SEQ ID NO: 90089 - RNA, 19 nt, Homo sapiens
gaacaucgucaggcuucau

SEQ ID NO: 90090 - RNA, 19 nt, Homo sapiens
gcaccuacggaacuguguu

SEQ ID NO: 90091 - RNA, 19 nt, Homo sapiens
cccaccggauguccucuuu

SEQ ID NO: 90092 - RNA, 19 nt, Homo sapiens
gaccaagcugccagacuau

SEQ ID NO: 90093 - RNA, 19 nt, Homo sapiens
cgacaagaagcugacuuug

SEQ ID NO: 90094 - RNA, 19 nt, Homo sapiens
auccugagauuguaaaguc

SEQ ID NO: 90095 - RNA, 19 nt, Homo sapiens
caagaagcugacuuugguu

SEQ ID NO: 90096 - RNA, 19 nt, Homo sapiens
cugagauuguaaagucauu

SEQ ID NO: 90097 - RNA, 19 nt, Homo sapiens
gcaaagaccuacuucugaa

SEQ ID NO: 90098 - RNA, 19 nt, Homo sapiens
gaagaagacuggccuagag

SEQ ID NO: 90099 - RNA, 19 nt, Homo sapiens
ggucuggacuuucuucauu

SEQ ID NO: 90100 - RNA, 19 nt, Homo sapiens
uaacagauaucgaugaacu

SEQ ID NO: 90101 - RNA, 19 nt, Homo sapiens
gaccagcagcggacaaaua

SEQ ID NO: 90102 - RNA, 19 nt, Homo sapiens
aagaauaucugccuacagu

SEQ ID NO: 90103 - RNA, 19 nt, Homo sapiens
guggaucucuggaguguug

SEQ ID NO: 90104 - RNA, 19 nt, Homo sapiens
guacagagcacccgaaguc

SEQ ID NO: 90105 - RNA, 19 nt, Homo sapiens
gaacagacagagaaaccaa

SEQ ID NO: 90106 - RNA, 19 nt, Homo sapiens
cuggaaaggugcaaagaaa

SEQ ID NO: 90107 - RNA, 19 nt, Homo sapiens
cugaaguguuugacauuua

SEQ ID NO: 90108 - RNA, 19 nt, Homo sapiens
gagaaaccaaacuaacuuu

SEQ ID NO: 90109 - RNA, 19 nt, Homo sapiens
ggcaaagaccuacuucuga

SEQ ID NO: 90110 - RNA, 19 nt, Homo sapiens
ccacugaaaccauaaagga

SEQ ID NO: 90111 - RNA, 19 nt, Homo sapiens
gaaguucagauguugauca

SEQ ID NO: 90112 - RNA, 19 nt, Homo sapiens
agacagagaaaccaaacua

SEQ ID NO: 90113 - RNA, 19 nt, Homo sapiens
uguaacagauaucgaugaa

SEQ ID NO: 90114 - RNA, 19 nt, Homo sapiens
gagaaguuuguaacagaua

SEQ ID NO: 90115 - RNA, 19 nt, Homo sapiens
aguguuggcugcauauuug

SEQ ID NO: 90116 - RNA, 19 nt, Homo sapiens
gaacaugucgaucaagacu

SEQ ID NO: 90117 - RNA, 19 nt, Homo sapiens
gaagacuggccuagagaug

SEQ ID NO: 90118 - RNA, 19 nt, Homo sapiens
agacuggccuagagauguu

SEQ ID NO: 90119 - RNA, 19 nt, Homo sapiens
guggucagguuguuugaug

SEQ ID NO: 90120 - RNA, 19 nt, Homo sapiens
gaguguuggcugcauauuu

SEQ ID NO: 90121 - RNA, 19 nt, Homo sapiens
gacagagaaaccaaacuaa

SEQ ID NO: 90122 - RNA, 19 nt, Homo sapiens
ccaaccaauugagaaguuu

SEQ ID NO: 90123 - RNA, 19 nt, Homo sapiens
ccaauugagaaguuuguaa

SEQ ID NO: 90124 - RNA, 19 nt, Homo sapiens
gaacaccucggagcugaau

SEQ ID NO: 90125 - RNA, 19 nt, Homo sapiens
uugagaaguuuguaacaga

SEQ ID NO: 90126 - RNA, 19 nt, Homo sapiens
ucugaaguguuugacauuu

SEQ ID NO: 90127 - RNA, 19 nt, Homo sapiens
ugagaaguuuguaacagau

SEQ ID NO: 90128 - RNA, 19 nt, Homo sapiens
ugaggcaccuggagaccuu

SEQ ID NO: 90129 - RNA, 19 nt, Homo sapiens
cagagcacccgaagucuug

SEQ ID NO: 90130 - RNA, 19 nt, Homo sapiens
ggccuugcccgcaucuaua

SEQ ID NO: 90131 - RNA, 19 nt, Homo sapiens
ucgaugaacuaggcaaaga

SEQ ID NO: 90132 - RNA, 19 nt, Homo sapiens
acugaaaccauaaaggaua

SEQ ID NO: 90133 - RNA, 19 nt, Homo sapiens
cugaaaccauaaaggauau

SEQ ID NO: 90134 - RNA, 19 nt, Homo sapiens
gcaugccgcucuccaccau

SEQ ID NO: 90135 - RNA, 19 nt, Homo sapiens
ucuccgaggucuggacuuu

SEQ ID NO: 90136 - RNA, 19 nt, Homo sapiens
cccaaccaauugagaaguu

SEQ ID NO: 90137 - RNA, 19 nt, Homo sapiens
agacuugaccacuuacuug

SEQ ID NO: 90138 - RNA, 19 nt, Homo sapiens
gcaaagaaaaccuggauuc

SEQ ID NO: 90139 - RNA, 19 nt, Homo sapiens
aaauaaaacucgcugacuu

SEQ ID NO: 90140 - RNA, 19 nt, Homo sapiens
agagaaaccaaacuaacuu

SEQ ID NO: 90141 - RNA, 19 nt, Homo sapiens
aagcugauccugcggagaa

SEQ ID NO: 90142 - RNA, 19 nt, Homo sapiens
cguggaaguucagauguug

SEQ ID NO: 90143 - RNA, 19 nt, Homo sapiens
ucacgaacagacagagaaa

SEQ ID NO: 90144 - RNA, 19 nt, Homo sapiens
gagcuguggaggauugcua

SEQ ID NO: 90145 - RNA, 19 nt, Homo sapiens
cagagaaaccaaacuaacu

SEQ ID NO: 90146 - RNA, 19 nt, Homo sapiens
uaacccagccaaaagaaua

SEQ ID NO: 90147 - RNA, 19 nt, Homo sapiens
accagcagcggacaaauaa

SEQ ID NO: 90148 - RNA, 19 nt, Homo sapiens
aguagugcaucgcgaucua

SEQ ID NO: 90149 - RNA, 19 nt, Homo sapiens
aaguucagauguugaucaa

SEQ ID NO: 90150 - RNA, 19 nt, Homo sapiens
ucguggaaguucagauguu

SEQ ID NO: 90151 - RNA, 19 nt, Homo sapiens
gacauuuaacccagccaaa

SEQ ID NO: 90152 - RNA, 19 nt, Homo sapiens
caaccaauugagaaguuug

SEQ ID NO: 90153 - RNA, 19 nt, Homo sapiens
guagugcaucgcgaucuaa

SEQ ID NO: 90154 - RNA, 19 nt, Homo sapiens
ggauaugauguuucagcuu

SEQ ID NO: 90155 - RNA, 19 nt, Homo sapiens
gcucugcuucuccaaggaa

SEQ ID NO: 90156 - RNA, 19 nt, Homo sapiens
agaagaagacuggccuaga

SEQ ID NO: 90157 - RNA, 19 nt, Homo sapiens
cuggaguguuggcugcaua

SEQ ID NO: 90158 - RNA, 19 nt, Homo sapiens
gaaguuuguaacagauauc

SEQ ID NO: 90159 - RNA, 19 nt, Homo sapiens
gcacagugucacgaacaga

SEQ ID NO: 90160 - RNA, 19 nt, Homo sapiens
caauugagaaguuuguaac

SEQ ID NO: 90161 - RNA, 19 nt, Homo sapiens
ugaccacuuacuuggauaa

SEQ ID NO: 90162 - RNA, 19 nt, Homo sapiens
aaaucugcccaaccaauug

SEQ ID NO: 90163 - RNA, 19 nt, Homo sapiens
cagcagcggacaaauaaaa

SEQ ID NO: 90164 - RNA, 19 nt, Homo sapiens
cuugaccacuuacuuggau

SEQ ID NO: 90165 - RNA, 19 nt, Homo sapiens
ccuggaaaggugcaaagaa

SEQ ID NO: 90166 - RNA, 19 nt, Homo sapiens
caggcggcauggagaagga

SEQ ID NO: 90167 - RNA, 19 nt, Homo sapiens
gaucuaaaaccacagaaca

SEQ ID NO: 90168 - RNA, 19 nt, Homo sapiens
ggacauagaucagaagcua

SEQ ID NO: 90169 - RNA, 19 nt, Homo sapiens
gaacagaggccuuagaaca

SEQ ID NO: 90170 - RNA, 19 nt, Homo sapiens
caauagagcuuauacacau

SEQ ID NO: 90171 - RNA, 19 nt, Homo sapiens
caucaaagccuacauguug

SEQ ID NO: 90172 - RNA, 19 nt, Homo sapiens
gcuaagucauccaaauaua

SEQ ID NO: 90173 - RNA, 19 nt, Homo sapiens
gagcuaagucauccaaaua

SEQ ID NO: 90174 - RNA, 19 nt, Homo sapiens
cauacaaggcuuauucuua

SEQ ID NO: 90175 - RNA, 19 nt, Homo sapiens
ggaaacugaucuagagguu

SEQ ID NO: 90176 - RNA, 19 nt, Homo sapiens
uaagguagcuuuaaauucg

SEQ ID NO: 90177 - RNA, 19 nt, Homo sapiens
aaacugaucuagagguuau

SEQ ID NO: 90178 - RNA, 19 nt, Homo sapiens
ggagacgacuuacuagauc

SEQ ID NO: 90179 - RNA, 19 nt, Homo sapiens
gggcaaagcguuaugagaa

SEQ ID NO: 90180 - RNA, 19 nt, Homo sapiens
uguguagucuuccagauua

SEQ ID NO: 90181 - RNA, 19 nt, Homo sapiens
gcuguuggcuguauauuag

SEQ ID NO: 90182 - RNA, 19 nt, Homo sapiens
caacauuggauccuacaua

SEQ ID NO: 90183 - RNA, 19 nt, Homo sapiens
caaggaggauugcccaaga

SEQ ID NO: 90184 - RNA, 19 nt, Homo sapiens
ggagcuaagucauccaaau

SEQ ID NO: 90185 - RNA, 19 nt, Homo sapiens
caaauugucgccauuaaga

SEQ ID NO: 90186 - RNA, 19 nt, Homo sapiens
gaugacucuucaaggauua

SEQ ID NO: 90187 - RNA, 19 nt, Homo sapiens
gaaaaugcauuagggaaaa

SEQ ID NO: 90188 - RNA, 19 nt, Homo sapiens
gaucagcuaacaagaauau

SEQ ID NO: 90189 - RNA, 19 nt, Homo sapiens
caaccaaauugucgccauu

SEQ ID NO: 90190 - RNA, 19 nt, Homo sapiens
gaaaagaacagaggccuua

SEQ ID NO: 90191 - RNA, 19 nt, Homo sapiens
ggaauaccuuugcaucaca

SEQ ID NO: 90192 - RNA, 19 nt, Homo sapiens
aaauagaaccgccuuaaga

SEQ ID NO: 90193 - RNA, 19 nt, Homo sapiens
gauuagagucccaaaguga

SEQ ID NO: 90194 - RNA, 19 nt, Homo sapiens
aaauccagcuuuggcaaua

SEQ ID NO: 90195 - RNA, 19 nt, Homo sapiens
cgacuuacuagaucucaua

SEQ ID NO: 90196 - RNA, 19 nt, Homo sapiens
gccaggagauucagaccuu

SEQ ID NO: 90197 - RNA, 19 nt, Homo sapiens
auagggaucugaaaccaaa

SEQ ID NO: 90198 - RNA, 19 nt, Homo sapiens
ggauggcucuggacgugaa

SEQ ID NO: 90199 - RNA, 19 nt, Homo sapiens
gauaagaauaccaaccaaa

SEQ ID NO: 90200 - RNA, 19 nt, Homo sapiens
gaaacugaucuagagguua

SEQ ID NO: 90201 - RNA, 19 nt, Homo sapiens
aaucaaacuuggacauaga

SEQ ID NO: 90202 - RNA, 19 nt, Homo sapiens
gaagcuaaagaugguauaa

SEQ ID NO: 90203 - RNA, 19 nt, Homo sapiens
ugaugacucuucaaggauu

SEQ ID NO: 90204 - RNA, 19 nt, Homo sapiens
uauggaaacugaucuagag

SEQ ID NO: 90205 - RNA, 19 nt, Homo sapiens
aguaaaugcuguagaagug

SEQ ID NO: 90206 - RNA, 19 nt, Homo sapiens
ggacauguguagucuucca

SEQ ID NO: 90207 - RNA, 19 nt, Homo sapiens
gagaaaaguucaauacucu

SEQ ID NO: 90208 - RNA, 19 nt, Homo sapiens
agagaacacuggacaacau

SEQ ID NO: 90209 - RNA, 19 nt, Homo sapiens
aagaauaccaaccaaauug

SEQ ID NO: 90210 - RNA, 19 nt, Homo sapiens
cuuacuagaucucauacaa

SEQ ID NO: 90211 - RNA, 19 nt, Homo sapiens
ggauugcccaagaaacuaa

SEQ ID NO: 90212 - RNA, 19 nt, Homo sapiens
cagcuaacaagaauauuug

SEQ ID NO: 90213 - RNA, 19 nt, Homo sapiens
gagauaagaauaccaacca

SEQ ID NO: 90214 - RNA, 19 nt, Homo sapiens
gagaacacuggacaacauu

SEQ ID NO: 90215 - RNA, 19 nt, Homo sapiens
gaacaguggccggacaugu

SEQ ID NO: 90216 - RNA, 19 nt, Homo sapiens
uauaauuggucuccuugau

SEQ ID NO: 90217 - RNA, 19 nt, Homo sapiens
guagaagugaguuuguaaa

SEQ ID NO: 90218 - RNA, 19 nt, Homo sapiens
uaauccaugugcucgaauu

SEQ ID NO: 90219 - RNA, 19 nt, Homo sapiens
ggcaaagcguuaugagaag

SEQ ID NO: 90220 - RNA, 19 nt, Homo sapiens
auauuagccuugucuuuga

SEQ ID NO: 90221 - RNA, 19 nt, Homo sapiens
ggacaacauuuuacuacug

SEQ ID NO: 90222 - RNA, 19 nt, Homo sapiens
gaauaccuuugcaucacau

SEQ ID NO: 90223 - RNA, 19 nt, Homo sapiens
gcacaccaacugaggaaca

SEQ ID NO: 90224 - RNA, 19 nt, Homo sapiens
gaguuacuauuuggagcua

SEQ ID NO: 90225 - RNA, 19 nt, Homo sapiens
gaucugaaaccaaacaacu

SEQ ID NO: 90226 - RNA, 19 nt, Homo sapiens
aauauuagccuugucuuug

SEQ ID NO: 90227 - RNA, 19 nt, Homo sapiens
ccagagauaagaauaccaa

SEQ ID NO: 90228 - RNA, 19 nt, Homo sapiens
gacaacauuuuacuacuga

SEQ ID NO: 90229 - RNA, 19 nt, Homo sapiens
gaggauugcccaagaaacu

SEQ ID NO: 90230 - RNA, 19 nt, Homo sapiens
gaaaauggaguucuaaaac

SEQ ID NO: 90231 - RNA, 19 nt, Homo sapiens
gacaguuugccaccguuua

SEQ ID NO: 90232 - RNA, 19 nt, Homo sapiens
uaaaggagcaaucaaaucc

SEQ ID NO: 90233 - RNA, 19 nt, Homo sapiens
uagcagaguuacuucuaag

SEQ ID NO: 90234 - RNA, 19 nt, Homo sapiens
ggcuguuggcuguauauua

SEQ ID NO: 90235 - RNA, 19 nt, Homo sapiens
gcuaggauguaugguguag

SEQ ID NO: 90236 - RNA, 19 nt, Homo sapiens
aaaucaaacuuggacauag

SEQ ID NO: 90237 - RNA, 19 nt, Homo sapiens
ccggacauguguagucuuc

SEQ ID NO: 90238 - RNA, 19 nt, Homo sapiens
ggacaguuugccaccguuu

SEQ ID NO: 90239 - RNA, 19 nt, Homo sapiens
uugaucagcuaacaagaau

SEQ ID NO: 90240 - RNA, 19 nt, Homo sapiens
gagauucagaccuugauca

SEQ ID NO: 90241 - RNA, 19 nt, Homo sapiens
ccaauagagcuuauacaca

SEQ ID NO: 90242 - RNA, 19 nt, Homo sapiens
aacauuggauccuacauag

SEQ ID NO: 90243 - RNA, 19 nt, Homo sapiens
agaaccgccuuaagagaga

SEQ ID NO: 90244 - RNA, 19 nt, Homo sapiens
acauagaucagaagcuaaa

SEQ ID NO: 90245 - RNA, 19 nt, Homo sapiens
gaaaaguucaauacucuug

SEQ ID NO: 90246 - RNA, 19 nt, Homo sapiens
ugauuagagucccaaagug

SEQ ID NO: 90247 - RNA, 19 nt, Homo sapiens
gaacacuggacaacauuuu

SEQ ID NO: 90248 - RNA, 19 nt, Homo sapiens
gacaccaucacacaucaaa

SEQ ID NO: 90249 - RNA, 19 nt, Homo sapiens
aagaacagaggccuuagaa

SEQ ID NO: 90250 - RNA, 19 nt, Homo sapiens
ucucauacaaggcuuauuc

SEQ ID NO: 90251 - RNA, 19 nt, Homo sapiens
gagacgacuuacuagaucu

SEQ ID NO: 90252 - RNA, 19 nt, Homo sapiens
uaaauagaaccgccuuaag

SEQ ID NO: 90253 - RNA, 19 nt, Homo sapiens
auaaauagaaccgccuuaa

SEQ ID NO: 90254 - RNA, 19 nt, Homo sapiens
guaaaugcuguagaaguga

SEQ ID NO: 90255 - RNA, 19 nt, Homo sapiens
uaggauguaugguguaggu

SEQ ID NO: 90256 - RNA, 19 nt, Homo sapiens
cggcuggagucgggcuuua

SEQ ID NO: 90257 - RNA, 19 nt, Homo sapiens
gaauaccaaccaaauuguc

SEQ ID NO: 90258 - RNA, 19 nt, Homo sapiens
cucuugaaauguagaauug

SEQ ID NO: 90259 - RNA, 19 nt, Homo sapiens
aaggaggauugcccaagaa

SEQ ID NO: 90260 - RNA, 19 nt, Homo sapiens
gcacugaaaaugaaguauu

SEQ ID NO: 90261 - RNA, 19 nt, Homo sapiens
gcaggagacgacuuacuag

SEQ ID NO: 90262 - RNA, 19 nt, Homo sapiens
acagaggccuuagaacaag

SEQ ID NO: 90263 - RNA, 19 nt, Homo sapiens
accaaauugucgccauuaa

SEQ ID NO: 90264 - RNA, 19 nt, Homo sapiens
caauacucuugaaauguag

SEQ ID NO: 90265 - RNA, 19 nt, Homo sapiens
cuguagaagugaguuugua

SEQ ID NO: 90266 - RNA, 19 nt, Homo sapiens
uuacaaggccagagauaag

SEQ ID NO: 90267 - RNA, 19 nt, Homo sapiens
guuaugagaagcuggacuu

SEQ ID NO: 90268 - RNA, 19 nt, Homo sapiens
gaacaugaccucuggcaua

SEQ ID NO: 90269 - RNA, 19 nt, Homo sapiens
gcaagcauuugucuuugua

SEQ ID NO: 90270 - RNA, 19 nt, Homo sapiens
gguaguggcuuccaaguug

SEQ ID NO: 90271 - RNA, 19 nt, Homo sapiens
agaagaaccugaugacaaa

SEQ ID NO: 90272 - RNA, 19 nt, Homo sapiens
caagaagccaguucaguua

SEQ ID NO: 90273 - RNA, 19 nt, Homo sapiens
gaacugggaucucuauguc

SEQ ID NO: 90274 - RNA, 19 nt, Homo sapiens
gaagaaauacguauaccaa

SEQ ID NO: 90275 - RNA, 19 nt, Homo sapiens
gauaaagauugggaagaua

SEQ ID NO: 90276 - RNA, 19 nt, Homo sapiens
ucgaggaccuguuugaaua

SEQ ID NO: 90277 - RNA, 19 nt, Homo sapiens
ggacagaauauucaaugua

SEQ ID NO: 90278 - RNA, 19 nt, Homo sapiens
caugaccucuggcauauaa

SEQ ID NO: 90279 - RNA, 19 nt, Homo sapiens
gaaggaugauaaagacuau

SEQ ID NO: 90280 - RNA, 19 nt, Homo sapiens
ggaaagaugggaaggauga

SEQ ID NO: 90281 - RNA, 19 nt, Homo sapiens
gacaauggacuaugacuuu

SEQ ID NO: 90282 - RNA, 19 nt, Homo sapiens
ccacaguacucacaucaga

SEQ ID NO: 90283 - RNA, 19 nt, Homo sapiens
gcaauaaccacacuaaugg

SEQ ID NO: 90284 - RNA, 19 nt, Homo sapiens
ggaaggaugauaaagacua

SEQ ID NO: 90285 - RNA, 19 nt, Homo sapiens
uauaccaacugcagccuua

SEQ ID NO: 90286 - RNA, 19 nt, Homo sapiens
gggauuuccugcagauaaa

SEQ ID NO: 90287 - RNA, 19 nt, Homo sapiens
gcacagagauuugaaaccu

SEQ ID NO: 90288 - RNA, 19 nt, Homo sapiens
gagcaaggcauuauaccaa

SEQ ID NO: 90289 - RNA, 19 nt, Homo sapiens
gaagaaagugagaguuguu

SEQ ID NO: 90290 - RNA, 19 nt, Homo sapiens
acaauggacuaugacuuua

SEQ ID NO: 90291 - RNA, 19 nt, Homo sapiens
gaggaaagaugggaaggau

SEQ ID NO: 90292 - RNA, 19 nt, Homo sapiens
gcauuccacuugcuucaga

SEQ ID NO: 90293 - RNA, 19 nt, Homo sapiens
uaaagcgaauuaccucaga

SEQ ID NO: 90294 - RNA, 19 nt, Homo sapiens
uacgagggcugcaaaguug

SEQ ID NO: 90295 - RNA, 19 nt, Homo sapiens
guacaaccacaucuucaaa

SEQ ID NO: 90296 - RNA, 19 nt, Homo sapiens
ggcaauaaccacacuaaug

SEQ ID NO: 90297 - RNA, 19 nt, Homo sapiens
guguauauuugcagaacua

SEQ ID NO: 90298 - RNA, 19 nt, Homo sapiens
gauuugaaaccugcuaaua

SEQ ID NO: 90299 - RNA, 19 nt, Homo sapiens
uaucagauccuagauggua

SEQ ID NO: 90300 - RNA, 19 nt, Homo sapiens
ucaaaucccuuacccaaaa

SEQ ID NO: 90301 - RNA, 19 nt, Homo sapiens
gcacuuauggucacgucua

SEQ ID NO: 90302 - RNA, 19 nt, Homo sapiens
gaaauacguauaccaacug

SEQ ID NO: 90303 - RNA, 19 nt, Homo sapiens
gcauuugucuuuguaugug

SEQ ID NO: 90304 - RNA, 19 nt, Homo sapiens
gcaggaccccuauuucuua

SEQ ID NO: 90305 - RNA, 19 nt, Homo sapiens
gacccaauaaagcgaauua

SEQ ID NO: 90306 - RNA, 19 nt, Homo sapiens
agaaauagcauuacuucga

SEQ ID NO: 90307 - RNA, 19 nt, Homo sapiens
guagagaaauagcauuacu

SEQ ID NO: 90308 - RNA, 19 nt, Homo sapiens
uaucaugaccucagacuau

SEQ ID NO: 90309 - RNA, 19 nt, Homo sapiens
gggcaagcauuugucuuug

SEQ ID NO: 90310 - RNA, 19 nt, Homo sapiens
caguuuguguuguggauuu

SEQ ID NO: 90311 - RNA, 19 nt, Homo sapiens
uaaaccagauaguaaagca

SEQ ID NO: 90312 - RNA, 19 nt, Homo sapiens
acaagaagccaguucaguu

SEQ ID NO: 90313 - RNA, 19 nt, Homo sapiens
gcagccuuaucaaguauau

SEQ ID NO: 90314 - RNA, 19 nt, Homo sapiens
gcaaggcauuauaccaaag

SEQ ID NO: 90315 - RNA, 19 nt, Homo sapiens
ggaacugggaucucuaugu

SEQ ID NO: 90316 - RNA, 19 nt, Homo sapiens
uaguaaagcauuccacuug

SEQ ID NO: 90317 - RNA, 19 nt, Homo sapiens
aaacgucauuucucuucaa

SEQ ID NO: 90318 - RNA, 19 nt, Homo sapiens
cuacaaagccaagaggaaa

SEQ ID NO: 90319 - RNA, 19 nt, Homo sapiens
cuacuuccauaguuuacuu

SEQ ID NO: 90320 - RNA, 19 nt, Homo sapiens
aagaagaaccugaugacaa

SEQ ID NO: 90321 - RNA, 19 nt, Homo sapiens
agauaaagauugggaagau

SEQ ID NO: 90322 - RNA, 19 nt, Homo sapiens
ggcuuugcccgauuauuua

SEQ ID NO: 90323 - RNA, 19 nt, Homo sapiens
ucagguggacuuaucauga

SEQ ID NO: 90324 - RNA, 19 nt, Homo sapiens
cgucagaaccaauauuuca

SEQ ID NO: 90325 - RNA, 19 nt, Homo sapiens
gauccuagaugguauucac

SEQ ID NO: 90326 - RNA, 19 nt, Homo sapiens
gaaggaacugggaucucua

SEQ ID NO: 90327 - RNA, 19 nt, Homo sapiens
ggcaagcauuugucuuugu

SEQ ID NO: 90328 - RNA, 19 nt, Homo sapiens
gccaugagaauguacugua

SEQ ID NO: 90329 - RNA, 19 nt, Homo sapiens
ugaagaaagugagaguugu

SEQ ID NO: 90330 - RNA, 19 nt, Homo sapiens
gaagaagaaccugaugaca

SEQ ID NO: 90331 - RNA, 19 nt, Homo sapiens
agaaauacguauaccaacu

SEQ ID NO: 90332 - RNA, 19 nt, Homo sapiens
caauggacuaugacuuuaa

SEQ ID NO: 90333 - RNA, 19 nt, Homo sapiens
gcaaacaagaagccaguuc

SEQ ID NO: 90334 - RNA, 19 nt, Homo sapiens
gaguuagacuugaaaagaa

SEQ ID NO: 90335 - RNA, 19 nt, Homo sapiens
caaacaagaagccaguuca

SEQ ID NO: 90336 - RNA, 19 nt, Homo sapiens
caaacgucauuucucuuca

SEQ ID NO: 90337 - RNA, 19 nt, Homo sapiens
ccaaacgucauuucucuuc

SEQ ID NO: 90338 - RNA, 19 nt, Homo sapiens
gucggcauguagagaaaua

SEQ ID NO: 90339 - RNA, 19 nt, Homo sapiens
ugaagccuuuagcagauuu

SEQ ID NO: 90340 - RNA, 19 nt, Homo sapiens
ggaagaagaaccugaugac

SEQ ID NO: 90341 - RNA, 19 nt, Homo sapiens
acugcagccuuaucaagua

SEQ ID NO: 90342 - RNA, 19 nt, Homo sapiens
cuacuaacgucagaaccaa

SEQ ID NO: 90343 - RNA, 19 nt, Homo sapiens
agaaggaacugggaucucu

SEQ ID NO: 90344 - RNA, 19 nt, Homo sapiens
ggcauauaaucaaguuuca

SEQ ID NO: 90345 - RNA, 19 nt, Homo sapiens
cagaggcugugacaaugga

SEQ ID NO: 90346 - RNA, 19 nt, Homo sapiens
gagcugcaucggaaucuug

SEQ ID NO: 90347 - RNA, 19 nt, Homo sapiens
gaacuacuaacgucagaac

SEQ ID NO: 90348 - RNA, 19 nt, Homo sapiens
cagaacuacuaacgucaga

SEQ ID NO: 90349 - RNA, 19 nt, Homo sapiens
ggcauuauaccaaagcuau

SEQ ID NO: 90350 - RNA, 19 nt, Homo sapiens
agauuuggauccagugguu

SEQ ID NO: 90351 - RNA, 19 nt, Homo sapiens
gaugauaaagacuaugcuu

SEQ ID NO: 90352 - RNA, 19 nt, Homo sapiens
aacaugaccucuggcauau

SEQ ID NO: 90353 - RNA, 19 nt, Homo sapiens
ugacuaugcugaacaugac

SEQ ID NO: 90354 - RNA, 19 nt, Homo sapiens
uaaccacacuaauggaacu

SEQ ID NO: 90355 - RNA, 19 nt, Homo sapiens
caacugcagccuuaucaag

SEQ ID NO: 90356 - RNA, 19 nt, Homo sapiens
guaccgagccccugaacua

SEQ ID NO: 90357 - RNA, 19 nt, Homo sapiens
agagaaauagcauuacuuc

SEQ ID NO: 90358 - RNA, 19 nt, Homo sapiens
cagacugaccaaugcauuu

SEQ ID NO: 90359 - RNA, 19 nt, Homo sapiens
gaacuacuucuuggagcaa

SEQ ID NO: 90360 - RNA, 19 nt, Homo sapiens
gagauuugaaaccugcuaa

SEQ ID NO: 90361 - RNA, 19 nt, Homo sapiens
agguguggcuucuguuuga

SEQ ID NO: 90362 - RNA, 19 nt, Homo sapiens
aagaugggaaggaugauaa

SEQ ID NO: 90363 - RNA, 19 nt, Homo sapiens
guaguggcuuccaaguugu

SEQ ID NO: 90364 - RNA, 19 nt, Homo sapiens
caauccacaugcugccuau

SEQ ID NO: 90365 - RNA, 19 nt, Homo sapiens
caagaggacaucaaaacua

SEQ ID NO: 90366 - RNA, 19 nt, Homo sapiens
uaacgucagaaccaauauu

SEQ ID NO: 90367 - RNA, 19 nt, Homo sapiens
ggaguuagacuugaaaaga

SEQ ID NO: 90368 - RNA, 19 nt, Homo sapiens
gaaacaagauccugcauag

SEQ ID NO: 90369 - RNA, 19 nt, Homo sapiens
gugaugaaguuuccaaaua

SEQ ID NO: 90370 - RNA, 19 nt, Homo sapiens
ggacuggaguggagcauug

SEQ ID NO: 90371 - RNA, 19 nt, Homo sapiens
ggccaaacguggacaacua

SEQ ID NO: 90372 - RNA, 19 nt, Homo sapiens
gaagguggcucugaagaag

SEQ ID NO: 90373 - RNA, 19 nt, Homo sapiens
ugaagaaggugcugaugga

SEQ ID NO: 90374 - RNA, 19 nt, Homo sapiens
guauauaccugguguucga

SEQ ID NO: 90375 - RNA, 19 nt, Homo sapiens
ugacguccauguucgagua

SEQ ID NO: 90376 - RNA, 19 nt, Homo sapiens
agacagggcauuugaguuu

SEQ ID NO: 90377 - RNA, 19 nt, Homo sapiens
cacuagggcucuuguguuu

SEQ ID NO: 90378 - RNA, 19 nt, Homo sapiens
caugaaggcugcuaaugug

SEQ ID NO: 90379 - RNA, 19 nt, Homo sapiens
gacagggcauuugaguuua

SEQ ID NO: 90380 - RNA, 19 nt, Homo sapiens
ggacaacuaugagcuguac

SEQ ID NO: 90381 - RNA, 19 nt, Homo sapiens
gaaggcugcuaaugugcuu

SEQ ID NO: 90382 - RNA, 19 nt, Homo sapiens
ucaagagggugaugcagau

SEQ ID NO: 90383 - RNA, 19 nt, Homo sapiens
caagauccuucagcuucua

SEQ ID NO: 90384 - RNA, 19 nt, Homo sapiens
ugaugaaguuuccaaauac

SEQ ID NO: 90385 - RNA, 19 nt, Homo sapiens
caacuugauugagauuugu

SEQ ID NO: 90386 - RNA, 19 nt, Homo sapiens
guuuauaucucucaugcau

SEQ ID NO: 90387 - RNA, 19 nt, Homo sapiens
ucuacuacauccacagaaa

SEQ ID NO: 90388 - RNA, 19 nt, Homo sapiens
ccucaggaaugggcuguuu

SEQ ID NO: 90389 - RNA, 19 nt, Homo sapiens
gcauuugaguuuauaucuc

SEQ ID NO: 90390 - RNA, 19 nt, Homo sapiens
ggacaugaaggcugcuaau

SEQ ID NO: 90391 - RNA, 19 nt, Homo sapiens
ggccuaacccucagaaaca

SEQ ID NO: 90392 - RNA, 19 nt, Homo sapiens
ggagacagggcauuugagu

SEQ ID NO: 90393 - RNA, 19 nt, Homo sapiens
ccaaccagacggaguuuga

SEQ ID NO: 90394 - RNA, 19 nt, Homo sapiens
caaacguggacaacuauga

SEQ ID NO: 90395 - RNA, 19 nt, Homo sapiens
agaaacaagauccugcaua

SEQ ID NO: 90396 - RNA, 19 nt, Homo sapiens
ggcacaguuugguccguua

SEQ ID NO: 90397 - RNA, 19 nt, Homo sapiens
gaagaaggugcugauggaa

SEQ ID NO: 90398 - RNA, 19 nt, Homo sapiens
gcugggcuguugagcaaug

SEQ ID NO: 90399 - RNA, 19 nt, Homo sapiens
acuaugagcuguacgaaaa

SEQ ID NO: 90400 - RNA, 19 nt, Homo sapiens
cagggcauuugaguuuaua

SEQ ID NO: 90401 - RNA, 19 nt, Homo sapiens
acgagaauguggucaacuu

SEQ ID NO: 90402 - RNA, 19 nt, Homo sapiens
ccacuagggcucuuguguu

SEQ ID NO: 90403 - RNA, 19 nt, Homo sapiens
acagggcauuugaguuuau

SEQ ID NO: 90404 - RNA, 19 nt, Homo sapiens
gccagaagcggaaggugaa

SEQ ID NO: 90405 - RNA, 19 nt, Homo sapiens
ugaccuugcugggcuguug

SEQ ID NO: 90406 - RNA, 19 nt, Homo sapiens
ccaccaaccagacggaguu

SEQ ID NO: 90407 - RNA, 19 nt, Homo sapiens
cugcaaggguaguauauac

SEQ ID NO: 90408 - RNA, 19 nt, Homo sapiens
guuugguccguuagaauua

SEQ ID NO: 90409 - RNA, 19 nt, Homo sapiens
ggagaauuuuacuguguuu

SEQ ID NO: 90410 - RNA, 19 nt, Homo sapiens
gcacuggagcugucuuguc

SEQ ID NO: 90411 - RNA, 19 nt, Homo sapiens
gaugaaguuuccaaauacg

SEQ ID NO: 90412 - RNA, 19 nt, Homo sapiens
gcaauguuuuggucaaguu

SEQ ID NO: 90413 - RNA, 19 nt, Homo sapiens
ucaagauccuucagcuucu

SEQ ID NO: 90414 - RNA, 19 nt, Homo sapiens
gcugcaaggguaguauaua

SEQ ID NO: 90415 - RNA, 19 nt, Homo sapiens
agaaggugcugauggaaaa

SEQ ID NO: 90416 - RNA, 19 nt, Homo sapiens
gagacagggcauuugaguu

SEQ ID NO: 90417 - RNA, 19 nt, Homo sapiens
ccacccaccugacguccau

SEQ ID NO: 90418 - RNA, 19 nt, Homo sapiens
ccaacucgcccucaucagu

SEQ ID NO: 90419 - RNA, 19 nt, Homo sapiens
uuaacggccucuacuacau

SEQ ID NO: 90420 - RNA, 19 nt, Homo sapiens
cacuggaccucaucgacaa

SEQ ID NO: 90421 - RNA, 19 nt, Homo sapiens
guggagacagggcauuuga

SEQ ID NO: 90422 - RNA, 19 nt, Homo sapiens
acaguuugguccguuagaa

SEQ ID NO: 90423 - RNA, 19 nt, Homo sapiens
agaagguggcucugaagaa

SEQ ID NO: 90424 - RNA, 19 nt, Homo sapiens
cggaagggcagccagauca

SEQ ID NO: 90425 - RNA, 19 nt, Homo sapiens
gaugguucccagaggguuu

SEQ ID NO: 90426 - RNA, 19 nt, Homo sapiens
ggaguuugagcgcgucuuc

SEQ ID NO: 90427 - RNA, 19 nt, Homo sapiens
gcaaucccgccaccaccaa

SEQ ID NO: 90428 - RNA, 19 nt, Homo sapiens
gccaaacguggacaacuau

SEQ ID NO: 90429 - RNA, 19 nt, Homo sapiens
gcaccaacucgcccucauc

SEQ ID NO: 90430 - RNA, 19 nt, Homo sapiens
gacaugaaggcugcuaaug

SEQ ID NO: 90431 - RNA, 19 nt, Homo sapiens
aagaaggugcugauggaaa

SEQ ID NO: 90432 - RNA, 19 nt, Homo sapiens
ucaaguucacgcugucuga

SEQ ID NO: 90433 - RNA, 19 nt, Homo sapiens
gggcuguugagcaauguuu

SEQ ID NO: 90434 - RNA, 19 nt, Homo sapiens
gggcuggcacaaacucuug

SEQ ID NO: 90435 - RNA, 19 nt, Homo sapiens
gcaagaccggccagaaggu

SEQ ID NO: 90436 - RNA, 19 nt, Homo sapiens
ccaccugacguccauguuc

SEQ ID NO: 90437 - RNA, 19 nt, Homo sapiens
ccucaaccacgacuucuuc

SEQ ID NO: 90438 - RNA, 19 nt, Homo sapiens
cgagaauguggucaacuug

SEQ ID NO: 90439 - RNA, 19 nt, Homo sapiens
caacuaugagcuguacgaa

SEQ ID NO: 90440 - RNA, 19 nt, Homo sapiens
gauccugcauagggacaug

SEQ ID NO: 90441 - RNA, 19 nt, Homo sapiens
agacauuccugggcacagu

SEQ ID NO: 90442 - RNA, 19 nt, Homo sapiens
acucuugguuucuucaaca

SEQ ID NO: 90443 - RNA, 19 nt, Homo sapiens
uccugaagcuggcagacuu

SEQ ID NO: 90444 - RNA, 19 nt, Homo sapiens
ucacccacccacaauccua

SEQ ID NO: 90445 - RNA, 19 nt, Homo sapiens
ccuucagccuggccaagaa

SEQ ID NO: 90446 - RNA, 19 nt, Homo sapiens
uaacggccucuacuacauc

SEQ ID NO: 90447 - RNA, 19 nt, Homo sapiens
caccaacucgcccucauca

SEQ ID NO: 90448 - RNA, 19 nt, Homo sapiens
uuugguccguuagaauuaa

SEQ ID NO: 90449 - RNA, 19 nt, Homo sapiens
caggagaauuuuacugugu

SEQ ID NO: 90450 - RNA, 19 nt, Homo sapiens
gucuuguccuugcugguuu

SEQ ID NO: 90451 - RNA, 19 nt, Homo sapiens
gcgaugacgcccucaacca

SEQ ID NO: 90452 - RNA, 19 nt, Homo sapiens
cauacgcacuggaccucau

SEQ ID NO: 90453 - RNA, 19 nt, Homo sapiens
acacggagcagcaccaacu

SEQ ID NO: 90454 - RNA, 19 nt, Homo sapiens
gcuuaacggccucuacuac

SEQ ID NO: 90455 - RNA, 19 nt, Homo sapiens
guaaacagauggcacuuug

SEQ ID NO: 90456 - RNA, 19 nt, Homo sapiens
gaacaaggagucagacauu

SEQ ID NO: 90457 - RNA, 19 nt, Homo sapiens
uuaaacaccuccucaugua

SEQ ID NO: 90458 - RNA, 19 nt, Homo sapiens
ccacaaugcugaauauaca

SEQ ID NO: 90459 - RNA, 19 nt, Homo sapiens
guucauugcacuuugauua

SEQ ID NO: 90460 - RNA, 19 nt, Homo sapiens
aaacuaggcgguugaauga

SEQ ID NO: 90461 - RNA, 19 nt, Homo sapiens
cacaggcgguuaugaaauu

SEQ ID NO: 90462 - RNA, 19 nt, Homo sapiens
auacuggccuggacuguuu

SEQ ID NO: 90463 - RNA, 19 nt, Homo sapiens
gaagggacacacaagaaga

SEQ ID NO: 90464 - RNA, 19 nt, Homo sapiens
gauggaacuucgacuuugu

SEQ ID NO: 90465 - RNA, 19 nt, Homo sapiens
cagcugggcucugcaauuc

SEQ ID NO: 90466 - RNA, 19 nt, Homo sapiens
ccaguucauugcacuuuga

SEQ ID NO: 90467 - RNA, 19 nt, Homo sapiens
caguuugugugucuuaauu

SEQ ID NO: 90468 - RNA, 19 nt, Homo sapiens
agaccagcaugacagauuu

SEQ ID NO: 90469 - RNA, 19 nt, Homo sapiens
aaacagauggcacuuugaa

SEQ ID NO: 90470 - RNA, 19 nt, Homo sapiens
gcgauggaacuucgacuuu

SEQ ID NO: 90471 - RNA, 19 nt, Homo sapiens
gugagcagcugccgaaguc

SEQ ID NO: 90472 - RNA, 19 nt, Homo sapiens
gggaagggacacacaagaa

SEQ ID NO: 90473 - RNA, 19 nt, Homo sapiens
aaugagagguuccuaagag

SEQ ID NO: 90474 - RNA, 19 nt, Homo sapiens
cgauggaacuucgacuuug

SEQ ID NO: 90475 - RNA, 19 nt, Homo sapiens
gaaugagagguuccuaaga

SEQ ID NO: 90476 - RNA, 19 nt, Homo sapiens
gcaggugcucaauaaauga

SEQ ID NO: 90477 - RNA, 19 nt, Homo sapiens
ucacagcuccucccacaau

SEQ ID NO: 90478 - RNA, 19 nt, Homo sapiens
cgacugugaugcgcuaaug

SEQ ID NO: 90479 - RNA, 19 nt, Homo sapiens
guacuguucugugucuuuc

SEQ ID NO: 90480 - RNA, 19 nt, Homo sapiens
gaccacacccuguacuguu

SEQ ID NO: 90481 - RNA, 19 nt, Homo sapiens
ggaagggacacacaagaag

SEQ ID NO: 90482 - RNA, 19 nt, Homo sapiens
gcugggaguaguugucuuu

SEQ ID NO: 90483 - RNA, 19 nt, Homo sapiens
gccucuggcauuagaauua

SEQ ID NO: 90484 - RNA, 19 nt, Homo sapiens
cucuacaucuucugccuua

SEQ ID NO: 90485 - RNA, 19 nt, Homo sapiens
caaggagucagacauuuua

SEQ ID NO: 90486 - RNA, 19 nt, Homo sapiens
aacaaggagucagacauuu

SEQ ID NO: 90487 - RNA, 19 nt, Homo sapiens
uaagagugcugggcauuuu

SEQ ID NO: 90488 - RNA, 19 nt, Homo sapiens
cagaggaggcgccauguca

SEQ ID NO: 90489 - RNA, 19 nt, Homo sapiens
ggaacaaggagucagacau

SEQ ID NO: 90490 - RNA, 19 nt, Homo sapiens
acuaggcgguugaaugaga

SEQ ID NO: 90491 - RNA, 19 nt, Homo sapiens
guacccuccuggcucuuga

SEQ ID NO: 90492 - RNA, 19 nt, Homo sapiens
gaggaggcgccaugucaga

SEQ ID NO: 90493 - RNA, 19 nt, Homo sapiens
cagaccagcaugacagauu

SEQ ID NO: 90494 - RNA, 19 nt, Homo sapiens
gagcccgucucaguguuga

SEQ ID NO: 90495 - RNA, 19 nt, Homo sapiens
ccaagaggaagcccuaauc

SEQ ID NO: 90496 - RNA, 19 nt, Homo sapiens
uuaagaugguggcaguaga

SEQ ID NO: 90497 - RNA, 19 nt, Homo sapiens
ccucuggcauuagaauuau

SEQ ID NO: 90498 - RNA, 19 nt, Homo sapiens
ggugcucaauaaaugauuc

SEQ ID NO: 90499 - RNA, 19 nt, Homo sapiens
ggaccacacccuguacugu

SEQ ID NO: 90500 - RNA, 19 nt, Homo sapiens
uuccagcuccuguaacaua

SEQ ID NO: 90501 - RNA, 19 nt, Homo sapiens
gggaguaguugucuuuccu

SEQ ID NO: 90502 - RNA, 19 nt, Homo sapiens
cagcaugacagauuucuac

SEQ ID NO: 90503 - RNA, 19 nt, Homo sapiens
gaccugucacugucuugua

SEQ ID NO: 90504 - RNA, 19 nt, Homo sapiens
uuugagaaguaaacagaug

SEQ ID NO: 90505 - RNA, 19 nt, Homo sapiens
cagcagaggaagaccaugu

SEQ ID NO: 90506 - RNA, 19 nt, Homo sapiens
cauuugagaaguaaacaga

SEQ ID NO: 90507 - RNA, 19 nt, Homo sapiens
ucacaggcgguuaugaaau

SEQ ID NO: 90508 - RNA, 19 nt, Homo sapiens
ugucacaggcgguuaugaa

SEQ ID NO: 90509 - RNA, 19 nt, Homo sapiens
aaacaccuccucauguaca

SEQ ID NO: 90510 - RNA, 19 nt, Homo sapiens
ccagcugggcucugcaauu

SEQ ID NO: 90511 - RNA, 19 nt, Homo sapiens
gggagcccgucucaguguu

SEQ ID NO: 90512 - RNA, 19 nt, Homo sapiens
ugaaugagagguuccuaag

SEQ ID NO: 90513 - RNA, 19 nt, Homo sapiens
ggagucagacauuuuaaga

SEQ ID NO: 90514 - RNA, 19 nt, Homo sapiens
caaaucguccagcgaccuu

SEQ ID NO: 90515 - RNA, 19 nt, Homo sapiens
gaagccugcaguccuggaa

SEQ ID NO: 90516 - RNA, 19 nt, Homo sapiens
ccuuccagcuccuguaaca

SEQ ID NO: 90517 - RNA, 19 nt, Homo sapiens
caugccacgugggcucaua

SEQ ID NO: 90518 - RNA, 19 nt, Homo sapiens
cuaagagugcugggcauuu

SEQ ID NO: 90519 - RNA, 19 nt, Homo sapiens
uaaacagauggcacuuuga

SEQ ID NO: 90520 - RNA, 19 nt, Homo sapiens
cauguggaccugucacugu

SEQ ID NO: 90521 - RNA, 19 nt, Homo sapiens
uuuaaacaccuccucaugu

SEQ ID NO: 90522 - RNA, 19 nt, Homo sapiens
agucagacauuuuaagaug

SEQ ID NO: 90523 - RNA, 19 nt, Homo sapiens
ggagcccgucucaguguug

SEQ ID NO: 90524 - RNA, 19 nt, Homo sapiens
gucacaggcgguuaugaaa

SEQ ID NO: 90525 - RNA, 19 nt, Homo sapiens
ccuaauccgcccacaggaa

SEQ ID NO: 90526 - RNA, 19 nt, Homo sapiens
ucucaguuugugugucuua

SEQ ID NO: 90527 - RNA, 19 nt, Homo sapiens
ccaccuagacuguaaaccu

SEQ ID NO: 90528 - RNA, 19 nt, Homo sapiens
caccuuccagcuccuguaa

SEQ ID NO: 90529 - RNA, 19 nt, Homo sapiens
uaagaugguggcaguagag

SEQ ID NO: 90530 - RNA, 19 nt, Homo sapiens
guaaacagauggcacuuug

SEQ ID NO: 90531 - RNA, 19 nt, Homo sapiens
gaacaaggagucagacauu

SEQ ID NO: 90532 - RNA, 19 nt, Homo sapiens
uuaaacaccuccucaugua

SEQ ID NO: 90533 - RNA, 19 nt, Homo sapiens
ccacaaugcugaauauaca

SEQ ID NO: 90534 - RNA, 19 nt, Homo sapiens
guucauugcacuuugauua

SEQ ID NO: 90535 - RNA, 19 nt, Homo sapiens
aaacuaggcgguugaauga

SEQ ID NO: 90536 - RNA, 19 nt, Homo sapiens
cacaggcgguuaugaaauu

SEQ ID NO: 90537 - RNA, 19 nt, Homo sapiens
auacuggccuggacuguuu

SEQ ID NO: 90538 - RNA, 19 nt, Homo sapiens
gaagggacacacaagaaga

SEQ ID NO: 90539 - RNA, 19 nt, Homo sapiens
gauggaacuucgacuuugu

SEQ ID NO: 90540 - RNA, 19 nt, Homo sapiens
cagcugggcucugcaauuc

SEQ ID NO: 90541 - RNA, 19 nt, Homo sapiens
ccaguucauugcacuuuga

SEQ ID NO: 90542 - RNA, 19 nt, Homo sapiens
caguuugugugucuuaauu

SEQ ID NO: 90543 - RNA, 19 nt, Homo sapiens
agaccagcaugacagauuu

SEQ ID NO: 90544 - RNA, 19 nt, Homo sapiens
aaacagauggcacuuugaa

SEQ ID NO: 90545 - RNA, 19 nt, Homo sapiens
gcgauggaacuucgacuuu

SEQ ID NO: 90546 - RNA, 19 nt, Homo sapiens
gugagcagcugccgaaguc

SEQ ID NO: 90547 - RNA, 19 nt, Homo sapiens
gggaagggacacacaagaa

SEQ ID NO: 90548 - RNA, 19 nt, Homo sapiens
aaugagagguuccuaagag

SEQ ID NO: 90549 - RNA, 19 nt, Homo sapiens
cgauggaacuucgacuuug

SEQ ID NO: 90550 - RNA, 19 nt, Homo sapiens
gaaugagagguuccuaaga

SEQ ID NO: 90551 - RNA, 19 nt, Homo sapiens
gcaggugcucaauaaauga

SEQ ID NO: 90552 - RNA, 19 nt, Homo sapiens
ucacagcuccucccacaau

SEQ ID NO: 90553 - RNA, 19 nt, Homo sapiens
cgacugugaugcgcuaaug

SEQ ID NO: 90554 - RNA, 19 nt, Homo sapiens
guacuguucugugucuuuc

SEQ ID NO: 90555 - RNA, 19 nt, Homo sapiens
gaccacacccuguacuguu

SEQ ID NO: 90556 - RNA, 19 nt, Homo sapiens
ggaagggacacacaagaag

SEQ ID NO: 90557 - RNA, 19 nt, Homo sapiens
gcugggaguaguugucuuu

SEQ ID NO: 90558 - RNA, 19 nt, Homo sapiens
gccucuggcauuagaauua

SEQ ID NO: 90559 - RNA, 19 nt, Homo sapiens
cucuacaucuucugccuua

SEQ ID NO: 90560 - RNA, 19 nt, Homo sapiens
caaggagucagacauuuua

SEQ ID NO: 90561 - RNA, 19 nt, Homo sapiens
aacaaggagucagacauuu

SEQ ID NO: 90562 - RNA, 19 nt, Homo sapiens
uaagagugcugggcauuuu

SEQ ID NO: 90563 - RNA, 19 nt, Homo sapiens
ggaacaaggagucagacau

SEQ ID NO: 90564 - RNA, 19 nt, Homo sapiens
acuaggcgguugaaugaga

SEQ ID NO: 90565 - RNA, 19 nt, Homo sapiens
guacccuccuggcucuuga

SEQ ID NO: 90566 - RNA, 19 nt, Homo sapiens
cagaccagcaugacagauu

SEQ ID NO: 90567 - RNA, 19 nt, Homo sapiens
gagcccgucucaguguuga

SEQ ID NO: 90568 - RNA, 19 nt, Homo sapiens
ccaagaggaagcccuaauc

SEQ ID NO: 90569 - RNA, 19 nt, Homo sapiens
uuaagaugguggcaguaga

SEQ ID NO: 90570 - RNA, 19 nt, Homo sapiens
ccucuggcauuagaauuau

SEQ ID NO: 90571 - RNA, 19 nt, Homo sapiens
ggugcucaauaaaugauuc

SEQ ID NO: 90572 - RNA, 19 nt, Homo sapiens
ggaccacacccuguacugu

SEQ ID NO: 90573 - RNA, 19 nt, Homo sapiens
uuccagcuccuguaacaua

SEQ ID NO: 90574 - RNA, 19 nt, Homo sapiens
gggaguaguugucuuuccu

SEQ ID NO: 90575 - RNA, 19 nt, Homo sapiens
cagcaugacagauuucuac

SEQ ID NO: 90576 - RNA, 19 nt, Homo sapiens
gaccugucacugucuugua

SEQ ID NO: 90577 - RNA, 19 nt, Homo sapiens
uuugagaaguaaacagaug

SEQ ID NO: 90578 - RNA, 19 nt, Homo sapiens
cauuugagaaguaaacaga

SEQ ID NO: 90579 - RNA, 19 nt, Homo sapiens
ucacaggcgguuaugaaau

SEQ ID NO: 90580 - RNA, 19 nt, Homo sapiens
ugucacaggcgguuaugaa

SEQ ID NO: 90581 - RNA, 19 nt, Homo sapiens
aaacaccuccucauguaca

SEQ ID NO: 90582 - RNA, 19 nt, Homo sapiens
cagcagaggaagaccaugu

SEQ ID NO: 90583 - RNA, 19 nt, Homo sapiens
ccagcugggcucugcaauu

SEQ ID NO: 90584 - RNA, 19 nt, Homo sapiens
gggagcccgucucaguguu

SEQ ID NO: 90585 - RNA, 19 nt, Homo sapiens
ugaaugagagguuccuaag

SEQ ID NO: 90586 - RNA, 19 nt, Homo sapiens
ggagucagacauuuuaaga

SEQ ID NO: 90587 - RNA, 19 nt, Homo sapiens
caaaucguccagcgaccuu

SEQ ID NO: 90588 - RNA, 19 nt, Homo sapiens
gaagccugcaguccuggaa

SEQ ID NO: 90589 - RNA, 19 nt, Homo sapiens
ccuuccagcuccuguaaca

SEQ ID NO: 90590 - RNA, 19 nt, Homo sapiens
caugccacgugggcucaua

SEQ ID NO: 90591 - RNA, 19 nt, Homo sapiens
cuaagagugcugggcauuu

SEQ ID NO: 90592 - RNA, 19 nt, Homo sapiens
cauguggaccugucacugu

SEQ ID NO: 90593 - RNA, 19 nt, Homo sapiens
uaaacagauggcacuuuga

SEQ ID NO: 90594 - RNA, 19 nt, Homo sapiens
uuuaaacaccuccucaugu

SEQ ID NO: 90595 - RNA, 19 nt, Homo sapiens
agucagacauuuuaagaug

SEQ ID NO: 90596 - RNA, 19 nt, Homo sapiens
ggagcccgucucaguguug

SEQ ID NO: 90597 - RNA, 19 nt, Homo sapiens
gucacaggcgguuaugaaa

SEQ ID NO: 90598 - RNA, 19 nt, Homo sapiens
ccuaauccgcccacaggaa

SEQ ID NO: 90599 - RNA, 19 nt, Homo sapiens
ucucaguuugugugucuua

SEQ ID NO: 90600 - RNA, 19 nt, Homo sapiens
ccaccuagacuguaaaccu

SEQ ID NO: 90601 - RNA, 19 nt, Homo sapiens
caccuuccagcuccuguaa

SEQ ID NO: 90602 - RNA, 19 nt, Homo sapiens
uaagaugguggcaguagag

SEQ ID NO: 90603 - RNA, 19 nt, Homo sapiens
gaauggacauccuguauaa

SEQ ID NO: 90604 - RNA, 19 nt, Homo sapiens
uaaaugaucugccucuaaa

SEQ ID NO: 90605 - RNA, 19 nt, Homo sapiens
guaaacagcucgaauuaag

SEQ ID NO: 90606 - RNA, 19 nt, Homo sapiens
ggaaggguuugaauuguuu

SEQ ID NO: 90607 - RNA, 19 nt, Homo sapiens
ggagaaagaugucaaacgu

SEQ ID NO: 90608 - RNA, 19 nt, Homo sapiens
gaacacuggcuaaagauaa

SEQ ID NO: 90609 - RNA, 19 nt, Homo sapiens
caaggaagauauacaugaa

SEQ ID NO: 90610 - RNA, 19 nt, Homo sapiens
gaagguucauguagagaaa

SEQ ID NO: 90611 - RNA, 19 nt, Homo sapiens
gcaaguggaauuucgauuu

SEQ ID NO: 90612 - RNA, 19 nt, Homo sapiens
caagaagccuggccucaga

SEQ ID NO: 90613 - RNA, 19 nt, Homo sapiens
gagaagcacugcagagaca

SEQ ID NO: 90614 - RNA, 19 nt, Homo sapiens
ggaauggacauccuguaua

SEQ ID NO: 90615 - RNA, 19 nt, Homo sapiens
gcaaggaagauauacauga

SEQ ID NO: 90616 - RNA, 19 nt, Homo sapiens
gggaaggguuugaauuguu

SEQ ID NO: 90617 - RNA, 19 nt, Homo sapiens
aaaggaagguucauguaga

SEQ ID NO: 90618 - RNA, 19 nt, Homo sapiens
caagcuaucuaaaguuugu

SEQ ID NO: 90619 - RNA, 19 nt, Homo sapiens
gaagagcuugcuuugauuu

SEQ ID NO: 90620 - RNA, 19 nt, Homo sapiens
aaagcacacuuguaggaua

SEQ ID NO: 90621 - RNA, 19 nt, Homo sapiens
cagcugauacuucauuuaa

SEQ ID NO: 90622 - RNA, 19 nt, Homo sapiens
uaagugaaauggauacuac

SEQ ID NO: 90623 - RNA, 19 nt, Homo sapiens
agagacagcugauacuuca

SEQ ID NO: 90624 - RNA, 19 nt, Homo sapiens
caacaacacaauaacacua

SEQ ID NO: 90625 - RNA, 19 nt, Homo sapiens
ggagcaaugcgcaggaaua

SEQ ID NO: 90626 - RNA, 19 nt, Homo sapiens
acauaucgcugacuucaug

SEQ ID NO: 90627 - RNA, 19 nt, Homo sapiens
gagcaaugcgcaggaauaa

SEQ ID NO: 90628 - RNA, 19 nt, Homo sapiens
cccaagcuaucuaaaguuu

SEQ ID NO: 90629 - RNA, 19 nt, Homo sapiens
cagcucgaauuaagaauau

SEQ ID NO: 90630 - RNA, 19 nt, Homo sapiens
ugaaauggauacuacaucu

SEQ ID NO: 90631 - RNA, 19 nt, Homo sapiens
uguacuaccuguguauaua

SEQ ID NO: 90632 - RNA, 19 nt, Homo sapiens
aagcacacuuguaggauaa

SEQ ID NO: 90633 - RNA, 19 nt, Homo sapiens
ugaagagcuugcuuugauu

SEQ ID NO: 90634 - RNA, 19 nt, Homo sapiens
gcaaugcgcaggaauaagg

SEQ ID NO: 90635 - RNA, 19 nt, Homo sapiens
gaaguuuauucucauuugg

SEQ ID NO: 90636 - RNA, 19 nt, Homo sapiens
gagcuugcuuugauuuaca

SEQ ID NO: 90637 - RNA, 19 nt, Homo sapiens
aaacagcucgaauuaagaa

SEQ ID NO: 90638 - RNA, 19 nt, Homo sapiens
uaggauaagugaaauggau

SEQ ID NO: 90639 - RNA, 19 nt, Homo sapiens
cccagucucucuuaaaguu

SEQ ID NO: 90640 - RNA, 19 nt, Homo sapiens
ggcuaaagauaauugcuau

SEQ ID NO: 90641 - RNA, 19 nt, Homo sapiens
ccacaggaaaguguuauuu

SEQ ID NO: 90642 - RNA, 19 nt, Homo sapiens
gacagcugauacuucauuu

SEQ ID NO: 90643 - RNA, 19 nt, Homo sapiens
augaagagcuugcuuugau

SEQ ID NO: 90644 - RNA, 19 nt, Homo sapiens
cuaccuguguauauaguuu

SEQ ID NO: 90645 - RNA, 19 nt, Homo sapiens
caaguggaauuucgauuuu

SEQ ID NO: 90646 - RNA, 19 nt, Homo sapiens
ggaagguucauguagagaa

SEQ ID NO: 90647 - RNA, 19 nt, Homo sapiens
gcaugaagagaagcaauuu

SEQ ID NO: 90648 - RNA, 19 nt, Homo sapiens
caacagaacagaagaaaau

SEQ ID NO: 90649 - RNA, 19 nt, Homo sapiens
gguaugaagagcuugcuuu

SEQ ID NO: 90650 - RNA, 19 nt, Homo sapiens
cgacgauucuucuacucaa

SEQ ID NO: 90651 - RNA, 19 nt, Homo sapiens
gaaaagcacacuuguagga

SEQ ID NO: 90652 - RNA, 19 nt, Homo sapiens
ggugaucacuccagguagu

SEQ ID NO: 90653 - RNA, 19 nt, Homo sapiens
uuugaacacuggcuaaaga

SEQ ID NO: 90654 - RNA, 19 nt, Homo sapiens
guaaugucccuuucagaga

SEQ ID NO: 90655 - RNA, 19 nt, Homo sapiens
guauuucauugccugugua

SEQ ID NO: 90656 - RNA, 19 nt, Homo sapiens
gaaauggauacuacaucuu

SEQ ID NO: 90657 - RNA, 19 nt, Homo sapiens
uaaaggaagguucauguag

SEQ ID NO: 90658 - RNA, 19 nt, Homo sapiens
guuaagaauugaccaucug

SEQ ID NO: 90659 - RNA, 19 nt, Homo sapiens
agcguuggauguagcauua

SEQ ID NO: 90660 - RNA, 19 nt, Homo sapiens
aaauacauaucgcugacuu

SEQ ID NO: 90661 - RNA, 19 nt, Homo sapiens
gacgauucuucuacucaaa

SEQ ID NO: 90662 - RNA, 19 nt, Homo sapiens
caauauacaagccaaagug

SEQ ID NO: 90663 - RNA, 19 nt, Homo sapiens
gauguaaugucccuuucag

SEQ ID NO: 90664 - RNA, 19 nt, Homo sapiens
ugacuugcaugaagagaag

SEQ ID NO: 90665 - RNA, 19 nt, Homo sapiens
gaugaagcaaggaagauau

SEQ ID NO: 90666 - RNA, 19 nt, Homo sapiens
gagaaaagcacacuuguag

SEQ ID NO: 90667 - RNA, 19 nt, Homo sapiens
guuggaauuuaccaguuaa

SEQ ID NO: 90668 - RNA, 19 nt, Homo sapiens
aguuggaauuuaccaguua

SEQ ID NO: 90669 - RNA, 19 nt, Homo sapiens
cuggugaucucccaagcua

SEQ ID NO: 90670 - RNA, 19 nt, Homo sapiens
uuaaaugaucugccucuaa

SEQ ID NO: 90671 - RNA, 19 nt, Homo sapiens
gcacugcagagacauggaa

SEQ ID NO: 90672 - RNA, 19 nt, Homo sapiens
guuaauuacucagcagaau

SEQ ID NO: 90673 - RNA, 19 nt, Homo sapiens
gaucucccaagcuaucuaa

SEQ ID NO: 90674 - RNA, 19 nt, Homo sapiens
caaacgugcgagugucuaa

SEQ ID NO: 90675 - RNA, 19 nt, Homo sapiens
ccgaggugcuugggaguuu

SEQ ID NO: 90676 - RNA, 19 nt, Homo sapiens
gaagcaaggaagauauaca

SEQ ID NO: 90677 - RNA, 19 nt, Homo sapiens
gcagcuugcccgaguucua

SEQ ID NO: 90678 - RNA, 19 nt, Homo sapiens
uuaaaggaagguucaugua

SEQ ID NO: 90679 - RNA, 19 nt, Homo sapiens
agaauugaccaucugcuuu

SEQ ID NO: 90680 - RNA, 19 nt, Homo sapiens
acagaaaccuauccucacu

SEQ ID NO: 90681 - RNA, 19 nt, Homo sapiens
gauagcugcauguggcuuu

SEQ ID NO: 90682 - RNA, 19 nt, Homo sapiens
caaaagagccaacagaaca

SEQ ID NO: 90683 - RNA, 19 nt, Homo sapiens
agcuuacucuguccauuua

SEQ ID NO: 90684 - RNA, 19 nt, Homo sapiens
guaugaagagcuugcuuug

SEQ ID NO: 90685 - RNA, 19 nt, Homo sapiens
gcaaguacgaguggcaaga

SEQ ID NO: 90686 - RNA, 19 nt, Homo sapiens
gaauugaccaucugcuuuu

SEQ ID NO: 90687 - RNA, 19 nt, Homo sapiens
aauucuaaaucccucgaua

SEQ ID NO: 90688 - RNA, 19 nt, Homo sapiens
ugaacacuggcuaaagaua

SEQ ID NO: 90689 - RNA, 19 nt, Homo sapiens
agacagcugauacuucauu

SEQ ID NO: 90690 - RNA, 19 nt, Homo sapiens
uaaacagcucgaauuaaga

SEQ ID NO: 90691 - RNA, 19 nt, Homo sapiens
aagcuuacucuguccauuu

SEQ ID NO: 90692 - RNA, 19 nt, Homo sapiens
cuuauuugcuucauuguac

SEQ ID NO: 90693 - RNA, 19 nt, Homo sapiens
acguaaacagcucgaauua

SEQ ID NO: 90694 - RNA, 19 nt, Homo sapiens
uuaaaagguugcauacuga

SEQ ID NO: 90695 - RNA, 19 nt, Homo sapiens
guacuaccuguguauauag

SEQ ID NO: 90696 - RNA, 19 nt, Homo sapiens
aaagaaaacuuccauagcu

SEQ ID NO: 90697 - RNA, 19 nt, Homo sapiens
guccauuuauccacaggaa

SEQ ID NO: 90698 - RNA, 19 nt, Homo sapiens
gaccaucugcuuuuauuaa

SEQ ID NO: 90699 - RNA, 19 nt, Homo sapiens
uauuugacuugcaugaaga

SEQ ID NO: 90700 - RNA, 19 nt, Homo sapiens
ucgcugacuucauggaaug

SEQ ID NO: 90701 - RNA, 19 nt, Homo sapiens
ugaugaagcaaggaagaua

SEQ ID NO: 90702 - RNA, 19 nt, Homo sapiens
acagcucgaauuaagaaua

SEQ ID NO: 90703 - RNA, 19 nt, Homo sapiens
gcagagcagcguucgguuu

SEQ ID NO: 90704 - RNA, 19 nt, Homo sapiens
cggagcagcugccuagugu

SEQ ID NO: 90705 - RNA, 19 nt, Homo sapiens
ccgcugggauuacgacuuc

SEQ ID NO: 90706 - RNA, 19 nt, Homo sapiens
ggccucugaucuccgauuu

SEQ ID NO: 90707 - RNA, 19 nt, Homo sapiens
ugaaaacugugcaauguau

SEQ ID NO: 90708 - RNA, 19 nt, Homo sapiens
aagguacacuggucccaaa

SEQ ID NO: 90709 - RNA, 19 nt, Homo sapiens
uguuuaaucucugcugaaa

SEQ ID NO: 90710 - RNA, 19 nt, Homo sapiens
uuuaaucucugcugaaacu

SEQ ID NO: 90711 - RNA, 19 nt, Homo sapiens
gcggugagccaauuuagag

SEQ ID NO: 90712 - RNA, 19 nt, Homo sapiens
ccucugaucuccgauuucu

SEQ ID NO: 90713 - RNA, 19 nt, Homo sapiens
caauuuagagcccaaagag

SEQ ID NO: 90714 - RNA, 19 nt, Homo sapiens
gaccuucccaguacuagug

SEQ ID NO: 90715 - RNA, 19 nt, Homo sapiens
gcugggaccguucauguag

SEQ ID NO: 90716 - RNA, 19 nt, Homo sapiens
gucccaaaguguaaagcuu

SEQ ID NO: 90717 - RNA, 19 nt, Homo sapiens
gcugcggugagccaauuua

SEQ ID NO: 90718 - RNA, 19 nt, Homo sapiens
ccaauuuagagcccaaaga

SEQ ID NO: 90719 - RNA, 19 nt, Homo sapiens
ucugaucuccgauuucuuc

SEQ ID NO: 90720 - RNA, 19 nt, Homo sapiens
gaacgccgaggaccagaac

SEQ ID NO: 90721 - RNA, 19 nt, Homo sapiens
gaagucgucgggcgauguc

SEQ ID NO: 90722 - RNA, 19 nt, Homo sapiens
ggcugggaccguucaugua

SEQ ID NO: 90723 - RNA, 19 nt, Homo sapiens
cagcugcacucggggauuu

SEQ ID NO: 90724 - RNA, 19 nt, Homo sapiens
aaacuuagaucaucaguca

SEQ ID NO: 90725 - RNA, 19 nt, Homo sapiens
aaacaccgcuucugccuuu

SEQ ID NO: 90726 - RNA, 19 nt, Homo sapiens
gaaccaaagcucaaauaaa

SEQ ID NO: 90727 - RNA, 19 nt, Homo sapiens
ccaacgcaccgaauaguua

SEQ ID NO: 90728 - RNA, 19 nt, Homo sapiens
gcuaagugcucggaguuaa

SEQ ID NO: 90729 - RNA, 19 nt, Homo sapiens
gcaaauggcagaaccaaag

SEQ ID NO: 90730 - RNA, 19 nt, Homo sapiens
agaaaccucgggaaacuua

SEQ ID NO: 90731 - RNA, 19 nt, Homo sapiens
uaagugcucggaguuaaua

SEQ ID NO: 90732 - RNA, 19 nt, Homo sapiens
cagaaccaaagcucaaaua

SEQ ID NO: 90733 - RNA, 19 nt, Homo sapiens
gagucacacugcuagcaaa

SEQ ID NO: 90734 - RNA, 19 nt, Homo sapiens
ugagaaaccucgggaaacu

SEQ ID NO: 90735 - RNA, 19 nt, Homo sapiens
ucacacugcuagcaaaugg

SEQ ID NO: 90736 - RNA, 19 nt, Homo sapiens
ggaaggucccucagacauc

SEQ ID NO: 90737 - RNA, 19 nt, Homo sapiens
agaaccaaagcucaaauaa

SEQ ID NO: 90738 - RNA, 19 nt, Homo sapiens
guuacuggcuucucuugag

SEQ ID NO: 90739 - RNA, 19 nt, Homo sapiens
uggcuucucuugagucaca

SEQ ID NO: 90740 - RNA, 19 nt, Homo sapiens
gcagaaccaaagcucaaau

SEQ ID NO: 90741 - RNA, 19 nt, Homo sapiens
cgggaaacuuagaucauca

SEQ ID NO: 90742 - RNA, 19 nt, Homo sapiens
ggaggccgauccaggucau

SEQ ID NO: 90743 - RNA, 19 nt, Homo sapiens
ccucagacauccccgauug

SEQ ID NO: 90744 - RNA, 19 nt, Homo sapiens
ccaccccgcuuucguaguu

SEQ ID NO: 90745 - RNA, 19 nt, Homo sapiens
ucgggaaacuuagaucauc

SEQ ID NO: 90746 - RNA, 19 nt, Homo sapiens
gagaaaccucgggaaacuu

SEQ ID NO: 90747 - RNA, 19 nt, Homo sapiens
gcccuaagcgcacauucau

SEQ ID NO: 90748 - RNA, 19 nt, Homo sapiens
gacuucaugacaagcauuu

SEQ ID NO: 90749 - RNA, 19 nt, Homo sapiens
ccccuugccuggaaagaua

SEQ ID NO: 90750 - RNA, 19 nt, Homo sapiens
ucugagaaaccucgggaaa

SEQ ID NO: 90751 - RNA, 19 nt, Homo sapiens
uuacuggcuucucuugagu

SEQ ID NO: 90752 - RNA, 19 nt, Homo sapiens
caacgcaccgaauaguuac

SEQ ID NO: 90753 - RNA, 19 nt, Homo sapiens
gugccacauucgcuaagug

SEQ ID NO: 90754 - RNA, 19 nt, Homo sapiens
aaacuuagaucaucaguca

SEQ ID NO: 90755 - RNA, 19 nt, Homo sapiens
aaacaccgcuucugccuuu

SEQ ID NO: 90756 - RNA, 19 nt, Homo sapiens
gaaccaaagcucaaauaaa

SEQ ID NO: 90757 - RNA, 19 nt, Homo sapiens
gcaaauggcagaaccaaag

SEQ ID NO: 90758 - RNA, 19 nt, Homo sapiens
agaaaccucgggaaacuua

SEQ ID NO: 90759 - RNA, 19 nt, Homo sapiens
cagaaccaaagcucaaaua

SEQ ID NO: 90760 - RNA, 19 nt, Homo sapiens
gagucacacugcuagcaaa

SEQ ID NO: 90761 - RNA, 19 nt, Homo sapiens
ugagaaaccucgggaaacu

SEQ ID NO: 90762 - RNA, 19 nt, Homo sapiens
ucacacugcuagcaaaugg

SEQ ID NO: 90763 - RNA, 19 nt, Homo sapiens
ggaaggucccucagacauc

SEQ ID NO: 90764 - RNA, 19 nt, Homo sapiens
ucagagccguuccgagauc

SEQ ID NO: 90765 - RNA, 19 nt, Homo sapiens
cagcagccgcuuccuagaa

SEQ ID NO: 90766 - RNA, 19 nt, Homo sapiens
agaaccaaagcucaaauaa

SEQ ID NO: 90767 - RNA, 19 nt, Homo sapiens
guuacuggcuucucuugag

SEQ ID NO: 90768 - RNA, 19 nt, Homo sapiens
uggcuucucuugagucaca

SEQ ID NO: 90769 - RNA, 19 nt, Homo sapiens
gcagaaccaaagcucaaau

SEQ ID NO: 90770 - RNA, 19 nt, Homo sapiens
cgggaaacuuagaucauca

SEQ ID NO: 90771 - RNA, 19 nt, Homo sapiens
ggucccagucugcaguuaa

SEQ ID NO: 90772 - RNA, 19 nt, Homo sapiens
ccucagacauccccgauug

SEQ ID NO: 90773 - RNA, 19 nt, Homo sapiens
ccaccccgcuuucguaguu

SEQ ID NO: 90774 - RNA, 19 nt, Homo sapiens
ucgggaaacuuagaucauc

SEQ ID NO: 90775 - RNA, 19 nt, Homo sapiens
gagaaaccucgggaaacuu

SEQ ID NO: 90776 - RNA, 19 nt, Homo sapiens
gcccuaagcgcacauucau

SEQ ID NO: 90777 - RNA, 19 nt, Homo sapiens
gacuucaugacaagcauuu

SEQ ID NO: 90778 - RNA, 19 nt, Homo sapiens
ucugagaaaccucgggaaa

SEQ ID NO: 90779 - RNA, 19 nt, Homo sapiens
uuacuggcuucucuugagu

SEQ ID NO: 90780 - RNA, 19 nt, Homo sapiens
gcagcagccgcuuccuaga

SEQ ID NO: 90781 - RNA, 19 nt, Homo sapiens
aaacuuagaucaucaguca

SEQ ID NO: 90782 - RNA, 19 nt, Homo sapiens
aaacaccgcuucugccuuu

SEQ ID NO: 90783 - RNA, 19 nt, Homo sapiens
gaaccaaagcucaaauaaa

SEQ ID NO: 90784 - RNA, 19 nt, Homo sapiens
gcaaauggcagaaccaaag

SEQ ID NO: 90785 - RNA, 19 nt, Homo sapiens
agaaaccucgggaaacuua

SEQ ID NO: 90786 - RNA, 19 nt, Homo sapiens
cagaaccaaagcucaaaua

SEQ ID NO: 90787 - RNA, 19 nt, Homo sapiens
gagucacacugcuagcaaa

SEQ ID NO: 90788 - RNA, 19 nt, Homo sapiens
ugagaaaccucgggaaacu

SEQ ID NO: 90789 - RNA, 19 nt, Homo sapiens
ucacacugcuagcaaaugg

SEQ ID NO: 90790 - RNA, 19 nt, Homo sapiens
ggaaggucccucagacauc

SEQ ID NO: 90791 - RNA, 19 nt, Homo sapiens
agaaccaaagcucaaauaa

SEQ ID NO: 90792 - RNA, 19 nt, Homo sapiens
guuacuggcuucucuugag

SEQ ID NO: 90793 - RNA, 19 nt, Homo sapiens
uggcuucucuugagucaca

SEQ ID NO: 90794 - RNA, 19 nt, Homo sapiens
gcagaaccaaagcucaaau

SEQ ID NO: 90795 - RNA, 19 nt, Homo sapiens
cgggaaacuuagaucauca

SEQ ID NO: 90796 - RNA, 19 nt, Homo sapiens
ugaccauucuguucucucu

SEQ ID NO: 90797 - RNA, 19 nt, Homo sapiens
ccucagacauccccgauug

SEQ ID NO: 90798 - RNA, 19 nt, Homo sapiens
gcucugaccauucuguucu

SEQ ID NO: 90799 - RNA, 19 nt, Homo sapiens
cacccuggcucugaccauu

SEQ ID NO: 90800 - RNA, 19 nt, Homo sapiens
ccaccccgcuuucguaguu

SEQ ID NO: 90801 - RNA, 19 nt, Homo sapiens
ucgggaaacuuagaucauc

SEQ ID NO: 90802 - RNA, 19 nt, Homo sapiens
gagaaaccucgggaaacuu

SEQ ID NO: 90803 - RNA, 19 nt, Homo sapiens
gcccuaagcgcacauucau

SEQ ID NO: 90804 - RNA, 19 nt, Homo sapiens
aagcuuccuuuccgucaug

SEQ ID NO: 90805 - RNA, 19 nt, Homo sapiens
gacuucaugacaagcauuu

SEQ ID NO: 90806 - RNA, 19 nt, Homo sapiens
ucugagaaaccucgggaaa

SEQ ID NO: 90807 - RNA, 19 nt, Homo sapiens
uuacuggcuucucuugagu

SEQ ID NO: 90808 - RNA, 19 nt, Homo sapiens
caagcuuccuuuccgucau

SEQ ID NO: 90809 - RNA, 19 nt, Homo sapiens
gaacuuagaucaucaguca

SEQ ID NO: 90810 - RNA, 19 nt, Homo sapiens
guacagaucucucgaaugc

SEQ ID NO: 90811 - RNA, 19 nt, Homo sapiens
aaacaccgcuucugccuuu

SEQ ID NO: 90812 - RNA, 19 nt, Homo sapiens
gaaccaaagcucaaauaaa

SEQ ID NO: 90813 - RNA, 19 nt, Homo sapiens
ccaacgcaccgaauaguua

SEQ ID NO: 90814 - RNA, 19 nt, Homo sapiens
gcuaagugcucggaguuaa

SEQ ID NO: 90815 - RNA, 19 nt, Homo sapiens
gcaaauggcagaaccaaag

SEQ ID NO: 90816 - RNA, 19 nt, Homo sapiens
ugagaaaccucgggaacuu

SEQ ID NO: 90817 - RNA, 19 nt, Homo sapiens
gggaacauauuuguauuag

SEQ ID NO: 90818 - RNA, 19 nt, Homo sapiens
gagaaaccucgggaacuua

SEQ ID NO: 90819 - RNA, 19 nt, Homo sapiens
uaagugcucggaguuaaua

SEQ ID NO: 90820 - RNA, 19 nt, Homo sapiens
cagaaccaaagcucaaaua

SEQ ID NO: 90821 - RNA, 19 nt, Homo sapiens
gagucacacugcuagcaaa

SEQ ID NO: 90822 - RNA, 19 nt, Homo sapiens
ggaaaccaaggaagaggaa

SEQ ID NO: 90823 - RNA, 19 nt, Homo sapiens
ucacacugcuagcaaaugg

SEQ ID NO: 90824 - RNA, 19 nt, Homo sapiens
gcguacagaucucucgaau

SEQ ID NO: 90825 - RNA, 19 nt, Homo sapiens
ucagguagcgcuucgauuc

SEQ ID NO: 90826 - RNA, 19 nt, Homo sapiens
ggaaggucccucagacauc

SEQ ID NO: 90827 - RNA, 19 nt, Homo sapiens
agaaccaaagcucaaauaa

SEQ ID NO: 90828 - RNA, 19 nt, Homo sapiens
guuacuggcuucucuugag

SEQ ID NO: 90829 - RNA, 19 nt, Homo sapiens
uguauuagauggaagucau

SEQ ID NO: 90830 - RNA, 19 nt, Homo sapiens
uggcuucucuugagucaca

SEQ ID NO: 90831 - RNA, 19 nt, Homo sapiens
gcagaaccaaagcucaaau

SEQ ID NO: 90832 - RNA, 19 nt, Homo sapiens
ccucagacauccccgauug

SEQ ID NO: 90833 - RNA, 19 nt, Homo sapiens
gaagggguuuguaaucaca

SEQ ID NO: 90834 - RNA, 19 nt, Homo sapiens
cagaagggguuuguaauca

SEQ ID NO: 90835 - RNA, 19 nt, Homo sapiens
ccaccccgcuuucguaguu

SEQ ID NO: 90836 - RNA, 19 nt, Homo sapiens
gcccuaagcgcacauucau

SEQ ID NO: 90837 - RNA, 19 nt, Homo sapiens
uuagauggaagucaugaug

SEQ ID NO: 90838 - RNA, 19 nt, Homo sapiens
ggggaacauauuuguauua

SEQ ID NO: 90839 - RNA, 19 nt, Homo sapiens
gagccacgcgcguacagau

SEQ ID NO: 90840 - RNA, 19 nt, Homo sapiens
aaaccaaggaagaggaaug

SEQ ID NO: 90841 - RNA, 19 nt, Homo sapiens
gacuucaugacaagcauuu

SEQ ID NO: 90842 - RNA, 19 nt, Homo sapiens
ccccuugccuggaaagaua

SEQ ID NO: 90843 - RNA, 19 nt, Homo sapiens
uuacuggcuucucuugagu

SEQ ID NO: 90844 - RNA, 19 nt, Homo sapiens
caacgcaccgaauaguuac

SEQ ID NO: 90845 - RNA, 19 nt, Homo sapiens
gaaaccucgggaacuuaga

SEQ ID NO: 90846 - RNA, 19 nt, Homo sapiens
gugccacauucgcuaagug

SEQ ID NO: 90847 - RNA, 19 nt, Homo sapiens
gaaguuugcaggggaauug

SEQ ID NO: 90848 - RNA, 19 nt, Homo sapiens
gaagauagaugcacuuaug

SEQ ID NO: 90849 - RNA, 19 nt, Homo sapiens
gcacuuaugcaguaaauua

SEQ ID NO: 90850 - RNA, 19 nt, Homo sapiens
gcaacugucuuauuuaaug

SEQ ID NO: 90851 - RNA, 19 nt, Homo sapiens
cuagauugcuuucuucuua

SEQ ID NO: 90852 - RNA, 19 nt, Homo sapiens
ggaagagugucguuaaguu

SEQ ID NO: 90853 - RNA, 19 nt, Homo sapiens
cagcaacugucuuauuuaa

SEQ ID NO: 90854 - RNA, 19 nt, Homo sapiens
gaauaaccuuccauacauu

SEQ ID NO: 90855 - RNA, 19 nt, Homo sapiens
caggguugcuugaucauua

SEQ ID NO: 90856 - RNA, 19 nt, Homo sapiens
gaggucagacuaagaaaua

SEQ ID NO: 90857 - RNA, 19 nt, Homo sapiens
gaacuacagcucuuaaaug

SEQ ID NO: 90858 - RNA, 19 nt, Homo sapiens
ggagugagagcaauuguaa

SEQ ID NO: 90859 - RNA, 19 nt, Homo sapiens
gcucuuaaauguagcaaug

SEQ ID NO: 90860 - RNA, 19 nt, Homo sapiens
gcaauaccagcaauucaua

SEQ ID NO: 90861 - RNA, 19 nt, Homo sapiens
gaagagugucguuaaguuu

SEQ ID NO: 90862 - RNA, 19 nt, Homo sapiens
guucauggguuuaccacua

SEQ ID NO: 90863 - RNA, 19 nt, Homo sapiens
gaggugggcuucaguaagu

SEQ ID NO: 90864 - RNA, 19 nt, Homo sapiens
gagggaaagugcauaugaa

SEQ ID NO: 90865 - RNA, 19 nt, Homo sapiens
gcacugcuuugggauuuaa

SEQ ID NO: 90866 - RNA, 19 nt, Homo sapiens
ggaaagugcauaugaaauc

SEQ ID NO: 90867 - RNA, 19 nt, Homo sapiens
gcagaggucagacuaagaa

SEQ ID NO: 90868 - RNA, 19 nt, Homo sapiens
gaaauccccuuaugacuug

SEQ ID NO: 90869 - RNA, 19 nt, Homo sapiens
cuacgaaucuuccgaugga

SEQ ID NO: 90870 - RNA, 19 nt, Homo sapiens
ggaaagaagggaagagugu

SEQ ID NO: 90871 - RNA, 19 nt, Homo sapiens
ccuuaugacuugcuacuuu

SEQ ID NO: 90872 - RNA, 19 nt, Homo sapiens
gaagggaagagugucguua

SEQ ID NO: 90873 - RNA, 19 nt, Homo sapiens
uccaagagguggguaauuu

SEQ ID NO: 90874 - RNA, 19 nt, Homo sapiens
acuaguggcucucaguuaa

SEQ ID NO: 90875 - RNA, 19 nt, Homo sapiens
ggauuuccagggauauuua

SEQ ID NO: 90876 - RNA, 19 nt, Homo sapiens
cacaaaguguauacaugua

SEQ ID NO: 90877 - RNA, 19 nt, Homo sapiens
gagcccaggucuccuagga

SEQ ID NO: 90878 - RNA, 19 nt, Homo sapiens
uucagcaacugucuuauuu

SEQ ID NO: 90879 - RNA, 19 nt, Homo sapiens
gagaaauguuaaagguuca

SEQ ID NO: 90880 - RNA, 19 nt, Homo sapiens
acugauacuucacuacuuu

SEQ ID NO: 90881 - RNA, 19 nt, Homo sapiens
uggaacaacugauacuuca

SEQ ID NO: 90882 - RNA, 19 nt, Homo sapiens
gugcacugcuuugggauuu

SEQ ID NO: 90883 - RNA, 19 nt, Homo sapiens
gguaagagaggaugugcaa

SEQ ID NO: 90884 - RNA, 19 nt, Homo sapiens
gcugaggaguuauggugaa

SEQ ID NO: 90885 - RNA, 19 nt, Homo sapiens
gcccacaacgacuuuauuu

SEQ ID NO: 90886 - RNA, 19 nt, Homo sapiens
gaacaacugauacuucacu

SEQ ID NO: 90887 - RNA, 19 nt, Homo sapiens
ccucgacacucaccaugaa

SEQ ID NO: 90888 - RNA, 19 nt, Homo sapiens
aacuacagcucuuaaaugu

SEQ ID NO: 90889 - RNA, 19 nt, Homo sapiens
aagcggauuuccagggaua

SEQ ID NO: 90890 - RNA, 19 nt, Homo sapiens
ccugagaaauguuaaaggu

SEQ ID NO: 90891 - RNA, 19 nt, Homo sapiens
gcaagucacaugcguaaac

SEQ ID NO: 90892 - RNA, 19 nt, Homo sapiens
aagagugucguuaaguuua

SEQ ID NO: 90893 - RNA, 19 nt, Homo sapiens
guucagcaacugucuuauu

SEQ ID NO: 90894 - RNA, 19 nt, Homo sapiens
uaaacgacacucucuggaa

SEQ ID NO: 90895 - RNA, 19 nt, Homo sapiens
ccugaagacugaggacaaa

SEQ ID NO: 90896 - RNA, 19 nt, Homo sapiens
gaaagugcauaugaaaucc

SEQ ID NO: 90897 - RNA, 19 nt, Homo sapiens
ugagggaaagugcauauga

SEQ ID NO: 90898 - RNA, 19 nt, Homo sapiens
cauaagcaauaccagcaau

SEQ ID NO: 90899 - RNA, 19 nt, Homo sapiens
ggagcagcgugggaaagaa

SEQ ID NO: 90900 - RNA, 19 nt, Homo sapiens
caauggcacuguugcaaac

SEQ ID NO: 90901 - RNA, 19 nt, Homo sapiens
uagaagauagaugcacuua

SEQ ID NO: 90902 - RNA, 19 nt, Homo sapiens
caacugucuuauuuaaugg

SEQ ID NO: 90903 - RNA, 19 nt, Homo sapiens
uuacuacacugaggagaga

SEQ ID NO: 90904 - RNA, 19 nt, Homo sapiens
gaagacugaggacaaagug

SEQ ID NO: 90905 - RNA, 19 nt, Homo sapiens
caauaccagcaauucauaa

SEQ ID NO: 90906 - RNA, 19 nt, Homo sapiens
gguggguaauuugguuuaa

SEQ ID NO: 90907 - RNA, 19 nt, Homo sapiens
cccaaaagauugcugaaaa

SEQ ID NO: 90908 - RNA, 19 nt, Homo sapiens
ggucagacuaagaaauauu

SEQ ID NO: 90909 - RNA, 19 nt, Homo sapiens
agagguggguaauuugguu

SEQ ID NO: 90910 - RNA, 19 nt, Homo sapiens
ucagcaacugucuuauuua

SEQ ID NO: 90911 - RNA, 19 nt, Homo sapiens
ggaaauccccuuaugacuu

SEQ ID NO: 90912 - RNA, 19 nt, Homo sapiens
gagcaccuuugcacaggau

SEQ ID NO: 90913 - RNA, 19 nt, Homo sapiens
accacuaacuccugagaaa

SEQ ID NO: 90914 - RNA, 19 nt, Homo sapiens
guggguaauuugguuuaaa

SEQ ID NO: 90915 - RNA, 19 nt, Homo sapiens
gcugaaaacggaauucuuu

SEQ ID NO: 90916 - RNA, 19 nt, Homo sapiens
ggaguggagugagagcaau

SEQ ID NO: 90917 - RNA, 19 nt, Homo sapiens
ggccuuugcucuuacuaca

SEQ ID NO: 90918 - RNA, 19 nt, Homo sapiens
aaugucugcugaggaguua

SEQ ID NO: 90919 - RNA, 19 nt, Homo sapiens
gggagaaggcagugauuag

SEQ ID NO: 90920 - RNA, 19 nt, Homo sapiens
ucccuucucucaauguuug

SEQ ID NO: 90921 - RNA, 19 nt, Homo sapiens
ccaagagguggguaauuug

SEQ ID NO: 90922 - RNA, 19 nt, Homo sapiens
caacugauacuucacuacu

SEQ ID NO: 90923 - RNA, 19 nt, Homo sapiens
gauguccuacuaucacuga

SEQ ID NO: 90924 - RNA, 19 nt, Homo sapiens
gugcagaggucagacuaag

SEQ ID NO: 90925 - RNA, 19 nt, Homo sapiens
augcuggccuuugcucuua

SEQ ID NO: 90926 - RNA, 19 nt, Homo sapiens
aggaaaaccugaagacuga

SEQ ID NO: 90927 - RNA, 19 nt, Homo sapiens
auggugaacccacaacuua

SEQ ID NO: 90928 - RNA, 19 nt, Homo sapiens
gagaaggcagugauuagca

SEQ ID NO: 90929 - RNA, 19 nt, Homo sapiens
cgaaucuuccgauggauga

SEQ ID NO: 90930 - RNA, 19 nt, Homo sapiens
gggaaagugcauaugaaau

SEQ ID NO: 90931 - RNA, 19 nt, Homo sapiens
gcuuucuucuuaaccuauu

SEQ ID NO: 90932 - RNA, 19 nt, Homo sapiens
guuaaaaugugaggaagaa

SEQ ID NO: 90933 - RNA, 19 nt, Homo sapiens
gacgacagaugcuaaaauc

SEQ ID NO: 90934 - RNA, 19 nt, Homo sapiens
gaagcgaaacacagagaag

SEQ ID NO: 90935 - RNA, 19 nt, Homo sapiens
ccaugaagcgaaacacaga

SEQ ID NO: 90936 - RNA, 19 nt, Homo sapiens
gcugagcccaggucuccua

SEQ ID NO: 90937 - RNA, 19 nt, Homo sapiens
uucauggguuuaccacuaa

SEQ ID NO: 90938 - RNA, 19 nt, Homo sapiens
cugauuguuuccuuuauag

SEQ ID NO: 90939 - RNA, 19 nt, Homo sapiens
gcacaggaugcuggccuuu

SEQ ID NO: 90940 - RNA, 19 nt, Homo sapiens
uggcaagucacaugcguaa

SEQ ID NO: 90941 - RNA, 19 nt, Homo sapiens
acgccuagauugcuuucuu

SEQ ID NO: 90942 - RNA, 19 nt, Homo sapiens
gugguggaguggagugaga

SEQ ID NO: 90943 - RNA, 19 nt, Homo sapiens
ccacaacgacuuuauuuuc

SEQ ID NO: 90944 - RNA, 19 nt, Homo sapiens
gugcauaugaaauccuuga

SEQ ID NO: 90945 - RNA, 19 nt, Homo sapiens
uaagcaauaccagcaauuc

SEQ ID NO: 90946 - RNA, 19 nt, Homo sapiens
aacuaaaggugcacugcuu

SEQ ID NO: 90947 - RNA, 19 nt, Homo sapiens
ucacugaacaaacuaaagg

SEQ ID NO: 90948 - RNA, 19 nt, Homo sapiens
gaagauagaugcacuuaug

SEQ ID NO: 90949 - RNA, 19 nt, Homo sapiens
gcacuuaugcaguaaauua

SEQ ID NO: 90950 - RNA, 19 nt, Homo sapiens
gcaacugucuuauuuaaug

SEQ ID NO: 90951 - RNA, 19 nt, Homo sapiens
cuagauugcuuucuucuua

SEQ ID NO: 90952 - RNA, 19 nt, Homo sapiens
ggaagagugucguuaaguu

SEQ ID NO: 90953 - RNA, 19 nt, Homo sapiens
cagcaacugucuuauuuaa

SEQ ID NO: 90954 - RNA, 19 nt, Homo sapiens
gaauaaccuuccauacauu

SEQ ID NO: 90955 - RNA, 19 nt, Homo sapiens
caggguugcuugaucauua

SEQ ID NO: 90956 - RNA, 19 nt, Homo sapiens
gaggucagacuaagaaaua

SEQ ID NO: 90957 - RNA, 19 nt, Homo sapiens
gaacuacagcucuuaaaug

SEQ ID NO: 90958 - RNA, 19 nt, Homo sapiens
ggagugagagcaauuguaa

SEQ ID NO: 90959 - RNA, 19 nt, Homo sapiens
gcucuuaaauguagcaaug

SEQ ID NO: 90960 - RNA, 19 nt, Homo sapiens
gcaauaccagcaauucaua

SEQ ID NO: 90961 - RNA, 19 nt, Homo sapiens
gaagagugucguuaaguuu

SEQ ID NO: 90962 - RNA, 19 nt, Homo sapiens
guucauggguuuaccacua

SEQ ID NO: 90963 - RNA, 19 nt, Homo sapiens
gaggugggcuucaguaagu

SEQ ID NO: 90964 - RNA, 19 nt, Homo sapiens
gagggaaagugcauaugaa

SEQ ID NO: 90965 - RNA, 19 nt, Homo sapiens
gcacugcuuugggauuuaa

SEQ ID NO: 90966 - RNA, 19 nt, Homo sapiens
ggaaagugcauaugaaauc

SEQ ID NO: 90967 - RNA, 19 nt, Homo sapiens
gcagaggucagacuaagaa

SEQ ID NO: 90968 - RNA, 19 nt, Homo sapiens
gaaauccccuuaugacuug

SEQ ID NO: 90969 - RNA, 19 nt, Homo sapiens
cuacgaaucuuccgaugga

SEQ ID NO: 90970 - RNA, 19 nt, Homo sapiens
ggaaagaagggaagagugu

SEQ ID NO: 90971 - RNA, 19 nt, Homo sapiens
ccuuaugacuugcuacuuu

SEQ ID NO: 90972 - RNA, 19 nt, Homo sapiens
gaagggaagagugucguua

SEQ ID NO: 90973 - RNA, 19 nt, Homo sapiens
uccaagagguggguaauuu

SEQ ID NO: 90974 - RNA, 19 nt, Homo sapiens
acuaguggcucucaguuaa

SEQ ID NO: 90975 - RNA, 19 nt, Homo sapiens
ggauuuccagggauauuua

SEQ ID NO: 90976 - RNA, 19 nt, Homo sapiens
cacaaaguguauacaugua

SEQ ID NO: 90977 - RNA, 19 nt, Homo sapiens
gagcccaggucuccuagga

SEQ ID NO: 90978 - RNA, 19 nt, Homo sapiens
uucagcaacugucuuauuu

SEQ ID NO: 90979 - RNA, 19 nt, Homo sapiens
gagaaauguuaaagguuca

SEQ ID NO: 90980 - RNA, 19 nt, Homo sapiens
acugauacuucacuacuuu

SEQ ID NO: 90981 - RNA, 19 nt, Homo sapiens
uggaacaacugauacuuca

SEQ ID NO: 90982 - RNA, 19 nt, Homo sapiens
gugcacugcuuugggauuu

SEQ ID NO: 90983 - RNA, 19 nt, Homo sapiens
gguaagagaggaugugcaa

SEQ ID NO: 90984 - RNA, 19 nt, Homo sapiens
gcugaggaguuauggugaa

SEQ ID NO: 90985 - RNA, 19 nt, Homo sapiens
gcccacaacgacuuuauuu

SEQ ID NO: 90986 - RNA, 19 nt, Homo sapiens
gaacaacugauacuucacu

SEQ ID NO: 90987 - RNA, 19 nt, Homo sapiens
ccucgacacucaccaugaa

SEQ ID NO: 90988 - RNA, 19 nt, Homo sapiens
aacuacagcucuuaaaugu

SEQ ID NO: 90989 - RNA, 19 nt, Homo sapiens
aagcggauuuccagggaua

SEQ ID NO: 90990 - RNA, 19 nt, Homo sapiens
ccugagaaauguuaaaggu

SEQ ID NO: 90991 - RNA, 19 nt, Homo sapiens
gcaagucacaugcguaaac

SEQ ID NO: 90992 - RNA, 19 nt, Homo sapiens
aagagugucguuaaguuua

SEQ ID NO: 90993 - RNA, 19 nt, Homo sapiens
guucagcaacugucuuauu

SEQ ID NO: 90994 - RNA, 19 nt, Homo sapiens
uaaacgacacucucuggaa

SEQ ID NO: 90995 - RNA, 19 nt, Homo sapiens
ccugaagacugaggacaaa

SEQ ID NO: 90996 - RNA, 19 nt, Homo sapiens
gaaagugcauaugaaaucc

SEQ ID NO: 90997 - RNA, 19 nt, Homo sapiens
ugagggaaagugcauauga

SEQ ID NO: 90998 - RNA, 19 nt, Homo sapiens
cauaagcaauaccagcaau

SEQ ID NO: 90999 - RNA, 19 nt, Homo sapiens
ggagcagcgugggaaagaa

SEQ ID NO: 91000 - RNA, 19 nt, Homo sapiens
caauggcacuguugcaaac

SEQ ID NO: 91001 - RNA, 19 nt, Homo sapiens
uagaagauagaugcacuua

SEQ ID NO: 91002 - RNA, 19 nt, Homo sapiens
caacugucuuauuuaaugg

SEQ ID NO: 91003 - RNA, 19 nt, Homo sapiens
uuacuacacugaggagaga

SEQ ID NO: 91004 - RNA, 19 nt, Homo sapiens
gaagacugaggacaaagug

SEQ ID NO: 91005 - RNA, 19 nt, Homo sapiens
caauaccagcaauucauaa

SEQ ID NO: 91006 - RNA, 19 nt, Homo sapiens
gguggguaauuugguuuaa

SEQ ID NO: 91007 - RNA, 19 nt, Homo sapiens
cccaaaagauugcugaaaa

SEQ ID NO: 91008 - RNA, 19 nt, Homo sapiens
ggucagacuaagaaauauu

SEQ ID NO: 91009 - RNA, 19 nt, Homo sapiens
agagguggguaauuugguu

SEQ ID NO: 91010 - RNA, 19 nt, Homo sapiens
ucagcaacugucuuauuua

SEQ ID NO: 91011 - RNA, 19 nt, Homo sapiens
ggaaauccccuuaugacuu

SEQ ID NO: 91012 - RNA, 19 nt, Homo sapiens
gagcaccuuugcacaggau

SEQ ID NO: 91013 - RNA, 19 nt, Homo sapiens
accacuaacuccugagaaa

SEQ ID NO: 91014 - RNA, 19 nt, Homo sapiens
guggguaauuugguuuaaa

SEQ ID NO: 91015 - RNA, 19 nt, Homo sapiens
gcugaaaacggaauucuuu

SEQ ID NO: 91016 - RNA, 19 nt, Homo sapiens
ggaguggagugagagcaau

SEQ ID NO: 91017 - RNA, 19 nt, Homo sapiens
ggccuuugcucuuacuaca

SEQ ID NO: 91018 - RNA, 19 nt, Homo sapiens
aaugucugcugaggaguua

SEQ ID NO: 91019 - RNA, 19 nt, Homo sapiens
gggagaaggcagugauuag

SEQ ID NO: 91020 - RNA, 19 nt, Homo sapiens
ucccuucucucaauguuug

SEQ ID NO: 91021 - RNA, 19 nt, Homo sapiens
ccaagagguggguaauuug

SEQ ID NO: 91022 - RNA, 19 nt, Homo sapiens
caacugauacuucacuacu

SEQ ID NO: 91023 - RNA, 19 nt, Homo sapiens
gauguccuacuaucacuga

SEQ ID NO: 91024 - RNA, 19 nt, Homo sapiens
gugcagaggucagacuaag

SEQ ID NO: 91025 - RNA, 19 nt, Homo sapiens
augcuggccuuugcucuua

SEQ ID NO: 91026 - RNA, 19 nt, Homo sapiens
aggaaaaccugaagacuga

SEQ ID NO: 91027 - RNA, 19 nt, Homo sapiens
auggugaacccacaacuua

SEQ ID NO: 91028 - RNA, 19 nt, Homo sapiens
ucgccgauguagauuugua

SEQ ID NO: 91029 - RNA, 19 nt, Homo sapiens
gagaaggcagugauuagca

SEQ ID NO: 91030 - RNA, 19 nt, Homo sapiens
cgaaucuuccgauggauga

SEQ ID NO: 91031 - RNA, 19 nt, Homo sapiens
gggaaagugcauaugaaau

SEQ ID NO: 91032 - RNA, 19 nt, Homo sapiens
gcuuucuucuuaaccuauu

SEQ ID NO: 91033 - RNA, 19 nt, Homo sapiens
guuaaaaugugaggaagaa

SEQ ID NO: 91034 - RNA, 19 nt, Homo sapiens
gacgacagaugcuaaaauc

SEQ ID NO: 91035 - RNA, 19 nt, Homo sapiens
gaagcgaaacacagagaag

SEQ ID NO: 91036 - RNA, 19 nt, Homo sapiens
ccaugaagcgaaacacaga

SEQ ID NO: 91037 - RNA, 19 nt, Homo sapiens
gcugagcccaggucuccua

SEQ ID NO: 91038 - RNA, 19 nt, Homo sapiens
uucauggguuuaccacuaa

SEQ ID NO: 91039 - RNA, 19 nt, Homo sapiens
cugauuguuuccuuuauag

SEQ ID NO: 91040 - RNA, 19 nt, Homo sapiens
gcacaggaugcuggccuuu

SEQ ID NO: 91041 - RNA, 19 nt, Homo sapiens
uggcaagucacaugcguaa

SEQ ID NO: 91042 - RNA, 19 nt, Homo sapiens
ccacaacgacuuuauuuuc

SEQ ID NO: 91043 - RNA, 19 nt, Homo sapiens
acgccuagauugcuuucuu

SEQ ID NO: 91044 - RNA, 19 nt, Homo sapiens
gugguggaguggagugaga

SEQ ID NO: 91045 - RNA, 19 nt, Homo sapiens
gugcauaugaaauccuuga

SEQ ID NO: 91046 - RNA, 19 nt, Homo sapiens
uaagcaauaccagcaauuc

SEQ ID NO: 91047 - RNA, 19 nt, Homo sapiens
aacuaaaggugcacugcuu

SEQ ID NO: 91048 - RNA, 19 nt, Homo sapiens
ccacaaaucuucaauaaac

SEQ ID NO: 91049 - RNA, 19 nt, Homo sapiens
gcagauaacuuugacuuuc

SEQ ID NO: 91050 - RNA, 19 nt, Homo sapiens
gaguagcucuccugacuuu

SEQ ID NO: 91051 - RNA, 19 nt, Homo sapiens
acaacaggcuuaugaauau

SEQ ID NO: 91052 - RNA, 19 nt, Homo sapiens
ggacaccgccugugauuug

SEQ ID NO: 91053 - RNA, 19 nt, Homo sapiens
caacaggcuuaugaauaua

SEQ ID NO: 91054 - RNA, 19 nt, Homo sapiens
gccaggagacugcuacuua

SEQ ID NO: 91055 - RNA, 19 nt, Homo sapiens
ccacguugccucuacuuua

SEQ ID NO: 91056 - RNA, 19 nt, Homo sapiens
uaacaucgaggauaaugaa

SEQ ID NO: 91057 - RNA, 19 nt, Homo sapiens
gccucuacuuuaucaauua

SEQ ID NO: 91058 - RNA, 19 nt, Homo sapiens
uacaacaggcuuaugaaua

SEQ ID NO: 91059 - RNA, 19 nt, Homo sapiens
agccacaaaucuucaauaa

SEQ ID NO: 91060 - RNA, 19 nt, Homo sapiens
agacuuugcuggaguuuca

SEQ ID NO: 91061 - RNA, 19 nt, Homo sapiens
caacagaagcagcaauugu

SEQ ID NO: 91062 - RNA, 19 nt, Homo sapiens
ugaaagaccgaacugguuu

SEQ ID NO: 91063 - RNA, 19 nt, Homo sapiens
gaacuuggccuacguuucc

SEQ ID NO: 91064 - RNA, 19 nt, Homo sapiens
gaaccugcccuugcacuug

SEQ ID NO: 91065 - RNA, 19 nt, Homo sapiens
guucuaacauguaauugca

SEQ ID NO: 91066 - RNA, 19 nt, Homo sapiens
gagccacaaaucuucaaua

SEQ ID NO: 91067 - RNA, 19 nt, Homo sapiens
gaacugguuucgcugucau

SEQ ID NO: 91068 - RNA, 19 nt, Homo sapiens
ccaggagacugcuacuuag

SEQ ID NO: 91069 - RNA, 19 nt, Homo sapiens
cacguugccucuacuuuau

SEQ ID NO: 91070 - RNA, 19 nt, Homo sapiens
gagcacugggcaaucguua

SEQ ID NO: 91071 - RNA, 19 nt, Homo sapiens
cagauaacuuugacuuucu

SEQ ID NO: 91072 - RNA, 19 nt, Homo sapiens
ugaaacugcauaagugaaa

SEQ ID NO: 91073 - RNA, 19 nt, Homo sapiens
gggaucagcuacaaaagaa

SEQ ID NO: 91074 - RNA, 19 nt, Homo sapiens
cggcgacucucccuacuca

SEQ ID NO: 91075 - RNA, 19 nt, Homo sapiens
ggcaacagaagcagcaauu

SEQ ID NO: 91076 - RNA, 19 nt, Homo sapiens
cgcgagagguggcaaagug

SEQ ID NO: 91077 - RNA, 19 nt, Homo sapiens
guagacgcuuuccgcauca

SEQ ID NO: 91078 - RNA, 19 nt, Homo sapiens
cugaguagcucuccugacu

SEQ ID NO: 91079 - RNA, 19 nt, Homo sapiens
ggaggaaugagguuguuag

SEQ ID NO: 91080 - RNA, 19 nt, Homo sapiens
acagaagcagcaauuguuu

SEQ ID NO: 91081 - RNA, 19 nt, Homo sapiens
gaccuagagcaacuuacua

SEQ ID NO: 91082 - RNA, 19 nt, Homo sapiens
aacuuugacuuucuucuga

SEQ ID NO: 91083 - RNA, 19 nt, Homo sapiens
caagggagggagugaagga

SEQ ID NO: 91084 - RNA, 19 nt, Homo sapiens
gcaacagaagcagcaauug

SEQ ID NO: 91085 - RNA, 19 nt, Homo sapiens
ggaccuagagcaacuuacu

SEQ ID NO: 91086 - RNA, 19 nt, Homo sapiens
guaauugcagauaacuuug

SEQ ID NO: 91087 - RNA, 19 nt, Homo sapiens
guuucaagcugauguuaac

SEQ ID NO: 91088 - RNA, 19 nt, Homo sapiens
gaguuucaagcugauguua

SEQ ID NO: 91089 - RNA, 19 nt, Homo sapiens
aaacgucaaugcacaaaau

SEQ ID NO: 91090 - RNA, 19 nt, Homo sapiens
ggcggcagcagcucaauga

SEQ ID NO: 91091 - RNA, 19 nt, Homo sapiens
gaaacugcauaagugaaaa

SEQ ID NO: 91092 - RNA, 19 nt, Homo sapiens
uaacuuugacuuucuucug

SEQ ID NO: 91093 - RNA, 19 nt, Homo sapiens
guagcucuccugacuuuua

SEQ ID NO: 91094 - RNA, 19 nt, Homo sapiens
gccacaaaucuucaauaaa

SEQ ID NO: 91095 - RNA, 19 nt, Homo sapiens
guaaacgucaaugcacaaa

SEQ ID NO: 91096 - RNA, 19 nt, Homo sapiens
gagggccaccgaacugcua

SEQ ID NO: 91097 - RNA, 19 nt, Homo sapiens
ggucguaggcgggaaguuc

SEQ ID NO: 91098 - RNA, 19 nt, Homo sapiens
gcgacucucccuacucaga

SEQ ID NO: 91099 - RNA, 19 nt, Homo sapiens
gaagcacacggccagcaau

SEQ ID NO: 91100 - RNA, 19 nt, Homo sapiens
agaagcagcaauuguuuca

SEQ ID NO: 91101 - RNA, 19 nt, Homo sapiens
gcuacucccguucgccuuu

SEQ ID NO: 91102 - RNA, 19 nt, Homo sapiens
cagcagaaagccugaacga

SEQ ID NO: 91103 - RNA, 19 nt, Homo sapiens
uaaaaugguuuguccugau

SEQ ID NO: 91104 - RNA, 19 nt, Homo sapiens
gggagggagugaaggaaaa

SEQ ID NO: 91105 - RNA, 19 nt, Homo sapiens
gggaggaaugagguuguua

SEQ ID NO: 91106 - RNA, 19 nt, Homo sapiens
ggaaccugcccuugcacuu

SEQ ID NO: 91107 - RNA, 19 nt, Homo sapiens
guuaugaaacuuggaaauc

SEQ ID NO: 91108 - RNA, 19 nt, Homo sapiens
ccuuaaaacucugccguua

SEQ ID NO: 91109 - RNA, 19 nt, Homo sapiens
ugccucuacuuuaucaauu

SEQ ID NO: 91110 - RNA, 19 nt, Homo sapiens
ggaguuucaagcugauguu

SEQ ID NO: 91111 - RNA, 19 nt, Homo sapiens
gcggaggacccaggacuau

SEQ ID NO: 91112 - RNA, 19 nt, Homo sapiens
uuacaacaggcuuaugaau

SEQ ID NO: 91113 - RNA, 19 nt, Homo sapiens
ucuuacaacaggcuuauga

SEQ ID NO: 91114 - RNA, 19 nt, Homo sapiens
cgacucucccuacucagaa

SEQ ID NO: 91115 - RNA, 19 nt, Homo sapiens
aaaccggcacccucucuga

SEQ ID NO: 91116 - RNA, 19 nt, Homo sapiens
uaauguaaacgucaaugca

SEQ ID NO: 91117 - RNA, 19 nt, Homo sapiens
uacagacuuugcuggaguu

SEQ ID NO: 91118 - RNA, 19 nt, Homo sapiens
uugaaagaccgaacugguu

SEQ ID NO: 91119 - RNA, 19 nt, Homo sapiens
guuaacaucgaggauaaug

SEQ ID NO: 91120 - RNA, 19 nt, Homo sapiens
ccuggacacuuuacagacu

SEQ ID NO: 91121 - RNA, 19 nt, Homo sapiens
cagaagcagcaauuguuuc

SEQ ID NO: 91122 - RNA, 19 nt, Homo sapiens
uggacacuuuacagacuuu

SEQ ID NO: 91123 - RNA, 19 nt, Homo sapiens
gccuuuggcgaucaucuuu

SEQ ID NO: 91124 - RNA, 19 nt, Homo sapiens
gcacugggcaaucguuacg

SEQ ID NO: 91125 - RNA, 19 nt, Homo sapiens
gcagcaagggagggaguga

SEQ ID NO: 91126 - RNA, 19 nt, Homo sapiens
ccacaaaaccgggaaagga

SEQ ID NO: 91127 - RNA, 19 nt, Homo sapiens
caggagacugcuacuuaga

SEQ ID NO: 91128 - RNA, 19 nt, Homo sapiens
gguuaugaaacuuggaaau

SEQ ID NO: 91129 - RNA, 19 nt, Homo sapiens
ccacaaaucuucaauaaac

SEQ ID NO: 91130 - RNA, 19 nt, Homo sapiens
gcagauaacuuugacuuuc

SEQ ID NO: 91131 - RNA, 19 nt, Homo sapiens
gaguagcucuccugacuuu

SEQ ID NO: 91132 - RNA, 19 nt, Homo sapiens
ggacaccgccugugauuug

SEQ ID NO: 91133 - RNA, 19 nt, Homo sapiens
gccaggagacugcuacuua

SEQ ID NO: 91134 - RNA, 19 nt, Homo sapiens
aggcagaucuuacuaguau

SEQ ID NO: 91135 - RNA, 19 nt, Homo sapiens
ccacguugccucuacuuua

SEQ ID NO: 91136 - RNA, 19 nt, Homo sapiens
gcagaucuuacuaguauuu

SEQ ID NO: 91137 - RNA, 19 nt, Homo sapiens
ugacagcucugccuacauc

SEQ ID NO: 91138 - RNA, 19 nt, Homo sapiens
uaacaucgaggauaaugaa

SEQ ID NO: 91139 - RNA, 19 nt, Homo sapiens
gccucuacuuuaucaauua

SEQ ID NO: 91140 - RNA, 19 nt, Homo sapiens
gcaggcagaucuuacuagu

SEQ ID NO: 91141 - RNA, 19 nt, Homo sapiens
caagcucuacuccagauua

SEQ ID NO: 91142 - RNA, 19 nt, Homo sapiens
agccacaaaucuucaauaa

SEQ ID NO: 91143 - RNA, 19 nt, Homo sapiens
agacuuugcuggaguuuca

SEQ ID NO: 91144 - RNA, 19 nt, Homo sapiens
ugaaagaccgaacugguuu

SEQ ID NO: 91145 - RNA, 19 nt, Homo sapiens
gaaccugcccuugcacuug

SEQ ID NO: 91146 - RNA, 19 nt, Homo sapiens
guucuaacauguaauugca

SEQ ID NO: 91147 - RNA, 19 nt, Homo sapiens
gagccacaaaucuucaaua

SEQ ID NO: 91148 - RNA, 19 nt, Homo sapiens
gaacugguuucgcugucau

SEQ ID NO: 91149 - RNA, 19 nt, Homo sapiens
ccaggagacugcuacuuag

SEQ ID NO: 91150 - RNA, 19 nt, Homo sapiens
gaucuauaguuccuugagu

SEQ ID NO: 91151 - RNA, 19 nt, Homo sapiens
cacguugccucuacuuuau

SEQ ID NO: 91152 - RNA, 19 nt, Homo sapiens
cagauaacuuugacuuucu

SEQ ID NO: 91153 - RNA, 19 nt, Homo sapiens
ugaaacugcauaagugaaa

SEQ ID NO: 91154 - RNA, 19 nt, Homo sapiens
aagcucuacuccagauuaa

SEQ ID NO: 91155 - RNA, 19 nt, Homo sapiens
ucaggacccuaaagaaugg

SEQ ID NO: 91156 - RNA, 19 nt, Homo sapiens
ggagucgucagaauucuuc

SEQ ID NO: 91157 - RNA, 19 nt, Homo sapiens
cugaguagcucuccugacu

SEQ ID NO: 91158 - RNA, 19 nt, Homo sapiens
cacacacacuccucacaga

SEQ ID NO: 91159 - RNA, 19 nt, Homo sapiens
ggaggaaugagguuguuag

SEQ ID NO: 91160 - RNA, 19 nt, Homo sapiens
gaccuagagcaacuuacua

SEQ ID NO: 91161 - RNA, 19 nt, Homo sapiens
gucaggacccuaaagaaug

SEQ ID NO: 91162 - RNA, 19 nt, Homo sapiens
cgucaggacccuaaagaau

SEQ ID NO: 91163 - RNA, 19 nt, Homo sapiens
aacuuugacuuucuucuga

SEQ ID NO: 91164 - RNA, 19 nt, Homo sapiens
ggaccuagagcaacuuacu

SEQ ID NO: 91165 - RNA, 19 nt, Homo sapiens
cgucagaauucuucauagg

SEQ ID NO: 91166 - RNA, 19 nt, Homo sapiens
guaauugcagauaacuuug

SEQ ID NO: 91167 - RNA, 19 nt, Homo sapiens
guuucaagcugauguuaac

SEQ ID NO: 91168 - RNA, 19 nt, Homo sapiens
gaguuucaagcugauguua

SEQ ID NO: 91169 - RNA, 19 nt, Homo sapiens
aaacgucaaugcacaaaau

SEQ ID NO: 91170 - RNA, 19 nt, Homo sapiens
gaaacugcauaagugaaaa

SEQ ID NO: 91171 - RNA, 19 nt, Homo sapiens
uaaccaggaauguaugugu

SEQ ID NO: 91172 - RNA, 19 nt, Homo sapiens
uaacuuugacuuucuucug

SEQ ID NO: 91173 - RNA, 19 nt, Homo sapiens
guagcucuccugacuuuua

SEQ ID NO: 91174 - RNA, 19 nt, Homo sapiens
gccacaaaucuucaauaaa

SEQ ID NO: 91175 - RNA, 19 nt, Homo sapiens
cagcucugccuacaucuga

SEQ ID NO: 91176 - RNA, 19 nt, Homo sapiens
acacacuccucacagagau

SEQ ID NO: 91177 - RNA, 19 nt, Homo sapiens
guaaacgucaaugcacaaa

SEQ ID NO: 91178 - RNA, 19 nt, Homo sapiens
gaaaaucuuacaacagguu

SEQ ID NO: 91179 - RNA, 19 nt, Homo sapiens
gaagcacacggccagcaau

SEQ ID NO: 91180 - RNA, 19 nt, Homo sapiens
gucgucagaauucuucaua

SEQ ID NO: 91181 - RNA, 19 nt, Homo sapiens
uaaaaugguuuguccugau

SEQ ID NO: 91182 - RNA, 19 nt, Homo sapiens
ucuuacaacagguuuauga

SEQ ID NO: 91183 - RNA, 19 nt, Homo sapiens
gggaggaaugagguuguua

SEQ ID NO: 91184 - RNA, 19 nt, Homo sapiens
ggaaccugcccuugcacuu

SEQ ID NO: 91185 - RNA, 19 nt, Homo sapiens
guuaugaaacuuggaaauc

SEQ ID NO: 91186 - RNA, 19 nt, Homo sapiens
ugccucuacuuuaucaauu

SEQ ID NO: 91187 - RNA, 19 nt, Homo sapiens
ggaguuucaagcugauguu

SEQ ID NO: 91188 - RNA, 19 nt, Homo sapiens
ccucuccaauggcucaguu

SEQ ID NO: 91189 - RNA, 19 nt, Homo sapiens
uaauguaaacgucaaugca

SEQ ID NO: 91190 - RNA, 19 nt, Homo sapiens
ucauagggguuaagcuaaa

SEQ ID NO: 91191 - RNA, 19 nt, Homo sapiens
agagaucuguagcguaggu

SEQ ID NO: 91192 - RNA, 19 nt, Homo sapiens
ggaauguaugugugucugu

SEQ ID NO: 91193 - RNA, 19 nt, Homo sapiens
uacagacuuugcuggaguu

SEQ ID NO: 91194 - RNA, 19 nt, Homo sapiens
uugaaagaccgaacugguu

SEQ ID NO: 91195 - RNA, 19 nt, Homo sapiens
ccaucaugcagccugguua

SEQ ID NO: 91196 - RNA, 19 nt, Homo sapiens
cgugacagcucugccuaca

SEQ ID NO: 91197 - RNA, 19 nt, Homo sapiens
guuaacaucgaggauaaug

SEQ ID NO: 91198 - RNA, 19 nt, Homo sapiens
ccuggacacuuuacagacu

SEQ ID NO: 91199 - RNA, 19 nt, Homo sapiens
uggacacuuuacagacuuu

SEQ ID NO: 91200 - RNA, 19 nt, Homo sapiens
cggagucauuaaccaggaa

SEQ ID NO: 91201 - RNA, 19 nt, Homo sapiens
ccuugagucuccacacaca

SEQ ID NO: 91202 - RNA, 19 nt, Homo sapiens
caggagacugcuacuuaga

SEQ ID NO: 91203 - RNA, 19 nt, Homo sapiens
gguuaugaaacuuggaaau

SEQ ID NO: 91204 - RNA, 19 nt, Homo sapiens
caguuuugcugaauaauca

SEQ ID NO: 91205 - RNA, 19 nt, Homo sapiens
caggcagaucuuacuagua

SEQ ID NO: 91206 - RNA, 19 nt, Homo sapiens
ggacguuucucauuuguuu

SEQ ID NO: 91207 - RNA, 19 nt, Homo sapiens
gcagagcauuuaagaguga

SEQ ID NO: 91208 - RNA, 19 nt, Homo sapiens
gaagguagaaugaguuaug

SEQ ID NO: 91209 - RNA, 19 nt, Homo sapiens
ccaaaucaauaagaaggua

SEQ ID NO: 91210 - RNA, 19 nt, Homo sapiens
gagcgucccaaaucaauaa

SEQ ID NO: 91211 - RNA, 19 nt, Homo sapiens
guacagcguuuuaaaagaa

SEQ ID NO: 91212 - RNA, 19 nt, Homo sapiens
gggcagagcauuuaagagu

SEQ ID NO: 91213 - RNA, 19 nt, Homo sapiens
aauuaagacuugugcauga

SEQ ID NO: 91214 - RNA, 19 nt, Homo sapiens
caauaagaagguagaauga

SEQ ID NO: 91215 - RNA, 19 nt, Homo sapiens
ucaauaagaagguagaaug

SEQ ID NO: 91216 - RNA, 19 nt, Homo sapiens
gaccugaagugugcacguu

SEQ ID NO: 91217 - RNA, 19 nt, Homo sapiens
gcuuauagguguugguuuu

SEQ ID NO: 91218 - RNA, 19 nt, Homo sapiens
cgucccaaaucaauaagaa

SEQ ID NO: 91219 - RNA, 19 nt, Homo sapiens
auaagaagguagaaugagu

SEQ ID NO: 91220 - RNA, 19 nt, Homo sapiens
ggagcgucccaaaucaaua

SEQ ID NO: 91221 - RNA, 19 nt, Homo sapiens
guagaaugaguuaugaguu

SEQ ID NO: 91222 - RNA, 19 nt, Homo sapiens
gaagagaggggaagaaaca

SEQ ID NO: 91223 - RNA, 19 nt, Homo sapiens
caauccaucuggcaguuca

SEQ ID NO: 91224 - RNA, 19 nt, Homo sapiens
uaagaagguagaaugaguu

SEQ ID NO: 91225 - RNA, 19 nt, Homo sapiens
aagaagguagaaugaguua

SEQ ID NO: 91226 - RNA, 19 nt, Homo sapiens
ccaccuaaacgguucaguu

SEQ ID NO: 91227 - RNA, 19 nt, Homo sapiens
guaccaguccaguccauga

SEQ ID NO: 91228 - RNA, 19 nt, Homo sapiens
gguuauguaucagaagaga

SEQ ID NO: 91229 - RNA, 19 nt, Homo sapiens
gcaggccacagccaccuaa

SEQ ID NO: 91230 - RNA, 19 nt, Homo sapiens
gcacggggcugaugucaac

SEQ ID NO: 91231 - RNA, 19 nt, Homo sapiens
aagguagaaugaguuauga

SEQ ID NO: 91232 - RNA, 19 nt, Homo sapiens
cccaagggcagagcauuua

SEQ ID NO: 91233 - RNA, 19 nt, Homo sapiens
gaugucaacgugccugaug

SEQ ID NO: 91234 - RNA, 19 nt, Homo sapiens
ccaagggcagagcauuuaa

SEQ ID NO: 91235 - RNA, 19 nt, Homo sapiens
cauauucuguuggaagcuu

SEQ ID NO: 91236 - RNA, 19 nt, Homo sapiens
gguagaaugaguuaugagu

SEQ ID NO: 91237 - RNA, 19 nt, Homo sapiens
agacggcgcugcaggucau

SEQ ID NO: 91238 - RNA, 19 nt, Homo sapiens
cacuuucucuucuuguuuc

SEQ ID NO: 91239 - RNA, 19 nt, Homo sapiens
gcauuuaagagugaaguca

SEQ ID NO: 91240 - RNA, 19 nt, Homo sapiens
ucuggcagcugaaucugau

SEQ ID NO: 91241 - RNA, 19 nt, Homo sapiens
acacuuucucuucuuguuu

SEQ ID NO: 91242 - RNA, 19 nt, Homo sapiens
ggagcuggcacugcagaga

SEQ ID NO: 91243 - RNA, 19 nt, Homo sapiens
ggacguuucucauuuguuu

SEQ ID NO: 91244 - RNA, 19 nt, Homo sapiens
gcagagcauuuaagaguga

SEQ ID NO: 91245 - RNA, 19 nt, Homo sapiens
gaagguagaaugaguuaug

SEQ ID NO: 91246 - RNA, 19 nt, Homo sapiens
ccaaaucaauaagaaggua

SEQ ID NO: 91247 - RNA, 19 nt, Homo sapiens
gagcgucccaaaucaauaa

SEQ ID NO: 91248 - RNA, 19 nt, Homo sapiens
guacagcguuuuaaaagaa

SEQ ID NO: 91249 - RNA, 19 nt, Homo sapiens
gggcagagcauuuaagagu

SEQ ID NO: 91250 - RNA, 19 nt, Homo sapiens
aauuaagacuugugcauga

SEQ ID NO: 91251 - RNA, 19 nt, Homo sapiens
caauaagaagguagaauga

SEQ ID NO: 91252 - RNA, 19 nt, Homo sapiens
ucaauaagaagguagaaug

SEQ ID NO: 91253 - RNA, 19 nt, Homo sapiens
gaccugaagugugcacguu

SEQ ID NO: 91254 - RNA, 19 nt, Homo sapiens
gcuuauagguguugguuuu

SEQ ID NO: 91255 - RNA, 19 nt, Homo sapiens
cgucccaaaucaauaagaa

SEQ ID NO: 91256 - RNA, 19 nt, Homo sapiens
uaagacuugugcaugauca

SEQ ID NO: 91257 - RNA, 19 nt, Homo sapiens
auaagaagguagaaugagu

SEQ ID NO: 91258 - RNA, 19 nt, Homo sapiens
ggagcgucccaaaucaaua

SEQ ID NO: 91259 - RNA, 19 nt, Homo sapiens
guagaaugaguuaugaguu

SEQ ID NO: 91260 - RNA, 19 nt, Homo sapiens
gaagagaggggaagaaaca

SEQ ID NO: 91261 - RNA, 19 nt, Homo sapiens
caauccaucuggcaguuca

SEQ ID NO: 91262 - RNA, 19 nt, Homo sapiens
uaagaagguagaaugaguu

SEQ ID NO: 91263 - RNA, 19 nt, Homo sapiens
aagaagguagaaugaguua

SEQ ID NO: 91264 - RNA, 19 nt, Homo sapiens
ccaccuaaacgguucaguu

SEQ ID NO: 91265 - RNA, 19 nt, Homo sapiens
guaccaguccaguccauga

SEQ ID NO: 91266 - RNA, 19 nt, Homo sapiens
gguuauguaucagaagaga

SEQ ID NO: 91267 - RNA, 19 nt, Homo sapiens
gcaggccacagccaccuaa

SEQ ID NO: 91268 - RNA, 19 nt, Homo sapiens
gcacggggcugaugucaac

SEQ ID NO: 91269 - RNA, 19 nt, Homo sapiens
aagguagaaugaguuauga

SEQ ID NO: 91270 - RNA, 19 nt, Homo sapiens
cccaagggcagagcauuua

SEQ ID NO: 91271 - RNA, 19 nt, Homo sapiens
gaugucaacgugccugaug

SEQ ID NO: 91272 - RNA, 19 nt, Homo sapiens
ccaagggcagagcauuuaa

SEQ ID NO: 91273 - RNA, 19 nt, Homo sapiens
cauauucuguuggaagcuu

SEQ ID NO: 91274 - RNA, 19 nt, Homo sapiens
gguagaaugaguuaugagu

SEQ ID NO: 91275 - RNA, 19 nt, Homo sapiens
agacggcgcugcaggucau

SEQ ID NO: 91276 - RNA, 19 nt, Homo sapiens
cacuuucucuucuuguuuc

SEQ ID NO: 91277 - RNA, 19 nt, Homo sapiens
gcauuuaagagugaaguca

SEQ ID NO: 91278 - RNA, 19 nt, Homo sapiens
ucuggcagcugaaucugau

SEQ ID NO: 91279 - RNA, 19 nt, Homo sapiens
acacuuucucuucuuguuu

SEQ ID NO: 91280 - RNA, 19 nt, Homo sapiens
ggagcuggcacugcagaga

SEQ ID NO: 91281 - RNA, 19 nt, Homo sapiens
caaauuagcugcacaucua

SEQ ID NO: 91282 - RNA, 19 nt, Homo sapiens
gaacagacuccaauucaua

SEQ ID NO: 91283 - RNA, 19 nt, Homo sapiens
gcagauauuccuaaaguuu

SEQ ID NO: 91284 - RNA, 19 nt, Homo sapiens
gaacuaaagagcuguggua

SEQ ID NO: 91285 - RNA, 19 nt, Homo sapiens
gaccaugucugaaauguca

SEQ ID NO: 91286 - RNA, 19 nt, Homo sapiens
gcacaucuaucaucaagag

SEQ ID NO: 91287 - RNA, 19 nt, Homo sapiens
gaaaugaaaccaccagugu

SEQ ID NO: 91288 - RNA, 19 nt, Homo sapiens
gaggggaacugucaaaaua

SEQ ID NO: 91289 - RNA, 19 nt, Homo sapiens
cuaaagagcugugguauac

SEQ ID NO: 91290 - RNA, 19 nt, Homo sapiens
ugggagaucuugucuugua

SEQ ID NO: 91291 - RNA, 19 nt, Homo sapiens
gaaauaauggaagagcuua

SEQ ID NO: 91292 - RNA, 19 nt, Homo sapiens
ucaguucucuagcauaauu

SEQ ID NO: 91293 - RNA, 19 nt, Homo sapiens
gugcagauauuccuaaagu

SEQ ID NO: 91294 - RNA, 19 nt, Homo sapiens
gagcuuacaaccugccuua

SEQ ID NO: 91295 - RNA, 19 nt, Homo sapiens
ggaauuaucacccaucauc

SEQ ID NO: 91296 - RNA, 19 nt, Homo sapiens
ccaucaagcaauacaauua

SEQ ID NO: 91297 - RNA, 19 nt, Homo sapiens
uaccagcaauguggaauua

SEQ ID NO: 91298 - RNA, 19 nt, Homo sapiens
ugucaguucucuagcauaa

SEQ ID NO: 91299 - RNA, 19 nt, Homo sapiens
aaagagcugugguauacaa

SEQ ID NO: 91300 - RNA, 19 nt, Homo sapiens
aaugaaaccaccaguguua

SEQ ID NO: 91301 - RNA, 19 nt, Homo sapiens
aaauguacaugugcagaua

SEQ ID NO: 91302 - RNA, 19 nt, Homo sapiens
uacagaccaucaagcaaua

SEQ ID NO: 91303 - RNA, 19 nt, Homo sapiens
gcugugaaauaauggaaga

SEQ ID NO: 91304 - RNA, 19 nt, Homo sapiens
ugaagagccuauugaagau

SEQ ID NO: 91305 - RNA, 19 nt, Homo sapiens
guucucaguuucucgguuu

SEQ ID NO: 91306 - RNA, 19 nt, Homo sapiens
cugcuugucuccuacuaua

SEQ ID NO: 91307 - RNA, 19 nt, Homo sapiens
cuuccagguuguaaauuua

SEQ ID NO: 91308 - RNA, 19 nt, Homo sapiens
uaucauggcuaucuuuguc

SEQ ID NO: 91309 - RNA, 19 nt, Homo sapiens
ccaccaguguuaucaacuu

SEQ ID NO: 91310 - RNA, 19 nt, Homo sapiens
uauaugaccaugucugaaa

SEQ ID NO: 91311 - RNA, 19 nt, Homo sapiens
gaagaugaacagacuccaa

SEQ ID NO: 91312 - RNA, 19 nt, Homo sapiens
gaaaccaccaguguuauca

SEQ ID NO: 91313 - RNA, 19 nt, Homo sapiens
cuugggagaucuugucuug

SEQ ID NO: 91314 - RNA, 19 nt, Homo sapiens
ggggaacugucaaaauaua

SEQ ID NO: 91315 - RNA, 19 nt, Homo sapiens
gcuuacaaccugccuuaaa

SEQ ID NO: 91316 - RNA, 19 nt, Homo sapiens
ugaaaugucaguucucuag

SEQ ID NO: 91317 - RNA, 19 nt, Homo sapiens
aucaagaucuguaucaaga

SEQ ID NO: 91318 - RNA, 19 nt, Homo sapiens
caaucaagaucuguaucaa

SEQ ID NO: 91319 - RNA, 19 nt, Homo sapiens
ccagcaauguggaauuauc

SEQ ID NO: 91320 - RNA, 19 nt, Homo sapiens
caaaccuucuggaucucua

SEQ ID NO: 91321 - RNA, 19 nt, Homo sapiens
gaugaacagacuccaauuc

SEQ ID NO: 91322 - RNA, 19 nt, Homo sapiens
cgagugaauuguucucagu

SEQ ID NO: 91323 - RNA, 19 nt, Homo sapiens
augaagagccuauugaaga

SEQ ID NO: 91324 - RNA, 19 nt, Homo sapiens
ucuuccagguuguaaauuu

SEQ ID NO: 91325 - RNA, 19 nt, Homo sapiens
caauacagaccaucaagca

SEQ ID NO: 91326 - RNA, 19 nt, Homo sapiens
cagaugaagagccuauuga

SEQ ID NO: 91327 - RNA, 19 nt, Homo sapiens
ggacaaauuagcugcacau

SEQ ID NO: 91328 - RNA, 19 nt, Homo sapiens
ugaguuucgggacaaauua

SEQ ID NO: 91329 - RNA, 19 nt, Homo sapiens
ucccaaaccuucuggaucu

SEQ ID NO: 91330 - RNA, 19 nt, Homo sapiens
gugaauuguucucaguuuc

SEQ ID NO: 91331 - RNA, 19 nt, Homo sapiens
aagagccuauugaagauga

SEQ ID NO: 91332 - RNA, 19 nt, Homo sapiens
acacugcuauggaggacuu

SEQ ID NO: 91333 - RNA, 19 nt, Homo sapiens
ccgcccaguucaauacaaa

SEQ ID NO: 91334 - RNA, 19 nt, Homo sapiens
agugaauuguucucaguuu

SEQ ID NO: 91335 - RNA, 19 nt, Homo sapiens
ggacuugggagaucuuguc

SEQ ID NO: 91336 - RNA, 19 nt, Homo sapiens
gaauuaucacccaucauca

SEQ ID NO: 91337 - RNA, 19 nt, Homo sapiens
gaugaagagccuauugaag

SEQ ID NO: 91338 - RNA, 19 nt, Homo sapiens
cauauaucauggcuaucuu

SEQ ID NO: 91339 - RNA, 19 nt, Homo sapiens
ccaguucaauacaaacaag

SEQ ID NO: 91340 - RNA, 19 nt, Homo sapiens
uauauaugaccaugucuga

SEQ ID NO: 91341 - RNA, 19 nt, Homo sapiens
gaccaucaagcaauacaau

SEQ ID NO: 91342 - RNA, 19 nt, Homo sapiens
cacaauaucaccagagcaa

SEQ ID NO: 91343 - RNA, 19 nt, Homo sapiens
agacuccaauucauauauc

SEQ ID NO: 91344 - RNA, 19 nt, Homo sapiens
caccagagcaagccauaga

SEQ ID NO: 91345 - RNA, 19 nt, Homo sapiens
uguagcugcuugucuccua

SEQ ID NO: 91346 - RNA, 19 nt, Homo sapiens
ugaaauaauggaagagcuu

SEQ ID NO: 91347 - RNA, 19 nt, Homo sapiens
caccaguguuaucaacuug

SEQ ID NO: 91348 - RNA, 19 nt, Homo sapiens
aaaccuuaauacacugcua

SEQ ID NO: 91349 - RNA, 19 nt, Homo sapiens
guggaauuaucacccauca

SEQ ID NO: 91350 - RNA, 19 nt, Homo sapiens
gaagagccuauugaagaug

SEQ ID NO: 91351 - RNA, 19 nt, Homo sapiens
aaaugucaguucucuagca

SEQ ID NO: 91352 - RNA, 19 nt, Homo sapiens
gaauuguucucaguuucuc

SEQ ID NO: 91353 - RNA, 19 nt, Homo sapiens
gcucuuccagguuguaaau

SEQ ID NO: 91354 - RNA, 19 nt, Homo sapiens
gguauacaagacauauuug

SEQ ID NO: 91355 - RNA, 19 nt, Homo sapiens
gagcugugguauacaagac

SEQ ID NO: 91356 - RNA, 19 nt, Homo sapiens
gauacagaagaacuaaaga

SEQ ID NO: 91357 - RNA, 19 nt, Homo sapiens
uauugaagaugaacagacu

SEQ ID NO: 91358 - RNA, 19 nt, Homo sapiens
acuaaagagcugugguaua

SEQ ID NO: 91359 - RNA, 19 nt, Homo sapiens
acaaucaagaucuguauca

SEQ ID NO: 91360 - RNA, 19 nt, Homo sapiens
ucacaaucaagaucuguau

SEQ ID NO: 91361 - RNA, 19 nt, Homo sapiens
cugcacaucuaucaucaag

SEQ ID NO: 91362 - RNA, 19 nt, Homo sapiens
auacagaccaucaagcaau

SEQ ID NO: 91363 - RNA, 19 nt, Homo sapiens
gggagaucuugucuuguag

SEQ ID NO: 91364 - RNA, 19 nt, Homo sapiens
ucagaugaagagccuauug

SEQ ID NO: 91365 - RNA, 19 nt, Homo sapiens
gacuccaauucauauauca

SEQ ID NO: 91366 - RNA, 19 nt, Homo sapiens
guucaauacaaacaaguga

SEQ ID NO: 91367 - RNA, 19 nt, Homo sapiens
uaaauguacaugugcagau

SEQ ID NO: 91368 - RNA, 19 nt, Homo sapiens
cuuacaaccugccuuaaaa

SEQ ID NO: 91369 - RNA, 19 nt, Homo sapiens
cagacuccaauucauauau

SEQ ID NO: 91370 - RNA, 19 nt, Homo sapiens
cuuaauacacugcuaugga

SEQ ID NO: 91371 - RNA, 19 nt, Homo sapiens
cagcaauguggaauuauca

SEQ ID NO: 91372 - RNA, 19 nt, Homo sapiens
gggcaauacagaccaucaa

SEQ ID NO: 91373 - RNA, 19 nt, Homo sapiens
caaaauauagagucccaaa

SEQ ID NO: 91374 - RNA, 19 nt, Homo sapiens
caugugcagauauuccuaa

SEQ ID NO: 91375 - RNA, 19 nt, Homo sapiens
ugaaaccaccaguguuauc

SEQ ID NO: 91376 - RNA, 19 nt, Homo sapiens
aaaugaaaccaccaguguu

SEQ ID NO: 91377 - RNA, 19 nt, Homo sapiens
gagugaauuguucucaguu

SEQ ID NO: 91378 - RNA, 19 nt, Homo sapiens
gagaucuugucuuguagcu

SEQ ID NO: 91379 - RNA, 19 nt, Homo sapiens
agaugaagagccuauugaa

SEQ ID NO: 91380 - RNA, 19 nt, Homo sapiens
aagaugaacagacuccaau

SEQ ID NO: 91381 - RNA, 19 nt, Homo sapiens
ccaaugagauggucaagaa

SEQ ID NO: 91382 - RNA, 19 nt, Homo sapiens
gaaauacuuuggucucuga

SEQ ID NO: 91383 - RNA, 19 nt, Homo sapiens
gaaaggaagugcagaggau

SEQ ID NO: 91384 - RNA, 19 nt, Homo sapiens
guagaugucuuuaguauac

SEQ ID NO: 91385 - RNA, 19 nt, Homo sapiens
ggacauggcagcaguauuc

SEQ ID NO: 91386 - RNA, 19 nt, Homo sapiens
gaacuguaauuagcaagaa

SEQ ID NO: 91387 - RNA, 19 nt, Homo sapiens
uaaggcagaugcuaauuau

SEQ ID NO: 91388 - RNA, 19 nt, Homo sapiens
gaucaaagaacaggacaua

SEQ ID NO: 91389 - RNA, 19 nt, Homo sapiens
guaaggcagaugcuaauua

SEQ ID NO: 91390 - RNA, 19 nt, Homo sapiens
guagagaacaucagccaua

SEQ ID NO: 91391 - RNA, 19 nt, Homo sapiens
gcgaugaggucaauguaga

SEQ ID NO: 91392 - RNA, 19 nt, Homo sapiens
ucaaagaacaggacauaaa

SEQ ID NO: 91393 - RNA, 19 nt, Homo sapiens
ggcauuaaguaagcaaaua

SEQ ID NO: 91394 - RNA, 19 nt, Homo sapiens
ggaaucagaacuccaaaug

SEQ ID NO: 91395 - RNA, 19 nt, Homo sapiens
guacagguauacccgaaau

SEQ ID NO: 91396 - RNA, 19 nt, Homo sapiens
gugcgugugugucugcuua

SEQ ID NO: 91397 - RNA, 19 nt, Homo sapiens
gcacucuaaugcuggguuu

SEQ ID NO: 91398 - RNA, 19 nt, Homo sapiens
gcagcaguauucaugauca

SEQ ID NO: 91399 - RNA, 19 nt, Homo sapiens
cacgugcuauccaguaaua

SEQ ID NO: 91400 - RNA, 19 nt, Homo sapiens
aggcagaugcuaauuauaa

SEQ ID NO: 91401 - RNA, 19 nt, Homo sapiens
aaucagaacuccaaaugca

SEQ ID NO: 91402 - RNA, 19 nt, Homo sapiens
caagugcucucauaguucu

SEQ ID NO: 91403 - RNA, 19 nt, Homo sapiens
ugaagaugcuacagggaaa

SEQ ID NO: 91404 - RNA, 19 nt, Homo sapiens
gcgacgacauccuuacguu

SEQ ID NO: 91405 - RNA, 19 nt, Homo sapiens
caaauagugcccucagcua

SEQ ID NO: 91406 - RNA, 19 nt, Homo sapiens
gcccucagcuacugcagaa

SEQ ID NO: 91407 - RNA, 19 nt, Homo sapiens
aagguucgcuguauguuug

SEQ ID NO: 91408 - RNA, 19 nt, Homo sapiens
cccgaaaucuuguggauca

SEQ ID NO: 91409 - RNA, 19 nt, Homo sapiens
gcacucugccacuuguuaa

SEQ ID NO: 91410 - RNA, 19 nt, Homo sapiens
gaagugcagaggauuuaga

SEQ ID NO: 91411 - RNA, 19 nt, Homo sapiens
gaacuccaaaugcaacuuc

SEQ ID NO: 91412 - RNA, 19 nt, Homo sapiens
ggucaagaagucugaaaga

SEQ ID NO: 91413 - RNA, 19 nt, Homo sapiens
gaaaucuaaaggagacauu

SEQ ID NO: 91414 - RNA, 19 nt, Homo sapiens
uuuggucucugaacuguaa

SEQ ID NO: 91415 - RNA, 19 nt, Homo sapiens
gaaggacauggcagcagua

SEQ ID NO: 91416 - RNA, 19 nt, Homo sapiens
cauaaacucaugucugugu

SEQ ID NO: 91417 - RNA, 19 nt, Homo sapiens
uuuguuaccuggaggacua

SEQ ID NO: 91418 - RNA, 19 nt, Homo sapiens
cuaaaggagacauuauuug

SEQ ID NO: 91419 - RNA, 19 nt, Homo sapiens
uauaaggcauuaaguaagc

SEQ ID NO: 91420 - RNA, 19 nt, Homo sapiens
caaagaacaggacauaaaa

SEQ ID NO: 91421 - RNA, 19 nt, Homo sapiens
uaaaggagacauuauuugc

SEQ ID NO: 91422 - RNA, 19 nt, Homo sapiens
cauuaaauccauacuagga

SEQ ID NO: 91423 - RNA, 19 nt, Homo sapiens
uucaagugcucucauaguu

SEQ ID NO: 91424 - RNA, 19 nt, Homo sapiens
uccauuaaauccauacuag

SEQ ID NO: 91425 - RNA, 19 nt, Homo sapiens
gcauuaaguaagcaaauag

SEQ ID NO: 91426 - RNA, 19 nt, Homo sapiens
uaagguucgcuguauguuu

SEQ ID NO: 91427 - RNA, 19 nt, Homo sapiens
gacuaaauguagaugucuu

SEQ ID NO: 91428 - RNA, 19 nt, Homo sapiens
ggcagaugcuaauuauaag

SEQ ID NO: 91429 - RNA, 19 nt, Homo sapiens
ucaagaagucugaaagagu

SEQ ID NO: 91430 - RNA, 19 nt, Homo sapiens
uaccaacucccacugcuuu

SEQ ID NO: 91431 - RNA, 19 nt, Homo sapiens
gacgacauccuuacguuuc

SEQ ID NO: 91432 - RNA, 19 nt, Homo sapiens
cgacgacauccuuacguuu

SEQ ID NO: 91433 - RNA, 19 nt, Homo sapiens
ucucugaacuguaauuagc

SEQ ID NO: 91434 - RNA, 19 nt, Homo sapiens
ggucucugaacuguaauua

SEQ ID NO: 91435 - RNA, 19 nt, Homo sapiens
cgugcuauccaguaauaua

SEQ ID NO: 91436 - RNA, 19 nt, Homo sapiens
aaaccagugugccuacauc

SEQ ID NO: 91437 - RNA, 19 nt, Homo sapiens
ggucauagucaaagauuuu

SEQ ID NO: 91438 - RNA, 19 nt, Homo sapiens
cagaggauuuagaaaagua

SEQ ID NO: 91439 - RNA, 19 nt, Homo sapiens
ccagugugccuacaucaau

SEQ ID NO: 91440 - RNA, 19 nt, Homo sapiens
ccacugcuuucugaagaug

SEQ ID NO: 91441 - RNA, 19 nt, Homo sapiens
acgccaaguucgaccagua

SEQ ID NO: 91442 - RNA, 19 nt, Homo sapiens
gaugcuacagggaaaucua

SEQ ID NO: 91443 - RNA, 19 nt, Homo sapiens
ucuauccucuaauuccauu

SEQ ID NO: 91444 - RNA, 19 nt, Homo sapiens
cgggcucgcuggagaacaa

SEQ ID NO: 91445 - RNA, 19 nt, Homo sapiens
uggcuuacaucgaguagag

SEQ ID NO: 91446 - RNA, 19 nt, Homo sapiens
cagugugccuacaucaaug

SEQ ID NO: 91447 - RNA, 19 nt, Homo sapiens
gucaagaagucugaaagag

SEQ ID NO: 91448 - RNA, 19 nt, Homo sapiens
ggcaauguacgccaaguuc

SEQ ID NO: 91449 - RNA, 19 nt, Homo sapiens
gaaaagucccacugaggaa

SEQ ID NO: 91450 - RNA, 19 nt, Homo sapiens
uagagaacaucagccauac

SEQ ID NO: 91451 - RNA, 19 nt, Homo sapiens
ucccacugcuuucugaaga

SEQ ID NO: 91452 - RNA, 19 nt, Homo sapiens
gcuguauguuugccuugga

SEQ ID NO: 91453 - RNA, 19 nt, Homo sapiens
ggaggugcaggccaucaug

SEQ ID NO: 91454 - RNA, 19 nt, Homo sapiens
gaagaugcuacagggaaau

SEQ ID NO: 91455 - RNA, 19 nt, Homo sapiens
agguauacccgaaaucuug

SEQ ID NO: 91456 - RNA, 19 nt, Homo sapiens
uuacguuucggcacucuaa

SEQ ID NO: 91457 - RNA, 19 nt, Homo sapiens
ccauggucauagucaaaga

SEQ ID NO: 91458 - RNA, 19 nt, Homo sapiens
aagccaauacuuagaucua

SEQ ID NO: 91459 - RNA, 19 nt, Homo sapiens
aggaagugcagaggauuua

SEQ ID NO: 91460 - RNA, 19 nt, Homo sapiens
ggacuaaauguagaugucu

SEQ ID NO: 91461 - RNA, 19 nt, Homo sapiens
cuggaggacuaaauguaga

SEQ ID NO: 91462 - RNA, 19 nt, Homo sapiens
guucuauccucuaauucca

SEQ ID NO: 91463 - RNA, 19 nt, Homo sapiens
ccucagcuacugcagaaga

SEQ ID NO: 91464 - RNA, 19 nt, Homo sapiens
gaaucagaacuccaaaugc

SEQ ID NO: 91465 - RNA, 19 nt, Homo sapiens
gugcagaggauuuagaaaa

SEQ ID NO: 91466 - RNA, 19 nt, Homo sapiens
ucugaacuguaauuagcaa

SEQ ID NO: 91467 - RNA, 19 nt, Homo sapiens
ucaagugcucucauaguuc

SEQ ID NO: 91468 - RNA, 19 nt, Homo sapiens
caauguacgccaaguucga

SEQ ID NO: 91469 - RNA, 19 nt, Homo sapiens
gggcaauguacgccaaguu

SEQ ID NO: 91470 - RNA, 19 nt, Homo sapiens
gauggaacagaccgaagug

SEQ ID NO: 91471 - RNA, 19 nt, Homo sapiens
uuauuugccuggccugaca

SEQ ID NO: 91472 - RNA, 19 nt, Homo sapiens
auacuaggagcgucaguga

SEQ ID NO: 91473 - RNA, 19 nt, Homo sapiens
uacccgaaaucuuguggau

SEQ ID NO: 91474 - RNA, 19 nt, Homo sapiens
gccaauacuuagaucuacu

SEQ ID NO: 91475 - RNA, 19 nt, Homo sapiens
cacaacaaaccaaaacaua

SEQ ID NO: 91476 - RNA, 19 nt, Homo sapiens
ugaacuguaauuagcaaga

SEQ ID NO: 91477 - RNA, 19 nt, Homo sapiens
acuuuaagguucgcuguau

SEQ ID NO: 91478 - RNA, 19 nt, Homo sapiens
gcuuacaucgaguagagaa

SEQ ID NO: 91479 - RNA, 19 nt, Homo sapiens
cagcaguauucaugaucau

SEQ ID NO: 91480 - RNA, 19 nt, Homo sapiens
uggcagcaguauucaugau

SEQ ID NO: 91481 - RNA, 19 nt, Homo sapiens
ggaagaccuugaaauuauu

SEQ ID NO: 91482 - RNA, 19 nt, Homo sapiens
uggaagaccuugaaauuau

SEQ ID NO: 91483 - RNA, 19 nt, Homo sapiens
gauggaagaccuugaaauu

SEQ ID NO: 91484 - RNA, 19 nt, Homo sapiens
caaauuauccggaagacuu

SEQ ID NO: 91485 - RNA, 19 nt, Homo sapiens
agacauaccuuuguuggaa

SEQ ID NO: 91486 - RNA, 19 nt, Homo sapiens
gaaauuauuggaagacaug

SEQ ID NO: 91487 - RNA, 19 nt, Homo sapiens
agaacuagauuuacuggaa

SEQ ID NO: 91488 - RNA, 19 nt, Homo sapiens
agacauggcuuuguuggaa

SEQ ID NO: 91489 - RNA, 19 nt, Homo sapiens
agacauggcuuuguuggaa

SEQ ID NO: 91490 - RNA, 19 nt, Homo sapiens
ggaagacauuaauuugaug

SEQ ID NO: 91491 - RNA, 19 nt, Homo sapiens
gcuggaagaucuguauuug

SEQ ID NO: 91492 - RNA, 19 nt, Homo sapiens
caaguaggcuggaagacau

SEQ ID NO: 91493 - RNA, 19 nt, Homo sapiens
uggaagaucuguauuugau

SEQ ID NO: 91494 - RNA, 19 nt, Homo sapiens
agacauggcuugguuggaa

SEQ ID NO: 91495 - RNA, 19 nt, Homo sapiens
gagcuuaguuggaagacau

SEQ ID NO: 91496 - RNA, 19 nt, Homo sapiens
agacauauauuggcuggaa

SEQ ID NO: 91497 - RNA, 19 nt, Homo sapiens
cggaagacuuggauuguug

SEQ ID NO: 91498 - RNA, 19 nt, Homo sapiens
agacguaccuuuguuggaa

SEQ ID NO: 91499 - RNA, 19 nt, Homo sapiens
agacguaccuuuguuggaa

SEQ ID NO: 91500 - RNA, 19 nt, Homo sapiens
agacguaccuuuguuggaa

SEQ ID NO: 91501 - RNA, 19 nt, Homo sapiens
agacguggaucuucaggaa

SEQ ID NO: 91502 - RNA, 19 nt, Homo sapiens
uggauuagcuggaagaucu

SEQ ID NO: 91503 - RNA, 19 nt, Homo sapiens
uggaagacauggcuuuguu

SEQ ID NO: 91504 - RNA, 19 nt, Homo sapiens
uggaagacauggcuuuguu

SEQ ID NO: 91505 - RNA, 19 nt, Homo sapiens
agacauggauuagcuggaa

SEQ ID NO: 91506 - RNA, 19 nt, Homo sapiens
uaagggaagacaaggauuu

SEQ ID NO: 91507 - RNA, 19 nt, Homo sapiens
ggaagacguaccuuuguug

SEQ ID NO: 91508 - RNA, 19 nt, Homo sapiens
ggaagacguaccuuuguug

SEQ ID NO: 91509 - RNA, 19 nt, Homo sapiens
ggaagacguaccuuuguug

SEQ ID NO: 91510 - RNA, 19 nt, Homo sapiens
ucaggaagacccaaauuau

SEQ ID NO: 91511 - RNA, 19 nt, Homo sapiens
uggaagacauggcuugguu

SEQ ID NO: 91512 - RNA, 19 nt, Homo sapiens
gcuggaagacauuaauuug

SEQ ID NO: 91513 - RNA, 19 nt, Homo sapiens
uggaagaucuggauuuggu

SEQ ID NO: 91514 - RNA, 19 nt, Homo sapiens
ucuggaagaacuagauuua

SEQ ID NO: 91515 - RNA, 19 nt, Homo sapiens
gaagaccuugaaauuauug

SEQ ID NO: 91516 - RNA, 19 nt, Homo sapiens
ggagguuacuggaagacau

SEQ ID NO: 91517 - RNA, 19 nt, Homo sapiens
ucuggaagcucaggauuau

SEQ ID NO: 91518 - RNA, 19 nt, Homo sapiens
gguggaagaccaguaauug

SEQ ID NO: 91519 - RNA, 19 nt, Homo sapiens
ggaagacauaccuuuguug

SEQ ID NO: 91520 - RNA, 19 nt, Homo sapiens
uggaagacauaccuuuguu

SEQ ID NO: 91521 - RNA, 19 nt, Homo sapiens
ggaagaacuagauuuacug

SEQ ID NO: 91522 - RNA, 19 nt, Homo sapiens
uggaagaccuggauuuggu

SEQ ID NO: 91523 - RNA, 19 nt, Homo sapiens
uggaagaccugaggccauu

SEQ ID NO: 91524 - RNA, 19 nt, Homo sapiens
uggauugucuggaagaugu

SEQ ID NO: 91525 - RNA, 19 nt, Homo sapiens
agacuuggauuugguggaa

SEQ ID NO: 91526 - RNA, 19 nt, Homo sapiens
agacacugauugacuggaa

SEQ ID NO: 91527 - RNA, 19 nt, Homo sapiens
agacacugauugacuggaa

SEQ ID NO: 91528 - RNA, 19 nt, Homo sapiens
ggaagacauggcuuuguug

SEQ ID NO: 91529 - RNA, 19 nt, Homo sapiens
ggaagacauggcuuuguug

SEQ ID NO: 91530 - RNA, 19 nt, Homo sapiens
ccuggaagaucuggauuug

SEQ ID NO: 91531 - RNA, 19 nt, Homo sapiens
uggaagacguaccuuuguu

SEQ ID NO: 91532 - RNA, 19 nt, Homo sapiens
uggaagacguaccuuuguu

SEQ ID NO: 91533 - RNA, 19 nt, Homo sapiens
uggaagacguaccuuuguu

SEQ ID NO: 91534 - RNA, 19 nt, Homo sapiens
uagauuuacuggaagacuu

SEQ ID NO: 91535 - RNA, 19 nt, Homo sapiens
uggaagacuugauuuacug

SEQ ID NO: 91536 - RNA, 19 nt, Homo sapiens
uggaagaacuagauuuacu

SEQ ID NO: 91537 - RNA, 19 nt, Homo sapiens
agacguagauuuucaggaa

SEQ ID NO: 91538 - RNA, 19 nt, Homo sapiens
ugagggaagacaaggauuu

SEQ ID NO: 91539 - RNA, 19 nt, Homo sapiens
agacguggauuugcuggaa

SEQ ID NO: 91540 - RNA, 19 nt, Homo sapiens
agauguggauugacuggaa

SEQ ID NO: 91541 - RNA, 19 nt, Homo sapiens
ggauuugguggaagacgua

SEQ ID NO: 91542 - RNA, 19 nt, Homo sapiens
cggaagauguggauugacu

SEQ ID NO: 91543 - RNA, 19 nt, Homo sapiens
agacauggauuuucuggaa

SEQ ID NO: 91544 - RNA, 19 nt, Homo sapiens
agacauggauuuucuggaa

SEQ ID NO: 91545 - RNA, 19 nt, Homo sapiens
agacaaggauuuucuggaa

SEQ ID NO: 91546 - RNA, 19 nt, Homo sapiens
agacaaggauuuucuggaa

SEQ ID NO: 91547 - RNA, 19 nt, Homo sapiens
uggauuugcuggaagacuu

SEQ ID NO: 91548 - RNA, 19 nt, Homo sapiens
gacuggauuugcuggaaga

SEQ ID NO: 91549 - RNA, 19 nt, Homo sapiens
guuggaagacguaccuuug

SEQ ID NO: 91550 - RNA, 19 nt, Homo sapiens
gacuggaagaucuagauuu

SEQ ID NO: 91551 - RNA, 19 nt, Homo sapiens
ccggaagacuuggauuguu

SEQ ID NO: 91552 - RNA, 19 nt, Homo sapiens
guuggaagacguaccuuug

SEQ ID NO: 91553 - RNA, 19 nt, Homo sapiens
gaccuugaaauuauuggaa

SEQ ID NO: 91554 - RNA, 19 nt, Homo sapiens
uggaagacauggauuagcu

SEQ ID NO: 91555 - RNA, 19 nt, Homo sapiens
caggaagacccaaauuauc

SEQ ID NO: 91556 - RNA, 19 nt, Homo sapiens
ggcuggaagacauuaauuu

SEQ ID NO: 91557 - RNA, 19 nt, Homo sapiens
gacuugauuuacuggaaga

SEQ ID NO: 91558 - RNA, 19 nt, Homo sapiens
auggaagaccuugaaauua

SEQ ID NO: 91559 - RNA, 19 nt, Homo sapiens
agaccuggauuucuuucug

SEQ ID NO: 91560 - RNA, 19 nt, Homo sapiens
agaccuggauuucuuucug

SEQ ID NO: 91561 - RNA, 19 nt, Homo sapiens
aagacuugauuuacuggaa

SEQ ID NO: 91562 - RNA, 19 nt, Homo sapiens
gguggaagacguagauuuu

SEQ ID NO: 91563 - RNA, 19 nt, Homo sapiens
gguuggaagacguggauuu

SEQ ID NO: 91564 - RNA, 19 nt, Homo sapiens
uuucggaagcuauggauuu

SEQ ID NO: 91565 - RNA, 19 nt, Homo sapiens
ggaagaucuguauuugaug

SEQ ID NO: 91566 - RNA, 19 nt, Homo sapiens
cugauugacuggaagaucu

SEQ ID NO: 91567 - RNA, 19 nt, Homo sapiens
agaccuggauuugguggaa

SEQ ID NO: 91568 - RNA, 19 nt, Homo sapiens
guugggaagacguggauuu

SEQ ID NO: 91569 - RNA, 19 nt, Homo sapiens
cauuggaagauguggauuu

SEQ ID NO: 91570 - RNA, 19 nt, Homo sapiens
cggaagcuauggauuugag

SEQ ID NO: 91571 - RNA, 19 nt, Homo sapiens
gauggaagacauggcuuug

SEQ ID NO: 91572 - RNA, 19 nt, Homo sapiens
gacuggaagaccuggauuu

SEQ ID NO: 91573 - RNA, 19 nt, Homo sapiens
gacuggaagaccuggauuu

SEQ ID NO: 91574 - RNA, 19 nt, Homo sapiens
gacuggaagaccuggauuu

SEQ ID NO: 91575 - RNA, 19 nt, Homo sapiens
gggaagacguggauuuucu

SEQ ID NO: 91576 - RNA, 19 nt, Homo sapiens
uucaggaagacccaaauua

SEQ ID NO: 91577 - RNA, 19 nt, Homo sapiens
agacacaaguaggcuggaa

SEQ ID NO: 91578 - RNA, 19 nt, Homo sapiens
guuggaagacauaccuuug

SEQ ID NO: 91579 - RNA, 19 nt, Homo sapiens
acuggaagaucuagauuuu

SEQ ID NO: 91580 - RNA, 19 nt, Homo sapiens
ucaggaagacauauauugg

SEQ ID NO: 91581 - RNA, 19 nt, Homo sapiens
gcaaugacauaacugcuua

SEQ ID NO: 91582 - RNA, 19 nt, Homo sapiens
ugacagauauggagauuug

SEQ ID NO: 91583 - RNA, 19 nt, Homo sapiens
gagagacuguagcugauua

SEQ ID NO: 91584 - RNA, 19 nt, Homo sapiens
ugacauaacugcuuaccuu

SEQ ID NO: 91585 - RNA, 19 nt, Homo sapiens
gggcuuaguuggauuuaaa

SEQ ID NO: 91586 - RNA, 19 nt, Homo sapiens
guuccaauaucaaguguua

SEQ ID NO: 91587 - RNA, 19 nt, Homo sapiens
gaaaugcuuccaugaaauu

SEQ ID NO: 91588 - RNA, 19 nt, Homo sapiens
gugaaaugcuuccaugaaa

SEQ ID NO: 91589 - RNA, 19 nt, Homo sapiens
gaagugauguaaacuccuu

SEQ ID NO: 91590 - RNA, 19 nt, Homo sapiens
ggaauucucacucuaacua

SEQ ID NO: 91591 - RNA, 19 nt, Homo sapiens
caaaaugucuuguaccuuu

SEQ ID NO: 91592 - RNA, 19 nt, Homo sapiens
ucaugucacuuuacugaua

SEQ ID NO: 91593 - RNA, 19 nt, Homo sapiens
ggacugacaagaaggaauu

SEQ ID NO: 91594 - RNA, 19 nt, Homo sapiens
uaacuaugaucucguuguu

SEQ ID NO: 91595 - RNA, 19 nt, Homo sapiens
guacugaguuuggugaaga

SEQ ID NO: 91596 - RNA, 19 nt, Homo sapiens
gggaaggacugacaagaag

SEQ ID NO: 91597 - RNA, 19 nt, Homo sapiens
cgacaaagaaacagauauu

SEQ ID NO: 91598 - RNA, 19 nt, Homo sapiens
ccugaagacucaucucauu

SEQ ID NO: 91599 - RNA, 19 nt, Homo sapiens
caaaagagccuucaaaauc

SEQ ID NO: 91600 - RNA, 19 nt, Homo sapiens
gaugacagauauggagauu

SEQ ID NO: 91601 - RNA, 19 nt, Homo sapiens
gcauugcacugucaaccuu

SEQ ID NO: 91602 - RNA, 19 nt, Homo sapiens
ugaguaaguugacgauguu

SEQ ID NO: 91603 - RNA, 19 nt, Homo sapiens
acacuuacuugaucuaugu

SEQ ID NO: 91604 - RNA, 19 nt, Homo sapiens
ucaaagagaagaacaacuu

SEQ ID NO: 91605 - RNA, 19 nt, Homo sapiens
cagauuugauugucaguau

SEQ ID NO: 91606 - RNA, 19 nt, Homo sapiens
ucacuuuacugauaacugu

SEQ ID NO: 91607 - RNA, 19 nt, Homo sapiens
ggacucaugucacuuuacu

SEQ ID NO: 91608 - RNA, 19 nt, Homo sapiens
gacuguagcugauuauuuu

SEQ ID NO: 91609 - RNA, 19 nt, Homo sapiens
gcaauagguugaaguuuug

SEQ ID NO: 91610 - RNA, 19 nt, Homo sapiens
ugaaaugcuuccaugaaau

SEQ ID NO: 91611 - RNA, 19 nt, Homo sapiens
caugucacuuuacugauaa

SEQ ID NO: 91612 - RNA, 19 nt, Homo sapiens
cauguagucuggaguacuu

SEQ ID NO: 91613 - RNA, 19 nt, Homo sapiens
caaguguuaucugcaauga

SEQ ID NO: 91614 - RNA, 19 nt, Homo sapiens
uaucaaguguuaucugcaa

SEQ ID NO: 91615 - RNA, 19 nt, Homo sapiens
gcauguuuguacugaguuu

SEQ ID NO: 91616 - RNA, 19 nt, Homo sapiens
cuugcuagguuucauaauu

SEQ ID NO: 91617 - RNA, 19 nt, Homo sapiens
ugucaaccuuugcaucuuu

SEQ ID NO: 91618 - RNA, 19 nt, Homo sapiens
ccuauguguuauccaaaua

SEQ ID NO: 91619 - RNA, 19 nt, Homo sapiens
gauaauggacagauuugau

SEQ ID NO: 91620 - RNA, 19 nt, Homo sapiens
ucacuuccacccuuucuaa

SEQ ID NO: 91621 - RNA, 19 nt, Homo sapiens
ggagcugcuuuuaauuuua

SEQ ID NO: 91622 - RNA, 19 nt, Homo sapiens
ggacauggugggauaaugg

SEQ ID NO: 91623 - RNA, 19 nt, Homo sapiens
aaaagagccuucaaaauca

SEQ ID NO: 91624 - RNA, 19 nt, Homo sapiens
gaauaccgaagugauguaa

SEQ ID NO: 91625 - RNA, 19 nt, Homo sapiens
ggaauaccgaagugaugua

SEQ ID NO: 91626 - RNA, 19 nt, Homo sapiens
ucgcuaccauagauuuaua

SEQ ID NO: 91627 - RNA, 19 nt, Homo sapiens
uaugaucuaccaugguuua

SEQ ID NO: 91628 - RNA, 19 nt, Homo sapiens
ugaagacucaucucauuga

SEQ ID NO: 91629 - RNA, 19 nt, Homo sapiens
cugaacagcaguuaaauau

SEQ ID NO: 91630 - RNA, 19 nt, Homo sapiens
uaaagggcuuaguuggauu

SEQ ID NO: 91631 - RNA, 19 nt, Homo sapiens
aacaaacacuuacuugauc

SEQ ID NO: 91632 - RNA, 19 nt, Homo sapiens
ucucugaaauuacugugaa

SEQ ID NO: 91633 - RNA, 19 nt, Homo sapiens
gaaggacugacaagaagga

SEQ ID NO: 91634 - RNA, 19 nt, Homo sapiens
aguauuugauggcaacuuu

SEQ ID NO: 91635 - RNA, 19 nt, Homo sapiens
gucaaccuuugcaucuuua

SEQ ID NO: 91636 - RNA, 19 nt, Homo sapiens
gagcaccagcgacaaagaa

SEQ ID NO: 91637 - RNA, 19 nt, Homo sapiens
cuuaugaucuaccaugguu

SEQ ID NO: 91638 - RNA, 19 nt, Homo sapiens
ggaaagagugagcuuguac

SEQ ID NO: 91639 - RNA, 19 nt, Homo sapiens
uaaacuccuucgugacaga

SEQ ID NO: 91640 - RNA, 19 nt, Homo sapiens
uauaucauuugcccucuau

SEQ ID NO: 91641 - RNA, 19 nt, Homo sapiens
gagugagcuuguacccuuu

SEQ ID NO: 91642 - RNA, 19 nt, Homo sapiens
auucauuggugguuucuuu

SEQ ID NO: 91643 - RNA, 19 nt, Homo sapiens
guaaguugacgauguuuua

SEQ ID NO: 91644 - RNA, 19 nt, Homo sapiens
agacuguagcugauuauuu

SEQ ID NO: 91645 - RNA, 19 nt, Homo sapiens
gauauggagauuuggauuc

SEQ ID NO: 91646 - RNA, 19 nt, Homo sapiens
uuuggaggcuucuuugcua

SEQ ID NO: 91647 - RNA, 19 nt, Homo sapiens
gacaaagaaacagauauug

SEQ ID NO: 91648 - RNA, 19 nt, Homo sapiens
uuacucacuuccacccuuu

SEQ ID NO: 91649 - RNA, 19 nt, Homo sapiens
cgagagcaccagcgacaaa

SEQ ID NO: 91650 - RNA, 19 nt, Homo sapiens
guucugggcauccaaguga

SEQ ID NO: 91651 - RNA, 19 nt, Homo sapiens
ccaccauccucagauagaa

SEQ ID NO: 91652 - RNA, 19 nt, Homo sapiens
ccugaacagcaguuaaaua

SEQ ID NO: 91653 - RNA, 19 nt, Homo sapiens
gggcccaaaucccagcaaa

SEQ ID NO: 91654 - RNA, 19 nt, Homo sapiens
gacauaacugcuuaccuuu

SEQ ID NO: 91655 - RNA, 19 nt, Homo sapiens
gcacuuccuccucauguag

SEQ ID NO: 91656 - RNA, 19 nt, Homo sapiens
ggagagacuguagcugauu

SEQ ID NO: 91657 - RNA, 19 nt, Homo sapiens
aguguuaucugcaaugaca

SEQ ID NO: 91658 - RNA, 19 nt, Homo sapiens
agucuggaguacuuucuaa

SEQ ID NO: 91659 - RNA, 19 nt, Homo sapiens
caaccugaacagcaguuaa

SEQ ID NO: 91660 - RNA, 19 nt, Homo sapiens
gggauaauggacagauuug

SEQ ID NO: 91661 - RNA, 19 nt, Homo sapiens
ggaggcuucuuugcuagug

SEQ ID NO: 91662 - RNA, 19 nt, Homo sapiens
ucuaaaggcagucuugaga

SEQ ID NO: 91663 - RNA, 19 nt, Homo sapiens
ccaguggaauaccgaagug

SEQ ID NO: 91664 - RNA, 19 nt, Homo sapiens
agaaacagauauugaugac

SEQ ID NO: 91665 - RNA, 19 nt, Homo sapiens
gccuauguguuauccaaau

SEQ ID NO: 91666 - RNA, 19 nt, Homo sapiens
uaucugcaaugacauaacu

SEQ ID NO: 91667 - RNA, 19 nt, Homo sapiens
gguacuuucuauugugugu

SEQ ID NO: 91668 - RNA, 19 nt, Homo sapiens
gcaaggcacaauaggaagu

SEQ ID NO: 91669 - RNA, 19 nt, Homo sapiens
cauugcugccuauguguua

SEQ ID NO: 91670 - RNA, 19 nt, Homo sapiens
caugauaugguuccuuguu

SEQ ID NO: 91671 - RNA, 19 nt, Homo sapiens
uugaaggcaugauaugguu

SEQ ID NO: 91672 - RNA, 19 nt, Homo sapiens
ggucaagcguccuccuuuu

SEQ ID NO: 91673 - RNA, 19 nt, Homo sapiens
guugguacuuucuauugug

SEQ ID NO: 91674 - RNA, 19 nt, Homo sapiens
ugcaauagguugaaguuuu

SEQ ID NO: 91675 - RNA, 19 nt, Homo sapiens
gcacuuggagcugcuuuua

SEQ ID NO: 91676 - RNA, 19 nt, Homo sapiens
gaauucucacucuaacuau

SEQ ID NO: 91677 - RNA, 19 nt, Homo sapiens
gcccaaaucccagcaaagu

SEQ ID NO: 91678 - RNA, 19 nt, Homo sapiens
cagauauugaugacagaua

SEQ ID NO: 91679 - RNA, 19 nt, Homo sapiens
aggaaagagugagcuugua

SEQ ID NO: 91680 - RNA, 19 nt, Homo sapiens
gcuucagacuuacucacuu

SEQ ID NO: 91681 - RNA, 19 nt, Homo sapiens
ggacaaagcucuuccucuu

SEQ ID NO: 91682 - RNA, 19 nt, Homo sapiens
gcaaauacuucuccagcaa

SEQ ID NO: 91683 - RNA, 19 nt, Homo sapiens
ggugguggcuccaguggua

SEQ ID NO: 91684 - RNA, 19 nt, Homo sapiens
caaacaagcacauacacua

SEQ ID NO: 91685 - RNA, 19 nt, Homo sapiens
caaccaaugacaacucuua

SEQ ID NO: 91686 - RNA, 19 nt, Homo sapiens
ggaagcagcagcucucauu

SEQ ID NO: 91687 - RNA, 19 nt, Homo sapiens
caaagcuccucucuugauu

SEQ ID NO: 91688 - RNA, 19 nt, Homo sapiens
auucaaagcuccucucuug

SEQ ID NO: 91689 - RNA, 19 nt, Homo sapiens
ccagggaccuuggcuaaga

SEQ ID NO: 91690 - RNA, 19 nt, Homo sapiens
gcacaaacaagcacauaca

SEQ ID NO: 91691 - RNA, 19 nt, Homo sapiens
caaagagaacccugugaaa

SEQ ID NO: 91692 - RNA, 19 nt, Homo sapiens
aaucaccucuguagacaaa

SEQ ID NO: 91693 - RNA, 19 nt, Homo sapiens
acaauucccucuacugugu

SEQ ID NO: 91694 - RNA, 19 nt, Homo sapiens
gcucugcucugccaaccaa

SEQ ID NO: 91695 - RNA, 19 nt, Homo sapiens
gcauaggguuagcucaguu

SEQ ID NO: 91696 - RNA, 19 nt, Homo sapiens
acaagcacauacacuauau

SEQ ID NO: 91697 - RNA, 19 nt, Homo sapiens
ggaucuggcucuagucuac

SEQ ID NO: 91698 - RNA, 19 nt, Homo sapiens
gguugcagacucucucuua

SEQ ID NO: 91699 - RNA, 19 nt, Homo sapiens
ccaaagagaacccugugaa

SEQ ID NO: 91700 - RNA, 19 nt, Homo sapiens
cagcagcagcuuccaagua

SEQ ID NO: 91701 - RNA, 19 nt, Homo sapiens
gauucucuccuacuguuua

SEQ ID NO: 91702 - RNA, 19 nt, Homo sapiens
ccucuacuguguugaaaug

SEQ ID NO: 91703 - RNA, 19 nt, Homo sapiens
gaccuuggcuaagagcauu

SEQ ID NO: 91704 - RNA, 19 nt, Homo sapiens
uacaguggcuccagcaguu

SEQ ID NO: 91705 - RNA, 19 nt, Homo sapiens
ccaaucaccucuguagaca

SEQ ID NO: 91706 - RNA, 19 nt, Homo sapiens
ccaaauaaagcaaagucaa

SEQ ID NO: 91707 - RNA, 19 nt, Homo sapiens
gcaugucugucuccuccuu

SEQ ID NO: 91708 - RNA, 19 nt, Homo sapiens
gcaaagucaaaccaucaaa

SEQ ID NO: 91709 - RNA, 19 nt, Homo sapiens
gcuccucucuugauucucu

SEQ ID NO: 91710 - RNA, 19 nt, Homo sapiens
aaacaagcacauacacuau

SEQ ID NO: 91711 - RNA, 19 nt, Homo sapiens
cccagcaguucuagcauuu

SEQ ID NO: 91712 - RNA, 19 nt, Homo sapiens
ggcaugaccuacaguaagg

SEQ ID NO: 91713 - RNA, 19 nt, Homo sapiens
gagcagcagcagcagcuuu

SEQ ID NO: 91714 - RNA, 19 nt, Homo sapiens
ugcagacucucucuuauca

SEQ ID NO: 91715 - RNA, 19 nt, Homo sapiens
caacucuuaccgcggaaua

SEQ ID NO: 91716 - RNA, 19 nt, Homo sapiens
ucugacgccugaagaaguu

SEQ ID NO: 91717 - RNA, 19 nt, Homo sapiens
guggguggcuccucugaca

SEQ ID NO: 91718 - RNA, 19 nt, Homo sapiens
gguauucccaggucagcua

SEQ ID NO: 91719 - RNA, 19 nt, Homo sapiens
gcagcuuccucggccauug

SEQ ID NO: 91720 - RNA, 19 nt, Homo sapiens
ggaagcagcggcucucacu

SEQ ID NO: 91721 - RNA, 19 nt, Homo sapiens
gggcacaaacaagcacaua

SEQ ID NO: 91722 - RNA, 19 nt, Homo sapiens
ccuccuuccucuucucaaa

SEQ ID NO: 91723 - RNA, 19 nt, Homo sapiens
guugcagacucucucuuau

SEQ ID NO: 91724 - RNA, 19 nt, Homo sapiens
aacaagcacauacacuaua

SEQ ID NO: 91725 - RNA, 19 nt, Homo sapiens
gagcauuggcaccuucuca

SEQ ID NO: 91726 - RNA, 19 nt, Homo sapiens
ugaccuacaguaaggguaa

SEQ ID NO: 91727 - RNA, 19 nt, Homo sapiens
uagcucaguuucccuccuu

SEQ ID NO: 91728 - RNA, 19 nt, Homo sapiens
gauauccuagcccaaguga

SEQ ID NO: 91729 - RNA, 19 nt, Homo sapiens
aaagagaacccugugaaag

SEQ ID NO: 91730 - RNA, 19 nt, Homo sapiens
gcauuggcaccuucucaga

SEQ ID NO: 91731 - RNA, 19 nt, Homo sapiens
cagcagcagcuuucaguuc

SEQ ID NO: 91732 - RNA, 19 nt, Homo sapiens
ucaccucuguagacaaauc

SEQ ID NO: 91733 - RNA, 19 nt, Homo sapiens
caaccagcgucccuguagu

SEQ ID NO: 91734 - RNA, 19 nt, Homo sapiens
gacaaagcucuuccucuuc

SEQ ID NO: 91735 - RNA, 19 nt, Homo sapiens
gaagcagcagcucucauuc

SEQ ID NO: 91736 - RNA, 19 nt, Homo sapiens
uugauucucuccuacuguu

SEQ ID NO: 91737 - RNA, 19 nt, Homo sapiens
gagugguucugcuuucucu

SEQ ID NO: 91738 - RNA, 19 nt, Homo sapiens
uauccuagcccaagugaag

SEQ ID NO: 91739 - RNA, 19 nt, Homo sapiens
gaccuacaguaaggguaaa

SEQ ID NO: 91740 - RNA, 19 nt, Homo sapiens
cccaucaccuucucaacug

SEQ ID NO: 91741 - RNA, 19 nt, Homo sapiens
uuacaauucccucuacugu

SEQ ID NO: 91742 - RNA, 19 nt, Homo sapiens
gguucugcuuucucuacua

SEQ ID NO: 91743 - RNA, 19 nt, Homo sapiens
guuacucgacaguccauaa

SEQ ID NO: 91744 - RNA, 19 nt, Homo sapiens
gggauauccuagcccaagu

SEQ ID NO: 91745 - RNA, 19 nt, Homo sapiens
gccaaccaaugacaacucu

SEQ ID NO: 91746 - RNA, 19 nt, Homo sapiens
agcagcagcuuccaaguag

SEQ ID NO: 91747 - RNA, 19 nt, Homo sapiens
ccaggcaugaccuacagua

SEQ ID NO: 91748 - RNA, 19 nt, Homo sapiens
uggcuccucugacaguuau

SEQ ID NO: 91749 - RNA, 19 nt, Homo sapiens
aagcaaagucaaaccauca

SEQ ID NO: 91750 - RNA, 19 nt, Homo sapiens
ccaaccagcgucccuguag

SEQ ID NO: 91751 - RNA, 19 nt, Homo sapiens
agcagcagcuuucaguuca

SEQ ID NO: 91752 - RNA, 19 nt, Homo sapiens
guucugcuuucucuacuac

SEQ ID NO: 91753 - RNA, 19 nt, Homo sapiens
cauaggguuagcucaguuu

SEQ ID NO: 91754 - RNA, 19 nt, Homo sapiens
ggcauaggguuagcucagu

SEQ ID NO: 91755 - RNA, 19 nt, Homo sapiens
ucucugagggcaaauacuu

SEQ ID NO: 91756 - RNA, 19 nt, Homo sapiens
aagagaacccugugaaagg

SEQ ID NO: 91757 - RNA, 19 nt, Homo sapiens
gccaaagcgucagcuccaa

SEQ ID NO: 91758 - RNA, 19 nt, Homo sapiens
aagcuccucucuugauucu

SEQ ID NO: 91759 - RNA, 19 nt, Homo sapiens
cuaagagcauuggcaccuu

SEQ ID NO: 91760 - RNA, 19 nt, Homo sapiens
gcuagcugacccugaaguu

SEQ ID NO: 91761 - RNA, 19 nt, Homo sapiens
gcagcaaguccagcucuuc

SEQ ID NO: 91762 - RNA, 19 nt, Homo sapiens
guaaggaccccacgcguau

SEQ ID NO: 91763 - RNA, 19 nt, Homo sapiens
ggcagcaaguccagcucuu

SEQ ID NO: 91764 - RNA, 19 nt, Homo sapiens
gcagcagcagcuuucaguu

SEQ ID NO: 91765 - RNA, 19 nt, Homo sapiens
caaagucaaaccaucaaaa

SEQ ID NO: 91766 - RNA, 19 nt, Homo sapiens
uaaagcaaagucaaaccau

SEQ ID NO: 91767 - RNA, 19 nt, Homo sapiens
caaaagagugguucugcuu

SEQ ID NO: 91768 - RNA, 19 nt, Homo sapiens
gacuccagcggcuucagua

SEQ ID NO: 91769 - RNA, 19 nt, Homo sapiens
ggauauccuagcccaagug

SEQ ID NO: 91770 - RNA, 19 nt, Homo sapiens
ugggcuacuucaccaaaga

SEQ ID NO: 91771 - RNA, 19 nt, Homo sapiens
ucuuaccgcggaauacuaa

SEQ ID NO: 91772 - RNA, 19 nt, Homo sapiens
uccagcggauccagcauug

SEQ ID NO: 91773 - RNA, 19 nt, Homo sapiens
uagcugacccugaaguuuu

SEQ ID NO: 91774 - RNA, 19 nt, Homo sapiens
cagcuacuccuccggaucu

SEQ ID NO: 91775 - RNA, 19 nt, Homo sapiens
caggcaugaccuacaguaa

SEQ ID NO: 91776 - RNA, 19 nt, Homo sapiens
gaauaaaguuacccuugua

SEQ ID NO: 91777 - RNA, 19 nt, Homo sapiens
ccacgaagauccuaccaaa

SEQ ID NO: 91778 - RNA, 19 nt, Homo sapiens
gauacaaacuggacucuca

SEQ ID NO: 91779 - RNA, 19 nt, Homo sapiens
caccaucacucgcaagaga

SEQ ID NO: 91780 - RNA, 19 nt, Homo sapiens
agaauaaaguuacccuugu

SEQ ID NO: 91781 - RNA, 19 nt, Homo sapiens
ucaccagguuguagaaguu

SEQ ID NO: 91782 - RNA, 19 nt, Homo sapiens
gagaauccccuccaucuuu

SEQ ID NO: 91783 - RNA, 19 nt, Homo sapiens
uaaaguuacccuuguacug

SEQ ID NO: 91784 - RNA, 19 nt, Homo sapiens
ugccagacaucaccagguu

SEQ ID NO: 91785 - RNA, 19 nt, Homo sapiens
uaauccaccucuucugcuu

SEQ ID NO: 91786 - RNA, 19 nt, Homo sapiens
gaagauccuaccaaaauga

SEQ ID NO: 91787 - RNA, 19 nt, Homo sapiens
ccaucagccuccugguuau

SEQ ID NO: 91788 - RNA, 19 nt, Homo sapiens
ugacacgucucagccuuag

SEQ ID NO: 91789 - RNA, 19 nt, Homo sapiens
gaaacagcugccaccauca

SEQ ID NO: 91790 - RNA, 19 nt, Homo sapiens
gcggaggcauuuuccuuuu

SEQ ID NO: 91791 - RNA, 19 nt, Homo sapiens
cagcaugagcggaggcauu

SEQ ID NO: 91792 - RNA, 19 nt, Homo sapiens
guuaugguacagauacaaa

SEQ ID NO: 91793 - RNA, 19 nt, Homo sapiens
gacaucaccagguuguaga

SEQ ID NO: 91794 - RNA, 19 nt, Homo sapiens
gugacacgucucagccuua

SEQ ID NO: 91795 - RNA, 19 nt, Homo sapiens
ccagacaucaccagguugu

SEQ ID NO: 91796 - RNA, 19 nt, Homo sapiens
caccucuucugcuucaguu

SEQ ID NO: 91797 - RNA, 19 nt, Homo sapiens
cgaagauccuaccaaaaug

SEQ ID NO: 91798 - RNA, 19 nt, Homo sapiens
gcgcuuccucuuccuccua

SEQ ID NO: 91799 - RNA, 19 nt, Homo sapiens
gcaagagaauccccuccau

SEQ ID NO: 91800 - RNA, 19 nt, Homo sapiens
acuggacucucaggacaaa

SEQ ID NO: 91801 - RNA, 19 nt, Homo sapiens
ccucuucugcuucaguuga

SEQ ID NO: 91802 - RNA, 19 nt, Homo sapiens
ggaugcagcuucaagaaua

SEQ ID NO: 91803 - RNA, 19 nt, Homo sapiens
ggacagguguuguauauag

SEQ ID NO: 91804 - RNA, 19 nt, Homo sapiens
gcaguaagccuguuggaua

SEQ ID NO: 91805 - RNA, 19 nt, Homo sapiens
gugaagaucugguuccaaa

SEQ ID NO: 91806 - RNA, 19 nt, Homo sapiens
gagaaggaguuucauuaca

SEQ ID NO: 91807 - RNA, 19 nt, Homo sapiens
gcaaaggagcgcaaaguga

SEQ ID NO: 91808 - RNA, 19 nt, Homo sapiens
caguaagccuguuggauaa

SEQ ID NO: 91809 - RNA, 19 nt, Homo sapiens
gcaaagugaacaagaagaa

SEQ ID NO: 91810 - RNA, 19 nt, Homo sapiens
caaaggagcgcaaagugaa

SEQ ID NO: 91811 - RNA, 19 nt, Homo sapiens
gaugcagcuucaagaauaa

SEQ ID NO: 91812 - RNA, 19 nt, Homo sapiens
gaaaagggauggagcugaa

SEQ ID NO: 91813 - RNA, 19 nt, Homo sapiens
gcuaugugcuggacaagga

SEQ ID NO: 91814 - RNA, 19 nt, Homo sapiens
aagaggaguuucugccaua

SEQ ID NO: 91815 - RNA, 19 nt, Homo sapiens
ggaggaacguggucaacuc

SEQ ID NO: 91816 - RNA, 19 nt, Homo sapiens
uggagaaggaguuucauua

SEQ ID NO: 91817 - RNA, 19 nt, Homo sapiens
ccacuggguuacagaauca

SEQ ID NO: 91818 - RNA, 19 nt, Homo sapiens
ugagggcucuggauugaga

SEQ ID NO: 91819 - RNA, 19 nt, Homo sapiens
ucacagcccucaugaucau

SEQ ID NO: 91820 - RNA, 19 nt, Homo sapiens
ccacacugauccuggagaa

SEQ ID NO: 91821 - RNA, 19 nt, Homo sapiens
cuggacagguguuguauau

SEQ ID NO: 91822 - RNA, 19 nt, Homo sapiens
ggaacguggucaacucaca

SEQ ID NO: 91823 - RNA, 19 nt, Homo sapiens
gccuggagcuggagaagga

SEQ ID NO: 91824 - RNA, 19 nt, Homo sapiens
gacagguguuguauauaga

SEQ ID NO: 91825 - RNA, 19 nt, Homo sapiens
ccauagcacugggcucuga

SEQ ID NO: 91826 - RNA, 19 nt, Homo sapiens
ggagaaggaguuucauuac

SEQ ID NO: 91827 - RNA, 19 nt, Homo sapiens
caggguggaugaucucaau

SEQ ID NO: 91828 - RNA, 19 nt, Homo sapiens
guaagacucggaccaagga

SEQ ID NO: 91829 - RNA, 19 nt, Homo sapiens
gaagaaacagcagcagcaa

SEQ ID NO: 91830 - RNA, 19 nt, Homo sapiens
agaaggaguuucauuacag

SEQ ID NO: 91831 - RNA, 19 nt, Homo sapiens
uuacagccguuacaucaca

SEQ ID NO: 91832 - RNA, 19 nt, Homo sapiens
cauuacagccguuacauca

SEQ ID NO: 91833 - RNA, 19 nt, Homo sapiens
ccauguaugugggcuaugu

SEQ ID NO: 91834 - RNA, 19 nt, Homo sapiens
caaagugaacaagaagaaa

SEQ ID NO: 91835 - RNA, 19 nt, Homo sapiens
gaacggcaggugaagaucu

SEQ ID NO: 91836 - RNA, 19 nt, Homo sapiens
cagcuggacagguguugua

SEQ ID NO: 91837 - RNA, 19 nt, Homo sapiens
ggaccaagcagagcucaca

SEQ ID NO: 91838 - RNA, 19 nt, Homo sapiens
agugagggcucuggauuga

SEQ ID NO: 91839 - RNA, 19 nt, Homo sapiens
guaagccuguuggauaaag

SEQ ID NO: 91840 - RNA, 19 nt, Homo sapiens
agaaacagcagcagcaaca

SEQ ID NO: 91841 - RNA, 19 nt, Homo sapiens
gagcgcaaagugaacaaga

SEQ ID NO: 91842 - RNA, 19 nt, Homo sapiens
gcagcuucaagaauaaauu

SEQ ID NO: 91843 - RNA, 19 nt, Homo sapiens
cagaaucacagcccucaug

SEQ ID NO: 91844 - RNA, 19 nt, Homo sapiens
agucuucccuaccagguuu

SEQ ID NO: 91845 - RNA, 19 nt, Homo sapiens
ggcagagucuucccuacca

SEQ ID NO: 91846 - RNA, 19 nt, Homo sapiens
ucaugaucauucucaguga

SEQ ID NO: 91847 - RNA, 19 nt, Homo sapiens
gggacaugguggacaguca

SEQ ID NO: 91848 - RNA, 19 nt, Homo sapiens
ucucuuggaugcagcuuca

SEQ ID NO: 91849 - RNA, 19 nt, Homo sapiens
acaaguaccgcguggucua

SEQ ID NO: 91850 - RNA, 19 nt, Homo sapiens
ucagugagggcucuggauu

SEQ ID NO: 91851 - RNA, 19 nt, Homo sapiens
gcuggauacuaagcacaaa

SEQ ID NO: 91852 - RNA, 19 nt, Homo sapiens
gaggaacguggucaacuca

SEQ ID NO: 91853 - RNA, 19 nt, Homo sapiens
uaagccuguuggauaaaga

SEQ ID NO: 91854 - RNA, 19 nt, Homo sapiens
gcuggacagguguuguaua

SEQ ID NO: 91855 - RNA, 19 nt, Homo sapiens
gggcaaaggagcgcaaagu

SEQ ID NO: 91856 - RNA, 19 nt, Homo sapiens
caccauguaugugggcuau

SEQ ID NO: 91857 - RNA, 19 nt, Homo sapiens
ggcaaaggagcgcaaagug

SEQ ID NO: 91858 - RNA, 19 nt, Homo sapiens
acaaggauucgcccgugua

SEQ ID NO: 91859 - RNA, 19 nt, Homo sapiens
uggcugcuccacuggguua

SEQ ID NO: 91860 - RNA, 19 nt, Homo sapiens
ccuguuggauaaagaccuu

SEQ ID NO: 91861 - RNA, 19 nt, Homo sapiens
agaaucacagcccucauga

SEQ ID NO: 91862 - RNA, 19 nt, Homo sapiens
ccuuccagcuccuguguuc

SEQ ID NO: 91863 - RNA, 19 nt, Homo sapiens
ggccaccuccucuccaaug

SEQ ID NO: 91864 - RNA, 19 nt, Homo sapiens
gcgcaaagugaacaagaag

SEQ ID NO: 91865 - RNA, 19 nt, Homo sapiens
uguuguauauagaguggaa

SEQ ID NO: 91866 - RNA, 19 nt, Homo sapiens
cgacuucuccagcuacucu

SEQ ID NO: 91867 - RNA, 19 nt, Homo sapiens
acucacaccugccucuucu

SEQ ID NO: 91868 - RNA, 19 nt, Homo sapiens
gguggaugaucucaaucuc

SEQ ID NO: 91869 - RNA, 19 nt, Homo sapiens
ggagcuggagaaggaguuu

SEQ ID NO: 91870 - RNA, 19 nt, Homo sapiens
cuccaaugccugugaaaga

SEQ ID NO: 91871 - RNA, 19 nt, Homo sapiens
gaaauauacucucccagau

SEQ ID NO: 91872 - RNA, 19 nt, Homo sapiens
gagagggacucaagggaaa

SEQ ID NO: 91873 - RNA, 19 nt, Homo sapiens
aauauacucucccagauuu

SEQ ID NO: 91874 - RNA, 19 nt, Homo sapiens
gaauguaugucagugcuau

SEQ ID NO: 91875 - RNA, 19 nt, Homo sapiens
gccaaaggcagcuaagaua

SEQ ID NO: 91876 - RNA, 19 nt, Homo sapiens
gcucuucucuuccuagauc

SEQ ID NO: 91877 - RNA, 19 nt, Homo sapiens
gagaaggaguuucacuaca

SEQ ID NO: 91878 - RNA, 19 nt, Homo sapiens
gaaggaguuucacuacagu

SEQ ID NO: 91879 - RNA, 19 nt, Homo sapiens
guaugucagugcuauaaau

SEQ ID NO: 91880 - RNA, 19 nt, Homo sapiens
aaaggcagcuaagauagaa

SEQ ID NO: 91881 - RNA, 19 nt, Homo sapiens
gagcuucucugggcugaau

SEQ ID NO: 91882 - RNA, 19 nt, Homo sapiens
aagcuggacugaccaaaga

SEQ ID NO: 91883 - RNA, 19 nt, Homo sapiens
acaaggacgugagcaugua

SEQ ID NO: 91884 - RNA, 19 nt, Homo sapiens
caaaggcagcuaagauaga

SEQ ID NO: 91885 - RNA, 19 nt, Homo sapiens
gggaguauuugaacacagu

SEQ ID NO: 91886 - RNA, 19 nt, Homo sapiens
ggcuggagcuggagaagga

SEQ ID NO: 91887 - RNA, 19 nt, Homo sapiens
acaaauaucgaguggugua

SEQ ID NO: 91888 - RNA, 19 nt, Homo sapiens
ccaggacgaaagacaaaua

SEQ ID NO: 91889 - RNA, 19 nt, Homo sapiens
ucucugggcugaauguaug

SEQ ID NO: 91890 - RNA, 19 nt, Homo sapiens
gaaaggcuuggcuggugua

SEQ ID NO: 91891 - RNA, 19 nt, Homo sapiens
ggacgaaagacaaauaucg

SEQ ID NO: 91892 - RNA, 19 nt, Homo sapiens
gggaguuuguguuguuguu

SEQ ID NO: 91893 - RNA, 19 nt, Homo sapiens
ggacugaccacaccaacca

SEQ ID NO: 91894 - RNA, 19 nt, Homo sapiens
ugagcuaccuccuggacaa

SEQ ID NO: 91895 - RNA, 19 nt, Homo sapiens
ggagaaggaguuucacuac

SEQ ID NO: 91896 - RNA, 19 nt, Homo sapiens
ucacuacagucgcuacauc

SEQ ID NO: 91897 - RNA, 19 nt, Homo sapiens
gcagagcaaaggagaggaa

SEQ ID NO: 91898 - RNA, 19 nt, Homo sapiens
ggagaagugauauggugaa

SEQ ID NO: 91899 - RNA, 19 nt, Homo sapiens
uaacauccaagccagaguu

SEQ ID NO: 91900 - RNA, 19 nt, Homo sapiens
caaccuggacuuccuguca

SEQ ID NO: 91901 - RNA, 19 nt, Homo sapiens
acagggacuuguuuagaga

SEQ ID NO: 91902 - RNA, 19 nt, Homo sapiens
gagcguggacucugcuaga

SEQ ID NO: 91903 - RNA, 19 nt, Homo sapiens
agaaggaguuucacuacag

SEQ ID NO: 91904 - RNA, 19 nt, Homo sapiens
ggaagccaaaggcagcuaa

SEQ ID NO: 91905 - RNA, 19 nt, Homo sapiens
aaauauacucucccagauu

SEQ ID NO: 91906 - RNA, 19 nt, Homo sapiens
gaagggaaguggggaguau

SEQ ID NO: 91907 - RNA, 19 nt, Homo sapiens
gacaaggacgugagcaugu

SEQ ID NO: 91908 - RNA, 19 nt, Homo sapiens
uaagacaagugggauuugg

SEQ ID NO: 91909 - RNA, 19 nt, Homo sapiens
ccacagccauagaccuaca

SEQ ID NO: 91910 - RNA, 19 nt, Homo sapiens
gagaagugauauggugaag

SEQ ID NO: 91911 - RNA, 19 nt, Homo sapiens
ccaaaggcagcuaagauag

SEQ ID NO: 91912 - RNA, 19 nt, Homo sapiens
ccacugaggagacagaaag

SEQ ID NO: 91913 - RNA, 19 nt, Homo sapiens
gacgaaagacaaauaucga

SEQ ID NO: 91914 - RNA, 19 nt, Homo sapiens
gagccaaccuggacuuccu

SEQ ID NO: 91915 - RNA, 19 nt, Homo sapiens
auaaaugagcuuuccagaa

SEQ ID NO: 91916 - RNA, 19 nt, Homo sapiens
agaggaaaaucaacaagaa

SEQ ID NO: 91917 - RNA, 19 nt, Homo sapiens
aggcuuggcugguguaugc

SEQ ID NO: 91918 - RNA, 19 nt, Homo sapiens
cagcucuucucuuccuaga

SEQ ID NO: 91919 - RNA, 19 nt, Homo sapiens
gcaaaggagaggaaaauca

SEQ ID NO: 91920 - RNA, 19 nt, Homo sapiens
uggagaaggaguuucacua

SEQ ID NO: 91921 - RNA, 19 nt, Homo sapiens
aaaccaggacgaaagacaa

SEQ ID NO: 91922 - RNA, 19 nt, Homo sapiens
guaagacaagugggauuug

SEQ ID NO: 91923 - RNA, 19 nt, Homo sapiens
gaguaagacaagugggauu

SEQ ID NO: 91924 - RNA, 19 nt, Homo sapiens
gaaguggggaguauuugaa

SEQ ID NO: 91925 - RNA, 19 nt, Homo sapiens
gaaagcuggacugaccaaa

SEQ ID NO: 91926 - RNA, 19 nt, Homo sapiens
ggagccaggaguaagacaa

SEQ ID NO: 91927 - RNA, 19 nt, Homo sapiens
ggaaaaucaacaagaagaa

SEQ ID NO: 91928 - RNA, 19 nt, Homo sapiens
caaaggagaggaaaaucaa

SEQ ID NO: 91929 - RNA, 19 nt, Homo sapiens
cuucugggcugcugcaaac

SEQ ID NO: 91930 - RNA, 19 nt, Homo sapiens
uuucagaaccgcagagcaa

SEQ ID NO: 91931 - RNA, 19 nt, Homo sapiens
caggacgaaagacaaauau

SEQ ID NO: 91932 - RNA, 19 nt, Homo sapiens
guauuugaacacaguugaa

SEQ ID NO: 91933 - RNA, 19 nt, Homo sapiens
gagccugucaccagagcuu

SEQ ID NO: 91934 - RNA, 19 nt, Homo sapiens
ggacccucgccaccaugua

SEQ ID NO: 91935 - RNA, 19 nt, Homo sapiens
gaagcauugccuggacuga

SEQ ID NO: 91936 - RNA, 19 nt, Homo sapiens
cggacuggcagaagcauug

SEQ ID NO: 91937 - RNA, 19 nt, Homo sapiens
ggagcuggagaaggaguuu

SEQ ID NO: 91938 - RNA, 19 nt, Homo sapiens
gagcaaaggagaggaaaau

SEQ ID NO: 91939 - RNA, 19 nt, Homo sapiens
ggaaguggggaguauuuga

SEQ ID NO: 91940 - RNA, 19 nt, Homo sapiens
ggaguuuguguuguuguug

SEQ ID NO: 91941 - RNA, 19 nt, Homo sapiens
ccucggcagccaagugaaa

SEQ ID NO: 91942 - RNA, 19 nt, Homo sapiens
aguaagacaagugggauuu

SEQ ID NO: 91943 - RNA, 19 nt, Homo sapiens
gagccaggaguaagacaag

SEQ ID NO: 91944 - RNA, 19 nt, Homo sapiens
gagaggaaaaucaacaaga

SEQ ID NO: 91945 - RNA, 19 nt, Homo sapiens
aaucagagcuggcaguuaa

SEQ ID NO: 91946 - RNA, 19 nt, Homo sapiens
ggaauuccauugcaauaga

SEQ ID NO: 91947 - RNA, 19 nt, Homo sapiens
gaaagaagcaggcauguac

SEQ ID NO: 91948 - RNA, 19 nt, Homo sapiens
guucguggauuucaaccua

SEQ ID NO: 91949 - RNA, 19 nt, Homo sapiens
gcaguuaaccugggccuuu

SEQ ID NO: 91950 - RNA, 19 nt, Homo sapiens
ggaacuaccuaacacuuuu

SEQ ID NO: 91951 - RNA, 19 nt, Homo sapiens
gaggcucggugcaaaguga

SEQ ID NO: 91952 - RNA, 19 nt, Homo sapiens
gguuauagucuccgaauga

SEQ ID NO: 91953 - RNA, 19 nt, Homo sapiens
gaaaaggaauuccauugca

SEQ ID NO: 91954 - RNA, 19 nt, Homo sapiens
gggaacuaccuaacacuuu

SEQ ID NO: 91955 - RNA, 19 nt, Homo sapiens
gcagagccaaggagagaaa

SEQ ID NO: 91956 - RNA, 19 nt, Homo sapiens
gaauuccauugcaauagau

SEQ ID NO: 91957 - RNA, 19 nt, Homo sapiens
gaagcugucuuuuggagaa

SEQ ID NO: 91958 - RNA, 19 nt, Homo sapiens
gauuggagcuggaaaagga

SEQ ID NO: 91959 - RNA, 19 nt, Homo sapiens
ggagagaaagaugaucaaa

SEQ ID NO: 91960 - RNA, 19 nt, Homo sapiens
ugaacgacgugaccucuag

SEQ ID NO: 91961 - RNA, 19 nt, Homo sapiens
ugagauacagcagguuaua

SEQ ID NO: 91962 - RNA, 19 nt, Homo sapiens
gaugccagccuccaauuuc

SEQ ID NO: 91963 - RNA, 19 nt, Homo sapiens
aaaagaaaaucucccaguu

SEQ ID NO: 91964 - RNA, 19 nt, Homo sapiens
aagaaaaucucccaguuug

SEQ ID NO: 91965 - RNA, 19 nt, Homo sapiens
agaaaaguaucguguaguu

SEQ ID NO: 91966 - RNA, 19 nt, Homo sapiens
uauccugggccgucuagua

SEQ ID NO: 91967 - RNA, 19 nt, Homo sapiens
caucugcuguucguggauu

SEQ ID NO: 91968 - RNA, 19 nt, Homo sapiens
ggaaaaccaggacaaaaga

SEQ ID NO: 91969 - RNA, 19 nt, Homo sapiens
agaaagaagcaggcaugua

SEQ ID NO: 91970 - RNA, 19 nt, Homo sapiens
gccaaggagagaaagauga

SEQ ID NO: 91971 - RNA, 19 nt, Homo sapiens
ccaaggagagaaagaugau

SEQ ID NO: 91972 - RNA, 19 nt, Homo sapiens
gagaagacuggagcgugua

SEQ ID NO: 91973 - RNA, 19 nt, Homo sapiens
gagagaaagaugaucaaaa

SEQ ID NO: 91974 - RNA, 19 nt, Homo sapiens
uauaucaccauccagagaa

SEQ ID NO: 91975 - RNA, 19 nt, Homo sapiens
auagauauaucaccaucca

SEQ ID NO: 91976 - RNA, 19 nt, Homo sapiens
ccauugcaauagauauauc

SEQ ID NO: 91977 - RNA, 19 nt, Homo sapiens
aaggaauuccauugcaaua

SEQ ID NO: 91978 - RNA, 19 nt, Homo sapiens
aaaguaucguguaguuuac

SEQ ID NO: 91979 - RNA, 19 nt, Homo sapiens
guacggaagcugucuuuug

SEQ ID NO: 91980 - RNA, 19 nt, Homo sapiens
aaagaaaaguaucguguag

SEQ ID NO: 91981 - RNA, 19 nt, Homo sapiens
ccggcuuucucgcacuaua

SEQ ID NO: 91982 - RNA, 19 nt, Homo sapiens
gcaauagauauaucaccau

SEQ ID NO: 91983 - RNA, 19 nt, Homo sapiens
gaccgacuacagcaacuug

SEQ ID NO: 91984 - RNA, 19 nt, Homo sapiens
gagaaagaagcaggcaugu

SEQ ID NO: 91985 - RNA, 19 nt, Homo sapiens
caucagcccuggggaacua

SEQ ID NO: 91986 - RNA, 19 nt, Homo sapiens
aaagaaaaucucccaguuu

SEQ ID NO: 91987 - RNA, 19 nt, Homo sapiens
caccggcuuucucgcacua

SEQ ID NO: 91988 - RNA, 19 nt, Homo sapiens
caguuaaccugggccuuuc

SEQ ID NO: 91989 - RNA, 19 nt, Homo sapiens
cgaugccagccuccaauuu

SEQ ID NO: 91990 - RNA, 19 nt, Homo sapiens
aaaaggaauuccauugcaa

SEQ ID NO: 91991 - RNA, 19 nt, Homo sapiens
gaaaaguaucguguaguuu

SEQ ID NO: 91992 - RNA, 19 nt, Homo sapiens
gagauacagcagguuauag

SEQ ID NO: 91993 - RNA, 19 nt, Homo sapiens
gagccaaggagagaaagau

SEQ ID NO: 91994 - RNA, 19 nt, Homo sapiens
ccugggccgucuaguacaa

SEQ ID NO: 91995 - RNA, 19 nt, Homo sapiens
aaaggaauuccauugcaau

SEQ ID NO: 91996 - RNA, 19 nt, Homo sapiens
gaaaaccaggacaaaagaa

SEQ ID NO: 91997 - RNA, 19 nt, Homo sapiens
gaaaaucucccaguuugag

SEQ ID NO: 91998 - RNA, 19 nt, Homo sapiens
ucgcagagccaaggagaga

SEQ ID NO: 91999 - RNA, 19 nt, Homo sapiens
ucaaagauuggagcuggaa

SEQ ID NO: 92000 - RNA, 19 nt, Homo sapiens
gauacagcagguuauaguc

SEQ ID NO: 92001 - RNA, 19 nt, Homo sapiens
agauacagcagguuauagu

SEQ ID NO: 92002 - RNA, 19 nt, Homo sapiens
gggaaaaccaggacaaaag

SEQ ID NO: 92003 - RNA, 19 nt, Homo sapiens
ggacaugccuuguucauaa

SEQ ID NO: 92004 - RNA, 19 nt, Homo sapiens
gaaguuaccucaucuuuga

SEQ ID NO: 92005 - RNA, 19 nt, Homo sapiens
ggacuaaacuagauugaaa

SEQ ID NO: 92006 - RNA, 19 nt, Homo sapiens
gaacuuuccucagagauua

SEQ ID NO: 92007 - RNA, 19 nt, Homo sapiens
gauaaacccuugauaguuc

SEQ ID NO: 92008 - RNA, 19 nt, Homo sapiens
uaagacaccucaaccuaua

SEQ ID NO: 92009 - RNA, 19 nt, Homo sapiens
gcaauaaaguuucuguaug

SEQ ID NO: 92010 - RNA, 19 nt, Homo sapiens
gaucauccauuucuucuga

SEQ ID NO: 92011 - RNA, 19 nt, Homo sapiens
gaauaaaaguggcacauua

SEQ ID NO: 92012 - RNA, 19 nt, Homo sapiens
uaucaaaccucccaaagaa

SEQ ID NO: 92013 - RNA, 19 nt, Homo sapiens
guggaaaccucccaugaua

SEQ ID NO: 92014 - RNA, 19 nt, Homo sapiens
gaauccagaugacacauuu

SEQ ID NO: 92015 - RNA, 19 nt, Homo sapiens
gagcauauguucuguugug

SEQ ID NO: 92016 - RNA, 19 nt, Homo sapiens
gauggaagaugggaaauug

SEQ ID NO: 92017 - RNA, 19 nt, Homo sapiens
gcacauccuguuucuaaua

SEQ ID NO: 92018 - RNA, 19 nt, Homo sapiens
caauaaaguuucuguaugg

SEQ ID NO: 92019 - RNA, 19 nt, Homo sapiens
ugacauggaugaggaaauu

SEQ ID NO: 92020 - RNA, 19 nt, Homo sapiens
acagugaguuguuugcuua

SEQ ID NO: 92021 - RNA, 19 nt, Homo sapiens
gaugggaaauugaagaguu

SEQ ID NO: 92022 - RNA, 19 nt, Homo sapiens
aaagaaagaugacauggau

SEQ ID NO: 92023 - RNA, 19 nt, Homo sapiens
gcaagagagauaaucaaua

SEQ ID NO: 92024 - RNA, 19 nt, Homo sapiens
cgaaaggacuaaacuagau

SEQ ID NO: 92025 - RNA, 19 nt, Homo sapiens
ugacagaggacugguauua

SEQ ID NO: 92026 - RNA, 19 nt, Homo sapiens
gugaagagcuaaaugcaau

SEQ ID NO: 92027 - RNA, 19 nt, Homo sapiens
ugccagaccugaacuuuaa

SEQ ID NO: 92028 - RNA, 19 nt, Homo sapiens
acagaggacugguauuaaa

SEQ ID NO: 92029 - RNA, 19 nt, Homo sapiens
gaggauguuuggcauugua

SEQ ID NO: 92030 - RNA, 19 nt, Homo sapiens
gagaggauguuuggcauug

SEQ ID NO: 92031 - RNA, 19 nt, Homo sapiens
cgacauauguauaccacaa

SEQ ID NO: 92032 - RNA, 19 nt, Homo sapiens
gaagggcacccauggcuuu

SEQ ID NO: 92033 - RNA, 19 nt, Homo sapiens
cagauuauuucgaagauga

SEQ ID NO: 92034 - RNA, 19 nt, Homo sapiens
ccacuuaaauggcuauaca

SEQ ID NO: 92035 - RNA, 19 nt, Homo sapiens
ggaaaagagugaagaagaa

SEQ ID NO: 92036 - RNA, 19 nt, Homo sapiens
gcagaugguuggagaugga

SEQ ID NO: 92037 - RNA, 19 nt, Homo sapiens
aagugaaccugcccaaaua

SEQ ID NO: 92038 - RNA, 19 nt, Homo sapiens
uggauuauauugcagcaua

SEQ ID NO: 92039 - RNA, 19 nt, Homo sapiens
ccucugauaucuacuuuga

SEQ ID NO: 92040 - RNA, 19 nt, Homo sapiens
ggaaaccucccaugauaga

SEQ ID NO: 92041 - RNA, 19 nt, Homo sapiens
ugccaaaccuccagaugua

SEQ ID NO: 92042 - RNA, 19 nt, Homo sapiens
gauaaagucaguacgcaaa

SEQ ID NO: 92043 - RNA, 19 nt, Homo sapiens
uuucagugcucuugguuua

SEQ ID NO: 92044 - RNA, 19 nt, Homo sapiens
cagaauuuauggaugauga

SEQ ID NO: 92045 - RNA, 19 nt, Homo sapiens
gcaaaaugauggugaaaug

SEQ ID NO: 92046 - RNA, 19 nt, Homo sapiens
gaagauucaaguguuguua

SEQ ID NO: 92047 - RNA, 19 nt, Homo sapiens
gaaaggacuaaacuagauu

SEQ ID NO: 92048 - RNA, 19 nt, Homo sapiens
uagcagacacugaugauuu

SEQ ID NO: 92049 - RNA, 19 nt, Homo sapiens
gaagaugggaaauugaaga

SEQ ID NO: 92050 - RNA, 19 nt, Homo sapiens
gaagagcuaaaugcaauaa

SEQ ID NO: 92051 - RNA, 19 nt, Homo sapiens
uuacauaucggaucuaaga

SEQ ID NO: 92052 - RNA, 19 nt, Homo sapiens
auacaaggauaauggguuu

SEQ ID NO: 92053 - RNA, 19 nt, Homo sapiens
cauuagaaguuacacaguu

SEQ ID NO: 92054 - RNA, 19 nt, Homo sapiens
gacaugccuuguucauaaa

SEQ ID NO: 92055 - RNA, 19 nt, Homo sapiens
ggagaugggccgauaaagu

SEQ ID NO: 92056 - RNA, 19 nt, Homo sapiens
gcaagaagaaaguaaucaa

SEQ ID NO: 92057 - RNA, 19 nt, Homo sapiens
gugccaauagcauuaauua

SEQ ID NO: 92058 - RNA, 19 nt, Homo sapiens
ccaaauagaagauucaagu

SEQ ID NO: 92059 - RNA, 19 nt, Homo sapiens
cauuugagguguuaguuga

SEQ ID NO: 92060 - RNA, 19 nt, Homo sapiens
uugaagaucccaaugauaa

SEQ ID NO: 92061 - RNA, 19 nt, Homo sapiens
agacacugaugauuugauu

SEQ ID NO: 92062 - RNA, 19 nt, Homo sapiens
ggacugguauuaaaaucua

SEQ ID NO: 92063 - RNA, 19 nt, Homo sapiens
gacggaagacuuugaagaa

SEQ ID NO: 92064 - RNA, 19 nt, Homo sapiens
gagaugggccgauaaaguc

SEQ ID NO: 92065 - RNA, 19 nt, Homo sapiens
ggucagaggaugagaugaa

SEQ ID NO: 92066 - RNA, 19 nt, Homo sapiens
gaaagugaaccugaggaaa

SEQ ID NO: 92067 - RNA, 19 nt, Homo sapiens
gguuggagauggaaaauaa

SEQ ID NO: 92068 - RNA, 19 nt, Homo sapiens
ggucgauaauccuaacuau

SEQ ID NO: 92069 - RNA, 19 nt, Homo sapiens
ggaaauugaagaguugaaa

SEQ ID NO: 92070 - RNA, 19 nt, Homo sapiens
ggaugaggaaauuucaaua

SEQ ID NO: 92071 - RNA, 19 nt, Homo sapiens
guacgaaaggacuaaacua

SEQ ID NO: 92072 - RNA, 19 nt, Homo sapiens
ggaaagugaaccugaggaa

SEQ ID NO: 92073 - RNA, 19 nt, Homo sapiens
agacugggaugaaagugaa

SEQ ID NO: 92074 - RNA, 19 nt, Homo sapiens
augcauacauugcuauuga

SEQ ID NO: 92075 - RNA, 19 nt, Homo sapiens
gaagaguacgaaaggacua

SEQ ID NO: 92076 - RNA, 19 nt, Homo sapiens
cauagaagggcaagaagaa

SEQ ID NO: 92077 - RNA, 19 nt, Homo sapiens
guuaguugaucaaacaguu

SEQ ID NO: 92078 - RNA, 19 nt, Homo sapiens
agauaaauguggagaagau

SEQ ID NO: 92079 - RNA, 19 nt, Homo sapiens
uauaagacaccucaaccua

SEQ ID NO: 92080 - RNA, 19 nt, Homo sapiens
gaccucugauaucuacuuu

SEQ ID NO: 92081 - RNA, 19 nt, Homo sapiens
aaaccucccaugauagaua

SEQ ID NO: 92082 - RNA, 19 nt, Homo sapiens
gaaagugaaccugcccaaa

SEQ ID NO: 92083 - RNA, 19 nt, Homo sapiens
agaaagaugacauggauga

SEQ ID NO: 92084 - RNA, 19 nt, Homo sapiens
ccucaucuuugaauuuaga

SEQ ID NO: 92085 - RNA, 19 nt, Homo sapiens
ucacugggcugcagauggu

SEQ ID NO: 92086 - RNA, 19 nt, Homo sapiens
caaagaaagaugacaugga

SEQ ID NO: 92087 - RNA, 19 nt, Homo sapiens
cuggaugggucuuaucaaa

SEQ ID NO: 92088 - RNA, 19 nt, Homo sapiens
gaaaacaggccgcaagaga

SEQ ID NO: 92089 - RNA, 19 nt, Homo sapiens
cauuacauaucggaucuaa

SEQ ID NO: 92090 - RNA, 19 nt, Homo sapiens
ccauggcuuugguugauuu

SEQ ID NO: 92091 - RNA, 19 nt, Homo sapiens
gcaacgacuuggacaucug

SEQ ID NO: 92092 - RNA, 19 nt, Homo sapiens
gaucaaacaguuguaaaca

SEQ ID NO: 92093 - RNA, 19 nt, Homo sapiens
ccagauaaauguggagaag

SEQ ID NO: 92094 - RNA, 19 nt, Homo sapiens
ggaggugcauacauuaaac

SEQ ID NO: 92095 - RNA, 19 nt, Homo sapiens
gaggaaauuucaauauacg

SEQ ID NO: 92096 - RNA, 19 nt, Homo sapiens
cacauccuguuucuaauau

SEQ ID NO: 92097 - RNA, 19 nt, Homo sapiens
cugcacauccuguuucuaa

SEQ ID NO: 92098 - RNA, 19 nt, Homo sapiens
gcuaauaagccugguguau

SEQ ID NO: 92099 - RNA, 19 nt, Homo sapiens
agacacggauggagaaugg

SEQ ID NO: 92100 - RNA, 19 nt, Homo sapiens
aaagugaaccugcccaaau

SEQ ID NO: 92101 - RNA, 19 nt, Homo sapiens
gcugauaaacccuugauag

SEQ ID NO: 92102 - RNA, 19 nt, Homo sapiens
gagagauaaucaauaugca

SEQ ID NO: 92103 - RNA, 19 nt, Homo sapiens
gaggauugcugauucuuua

SEQ ID NO: 92104 - RNA, 19 nt, Homo sapiens
ccaaggauauuuacagaaa

SEQ ID NO: 92105 - RNA, 19 nt, Homo sapiens
gcacaguacucuugguuug

SEQ ID NO: 92106 - RNA, 19 nt, Homo sapiens
gauggcaaccgucaaauua

SEQ ID NO: 92107 - RNA, 19 nt, Homo sapiens
agucagaucuugugaauga

SEQ ID NO: 92108 - RNA, 19 nt, Homo sapiens
gaauacaaguuucugauac

SEQ ID NO: 92109 - RNA, 19 nt, Homo sapiens
gagcaagacuccaucucaa

SEQ ID NO: 92110 - RNA, 19 nt, Homo sapiens
ugaggaugcuguagccuua

SEQ ID NO: 92111 - RNA, 19 nt, Homo sapiens
gaaaugacacagcaagcua

SEQ ID NO: 92112 - RNA, 19 nt, Homo sapiens
gggacuaaaugaacuaaug

SEQ ID NO: 92113 - RNA, 19 nt, Homo sapiens
ccacugcacugucugagaa

SEQ ID NO: 92114 - RNA, 19 nt, Homo sapiens
gaagaacagcggacucuau

SEQ ID NO: 92115 - RNA, 19 nt, Homo sapiens
acacacaaguucucuuuau

SEQ ID NO: 92116 - RNA, 19 nt, Homo sapiens
ggucagagccucccaguca

SEQ ID NO: 92117 - RNA, 19 nt, Homo sapiens
gcucacagccucacuucua

SEQ ID NO: 92118 - RNA, 19 nt, Homo sapiens
uagcagcccugguguaguu

SEQ ID NO: 92119 - RNA, 19 nt, Homo sapiens
uaacccaccugcacaguau

SEQ ID NO: 92120 - RNA, 19 nt, Homo sapiens
uggcaaccgucaaauuaua

SEQ ID NO: 92121 - RNA, 19 nt, Homo sapiens
ggacuaaaugaacuaauga

SEQ ID NO: 92122 - RNA, 19 nt, Homo sapiens
gaccagagaucgagaccau

SEQ ID NO: 92123 - RNA, 19 nt, Homo sapiens
cacaagaaaugacgcaaga

SEQ ID NO: 92124 - RNA, 19 nt, Homo sapiens
caacaggacccucacucua

SEQ ID NO: 92125 - RNA, 19 nt, Homo sapiens
caacaggacccucacucua

SEQ ID NO: 92126 - RNA, 19 nt, Homo sapiens
caacaggacccucacucua

SEQ ID NO: 92127 - RNA, 19 nt, Homo sapiens
cagaacgaauuaaguguug

SEQ ID NO: 92128 - RNA, 19 nt, Homo sapiens
aaagucagaucuugugaau

SEQ ID NO: 92129 - RNA, 19 nt, Homo sapiens
auacaguggucgagagaua

SEQ ID NO: 92130 - RNA, 19 nt, Homo sapiens
ugcaacagcuacagucuaa

SEQ ID NO: 92131 - RNA, 19 nt, Homo sapiens
gcuacuggccgcaauaauu

SEQ ID NO: 92132 - RNA, 19 nt, Homo sapiens
gcaccuguagucccaguua

SEQ ID NO: 92133 - RNA, 19 nt, Homo sapiens
caacaucacugagaagaac

SEQ ID NO: 92134 - RNA, 19 nt, Homo sapiens
ucacgacgaucacagucua

SEQ ID NO: 92135 - RNA, 19 nt, Homo sapiens
uaaugaggauugcugauuc

SEQ ID NO: 92136 - RNA, 19 nt, Homo sapiens
cugccaagcucacuauuga

SEQ ID NO: 92137 - RNA, 19 nt, Homo sapiens
acucugaccuguacucuug

SEQ ID NO: 92138 - RNA, 19 nt, Homo sapiens
ggcugcagcuguccaauga

SEQ ID NO: 92139 - RNA, 19 nt, Homo sapiens
gaacauccagcaacacaca

SEQ ID NO: 92140 - RNA, 19 nt, Homo sapiens
gcaagagccuauguaugug

SEQ ID NO: 92141 - RNA, 19 nt, Homo sapiens
gacccucacucuauucaau

SEQ ID NO: 92142 - RNA, 19 nt, Homo sapiens
caaugggacuuuccagcaa

SEQ ID NO: 92143 - RNA, 19 nt, Homo sapiens
gacccucacucuauucaau

SEQ ID NO: 92144 - RNA, 19 nt, Homo sapiens
cgcaagagccuauguaugu

SEQ ID NO: 92145 - RNA, 19 nt, Homo sapiens
ucaugaaacuguccaccaa

SEQ ID NO: 92146 - RNA, 19 nt, Homo sapiens
gaccuguacucuugaauac

SEQ ID NO: 92147 - RNA, 19 nt, Homo sapiens
gcaauaauuccauagucaa

SEQ ID NO: 92148 - RNA, 19 nt, Homo sapiens
ugacacagcaagcuacaaa

SEQ ID NO: 92149 - RNA, 19 nt, Homo sapiens
cacaaggaaugauguagga

SEQ ID NO: 92150 - RNA, 19 nt, Homo sapiens
gcgcagugauucagucauc

SEQ ID NO: 92151 - RNA, 19 nt, Homo sapiens
caacagagcaagacuccau

SEQ ID NO: 92152 - RNA, 19 nt, Homo sapiens
aagaacagcggacucuaua

SEQ ID NO: 92153 - RNA, 19 nt, Homo sapiens
uaacugacagcuucaugaa

SEQ ID NO: 92154 - RNA, 19 nt, Homo sapiens
gaaaccccaucucuacuaa

SEQ ID NO: 92155 - RNA, 19 nt, Homo sapiens
uaccaaggauauuuacaga

SEQ ID NO: 92156 - RNA, 19 nt, Homo sapiens
ggauggcaaccgucaaauu

SEQ ID NO: 92157 - RNA, 19 nt, Homo sapiens
ucacagcagccuugacaaa

SEQ ID NO: 92158 - RNA, 19 nt, Homo sapiens
ugguguaguuucuucauuu

SEQ ID NO: 92159 - RNA, 19 nt, Homo sapiens
acaggacccucacucuauu

SEQ ID NO: 92160 - RNA, 19 nt, Homo sapiens
ggaccacagucacgacgau

SEQ ID NO: 92161 - RNA, 19 nt, Homo sapiens
uaacccaccugcacaguac

SEQ ID NO: 92162 - RNA, 19 nt, Homo sapiens
acaggacccucacucuauu

SEQ ID NO: 92163 - RNA, 19 nt, Homo sapiens
uguggucgcuccagacuug

SEQ ID NO: 92164 - RNA, 19 nt, Homo sapiens
gaaacuguccaccaagauc

SEQ ID NO: 92165 - RNA, 19 nt, Homo sapiens
agaagacucugaccuguac

SEQ ID NO: 92166 - RNA, 19 nt, Homo sapiens
ugaccuguacucuugaaua

SEQ ID NO: 92167 - RNA, 19 nt, Homo sapiens
gcaggagaaucgcuugaac

SEQ ID NO: 92168 - RNA, 19 nt, Homo sapiens
cgcaauaauuccauaguca

SEQ ID NO: 92169 - RNA, 19 nt, Homo sapiens
caaauaauaacgggaccua

SEQ ID NO: 92170 - RNA, 19 nt, Homo sapiens
acacacacaaguucucuuu

SEQ ID NO: 92171 - RNA, 19 nt, Homo sapiens
ccaaacccguggaggacaa

SEQ ID NO: 92172 - RNA, 19 nt, Homo sapiens
cauccugaauguccucuau

SEQ ID NO: 92173 - RNA, 19 nt, Homo sapiens
cauccugaauguccucuau

SEQ ID NO: 92174 - RNA, 19 nt, Homo sapiens
ccaaacccguggaggacaa

SEQ ID NO: 92175 - RNA, 19 nt, Homo sapiens
ugucuuguuucccagauuu

SEQ ID NO: 92176 - RNA, 19 nt, Homo sapiens
gguguaguuucuucauuuc

SEQ ID NO: 92177 - RNA, 19 nt, Homo sapiens
ucuauucaaugucacaaga

SEQ ID NO: 92178 - RNA, 19 nt, Homo sapiens
acagcaagcuacaaaugug

SEQ ID NO: 92179 - RNA, 19 nt, Homo sapiens
ucuauucaaugucacaaga

SEQ ID NO: 92180 - RNA, 19 nt, Homo sapiens
gucauaaagucagaucuug

SEQ ID NO: 92181 - RNA, 19 nt, Homo sapiens
aauaggaacucaacaagcu

SEQ ID NO: 92182 - RNA, 19 nt, Homo sapiens
ggauugcugauucuuuaaa

SEQ ID NO: 92183 - RNA, 19 nt, Homo sapiens
cagccucacuucuaaccuu

SEQ ID NO: 92184 - RNA, 19 nt, Homo sapiens
ggcuacagcugguacaaag

SEQ ID NO: 92185 - RNA, 19 nt, Homo sapiens
gccaaaaucacgccaaaua

SEQ ID NO: 92186 - RNA, 19 nt, Homo sapiens
gcagcaacacacacaaguu

SEQ ID NO: 92187 - RNA, 19 nt, Homo sapiens
gacacuggccucaauagga

SEQ ID NO: 92188 - RNA, 19 nt, Homo sapiens
cagaacaucauccagaaug

SEQ ID NO: 92189 - RNA, 19 nt, Homo sapiens
gacccucacucuacucagu

SEQ ID NO: 92190 - RNA, 19 nt, Homo sapiens
gugccaagcccauaacuca

SEQ ID NO: 92191 - RNA, 19 nt, Homo sapiens
gaacuaacugacagcuuca

SEQ ID NO: 92192 - RNA, 19 nt, Homo sapiens
ccacagcgacccagucauc

SEQ ID NO: 92193 - RNA, 19 nt, Homo sapiens
ggaggugcuucuacuuguc

SEQ ID NO: 92194 - RNA, 19 nt, Homo sapiens
cagcaacacacacaaguuc

SEQ ID NO: 92195 - RNA, 19 nt, Homo sapiens
gagauaauauaccccaaug

SEQ ID NO: 92196 - RNA, 19 nt, Homo sapiens
guaauaggaacucaacaag

SEQ ID NO: 92197 - RNA, 19 nt, Homo sapiens
uauccacucuuacagcaau

SEQ ID NO: 92198 - RNA, 19 nt, Homo sapiens
gaaaagaaaagaagacucu

SEQ ID NO: 92199 - RNA, 19 nt, Homo sapiens
ccagaacgaauuaaguguu

SEQ ID NO: 92200 - RNA, 19 nt, Homo sapiens
cauaaagucagaucuugug

SEQ ID NO: 92201 - RNA, 19 nt, Homo sapiens
cagcuacagucuaaaauug

SEQ ID NO: 92202 - RNA, 19 nt, Homo sapiens
cuacuggccgcaauaauuc

SEQ ID NO: 92203 - RNA, 19 nt, Homo sapiens
ugacaagcuuuccaaauau

SEQ ID NO: 92204 - RNA, 19 nt, Homo sapiens
augacaagcuuuccaaaua

SEQ ID NO: 92205 - RNA, 19 nt, Homo sapiens
gacaagcuuuccaaauauu

SEQ ID NO: 92206 - RNA, 19 nt, Homo sapiens
gagcugagaucccgacaag

SEQ ID NO: 92207 - RNA, 19 nt, Homo sapiens
agaagucgguggacaagaa

SEQ ID NO: 92208 - RNA, 19 nt, Homo sapiens
cagccgauaucaacacuug

SEQ ID NO: 92209 - RNA, 19 nt, Homo sapiens
agaaagggguggaaacaua

SEQ ID NO: 92210 - RNA, 19 nt, Homo sapiens
ccacgccuguccuuagaaa

SEQ ID NO: 92211 - RNA, 19 nt, Homo sapiens
cccggcaacucuaguauuu

SEQ ID NO: 92212 - RNA, 19 nt, Homo sapiens
ggaccggaguuaugacaag

SEQ ID NO: 92213 - RNA, 19 nt, Homo sapiens
gguggagggucucuaguuc

SEQ ID NO: 92214 - RNA, 19 nt, Homo sapiens
ggacuuggugcgucuaaga

SEQ ID NO: 92215 - RNA, 19 nt, Homo sapiens
gagcaaaucgugccuuguc

SEQ ID NO: 92216 - RNA, 19 nt, Homo sapiens
cggcaacucuaguauuuag

SEQ ID NO: 92217 - RNA, 19 nt, Homo sapiens
gaagguggagggucucuag

SEQ ID NO: 92218 - RNA, 19 nt, Homo sapiens
caaaucgugccuugucauu

SEQ ID NO: 92219 - RNA, 19 nt, Homo sapiens
gcgcgucucugcuaaacca

SEQ ID NO: 92220 - RNA, 19 nt, Homo sapiens
caaacucaccgcuccaaug

SEQ ID NO: 92221 - RNA, 19 nt, Homo sapiens
ggaguuaugacaagcuuuc

SEQ ID NO: 92222 - RNA, 19 nt, Homo sapiens
gcaacucuaguauuuagga

SEQ ID NO: 92223 - RNA, 19 nt, Homo sapiens
gcagugccuugugcaaugu

SEQ ID NO: 92224 - RNA, 19 nt, Homo sapiens
acaagaacagcaacgagua

SEQ ID NO: 92225 - RNA, 19 nt, Homo sapiens
gccgauaucaacacuugua

SEQ ID NO: 92226 - RNA, 19 nt, Homo sapiens
gagacucccuuuccuuuug

SEQ ID NO: 92227 - RNA, 19 nt, Homo sapiens
ggaacacgaagcacgauca

SEQ ID NO: 92228 - RNA, 19 nt, Homo sapiens
ggagagggagaccuagaga

SEQ ID NO: 92229 - RNA, 19 nt, Homo sapiens
ccaagaagucgguggacaa

SEQ ID NO: 92230 - RNA, 19 nt, Homo sapiens
gagcugaccagugacaaug

SEQ ID NO: 92231 - RNA, 19 nt, Homo sapiens
guggaaacauagggacuug

SEQ ID NO: 92232 - RNA, 19 nt, Homo sapiens
ggugggagagggagaccua

SEQ ID NO: 92233 - RNA, 19 nt, Homo sapiens
aaucgugccuugucauuuu

SEQ ID NO: 92234 - RNA, 19 nt, Homo sapiens
ccuuggaaaugcaaacuca

SEQ ID NO: 92235 - RNA, 19 nt, Homo sapiens
guauuuaggauaaccuugu

SEQ ID NO: 92236 - RNA, 19 nt, Homo sapiens
cgacaucagcgccuacauc

SEQ ID NO: 92237 - RNA, 19 nt, Homo sapiens
cagagggaccggaguuaug

SEQ ID NO: 92238 - RNA, 19 nt, Homo sapiens
cagccuuguuuguacugua

SEQ ID NO: 92239 - RNA, 19 nt, Homo sapiens
caacucuaguauuuaggau

SEQ ID NO: 92240 - RNA, 19 nt, Homo sapiens
ccgcuccaaugccuacuga

SEQ ID NO: 92241 - RNA, 19 nt, Homo sapiens
gagccaggacuaggagauu

SEQ ID NO: 92242 - RNA, 19 nt, Homo sapiens
gcaaaucgugccuugucau

SEQ ID NO: 92243 - RNA, 19 nt, Homo sapiens
ggagcugaccagugacaau

SEQ ID NO: 92244 - RNA, 19 nt, Homo sapiens
cuucagcauugccuaggaa

SEQ ID NO: 92245 - RNA, 19 nt, Homo sapiens
cuuggugcgucuaagauga

SEQ ID NO: 92246 - RNA, 19 nt, Homo sapiens
cugagacucccuuuccuuu

SEQ ID NO: 92247 - RNA, 19 nt, Homo sapiens
agagggaccggaguuauga

SEQ ID NO: 92248 - RNA, 19 nt, Homo sapiens
acuuguaucuggccucugu

SEQ ID NO: 92249 - RNA, 19 nt, Homo sapiens
uaugacaagcuuuccaaau

SEQ ID NO: 92250 - RNA, 19 nt, Homo sapiens
caagaacagcaacgaguac

SEQ ID NO: 92251 - RNA, 19 nt, Homo sapiens
agagggagaccuagagauc

SEQ ID NO: 92252 - RNA, 19 nt, Homo sapiens
gcaaacucaccgcuccaau

SEQ ID NO: 92253 - RNA, 19 nt, Homo sapiens
guuaugacaagcuuuccaa

SEQ ID NO: 92254 - RNA, 19 nt, Homo sapiens
guuccuggccgaccuguuc

SEQ ID NO: 92255 - RNA, 19 nt, Homo sapiens
ggacccagggagugguuug

SEQ ID NO: 92256 - RNA, 19 nt, Homo sapiens
agcagugccuugugcaaug

SEQ ID NO: 92257 - RNA, 19 nt, Homo sapiens
gaacacgaagcacgaucag

SEQ ID NO: 92258 - RNA, 19 nt, Homo sapiens
gggacccucagccuuguuu

SEQ ID NO: 92259 - RNA, 19 nt, Homo sapiens
ccagagggaccggaguuau

SEQ ID NO: 92260 - RNA, 19 nt, Homo sapiens
ucaaggccaugggcaacug

SEQ ID NO: 92261 - RNA, 19 nt, Homo sapiens
aaacucaccgcuccaaugc

SEQ ID NO: 92262 - RNA, 19 nt, Homo sapiens
uauuuaggauaaccuugug

SEQ ID NO: 92263 - RNA, 19 nt, Homo sapiens
gcaccugcaguuccagauc

SEQ ID NO: 92264 - RNA, 19 nt, Homo sapiens
caagaagucgguggacaag

SEQ ID NO: 92265 - RNA, 19 nt, Homo sapiens
gcuccaaugccuacugagu

SEQ ID NO: 92266 - RNA, 19 nt, Homo sapiens
gagagggagaccuagagau

SEQ ID NO: 92267 - RNA, 19 nt, Homo sapiens
cuccacgccuguccuuaga

SEQ ID NO: 92268 - RNA, 19 nt, Homo sapiens
gaagaaacgucuaugugua

SEQ ID NO: 92269 - RNA, 19 nt, Homo sapiens
gaaaagaggcgucuguaua

SEQ ID NO: 92270 - RNA, 19 nt, Homo sapiens
guguacagaugaaugauaa

SEQ ID NO: 92271 - RNA, 19 nt, Homo sapiens
aguaaucgcuuaaagaugu

SEQ ID NO: 92272 - RNA, 19 nt, Homo sapiens
ugacgcaacccacguguaa

SEQ ID NO: 92273 - RNA, 19 nt, Homo sapiens
aaagaggcgucuguauauu

SEQ ID NO: 92274 - RNA, 19 nt, Homo sapiens
gauaaacucucugcuucuc

SEQ ID NO: 92275 - RNA, 19 nt, Homo sapiens
ccaagaagaccguggacaa

SEQ ID NO: 92276 - RNA, 19 nt, Homo sapiens
gcuuguugcuguugauguu

SEQ ID NO: 92277 - RNA, 19 nt, Homo sapiens
gaugaaugauaaacucucu

SEQ ID NO: 92278 - RNA, 19 nt, Homo sapiens
ugcaaucgguuuaaacaug

SEQ ID NO: 92279 - RNA, 19 nt, Homo sapiens
aaacgucuauguguacaga

SEQ ID NO: 92280 - RNA, 19 nt, Homo sapiens
gggagcccgucgguaauuu

SEQ ID NO: 92281 - RNA, 19 nt, Homo sapiens
gaugcaaucgguuuaaaca

SEQ ID NO: 92282 - RNA, 19 nt, Homo sapiens
ugaguaaucgcuuaaagau

SEQ ID NO: 92283 - RNA, 19 nt, Homo sapiens
agaagaaacgucuaugugu

SEQ ID NO: 92284 - RNA, 19 nt, Homo sapiens
aagaggcgucuguauauuu

SEQ ID NO: 92285 - RNA, 19 nt, Homo sapiens
guaaucgcuuaaagauguu

SEQ ID NO: 92286 - RNA, 19 nt, Homo sapiens
gcacagcgacgaguacaag

SEQ ID NO: 92287 - RNA, 19 nt, Homo sapiens
ggcccugaguaaucgcuua

SEQ ID NO: 92288 - RNA, 19 nt, Homo sapiens
acagaugaaugauaaacuc

SEQ ID NO: 92289 - RNA, 19 nt, Homo sapiens
acgagcggcugcagaagaa

SEQ ID NO: 92290 - RNA, 19 nt, Homo sapiens
gcgcuuaccucggcuacca

SEQ ID NO: 92291 - RNA, 19 nt, Homo sapiens
aaagaagaaacgucuaugu

SEQ ID NO: 92292 - RNA, 19 nt, Homo sapiens
ccucgcaggucaagagcaa

SEQ ID NO: 92293 - RNA, 19 nt, Homo sapiens
agaagaccguggacaagca

SEQ ID NO: 92294 - RNA, 19 nt, Homo sapiens
aagaagaaacgucuaugug

SEQ ID NO: 92295 - RNA, 19 nt, Homo sapiens
agaacgagcggcugcagaa

SEQ ID NO: 92296 - RNA, 19 nt, Homo sapiens
aaaagaggcgucuguauau

SEQ ID NO: 92297 - RNA, 19 nt, Homo sapiens
gcaacccacguguaacugu

SEQ ID NO: 92298 - RNA, 19 nt, Homo sapiens
uuucgaaguugaugcaauc

SEQ ID NO: 92299 - RNA, 19 nt, Homo sapiens
gggcaagaacugcaagaag

SEQ ID NO: 92300 - RNA, 19 nt, Homo sapiens
caagaagaccguggacaag

SEQ ID NO: 92301 - RNA, 19 nt, Homo sapiens
caagcauuaagaacacuuu

SEQ ID NO: 92302 - RNA, 19 nt, Homo sapiens
ucaagagcaaggccaagaa

SEQ ID NO: 92303 - RNA, 19 nt, Homo sapiens
cgcccgugguguuauuuaa

SEQ ID NO: 92304 - RNA, 19 nt, Homo sapiens
caaaccaaccgcacaugca

SEQ ID NO: 92305 - RNA, 19 nt, Homo sapiens
cuacgggcuuguugcuguu

SEQ ID NO: 92306 - RNA, 19 nt, Homo sapiens
gaguaaucgcuuaaagaug

SEQ ID NO: 92307 - RNA, 19 nt, Homo sapiens
aaugauaaacucucugcuu

SEQ ID NO: 92308 - RNA, 19 nt, Homo sapiens
uaaagaagaaacgucuaug

SEQ ID NO: 92309 - RNA, 19 nt, Homo sapiens
ccugaguaaucgcuuaaag

SEQ ID NO: 92310 - RNA, 19 nt, Homo sapiens
uauguguacagaugaauga

SEQ ID NO: 92311 - RNA, 19 nt, Homo sapiens
gcccgugguguuauuuaaa

SEQ ID NO: 92312 - RNA, 19 nt, Homo sapiens
gcacccugcggaacuuguu

SEQ ID NO: 92313 - RNA, 19 nt, Homo sapiens
acaagcacagcgacgagua

SEQ ID NO: 92314 - RNA, 19 nt, Homo sapiens
agaggcgucuguauauuuu

SEQ ID NO: 92315 - RNA, 19 nt, Homo sapiens
guacagaugaaugauaaac

SEQ ID NO: 92316 - RNA, 19 nt, Homo sapiens
caagagcaaggccaagaag

SEQ ID NO: 92317 - RNA, 19 nt, Homo sapiens
cugaguaaucgcuuaaaga

SEQ ID NO: 92318 - RNA, 19 nt, Homo sapiens
gcccugaguaaucgcuuaa

SEQ ID NO: 92319 - RNA, 19 nt, Homo sapiens
gagaaaagaggcgucugua

SEQ ID NO: 92320 - RNA, 19 nt, Homo sapiens
uugaugcaaucgguuuaaa

SEQ ID NO: 92321 - RNA, 19 nt, Homo sapiens
uguguacagaugaaugaua

SEQ ID NO: 92322 - RNA, 19 nt, Homo sapiens
gugguguuauuuaaagaag

SEQ ID NO: 92323 - RNA, 19 nt, Homo sapiens
ucagcacccugcggaacuu

SEQ ID NO: 92324 - RNA, 19 nt, Homo sapiens
guuucgaaguugaugcaau

SEQ ID NO: 92325 - RNA, 19 nt, Homo sapiens
gaauaaagcagcauuugaa

SEQ ID NO: 92326 - RNA, 19 nt, Homo sapiens
gagagaagcuaaacguguu

SEQ ID NO: 92327 - RNA, 19 nt, Homo sapiens
ccacuaaacugcgagagaa

SEQ ID NO: 92328 - RNA, 19 nt, Homo sapiens
ggacauaggagcgcaaaga

SEQ ID NO: 92329 - RNA, 19 nt, Homo sapiens
ggacuuaccaccacuaaac

SEQ ID NO: 92330 - RNA, 19 nt, Homo sapiens
caacgacccauaccucaga

SEQ ID NO: 92331 - RNA, 19 nt, Homo sapiens
gcucuucgccgaccucuuc

SEQ ID NO: 92332 - RNA, 19 nt, Homo sapiens
guaagaauaaagcagcauu

SEQ ID NO: 92333 - RNA, 19 nt, Homo sapiens
agaauaaagcagcauuuga

SEQ ID NO: 92334 - RNA, 19 nt, Homo sapiens
gacauaggagcgcaaagaa

SEQ ID NO: 92335 - RNA, 19 nt, Homo sapiens
cgagagcgccaucgacuuc

SEQ ID NO: 92336 - RNA, 19 nt, Homo sapiens
gggagagacucagcaacga

SEQ ID NO: 92337 - RNA, 19 nt, Homo sapiens
gcagcuaagguacauuugu

SEQ ID NO: 92338 - RNA, 19 nt, Homo sapiens
gauaagaggaaaagacuga

SEQ ID NO: 92339 - RNA, 19 nt, Homo sapiens
aaacugcgagagaagcuaa

SEQ ID NO: 92340 - RNA, 19 nt, Homo sapiens
gaagcuacagccuggacuu

SEQ ID NO: 92341 - RNA, 19 nt, Homo sapiens
ggagaugcagcagaaguug

SEQ ID NO: 92342 - RNA, 19 nt, Homo sapiens
cccuuuguauuguagauaa

SEQ ID NO: 92343 - RNA, 19 nt, Homo sapiens
accaggagaugcagcagaa

SEQ ID NO: 92344 - RNA, 19 nt, Homo sapiens
gcgccuacaucgacuccau

SEQ ID NO: 92345 - RNA, 19 nt, Homo sapiens
cuacaucuuacuccuguug

SEQ ID NO: 92346 - RNA, 19 nt, Homo sapiens
ugcaguuucuugggacaua

SEQ ID NO: 92347 - RNA, 19 nt, Homo sapiens
ggugacagccucgcuugga

SEQ ID NO: 92348 - RNA, 19 nt, Homo sapiens
aagaauaaagcagcauuug

SEQ ID NO: 92349 - RNA, 19 nt, Homo sapiens
gcaguuucuugggacauag

SEQ ID NO: 92350 - RNA, 19 nt, Homo sapiens
aagcuacagccuggacuua

SEQ ID NO: 92351 - RNA, 19 nt, Homo sapiens
cgacuucagcgccuacauc

SEQ ID NO: 92352 - RNA, 19 nt, Homo sapiens
ggugcccgcugcaguuucu

SEQ ID NO: 92353 - RNA, 19 nt, Homo sapiens
cacagaccguggugagcuu

SEQ ID NO: 92354 - RNA, 19 nt, Homo sapiens
ggaaaagacugagcaugcu

SEQ ID NO: 92355 - RNA, 19 nt, Homo sapiens
aaaccagacuuuucagaca

SEQ ID NO: 92356 - RNA, 19 nt, Homo sapiens
guggagcugucggcugaga

SEQ ID NO: 92357 - RNA, 19 nt, Homo sapiens
gaauaaaguugcacuguga

SEQ ID NO: 92358 - RNA, 19 nt, Homo sapiens
gaacaaagauagccuugag

SEQ ID NO: 92359 - RNA, 19 nt, Homo sapiens
agacauagaccauggauaa

SEQ ID NO: 92360 - RNA, 19 nt, Homo sapiens
gaggcuggcugguggauug

SEQ ID NO: 92361 - RNA, 19 nt, Homo sapiens
gcaagaaggcagugaacaa

SEQ ID NO: 92362 - RNA, 19 nt, Homo sapiens
cauagaccauggauaaaug

SEQ ID NO: 92363 - RNA, 19 nt, Homo sapiens
gcaggacccagcauaauga

SEQ ID NO: 92364 - RNA, 19 nt, Homo sapiens
ccuagaacccugagacaua

SEQ ID NO: 92365 - RNA, 19 nt, Homo sapiens
agaaggcagugaacaaaga

SEQ ID NO: 92366 - RNA, 19 nt, Homo sapiens
caagaaggcagugaacaaa

SEQ ID NO: 92367 - RNA, 19 nt, Homo sapiens
acaaagauagccuugagua

SEQ ID NO: 92368 - RNA, 19 nt, Homo sapiens
gagcaugaggccuccauug

SEQ ID NO: 92369 - RNA, 19 nt, Homo sapiens
uggaguacauggcagagaa

SEQ ID NO: 92370 - RNA, 19 nt, Homo sapiens
gggcaggucuagggcagaa

SEQ ID NO: 92371 - RNA, 19 nt, Homo sapiens
agaaggugcuggaguacau

SEQ ID NO: 92372 - RNA, 19 nt, Homo sapiens
cuagaacccugagacauag

SEQ ID NO: 92373 - RNA, 19 nt, Homo sapiens
ggaccuacuacgaguguga

SEQ ID NO: 92374 - RNA, 19 nt, Homo sapiens
gagggcaggacccagcaua

SEQ ID NO: 92375 - RNA, 19 nt, Homo sapiens
ggcaggacccagcauaaug

SEQ ID NO: 92376 - RNA, 19 nt, Homo sapiens
gaaggcagugaacaaagau

SEQ ID NO: 92377 - RNA, 19 nt, Homo sapiens
gcaggucuagggcagaaga

SEQ ID NO: 92378 - RNA, 19 nt, Homo sapiens
gacauagaccauggauaaa

SEQ ID NO: 92379 - RNA, 19 nt, Homo sapiens
gcuucucuccgaucucuuu

SEQ ID NO: 92380 - RNA, 19 nt, Homo sapiens
caaccucuuccgccagauu

SEQ ID NO: 92381 - RNA, 19 nt, Homo sapiens
gggcaggacccagcauaau

SEQ ID NO: 92382 - RNA, 19 nt, Homo sapiens
cagcuucucuccgaucucu

SEQ ID NO: 92383 - RNA, 19 nt, Homo sapiens
caaagauagccuugaguac

SEQ ID NO: 92384 - RNA, 19 nt, Homo sapiens
gccagcagccacucgaguu

SEQ ID NO: 92385 - RNA, 19 nt, Homo sapiens
gagacauagaccauggaua

SEQ ID NO: 92386 - RNA, 19 nt, Homo sapiens
gcaugaggccuccauugac

SEQ ID NO: 92387 - RNA, 19 nt, Homo sapiens
acauagaccauggauaaau

SEQ ID NO: 92388 - RNA, 19 nt, Homo sapiens
gcgcaagagccgagacaag

SEQ ID NO: 92389 - RNA, 19 nt, Homo sapiens
gcuacaauccccugcagua

SEQ ID NO: 92390 - RNA, 19 nt, Homo sapiens
ucaggaggagguagagaga

SEQ ID NO: 92391 - RNA, 19 nt, Homo sapiens
ggaauuaaguguacucaaa

SEQ ID NO: 92392 - RNA, 19 nt, Homo sapiens
gcuuguggcuugaauguua

SEQ ID NO: 92393 - RNA, 19 nt, Homo sapiens
ucaaucagcucaaagaaga

SEQ ID NO: 92394 - RNA, 19 nt, Homo sapiens
ggaauuaguguuauccaua

SEQ ID NO: 92395 - RNA, 19 nt, Homo sapiens
ucaaauugcugaccaagga

SEQ ID NO: 92396 - RNA, 19 nt, Homo sapiens
gaacggaauuaguguuauc

SEQ ID NO: 92397 - RNA, 19 nt, Homo sapiens
gcagguacaugugaagauu

SEQ ID NO: 92398 - RNA, 19 nt, Homo sapiens
gcagaaagcacaagacaca

SEQ ID NO: 92399 - RNA, 19 nt, Homo sapiens
ggaacaacauggcugugaa

SEQ ID NO: 92400 - RNA, 19 nt, Homo sapiens
gaacaacauggcugugaaa

SEQ ID NO: 92401 - RNA, 19 nt, Homo sapiens
gaauuaguguuauccauac

SEQ ID NO: 92402 - RNA, 19 nt, Homo sapiens
gagagucaaucagcucaaa

SEQ ID NO: 92403 - RNA, 19 nt, Homo sapiens
cugaagaguugauuagcua

SEQ ID NO: 92404 - RNA, 19 nt, Homo sapiens
cuuaauaaauccugacuuc

SEQ ID NO: 92405 - RNA, 19 nt, Homo sapiens
gucaauggcugaaaguugu

SEQ ID NO: 92406 - RNA, 19 nt, Homo sapiens
gacagcagauggcgacaau

SEQ ID NO: 92407 - RNA, 19 nt, Homo sapiens
gcacugaagaguugauuag

SEQ ID NO: 92408 - RNA, 19 nt, Homo sapiens
ggcugaaaguuguccauuu

SEQ ID NO: 92409 - RNA, 19 nt, Homo sapiens
gugaacggaauuaguguua

SEQ ID NO: 92410 - RNA, 19 nt, Homo sapiens
guaauucgaauaucugguu

SEQ ID NO: 92411 - RNA, 19 nt, Homo sapiens
gaccaaggaauuaagugua

SEQ ID NO: 92412 - RNA, 19 nt, Homo sapiens
gaagaguugauuagcuaaa

SEQ ID NO: 92413 - RNA, 19 nt, Homo sapiens
uaucugggaucccgauguu

SEQ ID NO: 92414 - RNA, 19 nt, Homo sapiens
caguagaccucacccuuuc

SEQ ID NO: 92415 - RNA, 19 nt, Homo sapiens
gacaacguacaguccauua

SEQ ID NO: 92416 - RNA, 19 nt, Homo sapiens
gcccauggaucgaaacagu

SEQ ID NO: 92417 - RNA, 19 nt, Homo sapiens
gcacacaaccuugcagaca

SEQ ID NO: 92418 - RNA, 19 nt, Homo sapiens
ccgauguucuuaauaaauc

SEQ ID NO: 92419 - RNA, 19 nt, Homo sapiens
caaccuugcagacaacgua

SEQ ID NO: 92420 - RNA, 19 nt, Homo sapiens
ucgaaacagugacgaguau

SEQ ID NO: 92421 - RNA, 19 nt, Homo sapiens
ggaggcugccgguuucgua

SEQ ID NO: 92422 - RNA, 19 nt, Homo sapiens
gcucaaagaagagaaugaa

SEQ ID NO: 92423 - RNA, 19 nt, Homo sapiens
gaauuaaguguacucaaag

SEQ ID NO: 92424 - RNA, 19 nt, Homo sapiens
gcaagcagaaagcacaaga

SEQ ID NO: 92425 - RNA, 19 nt, Homo sapiens
cacacaaccuugcagacaa

SEQ ID NO: 92426 - RNA, 19 nt, Homo sapiens
caagggagagugcccaaau

SEQ ID NO: 92427 - RNA, 19 nt, Homo sapiens
ggaucccgauguucuuaau

SEQ ID NO: 92428 - RNA, 19 nt, Homo sapiens
gcucucauuucuaccuguu

SEQ ID NO: 92429 - RNA, 19 nt, Homo sapiens
gaggagcagguacauguga

SEQ ID NO: 92430 - RNA, 19 nt, Homo sapiens
gcccaaaugagcaagauau

SEQ ID NO: 92431 - RNA, 19 nt, Homo sapiens
cgacaaugcaggacaguag

SEQ ID NO: 92432 - RNA, 19 nt, Homo sapiens
ugaucacccugcucucauu

SEQ ID NO: 92433 - RNA, 19 nt, Homo sapiens
uagaggagcagguacaugu

SEQ ID NO: 92434 - RNA, 19 nt, Homo sapiens
aauguuagccuuguaauuc

SEQ ID NO: 92435 - RNA, 19 nt, Homo sapiens
gagcuuguggcuugaaugu

SEQ ID NO: 92436 - RNA, 19 nt, Homo sapiens
agcaagauaucgcagcaaa

SEQ ID NO: 92437 - RNA, 19 nt, Homo sapiens
gaucacccugcucucauuu

SEQ ID NO: 92438 - RNA, 19 nt, Homo sapiens
gagucaaucagcucaaaga

SEQ ID NO: 92439 - RNA, 19 nt, Homo sapiens
gaucccgauguucuuaaua

SEQ ID NO: 92440 - RNA, 19 nt, Homo sapiens
acaguagaccucacccuuu

SEQ ID NO: 92441 - RNA, 19 nt, Homo sapiens
aucccgauguucuuaauaa

SEQ ID NO: 92442 - RNA, 19 nt, Homo sapiens
ccccaaauguuaagguaua

SEQ ID NO: 92443 - RNA, 19 nt, Homo sapiens
ccauuuccaugacucaaag

SEQ ID NO: 92444 - RNA, 19 nt, Homo sapiens
caaauguuaagguauaugg

SEQ ID NO: 92445 - RNA, 19 nt, Homo sapiens
ccauggaucgaaacaguga

SEQ ID NO: 92446 - RNA, 19 nt, Homo sapiens
ugaacggaauuaguguuau

SEQ ID NO: 92447 - RNA, 19 nt, Homo sapiens
gaggcugccgguuucguaa

SEQ ID NO: 92448 - RNA, 19 nt, Homo sapiens
gaaacagugacgaguaucg

SEQ ID NO: 92449 - RNA, 19 nt, Homo sapiens
aagggagagugcccaaaug

SEQ ID NO: 92450 - RNA, 19 nt, Homo sapiens
ccaccgacaccacucaugu

SEQ ID NO: 92451 - RNA, 19 nt, Homo sapiens
gaaaauacgacagcagaug

SEQ ID NO: 92452 - RNA, 19 nt, Homo sapiens
gagcagguacaugugaaga

SEQ ID NO: 92453 - RNA, 19 nt, Homo sapiens
ugucaauggcugaaaguug

SEQ ID NO: 92454 - RNA, 19 nt, Homo sapiens
uggcuugaauguuaaaggu

SEQ ID NO: 92455 - RNA, 19 nt, Homo sapiens
aaaucaaauugcugaccaa

SEQ ID NO: 92456 - RNA, 19 nt, Homo sapiens
gacaaugcaggacaguaga

SEQ ID NO: 92457 - RNA, 19 nt, Homo sapiens
acacaaccuugcagacaac

SEQ ID NO: 92458 - RNA, 19 nt, Homo sapiens
aaugaacgguuggaagcaa

SEQ ID NO: 92459 - RNA, 19 nt, Homo sapiens
gcguggaaaccauugauca

SEQ ID NO: 92460 - RNA, 19 nt, Homo sapiens
ucccgauguucuuaauaaa

SEQ ID NO: 92461 - RNA, 19 nt, Homo sapiens
ucacccugcucucauuucu

SEQ ID NO: 92462 - RNA, 19 nt, Homo sapiens
ccuuguaauucgaauaucu

SEQ ID NO: 92463 - RNA, 19 nt, Homo sapiens
ucaugucaauggcugaaag

SEQ ID NO: 92464 - RNA, 19 nt, Homo sapiens
gcaagggagagugcccaaa

SEQ ID NO: 92465 - RNA, 19 nt, Homo sapiens
aagacacacugcagagagu

SEQ ID NO: 92466 - RNA, 19 nt, Homo sapiens
cuuguggcuugaauguuaa

SEQ ID NO: 92467 - RNA, 19 nt, Homo sapiens
caacguacaguccauuagc

SEQ ID NO: 92468 - RNA, 19 nt, Homo sapiens
ugaccaaggaauuaagugu

SEQ ID NO: 92469 - RNA, 19 nt, Homo sapiens
cggaauuaguguuauccau

SEQ ID NO: 92470 - RNA, 19 nt, Homo sapiens
gggaucccgauguucuuaa

SEQ ID NO: 92471 - RNA, 19 nt, Homo sapiens
caaauugcugaccaaggaa

SEQ ID NO: 92472 - RNA, 19 nt, Homo sapiens
gaaugaacgguuggaagca

SEQ ID NO: 92473 - RNA, 19 nt, Homo sapiens
gcacaugccagcggcuuac

SEQ ID NO: 92474 - RNA, 19 nt, Homo sapiens
cagguacaugugaagauuu

SEQ ID NO: 92475 - RNA, 19 nt, Homo sapiens
cagcagauggcgacaaugc

SEQ ID NO: 92476 - RNA, 19 nt, Homo sapiens
gccgagagaggaacaacau

SEQ ID NO: 92477 - RNA, 19 nt, Homo sapiens
ugaagaguugauuagcuaa

SEQ ID NO: 92478 - RNA, 19 nt, Homo sapiens
uuuccagacuuuagagcuu

SEQ ID NO: 92479 - RNA, 19 nt, Homo sapiens
ggugaacggaauuaguguu

SEQ ID NO: 92480 - RNA, 19 nt, Homo sapiens
ucagaugccugcagucauu

SEQ ID NO: 92481 - RNA, 19 nt, Homo sapiens
gaccuacgccuaccuguuu

SEQ ID NO: 92482 - RNA, 19 nt, Homo sapiens
caacaagggcaacaagaaa

SEQ ID NO: 92483 - RNA, 19 nt, Homo sapiens
ucuacaagcuggucaguga

SEQ ID NO: 92484 - RNA, 19 nt, Homo sapiens
cuugagcucuuccugaaua

SEQ ID NO: 92485 - RNA, 19 nt, Homo sapiens
ccaacuuccucaacaacua

SEQ ID NO: 92486 - RNA, 19 nt, Homo sapiens
cgacaugccugccaucaac

SEQ ID NO: 92487 - RNA, 19 nt, Homo sapiens
gccuguaccucaacauuug

SEQ ID NO: 92488 - RNA, 19 nt, Homo sapiens
caacauggacggccacauc

SEQ ID NO: 92489 - RNA, 19 nt, Homo sapiens
cgacaucgacuauauagca

SEQ ID NO: 92490 - RNA, 19 nt, Homo sapiens
uggaaggcgucaauaagaa

SEQ ID NO: 92491 - RNA, 19 nt, Homo sapiens
agacugugguggacuuuga

SEQ ID NO: 92492 - RNA, 19 nt, Homo sapiens
ugagaccgauguccucuuc

SEQ ID NO: 92493 - RNA, 19 nt, Homo sapiens
ccacagaugacuccaagga

SEQ ID NO: 92494 - RNA, 19 nt, Homo sapiens
gcgccaagacgaccuuuga

SEQ ID NO: 92495 - RNA, 19 nt, Homo sapiens
ccgccgacaucgacuauau

SEQ ID NO: 92496 - RNA, 19 nt, Homo sapiens
cccugacgcuggccuauaa

SEQ ID NO: 92497 - RNA, 19 nt, Homo sapiens
ccaagacgaccuuugaugu

SEQ ID NO: 92498 - RNA, 19 nt, Homo sapiens
cagaugacauucaguacgu

SEQ ID NO: 92499 - RNA, 19 nt, Homo sapiens
guggaaggcgucaauaaga

SEQ ID NO: 92500 - RNA, 19 nt, Homo sapiens
ccaacaacaucacgcucuu

SEQ ID NO: 92501 - RNA, 19 nt, Homo sapiens
gaucagcacauggccauug

SEQ ID NO: 92502 - RNA, 19 nt, Homo sapiens
ucaacaagggcaacaagaa

SEQ ID NO: 92503 - RNA, 19 nt, Homo sapiens
acgccaaucugccagguaa

SEQ ID NO: 92504 - RNA, 19 nt, Homo sapiens
gggccaacuuccucaacaa

SEQ ID NO: 92505 - RNA, 19 nt, Homo sapiens
agaauaagaagaagacugu

SEQ ID NO: 92506 - RNA, 19 nt, Homo sapiens
ggaggaggacuucuacaag

SEQ ID NO: 92507 - RNA, 19 nt, Homo sapiens
ucacggaggaggacuucua

SEQ ID NO: 92508 - RNA, 19 nt, Homo sapiens
ggaccugcccguuaugauc

SEQ ID NO: 92509 - RNA, 19 nt, Homo sapiens
ggaugaagacugccuguac

SEQ ID NO: 92510 - RNA, 19 nt, Homo sapiens
ggagaucaccaagaagaug

SEQ ID NO: 92511 - RNA, 19 nt, Homo sapiens
ugucauugauggagacuuc

SEQ ID NO: 92512 - RNA, 19 nt, Homo sapiens
ccaagagugccaagaccua

SEQ ID NO: 92513 - RNA, 19 nt, Homo sapiens
gaugacauucaguacguuu

SEQ ID NO: 92514 - RNA, 19 nt, Homo sapiens
agaagacugugguggacuu

SEQ ID NO: 92515 - RNA, 19 nt, Homo sapiens
gggccgaccaugcagauga

SEQ ID NO: 92516 - RNA, 19 nt, Homo sapiens
gcccagugucugaagguua

SEQ ID NO: 92517 - RNA, 19 nt, Homo sapiens
gggcuucgucccugucauu

SEQ ID NO: 92518 - RNA, 19 nt, Homo sapiens
ccucaacaacuaccuguau

SEQ ID NO: 92519 - RNA, 19 nt, Homo sapiens
cgaccaugcagaugacauu

SEQ ID NO: 92520 - RNA, 19 nt, Homo sapiens
ggaaggcgucaauaagaag

SEQ ID NO: 92521 - RNA, 19 nt, Homo sapiens
caagacgaccuuugauguc

SEQ ID NO: 92522 - RNA, 19 nt, Homo sapiens
ucaacaacuaccuguauga

SEQ ID NO: 92523 - RNA, 19 nt, Homo sapiens
gcucagaugccugcaguca

SEQ ID NO: 92524 - RNA, 19 nt, Homo sapiens
cuacuggacccucaccuau

SEQ ID NO: 92525 - RNA, 19 nt, Homo sapiens
gcuacuggacccucaccua

SEQ ID NO: 92526 - RNA, 19 nt, Homo sapiens
gaacccuacacuacggaaa

SEQ ID NO: 92527 - RNA, 19 nt, Homo sapiens
gagcucuuccugaauaaag

SEQ ID NO: 92528 - RNA, 19 nt, Homo sapiens
gccaagacgaccuuugaug

SEQ ID NO: 92529 - RNA, 19 nt, Homo sapiens
uugcuugggugaagaggaa

SEQ ID NO: 92530 - RNA, 19 nt, Homo sapiens
gaagacugugguggacuuu

SEQ ID NO: 92531 - RNA, 19 nt, Homo sapiens
cccaggagaauaagaagaa

SEQ ID NO: 92532 - RNA, 19 nt, Homo sapiens
ggacccaucccaggagaau

SEQ ID NO: 92533 - RNA, 19 nt, Homo sapiens
ggccauugcuugggugaag

SEQ ID NO: 92534 - RNA, 19 nt, Homo sapiens
ccaugagccuugguaucaa

SEQ ID NO: 92535 - RNA, 19 nt, Homo sapiens
cccaugagccuugguauca

SEQ ID NO: 92536 - RNA, 19 nt, Homo sapiens
caucccaggagaauaagaa

SEQ ID NO: 92537 - RNA, 19 nt, Homo sapiens
cuucgucccugucauugau

SEQ ID NO: 92538 - RNA, 19 nt, Homo sapiens
acccaucccaggagaauaa

SEQ ID NO: 92539 - RNA, 19 nt, Homo sapiens
cggaggaggacuucuacaa

SEQ ID NO: 92540 - RNA, 19 nt, Homo sapiens
guaucaagaggccacaaga

SEQ ID NO: 92541 - RNA, 19 nt, Homo sapiens
ccucucggaugcccgucua

SEQ ID NO: 92542 - RNA, 19 nt, Homo sapiens
caaucugccagguaacuau

SEQ ID NO: 92543 - RNA, 19 nt, Homo sapiens
gugacucuguggacaucuu

SEQ ID NO: 92544 - RNA, 19 nt, Homo sapiens
aagcggagccugagaacca

SEQ ID NO: 92545 - RNA, 19 nt, Homo sapiens
gggcagcagcuccaugaag

SEQ ID NO: 92546 - RNA, 19 nt, Homo sapiens
accuggagaucaccaagaa

SEQ ID NO: 92547 - RNA, 19 nt, Homo sapiens
ccaugcagaugacauucag

SEQ ID NO: 92548 - RNA, 19 nt, Homo sapiens
cagagccaaugccaagagu

SEQ ID NO: 92549 - RNA, 19 nt, Homo sapiens
ccucccaucuugagcucuu

SEQ ID NO: 92550 - RNA, 19 nt, Homo sapiens
gacgaccuuugaugucuac

SEQ ID NO: 92551 - RNA, 19 nt, Homo sapiens
gggaugaagacugccugua

SEQ ID NO: 92552 - RNA, 19 nt, Homo sapiens
cauggacggccacaucuuc

SEQ ID NO: 92553 - RNA, 19 nt, Homo sapiens
cucaacaacuaccuguaug

SEQ ID NO: 92554 - RNA, 19 nt, Homo sapiens
ugccugcagucauuagguu

SEQ ID NO: 92555 - RNA, 19 nt, Homo sapiens
cuggagaucaccaagaaga

SEQ ID NO: 92556 - RNA, 19 nt, Homo sapiens
gacaggacagucucuaagg

SEQ ID NO: 92557 - RNA, 19 nt, Homo sapiens
augcagaugacauucagua

SEQ ID NO: 92558 - RNA, 19 nt, Homo sapiens
ggacccugaaggccaagaa

SEQ ID NO: 92559 - RNA, 19 nt, Homo sapiens
aagacugccuguaccucaa

SEQ ID NO: 92560 - RNA, 19 nt, Homo sapiens
gcccugacgcuggccuaua

SEQ ID NO: 92561 - RNA, 19 nt, Homo sapiens
ccaaucugccagguaacua

SEQ ID NO: 92562 - RNA, 19 nt, Homo sapiens
cagaugccugcagucauua

SEQ ID NO: 92563 - RNA, 19 nt, Homo sapiens
gaccugcccguuaugaucu

SEQ ID NO: 92564 - RNA, 19 nt, Homo sapiens
gccgacaucgacuauauag

SEQ ID NO: 92565 - RNA, 19 nt, Homo sapiens
caacaacaucacgcucuuc

SEQ ID NO: 92566 - RNA, 19 nt, Homo sapiens
cagaguagccucaccauua

SEQ ID NO: 92567 - RNA, 19 nt, Homo sapiens
gcacacaccucuugauaag

SEQ ID NO: 92568 - RNA, 19 nt, Homo sapiens
gaagauguaucauaacagu

SEQ ID NO: 92569 - RNA, 19 nt, Homo sapiens
gacuuuaguuugugaguua

SEQ ID NO: 92570 - RNA, 19 nt, Homo sapiens
gcaagagaaauauguguua

SEQ ID NO: 92571 - RNA, 19 nt, Homo sapiens
ggagaagacugcaugacuu

SEQ ID NO: 92572 - RNA, 19 nt, Homo sapiens
ggacuuugcugucucugaa

SEQ ID NO: 92573 - RNA, 19 nt, Homo sapiens
caucagauuugcuguggua

SEQ ID NO: 92574 - RNA, 19 nt, Homo sapiens
gagcacacaccucuugaua

SEQ ID NO: 92575 - RNA, 19 nt, Homo sapiens
gagaaaagguuauguacuu

SEQ ID NO: 92576 - RNA, 19 nt, Homo sapiens
guauguguguguugcuuua

SEQ ID NO: 92577 - RNA, 19 nt, Homo sapiens
gcaugacuuuccucuguaa

SEQ ID NO: 92578 - RNA, 19 nt, Homo sapiens
gguaauauaugagacaauc

SEQ ID NO: 92579 - RNA, 19 nt, Homo sapiens
gagaagacugcaugacuuu

SEQ ID NO: 92580 - RNA, 19 nt, Homo sapiens
acacaccucuugauaagga

SEQ ID NO: 92581 - RNA, 19 nt, Homo sapiens
cuaguaaauuccugucaaa

SEQ ID NO: 92582 - RNA, 19 nt, Homo sapiens
uagaaaaccuguaagcuuu

SEQ ID NO: 92583 - RNA, 19 nt, Homo sapiens
caacggauguguagcuuuu

SEQ ID NO: 92584 - RNA, 19 nt, Homo sapiens
gcugggcauuuccaucaua

SEQ ID NO: 92585 - RNA, 19 nt, Homo sapiens
uuacucaugugacuauuug

SEQ ID NO: 92586 - RNA, 19 nt, Homo sapiens
gagacaagguuggcuaaag

SEQ ID NO: 92587 - RNA, 19 nt, Homo sapiens
ccuguaagcuuugauguuc

SEQ ID NO: 92588 - RNA, 19 nt, Homo sapiens
gcgaugcugucuggacuuu

SEQ ID NO: 92589 - RNA, 19 nt, Homo sapiens
auaaagagacuccaagguu

SEQ ID NO: 92590 - RNA, 19 nt, Homo sapiens
ccaaaggccugaaaauaau

SEQ ID NO: 92591 - RNA, 19 nt, Homo sapiens
ccagagccaugacuagauc

SEQ ID NO: 92592 - RNA, 19 nt, Homo sapiens
uaaaggagauccgaaagcu

SEQ ID NO: 92593 - RNA, 19 nt, Homo sapiens
guaaauuccugucaaaauc

SEQ ID NO: 92594 - RNA, 19 nt, Homo sapiens
cugcaugacuuuccucugu

SEQ ID NO: 92595 - RNA, 19 nt, Homo sapiens
uuacaugcaggccgaguua

SEQ ID NO: 92596 - RNA, 19 nt, Homo sapiens
agaguagccucaccauuag

SEQ ID NO: 92597 - RNA, 19 nt, Homo sapiens
gcauuuccaucauauagac

SEQ ID NO: 92598 - RNA, 19 nt, Homo sapiens
gagguaauauaugagacaa

SEQ ID NO: 92599 - RNA, 19 nt, Homo sapiens
gaaggagaagacugcauga

SEQ ID NO: 92600 - RNA, 19 nt, Homo sapiens
aagguugacuuuaguuugu

SEQ ID NO: 92601 - RNA, 19 nt, Homo sapiens
agacaagguuggcuaaagg

SEQ ID NO: 92602 - RNA, 19 nt, Homo sapiens
caagguugacuuuaguuug

SEQ ID NO: 92603 - RNA, 19 nt, Homo sapiens
agaggcagcagaagcauuu

SEQ ID NO: 92604 - RNA, 19 nt, Homo sapiens
gcaagcccaggcccuauug

SEQ ID NO: 92605 - RNA, 19 nt, Homo sapiens
ucuaguaaauuccugucaa

SEQ ID NO: 92606 - RNA, 19 nt, Homo sapiens
gggcauuuccaucauauag

SEQ ID NO: 92607 - RNA, 19 nt, Homo sapiens
cagauuugcugugguaugg

SEQ ID NO: 92608 - RNA, 19 nt, Homo sapiens
aaagagacuccaagguuga

SEQ ID NO: 92609 - RNA, 19 nt, Homo sapiens
aagcuuugauguucugguu

SEQ ID NO: 92610 - RNA, 19 nt, Homo sapiens
gaaaaccuguaagcuuuga

SEQ ID NO: 92611 - RNA, 19 nt, Homo sapiens
gauguucugguuacuucua

SEQ ID NO: 92612 - RNA, 19 nt, Homo sapiens
ccaagguugacuuuaguuu

SEQ ID NO: 92613 - RNA, 19 nt, Homo sapiens
ggcagcaucauguaacuga

SEQ ID NO: 92614 - RNA, 19 nt, Homo sapiens
gauaaagagacuccaaggu

SEQ ID NO: 92615 - RNA, 19 nt, Homo sapiens
gaugcugucuggacuuugc

SEQ ID NO: 92616 - RNA, 19 nt, Homo sapiens
acuccaagguugacuuuag

SEQ ID NO: 92617 - RNA, 19 nt, Homo sapiens
guuacucucuucccaaagg

SEQ ID NO: 92618 - RNA, 19 nt, Homo sapiens
gauguaucauaacaguuca

SEQ ID NO: 92619 - RNA, 19 nt, Homo sapiens
ugacuuuaguuugugaguu

SEQ ID NO: 92620 - RNA, 19 nt, Homo sapiens
gccaagcaccggcucaugu

SEQ ID NO: 92621 - RNA, 19 nt, Homo sapiens
gcuuugauguucugguuac

SEQ ID NO: 92622 - RNA, 19 nt, Homo sapiens
caaucaacaccguuccaaa

SEQ ID NO: 92623 - RNA, 19 nt, Homo sapiens
guaacagagguaauauaug

SEQ ID NO: 92624 - RNA, 19 nt, Homo sapiens
gcuccugcacccaguguuu

SEQ ID NO: 92625 - RNA, 19 nt, Homo sapiens
ggcaagagaaauauguguu

SEQ ID NO: 92626 - RNA, 19 nt, Homo sapiens
ccgccuggcaagagaaaua

SEQ ID NO: 92627 - RNA, 19 nt, Homo sapiens
gguugacuuuaguuuguga

SEQ ID NO: 92628 - RNA, 19 nt, Homo sapiens
ggagacaagguuggcuaaa

SEQ ID NO: 92629 - RNA, 19 nt, Homo sapiens
gcacccaguguuucuguca

SEQ ID NO: 92630 - RNA, 19 nt, Homo sapiens
ugcaugacuuuccucugua

SEQ ID NO: 92631 - RNA, 19 nt, Homo sapiens
aagguuggcuaaaggagau

SEQ ID NO: 92632 - RNA, 19 nt, Homo sapiens
agauguaucauaacaguuc

SEQ ID NO: 92633 - RNA, 19 nt, Homo sapiens
gaaacuuaauuggggauga

SEQ ID NO: 92634 - RNA, 19 nt, Homo sapiens
aagcauuucuaguucaucu

SEQ ID NO: 92635 - RNA, 19 nt, Homo sapiens
uguaguuucuuuguagaga

SEQ ID NO: 92636 - RNA, 19 nt, Homo sapiens
cuggaaggcugggcauuuc

SEQ ID NO: 92637 - RNA, 19 nt, Homo sapiens
uccaaaggccugaaaauaa

SEQ ID NO: 92638 - RNA, 19 nt, Homo sapiens
aaucaacaccguuccaaag

SEQ ID NO: 92639 - RNA, 19 nt, Homo sapiens
acgccuaucuccucaccuu

SEQ ID NO: 92640 - RNA, 19 nt, Homo sapiens
ccuauuggcccuacaagag

SEQ ID NO: 92641 - RNA, 19 nt, Homo sapiens
uugauguucugguuacuuc

SEQ ID NO: 92642 - RNA, 19 nt, Homo sapiens
ggcuaaaggagauccgaaa

SEQ ID NO: 92643 - RNA, 19 nt, Homo sapiens
acagagguaauauaugaga

SEQ ID NO: 92644 - RNA, 19 nt, Homo sapiens
ggcaagcccaggcccuauu

SEQ ID NO: 92645 - RNA, 19 nt, Homo sapiens
gacaagguuggcuaaagga

SEQ ID NO: 92646 - RNA, 19 nt, Homo sapiens
guuacucaugugacuauuu

SEQ ID NO: 92647 - RNA, 19 nt, Homo sapiens
ccaagcaccggcucaugug

SEQ ID NO: 92648 - RNA, 19 nt, Homo sapiens
ucagccgccuggcaagaga

SEQ ID NO: 92649 - RNA, 19 nt, Homo sapiens
acaagaggcagcagaagca

SEQ ID NO: 92650 - RNA, 19 nt, Homo sapiens
gcuaaaggagauccgaaag

SEQ ID NO: 92651 - RNA, 19 nt, Homo sapiens
ccuggaaggcugggcauuu

SEQ ID NO: 92652 - RNA, 19 nt, Homo sapiens
gagauccgaaagcuucaga

SEQ ID NO: 92653 - RNA, 19 nt, Homo sapiens
gaagacugcaugacuuucc

SEQ ID NO: 92654 - RNA, 19 nt, Homo sapiens
uaguuucuuuguagagaga

SEQ ID NO: 92655 - RNA, 19 nt, Homo sapiens
uguaagcuuugauguucug

SEQ ID NO: 92656 - RNA, 19 nt, Homo sapiens
ugugacuauuugaggauuu

SEQ ID NO: 92657 - RNA, 19 nt, Homo sapiens
agacuccaagguugacuuu

SEQ ID NO: 92658 - RNA, 19 nt, Homo sapiens
ucagauaaagagacuccaa

SEQ ID NO: 92659 - RNA, 19 nt, Homo sapiens
uguguguguugcuuuaaau

SEQ ID NO: 92660 - RNA, 19 nt, Homo sapiens
ugaguggacugugcuuguc

SEQ ID NO: 92661 - RNA, 19 nt, Homo sapiens
uuugagcaguugccuggaa

SEQ ID NO: 92662 - RNA, 19 nt, Homo sapiens
caagcaccggcucauguga

SEQ ID NO: 92663 - RNA, 19 nt, Homo sapiens
cccaaaggaugugcaacug

SEQ ID NO: 92664 - RNA, 19 nt, Homo sapiens
gcuugucaacggaugugua

SEQ ID NO: 92665 - RNA, 19 nt, Homo sapiens
ggcauuuccaucauauaga

SEQ ID NO: 92666 - RNA, 19 nt, Homo sapiens
ggacauagccgccugcuuu

SEQ ID NO: 92667 - RNA, 19 nt, Homo sapiens
gggaagggcuccagaagaa

SEQ ID NO: 92668 - RNA, 19 nt, Homo sapiens
ggaagaggaugaugaagau

SEQ ID NO: 92669 - RNA, 19 nt, Homo sapiens
gcacgauccugaagaacaa

SEQ ID NO: 92670 - RNA, 19 nt, Homo sapiens
cagccucacugccugcuua

SEQ ID NO: 92671 - RNA, 19 nt, Homo sapiens
ggaagaggacgaugaggaa

SEQ ID NO: 92672 - RNA, 19 nt, Homo sapiens
ggaggagggugauguugau

SEQ ID NO: 92673 - RNA, 19 nt, Homo sapiens
ggacaucaaagcugaguca

SEQ ID NO: 92674 - RNA, 19 nt, Homo sapiens
ggaggaagagggugaagga

SEQ ID NO: 92675 - RNA, 19 nt, Homo sapiens
ggagggugauguugauagu

SEQ ID NO: 92676 - RNA, 19 nt, Homo sapiens
ccgaauggcugcagagucu

SEQ ID NO: 92677 - RNA, 19 nt, Homo sapiens
ggaagaagaggaggaggaa

SEQ ID NO: 92678 - RNA, 19 nt, Homo sapiens
ugagcacgauccugaagaa

SEQ ID NO: 92679 - RNA, 19 nt, Homo sapiens
gggaggccauggcuuacuu

SEQ ID NO: 92680 - RNA, 19 nt, Homo sapiens
aagaagaggaggaagauga

SEQ ID NO: 92681 - RNA, 19 nt, Homo sapiens
caucaccacuucccucaag

SEQ ID NO: 92682 - RNA, 19 nt, Homo sapiens
cgggagaagucacggauca

SEQ ID NO: 92683 - RNA, 19 nt, Homo sapiens
agaggaugaugaagaugaa

SEQ ID NO: 92684 - RNA, 19 nt, Homo sapiens
agggugauguugauaguga

SEQ ID NO: 92685 - RNA, 19 nt, Homo sapiens
ggaggaggagggugauguu

SEQ ID NO: 92686 - RNA, 19 nt, Homo sapiens
gcugcuccuuucccaguuu

SEQ ID NO: 92687 - RNA, 19 nt, Homo sapiens
cccagauccuuuaguaaug

SEQ ID NO: 92688 - RNA, 19 nt, Homo sapiens
ugaggaagaggaugaugaa

SEQ ID NO: 92689 - RNA, 19 nt, Homo sapiens
cggaggcccugcacuuugu

SEQ ID NO: 92690 - RNA, 19 nt, Homo sapiens
ucaagggcaucauccucaa

SEQ ID NO: 92691 - RNA, 19 nt, Homo sapiens
ccucacugccugcuuauug

SEQ ID NO: 92692 - RNA, 19 nt, Homo sapiens
agacgacgaugaugaugag

SEQ ID NO: 92693 - RNA, 19 nt, Homo sapiens
ugacuuuggcccuugguuu

SEQ ID NO: 92694 - RNA, 19 nt, Homo sapiens
gcuuauugccucuuucuca

SEQ ID NO: 92695 - RNA, 19 nt, Homo sapiens
aacacgaucugguucaugu

SEQ ID NO: 92696 - RNA, 19 nt, Homo sapiens
aagaagaggaggaggaaga

SEQ ID NO: 92697 - RNA, 19 nt, Homo sapiens
ucacggaggcccugcacuu

SEQ ID NO: 92698 - RNA, 19 nt, Homo sapiens
ugauagugaugaagaagag

SEQ ID NO: 92699 - RNA, 19 nt, Homo sapiens
ggaggaggaggaggaagaa

SEQ ID NO: 92700 - RNA, 19 nt, Homo sapiens
caagagugagggagaggaa

SEQ ID NO: 92701 - RNA, 19 nt, Homo sapiens
ugaagacgacgaugaugau

SEQ ID NO: 92702 - RNA, 19 nt, Homo sapiens
ugaggaggauggugaugag

SEQ ID NO: 92703 - RNA, 19 nt, Homo sapiens
ggagaagucacggaucauc

SEQ ID NO: 92704 - RNA, 19 nt, Homo sapiens
gccuugagaagcacaguuu

SEQ ID NO: 92705 - RNA, 19 nt, Homo sapiens
gaagacgacgaugaugaug

SEQ ID NO: 92706 - RNA, 19 nt, Homo sapiens
aagaggaugaugaagauga

SEQ ID NO: 92707 - RNA, 19 nt, Homo sapiens
gugaggaagaggacgauga

SEQ ID NO: 92708 - RNA, 19 nt, Homo sapiens
ggaggaggaggaagaagag

SEQ ID NO: 92709 - RNA, 19 nt, Homo sapiens
aggaagaggaugaugaaga

SEQ ID NO: 92710 - RNA, 19 nt, Homo sapiens
ggcgggagcacuacugguu

SEQ ID NO: 92711 - RNA, 19 nt, Homo sapiens
ggacgaugaggaagaggau

SEQ ID NO: 92712 - RNA, 19 nt, Homo sapiens
gaagcccagugcccuacuc

SEQ ID NO: 92713 - RNA, 19 nt, Homo sapiens
gaagaagaggaggaagaug

SEQ ID NO: 92714 - RNA, 19 nt, Homo sapiens
aguggagccuucggacaua

SEQ ID NO: 92715 - RNA, 19 nt, Homo sapiens
cuugagaagcacaguuuaa

SEQ ID NO: 92716 - RNA, 19 nt, Homo sapiens
ggaggccauggcuuacuuu

SEQ ID NO: 92717 - RNA, 19 nt, Homo sapiens
ugauguugauagugaugaa

SEQ ID NO: 92718 - RNA, 19 nt, Homo sapiens
gaggagggugauguugaua

SEQ ID NO: 92719 - RNA, 19 nt, Homo sapiens
ccagauccuuuaguaaugc

SEQ ID NO: 92720 - RNA, 19 nt, Homo sapiens
aagaugaagacgacgauga

SEQ ID NO: 92721 - RNA, 19 nt, Homo sapiens
ccagugcccuacucugcau

SEQ ID NO: 92722 - RNA, 19 nt, Homo sapiens
ugaagaagaggaggaagau

SEQ ID NO: 92723 - RNA, 19 nt, Homo sapiens
gcccuguccaugugacuuu

SEQ ID NO: 92724 - RNA, 19 nt, Homo sapiens
ccauccacgucaggucuuu

SEQ ID NO: 92725 - RNA, 19 nt, Homo sapiens
gcagagccccagauccuuu

SEQ ID NO: 92726 - RNA, 19 nt, Homo sapiens
gagccacauccuccacuug

SEQ ID NO: 92727 - RNA, 19 nt, Homo sapiens
guucaugugaccaggaaga

SEQ ID NO: 92728 - RNA, 19 nt, Homo sapiens
ggaggaggaggaggaggaa

SEQ ID NO: 92729 - RNA, 19 nt, Homo sapiens
ggcgggaguucgaggucuu

SEQ ID NO: 92730 - RNA, 19 nt, Homo sapiens
gaagaggaugaugaagaug

SEQ ID NO: 92731 - RNA, 19 nt, Homo sapiens
gacauagccgccugcuuuc

SEQ ID NO: 92732 - RNA, 19 nt, Homo sapiens
gaugaagacgacgaugaug

SEQ ID NO: 92733 - RNA, 19 nt, Homo sapiens
gaggaggagggugauguug

SEQ ID NO: 92734 - RNA, 19 nt, Homo sapiens
gccaggccaugcugcucaa

SEQ ID NO: 92735 - RNA, 19 nt, Homo sapiens
ccacuuggaacacgaucug

SEQ ID NO: 92736 - RNA, 19 nt, Homo sapiens
guacagagguuucaguuaa

SEQ ID NO: 92737 - RNA, 19 nt, Homo sapiens
gccaguagaucuuggauua

SEQ ID NO: 92738 - RNA, 19 nt, Homo sapiens
gcgaauagauuaucaagga

SEQ ID NO: 92739 - RNA, 19 nt, Homo sapiens
gaaaucacauccaaaguca

SEQ ID NO: 92740 - RNA, 19 nt, Homo sapiens
gaacagaauccaucacaaa

SEQ ID NO: 92741 - RNA, 19 nt, Homo sapiens
ugacaaacauucccauaaa

SEQ ID NO: 92742 - RNA, 19 nt, Homo sapiens
gaggagagcgaauagauua

SEQ ID NO: 92743 - RNA, 19 nt, Homo sapiens
acaagaagcucaaagaaug

SEQ ID NO: 92744 - RNA, 19 nt, Homo sapiens
ccauaaaccucacccagua

SEQ ID NO: 92745 - RNA, 19 nt, Homo sapiens
ucaaagaaauucagacaga

SEQ ID NO: 92746 - RNA, 19 nt, Homo sapiens
gguagaaagucaagagaaa

SEQ ID NO: 92747 - RNA, 19 nt, Homo sapiens
gaaagaaugauguggauga

SEQ ID NO: 92748 - RNA, 19 nt, Homo sapiens
gcucaaagaaugaagauaa

SEQ ID NO: 92749 - RNA, 19 nt, Homo sapiens
gcauaagacuucaguuuua

SEQ ID NO: 92750 - RNA, 19 nt, Homo sapiens
gaagagaugggaaaugauu

SEQ ID NO: 92751 - RNA, 19 nt, Homo sapiens
gaucaaccaaccuuaaaua

SEQ ID NO: 92752 - RNA, 19 nt, Homo sapiens
gaaagaagccucucuacag

SEQ ID NO: 92753 - RNA, 19 nt, Homo sapiens
ggaagagcaugaagagaug

SEQ ID NO: 92754 - RNA, 19 nt, Homo sapiens
caagagaacacguuugaaa

SEQ ID NO: 92755 - RNA, 19 nt, Homo sapiens
cagaauccaucacaaacua

SEQ ID NO: 92756 - RNA, 19 nt, Homo sapiens
gagcauaagacuucaguuu

SEQ ID NO: 92757 - RNA, 19 nt, Homo sapiens
gaugaaauuuccagauguu

SEQ ID NO: 92758 - RNA, 19 nt, Homo sapiens
caagacgaauuucaaagaa

SEQ ID NO: 92759 - RNA, 19 nt, Homo sapiens
gaaauucaacgacaagcua

SEQ ID NO: 92760 - RNA, 19 nt, Homo sapiens
gaagaaagaagccucucua

SEQ ID NO: 92761 - RNA, 19 nt, Homo sapiens
aaaaggaucugucuugaua

SEQ ID NO: 92762 - RNA, 19 nt, Homo sapiens
cagugaagcugaugaagaa

SEQ ID NO: 92763 - RNA, 19 nt, Homo sapiens
agaaugauguggaugauga

SEQ ID NO: 92764 - RNA, 19 nt, Homo sapiens
acaaaucagucaucuaaga

SEQ ID NO: 92765 - RNA, 19 nt, Homo sapiens
gaagaaaauucauggcuaa

SEQ ID NO: 92766 - RNA, 19 nt, Homo sapiens
ggauacaaguuaugcuuug

SEQ ID NO: 92767 - RNA, 19 nt, Homo sapiens
gaaacaagagagauuauuc

SEQ ID NO: 92768 - RNA, 19 nt, Homo sapiens
gauauuaggaccacaagaa

SEQ ID NO: 92769 - RNA, 19 nt, Homo sapiens
gaaaugaauuaccaaugca

SEQ ID NO: 92770 - RNA, 19 nt, Homo sapiens
ugaagcugaugaagaauuu

SEQ ID NO: 92771 - RNA, 19 nt, Homo sapiens
gaaagaucaaccaaccuua

SEQ ID NO: 92772 - RNA, 19 nt, Homo sapiens
ucaggaggauucgugauua

SEQ ID NO: 92773 - RNA, 19 nt, Homo sapiens
cuuccaggcucaauaauaa

SEQ ID NO: 92774 - RNA, 19 nt, Homo sapiens
gaugggaaaugauuguguu

SEQ ID NO: 92775 - RNA, 19 nt, Homo sapiens
guugauagaggaugaauuu

SEQ ID NO: 92776 - RNA, 19 nt, Homo sapiens
agagagagacuuacacuuu

SEQ ID NO: 92777 - RNA, 19 nt, Homo sapiens
caaagaaauucagacagaa

SEQ ID NO: 92778 - RNA, 19 nt, Homo sapiens
caucacauauuacccaaga

SEQ ID NO: 92779 - RNA, 19 nt, Homo sapiens
uaaauaugcugccuucaag

SEQ ID NO: 92780 - RNA, 19 nt, Homo sapiens
gcaaagagugccagaaauc

SEQ ID NO: 92781 - RNA, 19 nt, Homo sapiens
gacauuggauacacccuuu

SEQ ID NO: 92782 - RNA, 19 nt, Homo sapiens
cagaauagaauacgagauu

SEQ ID NO: 92783 - RNA, 19 nt, Homo sapiens
agaagccucucuacaguuu

SEQ ID NO: 92784 - RNA, 19 nt, Homo sapiens
caaagucaguuccaguuuc

SEQ ID NO: 92785 - RNA, 19 nt, Homo sapiens
ggauuacaauaccaagaaa

SEQ ID NO: 92786 - RNA, 19 nt, Homo sapiens
gaauccagucccauuguua

SEQ ID NO: 92787 - RNA, 19 nt, Homo sapiens
aaauacaccugacucgaaa

SEQ ID NO: 92788 - RNA, 19 nt, Homo sapiens
guaaauaugcugccuucaa

SEQ ID NO: 92789 - RNA, 19 nt, Homo sapiens
gcagaagacagcaacuaaa

SEQ ID NO: 92790 - RNA, 19 nt, Homo sapiens
gaucaucucagaauagaau

SEQ ID NO: 92791 - RNA, 19 nt, Homo sapiens
gagcaaggccagaauguuc

SEQ ID NO: 92792 - RNA, 19 nt, Homo sapiens
cuaaagugauaccaaagaa

SEQ ID NO: 92793 - RNA, 19 nt, Homo sapiens
gaaguucagaugacucaaa

SEQ ID NO: 92794 - RNA, 19 nt, Homo sapiens
caaguuaugcuuugauaga

SEQ ID NO: 92795 - RNA, 19 nt, Homo sapiens
uaaaggcaaccaaagagua

SEQ ID NO: 92796 - RNA, 19 nt, Homo sapiens
aaagaagccucucuacagu

SEQ ID NO: 92797 - RNA, 19 nt, Homo sapiens
ccagaaacaagagagauua

SEQ ID NO: 92798 - RNA, 19 nt, Homo sapiens
ggaaguucauggaaguuca

SEQ ID NO: 92799 - RNA, 19 nt, Homo sapiens
aaacaguacuggauacaag

SEQ ID NO: 92800 - RNA, 19 nt, Homo sapiens
cgaaguugauagaggauga

SEQ ID NO: 92801 - RNA, 19 nt, Homo sapiens
gagagagacuuacacuuuu

SEQ ID NO: 92802 - RNA, 19 nt, Homo sapiens
caaaaucagugccuaauuc

SEQ ID NO: 92803 - RNA, 19 nt, Homo sapiens
uaaaccagcugaagaacag

SEQ ID NO: 92804 - RNA, 19 nt, Homo sapiens
gauacaaguuaugcuuuga

SEQ ID NO: 92805 - RNA, 19 nt, Homo sapiens
gagagcgaauagauuauca

SEQ ID NO: 92806 - RNA, 19 nt, Homo sapiens
agacuuggcuaagaagaaa

SEQ ID NO: 92807 - RNA, 19 nt, Homo sapiens
gaaauauggaagagcauga

SEQ ID NO: 92808 - RNA, 19 nt, Homo sapiens
ucaggaucaucucagaaua

SEQ ID NO: 92809 - RNA, 19 nt, Homo sapiens
gaagguauacaagacauug

SEQ ID NO: 92810 - RNA, 19 nt, Homo sapiens
ggaucugucuugauaacga

SEQ ID NO: 92811 - RNA, 19 nt, Homo sapiens
ccaaagaguacagaaguuu

SEQ ID NO: 92812 - RNA, 19 nt, Homo sapiens
caaaucagucaucuaagaa

SEQ ID NO: 92813 - RNA, 19 nt, Homo sapiens
ggaccaagagaacacguuu

SEQ ID NO: 92814 - RNA, 19 nt, Homo sapiens
caacagagucaaacuugga

SEQ ID NO: 92815 - RNA, 19 nt, Homo sapiens
agaaaugaauuaccaaugc

SEQ ID NO: 92816 - RNA, 19 nt, Homo sapiens
ccaagacgaauuucaaaga

SEQ ID NO: 92817 - RNA, 19 nt, Homo sapiens
guuaugcuuugauagauga

SEQ ID NO: 92818 - RNA, 19 nt, Homo sapiens
ugaggaaaguguucuucuu

SEQ ID NO: 92819 - RNA, 19 nt, Homo sapiens
guaaaggacccagaaacaa

SEQ ID NO: 92820 - RNA, 19 nt, Homo sapiens
gguaaaggacccagaaaca

SEQ ID NO: 92821 - RNA, 19 nt, Homo sapiens
cauuaugacugcacagaau

SEQ ID NO: 92822 - RNA, 19 nt, Homo sapiens
uaaaguaucagaugaagag

SEQ ID NO: 92823 - RNA, 19 nt, Homo sapiens
aaagaucaaccaaccuuaa

SEQ ID NO: 92824 - RNA, 19 nt, Homo sapiens
cauguaauauaccaacaga

SEQ ID NO: 92825 - RNA, 19 nt, Homo sapiens
gcaacuaaaggcaaccaaa

SEQ ID NO: 92826 - RNA, 19 nt, Homo sapiens
gacuucaacugucacgaaa

SEQ ID NO: 92827 - RNA, 19 nt, Homo sapiens
ugauaacgaugaaagaaag

SEQ ID NO: 92828 - RNA, 19 nt, Homo sapiens
cgaauagauuaucaaggaa

SEQ ID NO: 92829 - RNA, 19 nt, Homo sapiens
gcugaagguucuggaggua

SEQ ID NO: 92830 - RNA, 19 nt, Homo sapiens
ggcagaagacagcaacuaa

SEQ ID NO: 92831 - RNA, 19 nt, Homo sapiens
augaagagaugggaaauga

SEQ ID NO: 92832 - RNA, 19 nt, Homo sapiens
gggacagucuaaagaugaa

SEQ ID NO: 92833 - RNA, 19 nt, Homo sapiens
cgccugagacuuaagguua

SEQ ID NO: 92834 - RNA, 19 nt, Homo sapiens
ggaccuuccaggcucaaua

SEQ ID NO: 92835 - RNA, 19 nt, Homo sapiens
caagaagcucaaagaauga

SEQ ID NO: 92836 - RNA, 19 nt, Homo sapiens
gaagacagcucaaauaaua

SEQ ID NO: 92837 - RNA, 19 nt, Homo sapiens
gaacaguccuuaaauauga

SEQ ID NO: 92838 - RNA, 19 nt, Homo sapiens
gaaagaagaugucaauaug

SEQ ID NO: 92839 - RNA, 19 nt, Homo sapiens
gaaggaaacugaaauauca

SEQ ID NO: 92840 - RNA, 19 nt, Homo sapiens
caacaaagcuacuaaauca

SEQ ID NO: 92841 - RNA, 19 nt, Homo sapiens
ggaaagaagugcuaccaua

SEQ ID NO: 92842 - RNA, 19 nt, Homo sapiens
gaccaaagcuuaacucuga

SEQ ID NO: 92843 - RNA, 19 nt, Homo sapiens
caacaugaaugcaucaaua

SEQ ID NO: 92844 - RNA, 19 nt, Homo sapiens
cguauuaucugcacaauua

SEQ ID NO: 92845 - RNA, 19 nt, Homo sapiens
caagaacaguccuuaaaua

SEQ ID NO: 92846 - RNA, 19 nt, Homo sapiens
ggaaagaaaugacacaguu

SEQ ID NO: 92847 - RNA, 19 nt, Homo sapiens
gaaaagugcucuagaauaa

SEQ ID NO: 92848 - RNA, 19 nt, Homo sapiens
gaaaugagaucuguaacaa

SEQ ID NO: 92849 - RNA, 19 nt, Homo sapiens
gaagagcuccauauaauaa

SEQ ID NO: 92850 - RNA, 19 nt, Homo sapiens
ggaaagggaccaauucaua

SEQ ID NO: 92851 - RNA, 19 nt, Homo sapiens
gaacaagaggaaacuauua

SEQ ID NO: 92852 - RNA, 19 nt, Homo sapiens
gaaaugaaaucuguagcua

SEQ ID NO: 92853 - RNA, 19 nt, Homo sapiens
ggaaagagauacaagacaa

SEQ ID NO: 92854 - RNA, 19 nt, Homo sapiens
gcaggaaacuauugacaaa

SEQ ID NO: 92855 - RNA, 19 nt, Homo sapiens
gcagcaaacuuuagaagaa

SEQ ID NO: 92856 - RNA, 19 nt, Homo sapiens
gagaaugaaucaggaaaua

SEQ ID NO: 92857 - RNA, 19 nt, Homo sapiens
ugaaggaucuguuaaggua

SEQ ID NO: 92858 - RNA, 19 nt, Homo sapiens
gaaacaacaucaagaaaca

SEQ ID NO: 92859 - RNA, 19 nt, Homo sapiens
gaagaauacuccuuauguu

SEQ ID NO: 92860 - RNA, 19 nt, Homo sapiens
gagaagaugucaauaggaa

SEQ ID NO: 92861 - RNA, 19 nt, Homo sapiens
gaagaucauuugggaguua

SEQ ID NO: 92862 - RNA, 19 nt, Homo sapiens
gaucgugucuuucauggua

SEQ ID NO: 92863 - RNA, 19 nt, Homo sapiens
gaacauauaaggcuagaaa

SEQ ID NO: 92864 - RNA, 19 nt, Homo sapiens
ggaaaugacuuuguuuaug

SEQ ID NO: 92865 - RNA, 19 nt, Homo sapiens
gaagaaaugagaucuguaa

SEQ ID NO: 92866 - RNA, 19 nt, Homo sapiens
gaguagaguucaagguuua

SEQ ID NO: 92867 - RNA, 19 nt, Homo sapiens
uuaagaagcuacaggaaua

SEQ ID NO: 92868 - RNA, 19 nt, Homo sapiens
gaauuucucuuacguguau

SEQ ID NO: 92869 - RNA, 19 nt, Homo sapiens
gcaaaugaacaucaacuua

SEQ ID NO: 92870 - RNA, 19 nt, Homo sapiens
gaauugacauuggaacaua

SEQ ID NO: 92871 - RNA, 19 nt, Homo sapiens
caacuacacagucgaauua

SEQ ID NO: 92872 - RNA, 19 nt, Homo sapiens
caaauaaacccuuaacuug

SEQ ID NO: 92873 - RNA, 19 nt, Homo sapiens
ugaagaaacugaaguaugu

SEQ ID NO: 92874 - RNA, 19 nt, Homo sapiens
caacaacacuggcaagaau

SEQ ID NO: 92875 - RNA, 19 nt, Homo sapiens
aaggaaggcuguaauauaa

SEQ ID NO: 92876 - RNA, 19 nt, Homo sapiens
ggaaagagacaaccuuaaa

SEQ ID NO: 92877 - RNA, 19 nt, Homo sapiens
gcaacaacuucuuaaugua

SEQ ID NO: 92878 - RNA, 19 nt, Homo sapiens
gaaaugcucuugagucucu

SEQ ID NO: 92879 - RNA, 19 nt, Homo sapiens
gaacaacuacgaacagaaa

SEQ ID NO: 92880 - RNA, 19 nt, Homo sapiens
caagauaccucagugauau

SEQ ID NO: 92881 - RNA, 19 nt, Homo sapiens
ugaaagccuugaagaaaua

SEQ ID NO: 92882 - RNA, 19 nt, Homo sapiens
gaacaaagaauugacauug

SEQ ID NO: 92883 - RNA, 19 nt, Homo sapiens
ccacuagaguugaaagaua

SEQ ID NO: 92884 - RNA, 19 nt, Homo sapiens
gaacggaauuuacaagauc

SEQ ID NO: 92885 - RNA, 19 nt, Homo sapiens
caagaacaauuacgaaaug

SEQ ID NO: 92886 - RNA, 19 nt, Homo sapiens
ugaaaucacugaaagagaa

SEQ ID NO: 92887 - RNA, 19 nt, Homo sapiens
gagaagacagcucaaauaa

SEQ ID NO: 92888 - RNA, 19 nt, Homo sapiens
caaggaaggcuguaauaua

SEQ ID NO: 92889 - RNA, 19 nt, Homo sapiens
gauccagcauuccuuauuu

SEQ ID NO: 92890 - RNA, 19 nt, Homo sapiens
gauaggauuugucaaguga

SEQ ID NO: 92891 - RNA, 19 nt, Homo sapiens
ccaagaaacuauugaugaa

SEQ ID NO: 92892 - RNA, 19 nt, Homo sapiens
ggaaauaguuaaucucucu

SEQ ID NO: 92893 - RNA, 19 nt, Homo sapiens
guaacacucuugauacauu

SEQ ID NO: 92894 - RNA, 19 nt, Homo sapiens
gagcuaagccauauaaaga

SEQ ID NO: 92895 - RNA, 19 nt, Homo sapiens
gcaugaagcuaaagaaagu

SEQ ID NO: 92896 - RNA, 19 nt, Homo sapiens
caacagaguuugaggaaag

SEQ ID NO: 92897 - RNA, 19 nt, Homo sapiens
gaaacugaaguauguguua

SEQ ID NO: 92898 - RNA, 19 nt, Homo sapiens
ucaagaaagucaagaagaa

SEQ ID NO: 92899 - RNA, 19 nt, Homo sapiens
cuaaacaccuggaaacuga

SEQ ID NO: 92900 - RNA, 19 nt, Homo sapiens
gaagugaaaucuauaacca

SEQ ID NO: 92901 - RNA, 19 nt, Homo sapiens
caagaaagacuaaaugaga

SEQ ID NO: 92902 - RNA, 19 nt, Homo sapiens
ugaaagaacuugcaacuac

SEQ ID NO: 92903 - RNA, 19 nt, Homo sapiens
gaaaauagaccuagagaaa

SEQ ID NO: 92904 - RNA, 19 nt, Homo sapiens
gaagagauacucagagaug

SEQ ID NO: 92905 - RNA, 19 nt, Homo sapiens
uaagagggauuguuucaga

SEQ ID NO: 92906 - RNA, 19 nt, Homo sapiens
ggagaaagaugaccuacag

SEQ ID NO: 92907 - RNA, 19 nt, Homo sapiens
gaagaagcguaucugagaa

SEQ ID NO: 92908 - RNA, 19 nt, Homo sapiens
gaacuaagaagaagcguau

SEQ ID NO: 92909 - RNA, 19 nt, Homo sapiens
ugaaguauguguuaagcua

SEQ ID NO: 92910 - RNA, 19 nt, Homo sapiens
ggaaggcuguaauauaaau

SEQ ID NO: 92911 - RNA, 19 nt, Homo sapiens
gaaagaagugcuaccauau

SEQ ID NO: 92912 - RNA, 19 nt, Homo sapiens
gaaagugaguucccuagca

SEQ ID NO: 92913 - RNA, 19 nt, Homo sapiens
gaacaagauccaagagauu

SEQ ID NO: 92914 - RNA, 19 nt, Homo sapiens
gaaagaacuugcaacuaca

SEQ ID NO: 92915 - RNA, 19 nt, Homo sapiens
ugaugaagcucuccugaaa

SEQ ID NO: 92916 - RNA, 19 nt, Homo sapiens
cagaauaauugccauaaug

SEQ ID NO: 92917 - RNA, 19 nt, Homo sapiens
cgacagaaccaccaaguaa

SEQ ID NO: 92918 - RNA, 19 nt, Homo sapiens
gagcaggcauuauggagaa

SEQ ID NO: 92919 - RNA, 19 nt, Homo sapiens
gaaauggcuuugaaaugga

SEQ ID NO: 92920 - RNA, 19 nt, Homo sapiens
caucagaaauggcuuugaa

SEQ ID NO: 92921 - RNA, 19 nt, Homo sapiens
gaaguuauaaggcuauuga

SEQ ID NO: 92922 - RNA, 19 nt, Homo sapiens
gagaaacuauaacuagaga

SEQ ID NO: 92923 - RNA, 19 nt, Homo sapiens
ugagugagauggagcaauu

SEQ ID NO: 92924 - RNA, 19 nt, Homo sapiens
cagaagaaguuguauauac

SEQ ID NO: 92925 - RNA, 19 nt, Homo sapiens
caacagcaccuuauggaaa

SEQ ID NO: 92926 - RNA, 19 nt, Homo sapiens
aaaguaagaugcucgaguu

SEQ ID NO: 92927 - RNA, 19 nt, Homo sapiens
gcucagaaacuuaaugaaa

SEQ ID NO: 92928 - RNA, 19 nt, Homo sapiens
gauauucacgauacuguua

SEQ ID NO: 92929 - RNA, 19 nt, Homo sapiens
aaacucaccucccuuauag

SEQ ID NO: 92930 - RNA, 19 nt, Homo sapiens
gcaacuacauacaagcaaa

SEQ ID NO: 92931 - RNA, 19 nt, Homo sapiens
uaagugagauagaauggaa

SEQ ID NO: 92932 - RNA, 19 nt, Homo sapiens
gaaaguacagaaugagaaa

SEQ ID NO: 92933 - RNA, 19 nt, Homo sapiens
gauagcaaguuaacacgaa

SEQ ID NO: 92934 - RNA, 19 nt, Homo sapiens
gaacagcagagaagaauca

SEQ ID NO: 92935 - RNA, 19 nt, Homo sapiens
acacucaaaugaugccuua

SEQ ID NO: 92936 - RNA, 19 nt, Homo sapiens
gcgaauaucugaauuagaa

SEQ ID NO: 92937 - RNA, 19 nt, Homo sapiens
ggaaauuaaugcauccuua

SEQ ID NO: 92938 - RNA, 19 nt, Homo sapiens
gaagaaggaugaagaaauc

SEQ ID NO: 92939 - RNA, 19 nt, Homo sapiens
gaacauacuucagaaacua

SEQ ID NO: 92940 - RNA, 19 nt, Homo sapiens
gagcgaggcuggugguuua

SEQ ID NO: 92941 - RNA, 19 nt, Homo sapiens
caagucaucuuucaucuaa

SEQ ID NO: 92942 - RNA, 19 nt, Homo sapiens
gagauuacuucaugugaua

SEQ ID NO: 92943 - RNA, 19 nt, Homo sapiens
gaucagcacugucagauga

SEQ ID NO: 92944 - RNA, 19 nt, Homo sapiens
gcugagugcuuuagaguua

SEQ ID NO: 92945 - RNA, 19 nt, Homo sapiens
gaaaugaaagcgaagaaua

SEQ ID NO: 92946 - RNA, 19 nt, Homo sapiens
ggugauggauuaacauaua

SEQ ID NO: 92947 - RNA, 19 nt, Homo sapiens
aagaagagcucaauaauuc

SEQ ID NO: 92948 - RNA, 19 nt, Homo sapiens
gaagauuucucaugaacuu

SEQ ID NO: 92949 - RNA, 19 nt, Homo sapiens
gagaagcuauguuuagaaa

SEQ ID NO: 92950 - RNA, 19 nt, Homo sapiens
gagaggaaauagcugaaua

SEQ ID NO: 92951 - RNA, 19 nt, Homo sapiens
gaagcuaugcuaagaaaua

SEQ ID NO: 92952 - RNA, 19 nt, Homo sapiens
gcaaaucaaaggagaaaua

SEQ ID NO: 92953 - RNA, 19 nt, Homo sapiens
ccugacagcucuagucuua

SEQ ID NO: 92954 - RNA, 19 nt, Homo sapiens
gaacagaugcaucaaaguu

SEQ ID NO: 92955 - RNA, 19 nt, Homo sapiens
ggaggcagaugaauacuug

SEQ ID NO: 92956 - RNA, 19 nt, Homo sapiens
guaaagaagagcucaauaa

SEQ ID NO: 92957 - RNA, 19 nt, Homo sapiens
ggaauuagauguuguuacu

SEQ ID NO: 92958 - RNA, 19 nt, Homo sapiens
gaaagggaauugcagaugu

SEQ ID NO: 92959 - RNA, 19 nt, Homo sapiens
gaacaaauguagggaugaa

SEQ ID NO: 92960 - RNA, 19 nt, Homo sapiens
gcagaugaauacuuggaua

SEQ ID NO: 92961 - RNA, 19 nt, Homo sapiens
acaagaaucuagagaauga

SEQ ID NO: 92962 - RNA, 19 nt, Homo sapiens
gaaacaagucagcgcauua

SEQ ID NO: 92963 - RNA, 19 nt, Homo sapiens
gagcaucagcugagaaaua

SEQ ID NO: 92964 - RNA, 19 nt, Homo sapiens
caacgaaucugagaaacuu

SEQ ID NO: 92965 - RNA, 19 nt, Homo sapiens
gaaugggacucuuaaggaa

SEQ ID NO: 92966 - RNA, 19 nt, Homo sapiens
caacagcguucuuuccaaa

SEQ ID NO: 92967 - RNA, 19 nt, Homo sapiens
caguguagaugaaguauuu

SEQ ID NO: 92968 - RNA, 19 nt, Homo sapiens
ugaaauagaugcggaagaa

SEQ ID NO: 92969 - RNA, 19 nt, Homo sapiens
gauaaacucacaucaguaa

SEQ ID NO: 92970 - RNA, 19 nt, Homo sapiens
gagcuaagaaacaagauua

SEQ ID NO: 92971 - RNA, 19 nt, Homo sapiens
gagaaagaauugcuuguca

SEQ ID NO: 92972 - RNA, 19 nt, Homo sapiens
ggagaaagcuagcauugag

SEQ ID NO: 92973 - RNA, 19 nt, Homo sapiens
cuacaaagaugugaagaaa

SEQ ID NO: 92974 - RNA, 19 nt, Homo sapiens
ugaaggagcucacacuaga

SEQ ID NO: 92975 - RNA, 19 nt, Homo sapiens
uaacucagauggaaucaga

SEQ ID NO: 92976 - RNA, 19 nt, Homo sapiens
gaaaugaaaggccaaguga

SEQ ID NO: 92977 - RNA, 19 nt, Homo sapiens
gcacagaaguuagcgcuau

SEQ ID NO: 92978 - RNA, 19 nt, Homo sapiens
ugaaagagagcuagagaua

SEQ ID NO: 92979 - RNA, 19 nt, Homo sapiens
gcuacaaggucuggacuua

SEQ ID NO: 92980 - RNA, 19 nt, Homo sapiens
gaaagucaagggauuauga

SEQ ID NO: 92981 - RNA, 19 nt, Homo sapiens
gcaauuagaagcuaugcua

SEQ ID NO: 92982 - RNA, 19 nt, Homo sapiens
gagcaaccaucuacuugaa

SEQ ID NO: 92983 - RNA, 19 nt, Homo sapiens
ggaaagacuagcccauaua

SEQ ID NO: 92984 - RNA, 19 nt, Homo sapiens
aaagagacaucaaaugaga

SEQ ID NO: 92985 - RNA, 19 nt, Homo sapiens
gagcugggcuuuggaagaa

SEQ ID NO: 92986 - RNA, 19 nt, Homo sapiens
caucauuccuuugcaaaua

SEQ ID NO: 92987 - RNA, 19 nt, Homo sapiens
uaagaacgcuggagaugga

SEQ ID NO: 92988 - RNA, 19 nt, Homo sapiens
ucaaagaacugaaagaaac

SEQ ID NO: 92989 - RNA, 19 nt, Homo sapiens
caacugagaucaaagaacu

SEQ ID NO: 92990 - RNA, 19 nt, Homo sapiens
gaaagcuacuacucagauu

SEQ ID NO: 92991 - RNA, 19 nt, Homo sapiens
caaacaguaugaaguagaa

SEQ ID NO: 92992 - RNA, 19 nt, Homo sapiens
ggaccucaaucuagacauu

SEQ ID NO: 92993 - RNA, 19 nt, Homo sapiens
gagcuugacugccuuagga

SEQ ID NO: 92994 - RNA, 19 nt, Homo sapiens
ugucagagcugcagaccua

SEQ ID NO: 92995 - RNA, 19 nt, Homo sapiens
gaacagcugaugaagguaa

SEQ ID NO: 92996 - RNA, 19 nt, Homo sapiens
ggauuaacauauagccuuu

SEQ ID NO: 92997 - RNA, 19 nt, Homo sapiens
agagaaagcuaaagagaug

SEQ ID NO: 92998 - RNA, 19 nt, Homo sapiens
caaggucgaugaauuaaca

SEQ ID NO: 92999 - RNA, 19 nt, Homo sapiens
gcaaagaucaauugaagga

SEQ ID NO: 93000 - RNA, 19 nt, Homo sapiens
cagcaaagaucaauugaag

SEQ ID NO: 93001 - RNA, 19 nt, Homo sapiens
ucugagaggucuggaauua

SEQ ID NO: 93002 - RNA, 19 nt, Homo sapiens
gugaagauauuggagauaa

SEQ ID NO: 93003 - RNA, 19 nt, Homo sapiens
gaccuauguugacucauua

SEQ ID NO: 93004 - RNA, 19 nt, Homo sapiens
caaaggaacaccaagaauu

SEQ ID NO: 93005 - RNA, 19 nt, Homo sapiens
aagaauaccucucaggaaa

SEQ ID NO: 93006 - RNA, 19 nt, Homo sapiens
ucucaaagaacuccaauua

SEQ ID NO: 93007 - RNA, 19 nt, Homo sapiens
gaaaagagguuaucaucug

SEQ ID NO: 93008 - RNA, 19 nt, Homo sapiens
aaagaacucucucaacuuc

SEQ ID NO: 93009 - RNA, 19 nt, Homo sapiens
ggagagauuucuugaugug

SEQ ID NO: 93010 - RNA, 19 nt, Homo sapiens
gaaaccauguuaagagauc

SEQ ID NO: 93011 - RNA, 19 nt, Homo sapiens
gaaagacuagcccauauau

SEQ ID NO: 93012 - RNA, 19 nt, Homo sapiens
uaaaucaguugaagaagga

SEQ ID NO: 93013 - RNA, 19 nt, Homo sapiens
gccagaagccugaaaguuu

SEQ ID NO: 93014 - RNA, 19 nt, Homo sapiens
caaagugagugucuccauu

SEQ ID NO: 93015 - RNA, 19 nt, Homo sapiens
guugaaaguuugcuaaaug

SEQ ID NO: 93016 - RNA, 19 nt, Homo sapiens
ggagaagcauggaggaaau

SEQ ID NO: 93017 - RNA, 19 nt, Homo sapiens
ucaaagaacuccaauuagg

SEQ ID NO: 93018 - RNA, 19 nt, Homo sapiens
gaaagaacucucucaacuu

SEQ ID NO: 93019 - RNA, 19 nt, Homo sapiens
cacagaagcuggagauaga

SEQ ID NO: 93020 - RNA, 19 nt, Homo sapiens
gaaagugagagaggaaaua

SEQ ID NO: 93021 - RNA, 19 nt, Homo sapiens
gaagaggcaucgagaaacu

SEQ ID NO: 93022 - RNA, 19 nt, Homo sapiens
gagaagaggcaucgagaaa

SEQ ID NO: 93023 - RNA, 19 nt, Homo sapiens
agaaaugcaugcagauaaa

SEQ ID NO: 93024 - RNA, 19 nt, Homo sapiens
gcucuagucuuagcaguuu

SEQ ID NO: 93025 - RNA, 19 nt, Homo sapiens
ggaagcauuugcaaaggaa

SEQ ID NO: 93026 - RNA, 19 nt, Homo sapiens
gcaaccaucuacuugaaga

SEQ ID NO: 93027 - RNA, 19 nt, Homo sapiens
caagucagcgcauuaguaa

SEQ ID NO: 93028 - RNA, 19 nt, Homo sapiens
gagugaaugucguuuagaa

SEQ ID NO: 93029 - RNA, 19 nt, Homo sapiens
gucagggcaugcuuuauua

SEQ ID NO: 93030 - RNA, 19 nt, Homo sapiens
gaaaauaagcagaagguua

SEQ ID NO: 93031 - RNA, 19 nt, Homo sapiens
uagggaaacuacuaaauga

SEQ ID NO: 93032 - RNA, 19 nt, Homo sapiens
gaaauuaguggccuuaaag

SEQ ID NO: 93033 - RNA, 19 nt, Homo sapiens
gggcaugcuuuauuaguga

SEQ ID NO: 93034 - RNA, 19 nt, Homo sapiens
cuacaggacuucucuuuag

SEQ ID NO: 93035 - RNA, 19 nt, Homo sapiens
gaaaggguuugcugacauc

SEQ ID NO: 93036 - RNA, 19 nt, Homo sapiens
gaagaaaggugaugucaag

SEQ ID NO: 93037 - RNA, 19 nt, Homo sapiens
gcaagauggugaugaaauu

SEQ ID NO: 93038 - RNA, 19 nt, Homo sapiens
gaaagugucucuguucuug

SEQ ID NO: 93039 - RNA, 19 nt, Homo sapiens
gaacauuccucucaagcuu

SEQ ID NO: 93040 - RNA, 19 nt, Homo sapiens
gaagaggagaucagacuua

SEQ ID NO: 93041 - RNA, 19 nt, Homo sapiens
ggacaacauugccagcuuu

SEQ ID NO: 93042 - RNA, 19 nt, Homo sapiens
gauagcagaugugauguuu

SEQ ID NO: 93043 - RNA, 19 nt, Homo sapiens
ucucagagcuauuuacaaa

SEQ ID NO: 93044 - RNA, 19 nt, Homo sapiens
gaccucagcuuugggaaua

SEQ ID NO: 93045 - RNA, 19 nt, Homo sapiens
ggacagaggccaugaagga

SEQ ID NO: 93046 - RNA, 19 nt, Homo sapiens
gaaauucugggccaacuuu

SEQ ID NO: 93047 - RNA, 19 nt, Homo sapiens
gcagaaccauggagcuuug

SEQ ID NO: 93048 - RNA, 19 nt, Homo sapiens
gaaaacaccugaagagcuu

SEQ ID NO: 93049 - RNA, 19 nt, Homo sapiens
gaucagacuuagcaagaug

SEQ ID NO: 93050 - RNA, 19 nt, Homo sapiens
gaguuuggcugguugauuc

SEQ ID NO: 93051 - RNA, 19 nt, Homo sapiens
gaaagggauugcagguuca

SEQ ID NO: 93052 - RNA, 19 nt, Homo sapiens
gagaaauacuuaggaggaa

SEQ ID NO: 93053 - RNA, 19 nt, Homo sapiens
cagaagccacugagaaaua

SEQ ID NO: 93054 - RNA, 19 nt, Homo sapiens
ccaccuacauguaugaguu

SEQ ID NO: 93055 - RNA, 19 nt, Homo sapiens
gcccuuggcugagcaaauu

SEQ ID NO: 93056 - RNA, 19 nt, Homo sapiens
acauagagcugugaaugaa

SEQ ID NO: 93057 - RNA, 19 nt, Homo sapiens
gagaucagacuuagcaaga

SEQ ID NO: 93058 - RNA, 19 nt, Homo sapiens
ccauggagcuuugugaaga

SEQ ID NO: 93059 - RNA, 19 nt, Homo sapiens
auucuuaucucuggacuua

SEQ ID NO: 93060 - RNA, 19 nt, Homo sapiens
gcugaaggacaaagaagua

SEQ ID NO: 93061 - RNA, 19 nt, Homo sapiens
gcacccaccuacauguaug

SEQ ID NO: 93062 - RNA, 19 nt, Homo sapiens
gaaguucgucagcuuagaa

SEQ ID NO: 93063 - RNA, 19 nt, Homo sapiens
ugaagaaugccaccucgua

SEQ ID NO: 93064 - RNA, 19 nt, Homo sapiens
uagcagaugugauguuugg

SEQ ID NO: 93065 - RNA, 19 nt, Homo sapiens
cccagaagcugaaggacaa

SEQ ID NO: 93066 - RNA, 19 nt, Homo sapiens
gaauuaacaagcaggaguu

SEQ ID NO: 93067 - RNA, 19 nt, Homo sapiens
gaccaucuuuggagaguca

SEQ ID NO: 93068 - RNA, 19 nt, Homo sapiens
gagcacccaccuacaugua

SEQ ID NO: 93069 - RNA, 19 nt, Homo sapiens
ccaugucacuccuguggaa

SEQ ID NO: 93070 - RNA, 19 nt, Homo sapiens
gaggagaucagacuuagca

SEQ ID NO: 93071 - RNA, 19 nt, Homo sapiens
gaaccauggagcuuuguga

SEQ ID NO: 93072 - RNA, 19 nt, Homo sapiens
gcaaagugcuggggaaguu

SEQ ID NO: 93073 - RNA, 19 nt, Homo sapiens
uuagcaagauggugaugaa

SEQ ID NO: 93074 - RNA, 19 nt, Homo sapiens
caacauugccagcuuugga

SEQ ID NO: 93075 - RNA, 19 nt, Homo sapiens
caagcuuucugaagacugu

SEQ ID NO: 93076 - RNA, 19 nt, Homo sapiens
ggaaguucgucagcuuaga

SEQ ID NO: 93077 - RNA, 19 nt, Homo sapiens
ccaagaaggcaguggagaa

SEQ ID NO: 93078 - RNA, 19 nt, Homo sapiens
gaagcugaaggacaaagaa

SEQ ID NO: 93079 - RNA, 19 nt, Homo sapiens
gcugguugauuccaauguu

SEQ ID NO: 93080 - RNA, 19 nt, Homo sapiens
uuacacuccugcugacuug

SEQ ID NO: 93081 - RNA, 19 nt, Homo sapiens
gaaauacuuaggaggaaca

SEQ ID NO: 93082 - RNA, 19 nt, Homo sapiens
auagagcugugaaugaaga

SEQ ID NO: 93083 - RNA, 19 nt, Homo sapiens
caccaccucugcugucaug

SEQ ID NO: 93084 - RNA, 19 nt, Homo sapiens
cauggagcuuugugaagaa

SEQ ID NO: 93085 - RNA, 19 nt, Homo sapiens
ccaagcuucucaucagaca

SEQ ID NO: 93086 - RNA, 19 nt, Homo sapiens
ggacaccgugcauggcaaa

SEQ ID NO: 93087 - RNA, 19 nt, Homo sapiens
gacugucuuuaccucaaua

SEQ ID NO: 93088 - RNA, 19 nt, Homo sapiens
uuacaaaccgaaaggagaa

SEQ ID NO: 93089 - RNA, 19 nt, Homo sapiens
gagcaaguuuuguauuugu

SEQ ID NO: 93090 - RNA, 19 nt, Homo sapiens
cacaagagccgagaacugu

SEQ ID NO: 93091 - RNA, 19 nt, Homo sapiens
gcguggcccucacuucugu

SEQ ID NO: 93092 - RNA, 19 nt, Homo sapiens
gagcucuucuccgucuuug

SEQ ID NO: 93093 - RNA, 19 nt, Homo sapiens
ggaguuuggcugguugauu

SEQ ID NO: 93094 - RNA, 19 nt, Homo sapiens
ccucagcuuugggaauaaa

SEQ ID NO: 93095 - RNA, 19 nt, Homo sapiens
ccacaagagccgagaacug

SEQ ID NO: 93096 - RNA, 19 nt, Homo sapiens
guccaagcuucucaucaga

SEQ ID NO: 93097 - RNA, 19 nt, Homo sapiens
cuugauagcagaugugaug

SEQ ID NO: 93098 - RNA, 19 nt, Homo sapiens
uaucacugcugggugcaaa

SEQ ID NO: 93099 - RNA, 19 nt, Homo sapiens
ggcccuugcugcccaugaa

SEQ ID NO: 93100 - RNA, 19 nt, Homo sapiens
ggagcaaguuuuguauuug

SEQ ID NO: 93101 - RNA, 19 nt, Homo sapiens
ggccagaguacaaccagaa

SEQ ID NO: 93102 - RNA, 19 nt, Homo sapiens
aagaggagaucagacuuag

SEQ ID NO: 93103 - RNA, 19 nt, Homo sapiens
cguccaagcuucucaucag

SEQ ID NO: 93104 - RNA, 19 nt, Homo sapiens
uugaugagcuauccacucu

SEQ ID NO: 93105 - RNA, 19 nt, Homo sapiens
caccucugcugucaugguu

SEQ ID NO: 93106 - RNA, 19 nt, Homo sapiens
aagugucucuguucuuguu

SEQ ID NO: 93107 - RNA, 19 nt, Homo sapiens
ggagcuuugugaagaaugc

SEQ ID NO: 93108 - RNA, 19 nt, Homo sapiens
caccgugcauggcaaagug

SEQ ID NO: 93109 - RNA, 19 nt, Homo sapiens
gaaguccuauccccuuguu

SEQ ID NO: 93110 - RNA, 19 nt, Homo sapiens
gccaugaaggagcaaguuu

SEQ ID NO: 93111 - RNA, 19 nt, Homo sapiens
caagaaggcaguggagaag

SEQ ID NO: 93112 - RNA, 19 nt, Homo sapiens
cagaguacaaccagaagga

SEQ ID NO: 93113 - RNA, 19 nt, Homo sapiens
agaagccacugagaaauac

SEQ ID NO: 93114 - RNA, 19 nt, Homo sapiens
uccagaagccacugagaaa

SEQ ID NO: 93115 - RNA, 19 nt, Homo sapiens
ucuuaucucuggacuuaca

SEQ ID NO: 93116 - RNA, 19 nt, Homo sapiens
ucagagcuauuuacaaacc

SEQ ID NO: 93117 - RNA, 19 nt, Homo sapiens
ugaaggagcaaguuuugua

SEQ ID NO: 93118 - RNA, 19 nt, Homo sapiens
ucagaaggcaucuuaccau

SEQ ID NO: 93119 - RNA, 19 nt, Homo sapiens
ccagacagaacacauagag

SEQ ID NO: 93120 - RNA, 19 nt, Homo sapiens
gaaggacaaagaaguagcu

SEQ ID NO: 93121 - RNA, 19 nt, Homo sapiens
gaguuucaguaccguccaa

SEQ ID NO: 93122 - RNA, 19 nt, Homo sapiens
acauguaugaguuucagua

SEQ ID NO: 93123 - RNA, 19 nt, Homo sapiens
ggagcacccaccuacaugu

SEQ ID NO: 93124 - RNA, 19 nt, Homo sapiens
ccucguacccuccuaugug

SEQ ID NO: 93125 - RNA, 19 nt, Homo sapiens
ggacuugauagcagaugug

SEQ ID NO: 93126 - RNA, 19 nt, Homo sapiens
ccuacauggucggaauuaa

SEQ ID NO: 93127 - RNA, 19 nt, Homo sapiens
ccucugcugucaugguuca

SEQ ID NO: 93128 - RNA, 19 nt, Homo sapiens
caauauacccaggccacaa

SEQ ID NO: 93129 - RNA, 19 nt, Homo sapiens
gauguggcuccgugccuuu

SEQ ID NO: 93130 - RNA, 19 nt, Homo sapiens
cagaagaggagaucagacu

SEQ ID NO: 93131 - RNA, 19 nt, Homo sapiens
gcccggaaccacagagaug

SEQ ID NO: 93132 - RNA, 19 nt, Homo sapiens
caauaucgccugggcaucu

SEQ ID NO: 93133 - RNA, 19 nt, Homo sapiens
cgucagcuuagaaggauuu

SEQ ID NO: 93134 - RNA, 19 nt, Homo sapiens
gcgaaagggauugcagguu

SEQ ID NO: 93135 - RNA, 19 nt, Homo sapiens
caagauggugaugaaauuc

SEQ ID NO: 93136 - RNA, 19 nt, Homo sapiens
gaaagaugcuuguaaugug

SEQ ID NO: 93137 - RNA, 19 nt, Homo sapiens
gggagaaccucacggauga

SEQ ID NO: 93138 - RNA, 19 nt, Homo sapiens
ccauaucucuaguucaaua

SEQ ID NO: 93139 - RNA, 19 nt, Homo sapiens
gguaguacguugugcaauu

SEQ ID NO: 93140 - RNA, 19 nt, Homo sapiens
caggacagauauucuuaua

SEQ ID NO: 93141 - RNA, 19 nt, Homo sapiens
gauggaaucugccaguaga

SEQ ID NO: 93142 - RNA, 19 nt, Homo sapiens
gcacaugagguuaaacaaa

SEQ ID NO: 93143 - RNA, 19 nt, Homo sapiens
guaguacguugugcaauuu

SEQ ID NO: 93144 - RNA, 19 nt, Homo sapiens
gaaggacaccaaagaagaa

SEQ ID NO: 93145 - RNA, 19 nt, Homo sapiens
ggaaggaagagaugaagaa

SEQ ID NO: 93146 - RNA, 19 nt, Homo sapiens
gggaagaucucguucaaaa

SEQ ID NO: 93147 - RNA, 19 nt, Homo sapiens
acuauucacuggcuuuaua

SEQ ID NO: 93148 - RNA, 19 nt, Homo sapiens
aaagggcccugaaguuuga

SEQ ID NO: 93149 - RNA, 19 nt, Homo sapiens
aaagaugcuuguaauguga

SEQ ID NO: 93150 - RNA, 19 nt, Homo sapiens
gaagaccagccuuuacuga

SEQ ID NO: 93151 - RNA, 19 nt, Homo sapiens
gcaagaaguucgggaagca

SEQ ID NO: 93152 - RNA, 19 nt, Homo sapiens
ugaagaagaccagccuuua

SEQ ID NO: 93153 - RNA, 19 nt, Homo sapiens
ugccuagccuguccacuua

SEQ ID NO: 93154 - RNA, 19 nt, Homo sapiens
gucuagaucuauuuccaua

SEQ ID NO: 93155 - RNA, 19 nt, Homo sapiens
uuacggagcucaggacaga

SEQ ID NO: 93156 - RNA, 19 nt, Homo sapiens
gaauaccaguuugaaggaa

SEQ ID NO: 93157 - RNA, 19 nt, Homo sapiens
gaaggaagagaugaagaaa

SEQ ID NO: 93158 - RNA, 19 nt, Homo sapiens
acaaagggcccugaaguuu

SEQ ID NO: 93159 - RNA, 19 nt, Homo sapiens
cacaugagguuaaacaaag

SEQ ID NO: 93160 - RNA, 19 nt, Homo sapiens
gaagucgguucagaagcua

SEQ ID NO: 93161 - RNA, 19 nt, Homo sapiens
gaagaagaccagccuuuac

SEQ ID NO: 93162 - RNA, 19 nt, Homo sapiens
gagccaaccuggagcacau

SEQ ID NO: 93163 - RNA, 19 nt, Homo sapiens
ggucuuaaauuaucuugcu

SEQ ID NO: 93164 - RNA, 19 nt, Homo sapiens
ugaaagaugcuuguaaugu

SEQ ID NO: 93165 - RNA, 19 nt, Homo sapiens
cuagaucuauuuccauauc

SEQ ID NO: 93166 - RNA, 19 nt, Homo sapiens
gguggccacuuacaaacuu

SEQ ID NO: 93167 - RNA, 19 nt, Homo sapiens
cuuugguggucuuaaauua

SEQ ID NO: 93168 - RNA, 19 nt, Homo sapiens
cgcagaagauguccgagaa

SEQ ID NO: 93169 - RNA, 19 nt, Homo sapiens
aaaacaggguggccacuua

SEQ ID NO: 93170 - RNA, 19 nt, Homo sapiens
gaagagaugaagaaaauga

SEQ ID NO: 93171 - RNA, 19 nt, Homo sapiens
ggacaccaaagaagaaauc

SEQ ID NO: 93172 - RNA, 19 nt, Homo sapiens
cgagaaggacaccaaagaa

SEQ ID NO: 93173 - RNA, 19 nt, Homo sapiens
ugagugcgcccuccauuug

SEQ ID NO: 93174 - RNA, 19 nt, Homo sapiens
gagcacaugagguuaaaca

SEQ ID NO: 93175 - RNA, 19 nt, Homo sapiens
gagaaggacaccaaagaag

SEQ ID NO: 93176 - RNA, 19 nt, Homo sapiens
agucauuguuccagcauaa

SEQ ID NO: 93177 - RNA, 19 nt, Homo sapiens
aaacaaagggcccugaagu

SEQ ID NO: 93178 - RNA, 19 nt, Homo sapiens
uuccauaucucuaguucaa

SEQ ID NO: 93179 - RNA, 19 nt, Homo sapiens
caaagaagaaauccugaag

SEQ ID NO: 93180 - RNA, 19 nt, Homo sapiens
gaccagccuuuacugaagu

SEQ ID NO: 93181 - RNA, 19 nt, Homo sapiens
gaugagaccgggaagaucu

SEQ ID NO: 93182 - RNA, 19 nt, Homo sapiens
aagaucagcuucaaugacu

SEQ ID NO: 93183 - RNA, 19 nt, Homo sapiens
gcucaggacagauauucuu

SEQ ID NO: 93184 - RNA, 19 nt, Homo sapiens
uaaauuccagucauuguuc

SEQ ID NO: 93185 - RNA, 19 nt, Homo sapiens
ccgggaagaucucguucaa

SEQ ID NO: 93186 - RNA, 19 nt, Homo sapiens
gaucagaagcaagaaguuc

SEQ ID NO: 93187 - RNA, 19 nt, Homo sapiens
gggaagcauuugaccucuu

SEQ ID NO: 93188 - RNA, 19 nt, Homo sapiens
ccuucaggcucuuugauga

SEQ ID NO: 93189 - RNA, 19 nt, Homo sapiens
agaaggacaccaaagaaga

SEQ ID NO: 93190 - RNA, 19 nt, Homo sapiens
ggaguuccuucggaucaug

SEQ ID NO: 93191 - RNA, 19 nt, Homo sapiens
cuucuuugguggucuuaaa

SEQ ID NO: 93192 - RNA, 19 nt, Homo sapiens
ccaaagaagaaauccugaa

SEQ ID NO: 93193 - RNA, 19 nt, Homo sapiens
gaaguucgggaagcauuug

SEQ ID NO: 93194 - RNA, 19 nt, Homo sapiens
gaagcuaaagugacucucu

SEQ ID NO: 93195 - RNA, 19 nt, Homo sapiens
uagacuugcuuggguggua

SEQ ID NO: 93196 - RNA, 19 nt, Homo sapiens
gagcucaggacagauauuc

SEQ ID NO: 93197 - RNA, 19 nt, Homo sapiens
agaccagccuuuacugaag

SEQ ID NO: 93198 - RNA, 19 nt, Homo sapiens
gaugaucgacgaagcugau

SEQ ID NO: 93199 - RNA, 19 nt, Homo sapiens
gaucagcuucaaugacuuc

SEQ ID NO: 93200 - RNA, 19 nt, Homo sapiens
caggguggccacuuacaaa

SEQ ID NO: 93201 - RNA, 19 nt, Homo sapiens
aauaccaguuugaaggaaa

SEQ ID NO: 93202 - RNA, 19 nt, Homo sapiens
aggaagagaugaagaaaau

SEQ ID NO: 93203 - RNA, 19 nt, Homo sapiens
ugagagcgcugggcuucga

SEQ ID NO: 93204 - RNA, 19 nt, Homo sapiens
gcucuuugaugacgaugag

SEQ ID NO: 93205 - RNA, 19 nt, Homo sapiens
ccgagaaggacaccaaaga

SEQ ID NO: 93206 - RNA, 19 nt, Homo sapiens
guggccacuuacaaacuua

SEQ ID NO: 93207 - RNA, 19 nt, Homo sapiens
gagcugaagguggccauga

SEQ ID NO: 93208 - RNA, 19 nt, Homo sapiens
gaauuugaaagaugcuugu

SEQ ID NO: 93209 - RNA, 19 nt, Homo sapiens
uggguugccugcuuccauu

SEQ ID NO: 93210 - RNA, 19 nt, Homo sapiens
augaggagcugcaggagau

SEQ ID NO: 93211 - RNA, 19 nt, Homo sapiens
ugacuauucacuggcuuua

SEQ ID NO: 93212 - RNA, 19 nt, Homo sapiens
ugaauaccaguuugaagga

SEQ ID NO: 93213 - RNA, 19 nt, Homo sapiens
ucacuucuuugguggucuu

SEQ ID NO: 93214 - RNA, 19 nt, Homo sapiens
ccaggaaggaagagaugaa

SEQ ID NO: 93215 - RNA, 19 nt, Homo sapiens
cccauaauuugucuagauc

SEQ ID NO: 93216 - RNA, 19 nt, Homo sapiens
aacaaagggcccugaaguu

SEQ ID NO: 93217 - RNA, 19 nt, Homo sapiens
ugaagcguguggccaacga

SEQ ID NO: 93218 - RNA, 19 nt, Homo sapiens
uggagcacaugagguuaaa

SEQ ID NO: 93219 - RNA, 19 nt, Homo sapiens
ggaucagaagcaagaaguu

SEQ ID NO: 93220 - RNA, 19 nt, Homo sapiens
uagcugaauaccaguuuga

SEQ ID NO: 93221 - RNA, 19 nt, Homo sapiens
guuccagcauaaugagaug

SEQ ID NO: 93222 - RNA, 19 nt, Homo sapiens
uaaugugaguuuuggguuu

SEQ ID NO: 93223 - RNA, 19 nt, Homo sapiens
uugguggucuuaaauuauc

SEQ ID NO: 93224 - RNA, 19 nt, Homo sapiens
gugguucccuuugucacuu

SEQ ID NO: 93225 - RNA, 19 nt, Homo sapiens
gaacccaggaaggaagaga

SEQ ID NO: 93226 - RNA, 19 nt, Homo sapiens
ggacagcuucugggacaca

SEQ ID NO: 93227 - RNA, 19 nt, Homo sapiens
acggagcucaggacagaua

SEQ ID NO: 93228 - RNA, 19 nt, Homo sapiens
aaaugugguucccuuuguc

SEQ ID NO: 93229 - RNA, 19 nt, Homo sapiens
gcagaagauguccgagaag

SEQ ID NO: 93230 - RNA, 19 nt, Homo sapiens
ggagcucaggacagauauu

SEQ ID NO: 93231 - RNA, 19 nt, Homo sapiens
gcugaagguggccaugaga

SEQ ID NO: 93232 - RNA, 19 nt, Homo sapiens
ccauuugcccugugcugaa

SEQ ID NO: 93233 - RNA, 19 nt, Homo sapiens
aagaccagccuuuacugaa

SEQ ID NO: 93234 - RNA, 19 nt, Homo sapiens
ggagaugaucgacgaagcu

SEQ ID NO: 93235 - RNA, 19 nt, Homo sapiens
cucaggacagauauucuua

SEQ ID NO: 93236 - RNA, 19 nt, Homo sapiens
gcacauguaacuagauuua

SEQ ID NO: 93237 - RNA, 19 nt, Homo sapiens
gcuauggccuccaacuuua

SEQ ID NO: 93238 - RNA, 19 nt, Homo sapiens
gaagaaauccugaaagcuu

SEQ ID NO: 93239 - RNA, 19 nt, Homo sapiens
caccauagauguuaaagaa

SEQ ID NO: 93240 - RNA, 19 nt, Homo sapiens
gugagaaccugacugauga

SEQ ID NO: 93241 - RNA, 19 nt, Homo sapiens
gcaagcacauguaacuaga

SEQ ID NO: 93242 - RNA, 19 nt, Homo sapiens
cgucaugcauuuccacaua

SEQ ID NO: 93243 - RNA, 19 nt, Homo sapiens
uaaaaugaccugcgaauua

SEQ ID NO: 93244 - RNA, 19 nt, Homo sapiens
ggaccucccuuuaucacuu

SEQ ID NO: 93245 - RNA, 19 nt, Homo sapiens
ccacggaccucccuuuauc

SEQ ID NO: 93246 - RNA, 19 nt, Homo sapiens
gaacugaagguggcaauga

SEQ ID NO: 93247 - RNA, 19 nt, Homo sapiens
gcauuuggauguguguuaa

SEQ ID NO: 93248 - RNA, 19 nt, Homo sapiens
gcaaacauggcaucaaguu

SEQ ID NO: 93249 - RNA, 19 nt, Homo sapiens
gaaaaugucugagaaagau

SEQ ID NO: 93250 - RNA, 19 nt, Homo sapiens
uaacugugaugacccagaa

SEQ ID NO: 93251 - RNA, 19 nt, Homo sapiens
ggaaguguucuuugauauu

SEQ ID NO: 93252 - RNA, 19 nt, Homo sapiens
ggaaaugauugaugaagcu

SEQ ID NO: 93253 - RNA, 19 nt, Homo sapiens
gaacuggcaccauagaugu

SEQ ID NO: 93254 - RNA, 19 nt, Homo sapiens
ggauguguguuaaugcuau

SEQ ID NO: 93255 - RNA, 19 nt, Homo sapiens
gcucuuugaugaugaugaa

SEQ ID NO: 93256 - RNA, 19 nt, Homo sapiens
aagaaauccugaaagcuuu

SEQ ID NO: 93257 - RNA, 19 nt, Homo sapiens
gaacgacuuuagacaagca

SEQ ID NO: 93258 - RNA, 19 nt, Homo sapiens
agaccagccucuauuaaga

SEQ ID NO: 93259 - RNA, 19 nt, Homo sapiens
ugaugaagcugaucgagau

SEQ ID NO: 93260 - RNA, 19 nt, Homo sapiens
gaugaaacugggaagauuu

SEQ ID NO: 93261 - RNA, 19 nt, Homo sapiens
gcacacaagcgugaagaaa

SEQ ID NO: 93262 - RNA, 19 nt, Homo sapiens
ggugagaaccugacugaug

SEQ ID NO: 93263 - RNA, 19 nt, Homo sapiens
ccacauauccacaaacaca

SEQ ID NO: 93264 - RNA, 19 nt, Homo sapiens
ugaugaaacugggaagauu

SEQ ID NO: 93265 - RNA, 19 nt, Homo sapiens
ggaacuggcaccauagaug

SEQ ID NO: 93266 - RNA, 19 nt, Homo sapiens
cagaacgacuuuagacaag

SEQ ID NO: 93267 - RNA, 19 nt, Homo sapiens
gaccucccuuuaucacuuu

SEQ ID NO: 93268 - RNA, 19 nt, Homo sapiens
gcacuggcauuuggaugug

SEQ ID NO: 93269 - RNA, 19 nt, Homo sapiens
guuuggaaguguucuuuga

SEQ ID NO: 93270 - RNA, 19 nt, Homo sapiens
guacacgucgguugccuaa

SEQ ID NO: 93271 - RNA, 19 nt, Homo sapiens
acacgucgguugccuaaca

SEQ ID NO: 93272 - RNA, 19 nt, Homo sapiens
uuggaaguguucuuugaua

SEQ ID NO: 93273 - RNA, 19 nt, Homo sapiens
agccugagcuuacugaaga

SEQ ID NO: 93274 - RNA, 19 nt, Homo sapiens
aagcacauguaacuagauu

SEQ ID NO: 93275 - RNA, 19 nt, Homo sapiens
aaugaacuuuggugacuuu

SEQ ID NO: 93276 - RNA, 19 nt, Homo sapiens
ccauagauguuaaagaacu

SEQ ID NO: 93277 - RNA, 19 nt, Homo sapiens
ugcaggaaaugauugauga

SEQ ID NO: 93278 - RNA, 19 nt, Homo sapiens
gggaagauuucguucaaaa

SEQ ID NO: 93279 - RNA, 19 nt, Homo sapiens
ggcuauggccuccaacuuu

SEQ ID NO: 93280 - RNA, 19 nt, Homo sapiens
gauaaggaagggacaggaa

SEQ ID NO: 93281 - RNA, 19 nt, Homo sapiens
aaacacagaacgacuuuag

SEQ ID NO: 93282 - RNA, 19 nt, Homo sapiens
ugaaacgcguggccaagga

SEQ ID NO: 93283 - RNA, 19 nt, Homo sapiens
aaagaccagccucuauuaa

SEQ ID NO: 93284 - RNA, 19 nt, Homo sapiens
gaccugcgaauuacccuaa

SEQ ID NO: 93285 - RNA, 19 nt, Homo sapiens
caagaguuccugcgcauca

SEQ ID NO: 93286 - RNA, 19 nt, Homo sapiens
augaggagcugcaggaaau

SEQ ID NO: 93287 - RNA, 19 nt, Homo sapiens
gaugaggagcugcaggaaa

SEQ ID NO: 93288 - RNA, 19 nt, Homo sapiens
aagaagaaauccugaaagc

SEQ ID NO: 93289 - RNA, 19 nt, Homo sapiens
gauguguguuaaugcuauu

SEQ ID NO: 93290 - RNA, 19 nt, Homo sapiens
ggcauuuggauguguguua

SEQ ID NO: 93291 - RNA, 19 nt, Homo sapiens
uggaaguguucuuugauau

SEQ ID NO: 93292 - RNA, 19 nt, Homo sapiens
gagauggagaggucaguga

SEQ ID NO: 93293 - RNA, 19 nt, Homo sapiens
aaacugggaagauuucguu

SEQ ID NO: 93294 - RNA, 19 nt, Homo sapiens
aaacauggcaucaaguucu

SEQ ID NO: 93295 - RNA, 19 nt, Homo sapiens
gaacuccugcacuggcauu

SEQ ID NO: 93296 - RNA, 19 nt, Homo sapiens
ugugaaaucuggcuuuuga

SEQ ID NO: 93297 - RNA, 19 nt, Homo sapiens
cuacugcaagcacauguaa

SEQ ID NO: 93298 - RNA, 19 nt, Homo sapiens
ugucugagaaagauacuaa

SEQ ID NO: 93299 - RNA, 19 nt, Homo sapiens
gcuuugagcaccugccauu

SEQ ID NO: 93300 - RNA, 19 nt, Homo sapiens
gggaagcuuuugaucuuuu

SEQ ID NO: 93301 - RNA, 19 nt, Homo sapiens
ugaucgagauggagaugga

SEQ ID NO: 93302 - RNA, 19 nt, Homo sapiens
cugggaagauuucguucaa

SEQ ID NO: 93303 - RNA, 19 nt, Homo sapiens
cccaagaaagaagaaauua

SEQ ID NO: 93304 - RNA, 19 nt, Homo sapiens
gcaccauagauguuaaaga

SEQ ID NO: 93305 - RNA, 19 nt, Homo sapiens
aguaaaaccuuucucaguu

SEQ ID NO: 93306 - RNA, 19 nt, Homo sapiens
acagaacgacuuuagacaa

SEQ ID NO: 93307 - RNA, 19 nt, Homo sapiens
acaaacacagaacgacuuu

SEQ ID NO: 93308 - RNA, 19 nt, Homo sapiens
gcaggaaaugauugaugaa

SEQ ID NO: 93309 - RNA, 19 nt, Homo sapiens
aggcaaacauggcaucaag

SEQ ID NO: 93310 - RNA, 19 nt, Homo sapiens
gucaugcauuuccacauau

SEQ ID NO: 93311 - RNA, 19 nt, Homo sapiens
ggagcugcaggaaaugauu

SEQ ID NO: 93312 - RNA, 19 nt, Homo sapiens
caagcucuuugaugaugau

SEQ ID NO: 93313 - RNA, 19 nt, Homo sapiens
gaaaaggaucuuaaagcuu

SEQ ID NO: 93314 - RNA, 19 nt, Homo sapiens
gagcugcaggaaaugauug

SEQ ID NO: 93315 - RNA, 19 nt, Homo sapiens
gagaaagauacuaaagaag

SEQ ID NO: 93316 - RNA, 19 nt, Homo sapiens
caucaaguucucagcgaaa

SEQ ID NO: 93317 - RNA, 19 nt, Homo sapiens
gaccagccucuauuaagau

SEQ ID NO: 93318 - RNA, 19 nt, Homo sapiens
aaaagaccagccucuauua

SEQ ID NO: 93319 - RNA, 19 nt, Homo sapiens
ugaagcugaucgagaugga

SEQ ID NO: 93320 - RNA, 19 nt, Homo sapiens
gaacccaagaaagaagaaa

SEQ ID NO: 93321 - RNA, 19 nt, Homo sapiens
ugacacuugaguuuaguuu

SEQ ID NO: 93322 - RNA, 19 nt, Homo sapiens
gggcuuugaacccaagaaa

SEQ ID NO: 93323 - RNA, 19 nt, Homo sapiens
gaggagcugcaggaaauga

SEQ ID NO: 93324 - RNA, 19 nt, Homo sapiens
uagacaagcacauguuaca

SEQ ID NO: 93325 - RNA, 19 nt, Homo sapiens
ggucagugagcaagaguuc

SEQ ID NO: 93326 - RNA, 19 nt, Homo sapiens
cuaaagaagaaauccugaa

SEQ ID NO: 93327 - RNA, 19 nt, Homo sapiens
gccacaagcagucauucuu

SEQ ID NO: 93328 - RNA, 19 nt, Homo sapiens
ugagcuuacugaagagcaa

SEQ ID NO: 93329 - RNA, 19 nt, Homo sapiens
gaaggcaaacauggcauca

SEQ ID NO: 93330 - RNA, 19 nt, Homo sapiens
uuuagacaagcacauguua

SEQ ID NO: 93331 - RNA, 19 nt, Homo sapiens
cauagauguuaaagaacug

SEQ ID NO: 93332 - RNA, 19 nt, Homo sapiens
caaacacagaacgacuuua

SEQ ID NO: 93333 - RNA, 19 nt, Homo sapiens
caaacauggcaucaaguuc

SEQ ID NO: 93334 - RNA, 19 nt, Homo sapiens
gagcacacaagcgugaaga

SEQ ID NO: 93335 - RNA, 19 nt, Homo sapiens
ugccugccauggugugaaa

SEQ ID NO: 93336 - RNA, 19 nt, Homo sapiens
agacaaagaugaagcaaua

SEQ ID NO: 93337 - RNA, 19 nt, Homo sapiens
aaacaugagugaugaagaa

SEQ ID NO: 93338 - RNA, 19 nt, Homo sapiens
ugacaaagauggugaugga

SEQ ID NO: 93339 - RNA, 19 nt, Homo sapiens
caagaggaguucauugcua

SEQ ID NO: 93340 - RNA, 19 nt, Homo sapiens
ggaaagagauccccaugaa

SEQ ID NO: 93341 - RNA, 19 nt, Homo sapiens
caaagauggugauggagaa

SEQ ID NO: 93342 - RNA, 19 nt, Homo sapiens
ggaguucauugcuauuaug

SEQ ID NO: 93343 - RNA, 19 nt, Homo sapiens
uuaaugaaguugugacaga

SEQ ID NO: 93344 - RNA, 19 nt, Homo sapiens
uauuaugacuggugacauu

SEQ ID NO: 93345 - RNA, 19 nt, Homo sapiens
gaggaguucauugcuauua

SEQ ID NO: 93346 - RNA, 19 nt, Homo sapiens
gaaaaucaccuuugaagau

SEQ ID NO: 93347 - RNA, 19 nt, Homo sapiens
ggaacagaaacaagaaauu

SEQ ID NO: 93348 - RNA, 19 nt, Homo sapiens
gaguuuagcucugagaagu

SEQ ID NO: 93349 - RNA, 19 nt, Homo sapiens
agauggugauggagaaaua

SEQ ID NO: 93350 - RNA, 19 nt, Homo sapiens
gaauuaaagguggcaauga

SEQ ID NO: 93351 - RNA, 19 nt, Homo sapiens
gcuagagaauugggugaaa

SEQ ID NO: 93352 - RNA, 19 nt, Homo sapiens
aagaaauacucaaggcauu

SEQ ID NO: 93353 - RNA, 19 nt, Homo sapiens
uaugacuggugacauuuaa

SEQ ID NO: 93354 - RNA, 19 nt, Homo sapiens
caugagugaugaagaacuu

SEQ ID NO: 93355 - RNA, 19 nt, Homo sapiens
aagaggaguucauugcuau

SEQ ID NO: 93356 - RNA, 19 nt, Homo sapiens
cagagaagccacagggaaa

SEQ ID NO: 93357 - RNA, 19 nt, Homo sapiens
acucaaggcauuuaaacua

SEQ ID NO: 93358 - RNA, 19 nt, Homo sapiens
gaagcaauagauuaucaug

SEQ ID NO: 93359 - RNA, 19 nt, Homo sapiens
guuuagcucugagaaguga

SEQ ID NO: 93360 - RNA, 19 nt, Homo sapiens
caaagaugaagcaauagau

SEQ ID NO: 93361 - RNA, 19 nt, Homo sapiens
ugaugaugauucagguaaa

SEQ ID NO: 93362 - RNA, 19 nt, Homo sapiens
cucaaggcauuuaaacuau

SEQ ID NO: 93363 - RNA, 19 nt, Homo sapiens
gcugauguacugaagauuc

SEQ ID NO: 93364 - RNA, 19 nt, Homo sapiens
gaggaacagaaacaagaaa

SEQ ID NO: 93365 - RNA, 19 nt, Homo sapiens
aagcugauguacugaagau

SEQ ID NO: 93366 - RNA, 19 nt, Homo sapiens
aaauaaaccaagaggaguu

SEQ ID NO: 93367 - RNA, 19 nt, Homo sapiens
gugacagacuggauauugg

SEQ ID NO: 93368 - RNA, 19 nt, Homo sapiens
gaugaugaugauucaggua

SEQ ID NO: 93369 - RNA, 19 nt, Homo sapiens
acaaagaugaagcaauaga

SEQ ID NO: 93370 - RNA, 19 nt, Homo sapiens
aaaccaagaggaguucauu

SEQ ID NO: 93371 - RNA, 19 nt, Homo sapiens
aauuaaagguggcaaugag

SEQ ID NO: 93372 - RNA, 19 nt, Homo sapiens
gugaaaacaugagugauga

SEQ ID NO: 93373 - RNA, 19 nt, Homo sapiens
gaugaugauucagguaaaa

SEQ ID NO: 93374 - RNA, 19 nt, Homo sapiens
gauggugauggagaaauaa

SEQ ID NO: 93375 - RNA, 19 nt, Homo sapiens
gcgacguguugcuagagaa

SEQ ID NO: 93376 - RNA, 19 nt, Homo sapiens
agaauugggugaaaacaug

SEQ ID NO: 93377 - RNA, 19 nt, Homo sapiens
cagacuggauauuggaaag

SEQ ID NO: 93378 - RNA, 19 nt, Homo sapiens
ugacagacuggauauugga

SEQ ID NO: 93379 - RNA, 19 nt, Homo sapiens
cagggaaaaucaccuuuga

SEQ ID NO: 93380 - RNA, 19 nt, Homo sapiens
ugauacagacaaagaugaa

SEQ ID NO: 93381 - RNA, 19 nt, Homo sapiens
aaagaagagaacugucuga

SEQ ID NO: 93382 - RNA, 19 nt, Homo sapiens
aaagagauccccaugaaga

SEQ ID NO: 93383 - RNA, 19 nt, Homo sapiens
ugaggaacagaaacaagaa

SEQ ID NO: 93384 - RNA, 19 nt, Homo sapiens
uuaugacuggugacauuua

SEQ ID NO: 93385 - RNA, 19 nt, Homo sapiens
ggacaaaacaaagaggaaa

SEQ ID NO: 93386 - RNA, 19 nt, Homo sapiens
ggaaaaucaccuuugaaga

SEQ ID NO: 93387 - RNA, 19 nt, Homo sapiens
aggaguucauugcuauuau

SEQ ID NO: 93388 - RNA, 19 nt, Homo sapiens
cugaggaacagaaacaaga

SEQ ID NO: 93389 - RNA, 19 nt, Homo sapiens
auggagaaauaaaccaaga

SEQ ID NO: 93390 - RNA, 19 nt, Homo sapiens
ugaauuaaagguggcaaug

SEQ ID NO: 93391 - RNA, 19 nt, Homo sapiens
ugugacagacuggauauug

SEQ ID NO: 93392 - RNA, 19 nt, Homo sapiens
gaacuauuugauacagaca

SEQ ID NO: 93393 - RNA, 19 nt, Homo sapiens
gacuggauauuggaaagag

SEQ ID NO: 93394 - RNA, 19 nt, Homo sapiens
acguguugcuagagaauug

SEQ ID NO: 93395 - RNA, 19 nt, Homo sapiens
gagaacugucugaggaaca

SEQ ID NO: 93396 - RNA, 19 nt, Homo sapiens
gaugaagcaauagauuauc

SEQ ID NO: 93397 - RNA, 19 nt, Homo sapiens
ggacagaucugcaaagaga

SEQ ID NO: 93398 - RNA, 19 nt, Homo sapiens
ucaagcagcuguucacaaa

SEQ ID NO: 93399 - RNA, 19 nt, Homo sapiens
gaacggcucgggccacuua

SEQ ID NO: 93400 - RNA, 19 nt, Homo sapiens
gcaaagagaucaacgucau

SEQ ID NO: 93401 - RNA, 19 nt, Homo sapiens
caagguagcuuuccaggau

SEQ ID NO: 93402 - RNA, 19 nt, Homo sapiens
gaacgugucuguggucuuc

SEQ ID NO: 93403 - RNA, 19 nt, Homo sapiens
caaagacuguuuccaacuu

SEQ ID NO: 93404 - RNA, 19 nt, Homo sapiens
guacggagauggagauugg

SEQ ID NO: 93405 - RNA, 19 nt, Homo sapiens
acacaccacugccugauaa

SEQ ID NO: 93406 - RNA, 19 nt, Homo sapiens
ggucaauucuucagugaug

SEQ ID NO: 93407 - RNA, 19 nt, Homo sapiens
ucacaagggucauuucauc

SEQ ID NO: 93408 - RNA, 19 nt, Homo sapiens
gaagccaaguccauugaug

SEQ ID NO: 93409 - RNA, 19 nt, Homo sapiens
ucacaaauuucaucuccuu

SEQ ID NO: 93410 - RNA, 19 nt, Homo sapiens
aagcagcuguucacaaauu

SEQ ID NO: 93411 - RNA, 19 nt, Homo sapiens
cgagccagcuacccagaua

SEQ ID NO: 93412 - RNA, 19 nt, Homo sapiens
gagauuaucacucgagaug

SEQ ID NO: 93413 - RNA, 19 nt, Homo sapiens
gaaguuggguuaggaguac

SEQ ID NO: 93414 - RNA, 19 nt, Homo sapiens
cccaagaucuccugccaaa

SEQ ID NO: 93415 - RNA, 19 nt, Homo sapiens
caacuccucccuauccuaa

SEQ ID NO: 93416 - RNA, 19 nt, Homo sapiens
ggaaguuggguuaggagua

SEQ ID NO: 93417 - RNA, 19 nt, Homo sapiens
gagaucgacucugccauug

SEQ ID NO: 93418 - RNA, 19 nt, Homo sapiens
ucuuaagccucuuggauuu

SEQ ID NO: 93419 - RNA, 19 nt, Homo sapiens
guccaggccuccuauucua

SEQ ID NO: 93420 - RNA, 19 nt, Homo sapiens
uaaaggcccacuggcauua

SEQ ID NO: 93421 - RNA, 19 nt, Homo sapiens
cgucaucucuaacaucaug

SEQ ID NO: 93422 - RNA, 19 nt, Homo sapiens
gggcaucccugaggucaug

SEQ ID NO: 93423 - RNA, 19 nt, Homo sapiens
ccauugaugucuccauuca

SEQ ID NO: 93424 - RNA, 19 nt, Homo sapiens
guauugaucaguccauuga

SEQ ID NO: 93425 - RNA, 19 nt, Homo sapiens
gcauuaaagugcuguaucc

SEQ ID NO: 93426 - RNA, 19 nt, Homo sapiens
caucaacccugagauuauc

SEQ ID NO: 93427 - RNA, 19 nt, Homo sapiens
gcaacauucuguagcuuac

SEQ ID NO: 93428 - RNA, 19 nt, Homo sapiens
gcucccaacuccucccuau

SEQ ID NO: 93429 - RNA, 19 nt, Homo sapiens
gaagggacagaucugcaaa

SEQ ID NO: 93430 - RNA, 19 nt, Homo sapiens
gaucgacucugccauugac

SEQ ID NO: 93431 - RNA, 19 nt, Homo sapiens
caucaucaacccugagauu

SEQ ID NO: 93432 - RNA, 19 nt, Homo sapiens
gauggugaaauuccucuuu

SEQ ID NO: 93433 - RNA, 19 nt, Homo sapiens
gcccaugccugcuccaaag

SEQ ID NO: 93434 - RNA, 19 nt, Homo sapiens
cgagaucgacucugccauu

SEQ ID NO: 93435 - RNA, 19 nt, Homo sapiens
aaagacuguuuccaacuug

SEQ ID NO: 93436 - RNA, 19 nt, Homo sapiens
caccaaagacuguuuccaa

SEQ ID NO: 93437 - RNA, 19 nt, Homo sapiens
uuacagcccucaugaacag

SEQ ID NO: 93438 - RNA, 19 nt, Homo sapiens
guccauugaugucuccauu

SEQ ID NO: 93439 - RNA, 19 nt, Homo sapiens
gguggaaguuggguuagga

SEQ ID NO: 93440 - RNA, 19 nt, Homo sapiens
ggucauuucaucuacaaga

SEQ ID NO: 93441 - RNA, 19 nt, Homo sapiens
cuaacaucauggccgauuu

SEQ ID NO: 93442 - RNA, 19 nt, Homo sapiens
gcccagaccagcaacauuc

SEQ ID NO: 93443 - RNA, 19 nt, Homo sapiens
ccuuucagauggagacauu

SEQ ID NO: 93444 - RNA, 19 nt, Homo sapiens
cuaccugucuuuccauaag

SEQ ID NO: 93445 - RNA, 19 nt, Homo sapiens
caagggucauuucaucuac

SEQ ID NO: 93446 - RNA, 19 nt, Homo sapiens
ccugguggcuggguauuga

SEQ ID NO: 93447 - RNA, 19 nt, Homo sapiens
aagaggauaucgugacuac

SEQ ID NO: 93448 - RNA, 19 nt, Homo sapiens
uuacacauuugaagaggau

SEQ ID NO: 93449 - RNA, 19 nt, Homo sapiens
guggucaauucuucaguga

SEQ ID NO: 93450 - RNA, 19 nt, Homo sapiens
gucauuucaucuacaagaa

SEQ ID NO: 93451 - RNA, 19 nt, Homo sapiens
gaagaggauaucgugacua

SEQ ID NO: 93452 - RNA, 19 nt, Homo sapiens
acaagggucauuucaucua

SEQ ID NO: 93453 - RNA, 19 nt, Homo sapiens
gacaggugaucccgucauc

SEQ ID NO: 93454 - RNA, 19 nt, Homo sapiens
cuaaaggcccacuggcauu

SEQ ID NO: 93455 - RNA, 19 nt, Homo sapiens
ugaagaggauaucgugacu

SEQ ID NO: 93456 - RNA, 19 nt, Homo sapiens
caacgucaucucuaacauc

SEQ ID NO: 93457 - RNA, 19 nt, Homo sapiens
auugaugucuccauucaga

SEQ ID NO: 93458 - RNA, 19 nt, Homo sapiens
ggaguacggagauggagau

SEQ ID NO: 93459 - RNA, 19 nt, Homo sapiens
ucaucaacccugagauuau

SEQ ID NO: 93460 - RNA, 19 nt, Homo sapiens
aacgucaucucuaacauca

SEQ ID NO: 93461 - RNA, 19 nt, Homo sapiens
gccauugaccuccagauca

SEQ ID NO: 93462 - RNA, 19 nt, Homo sapiens
uagcuuacacauuugaaga

SEQ ID NO: 93463 - RNA, 19 nt, Homo sapiens
gagucguggucaauucuuc

SEQ ID NO: 93464 - RNA, 19 nt, Homo sapiens
ucaaguauggguugcacaa

SEQ ID NO: 93465 - RNA, 19 nt, Homo sapiens
guuuccaacuugacugaga

SEQ ID NO: 93466 - RNA, 19 nt, Homo sapiens
ccagcaacauucuguagcu

SEQ ID NO: 93467 - RNA, 19 nt, Homo sapiens
ggguauugaucaguccauu

SEQ ID NO: 93468 - RNA, 19 nt, Homo sapiens
caacaccaaccaggaaauc

SEQ ID NO: 93469 - RNA, 19 nt, Homo sapiens
caucacaagggucauuuca

SEQ ID NO: 93470 - RNA, 19 nt, Homo sapiens
cccugaagcugguccugaa

SEQ ID NO: 93471 - RNA, 19 nt, Homo sapiens
cagcaacauucuguagcuu

SEQ ID NO: 93472 - RNA, 19 nt, Homo sapiens
gaccagcaacauucuguag

SEQ ID NO: 93473 - RNA, 19 nt, Homo sapiens
acaagggagucguggucaa

SEQ ID NO: 93474 - RNA, 19 nt, Homo sapiens
gccucaagaugcccaagau

SEQ ID NO: 93475 - RNA, 19 nt, Homo sapiens
agggacagaucugcaaaga

SEQ ID NO: 93476 - RNA, 19 nt, Homo sapiens
caaauuucaucuccuucac

SEQ ID NO: 93477 - RNA, 19 nt, Homo sapiens
gcugggcggacauacauau

SEQ ID NO: 93478 - RNA, 19 nt, Homo sapiens
cgugguggaaguuggguua

SEQ ID NO: 93479 - RNA, 19 nt, Homo sapiens
caagggagucguggucaau

SEQ ID NO: 93480 - RNA, 19 nt, Homo sapiens
gaugggagacgaguucaag

SEQ ID NO: 93481 - RNA, 19 nt, Homo sapiens
gggcugggcggacauacau

SEQ ID NO: 93482 - RNA, 19 nt, Homo sapiens
ugaagggacagaucugcaa

SEQ ID NO: 93483 - RNA, 19 nt, Homo sapiens
gacaucaucaacccugaga

SEQ ID NO: 93484 - RNA, 19 nt, Homo sapiens
gugagccucuucgacauca

SEQ ID NO: 93485 - RNA, 19 nt, Homo sapiens
ccgaguccauccagagcuu

SEQ ID NO: 93486 - RNA, 19 nt, Homo sapiens
gguggacauuucccugaca

SEQ ID NO: 93487 - RNA, 19 nt, Homo sapiens
gguauugaucaguccauug

SEQ ID NO: 93488 - RNA, 19 nt, Homo sapiens
gggcggacauacauauacg

SEQ ID NO: 93489 - RNA, 19 nt, Homo sapiens
ggaagccaaguccauugau

SEQ ID NO: 93490 - RNA, 19 nt, Homo sapiens
gcgugagccucuucgacau

SEQ ID NO: 93491 - RNA, 19 nt, Homo sapiens
acaaauuucaucuccuuca

SEQ ID NO: 93492 - RNA, 19 nt, Homo sapiens
aaggcccacuggcauuaaa

SEQ ID NO: 93493 - RNA, 19 nt, Homo sapiens
ccaaagacuguuuccaacu

SEQ ID NO: 93494 - RNA, 19 nt, Homo sapiens
ucaacgucaucucuaacau

SEQ ID NO: 93495 - RNA, 19 nt, Homo sapiens
caaagagaucaacgucauc

SEQ ID NO: 93496 - RNA, 19 nt, Homo sapiens
aagacuguuuccaacuuga

SEQ ID NO: 93497 - RNA, 19 nt, Homo sapiens
gaaggaggaucugguguuu

SEQ ID NO: 93498 - RNA, 19 nt, Homo sapiens
ugacagggaucaagcauga

SEQ ID NO: 93499 - RNA, 19 nt, Homo sapiens
ucaagaugcugccagauaa

SEQ ID NO: 93500 - RNA, 19 nt, Homo sapiens
gauaaggacugccgcuaug

SEQ ID NO: 93501 - RNA, 19 nt, Homo sapiens
gaucaagcaugaauugcaa

SEQ ID NO: 93502 - RNA, 19 nt, Homo sapiens
guguauaaauggaauguug

SEQ ID NO: 93503 - RNA, 19 nt, Homo sapiens
gugcuugucuguuuaguuc

SEQ ID NO: 93504 - RNA, 19 nt, Homo sapiens
ccaaggacgccaucaagaa

SEQ ID NO: 93505 - RNA, 19 nt, Homo sapiens
aggaggaucugguguuuau

SEQ ID NO: 93506 - RNA, 19 nt, Homo sapiens
ggucacggcuacucaugga

SEQ ID NO: 93507 - RNA, 19 nt, Homo sapiens
acucugugcuugucuguuu

SEQ ID NO: 93508 - RNA, 19 nt, Homo sapiens
cauggaagcaggaccagua

SEQ ID NO: 93509 - RNA, 19 nt, Homo sapiens
gaucugguguuuaucuucu

SEQ ID NO: 93510 - RNA, 19 nt, Homo sapiens
gucaagaugcugccagaua

SEQ ID NO: 93511 - RNA, 19 nt, Homo sapiens
ccaaggagagcaagaagga

SEQ ID NO: 93512 - RNA, 19 nt, Homo sapiens
ugagugaggacaagaagaa

SEQ ID NO: 93513 - RNA, 19 nt, Homo sapiens
ggagggcaagccuuuguga

SEQ ID NO: 93514 - RNA, 19 nt, Homo sapiens
ggacaagaagaacaucauc

SEQ ID NO: 93515 - RNA, 19 nt, Homo sapiens
guucuggccuucccaaacu

SEQ ID NO: 93516 - RNA, 19 nt, Homo sapiens
caaccuaugagaccaagga

SEQ ID NO: 93517 - RNA, 19 nt, Homo sapiens
ucaucaagguguucaacga

SEQ ID NO: 93518 - RNA, 19 nt, Homo sapiens
ggaagcaggaccaguaagg

SEQ ID NO: 93519 - RNA, 19 nt, Homo sapiens
ggaauguuguggagaugac

SEQ ID NO: 93520 - RNA, 19 nt, Homo sapiens
ccucuaugaugcaaccuau

SEQ ID NO: 93521 - RNA, 19 nt, Homo sapiens
gggccagacugucgacgau

SEQ ID NO: 93522 - RNA, 19 nt, Homo sapiens
caaggacgccaucaagaag

SEQ ID NO: 93523 - RNA, 19 nt, Homo sapiens
ggaucaagcaugaauugca

SEQ ID NO: 93524 - RNA, 19 nt, Homo sapiens
cuucuaaccgcaauaguga

SEQ ID NO: 93525 - RNA, 19 nt, Homo sapiens
ucuaugaugcaaccuauga

SEQ ID NO: 93526 - RNA, 19 nt, Homo sapiens
aauggaauguuguggagau

SEQ ID NO: 93527 - RNA, 19 nt, Homo sapiens
gaggaucugguguuuaucu

SEQ ID NO: 93528 - RNA, 19 nt, Homo sapiens
ggcugaagcagaccaaguu

SEQ ID NO: 93529 - RNA, 19 nt, Homo sapiens
gacaugaaggugcguaagu

SEQ ID NO: 93530 - RNA, 19 nt, Homo sapiens
gcuacgaggaggucaagga

SEQ ID NO: 93531 - RNA, 19 nt, Homo sapiens
caauagugacucugugcuu

SEQ ID NO: 93532 - RNA, 19 nt, Homo sapiens
uaaccgcaauagugacucu

SEQ ID NO: 93533 - RNA, 19 nt, Homo sapiens
caacuucuaaccgcaauag

SEQ ID NO: 93534 - RNA, 19 nt, Homo sapiens
cgccagaggaggugaagaa

SEQ ID NO: 93535 - RNA, 19 nt, Homo sapiens
agaaggaggaucugguguu

SEQ ID NO: 93536 - RNA, 19 nt, Homo sapiens
guauaaauggaauguugug

SEQ ID NO: 93537 - RNA, 19 nt, Homo sapiens
gaggacaagaagaacauca

SEQ ID NO: 93538 - RNA, 19 nt, Homo sapiens
cuguuuaguucuguguaua

SEQ ID NO: 93539 - RNA, 19 nt, Homo sapiens
gcuugucuguuuaguucug

SEQ ID NO: 93540 - RNA, 19 nt, Homo sapiens
gccgcuaugcccucuauga

SEQ ID NO: 93541 - RNA, 19 nt, Homo sapiens
acaugaaggugcguaaguc

SEQ ID NO: 93542 - RNA, 19 nt, Homo sapiens
gaggugaagaagcgcaaga

SEQ ID NO: 93543 - RNA, 19 nt, Homo sapiens
ucuguuuaguucuguguau

SEQ ID NO: 93544 - RNA, 19 nt, Homo sapiens
ucaagguguucaacgacau

SEQ ID NO: 93545 - RNA, 19 nt, Homo sapiens
aggacgccaucaagaagaa

SEQ ID NO: 93546 - RNA, 19 nt, Homo sapiens
ccaugcugccaacuucuaa

SEQ ID NO: 93547 - RNA, 19 nt, Homo sapiens
ucucggugcccucuccuuu

SEQ ID NO: 93548 - RNA, 19 nt, Homo sapiens
gcuccaaggacgccaucaa

SEQ ID NO: 93549 - RNA, 19 nt, Homo sapiens
gccaacuucuaaccgcaau

SEQ ID NO: 93550 - RNA, 19 nt, Homo sapiens
ggccuucccaaacugcuuu

SEQ ID NO: 93551 - RNA, 19 nt, Homo sapiens
agauaaggacugccgcuau

SEQ ID NO: 93552 - RNA, 19 nt, Homo sapiens
gaaagaagaccuaguauuu

SEQ ID NO: 93553 - RNA, 19 nt, Homo sapiens
guaaauggcuuggaugaua

SEQ ID NO: 93554 - RNA, 19 nt, Homo sapiens
gcaguucucuucuguuuaa

SEQ ID NO: 93555 - RNA, 19 nt, Homo sapiens
gaaacaacuucuaggguaa

SEQ ID NO: 93556 - RNA, 19 nt, Homo sapiens
gcaaaguuaugagaguuua

SEQ ID NO: 93557 - RNA, 19 nt, Homo sapiens
aaacaugaguggcaaguaa

SEQ ID NO: 93558 - RNA, 19 nt, Homo sapiens
gaaagcaguucucuucugu

SEQ ID NO: 93559 - RNA, 19 nt, Homo sapiens
ggacuugauucuacuggua

SEQ ID NO: 93560 - RNA, 19 nt, Homo sapiens
uaagaaagaagaccuagua

SEQ ID NO: 93561 - RNA, 19 nt, Homo sapiens
gauggcaauuucuguauaa

SEQ ID NO: 93562 - RNA, 19 nt, Homo sapiens
ugucuaggcuuccauuuaa

SEQ ID NO: 93563 - RNA, 19 nt, Homo sapiens
guacagcauucauguguga

SEQ ID NO: 93564 - RNA, 19 nt, Homo sapiens
uuacauggcuucuggaguu

SEQ ID NO: 93565 - RNA, 19 nt, Homo sapiens
gcaggaagcucuuauugcu

SEQ ID NO: 93566 - RNA, 19 nt, Homo sapiens
gcauucaugugugauauuu

SEQ ID NO: 93567 - RNA, 19 nt, Homo sapiens
gcacggauauaacacuaug

SEQ ID NO: 93568 - RNA, 19 nt, Homo sapiens
gccauuagacuguugaaua

SEQ ID NO: 93569 - RNA, 19 nt, Homo sapiens
ugacauuggugauacugua

SEQ ID NO: 93570 - RNA, 19 nt, Homo sapiens
gagauuaauuuggcauuug

SEQ ID NO: 93571 - RNA, 19 nt, Homo sapiens
ggauauaacacuaugcauu

SEQ ID NO: 93572 - RNA, 19 nt, Homo sapiens
caaaggauaagcuaauuga

SEQ ID NO: 93573 - RNA, 19 nt, Homo sapiens
gguauacggugcuaauuag

SEQ ID NO: 93574 - RNA, 19 nt, Homo sapiens
gcacugagcaauuuuauuu

SEQ ID NO: 93575 - RNA, 19 nt, Homo sapiens
cuaaguaguuguauaguag

SEQ ID NO: 93576 - RNA, 19 nt, Homo sapiens
cuaauugaaugccuugaaa

SEQ ID NO: 93577 - RNA, 19 nt, Homo sapiens
caaaacaacugguuauaug

SEQ ID NO: 93578 - RNA, 19 nt, Homo sapiens
uuaaggagcuuccauuucu

SEQ ID NO: 93579 - RNA, 19 nt, Homo sapiens
uaaauggcuuggaugauau

SEQ ID NO: 93580 - RNA, 19 nt, Homo sapiens
gccaaacucugauaagcaa

SEQ ID NO: 93581 - RNA, 19 nt, Homo sapiens
acagaacguugccuuguuu

SEQ ID NO: 93582 - RNA, 19 nt, Homo sapiens
gggaggcaauguaguaguu

SEQ ID NO: 93583 - RNA, 19 nt, Homo sapiens
aagcaguucucuucuguuu

SEQ ID NO: 93584 - RNA, 19 nt, Homo sapiens
gaaugggcaggaugaguua

SEQ ID NO: 93585 - RNA, 19 nt, Homo sapiens
ggaaagaaaauaucccuua

SEQ ID NO: 93586 - RNA, 19 nt, Homo sapiens
aaacuggacuugauucuac

SEQ ID NO: 93587 - RNA, 19 nt, Homo sapiens
gcagcaagcacuacaaugu

SEQ ID NO: 93588 - RNA, 19 nt, Homo sapiens
gaaucaauguuccaguuag

SEQ ID NO: 93589 - RNA, 19 nt, Homo sapiens
uaugcuagcucuaaagaug

SEQ ID NO: 93590 - RNA, 19 nt, Homo sapiens
aaggaaaucuucuacacaa

SEQ ID NO: 93591 - RNA, 19 nt, Homo sapiens
gaguuacagugaaugauga

SEQ ID NO: 93592 - RNA, 19 nt, Homo sapiens
gaauugauauagcagucuu

SEQ ID NO: 93593 - RNA, 19 nt, Homo sapiens
agucguggcucagaacuua

SEQ ID NO: 93594 - RNA, 19 nt, Homo sapiens
ugucauaguuauccacaaa

SEQ ID NO: 93595 - RNA, 19 nt, Homo sapiens
gugaauagcuuagaauacu

SEQ ID NO: 93596 - RNA, 19 nt, Homo sapiens
agacugugcuccuuauaga

SEQ ID NO: 93597 - RNA, 19 nt, Homo sapiens
gaauaggaauugauauagc

SEQ ID NO: 93598 - RNA, 19 nt, Homo sapiens
aggauaagcuaauugaaug

SEQ ID NO: 93599 - RNA, 19 nt, Homo sapiens
gcucuaaagaugccauuaa

SEQ ID NO: 93600 - RNA, 19 nt, Homo sapiens
auacggugcuaauuaguaa

SEQ ID NO: 93601 - RNA, 19 nt, Homo sapiens
uaucgucuacugauucuua

SEQ ID NO: 93602 - RNA, 19 nt, Homo sapiens
gcacuggucauuugagaau

SEQ ID NO: 93603 - RNA, 19 nt, Homo sapiens
caaugugaauagcuuagaa

SEQ ID NO: 93604 - RNA, 19 nt, Homo sapiens
guaaggaaaucuucuacac

SEQ ID NO: 93605 - RNA, 19 nt, Homo sapiens
gacgguauacuuaaccaua

SEQ ID NO: 93606 - RNA, 19 nt, Homo sapiens
ggaacagucauuucaccua

SEQ ID NO: 93607 - RNA, 19 nt, Homo sapiens
cugaauaaguguaggaguu

SEQ ID NO: 93608 - RNA, 19 nt, Homo sapiens
uuaccugcauaucuucuua

SEQ ID NO: 93609 - RNA, 19 nt, Homo sapiens
uugaaugccuugaaaguau

SEQ ID NO: 93610 - RNA, 19 nt, Homo sapiens
gcaaaggauaagcuaauug

SEQ ID NO: 93611 - RNA, 19 nt, Homo sapiens
ccauuagacuguugaauac

SEQ ID NO: 93612 - RNA, 19 nt, Homo sapiens
aaagcaagaugauuuaugc

SEQ ID NO: 93613 - RNA, 19 nt, Homo sapiens
gcuuuaaacugugauacuu

SEQ ID NO: 93614 - RNA, 19 nt, Homo sapiens
ugugagcgguuugcuguua

SEQ ID NO: 93615 - RNA, 19 nt, Homo sapiens
ggaauaggaauugauauag

SEQ ID NO: 93616 - RNA, 19 nt, Homo sapiens
gaagcaggaagcucuuauu

SEQ ID NO: 93617 - RNA, 19 nt, Homo sapiens
ugauggcaauuucuguaua

SEQ ID NO: 93618 - RNA, 19 nt, Homo sapiens
cugcaacacuaaagauauu

SEQ ID NO: 93619 - RNA, 19 nt, Homo sapiens
cagcacggauauaacacua

SEQ ID NO: 93620 - RNA, 19 nt, Homo sapiens
uuaagcagccuaucaguga

SEQ ID NO: 93621 - RNA, 19 nt, Homo sapiens
ggaguuacagugaaugaug

SEQ ID NO: 93622 - RNA, 19 nt, Homo sapiens
uaaaagagccuuaaaugga

SEQ ID NO: 93623 - RNA, 19 nt, Homo sapiens
uaacugugucaucaacuua

SEQ ID NO: 93624 - RNA, 19 nt, Homo sapiens
cacaaugaaugaaggaaau

SEQ ID NO: 93625 - RNA, 19 nt, Homo sapiens
caaaagagucuaagaaaga

SEQ ID NO: 93626 - RNA, 19 nt, Homo sapiens
ugaguuauccuggacauuu

SEQ ID NO: 93627 - RNA, 19 nt, Homo sapiens
ucucugcacuggucauuug

SEQ ID NO: 93628 - RNA, 19 nt, Homo sapiens
gcacuugauugcaguucug

SEQ ID NO: 93629 - RNA, 19 nt, Homo sapiens
ugaaugccuugaaaguauu

SEQ ID NO: 93630 - RNA, 19 nt, Homo sapiens
cagcugucccugugaguua

SEQ ID NO: 93631 - RNA, 19 nt, Homo sapiens
gcagaaaacaggaaagaaa

SEQ ID NO: 93632 - RNA, 19 nt, Homo sapiens
gcaguucugugaggcuuga

SEQ ID NO: 93633 - RNA, 19 nt, Homo sapiens
acugcuagcuugcaaaguu

SEQ ID NO: 93634 - RNA, 19 nt, Homo sapiens
ugaaucaauguuccaguua

SEQ ID NO: 93635 - RNA, 19 nt, Homo sapiens
gugauacuuugauuugcua

SEQ ID NO: 93636 - RNA, 19 nt, Homo sapiens
aaacauuaguagugggauu

SEQ ID NO: 93637 - RNA, 19 nt, Homo sapiens
ccuguuaccugcauaucuu

SEQ ID NO: 93638 - RNA, 19 nt, Homo sapiens
cugcuagcuugcaaaguua

SEQ ID NO: 93639 - RNA, 19 nt, Homo sapiens
gcugauuccuuaacuuucu

SEQ ID NO: 93640 - RNA, 19 nt, Homo sapiens
ugaaugguuugggaucuuu

SEQ ID NO: 93641 - RNA, 19 nt, Homo sapiens
aaacaggcaugcuaguaag

SEQ ID NO: 93642 - RNA, 19 nt, Homo sapiens
gaguuauccuggacauuuc

SEQ ID NO: 93643 - RNA, 19 nt, Homo sapiens
gaaugccuugaaaguauua

SEQ ID NO: 93644 - RNA, 19 nt, Homo sapiens
ugaaguugcuaccucugaa

SEQ ID NO: 93645 - RNA, 19 nt, Homo sapiens
uagcugauuccuuaacuuu

SEQ ID NO: 93646 - RNA, 19 nt, Homo sapiens
gauuuguucucuggauaaa

SEQ ID NO: 93647 - RNA, 19 nt, Homo sapiens
cuaaaaggaaugccaauua

SEQ ID NO: 93648 - RNA, 19 nt, Homo sapiens
gcacuacaaugugugugau

SEQ ID NO: 93649 - RNA, 19 nt, Homo sapiens
uuguaugccucuaguaauu

SEQ ID NO: 93650 - RNA, 19 nt, Homo sapiens
guaaggccaaacucugaua

SEQ ID NO: 93651 - RNA, 19 nt, Homo sapiens
acagucauuucaccuacua

SEQ ID NO: 93652 - RNA, 19 nt, Homo sapiens
gcagcaaggugaccacuua

SEQ ID NO: 93653 - RNA, 19 nt, Homo sapiens
ggucagcuaugaaguaaua

SEQ ID NO: 93654 - RNA, 19 nt, Homo sapiens
gaagacugcuuucguuauu

SEQ ID NO: 93655 - RNA, 19 nt, Homo sapiens
cuaauaggcucuacaagua

SEQ ID NO: 93656 - RNA, 19 nt, Homo sapiens
gaaaguacgcccaagauuu

SEQ ID NO: 93657 - RNA, 19 nt, Homo sapiens
ggagaaauguucaugguau

SEQ ID NO: 93658 - RNA, 19 nt, Homo sapiens
gaugucaacugcucgguua

SEQ ID NO: 93659 - RNA, 19 nt, Homo sapiens
cagcacaccuuaagaauuc

SEQ ID NO: 93660 - RNA, 19 nt, Homo sapiens
gcgagaauccguauacuaa

SEQ ID NO: 93661 - RNA, 19 nt, Homo sapiens
ggaagauggucagcuauga

SEQ ID NO: 93662 - RNA, 19 nt, Homo sapiens
gguaugccuuccaguauuu

SEQ ID NO: 93663 - RNA, 19 nt, Homo sapiens
cagaggaacugaugagugu

SEQ ID NO: 93664 - RNA, 19 nt, Homo sapiens
caaccaaggcuuugagauu

SEQ ID NO: 93665 - RNA, 19 nt, Homo sapiens
gcgcucggcuuccugguaa

SEQ ID NO: 93666 - RNA, 19 nt, Homo sapiens
ucucagaagcuuacaaaua

SEQ ID NO: 93667 - RNA, 19 nt, Homo sapiens
gcaaugaagcccugaugaa

SEQ ID NO: 93668 - RNA, 19 nt, Homo sapiens
ggagauaugauuaggagaa

SEQ ID NO: 93669 - RNA, 19 nt, Homo sapiens
gcuuugagauuguguugaa

SEQ ID NO: 93670 - RNA, 19 nt, Homo sapiens
gguaauucuucaccucuuu

SEQ ID NO: 93671 - RNA, 19 nt, Homo sapiens
ccuuugagcugacuaauca

SEQ ID NO: 93672 - RNA, 19 nt, Homo sapiens
ggaaaguacgcccaagauu

SEQ ID NO: 93673 - RNA, 19 nt, Homo sapiens
gcaacuacauacauggaau

SEQ ID NO: 93674 - RNA, 19 nt, Homo sapiens
cucagaagcuuacaaauag

SEQ ID NO: 93675 - RNA, 19 nt, Homo sapiens
ggaacugccucugagaaug

SEQ ID NO: 93676 - RNA, 19 nt, Homo sapiens
gauggucagcuaugaagua

SEQ ID NO: 93677 - RNA, 19 nt, Homo sapiens
gaacugccucugagaaugu

SEQ ID NO: 93678 - RNA, 19 nt, Homo sapiens
gaagauggucagcuaugaa

SEQ ID NO: 93679 - RNA, 19 nt, Homo sapiens
gcagcaaucucagaagcuu

SEQ ID NO: 93680 - RNA, 19 nt, Homo sapiens
ggguaugccuuccaguauu

SEQ ID NO: 93681 - RNA, 19 nt, Homo sapiens
caacuacauacauggaaua

SEQ ID NO: 93682 - RNA, 19 nt, Homo sapiens
caacacagcacaccuuaag

SEQ ID NO: 93683 - RNA, 19 nt, Homo sapiens
ggaagacugcuuucguuau

SEQ ID NO: 93684 - RNA, 19 nt, Homo sapiens
gagaaauguucaugguauc

SEQ ID NO: 93685 - RNA, 19 nt, Homo sapiens
gaagcgagaauccguauac

SEQ ID NO: 93686 - RNA, 19 nt, Homo sapiens
gagauuguguugaaugacu

SEQ ID NO: 93687 - RNA, 19 nt, Homo sapiens
ugaugaagcuugaguuggu

SEQ ID NO: 93688 - RNA, 19 nt, Homo sapiens
uguaggagguuucuaugga

SEQ ID NO: 93689 - RNA, 19 nt, Homo sapiens
aaggaagacugcuuucguu

SEQ ID NO: 93690 - RNA, 19 nt, Homo sapiens
gaaggaagacugcuuucgu

SEQ ID NO: 93691 - RNA, 19 nt, Homo sapiens
gcacugauucuccaugcaa

SEQ ID NO: 93692 - RNA, 19 nt, Homo sapiens
aaccaaggcuuugagauug

SEQ ID NO: 93693 - RNA, 19 nt, Homo sapiens
gaaguaauagaguuugcuu

SEQ ID NO: 93694 - RNA, 19 nt, Homo sapiens
ucuggaagauggucagcua

SEQ ID NO: 93695 - RNA, 19 nt, Homo sapiens
auggauuacuggauuguua

SEQ ID NO: 93696 - RNA, 19 nt, Homo sapiens
cuuaagaauucucaggaaa

SEQ ID NO: 93697 - RNA, 19 nt, Homo sapiens
ggacugcaacuacauacau

SEQ ID NO: 93698 - RNA, 19 nt, Homo sapiens
acacagcacaccuuaagaa

SEQ ID NO: 93699 - RNA, 19 nt, Homo sapiens
ugggauggauuacuggauu

SEQ ID NO: 93700 - RNA, 19 nt, Homo sapiens
gcuacucauuugcuucuau

SEQ ID NO: 93701 - RNA, 19 nt, Homo sapiens
gagaauguguaugucaaca

SEQ ID NO: 93702 - RNA, 19 nt, Homo sapiens
guagugguguaccuucaga

SEQ ID NO: 93703 - RNA, 19 nt, Homo sapiens
accacugacugcugaaaua

SEQ ID NO: 93704 - RNA, 19 nt, Homo sapiens
cuacaaguaugaucacaac

SEQ ID NO: 93705 - RNA, 19 nt, Homo sapiens
guuaugggaccacaagaaa

SEQ ID NO: 93706 - RNA, 19 nt, Homo sapiens
gggauggauuacuggauug

SEQ ID NO: 93707 - RNA, 19 nt, Homo sapiens
ggcaguugcuuuugaagua

SEQ ID NO: 93708 - RNA, 19 nt, Homo sapiens
uauggaggcugcaaugaag

SEQ ID NO: 93709 - RNA, 19 nt, Homo sapiens
gccauuucaccaucauuua

SEQ ID NO: 93710 - RNA, 19 nt, Homo sapiens
gaacugaugagugugcaau

SEQ ID NO: 93711 - RNA, 19 nt, Homo sapiens
cucaggagguugugucuug

SEQ ID NO: 93712 - RNA, 19 nt, Homo sapiens
gauaugauuaggagaagug

SEQ ID NO: 93713 - RNA, 19 nt, Homo sapiens
gagauaugauuaggagaag

SEQ ID NO: 93714 - RNA, 19 nt, Homo sapiens
ggccggaacugggcuuguu

SEQ ID NO: 93715 - RNA, 19 nt, Homo sapiens
gaguuugcuuaaucauuug

SEQ ID NO: 93716 - RNA, 19 nt, Homo sapiens
ucagaagcuuacaaauaga

SEQ ID NO: 93717 - RNA, 19 nt, Homo sapiens
aagacugcuuucguuauua

SEQ ID NO: 93718 - RNA, 19 nt, Homo sapiens
gcaaggugaccacuuacug

SEQ ID NO: 93719 - RNA, 19 nt, Homo sapiens
gaaauguucaugguaucaa

SEQ ID NO: 93720 - RNA, 19 nt, Homo sapiens
ggaaagaaggugggaacug

SEQ ID NO: 93721 - RNA, 19 nt, Homo sapiens
gugggugcaugauguguug

SEQ ID NO: 93722 - RNA, 19 nt, Homo sapiens
ggccauuucaccaucauuu

SEQ ID NO: 93723 - RNA, 19 nt, Homo sapiens
ccucugggauggauuacug

SEQ ID NO: 93724 - RNA, 19 nt, Homo sapiens
gacugcaacuacauacaug

SEQ ID NO: 93725 - RNA, 19 nt, Homo sapiens
uaaucaugcuguucugcuu

SEQ ID NO: 93726 - RNA, 19 nt, Homo sapiens
gagaauccguauacuaacc

SEQ ID NO: 93727 - RNA, 19 nt, Homo sapiens
cuacaagugguuugccuuu

SEQ ID NO: 93728 - RNA, 19 nt, Homo sapiens
gcagccacaccaauuccua

SEQ ID NO: 93729 - RNA, 19 nt, Homo sapiens
cuacucauuugcuucuaug

SEQ ID NO: 93730 - RNA, 19 nt, Homo sapiens
caccaucauuuacaaccaa

SEQ ID NO: 93731 - RNA, 19 nt, Homo sapiens
ucuaauaggcucuacaagu

SEQ ID NO: 93732 - RNA, 19 nt, Homo sapiens
ccuuaagaauucucaggaa

SEQ ID NO: 93733 - RNA, 19 nt, Homo sapiens
ccucugagaauguguaugu

SEQ ID NO: 93734 - RNA, 19 nt, Homo sapiens
ggcagcugcuacucauuug

SEQ ID NO: 93735 - RNA, 19 nt, Homo sapiens
uaggguaugccuuccagua

SEQ ID NO: 93736 - RNA, 19 nt, Homo sapiens
caaugaagcccugaugaag

SEQ ID NO: 93737 - RNA, 19 nt, Homo sapiens
uggcagcugcuacucauuu

SEQ ID NO: 93738 - RNA, 19 nt, Homo sapiens
aauaggcucuacaaguaug

SEQ ID NO: 93739 - RNA, 19 nt, Homo sapiens
gggaacugccucugagaau

SEQ ID NO: 93740 - RNA, 19 nt, Homo sapiens
cuuccaguauuucauaaug

SEQ ID NO: 93741 - RNA, 19 nt, Homo sapiens
caacugcaccuaucuugac

SEQ ID NO: 93742 - RNA, 19 nt, Homo sapiens
gggugagaauggcuacuuc

SEQ ID NO: 93743 - RNA, 19 nt, Homo sapiens
aaaguacgcccaagauuuu

SEQ ID NO: 93744 - RNA, 19 nt, Homo sapiens
ggauacagcauaugaugac

SEQ ID NO: 93745 - RNA, 19 nt, Homo sapiens
uugagauuguguugaauga

SEQ ID NO: 93746 - RNA, 19 nt, Homo sapiens
ggauuacuggauuguuaaa

SEQ ID NO: 93747 - RNA, 19 nt, Homo sapiens
gguuaugggaccacaagaa

SEQ ID NO: 93748 - RNA, 19 nt, Homo sapiens
ugacuuccuccacuacaaa

SEQ ID NO: 93749 - RNA, 19 nt, Homo sapiens
gaauccguauacuaaccaa

SEQ ID NO: 93750 - RNA, 19 nt, Homo sapiens
uaauaggcucuacaaguau

SEQ ID NO: 93751 - RNA, 19 nt, Homo sapiens
gucaacacagcacaccuua

SEQ ID NO: 93752 - RNA, 19 nt, Homo sapiens
ggaacaaacugguuauuaa

SEQ ID NO: 93753 - RNA, 19 nt, Homo sapiens
gaugucaacugcucgguua

SEQ ID NO: 93754 - RNA, 19 nt, Homo sapiens
uuaaggaugucacugauuu

SEQ ID NO: 93755 - RNA, 19 nt, Homo sapiens
caaccaaggcuuugagauu

SEQ ID NO: 93756 - RNA, 19 nt, Homo sapiens
gcgcucggcuuccugguaa

SEQ ID NO: 93757 - RNA, 19 nt, Homo sapiens
gcuuugagauuguguugaa

SEQ ID NO: 93758 - RNA, 19 nt, Homo sapiens
gguaauucuucaccucuuu

SEQ ID NO: 93759 - RNA, 19 nt, Homo sapiens
gaacagacguuggggcuaa

SEQ ID NO: 93760 - RNA, 19 nt, Homo sapiens
uuaaauagagcaucuguug

SEQ ID NO: 93761 - RNA, 19 nt, Homo sapiens
gagauuguguugaaugacu

SEQ ID NO: 93762 - RNA, 19 nt, Homo sapiens
ccugaacacucccuuggaa

SEQ ID NO: 93763 - RNA, 19 nt, Homo sapiens
aaccaaggcuuugagauug

SEQ ID NO: 93764 - RNA, 19 nt, Homo sapiens
guagugguguaccuucaga

SEQ ID NO: 93765 - RNA, 19 nt, Homo sapiens
guuaugggaccacaagaaa

SEQ ID NO: 93766 - RNA, 19 nt, Homo sapiens
gccauuucaccaucauuua

SEQ ID NO: 93767 - RNA, 19 nt, Homo sapiens
cuucuggagucuuuauuug

SEQ ID NO: 93768 - RNA, 19 nt, Homo sapiens
aggaacaaacugguuauua

SEQ ID NO: 93769 - RNA, 19 nt, Homo sapiens
cuacacaggagaaaggaaa

SEQ ID NO: 93770 - RNA, 19 nt, Homo sapiens
uaaauagagcaucuguuga

SEQ ID NO: 93771 - RNA, 19 nt, Homo sapiens
ggccauuucaccaucauuu

SEQ ID NO: 93772 - RNA, 19 nt, Homo sapiens
uauaugauuugccacaucu

SEQ ID NO: 93773 - RNA, 19 nt, Homo sapiens
uggcuucaccguucaguuu

SEQ ID NO: 93774 - RNA, 19 nt, Homo sapiens
gaaugugaacaaccagaga

SEQ ID NO: 93775 - RNA, 19 nt, Homo sapiens
gauauaugauuugccacau

SEQ ID NO: 93776 - RNA, 19 nt, Homo sapiens
gaacuguggggauauauga

SEQ ID NO: 93777 - RNA, 19 nt, Homo sapiens
cuacaagugguuugccuuu

SEQ ID NO: 93778 - RNA, 19 nt, Homo sapiens
caccaucauuuacaaccaa

SEQ ID NO: 93779 - RNA, 19 nt, Homo sapiens
aaauagagcaucuguugag

SEQ ID NO: 93780 - RNA, 19 nt, Homo sapiens
ggaugucacugauuuuauc

SEQ ID NO: 93781 - RNA, 19 nt, Homo sapiens
caacugcaccuaucuugac

SEQ ID NO: 93782 - RNA, 19 nt, Homo sapiens
ggauacagcauaugaugac

SEQ ID NO: 93783 - RNA, 19 nt, Homo sapiens
cugaggaacaaacugguua

SEQ ID NO: 93784 - RNA, 19 nt, Homo sapiens
ucaugcagcugggaacugu

SEQ ID NO: 93785 - RNA, 19 nt, Homo sapiens
gaaugacuacaagugguuu

SEQ ID NO: 93786 - RNA, 19 nt, Homo sapiens
uugagauuguguugaauga

SEQ ID NO: 93787 - RNA, 19 nt, Homo sapiens
gguuaugggaccacaagaa

SEQ ID NO: 93788 - RNA, 19 nt, Homo sapiens
ggaaaacaguaaacaucau

SEQ ID NO: 93789 - RNA, 19 nt, Homo sapiens
gaggaacaaacugguuauu

SEQ ID NO: 93790 - RNA, 19 nt, Homo sapiens
uaucagucauuuguucaug

SEQ ID NO: 93791 - RNA, 19 nt, Homo sapiens
augaugaccuuggcaauuc

SEQ ID NO: 93792 - RNA, 19 nt, Homo sapiens
uaugaugaccuuggcaauu

SEQ ID NO: 93793 - RNA, 19 nt, Homo sapiens
gcagcugcccuccugaaca

SEQ ID NO: 93794 - RNA, 19 nt, Homo sapiens
ccaacugcaccuaucuuga

SEQ ID NO: 93795 - RNA, 19 nt, Homo sapiens
ugaaugacuacaagugguu

SEQ ID NO: 93796 - RNA, 19 nt, Homo sapiens
uacagcauaugaugaccuu

SEQ ID NO: 93797 - RNA, 19 nt, Homo sapiens
gcugggaacuguggggaua

SEQ ID NO: 93798 - RNA, 19 nt, Homo sapiens
gaacaaccagagacuacac

SEQ ID NO: 93799 - RNA, 19 nt, Homo sapiens
ugccacaucugaggaacaa

SEQ ID NO: 93800 - RNA, 19 nt, Homo sapiens
agauuguguugaaugacua

SEQ ID NO: 93801 - RNA, 19 nt, Homo sapiens
ccaaggcuuugagauugug

SEQ ID NO: 93802 - RNA, 19 nt, Homo sapiens
ucuggagucuuuauuugca

SEQ ID NO: 93803 - RNA, 19 nt, Homo sapiens
gccaacugcaccuaucuug

SEQ ID NO: 93804 - RNA, 19 nt, Homo sapiens
cagcugcccuccugaacac

SEQ ID NO: 93805 - RNA, 19 nt, Homo sapiens
uugagggacucuuuuaaaa

SEQ ID NO: 93806 - RNA, 19 nt, Homo sapiens
ucagucauuuguucaugca

SEQ ID NO: 93807 - RNA, 19 nt, Homo sapiens
gugaacaaccagagacuac

SEQ ID NO: 93808 - RNA, 19 nt, Homo sapiens
uaugauuugccacaucuga

SEQ ID NO: 93809 - RNA, 19 nt, Homo sapiens
cauuuacaaccaaggcuuu

SEQ ID NO: 93810 - RNA, 19 nt, Homo sapiens
gcucggcuuccugguaauu

SEQ ID NO: 93811 - RNA, 19 nt, Homo sapiens
gagaagaacugaaaucaua

SEQ ID NO: 93812 - RNA, 19 nt, Homo sapiens
ccacaaagcucugaauuua

SEQ ID NO: 93813 - RNA, 19 nt, Homo sapiens
ggaaagggcuguuauaauc

SEQ ID NO: 93814 - RNA, 19 nt, Homo sapiens
gaaacuggcuuggaaauaa

SEQ ID NO: 93815 - RNA, 19 nt, Homo sapiens
gaacaaauuugaugaagga

SEQ ID NO: 93816 - RNA, 19 nt, Homo sapiens
gaaauucaauccuaacuga

SEQ ID NO: 93817 - RNA, 19 nt, Homo sapiens
ugacugaacuggauauaua

SEQ ID NO: 93818 - RNA, 19 nt, Homo sapiens
gaacauuuccuucucaaua

SEQ ID NO: 93819 - RNA, 19 nt, Homo sapiens
ggagaaugaugaugaagua

SEQ ID NO: 93820 - RNA, 19 nt, Homo sapiens
caagaaauauggaaaguug

SEQ ID NO: 93821 - RNA, 19 nt, Homo sapiens
ucaaagaucucacagcaaa

SEQ ID NO: 93822 - RNA, 19 nt, Homo sapiens
gaaggaagaguugguauua

SEQ ID NO: 93823 - RNA, 19 nt, Homo sapiens
ccaacaaccugaacaaauu

SEQ ID NO: 93824 - RNA, 19 nt, Homo sapiens
ucaaacaacuggaaucuga

SEQ ID NO: 93825 - RNA, 19 nt, Homo sapiens
gcauuuagauguauagguu

SEQ ID NO: 93826 - RNA, 19 nt, Homo sapiens
gaaccuagggugauauuaa

SEQ ID NO: 93827 - RNA, 19 nt, Homo sapiens
gaaaucaggguuaguauug

SEQ ID NO: 93828 - RNA, 19 nt, Homo sapiens
gaacugaaaucauacuucu

SEQ ID NO: 93829 - RNA, 19 nt, Homo sapiens
gaaaugccauauuagagaa

SEQ ID NO: 93830 - RNA, 19 nt, Homo sapiens
gcucagaucugugauagaa

SEQ ID NO: 93831 - RNA, 19 nt, Homo sapiens
gaagaguacuuuguuauca

SEQ ID NO: 93832 - RNA, 19 nt, Homo sapiens
gaagaucagugaaagacuu

SEQ ID NO: 93833 - RNA, 19 nt, Homo sapiens
ccaguaacauaccaaauaa

SEQ ID NO: 93834 - RNA, 19 nt, Homo sapiens
uaacagcuaugcagugauu

SEQ ID NO: 93835 - RNA, 19 nt, Homo sapiens
gaacacauaccuucgauau

SEQ ID NO: 93836 - RNA, 19 nt, Homo sapiens
acacauaccuucgauauau

SEQ ID NO: 93837 - RNA, 19 nt, Homo sapiens
ccaaucaacucuauacgaa

SEQ ID NO: 93838 - RNA, 19 nt, Homo sapiens
gcaagaauauaagacauug

SEQ ID NO: 93839 - RNA, 19 nt, Homo sapiens
gagaauagcuauguuuagu

SEQ ID NO: 93840 - RNA, 19 nt, Homo sapiens
gaagaagaggugcaagaua

SEQ ID NO: 93841 - RNA, 19 nt, Homo sapiens
gaggacaucuccaaguuug

SEQ ID NO: 93842 - RNA, 19 nt, Homo sapiens
auagagagcuggcuucaaa

SEQ ID NO: 93843 - RNA, 19 nt, Homo sapiens
gaagaagcaccaaucauga

SEQ ID NO: 93844 - RNA, 19 nt, Homo sapiens
gacauuugcucauggaauu

SEQ ID NO: 93845 - RNA, 19 nt, Homo sapiens
gaaggcaggaguccaauuu

SEQ ID NO: 93846 - RNA, 19 nt, Homo sapiens
aagcaccaaucaugaauua

SEQ ID NO: 93847 - RNA, 19 nt, Homo sapiens
gcaggugggauucuuaaua

SEQ ID NO: 93848 - RNA, 19 nt, Homo sapiens
gugaagaaauuaacgaaga

SEQ ID NO: 93849 - RNA, 19 nt, Homo sapiens
ggaaaugccauauuagaga

SEQ ID NO: 93850 - RNA, 19 nt, Homo sapiens
caucaaagcaugccaacua

SEQ ID NO: 93851 - RNA, 19 nt, Homo sapiens
ggcaagacuucacuucuaa

SEQ ID NO: 93852 - RNA, 19 nt, Homo sapiens
gugauuaccucagaaauga

SEQ ID NO: 93853 - RNA, 19 nt, Homo sapiens
gcccacagcuguaugauuc

SEQ ID NO: 93854 - RNA, 19 nt, Homo sapiens
ccacaagacugcacaucaa

SEQ ID NO: 93855 - RNA, 19 nt, Homo sapiens
guggagugaucaagaaaua

SEQ ID NO: 93856 - RNA, 19 nt, Homo sapiens
ggacuugguuuccugauag

SEQ ID NO: 93857 - RNA, 19 nt, Homo sapiens
ccaacuaucucauuuccaa

SEQ ID NO: 93858 - RNA, 19 nt, Homo sapiens
gcauagauguggauagcuu

SEQ ID NO: 93859 - RNA, 19 nt, Homo sapiens
caagagcaguauacaaaga

SEQ ID NO: 93860 - RNA, 19 nt, Homo sapiens
ccaaaucccuucuguugau

SEQ ID NO: 93861 - RNA, 19 nt, Homo sapiens
gaguuuagcuggaaaagua

SEQ ID NO: 93862 - RNA, 19 nt, Homo sapiens
ggaagcaaaugacaucaca

SEQ ID NO: 93863 - RNA, 19 nt, Homo sapiens
gaaaggcagcucuaaaugu

SEQ ID NO: 93864 - RNA, 19 nt, Homo sapiens
aaacuuggaucccuaugaa

SEQ ID NO: 93865 - RNA, 19 nt, Homo sapiens
gauuggagcuauagcaguu

SEQ ID NO: 93866 - RNA, 19 nt, Homo sapiens
gaaagcaggugggauucuu

SEQ ID NO: 93867 - RNA, 19 nt, Homo sapiens
gguagaggguguguaagua

SEQ ID NO: 93868 - RNA, 19 nt, Homo sapiens
gaaacucguuaauuuguag

SEQ ID NO: 93869 - RNA, 19 nt, Homo sapiens
cuagaucuguucucaguaa

SEQ ID NO: 93870 - RNA, 19 nt, Homo sapiens
ggucaacgagcaagaauuu

SEQ ID NO: 93871 - RNA, 19 nt, Homo sapiens
guacaaacaugguaugacu

SEQ ID NO: 93872 - RNA, 19 nt, Homo sapiens
gggagaaccuagggugaua

SEQ ID NO: 93873 - RNA, 19 nt, Homo sapiens
ucacagaccuuugaacuag

SEQ ID NO: 93874 - RNA, 19 nt, Homo sapiens
ucaagaagguuaucucaag

SEQ ID NO: 93875 - RNA, 19 nt, Homo sapiens
uaaccaaggucagaacauu

SEQ ID NO: 93876 - RNA, 19 nt, Homo sapiens
gcagaaagaagaaauucaa

SEQ ID NO: 93877 - RNA, 19 nt, Homo sapiens
ggaagucaccaaagcagua

SEQ ID NO: 93878 - RNA, 19 nt, Homo sapiens
aaugauaacuggaaacuuc

SEQ ID NO: 93879 - RNA, 19 nt, Homo sapiens
ugauaugggucuugauaaa

SEQ ID NO: 93880 - RNA, 19 nt, Homo sapiens
gagagcagcauaaauguug

SEQ ID NO: 93881 - RNA, 19 nt, Homo sapiens
gcaaaagacucccuuacaa

SEQ ID NO: 93882 - RNA, 19 nt, Homo sapiens
ugaaagcugugucuguaaa

SEQ ID NO: 93883 - RNA, 19 nt, Homo sapiens
gacagccucuucuucagua

SEQ ID NO: 93884 - RNA, 19 nt, Homo sapiens
ggacuugcauuggcacauu

SEQ ID NO: 93885 - RNA, 19 nt, Homo sapiens
caaauuugaugaaggacuu

SEQ ID NO: 93886 - RNA, 19 nt, Homo sapiens
gaaaguugcagaugagguu

SEQ ID NO: 93887 - RNA, 19 nt, Homo sapiens
acaaagcucugaauuuaca

SEQ ID NO: 93888 - RNA, 19 nt, Homo sapiens
gaaacucuguuccacaaag

SEQ ID NO: 93889 - RNA, 19 nt, Homo sapiens
gcuuaugccuucucuuuau

SEQ ID NO: 93890 - RNA, 19 nt, Homo sapiens
ggagauuuauguucuaugg

SEQ ID NO: 93891 - RNA, 19 nt, Homo sapiens
caaacugacucuuaagaag

SEQ ID NO: 93892 - RNA, 19 nt, Homo sapiens
gaauugaggacacugauau

SEQ ID NO: 93893 - RNA, 19 nt, Homo sapiens
gaaagaggagacagaagaa

SEQ ID NO: 93894 - RNA, 19 nt, Homo sapiens
acacugcgcugguuccaaa

SEQ ID NO: 93895 - RNA, 19 nt, Homo sapiens
caagaagguuaucucaaga

SEQ ID NO: 93896 - RNA, 19 nt, Homo sapiens
guaaacugauggcuaacaa

SEQ ID NO: 93897 - RNA, 19 nt, Homo sapiens
caagacaaagggaauagua

SEQ ID NO: 93898 - RNA, 19 nt, Homo sapiens
gaagguggaaucacacuga

SEQ ID NO: 93899 - RNA, 19 nt, Homo sapiens
caaccaaaccauacaagaa

SEQ ID NO: 93900 - RNA, 19 nt, Homo sapiens
gauaguggcuuuuauuaug

SEQ ID NO: 93901 - RNA, 19 nt, Homo sapiens
ggaauuauuugagaaagca

SEQ ID NO: 93902 - RNA, 19 nt, Homo sapiens
ggaacgcucuaucgcgauu

SEQ ID NO: 93903 - RNA, 19 nt, Homo sapiens
ggaaagagaaugggauaga

SEQ ID NO: 93904 - RNA, 19 nt, Homo sapiens
gaaagagaaugggauagag

SEQ ID NO: 93905 - RNA, 19 nt, Homo sapiens
ggaaaggcagcucuaaaug

SEQ ID NO: 93906 - RNA, 19 nt, Homo sapiens
gcuggaaugccaacaauuu

SEQ ID NO: 93907 - RNA, 19 nt, Homo sapiens
gagagcauauuuccuccaa

SEQ ID NO: 93908 - RNA, 19 nt, Homo sapiens
gggaguagccgacacuuug

SEQ ID NO: 93909 - RNA, 19 nt, Homo sapiens
aaacuugacugaacuggau

SEQ ID NO: 93910 - RNA, 19 nt, Homo sapiens
acaaaugaauggcaucgaa

SEQ ID NO: 93911 - RNA, 19 nt, Homo sapiens
gaaaggagcgccauggauu

SEQ ID NO: 93912 - RNA, 19 nt, Homo sapiens
ccacuaagguccaagaaga

SEQ ID NO: 93913 - RNA, 19 nt, Homo sapiens
ggagcgccauggauuacua

SEQ ID NO: 93914 - RNA, 19 nt, Homo sapiens
gcauaucccacuccacuaa

SEQ ID NO: 93915 - RNA, 19 nt, Homo sapiens
caaccgcccugaacacauc

SEQ ID NO: 93916 - RNA, 19 nt, Homo sapiens
uauaacagggucacaguaa

SEQ ID NO: 93917 - RNA, 19 nt, Homo sapiens
aaaggagcgccauggauua

SEQ ID NO: 93918 - RNA, 19 nt, Homo sapiens
aggauauacugcagcuuua

SEQ ID NO: 93919 - RNA, 19 nt, Homo sapiens
cgccauggauuacuacaga

SEQ ID NO: 93920 - RNA, 19 nt, Homo sapiens
cugcaguacuuguuauuau

SEQ ID NO: 93921 - RNA, 19 nt, Homo sapiens
ccacugcaguacuuguuau

SEQ ID NO: 93922 - RNA, 19 nt, Homo sapiens
uaacagggucacaguaaug

SEQ ID NO: 93923 - RNA, 19 nt, Homo sapiens
ugacacgcuucaaggauau

SEQ ID NO: 93924 - RNA, 19 nt, Homo sapiens
gaaugcacgcuacaggaaa

SEQ ID NO: 93925 - RNA, 19 nt, Homo sapiens
uuuacugccuuccuccuua

SEQ ID NO: 93926 - RNA, 19 nt, Homo sapiens
gcaguacuuguuauuauca

SEQ ID NO: 93927 - RNA, 19 nt, Homo sapiens
cuguguagcuaaaucauau

SEQ ID NO: 93928 - RNA, 19 nt, Homo sapiens
agaguccacuugcugugua

SEQ ID NO: 93929 - RNA, 19 nt, Homo sapiens
aaucagcagucuaguucuu

SEQ ID NO: 93930 - RNA, 19 nt, Homo sapiens
gaaaauaugcagcuaucuu

SEQ ID NO: 93931 - RNA, 19 nt, Homo sapiens
gagaaaggagcgccaugga

SEQ ID NO: 93932 - RNA, 19 nt, Homo sapiens
acaaucagcagucuaguuc

SEQ ID NO: 93933 - RNA, 19 nt, Homo sapiens
aaggauauacugcagcuuu

SEQ ID NO: 93934 - RNA, 19 nt, Homo sapiens
uuuauggcuuugugagaua

SEQ ID NO: 93935 - RNA, 19 nt, Homo sapiens
gcuguguagcuaaaucaua

SEQ ID NO: 93936 - RNA, 19 nt, Homo sapiens
guuuaguguuuauggcuuu

SEQ ID NO: 93937 - RNA, 19 nt, Homo sapiens
aaaagaacgucaccucaga

SEQ ID NO: 93938 - RNA, 19 nt, Homo sapiens
gaacucauaagacgaagcu

SEQ ID NO: 93939 - RNA, 19 nt, Homo sapiens
ccauuccgcuccugaugug

SEQ ID NO: 93940 - RNA, 19 nt, Homo sapiens
guuuauggcuuugugagau

SEQ ID NO: 93941 - RNA, 19 nt, Homo sapiens
gugcaggauugcccagaau

SEQ ID NO: 93942 - RNA, 19 nt, Homo sapiens
gguccaagaagacgauguu

SEQ ID NO: 93943 - RNA, 19 nt, Homo sapiens
gccacugcaguacuuguua

SEQ ID NO: 93944 - RNA, 19 nt, Homo sapiens
gcgugccacugcaguacuu

SEQ ID NO: 93945 - RNA, 19 nt, Homo sapiens
acucauaagacgaagcuaa

SEQ ID NO: 93946 - RNA, 19 nt, Homo sapiens
uuacugccuuccuccuuau

SEQ ID NO: 93947 - RNA, 19 nt, Homo sapiens
gccauggauuacuacagaa

SEQ ID NO: 93948 - RNA, 19 nt, Homo sapiens
ccacuugcuguguagcuaa

SEQ ID NO: 93949 - RNA, 19 nt, Homo sapiens
agaaugcacgcuacaggaa

SEQ ID NO: 93950 - RNA, 19 nt, Homo sapiens
cuaucuuucuggucacauu

SEQ ID NO: 93951 - RNA, 19 nt, Homo sapiens
cuuguuccacugcaaauaa

SEQ ID NO: 93952 - RNA, 19 nt, Homo sapiens
cagaaaauaugcagcuauc

SEQ ID NO: 93953 - RNA, 19 nt, Homo sapiens
cuugaugacugcugauuuu

SEQ ID NO: 93954 - RNA, 19 nt, Homo sapiens
auaacagggucacaguaau

SEQ ID NO: 93955 - RNA, 19 nt, Homo sapiens
uaagcuuguuccacugcaa

SEQ ID NO: 93956 - RNA, 19 nt, Homo sapiens
ccauggauuacuacagaaa

SEQ ID NO: 93957 - RNA, 19 nt, Homo sapiens
ccacuccacuaagguccaa

SEQ ID NO: 93958 - RNA, 19 nt, Homo sapiens
ggucacauugucgguguuu

SEQ ID NO: 93959 - RNA, 19 nt, Homo sapiens
ugcaguacuuguuauuauc

SEQ ID NO: 93960 - RNA, 19 nt, Homo sapiens
cucauaagacgaagcuaaa

SEQ ID NO: 93961 - RNA, 19 nt, Homo sapiens
aauacagcauuaagcuugu

SEQ ID NO: 93962 - RNA, 19 nt, Homo sapiens
ugaauacagcauuaagcuu

SEQ ID NO: 93963 - RNA, 19 nt, Homo sapiens
ccugaacacauccugcaaa

SEQ ID NO: 93964 - RNA, 19 nt, Homo sapiens
uuccuuaccauaccacuuu

SEQ ID NO: 93965 - RNA, 19 nt, Homo sapiens
cauauaacagggucacagu

SEQ ID NO: 93966 - RNA, 19 nt, Homo sapiens
gggcugcugcuucucuaga

SEQ ID NO: 93967 - RNA, 19 nt, Homo sapiens
cacuugcuguguagcuaaa

SEQ ID NO: 93968 - RNA, 19 nt, Homo sapiens
uacaaucagcagucuaguu

SEQ ID NO: 93969 - RNA, 19 nt, Homo sapiens
ugugcaggauugcccagaa

SEQ ID NO: 93970 - RNA, 19 nt, Homo sapiens
gcucucagcugucaaugug

SEQ ID NO: 93971 - RNA, 19 nt, Homo sapiens
ggacuccucuuccucaaag

SEQ ID NO: 93972 - RNA, 19 nt, Homo sapiens
ggacaugggcauccaagga

SEQ ID NO: 93973 - RNA, 19 nt, Homo sapiens
caauaaaggcuucucaauc

SEQ ID NO: 93974 - RNA, 19 nt, Homo sapiens
caccaaggauggagauguu

SEQ ID NO: 93975 - RNA, 19 nt, Homo sapiens
aauaaaggcuucucaaucc

SEQ ID NO: 93976 - RNA, 19 nt, Homo sapiens
gcaccaaggauggagaugu

SEQ ID NO: 93977 - RNA, 19 nt, Homo sapiens
acaauaaaggcuucucaau

SEQ ID NO: 93978 - RNA, 19 nt, Homo sapiens
cgagguauaaagccaggua

SEQ ID NO: 93979 - RNA, 19 nt, Homo sapiens
ccacaaccccgagguauaa

SEQ ID NO: 93980 - RNA, 19 nt, Homo sapiens
ccacaauaaaggcuucuca

SEQ ID NO: 93981 - RNA, 19 nt, Homo sapiens
ccgauccucccacaauaaa

SEQ ID NO: 93982 - RNA, 19 nt, Homo sapiens
gauccucccacaauaaagg

SEQ ID NO: 93983 - RNA, 19 nt, Homo sapiens
ccuccagccucgacuaguc

SEQ ID NO: 93984 - RNA, 19 nt, Homo sapiens
cgucaacaccaccaucugu

SEQ ID NO: 93985 - RNA, 19 nt, Homo sapiens
cacaauaaaggcuucucaa

SEQ ID NO: 93986 - RNA, 19 nt, Homo sapiens
gaaaggaucugaauaaagg

SEQ ID NO: 93987 - RNA, 19 nt, Homo sapiens
ggacaaaggccucucauca

SEQ ID NO: 93988 - RNA, 19 nt, Homo sapiens
gacagcagcuuccaucuau

SEQ ID NO: 93989 - RNA, 19 nt, Homo sapiens
agucagaucuugugaauga

SEQ ID NO: 93990 - RNA, 19 nt, Homo sapiens
gcucacagccucacuucua

SEQ ID NO: 93991 - RNA, 19 nt, Homo sapiens
ggacagcagcuuccaucua

SEQ ID NO: 93992 - RNA, 19 nt, Homo sapiens
aaagucagaucuugugaau

SEQ ID NO: 93993 - RNA, 19 nt, Homo sapiens
gagacaauauacaccaaug

SEQ ID NO: 93994 - RNA, 19 nt, Homo sapiens
cugccaagcucacuauuga

SEQ ID NO: 93995 - RNA, 19 nt, Homo sapiens
ggaaaggaucugaauaaag

SEQ ID NO: 93996 - RNA, 19 nt, Homo sapiens
gauggcaacagucuaauug

SEQ ID NO: 93997 - RNA, 19 nt, Homo sapiens
gagagacaauauacaccaa

SEQ ID NO: 93998 - RNA, 19 nt, Homo sapiens
cagcuuccaucuaugagaa

SEQ ID NO: 93999 - RNA, 19 nt, Homo sapiens
uggaaaggaucugaauaaa

SEQ ID NO: 94000 - RNA, 19 nt, Homo sapiens
gcauacagcggucgagaga

SEQ ID NO: 94001 - RNA, 19 nt, Homo sapiens
cagccucacuucuaaacuu

SEQ ID NO: 94002 - RNA, 19 nt, Homo sapiens
gucauaaagucagaucuug

SEQ ID NO: 94003 - RNA, 19 nt, Homo sapiens
aauaggaacucaacaagcu

SEQ ID NO: 94004 - RNA, 19 nt, Homo sapiens
cuaauugugggauauguaa

SEQ ID NO: 94005 - RNA, 19 nt, Homo sapiens
uuggaaaggaucugaauaa

SEQ ID NO: 94006 - RNA, 19 nt, Homo sapiens
cagcagcuuccaucuauga

SEQ ID NO: 94007 - RNA, 19 nt, Homo sapiens
ugugggauauguaauagga

SEQ ID NO: 94008 - RNA, 19 nt, Homo sapiens
ggcuacagcugguacaaag

SEQ ID NO: 94009 - RNA, 19 nt, Homo sapiens
ggauggcaacagucuaauu

SEQ ID NO: 94010 - RNA, 19 nt, Homo sapiens
cagagaaccagcuauaagu

SEQ ID NO: 94011 - RNA, 19 nt, Homo sapiens
auacagcggucgagagaca

SEQ ID NO: 94012 - RNA, 19 nt, Homo sapiens
guggauggcaacagucuaa

SEQ ID NO: 94013 - RNA, 19 nt, Homo sapiens
ccagagaaccagcuauaag

SEQ ID NO: 94014 - RNA, 19 nt, Homo sapiens
cagaaugucacccagaaug

SEQ ID NO: 94015 - RNA, 19 nt, Homo sapiens
guaauaggaacucaacaag

SEQ ID NO: 94016 - RNA, 19 nt, Homo sapiens
ggaggugcuucuacuuguc

SEQ ID NO: 94017 - RNA, 19 nt, Homo sapiens
cauaaagucagaucuugug

SEQ ID NO: 94018 - RNA, 19 nt, Homo sapiens
acaguuccauguauaccaa

SEQ ID NO: 94019 - RNA, 19 nt, Homo sapiens
uggcaacagucuaauugug

SEQ ID NO: 94020 - RNA, 19 nt, Homo sapiens
gcuauaaguccugagaaga

SEQ ID NO: 94021 - RNA, 19 nt, Homo sapiens
gccaagcucacuauugaau

SEQ ID NO: 94022 - RNA, 19 nt, Homo sapiens
gauauguaauaggaacuca

SEQ ID NO: 94023 - RNA, 19 nt, Homo sapiens
cucacagccucacuucuaa

SEQ ID NO: 94024 - RNA, 19 nt, Homo sapiens
uaaagucagaucuugugaa

SEQ ID NO: 94025 - RNA, 19 nt, Homo sapiens
uccagaaugucacccagaa

SEQ ID NO: 94026 - RNA, 19 nt, Homo sapiens
caucccugcugauccagaa

SEQ ID NO: 94027 - RNA, 19 nt, Homo sapiens
aagaguggauggcaacagu

SEQ ID NO: 94028 - RNA, 19 nt, Homo sapiens
gacaauauacaccaaugca

SEQ ID NO: 94029 - RNA, 19 nt, Homo sapiens
caagcucacuauugaaucc

SEQ ID NO: 94030 - RNA, 19 nt, Homo sapiens
uauaaguccugagaagaca

SEQ ID NO: 94031 - RNA, 19 nt, Homo sapiens
gccagagaaccagcuauaa

SEQ ID NO: 94032 - RNA, 19 nt, Homo sapiens
acagucuaauugugggaua

SEQ ID NO: 94033 - RNA, 19 nt, Homo sapiens
agaaugucacccagaauga

SEQ ID NO: 94034 - RNA, 19 nt, Homo sapiens
uguaauaggaacucaacaa

SEQ ID NO: 94035 - RNA, 19 nt, Homo sapiens
gggcuugcagggaaaguga

SEQ ID NO: 94036 - RNA, 19 nt, Homo sapiens
ccacugccaagcucacuau

SEQ ID NO: 94037 - RNA, 19 nt, Homo sapiens
cacccagaaugacauagga

SEQ ID NO: 94038 - RNA, 19 nt, Homo sapiens
gacaaaggccucucaucac

SEQ ID NO: 94039 - RNA, 19 nt, Homo sapiens
cuacacccuacaagucaua

SEQ ID NO: 94040 - RNA, 19 nt, Homo sapiens
gcagcuuccaucuaugaga

SEQ ID NO: 94041 - RNA, 19 nt, Homo sapiens
uacaagucauaaagucaga

SEQ ID NO: 94042 - RNA, 19 nt, Homo sapiens
agccagagaaccagcuaua

SEQ ID NO: 94043 - RNA, 19 nt, Homo sapiens
gcucugccuucucgauguc

SEQ ID NO: 94044 - RNA, 19 nt, Homo sapiens
uuccauguauaccaagaaa

SEQ ID NO: 94045 - RNA, 19 nt, Homo sapiens
gcggucgagagacaauaua

SEQ ID NO: 94046 - RNA, 19 nt, Homo sapiens
aggaggugcuucuacuugu

SEQ ID NO: 94047 - RNA, 19 nt, Homo sapiens
ucacagccucacuucuaaa

SEQ ID NO: 94048 - RNA, 19 nt, Homo sapiens
ccagcuauaaguccugaga

SEQ ID NO: 94049 - RNA, 19 nt, Homo sapiens
aaggaggugcuucuacuug

SEQ ID NO: 94050 - RNA, 19 nt, Homo sapiens
gaaagaguggauggcaaca

SEQ ID NO: 94051 - RNA, 19 nt, Homo sapiens
caaauaugcugcuugauua

SEQ ID NO: 94052 - RNA, 19 nt, Homo sapiens
gcucaugccugccucuuua

SEQ ID NO: 94053 - RNA, 19 nt, Homo sapiens
uaacaaauaugcugcuuga

SEQ ID NO: 94054 - RNA, 19 nt, Homo sapiens
gcuaugggaugccagauaa

SEQ ID NO: 94055 - RNA, 19 nt, Homo sapiens
ucauguggcucauucuuua

SEQ ID NO: 94056 - RNA, 19 nt, Homo sapiens
gcagguagaucccagaaca

SEQ ID NO: 94057 - RNA, 19 nt, Homo sapiens
cgucaaaugucaaauauuc

SEQ ID NO: 94058 - RNA, 19 nt, Homo sapiens
guuaaugccuuauguuuag

SEQ ID NO: 94059 - RNA, 19 nt, Homo sapiens
gaaacugcccugacucuug

SEQ ID NO: 94060 - RNA, 19 nt, Homo sapiens
gaucauacuucaaacucuu

SEQ ID NO: 94061 - RNA, 19 nt, Homo sapiens
gaacccugcugauccagaa

SEQ ID NO: 94062 - RNA, 19 nt, Homo sapiens
caugccaacuaucgaauua

SEQ ID NO: 94063 - RNA, 19 nt, Homo sapiens
caacaggacccucguucua

SEQ ID NO: 94064 - RNA, 19 nt, Homo sapiens
aaacugcccugacucuuga

SEQ ID NO: 94065 - RNA, 19 nt, Homo sapiens
aguaggagcuaucacuaua

SEQ ID NO: 94066 - RNA, 19 nt, Homo sapiens
gggaggaguuugugcaguu

SEQ ID NO: 94067 - RNA, 19 nt, Homo sapiens
caacaucccuaauacaacu

SEQ ID NO: 94068 - RNA, 19 nt, Homo sapiens
ggacaacucaauguaaauu

SEQ ID NO: 94069 - RNA, 19 nt, Homo sapiens
guggacaacucaauguaaa

SEQ ID NO: 94070 - RNA, 19 nt, Homo sapiens
ccacuguucuacuguugua

SEQ ID NO: 94071 - RNA, 19 nt, Homo sapiens
gcacacaacggucgagaga

SEQ ID NO: 94072 - RNA, 19 nt, Homo sapiens
acaaauaugcugcuugauu

SEQ ID NO: 94073 - RNA, 19 nt, Homo sapiens
gaaguaaccagacaauucu

SEQ ID NO: 94074 - RNA, 19 nt, Homo sapiens
ggauggcucugauauagca

SEQ ID NO: 94075 - RNA, 19 nt, Homo sapiens
uaaauacaguggguacuau

SEQ ID NO: 94076 - RNA, 19 nt, Homo sapiens
gcucuuaucccacuccauu

SEQ ID NO: 94077 - RNA, 19 nt, Homo sapiens
gaugccagauaacagaauu

SEQ ID NO: 94078 - RNA, 19 nt, Homo sapiens
agacuggacuggauucuuc

SEQ ID NO: 94079 - RNA, 19 nt, Homo sapiens
ugccaacuaucgaauuaua

SEQ ID NO: 94080 - RNA, 19 nt, Homo sapiens
uaggagcuaucacuauauu

SEQ ID NO: 94081 - RNA, 19 nt, Homo sapiens
gguggucccuguuagaguu

SEQ ID NO: 94082 - RNA, 19 nt, Homo sapiens
gaccugcucucuuccugaa

SEQ ID NO: 94083 - RNA, 19 nt, Homo sapiens
gaagaaguaaccagacaau

SEQ ID NO: 94084 - RNA, 19 nt, Homo sapiens
ggugugcuguauucucuaa

SEQ ID NO: 94085 - RNA, 19 nt, Homo sapiens
ccagacaauucuacguauu

SEQ ID NO: 94086 - RNA, 19 nt, Homo sapiens
ggugugauccuccugauug

SEQ ID NO: 94087 - RNA, 19 nt, Homo sapiens
cacaaagaaugacauagga

SEQ ID NO: 94088 - RNA, 19 nt, Homo sapiens
cauaaugagucccagaauc

SEQ ID NO: 94089 - RNA, 19 nt, Homo sapiens
gcacgguggucccuguuag

SEQ ID NO: 94090 - RNA, 19 nt, Homo sapiens
gcaauuugacagaguguug

SEQ ID NO: 94091 - RNA, 19 nt, Homo sapiens
gauaaugcuguaacuagaa

SEQ ID NO: 94092 - RNA, 19 nt, Homo sapiens
acacaacggucgagagaca

SEQ ID NO: 94093 - RNA, 19 nt, Homo sapiens
uaaaugccauauacucaca

SEQ ID NO: 94094 - RNA, 19 nt, Homo sapiens
ucaauccgguggagaacaa

SEQ ID NO: 94095 - RNA, 19 nt, Homo sapiens
gucaaacucucauuuaggu

SEQ ID NO: 94096 - RNA, 19 nt, Homo sapiens
ugccuuauguuuagucaaa

SEQ ID NO: 94097 - RNA, 19 nt, Homo sapiens
ccuguggcaucacuaagua

SEQ ID NO: 94098 - RNA, 19 nt, Homo sapiens
agaaguaaccagacaauuc

SEQ ID NO: 94099 - RNA, 19 nt, Homo sapiens
ccucuagacucaccuguuc

SEQ ID NO: 94100 - RNA, 19 nt, Homo sapiens
gcuaaaugccauauacuca

SEQ ID NO: 94101 - RNA, 19 nt, Homo sapiens
ccaaaaugaugguaacuga

SEQ ID NO: 94102 - RNA, 19 nt, Homo sapiens
gaacagggaggaguuugug

SEQ ID NO: 94103 - RNA, 19 nt, Homo sapiens
ggagguccuucuaguaguc

SEQ ID NO: 94104 - RNA, 19 nt, Homo sapiens
ggaggaguuugugcaguug

SEQ ID NO: 94105 - RNA, 19 nt, Homo sapiens
gcaggcaauuugacagagu

SEQ ID NO: 94106 - RNA, 19 nt, Homo sapiens
agauaaugcuguaacuaga

SEQ ID NO: 94107 - RNA, 19 nt, Homo sapiens
guaagauaaugcuguaacu

SEQ ID NO: 94108 - RNA, 19 nt, Homo sapiens
uagcagccuugguguaguu

SEQ ID NO: 94109 - RNA, 19 nt, Homo sapiens
caaugacgcaggauucuau

SEQ ID NO: 94110 - RNA, 19 nt, Homo sapiens
uuaacaacaucccuaauac

SEQ ID NO: 94111 - RNA, 19 nt, Homo sapiens
guggcuaacuuuaacaaca

SEQ ID NO: 94112 - RNA, 19 nt, Homo sapiens
gguggacaacucaauguaa

SEQ ID NO: 94113 - RNA, 19 nt, Homo sapiens
ggacuggauucuucuagcu

SEQ ID NO: 94114 - RNA, 19 nt, Homo sapiens
aggaggacaucauaaccua

SEQ ID NO: 94115 - RNA, 19 nt, Homo sapiens
gcccaguggcuaacuuuaa

SEQ ID NO: 94116 - RNA, 19 nt, Homo sapiens
ugguguaguuucugcauuu

SEQ ID NO: 94117 - RNA, 19 nt, Homo sapiens
cuacucagcgccacaaaga

SEQ ID NO: 94118 - RNA, 19 nt, Homo sapiens
ccagaacguuacccacaau

SEQ ID NO: 94119 - RNA, 19 nt, Homo sapiens
caucaugauuggaguacug

SEQ ID NO: 94120 - RNA, 19 nt, Homo sapiens
gaauguccgcuaugaguca

SEQ ID NO: 94121 - RNA, 19 nt, Homo sapiens
ccacaaagaaugacauagg

SEQ ID NO: 94122 - RNA, 19 nt, Homo sapiens
caugcuaaaugccauauac

SEQ ID NO: 94123 - RNA, 19 nt, Homo sapiens
gagccagucaugcuaaaug

SEQ ID NO: 94124 - RNA, 19 nt, Homo sapiens
augccugccucuuuaauuu

SEQ ID NO: 94125 - RNA, 19 nt, Homo sapiens
ggagguggacaacucaaug

SEQ ID NO: 94126 - RNA, 19 nt, Homo sapiens
ugggauggcucugauauag

SEQ ID NO: 94127 - RNA, 19 nt, Homo sapiens
gccauauacucacacugaa

SEQ ID NO: 94128 - RNA, 19 nt, Homo sapiens
caccauaacuagagacacu

SEQ ID NO: 94129 - RNA, 19 nt, Homo sapiens
ccacucagagcuaaccaaa

SEQ ID NO: 94130 - RNA, 19 nt, Homo sapiens
ccacaaugacgcaggauuc

SEQ ID NO: 94131 - RNA, 19 nt, Homo sapiens
caguaguguuaaugccuua

SEQ ID NO: 94132 - RNA, 19 nt, Homo sapiens
gcucacagccucgcuuuua

SEQ ID NO: 94133 - RNA, 19 nt, Homo sapiens
ggagcuaucacuauauuuu

SEQ ID NO: 94134 - RNA, 19 nt, Homo sapiens
uagucaaacucucauuuag

SEQ ID NO: 94135 - RNA, 19 nt, Homo sapiens
guguuaaugccuuauguuu

SEQ ID NO: 94136 - RNA, 19 nt, Homo sapiens
uaacaacaucccuaauaca

SEQ ID NO: 94137 - RNA, 19 nt, Homo sapiens
cugcugauccagaacguua

SEQ ID NO: 94138 - RNA, 19 nt, Homo sapiens
gagaguccaggcugucuga

SEQ ID NO: 94139 - RNA, 19 nt, Homo sapiens
ggaucauacuucaaacucu

SEQ ID NO: 94140 - RNA, 19 nt, Homo sapiens
uauagagacucaguugcaa

SEQ ID NO: 94141 - RNA, 19 nt, Homo sapiens
ucaacaccauaacuagaga

SEQ ID NO: 94142 - RNA, 19 nt, Homo sapiens
guagaucccagaacagaca

SEQ ID NO: 94143 - RNA, 19 nt, Homo sapiens
gaacguuacccacaaugac

SEQ ID NO: 94144 - RNA, 19 nt, Homo sapiens
ccaguaggagcuaucacua

SEQ ID NO: 94145 - RNA, 19 nt, Homo sapiens
ggcuacaacugguacaaag

SEQ ID NO: 94146 - RNA, 19 nt, Homo sapiens
gauuaggaggacaucauaa

SEQ ID NO: 94147 - RNA, 19 nt, Homo sapiens
gcccagaccaauauugaug

SEQ ID NO: 94148 - RNA, 19 nt, Homo sapiens
gacagaguguuggaugugu

SEQ ID NO: 94149 - RNA, 19 nt, Homo sapiens
uugguaagauaaugcugua

SEQ ID NO: 94150 - RNA, 19 nt, Homo sapiens
uaacuagagacacucaaau

SEQ ID NO: 94151 - RNA, 19 nt, Homo sapiens
caaacaggcugauaccuuu

SEQ ID NO: 94152 - RNA, 19 nt, Homo sapiens
gugagaaucugcugucuuu

SEQ ID NO: 94153 - RNA, 19 nt, Homo sapiens
ccacagaacugggcaacua

SEQ ID NO: 94154 - RNA, 19 nt, Homo sapiens
gcaaucagcuaccauucaa

SEQ ID NO: 94155 - RNA, 19 nt, Homo sapiens
gggcaacuauucaugagua

SEQ ID NO: 94156 - RNA, 19 nt, Homo sapiens
gacaguaacagcaucuuua

SEQ ID NO: 94157 - RNA, 19 nt, Homo sapiens
ccacuggacugucuaugaa

SEQ ID NO: 94158 - RNA, 19 nt, Homo sapiens
cacagucucugaugcuuua

SEQ ID NO: 94159 - RNA, 19 nt, Homo sapiens
agaaucugcugucuuuaua

SEQ ID NO: 94160 - RNA, 19 nt, Homo sapiens
gaugccaaccgucgaauua

SEQ ID NO: 94161 - RNA, 19 nt, Homo sapiens
ggguggcucugauauagua

SEQ ID NO: 94162 - RNA, 19 nt, Homo sapiens
gcaaacaggcugauaccuu

SEQ ID NO: 94163 - RNA, 19 nt, Homo sapiens
caacaucacuacaaagaac

SEQ ID NO: 94164 - RNA, 19 nt, Homo sapiens
gagaaucugcugucuuuau

SEQ ID NO: 94165 - RNA, 19 nt, Homo sapiens
caacaggacccucacucua

SEQ ID NO: 94166 - RNA, 19 nt, Homo sapiens
ucaguuauuugcacaaguu

SEQ ID NO: 94167 - RNA, 19 nt, Homo sapiens
cgaguacucuugaacacaa

SEQ ID NO: 94168 - RNA, 19 nt, Homo sapiens
uauaguagcucugguguag

SEQ ID NO: 94169 - RNA, 19 nt, Homo sapiens
gcaaucgagagacaauaua

SEQ ID NO: 94170 - RNA, 19 nt, Homo sapiens
cugcucagcucacuauuga

SEQ ID NO: 94171 - RNA, 19 nt, Homo sapiens
cguaugagauccuuuaguc

SEQ ID NO: 94172 - RNA, 19 nt, Homo sapiens
gcugauaccuuugugaagu

SEQ ID NO: 94173 - RNA, 19 nt, Homo sapiens
cuacaagucauaaagcuaa

SEQ ID NO: 94174 - RNA, 19 nt, Homo sapiens
gaaaugacacaggauccua

SEQ ID NO: 94175 - RNA, 19 nt, Homo sapiens
gccaauucuuuaaguguuu

SEQ ID NO: 94176 - RNA, 19 nt, Homo sapiens
caaaauugcuucuucuuca

SEQ ID NO: 94177 - RNA, 19 nt, Homo sapiens
caacuauucaugaguauuc

SEQ ID NO: 94178 - RNA, 19 nt, Homo sapiens
uaacggagugucuaaucua

SEQ ID NO: 94179 - RNA, 19 nt, Homo sapiens
uaguagcucugguguaguu

SEQ ID NO: 94180 - RNA, 19 nt, Homo sapiens
ugccaaccgucgaauuaua

SEQ ID NO: 94181 - RNA, 19 nt, Homo sapiens
aauguacuauggucucuuu

SEQ ID NO: 94182 - RNA, 19 nt, Homo sapiens
ugucuaaucuaucguguca

SEQ ID NO: 94183 - RNA, 19 nt, Homo sapiens
uuacguaugagauccuuua

SEQ ID NO: 94184 - RNA, 19 nt, Homo sapiens
gaacugggcaacuauucau

SEQ ID NO: 94185 - RNA, 19 nt, Homo sapiens
cacaaggaaugacguagga

SEQ ID NO: 94186 - RNA, 19 nt, Homo sapiens
gaaucugcugucuuuauaa

SEQ ID NO: 94187 - RNA, 19 nt, Homo sapiens
cuaccugacugccacagaa

SEQ ID NO: 94188 - RNA, 19 nt, Homo sapiens
caggguggcucugauauag

SEQ ID NO: 94189 - RNA, 19 nt, Homo sapiens
gcauacagcaaucgagaga

SEQ ID NO: 94190 - RNA, 19 nt, Homo sapiens
gagaaaauacagagaauga

SEQ ID NO: 94191 - RNA, 19 nt, Homo sapiens
ccaaaguucugggauuaca

SEQ ID NO: 94192 - RNA, 19 nt, Homo sapiens
agcuaaaucuuaugaguga

SEQ ID NO: 94193 - RNA, 19 nt, Homo sapiens
ugguguaguuucugcauuu

SEQ ID NO: 94194 - RNA, 19 nt, Homo sapiens
gggauguuauauuugagaa

SEQ ID NO: 94195 - RNA, 19 nt, Homo sapiens
ucaaucuccugacuucaug

SEQ ID NO: 94196 - RNA, 19 nt, Homo sapiens
ucuaugaacuugcaaacag

SEQ ID NO: 94197 - RNA, 19 nt, Homo sapiens
caucaugauuggaguacug

SEQ ID NO: 94198 - RNA, 19 nt, Homo sapiens
acaguaacagcaucuuuaa

SEQ ID NO: 94199 - RNA, 19 nt, Homo sapiens
gcacaaguucagugagaau

SEQ ID NO: 94200 - RNA, 19 nt, Homo sapiens
uaaaauugcucccuauugg

SEQ ID NO: 94201 - RNA, 19 nt, Homo sapiens
ccacugcucagcucacuau

SEQ ID NO: 94202 - RNA, 19 nt, Homo sapiens
ccaggguggcucugauaua

SEQ ID NO: 94203 - RNA, 19 nt, Homo sapiens
gacccucacucuacucagu

SEQ ID NO: 94204 - RNA, 19 nt, Homo sapiens
gaagcugugccauccaaug

SEQ ID NO: 94205 - RNA, 19 nt, Homo sapiens
uaacagcaucuuuaacaca

SEQ ID NO: 94206 - RNA, 19 nt, Homo sapiens
cuaauccacccucacagua

SEQ ID NO: 94207 - RNA, 19 nt, Homo sapiens
caugcaaugcuagauaaua

SEQ ID NO: 94208 - RNA, 19 nt, Homo sapiens
aacagcaucuuuaacacaa

SEQ ID NO: 94209 - RNA, 19 nt, Homo sapiens
caaagaacagcggauccua

SEQ ID NO: 94210 - RNA, 19 nt, Homo sapiens
aauccacccucacaguauu

SEQ ID NO: 94211 - RNA, 19 nt, Homo sapiens
ugacaguaacagcaucuuu

SEQ ID NO: 94212 - RNA, 19 nt, Homo sapiens
cagcuaccauucaaaauug

SEQ ID NO: 94213 - RNA, 19 nt, Homo sapiens
agucucugaugcuuuagua

SEQ ID NO: 94214 - RNA, 19 nt, Homo sapiens
auacagcaaucgagagaca

SEQ ID NO: 94215 - RNA, 19 nt, Homo sapiens
ggcuacaacugguacaaag

SEQ ID NO: 94216 - RNA, 19 nt, Homo sapiens
gccacuggacugucuauga

SEQ ID NO: 94217 - RNA, 19 nt, Homo sapiens
gcucagcucacuauugaag

SEQ ID NO: 94218 - RNA, 19 nt, Homo sapiens
guggguaaauggucagagu

SEQ ID NO: 94219 - RNA, 19 nt, Homo sapiens
caaauguacuauggucucu

SEQ ID NO: 94220 - RNA, 19 nt, Homo sapiens
ggaccacagucaggaugau

SEQ ID NO: 94221 - RNA, 19 nt, Homo sapiens
gcaacaggacccucacucu

SEQ ID NO: 94222 - RNA, 19 nt, Homo sapiens
ggcugcagcuguccaaugg

SEQ ID NO: 94223 - RNA, 19 nt, Homo sapiens
guaacagcaucuuuaacac

SEQ ID NO: 94224 - RNA, 19 nt, Homo sapiens
aguaacagcaucuuuaaca

SEQ ID NO: 94225 - RNA, 19 nt, Homo sapiens
uugcacaaguucagugaga

SEQ ID NO: 94226 - RNA, 19 nt, Homo sapiens
ggcacgaucucaacucacu

SEQ ID NO: 94227 - RNA, 19 nt, Homo sapiens
ucacgccacuggacugucu

SEQ ID NO: 94228 - RNA, 19 nt, Homo sapiens
uguaguuucugcauuucaa

SEQ ID NO: 94229 - RNA, 19 nt, Homo sapiens
aaagaacagcggauccuau

SEQ ID NO: 94230 - RNA, 19 nt, Homo sapiens
gauccuacacccuacaagu

SEQ ID NO: 94231 - RNA, 19 nt, Homo sapiens
caaguucagugagaaucug

SEQ ID NO: 94232 - RNA, 19 nt, Homo sapiens
agacucagaacacaaccua

SEQ ID NO: 94233 - RNA, 19 nt, Homo sapiens
ugccaauucuuuaaguguu

SEQ ID NO: 94234 - RNA, 19 nt, Homo sapiens
ccaaaacacagaaggaaaa

SEQ ID NO: 94235 - RNA, 19 nt, Homo sapiens
cugauaccuuugugaaguu

SEQ ID NO: 94236 - RNA, 19 nt, Homo sapiens
ggaacgucaccagaaauga

SEQ ID NO: 94237 - RNA, 19 nt, Homo sapiens
guacuauggucucuuuuag

SEQ ID NO: 94238 - RNA, 19 nt, Homo sapiens
cccaauggcugacaguaac

SEQ ID NO: 94239 - RNA, 19 nt, Homo sapiens
ggcuuugauugggauguua

SEQ ID NO: 94240 - RNA, 19 nt, Homo sapiens
ggcaacuauucaugaguau

SEQ ID NO: 94241 - RNA, 19 nt, Homo sapiens
guggcacgaucucaacuca

SEQ ID NO: 94242 - RNA, 19 nt, Homo sapiens
cccaacaucacuacaaaga

SEQ ID NO: 94243 - RNA, 19 nt, Homo sapiens
agacaccuauuaccaugca

SEQ ID NO: 94244 - RNA, 19 nt, Homo sapiens
cacccugaauguccucuau

SEQ ID NO: 94245 - RNA, 19 nt, Homo sapiens
gaacccagcgagugcaaac

SEQ ID NO: 94246 - RNA, 19 nt, Homo sapiens
cuaugaaugugaaauacag

SEQ ID NO: 94247 - RNA, 19 nt, Homo sapiens
cuccuagacucacuuguuc

SEQ ID NO: 94248 - RNA, 19 nt, Homo sapiens
ucuaaucuaucgugucaac

SEQ ID NO: 94249 - RNA, 19 nt, Homo sapiens
uuaacggagugucuaaucu

SEQ ID NO: 94250 - RNA, 19 nt, Homo sapiens
ggagguucuucuacuuguc

SEQ ID NO: 94251 - RNA, 19 nt, Homo sapiens
gaaaggaucugaauaaaga

SEQ ID NO: 94252 - RNA, 19 nt, Homo sapiens
uaacagacauucaagcaaa

SEQ ID NO: 94253 - RNA, 19 nt, Homo sapiens
aagcagauguggucucuua

SEQ ID NO: 94254 - RNA, 19 nt, Homo sapiens
cuacuggccugcaauauuu

SEQ ID NO: 94255 - RNA, 19 nt, Homo sapiens
gggaaaggauguucuucua

SEQ ID NO: 94256 - RNA, 19 nt, Homo sapiens
ggacaaaggccucucauca

SEQ ID NO: 94257 - RNA, 19 nt, Homo sapiens
ucucauugcugguuauaua

SEQ ID NO: 94258 - RNA, 19 nt, Homo sapiens
gaaaggauguucuucuacu

SEQ ID NO: 94259 - RNA, 19 nt, Homo sapiens
gaacagccacucccaucua

SEQ ID NO: 94260 - RNA, 19 nt, Homo sapiens
gaucacagccucacuuuua

SEQ ID NO: 94261 - RNA, 19 nt, Homo sapiens
caggaaaggaucugaauaa

SEQ ID NO: 94262 - RNA, 19 nt, Homo sapiens
gaauuucuauacucugaug

SEQ ID NO: 94263 - RNA, 19 nt, Homo sapiens
gaaccauaaaugccaguua

SEQ ID NO: 94264 - RNA, 19 nt, Homo sapiens
ggaaaggaucugaauaaag

SEQ ID NO: 94265 - RNA, 19 nt, Homo sapiens
caaagcagauguggucucu

SEQ ID NO: 94266 - RNA, 19 nt, Homo sapiens
uggaauuucuauacucuga

SEQ ID NO: 94267 - RNA, 19 nt, Homo sapiens
aggaaaggaucugaauaaa

SEQ ID NO: 94268 - RNA, 19 nt, Homo sapiens
cacgggaacuuagcagaaa

SEQ ID NO: 94269 - RNA, 19 nt, Homo sapiens
ccaggaaaggaucugaaua

SEQ ID NO: 94270 - RNA, 19 nt, Homo sapiens
uuacgacucugaccaagca

SEQ ID NO: 94271 - RNA, 19 nt, Homo sapiens
ucccaucuauguggaauuu

SEQ ID NO: 94272 - RNA, 19 nt, Homo sapiens
cacagcagcucugacaaga

SEQ ID NO: 94273 - RNA, 19 nt, Homo sapiens
acucugaugcaaacauuua

SEQ ID NO: 94274 - RNA, 19 nt, Homo sapiens
ggccugcaauauuucagaa

SEQ ID NO: 94275 - RNA, 19 nt, Homo sapiens
cauggucccucucacagau

SEQ ID NO: 94276 - RNA, 19 nt, Homo sapiens
gcccucucauugcugguua

SEQ ID NO: 94277 - RNA, 19 nt, Homo sapiens
ggaaaggauguucuucuac

SEQ ID NO: 94278 - RNA, 19 nt, Homo sapiens
ccagaucgaccacaaagca

SEQ ID NO: 94279 - RNA, 19 nt, Homo sapiens
gaaacuauucaagccuauu

SEQ ID NO: 94280 - RNA, 19 nt, Homo sapiens
auacucugaugcaaacauu

SEQ ID NO: 94281 - RNA, 19 nt, Homo sapiens
cagauguggucucuuaggu

SEQ ID NO: 94282 - RNA, 19 nt, Homo sapiens
ucacgggaacuuagcagaa

SEQ ID NO: 94283 - RNA, 19 nt, Homo sapiens
ucuauacucugaugcaaac

SEQ ID NO: 94284 - RNA, 19 nt, Homo sapiens
ccaucuauguggaauuucu

SEQ ID NO: 94285 - RNA, 19 nt, Homo sapiens
caauggaucccugcuguuc

SEQ ID NO: 94286 - RNA, 19 nt, Homo sapiens
auacaguggucgagagcaa

SEQ ID NO: 94287 - RNA, 19 nt, Homo sapiens
gggcuugcaaggaaaguga

SEQ ID NO: 94288 - RNA, 19 nt, Homo sapiens
aaccauaaaugccaguuac

SEQ ID NO: 94289 - RNA, 19 nt, Homo sapiens
cuauucaagccuauuauug

SEQ ID NO: 94290 - RNA, 19 nt, Homo sapiens
ucuacuggccugcaauauu

SEQ ID NO: 94291 - RNA, 19 nt, Homo sapiens
aaaggauguucuucuacug

SEQ ID NO: 94292 - RNA, 19 nt, Homo sapiens
ucucacagauccaccuucu

SEQ ID NO: 94293 - RNA, 19 nt, Homo sapiens
gagcaaguauaccccaaug

SEQ ID NO: 94294 - RNA, 19 nt, Homo sapiens
cagccacucccaucuaugu

SEQ ID NO: 94295 - RNA, 19 nt, Homo sapiens
uauaacagacauucaagca

SEQ ID NO: 94296 - RNA, 19 nt, Homo sapiens
aaacauuuacugccagauc

SEQ ID NO: 94297 - RNA, 19 nt, Homo sapiens
aacagccacucccaucuau

SEQ ID NO: 94298 - RNA, 19 nt, Homo sapiens
gacaaaggccucucaucac

SEQ ID NO: 94299 - RNA, 19 nt, Homo sapiens
gaucccugcuguuccaaaa

SEQ ID NO: 94300 - RNA, 19 nt, Homo sapiens
gcaaguauaccccaaugga

SEQ ID NO: 94301 - RNA, 19 nt, Homo sapiens
agaaacuauucaagccuau

SEQ ID NO: 94302 - RNA, 19 nt, Homo sapiens
gcagagggaaaggauguuc

SEQ ID NO: 94303 - RNA, 19 nt, Homo sapiens
ucacagcagcucugacaag

SEQ ID NO: 94304 - RNA, 19 nt, Homo sapiens
gcagauguggucucuuagg

SEQ ID NO: 94305 - RNA, 19 nt, Homo sapiens
acagacauucaagcaaaua

SEQ ID NO: 94306 - RNA, 19 nt, Homo sapiens
ggaacuuagcagaaacuca

SEQ ID NO: 94307 - RNA, 19 nt, Homo sapiens
gaucgaccacaaagcagau

SEQ ID NO: 94308 - RNA, 19 nt, Homo sapiens
uguggaauuucuauacucu

SEQ ID NO: 94309 - RNA, 19 nt, Homo sapiens
uauucaagccuauuauugg

SEQ ID NO: 94310 - RNA, 19 nt, Homo sapiens
ccauaaaugccaguuacga

SEQ ID NO: 94311 - RNA, 19 nt, Homo sapiens
ucaagcaacuuaucuacuu

SEQ ID NO: 94312 - RNA, 19 nt, Homo sapiens
ggucagggccaccguauaa

SEQ ID NO: 94313 - RNA, 19 nt, Homo sapiens
uggagaaccucgccaaauu

SEQ ID NO: 94314 - RNA, 19 nt, Homo sapiens
gcaauuucuuccugagauu

SEQ ID NO: 94315 - RNA, 19 nt, Homo sapiens
gaucauccuuccucuguuc

SEQ ID NO: 94316 - RNA, 19 nt, Homo sapiens
acaccaaccuggagaaguu

SEQ ID NO: 94317 - RNA, 19 nt, Homo sapiens
gcugaaacacguccauuug

SEQ ID NO: 94318 - RNA, 19 nt, Homo sapiens
ugaaccagcuacccucgaa

SEQ ID NO: 94319 - RNA, 19 nt, Homo sapiens
ggagaaccucgccaaauuc

SEQ ID NO: 94320 - RNA, 19 nt, Homo sapiens
acuuguaccugucccauaa

SEQ ID NO: 94321 - RNA, 19 nt, Homo sapiens
ugccgaaccucgugucauu

SEQ ID NO: 94322 - RNA, 19 nt, Homo sapiens
gugcuuugcuguccaucuu

SEQ ID NO: 94323 - RNA, 19 nt, Homo sapiens
ccaccaagagguccaagaa

SEQ ID NO: 94324 - RNA, 19 nt, Homo sapiens
ggucaaccucuucaucuug

SEQ ID NO: 94325 - RNA, 19 nt, Homo sapiens
uggaaacaaucaucagauc

SEQ ID NO: 94326 - RNA, 19 nt, Homo sapiens
ugaccgagcugaccuaccu

SEQ ID NO: 94327 - RNA, 19 nt, Homo sapiens
ucuugcagcucaacaacaa

SEQ ID NO: 94328 - RNA, 19 nt, Homo sapiens
ccaagcugcucaaccuaca

SEQ ID NO: 94329 - RNA, 19 nt, Homo sapiens
aaacaaucaucagauccuu

SEQ ID NO: 94330 - RNA, 19 nt, Homo sapiens
gaaacaaucaucagauccu

SEQ ID NO: 94331 - RNA, 19 nt, Homo sapiens
agaccaagcugcucaaccu

SEQ ID NO: 94332 - RNA, 19 nt, Homo sapiens
accaagagguccaagaaag

SEQ ID NO: 94333 - RNA, 19 nt, Homo sapiens
ggagaacaaccgcuugaac

SEQ ID NO: 94334 - RNA, 19 nt, Homo sapiens
gcaggucaucggugcuuug

SEQ ID NO: 94335 - RNA, 19 nt, Homo sapiens
cggagagacuacugaccuu

SEQ ID NO: 94336 - RNA, 19 nt, Homo sapiens
cccucgcccuuaccaauaa

SEQ ID NO: 94337 - RNA, 19 nt, Homo sapiens
gcucaacaacaacaagauc

SEQ ID NO: 94338 - RNA, 19 nt, Homo sapiens
acaaugccuuccaguccuu

SEQ ID NO: 94339 - RNA, 19 nt, Homo sapiens
gcacgucaucugcgacaag

SEQ ID NO: 94340 - RNA, 19 nt, Homo sapiens
caauuucuuccugagauuu

SEQ ID NO: 94341 - RNA, 19 nt, Homo sapiens
ugccucaccugccaaguuc

SEQ ID NO: 94342 - RNA, 19 nt, Homo sapiens
gacccucgcccuuaccaau

SEQ ID NO: 94343 - RNA, 19 nt, Homo sapiens
acagagcugccuacaccua

SEQ ID NO: 94344 - RNA, 19 nt, Homo sapiens
cagggccaccguauaaaga

SEQ ID NO: 94345 - RNA, 19 nt, Homo sapiens
ugcaauuucuuccugagau

SEQ ID NO: 94346 - RNA, 19 nt, Homo sapiens
caccaagagguccaagaaa

SEQ ID NO: 94347 - RNA, 19 nt, Homo sapiens
gugccucaccugccaaguu

SEQ ID NO: 94348 - RNA, 19 nt, Homo sapiens
gaccaagcugcucaaccua

SEQ ID NO: 94349 - RNA, 19 nt, Homo sapiens
cuggagacccucgcccuua

SEQ ID NO: 94350 - RNA, 19 nt, Homo sapiens
gagagacuacugaccuucu

SEQ ID NO: 94351 - RNA, 19 nt, Homo sapiens
guggagaaccucgccaaau

SEQ ID NO: 94352 - RNA, 19 nt, Homo sapiens
cagcucaacaacaacaaga

SEQ ID NO: 94353 - RNA, 19 nt, Homo sapiens
acagguuggucaucaggau

SEQ ID NO: 94354 - RNA, 19 nt, Homo sapiens
gccauuaaacagguucuga

SEQ ID NO: 94355 - RNA, 19 nt, Homo sapiens
ugaaaagcaucccggacaa

SEQ ID NO: 94356 - RNA, 19 nt, Homo sapiens
cccaaggugucagagaaga

SEQ ID NO: 94357 - RNA, 19 nt, Homo sapiens
guggaaacaaucaucagau

SEQ ID NO: 94358 - RNA, 19 nt, Homo sapiens
ccacguggaaacaaucauc

SEQ ID NO: 94359 - RNA, 19 nt, Homo sapiens
uccuuccucuguucucuuu

SEQ ID NO: 94360 - RNA, 19 nt, Homo sapiens
ccaccggagagacuacuga

SEQ ID NO: 94361 - RNA, 19 nt, Homo sapiens
ccagcuacccucgaacuuc

SEQ ID NO: 94362 - RNA, 19 nt, Homo sapiens
agcaacuuaucuacuugua

SEQ ID NO: 94363 - RNA, 19 nt, Homo sapiens
gaagacaacuuuacaagga

SEQ ID NO: 94364 - RNA, 19 nt, Homo sapiens
gagaacagcuuuagucaug

SEQ ID NO: 94365 - RNA, 19 nt, Homo sapiens
gcacacacauuaguauuaa

SEQ ID NO: 94366 - RNA, 19 nt, Homo sapiens
uaacgaggaugauauugua

SEQ ID NO: 94367 - RNA, 19 nt, Homo sapiens
ggaacaggauuaaagauga

SEQ ID NO: 94368 - RNA, 19 nt, Homo sapiens
gagaaggaacugauacuua

SEQ ID NO: 94369 - RNA, 19 nt, Homo sapiens
gaacugauacuuacauuuc

SEQ ID NO: 94370 - RNA, 19 nt, Homo sapiens
cuacuaaucugucaaacaa

SEQ ID NO: 94371 - RNA, 19 nt, Homo sapiens
ggacuugccucuguaaaug

SEQ ID NO: 94372 - RNA, 19 nt, Homo sapiens
uaaaguaguugugaccaua

SEQ ID NO: 94373 - RNA, 19 nt, Homo sapiens
gaucagaugugacuaaggu

SEQ ID NO: 94374 - RNA, 19 nt, Homo sapiens
gaagauaacgaggaugaua

SEQ ID NO: 94375 - RNA, 19 nt, Homo sapiens
gaacauagucucagauucu

SEQ ID NO: 94376 - RNA, 19 nt, Homo sapiens
gaccugaaguuucuaguug

SEQ ID NO: 94377 - RNA, 19 nt, Homo sapiens
gagacuggauucuuuaaau

SEQ ID NO: 94378 - RNA, 19 nt, Homo sapiens
gaagaacuuuaucagcaaa

SEQ ID NO: 94379 - RNA, 19 nt, Homo sapiens
ggacaggauuaucgagauu

SEQ ID NO: 94380 - RNA, 19 nt, Homo sapiens
ccacauagauagcuugaca

SEQ ID NO: 94381 - RNA, 19 nt, Homo sapiens
ugucauaucucuacuaauc

SEQ ID NO: 94382 - RNA, 19 nt, Homo sapiens
aaacugaaauggaacauag

SEQ ID NO: 94383 - RNA, 19 nt, Homo sapiens
gaacagcuuuagucaugga

SEQ ID NO: 94384 - RNA, 19 nt, Homo sapiens
aagagaaacugaaauggaa

SEQ ID NO: 94385 - RNA, 19 nt, Homo sapiens
ggagugcugucuguccuua

SEQ ID NO: 94386 - RNA, 19 nt, Homo sapiens
gcacauaaaguccuucuca

SEQ ID NO: 94387 - RNA, 19 nt, Homo sapiens
ggacaacuaaucaugguuu

SEQ ID NO: 94388 - RNA, 19 nt, Homo sapiens
uaaaguccuucucaagauu

SEQ ID NO: 94389 - RNA, 19 nt, Homo sapiens
gacaacuaaucaugguuua

SEQ ID NO: 94390 - RNA, 19 nt, Homo sapiens
gugggaaaguggccaauuu

SEQ ID NO: 94391 - RNA, 19 nt, Homo sapiens
cagcuuagcaaaucauaua

SEQ ID NO: 94392 - RNA, 19 nt, Homo sapiens
ggacagcauuaacaagaau

SEQ ID NO: 94393 - RNA, 19 nt, Homo sapiens
gaaguaugaugcacaggau

SEQ ID NO: 94394 - RNA, 19 nt, Homo sapiens
gauggaaaguacauuuaug

SEQ ID NO: 94395 - RNA, 19 nt, Homo sapiens
gggcugaucugccuuacau

SEQ ID NO: 94396 - RNA, 19 nt, Homo sapiens
gauuauggaguaugaagua

SEQ ID NO: 94397 - RNA, 19 nt, Homo sapiens
cacaugggauuauggagua

SEQ ID NO: 94398 - RNA, 19 nt, Homo sapiens
gcaaugggacaacuaauca

SEQ ID NO: 94399 - RNA, 19 nt, Homo sapiens
aagcagaguuggagccuuu

SEQ ID NO: 94400 - RNA, 19 nt, Homo sapiens
gcacaggauuuagaagaau

SEQ ID NO: 94401 - RNA, 19 nt, Homo sapiens
uaauaacucugggcaggua

SEQ ID NO: 94402 - RNA, 19 nt, Homo sapiens
ucaugucacucacuauaaa

SEQ ID NO: 94403 - RNA, 19 nt, Homo sapiens
cagcuuuagucauggaaua

SEQ ID NO: 94404 - RNA, 19 nt, Homo sapiens
ccaacaaacuaucaagcaa

SEQ ID NO: 94405 - RNA, 19 nt, Homo sapiens
uggaauaccuauacacaga

SEQ ID NO: 94406 - RNA, 19 nt, Homo sapiens
gaauugauguccgcucuuc

SEQ ID NO: 94407 - RNA, 19 nt, Homo sapiens
gaaggaauaacuuucacaa

SEQ ID NO: 94408 - RNA, 19 nt, Homo sapiens
ggagaaggaauaacuuuca

SEQ ID NO: 94409 - RNA, 19 nt, Homo sapiens
gaugaaucacuucucuuua

SEQ ID NO: 94410 - RNA, 19 nt, Homo sapiens
gaaauggaacauagucuca

SEQ ID NO: 94411 - RNA, 19 nt, Homo sapiens
ucugagaaauuguggcuaa

SEQ ID NO: 94412 - RNA, 19 nt, Homo sapiens
cggcugcggugaaguauga

SEQ ID NO: 94413 - RNA, 19 nt, Homo sapiens
uaacuuugcucuagaagac

SEQ ID NO: 94414 - RNA, 19 nt, Homo sapiens
gcauaaaccaucugacugu

SEQ ID NO: 94415 - RNA, 19 nt, Homo sapiens
acaaucagcuuagcaaauc

SEQ ID NO: 94416 - RNA, 19 nt, Homo sapiens
gaaacugaaauggaacaua

SEQ ID NO: 94417 - RNA, 19 nt, Homo sapiens
agaaggaacugauacuuac

SEQ ID NO: 94418 - RNA, 19 nt, Homo sapiens
gaucugccuuacauaauca

SEQ ID NO: 94419 - RNA, 19 nt, Homo sapiens
ugaagaacuuuaucagcaa

SEQ ID NO: 94420 - RNA, 19 nt, Homo sapiens
guucgucauuggaagauaa

SEQ ID NO: 94421 - RNA, 19 nt, Homo sapiens
cauaaaguccuucucaaga

SEQ ID NO: 94422 - RNA, 19 nt, Homo sapiens
caaacaaacaagucauuga

SEQ ID NO: 94423 - RNA, 19 nt, Homo sapiens
gcuacucugucaucuuuga

SEQ ID NO: 94424 - RNA, 19 nt, Homo sapiens
ggaaacccuuuuggaauua

SEQ ID NO: 94425 - RNA, 19 nt, Homo sapiens
ggaacauagucucagauuc

SEQ ID NO: 94426 - RNA, 19 nt, Homo sapiens
gcugaguacuuguaacugu

SEQ ID NO: 94427 - RNA, 19 nt, Homo sapiens
aggcuacucugucaucuuu

SEQ ID NO: 94428 - RNA, 19 nt, Homo sapiens
gcugaucugccuuacauaa

SEQ ID NO: 94429 - RNA, 19 nt, Homo sapiens
cgacguguuugccugcuuu

SEQ ID NO: 94430 - RNA, 19 nt, Homo sapiens
guugggcacuggcaauaaa

SEQ ID NO: 94431 - RNA, 19 nt, Homo sapiens
gaaguugccugugggucuu

SEQ ID NO: 94432 - RNA, 19 nt, Homo sapiens
gauguuagaugugggaaag

SEQ ID NO: 94433 - RNA, 19 nt, Homo sapiens
caaaaggcccuggcaauua

SEQ ID NO: 94434 - RNA, 19 nt, Homo sapiens
cauaaaccaucugacugua

SEQ ID NO: 94435 - RNA, 19 nt, Homo sapiens
gaacaggauuaaagaugac

SEQ ID NO: 94436 - RNA, 19 nt, Homo sapiens
caaacaagucauugaaguu

SEQ ID NO: 94437 - RNA, 19 nt, Homo sapiens
acaaacaagucauugaagu

SEQ ID NO: 94438 - RNA, 19 nt, Homo sapiens
ccugucauaucucuacuaa

SEQ ID NO: 94439 - RNA, 19 nt, Homo sapiens
acacuacaguaaaugauga

SEQ ID NO: 94440 - RNA, 19 nt, Homo sapiens
gaucccaucugcaggaaag

SEQ ID NO: 94441 - RNA, 19 nt, Homo sapiens
ggagucacauuaacuuugc

SEQ ID NO: 94442 - RNA, 19 nt, Homo sapiens
agacuggauucuuuaaaug

SEQ ID NO: 94443 - RNA, 19 nt, Homo sapiens
auaaagcacuagcugagaa

SEQ ID NO: 94444 - RNA, 19 nt, Homo sapiens
aaaaggcccuggcaauuaa

SEQ ID NO: 94445 - RNA, 19 nt, Homo sapiens
cgaggaugauauuguagaa

SEQ ID NO: 94446 - RNA, 19 nt, Homo sapiens
ugccuuacauaaucacaua

SEQ ID NO: 94447 - RNA, 19 nt, Homo sapiens
guacccuggucucaguaua

SEQ ID NO: 94448 - RNA, 19 nt, Homo sapiens
uaaaccaucugacuguagu

SEQ ID NO: 94449 - RNA, 19 nt, Homo sapiens
gaauaccuauacacagaca

SEQ ID NO: 94450 - RNA, 19 nt, Homo sapiens
ggaugauauuguagaaaug

SEQ ID NO: 94451 - RNA, 19 nt, Homo sapiens
uggcuacgcacacacauua

SEQ ID NO: 94452 - RNA, 19 nt, Homo sapiens
gaaccucggagacuggauu

SEQ ID NO: 94453 - RNA, 19 nt, Homo sapiens
cacaaugucauguaaugua

SEQ ID NO: 94454 - RNA, 19 nt, Homo sapiens
ggaacugauacuuacauuu

SEQ ID NO: 94455 - RNA, 19 nt, Homo sapiens
gcugauaccacauagauag

SEQ ID NO: 94456 - RNA, 19 nt, Homo sapiens
acccagaguuuauguagaa

SEQ ID NO: 94457 - RNA, 19 nt, Homo sapiens
cagcaaagcaagcagaguu

SEQ ID NO: 94458 - RNA, 19 nt, Homo sapiens
accaugaucuccugaagaa

SEQ ID NO: 94459 - RNA, 19 nt, Homo sapiens
gaagagggaauuugacaac

SEQ ID NO: 94460 - RNA, 19 nt, Homo sapiens
gucacuggcugccuacaaa

SEQ ID NO: 94461 - RNA, 19 nt, Homo sapiens
cacauuaacuuugcucuag

SEQ ID NO: 94462 - RNA, 19 nt, Homo sapiens
aaagagaaacugaaaugga

SEQ ID NO: 94463 - RNA, 19 nt, Homo sapiens
gaagaaagccucauugaca

SEQ ID NO: 94464 - RNA, 19 nt, Homo sapiens
gaugaaaccuaccugauga

SEQ ID NO: 94465 - RNA, 19 nt, Homo sapiens
gcaaggagcugcccgagau

SEQ ID NO: 94466 - RNA, 19 nt, Homo sapiens
uaacagggauggccauuga

SEQ ID NO: 94467 - RNA, 19 nt, Homo sapiens
uaaagaaccuugacuucau

SEQ ID NO: 94468 - RNA, 19 nt, Homo sapiens
ggaaauucaaggccacuua

SEQ ID NO: 94469 - RNA, 19 nt, Homo sapiens
gcaaucaguucuuugucuu

SEQ ID NO: 94470 - RNA, 19 nt, Homo sapiens
ccaacugggugucugagua

SEQ ID NO: 94471 - RNA, 19 nt, Homo sapiens
aaaccuaccugaugagcaa

SEQ ID NO: 94472 - RNA, 19 nt, Homo sapiens
gaggagcaguucaggaaga

SEQ ID NO: 94473 - RNA, 19 nt, Homo sapiens
gggaaaacauucauuaaga

SEQ ID NO: 94474 - RNA, 19 nt, Homo sapiens
aaagaaccuugacuucauu

SEQ ID NO: 94475 - RNA, 19 nt, Homo sapiens
gcaauacuaugggcucuuc

SEQ ID NO: 94476 - RNA, 19 nt, Homo sapiens
ggaugaaaccuaccugaug

SEQ ID NO: 94477 - RNA, 19 nt, Homo sapiens
ugaaugacauguaucucaa

SEQ ID NO: 94478 - RNA, 19 nt, Homo sapiens
guaaagaaccuugacuuca

SEQ ID NO: 94479 - RNA, 19 nt, Homo sapiens
gagauguucugcugcuaug

SEQ ID NO: 94480 - RNA, 19 nt, Homo sapiens
uuucacagcugcaaagaga

SEQ ID NO: 94481 - RNA, 19 nt, Homo sapiens
cgacaagucccugcaguuu

SEQ ID NO: 94482 - RNA, 19 nt, Homo sapiens
ugucuuggauguugucauu

SEQ ID NO: 94483 - RNA, 19 nt, Homo sapiens
uaaauuuguugcccgaguu

SEQ ID NO: 94484 - RNA, 19 nt, Homo sapiens
gcucagaacagcagcauca

SEQ ID NO: 94485 - RNA, 19 nt, Homo sapiens
ggagggaggagguacaaga

SEQ ID NO: 94486 - RNA, 19 nt, Homo sapiens
gggacucgcuggacaugau

SEQ ID NO: 94487 - RNA, 19 nt, Homo sapiens
ugacauguaucucaacaac

SEQ ID NO: 94488 - RNA, 19 nt, Homo sapiens
gcaccaggacucaccaaga

SEQ ID NO: 94489 - RNA, 19 nt, Homo sapiens
gaaauucaaggccacuuag

SEQ ID NO: 94490 - RNA, 19 nt, Homo sapiens
ucuuggauguugucauuaa

SEQ ID NO: 94491 - RNA, 19 nt, Homo sapiens
gcaugaagcaauacuaugg

SEQ ID NO: 94492 - RNA, 19 nt, Homo sapiens
caucguagccugcugcaau

SEQ ID NO: 94493 - RNA, 19 nt, Homo sapiens
ggaagagccaggccauugu

SEQ ID NO: 94494 - RNA, 19 nt, Homo sapiens
aagaaagccucauugacau

SEQ ID NO: 94495 - RNA, 19 nt, Homo sapiens
ccacaaccacggagauguu

SEQ ID NO: 94496 - RNA, 19 nt, Homo sapiens
ggagauguucugcugcuau

SEQ ID NO: 94497 - RNA, 19 nt, Homo sapiens
gagcguuugccuccaauug

SEQ ID NO: 94498 - RNA, 19 nt, Homo sapiens
ucuagagccuaaauuuguu

SEQ ID NO: 94499 - RNA, 19 nt, Homo sapiens
ccucaucucugguguacuc

SEQ ID NO: 94500 - RNA, 19 nt, Homo sapiens
gaauaguaaagaaccuuga

SEQ ID NO: 94501 - RNA, 19 nt, Homo sapiens
gaaaugcuccccggaaauu

SEQ ID NO: 94502 - RNA, 19 nt, Homo sapiens
gaagcgcuccggguagauu

SEQ ID NO: 94503 - RNA, 19 nt, Homo sapiens
gacgagcguuugccuccaa

SEQ ID NO: 94504 - RNA, 19 nt, Homo sapiens
gaagagccaggccauugug

SEQ ID NO: 94505 - RNA, 19 nt, Homo sapiens
ggaagaaagccucauugac

SEQ ID NO: 94506 - RNA, 19 nt, Homo sapiens
ugacuucauugucuauaag

SEQ ID NO: 94507 - RNA, 19 nt, Homo sapiens
cuacugagagcaagccauu

SEQ ID NO: 94508 - RNA, 19 nt, Homo sapiens
ggcggaggcuacagcaaga

SEQ ID NO: 94509 - RNA, 19 nt, Homo sapiens
cccguaagauggcagcaaa

SEQ ID NO: 94510 - RNA, 19 nt, Homo sapiens
gaaccuugacuucauuguc

SEQ ID NO: 94511 - RNA, 19 nt, Homo sapiens
gacaagucccugcaguuug

SEQ ID NO: 94512 - RNA, 19 nt, Homo sapiens
gaucuguucacucaguuga

SEQ ID NO: 94513 - RNA, 19 nt, Homo sapiens
caaaagcuguggaagaaag

SEQ ID NO: 94514 - RNA, 19 nt, Homo sapiens
ggauggccauugacaacca

SEQ ID NO: 94515 - RNA, 19 nt, Homo sapiens
gccacuccauucccacuga

SEQ ID NO: 94516 - RNA, 19 nt, Homo sapiens
aaacccagccucuagaaca

SEQ ID NO: 94517 - RNA, 19 nt, Homo sapiens
ccagggacaccaaccuuga

SEQ ID NO: 94518 - RNA, 19 nt, Homo sapiens
ggaggagguacaagaggaa

SEQ ID NO: 94519 - RNA, 19 nt, Homo sapiens
uggaagaaagccucauuga

SEQ ID NO: 94520 - RNA, 19 nt, Homo sapiens
gcagaaaugcagcccugau

SEQ ID NO: 94521 - RNA, 19 nt, Homo sapiens
caccaggacucaccaagac

SEQ ID NO: 94522 - RNA, 19 nt, Homo sapiens
ccaaacccagccucuagaa

SEQ ID NO: 94523 - RNA, 19 nt, Homo sapiens
cagaaaugcagcccugaug

SEQ ID NO: 94524 - RNA, 19 nt, Homo sapiens
caagacgcccauccuggaa

SEQ ID NO: 94525 - RNA, 19 nt, Homo sapiens
gggaucuguucacucaguu

SEQ ID NO: 94526 - RNA, 19 nt, Homo sapiens
acugggaaaugcugagcua

SEQ ID NO: 94527 - RNA, 19 nt, Homo sapiens
ucugaguacuggcugaaug

SEQ ID NO: 94528 - RNA, 19 nt, Homo sapiens
ggagguacaagaggaagga

SEQ ID NO: 94529 - RNA, 19 nt, Homo sapiens
gcgcugcaucugccuugua

SEQ ID NO: 94530 - RNA, 19 nt, Homo sapiens
cugcugcaaucaguucuuu

SEQ ID NO: 94531 - RNA, 19 nt, Homo sapiens
gaugaccagcugagguuug

SEQ ID NO: 94532 - RNA, 19 nt, Homo sapiens
gguuuguccucuccacuag

SEQ ID NO: 94533 - RNA, 19 nt, Homo sapiens
aaccuugacuucauugucu

SEQ ID NO: 94534 - RNA, 19 nt, Homo sapiens
ggacucgcuggacaugauu

SEQ ID NO: 94535 - RNA, 19 nt, Homo sapiens
ucaguucuuugucuuggau

SEQ ID NO: 94536 - RNA, 19 nt, Homo sapiens
agcagacccuggccacgua

SEQ ID NO: 94537 - RNA, 19 nt, Homo sapiens
ccuucuagagccuaaauuu

SEQ ID NO: 94538 - RNA, 19 nt, Homo sapiens
gcugcaaucaguucuuugu

SEQ ID NO: 94539 - RNA, 19 nt, Homo sapiens
guagccugcugcaaucagu

SEQ ID NO: 94540 - RNA, 19 nt, Homo sapiens
ugcaaaagcuguggaagaa

SEQ ID NO: 94541 - RNA, 19 nt, Homo sapiens
gcggccagcuugcuuucuc

SEQ ID NO: 94542 - RNA, 19 nt, Homo sapiens
acacgcugguggcucagaa

SEQ ID NO: 94543 - RNA, 19 nt, Homo sapiens
ucucugguguacucagcua

SEQ ID NO: 94544 - RNA, 19 nt, Homo sapiens
ccgaugaccagcugagguu

SEQ ID NO: 94545 - RNA, 19 nt, Homo sapiens
caacugggugucugaguac

SEQ ID NO: 94546 - RNA, 19 nt, Homo sapiens
aaugacauguaucucaaca

SEQ ID NO: 94547 - RNA, 19 nt, Homo sapiens
gaggagggaggagguacaa

SEQ ID NO: 94548 - RNA, 19 nt, Homo sapiens
ugcaaucaguucuuugucu

SEQ ID NO: 94549 - RNA, 19 nt, Homo sapiens
cugaaugacauguaucuca

SEQ ID NO: 94550 - RNA, 19 nt, Homo sapiens
ggagcugcccgagauguuc

SEQ ID NO: 94551 - RNA, 19 nt, Homo sapiens
uaguaaagaaccuugacuu

SEQ ID NO: 94552 - RNA, 19 nt, Homo sapiens
guggaagaaagccucauug

SEQ ID NO: 94553 - RNA, 19 nt, Homo sapiens
ugcccgagauguucaugga

SEQ ID NO: 94554 - RNA, 19 nt, Homo sapiens
aguacuggcugaaugacau

SEQ ID NO: 94555 - RNA, 19 nt, Homo sapiens
gagcugcccgagauguuca

SEQ ID NO: 94556 - RNA, 19 nt, Homo sapiens
acacagucauggccauaac

SEQ ID NO: 94557 - RNA, 19 nt, Homo sapiens
ggcacuggcuuuugugaga

SEQ ID NO: 94558 - RNA, 19 nt, Homo sapiens
cgcugcaucugccuuguau

SEQ ID NO: 94559 - RNA, 19 nt, Homo sapiens
aggaagagccaggccauug

SEQ ID NO: 94560 - RNA, 19 nt, Homo sapiens
caaucaguucuuugucuug

SEQ ID NO: 94561 - RNA, 19 nt, Homo sapiens
guccuguggucccaaaugg

SEQ ID NO: 94562 - RNA, 19 nt, Homo sapiens
cagaggcacuggcuuuugu

SEQ ID NO: 94563 - RNA, 19 nt, Homo sapiens
gaagaaagccucauugaca

SEQ ID NO: 94564 - RNA, 19 nt, Homo sapiens
gaugaaaccuaccugauga

SEQ ID NO: 94565 - RNA, 19 nt, Homo sapiens
gcaaggagcugcccgagau

SEQ ID NO: 94566 - RNA, 19 nt, Homo sapiens
uaacagggauggccauuga

SEQ ID NO: 94567 - RNA, 19 nt, Homo sapiens
uaaagaaccuugacuucau

SEQ ID NO: 94568 - RNA, 19 nt, Homo sapiens
ggaaauucaaggccacuua

SEQ ID NO: 94569 - RNA, 19 nt, Homo sapiens
gcaaucaguucuuugucuu

SEQ ID NO: 94570 - RNA, 19 nt, Homo sapiens
ccaacugggugucugagua

SEQ ID NO: 94571 - RNA, 19 nt, Homo sapiens
aaaccuaccugaugagcaa

SEQ ID NO: 94572 - RNA, 19 nt, Homo sapiens
gaggagcaguucaggaaga

SEQ ID NO: 94573 - RNA, 19 nt, Homo sapiens
gggaaaacauucauuaaga

SEQ ID NO: 94574 - RNA, 19 nt, Homo sapiens
aaagaaccuugacuucauu

SEQ ID NO: 94575 - RNA, 19 nt, Homo sapiens
gcaauacuaugggcucuuc

SEQ ID NO: 94576 - RNA, 19 nt, Homo sapiens
ggaugaaaccuaccugaug

SEQ ID NO: 94577 - RNA, 19 nt, Homo sapiens
ugaaugacauguaucucaa

SEQ ID NO: 94578 - RNA, 19 nt, Homo sapiens
guaaagaaccuugacuuca

SEQ ID NO: 94579 - RNA, 19 nt, Homo sapiens
gagauguucugcugcuaug

SEQ ID NO: 94580 - RNA, 19 nt, Homo sapiens
uuucacagcugcaaagaga

SEQ ID NO: 94581 - RNA, 19 nt, Homo sapiens
cgacaagucccugcaguuu

SEQ ID NO: 94582 - RNA, 19 nt, Homo sapiens
ugucuuggauguugucauu

SEQ ID NO: 94583 - RNA, 19 nt, Homo sapiens
gcucagaacagcagcauca

SEQ ID NO: 94584 - RNA, 19 nt, Homo sapiens
gcaccaggacucaccaaga

SEQ ID NO: 94585 - RNA, 19 nt, Homo sapiens
gggacucgcuggacaugau

SEQ ID NO: 94586 - RNA, 19 nt, Homo sapiens
ugacauguaucucaacaac

SEQ ID NO: 94587 - RNA, 19 nt, Homo sapiens
gaaauucaaggccacuuag

SEQ ID NO: 94588 - RNA, 19 nt, Homo sapiens
ucuuggauguugucauuaa

SEQ ID NO: 94589 - RNA, 19 nt, Homo sapiens
gcaugaagcaauacuaugg

SEQ ID NO: 94590 - RNA, 19 nt, Homo sapiens
ggaagagccaggccauugu

SEQ ID NO: 94591 - RNA, 19 nt, Homo sapiens
caucguagccugcugcaau

SEQ ID NO: 94592 - RNA, 19 nt, Homo sapiens
aagaaagccucauugacau

SEQ ID NO: 94593 - RNA, 19 nt, Homo sapiens
ccacaaccacggagauguu

SEQ ID NO: 94594 - RNA, 19 nt, Homo sapiens
ggagauguucugcugcuau

SEQ ID NO: 94595 - RNA, 19 nt, Homo sapiens
gagcguuugccuccaauug

SEQ ID NO: 94596 - RNA, 19 nt, Homo sapiens
ccucaucucugguguacuc

SEQ ID NO: 94597 - RNA, 19 nt, Homo sapiens
gaauaguaaagaaccuuga

SEQ ID NO: 94598 - RNA, 19 nt, Homo sapiens
gaaaugcuccccggaaauu

SEQ ID NO: 94599 - RNA, 19 nt, Homo sapiens
gacgagcguuugccuccaa

SEQ ID NO: 94600 - RNA, 19 nt, Homo sapiens
gaagagccaggccauugug

SEQ ID NO: 94601 - RNA, 19 nt, Homo sapiens
ggaagaaagccucauugac

SEQ ID NO: 94602 - RNA, 19 nt, Homo sapiens
ugacuucauugucuauaag

SEQ ID NO: 94603 - RNA, 19 nt, Homo sapiens
cuacugagagcaagccauu

SEQ ID NO: 94604 - RNA, 19 nt, Homo sapiens
cccguaagauggcagcaaa

SEQ ID NO: 94605 - RNA, 19 nt, Homo sapiens
ggcggaggcuacagcaaga

SEQ ID NO: 94606 - RNA, 19 nt, Homo sapiens
gaaccuugacuucauuguc

SEQ ID NO: 94607 - RNA, 19 nt, Homo sapiens
gacaagucccugcaguuug

SEQ ID NO: 94608 - RNA, 19 nt, Homo sapiens
gaucuguucacucaguuga

SEQ ID NO: 94609 - RNA, 19 nt, Homo sapiens
caaaagcuguggaagaaag

SEQ ID NO: 94610 - RNA, 19 nt, Homo sapiens
ggauggccauugacaacca

SEQ ID NO: 94611 - RNA, 19 nt, Homo sapiens
gccacuccauucccacuga

SEQ ID NO: 94612 - RNA, 19 nt, Homo sapiens
aaacccagccucuagaaca

SEQ ID NO: 94613 - RNA, 19 nt, Homo sapiens
ccagggacaccaaccuuga

SEQ ID NO: 94614 - RNA, 19 nt, Homo sapiens
uggaagaaagccucauuga

SEQ ID NO: 94615 - RNA, 19 nt, Homo sapiens
gcagaaaugcagcccugau

SEQ ID NO: 94616 - RNA, 19 nt, Homo sapiens
caccaggacucaccaagac

SEQ ID NO: 94617 - RNA, 19 nt, Homo sapiens
ccaaacccagccucuagaa

SEQ ID NO: 94618 - RNA, 19 nt, Homo sapiens
cagaaaugcagcccugaug

SEQ ID NO: 94619 - RNA, 19 nt, Homo sapiens
gggaucuguucacucaguu

SEQ ID NO: 94620 - RNA, 19 nt, Homo sapiens
caagacgcccauccuggaa

SEQ ID NO: 94621 - RNA, 19 nt, Homo sapiens
ucugaguacuggcugaaug

SEQ ID NO: 94622 - RNA, 19 nt, Homo sapiens
gcgcugcaucugccuugua

SEQ ID NO: 94623 - RNA, 19 nt, Homo sapiens
cugcugcaaucaguucuuu

SEQ ID NO: 94624 - RNA, 19 nt, Homo sapiens
gaugaccagcugagguuug

SEQ ID NO: 94625 - RNA, 19 nt, Homo sapiens
agcagacccuggccacgua

SEQ ID NO: 94626 - RNA, 19 nt, Homo sapiens
gguuuguccucuccacuag

SEQ ID NO: 94627 - RNA, 19 nt, Homo sapiens
aaccuugacuucauugucu

SEQ ID NO: 94628 - RNA, 19 nt, Homo sapiens
ggacucgcuggacaugauu

SEQ ID NO: 94629 - RNA, 19 nt, Homo sapiens
ucaguucuuugucuuggau

SEQ ID NO: 94630 - RNA, 19 nt, Homo sapiens
gcugcaaucaguucuuugu

SEQ ID NO: 94631 - RNA, 19 nt, Homo sapiens
guagccugcugcaaucagu

SEQ ID NO: 94632 - RNA, 19 nt, Homo sapiens
ugcaaaagcuguggaagaa

SEQ ID NO: 94633 - RNA, 19 nt, Homo sapiens
acacgcugguggcucagaa

SEQ ID NO: 94634 - RNA, 19 nt, Homo sapiens
ucucugguguacucagcua

SEQ ID NO: 94635 - RNA, 19 nt, Homo sapiens
ccgaugaccagcugagguu

SEQ ID NO: 94636 - RNA, 19 nt, Homo sapiens
caacugggugucugaguac

SEQ ID NO: 94637 - RNA, 19 nt, Homo sapiens
aaugacauguaucucaaca

SEQ ID NO: 94638 - RNA, 19 nt, Homo sapiens
cugaaugacauguaucuca

SEQ ID NO: 94639 - RNA, 19 nt, Homo sapiens
ugcaaucaguucuuugucu

SEQ ID NO: 94640 - RNA, 19 nt, Homo sapiens
ggagcugcccgagauguuc

SEQ ID NO: 94641 - RNA, 19 nt, Homo sapiens
uaguaaagaaccuugacuu

SEQ ID NO: 94642 - RNA, 19 nt, Homo sapiens
guggaagaaagccucauug

SEQ ID NO: 94643 - RNA, 19 nt, Homo sapiens
ugcccgagauguucaugga

SEQ ID NO: 94644 - RNA, 19 nt, Homo sapiens
gagcugcccgagauguuca

SEQ ID NO: 94645 - RNA, 19 nt, Homo sapiens
acacagucauggccauaac

SEQ ID NO: 94646 - RNA, 19 nt, Homo sapiens
ggcacuggcuuuugugaga

SEQ ID NO: 94647 - RNA, 19 nt, Homo sapiens
aggaagagccaggccauug

SEQ ID NO: 94648 - RNA, 19 nt, Homo sapiens
cgcugcaucugccuuguau

SEQ ID NO: 94649 - RNA, 19 nt, Homo sapiens
caaucaguucuuugucuug

SEQ ID NO: 94650 - RNA, 19 nt, Homo sapiens
aguacuggcugaaugacau

SEQ ID NO: 94651 - RNA, 19 nt, Homo sapiens
guccuguggucccaaaugg

SEQ ID NO: 94652 - RNA, 19 nt, Homo sapiens
cagaggcacuggcuuuugu

SEQ ID NO: 94653 - RNA, 19 nt, Homo sapiens
cuacaggcuccaccgaaga

SEQ ID NO: 94654 - RNA, 19 nt, Homo sapiens
aguaaagaaccuugacuuc

SEQ ID NO: 94655 - RNA, 19 nt, Homo sapiens
ggauguugucauuaauuuc

SEQ ID NO: 94656 - RNA, 19 nt, Homo sapiens
ucagaacagcagcaucaug

SEQ ID NO: 94657 - RNA, 19 nt, Homo sapiens
gaagaaagccucauugaca

SEQ ID NO: 94658 - RNA, 19 nt, Homo sapiens
gaugaaaccuaccugauga

SEQ ID NO: 94659 - RNA, 19 nt, Homo sapiens
gcaaggagcugcccgagau

SEQ ID NO: 94660 - RNA, 19 nt, Homo sapiens
uaacagggauggccauuga

SEQ ID NO: 94661 - RNA, 19 nt, Homo sapiens
uaaagaaccuugacuucau

SEQ ID NO: 94662 - RNA, 19 nt, Homo sapiens
ggaaauucaaggccacuua

SEQ ID NO: 94663 - RNA, 19 nt, Homo sapiens
gcaaucaguucuuugucuu

SEQ ID NO: 94664 - RNA, 19 nt, Homo sapiens
ccaacugggugucugagua

SEQ ID NO: 94665 - RNA, 19 nt, Homo sapiens
aaaccuaccugaugagcaa

SEQ ID NO: 94666 - RNA, 19 nt, Homo sapiens
gaggagcaguucaggaaga

SEQ ID NO: 94667 - RNA, 19 nt, Homo sapiens
gggaaaacauucauuaaga

SEQ ID NO: 94668 - RNA, 19 nt, Homo sapiens
aaagaaccuugacuucauu

SEQ ID NO: 94669 - RNA, 19 nt, Homo sapiens
gcaauacuaugggcucuuc

SEQ ID NO: 94670 - RNA, 19 nt, Homo sapiens
ggaugaaaccuaccugaug

SEQ ID NO: 94671 - RNA, 19 nt, Homo sapiens
ugaaugacauguaucucaa

SEQ ID NO: 94672 - RNA, 19 nt, Homo sapiens
guaaagaaccuugacuuca

SEQ ID NO: 94673 - RNA, 19 nt, Homo sapiens
gagauguucugcugcuaug

SEQ ID NO: 94674 - RNA, 19 nt, Homo sapiens
uuucacagcugcaaagaga

SEQ ID NO: 94675 - RNA, 19 nt, Homo sapiens
cgacaagucccugcaguuu

SEQ ID NO: 94676 - RNA, 19 nt, Homo sapiens
ugucuuggauguugucauu

SEQ ID NO: 94677 - RNA, 19 nt, Homo sapiens
gcucagaacagcagcauca

SEQ ID NO: 94678 - RNA, 19 nt, Homo sapiens
gggacucgcuggacaugau

SEQ ID NO: 94679 - RNA, 19 nt, Homo sapiens
gcaccaggacucaccaaga

SEQ ID NO: 94680 - RNA, 19 nt, Homo sapiens
ugacauguaucucaacaac

SEQ ID NO: 94681 - RNA, 19 nt, Homo sapiens
gaaauucaaggccacuuag

SEQ ID NO: 94682 - RNA, 19 nt, Homo sapiens
ucuuggauguugucauuaa

SEQ ID NO: 94683 - RNA, 19 nt, Homo sapiens
gcaugaagcaauacuaugg

SEQ ID NO: 94684 - RNA, 19 nt, Homo sapiens
caucguagccugcugcaau

SEQ ID NO: 94685 - RNA, 19 nt, Homo sapiens
ggaagagccaggccauugu

SEQ ID NO: 94686 - RNA, 19 nt, Homo sapiens
aagaaagccucauugacau

SEQ ID NO: 94687 - RNA, 19 nt, Homo sapiens
ccacaaccacggagauguu

SEQ ID NO: 94688 - RNA, 19 nt, Homo sapiens
ggagauguucugcugcuau

SEQ ID NO: 94689 - RNA, 19 nt, Homo sapiens
gagcguuugccuccaauug

SEQ ID NO: 94690 - RNA, 19 nt, Homo sapiens
ccucaucucugguguacuc

SEQ ID NO: 94691 - RNA, 19 nt, Homo sapiens
gaauaguaaagaaccuuga

SEQ ID NO: 94692 - RNA, 19 nt, Homo sapiens
gaaaugcuccccggaaauu

SEQ ID NO: 94693 - RNA, 19 nt, Homo sapiens
gaagagccaggccauugug

SEQ ID NO: 94694 - RNA, 19 nt, Homo sapiens
gacgagcguuugccuccaa

SEQ ID NO: 94695 - RNA, 19 nt, Homo sapiens
ggaagaaagccucauugac

SEQ ID NO: 94696 - RNA, 19 nt, Homo sapiens
ugacuucauugucuauaag

SEQ ID NO: 94697 - RNA, 19 nt, Homo sapiens
cuacugagagcaagccauu

SEQ ID NO: 94698 - RNA, 19 nt, Homo sapiens
ggcggaggcuacagcaaga

SEQ ID NO: 94699 - RNA, 19 nt, Homo sapiens
cccguaagauggcagcaaa

SEQ ID NO: 94700 - RNA, 19 nt, Homo sapiens
gaaccuugacuucauuguc

SEQ ID NO: 94701 - RNA, 19 nt, Homo sapiens
gacaagucccugcaguuug

SEQ ID NO: 94702 - RNA, 19 nt, Homo sapiens
gaucuguucacucaguuga

SEQ ID NO: 94703 - RNA, 19 nt, Homo sapiens
caaaagcuguggaagaaag

SEQ ID NO: 94704 - RNA, 19 nt, Homo sapiens
ggauggccauugacaacca

SEQ ID NO: 94705 - RNA, 19 nt, Homo sapiens
gccacuccauucccacuga

SEQ ID NO: 94706 - RNA, 19 nt, Homo sapiens
aaacccagccucuagaaca

SEQ ID NO: 94707 - RNA, 19 nt, Homo sapiens
ccagggacaccaaccuuga

SEQ ID NO: 94708 - RNA, 19 nt, Homo sapiens
aguccgaccucuggaaauu

SEQ ID NO: 94709 - RNA, 19 nt, Homo sapiens
uggaagaaagccucauuga

SEQ ID NO: 94710 - RNA, 19 nt, Homo sapiens
caccaggacucaccaagac

SEQ ID NO: 94711 - RNA, 19 nt, Homo sapiens
gcagaaaugcagcccugau

SEQ ID NO: 94712 - RNA, 19 nt, Homo sapiens
ccaaacccagccucuagaa

SEQ ID NO: 94713 - RNA, 19 nt, Homo sapiens
cagaaaugcagcccugaug

SEQ ID NO: 94714 - RNA, 19 nt, Homo sapiens
caagacgcccauccuggaa

SEQ ID NO: 94715 - RNA, 19 nt, Homo sapiens
gggaucuguucacucaguu

SEQ ID NO: 94716 - RNA, 19 nt, Homo sapiens
ucugaguacuggcugaaug

SEQ ID NO: 94717 - RNA, 19 nt, Homo sapiens
gcgcugcaucugccuugua

SEQ ID NO: 94718 - RNA, 19 nt, Homo sapiens
cugcugcaaucaguucuuu

SEQ ID NO: 94719 - RNA, 19 nt, Homo sapiens
gaugaccagcugagguuug

SEQ ID NO: 94720 - RNA, 19 nt, Homo sapiens
gguuuguccucuccacuag

SEQ ID NO: 94721 - RNA, 19 nt, Homo sapiens
aaccuugacuucauugucu

SEQ ID NO: 94722 - RNA, 19 nt, Homo sapiens
ggacucgcuggacaugauu

SEQ ID NO: 94723 - RNA, 19 nt, Homo sapiens
agcagacccuggccacgua

SEQ ID NO: 94724 - RNA, 19 nt, Homo sapiens
ucaguucuuugucuuggau

SEQ ID NO: 94725 - RNA, 19 nt, Homo sapiens
ccguugaggcuuugagaaa

SEQ ID NO: 94726 - RNA, 19 nt, Homo sapiens
gcugcaaucaguucuuugu

SEQ ID NO: 94727 - RNA, 19 nt, Homo sapiens
guagccugcugcaaucagu

SEQ ID NO: 94728 - RNA, 19 nt, Homo sapiens
ugcaaaagcuguggaagaa

SEQ ID NO: 94729 - RNA, 19 nt, Homo sapiens
acacgcugguggcucagaa

SEQ ID NO: 94730 - RNA, 19 nt, Homo sapiens
ucucugguguacucagcua

SEQ ID NO: 94731 - RNA, 19 nt, Homo sapiens
ccgaugaccagcugagguu

SEQ ID NO: 94732 - RNA, 19 nt, Homo sapiens
aaugacauguaucucaaca

SEQ ID NO: 94733 - RNA, 19 nt, Homo sapiens
caacugggugucugaguac

SEQ ID NO: 94734 - RNA, 19 nt, Homo sapiens
cugaaugacauguaucuca

SEQ ID NO: 94735 - RNA, 19 nt, Homo sapiens
ugcaaucaguucuuugucu

SEQ ID NO: 94736 - RNA, 19 nt, Homo sapiens
ggagcugcccgagauguuc

SEQ ID NO: 94737 - RNA, 19 nt, Homo sapiens
uaguaaagaaccuugacuu

SEQ ID NO: 94738 - RNA, 19 nt, Homo sapiens
guggaagaaagccucauug

SEQ ID NO: 94739 - RNA, 19 nt, Homo sapiens
ugcccgagauguucaugga

SEQ ID NO: 94740 - RNA, 19 nt, Homo sapiens
gagcugcccgagauguuca

SEQ ID NO: 94741 - RNA, 19 nt, Homo sapiens
acacagucauggccauaac

SEQ ID NO: 94742 - RNA, 19 nt, Homo sapiens
ggcacuggcuuuugugaga

SEQ ID NO: 94743 - RNA, 19 nt, Homo sapiens
aguacuggcugaaugacau

SEQ ID NO: 94744 - RNA, 19 nt, Homo sapiens
cgcugcaucugccuuguau

SEQ ID NO: 94745 - RNA, 19 nt, Homo sapiens
caaucaguucuuugucuug

SEQ ID NO: 94746 - RNA, 19 nt, Homo sapiens
aggaagagccaggccauug

SEQ ID NO: 94747 - RNA, 19 nt, Homo sapiens
guccuguggucccaaaugg

SEQ ID NO: 94748 - RNA, 19 nt, Homo sapiens
cagaggcacuggcuuuugu

SEQ ID NO: 94749 - RNA, 19 nt, Homo sapiens
cuacaggcuccaccgaaga

SEQ ID NO: 94750 - RNA, 19 nt, Homo sapiens
aguaaagaaccuugacuuc

SEQ ID NO: 94751 - RNA, 19 nt, Homo sapiens
ggauguugucauuaauuuc

SEQ ID NO: 94752 - RNA, 19 nt, Homo sapiens
ucagaacagcagcaucaug

SEQ ID NO: 94753 - RNA, 19 nt, Homo sapiens
gaagaaagccucauugaca

SEQ ID NO: 94754 - RNA, 19 nt, Homo sapiens
gaugaaaccuaccugauga

SEQ ID NO: 94755 - RNA, 19 nt, Homo sapiens
gcaaggagcugcccgagau

SEQ ID NO: 94756 - RNA, 19 nt, Homo sapiens
uaacagggauggccauuga

SEQ ID NO: 94757 - RNA, 19 nt, Homo sapiens
uaaagaaccuugacuucau

SEQ ID NO: 94758 - RNA, 19 nt, Homo sapiens
ggaaauucaaggccacuua

SEQ ID NO: 94759 - RNA, 19 nt, Homo sapiens
gcaaucaguucuuugucuu

SEQ ID NO: 94760 - RNA, 19 nt, Homo sapiens
ccaacugggugucugagua

SEQ ID NO: 94761 - RNA, 19 nt, Homo sapiens
aaaccuaccugaugagcaa

SEQ ID NO: 94762 - RNA, 19 nt, Homo sapiens
gaggagcaguucaggaaga

SEQ ID NO: 94763 - RNA, 19 nt, Homo sapiens
gggaaaacauucauuaaga

SEQ ID NO: 94764 - RNA, 19 nt, Homo sapiens
aaagaaccuugacuucauu

SEQ ID NO: 94765 - RNA, 19 nt, Homo sapiens
gcaauacuaugggcucuuc

SEQ ID NO: 94766 - RNA, 19 nt, Homo sapiens
ggaugaaaccuaccugaug

SEQ ID NO: 94767 - RNA, 19 nt, Homo sapiens
ugaaugacauguaucucaa

SEQ ID NO: 94768 - RNA, 19 nt, Homo sapiens
guaaagaaccuugacuuca

SEQ ID NO: 94769 - RNA, 19 nt, Homo sapiens
gagauguucugcugcuaug

SEQ ID NO: 94770 - RNA, 19 nt, Homo sapiens
uuucacagcugcaaagaga

SEQ ID NO: 94771 - RNA, 19 nt, Homo sapiens
cgacaagucccugcaguuu

SEQ ID NO: 94772 - RNA, 19 nt, Homo sapiens
ugucuuggauguugucauu

SEQ ID NO: 94773 - RNA, 19 nt, Homo sapiens
gcucagaacagcagcauca

SEQ ID NO: 94774 - RNA, 19 nt, Homo sapiens
gggacucgcuggacaugau

SEQ ID NO: 94775 - RNA, 19 nt, Homo sapiens
ugacauguaucucaacaac

SEQ ID NO: 94776 - RNA, 19 nt, Homo sapiens
gcaccaggacucaccaaga

SEQ ID NO: 94777 - RNA, 19 nt, Homo sapiens
gaaauucaaggccacuuag

SEQ ID NO: 94778 - RNA, 19 nt, Homo sapiens
ucuuggauguugucauuaa

SEQ ID NO: 94779 - RNA, 19 nt, Homo sapiens
gcaugaagcaauacuaugg

SEQ ID NO: 94780 - RNA, 19 nt, Homo sapiens
caucguagccugcugcaau

SEQ ID NO: 94781 - RNA, 19 nt, Homo sapiens
ggaagagccaggccauugu

SEQ ID NO: 94782 - RNA, 19 nt, Homo sapiens
aagaaagccucauugacau

SEQ ID NO: 94783 - RNA, 19 nt, Homo sapiens
ccacaaccacggagauguu

SEQ ID NO: 94784 - RNA, 19 nt, Homo sapiens
ggagauguucugcugcuau

SEQ ID NO: 94785 - RNA, 19 nt, Homo sapiens
gagcguuugccuccaauug

SEQ ID NO: 94786 - RNA, 19 nt, Homo sapiens
ccucaucucugguguacuc

SEQ ID NO: 94787 - RNA, 19 nt, Homo sapiens
gaauaguaaagaaccuuga

SEQ ID NO: 94788 - RNA, 19 nt, Homo sapiens
gaaaugcuccccggaaauu

SEQ ID NO: 94789 - RNA, 19 nt, Homo sapiens
gaagagccaggccauugug

SEQ ID NO: 94790 - RNA, 19 nt, Homo sapiens
gacgagcguuugccuccaa

SEQ ID NO: 94791 - RNA, 19 nt, Homo sapiens
ggaagaaagccucauugac

SEQ ID NO: 94792 - RNA, 19 nt, Homo sapiens
ugacuucauugucuauaag

SEQ ID NO: 94793 - RNA, 19 nt, Homo sapiens
cuacugagagcaagccauu

SEQ ID NO: 94794 - RNA, 19 nt, Homo sapiens
ggcggaggcuacagcaaga

SEQ ID NO: 94795 - RNA, 19 nt, Homo sapiens
cccguaagauggcagcaaa

SEQ ID NO: 94796 - RNA, 19 nt, Homo sapiens
gaaccuugacuucauuguc

SEQ ID NO: 94797 - RNA, 19 nt, Homo sapiens
gacaagucccugcaguuug

SEQ ID NO: 94798 - RNA, 19 nt, Homo sapiens
gaucuguucacucaguuga

SEQ ID NO: 94799 - RNA, 19 nt, Homo sapiens
caaaagcuguggaagaaag

SEQ ID NO: 94800 - RNA, 19 nt, Homo sapiens
ggauggccauugacaacca

SEQ ID NO: 94801 - RNA, 19 nt, Homo sapiens
gccacuccauucccacuga

SEQ ID NO: 94802 - RNA, 19 nt, Homo sapiens
aaacccagccucuagaaca

SEQ ID NO: 94803 - RNA, 19 nt, Homo sapiens
ccagggacaccaaccuuga

SEQ ID NO: 94804 - RNA, 19 nt, Homo sapiens
uggaagaaagccucauuga

SEQ ID NO: 94805 - RNA, 19 nt, Homo sapiens
gcagaaaugcagcccugau

SEQ ID NO: 94806 - RNA, 19 nt, Homo sapiens
caccaggacucaccaagac

SEQ ID NO: 94807 - RNA, 19 nt, Homo sapiens
ccaaacccagccucuagaa

SEQ ID NO: 94808 - RNA, 19 nt, Homo sapiens
cagaaaugcagcccugaug

SEQ ID NO: 94809 - RNA, 19 nt, Homo sapiens
gggaucuguucacucaguu

SEQ ID NO: 94810 - RNA, 19 nt, Homo sapiens
caagacgcccauccuggaa

SEQ ID NO: 94811 - RNA, 19 nt, Homo sapiens
ucugaguacuggcugaaug

SEQ ID NO: 94812 - RNA, 19 nt, Homo sapiens
gcgcugcaucugccuugua

SEQ ID NO: 94813 - RNA, 19 nt, Homo sapiens
cugcugcaaucaguucuuu

SEQ ID NO: 94814 - RNA, 19 nt, Homo sapiens
gaugaccagcugagguuug

SEQ ID NO: 94815 - RNA, 19 nt, Homo sapiens
gguuuguccucuccacuag

SEQ ID NO: 94816 - RNA, 19 nt, Homo sapiens
aaccuugacuucauugucu

SEQ ID NO: 94817 - RNA, 19 nt, Homo sapiens
ggacucgcuggacaugauu

SEQ ID NO: 94818 - RNA, 19 nt, Homo sapiens
ucaguucuuugucuuggau

SEQ ID NO: 94819 - RNA, 19 nt, Homo sapiens
agcagacccuggccacgua

SEQ ID NO: 94820 - RNA, 19 nt, Homo sapiens
gcugcaaucaguucuuugu

SEQ ID NO: 94821 - RNA, 19 nt, Homo sapiens
guagccugcugcaaucagu

SEQ ID NO: 94822 - RNA, 19 nt, Homo sapiens
ugcaaaagcuguggaagaa

SEQ ID NO: 94823 - RNA, 19 nt, Homo sapiens
aguccgaccucuggaaaug

SEQ ID NO: 94824 - RNA, 19 nt, Homo sapiens
acacgcugguggcucagaa

SEQ ID NO: 94825 - RNA, 19 nt, Homo sapiens
ucucugguguacucagcua

SEQ ID NO: 94826 - RNA, 19 nt, Homo sapiens
ccgaugaccagcugagguu

SEQ ID NO: 94827 - RNA, 19 nt, Homo sapiens
caacugggugucugaguac

SEQ ID NO: 94828 - RNA, 19 nt, Homo sapiens
aaugacauguaucucaaca

SEQ ID NO: 94829 - RNA, 19 nt, Homo sapiens
cugaaugacauguaucuca

SEQ ID NO: 94830 - RNA, 19 nt, Homo sapiens
ugcaaucaguucuuugucu

SEQ ID NO: 94831 - RNA, 19 nt, Homo sapiens
ggagcugcccgagauguuc

SEQ ID NO: 94832 - RNA, 19 nt, Homo sapiens
uaguaaagaaccuugacuu

SEQ ID NO: 94833 - RNA, 19 nt, Homo sapiens
aguacuggcugaaugacau

SEQ ID NO: 94834 - RNA, 19 nt, Homo sapiens
guggaagaaagccucauug

SEQ ID NO: 94835 - RNA, 19 nt, Homo sapiens
aggaagagccaggccauug

SEQ ID NO: 94836 - RNA, 19 nt, Homo sapiens
ugcccgagauguucaugga

SEQ ID NO: 94837 - RNA, 19 nt, Homo sapiens
gagcugcccgagauguuca

SEQ ID NO: 94838 - RNA, 19 nt, Homo sapiens
acacagucauggccauaac

SEQ ID NO: 94839 - RNA, 19 nt, Homo sapiens
ggcacuggcuuuugugaga

SEQ ID NO: 94840 - RNA, 19 nt, Homo sapiens
cgcugcaucugccuuguau

SEQ ID NO: 94841 - RNA, 19 nt, Homo sapiens
caaucaguucuuugucuug

SEQ ID NO: 94842 - RNA, 19 nt, Homo sapiens
guccuguggucccaaaugg

SEQ ID NO: 94843 - RNA, 19 nt, Homo sapiens
cagaggcacuggcuuuugu

SEQ ID NO: 94844 - RNA, 19 nt, Homo sapiens
cuacaggcuccaccgaaga

SEQ ID NO: 94845 - RNA, 19 nt, Homo sapiens
aguaaagaaccuugacuuc

SEQ ID NO: 94846 - RNA, 19 nt, Homo sapiens
ggauguugucauuaauuuc

SEQ ID NO: 94847 - RNA, 19 nt, Homo sapiens
ucagaacagcagcaucaug

SEQ ID NO: 94848 - RNA, 19 nt, Homo sapiens
cacagaaucuugcuucaua

SEQ ID NO: 94849 - RNA, 19 nt, Homo sapiens
ggagaaccguguggucuua

SEQ ID NO: 94850 - RNA, 19 nt, Homo sapiens
acucagagcuauaugguua

SEQ ID NO: 94851 - RNA, 19 nt, Homo sapiens
gagagaggguggaggguuu

SEQ ID NO: 94852 - RNA, 19 nt, Homo sapiens
uaacauccuucaagaauuc

SEQ ID NO: 94853 - RNA, 19 nt, Homo sapiens
gaagggagacuacaugaau

SEQ ID NO: 94854 - RNA, 19 nt, Homo sapiens
cagcagcccucaccgauga

SEQ ID NO: 94855 - RNA, 19 nt, Homo sapiens
ggagaaauuucacaguaca

SEQ ID NO: 94856 - RNA, 19 nt, Homo sapiens
gcagagaucccaggguuaa

SEQ ID NO: 94857 - RNA, 19 nt, Homo sapiens
gcaacuauaagccaaauau

SEQ ID NO: 94858 - RNA, 19 nt, Homo sapiens
ccugggaccuacagaauaa

SEQ ID NO: 94859 - RNA, 19 nt, Homo sapiens
cagcagaacagaauccuuu

SEQ ID NO: 94860 - RNA, 19 nt, Homo sapiens
gaacagggaagcagugaca

SEQ ID NO: 94861 - RNA, 19 nt, Homo sapiens
ggacaauaacggugugauu

SEQ ID NO: 94862 - RNA, 19 nt, Homo sapiens
aaagaacgauccuccacuu

SEQ ID NO: 94863 - RNA, 19 nt, Homo sapiens
cauacagucuuauuaguca

SEQ ID NO: 94864 - RNA, 19 nt, Homo sapiens
gaaccuaacauccuucaag

SEQ ID NO: 94865 - RNA, 19 nt, Homo sapiens
uaacagcaauauugaaagg

SEQ ID NO: 94866 - RNA, 19 nt, Homo sapiens
caaccucccucacagaaca

SEQ ID NO: 94867 - RNA, 19 nt, Homo sapiens
gggccagcauacagucuua

SEQ ID NO: 94868 - RNA, 19 nt, Homo sapiens
uguuaaggauuccaaguaa

SEQ ID NO: 94869 - RNA, 19 nt, Homo sapiens
gaacgauccuccacuugac

SEQ ID NO: 94870 - RNA, 19 nt, Homo sapiens
gguaugcugugaccaagga

SEQ ID NO: 94871 - RNA, 19 nt, Homo sapiens
gcagagagagagagagaga

SEQ ID NO: 94872 - RNA, 19 nt, Homo sapiens
cauacagucugcauggauu

SEQ ID NO: 94873 - RNA, 19 nt, Homo sapiens
ccaagugugugaugcugaa

SEQ ID NO: 94874 - RNA, 19 nt, Homo sapiens
uuggagaaauuucacagua

SEQ ID NO: 94875 - RNA, 19 nt, Homo sapiens
ggaaacagcaacuuguaca

SEQ ID NO: 94876 - RNA, 19 nt, Homo sapiens
gcuauaugguuagacguuu

SEQ ID NO: 94877 - RNA, 19 nt, Homo sapiens
cuaacauccuucaagaauu

SEQ ID NO: 94878 - RNA, 19 nt, Homo sapiens
ggaggcagagguaaacuug

SEQ ID NO: 94879 - RNA, 19 nt, Homo sapiens
caaagaacagagcugauga

SEQ ID NO: 94880 - RNA, 19 nt, Homo sapiens
gagcauacccacccucauc

SEQ ID NO: 94881 - RNA, 19 nt, Homo sapiens
ggagaggacaggaagaugu

SEQ ID NO: 94882 - RNA, 19 nt, Homo sapiens
ggauuccaaguaacucuua

SEQ ID NO: 94883 - RNA, 19 nt, Homo sapiens
gcacaaccucccucacaga

SEQ ID NO: 94884 - RNA, 19 nt, Homo sapiens
aaguggagcugcaagagaa

SEQ ID NO: 94885 - RNA, 19 nt, Homo sapiens
ggaaaguggagcugcaaga

SEQ ID NO: 94886 - RNA, 19 nt, Homo sapiens
gaaauuucacaguacauca

SEQ ID NO: 94887 - RNA, 19 nt, Homo sapiens
ccagcauacagucuuauua

SEQ ID NO: 94888 - RNA, 19 nt, Homo sapiens
aacaaaugguacagucaua

SEQ ID NO: 94889 - RNA, 19 nt, Homo sapiens
gagaagacgaucugcacuu

SEQ ID NO: 94890 - RNA, 19 nt, Homo sapiens
caacuaccaucagcuugga

SEQ ID NO: 94891 - RNA, 19 nt, Homo sapiens
agaaugugauggagaggaa

SEQ ID NO: 94892 - RNA, 19 nt, Homo sapiens
ggaugugccugugguaaag

SEQ ID NO: 94893 - RNA, 19 nt, Homo sapiens
gaucugcacuucgcauuuu

SEQ ID NO: 94894 - RNA, 19 nt, Homo sapiens
gaggaagacagcagagaga

SEQ ID NO: 94895 - RNA, 19 nt, Homo sapiens
cccagaagcacaaagcaua

SEQ ID NO: 94896 - RNA, 19 nt, Homo sapiens
caaguaacucuuauuugga

SEQ ID NO: 94897 - RNA, 19 nt, Homo sapiens
gcauacagucuuauuaguc

SEQ ID NO: 94898 - RNA, 19 nt, Homo sapiens
gagauuccaggaugccuuu

SEQ ID NO: 94899 - RNA, 19 nt, Homo sapiens
gcacagaacccggcuuggu

SEQ ID NO: 94900 - RNA, 19 nt, Homo sapiens
ccucagguguugcuugugu

SEQ ID NO: 94901 - RNA, 19 nt, Homo sapiens
ccuaacauccuucaagaau

SEQ ID NO: 94902 - RNA, 19 nt, Homo sapiens
aaccuaacauccuucaaga

SEQ ID NO: 94903 - RNA, 19 nt, Homo sapiens
gcuucggccucuccaacua

SEQ ID NO: 94904 - RNA, 19 nt, Homo sapiens
ggaagacagcagagagaga

SEQ ID NO: 94905 - RNA, 19 nt, Homo sapiens
gauggaaacagcaacuugu

SEQ ID NO: 94906 - RNA, 19 nt, Homo sapiens
cagcauacagucuuauuag

SEQ ID NO: 94907 - RNA, 19 nt, Homo sapiens
guaaagguggccucaggaa

SEQ ID NO: 94908 - RNA, 19 nt, Homo sapiens
gcccuggcuuugccuacua

SEQ ID NO: 94909 - RNA, 19 nt, Homo sapiens
gagcugaugaagccucuga

SEQ ID NO: 94910 - RNA, 19 nt, Homo sapiens
cguguggucuuaucugugu

SEQ ID NO: 94911 - RNA, 19 nt, Homo sapiens
gaacuccgggcacagaauc

SEQ ID NO: 94912 - RNA, 19 nt, Homo sapiens
uuaggguccuuuauauaga

SEQ ID NO: 94913 - RNA, 19 nt, Homo sapiens
uaggguccuuuauauagaa

SEQ ID NO: 94914 - RNA, 19 nt, Homo sapiens
ggaacauggcucacucaga

SEQ ID NO: 94915 - RNA, 19 nt, Homo sapiens
gagagggugcugaggagaa

SEQ ID NO: 94916 - RNA, 19 nt, Homo sapiens
caccgugugucuaagcaaa

SEQ ID NO: 94917 - RNA, 19 nt, Homo sapiens
agaacgauccuccacuuga

SEQ ID NO: 94918 - RNA, 19 nt, Homo sapiens
gggcaacuauaagccaaau

SEQ ID NO: 94919 - RNA, 19 nt, Homo sapiens
gcauggauucggaaggaaa

SEQ ID NO: 94920 - RNA, 19 nt, Homo sapiens
ccgugugccugaguuauuu

SEQ ID NO: 94921 - RNA, 19 nt, Homo sapiens
uaaagguggccucaggaaa

SEQ ID NO: 94922 - RNA, 19 nt, Homo sapiens
aggcagagguaaacuugga

SEQ ID NO: 94923 - RNA, 19 nt, Homo sapiens
caugauggaggcagaggua

SEQ ID NO: 94924 - RNA, 19 nt, Homo sapiens
ucacaguacaucauccaaa

SEQ ID NO: 94925 - RNA, 19 nt, Homo sapiens
uacaguggcugagaaaaua

SEQ ID NO: 94926 - RNA, 19 nt, Homo sapiens
gcagagcagagcaggguau

SEQ ID NO: 94927 - RNA, 19 nt, Homo sapiens
gcucagaacagguguccau

SEQ ID NO: 94928 - RNA, 19 nt, Homo sapiens
cagaauccuuuuccucuuu

SEQ ID NO: 94929 - RNA, 19 nt, Homo sapiens
cagcagagagagagagaga

SEQ ID NO: 94930 - RNA, 19 nt, Homo sapiens
gaaaguggagcugcaagag

SEQ ID NO: 94931 - RNA, 19 nt, Homo sapiens
cacccaagcgcauagcuaa

SEQ ID NO: 94932 - RNA, 19 nt, Homo sapiens
caaacaaaugguacaguca

SEQ ID NO: 94933 - RNA, 19 nt, Homo sapiens
acaaagaacagagcugaug

SEQ ID NO: 94934 - RNA, 19 nt, Homo sapiens
gaauguguaagaucuugga

SEQ ID NO: 94935 - RNA, 19 nt, Homo sapiens
acaaaugguacagucauaa

SEQ ID NO: 94936 - RNA, 19 nt, Homo sapiens
cccagaaccuaacauccuu

SEQ ID NO: 94937 - RNA, 19 nt, Homo sapiens
gcacagaaucuugcuucau

SEQ ID NO: 94938 - RNA, 19 nt, Homo sapiens
gcuccuuccgggacaauaa

SEQ ID NO: 94939 - RNA, 19 nt, Homo sapiens
aaaguggccaggucuauuc

SEQ ID NO: 94940 - RNA, 19 nt, Homo sapiens
ucagagcuauaugguuaga

SEQ ID NO: 94941 - RNA, 19 nt, Homo sapiens
uguuggagcccaugaagaa

SEQ ID NO: 94942 - RNA, 19 nt, Homo sapiens
caaaugguacagucauaag

SEQ ID NO: 94943 - RNA, 19 nt, Homo sapiens
uggcuuugccuacuagaaa

SEQ ID NO: 94944 - RNA, 19 nt, Homo sapiens
ucgcaguggucgcuucuuc

SEQ ID NO: 94945 - RNA, 19 nt, Homo sapiens
ugugucaguuccugccuuu

SEQ ID NO: 94946 - RNA, 19 nt, Homo sapiens
uagaagggagacuacauga

SEQ ID NO: 94947 - RNA, 19 nt, Homo sapiens
agacuaguccugagaugga

SEQ ID NO: 94948 - RNA, 19 nt, Homo sapiens
cagaagauguggaauauua

SEQ ID NO: 94949 - RNA, 19 nt, Homo sapiens
caucaagccucaucuaaua

SEQ ID NO: 94950 - RNA, 19 nt, Homo sapiens
gauaagaacucaugaaugg

SEQ ID NO: 94951 - RNA, 19 nt, Homo sapiens
gaaauuaggcgguuuauca

SEQ ID NO: 94952 - RNA, 19 nt, Homo sapiens
caggagagauucaguauuu

SEQ ID NO: 94953 - RNA, 19 nt, Homo sapiens
gaaagaaugaggccuguua

SEQ ID NO: 94954 - RNA, 19 nt, Homo sapiens
gaagagagcugaaacucau

SEQ ID NO: 94955 - RNA, 19 nt, Homo sapiens
ggaaauggauauagaugaa

SEQ ID NO: 94956 - RNA, 19 nt, Homo sapiens
gaaacaagcucuagaucau

SEQ ID NO: 94957 - RNA, 19 nt, Homo sapiens
caaaggaaauaguugcaua

SEQ ID NO: 94958 - RNA, 19 nt, Homo sapiens
cagaagacauucagcauuu

SEQ ID NO: 94959 - RNA, 19 nt, Homo sapiens
uaaauuggcuugcucauuc

SEQ ID NO: 94960 - RNA, 19 nt, Homo sapiens
caaagaagaugauuccaau

SEQ ID NO: 94961 - RNA, 19 nt, Homo sapiens
guaccgcucuccacucuua

SEQ ID NO: 94962 - RNA, 19 nt, Homo sapiens
gcacaccgauuaaagaaug

SEQ ID NO: 94963 - RNA, 19 nt, Homo sapiens
gagcauaccuggaguaguc

SEQ ID NO: 94964 - RNA, 19 nt, Homo sapiens
aaacagaucuucuaucagu

SEQ ID NO: 94965 - RNA, 19 nt, Homo sapiens
ucacucagaucaucgguua

SEQ ID NO: 94966 - RNA, 19 nt, Homo sapiens
gaaagaaagcaguauacua

SEQ ID NO: 94967 - RNA, 19 nt, Homo sapiens
gaagaaagaaagcaguaua

SEQ ID NO: 94968 - RNA, 19 nt, Homo sapiens
gaacuccucuacagaauuc

SEQ ID NO: 94969 - RNA, 19 nt, Homo sapiens
ugaaugcugugguuuauuu

SEQ ID NO: 94970 - RNA, 19 nt, Homo sapiens
gaagauggagcucucauuu

SEQ ID NO: 94971 - RNA, 19 nt, Homo sapiens
agacugaccuccauuuaaa

SEQ ID NO: 94972 - RNA, 19 nt, Homo sapiens
gcauaaagaugaagauugg

SEQ ID NO: 94973 - RNA, 19 nt, Homo sapiens
cagacuaccucaucaaauu

SEQ ID NO: 94974 - RNA, 19 nt, Homo sapiens
gaagaugauuccaauuugu

SEQ ID NO: 94975 - RNA, 19 nt, Homo sapiens
uaaggaaccugaaggagaa

SEQ ID NO: 94976 - RNA, 19 nt, Homo sapiens
ucagggagauucuuacaaa

SEQ ID NO: 94977 - RNA, 19 nt, Homo sapiens
ucaaggacuuuguucauuu

SEQ ID NO: 94978 - RNA, 19 nt, Homo sapiens
gggagaauauuaaaggauu

SEQ ID NO: 94979 - RNA, 19 nt, Homo sapiens
gaagggaggcgcaguagaa

SEQ ID NO: 94980 - RNA, 19 nt, Homo sapiens
gaagaguuaucagccauuu

SEQ ID NO: 94981 - RNA, 19 nt, Homo sapiens
ccaagcaacuguuaauguu

SEQ ID NO: 94982 - RNA, 19 nt, Homo sapiens
gaucacaggucaaauuugg

SEQ ID NO: 94983 - RNA, 19 nt, Homo sapiens
caugagggcuuagaauuaa

SEQ ID NO: 94984 - RNA, 19 nt, Homo sapiens
gaucugcaauccucaagaa

SEQ ID NO: 94985 - RNA, 19 nt, Homo sapiens
gaauggaaaugagugcuuu

SEQ ID NO: 94986 - RNA, 19 nt, Homo sapiens
gcagaaacaugauaagaac

SEQ ID NO: 94987 - RNA, 19 nt, Homo sapiens
uaaggaggaugaagaaaug

SEQ ID NO: 94988 - RNA, 19 nt, Homo sapiens
ggaggaugaugaugaagaa

SEQ ID NO: 94989 - RNA, 19 nt, Homo sapiens
gaacaacuagaacauacua

SEQ ID NO: 94990 - RNA, 19 nt, Homo sapiens
gaaaugagugcuuuacaga

SEQ ID NO: 94991 - RNA, 19 nt, Homo sapiens
gauagacacuuaacucagu

SEQ ID NO: 94992 - RNA, 19 nt, Homo sapiens
cacaagagcuggaggucua

SEQ ID NO: 94993 - RNA, 19 nt, Homo sapiens
ggaaagauuagaugcaauu

SEQ ID NO: 94994 - RNA, 19 nt, Homo sapiens
gaagaaaauucaucuguga

SEQ ID NO: 94995 - RNA, 19 nt, Homo sapiens
gcuauuaauucgccuaaga

SEQ ID NO: 94996 - RNA, 19 nt, Homo sapiens
gagaacaacuagaacauac

SEQ ID NO: 94997 - RNA, 19 nt, Homo sapiens
cagauuaguuucaauggaa

SEQ ID NO: 94998 - RNA, 19 nt, Homo sapiens
aaagggaaauucagacuug

SEQ ID NO: 94999 - RNA, 19 nt, Homo sapiens
caaagaaccaggagagauu

SEQ ID NO: 95000 - RNA, 19 nt, Homo sapiens
caagagcuaagaagaauaa

SEQ ID NO: 95001 - RNA, 19 nt, Homo sapiens
acaaauccauuccuucuga

SEQ ID NO: 95002 - RNA, 19 nt, Homo sapiens
ggacacaacugggaagaca

SEQ ID NO: 95003 - RNA, 19 nt, Homo sapiens
ggaaaugagugcuuuacag

SEQ ID NO: 95004 - RNA, 19 nt, Homo sapiens
cauacucgcugaugaaaug

SEQ ID NO: 95005 - RNA, 19 nt, Homo sapiens
ggagagauucaguauuuaa

SEQ ID NO: 95006 - RNA, 19 nt, Homo sapiens
uuccaaagcuacuuguuua

SEQ ID NO: 95007 - RNA, 19 nt, Homo sapiens
aaacugauacuucgucuuu

SEQ ID NO: 95008 - RNA, 19 nt, Homo sapiens
uauggaagcugggaaauga

SEQ ID NO: 95009 - RNA, 19 nt, Homo sapiens
gcagaaauuaggcgguuua

SEQ ID NO: 95010 - RNA, 19 nt, Homo sapiens
gggaagacaguacuacaua

SEQ ID NO: 95011 - RNA, 19 nt, Homo sapiens
caaggagucaguauuuaua

SEQ ID NO: 95012 - RNA, 19 nt, Homo sapiens
caaaggagagucccagaaa

SEQ ID NO: 95013 - RNA, 19 nt, Homo sapiens
guucuacuccuuucaauaa

SEQ ID NO: 95014 - RNA, 19 nt, Homo sapiens
ugauggagcuaaagaaaug

SEQ ID NO: 95015 - RNA, 19 nt, Homo sapiens
gaagcacaccgauuaaaga

SEQ ID NO: 95016 - RNA, 19 nt, Homo sapiens
ucaaaugaaugcugugguu

SEQ ID NO: 95017 - RNA, 19 nt, Homo sapiens
caaauagugggacguauaa

SEQ ID NO: 95018 - RNA, 19 nt, Homo sapiens
gaaaagcaguugugaugaa

SEQ ID NO: 95019 - RNA, 19 nt, Homo sapiens
gaucaaagaagacgauuag

SEQ ID NO: 95020 - RNA, 19 nt, Homo sapiens
ggaaacaagcucuagauca

SEQ ID NO: 95021 - RNA, 19 nt, Homo sapiens
gagagaauaugguuaugca

SEQ ID NO: 95022 - RNA, 19 nt, Homo sapiens
gaauauacgcaccauaaau

SEQ ID NO: 95023 - RNA, 19 nt, Homo sapiens
gcaaagaagaugauuccaa

SEQ ID NO: 95024 - RNA, 19 nt, Homo sapiens
uuacaaagcccucagcaaa

SEQ ID NO: 95025 - RNA, 19 nt, Homo sapiens
gaugaagauuggcaaaugu

SEQ ID NO: 95026 - RNA, 19 nt, Homo sapiens
caaagaagacgauuagaag

SEQ ID NO: 95027 - RNA, 19 nt, Homo sapiens
ugaugaagcacaccgauua

SEQ ID NO: 95028 - RNA, 19 nt, Homo sapiens
cugguuauccugauuauua

SEQ ID NO: 95029 - RNA, 19 nt, Homo sapiens
ggacuuuguucauuuccaa

SEQ ID NO: 95030 - RNA, 19 nt, Homo sapiens
gagaucacaggucaaauuu

SEQ ID NO: 95031 - RNA, 19 nt, Homo sapiens
guauacaaauccugaacaa

SEQ ID NO: 95032 - RNA, 19 nt, Homo sapiens
gagaauugguacauaaugg

SEQ ID NO: 95033 - RNA, 19 nt, Homo sapiens
ugaguuaguugauaaguca

SEQ ID NO: 95034 - RNA, 19 nt, Homo sapiens
aaccauugcuaccucauua

SEQ ID NO: 95035 - RNA, 19 nt, Homo sapiens
gacuugggcuucucaaaug

SEQ ID NO: 95036 - RNA, 19 nt, Homo sapiens
caacacaguaauugccuua

SEQ ID NO: 95037 - RNA, 19 nt, Homo sapiens
agaaagagaacaacuagaa

SEQ ID NO: 95038 - RNA, 19 nt, Homo sapiens
gaagaagaagaaagacaaa

SEQ ID NO: 95039 - RNA, 19 nt, Homo sapiens
aaacaguaguggagaauca

SEQ ID NO: 95040 - RNA, 19 nt, Homo sapiens
ggcaaucgaguucuuauuu

SEQ ID NO: 95041 - RNA, 19 nt, Homo sapiens
cgaucucauuucugaauua

SEQ ID NO: 95042 - RNA, 19 nt, Homo sapiens
aagcaugcauugaugagua

SEQ ID NO: 95043 - RNA, 19 nt, Homo sapiens
agcaagaacuuacagauga

SEQ ID NO: 95044 - RNA, 19 nt, Homo sapiens
ggaagucuguggagaggau

SEQ ID NO: 95045 - RNA, 19 nt, Homo sapiens
gaucaucgguuacauucag

SEQ ID NO: 95046 - RNA, 19 nt, Homo sapiens
guaaagaccaucgugauug

SEQ ID NO: 95047 - RNA, 19 nt, Homo sapiens
acacaaaggcagcucauuu

SEQ ID NO: 95048 - RNA, 19 nt, Homo sapiens
gaaacaaccugcauauuua

SEQ ID NO: 95049 - RNA, 19 nt, Homo sapiens
caagauggcucauaagaaa

SEQ ID NO: 95050 - RNA, 19 nt, Homo sapiens
gaaagggucuggagaagaa

SEQ ID NO: 95051 - RNA, 19 nt, Homo sapiens
gaacacagauauaacaaug

SEQ ID NO: 95052 - RNA, 19 nt, Homo sapiens
caagaaccaucgcgauuua

SEQ ID NO: 95053 - RNA, 19 nt, Homo sapiens
ggaaauggauauagaugaa

SEQ ID NO: 95054 - RNA, 19 nt, Homo sapiens
gaaauacgauacgggaaua

SEQ ID NO: 95055 - RNA, 19 nt, Homo sapiens
ggaagaauauccugauguu

SEQ ID NO: 95056 - RNA, 19 nt, Homo sapiens
gcacaggacuucaaagcaa

SEQ ID NO: 95057 - RNA, 19 nt, Homo sapiens
gauaaacucuuucaguguu

SEQ ID NO: 95058 - RNA, 19 nt, Homo sapiens
gaaaaggucucaagaagaa

SEQ ID NO: 95059 - RNA, 19 nt, Homo sapiens
gaaagaugauggcuuggaa

SEQ ID NO: 95060 - RNA, 19 nt, Homo sapiens
gaagguucaucaaggcuua

SEQ ID NO: 95061 - RNA, 19 nt, Homo sapiens
cuacauggaucaguaaaua

SEQ ID NO: 95062 - RNA, 19 nt, Homo sapiens
gcccaaaccucguguuaaa

SEQ ID NO: 95063 - RNA, 19 nt, Homo sapiens
gaaagugacguauacauga

SEQ ID NO: 95064 - RNA, 19 nt, Homo sapiens
ccaucgcgauuuaauauua

SEQ ID NO: 95065 - RNA, 19 nt, Homo sapiens
gugaagaggucgccauaaa

SEQ ID NO: 95066 - RNA, 19 nt, Homo sapiens
gcagagaccacgauuugua

SEQ ID NO: 95067 - RNA, 19 nt, Homo sapiens
ggagcuggcuucagaguug

SEQ ID NO: 95068 - RNA, 19 nt, Homo sapiens
gaacauggcuauggaaacu

SEQ ID NO: 95069 - RNA, 19 nt, Homo sapiens
ggacacagucgucaucuuu

SEQ ID NO: 95070 - RNA, 19 nt, Homo sapiens
agaaaucccuuccugcuaa

SEQ ID NO: 95071 - RNA, 19 nt, Homo sapiens
gaaaugggccuaggaaaga

SEQ ID NO: 95072 - RNA, 19 nt, Homo sapiens
caaaugagcccgaauaucu

SEQ ID NO: 95073 - RNA, 19 nt, Homo sapiens
ugaaaugacuggagaagga

SEQ ID NO: 95074 - RNA, 19 nt, Homo sapiens
uauacaagauggcucauaa

SEQ ID NO: 95075 - RNA, 19 nt, Homo sapiens
gaacaaggagaaacaaaug

SEQ ID NO: 95076 - RNA, 19 nt, Homo sapiens
cauaugagauccucuugaa

SEQ ID NO: 95077 - RNA, 19 nt, Homo sapiens
agaaacaaccugcauauuu

SEQ ID NO: 95078 - RNA, 19 nt, Homo sapiens
gaaagaagcagccguacug

SEQ ID NO: 95079 - RNA, 19 nt, Homo sapiens
caaaugaguucuaggaaag

SEQ ID NO: 95080 - RNA, 19 nt, Homo sapiens
gaaagaggagcauggaauu

SEQ ID NO: 95081 - RNA, 19 nt, Homo sapiens
gaagagcagcugaaagaaa

SEQ ID NO: 95082 - RNA, 19 nt, Homo sapiens
caucaaggcuuauaagaag

SEQ ID NO: 95083 - RNA, 19 nt, Homo sapiens
gcaaguagcgggucugaga

SEQ ID NO: 95084 - RNA, 19 nt, Homo sapiens
uauauuagcuugcuugaag

SEQ ID NO: 95085 - RNA, 19 nt, Homo sapiens
gugcuuaucuucucucaga

SEQ ID NO: 95086 - RNA, 19 nt, Homo sapiens
gaaccaucgcgauuuaaua

SEQ ID NO: 95087 - RNA, 19 nt, Homo sapiens
gaagaugugggaagaauau

SEQ ID NO: 95088 - RNA, 19 nt, Homo sapiens
gaugugccuugguguauuu

SEQ ID NO: 95089 - RNA, 19 nt, Homo sapiens
gcacuguaccuugaauuua

SEQ ID NO: 95090 - RNA, 19 nt, Homo sapiens
ccaacaacauguccagaaa

SEQ ID NO: 95091 - RNA, 19 nt, Homo sapiens
gaagaagcagguaaauauu

SEQ ID NO: 95092 - RNA, 19 nt, Homo sapiens
ucaaagagcucugguccuu

SEQ ID NO: 95093 - RNA, 19 nt, Homo sapiens
uaacguagugguuuacaua

SEQ ID NO: 95094 - RNA, 19 nt, Homo sapiens
gagcaucuacuacuguaua

SEQ ID NO: 95095 - RNA, 19 nt, Homo sapiens
ucucacagcucacuuguau

SEQ ID NO: 95096 - RNA, 19 nt, Homo sapiens
gaggaaaucuagugaagag

SEQ ID NO: 95097 - RNA, 19 nt, Homo sapiens
agaaggagcuagaagaaau

SEQ ID NO: 95098 - RNA, 19 nt, Homo sapiens
cagaugaacuucuaucaca

SEQ ID NO: 95099 - RNA, 19 nt, Homo sapiens
gcagagagaguuugaaauc

SEQ ID NO: 95100 - RNA, 19 nt, Homo sapiens
uauaugcgauugaagcuaa

SEQ ID NO: 95101 - RNA, 19 nt, Homo sapiens
gagaaggaguugaugaaca

SEQ ID NO: 95102 - RNA, 19 nt, Homo sapiens
guacaaggaccaccauuau

SEQ ID NO: 95103 - RNA, 19 nt, Homo sapiens
gagagagaaugaaguguca

SEQ ID NO: 95104 - RNA, 19 nt, Homo sapiens
agaagaagcagguaaauau

SEQ ID NO: 95105 - RNA, 19 nt, Homo sapiens
gaaaucccuuccugcuaaa

SEQ ID NO: 95106 - RNA, 19 nt, Homo sapiens
gaagacaaguaaaucuaca

SEQ ID NO: 95107 - RNA, 19 nt, Homo sapiens
cgaaaucaaacaaugguua

SEQ ID NO: 95108 - RNA, 19 nt, Homo sapiens
gaugagaaauaaggacaaa

SEQ ID NO: 95109 - RNA, 19 nt, Homo sapiens
ccagaaagaggccuuauga

SEQ ID NO: 95110 - RNA, 19 nt, Homo sapiens
caggagacauucagcauau

SEQ ID NO: 95111 - RNA, 19 nt, Homo sapiens
gcagagauccgaagguuca

SEQ ID NO: 95112 - RNA, 19 nt, Homo sapiens
gaaagaccauccagaccau

SEQ ID NO: 95113 - RNA, 19 nt, Homo sapiens
gaacagcagcucugaaucu

SEQ ID NO: 95114 - RNA, 19 nt, Homo sapiens
acaaaugaguucuaggaaa

SEQ ID NO: 95115 - RNA, 19 nt, Homo sapiens
aaacagacccagagcuuaa

SEQ ID NO: 95116 - RNA, 19 nt, Homo sapiens
augcugagcugguagauaa

SEQ ID NO: 95117 - RNA, 19 nt, Homo sapiens
gaugucagcccuucagaaa

SEQ ID NO: 95118 - RNA, 19 nt, Homo sapiens
gaaugaugacucuuuauug

SEQ ID NO: 95119 - RNA, 19 nt, Homo sapiens
gcacuuauaacaacauaug

SEQ ID NO: 95120 - RNA, 19 nt, Homo sapiens
ggagagugaagaauccuua

SEQ ID NO: 95121 - RNA, 19 nt, Homo sapiens
gaaauccaguaccucauca

SEQ ID NO: 95122 - RNA, 19 nt, Homo sapiens
guugauaccuccucacugu

SEQ ID NO: 95123 - RNA, 19 nt, Homo sapiens
gcuauuuacuugcauuguu

SEQ ID NO: 95124 - RNA, 19 nt, Homo sapiens
caagagauaacuacaauca

SEQ ID NO: 95125 - RNA, 19 nt, Homo sapiens
gaagaaagacgacgugacu

SEQ ID NO: 95126 - RNA, 19 nt, Homo sapiens
gcagaaggagcuagaagaa

SEQ ID NO: 95127 - RNA, 19 nt, Homo sapiens
gauuucaaguccaaccaua

SEQ ID NO: 95128 - RNA, 19 nt, Homo sapiens
uaaacuggcuagcucauuc

SEQ ID NO: 95129 - RNA, 19 nt, Homo sapiens
uaaagaaacaaccugcaua

SEQ ID NO: 95130 - RNA, 19 nt, Homo sapiens
ccaaagcuuuacauuguga

SEQ ID NO: 95131 - RNA, 19 nt, Homo sapiens
gggagaaagugacguauac

SEQ ID NO: 95132 - RNA, 19 nt, Homo sapiens
gggaggaggccaaauuaaa

SEQ ID NO: 95133 - RNA, 19 nt, Homo sapiens
ugucagcaaugcaggaaua

SEQ ID NO: 95134 - RNA, 19 nt, Homo sapiens
gcacaagcccgagcgcaua

SEQ ID NO: 95135 - RNA, 19 nt, Homo sapiens
gaccugaugagcagaaaua

SEQ ID NO: 95136 - RNA, 19 nt, Homo sapiens
gcccgaauaucuauguaaa

SEQ ID NO: 95137 - RNA, 19 nt, Homo sapiens
cugcgaaucuuaucacuug

SEQ ID NO: 95138 - RNA, 19 nt, Homo sapiens
gguacaaggaccaccauua

SEQ ID NO: 95139 - RNA, 19 nt, Homo sapiens
ugaaauccauuauccaaca

SEQ ID NO: 95140 - RNA, 19 nt, Homo sapiens
ggaagacucugaugaugac

SEQ ID NO: 95141 - RNA, 19 nt, Homo sapiens
caaaugacagugacucuga

SEQ ID NO: 95142 - RNA, 19 nt, Homo sapiens
aaccauaggcuccugauua

SEQ ID NO: 95143 - RNA, 19 nt, Homo sapiens
ccgaauaucuauguaaaug

SEQ ID NO: 95144 - RNA, 19 nt, Homo sapiens
ugaagaagaugugggaaga

SEQ ID NO: 95145 - RNA, 19 nt, Homo sapiens
agauguaccucugcuauuu

SEQ ID NO: 95146 - RNA, 19 nt, Homo sapiens
gcccugcguucuucuagua

SEQ ID NO: 95147 - RNA, 19 nt, Homo sapiens
gaugccaaaucuucgagua

SEQ ID NO: 95148 - RNA, 19 nt, Homo sapiens
caagauagaucauaaguug

SEQ ID NO: 95149 - RNA, 19 nt, Homo sapiens
gaacagaagucaucagcaa

SEQ ID NO: 95150 - RNA, 19 nt, Homo sapiens
ucaagaaacugcaugauuu

SEQ ID NO: 95151 - RNA, 19 nt, Homo sapiens
ccaacaaagugaugauuua

SEQ ID NO: 95152 - RNA, 19 nt, Homo sapiens
gaauaucccugaauacgaa

SEQ ID NO: 95153 - RNA, 19 nt, Homo sapiens
ggaggaagaugaaaugaau

SEQ ID NO: 95154 - RNA, 19 nt, Homo sapiens
aaaggaggcucguauguuu

SEQ ID NO: 95155 - RNA, 19 nt, Homo sapiens
gcaagaagcgugacaguga

SEQ ID NO: 95156 - RNA, 19 nt, Homo sapiens
ccagaaugaugcucaauuu

SEQ ID NO: 95157 - RNA, 19 nt, Homo sapiens
gagaagaacagcagaauug

SEQ ID NO: 95158 - RNA, 19 nt, Homo sapiens
ggacaccucuugagaagga

SEQ ID NO: 95159 - RNA, 19 nt, Homo sapiens
gcaagcaaguuaacuacaa

SEQ ID NO: 95160 - RNA, 19 nt, Homo sapiens
caaguuaacuacaaugaug

SEQ ID NO: 95161 - RNA, 19 nt, Homo sapiens
gaacaaccaguccaaguuu

SEQ ID NO: 95162 - RNA, 19 nt, Homo sapiens
gaaauccagugacgaaugu

SEQ ID NO: 95163 - RNA, 19 nt, Homo sapiens
caagaaagcuuuuaagaug

SEQ ID NO: 95164 - RNA, 19 nt, Homo sapiens
gaaagaugaugcugacaca

SEQ ID NO: 95165 - RNA, 19 nt, Homo sapiens
ggaggaguuugcugacaua

SEQ ID NO: 95166 - RNA, 19 nt, Homo sapiens
ggaggaauauuuagguaau

SEQ ID NO: 95167 - RNA, 19 nt, Homo sapiens
gggagaagauggagacaga

SEQ ID NO: 95168 - RNA, 19 nt, Homo sapiens
gcacauguaucaguuggaa

SEQ ID NO: 95169 - RNA, 19 nt, Homo sapiens
gcaaguauaagaagaagaa

SEQ ID NO: 95170 - RNA, 19 nt, Homo sapiens
ggaggaggaugaucacaug

SEQ ID NO: 95171 - RNA, 19 nt, Homo sapiens
ggaagaagaagaauacgaa

SEQ ID NO: 95172 - RNA, 19 nt, Homo sapiens
ucacagagcuucacacacu

SEQ ID NO: 95173 - RNA, 19 nt, Homo sapiens
ugacgacauucucaaauuu

SEQ ID NO: 95174 - RNA, 19 nt, Homo sapiens
ggagggacuuaccauauga

SEQ ID NO: 95175 - RNA, 19 nt, Homo sapiens
gaggaggaauauuuaggua

SEQ ID NO: 95176 - RNA, 19 nt, Homo sapiens
gcacagaagacaugacuau

SEQ ID NO: 95177 - RNA, 19 nt, Homo sapiens
gaagaaaggaggcucguau

SEQ ID NO: 95178 - RNA, 19 nt, Homo sapiens
ugacgaaugugguauacaa

SEQ ID NO: 95179 - RNA, 19 nt, Homo sapiens
gcagggagaugggaauaga

SEQ ID NO: 95180 - RNA, 19 nt, Homo sapiens
ggcaggacauccagaauga

SEQ ID NO: 95181 - RNA, 19 nt, Homo sapiens
gaggagaaguacuaucguu

SEQ ID NO: 95182 - RNA, 19 nt, Homo sapiens
cgacaagcguaaagugaaa

SEQ ID NO: 95183 - RNA, 19 nt, Homo sapiens
ggaagaaugacauggauga

SEQ ID NO: 95184 - RNA, 19 nt, Homo sapiens
gaaaggaggcucguauguu

SEQ ID NO: 95185 - RNA, 19 nt, Homo sapiens
gcaaaucuaccacaacuuc

SEQ ID NO: 95186 - RNA, 19 nt, Homo sapiens
ggaacuuucuggagaugaa

SEQ ID NO: 95187 - RNA, 19 nt, Homo sapiens
gggaaauuauucuguguga

SEQ ID NO: 95188 - RNA, 19 nt, Homo sapiens
ccagagagauuuaacaacu

SEQ ID NO: 95189 - RNA, 19 nt, Homo sapiens
ucucaaugguuacaagaua

SEQ ID NO: 95190 - RNA, 19 nt, Homo sapiens
gaaauuauucugugugaca

SEQ ID NO: 95191 - RNA, 19 nt, Homo sapiens
agacggcucugaaaccuuu

SEQ ID NO: 95192 - RNA, 19 nt, Homo sapiens
ucaggguucucaaugguua

SEQ ID NO: 95193 - RNA, 19 nt, Homo sapiens
cauaagaggcggaguaaga

SEQ ID NO: 95194 - RNA, 19 nt, Homo sapiens
gaaaggagaaggcauaagg

SEQ ID NO: 95195 - RNA, 19 nt, Homo sapiens
gagcgagaguucuuuguca

SEQ ID NO: 95196 - RNA, 19 nt, Homo sapiens
agacggaucaccaggauua

SEQ ID NO: 95197 - RNA, 19 nt, Homo sapiens
gaugcucaauuugccauua

SEQ ID NO: 95198 - RNA, 19 nt, Homo sapiens
gcagaagaaauacuacaaa

SEQ ID NO: 95199 - RNA, 19 nt, Homo sapiens
gaacaugccagccaagaca

SEQ ID NO: 95200 - RNA, 19 nt, Homo sapiens
gaaaauggcaccacucaaa

SEQ ID NO: 95201 - RNA, 19 nt, Homo sapiens
uaagaagaauccuaagauc

SEQ ID NO: 95202 - RNA, 19 nt, Homo sapiens
ccaagaagcagaaggagaa

SEQ ID NO: 95203 - RNA, 19 nt, Homo sapiens
gaacaugaaugaguaucuc

SEQ ID NO: 95204 - RNA, 19 nt, Homo sapiens
ugauggaucuuaagaagug

SEQ ID NO: 95205 - RNA, 19 nt, Homo sapiens
ggagaugggaauagaauug

SEQ ID NO: 95206 - RNA, 19 nt, Homo sapiens
gaggcacccugcacaugua

SEQ ID NO: 95207 - RNA, 19 nt, Homo sapiens
gcaaagguccaggccauaa

SEQ ID NO: 95208 - RNA, 19 nt, Homo sapiens
cagaagacaugacuauugg

SEQ ID NO: 95209 - RNA, 19 nt, Homo sapiens
gcaggagcuugacgacauu

SEQ ID NO: 95210 - RNA, 19 nt, Homo sapiens
caaggcagaugucuuuaag

SEQ ID NO: 95211 - RNA, 19 nt, Homo sapiens
gaaaugaauaucccugaau

SEQ ID NO: 95212 - RNA, 19 nt, Homo sapiens
ugaaccagcuggaggaguu

SEQ ID NO: 95213 - RNA, 19 nt, Homo sapiens
gggaauagaauugaaggua

SEQ ID NO: 95214 - RNA, 19 nt, Homo sapiens
caaugaugcugcucaggaa

SEQ ID NO: 95215 - RNA, 19 nt, Homo sapiens
acagcagugugauucauua

SEQ ID NO: 95216 - RNA, 19 nt, Homo sapiens
gaaacuaccagcggaagaa

SEQ ID NO: 95217 - RNA, 19 nt, Homo sapiens
gaaggaagaagaagaaggu

SEQ ID NO: 95218 - RNA, 19 nt, Homo sapiens
gcaagaagcuucggggaaa

SEQ ID NO: 95219 - RNA, 19 nt, Homo sapiens
ugagaaaggagaaggcaua

SEQ ID NO: 95220 - RNA, 19 nt, Homo sapiens
agucaugucucucgucaaa

SEQ ID NO: 95221 - RNA, 19 nt, Homo sapiens
ccaguucucccacuaauga

SEQ ID NO: 95222 - RNA, 19 nt, Homo sapiens
ggugagaucgggaaacaaa

SEQ ID NO: 95223 - RNA, 19 nt, Homo sapiens
gaucagagcgagaguucuu

SEQ ID NO: 95224 - RNA, 19 nt, Homo sapiens
cgacgaagguccugaacca

SEQ ID NO: 95225 - RNA, 19 nt, Homo sapiens
agacugagaaggaguuuaa

SEQ ID NO: 95226 - RNA, 19 nt, Homo sapiens
gggaagaagacaagauuga

SEQ ID NO: 95227 - RNA, 19 nt, Homo sapiens
gcagaugaccaaaauguua

SEQ ID NO: 95228 - RNA, 19 nt, Homo sapiens
ccagggcacugacaccauu

SEQ ID NO: 95229 - RNA, 19 nt, Homo sapiens
ggaggaagaagaagaauac

SEQ ID NO: 95230 - RNA, 19 nt, Homo sapiens
ggaguuugcugacauaucc

SEQ ID NO: 95231 - RNA, 19 nt, Homo sapiens
gagcgggaguuccagaugu

SEQ ID NO: 95232 - RNA, 19 nt, Homo sapiens
caagcaaguuaacuacaau

SEQ ID NO: 95233 - RNA, 19 nt, Homo sapiens
caugauggaucuuaagaag

SEQ ID NO: 95234 - RNA, 19 nt, Homo sapiens
cguaugagcugaucaccau

SEQ ID NO: 95235 - RNA, 19 nt, Homo sapiens
ugaggacaaugccaucaaa

SEQ ID NO: 95236 - RNA, 19 nt, Homo sapiens
cauucuagcugaugagaug

SEQ ID NO: 95237 - RNA, 19 nt, Homo sapiens
caggauaucuggaacaaaa

SEQ ID NO: 95238 - RNA, 19 nt, Homo sapiens
gaagagcgaaucacacaag

SEQ ID NO: 95239 - RNA, 19 nt, Homo sapiens
gcgcaucgauggugguauc

SEQ ID NO: 95240 - RNA, 19 nt, Homo sapiens
caagaaacugcaugauuug

SEQ ID NO: 95241 - RNA, 19 nt, Homo sapiens
agagagauuuaacaacuug

SEQ ID NO: 95242 - RNA, 19 nt, Homo sapiens
ugaaaugaauaucccugaa

SEQ ID NO: 95243 - RNA, 19 nt, Homo sapiens
ugcagaagauccuacauug

SEQ ID NO: 95244 - RNA, 19 nt, Homo sapiens
cuaagucuguaaacuguga

SEQ ID NO: 95245 - RNA, 19 nt, Homo sapiens
ccagaaauccagugacgaa

SEQ ID NO: 95246 - RNA, 19 nt, Homo sapiens
agaggcagcuccggaauga

SEQ ID NO: 95247 - RNA, 19 nt, Homo sapiens
agacaagauugaggaaauu

SEQ ID NO: 95248 - RNA, 19 nt, Homo sapiens
gaacugcucugcugugaua

SEQ ID NO: 95249 - RNA, 19 nt, Homo sapiens
gaacaaggacccuaaauuu

SEQ ID NO: 95250 - RNA, 19 nt, Homo sapiens
gaagagacaugcagcagua

SEQ ID NO: 95251 - RNA, 19 nt, Homo sapiens
gcaagaagcucaagaaggu

SEQ ID NO: 95252 - RNA, 19 nt, Homo sapiens
gcaagaagguucaggaguu

SEQ ID NO: 95253 - RNA, 19 nt, Homo sapiens
gaaagaagaagaagagaaa

SEQ ID NO: 95254 - RNA, 19 nt, Homo sapiens
gaaaguagcuccccugaaa

SEQ ID NO: 95255 - RNA, 19 nt, Homo sapiens
ccaaggaccugaaugauga

SEQ ID NO: 95256 - RNA, 19 nt, Homo sapiens
ggaaggugaugaagacuuu

SEQ ID NO: 95257 - RNA, 19 nt, Homo sapiens
gaauugguguuaugucuuu

SEQ ID NO: 95258 - RNA, 19 nt, Homo sapiens
guaaacaggucaacuacaa

SEQ ID NO: 95259 - RNA, 19 nt, Homo sapiens
gaagaggauuugucagaaa

SEQ ID NO: 95260 - RNA, 19 nt, Homo sapiens
caaaggugcugcugaugua

SEQ ID NO: 95261 - RNA, 19 nt, Homo sapiens
gaaagaggcaucugugaaa

SEQ ID NO: 95262 - RNA, 19 nt, Homo sapiens
gcaauuaugcgauauggua

SEQ ID NO: 95263 - RNA, 19 nt, Homo sapiens
gagugaggaugaugacuua

SEQ ID NO: 95264 - RNA, 19 nt, Homo sapiens
agaaagaguucaaggcaua

SEQ ID NO: 95265 - RNA, 19 nt, Homo sapiens
gaugauauccucaaauuug

SEQ ID NO: 95266 - RNA, 19 nt, Homo sapiens
gaaaugaaccguggcaauu

SEQ ID NO: 95267 - RNA, 19 nt, Homo sapiens
ggcaagacauccagaauga

SEQ ID NO: 95268 - RNA, 19 nt, Homo sapiens
gcaagaagaagaagaagaa

SEQ ID NO: 95269 - RNA, 19 nt, Homo sapiens
caagaagacuuaugagauc

SEQ ID NO: 95270 - RNA, 19 nt, Homo sapiens
guaaugaucuaccgguuug

SEQ ID NO: 95271 - RNA, 19 nt, Homo sapiens
uagcagagcucaccggauu

SEQ ID NO: 95272 - RNA, 19 nt, Homo sapiens
gggcaugaaugaauauuug

SEQ ID NO: 95273 - RNA, 19 nt, Homo sapiens
gaaagaacaaggacccuaa

SEQ ID NO: 95274 - RNA, 19 nt, Homo sapiens
ggaccugaaugaugagaaa

SEQ ID NO: 95275 - RNA, 19 nt, Homo sapiens
caaaggagccuaaaucauc

SEQ ID NO: 95276 - RNA, 19 nt, Homo sapiens
ccacugagcggcuaaauga

SEQ ID NO: 95277 - RNA, 19 nt, Homo sapiens
ggaaaucauuaaacaggaa

SEQ ID NO: 95278 - RNA, 19 nt, Homo sapiens
agaagaagcuuggaccuaa

SEQ ID NO: 95279 - RNA, 19 nt, Homo sapiens
gcucaaagccgauguguuc

SEQ ID NO: 95280 - RNA, 19 nt, Homo sapiens
uggaagaacugcugaguga

SEQ ID NO: 95281 - RNA, 19 nt, Homo sapiens
gaacaugcccuccaagaca

SEQ ID NO: 95282 - RNA, 19 nt, Homo sapiens
ggacuuaccuuacgaucag

SEQ ID NO: 95283 - RNA, 19 nt, Homo sapiens
ggacuuugguggugaugaa

SEQ ID NO: 95284 - RNA, 19 nt, Homo sapiens
gcuaugccauccucaauga

SEQ ID NO: 95285 - RNA, 19 nt, Homo sapiens
ggaagaaugauauggauga

SEQ ID NO: 95286 - RNA, 19 nt, Homo sapiens
ugacugcuguggaugguua

SEQ ID NO: 95287 - RNA, 19 nt, Homo sapiens
gaagaaagaagaagaagag

SEQ ID NO: 95288 - RNA, 19 nt, Homo sapiens
caagaagguucaggaguuu

SEQ ID NO: 95289 - RNA, 19 nt, Homo sapiens
gcuagaggauuucuuggaa

SEQ ID NO: 95290 - RNA, 19 nt, Homo sapiens
caaggagggucauuccaaa

SEQ ID NO: 95291 - RNA, 19 nt, Homo sapiens
gagcggcaguucuuuguga

SEQ ID NO: 95292 - RNA, 19 nt, Homo sapiens
guaagggccugcggaauga

SEQ ID NO: 95293 - RNA, 19 nt, Homo sapiens
cuccaaagcucaagaagaa

SEQ ID NO: 95294 - RNA, 19 nt, Homo sapiens
cagcaaauuucuugaugaa

SEQ ID NO: 95295 - RNA, 19 nt, Homo sapiens
gaaccguggcaauuucuua

SEQ ID NO: 95296 - RNA, 19 nt, Homo sapiens
gaaaauagccucaaagaag

SEQ ID NO: 95297 - RNA, 19 nt, Homo sapiens
caacaaagagggagaagau

SEQ ID NO: 95298 - RNA, 19 nt, Homo sapiens
ggacagccgugccaucauc

SEQ ID NO: 95299 - RNA, 19 nt, Homo sapiens
gaacagaggaaccuaugga

SEQ ID NO: 95300 - RNA, 19 nt, Homo sapiens
guagaacgggaaaucauua

SEQ ID NO: 95301 - RNA, 19 nt, Homo sapiens
aacaggagcuugaugauau

SEQ ID NO: 95302 - RNA, 19 nt, Homo sapiens
ucacgcagguggcaaagaa

SEQ ID NO: 95303 - RNA, 19 nt, Homo sapiens
ugaaacagcuggaagaacu

SEQ ID NO: 95304 - RNA, 19 nt, Homo sapiens
gcacaaaguucugaaacag

SEQ ID NO: 95305 - RNA, 19 nt, Homo sapiens
gguguuaugucuuugauuc

SEQ ID NO: 95306 - RNA, 19 nt, Homo sapiens
ggagaagauagcaguguua

SEQ ID NO: 95307 - RNA, 19 nt, Homo sapiens
gcugacauccuaugaauug

SEQ ID NO: 95308 - RNA, 19 nt, Homo sapiens
ggaggaggaugaugaugau

SEQ ID NO: 95309 - RNA, 19 nt, Homo sapiens
caugaaagcugaugugacu

SEQ ID NO: 95310 - RNA, 19 nt, Homo sapiens
ggaggaguuugcugacauu

SEQ ID NO: 95311 - RNA, 19 nt, Homo sapiens
gcugcuagccggcauuaua

SEQ ID NO: 95312 - RNA, 19 nt, Homo sapiens
agaacaagcucuggugauu

SEQ ID NO: 95313 - RNA, 19 nt, Homo sapiens
caaagaagaagagagcaua

SEQ ID NO: 95314 - RNA, 19 nt, Homo sapiens
aauggaagcuccuaagaug

SEQ ID NO: 95315 - RNA, 19 nt, Homo sapiens
ugauggaucuuaagaagug

SEQ ID NO: 95316 - RNA, 19 nt, Homo sapiens
gguauugaaugguuacuca

SEQ ID NO: 95317 - RNA, 19 nt, Homo sapiens
gaaacuaucagcggaagaa

SEQ ID NO: 95318 - RNA, 19 nt, Homo sapiens
ggaggugacugcuguggau

SEQ ID NO: 95319 - RNA, 19 nt, Homo sapiens
gaaacaagccagccaaugc

SEQ ID NO: 95320 - RNA, 19 nt, Homo sapiens
gcugagaccuuugcugaug

SEQ ID NO: 95321 - RNA, 19 nt, Homo sapiens
gcaaaucagagaaagaguu

SEQ ID NO: 95322 - RNA, 19 nt, Homo sapiens
ccgagagguuccacaauuu

SEQ ID NO: 95323 - RNA, 19 nt, Homo sapiens
aagcagagcuauuggaauc

SEQ ID NO: 95324 - RNA, 19 nt, Homo sapiens
cagcauguccuuacuagaa

SEQ ID NO: 95325 - RNA, 19 nt, Homo sapiens
aagaagaucuagcccgaaa

SEQ ID NO: 95326 - RNA, 19 nt, Homo sapiens
ggaugagacugaagacaca

SEQ ID NO: 95327 - RNA, 19 nt, Homo sapiens
gccauugccuccucuguug

SEQ ID NO: 95328 - RNA, 19 nt, Homo sapiens
gggagaagauagcaguguu

SEQ ID NO: 95329 - RNA, 19 nt, Homo sapiens
ggugauggaucuuaagaag

SEQ ID NO: 95330 - RNA, 19 nt, Homo sapiens
gcagugaggaggaggauau

SEQ ID NO: 95331 - RNA, 19 nt, Homo sapiens
gaagaacaaucagucuaag

SEQ ID NO: 95332 - RNA, 19 nt, Homo sapiens
ugaagaacaaucagucuaa

SEQ ID NO: 95333 - RNA, 19 nt, Homo sapiens
aagaaggccucccgcauga

SEQ ID NO: 95334 - RNA, 19 nt, Homo sapiens
ccaaacaggagcuugauga

SEQ ID NO: 95335 - RNA, 19 nt, Homo sapiens
gagcaucugggaaauuauu

SEQ ID NO: 95336 - RNA, 19 nt, Homo sapiens
cagaagaaauacuacaagu

SEQ ID NO: 95337 - RNA, 19 nt, Homo sapiens
ucaagaacaugcccuccaa

SEQ ID NO: 95338 - RNA, 19 nt, Homo sapiens
ccaaggaggaccagauaaa

SEQ ID NO: 95339 - RNA, 19 nt, Homo sapiens
gcaaggcggugagaucauc

SEQ ID NO: 95340 - RNA, 19 nt, Homo sapiens
gaagaagcuuggaccuaag

SEQ ID NO: 95341 - RNA, 19 nt, Homo sapiens
gaagaacugcugagugaca

SEQ ID NO: 95342 - RNA, 19 nt, Homo sapiens
uugcugagguggaguguuu

SEQ ID NO: 95343 - RNA, 19 nt, Homo sapiens
aacaagcucuggugauuga

SEQ ID NO: 95344 - RNA, 19 nt, Homo sapiens
gaacaagcucuggugauug

SEQ ID NO: 95345 - RNA, 19 nt, Homo sapiens
ccaagaagacuuaugagau

SEQ ID NO: 95346 - RNA, 19 nt, Homo sapiens
gaauugaucaccauugaca

SEQ ID NO: 95347 - RNA, 19 nt, Homo sapiens
ggaggaugaugaugaugau

SEQ ID NO: 95348 - RNA, 19 nt, Homo sapiens
gaagagagaagacauauuc

SEQ ID NO: 95349 - RNA, 19 nt, Homo sapiens
gaagacauauucuacacuu

SEQ ID NO: 95350 - RNA, 19 nt, Homo sapiens
ccagaaagcaaacauaaua

SEQ ID NO: 95351 - RNA, 19 nt, Homo sapiens
gcaaagaaacacaaacaaa

SEQ ID NO: 95352 - RNA, 19 nt, Homo sapiens
gauauguugucauggauuu

SEQ ID NO: 95353 - RNA, 19 nt, Homo sapiens
gcaggcagcuggagaugau

SEQ ID NO: 95354 - RNA, 19 nt, Homo sapiens
ggacuauguugaccucuau

SEQ ID NO: 95355 - RNA, 19 nt, Homo sapiens
ugaaagaaguggcaagcaa

SEQ ID NO: 95356 - RNA, 19 nt, Homo sapiens
gcaaacugcuggauuucug

SEQ ID NO: 95357 - RNA, 19 nt, Homo sapiens
gcuaaaugauggucacuuc

SEQ ID NO: 95358 - RNA, 19 nt, Homo sapiens
acacacagccucugguuaa

SEQ ID NO: 95359 - RNA, 19 nt, Homo sapiens
gcaaccagguagaauguca

SEQ ID NO: 95360 - RNA, 19 nt, Homo sapiens
caauggaucccaaauauca

SEQ ID NO: 95361 - RNA, 19 nt, Homo sapiens
gaaagaaguggcaagcaau

SEQ ID NO: 95362 - RNA, 19 nt, Homo sapiens
gauaugaaaguucuagaug

SEQ ID NO: 95363 - RNA, 19 nt, Homo sapiens
cuguagaggucaccaaauu

SEQ ID NO: 95364 - RNA, 19 nt, Homo sapiens
gagagaacauccagguuuu

SEQ ID NO: 95365 - RNA, 19 nt, Homo sapiens
ucagcuagcuagauauauc

SEQ ID NO: 95366 - RNA, 19 nt, Homo sapiens
caaagaaacacaaacaaac

SEQ ID NO: 95367 - RNA, 19 nt, Homo sapiens
gguagaaugucauccuuac

SEQ ID NO: 95368 - RNA, 19 nt, Homo sapiens
guguaaggaugcaggauug

SEQ ID NO: 95369 - RNA, 19 nt, Homo sapiens
ccauauugauucugcuuau

SEQ ID NO: 95370 - RNA, 19 nt, Homo sapiens
ggucuaaacagaaauuauc

SEQ ID NO: 95371 - RNA, 19 nt, Homo sapiens
caucagaggauaugaaagu

SEQ ID NO: 95372 - RNA, 19 nt, Homo sapiens
agcaauggaucccaaauau

SEQ ID NO: 95373 - RNA, 19 nt, Homo sapiens
gcagauggcagugugaaga

SEQ ID NO: 95374 - RNA, 19 nt, Homo sapiens
ggacacacagccucugguu

SEQ ID NO: 95375 - RNA, 19 nt, Homo sapiens
gacaucagaggauaugaaa

SEQ ID NO: 95376 - RNA, 19 nt, Homo sapiens
agagagaacauccagguuu

SEQ ID NO: 95377 - RNA, 19 nt, Homo sapiens
caaauuagcaauagaagcu

SEQ ID NO: 95378 - RNA, 19 nt, Homo sapiens
ggucaccaaauuagcaaua

SEQ ID NO: 95379 - RNA, 19 nt, Homo sapiens
gagcagcggaucagagaga

SEQ ID NO: 95380 - RNA, 19 nt, Homo sapiens
guccagaaagcaaacauaa

SEQ ID NO: 95381 - RNA, 19 nt, Homo sapiens
cagaggauaugaaaguucu

SEQ ID NO: 95382 - RNA, 19 nt, Homo sapiens
gcuggugacuggacacaca

SEQ ID NO: 95383 - RNA, 19 nt, Homo sapiens
caacaagccaggacucaag

SEQ ID NO: 95384 - RNA, 19 nt, Homo sapiens
gacauauucuacacuucaa

SEQ ID NO: 95385 - RNA, 19 nt, Homo sapiens
guagaggucaccaaauuag

SEQ ID NO: 95386 - RNA, 19 nt, Homo sapiens
uaugaaaguucuagauggu

SEQ ID NO: 95387 - RNA, 19 nt, Homo sapiens
ccaaauaucagcguguaga

SEQ ID NO: 95388 - RNA, 19 nt, Homo sapiens
ggaggacccaguucuuugu

SEQ ID NO: 95389 - RNA, 19 nt, Homo sapiens
ucaccaaauuagcaauaga

SEQ ID NO: 95390 - RNA, 19 nt, Homo sapiens
aagcaauggaucccaaaua

SEQ ID NO: 95391 - RNA, 19 nt, Homo sapiens
gcaauggaucccaaauauc

SEQ ID NO: 95392 - RNA, 19 nt, Homo sapiens
aacuucagcuagcuagaua

SEQ ID NO: 95393 - RNA, 19 nt, Homo sapiens
ggaccauccugauuaucca

SEQ ID NO: 95394 - RNA, 19 nt, Homo sapiens
ggauaugaaaguucuagau

SEQ ID NO: 95395 - RNA, 19 nt, Homo sapiens
caguugacaucagaggaua

SEQ ID NO: 95396 - RNA, 19 nt, Homo sapiens
uguagaggucaccaaauua

SEQ ID NO: 95397 - RNA, 19 nt, Homo sapiens
gacacacagccucugguua

SEQ ID NO: 95398 - RNA, 19 nt, Homo sapiens
ggauggugaugcagaggau

SEQ ID NO: 95399 - RNA, 19 nt, Homo sapiens
ggacuggccauccgaagca

SEQ ID NO: 95400 - RNA, 19 nt, Homo sapiens
cacagccucugguuaaauc

SEQ ID NO: 95401 - RNA, 19 nt, Homo sapiens
gauggucuaaacagaaauu

SEQ ID NO: 95402 - RNA, 19 nt, Homo sapiens
gcaagcaauggaucccaaa

SEQ ID NO: 95403 - RNA, 19 nt, Homo sapiens
guugaccucuaucuucuuc

SEQ ID NO: 95404 - RNA, 19 nt, Homo sapiens
gguccagaaagcaaacaua

SEQ ID NO: 95405 - RNA, 19 nt, Homo sapiens
ugacaucagaggauaugaa

SEQ ID NO: 95406 - RNA, 19 nt, Homo sapiens
uagcaaagaaacacaaaca

SEQ ID NO: 95407 - RNA, 19 nt, Homo sapiens
gggaggucauggagaagug

SEQ ID NO: 95408 - RNA, 19 nt, Homo sapiens
ccauccugauuauccauuu

SEQ ID NO: 95409 - RNA, 19 nt, Homo sapiens
cagguagaaugucauccuu

SEQ ID NO: 95410 - RNA, 19 nt, Homo sapiens
agccaggacucaaguacaa

SEQ ID NO: 95411 - RNA, 19 nt, Homo sapiens
agacauauucuacacuuca

SEQ ID NO: 95412 - RNA, 19 nt, Homo sapiens
ggaucugcuuagugaaaga

SEQ ID NO: 95413 - RNA, 19 nt, Homo sapiens
gaaguggcaagcaauggau

SEQ ID NO: 95414 - RNA, 19 nt, Homo sapiens
gaacccaacgacauaaacu

SEQ ID NO: 95415 - RNA, 19 nt, Homo sapiens
ggagaugauccucaacaag

SEQ ID NO: 95416 - RNA, 19 nt, Homo sapiens
uuggaaagcucacugaaaa

SEQ ID NO: 95417 - RNA, 19 nt, Homo sapiens
caccaaauuagcaauagaa

SEQ ID NO: 95418 - RNA, 19 nt, Homo sapiens
ucccaaauaucagcgugua

SEQ ID NO: 95419 - RNA, 19 nt, Homo sapiens
ggagaaguguaaggaugca

SEQ ID NO: 95420 - RNA, 19 nt, Homo sapiens
ggugagacgccacuaccaa

SEQ ID NO: 95421 - RNA, 19 nt, Homo sapiens
uggagaugauccucaacaa

SEQ ID NO: 95422 - RNA, 19 nt, Homo sapiens
gugagacgccacuaccaaa

SEQ ID NO: 95423 - RNA, 19 nt, Homo sapiens
uggacuauguugaccucua

SEQ ID NO: 95424 - RNA, 19 nt, Homo sapiens
cuucagcuagcuagauaua

SEQ ID NO: 95425 - RNA, 19 nt, Homo sapiens
caacuucagcuagcuagau

SEQ ID NO: 95426 - RNA, 19 nt, Homo sapiens
gauuauccauuuucagaug

SEQ ID NO: 95427 - RNA, 19 nt, Homo sapiens
gaauuccaguugacaucag

SEQ ID NO: 95428 - RNA, 19 nt, Homo sapiens
accucuaucuucuucauuu

SEQ ID NO: 95429 - RNA, 19 nt, Homo sapiens
auauauccaugguccagaa

SEQ ID NO: 95430 - RNA, 19 nt, Homo sapiens
cacacagccucugguuaaa

SEQ ID NO: 95431 - RNA, 19 nt, Homo sapiens
gaugaauauuagcauagag

SEQ ID NO: 95432 - RNA, 19 nt, Homo sapiens
uuaucgauauguugucaug

SEQ ID NO: 95433 - RNA, 19 nt, Homo sapiens
gggaacccaacgacauaaa

SEQ ID NO: 95434 - RNA, 19 nt, Homo sapiens
uauguugaccucuaucuuc

SEQ ID NO: 95435 - RNA, 19 nt, Homo sapiens
caaccagccuuggaaagcu

SEQ ID NO: 95436 - RNA, 19 nt, Homo sapiens
uggccaagagcuacaauga

SEQ ID NO: 95437 - RNA, 19 nt, Homo sapiens
aaagaaguggcaagcaaug

SEQ ID NO: 95438 - RNA, 19 nt, Homo sapiens
gccauauugauucugcuua

SEQ ID NO: 95439 - RNA, 19 nt, Homo sapiens
ugaccucuaucuucuucau

SEQ ID NO: 95440 - RNA, 19 nt, Homo sapiens
auucuacacuucaaagcuu

SEQ ID NO: 95441 - RNA, 19 nt, Homo sapiens
gugaagagagaagacauau

SEQ ID NO: 95442 - RNA, 19 nt, Homo sapiens
ugucauggauuuucuuaug

SEQ ID NO: 95443 - RNA, 19 nt, Homo sapiens
ucacuucaugcccguauug

SEQ ID NO: 95444 - RNA, 19 nt, Homo sapiens
ugugaagagagaagacaua

SEQ ID NO: 95445 - RNA, 19 nt, Homo sapiens
cagaugaauauuagcauag

SEQ ID NO: 95446 - RNA, 19 nt, Homo sapiens
ugaagagagaagacauauu

SEQ ID NO: 95447 - RNA, 19 nt, Homo sapiens
cccaguucuuugugccuua

SEQ ID NO: 95448 - RNA, 19 nt, Homo sapiens
ccaaacaucuuccaauuua

SEQ ID NO: 95449 - RNA, 19 nt, Homo sapiens
gcacaggucuuuccuuaug

SEQ ID NO: 95450 - RNA, 19 nt, Homo sapiens
caagaugugugguacuuua

SEQ ID NO: 95451 - RNA, 19 nt, Homo sapiens
caaauuggaugcagacaaa

SEQ ID NO: 95452 - RNA, 19 nt, Homo sapiens
gaaagagacuugugagaag

SEQ ID NO: 95453 - RNA, 19 nt, Homo sapiens
gaguggcgauugugauuua

SEQ ID NO: 95454 - RNA, 19 nt, Homo sapiens
gcaacaguauuucgguaua

SEQ ID NO: 95455 - RNA, 19 nt, Homo sapiens
gcagacaaaucuuaucaau

SEQ ID NO: 95456 - RNA, 19 nt, Homo sapiens
gggaaaggaugaauagaau

SEQ ID NO: 95457 - RNA, 19 nt, Homo sapiens
agacaaaucuuaucaaugc

SEQ ID NO: 95458 - RNA, 19 nt, Homo sapiens
ggacuucucuccaguaaac

SEQ ID NO: 95459 - RNA, 19 nt, Homo sapiens
aaagauagaugguacaaca

SEQ ID NO: 95460 - RNA, 19 nt, Homo sapiens
ccgcacaggucuuuccuua

SEQ ID NO: 95461 - RNA, 19 nt, Homo sapiens
ugaaagggauaaccucaaa

SEQ ID NO: 95462 - RNA, 19 nt, Homo sapiens
aaacagugcuucuagugaa

SEQ ID NO: 95463 - RNA, 19 nt, Homo sapiens
ggucuuuccuuaugggaua

SEQ ID NO: 95464 - RNA, 19 nt, Homo sapiens
ggaguauucugacuggaaa

SEQ ID NO: 95465 - RNA, 19 nt, Homo sapiens
caacaguauuucgguauaa

SEQ ID NO: 95466 - RNA, 19 nt, Homo sapiens
cagaauagagccagacaua

SEQ ID NO: 95467 - RNA, 19 nt, Homo sapiens
gagaauccaucagcaagaa

SEQ ID NO: 95468 - RNA, 19 nt, Homo sapiens
aagggaagcugauugauau

SEQ ID NO: 95469 - RNA, 19 nt, Homo sapiens
gagaaggcaauauccaaua

SEQ ID NO: 95470 - RNA, 19 nt, Homo sapiens
ccacauguccugaucauau

SEQ ID NO: 95471 - RNA, 19 nt, Homo sapiens
gcaaauaguaguuccugaa

SEQ ID NO: 95472 - RNA, 19 nt, Homo sapiens
ggaagcugauugauauugu

SEQ ID NO: 95473 - RNA, 19 nt, Homo sapiens
gggagaaggugccuaugga

SEQ ID NO: 95474 - RNA, 19 nt, Homo sapiens
ugaaucagguuacuauauc

SEQ ID NO: 95475 - RNA, 19 nt, Homo sapiens
cagugaagauuguagauau

SEQ ID NO: 95476 - RNA, 19 nt, Homo sapiens
gaaguugggcuaucaaugg

SEQ ID NO: 95477 - RNA, 19 nt, Homo sapiens
agaaagagaucuguaucaa

SEQ ID NO: 95478 - RNA, 19 nt, Homo sapiens
uagaguaacugaagaagca

SEQ ID NO: 95479 - RNA, 19 nt, Homo sapiens
aaagggaagcugauugaua

SEQ ID NO: 95480 - RNA, 19 nt, Homo sapiens
ggaauaacucacagggaua

SEQ ID NO: 95481 - RNA, 19 nt, Homo sapiens
gaauagaguaacugaagaa

SEQ ID NO: 95482 - RNA, 19 nt, Homo sapiens
gaaagagaucuguaucaau

SEQ ID NO: 95483 - RNA, 19 nt, Homo sapiens
gaaucagguuacuauauca

SEQ ID NO: 95484 - RNA, 19 nt, Homo sapiens
caacaaaccccucaagaaa

SEQ ID NO: 95485 - RNA, 19 nt, Homo sapiens
gcagugaagauuguagaua

SEQ ID NO: 95486 - RNA, 19 nt, Homo sapiens
gaauagagccagacauagg

SEQ ID NO: 95487 - RNA, 19 nt, Homo sapiens
gaagagaagagaauuucau

SEQ ID NO: 95488 - RNA, 19 nt, Homo sapiens
uaacucacagggauauuaa

SEQ ID NO: 95489 - RNA, 19 nt, Homo sapiens
gaagcugauugauauugug

SEQ ID NO: 95490 - RNA, 19 nt, Homo sapiens
gcacauucaauccaauuug

SEQ ID NO: 95491 - RNA, 19 nt, Homo sapiens
gauguuugguccuguggaa

SEQ ID NO: 95492 - RNA, 19 nt, Homo sapiens
gagaagagaauuucaugca

SEQ ID NO: 95493 - RNA, 19 nt, Homo sapiens
ugaaagagacuugugagaa

SEQ ID NO: 95494 - RNA, 19 nt, Homo sapiens
gccguagacuguccagaaa

SEQ ID NO: 95495 - RNA, 19 nt, Homo sapiens
aauaguaguuccugaagug

SEQ ID NO: 95496 - RNA, 19 nt, Homo sapiens
ugaaccagaugcucagaga

SEQ ID NO: 95497 - RNA, 19 nt, Homo sapiens
ugaauagaguaacugaaga

SEQ ID NO: 95498 - RNA, 19 nt, Homo sapiens
aaacucaucugguggaaac

SEQ ID NO: 95499 - RNA, 19 nt, Homo sapiens
ggaaaggaugaauagaauu

SEQ ID NO: 95500 - RNA, 19 nt, Homo sapiens
gauuggaguucaagagaca

SEQ ID NO: 95501 - RNA, 19 nt, Homo sapiens
aaugcucgcuggagaauug

SEQ ID NO: 95502 - RNA, 19 nt, Homo sapiens
gagagaaggcaauauccaa

SEQ ID NO: 95503 - RNA, 19 nt, Homo sapiens
cuucauguguguuuaguau

SEQ ID NO: 95504 - RNA, 19 nt, Homo sapiens
guaugaaucagguuacuau

SEQ ID NO: 95505 - RNA, 19 nt, Homo sapiens
acacgauucuuuaccaaau

SEQ ID NO: 95506 - RNA, 19 nt, Homo sapiens
cagaaccaguugauguuug

SEQ ID NO: 95507 - RNA, 19 nt, Homo sapiens
ucacagggauauuaaacca

SEQ ID NO: 95508 - RNA, 19 nt, Homo sapiens
gaauaacucacagggauau

SEQ ID NO: 95509 - RNA, 19 nt, Homo sapiens
gaauccaucagcaagaauu

SEQ ID NO: 95510 - RNA, 19 nt, Homo sapiens
gcagaaccaguugauguuu

SEQ ID NO: 95511 - RNA, 19 nt, Homo sapiens
gaggagggcagaauuucaa

SEQ ID NO: 95512 - RNA, 19 nt, Homo sapiens
cuaagcacauucaauccaa

SEQ ID NO: 95513 - RNA, 19 nt, Homo sapiens
gaaggugccuauggagaag

SEQ ID NO: 95514 - RNA, 19 nt, Homo sapiens
guuacuauaucaacaacug

SEQ ID NO: 95515 - RNA, 19 nt, Homo sapiens
guaaacagugcuucuagug

SEQ ID NO: 95516 - RNA, 19 nt, Homo sapiens
aagagaauuucaugcagaa

SEQ ID NO: 95517 - RNA, 19 nt, Homo sapiens
caacaacugauaggagaaa

SEQ ID NO: 95518 - RNA, 19 nt, Homo sapiens
gugagaaguugggcuauca

SEQ ID NO: 95519 - RNA, 19 nt, Homo sapiens
uaucaaugccugaaagaga

SEQ ID NO: 95520 - RNA, 19 nt, Homo sapiens
gaagaagcagucgcaguga

SEQ ID NO: 95521 - RNA, 19 nt, Homo sapiens
acugauaggagaaacaaua

SEQ ID NO: 95522 - RNA, 19 nt, Homo sapiens
uaaacagugcuucuaguga

SEQ ID NO: 95523 - RNA, 19 nt, Homo sapiens
auaauaaucgugagcguuu

SEQ ID NO: 95524 - RNA, 19 nt, Homo sapiens
ucacuucccuguuuaucca

SEQ ID NO: 95525 - RNA, 19 nt, Homo sapiens
gaagcgugccguagacugu

SEQ ID NO: 95526 - RNA, 19 nt, Homo sapiens
ggaauccuggugaauauag

SEQ ID NO: 95527 - RNA, 19 nt, Homo sapiens
uuaaagggaagcugauuga

SEQ ID NO: 95528 - RNA, 19 nt, Homo sapiens
ggugauggauuggaguuca

SEQ ID NO: 95529 - RNA, 19 nt, Homo sapiens
gauaggagaaacaauaaac

SEQ ID NO: 95530 - RNA, 19 nt, Homo sapiens
ucaacuugcugugaauaga

SEQ ID NO: 95531 - RNA, 19 nt, Homo sapiens
ugacauuauucuuccuaga

SEQ ID NO: 95532 - RNA, 19 nt, Homo sapiens
gggaguggcgauugugauu

SEQ ID NO: 95533 - RNA, 19 nt, Homo sapiens
caacugauaggagaaacaa

SEQ ID NO: 95534 - RNA, 19 nt, Homo sapiens
ggagaaacaauaaacucau

SEQ ID NO: 95535 - RNA, 19 nt, Homo sapiens
gugaauagaguaacugaag

SEQ ID NO: 95536 - RNA, 19 nt, Homo sapiens
ugacacgauucuuuaccaa

SEQ ID NO: 95537 - RNA, 19 nt, Homo sapiens
gaagauuguagauaugaag

SEQ ID NO: 95538 - RNA, 19 nt, Homo sapiens
guucggcauacaaauaaua

SEQ ID NO: 95539 - RNA, 19 nt, Homo sapiens
auccaaacaucuuccaauu

SEQ ID NO: 95540 - RNA, 19 nt, Homo sapiens
gugagcagccagaagguuu

SEQ ID NO: 95541 - RNA, 19 nt, Homo sapiens
cacauguccugaucauaug

SEQ ID NO: 95542 - RNA, 19 nt, Homo sapiens
gauagaugguacaacaaac

SEQ ID NO: 95543 - RNA, 19 nt, Homo sapiens
ugguuuaucugcaugguau

SEQ ID NO: 95544 - RNA, 19 nt, Homo sapiens
cacgauucuuuaccaaauu

SEQ ID NO: 95545 - RNA, 19 nt, Homo sapiens
ucaaaagaaugacacgauu

SEQ ID NO: 95546 - RNA, 19 nt, Homo sapiens
cauauuucuuccauguuga

SEQ ID NO: 95547 - RNA, 19 nt, Homo sapiens
ggugcucgguggagucaug

SEQ ID NO: 95548 - RNA, 19 nt, Homo sapiens
ccagaaagcucaggaauua

SEQ ID NO: 95549 - RNA, 19 nt, Homo sapiens
gaacucauauugacacuca

SEQ ID NO: 95550 - RNA, 19 nt, Homo sapiens
uacaauagcuguuaaggaa

SEQ ID NO: 95551 - RNA, 19 nt, Homo sapiens
guaaauggguccagucaug

SEQ ID NO: 95552 - RNA, 19 nt, Homo sapiens
ggagauuucuaaugauuug

SEQ ID NO: 95553 - RNA, 19 nt, Homo sapiens
gaaaggaaauaaugguaca

SEQ ID NO: 95554 - RNA, 19 nt, Homo sapiens
gaaggcacauaaagcaauu

SEQ ID NO: 95555 - RNA, 19 nt, Homo sapiens
gucaggagauuucuaauga

SEQ ID NO: 95556 - RNA, 19 nt, Homo sapiens
gaaagccacuggaauuguc

SEQ ID NO: 95557 - RNA, 19 nt, Homo sapiens
gcaaaguaaucaucguuca

SEQ ID NO: 95558 - RNA, 19 nt, Homo sapiens
uuaagaaaguggacaaaga

SEQ ID NO: 95559 - RNA, 19 nt, Homo sapiens
caggagauuucuaaugauu

SEQ ID NO: 95560 - RNA, 19 nt, Homo sapiens
aacaagcugugucuucuua

SEQ ID NO: 95561 - RNA, 19 nt, Homo sapiens
gccauaagccugaagauug

SEQ ID NO: 95562 - RNA, 19 nt, Homo sapiens
gaaauaaugguacagaucu

SEQ ID NO: 95563 - RNA, 19 nt, Homo sapiens
gcuaaucauugaauucugu

SEQ ID NO: 95564 - RNA, 19 nt, Homo sapiens
cuaaugauuuguggcaaua

SEQ ID NO: 95565 - RNA, 19 nt, Homo sapiens
ugaaggauaucuacaacug

SEQ ID NO: 95566 - RNA, 19 nt, Homo sapiens
gcaaccaaguccaggaaau

SEQ ID NO: 95567 - RNA, 19 nt, Homo sapiens
gcagggaugucaacgucaa

SEQ ID NO: 95568 - RNA, 19 nt, Homo sapiens
ccaaggaggaucacaacua

SEQ ID NO: 95569 - RNA, 19 nt, Homo sapiens
gcauagacccagaguauag

SEQ ID NO: 95570 - RNA, 19 nt, Homo sapiens
aaagagaggagucagagua

SEQ ID NO: 95571 - RNA, 19 nt, Homo sapiens
caaggaggaucacaacuac

SEQ ID NO: 95572 - RNA, 19 nt, Homo sapiens
gagaggagucagaguauug

SEQ ID NO: 95573 - RNA, 19 nt, Homo sapiens
caggaaagccacuggaauu

SEQ ID NO: 95574 - RNA, 19 nt, Homo sapiens
ugaauaacaucaccaaucg

SEQ ID NO: 95575 - RNA, 19 nt, Homo sapiens
gggauccgguccuguuuga

SEQ ID NO: 95576 - RNA, 19 nt, Homo sapiens
gugcauagacccagaguau

SEQ ID NO: 95577 - RNA, 19 nt, Homo sapiens
ggaaauaaugguacagauc

SEQ ID NO: 95578 - RNA, 19 nt, Homo sapiens
aaaggagauugaagccaua

SEQ ID NO: 95579 - RNA, 19 nt, Homo sapiens
uuuggacccuuaagaauuu

SEQ ID NO: 95580 - RNA, 19 nt, Homo sapiens
agaaggagcccaaggauuc

SEQ ID NO: 95581 - RNA, 19 nt, Homo sapiens
caauagcuguuaaggaaag

SEQ ID NO: 95582 - RNA, 19 nt, Homo sapiens
ggagauugaagccauagaa

SEQ ID NO: 95583 - RNA, 19 nt, Homo sapiens
cgacgaccacuaugaguuu

SEQ ID NO: 95584 - RNA, 19 nt, Homo sapiens
ucagcugccucauauuuau

SEQ ID NO: 95585 - RNA, 19 nt, Homo sapiens
ccauagaacucauauugac

SEQ ID NO: 95586 - RNA, 19 nt, Homo sapiens
ucuccaagauccugacauu

SEQ ID NO: 95587 - RNA, 19 nt, Homo sapiens
cuucuuaacugcccaagug

SEQ ID NO: 95588 - RNA, 19 nt, Homo sapiens
gaugucaacgucaauauca

SEQ ID NO: 95589 - RNA, 19 nt, Homo sapiens
ccauaagccugaagauugg

SEQ ID NO: 95590 - RNA, 19 nt, Homo sapiens
gcacgugggcaaaguaauc

SEQ ID NO: 95591 - RNA, 19 nt, Homo sapiens
gaaggcacgugggcaaagu

SEQ ID NO: 95592 - RNA, 19 nt, Homo sapiens
ccaagauccugacauugau

SEQ ID NO: 95593 - RNA, 19 nt, Homo sapiens
caaccaaguccaggaaauu

SEQ ID NO: 95594 - RNA, 19 nt, Homo sapiens
cgaaggagagagagagaaa

SEQ ID NO: 95595 - RNA, 19 nt, Homo sapiens
guggcaauaucagcaauuu

SEQ ID NO: 95596 - RNA, 19 nt, Homo sapiens
gagaagaaaugggguaaau

SEQ ID NO: 95597 - RNA, 19 nt, Homo sapiens
ggaaauuacaauagcuguu

SEQ ID NO: 95598 - RNA, 19 nt, Homo sapiens
gcgcaucgggugucaguga

SEQ ID NO: 95599 - RNA, 19 nt, Homo sapiens
ggaaagccacuggaauugu

SEQ ID NO: 95600 - RNA, 19 nt, Homo sapiens
ugacagcggccaugaggaa

SEQ ID NO: 95601 - RNA, 19 nt, Homo sapiens
ucagugagacacaauuuau

SEQ ID NO: 95602 - RNA, 19 nt, Homo sapiens
ccaagcgccugccagugaa

SEQ ID NO: 95603 - RNA, 19 nt, Homo sapiens
gaaaacaagcugugucuuc

SEQ ID NO: 95604 - RNA, 19 nt, Homo sapiens
gagcgaugaugaggagaug

SEQ ID NO: 95605 - RNA, 19 nt, Homo sapiens
uccaagauccugacauuga

SEQ ID NO: 95606 - RNA, 19 nt, Homo sapiens
gacccagaguauagacaaa

SEQ ID NO: 95607 - RNA, 19 nt, Homo sapiens
gccagaaagcucaggaauu

SEQ ID NO: 95608 - RNA, 19 nt, Homo sapiens
gcacacacacacacacaca

SEQ ID NO: 95609 - RNA, 19 nt, Homo sapiens
gguggacguuggacuguuc

SEQ ID NO: 95610 - RNA, 19 nt, Homo sapiens
acacucagcuguuuuacaa

SEQ ID NO: 95611 - RNA, 19 nt, Homo sapiens
caugucaggagauuucuaa

SEQ ID NO: 95612 - RNA, 19 nt, Homo sapiens
gauccgguccuguuugaau

SEQ ID NO: 95613 - RNA, 19 nt, Homo sapiens
ggaagcacagccagaagga

SEQ ID NO: 95614 - RNA, 19 nt, Homo sapiens
ccauuugguuucagcaugu

SEQ ID NO: 95615 - RNA, 19 nt, Homo sapiens
cuucagcugccucauauuu

SEQ ID NO: 95616 - RNA, 19 nt, Homo sapiens
agaacuugcugaagagcuu

SEQ ID NO: 95617 - RNA, 19 nt, Homo sapiens
uauugacacucagcuguuu

SEQ ID NO: 95618 - RNA, 19 nt, Homo sapiens
gccauagaacucauauuga

SEQ ID NO: 95619 - RNA, 19 nt, Homo sapiens
gcagaaagagcaaaaggaa

SEQ ID NO: 95620 - RNA, 19 nt, Homo sapiens
acaacuggaucuuggaaca

SEQ ID NO: 95621 - RNA, 19 nt, Homo sapiens
gggcaaaguaaucaucguu

SEQ ID NO: 95622 - RNA, 19 nt, Homo sapiens
cagcaugucaggagauuuc

SEQ ID NO: 95623 - RNA, 19 nt, Homo sapiens
acaagaagcgccagcacuu

SEQ ID NO: 95624 - RNA, 19 nt, Homo sapiens
uaagaaaguggacaaagag

SEQ ID NO: 95625 - RNA, 19 nt, Homo sapiens
aaccaaguccaggaaauua

SEQ ID NO: 95626 - RNA, 19 nt, Homo sapiens
gcgaugaugaggagaugaa

SEQ ID NO: 95627 - RNA, 19 nt, Homo sapiens
ggaugcggacugagaguga

SEQ ID NO: 95628 - RNA, 19 nt, Homo sapiens
ccagucaugccucccagua

SEQ ID NO: 95629 - RNA, 19 nt, Homo sapiens
gagcagacccaagcuugug

SEQ ID NO: 95630 - RNA, 19 nt, Homo sapiens
agaaaccuguggcugaauc

SEQ ID NO: 95631 - RNA, 19 nt, Homo sapiens
agacgaugaccucgacuuu

SEQ ID NO: 95632 - RNA, 19 nt, Homo sapiens
agccauagaacucauauug

SEQ ID NO: 95633 - RNA, 19 nt, Homo sapiens
gaagccauagaacucauau

SEQ ID NO: 95634 - RNA, 19 nt, Homo sapiens
gauugaagccauagaacuc

SEQ ID NO: 95635 - RNA, 19 nt, Homo sapiens
gcaaaaggaaaccacaaaa

SEQ ID NO: 95636 - RNA, 19 nt, Homo sapiens
gaaagcucaggaauuagug

SEQ ID NO: 95637 - RNA, 19 nt, Homo sapiens
cagaaggagcccaaggauu

SEQ ID NO: 95638 - RNA, 19 nt, Homo sapiens
cggaagaggacgacaggaa

SEQ ID NO: 95639 - RNA, 19 nt, Homo sapiens
acuaugaguuugccaccaa

SEQ ID NO: 95640 - RNA, 19 nt, Homo sapiens
gagagugagccaucuugug

SEQ ID NO: 95641 - RNA, 19 nt, Homo sapiens
gacaaagagaggagucaga

SEQ ID NO: 95642 - RNA, 19 nt, Homo sapiens
gaacauuuuccguauuuug

SEQ ID NO: 95643 - RNA, 19 nt, Homo sapiens
caagcugugucuucuuaac

SEQ ID NO: 95644 - RNA, 19 nt, Homo sapiens
ucaccaaucggacggcaaa

SEQ ID NO: 95645 - RNA, 19 nt, Homo sapiens
agagaggagucagaguauu

SEQ ID NO: 95646 - RNA, 19 nt, Homo sapiens
uaucacaggaacacacauu

SEQ ID NO: 95647 - RNA, 19 nt, Homo sapiens
ucaggagauuucuaaugau

SEQ ID NO: 95648 - RNA, 19 nt, Homo sapiens
gaacagcccuaugaauaaa

SEQ ID NO: 95649 - RNA, 19 nt, Homo sapiens
gaacggauccuuuccauuc

SEQ ID NO: 95650 - RNA, 19 nt, Homo sapiens
gcaauaacuucugaccuuu

SEQ ID NO: 95651 - RNA, 19 nt, Homo sapiens
gugaacagcccuaugaaua

SEQ ID NO: 95652 - RNA, 19 nt, Homo sapiens
gaacacaggcagcuuucua

SEQ ID NO: 95653 - RNA, 19 nt, Homo sapiens
ccaaggauguuauggagaa

SEQ ID NO: 95654 - RNA, 19 nt, Homo sapiens
gcugagaacuccugacugu

SEQ ID NO: 95655 - RNA, 19 nt, Homo sapiens
caacugcaauaacuucuga

SEQ ID NO: 95656 - RNA, 19 nt, Homo sapiens
aagcagagcuggagaaagu

SEQ ID NO: 95657 - RNA, 19 nt, Homo sapiens
ccacaacuuuaaacauuga

SEQ ID NO: 95658 - RNA, 19 nt, Homo sapiens
gggcacaacugcaauaacu

SEQ ID NO: 95659 - RNA, 19 nt, Homo sapiens
ggagaugaacggauccuuu

SEQ ID NO: 95660 - RNA, 19 nt, Homo sapiens
ugagaacuccugacuguaa

SEQ ID NO: 95661 - RNA, 19 nt, Homo sapiens
ugaacagcccuaugaauaa

SEQ ID NO: 95662 - RNA, 19 nt, Homo sapiens
ugaaagaggcgguggaaga

SEQ ID NO: 95663 - RNA, 19 nt, Homo sapiens
gcacaacugcaauaacuuc

SEQ ID NO: 95664 - RNA, 19 nt, Homo sapiens
auaccgaggugaugaaaug

SEQ ID NO: 95665 - RNA, 19 nt, Homo sapiens
ugcaauaacuucugaccuu

SEQ ID NO: 95666 - RNA, 19 nt, Homo sapiens
gggcacaucagcagaagaa

SEQ ID NO: 95667 - RNA, 19 nt, Homo sapiens
gagaugaacggauccuuuc

SEQ ID NO: 95668 - RNA, 19 nt, Homo sapiens
aaagagaggauuccaagga

SEQ ID NO: 95669 - RNA, 19 nt, Homo sapiens
acaggcagcuuucuagaag

SEQ ID NO: 95670 - RNA, 19 nt, Homo sapiens
cuacgcgccuugucuccua

SEQ ID NO: 95671 - RNA, 19 nt, Homo sapiens
ggucaucuccgacacacuu

SEQ ID NO: 95672 - RNA, 19 nt, Homo sapiens
gaaagaggcgguggaagag

SEQ ID NO: 95673 - RNA, 19 nt, Homo sapiens
gaagaaggccccacuguag

SEQ ID NO: 95674 - RNA, 19 nt, Homo sapiens
ccaaggagagggcacauca

SEQ ID NO: 95675 - RNA, 19 nt, Homo sapiens
gacuguaacauauucugua

SEQ ID NO: 95676 - RNA, 19 nt, Homo sapiens
ggaagaaggccccacugua

SEQ ID NO: 95677 - RNA, 19 nt, Homo sapiens
gcagcuuucuagaaguuuc

SEQ ID NO: 95678 - RNA, 19 nt, Homo sapiens
ccacugggcacaacugcaa

SEQ ID NO: 95679 - RNA, 19 nt, Homo sapiens
cuuuaaacauugacgauuc

SEQ ID NO: 95680 - RNA, 19 nt, Homo sapiens
acuccugacuguaacauau

SEQ ID NO: 95681 - RNA, 19 nt, Homo sapiens
gagagccugucggccauug

SEQ ID NO: 95682 - RNA, 19 nt, Homo sapiens
acaaggagauccggaaagg

SEQ ID NO: 95683 - RNA, 19 nt, Homo sapiens
aaucuguucugggcucuuu

SEQ ID NO: 95684 - RNA, 19 nt, Homo sapiens
gagaacuccugacuguaac

SEQ ID NO: 95685 - RNA, 19 nt, Homo sapiens
aggcagcuuucuagaaguu

SEQ ID NO: 95686 - RNA, 19 nt, Homo sapiens
gacgauuccuucucugaac

SEQ ID NO: 95687 - RNA, 19 nt, Homo sapiens
gaggacaaccgggacaguu

SEQ ID NO: 95688 - RNA, 19 nt, Homo sapiens
uggaccagcuggccaagga

SEQ ID NO: 95689 - RNA, 19 nt, Homo sapiens
caaggauguuauggagaaa

SEQ ID NO: 95690 - RNA, 19 nt, Homo sapiens
gcacaucagcagaagaaac

SEQ ID NO: 95691 - RNA, 19 nt, Homo sapiens
cccacaacuuuaaacauug

SEQ ID NO: 95692 - RNA, 19 nt, Homo sapiens
acuccuaccugcccuggaa

SEQ ID NO: 95693 - RNA, 19 nt, Homo sapiens
ccccacaacuuuaaacauu

SEQ ID NO: 95694 - RNA, 19 nt, Homo sapiens
gagccugucggccauugaa

SEQ ID NO: 95695 - RNA, 19 nt, Homo sapiens
acacagcgguuuugaagau

SEQ ID NO: 95696 - RNA, 19 nt, Homo sapiens
cacaucagcagaagaaaca

SEQ ID NO: 95697 - RNA, 19 nt, Homo sapiens
gggaggaucgaccgacaga

SEQ ID NO: 95698 - RNA, 19 nt, Homo sapiens
cauugacgauuccuucucu

SEQ ID NO: 95699 - RNA, 19 nt, Homo sapiens
cggauccuuuccauucuga

SEQ ID NO: 95700 - RNA, 19 nt, Homo sapiens
ugacgauuccuucucugaa

SEQ ID NO: 95701 - RNA, 19 nt, Homo sapiens
ggauaccgaggugaugaaa

SEQ ID NO: 95702 - RNA, 19 nt, Homo sapiens
cuacaaggagauccggaaa

SEQ ID NO: 95703 - RNA, 19 nt, Homo sapiens
gcugaaagaggcgguggaa

SEQ ID NO: 95704 - RNA, 19 nt, Homo sapiens
gauccuuuccauucugaga

SEQ ID NO: 95705 - RNA, 19 nt, Homo sapiens
cacaggcagcuuucuagaa

SEQ ID NO: 95706 - RNA, 19 nt, Homo sapiens
ugaagcagagcuggagaaa

SEQ ID NO: 95707 - RNA, 19 nt, Homo sapiens
ccaggaauguuuugagaca

SEQ ID NO: 95708 - RNA, 19 nt, Homo sapiens
gagggcacaucagcagaag

SEQ ID NO: 95709 - RNA, 19 nt, Homo sapiens
gggauaccgaggugaugaa

SEQ ID NO: 95710 - RNA, 19 nt, Homo sapiens
ucugaacacaggcagcuuu

SEQ ID NO: 95711 - RNA, 19 nt, Homo sapiens
ugagacaucagaauuuacu

SEQ ID NO: 95712 - RNA, 19 nt, Homo sapiens
gguggcaggcaaagagaga

SEQ ID NO: 95713 - RNA, 19 nt, Homo sapiens
gaugaacggauccuuucca

SEQ ID NO: 95714 - RNA, 19 nt, Homo sapiens
ggaaagagcuggacagaaa

SEQ ID NO: 95715 - RNA, 19 nt, Homo sapiens
gaagauagcugagaaauuc

SEQ ID NO: 95716 - RNA, 19 nt, Homo sapiens
gaagcuagguuucaagaua

SEQ ID NO: 95717 - RNA, 19 nt, Homo sapiens
gagaagaaauaaaggguua

SEQ ID NO: 95718 - RNA, 19 nt, Homo sapiens
ggaagaaccugaauaugga

SEQ ID NO: 95719 - RNA, 19 nt, Homo sapiens
gaaguaagauuguuaagag

SEQ ID NO: 95720 - RNA, 19 nt, Homo sapiens
ggacagggcugaccagaca

SEQ ID NO: 95721 - RNA, 19 nt, Homo sapiens
gaagagacaacaugaauga

SEQ ID NO: 95722 - RNA, 19 nt, Homo sapiens
caauauagcucccaucaca

SEQ ID NO: 95723 - RNA, 19 nt, Homo sapiens
gaagaagucagcugaguuu

SEQ ID NO: 95724 - RNA, 19 nt, Homo sapiens
ggacagaaauuaucucaac

SEQ ID NO: 95725 - RNA, 19 nt, Homo sapiens
gaaagaagagacaacauga

SEQ ID NO: 95726 - RNA, 19 nt, Homo sapiens
gaaccacaaugaaggaaug

SEQ ID NO: 95727 - RNA, 19 nt, Homo sapiens
cuacagggcuucagaggaa

SEQ ID NO: 95728 - RNA, 19 nt, Homo sapiens
gaagauagcagugaagaga

SEQ ID NO: 95729 - RNA, 19 nt, Homo sapiens
ggaagaaucugaggaaggu

SEQ ID NO: 95730 - RNA, 19 nt, Homo sapiens
ccaagucucugaagaagug

SEQ ID NO: 95731 - RNA, 19 nt, Homo sapiens
gaaaagacgucaaagacaa

SEQ ID NO: 95732 - RNA, 19 nt, Homo sapiens
ggaggaaucugaggaguca

SEQ ID NO: 95733 - RNA, 19 nt, Homo sapiens
aaacuuggcugcaauggau

SEQ ID NO: 95734 - RNA, 19 nt, Homo sapiens
gcagaggaagugaagaaua

SEQ ID NO: 95735 - RNA, 19 nt, Homo sapiens
ugacugugcuacugucuuu

SEQ ID NO: 95736 - RNA, 19 nt, Homo sapiens
caacaaaggcagacacaga

SEQ ID NO: 95737 - RNA, 19 nt, Homo sapiens
ggaggaagcuagguuucaa

SEQ ID NO: 95738 - RNA, 19 nt, Homo sapiens
gagacaacaugaaugacaa

SEQ ID NO: 95739 - RNA, 19 nt, Homo sapiens
ucaaaugccuugucgaagu

SEQ ID NO: 95740 - RNA, 19 nt, Homo sapiens
uaagauggcacauggauau

SEQ ID NO: 95741 - RNA, 19 nt, Homo sapiens
aaaaugagcugaccuugaa

SEQ ID NO: 95742 - RNA, 19 nt, Homo sapiens
caacuacggugaggaagga

SEQ ID NO: 95743 - RNA, 19 nt, Homo sapiens
uugcaugacuuguagcaua

SEQ ID NO: 95744 - RNA, 19 nt, Homo sapiens
aagcuagguuucaagauaa

SEQ ID NO: 95745 - RNA, 19 nt, Homo sapiens
gugacucgcugcaucauug

SEQ ID NO: 95746 - RNA, 19 nt, Homo sapiens
gaagucagcugaguuucca

SEQ ID NO: 95747 - RNA, 19 nt, Homo sapiens
ggaaagggacgccaucaca

SEQ ID NO: 95748 - RNA, 19 nt, Homo sapiens
cagaggaagugaagaauac

SEQ ID NO: 95749 - RNA, 19 nt, Homo sapiens
ccacgugccuauuucaugu

SEQ ID NO: 95750 - RNA, 19 nt, Homo sapiens
gcacauggauauggugaag

SEQ ID NO: 95751 - RNA, 19 nt, Homo sapiens
gaagagaaacaccuugaag

SEQ ID NO: 95752 - RNA, 19 nt, Homo sapiens
gaagugaagacacgccauu

SEQ ID NO: 95753 - RNA, 19 nt, Homo sapiens
ugaauugcaugacuuguag

SEQ ID NO: 95754 - RNA, 19 nt, Homo sapiens
uaacaggaaccacaaugaa

SEQ ID NO: 95755 - RNA, 19 nt, Homo sapiens
ggaagaagucagcugaguu

SEQ ID NO: 95756 - RNA, 19 nt, Homo sapiens
gacaaugacugugcuacug

SEQ ID NO: 95757 - RNA, 19 nt, Homo sapiens
cagcugaguuuccagacuu

SEQ ID NO: 95758 - RNA, 19 nt, Homo sapiens
gagcagccauuuugaaaga

SEQ ID NO: 95759 - RNA, 19 nt, Homo sapiens
acacauagccgagagaaga

SEQ ID NO: 95760 - RNA, 19 nt, Homo sapiens
acauggauauggugaagaa

SEQ ID NO: 95761 - RNA, 19 nt, Homo sapiens
caaaugccuugucgaaguc

SEQ ID NO: 95762 - RNA, 19 nt, Homo sapiens
gugcuacugucuuuggaaa

SEQ ID NO: 95763 - RNA, 19 nt, Homo sapiens
gugaauugcaugacuugua

SEQ ID NO: 95764 - RNA, 19 nt, Homo sapiens
ggagccacgugccuauuuc

SEQ ID NO: 95765 - RNA, 19 nt, Homo sapiens
gggcagaggaagugaagaa

SEQ ID NO: 95766 - RNA, 19 nt, Homo sapiens
agauagcagugaagagaaa

SEQ ID NO: 95767 - RNA, 19 nt, Homo sapiens
uacagaagauagcugagaa

SEQ ID NO: 95768 - RNA, 19 nt, Homo sapiens
ugaaagaagagacaacaug

SEQ ID NO: 95769 - RNA, 19 nt, Homo sapiens
gcaaggaggcauccacaag

SEQ ID NO: 95770 - RNA, 19 nt, Homo sapiens
gauaagauggcacauggau

SEQ ID NO: 95771 - RNA, 19 nt, Homo sapiens
gugccuauuucaugucuga

SEQ ID NO: 95772 - RNA, 19 nt, Homo sapiens
gacaaagagacaacugaaa

SEQ ID NO: 95773 - RNA, 19 nt, Homo sapiens
cugaaagacaccauuuaua

SEQ ID NO: 95774 - RNA, 19 nt, Homo sapiens
ggugggcacuguuaagaag

SEQ ID NO: 95775 - RNA, 19 nt, Homo sapiens
gauaacaggaaccacaaug

SEQ ID NO: 95776 - RNA, 19 nt, Homo sapiens
agaagcagccaucacauga

SEQ ID NO: 95777 - RNA, 19 nt, Homo sapiens
uggaccagcuccuucacua

SEQ ID NO: 95778 - RNA, 19 nt, Homo sapiens
gaaaaugagcugaccuuga

SEQ ID NO: 95779 - RNA, 19 nt, Homo sapiens
gaaagagcuggacagaaau

SEQ ID NO: 95780 - RNA, 19 nt, Homo sapiens
gaagaaagugaggaagaga

SEQ ID NO: 95781 - RNA, 19 nt, Homo sapiens
ugaggaaggugaggaagau

SEQ ID NO: 95782 - RNA, 19 nt, Homo sapiens
uaacaugcuuaugacaaug

SEQ ID NO: 95783 - RNA, 19 nt, Homo sapiens
ucacugaaagacaccauuu

SEQ ID NO: 95784 - RNA, 19 nt, Homo sapiens
ggagcggugggcacuguua

SEQ ID NO: 95785 - RNA, 19 nt, Homo sapiens
gcaauggauuuggaacuac

SEQ ID NO: 95786 - RNA, 19 nt, Homo sapiens
cagaaauuaucucaacuac

SEQ ID NO: 95787 - RNA, 19 nt, Homo sapiens
agaggaagaaccugaauau

SEQ ID NO: 95788 - RNA, 19 nt, Homo sapiens
ugaagacacgccauucuga

SEQ ID NO: 95789 - RNA, 19 nt, Homo sapiens
ugcaauggauuuggaacua

SEQ ID NO: 95790 - RNA, 19 nt, Homo sapiens
gaaaagaggaagagauuag

SEQ ID NO: 95791 - RNA, 19 nt, Homo sapiens
gggagccacgugccuauuu

SEQ ID NO: 95792 - RNA, 19 nt, Homo sapiens
ccaggaagaaucugaggaa

SEQ ID NO: 95793 - RNA, 19 nt, Homo sapiens
gaagccaggaagaaucuga

SEQ ID NO: 95794 - RNA, 19 nt, Homo sapiens
gagcuggacagaaauuauc

SEQ ID NO: 95795 - RNA, 19 nt, Homo sapiens
aaagagggaccaccauuca

SEQ ID NO: 95796 - RNA, 19 nt, Homo sapiens
gaaaagagggaccaccauu

SEQ ID NO: 95797 - RNA, 19 nt, Homo sapiens
caauggauuuggaacuaca

SEQ ID NO: 95798 - RNA, 19 nt, Homo sapiens
ugaagaaagugaggaagag

SEQ ID NO: 95799 - RNA, 19 nt, Homo sapiens
gagaaacuaccccagcuua

SEQ ID NO: 95800 - RNA, 19 nt, Homo sapiens
gaaccugaauauggagaag

SEQ ID NO: 95801 - RNA, 19 nt, Homo sapiens
cagaggaagaaccugaaua

SEQ ID NO: 95802 - RNA, 19 nt, Homo sapiens
ggagggagagaacuaucaa

SEQ ID NO: 95803 - RNA, 19 nt, Homo sapiens
gugaagaaagugaggaaga

SEQ ID NO: 95804 - RNA, 19 nt, Homo sapiens
gauauggugaagaaaguga

SEQ ID NO: 95805 - RNA, 19 nt, Homo sapiens
ggacauccaaggcccaaca

SEQ ID NO: 95806 - RNA, 19 nt, Homo sapiens
caaaggcagacacagagaa

SEQ ID NO: 95807 - RNA, 19 nt, Homo sapiens
gaaaaugugaauugcauga

SEQ ID NO: 95808 - RNA, 19 nt, Homo sapiens
uuuccagacuucuaugauu

SEQ ID NO: 95809 - RNA, 19 nt, Homo sapiens
aagaagagacaacaugaau

SEQ ID NO: 95810 - RNA, 19 nt, Homo sapiens
gauggcacauggauauggu

SEQ ID NO: 95811 - RNA, 19 nt, Homo sapiens
ugucucaguuggaaauaau

SEQ ID NO: 95812 - RNA, 19 nt, Homo sapiens
uuaagaagcagccaucaca

SEQ ID NO: 95813 - RNA, 19 nt, Homo sapiens
aggaagaaccugaauaugg

SEQ ID NO: 95814 - RNA, 19 nt, Homo sapiens
ggaaugaugugacgcucua

SEQ ID NO: 95815 - RNA, 19 nt, Homo sapiens
ggacagguauauaaaggaa

SEQ ID NO: 95816 - RNA, 19 nt, Homo sapiens
gaucugcgcuucccucuca

SEQ ID NO: 95817 - RNA, 19 nt, Homo sapiens
acagugaccauacuaauua

SEQ ID NO: 95818 - RNA, 19 nt, Homo sapiens
cuacagcuuugccaauaua

SEQ ID NO: 95819 - RNA, 19 nt, Homo sapiens
guaagacucgggauuagua

SEQ ID NO: 95820 - RNA, 19 nt, Homo sapiens
cauacaaacuggucugcua

SEQ ID NO: 95821 - RNA, 19 nt, Homo sapiens
acacacuuguugaugauua

SEQ ID NO: 95822 - RNA, 19 nt, Homo sapiens
gcuaugacauugccaagau

SEQ ID NO: 95823 - RNA, 19 nt, Homo sapiens
uuccacagcugcucaauaa

SEQ ID NO: 95824 - RNA, 19 nt, Homo sapiens
gugcugcucugcauacaaa

SEQ ID NO: 95825 - RNA, 19 nt, Homo sapiens
aaugaaggccgaauuuaua

SEQ ID NO: 95826 - RNA, 19 nt, Homo sapiens
ggagagacaaacagcauuu

SEQ ID NO: 95827 - RNA, 19 nt, Homo sapiens
gcaagggaauuucuucaac

SEQ ID NO: 95828 - RNA, 19 nt, Homo sapiens
caacaccuggauuucauua

SEQ ID NO: 95829 - RNA, 19 nt, Homo sapiens
gaagaggcccugucuaggu

SEQ ID NO: 95830 - RNA, 19 nt, Homo sapiens
guacacacuuguugaugau

SEQ ID NO: 95831 - RNA, 19 nt, Homo sapiens
gacagcagcuaugacauug

SEQ ID NO: 95832 - RNA, 19 nt, Homo sapiens
uacaagaguuuaacagugu

SEQ ID NO: 95833 - RNA, 19 nt, Homo sapiens
caacguagcccucuguucu

SEQ ID NO: 95834 - RNA, 19 nt, Homo sapiens
aagaggcccugucuaggua

SEQ ID NO: 95835 - RNA, 19 nt, Homo sapiens
ccaaacauccuacaagaca

SEQ ID NO: 95836 - RNA, 19 nt, Homo sapiens
ggaugcaaguccugacaga

SEQ ID NO: 95837 - RNA, 19 nt, Homo sapiens
gcgcuuugcuuuggucuau

SEQ ID NO: 95838 - RNA, 19 nt, Homo sapiens
aaacuggucugcuacuaca

SEQ ID NO: 95839 - RNA, 19 nt, Homo sapiens
gggaagaggcccugucuag

SEQ ID NO: 95840 - RNA, 19 nt, Homo sapiens
gagugggacagguauauaa

SEQ ID NO: 95841 - RNA, 19 nt, Homo sapiens
gcgcuucccucucaccaau

SEQ ID NO: 95842 - RNA, 19 nt, Homo sapiens
caagcucuaucaccaagga

SEQ ID NO: 95843 - RNA, 19 nt, Homo sapiens
ugacagcagcuaugacauu

SEQ ID NO: 95844 - RNA, 19 nt, Homo sapiens
ccacaucaucuacagcuuu

SEQ ID NO: 95845 - RNA, 19 nt, Homo sapiens
ggagugggacagguauaua

SEQ ID NO: 95846 - RNA, 19 nt, Homo sapiens
caagggaauuucuucaacu

SEQ ID NO: 95847 - RNA, 19 nt, Homo sapiens
gaaggccgaauuuauaaag

SEQ ID NO: 95848 - RNA, 19 nt, Homo sapiens
ccacaacacacagauuuga

SEQ ID NO: 95849 - RNA, 19 nt, Homo sapiens
gcaaccaguggguaggaua

SEQ ID NO: 95850 - RNA, 19 nt, Homo sapiens
ccacagcugcucaauaaag

SEQ ID NO: 95851 - RNA, 19 nt, Homo sapiens
aauguaagacucgggauua

SEQ ID NO: 95852 - RNA, 19 nt, Homo sapiens
gugcaguaccugaaggaua

SEQ ID NO: 95853 - RNA, 19 nt, Homo sapiens
cuaugacauugccaagaua

SEQ ID NO: 95854 - RNA, 19 nt, Homo sapiens
ggccgaauuuauaaaggaa

SEQ ID NO: 95855 - RNA, 19 nt, Homo sapiens
aguacacacuuguugauga

SEQ ID NO: 95856 - RNA, 19 nt, Homo sapiens
ggauuucauuagcaucaug

SEQ ID NO: 95857 - RNA, 19 nt, Homo sapiens
cacaucaucuacagcuuug

SEQ ID NO: 95858 - RNA, 19 nt, Homo sapiens
guccacaacacacagauuu

SEQ ID NO: 95859 - RNA, 19 nt, Homo sapiens
ugcaguaccugaaggauag

SEQ ID NO: 95860 - RNA, 19 nt, Homo sapiens
ucaagucaguaccgccauu

SEQ ID NO: 95861 - RNA, 19 nt, Homo sapiens
gauggaacuuugggucuca

SEQ ID NO: 95862 - RNA, 19 nt, Homo sapiens
ucucaaagauuuuccaaga

SEQ ID NO: 95863 - RNA, 19 nt, Homo sapiens
cuugaccgcuuccucugua

SEQ ID NO: 95864 - RNA, 19 nt, Homo sapiens
agccaaacauccuacaaga

SEQ ID NO: 95865 - RNA, 19 nt, Homo sapiens
acaaacuggucugcuacua

SEQ ID NO: 95866 - RNA, 19 nt, Homo sapiens
gcaucaugaccuacgauuu

SEQ ID NO: 95867 - RNA, 19 nt, Homo sapiens
cacagugaccauacuaauu

SEQ ID NO: 95868 - RNA, 19 nt, Homo sapiens
cacacuuguugaugauuaa

SEQ ID NO: 95869 - RNA, 19 nt, Homo sapiens
gagcuucacucuggcuucu

SEQ ID NO: 95870 - RNA, 19 nt, Homo sapiens
ucaacacacucaagaacag

SEQ ID NO: 95871 - RNA, 19 nt, Homo sapiens
gauuaguacacacuuguug

SEQ ID NO: 95872 - RNA, 19 nt, Homo sapiens
agugaggcaucgcaaugua

SEQ ID NO: 95873 - RNA, 19 nt, Homo sapiens
gagccaaacauccuacaag

SEQ ID NO: 95874 - RNA, 19 nt, Homo sapiens
caucaugaccuacgauuuu

SEQ ID NO: 95875 - RNA, 19 nt, Homo sapiens
acagguauauaaaggaagu

SEQ ID NO: 95876 - RNA, 19 nt, Homo sapiens
gcgcacccauggcuuugau

SEQ ID NO: 95877 - RNA, 19 nt, Homo sapiens
cacagcugcucaauaaagu

SEQ ID NO: 95878 - RNA, 19 nt, Homo sapiens
gcuucacucuggcuucuuc

SEQ ID NO: 95879 - RNA, 19 nt, Homo sapiens
gaccacaggccaucacagu

SEQ ID NO: 95880 - RNA, 19 nt, Homo sapiens
guacccacaucaucuacag

SEQ ID NO: 95881 - RNA, 19 nt, Homo sapiens
uuaccacccuaaucaagga

SEQ ID NO: 95882 - RNA, 19 nt, Homo sapiens
ggugugaaggcgucucaaa

SEQ ID NO: 95883 - RNA, 19 nt, Homo sapiens
gcucagcgcagcacugucu

SEQ ID NO: 95884 - RNA, 19 nt, Homo sapiens
gcugcucaauaaaguacaa

SEQ ID NO: 95885 - RNA, 19 nt, Homo sapiens
caauguaagacucgggauu

SEQ ID NO: 95886 - RNA, 19 nt, Homo sapiens
ggauggggcuguggggaua

SEQ ID NO: 95887 - RNA, 19 nt, Homo sapiens
ucaccaaugccaucaagga

SEQ ID NO: 95888 - RNA, 19 nt, Homo sapiens
gagccacaguccauagaac

SEQ ID NO: 95889 - RNA, 19 nt, Homo sapiens
ggacccuugccuacuauga

SEQ ID NO: 95890 - RNA, 19 nt, Homo sapiens
gacacagugaccauacuaa

SEQ ID NO: 95891 - RNA, 19 nt, Homo sapiens
gugaaggcgucucaaacag

SEQ ID NO: 95892 - RNA, 19 nt, Homo sapiens
ggagccacaguccauagaa

SEQ ID NO: 95893 - RNA, 19 nt, Homo sapiens
ggaauuccaggccgguuca

SEQ ID NO: 95894 - RNA, 19 nt, Homo sapiens
gucggaggauggaacuuug

SEQ ID NO: 95895 - RNA, 19 nt, Homo sapiens
cagugaccauacuaauuau

SEQ ID NO: 95896 - RNA, 19 nt, Homo sapiens
uaucaaaggacaccauuuu

SEQ ID NO: 95897 - RNA, 19 nt, Homo sapiens
ggauuaguacacacuuguu

SEQ ID NO: 95898 - RNA, 19 nt, Homo sapiens
acuaugagaucugugacuu

SEQ ID NO: 95899 - RNA, 19 nt, Homo sapiens
cccaacaccuggauuucau

SEQ ID NO: 95900 - RNA, 19 nt, Homo sapiens
ggcaagggaauuucuucaa

SEQ ID NO: 95901 - RNA, 19 nt, Homo sapiens
gggauuaguacacacuugu

SEQ ID NO: 95902 - RNA, 19 nt, Homo sapiens
gugaggcaucgcaauguaa

SEQ ID NO: 95903 - RNA, 19 nt, Homo sapiens
ugcaaguccugacagauuc

SEQ ID NO: 95904 - RNA, 19 nt, Homo sapiens
uauaagcaacgaucacauc

SEQ ID NO: 95905 - RNA, 19 nt, Homo sapiens
agacacagugaccauacua

SEQ ID NO: 95906 - RNA, 19 nt, Homo sapiens
caagacacagugaccauac

SEQ ID NO: 95907 - RNA, 19 nt, Homo sapiens
gaccuacgauuuucaugga

SEQ ID NO: 95908 - RNA, 19 nt, Homo sapiens
ucuacagcuuugccaauau

SEQ ID NO: 95909 - RNA, 19 nt, Homo sapiens
gcucaacacacucaagaac

SEQ ID NO: 95910 - RNA, 19 nt, Homo sapiens
acaagacacagugaccaua

SEQ ID NO: 95911 - RNA, 19 nt, Homo sapiens
auggaaauguuuacagauc

SEQ ID NO: 95912 - RNA, 19 nt, Homo sapiens
ggaagcccagccagggaaa

SEQ ID NO: 95913 - RNA, 19 nt, Homo sapiens
ugaaggccgaauuuauaaa

SEQ ID NO: 95914 - RNA, 19 nt, Homo sapiens
ggaggcaaaugauugauaa

SEQ ID NO: 95915 - RNA, 19 nt, Homo sapiens
ggacaagagugaagugaug

SEQ ID NO: 95916 - RNA, 19 nt, Homo sapiens
gggaggaucugccuacaaa

SEQ ID NO: 95917 - RNA, 19 nt, Homo sapiens
gccaugaucuggucuauug

SEQ ID NO: 95918 - RNA, 19 nt, Homo sapiens
gcucucaucucaucuauuc

SEQ ID NO: 95919 - RNA, 19 nt, Homo sapiens
gaccaagguucaguucuua

SEQ ID NO: 95920 - RNA, 19 nt, Homo sapiens
ggaauucauuaacuccaua

SEQ ID NO: 95921 - RNA, 19 nt, Homo sapiens
ccucuuagaucauagauug

SEQ ID NO: 95922 - RNA, 19 nt, Homo sapiens
ucacugugcugauucauga

SEQ ID NO: 95923 - RNA, 19 nt, Homo sapiens
gaucuggucuauugacaug

SEQ ID NO: 95924 - RNA, 19 nt, Homo sapiens
caacaagguuaucaucaag

SEQ ID NO: 95925 - RNA, 19 nt, Homo sapiens
ggaauucucaugugggauu

SEQ ID NO: 95926 - RNA, 19 nt, Homo sapiens
gcagggaggcaaaugauug

SEQ ID NO: 95927 - RNA, 19 nt, Homo sapiens
aggauuaacuuacagagaa

SEQ ID NO: 95928 - RNA, 19 nt, Homo sapiens
ccaagaaucccaaacugaa

SEQ ID NO: 95929 - RNA, 19 nt, Homo sapiens
caaaagaucuggauuucau

SEQ ID NO: 95930 - RNA, 19 nt, Homo sapiens
acaacaagguuaucaucaa

SEQ ID NO: 95931 - RNA, 19 nt, Homo sapiens
ugaguuagcagaagccuuu

SEQ ID NO: 95932 - RNA, 19 nt, Homo sapiens
caaccaccauggaccagaa

SEQ ID NO: 95933 - RNA, 19 nt, Homo sapiens
gggccaagcuccuacuaca

SEQ ID NO: 95934 - RNA, 19 nt, Homo sapiens
ggaaaggcuucucuugacu

SEQ ID NO: 95935 - RNA, 19 nt, Homo sapiens
ugacauggaugacuucacu

SEQ ID NO: 95936 - RNA, 19 nt, Homo sapiens
uaacuuugauggacuggau

SEQ ID NO: 95937 - RNA, 19 nt, Homo sapiens
cuacuacaauguggaauau

SEQ ID NO: 95938 - RNA, 19 nt, Homo sapiens
aaaauucucuuguccauug

SEQ ID NO: 95939 - RNA, 19 nt, Homo sapiens
agaccaagguucaguucuu

SEQ ID NO: 95940 - RNA, 19 nt, Homo sapiens
ugaggaaccauaacuuuga

SEQ ID NO: 95941 - RNA, 19 nt, Homo sapiens
caagaaucccaaacugaaa

SEQ ID NO: 95942 - RNA, 19 nt, Homo sapiens
ugaagaguauggagaccaa

SEQ ID NO: 95943 - RNA, 19 nt, Homo sapiens
gaggaaccauaacuuugau

SEQ ID NO: 95944 - RNA, 19 nt, Homo sapiens
cuacaucacgcuuggaauu

SEQ ID NO: 95945 - RNA, 19 nt, Homo sapiens
gguggauucuucuacauca

SEQ ID NO: 95946 - RNA, 19 nt, Homo sapiens
cagagaagcaggcaagaug

SEQ ID NO: 95947 - RNA, 19 nt, Homo sapiens
gggaggcaaaugauugaua

SEQ ID NO: 95948 - RNA, 19 nt, Homo sapiens
acacuggccucugcagaaa

SEQ ID NO: 95949 - RNA, 19 nt, Homo sapiens
gacuuccucuuagaucaua

SEQ ID NO: 95950 - RNA, 19 nt, Homo sapiens
uagcagaagccuuucagaa

SEQ ID NO: 95951 - RNA, 19 nt, Homo sapiens
ccuaugcucucaucucauc

SEQ ID NO: 95952 - RNA, 19 nt, Homo sapiens
ugacuucacuggcaaaucc

SEQ ID NO: 95953 - RNA, 19 nt, Homo sapiens
gaucugccaguuccugaaa

SEQ ID NO: 95954 - RNA, 19 nt, Homo sapiens
ggauuaacuuacagagaag

SEQ ID NO: 95955 - RNA, 19 nt, Homo sapiens
ugugaaggauuaacuuaca

SEQ ID NO: 95956 - RNA, 19 nt, Homo sapiens
gggcuaugaugaugugaag

SEQ ID NO: 95957 - RNA, 19 nt, Homo sapiens
ucacgcgccuccaggauca

SEQ ID NO: 95958 - RNA, 19 nt, Homo sapiens
ucauuucacugugcugauu

SEQ ID NO: 95959 - RNA, 19 nt, Homo sapiens
cuacccagaucagaaagaa

SEQ ID NO: 95960 - RNA, 19 nt, Homo sapiens
ggaggguaccuguuugguu

SEQ ID NO: 95961 - RNA, 19 nt, Homo sapiens
gaccaucaacagucucaaa

SEQ ID NO: 95962 - RNA, 19 nt, Homo sapiens
ccaagguucaguucuuaaa

SEQ ID NO: 95963 - RNA, 19 nt, Homo sapiens
gccaagcuccuacuacaau

SEQ ID NO: 95964 - RNA, 19 nt, Homo sapiens
acaagguuaucaucaagga

SEQ ID NO: 95965 - RNA, 19 nt, Homo sapiens
gagccaugaucuggucuau

SEQ ID NO: 95966 - RNA, 19 nt, Homo sapiens
ccacauaugggcacuccuu

SEQ ID NO: 95967 - RNA, 19 nt, Homo sapiens
ggcaaaugauugauaacag

SEQ ID NO: 95968 - RNA, 19 nt, Homo sapiens
aaggaaaggcuucucuuga

SEQ ID NO: 95969 - RNA, 19 nt, Homo sapiens
uccauaauccuguuucuga

SEQ ID NO: 95970 - RNA, 19 nt, Homo sapiens
gauuggaccugguuuuguu

SEQ ID NO: 95971 - RNA, 19 nt, Homo sapiens
cuauugacauggaugacuu

SEQ ID NO: 95972 - RNA, 19 nt, Homo sapiens
augaugaugugaagaguau

SEQ ID NO: 95973 - RNA, 19 nt, Homo sapiens
auaagggaaugccaucaga

SEQ ID NO: 95974 - RNA, 19 nt, Homo sapiens
ggugggcuaugaugaugug

SEQ ID NO: 95975 - RNA, 19 nt, Homo sapiens
ccaagcuccuacuacaaug

SEQ ID NO: 95976 - RNA, 19 nt, Homo sapiens
ucaucaaccuccuguccuu

SEQ ID NO: 95977 - RNA, 19 nt, Homo sapiens
cugcagcuguugacuuguu

SEQ ID NO: 95978 - RNA, 19 nt, Homo sapiens
ccaagccuuuccugacuuc

SEQ ID NO: 95979 - RNA, 19 nt, Homo sapiens
guauggagaccaagguuca

SEQ ID NO: 95980 - RNA, 19 nt, Homo sapiens
ugugcugauucaugaguua

SEQ ID NO: 95981 - RNA, 19 nt, Homo sapiens
gaagcuggccaaggauaug

SEQ ID NO: 95982 - RNA, 19 nt, Homo sapiens
aaacaacaagguuaucauc

SEQ ID NO: 95983 - RNA, 19 nt, Homo sapiens
caucucaucuauucauucg

SEQ ID NO: 95984 - RNA, 19 nt, Homo sapiens
ccuacuacaauguggaaua

SEQ ID NO: 95985 - RNA, 19 nt, Homo sapiens
ggccacaacagcccucuga

SEQ ID NO: 95986 - RNA, 19 nt, Homo sapiens
cauuggaggguaccuguuu

SEQ ID NO: 95987 - RNA, 19 nt, Homo sapiens
gcccugaaguacaauaaaa

SEQ ID NO: 95988 - RNA, 19 nt, Homo sapiens
gcaggaaccaggaaaauuc

SEQ ID NO: 95989 - RNA, 19 nt, Homo sapiens
gugaagugaugcucuacca

SEQ ID NO: 95990 - RNA, 19 nt, Homo sapiens
gggcagguguaguggucuu

SEQ ID NO: 95991 - RNA, 19 nt, Homo sapiens
ggagaccaagguucaguuc

SEQ ID NO: 95992 - RNA, 19 nt, Homo sapiens
gggaaugccaucagagaag

SEQ ID NO: 95993 - RNA, 19 nt, Homo sapiens
ucugaggaaccauaacuuu

SEQ ID NO: 95994 - RNA, 19 nt, Homo sapiens
uaugguggauucuucuaca

SEQ ID NO: 95995 - RNA, 19 nt, Homo sapiens
gaaaauucaccccugagaa

SEQ ID NO: 95996 - RNA, 19 nt, Homo sapiens
gaaaacaacaagguuauca

SEQ ID NO: 95997 - RNA, 19 nt, Homo sapiens
gaggaucugccuacaaacu

SEQ ID NO: 95998 - RNA, 19 nt, Homo sapiens
aggaaaggcuucucuugac

SEQ ID NO: 95999 - RNA, 19 nt, Homo sapiens
gcuaugaugaugugaagag

SEQ ID NO: 96000 - RNA, 19 nt, Homo sapiens
ggcaaaagaucuggauuuc

SEQ ID NO: 96001 - RNA, 19 nt, Homo sapiens
gcuuggaauucauuaacuc

SEQ ID NO: 96002 - RNA, 19 nt, Homo sapiens
uccugcagcuguugacuug

SEQ ID NO: 96003 - RNA, 19 nt, Homo sapiens
cagggaggcaaaugauuga

SEQ ID NO: 96004 - RNA, 19 nt, Homo sapiens
aaccaagaaucccaaacug

SEQ ID NO: 96005 - RNA, 19 nt, Homo sapiens
cuugugaaggauuaacuua

SEQ ID NO: 96006 - RNA, 19 nt, Homo sapiens
auuaugagaucugccaguu

SEQ ID NO: 96007 - RNA, 19 nt, Homo sapiens
aagaagcuggccaaggaua

SEQ ID NO: 96008 - RNA, 19 nt, Homo sapiens
ccaaggaaaggcuucucuu

SEQ ID NO: 96009 - RNA, 19 nt, Homo sapiens
aaaccaagaaucccaaacu

SEQ ID NO: 96010 - RNA, 19 nt, Homo sapiens
agagaagcaggcaagauga

SEQ ID NO: 96011 - RNA, 19 nt, Homo sapiens
uguccaagcagucaagaga

SEQ ID NO: 96012 - RNA, 19 nt, Homo sapiens
ggucuauugacauggauga

SEQ ID NO: 96013 - RNA, 19 nt, Homo sapiens
gaauauugaccccuuccua

SEQ ID NO: 96014 - RNA, 19 nt, Homo sapiens
gaaguucacagauauggua

SEQ ID NO: 96015 - RNA, 19 nt, Homo sapiens
acucagaaguucacagaua

SEQ ID NO: 96016 - RNA, 19 nt, Homo sapiens
gagggaugcuggccuacua

SEQ ID NO: 96017 - RNA, 19 nt, Homo sapiens
caacaaccgucagaccuuu

SEQ ID NO: 96018 - RNA, 19 nt, Homo sapiens
guacaggacuuggccaaug

SEQ ID NO: 96019 - RNA, 19 nt, Homo sapiens
ucaauggccugaagaagau

SEQ ID NO: 96020 - RNA, 19 nt, Homo sapiens
aaacuggucugcuacuuca

SEQ ID NO: 96021 - RNA, 19 nt, Homo sapiens
gaacugagucuuccauacu

SEQ ID NO: 96022 - RNA, 19 nt, Homo sapiens
gcacucagaaguucacaga

SEQ ID NO: 96023 - RNA, 19 nt, Homo sapiens
gagaaggucacgggacaua

SEQ ID NO: 96024 - RNA, 19 nt, Homo sapiens
ucagguuucugcgcaaaua

SEQ ID NO: 96025 - RNA, 19 nt, Homo sapiens
gcacuggacuuagaugacu

SEQ ID NO: 96026 - RNA, 19 nt, Homo sapiens
ggucugggcacuggacuua

SEQ ID NO: 96027 - RNA, 19 nt, Homo sapiens
caacucggccaucagguuu

SEQ ID NO: 96028 - RNA, 19 nt, Homo sapiens
caccuggaauugagucgua

SEQ ID NO: 96029 - RNA, 19 nt, Homo sapiens
cagccugccuccuggguuu

SEQ ID NO: 96030 - RNA, 19 nt, Homo sapiens
gauacgagguggacaaaau

SEQ ID NO: 96031 - RNA, 19 nt, Homo sapiens
gaugcuggccuacuaugaa

SEQ ID NO: 96032 - RNA, 19 nt, Homo sapiens
aaaccaaggucagcuaucu

SEQ ID NO: 96033 - RNA, 19 nt, Homo sapiens
cgacaggccugguguucag

SEQ ID NO: 96034 - RNA, 19 nt, Homo sapiens
gcaaaugcugcaccuggaa

SEQ ID NO: 96035 - RNA, 19 nt, Homo sapiens
uuucuguggucuuccuuua

SEQ ID NO: 96036 - RNA, 19 nt, Homo sapiens
caaagcugaugggcucuau

SEQ ID NO: 96037 - RNA, 19 nt, Homo sapiens
ggaacgccuucuucugagu

SEQ ID NO: 96038 - RNA, 19 nt, Homo sapiens
cucagaaguucacagauau

SEQ ID NO: 96039 - RNA, 19 nt, Homo sapiens
cagcugggcagaccuaugu

SEQ ID NO: 96040 - RNA, 19 nt, Homo sapiens
gaucagaaggugcccuaca

SEQ ID NO: 96041 - RNA, 19 nt, Homo sapiens
gaaggucacgggacauaac

SEQ ID NO: 96042 - RNA, 19 nt, Homo sapiens
gaaccuggauuuugucaac

SEQ ID NO: 96043 - RNA, 19 nt, Homo sapiens
cgucagaccuuugucaacu

SEQ ID NO: 96044 - RNA, 19 nt, Homo sapiens
cagcaacuccugcaaaugc

SEQ ID NO: 96045 - RNA, 19 nt, Homo sapiens
ggaauuucggcacucagaa

SEQ ID NO: 96046 - RNA, 19 nt, Homo sapiens
caagcugaagacccuguua

SEQ ID NO: 96047 - RNA, 19 nt, Homo sapiens
guucagcaacuccugcaaa

SEQ ID NO: 96048 - RNA, 19 nt, Homo sapiens
gaacgguccagcuucuaca

SEQ ID NO: 96049 - RNA, 19 nt, Homo sapiens
ggaugcuggccuacuauga

SEQ ID NO: 96050 - RNA, 19 nt, Homo sapiens
caucagguuucugcgcaaa

SEQ ID NO: 96051 - RNA, 19 nt, Homo sapiens
cagcugagcaccacugagu

SEQ ID NO: 96052 - RNA, 19 nt, Homo sapiens
gcaaagcugaugggcucua

SEQ ID NO: 96053 - RNA, 19 nt, Homo sapiens
ucugggcacuggacuuaga

SEQ ID NO: 96054 - RNA, 19 nt, Homo sapiens
gcgcuucacaacccuggua

SEQ ID NO: 96055 - RNA, 19 nt, Homo sapiens
gacaaggagcgcuucacaa

SEQ ID NO: 96056 - RNA, 19 nt, Homo sapiens
gaauuucggcacucagaag

SEQ ID NO: 96057 - RNA, 19 nt, Homo sapiens
cugcaaaacuggucugcua

SEQ ID NO: 96058 - RNA, 19 nt, Homo sapiens
ccaacaaccgucagaccuu

SEQ ID NO: 96059 - RNA, 19 nt, Homo sapiens
ucuguggucuuccuuuauc

SEQ ID NO: 96060 - RNA, 19 nt, Homo sapiens
gcuggaauuucggcacuca

SEQ ID NO: 96061 - RNA, 19 nt, Homo sapiens
caucggaggcuggaauuuc

SEQ ID NO: 96062 - RNA, 19 nt, Homo sapiens
ggaacgguccagcuucuac

SEQ ID NO: 96063 - RNA, 19 nt, Homo sapiens
guggagagcuucaaaacca

SEQ ID NO: 96064 - RNA, 19 nt, Homo sapiens
uugaugauguggagagcuu

SEQ ID NO: 96065 - RNA, 19 nt, Homo sapiens
ggugggcuuugaugaugug

SEQ ID NO: 96066 - RNA, 19 nt, Homo sapiens
ugggugggcuuugaugaug

SEQ ID NO: 96067 - RNA, 19 nt, Homo sapiens
cguggaugcugcugugcaa

SEQ ID NO: 96068 - RNA, 19 nt, Homo sapiens
caagaggcaagaagagagu

SEQ ID NO: 96069 - RNA, 19 nt, Homo sapiens
ccuuauggccuacgacuuc

SEQ ID NO: 96070 - RNA, 19 nt, Homo sapiens
cuauguggaugcuggauac

SEQ ID NO: 96071 - RNA, 19 nt, Homo sapiens
acaaggagcgcuucacaac

SEQ ID NO: 96072 - RNA, 19 nt, Homo sapiens
ucaacucggccaucagguu

SEQ ID NO: 96073 - RNA, 19 nt, Homo sapiens
caaaugcugcaccuggaau

SEQ ID NO: 96074 - RNA, 19 nt, Homo sapiens
gggcacuggacuuagauga

SEQ ID NO: 96075 - RNA, 19 nt, Homo sapiens
gcccugccguagacaagga

SEQ ID NO: 96076 - RNA, 19 nt, Homo sapiens
agaaggugcccuacaucuu

SEQ ID NO: 96077 - RNA, 19 nt, Homo sapiens
acacuggccuccucaucag

SEQ ID NO: 96078 - RNA, 19 nt, Homo sapiens
agaugaaucccaagcugaa

SEQ ID NO: 96079 - RNA, 19 nt, Homo sapiens
ugaguggaaugacgagacu

SEQ ID NO: 96080 - RNA, 19 nt, Homo sapiens
cuacggacgcuccuucaca

SEQ ID NO: 96081 - RNA, 19 nt, Homo sapiens
agacaaggagcgcuucaca

SEQ ID NO: 96082 - RNA, 19 nt, Homo sapiens
ggcccaggaucacucuaca

SEQ ID NO: 96083 - RNA, 19 nt, Homo sapiens
aacugagucuuccauacuu

SEQ ID NO: 96084 - RNA, 19 nt, Homo sapiens
cggcaggaacugagucuuc

SEQ ID NO: 96085 - RNA, 19 nt, Homo sapiens
cccuuucacuugcaaaaua

SEQ ID NO: 96086 - RNA, 19 nt, Homo sapiens
ucucagccuugccuuccuu

SEQ ID NO: 96087 - RNA, 19 nt, Homo sapiens
uucagcaacuccugcaaau

SEQ ID NO: 96088 - RNA, 19 nt, Homo sapiens
gggugggcuuugaugaugu

SEQ ID NO: 96089 - RNA, 19 nt, Homo sapiens
cagaaggugcccuacaucu

SEQ ID NO: 96090 - RNA, 19 nt, Homo sapiens
cacacuggccuccucauca

SEQ ID NO: 96091 - RNA, 19 nt, Homo sapiens
gagaaggcauuucauauuu

SEQ ID NO: 96092 - RNA, 19 nt, Homo sapiens
gaauuaaguuugccagaua

SEQ ID NO: 96093 - RNA, 19 nt, Homo sapiens
caacaucucugaauccuuu

SEQ ID NO: 96094 - RNA, 19 nt, Homo sapiens
cagaugagguccuguaaua

SEQ ID NO: 96095 - RNA, 19 nt, Homo sapiens
gaagaaauguugcuugaag

SEQ ID NO: 96096 - RNA, 19 nt, Homo sapiens
gagcaaacauccggaagua

SEQ ID NO: 96097 - RNA, 19 nt, Homo sapiens
gugaguggauguaugauua

SEQ ID NO: 96098 - RNA, 19 nt, Homo sapiens
gcugugaaauccauauaua

SEQ ID NO: 96099 - RNA, 19 nt, Homo sapiens
ggaaguaucccaccaagaa

SEQ ID NO: 96100 - RNA, 19 nt, Homo sapiens
gacgaaauauagugcaaua

SEQ ID NO: 96101 - RNA, 19 nt, Homo sapiens
gaaauauagugcaauagug

SEQ ID NO: 96102 - RNA, 19 nt, Homo sapiens
gaauacagcaguuacaauu

SEQ ID NO: 96103 - RNA, 19 nt, Homo sapiens
gcgauuagauacugaagaa

SEQ ID NO: 96104 - RNA, 19 nt, Homo sapiens
gaucauugcuugaaucuac

SEQ ID NO: 96105 - RNA, 19 nt, Homo sapiens
cgaacaagcucagaaagaa

SEQ ID NO: 96106 - RNA, 19 nt, Homo sapiens
gcaagaguaagcaguguua

SEQ ID NO: 96107 - RNA, 19 nt, Homo sapiens
uaaaggaagugcugagaau

SEQ ID NO: 96108 - RNA, 19 nt, Homo sapiens
uccagaagcugcuccuuua

SEQ ID NO: 96109 - RNA, 19 nt, Homo sapiens
gggcuaagguuuccaguca

SEQ ID NO: 96110 - RNA, 19 nt, Homo sapiens
guagauggcgacuguguua

SEQ ID NO: 96111 - RNA, 19 nt, Homo sapiens
guacuuugguuaauguuga

SEQ ID NO: 96112 - RNA, 19 nt, Homo sapiens
gaaauguugcuugaaguua

SEQ ID NO: 96113 - RNA, 19 nt, Homo sapiens
gaugagguccuguaauaaa

SEQ ID NO: 96114 - RNA, 19 nt, Homo sapiens
ccacaucagugucaucaga

SEQ ID NO: 96115 - RNA, 19 nt, Homo sapiens
gaacaagcucagaaagaaa

SEQ ID NO: 96116 - RNA, 19 nt, Homo sapiens
aagaagaaauguugcuuga

SEQ ID NO: 96117 - RNA, 19 nt, Homo sapiens
acugaggaauccagaauua

SEQ ID NO: 96118 - RNA, 19 nt, Homo sapiens
gcucauugauuucgaauac

SEQ ID NO: 96119 - RNA, 19 nt, Homo sapiens
gcagguacuuugguuaaug

SEQ ID NO: 96120 - RNA, 19 nt, Homo sapiens
ggaaaaguaucuaaaggaa

SEQ ID NO: 96121 - RNA, 19 nt, Homo sapiens
gaaggcauuucauauuugg

SEQ ID NO: 96122 - RNA, 19 nt, Homo sapiens
gagcgacguuuauuucauc

SEQ ID NO: 96123 - RNA, 19 nt, Homo sapiens
gcaaacauccggaaguauc

SEQ ID NO: 96124 - RNA, 19 nt, Homo sapiens
aaacugaugcucauugauu

SEQ ID NO: 96125 - RNA, 19 nt, Homo sapiens
gaaacgagaucgggaagac

SEQ ID NO: 96126 - RNA, 19 nt, Homo sapiens
gaguggauguaugauuaua

SEQ ID NO: 96127 - RNA, 19 nt, Homo sapiens
acaaauugcucaguuacaa

SEQ ID NO: 96128 - RNA, 19 nt, Homo sapiens
gaagugcugagaauuaaau

SEQ ID NO: 96129 - RNA, 19 nt, Homo sapiens
gcuaagguuuccagucaga

SEQ ID NO: 96130 - RNA, 19 nt, Homo sapiens
agaaacaacagcuccauuu

SEQ ID NO: 96131 - RNA, 19 nt, Homo sapiens
gcaagugagcagagaugua

SEQ ID NO: 96132 - RNA, 19 nt, Homo sapiens
caacagcuccauuuuauuu

SEQ ID NO: 96133 - RNA, 19 nt, Homo sapiens
cuagagaaggcauuucaua

SEQ ID NO: 96134 - RNA, 19 nt, Homo sapiens
gcuugaaguuaauagguuu

SEQ ID NO: 96135 - RNA, 19 nt, Homo sapiens
gaaguaucccaccaagaaa

SEQ ID NO: 96136 - RNA, 19 nt, Homo sapiens
agaaacugaugcucauuga

SEQ ID NO: 96137 - RNA, 19 nt, Homo sapiens
gggcguggaucgaguguag

SEQ ID NO: 96138 - RNA, 19 nt, Homo sapiens
gcucacuacugaacacaug

SEQ ID NO: 96139 - RNA, 19 nt, Homo sapiens
aaggaagugcugagaauua

SEQ ID NO: 96140 - RNA, 19 nt, Homo sapiens
agaaggcauuucauauuug

SEQ ID NO: 96141 - RNA, 19 nt, Homo sapiens
agagaaggcauuucauauu

SEQ ID NO: 96142 - RNA, 19 nt, Homo sapiens
ccaguuacuugccugcauu

SEQ ID NO: 96143 - RNA, 19 nt, Homo sapiens
ggagcgacguuuauuucau

SEQ ID NO: 96144 - RNA, 19 nt, Homo sapiens
ggauguaugauuauagcua

SEQ ID NO: 96145 - RNA, 19 nt, Homo sapiens
ugaggaauccagaauuaaa

SEQ ID NO: 96146 - RNA, 19 nt, Homo sapiens
gaggcaaacagcaagagua

SEQ ID NO: 96147 - RNA, 19 nt, Homo sapiens
gaggacgaguuccacauca

SEQ ID NO: 96148 - RNA, 19 nt, Homo sapiens
guuacaaucugcccuugga

SEQ ID NO: 96149 - RNA, 19 nt, Homo sapiens
caucucuuguuuacgauuu

SEQ ID NO: 96150 - RNA, 19 nt, Homo sapiens
uuacuugccugcauuccaa

SEQ ID NO: 96151 - RNA, 19 nt, Homo sapiens
aggaagugcugagaauuaa

SEQ ID NO: 96152 - RNA, 19 nt, Homo sapiens
gaucgaguguagcugugaa

SEQ ID NO: 96153 - RNA, 19 nt, Homo sapiens
cgaaauauagugcaauagu

SEQ ID NO: 96154 - RNA, 19 nt, Homo sapiens
gcaaacagcaagaguaagc

SEQ ID NO: 96155 - RNA, 19 nt, Homo sapiens
ccaguuguauuuugucaua

SEQ ID NO: 96156 - RNA, 19 nt, Homo sapiens
ccagcgaccucgaguccaa

SEQ ID NO: 96157 - RNA, 19 nt, Homo sapiens
gauggcgacuguguuauag

SEQ ID NO: 96158 - RNA, 19 nt, Homo sapiens
cugcagaaaucgccgagaa

SEQ ID NO: 96159 - RNA, 19 nt, Homo sapiens
uuucaucucuuguuuacga

SEQ ID NO: 96160 - RNA, 19 nt, Homo sapiens
gguuugcccuugcaucuca

SEQ ID NO: 96161 - RNA, 19 nt, Homo sapiens
aaacaacagcuccauuuua

SEQ ID NO: 96162 - RNA, 19 nt, Homo sapiens
uccacaaauugcucaguua

SEQ ID NO: 96163 - RNA, 19 nt, Homo sapiens
uagagaaggcauuucauau

SEQ ID NO: 96164 - RNA, 19 nt, Homo sapiens
caagguuugaugccuauuu

SEQ ID NO: 96165 - RNA, 19 nt, Homo sapiens
cauuggaaaucacuucugu

SEQ ID NO: 96166 - RNA, 19 nt, Homo sapiens
gaugcucauugauuucgaa

SEQ ID NO: 96167 - RNA, 19 nt, Homo sapiens
uaaagagggauccgaacaa

SEQ ID NO: 96168 - RNA, 19 nt, Homo sapiens
gaguguagcugugaaaucc

SEQ ID NO: 96169 - RNA, 19 nt, Homo sapiens
gaaacaacagcuccauuuu

SEQ ID NO: 96170 - RNA, 19 nt, Homo sapiens
ugagaucauugcuugaauc

SEQ ID NO: 96171 - RNA, 19 nt, Homo sapiens
ucaugaaugugcuggugaa

SEQ ID NO: 96172 - RNA, 19 nt, Homo sapiens
cagguacuuugguuaaugu

SEQ ID NO: 96173 - RNA, 19 nt, Homo sapiens
cgacguuuauuucaucucu

SEQ ID NO: 96174 - RNA, 19 nt, Homo sapiens
auacagcaguuacaauuac

SEQ ID NO: 96175 - RNA, 19 nt, Homo sapiens
gggccuaucuguggugcaa

SEQ ID NO: 96176 - RNA, 19 nt, Homo sapiens
agaauuaaguuugccagau

SEQ ID NO: 96177 - RNA, 19 nt, Homo sapiens
uuggguggcucacuacuga

SEQ ID NO: 96178 - RNA, 19 nt, Homo sapiens
ccucaucacuggacugcau

SEQ ID NO: 96179 - RNA, 19 nt, Homo sapiens
agaagguaauaucuuguug

SEQ ID NO: 96180 - RNA, 19 nt, Homo sapiens
gcuugaaucuacuccaucu

SEQ ID NO: 96181 - RNA, 19 nt, Homo sapiens
ggaagugcugagaauuaaa

SEQ ID NO: 96182 - RNA, 19 nt, Homo sapiens
aagcggagcagcuggauug

SEQ ID NO: 96183 - RNA, 19 nt, Homo sapiens
gggaagacgaaauauagug

SEQ ID NO: 96184 - RNA, 19 nt, Homo sapiens
cagaaacugaugcucauug

SEQ ID NO: 96185 - RNA, 19 nt, Homo sapiens
uaaguuugccagauauuuc

SEQ ID NO: 96186 - RNA, 19 nt, Homo sapiens
aaagagggauccgaacaag

SEQ ID NO: 96187 - RNA, 19 nt, Homo sapiens
guccagaagcugcuccuuu

SEQ ID NO: 96188 - RNA, 19 nt, Homo sapiens
gacagcaagugagcagaga

SEQ ID NO: 96189 - RNA, 19 nt, Homo sapiens
gauccgaacaagcucagaa

SEQ ID NO: 96190 - RNA, 19 nt, Homo sapiens
aacugaugcucauugauuu

SEQ ID NO: 96191 - RNA, 19 nt, Homo sapiens
ggaauggccuuucuacaaa

SEQ ID NO: 96192 - RNA, 19 nt, Homo sapiens
ggaagaagauuugcuggua

SEQ ID NO: 96193 - RNA, 19 nt, Homo sapiens
gaacagcaguugcauuuua

SEQ ID NO: 96194 - RNA, 19 nt, Homo sapiens
gugaguggguuuaugauua

SEQ ID NO: 96195 - RNA, 19 nt, Homo sapiens
ccacgaagauggcgcaauu

SEQ ID NO: 96196 - RNA, 19 nt, Homo sapiens
ccgaggagcugaggguuua

SEQ ID NO: 96197 - RNA, 19 nt, Homo sapiens
cauagaauuugguuacuug

SEQ ID NO: 96198 - RNA, 19 nt, Homo sapiens
caacuggccucccugagau

SEQ ID NO: 96199 - RNA, 19 nt, Homo sapiens
gaagauggcgcaauuucau

SEQ ID NO: 96200 - RNA, 19 nt, Homo sapiens
aagaacagcaguugcauuu

SEQ ID NO: 96201 - RNA, 19 nt, Homo sapiens
ugaguggguuuaugauuau

SEQ ID NO: 96202 - RNA, 19 nt, Homo sapiens
gaacaguacaucccaaguc

SEQ ID NO: 96203 - RNA, 19 nt, Homo sapiens
cagcagccauugccacgaa

SEQ ID NO: 96204 - RNA, 19 nt, Homo sapiens
ugaaccugcuggagaugua

SEQ ID NO: 96205 - RNA, 19 nt, Homo sapiens
ggaggaacaacgagcagaa

SEQ ID NO: 96206 - RNA, 19 nt, Homo sapiens
aagcaaggcccacagacua

SEQ ID NO: 96207 - RNA, 19 nt, Homo sapiens
aagaagauuugcugguaga

SEQ ID NO: 96208 - RNA, 19 nt, Homo sapiens
ccauagaauuugguuacuu

SEQ ID NO: 96209 - RNA, 19 nt, Homo sapiens
agagaaaacuggaagaaga

SEQ ID NO: 96210 - RNA, 19 nt, Homo sapiens
uguacagccugaaggauga

SEQ ID NO: 96211 - RNA, 19 nt, Homo sapiens
ccaacuggccucccugaga

SEQ ID NO: 96212 - RNA, 19 nt, Homo sapiens
caagaacagcaguugcauu

SEQ ID NO: 96213 - RNA, 19 nt, Homo sapiens
ccauggagcgguaccuaaa

SEQ ID NO: 96214 - RNA, 19 nt, Homo sapiens
cggagagacccgaguauga

SEQ ID NO: 96215 - RNA, 19 nt, Homo sapiens
gcauccauguccaccauag

SEQ ID NO: 96216 - RNA, 19 nt, Homo sapiens
gcucuggcaucccauuucu

SEQ ID NO: 96217 - RNA, 19 nt, Homo sapiens
aagauuugcugguagaagu

SEQ ID NO: 96218 - RNA, 19 nt, Homo sapiens
aggaauggccuuucuacaa

SEQ ID NO: 96219 - RNA, 19 nt, Homo sapiens
ugauuauacucacgaggaa

SEQ ID NO: 96220 - RNA, 19 nt, Homo sapiens
guagaagucagucgguaug

SEQ ID NO: 96221 - RNA, 19 nt, Homo sapiens
gaacaucuugcugcucuca

SEQ ID NO: 96222 - RNA, 19 nt, Homo sapiens
agaugaaccugcuggagau

SEQ ID NO: 96223 - RNA, 19 nt, Homo sapiens
acaauaaacaagcuucuuc

SEQ ID NO: 96224 - RNA, 19 nt, Homo sapiens
cauguccaccauagaauuu

SEQ ID NO: 96225 - RNA, 19 nt, Homo sapiens
gaguggguuuaugauuaua

SEQ ID NO: 96226 - RNA, 19 nt, Homo sapiens
ccaggaagggaacaucuug

SEQ ID NO: 96227 - RNA, 19 nt, Homo sapiens
ccacaaugacauccaggaa

SEQ ID NO: 96228 - RNA, 19 nt, Homo sapiens
cgaagauggcgcaauuuca

SEQ ID NO: 96229 - RNA, 19 nt, Homo sapiens
gguagaagucagucgguau

SEQ ID NO: 96230 - RNA, 19 nt, Homo sapiens
cccaagaggagcagagaaa

SEQ ID NO: 96231 - RNA, 19 nt, Homo sapiens
auaaacaagcuucuucuuc

SEQ ID NO: 96232 - RNA, 19 nt, Homo sapiens
guaacacaauaaacaagcu

SEQ ID NO: 96233 - RNA, 19 nt, Homo sapiens
gggcaaccucaggaaguua

SEQ ID NO: 96234 - RNA, 19 nt, Homo sapiens
gcuagaaagcgugauguuc

SEQ ID NO: 96235 - RNA, 19 nt, Homo sapiens
ggagagacccgaguaugac

SEQ ID NO: 96236 - RNA, 19 nt, Homo sapiens
ggagauguacagccugaag

SEQ ID NO: 96237 - RNA, 19 nt, Homo sapiens
ccauguccaccauagaauu

SEQ ID NO: 96238 - RNA, 19 nt, Homo sapiens
gaaaacuggaagaagauuu

SEQ ID NO: 96239 - RNA, 19 nt, Homo sapiens
ggccuguuccugaguuuga

SEQ ID NO: 96240 - RNA, 19 nt, Homo sapiens
gaagauuugcugguagaag

SEQ ID NO: 96241 - RNA, 19 nt, Homo sapiens
gcuguacggagccaucuug

SEQ ID NO: 96242 - RNA, 19 nt, Homo sapiens
caauaaacaagcuucuucu

SEQ ID NO: 96243 - RNA, 19 nt, Homo sapiens
ucgaguacagcaguuauaa

SEQ ID NO: 96244 - RNA, 19 nt, Homo sapiens
ggguuuaugauuauacuca

SEQ ID NO: 96245 - RNA, 19 nt, Homo sapiens
uauaggggcuuugacauug

SEQ ID NO: 96246 - RNA, 19 nt, Homo sapiens
gaccauggagcgguaccua

SEQ ID NO: 96247 - RNA, 19 nt, Homo sapiens
gcuugcagcagucuaagug

SEQ ID NO: 96248 - RNA, 19 nt, Homo sapiens
gaggaauggccuuucuaca

SEQ ID NO: 96249 - RNA, 19 nt, Homo sapiens
acaucuugcugcucucaga

SEQ ID NO: 96250 - RNA, 19 nt, Homo sapiens
gagcuucgagagccagugu

SEQ ID NO: 96251 - RNA, 19 nt, Homo sapiens
ugggcaaccucaggaaguu

SEQ ID NO: 96252 - RNA, 19 nt, Homo sapiens
caucccaagucggccauug

SEQ ID NO: 96253 - RNA, 19 nt, Homo sapiens
ccaagucggccauugaaaa

SEQ ID NO: 96254 - RNA, 19 nt, Homo sapiens
acaaagcaaggcccacaga

SEQ ID NO: 96255 - RNA, 19 nt, Homo sapiens
ggaacaguacaucccaagu

SEQ ID NO: 96256 - RNA, 19 nt, Homo sapiens
gugauguucgccauacuug

SEQ ID NO: 96257 - RNA, 19 nt, Homo sapiens
cacgaggaauggccuuucu

SEQ ID NO: 96258 - RNA, 19 nt, Homo sapiens
cucaggaaguuacuagagu

SEQ ID NO: 96259 - RNA, 19 nt, Homo sapiens
uggacucccuggugcuaga

SEQ ID NO: 96260 - RNA, 19 nt, Homo sapiens
gcaaaggccucaucaagaa

SEQ ID NO: 96261 - RNA, 19 nt, Homo sapiens
ggaauggccuuucuacaaa

SEQ ID NO: 96262 - RNA, 19 nt, Homo sapiens
ggaagaagauuugcuggua

SEQ ID NO: 96263 - RNA, 19 nt, Homo sapiens
gaacagcaguugcauuuua

SEQ ID NO: 96264 - RNA, 19 nt, Homo sapiens
gugaguggguuuaugauua

SEQ ID NO: 96265 - RNA, 19 nt, Homo sapiens
ccacgaagauggcgcaauu

SEQ ID NO: 96266 - RNA, 19 nt, Homo sapiens
gaugauggcuauggaguuu

SEQ ID NO: 96267 - RNA, 19 nt, Homo sapiens
gaagaaaucaagccuguga

SEQ ID NO: 96268 - RNA, 19 nt, Homo sapiens
gaucauguaucgccguaaa

SEQ ID NO: 96269 - RNA, 19 nt, Homo sapiens
gaccagcccugaugccuuu

SEQ ID NO: 96270 - RNA, 19 nt, Homo sapiens
gcaaagcccugcuggacau

SEQ ID NO: 96271 - RNA, 19 nt, Homo sapiens
ugacguaggcucugagaua

SEQ ID NO: 96272 - RNA, 19 nt, Homo sapiens
ccgaggagcugaggguuua

SEQ ID NO: 96273 - RNA, 19 nt, Homo sapiens
ccagaaggcugcuaagaag

SEQ ID NO: 96274 - RNA, 19 nt, Homo sapiens
cauagaauuugguuacuug

SEQ ID NO: 96275 - RNA, 19 nt, Homo sapiens
ggaguuuccuacaugauug

SEQ ID NO: 96276 - RNA, 19 nt, Homo sapiens
cuaagaagcaccagaauau

SEQ ID NO: 96277 - RNA, 19 nt, Homo sapiens
gcuaagaagcaccagaaua

SEQ ID NO: 96278 - RNA, 19 nt, Homo sapiens
agaaauaccuggugcucaa

SEQ ID NO: 96279 - RNA, 19 nt, Homo sapiens
ccaaagaauuccaggacaa

SEQ ID NO: 96280 - RNA, 19 nt, Homo sapiens
gggaucaacuccuggaaga

SEQ ID NO: 96281 - RNA, 19 nt, Homo sapiens
ggacuugugugaccugcuu

SEQ ID NO: 96282 - RNA, 19 nt, Homo sapiens
gacaaauccuucacucuca

SEQ ID NO: 96283 - RNA, 19 nt, Homo sapiens
cagcaacuauuaugucaug

SEQ ID NO: 96284 - RNA, 19 nt, Homo sapiens
gaacagcaacuauuauguc

SEQ ID NO: 96285 - RNA, 19 nt, Homo sapiens
gcugaagguuggagaaaug

SEQ ID NO: 96286 - RNA, 19 nt, Homo sapiens
ggacauugcugaucuuuuc

SEQ ID NO: 96287 - RNA, 19 nt, Homo sapiens
caacuggccucccugagau

SEQ ID NO: 96288 - RNA, 19 nt, Homo sapiens
gaucaacuccuggaagaaa

SEQ ID NO: 96289 - RNA, 19 nt, Homo sapiens
gaagauggcgcaauuucau

SEQ ID NO: 96290 - RNA, 19 nt, Homo sapiens
ugugugaccugcuuugaaa

SEQ ID NO: 96291 - RNA, 19 nt, Homo sapiens
gcuggaagacuguucauga

SEQ ID NO: 96292 - RNA, 19 nt, Homo sapiens
cagacgacguggaguugua

SEQ ID NO: 96293 - RNA, 19 nt, Homo sapiens
uggaugaugaggaauauua

SEQ ID NO: 96294 - RNA, 19 nt, Homo sapiens
aagaacagcaguugcauuu

SEQ ID NO: 96295 - RNA, 19 nt, Homo sapiens
ugaguggguuuaugauuau

SEQ ID NO: 96296 - RNA, 19 nt, Homo sapiens
auaaauacuugccucagaa

SEQ ID NO: 96297 - RNA, 19 nt, Homo sapiens
gaacaguacaucccaaguc

SEQ ID NO: 96298 - RNA, 19 nt, Homo sapiens
aauaaauacuugccucaga

SEQ ID NO: 96299 - RNA, 19 nt, Homo sapiens
ggcaaaggccucaucaaga

SEQ ID NO: 96300 - RNA, 19 nt, Homo sapiens
gguaggagaaggcaucuga

SEQ ID NO: 96301 - RNA, 19 nt, Homo sapiens
cagcagccauugccacgaa

SEQ ID NO: 96302 - RNA, 19 nt, Homo sapiens
ggagaaggcaucugagucu

SEQ ID NO: 96303 - RNA, 19 nt, Homo sapiens
uaaacuggaccgugaagaa

SEQ ID NO: 96304 - RNA, 19 nt, Homo sapiens
ugaaccugcuggagaugua

SEQ ID NO: 96305 - RNA, 19 nt, Homo sapiens
gagcaugcgugggcagaug

SEQ ID NO: 96306 - RNA, 19 nt, Homo sapiens
uaccauggguggauguuug

SEQ ID NO: 96307 - RNA, 19 nt, Homo sapiens
gcuauggaguuuccuacau

SEQ ID NO: 96308 - RNA, 19 nt, Homo sapiens
gcacgccaggccuucuuua

SEQ ID NO: 96309 - RNA, 19 nt, Homo sapiens
gagguucacggucugagua

SEQ ID NO: 96310 - RNA, 19 nt, Homo sapiens
gacguaggcucugagauag

SEQ ID NO: 96311 - RNA, 19 nt, Homo sapiens
ccacaucuccagcaaguuc

SEQ ID NO: 96312 - RNA, 19 nt, Homo sapiens
ugcgagaucucuuccagaa

SEQ ID NO: 96313 - RNA, 19 nt, Homo sapiens
caaguaacuaugugaguga

SEQ ID NO: 96314 - RNA, 19 nt, Homo sapiens
uggaguugcuggccaaaga

SEQ ID NO: 96315 - RNA, 19 nt, Homo sapiens
gaucugggcuauguguauc

SEQ ID NO: 96316 - RNA, 19 nt, Homo sapiens
ggaggaacaacgagcagaa

SEQ ID NO: 96317 - RNA, 19 nt, Homo sapiens
aagcaaggcccacagacua

SEQ ID NO: 96318 - RNA, 19 nt, Homo sapiens
gaccugcuuugaaaugugu

SEQ ID NO: 96319 - RNA, 19 nt, Homo sapiens
gcccuuagguaccuguguu

SEQ ID NO: 96320 - RNA, 19 nt, Homo sapiens
gaaaugccagcugcccuuu

SEQ ID NO: 96321 - RNA, 19 nt, Homo sapiens
agaagcaccagaauaugua

SEQ ID NO: 96322 - RNA, 19 nt, Homo sapiens
cuucaagaauggccaguug

SEQ ID NO: 96323 - RNA, 19 nt, Homo sapiens
ggagcccucucauggugaa

SEQ ID NO: 96324 - RNA, 19 nt, Homo sapiens
aagaagauuugcugguaga

SEQ ID NO: 96325 - RNA, 19 nt, Homo sapiens
ggcgagcccucaugugugu

SEQ ID NO: 96326 - RNA, 19 nt, Homo sapiens
uacaacaggugguuugaca

SEQ ID NO: 96327 - RNA, 19 nt, Homo sapiens
cauggcaacugcuacaaca

SEQ ID NO: 96328 - RNA, 19 nt, Homo sapiens
ugacgggcaucuucuucuu

SEQ ID NO: 96329 - RNA, 19 nt, Homo sapiens
ccauagaauuugguuacuu

SEQ ID NO: 96330 - RNA, 19 nt, Homo sapiens
agagaaaacuggaagaaga

SEQ ID NO: 96331 - RNA, 19 nt, Homo sapiens
ggaaggcgagcccucaugu

SEQ ID NO: 96332 - RNA, 19 nt, Homo sapiens
cuauggaguuuccuacaug

SEQ ID NO: 96333 - RNA, 19 nt, Homo sapiens
agacaucucugcccaagcu

SEQ ID NO: 96334 - RNA, 19 nt, Homo sapiens
uguacagccugaaggauga

SEQ ID NO: 96335 - RNA, 19 nt, Homo sapiens
ccaggcaauuggaucagaa

SEQ ID NO: 96336 - RNA, 19 nt, Homo sapiens
ggaaaccacauccgcaaag

SEQ ID NO: 96337 - RNA, 19 nt, Homo sapiens
gggcaccucugggaguuug

SEQ ID NO: 96338 - RNA, 19 nt, Homo sapiens
ccaguugggucucaaugca

SEQ ID NO: 96339 - RNA, 19 nt, Homo sapiens
ccacaagggacgcuucuuc

SEQ ID NO: 96340 - RNA, 19 nt, Homo sapiens
aaacuggaccgugaagaaa

SEQ ID NO: 96341 - RNA, 19 nt, Homo sapiens
ccaacuggccucccugaga

SEQ ID NO: 96342 - RNA, 19 nt, Homo sapiens
gcucaagccucaggaucug

SEQ ID NO: 96343 - RNA, 19 nt, Homo sapiens
cggagagacccgaguauga

SEQ ID NO: 96344 - RNA, 19 nt, Homo sapiens
ggaagaguacaucuaccuu

SEQ ID NO: 96345 - RNA, 19 nt, Homo sapiens
gaaacacgucuaccugucu

SEQ ID NO: 96346 - RNA, 19 nt, Homo sapiens
caagaacagcaguugcauu

SEQ ID NO: 96347 - RNA, 19 nt, Homo sapiens
ccauggagcgguaccuaaa

SEQ ID NO: 96348 - RNA, 19 nt, Homo sapiens
ccacguguuugcuuggaau

SEQ ID NO: 96349 - RNA, 19 nt, Homo sapiens
agucagcucuccuuuccuu

SEQ ID NO: 96350 - RNA, 19 nt, Homo sapiens
gugaacagcaacuauuaug

SEQ ID NO: 96351 - RNA, 19 nt, Homo sapiens
gcauccauguccaccauag

SEQ ID NO: 96352 - RNA, 19 nt, Homo sapiens
gcucuggcaucccauuucu

SEQ ID NO: 96353 - RNA, 19 nt, Homo sapiens
aagauuugcugguagaagu

SEQ ID NO: 96354 - RNA, 19 nt, Homo sapiens
aggaauggccuuucuacaa

SEQ ID NO: 96355 - RNA, 19 nt, Homo sapiens
ugauuauacucacgaggaa

SEQ ID NO: 96356 - RNA, 19 nt, Homo sapiens
cguguuugcuuggaauaaa

SEQ ID NO: 96357 - RNA, 19 nt, Homo sapiens
gacgaacgcccagcgcuuu

SEQ ID NO: 96358 - RNA, 19 nt, Homo sapiens
uauggaguuuccuacauga

SEQ ID NO: 96359 - RNA, 19 nt, Homo sapiens
ggaucugggcuauguguau

SEQ ID NO: 96360 - RNA, 19 nt, Homo sapiens
gaaagcagcagcaauuaua

SEQ ID NO: 96361 - RNA, 19 nt, Homo sapiens
uaucaaagcugcuguauuc

SEQ ID NO: 96362 - RNA, 19 nt, Homo sapiens
gagcagaugucuuuaauag

SEQ ID NO: 96363 - RNA, 19 nt, Homo sapiens
gcaugaagaugucgaagaa

SEQ ID NO: 96364 - RNA, 19 nt, Homo sapiens
gcaccuauuugguucauuu

SEQ ID NO: 96365 - RNA, 19 nt, Homo sapiens
ggcaggagauuuaauauug

SEQ ID NO: 96366 - RNA, 19 nt, Homo sapiens
gaaggcaggagauuuaaua

SEQ ID NO: 96367 - RNA, 19 nt, Homo sapiens
gcagaugucuuuaauagca

SEQ ID NO: 96368 - RNA, 19 nt, Homo sapiens
gcaaacaacuuacuauggu

SEQ ID NO: 96369 - RNA, 19 nt, Homo sapiens
gcucuuuacuucaauauga

SEQ ID NO: 96370 - RNA, 19 nt, Homo sapiens
gaaaggcaccuauuugguu

SEQ ID NO: 96371 - RNA, 19 nt, Homo sapiens
aaagaaggcaggagauuua

SEQ ID NO: 96372 - RNA, 19 nt, Homo sapiens
gcuguauucucgaggauua

SEQ ID NO: 96373 - RNA, 19 nt, Homo sapiens
ggagaguucugcauguuga

SEQ ID NO: 96374 - RNA, 19 nt, Homo sapiens
caaacaggcugaaacacuu

SEQ ID NO: 96375 - RNA, 19 nt, Homo sapiens
gcaggagauuuaauauuga

SEQ ID NO: 96376 - RNA, 19 nt, Homo sapiens
uaaaggauaugaagagauc

SEQ ID NO: 96377 - RNA, 19 nt, Homo sapiens
ugagaaauauccugaugaa

SEQ ID NO: 96378 - RNA, 19 nt, Homo sapiens
gggcagugcugauuacaga

SEQ ID NO: 96379 - RNA, 19 nt, Homo sapiens
gugcagaaauuguuuguuc

SEQ ID NO: 96380 - RNA, 19 nt, Homo sapiens
uagaaggacuguuugagaa

SEQ ID NO: 96381 - RNA, 19 nt, Homo sapiens
caaacaacuuacuauggua

SEQ ID NO: 96382 - RNA, 19 nt, Homo sapiens
ggaaaacagugacauugua

SEQ ID NO: 96383 - RNA, 19 nt, Homo sapiens
gcagaagacaugagugaaa

SEQ ID NO: 96384 - RNA, 19 nt, Homo sapiens
gaucaacagauuuccauuu

SEQ ID NO: 96385 - RNA, 19 nt, Homo sapiens
ccacagagcaaccaaagaa

SEQ ID NO: 96386 - RNA, 19 nt, Homo sapiens
ggaguccucugaauaaugg

SEQ ID NO: 96387 - RNA, 19 nt, Homo sapiens
gaaaugcucacagaacaaa

SEQ ID NO: 96388 - RNA, 19 nt, Homo sapiens
gcacaaaccuuggaaaccu

SEQ ID NO: 96389 - RNA, 19 nt, Homo sapiens
ggaguuugaugugaucgua

SEQ ID NO: 96390 - RNA, 19 nt, Homo sapiens
gcagcugcauguucaagaa

SEQ ID NO: 96391 - RNA, 19 nt, Homo sapiens
gaaggacuguuugagaaau

SEQ ID NO: 96392 - RNA, 19 nt, Homo sapiens
caacagauuuccauuuuga

SEQ ID NO: 96393 - RNA, 19 nt, Homo sapiens
agaauaaucucugagcauu

SEQ ID NO: 96394 - RNA, 19 nt, Homo sapiens
caggaugugugcuguguuu

SEQ ID NO: 96395 - RNA, 19 nt, Homo sapiens
agaaugcgcuagaaguaaa

SEQ ID NO: 96396 - RNA, 19 nt, Homo sapiens
acagugacauuguaaguga

SEQ ID NO: 96397 - RNA, 19 nt, Homo sapiens
gcaugaaaggcaccuauuu

SEQ ID NO: 96398 - RNA, 19 nt, Homo sapiens
gauaugaagagaucacauu

SEQ ID NO: 96399 - RNA, 19 nt, Homo sapiens
gaaaagcgaaugcuaauga

SEQ ID NO: 96400 - RNA, 19 nt, Homo sapiens
ggacaaaacuauucaacau

SEQ ID NO: 96401 - RNA, 19 nt, Homo sapiens
gaaaugauaaugcagucaa

SEQ ID NO: 96402 - RNA, 19 nt, Homo sapiens
gauuuaccauccaacguuu

SEQ ID NO: 96403 - RNA, 19 nt, Homo sapiens
cagagcagaugucuuuaau

SEQ ID NO: 96404 - RNA, 19 nt, Homo sapiens
cagaauuacuuacucacaa

SEQ ID NO: 96405 - RNA, 19 nt, Homo sapiens
caaacuggauacccaacuu

SEQ ID NO: 96406 - RNA, 19 nt, Homo sapiens
gcagugcugauuacagaua

SEQ ID NO: 96407 - RNA, 19 nt, Homo sapiens
gccaucaacuucagcagaa

SEQ ID NO: 96408 - RNA, 19 nt, Homo sapiens
agcaggagcuguuauaaug

SEQ ID NO: 96409 - RNA, 19 nt, Homo sapiens
uagaaucaguugugcagaa

SEQ ID NO: 96410 - RNA, 19 nt, Homo sapiens
gacaguuacuuuccugaga

SEQ ID NO: 96411 - RNA, 19 nt, Homo sapiens
ucucagagucuacuugaua

SEQ ID NO: 96412 - RNA, 19 nt, Homo sapiens
gcaauuauagaucaguuug

SEQ ID NO: 96413 - RNA, 19 nt, Homo sapiens
ggacaaagaauccagaaaa

SEQ ID NO: 96414 - RNA, 19 nt, Homo sapiens
caauugcaaugacaucaga

SEQ ID NO: 96415 - RNA, 19 nt, Homo sapiens
agaaguaaauggugcugaa

SEQ ID NO: 96416 - RNA, 19 nt, Homo sapiens
gagaaugcgcuagaaguaa

SEQ ID NO: 96417 - RNA, 19 nt, Homo sapiens
uuagaaagcagcagcaauu

SEQ ID NO: 96418 - RNA, 19 nt, Homo sapiens
cugaagacauuauccuuga

SEQ ID NO: 96419 - RNA, 19 nt, Homo sapiens
uaaagaaggcaggagauuu

SEQ ID NO: 96420 - RNA, 19 nt, Homo sapiens
ccacagaagcugcagauuc

SEQ ID NO: 96421 - RNA, 19 nt, Homo sapiens
auacugaaauggagauaga

SEQ ID NO: 96422 - RNA, 19 nt, Homo sapiens
gaauaaucucugagcauuu

SEQ ID NO: 96423 - RNA, 19 nt, Homo sapiens
aaucaguugugcagaaauu

SEQ ID NO: 96424 - RNA, 19 nt, Homo sapiens
gaagagaucacauuuuaug

SEQ ID NO: 96425 - RNA, 19 nt, Homo sapiens
gaaaaccauugugaugaua

SEQ ID NO: 96426 - RNA, 19 nt, Homo sapiens
cuaaaggaauaccaggaaa

SEQ ID NO: 96427 - RNA, 19 nt, Homo sapiens
agauucagaucaacagauu

SEQ ID NO: 96428 - RNA, 19 nt, Homo sapiens
ggacggguuugccugaauc

SEQ ID NO: 96429 - RNA, 19 nt, Homo sapiens
gaagacauuauccuugaug

SEQ ID NO: 96430 - RNA, 19 nt, Homo sapiens
uaugagaaauauccugaug

SEQ ID NO: 96431 - RNA, 19 nt, Homo sapiens
uggcccagauugugguuua

SEQ ID NO: 96432 - RNA, 19 nt, Homo sapiens
ucaguuuggucagagaaua

SEQ ID NO: 96433 - RNA, 19 nt, Homo sapiens
uaccaggauucuugcauuu

SEQ ID NO: 96434 - RNA, 19 nt, Homo sapiens
ugagaaauguuagaaagca

SEQ ID NO: 96435 - RNA, 19 nt, Homo sapiens
ggaaagcacaaaccuugga

SEQ ID NO: 96436 - RNA, 19 nt, Homo sapiens
aauaaucucugagcauuuc

SEQ ID NO: 96437 - RNA, 19 nt, Homo sapiens
gcuaaaggaauaccaggaa

SEQ ID NO: 96438 - RNA, 19 nt, Homo sapiens
aagcagcgauccagagaau

SEQ ID NO: 96439 - RNA, 19 nt, Homo sapiens
gaaagcacaaaccuuggaa

SEQ ID NO: 96440 - RNA, 19 nt, Homo sapiens
agaauucugugggcucuuu

SEQ ID NO: 96441 - RNA, 19 nt, Homo sapiens
caugaaaggcaccuauuug

SEQ ID NO: 96442 - RNA, 19 nt, Homo sapiens
gcaggagcuguuauaauga

SEQ ID NO: 96443 - RNA, 19 nt, Homo sapiens
aaacagcaagagaagauuu

SEQ ID NO: 96444 - RNA, 19 nt, Homo sapiens
ccagagcagaugucuuuaa

SEQ ID NO: 96445 - RNA, 19 nt, Homo sapiens
cagcagaagacaugaguga

SEQ ID NO: 96446 - RNA, 19 nt, Homo sapiens
agagaaugcgcuagaagua

SEQ ID NO: 96447 - RNA, 19 nt, Homo sapiens
ucugugggcucuuuacuuc

SEQ ID NO: 96448 - RNA, 19 nt, Homo sapiens
acaguuacuuuccugagaa

SEQ ID NO: 96449 - RNA, 19 nt, Homo sapiens
uuaccaggauucuugcauu

SEQ ID NO: 96450 - RNA, 19 nt, Homo sapiens
gaaaacagugacauuguaa

SEQ ID NO: 96451 - RNA, 19 nt, Homo sapiens
uagaaagcagcagcaauua

SEQ ID NO: 96452 - RNA, 19 nt, Homo sapiens
cacaaaccuuggaaaccua

SEQ ID NO: 96453 - RNA, 19 nt, Homo sapiens
agaaucaguugugcagaaa

SEQ ID NO: 96454 - RNA, 19 nt, Homo sapiens
gguggaauuuauugucuuc

SEQ ID NO: 96455 - RNA, 19 nt, Homo sapiens
aauauuaccaggauucuug

SEQ ID NO: 96456 - RNA, 19 nt, Homo sapiens
ggauuugcaugaagauguc

SEQ ID NO: 96457 - RNA, 19 nt, Homo sapiens
gauugugguuuaggaaaug

SEQ ID NO: 96458 - RNA, 19 nt, Homo sapiens
caggagcuguuauaaugau

SEQ ID NO: 96459 - RNA, 19 nt, Homo sapiens
aaaugugccuauagcagaa

SEQ ID NO: 96460 - RNA, 19 nt, Homo sapiens
gcucaaaugugcaguauaa

SEQ ID NO: 96461 - RNA, 19 nt, Homo sapiens
gcacacaguuucagauaaa

SEQ ID NO: 96462 - RNA, 19 nt, Homo sapiens
gagcagaugucuuuaauag

SEQ ID NO: 96463 - RNA, 19 nt, Homo sapiens
ggacaacguugaagagauu

SEQ ID NO: 96464 - RNA, 19 nt, Homo sapiens
ggaagaaaguacuguugua

SEQ ID NO: 96465 - RNA, 19 nt, Homo sapiens
caaagaaucuggacgaugu

SEQ ID NO: 96466 - RNA, 19 nt, Homo sapiens
gaaauaggauuacuuacuc

SEQ ID NO: 96467 - RNA, 19 nt, Homo sapiens
gaaagccaguuaucauauu

SEQ ID NO: 96468 - RNA, 19 nt, Homo sapiens
caagaaggaugaaacuauu

SEQ ID NO: 96469 - RNA, 19 nt, Homo sapiens
gaggaaacaugcucaaaug

SEQ ID NO: 96470 - RNA, 19 nt, Homo sapiens
gcagaugucuuuaauagca

SEQ ID NO: 96471 - RNA, 19 nt, Homo sapiens
ggcaggagguuuaauauug

SEQ ID NO: 96472 - RNA, 19 nt, Homo sapiens
gaaggcaggagguuuaaua

SEQ ID NO: 96473 - RNA, 19 nt, Homo sapiens
gcaggagguuuaauauuga

SEQ ID NO: 96474 - RNA, 19 nt, Homo sapiens
gaaggacaccuaucuggua

SEQ ID NO: 96475 - RNA, 19 nt, Homo sapiens
aaucacaccucauuucuuu

SEQ ID NO: 96476 - RNA, 19 nt, Homo sapiens
acaccuaucugguacauuu

SEQ ID NO: 96477 - RNA, 19 nt, Homo sapiens
caagcaagcugaaacacuu

SEQ ID NO: 96478 - RNA, 19 nt, Homo sapiens
gcaaggaacucaccauggu

SEQ ID NO: 96479 - RNA, 19 nt, Homo sapiens
gaaaugagcaugcugucaa

SEQ ID NO: 96480 - RNA, 19 nt, Homo sapiens
gccaggagcuugugcugua

SEQ ID NO: 96481 - RNA, 19 nt, Homo sapiens
gcaagaaggaugaaacuau

SEQ ID NO: 96482 - RNA, 19 nt, Homo sapiens
gaaaagaggaugcuaauga

SEQ ID NO: 96483 - RNA, 19 nt, Homo sapiens
gaagaaagccaguuaucau

SEQ ID NO: 96484 - RNA, 19 nt, Homo sapiens
ucucaaggauugcuaauug

SEQ ID NO: 96485 - RNA, 19 nt, Homo sapiens
acagaucagucuauacuaa

SEQ ID NO: 96486 - RNA, 19 nt, Homo sapiens
gcagaucucuagggcagua

SEQ ID NO: 96487 - RNA, 19 nt, Homo sapiens
ggucaaagaauaaaugcua

SEQ ID NO: 96488 - RNA, 19 nt, Homo sapiens
ucacuaggauucuugcauu

SEQ ID NO: 96489 - RNA, 19 nt, Homo sapiens
aaucagauguuagucguua

SEQ ID NO: 96490 - RNA, 19 nt, Homo sapiens
aaagagcaaucucgaaaug

SEQ ID NO: 96491 - RNA, 19 nt, Homo sapiens
gcuaggaccugcaacuuca

SEQ ID NO: 96492 - RNA, 19 nt, Homo sapiens
aaagaaggcaggagguuua

SEQ ID NO: 96493 - RNA, 19 nt, Homo sapiens
auacagagauuucacuaga

SEQ ID NO: 96494 - RNA, 19 nt, Homo sapiens
ucacugaaguucuggauuc

SEQ ID NO: 96495 - RNA, 19 nt, Homo sapiens
gggcaguacucauuacaga

SEQ ID NO: 96496 - RNA, 19 nt, Homo sapiens
ggaagacaguuaccuuucu

SEQ ID NO: 96497 - RNA, 19 nt, Homo sapiens
caggagaucuuuccaacug

SEQ ID NO: 96498 - RNA, 19 nt, Homo sapiens
uagaaucaguggugaagaa

SEQ ID NO: 96499 - RNA, 19 nt, Homo sapiens
agaaguaacugauguagag

SEQ ID NO: 96500 - RNA, 19 nt, Homo sapiens
gcagcugcauguucaagaa

SEQ ID NO: 96501 - RNA, 19 nt, Homo sapiens
ucucagacauucagcauug

SEQ ID NO: 96502 - RNA, 19 nt, Homo sapiens
ggagaucuuuccaacugaa

SEQ ID NO: 96503 - RNA, 19 nt, Homo sapiens
aaucaguggugaagaaauu

SEQ ID NO: 96504 - RNA, 19 nt, Homo sapiens
gguggaaucuauugucuuc

SEQ ID NO: 96505 - RNA, 19 nt, Homo sapiens
gaaaagugauacagagauu

SEQ ID NO: 96506 - RNA, 19 nt, Homo sapiens
gaagaaaguacuguuguau

SEQ ID NO: 96507 - RNA, 19 nt, Homo sapiens
gaagacaguuaccuuucug

SEQ ID NO: 96508 - RNA, 19 nt, Homo sapiens
gaacucaccaugguugaaa

SEQ ID NO: 96509 - RNA, 19 nt, Homo sapiens
uaaaggacaguuucccaua

SEQ ID NO: 96510 - RNA, 19 nt, Homo sapiens
gaaauuauucacuccguau

SEQ ID NO: 96511 - RNA, 19 nt, Homo sapiens
gcacucaauugcaaugaca

SEQ ID NO: 96512 - RNA, 19 nt, Homo sapiens
ggaaggaaagguagaacaa

SEQ ID NO: 96513 - RNA, 19 nt, Homo sapiens
uaaggccgaugaaccaauu

SEQ ID NO: 96514 - RNA, 19 nt, Homo sapiens
ggacagguuugcccgaauc

SEQ ID NO: 96515 - RNA, 19 nt, Homo sapiens
gaaaagagcaaucucgaaa

SEQ ID NO: 96516 - RNA, 19 nt, Homo sapiens
gagaagacuuagaaucagu

SEQ ID NO: 96517 - RNA, 19 nt, Homo sapiens
cagagcagaugucuuuaau

SEQ ID NO: 96518 - RNA, 19 nt, Homo sapiens
uaacugauguagaggaauc

SEQ ID NO: 96519 - RNA, 19 nt, Homo sapiens
cuaugcagauguugucuuu

SEQ ID NO: 96520 - RNA, 19 nt, Homo sapiens
augcagauguugucuuuaa

SEQ ID NO: 96521 - RNA, 19 nt, Homo sapiens
ugaaugcuaugcagauguu

SEQ ID NO: 96522 - RNA, 19 nt, Homo sapiens
agcagaagcucguauaaug

SEQ ID NO: 96523 - RNA, 19 nt, Homo sapiens
ugggauaacuggaacauca

SEQ ID NO: 96524 - RNA, 19 nt, Homo sapiens
agaggaugcuaaugaaauu

SEQ ID NO: 96525 - RNA, 19 nt, Homo sapiens
gcuguauucucaaggauug

SEQ ID NO: 96526 - RNA, 19 nt, Homo sapiens
cuucagugcuucugggaua

SEQ ID NO: 96527 - RNA, 19 nt, Homo sapiens
gcaauuauagaucacuuug

SEQ ID NO: 96528 - RNA, 19 nt, Homo sapiens
caauugcaaugacaucaga

SEQ ID NO: 96529 - RNA, 19 nt, Homo sapiens
agaaaguacuguuguaugg

SEQ ID NO: 96530 - RNA, 19 nt, Homo sapiens
gguuauauaugaugaaugc

SEQ ID NO: 96531 - RNA, 19 nt, Homo sapiens
aaaggacaguuucccauau

SEQ ID NO: 96532 - RNA, 19 nt, Homo sapiens
cuucauggcaucagaauuu

SEQ ID NO: 96533 - RNA, 19 nt, Homo sapiens
gaaccaauuagaaauagga

SEQ ID NO: 96534 - RNA, 19 nt, Homo sapiens
ucuauugucuucgucauaa

SEQ ID NO: 96535 - RNA, 19 nt, Homo sapiens
gcgacgaaaugccugcaaa

SEQ ID NO: 96536 - RNA, 19 nt, Homo sapiens
cauuacagaucagucuaua

SEQ ID NO: 96537 - RNA, 19 nt, Homo sapiens
aagaaagccaguuaucaua

SEQ ID NO: 96538 - RNA, 19 nt, Homo sapiens
ugaaagcaaaucuacagua

SEQ ID NO: 96539 - RNA, 19 nt, Homo sapiens
gaugaaugcuaugcagaug

SEQ ID NO: 96540 - RNA, 19 nt, Homo sapiens
uauaauggcuugccuucca

SEQ ID NO: 96541 - RNA, 19 nt, Homo sapiens
gaaaaguauuguggagaua

SEQ ID NO: 96542 - RNA, 19 nt, Homo sapiens
aagagaagacuuagaauca

SEQ ID NO: 96543 - RNA, 19 nt, Homo sapiens
cggacaaucuucccacaga

SEQ ID NO: 96544 - RNA, 19 nt, Homo sapiens
uacaauagauggucuuaac

SEQ ID NO: 96545 - RNA, 19 nt, Homo sapiens
ucagaaucaucuugcacua

SEQ ID NO: 96546 - RNA, 19 nt, Homo sapiens
gauguuagucguuauguag

SEQ ID NO: 96547 - RNA, 19 nt, Homo sapiens
aaacuuguaugcacacagu

SEQ ID NO: 96548 - RNA, 19 nt, Homo sapiens
gagauaaagaugaaagcaa

SEQ ID NO: 96549 - RNA, 19 nt, Homo sapiens
uggaaccaauaauguagua

SEQ ID NO: 96550 - RNA, 19 nt, Homo sapiens
caagagaagacuuagaauc

SEQ ID NO: 96551 - RNA, 19 nt, Homo sapiens
aaagacagauuuagaucag

SEQ ID NO: 96552 - RNA, 19 nt, Homo sapiens
agaaucaucuugcacuaca

SEQ ID NO: 96553 - RNA, 19 nt, Homo sapiens
caaaacugcuguauucuca

SEQ ID NO: 96554 - RNA, 19 nt, Homo sapiens
ggaaaaguauuguggagau

SEQ ID NO: 96555 - RNA, 19 nt, Homo sapiens
gcaaaacacacucagaaaa

SEQ ID NO: 96556 - RNA, 19 nt, Homo sapiens
agaaauaaacgaggaagaa

SEQ ID NO: 96557 - RNA, 19 nt, Homo sapiens
ggacaccuaucugguacau

SEQ ID NO: 96558 - RNA, 19 nt, Homo sapiens
cucccaaccuucaacauuu

SEQ ID NO: 96559 - RNA, 19 nt, Homo sapiens
ccagagcagaugucuuuaa

SEQ ID NO: 96560 - RNA, 19 nt, Homo sapiens
gaacauguaugaagauauc

SEQ ID NO: 96561 - RNA, 19 nt, Homo sapiens
gaauauagaccuccuguuu

SEQ ID NO: 96562 - RNA, 19 nt, Homo sapiens
caagauggcuuucgacaga

SEQ ID NO: 96563 - RNA, 19 nt, Homo sapiens
gaaggaacuuucuguuguu

SEQ ID NO: 96564 - RNA, 19 nt, Homo sapiens
uaugagaucuccagaacua

SEQ ID NO: 96565 - RNA, 19 nt, Homo sapiens
caauuccacucauuacaua

SEQ ID NO: 96566 - RNA, 19 nt, Homo sapiens
cagagaaacucaagcuauu

SEQ ID NO: 96567 - RNA, 19 nt, Homo sapiens
gcuguuacauuaccauaaa

SEQ ID NO: 96568 - RNA, 19 nt, Homo sapiens
gauuagagguuugggcaua

SEQ ID NO: 96569 - RNA, 19 nt, Homo sapiens
cgacagagauggugagaag

SEQ ID NO: 96570 - RNA, 19 nt, Homo sapiens
cuagaggucuuaauucuga

SEQ ID NO: 96571 - RNA, 19 nt, Homo sapiens
guucuucucuaacauagua

SEQ ID NO: 96572 - RNA, 19 nt, Homo sapiens
ccgcucagcugucuuguaa

SEQ ID NO: 96573 - RNA, 19 nt, Homo sapiens
gaacacacgcuuucugguu

SEQ ID NO: 96574 - RNA, 19 nt, Homo sapiens
ggagugaaaugugcagauu

SEQ ID NO: 96575 - RNA, 19 nt, Homo sapiens
ugaauacugugccaacuuu

SEQ ID NO: 96576 - RNA, 19 nt, Homo sapiens
gaccuacacuuuggcuuua

SEQ ID NO: 96577 - RNA, 19 nt, Homo sapiens
ccaagauggucccaaauga

SEQ ID NO: 96578 - RNA, 19 nt, Homo sapiens
guaagccuguugugacuuu

SEQ ID NO: 96579 - RNA, 19 nt, Homo sapiens
ugaaggaacuuucuguugu

SEQ ID NO: 96580 - RNA, 19 nt, Homo sapiens
cagaauacauugccaagau

SEQ ID NO: 96581 - RNA, 19 nt, Homo sapiens
cacaauaacgcgugaauaa

SEQ ID NO: 96582 - RNA, 19 nt, Homo sapiens
ugacaucacuuguuagaag

SEQ ID NO: 96583 - RNA, 19 nt, Homo sapiens
gagcaacucugaaagaaaa

SEQ ID NO: 96584 - RNA, 19 nt, Homo sapiens
gggcauauaaccagauuaa

SEQ ID NO: 96585 - RNA, 19 nt, Homo sapiens
ugaaagagacacaugauga

SEQ ID NO: 96586 - RNA, 19 nt, Homo sapiens
gcacuuaaacuguacuuca

SEQ ID NO: 96587 - RNA, 19 nt, Homo sapiens
ugaaagcacauaccacuaa

SEQ ID NO: 96588 - RNA, 19 nt, Homo sapiens
cacuuuggcuuuaagauuu

SEQ ID NO: 96589 - RNA, 19 nt, Homo sapiens
gcccugacccuguuugaua

SEQ ID NO: 96590 - RNA, 19 nt, Homo sapiens
cagcauguuucacagagua

SEQ ID NO: 96591 - RNA, 19 nt, Homo sapiens
ggaccuacacuuuggcuuu

SEQ ID NO: 96592 - RNA, 19 nt, Homo sapiens
cauaucacaugccuacauu

SEQ ID NO: 96593 - RNA, 19 nt, Homo sapiens
gcauauaaccagauuaaag

SEQ ID NO: 96594 - RNA, 19 nt, Homo sapiens
uccuguagcugcauuauuu

SEQ ID NO: 96595 - RNA, 19 nt, Homo sapiens
cauaagcaguguuccaaga

SEQ ID NO: 96596 - RNA, 19 nt, Homo sapiens
ucagggagauugagucuag

SEQ ID NO: 96597 - RNA, 19 nt, Homo sapiens
caaggcagcagaauacauu

SEQ ID NO: 96598 - RNA, 19 nt, Homo sapiens
aaacuguacuucagggauu

SEQ ID NO: 96599 - RNA, 19 nt, Homo sapiens
guguacagcugugaccuua

SEQ ID NO: 96600 - RNA, 19 nt, Homo sapiens
guagcugcauuauuucuug

SEQ ID NO: 96601 - RNA, 19 nt, Homo sapiens
gaaagcacauaccacuaag

SEQ ID NO: 96602 - RNA, 19 nt, Homo sapiens
gaaaacagaccaaaguauu

SEQ ID NO: 96603 - RNA, 19 nt, Homo sapiens
gcacaauaacgcgugaaua

SEQ ID NO: 96604 - RNA, 19 nt, Homo sapiens
gcacaucuaaagagaguga

SEQ ID NO: 96605 - RNA, 19 nt, Homo sapiens
gugaacauguaugaagaua

SEQ ID NO: 96606 - RNA, 19 nt, Homo sapiens
guuccaagauggucccaaa

SEQ ID NO: 96607 - RNA, 19 nt, Homo sapiens
guacaaacacgcacacaca

SEQ ID NO: 96608 - RNA, 19 nt, Homo sapiens
ucaagcuauugcaugauua

SEQ ID NO: 96609 - RNA, 19 nt, Homo sapiens
aaaccaaggcagcagaaua

SEQ ID NO: 96610 - RNA, 19 nt, Homo sapiens
ccucauccucgaagaauua

SEQ ID NO: 96611 - RNA, 19 nt, Homo sapiens
caaggugcauacauucaga

SEQ ID NO: 96612 - RNA, 19 nt, Homo sapiens
cgccauggcugcauugaau

SEQ ID NO: 96613 - RNA, 19 nt, Homo sapiens
gauugugguuugaauguuc

SEQ ID NO: 96614 - RNA, 19 nt, Homo sapiens
gacaucacuuguuagaaga

SEQ ID NO: 96615 - RNA, 19 nt, Homo sapiens
uaaagguuauccauaccaa

SEQ ID NO: 96616 - RNA, 19 nt, Homo sapiens
gagagugacccuccacgaa

SEQ ID NO: 96617 - RNA, 19 nt, Homo sapiens
cauaugaugccuacccuaa

SEQ ID NO: 96618 - RNA, 19 nt, Homo sapiens
gaaagagacacaugaugag

SEQ ID NO: 96619 - RNA, 19 nt, Homo sapiens
gcucagcugucuuguaaaa

SEQ ID NO: 96620 - RNA, 19 nt, Homo sapiens
gaaagaaaacgagcaaauu

SEQ ID NO: 96621 - RNA, 19 nt, Homo sapiens
gaagaauuaccuguacuug

SEQ ID NO: 96622 - RNA, 19 nt, Homo sapiens
agguugacaucacuuguua

SEQ ID NO: 96623 - RNA, 19 nt, Homo sapiens
agagacacaugaugagaga

SEQ ID NO: 96624 - RNA, 19 nt, Homo sapiens
gaauacauugccaagauga

SEQ ID NO: 96625 - RNA, 19 nt, Homo sapiens
guacuuucuuuccagcaaa

SEQ ID NO: 96626 - RNA, 19 nt, Homo sapiens
uaucacuggugcacuuaaa

SEQ ID NO: 96627 - RNA, 19 nt, Homo sapiens
ggugacugauggcuugauu

SEQ ID NO: 96628 - RNA, 19 nt, Homo sapiens
ccauaaaccauaucacaug

SEQ ID NO: 96629 - RNA, 19 nt, Homo sapiens
caaacacgcacacacaaau

SEQ ID NO: 96630 - RNA, 19 nt, Homo sapiens
gggucuaugucauugguuu

SEQ ID NO: 96631 - RNA, 19 nt, Homo sapiens
gguagucugugcuuguaau

SEQ ID NO: 96632 - RNA, 19 nt, Homo sapiens
gcgagcgccuuuacaaugg

SEQ ID NO: 96633 - RNA, 19 nt, Homo sapiens
gaaccuuggaaucgucuuu

SEQ ID NO: 96634 - RNA, 19 nt, Homo sapiens
gcagagaaccuuggaaucg

SEQ ID NO: 96635 - RNA, 19 nt, Homo sapiens
ggugagaaggcagauauuu

SEQ ID NO: 96636 - RNA, 19 nt, Homo sapiens
uaccgaguaucaggauuua

SEQ ID NO: 96637 - RNA, 19 nt, Homo sapiens
acagagagccagcauacaa

SEQ ID NO: 96638 - RNA, 19 nt, Homo sapiens
caauggcccugacccuguu

SEQ ID NO: 96639 - RNA, 19 nt, Homo sapiens
aagguuauccauaccaaua

SEQ ID NO: 96640 - RNA, 19 nt, Homo sapiens
gaguaagccuguugugacu

SEQ ID NO: 96641 - RNA, 19 nt, Homo sapiens
ucagagaaacucaagcuau

SEQ ID NO: 96642 - RNA, 19 nt, Homo sapiens
cauuaucacuggugcacuu

SEQ ID NO: 96643 - RNA, 19 nt, Homo sapiens
gagucuagaggucuuaauu

SEQ ID NO: 96644 - RNA, 19 nt, Homo sapiens
gaauacugugccaacuuua

SEQ ID NO: 96645 - RNA, 19 nt, Homo sapiens
gaaacuucaggcucuacua

SEQ ID NO: 96646 - RNA, 19 nt, Homo sapiens
agaccaaaguauuauggaa

SEQ ID NO: 96647 - RNA, 19 nt, Homo sapiens
ccagggaccuacacuuugg

SEQ ID NO: 96648 - RNA, 19 nt, Homo sapiens
gcaccgcucagcugucuug

SEQ ID NO: 96649 - RNA, 19 nt, Homo sapiens
gacccacccuuaugagauc

SEQ ID NO: 96650 - RNA, 19 nt, Homo sapiens
aggagaaucuuaugaaugc

SEQ ID NO: 96651 - RNA, 19 nt, Homo sapiens
gaaaaggagaaucuuauga

SEQ ID NO: 96652 - RNA, 19 nt, Homo sapiens
cauggcacaucuaaagaga

SEQ ID NO: 96653 - RNA, 19 nt, Homo sapiens
uaagcaguguuccaagaug

SEQ ID NO: 96654 - RNA, 19 nt, Homo sapiens
auacacaaccuuaaacaga

SEQ ID NO: 96655 - RNA, 19 nt, Homo sapiens
cuaguaauccuggguguuu

SEQ ID NO: 96656 - RNA, 19 nt, Homo sapiens
ccgaccagcucuugauugu

SEQ ID NO: 96657 - RNA, 19 nt, Homo sapiens
gugaaggaacuuucuguug

SEQ ID NO: 96658 - RNA, 19 nt, Homo sapiens
aaacagagagccagcauac

SEQ ID NO: 96659 - RNA, 19 nt, Homo sapiens
uugccaagaugacgauaaa

SEQ ID NO: 96660 - RNA, 19 nt, Homo sapiens
gaccacaaaugcaguauua

SEQ ID NO: 96661 - RNA, 19 nt, Homo sapiens
gcagaugcauugguuauua

SEQ ID NO: 96662 - RNA, 19 nt, Homo sapiens
ggacggaaaccacaaauaa

SEQ ID NO: 96663 - RNA, 19 nt, Homo sapiens
aaacaaacgucacacauga

SEQ ID NO: 96664 - RNA, 19 nt, Homo sapiens
ggugacagauggcuugaua

SEQ ID NO: 96665 - RNA, 19 nt, Homo sapiens
gaagagugauuaauacauc

SEQ ID NO: 96666 - RNA, 19 nt, Homo sapiens
gaaaccagaccuuaaacua

SEQ ID NO: 96667 - RNA, 19 nt, Homo sapiens
ccuuuaaacuucagucuua

SEQ ID NO: 96668 - RNA, 19 nt, Homo sapiens
aaacauuucuuaccacuug

SEQ ID NO: 96669 - RNA, 19 nt, Homo sapiens
gagaagacacacaacuuua

SEQ ID NO: 96670 - RNA, 19 nt, Homo sapiens
ucaagaaaguguacuguug

SEQ ID NO: 96671 - RNA, 19 nt, Homo sapiens
gagggugccuacauccuua

SEQ ID NO: 96672 - RNA, 19 nt, Homo sapiens
ccacgagaauguuguuauu

SEQ ID NO: 96673 - RNA, 19 nt, Homo sapiens
ccaagcacguucccaauga

SEQ ID NO: 96674 - RNA, 19 nt, Homo sapiens
gcuggaagagugauuaaua

SEQ ID NO: 96675 - RNA, 19 nt, Homo sapiens
ugacacagcuaaggauaaa

SEQ ID NO: 96676 - RNA, 19 nt, Homo sapiens
gacaaccacuucaauuaug

SEQ ID NO: 96677 - RNA, 19 nt, Homo sapiens
aaugaaacguguaucguaa

SEQ ID NO: 96678 - RNA, 19 nt, Homo sapiens
ucaagaggaucaagaaagu

SEQ ID NO: 96679 - RNA, 19 nt, Homo sapiens
ugauaacacuguacauaga

SEQ ID NO: 96680 - RNA, 19 nt, Homo sapiens
gaagagguuugagucgauu

SEQ ID NO: 96681 - RNA, 19 nt, Homo sapiens
gaaacccuccgguaccuaa

SEQ ID NO: 96682 - RNA, 19 nt, Homo sapiens
cgauauaucugccaauguc

SEQ ID NO: 96683 - RNA, 19 nt, Homo sapiens
gguacuugauacaguuaua

SEQ ID NO: 96684 - RNA, 19 nt, Homo sapiens
ggaaaccacaaauaaauag

SEQ ID NO: 96685 - RNA, 19 nt, Homo sapiens
ucacauaugauaccuauuc

SEQ ID NO: 96686 - RNA, 19 nt, Homo sapiens
ugaccacccugcaugauau

SEQ ID NO: 96687 - RNA, 19 nt, Homo sapiens
cgacaaccacuucaauuau

SEQ ID NO: 96688 - RNA, 19 nt, Homo sapiens
caacuaaccccaucuauga

SEQ ID NO: 96689 - RNA, 19 nt, Homo sapiens
gaagaauaccagccuccua

SEQ ID NO: 96690 - RNA, 19 nt, Homo sapiens
gaauaccagccuccuauau

SEQ ID NO: 96691 - RNA, 19 nt, Homo sapiens
ugagaagacacacaacuuu

SEQ ID NO: 96692 - RNA, 19 nt, Homo sapiens
cggaaaccacaaauaaaua

SEQ ID NO: 96693 - RNA, 19 nt, Homo sapiens
cgaagacguuuuauucuaa

SEQ ID NO: 96694 - RNA, 19 nt, Homo sapiens
ucacugaacacauugaaga

SEQ ID NO: 96695 - RNA, 19 nt, Homo sapiens
gauaacacuguacauagaa

SEQ ID NO: 96696 - RNA, 19 nt, Homo sapiens
gaaauugaagcaagaggau

SEQ ID NO: 96697 - RNA, 19 nt, Homo sapiens
agaagacacacaacuuuaa

SEQ ID NO: 96698 - RNA, 19 nt, Homo sapiens
aaaugaaacguguaucgua

SEQ ID NO: 96699 - RNA, 19 nt, Homo sapiens
gacggaaaccacaaauaaa

SEQ ID NO: 96700 - RNA, 19 nt, Homo sapiens
gauugaacguacacaaaca

SEQ ID NO: 96701 - RNA, 19 nt, Homo sapiens
acaaccacuucaauuauga

SEQ ID NO: 96702 - RNA, 19 nt, Homo sapiens
aaacgucacacaugaagaa

SEQ ID NO: 96703 - RNA, 19 nt, Homo sapiens
ugacagagauggugaaaag

SEQ ID NO: 96704 - RNA, 19 nt, Homo sapiens
gaagacacacaacuuuaag

SEQ ID NO: 96705 - RNA, 19 nt, Homo sapiens
cggaaggccuuuacagagu

SEQ ID NO: 96706 - RNA, 19 nt, Homo sapiens
acgacaaccacuucaauua

SEQ ID NO: 96707 - RNA, 19 nt, Homo sapiens
caacgacaaccacuucaau

SEQ ID NO: 96708 - RNA, 19 nt, Homo sapiens
gaacacacagcgguggaaa

SEQ ID NO: 96709 - RNA, 19 nt, Homo sapiens
ucuaugaacacauuggaua

SEQ ID NO: 96710 - RNA, 19 nt, Homo sapiens
gcaguauuaucauugacau

SEQ ID NO: 96711 - RNA, 19 nt, Homo sapiens
ccacaaaugcaguauuauc

SEQ ID NO: 96712 - RNA, 19 nt, Homo sapiens
caagaaaguguacuguugu

SEQ ID NO: 96713 - RNA, 19 nt, Homo sapiens
aaagaucuccucccugguu

SEQ ID NO: 96714 - RNA, 19 nt, Homo sapiens
aaccagaccuuaaacuaca

SEQ ID NO: 96715 - RNA, 19 nt, Homo sapiens
gugccuacauccuuagaga

SEQ ID NO: 96716 - RNA, 19 nt, Homo sapiens
acagguacuugauacaguu

SEQ ID NO: 96717 - RNA, 19 nt, Homo sapiens
caauguagaccuuuaaacu

SEQ ID NO: 96718 - RNA, 19 nt, Homo sapiens
cuggagcccuuaaacugua

SEQ ID NO: 96719 - RNA, 19 nt, Homo sapiens
acagauggcuugauaacac

SEQ ID NO: 96720 - RNA, 19 nt, Homo sapiens
ggaagagugauuaauacau

SEQ ID NO: 96721 - RNA, 19 nt, Homo sapiens
caugauaugcgguaccaaa

SEQ ID NO: 96722 - RNA, 19 nt, Homo sapiens
cauaugcauucgggaaauu

SEQ ID NO: 96723 - RNA, 19 nt, Homo sapiens
ggaauaaaagggaacuuaa

SEQ ID NO: 96724 - RNA, 19 nt, Homo sapiens
cauaugauaccuauuccaa

SEQ ID NO: 96725 - RNA, 19 nt, Homo sapiens
aauugaagcaagaggauua

SEQ ID NO: 96726 - RNA, 19 nt, Homo sapiens
ggauaugccacccuacuca

SEQ ID NO: 96727 - RNA, 19 nt, Homo sapiens
gccgauauaucugccaaug

SEQ ID NO: 96728 - RNA, 19 nt, Homo sapiens
uauaucaguuacagcaaga

SEQ ID NO: 96729 - RNA, 19 nt, Homo sapiens
ggaaaacagaccaaaauau

SEQ ID NO: 96730 - RNA, 19 nt, Homo sapiens
cacgcuggcucucagguuu

SEQ ID NO: 96731 - RNA, 19 nt, Homo sapiens
ggagggugccuacauccuu

SEQ ID NO: 96732 - RNA, 19 nt, Homo sapiens
cacaaaugcaguauuauca

SEQ ID NO: 96733 - RNA, 19 nt, Homo sapiens
gcccuuaaacuguauuuca

SEQ ID NO: 96734 - RNA, 19 nt, Homo sapiens
ggugguagacauaugcauu

SEQ ID NO: 96735 - RNA, 19 nt, Homo sapiens
gggacggaaaccacaaaua

SEQ ID NO: 96736 - RNA, 19 nt, Homo sapiens
ccacgacgggaaacacuuu

SEQ ID NO: 96737 - RNA, 19 nt, Homo sapiens
aaccugaucucaagaggau

SEQ ID NO: 96738 - RNA, 19 nt, Homo sapiens
gcaccucgucccaagagaa

SEQ ID NO: 96739 - RNA, 19 nt, Homo sapiens
gguuugagucgauucauga

SEQ ID NO: 96740 - RNA, 19 nt, Homo sapiens
aaacguguaucguaaaaug

SEQ ID NO: 96741 - RNA, 19 nt, Homo sapiens
ggaagccguccaugaagug

SEQ ID NO: 96742 - RNA, 19 nt, Homo sapiens
gugcucagacuguggauug

SEQ ID NO: 96743 - RNA, 19 nt, Homo sapiens
ccuccgaugcugaagaaua

SEQ ID NO: 96744 - RNA, 19 nt, Homo sapiens
agaagagguuugagucgau

SEQ ID NO: 96745 - RNA, 19 nt, Homo sapiens
guccuccgaugcugaagaa

SEQ ID NO: 96746 - RNA, 19 nt, Homo sapiens
ccaucccugucaucacaua

SEQ ID NO: 96747 - RNA, 19 nt, Homo sapiens
gacauaugcauucgggaaa

SEQ ID NO: 96748 - RNA, 19 nt, Homo sapiens
ucagagacccaugguggua

SEQ ID NO: 96749 - RNA, 19 nt, Homo sapiens
gccuacauccuuagagaaa

SEQ ID NO: 96750 - RNA, 19 nt, Homo sapiens
ucauacagguacuugauac

SEQ ID NO: 96751 - RNA, 19 nt, Homo sapiens
aagaauaccagccuccuau

SEQ ID NO: 96752 - RNA, 19 nt, Homo sapiens
auguagaccuuuaaacuuc

SEQ ID NO: 96753 - RNA, 19 nt, Homo sapiens
gcccagcaccaucaaguug

SEQ ID NO: 96754 - RNA, 19 nt, Homo sapiens
gaagcaagaggauuaaaau

SEQ ID NO: 96755 - RNA, 19 nt, Homo sapiens
gcaggcggaugagcuucuu

SEQ ID NO: 96756 - RNA, 19 nt, Homo sapiens
aaacaaaagcugccgagua

SEQ ID NO: 96757 - RNA, 19 nt, Homo sapiens
cacuguacauagaaacaaa

SEQ ID NO: 96758 - RNA, 19 nt, Homo sapiens
ggauugaacguacacaaac

SEQ ID NO: 96759 - RNA, 19 nt, Homo sapiens
cagaugcauugguuauuac

SEQ ID NO: 96760 - RNA, 19 nt, Homo sapiens
ccacggagcuccccaaaua

SEQ ID NO: 96761 - RNA, 19 nt, Homo sapiens
ucaagacagucaauaacua

SEQ ID NO: 96762 - RNA, 19 nt, Homo sapiens
acacggagcucaagacagu

SEQ ID NO: 96763 - RNA, 19 nt, Homo sapiens
ucaagaggccgacuaagaa

SEQ ID NO: 96764 - RNA, 19 nt, Homo sapiens
aagagacgcuggcgcaaga

SEQ ID NO: 96765 - RNA, 19 nt, Homo sapiens
gacagucaauaacuacuuc

SEQ ID NO: 96766 - RNA, 19 nt, Homo sapiens
caagaggccgacuaagaaa

SEQ ID NO: 96767 - RNA, 19 nt, Homo sapiens
gucaagaggccgacuaaga

SEQ ID NO: 96768 - RNA, 19 nt, Homo sapiens
ggaaggaagaagaggaaga

SEQ ID NO: 96769 - RNA, 19 nt, Homo sapiens
gcuccgaaguggugaucaa

SEQ ID NO: 96770 - RNA, 19 nt, Homo sapiens
gcaaugccuccgucaugaa

SEQ ID NO: 96771 - RNA, 19 nt, Homo sapiens
ccgaaguggugaucaagau

SEQ ID NO: 96772 - RNA, 19 nt, Homo sapiens
gagcucaagacagucaaua

SEQ ID NO: 96773 - RNA, 19 nt, Homo sapiens
gaaggaagaagaggaagag

SEQ ID NO: 96774 - RNA, 19 nt, Homo sapiens
gcuacgcacucugcaacaa

SEQ ID NO: 96775 - RNA, 19 nt, Homo sapiens
cagcaaugccuccgucaug

SEQ ID NO: 96776 - RNA, 19 nt, Homo sapiens
uaagaaagggcgugaucga

SEQ ID NO: 96777 - RNA, 19 nt, Homo sapiens
ggccugugcugaccucauc

SEQ ID NO: 96778 - RNA, 19 nt, Homo sapiens
caacacggagcucaagaca

SEQ ID NO: 96779 - RNA, 19 nt, Homo sapiens
gcaucuaccgggagacaga

SEQ ID NO: 96780 - RNA, 19 nt, Homo sapiens
ugggcacgcuggcuuguga

SEQ ID NO: 96781 - RNA, 19 nt, Homo sapiens
gcaaccugcugguacucau

SEQ ID NO: 96782 - RNA, 19 nt, Homo sapiens
gcagugcuacauccaguuc

SEQ ID NO: 96783 - RNA, 19 nt, Homo sapiens
caagacagucaauaacuac

SEQ ID NO: 96784 - RNA, 19 nt, Homo sapiens
ggcuggcccuggacuaugu

SEQ ID NO: 96785 - RNA, 19 nt, Homo sapiens
gcucaagacagucaauaac

SEQ ID NO: 96786 - RNA, 19 nt, Homo sapiens
uggccuggcugguuuccuu

SEQ ID NO: 96787 - RNA, 19 nt, Homo sapiens
gcuacuggcugugcuacgu

SEQ ID NO: 96788 - RNA, 19 nt, Homo sapiens
ugaucaagaugccaauggu

SEQ ID NO: 96789 - RNA, 19 nt, Homo sapiens
agcaaugccuccgucauga

SEQ ID NO: 96790 - RNA, 19 nt, Homo sapiens
aucgguaccuucuccauga

SEQ ID NO: 96791 - RNA, 19 nt, Homo sapiens
cuacgcacucugcaacaaa

SEQ ID NO: 96792 - RNA, 19 nt, Homo sapiens
caaugccuccgucaugaau

SEQ ID NO: 96793 - RNA, 19 nt, Homo sapiens
ugugggagcugggcuacug

SEQ ID NO: 96794 - RNA, 19 nt, Homo sapiens
ggacaccguacaacaucau

SEQ ID NO: 96795 - RNA, 19 nt, Homo sapiens
ugaaucugcugcucaucag

SEQ ID NO: 96796 - RNA, 19 nt, Homo sapiens
uggacuauguggccagcaa

SEQ ID NO: 96797 - RNA, 19 nt, Homo sapiens
cagcuuugaccgcuacuuc

SEQ ID NO: 96798 - RNA, 19 nt, Homo sapiens
ccgggcagcucugaugauc

SEQ ID NO: 96799 - RNA, 19 nt, Homo sapiens
gaugagaacucuaagcaaa

SEQ ID NO: 96800 - RNA, 19 nt, Homo sapiens
gcuguugccucuaauauga

SEQ ID NO: 96801 - RNA, 19 nt, Homo sapiens
gaaauaacccaggaugaaa

SEQ ID NO: 96802 - RNA, 19 nt, Homo sapiens
ccaaagaugagaacucuaa

SEQ ID NO: 96803 - RNA, 19 nt, Homo sapiens
caucaugacugugcuauau

SEQ ID NO: 96804 - RNA, 19 nt, Homo sapiens
acaaacuccucuaacaaua

SEQ ID NO: 96805 - RNA, 19 nt, Homo sapiens
ggauaaagaaggacaagaa

SEQ ID NO: 96806 - RNA, 19 nt, Homo sapiens
cauaggcgcuacaagguaa

SEQ ID NO: 96807 - RNA, 19 nt, Homo sapiens
ucaacaaacuccucuaaca

SEQ ID NO: 96808 - RNA, 19 nt, Homo sapiens
gaaggauagugaagccaaa

SEQ ID NO: 96809 - RNA, 19 nt, Homo sapiens
gcaaacaugcaucagaauu

SEQ ID NO: 96810 - RNA, 19 nt, Homo sapiens
guacaaggaaggauaguga

SEQ ID NO: 96811 - RNA, 19 nt, Homo sapiens
caacaaacuccucuaacaa

SEQ ID NO: 96812 - RNA, 19 nt, Homo sapiens
gcaaugccaccuucaagaa

SEQ ID NO: 96813 - RNA, 19 nt, Homo sapiens
aagcaaacaugcaucagaa

SEQ ID NO: 96814 - RNA, 19 nt, Homo sapiens
ggucagcaaugccucaguu

SEQ ID NO: 96815 - RNA, 19 nt, Homo sapiens
gcucuuacaaguccuuaua

SEQ ID NO: 96816 - RNA, 19 nt, Homo sapiens
uuaaacaccuucucaugug

SEQ ID NO: 96817 - RNA, 19 nt, Homo sapiens
ucaagaagaccuuuaaaca

SEQ ID NO: 96818 - RNA, 19 nt, Homo sapiens
aaucuuggcuauucuguug

SEQ ID NO: 96819 - RNA, 19 nt, Homo sapiens
uaucaacccugccugcuau

SEQ ID NO: 96820 - RNA, 19 nt, Homo sapiens
ucagugcuguugccucuaa

SEQ ID NO: 96821 - RNA, 19 nt, Homo sapiens
uaaagaaggacaagaagga

SEQ ID NO: 96822 - RNA, 19 nt, Homo sapiens
gcaagagcaggauaaagaa

SEQ ID NO: 96823 - RNA, 19 nt, Homo sapiens
uccagaccgucaacaauua

SEQ ID NO: 96824 - RNA, 19 nt, Homo sapiens
caaacaugcaucagaauug

SEQ ID NO: 96825 - RNA, 19 nt, Homo sapiens
gaacauccuagucaugguu

SEQ ID NO: 96826 - RNA, 19 nt, Homo sapiens
cuucucaugugucauuaua

SEQ ID NO: 96827 - RNA, 19 nt, Homo sapiens
ugaaauaacccaggaugaa

SEQ ID NO: 96828 - RNA, 19 nt, Homo sapiens
uagugaagccaaacaauaa

SEQ ID NO: 96829 - RNA, 19 nt, Homo sapiens
caaugcugcugucaccuuu

SEQ ID NO: 96830 - RNA, 19 nt, Homo sapiens
ucaugacugugcuauauug

SEQ ID NO: 96831 - RNA, 19 nt, Homo sapiens
ggagugcuacauucaguuu

SEQ ID NO: 96832 - RNA, 19 nt, Homo sapiens
gaagaccuuuaaacaccuu

SEQ ID NO: 96833 - RNA, 19 nt, Homo sapiens
cauuugaagugguguuuau

SEQ ID NO: 96834 - RNA, 19 nt, Homo sapiens
ggacaaucuuggcuauucu

SEQ ID NO: 96835 - RNA, 19 nt, Homo sapiens
gccaaacaauaacaacaug

SEQ ID NO: 96836 - RNA, 19 nt, Homo sapiens
ggugagaacuguggaggau

SEQ ID NO: 96837 - RNA, 19 nt, Homo sapiens
acaauugguuacuggcuuu

SEQ ID NO: 96838 - RNA, 19 nt, Homo sapiens
gugcugaccuuaucauagg

SEQ ID NO: 96839 - RNA, 19 nt, Homo sapiens
ccaggacaaucuuggcuau

SEQ ID NO: 96840 - RNA, 19 nt, Homo sapiens
ucuacacugugauugguua

SEQ ID NO: 96841 - RNA, 19 nt, Homo sapiens
ccacuucccugggccauuc

SEQ ID NO: 96842 - RNA, 19 nt, Homo sapiens
cagcaaugccucaguuaug

SEQ ID NO: 96843 - RNA, 19 nt, Homo sapiens
uauuguagcccgcaagauu

SEQ ID NO: 96844 - RNA, 19 nt, Homo sapiens
aaacaugcaucagaauugg

SEQ ID NO: 96845 - RNA, 19 nt, Homo sapiens
auagugaagccaaacaaua

SEQ ID NO: 96846 - RNA, 19 nt, Homo sapiens
ggcuagcccuggacuaugu

SEQ ID NO: 96847 - RNA, 19 nt, Homo sapiens
gaccgucaacaauuacuuu

SEQ ID NO: 96848 - RNA, 19 nt, Homo sapiens
gcuauucuguuggcuuuca

SEQ ID NO: 96849 - RNA, 19 nt, Homo sapiens
uggcuauucuguuggcuuu

SEQ ID NO: 96850 - RNA, 19 nt, Homo sapiens
gaaagucaccaggacaauc

SEQ ID NO: 96851 - RNA, 19 nt, Homo sapiens
ugagaacucuaagcaaaca

SEQ ID NO: 96852 - RNA, 19 nt, Homo sapiens
gaacuuguacacccucuac

SEQ ID NO: 96853 - RNA, 19 nt, Homo sapiens
ucuguuggcuuucaucauc

SEQ ID NO: 96854 - RNA, 19 nt, Homo sapiens
uaagcaaacaugcaucaga

SEQ ID NO: 96855 - RNA, 19 nt, Homo sapiens
caagaagaccuuuaaacac

SEQ ID NO: 96856 - RNA, 19 nt, Homo sapiens
gcaagauugugaagaugac

SEQ ID NO: 96857 - RNA, 19 nt, Homo sapiens
gagagaugaugaaauaacc

SEQ ID NO: 96858 - RNA, 19 nt, Homo sapiens
gauaaagaaggacaagaag

SEQ ID NO: 96859 - RNA, 19 nt, Homo sapiens
ucucaugugucauuauaag

SEQ ID NO: 96860 - RNA, 19 nt, Homo sapiens
agcaaugccucaguuauga

SEQ ID NO: 96861 - RNA, 19 nt, Homo sapiens
uacaaguccuuauaagaca

SEQ ID NO: 96862 - RNA, 19 nt, Homo sapiens
ggccugugcugaccuuauc

SEQ ID NO: 96863 - RNA, 19 nt, Homo sapiens
gauagugaagccaaacaau

SEQ ID NO: 96864 - RNA, 19 nt, Homo sapiens
gacaagaaggagccuguug

SEQ ID NO: 96865 - RNA, 19 nt, Homo sapiens
ucacaaaaccucugaccua

SEQ ID NO: 96866 - RNA, 19 nt, Homo sapiens
gcaaugccucaguuaugaa

SEQ ID NO: 96867 - RNA, 19 nt, Homo sapiens
caaacuccucuaacaauag

SEQ ID NO: 96868 - RNA, 19 nt, Homo sapiens
agcaagagcaggauaaaga

SEQ ID NO: 96869 - RNA, 19 nt, Homo sapiens
gaugaaaagcagaauauug

SEQ ID NO: 96870 - RNA, 19 nt, Homo sapiens
uauugcagccuucuauuug

SEQ ID NO: 96871 - RNA, 19 nt, Homo sapiens
guuacuggcuuuguuacau

SEQ ID NO: 96872 - RNA, 19 nt, Homo sapiens
ggaacauccuagucauggu

SEQ ID NO: 96873 - RNA, 19 nt, Homo sapiens
ggauagugaagccaaacaa

SEQ ID NO: 96874 - RNA, 19 nt, Homo sapiens
cuauugcagccuucuauuu

SEQ ID NO: 96875 - RNA, 19 nt, Homo sapiens
cugccuggguccucucuuu

SEQ ID NO: 96876 - RNA, 19 nt, Homo sapiens
ucauguaccccaacuaaua

SEQ ID NO: 96877 - RNA, 19 nt, Homo sapiens
aggacaaucuuggcuauuc

SEQ ID NO: 96878 - RNA, 19 nt, Homo sapiens
gagaugaaaagcagaauau

SEQ ID NO: 96879 - RNA, 19 nt, Homo sapiens
ggucagaauggagaugaaa

SEQ ID NO: 96880 - RNA, 19 nt, Homo sapiens
guccuuauaagacauuuga

SEQ ID NO: 96881 - RNA, 19 nt, Homo sapiens
uuacaaguccuuauaagac

SEQ ID NO: 96882 - RNA, 19 nt, Homo sapiens
uugaagugguguuuauugu

SEQ ID NO: 96883 - RNA, 19 nt, Homo sapiens
ccaagucugguacaaggaa

SEQ ID NO: 96884 - RNA, 19 nt, Homo sapiens
uggcuuucaucaucacuug

SEQ ID NO: 96885 - RNA, 19 nt, Homo sapiens
caccuucucaugugucauu

SEQ ID NO: 96886 - RNA, 19 nt, Homo sapiens
uuacuggcuuuguuacauc

SEQ ID NO: 96887 - RNA, 19 nt, Homo sapiens
ggacaagaaggagccuguu

SEQ ID NO: 96888 - RNA, 19 nt, Homo sapiens
aacaaacuccucuaacaau

SEQ ID NO: 96889 - RNA, 19 nt, Homo sapiens
agagcaggauaaagaagga

SEQ ID NO: 96890 - RNA, 19 nt, Homo sapiens
gcuauugcagccuucuauu

SEQ ID NO: 96891 - RNA, 19 nt, Homo sapiens
guggcuggaucccucaguu

SEQ ID NO: 96892 - RNA, 19 nt, Homo sapiens
ccaaugcugcugucaccuu

SEQ ID NO: 96893 - RNA, 19 nt, Homo sapiens
uuuaaacaccuucucaugu

SEQ ID NO: 96894 - RNA, 19 nt, Homo sapiens
ggagaugaaaagcagaaua

SEQ ID NO: 96895 - RNA, 19 nt, Homo sapiens
gccagcaagagcaggauaa

SEQ ID NO: 96896 - RNA, 19 nt, Homo sapiens
gcugcugucaccuuuggua

SEQ ID NO: 96897 - RNA, 19 nt, Homo sapiens
ucaucagcuuugacaggua

SEQ ID NO: 96898 - RNA, 19 nt, Homo sapiens
ugaaucugcucaucaucag

SEQ ID NO: 96899 - RNA, 19 nt, Homo sapiens
gaagaaggauguauucaua

SEQ ID NO: 96900 - RNA, 19 nt, Homo sapiens
gaagacagauuacauagua

SEQ ID NO: 96901 - RNA, 19 nt, Homo sapiens
gaagauaccuguccaagaa

SEQ ID NO: 96902 - RNA, 19 nt, Homo sapiens
ggaaaguucuguucuauuu

SEQ ID NO: 96903 - RNA, 19 nt, Homo sapiens
gaagugauuugcuuuguua

SEQ ID NO: 96904 - RNA, 19 nt, Homo sapiens
ugaagaaacucaagcauua

SEQ ID NO: 96905 - RNA, 19 nt, Homo sapiens
ggacaaaccauccaaauaa

SEQ ID NO: 96906 - RNA, 19 nt, Homo sapiens
gcagauauguugcuggaua

SEQ ID NO: 96907 - RNA, 19 nt, Homo sapiens
gcacauagauggcaagauc

SEQ ID NO: 96908 - RNA, 19 nt, Homo sapiens
ccaaagaggaguugaauua

SEQ ID NO: 96909 - RNA, 19 nt, Homo sapiens
gaacggaucugcagcuguu

SEQ ID NO: 96910 - RNA, 19 nt, Homo sapiens
caaagaagcuuauccaaag

SEQ ID NO: 96911 - RNA, 19 nt, Homo sapiens
gaaaugggaugcuuuaaag

SEQ ID NO: 96912 - RNA, 19 nt, Homo sapiens
gaaauuugcuucucuucaa

SEQ ID NO: 96913 - RNA, 19 nt, Homo sapiens
gaacaaaucagagaacuuu

SEQ ID NO: 96914 - RNA, 19 nt, Homo sapiens
gaagaagacagauuacaua

SEQ ID NO: 96915 - RNA, 19 nt, Homo sapiens
gacguuaccuugaaucaua

SEQ ID NO: 96916 - RNA, 19 nt, Homo sapiens
gaaagcacguggccaugua

SEQ ID NO: 96917 - RNA, 19 nt, Homo sapiens
gaucuaaucugcaggaaga

SEQ ID NO: 96918 - RNA, 19 nt, Homo sapiens
caaauaaccucccuaaucu

SEQ ID NO: 96919 - RNA, 19 nt, Homo sapiens
ggaggguucuugaguauuu

SEQ ID NO: 96920 - RNA, 19 nt, Homo sapiens
gagaugagauuacuccuau

SEQ ID NO: 96921 - RNA, 19 nt, Homo sapiens
caagaaagauguggauauu

SEQ ID NO: 96922 - RNA, 19 nt, Homo sapiens
ccaaaugacuuacucgaaa

SEQ ID NO: 96923 - RNA, 19 nt, Homo sapiens
aaagagugcugacaguuua

SEQ ID NO: 96924 - RNA, 19 nt, Homo sapiens
gagcagagauaucaccaaa

SEQ ID NO: 96925 - RNA, 19 nt, Homo sapiens
gaucaggcauugacaugua

SEQ ID NO: 96926 - RNA, 19 nt, Homo sapiens
gaacacagccuaaauaagg

SEQ ID NO: 96927 - RNA, 19 nt, Homo sapiens
guagaaggauucaaaguau

SEQ ID NO: 96928 - RNA, 19 nt, Homo sapiens
cagaauaacuggucuuguu

SEQ ID NO: 96929 - RNA, 19 nt, Homo sapiens
cagauaagcucaguaauau

SEQ ID NO: 96930 - RNA, 19 nt, Homo sapiens
caaaggagaaccagaauuu

SEQ ID NO: 96931 - RNA, 19 nt, Homo sapiens
gggaguaucuaucaaugua

SEQ ID NO: 96932 - RNA, 19 nt, Homo sapiens
gagaacaggucaaagaaau

SEQ ID NO: 96933 - RNA, 19 nt, Homo sapiens
gaaugagaauggagaguuu

SEQ ID NO: 96934 - RNA, 19 nt, Homo sapiens
ggauauuggucucuuaauu

SEQ ID NO: 96935 - RNA, 19 nt, Homo sapiens
ggaauaugcuguuguaugg

SEQ ID NO: 96936 - RNA, 19 nt, Homo sapiens
agacaaagcugcaagugaa

SEQ ID NO: 96937 - RNA, 19 nt, Homo sapiens
guacauaaauccuggugaa

SEQ ID NO: 96938 - RNA, 19 nt, Homo sapiens
gcaaagcuauuuacaaguc

SEQ ID NO: 96939 - RNA, 19 nt, Homo sapiens
cagcauauuucuuccauaa

SEQ ID NO: 96940 - RNA, 19 nt, Homo sapiens
ggauagacauugaacagaa

SEQ ID NO: 96941 - RNA, 19 nt, Homo sapiens
gaagugcccugucuaguca

SEQ ID NO: 96942 - RNA, 19 nt, Homo sapiens
gagaagaacuccugacucu

SEQ ID NO: 96943 - RNA, 19 nt, Homo sapiens
gaugauguauaccacaaua

SEQ ID NO: 96944 - RNA, 19 nt, Homo sapiens
gaaaugagggaccaucuuu

SEQ ID NO: 96945 - RNA, 19 nt, Homo sapiens
gaaaggcaauauaguuguu

SEQ ID NO: 96946 - RNA, 19 nt, Homo sapiens
caagauagauucgagagaa

SEQ ID NO: 96947 - RNA, 19 nt, Homo sapiens
gaacaucugucaguggauu

SEQ ID NO: 96948 - RNA, 19 nt, Homo sapiens
agagacagcuggugaauug

SEQ ID NO: 96949 - RNA, 19 nt, Homo sapiens
caaaguaucuauugguuca

SEQ ID NO: 96950 - RNA, 19 nt, Homo sapiens
gaagauggaauuggaguua

SEQ ID NO: 96951 - RNA, 19 nt, Homo sapiens
uaugauggcugucuguaua

SEQ ID NO: 96952 - RNA, 19 nt, Homo sapiens
agaaaucucucuaaaccua

SEQ ID NO: 96953 - RNA, 19 nt, Homo sapiens
ggucaaagcagaucauaaa

SEQ ID NO: 96954 - RNA, 19 nt, Homo sapiens
guucaucacuuucuacuga

SEQ ID NO: 96955 - RNA, 19 nt, Homo sapiens
ggaagacuguuaaccaaga

SEQ ID NO: 96956 - RNA, 19 nt, Homo sapiens
gcaugaaaccuaauaugua

SEQ ID NO: 96957 - RNA, 19 nt, Homo sapiens
guaauaagcccaucugguu

SEQ ID NO: 96958 - RNA, 19 nt, Homo sapiens
caaauggaauggcugguuu

SEQ ID NO: 96959 - RNA, 19 nt, Homo sapiens
cauguaugcuuuaaccuua

SEQ ID NO: 96960 - RNA, 19 nt, Homo sapiens
gaaguuugcauggguauua

SEQ ID NO: 96961 - RNA, 19 nt, Homo sapiens
caagagagaaagcaaauuu

SEQ ID NO: 96962 - RNA, 19 nt, Homo sapiens
ucagauaagcucaguaaua

SEQ ID NO: 96963 - RNA, 19 nt, Homo sapiens
uaagaacacagccuaaaua

SEQ ID NO: 96964 - RNA, 19 nt, Homo sapiens
ucaccgcucugacaaauuu

SEQ ID NO: 96965 - RNA, 19 nt, Homo sapiens
gaggagacguuuacagaga

SEQ ID NO: 96966 - RNA, 19 nt, Homo sapiens
ugucagaguugauacauaa

SEQ ID NO: 96967 - RNA, 19 nt, Homo sapiens
ggaacuggcauauuuguuu

SEQ ID NO: 96968 - RNA, 19 nt, Homo sapiens
ggaaaugggaugcuuuaaa

SEQ ID NO: 96969 - RNA, 19 nt, Homo sapiens
gcagucaacaggauuauuu

SEQ ID NO: 96970 - RNA, 19 nt, Homo sapiens
aaauauggcuguugcacua

SEQ ID NO: 96971 - RNA, 19 nt, Homo sapiens
gaaccagugauuagacuua

SEQ ID NO: 96972 - RNA, 19 nt, Homo sapiens
gaacuaugaaggaagauuu

SEQ ID NO: 96973 - RNA, 19 nt, Homo sapiens
gagcggugcuguugcauug

SEQ ID NO: 96974 - RNA, 19 nt, Homo sapiens
ugaaagcccuaauaaauag

SEQ ID NO: 96975 - RNA, 19 nt, Homo sapiens
ccagcugccuugucuguua

SEQ ID NO: 96976 - RNA, 19 nt, Homo sapiens
gauaauugcuuucuuugag

SEQ ID NO: 96977 - RNA, 19 nt, Homo sapiens
guaauggacuuucuaugau

SEQ ID NO: 96978 - RNA, 19 nt, Homo sapiens
caacaaagaguacaugaau

SEQ ID NO: 96979 - RNA, 19 nt, Homo sapiens
gagaagagcacgaguuuca

SEQ ID NO: 96980 - RNA, 19 nt, Homo sapiens
ucgaggaacucaagaauug

SEQ ID NO: 96981 - RNA, 19 nt, Homo sapiens
gugaaagacucauagaaga

SEQ ID NO: 96982 - RNA, 19 nt, Homo sapiens
ucagaagguuucaguguuu

SEQ ID NO: 96983 - RNA, 19 nt, Homo sapiens
gccaaugacucagaagaua

SEQ ID NO: 96984 - RNA, 19 nt, Homo sapiens
gaacaauucuccauuugac

SEQ ID NO: 96985 - RNA, 19 nt, Homo sapiens
caugaacaauucuccauuu

SEQ ID NO: 96986 - RNA, 19 nt, Homo sapiens
guaccaauuugcaauagaa

SEQ ID NO: 96987 - RNA, 19 nt, Homo sapiens
gacggaaccugcaucauau

SEQ ID NO: 96988 - RNA, 19 nt, Homo sapiens
gaauuucugucuugugaug

SEQ ID NO: 96989 - RNA, 19 nt, Homo sapiens
gcaagugaaucuauaagag

SEQ ID NO: 96990 - RNA, 19 nt, Homo sapiens
gguagaaggauucaaagua

SEQ ID NO: 96991 - RNA, 19 nt, Homo sapiens
ggauaauggucuacucuau

SEQ ID NO: 96992 - RNA, 19 nt, Homo sapiens
gaguugcccucgggaauua

SEQ ID NO: 96993 - RNA, 19 nt, Homo sapiens
uaaccaagauguucauauc

SEQ ID NO: 96994 - RNA, 19 nt, Homo sapiens
ccaacuagcccaauuagaa

SEQ ID NO: 96995 - RNA, 19 nt, Homo sapiens
gauauagacuguaaauguc

SEQ ID NO: 96996 - RNA, 19 nt, Homo sapiens
ucacugagguuuaaacaca

SEQ ID NO: 96997 - RNA, 19 nt, Homo sapiens
gaggaaaguucuguucuau

SEQ ID NO: 96998 - RNA, 19 nt, Homo sapiens
uaaaauagcugcagauauc

SEQ ID NO: 96999 - RNA, 19 nt, Homo sapiens
caacaacuacuuccucuua

SEQ ID NO: 97000 - RNA, 19 nt, Homo sapiens
ugaagacggucaacaacua

SEQ ID NO: 97001 - RNA, 19 nt, Homo sapiens
ggagagugcuucauucagu

SEQ ID NO: 97002 - RNA, 19 nt, Homo sapiens
ggacagaggcagagacaga

SEQ ID NO: 97003 - RNA, 19 nt, Homo sapiens
ggaugucccuggucaagga

SEQ ID NO: 97004 - RNA, 19 nt, Homo sapiens
ggcaauacuuuguuggaaa

SEQ ID NO: 97005 - RNA, 19 nt, Homo sapiens
aaagagagccggugugaug

SEQ ID NO: 97006 - RNA, 19 nt, Homo sapiens
guaauugugucauuuaagg

SEQ ID NO: 97007 - RNA, 19 nt, Homo sapiens
gcaacauccugguaauugu

SEQ ID NO: 97008 - RNA, 19 nt, Homo sapiens
cagaaccacuuucaagaug

SEQ ID NO: 97009 - RNA, 19 nt, Homo sapiens
ccagaagucagaucacuaa

SEQ ID NO: 97010 - RNA, 19 nt, Homo sapiens
ggacacagcuaagacuucu

SEQ ID NO: 97011 - RNA, 19 nt, Homo sapiens
gagagugcuucauucaguu

SEQ ID NO: 97012 - RNA, 19 nt, Homo sapiens
caucagcuccuccuggaua

SEQ ID NO: 97013 - RNA, 19 nt, Homo sapiens
ucacgaggccgcucacgua

SEQ ID NO: 97014 - RNA, 19 nt, Homo sapiens
ggucuucaucgcuuucuua

SEQ ID NO: 97015 - RNA, 19 nt, Homo sapiens
gcuaugcucugugcaacaa

SEQ ID NO: 97016 - RNA, 19 nt, Homo sapiens
uggaggaucuauaaggaaa

SEQ ID NO: 97017 - RNA, 19 nt, Homo sapiens
caaugccucuguuaugaau

SEQ ID NO: 97018 - RNA, 19 nt, Homo sapiens
cgggaaccgucacucauuu

SEQ ID NO: 97019 - RNA, 19 nt, Homo sapiens
ucgagcagcuggcaauuuc

SEQ ID NO: 97020 - RNA, 19 nt, Homo sapiens
ggucaucuccuuuguccuu

SEQ ID NO: 97021 - RNA, 19 nt, Homo sapiens
gcaaugccucuguuaugaa

SEQ ID NO: 97022 - RNA, 19 nt, Homo sapiens
cagagacagucggucauuu

SEQ ID NO: 97023 - RNA, 19 nt, Homo sapiens
gaucuugcuugccuucauc

SEQ ID NO: 97024 - RNA, 19 nt, Homo sapiens
gaacuucaacagcaaagca

SEQ ID NO: 97025 - RNA, 19 nt, Homo sapiens
uuauaugccugucaccauu

SEQ ID NO: 97026 - RNA, 19 nt, Homo sapiens
gagccaaacgaacaacaaa

SEQ ID NO: 97027 - RNA, 19 nt, Homo sapiens
cauuuaaggucaacaagca

SEQ ID NO: 97028 - RNA, 19 nt, Homo sapiens
caaacgaacaacaaagaga

SEQ ID NO: 97029 - RNA, 19 nt, Homo sapiens
gcagagacagucggucauu

SEQ ID NO: 97030 - RNA, 19 nt, Homo sapiens
ccgagcagauggaccaaga

SEQ ID NO: 97031 - RNA, 19 nt, Homo sapiens
ucauucaguuccucaguga

SEQ ID NO: 97032 - RNA, 19 nt, Homo sapiens
gccaaacgaacaacaaaga

SEQ ID NO: 97033 - RNA, 19 nt, Homo sapiens
cagcaaugccucuguuaug

SEQ ID NO: 97034 - RNA, 19 nt, Homo sapiens
ggcaacauccugguaauug

SEQ ID NO: 97035 - RNA, 19 nt, Homo sapiens
ucagaucacuaagcggaaa

SEQ ID NO: 97036 - RNA, 19 nt, Homo sapiens
gaagagcguggacgaugga

SEQ ID NO: 97037 - RNA, 19 nt, Homo sapiens
guaccgagccaaacgaaca

SEQ ID NO: 97038 - RNA, 19 nt, Homo sapiens
uuacgaacuucaacagcaa

SEQ ID NO: 97039 - RNA, 19 nt, Homo sapiens
ggaucuauaaggaaacuga

SEQ ID NO: 97040 - RNA, 19 nt, Homo sapiens
cuucaucgcuuucuuaacg

SEQ ID NO: 97041 - RNA, 19 nt, Homo sapiens
ucagugagcccaccauuac

SEQ ID NO: 97042 - RNA, 19 nt, Homo sapiens
caucagcuuugacagauac

SEQ ID NO: 97043 - RNA, 19 nt, Homo sapiens
gaaccacuuucaagaugcu

SEQ ID NO: 97044 - RNA, 19 nt, Homo sapiens
gaccacagcagcagugaca

SEQ ID NO: 97045 - RNA, 19 nt, Homo sapiens
agcaaugccucuguuauga

SEQ ID NO: 97046 - RNA, 19 nt, Homo sapiens
uagggaacuuggccuguga

SEQ ID NO: 97047 - RNA, 19 nt, Homo sapiens
ugaaucuguuuacgaccua

SEQ ID NO: 97048 - RNA, 19 nt, Homo sapiens
gaccagaagucagaucacu

SEQ ID NO: 97049 - RNA, 19 nt, Homo sapiens
ccaccaaguuacccucauc

SEQ ID NO: 97050 - RNA, 19 nt, Homo sapiens
cgagagccaucuacuccau

SEQ ID NO: 97051 - RNA, 19 nt, Homo sapiens
aacaacuacuuccucuuaa

SEQ ID NO: 97052 - RNA, 19 nt, Homo sapiens
ccugguaauugugucauuu

SEQ ID NO: 97053 - RNA, 19 nt, Homo sapiens
gcuacuggcugugcuacau

SEQ ID NO: 97054 - RNA, 19 nt, Homo sapiens
ucaucagcuuugacagaua

SEQ ID NO: 97055 - RNA, 19 nt, Homo sapiens
acacagcuaagacuucuga

SEQ ID NO: 97056 - RNA, 19 nt, Homo sapiens
acaaagagagccgguguga

SEQ ID NO: 97057 - RNA, 19 nt, Homo sapiens
ucaaugaaucuguuuacga

SEQ ID NO: 97058 - RNA, 19 nt, Homo sapiens
cauacaacaucaugguucu

SEQ ID NO: 97059 - RNA, 19 nt, Homo sapiens
uugcuugccuucaucauca

SEQ ID NO: 97060 - RNA, 19 nt, Homo sapiens
uauaugccugucaccauua

SEQ ID NO: 97061 - RNA, 19 nt, Homo sapiens
gagagccggugugaugauc

SEQ ID NO: 97062 - RNA, 19 nt, Homo sapiens
cagcuuugacagauacuuu

SEQ ID NO: 97063 - RNA, 19 nt, Homo sapiens
ucagaaccacuuucaagau

SEQ ID NO: 97064 - RNA, 19 nt, Homo sapiens
aaacauucagaaccacuuu

SEQ ID NO: 97065 - RNA, 19 nt, Homo sapiens
uaagacuucugacgucaac

SEQ ID NO: 97066 - RNA, 19 nt, Homo sapiens
gcagugacaguuggaacaa

SEQ ID NO: 97067 - RNA, 19 nt, Homo sapiens
caacauccugguaauugug

SEQ ID NO: 97068 - RNA, 19 nt, Homo sapiens
ggccugugccgaucugauu

SEQ ID NO: 97069 - RNA, 19 nt, Homo sapiens
uggcaauacuuuguuggaa

SEQ ID NO: 97070 - RNA, 19 nt, Homo sapiens
ucacucauuucggcagcua

SEQ ID NO: 97071 - RNA, 19 nt, Homo sapiens
caacagcaaagcaugaaac

SEQ ID NO: 97072 - RNA, 19 nt, Homo sapiens
gaggaucuauaaggaaacu

SEQ ID NO: 97073 - RNA, 19 nt, Homo sapiens
acuggaggaucuauaagga

SEQ ID NO: 97074 - RNA, 19 nt, Homo sapiens
uggcuugggucaucuccuu

SEQ ID NO: 97075 - RNA, 19 nt, Homo sapiens
gaagacggucaacaacuac

SEQ ID NO: 97076 - RNA, 19 nt, Homo sapiens
cacccgagcaggccuugua

SEQ ID NO: 97077 - RNA, 19 nt, Homo sapiens
ugacagcugcauacccaaa

SEQ ID NO: 97078 - RNA, 19 nt, Homo sapiens
acaacuacuuccucuuaag

SEQ ID NO: 97079 - RNA, 19 nt, Homo sapiens
uucggcagcuacaauguuu

SEQ ID NO: 97080 - RNA, 19 nt, Homo sapiens
gacccucagugcgaucuug

SEQ ID NO: 97081 - RNA, 19 nt, Homo sapiens
gccagcaaugccucuguua

SEQ ID NO: 97082 - RNA, 19 nt, Homo sapiens
ggagaggaaagccgacaag

SEQ ID NO: 97083 - RNA, 19 nt, Homo sapiens
gcaugaaacgcuccaacag

SEQ ID NO: 97084 - RNA, 19 nt, Homo sapiens
gacagaggcagagacagaa

SEQ ID NO: 97085 - RNA, 19 nt, Homo sapiens
gcuugccauugacuacgua

SEQ ID NO: 97086 - RNA, 19 nt, Homo sapiens
caaccucgccuuuguuucc

SEQ ID NO: 97087 - RNA, 19 nt, Homo sapiens
gugaacaccuuuugugaca

SEQ ID NO: 97088 - RNA, 19 nt, Homo sapiens
ucuccaagcuucccaucca

SEQ ID NO: 97089 - RNA, 19 nt, Homo sapiens
gugagcccaccauuacuuu

SEQ ID NO: 97090 - RNA, 19 nt, Homo sapiens
uuuacgaccuacaucauca

SEQ ID NO: 97091 - RNA, 19 nt, Homo sapiens
gaucuauaaggaaacugaa

SEQ ID NO: 97092 - RNA, 19 nt, Homo sapiens
cugguaauugugucauuua

SEQ ID NO: 97093 - RNA, 19 nt, Homo sapiens
caucggcaacauccuggua

SEQ ID NO: 97094 - RNA, 19 nt, Homo sapiens
gacagauacuuuuccauca

SEQ ID NO: 97095 - RNA, 19 nt, Homo sapiens
ccagcaaugccucuguuau

SEQ ID NO: 97096 - RNA, 19 nt, Homo sapiens
gaagaccagaagucagauc

SEQ ID NO: 97097 - RNA, 19 nt, Homo sapiens
ccgggaaccgucacucauu

SEQ ID NO: 97098 - RNA, 19 nt, Homo sapiens
ucaacaagcagcugaagac

SEQ ID NO: 97099 - RNA, 19 nt, Homo sapiens
gagcaacgccuccgucaug

SEQ ID NO: 97100 - RNA, 19 nt, Homo sapiens
caucaacccugccugcuau

SEQ ID NO: 97101 - RNA, 19 nt, Homo sapiens
gguccaagauccagauugu

SEQ ID NO: 97102 - RNA, 19 nt, Homo sapiens
gcaaccaggugcgcaagaa

SEQ ID NO: 97103 - RNA, 19 nt, Homo sapiens
ugacagccauugagauugu

SEQ ID NO: 97104 - RNA, 19 nt, Homo sapiens
caacaacuacuuccucuuc

SEQ ID NO: 97105 - RNA, 19 nt, Homo sapiens
gauaaggacacuuccaaug

SEQ ID NO: 97106 - RNA, 19 nt, Homo sapiens
cgaacgaucuuugccauuc

SEQ ID NO: 97107 - RNA, 19 nt, Homo sapiens
ucaccaagccucucaccua

SEQ ID NO: 97108 - RNA, 19 nt, Homo sapiens
cucaagagcccacuaauga

SEQ ID NO: 97109 - RNA, 19 nt, Homo sapiens
caagauggcaggccucaug

SEQ ID NO: 97110 - RNA, 19 nt, Homo sapiens
gcuaugagacgguggaaau

SEQ ID NO: 97111 - RNA, 19 nt, Homo sapiens
gaacgaucuuugccauucu

SEQ ID NO: 97112 - RNA, 19 nt, Homo sapiens
gugcaacgccaccuuuaaa

SEQ ID NO: 97113 - RNA, 19 nt, Homo sapiens
gaucuuugccauucugcua

SEQ ID NO: 97114 - RNA, 19 nt, Homo sapiens
caacuucacaccugucaau

SEQ ID NO: 97115 - RNA, 19 nt, Homo sapiens
uaaggacacuuccaaugag

SEQ ID NO: 97116 - RNA, 19 nt, Homo sapiens
gauggcaggccucaugauu

SEQ ID NO: 97117 - RNA, 19 nt, Homo sapiens
gcagacaggcaaugagugu

SEQ ID NO: 97118 - RNA, 19 nt, Homo sapiens
auaaggacacuuccaauga

SEQ ID NO: 97119 - RNA, 19 nt, Homo sapiens
acaggcagcugcagacagu

SEQ ID NO: 97120 - RNA, 19 nt, Homo sapiens
ugaagcagagcgucaagaa

SEQ ID NO: 97121 - RNA, 19 nt, Homo sapiens
caagagcccacuaaugaag

SEQ ID NO: 97122 - RNA, 19 nt, Homo sapiens
caacccagcagugaccuuu

SEQ ID NO: 97123 - RNA, 19 nt, Homo sapiens
ggcaguuugugguggguaa

SEQ ID NO: 97124 - RNA, 19 nt, Homo sapiens
cgacaaccacugcuucauc

SEQ ID NO: 97125 - RNA, 19 nt, Homo sapiens
ucaagagcccacuaaugaa

SEQ ID NO: 97126 - RNA, 19 nt, Homo sapiens
ccaagacgcuggccuuccu

SEQ ID NO: 97127 - RNA, 19 nt, Homo sapiens
ugcagacagucaacaacua

SEQ ID NO: 97128 - RNA, 19 nt, Homo sapiens
cgaagcagacaggcaauga

SEQ ID NO: 97129 - RNA, 19 nt, Homo sapiens
gagcgcaaagugacacgaa

SEQ ID NO: 97130 - RNA, 19 nt, Homo sapiens
uccaagauccagauuguga

SEQ ID NO: 97131 - RNA, 19 nt, Homo sapiens
ugacggugcuguacaucca

SEQ ID NO: 97132 - RNA, 19 nt, Homo sapiens
gcagacagucaacaacuac

SEQ ID NO: 97133 - RNA, 19 nt, Homo sapiens
ugugacagccauugagauu

SEQ ID NO: 97134 - RNA, 19 nt, Homo sapiens
acgcuggccuuccucaaga

SEQ ID NO: 97135 - RNA, 19 nt, Homo sapiens
ccucaagagcccacuaaug

SEQ ID NO: 97136 - RNA, 19 nt, Homo sapiens
auaggcgccuucuccauga

SEQ ID NO: 97137 - RNA, 19 nt, Homo sapiens
ggcgugugcugaucucauc

SEQ ID NO: 97138 - RNA, 19 nt, Homo sapiens
gaagcagagcgucaagaag

SEQ ID NO: 97139 - RNA, 19 nt, Homo sapiens
ucaugacggugcuguacau

SEQ ID NO: 97140 - RNA, 19 nt, Homo sapiens
ccaucaacccugccugcua

SEQ ID NO: 97141 - RNA, 19 nt, Homo sapiens
agauccagauugugacgaa

SEQ ID NO: 97142 - RNA, 19 nt, Homo sapiens
uggcaggccucaugauugc

SEQ ID NO: 97143 - RNA, 19 nt, Homo sapiens
gcaacgccuccgucaugaa

SEQ ID NO: 97144 - RNA, 19 nt, Homo sapiens
gcuacuggcucugcuacgu

SEQ ID NO: 97145 - RNA, 19 nt, Homo sapiens
gcagccgaguccacaagca

SEQ ID NO: 97146 - RNA, 19 nt, Homo sapiens
aaagugacacgaacgaucu

SEQ ID NO: 97147 - RNA, 19 nt, Homo sapiens
gacagucaacaacuacuuc

SEQ ID NO: 97148 - RNA, 19 nt, Homo sapiens
gaagcagacaggcaaugag

SEQ ID NO: 97149 - RNA, 19 nt, Homo sapiens
ucaccuggacgcccuacaa

SEQ ID NO: 97150 - RNA, 19 nt, Homo sapiens
gcaaagugacacgaacgau

SEQ ID NO: 97151 - RNA, 19 nt, Homo sapiens
caacgccuccgucaugaac

SEQ ID NO: 97152 - RNA, 19 nt, Homo sapiens
ccacccagaacaccaagga

SEQ ID NO: 97153 - RNA, 19 nt, Homo sapiens
uggacuacguggugagcaa

SEQ ID NO: 97154 - RNA, 19 nt, Homo sapiens
cagcuuugaccgcuacuuc

SEQ ID NO: 97155 - RNA, 19 nt, Homo sapiens
agacaggcaaugagugugu

SEQ ID NO: 97156 - RNA, 19 nt, Homo sapiens
caucuuguucuggcaguuu

SEQ ID NO: 97157 - RNA, 19 nt, Homo sapiens
gcugcugccuggguacugu

SEQ ID NO: 97158 - RNA, 19 nt, Homo sapiens
agaaauguguggccuauaa

SEQ ID NO: 97159 - RNA, 19 nt, Homo sapiens
gaccaaagcugagaagaga

SEQ ID NO: 97160 - RNA, 19 nt, Homo sapiens
gaaaagggcuggcaucaug

SEQ ID NO: 97161 - RNA, 19 nt, Homo sapiens
cagcaacgcuucugucaug

SEQ ID NO: 97162 - RNA, 19 nt, Homo sapiens
gaaagagagugguccuagu

SEQ ID NO: 97163 - RNA, 19 nt, Homo sapiens
ugugaaagcugaaacugaa

SEQ ID NO: 97164 - RNA, 19 nt, Homo sapiens
gugcagaucucaucauugg

SEQ ID NO: 97165 - RNA, 19 nt, Homo sapiens
caaaugaccaaacgaaaga

SEQ ID NO: 97166 - RNA, 19 nt, Homo sapiens
gcagaucucaucauuggaa

SEQ ID NO: 97167 - RNA, 19 nt, Homo sapiens
ggcaaugucuuggucauga

SEQ ID NO: 97168 - RNA, 19 nt, Homo sapiens
gcagcuacccuuccucaga

SEQ ID NO: 97169 - RNA, 19 nt, Homo sapiens
gaggaaagcagcccagaca

SEQ ID NO: 97170 - RNA, 19 nt, Homo sapiens
gagagugguccuagucaaa

SEQ ID NO: 97171 - RNA, 19 nt, Homo sapiens
ugaggaaacuuuugugaaa

SEQ ID NO: 97172 - RNA, 19 nt, Homo sapiens
ccaaagcugagaagagaaa

SEQ ID NO: 97173 - RNA, 19 nt, Homo sapiens
gaaucuaccgggaaacaga

SEQ ID NO: 97174 - RNA, 19 nt, Homo sapiens
gucaugaucuccuucaaag

SEQ ID NO: 97175 - RNA, 19 nt, Homo sapiens
gcuauugguugugcuaugu

SEQ ID NO: 97176 - RNA, 19 nt, Homo sapiens
ucagaaauguguggccuau

SEQ ID NO: 97177 - RNA, 19 nt, Homo sapiens
cagcuuagccugugcagau

SEQ ID NO: 97178 - RNA, 19 nt, Homo sapiens
ucaggaagaccuuuaagau

SEQ ID NO: 97179 - RNA, 19 nt, Homo sapiens
gcaacagaaccuucaggaa

SEQ ID NO: 97180 - RNA, 19 nt, Homo sapiens
caucaaaugaccaaacgaa

SEQ ID NO: 97181 - RNA, 19 nt, Homo sapiens
ugucgaaucuaccgggaaa

SEQ ID NO: 97182 - RNA, 19 nt, Homo sapiens
gagucuggcuugugaccuu

SEQ ID NO: 97183 - RNA, 19 nt, Homo sapiens
ggucaugaucuccuucaaa

SEQ ID NO: 97184 - RNA, 19 nt, Homo sapiens
gcucauagggcucuguuca

SEQ ID NO: 97185 - RNA, 19 nt, Homo sapiens
acuauuaccugcucagcuu

SEQ ID NO: 97186 - RNA, 19 nt, Homo sapiens
gcaaugucuuggucaugau

SEQ ID NO: 97187 - RNA, 19 nt, Homo sapiens
caggaagaccuuuaagaug

SEQ ID NO: 97188 - RNA, 19 nt, Homo sapiens
agagaaagccagcucauag

SEQ ID NO: 97189 - RNA, 19 nt, Homo sapiens
guaaaucaccagccuuugg

SEQ ID NO: 97190 - RNA, 19 nt, Homo sapiens
caacaauggcugucacaag

SEQ ID NO: 97191 - RNA, 19 nt, Homo sapiens
ggaagaccuuuaagaugcu

SEQ ID NO: 97192 - RNA, 19 nt, Homo sapiens
gagugguccuagucaaaga

SEQ ID NO: 97193 - RNA, 19 nt, Homo sapiens
ggaaccaggagaccaacaa

SEQ ID NO: 97194 - RNA, 19 nt, Homo sapiens
caguaaaucaccagccuuu

SEQ ID NO: 97195 - RNA, 19 nt, Homo sapiens
ccaagagucagaaaugugu

SEQ ID NO: 97196 - RNA, 19 nt, Homo sapiens
gacccaagagucagaaaug

SEQ ID NO: 97197 - RNA, 19 nt, Homo sapiens
gaagagaaagccagcucau

SEQ ID NO: 97198 - RNA, 19 nt, Homo sapiens
ucaugaaccuucuggugau

SEQ ID NO: 97199 - RNA, 19 nt, Homo sapiens
uaaaucaccagccuuugga

SEQ ID NO: 97200 - RNA, 19 nt, Homo sapiens
ucacauggaccccguauaa

SEQ ID NO: 97201 - RNA, 19 nt, Homo sapiens
gaaccaggagaccaacaau

SEQ ID NO: 97202 - RNA, 19 nt, Homo sapiens
cagagaagcgaaccaagga

SEQ ID NO: 97203 - RNA, 19 nt, Homo sapiens
gggcuggcaucaugauugg

SEQ ID NO: 97204 - RNA, 19 nt, Homo sapiens
ugaagagacugaggaaacu

SEQ ID NO: 97205 - RNA, 19 nt, Homo sapiens
ggccaagcguacuccgaaa

SEQ ID NO: 97206 - RNA, 19 nt, Homo sapiens
caacgcuucugucaugaac

SEQ ID NO: 97207 - RNA, 19 nt, Homo sapiens
ucgggagucuggcuuguga

SEQ ID NO: 97208 - RNA, 19 nt, Homo sapiens
ucucaucauuggaaucuuc

SEQ ID NO: 97209 - RNA, 19 nt, Homo sapiens
ggaaagcagcccagacacu

SEQ ID NO: 97210 - RNA, 19 nt, Homo sapiens
ucaaaugaccaaacgaaag

SEQ ID NO: 97211 - RNA, 19 nt, Homo sapiens
caacagccagcucaagaca

SEQ ID NO: 97212 - RNA, 19 nt, Homo sapiens
caugaucuccuucaaaguc

SEQ ID NO: 97213 - RNA, 19 nt, Homo sapiens
gccuauaaguuccgauugg

SEQ ID NO: 97214 - RNA, 19 nt, Homo sapiens
aaacagagaagcgaaccaa

SEQ ID NO: 97215 - RNA, 19 nt, Homo sapiens
gcaacgcuucugucaugaa

SEQ ID NO: 97216 - RNA, 19 nt, Homo sapiens
uaacaucaugguccugguu

SEQ ID NO: 97217 - RNA, 19 nt, Homo sapiens
gaaauguguggccuauaag

SEQ ID NO: 97218 - RNA, 19 nt, Homo sapiens
gagaaagccagcucauagg

SEQ ID NO: 97219 - RNA, 19 nt, Homo sapiens
acagccagcucaagacagu

SEQ ID NO: 97220 - RNA, 19 nt, Homo sapiens
gaagagacugaggaaacuu

SEQ ID NO: 97221 - RNA, 19 nt, Homo sapiens
guuucuaccuucugugaca

SEQ ID NO: 97222 - RNA, 19 nt, Homo sapiens
aagagaaagccagcucaua

SEQ ID NO: 97223 - RNA, 19 nt, Homo sapiens
gaucucaucauuggaaucu

SEQ ID NO: 97224 - RNA, 19 nt, Homo sapiens
gcucaagacaguuaacaac

SEQ ID NO: 97225 - RNA, 19 nt, Homo sapiens
uaccuucugugacaagugu

SEQ ID NO: 97226 - RNA, 19 nt, Homo sapiens
gggaagucaucaccauugc

SEQ ID NO: 97227 - RNA, 19 nt, Homo sapiens
guaagccugaucaccauug

SEQ ID NO: 97228 - RNA, 19 nt, Homo sapiens
gucaacagccagcucaaga

SEQ ID NO: 97229 - RNA, 19 nt, Homo sapiens
ccucuacugucgaaucuac

SEQ ID NO: 97230 - RNA, 19 nt, Homo sapiens
uggccuggcugaucuccuu

SEQ ID NO: 97231 - RNA, 19 nt, Homo sapiens
gcuaugcccucugcaacag

SEQ ID NO: 97232 - RNA, 19 nt, Homo sapiens
agagagugguccuagucaa

SEQ ID NO: 97233 - RNA, 19 nt, Homo sapiens
aaagagagugguccuaguc

SEQ ID NO: 97234 - RNA, 19 nt, Homo sapiens
ccaaguggucuacaagagu

SEQ ID NO: 97235 - RNA, 19 nt, Homo sapiens
cugugcagaucucaucauu

SEQ ID NO: 97236 - RNA, 19 nt, Homo sapiens
uggaagagaaguuguacug

SEQ ID NO: 97237 - RNA, 19 nt, Homo sapiens
cugcuucucugccgaugga

SEQ ID NO: 97238 - RNA, 19 nt, Homo sapiens
caagagucaggguaaggaa

SEQ ID NO: 97239 - RNA, 19 nt, Homo sapiens
agauccaguuucucucuga

SEQ ID NO: 97240 - RNA, 19 nt, Homo sapiens
caacgaaaggccucaaucc

SEQ ID NO: 97241 - RNA, 19 nt, Homo sapiens
uaagccugaucaccauugu

SEQ ID NO: 97242 - RNA, 19 nt, Homo sapiens
cuccuggccuucaucauca

SEQ ID NO: 97243 - RNA, 19 nt, Homo sapiens
gccaucaaaugaccaaacg

SEQ ID NO: 97244 - RNA, 19 nt, Homo sapiens
aagagacugaggaaacuuu

SEQ ID NO: 97245 - RNA, 19 nt, Homo sapiens
ucuacaagagucaggguaa

SEQ ID NO: 97246 - RNA, 19 nt, Homo sapiens
ucaugaccauccucuacug

SEQ ID NO: 97247 - RNA, 19 nt, Homo sapiens
ugccauugcugccuucuac

SEQ ID NO: 97248 - RNA, 19 nt, Homo sapiens
caaugcaaccaccgucaau

SEQ ID NO: 97249 - RNA, 19 nt, Homo sapiens
ccuuuaagaugcugcuucu

SEQ ID NO: 97250 - RNA, 19 nt, Homo sapiens
ggcuauugguugugcuaug

SEQ ID NO: 97251 - RNA, 19 nt, Homo sapiens
cuacaagagucaggguaag

SEQ ID NO: 97252 - RNA, 19 nt, Homo sapiens
gaccguuacuuuuccauca

SEQ ID NO: 97253 - RNA, 19 nt, Homo sapiens
ugggaagucaucaccauug

SEQ ID NO: 97254 - RNA, 19 nt, Homo sapiens
uaaguuccgauugguggua

SEQ ID NO: 97255 - RNA, 19 nt, Homo sapiens
ugguugugcuaugucaaua

SEQ ID NO: 97256 - RNA, 19 nt, Homo sapiens
ucaugguccugguuucuac

SEQ ID NO: 97257 - RNA, 19 nt, Homo sapiens
cagaucucaucauuggaau

SEQ ID NO: 97258 - RNA, 19 nt, Homo sapiens
gaacagaacugcagcauga

SEQ ID NO: 97259 - RNA, 19 nt, Homo sapiens
gcacuuaucaaacguguua

SEQ ID NO: 97260 - RNA, 19 nt, Homo sapiens
ccaaagugcuccugcagua

SEQ ID NO: 97261 - RNA, 19 nt, Homo sapiens
uggcaaagcuauuuaaaga

SEQ ID NO: 97262 - RNA, 19 nt, Homo sapiens
uaacuggccugguauucua

SEQ ID NO: 97263 - RNA, 19 nt, Homo sapiens
gagcaucucugucuuacug

SEQ ID NO: 97264 - RNA, 19 nt, Homo sapiens
caaugcagauggugacuuu

SEQ ID NO: 97265 - RNA, 19 nt, Homo sapiens
gcaaagcuauuuaaagacu

SEQ ID NO: 97266 - RNA, 19 nt, Homo sapiens
ggacaucaccuaccacuuc

SEQ ID NO: 97267 - RNA, 19 nt, Homo sapiens
gauggugacuuugcuauug

SEQ ID NO: 97268 - RNA, 19 nt, Homo sapiens
gcccagaccuuguucucua

SEQ ID NO: 97269 - RNA, 19 nt, Homo sapiens
caauguggaugaaguaaau

SEQ ID NO: 97270 - RNA, 19 nt, Homo sapiens
gagugaacccucuuuagua

SEQ ID NO: 97271 - RNA, 19 nt, Homo sapiens
ggaaguacguugcaauggu

SEQ ID NO: 97272 - RNA, 19 nt, Homo sapiens
cauauugcuucucccuuua

SEQ ID NO: 97273 - RNA, 19 nt, Homo sapiens
ucauauugcuucucccuuu

SEQ ID NO: 97274 - RNA, 19 nt, Homo sapiens
gaccaggagucuaacaaug

SEQ ID NO: 97275 - RNA, 19 nt, Homo sapiens
cuucuuaacuggccuggua

SEQ ID NO: 97276 - RNA, 19 nt, Homo sapiens
gaggaagauuugucuacuu

SEQ ID NO: 97277 - RNA, 19 nt, Homo sapiens
gggagugggugaucaagga

SEQ ID NO: 97278 - RNA, 19 nt, Homo sapiens
agugaacccucuuuaguaa

SEQ ID NO: 97279 - RNA, 19 nt, Homo sapiens
gagaagggcaggagaggaa

SEQ ID NO: 97280 - RNA, 19 nt, Homo sapiens
cagcaaggaugagcagaaa

SEQ ID NO: 97281 - RNA, 19 nt, Homo sapiens
ugaauuaaaucagcaagga

SEQ ID NO: 97282 - RNA, 19 nt, Homo sapiens
uaaaucagaucgugacaac

SEQ ID NO: 97283 - RNA, 19 nt, Homo sapiens
guaaguuuauggccuugaa

SEQ ID NO: 97284 - RNA, 19 nt, Homo sapiens
gaaaagaccauccagagaa

SEQ ID NO: 97285 - RNA, 19 nt, Homo sapiens
gacacuaucccaaauauca

SEQ ID NO: 97286 - RNA, 19 nt, Homo sapiens
gcugugcccuugauuggaa

SEQ ID NO: 97287 - RNA, 19 nt, Homo sapiens
gaucaucgucacccacuuu

SEQ ID NO: 97288 - RNA, 19 nt, Homo sapiens
gcuuagcucugcccuggaa

SEQ ID NO: 97289 - RNA, 19 nt, Homo sapiens
gcaggucgacucauugaau

SEQ ID NO: 97290 - RNA, 19 nt, Homo sapiens
cagaagacauugauaucuc

SEQ ID NO: 97291 - RNA, 19 nt, Homo sapiens
cguguuauauuccauacuu

SEQ ID NO: 97292 - RNA, 19 nt, Homo sapiens
caggucgacucauugaauu

SEQ ID NO: 97293 - RNA, 19 nt, Homo sapiens
aaacagcaauggguggauu

SEQ ID NO: 97294 - RNA, 19 nt, Homo sapiens
gaagauuugucuacuugcu

SEQ ID NO: 97295 - RNA, 19 nt, Homo sapiens
aggaagauuugucuacuug

SEQ ID NO: 97296 - RNA, 19 nt, Homo sapiens
cagagaccaugaagucaga

SEQ ID NO: 97297 - RNA, 19 nt, Homo sapiens
gaaccuaccagagcagaga

SEQ ID NO: 97298 - RNA, 19 nt, Homo sapiens
ugauaucucugacauuucu

SEQ ID NO: 97299 - RNA, 19 nt, Homo sapiens
caaccaaugugcgucugaa

SEQ ID NO: 97300 - RNA, 19 nt, Homo sapiens
gggcaggagaggaagauuu

SEQ ID NO: 97301 - RNA, 19 nt, Homo sapiens
aaauucacauuccuucaga

SEQ ID NO: 97302 - RNA, 19 nt, Homo sapiens
uaucgacacuaucccaaau

SEQ ID NO: 97303 - RNA, 19 nt, Homo sapiens
gucauugccuccaucauca

SEQ ID NO: 97304 - RNA, 19 nt, Homo sapiens
gaaaauacaugcuguucac

SEQ ID NO: 97305 - RNA, 19 nt, Homo sapiens
ggucgacucauugaauuaa

SEQ ID NO: 97306 - RNA, 19 nt, Homo sapiens
ggaagcacuccgugaccua

SEQ ID NO: 97307 - RNA, 19 nt, Homo sapiens
ggagucuucaugcuuguuu

SEQ ID NO: 97308 - RNA, 19 nt, Homo sapiens
cagaccuuguucucuauaa

SEQ ID NO: 97309 - RNA, 19 nt, Homo sapiens
guuugcaggucgacucauu

SEQ ID NO: 97310 - RNA, 19 nt, Homo sapiens
ccacuuucccuuugaugaa

SEQ ID NO: 97311 - RNA, 19 nt, Homo sapiens
ggcaggagaggaagauuug

SEQ ID NO: 97312 - RNA, 19 nt, Homo sapiens
gcagauggugacuuugcua

SEQ ID NO: 97313 - RNA, 19 nt, Homo sapiens
ucacccacuuucccuuuga

SEQ ID NO: 97314 - RNA, 19 nt, Homo sapiens
ggacaccuccagccaucuu

SEQ ID NO: 97315 - RNA, 19 nt, Homo sapiens
gagaggaagauuugucuac

SEQ ID NO: 97316 - RNA, 19 nt, Homo sapiens
ucgacacuaucccaaauau

SEQ ID NO: 97317 - RNA, 19 nt, Homo sapiens
gcucuucuccuucuuaacu

SEQ ID NO: 97318 - RNA, 19 nt, Homo sapiens
cuccugcucuuuagccuuu

SEQ ID NO: 97319 - RNA, 19 nt, Homo sapiens
agcaauggguggauuacaa

SEQ ID NO: 97320 - RNA, 19 nt, Homo sapiens
ccaaugugcgucugaaaca

SEQ ID NO: 97321 - RNA, 19 nt, Homo sapiens
ccucuccuccugcucuuua

SEQ ID NO: 97322 - RNA, 19 nt, Homo sapiens
ucaaacguguuauauucca

SEQ ID NO: 97323 - RNA, 19 nt, Homo sapiens
ggagaggaagauuugucua

SEQ ID NO: 97324 - RNA, 19 nt, Homo sapiens
ccaucgagggcaucaagua

SEQ ID NO: 97325 - RNA, 19 nt, Homo sapiens
aaaagaccauccagagaaa

SEQ ID NO: 97326 - RNA, 19 nt, Homo sapiens
ugacuauggcggugugaaa

SEQ ID NO: 97327 - RNA, 19 nt, Homo sapiens
guucugcugucucccugaa

SEQ ID NO: 97328 - RNA, 19 nt, Homo sapiens
ucacugucaucgucaucaa

SEQ ID NO: 97329 - RNA, 19 nt, Homo sapiens
uauucuaccugcccacaga

SEQ ID NO: 97330 - RNA, 19 nt, Homo sapiens
gaagcacuccgugaccuau

SEQ ID NO: 97331 - RNA, 19 nt, Homo sapiens
gaauuaaaucagcaaggau

SEQ ID NO: 97332 - RNA, 19 nt, Homo sapiens
agaagacauugauaucucu

SEQ ID NO: 97333 - RNA, 19 nt, Homo sapiens
ccagugcugugcccuugau

SEQ ID NO: 97334 - RNA, 19 nt, Homo sapiens
uuauggccuugaaguguuu

SEQ ID NO: 97335 - RNA, 19 nt, Homo sapiens
uuuauggccuugaaguguu

SEQ ID NO: 97336 - RNA, 19 nt, Homo sapiens
uggaugaaguaaaucagau

SEQ ID NO: 97337 - RNA, 19 nt, Homo sapiens
ucugagcaucucugucuua

SEQ ID NO: 97338 - RNA, 19 nt, Homo sapiens
gguggcaaagcuauuuaaa

SEQ ID NO: 97339 - RNA, 19 nt, Homo sapiens
ggaauccagaugacuaugg

SEQ ID NO: 97340 - RNA, 19 nt, Homo sapiens
gcuccacucgcacuuauca

SEQ ID NO: 97341 - RNA, 19 nt, Homo sapiens
gaagggcaggagaggaaga

SEQ ID NO: 97342 - RNA, 19 nt, Homo sapiens
guccugggcuccgaacaug

SEQ ID NO: 97343 - RNA, 19 nt, Homo sapiens
ucgcagagaccaugaaguc

SEQ ID NO: 97344 - RNA, 19 nt, Homo sapiens
gcaaggaugagcagaaaau

SEQ ID NO: 97345 - RNA, 19 nt, Homo sapiens
gcucugucguggccaucaa

SEQ ID NO: 97346 - RNA, 19 nt, Homo sapiens
uuuaaaagcuacugugaga

SEQ ID NO: 97347 - RNA, 19 nt, Homo sapiens
ucacauuccuucagaaaag

SEQ ID NO: 97348 - RNA, 19 nt, Homo sapiens
gcaauggguggauuacaac

SEQ ID NO: 97349 - RNA, 19 nt, Homo sapiens
acauugauaucucugacau

SEQ ID NO: 97350 - RNA, 19 nt, Homo sapiens
gaucgugacaaccaaugug

SEQ ID NO: 97351 - RNA, 19 nt, Homo sapiens
ucaauguggaugaaguaaa

SEQ ID NO: 97352 - RNA, 19 nt, Homo sapiens
guaaaucagaucgugacaa

SEQ ID NO: 97353 - RNA, 19 nt, Homo sapiens
ggugauggaccacauacuc

SEQ ID NO: 97354 - RNA, 19 nt, Homo sapiens
cugcucuucuccuucuuaa

SEQ ID NO: 97355 - RNA, 19 nt, Homo sapiens
agccagaccugagcaacuu

SEQ ID NO: 97356 - RNA, 19 nt, Homo sapiens
gucgacucauugaauuaaa

SEQ ID NO: 97357 - RNA, 19 nt, Homo sapiens
cgucauugccuccaucauc

SEQ ID NO: 97358 - RNA, 19 nt, Homo sapiens
ccaaaugccucucauguaa

SEQ ID NO: 97359 - RNA, 19 nt, Homo sapiens
ugacugagcucuauucugu

SEQ ID NO: 97360 - RNA, 19 nt, Homo sapiens
gagaagaaccaaaugauga

SEQ ID NO: 97361 - RNA, 19 nt, Homo sapiens
gaagggcuuugaacaaugu

SEQ ID NO: 97362 - RNA, 19 nt, Homo sapiens
ggaaguauguugccauggu

SEQ ID NO: 97363 - RNA, 19 nt, Homo sapiens
gcagaauccucacagaauc

SEQ ID NO: 97364 - RNA, 19 nt, Homo sapiens
ggaagggcuuugaacaaug

SEQ ID NO: 97365 - RNA, 19 nt, Homo sapiens
ucacugugcuggucuucua

SEQ ID NO: 97366 - RNA, 19 nt, Homo sapiens
gcagggugcugagcuguau

SEQ ID NO: 97367 - RNA, 19 nt, Homo sapiens
ggugaggucucucuaaguc

SEQ ID NO: 97368 - RNA, 19 nt, Homo sapiens
gaugagaagaaccaaauga

SEQ ID NO: 97369 - RNA, 19 nt, Homo sapiens
ugaagugacugagcucuau

SEQ ID NO: 97370 - RNA, 19 nt, Homo sapiens
gaccaaggcccaccucuuc

SEQ ID NO: 97371 - RNA, 19 nt, Homo sapiens
gaaggaggacuggaaguau

SEQ ID NO: 97372 - RNA, 19 nt, Homo sapiens
gccaaaugccucucaugua

SEQ ID NO: 97373 - RNA, 19 nt, Homo sapiens
gaaggugugcacuacauug

SEQ ID NO: 97374 - RNA, 19 nt, Homo sapiens
gaagaucacgcugugcauu

SEQ ID NO: 97375 - RNA, 19 nt, Homo sapiens
ccuaaacccucacucuuca

SEQ ID NO: 97376 - RNA, 19 nt, Homo sapiens
ggaguggagcgacuacaaa

SEQ ID NO: 97377 - RNA, 19 nt, Homo sapiens
ucaaugaccuguuuucuuc

SEQ ID NO: 97378 - RNA, 19 nt, Homo sapiens
agggauggaugguuggaua

SEQ ID NO: 97379 - RNA, 19 nt, Homo sapiens
ucgcucagcucaucgaugu

SEQ ID NO: 97380 - RNA, 19 nt, Homo sapiens
uggaagggcuuugaacaau

SEQ ID NO: 97381 - RNA, 19 nt, Homo sapiens
ccuccaggcuucuccuuga

SEQ ID NO: 97382 - RNA, 19 nt, Homo sapiens
ugaaggaggacuggaagua

SEQ ID NO: 97383 - RNA, 19 nt, Homo sapiens
gaggacagaugggcaugug

SEQ ID NO: 97384 - RNA, 19 nt, Homo sapiens
gcaucgacgucaccuucuu

SEQ ID NO: 97385 - RNA, 19 nt, Homo sapiens
acagguggcugggcuauuc

SEQ ID NO: 97386 - RNA, 19 nt, Homo sapiens
cuucagacguggugauugu

SEQ ID NO: 97387 - RNA, 19 nt, Homo sapiens
gaccugaccuccugaugcu

SEQ ID NO: 97388 - RNA, 19 nt, Homo sapiens
ccaccaacgucuggcuaaa

SEQ ID NO: 97389 - RNA, 19 nt, Homo sapiens
ggaaggugugcacuacauu

SEQ ID NO: 97390 - RNA, 19 nt, Homo sapiens
gggccaggcuuggguuuca

SEQ ID NO: 97391 - RNA, 19 nt, Homo sapiens
caggugaggucucucuaag

SEQ ID NO: 97392 - RNA, 19 nt, Homo sapiens
aaggaggacuggaaguaug

SEQ ID NO: 97393 - RNA, 19 nt, Homo sapiens
gaagccaaaugccucucau

SEQ ID NO: 97394 - RNA, 19 nt, Homo sapiens
uaccugcuguucaccauga

SEQ ID NO: 97395 - RNA, 19 nt, Homo sapiens
gcgaguaccugcuguucac

SEQ ID NO: 97396 - RNA, 19 nt, Homo sapiens
cagcagaauccucacagaa

SEQ ID NO: 97397 - RNA, 19 nt, Homo sapiens
cugguucucugcauccuuu

SEQ ID NO: 97398 - RNA, 19 nt, Homo sapiens
gaagugacugagcucuauu

SEQ ID NO: 97399 - RNA, 19 nt, Homo sapiens
gcaccuacaacagcaagaa

SEQ ID NO: 97400 - RNA, 19 nt, Homo sapiens
aaaugccucucauguaagu

SEQ ID NO: 97401 - RNA, 19 nt, Homo sapiens
ugagaagaaccaaaugaug

SEQ ID NO: 97402 - RNA, 19 nt, Homo sapiens
ccagcagaauccucacaga

SEQ ID NO: 97403 - RNA, 19 nt, Homo sapiens
ggagguacaggcagaucuu

SEQ ID NO: 97404 - RNA, 19 nt, Homo sapiens
cccgguggcuucugaugaa

SEQ ID NO: 97405 - RNA, 19 nt, Homo sapiens
ugacgucauuccucuccuu

SEQ ID NO: 97406 - RNA, 19 nt, Homo sapiens
guugaaguuuggagucugu

SEQ ID NO: 97407 - RNA, 19 nt, Homo sapiens
gcagaaggcacuggaaggu

SEQ ID NO: 97408 - RNA, 19 nt, Homo sapiens
ggcaacaucacaucucuca

SEQ ID NO: 97409 - RNA, 19 nt, Homo sapiens
guccaucgcucagcucauc

SEQ ID NO: 97410 - RNA, 19 nt, Homo sapiens
ccaggugaggucucucuaa

SEQ ID NO: 97411 - RNA, 19 nt, Homo sapiens
guggaagggcuuugaacaa

SEQ ID NO: 97412 - RNA, 19 nt, Homo sapiens
gaucuuccucuggcuguuu

SEQ ID NO: 97413 - RNA, 19 nt, Homo sapiens
guaccugccacucuauuuc

SEQ ID NO: 97414 - RNA, 19 nt, Homo sapiens
caugaaaugaagugacuga

SEQ ID NO: 97415 - RNA, 19 nt, Homo sapiens
ggaguaauaagggcucuuc

SEQ ID NO: 97416 - RNA, 19 nt, Homo sapiens
ccuacaacagcaagaagua

SEQ ID NO: 97417 - RNA, 19 nt, Homo sapiens
cuguggaccugaaggacua

SEQ ID NO: 97418 - RNA, 19 nt, Homo sapiens
gguuucaccugcagaaucg

SEQ ID NO: 97419 - RNA, 19 nt, Homo sapiens
aagaucacgcugugcauuu

SEQ ID NO: 97420 - RNA, 19 nt, Homo sapiens
ggaagccaaaugccucuca

SEQ ID NO: 97421 - RNA, 19 nt, Homo sapiens
caucuggaagcacauuuga

SEQ ID NO: 97422 - RNA, 19 nt, Homo sapiens
gaccaucggccucuuucug

SEQ ID NO: 97423 - RNA, 19 nt, Homo sapiens
cgagugggccaucgucaau

SEQ ID NO: 97424 - RNA, 19 nt, Homo sapiens
cccagcagguggagaggaa

SEQ ID NO: 97425 - RNA, 19 nt, Homo sapiens
uggaaggugugcacuacau

SEQ ID NO: 97426 - RNA, 19 nt, Homo sapiens
gcucaucuccugccucacu

SEQ ID NO: 97427 - RNA, 19 nt, Homo sapiens
uuugucagcugcccagaau

SEQ ID NO: 97428 - RNA, 19 nt, Homo sapiens
agggugagcugcugcuauc

SEQ ID NO: 97429 - RNA, 19 nt, Homo sapiens
gcuccuggacuuaugacaa

SEQ ID NO: 97430 - RNA, 19 nt, Homo sapiens
gauguggaagggcuuugaa

SEQ ID NO: 97431 - RNA, 19 nt, Homo sapiens
gcugggcuauuccauccau

SEQ ID NO: 97432 - RNA, 19 nt, Homo sapiens
gagggugagcugcugcuau

SEQ ID NO: 97433 - RNA, 19 nt, Homo sapiens
ggaugagaagaaccaaaug

SEQ ID NO: 97434 - RNA, 19 nt, Homo sapiens
gcucuucaaacaccucuuc

SEQ ID NO: 97435 - RNA, 19 nt, Homo sapiens
ggauguggaagggcuuuga

SEQ ID NO: 97436 - RNA, 19 nt, Homo sapiens
ggucaucgacaggaucuuc

SEQ ID NO: 97437 - RNA, 19 nt, Homo sapiens
caccuacgccuucgucauc

SEQ ID NO: 97438 - RNA, 19 nt, Homo sapiens
caaugcagauggggaguuu

SEQ ID NO: 97439 - RNA, 19 nt, Homo sapiens
gcuggaaccccgcugauuu

SEQ ID NO: 97440 - RNA, 19 nt, Homo sapiens
uggaugagaagaaccaaau

SEQ ID NO: 97441 - RNA, 19 nt, Homo sapiens
uuuggagucuguccgaguu

SEQ ID NO: 97442 - RNA, 19 nt, Homo sapiens
uagcuggaaugaucugacu

SEQ ID NO: 97443 - RNA, 19 nt, Homo sapiens
agaucgaccuggagcagau

SEQ ID NO: 97444 - RNA, 19 nt, Homo sapiens
acuacaaacugcgcuggaa

SEQ ID NO: 97445 - RNA, 19 nt, Homo sapiens
gcuucuccuugacgucauu

SEQ ID NO: 97446 - RNA, 19 nt, Homo sapiens
caaagugccagggagaaca

SEQ ID NO: 97447 - RNA, 19 nt, Homo sapiens
guuuagauuuggagaugag

SEQ ID NO: 97448 - RNA, 19 nt, Homo sapiens
ugccugggcuguccucagu

SEQ ID NO: 97449 - RNA, 19 nt, Homo sapiens
guggagcgacuacaaacug

SEQ ID NO: 97450 - RNA, 19 nt, Homo sapiens
caaaugccucucauguaag

SEQ ID NO: 97451 - RNA, 19 nt, Homo sapiens
uccuuucaaugaccuguuu

SEQ ID NO: 97452 - RNA, 19 nt, Homo sapiens
gugcagcaggcaaacaaga

SEQ ID NO: 97453 - RNA, 19 nt, Homo sapiens
gcgugcagcaggcaaacaa

SEQ ID NO: 97454 - RNA, 19 nt, Homo sapiens
gcgagugggccaucgucaa

SEQ ID NO: 97455 - RNA, 19 nt, Homo sapiens
guuugaccaugaaaugaag

SEQ ID NO: 97456 - RNA, 19 nt, Homo sapiens
agaucacgcugugcauuuc

SEQ ID NO: 97457 - RNA, 19 nt, Homo sapiens
aggaccggcucuucaaaca

SEQ ID NO: 97458 - RNA, 19 nt, Homo sapiens
gggaauagguuucaacaua

SEQ ID NO: 97459 - RNA, 19 nt, Homo sapiens
ccaaagagauucaagauga

SEQ ID NO: 97460 - RNA, 19 nt, Homo sapiens
gagaaaucaugccuaguua

SEQ ID NO: 97461 - RNA, 19 nt, Homo sapiens
uaaacuggguggauuauaa

SEQ ID NO: 97462 - RNA, 19 nt, Homo sapiens
ggaauagguuucaacauau

SEQ ID NO: 97463 - RNA, 19 nt, Homo sapiens
ugacauaccuugcuucuuc

SEQ ID NO: 97464 - RNA, 19 nt, Homo sapiens
gaacguacuuucuguuauc

SEQ ID NO: 97465 - RNA, 19 nt, Homo sapiens
ggauaaauauguguuggua

SEQ ID NO: 97466 - RNA, 19 nt, Homo sapiens
gaagaugcauaagcacuaa

SEQ ID NO: 97467 - RNA, 19 nt, Homo sapiens
gaaaucaugccuaguuauu

SEQ ID NO: 97468 - RNA, 19 nt, Homo sapiens
guaaagagaugucaaaaug

SEQ ID NO: 97469 - RNA, 19 nt, Homo sapiens
ggaggcugcuuccuaguaa

SEQ ID NO: 97470 - RNA, 19 nt, Homo sapiens
gaagguggaugaaguaaac

SEQ ID NO: 97471 - RNA, 19 nt, Homo sapiens
uguaggaucuuuagcagua

SEQ ID NO: 97472 - RNA, 19 nt, Homo sapiens
gagagagacuguuugaauc

SEQ ID NO: 97473 - RNA, 19 nt, Homo sapiens
ugagaaacauugcuuuaga

SEQ ID NO: 97474 - RNA, 19 nt, Homo sapiens
gaauagguuucaacauaug

SEQ ID NO: 97475 - RNA, 19 nt, Homo sapiens
aaucuugucucacuaguuu

SEQ ID NO: 97476 - RNA, 19 nt, Homo sapiens
cuacagaucucccaguaau

SEQ ID NO: 97477 - RNA, 19 nt, Homo sapiens
gcauuucgagguuuacuua

SEQ ID NO: 97478 - RNA, 19 nt, Homo sapiens
guacuacacuucugaaacu

SEQ ID NO: 97479 - RNA, 19 nt, Homo sapiens
ggaaguauguugccauggu

SEQ ID NO: 97480 - RNA, 19 nt, Homo sapiens
caaagaagccauccaaagu

SEQ ID NO: 97481 - RNA, 19 nt, Homo sapiens
cgacaagaccaaagccuua

SEQ ID NO: 97482 - RNA, 19 nt, Homo sapiens
gaacauuuaacuagccuuu

SEQ ID NO: 97483 - RNA, 19 nt, Homo sapiens
ccaugaaccucaaggacua

SEQ ID NO: 97484 - RNA, 19 nt, Homo sapiens
gcuauggaauauacaugua

SEQ ID NO: 97485 - RNA, 19 nt, Homo sapiens
ucucaaaucugaauugcuu

SEQ ID NO: 97486 - RNA, 19 nt, Homo sapiens
cuacuucucuugcauacuu

SEQ ID NO: 97487 - RNA, 19 nt, Homo sapiens
gcaugaaccuuuagaacag

SEQ ID NO: 97488 - RNA, 19 nt, Homo sapiens
cauaaucucuuugaagguu

SEQ ID NO: 97489 - RNA, 19 nt, Homo sapiens
ucacugugcucgucuucua

SEQ ID NO: 97490 - RNA, 19 nt, Homo sapiens
gaccaaagccuuacucaag

SEQ ID NO: 97491 - RNA, 19 nt, Homo sapiens
caaagugucaaguauauug

SEQ ID NO: 97492 - RNA, 19 nt, Homo sapiens
gccgagcucucaaaucuga

SEQ ID NO: 97493 - RNA, 19 nt, Homo sapiens
cuacacuucugaaacuuaa

SEQ ID NO: 97494 - RNA, 19 nt, Homo sapiens
gaccacagcaugaaccuuu

SEQ ID NO: 97495 - RNA, 19 nt, Homo sapiens
ggaagaugcauaagcacua

SEQ ID NO: 97496 - RNA, 19 nt, Homo sapiens
ucagagagcuucaacuacu

SEQ ID NO: 97497 - RNA, 19 nt, Homo sapiens
caucguuacccauuucuua

SEQ ID NO: 97498 - RNA, 19 nt, Homo sapiens
gcuaugcuauggaauauac

SEQ ID NO: 97499 - RNA, 19 nt, Homo sapiens
cauccaaagugucaaguau

SEQ ID NO: 97500 - RNA, 19 nt, Homo sapiens
ucaagcaaaucuggaauga

SEQ ID NO: 97501 - RNA, 19 nt, Homo sapiens
gccuaguuauucauuguua

SEQ ID NO: 97502 - RNA, 19 nt, Homo sapiens
ugagaaaucaugccuaguu

SEQ ID NO: 97503 - RNA, 19 nt, Homo sapiens
caagaugauuggaaguaug

SEQ ID NO: 97504 - RNA, 19 nt, Homo sapiens
gagcggcuguuugaagauu

SEQ ID NO: 97505 - RNA, 19 nt, Homo sapiens
ucaaggcaccagcaaauuu

SEQ ID NO: 97506 - RNA, 19 nt, Homo sapiens
caacuacuucucuugcaua

SEQ ID NO: 97507 - RNA, 19 nt, Homo sapiens
caaagagauucaagaugau

SEQ ID NO: 97508 - RNA, 19 nt, Homo sapiens
gugccgagcucucaaaucu

SEQ ID NO: 97509 - RNA, 19 nt, Homo sapiens
gacagaugauucacagaga

SEQ ID NO: 97510 - RNA, 19 nt, Homo sapiens
gaucaucaccacugacaga

SEQ ID NO: 97511 - RNA, 19 nt, Homo sapiens
ccaaugacauaccuugcuu

SEQ ID NO: 97512 - RNA, 19 nt, Homo sapiens
gaucggcucuuccaugaac

SEQ ID NO: 97513 - RNA, 19 nt, Homo sapiens
gcacuaaccccauucauga

SEQ ID NO: 97514 - RNA, 19 nt, Homo sapiens
ccacuuaucuuggaaucau

SEQ ID NO: 97515 - RNA, 19 nt, Homo sapiens
gugcuaaccucacgagaag

SEQ ID NO: 97516 - RNA, 19 nt, Homo sapiens
cagacauugugcuguauaa

SEQ ID NO: 97517 - RNA, 19 nt, Homo sapiens
gagaaacauugcuuuagac

SEQ ID NO: 97518 - RNA, 19 nt, Homo sapiens
guugagaaacauugcuuua

SEQ ID NO: 97519 - RNA, 19 nt, Homo sapiens
aaucaugccuaguuauuca

SEQ ID NO: 97520 - RNA, 19 nt, Homo sapiens
cagggaagaugcauaagca

SEQ ID NO: 97521 - RNA, 19 nt, Homo sapiens
aaaugaagccaaagagauu

SEQ ID NO: 97522 - RNA, 19 nt, Homo sapiens
ccucaugggugaagacugu

SEQ ID NO: 97523 - RNA, 19 nt, Homo sapiens
acuacaagcugaaguggaa

SEQ ID NO: 97524 - RNA, 19 nt, Homo sapiens
aagcaaaucuggaaugacu

SEQ ID NO: 97525 - RNA, 19 nt, Homo sapiens
gcugagcaccgucuauuug

SEQ ID NO: 97526 - RNA, 19 nt, Homo sapiens
gagaguaccuccuguucac

SEQ ID NO: 97527 - RNA, 19 nt, Homo sapiens
ccauaaacuggguggauua

SEQ ID NO: 97528 - RNA, 19 nt, Homo sapiens
augcauuucucguucuuua

SEQ ID NO: 97529 - RNA, 19 nt, Homo sapiens
uccaaagugucaaguauau

SEQ ID NO: 97530 - RNA, 19 nt, Homo sapiens
ugaccuacuucccguuuga

SEQ ID NO: 97531 - RNA, 19 nt, Homo sapiens
gacaaucacgcugggaaua

SEQ ID NO: 97532 - RNA, 19 nt, Homo sapiens
ggucaaggcaccagcaaau

SEQ ID NO: 97533 - RNA, 19 nt, Homo sapiens
acagaucucccaguaauuu

SEQ ID NO: 97534 - RNA, 19 nt, Homo sapiens
cacuacagaucucccagua

SEQ ID NO: 97535 - RNA, 19 nt, Homo sapiens
gaaaagucauucaguuauc

SEQ ID NO: 97536 - RNA, 19 nt, Homo sapiens
gaaggugacccugugcauu

SEQ ID NO: 97537 - RNA, 19 nt, Homo sapiens
acaaacacgacaucaagua

SEQ ID NO: 97538 - RNA, 19 nt, Homo sapiens
gagagacuguuugaaucuu

SEQ ID NO: 97539 - RNA, 19 nt, Homo sapiens
agagagagacuguuugaau

SEQ ID NO: 97540 - RNA, 19 nt, Homo sapiens
caaggcaccagcaaauuug

SEQ ID NO: 97541 - RNA, 19 nt, Homo sapiens
gagaucauccggccuguag

SEQ ID NO: 97542 - RNA, 19 nt, Homo sapiens
ugauuaguaugcuaugcua

SEQ ID NO: 97543 - RNA, 19 nt, Homo sapiens
ucaagaugauuggaaguau

SEQ ID NO: 97544 - RNA, 19 nt, Homo sapiens
aaagggcuaugccuccauu

SEQ ID NO: 97545 - RNA, 19 nt, Homo sapiens
ggccagggaagaugcauaa

SEQ ID NO: 97546 - RNA, 19 nt, Homo sapiens
ggugaagguggaugaagua

SEQ ID NO: 97547 - RNA, 19 nt, Homo sapiens
cgagugggccaucaucaaa

SEQ ID NO: 97548 - RNA, 19 nt, Homo sapiens
gaagccauccaaaguguca

SEQ ID NO: 97549 - RNA, 19 nt, Homo sapiens
cugaucggcucuuccauga

SEQ ID NO: 97550 - RNA, 19 nt, Homo sapiens
uaccaaaacuguaccauga

SEQ ID NO: 97551 - RNA, 19 nt, Homo sapiens
gaaacauugcuuuagacaa

SEQ ID NO: 97552 - RNA, 19 nt, Homo sapiens
gcaguacccuagccucaac

SEQ ID NO: 97553 - RNA, 19 nt, Homo sapiens
ggaaugacuacaagcugaa

SEQ ID NO: 97554 - RNA, 19 nt, Homo sapiens
cauaagcacuaagcugugu

SEQ ID NO: 97555 - RNA, 19 nt, Homo sapiens
aagaagccauccaaagugu

SEQ ID NO: 97556 - RNA, 19 nt, Homo sapiens
ucaaagaagccauccaaag

SEQ ID NO: 97557 - RNA, 19 nt, Homo sapiens
gguauccugugcauuguag

SEQ ID NO: 97558 - RNA, 19 nt, Homo sapiens
guacuucuguguugugauu

SEQ ID NO: 97559 - RNA, 19 nt, Homo sapiens
gagaagaaccagaugauga

SEQ ID NO: 97560 - RNA, 19 nt, Homo sapiens
gagagcagaaugaauaauu

SEQ ID NO: 97561 - RNA, 19 nt, Homo sapiens
ggauagagacgcagauuuc

SEQ ID NO: 97562 - RNA, 19 nt, Homo sapiens
ccugagagcagaaugaaua

SEQ ID NO: 97563 - RNA, 19 nt, Homo sapiens
ggaaguacguggccauggu

SEQ ID NO: 97564 - RNA, 19 nt, Homo sapiens
ggacccagcugacuaugag

SEQ ID NO: 97565 - RNA, 19 nt, Homo sapiens
gaacugcaccaugaaauuc

SEQ ID NO: 97566 - RNA, 19 nt, Homo sapiens
gcagauuucagauguaaga

SEQ ID NO: 97567 - RNA, 19 nt, Homo sapiens
agacgcagauuucagaugu

SEQ ID NO: 97568 - RNA, 19 nt, Homo sapiens
gaccaaggcccaccuguuc

SEQ ID NO: 97569 - RNA, 19 nt, Homo sapiens
gagggaggccugaaauguu

SEQ ID NO: 97570 - RNA, 19 nt, Homo sapiens
gagcagaaugaauaauuga

SEQ ID NO: 97571 - RNA, 19 nt, Homo sapiens
agggaggccugaaauguuu

SEQ ID NO: 97572 - RNA, 19 nt, Homo sapiens
guccaucgcucagcucauu

SEQ ID NO: 97573 - RNA, 19 nt, Homo sapiens
gcccacaccugccucugaa

SEQ ID NO: 97574 - RNA, 19 nt, Homo sapiens
agagcagaaugaauaauug

SEQ ID NO: 97575 - RNA, 19 nt, Homo sapiens
ucaccgugcuggucuucua

SEQ ID NO: 97576 - RNA, 19 nt, Homo sapiens
acacagacuucucggugaa

SEQ ID NO: 97577 - RNA, 19 nt, Homo sapiens
gauccacauugcauaagug

SEQ ID NO: 97578 - RNA, 19 nt, Homo sapiens
gaugagaagaaccagauga

SEQ ID NO: 97579 - RNA, 19 nt, Homo sapiens
ugaaggaggacuggaagua

SEQ ID NO: 97580 - RNA, 19 nt, Homo sapiens
gcaucgacgucaccuucuu

SEQ ID NO: 97581 - RNA, 19 nt, Homo sapiens
gcaccuacaacaccaggaa

SEQ ID NO: 97582 - RNA, 19 nt, Homo sapiens
acgcagauuucagauguaa

SEQ ID NO: 97583 - RNA, 19 nt, Homo sapiens
gcucuggguucgggaagaa

SEQ ID NO: 97584 - RNA, 19 nt, Homo sapiens
gaugaugaccacgaacgua

SEQ ID NO: 97585 - RNA, 19 nt, Homo sapiens
gaauaauugagguuaggaa

SEQ ID NO: 97586 - RNA, 19 nt, Homo sapiens
gggauagagacgcagauuu

SEQ ID NO: 97587 - RNA, 19 nt, Homo sapiens
gaagcccgauccacauugc

SEQ ID NO: 97588 - RNA, 19 nt, Homo sapiens
gacgcagauuucagaugua

SEQ ID NO: 97589 - RNA, 19 nt, Homo sapiens
uaccugcuguucaccauga

SEQ ID NO: 97590 - RNA, 19 nt, Homo sapiens
gcgaguaccugcuguucac

SEQ ID NO: 97591 - RNA, 19 nt, Homo sapiens
uagagacgcagauuucaga

SEQ ID NO: 97592 - RNA, 19 nt, Homo sapiens
gagcauccaguacuguguu

SEQ ID NO: 97593 - RNA, 19 nt, Homo sapiens
gaaggaggacuggaaguac

SEQ ID NO: 97594 - RNA, 19 nt, Homo sapiens
gcuguaagacggccuugga

SEQ ID NO: 97595 - RNA, 19 nt, Homo sapiens
ccacgaacguaugggugaa

SEQ ID NO: 97596 - RNA, 19 nt, Homo sapiens
uaagaagcccgauccacau

SEQ ID NO: 97597 - RNA, 19 nt, Homo sapiens
gauagagacgcagauuuca

SEQ ID NO: 97598 - RNA, 19 nt, Homo sapiens
cgagugcugugccgagauc

SEQ ID NO: 97599 - RNA, 19 nt, Homo sapiens
agaacugcaccaugaaauu

SEQ ID NO: 97600 - RNA, 19 nt, Homo sapiens
ggagggcguccaguacauu

SEQ ID NO: 97601 - RNA, 19 nt, Homo sapiens
ggucucggagcauccagua

SEQ ID NO: 97602 - RNA, 19 nt, Homo sapiens
ucgaguccaugcauaagau

SEQ ID NO: 97603 - RNA, 19 nt, Homo sapiens
uggcuggcaugaucuagga

SEQ ID NO: 97604 - RNA, 19 nt, Homo sapiens
ucaucgaguccaugcauaa

SEQ ID NO: 97605 - RNA, 19 nt, Homo sapiens
gcucaucaccgagaucauc

SEQ ID NO: 97606 - RNA, 19 nt, Homo sapiens
gaagcuggcaggagacacu

SEQ ID NO: 97607 - RNA, 19 nt, Homo sapiens
ggagugggugggacacaga

SEQ ID NO: 97608 - RNA, 19 nt, Homo sapiens
ggaguggcacgacuacaag

SEQ ID NO: 97609 - RNA, 19 nt, Homo sapiens
ucacuggucaucccacuca

SEQ ID NO: 97610 - RNA, 19 nt, Homo sapiens
aggcccaccuguuccauga

SEQ ID NO: 97611 - RNA, 19 nt, Homo sapiens
cgauccacauugcauaagu

SEQ ID NO: 97612 - RNA, 19 nt, Homo sapiens
ugacguggaugagaagaac

SEQ ID NO: 97613 - RNA, 19 nt, Homo sapiens
ugagggaggccugaaaugu

SEQ ID NO: 97614 - RNA, 19 nt, Homo sapiens
gcuucucccuggacucugu

SEQ ID NO: 97615 - RNA, 19 nt, Homo sapiens
ggguacuucuguguuguga

SEQ ID NO: 97616 - RNA, 19 nt, Homo sapiens
gagggcguccaguacauug

SEQ ID NO: 97617 - RNA, 19 nt, Homo sapiens
ccacgccugcuccucauga

SEQ ID NO: 97618 - RNA, 19 nt, Homo sapiens
ugaccaaggcccaccuguu

SEQ ID NO: 97619 - RNA, 19 nt, Homo sapiens
gagacucaggcccacauug

SEQ ID NO: 97620 - RNA, 19 nt, Homo sapiens
ggugagggaggccugaaau

SEQ ID NO: 97621 - RNA, 19 nt, Homo sapiens
cagcugacuaugagaaugu

SEQ ID NO: 97622 - RNA, 19 nt, Homo sapiens
ccagcugacuaugagaaug

SEQ ID NO: 97623 - RNA, 19 nt, Homo sapiens
gacaucguccucuacaaca

SEQ ID NO: 97624 - RNA, 19 nt, Homo sapiens
ccugaaggccgaagacaca

SEQ ID NO: 97625 - RNA, 19 nt, Homo sapiens
agaucgaccuggugaacau

SEQ ID NO: 97626 - RNA, 19 nt, Homo sapiens
ggagacccugggagaguga

SEQ ID NO: 97627 - RNA, 19 nt, Homo sapiens
guacguggccauggucauc

SEQ ID NO: 97628 - RNA, 19 nt, Homo sapiens
gaaacucuucuccgguuac

SEQ ID NO: 97629 - RNA, 19 nt, Homo sapiens
gagacgcagauuucagaug

SEQ ID NO: 97630 - RNA, 19 nt, Homo sapiens
gcucaucgaguccaugcau

SEQ ID NO: 97631 - RNA, 19 nt, Homo sapiens
cagaacugcaccaugaaau

SEQ ID NO: 97632 - RNA, 19 nt, Homo sapiens
gcccgauccacauugcaua

SEQ ID NO: 97633 - RNA, 19 nt, Homo sapiens
ggagacucaggcccacauu

SEQ ID NO: 97634 - RNA, 19 nt, Homo sapiens
gggacccagcugacuauga

SEQ ID NO: 97635 - RNA, 19 nt, Homo sapiens
gaguguggcgagaagauca

SEQ ID NO: 97636 - RNA, 19 nt, Homo sapiens
ccuacaacaccaggaagua

SEQ ID NO: 97637 - RNA, 19 nt, Homo sapiens
aagaagcccgauccacauu

SEQ ID NO: 97638 - RNA, 19 nt, Homo sapiens
uggaccagcuggacuucug

SEQ ID NO: 97639 - RNA, 19 nt, Homo sapiens
gcuccuggaccuacgacaa

SEQ ID NO: 97640 - RNA, 19 nt, Homo sapiens
caaauuuuccuuccuguuc

SEQ ID NO: 97641 - RNA, 19 nt, Homo sapiens
caagacccgcagcaccaaa

SEQ ID NO: 97642 - RNA, 19 nt, Homo sapiens
caagaucgaccuggugaac

SEQ ID NO: 97643 - RNA, 19 nt, Homo sapiens
aaacucuucuccgguuaca

SEQ ID NO: 97644 - RNA, 19 nt, Homo sapiens
ggacugaaguauacauuua

SEQ ID NO: 97645 - RNA, 19 nt, Homo sapiens
gaagauaguuugcuuaagg

SEQ ID NO: 97646 - RNA, 19 nt, Homo sapiens
gagaguaucugguauuuac

SEQ ID NO: 97647 - RNA, 19 nt, Homo sapiens
guacuugucuucuaucuuc

SEQ ID NO: 97648 - RNA, 19 nt, Homo sapiens
caacacacaucaugaagga

SEQ ID NO: 97649 - RNA, 19 nt, Homo sapiens
gaagucauguagacaggua

SEQ ID NO: 97650 - RNA, 19 nt, Homo sapiens
guaugucacuuacucauuu

SEQ ID NO: 97651 - RNA, 19 nt, Homo sapiens
ggaccaagauguagacaag

SEQ ID NO: 97652 - RNA, 19 nt, Homo sapiens
uaccauagaugucacguuu

SEQ ID NO: 97653 - RNA, 19 nt, Homo sapiens
uaacuguacuugucuucua

SEQ ID NO: 97654 - RNA, 19 nt, Homo sapiens
aaacaggaauggauagaug

SEQ ID NO: 97655 - RNA, 19 nt, Homo sapiens
gauggcaccuauaaaauua

SEQ ID NO: 97656 - RNA, 19 nt, Homo sapiens
ccaagggacugaaguauac

SEQ ID NO: 97657 - RNA, 19 nt, Homo sapiens
gaucauaccaucaucuuca

SEQ ID NO: 97658 - RNA, 19 nt, Homo sapiens
gaagagaucauaccaucau

SEQ ID NO: 97659 - RNA, 19 nt, Homo sapiens
gauggaacccugaugacua

SEQ ID NO: 97660 - RNA, 19 nt, Homo sapiens
cgucuucgcuaucaacauu

SEQ ID NO: 97661 - RNA, 19 nt, Homo sapiens
ggacuccaccggcaaacua

SEQ ID NO: 97662 - RNA, 19 nt, Homo sapiens
aagcugcgcucgauucuau

SEQ ID NO: 97663 - RNA, 19 nt, Homo sapiens
caacagggagcaaaggaaa

SEQ ID NO: 97664 - RNA, 19 nt, Homo sapiens
ggauguuucuguggacuuu

SEQ ID NO: 97665 - RNA, 19 nt, Homo sapiens
ggaccaaaaucuucuagaa

SEQ ID NO: 97666 - RNA, 19 nt, Homo sapiens
agucauaccucuaauugga

SEQ ID NO: 97667 - RNA, 19 nt, Homo sapiens
ugaugacuaugguggaaua

SEQ ID NO: 97668 - RNA, 19 nt, Homo sapiens
cuucaguacuugugucuuu

SEQ ID NO: 97669 - RNA, 19 nt, Homo sapiens
ggauuuauuucaagacuac

SEQ ID NO: 97670 - RNA, 19 nt, Homo sapiens
uaucugaaccuucuucuau

SEQ ID NO: 97671 - RNA, 19 nt, Homo sapiens
gacagguacuucacucaga

SEQ ID NO: 97672 - RNA, 19 nt, Homo sapiens
gaaaugcaaauaagugaag

SEQ ID NO: 97673 - RNA, 19 nt, Homo sapiens
ucuauucgcuacauuacaa

SEQ ID NO: 97674 - RNA, 19 nt, Homo sapiens
guacuucacucagaaagag

SEQ ID NO: 97675 - RNA, 19 nt, Homo sapiens
aaacugcuuucgaugagaa

SEQ ID NO: 97676 - RNA, 19 nt, Homo sapiens
uaagauggaacccugauga

SEQ ID NO: 97677 - RNA, 19 nt, Homo sapiens
uaucugauggcaccuauaa

SEQ ID NO: 97678 - RNA, 19 nt, Homo sapiens
gauucuauucgcuacauua

SEQ ID NO: 97679 - RNA, 19 nt, Homo sapiens
gaaccuucuucuauugcaa

SEQ ID NO: 97680 - RNA, 19 nt, Homo sapiens
cgaaaacagucaucaggua

SEQ ID NO: 97681 - RNA, 19 nt, Homo sapiens
caacauucaucaucguucu

SEQ ID NO: 97682 - RNA, 19 nt, Homo sapiens
uggaacaccugaaugacaa

SEQ ID NO: 97683 - RNA, 19 nt, Homo sapiens
ggagaguaucugguauuua

SEQ ID NO: 97684 - RNA, 19 nt, Homo sapiens
aaagucauaccucuaauug

SEQ ID NO: 97685 - RNA, 19 nt, Homo sapiens
uaacagacuaaguugcuaa

SEQ ID NO: 97686 - RNA, 19 nt, Homo sapiens
gaaauucauagcccagguu

SEQ ID NO: 97687 - RNA, 19 nt, Homo sapiens
ccaaacugcuuucgaugag

SEQ ID NO: 97688 - RNA, 19 nt, Homo sapiens
cauuugaccuucagaacug

SEQ ID NO: 97689 - RNA, 19 nt, Homo sapiens
ggacuugcaauaucucaau

SEQ ID NO: 97690 - RNA, 19 nt, Homo sapiens
ggaaaugcaaauaagugaa

SEQ ID NO: 97691 - RNA, 19 nt, Homo sapiens
gaagauuggaaauucauag

SEQ ID NO: 97692 - RNA, 19 nt, Homo sapiens
caucaucguucuuccucaa

SEQ ID NO: 97693 - RNA, 19 nt, Homo sapiens
ucucugcacuucaguacuu

SEQ ID NO: 97694 - RNA, 19 nt, Homo sapiens
gaaagaggaaacugagagu

SEQ ID NO: 97695 - RNA, 19 nt, Homo sapiens
guaaccgucuucgcuauca

SEQ ID NO: 97696 - RNA, 19 nt, Homo sapiens
uggagaguaucugguauuu

SEQ ID NO: 97697 - RNA, 19 nt, Homo sapiens
gguauccguaugucacuua

SEQ ID NO: 97698 - RNA, 19 nt, Homo sapiens
guugaaacaggaauggaua

SEQ ID NO: 97699 - RNA, 19 nt, Homo sapiens
acacacaucaugaaggaaa

SEQ ID NO: 97700 - RNA, 19 nt, Homo sapiens
ucugaaccuucuucuauug

SEQ ID NO: 97701 - RNA, 19 nt, Homo sapiens
gaagggaccaguacgaaaa

SEQ ID NO: 97702 - RNA, 19 nt, Homo sapiens
aggaauggauagauguaaa

SEQ ID NO: 97703 - RNA, 19 nt, Homo sapiens
gugagguuguugaagauug

SEQ ID NO: 97704 - RNA, 19 nt, Homo sapiens
acagguacuucacucagaa

SEQ ID NO: 97705 - RNA, 19 nt, Homo sapiens
ucuucuaucuuccuucaaa

SEQ ID NO: 97706 - RNA, 19 nt, Homo sapiens
gcaacagggagcaaaggaa

SEQ ID NO: 97707 - RNA, 19 nt, Homo sapiens
ggacuuuucuuuucguuuc

SEQ ID NO: 97708 - RNA, 19 nt, Homo sapiens
auaaugccauggcgccuuu

SEQ ID NO: 97709 - RNA, 19 nt, Homo sapiens
gauaguuugcuuaaggauu

SEQ ID NO: 97710 - RNA, 19 nt, Homo sapiens
ggagaaugggagauuguga

SEQ ID NO: 97711 - RNA, 19 nt, Homo sapiens
caaaaguuccuguaccaua

SEQ ID NO: 97712 - RNA, 19 nt, Homo sapiens
aaacagucaucagguacaa

SEQ ID NO: 97713 - RNA, 19 nt, Homo sapiens
gaacccugaugacuauggu

SEQ ID NO: 97714 - RNA, 19 nt, Homo sapiens
uuacaacacacaucaugaa

SEQ ID NO: 97715 - RNA, 19 nt, Homo sapiens
gauguagacaagagagauu

SEQ ID NO: 97716 - RNA, 19 nt, Homo sapiens
gacuugcaauaucucaauu

SEQ ID NO: 97717 - RNA, 19 nt, Homo sapiens
ccaugaaauuugguucuug

SEQ ID NO: 97718 - RNA, 19 nt, Homo sapiens
ugacuaugguggaauaaaa

SEQ ID NO: 97719 - RNA, 19 nt, Homo sapiens
gaaacaggaauggauagau

SEQ ID NO: 97720 - RNA, 19 nt, Homo sapiens
acaaacgucugguugaaac

SEQ ID NO: 97721 - RNA, 19 nt, Homo sapiens
gggcaaauauauuaauacc

SEQ ID NO: 97722 - RNA, 19 nt, Homo sapiens
cccaagggacugaaguaua

SEQ ID NO: 97723 - RNA, 19 nt, Homo sapiens
gaggaaacugagaguggua

SEQ ID NO: 97724 - RNA, 19 nt, Homo sapiens
acaugaagauaguuugcuu

SEQ ID NO: 97725 - RNA, 19 nt, Homo sapiens
caugaagauaguuugcuua

SEQ ID NO: 97726 - RNA, 19 nt, Homo sapiens
gggacugaaguauacauuu

SEQ ID NO: 97727 - RNA, 19 nt, Homo sapiens
acaccugaaugacaaaaua

SEQ ID NO: 97728 - RNA, 19 nt, Homo sapiens
caaacugcuuucgaugaga

SEQ ID NO: 97729 - RNA, 19 nt, Homo sapiens
gcuaucaacauucaucauc

SEQ ID NO: 97730 - RNA, 19 nt, Homo sapiens
aaauuugguucuuggacuu

SEQ ID NO: 97731 - RNA, 19 nt, Homo sapiens
aagauaguuugcuuaagga

SEQ ID NO: 97732 - RNA, 19 nt, Homo sapiens
ucuagaggaccaagaugua

SEQ ID NO: 97733 - RNA, 19 nt, Homo sapiens
aggauuaucugaaccuucu

SEQ ID NO: 97734 - RNA, 19 nt, Homo sapiens
uguugaagauuggaaauuc

SEQ ID NO: 97735 - RNA, 19 nt, Homo sapiens
uccgugagguuguugaaga

SEQ ID NO: 97736 - RNA, 19 nt, Homo sapiens
ucaaaagucauaccucuaa

SEQ ID NO: 97737 - RNA, 19 nt, Homo sapiens
uaucucaauugguggaugu

SEQ ID NO: 97738 - RNA, 19 nt, Homo sapiens
ugacaacaaacgucugguu

SEQ ID NO: 97739 - RNA, 19 nt, Homo sapiens
ugaagggaccaguacgaaa

SEQ ID NO: 97740 - RNA, 19 nt, Homo sapiens
auggaacccugaugacuau

SEQ ID NO: 97741 - RNA, 19 nt, Homo sapiens
ucaagcgccugccucucuu

SEQ ID NO: 97742 - RNA, 19 nt, Homo sapiens
uaaugcagauggacguuuu

SEQ ID NO: 97743 - RNA, 19 nt, Homo sapiens
uauaucugauggcaccuau

SEQ ID NO: 97744 - RNA, 19 nt, Homo sapiens
acaaggagcuggucaagaa

SEQ ID NO: 97745 - RNA, 19 nt, Homo sapiens
gcaggacgcucuacuaugg

SEQ ID NO: 97746 - RNA, 19 nt, Homo sapiens
caaagacgguagagagaaa

SEQ ID NO: 97747 - RNA, 19 nt, Homo sapiens
cagaugggcugauagauau

SEQ ID NO: 97748 - RNA, 19 nt, Homo sapiens
ggacagaucacuauuuaca

SEQ ID NO: 97749 - RNA, 19 nt, Homo sapiens
agaggaagcuuuacaagga

SEQ ID NO: 97750 - RNA, 19 nt, Homo sapiens
aaacccagauugaagcuaa

SEQ ID NO: 97751 - RNA, 19 nt, Homo sapiens
cagacauucuucucuauaa

SEQ ID NO: 97752 - RNA, 19 nt, Homo sapiens
gcuuacgguuucuuuguua

SEQ ID NO: 97753 - RNA, 19 nt, Homo sapiens
ggagugaaagguucuauga

SEQ ID NO: 97754 - RNA, 19 nt, Homo sapiens
gcagauaucaguggcuaua

SEQ ID NO: 97755 - RNA, 19 nt, Homo sapiens
uuggacagaucacuauuua

SEQ ID NO: 97756 - RNA, 19 nt, Homo sapiens
aaaccagacucacuaaauc

SEQ ID NO: 97757 - RNA, 19 nt, Homo sapiens
gaugucggcucccaacuuc

SEQ ID NO: 97758 - RNA, 19 nt, Homo sapiens
ggugaagacuguucguuuc

SEQ ID NO: 97759 - RNA, 19 nt, Homo sapiens
gcacuuuguuucauauucu

SEQ ID NO: 97760 - RNA, 19 nt, Homo sapiens
cacuaaauccuuuccaaua

SEQ ID NO: 97761 - RNA, 19 nt, Homo sapiens
gaggagguccgcuacauug

SEQ ID NO: 97762 - RNA, 19 nt, Homo sapiens
guacaaacccagauugaag

SEQ ID NO: 97763 - RNA, 19 nt, Homo sapiens
gcucguggcugagaucaug

SEQ ID NO: 97764 - RNA, 19 nt, Homo sapiens
gcaagaggagugaaagguu

SEQ ID NO: 97765 - RNA, 19 nt, Homo sapiens
gaugagaagaaccaaguuu

SEQ ID NO: 97766 - RNA, 19 nt, Homo sapiens
aguagaaucucagcacuuu

SEQ ID NO: 97767 - RNA, 19 nt, Homo sapiens
ccaggcauauucaagaguu

SEQ ID NO: 97768 - RNA, 19 nt, Homo sapiens
cagacucacuaaauccuuu

SEQ ID NO: 97769 - RNA, 19 nt, Homo sapiens
aguggaaugugucagaaua

SEQ ID NO: 97770 - RNA, 19 nt, Homo sapiens
uaaaccagacucacuaaau

SEQ ID NO: 97771 - RNA, 19 nt, Homo sapiens
aaauaaaccagacucacua

SEQ ID NO: 97772 - RNA, 19 nt, Homo sapiens
ggacguggaugagaagaac

SEQ ID NO: 97773 - RNA, 19 nt, Homo sapiens
guagagagaaacagcuuga

SEQ ID NO: 97774 - RNA, 19 nt, Homo sapiens
ggaggagguccgcuacauu

SEQ ID NO: 97775 - RNA, 19 nt, Homo sapiens
gauaacagucuuacucucu

SEQ ID NO: 97776 - RNA, 19 nt, Homo sapiens
guacgcugguuucccuuug

SEQ ID NO: 97777 - RNA, 19 nt, Homo sapiens
ccagacauucuucucuaua

SEQ ID NO: 97778 - RNA, 19 nt, Homo sapiens
aaccagacauucuucucua

SEQ ID NO: 97779 - RNA, 19 nt, Homo sapiens
guagucauuuugcccauua

SEQ ID NO: 97780 - RNA, 19 nt, Homo sapiens
acagaucacuauuuacagu

SEQ ID NO: 97781 - RNA, 19 nt, Homo sapiens
gcaggaggcagauaucagu

SEQ ID NO: 97782 - RNA, 19 nt, Homo sapiens
gggugaagacuguucguuu

SEQ ID NO: 97783 - RNA, 19 nt, Homo sapiens
gaaucucagcacuuuguuu

SEQ ID NO: 97784 - RNA, 19 nt, Homo sapiens
cgccacaacuccaguguuc

SEQ ID NO: 97785 - RNA, 19 nt, Homo sapiens
ccaccgagacaguugguuu

SEQ ID NO: 97786 - RNA, 19 nt, Homo sapiens
gcaacgggaaccugcugua

SEQ ID NO: 97787 - RNA, 19 nt, Homo sapiens
agugaaagguucuaugagu

SEQ ID NO: 97788 - RNA, 19 nt, Homo sapiens
ggaccagagucauccuucu

SEQ ID NO: 97789 - RNA, 19 nt, Homo sapiens
gagaagaaccaaguuuuaa

SEQ ID NO: 97790 - RNA, 19 nt, Homo sapiens
uaccauugauagcccagua

SEQ ID NO: 97791 - RNA, 19 nt, Homo sapiens
ccagauggccagauuugga

SEQ ID NO: 97792 - RNA, 19 nt, Homo sapiens
cgguuucuuuguuacuuua

SEQ ID NO: 97793 - RNA, 19 nt, Homo sapiens
caagaguuccugcuacauc

SEQ ID NO: 97794 - RNA, 19 nt, Homo sapiens
uugaugcuguuucuacauu

SEQ ID NO: 97795 - RNA, 19 nt, Homo sapiens
ccucuuagcuuuucugcaa

SEQ ID NO: 97796 - RNA, 19 nt, Homo sapiens
ucagcacuuuguuucauau

SEQ ID NO: 97797 - RNA, 19 nt, Homo sapiens
gcuaauccaggacagcauu

SEQ ID NO: 97798 - RNA, 19 nt, Homo sapiens
gcgcgugguuccugcgaau

SEQ ID NO: 97799 - RNA, 19 nt, Homo sapiens
gacgccacauuccacacua

SEQ ID NO: 97800 - RNA, 19 nt, Homo sapiens
cagcagggccacugaguag

SEQ ID NO: 97801 - RNA, 19 nt, Homo sapiens
gcucuacuauggccucaac

SEQ ID NO: 97802 - RNA, 19 nt, Homo sapiens
ugagaagaaccaaguuuua

SEQ ID NO: 97803 - RNA, 19 nt, Homo sapiens
uagaaucucagcacuuugu

SEQ ID NO: 97804 - RNA, 19 nt, Homo sapiens
cuaacguguuggugaauuc

SEQ ID NO: 97805 - RNA, 19 nt, Homo sapiens
gcuugaugcuguuucuaca

SEQ ID NO: 97806 - RNA, 19 nt, Homo sapiens
cucagcacuuuguuucaua

SEQ ID NO: 97807 - RNA, 19 nt, Homo sapiens
gaaaccagacauucuucuc

SEQ ID NO: 97808 - RNA, 19 nt, Homo sapiens
ucaaagacgguagagagaa

SEQ ID NO: 97809 - RNA, 19 nt, Homo sapiens
ucacuaaauccuuuccaau

SEQ ID NO: 97810 - RNA, 19 nt, Homo sapiens
gacauucuucucuauaaca

SEQ ID NO: 97811 - RNA, 19 nt, Homo sapiens
cagauggccagauuuggaa

SEQ ID NO: 97812 - RNA, 19 nt, Homo sapiens
cgcaaccacucaccgucua

SEQ ID NO: 97813 - RNA, 19 nt, Homo sapiens
gcagggccacugaguaguc

SEQ ID NO: 97814 - RNA, 19 nt, Homo sapiens
caaguggaccagagucauc

SEQ ID NO: 97815 - RNA, 19 nt, Homo sapiens
uaacagucuuacucucucu

SEQ ID NO: 97816 - RNA, 19 nt, Homo sapiens
ucuauaacagugcugauga

SEQ ID NO: 97817 - RNA, 19 nt, Homo sapiens
gaaugugucagaauaucca

SEQ ID NO: 97818 - RNA, 19 nt, Homo sapiens
agagagaaacagcuugaug

SEQ ID NO: 97819 - RNA, 19 nt, Homo sapiens
aauaaaccagacucacuaa

SEQ ID NO: 97820 - RNA, 19 nt, Homo sapiens
ccagauugaagcuaaaaua

SEQ ID NO: 97821 - RNA, 19 nt, Homo sapiens
gggauaacagucuuacucu

SEQ ID NO: 97822 - RNA, 19 nt, Homo sapiens
ccgcaggacgcucuacuau

SEQ ID NO: 97823 - RNA, 19 nt, Homo sapiens
caauggagaaugggaccua

SEQ ID NO: 97824 - RNA, 19 nt, Homo sapiens
gauuuggaaaccagacauu

SEQ ID NO: 97825 - RNA, 19 nt, Homo sapiens
uauuuacaguggaaugugu

SEQ ID NO: 97826 - RNA, 19 nt, Homo sapiens
aaugggaccuagugggaau

SEQ ID NO: 97827 - RNA, 19 nt, Homo sapiens
acaguggaaugugucagaa

SEQ ID NO: 97828 - RNA, 19 nt, Homo sapiens
ggaugagaagaaccaaguu

SEQ ID NO: 97829 - RNA, 19 nt, Homo sapiens
gagucauccuucugaacug

SEQ ID NO: 97830 - RNA, 19 nt, Homo sapiens
gcgcuuugacgccacauuc

SEQ ID NO: 97831 - RNA, 19 nt, Homo sapiens
ggaaaccagacauucuucu

SEQ ID NO: 97832 - RNA, 19 nt, Homo sapiens
uuucccagauggccagauu

SEQ ID NO: 97833 - RNA, 19 nt, Homo sapiens
ucucagcacuuuguuucau

SEQ ID NO: 97834 - RNA, 19 nt, Homo sapiens
aaucucagcacuuuguuuc

SEQ ID NO: 97835 - RNA, 19 nt, Homo sapiens
acgggaaccugcuguacau

SEQ ID NO: 97836 - RNA, 19 nt, Homo sapiens
acagucuuacucucucuua

SEQ ID NO: 97837 - RNA, 19 nt, Homo sapiens
guguacaaacccagauuga

SEQ ID NO: 97838 - RNA, 19 nt, Homo sapiens
gcgugguuccugcgaauga

SEQ ID NO: 97839 - RNA, 19 nt, Homo sapiens
uggaaugugucagaauauc

SEQ ID NO: 97840 - RNA, 19 nt, Homo sapiens
uguuucauauucucagaug

SEQ ID NO: 97841 - RNA, 19 nt, Homo sapiens
gcagaucauggacguggau

SEQ ID NO: 97842 - RNA, 19 nt, Homo sapiens
aggagcuggucaagaacua

SEQ ID NO: 97843 - RNA, 19 nt, Homo sapiens
gcugguuucccuuugaugu

SEQ ID NO: 97844 - RNA, 19 nt, Homo sapiens
gcacaaagguguacuuaga

SEQ ID NO: 97845 - RNA, 19 nt, Homo sapiens
gaacaacaaugaugggaau

SEQ ID NO: 97846 - RNA, 19 nt, Homo sapiens
gaagggacuuucauugaga

SEQ ID NO: 97847 - RNA, 19 nt, Homo sapiens
gggaacagaugaauauuuc

SEQ ID NO: 97848 - RNA, 19 nt, Homo sapiens
gcugcuggcugacaaagua

SEQ ID NO: 97849 - RNA, 19 nt, Homo sapiens
ucaaguaccucauguuuac

SEQ ID NO: 97850 - RNA, 19 nt, Homo sapiens
cgagaaggaugaagagaug

SEQ ID NO: 97851 - RNA, 19 nt, Homo sapiens
gaaucugggccucuuauuu

SEQ ID NO: 97852 - RNA, 19 nt, Homo sapiens
cgucagaucuucauucaca

SEQ ID NO: 97853 - RNA, 19 nt, Homo sapiens
gaucuucauucacaaacuu

SEQ ID NO: 97854 - RNA, 19 nt, Homo sapiens
ugacguggcucuggacauu

SEQ ID NO: 97855 - RNA, 19 nt, Homo sapiens
ggaaauccacauucaugaa

SEQ ID NO: 97856 - RNA, 19 nt, Homo sapiens
gagcacaaagguguacuua

SEQ ID NO: 97857 - RNA, 19 nt, Homo sapiens
gcaagggcaucaggaaauc

SEQ ID NO: 97858 - RNA, 19 nt, Homo sapiens
gaauugcacuaugguguuc

SEQ ID NO: 97859 - RNA, 19 nt, Homo sapiens
gaagagaugagcacaaagg

SEQ ID NO: 97860 - RNA, 19 nt, Homo sapiens
uaucaaguaccucauguuu

SEQ ID NO: 97861 - RNA, 19 nt, Homo sapiens
gugagagaguuuggugaua

SEQ ID NO: 97862 - RNA, 19 nt, Homo sapiens
ggaagccgccaagugauuu

SEQ ID NO: 97863 - RNA, 19 nt, Homo sapiens
ggucagcguuggucucauc

SEQ ID NO: 97864 - RNA, 19 nt, Homo sapiens
gaaauccacauucaugaag

SEQ ID NO: 97865 - RNA, 19 nt, Homo sapiens
ggacagcgccaggaaguca

SEQ ID NO: 97866 - RNA, 19 nt, Homo sapiens
ggaaggacagcgccaggaa

SEQ ID NO: 97867 - RNA, 19 nt, Homo sapiens
caacaaugaugggaauuuu

SEQ ID NO: 97868 - RNA, 19 nt, Homo sapiens
ggacgccacguaccacuug

SEQ ID NO: 97869 - RNA, 19 nt, Homo sapiens
gcaagccucucuucuaccu

SEQ ID NO: 97870 - RNA, 19 nt, Homo sapiens
gaacgagaaggaugaagag

SEQ ID NO: 97871 - RNA, 19 nt, Homo sapiens
ccgcaagccucucuucuac

SEQ ID NO: 97872 - RNA, 19 nt, Homo sapiens
caggaaauccacauucaug

SEQ ID NO: 97873 - RNA, 19 nt, Homo sapiens
ucacuaucaguacccauua

SEQ ID NO: 97874 - RNA, 19 nt, Homo sapiens
augaagagaugagcacaaa

SEQ ID NO: 97875 - RNA, 19 nt, Homo sapiens
ccugaucugcggcgauuua

SEQ ID NO: 97876 - RNA, 19 nt, Homo sapiens
ugagagaguuuggugauac

SEQ ID NO: 97877 - RNA, 19 nt, Homo sapiens
ucaguacccauuauuauca

SEQ ID NO: 97878 - RNA, 19 nt, Homo sapiens
ggaccacgaugcgcugaag

SEQ ID NO: 97879 - RNA, 19 nt, Homo sapiens
cuaucaguacccauuauua

SEQ ID NO: 97880 - RNA, 19 nt, Homo sapiens
uggcagaauugcacuaugg

SEQ ID NO: 97881 - RNA, 19 nt, Homo sapiens
gagcacgacggcaucgauu

SEQ ID NO: 97882 - RNA, 19 nt, Homo sapiens
aaucugggccucuuauuuc

SEQ ID NO: 97883 - RNA, 19 nt, Homo sapiens
ggaaucugggccucuuauu

SEQ ID NO: 97884 - RNA, 19 nt, Homo sapiens
ggcaagggcaucaggaaau

SEQ ID NO: 97885 - RNA, 19 nt, Homo sapiens
gggcaagggcaucaggaaa

SEQ ID NO: 97886 - RNA, 19 nt, Homo sapiens
gagagaguuuggugauacu

SEQ ID NO: 97887 - RNA, 19 nt, Homo sapiens
ccuguggacuuucaucauc

SEQ ID NO: 97888 - RNA, 19 nt, Homo sapiens
gguaguggaccgccucuuc

SEQ ID NO: 97889 - RNA, 19 nt, Homo sapiens
ucacaaacuuccgcuguac

SEQ ID NO: 97890 - RNA, 19 nt, Homo sapiens
ugaacgagaaggaugaaga

SEQ ID NO: 97891 - RNA, 19 nt, Homo sapiens
cuacugaacaacaaugaug

SEQ ID NO: 97892 - RNA, 19 nt, Homo sapiens
gccgcaagccucucuucua

SEQ ID NO: 97893 - RNA, 19 nt, Homo sapiens
gcaguuuguggccauggua

SEQ ID NO: 97894 - RNA, 19 nt, Homo sapiens
ggacuuucaucaucuucac

SEQ ID NO: 97895 - RNA, 19 nt, Homo sapiens
gaugaagagaugagcacaa

SEQ ID NO: 97896 - RNA, 19 nt, Homo sapiens
ucacucuucuggccaucuu

SEQ ID NO: 97897 - RNA, 19 nt, Homo sapiens
caucaggaaauccacauuc

SEQ ID NO: 97898 - RNA, 19 nt, Homo sapiens
acaacaaugaugggaauuu

SEQ ID NO: 97899 - RNA, 19 nt, Homo sapiens
uucacaaacuuccgcugua

SEQ ID NO: 97900 - RNA, 19 nt, Homo sapiens
caguacccauuauuaucaa

SEQ ID NO: 97901 - RNA, 19 nt, Homo sapiens
caguugaagugagagaguu

SEQ ID NO: 97902 - RNA, 19 nt, Homo sapiens
ggaacaggaggaccacgau

SEQ ID NO: 97903 - RNA, 19 nt, Homo sapiens
cggaagccgccaagugauu

SEQ ID NO: 97904 - RNA, 19 nt, Homo sapiens
ggcccaaacccgagagaga

SEQ ID NO: 97905 - RNA, 19 nt, Homo sapiens
ucagaucuucauucacaaa

SEQ ID NO: 97906 - RNA, 19 nt, Homo sapiens
ucucagucauccuuagugu

SEQ ID NO: 97907 - RNA, 19 nt, Homo sapiens
gcugacaaaguaccugaga

SEQ ID NO: 97908 - RNA, 19 nt, Homo sapiens
gaccuggaguggacugacu

SEQ ID NO: 97909 - RNA, 19 nt, Homo sapiens
ccgcuguaccugcgucuaa

SEQ ID NO: 97910 - RNA, 19 nt, Homo sapiens
auccuucucugccucuuaa

SEQ ID NO: 97911 - RNA, 19 nt, Homo sapiens
ccagaccccuuuccuugaa

SEQ ID NO: 97912 - RNA, 19 nt, Homo sapiens
cauccuuagugucgugguu

SEQ ID NO: 97913 - RNA, 19 nt, Homo sapiens
ccaugguccucgucaccuu

SEQ ID NO: 97914 - RNA, 19 nt, Homo sapiens
cacuaucaguacccauuau

SEQ ID NO: 97915 - RNA, 19 nt, Homo sapiens
ggagcacgacggcaucgau

SEQ ID NO: 97916 - RNA, 19 nt, Homo sapiens
cucgacagcugcaggaaca

SEQ ID NO: 97917 - RNA, 19 nt, Homo sapiens
uccggaagccgccaaguga

SEQ ID NO: 97918 - RNA, 19 nt, Homo sapiens
uccgucagaucuucauuca

SEQ ID NO: 97919 - RNA, 19 nt, Homo sapiens
gcacgacggcaucgauucg

SEQ ID NO: 97920 - RNA, 19 nt, Homo sapiens
cugcugacccuuacugugu

SEQ ID NO: 97921 - RNA, 19 nt, Homo sapiens
caucuucuaccucaucauc

SEQ ID NO: 97922 - RNA, 19 nt, Homo sapiens
aagggacuuucauugagaa

SEQ ID NO: 97923 - RNA, 19 nt, Homo sapiens
gcaucaggaaauccacauu

SEQ ID NO: 97924 - RNA, 19 nt, Homo sapiens
agaauugcacuaugguguu

SEQ ID NO: 97925 - RNA, 19 nt, Homo sapiens
gagaguuuggugauacugu

SEQ ID NO: 97926 - RNA, 19 nt, Homo sapiens
gaagacuggaggguugaga

SEQ ID NO: 97927 - RNA, 19 nt, Homo sapiens
gacguggcucuggacauua

SEQ ID NO: 97928 - RNA, 19 nt, Homo sapiens
gccaagugauuuucucuuc

SEQ ID NO: 97929 - RNA, 19 nt, Homo sapiens
gcugacccuuacuguguuc

SEQ ID NO: 97930 - RNA, 19 nt, Homo sapiens
gaagauggggcucucaauc

SEQ ID NO: 97931 - RNA, 19 nt, Homo sapiens
cugggccucuuauuucguu

SEQ ID NO: 97932 - RNA, 19 nt, Homo sapiens
ggggaacagaugaauauuu

SEQ ID NO: 97933 - RNA, 19 nt, Homo sapiens
gagaaggaugaagagauga

SEQ ID NO: 97934 - RNA, 19 nt, Homo sapiens
guaaagcacuucccauuug

SEQ ID NO: 97935 - RNA, 19 nt, Homo sapiens
gcacagagaucgacuuggu

SEQ ID NO: 97936 - RNA, 19 nt, Homo sapiens
ggacaucacguaugacuuc

SEQ ID NO: 97937 - RNA, 19 nt, Homo sapiens
gcgagaagaugacguugug

SEQ ID NO: 97938 - RNA, 19 nt, Homo sapiens
caagagcgcaugcaagauu

SEQ ID NO: 97939 - RNA, 19 nt, Homo sapiens
ccagagaccugcuccagau

SEQ ID NO: 97940 - RNA, 19 nt, Homo sapiens
gcaaguaccucauguucac

SEQ ID NO: 97941 - RNA, 19 nt, Homo sapiens
uaaagcacuucccauuuga

SEQ ID NO: 97942 - RNA, 19 nt, Homo sapiens
ggaaguacgucgccauggu

SEQ ID NO: 97943 - RNA, 19 nt, Homo sapiens
caugcaagauugaaguaaa

SEQ ID NO: 97944 - RNA, 19 nt, Homo sapiens
gggcuggccugacacaaug

SEQ ID NO: 97945 - RNA, 19 nt, Homo sapiens
ccaaugccguggucuccua

SEQ ID NO: 97946 - RNA, 19 nt, Homo sapiens
gcaagccgcucuucuacac

SEQ ID NO: 97947 - RNA, 19 nt, Homo sapiens
cuggaagccugaagaguuu

SEQ ID NO: 97948 - RNA, 19 nt, Homo sapiens
gcaaggcugcuaaguggaa

SEQ ID NO: 97949 - RNA, 19 nt, Homo sapiens
uggaccaacugcuuuguuu

SEQ ID NO: 97950 - RNA, 19 nt, Homo sapiens
gagagaggccuggguguga

SEQ ID NO: 97951 - RNA, 19 nt, Homo sapiens
ugaagaguuugacaacaug

SEQ ID NO: 97952 - RNA, 19 nt, Homo sapiens
uguacgagguguccuucua

SEQ ID NO: 97953 - RNA, 19 nt, Homo sapiens
cagaugugguccuguacaa

SEQ ID NO: 97954 - RNA, 19 nt, Homo sapiens
gaagagggguauaggacaa

SEQ ID NO: 97955 - RNA, 19 nt, Homo sapiens
uacaagagcgcaugcaaga

SEQ ID NO: 97956 - RNA, 19 nt, Homo sapiens
cagcgauuccugccaagua

SEQ ID NO: 97957 - RNA, 19 nt, Homo sapiens
ccaccuuccuccacucaga

SEQ ID NO: 97958 - RNA, 19 nt, Homo sapiens
gccguggucuccuaugaug

SEQ ID NO: 97959 - RNA, 19 nt, Homo sapiens
ucccagaugugguccugua

SEQ ID NO: 97960 - RNA, 19 nt, Homo sapiens
cugaagaguuugacaacau

SEQ ID NO: 97961 - RNA, 19 nt, Homo sapiens
ccuggaagccugaagaguu

SEQ ID NO: 97962 - RNA, 19 nt, Homo sapiens
gaugugguccuguacaaca

SEQ ID NO: 97963 - RNA, 19 nt, Homo sapiens
gaucaugaccaccaauguc

SEQ ID NO: 97964 - RNA, 19 nt, Homo sapiens
gagcaucuccuggauccuu

SEQ ID NO: 97965 - RNA, 19 nt, Homo sapiens
guacgagguguccuucuau

SEQ ID NO: 97966 - RNA, 19 nt, Homo sapiens
acacaaugguagcucugaa

SEQ ID NO: 97967 - RNA, 19 nt, Homo sapiens
cauccacccugaggaguga

SEQ ID NO: 97968 - RNA, 19 nt, Homo sapiens
ugagugaggacuggaagua

SEQ ID NO: 97969 - RNA, 19 nt, Homo sapiens
cagcagccacgccaucauu

SEQ ID NO: 97970 - RNA, 19 nt, Homo sapiens
gaagaguuugacaacauga

SEQ ID NO: 97971 - RNA, 19 nt, Homo sapiens
ggugaucgaccgccucuuc

SEQ ID NO: 97972 - RNA, 19 nt, Homo sapiens
uagccauccuugucuucua

SEQ ID NO: 97973 - RNA, 19 nt, Homo sapiens
gagcgggagcagaucauga

SEQ ID NO: 97974 - RNA, 19 nt, Homo sapiens
gaucuuugucuuugucugu

SEQ ID NO: 97975 - RNA, 19 nt, Homo sapiens
aguaaagcacuucccauuu

SEQ ID NO: 97976 - RNA, 19 nt, Homo sapiens
ccacagauccauccuuuug

SEQ ID NO: 97977 - RNA, 19 nt, Homo sapiens
uggcccagcucaucagugu

SEQ ID NO: 97978 - RNA, 19 nt, Homo sapiens
gcaugcaagauugaaguaa

SEQ ID NO: 97979 - RNA, 19 nt, Homo sapiens
uacgagguguccuucuauu

SEQ ID NO: 97980 - RNA, 19 nt, Homo sapiens
gccgcaagccgcucuucua

SEQ ID NO: 97981 - RNA, 19 nt, Homo sapiens
aagagcgcaugcaagauug

SEQ ID NO: 97982 - RNA, 19 nt, Homo sapiens
gagguguccuucuauucca

SEQ ID NO: 97983 - RNA, 19 nt, Homo sapiens
ggaagccugaagaguuuga

SEQ ID NO: 97984 - RNA, 19 nt, Homo sapiens
cuggacgacuucacaccua

SEQ ID NO: 97985 - RNA, 19 nt, Homo sapiens
gaagggaggggaagagaga

SEQ ID NO: 97986 - RNA, 19 nt, Homo sapiens
ccucaucuccaugcucuuu

SEQ ID NO: 97987 - RNA, 19 nt, Homo sapiens
gacaacaugaagaaaguuc

SEQ ID NO: 97988 - RNA, 19 nt, Homo sapiens
ccucuggaucuuugucuuu

SEQ ID NO: 97989 - RNA, 19 nt, Homo sapiens
uggcugcucuccaucucuu

SEQ ID NO: 97990 - RNA, 19 nt, Homo sapiens
cagccucucuuccagaacu

SEQ ID NO: 97991 - RNA, 19 nt, Homo sapiens
gcauguacgagguguccuu

SEQ ID NO: 97992 - RNA, 19 nt, Homo sapiens
uugacaacaugaagaaagu

SEQ ID NO: 97993 - RNA, 19 nt, Homo sapiens
guacgucgccauggugauc

SEQ ID NO: 97994 - RNA, 19 nt, Homo sapiens
cuucaucgcagaccacaug

SEQ ID NO: 97995 - RNA, 19 nt, Homo sapiens
cggcaaguaccucauguuc

SEQ ID NO: 97996 - RNA, 19 nt, Homo sapiens
ccucaccgucccaauugua

SEQ ID NO: 97997 - RNA, 19 nt, Homo sapiens
ggcaaguaccucauguuca

SEQ ID NO: 97998 - RNA, 19 nt, Homo sapiens
acuuggugcugaagaguga

SEQ ID NO: 97999 - RNA, 19 nt, Homo sapiens
gcgcaugcaagauugaagu

SEQ ID NO: 98000 - RNA, 19 nt, Homo sapiens
gaguuugacaacaugaaga

SEQ ID NO: 98001 - RNA, 19 nt, Homo sapiens
ccaggagugggaagauuau

SEQ ID NO: 98002 - RNA, 19 nt, Homo sapiens
uguaccagcccaggcaaua

SEQ ID NO: 98003 - RNA, 19 nt, Homo sapiens
ccuggaggcuggaccaacu

SEQ ID NO: 98004 - RNA, 19 nt, Homo sapiens
ucaucuccaugcucuuuca

SEQ ID NO: 98005 - RNA, 19 nt, Homo sapiens
gacaucacguaugacuuca

SEQ ID NO: 98006 - RNA, 19 nt, Homo sapiens
gcuaaguggaagacagaga

SEQ ID NO: 98007 - RNA, 19 nt, Homo sapiens
gacuguggcgagaagauga

SEQ ID NO: 98008 - RNA, 19 nt, Homo sapiens
cuacguacguggacaucac

SEQ ID NO: 98009 - RNA, 19 nt, Homo sapiens
ggaccuacgaccgcacaga

SEQ ID NO: 98010 - RNA, 19 nt, Homo sapiens
cuggugacaguacagcuua

SEQ ID NO: 98011 - RNA, 19 nt, Homo sapiens
gaggcuggaccaacugcuu

SEQ ID NO: 98012 - RNA, 19 nt, Homo sapiens
ugcagccucucuuccagaa

SEQ ID NO: 98013 - RNA, 19 nt, Homo sapiens
gauccuucccgcuacaaca

SEQ ID NO: 98014 - RNA, 19 nt, Homo sapiens
gaaaugcucuguuguuaaa

SEQ ID NO: 98015 - RNA, 19 nt, Homo sapiens
guacaagacuggaaauuug

SEQ ID NO: 98016 - RNA, 19 nt, Homo sapiens
cgacagaacugcuccauga

SEQ ID NO: 98017 - RNA, 19 nt, Homo sapiens
gcagaaacuuccaaaauua

SEQ ID NO: 98018 - RNA, 19 nt, Homo sapiens
ugacauaguucucuuugaa

SEQ ID NO: 98019 - RNA, 19 nt, Homo sapiens
ucacgaugcucccagauuu

SEQ ID NO: 98020 - RNA, 19 nt, Homo sapiens
caaagucauuccucucauu

SEQ ID NO: 98021 - RNA, 19 nt, Homo sapiens
cgagacaugugaagaaaga

SEQ ID NO: 98022 - RNA, 19 nt, Homo sapiens
caauggaaaugcucuguug

SEQ ID NO: 98023 - RNA, 19 nt, Homo sapiens
gagaguaccugcuguucau

SEQ ID NO: 98024 - RNA, 19 nt, Homo sapiens
gggaaauacugaacgcaaa

SEQ ID NO: 98025 - RNA, 19 nt, Homo sapiens
guuccaagguuaucagaaa

SEQ ID NO: 98026 - RNA, 19 nt, Homo sapiens
ggaaaugcucuguuguuaa

SEQ ID NO: 98027 - RNA, 19 nt, Homo sapiens
ccacaucggucuugguuuc

SEQ ID NO: 98028 - RNA, 19 nt, Homo sapiens
uaacggagaaugggaaaua

SEQ ID NO: 98029 - RNA, 19 nt, Homo sapiens
gacauuuguuccaagguua

SEQ ID NO: 98030 - RNA, 19 nt, Homo sapiens
uggaaaugcucuguuguua

SEQ ID NO: 98031 - RNA, 19 nt, Homo sapiens
guaacaggcucgguucuga

SEQ ID NO: 98032 - RNA, 19 nt, Homo sapiens
ggugggauccauuccauua

SEQ ID NO: 98033 - RNA, 19 nt, Homo sapiens
gaaaauaucccagcuugua

SEQ ID NO: 98034 - RNA, 19 nt, Homo sapiens
gaaaucaucccaucgucuu

SEQ ID NO: 98035 - RNA, 19 nt, Homo sapiens
gaaaucaaacggaacuguu

SEQ ID NO: 98036 - RNA, 19 nt, Homo sapiens
gaaauggguccgcccugua

SEQ ID NO: 98037 - RNA, 19 nt, Homo sapiens
cauuaaaguuccaucagaa

SEQ ID NO: 98038 - RNA, 19 nt, Homo sapiens
ugagacgccugccuuuauu

SEQ ID NO: 98039 - RNA, 19 nt, Homo sapiens
ccauuaaaguuccaucaga

SEQ ID NO: 98040 - RNA, 19 nt, Homo sapiens
gaaauuuguagcucaaguu

SEQ ID NO: 98041 - RNA, 19 nt, Homo sapiens
ccacagguuucaacucaau

SEQ ID NO: 98042 - RNA, 19 nt, Homo sapiens
ggaaauuuguagcucaagu

SEQ ID NO: 98043 - RNA, 19 nt, Homo sapiens
ccaaaugcaugugcuuguu

SEQ ID NO: 98044 - RNA, 19 nt, Homo sapiens
gaaaggcaaaguccucgaa

SEQ ID NO: 98045 - RNA, 19 nt, Homo sapiens
caccacagguuucaacuca

SEQ ID NO: 98046 - RNA, 19 nt, Homo sapiens
caucauuguuaccguguuu

SEQ ID NO: 98047 - RNA, 19 nt, Homo sapiens
gaagaaaucaucccaucgu

SEQ ID NO: 98048 - RNA, 19 nt, Homo sapiens
caccaugguugaccucauu

SEQ ID NO: 98049 - RNA, 19 nt, Homo sapiens
uuagauacauuucgagaca

SEQ ID NO: 98050 - RNA, 19 nt, Homo sapiens
uaucccagcuuguagaugu

SEQ ID NO: 98051 - RNA, 19 nt, Homo sapiens
gaaacagcuuagugaugga

SEQ ID NO: 98052 - RNA, 19 nt, Homo sapiens
aaacagaaacagcuuagug

SEQ ID NO: 98053 - RNA, 19 nt, Homo sapiens
agaggagagucaaccagua

SEQ ID NO: 98054 - RNA, 19 nt, Homo sapiens
ggucuugguuucucugaca

SEQ ID NO: 98055 - RNA, 19 nt, Homo sapiens
guacuccuaucccuuuauc

SEQ ID NO: 98056 - RNA, 19 nt, Homo sapiens
agacauuuguuccaagguu

SEQ ID NO: 98057 - RNA, 19 nt, Homo sapiens
ccaaggucaucgugaaauc

SEQ ID NO: 98058 - RNA, 19 nt, Homo sapiens
ugggauccauuccauuaaa

SEQ ID NO: 98059 - RNA, 19 nt, Homo sapiens
ggacagaccacaaguuacg

SEQ ID NO: 98060 - RNA, 19 nt, Homo sapiens
gcuuguagauguggaugaa

SEQ ID NO: 98061 - RNA, 19 nt, Homo sapiens
cuacauaguuaccauuagg

SEQ ID NO: 98062 - RNA, 19 nt, Homo sapiens
ggagaaugggaaauacuga

SEQ ID NO: 98063 - RNA, 19 nt, Homo sapiens
cagaacugcuccaugaagu

SEQ ID NO: 98064 - RNA, 19 nt, Homo sapiens
ggaauggacagaccacaag

SEQ ID NO: 98065 - RNA, 19 nt, Homo sapiens
cauuaacguucaccacaga

SEQ ID NO: 98066 - RNA, 19 nt, Homo sapiens
ggagaguaccugcuguuca

SEQ ID NO: 98067 - RNA, 19 nt, Homo sapiens
cuauuuaccuucggaugaa

SEQ ID NO: 98068 - RNA, 19 nt, Homo sapiens
guucuuguguucuauuuac

SEQ ID NO: 98069 - RNA, 19 nt, Homo sapiens
gagaaugggaaauacugaa

SEQ ID NO: 98070 - RNA, 19 nt, Homo sapiens
gguaguacaagacuggaaa

SEQ ID NO: 98071 - RNA, 19 nt, Homo sapiens
ucauguggaucgcuacuca

SEQ ID NO: 98072 - RNA, 19 nt, Homo sapiens
gacauaguucucuuugaaa

SEQ ID NO: 98073 - RNA, 19 nt, Homo sapiens
ccucagacauuuguuccaa

SEQ ID NO: 98074 - RNA, 19 nt, Homo sapiens
cagaaacagcuuagugaug

SEQ ID NO: 98075 - RNA, 19 nt, Homo sapiens
uuaccguguuugucauuaa

SEQ ID NO: 98076 - RNA, 19 nt, Homo sapiens
guuaccguguuugucauua

SEQ ID NO: 98077 - RNA, 19 nt, Homo sapiens
gggacggcguguacuccua

SEQ ID NO: 98078 - RNA, 19 nt, Homo sapiens
gaaccccuguauuuucuuu

SEQ ID NO: 98079 - RNA, 19 nt, Homo sapiens
caaccaauguguggcucaa

SEQ ID NO: 98080 - RNA, 19 nt, Homo sapiens
ggcuacauaguuaccauua

SEQ ID NO: 98081 - RNA, 19 nt, Homo sapiens
gagucaaccaguagugaaa

SEQ ID NO: 98082 - RNA, 19 nt, Homo sapiens
gagagucaaccaguaguga

SEQ ID NO: 98083 - RNA, 19 nt, Homo sapiens
gaggagagucaaccaguag

SEQ ID NO: 98084 - RNA, 19 nt, Homo sapiens
gaaagaggagagucaacca

SEQ ID NO: 98085 - RNA, 19 nt, Homo sapiens
ugaagaugcccuccucaga

SEQ ID NO: 98086 - RNA, 19 nt, Homo sapiens
ggaaauacugaacgcaaag

SEQ ID NO: 98087 - RNA, 19 nt, Homo sapiens
gauccauuccauuaaaguu

SEQ ID NO: 98088 - RNA, 19 nt, Homo sapiens
uauacccucuuucucauca

SEQ ID NO: 98089 - RNA, 19 nt, Homo sapiens
ggacggcguguacuccuau

SEQ ID NO: 98090 - RNA, 19 nt, Homo sapiens
gauaacggagaaugggaaa

SEQ ID NO: 98091 - RNA, 19 nt, Homo sapiens
uucgaaggcucccugauga

SEQ ID NO: 98092 - RNA, 19 nt, Homo sapiens
ucacacagacagaauccaa

SEQ ID NO: 98093 - RNA, 19 nt, Homo sapiens
caguucuuguguucuauuu

SEQ ID NO: 98094 - RNA, 19 nt, Homo sapiens
gcuacauaguuaccauuag

SEQ ID NO: 98095 - RNA, 19 nt, Homo sapiens
aagaugcccuccucagaca

SEQ ID NO: 98096 - RNA, 19 nt, Homo sapiens
ugcagaaacuuccaaaauu

SEQ ID NO: 98097 - RNA, 19 nt, Homo sapiens
ucugacaguuuuccuuuua

SEQ ID NO: 98098 - RNA, 19 nt, Homo sapiens
ccuaucccuuuaucacgua

SEQ ID NO: 98099 - RNA, 19 nt, Homo sapiens
gaaaaugucgacagaaaag

SEQ ID NO: 98100 - RNA, 19 nt, Homo sapiens
caaugaaaaugucgacaga

SEQ ID NO: 98101 - RNA, 19 nt, Homo sapiens
gggauccauuccauuaaag

SEQ ID NO: 98102 - RNA, 19 nt, Homo sapiens
cugcugauuccauuagaua

SEQ ID NO: 98103 - RNA, 19 nt, Homo sapiens
cgccugccuuuauucuaua

SEQ ID NO: 98104 - RNA, 19 nt, Homo sapiens
acgccugccuuuauucuau

SEQ ID NO: 98105 - RNA, 19 nt, Homo sapiens
caaaugcaugugcuuguuc

SEQ ID NO: 98106 - RNA, 19 nt, Homo sapiens
ucagccagguaguacaaga

SEQ ID NO: 98107 - RNA, 19 nt, Homo sapiens
caccacagaucuucuucca

SEQ ID NO: 98108 - RNA, 19 nt, Homo sapiens
ccaaagucauuccucucau

SEQ ID NO: 98109 - RNA, 19 nt, Homo sapiens
guguacuccuaucccuuua

SEQ ID NO: 98110 - RNA, 19 nt, Homo sapiens
gaagggacggcguguacuc

SEQ ID NO: 98111 - RNA, 19 nt, Homo sapiens
gcaccaugguugaccucau

SEQ ID NO: 98112 - RNA, 19 nt, Homo sapiens
ucuguggcuuccugacaua

SEQ ID NO: 98113 - RNA, 19 nt, Homo sapiens
uaaaguuccaucagaaucu

SEQ ID NO: 98114 - RNA, 19 nt, Homo sapiens
ggauaaagaugacuucgua

SEQ ID NO: 98115 - RNA, 19 nt, Homo sapiens
ggacgugacuuacgacuuc

SEQ ID NO: 98116 - RNA, 19 nt, Homo sapiens
ggagggagcuucagacagu

SEQ ID NO: 98117 - RNA, 19 nt, Homo sapiens
gaugaggccuaaguaaaua

SEQ ID NO: 98118 - RNA, 19 nt, Homo sapiens
gcacuuugcugcuucuuuc

SEQ ID NO: 98119 - RNA, 19 nt, Homo sapiens
aaacaggaauggacugauu

SEQ ID NO: 98120 - RNA, 19 nt, Homo sapiens
caagagcgccugcaagauu

SEQ ID NO: 98121 - RNA, 19 nt, Homo sapiens
ccaaguagcugggauuaca

SEQ ID NO: 98122 - RNA, 19 nt, Homo sapiens
uaaacggagucuugcuaua

SEQ ID NO: 98123 - RNA, 19 nt, Homo sapiens
ggaaguacguggcuauggu

SEQ ID NO: 98124 - RNA, 19 nt, Homo sapiens
gcaaguaccucauguucac

SEQ ID NO: 98125 - RNA, 19 nt, Homo sapiens
gaacaaaacccguuacaau

SEQ ID NO: 98126 - RNA, 19 nt, Homo sapiens
guaaauaugugagcauugg

SEQ ID NO: 98127 - RNA, 19 nt, Homo sapiens
ggaacuccauguacuuugu

SEQ ID NO: 98128 - RNA, 19 nt, Homo sapiens
gcucagaggcuuggcauuu

SEQ ID NO: 98129 - RNA, 19 nt, Homo sapiens
ggacgaccuucugaacaaa

SEQ ID NO: 98130 - RNA, 19 nt, Homo sapiens
ccuaugaggugucugucua

SEQ ID NO: 98131 - RNA, 19 nt, Homo sapiens
caccaucucucuccacuuc

SEQ ID NO: 98132 - RNA, 19 nt, Homo sapiens
caugaagaaugacgaugaa

SEQ ID NO: 98133 - RNA, 19 nt, Homo sapiens
gcaagauugaggugaagua

SEQ ID NO: 98134 - RNA, 19 nt, Homo sapiens
ccaaagugcugggauuaca

SEQ ID NO: 98135 - RNA, 19 nt, Homo sapiens
agauugaggugaaguacuu

SEQ ID NO: 98136 - RNA, 19 nt, Homo sapiens
ugccugacaucgugcuuua

SEQ ID NO: 98137 - RNA, 19 nt, Homo sapiens
gggcuguccucucugaaug

SEQ ID NO: 98138 - RNA, 19 nt, Homo sapiens
ggacagugaacccacaaga

SEQ ID NO: 98139 - RNA, 19 nt, Homo sapiens
cagcauggaugacuuuacu

SEQ ID NO: 98140 - RNA, 19 nt, Homo sapiens
ccucacagcucaucuccau

SEQ ID NO: 98141 - RNA, 19 nt, Homo sapiens
gcaagccucuguucuacac

SEQ ID NO: 98142 - RNA, 19 nt, Homo sapiens
cgaugaggccuaaguaaau

SEQ ID NO: 98143 - RNA, 19 nt, Homo sapiens
aaacggagucuugcuauau

SEQ ID NO: 98144 - RNA, 19 nt, Homo sapiens
gaagaaugacgaugaagac

SEQ ID NO: 98145 - RNA, 19 nt, Homo sapiens
uggacgaccuucugaacaa

SEQ ID NO: 98146 - RNA, 19 nt, Homo sapiens
cccagcacaugaagaauga

SEQ ID NO: 98147 - RNA, 19 nt, Homo sapiens
gcaggaggcauuagaaggu

SEQ ID NO: 98148 - RNA, 19 nt, Homo sapiens
gcgcaagccucuguucuac

SEQ ID NO: 98149 - RNA, 19 nt, Homo sapiens
uagcugggauuacagaaag

SEQ ID NO: 98150 - RNA, 19 nt, Homo sapiens
ucacacacuucuagauucu

SEQ ID NO: 98151 - RNA, 19 nt, Homo sapiens
ccagggagaaggacaguga

SEQ ID NO: 98152 - RNA, 19 nt, Homo sapiens
uggccaggcugauuucgaa

SEQ ID NO: 98153 - RNA, 19 nt, Homo sapiens
ccacagccagcauggauga

SEQ ID NO: 98154 - RNA, 19 nt, Homo sapiens
ucacagcucaucuccauca

SEQ ID NO: 98155 - RNA, 19 nt, Homo sapiens
uaaagcagccucccuacag

SEQ ID NO: 98156 - RNA, 19 nt, Homo sapiens
cgcccaggcucaagugauu

SEQ ID NO: 98157 - RNA, 19 nt, Homo sapiens
ccgaugaggccuaaguaaa

SEQ ID NO: 98158 - RNA, 19 nt, Homo sapiens
ugaagaaugacgaugaaga

SEQ ID NO: 98159 - RNA, 19 nt, Homo sapiens
aagagcgccugcaagauug

SEQ ID NO: 98160 - RNA, 19 nt, Homo sapiens
uacaagagcgccugcaaga

SEQ ID NO: 98161 - RNA, 19 nt, Homo sapiens
aaugucaccuccucugaga

SEQ ID NO: 98162 - RNA, 19 nt, Homo sapiens
uggcuccaauccauucuuu

SEQ ID NO: 98163 - RNA, 19 nt, Homo sapiens
gccugaaccucccaaguag

SEQ ID NO: 98164 - RNA, 19 nt, Homo sapiens
ugccugaaccucccaagua

SEQ ID NO: 98165 - RNA, 19 nt, Homo sapiens
guucaauucuggccugucu

SEQ ID NO: 98166 - RNA, 19 nt, Homo sapiens
cuaccuuccucuucaugaa

SEQ ID NO: 98167 - RNA, 19 nt, Homo sapiens
gaucaugaccaccaauguc

SEQ ID NO: 98168 - RNA, 19 nt, Homo sapiens
gagcgagagcagaucauga

SEQ ID NO: 98169 - RNA, 19 nt, Homo sapiens
ucugagaggccuucccuaa

SEQ ID NO: 98170 - RNA, 19 nt, Homo sapiens
uuacaggugugagccacua

SEQ ID NO: 98171 - RNA, 19 nt, Homo sapiens
acacacuucuagauucuuc

SEQ ID NO: 98172 - RNA, 19 nt, Homo sapiens
ccucacacacuucuagauu

SEQ ID NO: 98173 - RNA, 19 nt, Homo sapiens
ugucuacaccaacuugaua

SEQ ID NO: 98174 - RNA, 19 nt, Homo sapiens
gcacaugaagaaugacgau

SEQ ID NO: 98175 - RNA, 19 nt, Homo sapiens
acacggagauagacauggu

SEQ ID NO: 98176 - RNA, 19 nt, Homo sapiens
cugcaaagcgcaucugguu

SEQ ID NO: 98177 - RNA, 19 nt, Homo sapiens
caccgugcccagcuaauuu

SEQ ID NO: 98178 - RNA, 19 nt, Homo sapiens
acaaaacccguuacaauaa

SEQ ID NO: 98179 - RNA, 19 nt, Homo sapiens
guagcugggauuacagaaa

SEQ ID NO: 98180 - RNA, 19 nt, Homo sapiens
uaaagaugacuucguagca

SEQ ID NO: 98181 - RNA, 19 nt, Homo sapiens
gcaauggggauaaagauga

SEQ ID NO: 98182 - RNA, 19 nt, Homo sapiens
ccaccaaugucuggcugaa

SEQ ID NO: 98183 - RNA, 19 nt, Homo sapiens
ggaugugcaggaggcauua

SEQ ID NO: 98184 - RNA, 19 nt, Homo sapiens
ccugcaagauugaggugaa

SEQ ID NO: 98185 - RNA, 19 nt, Homo sapiens
ugaaugagcgagagcagau

SEQ ID NO: 98186 - RNA, 19 nt, Homo sapiens
aaagcagccucccuacagu

SEQ ID NO: 98187 - RNA, 19 nt, Homo sapiens
gagaggccuucccuaacca

SEQ ID NO: 98188 - RNA, 19 nt, Homo sapiens
ggccuucccuaucuucuac

SEQ ID NO: 98189 - RNA, 19 nt, Homo sapiens
gcccagcacaugaagaaug

SEQ ID NO: 98190 - RNA, 19 nt, Homo sapiens
ugcacaagcugccuaccuu

SEQ ID NO: 98191 - RNA, 19 nt, Homo sapiens
ccaaugucaccuccucuga

SEQ ID NO: 98192 - RNA, 19 nt, Homo sapiens
acaugaagaaugacgauga

SEQ ID NO: 98193 - RNA, 19 nt, Homo sapiens
cuacgagggugugaacauc

SEQ ID NO: 98194 - RNA, 19 nt, Homo sapiens
uaaccacccaaucauucua

SEQ ID NO: 98195 - RNA, 19 nt, Homo sapiens
ccugggcuguccucucuga

SEQ ID NO: 98196 - RNA, 19 nt, Homo sapiens
ggccuaaguaaauauguga

SEQ ID NO: 98197 - RNA, 19 nt, Homo sapiens
ggugggcacuuugcugcuu

SEQ ID NO: 98198 - RNA, 19 nt, Homo sapiens
gaacuccauguacuuugug

SEQ ID NO: 98199 - RNA, 19 nt, Homo sapiens
aacaaaacccguuacaaua

SEQ ID NO: 98200 - RNA, 19 nt, Homo sapiens
acaucgugcuuuacaacaa

SEQ ID NO: 98201 - RNA, 19 nt, Homo sapiens
ccuaaccacccaaucauuc

SEQ ID NO: 98202 - RNA, 19 nt, Homo sapiens
ugagaggccuucccuaacc

SEQ ID NO: 98203 - RNA, 19 nt, Homo sapiens
aacaggaauggacugauua

SEQ ID NO: 98204 - RNA, 19 nt, Homo sapiens
auucuuugcuccaauguca

SEQ ID NO: 98205 - RNA, 19 nt, Homo sapiens
gaacugccgcguggccaau

SEQ ID NO: 98206 - RNA, 19 nt, Homo sapiens
ccaccgugcccagcuaauu

SEQ ID NO: 98207 - RNA, 19 nt, Homo sapiens
gagggagcuucagacaguu

SEQ ID NO: 98208 - RNA, 19 nt, Homo sapiens
gccgaugaggccuaaguaa

SEQ ID NO: 98209 - RNA, 19 nt, Homo sapiens
cugccuaccuuccucuuca

SEQ ID NO: 98210 - RNA, 19 nt, Homo sapiens
cucagaggcuuggcauuug

SEQ ID NO: 98211 - RNA, 19 nt, Homo sapiens
ccucuguucuacaccauca

SEQ ID NO: 98212 - RNA, 19 nt, Homo sapiens
cagccagcauggaugacuu

SEQ ID NO: 98213 - RNA, 19 nt, Homo sapiens
ugaaacaggaauggacuga

SEQ ID NO: 98214 - RNA, 19 nt, Homo sapiens
gaaguggaaugcugaagaa

SEQ ID NO: 98215 - RNA, 19 nt, Homo sapiens
gggcaaacuucauuguuaa

SEQ ID NO: 98216 - RNA, 19 nt, Homo sapiens
guggaaugcugaagaauuu

SEQ ID NO: 98217 - RNA, 19 nt, Homo sapiens
gcagugaccucauguucga

SEQ ID NO: 98218 - RNA, 19 nt, Homo sapiens
ugagggaccagaacaauua

SEQ ID NO: 98219 - RNA, 19 nt, Homo sapiens
gagccacagucccuaauga

SEQ ID NO: 98220 - RNA, 19 nt, Homo sapiens
gagcacggcuggacagaca

SEQ ID NO: 98221 - RNA, 19 nt, Homo sapiens
ggacaagcgcuucaucuag

SEQ ID NO: 98222 - RNA, 19 nt, Homo sapiens
ggggcaaacuucauuguua

SEQ ID NO: 98223 - RNA, 19 nt, Homo sapiens
agcaggaacucuucaauga

SEQ ID NO: 98224 - RNA, 19 nt, Homo sapiens
gccaggacaucaccuucua

SEQ ID NO: 98225 - RNA, 19 nt, Homo sapiens
ugaagaauuuggaaacauc

SEQ ID NO: 98226 - RNA, 19 nt, Homo sapiens
ucaguucccucaaguauac

SEQ ID NO: 98227 - RNA, 19 nt, Homo sapiens
gcaacgugcuugucuacca

SEQ ID NO: 98228 - RNA, 19 nt, Homo sapiens
uggaguggaucaucauuga

SEQ ID NO: 98229 - RNA, 19 nt, Homo sapiens
ucaaguauacggccaaaga

SEQ ID NO: 98230 - RNA, 19 nt, Homo sapiens
ccaucucugucaccuauuu

SEQ ID NO: 98231 - RNA, 19 nt, Homo sapiens
caauuacaaugaggagaaa

SEQ ID NO: 98232 - RNA, 19 nt, Homo sapiens
gaccagaacaauuacaaug

SEQ ID NO: 98233 - RNA, 19 nt, Homo sapiens
caaguucaguucccucaag

SEQ ID NO: 98234 - RNA, 19 nt, Homo sapiens
ccagaacaauuacaaugag

SEQ ID NO: 98235 - RNA, 19 nt, Homo sapiens
caacauccacuuccgaaca

SEQ ID NO: 98236 - RNA, 19 nt, Homo sapiens
gagcagccacuccucaaug

SEQ ID NO: 98237 - RNA, 19 nt, Homo sapiens
gaccgccucugccuguuug

SEQ ID NO: 98238 - RNA, 19 nt, Homo sapiens
gcugaagaauuuggaaaca

SEQ ID NO: 98239 - RNA, 19 nt, Homo sapiens
gcaccuguuucaagagaag

SEQ ID NO: 98240 - RNA, 19 nt, Homo sapiens
gaacacccagcacccaugu

SEQ ID NO: 98241 - RNA, 19 nt, Homo sapiens
acaaccggcugaaguggaa

SEQ ID NO: 98242 - RNA, 19 nt, Homo sapiens
cuaaugacacccacuccua

SEQ ID NO: 98243 - RNA, 19 nt, Homo sapiens
gggcacagccuggaucuuc

SEQ ID NO: 98244 - RNA, 19 nt, Homo sapiens
caaccuggucuucuaccua

SEQ ID NO: 98245 - RNA, 19 nt, Homo sapiens
ugaaacaggaugccaagga

SEQ ID NO: 98246 - RNA, 19 nt, Homo sapiens
caagagaagggcuacaaca

SEQ ID NO: 98247 - RNA, 19 nt, Homo sapiens
cagaacugcucccucaagu

SEQ ID NO: 98248 - RNA, 19 nt, Homo sapiens
gaagaauuuggaaacauca

SEQ ID NO: 98249 - RNA, 19 nt, Homo sapiens
ggaccgccucugccuguuu

SEQ ID NO: 98250 - RNA, 19 nt, Homo sapiens
gcugccaccugccaucuuc

SEQ ID NO: 98251 - RNA, 19 nt, Homo sapiens
caaacuucauuguuaacca

SEQ ID NO: 98252 - RNA, 19 nt, Homo sapiens
guucaguucccucaaguau

SEQ ID NO: 98253 - RNA, 19 nt, Homo sapiens
acaauuacaaugaggagaa

SEQ ID NO: 98254 - RNA, 19 nt, Homo sapiens
cagcaggaacucuucaaug

SEQ ID NO: 98255 - RNA, 19 nt, Homo sapiens
cagagauugugcuggagaa

SEQ ID NO: 98256 - RNA, 19 nt, Homo sapiens
ggacagacaaccggcugaa

SEQ ID NO: 98257 - RNA, 19 nt, Homo sapiens
gaggagccacagucccuaa

SEQ ID NO: 98258 - RNA, 19 nt, Homo sapiens
ggaccagaacaauuacaau

SEQ ID NO: 98259 - RNA, 19 nt, Homo sapiens
cggcaccuguuucaagaga

SEQ ID NO: 98260 - RNA, 19 nt, Homo sapiens
ugaaguggaaugcugaaga

SEQ ID NO: 98261 - RNA, 19 nt, Homo sapiens
cuaccaauguguggauaga

SEQ ID NO: 98262 - RNA, 19 nt, Homo sapiens
caaccucaucucccugaaa

SEQ ID NO: 98263 - RNA, 19 nt, Homo sapiens
gcugauccggcaccuguuu

SEQ ID NO: 98264 - RNA, 19 nt, Homo sapiens
gacccucacuaccaaugug

SEQ ID NO: 98265 - RNA, 19 nt, Homo sapiens
ugacaguggugagaagaca

SEQ ID NO: 98266 - RNA, 19 nt, Homo sapiens
ccaaggagaaccgcaccua

SEQ ID NO: 98267 - RNA, 19 nt, Homo sapiens
ccucaucucccugaaagaa

SEQ ID NO: 98268 - RNA, 19 nt, Homo sapiens
ccacuacggcuucguguac

SEQ ID NO: 98269 - RNA, 19 nt, Homo sapiens
ccuacaacgugcaggacaa

SEQ ID NO: 98270 - RNA, 19 nt, Homo sapiens
gacagcagggucugagaga

SEQ ID NO: 98271 - RNA, 19 nt, Homo sapiens
caucuagggugggccuguu

SEQ ID NO: 98272 - RNA, 19 nt, Homo sapiens
gcaggaacucuucaaugag

SEQ ID NO: 98273 - RNA, 19 nt, Homo sapiens
gcaagccccucuucuacau

SEQ ID NO: 98274 - RNA, 19 nt, Homo sapiens
gaacggggagugggagaua

SEQ ID NO: 98275 - RNA, 19 nt, Homo sapiens
aagagaagggcuacaacaa

SEQ ID NO: 98276 - RNA, 19 nt, Homo sapiens
ugacggcuccuuccagauc

SEQ ID NO: 98277 - RNA, 19 nt, Homo sapiens
gggaccagaacaauuacaa

SEQ ID NO: 98278 - RNA, 19 nt, Homo sapiens
agacaucaguggccaucuc

SEQ ID NO: 98279 - RNA, 19 nt, Homo sapiens
uggucaaccuggucuucua

SEQ ID NO: 98280 - RNA, 19 nt, Homo sapiens
aggagacccucacuaccaa

SEQ ID NO: 98281 - RNA, 19 nt, Homo sapiens
ggagccacagucccuaaug

SEQ ID NO: 98282 - RNA, 19 nt, Homo sapiens
ggaaugcugaagaauuugg

SEQ ID NO: 98283 - RNA, 19 nt, Homo sapiens
ugccggagcuccugcacau

SEQ ID NO: 98284 - RNA, 19 nt, Homo sapiens
ucaucucccugaaagaagu

SEQ ID NO: 98285 - RNA, 19 nt, Homo sapiens
cagacaaccggcugaagug

SEQ ID NO: 98286 - RNA, 19 nt, Homo sapiens
guauacggccaaagagauc

SEQ ID NO: 98287 - RNA, 19 nt, Homo sapiens
aaccucaucucccugaaag

SEQ ID NO: 98288 - RNA, 19 nt, Homo sapiens
ccugcaacgugcuugucua

SEQ ID NO: 98289 - RNA, 19 nt, Homo sapiens
gcaggacaagcgcuucauc

SEQ ID NO: 98290 - RNA, 19 nt, Homo sapiens
agagaagggcuacaacaag

SEQ ID NO: 98291 - RNA, 19 nt, Homo sapiens
ccucaaguauacggccaaa

SEQ ID NO: 98292 - RNA, 19 nt, Homo sapiens
uccggcaccuguuucaaga

SEQ ID NO: 98293 - RNA, 19 nt, Homo sapiens
acagacaaccggcugaagu

SEQ ID NO: 98294 - RNA, 19 nt, Homo sapiens
gagacccucacuaccaaug

SEQ ID NO: 98295 - RNA, 19 nt, Homo sapiens
aggacaagcgcuucaucua

SEQ ID NO: 98296 - RNA, 19 nt, Homo sapiens
ccaaggccgaggaguacuu

SEQ ID NO: 98297 - RNA, 19 nt, Homo sapiens
accagaacaauuacaauga

SEQ ID NO: 98298 - RNA, 19 nt, Homo sapiens
cugaagaauuuggaaacau

SEQ ID NO: 98299 - RNA, 19 nt, Homo sapiens
aguggaaugcugaagaauu

SEQ ID NO: 98300 - RNA, 19 nt, Homo sapiens
gaaugcugaagaauuugga

SEQ ID NO: 98301 - RNA, 19 nt, Homo sapiens
gagauugugcuggagaaca

SEQ ID NO: 98302 - RNA, 19 nt, Homo sapiens
ggugggagcugguugaauu

SEQ ID NO: 98303 - RNA, 19 nt, Homo sapiens
ggaaugcccuugacaacau

SEQ ID NO: 98304 - RNA, 19 nt, Homo sapiens
gcaagaccaucaacaagau

SEQ ID NO: 98305 - RNA, 19 nt, Homo sapiens
ggagggaggagaaggguua

SEQ ID NO: 98306 - RNA, 19 nt, Homo sapiens
ggaggaaaggguucacaua

SEQ ID NO: 98307 - RNA, 19 nt, Homo sapiens
cggaggagcugauacugaa

SEQ ID NO: 98308 - RNA, 19 nt, Homo sapiens
acacagaggccuauacuga

SEQ ID NO: 98309 - RNA, 19 nt, Homo sapiens
ggaagggcaugggcuagaa

SEQ ID NO: 98310 - RNA, 19 nt, Homo sapiens
gcugaucaaucugcaguuu

SEQ ID NO: 98311 - RNA, 19 nt, Homo sapiens
caauauugauggccaguuc

SEQ ID NO: 98312 - RNA, 19 nt, Homo sapiens
ugacgaaucucaucucacu

SEQ ID NO: 98313 - RNA, 19 nt, Homo sapiens
ccacagucauuucuucuag

SEQ ID NO: 98314 - RNA, 19 nt, Homo sapiens
ccacccaucuccaguagga

SEQ ID NO: 98315 - RNA, 19 nt, Homo sapiens
uaacaaacaggauauccaa

SEQ ID NO: 98316 - RNA, 19 nt, Homo sapiens
ugugagcuaucuaucuaua

SEQ ID NO: 98317 - RNA, 19 nt, Homo sapiens
gaggaaaggguucacauag

SEQ ID NO: 98318 - RNA, 19 nt, Homo sapiens
aaucucaucucacugaaug

SEQ ID NO: 98319 - RNA, 19 nt, Homo sapiens
acgaggaacugcgucuuua

SEQ ID NO: 98320 - RNA, 19 nt, Homo sapiens
agucauuucuucuagguuu

SEQ ID NO: 98321 - RNA, 19 nt, Homo sapiens
cuugugagcuaucuaucua

SEQ ID NO: 98322 - RNA, 19 nt, Homo sapiens
ccaggaaacccucuucuuc

SEQ ID NO: 98323 - RNA, 19 nt, Homo sapiens
cugggcagguuccuuauuu

SEQ ID NO: 98324 - RNA, 19 nt, Homo sapiens
cuacaguacugacagaaag

SEQ ID NO: 98325 - RNA, 19 nt, Homo sapiens
acagaggccuauacugaga

SEQ ID NO: 98326 - RNA, 19 nt, Homo sapiens
ggcaagaccaucaacaaga

SEQ ID NO: 98327 - RNA, 19 nt, Homo sapiens
ugaucaaucugcaguuugu

SEQ ID NO: 98328 - RNA, 19 nt, Homo sapiens
gaaggggaaucauuaaagu

SEQ ID NO: 98329 - RNA, 19 nt, Homo sapiens
gcucucaggugccagucuu

SEQ ID NO: 98330 - RNA, 19 nt, Homo sapiens
gggaaucauuaaagugcuu

SEQ ID NO: 98331 - RNA, 19 nt, Homo sapiens
ggagcugguugaauugucu

SEQ ID NO: 98332 - RNA, 19 nt, Homo sapiens
ggaggagaaggguuacuug

SEQ ID NO: 98333 - RNA, 19 nt, Homo sapiens
cgccguguauccagccuua

SEQ ID NO: 98334 - RNA, 19 nt, Homo sapiens
caccaucucuucaacaacu

SEQ ID NO: 98335 - RNA, 19 nt, Homo sapiens
ccucaggcccacagguuua

SEQ ID NO: 98336 - RNA, 19 nt, Homo sapiens
agacugacgucaucuacuc

SEQ ID NO: 98337 - RNA, 19 nt, Homo sapiens
cuacagcaaggacgacuuu

SEQ ID NO: 98338 - RNA, 19 nt, Homo sapiens
uauccaaggccacuacauu

SEQ ID NO: 98339 - RNA, 19 nt, Homo sapiens
gcggaggagcugauacuga

SEQ ID NO: 98340 - RNA, 19 nt, Homo sapiens
gaaugcccuugacaacauc

SEQ ID NO: 98341 - RNA, 19 nt, Homo sapiens
gaagagguggaguucacuu

SEQ ID NO: 98342 - RNA, 19 nt, Homo sapiens
gaggaacugcgucuuuauc

SEQ ID NO: 98343 - RNA, 19 nt, Homo sapiens
gaggauacugucaccauca

SEQ ID NO: 98344 - RNA, 19 nt, Homo sapiens
cgucgucggugggcuuauu

SEQ ID NO: 98345 - RNA, 19 nt, Homo sapiens
cgaaucucaucucacugaa

SEQ ID NO: 98346 - RNA, 19 nt, Homo sapiens
cugguugaauugucuuuau

SEQ ID NO: 98347 - RNA, 19 nt, Homo sapiens
gugccagucuuccagaaag

SEQ ID NO: 98348 - RNA, 19 nt, Homo sapiens
gcucgcaccgacuucaauu

SEQ ID NO: 98349 - RNA, 19 nt, Homo sapiens
guuccucauugcccagaaa

SEQ ID NO: 98350 - RNA, 19 nt, Homo sapiens
cgagugggccaucgacuuc

SEQ ID NO: 98351 - RNA, 19 nt, Homo sapiens
gacguacaaugccgaagag

SEQ ID NO: 98352 - RNA, 19 nt, Homo sapiens
gcucucagacguacaaugc

SEQ ID NO: 98353 - RNA, 19 nt, Homo sapiens
ggaacugcgucuuuaucac

SEQ ID NO: 98354 - RNA, 19 nt, Homo sapiens
gccgagagcacgagagauc

SEQ ID NO: 98355 - RNA, 19 nt, Homo sapiens
gagguggaguucacuuuug

SEQ ID NO: 98356 - RNA, 19 nt, Homo sapiens
gaacgaggaacugcgucuu

SEQ ID NO: 98357 - RNA, 19 nt, Homo sapiens
caucuccaguaggaaauug

SEQ ID NO: 98358 - RNA, 19 nt, Homo sapiens
gggaaugcccuugacaaca

SEQ ID NO: 98359 - RNA, 19 nt, Homo sapiens
ccgaagagguggaguucac

SEQ ID NO: 98360 - RNA, 19 nt, Homo sapiens
gagcuaucuaucuauauuc

SEQ ID NO: 98361 - RNA, 19 nt, Homo sapiens
acgaaucucaucucacuga

SEQ ID NO: 98362 - RNA, 19 nt, Homo sapiens
ccgcucuucuacgucauua

SEQ ID NO: 98363 - RNA, 19 nt, Homo sapiens
gcgagugggccaucgacuu

SEQ ID NO: 98364 - RNA, 19 nt, Homo sapiens
ccugacgaaucucaucuca

SEQ ID NO: 98365 - RNA, 19 nt, Homo sapiens
acuagcgucuggauuggaa

SEQ ID NO: 98366 - RNA, 19 nt, Homo sapiens
gggaggagaaggguuacuu

SEQ ID NO: 98367 - RNA, 19 nt, Homo sapiens
ugacagaaagcaaggacau

SEQ ID NO: 98368 - RNA, 19 nt, Homo sapiens
gcccugacccuuccacagu

SEQ ID NO: 98369 - RNA, 19 nt, Homo sapiens
ggagacugacgucaucuac

SEQ ID NO: 98370 - RNA, 19 nt, Homo sapiens
ccacuagcgucuggauugg

SEQ ID NO: 98371 - RNA, 19 nt, Homo sapiens
agacguacaaugccgaaga

SEQ ID NO: 98372 - RNA, 19 nt, Homo sapiens
caaggggcguggagaguga

SEQ ID NO: 98373 - RNA, 19 nt, Homo sapiens
uugcugcucacacuauaua

SEQ ID NO: 98374 - RNA, 19 nt, Homo sapiens
gaccucccagccuuucuaa

SEQ ID NO: 98375 - RNA, 19 nt, Homo sapiens
aggaaaggguucacauagg

SEQ ID NO: 98376 - RNA, 19 nt, Homo sapiens
cuacgucauuaacaucauc

SEQ ID NO: 98377 - RNA, 19 nt, Homo sapiens
gggagacugacgucaucua

SEQ ID NO: 98378 - RNA, 19 nt, Homo sapiens
gaaucucaucucacugaau

SEQ ID NO: 98379 - RNA, 19 nt, Homo sapiens
gggaagggcaugggcuaga

SEQ ID NO: 98380 - RNA, 19 nt, Homo sapiens
cgaggaacugcgucuuuau

SEQ ID NO: 98381 - RNA, 19 nt, Homo sapiens
uggaaucgauuggcaggau

SEQ ID NO: 98382 - RNA, 19 nt, Homo sapiens
ggaggagcugauacugaaa

SEQ ID NO: 98383 - RNA, 19 nt, Homo sapiens
gcugguugaauugucuuua

SEQ ID NO: 98384 - RNA, 19 nt, Homo sapiens
gggagcugguugaauuguc

SEQ ID NO: 98385 - RNA, 19 nt, Homo sapiens
gccaggaaacccucuucuu

SEQ ID NO: 98386 - RNA, 19 nt, Homo sapiens
caucuacucgcucaucauc

SEQ ID NO: 98387 - RNA, 19 nt, Homo sapiens
cgacacagaggccuauacu

SEQ ID NO: 98388 - RNA, 19 nt, Homo sapiens
acagucauuucuucuaggu

SEQ ID NO: 98389 - RNA, 19 nt, Homo sapiens
ggaaccaaacaccuucagu

SEQ ID NO: 98390 - RNA, 19 nt, Homo sapiens
aggauuaccgacucaacua

SEQ ID NO: 98391 - RNA, 19 nt, Homo sapiens
ugaccucccagccuuucua

SEQ ID NO: 98392 - RNA, 19 nt, Homo sapiens
ggaaggggaaucauuaaag

SEQ ID NO: 98393 - RNA, 19 nt, Homo sapiens
guuacuugcugcucacacu

SEQ ID NO: 98394 - RNA, 19 nt, Homo sapiens
gcucacacuauauacagau

SEQ ID NO: 98395 - RNA, 19 nt, Homo sapiens
ggauauccaaggccacuac

SEQ ID NO: 98396 - RNA, 19 nt, Homo sapiens
cuuccacagucauuucuuc

SEQ ID NO: 98397 - RNA, 19 nt, Homo sapiens
ggugccagucuuccagaaa

SEQ ID NO: 98398 - RNA, 19 nt, Homo sapiens
gucaucuacucgcucauca

SEQ ID NO: 98399 - RNA, 19 nt, Homo sapiens
gaacugcucccuuaucuuc

SEQ ID NO: 98400 - RNA, 19 nt, Homo sapiens
gcagugaacuccucuucca

SEQ ID NO: 98401 - RNA, 19 nt, Homo sapiens
gcaaguaccugaccuuccu

SEQ ID NO: 98402 - RNA, 19 nt, Homo sapiens
ccaagaaggugccugaaac

SEQ ID NO: 98403 - RNA, 19 nt, Homo sapiens
uggcacagcuggcaucuuc

SEQ ID NO: 98404 - RNA, 19 nt, Homo sapiens
caacguggacggugucuuc

SEQ ID NO: 98405 - RNA, 19 nt, Homo sapiens
cagaacugcucccuuaucu

SEQ ID NO: 98406 - RNA, 19 nt, Homo sapiens
gcaccgaccagccaagaug

SEQ ID NO: 98407 - RNA, 19 nt, Homo sapiens
caccaccaaugucuggaua

SEQ ID NO: 98408 - RNA, 19 nt, Homo sapiens
ccugaggccuucacagaga

SEQ ID NO: 98409 - RNA, 19 nt, Homo sapiens
agacuuacagcaccaauga

SEQ ID NO: 98410 - RNA, 19 nt, Homo sapiens
ggaagcaggccaccagaag

SEQ ID NO: 98411 - RNA, 19 nt, Homo sapiens
ccaccaaugucuggauaga

SEQ ID NO: 98412 - RNA, 19 nt, Homo sapiens
uggagaagcuagagaaagg

SEQ ID NO: 98413 - RNA, 19 nt, Homo sapiens
gccaugcucucgcucuuca

SEQ ID NO: 98414 - RNA, 19 nt, Homo sapiens
uuacagcaccaaugagauu

SEQ ID NO: 98415 - RNA, 19 nt, Homo sapiens
gccaagaaggugccugaaa

SEQ ID NO: 98416 - RNA, 19 nt, Homo sapiens
accaaugucuggauagaga

SEQ ID NO: 98417 - RNA, 19 nt, Homo sapiens
acucggauguggucaaugu

SEQ ID NO: 98418 - RNA, 19 nt, Homo sapiens
ucgcagaccugaugcaaaa

SEQ ID NO: 98419 - RNA, 19 nt, Homo sapiens
ggaagccugcaaccucauu

SEQ ID NO: 98420 - RNA, 19 nt, Homo sapiens
aaaggaaucuccggaacca

SEQ ID NO: 98421 - RNA, 19 nt, Homo sapiens
gcaccagcagagucacuuu

SEQ ID NO: 98422 - RNA, 19 nt, Homo sapiens
aggaagcccucaccaccaa

SEQ ID NO: 98423 - RNA, 19 nt, Homo sapiens
ugucgugaaugcugugguu

SEQ ID NO: 98424 - RNA, 19 nt, Homo sapiens
gcugggauccgcgagacua

SEQ ID NO: 98425 - RNA, 19 nt, Homo sapiens
gaagcccucaccaccaaug

SEQ ID NO: 98426 - RNA, 19 nt, Homo sapiens
gccagaccaucgaguggau

SEQ ID NO: 98427 - RNA, 19 nt, Homo sapiens
cauccucauugucgugaau

SEQ ID NO: 98428 - RNA, 19 nt, Homo sapiens
gaagccugcaaccucauug

SEQ ID NO: 98429 - RNA, 19 nt, Homo sapiens
gcuggagaagcuagagaaa

SEQ ID NO: 98430 - RNA, 19 nt, Homo sapiens
ccucauggcccacuacaac

SEQ ID NO: 98431 - RNA, 19 nt, Homo sapiens
agacucggauguggucaau

SEQ ID NO: 98432 - RNA, 19 nt, Homo sapiens
cggauaucgugcuggagaa

SEQ ID NO: 98433 - RNA, 19 nt, Homo sapiens
ucgaguggauuuucauuga

SEQ ID NO: 98434 - RNA, 19 nt, Homo sapiens
cagaccaucgaguggauuu

SEQ ID NO: 98435 - RNA, 19 nt, Homo sapiens
cgugaaugcugugguugug

SEQ ID NO: 98436 - RNA, 19 nt, Homo sapiens
gaagaugccuguuaauuua

SEQ ID NO: 98437 - RNA, 19 nt, Homo sapiens
gaacugaccuugaaucuuu

SEQ ID NO: 98438 - RNA, 19 nt, Homo sapiens
gaacugccuuggccauuua

SEQ ID NO: 98439 - RNA, 19 nt, Homo sapiens
gaagaaggauccaaagugu

SEQ ID NO: 98440 - RNA, 19 nt, Homo sapiens
gaacagggcaauaguauga

SEQ ID NO: 98441 - RNA, 19 nt, Homo sapiens
gaaguggcccucaguaaua

SEQ ID NO: 98442 - RNA, 19 nt, Homo sapiens
guacacauccuaaauauga

SEQ ID NO: 98443 - RNA, 19 nt, Homo sapiens
gaagaacacuuugaucuca

SEQ ID NO: 98444 - RNA, 19 nt, Homo sapiens
caaagaagcugacaauacu

SEQ ID NO: 98445 - RNA, 19 nt, Homo sapiens
ccagauacuuucuuuacua

SEQ ID NO: 98446 - RNA, 19 nt, Homo sapiens
ggaaagaaauggaagaaaa

SEQ ID NO: 98447 - RNA, 19 nt, Homo sapiens
gcaauaguaugaugaaucu

SEQ ID NO: 98448 - RNA, 19 nt, Homo sapiens
ggugagggcugguuaaugu

SEQ ID NO: 98449 - RNA, 19 nt, Homo sapiens
gcacagagauggugaaaau

SEQ ID NO: 98450 - RNA, 19 nt, Homo sapiens
gaaaccagccucucaaugu

SEQ ID NO: 98451 - RNA, 19 nt, Homo sapiens
ccagagcucuuugagaaua

SEQ ID NO: 98452 - RNA, 19 nt, Homo sapiens
ggaguuagaggcugugaua

SEQ ID NO: 98453 - RNA, 19 nt, Homo sapiens
gaaauauggcaucuccuua

SEQ ID NO: 98454 - RNA, 19 nt, Homo sapiens
gaagauaguacacauccua

SEQ ID NO: 98455 - RNA, 19 nt, Homo sapiens
acaaagggcagcaauguua

SEQ ID NO: 98456 - RNA, 19 nt, Homo sapiens
gccaagauguuuuguauua

SEQ ID NO: 98457 - RNA, 19 nt, Homo sapiens
ggauguugguggaaagaua

SEQ ID NO: 98458 - RNA, 19 nt, Homo sapiens
ggucugggauucgauauuu

SEQ ID NO: 98459 - RNA, 19 nt, Homo sapiens
cacaacaacugaaagcuaa

SEQ ID NO: 98460 - RNA, 19 nt, Homo sapiens
aaacauaguucuucaggau

SEQ ID NO: 98461 - RNA, 19 nt, Homo sapiens
gcauucagcuugacuugga

SEQ ID NO: 98462 - RNA, 19 nt, Homo sapiens
ugugauagcuauaugguuu

SEQ ID NO: 98463 - RNA, 19 nt, Homo sapiens
gcagaugacguaugggaua

SEQ ID NO: 98464 - RNA, 19 nt, Homo sapiens
gcagcaauguuaagucuuc

SEQ ID NO: 98465 - RNA, 19 nt, Homo sapiens
ggaagucuguguacaucuu

SEQ ID NO: 98466 - RNA, 19 nt, Homo sapiens
ucuaucaucugcuaaguaa

SEQ ID NO: 98467 - RNA, 19 nt, Homo sapiens
ggaccucuaucaucugcua

SEQ ID NO: 98468 - RNA, 19 nt, Homo sapiens
aagagaagaugccuguuaa

SEQ ID NO: 98469 - RNA, 19 nt, Homo sapiens
ucacuacagucucguauug

SEQ ID NO: 98470 - RNA, 19 nt, Homo sapiens
gaagagaugucaggagaag

SEQ ID NO: 98471 - RNA, 19 nt, Homo sapiens
guaaaggccugugauguuc

SEQ ID NO: 98472 - RNA, 19 nt, Homo sapiens
gagaagaugccuguuaauu

SEQ ID NO: 98473 - RNA, 19 nt, Homo sapiens
cagaaugaguugucacuug

SEQ ID NO: 98474 - RNA, 19 nt, Homo sapiens
gcgugaaacuggaauaaau

SEQ ID NO: 98475 - RNA, 19 nt, Homo sapiens
gaaaauuguuguggacuua

SEQ ID NO: 98476 - RNA, 19 nt, Homo sapiens
aaagagaagaugccuguua

SEQ ID NO: 98477 - RNA, 19 nt, Homo sapiens
gcacaaaugauagaagaaa

SEQ ID NO: 98478 - RNA, 19 nt, Homo sapiens
ggagaaguucgguuuagua

SEQ ID NO: 98479 - RNA, 19 nt, Homo sapiens
cagcacaaaugauagaaga

SEQ ID NO: 98480 - RNA, 19 nt, Homo sapiens
gaaccaugccaauguugua

SEQ ID NO: 98481 - RNA, 19 nt, Homo sapiens
aaucugaacugaccuugaa

SEQ ID NO: 98482 - RNA, 19 nt, Homo sapiens
agaagaugccuguuaauuu

SEQ ID NO: 98483 - RNA, 19 nt, Homo sapiens
gaagaaauggcuaugaaca

SEQ ID NO: 98484 - RNA, 19 nt, Homo sapiens
uauggaaguuguugcuaua

SEQ ID NO: 98485 - RNA, 19 nt, Homo sapiens
ccauuuaccuggcaugaga

SEQ ID NO: 98486 - RNA, 19 nt, Homo sapiens
ccacagcuauuuagaagca

SEQ ID NO: 98487 - RNA, 19 nt, Homo sapiens
gcaaguuguugggcuguaa

SEQ ID NO: 98488 - RNA, 19 nt, Homo sapiens
caaagauguugaucaagga

SEQ ID NO: 98489 - RNA, 19 nt, Homo sapiens
ggucugcacuccuuuaucu

SEQ ID NO: 98490 - RNA, 19 nt, Homo sapiens
ggaaguggcccucaguaau

SEQ ID NO: 98491 - RNA, 19 nt, Homo sapiens
guaagcagaagauuauuga

SEQ ID NO: 98492 - RNA, 19 nt, Homo sapiens
uaugggauaucuucagaaa

SEQ ID NO: 98493 - RNA, 19 nt, Homo sapiens
ggacaaagggcagcaaugu

SEQ ID NO: 98494 - RNA, 19 nt, Homo sapiens
gaucaaggaagucugugua

SEQ ID NO: 98495 - RNA, 19 nt, Homo sapiens
ggaguugguuaacagaaug

SEQ ID NO: 98496 - RNA, 19 nt, Homo sapiens
aggaucagauuaugucuuu

SEQ ID NO: 98497 - RNA, 19 nt, Homo sapiens
gaucucagcaucacaacaa

SEQ ID NO: 98498 - RNA, 19 nt, Homo sapiens
gauauagggucugggauuc

SEQ ID NO: 98499 - RNA, 19 nt, Homo sapiens
ggaguugguguaaucauuu

SEQ ID NO: 98500 - RNA, 19 nt, Homo sapiens
uggaagaaauggcuaugaa

SEQ ID NO: 98501 - RNA, 19 nt, Homo sapiens
gcuguaagcagaagauuau

SEQ ID NO: 98502 - RNA, 19 nt, Homo sapiens
gcucacaaguucuauuucu

SEQ ID NO: 98503 - RNA, 19 nt, Homo sapiens
agaaauggcuaugaacaga

SEQ ID NO: 98504 - RNA, 19 nt, Homo sapiens
ggaaguuguugcuauacau

SEQ ID NO: 98505 - RNA, 19 nt, Homo sapiens
gaauaaauacugguucuca

SEQ ID NO: 98506 - RNA, 19 nt, Homo sapiens
uaugacuucugcaaagaua

SEQ ID NO: 98507 - RNA, 19 nt, Homo sapiens
guuguuguguguauaugua

SEQ ID NO: 98508 - RNA, 19 nt, Homo sapiens
gcgagcagaugacguaugg

SEQ ID NO: 98509 - RNA, 19 nt, Homo sapiens
gauaguacacauccuaaau

SEQ ID NO: 98510 - RNA, 19 nt, Homo sapiens
gguggaaagauaauacaua

SEQ ID NO: 98511 - RNA, 19 nt, Homo sapiens
gaacaugaucauucucugu

SEQ ID NO: 98512 - RNA, 19 nt, Homo sapiens
gaaacuggaauaaauacug

SEQ ID NO: 98513 - RNA, 19 nt, Homo sapiens
cagccacuguugauuauug

SEQ ID NO: 98514 - RNA, 19 nt, Homo sapiens
aaacagacaggaauuuaga

SEQ ID NO: 98515 - RNA, 19 nt, Homo sapiens
gaggaacagggcaauagua

SEQ ID NO: 98516 - RNA, 19 nt, Homo sapiens
aaauaugacuucugcaaag

SEQ ID NO: 98517 - RNA, 19 nt, Homo sapiens
caucaucugcagccauuua

SEQ ID NO: 98518 - RNA, 19 nt, Homo sapiens
ggaccaugguauuugaaug

SEQ ID NO: 98519 - RNA, 19 nt, Homo sapiens
gaaagcugcucaacaaacc

SEQ ID NO: 98520 - RNA, 19 nt, Homo sapiens
uccgaaagcugcucaacaa

SEQ ID NO: 98521 - RNA, 19 nt, Homo sapiens
cagcagaacaugaucauuc

SEQ ID NO: 98522 - RNA, 19 nt, Homo sapiens
ucaaagaagcugacaauac

SEQ ID NO: 98523 - RNA, 19 nt, Homo sapiens
ggagcuguuuggucauuug

SEQ ID NO: 98524 - RNA, 19 nt, Homo sapiens
ccauugaucuauauaagca

SEQ ID NO: 98525 - RNA, 19 nt, Homo sapiens
gcaauggaauacuguucug

SEQ ID NO: 98526 - RNA, 19 nt, Homo sapiens
gaacagcgugccauugauc

SEQ ID NO: 98527 - RNA, 19 nt, Homo sapiens
gcaaucuaaucugaacuga

SEQ ID NO: 98528 - RNA, 19 nt, Homo sapiens
gaagaaaaccucaaguaau

SEQ ID NO: 98529 - RNA, 19 nt, Homo sapiens
aaauggcuaugaacagaaa

SEQ ID NO: 98530 - RNA, 19 nt, Homo sapiens
gaaauggcuaugaacagaa

SEQ ID NO: 98531 - RNA, 19 nt, Homo sapiens
agaaugaguugucacuugu

SEQ ID NO: 98532 - RNA, 19 nt, Homo sapiens
ugaacugccuuggccauuu

SEQ ID NO: 98533 - RNA, 19 nt, Homo sapiens
aaauauggcaucuccuuaa

SEQ ID NO: 98534 - RNA, 19 nt, Homo sapiens
gggcagcaauguuaagucu

SEQ ID NO: 98535 - RNA, 19 nt, Homo sapiens
gcagagaggaggaccuguu

SEQ ID NO: 98536 - RNA, 19 nt, Homo sapiens
caacacgcauuucaugauc

SEQ ID NO: 98537 - RNA, 19 nt, Homo sapiens
ggagacaacacgcauuuca

SEQ ID NO: 98538 - RNA, 19 nt, Homo sapiens
gacaguuucucaucuaucu

SEQ ID NO: 98539 - RNA, 19 nt, Homo sapiens
ucaucuaucugggcacaua

SEQ ID NO: 98540 - RNA, 19 nt, Homo sapiens
gcauccagcucgcccuuuc

SEQ ID NO: 98541 - RNA, 19 nt, Homo sapiens
ugaaggccaccauguauga

SEQ ID NO: 98542 - RNA, 19 nt, Homo sapiens
ggugcuggaugacaaggaa

SEQ ID NO: 98543 - RNA, 19 nt, Homo sapiens
ugcaggagcucaucagcaa

SEQ ID NO: 98544 - RNA, 19 nt, Homo sapiens
cgggacaguuucucaucua

SEQ ID NO: 98545 - RNA, 19 nt, Homo sapiens
gacaacacgcauuucauga

SEQ ID NO: 98546 - RNA, 19 nt, Homo sapiens
gggacaguuucucaucuau

SEQ ID NO: 98547 - RNA, 19 nt, Homo sapiens
uuuaugggaucacagacua

SEQ ID NO: 98548 - RNA, 19 nt, Homo sapiens
ccaggugacgggacaguuu

SEQ ID NO: 98549 - RNA, 19 nt, Homo sapiens
agacaacacgcauuucaug

SEQ ID NO: 98550 - RNA, 19 nt, Homo sapiens
gaauagcgagagucaccuu

SEQ ID NO: 98551 - RNA, 19 nt, Homo sapiens
gacuucaucggcugccuua

SEQ ID NO: 98552 - RNA, 19 nt, Homo sapiens
acacgcauuucaugaucuu

SEQ ID NO: 98553 - RNA, 19 nt, Homo sapiens
cgugaaggccaccauguau

SEQ ID NO: 98554 - RNA, 19 nt, Homo sapiens
ugacauuuaugggaucaca

SEQ ID NO: 98555 - RNA, 19 nt, Homo sapiens
ggacaguuucucaucuauc

SEQ ID NO: 98556 - RNA, 19 nt, Homo sapiens
cuaccggacuggucacucu

SEQ ID NO: 98557 - RNA, 19 nt, Homo sapiens
ggucgggaauagcgagagu

SEQ ID NO: 98558 - RNA, 19 nt, Homo sapiens
gagacaacacgcauuucau

SEQ ID NO: 98559 - RNA, 19 nt, Homo sapiens
uuucagaccuugggagaca

SEQ ID NO: 98560 - RNA, 19 nt, Homo sapiens
caggagcucaucagcaaga

SEQ ID NO: 98561 - RNA, 19 nt, Homo sapiens
gcagguucacguguggaua

SEQ ID NO: 98562 - RNA, 19 nt, Homo sapiens
ugggagacaacacgcauuu

SEQ ID NO: 98563 - RNA, 19 nt, Homo sapiens
gguggacacagaagaguuc

SEQ ID NO: 98564 - RNA, 19 nt, Homo sapiens
caccauguaugagauguac

SEQ ID NO: 98565 - RNA, 19 nt, Homo sapiens
gugaaggccaccauguaug

SEQ ID NO: 98566 - RNA, 19 nt, Homo sapiens
uagcgagagucaccuucga

SEQ ID NO: 98567 - RNA, 19 nt, Homo sapiens
acaacacgcauuucaugau

SEQ ID NO: 98568 - RNA, 19 nt, Homo sapiens
gaaacucucuucaagucua

SEQ ID NO: 98569 - RNA, 19 nt, Homo sapiens
ccucaugccugcccagaaa

SEQ ID NO: 98570 - RNA, 19 nt, Homo sapiens
gagugaagcugcucaucga

SEQ ID NO: 98571 - RNA, 19 nt, Homo sapiens
gggcaggugugcauaucaa

SEQ ID NO: 98572 - RNA, 19 nt, Homo sapiens
gcacaagaccgaccucaac

SEQ ID NO: 98573 - RNA, 19 nt, Homo sapiens
gcucaucgacgaccacuuc

SEQ ID NO: 98574 - RNA, 19 nt, Homo sapiens
gggcaagcaugagaaguuc

SEQ ID NO: 98575 - RNA, 19 nt, Homo sapiens
aaacucucuucaagucuaa

SEQ ID NO: 98576 - RNA, 19 nt, Homo sapiens
gcuacaagcccagcgauga

SEQ ID NO: 98577 - RNA, 19 nt, Homo sapiens
gcugcuuccuaacuuauug

SEQ ID NO: 98578 - RNA, 19 nt, Homo sapiens
gccaugcccuucuccaaca

SEQ ID NO: 98579 - RNA, 19 nt, Homo sapiens
ucacccagauugaaacucu

SEQ ID NO: 98580 - RNA, 19 nt, Homo sapiens
ccuacgaaguguucaagga

SEQ ID NO: 98581 - RNA, 19 nt, Homo sapiens
gaccugagcgcccacaaca

SEQ ID NO: 98582 - RNA, 19 nt, Homo sapiens
ugaagcugcucaucgagau

SEQ ID NO: 98583 - RNA, 19 nt, Homo sapiens
ccugcugcuuccuaacuua

SEQ ID NO: 98584 - RNA, 19 nt, Homo sapiens
cgcgguaucuggcacaaug

SEQ ID NO: 98585 - RNA, 19 nt, Homo sapiens
ggccacccguacaucauga

SEQ ID NO: 98586 - RNA, 19 nt, Homo sapiens
ggccaucgacgaccucaug

SEQ ID NO: 98587 - RNA, 19 nt, Homo sapiens
gcccuuagccuugcuguag

SEQ ID NO: 98588 - RNA, 19 nt, Homo sapiens
gaaguucucggaggugcuu

SEQ ID NO: 98589 - RNA, 19 nt, Homo sapiens
ggaguccuacgaaguguuc

SEQ ID NO: 98590 - RNA, 19 nt, Homo sapiens
cgacgaccacuuccucuuc

SEQ ID NO: 98591 - RNA, 19 nt, Homo sapiens
cugcugaugcugaaauaaa

SEQ ID NO: 98592 - RNA, 19 nt, Homo sapiens
ggccucacccagauugaaa

SEQ ID NO: 98593 - RNA, 19 nt, Homo sapiens
gauacuacgcgcucaagag

SEQ ID NO: 98594 - RNA, 19 nt, Homo sapiens
agauacugcugaugcugaa

SEQ ID NO: 98595 - RNA, 19 nt, Homo sapiens
uacugcugaugcugaaaua

SEQ ID NO: 98596 - RNA, 19 nt, Homo sapiens
acaaugacaauaagaccuu

SEQ ID NO: 98597 - RNA, 19 nt, Homo sapiens
gcccagcgaugagcacaag

SEQ ID NO: 98598 - RNA, 19 nt, Homo sapiens
uggcuaagauacugcugau

SEQ ID NO: 98599 - RNA, 19 nt, Homo sapiens
cgucacccuugguagaguu

SEQ ID NO: 98600 - RNA, 19 nt, Homo sapiens
ucuaaggacuaugaguuca

SEQ ID NO: 98601 - RNA, 19 nt, Homo sapiens
uuaagcggcugcgacuuca

SEQ ID NO: 98602 - RNA, 19 nt, Homo sapiens
gcgggcaggugugcauauc

SEQ ID NO: 98603 - RNA, 19 nt, Homo sapiens
cuaagauacugcugaugcu

SEQ ID NO: 98604 - RNA, 19 nt, Homo sapiens
agguggagcuggugcagau

SEQ ID NO: 98605 - RNA, 19 nt, Homo sapiens
ugggcaagcaugagaaguu

SEQ ID NO: 98606 - RNA, 19 nt, Homo sapiens
ucuggcacaaugacaauaa

SEQ ID NO: 98607 - RNA, 19 nt, Homo sapiens
guaucuggcacaaugacaa

SEQ ID NO: 98608 - RNA, 19 nt, Homo sapiens
cuacgaaguguucaaggau

SEQ ID NO: 98609 - RNA, 19 nt, Homo sapiens
acaaccacauggccaaggu

SEQ ID NO: 98610 - RNA, 19 nt, Homo sapiens
gagcuucgcugaacguuaa

SEQ ID NO: 98611 - RNA, 19 nt, Homo sapiens
gaacguuaauguguaguaa

SEQ ID NO: 98612 - RNA, 19 nt, Homo sapiens
gagcaggucuucucaaagu

SEQ ID NO: 98613 - RNA, 19 nt, Homo sapiens
guaaaugcaccuccuugua

SEQ ID NO: 98614 - RNA, 19 nt, Homo sapiens
cuccaucgauguuguauuu

SEQ ID NO: 98615 - RNA, 19 nt, Homo sapiens
uaaaugcaccuccuuguau

SEQ ID NO: 98616 - RNA, 19 nt, Homo sapiens
gggauggccucguuacuag

SEQ ID NO: 98617 - RNA, 19 nt, Homo sapiens
uccaauggcuguguguuua

SEQ ID NO: 98618 - RNA, 19 nt, Homo sapiens
aaaugcaccuccuuguauu

SEQ ID NO: 98619 - RNA, 19 nt, Homo sapiens
gcaggcaagucgucagaca

SEQ ID NO: 98620 - RNA, 19 nt, Homo sapiens
gaacauugacgacgcuaag

SEQ ID NO: 98621 - RNA, 19 nt, Homo sapiens
uggagcaggucuucucaaa

SEQ ID NO: 98622 - RNA, 19 nt, Homo sapiens
gcuguguguuuaaagauug

SEQ ID NO: 98623 - RNA, 19 nt, Homo sapiens
caagaucguccuuccaaug

SEQ ID NO: 98624 - RNA, 19 nt, Homo sapiens
caauggcuguguguuuaaa

SEQ ID NO: 98625 - RNA, 19 nt, Homo sapiens
gcugaacguuaauguguag

SEQ ID NO: 98626 - RNA, 19 nt, Homo sapiens
ccagagaucucggggauuu

SEQ ID NO: 98627 - RNA, 19 nt, Homo sapiens
uaaaagaccgugugaaaug

SEQ ID NO: 98628 - RNA, 19 nt, Homo sapiens
gcaguuuucuuuggcuuua

SEQ ID NO: 98629 - RNA, 19 nt, Homo sapiens
ucagaugaaggcaaacuuu

SEQ ID NO: 98630 - RNA, 19 nt, Homo sapiens
gagacaguuacgacaguua

SEQ ID NO: 98631 - RNA, 19 nt, Homo sapiens
gaccacgagccaugaguuu

SEQ ID NO: 98632 - RNA, 19 nt, Homo sapiens
guucugaucuugucaaacc

SEQ ID NO: 98633 - RNA, 19 nt, Homo sapiens
guagucauuucgguucuga

SEQ ID NO: 98634 - RNA, 19 nt, Homo sapiens
gguccuacagagacaguua

SEQ ID NO: 98635 - RNA, 19 nt, Homo sapiens
guuaauguguaguaaaugc

SEQ ID NO: 98636 - RNA, 19 nt, Homo sapiens
gauuuggguuugucaccuu

SEQ ID NO: 98637 - RNA, 19 nt, Homo sapiens
ggaauucuuguacgcaguu

SEQ ID NO: 98638 - RNA, 19 nt, Homo sapiens
ucauuucgguucugaucuu

SEQ ID NO: 98639 - RNA, 19 nt, Homo sapiens
uauagcagccggagucaga

SEQ ID NO: 98640 - RNA, 19 nt, Homo sapiens
gagaucgaacggacuguga

SEQ ID NO: 98641 - RNA, 19 nt, Homo sapiens
ggagcuucgcugaacguua

SEQ ID NO: 98642 - RNA, 19 nt, Homo sapiens
ggcuguguguuuaaagauu

SEQ ID NO: 98643 - RNA, 19 nt, Homo sapiens
ccaacuccgugugacguuu

SEQ ID NO: 98644 - RNA, 19 nt, Homo sapiens
ccacuuucguagucauuuc

SEQ ID NO: 98645 - RNA, 19 nt, Homo sapiens
ccaauggcuguguguuuaa

SEQ ID NO: 98646 - RNA, 19 nt, Homo sapiens
cagagacaguuacgacagu

SEQ ID NO: 98647 - RNA, 19 nt, Homo sapiens
ugggaagucuguagaugga

SEQ ID NO: 98648 - RNA, 19 nt, Homo sapiens
gaauucuuguacgcaguuu

SEQ ID NO: 98649 - RNA, 19 nt, Homo sapiens
cuccuuguauucccacuuu

SEQ ID NO: 98650 - RNA, 19 nt, Homo sapiens
ucagagugguggcuacagu

SEQ ID NO: 98651 - RNA, 19 nt, Homo sapiens
ggccguggguucucuagag

SEQ ID NO: 98652 - RNA, 19 nt, Homo sapiens
gaaugggaagucuguagau

SEQ ID NO: 98653 - RNA, 19 nt, Homo sapiens
gacugugaauccgcucuuu

SEQ ID NO: 98654 - RNA, 19 nt, Homo sapiens
ugaaguggugguugugaaa

SEQ ID NO: 98655 - RNA, 19 nt, Homo sapiens
guacgcauacuccaucgau

SEQ ID NO: 98656 - RNA, 19 nt, Homo sapiens
ggacggcagauccgaguag

SEQ ID NO: 98657 - RNA, 19 nt, Homo sapiens
ucucugaaguggugguugu

SEQ ID NO: 98658 - RNA, 19 nt, Homo sapiens
ugcaguggcugaggaauuc

SEQ ID NO: 98659 - RNA, 19 nt, Homo sapiens
gaucgaacggacugugaau

SEQ ID NO: 98660 - RNA, 19 nt, Homo sapiens
ucaagaucguccuuccaau

SEQ ID NO: 98661 - RNA, 19 nt, Homo sapiens
cauacuccaucgauguugu

SEQ ID NO: 98662 - RNA, 19 nt, Homo sapiens
cgggauggccucguuacua

SEQ ID NO: 98663 - RNA, 19 nt, Homo sapiens
acuggaagacguacgcaua

SEQ ID NO: 98664 - RNA, 19 nt, Homo sapiens
cgcugaacguuaaugugua

SEQ ID NO: 98665 - RNA, 19 nt, Homo sapiens
ugaaugggaagucuguaga

SEQ ID NO: 98666 - RNA, 19 nt, Homo sapiens
ggaagacguacgcauacuc

SEQ ID NO: 98667 - RNA, 19 nt, Homo sapiens
uuacgacaguuacgcuaca

SEQ ID NO: 98668 - RNA, 19 nt, Homo sapiens
cugaaguggugguugugaa

SEQ ID NO: 98669 - RNA, 19 nt, Homo sapiens
gacggcagauccgaguaga

SEQ ID NO: 98670 - RNA, 19 nt, Homo sapiens
uggcugaggaauucuugua

SEQ ID NO: 98671 - RNA, 19 nt, Homo sapiens
caucgauguuguauuugca

SEQ ID NO: 98672 - RNA, 19 nt, Homo sapiens
ugaacguuaauguguagua

SEQ ID NO: 98673 - RNA, 19 nt, Homo sapiens
ucgcugaacguuaaugugu

SEQ ID NO: 98674 - RNA, 19 nt, Homo sapiens
gcaggucuucucaaaguac

SEQ ID NO: 98675 - RNA, 19 nt, Homo sapiens
ccaucgauguuguauuugc

SEQ ID NO: 98676 - RNA, 19 nt, Homo sapiens
aaugggaagucuguagaug

SEQ ID NO: 98677 - RNA, 19 nt, Homo sapiens
cgcuaaggaugccaugaug

SEQ ID NO: 98678 - RNA, 19 nt, Homo sapiens
ggacugugaauccgcucuu

SEQ ID NO: 98679 - RNA, 19 nt, Homo sapiens
acaguuacgcuacacacaa

SEQ ID NO: 98680 - RNA, 19 nt, Homo sapiens
acagggagacccagagauc

SEQ ID NO: 98681 - RNA, 19 nt, Homo sapiens
aaguggugguugugaaaga

SEQ ID NO: 98682 - RNA, 19 nt, Homo sapiens
guaguaaaugcaccuccuu

SEQ ID NO: 98683 - RNA, 19 nt, Homo sapiens
agagacaguuacgacaguu

SEQ ID NO: 98684 - RNA, 19 nt, Homo sapiens
gugugacguuucugagugu

SEQ ID NO: 98685 - RNA, 19 nt, Homo sapiens
caguuacgcuacacacaac

SEQ ID NO: 98686 - RNA, 19 nt, Homo sapiens
ggagcaggucuucucaaag

SEQ ID NO: 98687 - RNA, 19 nt, Homo sapiens
ugacguuucugaguguagu

SEQ ID NO: 98688 - RNA, 19 nt, Homo sapiens
ucaaaguacggacagaucu

SEQ ID NO: 98689 - RNA, 19 nt, Homo sapiens
gaaguggugguugugaaag

SEQ ID NO: 98690 - RNA, 19 nt, Homo sapiens
gcacacacauguaccuaga

SEQ ID NO: 98691 - RNA, 19 nt, Homo sapiens
gcauguggcuucauuauac

SEQ ID NO: 98692 - RNA, 19 nt, Homo sapiens
gcauagagcuggucucacu

SEQ ID NO: 98693 - RNA, 19 nt, Homo sapiens
gaucgacagugacuaguga

SEQ ID NO: 98694 - RNA, 19 nt, Homo sapiens
gacaacaccugcagaagau

SEQ ID NO: 98695 - RNA, 19 nt, Homo sapiens
agaaauacacgucugauaa

SEQ ID NO: 98696 - RNA, 19 nt, Homo sapiens
ucacacaacuuggagguaa

SEQ ID NO: 98697 - RNA, 19 nt, Homo sapiens
ggacaacuacaauagguaa

SEQ ID NO: 98698 - RNA, 19 nt, Homo sapiens
gagaaauacacgucugaua

SEQ ID NO: 98699 - RNA, 19 nt, Homo sapiens
gcccagaccucguccuuug

SEQ ID NO: 98700 - RNA, 19 nt, Homo sapiens
gaaggcacguucuuaguac

SEQ ID NO: 98701 - RNA, 19 nt, Homo sapiens
gaaauacacgucugauaag

SEQ ID NO: 98702 - RNA, 19 nt, Homo sapiens
gcacaugagaggagagaaa

SEQ ID NO: 98703 - RNA, 19 nt, Homo sapiens
cagcagagccugugucuca

SEQ ID NO: 98704 - RNA, 19 nt, Homo sapiens
gaaagcccauccugagaca

SEQ ID NO: 98705 - RNA, 19 nt, Homo sapiens
caacuacaauagguaagaa

SEQ ID NO: 98706 - RNA, 19 nt, Homo sapiens
cgacaacaccugcagaaga

SEQ ID NO: 98707 - RNA, 19 nt, Homo sapiens
cuaggggacugcacaauua

SEQ ID NO: 98708 - RNA, 19 nt, Homo sapiens
ccacugcuguacaccuaaa

SEQ ID NO: 98709 - RNA, 19 nt, Homo sapiens
gagagaaauacacgucuga

SEQ ID NO: 98710 - RNA, 19 nt, Homo sapiens
agacagagagugagccaaa

SEQ ID NO: 98711 - RNA, 19 nt, Homo sapiens
cugauaagacuucaugaaa

SEQ ID NO: 98712 - RNA, 19 nt, Homo sapiens
aaauacacgucugauaaga

SEQ ID NO: 98713 - RNA, 19 nt, Homo sapiens
gaauguguccacucucuuc

SEQ ID NO: 98714 - RNA, 19 nt, Homo sapiens
ggccgcauguggcuucauu

SEQ ID NO: 98715 - RNA, 19 nt, Homo sapiens
gaagagccagcaagagcaa

SEQ ID NO: 98716 - RNA, 19 nt, Homo sapiens
gaacaguuugguggucuuu

SEQ ID NO: 98717 - RNA, 19 nt, Homo sapiens
ggauggacaacuacaauag

SEQ ID NO: 98718 - RNA, 19 nt, Homo sapiens
gggagugccugugcuguca

SEQ ID NO: 98719 - RNA, 19 nt, Homo sapiens
gaggauggacaacuacaau

SEQ ID NO: 98720 - RNA, 19 nt, Homo sapiens
ccgacuaccuccgacagua

SEQ ID NO: 98721 - RNA, 19 nt, Homo sapiens
gugaauguguccacucucu

SEQ ID NO: 98722 - RNA, 19 nt, Homo sapiens
ucgggaaucuggcugguau

SEQ ID NO: 98723 - RNA, 19 nt, Homo sapiens
gcagaggaacugagaucga

SEQ ID NO: 98724 - RNA, 19 nt, Homo sapiens
aggaugacaugcagaggaa

SEQ ID NO: 98725 - RNA, 19 nt, Homo sapiens
gaggaucugcugugcauag

SEQ ID NO: 98726 - RNA, 19 nt, Homo sapiens
gcagccagccucuguuucu

SEQ ID NO: 98727 - RNA, 19 nt, Homo sapiens
ccaggaagagccagcaaga

SEQ ID NO: 98728 - RNA, 19 nt, Homo sapiens
gcauccuggugccugcaua

SEQ ID NO: 98729 - RNA, 19 nt, Homo sapiens
ccaccaugaugaugacaca

SEQ ID NO: 98730 - RNA, 19 nt, Homo sapiens
uagccaagaccuucuccua

SEQ ID NO: 98731 - RNA, 19 nt, Homo sapiens
gggcuacuguuggguguca

SEQ ID NO: 98732 - RNA, 19 nt, Homo sapiens
ggaggauggacaacuacaa

SEQ ID NO: 98733 - RNA, 19 nt, Homo sapiens
cacacaacuuggagguaaa

SEQ ID NO: 98734 - RNA, 19 nt, Homo sapiens
gggaaucuggcugguauug

SEQ ID NO: 98735 - RNA, 19 nt, Homo sapiens
ggccaccacugcaguucug

SEQ ID NO: 98736 - RNA, 19 nt, Homo sapiens
caaagcgggcacacacaug

SEQ ID NO: 98737 - RNA, 19 nt, Homo sapiens
cugcacaauuauacacuau

SEQ ID NO: 98738 - RNA, 19 nt, Homo sapiens
gagacaggcaggaccuugu

SEQ ID NO: 98739 - RNA, 19 nt, Homo sapiens
acacacauguaccuagaac

SEQ ID NO: 98740 - RNA, 19 nt, Homo sapiens
ugagaucgacagugacuag

SEQ ID NO: 98741 - RNA, 19 nt, Homo sapiens
aggaggaucugcugugcau

SEQ ID NO: 98742 - RNA, 19 nt, Homo sapiens
ugcccuggcuucucugguu

SEQ ID NO: 98743 - RNA, 19 nt, Homo sapiens
cgcauguggcuucauuaua

SEQ ID NO: 98744 - RNA, 19 nt, Homo sapiens
uaaggaggaugcgccuagu

SEQ ID NO: 98745 - RNA, 19 nt, Homo sapiens
gacagagagugagccaaag

SEQ ID NO: 98746 - RNA, 19 nt, Homo sapiens
ccaaagcgggcacacacau

SEQ ID NO: 98747 - RNA, 19 nt, Homo sapiens
ggugucagggaacaaaguu

SEQ ID NO: 98748 - RNA, 19 nt, Homo sapiens
ugacacagccauggacaca

SEQ ID NO: 98749 - RNA, 19 nt, Homo sapiens
ggacugcacaauuauacac

SEQ ID NO: 98750 - RNA, 19 nt, Homo sapiens
gcacucucagcccugguuu

SEQ ID NO: 98751 - RNA, 19 nt, Homo sapiens
ucugauaagacuucaugaa

SEQ ID NO: 98752 - RNA, 19 nt, Homo sapiens
caugagaggagagaaauac

SEQ ID NO: 98753 - RNA, 19 nt, Homo sapiens
agccacugcuguacaccua

SEQ ID NO: 98754 - RNA, 19 nt, Homo sapiens
aggauggacaacuacaaua

SEQ ID NO: 98755 - RNA, 19 nt, Homo sapiens
ccgcauguggcuucauuau

SEQ ID NO: 98756 - RNA, 19 nt, Homo sapiens
gauggacaacuacaauagg

SEQ ID NO: 98757 - RNA, 19 nt, Homo sapiens
ccacccgucugugaaugug

SEQ ID NO: 98758 - RNA, 19 nt, Homo sapiens
gagccaaccccaccucuau

SEQ ID NO: 98759 - RNA, 19 nt, Homo sapiens
acugcacaauuauacacua

SEQ ID NO: 98760 - RNA, 19 nt, Homo sapiens
cuggccaccugaacuguau

SEQ ID NO: 98761 - RNA, 19 nt, Homo sapiens
gcauguggcuucauuauac

SEQ ID NO: 98762 - RNA, 19 nt, Homo sapiens
gcauagagcuggucucacu

SEQ ID NO: 98763 - RNA, 19 nt, Homo sapiens
gaucgacagugacuaguga

SEQ ID NO: 98764 - RNA, 19 nt, Homo sapiens
gacaacaccugcagaagau

SEQ ID NO: 98765 - RNA, 19 nt, Homo sapiens
agaaauacacgucugauaa

SEQ ID NO: 98766 - RNA, 19 nt, Homo sapiens
ucacacaacuuggagguaa

SEQ ID NO: 98767 - RNA, 19 nt, Homo sapiens
ggacaacuacaauagguaa

SEQ ID NO: 98768 - RNA, 19 nt, Homo sapiens
gagaaauacacgucugaua

SEQ ID NO: 98769 - RNA, 19 nt, Homo sapiens
gaaggcacguucuuaguac

SEQ ID NO: 98770 - RNA, 19 nt, Homo sapiens
gaaauacacgucugauaag

SEQ ID NO: 98771 - RNA, 19 nt, Homo sapiens
gcacaugagaggagagaaa

SEQ ID NO: 98772 - RNA, 19 nt, Homo sapiens
cagcagagccugugucuca

SEQ ID NO: 98773 - RNA, 19 nt, Homo sapiens
gaaagcccauccugagaca

SEQ ID NO: 98774 - RNA, 19 nt, Homo sapiens
caacuacaauagguaagaa

SEQ ID NO: 98775 - RNA, 19 nt, Homo sapiens
cgacaacaccugcagaaga

SEQ ID NO: 98776 - RNA, 19 nt, Homo sapiens
cuaggggacugcacaauua

SEQ ID NO: 98777 - RNA, 19 nt, Homo sapiens
ccacugcuguacaccuaaa

SEQ ID NO: 98778 - RNA, 19 nt, Homo sapiens
gagagaaauacacgucuga

SEQ ID NO: 98779 - RNA, 19 nt, Homo sapiens
agacagagagugagccaaa

SEQ ID NO: 98780 - RNA, 19 nt, Homo sapiens
cugauaagacuucaugaaa

SEQ ID NO: 98781 - RNA, 19 nt, Homo sapiens
aaauacacgucugauaaga

SEQ ID NO: 98782 - RNA, 19 nt, Homo sapiens
gaauguguccacucucuuc

SEQ ID NO: 98783 - RNA, 19 nt, Homo sapiens
ggccgcauguggcuucauu

SEQ ID NO: 98784 - RNA, 19 nt, Homo sapiens
gaagagccagcaagagcaa

SEQ ID NO: 98785 - RNA, 19 nt, Homo sapiens
gaacaguuugguggucuuu

SEQ ID NO: 98786 - RNA, 19 nt, Homo sapiens
ggauggacaacuacaauag

SEQ ID NO: 98787 - RNA, 19 nt, Homo sapiens
gggagugccugugcuguca

SEQ ID NO: 98788 - RNA, 19 nt, Homo sapiens
gaggauggacaacuacaau

SEQ ID NO: 98789 - RNA, 19 nt, Homo sapiens
ccgacuaccuccgacagua

SEQ ID NO: 98790 - RNA, 19 nt, Homo sapiens
gugaauguguccacucucu

SEQ ID NO: 98791 - RNA, 19 nt, Homo sapiens
ucgggaaucuggcugguau

SEQ ID NO: 98792 - RNA, 19 nt, Homo sapiens
gcagaggaacugagaucga

SEQ ID NO: 98793 - RNA, 19 nt, Homo sapiens
aggaugacaugcagaggaa

SEQ ID NO: 98794 - RNA, 19 nt, Homo sapiens
gaggaucugcugugcauag

SEQ ID NO: 98795 - RNA, 19 nt, Homo sapiens
gcagccagccucuguuucu

SEQ ID NO: 98796 - RNA, 19 nt, Homo sapiens
ccaggaagagccagcaaga

SEQ ID NO: 98797 - RNA, 19 nt, Homo sapiens
gcauccuggugccugcaua

SEQ ID NO: 98798 - RNA, 19 nt, Homo sapiens
uagccaagaccuucuccua

SEQ ID NO: 98799 - RNA, 19 nt, Homo sapiens
ggaggauggacaacuacaa

SEQ ID NO: 98800 - RNA, 19 nt, Homo sapiens
gggaaucuggcugguauug

SEQ ID NO: 98801 - RNA, 19 nt, Homo sapiens
cacacaacuuggagguaaa

SEQ ID NO: 98802 - RNA, 19 nt, Homo sapiens
ggccaccacugcaguucug

SEQ ID NO: 98803 - RNA, 19 nt, Homo sapiens
cugcacaauuauacacuau

SEQ ID NO: 98804 - RNA, 19 nt, Homo sapiens
gagacaggcaggaccuugu

SEQ ID NO: 98805 - RNA, 19 nt, Homo sapiens
aggaggaucugcugugcau

SEQ ID NO: 98806 - RNA, 19 nt, Homo sapiens
ugagaucgacagugacuag

SEQ ID NO: 98807 - RNA, 19 nt, Homo sapiens
ugcccuggcuucucugguu

SEQ ID NO: 98808 - RNA, 19 nt, Homo sapiens
cgcauguggcuucauuaua

SEQ ID NO: 98809 - RNA, 19 nt, Homo sapiens
gacagagagugagccaaag

SEQ ID NO: 98810 - RNA, 19 nt, Homo sapiens
uaaggaggaugcgccuagu

SEQ ID NO: 98811 - RNA, 19 nt, Homo sapiens
ggacugcacaauuauacac

SEQ ID NO: 98812 - RNA, 19 nt, Homo sapiens
gcacucucagcccugguuu

SEQ ID NO: 98813 - RNA, 19 nt, Homo sapiens
ucugauaagacuucaugaa

SEQ ID NO: 98814 - RNA, 19 nt, Homo sapiens
caugagaggagagaaauac

SEQ ID NO: 98815 - RNA, 19 nt, Homo sapiens
agccacugcuguacaccua

SEQ ID NO: 98816 - RNA, 19 nt, Homo sapiens
aggauggacaacuacaaua

SEQ ID NO: 98817 - RNA, 19 nt, Homo sapiens
ccgcauguggcuucauuau

SEQ ID NO: 98818 - RNA, 19 nt, Homo sapiens
gauggacaacuacaauagg

SEQ ID NO: 98819 - RNA, 19 nt, Homo sapiens
ccacccgucugugaaugug

SEQ ID NO: 98820 - RNA, 19 nt, Homo sapiens
gagccaaccccaccucuau

SEQ ID NO: 98821 - RNA, 19 nt, Homo sapiens
acugcacaauuauacacua

SEQ ID NO: 98822 - RNA, 19 nt, Homo sapiens
cuggccaccugaacuguau

SEQ ID NO: 98823 - RNA, 19 nt, Homo sapiens
gcauggaacuggagcugua

SEQ ID NO: 98824 - RNA, 19 nt, Homo sapiens
gacgagauaugacaccuaa

SEQ ID NO: 98825 - RNA, 19 nt, Homo sapiens
gggaaacgcuacuucgaau

SEQ ID NO: 98826 - RNA, 19 nt, Homo sapiens
ucgcugaguucaaguguaa

SEQ ID NO: 98827 - RNA, 19 nt, Homo sapiens
guauguaggucucacagau

SEQ ID NO: 98828 - RNA, 19 nt, Homo sapiens
gcagcucccucaacaccuu

SEQ ID NO: 98829 - RNA, 19 nt, Homo sapiens
ggauugguguccgcuauga

SEQ ID NO: 98830 - RNA, 19 nt, Homo sapiens
gauaugacaccuaaggaau

SEQ ID NO: 98831 - RNA, 19 nt, Homo sapiens
caagcuggaucaagaggau

SEQ ID NO: 98832 - RNA, 19 nt, Homo sapiens
gaaguacacgaucucacaa

SEQ ID NO: 98833 - RNA, 19 nt, Homo sapiens
guauggaguugacgacaag

SEQ ID NO: 98834 - RNA, 19 nt, Homo sapiens
gaaacgcuacuucgaaugc

SEQ ID NO: 98835 - RNA, 19 nt, Homo sapiens
guacacgaucucacaagaa

SEQ ID NO: 98836 - RNA, 19 nt, Homo sapiens
uaugacaccuaaggaauuc

SEQ ID NO: 98837 - RNA, 19 nt, Homo sapiens
ggacgagauaugacaccua

SEQ ID NO: 98838 - RNA, 19 nt, Homo sapiens
gguccgcucuuuccugaag

SEQ ID NO: 98839 - RNA, 19 nt, Homo sapiens
caccaucgcugaguucaag

SEQ ID NO: 98840 - RNA, 19 nt, Homo sapiens
gagacucaugcauuaaauu

SEQ ID NO: 98841 - RNA, 19 nt, Homo sapiens
ucgaaugccaggccaagua

SEQ ID NO: 98842 - RNA, 19 nt, Homo sapiens
auguaggucucacagauuu

SEQ ID NO: 98843 - RNA, 19 nt, Homo sapiens
gagauaugacaccuaagga

SEQ ID NO: 98844 - RNA, 19 nt, Homo sapiens
gaaugggaaacgcuacuuc

SEQ ID NO: 98845 - RNA, 19 nt, Homo sapiens
uacacgaucucacaagaag

SEQ ID NO: 98846 - RNA, 19 nt, Homo sapiens
ccaaguauggcgccuuugu

SEQ ID NO: 98847 - RNA, 19 nt, Homo sapiens
ggaaacgcuacuucgaaug

SEQ ID NO: 98848 - RNA, 19 nt, Homo sapiens
ugucccggguggagaagua

SEQ ID NO: 98849 - RNA, 19 nt, Homo sapiens
gaguugacgacaaguucua

SEQ ID NO: 98850 - RNA, 19 nt, Homo sapiens
guauggcgccuuugucaag

SEQ ID NO: 98851 - RNA, 19 nt, Homo sapiens
guggagaaguacacgaucu

SEQ ID NO: 98852 - RNA, 19 nt, Homo sapiens
agacucaugcauuaaauuc

SEQ ID NO: 98853 - RNA, 19 nt, Homo sapiens
cgaaugccaggccaaguau

SEQ ID NO: 98854 - RNA, 19 nt, Homo sapiens
agaaguacacgaucucaca

SEQ ID NO: 98855 - RNA, 19 nt, Homo sapiens
cgagauaugacaccuaagg

SEQ ID NO: 98856 - RNA, 19 nt, Homo sapiens
uguauggaguugacgacaa

SEQ ID NO: 98857 - RNA, 19 nt, Homo sapiens
aguacacgaucucacaaga

SEQ ID NO: 98858 - RNA, 19 nt, Homo sapiens
ggagcuguauggaguugac

SEQ ID NO: 98859 - RNA, 19 nt, Homo sapiens
uauguaggucucacagauu

SEQ ID NO: 98860 - RNA, 19 nt, Homo sapiens
agauaugacaccuaaggaa

SEQ ID NO: 98861 - RNA, 19 nt, Homo sapiens
cuacggguuggacgagaua

SEQ ID NO: 98862 - RNA, 19 nt, Homo sapiens
ugggaaacgcuacuucgaa

SEQ ID NO: 98863 - RNA, 19 nt, Homo sapiens
acgacaaguucuacagcaa

SEQ ID NO: 98864 - RNA, 19 nt, Homo sapiens
guaggucucacagauuuca

SEQ ID NO: 98865 - RNA, 19 nt, Homo sapiens
auaugacaccuaaggaauu

SEQ ID NO: 98866 - RNA, 19 nt, Homo sapiens
ggaacuggagcuguaugga

SEQ ID NO: 98867 - RNA, 19 nt, Homo sapiens
gagacgaccuggacccuaa

SEQ ID NO: 98868 - RNA, 19 nt, Homo sapiens
agacugaccucaaccauga

SEQ ID NO: 98869 - RNA, 19 nt, Homo sapiens
gcacaagacugaccucaac

SEQ ID NO: 98870 - RNA, 19 nt, Homo sapiens
gagaaaggccaguccauug

SEQ ID NO: 98871 - RNA, 19 nt, Homo sapiens
caaccaggagcucuaguua

SEQ ID NO: 98872 - RNA, 19 nt, Homo sapiens
gagaagaaguuggagaaag

SEQ ID NO: 98873 - RNA, 19 nt, Homo sapiens
ccacgcaaagcgauaaaua

SEQ ID NO: 98874 - RNA, 19 nt, Homo sapiens
gggaaguacuacccucuga

SEQ ID NO: 98875 - RNA, 19 nt, Homo sapiens
ggagaaaggccaguccauu

SEQ ID NO: 98876 - RNA, 19 nt, Homo sapiens
gcaaagcgauaaauaaaag

SEQ ID NO: 98877 - RNA, 19 nt, Homo sapiens
gauucuggccaaugaaaua

SEQ ID NO: 98878 - RNA, 19 nt, Homo sapiens
gcguagggcugcagaagau

SEQ ID NO: 98879 - RNA, 19 nt, Homo sapiens
acucggagcuugugcuuug

SEQ ID NO: 98880 - RNA, 19 nt, Homo sapiens
ucucagaguuccaguuuca

SEQ ID NO: 98881 - RNA, 19 nt, Homo sapiens
ugaagagcaugacggagaa

SEQ ID NO: 98882 - RNA, 19 nt, Homo sapiens
acaagaagcugcgggacaa

SEQ ID NO: 98883 - RNA, 19 nt, Homo sapiens
caaccagaguuccaaccaa

SEQ ID NO: 98884 - RNA, 19 nt, Homo sapiens
aagcauugguggccuuaaa

SEQ ID NO: 98885 - RNA, 19 nt, Homo sapiens
ggaaauggagaagaaguug

SEQ ID NO: 98886 - RNA, 19 nt, Homo sapiens
agaagaaguuggagaaagg

SEQ ID NO: 98887 - RNA, 19 nt, Homo sapiens
caggagcucuaguuaaugg

SEQ ID NO: 98888 - RNA, 19 nt, Homo sapiens
accaggagcucuaguuaau

SEQ ID NO: 98889 - RNA, 19 nt, Homo sapiens
gaaguacuacccucugaag

SEQ ID NO: 98890 - RNA, 19 nt, Homo sapiens
ccaucuggcuucacuguag

SEQ ID NO: 98891 - RNA, 19 nt, Homo sapiens
guaacacccacaacaaguu

SEQ ID NO: 98892 - RNA, 19 nt, Homo sapiens
acgcaaagcgauaaauaaa

SEQ ID NO: 98893 - RNA, 19 nt, Homo sapiens
agaaaggccaguccauuga

SEQ ID NO: 98894 - RNA, 19 nt, Homo sapiens
gccgugggcucaguauuug

SEQ ID NO: 98895 - RNA, 19 nt, Homo sapiens
gcagaagauugaggagauc

SEQ ID NO: 98896 - RNA, 19 nt, Homo sapiens
ggagaagaaguuggagaaa

SEQ ID NO: 98897 - RNA, 19 nt, Homo sapiens
gcaaacauaacaaccacau

SEQ ID NO: 98898 - RNA, 19 nt, Homo sapiens
gcuacaaacccacugacaa

SEQ ID NO: 98899 - RNA, 19 nt, Homo sapiens
ggugguggauggugugaag

SEQ ID NO: 98900 - RNA, 19 nt, Homo sapiens
ggaaguacuacccucugaa

SEQ ID NO: 98901 - RNA, 19 nt, Homo sapiens
gcugggcucguccgaagua

SEQ ID NO: 98902 - RNA, 19 nt, Homo sapiens
ucuggauucuggccaauga

SEQ ID NO: 98903 - RNA, 19 nt, Homo sapiens
gggcucguccgaaguagaa

SEQ ID NO: 98904 - RNA, 19 nt, Homo sapiens
guacugacccuugaacucu

SEQ ID NO: 98905 - RNA, 19 nt, Homo sapiens
cacgcaaagcgauaaauaa

SEQ ID NO: 98906 - RNA, 19 nt, Homo sapiens
cguggcaucuggcacaaug

SEQ ID NO: 98907 - RNA, 19 nt, Homo sapiens
cuacaaacccacugacaag

SEQ ID NO: 98908 - RNA, 19 nt, Homo sapiens
aaccagaguuccaaccaau

SEQ ID NO: 98909 - RNA, 19 nt, Homo sapiens
gaccucagcaaacauaaca

SEQ ID NO: 98910 - RNA, 19 nt, Homo sapiens
ugguggaaauggagaagaa

SEQ ID NO: 98911 - RNA, 19 nt, Homo sapiens
ugcagaagauugaggagau

SEQ ID NO: 98912 - RNA, 19 nt, Homo sapiens
gguaacacccacaacaagu

SEQ ID NO: 98913 - RNA, 19 nt, Homo sapiens
gcaucaagggcuacacguu

SEQ ID NO: 98914 - RNA, 19 nt, Homo sapiens
cuacgaaguuuucaaggaa

SEQ ID NO: 98915 - RNA, 19 nt, Homo sapiens
uggcuucacuguagacgau

SEQ ID NO: 98916 - RNA, 19 nt, Homo sapiens
caucuggcuucacuguaga

SEQ ID NO: 98917 - RNA, 19 nt, Homo sapiens
ccaaccaggagcucuaguu

SEQ ID NO: 98918 - RNA, 19 nt, Homo sapiens
uggcaggguccucuucuuu

SEQ ID NO: 98919 - RNA, 19 nt, Homo sapiens
guggaggcgugcaugugaa

SEQ ID NO: 98920 - RNA, 19 nt, Homo sapiens
ccaccaugccauucgguaa

SEQ ID NO: 98921 - RNA, 19 nt, Homo sapiens
uaacacccacaacaaguuc

SEQ ID NO: 98922 - RNA, 19 nt, Homo sapiens
gcaucuggcacaaugacaa

SEQ ID NO: 98923 - RNA, 19 nt, Homo sapiens
gcaggguccucuucuuuuc

SEQ ID NO: 98924 - RNA, 19 nt, Homo sapiens
cagugucaccuccaggaua

SEQ ID NO: 98925 - RNA, 19 nt, Homo sapiens
ccacauggccaagguacug

SEQ ID NO: 98926 - RNA, 19 nt, Homo sapiens
ugccgugggcucaguauuu

SEQ ID NO: 98927 - RNA, 19 nt, Homo sapiens
guagggcugcagaagauug

SEQ ID NO: 98928 - RNA, 19 nt, Homo sapiens
cugacaagcacaagacuga

SEQ ID NO: 98929 - RNA, 19 nt, Homo sapiens
ccaguccauugacgacaug

SEQ ID NO: 98930 - RNA, 19 nt, Homo sapiens
uggagaagaaguuggagaa

SEQ ID NO: 98931 - RNA, 19 nt, Homo sapiens
gagacuccaucuggcuuca

SEQ ID NO: 98932 - RNA, 19 nt, Homo sapiens
ugaagcucaugguggaaau

SEQ ID NO: 98933 - RNA, 19 nt, Homo sapiens
caaccacauggccaaggua

SEQ ID NO: 98934 - RNA, 19 nt, Homo sapiens
cuucucagaguuccaguuu

SEQ ID NO: 98935 - RNA, 19 nt, Homo sapiens
gaaaggccaguccauugac

SEQ ID NO: 98936 - RNA, 19 nt, Homo sapiens
gcacuggccgcagcaucaa

SEQ ID NO: 98937 - RNA, 19 nt, Homo sapiens
aaauggagaagaaguugga

SEQ ID NO: 98938 - RNA, 19 nt, Homo sapiens
acaaugacaacaagagcuu

SEQ ID NO: 98939 - RNA, 19 nt, Homo sapiens
gccaguccauugacgacau

SEQ ID NO: 98940 - RNA, 19 nt, Homo sapiens
uacugacccuugaacucua

SEQ ID NO: 98941 - RNA, 19 nt, Homo sapiens
aaccaggagcucuaguuaa

SEQ ID NO: 98942 - RNA, 19 nt, Homo sapiens
cguggaggcgugcauguga

SEQ ID NO: 98943 - RNA, 19 nt, Homo sapiens
gugcucaccugcccaucca

SEQ ID NO: 98944 - RNA, 19 nt, Homo sapiens
cugcguggcuggugaugag

SEQ ID NO: 98945 - RNA, 19 nt, Homo sapiens
ggauucuggccaaugaaau

SEQ ID NO: 98946 - RNA, 19 nt, Homo sapiens
ccagaguuccaaccaaugg

SEQ ID NO: 98947 - RNA, 19 nt, Homo sapiens
uggaaauggagaagaaguu

SEQ ID NO: 98948 - RNA, 19 nt, Homo sapiens
gugaagcucaugguggaaa

SEQ ID NO: 98949 - RNA, 19 nt, Homo sapiens
acaaccacauggccaaggu

SEQ ID NO: 98950 - RNA, 19 nt, Homo sapiens
cgaccuggacccuaacuac

SEQ ID NO: 98951 - RNA, 19 nt, Homo sapiens
ggaguaaacuauuugauug

SEQ ID NO: 98952 - RNA, 19 nt, Homo sapiens
ggaaugagcguuugggaua

SEQ ID NO: 98953 - RNA, 19 nt, Homo sapiens
ggagaagggugguaacaug

SEQ ID NO: 98954 - RNA, 19 nt, Homo sapiens
gguauuugcugaccuguuu

SEQ ID NO: 98955 - RNA, 19 nt, Homo sapiens
gauagccgcuucccaaaga

SEQ ID NO: 98956 - RNA, 19 nt, Homo sapiens
gaagagaguguuugaaaga

SEQ ID NO: 98957 - RNA, 19 nt, Homo sapiens
gaauuuggcacaacaauga

SEQ ID NO: 98958 - RNA, 19 nt, Homo sapiens
ggagagacuuauccaagaa

SEQ ID NO: 98959 - RNA, 19 nt, Homo sapiens
gaacagcagcagcuuauug

SEQ ID NO: 98960 - RNA, 19 nt, Homo sapiens
gagaugaggagaccuauga

SEQ ID NO: 98961 - RNA, 19 nt, Homo sapiens
gaugaccacuuucuguuug

SEQ ID NO: 98962 - RNA, 19 nt, Homo sapiens
ggaucuagaugccaguaaa

SEQ ID NO: 98963 - RNA, 19 nt, Homo sapiens
gcacggcucugcgacaaga

SEQ ID NO: 98964 - RNA, 19 nt, Homo sapiens
ggucaucgauggaguaaac

SEQ ID NO: 98965 - RNA, 19 nt, Homo sapiens
gcuuauugaugaccacuuu

SEQ ID NO: 98966 - RNA, 19 nt, Homo sapiens
gagaguguuugaaagauuc

SEQ ID NO: 98967 - RNA, 19 nt, Homo sapiens
gaugagagguauguauugu

SEQ ID NO: 98968 - RNA, 19 nt, Homo sapiens
ucaaagagguggagagacu

SEQ ID NO: 98969 - RNA, 19 nt, Homo sapiens
gcucgagacuggccagaug

SEQ ID NO: 98970 - RNA, 19 nt, Homo sapiens
ggcggugucuuugauauuu

SEQ ID NO: 98971 - RNA, 19 nt, Homo sapiens
gccagaugcucguggaauu

SEQ ID NO: 98972 - RNA, 19 nt, Homo sapiens
gcugggaguucauguggaa

SEQ ID NO: 98973 - RNA, 19 nt, Homo sapiens
gagaagggugguaacauga

SEQ ID NO: 98974 - RNA, 19 nt, Homo sapiens
ucgauggaguaaacuauuu

SEQ ID NO: 98975 - RNA, 19 nt, Homo sapiens
ucccaaagauccuggagaa

SEQ ID NO: 98976 - RNA, 19 nt, Homo sapiens
gggcaggagugcacaucaa

SEQ ID NO: 98977 - RNA, 19 nt, Homo sapiens
gaagggugguaacaugaag

SEQ ID NO: 98978 - RNA, 19 nt, Homo sapiens
agagaguguuugaaagauu

SEQ ID NO: 98979 - RNA, 19 nt, Homo sapiens
agcagcagcuuauugauga

SEQ ID NO: 98980 - RNA, 19 nt, Homo sapiens
gcacaccacggaucuagau

SEQ ID NO: 98981 - RNA, 19 nt, Homo sapiens
ugaagagaguguuugaaag

SEQ ID NO: 98982 - RNA, 19 nt, Homo sapiens
ggagagaggccaggauauc

SEQ ID NO: 98983 - RNA, 19 nt, Homo sapiens
guauuguccucuagaguca

SEQ ID NO: 98984 - RNA, 19 nt, Homo sapiens
uguacgagcugccagugaa

SEQ ID NO: 98985 - RNA, 19 nt, Homo sapiens
ggaauuuggcacaacaaug

SEQ ID NO: 98986 - RNA, 19 nt, Homo sapiens
aaagagguggagagacuua

SEQ ID NO: 98987 - RNA, 19 nt, Homo sapiens
gaacgacggaggcuguauc

SEQ ID NO: 98988 - RNA, 19 nt, Homo sapiens
gauccaagagcgacacaau

SEQ ID NO: 98989 - RNA, 19 nt, Homo sapiens
gcugaugacucaagauucc

SEQ ID NO: 98990 - RNA, 19 nt, Homo sapiens
aauccguucuggcuacuuu

SEQ ID NO: 98991 - RNA, 19 nt, Homo sapiens
cagcugaugacucaagauu

SEQ ID NO: 98992 - RNA, 19 nt, Homo sapiens
caaagauccuggagaaccu

SEQ ID NO: 98993 - RNA, 19 nt, Homo sapiens
gaaugagcguuugggauac

SEQ ID NO: 98994 - RNA, 19 nt, Homo sapiens
gugguaacaugaagagagu

SEQ ID NO: 98995 - RNA, 19 nt, Homo sapiens
gaaagcacaacaacugcau

SEQ ID NO: 98996 - RNA, 19 nt, Homo sapiens
ggaccgacuaggcaaauca

SEQ ID NO: 98997 - RNA, 19 nt, Homo sapiens
ugaccuggcuggacguuac

SEQ ID NO: 98998 - RNA, 19 nt, Homo sapiens
gagaaccuaagacuccaaa

SEQ ID NO: 98999 - RNA, 19 nt, Homo sapiens
cagcagcagcuuauugaug

SEQ ID NO: 99000 - RNA, 19 nt, Homo sapiens
caugguggcuggagaugag

SEQ ID NO: 99001 - RNA, 19 nt, Homo sapiens
caagagcgacacaauggau

SEQ ID NO: 99002 - RNA, 19 nt, Homo sapiens
ccagaugcucguggaauuu

SEQ ID NO: 99003 - RNA, 19 nt, Homo sapiens
gaccacuuucuguuugaua

SEQ ID NO: 99004 - RNA, 19 nt, Homo sapiens
gguauguauuguccucuag

SEQ ID NO: 99005 - RNA, 19 nt, Homo sapiens
ucaagauucccaggaguuu

SEQ ID NO: 99006 - RNA, 19 nt, Homo sapiens
gauggaguaaacuauuuga

SEQ ID NO: 99007 - RNA, 19 nt, Homo sapiens
caggcggugucuuugauau

SEQ ID NO: 99008 - RNA, 19 nt, Homo sapiens
ugaugaccacuuucuguuu

SEQ ID NO: 99009 - RNA, 19 nt, Homo sapiens
cuacuuugaugagagguau

SEQ ID NO: 99010 - RNA, 19 nt, Homo sapiens
cuacaggcggugucuuuga

SEQ ID NO: 99011 - RNA, 19 nt, Homo sapiens
gauccuggagaaccuaaga

SEQ ID NO: 99012 - RNA, 19 nt, Homo sapiens
ggcaggagugcacaucaaa

SEQ ID NO: 99013 - RNA, 19 nt, Homo sapiens
augaagagaguguuugaaa

SEQ ID NO: 99014 - RNA, 19 nt, Homo sapiens
ucauccacaccaagcauua

SEQ ID NO: 99015 - RNA, 19 nt, Homo sapiens
gaagcacaccacggaucua

SEQ ID NO: 99016 - RNA, 19 nt, Homo sapiens
gccagcugaugacucaaga

SEQ ID NO: 99017 - RNA, 19 nt, Homo sapiens
uacaggcggugucuuugau

SEQ ID NO: 99018 - RNA, 19 nt, Homo sapiens
accacuuucuguuugauaa

SEQ ID NO: 99019 - RNA, 19 nt, Homo sapiens
cgaagcauccgaggacuca

SEQ ID NO: 99020 - RNA, 19 nt, Homo sapiens
gcggugucuuugauauuuc

SEQ ID NO: 99021 - RNA, 19 nt, Homo sapiens
caucuugaccuguccaucu

SEQ ID NO: 99022 - RNA, 19 nt, Homo sapiens
guuacuauaggcucaguga

SEQ ID NO: 99023 - RNA, 19 nt, Homo sapiens
aacagcagcagcuuauuga

SEQ ID NO: 99024 - RNA, 19 nt, Homo sapiens
gacgcuagaucaguguauc

SEQ ID NO: 99025 - RNA, 19 nt, Homo sapiens
caucgauggaguaaacuau

SEQ ID NO: 99026 - RNA, 19 nt, Homo sapiens
guacccagaccuccgaaag

SEQ ID NO: 99027 - RNA, 19 nt, Homo sapiens
cauguggaaugagcguuug

SEQ ID NO: 99028 - RNA, 19 nt, Homo sapiens
aagagaguguuugaaagau

SEQ ID NO: 99029 - RNA, 19 nt, Homo sapiens
ggacgcuagaucaguguau

SEQ ID NO: 99030 - RNA, 19 nt, Homo sapiens
ggagaugaggagaccuaug

SEQ ID NO: 99031 - RNA, 19 nt, Homo sapiens
gcaacuggucaucgaugga

SEQ ID NO: 99032 - RNA, 19 nt, Homo sapiens
cguuugggauacaucuuga

SEQ ID NO: 99033 - RNA, 19 nt, Homo sapiens
gcguuugggauacaucuug

SEQ ID NO: 99034 - RNA, 19 nt, Homo sapiens
gguaacaugaagagagugu

SEQ ID NO: 99035 - RNA, 19 nt, Homo sapiens
cguggaauuuggcacaaca

SEQ ID NO: 99036 - RNA, 19 nt, Homo sapiens
cugaacagcagcagcuuau

SEQ ID NO: 99037 - RNA, 19 nt, Homo sapiens
gaugacagaggcugaacag

SEQ ID NO: 99038 - RNA, 19 nt, Homo sapiens
ugaugagagguauguauug

SEQ ID NO: 99039 - RNA, 19 nt, Homo sapiens
ggaguuuugcucauucuaa

SEQ ID NO: 99040 - RNA, 19 nt, Homo sapiens
cgauggaguaaacuauuug

SEQ ID NO: 99041 - RNA, 19 nt, Homo sapiens
auacacgggugaucuccau

SEQ ID NO: 99042 - RNA, 19 nt, Homo sapiens
cagaugcucguggaauuug

SEQ ID NO: 99043 - RNA, 19 nt, Homo sapiens
ggaacguguugugguggau

SEQ ID NO: 99044 - RNA, 19 nt, Homo sapiens
gcaggaauggcucgagacu

SEQ ID NO: 99045 - RNA, 19 nt, Homo sapiens
cauccacaccaagcauuaa

SEQ ID NO: 99046 - RNA, 19 nt, Homo sapiens
ugaacggcgucuggagaga

SEQ ID NO: 99047 - RNA, 19 nt, Homo sapiens
acaugaagagaguguuuga

SEQ ID NO: 99048 - RNA, 19 nt, Homo sapiens
ccauggagaagggugguaa

SEQ ID NO: 99049 - RNA, 19 nt, Homo sapiens
cgagagguggaacguguug

SEQ ID NO: 99050 - RNA, 19 nt, Homo sapiens
uugaugagagguauguauu

SEQ ID NO: 99051 - RNA, 19 nt, Homo sapiens
ggaaugagcgccuaggaua

SEQ ID NO: 99052 - RNA, 19 nt, Homo sapiens
caacagacauaaaucucua

SEQ ID NO: 99053 - RNA, 19 nt, Homo sapiens
gaucagagguugagcuugu

SEQ ID NO: 99054 - RNA, 19 nt, Homo sapiens
ggagagaggccaagauauu

SEQ ID NO: 99055 - RNA, 19 nt, Homo sapiens
gauaagacauuucucaucu

SEQ ID NO: 99056 - RNA, 19 nt, Homo sapiens
guacgacauuuccaacaua

SEQ ID NO: 99057 - RNA, 19 nt, Homo sapiens
caacauagauagaauuggu

SEQ ID NO: 99058 - RNA, 19 nt, Homo sapiens
acauaaaucucuacucuga

SEQ ID NO: 99059 - RNA, 19 nt, Homo sapiens
gagagaggccaagauauua

SEQ ID NO: 99060 - RNA, 19 nt, Homo sapiens
gaggaaggauggccaguau

SEQ ID NO: 99061 - RNA, 19 nt, Homo sapiens
cugccuaucuuuacaauaa

SEQ ID NO: 99062 - RNA, 19 nt, Homo sapiens
gaugaccacuuucuguuug

SEQ ID NO: 99063 - RNA, 19 nt, Homo sapiens
gaagggagguagagaacgu

SEQ ID NO: 99064 - RNA, 19 nt, Homo sapiens
agacauaaaucucuacucu

SEQ ID NO: 99065 - RNA, 19 nt, Homo sapiens
gcgauucugucguggacua

SEQ ID NO: 99066 - RNA, 19 nt, Homo sapiens
gcugggaguucauguggaa

SEQ ID NO: 99067 - RNA, 19 nt, Homo sapiens
ggaguccuaugagguguuu

SEQ ID NO: 99068 - RNA, 19 nt, Homo sapiens
gcuucaagaucaaaggaaa

SEQ ID NO: 99069 - RNA, 19 nt, Homo sapiens
gcaaguccuccacagcaua

SEQ ID NO: 99070 - RNA, 19 nt, Homo sapiens
gcacacaacggaucuggau

SEQ ID NO: 99071 - RNA, 19 nt, Homo sapiens
gaggaucacaccaggguaa

SEQ ID NO: 99072 - RNA, 19 nt, Homo sapiens
gcaggccacuuuucacuaa

SEQ ID NO: 99073 - RNA, 19 nt, Homo sapiens
gauccugccuaucuuuaca

SEQ ID NO: 99074 - RNA, 19 nt, Homo sapiens
gguugagcuuguucagaua

SEQ ID NO: 99075 - RNA, 19 nt, Homo sapiens
uuucucaucuggauaaaug

SEQ ID NO: 99076 - RNA, 19 nt, Homo sapiens
agacauuucucaucuggau

SEQ ID NO: 99077 - RNA, 19 nt, Homo sapiens
cagcaaggacccacgcuuu

SEQ ID NO: 99078 - RNA, 19 nt, Homo sapiens
gagcugguguccacguuag

SEQ ID NO: 99079 - RNA, 19 nt, Homo sapiens
aggguaaucucaauggaaa

SEQ ID NO: 99080 - RNA, 19 nt, Homo sapiens
ggauaaaugaggaggauca

SEQ ID NO: 99081 - RNA, 19 nt, Homo sapiens
ggaaggauggccaguaucu

SEQ ID NO: 99082 - RNA, 19 nt, Homo sapiens
aauaaucugucugcuggua

SEQ ID NO: 99083 - RNA, 19 nt, Homo sapiens
caagaucaaaggaaauguu

SEQ ID NO: 99084 - RNA, 19 nt, Homo sapiens
guacaacagacauaaaucu

SEQ ID NO: 99085 - RNA, 19 nt, Homo sapiens
ucccaaagcucagcaagga

SEQ ID NO: 99086 - RNA, 19 nt, Homo sapiens
gggaaucuggcauaauuau

SEQ ID NO: 99087 - RNA, 19 nt, Homo sapiens
ggaucuggaugcaucaaag

SEQ ID NO: 99088 - RNA, 19 nt, Homo sapiens
agucaucgauggagucaau

SEQ ID NO: 99089 - RNA, 19 nt, Homo sapiens
aaggauggccaguaucuuu

SEQ ID NO: 99090 - RNA, 19 nt, Homo sapiens
agauagaauuggucgauca

SEQ ID NO: 99091 - RNA, 19 nt, Homo sapiens
gccggugacugggaaguuu

SEQ ID NO: 99092 - RNA, 19 nt, Homo sapiens
gacauuuccaacauagaua

SEQ ID NO: 99093 - RNA, 19 nt, Homo sapiens
gacccacgcuuuucuaaga

SEQ ID NO: 99094 - RNA, 19 nt, Homo sapiens
aauuguagauccugccuau

SEQ ID NO: 99095 - RNA, 19 nt, Homo sapiens
gagcgccuaggauacauuu

SEQ ID NO: 99096 - RNA, 19 nt, Homo sapiens
caaugcuucucugcuguuu

SEQ ID NO: 99097 - RNA, 19 nt, Homo sapiens
cgacauuuccaacauagau

SEQ ID NO: 99098 - RNA, 19 nt, Homo sapiens
gaaguagaacgguuaaucc

SEQ ID NO: 99099 - RNA, 19 nt, Homo sapiens
guagagaacguggccauca

SEQ ID NO: 99100 - RNA, 19 nt, Homo sapiens
gcaaugcuucucugcuguu

SEQ ID NO: 99101 - RNA, 19 nt, Homo sapiens
gccaguaucuuuucuaagu

SEQ ID NO: 99102 - RNA, 19 nt, Homo sapiens
agagaggccaagauauuaa

SEQ ID NO: 99103 - RNA, 19 nt, Homo sapiens
gccaguguccccuuuauua

SEQ ID NO: 99104 - RNA, 19 nt, Homo sapiens
cgaugaccacuuucuguuu

SEQ ID NO: 99105 - RNA, 19 nt, Homo sapiens
acuacaagcuguccgagau

SEQ ID NO: 99106 - RNA, 19 nt, Homo sapiens
gaucuggaugcaucaaaga

SEQ ID NO: 99107 - RNA, 19 nt, Homo sapiens
uagaacgguuaauccaaga

SEQ ID NO: 99108 - RNA, 19 nt, Homo sapiens
gaaccuuggaacaggacua

SEQ ID NO: 99109 - RNA, 19 nt, Homo sapiens
ggcaauaugaaacgaguau

SEQ ID NO: 99110 - RNA, 19 nt, Homo sapiens
gaucacaccaggguaaucu

SEQ ID NO: 99111 - RNA, 19 nt, Homo sapiens
gaccacuuucuguuugaua

SEQ ID NO: 99112 - RNA, 19 nt, Homo sapiens
uaagacacaacggcuauga

SEQ ID NO: 99113 - RNA, 19 nt, Homo sapiens
ccuaggcuauuuccuccaa

SEQ ID NO: 99114 - RNA, 19 nt, Homo sapiens
acaccaggguaaucucaau

SEQ ID NO: 99115 - RNA, 19 nt, Homo sapiens
acauuucucaucuggauaa

SEQ ID NO: 99116 - RNA, 19 nt, Homo sapiens
uacaagcuguccgagauga

SEQ ID NO: 99117 - RNA, 19 nt, Homo sapiens
gcugguacaacagacauaa

SEQ ID NO: 99118 - RNA, 19 nt, Homo sapiens
ucaucgauggagucaauua

SEQ ID NO: 99119 - RNA, 19 nt, Homo sapiens
agguugagcuuguucagau

SEQ ID NO: 99120 - RNA, 19 nt, Homo sapiens
aaagaaguagaacgguuaa

SEQ ID NO: 99121 - RNA, 19 nt, Homo sapiens
aaaagaaguagaacgguua

SEQ ID NO: 99122 - RNA, 19 nt, Homo sapiens
ccaggguaaucucaaugga

SEQ ID NO: 99123 - RNA, 19 nt, Homo sapiens
gaaugagcgccuaggauac

SEQ ID NO: 99124 - RNA, 19 nt, Homo sapiens
cuggaugcaucaaagauca

SEQ ID NO: 99125 - RNA, 19 nt, Homo sapiens
uaaucugucugcugguaca

SEQ ID NO: 99126 - RNA, 19 nt, Homo sapiens
aacuuucccuuucccaauu

SEQ ID NO: 99127 - RNA, 19 nt, Homo sapiens
aaacuuucccuuucccaau

SEQ ID NO: 99128 - RNA, 19 nt, Homo sapiens
ucagauagucaucgaugga

SEQ ID NO: 99129 - RNA, 19 nt, Homo sapiens
gaaggauggccaguaucuu

SEQ ID NO: 99130 - RNA, 19 nt, Homo sapiens
aaaaggaggcaauaugaaa

SEQ ID NO: 99131 - RNA, 19 nt, Homo sapiens
accacuuucuguuugauaa

SEQ ID NO: 99132 - RNA, 19 nt, Homo sapiens
uguacgacauuuccaacau

SEQ ID NO: 99133 - RNA, 19 nt, Homo sapiens
gaccuguccuucgaaccuu

SEQ ID NO: 99134 - RNA, 19 nt, Homo sapiens
uaaagacugugggcauggu

SEQ ID NO: 99135 - RNA, 19 nt, Homo sapiens
ggccaccccuucauaaaga

SEQ ID NO: 99136 - RNA, 19 nt, Homo sapiens
cuaacuggccgcaaugcuu

SEQ ID NO: 99137 - RNA, 19 nt, Homo sapiens
gcaagcacaacaacugcau

SEQ ID NO: 99138 - RNA, 19 nt, Homo sapiens
gaaccggcagaaagugugu

SEQ ID NO: 99139 - RNA, 19 nt, Homo sapiens
gagaggccaagauauuaag

SEQ ID NO: 99140 - RNA, 19 nt, Homo sapiens
gagcuuguucagauaguca

SEQ ID NO: 99141 - RNA, 19 nt, Homo sapiens
gaacgguuaauccaagaac

SEQ ID NO: 99142 - RNA, 19 nt, Homo sapiens
agaaguagaacgguuaauc

SEQ ID NO: 99143 - RNA, 19 nt, Homo sapiens
gcaguucgacgagcauuac

SEQ ID NO: 99144 - RNA, 19 nt, Homo sapiens
caggguaaucucaauggaa

SEQ ID NO: 99145 - RNA, 19 nt, Homo sapiens
ugauaagacauuucucauc

SEQ ID NO: 99146 - RNA, 19 nt, Homo sapiens
gagcgaagggagguagaga

SEQ ID NO: 99147 - RNA, 19 nt, Homo sapiens
ggcaguucgacgagcauua

SEQ ID NO: 99148 - RNA, 19 nt, Homo sapiens
uacgacauuuccaacauag

SEQ ID NO: 99149 - RNA, 19 nt, Homo sapiens
cgagcugguguccacguua

SEQ ID NO: 99150 - RNA, 19 nt, Homo sapiens
aggggaaucuggcauaauu

SEQ ID NO: 99151 - RNA, 19 nt, Homo sapiens
gaacagauaacuaugcuua

SEQ ID NO: 99152 - RNA, 19 nt, Homo sapiens
gaaucuggcuuaaacauga

SEQ ID NO: 99153 - RNA, 19 nt, Homo sapiens
agacagagauguugaaaga

SEQ ID NO: 99154 - RNA, 19 nt, Homo sapiens
gaagggagauacauguuau

SEQ ID NO: 99155 - RNA, 19 nt, Homo sapiens
gaaaguuaauggcuuaugu

SEQ ID NO: 99156 - RNA, 19 nt, Homo sapiens
gagcagcagugaugaagaa

SEQ ID NO: 99157 - RNA, 19 nt, Homo sapiens
ggacuggaauuaaauaaag

SEQ ID NO: 99158 - RNA, 19 nt, Homo sapiens
cgaaugaggcucuggaaua

SEQ ID NO: 99159 - RNA, 19 nt, Homo sapiens
gcuaaugcuugaacucuuu

SEQ ID NO: 99160 - RNA, 19 nt, Homo sapiens
acaggaggcucuuaacuuu

SEQ ID NO: 99161 - RNA, 19 nt, Homo sapiens
gaaugaggcucuggaauag

SEQ ID NO: 99162 - RNA, 19 nt, Homo sapiens
gaccaaauccugccucauu

SEQ ID NO: 99163 - RNA, 19 nt, Homo sapiens
gcucauaaugggaaaguua

SEQ ID NO: 99164 - RNA, 19 nt, Homo sapiens
gaaggcaguuugcgcuaau

SEQ ID NO: 99165 - RNA, 19 nt, Homo sapiens
gucacaagcuguugaauca

SEQ ID NO: 99166 - RNA, 19 nt, Homo sapiens
gauguuugauuacucuuga

SEQ ID NO: 99167 - RNA, 19 nt, Homo sapiens
ggaauuaacacccuugaca

SEQ ID NO: 99168 - RNA, 19 nt, Homo sapiens
cagacaaucuuauuacaca

SEQ ID NO: 99169 - RNA, 19 nt, Homo sapiens
acagagauguugaaagaau

SEQ ID NO: 99170 - RNA, 19 nt, Homo sapiens
ggccaucaguauugacuuu

SEQ ID NO: 99171 - RNA, 19 nt, Homo sapiens
ugggaaaguuaauggcuua

SEQ ID NO: 99172 - RNA, 19 nt, Homo sapiens
caucauaugucuccagucu

SEQ ID NO: 99173 - RNA, 19 nt, Homo sapiens
guacagugguauccucaug

SEQ ID NO: 99174 - RNA, 19 nt, Homo sapiens
gggaaagcccucauugcua

SEQ ID NO: 99175 - RNA, 19 nt, Homo sapiens
ugaagaaggaugaauauca

SEQ ID NO: 99176 - RNA, 19 nt, Homo sapiens
uggcugcaguucagaauuu

SEQ ID NO: 99177 - RNA, 19 nt, Homo sapiens
gaugaagaaggaugaauau

SEQ ID NO: 99178 - RNA, 19 nt, Homo sapiens
cagcagugaugaagaagga

SEQ ID NO: 99179 - RNA, 19 nt, Homo sapiens
acaauuaaauccggccuuu

SEQ ID NO: 99180 - RNA, 19 nt, Homo sapiens
gcaaacacugcucauaaug

SEQ ID NO: 99181 - RNA, 19 nt, Homo sapiens
uaacacccuugacauugaa

SEQ ID NO: 99182 - RNA, 19 nt, Homo sapiens
uuaacacccuugacauuga

SEQ ID NO: 99183 - RNA, 19 nt, Homo sapiens
ucaacuguauggucuauuc

SEQ ID NO: 99184 - RNA, 19 nt, Homo sapiens
ugaagggagauacauguua

SEQ ID NO: 99185 - RNA, 19 nt, Homo sapiens
accaaauccugccucauua

SEQ ID NO: 99186 - RNA, 19 nt, Homo sapiens
acuauaagaugcagucuca

SEQ ID NO: 99187 - RNA, 19 nt, Homo sapiens
caccauugcuguuuauaca

SEQ ID NO: 99188 - RNA, 19 nt, Homo sapiens
acaaacugcagauguauuu

SEQ ID NO: 99189 - RNA, 19 nt, Homo sapiens
cagggaaucuggcuuaaac

SEQ ID NO: 99190 - RNA, 19 nt, Homo sapiens
ucccauguuugcuuuauuu

SEQ ID NO: 99191 - RNA, 19 nt, Homo sapiens
ucucuuacuugcuguacua

SEQ ID NO: 99192 - RNA, 19 nt, Homo sapiens
ugaugaagaaggaugaaua

SEQ ID NO: 99193 - RNA, 19 nt, Homo sapiens
gagaacagauaacuaugcu

SEQ ID NO: 99194 - RNA, 19 nt, Homo sapiens
caggagaacagauaacuau

SEQ ID NO: 99195 - RNA, 19 nt, Homo sapiens
caguauugacuuucucuua

SEQ ID NO: 99196 - RNA, 19 nt, Homo sapiens
ccucauugcuacaguacaa

SEQ ID NO: 99197 - RNA, 19 nt, Homo sapiens
gguagcaguugguacuaga

SEQ ID NO: 99198 - RNA, 19 nt, Homo sapiens
ccagcagacaaucuuauua

SEQ ID NO: 99199 - RNA, 19 nt, Homo sapiens
aauccugccucauuaauuc

SEQ ID NO: 99200 - RNA, 19 nt, Homo sapiens
gcucuuaacuuugugaaaa

SEQ ID NO: 99201 - RNA, 19 nt, Homo sapiens
gauuguacuuuaugaccuu

SEQ ID NO: 99202 - RNA, 19 nt, Homo sapiens
guugugaccuucagcagau

SEQ ID NO: 99203 - RNA, 19 nt, Homo sapiens
ccaaauccugccucauuaa

SEQ ID NO: 99204 - RNA, 19 nt, Homo sapiens
cagcagauuuuaugaacua

SEQ ID NO: 99205 - RNA, 19 nt, Homo sapiens
caggaacuuuauaguggua

SEQ ID NO: 99206 - RNA, 19 nt, Homo sapiens
guuaucaggugguucagau

SEQ ID NO: 99207 - RNA, 19 nt, Homo sapiens
guaccucaguugugaccuu

SEQ ID NO: 99208 - RNA, 19 nt, Homo sapiens
aaagcaguguguuccauug

SEQ ID NO: 99209 - RNA, 19 nt, Homo sapiens
ggaaucuggcuuaaacaug

SEQ ID NO: 99210 - RNA, 19 nt, Homo sapiens
caucacaggaggcucuuaa

SEQ ID NO: 99211 - RNA, 19 nt, Homo sapiens
acaaguaacacaagucguu

SEQ ID NO: 99212 - RNA, 19 nt, Homo sapiens
uuacucaggagaacagaua

SEQ ID NO: 99213 - RNA, 19 nt, Homo sapiens
ggucacagacaagaaauau

SEQ ID NO: 99214 - RNA, 19 nt, Homo sapiens
guucacaucaagcucauuu

SEQ ID NO: 99215 - RNA, 19 nt, Homo sapiens
caaaauguguuccuugauc

SEQ ID NO: 99216 - RNA, 19 nt, Homo sapiens
uaaauccggccuuugaaga

SEQ ID NO: 99217 - RNA, 19 nt, Homo sapiens
gaauuaacacccuugacau

SEQ ID NO: 99218 - RNA, 19 nt, Homo sapiens
ggcuuggguuccauccuua

SEQ ID NO: 99219 - RNA, 19 nt, Homo sapiens
guaaagcaguguguuccau

SEQ ID NO: 99220 - RNA, 19 nt, Homo sapiens
gugaaacucauuaagguau

SEQ ID NO: 99221 - RNA, 19 nt, Homo sapiens
gaaaaucccauguuugcuu

SEQ ID NO: 99222 - RNA, 19 nt, Homo sapiens
gaugaugagacuacaacaa

SEQ ID NO: 99223 - RNA, 19 nt, Homo sapiens
gcuuaagggacauuauaaa

SEQ ID NO: 99224 - RNA, 19 nt, Homo sapiens
gggacuggaauuaaauaaa

SEQ ID NO: 99225 - RNA, 19 nt, Homo sapiens
ccuaaaugcggguaauauu

SEQ ID NO: 99226 - RNA, 19 nt, Homo sapiens
aauuaaauccggccuuuga

SEQ ID NO: 99227 - RNA, 19 nt, Homo sapiens
acagauaacuaugcuuaag

SEQ ID NO: 99228 - RNA, 19 nt, Homo sapiens
gacuucaccuccucacugu

SEQ ID NO: 99229 - RNA, 19 nt, Homo sapiens
uaaagacagagauguugaa

SEQ ID NO: 99230 - RNA, 19 nt, Homo sapiens
gcagggaaucuggcuuaaa

SEQ ID NO: 99231 - RNA, 19 nt, Homo sapiens
ugaaacucauuaagguaug

SEQ ID NO: 99232 - RNA, 19 nt, Homo sapiens
gcaguuugcgcuaaugcuu

SEQ ID NO: 99233 - RNA, 19 nt, Homo sapiens
agaaggcaguuugcgcuaa

SEQ ID NO: 99234 - RNA, 19 nt, Homo sapiens
caaguggaggccaucagua

SEQ ID NO: 99235 - RNA, 19 nt, Homo sapiens
gcaaguggaggccaucagu

SEQ ID NO: 99236 - RNA, 19 nt, Homo sapiens
ggucuauuccugacagcua

SEQ ID NO: 99237 - RNA, 19 nt, Homo sapiens
gcuguguauuucagucaaa

SEQ ID NO: 99238 - RNA, 19 nt, Homo sapiens
gagucaacacggagaguuu

SEQ ID NO: 99239 - RNA, 19 nt, Homo sapiens
auccugauguucacagaua

SEQ ID NO: 99240 - RNA, 19 nt, Homo sapiens
caaauccugccucauuaau

SEQ ID NO: 99241 - RNA, 19 nt, Homo sapiens
gcucaaugucuccuacuau

SEQ ID NO: 99242 - RNA, 19 nt, Homo sapiens
cuuacuugcuguacuauca

SEQ ID NO: 99243 - RNA, 19 nt, Homo sapiens
ggagaacagauaacuaugc

SEQ ID NO: 99244 - RNA, 19 nt, Homo sapiens
uaaagcaguguguuccauu

SEQ ID NO: 99245 - RNA, 19 nt, Homo sapiens
uggcagggaaucuggcuua

SEQ ID NO: 99246 - RNA, 19 nt, Homo sapiens
aggaggcucuuaacuuugu

SEQ ID NO: 99247 - RNA, 19 nt, Homo sapiens
cacaggaggcucuuaacuu

SEQ ID NO: 99248 - RNA, 19 nt, Homo sapiens
ggcucaaugucuccuacua

SEQ ID NO: 99249 - RNA, 19 nt, Homo sapiens
guggaggccaucaguauug

SEQ ID NO: 99250 - RNA, 19 nt, Homo sapiens
uauaagaugcagucucaga

SEQ ID NO: 99251 - RNA, 19 nt, Homo sapiens
caagaaaucuguucauguu

SEQ ID NO: 99252 - RNA, 19 nt, Homo sapiens
ccuaacaucuuucugauaa

SEQ ID NO: 99253 - RNA, 19 nt, Homo sapiens
ggaggaagcaucugaguuu

SEQ ID NO: 99254 - RNA, 19 nt, Homo sapiens
ggauuuauguuucagugua

SEQ ID NO: 99255 - RNA, 19 nt, Homo sapiens
gauguucaauacacuguuu

SEQ ID NO: 99256 - RNA, 19 nt, Homo sapiens
uagccaagcuggucccuaa

SEQ ID NO: 99257 - RNA, 19 nt, Homo sapiens
ccaagaaaccaaagaaaug

SEQ ID NO: 99258 - RNA, 19 nt, Homo sapiens
gcugguaacugcuuugcuu

SEQ ID NO: 99259 - RNA, 19 nt, Homo sapiens
ggaggaaucuuggcguuca

SEQ ID NO: 99260 - RNA, 19 nt, Homo sapiens
gaucaugucgcacaaacaa

SEQ ID NO: 99261 - RNA, 19 nt, Homo sapiens
caagaaaccaaagaaauga

SEQ ID NO: 99262 - RNA, 19 nt, Homo sapiens
uaacugcuuugcuucuuga

SEQ ID NO: 99263 - RNA, 19 nt, Homo sapiens
ggaagcaucugaguuugag

SEQ ID NO: 99264 - RNA, 19 nt, Homo sapiens
guaacugcuuugcuucuug

SEQ ID NO: 99265 - RNA, 19 nt, Homo sapiens
acacagcuguccuuacuuc

SEQ ID NO: 99266 - RNA, 19 nt, Homo sapiens
cugcuuugcuucuugagua

SEQ ID NO: 99267 - RNA, 19 nt, Homo sapiens
cagcuguccuuacuuccua

SEQ ID NO: 99268 - RNA, 19 nt, Homo sapiens
uuacacagcuguccuuacu

SEQ ID NO: 99269 - RNA, 19 nt, Homo sapiens
uccauuauaugauccauga

SEQ ID NO: 99270 - RNA, 19 nt, Homo sapiens
uguggugacuugcggauuu

SEQ ID NO: 99271 - RNA, 19 nt, Homo sapiens
gaggaagcaucugaguuug

SEQ ID NO: 99272 - RNA, 19 nt, Homo sapiens
gaaucugaauggaggaauc

SEQ ID NO: 99273 - RNA, 19 nt, Homo sapiens
uaugauccaugaaccagaa

SEQ ID NO: 99274 - RNA, 19 nt, Homo sapiens
guggugacuugcggauuua

SEQ ID NO: 99275 - RNA, 19 nt, Homo sapiens
gccacgaugugcucuguau

SEQ ID NO: 99276 - RNA, 19 nt, Homo sapiens
accagaaccucacaucuug

SEQ ID NO: 99277 - RNA, 19 nt, Homo sapiens
caucugaguuugagaccau

SEQ ID NO: 99278 - RNA, 19 nt, Homo sapiens
ucugaugucugaaucugaa

SEQ ID NO: 99279 - RNA, 19 nt, Homo sapiens
uauguugccuucuuguuuc

SEQ ID NO: 99280 - RNA, 19 nt, Homo sapiens
cgacgaggaguuugaguau

SEQ ID NO: 99281 - RNA, 19 nt, Homo sapiens
gguaacugcuuugcuucuu

SEQ ID NO: 99282 - RNA, 19 nt, Homo sapiens
gaaccagaaccucacaucu

SEQ ID NO: 99283 - RNA, 19 nt, Homo sapiens
ucaagaaaucuguucaugu

SEQ ID NO: 99284 - RNA, 19 nt, Homo sapiens
cagggaucauguaaacuug

SEQ ID NO: 99285 - RNA, 19 nt, Homo sapiens
gaguuugaguaucgacaug

SEQ ID NO: 99286 - RNA, 19 nt, Homo sapiens
ccaaggacauagccaagcu

SEQ ID NO: 99287 - RNA, 19 nt, Homo sapiens
gacuugcggauuuauguuu

SEQ ID NO: 99288 - RNA, 19 nt, Homo sapiens
acagggaucauguaaacuu

SEQ ID NO: 99289 - RNA, 19 nt, Homo sapiens
ccauagcccagccagauga

SEQ ID NO: 99290 - RNA, 19 nt, Homo sapiens
uuauguugccuucuuguuu

SEQ ID NO: 99291 - RNA, 19 nt, Homo sapiens
gauuuauguuucaguguac

SEQ ID NO: 99292 - RNA, 19 nt, Homo sapiens
agaacacacuuggcagaug

SEQ ID NO: 99293 - RNA, 19 nt, Homo sapiens
caauacacuguuugaaugu

SEQ ID NO: 99294 - RNA, 19 nt, Homo sapiens
guccuuacuuccuaacauc

SEQ ID NO: 99295 - RNA, 19 nt, Homo sapiens
cccaagaaaccaaagaaau

SEQ ID NO: 99296 - RNA, 19 nt, Homo sapiens
cuuacuuccuaacaucuuu

SEQ ID NO: 99297 - RNA, 19 nt, Homo sapiens
aaccagaaccucacaucuu

SEQ ID NO: 99298 - RNA, 19 nt, Homo sapiens
uuugagaccauggcuguua

SEQ ID NO: 99299 - RNA, 19 nt, Homo sapiens
ucaugucgcacaaacaaau

SEQ ID NO: 99300 - RNA, 19 nt, Homo sapiens
caccauagcccagccagau

SEQ ID NO: 99301 - RNA, 19 nt, Homo sapiens
ugucgcacaaacaaauuua

SEQ ID NO: 99302 - RNA, 19 nt, Homo sapiens
cuucuuguuucucacuuug

SEQ ID NO: 99303 - RNA, 19 nt, Homo sapiens
uuauuauguugccuucuug

SEQ ID NO: 99304 - RNA, 19 nt, Homo sapiens
cuuccuaacaucuuucuga

SEQ ID NO: 99305 - RNA, 19 nt, Homo sapiens
uucaagaaaucuguucaug

SEQ ID NO: 99306 - RNA, 19 nt, Homo sapiens
acgaggaguuugaguaucg

SEQ ID NO: 99307 - RNA, 19 nt, Homo sapiens
ccacuacccaagaaaccaa

SEQ ID NO: 99308 - RNA, 19 nt, Homo sapiens
gacgaggaguuugaguauc

SEQ ID NO: 99309 - RNA, 19 nt, Homo sapiens
auacgacgacgaggaguuu

SEQ ID NO: 99310 - RNA, 19 nt, Homo sapiens
uuguauguguggugacuug

SEQ ID NO: 99311 - RNA, 19 nt, Homo sapiens
gggaucauguaaacuugcu

SEQ ID NO: 99312 - RNA, 19 nt, Homo sapiens
cgcacaaacaaauuuacua

SEQ ID NO: 99313 - RNA, 19 nt, Homo sapiens
caacagagcucaguuaaau

SEQ ID NO: 99314 - RNA, 19 nt, Homo sapiens
guacaaaucuuucauccau

SEQ ID NO: 99315 - RNA, 19 nt, Homo sapiens
ccagagaacuuuccaaaca

SEQ ID NO: 99316 - RNA, 19 nt, Homo sapiens
guaccggcauguuauguua

SEQ ID NO: 99317 - RNA, 19 nt, Homo sapiens
ccacauauucuucucuuua

SEQ ID NO: 99318 - RNA, 19 nt, Homo sapiens
uuaagugccuguuugaguu

SEQ ID NO: 99319 - RNA, 19 nt, Homo sapiens
ugcaugagcuguauucuuc

SEQ ID NO: 99320 - RNA, 19 nt, Homo sapiens
cagagaacuuuccaaacaa

SEQ ID NO: 99321 - RNA, 19 nt, Homo sapiens
gcaacagagcucaguuaaa

SEQ ID NO: 99322 - RNA, 19 nt, Homo sapiens
cagcaacagagcucaguua

SEQ ID NO: 99323 - RNA, 19 nt, Homo sapiens
ccacgaggauggcccacaa

SEQ ID NO: 99324 - RNA, 19 nt, Homo sapiens
gugaauacuugagaaaugu

SEQ ID NO: 99325 - RNA, 19 nt, Homo sapiens
gcucuucgcgcucucguuu

SEQ ID NO: 99326 - RNA, 19 nt, Homo sapiens
cuugagaaauguacaaauc

SEQ ID NO: 99327 - RNA, 19 nt, Homo sapiens
ucucuuaagugccuguuug

SEQ ID NO: 99328 - RNA, 19 nt, Homo sapiens
acaaaucuuucauccauac

SEQ ID NO: 99329 - RNA, 19 nt, Homo sapiens
acaagcagaucuacuacuc

SEQ ID NO: 99330 - RNA, 19 nt, Homo sapiens
cacauauucuucucuuuag

SEQ ID NO: 99331 - RNA, 19 nt, Homo sapiens
agugaauacuugagaaaug

SEQ ID NO: 99332 - RNA, 19 nt, Homo sapiens
gagccagaaccacauauuc

SEQ ID NO: 99333 - RNA, 19 nt, Homo sapiens
agucuaggcuggguucauu

SEQ ID NO: 99334 - RNA, 19 nt, Homo sapiens
cgacgaacacuacgaguac

SEQ ID NO: 99335 - RNA, 19 nt, Homo sapiens
uacgaguaccggcauguua

SEQ ID NO: 99336 - RNA, 19 nt, Homo sapiens
uaagugccuguuugaguuu

SEQ ID NO: 99337 - RNA, 19 nt, Homo sapiens
gaggaguggaggagacuug

SEQ ID NO: 99338 - RNA, 19 nt, Homo sapiens
ucagugaauacuugagaaa

SEQ ID NO: 99339 - RNA, 19 nt, Homo sapiens
uagacgaccucuuccaaaa

SEQ ID NO: 99340 - RNA, 19 nt, Homo sapiens
cccacaagcagaucuacua

SEQ ID NO: 99341 - RNA, 19 nt, Homo sapiens
agagaacuuuccaaacaag

SEQ ID NO: 99342 - RNA, 19 nt, Homo sapiens
uauguuacccagagaacuu

SEQ ID NO: 99343 - RNA, 19 nt, Homo sapiens
auaagguaguauucaguga

SEQ ID NO: 99344 - RNA, 19 nt, Homo sapiens
gugcaugagcuguauucuu

SEQ ID NO: 99345 - RNA, 19 nt, Homo sapiens
aaccacauauucuucucuu

SEQ ID NO: 99346 - RNA, 19 nt, Homo sapiens
gaaccacauauucuucucu

SEQ ID NO: 99347 - RNA, 19 nt, Homo sapiens
caugagccagaaccacaua

SEQ ID NO: 99348 - RNA, 19 nt, Homo sapiens
cuguuugaguuuacugaaa

SEQ ID NO: 99349 - RNA, 19 nt, Homo sapiens
agagcucaguuaaaugcaa

SEQ ID NO: 99350 - RNA, 19 nt, Homo sapiens
ucgacgaacacuacgagua

SEQ ID NO: 99351 - RNA, 19 nt, Homo sapiens
aggcuggguucauuacaug

SEQ ID NO: 99352 - RNA, 19 nt, Homo sapiens
cauccauaccugugcauga

SEQ ID NO: 99353 - RNA, 19 nt, Homo sapiens
uuagacgaccucuuccaaa

SEQ ID NO: 99354 - RNA, 19 nt, Homo sapiens
uaggcuggguucauuacau

SEQ ID NO: 99355 - RNA, 19 nt, Homo sapiens
ugagccagaaccacauauu

SEQ ID NO: 99356 - RNA, 19 nt, Homo sapiens
ggauggcccacaagcagau

SEQ ID NO: 99357 - RNA, 19 nt, Homo sapiens
gaacgcagcaucagcuuua

SEQ ID NO: 99358 - RNA, 19 nt, Homo sapiens
uauaugagcugcuggauga

SEQ ID NO: 99359 - RNA, 19 nt, Homo sapiens
gaagagcagucacagauca

SEQ ID NO: 99360 - RNA, 19 nt, Homo sapiens
guuaagcgguccaacauuu

SEQ ID NO: 99361 - RNA, 19 nt, Homo sapiens
cgugauggcugccuacuuu

SEQ ID NO: 99362 - RNA, 19 nt, Homo sapiens
gcaccaaacuggaggucaa

SEQ ID NO: 99363 - RNA, 19 nt, Homo sapiens
ggaugagauucuagacuuu

SEQ ID NO: 99364 - RNA, 19 nt, Homo sapiens
gauggagaguuugagcuua

SEQ ID NO: 99365 - RNA, 19 nt, Homo sapiens
uaagaugugugacgugaug

SEQ ID NO: 99366 - RNA, 19 nt, Homo sapiens
gcgcagagauugagcuucu

SEQ ID NO: 99367 - RNA, 19 nt, Homo sapiens
gaaugcaaguuugggauga

SEQ ID NO: 99368 - RNA, 19 nt, Homo sapiens
gaauuccucuauaagaugu

SEQ ID NO: 99369 - RNA, 19 nt, Homo sapiens
ggaggcuuauucaucuaua

SEQ ID NO: 99370 - RNA, 19 nt, Homo sapiens
gaacgcaguggaugccuuu

SEQ ID NO: 99371 - RNA, 19 nt, Homo sapiens
gcagaucagcgcagagauu

SEQ ID NO: 99372 - RNA, 19 nt, Homo sapiens
gcaaaggcacagcugauga

SEQ ID NO: 99373 - RNA, 19 nt, Homo sapiens
gcgagaggguaucaaguau

SEQ ID NO: 99374 - RNA, 19 nt, Homo sapiens
aguuugagcuuaugaggua

SEQ ID NO: 99375 - RNA, 19 nt, Homo sapiens
gauagugugagcuucauuu

SEQ ID NO: 99376 - RNA, 19 nt, Homo sapiens
guacaaggccagcgagaau

SEQ ID NO: 99377 - RNA, 19 nt, Homo sapiens
ccauuuccaugaacuuuga

SEQ ID NO: 99378 - RNA, 19 nt, Homo sapiens
aggcacagcugaugaaaca

SEQ ID NO: 99379 - RNA, 19 nt, Homo sapiens
gcaguggcauuuaugaaac

SEQ ID NO: 99380 - RNA, 19 nt, Homo sapiens
gaacuacagcgaccaugau

SEQ ID NO: 99381 - RNA, 19 nt, Homo sapiens
gcaaguuugggaugaauga

SEQ ID NO: 99382 - RNA, 19 nt, Homo sapiens
gagaggguaucaaguaucg

SEQ ID NO: 99383 - RNA, 19 nt, Homo sapiens
ggcgagaggguaucaagua

SEQ ID NO: 99384 - RNA, 19 nt, Homo sapiens
uggaugagauucuagacuu

SEQ ID NO: 99385 - RNA, 19 nt, Homo sapiens
caaaggcacagcugaugaa

SEQ ID NO: 99386 - RNA, 19 nt, Homo sapiens
ccaguuacaaacccaauaa

SEQ ID NO: 99387 - RNA, 19 nt, Homo sapiens
ucaaguaucgucggaauga

SEQ ID NO: 99388 - RNA, 19 nt, Homo sapiens
gaaccgaagcugaacuaca

SEQ ID NO: 99389 - RNA, 19 nt, Homo sapiens
agaaugccaucguguggaa

SEQ ID NO: 99390 - RNA, 19 nt, Homo sapiens
ugggaugaaugacaagauu

SEQ ID NO: 99391 - RNA, 19 nt, Homo sapiens
uaucaaguaucgucggaau

SEQ ID NO: 99392 - RNA, 19 nt, Homo sapiens
ucgaauuccucuauaagau

SEQ ID NO: 99393 - RNA, 19 nt, Homo sapiens
cagcaaguuugacucugaa

SEQ ID NO: 99394 - RNA, 19 nt, Homo sapiens
cgccaugauuggaggcuua

SEQ ID NO: 99395 - RNA, 19 nt, Homo sapiens
ucaaaugggugcgcuacau

SEQ ID NO: 99396 - RNA, 19 nt, Homo sapiens
gcacagcugaugaaacaag

SEQ ID NO: 99397 - RNA, 19 nt, Homo sapiens
gacuuuggcuacccacaga

SEQ ID NO: 99398 - RNA, 19 nt, Homo sapiens
gagcgggaagcaaucaauu

SEQ ID NO: 99399 - RNA, 19 nt, Homo sapiens
ggucuucgaauuccucuau

SEQ ID NO: 99400 - RNA, 19 nt, Homo sapiens
gauuggaggcuuauucauc

SEQ ID NO: 99401 - RNA, 19 nt, Homo sapiens
ccucacugcuggcucagaa

SEQ ID NO: 99402 - RNA, 19 nt, Homo sapiens
ucaagguggucaucaaguc

SEQ ID NO: 99403 - RNA, 19 nt, Homo sapiens
gaagugggacgcaccaaac

SEQ ID NO: 99404 - RNA, 19 nt, Homo sapiens
ugaguggcaugccugaaug

SEQ ID NO: 99405 - RNA, 19 nt, Homo sapiens
gaggacaccaggucuguuc

SEQ ID NO: 99406 - RNA, 19 nt, Homo sapiens
caaacccaauaaacucugu

SEQ ID NO: 99407 - RNA, 19 nt, Homo sapiens
ccaaaggccaguaauggau

SEQ ID NO: 99408 - RNA, 19 nt, Homo sapiens
ccaacgacaagaagaaaug

SEQ ID NO: 99409 - RNA, 19 nt, Homo sapiens
gcucaucucccgagucuac

SEQ ID NO: 99410 - RNA, 19 nt, Homo sapiens
agagucagcaucagacaaa

SEQ ID NO: 99411 - RNA, 19 nt, Homo sapiens
aaccgaagcugaacuacag

SEQ ID NO: 99412 - RNA, 19 nt, Homo sapiens
aagaagagcagucacagau

SEQ ID NO: 99413 - RNA, 19 nt, Homo sapiens
gaacuuugaggugccauuc

SEQ ID NO: 99414 - RNA, 19 nt, Homo sapiens
gugcucaucucccgagucu

SEQ ID NO: 99415 - RNA, 19 nt, Homo sapiens
gaugagauucuagacuuug

SEQ ID NO: 99416 - RNA, 19 nt, Homo sapiens
gccaagcacauuacaagug

SEQ ID NO: 99417 - RNA, 19 nt, Homo sapiens
cagaucaccagccagguaa

SEQ ID NO: 99418 - RNA, 19 nt, Homo sapiens
gcaucaagagucagcauca

SEQ ID NO: 99419 - RNA, 19 nt, Homo sapiens
cgaauuccucuauaagaug

SEQ ID NO: 99420 - RNA, 19 nt, Homo sapiens
uuacaaacccaauaaacuc

SEQ ID NO: 99421 - RNA, 19 nt, Homo sapiens
ugucuguccuggccuaaug

SEQ ID NO: 99422 - RNA, 19 nt, Homo sapiens
gcacaaccaaggacaucau

SEQ ID NO: 99423 - RNA, 19 nt, Homo sapiens
cuuaugagguaucgcacaa

SEQ ID NO: 99424 - RNA, 19 nt, Homo sapiens
ggguggugaugaagagcua

SEQ ID NO: 99425 - RNA, 19 nt, Homo sapiens
uggaugugcuggagagugu

SEQ ID NO: 99426 - RNA, 19 nt, Homo sapiens
acagaucaccagccaggua

SEQ ID NO: 99427 - RNA, 19 nt, Homo sapiens
gcugcuggaugagauucua

SEQ ID NO: 99428 - RNA, 19 nt, Homo sapiens
ucuucgaauuccucuauaa

SEQ ID NO: 99429 - RNA, 19 nt, Homo sapiens
gcagucaccaagcagaaug

SEQ ID NO: 99430 - RNA, 19 nt, Homo sapiens
gggccaagcacauuacaag

SEQ ID NO: 99431 - RNA, 19 nt, Homo sapiens
gaugaagagcuaccugagu

SEQ ID NO: 99432 - RNA, 19 nt, Homo sapiens
gacaccaggucuguucuca

SEQ ID NO: 99433 - RNA, 19 nt, Homo sapiens
gccaggcucugaguucugu

SEQ ID NO: 99434 - RNA, 19 nt, Homo sapiens
gcaagagcgggaagcaauc

SEQ ID NO: 99435 - RNA, 19 nt, Homo sapiens
ucaccaagcagaaugucaa

SEQ ID NO: 99436 - RNA, 19 nt, Homo sapiens
gccuuucgggucaauguua

SEQ ID NO: 99437 - RNA, 19 nt, Homo sapiens
guuacaaacccaauaaacu

SEQ ID NO: 99438 - RNA, 19 nt, Homo sapiens
ggucugggccaagcacauu

SEQ ID NO: 99439 - RNA, 19 nt, Homo sapiens
cgcaguggcauuuaugaaa

SEQ ID NO: 99440 - RNA, 19 nt, Homo sapiens
ugaacuacagcgaccauga

SEQ ID NO: 99441 - RNA, 19 nt, Homo sapiens
ggagaguuugagcuuauga

SEQ ID NO: 99442 - RNA, 19 nt, Homo sapiens
cagaucagcgcagagauug

SEQ ID NO: 99443 - RNA, 19 nt, Homo sapiens
uggcaggcaugaaggaauc

SEQ ID NO: 99444 - RNA, 19 nt, Homo sapiens
gccaucguguggaagauca

SEQ ID NO: 99445 - RNA, 19 nt, Homo sapiens
ugagguaucgcacaaccaa

SEQ ID NO: 99446 - RNA, 19 nt, Homo sapiens
gcugaugaaacaagcaaga

SEQ ID NO: 99447 - RNA, 19 nt, Homo sapiens
cgugugacuucguccaguu

SEQ ID NO: 99448 - RNA, 19 nt, Homo sapiens
gggcaaaggcacagcugau

SEQ ID NO: 99449 - RNA, 19 nt, Homo sapiens
gugugaaccugcucauguc

SEQ ID NO: 99450 - RNA, 19 nt, Homo sapiens
ggcaagaucagcgaggaaa

SEQ ID NO: 99451 - RNA, 19 nt, Homo sapiens
cuaccaacgacaagaagaa

SEQ ID NO: 99452 - RNA, 19 nt, Homo sapiens
gaucagcgcagagauugag

SEQ ID NO: 99453 - RNA, 19 nt, Homo sapiens
gggaugaaugacaagauug

SEQ ID NO: 99454 - RNA, 19 nt, Homo sapiens
cuacucugcuuugggauag

SEQ ID NO: 99455 - RNA, 19 nt, Homo sapiens
ucuccucccuccugcuuug

SEQ ID NO: 99456 - RNA, 19 nt, Homo sapiens
cuacagcgaccaugauguc

SEQ ID NO: 99457 - RNA, 19 nt, Homo sapiens
ggacaucaucuucaacuuu

SEQ ID NO: 99458 - RNA, 19 nt, Homo sapiens
gacaucaucuucaacuuug

SEQ ID NO: 99459 - RNA, 19 nt, Homo sapiens
gcucuuagacaaauacuuu

SEQ ID NO: 99460 - RNA, 19 nt, Homo sapiens
ggagauggguuuggcauag

SEQ ID NO: 99461 - RNA, 19 nt, Homo sapiens
caagaagagugugcugaaa

SEQ ID NO: 99462 - RNA, 19 nt, Homo sapiens
ggagugugcuggaggagau

SEQ ID NO: 99463 - RNA, 19 nt, Homo sapiens
caggacaccuccaagaaga

SEQ ID NO: 99464 - RNA, 19 nt, Homo sapiens
ccucaaaguugucuauaag

SEQ ID NO: 99465 - RNA, 19 nt, Homo sapiens
ucaaaguugucuauaagag

SEQ ID NO: 99466 - RNA, 19 nt, Homo sapiens
caaaguugucuauaagaga

SEQ ID NO: 99467 - RNA, 19 nt, Homo sapiens
aaugguaccuggccacuuc

SEQ ID NO: 99468 - RNA, 19 nt, Homo sapiens
cgagcaggcugaccuacug

SEQ ID NO: 99469 - RNA, 19 nt, Homo sapiens
ccaagaagagugugcugaa

SEQ ID NO: 99470 - RNA, 19 nt, Homo sapiens
gacaaggaacggaagaaga

SEQ ID NO: 99471 - RNA, 19 nt, Homo sapiens
ggaccucaaaguugucuau

SEQ ID NO: 99472 - RNA, 19 nt, Homo sapiens
guggagcucuuagacaaau

SEQ ID NO: 99473 - RNA, 19 nt, Homo sapiens
gcucgaaagcccaagaugu

SEQ ID NO: 99474 - RNA, 19 nt, Homo sapiens
gagcuggacaucaucuuca

SEQ ID NO: 99475 - RNA, 19 nt, Homo sapiens
acaaggaacggaagaagau

SEQ ID NO: 99476 - RNA, 19 nt, Homo sapiens
gaaaacugcggcugcaaaa

SEQ ID NO: 99477 - RNA, 19 nt, Homo sapiens
aggcugaccuacugcaaga

SEQ ID NO: 99478 - RNA, 19 nt, Homo sapiens
gauaugccagccucuacuu

SEQ ID NO: 99479 - RNA, 19 nt, Homo sapiens
ggacaaggaacggaagaag

SEQ ID NO: 99480 - RNA, 19 nt, Homo sapiens
acguggagcucuuagacaa

SEQ ID NO: 99481 - RNA, 19 nt, Homo sapiens
caucgagggccaagacaau

SEQ ID NO: 99482 - RNA, 19 nt, Homo sapiens
ggaaaacugcggcugcaaa

SEQ ID NO: 99483 - RNA, 19 nt, Homo sapiens
gagauaugccagccucuac

SEQ ID NO: 99484 - RNA, 19 nt, Homo sapiens
agaagagugugcugaaagc

SEQ ID NO: 99485 - RNA, 19 nt, Homo sapiens
accucaaaguugucuauaa

SEQ ID NO: 99486 - RNA, 19 nt, Homo sapiens
gaccucaaaguugucuaua

SEQ ID NO: 99487 - RNA, 19 nt, Homo sapiens
gaugcgguucaugcuauua

SEQ ID NO: 99488 - RNA, 19 nt, Homo sapiens
ggacaccuccaagaagagu

SEQ ID NO: 99489 - RNA, 19 nt, Homo sapiens
ccaggacaccuccaagaag

SEQ ID NO: 99490 - RNA, 19 nt, Homo sapiens
ugaugcgguucaugcuauu

SEQ ID NO: 99491 - RNA, 19 nt, Homo sapiens
ugugcgagcuggacaucau

SEQ ID NO: 99492 - RNA, 19 nt, Homo sapiens
gagcugauccaccgauacg

SEQ ID NO: 99493 - RNA, 19 nt, Homo sapiens
gagauggguuuggcauagc

SEQ ID NO: 99494 - RNA, 19 nt, Homo sapiens
gauacguggagcucuuaga

SEQ ID NO: 99495 - RNA, 19 nt, Homo sapiens
ggaagugucugccuuuaug

SEQ ID NO: 99496 - RNA, 19 nt, Homo sapiens
ggacaucaucuucaacuuu

SEQ ID NO: 99497 - RNA, 19 nt, Homo sapiens
gacaucaucuucaacuuug

SEQ ID NO: 99498 - RNA, 19 nt, Homo sapiens
gcucuuagacaaauacuuu

SEQ ID NO: 99499 - RNA, 19 nt, Homo sapiens
gggaggaacaacauaguua

SEQ ID NO: 99500 - RNA, 19 nt, Homo sapiens
guccuucccucccuaauaa

SEQ ID NO: 99501 - RNA, 19 nt, Homo sapiens
uuucuaaccuugccacuuu

SEQ ID NO: 99502 - RNA, 19 nt, Homo sapiens
ggaggaacaacauaguuaa

SEQ ID NO: 99503 - RNA, 19 nt, Homo sapiens
ccucaaaguugucuauaag

SEQ ID NO: 99504 - RNA, 19 nt, Homo sapiens
gaagcuaggaggcaggaaa

SEQ ID NO: 99505 - RNA, 19 nt, Homo sapiens
uguccucucugucccauaa

SEQ ID NO: 99506 - RNA, 19 nt, Homo sapiens
ucaaaguugucuauaagag

SEQ ID NO: 99507 - RNA, 19 nt, Homo sapiens
caaaguugucuauaagaga

SEQ ID NO: 99508 - RNA, 19 nt, Homo sapiens
aaugguaccuggccacuuc

SEQ ID NO: 99509 - RNA, 19 nt, Homo sapiens
gacaaggaacggaagaaga

SEQ ID NO: 99510 - RNA, 19 nt, Homo sapiens
gggaagggcaagcuuuaug

SEQ ID NO: 99511 - RNA, 19 nt, Homo sapiens
ggaccucaaaguugucuau

SEQ ID NO: 99512 - RNA, 19 nt, Homo sapiens
gccuuuauguccuuucuuc

SEQ ID NO: 99513 - RNA, 19 nt, Homo sapiens
guggagcucuuagacaaau

SEQ ID NO: 99514 - RNA, 19 nt, Homo sapiens
gcucgaaagcccaagaugu

SEQ ID NO: 99515 - RNA, 19 nt, Homo sapiens
ggaagggcaagcuuuaugg

SEQ ID NO: 99516 - RNA, 19 nt, Homo sapiens
uuuauguccuuucuucuga

SEQ ID NO: 99517 - RNA, 19 nt, Homo sapiens
gaggaacaacauaguuaau

SEQ ID NO: 99518 - RNA, 19 nt, Homo sapiens
gagcuggacaucaucuuca

SEQ ID NO: 99519 - RNA, 19 nt, Homo sapiens
acaaggaacggaagaagau

SEQ ID NO: 99520 - RNA, 19 nt, Homo sapiens
gaaaacugcggcugcaaaa

SEQ ID NO: 99521 - RNA, 19 nt, Homo sapiens
gauaugccagccucuacuu

SEQ ID NO: 99522 - RNA, 19 nt, Homo sapiens
ggacaaggaacggaagaag

SEQ ID NO: 99523 - RNA, 19 nt, Homo sapiens
gggaagugucugccuuuau

SEQ ID NO: 99524 - RNA, 19 nt, Homo sapiens
acguggagcucuuagacaa

SEQ ID NO: 99525 - RNA, 19 nt, Homo sapiens
gaagugucugccuuuaugu

SEQ ID NO: 99526 - RNA, 19 nt, Homo sapiens
caucgagggccaagacaau

SEQ ID NO: 99527 - RNA, 19 nt, Homo sapiens
ggaaaacugcggcugcaaa

SEQ ID NO: 99528 - RNA, 19 nt, Homo sapiens
ccaggacaccuccacuuuc

SEQ ID NO: 99529 - RNA, 19 nt, Homo sapiens
gagauaugccagccucuac

SEQ ID NO: 99530 - RNA, 19 nt, Homo sapiens
accucaaaguugucuauaa

SEQ ID NO: 99531 - RNA, 19 nt, Homo sapiens
gaccucaaaguugucuaua

SEQ ID NO: 99532 - RNA, 19 nt, Homo sapiens
guucagggcacuucuuguc

SEQ ID NO: 99533 - RNA, 19 nt, Homo sapiens
caggacaccuccacuuucc

SEQ ID NO: 99534 - RNA, 19 nt, Homo sapiens
gaugcgguucaugcuauua

SEQ ID NO: 99535 - RNA, 19 nt, Homo sapiens
uguccuucccucccuaaua

SEQ ID NO: 99536 - RNA, 19 nt, Homo sapiens
ggggaagugucugccuuua

SEQ ID NO: 99537 - RNA, 19 nt, Homo sapiens
ccagggaggaacaacauag

SEQ ID NO: 99538 - RNA, 19 nt, Homo sapiens
aaauaugucagguuaaagg

SEQ ID NO: 99539 - RNA, 19 nt, Homo sapiens
ugaugcgguucaugcuauu

SEQ ID NO: 99540 - RNA, 19 nt, Homo sapiens
uccaggacaccuccacuuu

SEQ ID NO: 99541 - RNA, 19 nt, Homo sapiens
ugugcgagcuggacaucau

SEQ ID NO: 99542 - RNA, 19 nt, Homo sapiens
gagcugauccaccgauacg

SEQ ID NO: 99543 - RNA, 19 nt, Homo sapiens
gccagggaggaacaacaua

SEQ ID NO: 99544 - RNA, 19 nt, Homo sapiens
gauguccuucccucccuaa

SEQ ID NO: 99545 - RNA, 19 nt, Homo sapiens
gauacguggagcucuuaga

SEQ ID NO: 99546 - RNA, 19 nt, Homo sapiens
agacgaaggugcugaaaca

SEQ ID NO: 99547 - RNA, 19 nt, Homo sapiens
ggucuuaaacgaauauuuc

SEQ ID NO: 99548 - RNA, 19 nt, Homo sapiens
ggagggcauucacaacuuc

SEQ ID NO: 99549 - RNA, 19 nt, Homo sapiens
caacuucguggaggucuua

SEQ ID NO: 99550 - RNA, 19 nt, Homo sapiens
acgaauauuuccacaaugu

SEQ ID NO: 99551 - RNA, 19 nt, Homo sapiens
guggaggucuuaaacgaau

SEQ ID NO: 99552 - RNA, 19 nt, Homo sapiens
gcaguuugaugaugaugag

SEQ ID NO: 99553 - RNA, 19 nt, Homo sapiens
guuccuggcuggcgaaauc

SEQ ID NO: 99554 - RNA, 19 nt, Homo sapiens
ccacaagggaggagacuuc

SEQ ID NO: 99555 - RNA, 19 nt, Homo sapiens
acaugcaguuugaugauga

SEQ ID NO: 99556 - RNA, 19 nt, Homo sapiens
guugucgugugauuccaua

SEQ ID NO: 99557 - RNA, 19 nt, Homo sapiens
gcuuuauccucauccagaa

SEQ ID NO: 99558 - RNA, 19 nt, Homo sapiens
guuugaugaugaugagaaa

SEQ ID NO: 99559 - RNA, 19 nt, Homo sapiens
agugguacaugcaguuuga

SEQ ID NO: 99560 - RNA, 19 nt, Homo sapiens
gaauauuuccacaaugucu

SEQ ID NO: 99561 - RNA, 19 nt, Homo sapiens
uuccggaacuuuaagauca

SEQ ID NO: 99562 - RNA, 19 nt, Homo sapiens
guacaugcaguuugaugau

SEQ ID NO: 99563 - RNA, 19 nt, Homo sapiens
gguacaugcaguuugauga

SEQ ID NO: 99564 - RNA, 19 nt, Homo sapiens
gaccugguguucaacuucu

SEQ ID NO: 99565 - RNA, 19 nt, Homo sapiens
gaguaaccgugccguuguc

SEQ ID NO: 99566 - RNA, 19 nt, Homo sapiens
ggaccugguguucaacuuc

SEQ ID NO: 99567 - RNA, 19 nt, Homo sapiens
ggaggucuuaaacgaauau

SEQ ID NO: 99568 - RNA, 19 nt, Homo sapiens
acaacaaacuggcuuaccu

SEQ ID NO: 99569 - RNA, 19 nt, Homo sapiens
cagcaguccuucccucaac

SEQ ID NO: 99570 - RNA, 19 nt, Homo sapiens
uggagggcauucacaacuu

SEQ ID NO: 99571 - RNA, 19 nt, Homo sapiens
cgccaaacacaccaacuuu

SEQ ID NO: 99572 - RNA, 19 nt, Homo sapiens
caagugguacaugcaguuu

SEQ ID NO: 99573 - RNA, 19 nt, Homo sapiens
gagagaccagccagacgaa

SEQ ID NO: 99574 - RNA, 19 nt, Homo sapiens
ccgugugugucccgaguaa

SEQ ID NO: 99575 - RNA, 19 nt, Homo sapiens
guucaacuucuacaagguu

SEQ ID NO: 99576 - RNA, 19 nt, Homo sapiens
ccaagugguacaugcaguu

SEQ ID NO: 99577 - RNA, 19 nt, Homo sapiens
ccgcuaugcuggccucuac

SEQ ID NO: 99578 - RNA, 19 nt, Homo sapiens
cgaguaaccgugccguugu

SEQ ID NO: 99579 - RNA, 19 nt, Homo sapiens
gauccgcuuuauccucauc

SEQ ID NO: 99580 - RNA, 19 nt, Homo sapiens
gugccguugucgugugauu

SEQ ID NO: 99581 - RNA, 19 nt, Homo sapiens
gcuacagucccuggaguga

SEQ ID NO: 99582 - RNA, 19 nt, Homo sapiens
gccaugauccgcuuuaucc

SEQ ID NO: 99583 - RNA, 19 nt, Homo sapiens
uggaggucuuaaacgaaua

SEQ ID NO: 99584 - RNA, 19 nt, Homo sapiens
gcuaugcuggccucuacuu

SEQ ID NO: 99585 - RNA, 19 nt, Homo sapiens
gaugaugaugagaaacaga

SEQ ID NO: 99586 - RNA, 19 nt, Homo sapiens
agaaacagaagcugaucga

SEQ ID NO: 99587 - RNA, 19 nt, Homo sapiens
uacaugcaguuugaugaug

SEQ ID NO: 99588 - RNA, 19 nt, Homo sapiens
agacgaaggugcugaaaca

SEQ ID NO: 99589 - RNA, 19 nt, Homo sapiens
ggucuuaaacgaauauuuc

SEQ ID NO: 99590 - RNA, 19 nt, Homo sapiens
acgaauauuuccacaaugu

SEQ ID NO: 99591 - RNA, 19 nt, Homo sapiens
guggaggucuuaaacgaau

SEQ ID NO: 99592 - RNA, 19 nt, Homo sapiens
gcaguuugaugaugaugag

SEQ ID NO: 99593 - RNA, 19 nt, Homo sapiens
guuccuggcuggcgaaauc

SEQ ID NO: 99594 - RNA, 19 nt, Homo sapiens
ccacaagggaggagacuuc

SEQ ID NO: 99595 - RNA, 19 nt, Homo sapiens
acaugcaguuugaugauga

SEQ ID NO: 99596 - RNA, 19 nt, Homo sapiens
guugucgugugauuccaua

SEQ ID NO: 99597 - RNA, 19 nt, Homo sapiens
caacuuuguggaggucuua

SEQ ID NO: 99598 - RNA, 19 nt, Homo sapiens
gcuuuauccucauccagaa

SEQ ID NO: 99599 - RNA, 19 nt, Homo sapiens
guuugaugaugaugagaaa

SEQ ID NO: 99600 - RNA, 19 nt, Homo sapiens
agugguacaugcaguuuga

SEQ ID NO: 99601 - RNA, 19 nt, Homo sapiens
gaauauuuccacaaugucu

SEQ ID NO: 99602 - RNA, 19 nt, Homo sapiens
guacaugcaguuugaugau

SEQ ID NO: 99603 - RNA, 19 nt, Homo sapiens
gguacaugcaguuugauga

SEQ ID NO: 99604 - RNA, 19 nt, Homo sapiens
gaccugguguucaacuucu

SEQ ID NO: 99605 - RNA, 19 nt, Homo sapiens
gaguaaccgugccguuguc

SEQ ID NO: 99606 - RNA, 19 nt, Homo sapiens
ggaccugguguucaacuuc

SEQ ID NO: 99607 - RNA, 19 nt, Homo sapiens
ggaggucuuaaacgaauau

SEQ ID NO: 99608 - RNA, 19 nt, Homo sapiens
cagcaguccuucccucaac

SEQ ID NO: 99609 - RNA, 19 nt, Homo sapiens
cgccaaacacaccaacuuu

SEQ ID NO: 99610 - RNA, 19 nt, Homo sapiens
gagagaccagccagacgaa

SEQ ID NO: 99611 - RNA, 19 nt, Homo sapiens
caagugguacaugcaguuu

SEQ ID NO: 99612 - RNA, 19 nt, Homo sapiens
ccgugugugucccgaguaa

SEQ ID NO: 99613 - RNA, 19 nt, Homo sapiens
guucaacuucuacaagguu

SEQ ID NO: 99614 - RNA, 19 nt, Homo sapiens
ccaagugguacaugcaguu

SEQ ID NO: 99615 - RNA, 19 nt, Homo sapiens
cgaguaaccgugccguugu

SEQ ID NO: 99616 - RNA, 19 nt, Homo sapiens
gauccgcuuuauccucauc

SEQ ID NO: 99617 - RNA, 19 nt, Homo sapiens
gugccguugucgugugauu

SEQ ID NO: 99618 - RNA, 19 nt, Homo sapiens
gcuacagucccuggaguga

SEQ ID NO: 99619 - RNA, 19 nt, Homo sapiens
uggaggucuuaaacgaaua

SEQ ID NO: 99620 - RNA, 19 nt, Homo sapiens
gccaugauccgcuuuaucc

SEQ ID NO: 99621 - RNA, 19 nt, Homo sapiens
agaaacagaagcugaucga

SEQ ID NO: 99622 - RNA, 19 nt, Homo sapiens
gaugaugaugagaaacaga

SEQ ID NO: 99623 - RNA, 19 nt, Homo sapiens
uacaugcaguuugaugaug

SEQ ID NO: 99624 - RNA, 19 nt, Homo sapiens
ccaacuuuguggaggucuu

SEQ ID NO: 99625 - RNA, 19 nt, Homo sapiens
gaagagucaucuaaguuua

SEQ ID NO: 99626 - RNA, 19 nt, Homo sapiens
caagguaacuggacuucua

SEQ ID NO: 99627 - RNA, 19 nt, Homo sapiens
ggaggagagucuuaacuuu

SEQ ID NO: 99628 - RNA, 19 nt, Homo sapiens
gaaauugaguaguuccuau

SEQ ID NO: 99629 - RNA, 19 nt, Homo sapiens
ggaagagucaucuaaguuu

SEQ ID NO: 99630 - RNA, 19 nt, Homo sapiens
ccaaguauguauugcauga

SEQ ID NO: 99631 - RNA, 19 nt, Homo sapiens
gaucacaagugcagcauuc

SEQ ID NO: 99632 - RNA, 19 nt, Homo sapiens
ugaaugagauuguuacaca

SEQ ID NO: 99633 - RNA, 19 nt, Homo sapiens
gaagauacacaacagcaaa

SEQ ID NO: 99634 - RNA, 19 nt, Homo sapiens
uaacuggacuucuaaagca

SEQ ID NO: 99635 - RNA, 19 nt, Homo sapiens
ccugagaucccaagaaaua

SEQ ID NO: 99636 - RNA, 19 nt, Homo sapiens
uagacaagguucacaauau

SEQ ID NO: 99637 - RNA, 19 nt, Homo sapiens
agacaagguucacaauauu

SEQ ID NO: 99638 - RNA, 19 nt, Homo sapiens
ccuagaaggaggauuauua

SEQ ID NO: 99639 - RNA, 19 nt, Homo sapiens
gagaucccaagaaauauua

SEQ ID NO: 99640 - RNA, 19 nt, Homo sapiens
uggaggaucugacaacaaa

SEQ ID NO: 99641 - RNA, 19 nt, Homo sapiens
ugccaaaccugcccucuuu

SEQ ID NO: 99642 - RNA, 19 nt, Homo sapiens
uaacauuggugacaucagu

SEQ ID NO: 99643 - RNA, 19 nt, Homo sapiens
gacauuaugcaacguuaua

SEQ ID NO: 99644 - RNA, 19 nt, Homo sapiens
ucagggagacuuuccauuu

SEQ ID NO: 99645 - RNA, 19 nt, Homo sapiens
cggcaugccucuauguauu

SEQ ID NO: 99646 - RNA, 19 nt, Homo sapiens
uguaucagcuguaaagaau

SEQ ID NO: 99647 - RNA, 19 nt, Homo sapiens
guagacaagguucacaaua

SEQ ID NO: 99648 - RNA, 19 nt, Homo sapiens
gcucuuggauuuaagucaa

SEQ ID NO: 99649 - RNA, 19 nt, Homo sapiens
cagggagacuuuccauuug

SEQ ID NO: 99650 - RNA, 19 nt, Homo sapiens
ggaaugguauuggagacaa

SEQ ID NO: 99651 - RNA, 19 nt, Homo sapiens
ucacacaguuguuauuugg

SEQ ID NO: 99652 - RNA, 19 nt, Homo sapiens
cuuaauuccuucugcuaua

SEQ ID NO: 99653 - RNA, 19 nt, Homo sapiens
ucaaggcgauccuaaucuu

SEQ ID NO: 99654 - RNA, 19 nt, Homo sapiens
gaaugguauuggagacaaa

SEQ ID NO: 99655 - RNA, 19 nt, Homo sapiens
cagcauuccuuaauuccuu

SEQ ID NO: 99656 - RNA, 19 nt, Homo sapiens
gagaaccaaguauguauug

SEQ ID NO: 99657 - RNA, 19 nt, Homo sapiens
gggaagagucaucuaaguu

SEQ ID NO: 99658 - RNA, 19 nt, Homo sapiens
gugcagcauuccuuaauuc

SEQ ID NO: 99659 - RNA, 19 nt, Homo sapiens
aaaggccacucccagguaa

SEQ ID NO: 99660 - RNA, 19 nt, Homo sapiens
cuagaaggaggauuauuaa

SEQ ID NO: 99661 - RNA, 19 nt, Homo sapiens
ggagaaccaaguauguauu

SEQ ID NO: 99662 - RNA, 19 nt, Homo sapiens
ccugauaucuacuuuagca

SEQ ID NO: 99663 - RNA, 19 nt, Homo sapiens
caucuaaguuuaccaugca

SEQ ID NO: 99664 - RNA, 19 nt, Homo sapiens
aaaguucaauguugcuguu

SEQ ID NO: 99665 - RNA, 19 nt, Homo sapiens
ucugugagcuggauuugau

SEQ ID NO: 99666 - RNA, 19 nt, Homo sapiens
uugaguaguuccuauguga

SEQ ID NO: 99667 - RNA, 19 nt, Homo sapiens
gcucagugauuuuaaagaa

SEQ ID NO: 99668 - RNA, 19 nt, Homo sapiens
ucaagguacuguauagaag

SEQ ID NO: 99669 - RNA, 19 nt, Homo sapiens
uagacauuaugcaacguua

SEQ ID NO: 99670 - RNA, 19 nt, Homo sapiens
gaguaguuccuaugugauu

SEQ ID NO: 99671 - RNA, 19 nt, Homo sapiens
ggauuuaagucaagguacu

SEQ ID NO: 99672 - RNA, 19 nt, Homo sapiens
guggaaacauuagacaaau

SEQ ID NO: 99673 - RNA, 19 nt, Homo sapiens
ucaaguauuuguggaaaca

SEQ ID NO: 99674 - RNA, 19 nt, Homo sapiens
gaaccaaguauguauugca

SEQ ID NO: 99675 - RNA, 19 nt, Homo sapiens
gcauuccugugcccaccua

SEQ ID NO: 99676 - RNA, 19 nt, Homo sapiens
uaagucaagguacuguaua

SEQ ID NO: 99677 - RNA, 19 nt, Homo sapiens
gaacuuggcauuuuagauc

SEQ ID NO: 99678 - RNA, 19 nt, Homo sapiens
uuccugagaucccaagaaa

SEQ ID NO: 99679 - RNA, 19 nt, Homo sapiens
caagugcagcauuccuuaa

SEQ ID NO: 99680 - RNA, 19 nt, Homo sapiens
acaagugcagcauuccuua

SEQ ID NO: 99681 - RNA, 19 nt, Homo sapiens
guucaauguugcuguucuu

SEQ ID NO: 99682 - RNA, 19 nt, Homo sapiens
ugagaucccaagaaauauu

SEQ ID NO: 99683 - RNA, 19 nt, Homo sapiens
ggagacaaauaugaaugag

SEQ ID NO: 99684 - RNA, 19 nt, Homo sapiens
ggagacuuuccauuuggua

SEQ ID NO: 99685 - RNA, 19 nt, Homo sapiens
ccaugcaguuguuuaccaa

SEQ ID NO: 99686 - RNA, 19 nt, Homo sapiens
gcccuacagugaagauaca

SEQ ID NO: 99687 - RNA, 19 nt, Homo sapiens
gucacacaguuguuauuug

SEQ ID NO: 99688 - RNA, 19 nt, Homo sapiens
gucaagguacuguauagaa

SEQ ID NO: 99689 - RNA, 19 nt, Homo sapiens
gaggagagucuuaacuuuu

SEQ ID NO: 99690 - RNA, 19 nt, Homo sapiens
gagacaaauaugaaugaga

SEQ ID NO: 99691 - RNA, 19 nt, Homo sapiens
uuacaacccucugacucaa

SEQ ID NO: 99692 - RNA, 19 nt, Homo sapiens
gauacacaacagcaaauca

SEQ ID NO: 99693 - RNA, 19 nt, Homo sapiens
ugccugauaucuacuuuag

SEQ ID NO: 99694 - RNA, 19 nt, Homo sapiens
gacaagguucacaauauuc

SEQ ID NO: 99695 - RNA, 19 nt, Homo sapiens
ggauuugauuuuccaugua

SEQ ID NO: 99696 - RNA, 19 nt, Homo sapiens
uguggaaacauuagacaaa

SEQ ID NO: 99697 - RNA, 19 nt, Homo sapiens
gaucugacaacaaacugau

SEQ ID NO: 99698 - RNA, 19 nt, Homo sapiens
caauguugcuguucuugcu

SEQ ID NO: 99699 - RNA, 19 nt, Homo sapiens
cuguauagaaguuguguaa

SEQ ID NO: 99700 - RNA, 19 nt, Homo sapiens
ccucugacucaacaaagua

SEQ ID NO: 99701 - RNA, 19 nt, Homo sapiens
gaaguuguguaaaaucagu

SEQ ID NO: 99702 - RNA, 19 nt, Homo sapiens
aagguacuguauagaaguu

SEQ ID NO: 99703 - RNA, 19 nt, Homo sapiens
gguacuguauagaaguugu

SEQ ID NO: 99704 - RNA, 19 nt, Homo sapiens
caaaucaucagggagacuu

SEQ ID NO: 99705 - RNA, 19 nt, Homo sapiens
ggcaugccucuauguauug

SEQ ID NO: 99706 - RNA, 19 nt, Homo sapiens
ccaaaccugcccucuuuua

SEQ ID NO: 99707 - RNA, 19 nt, Homo sapiens
ugcuauaugucacacaguu

SEQ ID NO: 99708 - RNA, 19 nt, Homo sapiens
ucuaccagcccuacaguga

SEQ ID NO: 99709 - RNA, 19 nt, Homo sapiens
ggaucugacaacaaacuga

SEQ ID NO: 99710 - RNA, 19 nt, Homo sapiens
gggagacuuuccauuuggu

SEQ ID NO: 99711 - RNA, 19 nt, Homo sapiens
acacaacagcaaaucauca

SEQ ID NO: 99712 - RNA, 19 nt, Homo sapiens
acaacccucugacucaaca

SEQ ID NO: 99713 - RNA, 19 nt, Homo sapiens
guaacuggacuucuaaagc

SEQ ID NO: 99714 - RNA, 19 nt, Homo sapiens
guuguuauuuggagaacca

SEQ ID NO: 99715 - RNA, 19 nt, Homo sapiens
ugucacacaguuguuauuu

SEQ ID NO: 99716 - RNA, 19 nt, Homo sapiens
caagguacuguauagaagu

SEQ ID NO: 99717 - RNA, 19 nt, Homo sapiens
uagaggaggagagucuuaa

SEQ ID NO: 99718 - RNA, 19 nt, Homo sapiens
ugacaucaguauaaaagug

SEQ ID NO: 99719 - RNA, 19 nt, Homo sapiens
uggagacaaauaugaauga

SEQ ID NO: 99720 - RNA, 19 nt, Homo sapiens
ucugacaacaaacugauuu

SEQ ID NO: 99721 - RNA, 19 nt, Homo sapiens
agugcagcauuccuuaauu

SEQ ID NO: 99722 - RNA, 19 nt, Homo sapiens
aauaugaaucuuccugaga

SEQ ID NO: 99723 - RNA, 19 nt, Homo sapiens
uaccagcccuacagugaag

SEQ ID NO: 99724 - RNA, 19 nt, Homo sapiens
gagacuuuccauuugguau

SEQ ID NO: 99725 - RNA, 19 nt, Homo sapiens
gcucagagauucacacaga

SEQ ID NO: 99726 - RNA, 19 nt, Homo sapiens
ccacuugccuguuucuuga

SEQ ID NO: 99727 - RNA, 19 nt, Homo sapiens
gugcaaguguggagagaua

SEQ ID NO: 99728 - RNA, 19 nt, Homo sapiens
ccaauccucuuacaccuuu

SEQ ID NO: 99729 - RNA, 19 nt, Homo sapiens
ccaagaauaugcccuuuca

SEQ ID NO: 99730 - RNA, 19 nt, Homo sapiens
ucucagugcugccagauaa

SEQ ID NO: 99731 - RNA, 19 nt, Homo sapiens
gaaggaggaaucagacauu

SEQ ID NO: 99732 - RNA, 19 nt, Homo sapiens
gagauaaccagacuucaug

SEQ ID NO: 99733 - RNA, 19 nt, Homo sapiens
gaagagccacccagaagga

SEQ ID NO: 99734 - RNA, 19 nt, Homo sapiens
gaauaugcccuuucaggau

SEQ ID NO: 99735 - RNA, 19 nt, Homo sapiens
ggcgaccacuugccuguuu

SEQ ID NO: 99736 - RNA, 19 nt, Homo sapiens
ggaagcagcagguggaauc

SEQ ID NO: 99737 - RNA, 19 nt, Homo sapiens
ugucagcuauuuaaagaga

SEQ ID NO: 99738 - RNA, 19 nt, Homo sapiens
ucaauggccaauccucuua

SEQ ID NO: 99739 - RNA, 19 nt, Homo sapiens
ggccaagaauuugaacuga

SEQ ID NO: 99740 - RNA, 19 nt, Homo sapiens
uuaaagagauaaccagacu

SEQ ID NO: 99741 - RNA, 19 nt, Homo sapiens
caaggaaucccugucucua

SEQ ID NO: 99742 - RNA, 19 nt, Homo sapiens
ucaggauggccaagaauuu

SEQ ID NO: 99743 - RNA, 19 nt, Homo sapiens
guucuacugugacaaucaa

SEQ ID NO: 99744 - RNA, 19 nt, Homo sapiens
aaagagauaaccagacuuc

SEQ ID NO: 99745 - RNA, 19 nt, Homo sapiens
cagaagagccacccagaag

SEQ ID NO: 99746 - RNA, 19 nt, Homo sapiens
uuucucacuucaauccuua

SEQ ID NO: 99747 - RNA, 19 nt, Homo sapiens
ccaaauuuaaugucagcua

SEQ ID NO: 99748 - RNA, 19 nt, Homo sapiens
gauaaccagacuucauguu

SEQ ID NO: 99749 - RNA, 19 nt, Homo sapiens
gaauuugaacugagcaucu

SEQ ID NO: 99750 - RNA, 19 nt, Homo sapiens
gaucuuuucucacuucaau

SEQ ID NO: 99751 - RNA, 19 nt, Homo sapiens
gcuaacagcaugaucuuuu

SEQ ID NO: 99752 - RNA, 19 nt, Homo sapiens
ucuuacaccuuugaccaua

SEQ ID NO: 99753 - RNA, 19 nt, Homo sapiens
gacuucauguugccaagga

SEQ ID NO: 99754 - RNA, 19 nt, Homo sapiens
ugucuuccauuuccaagug

SEQ ID NO: 99755 - RNA, 19 nt, Homo sapiens
ccuuacuccugcucauuaa

SEQ ID NO: 99756 - RNA, 19 nt, Homo sapiens
auaucucccugaccaaauu

SEQ ID NO: 99757 - RNA, 19 nt, Homo sapiens
uuacaccuuugaccauaga

SEQ ID NO: 99758 - RNA, 19 nt, Homo sapiens
cagaaggagacaacaaugu

SEQ ID NO: 99759 - RNA, 19 nt, Homo sapiens
cauaucugcagguggauuu

SEQ ID NO: 99760 - RNA, 19 nt, Homo sapiens
ucuacugguucuacuguga

SEQ ID NO: 99761 - RNA, 19 nt, Homo sapiens
gaagucuggacacaauuca

SEQ ID NO: 99762 - RNA, 19 nt, Homo sapiens
gauaucucccugaccaaau

SEQ ID NO: 99763 - RNA, 19 nt, Homo sapiens
gugaagauggugcaagugu

SEQ ID NO: 99764 - RNA, 19 nt, Homo sapiens
caugaacagccgugaguau

SEQ ID NO: 99765 - RNA, 19 nt, Homo sapiens
caggauggccaagaauuug

SEQ ID NO: 99766 - RNA, 19 nt, Homo sapiens
aaggaggaaucagacauug

SEQ ID NO: 99767 - RNA, 19 nt, Homo sapiens
ccagaaggagacaacaaug

SEQ ID NO: 99768 - RNA, 19 nt, Homo sapiens
ucagaagagccacccagaa

SEQ ID NO: 99769 - RNA, 19 nt, Homo sapiens
ggauggccaagaauuugaa

SEQ ID NO: 99770 - RNA, 19 nt, Homo sapiens
gcaaguguggagagauauc

SEQ ID NO: 99771 - RNA, 19 nt, Homo sapiens
aaucaaagggcgaccacuu

SEQ ID NO: 99772 - RNA, 19 nt, Homo sapiens
auaaccagacuucauguug

SEQ ID NO: 99773 - RNA, 19 nt, Homo sapiens
cagcuaacagcaugaucuu

SEQ ID NO: 99774 - RNA, 19 nt, Homo sapiens
ggauuuccacacugagaug

SEQ ID NO: 99775 - RNA, 19 nt, Homo sapiens
ggauuccaaagccagcuaa

SEQ ID NO: 99776 - RNA, 19 nt, Homo sapiens
ccaaggaaucccugucucu

SEQ ID NO: 99777 - RNA, 19 nt, Homo sapiens
agagauaaccagacuucau

SEQ ID NO: 99778 - RNA, 19 nt, Homo sapiens
uccuuacuccugcucauua

SEQ ID NO: 99779 - RNA, 19 nt, Homo sapiens
gagauucacacagaagucu

SEQ ID NO: 99780 - RNA, 19 nt, Homo sapiens
gcgaccacuugccuguuuc

SEQ ID NO: 99781 - RNA, 19 nt, Homo sapiens
uugccuguuucuugaauga

SEQ ID NO: 99782 - RNA, 19 nt, Homo sapiens
agaugaaggaggaaucaga

SEQ ID NO: 99783 - RNA, 19 nt, Homo sapiens
gcacgaguaucuuuguuua

SEQ ID NO: 99784 - RNA, 19 nt, Homo sapiens
gaacaacaauggcuaugaa

SEQ ID NO: 99785 - RNA, 19 nt, Homo sapiens
gaaggcagauggaaauauu

SEQ ID NO: 99786 - RNA, 19 nt, Homo sapiens
caagguauuucacaacuua

SEQ ID NO: 99787 - RNA, 19 nt, Homo sapiens
guacauaccuggcuggauu

SEQ ID NO: 99788 - RNA, 19 nt, Homo sapiens
caaagaagcuccaaacaag

SEQ ID NO: 99789 - RNA, 19 nt, Homo sapiens
gaacagcucacaaguauau

SEQ ID NO: 99790 - RNA, 19 nt, Homo sapiens
gaagaaauauccaacugau

SEQ ID NO: 99791 - RNA, 19 nt, Homo sapiens
ggaaacgugugucuauauu

SEQ ID NO: 99792 - RNA, 19 nt, Homo sapiens
gaagagguguugagguuau

SEQ ID NO: 99793 - RNA, 19 nt, Homo sapiens
aaaguuagcugaauaugga

SEQ ID NO: 99794 - RNA, 19 nt, Homo sapiens
ucagaaauauccaacauug

SEQ ID NO: 99795 - RNA, 19 nt, Homo sapiens
gaagacaagagcaauagua

SEQ ID NO: 99796 - RNA, 19 nt, Homo sapiens
gaauauggaccacaaggua

SEQ ID NO: 99797 - RNA, 19 nt, Homo sapiens
ugacagugcugcccaugua

SEQ ID NO: 99798 - RNA, 19 nt, Homo sapiens
gacaaaggcugacuaugug

SEQ ID NO: 99799 - RNA, 19 nt, Homo sapiens
gaccugaaauuaauaagga

SEQ ID NO: 99800 - RNA, 19 nt, Homo sapiens
guacgcaauuugagacuaa

SEQ ID NO: 99801 - RNA, 19 nt, Homo sapiens
gauaaaccacuuccgauaa

SEQ ID NO: 99802 - RNA, 19 nt, Homo sapiens
gaacaaggacaccagcaaa

SEQ ID NO: 99803 - RNA, 19 nt, Homo sapiens
gggcuucgaucggcauuua

SEQ ID NO: 99804 - RNA, 19 nt, Homo sapiens
gaaacacucauucaacaaa

SEQ ID NO: 99805 - RNA, 19 nt, Homo sapiens
uggaacagcucacaaguau

SEQ ID NO: 99806 - RNA, 19 nt, Homo sapiens
ccaccaagaccugaaauua

SEQ ID NO: 99807 - RNA, 19 nt, Homo sapiens
acaaauggauguggaauau

SEQ ID NO: 99808 - RNA, 19 nt, Homo sapiens
gaacugcagcugucaauag

SEQ ID NO: 99809 - RNA, 19 nt, Homo sapiens
caaaggaagccaacucuga

SEQ ID NO: 99810 - RNA, 19 nt, Homo sapiens
aaagugaacucauacagau

SEQ ID NO: 99811 - RNA, 19 nt, Homo sapiens
ccauccagcuugagaguaa

SEQ ID NO: 99812 - RNA, 19 nt, Homo sapiens
gacaggagguuuacagaca

SEQ ID NO: 99813 - RNA, 19 nt, Homo sapiens
guaaggcauuuguccauga

SEQ ID NO: 99814 - RNA, 19 nt, Homo sapiens
gaaauacagucugcaagca

SEQ ID NO: 99815 - RNA, 19 nt, Homo sapiens
gaaauggagcugucucuca

SEQ ID NO: 99816 - RNA, 19 nt, Homo sapiens
ggaugacggugucuacuca

SEQ ID NO: 99817 - RNA, 19 nt, Homo sapiens
gacauaugcuucagaucaa

SEQ ID NO: 99818 - RNA, 19 nt, Homo sapiens
ggaagaaauauccaacuga

SEQ ID NO: 99819 - RNA, 19 nt, Homo sapiens
ggaagaauacaagcaguaa

SEQ ID NO: 99820 - RNA, 19 nt, Homo sapiens
gaagacaaaggcugacuau

SEQ ID NO: 99821 - RNA, 19 nt, Homo sapiens
aaagaaagacaccuucgua

SEQ ID NO: 99822 - RNA, 19 nt, Homo sapiens
gaaacgugugucuauauuu

SEQ ID NO: 99823 - RNA, 19 nt, Homo sapiens
cuacugcucucaucccaaa

SEQ ID NO: 99824 - RNA, 19 nt, Homo sapiens
gcucacaaguauaucauuc

SEQ ID NO: 99825 - RNA, 19 nt, Homo sapiens
gcucauuuguggcuucuga

SEQ ID NO: 99826 - RNA, 19 nt, Homo sapiens
aaggacacuuuguuucuua

SEQ ID NO: 99827 - RNA, 19 nt, Homo sapiens
gaacucauacagauaaaca

SEQ ID NO: 99828 - RNA, 19 nt, Homo sapiens
uguacaaagugaacucaua

SEQ ID NO: 99829 - RNA, 19 nt, Homo sapiens
gaccaaaacuugagaccua

SEQ ID NO: 99830 - RNA, 19 nt, Homo sapiens
agacaaaggcugacuaugu

SEQ ID NO: 99831 - RNA, 19 nt, Homo sapiens
guuaaagaccugugauaaa

SEQ ID NO: 99832 - RNA, 19 nt, Homo sapiens
gcaauuugagacuaagaua

SEQ ID NO: 99833 - RNA, 19 nt, Homo sapiens
gcacagaucuuuucauugc

SEQ ID NO: 99834 - RNA, 19 nt, Homo sapiens
uaaggucgaucugaaauca

SEQ ID NO: 99835 - RNA, 19 nt, Homo sapiens
caccaagaccugaaauuaa

SEQ ID NO: 99836 - RNA, 19 nt, Homo sapiens
gaaaauggcacagaucuuu

SEQ ID NO: 99837 - RNA, 19 nt, Homo sapiens
gaauacuacugcucucauc

SEQ ID NO: 99838 - RNA, 19 nt, Homo sapiens
gagguuaugucaagcaucu

SEQ ID NO: 99839 - RNA, 19 nt, Homo sapiens
ggaaucacagggagaugua

SEQ ID NO: 99840 - RNA, 19 nt, Homo sapiens
gaaaaccacuccuaugaca

SEQ ID NO: 99841 - RNA, 19 nt, Homo sapiens
ccaccucacuccugauuuc

SEQ ID NO: 99842 - RNA, 19 nt, Homo sapiens
caaagugaacucauacaga

SEQ ID NO: 99843 - RNA, 19 nt, Homo sapiens
gcagauuggacaaagaauu

SEQ ID NO: 99844 - RNA, 19 nt, Homo sapiens
ucagagacaaguucaauga

SEQ ID NO: 99845 - RNA, 19 nt, Homo sapiens
ugauggaucugaaauugug

SEQ ID NO: 99846 - RNA, 19 nt, Homo sapiens
caaauguaguaaagaagug

SEQ ID NO: 99847 - RNA, 19 nt, Homo sapiens
uuaaagaccugugauaaac

SEQ ID NO: 99848 - RNA, 19 nt, Homo sapiens
gaugaaacgucugcuccuu

SEQ ID NO: 99849 - RNA, 19 nt, Homo sapiens
ggauguggaauauaauuga

SEQ ID NO: 99850 - RNA, 19 nt, Homo sapiens
ucccauaccugaucucuuc

SEQ ID NO: 99851 - RNA, 19 nt, Homo sapiens
caagcaagcucacaaaccu

SEQ ID NO: 99852 - RNA, 19 nt, Homo sapiens
cagaacagccaguggauga

SEQ ID NO: 99853 - RNA, 19 nt, Homo sapiens
caacauugcacgaguaucu

SEQ ID NO: 99854 - RNA, 19 nt, Homo sapiens
ggauugagaaugaugaaau

SEQ ID NO: 99855 - RNA, 19 nt, Homo sapiens
ggaagcauggcgacuggua

SEQ ID NO: 99856 - RNA, 19 nt, Homo sapiens
caacaaagaagcuccaaac

SEQ ID NO: 99857 - RNA, 19 nt, Homo sapiens
ugauaaaccacuuccgaua

SEQ ID NO: 99858 - RNA, 19 nt, Homo sapiens
gguuaaagaccugugauaa

SEQ ID NO: 99859 - RNA, 19 nt, Homo sapiens
ugaaacgucugcuccuugu

SEQ ID NO: 99860 - RNA, 19 nt, Homo sapiens
caaguguguuucagcagaa

SEQ ID NO: 99861 - RNA, 19 nt, Homo sapiens
accaagaccugaaauuaau

SEQ ID NO: 99862 - RNA, 19 nt, Homo sapiens
ccuuggaacuacuggauaa

SEQ ID NO: 99863 - RNA, 19 nt, Homo sapiens
caaaaugacaggagguuua

SEQ ID NO: 99864 - RNA, 19 nt, Homo sapiens
acaaagaagcuccaaacaa

SEQ ID NO: 99865 - RNA, 19 nt, Homo sapiens
guaagauguucagcaggua

SEQ ID NO: 99866 - RNA, 19 nt, Homo sapiens
acagggagauguacagcaa

SEQ ID NO: 99867 - RNA, 19 nt, Homo sapiens
ggauuaacccuccagaaca

SEQ ID NO: 99868 - RNA, 19 nt, Homo sapiens
agacauaugcuucagauca

SEQ ID NO: 99869 - RNA, 19 nt, Homo sapiens
caggagguuuacagacaua

SEQ ID NO: 99870 - RNA, 19 nt, Homo sapiens
ggguugggauggugacauu

SEQ ID NO: 99871 - RNA, 19 nt, Homo sapiens
cgaagcacaugggaaguga

SEQ ID NO: 99872 - RNA, 19 nt, Homo sapiens
ggaagacaaaggcugacua

SEQ ID NO: 99873 - RNA, 19 nt, Homo sapiens
caacuuaugacacgaaugg

SEQ ID NO: 99874 - RNA, 19 nt, Homo sapiens
caauuacagugacuuccaa

SEQ ID NO: 99875 - RNA, 19 nt, Homo sapiens
gcaagguggcuuuguagug

SEQ ID NO: 99876 - RNA, 19 nt, Homo sapiens
gaauacaagcaguaagaug

SEQ ID NO: 99877 - RNA, 19 nt, Homo sapiens
gauaaggucgaucugaaau

SEQ ID NO: 99878 - RNA, 19 nt, Homo sapiens
gauuaacccuccagaacag

SEQ ID NO: 99879 - RNA, 19 nt, Homo sapiens
gaggagcuguccaaaauga

SEQ ID NO: 99880 - RNA, 19 nt, Homo sapiens
cagauuggacaaagaauug

SEQ ID NO: 99881 - RNA, 19 nt, Homo sapiens
gaagugauccgugauucug

SEQ ID NO: 99882 - RNA, 19 nt, Homo sapiens
gaacaaaaccacaacaaag

SEQ ID NO: 99883 - RNA, 19 nt, Homo sapiens
ggaaccagcucagcaaaua

SEQ ID NO: 99884 - RNA, 19 nt, Homo sapiens
gaugguggcuguuaucuug

SEQ ID NO: 99885 - RNA, 19 nt, Homo sapiens
gaagaucucucuggcaaga

SEQ ID NO: 99886 - RNA, 19 nt, Homo sapiens
cagcaaauauaccaucuuu

SEQ ID NO: 99887 - RNA, 19 nt, Homo sapiens
gcuaggagcugcauuugga

SEQ ID NO: 99888 - RNA, 19 nt, Homo sapiens
gaggaucacuauucuaaau

SEQ ID NO: 99889 - RNA, 19 nt, Homo sapiens
ucaagaagcuacccuacuu

SEQ ID NO: 99890 - RNA, 19 nt, Homo sapiens
ugaaggaacuaccagcuuu

SEQ ID NO: 99891 - RNA, 19 nt, Homo sapiens
gcaaauucaugucuguguu

SEQ ID NO: 99892 - RNA, 19 nt, Homo sapiens
gaaggaauaccucacaaug

SEQ ID NO: 99893 - RNA, 19 nt, Homo sapiens
guucagcgccuuuguguuu

SEQ ID NO: 99894 - RNA, 19 nt, Homo sapiens
gauaacaugucaccugaag

SEQ ID NO: 99895 - RNA, 19 nt, Homo sapiens
ggacugcccucugagaaug

SEQ ID NO: 99896 - RNA, 19 nt, Homo sapiens
gcgaagccaucaguacuuu

SEQ ID NO: 99897 - RNA, 19 nt, Homo sapiens
aggaauaccucacaaugaa

SEQ ID NO: 99898 - RNA, 19 nt, Homo sapiens
cgaauuaacgggucagauu

SEQ ID NO: 99899 - RNA, 19 nt, Homo sapiens
caugucaccugaagagauu

SEQ ID NO: 99900 - RNA, 19 nt, Homo sapiens
gugauuugcuucgaauuaa

SEQ ID NO: 99901 - RNA, 19 nt, Homo sapiens
gcaaggaugaggaucacua

SEQ ID NO: 99902 - RNA, 19 nt, Homo sapiens
gagggaauauggagcaauc

SEQ ID NO: 99903 - RNA, 19 nt, Homo sapiens
ggacagguggugagaagaa

SEQ ID NO: 99904 - RNA, 19 nt, Homo sapiens
ggaugaggaugaacugauc

SEQ ID NO: 99905 - RNA, 19 nt, Homo sapiens
gcucacauccugcccauga

SEQ ID NO: 99906 - RNA, 19 nt, Homo sapiens
ggaucacuauucuaaaugu

SEQ ID NO: 99907 - RNA, 19 nt, Homo sapiens
gaauuaacgggucagauug

SEQ ID NO: 99908 - RNA, 19 nt, Homo sapiens
gcucuuuccugaugguauu

SEQ ID NO: 99909 - RNA, 19 nt, Homo sapiens
ggucaacguugucaucauc

SEQ ID NO: 99910 - RNA, 19 nt, Homo sapiens
gcuacggacugcccucuga

SEQ ID NO: 99911 - RNA, 19 nt, Homo sapiens
gaaccaauuuccgaaugga

SEQ ID NO: 99912 - RNA, 19 nt, Homo sapiens
ggagcuggccgacaucuug

SEQ ID NO: 99913 - RNA, 19 nt, Homo sapiens
caccaucacugcucuguuc

SEQ ID NO: 99914 - RNA, 19 nt, Homo sapiens
ggaugaggaucacuauucu

SEQ ID NO: 99915 - RNA, 19 nt, Homo sapiens
gccaugcucuuuccugaug

SEQ ID NO: 99916 - RNA, 19 nt, Homo sapiens
caucaucuuucucuucuuc

SEQ ID NO: 99917 - RNA, 19 nt, Homo sapiens
ccagucagcuguguggauu

SEQ ID NO: 99918 - RNA, 19 nt, Homo sapiens
ccugggagcuguauuugug

SEQ ID NO: 99919 - RNA, 19 nt, Homo sapiens
caagguagagggcgaguug

SEQ ID NO: 99920 - RNA, 19 nt, Homo sapiens
ugucggagcugccuuacga

SEQ ID NO: 99921 - RNA, 19 nt, Homo sapiens
auucauggcuggagaguug

SEQ ID NO: 99922 - RNA, 19 nt, Homo sapiens
acauagggaugcccaagaa

SEQ ID NO: 99923 - RNA, 19 nt, Homo sapiens
ccacagacgaggaggauga

SEQ ID NO: 99924 - RNA, 19 nt, Homo sapiens
caagacucauacccuguuu

SEQ ID NO: 99925 - RNA, 19 nt, Homo sapiens
ccauacuacuacucugaua

SEQ ID NO: 99926 - RNA, 19 nt, Homo sapiens
cagaaccaauuuccgaaug

SEQ ID NO: 99927 - RNA, 19 nt, Homo sapiens
gaagacaggcuccaguucu

SEQ ID NO: 99928 - RNA, 19 nt, Homo sapiens
ggaugaggaugaggacgaa

SEQ ID NO: 99929 - RNA, 19 nt, Homo sapiens
gcuguauccuggaauuguu

SEQ ID NO: 99930 - RNA, 19 nt, Homo sapiens
ggagucggcuguuguuuug

SEQ ID NO: 99931 - RNA, 19 nt, Homo sapiens
ggaauaccucacaaugaaa

SEQ ID NO: 99932 - RNA, 19 nt, Homo sapiens
gagcauggacuacgucagu

SEQ ID NO: 99933 - RNA, 19 nt, Homo sapiens
aagacaggcuccaguucua

SEQ ID NO: 99934 - RNA, 19 nt, Homo sapiens
ccaggauuccacagauuua

SEQ ID NO: 99935 - RNA, 19 nt, Homo sapiens
gaaccagcucagcaaauau

SEQ ID NO: 99936 - RNA, 19 nt, Homo sapiens
gaagccaucaguacuuugu

SEQ ID NO: 99937 - RNA, 19 nt, Homo sapiens
ggucaccuccaccuacuuu

SEQ ID NO: 99938 - RNA, 19 nt, Homo sapiens
cccacgaccuccucauaaa

SEQ ID NO: 99939 - RNA, 19 nt, Homo sapiens
agacaacccugcacaagac

SEQ ID NO: 99940 - RNA, 19 nt, Homo sapiens
ugagccagccugucuguuu

SEQ ID NO: 99941 - RNA, 19 nt, Homo sapiens
gguacgugaugugaaguuu

SEQ ID NO: 99942 - RNA, 19 nt, Homo sapiens
gucaugaaguucuggaugu

SEQ ID NO: 99943 - RNA, 19 nt, Homo sapiens
caacaauacaugggugaaa

SEQ ID NO: 99944 - RNA, 19 nt, Homo sapiens
ucagccaguuucuugcuaa

SEQ ID NO: 99945 - RNA, 19 nt, Homo sapiens
gaauggauuuccccuuuga

SEQ ID NO: 99946 - RNA, 19 nt, Homo sapiens
gaacuacuggagaggauuc

SEQ ID NO: 99947 - RNA, 19 nt, Homo sapiens
uaacaugucaccugaagag

SEQ ID NO: 99948 - RNA, 19 nt, Homo sapiens
gacagguggugagaagaaa

SEQ ID NO: 99949 - RNA, 19 nt, Homo sapiens
cgaggaggaugaggaugaa

SEQ ID NO: 99950 - RNA, 19 nt, Homo sapiens
aagaggagcuggccgacau

SEQ ID NO: 99951 - RNA, 19 nt, Homo sapiens
gagcuguauuuguguaucu

SEQ ID NO: 99952 - RNA, 19 nt, Homo sapiens
ggacuacgucagugccaaa

SEQ ID NO: 99953 - RNA, 19 nt, Homo sapiens
gcagaggcuuaaggagcua

SEQ ID NO: 99954 - RNA, 19 nt, Homo sapiens
ugugauuugcuucgaauua

SEQ ID NO: 99955 - RNA, 19 nt, Homo sapiens
gcugugauuugcuucgaau

SEQ ID NO: 99956 - RNA, 19 nt, Homo sapiens
ggaauuguuaccuuuguca

SEQ ID NO: 99957 - RNA, 19 nt, Homo sapiens
ggacagcaaggaugaggau

SEQ ID NO: 99958 - RNA, 19 nt, Homo sapiens
uuugauuccugcuguauug

SEQ ID NO: 99959 - RNA, 19 nt, Homo sapiens
caugguacgugaugugaag

SEQ ID NO: 99960 - RNA, 19 nt, Homo sapiens
gaauaccucacaaugaaag

SEQ ID NO: 99961 - RNA, 19 nt, Homo sapiens
ccaauuuccgaauggauuu

SEQ ID NO: 99962 - RNA, 19 nt, Homo sapiens
ccacauugccagcaucugu

SEQ ID NO: 99963 - RNA, 19 nt, Homo sapiens
cagacaacccugcacaaga

SEQ ID NO: 99964 - RNA, 19 nt, Homo sapiens
guaccaguauaugcccuuu

SEQ ID NO: 99965 - RNA, 19 nt, Homo sapiens
aaccagcucagcaaauaua

SEQ ID NO: 99966 - RNA, 19 nt, Homo sapiens
gcugguaggagaaaucaug

SEQ ID NO: 99967 - RNA, 19 nt, Homo sapiens
caccaggaaugggucaauu

SEQ ID NO: 99968 - RNA, 19 nt, Homo sapiens
gagccagccugucuguuuu

SEQ ID NO: 99969 - RNA, 19 nt, Homo sapiens
accaguauaugcccuuuga

SEQ ID NO: 99970 - RNA, 19 nt, Homo sapiens
gcccucagccaguuucuug

SEQ ID NO: 99971 - RNA, 19 nt, Homo sapiens
ucagcaaauucaugucugu

SEQ ID NO: 99972 - RNA, 19 nt, Homo sapiens
cgaaaugaagacaauacuu

SEQ ID NO: 99973 - RNA, 19 nt, Homo sapiens
ggaaggcugguaggagaaa

SEQ ID NO: 99974 - RNA, 19 nt, Homo sapiens
acaaggcccucagccaguu

SEQ ID NO: 99975 - RNA, 19 nt, Homo sapiens
gauuuauggccaucacaaa

SEQ ID NO: 99976 - RNA, 19 nt, Homo sapiens
caaauucaugucuguguuc

SEQ ID NO: 99977 - RNA, 19 nt, Homo sapiens
caacccaggauuccacaga

SEQ ID NO: 99978 - RNA, 19 nt, Homo sapiens
uuauggccaucacaaagaa

SEQ ID NO: 99979 - RNA, 19 nt, Homo sapiens
gcccgaguccuucgccuuu

SEQ ID NO: 99980 - RNA, 19 nt, Homo sapiens
uacgugaugugaaguuugu

SEQ ID NO: 99981 - RNA, 19 nt, Homo sapiens
agacagggagcaggacaua

SEQ ID NO: 99982 - RNA, 19 nt, Homo sapiens
cugcagcccucucucuaug

SEQ ID NO: 99983 - RNA, 19 nt, Homo sapiens
gaugagcccugaagagauu

SEQ ID NO: 99984 - RNA, 19 nt, Homo sapiens
ggacagcucucacagaaag

SEQ ID NO: 99985 - RNA, 19 nt, Homo sapiens
gcacaagacucacacuauc

SEQ ID NO: 99986 - RNA, 19 nt, Homo sapiens
gaguggugcugaaagaaua

SEQ ID NO: 99987 - RNA, 19 nt, Homo sapiens
gaaucucccuggcaaguga

SEQ ID NO: 99988 - RNA, 19 nt, Homo sapiens
agaggaagcugcucggauu

SEQ ID NO: 99989 - RNA, 19 nt, Homo sapiens
gagaaugaaucccggaaca

SEQ ID NO: 99990 - RNA, 19 nt, Homo sapiens
gagcagacccugauguaug

SEQ ID NO: 99991 - RNA, 19 nt, Homo sapiens
ucaagaccuuuauagcuaa

SEQ ID NO: 99992 - RNA, 19 nt, Homo sapiens
gagaugagcccugaagaga

SEQ ID NO: 99993 - RNA, 19 nt, Homo sapiens
guucacaggugguggcauu

SEQ ID NO: 99994 - RNA, 19 nt, Homo sapiens
gaaccgggaugaagagacu

SEQ ID NO: 99995 - RNA, 19 nt, Homo sapiens
cucaagaccuuuauagcua

SEQ ID NO: 99996 - RNA, 19 nt, Homo sapiens
aagaauaccucacacucaa

SEQ ID NO: 99997 - RNA, 19 nt, Homo sapiens
gcaaguuccucucccucuu

SEQ ID NO: 99998 - RNA, 19 nt, Homo sapiens
ccagagcucuuggaauaug

SEQ ID NO: 99999 - RNA, 19 nt, Homo sapiens
ccccagagcucuuggaaua

SEQ ID NO: 100000 - RNA, 19 nt, Homo sapiens
agaugaaccugucaacuuc

SEQ ID NO: 100001 - RNA, 19 nt, Homo sapiens
ccagaccucuccacuaucu

SEQ ID NO: 100002 - RNA, 19 nt, Homo sapiens
guggagcccucuuugucua

SEQ ID NO: 100003 - RNA, 19 nt, Homo sapiens
uagaugaaccugucaacuu

SEQ ID NO: 100004 - RNA, 19 nt, Homo sapiens
gaauaccucacacucaaga

SEQ ID NO: 100005 - RNA, 19 nt, Homo sapiens
cuggacagcucucacagaa

SEQ ID NO: 100006 - RNA, 19 nt, Homo sapiens
ccuaaagccugcacucaag

SEQ ID NO: 100007 - RNA, 19 nt, Homo sapiens
acccagaccucuccacuau

SEQ ID NO: 100008 - RNA, 19 nt, Homo sapiens
ucaagaaacugcccuaccu

SEQ ID NO: 100009 - RNA, 19 nt, Homo sapiens
gggaggagcagcaacuaga

SEQ ID NO: 100010 - RNA, 19 nt, Homo sapiens
aucaaucgcuuccucauga

SEQ ID NO: 100011 - RNA, 19 nt, Homo sapiens
uauuacagcccucuucaaa

SEQ ID NO: 100012 - RNA, 19 nt, Homo sapiens
ggucaccuccaccuucuuu

SEQ ID NO: 100013 - RNA, 19 nt, Homo sapiens
cgacgacaaaugccaauga

SEQ ID NO: 100014 - RNA, 19 nt, Homo sapiens
gcuuaugucaccaguauug

SEQ ID NO: 100015 - RNA, 19 nt, Homo sapiens
ggaagauuguccaggugau

SEQ ID NO: 100016 - RNA, 19 nt, Homo sapiens
gaaugaaucccggaacaca

SEQ ID NO: 100017 - RNA, 19 nt, Homo sapiens
caaguuccucucccucuuu

SEQ ID NO: 100018 - RNA, 19 nt, Homo sapiens
gugcauaucgcaagcaugu

SEQ ID NO: 100019 - RNA, 19 nt, Homo sapiens
ucagcugggucauggacua

SEQ ID NO: 100020 - RNA, 19 nt, Homo sapiens
gcugaagcguguccgaauc

SEQ ID NO: 100021 - RNA, 19 nt, Homo sapiens
cagcagcaccuaccggauu

SEQ ID NO: 100022 - RNA, 19 nt, Homo sapiens
gcauaucgcaagcaugugu

SEQ ID NO: 100023 - RNA, 19 nt, Homo sapiens
ggaguggugcugaaagaau

SEQ ID NO: 100024 - RNA, 19 nt, Homo sapiens
gaguggaccaugcuuaugu

SEQ ID NO: 100025 - RNA, 19 nt, Homo sapiens
gacagcaucauccgaauca

SEQ ID NO: 100026 - RNA, 19 nt, Homo sapiens
gcugaaagaauaccucaca

SEQ ID NO: 100027 - RNA, 19 nt, Homo sapiens
cgacagcgacgacaaaugc

SEQ ID NO: 100028 - RNA, 19 nt, Homo sapiens
uaccugaaccggaagauug

SEQ ID NO: 100029 - RNA, 19 nt, Homo sapiens
cuuuauagcuaaggucauu

SEQ ID NO: 100030 - RNA, 19 nt, Homo sapiens
cauccugccugucaugauc

SEQ ID NO: 100031 - RNA, 19 nt, Homo sapiens
gcucuggcaucccugagau

SEQ ID NO: 100032 - RNA, 19 nt, Homo sapiens
gggaguggaccaugcuuau

SEQ ID NO: 100033 - RNA, 19 nt, Homo sapiens
gugagaagcgcaagcugaa

SEQ ID NO: 100034 - RNA, 19 nt, Homo sapiens
gcaccucacaggccuggaa

SEQ ID NO: 100035 - RNA, 19 nt, Homo sapiens
aaagaauaccucacacuca

SEQ ID NO: 100036 - RNA, 19 nt, Homo sapiens
ggagaccacugaggugcau

SEQ ID NO: 100037 - RNA, 19 nt, Homo sapiens
ugccacaaguuccuaguau

SEQ ID NO: 100038 - RNA, 19 nt, Homo sapiens
ggugaacacagaagacuca

SEQ ID NO: 100039 - RNA, 19 nt, Homo sapiens
gagcucacaggccagauug

SEQ ID NO: 100040 - RNA, 19 nt, Homo sapiens
ggguaucuaugagaaugaa

SEQ ID NO: 100041 - RNA, 19 nt, Homo sapiens
gaagauuguccaggugaug

SEQ ID NO: 100042 - RNA, 19 nt, Homo sapiens
cgggaugaagagacuauua

SEQ ID NO: 100043 - RNA, 19 nt, Homo sapiens
augcuuaugucaccaguau

SEQ ID NO: 100044 - RNA, 19 nt, Homo sapiens
ggaccuggaaggcgagaug

SEQ ID NO: 100045 - RNA, 19 nt, Homo sapiens
gcccacauccugccuguca

SEQ ID NO: 100046 - RNA, 19 nt, Homo sapiens
gcuuccaggugaacacaga

SEQ ID NO: 100047 - RNA, 19 nt, Homo sapiens
cuucaugccugucuuuguc

SEQ ID NO: 100048 - RNA, 19 nt, Homo sapiens
cuggucaucuucauucuca

SEQ ID NO: 100049 - RNA, 19 nt, Homo sapiens
gaggaaacgccugcucuuc

SEQ ID NO: 100050 - RNA, 19 nt, Homo sapiens
ggaugaagagacuauuaca

SEQ ID NO: 100051 - RNA, 19 nt, Homo sapiens
uggaaucguuacucuaaag

SEQ ID NO: 100052 - RNA, 19 nt, Homo sapiens
agacucauuggaaucguua

SEQ ID NO: 100053 - RNA, 19 nt, Homo sapiens
cagacucauuggaaucguu

SEQ ID NO: 100054 - RNA, 19 nt, Homo sapiens
cugcagcccucccucuaug

SEQ ID NO: 100055 - RNA, 19 nt, Homo sapiens
gaggagcagcaacuagaug

SEQ ID NO: 100056 - RNA, 19 nt, Homo sapiens
ggaggagcagcaacuagau

SEQ ID NO: 100057 - RNA, 19 nt, Homo sapiens
cacaggugguggcauuguu

SEQ ID NO: 100058 - RNA, 19 nt, Homo sapiens
caucauccgaaucaagaaa

SEQ ID NO: 100059 - RNA, 19 nt, Homo sapiens
gccacaaguuccuaguauc

SEQ ID NO: 100060 - RNA, 19 nt, Homo sapiens
ccucuccacuaucugauca

SEQ ID NO: 100061 - RNA, 19 nt, Homo sapiens
ucagccggauucacacaga

SEQ ID NO: 100062 - RNA, 19 nt, Homo sapiens
gaaucguuacucuaaagga

SEQ ID NO: 100063 - RNA, 19 nt, Homo sapiens
aguauuggcagacucauug

SEQ ID NO: 100064 - RNA, 19 nt, Homo sapiens
ggaguggaccaugcuuaug

SEQ ID NO: 100065 - RNA, 19 nt, Homo sapiens
cucaugaaguucuggaugu

SEQ ID NO: 100066 - RNA, 19 nt, Homo sapiens
gggaugaagagacuauuac

SEQ ID NO: 100067 - RNA, 19 nt, Homo sapiens
gacucacacuaucuucuca

SEQ ID NO: 100068 - RNA, 19 nt, Homo sapiens
guuggaauccugugagaag

SEQ ID NO: 100069 - RNA, 19 nt, Homo sapiens
ggucaucuucauucucaug

SEQ ID NO: 100070 - RNA, 19 nt, Homo sapiens
caccuucagugccuucauc

SEQ ID NO: 100071 - RNA, 19 nt, Homo sapiens
uauccaggguuggugaaga

SEQ ID NO: 100072 - RNA, 19 nt, Homo sapiens
ucauuggaaucguuacucu

SEQ ID NO: 100073 - RNA, 19 nt, Homo sapiens
ggagcagcaacuagaugaa

SEQ ID NO: 100074 - RNA, 19 nt, Homo sapiens
ggcccagugucaccaggaa

SEQ ID NO: 100075 - RNA, 19 nt, Homo sapiens
gccgaaugcuggcccuagu

SEQ ID NO: 100076 - RNA, 19 nt, Homo sapiens
gcacgagcagacccugaug

SEQ ID NO: 100077 - RNA, 19 nt, Homo sapiens
gcggaccucuuugcacaag

SEQ ID NO: 100078 - RNA, 19 nt, Homo sapiens
ugucauuggagcagcauuu

SEQ ID NO: 100079 - RNA, 19 nt, Homo sapiens
cuguuguccucaucacuuu

SEQ ID NO: 100080 - RNA, 19 nt, Homo sapiens
cuucagugccuucaucuuc

SEQ ID NO: 100081 - RNA, 19 nt, Homo sapiens
caagaccuuuauagcuaag

SEQ ID NO: 100082 - RNA, 19 nt, Homo sapiens
acacucaagaccuuuauag

SEQ ID NO: 100083 - RNA, 19 nt, Homo sapiens
caacaugguuugcaaauaa

SEQ ID NO: 100084 - RNA, 19 nt, Homo sapiens
gaagugagauuggagauuu

SEQ ID NO: 100085 - RNA, 19 nt, Homo sapiens
ggaaaggagugagguauuu

SEQ ID NO: 100086 - RNA, 19 nt, Homo sapiens
gaagagaccugacaauugc

SEQ ID NO: 100087 - RNA, 19 nt, Homo sapiens
gcacacauccgauuaaaug

SEQ ID NO: 100088 - RNA, 19 nt, Homo sapiens
uggaagagguuagcuauua

SEQ ID NO: 100089 - RNA, 19 nt, Homo sapiens
agaaacagcuacaacagua

SEQ ID NO: 100090 - RNA, 19 nt, Homo sapiens
gagcauggauucaguuuua

SEQ ID NO: 100091 - RNA, 19 nt, Homo sapiens
gaaacaacauuugaagaga

SEQ ID NO: 100092 - RNA, 19 nt, Homo sapiens
gaagcaguccuuucucaua

SEQ ID NO: 100093 - RNA, 19 nt, Homo sapiens
gacaguggaugauauagaa

SEQ ID NO: 100094 - RNA, 19 nt, Homo sapiens
gaaaccagcuacaauggau

SEQ ID NO: 100095 - RNA, 19 nt, Homo sapiens
uuaaaucgguguauccuuu

SEQ ID NO: 100096 - RNA, 19 nt, Homo sapiens
ggaauccucuucucuuugu

SEQ ID NO: 100097 - RNA, 19 nt, Homo sapiens
caauggauuuccugucaua

SEQ ID NO: 100098 - RNA, 19 nt, Homo sapiens
ggaagagguuagcuauuau

SEQ ID NO: 100099 - RNA, 19 nt, Homo sapiens
cuacugagcuguaacaaag

SEQ ID NO: 100100 - RNA, 19 nt, Homo sapiens
cuacagaaaugacaugaau

SEQ ID NO: 100101 - RNA, 19 nt, Homo sapiens
gagauaaucagacagcuaa

SEQ ID NO: 100102 - RNA, 19 nt, Homo sapiens
guaaagagaaggaaguauu

SEQ ID NO: 100103 - RNA, 19 nt, Homo sapiens
aaagauauccuccggcaua

SEQ ID NO: 100104 - RNA, 19 nt, Homo sapiens
gaauggaccucuauaaacg

SEQ ID NO: 100105 - RNA, 19 nt, Homo sapiens
ccacgaaauuuggaaagua

SEQ ID NO: 100106 - RNA, 19 nt, Homo sapiens
gaaaacaugggcagaauua

SEQ ID NO: 100107 - RNA, 19 nt, Homo sapiens
gagcagguguuauuaugga

SEQ ID NO: 100108 - RNA, 19 nt, Homo sapiens
gaaggaagcgagaacgaaa

SEQ ID NO: 100109 - RNA, 19 nt, Homo sapiens
gaaaggagagagaaggaaa

SEQ ID NO: 100110 - RNA, 19 nt, Homo sapiens
gaauagcacaacucuuuaa

SEQ ID NO: 100111 - RNA, 19 nt, Homo sapiens
ggaagaggaaguuuauuug

SEQ ID NO: 100112 - RNA, 19 nt, Homo sapiens
gaacgaaaucucucauugu

SEQ ID NO: 100113 - RNA, 19 nt, Homo sapiens
ugacaugaaugccaguaaa

SEQ ID NO: 100114 - RNA, 19 nt, Homo sapiens
cuaaaugcuuggaacagua

SEQ ID NO: 100115 - RNA, 19 nt, Homo sapiens
agaggaaguuuauuuguug

SEQ ID NO: 100116 - RNA, 19 nt, Homo sapiens
gcaguccuuucucauauug

SEQ ID NO: 100117 - RNA, 19 nt, Homo sapiens
gaagcacacauccgauuaa

SEQ ID NO: 100118 - RNA, 19 nt, Homo sapiens
gcagggaaggcauuuauga

SEQ ID NO: 100119 - RNA, 19 nt, Homo sapiens
ugagguauuucccgucuaa

SEQ ID NO: 100120 - RNA, 19 nt, Homo sapiens
caacaaaggcucaucaaac

SEQ ID NO: 100121 - RNA, 19 nt, Homo sapiens
gaaagcagcguaucaacuc

SEQ ID NO: 100122 - RNA, 19 nt, Homo sapiens
uggagcagcuugccuacua

SEQ ID NO: 100123 - RNA, 19 nt, Homo sapiens
ggcaucagguuugaguuua

SEQ ID NO: 100124 - RNA, 19 nt, Homo sapiens
gagaggauuuaacuucaug

SEQ ID NO: 100125 - RNA, 19 nt, Homo sapiens
gaagaggaaguuuauuugu

SEQ ID NO: 100126 - RNA, 19 nt, Homo sapiens
gcaguucucggguguguuu

SEQ ID NO: 100127 - RNA, 19 nt, Homo sapiens
ggaaggcauuuaugaagca

SEQ ID NO: 100128 - RNA, 19 nt, Homo sapiens
gcgagaggauuuaacuuca

SEQ ID NO: 100129 - RNA, 19 nt, Homo sapiens
agaacgaaaucucucauug

SEQ ID NO: 100130 - RNA, 19 nt, Homo sapiens
ggauucaguuuuagucuua

SEQ ID NO: 100131 - RNA, 19 nt, Homo sapiens
gaagagguuagcuauuauu

SEQ ID NO: 100132 - RNA, 19 nt, Homo sapiens
aaagguauuugcuccauau

SEQ ID NO: 100133 - RNA, 19 nt, Homo sapiens
uaaagguauuugcuccaua

SEQ ID NO: 100134 - RNA, 19 nt, Homo sapiens
gagcagcuguuccauagag

SEQ ID NO: 100135 - RNA, 19 nt, Homo sapiens
aacaaaggcucaucaaaca

SEQ ID NO: 100136 - RNA, 19 nt, Homo sapiens
uuacugagguuucaucaca

SEQ ID NO: 100137 - RNA, 19 nt, Homo sapiens
gaaggaaaggagugaggua

SEQ ID NO: 100138 - RNA, 19 nt, Homo sapiens
aaauaaugcugguggaaug

SEQ ID NO: 100139 - RNA, 19 nt, Homo sapiens
gaaaguccucggccauuga

SEQ ID NO: 100140 - RNA, 19 nt, Homo sapiens
uuaaguggauucaucauca

SEQ ID NO: 100141 - RNA, 19 nt, Homo sapiens
gcacuggccggauuaauag

SEQ ID NO: 100142 - RNA, 19 nt, Homo sapiens
ggaggcagcauuaacaguu

SEQ ID NO: 100143 - RNA, 19 nt, Homo sapiens
caaugaagcuugguuuuaa

SEQ ID NO: 100144 - RNA, 19 nt, Homo sapiens
cguaucaacuccuauuguu

SEQ ID NO: 100145 - RNA, 19 nt, Homo sapiens
gaacuagaacacugggaaa

SEQ ID NO: 100146 - RNA, 19 nt, Homo sapiens
ggcacuggccggauuaaua

SEQ ID NO: 100147 - RNA, 19 nt, Homo sapiens
gaaucagcaugggaaauga

SEQ ID NO: 100148 - RNA, 19 nt, Homo sapiens
uaugagaccucgaaggaau

SEQ ID NO: 100149 - RNA, 19 nt, Homo sapiens
gaugauuuccauacuauug

SEQ ID NO: 100150 - RNA, 19 nt, Homo sapiens
uugaauagcacaacucuuu

SEQ ID NO: 100151 - RNA, 19 nt, Homo sapiens
gaggaaguuuauuuguuga

SEQ ID NO: 100152 - RNA, 19 nt, Homo sapiens
cggaagaggaaguuuauuu

SEQ ID NO: 100153 - RNA, 19 nt, Homo sapiens
cauuacaccuggccuuuau

SEQ ID NO: 100154 - RNA, 19 nt, Homo sapiens
gccuggcacucauauuuaa

SEQ ID NO: 100155 - RNA, 19 nt, Homo sapiens
gugauagccuucccuaauc

SEQ ID NO: 100156 - RNA, 19 nt, Homo sapiens
ucauguugcucccguguuu

SEQ ID NO: 100157 - RNA, 19 nt, Homo sapiens
agcauuaccuuucuacauu

SEQ ID NO: 100158 - RNA, 19 nt, Homo sapiens
gaagguaucguuggcaguu

SEQ ID NO: 100159 - RNA, 19 nt, Homo sapiens
agaagagaccugacaauug

SEQ ID NO: 100160 - RNA, 19 nt, Homo sapiens
uacaauggauuuccuguca

SEQ ID NO: 100161 - RNA, 19 nt, Homo sapiens
gagguuagcuauuauuuuc

SEQ ID NO: 100162 - RNA, 19 nt, Homo sapiens
aaaagaagguccccuggua

SEQ ID NO: 100163 - RNA, 19 nt, Homo sapiens
gguccugguucuuauauca

SEQ ID NO: 100164 - RNA, 19 nt, Homo sapiens
auauugagauguacuguga

SEQ ID NO: 100165 - RNA, 19 nt, Homo sapiens
gcauuaccuuucuacauuc

SEQ ID NO: 100166 - RNA, 19 nt, Homo sapiens
aauagaaagugccaggaaa

SEQ ID NO: 100167 - RNA, 19 nt, Homo sapiens
cagcaggcauuggaguaua

SEQ ID NO: 100168 - RNA, 19 nt, Homo sapiens
gaagagagggauaaauguc

SEQ ID NO: 100169 - RNA, 19 nt, Homo sapiens
ugaaacagaugcagaaucc

SEQ ID NO: 100170 - RNA, 19 nt, Homo sapiens
cagguaaagucucgaagga

SEQ ID NO: 100171 - RNA, 19 nt, Homo sapiens
aagcaguccuuucucauau

SEQ ID NO: 100172 - RNA, 19 nt, Homo sapiens
ucgagcaccuggccuguuu

SEQ ID NO: 100173 - RNA, 19 nt, Homo sapiens
gcauucagcugaggaugug

SEQ ID NO: 100174 - RNA, 19 nt, Homo sapiens
agaagcagguugacucuag

SEQ ID NO: 100175 - RNA, 19 nt, Homo sapiens
cagaagagaccugacaauu

SEQ ID NO: 100176 - RNA, 19 nt, Homo sapiens
cacgaaauuuggaaaguau

SEQ ID NO: 100177 - RNA, 19 nt, Homo sapiens
cgacgcaaguccacgaaau

SEQ ID NO: 100178 - RNA, 19 nt, Homo sapiens
aaacagcuacaacaguaua

SEQ ID NO: 100179 - RNA, 19 nt, Homo sapiens
gaaaacgucagguaucuuu

SEQ ID NO: 100180 - RNA, 19 nt, Homo sapiens
gagauguacugugauuuua

SEQ ID NO: 100181 - RNA, 19 nt, Homo sapiens
gcauuacaccuggccuuua

SEQ ID NO: 100182 - RNA, 19 nt, Homo sapiens
gaagggaguguuucuugug

SEQ ID NO: 100183 - RNA, 19 nt, Homo sapiens
caaaugagcuugucaguuu

SEQ ID NO: 100184 - RNA, 19 nt, Homo sapiens
gaugugaucuguacaagua

SEQ ID NO: 100185 - RNA, 19 nt, Homo sapiens
gaacuuaacgacacauuua

SEQ ID NO: 100186 - RNA, 19 nt, Homo sapiens
guacauggcugaacucuuc

SEQ ID NO: 100187 - RNA, 19 nt, Homo sapiens
gcaacaagguggcaauuau

SEQ ID NO: 100188 - RNA, 19 nt, Homo sapiens
uaucaugucugcuuucuaa

SEQ ID NO: 100189 - RNA, 19 nt, Homo sapiens
ccaaauggauugcaagaga

SEQ ID NO: 100190 - RNA, 19 nt, Homo sapiens
gcucaaggcugauguuugu

SEQ ID NO: 100191 - RNA, 19 nt, Homo sapiens
guggguagcugaugcauuu

SEQ ID NO: 100192 - RNA, 19 nt, Homo sapiens
gcaauuccaucauguacuu

SEQ ID NO: 100193 - RNA, 19 nt, Homo sapiens
gaaguuugcuguauuggau

SEQ ID NO: 100194 - RNA, 19 nt, Homo sapiens
cuaaagacauuugcgcuua

SEQ ID NO: 100195 - RNA, 19 nt, Homo sapiens
gaacugauucucgcaauaa

SEQ ID NO: 100196 - RNA, 19 nt, Homo sapiens
ccagcgagcucauuucuga

SEQ ID NO: 100197 - RNA, 19 nt, Homo sapiens
ggaacugauucucgcaaua

SEQ ID NO: 100198 - RNA, 19 nt, Homo sapiens
uuucugagcuguucaauga

SEQ ID NO: 100199 - RNA, 19 nt, Homo sapiens
gcauaugcguugucaguug

SEQ ID NO: 100200 - RNA, 19 nt, Homo sapiens
uagaagaggucaguuacua

SEQ ID NO: 100201 - RNA, 19 nt, Homo sapiens
ggucggagcugcuggugaa

SEQ ID NO: 100202 - RNA, 19 nt, Homo sapiens
caaacaggcuacccaaugu

SEQ ID NO: 100203 - RNA, 19 nt, Homo sapiens
gcccaugcauucaauauug

SEQ ID NO: 100204 - RNA, 19 nt, Homo sapiens
cauacgaucuguguaagua

SEQ ID NO: 100205 - RNA, 19 nt, Homo sapiens
gcacugggcaucuuuguau

SEQ ID NO: 100206 - RNA, 19 nt, Homo sapiens
uaaaugaugugaucuguac

SEQ ID NO: 100207 - RNA, 19 nt, Homo sapiens
ggcauuugcuucauuuauu

SEQ ID NO: 100208 - RNA, 19 nt, Homo sapiens
caaaggagcaggagauuuc

SEQ ID NO: 100209 - RNA, 19 nt, Homo sapiens
ccgaauccaucauguuuaa

SEQ ID NO: 100210 - RNA, 19 nt, Homo sapiens
gaugaacuauuggagcaua

SEQ ID NO: 100211 - RNA, 19 nt, Homo sapiens
acaaguauguggagcauga

SEQ ID NO: 100212 - RNA, 19 nt, Homo sapiens
ggucaucauguuugaauua

SEQ ID NO: 100213 - RNA, 19 nt, Homo sapiens
cuggaaaccugauggauuu

SEQ ID NO: 100214 - RNA, 19 nt, Homo sapiens
gcacaggaggacagcauua

SEQ ID NO: 100215 - RNA, 19 nt, Homo sapiens
cugaagggcuggauaagaa

SEQ ID NO: 100216 - RNA, 19 nt, Homo sapiens
caaauggauugcaagagaa

SEQ ID NO: 100217 - RNA, 19 nt, Homo sapiens
uacccaauguuacuacuua

SEQ ID NO: 100218 - RNA, 19 nt, Homo sapiens
gcaacuagguacaaugucu

SEQ ID NO: 100219 - RNA, 19 nt, Homo sapiens
ccacuugcccuuucucuuu

SEQ ID NO: 100220 - RNA, 19 nt, Homo sapiens
cagagacgcucagcuugua

SEQ ID NO: 100221 - RNA, 19 nt, Homo sapiens
ggaggacagcauuaaauuu

SEQ ID NO: 100222 - RNA, 19 nt, Homo sapiens
gggcaucuuuguauuugaa

SEQ ID NO: 100223 - RNA, 19 nt, Homo sapiens
ucaaguagcauaugcaaga

SEQ ID NO: 100224 - RNA, 19 nt, Homo sapiens
caugaaugcugacucaaga

SEQ ID NO: 100225 - RNA, 19 nt, Homo sapiens
gcaagcaacuagguacaau

SEQ ID NO: 100226 - RNA, 19 nt, Homo sapiens
ggaaggaauuaagcuaugu

SEQ ID NO: 100227 - RNA, 19 nt, Homo sapiens
gggaaggaauuaagcuaug

SEQ ID NO: 100228 - RNA, 19 nt, Homo sapiens
caacaagguggcaauuauu

SEQ ID NO: 100229 - RNA, 19 nt, Homo sapiens
ggaaagaaggcaucuacga

SEQ ID NO: 100230 - RNA, 19 nt, Homo sapiens
ccaaguacagcaagaauga

SEQ ID NO: 100231 - RNA, 19 nt, Homo sapiens
guggguaaaugauguaaau

SEQ ID NO: 100232 - RNA, 19 nt, Homo sapiens
caagcuguguuuccuaaug

SEQ ID NO: 100233 - RNA, 19 nt, Homo sapiens
gaugagccguucccugaug

SEQ ID NO: 100234 - RNA, 19 nt, Homo sapiens
gaaggaaaauauugagcua

SEQ ID NO: 100235 - RNA, 19 nt, Homo sapiens
cuaaaucuguuccauuauc

SEQ ID NO: 100236 - RNA, 19 nt, Homo sapiens
ggacacauccuuauuuuga

SEQ ID NO: 100237 - RNA, 19 nt, Homo sapiens
agaggucaguuacuacuuu

SEQ ID NO: 100238 - RNA, 19 nt, Homo sapiens
guaauuagcauggucaaug

SEQ ID NO: 100239 - RNA, 19 nt, Homo sapiens
gaaggaauuaagcuaugua

SEQ ID NO: 100240 - RNA, 19 nt, Homo sapiens
cauuugcgcuuacuuuguu

SEQ ID NO: 100241 - RNA, 19 nt, Homo sapiens
caugucagcguccuuauuu

SEQ ID NO: 100242 - RNA, 19 nt, Homo sapiens
gcacugaucuucaaaaucg

SEQ ID NO: 100243 - RNA, 19 nt, Homo sapiens
ccaaacaggcuacccaaug

SEQ ID NO: 100244 - RNA, 19 nt, Homo sapiens
agugaaagcugcaaguaug

SEQ ID NO: 100245 - RNA, 19 nt, Homo sapiens
gcauguggguggguaaaug

SEQ ID NO: 100246 - RNA, 19 nt, Homo sapiens
uggaaacggugguggauau

SEQ ID NO: 100247 - RNA, 19 nt, Homo sapiens
aaucgucguuaccauauuu

SEQ ID NO: 100248 - RNA, 19 nt, Homo sapiens
gcucacgaccguccuguuu

SEQ ID NO: 100249 - RNA, 19 nt, Homo sapiens
ggagauuucgguagcguuu

SEQ ID NO: 100250 - RNA, 19 nt, Homo sapiens
cacuugcccuuucucuuua

SEQ ID NO: 100251 - RNA, 19 nt, Homo sapiens
ucagcguccuuauuuauug

SEQ ID NO: 100252 - RNA, 19 nt, Homo sapiens
gcugauguuuguaacuuau

SEQ ID NO: 100253 - RNA, 19 nt, Homo sapiens
gcaaaugagcuugucaguu

SEQ ID NO: 100254 - RNA, 19 nt, Homo sapiens
ucaaggagaccgacuacaa

SEQ ID NO: 100255 - RNA, 19 nt, Homo sapiens
uggagacgcucaucaagga

SEQ ID NO: 100256 - RNA, 19 nt, Homo sapiens
uggagucucuguugccuuu

SEQ ID NO: 100257 - RNA, 19 nt, Homo sapiens
uacaaugucuaucaggaaa

SEQ ID NO: 100258 - RNA, 19 nt, Homo sapiens
ccucucaggucuuaucaga

SEQ ID NO: 100259 - RNA, 19 nt, Homo sapiens
cauggcauuugcuucauuu

SEQ ID NO: 100260 - RNA, 19 nt, Homo sapiens
ggguaaaugauguaaauga

SEQ ID NO: 100261 - RNA, 19 nt, Homo sapiens
acaggaagaucaccagcaa

SEQ ID NO: 100262 - RNA, 19 nt, Homo sapiens
cgacacauuuacucuuuua

SEQ ID NO: 100263 - RNA, 19 nt, Homo sapiens
guggagcccuugagucuuc

SEQ ID NO: 100264 - RNA, 19 nt, Homo sapiens
ggaaguggacccugcuaau

SEQ ID NO: 100265 - RNA, 19 nt, Homo sapiens
ccagagauaaagaccauuu

SEQ ID NO: 100266 - RNA, 19 nt, Homo sapiens
guggauaucuuccggaaac

SEQ ID NO: 100267 - RNA, 19 nt, Homo sapiens
ugccaucacugccaucauu

SEQ ID NO: 100268 - RNA, 19 nt, Homo sapiens
gcauucggcugcaaauaac

SEQ ID NO: 100269 - RNA, 19 nt, Homo sapiens
aacgacacauuuacucuuu

SEQ ID NO: 100270 - RNA, 19 nt, Homo sapiens
uccauuaucuucucuguag

SEQ ID NO: 100271 - RNA, 19 nt, Homo sapiens
caugaugagugugaagaaa

SEQ ID NO: 100272 - RNA, 19 nt, Homo sapiens
caggcaagcugcacacauc

SEQ ID NO: 100273 - RNA, 19 nt, Homo sapiens
guaaaugaugugaucugua

SEQ ID NO: 100274 - RNA, 19 nt, Homo sapiens
gaauagccgucucguucuc

SEQ ID NO: 100275 - RNA, 19 nt, Homo sapiens
gaaguggacccugcuaauc

SEQ ID NO: 100276 - RNA, 19 nt, Homo sapiens
gggcgcugcuguuugcauu

SEQ ID NO: 100277 - RNA, 19 nt, Homo sapiens
gagcaaggaguccauaugg

SEQ ID NO: 100278 - RNA, 19 nt, Homo sapiens
guacaaugucuaucaggaa

SEQ ID NO: 100279 - RNA, 19 nt, Homo sapiens
cuccaggacugucuccaua

SEQ ID NO: 100280 - RNA, 19 nt, Homo sapiens
gaggacagcauuaaauuuu

SEQ ID NO: 100281 - RNA, 19 nt, Homo sapiens
caccauacgaucuguguaa

SEQ ID NO: 100282 - RNA, 19 nt, Homo sapiens
ggcugauguuuguaacuua

SEQ ID NO: 100283 - RNA, 19 nt, Homo sapiens
gaagagaucucauuauuuc

SEQ ID NO: 100284 - RNA, 19 nt, Homo sapiens
ggaauagguucuucaaaua

SEQ ID NO: 100285 - RNA, 19 nt, Homo sapiens
gcacuuccaucauuuauuu

SEQ ID NO: 100286 - RNA, 19 nt, Homo sapiens
caagugagcucauuucuga

SEQ ID NO: 100287 - RNA, 19 nt, Homo sapiens
uggaacagcuggcuuauua

SEQ ID NO: 100288 - RNA, 19 nt, Homo sapiens
guacaaugguggaggaaua

SEQ ID NO: 100289 - RNA, 19 nt, Homo sapiens
gggcaaguauccuguuaua

SEQ ID NO: 100290 - RNA, 19 nt, Homo sapiens
gagaaaugauccuuuguug

SEQ ID NO: 100291 - RNA, 19 nt, Homo sapiens
gcaaguauccuguuauaga

SEQ ID NO: 100292 - RNA, 19 nt, Homo sapiens
ccgaagagaucucauuauu

SEQ ID NO: 100293 - RNA, 19 nt, Homo sapiens
gaauggaccgucuucaaua

SEQ ID NO: 100294 - RNA, 19 nt, Homo sapiens
aagaagaguuugcucauaa

SEQ ID NO: 100295 - RNA, 19 nt, Homo sapiens
ccucugggcucuccuauuu

SEQ ID NO: 100296 - RNA, 19 nt, Homo sapiens
caaccguccugaccuauaa

SEQ ID NO: 100297 - RNA, 19 nt, Homo sapiens
uuucugagcuguuuaauga

SEQ ID NO: 100298 - RNA, 19 nt, Homo sapiens
gaauggaacagcuggcuua

SEQ ID NO: 100299 - RNA, 19 nt, Homo sapiens
caaauaggaucauggacuu

SEQ ID NO: 100300 - RNA, 19 nt, Homo sapiens
guuaaucucuucuaaagga

SEQ ID NO: 100301 - RNA, 19 nt, Homo sapiens
ccauggauauguuguuuaa

SEQ ID NO: 100302 - RNA, 19 nt, Homo sapiens
ugaacugacugguggcuua

SEQ ID NO: 100303 - RNA, 19 nt, Homo sapiens
ccuccaagcucugugauua

SEQ ID NO: 100304 - RNA, 19 nt, Homo sapiens
cauaaauccuuucccauug

SEQ ID NO: 100305 - RNA, 19 nt, Homo sapiens
ggaagacgaagguaaacua

SEQ ID NO: 100306 - RNA, 19 nt, Homo sapiens
gaagaggucagcuacuauu

SEQ ID NO: 100307 - RNA, 19 nt, Homo sapiens
gaaaggaaagccagaagga

SEQ ID NO: 100308 - RNA, 19 nt, Homo sapiens
gaccauggauauguuguuu

SEQ ID NO: 100309 - RNA, 19 nt, Homo sapiens
gaaaugauccuuuguugac

SEQ ID NO: 100310 - RNA, 19 nt, Homo sapiens
aaagaagaguuugcucaua

SEQ ID NO: 100311 - RNA, 19 nt, Homo sapiens
caacaugggccuuaauuca

SEQ ID NO: 100312 - RNA, 19 nt, Homo sapiens
gauaggcaccgagagauua

SEQ ID NO: 100313 - RNA, 19 nt, Homo sapiens
agacaaugcugcuuugguu

SEQ ID NO: 100314 - RNA, 19 nt, Homo sapiens
gaagacgaagguaaacuaa

SEQ ID NO: 100315 - RNA, 19 nt, Homo sapiens
gaaccaagauccugauucc

SEQ ID NO: 100316 - RNA, 19 nt, Homo sapiens
gaagauguagagaccauaa

SEQ ID NO: 100317 - RNA, 19 nt, Homo sapiens
gaauacaucgugccucuga

SEQ ID NO: 100318 - RNA, 19 nt, Homo sapiens
gaggacaagucguacaaug

SEQ ID NO: 100319 - RNA, 19 nt, Homo sapiens
accgagagauuaccaauaa

SEQ ID NO: 100320 - RNA, 19 nt, Homo sapiens
guucaaauguuauccuugu

SEQ ID NO: 100321 - RNA, 19 nt, Homo sapiens
aggaagauaucaugaaaga

SEQ ID NO: 100322 - RNA, 19 nt, Homo sapiens
ggaauggaccgucuucaau

SEQ ID NO: 100323 - RNA, 19 nt, Homo sapiens
ccaagauccugauuccauu

SEQ ID NO: 100324 - RNA, 19 nt, Homo sapiens
ggagaaaugauccuuuguu

SEQ ID NO: 100325 - RNA, 19 nt, Homo sapiens
gaacagccgccugguacua

SEQ ID NO: 100326 - RNA, 19 nt, Homo sapiens
acaaauacaggaagaauga

SEQ ID NO: 100327 - RNA, 19 nt, Homo sapiens
aggaauagguucuucaaau

SEQ ID NO: 100328 - RNA, 19 nt, Homo sapiens
cgaagagaucucauuauuu

SEQ ID NO: 100329 - RNA, 19 nt, Homo sapiens
ggcaauggaugugaugaaa

SEQ ID NO: 100330 - RNA, 19 nt, Homo sapiens
gagaaccguuucaacacaa

SEQ ID NO: 100331 - RNA, 19 nt, Homo sapiens
ccacauccgucucaaugga

SEQ ID NO: 100332 - RNA, 19 nt, Homo sapiens
uucguuagcugguuugaua

SEQ ID NO: 100333 - RNA, 19 nt, Homo sapiens
uauagcaggucgacuucua

SEQ ID NO: 100334 - RNA, 19 nt, Homo sapiens
caagugccuuugacccuuu

SEQ ID NO: 100335 - RNA, 19 nt, Homo sapiens
uaucuugagugguuucauu

SEQ ID NO: 100336 - RNA, 19 nt, Homo sapiens
caacuccugucucucuuug

SEQ ID NO: 100337 - RNA, 19 nt, Homo sapiens
guaguuagccaauaugcaa

SEQ ID NO: 100338 - RNA, 19 nt, Homo sapiens
aaggauguguuaaagcaua

SEQ ID NO: 100339 - RNA, 19 nt, Homo sapiens
gaccuaugaugauuucaau

SEQ ID NO: 100340 - RNA, 19 nt, Homo sapiens
gaauagguucuucaaauag

SEQ ID NO: 100341 - RNA, 19 nt, Homo sapiens
gaagauucaguucaaaugu

SEQ ID NO: 100342 - RNA, 19 nt, Homo sapiens
guuagcacuuccaucauuu

SEQ ID NO: 100343 - RNA, 19 nt, Homo sapiens
agacaucucugcucauugg

SEQ ID NO: 100344 - RNA, 19 nt, Homo sapiens
ucauagaguucuggaugua

SEQ ID NO: 100345 - RNA, 19 nt, Homo sapiens
ugaaaaugcucgaaagaaa

SEQ ID NO: 100346 - RNA, 19 nt, Homo sapiens
caaguauccuguuauagag

SEQ ID NO: 100347 - RNA, 19 nt, Homo sapiens
aauaguuggucccagcuua

SEQ ID NO: 100348 - RNA, 19 nt, Homo sapiens
ucauaaauccuuucccauu

SEQ ID NO: 100349 - RNA, 19 nt, Homo sapiens
gaucccuucuggccucuuu

SEQ ID NO: 100350 - RNA, 19 nt, Homo sapiens
gcacaagugagcucauuuc

SEQ ID NO: 100351 - RNA, 19 nt, Homo sapiens
gccacugcuucaacaaaua

SEQ ID NO: 100352 - RNA, 19 nt, Homo sapiens
agaaaccucugaauguaau

SEQ ID NO: 100353 - RNA, 19 nt, Homo sapiens
guaaguggacucugguuau

SEQ ID NO: 100354 - RNA, 19 nt, Homo sapiens
uugccuacauagucaauua

SEQ ID NO: 100355 - RNA, 19 nt, Homo sapiens
ccggagaaaugauccuuug

SEQ ID NO: 100356 - RNA, 19 nt, Homo sapiens
gguaaguggacucugguua

SEQ ID NO: 100357 - RNA, 19 nt, Homo sapiens
gggagccuuugccuacaua

SEQ ID NO: 100358 - RNA, 19 nt, Homo sapiens
ggaaaagaguaaugguauu

SEQ ID NO: 100359 - RNA, 19 nt, Homo sapiens
uaaagcauauagcacagau

SEQ ID NO: 100360 - RNA, 19 nt, Homo sapiens
ggaugacuguuucucuugu

SEQ ID NO: 100361 - RNA, 19 nt, Homo sapiens
uugaagaggucagcuacua

SEQ ID NO: 100362 - RNA, 19 nt, Homo sapiens
ggacaagucguacaauggu

SEQ ID NO: 100363 - RNA, 19 nt, Homo sapiens
uauaagacaaugcugcuuu

SEQ ID NO: 100364 - RNA, 19 nt, Homo sapiens
agacgaagguaaacuaagg

SEQ ID NO: 100365 - RNA, 19 nt, Homo sapiens
gucauaauguuugaacuga

SEQ ID NO: 100366 - RNA, 19 nt, Homo sapiens
ggauaggcaccgagagauu

SEQ ID NO: 100367 - RNA, 19 nt, Homo sapiens
gacaaugcugcuuugguua

SEQ ID NO: 100368 - RNA, 19 nt, Homo sapiens
uaguuaggcuuccaugaug

SEQ ID NO: 100369 - RNA, 19 nt, Homo sapiens
ggacauuacagaccaugga

SEQ ID NO: 100370 - RNA, 19 nt, Homo sapiens
uguuagcacuuccaucauu

SEQ ID NO: 100371 - RNA, 19 nt, Homo sapiens
gaagaguuugcucauaaga

SEQ ID NO: 100372 - RNA, 19 nt, Homo sapiens
gaugacuguuucucuuguu

SEQ ID NO: 100373 - RNA, 19 nt, Homo sapiens
uucaauagcugguguaguc

SEQ ID NO: 100374 - RNA, 19 nt, Homo sapiens
ugagaaccguuucaacaca

SEQ ID NO: 100375 - RNA, 19 nt, Homo sapiens
gcgaaagaccacccaguug

SEQ ID NO: 100376 - RNA, 19 nt, Homo sapiens
ugguguaucuguagccuuu

SEQ ID NO: 100377 - RNA, 19 nt, Homo sapiens
caacaaauacaggaagaau

SEQ ID NO: 100378 - RNA, 19 nt, Homo sapiens
gccaauaugcaaucacuga

SEQ ID NO: 100379 - RNA, 19 nt, Homo sapiens
uagagaccauaaucaguga

SEQ ID NO: 100380 - RNA, 19 nt, Homo sapiens
ucuuugagcucgugccauu

SEQ ID NO: 100381 - RNA, 19 nt, Homo sapiens
caauaugcaaucacugaaa

SEQ ID NO: 100382 - RNA, 19 nt, Homo sapiens
guaugacuguggaagaugu

SEQ ID NO: 100383 - RNA, 19 nt, Homo sapiens
uaaagcagauggccuauuu

SEQ ID NO: 100384 - RNA, 19 nt, Homo sapiens
gaacccggcuguugccuua

SEQ ID NO: 100385 - RNA, 19 nt, Homo sapiens
gaaugcaccugacuuauga

SEQ ID NO: 100386 - RNA, 19 nt, Homo sapiens
ccagaaacauaaaggauua

SEQ ID NO: 100387 - RNA, 19 nt, Homo sapiens
gcaaggaucuucccacuuc

SEQ ID NO: 100388 - RNA, 19 nt, Homo sapiens
uaagaaaggucgaagauau

SEQ ID NO: 100389 - RNA, 19 nt, Homo sapiens
gcaccugacuuaugaaaug

SEQ ID NO: 100390 - RNA, 19 nt, Homo sapiens
aaagguaugugcuaugaua

SEQ ID NO: 100391 - RNA, 19 nt, Homo sapiens
caagagagacuuuguauca

SEQ ID NO: 100392 - RNA, 19 nt, Homo sapiens
gagaguccuucccuuauuu

SEQ ID NO: 100393 - RNA, 19 nt, Homo sapiens
gaccauggauaauaagaaa

SEQ ID NO: 100394 - RNA, 19 nt, Homo sapiens
gcaaccagcucaucagcaa

SEQ ID NO: 100395 - RNA, 19 nt, Homo sapiens
guauugaugugcaguauug

SEQ ID NO: 100396 - RNA, 19 nt, Homo sapiens
gauggucaaucugauaaua

SEQ ID NO: 100397 - RNA, 19 nt, Homo sapiens
caaccucaccuaugaauuu

SEQ ID NO: 100398 - RNA, 19 nt, Homo sapiens
gaaagacuaugagaguuug

SEQ ID NO: 100399 - RNA, 19 nt, Homo sapiens
ggaaagacuaugagaguuu

SEQ ID NO: 100400 - RNA, 19 nt, Homo sapiens
gcaacaacaucaaguucaa

SEQ ID NO: 100401 - RNA, 19 nt, Homo sapiens
gcacgugccugaagguuuc

SEQ ID NO: 100402 - RNA, 19 nt, Homo sapiens
gaugugaauucaaguauca

SEQ ID NO: 100403 - RNA, 19 nt, Homo sapiens
ccaaugauaccuacaauga

SEQ ID NO: 100404 - RNA, 19 nt, Homo sapiens
gaagaugugaauucaagua

SEQ ID NO: 100405 - RNA, 19 nt, Homo sapiens
ggcacaaccucaccuauga

SEQ ID NO: 100406 - RNA, 19 nt, Homo sapiens
cauuugugaugcagaauua

SEQ ID NO: 100407 - RNA, 19 nt, Homo sapiens
ggauaauacucccaggaaa

SEQ ID NO: 100408 - RNA, 19 nt, Homo sapiens
agacagagguggaaaugga

SEQ ID NO: 100409 - RNA, 19 nt, Homo sapiens
gaggucaaaugcuaucuga

SEQ ID NO: 100410 - RNA, 19 nt, Homo sapiens
ugaaagguaugugcuauga

SEQ ID NO: 100411 - RNA, 19 nt, Homo sapiens
gagcuggccucccucaguu

SEQ ID NO: 100412 - RNA, 19 nt, Homo sapiens
caaaguaccguaugcgaaa

SEQ ID NO: 100413 - RNA, 19 nt, Homo sapiens
caacaucaaguucaagaaa

SEQ ID NO: 100414 - RNA, 19 nt, Homo sapiens
ucaaaucgguaaugacuca

SEQ ID NO: 100415 - RNA, 19 nt, Homo sapiens
gaagugguguuuuguguuu

SEQ ID NO: 100416 - RNA, 19 nt, Homo sapiens
caugacaaaucaacuguga

SEQ ID NO: 100417 - RNA, 19 nt, Homo sapiens
ccagaaugcaccugacuua

SEQ ID NO: 100418 - RNA, 19 nt, Homo sapiens
cagaagaugugaauucaag

SEQ ID NO: 100419 - RNA, 19 nt, Homo sapiens
uacggaagauccaguuuaa

SEQ ID NO: 100420 - RNA, 19 nt, Homo sapiens
ggaaauagcgcaggacauc

SEQ ID NO: 100421 - RNA, 19 nt, Homo sapiens
uauccucgcuaguuuguuu

SEQ ID NO: 100422 - RNA, 19 nt, Homo sapiens
ucagagaguccuucccuua

SEQ ID NO: 100423 - RNA, 19 nt, Homo sapiens
ggaauugggcacugagaaa

SEQ ID NO: 100424 - RNA, 19 nt, Homo sapiens
gauaugaggcggugaagug

SEQ ID NO: 100425 - RNA, 19 nt, Homo sapiens
caaugacccuuaccuggaa

SEQ ID NO: 100426 - RNA, 19 nt, Homo sapiens
guguuuaagucaccagaua

SEQ ID NO: 100427 - RNA, 19 nt, Homo sapiens
caagauggccuucauuuac

SEQ ID NO: 100428 - RNA, 19 nt, Homo sapiens
aaacggagccaguccauga

SEQ ID NO: 100429 - RNA, 19 nt, Homo sapiens
uggagaccauggauaauaa

SEQ ID NO: 100430 - RNA, 19 nt, Homo sapiens
ucaagauggccuucauuua

SEQ ID NO: 100431 - RNA, 19 nt, Homo sapiens
gcuguugccuuaaaugugu

SEQ ID NO: 100432 - RNA, 19 nt, Homo sapiens
gacccucgcuccuuccauu

SEQ ID NO: 100433 - RNA, 19 nt, Homo sapiens
gaagauaugaggcggugaa

SEQ ID NO: 100434 - RNA, 19 nt, Homo sapiens
gcagaauuaugcacugaca

SEQ ID NO: 100435 - RNA, 19 nt, Homo sapiens
gcccagagauagacaguag

SEQ ID NO: 100436 - RNA, 19 nt, Homo sapiens
ugacuagguuuaggaauug

SEQ ID NO: 100437 - RNA, 19 nt, Homo sapiens
caucuuugcuacuuuccua

SEQ ID NO: 100438 - RNA, 19 nt, Homo sapiens
ggagaaugccgacagaugu

SEQ ID NO: 100439 - RNA, 19 nt, Homo sapiens
ggucaaaugcuaucugaau

SEQ ID NO: 100440 - RNA, 19 nt, Homo sapiens
ggcagcagguuccgggaua

SEQ ID NO: 100441 - RNA, 19 nt, Homo sapiens
gauaauacucccaggaaau

SEQ ID NO: 100442 - RNA, 19 nt, Homo sapiens
ccaccaaaguuagcugaaa

SEQ ID NO: 100443 - RNA, 19 nt, Homo sapiens
cgucuacccuaauucuuaa

SEQ ID NO: 100444 - RNA, 19 nt, Homo sapiens
gaaccgcgguaacgagaag

SEQ ID NO: 100445 - RNA, 19 nt, Homo sapiens
gaauucaaguaucaagaca

SEQ ID NO: 100446 - RNA, 19 nt, Homo sapiens
cgccagcccugcaguauug

SEQ ID NO: 100447 - RNA, 19 nt, Homo sapiens
gauagacaguagaaugcaa

SEQ ID NO: 100448 - RNA, 19 nt, Homo sapiens
ggaagccaauuguccaagu

SEQ ID NO: 100449 - RNA, 19 nt, Homo sapiens
ggacuuacggcauuucugu

SEQ ID NO: 100450 - RNA, 19 nt, Homo sapiens
cgagucaaaucgguaauga

SEQ ID NO: 100451 - RNA, 19 nt, Homo sapiens
ugaaguggauggugguguu

SEQ ID NO: 100452 - RNA, 19 nt, Homo sapiens
gguaagaagugguguuuug

SEQ ID NO: 100453 - RNA, 19 nt, Homo sapiens
gcaucacccaccaaaguua

SEQ ID NO: 100454 - RNA, 19 nt, Homo sapiens
agagaguccuucccuuauu

SEQ ID NO: 100455 - RNA, 19 nt, Homo sapiens
ggaggaggaugagauucuu

SEQ ID NO: 100456 - RNA, 19 nt, Homo sapiens
acuaugagaguuuggauua

SEQ ID NO: 100457 - RNA, 19 nt, Homo sapiens
agauuuacgucuacccuaa

SEQ ID NO: 100458 - RNA, 19 nt, Homo sapiens
caucagagcuuggacuuuu

SEQ ID NO: 100459 - RNA, 19 nt, Homo sapiens
gcguaaaggugccaggaau

SEQ ID NO: 100460 - RNA, 19 nt, Homo sapiens
uucagcaucucacccauua

SEQ ID NO: 100461 - RNA, 19 nt, Homo sapiens
ggaggaggaggaugagauu

SEQ ID NO: 100462 - RNA, 19 nt, Homo sapiens
gaccauccuuggagaaaca

SEQ ID NO: 100463 - RNA, 19 nt, Homo sapiens
ccuaacaugugagaauaaa

SEQ ID NO: 100464 - RNA, 19 nt, Homo sapiens
gaugagauucuuccaagga

SEQ ID NO: 100465 - RNA, 19 nt, Homo sapiens
guucuucguucucuauuuc

SEQ ID NO: 100466 - RNA, 19 nt, Homo sapiens
ggugaauguuauuggaauu

SEQ ID NO: 100467 - RNA, 19 nt, Homo sapiens
ggaaauggacaagcugaga

SEQ ID NO: 100468 - RNA, 19 nt, Homo sapiens
uuagagagccuccuugugu

SEQ ID NO: 100469 - RNA, 19 nt, Homo sapiens
uaagugcucugacucugau

SEQ ID NO: 100470 - RNA, 19 nt, Homo sapiens
ccacagcucugcggaccuu

SEQ ID NO: 100471 - RNA, 19 nt, Homo sapiens
gaagccaauuguccaaguc

SEQ ID NO: 100472 - RNA, 19 nt, Homo sapiens
ugacauggccacacucuuc

SEQ ID NO: 100473 - RNA, 19 nt, Homo sapiens
aaugauaccuacaaugaca

SEQ ID NO: 100474 - RNA, 19 nt, Homo sapiens
cuaauuccacuguguauau

SEQ ID NO: 100475 - RNA, 19 nt, Homo sapiens
gacaguagaaugcaaauac

SEQ ID NO: 100476 - RNA, 19 nt, Homo sapiens
ucacguuauuucuuccuuu

SEQ ID NO: 100477 - RNA, 19 nt, Homo sapiens
gcuuugacuucuaaauguu

SEQ ID NO: 100478 - RNA, 19 nt, Homo sapiens
gacaacauacaguucauga

SEQ ID NO: 100479 - RNA, 19 nt, Homo sapiens
gccaguccaugaaguccua

SEQ ID NO: 100480 - RNA, 19 nt, Homo sapiens
gucaaaugcuaucugaaug

SEQ ID NO: 100481 - RNA, 19 nt, Homo sapiens
gcacuguuuguuuguauga

SEQ ID NO: 100482 - RNA, 19 nt, Homo sapiens
uaauuccacuccagagaug

SEQ ID NO: 100483 - RNA, 19 nt, Homo sapiens
uaaagcagauggccuauuu

SEQ ID NO: 100484 - RNA, 19 nt, Homo sapiens
gaacccggcuguugccuua

SEQ ID NO: 100485 - RNA, 19 nt, Homo sapiens
gaaugcaccugacuuauga

SEQ ID NO: 100486 - RNA, 19 nt, Homo sapiens
ccagaaacauaaaggauua

SEQ ID NO: 100487 - RNA, 19 nt, Homo sapiens
gcaaggaucuucccacuuc

SEQ ID NO: 100488 - RNA, 19 nt, Homo sapiens
uaagaaaggucgaagauau

SEQ ID NO: 100489 - RNA, 19 nt, Homo sapiens
gcaccugacuuaugaaaug

SEQ ID NO: 100490 - RNA, 19 nt, Homo sapiens
aaagguaugugcuaugaua

SEQ ID NO: 100491 - RNA, 19 nt, Homo sapiens
caagagagacuuuguauca

SEQ ID NO: 100492 - RNA, 19 nt, Homo sapiens
gagaguccuucccuuauuu

SEQ ID NO: 100493 - RNA, 19 nt, Homo sapiens
gaccauggauaauaagaaa

SEQ ID NO: 100494 - RNA, 19 nt, Homo sapiens
guauugaugugcaguauug

SEQ ID NO: 100495 - RNA, 19 nt, Homo sapiens
gauggucaaucugauaaua

SEQ ID NO: 100496 - RNA, 19 nt, Homo sapiens
gaaagacuaugagaguuug

SEQ ID NO: 100497 - RNA, 19 nt, Homo sapiens
ggaaagacuaugagaguuu

SEQ ID NO: 100498 - RNA, 19 nt, Homo sapiens
gcacgugccugaagguuuc

SEQ ID NO: 100499 - RNA, 19 nt, Homo sapiens
cgacagguauggaaagaga

SEQ ID NO: 100500 - RNA, 19 nt, Homo sapiens
cauuugugaugcagaauua

SEQ ID NO: 100501 - RNA, 19 nt, Homo sapiens
ggauaauacucccaggaaa

SEQ ID NO: 100502 - RNA, 19 nt, Homo sapiens
gaggucaaaugcuaucuga

SEQ ID NO: 100503 - RNA, 19 nt, Homo sapiens
ugaaagguaugugcuauga

SEQ ID NO: 100504 - RNA, 19 nt, Homo sapiens
gagcuggccucccucaguu

SEQ ID NO: 100505 - RNA, 19 nt, Homo sapiens
gaagugguguuuuguguuu

SEQ ID NO: 100506 - RNA, 19 nt, Homo sapiens
caugacaaaucaacuguga

SEQ ID NO: 100507 - RNA, 19 nt, Homo sapiens
ccagaaugcaccugacuua

SEQ ID NO: 100508 - RNA, 19 nt, Homo sapiens
uacggaagauccaguuuaa

SEQ ID NO: 100509 - RNA, 19 nt, Homo sapiens
ggaaauagcgcaggacauc

SEQ ID NO: 100510 - RNA, 19 nt, Homo sapiens
uauccucgcuaguuuguuu

SEQ ID NO: 100511 - RNA, 19 nt, Homo sapiens
ucagagaguccuucccuua

SEQ ID NO: 100512 - RNA, 19 nt, Homo sapiens
ggaauugggcacugagaaa

SEQ ID NO: 100513 - RNA, 19 nt, Homo sapiens
gauaugaggcggugaagug

SEQ ID NO: 100514 - RNA, 19 nt, Homo sapiens
caaugacccuuaccuggaa

SEQ ID NO: 100515 - RNA, 19 nt, Homo sapiens
guguuuaagucaccagaua

SEQ ID NO: 100516 - RNA, 19 nt, Homo sapiens
caagauggccuucauuuac

SEQ ID NO: 100517 - RNA, 19 nt, Homo sapiens
uggagaccauggauaauaa

SEQ ID NO: 100518 - RNA, 19 nt, Homo sapiens
ucaagauggccuucauuua

SEQ ID NO: 100519 - RNA, 19 nt, Homo sapiens
gcuguugccuuaaaugugu

SEQ ID NO: 100520 - RNA, 19 nt, Homo sapiens
gacccucgcuccuuccauu

SEQ ID NO: 100521 - RNA, 19 nt, Homo sapiens
gaagauaugaggcggugaa

SEQ ID NO: 100522 - RNA, 19 nt, Homo sapiens
gcagaauuaugcacugaca

SEQ ID NO: 100523 - RNA, 19 nt, Homo sapiens
gcccagagauagacaguag

SEQ ID NO: 100524 - RNA, 19 nt, Homo sapiens
ugacuagguuuaggaauug

SEQ ID NO: 100525 - RNA, 19 nt, Homo sapiens
caucuuugcuacuuuccua

SEQ ID NO: 100526 - RNA, 19 nt, Homo sapiens
ggucaaaugcuaucugaau

SEQ ID NO: 100527 - RNA, 19 nt, Homo sapiens
ggcagcagguuccgggaua

SEQ ID NO: 100528 - RNA, 19 nt, Homo sapiens
gauaauacucccaggaaau

SEQ ID NO: 100529 - RNA, 19 nt, Homo sapiens
ccaccaaaguuagcugaaa

SEQ ID NO: 100530 - RNA, 19 nt, Homo sapiens
cgucuacccuaauucuuaa

SEQ ID NO: 100531 - RNA, 19 nt, Homo sapiens
cgccagcccugcaguauug

SEQ ID NO: 100532 - RNA, 19 nt, Homo sapiens
gauagacaguagaaugcaa

SEQ ID NO: 100533 - RNA, 19 nt, Homo sapiens
ggaagccaauuguccaagu

SEQ ID NO: 100534 - RNA, 19 nt, Homo sapiens
ugaaguggauggugguguu

SEQ ID NO: 100535 - RNA, 19 nt, Homo sapiens
gguaagaagugguguuuug

SEQ ID NO: 100536 - RNA, 19 nt, Homo sapiens
gcaucacccaccaaaguua

SEQ ID NO: 100537 - RNA, 19 nt, Homo sapiens
agagaguccuucccuuauu

SEQ ID NO: 100538 - RNA, 19 nt, Homo sapiens
acuaugagaguuuggauua

SEQ ID NO: 100539 - RNA, 19 nt, Homo sapiens
ggaggaggaugagauucuu

SEQ ID NO: 100540 - RNA, 19 nt, Homo sapiens
agauuuacgucuacccuaa

SEQ ID NO: 100541 - RNA, 19 nt, Homo sapiens
caucagagcuuggacuuuu

SEQ ID NO: 100542 - RNA, 19 nt, Homo sapiens
gcguaaaggugccaggaau

SEQ ID NO: 100543 - RNA, 19 nt, Homo sapiens
uucagcaucucacccauua

SEQ ID NO: 100544 - RNA, 19 nt, Homo sapiens
ggaggaggaggaugagauu

SEQ ID NO: 100545 - RNA, 19 nt, Homo sapiens
gaccauccuuggagaaaca

SEQ ID NO: 100546 - RNA, 19 nt, Homo sapiens
ccuaacaugugagaauaaa

SEQ ID NO: 100547 - RNA, 19 nt, Homo sapiens
gaugagauucuuccaagga

SEQ ID NO: 100548 - RNA, 19 nt, Homo sapiens
ggugaauguuauuggaauu

SEQ ID NO: 100549 - RNA, 19 nt, Homo sapiens
ccacagcucugcggaccuu

SEQ ID NO: 100550 - RNA, 19 nt, Homo sapiens
gaagccaauuguccaaguc

SEQ ID NO: 100551 - RNA, 19 nt, Homo sapiens
gaagcgacagguauggaaa

SEQ ID NO: 100552 - RNA, 19 nt, Homo sapiens
cuaauuccacuguguauau

SEQ ID NO: 100553 - RNA, 19 nt, Homo sapiens
gacaguagaaugcaaauac

SEQ ID NO: 100554 - RNA, 19 nt, Homo sapiens
ucacguuauuucuuccuuu

SEQ ID NO: 100555 - RNA, 19 nt, Homo sapiens
gcuuugacuucuaaauguu

SEQ ID NO: 100556 - RNA, 19 nt, Homo sapiens
gacaacauacaguucauga

SEQ ID NO: 100557 - RNA, 19 nt, Homo sapiens
gucaaaugcuaucugaaug

SEQ ID NO: 100558 - RNA, 19 nt, Homo sapiens
gcacuguuuguuuguauga

SEQ ID NO: 100559 - RNA, 19 nt, Homo sapiens
uaauuccacuccagagaug

SEQ ID NO: 100560 - RNA, 19 nt, Homo sapiens
uuacggaagauccaguuua

SEQ ID NO: 100561 - RNA, 19 nt, Homo sapiens
uaugagaguuuggauuaug

SEQ ID NO: 100562 - RNA, 19 nt, Homo sapiens
cuugggaguucucauugua

SEQ ID NO: 100563 - RNA, 19 nt, Homo sapiens
auaauacucccaggaaaua

SEQ ID NO: 100564 - RNA, 19 nt, Homo sapiens
gaaccaccgcccaccagaa

SEQ ID NO: 100565 - RNA, 19 nt, Homo sapiens
caacauacaguucaugacu

SEQ ID NO: 100566 - RNA, 19 nt, Homo sapiens
uacccgaggucaaaugcua

SEQ ID NO: 100567 - RNA, 19 nt, Homo sapiens
uaaccucaccuuugucuuc

SEQ ID NO: 100568 - RNA, 19 nt, Homo sapiens
gaauuaugcacugacauga

SEQ ID NO: 100569 - RNA, 19 nt, Homo sapiens
guucugggauucaguuugg

SEQ ID NO: 100570 - RNA, 19 nt, Homo sapiens
uaagaaggaagccaauugu

SEQ ID NO: 100571 - RNA, 19 nt, Homo sapiens
ugucugcccuucacaaaca

SEQ ID NO: 100572 - RNA, 19 nt, Homo sapiens
ccagauaagcccaaagaca

SEQ ID NO: 100573 - RNA, 19 nt, Homo sapiens
agagauagacaguagaaug

SEQ ID NO: 100574 - RNA, 19 nt, Homo sapiens
ccagagauagacaguagaa

SEQ ID NO: 100575 - RNA, 19 nt, Homo sapiens
ggacaucacaaggaccaaa

SEQ ID NO: 100576 - RNA, 19 nt, Homo sapiens
gcgcaggacaucacaagga

SEQ ID NO: 100577 - RNA, 19 nt, Homo sapiens
gguaugugcuaugauaaag

SEQ ID NO: 100578 - RNA, 19 nt, Homo sapiens
uaacauugcagcuuucucu

SEQ ID NO: 100579 - RNA, 19 nt, Homo sapiens
ggucuugcccugugguuug

SEQ ID NO: 100580 - RNA, 19 nt, Homo sapiens
ggauuaugaucgcuguauc

SEQ ID NO: 100581 - RNA, 19 nt, Homo sapiens
ccacuguguauauaaauug

SEQ ID NO: 100582 - RNA, 19 nt, Homo sapiens
gaucagucgccucaguaaa

SEQ ID NO: 100583 - RNA, 19 nt, Homo sapiens
uaaagcagauggccuauuu

SEQ ID NO: 100584 - RNA, 19 nt, Homo sapiens
gaacccggcuguugccuua

SEQ ID NO: 100585 - RNA, 19 nt, Homo sapiens
gaaugcaccugacuuauga

SEQ ID NO: 100586 - RNA, 19 nt, Homo sapiens
ccagaaacauaaaggauua

SEQ ID NO: 100587 - RNA, 19 nt, Homo sapiens
gcaaggaucuucccacuuc

SEQ ID NO: 100588 - RNA, 19 nt, Homo sapiens
uaagaaaggucgaagauau

SEQ ID NO: 100589 - RNA, 19 nt, Homo sapiens
gcaccugacuuaugaaaug

SEQ ID NO: 100590 - RNA, 19 nt, Homo sapiens
aaagguaugugcuaugaua

SEQ ID NO: 100591 - RNA, 19 nt, Homo sapiens
caagagagacuuuguauca

SEQ ID NO: 100592 - RNA, 19 nt, Homo sapiens
gagaguccuucccuuauuu

SEQ ID NO: 100593 - RNA, 19 nt, Homo sapiens
gaccauggauaauaagaaa

SEQ ID NO: 100594 - RNA, 19 nt, Homo sapiens
guauugaugugcaguauug

SEQ ID NO: 100595 - RNA, 19 nt, Homo sapiens
gauggucaaucugauaaua

SEQ ID NO: 100596 - RNA, 19 nt, Homo sapiens
gaaagacuaugagaguuug

SEQ ID NO: 100597 - RNA, 19 nt, Homo sapiens
ggaaagacuaugagaguuu

SEQ ID NO: 100598 - RNA, 19 nt, Homo sapiens
gcacgugccugaagguuuc

SEQ ID NO: 100599 - RNA, 19 nt, Homo sapiens
cauuugugaugcagaauua

SEQ ID NO: 100600 - RNA, 19 nt, Homo sapiens
ggauaauacucccaggaaa

SEQ ID NO: 100601 - RNA, 19 nt, Homo sapiens
gaggucaaaugcuaucuga

SEQ ID NO: 100602 - RNA, 19 nt, Homo sapiens
ugaaagguaugugcuauga

SEQ ID NO: 100603 - RNA, 19 nt, Homo sapiens
gagcuggccucccucaguu

SEQ ID NO: 100604 - RNA, 19 nt, Homo sapiens
gaagugguguuuuguguuu

SEQ ID NO: 100605 - RNA, 19 nt, Homo sapiens
caugacaaaucaacuguga

SEQ ID NO: 100606 - RNA, 19 nt, Homo sapiens
ccagaaugcaccugacuua

SEQ ID NO: 100607 - RNA, 19 nt, Homo sapiens
uacggaagauccaguuuaa

SEQ ID NO: 100608 - RNA, 19 nt, Homo sapiens
ggaaauagcgcaggacauc

SEQ ID NO: 100609 - RNA, 19 nt, Homo sapiens
uauccucgcuaguuuguuu

SEQ ID NO: 100610 - RNA, 19 nt, Homo sapiens
ucagagaguccuucccuua

SEQ ID NO: 100611 - RNA, 19 nt, Homo sapiens
ggaauugggcacugagaaa

SEQ ID NO: 100612 - RNA, 19 nt, Homo sapiens
gauaugaggcggugaagug

SEQ ID NO: 100613 - RNA, 19 nt, Homo sapiens
caaugacccuuaccuggaa

SEQ ID NO: 100614 - RNA, 19 nt, Homo sapiens
guguuuaagucaccagaua

SEQ ID NO: 100615 - RNA, 19 nt, Homo sapiens
caagauggccuucauuuac

SEQ ID NO: 100616 - RNA, 19 nt, Homo sapiens
uggagaccauggauaauaa

SEQ ID NO: 100617 - RNA, 19 nt, Homo sapiens
ucaagauggccuucauuua

SEQ ID NO: 100618 - RNA, 19 nt, Homo sapiens
gcuguugccuuaaaugugu

SEQ ID NO: 100619 - RNA, 19 nt, Homo sapiens
gacccucgcuccuuccauu

SEQ ID NO: 100620 - RNA, 19 nt, Homo sapiens
gaagauaugaggcggugaa

SEQ ID NO: 100621 - RNA, 19 nt, Homo sapiens
gcagaauuaugcacugaca

SEQ ID NO: 100622 - RNA, 19 nt, Homo sapiens
gcccagagauagacaguag

SEQ ID NO: 100623 - RNA, 19 nt, Homo sapiens
ugacuagguuuaggaauug

SEQ ID NO: 100624 - RNA, 19 nt, Homo sapiens
caucuuugcuacuuuccua

SEQ ID NO: 100625 - RNA, 19 nt, Homo sapiens
ggagaaugccgacagaugu

SEQ ID NO: 100626 - RNA, 19 nt, Homo sapiens
ggucaaaugcuaucugaau

SEQ ID NO: 100627 - RNA, 19 nt, Homo sapiens
ggcagcagguuccgggaua

SEQ ID NO: 100628 - RNA, 19 nt, Homo sapiens
gauaauacucccaggaaau

SEQ ID NO: 100629 - RNA, 19 nt, Homo sapiens
ccaccaaaguuagcugaaa

SEQ ID NO: 100630 - RNA, 19 nt, Homo sapiens
cgucuacccuaauucuuaa

SEQ ID NO: 100631 - RNA, 19 nt, Homo sapiens
cgccagcccugcaguauug

SEQ ID NO: 100632 - RNA, 19 nt, Homo sapiens
gauagacaguagaaugcaa

SEQ ID NO: 100633 - RNA, 19 nt, Homo sapiens
ggaagccaauuguccaagu

SEQ ID NO: 100634 - RNA, 19 nt, Homo sapiens
ugaaguggauggugguguu

SEQ ID NO: 100635 - RNA, 19 nt, Homo sapiens
ggaggaggaugagauucuu

SEQ ID NO: 100636 - RNA, 19 nt, Homo sapiens
gguaagaagugguguuuug

SEQ ID NO: 100637 - RNA, 19 nt, Homo sapiens
acuaugagaguuuggauua

SEQ ID NO: 100638 - RNA, 19 nt, Homo sapiens
gcaucacccaccaaaguua

SEQ ID NO: 100639 - RNA, 19 nt, Homo sapiens
agagaguccuucccuuauu

SEQ ID NO: 100640 - RNA, 19 nt, Homo sapiens
agauuuacgucuacccuaa

SEQ ID NO: 100641 - RNA, 19 nt, Homo sapiens
caucagagcuuggacuuuu

SEQ ID NO: 100642 - RNA, 19 nt, Homo sapiens
gcguaaaggugccaggaau

SEQ ID NO: 100643 - RNA, 19 nt, Homo sapiens
uucagcaucucacccauua

SEQ ID NO: 100644 - RNA, 19 nt, Homo sapiens
ggaggaggaggaugagauu

SEQ ID NO: 100645 - RNA, 19 nt, Homo sapiens
gaccauccuuggagaaaca

SEQ ID NO: 100646 - RNA, 19 nt, Homo sapiens
ccuaacaugugagaauaaa

SEQ ID NO: 100647 - RNA, 19 nt, Homo sapiens
gaugagauucuuccaagga

SEQ ID NO: 100648 - RNA, 19 nt, Homo sapiens
ggugaauguuauuggaauu

SEQ ID NO: 100649 - RNA, 19 nt, Homo sapiens
uuagagagccuccuugugu

SEQ ID NO: 100650 - RNA, 19 nt, Homo sapiens
ccacagcucugcggaccuu

SEQ ID NO: 100651 - RNA, 19 nt, Homo sapiens
gaagccaauuguccaaguc

SEQ ID NO: 100652 - RNA, 19 nt, Homo sapiens
cuaauuccacuguguauau

SEQ ID NO: 100653 - RNA, 19 nt, Homo sapiens
gacaguagaaugcaaauac

SEQ ID NO: 100654 - RNA, 19 nt, Homo sapiens
ucacguuauuucuuccuuu

SEQ ID NO: 100655 - RNA, 19 nt, Homo sapiens
gcuuugacuucuaaauguu

SEQ ID NO: 100656 - RNA, 19 nt, Homo sapiens
gacaacauacaguucauga

SEQ ID NO: 100657 - RNA, 19 nt, Homo sapiens
gucaaaugcuaucugaaug

SEQ ID NO: 100658 - RNA, 19 nt, Homo sapiens
gcacuguuuguuuguauga

SEQ ID NO: 100659 - RNA, 19 nt, Homo sapiens
uaugagaguuuggauuaug

SEQ ID NO: 100660 - RNA, 19 nt, Homo sapiens
uaauuccacuccagagaug

SEQ ID NO: 100661 - RNA, 19 nt, Homo sapiens
uuacggaagauccaguuua

SEQ ID NO: 100662 - RNA, 19 nt, Homo sapiens
cuugggaguucucauugua

SEQ ID NO: 100663 - RNA, 19 nt, Homo sapiens
auaauacucccaggaaaua

SEQ ID NO: 100664 - RNA, 19 nt, Homo sapiens
gaaccaccgcccaccagaa

SEQ ID NO: 100665 - RNA, 19 nt, Homo sapiens
caacauacaguucaugacu

SEQ ID NO: 100666 - RNA, 19 nt, Homo sapiens
uacccgaggucaaaugcua

SEQ ID NO: 100667 - RNA, 19 nt, Homo sapiens
uaaccucaccuuugucuuc

SEQ ID NO: 100668 - RNA, 19 nt, Homo sapiens
gaauuaugcacugacauga

SEQ ID NO: 100669 - RNA, 19 nt, Homo sapiens
guucugggauucaguuugg

SEQ ID NO: 100670 - RNA, 19 nt, Homo sapiens
uaagaaggaagccaauugu

SEQ ID NO: 100671 - RNA, 19 nt, Homo sapiens
ugucugcccuucacaaaca

SEQ ID NO: 100672 - RNA, 19 nt, Homo sapiens
ccagauaagcccaaagaca

SEQ ID NO: 100673 - RNA, 19 nt, Homo sapiens
agagauagacaguagaaug

SEQ ID NO: 100674 - RNA, 19 nt, Homo sapiens
ccagagauagacaguagaa

SEQ ID NO: 100675 - RNA, 19 nt, Homo sapiens
ggacaucacaaggaccaaa

SEQ ID NO: 100676 - RNA, 19 nt, Homo sapiens
gcgcaggacaucacaagga

SEQ ID NO: 100677 - RNA, 19 nt, Homo sapiens
gguaugugcuaugauaaag

SEQ ID NO: 100678 - RNA, 19 nt, Homo sapiens
uaacauugcagcuuucucu

SEQ ID NO: 100679 - RNA, 19 nt, Homo sapiens
ggucuugcccugugguuug

SEQ ID NO: 100680 - RNA, 19 nt, Homo sapiens
ggauuaugaucgcuguauc

SEQ ID NO: 100681 - RNA, 19 nt, Homo sapiens
ccacuguguauauaaauug

SEQ ID NO: 100682 - RNA, 19 nt, Homo sapiens
gaucagucgccucaguaaa

SEQ ID NO: 100683 - RNA, 19 nt, Homo sapiens
uaaagcagauggccuauuu

SEQ ID NO: 100684 - RNA, 19 nt, Homo sapiens
gaacccggcuguugccuua

SEQ ID NO: 100685 - RNA, 19 nt, Homo sapiens
gaaugcaccugacuuauga

SEQ ID NO: 100686 - RNA, 19 nt, Homo sapiens
ccagaaacauaaaggauua

SEQ ID NO: 100687 - RNA, 19 nt, Homo sapiens
gcaaggaucuucccacuuc

SEQ ID NO: 100688 - RNA, 19 nt, Homo sapiens
uaagaaaggucgaagauau

SEQ ID NO: 100689 - RNA, 19 nt, Homo sapiens
gcaccugacuuaugaaaug

SEQ ID NO: 100690 - RNA, 19 nt, Homo sapiens
aaagguaugugcuaugaua

SEQ ID NO: 100691 - RNA, 19 nt, Homo sapiens
gagaguccuucccuuauuu

SEQ ID NO: 100692 - RNA, 19 nt, Homo sapiens
gaccauggauaauaagaaa

SEQ ID NO: 100693 - RNA, 19 nt, Homo sapiens
guauugaugugcaguauug

SEQ ID NO: 100694 - RNA, 19 nt, Homo sapiens
gauggucaaucugauaaua

SEQ ID NO: 100695 - RNA, 19 nt, Homo sapiens
gaaagacuaugagaguuug

SEQ ID NO: 100696 - RNA, 19 nt, Homo sapiens
ggaaagacuaugagaguuu

SEQ ID NO: 100697 - RNA, 19 nt, Homo sapiens
gcacgugccugaagguuuc

SEQ ID NO: 100698 - RNA, 19 nt, Homo sapiens
cauuugugaugcagaauua

SEQ ID NO: 100699 - RNA, 19 nt, Homo sapiens
ggauaauacucccaggaaa

SEQ ID NO: 100700 - RNA, 19 nt, Homo sapiens
gaggucaaaugcuaucuga

SEQ ID NO: 100701 - RNA, 19 nt, Homo sapiens
ugaaagguaugugcuauga

SEQ ID NO: 100702 - RNA, 19 nt, Homo sapiens
gagcuggccucccucaguu

SEQ ID NO: 100703 - RNA, 19 nt, Homo sapiens
gaagugguguuuuguguuu

SEQ ID NO: 100704 - RNA, 19 nt, Homo sapiens
caugacaaaucaacuguga

SEQ ID NO: 100705 - RNA, 19 nt, Homo sapiens
ccagaaugcaccugacuua

SEQ ID NO: 100706 - RNA, 19 nt, Homo sapiens
uacggaagauccaguuuaa

SEQ ID NO: 100707 - RNA, 19 nt, Homo sapiens
ggaaauagcgcaggacauc

SEQ ID NO: 100708 - RNA, 19 nt, Homo sapiens
uauccucgcuaguuuguuu

SEQ ID NO: 100709 - RNA, 19 nt, Homo sapiens
ucagagaguccuucccuua

SEQ ID NO: 100710 - RNA, 19 nt, Homo sapiens
ggaauugggcacugagaaa

SEQ ID NO: 100711 - RNA, 19 nt, Homo sapiens
gauaugaggcggugaagug

SEQ ID NO: 100712 - RNA, 19 nt, Homo sapiens
caaugacccuuaccuggaa

SEQ ID NO: 100713 - RNA, 19 nt, Homo sapiens
guguuuaagucaccagaua

SEQ ID NO: 100714 - RNA, 19 nt, Homo sapiens
caagauggccuucauuuac

SEQ ID NO: 100715 - RNA, 19 nt, Homo sapiens
uggagaccauggauaauaa

SEQ ID NO: 100716 - RNA, 19 nt, Homo sapiens
ucaagauggccuucauuua

SEQ ID NO: 100717 - RNA, 19 nt, Homo sapiens
gcuguugccuuaaaugugu

SEQ ID NO: 100718 - RNA, 19 nt, Homo sapiens
gacccucgcuccuuccauu

SEQ ID NO: 100719 - RNA, 19 nt, Homo sapiens
gaagauaugaggcggugaa

SEQ ID NO: 100720 - RNA, 19 nt, Homo sapiens
gcagaauuaugcacugaca

SEQ ID NO: 100721 - RNA, 19 nt, Homo sapiens
gcccagagauagacaguag

SEQ ID NO: 100722 - RNA, 19 nt, Homo sapiens
ugacuagguuuaggaauug

SEQ ID NO: 100723 - RNA, 19 nt, Homo sapiens
caucuuugcuacuuuccua

SEQ ID NO: 100724 - RNA, 19 nt, Homo sapiens
ggucaaaugcuaucugaau

SEQ ID NO: 100725 - RNA, 19 nt, Homo sapiens
ggcagcagguuccgggaua

SEQ ID NO: 100726 - RNA, 19 nt, Homo sapiens
gauaauacucccaggaaau

SEQ ID NO: 100727 - RNA, 19 nt, Homo sapiens
ccaccaaaguuagcugaaa

SEQ ID NO: 100728 - RNA, 19 nt, Homo sapiens
cgucuacccuaauucuuaa

SEQ ID NO: 100729 - RNA, 19 nt, Homo sapiens
cgccagcccugcaguauug

SEQ ID NO: 100730 - RNA, 19 nt, Homo sapiens
gauagacaguagaaugcaa

SEQ ID NO: 100731 - RNA, 19 nt, Homo sapiens
ggaagccaauuguccaagu

SEQ ID NO: 100732 - RNA, 19 nt, Homo sapiens
ugaaguggauggugguguu

SEQ ID NO: 100733 - RNA, 19 nt, Homo sapiens
gguaagaagugguguuuug

SEQ ID NO: 100734 - RNA, 19 nt, Homo sapiens
ggaggaggaugagauucuu

SEQ ID NO: 100735 - RNA, 19 nt, Homo sapiens
gcaucacccaccaaaguua

SEQ ID NO: 100736 - RNA, 19 nt, Homo sapiens
agagaguccuucccuuauu

SEQ ID NO: 100737 - RNA, 19 nt, Homo sapiens
acuaugagaguuuggauua

SEQ ID NO: 100738 - RNA, 19 nt, Homo sapiens
agauuuacgucuacccuaa

SEQ ID NO: 100739 - RNA, 19 nt, Homo sapiens
caucagagcuuggacuuuu

SEQ ID NO: 100740 - RNA, 19 nt, Homo sapiens
gcguaaaggugccaggaau

SEQ ID NO: 100741 - RNA, 19 nt, Homo sapiens
gaccauccuuggagaaaca

SEQ ID NO: 100742 - RNA, 19 nt, Homo sapiens
uucagcaucucacccauua

SEQ ID NO: 100743 - RNA, 19 nt, Homo sapiens
ggaggaggaggaugagauu

SEQ ID NO: 100744 - RNA, 19 nt, Homo sapiens
ccuaacaugugagaauaaa

SEQ ID NO: 100745 - RNA, 19 nt, Homo sapiens
gaugagauucuuccaagga

SEQ ID NO: 100746 - RNA, 19 nt, Homo sapiens
ggugaauguuauuggaauu

SEQ ID NO: 100747 - RNA, 19 nt, Homo sapiens
ccacagcucugcggaccuu

SEQ ID NO: 100748 - RNA, 19 nt, Homo sapiens
gaagccaauuguccaaguc

SEQ ID NO: 100749 - RNA, 19 nt, Homo sapiens
cuaauuccacuguguauau

SEQ ID NO: 100750 - RNA, 19 nt, Homo sapiens
gacaguagaaugcaaauac

SEQ ID NO: 100751 - RNA, 19 nt, Homo sapiens
ucacguuauuucuuccuuu

SEQ ID NO: 100752 - RNA, 19 nt, Homo sapiens
gcuuugacuucuaaauguu

SEQ ID NO: 100753 - RNA, 19 nt, Homo sapiens
gacaacauacaguucauga

SEQ ID NO: 100754 - RNA, 19 nt, Homo sapiens
gucaaaugcuaucugaaug

SEQ ID NO: 100755 - RNA, 19 nt, Homo sapiens
gcacuguuuguuuguauga

SEQ ID NO: 100756 - RNA, 19 nt, Homo sapiens
uaugagaguuuggauuaug

SEQ ID NO: 100757 - RNA, 19 nt, Homo sapiens
uaauuccacuccagagaug

SEQ ID NO: 100758 - RNA, 19 nt, Homo sapiens
uuacggaagauccaguuua

SEQ ID NO: 100759 - RNA, 19 nt, Homo sapiens
cuugggaguucucauugua

SEQ ID NO: 100760 - RNA, 19 nt, Homo sapiens
auaauacucccaggaaaua

SEQ ID NO: 100761 - RNA, 19 nt, Homo sapiens
gaaccaccgcccaccagaa

SEQ ID NO: 100762 - RNA, 19 nt, Homo sapiens
caacauacaguucaugacu

SEQ ID NO: 100763 - RNA, 19 nt, Homo sapiens
uacccgaggucaaaugcua

SEQ ID NO: 100764 - RNA, 19 nt, Homo sapiens
uaaccucaccuuugucuuc

SEQ ID NO: 100765 - RNA, 19 nt, Homo sapiens
gaauuaugcacugacauga

SEQ ID NO: 100766 - RNA, 19 nt, Homo sapiens
guucugggauucaguuugg

SEQ ID NO: 100767 - RNA, 19 nt, Homo sapiens
uaagaaggaagccaauugu

SEQ ID NO: 100768 - RNA, 19 nt, Homo sapiens
ugucugcccuucacaaaca

SEQ ID NO: 100769 - RNA, 19 nt, Homo sapiens
ccagauaagcccaaagaca

SEQ ID NO: 100770 - RNA, 19 nt, Homo sapiens
agagauagacaguagaaug

SEQ ID NO: 100771 - RNA, 19 nt, Homo sapiens
ccagagauagacaguagaa

SEQ ID NO: 100772 - RNA, 19 nt, Homo sapiens
ggacaucacaaggaccaaa

SEQ ID NO: 100773 - RNA, 19 nt, Homo sapiens
gcgcaggacaucacaagga

SEQ ID NO: 100774 - RNA, 19 nt, Homo sapiens
gguaugugcuaugauaaag

SEQ ID NO: 100775 - RNA, 19 nt, Homo sapiens
ggauuaugaucgcuguauc

SEQ ID NO: 100776 - RNA, 19 nt, Homo sapiens
uaacauugcagcuuucucu

SEQ ID NO: 100777 - RNA, 19 nt, Homo sapiens
ggucuugcccugugguuug

SEQ ID NO: 100778 - RNA, 19 nt, Homo sapiens
ccacuguguauauaaauug

SEQ ID NO: 100779 - RNA, 19 nt, Homo sapiens
gaucagucgccucaguaaa

SEQ ID NO: 100780 - RNA, 19 nt, Homo sapiens
cuucuccacucaugacaaa

SEQ ID NO: 100781 - RNA, 19 nt, Homo sapiens
gcccaaagacagcaacuuc

SEQ ID NO: 100782 - RNA, 19 nt, Homo sapiens
uuaagaaggaagccaauug

SEQ ID NO: 100783 - RNA, 19 nt, Homo sapiens
gcguggagcuggaugauga

SEQ ID NO: 100784 - RNA, 19 nt, Homo sapiens
ccaaggagaucccacacaa

SEQ ID NO: 100785 - RNA, 19 nt, Homo sapiens
ggagcuggaugaugaacuu

SEQ ID NO: 100786 - RNA, 19 nt, Homo sapiens
caacuucagugucccuguu

SEQ ID NO: 100787 - RNA, 19 nt, Homo sapiens
gcucaucguucuccuaaag

SEQ ID NO: 100788 - RNA, 19 nt, Homo sapiens
gcucugugauuguggcuuu

SEQ ID NO: 100789 - RNA, 19 nt, Homo sapiens
ggucugaacgcgaaauaaa

SEQ ID NO: 100790 - RNA, 19 nt, Homo sapiens
gauuguggcuuucauagag

SEQ ID NO: 100791 - RNA, 19 nt, Homo sapiens
gcccaggccucaucaacuu

SEQ ID NO: 100792 - RNA, 19 nt, Homo sapiens
ggaaaggaagggccgauga

SEQ ID NO: 100793 - RNA, 19 nt, Homo sapiens
ccauggaccucuccgaguu

SEQ ID NO: 100794 - RNA, 19 nt, Homo sapiens
uaugagagcuuggacuaug

SEQ ID NO: 100795 - RNA, 19 nt, Homo sapiens
gugaugagcacaccaguga

SEQ ID NO: 100796 - RNA, 19 nt, Homo sapiens
gcccagcccugcccauaau

SEQ ID NO: 100797 - RNA, 19 nt, Homo sapiens
gaaggucggcgucauugug

SEQ ID NO: 100798 - RNA, 19 nt, Homo sapiens
uggaggaucuucuuugcuu

SEQ ID NO: 100799 - RNA, 19 nt, Homo sapiens
gaaaggaagggccgaugau

SEQ ID NO: 100800 - RNA, 19 nt, Homo sapiens
gaacgcgaaauaaagaaau

SEQ ID NO: 100801 - RNA, 19 nt, Homo sapiens
gaaggucaacgucacugaa

SEQ ID NO: 100802 - RNA, 19 nt, Homo sapiens
caaaguguccggugugauc

SEQ ID NO: 100803 - RNA, 19 nt, Homo sapiens
ucaagacguuggugaucaa

SEQ ID NO: 100804 - RNA, 19 nt, Homo sapiens
aaaccuggcuggccucaag

SEQ ID NO: 100805 - RNA, 19 nt, Homo sapiens
ggagcugcuuggccucauu

SEQ ID NO: 100806 - RNA, 19 nt, Homo sapiens
gcucgugggcucugugauu

SEQ ID NO: 100807 - RNA, 19 nt, Homo sapiens
acauucagcugcagagugu

SEQ ID NO: 100808 - RNA, 19 nt, Homo sapiens
gaucgugggcgacgucuuc

SEQ ID NO: 100809 - RNA, 19 nt, Homo sapiens
ggucaucugcgcccucauu

SEQ ID NO: 100810 - RNA, 19 nt, Homo sapiens
gagaaggucggcgucauug

SEQ ID NO: 100811 - RNA, 19 nt, Homo sapiens
gcucaugaccgccaagauc

SEQ ID NO: 100812 - RNA, 19 nt, Homo sapiens
agacguuggugaucaaagu

SEQ ID NO: 100813 - RNA, 19 nt, Homo sapiens
ccucguggccugcuucauu

SEQ ID NO: 100814 - RNA, 19 nt, Homo sapiens
gcccugugcugugauguug

SEQ ID NO: 100815 - RNA, 19 nt, Homo sapiens
uggccaacgucucuaagaa

SEQ ID NO: 100816 - RNA, 19 nt, Homo sapiens
cagcucaucguucuccuaa

SEQ ID NO: 100817 - RNA, 19 nt, Homo sapiens
gcucccagcucaucguucu

SEQ ID NO: 100818 - RNA, 19 nt, Homo sapiens
gcagaggcaacuucagugu

SEQ ID NO: 100819 - RNA, 19 nt, Homo sapiens
ggaaggucaacgucacuga

SEQ ID NO: 100820 - RNA, 19 nt, Homo sapiens
caagggcaauaucgacaag

SEQ ID NO: 100821 - RNA, 19 nt, Homo sapiens
gauguugagagcugagaaa

SEQ ID NO: 100822 - RNA, 19 nt, Homo sapiens
gagcugcuuggccucauuu

SEQ ID NO: 100823 - RNA, 19 nt, Homo sapiens
ucgacaaguucacagagaa

SEQ ID NO: 100824 - RNA, 19 nt, Homo sapiens
gcuccugucccucaaguau

SEQ ID NO: 100825 - RNA, 19 nt, Homo sapiens
acuacuggcugaccauguu

SEQ ID NO: 100826 - RNA, 19 nt, Homo sapiens
uccaugaucuccacguuca

SEQ ID NO: 100827 - RNA, 19 nt, Homo sapiens
gaugauccacucagguuca

SEQ ID NO: 100828 - RNA, 19 nt, Homo sapiens
gagcuuggacuaugacaac

SEQ ID NO: 100829 - RNA, 19 nt, Homo sapiens
ggaccucuccgaguucaug

SEQ ID NO: 100830 - RNA, 19 nt, Homo sapiens
ugagaaggucggcgucauu

SEQ ID NO: 100831 - RNA, 19 nt, Homo sapiens
ucaagaucuucgaguacuu

SEQ ID NO: 100832 - RNA, 19 nt, Homo sapiens
gaucaagugcuuccucaac

SEQ ID NO: 100833 - RNA, 19 nt, Homo sapiens
ccagggaucagcugugugu

SEQ ID NO: 100834 - RNA, 19 nt, Homo sapiens
uguacgacaugcacauuca

SEQ ID NO: 100835 - RNA, 19 nt, Homo sapiens
gcugcggccuucuucaaca

SEQ ID NO: 100836 - RNA, 19 nt, Homo sapiens
gcagauggcgaguacaacu

SEQ ID NO: 100837 - RNA, 19 nt, Homo sapiens
gaagguuugacucggagaa

SEQ ID NO: 100838 - RNA, 19 nt, Homo sapiens
acucguagcaccaggguuu

SEQ ID NO: 100839 - RNA, 19 nt, Homo sapiens
ccucgucuagguuucuuua

SEQ ID NO: 100840 - RNA, 19 nt, Homo sapiens
cggcaaauacgcccugaug

SEQ ID NO: 100841 - RNA, 19 nt, Homo sapiens
cuucuuugcuuccaugauc

SEQ ID NO: 100842 - RNA, 19 nt, Homo sapiens
ccuccacucuccucgucua

SEQ ID NO: 100843 - RNA, 19 nt, Homo sapiens
gugcagauggcgaguacaa

SEQ ID NO: 100844 - RNA, 19 nt, Homo sapiens
ggcaauaucgacaaguuca

SEQ ID NO: 100845 - RNA, 19 nt, Homo sapiens
ccacucuccucgucuaggu

SEQ ID NO: 100846 - RNA, 19 nt, Homo sapiens
gcgacacggcguccaauca

SEQ ID NO: 100847 - RNA, 19 nt, Homo sapiens
ucaccacguucugcgcuuu

SEQ ID NO: 100848 - RNA, 19 nt, Homo sapiens
ucacgcuggucuacuucuu

SEQ ID NO: 100849 - RNA, 19 nt, Homo sapiens
uccugucccucaaguauga

SEQ ID NO: 100850 - RNA, 19 nt, Homo sapiens
ucaaguacagggucaucaa

SEQ ID NO: 100851 - RNA, 19 nt, Homo sapiens
ucugaacgcgaaauaaaga

SEQ ID NO: 100852 - RNA, 19 nt, Homo sapiens
gacacggcguccaaucaca

SEQ ID NO: 100853 - RNA, 19 nt, Homo sapiens
ugggcgacgucuucauuga

SEQ ID NO: 100854 - RNA, 19 nt, Homo sapiens
cgagaucccggucuucauc

SEQ ID NO: 100855 - RNA, 19 nt, Homo sapiens
gaccuggaggaucuucuuu

SEQ ID NO: 100856 - RNA, 19 nt, Homo sapiens
ccgaugauccacucagguu

SEQ ID NO: 100857 - RNA, 19 nt, Homo sapiens
ugaacgcgaaauaaagaaa

SEQ ID NO: 100858 - RNA, 19 nt, Homo sapiens
ccgaguguguugggucuga

SEQ ID NO: 100859 - RNA, 19 nt, Homo sapiens
ucgcgggacugacccuguu

SEQ ID NO: 100860 - RNA, 19 nt, Homo sapiens
agggcaauaucgacaaguu

SEQ ID NO: 100861 - RNA, 19 nt, Homo sapiens
ggucaucaagggcaauauc

SEQ ID NO: 100862 - RNA, 19 nt, Homo sapiens
gacgccaccacccugcuua

SEQ ID NO: 100863 - RNA, 19 nt, Homo sapiens
cugaccauguuucgaauca

SEQ ID NO: 100864 - RNA, 19 nt, Homo sapiens
uggcugaccauguuucgaa

SEQ ID NO: 100865 - RNA, 19 nt, Homo sapiens
caagaucuucgaguacuuc

SEQ ID NO: 100866 - RNA, 19 nt, Homo sapiens
auuucaagaucuucgagua

SEQ ID NO: 100867 - RNA, 19 nt, Homo sapiens
caagguguccgaguguguu

SEQ ID NO: 100868 - RNA, 19 nt, Homo sapiens
ccuacacgauccacgagau

SEQ ID NO: 100869 - RNA, 19 nt, Homo sapiens
aguaugagagcuuggacua

SEQ ID NO: 100870 - RNA, 19 nt, Homo sapiens
gaucaagcgcugggucauc

SEQ ID NO: 100871 - RNA, 19 nt, Homo sapiens
augagagcuuggacuauga

SEQ ID NO: 100872 - RNA, 19 nt, Homo sapiens
ggaucucccuguccuaccu

SEQ ID NO: 100873 - RNA, 19 nt, Homo sapiens
uguucacgcuggucuacuu

SEQ ID NO: 100874 - RNA, 19 nt, Homo sapiens
ccauggccaacgucucuaa

SEQ ID NO: 100875 - RNA, 19 nt, Homo sapiens
cucguggccugcuucauug

SEQ ID NO: 100876 - RNA, 19 nt, Homo sapiens
ccugaggcacggacucgua

SEQ ID NO: 100877 - RNA, 19 nt, Homo sapiens
gcuggaugaugaacuuuug

SEQ ID NO: 100878 - RNA, 19 nt, Homo sapiens
gcauuuaccacgggaacau

SEQ ID NO: 100879 - RNA, 19 nt, Homo sapiens
gcucaagacguuggugauc

SEQ ID NO: 100880 - RNA, 19 nt, Homo sapiens
gggcaauaucgacaaguuc

SEQ ID NO: 100881 - RNA, 19 nt, Homo sapiens
cggcagaggcaacuucagu

SEQ ID NO: 100882 - RNA, 19 nt, Homo sapiens
cgugggcgacgucuucauu

SEQ ID NO: 100883 - RNA, 19 nt, Homo sapiens
ccacagacgugaccgagua

SEQ ID NO: 100884 - RNA, 19 nt, Homo sapiens
ggucaugucuucccacuuc

SEQ ID NO: 100885 - RNA, 19 nt, Homo sapiens
gagcugugcuuaccucuuc

SEQ ID NO: 100886 - RNA, 19 nt, Homo sapiens
gcaccugucuguaaugauc

SEQ ID NO: 100887 - RNA, 19 nt, Homo sapiens
gugcuuaccucuucuguca

SEQ ID NO: 100888 - RNA, 19 nt, Homo sapiens
gcaccaucauugucaagaa

SEQ ID NO: 100889 - RNA, 19 nt, Homo sapiens
gcaucgaggucaugucuuc

SEQ ID NO: 100890 - RNA, 19 nt, Homo sapiens
ccaaacugcuggcuacuag

SEQ ID NO: 100891 - RNA, 19 nt, Homo sapiens
ucaagaagcugccauaccu

SEQ ID NO: 100892 - RNA, 19 nt, Homo sapiens
gggcguggccacagucuuu

SEQ ID NO: 100893 - RNA, 19 nt, Homo sapiens
gcacaccaguggcuguaca

SEQ ID NO: 100894 - RNA, 19 nt, Homo sapiens
gagaugaagaaagcaauuu

SEQ ID NO: 100895 - RNA, 19 nt, Homo sapiens
ggagaugaagaaagcaauu

SEQ ID NO: 100896 - RNA, 19 nt, Homo sapiens
ucaccacacuggccaagga

SEQ ID NO: 100897 - RNA, 19 nt, Homo sapiens
gagaacaagagcaagcaaa

SEQ ID NO: 100898 - RNA, 19 nt, Homo sapiens
caaauccgccagcuccaaa

SEQ ID NO: 100899 - RNA, 19 nt, Homo sapiens
gagcugaccggccagauag

SEQ ID NO: 100900 - RNA, 19 nt, Homo sapiens
uggaguggcuaaagcagaa

SEQ ID NO: 100901 - RNA, 19 nt, Homo sapiens
ccagugacccugacgcuau

SEQ ID NO: 100902 - RNA, 19 nt, Homo sapiens
ggucagcuaugccaugaac

SEQ ID NO: 100903 - RNA, 19 nt, Homo sapiens
guacuucaugcccaucuuu

SEQ ID NO: 100904 - RNA, 19 nt, Homo sapiens
gugcaccugucuguaauga

SEQ ID NO: 100905 - RNA, 19 nt, Homo sapiens
ucauggcccuggucagcua

SEQ ID NO: 100906 - RNA, 19 nt, Homo sapiens
gacugguacuuccugauga

SEQ ID NO: 100907 - RNA, 19 nt, Homo sapiens
caacaucggcucccaccau

SEQ ID NO: 100908 - RNA, 19 nt, Homo sapiens
gagcacagagucccagauc

SEQ ID NO: 100909 - RNA, 19 nt, Homo sapiens
uaucuuuccuggacugugu

SEQ ID NO: 100910 - RNA, 19 nt, Homo sapiens
caccugcuccgguaucuuu

SEQ ID NO: 100911 - RNA, 19 nt, Homo sapiens
gcacaaaaccucuuuaagc

SEQ ID NO: 100912 - RNA, 19 nt, Homo sapiens
cgaccugccugagaucuuc

SEQ ID NO: 100913 - RNA, 19 nt, Homo sapiens
gaaccuuccucagcuucau

SEQ ID NO: 100914 - RNA, 19 nt, Homo sapiens
gagcacaccaguggcugua

SEQ ID NO: 100915 - RNA, 19 nt, Homo sapiens
gcuaugccaugaacuuugc

SEQ ID NO: 100916 - RNA, 19 nt, Homo sapiens
cagugacccugacgcuauu

SEQ ID NO: 100917 - RNA, 19 nt, Homo sapiens
gaccaucaccucccucuac

SEQ ID NO: 100918 - RNA, 19 nt, Homo sapiens
ggguggagaugaagaaagc

SEQ ID NO: 100919 - RNA, 19 nt, Homo sapiens
uggaggagguggucaaggu

SEQ ID NO: 100920 - RNA, 19 nt, Homo sapiens
ggguggagcacuucaugaa

SEQ ID NO: 100921 - RNA, 19 nt, Homo sapiens
ugagcugaccggccagaua

SEQ ID NO: 100922 - RNA, 19 nt, Homo sapiens
cuucucggcuguccaugaa

SEQ ID NO: 100923 - RNA, 19 nt, Homo sapiens
uuccucagcuucaucaaga

SEQ ID NO: 100924 - RNA, 19 nt, Homo sapiens
gguuaccaaucccaucaug

SEQ ID NO: 100925 - RNA, 19 nt, Homo sapiens
gggcgcugaugacccagaa

SEQ ID NO: 100926 - RNA, 19 nt, Homo sapiens
uggacucgcuguucgacaa

SEQ ID NO: 100927 - RNA, 19 nt, Homo sapiens
aggacuaccuggauaucaa

SEQ ID NO: 100928 - RNA, 19 nt, Homo sapiens
uuggaggacuaccuggaua

SEQ ID NO: 100929 - RNA, 19 nt, Homo sapiens
caauuuccaaccugacaaa

SEQ ID NO: 100930 - RNA, 19 nt, Homo sapiens
gcacagagucccagauccu

SEQ ID NO: 100931 - RNA, 19 nt, Homo sapiens
ggaggagguggucaagguu

SEQ ID NO: 100932 - RNA, 19 nt, Homo sapiens
ucaccucccucuacaagac

SEQ ID NO: 100933 - RNA, 19 nt, Homo sapiens
gcaauuuccaaccugacaa

SEQ ID NO: 100934 - RNA, 19 nt, Homo sapiens
gaggguggagcacuucaug

SEQ ID NO: 100935 - RNA, 19 nt, Homo sapiens
gaaguucuggaugcugauu

SEQ ID NO: 100936 - RNA, 19 nt, Homo sapiens
ggcuaaagcagaagguguu

SEQ ID NO: 100937 - RNA, 19 nt, Homo sapiens
caccaucauugucaagaag

SEQ ID NO: 100938 - RNA, 19 nt, Homo sapiens
ucccggagcugaagaccau

SEQ ID NO: 100939 - RNA, 19 nt, Homo sapiens
uguccuggguggagaugaa

SEQ ID NO: 100940 - RNA, 19 nt, Homo sapiens
gaaccuucagucccucuuc

SEQ ID NO: 100941 - RNA, 19 nt, Homo sapiens
cagcuaugccaugaacuuu

SEQ ID NO: 100942 - RNA, 19 nt, Homo sapiens
ugccagcccuccuucuaug

SEQ ID NO: 100943 - RNA, 19 nt, Homo sapiens
cuguggcccucgucucuuu

SEQ ID NO: 100944 - RNA, 19 nt, Homo sapiens
gcccaucuuuauccuugga

SEQ ID NO: 100945 - RNA, 19 nt, Homo sapiens
uccgccagcuccaaaguga

SEQ ID NO: 100946 - RNA, 19 nt, Homo sapiens
ggacuaccuggauaucaag

SEQ ID NO: 100947 - RNA, 19 nt, Homo sapiens
ucagcuaugccaugaacuu

SEQ ID NO: 100948 - RNA, 19 nt, Homo sapiens
agacugguacuuccugaug

SEQ ID NO: 100949 - RNA, 19 nt, Homo sapiens
ucuuuaagcuguugaaccu

SEQ ID NO: 100950 - RNA, 19 nt, Homo sapiens
gguacuucaugcccaucuu

SEQ ID NO: 100951 - RNA, 19 nt, Homo sapiens
ggguggacguucccuucga

SEQ ID NO: 100952 - RNA, 19 nt, Homo sapiens
caucaccucccucuacaag

SEQ ID NO: 100953 - RNA, 19 nt, Homo sapiens
cacaaaaccucuuuaagcu

SEQ ID NO: 100954 - RNA, 19 nt, Homo sapiens
caucggcucccaccaugug

SEQ ID NO: 100955 - RNA, 19 nt, Homo sapiens
cagcccuccuucuaugaug

SEQ ID NO: 100956 - RNA, 19 nt, Homo sapiens
gaggacuaccuggauauca

SEQ ID NO: 100957 - RNA, 19 nt, Homo sapiens
aaaccucuuuaagcuguug

SEQ ID NO: 100958 - RNA, 19 nt, Homo sapiens
gacccugacgcuauucuca

SEQ ID NO: 100959 - RNA, 19 nt, Homo sapiens
cuagcaagccuguguacuc

SEQ ID NO: 100960 - RNA, 19 nt, Homo sapiens
cuacuagcaagccugugua

SEQ ID NO: 100961 - RNA, 19 nt, Homo sapiens
cagcaucgaggucaugucu

SEQ ID NO: 100962 - RNA, 19 nt, Homo sapiens
cuggucagcuaugccauga

SEQ ID NO: 100963 - RNA, 19 nt, Homo sapiens
ggagcugaagaccauguug

SEQ ID NO: 100964 - RNA, 19 nt, Homo sapiens
cuaccuggauaucaagaac

SEQ ID NO: 100965 - RNA, 19 nt, Homo sapiens
guuggcgggugugaucuug

SEQ ID NO: 100966 - RNA, 19 nt, Homo sapiens
ggacuuggcuguugagagu

SEQ ID NO: 100967 - RNA, 19 nt, Homo sapiens
gaaccuucauucccucuuu

SEQ ID NO: 100968 - RNA, 19 nt, Homo sapiens
gggcagcgcuuaccucuuc

SEQ ID NO: 100969 - RNA, 19 nt, Homo sapiens
gcgcuuaccucuucuguca

SEQ ID NO: 100970 - RNA, 19 nt, Homo sapiens
ggucaugucuucccacuuc

SEQ ID NO: 100971 - RNA, 19 nt, Homo sapiens
gaucaccaaucccaucaug

SEQ ID NO: 100972 - RNA, 19 nt, Homo sapiens
gcaucgaggucaugucuuc

SEQ ID NO: 100973 - RNA, 19 nt, Homo sapiens
gcaccgucauugucaagaa

SEQ ID NO: 100974 - RNA, 19 nt, Homo sapiens
gcaccugucugugaugaug

SEQ ID NO: 100975 - RNA, 19 nt, Homo sapiens
ucaagaagcugccauaccu

SEQ ID NO: 100976 - RNA, 19 nt, Homo sapiens
ggacugguacuuccugaug

SEQ ID NO: 100977 - RNA, 19 nt, Homo sapiens
uggaguggcugaagcagaa

SEQ ID NO: 100978 - RNA, 19 nt, Homo sapiens
cgaggugaccggccagaua

SEQ ID NO: 100979 - RNA, 19 nt, Homo sapiens
gggcguggccacagucuuu

SEQ ID NO: 100980 - RNA, 19 nt, Homo sapiens
gagaugaagaaagcaauuu

SEQ ID NO: 100981 - RNA, 19 nt, Homo sapiens
ggagaugaagaaagcaauu

SEQ ID NO: 100982 - RNA, 19 nt, Homo sapiens
ucaccacacuggccaagga

SEQ ID NO: 100983 - RNA, 19 nt, Homo sapiens
gagaacaagagcaagcaaa

SEQ ID NO: 100984 - RNA, 19 nt, Homo sapiens
guacuucaugcccaucuuu

SEQ ID NO: 100985 - RNA, 19 nt, Homo sapiens
gacugguacuuccugauga

SEQ ID NO: 100986 - RNA, 19 nt, Homo sapiens
gagcacagagucccagauc

SEQ ID NO: 100987 - RNA, 19 nt, Homo sapiens
cgaccugccugagaucuuc

SEQ ID NO: 100988 - RNA, 19 nt, Homo sapiens
ccauggacuuggcuguuga

SEQ ID NO: 100989 - RNA, 19 nt, Homo sapiens
cagaaccagugacccugaa

SEQ ID NO: 100990 - RNA, 19 nt, Homo sapiens
gaggugaccggccagauag

SEQ ID NO: 100991 - RNA, 19 nt, Homo sapiens
gaccaucaccucccucuac

SEQ ID NO: 100992 - RNA, 19 nt, Homo sapiens
ggguggagaugaagaaagc

SEQ ID NO: 100993 - RNA, 19 nt, Homo sapiens
uggaggagguggucaaggu

SEQ ID NO: 100994 - RNA, 19 nt, Homo sapiens
ggguggagcacuucaugaa

SEQ ID NO: 100995 - RNA, 19 nt, Homo sapiens
cuucucggcuguccaugaa

SEQ ID NO: 100996 - RNA, 19 nt, Homo sapiens
gauggcaccgucauuguca

SEQ ID NO: 100997 - RNA, 19 nt, Homo sapiens
gggcgcugaugacccagaa

SEQ ID NO: 100998 - RNA, 19 nt, Homo sapiens
uggacucgcuguucgacaa

SEQ ID NO: 100999 - RNA, 19 nt, Homo sapiens
aggacuaccuggauaucaa

SEQ ID NO: 101000 - RNA, 19 nt, Homo sapiens
uuggaggacuaccuggaua

SEQ ID NO: 101001 - RNA, 19 nt, Homo sapiens
caauuuccaaccugacaaa

SEQ ID NO: 101002 - RNA, 19 nt, Homo sapiens
gcacagagucccagauccu

SEQ ID NO: 101003 - RNA, 19 nt, Homo sapiens
gugcaccugucugugauga

SEQ ID NO: 101004 - RNA, 19 nt, Homo sapiens
ggaggagguggucaagguu

SEQ ID NO: 101005 - RNA, 19 nt, Homo sapiens
ucaccucccucuacaagac

SEQ ID NO: 101006 - RNA, 19 nt, Homo sapiens
ggaggugaagaccauguug

SEQ ID NO: 101007 - RNA, 19 nt, Homo sapiens
gcaauuuccaaccugacaa

SEQ ID NO: 101008 - RNA, 19 nt, Homo sapiens
gaggguggagcacuucaug

SEQ ID NO: 101009 - RNA, 19 nt, Homo sapiens
gaaguucuggaugcugauu

SEQ ID NO: 101010 - RNA, 19 nt, Homo sapiens
ccagcaagccuguguacuc

SEQ ID NO: 101011 - RNA, 19 nt, Homo sapiens
gcgugaggguggagcacuu

SEQ ID NO: 101012 - RNA, 19 nt, Homo sapiens
ggcuucaucaggaacaaua

SEQ ID NO: 101013 - RNA, 19 nt, Homo sapiens
uguccuggguggagaugaa

SEQ ID NO: 101014 - RNA, 19 nt, Homo sapiens
ugccagcccuccuucuaug

SEQ ID NO: 101015 - RNA, 19 nt, Homo sapiens
cuguggcccucgucucuuu

SEQ ID NO: 101016 - RNA, 19 nt, Homo sapiens
gcgcaccaguggcuguaca

SEQ ID NO: 101017 - RNA, 19 nt, Homo sapiens
gcccucgucucuuucucuu

SEQ ID NO: 101018 - RNA, 19 nt, Homo sapiens
cuucauucccucuuuguga

SEQ ID NO: 101019 - RNA, 19 nt, Homo sapiens
acaauagguucagcuccaa

SEQ ID NO: 101020 - RNA, 19 nt, Homo sapiens
cgaaucuucuuuggcuuca

SEQ ID NO: 101021 - RNA, 19 nt, Homo sapiens
gagcgcaccaguggcugua

SEQ ID NO: 101022 - RNA, 19 nt, Homo sapiens
uaucucuccuggacugugu

SEQ ID NO: 101023 - RNA, 19 nt, Homo sapiens
ggacuaccuggauaucaag

SEQ ID NO: 101024 - RNA, 19 nt, Homo sapiens
cagagacuucccugcauga

SEQ ID NO: 101025 - RNA, 19 nt, Homo sapiens
gguacuucaugcccaucuu

SEQ ID NO: 101026 - RNA, 19 nt, Homo sapiens
aaucuucuuuggcuucauc

SEQ ID NO: 101027 - RNA, 19 nt, Homo sapiens
ugucagcgaaucuucuuug

SEQ ID NO: 101028 - RNA, 19 nt, Homo sapiens
ggguggacguucccuucga

SEQ ID NO: 101029 - RNA, 19 nt, Homo sapiens
caucaccucccucuacaag

SEQ ID NO: 101030 - RNA, 19 nt, Homo sapiens
cagcccuccuucuaugaug

SEQ ID NO: 101031 - RNA, 19 nt, Homo sapiens
gaggacuaccuggauauca

SEQ ID NO: 101032 - RNA, 19 nt, Homo sapiens
ucaugcccaucuuugucua

SEQ ID NO: 101033 - RNA, 19 nt, Homo sapiens
ucuucgggcuucucucaga

SEQ ID NO: 101034 - RNA, 19 nt, Homo sapiens
cagcaucgaggucaugucu

SEQ ID NO: 101035 - RNA, 19 nt, Homo sapiens
ucuuugagcuguugaaccu

SEQ ID NO: 101036 - RNA, 19 nt, Homo sapiens
gggcgaggacugguacuuc

SEQ ID NO: 101037 - RNA, 19 nt, Homo sapiens
caauagguucagcuccaaa

SEQ ID NO: 101038 - RNA, 19 nt, Homo sapiens
cuaccuggauaucaagaac

SEQ ID NO: 101039 - RNA, 19 nt, Homo sapiens
gauaaagacucucauagaa

SEQ ID NO: 101040 - RNA, 19 nt, Homo sapiens
gaaagaggaugcccuaaau

SEQ ID NO: 101041 - RNA, 19 nt, Homo sapiens
agaaagcgcugcaggaaua

SEQ ID NO: 101042 - RNA, 19 nt, Homo sapiens
gaagaacccuaaauuuaug

SEQ ID NO: 101043 - RNA, 19 nt, Homo sapiens
ggaagaacccuaaauuuau

SEQ ID NO: 101044 - RNA, 19 nt, Homo sapiens
gaaguaaguacgucaauaa

SEQ ID NO: 101045 - RNA, 19 nt, Homo sapiens
gcaugcaacuaauucaaua

SEQ ID NO: 101046 - RNA, 19 nt, Homo sapiens
ggaaguaaguacgucaaua

SEQ ID NO: 101047 - RNA, 19 nt, Homo sapiens
guaaguacgucaauaagga

SEQ ID NO: 101048 - RNA, 19 nt, Homo sapiens
aaacagaccugcaugaagu

SEQ ID NO: 101049 - RNA, 19 nt, Homo sapiens
guagaagucuccaggaaga

SEQ ID NO: 101050 - RNA, 19 nt, Homo sapiens
acaaugagcuccaggaaau

SEQ ID NO: 101051 - RNA, 19 nt, Homo sapiens
ggagugagauguggauguu

SEQ ID NO: 101052 - RNA, 19 nt, Homo sapiens
aggaagaacccuaaauuua

SEQ ID NO: 101053 - RNA, 19 nt, Homo sapiens
gcacgcgucugcagaagug

SEQ ID NO: 101054 - RNA, 19 nt, Homo sapiens
caauaaaacugucuuguga

SEQ ID NO: 101055 - RNA, 19 nt, Homo sapiens
gugcaaagacuccagaauu

SEQ ID NO: 101056 - RNA, 19 nt, Homo sapiens
guacgucaauaaggaaauu

SEQ ID NO: 101057 - RNA, 19 nt, Homo sapiens
acaacgagcugcuaaaguc

SEQ ID NO: 101058 - RNA, 19 nt, Homo sapiens
gaagaagccaagaagaaga

SEQ ID NO: 101059 - RNA, 19 nt, Homo sapiens
ugcaaagacuccagaauug

SEQ ID NO: 101060 - RNA, 19 nt, Homo sapiens
ggagaaagcgcugcaggaa

SEQ ID NO: 101061 - RNA, 19 nt, Homo sapiens
gaucuugucuguggacugu

SEQ ID NO: 101062 - RNA, 19 nt, Homo sapiens
ccaggaagaacccuaaauu

SEQ ID NO: 101063 - RNA, 19 nt, Homo sapiens
gaggaugcccuaaaugaga

SEQ ID NO: 101064 - RNA, 19 nt, Homo sapiens
gaaauacaacgagcugcua

SEQ ID NO: 101065 - RNA, 19 nt, Homo sapiens
ugaagacucugcugcuguu

SEQ ID NO: 101066 - RNA, 19 nt, Homo sapiens
ugaaacagauaaagacucu

SEQ ID NO: 101067 - RNA, 19 nt, Homo sapiens
caggaagaacccuaaauuu

SEQ ID NO: 101068 - RNA, 19 nt, Homo sapiens
gaaacagaccugcaugaag

SEQ ID NO: 101069 - RNA, 19 nt, Homo sapiens
uagaagaagccaagaagaa

SEQ ID NO: 101070 - RNA, 19 nt, Homo sapiens
ggaugaaggaccaguguga

SEQ ID NO: 101071 - RNA, 19 nt, Homo sapiens
gcucagcaaccuagaagaa

SEQ ID NO: 101072 - RNA, 19 nt, Homo sapiens
gcgaagaccaguacuaucu

SEQ ID NO: 101073 - RNA, 19 nt, Homo sapiens
cagcugaacgagcaguuua

SEQ ID NO: 101074 - RNA, 19 nt, Homo sapiens
ccaggagugugcaaugaga

SEQ ID NO: 101075 - RNA, 19 nt, Homo sapiens
gccgggagaucuugucugu

SEQ ID NO: 101076 - RNA, 19 nt, Homo sapiens
agaaagaggaugcccuaaa

SEQ ID NO: 101077 - RNA, 19 nt, Homo sapiens
agauaaagacucucauaga

SEQ ID NO: 101078 - RNA, 19 nt, Homo sapiens
acagauaaagacucucaua

SEQ ID NO: 101079 - RNA, 19 nt, Homo sapiens
gacggucccuguagaaguc

SEQ ID NO: 101080 - RNA, 19 nt, Homo sapiens
aagaggaugcccuaaauga

SEQ ID NO: 101081 - RNA, 19 nt, Homo sapiens
gacaaugagcuccaggaaa

SEQ ID NO: 101082 - RNA, 19 nt, Homo sapiens
gagauguggauguugcuuu

SEQ ID NO: 101083 - RNA, 19 nt, Homo sapiens
ccggaggccucacuucuuc

SEQ ID NO: 101084 - RNA, 19 nt, Homo sapiens
caucauagacgagcucuuc

SEQ ID NO: 101085 - RNA, 19 nt, Homo sapiens
uccaggaaauguccaauca

SEQ ID NO: 101086 - RNA, 19 nt, Homo sapiens
agaccugcaugaaguucua

SEQ ID NO: 101087 - RNA, 19 nt, Homo sapiens
uaaaugagaccagggaauc

SEQ ID NO: 101088 - RNA, 19 nt, Homo sapiens
aaacagauaaagacucuca

SEQ ID NO: 101089 - RNA, 19 nt, Homo sapiens
gaagcucuuugacucugau

SEQ ID NO: 101090 - RNA, 19 nt, Homo sapiens
gagaaagcgcugcaggaau

SEQ ID NO: 101091 - RNA, 19 nt, Homo sapiens
gaauuggaggcaugaugaa

SEQ ID NO: 101092 - RNA, 19 nt, Homo sapiens
agacucugcugcuguuugu

SEQ ID NO: 101093 - RNA, 19 nt, Homo sapiens
gcccuuccuugagaugaua

SEQ ID NO: 101094 - RNA, 19 nt, Homo sapiens
gagcucgcccuucuacuuc

SEQ ID NO: 101095 - RNA, 19 nt, Homo sapiens
gcaaagacuccagaauugg

SEQ ID NO: 101096 - RNA, 19 nt, Homo sapiens
ucuggauccugcacucuaa

SEQ ID NO: 101097 - RNA, 19 nt, Homo sapiens
agaauuggaggcaugauga

SEQ ID NO: 101098 - RNA, 19 nt, Homo sapiens
gcaaggcgaagaccaguac

SEQ ID NO: 101099 - RNA, 19 nt, Homo sapiens
aaccagagcucgcccuucu

SEQ ID NO: 101100 - RNA, 19 nt, Homo sapiens
gccgccagcuugaggaguu

SEQ ID NO: 101101 - RNA, 19 nt, Homo sapiens
ugaaacagaccugcaugaa

SEQ ID NO: 101102 - RNA, 19 nt, Homo sapiens
aaacgaagagcgcaagaca

SEQ ID NO: 101103 - RNA, 19 nt, Homo sapiens
gacgaugaccggacugugu

SEQ ID NO: 101104 - RNA, 19 nt, Homo sapiens
ccaaucagggaaguaagua

SEQ ID NO: 101105 - RNA, 19 nt, Homo sapiens
gcucaugggaagaacagaa

SEQ ID NO: 101106 - RNA, 19 nt, Homo sapiens
gcuccugcaugcaacuaau

SEQ ID NO: 101107 - RNA, 19 nt, Homo sapiens
gaaggaccagugugacaag

SEQ ID NO: 101108 - RNA, 19 nt, Homo sapiens
cagauaaagacucucauag

SEQ ID NO: 101109 - RNA, 19 nt, Homo sapiens
uaaguacgucaauaaggaa

SEQ ID NO: 101110 - RNA, 19 nt, Homo sapiens
gcagcugaacgagcaguuu

SEQ ID NO: 101111 - RNA, 19 nt, Homo sapiens
uguaagcccugccugaaac

SEQ ID NO: 101112 - RNA, 19 nt, Homo sapiens
ugaagcucuuugacucuga

SEQ ID NO: 101113 - RNA, 19 nt, Homo sapiens
aaauacaacgagcugcuaa

SEQ ID NO: 101114 - RNA, 19 nt, Homo sapiens
gccaacagaauucauacga

SEQ ID NO: 101115 - RNA, 19 nt, Homo sapiens
gaccagggaaucagagaca

SEQ ID NO: 101116 - RNA, 19 nt, Homo sapiens
cuguagaagucuccaggaa

SEQ ID NO: 101117 - RNA, 19 nt, Homo sapiens
gaggcaugaugaagacucu

SEQ ID NO: 101118 - RNA, 19 nt, Homo sapiens
guguaagcccugccugaaa

SEQ ID NO: 101119 - RNA, 19 nt, Homo sapiens
uuccagcccuuccuugaga

SEQ ID NO: 101120 - RNA, 19 nt, Homo sapiens
ccagggaaucagagacaaa

SEQ ID NO: 101121 - RNA, 19 nt, Homo sapiens
aagccaagaagaagaaaga

SEQ ID NO: 101122 - RNA, 19 nt, Homo sapiens
caugggaagaacagaauug

SEQ ID NO: 101123 - RNA, 19 nt, Homo sapiens
ugaccgaggcgugcaaaga

SEQ ID NO: 101124 - RNA, 19 nt, Homo sapiens
ucccaggagugugcaauga

SEQ ID NO: 101125 - RNA, 19 nt, Homo sapiens
aagaagccaagaagaagaa

SEQ ID NO: 101126 - RNA, 19 nt, Homo sapiens
agagguugaccaggaaaua

SEQ ID NO: 101127 - RNA, 19 nt, Homo sapiens
cugagagguugaccaggaa

SEQ ID NO: 101128 - RNA, 19 nt, Homo sapiens
ggaggccucacuucuucuu

SEQ ID NO: 101129 - RNA, 19 nt, Homo sapiens
uaaaguccuaccaguggaa

SEQ ID NO: 101130 - RNA, 19 nt, Homo sapiens
gcacccgccaacagaauuc

SEQ ID NO: 101131 - RNA, 19 nt, Homo sapiens
aaagaggaugcccuaaaug

SEQ ID NO: 101132 - RNA, 19 nt, Homo sapiens
uggagaccguggcggagaa

SEQ ID NO: 101133 - RNA, 19 nt, Homo sapiens
cagaauuggaggcaugaug

SEQ ID NO: 101134 - RNA, 19 nt, Homo sapiens
gcagcuugaugcccuucuc

SEQ ID NO: 101135 - RNA, 19 nt, Homo sapiens
ugauggcccucugggaaga

SEQ ID NO: 101136 - RNA, 19 nt, Homo sapiens
agaagaagccaagaagaag

SEQ ID NO: 101137 - RNA, 19 nt, Homo sapiens
caagaagaagaaagaggau

SEQ ID NO: 101138 - RNA, 19 nt, Homo sapiens
ggaggagugagauguggau

SEQ ID NO: 101139 - RNA, 19 nt, Homo sapiens
ggagucaccuucaauguua

SEQ ID NO: 101140 - RNA, 19 nt, Homo sapiens
caacaagauugaggaauuu

SEQ ID NO: 101141 - RNA, 19 nt, Homo sapiens
ccaacaagauugaggaauu

SEQ ID NO: 101142 - RNA, 19 nt, Homo sapiens
ggcaaaggcccucaaauaa

SEQ ID NO: 101143 - RNA, 19 nt, Homo sapiens
ggacaacauauuucaguaa

SEQ ID NO: 101144 - RNA, 19 nt, Homo sapiens
caaaggcccuggugguuuc

SEQ ID NO: 101145 - RNA, 19 nt, Homo sapiens
uggcaaaggcccucaaaua

SEQ ID NO: 101146 - RNA, 19 nt, Homo sapiens
gcaaaggcccucaaauaag

SEQ ID NO: 101147 - RNA, 19 nt, Homo sapiens
gcaaguaggucugauugag

SEQ ID NO: 101148 - RNA, 19 nt, Homo sapiens
caaaggcccucaaauaagc

SEQ ID NO: 101149 - RNA, 19 nt, Homo sapiens
ugauugagcuuguguugug

SEQ ID NO: 101150 - RNA, 19 nt, Homo sapiens
agaucgagcucgccuauga

SEQ ID NO: 101151 - RNA, 19 nt, Homo sapiens
gagcuuguguugugcugaa

SEQ ID NO: 101152 - RNA, 19 nt, Homo sapiens
aaccauggcugaagaacaa

SEQ ID NO: 101153 - RNA, 19 nt, Homo sapiens
ggagagagucccugagugu

SEQ ID NO: 101154 - RNA, 19 nt, Homo sapiens
cagaagaaguggaugaaac

SEQ ID NO: 101155 - RNA, 19 nt, Homo sapiens
ugaguaggacaacauauuu

SEQ ID NO: 101156 - RNA, 19 nt, Homo sapiens
gggauggugugguggaaga

SEQ ID NO: 101157 - RNA, 19 nt, Homo sapiens
ugaaagcccugaagguuuu

SEQ ID NO: 101158 - RNA, 19 nt, Homo sapiens
ugaaaccagugcugaagau

SEQ ID NO: 101159 - RNA, 19 nt, Homo sapiens
gagaagggacuccugaaag

SEQ ID NO: 101160 - RNA, 19 nt, Homo sapiens
gcacacagacaccaacaag

SEQ ID NO: 101161 - RNA, 19 nt, Homo sapiens
ggaccgagacagugcagaa

SEQ ID NO: 101162 - RNA, 19 nt, Homo sapiens
caucgguacuugagcaaug

SEQ ID NO: 101163 - RNA, 19 nt, Homo sapiens
gugaguaggacaacauauu

SEQ ID NO: 101164 - RNA, 19 nt, Homo sapiens
ggagaucgagcucgccuau

SEQ ID NO: 101165 - RNA, 19 nt, Homo sapiens
gggagucaccuucaauguu

SEQ ID NO: 101166 - RNA, 19 nt, Homo sapiens
aaccagugcugaagaugaa

SEQ ID NO: 101167 - RNA, 19 nt, Homo sapiens
gggaugagggaaagaaaug

SEQ ID NO: 101168 - RNA, 19 nt, Homo sapiens
acacagacaccaacaagau

SEQ ID NO: 101169 - RNA, 19 nt, Homo sapiens
ccagagacuguucauggua

SEQ ID NO: 101170 - RNA, 19 nt, Homo sapiens
gggagugcaucgguacuug

SEQ ID NO: 101171 - RNA, 19 nt, Homo sapiens
ggaugaaaccagugcugaa

SEQ ID NO: 101172 - RNA, 19 nt, Homo sapiens
ucaaugacaaucuggagaa

SEQ ID NO: 101173 - RNA, 19 nt, Homo sapiens
gccaaaguuacacauagua

SEQ ID NO: 101174 - RNA, 19 nt, Homo sapiens
cugccuacaucaagaauuc

SEQ ID NO: 101175 - RNA, 19 nt, Homo sapiens
aggacaacauauuucagua

SEQ ID NO: 101176 - RNA, 19 nt, Homo sapiens
gaugaaggugucucucaga

SEQ ID NO: 101177 - RNA, 19 nt, Homo sapiens
cgugaaggcuggcagugau

SEQ ID NO: 101178 - RNA, 19 nt, Homo sapiens
cugaaagcccugaagguuu

SEQ ID NO: 101179 - RNA, 19 nt, Homo sapiens
agaagggacuccugaaagc

SEQ ID NO: 101180 - RNA, 19 nt, Homo sapiens
acaaaggcccuggugguuu

SEQ ID NO: 101181 - RNA, 19 nt, Homo sapiens
ccaccuguccagaugauga

SEQ ID NO: 101182 - RNA, 19 nt, Homo sapiens
ggagugcaucgguacuuga

SEQ ID NO: 101183 - RNA, 19 nt, Homo sapiens
aaaccagugcugaagauga

SEQ ID NO: 101184 - RNA, 19 nt, Homo sapiens
ccugaaagcccugaagguu

SEQ ID NO: 101185 - RNA, 19 nt, Homo sapiens
caaauuuucugccuacauc

SEQ ID NO: 101186 - RNA, 19 nt, Homo sapiens
ccuaugagcaaguggcaaa

SEQ ID NO: 101187 - RNA, 19 nt, Homo sapiens
aaccgcaggucgaauuguu

SEQ ID NO: 101188 - RNA, 19 nt, Homo sapiens
acgcaaccauggcugaaga

SEQ ID NO: 101189 - RNA, 19 nt, Homo sapiens
gaacaaccgcaggucgaau

SEQ ID NO: 101190 - RNA, 19 nt, Homo sapiens
gcuuccaccuguccagaug

SEQ ID NO: 101191 - RNA, 19 nt, Homo sapiens
gugcaaguaggucugauug

SEQ ID NO: 101192 - RNA, 19 nt, Homo sapiens
gaugaaaccagugcugaag

SEQ ID NO: 101193 - RNA, 19 nt, Homo sapiens
gaguaggacaacauauuuc

SEQ ID NO: 101194 - RNA, 19 nt, Homo sapiens
caaaguuacacauaguaca

SEQ ID NO: 101195 - RNA, 19 nt, Homo sapiens
caaacccagcacucaauga

SEQ ID NO: 101196 - RNA, 19 nt, Homo sapiens
agagagucccugaguguga

SEQ ID NO: 101197 - RNA, 19 nt, Homo sapiens
gaagaggggaugagggaaa

SEQ ID NO: 101198 - RNA, 19 nt, Homo sapiens
caggugguguguaagaagu

SEQ ID NO: 101199 - RNA, 19 nt, Homo sapiens
gaaaccagugcugaagaug

SEQ ID NO: 101200 - RNA, 19 nt, Homo sapiens
acccagcacucaaugacaa

SEQ ID NO: 101201 - RNA, 19 nt, Homo sapiens
uaccaccguugacaccaaa

SEQ ID NO: 101202 - RNA, 19 nt, Homo sapiens
cacagacaccaacaagauu

SEQ ID NO: 101203 - RNA, 19 nt, Homo sapiens
caagauugaggaauuucug

SEQ ID NO: 101204 - RNA, 19 nt, Homo sapiens
acagacaccaacaagauug

SEQ ID NO: 101205 - RNA, 19 nt, Homo sapiens
gggugaguaggacaacaua

SEQ ID NO: 101206 - RNA, 19 nt, Homo sapiens
cacaaaggcccuggugguu

SEQ ID NO: 101207 - RNA, 19 nt, Homo sapiens
ccagaagaaguggaugaaa

SEQ ID NO: 101208 - RNA, 19 nt, Homo sapiens
caaugacaaucuggagaag

SEQ ID NO: 101209 - RNA, 19 nt, Homo sapiens
ugccaaaguuacacauagu

SEQ ID NO: 101210 - RNA, 19 nt, Homo sapiens
caaccauggcugaagaaca

SEQ ID NO: 101211 - RNA, 19 nt, Homo sapiens
ggugcaaguaggucugauu

SEQ ID NO: 101212 - RNA, 19 nt, Homo sapiens
uugccaaaguuacacauag

SEQ ID NO: 101213 - RNA, 19 nt, Homo sapiens
uuaccaccguugacaccaa

SEQ ID NO: 101214 - RNA, 19 nt, Homo sapiens
uaggacaacauauuucagu

SEQ ID NO: 101215 - RNA, 19 nt, Homo sapiens
guugccaaaguuacacaua

SEQ ID NO: 101216 - RNA, 19 nt, Homo sapiens
ucaaacccagcacucaaug

SEQ ID NO: 101217 - RNA, 19 nt, Homo sapiens
caagaaauaucgugacuuu

SEQ ID NO: 101218 - RNA, 19 nt, Homo sapiens
caacauuacuugagucuuu

SEQ ID NO: 101219 - RNA, 19 nt, Homo sapiens
gaaacaaagucaacugaau

SEQ ID NO: 101220 - RNA, 19 nt, Homo sapiens
uaaauaaucuguccacugu

SEQ ID NO: 101221 - RNA, 19 nt, Homo sapiens
ggucagagaugagaaugua

SEQ ID NO: 101222 - RNA, 19 nt, Homo sapiens
uuacaggucuucauacuuu

SEQ ID NO: 101223 - RNA, 19 nt, Homo sapiens
uaaaguugcugccaagaaa

SEQ ID NO: 101224 - RNA, 19 nt, Homo sapiens
cagaaagccugaagaacua

SEQ ID NO: 101225 - RNA, 19 nt, Homo sapiens
cauauaagcuaaacagaug

SEQ ID NO: 101226 - RNA, 19 nt, Homo sapiens
gaagaagcacucauuaaau

SEQ ID NO: 101227 - RNA, 19 nt, Homo sapiens
ccacugcaauccugaauga

SEQ ID NO: 101228 - RNA, 19 nt, Homo sapiens
ucagagaggcaaauucuua

SEQ ID NO: 101229 - RNA, 19 nt, Homo sapiens
ugaagaagcacucauuaaa

SEQ ID NO: 101230 - RNA, 19 nt, Homo sapiens
gaaaaggaacucuguauuu

SEQ ID NO: 101231 - RNA, 19 nt, Homo sapiens
gaagagcucaagaucaauu

SEQ ID NO: 101232 - RNA, 19 nt, Homo sapiens
gcaccaacauuacuugagu

SEQ ID NO: 101233 - RNA, 19 nt, Homo sapiens
agaaauaucgugacuuuga

SEQ ID NO: 101234 - RNA, 19 nt, Homo sapiens
gagcugcacuuaagcaucu

SEQ ID NO: 101235 - RNA, 19 nt, Homo sapiens
gaaaagagucuacaaguau

SEQ ID NO: 101236 - RNA, 19 nt, Homo sapiens
aggaagagcucaagaucaa

SEQ ID NO: 101237 - RNA, 19 nt, Homo sapiens
gcgucuggaugacuacuua

SEQ ID NO: 101238 - RNA, 19 nt, Homo sapiens
uuacuugagucuuuggaua

SEQ ID NO: 101239 - RNA, 19 nt, Homo sapiens
uacccaagcugaacauuau

SEQ ID NO: 101240 - RNA, 19 nt, Homo sapiens
uaaccucuuugccaaguuu

SEQ ID NO: 101241 - RNA, 19 nt, Homo sapiens
gcaaauguggcuaaacaga

SEQ ID NO: 101242 - RNA, 19 nt, Homo sapiens
ucuuaaagcaccaacauua

SEQ ID NO: 101243 - RNA, 19 nt, Homo sapiens
gcacuuaagcaucuagaau

SEQ ID NO: 101244 - RNA, 19 nt, Homo sapiens
uggcuaaacagaagaguua

SEQ ID NO: 101245 - RNA, 19 nt, Homo sapiens
ucaagcgucuggaugacua

SEQ ID NO: 101246 - RNA, 19 nt, Homo sapiens
ccaaguacaaggagucuuu

SEQ ID NO: 101247 - RNA, 19 nt, Homo sapiens
gagaauguagccuuuguga

SEQ ID NO: 101248 - RNA, 19 nt, Homo sapiens
caagaucaauuggucauag

SEQ ID NO: 101249 - RNA, 19 nt, Homo sapiens
aauaaucuguccacuguau

SEQ ID NO: 101250 - RNA, 19 nt, Homo sapiens
ugaaauugauccagacagu

SEQ ID NO: 101251 - RNA, 19 nt, Homo sapiens
cugcauacauuaagaauac

SEQ ID NO: 101252 - RNA, 19 nt, Homo sapiens
gaagugauggagagaguau

SEQ ID NO: 101253 - RNA, 19 nt, Homo sapiens
caaauguggcuaaacagaa

SEQ ID NO: 101254 - RNA, 19 nt, Homo sapiens
gaaaauacuuacgcaaaug

SEQ ID NO: 101255 - RNA, 19 nt, Homo sapiens
gaaauaucgugacuuugac

SEQ ID NO: 101256 - RNA, 19 nt, Homo sapiens
gaccagaaagccugaagaa

SEQ ID NO: 101257 - RNA, 19 nt, Homo sapiens
aaaaucagcucuaggaaga

SEQ ID NO: 101258 - RNA, 19 nt, Homo sapiens
ugaaugacauggaaagcau

SEQ ID NO: 101259 - RNA, 19 nt, Homo sapiens
cuauccaacucucuuauga

SEQ ID NO: 101260 - RNA, 19 nt, Homo sapiens
ccagaaagccugaagaacu

SEQ ID NO: 101261 - RNA, 19 nt, Homo sapiens
gcaguaaagacaaagaugu

SEQ ID NO: 101262 - RNA, 19 nt, Homo sapiens
ggucauagaacagcauuug

SEQ ID NO: 101263 - RNA, 19 nt, Homo sapiens
agaaaagagucuacaagua

SEQ ID NO: 101264 - RNA, 19 nt, Homo sapiens
aaucucugcucaaagaauu

SEQ ID NO: 101265 - RNA, 19 nt, Homo sapiens
cugaagaacuaaaggacuu

SEQ ID NO: 101266 - RNA, 19 nt, Homo sapiens
uguaaaggcuggaagugau

SEQ ID NO: 101267 - RNA, 19 nt, Homo sapiens
ucaaguggacccugagauu

SEQ ID NO: 101268 - RNA, 19 nt, Homo sapiens
ucacccugcuccuuagaaa

SEQ ID NO: 101269 - RNA, 19 nt, Homo sapiens
gagaaaaggcuauauuugu

SEQ ID NO: 101270 - RNA, 19 nt, Homo sapiens
acgcaaauguggcuaaaca

SEQ ID NO: 101271 - RNA, 19 nt, Homo sapiens
gcagaauucucaggagucu

SEQ ID NO: 101272 - RNA, 19 nt, Homo sapiens
aaucucacccugcuccuua

SEQ ID NO: 101273 - RNA, 19 nt, Homo sapiens
ugucugcaguuauaaaugu

SEQ ID NO: 101274 - RNA, 19 nt, Homo sapiens
ggcguuaucuccacaaugc

SEQ ID NO: 101275 - RNA, 19 nt, Homo sapiens
gagagaguauuggaaacug

SEQ ID NO: 101276 - RNA, 19 nt, Homo sapiens
aaacaaagucaacugaauc

SEQ ID NO: 101277 - RNA, 19 nt, Homo sapiens
uaucgugacuuugacauuc

SEQ ID NO: 101278 - RNA, 19 nt, Homo sapiens
cagagaggcaaauucuuaa

SEQ ID NO: 101279 - RNA, 19 nt, Homo sapiens
agagugagcauaucagaga

SEQ ID NO: 101280 - RNA, 19 nt, Homo sapiens
auacagagagugagcauau

SEQ ID NO: 101281 - RNA, 19 nt, Homo sapiens
ucaggagucuggcguuauc

SEQ ID NO: 101282 - RNA, 19 nt, Homo sapiens
uucaagagcugcacuuaag

SEQ ID NO: 101283 - RNA, 19 nt, Homo sapiens
ucucaggagucuggcguua

SEQ ID NO: 101284 - RNA, 19 nt, Homo sapiens
caaguuuucugcauacauu

SEQ ID NO: 101285 - RNA, 19 nt, Homo sapiens
uaaucuguccacuguauuu

SEQ ID NO: 101286 - RNA, 19 nt, Homo sapiens
auccaacucucuuaugaaa

SEQ ID NO: 101287 - RNA, 19 nt, Homo sapiens
aaauguggcuaaacagaag

SEQ ID NO: 101288 - RNA, 19 nt, Homo sapiens
cuaugcccgugaagaauuu

SEQ ID NO: 101289 - RNA, 19 nt, Homo sapiens
uuacccaagcugaacauua

SEQ ID NO: 101290 - RNA, 19 nt, Homo sapiens
agaugagaauguagccuuu

SEQ ID NO: 101291 - RNA, 19 nt, Homo sapiens
uaaagcaccaacauuacuu

SEQ ID NO: 101292 - RNA, 19 nt, Homo sapiens
caaguggacccugagauug

SEQ ID NO: 101293 - RNA, 19 nt, Homo sapiens
aaguagagguacaaucuca

SEQ ID NO: 101294 - RNA, 19 nt, Homo sapiens
uggaaagcaucacaaucuu

SEQ ID NO: 101295 - RNA, 19 nt, Homo sapiens
gaaaaggcuauauuuguga

SEQ ID NO: 101296 - RNA, 19 nt, Homo sapiens
caaguauuguggacucuac

SEQ ID NO: 101297 - RNA, 19 nt, Homo sapiens
ccaagcugaacauuauuaa

SEQ ID NO: 101298 - RNA, 19 nt, Homo sapiens
gaaagccugaagaacuaaa

SEQ ID NO: 101299 - RNA, 19 nt, Homo sapiens
cuggaaugcauacauauaa

SEQ ID NO: 101300 - RNA, 19 nt, Homo sapiens
ggagaaaaggcuauauuug

SEQ ID NO: 101301 - RNA, 19 nt, Homo sapiens
cuccguuccugguguauaa

SEQ ID NO: 101302 - RNA, 19 nt, Homo sapiens
gagaggcaaauucuuaaag

SEQ ID NO: 101303 - RNA, 19 nt, Homo sapiens
gcauacauauaagcuaaac

SEQ ID NO: 101304 - RNA, 19 nt, Homo sapiens
cacuuaagcaucuagaauu

SEQ ID NO: 101305 - RNA, 19 nt, Homo sapiens
gccaagaaauaucgugacu

SEQ ID NO: 101306 - RNA, 19 nt, Homo sapiens
gaugucugcaguuauaaau

SEQ ID NO: 101307 - RNA, 19 nt, Homo sapiens
cccaagcugaacauuauua

SEQ ID NO: 101308 - RNA, 19 nt, Homo sapiens
aagaucaauuggucauaga

SEQ ID NO: 101309 - RNA, 19 nt, Homo sapiens
ccuggaaugcauacauaua

SEQ ID NO: 101310 - RNA, 19 nt, Homo sapiens
ggaacucuguauuuucuau

SEQ ID NO: 101311 - RNA, 19 nt, Homo sapiens
agaaaaggcuauauuugug

SEQ ID NO: 101312 - RNA, 19 nt, Homo sapiens
uaacacuggcugauuguag

SEQ ID NO: 101313 - RNA, 19 nt, Homo sapiens
caaggagucuuuugaugug

SEQ ID NO: 101314 - RNA, 19 nt, Homo sapiens
uucaugauccucuggcuua

SEQ ID NO: 101315 - RNA, 19 nt, Homo sapiens
cauuugacgccuagaacua

SEQ ID NO: 101316 - RNA, 19 nt, Homo sapiens
uaucagagaggcaaauucu

SEQ ID NO: 101317 - RNA, 19 nt, Homo sapiens
gaaagcaggucuauaaaug

SEQ ID NO: 101318 - RNA, 19 nt, Homo sapiens
gaacgcaccuuaauaaauc

SEQ ID NO: 101319 - RNA, 19 nt, Homo sapiens
guacauagcuaagguaaug

SEQ ID NO: 101320 - RNA, 19 nt, Homo sapiens
gcaaauacaaucacucuaa

SEQ ID NO: 101321 - RNA, 19 nt, Homo sapiens
guaaaccucugaaggaauu

SEQ ID NO: 101322 - RNA, 19 nt, Homo sapiens
gaugaacgcaccuuaauaa

SEQ ID NO: 101323 - RNA, 19 nt, Homo sapiens
ucagaaagauggcauauca

SEQ ID NO: 101324 - RNA, 19 nt, Homo sapiens
ggucacauuugcauuguuu

SEQ ID NO: 101325 - RNA, 19 nt, Homo sapiens
ccaggaaacguaaauauuu

SEQ ID NO: 101326 - RNA, 19 nt, Homo sapiens
gaacaugagcgucucuuug

SEQ ID NO: 101327 - RNA, 19 nt, Homo sapiens
ugaauacuaucuuggguuu

SEQ ID NO: 101328 - RNA, 19 nt, Homo sapiens
guacagaaaugacuacacu

SEQ ID NO: 101329 - RNA, 19 nt, Homo sapiens
uaacagauccuacucuuca

SEQ ID NO: 101330 - RNA, 19 nt, Homo sapiens
guacuuacgacuucauuaa

SEQ ID NO: 101331 - RNA, 19 nt, Homo sapiens
gaacaagcgcugcaaauac

SEQ ID NO: 101332 - RNA, 19 nt, Homo sapiens
gaacaucacaguacauugg

SEQ ID NO: 101333 - RNA, 19 nt, Homo sapiens
gaacuuacuguccugauug

SEQ ID NO: 101334 - RNA, 19 nt, Homo sapiens
ggaguaugauccagccaaa

SEQ ID NO: 101335 - RNA, 19 nt, Homo sapiens
uagagcaccugaaguuauu

SEQ ID NO: 101336 - RNA, 19 nt, Homo sapiens
cggcagauauguuucaaga

SEQ ID NO: 101337 - RNA, 19 nt, Homo sapiens
ugacuacacucaaggaugu

SEQ ID NO: 101338 - RNA, 19 nt, Homo sapiens
gcaggucuauaaaugagaa

SEQ ID NO: 101339 - RNA, 19 nt, Homo sapiens
ggaaagcaggucuauaaau

SEQ ID NO: 101340 - RNA, 19 nt, Homo sapiens
ugacaaggauugggauuau

SEQ ID NO: 101341 - RNA, 19 nt, Homo sapiens
guaaggagcauuuagcaau

SEQ ID NO: 101342 - RNA, 19 nt, Homo sapiens
caugaaagccgguaucaga

SEQ ID NO: 101343 - RNA, 19 nt, Homo sapiens
gacgcuacauugaugagua

SEQ ID NO: 101344 - RNA, 19 nt, Homo sapiens
guagacauguagcaguaaa

SEQ ID NO: 101345 - RNA, 19 nt, Homo sapiens
gguagaaguggaagaagua

SEQ ID NO: 101346 - RNA, 19 nt, Homo sapiens
uaggaugcauucuuauuga

SEQ ID NO: 101347 - RNA, 19 nt, Homo sapiens
uagcaagucuucugguaga

SEQ ID NO: 101348 - RNA, 19 nt, Homo sapiens
gaaggaagagaucacauag

SEQ ID NO: 101349 - RNA, 19 nt, Homo sapiens
ugaaggaauuuaugcuuuc

SEQ ID NO: 101350 - RNA, 19 nt, Homo sapiens
caacauaugaugacgaaca

SEQ ID NO: 101351 - RNA, 19 nt, Homo sapiens
gagaaagauuaucauaguc

SEQ ID NO: 101352 - RNA, 19 nt, Homo sapiens
gaauuuaugcuuucucaag

SEQ ID NO: 101353 - RNA, 19 nt, Homo sapiens
cugaaggaauuuaugcuuu

SEQ ID NO: 101354 - RNA, 19 nt, Homo sapiens
uaucuuggguuuaccguau

SEQ ID NO: 101355 - RNA, 19 nt, Homo sapiens
guacauugguaucuacaag

SEQ ID NO: 101356 - RNA, 19 nt, Homo sapiens
uauugggacuuaguacuua

SEQ ID NO: 101357 - RNA, 19 nt, Homo sapiens
gaaguggaagaaguaguua

SEQ ID NO: 101358 - RNA, 19 nt, Homo sapiens
gagcaucauggucacauuu

SEQ ID NO: 101359 - RNA, 19 nt, Homo sapiens
gaucauaaagcgggaggua

SEQ ID NO: 101360 - RNA, 19 nt, Homo sapiens
gaagagucaccgaaggaaa

SEQ ID NO: 101361 - RNA, 19 nt, Homo sapiens
ugauagccauuauuuggaa

SEQ ID NO: 101362 - RNA, 19 nt, Homo sapiens
uggagugcaucgaucauaa

SEQ ID NO: 101363 - RNA, 19 nt, Homo sapiens
guacuaagugcaagauaug

SEQ ID NO: 101364 - RNA, 19 nt, Homo sapiens
agaaaugacuacacucaag

SEQ ID NO: 101365 - RNA, 19 nt, Homo sapiens
uuggaaagcaggucuauaa

SEQ ID NO: 101366 - RNA, 19 nt, Homo sapiens
agaacaagcgcugcaaaua

SEQ ID NO: 101367 - RNA, 19 nt, Homo sapiens
agaaggaagagaucacaua

SEQ ID NO: 101368 - RNA, 19 nt, Homo sapiens
gcaaugauggaaaggauuc

SEQ ID NO: 101369 - RNA, 19 nt, Homo sapiens
ugacgaacaucacaguaca

SEQ ID NO: 101370 - RNA, 19 nt, Homo sapiens
cguacuaagugcaagauau

SEQ ID NO: 101371 - RNA, 19 nt, Homo sapiens
ccaaagagaccaugaaagc

SEQ ID NO: 101372 - RNA, 19 nt, Homo sapiens
gaaccuggacaucgccaaa

SEQ ID NO: 101373 - RNA, 19 nt, Homo sapiens
aggaagagaucacauagca

SEQ ID NO: 101374 - RNA, 19 nt, Homo sapiens
uagcuaagguaaugaacau

SEQ ID NO: 101375 - RNA, 19 nt, Homo sapiens
gagaacaagcgcugcaaau

SEQ ID NO: 101376 - RNA, 19 nt, Homo sapiens
gagcagcagcagucauaaa

SEQ ID NO: 101377 - RNA, 19 nt, Homo sapiens
ugaagcugcucgcucagaa

SEQ ID NO: 101378 - RNA, 19 nt, Homo sapiens
aacaagcgcugcaaauaca

SEQ ID NO: 101379 - RNA, 19 nt, Homo sapiens
ggauugggauuauggaaaa

SEQ ID NO: 101380 - RNA, 19 nt, Homo sapiens
gaaggaauuuaugcuuucu

SEQ ID NO: 101381 - RNA, 19 nt, Homo sapiens
aguaauaaguugacucaca

SEQ ID NO: 101382 - RNA, 19 nt, Homo sapiens
guggauagauacugugaag

SEQ ID NO: 101383 - RNA, 19 nt, Homo sapiens
ggagugcaucgaucauaaa

SEQ ID NO: 101384 - RNA, 19 nt, Homo sapiens
agaacuuacuguccugauu

SEQ ID NO: 101385 - RNA, 19 nt, Homo sapiens
cagagaagccuuaaagcau

SEQ ID NO: 101386 - RNA, 19 nt, Homo sapiens
caaaagaauuacucucaga

SEQ ID NO: 101387 - RNA, 19 nt, Homo sapiens
gaaagauggcauaucagau

SEQ ID NO: 101388 - RNA, 19 nt, Homo sapiens
ccaggaguguagaggauga

SEQ ID NO: 101389 - RNA, 19 nt, Homo sapiens
cuacauugaugaguacaga

SEQ ID NO: 101390 - RNA, 19 nt, Homo sapiens
cauagucgacgcuacauug

SEQ ID NO: 101391 - RNA, 19 nt, Homo sapiens
uuauagagcaccugaaguu

SEQ ID NO: 101392 - RNA, 19 nt, Homo sapiens
ugaacgcaccuuaauaaau

SEQ ID NO: 101393 - RNA, 19 nt, Homo sapiens
gaaaagaaccaggagugua

SEQ ID NO: 101394 - RNA, 19 nt, Homo sapiens
gauagccauuauuuggaaa

SEQ ID NO: 101395 - RNA, 19 nt, Homo sapiens
ggagaacaagcgcugcaaa

SEQ ID NO: 101396 - RNA, 19 nt, Homo sapiens
ucuuugaccucauucagaa

SEQ ID NO: 101397 - RNA, 19 nt, Homo sapiens
cauaggaugcauucuuauu

SEQ ID NO: 101398 - RNA, 19 nt, Homo sapiens
cacaguacauugguaucua

SEQ ID NO: 101399 - RNA, 19 nt, Homo sapiens
ugaugaacgcaccuuaaua

SEQ ID NO: 101400 - RNA, 19 nt, Homo sapiens
agaaagauggcauaucaga

SEQ ID NO: 101401 - RNA, 19 nt, Homo sapiens
uggaaugguuugagcauca

SEQ ID NO: 101402 - RNA, 19 nt, Homo sapiens
uguaacagauccuacucuu

SEQ ID NO: 101403 - RNA, 19 nt, Homo sapiens
uagcaaugauggaaaggau

SEQ ID NO: 101404 - RNA, 19 nt, Homo sapiens
uaugcaagucugugaauuu

SEQ ID NO: 101405 - RNA, 19 nt, Homo sapiens
gcagugcccaggagaacaa

SEQ ID NO: 101406 - RNA, 19 nt, Homo sapiens
ugugaugucuggagcauag

SEQ ID NO: 101407 - RNA, 19 nt, Homo sapiens
gacuggaucauaucagaaa

SEQ ID NO: 101408 - RNA, 19 nt, Homo sapiens
uuugaacuauugggacuua

SEQ ID NO: 101409 - RNA, 19 nt, Homo sapiens
uggaacaucugaauacaac

SEQ ID NO: 101410 - RNA, 19 nt, Homo sapiens
agguagacauguagcagua

SEQ ID NO: 101411 - RNA, 19 nt, Homo sapiens
gaguggagacguacuaagu

SEQ ID NO: 101412 - RNA, 19 nt, Homo sapiens
ccacaguacuucacaucgu

SEQ ID NO: 101413 - RNA, 19 nt, Homo sapiens
aguagcaagucuucuggua

SEQ ID NO: 101414 - RNA, 19 nt, Homo sapiens
cauuucgacuggaucauau

SEQ ID NO: 101415 - RNA, 19 nt, Homo sapiens
gaacaucugaauacaacag

SEQ ID NO: 101416 - RNA, 19 nt, Homo sapiens
aaauguggauagauacugu

SEQ ID NO: 101417 - RNA, 19 nt, Homo sapiens
ugaaagaacuuguaccuau

SEQ ID NO: 101418 - RNA, 19 nt, Homo sapiens
gaaagacccugacaacaag

SEQ ID NO: 101419 - RNA, 19 nt, Homo sapiens
guacagucuuugugaaaua

SEQ ID NO: 101420 - RNA, 19 nt, Homo sapiens
uuaagaauguggagaagua

SEQ ID NO: 101421 - RNA, 19 nt, Homo sapiens
gauaacaagcugacacaua

SEQ ID NO: 101422 - RNA, 19 nt, Homo sapiens
gaaagaacuuguaccuauc

SEQ ID NO: 101423 - RNA, 19 nt, Homo sapiens
ugaaaucguuagcaccuua

SEQ ID NO: 101424 - RNA, 19 nt, Homo sapiens
gugaauaugugaaauagug

SEQ ID NO: 101425 - RNA, 19 nt, Homo sapiens
ucaaguuccuccaugauaa

SEQ ID NO: 101426 - RNA, 19 nt, Homo sapiens
ggaagcagcucgacuugag

SEQ ID NO: 101427 - RNA, 19 nt, Homo sapiens
ccuccuggcucucuauaua

SEQ ID NO: 101428 - RNA, 19 nt, Homo sapiens
ccacauguguaucuccuuu

SEQ ID NO: 101429 - RNA, 19 nt, Homo sapiens
ggagaugccuacuaugaca

SEQ ID NO: 101430 - RNA, 19 nt, Homo sapiens
gaagguaccacuccucaga

SEQ ID NO: 101431 - RNA, 19 nt, Homo sapiens
ggaguuaccgugaacacua

SEQ ID NO: 101432 - RNA, 19 nt, Homo sapiens
gaacuuguaccuaucacuu

SEQ ID NO: 101433 - RNA, 19 nt, Homo sapiens
acuaugagcucaccuacaa

SEQ ID NO: 101434 - RNA, 19 nt, Homo sapiens
agaaagacccugacaacaa

SEQ ID NO: 101435 - RNA, 19 nt, Homo sapiens
agacaagaaagcagaaaua

SEQ ID NO: 101436 - RNA, 19 nt, Homo sapiens
caccagaagucauccuuga

SEQ ID NO: 101437 - RNA, 19 nt, Homo sapiens
caccuucgauuuccucaaa

SEQ ID NO: 101438 - RNA, 19 nt, Homo sapiens
gaucaacgugcuagagaaa

SEQ ID NO: 101439 - RNA, 19 nt, Homo sapiens
aaagcaugcuagaguauga

SEQ ID NO: 101440 - RNA, 19 nt, Homo sapiens
gcucuucgaucugauugaa

SEQ ID NO: 101441 - RNA, 19 nt, Homo sapiens
gagagcaucuagccaugau

SEQ ID NO: 101442 - RNA, 19 nt, Homo sapiens
gcuacagacgcaacgauua

SEQ ID NO: 101443 - RNA, 19 nt, Homo sapiens
gaaagacaagaaagcagaa

SEQ ID NO: 101444 - RNA, 19 nt, Homo sapiens
ccuacaaccuagagaagaa

SEQ ID NO: 101445 - RNA, 19 nt, Homo sapiens
gaguuaccgugaacacuau

SEQ ID NO: 101446 - RNA, 19 nt, Homo sapiens
auaacaagcugacacauac

SEQ ID NO: 101447 - RNA, 19 nt, Homo sapiens
caaggaagcagcucgacuu

SEQ ID NO: 101448 - RNA, 19 nt, Homo sapiens
agaagucgcuccuggucaa

SEQ ID NO: 101449 - RNA, 19 nt, Homo sapiens
guaaccagguggcaucuac

SEQ ID NO: 101450 - RNA, 19 nt, Homo sapiens
caccagcucuucgaucuga

SEQ ID NO: 101451 - RNA, 19 nt, Homo sapiens
gacaagaaagcagaaauau

SEQ ID NO: 101452 - RNA, 19 nt, Homo sapiens
gcugcaucaucuuugaaua

SEQ ID NO: 101453 - RNA, 19 nt, Homo sapiens
gugccaggcugucaaguuc

SEQ ID NO: 101454 - RNA, 19 nt, Homo sapiens
gagaucaacgugcuagaga

SEQ ID NO: 101455 - RNA, 19 nt, Homo sapiens
uugaaagcaugcuagagua

SEQ ID NO: 101456 - RNA, 19 nt, Homo sapiens
cagaagucauccuugaguu

SEQ ID NO: 101457 - RNA, 19 nt, Homo sapiens
gaccuucggccgaguugua

SEQ ID NO: 101458 - RNA, 19 nt, Homo sapiens
ccagacccaugacaacaga

SEQ ID NO: 101459 - RNA, 19 nt, Homo sapiens
gaguauaggcugcaucauc

SEQ ID NO: 101460 - RNA, 19 nt, Homo sapiens
aggcgcagccggacauuua

SEQ ID NO: 101461 - RNA, 19 nt, Homo sapiens
gaaagcaugcuagaguaug

SEQ ID NO: 101462 - RNA, 19 nt, Homo sapiens
ggccuuagcaccuucgauu

SEQ ID NO: 101463 - RNA, 19 nt, Homo sapiens
aagcauaagcgacgaagaa

SEQ ID NO: 101464 - RNA, 19 nt, Homo sapiens
cccugaagaucauuaagaa

SEQ ID NO: 101465 - RNA, 19 nt, Homo sapiens
gacacagacuaucggcauu

SEQ ID NO: 101466 - RNA, 19 nt, Homo sapiens
ggaauuuuguacagucuuu

SEQ ID NO: 101467 - RNA, 19 nt, Homo sapiens
gcaucuaccccauguuuua

SEQ ID NO: 101468 - RNA, 19 nt, Homo sapiens
gcaucaucuuugaauacua

SEQ ID NO: 101469 - RNA, 19 nt, Homo sapiens
gagaugagcgcagugugaa

SEQ ID NO: 101470 - RNA, 19 nt, Homo sapiens
ggauugggaugagaacaca

SEQ ID NO: 101471 - RNA, 19 nt, Homo sapiens
gucaaguuccuccaugaua

SEQ ID NO: 101472 - RNA, 19 nt, Homo sapiens
cgagaugagcgcaguguga

SEQ ID NO: 101473 - RNA, 19 nt, Homo sapiens
gagaaagacccugacaaca

SEQ ID NO: 101474 - RNA, 19 nt, Homo sapiens
cuacagacgcaacgauuau

SEQ ID NO: 101475 - RNA, 19 nt, Homo sapiens
gagaggacagcuaccaugu

SEQ ID NO: 101476 - RNA, 19 nt, Homo sapiens
ccucaagccugaaaauauu

SEQ ID NO: 101477 - RNA, 19 nt, Homo sapiens
acauguguaucuccuuuga

SEQ ID NO: 101478 - RNA, 19 nt, Homo sapiens
cggccgaguuguacaaugu

SEQ ID NO: 101479 - RNA, 19 nt, Homo sapiens
ugugauguguggaguauag

SEQ ID NO: 101480 - RNA, 19 nt, Homo sapiens
gaugagcgcagugugaaga

SEQ ID NO: 101481 - RNA, 19 nt, Homo sapiens
cauaagcgacgaagaaguc

SEQ ID NO: 101482 - RNA, 19 nt, Homo sapiens
aguauaggcugcaucaucu

SEQ ID NO: 101483 - RNA, 19 nt, Homo sapiens
guuugugaauucagacuau

SEQ ID NO: 101484 - RNA, 19 nt, Homo sapiens
ucucgaagcaguuaugaug

SEQ ID NO: 101485 - RNA, 19 nt, Homo sapiens
gaguugcccugaagaucau

SEQ ID NO: 101486 - RNA, 19 nt, Homo sapiens
cgaguugcccugaagauca

SEQ ID NO: 101487 - RNA, 19 nt, Homo sapiens
ccugugaauaugugaaaua

SEQ ID NO: 101488 - RNA, 19 nt, Homo sapiens
caagagaacgagccagagu

SEQ ID NO: 101489 - RNA, 19 nt, Homo sapiens
gaaaaucaaugagaaagac

SEQ ID NO: 101490 - RNA, 19 nt, Homo sapiens
gcccugaagaucauuaaga

SEQ ID NO: 101491 - RNA, 19 nt, Homo sapiens
caccauagcaccauugucu

SEQ ID NO: 101492 - RNA, 19 nt, Homo sapiens
cagacuaucggcauuccua

SEQ ID NO: 101493 - RNA, 19 nt, Homo sapiens
ucgaagcaguuaugaugau

SEQ ID NO: 101494 - RNA, 19 nt, Homo sapiens
cacaucagcugggcgcuau

SEQ ID NO: 101495 - RNA, 19 nt, Homo sapiens
gauaucagucggugacgau

SEQ ID NO: 101496 - RNA, 19 nt, Homo sapiens
ugagaaagacccugacaac

SEQ ID NO: 101497 - RNA, 19 nt, Homo sapiens
uaggcugcaucaucuuuga

SEQ ID NO: 101498 - RNA, 19 nt, Homo sapiens
gaagcagcucgacuugaga

SEQ ID NO: 101499 - RNA, 19 nt, Homo sapiens
acauuuagccgcucaucuu

SEQ ID NO: 101500 - RNA, 19 nt, Homo sapiens
ugaaagcaugcuagaguau

SEQ ID NO: 101501 - RNA, 19 nt, Homo sapiens
uaccauguccguucucgaa

SEQ ID NO: 101502 - RNA, 19 nt, Homo sapiens
ucgauuuccucaaagacaa

SEQ ID NO: 101503 - RNA, 19 nt, Homo sapiens
aaagaacuuguaccuauca

SEQ ID NO: 101504 - RNA, 19 nt, Homo sapiens
uauaggcugcaucaucuuu

SEQ ID NO: 101505 - RNA, 19 nt, Homo sapiens
ccagaagucauccuugagu

SEQ ID NO: 101506 - RNA, 19 nt, Homo sapiens
ccucaaagacaacaacuac

SEQ ID NO: 101507 - RNA, 19 nt, Homo sapiens
agaucaacgugcuagagaa

SEQ ID NO: 101508 - RNA, 19 nt, Homo sapiens
cgaguuguacaauguguug

SEQ ID NO: 101509 - RNA, 19 nt, Homo sapiens
aauaacgugcuucauuuga

SEQ ID NO: 101510 - RNA, 19 nt, Homo sapiens
gaauaucagcgggagaaca

SEQ ID NO: 101511 - RNA, 19 nt, Homo sapiens
cgaagcaguuaugaugauc

SEQ ID NO: 101512 - RNA, 19 nt, Homo sapiens
agucgcuccuggucaagua

SEQ ID NO: 101513 - RNA, 19 nt, Homo sapiens
gacaacagagagcaucuag

SEQ ID NO: 101514 - RNA, 19 nt, Homo sapiens
gugccaccuuugaccauga

SEQ ID NO: 101515 - RNA, 19 nt, Homo sapiens
uagagaagaagcgagauga

SEQ ID NO: 101516 - RNA, 19 nt, Homo sapiens
ugagcucaccuacaaccua

SEQ ID NO: 101517 - RNA, 19 nt, Homo sapiens
ugaaagaacuuguaccuau

SEQ ID NO: 101518 - RNA, 19 nt, Homo sapiens
gaaagacccugacaacaag

SEQ ID NO: 101519 - RNA, 19 nt, Homo sapiens
guacagucuuugugaaaua

SEQ ID NO: 101520 - RNA, 19 nt, Homo sapiens
uuaagaauguggagaagua

SEQ ID NO: 101521 - RNA, 19 nt, Homo sapiens
gauaacaagcugacacaua

SEQ ID NO: 101522 - RNA, 19 nt, Homo sapiens
gaaagaacuuguaccuauc

SEQ ID NO: 101523 - RNA, 19 nt, Homo sapiens
ugaaaucguuagcaccuua

SEQ ID NO: 101524 - RNA, 19 nt, Homo sapiens
gugaauaugugaaauagug

SEQ ID NO: 101525 - RNA, 19 nt, Homo sapiens
ucaaguuccuccaugauaa

SEQ ID NO: 101526 - RNA, 19 nt, Homo sapiens
ggaagcagcucgacuugag

SEQ ID NO: 101527 - RNA, 19 nt, Homo sapiens
ccuccuggcucucuauaua

SEQ ID NO: 101528 - RNA, 19 nt, Homo sapiens
ccacauguguaucuccuuu

SEQ ID NO: 101529 - RNA, 19 nt, Homo sapiens
ggagaugccuacuaugaca

SEQ ID NO: 101530 - RNA, 19 nt, Homo sapiens
gaagguaccacuccucaga

SEQ ID NO: 101531 - RNA, 19 nt, Homo sapiens
ggaguuaccgugaacacua

SEQ ID NO: 101532 - RNA, 19 nt, Homo sapiens
gaacuuguaccuaucacuu

SEQ ID NO: 101533 - RNA, 19 nt, Homo sapiens
acuaugagcucaccuacaa

SEQ ID NO: 101534 - RNA, 19 nt, Homo sapiens
agaaagacccugacaacaa

SEQ ID NO: 101535 - RNA, 19 nt, Homo sapiens
agacaagaaagcagaaaua

SEQ ID NO: 101536 - RNA, 19 nt, Homo sapiens
caccagaagucauccuuga

SEQ ID NO: 101537 - RNA, 19 nt, Homo sapiens
caccuucgauuuccucaaa

SEQ ID NO: 101538 - RNA, 19 nt, Homo sapiens
gaucaacgugcuagagaaa

SEQ ID NO: 101539 - RNA, 19 nt, Homo sapiens
aaagcaugcuagaguauga

SEQ ID NO: 101540 - RNA, 19 nt, Homo sapiens
gcucuucgaucugauugaa

SEQ ID NO: 101541 - RNA, 19 nt, Homo sapiens
gagagcaucuagccaugau

SEQ ID NO: 101542 - RNA, 19 nt, Homo sapiens
gcuacagacgcaacgauua

SEQ ID NO: 101543 - RNA, 19 nt, Homo sapiens
gaaagacaagaaagcagaa

SEQ ID NO: 101544 - RNA, 19 nt, Homo sapiens
ccuacaaccuagagaagaa

SEQ ID NO: 101545 - RNA, 19 nt, Homo sapiens
gaguuaccgugaacacuau

SEQ ID NO: 101546 - RNA, 19 nt, Homo sapiens
auaacaagcugacacauac

SEQ ID NO: 101547 - RNA, 19 nt, Homo sapiens
caaggaagcagcucgacuu

SEQ ID NO: 101548 - RNA, 19 nt, Homo sapiens
agaagucgcuccuggucaa

SEQ ID NO: 101549 - RNA, 19 nt, Homo sapiens
cuacaagagcgauaugaaa

SEQ ID NO: 101550 - RNA, 19 nt, Homo sapiens
guaaccagguggcaucuac

SEQ ID NO: 101551 - RNA, 19 nt, Homo sapiens
caccagcucuucgaucuga

SEQ ID NO: 101552 - RNA, 19 nt, Homo sapiens
gacaagaaagcagaaauau

SEQ ID NO: 101553 - RNA, 19 nt, Homo sapiens
gcugcaucaucuuugaaua

SEQ ID NO: 101554 - RNA, 19 nt, Homo sapiens
gugccaggcugucaaguuc

SEQ ID NO: 101555 - RNA, 19 nt, Homo sapiens
gagaucaacgugcuagaga

SEQ ID NO: 101556 - RNA, 19 nt, Homo sapiens
uugaaagcaugcuagagua

SEQ ID NO: 101557 - RNA, 19 nt, Homo sapiens
cagaagucauccuugaguu

SEQ ID NO: 101558 - RNA, 19 nt, Homo sapiens
gaccuucggccgaguugua

SEQ ID NO: 101559 - RNA, 19 nt, Homo sapiens
ccagacccaugacaacaga

SEQ ID NO: 101560 - RNA, 19 nt, Homo sapiens
gaguauaggcugcaucauc

SEQ ID NO: 101561 - RNA, 19 nt, Homo sapiens
aggcgcagccggacauuua

SEQ ID NO: 101562 - RNA, 19 nt, Homo sapiens
gaaagcaugcuagaguaug

SEQ ID NO: 101563 - RNA, 19 nt, Homo sapiens
ggccuuagcaccuucgauu

SEQ ID NO: 101564 - RNA, 19 nt, Homo sapiens
aagcauaagcgacgaagaa

SEQ ID NO: 101565 - RNA, 19 nt, Homo sapiens
cccugaagaucauuaagaa

SEQ ID NO: 101566 - RNA, 19 nt, Homo sapiens
gacacagacuaucggcauu

SEQ ID NO: 101567 - RNA, 19 nt, Homo sapiens
ggaauuuuguacagucuuu

SEQ ID NO: 101568 - RNA, 19 nt, Homo sapiens
gcaucuaccccauguuuua

SEQ ID NO: 101569 - RNA, 19 nt, Homo sapiens
gcaucaucuuugaauacua

SEQ ID NO: 101570 - RNA, 19 nt, Homo sapiens
gagaugagcgcagugugaa

SEQ ID NO: 101571 - RNA, 19 nt, Homo sapiens
ggauugggaugagaacaca

SEQ ID NO: 101572 - RNA, 19 nt, Homo sapiens
gucaaguuccuccaugaua

SEQ ID NO: 101573 - RNA, 19 nt, Homo sapiens
cgagaugagcgcaguguga

SEQ ID NO: 101574 - RNA, 19 nt, Homo sapiens
gagaaagacccugacaaca

SEQ ID NO: 101575 - RNA, 19 nt, Homo sapiens
cuacagacgcaacgauuau

SEQ ID NO: 101576 - RNA, 19 nt, Homo sapiens
gagaggacagcuaccaugu

SEQ ID NO: 101577 - RNA, 19 nt, Homo sapiens
ccucaagccugaaaauauu

SEQ ID NO: 101578 - RNA, 19 nt, Homo sapiens
acauguguaucuccuuuga

SEQ ID NO: 101579 - RNA, 19 nt, Homo sapiens
cggccgaguuguacaaugu

SEQ ID NO: 101580 - RNA, 19 nt, Homo sapiens
gcuacaagagcgauaugaa

SEQ ID NO: 101581 - RNA, 19 nt, Homo sapiens
ugugauguguggaguauag

SEQ ID NO: 101582 - RNA, 19 nt, Homo sapiens
gaugagcgcagugugaaga

SEQ ID NO: 101583 - RNA, 19 nt, Homo sapiens
cauaagcgacgaagaaguc

SEQ ID NO: 101584 - RNA, 19 nt, Homo sapiens
aguauaggcugcaucaucu

SEQ ID NO: 101585 - RNA, 19 nt, Homo sapiens
guuugugaauucagacuau

SEQ ID NO: 101586 - RNA, 19 nt, Homo sapiens
ucucgaagcaguuaugaug

SEQ ID NO: 101587 - RNA, 19 nt, Homo sapiens
gaguugcccugaagaucau

SEQ ID NO: 101588 - RNA, 19 nt, Homo sapiens
cgaguugcccugaagauca

SEQ ID NO: 101589 - RNA, 19 nt, Homo sapiens
ccugugaauaugugaaaua

SEQ ID NO: 101590 - RNA, 19 nt, Homo sapiens
caagagaacgagccagagu

SEQ ID NO: 101591 - RNA, 19 nt, Homo sapiens
gaaaaucaaugagaaagac

SEQ ID NO: 101592 - RNA, 19 nt, Homo sapiens
gcccugaagaucauuaaga

SEQ ID NO: 101593 - RNA, 19 nt, Homo sapiens
uacaagagcgauaugaaau

SEQ ID NO: 101594 - RNA, 19 nt, Homo sapiens
caccauagcaccauugucu

SEQ ID NO: 101595 - RNA, 19 nt, Homo sapiens
ucgaagcaguuaugaugau

SEQ ID NO: 101596 - RNA, 19 nt, Homo sapiens
cagacuaucggcauuccua

SEQ ID NO: 101597 - RNA, 19 nt, Homo sapiens
cacaucagcugggcgcuau

SEQ ID NO: 101598 - RNA, 19 nt, Homo sapiens
gauaucagucggugacgau

SEQ ID NO: 101599 - RNA, 19 nt, Homo sapiens
ugagaaagacccugacaac

SEQ ID NO: 101600 - RNA, 19 nt, Homo sapiens
uaggcugcaucaucuuuga

SEQ ID NO: 101601 - RNA, 19 nt, Homo sapiens
gaagcagcucgacuugaga

SEQ ID NO: 101602 - RNA, 19 nt, Homo sapiens
acauuuagccgcucaucuu

SEQ ID NO: 101603 - RNA, 19 nt, Homo sapiens
ugaaagcaugcuagaguau

SEQ ID NO: 101604 - RNA, 19 nt, Homo sapiens
ucgauuuccucaaagacaa

SEQ ID NO: 101605 - RNA, 19 nt, Homo sapiens
uaccauguccguucucgaa

SEQ ID NO: 101606 - RNA, 19 nt, Homo sapiens
aaagaacuuguaccuauca

SEQ ID NO: 101607 - RNA, 19 nt, Homo sapiens
uauaggcugcaucaucuuu

SEQ ID NO: 101608 - RNA, 19 nt, Homo sapiens
ccagaagucauccuugagu

SEQ ID NO: 101609 - RNA, 19 nt, Homo sapiens
ccucaaagacaacaacuac

SEQ ID NO: 101610 - RNA, 19 nt, Homo sapiens
agaucaacgugcuagagaa

SEQ ID NO: 101611 - RNA, 19 nt, Homo sapiens
cgaguuguacaauguguug

SEQ ID NO: 101612 - RNA, 19 nt, Homo sapiens
aauaacgugcuucauuuga

SEQ ID NO: 101613 - RNA, 19 nt, Homo sapiens
cgaagcaguuaugaugauc

SEQ ID NO: 101614 - RNA, 19 nt, Homo sapiens
agucgcuccuggucaagua

SEQ ID NO: 101615 - RNA, 19 nt, Homo sapiens
gacaacagagagcaucuag

SEQ ID NO: 101616 - RNA, 19 nt, Homo sapiens
gugccaccuuugaccauga

SEQ ID NO: 101617 - RNA, 19 nt, Homo sapiens
ccaggaagcagaaauauuu

SEQ ID NO: 101618 - RNA, 19 nt, Homo sapiens
agaauaacuuccagccuua

SEQ ID NO: 101619 - RNA, 19 nt, Homo sapiens
gacccaagcuauuuauaug

SEQ ID NO: 101620 - RNA, 19 nt, Homo sapiens
gcaagaacaccuuugaguu

SEQ ID NO: 101621 - RNA, 19 nt, Homo sapiens
ggacuacuauggaccuuca

SEQ ID NO: 101622 - RNA, 19 nt, Homo sapiens
gagcggagcccauccuuug

SEQ ID NO: 101623 - RNA, 19 nt, Homo sapiens
ugaggaggauguuagaauu

SEQ ID NO: 101624 - RNA, 19 nt, Homo sapiens
gagaaucagcugacccaua

SEQ ID NO: 101625 - RNA, 19 nt, Homo sapiens
ggaguguacuggaagaaau

SEQ ID NO: 101626 - RNA, 19 nt, Homo sapiens
uugaaacccucuacaauga

SEQ ID NO: 101627 - RNA, 19 nt, Homo sapiens
gaggagaagucagugaaga

SEQ ID NO: 101628 - RNA, 19 nt, Homo sapiens
ggccagagccacccaauga

SEQ ID NO: 101629 - RNA, 19 nt, Homo sapiens
guaccaggaagcagaaaua

SEQ ID NO: 101630 - RNA, 19 nt, Homo sapiens
gcaaggugguggagugcuu

SEQ ID NO: 101631 - RNA, 19 nt, Homo sapiens
ccagaaagcacagauuuga

SEQ ID NO: 101632 - RNA, 19 nt, Homo sapiens
ggaggauguuagaauuuga

SEQ ID NO: 101633 - RNA, 19 nt, Homo sapiens
agaaucagcugacccauac

SEQ ID NO: 101634 - RNA, 19 nt, Homo sapiens
gaggaggauguuagaauuu

SEQ ID NO: 101635 - RNA, 19 nt, Homo sapiens
ucaaggagaaggacaaaga

SEQ ID NO: 101636 - RNA, 19 nt, Homo sapiens
gaagaucucgguccagaag

SEQ ID NO: 101637 - RNA, 19 nt, Homo sapiens
agaguuacaugcuccaaga

SEQ ID NO: 101638 - RNA, 19 nt, Homo sapiens
gaccuggaguguacuggaa

SEQ ID NO: 101639 - RNA, 19 nt, Homo sapiens
gcugcauucucuuugagua

SEQ ID NO: 101640 - RNA, 19 nt, Homo sapiens
aaugaacagugcaauguga

SEQ ID NO: 101641 - RNA, 19 nt, Homo sapiens
gauuugacccaagcuauuu

SEQ ID NO: 101642 - RNA, 19 nt, Homo sapiens
guuugugaauucugaguuu

SEQ ID NO: 101643 - RNA, 19 nt, Homo sapiens
gaaaucaacgugcucaaaa

SEQ ID NO: 101644 - RNA, 19 nt, Homo sapiens
cccaagcuauuuauauguu

SEQ ID NO: 101645 - RNA, 19 nt, Homo sapiens
gccgguaugugaaggagaa

SEQ ID NO: 101646 - RNA, 19 nt, Homo sapiens
gagcaccacaccaccauug

SEQ ID NO: 101647 - RNA, 19 nt, Homo sapiens
cgccugaggugauccuuga

SEQ ID NO: 101648 - RNA, 19 nt, Homo sapiens
caacuuccacggucacaug

SEQ ID NO: 101649 - RNA, 19 nt, Homo sapiens
ccaaugaacagugcaaugu

SEQ ID NO: 101650 - RNA, 19 nt, Homo sapiens
gcagcuguuugaccugaug

SEQ ID NO: 101651 - RNA, 19 nt, Homo sapiens
gaacugcaaaccucugaag

SEQ ID NO: 101652 - RNA, 19 nt, Homo sapiens
uaccugagcuaccgaugga

SEQ ID NO: 101653 - RNA, 19 nt, Homo sapiens
gaaauggugcaguccagau

SEQ ID NO: 101654 - RNA, 19 nt, Homo sapiens
ccagaugcaucacuguaag

SEQ ID NO: 101655 - RNA, 19 nt, Homo sapiens
caaggagaaggacaaagaa

SEQ ID NO: 101656 - RNA, 19 nt, Homo sapiens
ugacccaagcuauuuauau

SEQ ID NO: 101657 - RNA, 19 nt, Homo sapiens
gcauucucuuugaguacua

SEQ ID NO: 101658 - RNA, 19 nt, Homo sapiens
gagaacugcaaaccucuga

SEQ ID NO: 101659 - RNA, 19 nt, Homo sapiens
caagagcugugaggagaag

SEQ ID NO: 101660 - RNA, 19 nt, Homo sapiens
gcugacccauacagacuug

SEQ ID NO: 101661 - RNA, 19 nt, Homo sapiens
ugugacgucuggagcauug

SEQ ID NO: 101662 - RNA, 19 nt, Homo sapiens
ggacaaagaaaacaaguuc

SEQ ID NO: 101663 - RNA, 19 nt, Homo sapiens
gggaugagaacagcucuga

SEQ ID NO: 101664 - RNA, 19 nt, Homo sapiens
ucacaugugcaucgccuuu

SEQ ID NO: 101665 - RNA, 19 nt, Homo sapiens
ggcaagaacaccuuugagu

SEQ ID NO: 101666 - RNA, 19 nt, Homo sapiens
gugcccagcugccagaaag

SEQ ID NO: 101667 - RNA, 19 nt, Homo sapiens
aggaggauguuagaauuug

SEQ ID NO: 101668 - RNA, 19 nt, Homo sapiens
gaagggagacugcgauacc

SEQ ID NO: 101669 - RNA, 19 nt, Homo sapiens
acaugugcaucgccuuuga

SEQ ID NO: 101670 - RNA, 19 nt, Homo sapiens
gccgugacagcgauacaua

SEQ ID NO: 101671 - RNA, 19 nt, Homo sapiens
guuccugugugucuugaug

SEQ ID NO: 101672 - RNA, 19 nt, Homo sapiens
gugccacauuugaccauga

SEQ ID NO: 101673 - RNA, 19 nt, Homo sapiens
agaaaucaacgugcucaaa

SEQ ID NO: 101674 - RNA, 19 nt, Homo sapiens
gccagaaagcacagauuug

SEQ ID NO: 101675 - RNA, 19 nt, Homo sapiens
cuugaaaccugagaacauc

SEQ ID NO: 101676 - RNA, 19 nt, Homo sapiens
cauccgaguggcugacuuu

SEQ ID NO: 101677 - RNA, 19 nt, Homo sapiens
cuauggaccuucacguucu

SEQ ID NO: 101678 - RNA, 19 nt, Homo sapiens
ugccagaaagcacagauuu

SEQ ID NO: 101679 - RNA, 19 nt, Homo sapiens
gcccaucccaucacacaug

SEQ ID NO: 101680 - RNA, 19 nt, Homo sapiens
uuugaaacccucuacaaug

SEQ ID NO: 101681 - RNA, 19 nt, Homo sapiens
cugccacgcccuuagauuu

SEQ ID NO: 101682 - RNA, 19 nt, Homo sapiens
gaccugaugaggaggaugu

SEQ ID NO: 101683 - RNA, 19 nt, Homo sapiens
gugaggagaagucagugaa

SEQ ID NO: 101684 - RNA, 19 nt, Homo sapiens
gaaggagaacugcaaaccu

SEQ ID NO: 101685 - RNA, 19 nt, Homo sapiens
gaugauggagaagauccua

SEQ ID NO: 101686 - RNA, 19 nt, Homo sapiens
gaguguacuggaagaaaug

SEQ ID NO: 101687 - RNA, 19 nt, Homo sapiens
gcccaccacugccacaaac

SEQ ID NO: 101688 - RNA, 19 nt, Homo sapiens
acagugcaaugugaaggaa

SEQ ID NO: 101689 - RNA, 19 nt, Homo sapiens
caaugaacagugcaaugug

SEQ ID NO: 101690 - RNA, 19 nt, Homo sapiens
guccagaugcaucacugua

SEQ ID NO: 101691 - RNA, 19 nt, Homo sapiens
gagaagucagugaagaaca

SEQ ID NO: 101692 - RNA, 19 nt, Homo sapiens
ugugaauucugaguuugaa

SEQ ID NO: 101693 - RNA, 19 nt, Homo sapiens
gcucugccacgcccuuaga

SEQ ID NO: 101694 - RNA, 19 nt, Homo sapiens
cagauuugacccaagcuau

SEQ ID NO: 101695 - RNA, 19 nt, Homo sapiens
gagcacgugcagcuguuug

SEQ ID NO: 101696 - RNA, 19 nt, Homo sapiens
auacauaccggugugaaga

SEQ ID NO: 101697 - RNA, 19 nt, Homo sapiens
aaaacaaguuccugugugu

SEQ ID NO: 101698 - RNA, 19 nt, Homo sapiens
aaguguuucuuacuguuug

SEQ ID NO: 101699 - RNA, 19 nt, Homo sapiens
cccaucccaucacacauga

SEQ ID NO: 101700 - RNA, 19 nt, Homo sapiens
agcauuggcugcauucucu

SEQ ID NO: 101701 - RNA, 19 nt, Homo sapiens
gagcauuggcugcauucuc

SEQ ID NO: 101702 - RNA, 19 nt, Homo sapiens
ggagaagucagugaagaac

SEQ ID NO: 101703 - RNA, 19 nt, Homo sapiens
gcugugaggagaagucagu

SEQ ID NO: 101704 - RNA, 19 nt, Homo sapiens
agauuugacccaagcuauu

SEQ ID NO: 101705 - RNA, 19 nt, Homo sapiens
agaagucagugaagaacac

SEQ ID NO: 101706 - RNA, 19 nt, Homo sapiens
gacccauacagacuugaaa

SEQ ID NO: 101707 - RNA, 19 nt, Homo sapiens
ccgcaacccaagcagauga

SEQ ID NO: 101708 - RNA, 19 nt, Homo sapiens
gaagaguuacaugcuccaa

SEQ ID NO: 101709 - RNA, 19 nt, Homo sapiens
gauacauaccggugugaag

SEQ ID NO: 101710 - RNA, 19 nt, Homo sapiens
gcggagcccauccuuugga

SEQ ID NO: 101711 - RNA, 19 nt, Homo sapiens
gccagagccacccaaugaa

SEQ ID NO: 101712 - RNA, 19 nt, Homo sapiens
gaugaggaggauguuagaa

SEQ ID NO: 101713 - RNA, 19 nt, Homo sapiens
gcauccgaguggcugacuu

SEQ ID NO: 101714 - RNA, 19 nt, Homo sapiens
ccaggaagcagaaauauuu

SEQ ID NO: 101715 - RNA, 19 nt, Homo sapiens
agaauaacuuccagccuua

SEQ ID NO: 101716 - RNA, 19 nt, Homo sapiens
gacccaagcuauuuauaug

SEQ ID NO: 101717 - RNA, 19 nt, Homo sapiens
gcaagaacaccuuugaguu

SEQ ID NO: 101718 - RNA, 19 nt, Homo sapiens
ggacuacuauggaccuuca

SEQ ID NO: 101719 - RNA, 19 nt, Homo sapiens
gagcggagcccauccuuug

SEQ ID NO: 101720 - RNA, 19 nt, Homo sapiens
ugaggaggauguuagaauu

SEQ ID NO: 101721 - RNA, 19 nt, Homo sapiens
gagaaucagcugacccaua

SEQ ID NO: 101722 - RNA, 19 nt, Homo sapiens
ggaguguacuggaagaaau

SEQ ID NO: 101723 - RNA, 19 nt, Homo sapiens
uugaaacccucuacaauga

SEQ ID NO: 101724 - RNA, 19 nt, Homo sapiens
caagagcgauaugagauug

SEQ ID NO: 101725 - RNA, 19 nt, Homo sapiens
gaggagaagucagugaaga

SEQ ID NO: 101726 - RNA, 19 nt, Homo sapiens
ggccagagccacccaauga

SEQ ID NO: 101727 - RNA, 19 nt, Homo sapiens
guaccaggaagcagaaaua

SEQ ID NO: 101728 - RNA, 19 nt, Homo sapiens
gcaaggugguggagugcuu

SEQ ID NO: 101729 - RNA, 19 nt, Homo sapiens
ccagaaagcacagauuuga

SEQ ID NO: 101730 - RNA, 19 nt, Homo sapiens
ggaggauguuagaauuuga

SEQ ID NO: 101731 - RNA, 19 nt, Homo sapiens
agaaucagcugacccauac

SEQ ID NO: 101732 - RNA, 19 nt, Homo sapiens
gaggaggauguuagaauuu

SEQ ID NO: 101733 - RNA, 19 nt, Homo sapiens
ucaaggagaaggacaaaga

SEQ ID NO: 101734 - RNA, 19 nt, Homo sapiens
gaagaucucgguccagaag

SEQ ID NO: 101735 - RNA, 19 nt, Homo sapiens
agaguuacaugcuccaaga

SEQ ID NO: 101736 - RNA, 19 nt, Homo sapiens
gaccuggaguguacuggaa

SEQ ID NO: 101737 - RNA, 19 nt, Homo sapiens
gcugcauucucuuugagua

SEQ ID NO: 101738 - RNA, 19 nt, Homo sapiens
aaugaacagugcaauguga

SEQ ID NO: 101739 - RNA, 19 nt, Homo sapiens
gauuugacccaagcuauuu

SEQ ID NO: 101740 - RNA, 19 nt, Homo sapiens
guuugugaauucugaguuu

SEQ ID NO: 101741 - RNA, 19 nt, Homo sapiens
gaaaucaacgugcucaaaa

SEQ ID NO: 101742 - RNA, 19 nt, Homo sapiens
cccaagcuauuuauauguu

SEQ ID NO: 101743 - RNA, 19 nt, Homo sapiens
gaagccaacagagcaguaa

SEQ ID NO: 101744 - RNA, 19 nt, Homo sapiens
gccgguaugugaaggagaa

SEQ ID NO: 101745 - RNA, 19 nt, Homo sapiens
gagcaccacaccaccauug

SEQ ID NO: 101746 - RNA, 19 nt, Homo sapiens
cgccugaggugauccuuga

SEQ ID NO: 101747 - RNA, 19 nt, Homo sapiens
caacuuccacggucacaug

SEQ ID NO: 101748 - RNA, 19 nt, Homo sapiens
ccaaugaacagugcaaugu

SEQ ID NO: 101749 - RNA, 19 nt, Homo sapiens
gcagcuguuugaccugaug

SEQ ID NO: 101750 - RNA, 19 nt, Homo sapiens
gaacugcaaaccucugaag

SEQ ID NO: 101751 - RNA, 19 nt, Homo sapiens
uaccugagcuaccgaugga

SEQ ID NO: 101752 - RNA, 19 nt, Homo sapiens
gaaauggugcaguccagau

SEQ ID NO: 101753 - RNA, 19 nt, Homo sapiens
caaggagaaggacaaagaa

SEQ ID NO: 101754 - RNA, 19 nt, Homo sapiens
ccagaugcaucacuguaag

SEQ ID NO: 101755 - RNA, 19 nt, Homo sapiens
ugacccaagcuauuuauau

SEQ ID NO: 101756 - RNA, 19 nt, Homo sapiens
gcauucucuuugaguacua

SEQ ID NO: 101757 - RNA, 19 nt, Homo sapiens
gagaacugcaaaccucuga

SEQ ID NO: 101758 - RNA, 19 nt, Homo sapiens
caagagcugugaggagaag

SEQ ID NO: 101759 - RNA, 19 nt, Homo sapiens
gcugacccauacagacuug

SEQ ID NO: 101760 - RNA, 19 nt, Homo sapiens
ccaagagcgauaugagauu

SEQ ID NO: 101761 - RNA, 19 nt, Homo sapiens
gccggaguguggaagauga

SEQ ID NO: 101762 - RNA, 19 nt, Homo sapiens
ugugacgucuggagcauug

SEQ ID NO: 101763 - RNA, 19 nt, Homo sapiens
ggacaaagaaaacaaguuc

SEQ ID NO: 101764 - RNA, 19 nt, Homo sapiens
gggaugagaacagcucuga

SEQ ID NO: 101765 - RNA, 19 nt, Homo sapiens
ucacaugugcaucgccuuu

SEQ ID NO: 101766 - RNA, 19 nt, Homo sapiens
ggcaagaacaccuuugagu

SEQ ID NO: 101767 - RNA, 19 nt, Homo sapiens
gugcccagcugccagaaag

SEQ ID NO: 101768 - RNA, 19 nt, Homo sapiens
aggaggauguuagaauuug

SEQ ID NO: 101769 - RNA, 19 nt, Homo sapiens
gaagggagacugcgauacc

SEQ ID NO: 101770 - RNA, 19 nt, Homo sapiens
acaugugcaucgccuuuga

SEQ ID NO: 101771 - RNA, 19 nt, Homo sapiens
guuccugugugucuugaug

SEQ ID NO: 101772 - RNA, 19 nt, Homo sapiens
gccgugacagcgauacaua

SEQ ID NO: 101773 - RNA, 19 nt, Homo sapiens
gugccacauuugaccauga

SEQ ID NO: 101774 - RNA, 19 nt, Homo sapiens
agaaaucaacgugcucaaa

SEQ ID NO: 101775 - RNA, 19 nt, Homo sapiens
gccagaaagcacagauuug

SEQ ID NO: 101776 - RNA, 19 nt, Homo sapiens
cuugaaaccugagaacauc

SEQ ID NO: 101777 - RNA, 19 nt, Homo sapiens
cauccgaguggcugacuuu

SEQ ID NO: 101778 - RNA, 19 nt, Homo sapiens
cuauggaccuucacguucu

SEQ ID NO: 101779 - RNA, 19 nt, Homo sapiens
ugccagaaagcacagauuu

SEQ ID NO: 101780 - RNA, 19 nt, Homo sapiens
gcccaucccaucacacaug

SEQ ID NO: 101781 - RNA, 19 nt, Homo sapiens
uuugaaacccucuacaaug

SEQ ID NO: 101782 - RNA, 19 nt, Homo sapiens
cugccacgcccuuagauuu

SEQ ID NO: 101783 - RNA, 19 nt, Homo sapiens
gaccugaugaggaggaugu

SEQ ID NO: 101784 - RNA, 19 nt, Homo sapiens
gugaggagaagucagugaa

SEQ ID NO: 101785 - RNA, 19 nt, Homo sapiens
gaaggagaacugcaaaccu

SEQ ID NO: 101786 - RNA, 19 nt, Homo sapiens
gaugauggagaagauccua

SEQ ID NO: 101787 - RNA, 19 nt, Homo sapiens
gaguguacuggaagaaaug

SEQ ID NO: 101788 - RNA, 19 nt, Homo sapiens
gcccaccacugccacaaac

SEQ ID NO: 101789 - RNA, 19 nt, Homo sapiens
acagugcaaugugaaggaa

SEQ ID NO: 101790 - RNA, 19 nt, Homo sapiens
caaugaacagugcaaugug

SEQ ID NO: 101791 - RNA, 19 nt, Homo sapiens
guccagaugcaucacugua

SEQ ID NO: 101792 - RNA, 19 nt, Homo sapiens
gagaagucagugaagaaca

SEQ ID NO: 101793 - RNA, 19 nt, Homo sapiens
ugugaauucugaguuugaa

SEQ ID NO: 101794 - RNA, 19 nt, Homo sapiens
gcucugccacgcccuuaga

SEQ ID NO: 101795 - RNA, 19 nt, Homo sapiens
cagauuugacccaagcuau

SEQ ID NO: 101796 - RNA, 19 nt, Homo sapiens
auacauaccggugugaaga

SEQ ID NO: 101797 - RNA, 19 nt, Homo sapiens
gagcacgugcagcuguuug

SEQ ID NO: 101798 - RNA, 19 nt, Homo sapiens
aaaacaaguuccugugugu

SEQ ID NO: 101799 - RNA, 19 nt, Homo sapiens
aaguguuucuuacuguuug

SEQ ID NO: 101800 - RNA, 19 nt, Homo sapiens
cccaucccaucacacauga

SEQ ID NO: 101801 - RNA, 19 nt, Homo sapiens
agcauuggcugcauucucu

SEQ ID NO: 101802 - RNA, 19 nt, Homo sapiens
gagcauuggcugcauucuc

SEQ ID NO: 101803 - RNA, 19 nt, Homo sapiens
ggagaagucagugaagaac

SEQ ID NO: 101804 - RNA, 19 nt, Homo sapiens
gcugugaggagaagucagu

SEQ ID NO: 101805 - RNA, 19 nt, Homo sapiens
agauuugacccaagcuauu

SEQ ID NO: 101806 - RNA, 19 nt, Homo sapiens
agaagucagugaagaacac

SEQ ID NO: 101807 - RNA, 19 nt, Homo sapiens
gacccauacagacuugaaa

SEQ ID NO: 101808 - RNA, 19 nt, Homo sapiens
ccgcaacccaagcagauga

SEQ ID NO: 101809 - RNA, 19 nt, Homo sapiens
gaagaguuacaugcuccaa

SEQ ID NO: 101810 - RNA, 19 nt, Homo sapiens
gauacauaccggugugaag

SEQ ID NO: 101811 - RNA, 19 nt, Homo sapiens
gcggagcccauccuuugga

SEQ ID NO: 101812 - RNA, 19 nt, Homo sapiens
gccagagccacccaaugaa

SEQ ID NO: 101813 - RNA, 19 nt, Homo sapiens
gaugaggaggauguuagaa

SEQ ID NO: 101814 - RNA, 19 nt, Homo sapiens
ggaauaaaguggaauaaug

SEQ ID NO: 101815 - RNA, 19 nt, Homo sapiens
ccacaaguccuuccaauua

SEQ ID NO: 101816 - RNA, 19 nt, Homo sapiens
ucacaaaccuuccuugcua

SEQ ID NO: 101817 - RNA, 19 nt, Homo sapiens
ggaaguagguggcagaugu

SEQ ID NO: 101818 - RNA, 19 nt, Homo sapiens
caagucaucuuccagagua

SEQ ID NO: 101819 - RNA, 19 nt, Homo sapiens
gcugaacccucaacuauug

SEQ ID NO: 101820 - RNA, 19 nt, Homo sapiens
gcaggacucuuugauguaa

SEQ ID NO: 101821 - RNA, 19 nt, Homo sapiens
gaaaauaccugacccuaga

SEQ ID NO: 101822 - RNA, 19 nt, Homo sapiens
gaaauggccaguuuacuug

SEQ ID NO: 101823 - RNA, 19 nt, Homo sapiens
gaacuuauccacuuauauc

SEQ ID NO: 101824 - RNA, 19 nt, Homo sapiens
guauugaaauggccaguuu

SEQ ID NO: 101825 - RNA, 19 nt, Homo sapiens
ugauacaacugccagguua

SEQ ID NO: 101826 - RNA, 19 nt, Homo sapiens
gcucaggaguuggcaaaua

SEQ ID NO: 101827 - RNA, 19 nt, Homo sapiens
gcaguucagucccuuauuc

SEQ ID NO: 101828 - RNA, 19 nt, Homo sapiens
gcuguuuccucgucuguua

SEQ ID NO: 101829 - RNA, 19 nt, Homo sapiens
ccaaaggguuguauacaga

SEQ ID NO: 101830 - RNA, 19 nt, Homo sapiens
gggcugaguuucaucacua

SEQ ID NO: 101831 - RNA, 19 nt, Homo sapiens
gggcaggacucuuugaugu

SEQ ID NO: 101832 - RNA, 19 nt, Homo sapiens
ccaauuauauuucccaagu

SEQ ID NO: 101833 - RNA, 19 nt, Homo sapiens
gcaaggagaccucuacugu

SEQ ID NO: 101834 - RNA, 19 nt, Homo sapiens
ugacugcacaucuuaaaua

SEQ ID NO: 101835 - RNA, 19 nt, Homo sapiens
ucaauaagaugcuguaacu

SEQ ID NO: 101836 - RNA, 19 nt, Homo sapiens
gaagugccauucugugauc

SEQ ID NO: 101837 - RNA, 19 nt, Homo sapiens
gaucccagcucuccucaau

SEQ ID NO: 101838 - RNA, 19 nt, Homo sapiens
ccaaggaacucucacucuu

SEQ ID NO: 101839 - RNA, 19 nt, Homo sapiens
ugccuuagauuccucaaua

SEQ ID NO: 101840 - RNA, 19 nt, Homo sapiens
uaacuucucugacuacucu

SEQ ID NO: 101841 - RNA, 19 nt, Homo sapiens
cuucaaggauuacuggaua

SEQ ID NO: 101842 - RNA, 19 nt, Homo sapiens
agaaaccugugucaucuuu

SEQ ID NO: 101843 - RNA, 19 nt, Homo sapiens
gaacaaaucacugacaucu

SEQ ID NO: 101844 - RNA, 19 nt, Homo sapiens
acaaguccuuccaauuaua

SEQ ID NO: 101845 - RNA, 19 nt, Homo sapiens
cuucauugcuccauuugua

SEQ ID NO: 101846 - RNA, 19 nt, Homo sapiens
ggugguggcuucagcaaug

SEQ ID NO: 101847 - RNA, 19 nt, Homo sapiens
ggaaacccauguuguaagg

SEQ ID NO: 101848 - RNA, 19 nt, Homo sapiens
cuagaaucguguccuauuu

SEQ ID NO: 101849 - RNA, 19 nt, Homo sapiens
acaaaucacugacaucuac

SEQ ID NO: 101850 - RNA, 19 nt, Homo sapiens
gaccuucauugcuccauuu

SEQ ID NO: 101851 - RNA, 19 nt, Homo sapiens
ggucuuaacuucucugacu

SEQ ID NO: 101852 - RNA, 19 nt, Homo sapiens
acacaggacuuucugacuu

SEQ ID NO: 101853 - RNA, 19 nt, Homo sapiens
gugccuaccucuagcauug

SEQ ID NO: 101854 - RNA, 19 nt, Homo sapiens
gguaaaugaugcuaugcuu

SEQ ID NO: 101855 - RNA, 19 nt, Homo sapiens
ccucuucgguggcaacuuu

SEQ ID NO: 101856 - RNA, 19 nt, Homo sapiens
guucugauauggacuagga

SEQ ID NO: 101857 - RNA, 19 nt, Homo sapiens
gcauacuucucaaucuuug

SEQ ID NO: 101858 - RNA, 19 nt, Homo sapiens
agaaucguguccuauuuaa

SEQ ID NO: 101859 - RNA, 19 nt, Homo sapiens
ucuagaacuuauccacuua

SEQ ID NO: 101860 - RNA, 19 nt, Homo sapiens
ccucuacugucaccguuua

SEQ ID NO: 101861 - RNA, 19 nt, Homo sapiens
ggucaacacugagcucaug

SEQ ID NO: 101862 - RNA, 19 nt, Homo sapiens
ugaaauggccaguuuacuu

SEQ ID NO: 101863 - RNA, 19 nt, Homo sapiens
gaaucuugguucugauaug

SEQ ID NO: 101864 - RNA, 19 nt, Homo sapiens
cuuccucucucaucaauuu

SEQ ID NO: 101865 - RNA, 19 nt, Homo sapiens
aaggagaccucuacuguca

SEQ ID NO: 101866 - RNA, 19 nt, Homo sapiens
uagaaucguguccuauuua

SEQ ID NO: 101867 - RNA, 19 nt, Homo sapiens
aaaccuuccuugcuauuug

SEQ ID NO: 101868 - RNA, 19 nt, Homo sapiens
aaucauagcucacaaaccu

SEQ ID NO: 101869 - RNA, 19 nt, Homo sapiens
cacaaguccuuccaauuau

SEQ ID NO: 101870 - RNA, 19 nt, Homo sapiens
gacugcacaucuuaaauau

SEQ ID NO: 101871 - RNA, 19 nt, Homo sapiens
ccagaaaccugugucaucu

SEQ ID NO: 101872 - RNA, 19 nt, Homo sapiens
gaugugcaguaccugauga

SEQ ID NO: 101873 - RNA, 19 nt, Homo sapiens
acucagaccuggcucaguu

SEQ ID NO: 101874 - RNA, 19 nt, Homo sapiens
cucaggaguuggcaaauaa

SEQ ID NO: 101875 - RNA, 19 nt, Homo sapiens
caacaaguccucaaucaac

SEQ ID NO: 101876 - RNA, 19 nt, Homo sapiens
uaagaugcgugauacucaa

SEQ ID NO: 101877 - RNA, 19 nt, Homo sapiens
gugcauacuucucaaucuu

SEQ ID NO: 101878 - RNA, 19 nt, Homo sapiens
cguaagcgauacaacuuga

SEQ ID NO: 101879 - RNA, 19 nt, Homo sapiens
guaacgaccacauaguauu

SEQ ID NO: 101880 - RNA, 19 nt, Homo sapiens
cauaaucaccagggaauaa

SEQ ID NO: 101881 - RNA, 19 nt, Homo sapiens
gagagacugggucaaguaa

SEQ ID NO: 101882 - RNA, 19 nt, Homo sapiens
guaaaugaugcuaugcuuu

SEQ ID NO: 101883 - RNA, 19 nt, Homo sapiens
gacuuucuauccaauaaug

SEQ ID NO: 101884 - RNA, 19 nt, Homo sapiens
ggaguuggcaaauaagaau

SEQ ID NO: 101885 - RNA, 19 nt, Homo sapiens
uaacgaccacauaguauug

SEQ ID NO: 101886 - RNA, 19 nt, Homo sapiens
ucacugacaucuacaacca

SEQ ID NO: 101887 - RNA, 19 nt, Homo sapiens
gaaaugcggugagcuugac

SEQ ID NO: 101888 - RNA, 19 nt, Homo sapiens
gcugaagacucuacucaac

SEQ ID NO: 101889 - RNA, 19 nt, Homo sapiens
gagcacaggauccuuagug

SEQ ID NO: 101890 - RNA, 19 nt, Homo sapiens
gauacaacuugaccucaca

SEQ ID NO: 101891 - RNA, 19 nt, Homo sapiens
ccucgucuguuaaguguga

SEQ ID NO: 101892 - RNA, 19 nt, Homo sapiens
cuacugacugcacaucuua

SEQ ID NO: 101893 - RNA, 19 nt, Homo sapiens
gaaccuuuccucaucacaa

SEQ ID NO: 101894 - RNA, 19 nt, Homo sapiens
gcacaucaggcaucaguag

SEQ ID NO: 101895 - RNA, 19 nt, Homo sapiens
uuacuugucugccuuccuu

SEQ ID NO: 101896 - RNA, 19 nt, Homo sapiens
caauaccugccuuucauaa

SEQ ID NO: 101897 - RNA, 19 nt, Homo sapiens
gagagagacugggucaagu

SEQ ID NO: 101898 - RNA, 19 nt, Homo sapiens
guuugaaucuugguucuga

SEQ ID NO: 101899 - RNA, 19 nt, Homo sapiens
gggcuauauucucuugaaa

SEQ ID NO: 101900 - RNA, 19 nt, Homo sapiens
gcggugagcuugacuugac

SEQ ID NO: 101901 - RNA, 19 nt, Homo sapiens
gcaagacucaguucagaag

SEQ ID NO: 101902 - RNA, 19 nt, Homo sapiens
ggauagaauucaggcuuuc

SEQ ID NO: 101903 - RNA, 19 nt, Homo sapiens
uggauagaauucaggcuuu

SEQ ID NO: 101904 - RNA, 19 nt, Homo sapiens
cacaggacuuucugacuug

SEQ ID NO: 101905 - RNA, 19 nt, Homo sapiens
ucucguuucuucuugguaa

SEQ ID NO: 101906 - RNA, 19 nt, Homo sapiens
ccauuaccaucucacuaaa

SEQ ID NO: 101907 - RNA, 19 nt, Homo sapiens
gaaguagguggcagauguu

SEQ ID NO: 101908 - RNA, 19 nt, Homo sapiens
guaagaugcgugauacuca

SEQ ID NO: 101909 - RNA, 19 nt, Homo sapiens
gcauuguaacgaccacaua

SEQ ID NO: 101910 - RNA, 19 nt, Homo sapiens
cccugaggcuacuuuauuu

SEQ ID NO: 101911 - RNA, 19 nt, Homo sapiens
caaacaauuccaucucguu

SEQ ID NO: 101912 - RNA, 19 nt, Homo sapiens
caucucaucuuucucuuuu

SEQ ID NO: 101913 - RNA, 19 nt, Homo sapiens
gccuuagauuccucaauaa

SEQ ID NO: 101914 - RNA, 19 nt, Homo sapiens
caucaugccuucugaauaa

SEQ ID NO: 101915 - RNA, 19 nt, Homo sapiens
caacagcucaucacgauuu

SEQ ID NO: 101916 - RNA, 19 nt, Homo sapiens
gcaacaacuucucuuaugu

SEQ ID NO: 101917 - RNA, 19 nt, Homo sapiens
ucaagggucugcuguggua

SEQ ID NO: 101918 - RNA, 19 nt, Homo sapiens
ggucuucgcuagcaucuca

SEQ ID NO: 101919 - RNA, 19 nt, Homo sapiens
ggccagcuauuucuuguug

SEQ ID NO: 101920 - RNA, 19 nt, Homo sapiens
gcugaagccuuguuuccuu

SEQ ID NO: 101921 - RNA, 19 nt, Homo sapiens
ggucugcugugguacauug

SEQ ID NO: 101922 - RNA, 19 nt, Homo sapiens
cgggaaagguggacaguau

SEQ ID NO: 101923 - RNA, 19 nt, Homo sapiens
ccacacucgucaucaaauu

SEQ ID NO: 101924 - RNA, 19 nt, Homo sapiens
cacaacagcucaucacgau

SEQ ID NO: 101925 - RNA, 19 nt, Homo sapiens
gugaacaccuuccacaaca

SEQ ID NO: 101926 - RNA, 19 nt, Homo sapiens
ggaaagguggacaguauuc

SEQ ID NO: 101927 - RNA, 19 nt, Homo sapiens
ucugccagcucuccugaua

SEQ ID NO: 101928 - RNA, 19 nt, Homo sapiens
ugcaacaacuucucuuaug

SEQ ID NO: 101929 - RNA, 19 nt, Homo sapiens
ggacgcaggucacauucac

SEQ ID NO: 101930 - RNA, 19 nt, Homo sapiens
caacaacuucucuuaugug

SEQ ID NO: 101931 - RNA, 19 nt, Homo sapiens
gaacaccuuccacaacauc

SEQ ID NO: 101932 - RNA, 19 nt, Homo sapiens
gcaccgggaguuugcaaug

SEQ ID NO: 101933 - RNA, 19 nt, Homo sapiens
ucaggacgcaggucacauu

SEQ ID NO: 101934 - RNA, 19 nt, Homo sapiens
cagccuacgugaacaccuu

SEQ ID NO: 101935 - RNA, 19 nt, Homo sapiens
cagagacccuccaugaacu

SEQ ID NO: 101936 - RNA, 19 nt, Homo sapiens
ccagagacccuccaugaac

SEQ ID NO: 101937 - RNA, 19 nt, Homo sapiens
gaaagguggacaguauuca

SEQ ID NO: 101938 - RNA, 19 nt, Homo sapiens
gaugagcaccgggaguuug

SEQ ID NO: 101939 - RNA, 19 nt, Homo sapiens
gggaaagguggacaguauu

SEQ ID NO: 101940 - RNA, 19 nt, Homo sapiens
gagucacgcucagcaauac

SEQ ID NO: 101941 - RNA, 19 nt, Homo sapiens
caucacgauuugacugcaa

SEQ ID NO: 101942 - RNA, 19 nt, Homo sapiens
cgacauccuuagccacaag

SEQ ID NO: 101943 - RNA, 19 nt, Homo sapiens
ccgaguauuucauuaacca

SEQ ID NO: 101944 - RNA, 19 nt, Homo sapiens
caugccuucugaauaaaug

SEQ ID NO: 101945 - RNA, 19 nt, Homo sapiens
uaccucgucuuccugauca

SEQ ID NO: 101946 - RNA, 19 nt, Homo sapiens
gcaucuaccucgucuuccu

SEQ ID NO: 101947 - RNA, 19 nt, Homo sapiens
gguguggucuucgcuagca

SEQ ID NO: 101948 - RNA, 19 nt, Homo sapiens
gacugcaacucugucucua

SEQ ID NO: 101949 - RNA, 19 nt, Homo sapiens
uggcuuugccucugcauga

SEQ ID NO: 101950 - RNA, 19 nt, Homo sapiens
gaagccuuguuuccuugca

SEQ ID NO: 101951 - RNA, 19 nt, Homo sapiens
gugaugagcaccgggaguu

SEQ ID NO: 101952 - RNA, 19 nt, Homo sapiens
acaagaggacaucgggaaa

SEQ ID NO: 101953 - RNA, 19 nt, Homo sapiens
ugaacaccuuccacaacau

SEQ ID NO: 101954 - RNA, 19 nt, Homo sapiens
aagcaucuaccucgucuuc

SEQ ID NO: 101955 - RNA, 19 nt, Homo sapiens
aaagguggacaguauucaa

SEQ ID NO: 101956 - RNA, 19 nt, Homo sapiens
agacgugugguucggcuuu

SEQ ID NO: 101957 - RNA, 19 nt, Homo sapiens
gcugcugucgcauccguuu

SEQ ID NO: 101958 - RNA, 19 nt, Homo sapiens
gaacaaaugucauccuuga

SEQ ID NO: 101959 - RNA, 19 nt, Homo sapiens
gaagaaaucccuuuaccua

SEQ ID NO: 101960 - RNA, 19 nt, Homo sapiens
gcagagacaugguuugauu

SEQ ID NO: 101961 - RNA, 19 nt, Homo sapiens
ccaaguagcugugcuuuaa

SEQ ID NO: 101962 - RNA, 19 nt, Homo sapiens
gaaaccaacuauacaagaa

SEQ ID NO: 101963 - RNA, 19 nt, Homo sapiens
ggaaacauguucaaccaaa

SEQ ID NO: 101964 - RNA, 19 nt, Homo sapiens
cagaauugcugcauauuaa

SEQ ID NO: 101965 - RNA, 19 nt, Homo sapiens
guaagaagauggaguagau

SEQ ID NO: 101966 - RNA, 19 nt, Homo sapiens
acagaaagcuuaaucauag

SEQ ID NO: 101967 - RNA, 19 nt, Homo sapiens
ccaauuaugugauucaguu

SEQ ID NO: 101968 - RNA, 19 nt, Homo sapiens
gaucuugccuaauguaguu

SEQ ID NO: 101969 - RNA, 19 nt, Homo sapiens
caccauaacuggagugauu

SEQ ID NO: 101970 - RNA, 19 nt, Homo sapiens
caaguuggcugaauuugga

SEQ ID NO: 101971 - RNA, 19 nt, Homo sapiens
uaaagaagcugaaauucgu

SEQ ID NO: 101972 - RNA, 19 nt, Homo sapiens
cuacuuaucugggaaauga

SEQ ID NO: 101973 - RNA, 19 nt, Homo sapiens
gccauuggauucagaagua

SEQ ID NO: 101974 - RNA, 19 nt, Homo sapiens
gcuaguaacuggcuugugu

SEQ ID NO: 101975 - RNA, 19 nt, Homo sapiens
gaaaucccuuuaccuauca

SEQ ID NO: 101976 - RNA, 19 nt, Homo sapiens
ggacaggucaguucauaaa

SEQ ID NO: 101977 - RNA, 19 nt, Homo sapiens
ggaaccaaguuuaguauag

SEQ ID NO: 101978 - RNA, 19 nt, Homo sapiens
cuacgacuguuccaaauuu

SEQ ID NO: 101979 - RNA, 19 nt, Homo sapiens
gaggaaauaaguacagaua

SEQ ID NO: 101980 - RNA, 19 nt, Homo sapiens
gauguucacuggaaggaaa

SEQ ID NO: 101981 - RNA, 19 nt, Homo sapiens
ccacauauugucaguguua

SEQ ID NO: 101982 - RNA, 19 nt, Homo sapiens
ugaauuggaugcacuauag

SEQ ID NO: 101983 - RNA, 19 nt, Homo sapiens
gauauggugugcccagauu

SEQ ID NO: 101984 - RNA, 19 nt, Homo sapiens
guaaugaagucaggucuug

SEQ ID NO: 101985 - RNA, 19 nt, Homo sapiens
caacugaacacguuucuau

SEQ ID NO: 101986 - RNA, 19 nt, Homo sapiens
ggagggugaugaugacauu

SEQ ID NO: 101987 - RNA, 19 nt, Homo sapiens
guaacuggcuuguguucuu

SEQ ID NO: 101988 - RNA, 19 nt, Homo sapiens
ucaggacucuucucuugua

SEQ ID NO: 101989 - RNA, 19 nt, Homo sapiens
gaacacguuucuauucaag

SEQ ID NO: 101990 - RNA, 19 nt, Homo sapiens
guacugagucccauaugua

SEQ ID NO: 101991 - RNA, 19 nt, Homo sapiens
guacagauacugacaggaa

SEQ ID NO: 101992 - RNA, 19 nt, Homo sapiens
gaaccaaguuuaguauagu

SEQ ID NO: 101993 - RNA, 19 nt, Homo sapiens
gguaauugaugccauuguu

SEQ ID NO: 101994 - RNA, 19 nt, Homo sapiens
gaaacauguucaaccaaau

SEQ ID NO: 101995 - RNA, 19 nt, Homo sapiens
agacaugguuugauuccua

SEQ ID NO: 101996 - RNA, 19 nt, Homo sapiens
gcaacuauaucaggaaaca

SEQ ID NO: 101997 - RNA, 19 nt, Homo sapiens
guaaagauguaaguugugu

SEQ ID NO: 101998 - RNA, 19 nt, Homo sapiens
gcacuauaguacaggcuuu

SEQ ID NO: 101999 - RNA, 19 nt, Homo sapiens
ggauugcuguaaagaugua

SEQ ID NO: 102000 - RNA, 19 nt, Homo sapiens
gagcucuucuuucugauau

SEQ ID NO: 102001 - RNA, 19 nt, Homo sapiens
ggugggagcucuucuuucu

SEQ ID NO: 102002 - RNA, 19 nt, Homo sapiens
ggacucuucucuuguaaag

SEQ ID NO: 102003 - RNA, 19 nt, Homo sapiens
uugagucucuugcaaauuu

SEQ ID NO: 102004 - RNA, 19 nt, Homo sapiens
gacauuaguucaaguagca

SEQ ID NO: 102005 - RNA, 19 nt, Homo sapiens
ggcaagaacuacacaaugg

SEQ ID NO: 102006 - RNA, 19 nt, Homo sapiens
gcacuauugucccuucuuc

SEQ ID NO: 102007 - RNA, 19 nt, Homo sapiens
gaccacauauugucagugu

SEQ ID NO: 102008 - RNA, 19 nt, Homo sapiens
gaagauggaguagauauca

SEQ ID NO: 102009 - RNA, 19 nt, Homo sapiens
gcagacacguuuggguaaa

SEQ ID NO: 102010 - RNA, 19 nt, Homo sapiens
gauguaaguuguguauguu

SEQ ID NO: 102011 - RNA, 19 nt, Homo sapiens
ucucaggacucuucucuug

SEQ ID NO: 102012 - RNA, 19 nt, Homo sapiens
uaacaaguuggcugaauuu

SEQ ID NO: 102013 - RNA, 19 nt, Homo sapiens
uagcugugcuuuaauuaga

SEQ ID NO: 102014 - RNA, 19 nt, Homo sapiens
guaaacaggcaccuucuga

SEQ ID NO: 102015 - RNA, 19 nt, Homo sapiens
gaauggcagugauaaugau

SEQ ID NO: 102016 - RNA, 19 nt, Homo sapiens
ggauucagaaguacauuaa

SEQ ID NO: 102017 - RNA, 19 nt, Homo sapiens
aagagaaggugaugcagaa

SEQ ID NO: 102018 - RNA, 19 nt, Homo sapiens
gaauuucuguugagucucu

SEQ ID NO: 102019 - RNA, 19 nt, Homo sapiens
ucaaguagcaacuauauca

SEQ ID NO: 102020 - RNA, 19 nt, Homo sapiens
agaaaucccuuuaccuauc

SEQ ID NO: 102021 - RNA, 19 nt, Homo sapiens
gaauuuggccauaguauac

SEQ ID NO: 102022 - RNA, 19 nt, Homo sapiens
uguacuacguauagacuua

SEQ ID NO: 102023 - RNA, 19 nt, Homo sapiens
cacagaaagcuuaaucaua

SEQ ID NO: 102024 - RNA, 19 nt, Homo sapiens
uaggauugcuguaaagaug

SEQ ID NO: 102025 - RNA, 19 nt, Homo sapiens
uaacuggcuuguguucuuu

SEQ ID NO: 102026 - RNA, 19 nt, Homo sapiens
agacuaacuuuacaacuuc

SEQ ID NO: 102027 - RNA, 19 nt, Homo sapiens
gauauggcaguuacacuuu

SEQ ID NO: 102028 - RNA, 19 nt, Homo sapiens
gcugaaauucguacuauau

SEQ ID NO: 102029 - RNA, 19 nt, Homo sapiens
aacacucucugguuuauaa

SEQ ID NO: 102030 - RNA, 19 nt, Homo sapiens
uuaacaaguuggcugaauu

SEQ ID NO: 102031 - RNA, 19 nt, Homo sapiens
gaaacaggacaaugaaaca

SEQ ID NO: 102032 - RNA, 19 nt, Homo sapiens
gcaaggcccugaauguacu

SEQ ID NO: 102033 - RNA, 19 nt, Homo sapiens
ccugagagguuaguacauu

SEQ ID NO: 102034 - RNA, 19 nt, Homo sapiens
ucaagaacauagaaaccaa

SEQ ID NO: 102035 - RNA, 19 nt, Homo sapiens
gaugaugacauugaaguuu

SEQ ID NO: 102036 - RNA, 19 nt, Homo sapiens
cuguuaagaucaccaagua

SEQ ID NO: 102037 - RNA, 19 nt, Homo sapiens
caaguuuaguauagucuga

SEQ ID NO: 102038 - RNA, 19 nt, Homo sapiens
uaacaucucaggacucuuc

SEQ ID NO: 102039 - RNA, 19 nt, Homo sapiens
ccaaauacacauucucguu

SEQ ID NO: 102040 - RNA, 19 nt, Homo sapiens
ccacauauugucgguguua

SEQ ID NO: 102041 - RNA, 19 nt, Homo sapiens
caaaacugcugucugguaa

SEQ ID NO: 102042 - RNA, 19 nt, Homo sapiens
gaagugaaggaauuggaaa

SEQ ID NO: 102043 - RNA, 19 nt, Homo sapiens
guaaaguggaccuuagaaa

SEQ ID NO: 102044 - RNA, 19 nt, Homo sapiens
ggauuuaggauugcuguaa

SEQ ID NO: 102045 - RNA, 19 nt, Homo sapiens
uguggcaaauccaguguua

SEQ ID NO: 102046 - RNA, 19 nt, Homo sapiens
ugggagcucuucuuucuga

SEQ ID NO: 102047 - RNA, 19 nt, Homo sapiens
cgaguuaggugaucuuggu

SEQ ID NO: 102048 - RNA, 19 nt, Homo sapiens
gaaauucguacuauauugg

SEQ ID NO: 102049 - RNA, 19 nt, Homo sapiens
ccuaugaaauucccuuuua

SEQ ID NO: 102050 - RNA, 19 nt, Homo sapiens
ggacaaugaaacaggaauu

SEQ ID NO: 102051 - RNA, 19 nt, Homo sapiens
ucaguaagaagauggagua

SEQ ID NO: 102052 - RNA, 19 nt, Homo sapiens
gaagcugaaauucguacua

SEQ ID NO: 102053 - RNA, 19 nt, Homo sapiens
cuuaagugcuuuaguuuag

SEQ ID NO: 102054 - RNA, 19 nt, Homo sapiens
aaaccacauuugccaacua

SEQ ID NO: 102055 - RNA, 19 nt, Homo sapiens
ucgagaggcuccggaagua

SEQ ID NO: 102056 - RNA, 19 nt, Homo sapiens
gcaccuuccuggacugcaa

SEQ ID NO: 102057 - RNA, 19 nt, Homo sapiens
aaggacaggucaguucaua

SEQ ID NO: 102058 - RNA, 19 nt, Homo sapiens
ggagagcauuuguauguua

SEQ ID NO: 102059 - RNA, 19 nt, Homo sapiens
gacagaagauucaauaaga

SEQ ID NO: 102060 - RNA, 19 nt, Homo sapiens
caaaguacuucaaauggua

SEQ ID NO: 102061 - RNA, 19 nt, Homo sapiens
ggaagcacaugaacaagga

SEQ ID NO: 102062 - RNA, 19 nt, Homo sapiens
ggagugaaguuaaugaaag

SEQ ID NO: 102063 - RNA, 19 nt, Homo sapiens
ugacuacgauggagaagaa

SEQ ID NO: 102064 - RNA, 19 nt, Homo sapiens
gcagaucuauguggugaaa

SEQ ID NO: 102065 - RNA, 19 nt, Homo sapiens
ggaccgaagugacugucua

SEQ ID NO: 102066 - RNA, 19 nt, Homo sapiens
ggaugaaguccucaaagua

SEQ ID NO: 102067 - RNA, 19 nt, Homo sapiens
agaagaauaugauguggaa

SEQ ID NO: 102068 - RNA, 19 nt, Homo sapiens
ggaagacagugaugaugau

SEQ ID NO: 102069 - RNA, 19 nt, Homo sapiens
uuaccagucugcuguuaua

SEQ ID NO: 102070 - RNA, 19 nt, Homo sapiens
gggaugaaguccucaaagu

SEQ ID NO: 102071 - RNA, 19 nt, Homo sapiens
gugagcagccaguauaaua

SEQ ID NO: 102072 - RNA, 19 nt, Homo sapiens
uauggugaaugccaaauuu

SEQ ID NO: 102073 - RNA, 19 nt, Homo sapiens
gagagcauuuguauguuau

SEQ ID NO: 102074 - RNA, 19 nt, Homo sapiens
gagacagacuauacugaga

SEQ ID NO: 102075 - RNA, 19 nt, Homo sapiens
ggacagaagauucaauaag

SEQ ID NO: 102076 - RNA, 19 nt, Homo sapiens
gaaggaaugcuuucucagu

SEQ ID NO: 102077 - RNA, 19 nt, Homo sapiens
ggauucagaugacuacgau

SEQ ID NO: 102078 - RNA, 19 nt, Homo sapiens
cagcagaagauagauaaua

SEQ ID NO: 102079 - RNA, 19 nt, Homo sapiens
gaugauguugaaccuauua

SEQ ID NO: 102080 - RNA, 19 nt, Homo sapiens
ccucuuagguuguauccuu

SEQ ID NO: 102081 - RNA, 19 nt, Homo sapiens
agacagugaugaugauguu

SEQ ID NO: 102082 - RNA, 19 nt, Homo sapiens
gugcaucauuuguaagcua

SEQ ID NO: 102083 - RNA, 19 nt, Homo sapiens
gagauuagaaggaaugcuu

SEQ ID NO: 102084 - RNA, 19 nt, Homo sapiens
uaagcuagcagaucuaugu

SEQ ID NO: 102085 - RNA, 19 nt, Homo sapiens
caggacagaagauucaaua

SEQ ID NO: 102086 - RNA, 19 nt, Homo sapiens
uaggagagcauuuguaugu

SEQ ID NO: 102087 - RNA, 19 nt, Homo sapiens
gaggguauuuguaguuuac

SEQ ID NO: 102088 - RNA, 19 nt, Homo sapiens
ucaaaguacuucaaauggu

SEQ ID NO: 102089 - RNA, 19 nt, Homo sapiens
caagaggguauuuguaguu

SEQ ID NO: 102090 - RNA, 19 nt, Homo sapiens
gagugaaguuaaugaaagu

SEQ ID NO: 102091 - RNA, 19 nt, Homo sapiens
aacaguugcuggacaguuu

SEQ ID NO: 102092 - RNA, 19 nt, Homo sapiens
ggagagauuagaaggaaug

SEQ ID NO: 102093 - RNA, 19 nt, Homo sapiens
gaggcaauguucacugcaa

SEQ ID NO: 102094 - RNA, 19 nt, Homo sapiens
guuagauggcucuggauua

SEQ ID NO: 102095 - RNA, 19 nt, Homo sapiens
gaugaaguccucaaaguac

SEQ ID NO: 102096 - RNA, 19 nt, Homo sapiens
ugccaaauuugaagaagaa

SEQ ID NO: 102097 - RNA, 19 nt, Homo sapiens
gguuguauccuuuaauuuc

SEQ ID NO: 102098 - RNA, 19 nt, Homo sapiens
gagcagccaguauaauaug

SEQ ID NO: 102099 - RNA, 19 nt, Homo sapiens
uuagauggcucuggauuag

SEQ ID NO: 102100 - RNA, 19 nt, Homo sapiens
uuacaccuaugaagaagga

SEQ ID NO: 102101 - RNA, 19 nt, Homo sapiens
uaacagaacaagugagucu

SEQ ID NO: 102102 - RNA, 19 nt, Homo sapiens
gcagaagauagauaauaug

SEQ ID NO: 102103 - RNA, 19 nt, Homo sapiens
ggucaggacagaagauuca

SEQ ID NO: 102104 - RNA, 19 nt, Homo sapiens
ggacaucccuacauuuuac

SEQ ID NO: 102105 - RNA, 19 nt, Homo sapiens
gaagaggaagacagugaug

SEQ ID NO: 102106 - RNA, 19 nt, Homo sapiens
aagaaccuguugcugauga

SEQ ID NO: 102107 - RNA, 19 nt, Homo sapiens
aagaggguauuuguaguuu

SEQ ID NO: 102108 - RNA, 19 nt, Homo sapiens
ccaagaggguauuuguagu

SEQ ID NO: 102109 - RNA, 19 nt, Homo sapiens
uaaccaagaggguauuugu

SEQ ID NO: 102110 - RNA, 19 nt, Homo sapiens
gcacugguacccuuuacau

SEQ ID NO: 102111 - RNA, 19 nt, Homo sapiens
gaagaagaaucaaaagaac

SEQ ID NO: 102112 - RNA, 19 nt, Homo sapiens
gcugagagccgccugucuu

SEQ ID NO: 102113 - RNA, 19 nt, Homo sapiens
guacuucaaaugguaauug

SEQ ID NO: 102114 - RNA, 19 nt, Homo sapiens
ccucaaaguacuucaaaug

SEQ ID NO: 102115 - RNA, 19 nt, Homo sapiens
ccucugaguaggccuauaa

SEQ ID NO: 102116 - RNA, 19 nt, Homo sapiens
agaggguauuuguaguuua

SEQ ID NO: 102117 - RNA, 19 nt, Homo sapiens
caaguugucaccagcagaa

SEQ ID NO: 102118 - RNA, 19 nt, Homo sapiens
aagccacacuggagagauu

SEQ ID NO: 102119 - RNA, 19 nt, Homo sapiens
uuagauuugugccuaguga

SEQ ID NO: 102120 - RNA, 19 nt, Homo sapiens
gaaugccaaauuugaagaa

SEQ ID NO: 102121 - RNA, 19 nt, Homo sapiens
gagcuccuuucgccauguu

SEQ ID NO: 102122 - RNA, 19 nt, Homo sapiens
ggaugaggauucagaugac

SEQ ID NO: 102123 - RNA, 19 nt, Homo sapiens
gauuugugccuagugauaa

SEQ ID NO: 102124 - RNA, 19 nt, Homo sapiens
ggugaaugccaaauuugaa

SEQ ID NO: 102125 - RNA, 19 nt, Homo sapiens
acaagugagucugggauga

SEQ ID NO: 102126 - RNA, 19 nt, Homo sapiens
aaccaguucuuucuugaga

SEQ ID NO: 102127 - RNA, 19 nt, Homo sapiens
agauggcucuggauuagga

SEQ ID NO: 102128 - RNA, 19 nt, Homo sapiens
cugaguaggccuauaauuc

SEQ ID NO: 102129 - RNA, 19 nt, Homo sapiens
gacagacuauacugagaca

SEQ ID NO: 102130 - RNA, 19 nt, Homo sapiens
cagaagauucaauaagaga

SEQ ID NO: 102131 - RNA, 19 nt, Homo sapiens
cuggagagauuagaaggaa

SEQ ID NO: 102132 - RNA, 19 nt, Homo sapiens
gagcauuuguauguuaugg

SEQ ID NO: 102133 - RNA, 19 nt, Homo sapiens
cugcuguuauaaccucuua

SEQ ID NO: 102134 - RNA, 19 nt, Homo sapiens
guuugaggaugcagauguu

SEQ ID NO: 102135 - RNA, 19 nt, Homo sapiens
ucugugagcagccaguaua

SEQ ID NO: 102136 - RNA, 19 nt, Homo sapiens
caccuaugaagaaggauua

SEQ ID NO: 102137 - RNA, 19 nt, Homo sapiens
ucacugcaaugugcgaaug

SEQ ID NO: 102138 - RNA, 19 nt, Homo sapiens
ccuuuaauuuccagccuuu

SEQ ID NO: 102139 - RNA, 19 nt, Homo sapiens
ccaguucuuucuugagaca

SEQ ID NO: 102140 - RNA, 19 nt, Homo sapiens
aacccaaccugaaccaguu

SEQ ID NO: 102141 - RNA, 19 nt, Homo sapiens
ggauaccacaccaacaguu

SEQ ID NO: 102142 - RNA, 19 nt, Homo sapiens
acacugaggcugugcugaa

SEQ ID NO: 102143 - RNA, 19 nt, Homo sapiens
gcaauguucacugcaaugu

SEQ ID NO: 102144 - RNA, 19 nt, Homo sapiens
ugaagaagaggaagacagu

SEQ ID NO: 102145 - RNA, 19 nt, Homo sapiens
caagugagucugggaugaa

SEQ ID NO: 102146 - RNA, 19 nt, Homo sapiens
gcgguguggugcacgcauu

SEQ ID NO: 102147 - RNA, 19 nt, Homo sapiens
acagaagauucaauaagag

SEQ ID NO: 102148 - RNA, 19 nt, Homo sapiens
ggcagcagccagacacuga

SEQ ID NO: 102149 - RNA, 19 nt, Homo sapiens
gauguugaaccuauuacug

SEQ ID NO: 102150 - RNA, 19 nt, Homo sapiens
aagaagaggaagacaguga

SEQ ID NO: 102151 - RNA, 19 nt, Homo sapiens
ucuaggagagcauuuguau

SEQ ID NO: 102152 - RNA, 19 nt, Homo sapiens
ggaugcagauguugaucac

SEQ ID NO: 102153 - RNA, 19 nt, Homo sapiens
gcauugcugugcuccaacu

SEQ ID NO: 102154 - RNA, 19 nt, Homo sapiens
aaucagcguuggaggcaau

SEQ ID NO: 102155 - RNA, 19 nt, Homo sapiens
cagugaugaugauguugaa

SEQ ID NO: 102156 - RNA, 19 nt, Homo sapiens
gaagacagugaugaugaug

SEQ ID NO: 102157 - RNA, 19 nt, Homo sapiens
aaaagaaccuguugcugau

SEQ ID NO: 102158 - RNA, 19 nt, Homo sapiens
ggugagcucugcaugaaua

SEQ ID NO: 102159 - RNA, 19 nt, Homo sapiens
cagcauaucuguuuucuga

SEQ ID NO: 102160 - RNA, 19 nt, Homo sapiens
ucuaugggauuuacuacaa

SEQ ID NO: 102161 - RNA, 19 nt, Homo sapiens
ugaauagugcccaguguaa

SEQ ID NO: 102162 - RNA, 19 nt, Homo sapiens
gcauaucuguuuucugauu

SEQ ID NO: 102163 - RNA, 19 nt, Homo sapiens
uuaaaggccuccugcaaac

SEQ ID NO: 102164 - RNA, 19 nt, Homo sapiens
caucaccaacaccaacuuu

SEQ ID NO: 102165 - RNA, 19 nt, Homo sapiens
caugaauagugcccagugu

SEQ ID NO: 102166 - RNA, 19 nt, Homo sapiens
gagcucugcaugaauagug

SEQ ID NO: 102167 - RNA, 19 nt, Homo sapiens
acggugagcucugcaugaa

SEQ ID NO: 102168 - RNA, 19 nt, Homo sapiens
auuaaaggccuccugcaaa

SEQ ID NO: 102169 - RNA, 19 nt, Homo sapiens
gaauagugcccaguguaag

SEQ ID NO: 102170 - RNA, 19 nt, Homo sapiens
aagacgcucuaugggauuu

SEQ ID NO: 102171 - RNA, 19 nt, Homo sapiens
caagacgcucuaugggauu

SEQ ID NO: 102172 - RNA, 19 nt, Homo sapiens
ucccacaccuagcccagaa

SEQ ID NO: 102173 - RNA, 19 nt, Homo sapiens
aauagugcccaguguaaga

SEQ ID NO: 102174 - RNA, 19 nt, Homo sapiens
ccacucaccauggagaaga

SEQ ID NO: 102175 - RNA, 19 nt, Homo sapiens
agaaugcuguaggccacua

SEQ ID NO: 102176 - RNA, 19 nt, Homo sapiens
uugaccagcauaucuguuu

SEQ ID NO: 102177 - RNA, 19 nt, Homo sapiens
ccacaccuagcccagaaug

SEQ ID NO: 102178 - RNA, 19 nt, Homo sapiens
uaugggauuuacuacaagu

SEQ ID NO: 102179 - RNA, 19 nt, Homo sapiens
aauuaaaggccuccugcaa

SEQ ID NO: 102180 - RNA, 19 nt, Homo sapiens
caucaaaggugugcuguuu

SEQ ID NO: 102181 - RNA, 19 nt, Homo sapiens
caaaguguaugaugauaug

SEQ ID NO: 102182 - RNA, 19 nt, Homo sapiens
caagagggcugaggacuau

SEQ ID NO: 102183 - RNA, 19 nt, Homo sapiens
uaaugaaccugcaugugua

SEQ ID NO: 102184 - RNA, 19 nt, Homo sapiens
cgaccaaaguguaugauga

SEQ ID NO: 102185 - RNA, 19 nt, Homo sapiens
acaaggcccucaacacauu

SEQ ID NO: 102186 - RNA, 19 nt, Homo sapiens
ccaucuacauccacguuua

SEQ ID NO: 102187 - RNA, 19 nt, Homo sapiens
gaacagcacgaucuugugu

SEQ ID NO: 102188 - RNA, 19 nt, Homo sapiens
caagaaugauauccaguuc

SEQ ID NO: 102189 - RNA, 19 nt, Homo sapiens
ucauauggguguuuaacuu

SEQ ID NO: 102190 - RNA, 19 nt, Homo sapiens
ucaaaggugugcuguuuag

SEQ ID NO: 102191 - RNA, 19 nt, Homo sapiens
uaacacagucuggauuuaa

SEQ ID NO: 102192 - RNA, 19 nt, Homo sapiens
cauauggguguuuaacuua

SEQ ID NO: 102193 - RNA, 19 nt, Homo sapiens
gcacuuugcugagcucgau

SEQ ID NO: 102194 - RNA, 19 nt, Homo sapiens
ucaagaugcccguuaugua

SEQ ID NO: 102195 - RNA, 19 nt, Homo sapiens
gaacggcuccaucuacauc

SEQ ID NO: 102196 - RNA, 19 nt, Homo sapiens
caacaucaccaucaacauc

SEQ ID NO: 102197 - RNA, 19 nt, Homo sapiens
gaagcggacccagaaauga

SEQ ID NO: 102198 - RNA, 19 nt, Homo sapiens
gacagaagcggacccagaa

SEQ ID NO: 102199 - RNA, 19 nt, Homo sapiens
ggacaacgagaccaacuuc

SEQ ID NO: 102200 - RNA, 19 nt, Homo sapiens
gaagaucaccaaggucaug

SEQ ID NO: 102201 - RNA, 19 nt, Homo sapiens
cgugagcggugacuacuau

SEQ ID NO: 102202 - RNA, 19 nt, Homo sapiens
uuaacacagucuggauuua

SEQ ID NO: 102203 - RNA, 19 nt, Homo sapiens
caagaugcccguuauguac

SEQ ID NO: 102204 - RNA, 19 nt, Homo sapiens
cagaacggcuccaucuaca

SEQ ID NO: 102205 - RNA, 19 nt, Homo sapiens
caacgaguuuggcaugagu

SEQ ID NO: 102206 - RNA, 19 nt, Homo sapiens
acuacaagcucaagucugu

SEQ ID NO: 102207 - RNA, 19 nt, Homo sapiens
ugacuacuaucccaucauc

SEQ ID NO: 102208 - RNA, 19 nt, Homo sapiens
ggaucaauaugugaaguuc

SEQ ID NO: 102209 - RNA, 19 nt, Homo sapiens
gcagaacggcuccaucuac

SEQ ID NO: 102210 - RNA, 19 nt, Homo sapiens
gcaccaagucgcccuggaa

SEQ ID NO: 102211 - RNA, 19 nt, Homo sapiens
cuacaaggcccucaacaca

SEQ ID NO: 102212 - RNA, 19 nt, Homo sapiens
cccggaugaucaacaaaua

SEQ ID NO: 102213 - RNA, 19 nt, Homo sapiens
uuaaugaaccugcaugugu

SEQ ID NO: 102214 - RNA, 19 nt, Homo sapiens
guccacaugucccggauga

SEQ ID NO: 102215 - RNA, 19 nt, Homo sapiens
ucaagaaugauauccaguu

SEQ ID NO: 102216 - RNA, 19 nt, Homo sapiens
ucaagagggcugaggacua

SEQ ID NO: 102217 - RNA, 19 nt, Homo sapiens
acagcacgaucuuguguau

SEQ ID NO: 102218 - RNA, 19 nt, Homo sapiens
gggaacagcacgaucuugu

SEQ ID NO: 102219 - RNA, 19 nt, Homo sapiens
ucagagcacgagcacuuua

SEQ ID NO: 102220 - RNA, 19 nt, Homo sapiens
ccacggccguucaucaucu

SEQ ID NO: 102221 - RNA, 19 nt, Homo sapiens
gcuaugccgucuacagucu

SEQ ID NO: 102222 - RNA, 19 nt, Homo sapiens
uuuaggaucuucaucaucu

SEQ ID NO: 102223 - RNA, 19 nt, Homo sapiens
gaccaaaguguaugaugau

SEQ ID NO: 102224 - RNA, 19 nt, Homo sapiens
cuacauccacguuuacuuc

SEQ ID NO: 102225 - RNA, 19 nt, Homo sapiens
ccaaaguguaugaugauau

SEQ ID NO: 102226 - RNA, 19 nt, Homo sapiens
gcacaggguggcaggaauc

SEQ ID NO: 102227 - RNA, 19 nt, Homo sapiens
acuggaaccugcagaagga

SEQ ID NO: 102228 - RNA, 19 nt, Homo sapiens
acacagucuggauuuaaua

SEQ ID NO: 102229 - RNA, 19 nt, Homo sapiens
caggucagcgucuucauug

SEQ ID NO: 102230 - RNA, 19 nt, Homo sapiens
gggcugcuaugccgucuac

SEQ ID NO: 102231 - RNA, 19 nt, Homo sapiens
ggugugcuguuuaggaucu

SEQ ID NO: 102232 - RNA, 19 nt, Homo sapiens
ucaccaucaucgugucuau

SEQ ID NO: 102233 - RNA, 19 nt, Homo sapiens
ucuggaagaucaccaaggu

SEQ ID NO: 102234 - RNA, 19 nt, Homo sapiens
ccaggucagcgucuucauu

SEQ ID NO: 102235 - RNA, 19 nt, Homo sapiens
ggaaccugcagaaggacua

SEQ ID NO: 102236 - RNA, 19 nt, Homo sapiens
cccaucaucuacuucaaug

SEQ ID NO: 102237 - RNA, 19 nt, Homo sapiens
ggaacagcacgaucuugug

SEQ ID NO: 102238 - RNA, 19 nt, Homo sapiens
uguacgagcagucagauga

SEQ ID NO: 102239 - RNA, 19 nt, Homo sapiens
ggugacuacuaucccauca

SEQ ID NO: 102240 - RNA, 19 nt, Homo sapiens
gaugaucaacaaauacaag

SEQ ID NO: 102241 - RNA, 19 nt, Homo sapiens
cacguuuacuucaccaaga

SEQ ID NO: 102242 - RNA, 19 nt, Homo sapiens
ucucagagcacgagcacuu

SEQ ID NO: 102243 - RNA, 19 nt, Homo sapiens
cacagagcguccagcagaa

SEQ ID NO: 102244 - RNA, 19 nt, Homo sapiens
ccacccgagucaacgaguu

SEQ ID NO: 102245 - RNA, 19 nt, Homo sapiens
caucaucgugucuaucguu

SEQ ID NO: 102246 - RNA, 19 nt, Homo sapiens
cagcagaacggcuccaucu

SEQ ID NO: 102247 - RNA, 19 nt, Homo sapiens
gccagcagaggacaagaaa

SEQ ID NO: 102248 - RNA, 19 nt, Homo sapiens
gagcacaggguggcaggaa

SEQ ID NO: 102249 - RNA, 19 nt, Homo sapiens
guuccuggccuucaagaau

SEQ ID NO: 102250 - RNA, 19 nt, Homo sapiens
ccacaugucccggaugauc

SEQ ID NO: 102251 - RNA, 19 nt, Homo sapiens
aaaggugugcuguuuagga

SEQ ID NO: 102252 - RNA, 19 nt, Homo sapiens
cacagucuggauuuaauaa

SEQ ID NO: 102253 - RNA, 19 nt, Homo sapiens
aacacagucuggauuuaau

SEQ ID NO: 102254 - RNA, 19 nt, Homo sapiens
cacgagcacuuuacagacu

SEQ ID NO: 102255 - RNA, 19 nt, Homo sapiens
ccucugucccucuguguuu

SEQ ID NO: 102256 - RNA, 19 nt, Homo sapiens
caacuacaagcucaagucu

SEQ ID NO: 102257 - RNA, 19 nt, Homo sapiens
gcacuuuacagacuucaac

SEQ ID NO: 102258 - RNA, 19 nt, Homo sapiens
cagaagcggacccagaaau

SEQ ID NO: 102259 - RNA, 19 nt, Homo sapiens
uacaagcgcagacgauuuc

SEQ ID NO: 102260 - RNA, 19 nt, Homo sapiens
ggcgcaugcucaccuacaa

SEQ ID NO: 102261 - RNA, 19 nt, Homo sapiens
auacaagcgcagacgauuu

SEQ ID NO: 102262 - RNA, 19 nt, Homo sapiens
aaggugugcuguuuaggau

SEQ ID NO: 102263 - RNA, 19 nt, Homo sapiens
ucacagugucuucgaguuc

SEQ ID NO: 102264 - RNA, 19 nt, Homo sapiens
acuacuaucccaucaucua

SEQ ID NO: 102265 - RNA, 19 nt, Homo sapiens
acccagaaaugaucaagag

SEQ ID NO: 102266 - RNA, 19 nt, Homo sapiens
agaagcggacccagaaaug

SEQ ID NO: 102267 - RNA, 19 nt, Homo sapiens
accaaaguguaugaugaua

SEQ ID NO: 102268 - RNA, 19 nt, Homo sapiens
gucaacgaguuuggcauga

SEQ ID NO: 102269 - RNA, 19 nt, Homo sapiens
caggguggcaggaaucuuc

SEQ ID NO: 102270 - RNA, 19 nt, Homo sapiens
ucaucgaccucuggaagau

SEQ ID NO: 102271 - RNA, 19 nt, Homo sapiens
aagcgcagacgauuucaga

SEQ ID NO: 102272 - RNA, 19 nt, Homo sapiens
agcacgaucuuguguaugg

SEQ ID NO: 102273 - RNA, 19 nt, Homo sapiens
uuuaacacagucuggauuu

SEQ ID NO: 102274 - RNA, 19 nt, Homo sapiens
ggcaggccaggguuuguuu

SEQ ID NO: 102275 - RNA, 19 nt, Homo sapiens
uguaugaugauauggcauu

SEQ ID NO: 102276 - RNA, 19 nt, Homo sapiens
ggaugaucaacaaauacaa

SEQ ID NO: 102277 - RNA, 19 nt, Homo sapiens
ccuguucgccuuugucauc

SEQ ID NO: 102278 - RNA, 19 nt, Homo sapiens
gacgaccuguucgccuuug

SEQ ID NO: 102279 - RNA, 19 nt, Homo sapiens
cgacgaccuguucgccuuu

SEQ ID NO: 102280 - RNA, 19 nt, Homo sapiens
gaagaagccuuuguaaaug

SEQ ID NO: 102281 - RNA, 19 nt, Homo sapiens
uaaaggagcuagaagaaug

SEQ ID NO: 102282 - RNA, 19 nt, Homo sapiens
gaaaguauccguaaaugga

SEQ ID NO: 102283 - RNA, 19 nt, Homo sapiens
gaagcagaguggaaagaaa

SEQ ID NO: 102284 - RNA, 19 nt, Homo sapiens
caacagggcagcagaagaa

SEQ ID NO: 102285 - RNA, 19 nt, Homo sapiens
agaagaagccuuuguaaau

SEQ ID NO: 102286 - RNA, 19 nt, Homo sapiens
ggaaaguaaugguccaaca

SEQ ID NO: 102287 - RNA, 19 nt, Homo sapiens
gcagaagaagccuuuguaa

SEQ ID NO: 102288 - RNA, 19 nt, Homo sapiens
gcaagaagcagaguggaaa

SEQ ID NO: 102289 - RNA, 19 nt, Homo sapiens
gagagaagaacaaauggaa

SEQ ID NO: 102290 - RNA, 19 nt, Homo sapiens
cuacaucugcaauaucuua

SEQ ID NO: 102291 - RNA, 19 nt, Homo sapiens
gcaagcaggccaaagaugu

SEQ ID NO: 102292 - RNA, 19 nt, Homo sapiens
aagaagccuuuguaaauga

SEQ ID NO: 102293 - RNA, 19 nt, Homo sapiens
caauaaaggagcuagaaga

SEQ ID NO: 102294 - RNA, 19 nt, Homo sapiens
gugcuucugugcauuauuc

SEQ ID NO: 102295 - RNA, 19 nt, Homo sapiens
cagaagaagccuuuguaaa

SEQ ID NO: 102296 - RNA, 19 nt, Homo sapiens
cacagucauuggauuaauu

SEQ ID NO: 102297 - RNA, 19 nt, Homo sapiens
ggacgagcagcuacagaaa

SEQ ID NO: 102298 - RNA, 19 nt, Homo sapiens
aaacacuacaucugcaaua

SEQ ID NO: 102299 - RNA, 19 nt, Homo sapiens
ggaaagaaaaggcaauaaa

SEQ ID NO: 102300 - RNA, 19 nt, Homo sapiens
ggugaauacuaccaggaaa

SEQ ID NO: 102301 - RNA, 19 nt, Homo sapiens
cuagaagaaugguaugcaa

SEQ ID NO: 102302 - RNA, 19 nt, Homo sapiens
caucugcaauaucuuaauc

SEQ ID NO: 102303 - RNA, 19 nt, Homo sapiens
ggagcuagaagaaugguau

SEQ ID NO: 102304 - RNA, 19 nt, Homo sapiens
agacaguuaugcagcuauu

SEQ ID NO: 102305 - RNA, 19 nt, Homo sapiens
ggaugcuguugauggagua

SEQ ID NO: 102306 - RNA, 19 nt, Homo sapiens
ccaauucucggaagcaaga

SEQ ID NO: 102307 - RNA, 19 nt, Homo sapiens
ggagagaagaacaaaugga

SEQ ID NO: 102308 - RNA, 19 nt, Homo sapiens
ggaaacacuacaucugcaa

SEQ ID NO: 102309 - RNA, 19 nt, Homo sapiens
aauaaaggagcuagaagaa

SEQ ID NO: 102310 - RNA, 19 nt, Homo sapiens
ggaagcccuugaugccaau

SEQ ID NO: 102311 - RNA, 19 nt, Homo sapiens
gaaaguaaugguccaacag

SEQ ID NO: 102312 - RNA, 19 nt, Homo sapiens
gcagcaagagagcgagauu

SEQ ID NO: 102313 - RNA, 19 nt, Homo sapiens
gaagaaugguaugcaagac

SEQ ID NO: 102314 - RNA, 19 nt, Homo sapiens
uaaauggagagaagaacaa

SEQ ID NO: 102315 - RNA, 19 nt, Homo sapiens
guaaauggagagaagaaca

SEQ ID NO: 102316 - RNA, 19 nt, Homo sapiens
aguaaugaauggugaauac

SEQ ID NO: 102317 - RNA, 19 nt, Homo sapiens
cacuacaucugcaauaucu

SEQ ID NO: 102318 - RNA, 19 nt, Homo sapiens
gcaauaaaggagcuagaag

SEQ ID NO: 102319 - RNA, 19 nt, Homo sapiens
gaaagaaaaggcaauaaag

SEQ ID NO: 102320 - RNA, 19 nt, Homo sapiens
uagaguuguucauuguuug

SEQ ID NO: 102321 - RNA, 19 nt, Homo sapiens
cuucacagucauuggauua

SEQ ID NO: 102322 - RNA, 19 nt, Homo sapiens
gaaacacuacaucugcaau

SEQ ID NO: 102323 - RNA, 19 nt, Homo sapiens
acaaauggaacgcuuggaa

SEQ ID NO: 102324 - RNA, 19 nt, Homo sapiens
ucacagucauuggauuaau

SEQ ID NO: 102325 - RNA, 19 nt, Homo sapiens
uuucacaaguggaucgauu

SEQ ID NO: 102326 - RNA, 19 nt, Homo sapiens
cuagcaagcaggccaaaga

SEQ ID NO: 102327 - RNA, 19 nt, Homo sapiens
aaaguaaugguccaacaga

SEQ ID NO: 102328 - RNA, 19 nt, Homo sapiens
aaacaacagggcagcagaa

SEQ ID NO: 102329 - RNA, 19 nt, Homo sapiens
agaagaaugguaugcaaga

SEQ ID NO: 102330 - RNA, 19 nt, Homo sapiens
cugaaaguauccguaaaug

SEQ ID NO: 102331 - RNA, 19 nt, Homo sapiens
uuaugcagcuauuucacaa

SEQ ID NO: 102332 - RNA, 19 nt, Homo sapiens
uguuugugauugcauguuu

SEQ ID NO: 102333 - RNA, 19 nt, Homo sapiens
cuuuagaguuguucauugu

SEQ ID NO: 102334 - RNA, 19 nt, Homo sapiens
gaguaaugaauggugaaua

SEQ ID NO: 102335 - RNA, 19 nt, Homo sapiens
gggagaggaggaagaggaa

SEQ ID NO: 102336 - RNA, 19 nt, Homo sapiens
gcucuucacagucauugga

SEQ ID NO: 102337 - RNA, 19 nt, Homo sapiens
ggcaauaaaggagcuagaa

SEQ ID NO: 102338 - RNA, 19 nt, Homo sapiens
guugauggaguaaugaaug

SEQ ID NO: 102339 - RNA, 19 nt, Homo sapiens
gcauguuuccuuccuucaa

SEQ ID NO: 102340 - RNA, 19 nt, Homo sapiens
ucuuuagaguuguucauug

SEQ ID NO: 102341 - RNA, 19 nt, Homo sapiens
aaugaauggugaauacuac

SEQ ID NO: 102342 - RNA, 19 nt, Homo sapiens
ggcagcagaagaagccuuu

SEQ ID NO: 102343 - RNA, 19 nt, Homo sapiens
ccugaaaguauccguaaau

SEQ ID NO: 102344 - RNA, 19 nt, Homo sapiens
gccugaaaguauccguaaa

SEQ ID NO: 102345 - RNA, 19 nt, Homo sapiens
guucauuguuugugauugc

SEQ ID NO: 102346 - RNA, 19 nt, Homo sapiens
aacacuacaucugcaauau

SEQ ID NO: 102347 - RNA, 19 nt, Homo sapiens
ccugugcuucugugcauua

SEQ ID NO: 102348 - RNA, 19 nt, Homo sapiens
acagacaguuaugcagcua

SEQ ID NO: 102349 - RNA, 19 nt, Homo sapiens
ucuuaauccuacucaguga

SEQ ID NO: 102350 - RNA, 19 nt, Homo sapiens
cauguuuccuuccuucaac

SEQ ID NO: 102351 - RNA, 19 nt, Homo sapiens
gcaauaucuuaauccuacu

SEQ ID NO: 102352 - RNA, 19 nt, Homo sapiens
cgccauggcugagcuggau

SEQ ID NO: 102353 - RNA, 19 nt, Homo sapiens
ggaguaaugaauggugaau

SEQ ID NO: 102354 - RNA, 19 nt, Homo sapiens
ggagggagaggaggaagag

SEQ ID NO: 102355 - RNA, 19 nt, Homo sapiens
cagcagaagaagccuuugu

SEQ ID NO: 102356 - RNA, 19 nt, Homo sapiens
cuucugugcauuauucuga

SEQ ID NO: 102357 - RNA, 19 nt, Homo sapiens
acaguuaugcagcuauuuc

SEQ ID NO: 102358 - RNA, 19 nt, Homo sapiens
guuaugcagcuauuucaca

SEQ ID NO: 102359 - RNA, 19 nt, Homo sapiens
gaaaacaaaagcaaacaac

SEQ ID NO: 102360 - RNA, 19 nt, Homo sapiens
agaagcagaguggaaagaa

SEQ ID NO: 102361 - RNA, 19 nt, Homo sapiens
uaucuuaauccuacucagu

SEQ ID NO: 102362 - RNA, 19 nt, Homo sapiens
caagcaggccaaagauguc

SEQ ID NO: 102363 - RNA, 19 nt, Homo sapiens
gagcuagaagaaugguaug

SEQ ID NO: 102364 - RNA, 19 nt, Homo sapiens
ugaaaguauccguaaaugg

SEQ ID NO: 102365 - RNA, 19 nt, Homo sapiens
gaagaagccuuuguaaaug

SEQ ID NO: 102366 - RNA, 19 nt, Homo sapiens
uaaaggagcuagaagaaug

SEQ ID NO: 102367 - RNA, 19 nt, Homo sapiens
gaaaguauccguaaaugga

SEQ ID NO: 102368 - RNA, 19 nt, Homo sapiens
agaugaagcuuucuacaaa

SEQ ID NO: 102369 - RNA, 19 nt, Homo sapiens
gaagcagaguggaaagaaa

SEQ ID NO: 102370 - RNA, 19 nt, Homo sapiens
agaagaagccuuuguaaau

SEQ ID NO: 102371 - RNA, 19 nt, Homo sapiens
ggaaaguaaugguccaaca

SEQ ID NO: 102372 - RNA, 19 nt, Homo sapiens
gcagaagaagccuuuguaa

SEQ ID NO: 102373 - RNA, 19 nt, Homo sapiens
gcaagaagcagaguggaaa

SEQ ID NO: 102374 - RNA, 19 nt, Homo sapiens
ucgcugacgugauugguua

SEQ ID NO: 102375 - RNA, 19 nt, Homo sapiens
gagagaagaacaaauggaa

SEQ ID NO: 102376 - RNA, 19 nt, Homo sapiens
cuacaucugcaauaucuua

SEQ ID NO: 102377 - RNA, 19 nt, Homo sapiens
gcaagcaggccaaagaugu

SEQ ID NO: 102378 - RNA, 19 nt, Homo sapiens
aagaagccuuuguaaauga

SEQ ID NO: 102379 - RNA, 19 nt, Homo sapiens
caauaaaggagcuagaaga

SEQ ID NO: 102380 - RNA, 19 nt, Homo sapiens
gugcuucugugcauuauuc

SEQ ID NO: 102381 - RNA, 19 nt, Homo sapiens
cagaagaagccuuuguaaa

SEQ ID NO: 102382 - RNA, 19 nt, Homo sapiens
cacagucauuggauuaauu

SEQ ID NO: 102383 - RNA, 19 nt, Homo sapiens
ggacgagcagcuacagaaa

SEQ ID NO: 102384 - RNA, 19 nt, Homo sapiens
acaacaggguggcagauga

SEQ ID NO: 102385 - RNA, 19 nt, Homo sapiens
aaacacuacaucugcaaua

SEQ ID NO: 102386 - RNA, 19 nt, Homo sapiens
ggaaagaaaaggcaauaaa

SEQ ID NO: 102387 - RNA, 19 nt, Homo sapiens
ggugaauacuaccaggaaa

SEQ ID NO: 102388 - RNA, 19 nt, Homo sapiens
cuagaagaaugguaugcaa

SEQ ID NO: 102389 - RNA, 19 nt, Homo sapiens
caucugcaauaucuuaauc

SEQ ID NO: 102390 - RNA, 19 nt, Homo sapiens
gguggcagaugaagcuuuc

SEQ ID NO: 102391 - RNA, 19 nt, Homo sapiens
ggagcuagaagaaugguau

SEQ ID NO: 102392 - RNA, 19 nt, Homo sapiens
agacaguuaugcagcuauu

SEQ ID NO: 102393 - RNA, 19 nt, Homo sapiens
cagaugaagcuuucuacaa

SEQ ID NO: 102394 - RNA, 19 nt, Homo sapiens
caacaggguggcagaugaa

SEQ ID NO: 102395 - RNA, 19 nt, Homo sapiens
ggaugcuguugauggagua

SEQ ID NO: 102396 - RNA, 19 nt, Homo sapiens
gaugaagcuuucuacaaac

SEQ ID NO: 102397 - RNA, 19 nt, Homo sapiens
ccaauucucggaagcaaga

SEQ ID NO: 102398 - RNA, 19 nt, Homo sapiens
ggagagaagaacaaaugga

SEQ ID NO: 102399 - RNA, 19 nt, Homo sapiens
ggaaacacuacaucugcaa

SEQ ID NO: 102400 - RNA, 19 nt, Homo sapiens
gaagcuuucuacaaacaac

SEQ ID NO: 102401 - RNA, 19 nt, Homo sapiens
aauaaaggagcuagaagaa

SEQ ID NO: 102402 - RNA, 19 nt, Homo sapiens
ggaagcccuugaugccaau

SEQ ID NO: 102403 - RNA, 19 nt, Homo sapiens
gaaaguaaugguccaacag

SEQ ID NO: 102404 - RNA, 19 nt, Homo sapiens
gcagcaagagagcgagauu

SEQ ID NO: 102405 - RNA, 19 nt, Homo sapiens
acccuucgcugacgugauu

SEQ ID NO: 102406 - RNA, 19 nt, Homo sapiens
gaagaaugguaugcaagac

SEQ ID NO: 102407 - RNA, 19 nt, Homo sapiens
aguaaugaauggugaauac

SEQ ID NO: 102408 - RNA, 19 nt, Homo sapiens
uaaauggagagaagaacaa

SEQ ID NO: 102409 - RNA, 19 nt, Homo sapiens
guaaauggagagaagaaca

SEQ ID NO: 102410 - RNA, 19 nt, Homo sapiens
cacuacaucugcaauaucu

SEQ ID NO: 102411 - RNA, 19 nt, Homo sapiens
gcaauaaaggagcuagaag

SEQ ID NO: 102412 - RNA, 19 nt, Homo sapiens
gaaagaaaaggcaauaaag

SEQ ID NO: 102413 - RNA, 19 nt, Homo sapiens
uagaguuguucauuguuug

SEQ ID NO: 102414 - RNA, 19 nt, Homo sapiens
cuucacagucauuggauua

SEQ ID NO: 102415 - RNA, 19 nt, Homo sapiens
gaaacacuacaucugcaau

SEQ ID NO: 102416 - RNA, 19 nt, Homo sapiens
acauaaaccauccuugcua

SEQ ID NO: 102417 - RNA, 19 nt, Homo sapiens
acaaauggaacgcuuggaa

SEQ ID NO: 102418 - RNA, 19 nt, Homo sapiens
ucacagucauuggauuaau

SEQ ID NO: 102419 - RNA, 19 nt, Homo sapiens
uuucacaaguggaucgauu

SEQ ID NO: 102420 - RNA, 19 nt, Homo sapiens
cuagcaagcaggccaaaga

SEQ ID NO: 102421 - RNA, 19 nt, Homo sapiens
gaacaggcagcagaagaag

SEQ ID NO: 102422 - RNA, 19 nt, Homo sapiens
agaagaaugguaugcaaga

SEQ ID NO: 102423 - RNA, 19 nt, Homo sapiens
aaaguaaugguccaacaga

SEQ ID NO: 102424 - RNA, 19 nt, Homo sapiens
cugaaaguauccguaaaug

SEQ ID NO: 102425 - RNA, 19 nt, Homo sapiens
uuaugcagcuauuucacaa

SEQ ID NO: 102426 - RNA, 19 nt, Homo sapiens
uguuugugauugcauguuu

SEQ ID NO: 102427 - RNA, 19 nt, Homo sapiens
cuuuagaguuguucauugu

SEQ ID NO: 102428 - RNA, 19 nt, Homo sapiens
agaacaggcagcagaagaa

SEQ ID NO: 102429 - RNA, 19 nt, Homo sapiens
gaguaaugaauggugaaua

SEQ ID NO: 102430 - RNA, 19 nt, Homo sapiens
gcagaugaagcuuucuaca

SEQ ID NO: 102431 - RNA, 19 nt, Homo sapiens
gggagaggaggaagaggaa

SEQ ID NO: 102432 - RNA, 19 nt, Homo sapiens
gcucuucacagucauugga

SEQ ID NO: 102433 - RNA, 19 nt, Homo sapiens
guugauggaguaaugaaug

SEQ ID NO: 102434 - RNA, 19 nt, Homo sapiens
ggcaauaaaggagcuagaa

SEQ ID NO: 102435 - RNA, 19 nt, Homo sapiens
gcauguuuccuuccuucaa

SEQ ID NO: 102436 - RNA, 19 nt, Homo sapiens
ucuuuagaguuguucauug

SEQ ID NO: 102437 - RNA, 19 nt, Homo sapiens
aaugaauggugaauacuac

SEQ ID NO: 102438 - RNA, 19 nt, Homo sapiens
ugacgugauugguuauguc

SEQ ID NO: 102439 - RNA, 19 nt, Homo sapiens
ggcagcagaagaagccuuu

SEQ ID NO: 102440 - RNA, 19 nt, Homo sapiens
uagaacaggcagcagaaga

SEQ ID NO: 102441 - RNA, 19 nt, Homo sapiens
ccugaaaguauccguaaau

SEQ ID NO: 102442 - RNA, 19 nt, Homo sapiens
gccugaaaguauccguaaa

SEQ ID NO: 102443 - RNA, 19 nt, Homo sapiens
guucauuguuugugauugc

SEQ ID NO: 102444 - RNA, 19 nt, Homo sapiens
aacacuacaucugcaauau

SEQ ID NO: 102445 - RNA, 19 nt, Homo sapiens
ccugugcuucugugcauua

SEQ ID NO: 102446 - RNA, 19 nt, Homo sapiens
acagacaguuaugcagcua

SEQ ID NO: 102447 - RNA, 19 nt, Homo sapiens
ucuuaauccuacucaguga

SEQ ID NO: 102448 - RNA, 19 nt, Homo sapiens
cauguuuccuuccuucaac

SEQ ID NO: 102449 - RNA, 19 nt, Homo sapiens
gcaauaucuuaauccuacu

SEQ ID NO: 102450 - RNA, 19 nt, Homo sapiens
ggaguaaugaauggugaau

SEQ ID NO: 102451 - RNA, 19 nt, Homo sapiens
cgccauggcugagcuggau

SEQ ID NO: 102452 - RNA, 19 nt, Homo sapiens
ggagggagaggaggaagag

SEQ ID NO: 102453 - RNA, 19 nt, Homo sapiens
cagcagaagaagccuuugu

SEQ ID NO: 102454 - RNA, 19 nt, Homo sapiens
cuucugugcauuauucuga

SEQ ID NO: 102455 - RNA, 19 nt, Homo sapiens
guuaugcagcuauuucaca

SEQ ID NO: 102456 - RNA, 19 nt, Homo sapiens
acaguuaugcagcuauuuc

SEQ ID NO: 102457 - RNA, 19 nt, Homo sapiens
gaaaacaaaagcaaacaac

SEQ ID NO: 102458 - RNA, 19 nt, Homo sapiens
agaagcagaguggaaagaa

SEQ ID NO: 102459 - RNA, 19 nt, Homo sapiens
ugaaaguauccguaaaugg

SEQ ID NO: 102460 - RNA, 19 nt, Homo sapiens
uaucuuaauccuacucagu

SEQ ID NO: 102461 - RNA, 19 nt, Homo sapiens
caagcaggccaaagauguc

SEQ ID NO: 102462 - RNA, 19 nt, Homo sapiens
gauugguuaugucacaaac

SEQ ID NO: 102463 - RNA, 19 nt, Homo sapiens
augaagcuuucuacaaaca

SEQ ID NO: 102464 - RNA, 19 nt, Homo sapiens
gagcuagaagaaugguaug

SEQ ID NO: 102465 - RNA, 19 nt, Homo sapiens
gaaaauggcugaugacuuu

SEQ ID NO: 102466 - RNA, 19 nt, Homo sapiens
gagcgagauugcaggcaua

SEQ ID NO: 102467 - RNA, 19 nt, Homo sapiens
gcgccagagugaacaagua

SEQ ID NO: 102468 - RNA, 19 nt, Homo sapiens
caucuaaggucacggaaca

SEQ ID NO: 102469 - RNA, 19 nt, Homo sapiens
gaagguggcccagcuaugu

SEQ ID NO: 102470 - RNA, 19 nt, Homo sapiens
gugaacaaguagagaagaa

SEQ ID NO: 102471 - RNA, 19 nt, Homo sapiens
ggaaccagcgccagaguga

SEQ ID NO: 102472 - RNA, 19 nt, Homo sapiens
cgaggaggcuuucgugaag

SEQ ID NO: 102473 - RNA, 19 nt, Homo sapiens
gacugucccuccugaugua

SEQ ID NO: 102474 - RNA, 19 nt, Homo sapiens
gagaagaacaagaucaaca

SEQ ID NO: 102475 - RNA, 19 nt, Homo sapiens
gaacaaguagagaagaaca

SEQ ID NO: 102476 - RNA, 19 nt, Homo sapiens
gggagaaggccaagaagga

SEQ ID NO: 102477 - RNA, 19 nt, Homo sapiens
gcacagagugggagaaggu

SEQ ID NO: 102478 - RNA, 19 nt, Homo sapiens
gcagcaagcagugcaaaga

SEQ ID NO: 102479 - RNA, 19 nt, Homo sapiens
ucagucuacucaauuguga

SEQ ID NO: 102480 - RNA, 19 nt, Homo sapiens
gcaagcagugcaaagaugu

SEQ ID NO: 102481 - RNA, 19 nt, Homo sapiens
cuuaaaggguguguuguug

SEQ ID NO: 102482 - RNA, 19 nt, Homo sapiens
ggagaagguggcccagcua

SEQ ID NO: 102483 - RNA, 19 nt, Homo sapiens
gcuuaaaggguguguuguu

SEQ ID NO: 102484 - RNA, 19 nt, Homo sapiens
guagagaagaacaagauca

SEQ ID NO: 102485 - RNA, 19 nt, Homo sapiens
uaaaggguguguuguugac

SEQ ID NO: 102486 - RNA, 19 nt, Homo sapiens
gagauugcaggcauagaga

SEQ ID NO: 102487 - RNA, 19 nt, Homo sapiens
agaagaacaagaucaacaa

SEQ ID NO: 102488 - RNA, 19 nt, Homo sapiens
uaaggucacggaacaggaa

SEQ ID NO: 102489 - RNA, 19 nt, Homo sapiens
ggccaacgguccugcugau

SEQ ID NO: 102490 - RNA, 19 nt, Homo sapiens
gagaagguggcccagcuau

SEQ ID NO: 102491 - RNA, 19 nt, Homo sapiens
ugucccuccugauguauuu

SEQ ID NO: 102492 - RNA, 19 nt, Homo sapiens
cuaggugcauggccacaga

SEQ ID NO: 102493 - RNA, 19 nt, Homo sapiens
uagagaagaacaagaucaa

SEQ ID NO: 102494 - RNA, 19 nt, Homo sapiens
gcugaugacuuuggcuucu

SEQ ID NO: 102495 - RNA, 19 nt, Homo sapiens
ccagcuaugugacuucaac

SEQ ID NO: 102496 - RNA, 19 nt, Homo sapiens
gggcauccgaggaggcuuu

SEQ ID NO: 102497 - RNA, 19 nt, Homo sapiens
gaagaacaagaucaacaac

SEQ ID NO: 102498 - RNA, 19 nt, Homo sapiens
caauggagauguguuucag

SEQ ID NO: 102499 - RNA, 19 nt, Homo sapiens
ccucucagucuacucaauu

SEQ ID NO: 102500 - RNA, 19 nt, Homo sapiens
ccucacgccuccucucagu

SEQ ID NO: 102501 - RNA, 19 nt, Homo sapiens
agaggaaacggcugcaaga

SEQ ID NO: 102502 - RNA, 19 nt, Homo sapiens
uuaaaggguguguuguuga

SEQ ID NO: 102503 - RNA, 19 nt, Homo sapiens
gagcagcaagcagugcaaa

SEQ ID NO: 102504 - RNA, 19 nt, Homo sapiens
gcccagcuaugugacuuca

SEQ ID NO: 102505 - RNA, 19 nt, Homo sapiens
ccgaggaggcuuucgugaa

SEQ ID NO: 102506 - RNA, 19 nt, Homo sapiens
ggcgagaggagcagaggaa

SEQ ID NO: 102507 - RNA, 19 nt, Homo sapiens
caaguagagaagaacaaga

SEQ ID NO: 102508 - RNA, 19 nt, Homo sapiens
ugaugacuuuggcuucuuc

SEQ ID NO: 102509 - RNA, 19 nt, Homo sapiens
agagugaacaaguagagaa

SEQ ID NO: 102510 - RNA, 19 nt, Homo sapiens
ucaauggagauguguuuca

SEQ ID NO: 102511 - RNA, 19 nt, Homo sapiens
ucuacucaauugugacugu

SEQ ID NO: 102512 - RNA, 19 nt, Homo sapiens
gaaccagcgccagagugaa

SEQ ID NO: 102513 - RNA, 19 nt, Homo sapiens
ggcgggagaaggccaagaa

SEQ ID NO: 102514 - RNA, 19 nt, Homo sapiens
gagaggagcagaggaaacg

SEQ ID NO: 102515 - RNA, 19 nt, Homo sapiens
ccugagagcauccgcaagu

SEQ ID NO: 102516 - RNA, 19 nt, Homo sapiens
ugacugucccuccugaugu

SEQ ID NO: 102517 - RNA, 19 nt, Homo sapiens
agcaagcagugcaaagaug

SEQ ID NO: 102518 - RNA, 19 nt, Homo sapiens
cagcaagcagugcaaagau

SEQ ID NO: 102519 - RNA, 19 nt, Homo sapiens
ggaaaauggcugaugacuu

SEQ ID NO: 102520 - RNA, 19 nt, Homo sapiens
cgagauugcaggcauagag

SEQ ID NO: 102521 - RNA, 19 nt, Homo sapiens
uggcuuaaaggguguguug

SEQ ID NO: 102522 - RNA, 19 nt, Homo sapiens
agucaauggagauguguuu

SEQ ID NO: 102523 - RNA, 19 nt, Homo sapiens
gaccacagucaauggagau

SEQ ID NO: 102524 - RNA, 19 nt, Homo sapiens
gaaaauggcugaugacuuu

SEQ ID NO: 102525 - RNA, 19 nt, Homo sapiens
gagcgagauugcaggcaua

SEQ ID NO: 102526 - RNA, 19 nt, Homo sapiens
gcgccagagugaacaagua

SEQ ID NO: 102527 - RNA, 19 nt, Homo sapiens
caucuaaggucacggaaca

SEQ ID NO: 102528 - RNA, 19 nt, Homo sapiens
gaagguggcccagcuaugu

SEQ ID NO: 102529 - RNA, 19 nt, Homo sapiens
gugaacaaguagagaagaa

SEQ ID NO: 102530 - RNA, 19 nt, Homo sapiens
ggaaccagcgccagaguga

SEQ ID NO: 102531 - RNA, 19 nt, Homo sapiens
cgaggaggcuuucgugaag

SEQ ID NO: 102532 - RNA, 19 nt, Homo sapiens
gacugucccuccugaugua

SEQ ID NO: 102533 - RNA, 19 nt, Homo sapiens
gagaagaacaagaucaaca

SEQ ID NO: 102534 - RNA, 19 nt, Homo sapiens
gaacaaguagagaagaaca

SEQ ID NO: 102535 - RNA, 19 nt, Homo sapiens
gggagaaggccaagaagga

SEQ ID NO: 102536 - RNA, 19 nt, Homo sapiens
gcacagagugggagaaggu

SEQ ID NO: 102537 - RNA, 19 nt, Homo sapiens
gcagcaagcagugcaaaga

SEQ ID NO: 102538 - RNA, 19 nt, Homo sapiens
ucagucuacucaauuguga

SEQ ID NO: 102539 - RNA, 19 nt, Homo sapiens
ccggaucgcugacaaagca

SEQ ID NO: 102540 - RNA, 19 nt, Homo sapiens
gcaagcagugcaaagaugu

SEQ ID NO: 102541 - RNA, 19 nt, Homo sapiens
cuuaaaggguguguuguug

SEQ ID NO: 102542 - RNA, 19 nt, Homo sapiens
ggagaagguggcccagcua

SEQ ID NO: 102543 - RNA, 19 nt, Homo sapiens
gcuuaaaggguguguuguu

SEQ ID NO: 102544 - RNA, 19 nt, Homo sapiens
guagagaagaacaagauca

SEQ ID NO: 102545 - RNA, 19 nt, Homo sapiens
gagauugcaggcauagaga

SEQ ID NO: 102546 - RNA, 19 nt, Homo sapiens
agaagaacaagaucaacaa

SEQ ID NO: 102547 - RNA, 19 nt, Homo sapiens
uaaggucacggaacaggaa

SEQ ID NO: 102548 - RNA, 19 nt, Homo sapiens
ggccaacgguccugcugau

SEQ ID NO: 102549 - RNA, 19 nt, Homo sapiens
gagaagguggcccagcuau

SEQ ID NO: 102550 - RNA, 19 nt, Homo sapiens
ugucccuccugauguauuu

SEQ ID NO: 102551 - RNA, 19 nt, Homo sapiens
cuaggugcauggccacaga

SEQ ID NO: 102552 - RNA, 19 nt, Homo sapiens
uagagaagaacaagaucaa

SEQ ID NO: 102553 - RNA, 19 nt, Homo sapiens
gcugaugacuuuggcuucu

SEQ ID NO: 102554 - RNA, 19 nt, Homo sapiens
ccagcuaugugacuucaac

SEQ ID NO: 102555 - RNA, 19 nt, Homo sapiens
gaagaacaagaucaacaac

SEQ ID NO: 102556 - RNA, 19 nt, Homo sapiens
caaccggaucgcugacaaa

SEQ ID NO: 102557 - RNA, 19 nt, Homo sapiens
caauggagauguguuucag

SEQ ID NO: 102558 - RNA, 19 nt, Homo sapiens
ccucucagucuacucaauu

SEQ ID NO: 102559 - RNA, 19 nt, Homo sapiens
ccucacgccuccucucagu

SEQ ID NO: 102560 - RNA, 19 nt, Homo sapiens
agaggaaacggcugcaaga

SEQ ID NO: 102561 - RNA, 19 nt, Homo sapiens
gagcagcaagcagugcaaa

SEQ ID NO: 102562 - RNA, 19 nt, Homo sapiens
gcccagcuaugugacuuca

SEQ ID NO: 102563 - RNA, 19 nt, Homo sapiens
ccgaggaggcuuucgugaa

SEQ ID NO: 102564 - RNA, 19 nt, Homo sapiens
ggcgagaggagcagaggaa

SEQ ID NO: 102565 - RNA, 19 nt, Homo sapiens
caaguagagaagaacaaga

SEQ ID NO: 102566 - RNA, 19 nt, Homo sapiens
ugaugacuuuggcuucuuc

SEQ ID NO: 102567 - RNA, 19 nt, Homo sapiens
agagugaacaaguagagaa

SEQ ID NO: 102568 - RNA, 19 nt, Homo sapiens
ucaauggagauguguuuca

SEQ ID NO: 102569 - RNA, 19 nt, Homo sapiens
ucuacucaauugugacugu

SEQ ID NO: 102570 - RNA, 19 nt, Homo sapiens
gaaccagcgccagagugaa

SEQ ID NO: 102571 - RNA, 19 nt, Homo sapiens
ggcgggagaaggccaagaa

SEQ ID NO: 102572 - RNA, 19 nt, Homo sapiens
gagaggagcagaggaaacg

SEQ ID NO: 102573 - RNA, 19 nt, Homo sapiens
ccugagagcauccgcaagu

SEQ ID NO: 102574 - RNA, 19 nt, Homo sapiens
ugacugucccuccugaugu

SEQ ID NO: 102575 - RNA, 19 nt, Homo sapiens
agcaagcagugcaaagaug

SEQ ID NO: 102576 - RNA, 19 nt, Homo sapiens
cagcaagcagugcaaagau

SEQ ID NO: 102577 - RNA, 19 nt, Homo sapiens
ggaaaauggcugaugacuu

SEQ ID NO: 102578 - RNA, 19 nt, Homo sapiens
acaaccggaucgcugacaa

SEQ ID NO: 102579 - RNA, 19 nt, Homo sapiens
cgagauugcaggcauagag

SEQ ID NO: 102580 - RNA, 19 nt, Homo sapiens
uggcuuaaaggguguguug

SEQ ID NO: 102581 - RNA, 19 nt, Homo sapiens
agucaauggagauguguuu

SEQ ID NO: 102582 - RNA, 19 nt, Homo sapiens
gaccacagucaauggagau

SEQ ID NO: 102583 - RNA, 19 nt, Homo sapiens
gaaagaaucuguagagaaa

SEQ ID NO: 102584 - RNA, 19 nt, Homo sapiens
ggagggaaguuacauauua

SEQ ID NO: 102585 - RNA, 19 nt, Homo sapiens
gcaaugagcuguuugaaga

SEQ ID NO: 102586 - RNA, 19 nt, Homo sapiens
gggaagaacuggugaagua

SEQ ID NO: 102587 - RNA, 19 nt, Homo sapiens
ugacaaagguggauaaauu

SEQ ID NO: 102588 - RNA, 19 nt, Homo sapiens
gaagggcaauucaaagaua

SEQ ID NO: 102589 - RNA, 19 nt, Homo sapiens
ggaaauggaucucuuugaa

SEQ ID NO: 102590 - RNA, 19 nt, Homo sapiens
gggaauaguuucaauguuu

SEQ ID NO: 102591 - RNA, 19 nt, Homo sapiens
gcuaagagcugcagaacaa

SEQ ID NO: 102592 - RNA, 19 nt, Homo sapiens
ggaaggaaaugcagaagaa

SEQ ID NO: 102593 - RNA, 19 nt, Homo sapiens
caacaaauacgaauccuua

SEQ ID NO: 102594 - RNA, 19 nt, Homo sapiens
caacaaaucugugaaugaa

SEQ ID NO: 102595 - RNA, 19 nt, Homo sapiens
gaaagaagggcaauucaaa

SEQ ID NO: 102596 - RNA, 19 nt, Homo sapiens
gaagaagcauuugccauuu

SEQ ID NO: 102597 - RNA, 19 nt, Homo sapiens
gggcuaacgucccaaauaa

SEQ ID NO: 102598 - RNA, 19 nt, Homo sapiens
gcaaagagcaccaugauuc

SEQ ID NO: 102599 - RNA, 19 nt, Homo sapiens
gggaauguuuacugaauua

SEQ ID NO: 102600 - RNA, 19 nt, Homo sapiens
gagaauggcuguacguaau

SEQ ID NO: 102601 - RNA, 19 nt, Homo sapiens
caaaguaauugcacugaaa

SEQ ID NO: 102602 - RNA, 19 nt, Homo sapiens
gaauccagcuagcaaagua

SEQ ID NO: 102603 - RNA, 19 nt, Homo sapiens
ggugccagauuaucaauua

SEQ ID NO: 102604 - RNA, 19 nt, Homo sapiens
caacuacuuugguuccuua

SEQ ID NO: 102605 - RNA, 19 nt, Homo sapiens
ucagguggcuucuaaauau

SEQ ID NO: 102606 - RNA, 19 nt, Homo sapiens
gaaagugucucagcccauu

SEQ ID NO: 102607 - RNA, 19 nt, Homo sapiens
gcaaucagauguucacaca

SEQ ID NO: 102608 - RNA, 19 nt, Homo sapiens
gaugugguguucuugauaa

SEQ ID NO: 102609 - RNA, 19 nt, Homo sapiens
gcagaagaaucaacguuau

SEQ ID NO: 102610 - RNA, 19 nt, Homo sapiens
guacacguguuauggagua

SEQ ID NO: 102611 - RNA, 19 nt, Homo sapiens
gacaaagguggauaaauua

SEQ ID NO: 102612 - RNA, 19 nt, Homo sapiens
agggacagcucaacaaaua

SEQ ID NO: 102613 - RNA, 19 nt, Homo sapiens
cugcagaccuuccuaauga

SEQ ID NO: 102614 - RNA, 19 nt, Homo sapiens
guagaagacucccuagaau

SEQ ID NO: 102615 - RNA, 19 nt, Homo sapiens
guagaugucuuuauggaau

SEQ ID NO: 102616 - RNA, 19 nt, Homo sapiens
gauuguagaugucuuuaug

SEQ ID NO: 102617 - RNA, 19 nt, Homo sapiens
aaacuuggaucaccuaugu

SEQ ID NO: 102618 - RNA, 19 nt, Homo sapiens
ggagagauuucuucgugaa

SEQ ID NO: 102619 - RNA, 19 nt, Homo sapiens
ucacacagauuguagaugu

SEQ ID NO: 102620 - RNA, 19 nt, Homo sapiens
aagauaagcuggaauguuc

SEQ ID NO: 102621 - RNA, 19 nt, Homo sapiens
gcaguaugcuucugaaucu

SEQ ID NO: 102622 - RNA, 19 nt, Homo sapiens
gaacuauacuacagagcaa

SEQ ID NO: 102623 - RNA, 19 nt, Homo sapiens
gaagagagaaauucaaaca

SEQ ID NO: 102624 - RNA, 19 nt, Homo sapiens
gcaauacaguucuacuuag

SEQ ID NO: 102625 - RNA, 19 nt, Homo sapiens
gaaaggauccagaauugug

SEQ ID NO: 102626 - RNA, 19 nt, Homo sapiens
gaggauuacuugauguuga

SEQ ID NO: 102627 - RNA, 19 nt, Homo sapiens
gcaaaucaaagaaguagaa

SEQ ID NO: 102628 - RNA, 19 nt, Homo sapiens
ggacccagaugugcacuuu

SEQ ID NO: 102629 - RNA, 19 nt, Homo sapiens
gcagacagcgccaucauga

SEQ ID NO: 102630 - RNA, 19 nt, Homo sapiens
uuaaccgccuggauaauua

SEQ ID NO: 102631 - RNA, 19 nt, Homo sapiens
ggcaguggaugucuucuuu

SEQ ID NO: 102632 - RNA, 19 nt, Homo sapiens
gcagcuauauucuguagau

SEQ ID NO: 102633 - RNA, 19 nt, Homo sapiens
agaaaggaauggugaaaga

SEQ ID NO: 102634 - RNA, 19 nt, Homo sapiens
ucgaaaggauccagaauug

SEQ ID NO: 102635 - RNA, 19 nt, Homo sapiens
gaaguuggcacaccaccua

SEQ ID NO: 102636 - RNA, 19 nt, Homo sapiens
gagggaaguuacauauuau

SEQ ID NO: 102637 - RNA, 19 nt, Homo sapiens
acagacaacuugccugauu

SEQ ID NO: 102638 - RNA, 19 nt, Homo sapiens
gacaaauucaucugcauua

SEQ ID NO: 102639 - RNA, 19 nt, Homo sapiens
ggucaauucucuacugaug

SEQ ID NO: 102640 - RNA, 19 nt, Homo sapiens
gaauggcuguacguaauaa

SEQ ID NO: 102641 - RNA, 19 nt, Homo sapiens
ggcacaauaucauggauuu

SEQ ID NO: 102642 - RNA, 19 nt, Homo sapiens
ucaggagaauugcugcuua

SEQ ID NO: 102643 - RNA, 19 nt, Homo sapiens
ucaagccucuguuguuaaa

SEQ ID NO: 102644 - RNA, 19 nt, Homo sapiens
gaacacaggaaucugcaaa

SEQ ID NO: 102645 - RNA, 19 nt, Homo sapiens
uaacuuagccggugcugaa

SEQ ID NO: 102646 - RNA, 19 nt, Homo sapiens
gacccuacauuggcacuua

SEQ ID NO: 102647 - RNA, 19 nt, Homo sapiens
gaagauaagcuggaauguu

SEQ ID NO: 102648 - RNA, 19 nt, Homo sapiens
gaauacgguugcucuuguu

SEQ ID NO: 102649 - RNA, 19 nt, Homo sapiens
caacaaagacaacacuaau

SEQ ID NO: 102650 - RNA, 19 nt, Homo sapiens
guacugaaacaucgucuuu

SEQ ID NO: 102651 - RNA, 19 nt, Homo sapiens
gcagaacaagcucaucuuu

SEQ ID NO: 102652 - RNA, 19 nt, Homo sapiens
guaugaugcugcuaaguug

SEQ ID NO: 102653 - RNA, 19 nt, Homo sapiens
gaacguggccaaugugauc

SEQ ID NO: 102654 - RNA, 19 nt, Homo sapiens
gaaggucucuuuuauuuuc

SEQ ID NO: 102655 - RNA, 19 nt, Homo sapiens
uugaugcucugaagaauaa

SEQ ID NO: 102656 - RNA, 19 nt, Homo sapiens
uuucugggauccauuguua

SEQ ID NO: 102657 - RNA, 19 nt, Homo sapiens
guucacacccaucuucuua

SEQ ID NO: 102658 - RNA, 19 nt, Homo sapiens
ccaaagggaauucuucgua

SEQ ID NO: 102659 - RNA, 19 nt, Homo sapiens
ugaauuggcugaagaacuc

SEQ ID NO: 102660 - RNA, 19 nt, Homo sapiens
ggaaagaagggcaauucaa

SEQ ID NO: 102661 - RNA, 19 nt, Homo sapiens
uauauuaaccgccuggaua

SEQ ID NO: 102662 - RNA, 19 nt, Homo sapiens
gauuugacuuuguccauga

SEQ ID NO: 102663 - RNA, 19 nt, Homo sapiens
gaucagcuaccacuuauca

SEQ ID NO: 102664 - RNA, 19 nt, Homo sapiens
cagaugugcacuuuaaaua

SEQ ID NO: 102665 - RNA, 19 nt, Homo sapiens
gaagaauaaucgcccaucu

SEQ ID NO: 102666 - RNA, 19 nt, Homo sapiens
agccacagcuggaauaauu

SEQ ID NO: 102667 - RNA, 19 nt, Homo sapiens
gcccuuauguugugcugua

SEQ ID NO: 102668 - RNA, 19 nt, Homo sapiens
gaacugcucaauauucaau

SEQ ID NO: 102669 - RNA, 19 nt, Homo sapiens
gaacuuaucaacuacuauc

SEQ ID NO: 102670 - RNA, 19 nt, Homo sapiens
ugaagaagcauuugccauu

SEQ ID NO: 102671 - RNA, 19 nt, Homo sapiens
gaucuggaacuuauuaaug

SEQ ID NO: 102672 - RNA, 19 nt, Homo sapiens
gcaaacauuggcuucagua

SEQ ID NO: 102673 - RNA, 19 nt, Homo sapiens
gauguugacuguucugaag

SEQ ID NO: 102674 - RNA, 19 nt, Homo sapiens
agaaacaggucaaguccaa

SEQ ID NO: 102675 - RNA, 19 nt, Homo sapiens
gaagaacaagcuacagaga

SEQ ID NO: 102676 - RNA, 19 nt, Homo sapiens
agaacaagcucaucuuugg

SEQ ID NO: 102677 - RNA, 19 nt, Homo sapiens
aaaccgccuugcagaguua

SEQ ID NO: 102678 - RNA, 19 nt, Homo sapiens
gcagauggcccguaagaag

SEQ ID NO: 102679 - RNA, 19 nt, Homo sapiens
ucauugaacugcuggagaa

SEQ ID NO: 102680 - RNA, 19 nt, Homo sapiens
gaaaaucccuacuaugaca

SEQ ID NO: 102681 - RNA, 19 nt, Homo sapiens
gaaguagaaagaaucugua

SEQ ID NO: 102682 - RNA, 19 nt, Homo sapiens
gcagcuagcuuugcacagu

SEQ ID NO: 102683 - RNA, 19 nt, Homo sapiens
ggcagaagcuugagguuau

SEQ ID NO: 102684 - RNA, 19 nt, Homo sapiens
ucaccacgauaucauguua

SEQ ID NO: 102685 - RNA, 19 nt, Homo sapiens
gcagaagcuugagguuaua

SEQ ID NO: 102686 - RNA, 19 nt, Homo sapiens
gcaggaaggucuauaacag

SEQ ID NO: 102687 - RNA, 19 nt, Homo sapiens
uaacauaacagaggaagaa

SEQ ID NO: 102688 - RNA, 19 nt, Homo sapiens
ucacccgaaucucccauua

SEQ ID NO: 102689 - RNA, 19 nt, Homo sapiens
gcugacggcugcucauugu

SEQ ID NO: 102690 - RNA, 19 nt, Homo sapiens
cacgauaucauguuacuaa

SEQ ID NO: 102691 - RNA, 19 nt, Homo sapiens
cuacauggccuaccuggaa

SEQ ID NO: 102692 - RNA, 19 nt, Homo sapiens
gcaauuccgucauccaaaa

SEQ ID NO: 102693 - RNA, 19 nt, Homo sapiens
uguggugguuuccuuauaa

SEQ ID NO: 102694 - RNA, 19 nt, Homo sapiens
ccuuggagcccauaacaua

SEQ ID NO: 102695 - RNA, 19 nt, Homo sapiens
ucagagacuuugaccacaa

SEQ ID NO: 102696 - RNA, 19 nt, Homo sapiens
uauaacacuucuacucuuc

SEQ ID NO: 102697 - RNA, 19 nt, Homo sapiens
acacauggcagaagcuuga

SEQ ID NO: 102698 - RNA, 19 nt, Homo sapiens
gcaaucccaggaagacaaa

SEQ ID NO: 102699 - RNA, 19 nt, Homo sapiens
gauccugcaggcaaauuaa

SEQ ID NO: 102700 - RNA, 19 nt, Homo sapiens
uacuaaaguugaaggagaa

SEQ ID NO: 102701 - RNA, 19 nt, Homo sapiens
auaaagcaauuccgucauc

SEQ ID NO: 102702 - RNA, 19 nt, Homo sapiens
uggccuaccuggaaauugu

SEQ ID NO: 102703 - RNA, 19 nt, Homo sapiens
cagagacuuugaccacaau

SEQ ID NO: 102704 - RNA, 19 nt, Homo sapiens
caacggucccucaaaauuu

SEQ ID NO: 102705 - RNA, 19 nt, Homo sapiens
ccaucacaauucaacuuug

SEQ ID NO: 102706 - RNA, 19 nt, Homo sapiens
uggcagaagcuugagguua

SEQ ID NO: 102707 - RNA, 19 nt, Homo sapiens
gaagcuugagguuauaaag

SEQ ID NO: 102708 - RNA, 19 nt, Homo sapiens
cuuauaagacggaacuuug

SEQ ID NO: 102709 - RNA, 19 nt, Homo sapiens
uacauggccuaccuggaaa

SEQ ID NO: 102710 - RNA, 19 nt, Homo sapiens
cugcugcucuuucucuugu

SEQ ID NO: 102711 - RNA, 19 nt, Homo sapiens
cagccucucugggaagaug

SEQ ID NO: 102712 - RNA, 19 nt, Homo sapiens
gagcccauaacauaacaga

SEQ ID NO: 102713 - RNA, 19 nt, Homo sapiens
cccagggcaucguauccua

SEQ ID NO: 102714 - RNA, 19 nt, Homo sapiens
ggcaaucccaggaagacaa

SEQ ID NO: 102715 - RNA, 19 nt, Homo sapiens
gggcaucguauccuaugga

SEQ ID NO: 102716 - RNA, 19 nt, Homo sapiens
ggaaggucuauaacaguca

SEQ ID NO: 102717 - RNA, 19 nt, Homo sapiens
ggcagccucucugggaaga

SEQ ID NO: 102718 - RNA, 19 nt, Homo sapiens
cauaacagaggaagaagac

SEQ ID NO: 102719 - RNA, 19 nt, Homo sapiens
uuguggugguuuccuuaua

SEQ ID NO: 102720 - RNA, 19 nt, Homo sapiens
ccaacggucccucaaaauu

SEQ ID NO: 102721 - RNA, 19 nt, Homo sapiens
gcagccacuucagagacuu

SEQ ID NO: 102722 - RNA, 19 nt, Homo sapiens
cagaagcuugagguuauaa

SEQ ID NO: 102723 - RNA, 19 nt, Homo sapiens
caggaaggucuauaacagu

SEQ ID NO: 102724 - RNA, 19 nt, Homo sapiens
gaaaauacaugacguacuu

SEQ ID NO: 102725 - RNA, 19 nt, Homo sapiens
gaaccgagcugacauuuug

SEQ ID NO: 102726 - RNA, 19 nt, Homo sapiens
gauaaacuaugaggacauu

SEQ ID NO: 102727 - RNA, 19 nt, Homo sapiens
ucugagaucuguugauuga

SEQ ID NO: 102728 - RNA, 19 nt, Homo sapiens
gaaaugacgcaaagugaga

SEQ ID NO: 102729 - RNA, 19 nt, Homo sapiens
gcaaacgcccuucuggaaa

SEQ ID NO: 102730 - RNA, 19 nt, Homo sapiens
ucugagaauuguugagaua

SEQ ID NO: 102731 - RNA, 19 nt, Homo sapiens
aaacacaccuggcuucucu

SEQ ID NO: 102732 - RNA, 19 nt, Homo sapiens
ugagaucuguugauugaug

SEQ ID NO: 102733 - RNA, 19 nt, Homo sapiens
gaauggacacuuacagaug

SEQ ID NO: 102734 - RNA, 19 nt, Homo sapiens
ccacaagccaguugaaaga

SEQ ID NO: 102735 - RNA, 19 nt, Homo sapiens
gagaucuguugauugauga

SEQ ID NO: 102736 - RNA, 19 nt, Homo sapiens
ccgccgugcugguuaauuu

SEQ ID NO: 102737 - RNA, 19 nt, Homo sapiens
gagaauuguugagauacuu

SEQ ID NO: 102738 - RNA, 19 nt, Homo sapiens
uguacagaauggacacuua

SEQ ID NO: 102739 - RNA, 19 nt, Homo sapiens
cagcugagguuugcacuuc

SEQ ID NO: 102740 - RNA, 19 nt, Homo sapiens
gcacagugacuucugagau

SEQ ID NO: 102741 - RNA, 19 nt, Homo sapiens
ggcaaacgcccuucuggaa

SEQ ID NO: 102742 - RNA, 19 nt, Homo sapiens
ggaagaacagaaagugguu

SEQ ID NO: 102743 - RNA, 19 nt, Homo sapiens
gcauggaacacuucgaguu

SEQ ID NO: 102744 - RNA, 19 nt, Homo sapiens
acaaggaaaugacgcaaag

SEQ ID NO: 102745 - RNA, 19 nt, Homo sapiens
acaagccaguugaaagaaa

SEQ ID NO: 102746 - RNA, 19 nt, Homo sapiens
gggcugacaucgccaacau

SEQ ID NO: 102747 - RNA, 19 nt, Homo sapiens
uaaacuaugaggacauuga

SEQ ID NO: 102748 - RNA, 19 nt, Homo sapiens
cuucugagaucuguugauu

SEQ ID NO: 102749 - RNA, 19 nt, Homo sapiens
gugcugcgaucaccacuca

SEQ ID NO: 102750 - RNA, 19 nt, Homo sapiens
ccagcucacucaucaaugg

SEQ ID NO: 102751 - RNA, 19 nt, Homo sapiens
aggaagugauaaacuauga

SEQ ID NO: 102752 - RNA, 19 nt, Homo sapiens
caaacgcccuucuggaaaa

SEQ ID NO: 102753 - RNA, 19 nt, Homo sapiens
aggacaaccuggacaaguu

SEQ ID NO: 102754 - RNA, 19 nt, Homo sapiens
agaaggugcugcaggacaa

SEQ ID NO: 102755 - RNA, 19 nt, Homo sapiens
gugaugaaggucuccauaa

SEQ ID NO: 102756 - RNA, 19 nt, Homo sapiens
cgagcugauucaaguugua

SEQ ID NO: 102757 - RNA, 19 nt, Homo sapiens
gaaccacaagccaguugaa

SEQ ID NO: 102758 - RNA, 19 nt, Homo sapiens
ggaccggcacgucuucauu

SEQ ID NO: 102759 - RNA, 19 nt, Homo sapiens
aguagucccugcacaguga

SEQ ID NO: 102760 - RNA, 19 nt, Homo sapiens
ugauucaaguuguacagaa

SEQ ID NO: 102761 - RNA, 19 nt, Homo sapiens
ucauccagcucacucauca

SEQ ID NO: 102762 - RNA, 19 nt, Homo sapiens
cacagugacuucugagauc

SEQ ID NO: 102763 - RNA, 19 nt, Homo sapiens
aauggacacuuacagaugu

SEQ ID NO: 102764 - RNA, 19 nt, Homo sapiens
agagcaagauccuguccaa

SEQ ID NO: 102765 - RNA, 19 nt, Homo sapiens
cagaauggacacuuacaga

SEQ ID NO: 102766 - RNA, 19 nt, Homo sapiens
ggagcuaggacuacuaugg

SEQ ID NO: 102767 - RNA, 19 nt, Homo sapiens
uuacugcucugagaauugu

SEQ ID NO: 102768 - RNA, 19 nt, Homo sapiens
gaggagcuaggacuacuau

SEQ ID NO: 102769 - RNA, 19 nt, Homo sapiens
cggcacgucuucauugauc

SEQ ID NO: 102770 - RNA, 19 nt, Homo sapiens
cauguggacuggugcaagu

SEQ ID NO: 102771 - RNA, 19 nt, Homo sapiens
gcgaggaggagaccgaaga

SEQ ID NO: 102772 - RNA, 19 nt, Homo sapiens
acagaaagugguugcguuu

SEQ ID NO: 102773 - RNA, 19 nt, Homo sapiens
caaggaagaacagaaagug

SEQ ID NO: 102774 - RNA, 19 nt, Homo sapiens
gaaaaucugagacaggaaa

SEQ ID NO: 102775 - RNA, 19 nt, Homo sapiens
gaccggcacgucuucauug

SEQ ID NO: 102776 - RNA, 19 nt, Homo sapiens
ugaugaaggucuccauaac

SEQ ID NO: 102777 - RNA, 19 nt, Homo sapiens
gcucugagaauuguugaga

SEQ ID NO: 102778 - RNA, 19 nt, Homo sapiens
ucagauugcuccccaaaga

SEQ ID NO: 102779 - RNA, 19 nt, Homo sapiens
cauucagacuccaaacaga

SEQ ID NO: 102780 - RNA, 19 nt, Homo sapiens
agacagucguucccagugu

SEQ ID NO: 102781 - RNA, 19 nt, Homo sapiens
gcaaagcaggaaggacuga

SEQ ID NO: 102782 - RNA, 19 nt, Homo sapiens
gagcugacaccaggauuca

SEQ ID NO: 102783 - RNA, 19 nt, Homo sapiens
caggagaggcgggaagauu

SEQ ID NO: 102784 - RNA, 19 nt, Homo sapiens
uaucguaugacuccacuug

SEQ ID NO: 102785 - RNA, 19 nt, Homo sapiens
ugacuucugagaucuguug

SEQ ID NO: 102786 - RNA, 19 nt, Homo sapiens
guccaaggaagaacagaaa

SEQ ID NO: 102787 - RNA, 19 nt, Homo sapiens
ggaaccacaagccaguuga

SEQ ID NO: 102788 - RNA, 19 nt, Homo sapiens
ucgccaacaucugcaauga

SEQ ID NO: 102789 - RNA, 19 nt, Homo sapiens
ccacagaccaugucaucgu

SEQ ID NO: 102790 - RNA, 19 nt, Homo sapiens
aaucugagacaggaaauga

SEQ ID NO: 102791 - RNA, 19 nt, Homo sapiens
caagccaguugaaagaaaa

SEQ ID NO: 102792 - RNA, 19 nt, Homo sapiens
gacggaguccuguguuugu

SEQ ID NO: 102793 - RNA, 19 nt, Homo sapiens
guacagaauggacacuuac

SEQ ID NO: 102794 - RNA, 19 nt, Homo sapiens
uggcgcugccugugucuua

SEQ ID NO: 102795 - RNA, 19 nt, Homo sapiens
cgugcacacucucaacuuc

SEQ ID NO: 102796 - RNA, 19 nt, Homo sapiens
acacuuccgugcacacucu

SEQ ID NO: 102797 - RNA, 19 nt, Homo sapiens
aggagaggcgggaagauuu

SEQ ID NO: 102798 - RNA, 19 nt, Homo sapiens
agucacgcaugcaguguug

SEQ ID NO: 102799 - RNA, 19 nt, Homo sapiens
guggacuggugcaaguuga

SEQ ID NO: 102800 - RNA, 19 nt, Homo sapiens
cugacggaguccuguguuu

SEQ ID NO: 102801 - RNA, 19 nt, Homo sapiens
ccaaggaagaacagaaagu

SEQ ID NO: 102802 - RNA, 19 nt, Homo sapiens
gcagagcugacaccaggau

SEQ ID NO: 102803 - RNA, 19 nt, Homo sapiens
ugagaauuguugagauacu

SEQ ID NO: 102804 - RNA, 19 nt, Homo sapiens
gcauucagacuccaaacag

SEQ ID NO: 102805 - RNA, 19 nt, Homo sapiens
gaaaaggaagugauaaacu

SEQ ID NO: 102806 - RNA, 19 nt, Homo sapiens
ucacugcggccucaaccuu

SEQ ID NO: 102807 - RNA, 19 nt, Homo sapiens
ccugcacagugacuucuga

SEQ ID NO: 102808 - RNA, 19 nt, Homo sapiens
ggaggagaaacaggacuug

SEQ ID NO: 102809 - RNA, 19 nt, Homo sapiens
accacgagcugauucaagu

SEQ ID NO: 102810 - RNA, 19 nt, Homo sapiens
gggaaccacaagccaguug

SEQ ID NO: 102811 - RNA, 19 nt, Homo sapiens
gugagccgauuguccuauc

SEQ ID NO: 102812 - RNA, 19 nt, Homo sapiens
ccugggcuuuggucagauu

SEQ ID NO: 102813 - RNA, 19 nt, Homo sapiens
gugguugcguuucaugagu

SEQ ID NO: 102814 - RNA, 19 nt, Homo sapiens
gacccaguccagcaccuuu

SEQ ID NO: 102815 - RNA, 19 nt, Homo sapiens
ugacggaguccuguguuug

SEQ ID NO: 102816 - RNA, 19 nt, Homo sapiens
ggagaggcgggaagauuuu

SEQ ID NO: 102817 - RNA, 19 nt, Homo sapiens
gaggcgaagagccgacuug

SEQ ID NO: 102818 - RNA, 19 nt, Homo sapiens
cccaaggccuacagacaca

SEQ ID NO: 102819 - RNA, 19 nt, Homo sapiens
uuacagauguguggaaaau

SEQ ID NO: 102820 - RNA, 19 nt, Homo sapiens
caggcuuaguaucguauga

SEQ ID NO: 102821 - RNA, 19 nt, Homo sapiens
aaauacaugacguacuuga

SEQ ID NO: 102822 - RNA, 19 nt, Homo sapiens
aggaaaugacgcaaaguga

SEQ ID NO: 102823 - RNA, 19 nt, Homo sapiens
cgugaugaaggucuccaua

SEQ ID NO: 102824 - RNA, 19 nt, Homo sapiens
caagcaagauuucagauuu

SEQ ID NO: 102825 - RNA, 19 nt, Homo sapiens
gggagacacugauguauga

SEQ ID NO: 102826 - RNA, 19 nt, Homo sapiens
caaguugggugauauguug

SEQ ID NO: 102827 - RNA, 19 nt, Homo sapiens
gcacgggccauaugaauaa

SEQ ID NO: 102828 - RNA, 19 nt, Homo sapiens
guagaaagaagaugaauga

SEQ ID NO: 102829 - RNA, 19 nt, Homo sapiens
ggacucaucauuuccauuu

SEQ ID NO: 102830 - RNA, 19 nt, Homo sapiens
ccacagaguuugacuaugg

SEQ ID NO: 102831 - RNA, 19 nt, Homo sapiens
ggauagagagggaauguaa

SEQ ID NO: 102832 - RNA, 19 nt, Homo sapiens
uaacauggugugcuucuua

SEQ ID NO: 102833 - RNA, 19 nt, Homo sapiens
caucuaagccuucugguuu

SEQ ID NO: 102834 - RNA, 19 nt, Homo sapiens
gaacuuggaaauagugauu

SEQ ID NO: 102835 - RNA, 19 nt, Homo sapiens
acacagggauuauaaagau

SEQ ID NO: 102836 - RNA, 19 nt, Homo sapiens
guugagaccuaacgagaaa

SEQ ID NO: 102837 - RNA, 19 nt, Homo sapiens
ggugauauguugguagauu

SEQ ID NO: 102838 - RNA, 19 nt, Homo sapiens
gggagggacucaucauuuc

SEQ ID NO: 102839 - RNA, 19 nt, Homo sapiens
gagaagggcuuggacucaa

SEQ ID NO: 102840 - RNA, 19 nt, Homo sapiens
ugaauaacauggugugcuu

SEQ ID NO: 102841 - RNA, 19 nt, Homo sapiens
agaaagcccuuaggaagaa

SEQ ID NO: 102842 - RNA, 19 nt, Homo sapiens
ggaccuggcugugcaagug

SEQ ID NO: 102843 - RNA, 19 nt, Homo sapiens
gagcagagcagacauuugg

SEQ ID NO: 102844 - RNA, 19 nt, Homo sapiens
caaaugagaagaaauccaa

SEQ ID NO: 102845 - RNA, 19 nt, Homo sapiens
ggugagagguuccggaagu

SEQ ID NO: 102846 - RNA, 19 nt, Homo sapiens
ggacuaaguguaccagaga

SEQ ID NO: 102847 - RNA, 19 nt, Homo sapiens
gaaccucuuugggcuggua

SEQ ID NO: 102848 - RNA, 19 nt, Homo sapiens
gagagaagccgggauggaa

SEQ ID NO: 102849 - RNA, 19 nt, Homo sapiens
caagauuucagauuuguga

SEQ ID NO: 102850 - RNA, 19 nt, Homo sapiens
gaccugcucuuccuguuca

SEQ ID NO: 102851 - RNA, 19 nt, Homo sapiens
cggaagaguugagaccuaa

SEQ ID NO: 102852 - RNA, 19 nt, Homo sapiens
ccaauuaaacccaguagug

SEQ ID NO: 102853 - RNA, 19 nt, Homo sapiens
acaaagacuucacggacaa

SEQ ID NO: 102854 - RNA, 19 nt, Homo sapiens
ucaccagcaucaucauuug

SEQ ID NO: 102855 - RNA, 19 nt, Homo sapiens
aagcaagauuucagauuug

SEQ ID NO: 102856 - RNA, 19 nt, Homo sapiens
gaccacagaguuugacuau

SEQ ID NO: 102857 - RNA, 19 nt, Homo sapiens
cgacugccaucuuggacuu

SEQ ID NO: 102858 - RNA, 19 nt, Homo sapiens
gaccuaacgagaaauagaa

SEQ ID NO: 102859 - RNA, 19 nt, Homo sapiens
gaccaaaugagaagaaauc

SEQ ID NO: 102860 - RNA, 19 nt, Homo sapiens
gggcugguauugccuuugu

SEQ ID NO: 102861 - RNA, 19 nt, Homo sapiens
acugugggcuccauucaaa

SEQ ID NO: 102862 - RNA, 19 nt, Homo sapiens
cauaggaggccaacccaaa

SEQ ID NO: 102863 - RNA, 19 nt, Homo sapiens
aaagcuguccguuugauuu

SEQ ID NO: 102864 - RNA, 19 nt, Homo sapiens
gacucaucauuuccauuua

SEQ ID NO: 102865 - RNA, 19 nt, Homo sapiens
gggcuaagcacgggccaua

SEQ ID NO: 102866 - RNA, 19 nt, Homo sapiens
ggugaugccauguguaaga

SEQ ID NO: 102867 - RNA, 19 nt, Homo sapiens
ucauuggccugguuggaaa

SEQ ID NO: 102868 - RNA, 19 nt, Homo sapiens
ugacacgaccacagaguuu

SEQ ID NO: 102869 - RNA, 19 nt, Homo sapiens
gugagagguuccggaagua

SEQ ID NO: 102870 - RNA, 19 nt, Homo sapiens
gaucuacgccuucguuggu

SEQ ID NO: 102871 - RNA, 19 nt, Homo sapiens
ugagaccuaacgagaaaua

SEQ ID NO: 102872 - RNA, 19 nt, Homo sapiens
gagaguggaagcuguuuca

SEQ ID NO: 102873 - RNA, 19 nt, Homo sapiens
ggguugguuucccuucuuu

SEQ ID NO: 102874 - RNA, 19 nt, Homo sapiens
auagugauuuccacaguga

SEQ ID NO: 102875 - RNA, 19 nt, Homo sapiens
acugauguaugaggaauuu

SEQ ID NO: 102876 - RNA, 19 nt, Homo sapiens
ucagauuugugaccauuag

SEQ ID NO: 102877 - RNA, 19 nt, Homo sapiens
cuaagacgaccaaaugaga

SEQ ID NO: 102878 - RNA, 19 nt, Homo sapiens
uaagauccucucuggguuu

SEQ ID NO: 102879 - RNA, 19 nt, Homo sapiens
acuacaaguugaaggauga

SEQ ID NO: 102880 - RNA, 19 nt, Homo sapiens
gcuaagcacgggccauaug

SEQ ID NO: 102881 - RNA, 19 nt, Homo sapiens
caugggagacacugaugua

SEQ ID NO: 102882 - RNA, 19 nt, Homo sapiens
aagaaagcccuuaggaaga

SEQ ID NO: 102883 - RNA, 19 nt, Homo sapiens
gugauauguugguagauuc

SEQ ID NO: 102884 - RNA, 19 nt, Homo sapiens
aacauggugugcuucuuaa

SEQ ID NO: 102885 - RNA, 19 nt, Homo sapiens
ucaagcaagauuucagauu

SEQ ID NO: 102886 - RNA, 19 nt, Homo sapiens
gagacugggacuaagugua

SEQ ID NO: 102887 - RNA, 19 nt, Homo sapiens
uaagacgaccaaaugagaa

SEQ ID NO: 102888 - RNA, 19 nt, Homo sapiens
gaaagcccuuaggaagaau

SEQ ID NO: 102889 - RNA, 19 nt, Homo sapiens
gggaacauagaacucauga

SEQ ID NO: 102890 - RNA, 19 nt, Homo sapiens
gacuaaguguaccagagaa

SEQ ID NO: 102891 - RNA, 19 nt, Homo sapiens
gcaucuaccuccugaaccu

SEQ ID NO: 102892 - RNA, 19 nt, Homo sapiens
gaaucucucuucuuuucaa

SEQ ID NO: 102893 - RNA, 19 nt, Homo sapiens
ccucuguacuccuugguau

SEQ ID NO: 102894 - RNA, 19 nt, Homo sapiens
ugaggaauuucuguucuuc

SEQ ID NO: 102895 - RNA, 19 nt, Homo sapiens
cacgaaagccuacgagagu

SEQ ID NO: 102896 - RNA, 19 nt, Homo sapiens
caugccaggcuuauacuuu

SEQ ID NO: 102897 - RNA, 19 nt, Homo sapiens
aaacaugaccagcaucuac

SEQ ID NO: 102898 - RNA, 19 nt, Homo sapiens
ggauuugggcucuuggaau

SEQ ID NO: 102899 - RNA, 19 nt, Homo sapiens
cugcuaagacgaccaaaug

SEQ ID NO: 102900 - RNA, 19 nt, Homo sapiens
gcccagaaacaaagacuuc

SEQ ID NO: 102901 - RNA, 19 nt, Homo sapiens
ccacuucccacuauugcuu

SEQ ID NO: 102902 - RNA, 19 nt, Homo sapiens
gaacuucuccccugguaga

SEQ ID NO: 102903 - RNA, 19 nt, Homo sapiens
cacagggauuauaaagauu

SEQ ID NO: 102904 - RNA, 19 nt, Homo sapiens
aaaggaagcaggguugguu

SEQ ID NO: 102905 - RNA, 19 nt, Homo sapiens
cuaacgagaaauagaaaug

SEQ ID NO: 102906 - RNA, 19 nt, Homo sapiens
gguagaaagaagaugaaug

SEQ ID NO: 102907 - RNA, 19 nt, Homo sapiens
ugggugauauguugguaga

SEQ ID NO: 102908 - RNA, 19 nt, Homo sapiens
gaagaugaaugagcaaaac

SEQ ID NO: 102909 - RNA, 19 nt, Homo sapiens
gauucuaauggcuuuauug

SEQ ID NO: 102910 - RNA, 19 nt, Homo sapiens
cuaagcacgggccauauga

SEQ ID NO: 102911 - RNA, 19 nt, Homo sapiens
acggaagaguugagaccua

SEQ ID NO: 102912 - RNA, 19 nt, Homo sapiens
uagaacucaugacggaaga

SEQ ID NO: 102913 - RNA, 19 nt, Homo sapiens
uaugaggaauuucuguucu

SEQ ID NO: 102914 - RNA, 19 nt, Homo sapiens
guaugaggaauuucuguuc

SEQ ID NO: 102915 - RNA, 19 nt, Homo sapiens
ucacccacuucccacuauu

SEQ ID NO: 102916 - RNA, 19 nt, Homo sapiens
ggacucaagcaagauuuca

SEQ ID NO: 102917 - RNA, 19 nt, Homo sapiens
gauagagagggaauguaau

SEQ ID NO: 102918 - RNA, 19 nt, Homo sapiens
ccagccagguucugacucu

SEQ ID NO: 102919 - RNA, 19 nt, Homo sapiens
caaacaccacagaggacua

SEQ ID NO: 102920 - RNA, 19 nt, Homo sapiens
gcaagugacggaggugauc

SEQ ID NO: 102921 - RNA, 19 nt, Homo sapiens
gcuacacagggauuauaaa

SEQ ID NO: 102922 - RNA, 19 nt, Homo sapiens
gcaguggaacuaagaaagc

SEQ ID NO: 102923 - RNA, 19 nt, Homo sapiens
uuugugaccauuagcauuu

SEQ ID NO: 102924 - RNA, 19 nt, Homo sapiens
gcuuugagcuuaagaauuu

SEQ ID NO: 102925 - RNA, 19 nt, Homo sapiens
caaauuggcuucuaaucaa

SEQ ID NO: 102926 - RNA, 19 nt, Homo sapiens
gaaagugacuacacaagga

SEQ ID NO: 102927 - RNA, 19 nt, Homo sapiens
ccacgaggauggaauaauu

SEQ ID NO: 102928 - RNA, 19 nt, Homo sapiens
ggacagagcagaacuuuca

SEQ ID NO: 102929 - RNA, 19 nt, Homo sapiens
gaacagagaaaguggauug

SEQ ID NO: 102930 - RNA, 19 nt, Homo sapiens
gcucuuggcuguaggauug

SEQ ID NO: 102931 - RNA, 19 nt, Homo sapiens
guaaugaugucguuugaau

SEQ ID NO: 102932 - RNA, 19 nt, Homo sapiens
gaacuuucaccuucauaua

SEQ ID NO: 102933 - RNA, 19 nt, Homo sapiens
gaaggagccuagagacaga

SEQ ID NO: 102934 - RNA, 19 nt, Homo sapiens
guaaagaguuaguuugagu

SEQ ID NO: 102935 - RNA, 19 nt, Homo sapiens
ggaaagaaugugaaaguga

SEQ ID NO: 102936 - RNA, 19 nt, Homo sapiens
ccacauggcuaaagaaggu

SEQ ID NO: 102937 - RNA, 19 nt, Homo sapiens
gaagucaugcguuuaauca

SEQ ID NO: 102938 - RNA, 19 nt, Homo sapiens
gacuauggcucuacuuuca

SEQ ID NO: 102939 - RNA, 19 nt, Homo sapiens
gccacaagcugaacagaga

SEQ ID NO: 102940 - RNA, 19 nt, Homo sapiens
gagaagcucccugaaguaa

SEQ ID NO: 102941 - RNA, 19 nt, Homo sapiens
ggcauagaguucagacuuu

SEQ ID NO: 102942 - RNA, 19 nt, Homo sapiens
caucaucuaugccuucguu

SEQ ID NO: 102943 - RNA, 19 nt, Homo sapiens
caggaaucaucuuuacuaa

SEQ ID NO: 102944 - RNA, 19 nt, Homo sapiens
ccaggaaucaucuuuacua

SEQ ID NO: 102945 - RNA, 19 nt, Homo sapiens
gaguugcuaucaugucaaa

SEQ ID NO: 102946 - RNA, 19 nt, Homo sapiens
caaagaaggagccuagaga

SEQ ID NO: 102947 - RNA, 19 nt, Homo sapiens
agacagaaaugacagaucu

SEQ ID NO: 102948 - RNA, 19 nt, Homo sapiens
ggcggaaucuucuucauca

SEQ ID NO: 102949 - RNA, 19 nt, Homo sapiens
gaacuccuaaaucaaauug

SEQ ID NO: 102950 - RNA, 19 nt, Homo sapiens
agagauaauucuagcuuug

SEQ ID NO: 102951 - RNA, 19 nt, Homo sapiens
ggagugagaccaggaaaga

SEQ ID NO: 102952 - RNA, 19 nt, Homo sapiens
ucaccaucaugauuguuua

SEQ ID NO: 102953 - RNA, 19 nt, Homo sapiens
caagugugaucaccugguu

SEQ ID NO: 102954 - RNA, 19 nt, Homo sapiens
ccaggcaacuugggaacua

SEQ ID NO: 102955 - RNA, 19 nt, Homo sapiens
gaagcucccugaaguaagc

SEQ ID NO: 102956 - RNA, 19 nt, Homo sapiens
gaauacaggcauagaguuc

SEQ ID NO: 102957 - RNA, 19 nt, Homo sapiens
ggccaucucugaucugcuu

SEQ ID NO: 102958 - RNA, 19 nt, Homo sapiens
cgagagcggugaagaaguc

SEQ ID NO: 102959 - RNA, 19 nt, Homo sapiens
ugauggugaugaaauguaa

SEQ ID NO: 102960 - RNA, 19 nt, Homo sapiens
gaaucuuggugucuacguu

SEQ ID NO: 102961 - RNA, 19 nt, Homo sapiens
gcaucaaucccaucaucua

SEQ ID NO: 102962 - RNA, 19 nt, Homo sapiens
cagagauaauucuagcuuu

SEQ ID NO: 102963 - RNA, 19 nt, Homo sapiens
guaaaugugguaaagaguu

SEQ ID NO: 102964 - RNA, 19 nt, Homo sapiens
gagaaguucagaagccuuu

SEQ ID NO: 102965 - RNA, 19 nt, Homo sapiens
ucaaauuggcuucuaauca

SEQ ID NO: 102966 - RNA, 19 nt, Homo sapiens
caacgagagcggugaagaa

SEQ ID NO: 102967 - RNA, 19 nt, Homo sapiens
agagucaucuucaccauca

SEQ ID NO: 102968 - RNA, 19 nt, Homo sapiens
gcaaugugcaaauuauuca

SEQ ID NO: 102969 - RNA, 19 nt, Homo sapiens
ggugcucccugucauaaau

SEQ ID NO: 102970 - RNA, 19 nt, Homo sapiens
gcagaacuuucaccuucau

SEQ ID NO: 102971 - RNA, 19 nt, Homo sapiens
ucacacgucuggcuucaca

SEQ ID NO: 102972 - RNA, 19 nt, Homo sapiens
gaucucugcuuuggaaauc

SEQ ID NO: 102973 - RNA, 19 nt, Homo sapiens
gcagugagagucaucuuca

SEQ ID NO: 102974 - RNA, 19 nt, Homo sapiens
gcuggucguccucaucuua

SEQ ID NO: 102975 - RNA, 19 nt, Homo sapiens
agugggaacuccuaaauca

SEQ ID NO: 102976 - RNA, 19 nt, Homo sapiens
uugagcaggugguauguuu

SEQ ID NO: 102977 - RNA, 19 nt, Homo sapiens
gagauaauucuagcuuuga

SEQ ID NO: 102978 - RNA, 19 nt, Homo sapiens
uguaucacaucgguuauuu

SEQ ID NO: 102979 - RNA, 19 nt, Homo sapiens
gugcuugacugacauuuac

SEQ ID NO: 102980 - RNA, 19 nt, Homo sapiens
uuaaguugauggugaugaa

SEQ ID NO: 102981 - RNA, 19 nt, Homo sapiens
cgagccaaguuaagaaugu

SEQ ID NO: 102982 - RNA, 19 nt, Homo sapiens
ccuauaacauugucauucu

SEQ ID NO: 102983 - RNA, 19 nt, Homo sapiens
cuaaaugccagaaagaaga

SEQ ID NO: 102984 - RNA, 19 nt, Homo sapiens
uguaugauccuaaugaaug

SEQ ID NO: 102985 - RNA, 19 nt, Homo sapiens
ggacuauggcucuacuuuc

SEQ ID NO: 102986 - RNA, 19 nt, Homo sapiens
gagccaaguuaagaauguu

SEQ ID NO: 102987 - RNA, 19 nt, Homo sapiens
gggaacuccuaaaucaaau

SEQ ID NO: 102988 - RNA, 19 nt, Homo sapiens
uaaucacauucgaguguuu

SEQ ID NO: 102989 - RNA, 19 nt, Homo sapiens
cagagaaaguggauugaac

SEQ ID NO: 102990 - RNA, 19 nt, Homo sapiens
gcuaaagaagguuucagaa

SEQ ID NO: 102991 - RNA, 19 nt, Homo sapiens
cuccaucgcugucaucuca

SEQ ID NO: 102992 - RNA, 19 nt, Homo sapiens
aaaguggauugaacaagga

SEQ ID NO: 102993 - RNA, 19 nt, Homo sapiens
ggucguccucaucuuaaua

SEQ ID NO: 102994 - RNA, 19 nt, Homo sapiens
gaagaagucaccaccuuuu

SEQ ID NO: 102995 - RNA, 19 nt, Homo sapiens
uaaguaaugaugucguuug

SEQ ID NO: 102996 - RNA, 19 nt, Homo sapiens
ugaagaagucaccaccuuu

SEQ ID NO: 102997 - RNA, 19 nt, Homo sapiens
caucuucaccaucaugauu

SEQ ID NO: 102998 - RNA, 19 nt, Homo sapiens
uauuguccaugcuguguuu

SEQ ID NO: 102999 - RNA, 19 nt, Homo sapiens
ggaacuagacucccaagcu

SEQ ID NO: 103000 - RNA, 19 nt, Homo sapiens
uaaacccuauugguaaaga

SEQ ID NO: 103001 - RNA, 19 nt, Homo sapiens
gcauagaguucagacuuuu

SEQ ID NO: 103002 - RNA, 19 nt, Homo sapiens
gagccuagagacagaaaug

SEQ ID NO: 103003 - RNA, 19 nt, Homo sapiens
ggaaaaggaaagucaauug

SEQ ID NO: 103004 - RNA, 19 nt, Homo sapiens
caggaaagaaugugaaagu

SEQ ID NO: 103005 - RNA, 19 nt, Homo sapiens
ucauaaauuugacgugaag

SEQ ID NO: 103006 - RNA, 19 nt, Homo sapiens
guccucaucuuaauaaacu

SEQ ID NO: 103007 - RNA, 19 nt, Homo sapiens
gauccuaaugaaugcauaa

SEQ ID NO: 103008 - RNA, 19 nt, Homo sapiens
gaucugaugcaagcaagaa

SEQ ID NO: 103009 - RNA, 19 nt, Homo sapiens
uguauuagucacagagaua

SEQ ID NO: 103010 - RNA, 19 nt, Homo sapiens
gagaaaguggauugaacaa

SEQ ID NO: 103011 - RNA, 19 nt, Homo sapiens
ccaggacggucaccuuugg

SEQ ID NO: 103012 - RNA, 19 nt, Homo sapiens
ugaaaaugcuguauuaguc

SEQ ID NO: 103013 - RNA, 19 nt, Homo sapiens
gcugaaaacugcaacuugu

SEQ ID NO: 103014 - RNA, 19 nt, Homo sapiens
gagugggucuuugggaaug

SEQ ID NO: 103015 - RNA, 19 nt, Homo sapiens
gaaacacugggcuucuaga

SEQ ID NO: 103016 - RNA, 19 nt, Homo sapiens
ugggaacuccuaaaucaaa

SEQ ID NO: 103017 - RNA, 19 nt, Homo sapiens
aaguaaugaugucguuuga

SEQ ID NO: 103018 - RNA, 19 nt, Homo sapiens
ucuaaguaaugaugucguu

SEQ ID NO: 103019 - RNA, 19 nt, Homo sapiens
uaucaugucaaacgugaaa

SEQ ID NO: 103020 - RNA, 19 nt, Homo sapiens
gguaaagaguuaguuugag

SEQ ID NO: 103021 - RNA, 19 nt, Homo sapiens
ggcuguaucacaucgguua

SEQ ID NO: 103022 - RNA, 19 nt, Homo sapiens
ggaacuccuaaaucaaauu

SEQ ID NO: 103023 - RNA, 19 nt, Homo sapiens
acaucucguucucgguuua

SEQ ID NO: 103024 - RNA, 19 nt, Homo sapiens
gcaaagggcucacgcauuc

SEQ ID NO: 103025 - RNA, 19 nt, Homo sapiens
gcaguuugauuguuguuua

SEQ ID NO: 103026 - RNA, 19 nt, Homo sapiens
gaagguaucucucgguguu

SEQ ID NO: 103027 - RNA, 19 nt, Homo sapiens
gaaauaucaugcuccauug

SEQ ID NO: 103028 - RNA, 19 nt, Homo sapiens
ccacgaggauggaauaauu

SEQ ID NO: 103029 - RNA, 19 nt, Homo sapiens
gaacagagaaaguggauug

SEQ ID NO: 103030 - RNA, 19 nt, Homo sapiens
ggaagucucggcugguuua

SEQ ID NO: 103031 - RNA, 19 nt, Homo sapiens
ggagugacuucaacaaaca

SEQ ID NO: 103032 - RNA, 19 nt, Homo sapiens
uaaagcaggugcccaggaa

SEQ ID NO: 103033 - RNA, 19 nt, Homo sapiens
gccacaagcugaacagaga

SEQ ID NO: 103034 - RNA, 19 nt, Homo sapiens
gaacaauagaaaccuguaa

SEQ ID NO: 103035 - RNA, 19 nt, Homo sapiens
gggagaaguucagaaggua

SEQ ID NO: 103036 - RNA, 19 nt, Homo sapiens
ugaaauaucaugcuccauu

SEQ ID NO: 103037 - RNA, 19 nt, Homo sapiens
ccaugcaccuuacauuuga

SEQ ID NO: 103038 - RNA, 19 nt, Homo sapiens
gagaugauacugguccuua

SEQ ID NO: 103039 - RNA, 19 nt, Homo sapiens
agucucggcugguuuauaa

SEQ ID NO: 103040 - RNA, 19 nt, Homo sapiens
gcaauaaccugggaguuuu

SEQ ID NO: 103041 - RNA, 19 nt, Homo sapiens
caucaucuaugccuucguu

SEQ ID NO: 103042 - RNA, 19 nt, Homo sapiens
caggaaucaucuuuacuaa

SEQ ID NO: 103043 - RNA, 19 nt, Homo sapiens
ccaggaaucaucuuuacua

SEQ ID NO: 103044 - RNA, 19 nt, Homo sapiens
ggcggaaucuucuucauca

SEQ ID NO: 103045 - RNA, 19 nt, Homo sapiens
gacuuugacucuccagaaa

SEQ ID NO: 103046 - RNA, 19 nt, Homo sapiens
guacuaauacagacuaugu

SEQ ID NO: 103047 - RNA, 19 nt, Homo sapiens
ucaccaucaugauuguuua

SEQ ID NO: 103048 - RNA, 19 nt, Homo sapiens
caagugugaucaccugguu

SEQ ID NO: 103049 - RNA, 19 nt, Homo sapiens
ggccaucucugaucugcuu

SEQ ID NO: 103050 - RNA, 19 nt, Homo sapiens
cgagagcggugaagaaguc

SEQ ID NO: 103051 - RNA, 19 nt, Homo sapiens
gcaucaaucccaucaucua

SEQ ID NO: 103052 - RNA, 19 nt, Homo sapiens
caaugcauauccaacaugu

SEQ ID NO: 103053 - RNA, 19 nt, Homo sapiens
gaggagcaguuugauuguu

SEQ ID NO: 103054 - RNA, 19 nt, Homo sapiens
caacgagagcggugaagaa

SEQ ID NO: 103055 - RNA, 19 nt, Homo sapiens
cauaagugcaugacauauu

SEQ ID NO: 103056 - RNA, 19 nt, Homo sapiens
ggaguccgaugauucucuu

SEQ ID NO: 103057 - RNA, 19 nt, Homo sapiens
agagucaucuucaccauca

SEQ ID NO: 103058 - RNA, 19 nt, Homo sapiens
gcaaugugcaaauuauuca

SEQ ID NO: 103059 - RNA, 19 nt, Homo sapiens
ggugcucccugucauaaau

SEQ ID NO: 103060 - RNA, 19 nt, Homo sapiens
ggagaaggagggagacaug

SEQ ID NO: 103061 - RNA, 19 nt, Homo sapiens
gcagugagagucaucuuca

SEQ ID NO: 103062 - RNA, 19 nt, Homo sapiens
gcuggucguccucaucuua

SEQ ID NO: 103063 - RNA, 19 nt, Homo sapiens
agacaaaggugagcaaagg

SEQ ID NO: 103064 - RNA, 19 nt, Homo sapiens
cagacuaugucacccaaug

SEQ ID NO: 103065 - RNA, 19 nt, Homo sapiens
uguaucacaucgguuauuu

SEQ ID NO: 103066 - RNA, 19 nt, Homo sapiens
gugcuugacugacauuuac

SEQ ID NO: 103067 - RNA, 19 nt, Homo sapiens
ccuauaacauugucauucu

SEQ ID NO: 103068 - RNA, 19 nt, Homo sapiens
caacaugugcucagggaau

SEQ ID NO: 103069 - RNA, 19 nt, Homo sapiens
cuaaaugccagaaagaaga

SEQ ID NO: 103070 - RNA, 19 nt, Homo sapiens
ugaaugggagugagggaua

SEQ ID NO: 103071 - RNA, 19 nt, Homo sapiens
cagagaaaguggauugaac

SEQ ID NO: 103072 - RNA, 19 nt, Homo sapiens
gaaugggagugagggauag

SEQ ID NO: 103073 - RNA, 19 nt, Homo sapiens
ucagggcuguguguacuaa

SEQ ID NO: 103074 - RNA, 19 nt, Homo sapiens
aaaguggauugaacaagga

SEQ ID NO: 103075 - RNA, 19 nt, Homo sapiens
ggucguccucaucuuaaua

SEQ ID NO: 103076 - RNA, 19 nt, Homo sapiens
gaagaagucaccaccuuuu

SEQ ID NO: 103077 - RNA, 19 nt, Homo sapiens
caucuucaccaucaugauu

SEQ ID NO: 103078 - RNA, 19 nt, Homo sapiens
uauuguccaugcuguguuu

SEQ ID NO: 103079 - RNA, 19 nt, Homo sapiens
ugaagaagucaccaccuuu

SEQ ID NO: 103080 - RNA, 19 nt, Homo sapiens
caucugccacguguauuua

SEQ ID NO: 103081 - RNA, 19 nt, Homo sapiens
guccucaucuuaauaaacu

SEQ ID NO: 103082 - RNA, 19 nt, Homo sapiens
ucauaaauuugacgugaag

SEQ ID NO: 103083 - RNA, 19 nt, Homo sapiens
gagccuggacaaagacaaa

SEQ ID NO: 103084 - RNA, 19 nt, Homo sapiens
gagaaaguggauugaacaa

SEQ ID NO: 103085 - RNA, 19 nt, Homo sapiens
gacaguggauggagugacu

SEQ ID NO: 103086 - RNA, 19 nt, Homo sapiens
ccaggacggucaccuuugg

SEQ ID NO: 103087 - RNA, 19 nt, Homo sapiens
aacaugugcucagggaaua

SEQ ID NO: 103088 - RNA, 19 nt, Homo sapiens
ggagcaguuugauuguugu

SEQ ID NO: 103089 - RNA, 19 nt, Homo sapiens
caggaagucucggcugguu

SEQ ID NO: 103090 - RNA, 19 nt, Homo sapiens
gagugggucuuugggaaug

SEQ ID NO: 103091 - RNA, 19 nt, Homo sapiens
aauagaaaccuguaaagca

SEQ ID NO: 103092 - RNA, 19 nt, Homo sapiens
ggcuguaucacaucgguua

SEQ ID NO: 103093 - RNA, 19 nt, Homo sapiens
gcauucagccaggagauga

SEQ ID NO: 103094 - RNA, 19 nt, Homo sapiens
acaucucguucucgguuua

SEQ ID NO: 103095 - RNA, 19 nt, Homo sapiens
aggagcaguuugauuguug

SEQ ID NO: 103096 - RNA, 19 nt, Homo sapiens
cugaagugcuugacugaca

SEQ ID NO: 103097 - RNA, 19 nt, Homo sapiens
acgaggagcaguuugauug

SEQ ID NO: 103098 - RNA, 19 nt, Homo sapiens
gaauucuucggccugagua

SEQ ID NO: 103099 - RNA, 19 nt, Homo sapiens
acaacaugcuguccacauc

SEQ ID NO: 103100 - RNA, 19 nt, Homo sapiens
gaagugcuugacugacauu

SEQ ID NO: 103101 - RNA, 19 nt, Homo sapiens
ugcaauaaccugggaguuu

SEQ ID NO: 103102 - RNA, 19 nt, Homo sapiens
caaagacaaaggugagcaa

SEQ ID NO: 103103 - RNA, 19 nt, Homo sapiens
gagaaggagggagacauga

SEQ ID NO: 103104 - RNA, 19 nt, Homo sapiens
agggcuguguguacuaaua

SEQ ID NO: 103105 - RNA, 19 nt, Homo sapiens
gaaccucagggcugugugu

SEQ ID NO: 103106 - RNA, 19 nt, Homo sapiens
ucaccaagcgcuucugcaa

SEQ ID NO: 103107 - RNA, 19 nt, Homo sapiens
ggagaaguucagaagguau

SEQ ID NO: 103108 - RNA, 19 nt, Homo sapiens
caucaaucccaucaucuau

SEQ ID NO: 103109 - RNA, 19 nt, Homo sapiens
ccaucaugauuguuuacuu

SEQ ID NO: 103110 - RNA, 19 nt, Homo sapiens
caugcuguguuugcuuuaa

SEQ ID NO: 103111 - RNA, 19 nt, Homo sapiens
ucuuauuacucucccauug

SEQ ID NO: 103112 - RNA, 19 nt, Homo sapiens
ucaaucccaucaucuaugc

SEQ ID NO: 103113 - RNA, 19 nt, Homo sapiens
uggacucccuauaacauug

SEQ ID NO: 103114 - RNA, 19 nt, Homo sapiens
gaggugaagaagagaaugu

SEQ ID NO: 103115 - RNA, 19 nt, Homo sapiens
uccaugcuguguuugcuuu

SEQ ID NO: 103116 - RNA, 19 nt, Homo sapiens
ucgcugguguucaucuuug

SEQ ID NO: 103117 - RNA, 19 nt, Homo sapiens
ccaucugccacguguauuu

SEQ ID NO: 103118 - RNA, 19 nt, Homo sapiens
ggaauucuucggccugagu

SEQ ID NO: 103119 - RNA, 19 nt, Homo sapiens
ucacucugcugcaaaugag

SEQ ID NO: 103120 - RNA, 19 nt, Homo sapiens
uuauuacucucccauugug

SEQ ID NO: 103121 - RNA, 19 nt, Homo sapiens
ugaagaagagaaugugaca

SEQ ID NO: 103122 - RNA, 19 nt, Homo sapiens
gagaaguucagaagguauc

SEQ ID NO: 103123 - RNA, 19 nt, Homo sapiens
cugaguaacugugaaagca

SEQ ID NO: 103124 - RNA, 19 nt, Homo sapiens
gcaagaacuuaucgaaaua

SEQ ID NO: 103125 - RNA, 19 nt, Homo sapiens
guauauagcuggaggcauu

SEQ ID NO: 103126 - RNA, 19 nt, Homo sapiens
ggaacucucuauuguguuu

SEQ ID NO: 103127 - RNA, 19 nt, Homo sapiens
ggagagagguuccggaagu

SEQ ID NO: 103128 - RNA, 19 nt, Homo sapiens
ggcaagaacuuaucgaaau

SEQ ID NO: 103129 - RNA, 19 nt, Homo sapiens
guagaugcauguacccuaa

SEQ ID NO: 103130 - RNA, 19 nt, Homo sapiens
ucaaggacuucacuaaauu

SEQ ID NO: 103131 - RNA, 19 nt, Homo sapiens
uagcagcucuuccugaauu

SEQ ID NO: 103132 - RNA, 19 nt, Homo sapiens
ugaagacacugaaauauac

SEQ ID NO: 103133 - RNA, 19 nt, Homo sapiens
aaacaguccuucaaacuuc

SEQ ID NO: 103134 - RNA, 19 nt, Homo sapiens
gcacuaauugcaaggauuu

SEQ ID NO: 103135 - RNA, 19 nt, Homo sapiens
gcuagcagcucuuccugaa

SEQ ID NO: 103136 - RNA, 19 nt, Homo sapiens
ucagccagcuauugauaua

SEQ ID NO: 103137 - RNA, 19 nt, Homo sapiens
uuaaugcaccugaauguua

SEQ ID NO: 103138 - RNA, 19 nt, Homo sapiens
cugagaagcuagucuguuu

SEQ ID NO: 103139 - RNA, 19 nt, Homo sapiens
gcaccugaauguuagauag

SEQ ID NO: 103140 - RNA, 19 nt, Homo sapiens
gagagagguuccggaagua

SEQ ID NO: 103141 - RNA, 19 nt, Homo sapiens
gaaaugacaaccucacuag

SEQ ID NO: 103142 - RNA, 19 nt, Homo sapiens
gagaagcuagucuguuuaa

SEQ ID NO: 103143 - RNA, 19 nt, Homo sapiens
gaaagaaccagcucugucu

SEQ ID NO: 103144 - RNA, 19 nt, Homo sapiens
gaagaguuguuugaagaga

SEQ ID NO: 103145 - RNA, 19 nt, Homo sapiens
ccaaggagaugaagcaaac

SEQ ID NO: 103146 - RNA, 19 nt, Homo sapiens
ucaggugacugguuaguau

SEQ ID NO: 103147 - RNA, 19 nt, Homo sapiens
gagcuuugcuucucucucu

SEQ ID NO: 103148 - RNA, 19 nt, Homo sapiens
caaggacuucacuaaauua

SEQ ID NO: 103149 - RNA, 19 nt, Homo sapiens
gaucuacgccuuuguugga

SEQ ID NO: 103150 - RNA, 19 nt, Homo sapiens
gaagaacugcacgaaagua

SEQ ID NO: 103151 - RNA, 19 nt, Homo sapiens
gcagaaaauugccuaaaga

SEQ ID NO: 103152 - RNA, 19 nt, Homo sapiens
gugagaagcuggaaagaac

SEQ ID NO: 103153 - RNA, 19 nt, Homo sapiens
gcaugaacccggugaucua

SEQ ID NO: 103154 - RNA, 19 nt, Homo sapiens
aagaagaacugcacgaaag

SEQ ID NO: 103155 - RNA, 19 nt, Homo sapiens
acacacagcaguagcagua

SEQ ID NO: 103156 - RNA, 19 nt, Homo sapiens
gagaugaagcaaacacauu

SEQ ID NO: 103157 - RNA, 19 nt, Homo sapiens
guuaguauguggugucaau

SEQ ID NO: 103158 - RNA, 19 nt, Homo sapiens
gaaugaccaucuucugucu

SEQ ID NO: 103159 - RNA, 19 nt, Homo sapiens
cugaagaguuguuugaaga

SEQ ID NO: 103160 - RNA, 19 nt, Homo sapiens
gaauuaugaccaacaucua

SEQ ID NO: 103161 - RNA, 19 nt, Homo sapiens
agaugaagcaaacacauua

SEQ ID NO: 103162 - RNA, 19 nt, Homo sapiens
uuucucaggugacugguua

SEQ ID NO: 103163 - RNA, 19 nt, Homo sapiens
gaacugcacgaaaguaucu

SEQ ID NO: 103164 - RNA, 19 nt, Homo sapiens
cuaguucuuucccugcuua

SEQ ID NO: 103165 - RNA, 19 nt, Homo sapiens
ccugaauguuagauaguua

SEQ ID NO: 103166 - RNA, 19 nt, Homo sapiens
gcagauacaucccauuccu

SEQ ID NO: 103167 - RNA, 19 nt, Homo sapiens
cuaugagacugaagaguug

SEQ ID NO: 103168 - RNA, 19 nt, Homo sapiens
gcaauguggugguggugau

SEQ ID NO: 103169 - RNA, 19 nt, Homo sapiens
caaccucacuagauacagu

SEQ ID NO: 103170 - RNA, 19 nt, Homo sapiens
augacaaccucacuagaua

SEQ ID NO: 103171 - RNA, 19 nt, Homo sapiens
augagaagcugguaacaga

SEQ ID NO: 103172 - RNA, 19 nt, Homo sapiens
gugcaacacugaagcucuu

SEQ ID NO: 103173 - RNA, 19 nt, Homo sapiens
uaaugcaccugaauguuag

SEQ ID NO: 103174 - RNA, 19 nt, Homo sapiens
ccggaacucucuauugugu

SEQ ID NO: 103175 - RNA, 19 nt, Homo sapiens
acauuucacugcugaguug

SEQ ID NO: 103176 - RNA, 19 nt, Homo sapiens
gaagagauuuucagcagau

SEQ ID NO: 103177 - RNA, 19 nt, Homo sapiens
gggcaagaacuuaucgaaa

SEQ ID NO: 103178 - RNA, 19 nt, Homo sapiens
uaucaaggacuucacuaaa

SEQ ID NO: 103179 - RNA, 19 nt, Homo sapiens
gcagcguacucaucaucaa

SEQ ID NO: 103180 - RNA, 19 nt, Homo sapiens
uauguggugucaaucauga

SEQ ID NO: 103181 - RNA, 19 nt, Homo sapiens
gaugaagcaaacacauuaa

SEQ ID NO: 103182 - RNA, 19 nt, Homo sapiens
ggaaggaccaaggagauga

SEQ ID NO: 103183 - RNA, 19 nt, Homo sapiens
caggaguggugacgccuaa

SEQ ID NO: 103184 - RNA, 19 nt, Homo sapiens
uaaugucugugaucugaug

SEQ ID NO: 103185 - RNA, 19 nt, Homo sapiens
acacugaaauauacacaca

SEQ ID NO: 103186 - RNA, 19 nt, Homo sapiens
cauuguccaugcuguguuu

SEQ ID NO: 103187 - RNA, 19 nt, Homo sapiens
gaagcuagucuguuuaaaa

SEQ ID NO: 103188 - RNA, 19 nt, Homo sapiens
gaucugaugguaucucugu

SEQ ID NO: 103189 - RNA, 19 nt, Homo sapiens
acuaaugucugugaucuga

SEQ ID NO: 103190 - RNA, 19 nt, Homo sapiens
gaaggaccaaggagaugaa

SEQ ID NO: 103191 - RNA, 19 nt, Homo sapiens
gagaagcugguaacagaga

SEQ ID NO: 103192 - RNA, 19 nt, Homo sapiens
ggacauaucaaggacuuca

SEQ ID NO: 103193 - RNA, 19 nt, Homo sapiens
aaauauacacacagcagua

SEQ ID NO: 103194 - RNA, 19 nt, Homo sapiens
cuuccacacucaccucuaa

SEQ ID NO: 103195 - RNA, 19 nt, Homo sapiens
gagccggaacucucuauug

SEQ ID NO: 103196 - RNA, 19 nt, Homo sapiens
ucaugcaccugggcagaua

SEQ ID NO: 103197 - RNA, 19 nt, Homo sapiens
ggaccaaggagaugaagca

SEQ ID NO: 103198 - RNA, 19 nt, Homo sapiens
gcagaugagaagcugguaa

SEQ ID NO: 103199 - RNA, 19 nt, Homo sapiens
uaagcuaucacuggacaua

SEQ ID NO: 103200 - RNA, 19 nt, Homo sapiens
uaacuucagccagcuauug

SEQ ID NO: 103201 - RNA, 19 nt, Homo sapiens
cuacuuuacuaaugucugu

SEQ ID NO: 103202 - RNA, 19 nt, Homo sapiens
ucauaauccugcugacaau

SEQ ID NO: 103203 - RNA, 19 nt, Homo sapiens
ugaaaugacaaccucacua

SEQ ID NO: 103204 - RNA, 19 nt, Homo sapiens
aagaaucauugcacauuuc

SEQ ID NO: 103205 - RNA, 19 nt, Homo sapiens
uaaagcagcacuaauugca

SEQ ID NO: 103206 - RNA, 19 nt, Homo sapiens
uaaugugccuaguucuuuc

SEQ ID NO: 103207 - RNA, 19 nt, Homo sapiens
cuaaugugccuaguucuuu

SEQ ID NO: 103208 - RNA, 19 nt, Homo sapiens
gggcagauacaucccauuc

SEQ ID NO: 103209 - RNA, 19 nt, Homo sapiens
gaugguaucucuguuucag

SEQ ID NO: 103210 - RNA, 19 nt, Homo sapiens
ggaggcauuuccacacucu

SEQ ID NO: 103211 - RNA, 19 nt, Homo sapiens
aaagaagaacugcacgaaa

SEQ ID NO: 103212 - RNA, 19 nt, Homo sapiens
guaccacauccuacuauga

SEQ ID NO: 103213 - RNA, 19 nt, Homo sapiens
agccagcuauugauauaaa

SEQ ID NO: 103214 - RNA, 19 nt, Homo sapiens
gaggaaggaccaaggagau

SEQ ID NO: 103215 - RNA, 19 nt, Homo sapiens
agacugaagaguuguuuga

SEQ ID NO: 103216 - RNA, 19 nt, Homo sapiens
gagcccggacugucacuuu

SEQ ID NO: 103217 - RNA, 19 nt, Homo sapiens
uagauacaguugagaccuu

SEQ ID NO: 103218 - RNA, 19 nt, Homo sapiens
cuacacaggaaucaucaaa

SEQ ID NO: 103219 - RNA, 19 nt, Homo sapiens
ucuaugagacugaagaguu

SEQ ID NO: 103220 - RNA, 19 nt, Homo sapiens
gcagcucuuccugaauuua

SEQ ID NO: 103221 - RNA, 19 nt, Homo sapiens
gcugauaccagagcacuga

SEQ ID NO: 103222 - RNA, 19 nt, Homo sapiens
ucacugcugaguuguauug

SEQ ID NO: 103223 - RNA, 19 nt, Homo sapiens
uuucuaaugugccuaguuc

SEQ ID NO: 103224 - RNA, 19 nt, Homo sapiens
gaaagcauauacagcaauu

SEQ ID NO: 103225 - RNA, 19 nt, Homo sapiens
ugaaugaaguuguagguaa

SEQ ID NO: 103226 - RNA, 19 nt, Homo sapiens
ugaggagccuguagaguua

SEQ ID NO: 103227 - RNA, 19 nt, Homo sapiens
caaagacuauucccuucua

SEQ ID NO: 103228 - RNA, 19 nt, Homo sapiens
gaaugaaguuguagguaau

SEQ ID NO: 103229 - RNA, 19 nt, Homo sapiens
gcaauuacuaucuguauga

SEQ ID NO: 103230 - RNA, 19 nt, Homo sapiens
gaaguuguagguaauauug

SEQ ID NO: 103231 - RNA, 19 nt, Homo sapiens
ggagaaauuucgcaaguac

SEQ ID NO: 103232 - RNA, 19 nt, Homo sapiens
gaaagauacuuggacuaug

SEQ ID NO: 103233 - RNA, 19 nt, Homo sapiens
gaacaaggcggugaagaug

SEQ ID NO: 103234 - RNA, 19 nt, Homo sapiens
gaaauucuguggugguucu

SEQ ID NO: 103235 - RNA, 19 nt, Homo sapiens
gcauauacagcaauuacua

SEQ ID NO: 103236 - RNA, 19 nt, Homo sapiens
caacauagugcucuuccua

SEQ ID NO: 103237 - RNA, 19 nt, Homo sapiens
gcaagaugauuuccuggau

SEQ ID NO: 103238 - RNA, 19 nt, Homo sapiens
gggagaaauuucgcaagua

SEQ ID NO: 103239 - RNA, 19 nt, Homo sapiens
guucucagcucccuggaaa

SEQ ID NO: 103240 - RNA, 19 nt, Homo sapiens
gugcuugaaugaaguugua

SEQ ID NO: 103241 - RNA, 19 nt, Homo sapiens
cuggacaccuuacaacaua

SEQ ID NO: 103242 - RNA, 19 nt, Homo sapiens
cagagggaauugcagagua

SEQ ID NO: 103243 - RNA, 19 nt, Homo sapiens
gaaaugcagagucaaugaa

SEQ ID NO: 103244 - RNA, 19 nt, Homo sapiens
ucaugagcauugauagaua

SEQ ID NO: 103245 - RNA, 19 nt, Homo sapiens
ggaguaaaucgcuaccuuu

SEQ ID NO: 103246 - RNA, 19 nt, Homo sapiens
ggaaagacagcuucucauc

SEQ ID NO: 103247 - RNA, 19 nt, Homo sapiens
ggaccuugcagcauuguaa

SEQ ID NO: 103248 - RNA, 19 nt, Homo sapiens
ugacaaguccauucagaaa

SEQ ID NO: 103249 - RNA, 19 nt, Homo sapiens
cuucuaaccugaacugaug

SEQ ID NO: 103250 - RNA, 19 nt, Homo sapiens
aaagauacuuggacuaugc

SEQ ID NO: 103251 - RNA, 19 nt, Homo sapiens
caaauuuacucugcugaca

SEQ ID NO: 103252 - RNA, 19 nt, Homo sapiens
guucacugcugccuuaauc

SEQ ID NO: 103253 - RNA, 19 nt, Homo sapiens
guucagcacuuguuauacu

SEQ ID NO: 103254 - RNA, 19 nt, Homo sapiens
gugggcuccuccaaauuua

SEQ ID NO: 103255 - RNA, 19 nt, Homo sapiens
ugaaagauacuuggacuau

SEQ ID NO: 103256 - RNA, 19 nt, Homo sapiens
cacccucgaugaaagcaua

SEQ ID NO: 103257 - RNA, 19 nt, Homo sapiens
ccacggauauagcagauac

SEQ ID NO: 103258 - RNA, 19 nt, Homo sapiens
auagauaccuggcgauagu

SEQ ID NO: 103259 - RNA, 19 nt, Homo sapiens
cuaggucugugcaagauga

SEQ ID NO: 103260 - RNA, 19 nt, Homo sapiens
ccacuguauuccuugguuu

SEQ ID NO: 103261 - RNA, 19 nt, Homo sapiens
uuuguucacugcugccuua

SEQ ID NO: 103262 - RNA, 19 nt, Homo sapiens
aagaaggcaucaaggcauu

SEQ ID NO: 103263 - RNA, 19 nt, Homo sapiens
aaagacuauucccuucuaa

SEQ ID NO: 103264 - RNA, 19 nt, Homo sapiens
cuucaggacugcaccuuug

SEQ ID NO: 103265 - RNA, 19 nt, Homo sapiens
aaagacagcuucucauccu

SEQ ID NO: 103266 - RNA, 19 nt, Homo sapiens
acaaggcggugaagaugau

SEQ ID NO: 103267 - RNA, 19 nt, Homo sapiens
guccaugacugauguguac

SEQ ID NO: 103268 - RNA, 19 nt, Homo sapiens
ugaaaugcagagucaauga

SEQ ID NO: 103269 - RNA, 19 nt, Homo sapiens
ggucugugcaagaugauuu

SEQ ID NO: 103270 - RNA, 19 nt, Homo sapiens
uauuuggucugcuuggaaa

SEQ ID NO: 103271 - RNA, 19 nt, Homo sapiens
acauagugcucuuccuaga

SEQ ID NO: 103272 - RNA, 19 nt, Homo sapiens
caaccauaccuacugcaaa

SEQ ID NO: 103273 - RNA, 19 nt, Homo sapiens
gauagugcacgcgguguuu

SEQ ID NO: 103274 - RNA, 19 nt, Homo sapiens
uggaguaaaucgcuaccuu

SEQ ID NO: 103275 - RNA, 19 nt, Homo sapiens
aagaugauuuccuggaugu

SEQ ID NO: 103276 - RNA, 19 nt, Homo sapiens
gaucugcucuucguguuuu

SEQ ID NO: 103277 - RNA, 19 nt, Homo sapiens
aaaaugaaccccacggaua

SEQ ID NO: 103278 - RNA, 19 nt, Homo sapiens
gcaaagacuauucccuucu

SEQ ID NO: 103279 - RNA, 19 nt, Homo sapiens
uuaaucccaucaucuacuu

SEQ ID NO: 103280 - RNA, 19 nt, Homo sapiens
ucaggaccuugcagcauug

SEQ ID NO: 103281 - RNA, 19 nt, Homo sapiens
gcaaccauaccuacugcaa

SEQ ID NO: 103282 - RNA, 19 nt, Homo sapiens
uuacaguggcauauucuuu

SEQ ID NO: 103283 - RNA, 19 nt, Homo sapiens
gcagcagaccaguggguuu

SEQ ID NO: 103284 - RNA, 19 nt, Homo sapiens
gaaggcaucaaggcauuug

SEQ ID NO: 103285 - RNA, 19 nt, Homo sapiens
gauaccacccucgaugaaa

SEQ ID NO: 103286 - RNA, 19 nt, Homo sapiens
ucagcucccuggaaaucaa

SEQ ID NO: 103287 - RNA, 19 nt, Homo sapiens
cagcaauuacuaucuguau

SEQ ID NO: 103288 - RNA, 19 nt, Homo sapiens
auacagcaauuacuaucug

SEQ ID NO: 103289 - RNA, 19 nt, Homo sapiens
guaaaucgcuaccuuuugc

SEQ ID NO: 103290 - RNA, 19 nt, Homo sapiens
ugugggcuccuccaaauuu

SEQ ID NO: 103291 - RNA, 19 nt, Homo sapiens
acauucagagcuuacuuua

SEQ ID NO: 103292 - RNA, 19 nt, Homo sapiens
ggugaaaugcagagucaau

SEQ ID NO: 103293 - RNA, 19 nt, Homo sapiens
gccuuaaucccaucaucua

SEQ ID NO: 103294 - RNA, 19 nt, Homo sapiens
caugagcauugauagauac

SEQ ID NO: 103295 - RNA, 19 nt, Homo sapiens
guucugguccuguucaaau

SEQ ID NO: 103296 - RNA, 19 nt, Homo sapiens
gagccagugucaggaggaa

SEQ ID NO: 103297 - RNA, 19 nt, Homo sapiens
ucaaugaacuuuuccacau

SEQ ID NO: 103298 - RNA, 19 nt, Homo sapiens
caacauugacaaguccauu

SEQ ID NO: 103299 - RNA, 19 nt, Homo sapiens
cagauaccacccucgauga

SEQ ID NO: 103300 - RNA, 19 nt, Homo sapiens
guggaaagacagcuucuca

SEQ ID NO: 103301 - RNA, 19 nt, Homo sapiens
gagcuuacuuuaaaauugg

SEQ ID NO: 103302 - RNA, 19 nt, Homo sapiens
uugaggagccuguagaguu

SEQ ID NO: 103303 - RNA, 19 nt, Homo sapiens
acugugggcuccuccaaau

SEQ ID NO: 103304 - RNA, 19 nt, Homo sapiens
ccuuagggaucaugcuguu

SEQ ID NO: 103305 - RNA, 19 nt, Homo sapiens
ucaccaguuuggcuacaug

SEQ ID NO: 103306 - RNA, 19 nt, Homo sapiens
ugauagauaccuggcgaua

SEQ ID NO: 103307 - RNA, 19 nt, Homo sapiens
ucaugaugcucuguaggaa

SEQ ID NO: 103308 - RNA, 19 nt, Homo sapiens
cauccuacagcucuucaaa

SEQ ID NO: 103309 - RNA, 19 nt, Homo sapiens
agaacaaggcggugaagau

SEQ ID NO: 103310 - RNA, 19 nt, Homo sapiens
cuuccuggcuuucuguuca

SEQ ID NO: 103311 - RNA, 19 nt, Homo sapiens
gggcuaggucugugcaaga

SEQ ID NO: 103312 - RNA, 19 nt, Homo sapiens
cucccucccucucucauuu

SEQ ID NO: 103313 - RNA, 19 nt, Homo sapiens
ggaucaugcuguuuugcua

SEQ ID NO: 103314 - RNA, 19 nt, Homo sapiens
cauggucaguggcuguguu

SEQ ID NO: 103315 - RNA, 19 nt, Homo sapiens
ggaucugcucuucguguuu

SEQ ID NO: 103316 - RNA, 19 nt, Homo sapiens
caucucggaucugcucuuc

SEQ ID NO: 103317 - RNA, 19 nt, Homo sapiens
gaguaaaucgcuaccuuuu

SEQ ID NO: 103318 - RNA, 19 nt, Homo sapiens
cacauucagagcuuacuuu

SEQ ID NO: 103319 - RNA, 19 nt, Homo sapiens
gaccuugcagcauuguaaa

SEQ ID NO: 103320 - RNA, 19 nt, Homo sapiens
uggcauauucuuugucaug

SEQ ID NO: 103321 - RNA, 19 nt, Homo sapiens
acaguggcauauucuuugu

SEQ ID NO: 103322 - RNA, 19 nt, Homo sapiens
uacaguggcauauucuuug

SEQ ID NO: 103323 - RNA, 19 nt, Homo sapiens
uggaaauucuguggugguu

SEQ ID NO: 103324 - RNA, 19 nt, Homo sapiens
gaaugaaggugucagaaua

SEQ ID NO: 103325 - RNA, 19 nt, Homo sapiens
ggacaaggcuagaucauga

SEQ ID NO: 103326 - RNA, 19 nt, Homo sapiens
ggaacaagauggauuauca

SEQ ID NO: 103327 - RNA, 19 nt, Homo sapiens
cuacguaucuggcauagua

SEQ ID NO: 103328 - RNA, 19 nt, Homo sapiens
gaaggugucagaauaauaa

SEQ ID NO: 103329 - RNA, 19 nt, Homo sapiens
gaagggacauauucauuug

SEQ ID NO: 103330 - RNA, 19 nt, Homo sapiens
gaggauugauuaccuagua

SEQ ID NO: 103331 - RNA, 19 nt, Homo sapiens
gaagauggauugguguaaa

SEQ ID NO: 103332 - RNA, 19 nt, Homo sapiens
caagauggauuaucaagug

SEQ ID NO: 103333 - RNA, 19 nt, Homo sapiens
ggucuaagauucauccauu

SEQ ID NO: 103334 - RNA, 19 nt, Homo sapiens
gagaaaagcccguaaauaa

SEQ ID NO: 103335 - RNA, 19 nt, Homo sapiens
ggaagggacauauucauuu

SEQ ID NO: 103336 - RNA, 19 nt, Homo sapiens
gaaugcuucugacuucaua

SEQ ID NO: 103337 - RNA, 19 nt, Homo sapiens
ggccaucucugaccuguuu

SEQ ID NO: 103338 - RNA, 19 nt, Homo sapiens
aaacagcauuuccuacuuu

SEQ ID NO: 103339 - RNA, 19 nt, Homo sapiens
ucacaugcaucaaguuauu

SEQ ID NO: 103340 - RNA, 19 nt, Homo sapiens
guucagaaacuaccucuua

SEQ ID NO: 103341 - RNA, 19 nt, Homo sapiens
gaagaaccuugacggcauu

SEQ ID NO: 103342 - RNA, 19 nt, Homo sapiens
gagcaugacugacaucuac

SEQ ID NO: 103343 - RNA, 19 nt, Homo sapiens
gaacauacuucagcucaca

SEQ ID NO: 103344 - RNA, 19 nt, Homo sapiens
ugaguuggaucaucuauug

SEQ ID NO: 103345 - RNA, 19 nt, Homo sapiens
gauuauaucuggagugaag

SEQ ID NO: 103346 - RNA, 19 nt, Homo sapiens
caggaaggaugagcauuua

SEQ ID NO: 103347 - RNA, 19 nt, Homo sapiens
ggaagcuucuuaaaugaga

SEQ ID NO: 103348 - RNA, 19 nt, Homo sapiens
gccaaacgcuucugcaaau

SEQ ID NO: 103349 - RNA, 19 nt, Homo sapiens
ucaaagacauucugacauc

SEQ ID NO: 103350 - RNA, 19 nt, Homo sapiens
ggaggagacuagauuuaug

SEQ ID NO: 103351 - RNA, 19 nt, Homo sapiens
gagaaucccuagucuucaa

SEQ ID NO: 103352 - RNA, 19 nt, Homo sapiens
ggaaguuacuguuauagag

SEQ ID NO: 103353 - RNA, 19 nt, Homo sapiens
gguaugaggucuaggaaca

SEQ ID NO: 103354 - RNA, 19 nt, Homo sapiens
aaagaaagccucagagaau

SEQ ID NO: 103355 - RNA, 19 nt, Homo sapiens
gagagaaucccuagucuuc

SEQ ID NO: 103356 - RNA, 19 nt, Homo sapiens
cgaaaguuccuuauguaua

SEQ ID NO: 103357 - RNA, 19 nt, Homo sapiens
gcacauacuugagacuguu

SEQ ID NO: 103358 - RNA, 19 nt, Homo sapiens
gaucuauucuccagcuuau

SEQ ID NO: 103359 - RNA, 19 nt, Homo sapiens
ggacauauucauuuggaaa

SEQ ID NO: 103360 - RNA, 19 nt, Homo sapiens
gagcaaagcauugagcaaa

SEQ ID NO: 103361 - RNA, 19 nt, Homo sapiens
cagguaaggugagggaaua

SEQ ID NO: 103362 - RNA, 19 nt, Homo sapiens
gcaaaggggucccauauag

SEQ ID NO: 103363 - RNA, 19 nt, Homo sapiens
uccaagguaugguuaauaa

SEQ ID NO: 103364 - RNA, 19 nt, Homo sapiens
gaagaauuuccagacauua

SEQ ID NO: 103365 - RNA, 19 nt, Homo sapiens
gcacugagcaaagcauuga

SEQ ID NO: 103366 - RNA, 19 nt, Homo sapiens
gcacauggcuuaguuuuca

SEQ ID NO: 103367 - RNA, 19 nt, Homo sapiens
ugacagggcucuauuuuau

SEQ ID NO: 103368 - RNA, 19 nt, Homo sapiens
gaaauacaaugugucaacu

SEQ ID NO: 103369 - RNA, 19 nt, Homo sapiens
gaggagacuagauuuauga

SEQ ID NO: 103370 - RNA, 19 nt, Homo sapiens
aagcuuggcuguagaagga

SEQ ID NO: 103371 - RNA, 19 nt, Homo sapiens
gaaggaauuugaguuggau

SEQ ID NO: 103372 - RNA, 19 nt, Homo sapiens
gguggaacaagauggauua

SEQ ID NO: 103373 - RNA, 19 nt, Homo sapiens
ggaaugaaggugucagaau

SEQ ID NO: 103374 - RNA, 19 nt, Homo sapiens
ggaaauaagcugccuugag

SEQ ID NO: 103375 - RNA, 19 nt, Homo sapiens
ucaagaagaagauggauug

SEQ ID NO: 103376 - RNA, 19 nt, Homo sapiens
gacagaagccucacugcaa

SEQ ID NO: 103377 - RNA, 19 nt, Homo sapiens
gaaccaggcgagagacuug

SEQ ID NO: 103378 - RNA, 19 nt, Homo sapiens
ucaccaucaugauuguuua

SEQ ID NO: 103379 - RNA, 19 nt, Homo sapiens
gaacaagauggauuaucaa

SEQ ID NO: 103380 - RNA, 19 nt, Homo sapiens
ugaaggauccugccaccua

SEQ ID NO: 103381 - RNA, 19 nt, Homo sapiens
ggagggagguauucguaag

SEQ ID NO: 103382 - RNA, 19 nt, Homo sapiens
gcaaaaggcugaagagcau

SEQ ID NO: 103383 - RNA, 19 nt, Homo sapiens
ucacugguguucaucuuug

SEQ ID NO: 103384 - RNA, 19 nt, Homo sapiens
gaacuacucagggaaugaa

SEQ ID NO: 103385 - RNA, 19 nt, Homo sapiens
gcacauacuacacauucaa

SEQ ID NO: 103386 - RNA, 19 nt, Homo sapiens
ggugaggauugauuaccua

SEQ ID NO: 103387 - RNA, 19 nt, Homo sapiens
gacaaacucucccuucacu

SEQ ID NO: 103388 - RNA, 19 nt, Homo sapiens
cagugggacuuuggaaaua

SEQ ID NO: 103389 - RNA, 19 nt, Homo sapiens
guaaggugagggaauagua

SEQ ID NO: 103390 - RNA, 19 nt, Homo sapiens
gggaagggacauauucauu

SEQ ID NO: 103391 - RNA, 19 nt, Homo sapiens
cuucugacuucauagauuu

SEQ ID NO: 103392 - RNA, 19 nt, Homo sapiens
ggauuugguuuggaaguga

SEQ ID NO: 103393 - RNA, 19 nt, Homo sapiens
aagaaagccucagagaauu

SEQ ID NO: 103394 - RNA, 19 nt, Homo sapiens
uacaaugugucaacucuug

SEQ ID NO: 103395 - RNA, 19 nt, Homo sapiens
ggaaauacaaugugucaac

SEQ ID NO: 103396 - RNA, 19 nt, Homo sapiens
gaaaugaauauaccccuua

SEQ ID NO: 103397 - RNA, 19 nt, Homo sapiens
caauaagcaucaaacucuu

SEQ ID NO: 103398 - RNA, 19 nt, Homo sapiens
caucccagcugaaauacug

SEQ ID NO: 103399 - RNA, 19 nt, Homo sapiens
ucuggaaucuucuucauca

SEQ ID NO: 103400 - RNA, 19 nt, Homo sapiens
gggaugagcagagaacaaa

SEQ ID NO: 103401 - RNA, 19 nt, Homo sapiens
ucaauaagcaucaaacucu

SEQ ID NO: 103402 - RNA, 19 nt, Homo sapiens
gcuucugacuucauagauu

SEQ ID NO: 103403 - RNA, 19 nt, Homo sapiens
gcaaggagaccaccaacag

SEQ ID NO: 103404 - RNA, 19 nt, Homo sapiens
ucaggaaggaugagcauuu

SEQ ID NO: 103405 - RNA, 19 nt, Homo sapiens
cauauagguuguaaaugug

SEQ ID NO: 103406 - RNA, 19 nt, Homo sapiens
aggcuuaucuucaccauca

SEQ ID NO: 103407 - RNA, 19 nt, Homo sapiens
aagaggugcuacugacuuu

SEQ ID NO: 103408 - RNA, 19 nt, Homo sapiens
aaggcuagaucaugaagaa

SEQ ID NO: 103409 - RNA, 19 nt, Homo sapiens
uccgaaaguuccuuaugua

SEQ ID NO: 103410 - RNA, 19 nt, Homo sapiens
gcccaucaauuauagaaag

SEQ ID NO: 103411 - RNA, 19 nt, Homo sapiens
guaccuggcugucguccau

SEQ ID NO: 103412 - RNA, 19 nt, Homo sapiens
uaucaagugucaaguccaa

SEQ ID NO: 103413 - RNA, 19 nt, Homo sapiens
gcaaagcauugagcaaagg

SEQ ID NO: 103414 - RNA, 19 nt, Homo sapiens
gcauuuagcacauacuaca

SEQ ID NO: 103415 - RNA, 19 nt, Homo sapiens
gaauuugaguuggaucauc

SEQ ID NO: 103416 - RNA, 19 nt, Homo sapiens
gauggauuaucaaguguca

SEQ ID NO: 103417 - RNA, 19 nt, Homo sapiens
guagugggaugagcagaga

SEQ ID NO: 103418 - RNA, 19 nt, Homo sapiens
gagaacuacucagggaaug

SEQ ID NO: 103419 - RNA, 19 nt, Homo sapiens
gcaaccacaggcagcauuu

SEQ ID NO: 103420 - RNA, 19 nt, Homo sapiens
caggaggagacuagauuua

SEQ ID NO: 103421 - RNA, 19 nt, Homo sapiens
agaaggaauuugaguugga

SEQ ID NO: 103422 - RNA, 19 nt, Homo sapiens
caagguaugguuaauaagu

SEQ ID NO: 103423 - RNA, 19 nt, Homo sapiens
ugucguccaugcuguguuu

SEQ ID NO: 103424 - RNA, 19 nt, Homo sapiens
ggaaagaacugucauguaa

SEQ ID NO: 103425 - RNA, 19 nt, Homo sapiens
gagcuucucugcauaauuu

SEQ ID NO: 103426 - RNA, 19 nt, Homo sapiens
uaacagcucucuucaauga

SEQ ID NO: 103427 - RNA, 19 nt, Homo sapiens
caacaagccugacccugua

SEQ ID NO: 103428 - RNA, 19 nt, Homo sapiens
gaagacaggaucuagaaua

SEQ ID NO: 103429 - RNA, 19 nt, Homo sapiens
gcacaaagccauccgugua

SEQ ID NO: 103430 - RNA, 19 nt, Homo sapiens
gaauuaugcuggcuucuga

SEQ ID NO: 103431 - RNA, 19 nt, Homo sapiens
gcgcugaugugaucuauga

SEQ ID NO: 103432 - RNA, 19 nt, Homo sapiens
uaaagcagcucagguugua

SEQ ID NO: 103433 - RNA, 19 nt, Homo sapiens
ccacauacuuuauuucuuc

SEQ ID NO: 103434 - RNA, 19 nt, Homo sapiens
ucacagaaguccuggcuuu

SEQ ID NO: 103435 - RNA, 19 nt, Homo sapiens
gauaaaugaagcugacuua

SEQ ID NO: 103436 - RNA, 19 nt, Homo sapiens
gggaaaugcugaauuaaag

SEQ ID NO: 103437 - RNA, 19 nt, Homo sapiens
gguggaagcugcugauguu

SEQ ID NO: 103438 - RNA, 19 nt, Homo sapiens
ugacaaugguguuauuuga

SEQ ID NO: 103439 - RNA, 19 nt, Homo sapiens
gugagugucucuugucuaa

SEQ ID NO: 103440 - RNA, 19 nt, Homo sapiens
gacauccucuuuguucuua

SEQ ID NO: 103441 - RNA, 19 nt, Homo sapiens
gacaggaucuagaauaauc

SEQ ID NO: 103442 - RNA, 19 nt, Homo sapiens
gccaacacaucacucauuu

SEQ ID NO: 103443 - RNA, 19 nt, Homo sapiens
gagcuggagucaucagauu

SEQ ID NO: 103444 - RNA, 19 nt, Homo sapiens
gagccgagaucgugccauu

SEQ ID NO: 103445 - RNA, 19 nt, Homo sapiens
gaaacaucuugcuuauuug

SEQ ID NO: 103446 - RNA, 19 nt, Homo sapiens
ggauaaagcagcucagguu

SEQ ID NO: 103447 - RNA, 19 nt, Homo sapiens
gcagacauccucuuuguuc

SEQ ID NO: 103448 - RNA, 19 nt, Homo sapiens
caggagacauuaagauaga

SEQ ID NO: 103449 - RNA, 19 nt, Homo sapiens
caaaacaggugccauggua

SEQ ID NO: 103450 - RNA, 19 nt, Homo sapiens
ucaaugcgcugaugugauc

SEQ ID NO: 103451 - RNA, 19 nt, Homo sapiens
gaaagaacugucauguaaa

SEQ ID NO: 103452 - RNA, 19 nt, Homo sapiens
uaagauggguggaucacuu

SEQ ID NO: 103453 - RNA, 19 nt, Homo sapiens
aagacaggaucuagaauaa

SEQ ID NO: 103454 - RNA, 19 nt, Homo sapiens
ggaaagacaagcucaagug

SEQ ID NO: 103455 - RNA, 19 nt, Homo sapiens
uuugggaaaugcugaauua

SEQ ID NO: 103456 - RNA, 19 nt, Homo sapiens
ccagugagaccgcagauaa

SEQ ID NO: 103457 - RNA, 19 nt, Homo sapiens
acagaaacaucuugcuuau

SEQ ID NO: 103458 - RNA, 19 nt, Homo sapiens
ugaaguaggaaucguauuu

SEQ ID NO: 103459 - RNA, 19 nt, Homo sapiens
ucaaugacauagaaaguuc

SEQ ID NO: 103460 - RNA, 19 nt, Homo sapiens
caacacaucacucauuuua

SEQ ID NO: 103461 - RNA, 19 nt, Homo sapiens
gcacagaaacaucuugcuu

SEQ ID NO: 103462 - RNA, 19 nt, Homo sapiens
aagacaagcucaaguguuc

SEQ ID NO: 103463 - RNA, 19 nt, Homo sapiens
ugacagacgucuaucucuu

SEQ ID NO: 103464 - RNA, 19 nt, Homo sapiens
ggaauauucugguggugau

SEQ ID NO: 103465 - RNA, 19 nt, Homo sapiens
caacuuuacugagacaaug

SEQ ID NO: 103466 - RNA, 19 nt, Homo sapiens
guuauaagcagcaggauug

SEQ ID NO: 103467 - RNA, 19 nt, Homo sapiens
ucagauuccucauaacaug

SEQ ID NO: 103468 - RNA, 19 nt, Homo sapiens
cacagaaacaucuugcuua

SEQ ID NO: 103469 - RNA, 19 nt, Homo sapiens
uuuaacagcucucuucaau

SEQ ID NO: 103470 - RNA, 19 nt, Homo sapiens
gcuaguguuuccucucauu

SEQ ID NO: 103471 - RNA, 19 nt, Homo sapiens
aaucauagcuguggugcuu

SEQ ID NO: 103472 - RNA, 19 nt, Homo sapiens
gcuacucuuugguuucuuu

SEQ ID NO: 103473 - RNA, 19 nt, Homo sapiens
ucuaugccaucaacuuuaa

SEQ ID NO: 103474 - RNA, 19 nt, Homo sapiens
gaaagacaagcucaagugu

SEQ ID NO: 103475 - RNA, 19 nt, Homo sapiens
ggaugcugcuccugacuug

SEQ ID NO: 103476 - RNA, 19 nt, Homo sapiens
ccugggagcuguucucugu

SEQ ID NO: 103477 - RNA, 19 nt, Homo sapiens
cgacuccagugaagauuau

SEQ ID NO: 103478 - RNA, 19 nt, Homo sapiens
gaugagcuucucugcauaa

SEQ ID NO: 103479 - RNA, 19 nt, Homo sapiens
ugccaaagcugggagauga

SEQ ID NO: 103480 - RNA, 19 nt, Homo sapiens
gaaaugcugaauuaaagug

SEQ ID NO: 103481 - RNA, 19 nt, Homo sapiens
ugaaggaccuguggugugu

SEQ ID NO: 103482 - RNA, 19 nt, Homo sapiens
gcaguucuccaggcuauuu

SEQ ID NO: 103483 - RNA, 19 nt, Homo sapiens
gggcuguucuucagugguu

SEQ ID NO: 103484 - RNA, 19 nt, Homo sapiens
aaagaacugucauguaaac

SEQ ID NO: 103485 - RNA, 19 nt, Homo sapiens
cgaaaccccucucuacuaa

SEQ ID NO: 103486 - RNA, 19 nt, Homo sapiens
guaaugaaguugggguuua

SEQ ID NO: 103487 - RNA, 19 nt, Homo sapiens
ggccagguaugcauggaaa

SEQ ID NO: 103488 - RNA, 19 nt, Homo sapiens
aaccagaagcugcaucuua

SEQ ID NO: 103489 - RNA, 19 nt, Homo sapiens
gcguuugacucuagaaauc

SEQ ID NO: 103490 - RNA, 19 nt, Homo sapiens
gacaaugcgucguccuuca

SEQ ID NO: 103491 - RNA, 19 nt, Homo sapiens
cuugucagauuccucauaa

SEQ ID NO: 103492 - RNA, 19 nt, Homo sapiens
gagcuacucuuugguuucu

SEQ ID NO: 103493 - RNA, 19 nt, Homo sapiens
ucucuucaaugacauagaa

SEQ ID NO: 103494 - RNA, 19 nt, Homo sapiens
ugaaauuugugauggaauc

SEQ ID NO: 103495 - RNA, 19 nt, Homo sapiens
uaugaggagcugcagauua

SEQ ID NO: 103496 - RNA, 19 nt, Homo sapiens
gagacaauguagaaagaag

SEQ ID NO: 103497 - RNA, 19 nt, Homo sapiens
aaauggagguggaaagaca

SEQ ID NO: 103498 - RNA, 19 nt, Homo sapiens
ugaaacauacucauagaug

SEQ ID NO: 103499 - RNA, 19 nt, Homo sapiens
gaaagcugagucucccuaa

SEQ ID NO: 103500 - RNA, 19 nt, Homo sapiens
ugugacggcugcaaauuug

SEQ ID NO: 103501 - RNA, 19 nt, Homo sapiens
gagugucucuugucuaaac

SEQ ID NO: 103502 - RNA, 19 nt, Homo sapiens
gaccgcagauaacgacaau

SEQ ID NO: 103503 - RNA, 19 nt, Homo sapiens
gcuaauuggcuauacgaaa

SEQ ID NO: 103504 - RNA, 19 nt, Homo sapiens
aaacagccuuugggaaaug

SEQ ID NO: 103505 - RNA, 19 nt, Homo sapiens
gccgggagguacucagaaa

SEQ ID NO: 103506 - RNA, 19 nt, Homo sapiens
aaaaucaucugccuuguug

SEQ ID NO: 103507 - RNA, 19 nt, Homo sapiens
accagaagcugcaucuuau

SEQ ID NO: 103508 - RNA, 19 nt, Homo sapiens
caaagcaaaggagugguua

SEQ ID NO: 103509 - RNA, 19 nt, Homo sapiens
aauagcaacuuguguuaca

SEQ ID NO: 103510 - RNA, 19 nt, Homo sapiens
uuacugagacaauguagaa

SEQ ID NO: 103511 - RNA, 19 nt, Homo sapiens
guagugggccauuaggaaa

SEQ ID NO: 103512 - RNA, 19 nt, Homo sapiens
caucuaugccaucaacuuu

SEQ ID NO: 103513 - RNA, 19 nt, Homo sapiens
gaaguaggaaucguauuuc

SEQ ID NO: 103514 - RNA, 19 nt, Homo sapiens
gcuguucucugucgugagu

SEQ ID NO: 103515 - RNA, 19 nt, Homo sapiens
gaagccaacacaucacuca

SEQ ID NO: 103516 - RNA, 19 nt, Homo sapiens
agccauccguguaaucaua

SEQ ID NO: 103517 - RNA, 19 nt, Homo sapiens
guuuaaaccugacaauggu

SEQ ID NO: 103518 - RNA, 19 nt, Homo sapiens
uuaggaagguacugucaug

SEQ ID NO: 103519 - RNA, 19 nt, Homo sapiens
gcuggcuucugauaauuau

SEQ ID NO: 103520 - RNA, 19 nt, Homo sapiens
uaugcuggcuucugauaau

SEQ ID NO: 103521 - RNA, 19 nt, Homo sapiens
cuacaaccagcuugcauuu

SEQ ID NO: 103522 - RNA, 19 nt, Homo sapiens
ccuuugauguucaugauau

SEQ ID NO: 103523 - RNA, 19 nt, Homo sapiens
gacaaugguguuauuugaa

SEQ ID NO: 103524 - RNA, 19 nt, Homo sapiens
ggaaagaacugucauguaa

SEQ ID NO: 103525 - RNA, 19 nt, Homo sapiens
gagcuucucugcauaauuu

SEQ ID NO: 103526 - RNA, 19 nt, Homo sapiens
uaacagcucucuucaauga

SEQ ID NO: 103527 - RNA, 19 nt, Homo sapiens
caacaagccugacccugua

SEQ ID NO: 103528 - RNA, 19 nt, Homo sapiens
gaagacaggaucuagaaua

SEQ ID NO: 103529 - RNA, 19 nt, Homo sapiens
gcuagaagcugcaucuuau

SEQ ID NO: 103530 - RNA, 19 nt, Homo sapiens
gcacaaagccauccgugua

SEQ ID NO: 103531 - RNA, 19 nt, Homo sapiens
gaauuaugcuggcuucuga

SEQ ID NO: 103532 - RNA, 19 nt, Homo sapiens
gcgcugaugugaucuauga

SEQ ID NO: 103533 - RNA, 19 nt, Homo sapiens
uaaagcagcucagguugua

SEQ ID NO: 103534 - RNA, 19 nt, Homo sapiens
ccacauacuuuauuucuuc

SEQ ID NO: 103535 - RNA, 19 nt, Homo sapiens
ucacagaaguccuggcuuu

SEQ ID NO: 103536 - RNA, 19 nt, Homo sapiens
gauaaaugaagcugacuua

SEQ ID NO: 103537 - RNA, 19 nt, Homo sapiens
gggaaaugcugaauuaaag

SEQ ID NO: 103538 - RNA, 19 nt, Homo sapiens
gguggaagcugcugauguu

SEQ ID NO: 103539 - RNA, 19 nt, Homo sapiens
ugacaaugguguuauuuga

SEQ ID NO: 103540 - RNA, 19 nt, Homo sapiens
gugagugucucuugucuaa

SEQ ID NO: 103541 - RNA, 19 nt, Homo sapiens
gacauccucuuuguucuua

SEQ ID NO: 103542 - RNA, 19 nt, Homo sapiens
ucuaguagcucaccgcuuu

SEQ ID NO: 103543 - RNA, 19 nt, Homo sapiens
gacaggaucuagaauaauc

SEQ ID NO: 103544 - RNA, 19 nt, Homo sapiens
gccaacacaucacucauuu

SEQ ID NO: 103545 - RNA, 19 nt, Homo sapiens
gagcuggagucaucagauu

SEQ ID NO: 103546 - RNA, 19 nt, Homo sapiens
gagccgagaucgugccauu

SEQ ID NO: 103547 - RNA, 19 nt, Homo sapiens
gaaacaucuugcuuauuug

SEQ ID NO: 103548 - RNA, 19 nt, Homo sapiens
ggauaaagcagcucagguu

SEQ ID NO: 103549 - RNA, 19 nt, Homo sapiens
gcagacauccucuuuguuc

SEQ ID NO: 103550 - RNA, 19 nt, Homo sapiens
caggagacauuaagauaga

SEQ ID NO: 103551 - RNA, 19 nt, Homo sapiens
caaaacaggugccauggua

SEQ ID NO: 103552 - RNA, 19 nt, Homo sapiens
ucaaugcgcugaugugauc

SEQ ID NO: 103553 - RNA, 19 nt, Homo sapiens
gaaagaacugucauguaaa

SEQ ID NO: 103554 - RNA, 19 nt, Homo sapiens
uaagauggguggaucacuu

SEQ ID NO: 103555 - RNA, 19 nt, Homo sapiens
aagacaggaucuagaauaa

SEQ ID NO: 103556 - RNA, 19 nt, Homo sapiens
ggaaagacaagcucaagug

SEQ ID NO: 103557 - RNA, 19 nt, Homo sapiens
uuugggaaaugcugaauua

SEQ ID NO: 103558 - RNA, 19 nt, Homo sapiens
gcaaauaggcguuacuuuu

SEQ ID NO: 103559 - RNA, 19 nt, Homo sapiens
guaaaggaguaugaaaguu

SEQ ID NO: 103560 - RNA, 19 nt, Homo sapiens
ccagugagaccgcagauaa

SEQ ID NO: 103561 - RNA, 19 nt, Homo sapiens
ucaauacccuacaggauau

SEQ ID NO: 103562 - RNA, 19 nt, Homo sapiens
gagauaaccagguaaagga

SEQ ID NO: 103563 - RNA, 19 nt, Homo sapiens
acagaaacaucuugcuuau

SEQ ID NO: 103564 - RNA, 19 nt, Homo sapiens
ugaaguaggaaucguauuu

SEQ ID NO: 103565 - RNA, 19 nt, Homo sapiens
ucaaugacauagaaaguuc

SEQ ID NO: 103566 - RNA, 19 nt, Homo sapiens
caacacaucacucauuuua

SEQ ID NO: 103567 - RNA, 19 nt, Homo sapiens
gcacagaaacaucuugcuu

SEQ ID NO: 103568 - RNA, 19 nt, Homo sapiens
aagacaagcucaaguguuc

SEQ ID NO: 103569 - RNA, 19 nt, Homo sapiens
ugacagacgucuaucucuu

SEQ ID NO: 103570 - RNA, 19 nt, Homo sapiens
ggaauauucugguggugau

SEQ ID NO: 103571 - RNA, 19 nt, Homo sapiens
uacaggauauacaugguua

SEQ ID NO: 103572 - RNA, 19 nt, Homo sapiens
caacuuuacugagacaaug

SEQ ID NO: 103573 - RNA, 19 nt, Homo sapiens
guuauaagcagcaggauug

SEQ ID NO: 103574 - RNA, 19 nt, Homo sapiens
ucagauuccucauaacaug

SEQ ID NO: 103575 - RNA, 19 nt, Homo sapiens
cacagaaacaucuugcuua

SEQ ID NO: 103576 - RNA, 19 nt, Homo sapiens
uuuaacagcucucuucaau

SEQ ID NO: 103577 - RNA, 19 nt, Homo sapiens
gcuaguguuuccucucauu

SEQ ID NO: 103578 - RNA, 19 nt, Homo sapiens
aaucauagcuguggugcuu

SEQ ID NO: 103579 - RNA, 19 nt, Homo sapiens
gcuacucuuugguuucuuu

SEQ ID NO: 103580 - RNA, 19 nt, Homo sapiens
ucuaugccaucaacuuuaa

SEQ ID NO: 103581 - RNA, 19 nt, Homo sapiens
gaaagacaagcucaagugu

SEQ ID NO: 103582 - RNA, 19 nt, Homo sapiens
aaaggaguaugaaaguuug

SEQ ID NO: 103583 - RNA, 19 nt, Homo sapiens
ggaugcugcuccugacuug

SEQ ID NO: 103584 - RNA, 19 nt, Homo sapiens
ccugggagcuguucucugu

SEQ ID NO: 103585 - RNA, 19 nt, Homo sapiens
cgacuccagugaagauuau

SEQ ID NO: 103586 - RNA, 19 nt, Homo sapiens
gaugagcuucucugcauaa

SEQ ID NO: 103587 - RNA, 19 nt, Homo sapiens
ugccaaagcugggagauga

SEQ ID NO: 103588 - RNA, 19 nt, Homo sapiens
gaaaugcugaauuaaagug

SEQ ID NO: 103589 - RNA, 19 nt, Homo sapiens
ugaaggaccuguggugugu

SEQ ID NO: 103590 - RNA, 19 nt, Homo sapiens
gcaguucuccaggcuauuu

SEQ ID NO: 103591 - RNA, 19 nt, Homo sapiens
gggcuguucuucagugguu

SEQ ID NO: 103592 - RNA, 19 nt, Homo sapiens
aaagaacugucauguaaac

SEQ ID NO: 103593 - RNA, 19 nt, Homo sapiens
cgaaaccccucucuacuaa

SEQ ID NO: 103594 - RNA, 19 nt, Homo sapiens
guaaugaaguugggguuua

SEQ ID NO: 103595 - RNA, 19 nt, Homo sapiens
ggaguucaaugccucucuu

SEQ ID NO: 103596 - RNA, 19 nt, Homo sapiens
ggccagguaugcauggaaa

SEQ ID NO: 103597 - RNA, 19 nt, Homo sapiens
gcguuugacucuagaaauc

SEQ ID NO: 103598 - RNA, 19 nt, Homo sapiens
gacaaugcgucguccuuca

SEQ ID NO: 103599 - RNA, 19 nt, Homo sapiens
cuugucagauuccucauaa

SEQ ID NO: 103600 - RNA, 19 nt, Homo sapiens
gagcuacucuuugguuucu

SEQ ID NO: 103601 - RNA, 19 nt, Homo sapiens
ucuuaucacuuuaccauug

SEQ ID NO: 103602 - RNA, 19 nt, Homo sapiens
ucucuucaaugacauagaa

SEQ ID NO: 103603 - RNA, 19 nt, Homo sapiens
ugaaauuugugauggaauc

SEQ ID NO: 103604 - RNA, 19 nt, Homo sapiens
uaugaggagcugcagauua

SEQ ID NO: 103605 - RNA, 19 nt, Homo sapiens
gagacaauguagaaagaag

SEQ ID NO: 103606 - RNA, 19 nt, Homo sapiens
aaauggagguggaaagaca

SEQ ID NO: 103607 - RNA, 19 nt, Homo sapiens
ugaaacauacucauagaug

SEQ ID NO: 103608 - RNA, 19 nt, Homo sapiens
gaaagcugagucucccuaa

SEQ ID NO: 103609 - RNA, 19 nt, Homo sapiens
ugugacggcugcaaauuug

SEQ ID NO: 103610 - RNA, 19 nt, Homo sapiens
gagugucucuugucuaaac

SEQ ID NO: 103611 - RNA, 19 nt, Homo sapiens
gaccgcagauaacgacaau

SEQ ID NO: 103612 - RNA, 19 nt, Homo sapiens
gcuaauuggcuauacgaaa

SEQ ID NO: 103613 - RNA, 19 nt, Homo sapiens
aaacagccuuugggaaaug

SEQ ID NO: 103614 - RNA, 19 nt, Homo sapiens
gccgggagguacucagaaa

SEQ ID NO: 103615 - RNA, 19 nt, Homo sapiens
aaaaucaucugccuuguug

SEQ ID NO: 103616 - RNA, 19 nt, Homo sapiens
cccaggagauaaccaggua

SEQ ID NO: 103617 - RNA, 19 nt, Homo sapiens
gguaaaggaguaugaaagu

SEQ ID NO: 103618 - RNA, 19 nt, Homo sapiens
uaugaaaguuuggguacaa

SEQ ID NO: 103619 - RNA, 19 nt, Homo sapiens
caaagcaaaggagugguua

SEQ ID NO: 103620 - RNA, 19 nt, Homo sapiens
aauagcaacuuguguuaca

SEQ ID NO: 103621 - RNA, 19 nt, Homo sapiens
uuacugagacaauguagaa

SEQ ID NO: 103622 - RNA, 19 nt, Homo sapiens
guagugggccauuaggaaa

SEQ ID NO: 103623 - RNA, 19 nt, Homo sapiens
caucuaugccaucaacuuu

SEQ ID NO: 103624 - RNA, 19 nt, Homo sapiens
gcaaugggcuggucguguu

SEQ ID NO: 103625 - RNA, 19 nt, Homo sapiens
agacagggcugauaagcua

SEQ ID NO: 103626 - RNA, 19 nt, Homo sapiens
ggucuucgguguccacuuu

SEQ ID NO: 103627 - RNA, 19 nt, Homo sapiens
gacaucagcuggucaaaca

SEQ ID NO: 103628 - RNA, 19 nt, Homo sapiens
gaaagugaaaguccagaaa

SEQ ID NO: 103629 - RNA, 19 nt, Homo sapiens
gcaacgaucucuucaagcu

SEQ ID NO: 103630 - RNA, 19 nt, Homo sapiens
gaaaaccucuccucauguu

SEQ ID NO: 103631 - RNA, 19 nt, Homo sapiens
ccagcuaccucaaccaaug

SEQ ID NO: 103632 - RNA, 19 nt, Homo sapiens
gcgaugcgaugcucucuca

SEQ ID NO: 103633 - RNA, 19 nt, Homo sapiens
ggaaacaacagcuuuaaaa

SEQ ID NO: 103634 - RNA, 19 nt, Homo sapiens
cagaccagcucuuccgaaa

SEQ ID NO: 103635 - RNA, 19 nt, Homo sapiens
gacaugcacucagcucuug

SEQ ID NO: 103636 - RNA, 19 nt, Homo sapiens
ucaagaggcucaagaccau

SEQ ID NO: 103637 - RNA, 19 nt, Homo sapiens
gaggagaggacaagggaaa

SEQ ID NO: 103638 - RNA, 19 nt, Homo sapiens
acacuuuguucgagucuuu

SEQ ID NO: 103639 - RNA, 19 nt, Homo sapiens
gagcagaugcaaugacuca

SEQ ID NO: 103640 - RNA, 19 nt, Homo sapiens
gaggaaacaacagcuuuaa

SEQ ID NO: 103641 - RNA, 19 nt, Homo sapiens
gcaacaaggccaucaaggu

SEQ ID NO: 103642 - RNA, 19 nt, Homo sapiens
ggcaugcuccuacuucuuu

SEQ ID NO: 103643 - RNA, 19 nt, Homo sapiens
ugaggaaacaacagcuuua

SEQ ID NO: 103644 - RNA, 19 nt, Homo sapiens
ggaaacagaggcuauuguc

SEQ ID NO: 103645 - RNA, 19 nt, Homo sapiens
cgucaacccuuucuuguac

SEQ ID NO: 103646 - RNA, 19 nt, Homo sapiens
gagcuucuguuaccuuguc

SEQ ID NO: 103647 - RNA, 19 nt, Homo sapiens
ccacacacagauaaaguuu

SEQ ID NO: 103648 - RNA, 19 nt, Homo sapiens
cccacgagcuuguucuuug

SEQ ID NO: 103649 - RNA, 19 nt, Homo sapiens
gaaaguccagaaacuguuc

SEQ ID NO: 103650 - RNA, 19 nt, Homo sapiens
ggucaaacaaacucucuga

SEQ ID NO: 103651 - RNA, 19 nt, Homo sapiens
gcaccugugagcucaguaa

SEQ ID NO: 103652 - RNA, 19 nt, Homo sapiens
ccacgagcuuguucuuugu

SEQ ID NO: 103653 - RNA, 19 nt, Homo sapiens
guguugaccuauaucuauu

SEQ ID NO: 103654 - RNA, 19 nt, Homo sapiens
uguacuccaucauuuguuu

SEQ ID NO: 103655 - RNA, 19 nt, Homo sapiens
uaucauguacuccaucauu

SEQ ID NO: 103656 - RNA, 19 nt, Homo sapiens
ggugguggcucuccuuguc

SEQ ID NO: 103657 - RNA, 19 nt, Homo sapiens
ccgcaacgaucucuucaag

SEQ ID NO: 103658 - RNA, 19 nt, Homo sapiens
gcuccaggcacgcaacuuu

SEQ ID NO: 103659 - RNA, 19 nt, Homo sapiens
gcucaucuuugccaucuac

SEQ ID NO: 103660 - RNA, 19 nt, Homo sapiens
gggagcagaugcaaugacu

SEQ ID NO: 103661 - RNA, 19 nt, Homo sapiens
cagagcuccuguacaguga

SEQ ID NO: 103662 - RNA, 19 nt, Homo sapiens
ggacgugcggaacuuuaaa

SEQ ID NO: 103663 - RNA, 19 nt, Homo sapiens
gaaggacgugcggaacuuu

SEQ ID NO: 103664 - RNA, 19 nt, Homo sapiens
gugggcaucuggauacuag

SEQ ID NO: 103665 - RNA, 19 nt, Homo sapiens
ucaagaccaugaccgauac

SEQ ID NO: 103666 - RNA, 19 nt, Homo sapiens
gcuaacaccagacagacaa

SEQ ID NO: 103667 - RNA, 19 nt, Homo sapiens
caucagcuggucaaacaaa

SEQ ID NO: 103668 - RNA, 19 nt, Homo sapiens
ucuucaagcucuucaagga

SEQ ID NO: 103669 - RNA, 19 nt, Homo sapiens
gcgucaacccuuucuugua

SEQ ID NO: 103670 - RNA, 19 nt, Homo sapiens
gccaugagcuucuguuacc

SEQ ID NO: 103671 - RNA, 19 nt, Homo sapiens
guucugcuuucgauucguu

SEQ ID NO: 103672 - RNA, 19 nt, Homo sapiens
aaccaggccuuaucuccaa

SEQ ID NO: 103673 - RNA, 19 nt, Homo sapiens
ccaaggagggugagugcaa

SEQ ID NO: 103674 - RNA, 19 nt, Homo sapiens
uaagcuaacaccagacaga

SEQ ID NO: 103675 - RNA, 19 nt, Homo sapiens
gauaagcuaacaccagaca

SEQ ID NO: 103676 - RNA, 19 nt, Homo sapiens
gcugcugcgucaacccuuu

SEQ ID NO: 103677 - RNA, 19 nt, Homo sapiens
ucccagagcuccuguacag

SEQ ID NO: 103678 - RNA, 19 nt, Homo sapiens
ccugugagcucaguaagca

SEQ ID NO: 103679 - RNA, 19 nt, Homo sapiens
agaaggacgugcggaacuu

SEQ ID NO: 103680 - RNA, 19 nt, Homo sapiens
gcaagccccugcuccagaa

SEQ ID NO: 103681 - RNA, 19 nt, Homo sapiens
guggccaacuucaacauca

SEQ ID NO: 103682 - RNA, 19 nt, Homo sapiens
guuaagagagcaacauuuu

SEQ ID NO: 103683 - RNA, 19 nt, Homo sapiens
ggagaggacaagggaaaug

SEQ ID NO: 103684 - RNA, 19 nt, Homo sapiens
gagaggacaagggaaaugu

SEQ ID NO: 103685 - RNA, 19 nt, Homo sapiens
gugaaaguccagaaacugu

SEQ ID NO: 103686 - RNA, 19 nt, Homo sapiens
ucuguuaccuugucaucau

SEQ ID NO: 103687 - RNA, 19 nt, Homo sapiens
gagcauguggaggccuuua

SEQ ID NO: 103688 - RNA, 19 nt, Homo sapiens
gcaugcuccuacuucuuug

SEQ ID NO: 103689 - RNA, 19 nt, Homo sapiens
guaugccugugucaagaug

SEQ ID NO: 103690 - RNA, 19 nt, Homo sapiens
ggucacggacgauuacauc

SEQ ID NO: 103691 - RNA, 19 nt, Homo sapiens
gagcuuguucuuuguucuu

SEQ ID NO: 103692 - RNA, 19 nt, Homo sapiens
agacaacacugggaaacag

SEQ ID NO: 103693 - RNA, 19 nt, Homo sapiens
cguguugaccuauaucuau

SEQ ID NO: 103694 - RNA, 19 nt, Homo sapiens
guugaccuauaucuauuuc

SEQ ID NO: 103695 - RNA, 19 nt, Homo sapiens
ccuaucauguacuccauca

SEQ ID NO: 103696 - RNA, 19 nt, Homo sapiens
gggaaacagaggcuauugu

SEQ ID NO: 103697 - RNA, 19 nt, Homo sapiens
cucaagaccaugaccgaua

SEQ ID NO: 103698 - RNA, 19 nt, Homo sapiens
acacacagauaaaguuuuc

SEQ ID NO: 103699 - RNA, 19 nt, Homo sapiens
uuucuucacuguccuccaa

SEQ ID NO: 103700 - RNA, 19 nt, Homo sapiens
gcccagagagcgucaugga

SEQ ID NO: 103701 - RNA, 19 nt, Homo sapiens
ucaguaagcaacucaacau

SEQ ID NO: 103702 - RNA, 19 nt, Homo sapiens
ucaaacaaacucucugaac

SEQ ID NO: 103703 - RNA, 19 nt, Homo sapiens
ugaaaguccagaaacuguu

SEQ ID NO: 103704 - RNA, 19 nt, Homo sapiens
gaugaggucacggacgauu

SEQ ID NO: 103705 - RNA, 19 nt, Homo sapiens
cccagacgguggccaacuu

SEQ ID NO: 103706 - RNA, 19 nt, Homo sapiens
cugaaaaccucuccucaug

SEQ ID NO: 103707 - RNA, 19 nt, Homo sapiens
ggacaucagcuggucaaac

SEQ ID NO: 103708 - RNA, 19 nt, Homo sapiens
ggagacuucuuggcuuggu

SEQ ID NO: 103709 - RNA, 19 nt, Homo sapiens
gaccagcucuuccgaaaac

SEQ ID NO: 103710 - RNA, 19 nt, Homo sapiens
auagggagcagaugcaaug

SEQ ID NO: 103711 - RNA, 19 nt, Homo sapiens
aucauguacuccaucauuu

SEQ ID NO: 103712 - RNA, 19 nt, Homo sapiens
ucauguacuccaucauuug

SEQ ID NO: 103713 - RNA, 19 nt, Homo sapiens
cagccuuccugugugguuu

SEQ ID NO: 103714 - RNA, 19 nt, Homo sapiens
ugacaugcacucagcucuu

SEQ ID NO: 103715 - RNA, 19 nt, Homo sapiens
gacaacacugggaaacaga

SEQ ID NO: 103716 - RNA, 19 nt, Homo sapiens
caaaagcugcucagggaaa

SEQ ID NO: 103717 - RNA, 19 nt, Homo sapiens
ggucguggucuucauaguc

SEQ ID NO: 103718 - RNA, 19 nt, Homo sapiens
caacuuugagcgcaacaag

SEQ ID NO: 103719 - RNA, 19 nt, Homo sapiens
gcauguggaggccuuuauc

SEQ ID NO: 103720 - RNA, 19 nt, Homo sapiens
agauaaaguuuucccuuga

SEQ ID NO: 103721 - RNA, 19 nt, Homo sapiens
ugaaagugaaaguccagaa

SEQ ID NO: 103722 - RNA, 19 nt, Homo sapiens
gacagacaacacugggaaa

SEQ ID NO: 103723 - RNA, 19 nt, Homo sapiens
guuccucccuaucauguac

SEQ ID NO: 103724 - RNA, 19 nt, Homo sapiens
gaacaaaggcugucacuaa

SEQ ID NO: 103725 - RNA, 19 nt, Homo sapiens
ugaaauggcuggagugauu

SEQ ID NO: 103726 - RNA, 19 nt, Homo sapiens
gaggaucaaugaagacuaa

SEQ ID NO: 103727 - RNA, 19 nt, Homo sapiens
cacaaugacuggagacaua

SEQ ID NO: 103728 - RNA, 19 nt, Homo sapiens
caaugaagaugaugcuauu

SEQ ID NO: 103729 - RNA, 19 nt, Homo sapiens
caugaaggaugccauauau

SEQ ID NO: 103730 - RNA, 19 nt, Homo sapiens
gaaacaccucucagaaaua

SEQ ID NO: 103731 - RNA, 19 nt, Homo sapiens
caccaucagucaaugaaua

SEQ ID NO: 103732 - RNA, 19 nt, Homo sapiens
gcaagaagcugaggagcau

SEQ ID NO: 103733 - RNA, 19 nt, Homo sapiens
gcagccaaaucuucaacua

SEQ ID NO: 103734 - RNA, 19 nt, Homo sapiens
gaacuuauucagacaaaug

SEQ ID NO: 103735 - RNA, 19 nt, Homo sapiens
uaucauaaguagagacuga

SEQ ID NO: 103736 - RNA, 19 nt, Homo sapiens
gacaguaaccuuucaauca

SEQ ID NO: 103737 - RNA, 19 nt, Homo sapiens
aaacaccucucagaaauau

SEQ ID NO: 103738 - RNA, 19 nt, Homo sapiens
agaaacaccucucagaaau

SEQ ID NO: 103739 - RNA, 19 nt, Homo sapiens
gggagaaguucaagaaaca

SEQ ID NO: 103740 - RNA, 19 nt, Homo sapiens
ggaauuggcaacacugaaa

SEQ ID NO: 103741 - RNA, 19 nt, Homo sapiens
uggaagaaguggauauuga

SEQ ID NO: 103742 - RNA, 19 nt, Homo sapiens
ugacaacagugaccgacua

SEQ ID NO: 103743 - RNA, 19 nt, Homo sapiens
ggaagaaguggauauugaa

SEQ ID NO: 103744 - RNA, 19 nt, Homo sapiens
caacagugaccgacuacua

SEQ ID NO: 103745 - RNA, 19 nt, Homo sapiens
caagaaacaccucucagaa

SEQ ID NO: 103746 - RNA, 19 nt, Homo sapiens
ucagacaaauggcaaguug

SEQ ID NO: 103747 - RNA, 19 nt, Homo sapiens
cuacuacccugauaucuuc

SEQ ID NO: 103748 - RNA, 19 nt, Homo sapiens
uguagacucuggaaguaua

SEQ ID NO: 103749 - RNA, 19 nt, Homo sapiens
acaguaaccuuucaaucaa

SEQ ID NO: 103750 - RNA, 19 nt, Homo sapiens
caaggugauugugauuaua

SEQ ID NO: 103751 - RNA, 19 nt, Homo sapiens
ugucugaccuccuucauau

SEQ ID NO: 103752 - RNA, 19 nt, Homo sapiens
aaagaugucugaccuccuu

SEQ ID NO: 103753 - RNA, 19 nt, Homo sapiens
gccaacagcugacuuaugc

SEQ ID NO: 103754 - RNA, 19 nt, Homo sapiens
acagagacuucuagacaaa

SEQ ID NO: 103755 - RNA, 19 nt, Homo sapiens
aaacagagacuucuagaca

SEQ ID NO: 103756 - RNA, 19 nt, Homo sapiens
ucaaggugauugugauuau

SEQ ID NO: 103757 - RNA, 19 nt, Homo sapiens
agaaguggauauugaaguu

SEQ ID NO: 103758 - RNA, 19 nt, Homo sapiens
auacagacuuugugaagaa

SEQ ID NO: 103759 - RNA, 19 nt, Homo sapiens
gcaaaggugugggugugaa

SEQ ID NO: 103760 - RNA, 19 nt, Homo sapiens
gaucuucaccaacuucaaa

SEQ ID NO: 103761 - RNA, 19 nt, Homo sapiens
gauguuucuucucauguaa

SEQ ID NO: 103762 - RNA, 19 nt, Homo sapiens
gaaggaugccauauauguu

SEQ ID NO: 103763 - RNA, 19 nt, Homo sapiens
gauacagacuuugugaaga

SEQ ID NO: 103764 - RNA, 19 nt, Homo sapiens
gucauugcaucuuuacuuu

SEQ ID NO: 103765 - RNA, 19 nt, Homo sapiens
caaaggcugucacuaaggu

SEQ ID NO: 103766 - RNA, 19 nt, Homo sapiens
cagcagcacgcauucauaa

SEQ ID NO: 103767 - RNA, 19 nt, Homo sapiens
aaauauaccuucagagacu

SEQ ID NO: 103768 - RNA, 19 nt, Homo sapiens
ucaguaggcuggaagaagu

SEQ ID NO: 103769 - RNA, 19 nt, Homo sapiens
gugauuguguuuauugaug

SEQ ID NO: 103770 - RNA, 19 nt, Homo sapiens
ugugaacccuguuaucuau

SEQ ID NO: 103771 - RNA, 19 nt, Homo sapiens
aaacuucaauauccacuuc

SEQ ID NO: 103772 - RNA, 19 nt, Homo sapiens
aaacuugccguuauugauu

SEQ ID NO: 103773 - RNA, 19 nt, Homo sapiens
caaguggccucugaagaug

SEQ ID NO: 103774 - RNA, 19 nt, Homo sapiens
ccgcugccuugauggauua

SEQ ID NO: 103775 - RNA, 19 nt, Homo sapiens
ccaaguggccucugaagau

SEQ ID NO: 103776 - RNA, 19 nt, Homo sapiens
guaccuggcuguuguccau

SEQ ID NO: 103777 - RNA, 19 nt, Homo sapiens
ugauguuucuucucaugua

SEQ ID NO: 103778 - RNA, 19 nt, Homo sapiens
ugaaggaugccauauaugu

SEQ ID NO: 103779 - RNA, 19 nt, Homo sapiens
acugaaaccuccagaacaa

SEQ ID NO: 103780 - RNA, 19 nt, Homo sapiens
uuggauggauguagcauaa

SEQ ID NO: 103781 - RNA, 19 nt, Homo sapiens
ucacagauguauaccucuu

SEQ ID NO: 103782 - RNA, 19 nt, Homo sapiens
aauaacagccucauugaug

SEQ ID NO: 103783 - RNA, 19 nt, Homo sapiens
gugauuauagugacaauga

SEQ ID NO: 103784 - RNA, 19 nt, Homo sapiens
uuaauggugcgucauauuu

SEQ ID NO: 103785 - RNA, 19 nt, Homo sapiens
ugucugauguuucuucuca

SEQ ID NO: 103786 - RNA, 19 nt, Homo sapiens
aagaaacaccucucagaaa

SEQ ID NO: 103787 - RNA, 19 nt, Homo sapiens
ucaagaaacaccucucaga

SEQ ID NO: 103788 - RNA, 19 nt, Homo sapiens
ucacuuccuugcacaguau

SEQ ID NO: 103789 - RNA, 19 nt, Homo sapiens
ggucauugcaucuuuacuu

SEQ ID NO: 103790 - RNA, 19 nt, Homo sapiens
gaauaacagccucauugau

SEQ ID NO: 103791 - RNA, 19 nt, Homo sapiens
ugaauaacagccucauuga

SEQ ID NO: 103792 - RNA, 19 nt, Homo sapiens
caaacacaaugccucaucu

SEQ ID NO: 103793 - RNA, 19 nt, Homo sapiens
ccaguugucuaugcauuga

SEQ ID NO: 103794 - RNA, 19 nt, Homo sapiens
gaagaugguguucuacagu

SEQ ID NO: 103795 - RNA, 19 nt, Homo sapiens
gaggauacagacuuuguga

SEQ ID NO: 103796 - RNA, 19 nt, Homo sapiens
ggauacagacuuugugaag

SEQ ID NO: 103797 - RNA, 19 nt, Homo sapiens
ggacaguaaccuuucaauc

SEQ ID NO: 103798 - RNA, 19 nt, Homo sapiens
ucaacugugucugauguuu

SEQ ID NO: 103799 - RNA, 19 nt, Homo sapiens
gauucuguaugccaaguga

SEQ ID NO: 103800 - RNA, 19 nt, Homo sapiens
gugguaacuuuaaaggauu

SEQ ID NO: 103801 - RNA, 19 nt, Homo sapiens
acaccucucagaaauauuu

SEQ ID NO: 103802 - RNA, 19 nt, Homo sapiens
ggacuguaaugugcaaagu

SEQ ID NO: 103803 - RNA, 19 nt, Homo sapiens
gaaacagccuggucauccu

SEQ ID NO: 103804 - RNA, 19 nt, Homo sapiens
caguaaccuuucaaucaaa

SEQ ID NO: 103805 - RNA, 19 nt, Homo sapiens
ccucaacugugucugaugu

SEQ ID NO: 103806 - RNA, 19 nt, Homo sapiens
ccugaucccucaacugugu

SEQ ID NO: 103807 - RNA, 19 nt, Homo sapiens
gcagcacgcauucauaaca

SEQ ID NO: 103808 - RNA, 19 nt, Homo sapiens
gagaggcugcugcucauug

SEQ ID NO: 103809 - RNA, 19 nt, Homo sapiens
acaugaggauacagacuuu

SEQ ID NO: 103810 - RNA, 19 nt, Homo sapiens
gaaguggauauugaaguuu

SEQ ID NO: 103811 - RNA, 19 nt, Homo sapiens
ccacccaugucacagaaau

SEQ ID NO: 103812 - RNA, 19 nt, Homo sapiens
ucaugaguguggacaggua

SEQ ID NO: 103813 - RNA, 19 nt, Homo sapiens
gaagaaggaauuggcaaca

SEQ ID NO: 103814 - RNA, 19 nt, Homo sapiens
ggagagcugugaaaaguca

SEQ ID NO: 103815 - RNA, 19 nt, Homo sapiens
gacuacuacuacccugaua

SEQ ID NO: 103816 - RNA, 19 nt, Homo sapiens
acagauguauaccucuuga

SEQ ID NO: 103817 - RNA, 19 nt, Homo sapiens
caagaaauuaucucagcuu

SEQ ID NO: 103818 - RNA, 19 nt, Homo sapiens
gcuuaucaguaguaucaau

SEQ ID NO: 103819 - RNA, 19 nt, Homo sapiens
gugaguaaguguaagaaaa

SEQ ID NO: 103820 - RNA, 19 nt, Homo sapiens
uaaaagccaucaaacacaa

SEQ ID NO: 103821 - RNA, 19 nt, Homo sapiens
gaagaaguggauauugaag

SEQ ID NO: 103822 - RNA, 19 nt, Homo sapiens
cagaaaaguugcagccaaa

SEQ ID NO: 103823 - RNA, 19 nt, Homo sapiens
cuugauggauuauacacuu

SEQ ID NO: 103824 - RNA, 19 nt, Homo sapiens
ggaaaugacuggcaugaau

SEQ ID NO: 103825 - RNA, 19 nt, Homo sapiens
gcaugagccuggacaagua

SEQ ID NO: 103826 - RNA, 19 nt, Homo sapiens
gccaguaccugaaggcuuu

SEQ ID NO: 103827 - RNA, 19 nt, Homo sapiens
gauauggucuuuguacaga

SEQ ID NO: 103828 - RNA, 19 nt, Homo sapiens
cuuaugagcugcuauugaa

SEQ ID NO: 103829 - RNA, 19 nt, Homo sapiens
ucugagagcagcauacuua

SEQ ID NO: 103830 - RNA, 19 nt, Homo sapiens
gaaccuccuucuucucaug

SEQ ID NO: 103831 - RNA, 19 nt, Homo sapiens
gcuccuugcuaccauagua

SEQ ID NO: 103832 - RNA, 19 nt, Homo sapiens
ucaauuggguguccacuca

SEQ ID NO: 103833 - RNA, 19 nt, Homo sapiens
ggagagaggcagucugaga

SEQ ID NO: 103834 - RNA, 19 nt, Homo sapiens
gaaaugacuggcaugaaug

SEQ ID NO: 103835 - RNA, 19 nt, Homo sapiens
ugagcacucuuuauacuau

SEQ ID NO: 103836 - RNA, 19 nt, Homo sapiens
gaugggaaccagcucaauu

SEQ ID NO: 103837 - RNA, 19 nt, Homo sapiens
gagagaggcagucugagaa

SEQ ID NO: 103838 - RNA, 19 nt, Homo sapiens
gcacugcccaggccucauu

SEQ ID NO: 103839 - RNA, 19 nt, Homo sapiens
cagccugagugaccaaauu

SEQ ID NO: 103840 - RNA, 19 nt, Homo sapiens
ggugagcacucuuuauacu

SEQ ID NO: 103841 - RNA, 19 nt, Homo sapiens
gagagcagcauacuuacug

SEQ ID NO: 103842 - RNA, 19 nt, Homo sapiens
gagcacucuuuauacuauu

SEQ ID NO: 103843 - RNA, 19 nt, Homo sapiens
gcaggcggaugguugagau

SEQ ID NO: 103844 - RNA, 19 nt, Homo sapiens
ucugagaacuacccuaaca

SEQ ID NO: 103845 - RNA, 19 nt, Homo sapiens
agacuacgcacuccaggua

SEQ ID NO: 103846 - RNA, 19 nt, Homo sapiens
gcggaugguugagaucuau

SEQ ID NO: 103847 - RNA, 19 nt, Homo sapiens
ggcauuuccuuccaacaug

SEQ ID NO: 103848 - RNA, 19 nt, Homo sapiens
gccaugaucuucuucuacu

SEQ ID NO: 103849 - RNA, 19 nt, Homo sapiens
gcgggaaccuccuucuucu

SEQ ID NO: 103850 - RNA, 19 nt, Homo sapiens
ccacugaggaugccgauuc

SEQ ID NO: 103851 - RNA, 19 nt, Homo sapiens
acaaguaccuggagaucgu

SEQ ID NO: 103852 - RNA, 19 nt, Homo sapiens
agaacuacccuaacaagga

SEQ ID NO: 103853 - RNA, 19 nt, Homo sapiens
gcaagauggugagcacucu

SEQ ID NO: 103854 - RNA, 19 nt, Homo sapiens
gggaaccuccuucuucuca

SEQ ID NO: 103855 - RNA, 19 nt, Homo sapiens
gaggaaaugacuggcauga

SEQ ID NO: 103856 - RNA, 19 nt, Homo sapiens
gcaaguauucgggaacugu

SEQ ID NO: 103857 - RNA, 19 nt, Homo sapiens
uguuggaccugcaaguauu

SEQ ID NO: 103858 - RNA, 19 nt, Homo sapiens
ggacaaguaccuggagauc

SEQ ID NO: 103859 - RNA, 19 nt, Homo sapiens
gaggucagccagcaucuag

SEQ ID NO: 103860 - RNA, 19 nt, Homo sapiens
gcuguuggaccugcaagua

SEQ ID NO: 103861 - RNA, 19 nt, Homo sapiens
uuauccagcuguucugaga

SEQ ID NO: 103862 - RNA, 19 nt, Homo sapiens
gcccaggccucauuaucca

SEQ ID NO: 103863 - RNA, 19 nt, Homo sapiens
uggcaugaaugaccuugga

SEQ ID NO: 103864 - RNA, 19 nt, Homo sapiens
gagcaucgccuuccuucac

SEQ ID NO: 103865 - RNA, 19 nt, Homo sapiens
gaggaugccgauucugaga

SEQ ID NO: 103866 - RNA, 19 nt, Homo sapiens
caucuccaaccuucuguuu

SEQ ID NO: 103867 - RNA, 19 nt, Homo sapiens
guacugauugaauuacuca

SEQ ID NO: 103868 - RNA, 19 nt, Homo sapiens
gcacuccagguaacagaga

SEQ ID NO: 103869 - RNA, 19 nt, Homo sapiens
ccguauugguugugucuug

SEQ ID NO: 103870 - RNA, 19 nt, Homo sapiens
cugccucucugcaaaguug

SEQ ID NO: 103871 - RNA, 19 nt, Homo sapiens
ucuccaaccuucuguuucu

SEQ ID NO: 103872 - RNA, 19 nt, Homo sapiens
ggcggaugguugagaucua

SEQ ID NO: 103873 - RNA, 19 nt, Homo sapiens
uagcagcuucuauuacuau

SEQ ID NO: 103874 - RNA, 19 nt, Homo sapiens
ucugcaaaguugagcacua

SEQ ID NO: 103875 - RNA, 19 nt, Homo sapiens
ucccugauauggucuuugu

SEQ ID NO: 103876 - RNA, 19 nt, Homo sapiens
gggcauuuccuuccaacau

SEQ ID NO: 103877 - RNA, 19 nt, Homo sapiens
gugagcacucuuuauacua

SEQ ID NO: 103878 - RNA, 19 nt, Homo sapiens
auggugagcacucuuuaua

SEQ ID NO: 103879 - RNA, 19 nt, Homo sapiens
ccaaggguguguggaacug

SEQ ID NO: 103880 - RNA, 19 nt, Homo sapiens
gauggugagcacucuuuau

SEQ ID NO: 103881 - RNA, 19 nt, Homo sapiens
ggucuucgggaguuucuug

SEQ ID NO: 103882 - RNA, 19 nt, Homo sapiens
cagcuucuauuacuaugac

SEQ ID NO: 103883 - RNA, 19 nt, Homo sapiens
ucauggucuugcuccguua

SEQ ID NO: 103884 - RNA, 19 nt, Homo sapiens
agucugagaacuacccuaa

SEQ ID NO: 103885 - RNA, 19 nt, Homo sapiens
gaggcagucugagaacuac

SEQ ID NO: 103886 - RNA, 19 nt, Homo sapiens
ucagccagcaucuagacua

SEQ ID NO: 103887 - RNA, 19 nt, Homo sapiens
agucuucuauagccugauu

SEQ ID NO: 103888 - RNA, 19 nt, Homo sapiens
agaggcagucugagaacua

SEQ ID NO: 103889 - RNA, 19 nt, Homo sapiens
aaaugacuggcaugaauga

SEQ ID NO: 103890 - RNA, 19 nt, Homo sapiens
ggaaccuccuucuucucau

SEQ ID NO: 103891 - RNA, 19 nt, Homo sapiens
aauuggguguccacucaaa

SEQ ID NO: 103892 - RNA, 19 nt, Homo sapiens
cgucgggacugggcauuuc

SEQ ID NO: 103893 - RNA, 19 nt, Homo sapiens
gagaggcagucugagaacu

SEQ ID NO: 103894 - RNA, 19 nt, Homo sapiens
cauacuuacugcccaagag

SEQ ID NO: 103895 - RNA, 19 nt, Homo sapiens
gcagcuucuauuacuauga

SEQ ID NO: 103896 - RNA, 19 nt, Homo sapiens
ugagaacuacccuaacaag

SEQ ID NO: 103897 - RNA, 19 nt, Homo sapiens
cagccagcaucuagacuac

SEQ ID NO: 103898 - RNA, 19 nt, Homo sapiens
cugaggaugccgauucuga

SEQ ID NO: 103899 - RNA, 19 nt, Homo sapiens
gcaaaguugagcacuacag

SEQ ID NO: 103900 - RNA, 19 nt, Homo sapiens
cauugggucuucgggaguu

SEQ ID NO: 103901 - RNA, 19 nt, Homo sapiens
cugcaaaguugagcacuac

SEQ ID NO: 103902 - RNA, 19 nt, Homo sapiens
gcauacuuacugcccaaga

SEQ ID NO: 103903 - RNA, 19 nt, Homo sapiens
uguaugccuucuccaguca

SEQ ID NO: 103904 - RNA, 19 nt, Homo sapiens
ucaccuuguuucugcauac

SEQ ID NO: 103905 - RNA, 19 nt, Homo sapiens
ggccuggcauugggucuuc

SEQ ID NO: 103906 - RNA, 19 nt, Homo sapiens
cauagaagcuuuaccaaga

SEQ ID NO: 103907 - RNA, 19 nt, Homo sapiens
gaauggaggaugaagauua

SEQ ID NO: 103908 - RNA, 19 nt, Homo sapiens
ccaaggauaugucuucuga

SEQ ID NO: 103909 - RNA, 19 nt, Homo sapiens
gaaauagaguccacuucuu

SEQ ID NO: 103910 - RNA, 19 nt, Homo sapiens
gaucuugaaugaacaaaug

SEQ ID NO: 103911 - RNA, 19 nt, Homo sapiens
gcagggagcucaggacaga

SEQ ID NO: 103912 - RNA, 19 nt, Homo sapiens
gguccuggcuuucuucuug

SEQ ID NO: 103913 - RNA, 19 nt, Homo sapiens
ggucaaugcucuaagugaa

SEQ ID NO: 103914 - RNA, 19 nt, Homo sapiens
gagaggacuucuaugaaug

SEQ ID NO: 103915 - RNA, 19 nt, Homo sapiens
gcaauggucuggugaucau

SEQ ID NO: 103916 - RNA, 19 nt, Homo sapiens
ugagaggacuucuaugaau

SEQ ID NO: 103917 - RNA, 19 nt, Homo sapiens
gacauagaauggaggauga

SEQ ID NO: 103918 - RNA, 19 nt, Homo sapiens
gcucagggcucugcaacaa

SEQ ID NO: 103919 - RNA, 19 nt, Homo sapiens
ggaugaagauuacaacacu

SEQ ID NO: 103920 - RNA, 19 nt, Homo sapiens
ggacagccaugugcaagau

SEQ ID NO: 103921 - RNA, 19 nt, Homo sapiens
gcccaucucuccagcagaa

SEQ ID NO: 103922 - RNA, 19 nt, Homo sapiens
gaacugcuuucugggcaaa

SEQ ID NO: 103923 - RNA, 19 nt, Homo sapiens
acaaaugaaugaacugcuu

SEQ ID NO: 103924 - RNA, 19 nt, Homo sapiens
uuacaacacuuccaucagu

SEQ ID NO: 103925 - RNA, 19 nt, Homo sapiens
gccuuggacuagcaauuua

SEQ ID NO: 103926 - RNA, 19 nt, Homo sapiens
ggugaugaauacccugauu

SEQ ID NO: 103927 - RNA, 19 nt, Homo sapiens
gaagaagacagugaacaug

SEQ ID NO: 103928 - RNA, 19 nt, Homo sapiens
ugaaugagaggacuucuau

SEQ ID NO: 103929 - RNA, 19 nt, Homo sapiens
ucagggcucugcaacaaug

SEQ ID NO: 103930 - RNA, 19 nt, Homo sapiens
gaaaauauccugcuucaac

SEQ ID NO: 103931 - RNA, 19 nt, Homo sapiens
ggacacagccaaccugcau

SEQ ID NO: 103932 - RNA, 19 nt, Homo sapiens
ucaguuacggugaugaaua

SEQ ID NO: 103933 - RNA, 19 nt, Homo sapiens
gugaugaauacccugauua

SEQ ID NO: 103934 - RNA, 19 nt, Homo sapiens
aaauagaguccacuucuug

SEQ ID NO: 103935 - RNA, 19 nt, Homo sapiens
uagcacagcaucacuucua

SEQ ID NO: 103936 - RNA, 19 nt, Homo sapiens
ccagggacacccaaggaua

SEQ ID NO: 103937 - RNA, 19 nt, Homo sapiens
aaugagaggacuucuauga

SEQ ID NO: 103938 - RNA, 19 nt, Homo sapiens
gaugaagauuacaacacuu

SEQ ID NO: 103939 - RNA, 19 nt, Homo sapiens
caaaugaaugaacugcuuu

SEQ ID NO: 103940 - RNA, 19 nt, Homo sapiens
ucaaugcucuaagugaaga

SEQ ID NO: 103941 - RNA, 19 nt, Homo sapiens
cgaguggccugcagucaca

SEQ ID NO: 103942 - RNA, 19 nt, Homo sapiens
ccacugcccuugccauugc

SEQ ID NO: 103943 - RNA, 19 nt, Homo sapiens
caucaucauuaccuucuuc

SEQ ID NO: 103944 - RNA, 19 nt, Homo sapiens
cagaggagccugugauugg

SEQ ID NO: 103945 - RNA, 19 nt, Homo sapiens
ggagaaauagaguccacuu

SEQ ID NO: 103946 - RNA, 19 nt, Homo sapiens
caagguggcccucuucucu

SEQ ID NO: 103947 - RNA, 19 nt, Homo sapiens
gauuacaacacuuccauca

SEQ ID NO: 103948 - RNA, 19 nt, Homo sapiens
gcaacuuccuucucaucca

SEQ ID NO: 103949 - RNA, 19 nt, Homo sapiens
cagugaacauggucugguu

SEQ ID NO: 103950 - RNA, 19 nt, Homo sapiens
gggaaaauauccugcuuca

SEQ ID NO: 103951 - RNA, 19 nt, Homo sapiens
caaccugcaugggaaaaua

SEQ ID NO: 103952 - RNA, 19 nt, Homo sapiens
uggcagauuuccuguucaa

SEQ ID NO: 103953 - RNA, 19 nt, Homo sapiens
caguuacggugaugaauac

SEQ ID NO: 103954 - RNA, 19 nt, Homo sapiens
acaacacuuccaucaguua

SEQ ID NO: 103955 - RNA, 19 nt, Homo sapiens
ugggaggcgugacauagaa

SEQ ID NO: 103956 - RNA, 19 nt, Homo sapiens
uagaagcuuuaccaagaug

SEQ ID NO: 103957 - RNA, 19 nt, Homo sapiens
ucaucuggguccuggcuuu

SEQ ID NO: 103958 - RNA, 19 nt, Homo sapiens
gcagcguucgccuggcuua

SEQ ID NO: 103959 - RNA, 19 nt, Homo sapiens
ugaagaagacagugaacau

SEQ ID NO: 103960 - RNA, 19 nt, Homo sapiens
uacaacacuuccaucaguu

SEQ ID NO: 103961 - RNA, 19 nt, Homo sapiens
ugaugaauacccugauuau

SEQ ID NO: 103962 - RNA, 19 nt, Homo sapiens
auugugaccaucaucauua

SEQ ID NO: 103963 - RNA, 19 nt, Homo sapiens
gagaaauagaguccacuuc

SEQ ID NO: 103964 - RNA, 19 nt, Homo sapiens
caagaucagcaacuuccuu

SEQ ID NO: 103965 - RNA, 19 nt, Homo sapiens
cagauuuccuguucaacgu

SEQ ID NO: 103966 - RNA, 19 nt, Homo sapiens
gggcaauggucuggugauc

SEQ ID NO: 103967 - RNA, 19 nt, Homo sapiens
uagaauggaggaugaagau

SEQ ID NO: 103968 - RNA, 19 nt, Homo sapiens
gcaucacuucuaccacuuu

SEQ ID NO: 103969 - RNA, 19 nt, Homo sapiens
cagggacacccaaggauau

SEQ ID NO: 103970 - RNA, 19 nt, Homo sapiens
gaugggaggcgugacauag

SEQ ID NO: 103971 - RNA, 19 nt, Homo sapiens
gggcucugcaacaaugaua

SEQ ID NO: 103972 - RNA, 19 nt, Homo sapiens
gggaaucuagggccuggaa

SEQ ID NO: 103973 - RNA, 19 nt, Homo sapiens
gagggagaccggcaugcuu

SEQ ID NO: 103974 - RNA, 19 nt, Homo sapiens
gcaugaaccccauucugua

SEQ ID NO: 103975 - RNA, 19 nt, Homo sapiens
ucaagauuauugugaccau

SEQ ID NO: 103976 - RNA, 19 nt, Homo sapiens
gaucagcaacuuccuucuc

SEQ ID NO: 103977 - RNA, 19 nt, Homo sapiens
agaagacagugaacauggu

SEQ ID NO: 103978 - RNA, 19 nt, Homo sapiens
aauggaggaugaagauuac

SEQ ID NO: 103979 - RNA, 19 nt, Homo sapiens
caucacuucuaccacuuuc

SEQ ID NO: 103980 - RNA, 19 nt, Homo sapiens
ggagaccggcaugcuuuga

SEQ ID NO: 103981 - RNA, 19 nt, Homo sapiens
auagaagcuuuaccaagau

SEQ ID NO: 103982 - RNA, 19 nt, Homo sapiens
ccauacagccuuggacuag

SEQ ID NO: 103983 - RNA, 19 nt, Homo sapiens
ugcaugggaugaacagugu

SEQ ID NO: 103984 - RNA, 19 nt, Homo sapiens
agaggacuucuaugaauga

SEQ ID NO: 103985 - RNA, 19 nt, Homo sapiens
auacaggccacucuuccua

SEQ ID NO: 103986 - RNA, 19 nt, Homo sapiens
ccacacacucaaccuccua

SEQ ID NO: 103987 - RNA, 19 nt, Homo sapiens
ggaagccuccgggugauag

SEQ ID NO: 103988 - RNA, 19 nt, Homo sapiens
gaagccagggugugcaagu

SEQ ID NO: 103989 - RNA, 19 nt, Homo sapiens
gggaagccuccgggugaua

SEQ ID NO: 103990 - RNA, 19 nt, Homo sapiens
ccuggucaaugcucuaagu

SEQ ID NO: 103991 - RNA, 19 nt, Homo sapiens
ugaccaucaucauuaccuu

SEQ ID NO: 103992 - RNA, 19 nt, Homo sapiens
cccaauccauaucaccuau

SEQ ID NO: 103993 - RNA, 19 nt, Homo sapiens
caacgucuuccucccaauc

SEQ ID NO: 103994 - RNA, 19 nt, Homo sapiens
aguggcagauuuccuguuc

SEQ ID NO: 103995 - RNA, 19 nt, Homo sapiens
ucuuuagcauccaccaauu

SEQ ID NO: 103996 - RNA, 19 nt, Homo sapiens
uauccugcuucaacaacuu

SEQ ID NO: 103997 - RNA, 19 nt, Homo sapiens
gccagaggagccugugauu

SEQ ID NO: 103998 - RNA, 19 nt, Homo sapiens
guccuggcuuucuucuuga

SEQ ID NO: 103999 - RNA, 19 nt, Homo sapiens
acagccaugugcaagauca

SEQ ID NO: 104000 - RNA, 19 nt, Homo sapiens
ccagaggagccugugauug

SEQ ID NO: 104001 - RNA, 19 nt, Homo sapiens
aaugauagcagaagcugau

SEQ ID NO: 104002 - RNA, 19 nt, Homo sapiens
auacagccuuggacuagca

SEQ ID NO: 104003 - RNA, 19 nt, Homo sapiens
ccaugccagugcagauuca

SEQ ID NO: 104004 - RNA, 19 nt, Homo sapiens
agaccggcaugcuuugauc

SEQ ID NO: 104005 - RNA, 19 nt, Homo sapiens
uuucaugggucaggacuuc

SEQ ID NO: 104006 - RNA, 19 nt, Homo sapiens
gaucauagcuugaacugaa

SEQ ID NO: 104007 - RNA, 19 nt, Homo sapiens
gaucauaaauccagacuca

SEQ ID NO: 104008 - RNA, 19 nt, Homo sapiens
caaagagaauggagaauug

SEQ ID NO: 104009 - RNA, 19 nt, Homo sapiens
caaccuacacuuccuauua

SEQ ID NO: 104010 - RNA, 19 nt, Homo sapiens
gaaccagucccuuuaagua

SEQ ID NO: 104011 - RNA, 19 nt, Homo sapiens
ggaaagagguagugccaau

SEQ ID NO: 104012 - RNA, 19 nt, Homo sapiens
gcaggagacuucaaggaaa

SEQ ID NO: 104013 - RNA, 19 nt, Homo sapiens
gagaauugguugaccuaaa

SEQ ID NO: 104014 - RNA, 19 nt, Homo sapiens
gaugugcccucuuuaaauc

SEQ ID NO: 104015 - RNA, 19 nt, Homo sapiens
uuacugaugugcccucuuu

SEQ ID NO: 104016 - RNA, 19 nt, Homo sapiens
gaaggcccauggucagauu

SEQ ID NO: 104017 - RNA, 19 nt, Homo sapiens
ggaguggaguggaagaaga

SEQ ID NO: 104018 - RNA, 19 nt, Homo sapiens
ggaaguaauuggcauucug

SEQ ID NO: 104019 - RNA, 19 nt, Homo sapiens
ggaagaagagggagagaug

SEQ ID NO: 104020 - RNA, 19 nt, Homo sapiens
aaacaaagcgaaacaaaca

SEQ ID NO: 104021 - RNA, 19 nt, Homo sapiens
acaggcagcuuuaaccauu

SEQ ID NO: 104022 - RNA, 19 nt, Homo sapiens
cuccagcccucucaaguua

SEQ ID NO: 104023 - RNA, 19 nt, Homo sapiens
ccagcuaacuuuuguauuu

SEQ ID NO: 104024 - RNA, 19 nt, Homo sapiens
aaccuacacuuccuauuaa

SEQ ID NO: 104025 - RNA, 19 nt, Homo sapiens
aauaguagcugugagaaga

SEQ ID NO: 104026 - RNA, 19 nt, Homo sapiens
agaauugguugaccuaaau

SEQ ID NO: 104027 - RNA, 19 nt, Homo sapiens
ccaaagagaauggagaauu

SEQ ID NO: 104028 - RNA, 19 nt, Homo sapiens
uaauuggcauucuguguga

SEQ ID NO: 104029 - RNA, 19 nt, Homo sapiens
aaagauaucagcauuguag

SEQ ID NO: 104030 - RNA, 19 nt, Homo sapiens
aaaguggaacugaauagua

SEQ ID NO: 104031 - RNA, 19 nt, Homo sapiens
gaaguaauuggcauucugu

SEQ ID NO: 104032 - RNA, 19 nt, Homo sapiens
caggcagcuuuaaccauua

SEQ ID NO: 104033 - RNA, 19 nt, Homo sapiens
ccagcccucucaaguuaaa

SEQ ID NO: 104034 - RNA, 19 nt, Homo sapiens
aaggagaccauuuggauuu

SEQ ID NO: 104035 - RNA, 19 nt, Homo sapiens
gugcugggauuaccgguau

SEQ ID NO: 104036 - RNA, 19 nt, Homo sapiens
cauuaaaacugaagucuga

SEQ ID NO: 104037 - RNA, 19 nt, Homo sapiens
gcaggcaucuggguguugu

SEQ ID NO: 104038 - RNA, 19 nt, Homo sapiens
ccaaccaguuccugccaaa

SEQ ID NO: 104039 - RNA, 19 nt, Homo sapiens
gucuagaccugcaucuuga

SEQ ID NO: 104040 - RNA, 19 nt, Homo sapiens
ggccuuccaucuaaucuuc

SEQ ID NO: 104041 - RNA, 19 nt, Homo sapiens
gcaucuggguguuguccuu

SEQ ID NO: 104042 - RNA, 19 nt, Homo sapiens
gguguggaguauccugaaa

SEQ ID NO: 104043 - RNA, 19 nt, Homo sapiens
ugauaccauucacuacuuu

SEQ ID NO: 104044 - RNA, 19 nt, Homo sapiens
gcaugaggcaucacuguuc

SEQ ID NO: 104045 - RNA, 19 nt, Homo sapiens
caucuuuccugagaaguga

SEQ ID NO: 104046 - RNA, 19 nt, Homo sapiens
ggagagauggagcaaagug

SEQ ID NO: 104047 - RNA, 19 nt, Homo sapiens
cuuccucucuggcugauuu

SEQ ID NO: 104048 - RNA, 19 nt, Homo sapiens
guucaauuauccagucuag

SEQ ID NO: 104049 - RNA, 19 nt, Homo sapiens
caaggagaccauuuggauu

SEQ ID NO: 104050 - RNA, 19 nt, Homo sapiens
ugucuaaaguggaacugaa

SEQ ID NO: 104051 - RNA, 19 nt, Homo sapiens
ucaaacugcuaacaucaag

SEQ ID NO: 104052 - RNA, 19 nt, Homo sapiens
caaggcaccuggaguuuug

SEQ ID NO: 104053 - RNA, 19 nt, Homo sapiens
cgacggccaugaacacuac

SEQ ID NO: 104054 - RNA, 19 nt, Homo sapiens
ucuccuauaugauaccauu

SEQ ID NO: 104055 - RNA, 19 nt, Homo sapiens
gcugugagaagauaggaaa

SEQ ID NO: 104056 - RNA, 19 nt, Homo sapiens
caaagugagggccgaguga

SEQ ID NO: 104057 - RNA, 19 nt, Homo sapiens
aaguggaacugaauaguag

SEQ ID NO: 104058 - RNA, 19 nt, Homo sapiens
gagagauggagcaaaguga

SEQ ID NO: 104059 - RNA, 19 nt, Homo sapiens
cauaccuccuucuccuaua

SEQ ID NO: 104060 - RNA, 19 nt, Homo sapiens
ggaaccagucccuuuaagu

SEQ ID NO: 104061 - RNA, 19 nt, Homo sapiens
aauggaaccagucccuuua

SEQ ID NO: 104062 - RNA, 19 nt, Homo sapiens
uaguagcugugagaagaua

SEQ ID NO: 104063 - RNA, 19 nt, Homo sapiens
caggagacuucaaggaaag

SEQ ID NO: 104064 - RNA, 19 nt, Homo sapiens
gcuccuuccuggucucuuc

SEQ ID NO: 104065 - RNA, 19 nt, Homo sapiens
gagucucgcucugucauuc

SEQ ID NO: 104066 - RNA, 19 nt, Homo sapiens
ccugagaagugagaguuga

SEQ ID NO: 104067 - RNA, 19 nt, Homo sapiens
aaauggaaccagucccuuu

SEQ ID NO: 104068 - RNA, 19 nt, Homo sapiens
ggaccucaguggccaccau

SEQ ID NO: 104069 - RNA, 19 nt, Homo sapiens
ccagcucggccucaacuuu

SEQ ID NO: 104070 - RNA, 19 nt, Homo sapiens
gcccaaggcaccuggaguu

SEQ ID NO: 104071 - RNA, 19 nt, Homo sapiens
caugaacacuacaucuucu

SEQ ID NO: 104072 - RNA, 19 nt, Homo sapiens
ugccucagccucccaagua

SEQ ID NO: 104073 - RNA, 19 nt, Homo sapiens
ccaugaacacuacaucuuc

SEQ ID NO: 104074 - RNA, 19 nt, Homo sapiens
cuccuucuccuauaugaua

SEQ ID NO: 104075 - RNA, 19 nt, Homo sapiens
ccuccaaucugagcccauu

SEQ ID NO: 104076 - RNA, 19 nt, Homo sapiens
agggagagauggagcaaag

SEQ ID NO: 104077 - RNA, 19 nt, Homo sapiens
gccaugaacacuacaucuu

SEQ ID NO: 104078 - RNA, 19 nt, Homo sapiens
ccucugcucugugguacuu

SEQ ID NO: 104079 - RNA, 19 nt, Homo sapiens
ugaugugcccucuuuaaau

SEQ ID NO: 104080 - RNA, 19 nt, Homo sapiens
aaccagucccuuuaaguaa

SEQ ID NO: 104081 - RNA, 19 nt, Homo sapiens
gaauaguagcugugagaag

SEQ ID NO: 104082 - RNA, 19 nt, Homo sapiens
cagcucggccucaacuuug

SEQ ID NO: 104083 - RNA, 19 nt, Homo sapiens
ucaauuauccagucuagac

SEQ ID NO: 104084 - RNA, 19 nt, Homo sapiens
aaagcgaaacaaacacaaa

SEQ ID NO: 104085 - RNA, 19 nt, Homo sapiens
gauaccaaggagaccauuu

SEQ ID NO: 104086 - RNA, 19 nt, Homo sapiens
gaaagagguagugccaauc

SEQ ID NO: 104087 - RNA, 19 nt, Homo sapiens
gugagaagauaggaaagag

SEQ ID NO: 104088 - RNA, 19 nt, Homo sapiens
ggccagcuacucggacaua

SEQ ID NO: 104089 - RNA, 19 nt, Homo sapiens
ucaucucucugcuggcuau

SEQ ID NO: 104090 - RNA, 19 nt, Homo sapiens
ggagaauugguugaccuaa

SEQ ID NO: 104091 - RNA, 19 nt, Homo sapiens
aaacugcuaacaucaagug

SEQ ID NO: 104092 - RNA, 19 nt, Homo sapiens
auaccuccuucuccuauau

SEQ ID NO: 104093 - RNA, 19 nt, Homo sapiens
ucuaaaguggaacugaaua

SEQ ID NO: 104094 - RNA, 19 nt, Homo sapiens
gcucccacaggcagcuuua

SEQ ID NO: 104095 - RNA, 19 nt, Homo sapiens
gagcccauuucccuucucu

SEQ ID NO: 104096 - RNA, 19 nt, Homo sapiens
gaauugguugaccuaaaug

SEQ ID NO: 104097 - RNA, 19 nt, Homo sapiens
ggggaaaggggaaguaauu

SEQ ID NO: 104098 - RNA, 19 nt, Homo sapiens
ucagcaggguaaccacaug

SEQ ID NO: 104099 - RNA, 19 nt, Homo sapiens
gugcaguggugcgaucuca

SEQ ID NO: 104100 - RNA, 19 nt, Homo sapiens
ucacggccaugagucuaga

SEQ ID NO: 104101 - RNA, 19 nt, Homo sapiens
cucacuagguguagaguuc

SEQ ID NO: 104102 - RNA, 19 nt, Homo sapiens
caucagcuuccaaccaguu

SEQ ID NO: 104103 - RNA, 19 nt, Homo sapiens
caaagcgaaacaaacacaa

SEQ ID NO: 104104 - RNA, 19 nt, Homo sapiens
cuacacuuccuauuaaucu

SEQ ID NO: 104105 - RNA, 19 nt, Homo sapiens
uaccaaagagaauggagaa

SEQ ID NO: 104106 - RNA, 19 nt, Homo sapiens
gaaucaagauccugaaaua

SEQ ID NO: 104107 - RNA, 19 nt, Homo sapiens
gaaccugacugucuucuuu

SEQ ID NO: 104108 - RNA, 19 nt, Homo sapiens
uaucauggcuucuguauau

SEQ ID NO: 104109 - RNA, 19 nt, Homo sapiens
gaaggaagacgaagaacua

SEQ ID NO: 104110 - RNA, 19 nt, Homo sapiens
cuacggagcucugggauua

SEQ ID NO: 104111 - RNA, 19 nt, Homo sapiens
ggaugaaucucgacccuuu

SEQ ID NO: 104112 - RNA, 19 nt, Homo sapiens
cuaagaaucugaagacauu

SEQ ID NO: 104113 - RNA, 19 nt, Homo sapiens
gacaggagcuggaaaguca

SEQ ID NO: 104114 - RNA, 19 nt, Homo sapiens
ggaacagaguuuaaugaaa

SEQ ID NO: 104115 - RNA, 19 nt, Homo sapiens
gggauuagcccaagguaua

SEQ ID NO: 104116 - RNA, 19 nt, Homo sapiens
gagaaggguauaaaucuua

SEQ ID NO: 104117 - RNA, 19 nt, Homo sapiens
ggacacaucugccauucga

SEQ ID NO: 104118 - RNA, 19 nt, Homo sapiens
gagagaagcugaccaucau

SEQ ID NO: 104119 - RNA, 19 nt, Homo sapiens
gcacauggcuccugguuuu

SEQ ID NO: 104120 - RNA, 19 nt, Homo sapiens
aaauaaaugucaccaggua

SEQ ID NO: 104121 - RNA, 19 nt, Homo sapiens
ggaaguugaugaagagaug

SEQ ID NO: 104122 - RNA, 19 nt, Homo sapiens
acaaaucccuggacccuuu

SEQ ID NO: 104123 - RNA, 19 nt, Homo sapiens
gaaucaugcuggagaaguu

SEQ ID NO: 104124 - RNA, 19 nt, Homo sapiens
caucaaauaucuugcacaa

SEQ ID NO: 104125 - RNA, 19 nt, Homo sapiens
gacaaacguuuaaagauca

SEQ ID NO: 104126 - RNA, 19 nt, Homo sapiens
caagugaccgugacacaua

SEQ ID NO: 104127 - RNA, 19 nt, Homo sapiens
gaagaugcagccuccauaa

SEQ ID NO: 104128 - RNA, 19 nt, Homo sapiens
gggaaauccuccuugauau

SEQ ID NO: 104129 - RNA, 19 nt, Homo sapiens
gaacaagaaucagagucaa

SEQ ID NO: 104130 - RNA, 19 nt, Homo sapiens
caaacugccucuucagaau

SEQ ID NO: 104131 - RNA, 19 nt, Homo sapiens
gaaauagagaccaacauug

SEQ ID NO: 104132 - RNA, 19 nt, Homo sapiens
ugaauagccugaaggaaga

SEQ ID NO: 104133 - RNA, 19 nt, Homo sapiens
ccauuacccucuucaauau

SEQ ID NO: 104134 - RNA, 19 nt, Homo sapiens
ugaaauugcugaucuccuu

SEQ ID NO: 104135 - RNA, 19 nt, Homo sapiens
gaagagagagcugcagaaa

SEQ ID NO: 104136 - RNA, 19 nt, Homo sapiens
gcgaauaacugaguacaca

SEQ ID NO: 104137 - RNA, 19 nt, Homo sapiens
ggaagaaagagcucaagaa

SEQ ID NO: 104138 - RNA, 19 nt, Homo sapiens
agacaaacguuuaaagauc

SEQ ID NO: 104139 - RNA, 19 nt, Homo sapiens
uaaggaagcuggcauugag

SEQ ID NO: 104140 - RNA, 19 nt, Homo sapiens
gaagacauuucuaagacau

SEQ ID NO: 104141 - RNA, 19 nt, Homo sapiens
ccacagagcggcuagagaa

SEQ ID NO: 104142 - RNA, 19 nt, Homo sapiens
guggauagcaacaauauuu

SEQ ID NO: 104143 - RNA, 19 nt, Homo sapiens
gaggaugucugggaaguug

SEQ ID NO: 104144 - RNA, 19 nt, Homo sapiens
gaaagucaucccucacaaa

SEQ ID NO: 104145 - RNA, 19 nt, Homo sapiens
ggaaagucaucccucacaa

SEQ ID NO: 104146 - RNA, 19 nt, Homo sapiens
gagaagagagaacagcuuu

SEQ ID NO: 104147 - RNA, 19 nt, Homo sapiens
gaacaauuguagagaaagg

SEQ ID NO: 104148 - RNA, 19 nt, Homo sapiens
ucaaguggaugagauugua

SEQ ID NO: 104149 - RNA, 19 nt, Homo sapiens
ugacaaagccaugcaguuu

SEQ ID NO: 104150 - RNA, 19 nt, Homo sapiens
cagagcggcuagagaagua

SEQ ID NO: 104151 - RNA, 19 nt, Homo sapiens
ccauagagcuggcccuugu

SEQ ID NO: 104152 - RNA, 19 nt, Homo sapiens
guaucagguuugccaguua

SEQ ID NO: 104153 - RNA, 19 nt, Homo sapiens
ggccagagcuaccuaccaa

SEQ ID NO: 104154 - RNA, 19 nt, Homo sapiens
cugaagaacugcuacaaau

SEQ ID NO: 104155 - RNA, 19 nt, Homo sapiens
ccacagcaguccuggauuc

SEQ ID NO: 104156 - RNA, 19 nt, Homo sapiens
gaaauccuccuugauauca

SEQ ID NO: 104157 - RNA, 19 nt, Homo sapiens
agaaagagcucaagaaccu

SEQ ID NO: 104158 - RNA, 19 nt, Homo sapiens
gaauaacugaguacacaaa

SEQ ID NO: 104159 - RNA, 19 nt, Homo sapiens
caucugaagucccugagaa

SEQ ID NO: 104160 - RNA, 19 nt, Homo sapiens
acacuuagccgcaguucua

SEQ ID NO: 104161 - RNA, 19 nt, Homo sapiens
gaagaaagagcucaagaac

SEQ ID NO: 104162 - RNA, 19 nt, Homo sapiens
guugggacccucagucuua

SEQ ID NO: 104163 - RNA, 19 nt, Homo sapiens
cuagacaacgggaagauua

SEQ ID NO: 104164 - RNA, 19 nt, Homo sapiens
guggucagauuaucauuga

SEQ ID NO: 104165 - RNA, 19 nt, Homo sapiens
ggacacuguuggcuuuguu

SEQ ID NO: 104166 - RNA, 19 nt, Homo sapiens
aaggagaguuugcuaagaa

SEQ ID NO: 104167 - RNA, 19 nt, Homo sapiens
ggagagaaggguauaaauc

SEQ ID NO: 104168 - RNA, 19 nt, Homo sapiens
guacaccguuggagaaaca

SEQ ID NO: 104169 - RNA, 19 nt, Homo sapiens
gcuagugaaugacaucuuc

SEQ ID NO: 104170 - RNA, 19 nt, Homo sapiens
caucauccauagcuucauu

SEQ ID NO: 104171 - RNA, 19 nt, Homo sapiens
acaaugguguguacagaaa

SEQ ID NO: 104172 - RNA, 19 nt, Homo sapiens
uggcucaccucaagucuuu

SEQ ID NO: 104173 - RNA, 19 nt, Homo sapiens
gcagcuggauuacaugcuu

SEQ ID NO: 104174 - RNA, 19 nt, Homo sapiens
gagaaacagugaaccugau

SEQ ID NO: 104175 - RNA, 19 nt, Homo sapiens
aaacgcacaugaagagaga

SEQ ID NO: 104176 - RNA, 19 nt, Homo sapiens
acacaaaaguggaaaauga

SEQ ID NO: 104177 - RNA, 19 nt, Homo sapiens
caucagaaauagagaccaa

SEQ ID NO: 104178 - RNA, 19 nt, Homo sapiens
ccaauggccuguugaaagg

SEQ ID NO: 104179 - RNA, 19 nt, Homo sapiens
cgacaugacugcaauuuug

SEQ ID NO: 104180 - RNA, 19 nt, Homo sapiens
ggucaaguguucuacagau

SEQ ID NO: 104181 - RNA, 19 nt, Homo sapiens
aaggcaagauccaguuuaa

SEQ ID NO: 104182 - RNA, 19 nt, Homo sapiens
caagguauauuuguguuca

SEQ ID NO: 104183 - RNA, 19 nt, Homo sapiens
gagagaaggguauaaaucu

SEQ ID NO: 104184 - RNA, 19 nt, Homo sapiens
ugggaaauccuccuugaua

SEQ ID NO: 104185 - RNA, 19 nt, Homo sapiens
gagauccucuaccaccaaa

SEQ ID NO: 104186 - RNA, 19 nt, Homo sapiens
ggaguacaccguuggagaa

SEQ ID NO: 104187 - RNA, 19 nt, Homo sapiens
agagagagcugcagaaagc

SEQ ID NO: 104188 - RNA, 19 nt, Homo sapiens
ggaagacgaagaacuagug

SEQ ID NO: 104189 - RNA, 19 nt, Homo sapiens
agaagaagacgaugacuau

SEQ ID NO: 104190 - RNA, 19 nt, Homo sapiens
gaggagauuuggcugagau

SEQ ID NO: 104191 - RNA, 19 nt, Homo sapiens
cccagaagcucauggaugu

SEQ ID NO: 104192 - RNA, 19 nt, Homo sapiens
aaagaagucugggaccaaa

SEQ ID NO: 104193 - RNA, 19 nt, Homo sapiens
gaacacccaugaaccuacu

SEQ ID NO: 104194 - RNA, 19 nt, Homo sapiens
gcaaaggcaagauccaguu

SEQ ID NO: 104195 - RNA, 19 nt, Homo sapiens
caacagguggcuugcaauu

SEQ ID NO: 104196 - RNA, 19 nt, Homo sapiens
cagcaguccuggauucaga

SEQ ID NO: 104197 - RNA, 19 nt, Homo sapiens
gcgauacuguccaccaaga

SEQ ID NO: 104198 - RNA, 19 nt, Homo sapiens
ugucuuaucuaucuucuuc

SEQ ID NO: 104199 - RNA, 19 nt, Homo sapiens
uacugaagcuagugaauga

SEQ ID NO: 104200 - RNA, 19 nt, Homo sapiens
ugaaaucauuccuacugaa

SEQ ID NO: 104201 - RNA, 19 nt, Homo sapiens
gaguagauauugcuuccau

SEQ ID NO: 104202 - RNA, 19 nt, Homo sapiens
aaugacaucuucacguuug

SEQ ID NO: 104203 - RNA, 19 nt, Homo sapiens
guucaaaacuuucuacaug

SEQ ID NO: 104204 - RNA, 19 nt, Homo sapiens
gauaagugaacacccauga

SEQ ID NO: 104205 - RNA, 19 nt, Homo sapiens
cauggacagugacaaggua

SEQ ID NO: 104206 - RNA, 19 nt, Homo sapiens
ggaagaagcugcccucuga

SEQ ID NO: 104207 - RNA, 19 nt, Homo sapiens
gaacaaagcuguggagaag

SEQ ID NO: 104208 - RNA, 19 nt, Homo sapiens
guacugaccuggcucauga

SEQ ID NO: 104209 - RNA, 19 nt, Homo sapiens
gaaggaggcugaagagaag

SEQ ID NO: 104210 - RNA, 19 nt, Homo sapiens
ggccugagcucgacaaguu

SEQ ID NO: 104211 - RNA, 19 nt, Homo sapiens
cgaaauaacuaccugaagu

SEQ ID NO: 104212 - RNA, 19 nt, Homo sapiens
guacaugaauuucuacaag

SEQ ID NO: 104213 - RNA, 19 nt, Homo sapiens
ugaccaaccugauguaugu

SEQ ID NO: 104214 - RNA, 19 nt, Homo sapiens
caaaucagacacccuuaua

SEQ ID NO: 104215 - RNA, 19 nt, Homo sapiens
uaaaguacauggccuucuu

SEQ ID NO: 104216 - RNA, 19 nt, Homo sapiens
gcacagaugaacccaauga

SEQ ID NO: 104217 - RNA, 19 nt, Homo sapiens
uaacacauuucaaggauag

SEQ ID NO: 104218 - RNA, 19 nt, Homo sapiens
ggacagagaaagugaagga

SEQ ID NO: 104219 - RNA, 19 nt, Homo sapiens
cagagaaagugaaggagaa

SEQ ID NO: 104220 - RNA, 19 nt, Homo sapiens
guucaugggugagggauaa

SEQ ID NO: 104221 - RNA, 19 nt, Homo sapiens
caaguugcaucaaguguuc

SEQ ID NO: 104222 - RNA, 19 nt, Homo sapiens
caacaucguuagcaaaguc

SEQ ID NO: 104223 - RNA, 19 nt, Homo sapiens
cagaggugguuccagcuua

SEQ ID NO: 104224 - RNA, 19 nt, Homo sapiens
gagcagacugggcaacaua

SEQ ID NO: 104225 - RNA, 19 nt, Homo sapiens
agaaggaccugaaugagau

SEQ ID NO: 104226 - RNA, 19 nt, Homo sapiens
ggacaucauuacggacaaa

SEQ ID NO: 104227 - RNA, 19 nt, Homo sapiens
acaaauagcgccaucauca

SEQ ID NO: 104228 - RNA, 19 nt, Homo sapiens
ggaagauacugaugcugau

SEQ ID NO: 104229 - RNA, 19 nt, Homo sapiens
ggaauuugucuaacacauu

SEQ ID NO: 104230 - RNA, 19 nt, Homo sapiens
gaagagaauccaccugcaa

SEQ ID NO: 104231 - RNA, 19 nt, Homo sapiens
gguuccagcuuaugaagaa

SEQ ID NO: 104232 - RNA, 19 nt, Homo sapiens
gaaagcuggaucuguguuu

SEQ ID NO: 104233 - RNA, 19 nt, Homo sapiens
ucacgggcgucuuugcuuu

SEQ ID NO: 104234 - RNA, 19 nt, Homo sapiens
ggaggaagaggaaguggaa

SEQ ID NO: 104235 - RNA, 19 nt, Homo sapiens
ggagaucggccgugagaug

SEQ ID NO: 104236 - RNA, 19 nt, Homo sapiens
cagcaaagccuacguguac

SEQ ID NO: 104237 - RNA, 19 nt, Homo sapiens
gcugauggauuaccuaugc

SEQ ID NO: 104238 - RNA, 19 nt, Homo sapiens
gaagauacugaugcugaua

SEQ ID NO: 104239 - RNA, 19 nt, Homo sapiens
cauuugaauuccugucuuu

SEQ ID NO: 104240 - RNA, 19 nt, Homo sapiens
gaaauaacuaccugaaguc

SEQ ID NO: 104241 - RNA, 19 nt, Homo sapiens
ggagcacuauugcgacaug

SEQ ID NO: 104242 - RNA, 19 nt, Homo sapiens
ucaaggagcggacagagaa

SEQ ID NO: 104243 - RNA, 19 nt, Homo sapiens
acaaagcuguggagaagau

SEQ ID NO: 104244 - RNA, 19 nt, Homo sapiens
gaaguuacuccggaagaaa

SEQ ID NO: 104245 - RNA, 19 nt, Homo sapiens
gaauuccugucuuuauuac

SEQ ID NO: 104246 - RNA, 19 nt, Homo sapiens
gacaugcucugcugcaagu

SEQ ID NO: 104247 - RNA, 19 nt, Homo sapiens
ccgaggagguggcugaaga

SEQ ID NO: 104248 - RNA, 19 nt, Homo sapiens
gugcacagaugaacccaau

SEQ ID NO: 104249 - RNA, 19 nt, Homo sapiens
aaaugaggcuccaauacau

SEQ ID NO: 104250 - RNA, 19 nt, Homo sapiens
gaagagaauccacccucaa

SEQ ID NO: 104251 - RNA, 19 nt, Homo sapiens
uggagaagaugcccagaga

SEQ ID NO: 104252 - RNA, 19 nt, Homo sapiens
gaagugcagguggaagaua

SEQ ID NO: 104253 - RNA, 19 nt, Homo sapiens
gaaacagcacccagaagug

SEQ ID NO: 104254 - RNA, 19 nt, Homo sapiens
gcccuuacuuccaccauau

SEQ ID NO: 104255 - RNA, 19 nt, Homo sapiens
cuaacacauuucaaggaua

SEQ ID NO: 104256 - RNA, 19 nt, Homo sapiens
gggaggagaaggcggagua

SEQ ID NO: 104257 - RNA, 19 nt, Homo sapiens
gcaaaaggcggcaaacuug

SEQ ID NO: 104258 - RNA, 19 nt, Homo sapiens
aaaaggacaugcgaaauaa

SEQ ID NO: 104259 - RNA, 19 nt, Homo sapiens
gauaagaaggaccugaaug

SEQ ID NO: 104260 - RNA, 19 nt, Homo sapiens
gcauuugaauuccugucuu

SEQ ID NO: 104261 - RNA, 19 nt, Homo sapiens
agacacgccugcaguuugu

SEQ ID NO: 104262 - RNA, 19 nt, Homo sapiens
ccaagaaggaggcugaaga

SEQ ID NO: 104263 - RNA, 19 nt, Homo sapiens
gggaggaggccaagaagga

SEQ ID NO: 104264 - RNA, 19 nt, Homo sapiens
ggauugaagaggagaaaga

SEQ ID NO: 104265 - RNA, 19 nt, Homo sapiens
ggacacagggugcacagau

SEQ ID NO: 104266 - RNA, 19 nt, Homo sapiens
caugaaggguguagagaag

SEQ ID NO: 104267 - RNA, 19 nt, Homo sapiens
gcaacaauaagcccaagga

SEQ ID NO: 104268 - RNA, 19 nt, Homo sapiens
gugaugaucggacagauga

SEQ ID NO: 104269 - RNA, 19 nt, Homo sapiens
uaugcgaccucaucuacuu

SEQ ID NO: 104270 - RNA, 19 nt, Homo sapiens
gugauggccuggaauugga

SEQ ID NO: 104271 - RNA, 19 nt, Homo sapiens
gcacaaauagcgccaucau

SEQ ID NO: 104272 - RNA, 19 nt, Homo sapiens
agaaggaggcugaagagaa

SEQ ID NO: 104273 - RNA, 19 nt, Homo sapiens
agagagcugucccggauug

SEQ ID NO: 104274 - RNA, 19 nt, Homo sapiens
gacacagggugcacagaug

SEQ ID NO: 104275 - RNA, 19 nt, Homo sapiens
gcuggcgguuggcaucuaa

SEQ ID NO: 104276 - RNA, 19 nt, Homo sapiens
auaagaaggaccugaauga

SEQ ID NO: 104277 - RNA, 19 nt, Homo sapiens
ugaagacccucaucaccau

SEQ ID NO: 104278 - RNA, 19 nt, Homo sapiens
gcauugacccgcugaccaa

SEQ ID NO: 104279 - RNA, 19 nt, Homo sapiens
uggaagaggagcacuauug

SEQ ID NO: 104280 - RNA, 19 nt, Homo sapiens
ugaaggagaaacucauuga

SEQ ID NO: 104281 - RNA, 19 nt, Homo sapiens
cgaaacagcacccagaagu

SEQ ID NO: 104282 - RNA, 19 nt, Homo sapiens
uauauucgcuguuacuacu

SEQ ID NO: 104283 - RNA, 19 nt, Homo sapiens
caacauagcgagaccucau

SEQ ID NO: 104284 - RNA, 19 nt, Homo sapiens
caaauagcgccaucaucaa

SEQ ID NO: 104285 - RNA, 19 nt, Homo sapiens
gcacggugaaguacaugaa

SEQ ID NO: 104286 - RNA, 19 nt, Homo sapiens
ccagagcacuucagaucag

SEQ ID NO: 104287 - RNA, 19 nt, Homo sapiens
ggaucuguguuuggagaaa

SEQ ID NO: 104288 - RNA, 19 nt, Homo sapiens
gugggaaacaguuauauuc

SEQ ID NO: 104289 - RNA, 19 nt, Homo sapiens
acuggcugcugauggauua

SEQ ID NO: 104290 - RNA, 19 nt, Homo sapiens
gagcggacagagaaaguga

SEQ ID NO: 104291 - RNA, 19 nt, Homo sapiens
gccaccaucuccugccaaa

SEQ ID NO: 104292 - RNA, 19 nt, Homo sapiens
ucugaggucuggagagaug

SEQ ID NO: 104293 - RNA, 19 nt, Homo sapiens
ucuaacacauuucaaggau

SEQ ID NO: 104294 - RNA, 19 nt, Homo sapiens
agaaguuacuccggaagaa

SEQ ID NO: 104295 - RNA, 19 nt, Homo sapiens
ccaucgacgugaacuacaa

SEQ ID NO: 104296 - RNA, 19 nt, Homo sapiens
cgcaaggcaugcuggauga

SEQ ID NO: 104297 - RNA, 19 nt, Homo sapiens
aagaaggaccugaaugaga

SEQ ID NO: 104298 - RNA, 19 nt, Homo sapiens
gaucuguguuuggagaaau

SEQ ID NO: 104299 - RNA, 19 nt, Homo sapiens
ggaaccagagccagagaug

SEQ ID NO: 104300 - RNA, 19 nt, Homo sapiens
cagccuaccuucucuacag

SEQ ID NO: 104301 - RNA, 19 nt, Homo sapiens
ccuauaaucccagugcuuu

SEQ ID NO: 104302 - RNA, 19 nt, Homo sapiens
ucuacagccugcauuugaa

SEQ ID NO: 104303 - RNA, 19 nt, Homo sapiens
ccugauguauguccuaugg

SEQ ID NO: 104304 - RNA, 19 nt, Homo sapiens
uggaagaaguaccaguuuc

SEQ ID NO: 104305 - RNA, 19 nt, Homo sapiens
ccagggcgcugagauuucu

SEQ ID NO: 104306 - RNA, 19 nt, Homo sapiens
ccaaacaucuucaggauuu

SEQ ID NO: 104307 - RNA, 19 nt, Homo sapiens
caacugauuugcuguauuu

SEQ ID NO: 104308 - RNA, 19 nt, Homo sapiens
gaaagaaguugugguuauu

SEQ ID NO: 104309 - RNA, 19 nt, Homo sapiens
gaagaacggccaauauuaa

SEQ ID NO: 104310 - RNA, 19 nt, Homo sapiens
ggaagaacuuaaacucaua

SEQ ID NO: 104311 - RNA, 19 nt, Homo sapiens
gaacaaggacugcugguaa

SEQ ID NO: 104312 - RNA, 19 nt, Homo sapiens
gagcaaagcuggcaaucga

SEQ ID NO: 104313 - RNA, 19 nt, Homo sapiens
gaaagaacaccacaagaaa

SEQ ID NO: 104314 - RNA, 19 nt, Homo sapiens
gacgagagauguacauuau

SEQ ID NO: 104315 - RNA, 19 nt, Homo sapiens
gugcaaagauauaaacuga

SEQ ID NO: 104316 - RNA, 19 nt, Homo sapiens
gaucagcauucuuaacauu

SEQ ID NO: 104317 - RNA, 19 nt, Homo sapiens
gagcagaaauugccaucaa

SEQ ID NO: 104318 - RNA, 19 nt, Homo sapiens
ggugagaucagcauucuua

SEQ ID NO: 104319 - RNA, 19 nt, Homo sapiens
cgaagaacggccaauauua

SEQ ID NO: 104320 - RNA, 19 nt, Homo sapiens
ggacgagagauguacauua

SEQ ID NO: 104321 - RNA, 19 nt, Homo sapiens
gaaagauggucuacuggau

SEQ ID NO: 104322 - RNA, 19 nt, Homo sapiens
cgagagauguacauuauca

SEQ ID NO: 104323 - RNA, 19 nt, Homo sapiens
gaacagaaacaaggacaaa

SEQ ID NO: 104324 - RNA, 19 nt, Homo sapiens
gaaauacgaaggauggaaa

SEQ ID NO: 104325 - RNA, 19 nt, Homo sapiens
gaagagaagguuacucgaa

SEQ ID NO: 104326 - RNA, 19 nt, Homo sapiens
agaaagaaguugugguuau

SEQ ID NO: 104327 - RNA, 19 nt, Homo sapiens
ggucuacccugauauuaau

SEQ ID NO: 104328 - RNA, 19 nt, Homo sapiens
gagcaagucagaugauaaa

SEQ ID NO: 104329 - RNA, 19 nt, Homo sapiens
cugauaaugugcaaagaua

SEQ ID NO: 104330 - RNA, 19 nt, Homo sapiens
ccgaaaagcuggucauuaa

SEQ ID NO: 104331 - RNA, 19 nt, Homo sapiens
cgaaauguaagcaaagaua

SEQ ID NO: 104332 - RNA, 19 nt, Homo sapiens
gcaaagauaagaaagaaca

SEQ ID NO: 104333 - RNA, 19 nt, Homo sapiens
caagaaagaaguugugguu

SEQ ID NO: 104334 - RNA, 19 nt, Homo sapiens
ggugguugauuuccuaauu

SEQ ID NO: 104335 - RNA, 19 nt, Homo sapiens
cugauuaccuagaauauug

SEQ ID NO: 104336 - RNA, 19 nt, Homo sapiens
cuauacaucugaagaauca

SEQ ID NO: 104337 - RNA, 19 nt, Homo sapiens
gaacuauccagaaauuaga

SEQ ID NO: 104338 - RNA, 19 nt, Homo sapiens
ggaaacacauauuacaacu

SEQ ID NO: 104339 - RNA, 19 nt, Homo sapiens
cagcagaaacugaaacaaa

SEQ ID NO: 104340 - RNA, 19 nt, Homo sapiens
gacaaacuauccaaacauc

SEQ ID NO: 104341 - RNA, 19 nt, Homo sapiens
gagaucagcauucuuaaca

SEQ ID NO: 104342 - RNA, 19 nt, Homo sapiens
cuacaguccuggagauuau

SEQ ID NO: 104343 - RNA, 19 nt, Homo sapiens
gguaaaggaagaacuuaaa

SEQ ID NO: 104344 - RNA, 19 nt, Homo sapiens
agaaagaacaccacaagaa

SEQ ID NO: 104345 - RNA, 19 nt, Homo sapiens
ucugagagauacuaugauu

SEQ ID NO: 104346 - RNA, 19 nt, Homo sapiens
ggaagacucaguugggaaa

SEQ ID NO: 104347 - RNA, 19 nt, Homo sapiens
gcaaagauauggaaaagag

SEQ ID NO: 104348 - RNA, 19 nt, Homo sapiens
ggaacuauccagaaauuag

SEQ ID NO: 104349 - RNA, 19 nt, Homo sapiens
guaccugccuggugccauu

SEQ ID NO: 104350 - RNA, 19 nt, Homo sapiens
uaacugagaauuaccaugu

SEQ ID NO: 104351 - RNA, 19 nt, Homo sapiens
agacucaguugggaaauuu

SEQ ID NO: 104352 - RNA, 19 nt, Homo sapiens
uggaagcucuaacugagua

SEQ ID NO: 104353 - RNA, 19 nt, Homo sapiens
ucacucaguuugugguauu

SEQ ID NO: 104354 - RNA, 19 nt, Homo sapiens
gcauguguguucuacucua

SEQ ID NO: 104355 - RNA, 19 nt, Homo sapiens
gugaacaacagcagcaaua

SEQ ID NO: 104356 - RNA, 19 nt, Homo sapiens
gaauuaccauguacaucau

SEQ ID NO: 104357 - RNA, 19 nt, Homo sapiens
gaaacaaggacaaacuauc

SEQ ID NO: 104358 - RNA, 19 nt, Homo sapiens
ucacugauaccaacugauu

SEQ ID NO: 104359 - RNA, 19 nt, Homo sapiens
uaaacuugauguucuguca

SEQ ID NO: 104360 - RNA, 19 nt, Homo sapiens
guacaucauauuugggaua

SEQ ID NO: 104361 - RNA, 19 nt, Homo sapiens
ugacugacaucaacuaaaa

SEQ ID NO: 104362 - RNA, 19 nt, Homo sapiens
aaugaaagauggucuacug

SEQ ID NO: 104363 - RNA, 19 nt, Homo sapiens
ucaauacacagcagucuuu

SEQ ID NO: 104364 - RNA, 19 nt, Homo sapiens
aaacuaagagcagaaauug

SEQ ID NO: 104365 - RNA, 19 nt, Homo sapiens
ugcaucacauuaccuguua

SEQ ID NO: 104366 - RNA, 19 nt, Homo sapiens
gaaugcagccagagcagaa

SEQ ID NO: 104367 - RNA, 19 nt, Homo sapiens
cgugagggauucugaguau

SEQ ID NO: 104368 - RNA, 19 nt, Homo sapiens
uuuccaaccuuguuaugua

SEQ ID NO: 104369 - RNA, 19 nt, Homo sapiens
gaacaacagcagcaauaag

SEQ ID NO: 104370 - RNA, 19 nt, Homo sapiens
gaagaggaagacucaguug

SEQ ID NO: 104371 - RNA, 19 nt, Homo sapiens
ucuaugauuuccaacauga

SEQ ID NO: 104372 - RNA, 19 nt, Homo sapiens
gaaaugauacaugggucua

SEQ ID NO: 104373 - RNA, 19 nt, Homo sapiens
caucauauuugggauaaca

SEQ ID NO: 104374 - RNA, 19 nt, Homo sapiens
ugaagcguauuugaaguaa

SEQ ID NO: 104375 - RNA, 19 nt, Homo sapiens
gcagaaacugaaacaaaga

SEQ ID NO: 104376 - RNA, 19 nt, Homo sapiens
aagagaagguuacucgaau

SEQ ID NO: 104377 - RNA, 19 nt, Homo sapiens
ggauuacguaucagacaua

SEQ ID NO: 104378 - RNA, 19 nt, Homo sapiens
aaagaggguuauuaaaugg

SEQ ID NO: 104379 - RNA, 19 nt, Homo sapiens
caaacuauccaaacaucuu

SEQ ID NO: 104380 - RNA, 19 nt, Homo sapiens
ggacaaacuauccaaacau

SEQ ID NO: 104381 - RNA, 19 nt, Homo sapiens
gaaucuuggcugaguauga

SEQ ID NO: 104382 - RNA, 19 nt, Homo sapiens
gaagaaucagagaaugaaa

SEQ ID NO: 104383 - RNA, 19 nt, Homo sapiens
ggaguuggucuugaaauug

SEQ ID NO: 104384 - RNA, 19 nt, Homo sapiens
uggaguuggucuugaaauu

SEQ ID NO: 104385 - RNA, 19 nt, Homo sapiens
gauguucugucacugauac

SEQ ID NO: 104386 - RNA, 19 nt, Homo sapiens
cuagaauauuggcucauuu

SEQ ID NO: 104387 - RNA, 19 nt, Homo sapiens
ccuagaauauuggcucauu

SEQ ID NO: 104388 - RNA, 19 nt, Homo sapiens
gugaagcguauuugaagua

SEQ ID NO: 104389 - RNA, 19 nt, Homo sapiens
gauuguaccagauauugaa

SEQ ID NO: 104390 - RNA, 19 nt, Homo sapiens
ucuacuggaucuaaacauu

SEQ ID NO: 104391 - RNA, 19 nt, Homo sapiens
agauguacauuaucaagga

SEQ ID NO: 104392 - RNA, 19 nt, Homo sapiens
aacaaggacugcugguaaa

SEQ ID NO: 104393 - RNA, 19 nt, Homo sapiens
aagaaguugugguuauuga

SEQ ID NO: 104394 - RNA, 19 nt, Homo sapiens
ccauguacaucauauuugg

SEQ ID NO: 104395 - RNA, 19 nt, Homo sapiens
agaauuaccauguacauca

SEQ ID NO: 104396 - RNA, 19 nt, Homo sapiens
gauguacauuaucaaggaa

SEQ ID NO: 104397 - RNA, 19 nt, Homo sapiens
uuuccuaauuggaguguua

SEQ ID NO: 104398 - RNA, 19 nt, Homo sapiens
gugguugauuuccuaauug

SEQ ID NO: 104399 - RNA, 19 nt, Homo sapiens
acgguucucucguauguuu

SEQ ID NO: 104400 - RNA, 19 nt, Homo sapiens
uaagaaagaacaccacaag

SEQ ID NO: 104401 - RNA, 19 nt, Homo sapiens
gaagagcaagucagaugau

SEQ ID NO: 104402 - RNA, 19 nt, Homo sapiens
caucacagagggagcagua

SEQ ID NO: 104403 - RNA, 19 nt, Homo sapiens
gauaaacuaagagcagaaa

SEQ ID NO: 104404 - RNA, 19 nt, Homo sapiens
cagaaacaaggacaaacua

SEQ ID NO: 104405 - RNA, 19 nt, Homo sapiens
gaugaugacagugccuaua

SEQ ID NO: 104406 - RNA, 19 nt, Homo sapiens
gcacacaggacucucauua

SEQ ID NO: 104407 - RNA, 19 nt, Homo sapiens
ccaaagagauucaaagaca

SEQ ID NO: 104408 - RNA, 19 nt, Homo sapiens
gaacguaucuuugcaaacu

SEQ ID NO: 104409 - RNA, 19 nt, Homo sapiens
gaaagaggcugccccauuu

SEQ ID NO: 104410 - RNA, 19 nt, Homo sapiens
caagacaguuugaggcaua

SEQ ID NO: 104411 - RNA, 19 nt, Homo sapiens
ggaaguacauuuacagucu

SEQ ID NO: 104412 - RNA, 19 nt, Homo sapiens
gcaaauuacccaaagauga

SEQ ID NO: 104413 - RNA, 19 nt, Homo sapiens
gcucacagauugcagaaau

SEQ ID NO: 104414 - RNA, 19 nt, Homo sapiens
gaaccuguuucuucaccua

SEQ ID NO: 104415 - RNA, 19 nt, Homo sapiens
guuccgugauugcaaauua

SEQ ID NO: 104416 - RNA, 19 nt, Homo sapiens
acaggacucucauuacuuu

SEQ ID NO: 104417 - RNA, 19 nt, Homo sapiens
caaauuccauccuucacuu

SEQ ID NO: 104418 - RNA, 19 nt, Homo sapiens
ccagugaagugccagguuu

SEQ ID NO: 104419 - RNA, 19 nt, Homo sapiens
gggauuauaucugcaagaa

SEQ ID NO: 104420 - RNA, 19 nt, Homo sapiens
uccaugaucucgaauauga

SEQ ID NO: 104421 - RNA, 19 nt, Homo sapiens
cgaccuggcuuacuuaaag

SEQ ID NO: 104422 - RNA, 19 nt, Homo sapiens
gguaucaccucguguguuc

SEQ ID NO: 104423 - RNA, 19 nt, Homo sapiens
gauaauggguauauaacag

SEQ ID NO: 104424 - RNA, 19 nt, Homo sapiens
ccaccgaccuggcuuacuu

SEQ ID NO: 104425 - RNA, 19 nt, Homo sapiens
agaugagucuuucuucuuu

SEQ ID NO: 104426 - RNA, 19 nt, Homo sapiens
gaacuuggucuuguacauu

SEQ ID NO: 104427 - RNA, 19 nt, Homo sapiens
ggagugcuauggcaaguag

SEQ ID NO: 104428 - RNA, 19 nt, Homo sapiens
uaacugguaucugcuuauu

SEQ ID NO: 104429 - RNA, 19 nt, Homo sapiens
ucacagauugcagaaauua

SEQ ID NO: 104430 - RNA, 19 nt, Homo sapiens
cggcagauguccuguaugu

SEQ ID NO: 104431 - RNA, 19 nt, Homo sapiens
ccacccagaugaagaugaa

SEQ ID NO: 104432 - RNA, 19 nt, Homo sapiens
aagacaaccugaucgauga

SEQ ID NO: 104433 - RNA, 19 nt, Homo sapiens
gagucuuucuucuuucuuu

SEQ ID NO: 104434 - RNA, 19 nt, Homo sapiens
gaugaggaguaucucuuug

SEQ ID NO: 104435 - RNA, 19 nt, Homo sapiens
guacaacgccacccagaug

SEQ ID NO: 104436 - RNA, 19 nt, Homo sapiens
agaagacgguggaugagaa

SEQ ID NO: 104437 - RNA, 19 nt, Homo sapiens
accgaaagcucacagauug

SEQ ID NO: 104438 - RNA, 19 nt, Homo sapiens
gcuccaugaucucgaauau

SEQ ID NO: 104439 - RNA, 19 nt, Homo sapiens
gagaagauggccaagauca

SEQ ID NO: 104440 - RNA, 19 nt, Homo sapiens
gaagugccagguuugauug

SEQ ID NO: 104441 - RNA, 19 nt, Homo sapiens
ucaagagccucccagacaa

SEQ ID NO: 104442 - RNA, 19 nt, Homo sapiens
acaagaagacgguggauga

SEQ ID NO: 104443 - RNA, 19 nt, Homo sapiens
gcagauguccuguaugucu

SEQ ID NO: 104444 - RNA, 19 nt, Homo sapiens
uauaacugguaucugcuua

SEQ ID NO: 104445 - RNA, 19 nt, Homo sapiens
acaggaagcugaagguaca

SEQ ID NO: 104446 - RNA, 19 nt, Homo sapiens
ccgagaagauggccaagau

SEQ ID NO: 104447 - RNA, 19 nt, Homo sapiens
ggaacuuggucuuguacau

SEQ ID NO: 104448 - RNA, 19 nt, Homo sapiens
acugguaucugcuuauuug

SEQ ID NO: 104449 - RNA, 19 nt, Homo sapiens
aaacaaaccccaguaaaua

SEQ ID NO: 104450 - RNA, 19 nt, Homo sapiens
gaagagacauccccuccuu

SEQ ID NO: 104451 - RNA, 19 nt, Homo sapiens
ugaggcauauuucuuaauc

SEQ ID NO: 104452 - RNA, 19 nt, Homo sapiens
guuugaggcauauuucuua

SEQ ID NO: 104453 - RNA, 19 nt, Homo sapiens
ggcagauccugaugaaaga

SEQ ID NO: 104454 - RNA, 19 nt, Homo sapiens
gacggcagauccugaugaa

SEQ ID NO: 104455 - RNA, 19 nt, Homo sapiens
agaaggcccuggaggagaa

SEQ ID NO: 104456 - RNA, 19 nt, Homo sapiens
agaaggaggugcucaagag

SEQ ID NO: 104457 - RNA, 19 nt, Homo sapiens
cgugaaagaugaggaguau

SEQ ID NO: 104458 - RNA, 19 nt, Homo sapiens
gcagcuguguggcauggaa

SEQ ID NO: 104459 - RNA, 19 nt, Homo sapiens
aaacagaggacaaacaaca

SEQ ID NO: 104460 - RNA, 19 nt, Homo sapiens
gaccucaaauuccauccuu

SEQ ID NO: 104461 - RNA, 19 nt, Homo sapiens
gaugaaagacaaccugauc

SEQ ID NO: 104462 - RNA, 19 nt, Homo sapiens
gaagauuagaccauuagga

SEQ ID NO: 104463 - RNA, 19 nt, Homo sapiens
gcaucuacuuugccauuuc

SEQ ID NO: 104464 - RNA, 19 nt, Homo sapiens
gcacagagacaaggaccaa

SEQ ID NO: 104465 - RNA, 19 nt, Homo sapiens
ggagguguccagccaagaa

SEQ ID NO: 104466 - RNA, 19 nt, Homo sapiens
caaauuacccaaagaugag

SEQ ID NO: 104467 - RNA, 19 nt, Homo sapiens
ugaguuccgugauugcaaa

SEQ ID NO: 104468 - RNA, 19 nt, Homo sapiens
ggagagcauuuuagauuga

SEQ ID NO: 104469 - RNA, 19 nt, Homo sapiens
ggugaccuauucuaacuca

SEQ ID NO: 104470 - RNA, 19 nt, Homo sapiens
acacaggacucucauuacu

SEQ ID NO: 104471 - RNA, 19 nt, Homo sapiens
ggacggcagauccugauga

SEQ ID NO: 104472 - RNA, 19 nt, Homo sapiens
gccaacauccgcagcauug

SEQ ID NO: 104473 - RNA, 19 nt, Homo sapiens
aagauuagaccauuaggaa

SEQ ID NO: 104474 - RNA, 19 nt, Homo sapiens
ggaaagaggcugccccauu

SEQ ID NO: 104475 - RNA, 19 nt, Homo sapiens
gcaucugucuccugcuuca

SEQ ID NO: 104476 - RNA, 19 nt, Homo sapiens
gcaagaagggagauauugg

SEQ ID NO: 104477 - RNA, 19 nt, Homo sapiens
ggaacuuggucaggguuga

SEQ ID NO: 104478 - RNA, 19 nt, Homo sapiens
gcacaaacuacccagaagu

SEQ ID NO: 104479 - RNA, 19 nt, Homo sapiens
ccugauaauggguauauaa

SEQ ID NO: 104480 - RNA, 19 nt, Homo sapiens
ugaagugccagguuugauu

SEQ ID NO: 104481 - RNA, 19 nt, Homo sapiens
gugccagguuugauuguga

SEQ ID NO: 104482 - RNA, 19 nt, Homo sapiens
caaaggacgaucucaugga

SEQ ID NO: 104483 - RNA, 19 nt, Homo sapiens
gagaaggaggugcucaaga

SEQ ID NO: 104484 - RNA, 19 nt, Homo sapiens
gggcacaaacuacccagaa

SEQ ID NO: 104485 - RNA, 19 nt, Homo sapiens
uaaaggugggcacaaacua

SEQ ID NO: 104486 - RNA, 19 nt, Homo sapiens
gaugagucuuucuucuuuc

SEQ ID NO: 104487 - RNA, 19 nt, Homo sapiens
aagcugaagguacaacaua

SEQ ID NO: 104488 - RNA, 19 nt, Homo sapiens
gaagauggccaagaucaac

SEQ ID NO: 104489 - RNA, 19 nt, Homo sapiens
gaaagacaaccugaucgau

SEQ ID NO: 104490 - RNA, 19 nt, Homo sapiens
ugucuuggaugugcuugua

SEQ ID NO: 104491 - RNA, 19 nt, Homo sapiens
ccauuaggaacguaucuuu

SEQ ID NO: 104492 - RNA, 19 nt, Homo sapiens
caaggaggagagcuaugua

SEQ ID NO: 104493 - RNA, 19 nt, Homo sapiens
uaacaggaagcugaaggua

SEQ ID NO: 104494 - RNA, 19 nt, Homo sapiens
acacggaggaggagaagaa

SEQ ID NO: 104495 - RNA, 19 nt, Homo sapiens
ugaggaguaucucuuugug

SEQ ID NO: 104496 - RNA, 19 nt, Homo sapiens
guacagggagagcauuuua

SEQ ID NO: 104497 - RNA, 19 nt, Homo sapiens
gaaguucugccggauggaa

SEQ ID NO: 104498 - RNA, 19 nt, Homo sapiens
ccaagaucaacacccaaua

SEQ ID NO: 104499 - RNA, 19 nt, Homo sapiens
gacaguuugaggcauauuu

SEQ ID NO: 104500 - RNA, 19 nt, Homo sapiens
gcucuacucacccuuugaa

SEQ ID NO: 104501 - RNA, 19 nt, Homo sapiens
gaacuuggucaggguugaa

SEQ ID NO: 104502 - RNA, 19 nt, Homo sapiens
ucaaccgccuacugaaguu

SEQ ID NO: 104503 - RNA, 19 nt, Homo sapiens
cggcagauccugaugaaag

SEQ ID NO: 104504 - RNA, 19 nt, Homo sapiens
ggagaaaggacggcagauc

SEQ ID NO: 104505 - RNA, 19 nt, Homo sapiens
ggacuacucggcagauguc

SEQ ID NO: 104506 - RNA, 19 nt, Homo sapiens
gcgagaagauccuaaauga

SEQ ID NO: 104507 - RNA, 19 nt, Homo sapiens
gaaagacugugcacuacaa

SEQ ID NO: 104508 - RNA, 19 nt, Homo sapiens
gcagaaagaagaagaguaa

SEQ ID NO: 104509 - RNA, 19 nt, Homo sapiens
gagaagauccuaaaugaga

SEQ ID NO: 104510 - RNA, 19 nt, Homo sapiens
gcacaaagcacuucuccuu

SEQ ID NO: 104511 - RNA, 19 nt, Homo sapiens
gggaugaggucuccgguuu

SEQ ID NO: 104512 - RNA, 19 nt, Homo sapiens
gaaagaagaagaguaagaa

SEQ ID NO: 104513 - RNA, 19 nt, Homo sapiens
gaaagucccuggcccacau

SEQ ID NO: 104514 - RNA, 19 nt, Homo sapiens
gucagacacuuauuuauug

SEQ ID NO: 104515 - RNA, 19 nt, Homo sapiens
gcaaguggguugacuacuc

SEQ ID NO: 104516 - RNA, 19 nt, Homo sapiens
ggagauggauuugaagaag

SEQ ID NO: 104517 - RNA, 19 nt, Homo sapiens
guacuucgccuccuacaug

SEQ ID NO: 104518 - RNA, 19 nt, Homo sapiens
gcacauccguuggccauca

SEQ ID NO: 104519 - RNA, 19 nt, Homo sapiens
ggaucaggcucuccucaug

SEQ ID NO: 104520 - RNA, 19 nt, Homo sapiens
gcugacaacaucuacauuu

SEQ ID NO: 104521 - RNA, 19 nt, Homo sapiens
guggagaucugcccagugu

SEQ ID NO: 104522 - RNA, 19 nt, Homo sapiens
gaccucaaguugggaaauu

SEQ ID NO: 104523 - RNA, 19 nt, Homo sapiens
cagaagugcugcugagaca

SEQ ID NO: 104524 - RNA, 19 nt, Homo sapiens
ugaggacgcugacaacauc

SEQ ID NO: 104525 - RNA, 19 nt, Homo sapiens
caguggagauggauuugaa

SEQ ID NO: 104526 - RNA, 19 nt, Homo sapiens
gaaucagggaccagcuuua

SEQ ID NO: 104527 - RNA, 19 nt, Homo sapiens
agaagaagaguaagaauca

SEQ ID NO: 104528 - RNA, 19 nt, Homo sapiens
gaccugagcuggagaugcu

SEQ ID NO: 104529 - RNA, 19 nt, Homo sapiens
gcaucaagcagguucacua

SEQ ID NO: 104530 - RNA, 19 nt, Homo sapiens
ucacugggcugugucaugu

SEQ ID NO: 104531 - RNA, 19 nt, Homo sapiens
gcaccgggaccucaaguug

SEQ ID NO: 104532 - RNA, 19 nt, Homo sapiens
ggaaucagggaccagcuuu

SEQ ID NO: 104533 - RNA, 19 nt, Homo sapiens
ccucaaaggccgcuuguug

SEQ ID NO: 104534 - RNA, 19 nt, Homo sapiens
gaagauccuaaaugagauu

SEQ ID NO: 104535 - RNA, 19 nt, Homo sapiens
acaaagcacuucuccuucu

SEQ ID NO: 104536 - RNA, 19 nt, Homo sapiens
gaagaagaguaagaaucau

SEQ ID NO: 104537 - RNA, 19 nt, Homo sapiens
ggaccacuuuuauuuauug

SEQ ID NO: 104538 - RNA, 19 nt, Homo sapiens
uggguugacuacuccaaua

SEQ ID NO: 104539 - RNA, 19 nt, Homo sapiens
cuauguggcuccagaagug

SEQ ID NO: 104540 - RNA, 19 nt, Homo sapiens
gcucuccucaugcuguuua

SEQ ID NO: 104541 - RNA, 19 nt, Homo sapiens
gcucugagaaauuguauag

SEQ ID NO: 104542 - RNA, 19 nt, Homo sapiens
ugagacggcugaccugaag

SEQ ID NO: 104543 - RNA, 19 nt, Homo sapiens
guaguggagucagcccuuu

SEQ ID NO: 104544 - RNA, 19 nt, Homo sapiens
gaugaggucuccgguuugg

SEQ ID NO: 104545 - RNA, 19 nt, Homo sapiens
cagaaagacugugcacuac

SEQ ID NO: 104546 - RNA, 19 nt, Homo sapiens
gccaugacuucuuuaccaa

SEQ ID NO: 104547 - RNA, 19 nt, Homo sapiens
uaaguucggcuuuggguau

SEQ ID NO: 104548 - RNA, 19 nt, Homo sapiens
ggcaagcaguggagaugga

SEQ ID NO: 104549 - RNA, 19 nt, Homo sapiens
agaaagaagaagaguaaga

SEQ ID NO: 104550 - RNA, 19 nt, Homo sapiens
uuaccucgcuucccaccuu

SEQ ID NO: 104551 - RNA, 19 nt, Homo sapiens
gcacuguccaggugaacuu

SEQ ID NO: 104552 - RNA, 19 nt, Homo sapiens
caugaaggguggagaucug

SEQ ID NO: 104553 - RNA, 19 nt, Homo sapiens
ugacuacuccaauaaguuc

SEQ ID NO: 104554 - RNA, 19 nt, Homo sapiens
gauccuuucuggccucaag

SEQ ID NO: 104555 - RNA, 19 nt, Homo sapiens
gauccuaaaugagauugag

SEQ ID NO: 104556 - RNA, 19 nt, Homo sapiens
gaaaucguagugcuuguac

SEQ ID NO: 104557 - RNA, 19 nt, Homo sapiens
cgaaaucguagugcuugua

SEQ ID NO: 104558 - RNA, 19 nt, Homo sapiens
cgccuacgcugucaaaguc

SEQ ID NO: 104559 - RNA, 19 nt, Homo sapiens
caaagcacuucuccuucuc

SEQ ID NO: 104560 - RNA, 19 nt, Homo sapiens
ucaagcagguucacuacac

SEQ ID NO: 104561 - RNA, 19 nt, Homo sapiens
cugagaacauggaacugaa

SEQ ID NO: 104562 - RNA, 19 nt, Homo sapiens
guugacuacuccaauaagu

SEQ ID NO: 104563 - RNA, 19 nt, Homo sapiens
uuucuggccucaaguacuu

SEQ ID NO: 104564 - RNA, 19 nt, Homo sapiens
ggaccacaccaagcugauu

SEQ ID NO: 104565 - RNA, 19 nt, Homo sapiens
cgccaugacuucuuuacca

SEQ ID NO: 104566 - RNA, 19 nt, Homo sapiens
caacgauggcacacauaug

SEQ ID NO: 104567 - RNA, 19 nt, Homo sapiens
ggguugacuacuccaauaa

SEQ ID NO: 104568 - RNA, 19 nt, Homo sapiens
agaagauccuaaaugagau

SEQ ID NO: 104569 - RNA, 19 nt, Homo sapiens
ucugagaaauuguauagcu

SEQ ID NO: 104570 - RNA, 19 nt, Homo sapiens
uuucaucacugagaacaug

SEQ ID NO: 104571 - RNA, 19 nt, Homo sapiens
uggcugugcucuucaacga

SEQ ID NO: 104572 - RNA, 19 nt, Homo sapiens
cugagaaauuguauagcuu

SEQ ID NO: 104573 - RNA, 19 nt, Homo sapiens
guagagacagcaccugaag

SEQ ID NO: 104574 - RNA, 19 nt, Homo sapiens
ccugcgccaugacuucuuu

SEQ ID NO: 104575 - RNA, 19 nt, Homo sapiens
ucagacacuuauuuauugg

SEQ ID NO: 104576 - RNA, 19 nt, Homo sapiens
gaccacaccaagcugauuc

SEQ ID NO: 104577 - RNA, 19 nt, Homo sapiens
ggcagaaagaagaagagua

SEQ ID NO: 104578 - RNA, 19 nt, Homo sapiens
caacaucuacauuuucuug

SEQ ID NO: 104579 - RNA, 19 nt, Homo sapiens
ucaacgauggcacacauau

SEQ ID NO: 104580 - RNA, 19 nt, Homo sapiens
uccaauaaguucggcuuug

SEQ ID NO: 104581 - RNA, 19 nt, Homo sapiens
uuugugcucugagaaauug

SEQ ID NO: 104582 - RNA, 19 nt, Homo sapiens
gcaguggagauggauuuga

SEQ ID NO: 104583 - RNA, 19 nt, Homo sapiens
ggaugaggucuccgguuug

SEQ ID NO: 104584 - RNA, 19 nt, Homo sapiens
cuucaacgauggcacacau

SEQ ID NO: 104585 - RNA, 19 nt, Homo sapiens
gguagagacagcaccugaa

SEQ ID NO: 104586 - RNA, 19 nt, Homo sapiens
uguggaagagguagaggua

SEQ ID NO: 104587 - RNA, 19 nt, Homo sapiens
agccagaagugcgcuacua

SEQ ID NO: 104588 - RNA, 19 nt, Homo sapiens
gacaacaucuacauuuucu

SEQ ID NO: 104589 - RNA, 19 nt, Homo sapiens
aagcaguggagauggauuu

SEQ ID NO: 104590 - RNA, 19 nt, Homo sapiens
ccagcuaggagucuguuug

SEQ ID NO: 104591 - RNA, 19 nt, Homo sapiens
gauccugcgccaugacuuc

SEQ ID NO: 104592 - RNA, 19 nt, Homo sapiens
caacuauguggcuccagaa

SEQ ID NO: 104593 - RNA, 19 nt, Homo sapiens
cuccuaggauaauaaacaa

SEQ ID NO: 104594 - RNA, 19 nt, Homo sapiens
ggccgcaccuaccucaaag

SEQ ID NO: 104595 - RNA, 19 nt, Homo sapiens
aagaagaagaguaagaauc

SEQ ID NO: 104596 - RNA, 19 nt, Homo sapiens
ucagggaccagcuuuacug

SEQ ID NO: 104597 - RNA, 19 nt, Homo sapiens
gcgccuacgcugucaaagu

SEQ ID NO: 104598 - RNA, 19 nt, Homo sapiens
gagacguaccgcugcauca

SEQ ID NO: 104599 - RNA, 19 nt, Homo sapiens
ucacugagaacauggaacu

SEQ ID NO: 104600 - RNA, 19 nt, Homo sapiens
ccuccuaggauaauaaaca

SEQ ID NO: 104601 - RNA, 19 nt, Homo sapiens
gcucuggcccuugccuuug

SEQ ID NO: 104602 - RNA, 19 nt, Homo sapiens
agauggauuugaagaaggu

SEQ ID NO: 104603 - RNA, 19 nt, Homo sapiens
cuacgaggccacugacaca

SEQ ID NO: 104604 - RNA, 19 nt, Homo sapiens
aagaagaguaagaaucaug

SEQ ID NO: 104605 - RNA, 19 nt, Homo sapiens
uauggucacugggcugugu

SEQ ID NO: 104606 - RNA, 19 nt, Homo sapiens
gcacacaacuacuacaauu

SEQ ID NO: 104607 - RNA, 19 nt, Homo sapiens
ccaacgaccuguuugagaa

SEQ ID NO: 104608 - RNA, 19 nt, Homo sapiens
ucaaggccaucaccaagua

SEQ ID NO: 104609 - RNA, 19 nt, Homo sapiens
cacaaggccuucccuguuu

SEQ ID NO: 104610 - RNA, 19 nt, Homo sapiens
cacaauaaauggcuguaaa

SEQ ID NO: 104611 - RNA, 19 nt, Homo sapiens
gaacaucggcaacuucauc

SEQ ID NO: 104612 - RNA, 19 nt, Homo sapiens
gcagaugggcaccaacaaa

SEQ ID NO: 104613 - RNA, 19 nt, Homo sapiens
cagccgagguuaagaacaa

SEQ ID NO: 104614 - RNA, 19 nt, Homo sapiens
ggacacacgcgguuugguu

SEQ ID NO: 104615 - RNA, 19 nt, Homo sapiens
caaacugcaugcccagaga

SEQ ID NO: 104616 - RNA, 19 nt, Homo sapiens
gcacugagcaacgcuauuc

SEQ ID NO: 104617 - RNA, 19 nt, Homo sapiens
ccacaaggccuucccuguu

SEQ ID NO: 104618 - RNA, 19 nt, Homo sapiens
guaaugagagcacuuucuu

SEQ ID NO: 104619 - RNA, 19 nt, Homo sapiens
gacaguggcguuuguaaug

SEQ ID NO: 104620 - RNA, 19 nt, Homo sapiens
ggaccaagcggcagaucuu

SEQ ID NO: 104621 - RNA, 19 nt, Homo sapiens
gaugggcaccaacaaguuu

SEQ ID NO: 104622 - RNA, 19 nt, Homo sapiens
ggagugaaguacgcagaga

SEQ ID NO: 104623 - RNA, 19 nt, Homo sapiens
gcuacaggguccaacauag

SEQ ID NO: 104624 - RNA, 19 nt, Homo sapiens
gaagggcggaacaucauug

SEQ ID NO: 104625 - RNA, 19 nt, Homo sapiens
gaagaagaucaaugaguca

SEQ ID NO: 104626 - RNA, 19 nt, Homo sapiens
gcacaauaaauggcuguaa

SEQ ID NO: 104627 - RNA, 19 nt, Homo sapiens
gagaacaucggcaacuuca

SEQ ID NO: 104628 - RNA, 19 nt, Homo sapiens
gagaagggcggaacaucau

SEQ ID NO: 104629 - RNA, 19 nt, Homo sapiens
ggagaacaucggcaacuuc

SEQ ID NO: 104630 - RNA, 19 nt, Homo sapiens
acaguggcguuuguaauga

SEQ ID NO: 104631 - RNA, 19 nt, Homo sapiens
gacacacgcgguuugguuu

SEQ ID NO: 104632 - RNA, 19 nt, Homo sapiens
ggaggcugcugcugcucuu

SEQ ID NO: 104633 - RNA, 19 nt, Homo sapiens
ccuccgcucuguagugcua

SEQ ID NO: 104634 - RNA, 19 nt, Homo sapiens
cauguccucugcucacuuc

SEQ ID NO: 104635 - RNA, 19 nt, Homo sapiens
caaaggacgcacugagcaa

SEQ ID NO: 104636 - RNA, 19 nt, Homo sapiens
ggcaccagcuggagaacau

SEQ ID NO: 104637 - RNA, 19 nt, Homo sapiens
gcgaauucaucaauaagcu

SEQ ID NO: 104638 - RNA, 19 nt, Homo sapiens
cuauuucacuggagcacaa

SEQ ID NO: 104639 - RNA, 19 nt, Homo sapiens
gcagaugggcagcaacaag

SEQ ID NO: 104640 - RNA, 19 nt, Homo sapiens
gcagaugggcaccaacaag

SEQ ID NO: 104641 - RNA, 19 nt, Homo sapiens
caauggaacggcccuggaa

SEQ ID NO: 104642 - RNA, 19 nt, Homo sapiens
cuacaggguccaacauaga

SEQ ID NO: 104643 - RNA, 19 nt, Homo sapiens
gaagacgaaaggaaacaag

SEQ ID NO: 104644 - RNA, 19 nt, Homo sapiens
gagcaggagcugagagagu

SEQ ID NO: 104645 - RNA, 19 nt, Homo sapiens
cuacaggguuagaguuugg

SEQ ID NO: 104646 - RNA, 19 nt, Homo sapiens
gaugggcaccaacaaagga

SEQ ID NO: 104647 - RNA, 19 nt, Homo sapiens
gaacgugggagugaaguac

SEQ ID NO: 104648 - RNA, 19 nt, Homo sapiens
cgaaaggaaacaaggugaa

SEQ ID NO: 104649 - RNA, 19 nt, Homo sapiens
uaaugagagcacuuucuuu

SEQ ID NO: 104650 - RNA, 19 nt, Homo sapiens
gaagcaggagcggaaauuc

SEQ ID NO: 104651 - RNA, 19 nt, Homo sapiens
gaaaggaaacaaggugaac

SEQ ID NO: 104652 - RNA, 19 nt, Homo sapiens
uggcgaagacgaaaggaaa

SEQ ID NO: 104653 - RNA, 19 nt, Homo sapiens
ggaacggcccuggaagaga

SEQ ID NO: 104654 - RNA, 19 nt, Homo sapiens
gccaacgaccuguuugaga

SEQ ID NO: 104655 - RNA, 19 nt, Homo sapiens
uuugagaacaccaaccaua

SEQ ID NO: 104656 - RNA, 19 nt, Homo sapiens
cacuggagcacaauaaaug

SEQ ID NO: 104657 - RNA, 19 nt, Homo sapiens
ugcagcgacuggcauacua

SEQ ID NO: 104658 - RNA, 19 nt, Homo sapiens
agagaagggcggaacauca

SEQ ID NO: 104659 - RNA, 19 nt, Homo sapiens
cuucauggacggccucaaa

SEQ ID NO: 104660 - RNA, 19 nt, Homo sapiens
ucacuggagcacaauaaau

SEQ ID NO: 104661 - RNA, 19 nt, Homo sapiens
gugaagaagaucaaugagu

SEQ ID NO: 104662 - RNA, 19 nt, Homo sapiens
ccgugaagaagaucaauga

SEQ ID NO: 104663 - RNA, 19 nt, Homo sapiens
ugacaguggcguuuguaau

SEQ ID NO: 104664 - RNA, 19 nt, Homo sapiens
gcagcgacuggcauacuau

SEQ ID NO: 104665 - RNA, 19 nt, Homo sapiens
gcacugcgacacgcucaau

SEQ ID NO: 104666 - RNA, 19 nt, Homo sapiens
aguccacccuccuggcuuu

SEQ ID NO: 104667 - RNA, 19 nt, Homo sapiens
ggaugugacaguggcguuu

SEQ ID NO: 104668 - RNA, 19 nt, Homo sapiens
gggagcaggagcugagaga

SEQ ID NO: 104669 - RNA, 19 nt, Homo sapiens
gagugaaguacgcagagaa

SEQ ID NO: 104670 - RNA, 19 nt, Homo sapiens
uggagaacaucggcaacuu

SEQ ID NO: 104671 - RNA, 19 nt, Homo sapiens
cagaugggcaccaacaaag

SEQ ID NO: 104672 - RNA, 19 nt, Homo sapiens
cagaugggcaccaacaagu

SEQ ID NO: 104673 - RNA, 19 nt, Homo sapiens
gagaagcaggagcggaaau

SEQ ID NO: 104674 - RNA, 19 nt, Homo sapiens
ugagaacaccaaccauaca

SEQ ID NO: 104675 - RNA, 19 nt, Homo sapiens
cuuugcgaauucaucaaua

SEQ ID NO: 104676 - RNA, 19 nt, Homo sapiens
ggguuagaguuuggagaga

SEQ ID NO: 104677 - RNA, 19 nt, Homo sapiens
ccaccacgcacacaacuac

SEQ ID NO: 104678 - RNA, 19 nt, Homo sapiens
agaagcaggagcggaaauu

SEQ ID NO: 104679 - RNA, 19 nt, Homo sapiens
ugaaguacgcagagaagca

SEQ ID NO: 104680 - RNA, 19 nt, Homo sapiens
ugaggccaacgaccuguuu

SEQ ID NO: 104681 - RNA, 19 nt, Homo sapiens
cccaacagcgcccaaagga

SEQ ID NO: 104682 - RNA, 19 nt, Homo sapiens
caggcuccgugaagaagau

SEQ ID NO: 104683 - RNA, 19 nt, Homo sapiens
cauggacggccucaaagau

SEQ ID NO: 104684 - RNA, 19 nt, Homo sapiens
cagcauggcgaagacgaaa

SEQ ID NO: 104685 - RNA, 19 nt, Homo sapiens
aaugagagcacuuucuuuu

SEQ ID NO: 104686 - RNA, 19 nt, Homo sapiens
gaagugaaauucugaguug

SEQ ID NO: 104687 - RNA, 19 nt, Homo sapiens
gagauaaugugaaauacga

SEQ ID NO: 104688 - RNA, 19 nt, Homo sapiens
gaagagaccugggcuugga

SEQ ID NO: 104689 - RNA, 19 nt, Homo sapiens
gaaggauggaacuaucuua

SEQ ID NO: 104690 - RNA, 19 nt, Homo sapiens
ucaaggccauaucccaaua

SEQ ID NO: 104691 - RNA, 19 nt, Homo sapiens
ggauggaacuaucuuaugc

SEQ ID NO: 104692 - RNA, 19 nt, Homo sapiens
gcagaugggcaccaacaaa

SEQ ID NO: 104693 - RNA, 19 nt, Homo sapiens
cgugagauaaugugaaaua

SEQ ID NO: 104694 - RNA, 19 nt, Homo sapiens
ccuaggaccuucagaucaa

SEQ ID NO: 104695 - RNA, 19 nt, Homo sapiens
gggccgugauguuaaauau

SEQ ID NO: 104696 - RNA, 19 nt, Homo sapiens
gaccugggcuuggaaggaa

SEQ ID NO: 104697 - RNA, 19 nt, Homo sapiens
ggagagagugcuaggaaau

SEQ ID NO: 104698 - RNA, 19 nt, Homo sapiens
ucaaggccauggucagcua

SEQ ID NO: 104699 - RNA, 19 nt, Homo sapiens
ggaagugaaauucugaguu

SEQ ID NO: 104700 - RNA, 19 nt, Homo sapiens
gaaagugagggccguacaa

SEQ ID NO: 104701 - RNA, 19 nt, Homo sapiens
gugaaauucugaguuguug

SEQ ID NO: 104702 - RNA, 19 nt, Homo sapiens
guacaaggaagugaaauuc

SEQ ID NO: 104703 - RNA, 19 nt, Homo sapiens
gcaaguuucaggaaguauu

SEQ ID NO: 104704 - RNA, 19 nt, Homo sapiens
gcugagcaguuugugguuu

SEQ ID NO: 104705 - RNA, 19 nt, Homo sapiens
acaaggaagugaaauucug

SEQ ID NO: 104706 - RNA, 19 nt, Homo sapiens
gccgugauguuaaauaucu

SEQ ID NO: 104707 - RNA, 19 nt, Homo sapiens
agagagugcuaggaaauga

SEQ ID NO: 104708 - RNA, 19 nt, Homo sapiens
ggacauuggcgucaaguac

SEQ ID NO: 104709 - RNA, 19 nt, Homo sapiens
caaggaagugaaauucuga

SEQ ID NO: 104710 - RNA, 19 nt, Homo sapiens
caaggacaguggagagagu

SEQ ID NO: 104711 - RNA, 19 nt, Homo sapiens
uagaaaaccuguccaacuu

SEQ ID NO: 104712 - RNA, 19 nt, Homo sapiens
guucagugcugccagucaa

SEQ ID NO: 104713 - RNA, 19 nt, Homo sapiens
gaaaaccuguccaacuuca

SEQ ID NO: 104714 - RNA, 19 nt, Homo sapiens
ugacuggauuugccuagga

SEQ ID NO: 104715 - RNA, 19 nt, Homo sapiens
gcucccaagugacuggauu

SEQ ID NO: 104716 - RNA, 19 nt, Homo sapiens
ccgcaaguuucaggaagua

SEQ ID NO: 104717 - RNA, 19 nt, Homo sapiens
ggagcggaauuucgacgau

SEQ ID NO: 104718 - RNA, 19 nt, Homo sapiens
ugugacaacuccuccaugu

SEQ ID NO: 104719 - RNA, 19 nt, Homo sapiens
gcugggaaccgacaagugu

SEQ ID NO: 104720 - RNA, 19 nt, Homo sapiens
gcacacucaugaacaagcu

SEQ ID NO: 104721 - RNA, 19 nt, Homo sapiens
uaugcacacucaugaacaa

SEQ ID NO: 104722 - RNA, 19 nt, Homo sapiens
uccgugagauaaugugaaa

SEQ ID NO: 104723 - RNA, 19 nt, Homo sapiens
gagaagcaggagcggaauu

SEQ ID NO: 104724 - RNA, 19 nt, Homo sapiens
gagagagugcuaggaaaug

SEQ ID NO: 104725 - RNA, 19 nt, Homo sapiens
uuugucagcugagcaguuu

SEQ ID NO: 104726 - RNA, 19 nt, Homo sapiens
cagaugggcaccaacaaau

SEQ ID NO: 104727 - RNA, 19 nt, Homo sapiens
cagaucaacagacuucaga

SEQ ID NO: 104728 - RNA, 19 nt, Homo sapiens
ccugaaggauggaacuauc

SEQ ID NO: 104729 - RNA, 19 nt, Homo sapiens
caaccaagggucugugagu

SEQ ID NO: 104730 - RNA, 19 nt, Homo sapiens
uggagagagugcuaggaaa

SEQ ID NO: 104731 - RNA, 19 nt, Homo sapiens
guggagagagugcuaggaa

SEQ ID NO: 104732 - RNA, 19 nt, Homo sapiens
ggucccugcuggcacauuc

SEQ ID NO: 104733 - RNA, 19 nt, Homo sapiens
gaucaggcagcagagcuuu

SEQ ID NO: 104734 - RNA, 19 nt, Homo sapiens
gcuccacgcaguucaacaa

SEQ ID NO: 104735 - RNA, 19 nt, Homo sapiens
cuuccgggcucaagcgauu

SEQ ID NO: 104736 - RNA, 19 nt, Homo sapiens
agaaccggcuccuguccaa

SEQ ID NO: 104737 - RNA, 19 nt, Homo sapiens
gaaccgacaagugugacaa

SEQ ID NO: 104738 - RNA, 19 nt, Homo sapiens
gccaacgaccuguuugaga

SEQ ID NO: 104739 - RNA, 19 nt, Homo sapiens
caaacgcaauaaaaccuuu

SEQ ID NO: 104740 - RNA, 19 nt, Homo sapiens
cccaagcgcugagauuaca

SEQ ID NO: 104741 - RNA, 19 nt, Homo sapiens
ccacaucgucuucccaucu

SEQ ID NO: 104742 - RNA, 19 nt, Homo sapiens
gcccugcuccgugagauaa

SEQ ID NO: 104743 - RNA, 19 nt, Homo sapiens
ggaaguauucacaaaagaa

SEQ ID NO: 104744 - RNA, 19 nt, Homo sapiens
caaguuucaggaaguauuc

SEQ ID NO: 104745 - RNA, 19 nt, Homo sapiens
agaagcaggagcggaauuu

SEQ ID NO: 104746 - RNA, 19 nt, Homo sapiens
acucuggccucaguagauu

SEQ ID NO: 104747 - RNA, 19 nt, Homo sapiens
cguacaaggaagugaaauu

SEQ ID NO: 104748 - RNA, 19 nt, Homo sapiens
gugcaguggcgccaucuug

SEQ ID NO: 104749 - RNA, 19 nt, Homo sapiens
uaucuuaugcacacucaug

SEQ ID NO: 104750 - RNA, 19 nt, Homo sapiens
uucaggaaguauucacaaa

SEQ ID NO: 104751 - RNA, 19 nt, Homo sapiens
ccauaucccaauacgugua

SEQ ID NO: 104752 - RNA, 19 nt, Homo sapiens
cgaggccaacgaccuguuu

SEQ ID NO: 104753 - RNA, 19 nt, Homo sapiens
aaauacgacuguggaccaa

SEQ ID NO: 104754 - RNA, 19 nt, Homo sapiens
uuucuaugcccgcaaguuu

SEQ ID NO: 104755 - RNA, 19 nt, Homo sapiens
cagaugggcacgaacaagu

SEQ ID NO: 104756 - RNA, 19 nt, Homo sapiens
gaagcaggagcggaauuuc

SEQ ID NO: 104757 - RNA, 19 nt, Homo sapiens
cggcuccuguccaaauaug

SEQ ID NO: 104758 - RNA, 19 nt, Homo sapiens
gacaguggagagagugcua

SEQ ID NO: 104759 - RNA, 19 nt, Homo sapiens
ucaaguacucggagaagca

SEQ ID NO: 104760 - RNA, 19 nt, Homo sapiens
ggaucaggcagcagagcuu

SEQ ID NO: 104761 - RNA, 19 nt, Homo sapiens
gaaccggcuccuguccaaa

SEQ ID NO: 104762 - RNA, 19 nt, Homo sapiens
ggcggcacaucuaugauac

SEQ ID NO: 104763 - RNA, 19 nt, Homo sapiens
gaugggcaccaacaaaugc

SEQ ID NO: 104764 - RNA, 19 nt, Homo sapiens
gugagauaaugugaaauac

SEQ ID NO: 104765 - RNA, 19 nt, Homo sapiens
gugagggccguacaaggaa

SEQ ID NO: 104766 - RNA, 19 nt, Homo sapiens
agugagggccguacaagga

SEQ ID NO: 104767 - RNA, 19 nt, Homo sapiens
cuucagaucaacagacuuc

SEQ ID NO: 104768 - RNA, 19 nt, Homo sapiens
gccuaggaccuucagauca

SEQ ID NO: 104769 - RNA, 19 nt, Homo sapiens
gaacuaucuuaugcacacu

SEQ ID NO: 104770 - RNA, 19 nt, Homo sapiens
cugguugccucgccucuuc

SEQ ID NO: 104771 - RNA, 19 nt, Homo sapiens
gcugagauuacagguguga

SEQ ID NO: 104772 - RNA, 19 nt, Homo sapiens
gcaguuugugguuucuaug

SEQ ID NO: 104773 - RNA, 19 nt, Homo sapiens
cugagcaguuugugguuuc

SEQ ID NO: 104774 - RNA, 19 nt, Homo sapiens
cacaucgucuucccaucug

SEQ ID NO: 104775 - RNA, 19 nt, Homo sapiens
ugaaggauggaacuaucuu

SEQ ID NO: 104776 - RNA, 19 nt, Homo sapiens
gguggacauuggcgucaag

SEQ ID NO: 104777 - RNA, 19 nt, Homo sapiens
gaagagacaucuaugauca

SEQ ID NO: 104778 - RNA, 19 nt, Homo sapiens
agaaggagcucaguauuua

SEQ ID NO: 104779 - RNA, 19 nt, Homo sapiens
gcaaguauaugaucccaaa

SEQ ID NO: 104780 - RNA, 19 nt, Homo sapiens
caaaguugcuucccagaaa

SEQ ID NO: 104781 - RNA, 19 nt, Homo sapiens
caagauugcuuccaaguau

SEQ ID NO: 104782 - RNA, 19 nt, Homo sapiens
guggacaacucgacaauuu

SEQ ID NO: 104783 - RNA, 19 nt, Homo sapiens
cagaauacccugaugagua

SEQ ID NO: 104784 - RNA, 19 nt, Homo sapiens
ggacuaggaggcaucuuua

SEQ ID NO: 104785 - RNA, 19 nt, Homo sapiens
gaagccacaugacauauuc

SEQ ID NO: 104786 - RNA, 19 nt, Homo sapiens
agacuaaacucaugcuuau

SEQ ID NO: 104787 - RNA, 19 nt, Homo sapiens
gagaauauuggcaacuuua

SEQ ID NO: 104788 - RNA, 19 nt, Homo sapiens
ggagaauauuggcaacuuu

SEQ ID NO: 104789 - RNA, 19 nt, Homo sapiens
guuaaauccuacagcauaa

SEQ ID NO: 104790 - RNA, 19 nt, Homo sapiens
gguuaaauccuacagcaua

SEQ ID NO: 104791 - RNA, 19 nt, Homo sapiens
aagcuagccuugaguaauu

SEQ ID NO: 104792 - RNA, 19 nt, Homo sapiens
accaaggcauugauuauua

SEQ ID NO: 104793 - RNA, 19 nt, Homo sapiens
ggaguuaaguaugcagaaa

SEQ ID NO: 104794 - RNA, 19 nt, Homo sapiens
gcagaugggcacuaauaaa

SEQ ID NO: 104795 - RNA, 19 nt, Homo sapiens
gaaccaccaugacccacuu

SEQ ID NO: 104796 - RNA, 19 nt, Homo sapiens
gaugggcacuaauaaagga

SEQ ID NO: 104797 - RNA, 19 nt, Homo sapiens
cagaaggagcucaguauuu

SEQ ID NO: 104798 - RNA, 19 nt, Homo sapiens
aucaauaacucgcauauga

SEQ ID NO: 104799 - RNA, 19 nt, Homo sapiens
ccucuucccucaauaguug

SEQ ID NO: 104800 - RNA, 19 nt, Homo sapiens
gaucagaagcuaacauuac

SEQ ID NO: 104801 - RNA, 19 nt, Homo sapiens
gaaaggaaugaguguguau

SEQ ID NO: 104802 - RNA, 19 nt, Homo sapiens
acagauggguaccaacaaa

SEQ ID NO: 104803 - RNA, 19 nt, Homo sapiens
ggccucaguuggagaauau

SEQ ID NO: 104804 - RNA, 19 nt, Homo sapiens
agaacaagauugcuuccaa

SEQ ID NO: 104805 - RNA, 19 nt, Homo sapiens
aggcagguaugacagcuua

SEQ ID NO: 104806 - RNA, 19 nt, Homo sapiens
gaugggaaccaacaaaugu

SEQ ID NO: 104807 - RNA, 19 nt, Homo sapiens
ggucuuugccaacuaaauu

SEQ ID NO: 104808 - RNA, 19 nt, Homo sapiens
cuacaguauuguuugcuaa

SEQ ID NO: 104809 - RNA, 19 nt, Homo sapiens
ccaaggcauugauuauuag

SEQ ID NO: 104810 - RNA, 19 nt, Homo sapiens
gcagaugggaaccaacaaa

SEQ ID NO: 104811 - RNA, 19 nt, Homo sapiens
gaccaaggcauugauuauu

SEQ ID NO: 104812 - RNA, 19 nt, Homo sapiens
acaaaugguucggaaauca

SEQ ID NO: 104813 - RNA, 19 nt, Homo sapiens
caaggaacaggaacaaaug

SEQ ID NO: 104814 - RNA, 19 nt, Homo sapiens
ccaaggaacaggaacaaau

SEQ ID NO: 104815 - RNA, 19 nt, Homo sapiens
ccuacagcauaaucaauaa

SEQ ID NO: 104816 - RNA, 19 nt, Homo sapiens
uuagugcuguaauagguua

SEQ ID NO: 104817 - RNA, 19 nt, Homo sapiens
gcgaguaccaggaugacua

SEQ ID NO: 104818 - RNA, 19 nt, Homo sapiens
agaaaggaaugagugugua

SEQ ID NO: 104819 - RNA, 19 nt, Homo sapiens
agacaucuaugaucagaag

SEQ ID NO: 104820 - RNA, 19 nt, Homo sapiens
ccauugacauuggaguuaa

SEQ ID NO: 104821 - RNA, 19 nt, Homo sapiens
uaacucgcauaugaaguaa

SEQ ID NO: 104822 - RNA, 19 nt, Homo sapiens
gaagucaagaacaagauug

SEQ ID NO: 104823 - RNA, 19 nt, Homo sapiens
cuaggaggcaucuuuauga

SEQ ID NO: 104824 - RNA, 19 nt, Homo sapiens
aaacucaugcuuauugcua

SEQ ID NO: 104825 - RNA, 19 nt, Homo sapiens
ggaacaggaacaaaugguu

SEQ ID NO: 104826 - RNA, 19 nt, Homo sapiens
ccagaagagacaucuauga

SEQ ID NO: 104827 - RNA, 19 nt, Homo sapiens
gaccagaccacaauuaguc

SEQ ID NO: 104828 - RNA, 19 nt, Homo sapiens
caacggaagccaaggaaca

SEQ ID NO: 104829 - RNA, 19 nt, Homo sapiens
gggacuaggaggcaucuuu

SEQ ID NO: 104830 - RNA, 19 nt, Homo sapiens
ugacauauucgaagcaaau

SEQ ID NO: 104831 - RNA, 19 nt, Homo sapiens
gaucuucgcaauuggauag

SEQ ID NO: 104832 - RNA, 19 nt, Homo sapiens
auuauuagauccacacaga

SEQ ID NO: 104833 - RNA, 19 nt, Homo sapiens
uauaugaucccaaauacug

SEQ ID NO: 104834 - RNA, 19 nt, Homo sapiens
ucugcgaacuuauaaacaa

SEQ ID NO: 104835 - RNA, 19 nt, Homo sapiens
gacaauuucccuacagaug

SEQ ID NO: 104836 - RNA, 19 nt, Homo sapiens
gaagaggugacaggcauga

SEQ ID NO: 104837 - RNA, 19 nt, Homo sapiens
aagacuaaacucaugcuua

SEQ ID NO: 104838 - RNA, 19 nt, Homo sapiens
cgaccaaggcauugauuau

SEQ ID NO: 104839 - RNA, 19 nt, Homo sapiens
cagaaccugucauucacaa

SEQ ID NO: 104840 - RNA, 19 nt, Homo sapiens
cugcagaugggcacuaaua

SEQ ID NO: 104841 - RNA, 19 nt, Homo sapiens
aaagcuggccaaaguguaa

SEQ ID NO: 104842 - RNA, 19 nt, Homo sapiens
auaacucgcauaugaagua

SEQ ID NO: 104843 - RNA, 19 nt, Homo sapiens
ucaauaacucgcauaugaa

SEQ ID NO: 104844 - RNA, 19 nt, Homo sapiens
gcgaccaaggcauugauua

SEQ ID NO: 104845 - RNA, 19 nt, Homo sapiens
ccauacaaccauugacauu

SEQ ID NO: 104846 - RNA, 19 nt, Homo sapiens
gcuauucaggcuuauggua

SEQ ID NO: 104847 - RNA, 19 nt, Homo sapiens
gcucaguauuuaguccuuu

SEQ ID NO: 104848 - RNA, 19 nt, Homo sapiens
caucuaugaucagaagcua

SEQ ID NO: 104849 - RNA, 19 nt, Homo sapiens
cagaagagacaucuaugau

SEQ ID NO: 104850 - RNA, 19 nt, Homo sapiens
acaaaaggauuccauacaa

SEQ ID NO: 104851 - RNA, 19 nt, Homo sapiens
gaaacaugacccagguuca

SEQ ID NO: 104852 - RNA, 19 nt, Homo sapiens
acuaaacucaugcuuauug

SEQ ID NO: 104853 - RNA, 19 nt, Homo sapiens
uaguguaucugguuucuac

SEQ ID NO: 104854 - RNA, 19 nt, Homo sapiens
ccagagauuaccaauauag

SEQ ID NO: 104855 - RNA, 19 nt, Homo sapiens
gcaucuuuaugaucccaaa

SEQ ID NO: 104856 - RNA, 19 nt, Homo sapiens
ugacauuggaguuaaguau

SEQ ID NO: 104857 - RNA, 19 nt, Homo sapiens
caacuuccagcugggcuua

SEQ ID NO: 104858 - RNA, 19 nt, Homo sapiens
ccccagagauuaccaauau

SEQ ID NO: 104859 - RNA, 19 nt, Homo sapiens
agagacaucuaugaucaga

SEQ ID NO: 104860 - RNA, 19 nt, Homo sapiens
cagaugggcacuaauaaag

SEQ ID NO: 104861 - RNA, 19 nt, Homo sapiens
cauccucugcgaacuuaua

SEQ ID NO: 104862 - RNA, 19 nt, Homo sapiens
auacaaccauugacauugg

SEQ ID NO: 104863 - RNA, 19 nt, Homo sapiens
gguaugaagccacaugaca

SEQ ID NO: 104864 - RNA, 19 nt, Homo sapiens
caacgaguccucacugaac

SEQ ID NO: 104865 - RNA, 19 nt, Homo sapiens
acaagauugcuuccaagua

SEQ ID NO: 104866 - RNA, 19 nt, Homo sapiens
acacagaaggagcucagua

SEQ ID NO: 104867 - RNA, 19 nt, Homo sapiens
cagaaaggaaugagugugu

SEQ ID NO: 104868 - RNA, 19 nt, Homo sapiens
cggccgaagucaagaacaa

SEQ ID NO: 104869 - RNA, 19 nt, Homo sapiens
ugacccagguucagacuac

SEQ ID NO: 104870 - RNA, 19 nt, Homo sapiens
gucaacgaguccucacuga

SEQ ID NO: 104871 - RNA, 19 nt, Homo sapiens
auaaagucaugaucagugu

SEQ ID NO: 104872 - RNA, 19 nt, Homo sapiens
ucuacaguauuguuugcua

SEQ ID NO: 104873 - RNA, 19 nt, Homo sapiens
guuucuacauggaagacua

SEQ ID NO: 104874 - RNA, 19 nt, Homo sapiens
caauaacucgcauaugaag

SEQ ID NO: 104875 - RNA, 19 nt, Homo sapiens
uaggaggcaucuuuaugau

SEQ ID NO: 104876 - RNA, 19 nt, Homo sapiens
ccucaauaguugccuuuua

SEQ ID NO: 104877 - RNA, 19 nt, Homo sapiens
gaagaaagcagaacaguua

SEQ ID NO: 104878 - RNA, 19 nt, Homo sapiens
gagcuuaccucccaccuuu

SEQ ID NO: 104879 - RNA, 19 nt, Homo sapiens
gaccaucucugcccucuuu

SEQ ID NO: 104880 - RNA, 19 nt, Homo sapiens
ggaguacgcucaacaagau

SEQ ID NO: 104881 - RNA, 19 nt, Homo sapiens
gcagaacccuggugaggaa

SEQ ID NO: 104882 - RNA, 19 nt, Homo sapiens
ugagugaucccauuucuua

SEQ ID NO: 104883 - RNA, 19 nt, Homo sapiens
aaaguuaaccuaccuguaa

SEQ ID NO: 104884 - RNA, 19 nt, Homo sapiens
agaaggagcugcgacaauu

SEQ ID NO: 104885 - RNA, 19 nt, Homo sapiens
ggaagaaagcagaacaguu

SEQ ID NO: 104886 - RNA, 19 nt, Homo sapiens
ggacuuggucaccuacuuu

SEQ ID NO: 104887 - RNA, 19 nt, Homo sapiens
ucagaauucuugugcuuga

SEQ ID NO: 104888 - RNA, 19 nt, Homo sapiens
caucagaauucuugugcuu

SEQ ID NO: 104889 - RNA, 19 nt, Homo sapiens
cuagguaacaguuugauaa

SEQ ID NO: 104890 - RNA, 19 nt, Homo sapiens
uaaccuaccuguaacuuuu

SEQ ID NO: 104891 - RNA, 19 nt, Homo sapiens
gaauucuugugcuugauga

SEQ ID NO: 104892 - RNA, 19 nt, Homo sapiens
gacgggccuugaccucuua

SEQ ID NO: 104893 - RNA, 19 nt, Homo sapiens
gggagaagauggacuuggu

SEQ ID NO: 104894 - RNA, 19 nt, Homo sapiens
uaacagggccuugcuaauc

SEQ ID NO: 104895 - RNA, 19 nt, Homo sapiens
ccuguaagacugauaauga

SEQ ID NO: 104896 - RNA, 19 nt, Homo sapiens
aagcaauccuccugaguga

SEQ ID NO: 104897 - RNA, 19 nt, Homo sapiens
gugcccagcucaaggagaa

SEQ ID NO: 104898 - RNA, 19 nt, Homo sapiens
caaccuguaagacugauaa

SEQ ID NO: 104899 - RNA, 19 nt, Homo sapiens
acacauuccugcccaagau

SEQ ID NO: 104900 - RNA, 19 nt, Homo sapiens
ugaaauggccgaccaguac

SEQ ID NO: 104901 - RNA, 19 nt, Homo sapiens
gugcuuuggauuuaaguua

SEQ ID NO: 104902 - RNA, 19 nt, Homo sapiens
cuaaucggguugucacuca

SEQ ID NO: 104903 - RNA, 19 nt, Homo sapiens
gcaauccuccugagugauc

SEQ ID NO: 104904 - RNA, 19 nt, Homo sapiens
gaacuagugguggcucuga

SEQ ID NO: 104905 - RNA, 19 nt, Homo sapiens
caaaguuaaccuaccugua

SEQ ID NO: 104906 - RNA, 19 nt, Homo sapiens
gcauugcacaaccaaguuu

SEQ ID NO: 104907 - RNA, 19 nt, Homo sapiens
gggaugagcccagggagaa

SEQ ID NO: 104908 - RNA, 19 nt, Homo sapiens
caaccucagcaaccuguaa

SEQ ID NO: 104909 - RNA, 19 nt, Homo sapiens
gaagggguuucuaacacua

SEQ ID NO: 104910 - RNA, 19 nt, Homo sapiens
gaaggagcugcgacaauuc

SEQ ID NO: 104911 - RNA, 19 nt, Homo sapiens
cuguaagacugauaaugaa

SEQ ID NO: 104912 - RNA, 19 nt, Homo sapiens
gugaucccauuucuuaauc

SEQ ID NO: 104913 - RNA, 19 nt, Homo sapiens
ggaccucugggcuuugauu

SEQ ID NO: 104914 - RNA, 19 nt, Homo sapiens
ggacaucagaauucuugug

SEQ ID NO: 104915 - RNA, 19 nt, Homo sapiens
caagaaggcuggggcuauu

SEQ ID NO: 104916 - RNA, 19 nt, Homo sapiens
cgagugauguggacaagcu

SEQ ID NO: 104917 - RNA, 19 nt, Homo sapiens
accaagagccaauggagua

SEQ ID NO: 104918 - RNA, 19 nt, Homo sapiens
ggcugacgcuuacaagauc

SEQ ID NO: 104919 - RNA, 19 nt, Homo sapiens
agacgggccuugaccucuu

SEQ ID NO: 104920 - RNA, 19 nt, Homo sapiens
guagaccccuggcugguaa

SEQ ID NO: 104921 - RNA, 19 nt, Homo sapiens
uuugauaacuagggaagaa

SEQ ID NO: 104922 - RNA, 19 nt, Homo sapiens
gauuccaucuccuugucuu

SEQ ID NO: 104923 - RNA, 19 nt, Homo sapiens
gaaagcagaacaguuaagc

SEQ ID NO: 104924 - RNA, 19 nt, Homo sapiens
ccacgcugcuagagugcaa

SEQ ID NO: 104925 - RNA, 19 nt, Homo sapiens
acagaggcuucucccgaaa

SEQ ID NO: 104926 - RNA, 19 nt, Homo sapiens
ggaguuaagcgagcagcaa

SEQ ID NO: 104927 - RNA, 19 nt, Homo sapiens
gggaggcaccauucaggaa

SEQ ID NO: 104928 - RNA, 19 nt, Homo sapiens
caaccaaguuuugugacua

SEQ ID NO: 104929 - RNA, 19 nt, Homo sapiens
agauggacuuggucaccua

SEQ ID NO: 104930 - RNA, 19 nt, Homo sapiens
guaacagggccuugcuaau

SEQ ID NO: 104931 - RNA, 19 nt, Homo sapiens
guggacaaguaccgugaug

SEQ ID NO: 104932 - RNA, 19 nt, Homo sapiens
ggugucggcugacgcuuac

SEQ ID NO: 104933 - RNA, 19 nt, Homo sapiens
ccagggagaagauggacuu

SEQ ID NO: 104934 - RNA, 19 nt, Homo sapiens
gaaccacaaggccuucaag

SEQ ID NO: 104935 - RNA, 19 nt, Homo sapiens
cugaugaccugaagaagcu

SEQ ID NO: 104936 - RNA, 19 nt, Homo sapiens
aaguuacuauccuggcuuu

SEQ ID NO: 104937 - RNA, 19 nt, Homo sapiens
gaacuccugggcucaagca

SEQ ID NO: 104938 - RNA, 19 nt, Homo sapiens
guccugcaccaucauauga

SEQ ID NO: 104939 - RNA, 19 nt, Homo sapiens
cgggacaucagaauucuug

SEQ ID NO: 104940 - RNA, 19 nt, Homo sapiens
gggucaucguggacaagua

SEQ ID NO: 104941 - RNA, 19 nt, Homo sapiens
caccauaacuagguaacag

SEQ ID NO: 104942 - RNA, 19 nt, Homo sapiens
gugcaguggugcgaucaug

SEQ ID NO: 104943 - RNA, 19 nt, Homo sapiens
gggccaucuucacgggaua

SEQ ID NO: 104944 - RNA, 19 nt, Homo sapiens
ggaggucagggccaucuuc

SEQ ID NO: 104945 - RNA, 19 nt, Homo sapiens
ggacugugcccagcucaag

SEQ ID NO: 104946 - RNA, 19 nt, Homo sapiens
cagcaaccuguaagacuga

SEQ ID NO: 104947 - RNA, 19 nt, Homo sapiens
gcuccaguccugcucucua

SEQ ID NO: 104948 - RNA, 19 nt, Homo sapiens
gagugaucccauuucuuaa

SEQ ID NO: 104949 - RNA, 19 nt, Homo sapiens
ccuccugagugaucccauu

SEQ ID NO: 104950 - RNA, 19 nt, Homo sapiens
ggggcaagcucuauuccuu

SEQ ID NO: 104951 - RNA, 19 nt, Homo sapiens
gaugagcccagggagaaga

SEQ ID NO: 104952 - RNA, 19 nt, Homo sapiens
cagcccaucuugccuccau

SEQ ID NO: 104953 - RNA, 19 nt, Homo sapiens
gaucccauuucuuaaucag

SEQ ID NO: 104954 - RNA, 19 nt, Homo sapiens
cuccugggcucaagcaauc

SEQ ID NO: 104955 - RNA, 19 nt, Homo sapiens
guucucaccaccacuuaug

SEQ ID NO: 104956 - RNA, 19 nt, Homo sapiens
gcagaggaguacgcucaac

SEQ ID NO: 104957 - RNA, 19 nt, Homo sapiens
ugaccaagaagagcucuga

SEQ ID NO: 104958 - RNA, 19 nt, Homo sapiens
cggcugaugaccugaagaa

SEQ ID NO: 104959 - RNA, 19 nt, Homo sapiens
aguaacagggccuugcuaa

SEQ ID NO: 104960 - RNA, 19 nt, Homo sapiens
ccucccaccuuugguccua

SEQ ID NO: 104961 - RNA, 19 nt, Homo sapiens
uaacugacccucccuuccu

SEQ ID NO: 104962 - RNA, 19 nt, Homo sapiens
gcugacgcuuacaagauca

SEQ ID NO: 104963 - RNA, 19 nt, Homo sapiens
aguacaagcggcucgauga

SEQ ID NO: 104964 - RNA, 19 nt, Homo sapiens
caagaaggagcugcgacaa

SEQ ID NO: 104965 - RNA, 19 nt, Homo sapiens
ggaaccacaaggccuucaa

SEQ ID NO: 104966 - RNA, 19 nt, Homo sapiens
ggaagggguuucuaacacu

SEQ ID NO: 104967 - RNA, 19 nt, Homo sapiens
cggcugacgcuuacaagau

SEQ ID NO: 104968 - RNA, 19 nt, Homo sapiens
ccugagugaucccauuucu

SEQ ID NO: 104969 - RNA, 19 nt, Homo sapiens
gcaaccuguaagacugaua

SEQ ID NO: 104970 - RNA, 19 nt, Homo sapiens
gggaaacgugcccucuguu

SEQ ID NO: 104971 - RNA, 19 nt, Homo sapiens
gcaccaucauaugaguguu

SEQ ID NO: 104972 - RNA, 19 nt, Homo sapiens
gaggucagggccaucuuca

SEQ ID NO: 104973 - RNA, 19 nt, Homo sapiens
ggucaucguggacaaguac

SEQ ID NO: 104974 - RNA, 19 nt, Homo sapiens
aagaaagcagaacaguuaa

SEQ ID NO: 104975 - RNA, 19 nt, Homo sapiens
gggaagaaagcagaacagu

SEQ ID NO: 104976 - RNA, 19 nt, Homo sapiens
gcagggaggcaccauucag

SEQ ID NO: 104977 - RNA, 19 nt, Homo sapiens
ccacagaaauucccuuuaa

SEQ ID NO: 104978 - RNA, 19 nt, Homo sapiens
ugacauggcauccaaauua

SEQ ID NO: 104979 - RNA, 19 nt, Homo sapiens
ggacauagaguguuucaug

SEQ ID NO: 104980 - RNA, 19 nt, Homo sapiens
gaugaaaccuaccugaugu

SEQ ID NO: 104981 - RNA, 19 nt, Homo sapiens
gcgagaaacugcaaucugu

SEQ ID NO: 104982 - RNA, 19 nt, Homo sapiens
gcacaaacacgcaaacaau

SEQ ID NO: 104983 - RNA, 19 nt, Homo sapiens
ucuauugucuccuugguua

SEQ ID NO: 104984 - RNA, 19 nt, Homo sapiens
ucacagccaucgacaggua

SEQ ID NO: 104985 - RNA, 19 nt, Homo sapiens
ggucaagauugccaaggua

SEQ ID NO: 104986 - RNA, 19 nt, Homo sapiens
ggugaacauuacagaauuu

SEQ ID NO: 104987 - RNA, 19 nt, Homo sapiens
gacauuagguuagccaaga

SEQ ID NO: 104988 - RNA, 19 nt, Homo sapiens
ugaacaagcucauuaagac

SEQ ID NO: 104989 - RNA, 19 nt, Homo sapiens
gcagaccaggugaacauua

SEQ ID NO: 104990 - RNA, 19 nt, Homo sapiens
caugguguaugaugucuuu

SEQ ID NO: 104991 - RNA, 19 nt, Homo sapiens
ugccacaugucacuuauuu

SEQ ID NO: 104992 - RNA, 19 nt, Homo sapiens
caagagcacggucaagauu

SEQ ID NO: 104993 - RNA, 19 nt, Homo sapiens
caacguguuucuguucaaa

SEQ ID NO: 104994 - RNA, 19 nt, Homo sapiens
ccacugaccuccuguacgu

SEQ ID NO: 104995 - RNA, 19 nt, Homo sapiens
uuaagacgguguuugcauu

SEQ ID NO: 104996 - RNA, 19 nt, Homo sapiens
gaccauagccauugugauc

SEQ ID NO: 104997 - RNA, 19 nt, Homo sapiens
gauccuagauggccuugca

SEQ ID NO: 104998 - RNA, 19 nt, Homo sapiens
gagcucagccuaaucaaag

SEQ ID NO: 104999 - RNA, 19 nt, Homo sapiens
aaaccuaccugauguucug

SEQ ID NO: 105000 - RNA, 19 nt, Homo sapiens
gagcauguuucccucuugu

SEQ ID NO: 105001 - RNA, 19 nt, Homo sapiens
ucauggacauagaguguuu

SEQ ID NO: 105002 - RNA, 19 nt, Homo sapiens
gacauggcauccaaauuag

SEQ ID NO: 105003 - RNA, 19 nt, Homo sapiens
cuagauggccuugcagaua

SEQ ID NO: 105004 - RNA, 19 nt, Homo sapiens
acaagucucucucguccuu

SEQ ID NO: 105005 - RNA, 19 nt, Homo sapiens
caugucacuuauuugcuua

SEQ ID NO: 105006 - RNA, 19 nt, Homo sapiens
aaucaaagacugagguuau

SEQ ID NO: 105007 - RNA, 19 nt, Homo sapiens
ggagcauguuucccucuug

SEQ ID NO: 105008 - RNA, 19 nt, Homo sapiens
ucuaugcucugaggaguaa

SEQ ID NO: 105009 - RNA, 19 nt, Homo sapiens
acauguauauucucuggaa

SEQ ID NO: 105010 - RNA, 19 nt, Homo sapiens
gaacugcgagaaacugcaa

SEQ ID NO: 105011 - RNA, 19 nt, Homo sapiens
gcaacguguuucuguucaa

SEQ ID NO: 105012 - RNA, 19 nt, Homo sapiens
ccgcauggacauuagguua

SEQ ID NO: 105013 - RNA, 19 nt, Homo sapiens
ucaaggagaaugaggagaa

SEQ ID NO: 105014 - RNA, 19 nt, Homo sapiens
gauugccacaugucacuua

SEQ ID NO: 105015 - RNA, 19 nt, Homo sapiens
guacgaagacaucaaaggu

SEQ ID NO: 105016 - RNA, 19 nt, Homo sapiens
caaagacugagguuaugaa

SEQ ID NO: 105017 - RNA, 19 nt, Homo sapiens
cagaaauucccuuuaacuu

SEQ ID NO: 105018 - RNA, 19 nt, Homo sapiens
gcauguuucccucuuguga

SEQ ID NO: 105019 - RNA, 19 nt, Homo sapiens
agaaauucccuuuaacuuc

SEQ ID NO: 105020 - RNA, 19 nt, Homo sapiens
uagauggccuugcagauac

SEQ ID NO: 105021 - RNA, 19 nt, Homo sapiens
acagguacauauccauuca

SEQ ID NO: 105022 - RNA, 19 nt, Homo sapiens
ggagaacuucauggacaua

SEQ ID NO: 105023 - RNA, 19 nt, Homo sapiens
acaugucacuuauuugcuu

SEQ ID NO: 105024 - RNA, 19 nt, Homo sapiens
cgacagguacauauccauu

SEQ ID NO: 105025 - RNA, 19 nt, Homo sapiens
guacuucccacagaaauuc

SEQ ID NO: 105026 - RNA, 19 nt, Homo sapiens
gggagaacuucauggacau

SEQ ID NO: 105027 - RNA, 19 nt, Homo sapiens
cugcgcagccucuggauaa

SEQ ID NO: 105028 - RNA, 19 nt, Homo sapiens
ugaugaaaccuaccugaug

SEQ ID NO: 105029 - RNA, 19 nt, Homo sapiens
gaacuucauggacauagag

SEQ ID NO: 105030 - RNA, 19 nt, Homo sapiens
caagcccgcauggacauua

SEQ ID NO: 105031 - RNA, 19 nt, Homo sapiens
gggcuggaacugcgagaaa

SEQ ID NO: 105032 - RNA, 19 nt, Homo sapiens
gauguggaccauagccauu

SEQ ID NO: 105033 - RNA, 19 nt, Homo sapiens
ucaguacgaagacaucaaa

SEQ ID NO: 105034 - RNA, 19 nt, Homo sapiens
aaaggugauugccacaugu

SEQ ID NO: 105035 - RNA, 19 nt, Homo sapiens
cagaccaggugaacauuac

SEQ ID NO: 105036 - RNA, 19 nt, Homo sapiens
ccacaugucacuuauuugc

SEQ ID NO: 105037 - RNA, 19 nt, Homo sapiens
uacgugggcucaaaugaca

SEQ ID NO: 105038 - RNA, 19 nt, Homo sapiens
caggugaacauuacagaau

SEQ ID NO: 105039 - RNA, 19 nt, Homo sapiens
cagcagaccaggugaacau

SEQ ID NO: 105040 - RNA, 19 nt, Homo sapiens
uaggguacuucccacagaa

SEQ ID NO: 105041 - RNA, 19 nt, Homo sapiens
gaagacaucaaaggugaca

SEQ ID NO: 105042 - RNA, 19 nt, Homo sapiens
aagagucuauugucuccuu

SEQ ID NO: 105043 - RNA, 19 nt, Homo sapiens
caaacaaugcagccagugu

SEQ ID NO: 105044 - RNA, 19 nt, Homo sapiens
aggugaacauuacagaauu

SEQ ID NO: 105045 - RNA, 19 nt, Homo sapiens
cacaaacacgcaaacaaug

SEQ ID NO: 105046 - RNA, 19 nt, Homo sapiens
cggacugccugcacaaaca

SEQ ID NO: 105047 - RNA, 19 nt, Homo sapiens
cagcguggcacccagaaga

SEQ ID NO: 105048 - RNA, 19 nt, Homo sapiens
uuaggguacuucccacaga

SEQ ID NO: 105049 - RNA, 19 nt, Homo sapiens
aaggugacauggcauccaa

SEQ ID NO: 105050 - RNA, 19 nt, Homo sapiens
gcaaagauagccgcaacgu

SEQ ID NO: 105051 - RNA, 19 nt, Homo sapiens
ucauugacuuccacguguu

SEQ ID NO: 105052 - RNA, 19 nt, Homo sapiens
gguacuucccacagaaauu

SEQ ID NO: 105053 - RNA, 19 nt, Homo sapiens
acuuuaccaugcucaauga

SEQ ID NO: 105054 - RNA, 19 nt, Homo sapiens
gcguacauguauauucucu

SEQ ID NO: 105055 - RNA, 19 nt, Homo sapiens
ccagcguacugcuucuguu

SEQ ID NO: 105056 - RNA, 19 nt, Homo sapiens
agaacuucauggacauaga

SEQ ID NO: 105057 - RNA, 19 nt, Homo sapiens
ucaaagacugagguuauga

SEQ ID NO: 105058 - RNA, 19 nt, Homo sapiens
ucaagagcacggucaagau

SEQ ID NO: 105059 - RNA, 19 nt, Homo sapiens
gucacuuucucagucauuu

SEQ ID NO: 105060 - RNA, 19 nt, Homo sapiens
cgagaaacugcaaucuguu

SEQ ID NO: 105061 - RNA, 19 nt, Homo sapiens
agacaucaaaggugacaug

SEQ ID NO: 105062 - RNA, 19 nt, Homo sapiens
gucuacagcuucauugacu

SEQ ID NO: 105063 - RNA, 19 nt, Homo sapiens
gucaagauugccaagguaa

SEQ ID NO: 105064 - RNA, 19 nt, Homo sapiens
gcauggacauuagguuagc

SEQ ID NO: 105065 - RNA, 19 nt, Homo sapiens
ugccugauguggaccauag

SEQ ID NO: 105066 - RNA, 19 nt, Homo sapiens
gacagguacauauccauuc

SEQ ID NO: 105067 - RNA, 19 nt, Homo sapiens
gccgcaacguguuucuguu

SEQ ID NO: 105068 - RNA, 19 nt, Homo sapiens
caaggagaaugaggagaac

SEQ ID NO: 105069 - RNA, 19 nt, Homo sapiens
cacagaaauucccuuuaac

SEQ ID NO: 105070 - RNA, 19 nt, Homo sapiens
uauugucuccuugguuaua

SEQ ID NO: 105071 - RNA, 19 nt, Homo sapiens
caaacacgcaaacaaugca

SEQ ID NO: 105072 - RNA, 19 nt, Homo sapiens
uaaucaaagacugagguua

SEQ ID NO: 105073 - RNA, 19 nt, Homo sapiens
agaagagcaucaucaucca

SEQ ID NO: 105074 - RNA, 19 nt, Homo sapiens
ccacgccguccgcaugauu

SEQ ID NO: 105075 - RNA, 19 nt, Homo sapiens
ggucacggccuccuucacu

SEQ ID NO: 105076 - RNA, 19 nt, Homo sapiens
uugcuuaguuuccguuugg

SEQ ID NO: 105077 - RNA, 19 nt, Homo sapiens
gaagaaagccuguuguuua

SEQ ID NO: 105078 - RNA, 19 nt, Homo sapiens
gagauuggaucaaguauua

SEQ ID NO: 105079 - RNA, 19 nt, Homo sapiens
guacagagcuggcaucuau

SEQ ID NO: 105080 - RNA, 19 nt, Homo sapiens
ggauguggcuuaugagaua

SEQ ID NO: 105081 - RNA, 19 nt, Homo sapiens
ccacagaaauucccuuuaa

SEQ ID NO: 105082 - RNA, 19 nt, Homo sapiens
gaucagaguucccaagaaa

SEQ ID NO: 105083 - RNA, 19 nt, Homo sapiens
ggaaugauauugcugaaga

SEQ ID NO: 105084 - RNA, 19 nt, Homo sapiens
ggauguauuuguaguguua

SEQ ID NO: 105085 - RNA, 19 nt, Homo sapiens
ugacauggcauccaaauua

SEQ ID NO: 105086 - RNA, 19 nt, Homo sapiens
gacuauagcuguucuaaug

SEQ ID NO: 105087 - RNA, 19 nt, Homo sapiens
aaacacagcugcuuucuuc

SEQ ID NO: 105088 - RNA, 19 nt, Homo sapiens
aaaguuaccuggaaucaaa

SEQ ID NO: 105089 - RNA, 19 nt, Homo sapiens
gcacuggccuucugaugaa

SEQ ID NO: 105090 - RNA, 19 nt, Homo sapiens
gaaauaucaucacguaugu

SEQ ID NO: 105091 - RNA, 19 nt, Homo sapiens
gaagagagaaagcauauug

SEQ ID NO: 105092 - RNA, 19 nt, Homo sapiens
gcacauggauucaguuucu

SEQ ID NO: 105093 - RNA, 19 nt, Homo sapiens
caggagagauuauuuacaa

SEQ ID NO: 105094 - RNA, 19 nt, Homo sapiens
ccuguaaucuuguugauaa

SEQ ID NO: 105095 - RNA, 19 nt, Homo sapiens
aagaaagccuguuguuuaa

SEQ ID NO: 105096 - RNA, 19 nt, Homo sapiens
gcuaauguuuccauaguuu

SEQ ID NO: 105097 - RNA, 19 nt, Homo sapiens
ggacauagaguguuucaug

SEQ ID NO: 105098 - RNA, 19 nt, Homo sapiens
gcaauaucuucguuaguaa

SEQ ID NO: 105099 - RNA, 19 nt, Homo sapiens
cuaguuagauucacuuuga

SEQ ID NO: 105100 - RNA, 19 nt, Homo sapiens
gaugaaaccuaccugaugu

SEQ ID NO: 105101 - RNA, 19 nt, Homo sapiens
gaaagccuguuguuuaagu

SEQ ID NO: 105102 - RNA, 19 nt, Homo sapiens
gcgagaaacugcaaucugu

SEQ ID NO: 105103 - RNA, 19 nt, Homo sapiens
gaugaaauguuaacaaugc

SEQ ID NO: 105104 - RNA, 19 nt, Homo sapiens
cgacaucucugacuuucuu

SEQ ID NO: 105105 - RNA, 19 nt, Homo sapiens
guauuaagcccacaguaua

SEQ ID NO: 105106 - RNA, 19 nt, Homo sapiens
gaaacaugacucuuuauug

SEQ ID NO: 105107 - RNA, 19 nt, Homo sapiens
gaagaacucaccaggguuu

SEQ ID NO: 105108 - RNA, 19 nt, Homo sapiens
gaacgauccuucaaagucu

SEQ ID NO: 105109 - RNA, 19 nt, Homo sapiens
gcacaaacacgcaaacaau

SEQ ID NO: 105110 - RNA, 19 nt, Homo sapiens
cgggaaacaugacucuuua

SEQ ID NO: 105111 - RNA, 19 nt, Homo sapiens
caucagagguaucuuacuu

SEQ ID NO: 105112 - RNA, 19 nt, Homo sapiens
caucacacauguucagaaa

SEQ ID NO: 105113 - RNA, 19 nt, Homo sapiens
ggguuuaguuugcauuuaa

SEQ ID NO: 105114 - RNA, 19 nt, Homo sapiens
cacauuaucuucuggacua

SEQ ID NO: 105115 - RNA, 19 nt, Homo sapiens
gcaucuaucuggugauuuc

SEQ ID NO: 105116 - RNA, 19 nt, Homo sapiens
ucuauugucuccuugguua

SEQ ID NO: 105117 - RNA, 19 nt, Homo sapiens
ggaaacaugacucuuuauu

SEQ ID NO: 105118 - RNA, 19 nt, Homo sapiens
ugcaucaucuugaacauua

SEQ ID NO: 105119 - RNA, 19 nt, Homo sapiens
ucacagccaucgacaggua

SEQ ID NO: 105120 - RNA, 19 nt, Homo sapiens
ggcaggauguggcuuauga

SEQ ID NO: 105121 - RNA, 19 nt, Homo sapiens
ggcaauggcuauuaacaau

SEQ ID NO: 105122 - RNA, 19 nt, Homo sapiens
augaagagcuagagaaauu

SEQ ID NO: 105123 - RNA, 19 nt, Homo sapiens
ucagggugcuagaggauua

SEQ ID NO: 105124 - RNA, 19 nt, Homo sapiens
ggucaagauugccaaggua

SEQ ID NO: 105125 - RNA, 19 nt, Homo sapiens
ugcaauaucuucguuagua

SEQ ID NO: 105126 - RNA, 19 nt, Homo sapiens
aggaaccucugauuuauuu

SEQ ID NO: 105127 - RNA, 19 nt, Homo sapiens
ggugaacauuacagaauuu

SEQ ID NO: 105128 - RNA, 19 nt, Homo sapiens
cacagcugcuuucuucuua

SEQ ID NO: 105129 - RNA, 19 nt, Homo sapiens
ccaaggaagggauguauuu

SEQ ID NO: 105130 - RNA, 19 nt, Homo sapiens
aaccacaacuuucacuaua

SEQ ID NO: 105131 - RNA, 19 nt, Homo sapiens
uaaacuuggugcuuauuga

SEQ ID NO: 105132 - RNA, 19 nt, Homo sapiens
gcucgugguuagcaagaua

SEQ ID NO: 105133 - RNA, 19 nt, Homo sapiens
gaagggauguauuuguagu

SEQ ID NO: 105134 - RNA, 19 nt, Homo sapiens
gacauuagguuagccaaga

SEQ ID NO: 105135 - RNA, 19 nt, Homo sapiens
gauuugggcugaauguaug

SEQ ID NO: 105136 - RNA, 19 nt, Homo sapiens
uuacuguccuguugauuaa

SEQ ID NO: 105137 - RNA, 19 nt, Homo sapiens
ugacaucagagguaucuua

SEQ ID NO: 105138 - RNA, 19 nt, Homo sapiens
caaacaacagucuucauuu

SEQ ID NO: 105139 - RNA, 19 nt, Homo sapiens
ccaaacaacagucuucauu

SEQ ID NO: 105140 - RNA, 19 nt, Homo sapiens
ccacaacuuucacuauaau

SEQ ID NO: 105141 - RNA, 19 nt, Homo sapiens
ucacuuaucaguuugcuaa

SEQ ID NO: 105142 - RNA, 19 nt, Homo sapiens
gcugggcaauggcuauuaa

SEQ ID NO: 105143 - RNA, 19 nt, Homo sapiens
aagauacacucaagcauga

SEQ ID NO: 105144 - RNA, 19 nt, Homo sapiens
ucaauagcguguguagaua

SEQ ID NO: 105145 - RNA, 19 nt, Homo sapiens
aggaagggauguauuugua

SEQ ID NO: 105146 - RNA, 19 nt, Homo sapiens
aaacugugaccaaguauaa

SEQ ID NO: 105147 - RNA, 19 nt, Homo sapiens
ugaacaagcucauuaagac

SEQ ID NO: 105148 - RNA, 19 nt, Homo sapiens
gcagaccaggugaacauua

SEQ ID NO: 105149 - RNA, 19 nt, Homo sapiens
uaagagauuggaucaagua

SEQ ID NO: 105150 - RNA, 19 nt, Homo sapiens
gcuauuacuggaucucuua

SEQ ID NO: 105151 - RNA, 19 nt, Homo sapiens
uaucagagauguccauuuu

SEQ ID NO: 105152 - RNA, 19 nt, Homo sapiens
gaaauaggagggaaaccuu

SEQ ID NO: 105153 - RNA, 19 nt, Homo sapiens
caugguguaugaugucuuu

SEQ ID NO: 105154 - RNA, 19 nt, Homo sapiens
gggagaguuucuuuacauu

SEQ ID NO: 105155 - RNA, 19 nt, Homo sapiens
cauaucaugcacacaauua

SEQ ID NO: 105156 - RNA, 19 nt, Homo sapiens
gaaugauauugcugaagaa

SEQ ID NO: 105157 - RNA, 19 nt, Homo sapiens
gcauugacgucuagcuaug

SEQ ID NO: 105158 - RNA, 19 nt, Homo sapiens
aaauugaguucuuccugua

SEQ ID NO: 105159 - RNA, 19 nt, Homo sapiens
caucaugucuauuguccaa

SEQ ID NO: 105160 - RNA, 19 nt, Homo sapiens
agacaggagagauuauuua

SEQ ID NO: 105161 - RNA, 19 nt, Homo sapiens
guuccuauauuccagguuu

SEQ ID NO: 105162 - RNA, 19 nt, Homo sapiens
ccacugaccuccuguacgu

SEQ ID NO: 105163 - RNA, 19 nt, Homo sapiens
guuacuguccuguugauua

SEQ ID NO: 105164 - RNA, 19 nt, Homo sapiens
ggagagauuauuuacaaga

SEQ ID NO: 105165 - RNA, 19 nt, Homo sapiens
acuuaacccugacaaauuu

SEQ ID NO: 105166 - RNA, 19 nt, Homo sapiens
acaguaaugucauaaagug

SEQ ID NO: 105167 - RNA, 19 nt, Homo sapiens
caagagcacggucaagauu

SEQ ID NO: 105168 - RNA, 19 nt, Homo sapiens
caacguguuucuguucaaa

SEQ ID NO: 105169 - RNA, 19 nt, Homo sapiens
uaagacagcauguguuaau

SEQ ID NO: 105170 - RNA, 19 nt, Homo sapiens
uuaagacgguguuugcauu

SEQ ID NO: 105171 - RNA, 19 nt, Homo sapiens
ugucuauuguccaaaguua

SEQ ID NO: 105172 - RNA, 19 nt, Homo sapiens
aaagagaccacccauauca

SEQ ID NO: 105173 - RNA, 19 nt, Homo sapiens
aaucaguccuagaauguuu

SEQ ID NO: 105174 - RNA, 19 nt, Homo sapiens
gauccuagauggccuugca

SEQ ID NO: 105175 - RNA, 19 nt, Homo sapiens
ugaaauaucaucacguaug

SEQ ID NO: 105176 - RNA, 19 nt, Homo sapiens
gagcucagccuaaucaaag

SEQ ID NO: 105177 - RNA, 19 nt, Homo sapiens
ggacauagaguguuucaug

SEQ ID NO: 105178 - RNA, 19 nt, Homo sapiens
gaugaaaccuaccugaugu

SEQ ID NO: 105179 - RNA, 19 nt, Homo sapiens
gcgagaaacugcaaucugu

SEQ ID NO: 105180 - RNA, 19 nt, Homo sapiens
gcacaaacacgcaaacaau

SEQ ID NO: 105181 - RNA, 19 nt, Homo sapiens
ucacagccaucgacaggua

SEQ ID NO: 105182 - RNA, 19 nt, Homo sapiens
ggucaagauugccaaggua

SEQ ID NO: 105183 - RNA, 19 nt, Homo sapiens
gacauuagguuagccaaga

SEQ ID NO: 105184 - RNA, 19 nt, Homo sapiens
caaaggagaaugaggagaa

SEQ ID NO: 105185 - RNA, 19 nt, Homo sapiens
ugaacaagcucauuaagac

SEQ ID NO: 105186 - RNA, 19 nt, Homo sapiens
caugguguaugaugucuuu

SEQ ID NO: 105187 - RNA, 19 nt, Homo sapiens
caagagcacggucaagauu

SEQ ID NO: 105188 - RNA, 19 nt, Homo sapiens
caacguguuucuguucaaa

SEQ ID NO: 105189 - RNA, 19 nt, Homo sapiens
guacgaagacaucaaagga

SEQ ID NO: 105190 - RNA, 19 nt, Homo sapiens
ccacugaccuccuguacgu

SEQ ID NO: 105191 - RNA, 19 nt, Homo sapiens
uuaagacgguguuugcauu

SEQ ID NO: 105192 - RNA, 19 nt, Homo sapiens
gaccauagccauugugauc

SEQ ID NO: 105193 - RNA, 19 nt, Homo sapiens
gauccuagauggccuugca

SEQ ID NO: 105194 - RNA, 19 nt, Homo sapiens
aaaccuaccugauguucug

SEQ ID NO: 105195 - RNA, 19 nt, Homo sapiens
gagcauguuucccucuugu

SEQ ID NO: 105196 - RNA, 19 nt, Homo sapiens
ucauggacauagaguguuu

SEQ ID NO: 105197 - RNA, 19 nt, Homo sapiens
cuagauggccuugcagaua

SEQ ID NO: 105198 - RNA, 19 nt, Homo sapiens
ggagcauguuucccucuug

SEQ ID NO: 105199 - RNA, 19 nt, Homo sapiens
ucuaugcucugaggaguaa

SEQ ID NO: 105200 - RNA, 19 nt, Homo sapiens
acauguauauucucuggaa

SEQ ID NO: 105201 - RNA, 19 nt, Homo sapiens
gaacugcgagaaacugcaa

SEQ ID NO: 105202 - RNA, 19 nt, Homo sapiens
gcaacguguuucuguucaa

SEQ ID NO: 105203 - RNA, 19 nt, Homo sapiens
ccgcauggacauuagguua

SEQ ID NO: 105204 - RNA, 19 nt, Homo sapiens
agacaucaaaggagaauga

SEQ ID NO: 105205 - RNA, 19 nt, Homo sapiens
gcauguuucccucuuguga

SEQ ID NO: 105206 - RNA, 19 nt, Homo sapiens
uagauggccuugcagauac

SEQ ID NO: 105207 - RNA, 19 nt, Homo sapiens
gaagacaucaaaggagaau

SEQ ID NO: 105208 - RNA, 19 nt, Homo sapiens
acagguacauauccauuca

SEQ ID NO: 105209 - RNA, 19 nt, Homo sapiens
ggagaacuucauggacaua

SEQ ID NO: 105210 - RNA, 19 nt, Homo sapiens
cgacagguacauauccauu

SEQ ID NO: 105211 - RNA, 19 nt, Homo sapiens
gggagaacuucauggacau

SEQ ID NO: 105212 - RNA, 19 nt, Homo sapiens
cugcgcagccucuggauaa

SEQ ID NO: 105213 - RNA, 19 nt, Homo sapiens
ugaugaaaccuaccugaug

SEQ ID NO: 105214 - RNA, 19 nt, Homo sapiens
gaacuucauggacauagag

SEQ ID NO: 105215 - RNA, 19 nt, Homo sapiens
ucaguacgaagacaucaaa

SEQ ID NO: 105216 - RNA, 19 nt, Homo sapiens
caagcccgcauggacauua

SEQ ID NO: 105217 - RNA, 19 nt, Homo sapiens
gggcuggaacugcgagaaa

SEQ ID NO: 105218 - RNA, 19 nt, Homo sapiens
gauguggaccauagccauu

SEQ ID NO: 105219 - RNA, 19 nt, Homo sapiens
uacgugggcucaaaugaca

SEQ ID NO: 105220 - RNA, 19 nt, Homo sapiens
caaacaaugcagccagugu

SEQ ID NO: 105221 - RNA, 19 nt, Homo sapiens
cacaaacacgcaaacaaug

SEQ ID NO: 105222 - RNA, 19 nt, Homo sapiens
cggacugccugcacaaaca

SEQ ID NO: 105223 - RNA, 19 nt, Homo sapiens
cagcguggcacccagaaga

SEQ ID NO: 105224 - RNA, 19 nt, Homo sapiens
gcaaagauagccgcaacgu

SEQ ID NO: 105225 - RNA, 19 nt, Homo sapiens
ucauugacuuccacguguu

SEQ ID NO: 105226 - RNA, 19 nt, Homo sapiens
gcguacauguauauucucu

SEQ ID NO: 105227 - RNA, 19 nt, Homo sapiens
ccagcguacugcuucuguu

SEQ ID NO: 105228 - RNA, 19 nt, Homo sapiens
agaacuucauggacauaga

SEQ ID NO: 105229 - RNA, 19 nt, Homo sapiens
ucaagagcacggucaagau

SEQ ID NO: 105230 - RNA, 19 nt, Homo sapiens
cgagaaacugcaaucuguu

SEQ ID NO: 105231 - RNA, 19 nt, Homo sapiens
gucuacagcuucauugacu

SEQ ID NO: 105232 - RNA, 19 nt, Homo sapiens
gucaagauugccaagguaa

SEQ ID NO: 105233 - RNA, 19 nt, Homo sapiens
gcauggacauuagguuagc

SEQ ID NO: 105234 - RNA, 19 nt, Homo sapiens
ugccugauguggaccauag

SEQ ID NO: 105235 - RNA, 19 nt, Homo sapiens
gacagguacauauccauuc

SEQ ID NO: 105236 - RNA, 19 nt, Homo sapiens
gccgcaacguguuucuguu

SEQ ID NO: 105237 - RNA, 19 nt, Homo sapiens
caaacacgcaaacaaugca

SEQ ID NO: 105238 - RNA, 19 nt, Homo sapiens
agaagagcaucaucaucca

SEQ ID NO: 105239 - RNA, 19 nt, Homo sapiens
ccacgccguccgcaugauu

SEQ ID NO: 105240 - RNA, 19 nt, Homo sapiens
ggucacggccuccuucacu

SEQ ID NO: 105241 - RNA, 19 nt, Homo sapiens
cccaucaucuaugcucuga

SEQ ID NO: 105242 - RNA, 19 nt, Homo sapiens
uaagacgguguuugcauuc

SEQ ID NO: 105243 - RNA, 19 nt, Homo sapiens
guacgugggcucaaaugac

SEQ ID NO: 105244 - RNA, 19 nt, Homo sapiens
gcguacugcuucuguucau

SEQ ID NO: 105245 - RNA, 19 nt, Homo sapiens
gaaaccuaccugauguucu

SEQ ID NO: 105246 - RNA, 19 nt, Homo sapiens
guguuccaccgcaaagaua

SEQ ID NO: 105247 - RNA, 19 nt, Homo sapiens
ccacguguuccaccgcaaa

SEQ ID NO: 105248 - RNA, 19 nt, Homo sapiens
ccaagguaaccaugucugu

SEQ ID NO: 105249 - RNA, 19 nt, Homo sapiens
gacauucaguacgaagaca

SEQ ID NO: 105250 - RNA, 19 nt, Homo sapiens
cgaagacaucaaaggagaa

SEQ ID NO: 105251 - RNA, 19 nt, Homo sapiens
cggagcauguuucccucuu

SEQ ID NO: 105252 - RNA, 19 nt, Homo sapiens
gcccucugcuugcaaucau

SEQ ID NO: 105253 - RNA, 19 nt, Homo sapiens
ccagaagagcaucaucauc

SEQ ID NO: 105254 - RNA, 19 nt, Homo sapiens
augcguacauguauauucu

SEQ ID NO: 105255 - RNA, 19 nt, Homo sapiens
ggagaaugaggagaacauc

SEQ ID NO: 105256 - RNA, 19 nt, Homo sapiens
gaacguggcugugcucuau

SEQ ID NO: 105257 - RNA, 19 nt, Homo sapiens
ggauuaagguguugacuug

SEQ ID NO: 105258 - RNA, 19 nt, Homo sapiens
ggagaaaucugagaagaau

SEQ ID NO: 105259 - RNA, 19 nt, Homo sapiens
ggucaacccugucaucuau

SEQ ID NO: 105260 - RNA, 19 nt, Homo sapiens
ggcacucucuucuuacuua

SEQ ID NO: 105261 - RNA, 19 nt, Homo sapiens
gguguugacuugccucuuu

SEQ ID NO: 105262 - RNA, 19 nt, Homo sapiens
gacagaggcugaugggaaa

SEQ ID NO: 105263 - RNA, 19 nt, Homo sapiens
ggaaucaucuacaccuaug

SEQ ID NO: 105264 - RNA, 19 nt, Homo sapiens
gcaugcagcuuugugaauu

SEQ ID NO: 105265 - RNA, 19 nt, Homo sapiens
uuaaacaacucaagucaga

SEQ ID NO: 105266 - RNA, 19 nt, Homo sapiens
guucaucgccuuccucuuu

SEQ ID NO: 105267 - RNA, 19 nt, Homo sapiens
ccaacccuaugaaggauua

SEQ ID NO: 105268 - RNA, 19 nt, Homo sapiens
ugacagagauagccaaugg

SEQ ID NO: 105269 - RNA, 19 nt, Homo sapiens
gaucuagaccucucugauu

SEQ ID NO: 105270 - RNA, 19 nt, Homo sapiens
caacucaagucagaaauca

SEQ ID NO: 105271 - RNA, 19 nt, Homo sapiens
ugaggccucuucccaauuu

SEQ ID NO: 105272 - RNA, 19 nt, Homo sapiens
ggacuugggagaaaucuga

SEQ ID NO: 105273 - RNA, 19 nt, Homo sapiens
gaugaggccucuucccaau

SEQ ID NO: 105274 - RNA, 19 nt, Homo sapiens
ucaagaaggccuuugcuuu

SEQ ID NO: 105275 - RNA, 19 nt, Homo sapiens
caagaaggccuuugcuuuc

SEQ ID NO: 105276 - RNA, 19 nt, Homo sapiens
ccucauaccuguucauugg

SEQ ID NO: 105277 - RNA, 19 nt, Homo sapiens
gaugugagguuggccaaga

SEQ ID NO: 105278 - RNA, 19 nt, Homo sapiens
gaagucaggguaucagaug

SEQ ID NO: 105279 - RNA, 19 nt, Homo sapiens
gcacucucuucuuacuuaa

SEQ ID NO: 105280 - RNA, 19 nt, Homo sapiens
ucuuggcacucucuucuua

SEQ ID NO: 105281 - RNA, 19 nt, Homo sapiens
uaugaaggauuacaugauc

SEQ ID NO: 105282 - RNA, 19 nt, Homo sapiens
gggacugacuccuggaaga

SEQ ID NO: 105283 - RNA, 19 nt, Homo sapiens
cgaggacuaugcuaugaug

SEQ ID NO: 105284 - RNA, 19 nt, Homo sapiens
aaacaacucaagucagaaa

SEQ ID NO: 105285 - RNA, 19 nt, Homo sapiens
cgaaugaggcuggauguga

SEQ ID NO: 105286 - RNA, 19 nt, Homo sapiens
ugaccgccauugaccgaua

SEQ ID NO: 105287 - RNA, 19 nt, Homo sapiens
ggaccgaggacuaugcuau

SEQ ID NO: 105288 - RNA, 19 nt, Homo sapiens
ccaaagccuucuagacaag

SEQ ID NO: 105289 - RNA, 19 nt, Homo sapiens
gggagaaaucugagaagaa

SEQ ID NO: 105290 - RNA, 19 nt, Homo sapiens
ggaaggcccaucagcaugu

SEQ ID NO: 105291 - RNA, 19 nt, Homo sapiens
ucucagcacuagucuccua

SEQ ID NO: 105292 - RNA, 19 nt, Homo sapiens
caugcagcuuugugaauuu

SEQ ID NO: 105293 - RNA, 19 nt, Homo sapiens
cccaaagccuucuagacaa

SEQ ID NO: 105294 - RNA, 19 nt, Homo sapiens
ggucuuugcaugcagcuuu

SEQ ID NO: 105295 - RNA, 19 nt, Homo sapiens
uaagugcccuggagaacgu

SEQ ID NO: 105296 - RNA, 19 nt, Homo sapiens
ugaugaggauuaagguguu

SEQ ID NO: 105297 - RNA, 19 nt, Homo sapiens
ggucuucucucugccuaau

SEQ ID NO: 105298 - RNA, 19 nt, Homo sapiens
ccaggaauggcccgaauga

SEQ ID NO: 105299 - RNA, 19 nt, Homo sapiens
gaugaggauuaagguguug

SEQ ID NO: 105300 - RNA, 19 nt, Homo sapiens
ugagaagaauggguuguuc

SEQ ID NO: 105301 - RNA, 19 nt, Homo sapiens
gguagggccacgaggagua

SEQ ID NO: 105302 - RNA, 19 nt, Homo sapiens
uagacaagcucaguggaau

SEQ ID NO: 105303 - RNA, 19 nt, Homo sapiens
cuauccaccuuccuacaaa

SEQ ID NO: 105304 - RNA, 19 nt, Homo sapiens
ggacauccaggucuucucu

SEQ ID NO: 105305 - RNA, 19 nt, Homo sapiens
ggacagggucaguacaagu

SEQ ID NO: 105306 - RNA, 19 nt, Homo sapiens
uaugcuaugaugaggauua

SEQ ID NO: 105307 - RNA, 19 nt, Homo sapiens
gaggccucuucccaauuua

SEQ ID NO: 105308 - RNA, 19 nt, Homo sapiens
gcuauccaccuuccuacaa

SEQ ID NO: 105309 - RNA, 19 nt, Homo sapiens
ggaagucaggguaucagau

SEQ ID NO: 105310 - RNA, 19 nt, Homo sapiens
gaaggcccaucagcaugug

SEQ ID NO: 105311 - RNA, 19 nt, Homo sapiens
ccucucugauugcugauga

SEQ ID NO: 105312 - RNA, 19 nt, Homo sapiens
gaccgaggacuaugcuaug

SEQ ID NO: 105313 - RNA, 19 nt, Homo sapiens
ugggagaaaucugagaaga

SEQ ID NO: 105314 - RNA, 19 nt, Homo sapiens
cacgaggaguagccaggua

SEQ ID NO: 105315 - RNA, 19 nt, Homo sapiens
gaagcccucauaccuguuc

SEQ ID NO: 105316 - RNA, 19 nt, Homo sapiens
gauccuguccucccaccaa

SEQ ID NO: 105317 - RNA, 19 nt, Homo sapiens
ucuucucucugccuaauug

SEQ ID NO: 105318 - RNA, 19 nt, Homo sapiens
ccggaaucaucuacaccua

SEQ ID NO: 105319 - RNA, 19 nt, Homo sapiens
gcuguguugugcacucuuc

SEQ ID NO: 105320 - RNA, 19 nt, Homo sapiens
gagaccaccaggagccaaa

SEQ ID NO: 105321 - RNA, 19 nt, Homo sapiens
gcuaugaugaggauuaagg

SEQ ID NO: 105322 - RNA, 19 nt, Homo sapiens
cuacaccuaugggcauguu

SEQ ID NO: 105323 - RNA, 19 nt, Homo sapiens
gcucugcucacccguggaa

SEQ ID NO: 105324 - RNA, 19 nt, Homo sapiens
cuagacaagcucaguggaa

SEQ ID NO: 105325 - RNA, 19 nt, Homo sapiens
gcugugcuccucaucuguu

SEQ ID NO: 105326 - RNA, 19 nt, Homo sapiens
agaaaucugagaagaaugg

SEQ ID NO: 105327 - RNA, 19 nt, Homo sapiens
gcauguggccagcuugucu

SEQ ID NO: 105328 - RNA, 19 nt, Homo sapiens
ggaggaaugcugggugaca

SEQ ID NO: 105329 - RNA, 19 nt, Homo sapiens
acccaaagccuucuagaca

SEQ ID NO: 105330 - RNA, 19 nt, Homo sapiens
ccuaugaaggauuacauga

SEQ ID NO: 105331 - RNA, 19 nt, Homo sapiens
cagguaggcgagacacaaa

SEQ ID NO: 105332 - RNA, 19 nt, Homo sapiens
ugaugaguguugggacuga

SEQ ID NO: 105333 - RNA, 19 nt, Homo sapiens
caagucagaaaucaguuca

SEQ ID NO: 105334 - RNA, 19 nt, Homo sapiens
aucuagaccucucugauug

SEQ ID NO: 105335 - RNA, 19 nt, Homo sapiens
gaagauuggcagcgugacu

SEQ ID NO: 105336 - RNA, 19 nt, Homo sapiens
guuguucucuugggaaguc

SEQ ID NO: 105337 - RNA, 19 nt, Homo sapiens
ugagggacuugggagaaau

SEQ ID NO: 105338 - RNA, 19 nt, Homo sapiens
gcccagcaaugagggacuu

SEQ ID NO: 105339 - RNA, 19 nt, Homo sapiens
gacagggucaguacaaguc

SEQ ID NO: 105340 - RNA, 19 nt, Homo sapiens
ggucuuggcacucucuucu

SEQ ID NO: 105341 - RNA, 19 nt, Homo sapiens
caucauguggguccucuca

SEQ ID NO: 105342 - RNA, 19 nt, Homo sapiens
gaauuuccauguuuuccau

SEQ ID NO: 105343 - RNA, 19 nt, Homo sapiens
uggcugugcucuaucugau

SEQ ID NO: 105344 - RNA, 19 nt, Homo sapiens
gggacagggucaguacaag

SEQ ID NO: 105345 - RNA, 19 nt, Homo sapiens
ccagguaggcgagacacaa

SEQ ID NO: 105346 - RNA, 19 nt, Homo sapiens
gacaagcucaguggaaucu

SEQ ID NO: 105347 - RNA, 19 nt, Homo sapiens
ggccucuucccaauuuaaa

SEQ ID NO: 105348 - RNA, 19 nt, Homo sapiens
ggucagaggcaaaagaaga

SEQ ID NO: 105349 - RNA, 19 nt, Homo sapiens
gcagcuuugugaauuucca

SEQ ID NO: 105350 - RNA, 19 nt, Homo sapiens
cuucugggccugcuaagug

SEQ ID NO: 105351 - RNA, 19 nt, Homo sapiens
gauaaaugacaagccuuca

SEQ ID NO: 105352 - RNA, 19 nt, Homo sapiens
acuaugcuaugaugaggau

SEQ ID NO: 105353 - RNA, 19 nt, Homo sapiens
aagucacccuugccacuga

SEQ ID NO: 105354 - RNA, 19 nt, Homo sapiens
caacccaaagccuucuaga

SEQ ID NO: 105355 - RNA, 19 nt, Homo sapiens
gcagcgugacuaugaccuu

SEQ ID NO: 105356 - RNA, 19 nt, Homo sapiens
ccaagggucuuuauguaua

SEQ ID NO: 105357 - RNA, 19 nt, Homo sapiens
uaucguaccuuccauguuu

SEQ ID NO: 105358 - RNA, 19 nt, Homo sapiens
aagagaaccuucaagcuua

SEQ ID NO: 105359 - RNA, 19 nt, Homo sapiens
gacaaugaguggaauacua

SEQ ID NO: 105360 - RNA, 19 nt, Homo sapiens
caaaugggcauacaaguuu

SEQ ID NO: 105361 - RNA, 19 nt, Homo sapiens
gaagaugcauccauguaau

SEQ ID NO: 105362 - RNA, 19 nt, Homo sapiens
agaagucaguugcaaauuu

SEQ ID NO: 105363 - RNA, 19 nt, Homo sapiens
gauagaggaguuaaugaua

SEQ ID NO: 105364 - RNA, 19 nt, Homo sapiens
ggaagaugcauccauguaa

SEQ ID NO: 105365 - RNA, 19 nt, Homo sapiens
ucacacagcuaacaaguag

SEQ ID NO: 105366 - RNA, 19 nt, Homo sapiens
gcuguuagauguccucaga

SEQ ID NO: 105367 - RNA, 19 nt, Homo sapiens
gcacgugggagccauuaua

SEQ ID NO: 105368 - RNA, 19 nt, Homo sapiens
ugacuuccaucaagcuaua

SEQ ID NO: 105369 - RNA, 19 nt, Homo sapiens
caaggaagauucguucaga

SEQ ID NO: 105370 - RNA, 19 nt, Homo sapiens
guacagcguuuacaaccuu

SEQ ID NO: 105371 - RNA, 19 nt, Homo sapiens
gcugaugggaugccuauua

SEQ ID NO: 105372 - RNA, 19 nt, Homo sapiens
uaaugauacuccuggaaua

SEQ ID NO: 105373 - RNA, 19 nt, Homo sapiens
gaagucaguugcaaauuuu

SEQ ID NO: 105374 - RNA, 19 nt, Homo sapiens
gccauuauauugcuaacaa

SEQ ID NO: 105375 - RNA, 19 nt, Homo sapiens
caagagaaccuucaagcuu

SEQ ID NO: 105376 - RNA, 19 nt, Homo sapiens
cuaugugccuuucacuuua

SEQ ID NO: 105377 - RNA, 19 nt, Homo sapiens
gcauuuaacugccuuacag

SEQ ID NO: 105378 - RNA, 19 nt, Homo sapiens
gagggcagcuggagaucuu

SEQ ID NO: 105379 - RNA, 19 nt, Homo sapiens
ucacagagauuugguuaag

SEQ ID NO: 105380 - RNA, 19 nt, Homo sapiens
ggucugagaagauucaauu

SEQ ID NO: 105381 - RNA, 19 nt, Homo sapiens
gcagagcgacuccaagaga

SEQ ID NO: 105382 - RNA, 19 nt, Homo sapiens
ccaagucgcugccuuugca

SEQ ID NO: 105383 - RNA, 19 nt, Homo sapiens
uuuagaggcuugaucauga

SEQ ID NO: 105384 - RNA, 19 nt, Homo sapiens
gcucacagagauuugguua

SEQ ID NO: 105385 - RNA, 19 nt, Homo sapiens
caagggucuuuauguauau

SEQ ID NO: 105386 - RNA, 19 nt, Homo sapiens
gcuuucccaucuuaaauuu

SEQ ID NO: 105387 - RNA, 19 nt, Homo sapiens
guuagucccuucucucuuc

SEQ ID NO: 105388 - RNA, 19 nt, Homo sapiens
gaugggaugccuauuaaug

SEQ ID NO: 105389 - RNA, 19 nt, Homo sapiens
ugacugcucuuacggaauc

SEQ ID NO: 105390 - RNA, 19 nt, Homo sapiens
cugaugggaugccuauuaa

SEQ ID NO: 105391 - RNA, 19 nt, Homo sapiens
ugccaagggucuuuaugua

SEQ ID NO: 105392 - RNA, 19 nt, Homo sapiens
acagaucauucuccuugua

SEQ ID NO: 105393 - RNA, 19 nt, Homo sapiens
aaaucagacucuuuaguug

SEQ ID NO: 105394 - RNA, 19 nt, Homo sapiens
gaguggaauacuaaaguua

SEQ ID NO: 105395 - RNA, 19 nt, Homo sapiens
acaaugaguggaauacuaa

SEQ ID NO: 105396 - RNA, 19 nt, Homo sapiens
ucucuuauuuggaccagua

SEQ ID NO: 105397 - RNA, 19 nt, Homo sapiens
aaaugggcauacaaguuua

SEQ ID NO: 105398 - RNA, 19 nt, Homo sapiens
gaccuucguuucauuucuu

SEQ ID NO: 105399 - RNA, 19 nt, Homo sapiens
ccgccaaacuucugaacuu

SEQ ID NO: 105400 - RNA, 19 nt, Homo sapiens
acaaguagcacacugaguu

SEQ ID NO: 105401 - RNA, 19 nt, Homo sapiens
gaaaacaggcucacagaga

SEQ ID NO: 105402 - RNA, 19 nt, Homo sapiens
ugaguggaauacuaaaguu

SEQ ID NO: 105403 - RNA, 19 nt, Homo sapiens
caguguaacccaagcauuu

SEQ ID NO: 105404 - RNA, 19 nt, Homo sapiens
uaaccuuucuaacccacua

SEQ ID NO: 105405 - RNA, 19 nt, Homo sapiens
gcauccauguaaucuauuc

SEQ ID NO: 105406 - RNA, 19 nt, Homo sapiens
cagagcgacuccaagagaa

SEQ ID NO: 105407 - RNA, 19 nt, Homo sapiens
cgugggagccauuauauug

SEQ ID NO: 105408 - RNA, 19 nt, Homo sapiens
ccuaugugccuuucacuuu

SEQ ID NO: 105409 - RNA, 19 nt, Homo sapiens
caaguagcacacugaguuu

SEQ ID NO: 105410 - RNA, 19 nt, Homo sapiens
acaaaugggcauacaaguu

SEQ ID NO: 105411 - RNA, 19 nt, Homo sapiens
aaguagcguuggagacaua

SEQ ID NO: 105412 - RNA, 19 nt, Homo sapiens
ccagauagaggaguuaaug

SEQ ID NO: 105413 - RNA, 19 nt, Homo sapiens
aaacuuucaccucagauuu

SEQ ID NO: 105414 - RNA, 19 nt, Homo sapiens
guagcacacugaguuugaa

SEQ ID NO: 105415 - RNA, 19 nt, Homo sapiens
uaacugccuuacagacaga

SEQ ID NO: 105416 - RNA, 19 nt, Homo sapiens
gggccucgcuuucccaucu

SEQ ID NO: 105417 - RNA, 19 nt, Homo sapiens
gaacaucaaccuggacucu

SEQ ID NO: 105418 - RNA, 19 nt, Homo sapiens
cccauuagguagaugagaa

SEQ ID NO: 105419 - RNA, 19 nt, Homo sapiens
ggaccaguauagacagaag

SEQ ID NO: 105420 - RNA, 19 nt, Homo sapiens
ucacugcaccucuuuguca

SEQ ID NO: 105421 - RNA, 19 nt, Homo sapiens
agucacaucucuuauuugg

SEQ ID NO: 105422 - RNA, 19 nt, Homo sapiens
gaaguaaacccagcugacu

SEQ ID NO: 105423 - RNA, 19 nt, Homo sapiens
cgccaaacuucugaacuuu

SEQ ID NO: 105424 - RNA, 19 nt, Homo sapiens
cagacucuuuaguugauuu

SEQ ID NO: 105425 - RNA, 19 nt, Homo sapiens
cagaucauucuccuuguaa

SEQ ID NO: 105426 - RNA, 19 nt, Homo sapiens
gccaagggucuuuauguau

SEQ ID NO: 105427 - RNA, 19 nt, Homo sapiens
gacaacguccuuccacuuc

SEQ ID NO: 105428 - RNA, 19 nt, Homo sapiens
cauaccagauagaggaguu

SEQ ID NO: 105429 - RNA, 19 nt, Homo sapiens
aauccuaugugaagcauca

SEQ ID NO: 105430 - RNA, 19 nt, Homo sapiens
caaacuuucaccucagauu

SEQ ID NO: 105431 - RNA, 19 nt, Homo sapiens
guuaagacaacaggcauuu

SEQ ID NO: 105432 - RNA, 19 nt, Homo sapiens
ugggaugccuauuaauguu

SEQ ID NO: 105433 - RNA, 19 nt, Homo sapiens
ccucagaagucaguugcaa

SEQ ID NO: 105434 - RNA, 19 nt, Homo sapiens
agagaaccuucaagcuuau

SEQ ID NO: 105435 - RNA, 19 nt, Homo sapiens
gucaaacuuucaccucaga

SEQ ID NO: 105436 - RNA, 19 nt, Homo sapiens
uuagaggcuugaucaugaa

SEQ ID NO: 105437 - RNA, 19 nt, Homo sapiens
ggaugacucggucugagaa

SEQ ID NO: 105438 - RNA, 19 nt, Homo sapiens
uuucuaacccacuaaguaa

SEQ ID NO: 105439 - RNA, 19 nt, Homo sapiens
caacaggcauuuucuuucu

SEQ ID NO: 105440 - RNA, 19 nt, Homo sapiens
caguauagacagaaguaaa

SEQ ID NO: 105441 - RNA, 19 nt, Homo sapiens
gaggagggcagcuggagau

SEQ ID NO: 105442 - RNA, 19 nt, Homo sapiens
ucagaagucaguugcaaau

SEQ ID NO: 105443 - RNA, 19 nt, Homo sapiens
augcauccauguaaucuau

SEQ ID NO: 105444 - RNA, 19 nt, Homo sapiens
ugaguuaagggauggcuuu

SEQ ID NO: 105445 - RNA, 19 nt, Homo sapiens
uugaaggacuacagguauu

SEQ ID NO: 105446 - RNA, 19 nt, Homo sapiens
ugauacuccuggaauacaa

SEQ ID NO: 105447 - RNA, 19 nt, Homo sapiens
ggaauccuaugugaagcau

SEQ ID NO: 105448 - RNA, 19 nt, Homo sapiens
caggauuuauuguucauac

SEQ ID NO: 105449 - RNA, 19 nt, Homo sapiens
aaucagacucuuuaguuga

SEQ ID NO: 105450 - RNA, 19 nt, Homo sapiens
uaaccucuacaggcauuua

SEQ ID NO: 105451 - RNA, 19 nt, Homo sapiens
ugaaggacuacagguauuu

SEQ ID NO: 105452 - RNA, 19 nt, Homo sapiens
gcaguguaacccaagcauu

SEQ ID NO: 105453 - RNA, 19 nt, Homo sapiens
gcagcuggagaucuuaaga

SEQ ID NO: 105454 - RNA, 19 nt, Homo sapiens
ggugguguuacucccauua

SEQ ID NO: 105455 - RNA, 19 nt, Homo sapiens
uuggagacauacacaaaug

SEQ ID NO: 105456 - RNA, 19 nt, Homo sapiens
ccacagcuaucaccuuuga

SEQ ID NO: 105457 - RNA, 19 nt, Homo sapiens
guaacuugcuguauuugaa

SEQ ID NO: 105458 - RNA, 19 nt, Homo sapiens
cugcauggcuccaaaauua

SEQ ID NO: 105459 - RNA, 19 nt, Homo sapiens
ggagugggcgguucucauu

SEQ ID NO: 105460 - RNA, 19 nt, Homo sapiens
cccaacaccuucaauguga

SEQ ID NO: 105461 - RNA, 19 nt, Homo sapiens
aaugguaacuugcuguauu

SEQ ID NO: 105462 - RNA, 19 nt, Homo sapiens
ggccugacccugagucuuu

SEQ ID NO: 105463 - RNA, 19 nt, Homo sapiens
cauuaaacgucaccauuuc

SEQ ID NO: 105464 - RNA, 19 nt, Homo sapiens
uacaaggucuccauaagug

SEQ ID NO: 105465 - RNA, 19 nt, Homo sapiens
guacaaggucuccauaagu

SEQ ID NO: 105466 - RNA, 19 nt, Homo sapiens
aagaaccgcugccacauuc

SEQ ID NO: 105467 - RNA, 19 nt, Homo sapiens
caagaaccgcugccacauu

SEQ ID NO: 105468 - RNA, 19 nt, Homo sapiens
aaacgucaccauuucauga

SEQ ID NO: 105469 - RNA, 19 nt, Homo sapiens
ucauuaaacgucaccauuu

SEQ ID NO: 105470 - RNA, 19 nt, Homo sapiens
gaagccugauccuccagaa

SEQ ID NO: 105471 - RNA, 19 nt, Homo sapiens
ugccacagcuaucaccuuu

SEQ ID NO: 105472 - RNA, 19 nt, Homo sapiens
gcuccuaucccacaguauu

SEQ ID NO: 105473 - RNA, 19 nt, Homo sapiens
caaguacaaggucuccaua

SEQ ID NO: 105474 - RNA, 19 nt, Homo sapiens
agugggcgguucucauuaa

SEQ ID NO: 105475 - RNA, 19 nt, Homo sapiens
gagugggcgguucucauua

SEQ ID NO: 105476 - RNA, 19 nt, Homo sapiens
ggacccagcccucaagaac

SEQ ID NO: 105477 - RNA, 19 nt, Homo sapiens
ccaaaauuauggucuguga

SEQ ID NO: 105478 - RNA, 19 nt, Homo sapiens
augguaacuugcuguauuu

SEQ ID NO: 105479 - RNA, 19 nt, Homo sapiens
gaaggacccagcccucaag

SEQ ID NO: 105480 - RNA, 19 nt, Homo sapiens
ggaaggaguacauuaucca

SEQ ID NO: 105481 - RNA, 19 nt, Homo sapiens
ugacguggcggguaaaugg

SEQ ID NO: 105482 - RNA, 19 nt, Homo sapiens
gguaacuugcuguauuuga

SEQ ID NO: 105483 - RNA, 19 nt, Homo sapiens
cagcacacaccaucacaga

SEQ ID NO: 105484 - RNA, 19 nt, Homo sapiens
ccagcagucucuugaucug

SEQ ID NO: 105485 - RNA, 19 nt, Homo sapiens
gggaaggaguacauuaucc

SEQ ID NO: 105486 - RNA, 19 nt, Homo sapiens
ucaaugguaacuugcugua

SEQ ID NO: 105487 - RNA, 19 nt, Homo sapiens
gagccucucacauccgauu

SEQ ID NO: 105488 - RNA, 19 nt, Homo sapiens
uaucaccuuugacgaguuc

SEQ ID NO: 105489 - RNA, 19 nt, Homo sapiens
caccuguucuccaccauca

SEQ ID NO: 105490 - RNA, 19 nt, Homo sapiens
gggcgguucucauuaaacg

SEQ ID NO: 105491 - RNA, 19 nt, Homo sapiens
gugggcgguucucauuaaa

SEQ ID NO: 105492 - RNA, 19 nt, Homo sapiens
gccgggaaggaguacauua

SEQ ID NO: 105493 - RNA, 19 nt, Homo sapiens
ccaccuacauucccaacac

SEQ ID NO: 105494 - RNA, 19 nt, Homo sapiens
cuccauaagugucagcaau

SEQ ID NO: 105495 - RNA, 19 nt, Homo sapiens
cugacucaaugguaacuug

SEQ ID NO: 105496 - RNA, 19 nt, Homo sapiens
ugcauucucuucagacaca

SEQ ID NO: 105497 - RNA, 19 nt, Homo sapiens
ggccugcugugcugugcuu

SEQ ID NO: 105498 - RNA, 19 nt, Homo sapiens
cagcuaacccacccaccaa

SEQ ID NO: 105499 - RNA, 19 nt, Homo sapiens
ccacaaugccacagcuauc

SEQ ID NO: 105500 - RNA, 19 nt, Homo sapiens
aguacaaggucuccauaag

SEQ ID NO: 105501 - RNA, 19 nt, Homo sapiens
aaauuauggucugugagaa

SEQ ID NO: 105502 - RNA, 19 nt, Homo sapiens
caaugugacugugcugcau

SEQ ID NO: 105503 - RNA, 19 nt, Homo sapiens
cugcuccuaucccacagua

SEQ ID NO: 105504 - RNA, 19 nt, Homo sapiens
gaggugggccaugcagcua

SEQ ID NO: 105505 - RNA, 19 nt, Homo sapiens
gcacagcacacaccaucac

SEQ ID NO: 105506 - RNA, 19 nt, Homo sapiens
auuauaagcuccugaugcu

SEQ ID NO: 105507 - RNA, 19 nt, Homo sapiens
cuaccacgaagaucuguga

SEQ ID NO: 105508 - RNA, 19 nt, Homo sapiens
ccaccuaccacgaagaucu

SEQ ID NO: 105509 - RNA, 19 nt, Homo sapiens
ccugggcucugacgugaca

SEQ ID NO: 105510 - RNA, 19 nt, Homo sapiens
ucuccaccaucaaguacaa

SEQ ID NO: 105511 - RNA, 19 nt, Homo sapiens
ccgggaaggaguacauuau

SEQ ID NO: 105512 - RNA, 19 nt, Homo sapiens
uaaacgucaccauuucaug

SEQ ID NO: 105513 - RNA, 19 nt, Homo sapiens
ccucugcccuguuuuguau

SEQ ID NO: 105514 - RNA, 19 nt, Homo sapiens
ccauaagugucagcaaugc

SEQ ID NO: 105515 - RNA, 19 nt, Homo sapiens
cuaacccacccaccaaaga

SEQ ID NO: 105516 - RNA, 19 nt, Homo sapiens
gacgugacacugccaugug

SEQ ID NO: 105517 - RNA, 19 nt, Homo sapiens
uuugacgaguucaccauug

SEQ ID NO: 105518 - RNA, 19 nt, Homo sapiens
ccacagcuaucaccuuuga

SEQ ID NO: 105519 - RNA, 19 nt, Homo sapiens
guaacuugcuguauuugaa

SEQ ID NO: 105520 - RNA, 19 nt, Homo sapiens
cugcauggcuccaaaauua

SEQ ID NO: 105521 - RNA, 19 nt, Homo sapiens
ggagugggcgguucucauu

SEQ ID NO: 105522 - RNA, 19 nt, Homo sapiens
cccaacaccuucaauguga

SEQ ID NO: 105523 - RNA, 19 nt, Homo sapiens
aaugguaacuugcuguauu

SEQ ID NO: 105524 - RNA, 19 nt, Homo sapiens
ggccugacccugagucuuu

SEQ ID NO: 105525 - RNA, 19 nt, Homo sapiens
cauuaaacgucaccauuuc

SEQ ID NO: 105526 - RNA, 19 nt, Homo sapiens
uacaaggucuccauaagug

SEQ ID NO: 105527 - RNA, 19 nt, Homo sapiens
guacaaggucuccauaagu

SEQ ID NO: 105528 - RNA, 19 nt, Homo sapiens
aagaaccgcugccacauuc

SEQ ID NO: 105529 - RNA, 19 nt, Homo sapiens
caagaaccgcugccacauu

SEQ ID NO: 105530 - RNA, 19 nt, Homo sapiens
aaacgucaccauuucauga

SEQ ID NO: 105531 - RNA, 19 nt, Homo sapiens
ucauuaaacgucaccauuu

SEQ ID NO: 105532 - RNA, 19 nt, Homo sapiens
gaagccugauccuccagaa

SEQ ID NO: 105533 - RNA, 19 nt, Homo sapiens
ugccacagcuaucaccuuu

SEQ ID NO: 105534 - RNA, 19 nt, Homo sapiens
uggaaguccugaagaguug

SEQ ID NO: 105535 - RNA, 19 nt, Homo sapiens
gcuccuaucccacaguauu

SEQ ID NO: 105536 - RNA, 19 nt, Homo sapiens
caaguacaaggucuccaua

SEQ ID NO: 105537 - RNA, 19 nt, Homo sapiens
ggccaguggugaagagaug

SEQ ID NO: 105538 - RNA, 19 nt, Homo sapiens
agugggcgguucucauuaa

SEQ ID NO: 105539 - RNA, 19 nt, Homo sapiens
gagugggcgguucucauua

SEQ ID NO: 105540 - RNA, 19 nt, Homo sapiens
ggacccagcccucaagaac

SEQ ID NO: 105541 - RNA, 19 nt, Homo sapiens
ccaaaauuauggucuguga

SEQ ID NO: 105542 - RNA, 19 nt, Homo sapiens
augguaacuugcuguauuu

SEQ ID NO: 105543 - RNA, 19 nt, Homo sapiens
gaaggacccagcccucaag

SEQ ID NO: 105544 - RNA, 19 nt, Homo sapiens
ggaaggaguacauuaucca

SEQ ID NO: 105545 - RNA, 19 nt, Homo sapiens
gguaacuugcuguauuuga

SEQ ID NO: 105546 - RNA, 19 nt, Homo sapiens
cagcacacaccaucacaga

SEQ ID NO: 105547 - RNA, 19 nt, Homo sapiens
ugacguggcggguaaaugg

SEQ ID NO: 105548 - RNA, 19 nt, Homo sapiens
ccagcagucucuugaucug

SEQ ID NO: 105549 - RNA, 19 nt, Homo sapiens
gggaaggaguacauuaucc

SEQ ID NO: 105550 - RNA, 19 nt, Homo sapiens
ggaggaggaggacauugau

SEQ ID NO: 105551 - RNA, 19 nt, Homo sapiens
gcgcgacucuagccuuguc

SEQ ID NO: 105552 - RNA, 19 nt, Homo sapiens
ucaaugguaacuugcugua

SEQ ID NO: 105553 - RNA, 19 nt, Homo sapiens
gagccucucacauccgauu

SEQ ID NO: 105554 - RNA, 19 nt, Homo sapiens
uaucaccuuugacgaguuc

SEQ ID NO: 105555 - RNA, 19 nt, Homo sapiens
ggaggaggaggaggacauu

SEQ ID NO: 105556 - RNA, 19 nt, Homo sapiens
caccuguucuccaccauca

SEQ ID NO: 105557 - RNA, 19 nt, Homo sapiens
gggcgguucucauuaaacg

SEQ ID NO: 105558 - RNA, 19 nt, Homo sapiens
gugggcgguucucauuaaa

SEQ ID NO: 105559 - RNA, 19 nt, Homo sapiens
gccgggaaggaguacauua

SEQ ID NO: 105560 - RNA, 19 nt, Homo sapiens
ccaccuacauucccaacac

SEQ ID NO: 105561 - RNA, 19 nt, Homo sapiens
cuccauaagugucagcaau

SEQ ID NO: 105562 - RNA, 19 nt, Homo sapiens
cugacucaaugguaacuug

SEQ ID NO: 105563 - RNA, 19 nt, Homo sapiens
ugcauucucuucagacaca

SEQ ID NO: 105564 - RNA, 19 nt, Homo sapiens
ggccugcugugcugugcuu

SEQ ID NO: 105565 - RNA, 19 nt, Homo sapiens
cagcuaacccacccaccaa

SEQ ID NO: 105566 - RNA, 19 nt, Homo sapiens
ccacaaugccacagcuauc

SEQ ID NO: 105567 - RNA, 19 nt, Homo sapiens
aguacaaggucuccauaag

SEQ ID NO: 105568 - RNA, 19 nt, Homo sapiens
aaauuauggucugugagaa

SEQ ID NO: 105569 - RNA, 19 nt, Homo sapiens
caaugugacugugcugcau

SEQ ID NO: 105570 - RNA, 19 nt, Homo sapiens
cugcuccuaucccacagua

SEQ ID NO: 105571 - RNA, 19 nt, Homo sapiens
gaggugggccaugcagcua

SEQ ID NO: 105572 - RNA, 19 nt, Homo sapiens
gcacagcacacaccaucac

SEQ ID NO: 105573 - RNA, 19 nt, Homo sapiens
auuauaagcuccugaugcu

SEQ ID NO: 105574 - RNA, 19 nt, Homo sapiens
cuaccacgaagaucuguga

SEQ ID NO: 105575 - RNA, 19 nt, Homo sapiens
ccaccuaccacgaagaucu

SEQ ID NO: 105576 - RNA, 19 nt, Homo sapiens
ccugggcucugacgugaca

SEQ ID NO: 105577 - RNA, 19 nt, Homo sapiens
ucuccaccaucaaguacaa

SEQ ID NO: 105578 - RNA, 19 nt, Homo sapiens
ccgggaaggaguacauuau

SEQ ID NO: 105579 - RNA, 19 nt, Homo sapiens
uaaacgucaccauuucaug

SEQ ID NO: 105580 - RNA, 19 nt, Homo sapiens
ccucugcccuguuuuguau

SEQ ID NO: 105581 - RNA, 19 nt, Homo sapiens
ccauaagugucagcaaugc

SEQ ID NO: 105582 - RNA, 19 nt, Homo sapiens
gacgugacacugccaugug

SEQ ID NO: 105583 - RNA, 19 nt, Homo sapiens
cuaacccacccaccaaaga

SEQ ID NO: 105584 - RNA, 19 nt, Homo sapiens
gaggaggaggacauugaug

SEQ ID NO: 105585 - RNA, 19 nt, Homo sapiens
aggaggaggaggacauuga

SEQ ID NO: 105586 - RNA, 19 nt, Homo sapiens
uuugacgaguucaccauug

SEQ ID NO: 105587 - RNA, 19 nt, Homo sapiens
gaaagaugcuggaauauac

SEQ ID NO: 105588 - RNA, 19 nt, Homo sapiens
ccauagagcuaaauucuuu

SEQ ID NO: 105589 - RNA, 19 nt, Homo sapiens
gaaccgaacuucuacugaa

SEQ ID NO: 105590 - RNA, 19 nt, Homo sapiens
acagaaagaugcuggaaua

SEQ ID NO: 105591 - RNA, 19 nt, Homo sapiens
caacacacaugaugacuga

SEQ ID NO: 105592 - RNA, 19 nt, Homo sapiens
gaggaaaccuuguuaucaa

SEQ ID NO: 105593 - RNA, 19 nt, Homo sapiens
gaagagcagccaaucaaua

SEQ ID NO: 105594 - RNA, 19 nt, Homo sapiens
ggauaaacaucaagcaaga

SEQ ID NO: 105595 - RNA, 19 nt, Homo sapiens
agaagaagcugcaaacaga

SEQ ID NO: 105596 - RNA, 19 nt, Homo sapiens
gaugguagcuuggaaauca

SEQ ID NO: 105597 - RNA, 19 nt, Homo sapiens
gaauggugcuucucuguga

SEQ ID NO: 105598 - RNA, 19 nt, Homo sapiens
ucaaaugaaucuacaguga

SEQ ID NO: 105599 - RNA, 19 nt, Homo sapiens
uagcagaguuuacauggua

SEQ ID NO: 105600 - RNA, 19 nt, Homo sapiens
ggacaauucuucagcuuca

SEQ ID NO: 105601 - RNA, 19 nt, Homo sapiens
guuccaauaugccuuauaa

SEQ ID NO: 105602 - RNA, 19 nt, Homo sapiens
gaaaugaauccuaugaaga

SEQ ID NO: 105603 - RNA, 19 nt, Homo sapiens
gaaacaugcuggaagauac

SEQ ID NO: 105604 - RNA, 19 nt, Homo sapiens
gaauuaagacuguaugaug

SEQ ID NO: 105605 - RNA, 19 nt, Homo sapiens
gagaauagaagacauuaga

SEQ ID NO: 105606 - RNA, 19 nt, Homo sapiens
gaaaugcgcagcugaaaca

SEQ ID NO: 105607 - RNA, 19 nt, Homo sapiens
cagaguggcuugucaauag

SEQ ID NO: 105608 - RNA, 19 nt, Homo sapiens
ggauguauaugcauugaug

SEQ ID NO: 105609 - RNA, 19 nt, Homo sapiens
gaguuuacaugguauagaa

SEQ ID NO: 105610 - RNA, 19 nt, Homo sapiens
ggucagucaucuugugaua

SEQ ID NO: 105611 - RNA, 19 nt, Homo sapiens
gaacuucuacugaauacaa

SEQ ID NO: 105612 - RNA, 19 nt, Homo sapiens
ugagauaucuguucauugg

SEQ ID NO: 105613 - RNA, 19 nt, Homo sapiens
caacaacccugacaaacag

SEQ ID NO: 105614 - RNA, 19 nt, Homo sapiens
guggaaagcuaucagauuc

SEQ ID NO: 105615 - RNA, 19 nt, Homo sapiens
gaaagcccaucccuacaau

SEQ ID NO: 105616 - RNA, 19 nt, Homo sapiens
ggaauauacuacuguuuag

SEQ ID NO: 105617 - RNA, 19 nt, Homo sapiens
gcuaucagauucgguauug

SEQ ID NO: 105618 - RNA, 19 nt, Homo sapiens
caacagaaguagguguaaa

SEQ ID NO: 105619 - RNA, 19 nt, Homo sapiens
ggaaagaugcaaagacaga

SEQ ID NO: 105620 - RNA, 19 nt, Homo sapiens
gcugaaacaugcuggaaga

SEQ ID NO: 105621 - RNA, 19 nt, Homo sapiens
ggugauaauugaaugcaaa

SEQ ID NO: 105622 - RNA, 19 nt, Homo sapiens
gaagggugauaauugaaug

SEQ ID NO: 105623 - RNA, 19 nt, Homo sapiens
gaucuucaauauucagcua

SEQ ID NO: 105624 - RNA, 19 nt, Homo sapiens
gcacagugauggaggagau

SEQ ID NO: 105625 - RNA, 19 nt, Homo sapiens
gcaaacagaguucaaguca

SEQ ID NO: 105626 - RNA, 19 nt, Homo sapiens
ucagaugacuggaaagaug

SEQ ID NO: 105627 - RNA, 19 nt, Homo sapiens
gaucaucaguucaguaagg

SEQ ID NO: 105628 - RNA, 19 nt, Homo sapiens
caagagcaguggacuuaau

SEQ ID NO: 105629 - RNA, 19 nt, Homo sapiens
ucacaaacacuccauagaa

SEQ ID NO: 105630 - RNA, 19 nt, Homo sapiens
guggaagggugauaauuga

SEQ ID NO: 105631 - RNA, 19 nt, Homo sapiens
ccacugcauuucaaguuaa

SEQ ID NO: 105632 - RNA, 19 nt, Homo sapiens
ggaaaggaauggugcuucu

SEQ ID NO: 105633 - RNA, 19 nt, Homo sapiens
caauaugccuuauaaacca

SEQ ID NO: 105634 - RNA, 19 nt, Homo sapiens
ggaguggugucucaaguca

SEQ ID NO: 105635 - RNA, 19 nt, Homo sapiens
gauauaagguacucuacag

SEQ ID NO: 105636 - RNA, 19 nt, Homo sapiens
agacuauucuuucagauga

SEQ ID NO: 105637 - RNA, 19 nt, Homo sapiens
ucaacaacauuacaaggaa

SEQ ID NO: 105638 - RNA, 19 nt, Homo sapiens
ggaagaugguagcuuggaa

SEQ ID NO: 105639 - RNA, 19 nt, Homo sapiens
ggaaagcccaucccuacaa

SEQ ID NO: 105640 - RNA, 19 nt, Homo sapiens
gauaaacggcgauuugugu

SEQ ID NO: 105641 - RNA, 19 nt, Homo sapiens
ggaggaaaccuuguuauca

SEQ ID NO: 105642 - RNA, 19 nt, Homo sapiens
gauccuggcugcuaaaggu

SEQ ID NO: 105643 - RNA, 19 nt, Homo sapiens
ucaaggauguauaugcauu

SEQ ID NO: 105644 - RNA, 19 nt, Homo sapiens
caaagagcguguucagcaa

SEQ ID NO: 105645 - RNA, 19 nt, Homo sapiens
ggacguugaucucacaagu

SEQ ID NO: 105646 - RNA, 19 nt, Homo sapiens
gauccuacgcgaauuauau

SEQ ID NO: 105647 - RNA, 19 nt, Homo sapiens
caacugccauagagcuaaa

SEQ ID NO: 105648 - RNA, 19 nt, Homo sapiens
gaggaaaggauaaacauca

SEQ ID NO: 105649 - RNA, 19 nt, Homo sapiens
uagaagauauggucaugga

SEQ ID NO: 105650 - RNA, 19 nt, Homo sapiens
ugaaaugaauccuaugaag

SEQ ID NO: 105651 - RNA, 19 nt, Homo sapiens
ucagucaucuugugauaau

SEQ ID NO: 105652 - RNA, 19 nt, Homo sapiens
acagagagcugaccauaac

SEQ ID NO: 105653 - RNA, 19 nt, Homo sapiens
gaagaugguagcuuggaaa

SEQ ID NO: 105654 - RNA, 19 nt, Homo sapiens
guuuacaaauggagaauga

SEQ ID NO: 105655 - RNA, 19 nt, Homo sapiens
acaagacgcucccagugaa

SEQ ID NO: 105656 - RNA, 19 nt, Homo sapiens
gaaggcaucuaugaaugug

SEQ ID NO: 105657 - RNA, 19 nt, Homo sapiens
caaagagaauauucacuac

SEQ ID NO: 105658 - RNA, 19 nt, Homo sapiens
ggguagaacacaucaauga

SEQ ID NO: 105659 - RNA, 19 nt, Homo sapiens
agaaagaugcuggaauaua

SEQ ID NO: 105660 - RNA, 19 nt, Homo sapiens
caacaacauuacaaggaau

SEQ ID NO: 105661 - RNA, 19 nt, Homo sapiens
gcagcagaauacucauuug

SEQ ID NO: 105662 - RNA, 19 nt, Homo sapiens
gccaaucaauaccauuuau

SEQ ID NO: 105663 - RNA, 19 nt, Homo sapiens
aaacagagagcugaccaua

SEQ ID NO: 105664 - RNA, 19 nt, Homo sapiens
gaacccuuguuaucacaga

SEQ ID NO: 105665 - RNA, 19 nt, Homo sapiens
gcauuuaagccauuugaug

SEQ ID NO: 105666 - RNA, 19 nt, Homo sapiens
ggaaaucaacaacauuaca

SEQ ID NO: 105667 - RNA, 19 nt, Homo sapiens
gguggaagggugauaauug

SEQ ID NO: 105668 - RNA, 19 nt, Homo sapiens
acacagagguggacauagg

SEQ ID NO: 105669 - RNA, 19 nt, Homo sapiens
gcugagaacauuagaggaa

SEQ ID NO: 105670 - RNA, 19 nt, Homo sapiens
guucaaggauguauaugca

SEQ ID NO: 105671 - RNA, 19 nt, Homo sapiens
guaggaggaaaccuuguua

SEQ ID NO: 105672 - RNA, 19 nt, Homo sapiens
ugaggaagacaaaggauuu

SEQ ID NO: 105673 - RNA, 19 nt, Homo sapiens
ucacagauccuacgcgaau

SEQ ID NO: 105674 - RNA, 19 nt, Homo sapiens
cacaaacacuccauagaag

SEQ ID NO: 105675 - RNA, 19 nt, Homo sapiens
gcacuggaacccuuguuau

SEQ ID NO: 105676 - RNA, 19 nt, Homo sapiens
caaauucaucccacucauu

SEQ ID NO: 105677 - RNA, 19 nt, Homo sapiens
aggaaucacuggaaggaaa

SEQ ID NO: 105678 - RNA, 19 nt, Homo sapiens
aaucuacagugacgggaua

SEQ ID NO: 105679 - RNA, 19 nt, Homo sapiens
gcacugcccagacaauugu

SEQ ID NO: 105680 - RNA, 19 nt, Homo sapiens
ugaaacaugcuggaagaua

SEQ ID NO: 105681 - RNA, 19 nt, Homo sapiens
aaauugaaccgaacuucua

SEQ ID NO: 105682 - RNA, 19 nt, Homo sapiens
gcaagaauuuauguucaag

SEQ ID NO: 105683 - RNA, 19 nt, Homo sapiens
gggcuguucuuaagaucuu

SEQ ID NO: 105684 - RNA, 19 nt, Homo sapiens
gguucacgcuauauaauca

SEQ ID NO: 105685 - RNA, 19 nt, Homo sapiens
aaauguggcuccuucagau

SEQ ID NO: 105686 - RNA, 19 nt, Homo sapiens
ugccuuggaucucacauuu

SEQ ID NO: 105687 - RNA, 19 nt, Homo sapiens
gaaagaugcuggaauauac

SEQ ID NO: 105688 - RNA, 19 nt, Homo sapiens
ccauagagcuaaauucuuu

SEQ ID NO: 105689 - RNA, 19 nt, Homo sapiens
gaaccgaacuucuacugaa

SEQ ID NO: 105690 - RNA, 19 nt, Homo sapiens
acagaaagaugcuggaaua

SEQ ID NO: 105691 - RNA, 19 nt, Homo sapiens
caacacacaugaugacuga

SEQ ID NO: 105692 - RNA, 19 nt, Homo sapiens
gaggaaaccuuguuaucaa

SEQ ID NO: 105693 - RNA, 19 nt, Homo sapiens
gaagagcagccaaucaaua

SEQ ID NO: 105694 - RNA, 19 nt, Homo sapiens
ggauaaacaucaagcaaga

SEQ ID NO: 105695 - RNA, 19 nt, Homo sapiens
agaagaagcugcaaacaga

SEQ ID NO: 105696 - RNA, 19 nt, Homo sapiens
gaugguagcuuggaaauca

SEQ ID NO: 105697 - RNA, 19 nt, Homo sapiens
gaauggugcuucucuguga

SEQ ID NO: 105698 - RNA, 19 nt, Homo sapiens
ucaaaugaaucuacaguga

SEQ ID NO: 105699 - RNA, 19 nt, Homo sapiens
ggacaauucuucagcuuca

SEQ ID NO: 105700 - RNA, 19 nt, Homo sapiens
guuccaauaugccuuauaa

SEQ ID NO: 105701 - RNA, 19 nt, Homo sapiens
gaaaugaauccuaugaaga

SEQ ID NO: 105702 - RNA, 19 nt, Homo sapiens
gaaacaugcuggaagauac

SEQ ID NO: 105703 - RNA, 19 nt, Homo sapiens
gaauuaagacuguaugaug

SEQ ID NO: 105704 - RNA, 19 nt, Homo sapiens
gagaauagaagacauuaga

SEQ ID NO: 105705 - RNA, 19 nt, Homo sapiens
gaaaugcgcagcugaaaca

SEQ ID NO: 105706 - RNA, 19 nt, Homo sapiens
cagaguggcuugucaauag

SEQ ID NO: 105707 - RNA, 19 nt, Homo sapiens
ggauguauaugcauugaug

SEQ ID NO: 105708 - RNA, 19 nt, Homo sapiens
ggucagucaucuugugaua

SEQ ID NO: 105709 - RNA, 19 nt, Homo sapiens
gaacuucuacugaauacaa

SEQ ID NO: 105710 - RNA, 19 nt, Homo sapiens
ugagauaucuguucauugg

SEQ ID NO: 105711 - RNA, 19 nt, Homo sapiens
caacaacccugacaaacag

SEQ ID NO: 105712 - RNA, 19 nt, Homo sapiens
guggaaagcuaucagauuc

SEQ ID NO: 105713 - RNA, 19 nt, Homo sapiens
gaaagcccaucccuacaau

SEQ ID NO: 105714 - RNA, 19 nt, Homo sapiens
ggaauauacuacuguuuag

SEQ ID NO: 105715 - RNA, 19 nt, Homo sapiens
gcuaucagauucgguauug

SEQ ID NO: 105716 - RNA, 19 nt, Homo sapiens
caacagaaguagguguaaa

SEQ ID NO: 105717 - RNA, 19 nt, Homo sapiens
ggaaagaugcaaagacaga

SEQ ID NO: 105718 - RNA, 19 nt, Homo sapiens
gcugaaacaugcuggaaga

SEQ ID NO: 105719 - RNA, 19 nt, Homo sapiens
ggugauaauugaaugcaaa

SEQ ID NO: 105720 - RNA, 19 nt, Homo sapiens
gaagggugauaauugaaug

SEQ ID NO: 105721 - RNA, 19 nt, Homo sapiens
gaucuucaauauucagcua

SEQ ID NO: 105722 - RNA, 19 nt, Homo sapiens
gcacagugauggaggagau

SEQ ID NO: 105723 - RNA, 19 nt, Homo sapiens
gcaaacagaguucaaguca

SEQ ID NO: 105724 - RNA, 19 nt, Homo sapiens
ucagaugacuggaaagaug

SEQ ID NO: 105725 - RNA, 19 nt, Homo sapiens
gaucaucaguucaguaagg

SEQ ID NO: 105726 - RNA, 19 nt, Homo sapiens
caagagcaguggacuuaau

SEQ ID NO: 105727 - RNA, 19 nt, Homo sapiens
ucacaaacacuccauagaa

SEQ ID NO: 105728 - RNA, 19 nt, Homo sapiens
guggaagggugauaauuga

SEQ ID NO: 105729 - RNA, 19 nt, Homo sapiens
ccacugcauuucaaguuaa

SEQ ID NO: 105730 - RNA, 19 nt, Homo sapiens
ggaaaggaauggugcuucu

SEQ ID NO: 105731 - RNA, 19 nt, Homo sapiens
caauaugccuuauaaacca

SEQ ID NO: 105732 - RNA, 19 nt, Homo sapiens
ggaguggugucucaaguca

SEQ ID NO: 105733 - RNA, 19 nt, Homo sapiens
gauauaagguacucuacag

SEQ ID NO: 105734 - RNA, 19 nt, Homo sapiens
agacuauucuuucagauga

SEQ ID NO: 105735 - RNA, 19 nt, Homo sapiens
ucaacaacauuacaaggaa

SEQ ID NO: 105736 - RNA, 19 nt, Homo sapiens
ggaagaugguagcuuggaa

SEQ ID NO: 105737 - RNA, 19 nt, Homo sapiens
ggaaagcccaucccuacaa

SEQ ID NO: 105738 - RNA, 19 nt, Homo sapiens
gauaaacggcgauuugugu

SEQ ID NO: 105739 - RNA, 19 nt, Homo sapiens
ggaggaaaccuuguuauca

SEQ ID NO: 105740 - RNA, 19 nt, Homo sapiens
gauccuggcugcuaaaggu

SEQ ID NO: 105741 - RNA, 19 nt, Homo sapiens
ucaaggauguauaugcauu

SEQ ID NO: 105742 - RNA, 19 nt, Homo sapiens
caaagagcguguucagcaa

SEQ ID NO: 105743 - RNA, 19 nt, Homo sapiens
ggacguugaucucacaagu

SEQ ID NO: 105744 - RNA, 19 nt, Homo sapiens
gauccuacgcgaauuauau

SEQ ID NO: 105745 - RNA, 19 nt, Homo sapiens
caacugccauagagcuaaa

SEQ ID NO: 105746 - RNA, 19 nt, Homo sapiens
gaggaaaggauaaacauca

SEQ ID NO: 105747 - RNA, 19 nt, Homo sapiens
ugaaaugaauccuaugaag

SEQ ID NO: 105748 - RNA, 19 nt, Homo sapiens
ucagucaucuugugauaau

SEQ ID NO: 105749 - RNA, 19 nt, Homo sapiens
acagagagcugaccauaac

SEQ ID NO: 105750 - RNA, 19 nt, Homo sapiens
gaagaugguagcuuggaaa

SEQ ID NO: 105751 - RNA, 19 nt, Homo sapiens
guuuacaaauggagaauga

SEQ ID NO: 105752 - RNA, 19 nt, Homo sapiens
acaagacgcucccagugaa

SEQ ID NO: 105753 - RNA, 19 nt, Homo sapiens
gaaggcaucuaugaaugug

SEQ ID NO: 105754 - RNA, 19 nt, Homo sapiens
caaagagaauauucacuac

SEQ ID NO: 105755 - RNA, 19 nt, Homo sapiens
ggguagaacacaucaauga

SEQ ID NO: 105756 - RNA, 19 nt, Homo sapiens
agaaagaugcuggaauaua

SEQ ID NO: 105757 - RNA, 19 nt, Homo sapiens
caacaacauuacaaggaau

SEQ ID NO: 105758 - RNA, 19 nt, Homo sapiens
gcagcagaauacucauuug

SEQ ID NO: 105759 - RNA, 19 nt, Homo sapiens
gccaaucaauaccauuuau

SEQ ID NO: 105760 - RNA, 19 nt, Homo sapiens
aaacagagagcugaccaua

SEQ ID NO: 105761 - RNA, 19 nt, Homo sapiens
gaacccuuguuaucacaga

SEQ ID NO: 105762 - RNA, 19 nt, Homo sapiens
gcauuuaagccauuugaug

SEQ ID NO: 105763 - RNA, 19 nt, Homo sapiens
ugaggaagacaaaggauuu

SEQ ID NO: 105764 - RNA, 19 nt, Homo sapiens
ggaaaucaacaacauuaca

SEQ ID NO: 105765 - RNA, 19 nt, Homo sapiens
gguggaagggugauaauug

SEQ ID NO: 105766 - RNA, 19 nt, Homo sapiens
acacagagguggacauagg

SEQ ID NO: 105767 - RNA, 19 nt, Homo sapiens
gcugagaacauuagaggaa

SEQ ID NO: 105768 - RNA, 19 nt, Homo sapiens
guucaaggauguauaugca

SEQ ID NO: 105769 - RNA, 19 nt, Homo sapiens
guaggaggaaaccuuguua

SEQ ID NO: 105770 - RNA, 19 nt, Homo sapiens
ucacagauccuacgcgaau

SEQ ID NO: 105771 - RNA, 19 nt, Homo sapiens
cacaaacacuccauagaag

SEQ ID NO: 105772 - RNA, 19 nt, Homo sapiens
gcacuggaacccuuguuau

SEQ ID NO: 105773 - RNA, 19 nt, Homo sapiens
caaauucaucccacucauu

SEQ ID NO: 105774 - RNA, 19 nt, Homo sapiens
aggaaucacuggaaggaaa

SEQ ID NO: 105775 - RNA, 19 nt, Homo sapiens
aaucuacagugacgggaua

SEQ ID NO: 105776 - RNA, 19 nt, Homo sapiens
gcacugcccagacaauugu

SEQ ID NO: 105777 - RNA, 19 nt, Homo sapiens
ugaaacaugcuggaagaua

SEQ ID NO: 105778 - RNA, 19 nt, Homo sapiens
gcaagaauuuauguucaag

SEQ ID NO: 105779 - RNA, 19 nt, Homo sapiens
gggcuguucuuaagaucuu

SEQ ID NO: 105780 - RNA, 19 nt, Homo sapiens
aaauugaaccgaacuucua

SEQ ID NO: 105781 - RNA, 19 nt, Homo sapiens
gguucacgcuauauaauca

SEQ ID NO: 105782 - RNA, 19 nt, Homo sapiens
aaauguggcuccuucagau

SEQ ID NO: 105783 - RNA, 19 nt, Homo sapiens
ugccuuggaucucacauuu

SEQ ID NO: 105784 - RNA, 19 nt, Homo sapiens
cggaauguaucagugcaua

SEQ ID NO: 105785 - RNA, 19 nt, Homo sapiens
caagcaagaauuuauguuc

SEQ ID NO: 105786 - RNA, 19 nt, Homo sapiens
gcaaauucaucccacucau

SEQ ID NO: 105787 - RNA, 19 nt, Homo sapiens
gcaagacagugauugaaua

SEQ ID NO: 105788 - RNA, 19 nt, Homo sapiens
ggaaaugacccaaacauaa

SEQ ID NO: 105789 - RNA, 19 nt, Homo sapiens
gggaaucacuggugcuaua

SEQ ID NO: 105790 - RNA, 19 nt, Homo sapiens
gaaaucaaccggaggaauu

SEQ ID NO: 105791 - RNA, 19 nt, Homo sapiens
cagaagaacugguacauca

SEQ ID NO: 105792 - RNA, 19 nt, Homo sapiens
gaauaaagcauguggaaau

SEQ ID NO: 105793 - RNA, 19 nt, Homo sapiens
gaagacaucccaccaauca

SEQ ID NO: 105794 - RNA, 19 nt, Homo sapiens
gcauucaucucucaaacuu

SEQ ID NO: 105795 - RNA, 19 nt, Homo sapiens
gcgaugacgugaucuguga

SEQ ID NO: 105796 - RNA, 19 nt, Homo sapiens
caaagagucuacaugucua

SEQ ID NO: 105797 - RNA, 19 nt, Homo sapiens
caaaggcaaugcucaaaca

SEQ ID NO: 105798 - RNA, 19 nt, Homo sapiens
cgaccucucuccucugaaa

SEQ ID NO: 105799 - RNA, 19 nt, Homo sapiens
gggagagacuguucuguuc

SEQ ID NO: 105800 - RNA, 19 nt, Homo sapiens
ggagacaauuucacaugga

SEQ ID NO: 105801 - RNA, 19 nt, Homo sapiens
caaaggugcuacaucuaug

SEQ ID NO: 105802 - RNA, 19 nt, Homo sapiens
uaacuguguugcugaaaga

SEQ ID NO: 105803 - RNA, 19 nt, Homo sapiens
ggaauucggcuucgacguu

SEQ ID NO: 105804 - RNA, 19 nt, Homo sapiens
gacagugauugaauacaaa

SEQ ID NO: 105805 - RNA, 19 nt, Homo sapiens
gagcaugaccgauggauuc

SEQ ID NO: 105806 - RNA, 19 nt, Homo sapiens
ggaagcggcuccccauuuu

SEQ ID NO: 105807 - RNA, 19 nt, Homo sapiens
gcagaaacaucggauuugg

SEQ ID NO: 105808 - RNA, 19 nt, Homo sapiens
agacagugauugaauacaa

SEQ ID NO: 105809 - RNA, 19 nt, Homo sapiens
ccacaaagagucuacaugu

SEQ ID NO: 105810 - RNA, 19 nt, Homo sapiens
gauggggacuugugaauuu

SEQ ID NO: 105811 - RNA, 19 nt, Homo sapiens
gaagacacaggaaacaaug

SEQ ID NO: 105812 - RNA, 19 nt, Homo sapiens
gaacagcguggccuacaug

SEQ ID NO: 105813 - RNA, 19 nt, Homo sapiens
gcaaaagacucuguaccua

SEQ ID NO: 105814 - RNA, 19 nt, Homo sapiens
gcugaaagacuaccucguu

SEQ ID NO: 105815 - RNA, 19 nt, Homo sapiens
caauggugcuccugguauu

SEQ ID NO: 105816 - RNA, 19 nt, Homo sapiens
ccaaaggugcuacaucuau

SEQ ID NO: 105817 - RNA, 19 nt, Homo sapiens
caaagaaggcggcaaaggu

SEQ ID NO: 105818 - RNA, 19 nt, Homo sapiens
ccaaucaccugcguacaga

SEQ ID NO: 105819 - RNA, 19 nt, Homo sapiens
ucagggugcucgaggauug

SEQ ID NO: 105820 - RNA, 19 nt, Homo sapiens
gcaagguguugugcgauga

SEQ ID NO: 105821 - RNA, 19 nt, Homo sapiens
caaagaagccuugccaucu

SEQ ID NO: 105822 - RNA, 19 nt, Homo sapiens
gggaaugccuggugaacgu

SEQ ID NO: 105823 - RNA, 19 nt, Homo sapiens
aaagaagccuugccaucug

SEQ ID NO: 105824 - RNA, 19 nt, Homo sapiens
aaaagugcauucaaccuua

SEQ ID NO: 105825 - RNA, 19 nt, Homo sapiens
gacaagcaacccaaacuga

SEQ ID NO: 105826 - RNA, 19 nt, Homo sapiens
cuagacauguucagcuuug

SEQ ID NO: 105827 - RNA, 19 nt, Homo sapiens
gcaagaggcgagagagguu

SEQ ID NO: 105828 - RNA, 19 nt, Homo sapiens
uaccaaaggugcuacaucu

SEQ ID NO: 105829 - RNA, 19 nt, Homo sapiens
gagagacuguucuguucug

SEQ ID NO: 105830 - RNA, 19 nt, Homo sapiens
ccagcugucuuauggcuau

SEQ ID NO: 105831 - RNA, 19 nt, Homo sapiens
ggaauaaagcauguggaaa

SEQ ID NO: 105832 - RNA, 19 nt, Homo sapiens
agacuguucuguucuguuc

SEQ ID NO: 105833 - RNA, 19 nt, Homo sapiens
gagacaacuucccaaagca

SEQ ID NO: 105834 - RNA, 19 nt, Homo sapiens
guaacuguguugcugaaag

SEQ ID NO: 105835 - RNA, 19 nt, Homo sapiens
gcaacagccgcuucaccua

SEQ ID NO: 105836 - RNA, 19 nt, Homo sapiens
gccgugaccucaagaugug

SEQ ID NO: 105837 - RNA, 19 nt, Homo sapiens
agagaaggcucacgauggu

SEQ ID NO: 105838 - RNA, 19 nt, Homo sapiens
cggccaaccuggugcuaaa

SEQ ID NO: 105839 - RNA, 19 nt, Homo sapiens
aauaaagcauguggaaaug

SEQ ID NO: 105840 - RNA, 19 nt, Homo sapiens
cuaccucguucuugucuug

SEQ ID NO: 105841 - RNA, 19 nt, Homo sapiens
gaagggacacagagguuuc

SEQ ID NO: 105842 - RNA, 19 nt, Homo sapiens
ggaaagaauggagaugaug

SEQ ID NO: 105843 - RNA, 19 nt, Homo sapiens
aaucacuggugcuauagaa

SEQ ID NO: 105844 - RNA, 19 nt, Homo sapiens
aagcagaaacaucggauuu

SEQ ID NO: 105845 - RNA, 19 nt, Homo sapiens
caacaucuccccuucguuu

SEQ ID NO: 105846 - RNA, 19 nt, Homo sapiens
uggcaaagauggacucaac

SEQ ID NO: 105847 - RNA, 19 nt, Homo sapiens
caaggucccucuggagcaa

SEQ ID NO: 105848 - RNA, 19 nt, Homo sapiens
uggaaaugacccaaacaua

SEQ ID NO: 105849 - RNA, 19 nt, Homo sapiens
aaaagacucuguaccuauu

SEQ ID NO: 105850 - RNA, 19 nt, Homo sapiens
ugauggcucuccuggcaaa

SEQ ID NO: 105851 - RNA, 19 nt, Homo sapiens
uaaagcauguggaaaugac

SEQ ID NO: 105852 - RNA, 19 nt, Homo sapiens
ccaaagcacaaagcaguuu

SEQ ID NO: 105853 - RNA, 19 nt, Homo sapiens
ccauggcucuugcaacauc

SEQ ID NO: 105854 - RNA, 19 nt, Homo sapiens
guucucagacugccaaaga

SEQ ID NO: 105855 - RNA, 19 nt, Homo sapiens
caaagucuucugcaacaug

SEQ ID NO: 105856 - RNA, 19 nt, Homo sapiens
gcuacuaccgggcugauga

SEQ ID NO: 105857 - RNA, 19 nt, Homo sapiens
gaagggccacgacaaagca

SEQ ID NO: 105858 - RNA, 19 nt, Homo sapiens
ucccauggcucuugcaaca

SEQ ID NO: 105859 - RNA, 19 nt, Homo sapiens
agacacaggaaacaaugua

SEQ ID NO: 105860 - RNA, 19 nt, Homo sapiens
gccagcagaucgagaacau

SEQ ID NO: 105861 - RNA, 19 nt, Homo sapiens
cagcuggccucccuggaau

SEQ ID NO: 105862 - RNA, 19 nt, Homo sapiens
agagacaacuucccaaagc

SEQ ID NO: 105863 - RNA, 19 nt, Homo sapiens
caggaagggccacgacaaa

SEQ ID NO: 105864 - RNA, 19 nt, Homo sapiens
uguauugucugcccagcaa

SEQ ID NO: 105865 - RNA, 19 nt, Homo sapiens
acaaagagucuacaugucu

SEQ ID NO: 105866 - RNA, 19 nt, Homo sapiens
gagcgugguggaccuggua

SEQ ID NO: 105867 - RNA, 19 nt, Homo sapiens
cacagagguuucagugguu

SEQ ID NO: 105868 - RNA, 19 nt, Homo sapiens
uuauggcuaugaugagaaa

SEQ ID NO: 105869 - RNA, 19 nt, Homo sapiens
ucagagacaacuucccaaa

SEQ ID NO: 105870 - RNA, 19 nt, Homo sapiens
agaaggcccugcuccucaa

SEQ ID NO: 105871 - RNA, 19 nt, Homo sapiens
acaagaggcaugucugguu

SEQ ID NO: 105872 - RNA, 19 nt, Homo sapiens
ccaucaaagucuucugcaa

SEQ ID NO: 105873 - RNA, 19 nt, Homo sapiens
gaguggagaguacuggauu

SEQ ID NO: 105874 - RNA, 19 nt, Homo sapiens
gggcugaugaugccaaugu

SEQ ID NO: 105875 - RNA, 19 nt, Homo sapiens
cacuggugcuauagaaauu

SEQ ID NO: 105876 - RNA, 19 nt, Homo sapiens
guucuguucuguuccuugu

SEQ ID NO: 105877 - RNA, 19 nt, Homo sapiens
gcaagaaccccaaggacaa

SEQ ID NO: 105878 - RNA, 19 nt, Homo sapiens
uggugaaccuggcaaacaa

SEQ ID NO: 105879 - RNA, 19 nt, Homo sapiens
aggcaaaccuggugaacag

SEQ ID NO: 105880 - RNA, 19 nt, Homo sapiens
uggaaagaauggagaugau

SEQ ID NO: 105881 - RNA, 19 nt, Homo sapiens
uuugauugcuggaauaaag

SEQ ID NO: 105882 - RNA, 19 nt, Homo sapiens
caacuucccaaagcacaaa

SEQ ID NO: 105883 - RNA, 19 nt, Homo sapiens
gagggaaucacuggugcua

SEQ ID NO: 105884 - RNA, 19 nt, Homo sapiens
acgaagacaucccaccaau

SEQ ID NO: 105885 - RNA, 19 nt, Homo sapiens
cacaaagagucuacauguc

SEQ ID NO: 105886 - RNA, 19 nt, Homo sapiens
guugugcgaugacgugauc

SEQ ID NO: 105887 - RNA, 19 nt, Homo sapiens
gaacuuugcugcucaguau

SEQ ID NO: 105888 - RNA, 19 nt, Homo sapiens
ggaaauggcuacccaacuu

SEQ ID NO: 105889 - RNA, 19 nt, Homo sapiens
gaacagcauugcauacaug

SEQ ID NO: 105890 - RNA, 19 nt, Homo sapiens
gagaagaaauacuccugua

SEQ ID NO: 105891 - RNA, 19 nt, Homo sapiens
gcagccaguuugaauauaa

SEQ ID NO: 105892 - RNA, 19 nt, Homo sapiens
gaacugagguccuuguuuu

SEQ ID NO: 105893 - RNA, 19 nt, Homo sapiens
caaaggugcuaauuaauag

SEQ ID NO: 105894 - RNA, 19 nt, Homo sapiens
ggaaagagaggcccuaaug

SEQ ID NO: 105895 - RNA, 19 nt, Homo sapiens
cuacagggcucuaaugaug

SEQ ID NO: 105896 - RNA, 19 nt, Homo sapiens
gccaagaacugguauagga

SEQ ID NO: 105897 - RNA, 19 nt, Homo sapiens
ccugaaggcucuagaaaga

SEQ ID NO: 105898 - RNA, 19 nt, Homo sapiens
caaggagucugcaugucua

SEQ ID NO: 105899 - RNA, 19 nt, Homo sapiens
caaaguauacugugauuuc

SEQ ID NO: 105900 - RNA, 19 nt, Homo sapiens
ucagauacuugaagaaugu

SEQ ID NO: 105901 - RNA, 19 nt, Homo sapiens
gcaauacaguuucauuaac

SEQ ID NO: 105902 - RNA, 19 nt, Homo sapiens
gagaugaacugagguccuu

SEQ ID NO: 105903 - RNA, 19 nt, Homo sapiens
gaaauuggagcuguuggua

SEQ ID NO: 105904 - RNA, 19 nt, Homo sapiens
caacggugcuccuggugaa

SEQ ID NO: 105905 - RNA, 19 nt, Homo sapiens
uggcagagcuggcgucaug

SEQ ID NO: 105906 - RNA, 19 nt, Homo sapiens
gcccaaaguuguccucuuc

SEQ ID NO: 105907 - RNA, 19 nt, Homo sapiens
gcacaucuacuugcuuaaa

SEQ ID NO: 105908 - RNA, 19 nt, Homo sapiens
gcaacagcagguucacuua

SEQ ID NO: 105909 - RNA, 19 nt, Homo sapiens
cugcacaucuacuugcuua

SEQ ID NO: 105910 - RNA, 19 nt, Homo sapiens
acaauggucuggauggauu

SEQ ID NO: 105911 - RNA, 19 nt, Homo sapiens
uggccgaacuggagaagua

SEQ ID NO: 105912 - RNA, 19 nt, Homo sapiens
gaauguugauggugcuaga

SEQ ID NO: 105913 - RNA, 19 nt, Homo sapiens
uauggaugcuaucaaagua

SEQ ID NO: 105914 - RNA, 19 nt, Homo sapiens
gugcaauacaguuucauua

SEQ ID NO: 105915 - RNA, 19 nt, Homo sapiens
cccagucuguuucaaauaa

SEQ ID NO: 105916 - RNA, 19 nt, Homo sapiens
cuaaugauguugaacuugu

SEQ ID NO: 105917 - RNA, 19 nt, Homo sapiens
ucaaaacacuuucccauga

SEQ ID NO: 105918 - RNA, 19 nt, Homo sapiens
uggcaaggcuggugaagau

SEQ ID NO: 105919 - RNA, 19 nt, Homo sapiens
agaggaaacuguaagaaag

SEQ ID NO: 105920 - RNA, 19 nt, Homo sapiens
gugcugaccuagacagaga

SEQ ID NO: 105921 - RNA, 19 nt, Homo sapiens
caaggacuaugaaguugau

SEQ ID NO: 105922 - RNA, 19 nt, Homo sapiens
gggugaaccuggucucaga

SEQ ID NO: 105923 - RNA, 19 nt, Homo sapiens
cgccugcccuuccuugaua

SEQ ID NO: 105924 - RNA, 19 nt, Homo sapiens
uggaugcuaucaaaguaua

SEQ ID NO: 105925 - RNA, 19 nt, Homo sapiens
gguuggaccugcuggcauu

SEQ ID NO: 105926 - RNA, 19 nt, Homo sapiens
gaaaaugucaaccuuugua

SEQ ID NO: 105927 - RNA, 19 nt, Homo sapiens
gaaauggcuacccaacuug

SEQ ID NO: 105928 - RNA, 19 nt, Homo sapiens
ggacauuggcccagucugu

SEQ ID NO: 105929 - RNA, 19 nt, Homo sapiens
cacuauggaugcuaucaaa

SEQ ID NO: 105930 - RNA, 19 nt, Homo sapiens
ugaagucucucaacaacca

SEQ ID NO: 105931 - RNA, 19 nt, Homo sapiens
gaagauggucacccuggaa

SEQ ID NO: 105932 - RNA, 19 nt, Homo sapiens
aggcagagauggugaagau

SEQ ID NO: 105933 - RNA, 19 nt, Homo sapiens
ccaaaguuguccucuucuu

SEQ ID NO: 105934 - RNA, 19 nt, Homo sapiens
uguaucgugugguguauuu

SEQ ID NO: 105935 - RNA, 19 nt, Homo sapiens
ugucaaccuuuguaagaaa

SEQ ID NO: 105936 - RNA, 19 nt, Homo sapiens
gaaguugaugcuacucuga

SEQ ID NO: 105937 - RNA, 19 nt, Homo sapiens
uaaagggacacaauggauu

SEQ ID NO: 105938 - RNA, 19 nt, Homo sapiens
gggaagcccuggugaacgu

SEQ ID NO: 105939 - RNA, 19 nt, Homo sapiens
gaaagagaggcccuaaugg

SEQ ID NO: 105940 - RNA, 19 nt, Homo sapiens
ggugagagaggacguguug

SEQ ID NO: 105941 - RNA, 19 nt, Homo sapiens
cagguucacuuacacuguu

SEQ ID NO: 105942 - RNA, 19 nt, Homo sapiens
gauugacccuaaccaagga

SEQ ID NO: 105943 - RNA, 19 nt, Homo sapiens
cagauugagacccuucuua

SEQ ID NO: 105944 - RNA, 19 nt, Homo sapiens
agaaguaggugcaguuggu

SEQ ID NO: 105945 - RNA, 19 nt, Homo sapiens
uguaagcgguggugguuau

SEQ ID NO: 105946 - RNA, 19 nt, Homo sapiens
ucucagaggugaaauuggu

SEQ ID NO: 105947 - RNA, 19 nt, Homo sapiens
gaugcacuauggaugcuau

SEQ ID NO: 105948 - RNA, 19 nt, Homo sapiens
ugacuuugguuacgaugga

SEQ ID NO: 105949 - RNA, 19 nt, Homo sapiens
gcugaauccuuccauuucu

SEQ ID NO: 105950 - RNA, 19 nt, Homo sapiens
caacaugccaaucuuuaca

SEQ ID NO: 105951 - RNA, 19 nt, Homo sapiens
caaagggccuaagggugaa

SEQ ID NO: 105952 - RNA, 19 nt, Homo sapiens
gauucagcauuuguucuuu

SEQ ID NO: 105953 - RNA, 19 nt, Homo sapiens
cuagaagaauuugagaaga

SEQ ID NO: 105954 - RNA, 19 nt, Homo sapiens
gauggugcuagaagaauuu

SEQ ID NO: 105955 - RNA, 19 nt, Homo sapiens
ugauggugcuagaagaauu

SEQ ID NO: 105956 - RNA, 19 nt, Homo sapiens
ccacagagggaaguuuaaa

SEQ ID NO: 105957 - RNA, 19 nt, Homo sapiens
ccagucuguuucaaauaaa

SEQ ID NO: 105958 - RNA, 19 nt, Homo sapiens
ugaauucuuuguggacauu

SEQ ID NO: 105959 - RNA, 19 nt, Homo sapiens
gaggagagccuggcaacau

SEQ ID NO: 105960 - RNA, 19 nt, Homo sapiens
cggacgaccuggugagaga

SEQ ID NO: 105961 - RNA, 19 nt, Homo sapiens
ggaacuuugcugcucagua

SEQ ID NO: 105962 - RNA, 19 nt, Homo sapiens
aagaggaaacuguaagaaa

SEQ ID NO: 105963 - RNA, 19 nt, Homo sapiens
gcuagaagaauuugagaag

SEQ ID NO: 105964 - RNA, 19 nt, Homo sapiens
ggcccagucuguuucaaau

SEQ ID NO: 105965 - RNA, 19 nt, Homo sapiens
gcacaugccgugacuugag

SEQ ID NO: 105966 - RNA, 19 nt, Homo sapiens
gugguuaugacuuugguua

SEQ ID NO: 105967 - RNA, 19 nt, Homo sapiens
cagaggucuuccuggcuua

SEQ ID NO: 105968 - RNA, 19 nt, Homo sapiens
uggauucccuggacccaaa

SEQ ID NO: 105969 - RNA, 19 nt, Homo sapiens
ugaaauaaagcauguuugg

SEQ ID NO: 105970 - RNA, 19 nt, Homo sapiens
ucuuacaccuguuauggaa

SEQ ID NO: 105971 - RNA, 19 nt, Homo sapiens
aaagcugaauccuuccauu

SEQ ID NO: 105972 - RNA, 19 nt, Homo sapiens
ggagguuucggcuaaguug

SEQ ID NO: 105973 - RNA, 19 nt, Homo sapiens
agcaggagguuucggcuaa

SEQ ID NO: 105974 - RNA, 19 nt, Homo sapiens
gcgguuacccuggcaauau

SEQ ID NO: 105975 - RNA, 19 nt, Homo sapiens
aggagagccuggcaacauu

SEQ ID NO: 105976 - RNA, 19 nt, Homo sapiens
gaaauaaagcauguuuggu

SEQ ID NO: 105977 - RNA, 19 nt, Homo sapiens
uccaucuuauucccaauua

SEQ ID NO: 105978 - RNA, 19 nt, Homo sapiens
acagggcucuaaugauguu

SEQ ID NO: 105979 - RNA, 19 nt, Homo sapiens
ccaacuaugccucucagaa

SEQ ID NO: 105980 - RNA, 19 nt, Homo sapiens
ggcagccaguuugaauaua

SEQ ID NO: 105981 - RNA, 19 nt, Homo sapiens
gggcacugcugguccaucu

SEQ ID NO: 105982 - RNA, 19 nt, Homo sapiens
ggaccaaugggcuuaaugg

SEQ ID NO: 105983 - RNA, 19 nt, Homo sapiens
aaccaaggaugcacuaugg

SEQ ID NO: 105984 - RNA, 19 nt, Homo sapiens
caaaguuguccucuucuuc

SEQ ID NO: 105985 - RNA, 19 nt, Homo sapiens
uuccaaagguuuaaacuac

SEQ ID NO: 105986 - RNA, 19 nt, Homo sapiens
cacaucuacuugcuuaaau

SEQ ID NO: 105987 - RNA, 19 nt, Homo sapiens
gggcagagguauaaugaua

SEQ ID NO: 105988 - RNA, 19 nt, Homo sapiens
gcaagacuguuaucgagua

SEQ ID NO: 105989 - RNA, 19 nt, Homo sapiens
gaaacuaacuggugugagu

SEQ ID NO: 105990 - RNA, 19 nt, Homo sapiens
ggaauucgguguggacaua

SEQ ID NO: 105991 - RNA, 19 nt, Homo sapiens
gcacgaaacauaccgguaa

SEQ ID NO: 105992 - RNA, 19 nt, Homo sapiens
cagcaaacguucccaagaa

SEQ ID NO: 105993 - RNA, 19 nt, Homo sapiens
ccaagggccuccugcauga

SEQ ID NO: 105994 - RNA, 19 nt, Homo sapiens
gaacagcauugccuaucug

SEQ ID NO: 105995 - RNA, 19 nt, Homo sapiens
caucaaggauauuguagga

SEQ ID NO: 105996 - RNA, 19 nt, Homo sapiens
gcaaagauggugcuaaugg

SEQ ID NO: 105997 - RNA, 19 nt, Homo sapiens
gcaaggagacagaggagaa

SEQ ID NO: 105998 - RNA, 19 nt, Homo sapiens
aaacuuugcugcccagaug

SEQ ID NO: 105999 - RNA, 19 nt, Homo sapiens
caaagauggugcuaaugga

SEQ ID NO: 106000 - RNA, 19 nt, Homo sapiens
gucaaacaccucuguauuu

SEQ ID NO: 106001 - RNA, 19 nt, Homo sapiens
uggcaaagcuggugagaag

SEQ ID NO: 106002 - RNA, 19 nt, Homo sapiens
gcagagguauaaugauaag

SEQ ID NO: 106003 - RNA, 19 nt, Homo sapiens
ccaaaggacccaaguacuu

SEQ ID NO: 106004 - RNA, 19 nt, Homo sapiens
gcaauagcagguucacgua

SEQ ID NO: 106005 - RNA, 19 nt, Homo sapiens
gaccugaccugauguccau

SEQ ID NO: 106006 - RNA, 19 nt, Homo sapiens
caaguacuuuccaaucuca

SEQ ID NO: 106007 - RNA, 19 nt, Homo sapiens
gcgacgacauaaucuguga

SEQ ID NO: 106008 - RNA, 19 nt, Homo sapiens
gcaagagcaaggagaagaa

SEQ ID NO: 106009 - RNA, 19 nt, Homo sapiens
uggcaaagauggugcuaau

SEQ ID NO: 106010 - RNA, 19 nt, Homo sapiens
uggcaaagauggugagaca

SEQ ID NO: 106011 - RNA, 19 nt, Homo sapiens
gcuggaggauuugaugaaa

SEQ ID NO: 106012 - RNA, 19 nt, Homo sapiens
gaguaccggucacagaaga

SEQ ID NO: 106013 - RNA, 19 nt, Homo sapiens
gcaaggagaagaaacacau

SEQ ID NO: 106014 - RNA, 19 nt, Homo sapiens
gaaggauggcugcacgaaa

SEQ ID NO: 106015 - RNA, 19 nt, Homo sapiens
gaagggagagccuggagau

SEQ ID NO: 106016 - RNA, 19 nt, Homo sapiens
ucaaaggucacagagguua

SEQ ID NO: 106017 - RNA, 19 nt, Homo sapiens
ggcagaggcaggaaacuaa

SEQ ID NO: 106018 - RNA, 19 nt, Homo sapiens
uggcugaccugaccugaug

SEQ ID NO: 106019 - RNA, 19 nt, Homo sapiens
aggagaagcuggugcacaa

SEQ ID NO: 106020 - RNA, 19 nt, Homo sapiens
ucaaggauuucaaggcaau

SEQ ID NO: 106021 - RNA, 19 nt, Homo sapiens
ggagacaucaaggauauug

SEQ ID NO: 106022 - RNA, 19 nt, Homo sapiens
ucaaacaccucuguauuuu

SEQ ID NO: 106023 - RNA, 19 nt, Homo sapiens
uaacuggugugagucaaau

SEQ ID NO: 106024 - RNA, 19 nt, Homo sapiens
ggacccaaguacuuuccaa

SEQ ID NO: 106025 - RNA, 19 nt, Homo sapiens
ucaagucccucaacaacca

SEQ ID NO: 106026 - RNA, 19 nt, Homo sapiens
caauggugcuauucugugu

SEQ ID NO: 106027 - RNA, 19 nt, Homo sapiens
cuaggacucugcacugaau

SEQ ID NO: 106028 - RNA, 19 nt, Homo sapiens
caaacguucccaagaagaa

SEQ ID NO: 106029 - RNA, 19 nt, Homo sapiens
gcagcaagagcaaggagaa

SEQ ID NO: 106030 - RNA, 19 nt, Homo sapiens
gaguggagacuacuggauu

SEQ ID NO: 106031 - RNA, 19 nt, Homo sapiens
ucaaggcaauccuggugaa

SEQ ID NO: 106032 - RNA, 19 nt, Homo sapiens
agacaucaaggauauugua

SEQ ID NO: 106033 - RNA, 19 nt, Homo sapiens
cuggagacaucaaggauau

SEQ ID NO: 106034 - RNA, 19 nt, Homo sapiens
agaagaaacacaucugguu

SEQ ID NO: 106035 - RNA, 19 nt, Homo sapiens
gcaaacguucccaagaaga

SEQ ID NO: 106036 - RNA, 19 nt, Homo sapiens
uggagugacugguccuaaa

SEQ ID NO: 106037 - RNA, 19 nt, Homo sapiens
gguauaaugauaaggaugu

SEQ ID NO: 106038 - RNA, 19 nt, Homo sapiens
gauggcugcacgaaacaua

SEQ ID NO: 106039 - RNA, 19 nt, Homo sapiens
gagguauaaugauaaggau

SEQ ID NO: 106040 - RNA, 19 nt, Homo sapiens
ccaaguacuuuccaaucuc

SEQ ID NO: 106041 - RNA, 19 nt, Homo sapiens
gggugacguuggugagaaa

SEQ ID NO: 106042 - RNA, 19 nt, Homo sapiens
ugguauugcuggcuucaaa

SEQ ID NO: 106043 - RNA, 19 nt, Homo sapiens
uggaauuccuggagccaaa

SEQ ID NO: 106044 - RNA, 19 nt, Homo sapiens
uggaaagccuggugaugau

SEQ ID NO: 106045 - RNA, 19 nt, Homo sapiens
caagaaggcccugcucauc

SEQ ID NO: 106046 - RNA, 19 nt, Homo sapiens
ggccaagggugagcaagga

SEQ ID NO: 106047 - RNA, 19 nt, Homo sapiens
gcacugauggucccaaagg

SEQ ID NO: 106048 - RNA, 19 nt, Homo sapiens
acacaauggugcuauucug

SEQ ID NO: 106049 - RNA, 19 nt, Homo sapiens
gaacccagaaacaacacaa

SEQ ID NO: 106050 - RNA, 19 nt, Homo sapiens
ggaaggcucccagaacauc

SEQ ID NO: 106051 - RNA, 19 nt, Homo sapiens
ucaagguccucgcggugaa

SEQ ID NO: 106052 - RNA, 19 nt, Homo sapiens
ucagggugcucgugguuuc

SEQ ID NO: 106053 - RNA, 19 nt, Homo sapiens
aggagaaccuggagacauc

SEQ ID NO: 106054 - RNA, 19 nt, Homo sapiens
ugucaaacaccucuguauu

SEQ ID NO: 106055 - RNA, 19 nt, Homo sapiens
ggcagagguauaaugauaa

SEQ ID NO: 106056 - RNA, 19 nt, Homo sapiens
caagaacagcauugccuau

SEQ ID NO: 106057 - RNA, 19 nt, Homo sapiens
acacucaagucccucaaca

SEQ ID NO: 106058 - RNA, 19 nt, Homo sapiens
caaucuggcucccaacacu

SEQ ID NO: 106059 - RNA, 19 nt, Homo sapiens
uggagagccuggcgagaga

SEQ ID NO: 106060 - RNA, 19 nt, Homo sapiens
caggaugggcagagguaua

SEQ ID NO: 106061 - RNA, 19 nt, Homo sapiens
gcgcaggaacugugugugu

SEQ ID NO: 106062 - RNA, 19 nt, Homo sapiens
ucucgguguucuauuuauu

SEQ ID NO: 106063 - RNA, 19 nt, Homo sapiens
gaccugaacugggcagacu

SEQ ID NO: 106064 - RNA, 19 nt, Homo sapiens
aaggauggcugcacgaaac

SEQ ID NO: 106065 - RNA, 19 nt, Homo sapiens
caagagcaaggagaagaaa

SEQ ID NO: 106066 - RNA, 19 nt, Homo sapiens
uggccugccuggugaaaga

SEQ ID NO: 106067 - RNA, 19 nt, Homo sapiens
cccaaguacuuuccaaucu

SEQ ID NO: 106068 - RNA, 19 nt, Homo sapiens
cgacauaaucugugaagac

SEQ ID NO: 106069 - RNA, 19 nt, Homo sapiens
uggaaaagauggucccaaa

SEQ ID NO: 106070 - RNA, 19 nt, Homo sapiens
uggacccgcuggugaagaa

SEQ ID NO: 106071 - RNA, 19 nt, Homo sapiens
gaugggcagagguauaaug

SEQ ID NO: 106072 - RNA, 19 nt, Homo sapiens
cgaaacauaccgguaagug

SEQ ID NO: 106073 - RNA, 19 nt, Homo sapiens
ucacguacacugcccugaa

SEQ ID NO: 106074 - RNA, 19 nt, Homo sapiens
ggaccaaagggacagaaag

SEQ ID NO: 106075 - RNA, 19 nt, Homo sapiens
acggaaggcucccagaaca

SEQ ID NO: 106076 - RNA, 19 nt, Homo sapiens
ccacggaaggcucccagaa

SEQ ID NO: 106077 - RNA, 19 nt, Homo sapiens
uggcuuccauuucagcuau

SEQ ID NO: 106078 - RNA, 19 nt, Homo sapiens
aaagauggugcuaauggaa

SEQ ID NO: 106079 - RNA, 19 nt, Homo sapiens
gggagagccuggagaugac

SEQ ID NO: 106080 - RNA, 19 nt, Homo sapiens
ccuacacaauggugcuauu

SEQ ID NO: 106081 - RNA, 19 nt, Homo sapiens
aauagcagguucacguaca

SEQ ID NO: 106082 - RNA, 19 nt, Homo sapiens
gcagcuggcaaccucaaga

SEQ ID NO: 106083 - RNA, 19 nt, Homo sapiens
agaacagcauugccuaucu

SEQ ID NO: 106084 - RNA, 19 nt, Homo sapiens
ccagcaaacguucccaaga

SEQ ID NO: 106085 - RNA, 19 nt, Homo sapiens
gaaaagauggucccaaagg

SEQ ID NO: 106086 - RNA, 19 nt, Homo sapiens
ggagugacugguccuaaag

SEQ ID NO: 106087 - RNA, 19 nt, Homo sapiens
gcaagacuguuaucgagua

SEQ ID NO: 106088 - RNA, 19 nt, Homo sapiens
gaaacuaacuggugugagu

SEQ ID NO: 106089 - RNA, 19 nt, Homo sapiens
ggaauucgguguggacaua

SEQ ID NO: 106090 - RNA, 19 nt, Homo sapiens
gcacgaaacauaccgguaa

SEQ ID NO: 106091 - RNA, 19 nt, Homo sapiens
cagcaaacguucccaagaa

SEQ ID NO: 106092 - RNA, 19 nt, Homo sapiens
ccaagggccuccugcauga

SEQ ID NO: 106093 - RNA, 19 nt, Homo sapiens
gaacagcauugccuaucug

SEQ ID NO: 106094 - RNA, 19 nt, Homo sapiens
caucaaggauauuguagga

SEQ ID NO: 106095 - RNA, 19 nt, Homo sapiens
gcaaagauggugcuaaugg

SEQ ID NO: 106096 - RNA, 19 nt, Homo sapiens
gcaaggagacagaggagaa

SEQ ID NO: 106097 - RNA, 19 nt, Homo sapiens
aaacuuugcugcccagaug

SEQ ID NO: 106098 - RNA, 19 nt, Homo sapiens
caaagauggugcuaaugga

SEQ ID NO: 106099 - RNA, 19 nt, Homo sapiens
gucaaacaccucuguauuu

SEQ ID NO: 106100 - RNA, 19 nt, Homo sapiens
uggcaaagcuggugagaag

SEQ ID NO: 106101 - RNA, 19 nt, Homo sapiens
ccaaaggacccaaguacuu

SEQ ID NO: 106102 - RNA, 19 nt, Homo sapiens
gcaauagcagguucacgua

SEQ ID NO: 106103 - RNA, 19 nt, Homo sapiens
gaccugaccugauguccau

SEQ ID NO: 106104 - RNA, 19 nt, Homo sapiens
caaguacuuuccaaucuca

SEQ ID NO: 106105 - RNA, 19 nt, Homo sapiens
gcaagagcaaggagaagaa

SEQ ID NO: 106106 - RNA, 19 nt, Homo sapiens
uggcaaagauggugcuaau

SEQ ID NO: 106107 - RNA, 19 nt, Homo sapiens
uggcaaagauggugagaca

SEQ ID NO: 106108 - RNA, 19 nt, Homo sapiens
gcuggaggauuugaugaaa

SEQ ID NO: 106109 - RNA, 19 nt, Homo sapiens
gaguaccggucacagaaga

SEQ ID NO: 106110 - RNA, 19 nt, Homo sapiens
gcaaggagaagaaacacau

SEQ ID NO: 106111 - RNA, 19 nt, Homo sapiens
gaaggauggcugcacgaaa

SEQ ID NO: 106112 - RNA, 19 nt, Homo sapiens
gaagggagagccuggagau

SEQ ID NO: 106113 - RNA, 19 nt, Homo sapiens
ucaaaggucacagagguua

SEQ ID NO: 106114 - RNA, 19 nt, Homo sapiens
ggcagaggcaggaaacuaa

SEQ ID NO: 106115 - RNA, 19 nt, Homo sapiens
uggcugaccugaccugaug

SEQ ID NO: 106116 - RNA, 19 nt, Homo sapiens
aggagaagcuggugcacaa

SEQ ID NO: 106117 - RNA, 19 nt, Homo sapiens
ucaaggauuucaaggcaau

SEQ ID NO: 106118 - RNA, 19 nt, Homo sapiens
ggagacaucaaggauauug

SEQ ID NO: 106119 - RNA, 19 nt, Homo sapiens
ucaaacaccucuguauuuu

SEQ ID NO: 106120 - RNA, 19 nt, Homo sapiens
uaacuggugugagucaaau

SEQ ID NO: 106121 - RNA, 19 nt, Homo sapiens
ggacccaaguacuuuccaa

SEQ ID NO: 106122 - RNA, 19 nt, Homo sapiens
ucaagucccucaacaacca

SEQ ID NO: 106123 - RNA, 19 nt, Homo sapiens
caauggugcuauucugugu

SEQ ID NO: 106124 - RNA, 19 nt, Homo sapiens
cuaggacucugcacugaau

SEQ ID NO: 106125 - RNA, 19 nt, Homo sapiens
caaacguucccaagaagaa

SEQ ID NO: 106126 - RNA, 19 nt, Homo sapiens
cuggagacaucaaggauau

SEQ ID NO: 106127 - RNA, 19 nt, Homo sapiens
agacaucaaggauauugua

SEQ ID NO: 106128 - RNA, 19 nt, Homo sapiens
gcagcaagagcaaggagaa

SEQ ID NO: 106129 - RNA, 19 nt, Homo sapiens
gaguggagacuacuggauu

SEQ ID NO: 106130 - RNA, 19 nt, Homo sapiens
ucaaggcaauccuggugaa

SEQ ID NO: 106131 - RNA, 19 nt, Homo sapiens
agaagaaacacaucugguu

SEQ ID NO: 106132 - RNA, 19 nt, Homo sapiens
gcaaacguucccaagaaga

SEQ ID NO: 106133 - RNA, 19 nt, Homo sapiens
uggagugacugguccuaaa

SEQ ID NO: 106134 - RNA, 19 nt, Homo sapiens
gauggcugcacgaaacaua

SEQ ID NO: 106135 - RNA, 19 nt, Homo sapiens
ccaaguacuuuccaaucuc

SEQ ID NO: 106136 - RNA, 19 nt, Homo sapiens
gggugacguuggugagaaa

SEQ ID NO: 106137 - RNA, 19 nt, Homo sapiens
ugguauugcuggcuucaaa

SEQ ID NO: 106138 - RNA, 19 nt, Homo sapiens
uggaauuccuggagccaaa

SEQ ID NO: 106139 - RNA, 19 nt, Homo sapiens
uggaaagccuggugaugau

SEQ ID NO: 106140 - RNA, 19 nt, Homo sapiens
caagaaggcccugcucauc

SEQ ID NO: 106141 - RNA, 19 nt, Homo sapiens
ggccaagggugagcaagga

SEQ ID NO: 106142 - RNA, 19 nt, Homo sapiens
gcacugauggucccaaagg

SEQ ID NO: 106143 - RNA, 19 nt, Homo sapiens
acacaauggugcuauucug

SEQ ID NO: 106144 - RNA, 19 nt, Homo sapiens
gaacccagaaacaacacaa

SEQ ID NO: 106145 - RNA, 19 nt, Homo sapiens
ggaaggcucccagaacauc

SEQ ID NO: 106146 - RNA, 19 nt, Homo sapiens
aggagaaccuggagacauc

SEQ ID NO: 106147 - RNA, 19 nt, Homo sapiens
ucaagguccucgcggugaa

SEQ ID NO: 106148 - RNA, 19 nt, Homo sapiens
ucagggugcucgugguuuc

SEQ ID NO: 106149 - RNA, 19 nt, Homo sapiens
ugucaaacaccucuguauu

SEQ ID NO: 106150 - RNA, 19 nt, Homo sapiens
caagaacagcauugccuau

SEQ ID NO: 106151 - RNA, 19 nt, Homo sapiens
acacucaagucccucaaca

SEQ ID NO: 106152 - RNA, 19 nt, Homo sapiens
caaucuggcucccaacacu

SEQ ID NO: 106153 - RNA, 19 nt, Homo sapiens
uggagagccuggcgagaga

SEQ ID NO: 106154 - RNA, 19 nt, Homo sapiens
gcgcaggaacugugugugu

SEQ ID NO: 106155 - RNA, 19 nt, Homo sapiens
ucucgguguucuauuuauu

SEQ ID NO: 106156 - RNA, 19 nt, Homo sapiens
gaccugaacugggcagacu

SEQ ID NO: 106157 - RNA, 19 nt, Homo sapiens
aaggauggcugcacgaaac

SEQ ID NO: 106158 - RNA, 19 nt, Homo sapiens
caagagcaaggagaagaaa

SEQ ID NO: 106159 - RNA, 19 nt, Homo sapiens
uggccugccuggugaaaga

SEQ ID NO: 106160 - RNA, 19 nt, Homo sapiens
cccaaguacuuuccaaucu

SEQ ID NO: 106161 - RNA, 19 nt, Homo sapiens
uggaaaagauggucccaaa

SEQ ID NO: 106162 - RNA, 19 nt, Homo sapiens
uggacccgcuggugaagaa

SEQ ID NO: 106163 - RNA, 19 nt, Homo sapiens
ggaccaaagggacagaaag

SEQ ID NO: 106164 - RNA, 19 nt, Homo sapiens
cgaaacauaccgguaagug

SEQ ID NO: 106165 - RNA, 19 nt, Homo sapiens
ucacguacacugcccugaa

SEQ ID NO: 106166 - RNA, 19 nt, Homo sapiens
acggaaggcucccagaaca

SEQ ID NO: 106167 - RNA, 19 nt, Homo sapiens
ccacggaaggcucccagaa

SEQ ID NO: 106168 - RNA, 19 nt, Homo sapiens
uggcuuccauuucagcuau

SEQ ID NO: 106169 - RNA, 19 nt, Homo sapiens
aaagauggugcuaauggaa

SEQ ID NO: 106170 - RNA, 19 nt, Homo sapiens
gggagagccuggagaugac

SEQ ID NO: 106171 - RNA, 19 nt, Homo sapiens
ccuacacaauggugcuauu

SEQ ID NO: 106172 - RNA, 19 nt, Homo sapiens
aauagcagguucacguaca

SEQ ID NO: 106173 - RNA, 19 nt, Homo sapiens
gcagcuggcaaccucaaga

SEQ ID NO: 106174 - RNA, 19 nt, Homo sapiens
agaacagcauugccuaucu

SEQ ID NO: 106175 - RNA, 19 nt, Homo sapiens
ccagcaaacguucccaaga

SEQ ID NO: 106176 - RNA, 19 nt, Homo sapiens
gaaaagauggucccaaagg

SEQ ID NO: 106177 - RNA, 19 nt, Homo sapiens
ggagugacugguccuaaag

SEQ ID NO: 106178 - RNA, 19 nt, Homo sapiens
aaagaggugcucccggaaa

SEQ ID NO: 106179 - RNA, 19 nt, Homo sapiens
guaaugcaaggaccaaugg

SEQ ID NO: 106180 - RNA, 19 nt, Homo sapiens
uggcagagauggagaaccu

SEQ ID NO: 106181 - RNA, 19 nt, Homo sapiens
guggaagaguggagacuac

SEQ ID NO: 106182 - RNA, 19 nt, Homo sapiens
caacggugagccuggcaaa

SEQ ID NO: 106183 - RNA, 19 nt, Homo sapiens
uggaaaagcuggugaaagg

SEQ ID NO: 106184 - RNA, 19 nt, Homo sapiens
cuggaaagccuggugauga

SEQ ID NO: 106185 - RNA, 19 nt, Homo sapiens
aaucucgguguucuauuua

SEQ ID NO: 106186 - RNA, 19 nt, Homo sapiens
ccggucugcuucuuguaaa

SEQ ID NO: 106187 - RNA, 19 nt, Homo sapiens
caaagagucucaugucuga

SEQ ID NO: 106188 - RNA, 19 nt, Homo sapiens
gaucagaauuguugacuug

SEQ ID NO: 106189 - RNA, 19 nt, Homo sapiens
gauaucaacugcuuguaaa

SEQ ID NO: 106190 - RNA, 19 nt, Homo sapiens
guacaugucucccaucaga

SEQ ID NO: 106191 - RNA, 19 nt, Homo sapiens
caaaggacaucgaggauuc

SEQ ID NO: 106192 - RNA, 19 nt, Homo sapiens
gagaugaaccaauggauuu

SEQ ID NO: 106193 - RNA, 19 nt, Homo sapiens
cagaggagcugcuggagaa

SEQ ID NO: 106194 - RNA, 19 nt, Homo sapiens
caaauuggaugcuaucaag

SEQ ID NO: 106195 - RNA, 19 nt, Homo sapiens
caaauagaaagccucauua

SEQ ID NO: 106196 - RNA, 19 nt, Homo sapiens
ucucugcgaugacauaaua

SEQ ID NO: 106197 - RNA, 19 nt, Homo sapiens
ucucaauggugcuauaaua

SEQ ID NO: 106198 - RNA, 19 nt, Homo sapiens
ccagaaccaugccaaauau

SEQ ID NO: 106199 - RNA, 19 nt, Homo sapiens
uuacagacacccauaauaa

SEQ ID NO: 106200 - RNA, 19 nt, Homo sapiens
cuguaaaggucaacaauaa

SEQ ID NO: 106201 - RNA, 19 nt, Homo sapiens
uaucugaaaucccaacaaa

SEQ ID NO: 106202 - RNA, 19 nt, Homo sapiens
aaaccaaacucuaucugaa

SEQ ID NO: 106203 - RNA, 19 nt, Homo sapiens
gcuaauguacuuucacuuu

SEQ ID NO: 106204 - RNA, 19 nt, Homo sapiens
ugaaggaaauagcaaauuc

SEQ ID NO: 106205 - RNA, 19 nt, Homo sapiens
caucgaggauucccuggua

SEQ ID NO: 106206 - RNA, 19 nt, Homo sapiens
ggauaucaacugcuuguaa

SEQ ID NO: 106207 - RNA, 19 nt, Homo sapiens
caaauucaccuacacaguu

SEQ ID NO: 106208 - RNA, 19 nt, Homo sapiens
caucacauaucacugcaaa

SEQ ID NO: 106209 - RNA, 19 nt, Homo sapiens
ggagaauguugugcaguuu

SEQ ID NO: 106210 - RNA, 19 nt, Homo sapiens
ccgaugagauuaugacuuc

SEQ ID NO: 106211 - RNA, 19 nt, Homo sapiens
ugauuaaucuccuggaaga

SEQ ID NO: 106212 - RNA, 19 nt, Homo sapiens
caacaccgaugagauuaug

SEQ ID NO: 106213 - RNA, 19 nt, Homo sapiens
gccagaaccaugccaaaua

SEQ ID NO: 106214 - RNA, 19 nt, Homo sapiens
gcauagagaauguguugaa

SEQ ID NO: 106215 - RNA, 19 nt, Homo sapiens
gcugugagacuaccuauug

SEQ ID NO: 106216 - RNA, 19 nt, Homo sapiens
ggaggaugguugcacgaaa

SEQ ID NO: 106217 - RNA, 19 nt, Homo sapiens
gauuaugacuucacucaag

SEQ ID NO: 106218 - RNA, 19 nt, Homo sapiens
uaagaauggugccaaagga

SEQ ID NO: 106219 - RNA, 19 nt, Homo sapiens
uaaccaaggaugcaaauug

SEQ ID NO: 106220 - RNA, 19 nt, Homo sapiens
gaaauucugccauccugaa

SEQ ID NO: 106221 - RNA, 19 nt, Homo sapiens
gcacaaagagucucauguc

SEQ ID NO: 106222 - RNA, 19 nt, Homo sapiens
aaacacugguggacagauu

SEQ ID NO: 106223 - RNA, 19 nt, Homo sapiens
ggagaugaaccaauggauu

SEQ ID NO: 106224 - RNA, 19 nt, Homo sapiens
ucucaugucugauauuuag

SEQ ID NO: 106225 - RNA, 19 nt, Homo sapiens
guucuaaucuugucaacca

SEQ ID NO: 106226 - RNA, 19 nt, Homo sapiens
gaaauagcaaauucaccua

SEQ ID NO: 106227 - RNA, 19 nt, Homo sapiens
gaacuauucuccccaguau

SEQ ID NO: 106228 - RNA, 19 nt, Homo sapiens
gauaaccuuucuuucugaa

SEQ ID NO: 106229 - RNA, 19 nt, Homo sapiens
gaacguggaccuccuggau

SEQ ID NO: 106230 - RNA, 19 nt, Homo sapiens
gcauaagugccaauccuuu

SEQ ID NO: 106231 - RNA, 19 nt, Homo sapiens
uggauucccugguaugaaa

SEQ ID NO: 106232 - RNA, 19 nt, Homo sapiens
gaaggaaauagcaaauuca

SEQ ID NO: 106233 - RNA, 19 nt, Homo sapiens
aggaaugccuggagaaaga

SEQ ID NO: 106234 - RNA, 19 nt, Homo sapiens
uaccucaacuggucagaaa

SEQ ID NO: 106235 - RNA, 19 nt, Homo sapiens
gcuuguaugugguuguuga

SEQ ID NO: 106236 - RNA, 19 nt, Homo sapiens
cgacaaaauuccaguuauu

SEQ ID NO: 106237 - RNA, 19 nt, Homo sapiens
cuaucaagguauucuguaa

SEQ ID NO: 106238 - RNA, 19 nt, Homo sapiens
cauagagaauguguugaaa

SEQ ID NO: 106239 - RNA, 19 nt, Homo sapiens
gcaagugaccgacaaaauu

SEQ ID NO: 106240 - RNA, 19 nt, Homo sapiens
gagauuaugacuucacuca

SEQ ID NO: 106241 - RNA, 19 nt, Homo sapiens
uggagaaccuggugcaaau

SEQ ID NO: 106242 - RNA, 19 nt, Homo sapiens
gaaauggugacccugguau

SEQ ID NO: 106243 - RNA, 19 nt, Homo sapiens
gcuuuaaagacgcauguua

SEQ ID NO: 106244 - RNA, 19 nt, Homo sapiens
ccuggaagauugguuuaaa

SEQ ID NO: 106245 - RNA, 19 nt, Homo sapiens
gcaaauuggaugcuaucaa

SEQ ID NO: 106246 - RNA, 19 nt, Homo sapiens
gaugcaaauuggaugcuau

SEQ ID NO: 106247 - RNA, 19 nt, Homo sapiens
acaaauagaaagccucauu

SEQ ID NO: 106248 - RNA, 19 nt, Homo sapiens
ucacucaagucuguuaaug

SEQ ID NO: 106249 - RNA, 19 nt, Homo sapiens
cuacugguccucagaacua

SEQ ID NO: 106250 - RNA, 19 nt, Homo sapiens
ugucauugcuggucaagau

SEQ ID NO: 106251 - RNA, 19 nt, Homo sapiens
cccagaacaucacauauca

SEQ ID NO: 106252 - RNA, 19 nt, Homo sapiens
gauggugguuuucaguuua

SEQ ID NO: 106253 - RNA, 19 nt, Homo sapiens
ggaugcaaauuggaugcua

SEQ ID NO: 106254 - RNA, 19 nt, Homo sapiens
uccaggagcugcaggagaa

SEQ ID NO: 106255 - RNA, 19 nt, Homo sapiens
cuucaucccacuauuauuu

SEQ ID NO: 106256 - RNA, 19 nt, Homo sapiens
cagauuguauucuaugagu

SEQ ID NO: 106257 - RNA, 19 nt, Homo sapiens
cagaaacacagauuguauu

SEQ ID NO: 106258 - RNA, 19 nt, Homo sapiens
ccaaauacaauucaaaugc

SEQ ID NO: 106259 - RNA, 19 nt, Homo sapiens
uaaaccaaacucuaucuga

SEQ ID NO: 106260 - RNA, 19 nt, Homo sapiens
cugaagauguccuugaugu

SEQ ID NO: 106261 - RNA, 19 nt, Homo sapiens
gccaauccuuugaauguuc

SEQ ID NO: 106262 - RNA, 19 nt, Homo sapiens
uuauggagaugaaccaaug

SEQ ID NO: 106263 - RNA, 19 nt, Homo sapiens
ugacuugcauucagaacau

SEQ ID NO: 106264 - RNA, 19 nt, Homo sapiens
cuucaacacucuuuaugau

SEQ ID NO: 106265 - RNA, 19 nt, Homo sapiens
cuacggcaauccugaacuu

SEQ ID NO: 106266 - RNA, 19 nt, Homo sapiens
acucaagucuguuaaugga

SEQ ID NO: 106267 - RNA, 19 nt, Homo sapiens
caguggaccuccuggcaaa

SEQ ID NO: 106268 - RNA, 19 nt, Homo sapiens
caagggugaucguggugaa

SEQ ID NO: 106269 - RNA, 19 nt, Homo sapiens
ggauggaucaccuggagaa

SEQ ID NO: 106270 - RNA, 19 nt, Homo sapiens
uggagaauguugugcaguu

SEQ ID NO: 106271 - RNA, 19 nt, Homo sapiens
augugacgaucaagaauua

SEQ ID NO: 106272 - RNA, 19 nt, Homo sapiens
gaaccaugccaaauaugug

SEQ ID NO: 106273 - RNA, 19 nt, Homo sapiens
ggucaguccuaugcggaua

SEQ ID NO: 106274 - RNA, 19 nt, Homo sapiens
gcaaggaaugccuggagaa

SEQ ID NO: 106275 - RNA, 19 nt, Homo sapiens
caaagguccagcugggaua

SEQ ID NO: 106276 - RNA, 19 nt, Homo sapiens
uagcauagagaauguguug

SEQ ID NO: 106277 - RNA, 19 nt, Homo sapiens
acacuagcauagagaaugu

SEQ ID NO: 106278 - RNA, 19 nt, Homo sapiens
ucagaaacacagauuguau

SEQ ID NO: 106279 - RNA, 19 nt, Homo sapiens
auagaaagccucauuaguc

SEQ ID NO: 106280 - RNA, 19 nt, Homo sapiens
acacagaggcuucgaugga

SEQ ID NO: 106281 - RNA, 19 nt, Homo sapiens
cagcugggauaccuggauu

SEQ ID NO: 106282 - RNA, 19 nt, Homo sapiens
ugucaagucuggaguagca

SEQ ID NO: 106283 - RNA, 19 nt, Homo sapiens
ggucagaaacacagauugu

SEQ ID NO: 106284 - RNA, 19 nt, Homo sapiens
agauaaccuuucuuucuga

SEQ ID NO: 106285 - RNA, 19 nt, Homo sapiens
gaggaugguugcacgaaac

SEQ ID NO: 106286 - RNA, 19 nt, Homo sapiens
gcaaauucaccuacacagu

SEQ ID NO: 106287 - RNA, 19 nt, Homo sapiens
gcaacgaacccuagaaaua

SEQ ID NO: 106288 - RNA, 19 nt, Homo sapiens
gcgauaagcuucaauagug

SEQ ID NO: 106289 - RNA, 19 nt, Homo sapiens
ggaaugggcuugccaggaa

SEQ ID NO: 106290 - RNA, 19 nt, Homo sapiens
gcucaaaggugacaaagga

SEQ ID NO: 106291 - RNA, 19 nt, Homo sapiens
ggagcgagauguucaagaa

SEQ ID NO: 106292 - RNA, 19 nt, Homo sapiens
aaagggagaucaagggaua

SEQ ID NO: 106293 - RNA, 19 nt, Homo sapiens
ccaaugcacugauguguga

SEQ ID NO: 106294 - RNA, 19 nt, Homo sapiens
gaauaaagaugguccaaaa

SEQ ID NO: 106295 - RNA, 19 nt, Homo sapiens
guaccucacuguccaauau

SEQ ID NO: 106296 - RNA, 19 nt, Homo sapiens
gaaagacugugcuguccuu

SEQ ID NO: 106297 - RNA, 19 nt, Homo sapiens
ggacaaaugggcuuaaguu

SEQ ID NO: 106298 - RNA, 19 nt, Homo sapiens
uaaaggugauccagguaua

SEQ ID NO: 106299 - RNA, 19 nt, Homo sapiens
ggagagaaaggacaaauug

SEQ ID NO: 106300 - RNA, 19 nt, Homo sapiens
caaagguguugacggcuua

SEQ ID NO: 106301 - RNA, 19 nt, Homo sapiens
caaauggaauuguggaaug

SEQ ID NO: 106302 - RNA, 19 nt, Homo sapiens
uaaaggccgucauuucauu

SEQ ID NO: 106303 - RNA, 19 nt, Homo sapiens
agacugugcuguccuuuaa

SEQ ID NO: 106304 - RNA, 19 nt, Homo sapiens
uaaagugccuuauaggaau

SEQ ID NO: 106305 - RNA, 19 nt, Homo sapiens
caacgaacccuagaaauau

SEQ ID NO: 106306 - RNA, 19 nt, Homo sapiens
uaacacacccugcuucauu

SEQ ID NO: 106307 - RNA, 19 nt, Homo sapiens
ggagagaguugccucaucu

SEQ ID NO: 106308 - RNA, 19 nt, Homo sapiens
gggagacccuggcuugaaa

SEQ ID NO: 106309 - RNA, 19 nt, Homo sapiens
guaaagugccuuauaggaa

SEQ ID NO: 106310 - RNA, 19 nt, Homo sapiens
gcagaucaagguuuaguuu

SEQ ID NO: 106311 - RNA, 19 nt, Homo sapiens
cgcaaacgcuuacagcuuu

SEQ ID NO: 106312 - RNA, 19 nt, Homo sapiens
uuaggcagaucaagguuua

SEQ ID NO: 106313 - RNA, 19 nt, Homo sapiens
gcaauccaaugcacugaug

SEQ ID NO: 106314 - RNA, 19 nt, Homo sapiens
agaaauauauccuguguac

SEQ ID NO: 106315 - RNA, 19 nt, Homo sapiens
acaaaggccucccaggauu

SEQ ID NO: 106316 - RNA, 19 nt, Homo sapiens
uggcuuaccuggagacaaa

SEQ ID NO: 106317 - RNA, 19 nt, Homo sapiens
caaaugggcuuaaguuuuc

SEQ ID NO: 106318 - RNA, 19 nt, Homo sapiens
gcacaaugcccuuccuguu

SEQ ID NO: 106319 - RNA, 19 nt, Homo sapiens
uaacaacgugugcaacuuu

SEQ ID NO: 106320 - RNA, 19 nt, Homo sapiens
gaagggagagccuggaguu

SEQ ID NO: 106321 - RNA, 19 nt, Homo sapiens
ccaaggagaccgaggcuuu

SEQ ID NO: 106322 - RNA, 19 nt, Homo sapiens
gaaaggugaaagaggauuu

SEQ ID NO: 106323 - RNA, 19 nt, Homo sapiens
ggaauuugcguaacuaaca

SEQ ID NO: 106324 - RNA, 19 nt, Homo sapiens
gcaagguguuacaggauug

SEQ ID NO: 106325 - RNA, 19 nt, Homo sapiens
caaaggagagcaaggauuc

SEQ ID NO: 106326 - RNA, 19 nt, Homo sapiens
ggccgucauuucauuagua

SEQ ID NO: 106327 - RNA, 19 nt, Homo sapiens
agacuaggauauugaaugu

SEQ ID NO: 106328 - RNA, 19 nt, Homo sapiens
uggcaucccuggugucaaa

SEQ ID NO: 106329 - RNA, 19 nt, Homo sapiens
agaguugccucaucuguga

SEQ ID NO: 106330 - RNA, 19 nt, Homo sapiens
ucaugaauauggugucuau

SEQ ID NO: 106331 - RNA, 19 nt, Homo sapiens
cggcuuaccuggagacaug

SEQ ID NO: 106332 - RNA, 19 nt, Homo sapiens
acuaggauauugaauguga

SEQ ID NO: 106333 - RNA, 19 nt, Homo sapiens
agugaaacauguacuuuga

SEQ ID NO: 106334 - RNA, 19 nt, Homo sapiens
cuagaaauauauccugugu

SEQ ID NO: 106335 - RNA, 19 nt, Homo sapiens
aggaacaccuggagagaaa

SEQ ID NO: 106336 - RNA, 19 nt, Homo sapiens
agugagaacuccaucagaa

SEQ ID NO: 106337 - RNA, 19 nt, Homo sapiens
gaaucacaguaucaguauu

SEQ ID NO: 106338 - RNA, 19 nt, Homo sapiens
aacgaacccuagaaauaua

SEQ ID NO: 106339 - RNA, 19 nt, Homo sapiens
gggcaugccugguauuggu

SEQ ID NO: 106340 - RNA, 19 nt, Homo sapiens
caaaggagacaaagguuca

SEQ ID NO: 106341 - RNA, 19 nt, Homo sapiens
gaaaugacuacucguacug

SEQ ID NO: 106342 - RNA, 19 nt, Homo sapiens
uuccuguucugcaauauua

SEQ ID NO: 106343 - RNA, 19 nt, Homo sapiens
gaaccaggucuaccaggaa

SEQ ID NO: 106344 - RNA, 19 nt, Homo sapiens
gcaucuggcuacccuggaa

SEQ ID NO: 106345 - RNA, 19 nt, Homo sapiens
gacaaaugggcuuaaguuu

SEQ ID NO: 106346 - RNA, 19 nt, Homo sapiens
cccuuggucuguacaaaua

SEQ ID NO: 106347 - RNA, 19 nt, Homo sapiens
gaccaggcauagucaaaca

SEQ ID NO: 106348 - RNA, 19 nt, Homo sapiens
uaccgggacucaaagguuu

SEQ ID NO: 106349 - RNA, 19 nt, Homo sapiens
gaucaagguuuaguuuaac

SEQ ID NO: 106350 - RNA, 19 nt, Homo sapiens
ggaauaaagaugguccaaa

SEQ ID NO: 106351 - RNA, 19 nt, Homo sapiens
gaagugcgccauucaucga

SEQ ID NO: 106352 - RNA, 19 nt, Homo sapiens
caacuuugcaucacgaaau

SEQ ID NO: 106353 - RNA, 19 nt, Homo sapiens
agugggugcuccuggauua

SEQ ID NO: 106354 - RNA, 19 nt, Homo sapiens
uggcuucccuggugaaaga

SEQ ID NO: 106355 - RNA, 19 nt, Homo sapiens
cagaucaagguuuaguuua

SEQ ID NO: 106356 - RNA, 19 nt, Homo sapiens
ccagaaaggagaccaagga

SEQ ID NO: 106357 - RNA, 19 nt, Homo sapiens
caaggacucccuggcauaa

SEQ ID NO: 106358 - RNA, 19 nt, Homo sapiens
cggaaaagauggugacaaa

SEQ ID NO: 106359 - RNA, 19 nt, Homo sapiens
ggaauuacagacucaguag

SEQ ID NO: 106360 - RNA, 19 nt, Homo sapiens
ugccaagucuguaugagaa

SEQ ID NO: 106361 - RNA, 19 nt, Homo sapiens
uccaggaguuccaggauuu

SEQ ID NO: 106362 - RNA, 19 nt, Homo sapiens
gacaaaggccucccaggau

SEQ ID NO: 106363 - RNA, 19 nt, Homo sapiens
agacaaaggugcaaaagga

SEQ ID NO: 106364 - RNA, 19 nt, Homo sapiens
gaacauaagaagccugacu

SEQ ID NO: 106365 - RNA, 19 nt, Homo sapiens
gagaggagcgagauguuca

SEQ ID NO: 106366 - RNA, 19 nt, Homo sapiens
ugagauacuuggccaugug

SEQ ID NO: 106367 - RNA, 19 nt, Homo sapiens
aaacauguacuuugagcuu

SEQ ID NO: 106368 - RNA, 19 nt, Homo sapiens
cagcaacgaacccuagaaa

SEQ ID NO: 106369 - RNA, 19 nt, Homo sapiens
cgaaaugacuacucguacu

SEQ ID NO: 106370 - RNA, 19 nt, Homo sapiens
gaaaggccagcaagguguu

SEQ ID NO: 106371 - RNA, 19 nt, Homo sapiens
gggcagauucggaccacua

SEQ ID NO: 106372 - RNA, 19 nt, Homo sapiens
caaacugaaugacuugacu

SEQ ID NO: 106373 - RNA, 19 nt, Homo sapiens
gugcuguccuuuaacauag

SEQ ID NO: 106374 - RNA, 19 nt, Homo sapiens
aguuaaaggugacaaagga

SEQ ID NO: 106375 - RNA, 19 nt, Homo sapiens
caaaggagaagcaggucuu

SEQ ID NO: 106376 - RNA, 19 nt, Homo sapiens
ggaccaaguggaagagaug

SEQ ID NO: 106377 - RNA, 19 nt, Homo sapiens
cacaggaccuuugggagaa

SEQ ID NO: 106378 - RNA, 19 nt, Homo sapiens
aggacaagcucaaguucaa

SEQ ID NO: 106379 - RNA, 19 nt, Homo sapiens
ucauuaguauuccucauuc

SEQ ID NO: 106380 - RNA, 19 nt, Homo sapiens
ccauacuguuugcccauuu

SEQ ID NO: 106381 - RNA, 19 nt, Homo sapiens
aagcuucaauaguggcaua

SEQ ID NO: 106382 - RNA, 19 nt, Homo sapiens
caacauggugcuacuucuu

SEQ ID NO: 106383 - RNA, 19 nt, Homo sapiens
ugggauugauggaguuaaa

SEQ ID NO: 106384 - RNA, 19 nt, Homo sapiens
caaagggugagguggguuu

SEQ ID NO: 106385 - RNA, 19 nt, Homo sapiens
gaaccgggaccuccuggau

SEQ ID NO: 106386 - RNA, 19 nt, Homo sapiens
uggcagagaugguguugca

SEQ ID NO: 106387 - RNA, 19 nt, Homo sapiens
gggcaggccugguguguuu

SEQ ID NO: 106388 - RNA, 19 nt, Homo sapiens
uaaaggaauugauggaaug

SEQ ID NO: 106389 - RNA, 19 nt, Homo sapiens
gcgaugggcucgauggauu

SEQ ID NO: 106390 - RNA, 19 nt, Homo sapiens
cgacgaagcuaucaaaggu

SEQ ID NO: 106391 - RNA, 19 nt, Homo sapiens
caaauaccguugaugugaa

SEQ ID NO: 106392 - RNA, 19 nt, Homo sapiens
caagaggcguuucuggauu

SEQ ID NO: 106393 - RNA, 19 nt, Homo sapiens
gaaugcagauguacagaag

SEQ ID NO: 106394 - RNA, 19 nt, Homo sapiens
uaagaggcauuuccuugaa

SEQ ID NO: 106395 - RNA, 19 nt, Homo sapiens
cgaaggcgguggccaauca

SEQ ID NO: 106396 - RNA, 19 nt, Homo sapiens
ccguugaugugaauuauuu

SEQ ID NO: 106397 - RNA, 19 nt, Homo sapiens
ggugaugucugcuacuaug

SEQ ID NO: 106398 - RNA, 19 nt, Homo sapiens
uauuuggccugaaagguua

SEQ ID NO: 106399 - RNA, 19 nt, Homo sapiens
caaaggcgaggcuggauuu

SEQ ID NO: 106400 - RNA, 19 nt, Homo sapiens
caacagaggacuugguuuc

SEQ ID NO: 106401 - RNA, 19 nt, Homo sapiens
ccaaauaccguugauguga

SEQ ID NO: 106402 - RNA, 19 nt, Homo sapiens
gagcaaggccauccaggaa

SEQ ID NO: 106403 - RNA, 19 nt, Homo sapiens
ccugauggcuuccuguuug

SEQ ID NO: 106404 - RNA, 19 nt, Homo sapiens
gaagggagaagaaggaauc

SEQ ID NO: 106405 - RNA, 19 nt, Homo sapiens
gcaaaaccgugcucuuuau

SEQ ID NO: 106406 - RNA, 19 nt, Homo sapiens
ccacugcacuuuccaaugc

SEQ ID NO: 106407 - RNA, 19 nt, Homo sapiens
gcuccgggcuuaccagguu

SEQ ID NO: 106408 - RNA, 19 nt, Homo sapiens
ccacagacaacucacauug

SEQ ID NO: 106409 - RNA, 19 nt, Homo sapiens
aggaagcccuggauuuaaa

SEQ ID NO: 106410 - RNA, 19 nt, Homo sapiens
ccagaacaaucacaaccaa

SEQ ID NO: 106411 - RNA, 19 nt, Homo sapiens
ccaacgggauuccaucaga

SEQ ID NO: 106412 - RNA, 19 nt, Homo sapiens
gaaggucugccuggugaua

SEQ ID NO: 106413 - RNA, 19 nt, Homo sapiens
caacucacauuguucaacu

SEQ ID NO: 106414 - RNA, 19 nt, Homo sapiens
ccaaggcccuccuggacuu

SEQ ID NO: 106415 - RNA, 19 nt, Homo sapiens
gcaagaggcguuucuggau

SEQ ID NO: 106416 - RNA, 19 nt, Homo sapiens
gaagauugccguccaacca

SEQ ID NO: 106417 - RNA, 19 nt, Homo sapiens
caagggagacccaggauuc

SEQ ID NO: 106418 - RNA, 19 nt, Homo sapiens
aagaggagcgcgacagaua

SEQ ID NO: 106419 - RNA, 19 nt, Homo sapiens
caaugggccaccaggauua

SEQ ID NO: 106420 - RNA, 19 nt, Homo sapiens
caccugggauggaugguuu

SEQ ID NO: 106421 - RNA, 19 nt, Homo sapiens
gcaccaugcccuuccugua

SEQ ID NO: 106422 - RNA, 19 nt, Homo sapiens
uaccaggucugaagggauu

SEQ ID NO: 106423 - RNA, 19 nt, Homo sapiens
cuuaugcacugccuaaaga

SEQ ID NO: 106424 - RNA, 19 nt, Homo sapiens
ggugcuuauucuuaacuua

SEQ ID NO: 106425 - RNA, 19 nt, Homo sapiens
ggaaugcagauguacagaa

SEQ ID NO: 106426 - RNA, 19 nt, Homo sapiens
acagaggacuugguuucua

SEQ ID NO: 106427 - RNA, 19 nt, Homo sapiens
gcaaaggcgaggcuggauu

SEQ ID NO: 106428 - RNA, 19 nt, Homo sapiens
ggauuuaaaggaauugaug

SEQ ID NO: 106429 - RNA, 19 nt, Homo sapiens
gaaaggagcaaaaggaaga

SEQ ID NO: 106430 - RNA, 19 nt, Homo sapiens
ccaccaggauuacaaggau

SEQ ID NO: 106431 - RNA, 19 nt, Homo sapiens
gcagcugucuagaggacuu

SEQ ID NO: 106432 - RNA, 19 nt, Homo sapiens
gggagaagaaggaaucaug

SEQ ID NO: 106433 - RNA, 19 nt, Homo sapiens
gaaggaaucaugggcuuuc

SEQ ID NO: 106434 - RNA, 19 nt, Homo sapiens
ggagacccuucuagacauc

SEQ ID NO: 106435 - RNA, 19 nt, Homo sapiens
ccagccagguugcauagga

SEQ ID NO: 106436 - RNA, 19 nt, Homo sapiens
gagcuguacucuucugacu

SEQ ID NO: 106437 - RNA, 19 nt, Homo sapiens
gagaucaagcccuacauca

SEQ ID NO: 106438 - RNA, 19 nt, Homo sapiens
ggagagaagggaacagaag

SEQ ID NO: 106439 - RNA, 19 nt, Homo sapiens
gggcaccacuggaauacca

SEQ ID NO: 106440 - RNA, 19 nt, Homo sapiens
gaauaagaggcauuuccuu

SEQ ID NO: 106441 - RNA, 19 nt, Homo sapiens
aaaccgugcucuuuauuuu

SEQ ID NO: 106442 - RNA, 19 nt, Homo sapiens
aggcacagcuaaccacuuc

SEQ ID NO: 106443 - RNA, 19 nt, Homo sapiens
gauauuccuuccucaugca

SEQ ID NO: 106444 - RNA, 19 nt, Homo sapiens
ggacuuaaaggacaaacag

SEQ ID NO: 106445 - RNA, 19 nt, Homo sapiens
aaaggagauuccagaacaa

SEQ ID NO: 106446 - RNA, 19 nt, Homo sapiens
ggggugagcuguacucuuc

SEQ ID NO: 106447 - RNA, 19 nt, Homo sapiens
gaacaaucacaaccaaagg

SEQ ID NO: 106448 - RNA, 19 nt, Homo sapiens
ggagaugaaggacccauag

SEQ ID NO: 106449 - RNA, 19 nt, Homo sapiens
ccagaagauugccguccaa

SEQ ID NO: 106450 - RNA, 19 nt, Homo sapiens
caaaagguauccaaggaau

SEQ ID NO: 106451 - RNA, 19 nt, Homo sapiens
aaggauaccugggcgcaaa

SEQ ID NO: 106452 - RNA, 19 nt, Homo sapiens
aaaaggagauuccagaaca

SEQ ID NO: 106453 - RNA, 19 nt, Homo sapiens
gcuaaccacuucgcacaca

SEQ ID NO: 106454 - RNA, 19 nt, Homo sapiens
aggaagagguggugugucu

SEQ ID NO: 106455 - RNA, 19 nt, Homo sapiens
caaagggagacccggguuu

SEQ ID NO: 106456 - RNA, 19 nt, Homo sapiens
cagaggacuugguuucuac

SEQ ID NO: 106457 - RNA, 19 nt, Homo sapiens
uaaagaggagcgcgacaga

SEQ ID NO: 106458 - RNA, 19 nt, Homo sapiens
aaauaccguugaugugaau

SEQ ID NO: 106459 - RNA, 19 nt, Homo sapiens
agggauauuuggccugaaa

SEQ ID NO: 106460 - RNA, 19 nt, Homo sapiens
ggucugaagggauucuuug

SEQ ID NO: 106461 - RNA, 19 nt, Homo sapiens
ccacaggagucaccuucca

SEQ ID NO: 106462 - RNA, 19 nt, Homo sapiens
ggaguuuguggaucggaua

SEQ ID NO: 106463 - RNA, 19 nt, Homo sapiens
acagaaaggagaccaagga

SEQ ID NO: 106464 - RNA, 19 nt, Homo sapiens
ggagaugaagggccuaugg

SEQ ID NO: 106465 - RNA, 19 nt, Homo sapiens
uaaaggagagaaaggagau

SEQ ID NO: 106466 - RNA, 19 nt, Homo sapiens
gaugugccguguggaggaa

SEQ ID NO: 106467 - RNA, 19 nt, Homo sapiens
uggcgggugugaagaaguu

SEQ ID NO: 106468 - RNA, 19 nt, Homo sapiens
uaggagggcccaagggauu

SEQ ID NO: 106469 - RNA, 19 nt, Homo sapiens
cguugucccugagauuuaa

SEQ ID NO: 106470 - RNA, 19 nt, Homo sapiens
guggagacccuucuagaca

SEQ ID NO: 106471 - RNA, 19 nt, Homo sapiens
cauguaaccacugcacuuu

SEQ ID NO: 106472 - RNA, 19 nt, Homo sapiens
ggaacgacaaguccuacug

SEQ ID NO: 106473 - RNA, 19 nt, Homo sapiens
ccagugcuacccugagaaa

SEQ ID NO: 106474 - RNA, 19 nt, Homo sapiens
ucccagggcugucaggaau

SEQ ID NO: 106475 - RNA, 19 nt, Homo sapiens
aagaggcguuucuggauuc

SEQ ID NO: 106476 - RNA, 19 nt, Homo sapiens
cccagguuauccaggaaua

SEQ ID NO: 106477 - RNA, 19 nt, Homo sapiens
ggcaaaaccgugcucuuua

SEQ ID NO: 106478 - RNA, 19 nt, Homo sapiens
gggaacagaaggugacauc

SEQ ID NO: 106479 - RNA, 19 nt, Homo sapiens
ggagagcaggccuguaugg

SEQ ID NO: 106480 - RNA, 19 nt, Homo sapiens
cggaauacccggucugaag

SEQ ID NO: 106481 - RNA, 19 nt, Homo sapiens
aaaggucucucuggugaca

SEQ ID NO: 106482 - RNA, 19 nt, Homo sapiens
ccaggaauaagaggcauuu

SEQ ID NO: 106483 - RNA, 19 nt, Homo sapiens
gcaaggcaacagaggacuu

SEQ ID NO: 106484 - RNA, 19 nt, Homo sapiens
ugucagccuugcuacuuga

SEQ ID NO: 106485 - RNA, 19 nt, Homo sapiens
acaaugggccaccaggauu

SEQ ID NO: 106486 - RNA, 19 nt, Homo sapiens
auaagaggcauuuccuuga

SEQ ID NO: 106487 - RNA, 19 nt, Homo sapiens
caacaaagguucuaaagga

SEQ ID NO: 106488 - RNA, 19 nt, Homo sapiens
gcagagcccuugagccuua

SEQ ID NO: 106489 - RNA, 19 nt, Homo sapiens
gauaaggucugaauaauag

SEQ ID NO: 106490 - RNA, 19 nt, Homo sapiens
gaagauaaggucugaauaa

SEQ ID NO: 106491 - RNA, 19 nt, Homo sapiens
ugaaagaacuuaaggcauu

SEQ ID NO: 106492 - RNA, 19 nt, Homo sapiens
gaagacaagugaugcuaaa

SEQ ID NO: 106493 - RNA, 19 nt, Homo sapiens
gagaagauauagaacuuga

SEQ ID NO: 106494 - RNA, 19 nt, Homo sapiens
gaaagaacuuaaggcauuu

SEQ ID NO: 106495 - RNA, 19 nt, Homo sapiens
gaaagaauguucagaaagc

SEQ ID NO: 106496 - RNA, 19 nt, Homo sapiens
uaagggagcaguucaauaa

SEQ ID NO: 106497 - RNA, 19 nt, Homo sapiens
cuacagagaugcuaagaga

SEQ ID NO: 106498 - RNA, 19 nt, Homo sapiens
caauauugcuccaugauga

SEQ ID NO: 106499 - RNA, 19 nt, Homo sapiens
gaacuuaaggcauuuguug

SEQ ID NO: 106500 - RNA, 19 nt, Homo sapiens
caacaaggcagaagaggua

SEQ ID NO: 106501 - RNA, 19 nt, Homo sapiens
guacuaaccuacagagaug

SEQ ID NO: 106502 - RNA, 19 nt, Homo sapiens
gcacacaaauaacaagaau

SEQ ID NO: 106503 - RNA, 19 nt, Homo sapiens
cauaauacccuuggaaaua

SEQ ID NO: 106504 - RNA, 19 nt, Homo sapiens
agagauaucccacguaaua

SEQ ID NO: 106505 - RNA, 19 nt, Homo sapiens
gaacuugauggcuaacuua

SEQ ID NO: 106506 - RNA, 19 nt, Homo sapiens
guauuuaacuucugaggaa

SEQ ID NO: 106507 - RNA, 19 nt, Homo sapiens
ccaaggacgugauggaauu

SEQ ID NO: 106508 - RNA, 19 nt, Homo sapiens
ccaaggacuuccaggcuua

SEQ ID NO: 106509 - RNA, 19 nt, Homo sapiens
gauguacucuaaauacuga

SEQ ID NO: 106510 - RNA, 19 nt, Homo sapiens
gcagcuggcuugaaaggaa

SEQ ID NO: 106511 - RNA, 19 nt, Homo sapiens
cagaaagaauguucagaaa

SEQ ID NO: 106512 - RNA, 19 nt, Homo sapiens
uauaagaggugaccaagga

SEQ ID NO: 106513 - RNA, 19 nt, Homo sapiens
ucagagauaucccacguaa

SEQ ID NO: 106514 - RNA, 19 nt, Homo sapiens
gaauuccaaugaagccaua

SEQ ID NO: 106515 - RNA, 19 nt, Homo sapiens
uagcucaugugcauuauuu

SEQ ID NO: 106516 - RNA, 19 nt, Homo sapiens
acaggugacucuaagguua

SEQ ID NO: 106517 - RNA, 19 nt, Homo sapiens
gcaguucaauaauccauga

SEQ ID NO: 106518 - RNA, 19 nt, Homo sapiens
caaagaggauauccaggaa

SEQ ID NO: 106519 - RNA, 19 nt, Homo sapiens
uaaggcauuuguugguuua

SEQ ID NO: 106520 - RNA, 19 nt, Homo sapiens
gaacaaggagauaaaggaa

SEQ ID NO: 106521 - RNA, 19 nt, Homo sapiens
aaauugggcucacuugauu

SEQ ID NO: 106522 - RNA, 19 nt, Homo sapiens
ugucacugcuguuauauuu

SEQ ID NO: 106523 - RNA, 19 nt, Homo sapiens
gaacacagaacugaacuga

SEQ ID NO: 106524 - RNA, 19 nt, Homo sapiens
gcuguuauauuucaucaug

SEQ ID NO: 106525 - RNA, 19 nt, Homo sapiens
ccacagcaauuccuucaug

SEQ ID NO: 106526 - RNA, 19 nt, Homo sapiens
ucagauacuuagcuuauga

SEQ ID NO: 106527 - RNA, 19 nt, Homo sapiens
gaugauaacacuauugaug

SEQ ID NO: 106528 - RNA, 19 nt, Homo sapiens
caaacaugcccauuacuaa

SEQ ID NO: 106529 - RNA, 19 nt, Homo sapiens
acuaagaugugcagcauuu

SEQ ID NO: 106530 - RNA, 19 nt, Homo sapiens
gaaaagacacugaagcuaa

SEQ ID NO: 106531 - RNA, 19 nt, Homo sapiens
guaacucauugcucuguaa

SEQ ID NO: 106532 - RNA, 19 nt, Homo sapiens
uaacuuggccgcuguaugu

SEQ ID NO: 106533 - RNA, 19 nt, Homo sapiens
cugaaagagucauuguuua

SEQ ID NO: 106534 - RNA, 19 nt, Homo sapiens
cagcauacgcacacaaaua

SEQ ID NO: 106535 - RNA, 19 nt, Homo sapiens
ccaccaggcucaagaggaa

SEQ ID NO: 106536 - RNA, 19 nt, Homo sapiens
gaagauauagaacuugaug

SEQ ID NO: 106537 - RNA, 19 nt, Homo sapiens
gcuccaugaugacuuagua

SEQ ID NO: 106538 - RNA, 19 nt, Homo sapiens
gaacgugcaacuacuauuc

SEQ ID NO: 106539 - RNA, 19 nt, Homo sapiens
gcagaugcacuguuuguga

SEQ ID NO: 106540 - RNA, 19 nt, Homo sapiens
auaagcagaugcacuguuu

SEQ ID NO: 106541 - RNA, 19 nt, Homo sapiens
gaaagggcuuggauggaau

SEQ ID NO: 106542 - RNA, 19 nt, Homo sapiens
gaaagagugauaggacaua

SEQ ID NO: 106543 - RNA, 19 nt, Homo sapiens
ccauaaauguuggugcaua

SEQ ID NO: 106544 - RNA, 19 nt, Homo sapiens
caugaugacuuaguacaaa

SEQ ID NO: 106545 - RNA, 19 nt, Homo sapiens
gugauuguaugaaguuuga

SEQ ID NO: 106546 - RNA, 19 nt, Homo sapiens
caaugucaaugauguaugu

SEQ ID NO: 106547 - RNA, 19 nt, Homo sapiens
ucagauggauugccagguu

SEQ ID NO: 106548 - RNA, 19 nt, Homo sapiens
gaccaggccucccagguau

SEQ ID NO: 106549 - RNA, 19 nt, Homo sapiens
agaaagggcuuggauggaa

SEQ ID NO: 106550 - RNA, 19 nt, Homo sapiens
ucaauugcuuuguaaguga

SEQ ID NO: 106551 - RNA, 19 nt, Homo sapiens
cagcaaggguugugucugu

SEQ ID NO: 106552 - RNA, 19 nt, Homo sapiens
ucucuaaucugugcuguuu

SEQ ID NO: 106553 - RNA, 19 nt, Homo sapiens
cagaaagccuauuccauca

SEQ ID NO: 106554 - RNA, 19 nt, Homo sapiens
gcuccugccuggaagaauu

SEQ ID NO: 106555 - RNA, 19 nt, Homo sapiens
acaaggagauaaaggaaau

SEQ ID NO: 106556 - RNA, 19 nt, Homo sapiens
guaaagggccagagaggaa

SEQ ID NO: 106557 - RNA, 19 nt, Homo sapiens
guuauauccugacaagauu

SEQ ID NO: 106558 - RNA, 19 nt, Homo sapiens
ucacaugguuuacauccuu

SEQ ID NO: 106559 - RNA, 19 nt, Homo sapiens
ucacugcuguuauauuuca

SEQ ID NO: 106560 - RNA, 19 nt, Homo sapiens
acucauugcucuguaauaa

SEQ ID NO: 106561 - RNA, 19 nt, Homo sapiens
gaagaggaacgugcaacua

SEQ ID NO: 106562 - RNA, 19 nt, Homo sapiens
ggaacaaggagauaaagga

SEQ ID NO: 106563 - RNA, 19 nt, Homo sapiens
ggaagacaagugaugcuaa

SEQ ID NO: 106564 - RNA, 19 nt, Homo sapiens
gaauaugucaucacucuag

SEQ ID NO: 106565 - RNA, 19 nt, Homo sapiens
aaacaauauugcuccauga

SEQ ID NO: 106566 - RNA, 19 nt, Homo sapiens
gaacaaaguaaugacagaa

SEQ ID NO: 106567 - RNA, 19 nt, Homo sapiens
gaaagccuauuccaucaac

SEQ ID NO: 106568 - RNA, 19 nt, Homo sapiens
caagggagaaccagcagua

SEQ ID NO: 106569 - RNA, 19 nt, Homo sapiens
gagccuggguuaccuggaa

SEQ ID NO: 106570 - RNA, 19 nt, Homo sapiens
ggaccaccaggaacaguua

SEQ ID NO: 106571 - RNA, 19 nt, Homo sapiens
ucaaacaugcccauuacua

SEQ ID NO: 106572 - RNA, 19 nt, Homo sapiens
ccagaaagaauguucagaa

SEQ ID NO: 106573 - RNA, 19 nt, Homo sapiens
cagaugcacuguuugugaa

SEQ ID NO: 106574 - RNA, 19 nt, Homo sapiens
ccacaggcauagaaggauu

SEQ ID NO: 106575 - RNA, 19 nt, Homo sapiens
auacaggucuuccaggauu

SEQ ID NO: 106576 - RNA, 19 nt, Homo sapiens
cuugauggcuaacuuacua

SEQ ID NO: 106577 - RNA, 19 nt, Homo sapiens
gccaguaguucucaaagug

SEQ ID NO: 106578 - RNA, 19 nt, Homo sapiens
gagaagauaaggucugaau

SEQ ID NO: 106579 - RNA, 19 nt, Homo sapiens
guacacagugcccuuauau

SEQ ID NO: 106580 - RNA, 19 nt, Homo sapiens
gcuaaaaccugaauuccaa

SEQ ID NO: 106581 - RNA, 19 nt, Homo sapiens
acucuaagguuaucuacuu

SEQ ID NO: 106582 - RNA, 19 nt, Homo sapiens
gaaaaccuguucuaucaau

SEQ ID NO: 106583 - RNA, 19 nt, Homo sapiens
gugcagcauuucacuuauu

SEQ ID NO: 106584 - RNA, 19 nt, Homo sapiens
ucaaaggauucgcaggaaa

SEQ ID NO: 106585 - RNA, 19 nt, Homo sapiens
ggaaaugaagggcuugaug

SEQ ID NO: 106586 - RNA, 19 nt, Homo sapiens
aaagggugcuccugcuaaa

SEQ ID NO: 106587 - RNA, 19 nt, Homo sapiens
caacaaagguucuaaagga

SEQ ID NO: 106588 - RNA, 19 nt, Homo sapiens
gauaaggucugaauaauag

SEQ ID NO: 106589 - RNA, 19 nt, Homo sapiens
gaagauaaggucugaauaa

SEQ ID NO: 106590 - RNA, 19 nt, Homo sapiens
ugaaagaacuuaaggcauu

SEQ ID NO: 106591 - RNA, 19 nt, Homo sapiens
gcauagcccuugagccuua

SEQ ID NO: 106592 - RNA, 19 nt, Homo sapiens
gaagacaagugaugcuaaa

SEQ ID NO: 106593 - RNA, 19 nt, Homo sapiens
gagaagauauagaacuuga

SEQ ID NO: 106594 - RNA, 19 nt, Homo sapiens
gaaagaacuuaaggcauuu

SEQ ID NO: 106595 - RNA, 19 nt, Homo sapiens
uaagggagcaguucaauaa

SEQ ID NO: 106596 - RNA, 19 nt, Homo sapiens
cuacagagaugcuaagaga

SEQ ID NO: 106597 - RNA, 19 nt, Homo sapiens
caauauugcuccaugauga

SEQ ID NO: 106598 - RNA, 19 nt, Homo sapiens
gaacuuaaggcauuuguug

SEQ ID NO: 106599 - RNA, 19 nt, Homo sapiens
caacaaggcagaagaggua

SEQ ID NO: 106600 - RNA, 19 nt, Homo sapiens
guacuaaccuacagagaug

SEQ ID NO: 106601 - RNA, 19 nt, Homo sapiens
gcacacaaauaacaagaau

SEQ ID NO: 106602 - RNA, 19 nt, Homo sapiens
cauaauacccuuggaaaua

SEQ ID NO: 106603 - RNA, 19 nt, Homo sapiens
agagauaucccacguaaua

SEQ ID NO: 106604 - RNA, 19 nt, Homo sapiens
gaacuugauggcuaacuua

SEQ ID NO: 106605 - RNA, 19 nt, Homo sapiens
guauuuaacuucugaggaa

SEQ ID NO: 106606 - RNA, 19 nt, Homo sapiens
ccaaggacgugauggaauu

SEQ ID NO: 106607 - RNA, 19 nt, Homo sapiens
ccaaggacuuccaggcuua

SEQ ID NO: 106608 - RNA, 19 nt, Homo sapiens
gauguacucuaaauacuga

SEQ ID NO: 106609 - RNA, 19 nt, Homo sapiens
gcagcuggcuugaaaggaa

SEQ ID NO: 106610 - RNA, 19 nt, Homo sapiens
uauaagaggugaccaagga

SEQ ID NO: 106611 - RNA, 19 nt, Homo sapiens
ucagagauaucccacguaa

SEQ ID NO: 106612 - RNA, 19 nt, Homo sapiens
gaauuccaaugaagccaua

SEQ ID NO: 106613 - RNA, 19 nt, Homo sapiens
uagcucaugugcauuauuu

SEQ ID NO: 106614 - RNA, 19 nt, Homo sapiens
acaggugacucuaagguua

SEQ ID NO: 106615 - RNA, 19 nt, Homo sapiens
gcaguucaauaauccauga

SEQ ID NO: 106616 - RNA, 19 nt, Homo sapiens
caaagaggauauccaggaa

SEQ ID NO: 106617 - RNA, 19 nt, Homo sapiens
uaaggcauuuguugguuua

SEQ ID NO: 106618 - RNA, 19 nt, Homo sapiens
gaacaaggagauaaaggaa

SEQ ID NO: 106619 - RNA, 19 nt, Homo sapiens
aaauugggcucacuugauu

SEQ ID NO: 106620 - RNA, 19 nt, Homo sapiens
ugucacugcuguuauauuu

SEQ ID NO: 106621 - RNA, 19 nt, Homo sapiens
gaacacagaacugaacuga

SEQ ID NO: 106622 - RNA, 19 nt, Homo sapiens
gcuguuauauuucaucaug

SEQ ID NO: 106623 - RNA, 19 nt, Homo sapiens
ccacagcaauuccuucaug

SEQ ID NO: 106624 - RNA, 19 nt, Homo sapiens
ucagauacuuagcuuauga

SEQ ID NO: 106625 - RNA, 19 nt, Homo sapiens
gaugauaacacuauugaug

SEQ ID NO: 106626 - RNA, 19 nt, Homo sapiens
caaacaugcccauuacuaa

SEQ ID NO: 106627 - RNA, 19 nt, Homo sapiens
acuaagaugugcagcauuu

SEQ ID NO: 106628 - RNA, 19 nt, Homo sapiens
gaaaagacacugaagcuaa

SEQ ID NO: 106629 - RNA, 19 nt, Homo sapiens
guaacucauugcucuguaa

SEQ ID NO: 106630 - RNA, 19 nt, Homo sapiens
uaacuuggccgcuguaugu

SEQ ID NO: 106631 - RNA, 19 nt, Homo sapiens
cugaaagagucauuguuua

SEQ ID NO: 106632 - RNA, 19 nt, Homo sapiens
cagcauacgcacacaaaua

SEQ ID NO: 106633 - RNA, 19 nt, Homo sapiens
ccaccaggcucaagaggaa

SEQ ID NO: 106634 - RNA, 19 nt, Homo sapiens
gaagauauagaacuugaug

SEQ ID NO: 106635 - RNA, 19 nt, Homo sapiens
gcuccaugaugacuuagua

SEQ ID NO: 106636 - RNA, 19 nt, Homo sapiens
gcagaugcacuguuuguga

SEQ ID NO: 106637 - RNA, 19 nt, Homo sapiens
auaagcagaugcacuguuu

SEQ ID NO: 106638 - RNA, 19 nt, Homo sapiens
gaaagggcuuggauggaau

SEQ ID NO: 106639 - RNA, 19 nt, Homo sapiens
gaaagagugauaggacaua

SEQ ID NO: 106640 - RNA, 19 nt, Homo sapiens
ccauaaauguuggugcaua

SEQ ID NO: 106641 - RNA, 19 nt, Homo sapiens
caugaugacuuaguacaaa

SEQ ID NO: 106642 - RNA, 19 nt, Homo sapiens
gugauuguaugaaguuuga

SEQ ID NO: 106643 - RNA, 19 nt, Homo sapiens
caaugucaaugauguaugu

SEQ ID NO: 106644 - RNA, 19 nt, Homo sapiens
ucagauggauugccagguu

SEQ ID NO: 106645 - RNA, 19 nt, Homo sapiens
gaccaggccucccagguau

SEQ ID NO: 106646 - RNA, 19 nt, Homo sapiens
agaaagggcuuggauggaa

SEQ ID NO: 106647 - RNA, 19 nt, Homo sapiens
ucaauugcuuuguaaguga

SEQ ID NO: 106648 - RNA, 19 nt, Homo sapiens
cagcaaggguugugucugu

SEQ ID NO: 106649 - RNA, 19 nt, Homo sapiens
ucucuaaucugugcuguuu

SEQ ID NO: 106650 - RNA, 19 nt, Homo sapiens
acaaggagauaaaggaaau

SEQ ID NO: 106651 - RNA, 19 nt, Homo sapiens
guaaagggccagagaggaa

SEQ ID NO: 106652 - RNA, 19 nt, Homo sapiens
guuauauccugacaagauu

SEQ ID NO: 106653 - RNA, 19 nt, Homo sapiens
ucacaugguuuacauccuu

SEQ ID NO: 106654 - RNA, 19 nt, Homo sapiens
ucacugcuguuauauuuca

SEQ ID NO: 106655 - RNA, 19 nt, Homo sapiens
acucauugcucuguaauaa

SEQ ID NO: 106656 - RNA, 19 nt, Homo sapiens
ggaacaaggagauaaagga

SEQ ID NO: 106657 - RNA, 19 nt, Homo sapiens
ggaagacaagugaugcuaa

SEQ ID NO: 106658 - RNA, 19 nt, Homo sapiens
gaauaugucaucacucuag

SEQ ID NO: 106659 - RNA, 19 nt, Homo sapiens
aaacaauauugcuccauga

SEQ ID NO: 106660 - RNA, 19 nt, Homo sapiens
gaacaaaguaaugacagaa

SEQ ID NO: 106661 - RNA, 19 nt, Homo sapiens
gaaagccuauuccaucaac

SEQ ID NO: 106662 - RNA, 19 nt, Homo sapiens
caagggagaaccagcagua

SEQ ID NO: 106663 - RNA, 19 nt, Homo sapiens
gagccuggguuaccuggaa

SEQ ID NO: 106664 - RNA, 19 nt, Homo sapiens
ggaccaccaggaacaguua

SEQ ID NO: 106665 - RNA, 19 nt, Homo sapiens
ucaaacaugcccauuacua

SEQ ID NO: 106666 - RNA, 19 nt, Homo sapiens
cagaugcacuguuugugaa

SEQ ID NO: 106667 - RNA, 19 nt, Homo sapiens
ccacaggcauagaaggauu

SEQ ID NO: 106668 - RNA, 19 nt, Homo sapiens
auacaggucuuccaggauu

SEQ ID NO: 106669 - RNA, 19 nt, Homo sapiens
cuugauggcuaacuuacua

SEQ ID NO: 106670 - RNA, 19 nt, Homo sapiens
gccaguaguucucaaagug

SEQ ID NO: 106671 - RNA, 19 nt, Homo sapiens
gagaagauaaggucugaau

SEQ ID NO: 106672 - RNA, 19 nt, Homo sapiens
guacacagugcccuuauau

SEQ ID NO: 106673 - RNA, 19 nt, Homo sapiens
gcuaaaaccugaauuccaa

SEQ ID NO: 106674 - RNA, 19 nt, Homo sapiens
acucuaagguuaucuacuu

SEQ ID NO: 106675 - RNA, 19 nt, Homo sapiens
gaaaaccuguucuaucaau

SEQ ID NO: 106676 - RNA, 19 nt, Homo sapiens
gugcagcauuucacuuauu

SEQ ID NO: 106677 - RNA, 19 nt, Homo sapiens
ucaaaggauucgcaggaaa

SEQ ID NO: 106678 - RNA, 19 nt, Homo sapiens
ggaaaugaagggcuugaug

SEQ ID NO: 106679 - RNA, 19 nt, Homo sapiens
guaagggagcaguucaaua

SEQ ID NO: 106680 - RNA, 19 nt, Homo sapiens
ugugguaucuggagcauug

SEQ ID NO: 106681 - RNA, 19 nt, Homo sapiens
gcaaagcagcaacuauuca

SEQ ID NO: 106682 - RNA, 19 nt, Homo sapiens
aaagggugcuccugcuaaa

SEQ ID NO: 106683 - RNA, 19 nt, Homo sapiens
gacaguggaucaccugcaa

SEQ ID NO: 106684 - RNA, 19 nt, Homo sapiens
gaacccuggugcucaagga

SEQ ID NO: 106685 - RNA, 19 nt, Homo sapiens
aggcuuaaauggauugaaa

SEQ ID NO: 106686 - RNA, 19 nt, Homo sapiens
aaaccugaauuccaaugaa

SEQ ID NO: 106687 - RNA, 19 nt, Homo sapiens
caacaaagguucuaaagga

SEQ ID NO: 106688 - RNA, 19 nt, Homo sapiens
gauaaggucugaauaauag

SEQ ID NO: 106689 - RNA, 19 nt, Homo sapiens
gaagauaaggucugaauaa

SEQ ID NO: 106690 - RNA, 19 nt, Homo sapiens
ugaaagaacuuaaggcauu

SEQ ID NO: 106691 - RNA, 19 nt, Homo sapiens
gaagacaagugaugcuaaa

SEQ ID NO: 106692 - RNA, 19 nt, Homo sapiens
gagaagauauagaacuuga

SEQ ID NO: 106693 - RNA, 19 nt, Homo sapiens
gaaagaacuuaaggcauuu

SEQ ID NO: 106694 - RNA, 19 nt, Homo sapiens
gaaagaauguucagaaagc

SEQ ID NO: 106695 - RNA, 19 nt, Homo sapiens
uaagggagcaguucaauaa

SEQ ID NO: 106696 - RNA, 19 nt, Homo sapiens
cuacagagaugcuaagaga

SEQ ID NO: 106697 - RNA, 19 nt, Homo sapiens
caauauugcuccaugauga

SEQ ID NO: 106698 - RNA, 19 nt, Homo sapiens
gaacuuaaggcauuuguug

SEQ ID NO: 106699 - RNA, 19 nt, Homo sapiens
caacaaggcagaagaggua

SEQ ID NO: 106700 - RNA, 19 nt, Homo sapiens
guacuaaccuacagagaug

SEQ ID NO: 106701 - RNA, 19 nt, Homo sapiens
gcacacaaauaacaagaau

SEQ ID NO: 106702 - RNA, 19 nt, Homo sapiens
cauaauacccuuggaaaua

SEQ ID NO: 106703 - RNA, 19 nt, Homo sapiens
agagauaucccacguaaua

SEQ ID NO: 106704 - RNA, 19 nt, Homo sapiens
gaacuugauggcuaacuua

SEQ ID NO: 106705 - RNA, 19 nt, Homo sapiens
guauuuaacuucugaggaa

SEQ ID NO: 106706 - RNA, 19 nt, Homo sapiens
ccaaggacgugauggaauu

SEQ ID NO: 106707 - RNA, 19 nt, Homo sapiens
ccaaggacuuccaggcuua

SEQ ID NO: 106708 - RNA, 19 nt, Homo sapiens
gauguacucuaaauacuga

SEQ ID NO: 106709 - RNA, 19 nt, Homo sapiens
gcagcuggcuugaaaggaa

SEQ ID NO: 106710 - RNA, 19 nt, Homo sapiens
cagaaagaauguucagaaa

SEQ ID NO: 106711 - RNA, 19 nt, Homo sapiens
uauaagaggugaccaagga

SEQ ID NO: 106712 - RNA, 19 nt, Homo sapiens
ucagagauaucccacguaa

SEQ ID NO: 106713 - RNA, 19 nt, Homo sapiens
gaauuccaaugaagccaua

SEQ ID NO: 106714 - RNA, 19 nt, Homo sapiens
uagcucaugugcauuauuu

SEQ ID NO: 106715 - RNA, 19 nt, Homo sapiens
acaggugacucuaagguua

SEQ ID NO: 106716 - RNA, 19 nt, Homo sapiens
gcaguucaauaauccauga

SEQ ID NO: 106717 - RNA, 19 nt, Homo sapiens
caaagaggauauccaggaa

SEQ ID NO: 106718 - RNA, 19 nt, Homo sapiens
uaaggcauuuguugguuua

SEQ ID NO: 106719 - RNA, 19 nt, Homo sapiens
gaacaaggagauaaaggaa

SEQ ID NO: 106720 - RNA, 19 nt, Homo sapiens
aaauugggcucacuugauu

SEQ ID NO: 106721 - RNA, 19 nt, Homo sapiens
ugucacugcuguuauauuu

SEQ ID NO: 106722 - RNA, 19 nt, Homo sapiens
gaacacagaacugaacuga

SEQ ID NO: 106723 - RNA, 19 nt, Homo sapiens
gcuguuauauuucaucaug

SEQ ID NO: 106724 - RNA, 19 nt, Homo sapiens
ccacagcaauuccuucaug

SEQ ID NO: 106725 - RNA, 19 nt, Homo sapiens
ucagauacuuagcuuauga

SEQ ID NO: 106726 - RNA, 19 nt, Homo sapiens
gaugauaacacuauugaug

SEQ ID NO: 106727 - RNA, 19 nt, Homo sapiens
caaacaugcccauuacuaa

SEQ ID NO: 106728 - RNA, 19 nt, Homo sapiens
acuaagaugugcagcauuu

SEQ ID NO: 106729 - RNA, 19 nt, Homo sapiens
gaaaagacacugaagcuaa

SEQ ID NO: 106730 - RNA, 19 nt, Homo sapiens
guaacucauugcucuguaa

SEQ ID NO: 106731 - RNA, 19 nt, Homo sapiens
uaacuuggccgcuguaugu

SEQ ID NO: 106732 - RNA, 19 nt, Homo sapiens
cugaaagagucauuguuua

SEQ ID NO: 106733 - RNA, 19 nt, Homo sapiens
cagcauacgcacacaaaua

SEQ ID NO: 106734 - RNA, 19 nt, Homo sapiens
ccaccaggcucaagaggaa

SEQ ID NO: 106735 - RNA, 19 nt, Homo sapiens
gaagauauagaacuugaug

SEQ ID NO: 106736 - RNA, 19 nt, Homo sapiens
gcuccaugaugacuuagua

SEQ ID NO: 106737 - RNA, 19 nt, Homo sapiens
gaacgugcaacuacuauuc

SEQ ID NO: 106738 - RNA, 19 nt, Homo sapiens
gaaagggcuuggauggaau

SEQ ID NO: 106739 - RNA, 19 nt, Homo sapiens
gaaagagugauaggacaua

SEQ ID NO: 106740 - RNA, 19 nt, Homo sapiens
ccauaaauguuggugcaua

SEQ ID NO: 106741 - RNA, 19 nt, Homo sapiens
caugaugacuuaguacaaa

SEQ ID NO: 106742 - RNA, 19 nt, Homo sapiens
gugauuguaugaaguuuga

SEQ ID NO: 106743 - RNA, 19 nt, Homo sapiens
ucagauggauugccagguu

SEQ ID NO: 106744 - RNA, 19 nt, Homo sapiens
gaccaggccucccagguau

SEQ ID NO: 106745 - RNA, 19 nt, Homo sapiens
agaaagggcuuggauggaa

SEQ ID NO: 106746 - RNA, 19 nt, Homo sapiens
ucaauugcuuuguaaguga

SEQ ID NO: 106747 - RNA, 19 nt, Homo sapiens
cagcaaggguugugucugu

SEQ ID NO: 106748 - RNA, 19 nt, Homo sapiens
ucucuaaucugugcuguuu

SEQ ID NO: 106749 - RNA, 19 nt, Homo sapiens
cagaaagccuauuccauca

SEQ ID NO: 106750 - RNA, 19 nt, Homo sapiens
gcuccugccuggaagaauu

SEQ ID NO: 106751 - RNA, 19 nt, Homo sapiens
acaaggagauaaaggaaau

SEQ ID NO: 106752 - RNA, 19 nt, Homo sapiens
guaaagggccagagaggaa

SEQ ID NO: 106753 - RNA, 19 nt, Homo sapiens
guuauauccugacaagauu

SEQ ID NO: 106754 - RNA, 19 nt, Homo sapiens
ucacaugguuuacauccuu

SEQ ID NO: 106755 - RNA, 19 nt, Homo sapiens
ucacugcuguuauauuuca

SEQ ID NO: 106756 - RNA, 19 nt, Homo sapiens
acucauugcucuguaauaa

SEQ ID NO: 106757 - RNA, 19 nt, Homo sapiens
gaagaggaacgugcaacua

SEQ ID NO: 106758 - RNA, 19 nt, Homo sapiens
ggaacaaggagauaaagga

SEQ ID NO: 106759 - RNA, 19 nt, Homo sapiens
ggaagacaagugaugcuaa

SEQ ID NO: 106760 - RNA, 19 nt, Homo sapiens
gaauaugucaucacucuag

SEQ ID NO: 106761 - RNA, 19 nt, Homo sapiens
aaacaauauugcuccauga

SEQ ID NO: 106762 - RNA, 19 nt, Homo sapiens
gaacaaaguaaugacagaa

SEQ ID NO: 106763 - RNA, 19 nt, Homo sapiens
gaaagccuauuccaucaac

SEQ ID NO: 106764 - RNA, 19 nt, Homo sapiens
caagggagaaccagcagua

SEQ ID NO: 106765 - RNA, 19 nt, Homo sapiens
gagccuggguuaccuggaa

SEQ ID NO: 106766 - RNA, 19 nt, Homo sapiens
ggaccaccaggaacaguua

SEQ ID NO: 106767 - RNA, 19 nt, Homo sapiens
ucaaacaugcccauuacua

SEQ ID NO: 106768 - RNA, 19 nt, Homo sapiens
ccagaaagaauguucagaa

SEQ ID NO: 106769 - RNA, 19 nt, Homo sapiens
ccacaggcauagaaggauu

SEQ ID NO: 106770 - RNA, 19 nt, Homo sapiens
auacaggucuuccaggauu

SEQ ID NO: 106771 - RNA, 19 nt, Homo sapiens
cuugauggcuaacuuacua

SEQ ID NO: 106772 - RNA, 19 nt, Homo sapiens
gccaguaguucucaaagug

SEQ ID NO: 106773 - RNA, 19 nt, Homo sapiens
gagaagauaaggucugaau

SEQ ID NO: 106774 - RNA, 19 nt, Homo sapiens
guacacagugcccuuauau

SEQ ID NO: 106775 - RNA, 19 nt, Homo sapiens
gcuaaaaccugaauuccaa

SEQ ID NO: 106776 - RNA, 19 nt, Homo sapiens
acucuaagguuaucuacuu

SEQ ID NO: 106777 - RNA, 19 nt, Homo sapiens
gaaaaccuguucuaucaau

SEQ ID NO: 106778 - RNA, 19 nt, Homo sapiens
gugcagcauuucacuuauu

SEQ ID NO: 106779 - RNA, 19 nt, Homo sapiens
ucaaaggauucgcaggaaa

SEQ ID NO: 106780 - RNA, 19 nt, Homo sapiens
ggaaaugaagggcuugaug

SEQ ID NO: 106781 - RNA, 19 nt, Homo sapiens
guaagggagcaguucaaua

SEQ ID NO: 106782 - RNA, 19 nt, Homo sapiens
aaagggugcuccugcuaaa

SEQ ID NO: 106783 - RNA, 19 nt, Homo sapiens
ugugguaucuggagcauug

SEQ ID NO: 106784 - RNA, 19 nt, Homo sapiens
gcaaagcagcaacuauuca

SEQ ID NO: 106785 - RNA, 19 nt, Homo sapiens
gacaguggaucaccugcaa

SEQ ID NO: 106786 - RNA, 19 nt, Homo sapiens
gaacccuggugcucaagga

SEQ ID NO: 106787 - RNA, 19 nt, Homo sapiens
caacaaagguucuaaagga

SEQ ID NO: 106788 - RNA, 19 nt, Homo sapiens
gauaaggucugaauaauag

SEQ ID NO: 106789 - RNA, 19 nt, Homo sapiens
gaagauaaggucugaauaa

SEQ ID NO: 106790 - RNA, 19 nt, Homo sapiens
ugaaagaacuuaaggcauu

SEQ ID NO: 106791 - RNA, 19 nt, Homo sapiens
gaagacaagugaugcuaaa

SEQ ID NO: 106792 - RNA, 19 nt, Homo sapiens
gagaagauauagaacuuga

SEQ ID NO: 106793 - RNA, 19 nt, Homo sapiens
gaaagaacuuaaggcauuu

SEQ ID NO: 106794 - RNA, 19 nt, Homo sapiens
uaagggagcaguucaauaa

SEQ ID NO: 106795 - RNA, 19 nt, Homo sapiens
cuacagagaugcuaagaga

SEQ ID NO: 106796 - RNA, 19 nt, Homo sapiens
caauauugcuccaugauga

SEQ ID NO: 106797 - RNA, 19 nt, Homo sapiens
gaacuuaaggcauuuguug

SEQ ID NO: 106798 - RNA, 19 nt, Homo sapiens
caacaaggcagaagaggua

SEQ ID NO: 106799 - RNA, 19 nt, Homo sapiens
guacuaaccuacagagaug

SEQ ID NO: 106800 - RNA, 19 nt, Homo sapiens
gcacacaaauaacaagaau

SEQ ID NO: 106801 - RNA, 19 nt, Homo sapiens
cauaauacccuuggaaaua

SEQ ID NO: 106802 - RNA, 19 nt, Homo sapiens
agagauaucccacguaaua

SEQ ID NO: 106803 - RNA, 19 nt, Homo sapiens
gaacuugauggcuaacuua

SEQ ID NO: 106804 - RNA, 19 nt, Homo sapiens
guauuuaacuucugaggaa

SEQ ID NO: 106805 - RNA, 19 nt, Homo sapiens
ccaaggacgugauggaauu

SEQ ID NO: 106806 - RNA, 19 nt, Homo sapiens
ccaaggacuuccaggcuua

SEQ ID NO: 106807 - RNA, 19 nt, Homo sapiens
gauguacucuaaauacuga

SEQ ID NO: 106808 - RNA, 19 nt, Homo sapiens
gcagcuggcuugaaaggaa

SEQ ID NO: 106809 - RNA, 19 nt, Homo sapiens
uauaagaggugaccaagga

SEQ ID NO: 106810 - RNA, 19 nt, Homo sapiens
ucagagauaucccacguaa

SEQ ID NO: 106811 - RNA, 19 nt, Homo sapiens
gaauuccaaugaagccaua

SEQ ID NO: 106812 - RNA, 19 nt, Homo sapiens
uagcucaugugcauuauuu

SEQ ID NO: 106813 - RNA, 19 nt, Homo sapiens
acaggugacucuaagguua

SEQ ID NO: 106814 - RNA, 19 nt, Homo sapiens
gcaguucaauaauccauga

SEQ ID NO: 106815 - RNA, 19 nt, Homo sapiens
caaagaggauauccaggaa

SEQ ID NO: 106816 - RNA, 19 nt, Homo sapiens
uaaggcauuuguugguuua

SEQ ID NO: 106817 - RNA, 19 nt, Homo sapiens
gaacaaggagauaaaggaa

SEQ ID NO: 106818 - RNA, 19 nt, Homo sapiens
aaauugggcucacuugauu

SEQ ID NO: 106819 - RNA, 19 nt, Homo sapiens
ugucacugcuguuauauuu

SEQ ID NO: 106820 - RNA, 19 nt, Homo sapiens
gaacacagaacugaacuga

SEQ ID NO: 106821 - RNA, 19 nt, Homo sapiens
gcuguuauauuucaucaug

SEQ ID NO: 106822 - RNA, 19 nt, Homo sapiens
ccacagcaauuccuucaug

SEQ ID NO: 106823 - RNA, 19 nt, Homo sapiens
ucagauacuuagcuuauga

SEQ ID NO: 106824 - RNA, 19 nt, Homo sapiens
gaugauaacacuauugaug

SEQ ID NO: 106825 - RNA, 19 nt, Homo sapiens
caaacaugcccauuacuaa

SEQ ID NO: 106826 - RNA, 19 nt, Homo sapiens
acuaagaugugcagcauuu

SEQ ID NO: 106827 - RNA, 19 nt, Homo sapiens
gaaaagacacugaagcuaa

SEQ ID NO: 106828 - RNA, 19 nt, Homo sapiens
guaacucauugcucuguaa

SEQ ID NO: 106829 - RNA, 19 nt, Homo sapiens
uaacuuggccgcuguaugu

SEQ ID NO: 106830 - RNA, 19 nt, Homo sapiens
cugaaagagucauuguuua

SEQ ID NO: 106831 - RNA, 19 nt, Homo sapiens
cagcauacgcacacaaaua

SEQ ID NO: 106832 - RNA, 19 nt, Homo sapiens
ccaccaggcucaagaggaa

SEQ ID NO: 106833 - RNA, 19 nt, Homo sapiens
gaagauauagaacuugaug

SEQ ID NO: 106834 - RNA, 19 nt, Homo sapiens
gcuccaugaugacuuagua

SEQ ID NO: 106835 - RNA, 19 nt, Homo sapiens
gaaagggcuuggauggaau

SEQ ID NO: 106836 - RNA, 19 nt, Homo sapiens
gaaagagugauaggacaua

SEQ ID NO: 106837 - RNA, 19 nt, Homo sapiens
ccauaaauguuggugcaua

SEQ ID NO: 106838 - RNA, 19 nt, Homo sapiens
caugaugacuuaguacaaa

SEQ ID NO: 106839 - RNA, 19 nt, Homo sapiens
gugauuguaugaaguuuga

SEQ ID NO: 106840 - RNA, 19 nt, Homo sapiens
ucagauggauugccagguu

SEQ ID NO: 106841 - RNA, 19 nt, Homo sapiens
gaccaggccucccagguau

SEQ ID NO: 106842 - RNA, 19 nt, Homo sapiens
agaaagggcuuggauggaa

SEQ ID NO: 106843 - RNA, 19 nt, Homo sapiens
ucaauugcuuuguaaguga

SEQ ID NO: 106844 - RNA, 19 nt, Homo sapiens
cagcaaggguugugucugu

SEQ ID NO: 106845 - RNA, 19 nt, Homo sapiens
ucucuaaucugugcuguuu

SEQ ID NO: 106846 - RNA, 19 nt, Homo sapiens
acaaggagauaaaggaaau

SEQ ID NO: 106847 - RNA, 19 nt, Homo sapiens
guaaagggccagagaggaa

SEQ ID NO: 106848 - RNA, 19 nt, Homo sapiens
guuauauccugacaagauu

SEQ ID NO: 106849 - RNA, 19 nt, Homo sapiens
ucacaugguuuacauccuu

SEQ ID NO: 106850 - RNA, 19 nt, Homo sapiens
ucacugcuguuauauuuca

SEQ ID NO: 106851 - RNA, 19 nt, Homo sapiens
acucauugcucuguaauaa

SEQ ID NO: 106852 - RNA, 19 nt, Homo sapiens
ggaacaaggagauaaagga

SEQ ID NO: 106853 - RNA, 19 nt, Homo sapiens
ggaagacaagugaugcuaa

SEQ ID NO: 106854 - RNA, 19 nt, Homo sapiens
gaauaugucaucacucuag

SEQ ID NO: 106855 - RNA, 19 nt, Homo sapiens
aaacaauauugcuccauga

SEQ ID NO: 106856 - RNA, 19 nt, Homo sapiens
gaacaaaguaaugacagaa

SEQ ID NO: 106857 - RNA, 19 nt, Homo sapiens
gaaagccuauuccaucaac

SEQ ID NO: 106858 - RNA, 19 nt, Homo sapiens
caagggagaaccagcagua

SEQ ID NO: 106859 - RNA, 19 nt, Homo sapiens
gagccuggguuaccuggaa

SEQ ID NO: 106860 - RNA, 19 nt, Homo sapiens
ggaccaccaggaacaguua

SEQ ID NO: 106861 - RNA, 19 nt, Homo sapiens
ucaaacaugcccauuacua

SEQ ID NO: 106862 - RNA, 19 nt, Homo sapiens
ccacaggcauagaaggauu

SEQ ID NO: 106863 - RNA, 19 nt, Homo sapiens
auacaggucuuccaggauu

SEQ ID NO: 106864 - RNA, 19 nt, Homo sapiens
cuugauggcuaacuuacua

SEQ ID NO: 106865 - RNA, 19 nt, Homo sapiens
gccaguaguucucaaagug

SEQ ID NO: 106866 - RNA, 19 nt, Homo sapiens
gagaagauaaggucugaau

SEQ ID NO: 106867 - RNA, 19 nt, Homo sapiens
guacacagugcccuuauau

SEQ ID NO: 106868 - RNA, 19 nt, Homo sapiens
gcuaaaaccugaauuccaa

SEQ ID NO: 106869 - RNA, 19 nt, Homo sapiens
acucuaagguuaucuacuu

SEQ ID NO: 106870 - RNA, 19 nt, Homo sapiens
gaaaaccuguucuaucaau

SEQ ID NO: 106871 - RNA, 19 nt, Homo sapiens
gugcagcauuucacuuauu

SEQ ID NO: 106872 - RNA, 19 nt, Homo sapiens
ucaaaggauucgcaggaaa

SEQ ID NO: 106873 - RNA, 19 nt, Homo sapiens
ggaaaugaagggcuugaug

SEQ ID NO: 106874 - RNA, 19 nt, Homo sapiens
guaagggagcaguucaaua

SEQ ID NO: 106875 - RNA, 19 nt, Homo sapiens
ugugguaucuggagcauug

SEQ ID NO: 106876 - RNA, 19 nt, Homo sapiens
gcaaagcagcaacuauuca

SEQ ID NO: 106877 - RNA, 19 nt, Homo sapiens
gacaguggaucaccugcaa

SEQ ID NO: 106878 - RNA, 19 nt, Homo sapiens
gaacccuggugcucaagga

SEQ ID NO: 106879 - RNA, 19 nt, Homo sapiens
aggcuuaaauggauugaaa

SEQ ID NO: 106880 - RNA, 19 nt, Homo sapiens
aaagggugcuccugcuaaa

SEQ ID NO: 106881 - RNA, 19 nt, Homo sapiens
aaaccugaauuccaaugaa

SEQ ID NO: 106882 - RNA, 19 nt, Homo sapiens
ccuugucacugcuguuaua

SEQ ID NO: 106883 - RNA, 19 nt, Homo sapiens
ucauugcucuguaauaauc

SEQ ID NO: 106884 - RNA, 19 nt, Homo sapiens
ugugaaagcuggggaauua

SEQ ID NO: 106885 - RNA, 19 nt, Homo sapiens
ggacuuccaggcuuaaaug

SEQ ID NO: 106886 - RNA, 19 nt, Homo sapiens
gcaaggguugugucuguaa

SEQ ID NO: 106887 - RNA, 19 nt, Homo sapiens
caacaaagguucuaaagga

SEQ ID NO: 106888 - RNA, 19 nt, Homo sapiens
gauaaggucugaauaauag

SEQ ID NO: 106889 - RNA, 19 nt, Homo sapiens
gaagauaaggucugaauaa

SEQ ID NO: 106890 - RNA, 19 nt, Homo sapiens
ugaaagaacuuaaggcauu

SEQ ID NO: 106891 - RNA, 19 nt, Homo sapiens
gaagacaagugaugcuaaa

SEQ ID NO: 106892 - RNA, 19 nt, Homo sapiens
gagaagauauagaacuuga

SEQ ID NO: 106893 - RNA, 19 nt, Homo sapiens
gaaagaacuuaaggcauuu

SEQ ID NO: 106894 - RNA, 19 nt, Homo sapiens
uaagggagcaguucaauaa

SEQ ID NO: 106895 - RNA, 19 nt, Homo sapiens
cuacagagaugcuaagaga

SEQ ID NO: 106896 - RNA, 19 nt, Homo sapiens
caauauugcuccaugauga

SEQ ID NO: 106897 - RNA, 19 nt, Homo sapiens
gaacuuaaggcauuuguug

SEQ ID NO: 106898 - RNA, 19 nt, Homo sapiens
caacaaggcagaagaggua

SEQ ID NO: 106899 - RNA, 19 nt, Homo sapiens
guacuaaccuacagagaug

SEQ ID NO: 106900 - RNA, 19 nt, Homo sapiens
gcacacaaauaacaagaau

SEQ ID NO: 106901 - RNA, 19 nt, Homo sapiens
cauaauacccuuggaaaua

SEQ ID NO: 106902 - RNA, 19 nt, Homo sapiens
agagauaucccacguaaua

SEQ ID NO: 106903 - RNA, 19 nt, Homo sapiens
gaacuugauggcuaacuua

SEQ ID NO: 106904 - RNA, 19 nt, Homo sapiens
guauuuaacuucugaggaa

SEQ ID NO: 106905 - RNA, 19 nt, Homo sapiens
ccaaggacgugauggaauu

SEQ ID NO: 106906 - RNA, 19 nt, Homo sapiens
ccaaggacuuccaggcuua

SEQ ID NO: 106907 - RNA, 19 nt, Homo sapiens
gauguacucuaaauacuga

SEQ ID NO: 106908 - RNA, 19 nt, Homo sapiens
gcagcuggcuugaaaggaa

SEQ ID NO: 106909 - RNA, 19 nt, Homo sapiens
uauaagaggugaccaagga

SEQ ID NO: 106910 - RNA, 19 nt, Homo sapiens
ucagagauaucccacguaa

SEQ ID NO: 106911 - RNA, 19 nt, Homo sapiens
gaauuccaaugaagccaua

SEQ ID NO: 106912 - RNA, 19 nt, Homo sapiens
uagcucaugugcauuauuu

SEQ ID NO: 106913 - RNA, 19 nt, Homo sapiens
acaggugacucuaagguua

SEQ ID NO: 106914 - RNA, 19 nt, Homo sapiens
gcaguucaauaauccauga

SEQ ID NO: 106915 - RNA, 19 nt, Homo sapiens
caaagaggauauccaggaa

SEQ ID NO: 106916 - RNA, 19 nt, Homo sapiens
uaaggcauuuguugguuua

SEQ ID NO: 106917 - RNA, 19 nt, Homo sapiens
gaacaaggagauaaaggaa

SEQ ID NO: 106918 - RNA, 19 nt, Homo sapiens
aaauugggcucacuugauu

SEQ ID NO: 106919 - RNA, 19 nt, Homo sapiens
ugucacugcuguuauauuu

SEQ ID NO: 106920 - RNA, 19 nt, Homo sapiens
gaacacagaacugaacuga

SEQ ID NO: 106921 - RNA, 19 nt, Homo sapiens
gcuguuauauuucaucaug

SEQ ID NO: 106922 - RNA, 19 nt, Homo sapiens
ccacagcaauuccuucaug

SEQ ID NO: 106923 - RNA, 19 nt, Homo sapiens
ucagauacuuagcuuauga

SEQ ID NO: 106924 - RNA, 19 nt, Homo sapiens
gaugauaacacuauugaug

SEQ ID NO: 106925 - RNA, 19 nt, Homo sapiens
caaacaugcccauuacuaa

SEQ ID NO: 106926 - RNA, 19 nt, Homo sapiens
acuaagaugugcagcauuu

SEQ ID NO: 106927 - RNA, 19 nt, Homo sapiens
gaaaagacacugaagcuaa

SEQ ID NO: 106928 - RNA, 19 nt, Homo sapiens
guaacucauugcucuguaa

SEQ ID NO: 106929 - RNA, 19 nt, Homo sapiens
uaacuuggccgcuguaugu

SEQ ID NO: 106930 - RNA, 19 nt, Homo sapiens
cugaaagagucauuguuua

SEQ ID NO: 106931 - RNA, 19 nt, Homo sapiens
cagcauacgcacacaaaua

SEQ ID NO: 106932 - RNA, 19 nt, Homo sapiens
ccaccaggcucaagaggaa

SEQ ID NO: 106933 - RNA, 19 nt, Homo sapiens
gaagauauagaacuugaug

SEQ ID NO: 106934 - RNA, 19 nt, Homo sapiens
gcuccaugaugacuuagua

SEQ ID NO: 106935 - RNA, 19 nt, Homo sapiens
gaaagggcuuggauggaau

SEQ ID NO: 106936 - RNA, 19 nt, Homo sapiens
gaaagagugauaggacaua

SEQ ID NO: 106937 - RNA, 19 nt, Homo sapiens
ccauaaauguuggugcaua

SEQ ID NO: 106938 - RNA, 19 nt, Homo sapiens
caugaugacuuaguacaaa

SEQ ID NO: 106939 - RNA, 19 nt, Homo sapiens
gugauuguaugaaguuuga

SEQ ID NO: 106940 - RNA, 19 nt, Homo sapiens
ucagauggauugccagguu

SEQ ID NO: 106941 - RNA, 19 nt, Homo sapiens
gaccaggccucccagguau

SEQ ID NO: 106942 - RNA, 19 nt, Homo sapiens
agaaagggcuuggauggaa

SEQ ID NO: 106943 - RNA, 19 nt, Homo sapiens
ucaauugcuuuguaaguga

SEQ ID NO: 106944 - RNA, 19 nt, Homo sapiens
cagcaaggguugugucugu

SEQ ID NO: 106945 - RNA, 19 nt, Homo sapiens
ucucuaaucugugcuguuu

SEQ ID NO: 106946 - RNA, 19 nt, Homo sapiens
acaaggagauaaaggaaau

SEQ ID NO: 106947 - RNA, 19 nt, Homo sapiens
guaaagggccagagaggaa

SEQ ID NO: 106948 - RNA, 19 nt, Homo sapiens
guuauauccugacaagauu

SEQ ID NO: 106949 - RNA, 19 nt, Homo sapiens
ucacaugguuuacauccuu

SEQ ID NO: 106950 - RNA, 19 nt, Homo sapiens
ucacugcuguuauauuuca

SEQ ID NO: 106951 - RNA, 19 nt, Homo sapiens
acucauugcucuguaauaa

SEQ ID NO: 106952 - RNA, 19 nt, Homo sapiens
ggaacaaggagauaaagga

SEQ ID NO: 106953 - RNA, 19 nt, Homo sapiens
ggaagacaagugaugcuaa

SEQ ID NO: 106954 - RNA, 19 nt, Homo sapiens
gaauaugucaucacucuag

SEQ ID NO: 106955 - RNA, 19 nt, Homo sapiens
aaacaauauugcuccauga

SEQ ID NO: 106956 - RNA, 19 nt, Homo sapiens
gaacaaaguaaugacagaa

SEQ ID NO: 106957 - RNA, 19 nt, Homo sapiens
gaaagccuauuccaucaac

SEQ ID NO: 106958 - RNA, 19 nt, Homo sapiens
caagggagaaccagcagua

SEQ ID NO: 106959 - RNA, 19 nt, Homo sapiens
gagccuggguuaccuggaa

SEQ ID NO: 106960 - RNA, 19 nt, Homo sapiens
ggaccaccaggaacaguua

SEQ ID NO: 106961 - RNA, 19 nt, Homo sapiens
ucaaacaugcccauuacua

SEQ ID NO: 106962 - RNA, 19 nt, Homo sapiens
ccacaggcauagaaggauu

SEQ ID NO: 106963 - RNA, 19 nt, Homo sapiens
auacaggucuuccaggauu

SEQ ID NO: 106964 - RNA, 19 nt, Homo sapiens
cuugauggcuaacuuacua

SEQ ID NO: 106965 - RNA, 19 nt, Homo sapiens
gccaguaguucucaaagug

SEQ ID NO: 106966 - RNA, 19 nt, Homo sapiens
gagaagauaaggucugaau

SEQ ID NO: 106967 - RNA, 19 nt, Homo sapiens
guacacagugcccuuauau

SEQ ID NO: 106968 - RNA, 19 nt, Homo sapiens
gcuaaaaccugaauuccaa

SEQ ID NO: 106969 - RNA, 19 nt, Homo sapiens
acucuaagguuaucuacuu

SEQ ID NO: 106970 - RNA, 19 nt, Homo sapiens
gaaaaccuguucuaucaau

SEQ ID NO: 106971 - RNA, 19 nt, Homo sapiens
gugcagcauuucacuuauu

SEQ ID NO: 106972 - RNA, 19 nt, Homo sapiens
ucaaaggauucgcaggaaa

SEQ ID NO: 106973 - RNA, 19 nt, Homo sapiens
ggaaaugaagggcuugaug

SEQ ID NO: 106974 - RNA, 19 nt, Homo sapiens
guaagggagcaguucaaua

SEQ ID NO: 106975 - RNA, 19 nt, Homo sapiens
ugugguaucuggagcauug

SEQ ID NO: 106976 - RNA, 19 nt, Homo sapiens
gcaaagcagcaacuauuca

SEQ ID NO: 106977 - RNA, 19 nt, Homo sapiens
gacaguggaucaccugcaa

SEQ ID NO: 106978 - RNA, 19 nt, Homo sapiens
gaacccuggugcucaagga

SEQ ID NO: 106979 - RNA, 19 nt, Homo sapiens
aggcuuaaauggauugaaa

SEQ ID NO: 106980 - RNA, 19 nt, Homo sapiens
aaagggugcuccugcuaaa

SEQ ID NO: 106981 - RNA, 19 nt, Homo sapiens
aaaccugaauuccaaugaa

SEQ ID NO: 106982 - RNA, 19 nt, Homo sapiens
ccuugucacugcuguuaua

SEQ ID NO: 106983 - RNA, 19 nt, Homo sapiens
ucauugcucuguaauaauc

SEQ ID NO: 106984 - RNA, 19 nt, Homo sapiens
ugugaaagcuggggaauua

SEQ ID NO: 106985 - RNA, 19 nt, Homo sapiens
ggacuuccaggcuuaaaug

SEQ ID NO: 106986 - RNA, 19 nt, Homo sapiens
gcaaggguugugucuguaa

SEQ ID NO: 106987 - RNA, 19 nt, Homo sapiens
caacaaagguucuaaagga

SEQ ID NO: 106988 - RNA, 19 nt, Homo sapiens
gauaaggucugaauaauag

SEQ ID NO: 106989 - RNA, 19 nt, Homo sapiens
gaagauaaggucugaauaa

SEQ ID NO: 106990 - RNA, 19 nt, Homo sapiens
ugaaagaacuuaaggcauu

SEQ ID NO: 106991 - RNA, 19 nt, Homo sapiens
gaagacaagugaugcuaaa

SEQ ID NO: 106992 - RNA, 19 nt, Homo sapiens
gagaagauauagaacuuga

SEQ ID NO: 106993 - RNA, 19 nt, Homo sapiens
gaaagaacuuaaggcauuu

SEQ ID NO: 106994 - RNA, 19 nt, Homo sapiens
uaagggagcaguucaauaa

SEQ ID NO: 106995 - RNA, 19 nt, Homo sapiens
cuacagagaugcuaagaga

SEQ ID NO: 106996 - RNA, 19 nt, Homo sapiens
caauauugcuccaugauga

SEQ ID NO: 106997 - RNA, 19 nt, Homo sapiens
gaacuuaaggcauuuguug

SEQ ID NO: 106998 - RNA, 19 nt, Homo sapiens
caacaaggcagaagaggua

SEQ ID NO: 106999 - RNA, 19 nt, Homo sapiens
guacuaaccuacagagaug

SEQ ID NO: 107000 - RNA, 19 nt, Homo sapiens
gcacacaaauaacaagaau

SEQ ID NO: 107001 - RNA, 19 nt, Homo sapiens
cauaauacccuuggaaaua

SEQ ID NO: 107002 - RNA, 19 nt, Homo sapiens
agagauaucccacguaaua

SEQ ID NO: 107003 - RNA, 19 nt, Homo sapiens
gaacuugauggcuaacuua

SEQ ID NO: 107004 - RNA, 19 nt, Homo sapiens
guauuuaacuucugaggaa

SEQ ID NO: 107005 - RNA, 19 nt, Homo sapiens
ccaaggacgugauggaauu

SEQ ID NO: 107006 - RNA, 19 nt, Homo sapiens
ccaaggacuuccaggcuua

SEQ ID NO: 107007 - RNA, 19 nt, Homo sapiens
gauguacucuaaauacuga

SEQ ID NO: 107008 - RNA, 19 nt, Homo sapiens
gcagcuggcuugaaaggaa

SEQ ID NO: 107009 - RNA, 19 nt, Homo sapiens
uauaagaggugaccaagga

SEQ ID NO: 107010 - RNA, 19 nt, Homo sapiens
ucagagauaucccacguaa

SEQ ID NO: 107011 - RNA, 19 nt, Homo sapiens
gaauuccaaugaagccaua

SEQ ID NO: 107012 - RNA, 19 nt, Homo sapiens
uagcucaugugcauuauuu

SEQ ID NO: 107013 - RNA, 19 nt, Homo sapiens
acaggugacucuaagguua

SEQ ID NO: 107014 - RNA, 19 nt, Homo sapiens
gcaguucaauaauccauga

SEQ ID NO: 107015 - RNA, 19 nt, Homo sapiens
caaagaggauauccaggaa

SEQ ID NO: 107016 - RNA, 19 nt, Homo sapiens
uaaggcauuuguugguuua

SEQ ID NO: 107017 - RNA, 19 nt, Homo sapiens
gaacaaggagauaaaggaa

SEQ ID NO: 107018 - RNA, 19 nt, Homo sapiens
aaauugggcucacuugauu

SEQ ID NO: 107019 - RNA, 19 nt, Homo sapiens
ugucacugcuguuauauuu

SEQ ID NO: 107020 - RNA, 19 nt, Homo sapiens
gaacacagaacugaacuga

SEQ ID NO: 107021 - RNA, 19 nt, Homo sapiens
gcuguuauauuucaucaug

SEQ ID NO: 107022 - RNA, 19 nt, Homo sapiens
ucagauacuuagcuuauga

SEQ ID NO: 107023 - RNA, 19 nt, Homo sapiens
gaugauaacacuauugaug

SEQ ID NO: 107024 - RNA, 19 nt, Homo sapiens
caaacaugcccauuacuaa

SEQ ID NO: 107025 - RNA, 19 nt, Homo sapiens
acuaagaugugcagcauuu

SEQ ID NO: 107026 - RNA, 19 nt, Homo sapiens
gaaaagacacugaagcuaa

SEQ ID NO: 107027 - RNA, 19 nt, Homo sapiens
guaacucauugcucuguaa

SEQ ID NO: 107028 - RNA, 19 nt, Homo sapiens
uaacuuggccgcuguaugu

SEQ ID NO: 107029 - RNA, 19 nt, Homo sapiens
cugaaagagucauuguuua

SEQ ID NO: 107030 - RNA, 19 nt, Homo sapiens
cagcauacgcacacaaaua

SEQ ID NO: 107031 - RNA, 19 nt, Homo sapiens
ccaccaggcucaagaggaa

SEQ ID NO: 107032 - RNA, 19 nt, Homo sapiens
gaagauauagaacuugaug

SEQ ID NO: 107033 - RNA, 19 nt, Homo sapiens
gcuccaugaugacuuagua

SEQ ID NO: 107034 - RNA, 19 nt, Homo sapiens
gaaagggcuuggauggaau

SEQ ID NO: 107035 - RNA, 19 nt, Homo sapiens
gaaagagugauaggacaua

SEQ ID NO: 107036 - RNA, 19 nt, Homo sapiens
ccauaaauguuggugcaua

SEQ ID NO: 107037 - RNA, 19 nt, Homo sapiens
caugaugacuuaguacaaa

SEQ ID NO: 107038 - RNA, 19 nt, Homo sapiens
gugauuguaugaaguuuga

SEQ ID NO: 107039 - RNA, 19 nt, Homo sapiens
gaccaggccucccagguau

SEQ ID NO: 107040 - RNA, 19 nt, Homo sapiens
agaaagggcuuggauggaa

SEQ ID NO: 107041 - RNA, 19 nt, Homo sapiens
ucaauugcuuuguaaguga

SEQ ID NO: 107042 - RNA, 19 nt, Homo sapiens
cagcaaggguugugucugu

SEQ ID NO: 107043 - RNA, 19 nt, Homo sapiens
ucucuaaucugugcuguuu

SEQ ID NO: 107044 - RNA, 19 nt, Homo sapiens
cagaaagccuauuccauca

SEQ ID NO: 107045 - RNA, 19 nt, Homo sapiens
acaaggagauaaaggaaau

SEQ ID NO: 107046 - RNA, 19 nt, Homo sapiens
guaaagggccagagaggaa

SEQ ID NO: 107047 - RNA, 19 nt, Homo sapiens
guuauauccugacaagauu

SEQ ID NO: 107048 - RNA, 19 nt, Homo sapiens
ucacaugguuuacauccuu

SEQ ID NO: 107049 - RNA, 19 nt, Homo sapiens
ucacugcuguuauauuuca

SEQ ID NO: 107050 - RNA, 19 nt, Homo sapiens
acucauugcucuguaauaa

SEQ ID NO: 107051 - RNA, 19 nt, Homo sapiens
ggaacaaggagauaaagga

SEQ ID NO: 107052 - RNA, 19 nt, Homo sapiens
ggaagacaagugaugcuaa

SEQ ID NO: 107053 - RNA, 19 nt, Homo sapiens
gaauaugucaucacucuag

SEQ ID NO: 107054 - RNA, 19 nt, Homo sapiens
aaacaauauugcuccauga

SEQ ID NO: 107055 - RNA, 19 nt, Homo sapiens
gaacaaaguaaugacagaa

SEQ ID NO: 107056 - RNA, 19 nt, Homo sapiens
gaaagccuauuccaucaac

SEQ ID NO: 107057 - RNA, 19 nt, Homo sapiens
caagggagaaccagcagua

SEQ ID NO: 107058 - RNA, 19 nt, Homo sapiens
gagccuggguuaccuggaa

SEQ ID NO: 107059 - RNA, 19 nt, Homo sapiens
ggaccaccaggaacaguua

SEQ ID NO: 107060 - RNA, 19 nt, Homo sapiens
ucaaacaugcccauuacua

SEQ ID NO: 107061 - RNA, 19 nt, Homo sapiens
ccacaggcauagaaggauu

SEQ ID NO: 107062 - RNA, 19 nt, Homo sapiens
auacaggucuuccaggauu

SEQ ID NO: 107063 - RNA, 19 nt, Homo sapiens
cuugauggcuaacuuacua

SEQ ID NO: 107064 - RNA, 19 nt, Homo sapiens
gccaguaguucucaaagug

SEQ ID NO: 107065 - RNA, 19 nt, Homo sapiens
gagaagauaaggucugaau

SEQ ID NO: 107066 - RNA, 19 nt, Homo sapiens
guacacagugcccuuauau

SEQ ID NO: 107067 - RNA, 19 nt, Homo sapiens
gcuaaaaccugaauuccaa

SEQ ID NO: 107068 - RNA, 19 nt, Homo sapiens
acucuaagguuaucuacuu

SEQ ID NO: 107069 - RNA, 19 nt, Homo sapiens
gaaaaccuguucuaucaau

SEQ ID NO: 107070 - RNA, 19 nt, Homo sapiens
gugcagcauuucacuuauu

SEQ ID NO: 107071 - RNA, 19 nt, Homo sapiens
ucaaaggauucgcaggaaa

SEQ ID NO: 107072 - RNA, 19 nt, Homo sapiens
ggaaaugaagggcuugaug

SEQ ID NO: 107073 - RNA, 19 nt, Homo sapiens
guaagggagcaguucaaua

SEQ ID NO: 107074 - RNA, 19 nt, Homo sapiens
ugugguaucuggagcauug

SEQ ID NO: 107075 - RNA, 19 nt, Homo sapiens
gcaaagcagcaacuauuca

SEQ ID NO: 107076 - RNA, 19 nt, Homo sapiens
gaacccuggugcucaagga

SEQ ID NO: 107077 - RNA, 19 nt, Homo sapiens
aggcuuaaauggauugaaa

SEQ ID NO: 107078 - RNA, 19 nt, Homo sapiens
aaagggugcuccugcuaaa

SEQ ID NO: 107079 - RNA, 19 nt, Homo sapiens
aaaccugaauuccaaugaa

SEQ ID NO: 107080 - RNA, 19 nt, Homo sapiens
ccuugucacugcuguuaua

SEQ ID NO: 107081 - RNA, 19 nt, Homo sapiens
ucauugcucuguaauaauc

SEQ ID NO: 107082 - RNA, 19 nt, Homo sapiens
ugugaaagcuggggaauua

SEQ ID NO: 107083 - RNA, 19 nt, Homo sapiens
ggacuuccaggcuuaaaug

SEQ ID NO: 107084 - RNA, 19 nt, Homo sapiens
gcaaggguugugucuguaa

SEQ ID NO: 107085 - RNA, 19 nt, Homo sapiens
caagugcaguucugugauc

SEQ ID NO: 107086 - RNA, 19 nt, Homo sapiens
ccuauuccaucaacuguga

SEQ ID NO: 107087 - RNA, 19 nt, Homo sapiens
ggacauggcucuaucuuua

SEQ ID NO: 107088 - RNA, 19 nt, Homo sapiens
gaauagaaaugccuacuuu

SEQ ID NO: 107089 - RNA, 19 nt, Homo sapiens
gcagggaacuugccacuuu

SEQ ID NO: 107090 - RNA, 19 nt, Homo sapiens
gaggagagcugggaagaua

SEQ ID NO: 107091 - RNA, 19 nt, Homo sapiens
guaaugagcucuuauaugc

SEQ ID NO: 107092 - RNA, 19 nt, Homo sapiens
aaacguaucuugcuugcua

SEQ ID NO: 107093 - RNA, 19 nt, Homo sapiens
gaagaacuggcuuuacuua

SEQ ID NO: 107094 - RNA, 19 nt, Homo sapiens
ucagaaaggugacacaauu

SEQ ID NO: 107095 - RNA, 19 nt, Homo sapiens
guaucuugcuugcuaauua

SEQ ID NO: 107096 - RNA, 19 nt, Homo sapiens
agaaagaggugauaaagga

SEQ ID NO: 107097 - RNA, 19 nt, Homo sapiens
ugacagagcuaucauuauc

SEQ ID NO: 107098 - RNA, 19 nt, Homo sapiens
gaacacagaaccucacuug

SEQ ID NO: 107099 - RNA, 19 nt, Homo sapiens
gaugauaaaggccagauua

SEQ ID NO: 107100 - RNA, 19 nt, Homo sapiens
gcagcugccuggaagauuu

SEQ ID NO: 107101 - RNA, 19 nt, Homo sapiens
agagaagacuggcagaaua

SEQ ID NO: 107102 - RNA, 19 nt, Homo sapiens
ggaauuuggugaucuaauc

SEQ ID NO: 107103 - RNA, 19 nt, Homo sapiens
agagaaagcucacaaucaa

SEQ ID NO: 107104 - RNA, 19 nt, Homo sapiens
gagccuagauacucuuauu

SEQ ID NO: 107105 - RNA, 19 nt, Homo sapiens
gaaagcagacuugcaguuu

SEQ ID NO: 107106 - RNA, 19 nt, Homo sapiens
uaagaggguucauugguuu

SEQ ID NO: 107107 - RNA, 19 nt, Homo sapiens
gaacuuggccugagaacau

SEQ ID NO: 107108 - RNA, 19 nt, Homo sapiens
aaacuucauucuuggguua

SEQ ID NO: 107109 - RNA, 19 nt, Homo sapiens
gcaaauaaguauagcuucu

SEQ ID NO: 107110 - RNA, 19 nt, Homo sapiens
uaaaggugcuucagguuug

SEQ ID NO: 107111 - RNA, 19 nt, Homo sapiens
guuaacaguuccuuucaaa

SEQ ID NO: 107112 - RNA, 19 nt, Homo sapiens
gauaaaggccagauuacaa

SEQ ID NO: 107113 - RNA, 19 nt, Homo sapiens
gcagggaccacauggauuu

SEQ ID NO: 107114 - RNA, 19 nt, Homo sapiens
gaaauacauugguccuugu

SEQ ID NO: 107115 - RNA, 19 nt, Homo sapiens
uauguucucuucugcauuu

SEQ ID NO: 107116 - RNA, 19 nt, Homo sapiens
gcagagauuuucaacauuu

SEQ ID NO: 107117 - RNA, 19 nt, Homo sapiens
ugacaugguuguaucaaga

SEQ ID NO: 107118 - RNA, 19 nt, Homo sapiens
caacugguguuccuggauu

SEQ ID NO: 107119 - RNA, 19 nt, Homo sapiens
aaggccagauuacaaauua

SEQ ID NO: 107120 - RNA, 19 nt, Homo sapiens
gcaagaggaccuaaaggaa

SEQ ID NO: 107121 - RNA, 19 nt, Homo sapiens
gaagacuggcagaauauuu

SEQ ID NO: 107122 - RNA, 19 nt, Homo sapiens
gaaaggcaaguagaugaua

SEQ ID NO: 107123 - RNA, 19 nt, Homo sapiens
ggauggacaugcuggagaa

SEQ ID NO: 107124 - RNA, 19 nt, Homo sapiens
ggcaacaguuugacauuug

SEQ ID NO: 107125 - RNA, 19 nt, Homo sapiens
ggucuugccuucccguauu

SEQ ID NO: 107126 - RNA, 19 nt, Homo sapiens
caagaggaccuaaaggaaa

SEQ ID NO: 107127 - RNA, 19 nt, Homo sapiens
cacaauuucuugcaacgua

SEQ ID NO: 107128 - RNA, 19 nt, Homo sapiens
ggagaaagagguccugaug

SEQ ID NO: 107129 - RNA, 19 nt, Homo sapiens
auaaacaggucaaugaaug

SEQ ID NO: 107130 - RNA, 19 nt, Homo sapiens
gaucgaagaacuggcuuua

SEQ ID NO: 107131 - RNA, 19 nt, Homo sapiens
gggagaaccuggagagaag

SEQ ID NO: 107132 - RNA, 19 nt, Homo sapiens
ggcacgcgcuucauacaaa

SEQ ID NO: 107133 - RNA, 19 nt, Homo sapiens
cuaagaggguucauugguu

SEQ ID NO: 107134 - RNA, 19 nt, Homo sapiens
cagaauauuuccuaguuca

SEQ ID NO: 107135 - RNA, 19 nt, Homo sapiens
gcagaauauuuccuaguuc

SEQ ID NO: 107136 - RNA, 19 nt, Homo sapiens
cacagaaccucacuuguca

SEQ ID NO: 107137 - RNA, 19 nt, Homo sapiens
aaaggcaaguagaugauaa

SEQ ID NO: 107138 - RNA, 19 nt, Homo sapiens
cuaaugaggugcuccuuca

SEQ ID NO: 107139 - RNA, 19 nt, Homo sapiens
ggugacaaauggaacauca

SEQ ID NO: 107140 - RNA, 19 nt, Homo sapiens
gagaagacuggcagaauau

SEQ ID NO: 107141 - RNA, 19 nt, Homo sapiens
gcacagauggauuuguuug

SEQ ID NO: 107142 - RNA, 19 nt, Homo sapiens
gaaacucaccuuccucauc

SEQ ID NO: 107143 - RNA, 19 nt, Homo sapiens
gggcuugccugguauucaa

SEQ ID NO: 107144 - RNA, 19 nt, Homo sapiens
gugauauacuguaguguug

SEQ ID NO: 107145 - RNA, 19 nt, Homo sapiens
aaacucaccuuccucaucu

SEQ ID NO: 107146 - RNA, 19 nt, Homo sapiens
ggucuaagaggguucauug

SEQ ID NO: 107147 - RNA, 19 nt, Homo sapiens
gagguaagggugacaaaug

SEQ ID NO: 107148 - RNA, 19 nt, Homo sapiens
ucuggcaguuugaauauuu

SEQ ID NO: 107149 - RNA, 19 nt, Homo sapiens
gggaauaccugggcuaaaa

SEQ ID NO: 107150 - RNA, 19 nt, Homo sapiens
gauuuguaaugagcucuua

SEQ ID NO: 107151 - RNA, 19 nt, Homo sapiens
ccagacaccuuaaaagaaa

SEQ ID NO: 107152 - RNA, 19 nt, Homo sapiens
gaacaucagaaacguaucu

SEQ ID NO: 107153 - RNA, 19 nt, Homo sapiens
ucauuugacccauuugaua

SEQ ID NO: 107154 - RNA, 19 nt, Homo sapiens
ggacucccuuucagugguu

SEQ ID NO: 107155 - RNA, 19 nt, Homo sapiens
gagcagcaccauuccuuga

SEQ ID NO: 107156 - RNA, 19 nt, Homo sapiens
gaaagaggugauaaaggaa

SEQ ID NO: 107157 - RNA, 19 nt, Homo sapiens
aagaggugcuccagggaua

SEQ ID NO: 107158 - RNA, 19 nt, Homo sapiens
agagggacaugcuggguuu

SEQ ID NO: 107159 - RNA, 19 nt, Homo sapiens
gaggugcuccuucagauug

SEQ ID NO: 107160 - RNA, 19 nt, Homo sapiens
caagggagaaucugguauu

SEQ ID NO: 107161 - RNA, 19 nt, Homo sapiens
ucagaaacguaucuugcuu

SEQ ID NO: 107162 - RNA, 19 nt, Homo sapiens
acaaauggaacaucagaaa

SEQ ID NO: 107163 - RNA, 19 nt, Homo sapiens
gagcuaucauuaucgacuu

SEQ ID NO: 107164 - RNA, 19 nt, Homo sapiens
gaaaggaccaaugggauuc

SEQ ID NO: 107165 - RNA, 19 nt, Homo sapiens
gaagagaagacuggcagaa

SEQ ID NO: 107166 - RNA, 19 nt, Homo sapiens
ggagaaagaggugauaaag

SEQ ID NO: 107167 - RNA, 19 nt, Homo sapiens
cuaggaauuuggugaucua

SEQ ID NO: 107168 - RNA, 19 nt, Homo sapiens
cgugacagagcuaucauua

SEQ ID NO: 107169 - RNA, 19 nt, Homo sapiens
cagaaaggcaaguagauga

SEQ ID NO: 107170 - RNA, 19 nt, Homo sapiens
gaacggcuugcauggauug

SEQ ID NO: 107171 - RNA, 19 nt, Homo sapiens
ggugaucuaauccuaaauu

SEQ ID NO: 107172 - RNA, 19 nt, Homo sapiens
gaaacuagaaagcagagau

SEQ ID NO: 107173 - RNA, 19 nt, Homo sapiens
cugcacagauggauuuguu

SEQ ID NO: 107174 - RNA, 19 nt, Homo sapiens
ggcgaagggugacaugguu

SEQ ID NO: 107175 - RNA, 19 nt, Homo sapiens
caagugugauauacuguag

SEQ ID NO: 107176 - RNA, 19 nt, Homo sapiens
gguagagccaccugacuuu

SEQ ID NO: 107177 - RNA, 19 nt, Homo sapiens
gcaacaguuugacauuugg

SEQ ID NO: 107178 - RNA, 19 nt, Homo sapiens
cggcuugcauggauugaaa

SEQ ID NO: 107179 - RNA, 19 nt, Homo sapiens
cuaaaggugcuucagguuu

SEQ ID NO: 107180 - RNA, 19 nt, Homo sapiens
aggcaaaccugguaugagu

SEQ ID NO: 107181 - RNA, 19 nt, Homo sapiens
ggagauaaggguccaacug

SEQ ID NO: 107182 - RNA, 19 nt, Homo sapiens
ggcucuaucuuuaaacgaa

SEQ ID NO: 107183 - RNA, 19 nt, Homo sapiens
uaagggccgauuuaauuaa

SEQ ID NO: 107184 - RNA, 19 nt, Homo sapiens
acacuuugcuccacacaca

SEQ ID NO: 107185 - RNA, 19 nt, Homo sapiens
gucaaugaaugaaacuaga

SEQ ID NO: 107186 - RNA, 19 nt, Homo sapiens
ucgaagaacuggcuuuacu

SEQ ID NO: 107187 - RNA, 19 nt, Homo sapiens
gcacauggauuucuuauua

SEQ ID NO: 107188 - RNA, 19 nt, Homo sapiens
ggacagaguaucauaauua

SEQ ID NO: 107189 - RNA, 19 nt, Homo sapiens
ccaaggaccucaaggcuua

SEQ ID NO: 107190 - RNA, 19 nt, Homo sapiens
gcuaucaucuccugacuua

SEQ ID NO: 107191 - RNA, 19 nt, Homo sapiens
gcuauauucuccaagauua

SEQ ID NO: 107192 - RNA, 19 nt, Homo sapiens
gcagaucagugaacagaaa

SEQ ID NO: 107193 - RNA, 19 nt, Homo sapiens
ggacuuauauuccuacauc

SEQ ID NO: 107194 - RNA, 19 nt, Homo sapiens
gaaccagguaguauaauua

SEQ ID NO: 107195 - RNA, 19 nt, Homo sapiens
gaaaggacccaguggagua

SEQ ID NO: 107196 - RNA, 19 nt, Homo sapiens
guacagaacugggaaacaa

SEQ ID NO: 107197 - RNA, 19 nt, Homo sapiens
gaaucacucuuuacagaaa

SEQ ID NO: 107198 - RNA, 19 nt, Homo sapiens
caacuuugcuucaagaaau

SEQ ID NO: 107199 - RNA, 19 nt, Homo sapiens
gaaaggagaucagggacuu

SEQ ID NO: 107200 - RNA, 19 nt, Homo sapiens
aaacacacacgcagaauua

SEQ ID NO: 107201 - RNA, 19 nt, Homo sapiens
ggacaaaguucuuccaaac

SEQ ID NO: 107202 - RNA, 19 nt, Homo sapiens
gagcaaagucucuauuauu

SEQ ID NO: 107203 - RNA, 19 nt, Homo sapiens
uagcaugaaucacucuuua

SEQ ID NO: 107204 - RNA, 19 nt, Homo sapiens
gauaacaugcugacuagua

SEQ ID NO: 107205 - RNA, 19 nt, Homo sapiens
ucagaaaggugaugaagga

SEQ ID NO: 107206 - RNA, 19 nt, Homo sapiens
ggaauaugggcuuaaauuu

SEQ ID NO: 107207 - RNA, 19 nt, Homo sapiens
caagauaacaugcugacua

SEQ ID NO: 107208 - RNA, 19 nt, Homo sapiens
aaagggugauggaggauua

SEQ ID NO: 107209 - RNA, 19 nt, Homo sapiens
gaauaugggcuuaaauuuc

SEQ ID NO: 107210 - RNA, 19 nt, Homo sapiens
gagagaggguuuccagguu

SEQ ID NO: 107211 - RNA, 19 nt, Homo sapiens
gaacacuucaggucuauga

SEQ ID NO: 107212 - RNA, 19 nt, Homo sapiens
ggaaauggagguauuaaag

SEQ ID NO: 107213 - RNA, 19 nt, Homo sapiens
caaaggugauccugguauu

SEQ ID NO: 107214 - RNA, 19 nt, Homo sapiens
ggaaggacacccaggauug

SEQ ID NO: 107215 - RNA, 19 nt, Homo sapiens
cauauaaacccucaagauu

SEQ ID NO: 107216 - RNA, 19 nt, Homo sapiens
caauggugcuacuauauau

SEQ ID NO: 107217 - RNA, 19 nt, Homo sapiens
aggcagagauggugaugua

SEQ ID NO: 107218 - RNA, 19 nt, Homo sapiens
gggaauaugggcuuaaauu

SEQ ID NO: 107219 - RNA, 19 nt, Homo sapiens
gcagaaggcucaggucaag

SEQ ID NO: 107220 - RNA, 19 nt, Homo sapiens
caagggagaacguggauuu

SEQ ID NO: 107221 - RNA, 19 nt, Homo sapiens
acaaaguucuuccaaacaa

SEQ ID NO: 107222 - RNA, 19 nt, Homo sapiens
gcugaaagcaggagacuug

SEQ ID NO: 107223 - RNA, 19 nt, Homo sapiens
uauaggaccuccaggauca

SEQ ID NO: 107224 - RNA, 19 nt, Homo sapiens
caccaggacuuccagguuu

SEQ ID NO: 107225 - RNA, 19 nt, Homo sapiens
gaaaagaccaauugaugua

SEQ ID NO: 107226 - RNA, 19 nt, Homo sapiens
ugaaccagguaguauaauu

SEQ ID NO: 107227 - RNA, 19 nt, Homo sapiens
gaagagucacauugaguaa

SEQ ID NO: 107228 - RNA, 19 nt, Homo sapiens
gcaaggagagccaggcaaa

SEQ ID NO: 107229 - RNA, 19 nt, Homo sapiens
gaacagaaaagaccaauug

SEQ ID NO: 107230 - RNA, 19 nt, Homo sapiens
cgaauuagccgaugucaag

SEQ ID NO: 107231 - RNA, 19 nt, Homo sapiens
gacuugaggacacgaauua

SEQ ID NO: 107232 - RNA, 19 nt, Homo sapiens
caccaggacuccaggguaa

SEQ ID NO: 107233 - RNA, 19 nt, Homo sapiens
gaaggaccaccuggaauuu

SEQ ID NO: 107234 - RNA, 19 nt, Homo sapiens
cgucaauggugcuacuaua

SEQ ID NO: 107235 - RNA, 19 nt, Homo sapiens
aggauuaccuggacagaaa

SEQ ID NO: 107236 - RNA, 19 nt, Homo sapiens
gaaccaggauuugcauuac

SEQ ID NO: 107237 - RNA, 19 nt, Homo sapiens
caacuggucccaaaggauu

SEQ ID NO: 107238 - RNA, 19 nt, Homo sapiens
aaacaacacuugguuaguc

SEQ ID NO: 107239 - RNA, 19 nt, Homo sapiens
ggaaacaacacuugguuag

SEQ ID NO: 107240 - RNA, 19 nt, Homo sapiens
ucaauggugcuacuauaua

SEQ ID NO: 107241 - RNA, 19 nt, Homo sapiens
gauuaucucuuaagaccau

SEQ ID NO: 107242 - RNA, 19 nt, Homo sapiens
gaaaugacuauucuuacug

SEQ ID NO: 107243 - RNA, 19 nt, Homo sapiens
gccaauugauguuucuuau

SEQ ID NO: 107244 - RNA, 19 nt, Homo sapiens
gggaaacaacacuugguua

SEQ ID NO: 107245 - RNA, 19 nt, Homo sapiens
ggcucuagcucucuccaua

SEQ ID NO: 107246 - RNA, 19 nt, Homo sapiens
auaacaugcugacuaguaa

SEQ ID NO: 107247 - RNA, 19 nt, Homo sapiens
gaagaggacauaacauuuu

SEQ ID NO: 107248 - RNA, 19 nt, Homo sapiens
gcaggugccucuggauuuc

SEQ ID NO: 107249 - RNA, 19 nt, Homo sapiens
cggagcaccugguccuaua

SEQ ID NO: 107250 - RNA, 19 nt, Homo sapiens
uggaagaauuggucuagaa

SEQ ID NO: 107251 - RNA, 19 nt, Homo sapiens
cauuggaacugguauuuca

SEQ ID NO: 107252 - RNA, 19 nt, Homo sapiens
caauugauguagaguuuca

SEQ ID NO: 107253 - RNA, 19 nt, Homo sapiens
acacuugguuagucucuuu

SEQ ID NO: 107254 - RNA, 19 nt, Homo sapiens
uaagagaagagucacauug

SEQ ID NO: 107255 - RNA, 19 nt, Homo sapiens
ggacauaacauuuugaaga

SEQ ID NO: 107256 - RNA, 19 nt, Homo sapiens
ccuggaaccuccucuguug

SEQ ID NO: 107257 - RNA, 19 nt, Homo sapiens
aaauggagguauuaaagga

SEQ ID NO: 107258 - RNA, 19 nt, Homo sapiens
ggacagccaggucuuauag

SEQ ID NO: 107259 - RNA, 19 nt, Homo sapiens
aaagggugaugauggaauu

SEQ ID NO: 107260 - RNA, 19 nt, Homo sapiens
ugaagaggacauaacauuu

SEQ ID NO: 107261 - RNA, 19 nt, Homo sapiens
ucaggucuaugaaggcuuu

SEQ ID NO: 107262 - RNA, 19 nt, Homo sapiens
cuagcucucuccauauaaa

SEQ ID NO: 107263 - RNA, 19 nt, Homo sapiens
ugaaccaggauuugcauua

SEQ ID NO: 107264 - RNA, 19 nt, Homo sapiens
agagaggguuuccagguuu

SEQ ID NO: 107265 - RNA, 19 nt, Homo sapiens
gacaacggaugcaccacaa

SEQ ID NO: 107266 - RNA, 19 nt, Homo sapiens
uggcuugccugguuugaaa

SEQ ID NO: 107267 - RNA, 19 nt, Homo sapiens
cuaccuggcuugccugguu

SEQ ID NO: 107268 - RNA, 19 nt, Homo sapiens
gaguggacaaccuggauua

SEQ ID NO: 107269 - RNA, 19 nt, Homo sapiens
caaaucuucugggcucaaa

SEQ ID NO: 107270 - RNA, 19 nt, Homo sapiens
gaugaaggaccaccuggaa

SEQ ID NO: 107271 - RNA, 19 nt, Homo sapiens
gaaaauggccaaccaggaa

SEQ ID NO: 107272 - RNA, 19 nt, Homo sapiens
ggugaaccagguaguauaa

SEQ ID NO: 107273 - RNA, 19 nt, Homo sapiens
gagaggguuuccagguuug

SEQ ID NO: 107274 - RNA, 19 nt, Homo sapiens
caaaguucuuccaaacaau

SEQ ID NO: 107275 - RNA, 19 nt, Homo sapiens
cuaaagaaauaaggaagug

SEQ ID NO: 107276 - RNA, 19 nt, Homo sapiens
gagcauccagccauucauu

SEQ ID NO: 107277 - RNA, 19 nt, Homo sapiens
gaaauggagguauuaaagg

SEQ ID NO: 107278 - RNA, 19 nt, Homo sapiens
ugggacaccuggaagaauu

SEQ ID NO: 107279 - RNA, 19 nt, Homo sapiens
ggauccaggucagacuaua

SEQ ID NO: 107280 - RNA, 19 nt, Homo sapiens
ggagagccugguggaauua

SEQ ID NO: 107281 - RNA, 19 nt, Homo sapiens
ugaaggaccaccuggaauu

SEQ ID NO: 107282 - RNA, 19 nt, Homo sapiens
caguaaaccucagucagaa

SEQ ID NO: 107283 - RNA, 19 nt, Homo sapiens
ucaguaaaccucagucaga

SEQ ID NO: 107284 - RNA, 19 nt, Homo sapiens
ccagagcccaugccaauga

SEQ ID NO: 107285 - RNA, 19 nt, Homo sapiens
gaacugggaaacaacacuu

SEQ ID NO: 107286 - RNA, 19 nt, Homo sapiens
uacaucaaguuacuacuga

SEQ ID NO: 107287 - RNA, 19 nt, Homo sapiens
gcacauggauuucuuauua

SEQ ID NO: 107288 - RNA, 19 nt, Homo sapiens
ggacagaguaucauaauua

SEQ ID NO: 107289 - RNA, 19 nt, Homo sapiens
ccaaggaccucaaggcuua

SEQ ID NO: 107290 - RNA, 19 nt, Homo sapiens
gcuaucaucuccugacuua

SEQ ID NO: 107291 - RNA, 19 nt, Homo sapiens
gcuauauucuccaagauua

SEQ ID NO: 107292 - RNA, 19 nt, Homo sapiens
gcagaucagugaacagaaa

SEQ ID NO: 107293 - RNA, 19 nt, Homo sapiens
ggacuuauauuccuacauc

SEQ ID NO: 107294 - RNA, 19 nt, Homo sapiens
gaaccagguaguauaauua

SEQ ID NO: 107295 - RNA, 19 nt, Homo sapiens
gaaaggacccaguggagua

SEQ ID NO: 107296 - RNA, 19 nt, Homo sapiens
guacagaacugggaaacaa

SEQ ID NO: 107297 - RNA, 19 nt, Homo sapiens
gaaucacucuuuacagaaa

SEQ ID NO: 107298 - RNA, 19 nt, Homo sapiens
caacuuugcuucaagaaau

SEQ ID NO: 107299 - RNA, 19 nt, Homo sapiens
gaaaggagaucagggacuu

SEQ ID NO: 107300 - RNA, 19 nt, Homo sapiens
aaacacacacgcagaauua

SEQ ID NO: 107301 - RNA, 19 nt, Homo sapiens
ggacaaaguucuuccaaac

SEQ ID NO: 107302 - RNA, 19 nt, Homo sapiens
gagcaaagucucuauuauu

SEQ ID NO: 107303 - RNA, 19 nt, Homo sapiens
uagcaugaaucacucuuua

SEQ ID NO: 107304 - RNA, 19 nt, Homo sapiens
gauaacaugcugacuagua

SEQ ID NO: 107305 - RNA, 19 nt, Homo sapiens
ucagaaaggugaugaagga

SEQ ID NO: 107306 - RNA, 19 nt, Homo sapiens
ggaauaugggcuuaaauuu

SEQ ID NO: 107307 - RNA, 19 nt, Homo sapiens
caagauaacaugcugacua

SEQ ID NO: 107308 - RNA, 19 nt, Homo sapiens
aaagggugauggaggauua

SEQ ID NO: 107309 - RNA, 19 nt, Homo sapiens
gaauaugggcuuaaauuuc

SEQ ID NO: 107310 - RNA, 19 nt, Homo sapiens
gagagaggguuuccagguu

SEQ ID NO: 107311 - RNA, 19 nt, Homo sapiens
gaacacuucaggucuauga

SEQ ID NO: 107312 - RNA, 19 nt, Homo sapiens
ggaaauggagguauuaaag

SEQ ID NO: 107313 - RNA, 19 nt, Homo sapiens
caaaggugauccugguauu

SEQ ID NO: 107314 - RNA, 19 nt, Homo sapiens
ggaaggacacccaggauug

SEQ ID NO: 107315 - RNA, 19 nt, Homo sapiens
cauauaaacccucaagauu

SEQ ID NO: 107316 - RNA, 19 nt, Homo sapiens
caauggugcuacuauauau

SEQ ID NO: 107317 - RNA, 19 nt, Homo sapiens
aggcagagauggugaugua

SEQ ID NO: 107318 - RNA, 19 nt, Homo sapiens
gggaauaugggcuuaaauu

SEQ ID NO: 107319 - RNA, 19 nt, Homo sapiens
gcagaaggcucaggucaag

SEQ ID NO: 107320 - RNA, 19 nt, Homo sapiens
caagggagaacguggauuu

SEQ ID NO: 107321 - RNA, 19 nt, Homo sapiens
acaaaguucuuccaaacaa

SEQ ID NO: 107322 - RNA, 19 nt, Homo sapiens
gcugaaagcaggagacuug

SEQ ID NO: 107323 - RNA, 19 nt, Homo sapiens
uauaggaccuccaggauca

SEQ ID NO: 107324 - RNA, 19 nt, Homo sapiens
caccaggacuuccagguuu

SEQ ID NO: 107325 - RNA, 19 nt, Homo sapiens
gaaaagaccaauugaugua

SEQ ID NO: 107326 - RNA, 19 nt, Homo sapiens
ugaaccagguaguauaauu

SEQ ID NO: 107327 - RNA, 19 nt, Homo sapiens
gaagagucacauugaguaa

SEQ ID NO: 107328 - RNA, 19 nt, Homo sapiens
gcaaggagagccaggcaaa

SEQ ID NO: 107329 - RNA, 19 nt, Homo sapiens
gaacagaaaagaccaauug

SEQ ID NO: 107330 - RNA, 19 nt, Homo sapiens
cgaauuagccgaugucaag

SEQ ID NO: 107331 - RNA, 19 nt, Homo sapiens
gacuugaggacacgaauua

SEQ ID NO: 107332 - RNA, 19 nt, Homo sapiens
caccaggacuccaggguaa

SEQ ID NO: 107333 - RNA, 19 nt, Homo sapiens
gaaggaccaccuggaauuu

SEQ ID NO: 107334 - RNA, 19 nt, Homo sapiens
cgucaauggugcuacuaua

SEQ ID NO: 107335 - RNA, 19 nt, Homo sapiens
aggauuaccuggacagaaa

SEQ ID NO: 107336 - RNA, 19 nt, Homo sapiens
gaaccaggauuugcauuac

SEQ ID NO: 107337 - RNA, 19 nt, Homo sapiens
caacuggucccaaaggauu

SEQ ID NO: 107338 - RNA, 19 nt, Homo sapiens
aaacaacacuugguuaguc

SEQ ID NO: 107339 - RNA, 19 nt, Homo sapiens
ggaaacaacacuugguuag

SEQ ID NO: 107340 - RNA, 19 nt, Homo sapiens
ucaauggugcuacuauaua

SEQ ID NO: 107341 - RNA, 19 nt, Homo sapiens
gauuaucucuuaagaccau

SEQ ID NO: 107342 - RNA, 19 nt, Homo sapiens
gaaaugacuauucuuacug

SEQ ID NO: 107343 - RNA, 19 nt, Homo sapiens
gccaauugauguuucuuau

SEQ ID NO: 107344 - RNA, 19 nt, Homo sapiens
gggaaacaacacuugguua

SEQ ID NO: 107345 - RNA, 19 nt, Homo sapiens
ggcucuagcucucuccaua

SEQ ID NO: 107346 - RNA, 19 nt, Homo sapiens
auaacaugcugacuaguaa

SEQ ID NO: 107347 - RNA, 19 nt, Homo sapiens
gaagaggacauaacauuuu

SEQ ID NO: 107348 - RNA, 19 nt, Homo sapiens
gcaggugccucuggauuuc

SEQ ID NO: 107349 - RNA, 19 nt, Homo sapiens
cggagcaccugguccuaua

SEQ ID NO: 107350 - RNA, 19 nt, Homo sapiens
uggaagaauuggucuagaa

SEQ ID NO: 107351 - RNA, 19 nt, Homo sapiens
cauuggaacugguauuuca

SEQ ID NO: 107352 - RNA, 19 nt, Homo sapiens
caauugauguagaguuuca

SEQ ID NO: 107353 - RNA, 19 nt, Homo sapiens
acacuugguuagucucuuu

SEQ ID NO: 107354 - RNA, 19 nt, Homo sapiens
uaagagaagagucacauug

SEQ ID NO: 107355 - RNA, 19 nt, Homo sapiens
ggacauaacauuuugaaga

SEQ ID NO: 107356 - RNA, 19 nt, Homo sapiens
ccuggaaccuccucuguug

SEQ ID NO: 107357 - RNA, 19 nt, Homo sapiens
aaauggagguauuaaagga

SEQ ID NO: 107358 - RNA, 19 nt, Homo sapiens
ggacagccaggucuuauag

SEQ ID NO: 107359 - RNA, 19 nt, Homo sapiens
aaagggugaugauggaauu

SEQ ID NO: 107360 - RNA, 19 nt, Homo sapiens
ugaagaggacauaacauuu

SEQ ID NO: 107361 - RNA, 19 nt, Homo sapiens
ucaggucuaugaaggcuuu

SEQ ID NO: 107362 - RNA, 19 nt, Homo sapiens
cuagcucucuccauauaaa

SEQ ID NO: 107363 - RNA, 19 nt, Homo sapiens
ugaaccaggauuugcauua

SEQ ID NO: 107364 - RNA, 19 nt, Homo sapiens
agagaggguuuccagguuu

SEQ ID NO: 107365 - RNA, 19 nt, Homo sapiens
gacaacggaugcaccacaa

SEQ ID NO: 107366 - RNA, 19 nt, Homo sapiens
uggcuugccugguuugaaa

SEQ ID NO: 107367 - RNA, 19 nt, Homo sapiens
cuaccuggcuugccugguu

SEQ ID NO: 107368 - RNA, 19 nt, Homo sapiens
gaguggacaaccuggauua

SEQ ID NO: 107369 - RNA, 19 nt, Homo sapiens
caaaucuucugggcucaaa

SEQ ID NO: 107370 - RNA, 19 nt, Homo sapiens
gaugaaggaccaccuggaa

SEQ ID NO: 107371 - RNA, 19 nt, Homo sapiens
gaaaauggccaaccaggaa

SEQ ID NO: 107372 - RNA, 19 nt, Homo sapiens
ggugaaccagguaguauaa

SEQ ID NO: 107373 - RNA, 19 nt, Homo sapiens
gagaggguuuccagguuug

SEQ ID NO: 107374 - RNA, 19 nt, Homo sapiens
caaaguucuuccaaacaau

SEQ ID NO: 107375 - RNA, 19 nt, Homo sapiens
cuaaagaaauaaggaagug

SEQ ID NO: 107376 - RNA, 19 nt, Homo sapiens
gagcauccagccauucauu

SEQ ID NO: 107377 - RNA, 19 nt, Homo sapiens
gaaauggagguauuaaagg

SEQ ID NO: 107378 - RNA, 19 nt, Homo sapiens
ugggacaccuggaagaauu

SEQ ID NO: 107379 - RNA, 19 nt, Homo sapiens
ggauccaggucagacuaua

SEQ ID NO: 107380 - RNA, 19 nt, Homo sapiens
ggagagccugguggaauua

SEQ ID NO: 107381 - RNA, 19 nt, Homo sapiens
ugaaggaccaccuggaauu

SEQ ID NO: 107382 - RNA, 19 nt, Homo sapiens
caguaaaccucagucagaa

SEQ ID NO: 107383 - RNA, 19 nt, Homo sapiens
ucaguaaaccucagucaga

SEQ ID NO: 107384 - RNA, 19 nt, Homo sapiens
ccagagcccaugccaauga

SEQ ID NO: 107385 - RNA, 19 nt, Homo sapiens
gaacugggaaacaacacuu

SEQ ID NO: 107386 - RNA, 19 nt, Homo sapiens
uacaucaaguuacuacuga

SEQ ID NO: 107387 - RNA, 19 nt, Homo sapiens
gcacauggauuucuuauua

SEQ ID NO: 107388 - RNA, 19 nt, Homo sapiens
ggacagaguaucauaauua

SEQ ID NO: 107389 - RNA, 19 nt, Homo sapiens
ccaaggaccucaaggcuua

SEQ ID NO: 107390 - RNA, 19 nt, Homo sapiens
gcuaucaucuccugacuua

SEQ ID NO: 107391 - RNA, 19 nt, Homo sapiens
gcuauauucuccaagauua

SEQ ID NO: 107392 - RNA, 19 nt, Homo sapiens
gcagaucagugaacagaaa

SEQ ID NO: 107393 - RNA, 19 nt, Homo sapiens
ggacuuauauuccuacauc

SEQ ID NO: 107394 - RNA, 19 nt, Homo sapiens
gaaccagguaguauaauua

SEQ ID NO: 107395 - RNA, 19 nt, Homo sapiens
gaaaggacccaguggagua

SEQ ID NO: 107396 - RNA, 19 nt, Homo sapiens
guacagaacugggaaacaa

SEQ ID NO: 107397 - RNA, 19 nt, Homo sapiens
gaaucacucuuuacagaaa

SEQ ID NO: 107398 - RNA, 19 nt, Homo sapiens
caacuuugcuucaagaaau

SEQ ID NO: 107399 - RNA, 19 nt, Homo sapiens
gaaaggagaucagggacuu

SEQ ID NO: 107400 - RNA, 19 nt, Homo sapiens
aaacacacacgcagaauua

SEQ ID NO: 107401 - RNA, 19 nt, Homo sapiens
ggacaaaguucuuccaaac

SEQ ID NO: 107402 - RNA, 19 nt, Homo sapiens
gagcaaagucucuauuauu

SEQ ID NO: 107403 - RNA, 19 nt, Homo sapiens
uagcaugaaucacucuuua

SEQ ID NO: 107404 - RNA, 19 nt, Homo sapiens
gauaacaugcugacuagua

SEQ ID NO: 107405 - RNA, 19 nt, Homo sapiens
ucagaaaggugaugaagga

SEQ ID NO: 107406 - RNA, 19 nt, Homo sapiens
ggaauaugggcuuaaauuu

SEQ ID NO: 107407 - RNA, 19 nt, Homo sapiens
caagauaacaugcugacua

SEQ ID NO: 107408 - RNA, 19 nt, Homo sapiens
aaagggugauggaggauua

SEQ ID NO: 107409 - RNA, 19 nt, Homo sapiens
gaauaugggcuuaaauuuc

SEQ ID NO: 107410 - RNA, 19 nt, Homo sapiens
gagagaggguuuccagguu

SEQ ID NO: 107411 - RNA, 19 nt, Homo sapiens
gaacacuucaggucuauga

SEQ ID NO: 107412 - RNA, 19 nt, Homo sapiens
ggaaauggagguauuaaag

SEQ ID NO: 107413 - RNA, 19 nt, Homo sapiens
caaaggugauccugguauu

SEQ ID NO: 107414 - RNA, 19 nt, Homo sapiens
ggaaggacacccaggauug

SEQ ID NO: 107415 - RNA, 19 nt, Homo sapiens
cauauaaacccucaagauu

SEQ ID NO: 107416 - RNA, 19 nt, Homo sapiens
caauggugcuacuauauau

SEQ ID NO: 107417 - RNA, 19 nt, Homo sapiens
aggcagagauggugaugua

SEQ ID NO: 107418 - RNA, 19 nt, Homo sapiens
gggaauaugggcuuaaauu

SEQ ID NO: 107419 - RNA, 19 nt, Homo sapiens
gcagaaggcucaggucaag

SEQ ID NO: 107420 - RNA, 19 nt, Homo sapiens
caagggagaacguggauuu

SEQ ID NO: 107421 - RNA, 19 nt, Homo sapiens
acaaaguucuuccaaacaa

SEQ ID NO: 107422 - RNA, 19 nt, Homo sapiens
gcugaaagcaggagacuug

SEQ ID NO: 107423 - RNA, 19 nt, Homo sapiens
uauaggaccuccaggauca

SEQ ID NO: 107424 - RNA, 19 nt, Homo sapiens
caccaggacuuccagguuu

SEQ ID NO: 107425 - RNA, 19 nt, Homo sapiens
gaaaagaccaauugaugua

SEQ ID NO: 107426 - RNA, 19 nt, Homo sapiens
ugaaccagguaguauaauu

SEQ ID NO: 107427 - RNA, 19 nt, Homo sapiens
gaagagucacauugaguaa

SEQ ID NO: 107428 - RNA, 19 nt, Homo sapiens
gcaaggagagccaggcaaa

SEQ ID NO: 107429 - RNA, 19 nt, Homo sapiens
gaacagaaaagaccaauug

SEQ ID NO: 107430 - RNA, 19 nt, Homo sapiens
cgaauuagccgaugucaag

SEQ ID NO: 107431 - RNA, 19 nt, Homo sapiens
gacuugaggacacgaauua

SEQ ID NO: 107432 - RNA, 19 nt, Homo sapiens
caccaggacuccaggguaa

SEQ ID NO: 107433 - RNA, 19 nt, Homo sapiens
gaaggaccaccuggaauuu

SEQ ID NO: 107434 - RNA, 19 nt, Homo sapiens
cgucaauggugcuacuaua

SEQ ID NO: 107435 - RNA, 19 nt, Homo sapiens
aggauuaccuggacagaaa

SEQ ID NO: 107436 - RNA, 19 nt, Homo sapiens
gaaccaggauuugcauuac

SEQ ID NO: 107437 - RNA, 19 nt, Homo sapiens
caacuggucccaaaggauu

SEQ ID NO: 107438 - RNA, 19 nt, Homo sapiens
aaacaacacuugguuaguc

SEQ ID NO: 107439 - RNA, 19 nt, Homo sapiens
ggaaacaacacuugguuag

SEQ ID NO: 107440 - RNA, 19 nt, Homo sapiens
ucaauggugcuacuauaua

SEQ ID NO: 107441 - RNA, 19 nt, Homo sapiens
gauuaucucuuaagaccau

SEQ ID NO: 107442 - RNA, 19 nt, Homo sapiens
gaaaugacuauucuuacug

SEQ ID NO: 107443 - RNA, 19 nt, Homo sapiens
gccaauugauguuucuuau

SEQ ID NO: 107444 - RNA, 19 nt, Homo sapiens
gggaaacaacacuugguua

SEQ ID NO: 107445 - RNA, 19 nt, Homo sapiens
ggcucuagcucucuccaua

SEQ ID NO: 107446 - RNA, 19 nt, Homo sapiens
auaacaugcugacuaguaa

SEQ ID NO: 107447 - RNA, 19 nt, Homo sapiens
gaagaggacauaacauuuu

SEQ ID NO: 107448 - RNA, 19 nt, Homo sapiens
gcaggugccucuggauuuc

SEQ ID NO: 107449 - RNA, 19 nt, Homo sapiens
cggagcaccugguccuaua

SEQ ID NO: 107450 - RNA, 19 nt, Homo sapiens
uggaagaauuggucuagaa

SEQ ID NO: 107451 - RNA, 19 nt, Homo sapiens
cauuggaacugguauuuca

SEQ ID NO: 107452 - RNA, 19 nt, Homo sapiens
caauugauguagaguuuca

SEQ ID NO: 107453 - RNA, 19 nt, Homo sapiens
acacuugguuagucucuuu

SEQ ID NO: 107454 - RNA, 19 nt, Homo sapiens
uaagagaagagucacauug

SEQ ID NO: 107455 - RNA, 19 nt, Homo sapiens
ggacauaacauuuugaaga

SEQ ID NO: 107456 - RNA, 19 nt, Homo sapiens
ccuggaaccuccucuguug

SEQ ID NO: 107457 - RNA, 19 nt, Homo sapiens
aaauggagguauuaaagga

SEQ ID NO: 107458 - RNA, 19 nt, Homo sapiens
ggacagccaggucuuauag

SEQ ID NO: 107459 - RNA, 19 nt, Homo sapiens
aaagggugaugauggaauu

SEQ ID NO: 107460 - RNA, 19 nt, Homo sapiens
ugaagaggacauaacauuu

SEQ ID NO: 107461 - RNA, 19 nt, Homo sapiens
ucaggucuaugaaggcuuu

SEQ ID NO: 107462 - RNA, 19 nt, Homo sapiens
cuagcucucuccauauaaa

SEQ ID NO: 107463 - RNA, 19 nt, Homo sapiens
ugaaccaggauuugcauua

SEQ ID NO: 107464 - RNA, 19 nt, Homo sapiens
agagaggguuuccagguuu

SEQ ID NO: 107465 - RNA, 19 nt, Homo sapiens
gacaacggaugcaccacaa

SEQ ID NO: 107466 - RNA, 19 nt, Homo sapiens
uggcuugccugguuugaaa

SEQ ID NO: 107467 - RNA, 19 nt, Homo sapiens
cuaccuggcuugccugguu

SEQ ID NO: 107468 - RNA, 19 nt, Homo sapiens
gaguggacaaccuggauua

SEQ ID NO: 107469 - RNA, 19 nt, Homo sapiens
caaaucuucugggcucaaa

SEQ ID NO: 107470 - RNA, 19 nt, Homo sapiens
gaugaaggaccaccuggaa

SEQ ID NO: 107471 - RNA, 19 nt, Homo sapiens
gaaaauggccaaccaggaa

SEQ ID NO: 107472 - RNA, 19 nt, Homo sapiens
ggugaaccagguaguauaa

SEQ ID NO: 107473 - RNA, 19 nt, Homo sapiens
gagaggguuuccagguuug

SEQ ID NO: 107474 - RNA, 19 nt, Homo sapiens
caaaguucuuccaaacaau

SEQ ID NO: 107475 - RNA, 19 nt, Homo sapiens
cuaaagaaauaaggaagug

SEQ ID NO: 107476 - RNA, 19 nt, Homo sapiens
gagcauccagccauucauu

SEQ ID NO: 107477 - RNA, 19 nt, Homo sapiens
gaaauggagguauuaaagg

SEQ ID NO: 107478 - RNA, 19 nt, Homo sapiens
ugggacaccuggaagaauu

SEQ ID NO: 107479 - RNA, 19 nt, Homo sapiens
ggauccaggucagacuaua

SEQ ID NO: 107480 - RNA, 19 nt, Homo sapiens
ggagagccugguggaauua

SEQ ID NO: 107481 - RNA, 19 nt, Homo sapiens
ugaaggaccaccuggaauu

SEQ ID NO: 107482 - RNA, 19 nt, Homo sapiens
caguaaaccucagucagaa

SEQ ID NO: 107483 - RNA, 19 nt, Homo sapiens
ucaguaaaccucagucaga

SEQ ID NO: 107484 - RNA, 19 nt, Homo sapiens
ccagagcccaugccaauga

SEQ ID NO: 107485 - RNA, 19 nt, Homo sapiens
gaacugggaaacaacacuu

SEQ ID NO: 107486 - RNA, 19 nt, Homo sapiens
uacaucaaguuacuacuga

SEQ ID NO: 107487 - RNA, 19 nt, Homo sapiens
ucaaggagcuguuggauuu

SEQ ID NO: 107488 - RNA, 19 nt, Homo sapiens
gaaagugguucacaaggua

SEQ ID NO: 107489 - RNA, 19 nt, Homo sapiens
gcaaggcccuccaggauuu

SEQ ID NO: 107490 - RNA, 19 nt, Homo sapiens
ggagagaagucuuauggaa

SEQ ID NO: 107491 - RNA, 19 nt, Homo sapiens
aggaagagauggacuaaua

SEQ ID NO: 107492 - RNA, 19 nt, Homo sapiens
aaacaaaggugaagaugga

SEQ ID NO: 107493 - RNA, 19 nt, Homo sapiens
gaacaaggccuacaaggau

SEQ ID NO: 107494 - RNA, 19 nt, Homo sapiens
gaaagguccuccuggauca

SEQ ID NO: 107495 - RNA, 19 nt, Homo sapiens
gaacagagaguuucuacau

SEQ ID NO: 107496 - RNA, 19 nt, Homo sapiens
cuacaaggcuccaaagguu

SEQ ID NO: 107497 - RNA, 19 nt, Homo sapiens
gggcuuccgugguguaaua

SEQ ID NO: 107498 - RNA, 19 nt, Homo sapiens
gagaucugcuguccuguuu

SEQ ID NO: 107499 - RNA, 19 nt, Homo sapiens
ucucagaagucccuguuua

SEQ ID NO: 107500 - RNA, 19 nt, Homo sapiens
gcacacauuauuugguuua

SEQ ID NO: 107501 - RNA, 19 nt, Homo sapiens
gccaagaggugacaaagga

SEQ ID NO: 107502 - RNA, 19 nt, Homo sapiens
ccagaacacucuuagcuau

SEQ ID NO: 107503 - RNA, 19 nt, Homo sapiens
gcuaaucagucauuucuuc

SEQ ID NO: 107504 - RNA, 19 nt, Homo sapiens
gcacaaaggauuucuugga

SEQ ID NO: 107505 - RNA, 19 nt, Homo sapiens
ggacggaguaccagguuua

SEQ ID NO: 107506 - RNA, 19 nt, Homo sapiens
gaggcccacuugugucuua

SEQ ID NO: 107507 - RNA, 19 nt, Homo sapiens
ugaauggucugaagaagga

SEQ ID NO: 107508 - RNA, 19 nt, Homo sapiens
uuucacagguagccuauua

SEQ ID NO: 107509 - RNA, 19 nt, Homo sapiens
ggacuaauaggcaauauag

SEQ ID NO: 107510 - RNA, 19 nt, Homo sapiens
guacagaggucagcacaca

SEQ ID NO: 107511 - RNA, 19 nt, Homo sapiens
gaaucacccugcccuguau

SEQ ID NO: 107512 - RNA, 19 nt, Homo sapiens
ccagguaguuucaaaggaa

SEQ ID NO: 107513 - RNA, 19 nt, Homo sapiens
ggaaucacccugcccugua

SEQ ID NO: 107514 - RNA, 19 nt, Homo sapiens
gcacaguguugguuuccuu

SEQ ID NO: 107515 - RNA, 19 nt, Homo sapiens
gcaagagaauugaaaugag

SEQ ID NO: 107516 - RNA, 19 nt, Homo sapiens
cagcacacauuauuugguu

SEQ ID NO: 107517 - RNA, 19 nt, Homo sapiens
uaacagggcacaaaggauu

SEQ ID NO: 107518 - RNA, 19 nt, Homo sapiens
uaaaggcaaggauggauua

SEQ ID NO: 107519 - RNA, 19 nt, Homo sapiens
ggaacaaggccuacaagga

SEQ ID NO: 107520 - RNA, 19 nt, Homo sapiens
gagagaagucuuauggaaa

SEQ ID NO: 107521 - RNA, 19 nt, Homo sapiens
gagcaaguccucacucuuc

SEQ ID NO: 107522 - RNA, 19 nt, Homo sapiens
ccuaaucgcuaaucaguca

SEQ ID NO: 107523 - RNA, 19 nt, Homo sapiens
acugcuagcuuucuccuua

SEQ ID NO: 107524 - RNA, 19 nt, Homo sapiens
uaagggagaccaaggaauu

SEQ ID NO: 107525 - RNA, 19 nt, Homo sapiens
cggaauaccuaguccaaga

SEQ ID NO: 107526 - RNA, 19 nt, Homo sapiens
gauuggcaguccaggcuua

SEQ ID NO: 107527 - RNA, 19 nt, Homo sapiens
caauacagacaaagcauaa

SEQ ID NO: 107528 - RNA, 19 nt, Homo sapiens
caaaggaguuaguggaaag

SEQ ID NO: 107529 - RNA, 19 nt, Homo sapiens
gaaccaauucucaguacaa

SEQ ID NO: 107530 - RNA, 19 nt, Homo sapiens
guacauuggagucucauuu

SEQ ID NO: 107531 - RNA, 19 nt, Homo sapiens
cagguagccuauuaaacua

SEQ ID NO: 107532 - RNA, 19 nt, Homo sapiens
ggaaagaaaggaacaagag

SEQ ID NO: 107533 - RNA, 19 nt, Homo sapiens
acaaggagcacccggauuu

SEQ ID NO: 107534 - RNA, 19 nt, Homo sapiens
ccuccuggaucaauuguaa

SEQ ID NO: 107535 - RNA, 19 nt, Homo sapiens
ggucagcacacauuauuug

SEQ ID NO: 107536 - RNA, 19 nt, Homo sapiens
gaggucagcacacauuauu

SEQ ID NO: 107537 - RNA, 19 nt, Homo sapiens
ucaaaggaaaugagaauga

SEQ ID NO: 107538 - RNA, 19 nt, Homo sapiens
gacaaaccaucuccuccuu

SEQ ID NO: 107539 - RNA, 19 nt, Homo sapiens
gcauaugguccuagacaaa

SEQ ID NO: 107540 - RNA, 19 nt, Homo sapiens
ccaaaggcuucccuggauu

SEQ ID NO: 107541 - RNA, 19 nt, Homo sapiens
guccagaauuugagacuga

SEQ ID NO: 107542 - RNA, 19 nt, Homo sapiens
caugggaguuccuggcuuu

SEQ ID NO: 107543 - RNA, 19 nt, Homo sapiens
gguagccuauuaaacuauu

SEQ ID NO: 107544 - RNA, 19 nt, Homo sapiens
gauguggccugguucaaag

SEQ ID NO: 107545 - RNA, 19 nt, Homo sapiens
uuagcucucucuagaauga

SEQ ID NO: 107546 - RNA, 19 nt, Homo sapiens
ucagucauuucuucaugua

SEQ ID NO: 107547 - RNA, 19 nt, Homo sapiens
ggaguugccugugucugaa

SEQ ID NO: 107548 - RNA, 19 nt, Homo sapiens
ccucugggaucacagguuu

SEQ ID NO: 107549 - RNA, 19 nt, Homo sapiens
gcugugaucucagguaauc

SEQ ID NO: 107550 - RNA, 19 nt, Homo sapiens
gaaaggauccaagggugaa

SEQ ID NO: 107551 - RNA, 19 nt, Homo sapiens
gauucuguuuccuuaagua

SEQ ID NO: 107552 - RNA, 19 nt, Homo sapiens
agagaagucuuauggaaag

SEQ ID NO: 107553 - RNA, 19 nt, Homo sapiens
ccaagccuaucaaaggaaa

SEQ ID NO: 107554 - RNA, 19 nt, Homo sapiens
ggccaagccuaucaaagga

SEQ ID NO: 107555 - RNA, 19 nt, Homo sapiens
cagaggauguggccugguu

SEQ ID NO: 107556 - RNA, 19 nt, Homo sapiens
gcaccaugcccuucaucua

SEQ ID NO: 107557 - RNA, 19 nt, Homo sapiens
ucaaaggaguuaguggaaa

SEQ ID NO: 107558 - RNA, 19 nt, Homo sapiens
gaacaagaggcaagaaagg

SEQ ID NO: 107559 - RNA, 19 nt, Homo sapiens
ggucauuaauggcauaugg

SEQ ID NO: 107560 - RNA, 19 nt, Homo sapiens
aacagagaguuucuacaua

SEQ ID NO: 107561 - RNA, 19 nt, Homo sapiens
ucacaacagucaccucaca

SEQ ID NO: 107562 - RNA, 19 nt, Homo sapiens
caaaggcuucccuggauuu

SEQ ID NO: 107563 - RNA, 19 nt, Homo sapiens
gaaggggucuguuggauuc

SEQ ID NO: 107564 - RNA, 19 nt, Homo sapiens
acagagaguuucuacauac

SEQ ID NO: 107565 - RNA, 19 nt, Homo sapiens
ggcaagagaauugaaauga

SEQ ID NO: 107566 - RNA, 19 nt, Homo sapiens
gaucugcuguccuguuucu

SEQ ID NO: 107567 - RNA, 19 nt, Homo sapiens
ugcagaagcuguccagguu

SEQ ID NO: 107568 - RNA, 19 nt, Homo sapiens
gcaauugggccucuaggau

SEQ ID NO: 107569 - RNA, 19 nt, Homo sapiens
cguccaaugucaaaccuuu

SEQ ID NO: 107570 - RNA, 19 nt, Homo sapiens
uaaaggagccagaggagau

SEQ ID NO: 107571 - RNA, 19 nt, Homo sapiens
cuggauggcuguaauggaa

SEQ ID NO: 107572 - RNA, 19 nt, Homo sapiens
uauaaacugugccaauaca

SEQ ID NO: 107573 - RNA, 19 nt, Homo sapiens
gugcugugaucucagguaa

SEQ ID NO: 107574 - RNA, 19 nt, Homo sapiens
gagaguuucuacauacaag

SEQ ID NO: 107575 - RNA, 19 nt, Homo sapiens
aaaaggauauccaggaauu

SEQ ID NO: 107576 - RNA, 19 nt, Homo sapiens
caagacguccaaugucaaa

SEQ ID NO: 107577 - RNA, 19 nt, Homo sapiens
ggaaauccaggccuaguag

SEQ ID NO: 107578 - RNA, 19 nt, Homo sapiens
gaucaauuguaaagaaagg

SEQ ID NO: 107579 - RNA, 19 nt, Homo sapiens
ccaauacagacaaagcaua

SEQ ID NO: 107580 - RNA, 19 nt, Homo sapiens
cuagcacacucuucucuug

SEQ ID NO: 107581 - RNA, 19 nt, Homo sapiens
gcaggcaagagaauugaaa

SEQ ID NO: 107582 - RNA, 19 nt, Homo sapiens
gaggagaggcagcaguuug

SEQ ID NO: 107583 - RNA, 19 nt, Homo sapiens
gcaaugauaaaucuuacug

SEQ ID NO: 107584 - RNA, 19 nt, Homo sapiens
ucaacgaggugugccacua

SEQ ID NO: 107585 - RNA, 19 nt, Homo sapiens
acaaggcuccaaagguuua

SEQ ID NO: 107586 - RNA, 19 nt, Homo sapiens
gccagacaguugaaauuuc

SEQ ID NO: 107587 - RNA, 19 nt, Homo sapiens
ucaaggagcuguuggauuu

SEQ ID NO: 107588 - RNA, 19 nt, Homo sapiens
gaaagugguucacaaggua

SEQ ID NO: 107589 - RNA, 19 nt, Homo sapiens
gcaaggcccuccaggauuu

SEQ ID NO: 107590 - RNA, 19 nt, Homo sapiens
ggagagaagucuuauggaa

SEQ ID NO: 107591 - RNA, 19 nt, Homo sapiens
aggaagagauggacuaaua

SEQ ID NO: 107592 - RNA, 19 nt, Homo sapiens
aaacaaaggugaagaugga

SEQ ID NO: 107593 - RNA, 19 nt, Homo sapiens
gaacaaggccuacaaggau

SEQ ID NO: 107594 - RNA, 19 nt, Homo sapiens
gaaagguccuccuggauca

SEQ ID NO: 107595 - RNA, 19 nt, Homo sapiens
cuacaaggcuccaaagguu

SEQ ID NO: 107596 - RNA, 19 nt, Homo sapiens
gggcuuccgugguguaaua

SEQ ID NO: 107597 - RNA, 19 nt, Homo sapiens
gagaucugcuguccuguuu

SEQ ID NO: 107598 - RNA, 19 nt, Homo sapiens
ucucagaagucccuguuua

SEQ ID NO: 107599 - RNA, 19 nt, Homo sapiens
uagaagcaguguuuaguuu

SEQ ID NO: 107600 - RNA, 19 nt, Homo sapiens
gccaagaggugacaaagga

SEQ ID NO: 107601 - RNA, 19 nt, Homo sapiens
ccagaacacucuuagcuau

SEQ ID NO: 107602 - RNA, 19 nt, Homo sapiens
gcuaaucagucauuucuuc

SEQ ID NO: 107603 - RNA, 19 nt, Homo sapiens
gcacaaaggauuucuugga

SEQ ID NO: 107604 - RNA, 19 nt, Homo sapiens
ggacggaguaccagguuua

SEQ ID NO: 107605 - RNA, 19 nt, Homo sapiens
gcacacauuauuuggcuua

SEQ ID NO: 107606 - RNA, 19 nt, Homo sapiens
ugaauggucugaagaagga

SEQ ID NO: 107607 - RNA, 19 nt, Homo sapiens
uuucacagguagccuauua

SEQ ID NO: 107608 - RNA, 19 nt, Homo sapiens
caacaaauguggccaagcu

SEQ ID NO: 107609 - RNA, 19 nt, Homo sapiens
ggacuaauaggcaauauag

SEQ ID NO: 107610 - RNA, 19 nt, Homo sapiens
guacagaggucagcacaca

SEQ ID NO: 107611 - RNA, 19 nt, Homo sapiens
gaaucacccugcccuguau

SEQ ID NO: 107612 - RNA, 19 nt, Homo sapiens
ccagguaguuucaaaggaa

SEQ ID NO: 107613 - RNA, 19 nt, Homo sapiens
ggaaucacccugcccugua

SEQ ID NO: 107614 - RNA, 19 nt, Homo sapiens
gcacaguguugguuuccuu

SEQ ID NO: 107615 - RNA, 19 nt, Homo sapiens
gcaagagaauugaaaugag

SEQ ID NO: 107616 - RNA, 19 nt, Homo sapiens
uaacagggcacaaaggauu

SEQ ID NO: 107617 - RNA, 19 nt, Homo sapiens
uaaaggcaaggauggauua

SEQ ID NO: 107618 - RNA, 19 nt, Homo sapiens
ggaaacagccuccaagcau

SEQ ID NO: 107619 - RNA, 19 nt, Homo sapiens
ggaacaaggccuacaagga

SEQ ID NO: 107620 - RNA, 19 nt, Homo sapiens
gagagaagucuuauggaaa

SEQ ID NO: 107621 - RNA, 19 nt, Homo sapiens
gagcaaguccucacucuuc

SEQ ID NO: 107622 - RNA, 19 nt, Homo sapiens
acugcuagcuuucuccuua

SEQ ID NO: 107623 - RNA, 19 nt, Homo sapiens
uaagggagaccaaggaauu

SEQ ID NO: 107624 - RNA, 19 nt, Homo sapiens
cggaauaccuaguccaaga

SEQ ID NO: 107625 - RNA, 19 nt, Homo sapiens
gauuggcaguccaggcuua

SEQ ID NO: 107626 - RNA, 19 nt, Homo sapiens
caauacagacaaagcauaa

SEQ ID NO: 107627 - RNA, 19 nt, Homo sapiens
guaaagcaagccugaauug

SEQ ID NO: 107628 - RNA, 19 nt, Homo sapiens
caaaggaguuaguggaaag

SEQ ID NO: 107629 - RNA, 19 nt, Homo sapiens
gaaccaauucucaguacaa

SEQ ID NO: 107630 - RNA, 19 nt, Homo sapiens
guacauuggagucucauuu

SEQ ID NO: 107631 - RNA, 19 nt, Homo sapiens
cagguagccuauuaaacua

SEQ ID NO: 107632 - RNA, 19 nt, Homo sapiens
gccaagcuaucaaaggaaa

SEQ ID NO: 107633 - RNA, 19 nt, Homo sapiens
ccgaaucgcuaaucaguca

SEQ ID NO: 107634 - RNA, 19 nt, Homo sapiens
ggaaagaaaggaacaagag

SEQ ID NO: 107635 - RNA, 19 nt, Homo sapiens
acaaggagcacccggauuu

SEQ ID NO: 107636 - RNA, 19 nt, Homo sapiens
gaagcaguguuuaguuucu

SEQ ID NO: 107637 - RNA, 19 nt, Homo sapiens
ccuccuggaucaauuguaa

SEQ ID NO: 107638 - RNA, 19 nt, Homo sapiens
ggucagcacacauuauuug

SEQ ID NO: 107639 - RNA, 19 nt, Homo sapiens
gaggucagcacacauuauu

SEQ ID NO: 107640 - RNA, 19 nt, Homo sapiens
ucaaaggaaaugagaauga

SEQ ID NO: 107641 - RNA, 19 nt, Homo sapiens
gacaaaccaucuccuccuu

SEQ ID NO: 107642 - RNA, 19 nt, Homo sapiens
gcauaugguccuagacaaa

SEQ ID NO: 107643 - RNA, 19 nt, Homo sapiens
ccaaaggcuucccuggauu

SEQ ID NO: 107644 - RNA, 19 nt, Homo sapiens
guccagaauuugagacuga

SEQ ID NO: 107645 - RNA, 19 nt, Homo sapiens
caugggaguuccuggcuuu

SEQ ID NO: 107646 - RNA, 19 nt, Homo sapiens
gguagccuauuaaacuauu

SEQ ID NO: 107647 - RNA, 19 nt, Homo sapiens
gauguggccugguucaaag

SEQ ID NO: 107648 - RNA, 19 nt, Homo sapiens
ucagucauuucuucaugua

SEQ ID NO: 107649 - RNA, 19 nt, Homo sapiens
ggaguugccugugucugaa

SEQ ID NO: 107650 - RNA, 19 nt, Homo sapiens
ccucugggaucacagguuu

SEQ ID NO: 107651 - RNA, 19 nt, Homo sapiens
gcugugaucucagguaauc

SEQ ID NO: 107652 - RNA, 19 nt, Homo sapiens
gaaaggauccaagggugaa

SEQ ID NO: 107653 - RNA, 19 nt, Homo sapiens
gauucuguuuccuuaagua

SEQ ID NO: 107654 - RNA, 19 nt, Homo sapiens
cagaggauguggccugguu

SEQ ID NO: 107655 - RNA, 19 nt, Homo sapiens
gcaccaugcccuucaucua

SEQ ID NO: 107656 - RNA, 19 nt, Homo sapiens
ucaaaggaguuaguggaaa

SEQ ID NO: 107657 - RNA, 19 nt, Homo sapiens
gaacaagaggcaagaaagg

SEQ ID NO: 107658 - RNA, 19 nt, Homo sapiens
agagaagucuuauggaaag

SEQ ID NO: 107659 - RNA, 19 nt, Homo sapiens
ggucauuaauggcauaugg

SEQ ID NO: 107660 - RNA, 19 nt, Homo sapiens
ucacaacagucaccucaca

SEQ ID NO: 107661 - RNA, 19 nt, Homo sapiens
caaaggcuucccuggauuu

SEQ ID NO: 107662 - RNA, 19 nt, Homo sapiens
gaaggggucuguuggauuc

SEQ ID NO: 107663 - RNA, 19 nt, Homo sapiens
ggcaagagaauugaaauga

SEQ ID NO: 107664 - RNA, 19 nt, Homo sapiens
gaucugcuguccuguuucu

SEQ ID NO: 107665 - RNA, 19 nt, Homo sapiens
ugcagaagcuguccagguu

SEQ ID NO: 107666 - RNA, 19 nt, Homo sapiens
gcaauugggccucuaggau

SEQ ID NO: 107667 - RNA, 19 nt, Homo sapiens
cguccaaugucaaaccuuu

SEQ ID NO: 107668 - RNA, 19 nt, Homo sapiens
uaaaggagccagaggagau

SEQ ID NO: 107669 - RNA, 19 nt, Homo sapiens
cuggauggcuguaauggaa

SEQ ID NO: 107670 - RNA, 19 nt, Homo sapiens
uauaaacugugccaauaca

SEQ ID NO: 107671 - RNA, 19 nt, Homo sapiens
gugcugugaucucagguaa

SEQ ID NO: 107672 - RNA, 19 nt, Homo sapiens
aaaaggauauccaggaauu

SEQ ID NO: 107673 - RNA, 19 nt, Homo sapiens
caagacguccaaugucaaa

SEQ ID NO: 107674 - RNA, 19 nt, Homo sapiens
ggaaauccaggccuaguag

SEQ ID NO: 107675 - RNA, 19 nt, Homo sapiens
gaucaauuguaaagaaagg

SEQ ID NO: 107676 - RNA, 19 nt, Homo sapiens
ccaauacagacaaagcaua

SEQ ID NO: 107677 - RNA, 19 nt, Homo sapiens
cuagcacacucuucucuug

SEQ ID NO: 107678 - RNA, 19 nt, Homo sapiens
gcaggcaagagaauugaaa

SEQ ID NO: 107679 - RNA, 19 nt, Homo sapiens
gaggagaggcagcaguuug

SEQ ID NO: 107680 - RNA, 19 nt, Homo sapiens
gcaaugauaaaucuuacug

SEQ ID NO: 107681 - RNA, 19 nt, Homo sapiens
ucaacgaggugugccacua

SEQ ID NO: 107682 - RNA, 19 nt, Homo sapiens
acaaggcuccaaagguuua

SEQ ID NO: 107683 - RNA, 19 nt, Homo sapiens
gccagacaguugaaauuuc

SEQ ID NO: 107684 - RNA, 19 nt, Homo sapiens
ugacaucuuuggugcugaa

SEQ ID NO: 107685 - RNA, 19 nt, Homo sapiens
gcagaccaccguaaagcaa

SEQ ID NO: 107686 - RNA, 19 nt, Homo sapiens
ggauguggccugguucaaa

SEQ ID NO: 107687 - RNA, 19 nt, Homo sapiens
caacuugccugauggaaua

SEQ ID NO: 107688 - RNA, 19 nt, Homo sapiens
ggaaacugcucuccuaugu

SEQ ID NO: 107689 - RNA, 19 nt, Homo sapiens
caaaggagaugauggugaa

SEQ ID NO: 107690 - RNA, 19 nt, Homo sapiens
gcagaaaggugaugaaggu

SEQ ID NO: 107691 - RNA, 19 nt, Homo sapiens
gauuaaaggugcuuauguu

SEQ ID NO: 107692 - RNA, 19 nt, Homo sapiens
gaaccaggauaccaucuau

SEQ ID NO: 107693 - RNA, 19 nt, Homo sapiens
gggagggacugccagauuu

SEQ ID NO: 107694 - RNA, 19 nt, Homo sapiens
cguggaagcugccaaagaa

SEQ ID NO: 107695 - RNA, 19 nt, Homo sapiens
cagcagaucuccugaaggu

SEQ ID NO: 107696 - RNA, 19 nt, Homo sapiens
caaggaugcuccagggauu

SEQ ID NO: 107697 - RNA, 19 nt, Homo sapiens
gggagaagauggcccugaa

SEQ ID NO: 107698 - RNA, 19 nt, Homo sapiens
ccaacacgauccauuuaga

SEQ ID NO: 107699 - RNA, 19 nt, Homo sapiens
ccaaggacccacaggauuu

SEQ ID NO: 107700 - RNA, 19 nt, Homo sapiens
agauggcccuccaggauua

SEQ ID NO: 107701 - RNA, 19 nt, Homo sapiens
ccaauccagaugaauauua

SEQ ID NO: 107702 - RNA, 19 nt, Homo sapiens
cgacaucaauggcaucauc

SEQ ID NO: 107703 - RNA, 19 nt, Homo sapiens
gugggaaacugcucuccua

SEQ ID NO: 107704 - RNA, 19 nt, Homo sapiens
aagaaaggcuaccagaaga

SEQ ID NO: 107705 - RNA, 19 nt, Homo sapiens
gaacaaggucucccaggau

SEQ ID NO: 107706 - RNA, 19 nt, Homo sapiens
gggacacccuggcaaagaa

SEQ ID NO: 107707 - RNA, 19 nt, Homo sapiens
caagaaaggcuaccagaag

SEQ ID NO: 107708 - RNA, 19 nt, Homo sapiens
ggaccaaagggcucuauug

SEQ ID NO: 107709 - RNA, 19 nt, Homo sapiens
ggaaggugcggaugacuug

SEQ ID NO: 107710 - RNA, 19 nt, Homo sapiens
gcgagggugagaccuauua

SEQ ID NO: 107711 - RNA, 19 nt, Homo sapiens
gauggcaaguggcacagaa

SEQ ID NO: 107712 - RNA, 19 nt, Homo sapiens
ggacuucuccauccuaaca

SEQ ID NO: 107713 - RNA, 19 nt, Homo sapiens
aaagggcucuauuggauuc

SEQ ID NO: 107714 - RNA, 19 nt, Homo sapiens
gggagacgauggagaaagg

SEQ ID NO: 107715 - RNA, 19 nt, Homo sapiens
cccaugaccuccuaaagug

SEQ ID NO: 107716 - RNA, 19 nt, Homo sapiens
ugagaccuauuacuacgaa

SEQ ID NO: 107717 - RNA, 19 nt, Homo sapiens
ggauuaaaggugcuuaugu

SEQ ID NO: 107718 - RNA, 19 nt, Homo sapiens
gaagacgguucuggagauc

SEQ ID NO: 107719 - RNA, 19 nt, Homo sapiens
ucaauggcaucaucguguu

SEQ ID NO: 107720 - RNA, 19 nt, Homo sapiens
aaagaagaccaccaaauuc

SEQ ID NO: 107721 - RNA, 19 nt, Homo sapiens
ggacugaaaggcaaugaag

SEQ ID NO: 107722 - RNA, 19 nt, Homo sapiens
gaagggugaagacggcuuu

SEQ ID NO: 107723 - RNA, 19 nt, Homo sapiens
caagguaagccucguaaag

SEQ ID NO: 107724 - RNA, 19 nt, Homo sapiens
aauacugggucgauccuaa

SEQ ID NO: 107725 - RNA, 19 nt, Homo sapiens
uaccaucuaugaagggauu

SEQ ID NO: 107726 - RNA, 19 nt, Homo sapiens
caauccagaugaauauuac

SEQ ID NO: 107727 - RNA, 19 nt, Homo sapiens
cagcuuaugauuacuguga

SEQ ID NO: 107728 - RNA, 19 nt, Homo sapiens
uuucacaacuugccugaug

SEQ ID NO: 107729 - RNA, 19 nt, Homo sapiens
aaaagaagaccaccaaauu

SEQ ID NO: 107730 - RNA, 19 nt, Homo sapiens
uccugaagguucuagauuu

SEQ ID NO: 107731 - RNA, 19 nt, Homo sapiens
gcucucagcguccacaaga

SEQ ID NO: 107732 - RNA, 19 nt, Homo sapiens
ccaagaaaggcuaccagaa

SEQ ID NO: 107733 - RNA, 19 nt, Homo sapiens
cggcugugcuaccaagaaa

SEQ ID NO: 107734 - RNA, 19 nt, Homo sapiens
aaagauggcccuccaggau

SEQ ID NO: 107735 - RNA, 19 nt, Homo sapiens
caaagggcucuauuggauu

SEQ ID NO: 107736 - RNA, 19 nt, Homo sapiens
cgaauucagcaaccucgua

SEQ ID NO: 107737 - RNA, 19 nt, Homo sapiens
gauggaauaacaaagacaa

SEQ ID NO: 107738 - RNA, 19 nt, Homo sapiens
agacggcuuuccuggguuu

SEQ ID NO: 107739 - RNA, 19 nt, Homo sapiens
ggaguucacugaggaaacg

SEQ ID NO: 107740 - RNA, 19 nt, Homo sapiens
ccgaagaccuagggaagga

SEQ ID NO: 107741 - RNA, 19 nt, Homo sapiens
ggagggacugccagauuug

SEQ ID NO: 107742 - RNA, 19 nt, Homo sapiens
ggagauugagcagaugaaa

SEQ ID NO: 107743 - RNA, 19 nt, Homo sapiens
ugccagauuuggacacuau

SEQ ID NO: 107744 - RNA, 19 nt, Homo sapiens
cucugaagcuggagauuga

SEQ ID NO: 107745 - RNA, 19 nt, Homo sapiens
gccagcagaucuccugaag

SEQ ID NO: 107746 - RNA, 19 nt, Homo sapiens
ccgggcagcuuaugauuac

SEQ ID NO: 107747 - RNA, 19 nt, Homo sapiens
guaaaggucaucccaccau

SEQ ID NO: 107748 - RNA, 19 nt, Homo sapiens
gaaacugcucuccuaugug

SEQ ID NO: 107749 - RNA, 19 nt, Homo sapiens
ugacaaaggagaugauggu

SEQ ID NO: 107750 - RNA, 19 nt, Homo sapiens
ccuccaggauuacgugguu

SEQ ID NO: 107751 - RNA, 19 nt, Homo sapiens
aaagggagaaccagcgauu

SEQ ID NO: 107752 - RNA, 19 nt, Homo sapiens
gcucucccgucuuccucua

SEQ ID NO: 107753 - RNA, 19 nt, Homo sapiens
caggguauccagcagauug

SEQ ID NO: 107754 - RNA, 19 nt, Homo sapiens
gugccuucccgauggauua

SEQ ID NO: 107755 - RNA, 19 nt, Homo sapiens
ugaaucacaugaccuagcu

SEQ ID NO: 107756 - RNA, 19 nt, Homo sapiens
ugaagcgucacagaaauuu

SEQ ID NO: 107757 - RNA, 19 nt, Homo sapiens
cggagaugauggucccaaa

SEQ ID NO: 107758 - RNA, 19 nt, Homo sapiens
ucuauuggauucccuggau

SEQ ID NO: 107759 - RNA, 19 nt, Homo sapiens
ccuugauccucgacuguaa

SEQ ID NO: 107760 - RNA, 19 nt, Homo sapiens
caacugugaaagccaagaa

SEQ ID NO: 107761 - RNA, 19 nt, Homo sapiens
ccuccaacacgauccauuu

SEQ ID NO: 107762 - RNA, 19 nt, Homo sapiens
ggaauaacaaagacaacag

SEQ ID NO: 107763 - RNA, 19 nt, Homo sapiens
gggaaacugcucuccuaug

SEQ ID NO: 107764 - RNA, 19 nt, Homo sapiens
ggguaucacugguccuucu

SEQ ID NO: 107765 - RNA, 19 nt, Homo sapiens
gaaggcagacagggagaga

SEQ ID NO: 107766 - RNA, 19 nt, Homo sapiens
caggauaccaucuaugaag

SEQ ID NO: 107767 - RNA, 19 nt, Homo sapiens
uccggaaccuugacgagaa

SEQ ID NO: 107768 - RNA, 19 nt, Homo sapiens
ccugauggaauaacaaaga

SEQ ID NO: 107769 - RNA, 19 nt, Homo sapiens
cauccuaacaacugugaaa

SEQ ID NO: 107770 - RNA, 19 nt, Homo sapiens
augaugaccucaccuaugg

SEQ ID NO: 107771 - RNA, 19 nt, Homo sapiens
gacccauccuguucgugaa

SEQ ID NO: 107772 - RNA, 19 nt, Homo sapiens
gaucuucggcucucucaac

SEQ ID NO: 107773 - RNA, 19 nt, Homo sapiens
gagaugauggucccaaagg

SEQ ID NO: 107774 - RNA, 19 nt, Homo sapiens
ggaagacaaggaccaaagg

SEQ ID NO: 107775 - RNA, 19 nt, Homo sapiens
aggaaugccuggacaaacu

SEQ ID NO: 107776 - RNA, 19 nt, Homo sapiens
guacccugcgucugcauuu

SEQ ID NO: 107777 - RNA, 19 nt, Homo sapiens
uaacaaccuccaacacgau

SEQ ID NO: 107778 - RNA, 19 nt, Homo sapiens
cgacuucccagauggugaa

SEQ ID NO: 107779 - RNA, 19 nt, Homo sapiens
cgacgggaauggcgagaac

SEQ ID NO: 107780 - RNA, 19 nt, Homo sapiens
cgaaccaggauaccaucua

SEQ ID NO: 107781 - RNA, 19 nt, Homo sapiens
agggugagaccuauuacua

SEQ ID NO: 107782 - RNA, 19 nt, Homo sapiens
cagauuuggacacuauauu

SEQ ID NO: 107783 - RNA, 19 nt, Homo sapiens
gaagcgucacagaaauuug

SEQ ID NO: 107784 - RNA, 19 nt, Homo sapiens
cggcuuuccuggguuuaaa

SEQ ID NO: 107785 - RNA, 19 nt, Homo sapiens
ugauggagccagaggaaug

SEQ ID NO: 107786 - RNA, 19 nt, Homo sapiens
gggaaggugcggaugacuu

SEQ ID NO: 107787 - RNA, 19 nt, Homo sapiens
gaacaucacuuacaucugu

SEQ ID NO: 107788 - RNA, 19 nt, Homo sapiens
gaaauagccugcacucaga

SEQ ID NO: 107789 - RNA, 19 nt, Homo sapiens
caaauuaaaugcacgcuuu

SEQ ID NO: 107790 - RNA, 19 nt, Homo sapiens
gcaaaugacuuagauauca

SEQ ID NO: 107791 - RNA, 19 nt, Homo sapiens
guaaaucuccugacaauaa

SEQ ID NO: 107792 - RNA, 19 nt, Homo sapiens
caagacacaucgacaauga

SEQ ID NO: 107793 - RNA, 19 nt, Homo sapiens
gaccaccaaucaccuaaua

SEQ ID NO: 107794 - RNA, 19 nt, Homo sapiens
ggagcugacucuaaucaaa

SEQ ID NO: 107795 - RNA, 19 nt, Homo sapiens
gguuuaagaugaccaauga

SEQ ID NO: 107796 - RNA, 19 nt, Homo sapiens
ugacagagguggcauagga

SEQ ID NO: 107797 - RNA, 19 nt, Homo sapiens
ugacaaaggugaucaugga

SEQ ID NO: 107798 - RNA, 19 nt, Homo sapiens
gaaagagcaucguuccaau

SEQ ID NO: 107799 - RNA, 19 nt, Homo sapiens
ugaaggauauggugaagaa

SEQ ID NO: 107800 - RNA, 19 nt, Homo sapiens
ggaaugcuuuguaauacuu

SEQ ID NO: 107801 - RNA, 19 nt, Homo sapiens
gguauggucuugauaugaa

SEQ ID NO: 107802 - RNA, 19 nt, Homo sapiens
gaauauagaacacagaaug

SEQ ID NO: 107803 - RNA, 19 nt, Homo sapiens
gaagggagaugcugguucu

SEQ ID NO: 107804 - RNA, 19 nt, Homo sapiens
ggacuuacuauucuuguuu

SEQ ID NO: 107805 - RNA, 19 nt, Homo sapiens
acaagaacuuugacuguuu

SEQ ID NO: 107806 - RNA, 19 nt, Homo sapiens
ggucauguaucucugcaaa

SEQ ID NO: 107807 - RNA, 19 nt, Homo sapiens
gauagaagucacacuagua

SEQ ID NO: 107808 - RNA, 19 nt, Homo sapiens
gcccacagcugacuucaug

SEQ ID NO: 107809 - RNA, 19 nt, Homo sapiens
ggaaugcuguccugucugu

SEQ ID NO: 107810 - RNA, 19 nt, Homo sapiens
caaggacucuaaauugaga

SEQ ID NO: 107811 - RNA, 19 nt, Homo sapiens
caguuuagguuuaagauga

SEQ ID NO: 107812 - RNA, 19 nt, Homo sapiens
ggagagagagggagacuug

SEQ ID NO: 107813 - RNA, 19 nt, Homo sapiens
gaagucacacuaguauaua

SEQ ID NO: 107814 - RNA, 19 nt, Homo sapiens
gaauuuacuucgacuucuu

SEQ ID NO: 107815 - RNA, 19 nt, Homo sapiens
uggaaucccuggaccauuu

SEQ ID NO: 107816 - RNA, 19 nt, Homo sapiens
uaucuggaaugcuuuguaa

SEQ ID NO: 107817 - RNA, 19 nt, Homo sapiens
gaaccuggcagaaauggaa

SEQ ID NO: 107818 - RNA, 19 nt, Homo sapiens
acaauaaccucagaaucua

SEQ ID NO: 107819 - RNA, 19 nt, Homo sapiens
caacuuuggucauguaucu

SEQ ID NO: 107820 - RNA, 19 nt, Homo sapiens
gcauacaacuuuggucaug

SEQ ID NO: 107821 - RNA, 19 nt, Homo sapiens
gugcuaugcuucuguuauu

SEQ ID NO: 107822 - RNA, 19 nt, Homo sapiens
ggagaacaaagugaauuua

SEQ ID NO: 107823 - RNA, 19 nt, Homo sapiens
gcaucagcauuguauauau

SEQ ID NO: 107824 - RNA, 19 nt, Homo sapiens
caagaacuuugacuguuug

SEQ ID NO: 107825 - RNA, 19 nt, Homo sapiens
aaagggagaaccaggauua

SEQ ID NO: 107826 - RNA, 19 nt, Homo sapiens
caaaugugaugauuggaau

SEQ ID NO: 107827 - RNA, 19 nt, Homo sapiens
ggaaacaggagaaacaugu

SEQ ID NO: 107828 - RNA, 19 nt, Homo sapiens
ggagguggcaauacaaauu

SEQ ID NO: 107829 - RNA, 19 nt, Homo sapiens
cugcaaagcaucaaauuaa

SEQ ID NO: 107830 - RNA, 19 nt, Homo sapiens
ugacuuagauaucaaagca

SEQ ID NO: 107831 - RNA, 19 nt, Homo sapiens
caguaaaucuccugacaau

SEQ ID NO: 107832 - RNA, 19 nt, Homo sapiens
ggauggugcuguuggagaa

SEQ ID NO: 107833 - RNA, 19 nt, Homo sapiens
acaaacauauguccaagga

SEQ ID NO: 107834 - RNA, 19 nt, Homo sapiens
uuagacaucuuucucauuc

SEQ ID NO: 107835 - RNA, 19 nt, Homo sapiens
gggaauggcuggaggacau

SEQ ID NO: 107836 - RNA, 19 nt, Homo sapiens
agacgaggaugaaggauau

SEQ ID NO: 107837 - RNA, 19 nt, Homo sapiens
gaaauugggccaguuuguu

SEQ ID NO: 107838 - RNA, 19 nt, Homo sapiens
gcucuaagcggaauggaaa

SEQ ID NO: 107839 - RNA, 19 nt, Homo sapiens
caaagcagagggaaauauu

SEQ ID NO: 107840 - RNA, 19 nt, Homo sapiens
gaaacaggagaaacaugua

SEQ ID NO: 107841 - RNA, 19 nt, Homo sapiens
gggcagagaggaauuguug

SEQ ID NO: 107842 - RNA, 19 nt, Homo sapiens
ggaagaagacgaggaugaa

SEQ ID NO: 107843 - RNA, 19 nt, Homo sapiens
gauuggaauuagaccauuu

SEQ ID NO: 107844 - RNA, 19 nt, Homo sapiens
gagaacccacagucuaaua

SEQ ID NO: 107845 - RNA, 19 nt, Homo sapiens
gcagaaaguaaacugauug

SEQ ID NO: 107846 - RNA, 19 nt, Homo sapiens
gcaaacccauccaguguac

SEQ ID NO: 107847 - RNA, 19 nt, Homo sapiens
gugaugaccuaaagcuuug

SEQ ID NO: 107848 - RNA, 19 nt, Homo sapiens
gaugaaagcaugccagauc

SEQ ID NO: 107849 - RNA, 19 nt, Homo sapiens
gaagugggauuugcaggau

SEQ ID NO: 107850 - RNA, 19 nt, Homo sapiens
gaacaaggaagugcuggaa

SEQ ID NO: 107851 - RNA, 19 nt, Homo sapiens
gccaaagggugcucaagga

SEQ ID NO: 107852 - RNA, 19 nt, Homo sapiens
ggacugugccgacccugua

SEQ ID NO: 107853 - RNA, 19 nt, Homo sapiens
gggauggacuuacuauucu

SEQ ID NO: 107854 - RNA, 19 nt, Homo sapiens
aaagaagccucccagaaca

SEQ ID NO: 107855 - RNA, 19 nt, Homo sapiens
ggcaggaccuccaggauca

SEQ ID NO: 107856 - RNA, 19 nt, Homo sapiens
aggauauggugaagaaaua

SEQ ID NO: 107857 - RNA, 19 nt, Homo sapiens
ggcaauuugucucaauaaa

SEQ ID NO: 107858 - RNA, 19 nt, Homo sapiens
uccaaggacucuaaauuga

SEQ ID NO: 107859 - RNA, 19 nt, Homo sapiens
gacuauaaguuuagacauc

SEQ ID NO: 107860 - RNA, 19 nt, Homo sapiens
caucagcauuguauauaug

SEQ ID NO: 107861 - RNA, 19 nt, Homo sapiens
gaacuuugacuguuugaag

SEQ ID NO: 107862 - RNA, 19 nt, Homo sapiens
ucaaauggcuggguuggau

SEQ ID NO: 107863 - RNA, 19 nt, Homo sapiens
gaacccacagucuaauauu

SEQ ID NO: 107864 - RNA, 19 nt, Homo sapiens
gggcaaaugacuuagauau

SEQ ID NO: 107865 - RNA, 19 nt, Homo sapiens
caaagcagaguggugaaua

SEQ ID NO: 107866 - RNA, 19 nt, Homo sapiens
caagaccucuccucauucu

SEQ ID NO: 107867 - RNA, 19 nt, Homo sapiens
caccaggucuucaagguau

SEQ ID NO: 107868 - RNA, 19 nt, Homo sapiens
ugaaagaggagaacaagga

SEQ ID NO: 107869 - RNA, 19 nt, Homo sapiens
aaagggugcucaaggagaa

SEQ ID NO: 107870 - RNA, 19 nt, Homo sapiens
agaccucuccucauucuua

SEQ ID NO: 107871 - RNA, 19 nt, Homo sapiens
gcaauaggaacugauggua

SEQ ID NO: 107872 - RNA, 19 nt, Homo sapiens
ggccagauguacuuaaaca

SEQ ID NO: 107873 - RNA, 19 nt, Homo sapiens
uaggauacauggacgauca

SEQ ID NO: 107874 - RNA, 19 nt, Homo sapiens
gagggucucaguucgcuua

SEQ ID NO: 107875 - RNA, 19 nt, Homo sapiens
ccuugugucucaauacuuu

SEQ ID NO: 107876 - RNA, 19 nt, Homo sapiens
cacaagaacuuugacuguu

SEQ ID NO: 107877 - RNA, 19 nt, Homo sapiens
ccaccgccauucacaagaa

SEQ ID NO: 107878 - RNA, 19 nt, Homo sapiens
guagucagauugaaaccau

SEQ ID NO: 107879 - RNA, 19 nt, Homo sapiens
agcaagaccucuccucauu

SEQ ID NO: 107880 - RNA, 19 nt, Homo sapiens
gaaagaggaauugcaggaa

SEQ ID NO: 107881 - RNA, 19 nt, Homo sapiens
gaaguuggagcaccugguu

SEQ ID NO: 107882 - RNA, 19 nt, Homo sapiens
uccgggagcucguggauuu

SEQ ID NO: 107883 - RNA, 19 nt, Homo sapiens
gagguggcaauacaaauuu

SEQ ID NO: 107884 - RNA, 19 nt, Homo sapiens
ucacuguuccucugucaua

SEQ ID NO: 107885 - RNA, 19 nt, Homo sapiens
gaaaggugcuaugcuucug

SEQ ID NO: 107886 - RNA, 19 nt, Homo sapiens
uccaggcucugaugguuua

SEQ ID NO: 107887 - RNA, 19 nt, Homo sapiens
gagaauaaguaccugauug

SEQ ID NO: 107888 - RNA, 19 nt, Homo sapiens
ucaagacccucgagauuaa

SEQ ID NO: 107889 - RNA, 19 nt, Homo sapiens
gggacgagcuggucaaguu

SEQ ID NO: 107890 - RNA, 19 nt, Homo sapiens
ggaggccguugcagacaua

SEQ ID NO: 107891 - RNA, 19 nt, Homo sapiens
caacgcugcugccugcuuu

SEQ ID NO: 107892 - RNA, 19 nt, Homo sapiens
gcccagaucugcauagaca

SEQ ID NO: 107893 - RNA, 19 nt, Homo sapiens
gcauuggccugcagaacuu

SEQ ID NO: 107894 - RNA, 19 nt, Homo sapiens
caagaaguguccagauuac

SEQ ID NO: 107895 - RNA, 19 nt, Homo sapiens
acaagaaguguccagauua

SEQ ID NO: 107896 - RNA, 19 nt, Homo sapiens
gcucagaccagcucaaugu

SEQ ID NO: 107897 - RNA, 19 nt, Homo sapiens
cgacugcgcuaucaagaag

SEQ ID NO: 107898 - RNA, 19 nt, Homo sapiens
cugcagaacuucgagauug

SEQ ID NO: 107899 - RNA, 19 nt, Homo sapiens
gggcaggcaucgagaucuu

SEQ ID NO: 107900 - RNA, 19 nt, Homo sapiens
ucaagagccugcaguggau

SEQ ID NO: 107901 - RNA, 19 nt, Homo sapiens
ggcugugucuuacuagaaa

SEQ ID NO: 107902 - RNA, 19 nt, Homo sapiens
gcaagacggccgaguacga

SEQ ID NO: 107903 - RNA, 19 nt, Homo sapiens
gggcaucaaagacguguuu

SEQ ID NO: 107904 - RNA, 19 nt, Homo sapiens
gaagggagaagccggagau

SEQ ID NO: 107905 - RNA, 19 nt, Homo sapiens
agagggcugugucuuacua

SEQ ID NO: 107906 - RNA, 19 nt, Homo sapiens
ggagaauaaguaccugauu

SEQ ID NO: 107907 - RNA, 19 nt, Homo sapiens
ucagaauagugauguguuc

SEQ ID NO: 107908 - RNA, 19 nt, Homo sapiens
ccacucaucacuaaacaga

SEQ ID NO: 107909 - RNA, 19 nt, Homo sapiens
caccaauccucaccuaaca

SEQ ID NO: 107910 - RNA, 19 nt, Homo sapiens
ccaaggacuucgucgucaa

SEQ ID NO: 107911 - RNA, 19 nt, Homo sapiens
gcagggugaucagggaaga

SEQ ID NO: 107912 - RNA, 19 nt, Homo sapiens
gaaugucaccgcccagauc

SEQ ID NO: 107913 - RNA, 19 nt, Homo sapiens
cucaagacccucgagauua

SEQ ID NO: 107914 - RNA, 19 nt, Homo sapiens
uauccauguugcugacuuu

SEQ ID NO: 107915 - RNA, 19 nt, Homo sapiens
ccauggacuuuaucaacga

SEQ ID NO: 107916 - RNA, 19 nt, Homo sapiens
ucgaugccauggacuuuau

SEQ ID NO: 107917 - RNA, 19 nt, Homo sapiens
cgagaaggccgugcaggaa

SEQ ID NO: 107918 - RNA, 19 nt, Homo sapiens
cugcugcucuucucagaug

SEQ ID NO: 107919 - RNA, 19 nt, Homo sapiens
gcaccugggcgucaaaguc

SEQ ID NO: 107920 - RNA, 19 nt, Homo sapiens
gaauaaguaccugauugug

SEQ ID NO: 107921 - RNA, 19 nt, Homo sapiens
aaaccucuccuuccucaga

SEQ ID NO: 107922 - RNA, 19 nt, Homo sapiens
accgaaaccugguguggaa

SEQ ID NO: 107923 - RNA, 19 nt, Homo sapiens
ccguggaccuguucuuugu

SEQ ID NO: 107924 - RNA, 19 nt, Homo sapiens
guacagccacagccagaug

SEQ ID NO: 107925 - RNA, 19 nt, Homo sapiens
aaugugcucuugcugugaa

SEQ ID NO: 107926 - RNA, 19 nt, Homo sapiens
aaauaacguugagcaagug

SEQ ID NO: 107927 - RNA, 19 nt, Homo sapiens
cagaccagcucaaugucau

SEQ ID NO: 107928 - RNA, 19 nt, Homo sapiens
acucaagacccucgagauu

SEQ ID NO: 107929 - RNA, 19 nt, Homo sapiens
uagccucccucuccucugu

SEQ ID NO: 107930 - RNA, 19 nt, Homo sapiens
ccaagcaccugggcgucaa

SEQ ID NO: 107931 - RNA, 19 nt, Homo sapiens
gcuggaggaugcugugaac

SEQ ID NO: 107932 - RNA, 19 nt, Homo sapiens
gugacgagguggagaucau

SEQ ID NO: 107933 - RNA, 19 nt, Homo sapiens
agacguguuugacuucauc

SEQ ID NO: 107934 - RNA, 19 nt, Homo sapiens
ucaaggaagccaucaagag

SEQ ID NO: 107935 - RNA, 19 nt, Homo sapiens
gacgauaacaacgacauug

SEQ ID NO: 107936 - RNA, 19 nt, Homo sapiens
aaaauaacguugagcaagu

SEQ ID NO: 107937 - RNA, 19 nt, Homo sapiens
agaauaaguaccugauugu

SEQ ID NO: 107938 - RNA, 19 nt, Homo sapiens
gggcugugucuuacuagaa

SEQ ID NO: 107939 - RNA, 19 nt, Homo sapiens
gcucaaggaagccaucaag

SEQ ID NO: 107940 - RNA, 19 nt, Homo sapiens
ggacgagcuggucaaguuc

SEQ ID NO: 107941 - RNA, 19 nt, Homo sapiens
agccggagauccuggaaga

SEQ ID NO: 107942 - RNA, 19 nt, Homo sapiens
ggccuggacuggacaugag

SEQ ID NO: 107943 - RNA, 19 nt, Homo sapiens
ggacgcggucaaguacuuu

SEQ ID NO: 107944 - RNA, 19 nt, Homo sapiens
cuaaacagagcccaagcuu

SEQ ID NO: 107945 - RNA, 19 nt, Homo sapiens
gauuacaccugccccauca

SEQ ID NO: 107946 - RNA, 19 nt, Homo sapiens
ccaagcgcuucaucgacaa

SEQ ID NO: 107947 - RNA, 19 nt, Homo sapiens
gccucucgcuggucaagga

SEQ ID NO: 107948 - RNA, 19 nt, Homo sapiens
gacaaagucaaguccuuca

SEQ ID NO: 107949 - RNA, 19 nt, Homo sapiens
acgcggguguggugcagua

SEQ ID NO: 107950 - RNA, 19 nt, Homo sapiens
ucugaaccauauccauguu

SEQ ID NO: 107951 - RNA, 19 nt, Homo sapiens
uggacgcggucaaguacuu

SEQ ID NO: 107952 - RNA, 19 nt, Homo sapiens
ucaccaagcgcuucaucga

SEQ ID NO: 107953 - RNA, 19 nt, Homo sapiens
ggccguugcagacauaaau

SEQ ID NO: 107954 - RNA, 19 nt, Homo sapiens
aaagacguguuugacuuca

SEQ ID NO: 107955 - RNA, 19 nt, Homo sapiens
ggacgaaugcgagauuuug

SEQ ID NO: 107956 - RNA, 19 nt, Homo sapiens
ccggacgaaugcgagauuu

SEQ ID NO: 107957 - RNA, 19 nt, Homo sapiens
aagaggagacccuggugaa

SEQ ID NO: 107958 - RNA, 19 nt, Homo sapiens
cgaaugccagccugcaaga

SEQ ID NO: 107959 - RNA, 19 nt, Homo sapiens
uugcugacuuuuccaaaua

SEQ ID NO: 107960 - RNA, 19 nt, Homo sapiens
gaacgugcaggagcucaag

SEQ ID NO: 107961 - RNA, 19 nt, Homo sapiens
ggaacgugcaggagcucaa

SEQ ID NO: 107962 - RNA, 19 nt, Homo sapiens
gggagaagccggagauccu

SEQ ID NO: 107963 - RNA, 19 nt, Homo sapiens
caucguggacaugaucaaa

SEQ ID NO: 107964 - RNA, 19 nt, Homo sapiens
gagccgcgucugagcauca

SEQ ID NO: 107965 - RNA, 19 nt, Homo sapiens
agugauguguucgacguuu

SEQ ID NO: 107966 - RNA, 19 nt, Homo sapiens
ccaccaauccucaccuaac

SEQ ID NO: 107967 - RNA, 19 nt, Homo sapiens
uuacuagaaacaacgcaaa

SEQ ID NO: 107968 - RNA, 19 nt, Homo sapiens
ucccaccaauccucaccua

SEQ ID NO: 107969 - RNA, 19 nt, Homo sapiens
gugcuggacaccucugaga

SEQ ID NO: 107970 - RNA, 19 nt, Homo sapiens
ugaaggagaauaaguaccu

SEQ ID NO: 107971 - RNA, 19 nt, Homo sapiens
gccagaccaucgacaccau

SEQ ID NO: 107972 - RNA, 19 nt, Homo sapiens
cacaauaccugaacuccuu

SEQ ID NO: 107973 - RNA, 19 nt, Homo sapiens
ucaagaaccucgaguggau

SEQ ID NO: 107974 - RNA, 19 nt, Homo sapiens
caaggaggcugucaagaac

SEQ ID NO: 107975 - RNA, 19 nt, Homo sapiens
ucaaggaggcugucaagaa

SEQ ID NO: 107976 - RNA, 19 nt, Homo sapiens
ggacgaugaccucaacuug

SEQ ID NO: 107977 - RNA, 19 nt, Homo sapiens
gggcguuccuggcuucaaa

SEQ ID NO: 107978 - RNA, 19 nt, Homo sapiens
aaggugagcugccuggaaa

SEQ ID NO: 107979 - RNA, 19 nt, Homo sapiens
gagaagcacgagagugaaa

SEQ ID NO: 107980 - RNA, 19 nt, Homo sapiens
agagaagggugaauuugga

SEQ ID NO: 107981 - RNA, 19 nt, Homo sapiens
agcaagcccugacccaaua

SEQ ID NO: 107982 - RNA, 19 nt, Homo sapiens
gcagcgacguggacaugga

SEQ ID NO: 107983 - RNA, 19 nt, Homo sapiens
ucccaaggcuccugaccua

SEQ ID NO: 107984 - RNA, 19 nt, Homo sapiens
ggagagaagggugaauuug

SEQ ID NO: 107985 - RNA, 19 nt, Homo sapiens
ccacggacauccugcucuu

SEQ ID NO: 107986 - RNA, 19 nt, Homo sapiens
gagcaagcccugacccaau

SEQ ID NO: 107987 - RNA, 19 nt, Homo sapiens
gagagaagggugaauuugg

SEQ ID NO: 107988 - RNA, 19 nt, Homo sapiens
aacaacaacugcccagaga

SEQ ID NO: 107989 - RNA, 19 nt, Homo sapiens
caacaacugcccagagaag

SEQ ID NO: 107990 - RNA, 19 nt, Homo sapiens
gaccuucccugccaaacag

SEQ ID NO: 107991 - RNA, 19 nt, Homo sapiens
gaggaaaggagagaaagga

SEQ ID NO: 107992 - RNA, 19 nt, Homo sapiens
caagggcaccguccacuuc

SEQ ID NO: 107993 - RNA, 19 nt, Homo sapiens
ggacauguuccacgagaag

SEQ ID NO: 107994 - RNA, 19 nt, Homo sapiens
cacaggugcugccaagaug

SEQ ID NO: 107995 - RNA, 19 nt, Homo sapiens
gggccuccuucaucaagaa

SEQ ID NO: 107996 - RNA, 19 nt, Homo sapiens
cagcaggugcgcaacauga

SEQ ID NO: 107997 - RNA, 19 nt, Homo sapiens
gcaagggcaccguccacuu

SEQ ID NO: 107998 - RNA, 19 nt, Homo sapiens
ggacgacgacccucucaac

SEQ ID NO: 107999 - RNA, 19 nt, Homo sapiens
ccacaggugcugccaagau

SEQ ID NO: 108000 - RNA, 19 nt, Homo sapiens
ccucagcccucaaguuugc

SEQ ID NO: 108001 - RNA, 19 nt, Homo sapiens
gggcuaccguggacagaag

SEQ ID NO: 108002 - RNA, 19 nt, Homo sapiens
acgcagagcuguccuucgu

SEQ ID NO: 108003 - RNA, 19 nt, Homo sapiens
gcaagcccugacccaauaa

SEQ ID NO: 108004 - RNA, 19 nt, Homo sapiens
acgagaagcacgagaguga

SEQ ID NO: 108005 - RNA, 19 nt, Homo sapiens
caaggugagcugccuggaa

SEQ ID NO: 108006 - RNA, 19 nt, Homo sapiens
caacaugacggagcagauc

SEQ ID NO: 108007 - RNA, 19 nt, Homo sapiens
agugugacgucaugaccua

SEQ ID NO: 108008 - RNA, 19 nt, Homo sapiens
ccuggucgcugagaaguuc

SEQ ID NO: 108009 - RNA, 19 nt, Homo sapiens
aggagaaccugggaggaaa

SEQ ID NO: 108010 - RNA, 19 nt, Homo sapiens
cgaggcgacuuuggcuuga

SEQ ID NO: 108011 - RNA, 19 nt, Homo sapiens
gcgcaagcagaacguggua

SEQ ID NO: 108012 - RNA, 19 nt, Homo sapiens
gaucgugugcccagaccuu

SEQ ID NO: 108013 - RNA, 19 nt, Homo sapiens
gggacauguuccacgagaa

SEQ ID NO: 108014 - RNA, 19 nt, Homo sapiens
gccggacacuaccgagaga

SEQ ID NO: 108015 - RNA, 19 nt, Homo sapiens
gugaaaaccucuacuccau

SEQ ID NO: 108016 - RNA, 19 nt, Homo sapiens
gaggcgacuuuggcuugaa

SEQ ID NO: 108017 - RNA, 19 nt, Homo sapiens
acccucagcccucaaguuu

SEQ ID NO: 108018 - RNA, 19 nt, Homo sapiens
gugugggcguggugcagua

SEQ ID NO: 108019 - RNA, 19 nt, Homo sapiens
caaaggagagaagggugaa

SEQ ID NO: 108020 - RNA, 19 nt, Homo sapiens
ccaaccagaaccugaagga

SEQ ID NO: 108021 - RNA, 19 nt, Homo sapiens
cgcuggagaccacacaaua

SEQ ID NO: 108022 - RNA, 19 nt, Homo sapiens
gcuggacgacgaacauauc

SEQ ID NO: 108023 - RNA, 19 nt, Homo sapiens
caagaacgggaccgaugga

SEQ ID NO: 108024 - RNA, 19 nt, Homo sapiens
cuacggagagugcuacaag

SEQ ID NO: 108025 - RNA, 19 nt, Homo sapiens
gacacuaccgagagaaaca

SEQ ID NO: 108026 - RNA, 19 nt, Homo sapiens
gccacgagggcaccuuuga

SEQ ID NO: 108027 - RNA, 19 nt, Homo sapiens
ggaggaaaggagagaaagg

SEQ ID NO: 108028 - RNA, 19 nt, Homo sapiens
aggcgacuuuggcuugaaa

SEQ ID NO: 108029 - RNA, 19 nt, Homo sapiens
gguaucaaggcaacaaugg

SEQ ID NO: 108030 - RNA, 19 nt, Homo sapiens
auccugcucuuccacauga

SEQ ID NO: 108031 - RNA, 19 nt, Homo sapiens
caagaaccucgaguggauu

SEQ ID NO: 108032 - RNA, 19 nt, Homo sapiens
cacggagugugacgucaug

SEQ ID NO: 108033 - RNA, 19 nt, Homo sapiens
gggacgaugaccucaacuu

SEQ ID NO: 108034 - RNA, 19 nt, Homo sapiens
gaaguccuggugugaaagg

SEQ ID NO: 108035 - RNA, 19 nt, Homo sapiens
gcuggagaccacacaauac

SEQ ID NO: 108036 - RNA, 19 nt, Homo sapiens
ccacagcaggugcgcaaca

SEQ ID NO: 108037 - RNA, 19 nt, Homo sapiens
cagcuggacgacgaacaua

SEQ ID NO: 108038 - RNA, 19 nt, Homo sapiens
aggagagaagggugaauuu

SEQ ID NO: 108039 - RNA, 19 nt, Homo sapiens
cuaccgagagaaacaacaa

SEQ ID NO: 108040 - RNA, 19 nt, Homo sapiens
ggauggagcuguucauuga

SEQ ID NO: 108041 - RNA, 19 nt, Homo sapiens
uaagaacccuggucauuga

SEQ ID NO: 108042 - RNA, 19 nt, Homo sapiens
gaacccuggucauugaauu

SEQ ID NO: 108043 - RNA, 19 nt, Homo sapiens
gcaagacccuuaacucacu

SEQ ID NO: 108044 - RNA, 19 nt, Homo sapiens
ucaagaaccucgaguggau

SEQ ID NO: 108045 - RNA, 19 nt, Homo sapiens
caaggaggcugucaagaac

SEQ ID NO: 108046 - RNA, 19 nt, Homo sapiens
ucaaggaggcugucaagaa

SEQ ID NO: 108047 - RNA, 19 nt, Homo sapiens
ggacgaugaccucaacuug

SEQ ID NO: 108048 - RNA, 19 nt, Homo sapiens
gggcguuccuggcuucaaa

SEQ ID NO: 108049 - RNA, 19 nt, Homo sapiens
aaggugagcugccuggaaa

SEQ ID NO: 108050 - RNA, 19 nt, Homo sapiens
gagaagcacgagagugaaa

SEQ ID NO: 108051 - RNA, 19 nt, Homo sapiens
agagaagggugaauuugga

SEQ ID NO: 108052 - RNA, 19 nt, Homo sapiens
uauaagaacccuggucauu

SEQ ID NO: 108053 - RNA, 19 nt, Homo sapiens
gcuguucauugacaccuuu

SEQ ID NO: 108054 - RNA, 19 nt, Homo sapiens
ggagagaagggugaauuug

SEQ ID NO: 108055 - RNA, 19 nt, Homo sapiens
ccacggacauccugcucuu

SEQ ID NO: 108056 - RNA, 19 nt, Homo sapiens
aguggccgcucucuuuaua

SEQ ID NO: 108057 - RNA, 19 nt, Homo sapiens
ccaguggccgcucucuuua

SEQ ID NO: 108058 - RNA, 19 nt, Homo sapiens
gagagaagggugaauuugg

SEQ ID NO: 108059 - RNA, 19 nt, Homo sapiens
aacaacaacugcccagaga

SEQ ID NO: 108060 - RNA, 19 nt, Homo sapiens
caacaacugcccagagaag

SEQ ID NO: 108061 - RNA, 19 nt, Homo sapiens
gaccuucccugccaaacag

SEQ ID NO: 108062 - RNA, 19 nt, Homo sapiens
gaggaaaggagagaaagga

SEQ ID NO: 108063 - RNA, 19 nt, Homo sapiens
caagggcaccguccacuuc

SEQ ID NO: 108064 - RNA, 19 nt, Homo sapiens
ggacauguuccacgagaag

SEQ ID NO: 108065 - RNA, 19 nt, Homo sapiens
cacaggugcugccaagaug

SEQ ID NO: 108066 - RNA, 19 nt, Homo sapiens
gggccuccuucaucaagaa

SEQ ID NO: 108067 - RNA, 19 nt, Homo sapiens
cagcaggugcgcaacauga

SEQ ID NO: 108068 - RNA, 19 nt, Homo sapiens
ugaccucgcaagacccuua

SEQ ID NO: 108069 - RNA, 19 nt, Homo sapiens
gcgcuggcccucugcuaaa

SEQ ID NO: 108070 - RNA, 19 nt, Homo sapiens
gcaagggcaccguccacuu

SEQ ID NO: 108071 - RNA, 19 nt, Homo sapiens
ccacaggugcugccaagau

SEQ ID NO: 108072 - RNA, 19 nt, Homo sapiens
ccucagcccucaaguuugc

SEQ ID NO: 108073 - RNA, 19 nt, Homo sapiens
gggcuaccguggacagaag

SEQ ID NO: 108074 - RNA, 19 nt, Homo sapiens
ccagaaugaccucgcaaga

SEQ ID NO: 108075 - RNA, 19 nt, Homo sapiens
acgagaagcacgagaguga

SEQ ID NO: 108076 - RNA, 19 nt, Homo sapiens
caaggugagcugccuggaa

SEQ ID NO: 108077 - RNA, 19 nt, Homo sapiens
caacaugacggagcagauc

SEQ ID NO: 108078 - RNA, 19 nt, Homo sapiens
agugugacgucaugaccua

SEQ ID NO: 108079 - RNA, 19 nt, Homo sapiens
ucgcaagacccuuaacuca

SEQ ID NO: 108080 - RNA, 19 nt, Homo sapiens
auaagaacccuggucauug

SEQ ID NO: 108081 - RNA, 19 nt, Homo sapiens
gccgagagaucuggaaucg

SEQ ID NO: 108082 - RNA, 19 nt, Homo sapiens
ccuggucgcugagaaguuc

SEQ ID NO: 108083 - RNA, 19 nt, Homo sapiens
aggagaaccugggaggaaa

SEQ ID NO: 108084 - RNA, 19 nt, Homo sapiens
cgaggcgacuuuggcuuga

SEQ ID NO: 108085 - RNA, 19 nt, Homo sapiens
uccaguggccgcucucuuu

SEQ ID NO: 108086 - RNA, 19 nt, Homo sapiens
gaucgugugcccagaccuu

SEQ ID NO: 108087 - RNA, 19 nt, Homo sapiens
gggacauguuccacgagaa

SEQ ID NO: 108088 - RNA, 19 nt, Homo sapiens
gccggacacuaccgagaga

SEQ ID NO: 108089 - RNA, 19 nt, Homo sapiens
gugaaaaccucuacuccau

SEQ ID NO: 108090 - RNA, 19 nt, Homo sapiens
gaggcgacuuuggcuugaa

SEQ ID NO: 108091 - RNA, 19 nt, Homo sapiens
acccucagcccucaaguuu

SEQ ID NO: 108092 - RNA, 19 nt, Homo sapiens
gugugggcguggugcagua

SEQ ID NO: 108093 - RNA, 19 nt, Homo sapiens
caaaggagagaagggugaa

SEQ ID NO: 108094 - RNA, 19 nt, Homo sapiens
ccaaccagaaccugaagga

SEQ ID NO: 108095 - RNA, 19 nt, Homo sapiens
gcuggacgacgaacauauc

SEQ ID NO: 108096 - RNA, 19 nt, Homo sapiens
caagaacgggaccgaugga

SEQ ID NO: 108097 - RNA, 19 nt, Homo sapiens
cuacggagagugcuacaag

SEQ ID NO: 108098 - RNA, 19 nt, Homo sapiens
auccugcucuuccacauga

SEQ ID NO: 108099 - RNA, 19 nt, Homo sapiens
gacacuaccgagagaaaca

SEQ ID NO: 108100 - RNA, 19 nt, Homo sapiens
gccacgagggcaccuuuga

SEQ ID NO: 108101 - RNA, 19 nt, Homo sapiens
ggaggaaaggagagaaagg

SEQ ID NO: 108102 - RNA, 19 nt, Homo sapiens
aggcgacuuuggcuugaaa

SEQ ID NO: 108103 - RNA, 19 nt, Homo sapiens
gguaucaaggcaacaaugg

SEQ ID NO: 108104 - RNA, 19 nt, Homo sapiens
caagaaccucgaguggauu

SEQ ID NO: 108105 - RNA, 19 nt, Homo sapiens
cacggagugugacgucaug

SEQ ID NO: 108106 - RNA, 19 nt, Homo sapiens
uggccgcucucuuuauaag

SEQ ID NO: 108107 - RNA, 19 nt, Homo sapiens
gggacgaugaccucaacuu

SEQ ID NO: 108108 - RNA, 19 nt, Homo sapiens
gaaguccuggugugaaagg

SEQ ID NO: 108109 - RNA, 19 nt, Homo sapiens
ccacagcaggugcgcaaca

SEQ ID NO: 108110 - RNA, 19 nt, Homo sapiens
cuaccgagagaaacaacaa

SEQ ID NO: 108111 - RNA, 19 nt, Homo sapiens
cagcuggacgacgaacaua

SEQ ID NO: 108112 - RNA, 19 nt, Homo sapiens
aggagagaagggugaauuu

SEQ ID NO: 108113 - RNA, 19 nt, Homo sapiens
ggauggagcuguucauuga

SEQ ID NO: 108114 - RNA, 19 nt, Homo sapiens
uaagaacccuggucauuga

SEQ ID NO: 108115 - RNA, 19 nt, Homo sapiens
gaacccuggucauugaauu

SEQ ID NO: 108116 - RNA, 19 nt, Homo sapiens
gcaagacccuuaacucacu

SEQ ID NO: 108117 - RNA, 19 nt, Homo sapiens
ucaagaaccucgaguggau

SEQ ID NO: 108118 - RNA, 19 nt, Homo sapiens
caaggaggcugucaagaac

SEQ ID NO: 108119 - RNA, 19 nt, Homo sapiens
ucaaggaggcugucaagaa

SEQ ID NO: 108120 - RNA, 19 nt, Homo sapiens
ggacgaugaccucaacuug

SEQ ID NO: 108121 - RNA, 19 nt, Homo sapiens
gggcguuccuggcuucaaa

SEQ ID NO: 108122 - RNA, 19 nt, Homo sapiens
aaggugagcugccuggaaa

SEQ ID NO: 108123 - RNA, 19 nt, Homo sapiens
gagaagcacgagagugaaa

SEQ ID NO: 108124 - RNA, 19 nt, Homo sapiens
agagaagggugaauuugga

SEQ ID NO: 108125 - RNA, 19 nt, Homo sapiens
uauaagaacccuggucauu

SEQ ID NO: 108126 - RNA, 19 nt, Homo sapiens
gcuguucauugacaccuuu

SEQ ID NO: 108127 - RNA, 19 nt, Homo sapiens
ggagagaagggugaauuug

SEQ ID NO: 108128 - RNA, 19 nt, Homo sapiens
ccacggacauccugcucuu

SEQ ID NO: 108129 - RNA, 19 nt, Homo sapiens
aguggccgcucucuuuaua

SEQ ID NO: 108130 - RNA, 19 nt, Homo sapiens
ccaguggccgcucucuuua

SEQ ID NO: 108131 - RNA, 19 nt, Homo sapiens
gagagaagggugaauuugg

SEQ ID NO: 108132 - RNA, 19 nt, Homo sapiens
aacaacaacugcccagaga

SEQ ID NO: 108133 - RNA, 19 nt, Homo sapiens
caacaacugcccagagaag

SEQ ID NO: 108134 - RNA, 19 nt, Homo sapiens
gaccuucccugccaaacag

SEQ ID NO: 108135 - RNA, 19 nt, Homo sapiens
gaggaaaggagagaaagga

SEQ ID NO: 108136 - RNA, 19 nt, Homo sapiens
caagggcaccguccacuuc

SEQ ID NO: 108137 - RNA, 19 nt, Homo sapiens
ggacauguuccacgagaag

SEQ ID NO: 108138 - RNA, 19 nt, Homo sapiens
cacaggugcugccaagaug

SEQ ID NO: 108139 - RNA, 19 nt, Homo sapiens
gggccuccuucaucaagaa

SEQ ID NO: 108140 - RNA, 19 nt, Homo sapiens
cagcaggugcgcaacauga

SEQ ID NO: 108141 - RNA, 19 nt, Homo sapiens
ugaccucgcaagacccuua

SEQ ID NO: 108142 - RNA, 19 nt, Homo sapiens
gcgcuggcccucugcuaaa

SEQ ID NO: 108143 - RNA, 19 nt, Homo sapiens
gcaagggcaccguccacuu

SEQ ID NO: 108144 - RNA, 19 nt, Homo sapiens
ccacaggugcugccaagau

SEQ ID NO: 108145 - RNA, 19 nt, Homo sapiens
ccucagcccucaaguuugc

SEQ ID NO: 108146 - RNA, 19 nt, Homo sapiens
gggcuaccguggacagaag

SEQ ID NO: 108147 - RNA, 19 nt, Homo sapiens
ccaccugcauuuccucuac

SEQ ID NO: 108148 - RNA, 19 nt, Homo sapiens
ccagaaugaccucgcaaga

SEQ ID NO: 108149 - RNA, 19 nt, Homo sapiens
acgagaagcacgagaguga

SEQ ID NO: 108150 - RNA, 19 nt, Homo sapiens
caaggugagcugccuggaa

SEQ ID NO: 108151 - RNA, 19 nt, Homo sapiens
caacaugacggagcagauc

SEQ ID NO: 108152 - RNA, 19 nt, Homo sapiens
aaaugccgcucuucacucu

SEQ ID NO: 108153 - RNA, 19 nt, Homo sapiens
agugugacgucaugaccua

SEQ ID NO: 108154 - RNA, 19 nt, Homo sapiens
ucgcaagacccuuaacuca

SEQ ID NO: 108155 - RNA, 19 nt, Homo sapiens
auaagaacccuggucauug

SEQ ID NO: 108156 - RNA, 19 nt, Homo sapiens
gccgagagaucuggaaucg

SEQ ID NO: 108157 - RNA, 19 nt, Homo sapiens
ccuggucgcugagaaguuc

SEQ ID NO: 108158 - RNA, 19 nt, Homo sapiens
aggagaaccugggaggaaa

SEQ ID NO: 108159 - RNA, 19 nt, Homo sapiens
cgaggcgacuuuggcuuga

SEQ ID NO: 108160 - RNA, 19 nt, Homo sapiens
uccaguggccgcucucuuu

SEQ ID NO: 108161 - RNA, 19 nt, Homo sapiens
gaucgugugcccagaccuu

SEQ ID NO: 108162 - RNA, 19 nt, Homo sapiens
gggacauguuccacgagaa

SEQ ID NO: 108163 - RNA, 19 nt, Homo sapiens
gccggacacuaccgagaga

SEQ ID NO: 108164 - RNA, 19 nt, Homo sapiens
gcccaaaugccgcucuuca

SEQ ID NO: 108165 - RNA, 19 nt, Homo sapiens
gugaaaaccucuacuccau

SEQ ID NO: 108166 - RNA, 19 nt, Homo sapiens
gaggcgacuuuggcuugaa

SEQ ID NO: 108167 - RNA, 19 nt, Homo sapiens
ccaaaugccgcucuucacu

SEQ ID NO: 108168 - RNA, 19 nt, Homo sapiens
cgacucgccagcccaaaug

SEQ ID NO: 108169 - RNA, 19 nt, Homo sapiens
acccucagcccucaaguuu

SEQ ID NO: 108170 - RNA, 19 nt, Homo sapiens
gugugggcguggugcagua

SEQ ID NO: 108171 - RNA, 19 nt, Homo sapiens
caaaggagagaagggugaa

SEQ ID NO: 108172 - RNA, 19 nt, Homo sapiens
ccaaccagaaccugaagga

SEQ ID NO: 108173 - RNA, 19 nt, Homo sapiens
gcuggacgacgaacauauc

SEQ ID NO: 108174 - RNA, 19 nt, Homo sapiens
caagaacgggaccgaugga

SEQ ID NO: 108175 - RNA, 19 nt, Homo sapiens
cuacggagagugcuacaag

SEQ ID NO: 108176 - RNA, 19 nt, Homo sapiens
gacacuaccgagagaaaca

SEQ ID NO: 108177 - RNA, 19 nt, Homo sapiens
auccugcucuuccacauga

SEQ ID NO: 108178 - RNA, 19 nt, Homo sapiens
gccacgagggcaccuuuga

SEQ ID NO: 108179 - RNA, 19 nt, Homo sapiens
ggaggaaaggagagaaagg

SEQ ID NO: 108180 - RNA, 19 nt, Homo sapiens
aggcgacuuuggcuugaaa

SEQ ID NO: 108181 - RNA, 19 nt, Homo sapiens
gguaucaaggcaacaaugg

SEQ ID NO: 108182 - RNA, 19 nt, Homo sapiens
caagaaccucgaguggauu

SEQ ID NO: 108183 - RNA, 19 nt, Homo sapiens
cacggagugugacgucaug

SEQ ID NO: 108184 - RNA, 19 nt, Homo sapiens
uggccgcucucuuuauaag

SEQ ID NO: 108185 - RNA, 19 nt, Homo sapiens
gggacgaugaccucaacuu

SEQ ID NO: 108186 - RNA, 19 nt, Homo sapiens
gaaguccuggugugaaagg

SEQ ID NO: 108187 - RNA, 19 nt, Homo sapiens
ccacagcaggugcgcaaca

SEQ ID NO: 108188 - RNA, 19 nt, Homo sapiens
cuaccgagagaaacaacaa

SEQ ID NO: 108189 - RNA, 19 nt, Homo sapiens
cagcuggacgacgaacaua

SEQ ID NO: 108190 - RNA, 19 nt, Homo sapiens
aggagagaagggugaauuu

SEQ ID NO: 108191 - RNA, 19 nt, Homo sapiens
cgacauggcuuucaucuua

SEQ ID NO: 108192 - RNA, 19 nt, Homo sapiens
caaagaaccuugugaaguu

SEQ ID NO: 108193 - RNA, 19 nt, Homo sapiens
gaacagagcugcagaccau

SEQ ID NO: 108194 - RNA, 19 nt, Homo sapiens
ggacuuggauuaugaacua

SEQ ID NO: 108195 - RNA, 19 nt, Homo sapiens
ucaaugagaugaagaagua

SEQ ID NO: 108196 - RNA, 19 nt, Homo sapiens
caacaaagccugugacuau

SEQ ID NO: 108197 - RNA, 19 nt, Homo sapiens
caaaugaucuaguucagaa

SEQ ID NO: 108198 - RNA, 19 nt, Homo sapiens
ggagagaccucacagacuu

SEQ ID NO: 108199 - RNA, 19 nt, Homo sapiens
uaacggaguucucuuuaaa

SEQ ID NO: 108200 - RNA, 19 nt, Homo sapiens
ggacacaguuuaugaagau

SEQ ID NO: 108201 - RNA, 19 nt, Homo sapiens
gaugacaacuugguguuua

SEQ ID NO: 108202 - RNA, 19 nt, Homo sapiens
gauguggucuugaguauug

SEQ ID NO: 108203 - RNA, 19 nt, Homo sapiens
gaaagggaauccuggaaga

SEQ ID NO: 108204 - RNA, 19 nt, Homo sapiens
gaacggcacucaagguuuc

SEQ ID NO: 108205 - RNA, 19 nt, Homo sapiens
ggaggagguuggaaagaua

SEQ ID NO: 108206 - RNA, 19 nt, Homo sapiens
gaaguccuuucucauauuu

SEQ ID NO: 108207 - RNA, 19 nt, Homo sapiens
gcagggauuucauauuaaa

SEQ ID NO: 108208 - RNA, 19 nt, Homo sapiens
ccagauggcuuugcacaua

SEQ ID NO: 108209 - RNA, 19 nt, Homo sapiens
gcaaggcucucgaauuugu

SEQ ID NO: 108210 - RNA, 19 nt, Homo sapiens
uggcaaggcucucgaauuu

SEQ ID NO: 108211 - RNA, 19 nt, Homo sapiens
gaauugcgguggcucagua

SEQ ID NO: 108212 - RNA, 19 nt, Homo sapiens
gaacuuaagucugcugaug

SEQ ID NO: 108213 - RNA, 19 nt, Homo sapiens
caaauucccucuggaguuu

SEQ ID NO: 108214 - RNA, 19 nt, Homo sapiens
gaagaaagcagacauugug

SEQ ID NO: 108215 - RNA, 19 nt, Homo sapiens
gcaguucucucgaauacuu

SEQ ID NO: 108216 - RNA, 19 nt, Homo sapiens
uugcagggauuucauauua

SEQ ID NO: 108217 - RNA, 19 nt, Homo sapiens
gcaggaaggugaacaucaa

SEQ ID NO: 108218 - RNA, 19 nt, Homo sapiens
gaacuagccuuugcuuuag

SEQ ID NO: 108219 - RNA, 19 nt, Homo sapiens
gaagacacgccaacacuaa

SEQ ID NO: 108220 - RNA, 19 nt, Homo sapiens
gaaagaguuuguccagaga

SEQ ID NO: 108221 - RNA, 19 nt, Homo sapiens
gaaggaacuugcagggauu

SEQ ID NO: 108222 - RNA, 19 nt, Homo sapiens
ggaguucucuuuaaacaca

SEQ ID NO: 108223 - RNA, 19 nt, Homo sapiens
gcacauagcuaccgaugac

SEQ ID NO: 108224 - RNA, 19 nt, Homo sapiens
ugacauaguaggaaacuua

SEQ ID NO: 108225 - RNA, 19 nt, Homo sapiens
ggaccaaugccuuaauuaa

SEQ ID NO: 108226 - RNA, 19 nt, Homo sapiens
gaaacaagagaccaacuuu

SEQ ID NO: 108227 - RNA, 19 nt, Homo sapiens
caagugaaccgcucaauau

SEQ ID NO: 108228 - RNA, 19 nt, Homo sapiens
guaacggaguucucuuuaa

SEQ ID NO: 108229 - RNA, 19 nt, Homo sapiens
gaagagaagcagcauaaug

SEQ ID NO: 108230 - RNA, 19 nt, Homo sapiens
gcaagugaaccgcucaaua

SEQ ID NO: 108231 - RNA, 19 nt, Homo sapiens
gaaagaaugugaaaagguu

SEQ ID NO: 108232 - RNA, 19 nt, Homo sapiens
gacaaaggauugccugguu

SEQ ID NO: 108233 - RNA, 19 nt, Homo sapiens
caacaaaguggucuacaaa

SEQ ID NO: 108234 - RNA, 19 nt, Homo sapiens
ucagagagcuucccaacau

SEQ ID NO: 108235 - RNA, 19 nt, Homo sapiens
caauauucguguugguuua

SEQ ID NO: 108236 - RNA, 19 nt, Homo sapiens
gaaguucacucaaacaaaa

SEQ ID NO: 108237 - RNA, 19 nt, Homo sapiens
gggcagagcuucagcacau

SEQ ID NO: 108238 - RNA, 19 nt, Homo sapiens
agaacuagccuuugcuuua

SEQ ID NO: 108239 - RNA, 19 nt, Homo sapiens
guacagcgaugaugucaag

SEQ ID NO: 108240 - RNA, 19 nt, Homo sapiens
gacuuucucuacaagauua

SEQ ID NO: 108241 - RNA, 19 nt, Homo sapiens
caacagaacuagccuuugc

SEQ ID NO: 108242 - RNA, 19 nt, Homo sapiens
gaacaagggugccgaucag

SEQ ID NO: 108243 - RNA, 19 nt, Homo sapiens
gaaccaaucagacuggaaa

SEQ ID NO: 108244 - RNA, 19 nt, Homo sapiens
cagacuagauuucaagcua

SEQ ID NO: 108245 - RNA, 19 nt, Homo sapiens
ccucuggaguuucauguua

SEQ ID NO: 108246 - RNA, 19 nt, Homo sapiens
ggaacauccugcugcauga

SEQ ID NO: 108247 - RNA, 19 nt, Homo sapiens
caacauagaagaaagaauc

SEQ ID NO: 108248 - RNA, 19 nt, Homo sapiens
gaagcaggcuagcguguuc

SEQ ID NO: 108249 - RNA, 19 nt, Homo sapiens
gagaaacucccaauuggaa

SEQ ID NO: 108250 - RNA, 19 nt, Homo sapiens
gcacaagacucugcugaca

SEQ ID NO: 108251 - RNA, 19 nt, Homo sapiens
cgacgucuucuucaaauua

SEQ ID NO: 108252 - RNA, 19 nt, Homo sapiens
gagauguggucuugaguau

SEQ ID NO: 108253 - RNA, 19 nt, Homo sapiens
gcucuagacuuuguucgua

SEQ ID NO: 108254 - RNA, 19 nt, Homo sapiens
gaccaaugccuuaauuaaa

SEQ ID NO: 108255 - RNA, 19 nt, Homo sapiens
gcuaaugcaucuggaguuu

SEQ ID NO: 108256 - RNA, 19 nt, Homo sapiens
gaagaagaaagcagacauu

SEQ ID NO: 108257 - RNA, 19 nt, Homo sapiens
uagagaggcugguugacua

SEQ ID NO: 108258 - RNA, 19 nt, Homo sapiens
guaagucccuagaugaaau

SEQ ID NO: 108259 - RNA, 19 nt, Homo sapiens
acaagacucugcugacauu

SEQ ID NO: 108260 - RNA, 19 nt, Homo sapiens
caaagccugugacuauuau

SEQ ID NO: 108261 - RNA, 19 nt, Homo sapiens
cgaauaacguuacuucaag

SEQ ID NO: 108262 - RNA, 19 nt, Homo sapiens
gaaagcagacauuguguuc

SEQ ID NO: 108263 - RNA, 19 nt, Homo sapiens
gaaaucggacaggaucuua

SEQ ID NO: 108264 - RNA, 19 nt, Homo sapiens
gcagcaagcagaugucaaa

SEQ ID NO: 108265 - RNA, 19 nt, Homo sapiens
gggaggggauuuaauuuua

SEQ ID NO: 108266 - RNA, 19 nt, Homo sapiens
gaaauaguggacacaguuu

SEQ ID NO: 108267 - RNA, 19 nt, Homo sapiens
gagcuagccaggcgaauaa

SEQ ID NO: 108268 - RNA, 19 nt, Homo sapiens
gggcucugcucuagacuuu

SEQ ID NO: 108269 - RNA, 19 nt, Homo sapiens
gaggaaacaucggcacuug

SEQ ID NO: 108270 - RNA, 19 nt, Homo sapiens
ugaagccucuaacaaauga

SEQ ID NO: 108271 - RNA, 19 nt, Homo sapiens
gaacauuccuaucaaucca

SEQ ID NO: 108272 - RNA, 19 nt, Homo sapiens
caaacgacgucuucuucaa

SEQ ID NO: 108273 - RNA, 19 nt, Homo sapiens
gaaccugggcuaaauggaa

SEQ ID NO: 108274 - RNA, 19 nt, Homo sapiens
cagagaugcucgagaaguu

SEQ ID NO: 108275 - RNA, 19 nt, Homo sapiens
gaagaaagaaucaugaacu

SEQ ID NO: 108276 - RNA, 19 nt, Homo sapiens
gaucgaggauggagugcuu

SEQ ID NO: 108277 - RNA, 19 nt, Homo sapiens
caacgaagccggugacuac

SEQ ID NO: 108278 - RNA, 19 nt, Homo sapiens
ucacagacuuccuggagaa

SEQ ID NO: 108279 - RNA, 19 nt, Homo sapiens
acggagaucuggcugauuu

SEQ ID NO: 108280 - RNA, 19 nt, Homo sapiens
gaacagaaucagccagaug

SEQ ID NO: 108281 - RNA, 19 nt, Homo sapiens
gcaaugcccuggaguacgu

SEQ ID NO: 108282 - RNA, 19 nt, Homo sapiens
ucacagagaugcagaccau

SEQ ID NO: 108283 - RNA, 19 nt, Homo sapiens
cagagucgcuucccaagau

SEQ ID NO: 108284 - RNA, 19 nt, Homo sapiens
cggcuacucuauauacuuu

SEQ ID NO: 108285 - RNA, 19 nt, Homo sapiens
acaaagacggccacuguua

SEQ ID NO: 108286 - RNA, 19 nt, Homo sapiens
gcaaggacugcaagaguuu

SEQ ID NO: 108287 - RNA, 19 nt, Homo sapiens
ugacaacauugccgagaaa

SEQ ID NO: 108288 - RNA, 19 nt, Homo sapiens
ccaagaggcagauuauuga

SEQ ID NO: 108289 - RNA, 19 nt, Homo sapiens
ucgaugagcucaaugugaa

SEQ ID NO: 108290 - RNA, 19 nt, Homo sapiens
gcaaauguaaagucuagaa

SEQ ID NO: 108291 - RNA, 19 nt, Homo sapiens
cgacauggcuuucaucuua

SEQ ID NO: 108292 - RNA, 19 nt, Homo sapiens
caaagaaccuugugaaguu

SEQ ID NO: 108293 - RNA, 19 nt, Homo sapiens
ggacuuggauuaugaacua

SEQ ID NO: 108294 - RNA, 19 nt, Homo sapiens
ucaaugagaugaagaagua

SEQ ID NO: 108295 - RNA, 19 nt, Homo sapiens
caacaaagccugugacuau

SEQ ID NO: 108296 - RNA, 19 nt, Homo sapiens
caaaugaucuaguucagaa

SEQ ID NO: 108297 - RNA, 19 nt, Homo sapiens
ggagagaccucacagacuu

SEQ ID NO: 108298 - RNA, 19 nt, Homo sapiens
uaacggaguucucuuuaaa

SEQ ID NO: 108299 - RNA, 19 nt, Homo sapiens
ggacacaguuuaugaagau

SEQ ID NO: 108300 - RNA, 19 nt, Homo sapiens
gaugacaacuugguguuua

SEQ ID NO: 108301 - RNA, 19 nt, Homo sapiens
gauguggucuugaguauug

SEQ ID NO: 108302 - RNA, 19 nt, Homo sapiens
gaaagggaauccuggaaga

SEQ ID NO: 108303 - RNA, 19 nt, Homo sapiens
gaacggcacucaagguuuc

SEQ ID NO: 108304 - RNA, 19 nt, Homo sapiens
ggaggagguuggaaagaua

SEQ ID NO: 108305 - RNA, 19 nt, Homo sapiens
gaaguccuuucucauauuu

SEQ ID NO: 108306 - RNA, 19 nt, Homo sapiens
gcagggauuucauauuaaa

SEQ ID NO: 108307 - RNA, 19 nt, Homo sapiens
gaauugcgguggcucagua

SEQ ID NO: 108308 - RNA, 19 nt, Homo sapiens
gaacuuaagucugcugaug

SEQ ID NO: 108309 - RNA, 19 nt, Homo sapiens
caaauucccucuggaguuu

SEQ ID NO: 108310 - RNA, 19 nt, Homo sapiens
gaagaaagcagacauugug

SEQ ID NO: 108311 - RNA, 19 nt, Homo sapiens
gcaguucucucgaauacuu

SEQ ID NO: 108312 - RNA, 19 nt, Homo sapiens
uugcagggauuucauauua

SEQ ID NO: 108313 - RNA, 19 nt, Homo sapiens
gcaggaaggugaacaucaa

SEQ ID NO: 108314 - RNA, 19 nt, Homo sapiens
gaacuagccuuugcuuuag

SEQ ID NO: 108315 - RNA, 19 nt, Homo sapiens
gaagacacgccaacacuaa

SEQ ID NO: 108316 - RNA, 19 nt, Homo sapiens
gaaagaguuuguccagaga

SEQ ID NO: 108317 - RNA, 19 nt, Homo sapiens
gaaggaacuugcagggauu

SEQ ID NO: 108318 - RNA, 19 nt, Homo sapiens
ggaguucucuuuaaacaca

SEQ ID NO: 108319 - RNA, 19 nt, Homo sapiens
gcacauagcuaccgaugac

SEQ ID NO: 108320 - RNA, 19 nt, Homo sapiens
ugacauaguaggaaacuua

SEQ ID NO: 108321 - RNA, 19 nt, Homo sapiens
ggaccaaugccuuaauuaa

SEQ ID NO: 108322 - RNA, 19 nt, Homo sapiens
gaaacaagagaccaacuuu

SEQ ID NO: 108323 - RNA, 19 nt, Homo sapiens
caagugaaccgcucaauau

SEQ ID NO: 108324 - RNA, 19 nt, Homo sapiens
guaacggaguucucuuuaa

SEQ ID NO: 108325 - RNA, 19 nt, Homo sapiens
gaagagaagcagcauaaug

SEQ ID NO: 108326 - RNA, 19 nt, Homo sapiens
gcaagugaaccgcucaaua

SEQ ID NO: 108327 - RNA, 19 nt, Homo sapiens
gaaagaaugugaaaagguu

SEQ ID NO: 108328 - RNA, 19 nt, Homo sapiens
gacaaaggauugccugguu

SEQ ID NO: 108329 - RNA, 19 nt, Homo sapiens
caacaaaguggucuacaaa

SEQ ID NO: 108330 - RNA, 19 nt, Homo sapiens
ucagagagcuucccaacau

SEQ ID NO: 108331 - RNA, 19 nt, Homo sapiens
caauauucguguugguuua

SEQ ID NO: 108332 - RNA, 19 nt, Homo sapiens
gaaguucacucaaacaaaa

SEQ ID NO: 108333 - RNA, 19 nt, Homo sapiens
gggcagagcuucagcacau

SEQ ID NO: 108334 - RNA, 19 nt, Homo sapiens
agaacuagccuuugcuuua

SEQ ID NO: 108335 - RNA, 19 nt, Homo sapiens
guacagcgaugaugucaag

SEQ ID NO: 108336 - RNA, 19 nt, Homo sapiens
gacuuucucuacaagauua

SEQ ID NO: 108337 - RNA, 19 nt, Homo sapiens
caacagaacuagccuuugc

SEQ ID NO: 108338 - RNA, 19 nt, Homo sapiens
gaacaagggugccgaucag

SEQ ID NO: 108339 - RNA, 19 nt, Homo sapiens
gaaccaaucagacuggaaa

SEQ ID NO: 108340 - RNA, 19 nt, Homo sapiens
cagacuagauuucaagcua

SEQ ID NO: 108341 - RNA, 19 nt, Homo sapiens
ccucuggaguuucauguua

SEQ ID NO: 108342 - RNA, 19 nt, Homo sapiens
ggaacauccugcugcauga

SEQ ID NO: 108343 - RNA, 19 nt, Homo sapiens
caacauagaagaaagaauc

SEQ ID NO: 108344 - RNA, 19 nt, Homo sapiens
gaagcaggcuagcguguuc

SEQ ID NO: 108345 - RNA, 19 nt, Homo sapiens
gagaaacucccaauuggaa

SEQ ID NO: 108346 - RNA, 19 nt, Homo sapiens
gcacaagacucugcugaca

SEQ ID NO: 108347 - RNA, 19 nt, Homo sapiens
cgacgucuucuucaaauua

SEQ ID NO: 108348 - RNA, 19 nt, Homo sapiens
gagauguggucuugaguau

SEQ ID NO: 108349 - RNA, 19 nt, Homo sapiens
gcucuagacuuuguucgua

SEQ ID NO: 108350 - RNA, 19 nt, Homo sapiens
gaccaaugccuuaauuaaa

SEQ ID NO: 108351 - RNA, 19 nt, Homo sapiens
gcuaaugcaucuggaguuu

SEQ ID NO: 108352 - RNA, 19 nt, Homo sapiens
gaagaagaaagcagacauu

SEQ ID NO: 108353 - RNA, 19 nt, Homo sapiens
uagagaggcugguugacua

SEQ ID NO: 108354 - RNA, 19 nt, Homo sapiens
guaagucccuagaugaaau

SEQ ID NO: 108355 - RNA, 19 nt, Homo sapiens
acaagacucugcugacauu

SEQ ID NO: 108356 - RNA, 19 nt, Homo sapiens
caaagccugugacuauuau

SEQ ID NO: 108357 - RNA, 19 nt, Homo sapiens
cgaauaacguuacuucaag

SEQ ID NO: 108358 - RNA, 19 nt, Homo sapiens
gaaagcagacauuguguuc

SEQ ID NO: 108359 - RNA, 19 nt, Homo sapiens
gaaaucggacaggaucuua

SEQ ID NO: 108360 - RNA, 19 nt, Homo sapiens
gcagcaagcagaugucaaa

SEQ ID NO: 108361 - RNA, 19 nt, Homo sapiens
gggaggggauuuaauuuua

SEQ ID NO: 108362 - RNA, 19 nt, Homo sapiens
gaaauaguggacacaguuu

SEQ ID NO: 108363 - RNA, 19 nt, Homo sapiens
gagcuagccaggcgaauaa

SEQ ID NO: 108364 - RNA, 19 nt, Homo sapiens
gggcucugcucuagacuuu

SEQ ID NO: 108365 - RNA, 19 nt, Homo sapiens
gaggaaacaucggcacuug

SEQ ID NO: 108366 - RNA, 19 nt, Homo sapiens
ugaagccucuaacaaauga

SEQ ID NO: 108367 - RNA, 19 nt, Homo sapiens
gaacauuccuaucaaucca

SEQ ID NO: 108368 - RNA, 19 nt, Homo sapiens
caaacgacgucuucuucaa

SEQ ID NO: 108369 - RNA, 19 nt, Homo sapiens
gaaccugggcuaaauggaa

SEQ ID NO: 108370 - RNA, 19 nt, Homo sapiens
cagagaugcucgagaaguu

SEQ ID NO: 108371 - RNA, 19 nt, Homo sapiens
gaagaaagaaucaugaacu

SEQ ID NO: 108372 - RNA, 19 nt, Homo sapiens
gaucgaggauggagugcuu

SEQ ID NO: 108373 - RNA, 19 nt, Homo sapiens
caacgaagccggugacuac

SEQ ID NO: 108374 - RNA, 19 nt, Homo sapiens
ucacagacuuccuggagaa

SEQ ID NO: 108375 - RNA, 19 nt, Homo sapiens
acggagaucuggcugauuu

SEQ ID NO: 108376 - RNA, 19 nt, Homo sapiens
gaacagaaucagccagaug

SEQ ID NO: 108377 - RNA, 19 nt, Homo sapiens
gcaaugcccuggaguacgu

SEQ ID NO: 108378 - RNA, 19 nt, Homo sapiens
ucacagagaugcagaccau

SEQ ID NO: 108379 - RNA, 19 nt, Homo sapiens
cagagucgcuucccaagau

SEQ ID NO: 108380 - RNA, 19 nt, Homo sapiens
cggcuacucuauauacuuu

SEQ ID NO: 108381 - RNA, 19 nt, Homo sapiens
acaaagacggccacuguua

SEQ ID NO: 108382 - RNA, 19 nt, Homo sapiens
gcaaggacugcaagaguuu

SEQ ID NO: 108383 - RNA, 19 nt, Homo sapiens
ugacaacauugccgagaaa

SEQ ID NO: 108384 - RNA, 19 nt, Homo sapiens
ccaagaggcagauuauuga

SEQ ID NO: 108385 - RNA, 19 nt, Homo sapiens
ucgaugagcucaaugugaa

SEQ ID NO: 108386 - RNA, 19 nt, Homo sapiens
gcaaauguaaagucuagaa

SEQ ID NO: 108387 - RNA, 19 nt, Homo sapiens
uagauucccuugcacugua

SEQ ID NO: 108388 - RNA, 19 nt, Homo sapiens
ggagagaggacccaaagga

SEQ ID NO: 108389 - RNA, 19 nt, Homo sapiens
ggcgaggguuuauguauga

SEQ ID NO: 108390 - RNA, 19 nt, Homo sapiens
ucuacaagauuaucgauga

SEQ ID NO: 108391 - RNA, 19 nt, Homo sapiens
cgacauggcuuucaucuua

SEQ ID NO: 108392 - RNA, 19 nt, Homo sapiens
caaagaaccuugugaaguu

SEQ ID NO: 108393 - RNA, 19 nt, Homo sapiens
gaacagagcugcagaccau

SEQ ID NO: 108394 - RNA, 19 nt, Homo sapiens
ggacuuggauuaugaacua

SEQ ID NO: 108395 - RNA, 19 nt, Homo sapiens
ucaaugagaugaagaagua

SEQ ID NO: 108396 - RNA, 19 nt, Homo sapiens
caacaaagccugugacuau

SEQ ID NO: 108397 - RNA, 19 nt, Homo sapiens
caaaugaucuaguucagaa

SEQ ID NO: 108398 - RNA, 19 nt, Homo sapiens
ggagagaccucacagacuu

SEQ ID NO: 108399 - RNA, 19 nt, Homo sapiens
ggacacaguuuaugaagau

SEQ ID NO: 108400 - RNA, 19 nt, Homo sapiens
gaugacaacuugguguuua

SEQ ID NO: 108401 - RNA, 19 nt, Homo sapiens
gauguggucuugaguauug

SEQ ID NO: 108402 - RNA, 19 nt, Homo sapiens
gaaagggaauccuggaaga

SEQ ID NO: 108403 - RNA, 19 nt, Homo sapiens
gaacggcacucaagguuuc

SEQ ID NO: 108404 - RNA, 19 nt, Homo sapiens
ggaggagguuggaaagaua

SEQ ID NO: 108405 - RNA, 19 nt, Homo sapiens
gaaguccuuucucauauuu

SEQ ID NO: 108406 - RNA, 19 nt, Homo sapiens
gcagggauuucauauuaaa

SEQ ID NO: 108407 - RNA, 19 nt, Homo sapiens
ccagauggcuuugcacaua

SEQ ID NO: 108408 - RNA, 19 nt, Homo sapiens
gcaaggcucucgaauuugu

SEQ ID NO: 108409 - RNA, 19 nt, Homo sapiens
uggcaaggcucucgaauuu

SEQ ID NO: 108410 - RNA, 19 nt, Homo sapiens
gaauugcgguggcucagua

SEQ ID NO: 108411 - RNA, 19 nt, Homo sapiens
gaacuuaagucugcugaug

SEQ ID NO: 108412 - RNA, 19 nt, Homo sapiens
caaauucccucuggaguuu

SEQ ID NO: 108413 - RNA, 19 nt, Homo sapiens
gaagaaagcagacauugug

SEQ ID NO: 108414 - RNA, 19 nt, Homo sapiens
gcaguucucucgaauacuu

SEQ ID NO: 108415 - RNA, 19 nt, Homo sapiens
uugcagggauuucauauua

SEQ ID NO: 108416 - RNA, 19 nt, Homo sapiens
gcaggaaggugaacaucaa

SEQ ID NO: 108417 - RNA, 19 nt, Homo sapiens
gaacuagccuuugcuuuag

SEQ ID NO: 108418 - RNA, 19 nt, Homo sapiens
gaagacacgccaacacuaa

SEQ ID NO: 108419 - RNA, 19 nt, Homo sapiens
gaaagaguuuguccagaga

SEQ ID NO: 108420 - RNA, 19 nt, Homo sapiens
gaaggaacuugcagggauu

SEQ ID NO: 108421 - RNA, 19 nt, Homo sapiens
gcacauagcuaccgaugac

SEQ ID NO: 108422 - RNA, 19 nt, Homo sapiens
ugacauaguaggaaacuua

SEQ ID NO: 108423 - RNA, 19 nt, Homo sapiens
ggaccaaugccuuaauuaa

SEQ ID NO: 108424 - RNA, 19 nt, Homo sapiens
gaaacaagagaccaacuuu

SEQ ID NO: 108425 - RNA, 19 nt, Homo sapiens
caagugaaccgcucaauau

SEQ ID NO: 108426 - RNA, 19 nt, Homo sapiens
gaagagaagcagcauaaug

SEQ ID NO: 108427 - RNA, 19 nt, Homo sapiens
gcaagugaaccgcucaaua

SEQ ID NO: 108428 - RNA, 19 nt, Homo sapiens
gaaagaaugugaaaagguu

SEQ ID NO: 108429 - RNA, 19 nt, Homo sapiens
gacaaaggauugccugguu

SEQ ID NO: 108430 - RNA, 19 nt, Homo sapiens
caacaaaguggucuacaaa

SEQ ID NO: 108431 - RNA, 19 nt, Homo sapiens
ucagagagcuucccaacau

SEQ ID NO: 108432 - RNA, 19 nt, Homo sapiens
gggcagagcuucagcacau

SEQ ID NO: 108433 - RNA, 19 nt, Homo sapiens
agaacuagccuuugcuuua

SEQ ID NO: 108434 - RNA, 19 nt, Homo sapiens
guacagcgaugaugucaag

SEQ ID NO: 108435 - RNA, 19 nt, Homo sapiens
gacuuucucuacaagauua

SEQ ID NO: 108436 - RNA, 19 nt, Homo sapiens
caacagaacuagccuuugc

SEQ ID NO: 108437 - RNA, 19 nt, Homo sapiens
gaacaagggugccgaucag

SEQ ID NO: 108438 - RNA, 19 nt, Homo sapiens
gaaccaaucagacuggaaa

SEQ ID NO: 108439 - RNA, 19 nt, Homo sapiens
cagacuagauuucaagcua

SEQ ID NO: 108440 - RNA, 19 nt, Homo sapiens
ccucuggaguuucauguua

SEQ ID NO: 108441 - RNA, 19 nt, Homo sapiens
ggaacauccugcugcauga

SEQ ID NO: 108442 - RNA, 19 nt, Homo sapiens
caacauagaagaaagaauc

SEQ ID NO: 108443 - RNA, 19 nt, Homo sapiens
gaagcaggcuagcguguuc

SEQ ID NO: 108444 - RNA, 19 nt, Homo sapiens
gagaaacucccaauuggaa

SEQ ID NO: 108445 - RNA, 19 nt, Homo sapiens
gcacaagacucugcugaca

SEQ ID NO: 108446 - RNA, 19 nt, Homo sapiens
cgacgucuucuucaaauua

SEQ ID NO: 108447 - RNA, 19 nt, Homo sapiens
gagauguggucuugaguau

SEQ ID NO: 108448 - RNA, 19 nt, Homo sapiens
gcucuagacuuuguucgua

SEQ ID NO: 108449 - RNA, 19 nt, Homo sapiens
gaccaaugccuuaauuaaa

SEQ ID NO: 108450 - RNA, 19 nt, Homo sapiens
gcuaaugcaucuggaguuu

SEQ ID NO: 108451 - RNA, 19 nt, Homo sapiens
gaagaagaaagcagacauu

SEQ ID NO: 108452 - RNA, 19 nt, Homo sapiens
uagagaggcugguugacua

SEQ ID NO: 108453 - RNA, 19 nt, Homo sapiens
guaagucccuagaugaaau

SEQ ID NO: 108454 - RNA, 19 nt, Homo sapiens
acaagacucugcugacauu

SEQ ID NO: 108455 - RNA, 19 nt, Homo sapiens
caaagccugugacuauuau

SEQ ID NO: 108456 - RNA, 19 nt, Homo sapiens
cgaauaacguuacuucaag

SEQ ID NO: 108457 - RNA, 19 nt, Homo sapiens
gaaagcagacauuguguuc

SEQ ID NO: 108458 - RNA, 19 nt, Homo sapiens
gaaaucggacaggaucuua

SEQ ID NO: 108459 - RNA, 19 nt, Homo sapiens
gcagcaagcagaugucaaa

SEQ ID NO: 108460 - RNA, 19 nt, Homo sapiens
gggaggggauuuaauuuua

SEQ ID NO: 108461 - RNA, 19 nt, Homo sapiens
gaaauaguggacacaguuu

SEQ ID NO: 108462 - RNA, 19 nt, Homo sapiens
gggcucugcucuagacuuu

SEQ ID NO: 108463 - RNA, 19 nt, Homo sapiens
gaggaaacaucggcacuug

SEQ ID NO: 108464 - RNA, 19 nt, Homo sapiens
ugaagccucuaacaaauga

SEQ ID NO: 108465 - RNA, 19 nt, Homo sapiens
gaacauuccuaucaaucca

SEQ ID NO: 108466 - RNA, 19 nt, Homo sapiens
caaacgacgucuucuucaa

SEQ ID NO: 108467 - RNA, 19 nt, Homo sapiens
gaaccugggcuaaauggaa

SEQ ID NO: 108468 - RNA, 19 nt, Homo sapiens
cagagaugcucgagaaguu

SEQ ID NO: 108469 - RNA, 19 nt, Homo sapiens
gaagaaagaaucaugaacu

SEQ ID NO: 108470 - RNA, 19 nt, Homo sapiens
gaucgaggauggagugcuu

SEQ ID NO: 108471 - RNA, 19 nt, Homo sapiens
gaagagagcaagcgagaca

SEQ ID NO: 108472 - RNA, 19 nt, Homo sapiens
caacgaagccggugacuac

SEQ ID NO: 108473 - RNA, 19 nt, Homo sapiens
ucacagacuuccuggagaa

SEQ ID NO: 108474 - RNA, 19 nt, Homo sapiens
acggagaucuggcugauuu

SEQ ID NO: 108475 - RNA, 19 nt, Homo sapiens
gaacagaaucagccagaug

SEQ ID NO: 108476 - RNA, 19 nt, Homo sapiens
gcaaugcccuggaguacgu

SEQ ID NO: 108477 - RNA, 19 nt, Homo sapiens
ucacagagaugcagaccau

SEQ ID NO: 108478 - RNA, 19 nt, Homo sapiens
cagagucgcuucccaagau

SEQ ID NO: 108479 - RNA, 19 nt, Homo sapiens
cggcuacucuauauacuuu

SEQ ID NO: 108480 - RNA, 19 nt, Homo sapiens
acaaagacggccacuguua

SEQ ID NO: 108481 - RNA, 19 nt, Homo sapiens
gcaaggacugcaagaguuu

SEQ ID NO: 108482 - RNA, 19 nt, Homo sapiens
ugacaacauugccgagaaa

SEQ ID NO: 108483 - RNA, 19 nt, Homo sapiens
ccaagaggcagauuauuga

SEQ ID NO: 108484 - RNA, 19 nt, Homo sapiens
ucgaugagcucaaugugaa

SEQ ID NO: 108485 - RNA, 19 nt, Homo sapiens
gcaaauguaaagucuagaa

SEQ ID NO: 108486 - RNA, 19 nt, Homo sapiens
uagauucccuugcacugua

SEQ ID NO: 108487 - RNA, 19 nt, Homo sapiens
ggagagaggacccaaagga

SEQ ID NO: 108488 - RNA, 19 nt, Homo sapiens
ggcgaggguuuauguauga

SEQ ID NO: 108489 - RNA, 19 nt, Homo sapiens
gagugaugcugcagacauu

SEQ ID NO: 108490 - RNA, 19 nt, Homo sapiens
ucuacaagauuaucgauga

SEQ ID NO: 108491 - RNA, 19 nt, Homo sapiens
cgacauggcuuucaucuua

SEQ ID NO: 108492 - RNA, 19 nt, Homo sapiens
caaagaaccuugugaaguu

SEQ ID NO: 108493 - RNA, 19 nt, Homo sapiens
gaacagagcugcagaccau

SEQ ID NO: 108494 - RNA, 19 nt, Homo sapiens
ggacuuggauuaugaacua

SEQ ID NO: 108495 - RNA, 19 nt, Homo sapiens
ucaaugagaugaagaagua

SEQ ID NO: 108496 - RNA, 19 nt, Homo sapiens
caacaaagccugugacuau

SEQ ID NO: 108497 - RNA, 19 nt, Homo sapiens
caaaugaucuaguucagaa

SEQ ID NO: 108498 - RNA, 19 nt, Homo sapiens
ggagagaccucacagacuu

SEQ ID NO: 108499 - RNA, 19 nt, Homo sapiens
uaacggaguucucuuuaaa

SEQ ID NO: 108500 - RNA, 19 nt, Homo sapiens
ggacacaguuuaugaagau

SEQ ID NO: 108501 - RNA, 19 nt, Homo sapiens
gauguggucuugaguauug

SEQ ID NO: 108502 - RNA, 19 nt, Homo sapiens
gaaagggaauccuggaaga

SEQ ID NO: 108503 - RNA, 19 nt, Homo sapiens
gaacggcacucaagguuuc

SEQ ID NO: 108504 - RNA, 19 nt, Homo sapiens
ggaggagguuggaaagaua

SEQ ID NO: 108505 - RNA, 19 nt, Homo sapiens
gaaguccuuucucauauuu

SEQ ID NO: 108506 - RNA, 19 nt, Homo sapiens
gcagggauuucauauuaaa

SEQ ID NO: 108507 - RNA, 19 nt, Homo sapiens
ccagauggcuuugcacaua

SEQ ID NO: 108508 - RNA, 19 nt, Homo sapiens
gcaaggcucucgaauuugu

SEQ ID NO: 108509 - RNA, 19 nt, Homo sapiens
uggcaaggcucucgaauuu

SEQ ID NO: 108510 - RNA, 19 nt, Homo sapiens
gaauugcgguggcucagua

SEQ ID NO: 108511 - RNA, 19 nt, Homo sapiens
gaacuuaagucugcugaug

SEQ ID NO: 108512 - RNA, 19 nt, Homo sapiens
caaauucccucuggaguuu

SEQ ID NO: 108513 - RNA, 19 nt, Homo sapiens
gaagaaagcagacauugug

SEQ ID NO: 108514 - RNA, 19 nt, Homo sapiens
gcaguucucucgaauacuu

SEQ ID NO: 108515 - RNA, 19 nt, Homo sapiens
uugcagggauuucauauua

SEQ ID NO: 108516 - RNA, 19 nt, Homo sapiens
gcaggaaggugaacaucaa

SEQ ID NO: 108517 - RNA, 19 nt, Homo sapiens
gaacuagccuuugcuuuag

SEQ ID NO: 108518 - RNA, 19 nt, Homo sapiens
gaagacacgccaacacuaa

SEQ ID NO: 108519 - RNA, 19 nt, Homo sapiens
gaaagaguuuguccagaga

SEQ ID NO: 108520 - RNA, 19 nt, Homo sapiens
gaaggaacuugcagggauu

SEQ ID NO: 108521 - RNA, 19 nt, Homo sapiens
ggaguucucuuuaaacaca

SEQ ID NO: 108522 - RNA, 19 nt, Homo sapiens
ugacauaguaggaaacuua

SEQ ID NO: 108523 - RNA, 19 nt, Homo sapiens
ggaccaaugccuuaauuaa

SEQ ID NO: 108524 - RNA, 19 nt, Homo sapiens
gaaacaagagaccaacuuu

SEQ ID NO: 108525 - RNA, 19 nt, Homo sapiens
caagugaaccgcucaauau

SEQ ID NO: 108526 - RNA, 19 nt, Homo sapiens
guaacggaguucucuuuaa

SEQ ID NO: 108527 - RNA, 19 nt, Homo sapiens
gaagagaagcagcauaaug

SEQ ID NO: 108528 - RNA, 19 nt, Homo sapiens
gcaagugaaccgcucaaua

SEQ ID NO: 108529 - RNA, 19 nt, Homo sapiens
gaaagaaugugaaaagguu

SEQ ID NO: 108530 - RNA, 19 nt, Homo sapiens
gacaaaggauugccugguu

SEQ ID NO: 108531 - RNA, 19 nt, Homo sapiens
caacaaaguggucuacaaa

SEQ ID NO: 108532 - RNA, 19 nt, Homo sapiens
ucagagagcuucccaacau

SEQ ID NO: 108533 - RNA, 19 nt, Homo sapiens
caauauucguguugguuua

SEQ ID NO: 108534 - RNA, 19 nt, Homo sapiens
gaaguucacucaaacaaaa

SEQ ID NO: 108535 - RNA, 19 nt, Homo sapiens
agaacuagccuuugcuuua

SEQ ID NO: 108536 - RNA, 19 nt, Homo sapiens
guacagcgaugaugucaag

SEQ ID NO: 108537 - RNA, 19 nt, Homo sapiens
gacuuucucuacaagauua

SEQ ID NO: 108538 - RNA, 19 nt, Homo sapiens
caacagaacuagccuuugc

SEQ ID NO: 108539 - RNA, 19 nt, Homo sapiens
gaacaagggugccgaucag

SEQ ID NO: 108540 - RNA, 19 nt, Homo sapiens
gaaccaaucagacuggaaa

SEQ ID NO: 108541 - RNA, 19 nt, Homo sapiens
cagacuagauuucaagcua

SEQ ID NO: 108542 - RNA, 19 nt, Homo sapiens
ccucuggaguuucauguua

SEQ ID NO: 108543 - RNA, 19 nt, Homo sapiens
ggaacauccugcugcauga

SEQ ID NO: 108544 - RNA, 19 nt, Homo sapiens
caacauagaagaaagaauc

SEQ ID NO: 108545 - RNA, 19 nt, Homo sapiens
cgacgucuucuucaaauua

SEQ ID NO: 108546 - RNA, 19 nt, Homo sapiens
gagauguggucuugaguau

SEQ ID NO: 108547 - RNA, 19 nt, Homo sapiens
gcucuagacuuuguucgua

SEQ ID NO: 108548 - RNA, 19 nt, Homo sapiens
gaccaaugccuuaauuaaa

SEQ ID NO: 108549 - RNA, 19 nt, Homo sapiens
gcuaaugcaucuggaguuu

SEQ ID NO: 108550 - RNA, 19 nt, Homo sapiens
gaagaagaaagcagacauu

SEQ ID NO: 108551 - RNA, 19 nt, Homo sapiens
uagagaggcugguugacua

SEQ ID NO: 108552 - RNA, 19 nt, Homo sapiens
guaagucccuagaugaaau

SEQ ID NO: 108553 - RNA, 19 nt, Homo sapiens
caaagccugugacuauuau

SEQ ID NO: 108554 - RNA, 19 nt, Homo sapiens
cgaauaacguuacuucaag

SEQ ID NO: 108555 - RNA, 19 nt, Homo sapiens
gaaagcagacauuguguuc

SEQ ID NO: 108556 - RNA, 19 nt, Homo sapiens
gaaaucggacaggaucuua

SEQ ID NO: 108557 - RNA, 19 nt, Homo sapiens
gcagcaagcagaugucaaa

SEQ ID NO: 108558 - RNA, 19 nt, Homo sapiens
gggaggggauuuaauuuua

SEQ ID NO: 108559 - RNA, 19 nt, Homo sapiens
gaaauaguggacacaguuu

SEQ ID NO: 108560 - RNA, 19 nt, Homo sapiens
gagcuagccaggcgaauaa

SEQ ID NO: 108561 - RNA, 19 nt, Homo sapiens
gggcucugcucuagacuuu

SEQ ID NO: 108562 - RNA, 19 nt, Homo sapiens
gaggaaacaucggcacuug

SEQ ID NO: 108563 - RNA, 19 nt, Homo sapiens
ugaagccucuaacaaauga

SEQ ID NO: 108564 - RNA, 19 nt, Homo sapiens
gaacauuccuaucaaucca

SEQ ID NO: 108565 - RNA, 19 nt, Homo sapiens
caaacgacgucuucuucaa

SEQ ID NO: 108566 - RNA, 19 nt, Homo sapiens
gaaccugggcuaaauggaa

SEQ ID NO: 108567 - RNA, 19 nt, Homo sapiens
cagagaugcucgagaaguu

SEQ ID NO: 108568 - RNA, 19 nt, Homo sapiens
gaagaaagaaucaugaacu

SEQ ID NO: 108569 - RNA, 19 nt, Homo sapiens
gaucgaggauggagugcuu

SEQ ID NO: 108570 - RNA, 19 nt, Homo sapiens
caacgaagccggugacuac

SEQ ID NO: 108571 - RNA, 19 nt, Homo sapiens
ucacagacuuccuggagaa

SEQ ID NO: 108572 - RNA, 19 nt, Homo sapiens
acggagaucuggcugauuu

SEQ ID NO: 108573 - RNA, 19 nt, Homo sapiens
gaacagaaucagccagaug

SEQ ID NO: 108574 - RNA, 19 nt, Homo sapiens
gcaaugcccuggaguacgu

SEQ ID NO: 108575 - RNA, 19 nt, Homo sapiens
ucacagagaugcagaccau

SEQ ID NO: 108576 - RNA, 19 nt, Homo sapiens
cagagucgcuucccaagau

SEQ ID NO: 108577 - RNA, 19 nt, Homo sapiens
cggcuacucuauauacuuu

SEQ ID NO: 108578 - RNA, 19 nt, Homo sapiens
acaaagacggccacuguua

SEQ ID NO: 108579 - RNA, 19 nt, Homo sapiens
gcaaggacugcaagaguuu

SEQ ID NO: 108580 - RNA, 19 nt, Homo sapiens
ugacaacauugccgagaaa

SEQ ID NO: 108581 - RNA, 19 nt, Homo sapiens
ccaagaggcagauuauuga

SEQ ID NO: 108582 - RNA, 19 nt, Homo sapiens
ucgaugagcucaaugugaa

SEQ ID NO: 108583 - RNA, 19 nt, Homo sapiens
gcaaauguaaagucuagaa

SEQ ID NO: 108584 - RNA, 19 nt, Homo sapiens
uagauucccuugcacugua

SEQ ID NO: 108585 - RNA, 19 nt, Homo sapiens
ggagagaggacccaaagga

SEQ ID NO: 108586 - RNA, 19 nt, Homo sapiens
ggcgaggguuuauguauga

SEQ ID NO: 108587 - RNA, 19 nt, Homo sapiens
gagugaugcugcagacauu

SEQ ID NO: 108588 - RNA, 19 nt, Homo sapiens
ucuacaagauuaucgauga

SEQ ID NO: 108589 - RNA, 19 nt, Homo sapiens
gaaacuuaguguccugugu

SEQ ID NO: 108590 - RNA, 19 nt, Homo sapiens
ucgaauacuuugaauguug

SEQ ID NO: 108591 - RNA, 19 nt, Homo sapiens
cgacauggcuuucaucuua

SEQ ID NO: 108592 - RNA, 19 nt, Homo sapiens
caaagaaccuugugaaguu

SEQ ID NO: 108593 - RNA, 19 nt, Homo sapiens
gaacagagcugcagaccau

SEQ ID NO: 108594 - RNA, 19 nt, Homo sapiens
ggacuuggauuaugaacua

SEQ ID NO: 108595 - RNA, 19 nt, Homo sapiens
ucaaugagaugaagaagua

SEQ ID NO: 108596 - RNA, 19 nt, Homo sapiens
caacaaagccugugacuau

SEQ ID NO: 108597 - RNA, 19 nt, Homo sapiens
caaaugaucuaguucagaa

SEQ ID NO: 108598 - RNA, 19 nt, Homo sapiens
ggagagaccucacagacuu

SEQ ID NO: 108599 - RNA, 19 nt, Homo sapiens
uaacggaguucucuuuaaa

SEQ ID NO: 108600 - RNA, 19 nt, Homo sapiens
ggacacaguuuaugaagau

SEQ ID NO: 108601 - RNA, 19 nt, Homo sapiens
gaugacaacuugguguuua

SEQ ID NO: 108602 - RNA, 19 nt, Homo sapiens
gauguggucuugaguauug

SEQ ID NO: 108603 - RNA, 19 nt, Homo sapiens
gaaagggaauccuggaaga

SEQ ID NO: 108604 - RNA, 19 nt, Homo sapiens
gaacggcacucaagguuuc

SEQ ID NO: 108605 - RNA, 19 nt, Homo sapiens
ggaggagguuggaaagaua

SEQ ID NO: 108606 - RNA, 19 nt, Homo sapiens
gcagggauuucauauuaaa

SEQ ID NO: 108607 - RNA, 19 nt, Homo sapiens
ccagauggcuuugcacaua

SEQ ID NO: 108608 - RNA, 19 nt, Homo sapiens
gcaaggcucucgaauuugu

SEQ ID NO: 108609 - RNA, 19 nt, Homo sapiens
uggcaaggcucucgaauuu

SEQ ID NO: 108610 - RNA, 19 nt, Homo sapiens
gaauugcgguggcucagua

SEQ ID NO: 108611 - RNA, 19 nt, Homo sapiens
caaauucccucuggaguuu

SEQ ID NO: 108612 - RNA, 19 nt, Homo sapiens
gaagaaagcagacauugug

SEQ ID NO: 108613 - RNA, 19 nt, Homo sapiens
gcaguucucucgaauacuu

SEQ ID NO: 108614 - RNA, 19 nt, Homo sapiens
uugcagggauuucauauua

SEQ ID NO: 108615 - RNA, 19 nt, Homo sapiens
gcaggaaggugaacaucaa

SEQ ID NO: 108616 - RNA, 19 nt, Homo sapiens
gaacuagccuuugcuuuag

SEQ ID NO: 108617 - RNA, 19 nt, Homo sapiens
gaagacacgccaacacuaa

SEQ ID NO: 108618 - RNA, 19 nt, Homo sapiens
gaaagaguuuguccagaga

SEQ ID NO: 108619 - RNA, 19 nt, Homo sapiens
gaaggaacuugcagggauu

SEQ ID NO: 108620 - RNA, 19 nt, Homo sapiens
ggaguucucuuuaaacaca

SEQ ID NO: 108621 - RNA, 19 nt, Homo sapiens
gcacauagcuaccgaugac

SEQ ID NO: 108622 - RNA, 19 nt, Homo sapiens
ggaccaaugccuuaauuaa

SEQ ID NO: 108623 - RNA, 19 nt, Homo sapiens
gaaacaagagaccaacuuu

SEQ ID NO: 108624 - RNA, 19 nt, Homo sapiens
guaacggaguucucuuuaa

SEQ ID NO: 108625 - RNA, 19 nt, Homo sapiens
gaagagaagcagcauaaug

SEQ ID NO: 108626 - RNA, 19 nt, Homo sapiens
gaaagaaugugaaaagguu

SEQ ID NO: 108627 - RNA, 19 nt, Homo sapiens
gacaaaggauugccugguu

SEQ ID NO: 108628 - RNA, 19 nt, Homo sapiens
caacaaaguggucuacaaa

SEQ ID NO: 108629 - RNA, 19 nt, Homo sapiens
ucagagagcuucccaacau

SEQ ID NO: 108630 - RNA, 19 nt, Homo sapiens
caauauucguguugguuua

SEQ ID NO: 108631 - RNA, 19 nt, Homo sapiens
gaaguucacucaaacaaaa

SEQ ID NO: 108632 - RNA, 19 nt, Homo sapiens
gggcagagcuucagcacau

SEQ ID NO: 108633 - RNA, 19 nt, Homo sapiens
agaacuagccuuugcuuua

SEQ ID NO: 108634 - RNA, 19 nt, Homo sapiens
guacagcgaugaugucaag

SEQ ID NO: 108635 - RNA, 19 nt, Homo sapiens
gacuuucucuacaagauua

SEQ ID NO: 108636 - RNA, 19 nt, Homo sapiens
caacagaacuagccuuugc

SEQ ID NO: 108637 - RNA, 19 nt, Homo sapiens
gaacaagggugccgaucag

SEQ ID NO: 108638 - RNA, 19 nt, Homo sapiens
cagacuagauuucaagcua

SEQ ID NO: 108639 - RNA, 19 nt, Homo sapiens
ccucuggaguuucauguua

SEQ ID NO: 108640 - RNA, 19 nt, Homo sapiens
ggaacauccugcugcauga

SEQ ID NO: 108641 - RNA, 19 nt, Homo sapiens
caacauagaagaaagaauc

SEQ ID NO: 108642 - RNA, 19 nt, Homo sapiens
gaagcaggcuagcguguuc

SEQ ID NO: 108643 - RNA, 19 nt, Homo sapiens
gagaaacucccaauuggaa

SEQ ID NO: 108644 - RNA, 19 nt, Homo sapiens
gcacaagacucugcugaca

SEQ ID NO: 108645 - RNA, 19 nt, Homo sapiens
cgacgucuucuucaaauua

SEQ ID NO: 108646 - RNA, 19 nt, Homo sapiens
gagauguggucuugaguau

SEQ ID NO: 108647 - RNA, 19 nt, Homo sapiens
gcucuagacuuuguucgua

SEQ ID NO: 108648 - RNA, 19 nt, Homo sapiens
gaccaaugccuuaauuaaa

SEQ ID NO: 108649 - RNA, 19 nt, Homo sapiens
gcuaaugcaucuggaguuu

SEQ ID NO: 108650 - RNA, 19 nt, Homo sapiens
gaagaagaaagcagacauu

SEQ ID NO: 108651 - RNA, 19 nt, Homo sapiens
uagagaggcugguugacua

SEQ ID NO: 108652 - RNA, 19 nt, Homo sapiens
guaagucccuagaugaaau

SEQ ID NO: 108653 - RNA, 19 nt, Homo sapiens
acaagacucugcugacauu

SEQ ID NO: 108654 - RNA, 19 nt, Homo sapiens
caaagccugugacuauuau

SEQ ID NO: 108655 - RNA, 19 nt, Homo sapiens
cgaauaacguuacuucaag

SEQ ID NO: 108656 - RNA, 19 nt, Homo sapiens
gaaagcagacauuguguuc

SEQ ID NO: 108657 - RNA, 19 nt, Homo sapiens
gaaaucggacaggaucuua

SEQ ID NO: 108658 - RNA, 19 nt, Homo sapiens
gggaggggauuuaauuuua

SEQ ID NO: 108659 - RNA, 19 nt, Homo sapiens
gaaauaguggacacaguuu

SEQ ID NO: 108660 - RNA, 19 nt, Homo sapiens
gagcuagccaggcgaauaa

SEQ ID NO: 108661 - RNA, 19 nt, Homo sapiens
gggcucugcucuagacuuu

SEQ ID NO: 108662 - RNA, 19 nt, Homo sapiens
gaggaaacaucggcacuug

SEQ ID NO: 108663 - RNA, 19 nt, Homo sapiens
ugaagccucuaacaaauga

SEQ ID NO: 108664 - RNA, 19 nt, Homo sapiens
gaacauuccuaucaaucca

SEQ ID NO: 108665 - RNA, 19 nt, Homo sapiens
caaacgacgucuucuucaa

SEQ ID NO: 108666 - RNA, 19 nt, Homo sapiens
gaaccugggcuaaauggaa

SEQ ID NO: 108667 - RNA, 19 nt, Homo sapiens
cagagaugcucgagaaguu

SEQ ID NO: 108668 - RNA, 19 nt, Homo sapiens
gaagaaagaaucaugaacu

SEQ ID NO: 108669 - RNA, 19 nt, Homo sapiens
gaucgaggauggagugcuu

SEQ ID NO: 108670 - RNA, 19 nt, Homo sapiens
caacgaagccggugacuac

SEQ ID NO: 108671 - RNA, 19 nt, Homo sapiens
ucacagacuuccuggagaa

SEQ ID NO: 108672 - RNA, 19 nt, Homo sapiens
acggagaucuggcugauuu

SEQ ID NO: 108673 - RNA, 19 nt, Homo sapiens
gaacagaaucagccagaug

SEQ ID NO: 108674 - RNA, 19 nt, Homo sapiens
gcaaugcccuggaguacgu

SEQ ID NO: 108675 - RNA, 19 nt, Homo sapiens
ucacagagaugcagaccau

SEQ ID NO: 108676 - RNA, 19 nt, Homo sapiens
cagagucgcuucccaagau

SEQ ID NO: 108677 - RNA, 19 nt, Homo sapiens
cggcuacucuauauacuuu

SEQ ID NO: 108678 - RNA, 19 nt, Homo sapiens
acaaagacggccacuguua

SEQ ID NO: 108679 - RNA, 19 nt, Homo sapiens
gcaaggacugcaagaguuu

SEQ ID NO: 108680 - RNA, 19 nt, Homo sapiens
ugacaacauugccgagaaa

SEQ ID NO: 108681 - RNA, 19 nt, Homo sapiens
ccaagaggcagauuauuga

SEQ ID NO: 108682 - RNA, 19 nt, Homo sapiens
ucgaugagcucaaugugaa

SEQ ID NO: 108683 - RNA, 19 nt, Homo sapiens
gcaaauguaaagucuagaa

SEQ ID NO: 108684 - RNA, 19 nt, Homo sapiens
uagauucccuugcacugua

SEQ ID NO: 108685 - RNA, 19 nt, Homo sapiens
ggagagaggacccaaagga

SEQ ID NO: 108686 - RNA, 19 nt, Homo sapiens
ggcgaggguuuauguauga

SEQ ID NO: 108687 - RNA, 19 nt, Homo sapiens
gagugaugcugcagacauu

SEQ ID NO: 108688 - RNA, 19 nt, Homo sapiens
ucuacaagauuaucgauga

SEQ ID NO: 108689 - RNA, 19 nt, Homo sapiens
ucgaauacuuugaauguug

SEQ ID NO: 108690 - RNA, 19 nt, Homo sapiens
caaguaaauguuccgaaua

SEQ ID NO: 108691 - RNA, 19 nt, Homo sapiens
gaacugaccauccagaaua

SEQ ID NO: 108692 - RNA, 19 nt, Homo sapiens
ggacacagcugcccaaagg

SEQ ID NO: 108693 - RNA, 19 nt, Homo sapiens
gccaguggauuucggauua

SEQ ID NO: 108694 - RNA, 19 nt, Homo sapiens
gguccuagcugacggcuuu

SEQ ID NO: 108695 - RNA, 19 nt, Homo sapiens
gaaaggagaacguggagaa

SEQ ID NO: 108696 - RNA, 19 nt, Homo sapiens
ggucacagcucacagauac

SEQ ID NO: 108697 - RNA, 19 nt, Homo sapiens
ggcauuaucuugcaaagga

SEQ ID NO: 108698 - RNA, 19 nt, Homo sapiens
gaauggugcugcaggcaaa

SEQ ID NO: 108699 - RNA, 19 nt, Homo sapiens
ggaugugacuggcgucuga

SEQ ID NO: 108700 - RNA, 19 nt, Homo sapiens
gggcuuggauggugacaaa

SEQ ID NO: 108701 - RNA, 19 nt, Homo sapiens
gggcacaccugucuccauu

SEQ ID NO: 108702 - RNA, 19 nt, Homo sapiens
ggaaacugcuggcaucaag

SEQ ID NO: 108703 - RNA, 19 nt, Homo sapiens
ggacugaggcccagauaau

SEQ ID NO: 108704 - RNA, 19 nt, Homo sapiens
gcacaccugucuccauugu

SEQ ID NO: 108705 - RNA, 19 nt, Homo sapiens
guacugcccucugauguga

SEQ ID NO: 108706 - RNA, 19 nt, Homo sapiens
gcacguccguuauuucagu

SEQ ID NO: 108707 - RNA, 19 nt, Homo sapiens
gcacugacgcuucuguuga

SEQ ID NO: 108708 - RNA, 19 nt, Homo sapiens
cagcucaucugucaccauu

SEQ ID NO: 108709 - RNA, 19 nt, Homo sapiens
gccagcagcucaucuguca

SEQ ID NO: 108710 - RNA, 19 nt, Homo sapiens
cuugagaggugacauauuc

SEQ ID NO: 108711 - RNA, 19 nt, Homo sapiens
gauaaugagcugagauuca

SEQ ID NO: 108712 - RNA, 19 nt, Homo sapiens
ccacauccauccuccuuuc

SEQ ID NO: 108713 - RNA, 19 nt, Homo sapiens
gaugaugaguacucugaau

SEQ ID NO: 108714 - RNA, 19 nt, Homo sapiens
acaccugucuccauuguug

SEQ ID NO: 108715 - RNA, 19 nt, Homo sapiens
gcauccagcuacauccuau

SEQ ID NO: 108716 - RNA, 19 nt, Homo sapiens
gcucaucugucaccauuac

SEQ ID NO: 108717 - RNA, 19 nt, Homo sapiens
guggaucgguugcuggaaa

SEQ ID NO: 108718 - RNA, 19 nt, Homo sapiens
gaggagagccuggaagugu

SEQ ID NO: 108719 - RNA, 19 nt, Homo sapiens
gagaaaucccaguugguuu

SEQ ID NO: 108720 - RNA, 19 nt, Homo sapiens
gagugcacguccguuauuu

SEQ ID NO: 108721 - RNA, 19 nt, Homo sapiens
gagggaaugccaaccguuu

SEQ ID NO: 108722 - RNA, 19 nt, Homo sapiens
gcaaaggauccgugacaug

SEQ ID NO: 108723 - RNA, 19 nt, Homo sapiens
ucagacagcauucgacuug

SEQ ID NO: 108724 - RNA, 19 nt, Homo sapiens
gggcugcaauucuccaugu

SEQ ID NO: 108725 - RNA, 19 nt, Homo sapiens
gaagggagacaagggagaa

SEQ ID NO: 108726 - RNA, 19 nt, Homo sapiens
gggagagccuggugacaag

SEQ ID NO: 108727 - RNA, 19 nt, Homo sapiens
ugggaaaccuggccugaau

SEQ ID NO: 108728 - RNA, 19 nt, Homo sapiens
gggcuucccuggagcagau

SEQ ID NO: 108729 - RNA, 19 nt, Homo sapiens
ucacuggagccacagcuua

SEQ ID NO: 108730 - RNA, 19 nt, Homo sapiens
guggagaccugggaugaga

SEQ ID NO: 108731 - RNA, 19 nt, Homo sapiens
ccaagccugugaugacaug

SEQ ID NO: 108732 - RNA, 19 nt, Homo sapiens
ugucggaccuaaaggagaa

SEQ ID NO: 108733 - RNA, 19 nt, Homo sapiens
gaagggagagaaaggagau

SEQ ID NO: 108734 - RNA, 19 nt, Homo sapiens
aaaccuggccugaauggaa

SEQ ID NO: 108735 - RNA, 19 nt, Homo sapiens
ugucaggcauccuucacua

SEQ ID NO: 108736 - RNA, 19 nt, Homo sapiens
ugacugugauugcccucua

SEQ ID NO: 108737 - RNA, 19 nt, Homo sapiens
gcguggagcuccugguauc

SEQ ID NO: 108738 - RNA, 19 nt, Homo sapiens
uggcgucucuuacaucuuc

SEQ ID NO: 108739 - RNA, 19 nt, Homo sapiens
gaguauacggugcauguga

SEQ ID NO: 108740 - RNA, 19 nt, Homo sapiens
gcagugagcggaugugacu

SEQ ID NO: 108741 - RNA, 19 nt, Homo sapiens
guucaucgcaucuggauca

SEQ ID NO: 108742 - RNA, 19 nt, Homo sapiens
gcaggaaggccaggagaga

SEQ ID NO: 108743 - RNA, 19 nt, Homo sapiens
ggaccagagcugccuguga

SEQ ID NO: 108744 - RNA, 19 nt, Homo sapiens
ccgcugacauuguguucuu

SEQ ID NO: 108745 - RNA, 19 nt, Homo sapiens
cagauaaugagcugagauu

SEQ ID NO: 108746 - RNA, 19 nt, Homo sapiens
cgaaauggcagcccuggau

SEQ ID NO: 108747 - RNA, 19 nt, Homo sapiens
aggacgagauggugaaguu

SEQ ID NO: 108748 - RNA, 19 nt, Homo sapiens
aguauucuguggaggagua

SEQ ID NO: 108749 - RNA, 19 nt, Homo sapiens
agguuggccugcugucuua

SEQ ID NO: 108750 - RNA, 19 nt, Homo sapiens
ccauguggcuggcguggau

SEQ ID NO: 108751 - RNA, 19 nt, Homo sapiens
ggaacugaccauccagaau

SEQ ID NO: 108752 - RNA, 19 nt, Homo sapiens
ggagaacagggcagagaug

SEQ ID NO: 108753 - RNA, 19 nt, Homo sapiens
ggagaggauggacgaaaug

SEQ ID NO: 108754 - RNA, 19 nt, Homo sapiens
uuacgccgcugacauugug

SEQ ID NO: 108755 - RNA, 19 nt, Homo sapiens
cgacuuggaugacguucag

SEQ ID NO: 108756 - RNA, 19 nt, Homo sapiens
gaccgugagcacccuauuu

SEQ ID NO: 108757 - RNA, 19 nt, Homo sapiens
ggcuuaauguggugauguu

SEQ ID NO: 108758 - RNA, 19 nt, Homo sapiens
cccaugaccuuggcauuau

SEQ ID NO: 108759 - RNA, 19 nt, Homo sapiens
uggagaggauggacgaaau

SEQ ID NO: 108760 - RNA, 19 nt, Homo sapiens
gggugaggcuggagagaag

SEQ ID NO: 108761 - RNA, 19 nt, Homo sapiens
ggccugagaggacaaguug

SEQ ID NO: 108762 - RNA, 19 nt, Homo sapiens
ggugaugguucugcuagug

SEQ ID NO: 108763 - RNA, 19 nt, Homo sapiens
ccacaugccacucaagaca

SEQ ID NO: 108764 - RNA, 19 nt, Homo sapiens
gccacaggauacaggguuu

SEQ ID NO: 108765 - RNA, 19 nt, Homo sapiens
gaaacuccacuugcuguuc

SEQ ID NO: 108766 - RNA, 19 nt, Homo sapiens
agacagcauucgacuugga

SEQ ID NO: 108767 - RNA, 19 nt, Homo sapiens
gugaugacauggugcugau

SEQ ID NO: 108768 - RNA, 19 nt, Homo sapiens
gaagcuccuugggauagug

SEQ ID NO: 108769 - RNA, 19 nt, Homo sapiens
caagggugaccgaggcuuu

SEQ ID NO: 108770 - RNA, 19 nt, Homo sapiens
caucggcuuuccuggagaa

SEQ ID NO: 108771 - RNA, 19 nt, Homo sapiens
aaccuggccugaauggaaa

SEQ ID NO: 108772 - RNA, 19 nt, Homo sapiens
gcuacaagguccaguacac

SEQ ID NO: 108773 - RNA, 19 nt, Homo sapiens
cagccaauccuugagagua

SEQ ID NO: 108774 - RNA, 19 nt, Homo sapiens
gaugacauggugcugauuc

SEQ ID NO: 108775 - RNA, 19 nt, Homo sapiens
cgagugcacguccguuauu

SEQ ID NO: 108776 - RNA, 19 nt, Homo sapiens
ccacaggggucuccagguu

SEQ ID NO: 108777 - RNA, 19 nt, Homo sapiens
agagaaaucccaguugguu

SEQ ID NO: 108778 - RNA, 19 nt, Homo sapiens
ucaaugacuucagcaucuu

SEQ ID NO: 108779 - RNA, 19 nt, Homo sapiens
caaggugucuguggaugag

SEQ ID NO: 108780 - RNA, 19 nt, Homo sapiens
ggaaaccuggccugaaugg

SEQ ID NO: 108781 - RNA, 19 nt, Homo sapiens
gacccggguuugccuggaa

SEQ ID NO: 108782 - RNA, 19 nt, Homo sapiens
uggugaaguuggagagaaa

SEQ ID NO: 108783 - RNA, 19 nt, Homo sapiens
ccacccggcuugguucuuc

SEQ ID NO: 108784 - RNA, 19 nt, Homo sapiens
ccacuguucccacugaaug

SEQ ID NO: 108785 - RNA, 19 nt, Homo sapiens
caccagauacucccaggaa

SEQ ID NO: 108786 - RNA, 19 nt, Homo sapiens
ggaaacuccacuugcuguu

SEQ ID NO: 108787 - RNA, 19 nt, Homo sapiens
ggccggaacugaccaucca

SEQ ID NO: 108788 - RNA, 19 nt, Homo sapiens
ucggaccacugcccuagaa

SEQ ID NO: 108789 - RNA, 19 nt, Homo sapiens
uggaaaagauggagacaga

SEQ ID NO: 108790 - RNA, 19 nt, Homo sapiens
uggcagcccuggaucaucu

SEQ ID NO: 108791 - RNA, 19 nt, Homo sapiens
gaaagaagcuguugugaag

SEQ ID NO: 108792 - RNA, 19 nt, Homo sapiens
ggacauuggucuuugauuu

SEQ ID NO: 108793 - RNA, 19 nt, Homo sapiens
gaagucaucucaagaacaa

SEQ ID NO: 108794 - RNA, 19 nt, Homo sapiens
caagaaaggcaaagaaaua

SEQ ID NO: 108795 - RNA, 19 nt, Homo sapiens
gcaguccugucaaguauaa

SEQ ID NO: 108796 - RNA, 19 nt, Homo sapiens
gaaauaccauuagccaguu

SEQ ID NO: 108797 - RNA, 19 nt, Homo sapiens
caaagaguauccacaccua

SEQ ID NO: 108798 - RNA, 19 nt, Homo sapiens
caccacaaauuccacaaua

SEQ ID NO: 108799 - RNA, 19 nt, Homo sapiens
gcaaggacauuggucuuug

SEQ ID NO: 108800 - RNA, 19 nt, Homo sapiens
gggaauugauggcgugaaa

SEQ ID NO: 108801 - RNA, 19 nt, Homo sapiens
ugggauaccuggaauuaaa

SEQ ID NO: 108802 - RNA, 19 nt, Homo sapiens
gaacaacgagcccgugaug

SEQ ID NO: 108803 - RNA, 19 nt, Homo sapiens
gcaaagaaauaccauuagc

SEQ ID NO: 108804 - RNA, 19 nt, Homo sapiens
ucaaauuccuccucagaug

SEQ ID NO: 108805 - RNA, 19 nt, Homo sapiens
ggagugcugcuuaccauuu

SEQ ID NO: 108806 - RNA, 19 nt, Homo sapiens
caaggacauuggucuuuga

SEQ ID NO: 108807 - RNA, 19 nt, Homo sapiens
cagcaguccugucaaguau

SEQ ID NO: 108808 - RNA, 19 nt, Homo sapiens
caaaggagaaggugggauu

SEQ ID NO: 108809 - RNA, 19 nt, Homo sapiens
gaacaaaagacaacugaaa

SEQ ID NO: 108810 - RNA, 19 nt, Homo sapiens
ggagaaaggaccaauaggu

SEQ ID NO: 108811 - RNA, 19 nt, Homo sapiens
acaacgagcccgugaugua

SEQ ID NO: 108812 - RNA, 19 nt, Homo sapiens
cccaauauaugaaggaaau

SEQ ID NO: 108813 - RNA, 19 nt, Homo sapiens
caugggauaccuggaauua

SEQ ID NO: 108814 - RNA, 19 nt, Homo sapiens
ugaaagaagcuguugugaa

SEQ ID NO: 108815 - RNA, 19 nt, Homo sapiens
gcuaagaaaggcaagaaug

SEQ ID NO: 108816 - RNA, 19 nt, Homo sapiens
aggcaaagaaauaccauua

SEQ ID NO: 108817 - RNA, 19 nt, Homo sapiens
gcaaggagaugccccacuu

SEQ ID NO: 108818 - RNA, 19 nt, Homo sapiens
ucagaugccaccacaaauu

SEQ ID NO: 108819 - RNA, 19 nt, Homo sapiens
ggguugcucuauucaagaa

SEQ ID NO: 108820 - RNA, 19 nt, Homo sapiens
acagggauauccaggaguu

SEQ ID NO: 108821 - RNA, 19 nt, Homo sapiens
gaauggagggccagccuau

SEQ ID NO: 108822 - RNA, 19 nt, Homo sapiens
gagccucucucccugaucu

SEQ ID NO: 108823 - RNA, 19 nt, Homo sapiens
gacauuggucuuugauuug

SEQ ID NO: 108824 - RNA, 19 nt, Homo sapiens
ggaguuggaaagccaggua

SEQ ID NO: 108825 - RNA, 19 nt, Homo sapiens
gaaaggcaaagaaauacca

SEQ ID NO: 108826 - RNA, 19 nt, Homo sapiens
caacucacccuugaaguca

SEQ ID NO: 108827 - RNA, 19 nt, Homo sapiens
ccaagaaaggcaaagaaau

SEQ ID NO: 108828 - RNA, 19 nt, Homo sapiens
ccucagaugccaccacaaa

SEQ ID NO: 108829 - RNA, 19 nt, Homo sapiens
aggagaaggugggauugua

SEQ ID NO: 108830 - RNA, 19 nt, Homo sapiens
gggcaaaccaggagugaca

SEQ ID NO: 108831 - RNA, 19 nt, Homo sapiens
ggucaugggauaccuggaa

SEQ ID NO: 108832 - RNA, 19 nt, Homo sapiens
gagugcugcuuaccauuuc

SEQ ID NO: 108833 - RNA, 19 nt, Homo sapiens
ucagcaguccugucaagua

SEQ ID NO: 108834 - RNA, 19 nt, Homo sapiens
aggagaaauuggacagaaa

SEQ ID NO: 108835 - RNA, 19 nt, Homo sapiens
uaccuggaauuaaaggaaa

SEQ ID NO: 108836 - RNA, 19 nt, Homo sapiens
gcucacacguucaccaacu

SEQ ID NO: 108837 - RNA, 19 nt, Homo sapiens
gcauuuaccgccgagcuaa

SEQ ID NO: 108838 - RNA, 19 nt, Homo sapiens
ggagaaggugggauuguag

SEQ ID NO: 108839 - RNA, 19 nt, Homo sapiens
ggagaaauuggacagaaag

SEQ ID NO: 108840 - RNA, 19 nt, Homo sapiens
acauuggucuuugauuuga

SEQ ID NO: 108841 - RNA, 19 nt, Homo sapiens
ggaagccguacccaagaaa

SEQ ID NO: 108842 - RNA, 19 nt, Homo sapiens
gcaguauggcaaagaguau

SEQ ID NO: 108843 - RNA, 19 nt, Homo sapiens
ugaggucccuggugucuac

SEQ ID NO: 108844 - RNA, 19 nt, Homo sapiens
aaggagaaauuggacagaa

SEQ ID NO: 108845 - RNA, 19 nt, Homo sapiens
gaacuacaacccgcagaca

SEQ ID NO: 108846 - RNA, 19 nt, Homo sapiens
gggauacccggaauuggaa

SEQ ID NO: 108847 - RNA, 19 nt, Homo sapiens
uggagagccuggcccaaga

SEQ ID NO: 108848 - RNA, 19 nt, Homo sapiens
aaauaccauuagccaguuu

SEQ ID NO: 108849 - RNA, 19 nt, Homo sapiens
cguguggguugcucuauuc

SEQ ID NO: 108850 - RNA, 19 nt, Homo sapiens
uaagaaaggcaagaaugga

SEQ ID NO: 108851 - RNA, 19 nt, Homo sapiens
cagaugccaccacaaauuc

SEQ ID NO: 108852 - RNA, 19 nt, Homo sapiens
gagcucacacguucaccaa

SEQ ID NO: 108853 - RNA, 19 nt, Homo sapiens
guggguugcucuauucaag

SEQ ID NO: 108854 - RNA, 19 nt, Homo sapiens
ucauggacuuccuggcauu

SEQ ID NO: 108855 - RNA, 19 nt, Homo sapiens
ccuggugucuacuacuuug

SEQ ID NO: 108856 - RNA, 19 nt, Homo sapiens
uaagggagagccaggaauc

SEQ ID NO: 108857 - RNA, 19 nt, Homo sapiens
ggacagaaaggggaaauug

SEQ ID NO: 108858 - RNA, 19 nt, Homo sapiens
guauguccacuccuccuuu

SEQ ID NO: 108859 - RNA, 19 nt, Homo sapiens
cauaccacguucacugcaa

SEQ ID NO: 108860 - RNA, 19 nt, Homo sapiens
ggaguggcaggacuucaug

SEQ ID NO: 108861 - RNA, 19 nt, Homo sapiens
cccaagaaaggcaaagaaa

SEQ ID NO: 108862 - RNA, 19 nt, Homo sapiens
ccucaaauuccuccucaga

SEQ ID NO: 108863 - RNA, 19 nt, Homo sapiens
cuacuuugcauaccacguu

SEQ ID NO: 108864 - RNA, 19 nt, Homo sapiens
ggagggccagccuaugaga

SEQ ID NO: 108865 - RNA, 19 nt, Homo sapiens
cuaagaaaggcaagaaugg

SEQ ID NO: 108866 - RNA, 19 nt, Homo sapiens
ggacuaccaggaccucaag

SEQ ID NO: 108867 - RNA, 19 nt, Homo sapiens
gcgagccucucucccugau

SEQ ID NO: 108868 - RNA, 19 nt, Homo sapiens
ccaacucacccuugaaguc

SEQ ID NO: 108869 - RNA, 19 nt, Homo sapiens
cgagcuaaccgcaccuuuc

SEQ ID NO: 108870 - RNA, 19 nt, Homo sapiens
gggcuaagaaaggcaagaa

SEQ ID NO: 108871 - RNA, 19 nt, Homo sapiens
gaucccaggaccacaagga

SEQ ID NO: 108872 - RNA, 19 nt, Homo sapiens
aaccagggccacagggaua

SEQ ID NO: 108873 - RNA, 19 nt, Homo sapiens
ucaagggagcucacacguu

SEQ ID NO: 108874 - RNA, 19 nt, Homo sapiens
aggaagccguacccaagaa

SEQ ID NO: 108875 - RNA, 19 nt, Homo sapiens
caacgagcccgugauguac

SEQ ID NO: 108876 - RNA, 19 nt, Homo sapiens
caaaagacaacugaaagaa

SEQ ID NO: 108877 - RNA, 19 nt, Homo sapiens
ccagaugcccucagaacag

SEQ ID NO: 108878 - RNA, 19 nt, Homo sapiens
aaagccagguuuccuuggu

SEQ ID NO: 108879 - RNA, 19 nt, Homo sapiens
ggaaucccagguccuaugg

SEQ ID NO: 108880 - RNA, 19 nt, Homo sapiens
ggcaaagaaauaccauuag

SEQ ID NO: 108881 - RNA, 19 nt, Homo sapiens
ugggauacccggaauugga

SEQ ID NO: 108882 - RNA, 19 nt, Homo sapiens
ucgaggacccaaaggacua

SEQ ID NO: 108883 - RNA, 19 nt, Homo sapiens
gagcuaaccgcaccuuucc

SEQ ID NO: 108884 - RNA, 19 nt, Homo sapiens
ggguuugccaggucccaua

SEQ ID NO: 108885 - RNA, 19 nt, Homo sapiens
gccaagaaugggcaaggaa

SEQ ID NO: 108886 - RNA, 19 nt, Homo sapiens
ggucagcaaguaccucaca

SEQ ID NO: 108887 - RNA, 19 nt, Homo sapiens
guugcucuauucaagaaca

SEQ ID NO: 108888 - RNA, 19 nt, Homo sapiens
gaagccuggugcccuuggu

SEQ ID NO: 108889 - RNA, 19 nt, Homo sapiens
ugauucagcaguccuguca

SEQ ID NO: 108890 - RNA, 19 nt, Homo sapiens
uuugccaggucaugggaua

SEQ ID NO: 108891 - RNA, 19 nt, Homo sapiens
gaacggugcuauucaguaa

SEQ ID NO: 108892 - RNA, 19 nt, Homo sapiens
gaaaugaacucuguccaaa

SEQ ID NO: 108893 - RNA, 19 nt, Homo sapiens
gcagguggcuuacaaguug

SEQ ID NO: 108894 - RNA, 19 nt, Homo sapiens
caaguuggcauaaagauua

SEQ ID NO: 108895 - RNA, 19 nt, Homo sapiens
gggcaaagaugauuaccuu

SEQ ID NO: 108896 - RNA, 19 nt, Homo sapiens
uguauuaccuucaguauga

SEQ ID NO: 108897 - RNA, 19 nt, Homo sapiens
gaagaggucccaacgguuu

SEQ ID NO: 108898 - RNA, 19 nt, Homo sapiens
cgacagaucagcacauuaa

SEQ ID NO: 108899 - RNA, 19 nt, Homo sapiens
gcagauaauccucaaguuu

SEQ ID NO: 108900 - RNA, 19 nt, Homo sapiens
gaauuuguccuccuuguuu

SEQ ID NO: 108901 - RNA, 19 nt, Homo sapiens
uagaagagcuauccagaga

SEQ ID NO: 108902 - RNA, 19 nt, Homo sapiens
ucaaguuucuguuccauuu

SEQ ID NO: 108903 - RNA, 19 nt, Homo sapiens
acaauuggcuuucaugaug

SEQ ID NO: 108904 - RNA, 19 nt, Homo sapiens
gaagagcuauccagagagu

SEQ ID NO: 108905 - RNA, 19 nt, Homo sapiens
ccaaagggaucugcaggua

SEQ ID NO: 108906 - RNA, 19 nt, Homo sapiens
gaugggaaauucaggcaaa

SEQ ID NO: 108907 - RNA, 19 nt, Homo sapiens
cccaggaucuugagcuuua

SEQ ID NO: 108908 - RNA, 19 nt, Homo sapiens
gagagaaacuugccaugag

SEQ ID NO: 108909 - RNA, 19 nt, Homo sapiens
gaagaacggugcuauucag

SEQ ID NO: 108910 - RNA, 19 nt, Homo sapiens
gaaauaauguagacuucag

SEQ ID NO: 108911 - RNA, 19 nt, Homo sapiens
gaaggagccugggugagaa

SEQ ID NO: 108912 - RNA, 19 nt, Homo sapiens
gaacaauuggcuuucauga

SEQ ID NO: 108913 - RNA, 19 nt, Homo sapiens
gcaaagaugauuaccuuca

SEQ ID NO: 108914 - RNA, 19 nt, Homo sapiens
ggagcaaguuggcauaaag

SEQ ID NO: 108915 - RNA, 19 nt, Homo sapiens
gcuuacaaguugggaaaua

SEQ ID NO: 108916 - RNA, 19 nt, Homo sapiens
cauagggacuguuggcaaa

SEQ ID NO: 108917 - RNA, 19 nt, Homo sapiens
aaugaacucuguccaaaga

SEQ ID NO: 108918 - RNA, 19 nt, Homo sapiens
ggaaaugaacucuguccaa

SEQ ID NO: 108919 - RNA, 19 nt, Homo sapiens
gaagacagcagagucauca

SEQ ID NO: 108920 - RNA, 19 nt, Homo sapiens
aaagggaucugcagguaau

SEQ ID NO: 108921 - RNA, 19 nt, Homo sapiens
ugaaggugcuagaggaauu

SEQ ID NO: 108922 - RNA, 19 nt, Homo sapiens
ggagagaaacuugccauga

SEQ ID NO: 108923 - RNA, 19 nt, Homo sapiens
uaaagcagcaucuagaaga

SEQ ID NO: 108924 - RNA, 19 nt, Homo sapiens
gaucaggauuggccaagau

SEQ ID NO: 108925 - RNA, 19 nt, Homo sapiens
ccaaacaccucccuugaac

SEQ ID NO: 108926 - RNA, 19 nt, Homo sapiens
ggcauaagaucaugauugg

SEQ ID NO: 108927 - RNA, 19 nt, Homo sapiens
gggaaauaauguagacuuc

SEQ ID NO: 108928 - RNA, 19 nt, Homo sapiens
gauaaagcagcaucuagaa

SEQ ID NO: 108929 - RNA, 19 nt, Homo sapiens
gaaggagcaaguuggcaua

SEQ ID NO: 108930 - RNA, 19 nt, Homo sapiens
gacagugacucccuuccaa

SEQ ID NO: 108931 - RNA, 19 nt, Homo sapiens
ggacccagaggaacaauug

SEQ ID NO: 108932 - RNA, 19 nt, Homo sapiens
acacauaguccuaggguaa

SEQ ID NO: 108933 - RNA, 19 nt, Homo sapiens
acagcagagucaucaguua

SEQ ID NO: 108934 - RNA, 19 nt, Homo sapiens
gacaaucacauauagaaga

SEQ ID NO: 108935 - RNA, 19 nt, Homo sapiens
gcaaguuggcauaaagauu

SEQ ID NO: 108936 - RNA, 19 nt, Homo sapiens
cuacauugcagguggcuua

SEQ ID NO: 108937 - RNA, 19 nt, Homo sapiens
aaaggugacuugggagaaa

SEQ ID NO: 108938 - RNA, 19 nt, Homo sapiens
agaagcaggucccaaagga

SEQ ID NO: 108939 - RNA, 19 nt, Homo sapiens
acacaagggugaagaaggu

SEQ ID NO: 108940 - RNA, 19 nt, Homo sapiens
augauuaccuucagcauga

SEQ ID NO: 108941 - RNA, 19 nt, Homo sapiens
acuuggagauauaggauua

SEQ ID NO: 108942 - RNA, 19 nt, Homo sapiens
aguaaguucucuuuccuuu

SEQ ID NO: 108943 - RNA, 19 nt, Homo sapiens
guagagcaccgacagauca

SEQ ID NO: 108944 - RNA, 19 nt, Homo sapiens
gaggaacaauuggcuuuca

SEQ ID NO: 108945 - RNA, 19 nt, Homo sapiens
uaauguagacuucaggauu

SEQ ID NO: 108946 - RNA, 19 nt, Homo sapiens
gaacuuggagauauaggau

SEQ ID NO: 108947 - RNA, 19 nt, Homo sapiens
cagauaauccucaaguuuc

SEQ ID NO: 108948 - RNA, 19 nt, Homo sapiens
gggccacugugccaauaaa

SEQ ID NO: 108949 - RNA, 19 nt, Homo sapiens
gcuauaccuaugugucuua

SEQ ID NO: 108950 - RNA, 19 nt, Homo sapiens
ucagcgagcauuuaacaaa

SEQ ID NO: 108951 - RNA, 19 nt, Homo sapiens
ccaagaggcccaauugaca

SEQ ID NO: 108952 - RNA, 19 nt, Homo sapiens
aaagauuaauggccaaaca

SEQ ID NO: 108953 - RNA, 19 nt, Homo sapiens
caaguugggaaauaaugua

SEQ ID NO: 108954 - RNA, 19 nt, Homo sapiens
cagcagagucaucaguuaa

SEQ ID NO: 108955 - RNA, 19 nt, Homo sapiens
aaacaccucccuugaacaa

SEQ ID NO: 108956 - RNA, 19 nt, Homo sapiens
caaagggaucugcagguaa

SEQ ID NO: 108957 - RNA, 19 nt, Homo sapiens
acaccucccuugaacaaau

SEQ ID NO: 108958 - RNA, 19 nt, Homo sapiens
caaagaugauuaccuucag

SEQ ID NO: 108959 - RNA, 19 nt, Homo sapiens
uaagcagguuugcaugaga

SEQ ID NO: 108960 - RNA, 19 nt, Homo sapiens
gggcuuagauggugaaccu

SEQ ID NO: 108961 - RNA, 19 nt, Homo sapiens
gagcaaguuggcauaaaga

SEQ ID NO: 108962 - RNA, 19 nt, Homo sapiens
ugggaaaacuugcagauaa

SEQ ID NO: 108963 - RNA, 19 nt, Homo sapiens
ccagauucccugucaauuc

SEQ ID NO: 108964 - RNA, 19 nt, Homo sapiens
aauguagacuucaggauuc

SEQ ID NO: 108965 - RNA, 19 nt, Homo sapiens
cuuacaaguugggaaauaa

SEQ ID NO: 108966 - RNA, 19 nt, Homo sapiens
gauuggccaagaugacuua

SEQ ID NO: 108967 - RNA, 19 nt, Homo sapiens
ugaaggagccugggugaga

SEQ ID NO: 108968 - RNA, 19 nt, Homo sapiens
ggucagcgagcauuuaaca

SEQ ID NO: 108969 - RNA, 19 nt, Homo sapiens
uaaaggagaaauuggugaa

SEQ ID NO: 108970 - RNA, 19 nt, Homo sapiens
uaaaggggcuaaaggagaa

SEQ ID NO: 108971 - RNA, 19 nt, Homo sapiens
uaaguucucuuuccuuucc

SEQ ID NO: 108972 - RNA, 19 nt, Homo sapiens
uggaaugccuggaacaaag

SEQ ID NO: 108973 - RNA, 19 nt, Homo sapiens
ccaaaggagacacggguuu

SEQ ID NO: 108974 - RNA, 19 nt, Homo sapiens
ccaggucgcucaggauauc

SEQ ID NO: 108975 - RNA, 19 nt, Homo sapiens
ggaaauaauguagacuuca

SEQ ID NO: 108976 - RNA, 19 nt, Homo sapiens
gaacucuguccaaagauca

SEQ ID NO: 108977 - RNA, 19 nt, Homo sapiens
caauguauuaccuucagua

SEQ ID NO: 108978 - RNA, 19 nt, Homo sapiens
gugagaaacaccauccaaa

SEQ ID NO: 108979 - RNA, 19 nt, Homo sapiens
cagcgagcauuuaacaaag

SEQ ID NO: 108980 - RNA, 19 nt, Homo sapiens
gagagggccugagggaagu

SEQ ID NO: 108981 - RNA, 19 nt, Homo sapiens
cagaggaacaauuggcuuu

SEQ ID NO: 108982 - RNA, 19 nt, Homo sapiens
ccacugugccaauaaacaa

SEQ ID NO: 108983 - RNA, 19 nt, Homo sapiens
gugaugggaucccuggaau

SEQ ID NO: 108984 - RNA, 19 nt, Homo sapiens
ggaacaauuggcuuucaug

SEQ ID NO: 108985 - RNA, 19 nt, Homo sapiens
accuggcgcugauggauua

SEQ ID NO: 108986 - RNA, 19 nt, Homo sapiens
guggacugccugaagaaua

SEQ ID NO: 108987 - RNA, 19 nt, Homo sapiens
ucaguaugauuacagaagu

SEQ ID NO: 108988 - RNA, 19 nt, Homo sapiens
gaaggugaagcaggagaaa

SEQ ID NO: 108989 - RNA, 19 nt, Homo sapiens
gggugccucuggugaagaa

SEQ ID NO: 108990 - RNA, 19 nt, Homo sapiens
cagcagccuuuucgaauuu

SEQ ID NO: 108991 - RNA, 19 nt, Homo sapiens
gaacggugcuauucaguaa

SEQ ID NO: 108992 - RNA, 19 nt, Homo sapiens
gggcaaagaugauuaccuu

SEQ ID NO: 108993 - RNA, 19 nt, Homo sapiens
uguauuaccuucaguauga

SEQ ID NO: 108994 - RNA, 19 nt, Homo sapiens
gaagaggucccaacgguuu

SEQ ID NO: 108995 - RNA, 19 nt, Homo sapiens
cgacagaucagcacauuaa

SEQ ID NO: 108996 - RNA, 19 nt, Homo sapiens
acaauuggcuuucaugaug

SEQ ID NO: 108997 - RNA, 19 nt, Homo sapiens
ccaaagggaucugcaggua

SEQ ID NO: 108998 - RNA, 19 nt, Homo sapiens
gaugggaaauucaggcaaa

SEQ ID NO: 108999 - RNA, 19 nt, Homo sapiens
cccaggaucuugagcuuua

SEQ ID NO: 109000 - RNA, 19 nt, Homo sapiens
gaagaacggugcuauucag

SEQ ID NO: 109001 - RNA, 19 nt, Homo sapiens
gaaggagccugggugagaa

SEQ ID NO: 109002 - RNA, 19 nt, Homo sapiens
gaacaauuggcuuucauga

SEQ ID NO: 109003 - RNA, 19 nt, Homo sapiens
gcaaagaugauuaccuuca

SEQ ID NO: 109004 - RNA, 19 nt, Homo sapiens
gaagacagcagagucauca

SEQ ID NO: 109005 - RNA, 19 nt, Homo sapiens
aaagggaucugcagguaau

SEQ ID NO: 109006 - RNA, 19 nt, Homo sapiens
ugaaggugcuagaggaauu

SEQ ID NO: 109007 - RNA, 19 nt, Homo sapiens
ccaaacaccucccuugaac

SEQ ID NO: 109008 - RNA, 19 nt, Homo sapiens
ggacccagaggaacaauug

SEQ ID NO: 109009 - RNA, 19 nt, Homo sapiens
acagcagagucaucaguua

SEQ ID NO: 109010 - RNA, 19 nt, Homo sapiens
gacaaucacauauagaaga

SEQ ID NO: 109011 - RNA, 19 nt, Homo sapiens
aaaggugacuugggagaaa

SEQ ID NO: 109012 - RNA, 19 nt, Homo sapiens
agaagcaggucccaaagga

SEQ ID NO: 109013 - RNA, 19 nt, Homo sapiens
acacaagggugaagaaggu

SEQ ID NO: 109014 - RNA, 19 nt, Homo sapiens
augauuaccuucagcauga

SEQ ID NO: 109015 - RNA, 19 nt, Homo sapiens
acuuggagauauaggauua

SEQ ID NO: 109016 - RNA, 19 nt, Homo sapiens
aguaaguucucuuuccuuu

SEQ ID NO: 109017 - RNA, 19 nt, Homo sapiens
guagagcaccgacagauca

SEQ ID NO: 109018 - RNA, 19 nt, Homo sapiens
gaggaacaauuggcuuuca

SEQ ID NO: 109019 - RNA, 19 nt, Homo sapiens
gaacuuggagauauaggau

SEQ ID NO: 109020 - RNA, 19 nt, Homo sapiens
gggccacugugccaauaaa

SEQ ID NO: 109021 - RNA, 19 nt, Homo sapiens
gcuauaccuaugugucuua

SEQ ID NO: 109022 - RNA, 19 nt, Homo sapiens
ucagcgagcauuuaacaaa

SEQ ID NO: 109023 - RNA, 19 nt, Homo sapiens
cagcagagucaucaguuaa

SEQ ID NO: 109024 - RNA, 19 nt, Homo sapiens
aaacaccucccuugaacaa

SEQ ID NO: 109025 - RNA, 19 nt, Homo sapiens
caaagggaucugcagguaa

SEQ ID NO: 109026 - RNA, 19 nt, Homo sapiens
gggacgaagugccaccuau

SEQ ID NO: 109027 - RNA, 19 nt, Homo sapiens
acaccucccuugaacaaau

SEQ ID NO: 109028 - RNA, 19 nt, Homo sapiens
caaagaugauuaccuucag

SEQ ID NO: 109029 - RNA, 19 nt, Homo sapiens
uaagcagguuugcaugaga

SEQ ID NO: 109030 - RNA, 19 nt, Homo sapiens
gggcuuagauggugaaccu

SEQ ID NO: 109031 - RNA, 19 nt, Homo sapiens
ugaaggagccugggugaga

SEQ ID NO: 109032 - RNA, 19 nt, Homo sapiens
ggucagcgagcauuuaaca

SEQ ID NO: 109033 - RNA, 19 nt, Homo sapiens
ggacgaagugccaccuaug

SEQ ID NO: 109034 - RNA, 19 nt, Homo sapiens
uaaaggagaaauuggugaa

SEQ ID NO: 109035 - RNA, 19 nt, Homo sapiens
uaaaggggcuaaaggagaa

SEQ ID NO: 109036 - RNA, 19 nt, Homo sapiens
uaaguucucuuuccuuucc

SEQ ID NO: 109037 - RNA, 19 nt, Homo sapiens
cgaagugccaccuaugcua

SEQ ID NO: 109038 - RNA, 19 nt, Homo sapiens
uggaaugccuggaacaaag

SEQ ID NO: 109039 - RNA, 19 nt, Homo sapiens
ccaaaggagacacggguuu

SEQ ID NO: 109040 - RNA, 19 nt, Homo sapiens
ccaggucgcucaggauauc

SEQ ID NO: 109041 - RNA, 19 nt, Homo sapiens
caauguauuaccuucagua

SEQ ID NO: 109042 - RNA, 19 nt, Homo sapiens
gugagaaacaccauccaaa

SEQ ID NO: 109043 - RNA, 19 nt, Homo sapiens
cagcgagcauuuaacaaag

SEQ ID NO: 109044 - RNA, 19 nt, Homo sapiens
gagagggccugagggaagu

SEQ ID NO: 109045 - RNA, 19 nt, Homo sapiens
cagaggaacaauuggcuuu

SEQ ID NO: 109046 - RNA, 19 nt, Homo sapiens
ccacugugccaauaaacaa

SEQ ID NO: 109047 - RNA, 19 nt, Homo sapiens
gcuaguggcgggucuggaa

SEQ ID NO: 109048 - RNA, 19 nt, Homo sapiens
accuggcgcugauggauua

SEQ ID NO: 109049 - RNA, 19 nt, Homo sapiens
gugaugggaucccuggaau

SEQ ID NO: 109050 - RNA, 19 nt, Homo sapiens
ggaacaauuggcuuucaug

SEQ ID NO: 109051 - RNA, 19 nt, Homo sapiens
ucaguaugauuacagaagu

SEQ ID NO: 109052 - RNA, 19 nt, Homo sapiens
gaaggugaagcaggagaaa

SEQ ID NO: 109053 - RNA, 19 nt, Homo sapiens
gggugccucuggugaagaa

SEQ ID NO: 109054 - RNA, 19 nt, Homo sapiens
uagaagaacggugcuauuc

SEQ ID NO: 109055 - RNA, 19 nt, Homo sapiens
gcaggucccaaaggagaua

SEQ ID NO: 109056 - RNA, 19 nt, Homo sapiens
cuccugggcuucccgguuu

SEQ ID NO: 109057 - RNA, 19 nt, Homo sapiens
gagcuuuagugugcuauac

SEQ ID NO: 109058 - RNA, 19 nt, Homo sapiens
gcagagucaucaguuaaaa

SEQ ID NO: 109059 - RNA, 19 nt, Homo sapiens
gagaaacaccauccaaagc

SEQ ID NO: 109060 - RNA, 19 nt, Homo sapiens
ggaacuuggagauauagga

SEQ ID NO: 109061 - RNA, 19 nt, Homo sapiens
ccagggagaacucggagaa

SEQ ID NO: 109062 - RNA, 19 nt, Homo sapiens
gacagcagagucaucaguu

SEQ ID NO: 109063 - RNA, 19 nt, Homo sapiens
ugagaaacaccauccaaag

SEQ ID NO: 109064 - RNA, 19 nt, Homo sapiens
cagaucagcacauuaagca

SEQ ID NO: 109065 - RNA, 19 nt, Homo sapiens
aggauuaccuggcccaaag

SEQ ID NO: 109066 - RNA, 19 nt, Homo sapiens
cagguaaacuggguucucu

SEQ ID NO: 109067 - RNA, 19 nt, Homo sapiens
caccaggucgcucaggaua

SEQ ID NO: 109068 - RNA, 19 nt, Homo sapiens
caccucccuugaacaaauu

SEQ ID NO: 109069 - RNA, 19 nt, Homo sapiens
ggaagacagcagagucauc

SEQ ID NO: 109070 - RNA, 19 nt, Homo sapiens
uggcaguagaggagaauua

SEQ ID NO: 109071 - RNA, 19 nt, Homo sapiens
cggagaaguuggagcucaa

SEQ ID NO: 109072 - RNA, 19 nt, Homo sapiens
ggauuuccaggccguggua

SEQ ID NO: 109073 - RNA, 19 nt, Homo sapiens
caguagaggagaauuagga

SEQ ID NO: 109074 - RNA, 19 nt, Homo sapiens
cuacuugacaaucacauau

SEQ ID NO: 109075 - RNA, 19 nt, Homo sapiens
agggaagccuggucagaug

SEQ ID NO: 109076 - RNA, 19 nt, Homo sapiens
aaaaggugcucggggcuua

SEQ ID NO: 109077 - RNA, 19 nt, Homo sapiens
agaacggugcuauucagua

SEQ ID NO: 109078 - RNA, 19 nt, Homo sapiens
uggaauuccuggugcaaag

SEQ ID NO: 109079 - RNA, 19 nt, Homo sapiens
ggagaagcaggucccaaag

SEQ ID NO: 109080 - RNA, 19 nt, Homo sapiens
ggcaucaccggcauaguug

SEQ ID NO: 109081 - RNA, 19 nt, Homo sapiens
aggcaucaccggcauaguu

SEQ ID NO: 109082 - RNA, 19 nt, Homo sapiens
uuagugugcuauaccuaug

SEQ ID NO: 109083 - RNA, 19 nt, Homo sapiens
agaagaacggugcuauuca

SEQ ID NO: 109084 - RNA, 19 nt, Homo sapiens
caaagggugaaccaggaaa

SEQ ID NO: 109085 - RNA, 19 nt, Homo sapiens
auaccuaugugucuuaucg

SEQ ID NO: 109086 - RNA, 19 nt, Homo sapiens
gaaccuggugugccuggau

SEQ ID NO: 109087 - RNA, 19 nt, Homo sapiens
gaaggugcuagaggaauuc

SEQ ID NO: 109088 - RNA, 19 nt, Homo sapiens
gagaagcaggucccaaagg

SEQ ID NO: 109089 - RNA, 19 nt, Homo sapiens
gccuggaucgcguggauuu

SEQ ID NO: 109090 - RNA, 19 nt, Homo sapiens
uaaaggugacuugggagaa

SEQ ID NO: 109091 - RNA, 19 nt, Homo sapiens
ucgaagcgcugaaggaaua

SEQ ID NO: 109092 - RNA, 19 nt, Homo sapiens
gagcaucauucggcuguua

SEQ ID NO: 109093 - RNA, 19 nt, Homo sapiens
gaagggugauccaggagaa

SEQ ID NO: 109094 - RNA, 19 nt, Homo sapiens
caucaucucccuucucuuu

SEQ ID NO: 109095 - RNA, 19 nt, Homo sapiens
ccucccagcucaguauuua

SEQ ID NO: 109096 - RNA, 19 nt, Homo sapiens
ugaggcggcuauacccuua

SEQ ID NO: 109097 - RNA, 19 nt, Homo sapiens
aauaaaagcucccaaguug

SEQ ID NO: 109098 - RNA, 19 nt, Homo sapiens
gcaaggaguacguggagaa

SEQ ID NO: 109099 - RNA, 19 nt, Homo sapiens
ggaaggcagugcggauuuc

SEQ ID NO: 109100 - RNA, 19 nt, Homo sapiens
gcucaguauuuaaacauca

SEQ ID NO: 109101 - RNA, 19 nt, Homo sapiens
caagggacagcaaggagua

SEQ ID NO: 109102 - RNA, 19 nt, Homo sapiens
ucauucggcuguuaccaaa

SEQ ID NO: 109103 - RNA, 19 nt, Homo sapiens
ccaggccuuucuguaaaua

SEQ ID NO: 109104 - RNA, 19 nt, Homo sapiens
gaucacaggcccgaaagga

SEQ ID NO: 109105 - RNA, 19 nt, Homo sapiens
cacccaggccuuucuguaa

SEQ ID NO: 109106 - RNA, 19 nt, Homo sapiens
ggcaaguggugucgaugga

SEQ ID NO: 109107 - RNA, 19 nt, Homo sapiens
cggcaaggauggagaucga

SEQ ID NO: 109108 - RNA, 19 nt, Homo sapiens
aaagugaggccaacacaca

SEQ ID NO: 109109 - RNA, 19 nt, Homo sapiens
acccaggccuuucuguaaa

SEQ ID NO: 109110 - RNA, 19 nt, Homo sapiens
ccacccaggccuuucugua

SEQ ID NO: 109111 - RNA, 19 nt, Homo sapiens
gcuugaggaccaauacuga

SEQ ID NO: 109112 - RNA, 19 nt, Homo sapiens
ccagcucaguauuuaaaca

SEQ ID NO: 109113 - RNA, 19 nt, Homo sapiens
uggccucccuggugagauu

SEQ ID NO: 109114 - RNA, 19 nt, Homo sapiens
caagggcgagccuggcaaa

SEQ ID NO: 109115 - RNA, 19 nt, Homo sapiens
aggccuuucuguaaauaaa

SEQ ID NO: 109116 - RNA, 19 nt, Homo sapiens
caacuguccacccggaaug

SEQ ID NO: 109117 - RNA, 19 nt, Homo sapiens
ggaaaaggaauucuaaaac

SEQ ID NO: 109118 - RNA, 19 nt, Homo sapiens
gggaaaacguggagagaag

SEQ ID NO: 109119 - RNA, 19 nt, Homo sapiens
ccuuggagcuucggccuau

SEQ ID NO: 109120 - RNA, 19 nt, Homo sapiens
cgcugaagaugcugcaaga

SEQ ID NO: 109121 - RNA, 19 nt, Homo sapiens
gggcccucauggauauaaa

SEQ ID NO: 109122 - RNA, 19 nt, Homo sapiens
uuacagagccuggauccau

SEQ ID NO: 109123 - RNA, 19 nt, Homo sapiens
cggcaucgacggugacaau

SEQ ID NO: 109124 - RNA, 19 nt, Homo sapiens
ggauguggcgcugaagaug

SEQ ID NO: 109125 - RNA, 19 nt, Homo sapiens
aacaucaucucccuucucu

SEQ ID NO: 109126 - RNA, 19 nt, Homo sapiens
cgggauugaugguuuaacu

SEQ ID NO: 109127 - RNA, 19 nt, Homo sapiens
ucccagcucaguauuuaaa

SEQ ID NO: 109128 - RNA, 19 nt, Homo sapiens
gcggauuuccuguguccaa

SEQ ID NO: 109129 - RNA, 19 nt, Homo sapiens
caacggcaaggauggagau

SEQ ID NO: 109130 - RNA, 19 nt, Homo sapiens
gggccuuccuggauucucu

SEQ ID NO: 109131 - RNA, 19 nt, Homo sapiens
ucaucucccuucucuuucu

SEQ ID NO: 109132 - RNA, 19 nt, Homo sapiens
uaaacaucaucucccuucu

SEQ ID NO: 109133 - RNA, 19 nt, Homo sapiens
cagggcaaguggugucgau

SEQ ID NO: 109134 - RNA, 19 nt, Homo sapiens
uggaaggcagugcggauuu

SEQ ID NO: 109135 - RNA, 19 nt, Homo sapiens
cccaggccuuucuguaaau

SEQ ID NO: 109136 - RNA, 19 nt, Homo sapiens
cagugcggauuuccugugu

SEQ ID NO: 109137 - RNA, 19 nt, Homo sapiens
cgaacaaauugcacaguua

SEQ ID NO: 109138 - RNA, 19 nt, Homo sapiens
gguaggguguguauauaua

SEQ ID NO: 109139 - RNA, 19 nt, Homo sapiens
gaagguaggguguguauau

SEQ ID NO: 109140 - RNA, 19 nt, Homo sapiens
gaccuucagugcccaagua

SEQ ID NO: 109141 - RNA, 19 nt, Homo sapiens
gcgaacaaauugcacaguu

SEQ ID NO: 109142 - RNA, 19 nt, Homo sapiens
gaugaucagcgaacaaauu

SEQ ID NO: 109143 - RNA, 19 nt, Homo sapiens
gaacaaauugcacaguuag

SEQ ID NO: 109144 - RNA, 19 nt, Homo sapiens
ggacggcauugacggagaa

SEQ ID NO: 109145 - RNA, 19 nt, Homo sapiens
gcauuuguguaaagacuau

SEQ ID NO: 109146 - RNA, 19 nt, Homo sapiens
ucucgaagcucauaaaauu

SEQ ID NO: 109147 - RNA, 19 nt, Homo sapiens
gagagaagguagggugugu

SEQ ID NO: 109148 - RNA, 19 nt, Homo sapiens
aaaaggcccuagcuaauaa

SEQ ID NO: 109149 - RNA, 19 nt, Homo sapiens
ccaaggagccguguuagga

SEQ ID NO: 109150 - RNA, 19 nt, Homo sapiens
caaaaggcccuagcuaaua

SEQ ID NO: 109151 - RNA, 19 nt, Homo sapiens
gagaagguaggguguguau

SEQ ID NO: 109152 - RNA, 19 nt, Homo sapiens
gggacccacuggcuacaaa

SEQ ID NO: 109153 - RNA, 19 nt, Homo sapiens
guaggguguguauauauaa

SEQ ID NO: 109154 - RNA, 19 nt, Homo sapiens
aagguaggguguguauaua

SEQ ID NO: 109155 - RNA, 19 nt, Homo sapiens
gcaaggacggccagaaugg

SEQ ID NO: 109156 - RNA, 19 nt, Homo sapiens
auuaaugacuggcuacaga

SEQ ID NO: 109157 - RNA, 19 nt, Homo sapiens
cauagcauuuguguaaaga

SEQ ID NO: 109158 - RNA, 19 nt, Homo sapiens
gggaugaucagcgaacaaa

SEQ ID NO: 109159 - RNA, 19 nt, Homo sapiens
gaucagcgaacaaauugca

SEQ ID NO: 109160 - RNA, 19 nt, Homo sapiens
gggcaaggacggccagaau

SEQ ID NO: 109161 - RNA, 19 nt, Homo sapiens
ccugacagcauaccucaaa

SEQ ID NO: 109162 - RNA, 19 nt, Homo sapiens
gcacaguggacggucauga

SEQ ID NO: 109163 - RNA, 19 nt, Homo sapiens
gaucucaucccaauaaaau

SEQ ID NO: 109164 - RNA, 19 nt, Homo sapiens
uguaaagacuaugaucuca

SEQ ID NO: 109165 - RNA, 19 nt, Homo sapiens
uaagggagaccaggguauu

SEQ ID NO: 109166 - RNA, 19 nt, Homo sapiens
augacuggcuacagaguaa

SEQ ID NO: 109167 - RNA, 19 nt, Homo sapiens
ccuguaagcccagcauuug

SEQ ID NO: 109168 - RNA, 19 nt, Homo sapiens
acauagcauuuguguaaag

SEQ ID NO: 109169 - RNA, 19 nt, Homo sapiens
gcccagcauuugagagaag

SEQ ID NO: 109170 - RNA, 19 nt, Homo sapiens
caccucagccugccaagga

SEQ ID NO: 109171 - RNA, 19 nt, Homo sapiens
ggcccuagcuaauaaaccu

SEQ ID NO: 109172 - RNA, 19 nt, Homo sapiens
gacaaggacgcccgaagca

SEQ ID NO: 109173 - RNA, 19 nt, Homo sapiens
cugccaaggagccguguua

SEQ ID NO: 109174 - RNA, 19 nt, Homo sapiens
ggcaaggacggccagaaug

SEQ ID NO: 109175 - RNA, 19 nt, Homo sapiens
uagcauuuguguaaagacu

SEQ ID NO: 109176 - RNA, 19 nt, Homo sapiens
guaagcccagcauuugaga

SEQ ID NO: 109177 - RNA, 19 nt, Homo sapiens
aguggacggucaugaagga

SEQ ID NO: 109178 - RNA, 19 nt, Homo sapiens
aaaucaggcucucgaagcu

SEQ ID NO: 109179 - RNA, 19 nt, Homo sapiens
cacaguggacggucaugaa

SEQ ID NO: 109180 - RNA, 19 nt, Homo sapiens
ugaggaagcaagugacaag

SEQ ID NO: 109181 - RNA, 19 nt, Homo sapiens
ggucugacuggacgagaug

SEQ ID NO: 109182 - RNA, 19 nt, Homo sapiens
caaaggcgagaagggagaa

SEQ ID NO: 109183 - RNA, 19 nt, Homo sapiens
ucaaaaggcccuagcuaau

SEQ ID NO: 109184 - RNA, 19 nt, Homo sapiens
ccacagagcuaaucuaaau

SEQ ID NO: 109185 - RNA, 19 nt, Homo sapiens
ggacuggaaucuuuacuug

SEQ ID NO: 109186 - RNA, 19 nt, Homo sapiens
gaaagggacucauguuugg

SEQ ID NO: 109187 - RNA, 19 nt, Homo sapiens
gcaaggugcuuucaucaau

SEQ ID NO: 109188 - RNA, 19 nt, Homo sapiens
ggagguaucauauaacuuu

SEQ ID NO: 109189 - RNA, 19 nt, Homo sapiens
gaguaaagguauagcagua

SEQ ID NO: 109190 - RNA, 19 nt, Homo sapiens
ugaagccucucuugaauuu

SEQ ID NO: 109191 - RNA, 19 nt, Homo sapiens
gacuagaaguggagauaua

SEQ ID NO: 109192 - RNA, 19 nt, Homo sapiens
gagcuaaucuaaaucuugu

SEQ ID NO: 109193 - RNA, 19 nt, Homo sapiens
aagaaguccugcuauguua

SEQ ID NO: 109194 - RNA, 19 nt, Homo sapiens
gagaauaugcugccacaaa

SEQ ID NO: 109195 - RNA, 19 nt, Homo sapiens
gaacucccauaccauuuga

SEQ ID NO: 109196 - RNA, 19 nt, Homo sapiens
ccaaagaaguccugcuaug

SEQ ID NO: 109197 - RNA, 19 nt, Homo sapiens
caucaucgaucucacagaa

SEQ ID NO: 109198 - RNA, 19 nt, Homo sapiens
ggagaaaugggaccaauug

SEQ ID NO: 109199 - RNA, 19 nt, Homo sapiens
ccuaguggcuccaauguga

SEQ ID NO: 109200 - RNA, 19 nt, Homo sapiens
gaauaugcugccacaaaua

SEQ ID NO: 109201 - RNA, 19 nt, Homo sapiens
ggguaggccuguauaagaa

SEQ ID NO: 109202 - RNA, 19 nt, Homo sapiens
guacaccuaugaugaauac

SEQ ID NO: 109203 - RNA, 19 nt, Homo sapiens
cccaaggacuggaaucuuu

SEQ ID NO: 109204 - RNA, 19 nt, Homo sapiens
ggagagagaggaccauaug

SEQ ID NO: 109205 - RNA, 19 nt, Homo sapiens
gaaugccugugucugcuuu

SEQ ID NO: 109206 - RNA, 19 nt, Homo sapiens
uccaggagguaucauauaa

SEQ ID NO: 109207 - RNA, 19 nt, Homo sapiens
aaagugagcagcaacguaa

SEQ ID NO: 109208 - RNA, 19 nt, Homo sapiens
gaaguccugcuauguuaaa

SEQ ID NO: 109209 - RNA, 19 nt, Homo sapiens
agaauaugcugccacaaau

SEQ ID NO: 109210 - RNA, 19 nt, Homo sapiens
gaauccaucugagaauaug

SEQ ID NO: 109211 - RNA, 19 nt, Homo sapiens
guuauucucuccaaagcuu

SEQ ID NO: 109212 - RNA, 19 nt, Homo sapiens
gguaucugaccuauucuua

SEQ ID NO: 109213 - RNA, 19 nt, Homo sapiens
gcagaggaagcuucagaaa

SEQ ID NO: 109214 - RNA, 19 nt, Homo sapiens
gcuaguauccuugaacuug

SEQ ID NO: 109215 - RNA, 19 nt, Homo sapiens
caaggugcuuucaucaaug

SEQ ID NO: 109216 - RNA, 19 nt, Homo sapiens
ugaaagggacucauguuug

SEQ ID NO: 109217 - RNA, 19 nt, Homo sapiens
ccaaggacuggaaucuuua

SEQ ID NO: 109218 - RNA, 19 nt, Homo sapiens
ggaacucccauaccauuug

SEQ ID NO: 109219 - RNA, 19 nt, Homo sapiens
caacuaagggccucaaugg

SEQ ID NO: 109220 - RNA, 19 nt, Homo sapiens
cagcuggcauagcaacuaa

SEQ ID NO: 109221 - RNA, 19 nt, Homo sapiens
ggaaugcccggacacaaug

SEQ ID NO: 109222 - RNA, 19 nt, Homo sapiens
cagcugggccugcaggaua

SEQ ID NO: 109223 - RNA, 19 nt, Homo sapiens
aaagaaguccugcuauguu

SEQ ID NO: 109224 - RNA, 19 nt, Homo sapiens
ggagugccaucaucgaucu

SEQ ID NO: 109225 - RNA, 19 nt, Homo sapiens
cagcauaacuuggaaacag

SEQ ID NO: 109226 - RNA, 19 nt, Homo sapiens
caaagaaguccugcuaugu

SEQ ID NO: 109227 - RNA, 19 nt, Homo sapiens
uaauguacaccuaugauga

SEQ ID NO: 109228 - RNA, 19 nt, Homo sapiens
gugaaagggacucauguuu

SEQ ID NO: 109229 - RNA, 19 nt, Homo sapiens
guaaagguauagcaguaag

SEQ ID NO: 109230 - RNA, 19 nt, Homo sapiens
uaauuuacacugaggguuu

SEQ ID NO: 109231 - RNA, 19 nt, Homo sapiens
gguacuagaggcccuauug

SEQ ID NO: 109232 - RNA, 19 nt, Homo sapiens
ucaaauauacaggugcaua

SEQ ID NO: 109233 - RNA, 19 nt, Homo sapiens
ggaaacauccaggagguau

SEQ ID NO: 109234 - RNA, 19 nt, Homo sapiens
gcucuaaguuaugugaaau

SEQ ID NO: 109235 - RNA, 19 nt, Homo sapiens
gcaaucuuaaggcucuuua

SEQ ID NO: 109236 - RNA, 19 nt, Homo sapiens
cgagucaaauggccuauac

SEQ ID NO: 109237 - RNA, 19 nt, Homo sapiens
ucagauaccaggaauauac

SEQ ID NO: 109238 - RNA, 19 nt, Homo sapiens
ccauaaagaguaaagguau

SEQ ID NO: 109239 - RNA, 19 nt, Homo sapiens
uuuaugcacuguacuguau

SEQ ID NO: 109240 - RNA, 19 nt, Homo sapiens
caaagcuuacccagcaaua

SEQ ID NO: 109241 - RNA, 19 nt, Homo sapiens
uggagaggcuggcccaaga

SEQ ID NO: 109242 - RNA, 19 nt, Homo sapiens
gggaaugcccggacacaau

SEQ ID NO: 109243 - RNA, 19 nt, Homo sapiens
guaagaggagagcaaggua

SEQ ID NO: 109244 - RNA, 19 nt, Homo sapiens
gagguaggcugaaaagaau

SEQ ID NO: 109245 - RNA, 19 nt, Homo sapiens
aauaggaacucccauacca

SEQ ID NO: 109246 - RNA, 19 nt, Homo sapiens
gcaauaggaacucccauac

SEQ ID NO: 109247 - RNA, 19 nt, Homo sapiens
gcugaacgauaccaaaugc

SEQ ID NO: 109248 - RNA, 19 nt, Homo sapiens
agcugugccucacuuauua

SEQ ID NO: 109249 - RNA, 19 nt, Homo sapiens
ugugaagccucucuugaau

SEQ ID NO: 109250 - RNA, 19 nt, Homo sapiens
auacagauuugagcuauca

SEQ ID NO: 109251 - RNA, 19 nt, Homo sapiens
gcaacuaagggccucaaug

SEQ ID NO: 109252 - RNA, 19 nt, Homo sapiens
caccaggcauuccaggauu

SEQ ID NO: 109253 - RNA, 19 nt, Homo sapiens
gagguaucauauaacuuug

SEQ ID NO: 109254 - RNA, 19 nt, Homo sapiens
ggagguaggcugaaaagaa

SEQ ID NO: 109255 - RNA, 19 nt, Homo sapiens
uaugcacuguacuguauuu

SEQ ID NO: 109256 - RNA, 19 nt, Homo sapiens
caggagguaucauauaacu

SEQ ID NO: 109257 - RNA, 19 nt, Homo sapiens
caccaaagaaguccugcua

SEQ ID NO: 109258 - RNA, 19 nt, Homo sapiens
acaggugcauauauacuug

SEQ ID NO: 109259 - RNA, 19 nt, Homo sapiens
aaagcauucucuaacucua

SEQ ID NO: 109260 - RNA, 19 nt, Homo sapiens
aaaccaggguacccaggaa

SEQ ID NO: 109261 - RNA, 19 nt, Homo sapiens
ccuacaccauaaagaguaa

SEQ ID NO: 109262 - RNA, 19 nt, Homo sapiens
gggcagaggaagcuucaga

SEQ ID NO: 109263 - RNA, 19 nt, Homo sapiens
guaauguacaccuaugaug

SEQ ID NO: 109264 - RNA, 19 nt, Homo sapiens
ucccauaccauuugauaaa

SEQ ID NO: 109265 - RNA, 19 nt, Homo sapiens
gaacucccagcacgcagaa

SEQ ID NO: 109266 - RNA, 19 nt, Homo sapiens
gaauuucuaguuagcaauc

SEQ ID NO: 109267 - RNA, 19 nt, Homo sapiens
ggacagccaggcaucaaag

SEQ ID NO: 109268 - RNA, 19 nt, Homo sapiens
accaucagcuguagggaaa

SEQ ID NO: 109269 - RNA, 19 nt, Homo sapiens
ucucaaccauucuuucaag

SEQ ID NO: 109270 - RNA, 19 nt, Homo sapiens
caaaaugcauauggaggua

SEQ ID NO: 109271 - RNA, 19 nt, Homo sapiens
guaggccuguauaagaaug

SEQ ID NO: 109272 - RNA, 19 nt, Homo sapiens
acaggcaacagcauuauga

SEQ ID NO: 109273 - RNA, 19 nt, Homo sapiens
ugccaggacucccaggaaa

SEQ ID NO: 109274 - RNA, 19 nt, Homo sapiens
gauaccaggaauauacuau

SEQ ID NO: 109275 - RNA, 19 nt, Homo sapiens
auaacaggcaacagcauua

SEQ ID NO: 109276 - RNA, 19 nt, Homo sapiens
uaggaacucccauaccauu

SEQ ID NO: 109277 - RNA, 19 nt, Homo sapiens
ugguaugaauggacagaaa

SEQ ID NO: 109278 - RNA, 19 nt, Homo sapiens
cuaaaucuugugcuagaaa

SEQ ID NO: 109279 - RNA, 19 nt, Homo sapiens
uauaacaggcaacagcauu

SEQ ID NO: 109280 - RNA, 19 nt, Homo sapiens
gggagaaaugggaccaauu

SEQ ID NO: 109281 - RNA, 19 nt, Homo sapiens
caaaggugauagagguuuu

SEQ ID NO: 109282 - RNA, 19 nt, Homo sapiens
cuaugaauaugagaacuuc

SEQ ID NO: 109283 - RNA, 19 nt, Homo sapiens
ggccagaaggcauuggaaa

SEQ ID NO: 109284 - RNA, 19 nt, Homo sapiens
gaauaaggaugguauagaa

SEQ ID NO: 109285 - RNA, 19 nt, Homo sapiens
ggagauuccuucaaaguuu

SEQ ID NO: 109286 - RNA, 19 nt, Homo sapiens
gggagaagauggagaaauu

SEQ ID NO: 109287 - RNA, 19 nt, Homo sapiens
uaaagaggcugaaagugua

SEQ ID NO: 109288 - RNA, 19 nt, Homo sapiens
aaacagggcugauucuuga

SEQ ID NO: 109289 - RNA, 19 nt, Homo sapiens
gaacaaggauuuuggauga

SEQ ID NO: 109290 - RNA, 19 nt, Homo sapiens
gaacgugggucagcaggua

SEQ ID NO: 109291 - RNA, 19 nt, Homo sapiens
gcaaauugguguugagguu

SEQ ID NO: 109292 - RNA, 19 nt, Homo sapiens
gaacucugauggcaauaaa

SEQ ID NO: 109293 - RNA, 19 nt, Homo sapiens
gagauuccuucaaaguuua

SEQ ID NO: 109294 - RNA, 19 nt, Homo sapiens
gaacgcaaaccaucaaauu

SEQ ID NO: 109295 - RNA, 19 nt, Homo sapiens
aaacaacgcugcauauaca

SEQ ID NO: 109296 - RNA, 19 nt, Homo sapiens
aaagggacauccugguuua

SEQ ID NO: 109297 - RNA, 19 nt, Homo sapiens
gaaguugguuuagugaauu

SEQ ID NO: 109298 - RNA, 19 nt, Homo sapiens
cagaggauauaaucgaaua

SEQ ID NO: 109299 - RNA, 19 nt, Homo sapiens
ucugguagauggagauuua

SEQ ID NO: 109300 - RNA, 19 nt, Homo sapiens
ggaaguugguuuagugaau

SEQ ID NO: 109301 - RNA, 19 nt, Homo sapiens
gcaagcagaugcagaugau

SEQ ID NO: 109302 - RNA, 19 nt, Homo sapiens
aaagggagaucgaggguuu

SEQ ID NO: 109303 - RNA, 19 nt, Homo sapiens
gaggauacacuauaugaaa

SEQ ID NO: 109304 - RNA, 19 nt, Homo sapiens
ucaauucccugaaacaaga

SEQ ID NO: 109305 - RNA, 19 nt, Homo sapiens
uaugggaccuccuggcuua

SEQ ID NO: 109306 - RNA, 19 nt, Homo sapiens
gaaacagggcugauucuug

SEQ ID NO: 109307 - RNA, 19 nt, Homo sapiens
uggcuaagauuaagacaaa

SEQ ID NO: 109308 - RNA, 19 nt, Homo sapiens
guugggagaucaccuguuu

SEQ ID NO: 109309 - RNA, 19 nt, Homo sapiens
gaauacaacuauggaacaa

SEQ ID NO: 109310 - RNA, 19 nt, Homo sapiens
gcaaacaucccuggcgaua

SEQ ID NO: 109311 - RNA, 19 nt, Homo sapiens
gaaguucggauuugaaguu

SEQ ID NO: 109312 - RNA, 19 nt, Homo sapiens
ggaagcaggugcagaaggu

SEQ ID NO: 109313 - RNA, 19 nt, Homo sapiens
caagggaucuaaaggugaa

SEQ ID NO: 109314 - RNA, 19 nt, Homo sapiens
gcacaaacagaaagaauuc

SEQ ID NO: 109315 - RNA, 19 nt, Homo sapiens
gcauauacagguaccauuu

SEQ ID NO: 109316 - RNA, 19 nt, Homo sapiens
gaucaaguaccuauuguug

SEQ ID NO: 109317 - RNA, 19 nt, Homo sapiens
gaaauagacggcagggauu

SEQ ID NO: 109318 - RNA, 19 nt, Homo sapiens
gaauuucuuuggugcugua

SEQ ID NO: 109319 - RNA, 19 nt, Homo sapiens
gaacauaucaaaucaacag

SEQ ID NO: 109320 - RNA, 19 nt, Homo sapiens
cauaugaaauuuccaaugg

SEQ ID NO: 109321 - RNA, 19 nt, Homo sapiens
gggaguagcuggcaaacca

SEQ ID NO: 109322 - RNA, 19 nt, Homo sapiens
gaagaaaacugugacaaug

SEQ ID NO: 109323 - RNA, 19 nt, Homo sapiens
auacuuagauguugaagga

SEQ ID NO: 109324 - RNA, 19 nt, Homo sapiens
gaguaagaauuucaucaug

SEQ ID NO: 109325 - RNA, 19 nt, Homo sapiens
ugacaagggugaagaugga

SEQ ID NO: 109326 - RNA, 19 nt, Homo sapiens
ggacauccugguuuaauug

SEQ ID NO: 109327 - RNA, 19 nt, Homo sapiens
uggcuuaccuggucucaaa

SEQ ID NO: 109328 - RNA, 19 nt, Homo sapiens
caaauccaguugaagaaau

SEQ ID NO: 109329 - RNA, 19 nt, Homo sapiens
uuacagaguuucaaagcaa

SEQ ID NO: 109330 - RNA, 19 nt, Homo sapiens
ccaggaaguugguuuagug

SEQ ID NO: 109331 - RNA, 19 nt, Homo sapiens
acgcaaaccaucaaauuua

SEQ ID NO: 109332 - RNA, 19 nt, Homo sapiens
gaauaugacuaugaguaug

SEQ ID NO: 109333 - RNA, 19 nt, Homo sapiens
cgaaaccacuugauagaag

SEQ ID NO: 109334 - RNA, 19 nt, Homo sapiens
gaagaacgcaaaccaucaa

SEQ ID NO: 109335 - RNA, 19 nt, Homo sapiens
gggacauccugguuuaauu

SEQ ID NO: 109336 - RNA, 19 nt, Homo sapiens
gggagcagauggugucaga

SEQ ID NO: 109337 - RNA, 19 nt, Homo sapiens
gagcaauuguugauaccaa

SEQ ID NO: 109338 - RNA, 19 nt, Homo sapiens
caagguugcucaggagauu

SEQ ID NO: 109339 - RNA, 19 nt, Homo sapiens
gauggugaauauuggauug

SEQ ID NO: 109340 - RNA, 19 nt, Homo sapiens
ggauggaauggaagaaaua

SEQ ID NO: 109341 - RNA, 19 nt, Homo sapiens
gaggagaaguuggucaaau

SEQ ID NO: 109342 - RNA, 19 nt, Homo sapiens
gaaaggacagaaaggagaa

SEQ ID NO: 109343 - RNA, 19 nt, Homo sapiens
caagacaucgagcauauga

SEQ ID NO: 109344 - RNA, 19 nt, Homo sapiens
cuucagaacuguuaacauc

SEQ ID NO: 109345 - RNA, 19 nt, Homo sapiens
ggauucugaucuucuggua

SEQ ID NO: 109346 - RNA, 19 nt, Homo sapiens
caagguaucucagggaaag

SEQ ID NO: 109347 - RNA, 19 nt, Homo sapiens
aggagaaguuggucaaauu

SEQ ID NO: 109348 - RNA, 19 nt, Homo sapiens
gaagcuggcccacgagguu

SEQ ID NO: 109349 - RNA, 19 nt, Homo sapiens
gaagugagagagcaauugu

SEQ ID NO: 109350 - RNA, 19 nt, Homo sapiens
uaacaacccucgcauugac

SEQ ID NO: 109351 - RNA, 19 nt, Homo sapiens
cauauacagguaccauuua

SEQ ID NO: 109352 - RNA, 19 nt, Homo sapiens
ggagaaguuggucaaauug

SEQ ID NO: 109353 - RNA, 19 nt, Homo sapiens
gcagauggaggaagaggaa

SEQ ID NO: 109354 - RNA, 19 nt, Homo sapiens
gauacugcuuacagaguuu

SEQ ID NO: 109355 - RNA, 19 nt, Homo sapiens
gaaauaccgaugccuuugu

SEQ ID NO: 109356 - RNA, 19 nt, Homo sapiens
caucgagcauaugaaauuu

SEQ ID NO: 109357 - RNA, 19 nt, Homo sapiens
aacaagacaucgagcauau

SEQ ID NO: 109358 - RNA, 19 nt, Homo sapiens
cacaagguccuauuggaua

SEQ ID NO: 109359 - RNA, 19 nt, Homo sapiens
ggagaucgaggguuugaug

SEQ ID NO: 109360 - RNA, 19 nt, Homo sapiens
ggaaauaccgaugccuuug

SEQ ID NO: 109361 - RNA, 19 nt, Homo sapiens
gaaaacaacgcugcauaua

SEQ ID NO: 109362 - RNA, 19 nt, Homo sapiens
ggugagacuugcauuuauc

SEQ ID NO: 109363 - RNA, 19 nt, Homo sapiens
ggaauggaagaaauauuug

SEQ ID NO: 109364 - RNA, 19 nt, Homo sapiens
gcagaugcagaugauaaua

SEQ ID NO: 109365 - RNA, 19 nt, Homo sapiens
ggucugcagucgcaauuuc

SEQ ID NO: 109366 - RNA, 19 nt, Homo sapiens
auacaacuauggaacaaug

SEQ ID NO: 109367 - RNA, 19 nt, Homo sapiens
ugacuuuggugaucagaau

SEQ ID NO: 109368 - RNA, 19 nt, Homo sapiens
gcaaucagcguggagaaga

SEQ ID NO: 109369 - RNA, 19 nt, Homo sapiens
guucuauacuguuaucugu

SEQ ID NO: 109370 - RNA, 19 nt, Homo sapiens
gaaaagacugucauugaaa

SEQ ID NO: 109371 - RNA, 19 nt, Homo sapiens
ugaaaagacugucauugaa

SEQ ID NO: 109372 - RNA, 19 nt, Homo sapiens
gcagaagguccuccuggaa

SEQ ID NO: 109373 - RNA, 19 nt, Homo sapiens
gggugcaccuggacugaaa

SEQ ID NO: 109374 - RNA, 19 nt, Homo sapiens
agaauuugguccaggugua

SEQ ID NO: 109375 - RNA, 19 nt, Homo sapiens
auggaacaauggaaaguua

SEQ ID NO: 109376 - RNA, 19 nt, Homo sapiens
ucaggaaccucagauagau

SEQ ID NO: 109377 - RNA, 19 nt, Homo sapiens
cagcauaugacuacuguga

SEQ ID NO: 109378 - RNA, 19 nt, Homo sapiens
gcacuagauuuucacaauu

SEQ ID NO: 109379 - RNA, 19 nt, Homo sapiens
caucauggccaaaggagaa

SEQ ID NO: 109380 - RNA, 19 nt, Homo sapiens
guggugagacuugcauuua

SEQ ID NO: 109381 - RNA, 19 nt, Homo sapiens
agacaucgagcauaugaaa

SEQ ID NO: 109382 - RNA, 19 nt, Homo sapiens
agacaagggugaaauuggu

SEQ ID NO: 109383 - RNA, 19 nt, Homo sapiens
gauguuaccguuccguuau

SEQ ID NO: 109384 - RNA, 19 nt, Homo sapiens
gaauaaggaugguauagaa

SEQ ID NO: 109385 - RNA, 19 nt, Homo sapiens
ggagauuccuucaaaguuu

SEQ ID NO: 109386 - RNA, 19 nt, Homo sapiens
gggagaagauggagaaauu

SEQ ID NO: 109387 - RNA, 19 nt, Homo sapiens
aaacagggcugauucuuga

SEQ ID NO: 109388 - RNA, 19 nt, Homo sapiens
gaacaaggauuuuggauga

SEQ ID NO: 109389 - RNA, 19 nt, Homo sapiens
gaacgugggucagcaggua

SEQ ID NO: 109390 - RNA, 19 nt, Homo sapiens
gcaaauugguguugagguu

SEQ ID NO: 109391 - RNA, 19 nt, Homo sapiens
gaacucugauggcaauaaa

SEQ ID NO: 109392 - RNA, 19 nt, Homo sapiens
gagauuccuucaaaguuua

SEQ ID NO: 109393 - RNA, 19 nt, Homo sapiens
gaacgcaaaccaucaaauu

SEQ ID NO: 109394 - RNA, 19 nt, Homo sapiens
aaacaacgcugcauauaca

SEQ ID NO: 109395 - RNA, 19 nt, Homo sapiens
aaagggacauccugguuua

SEQ ID NO: 109396 - RNA, 19 nt, Homo sapiens
gaaguugguuuagugaauu

SEQ ID NO: 109397 - RNA, 19 nt, Homo sapiens
ucugguagauggagauuua

SEQ ID NO: 109398 - RNA, 19 nt, Homo sapiens
ggaaguugguuuagugaau

SEQ ID NO: 109399 - RNA, 19 nt, Homo sapiens
gcaagcagaugcagaugau

SEQ ID NO: 109400 - RNA, 19 nt, Homo sapiens
aaagggagaucgaggguuu

SEQ ID NO: 109401 - RNA, 19 nt, Homo sapiens
gacaguggcuacuaaauca

SEQ ID NO: 109402 - RNA, 19 nt, Homo sapiens
gaggauacacuauaugaaa

SEQ ID NO: 109403 - RNA, 19 nt, Homo sapiens
ucaauucccugaaacaaga

SEQ ID NO: 109404 - RNA, 19 nt, Homo sapiens
uaugggaccuccuggcuua

SEQ ID NO: 109405 - RNA, 19 nt, Homo sapiens
gaaacagggcugauucuug

SEQ ID NO: 109406 - RNA, 19 nt, Homo sapiens
uggcuaagauuaagacaaa

SEQ ID NO: 109407 - RNA, 19 nt, Homo sapiens
guugggagaucaccuguuu

SEQ ID NO: 109408 - RNA, 19 nt, Homo sapiens
gaauacaacuauggaacaa

SEQ ID NO: 109409 - RNA, 19 nt, Homo sapiens
gcaaacaucccuggcgaua

SEQ ID NO: 109410 - RNA, 19 nt, Homo sapiens
gaaguucggauuugaaguu

SEQ ID NO: 109411 - RNA, 19 nt, Homo sapiens
ggaagcaggugcagaaggu

SEQ ID NO: 109412 - RNA, 19 nt, Homo sapiens
caagggaucuaaaggugaa

SEQ ID NO: 109413 - RNA, 19 nt, Homo sapiens
gcacaaacagaaagaauuc

SEQ ID NO: 109414 - RNA, 19 nt, Homo sapiens
gcauauacagguaccauuu

SEQ ID NO: 109415 - RNA, 19 nt, Homo sapiens
gaucaaguaccuauuguug

SEQ ID NO: 109416 - RNA, 19 nt, Homo sapiens
gaaauagacggcagggauu

SEQ ID NO: 109417 - RNA, 19 nt, Homo sapiens
gcuacuaaaucaaaggaaa

SEQ ID NO: 109418 - RNA, 19 nt, Homo sapiens
gaauuucuuuggugcugua

SEQ ID NO: 109419 - RNA, 19 nt, Homo sapiens
gaacauaucaaaucaacag

SEQ ID NO: 109420 - RNA, 19 nt, Homo sapiens
cauaugaaauuuccaaugg

SEQ ID NO: 109421 - RNA, 19 nt, Homo sapiens
gggaguagcuggcaaacca

SEQ ID NO: 109422 - RNA, 19 nt, Homo sapiens
gaagaaaacugugacaaug

SEQ ID NO: 109423 - RNA, 19 nt, Homo sapiens
auacuuagauguugaagga

SEQ ID NO: 109424 - RNA, 19 nt, Homo sapiens
gaguaagaauuucaucaug

SEQ ID NO: 109425 - RNA, 19 nt, Homo sapiens
ugacaagggugaagaugga

SEQ ID NO: 109426 - RNA, 19 nt, Homo sapiens
gaagaaaaguuaucaagca

SEQ ID NO: 109427 - RNA, 19 nt, Homo sapiens
ggacauccugguuuaauug

SEQ ID NO: 109428 - RNA, 19 nt, Homo sapiens
uggcuuaccuggucucaaa

SEQ ID NO: 109429 - RNA, 19 nt, Homo sapiens
caaauccaguugaagaaau

SEQ ID NO: 109430 - RNA, 19 nt, Homo sapiens
uuacagaguuucaaagcaa

SEQ ID NO: 109431 - RNA, 19 nt, Homo sapiens
ccaggaaguugguuuagug

SEQ ID NO: 109432 - RNA, 19 nt, Homo sapiens
acgcaaaccaucaaauuua

SEQ ID NO: 109433 - RNA, 19 nt, Homo sapiens
cgaaaccacuugauagaag

SEQ ID NO: 109434 - RNA, 19 nt, Homo sapiens
gaagaacgcaaaccaucaa

SEQ ID NO: 109435 - RNA, 19 nt, Homo sapiens
gggacauccugguuuaauu

SEQ ID NO: 109436 - RNA, 19 nt, Homo sapiens
gggagcagauggugucaga

SEQ ID NO: 109437 - RNA, 19 nt, Homo sapiens
gagcaauuguugauaccaa

SEQ ID NO: 109438 - RNA, 19 nt, Homo sapiens
caagguugcucaggagauu

SEQ ID NO: 109439 - RNA, 19 nt, Homo sapiens
gauggugaauauuggauug

SEQ ID NO: 109440 - RNA, 19 nt, Homo sapiens
ggauggaauggaagaaaua

SEQ ID NO: 109441 - RNA, 19 nt, Homo sapiens
gaggagaaguuggucaaau

SEQ ID NO: 109442 - RNA, 19 nt, Homo sapiens
gaaaggacagaaaggagaa

SEQ ID NO: 109443 - RNA, 19 nt, Homo sapiens
ggacaguggcuacuaaauc

SEQ ID NO: 109444 - RNA, 19 nt, Homo sapiens
caagacaucgagcauauga

SEQ ID NO: 109445 - RNA, 19 nt, Homo sapiens
ugaggacaguggcuacuaa

SEQ ID NO: 109446 - RNA, 19 nt, Homo sapiens
cuucagaacuguuaacauc

SEQ ID NO: 109447 - RNA, 19 nt, Homo sapiens
ggauucugaucuucuggua

SEQ ID NO: 109448 - RNA, 19 nt, Homo sapiens
caagguaucucagggaaag

SEQ ID NO: 109449 - RNA, 19 nt, Homo sapiens
aggagaaguuggucaaauu

SEQ ID NO: 109450 - RNA, 19 nt, Homo sapiens
gaagcuggcccacgagguu

SEQ ID NO: 109451 - RNA, 19 nt, Homo sapiens
gaaaaguuaucaagcauca

SEQ ID NO: 109452 - RNA, 19 nt, Homo sapiens
gaagugagagagcaauugu

SEQ ID NO: 109453 - RNA, 19 nt, Homo sapiens
uaacaacccucgcauugac

SEQ ID NO: 109454 - RNA, 19 nt, Homo sapiens
cauauacagguaccauuua

SEQ ID NO: 109455 - RNA, 19 nt, Homo sapiens
ggagaaguuggucaaauug

SEQ ID NO: 109456 - RNA, 19 nt, Homo sapiens
gcagauggaggaagaggaa

SEQ ID NO: 109457 - RNA, 19 nt, Homo sapiens
gauacugcuuacagaguuu

SEQ ID NO: 109458 - RNA, 19 nt, Homo sapiens
gaaauaccgaugccuuugu

SEQ ID NO: 109459 - RNA, 19 nt, Homo sapiens
caucgagcauaugaaauuu

SEQ ID NO: 109460 - RNA, 19 nt, Homo sapiens
aacaagacaucgagcauau

SEQ ID NO: 109461 - RNA, 19 nt, Homo sapiens
cacaagguccuauuggaua

SEQ ID NO: 109462 - RNA, 19 nt, Homo sapiens
ggagaucgaggguuugaug

SEQ ID NO: 109463 - RNA, 19 nt, Homo sapiens
ccaagaagaagaaaaguua

SEQ ID NO: 109464 - RNA, 19 nt, Homo sapiens
ggaaauaccgaugccuuug

SEQ ID NO: 109465 - RNA, 19 nt, Homo sapiens
gaaaacaacgcugcauaua

SEQ ID NO: 109466 - RNA, 19 nt, Homo sapiens
ggugagacuugcauuuauc

SEQ ID NO: 109467 - RNA, 19 nt, Homo sapiens
ggaauggaagaaauauuug

SEQ ID NO: 109468 - RNA, 19 nt, Homo sapiens
gcagaugcagaugauaaua

SEQ ID NO: 109469 - RNA, 19 nt, Homo sapiens
auacaacuauggaacaaug

SEQ ID NO: 109470 - RNA, 19 nt, Homo sapiens
ggucugcagucgcaauuuc

SEQ ID NO: 109471 - RNA, 19 nt, Homo sapiens
ugacuuuggugaucagaau

SEQ ID NO: 109472 - RNA, 19 nt, Homo sapiens
gcaaucagcguggagaaga

SEQ ID NO: 109473 - RNA, 19 nt, Homo sapiens
guucuauacuguuaucugu

SEQ ID NO: 109474 - RNA, 19 nt, Homo sapiens
gaaaagacugucauugaaa

SEQ ID NO: 109475 - RNA, 19 nt, Homo sapiens
ugaaaagacugucauugaa

SEQ ID NO: 109476 - RNA, 19 nt, Homo sapiens
gcagaagguccuccuggaa

SEQ ID NO: 109477 - RNA, 19 nt, Homo sapiens
gggugcaccuggacugaaa

SEQ ID NO: 109478 - RNA, 19 nt, Homo sapiens
agaauuugguccaggugua

SEQ ID NO: 109479 - RNA, 19 nt, Homo sapiens
auggaacaauggaaaguua

SEQ ID NO: 109480 - RNA, 19 nt, Homo sapiens
ucaggaaccucagauagau

SEQ ID NO: 109481 - RNA, 19 nt, Homo sapiens
cagcauaugacuacuguga

SEQ ID NO: 109482 - RNA, 19 nt, Homo sapiens
gcacuagauuuucacaauu

SEQ ID NO: 109483 - RNA, 19 nt, Homo sapiens
caucauggccaaaggagaa

SEQ ID NO: 109484 - RNA, 19 nt, Homo sapiens
gaauaaggaugguauagaa

SEQ ID NO: 109485 - RNA, 19 nt, Homo sapiens
ggagauuccuucaaaguuu

SEQ ID NO: 109486 - RNA, 19 nt, Homo sapiens
gggagaagauggagaaauu

SEQ ID NO: 109487 - RNA, 19 nt, Homo sapiens
aaacagggcugauucuuga

SEQ ID NO: 109488 - RNA, 19 nt, Homo sapiens
gaacaaggauuuuggauga

SEQ ID NO: 109489 - RNA, 19 nt, Homo sapiens
gaacgugggucagcaggua

SEQ ID NO: 109490 - RNA, 19 nt, Homo sapiens
gcaaauugguguugagguu

SEQ ID NO: 109491 - RNA, 19 nt, Homo sapiens
gaacucugauggcaauaaa

SEQ ID NO: 109492 - RNA, 19 nt, Homo sapiens
gagauuccuucaaaguuua

SEQ ID NO: 109493 - RNA, 19 nt, Homo sapiens
gaacgcaaaccaucaaauu

SEQ ID NO: 109494 - RNA, 19 nt, Homo sapiens
aaacaacgcugcauauaca

SEQ ID NO: 109495 - RNA, 19 nt, Homo sapiens
aaagggacauccugguuua

SEQ ID NO: 109496 - RNA, 19 nt, Homo sapiens
gaaguugguuuagugaauu

SEQ ID NO: 109497 - RNA, 19 nt, Homo sapiens
ucugguagauggagauuua

SEQ ID NO: 109498 - RNA, 19 nt, Homo sapiens
ggaaguugguuuagugaau

SEQ ID NO: 109499 - RNA, 19 nt, Homo sapiens
gcaagcagaugcagaugau

SEQ ID NO: 109500 - RNA, 19 nt, Homo sapiens
aaagggagaucgaggguuu

SEQ ID NO: 109501 - RNA, 19 nt, Homo sapiens
gaggauacacuauaugaaa

SEQ ID NO: 109502 - RNA, 19 nt, Homo sapiens
ucaauucccugaaacaaga

SEQ ID NO: 109503 - RNA, 19 nt, Homo sapiens
uaugggaccuccuggcuua

SEQ ID NO: 109504 - RNA, 19 nt, Homo sapiens
gaaacagggcugauucuug

SEQ ID NO: 109505 - RNA, 19 nt, Homo sapiens
uggcuaagauuaagacaaa

SEQ ID NO: 109506 - RNA, 19 nt, Homo sapiens
guugggagaucaccuguuu

SEQ ID NO: 109507 - RNA, 19 nt, Homo sapiens
gaauacaacuauggaacaa

SEQ ID NO: 109508 - RNA, 19 nt, Homo sapiens
gcaaacaucccuggcgaua

SEQ ID NO: 109509 - RNA, 19 nt, Homo sapiens
gaaguucggauuugaaguu

SEQ ID NO: 109510 - RNA, 19 nt, Homo sapiens
ggaagcaggugcagaaggu

SEQ ID NO: 109511 - RNA, 19 nt, Homo sapiens
caagggaucuaaaggugaa

SEQ ID NO: 109512 - RNA, 19 nt, Homo sapiens
gcacaaacagaaagaauuc

SEQ ID NO: 109513 - RNA, 19 nt, Homo sapiens
gcauauacagguaccauuu

SEQ ID NO: 109514 - RNA, 19 nt, Homo sapiens
gaucaaguaccuauuguug

SEQ ID NO: 109515 - RNA, 19 nt, Homo sapiens
gaaauagacggcagggauu

SEQ ID NO: 109516 - RNA, 19 nt, Homo sapiens
gaauuucuuuggugcugua

SEQ ID NO: 109517 - RNA, 19 nt, Homo sapiens
gaacauaucaaaucaacag

SEQ ID NO: 109518 - RNA, 19 nt, Homo sapiens
cauaugaaauuuccaaugg

SEQ ID NO: 109519 - RNA, 19 nt, Homo sapiens
gggaguagcuggcaaacca

SEQ ID NO: 109520 - RNA, 19 nt, Homo sapiens
gaagaaaacugugacaaug

SEQ ID NO: 109521 - RNA, 19 nt, Homo sapiens
auacuuagauguugaagga

SEQ ID NO: 109522 - RNA, 19 nt, Homo sapiens
gaguaagaauuucaucaug

SEQ ID NO: 109523 - RNA, 19 nt, Homo sapiens
ugacaagggugaagaugga

SEQ ID NO: 109524 - RNA, 19 nt, Homo sapiens
ggacauccugguuuaauug

SEQ ID NO: 109525 - RNA, 19 nt, Homo sapiens
uggcuuaccuggucucaaa

SEQ ID NO: 109526 - RNA, 19 nt, Homo sapiens
caaauccaguugaagaaau

SEQ ID NO: 109527 - RNA, 19 nt, Homo sapiens
uuacagaguuucaaagcaa

SEQ ID NO: 109528 - RNA, 19 nt, Homo sapiens
ccaggaaguugguuuagug

SEQ ID NO: 109529 - RNA, 19 nt, Homo sapiens
acgcaaaccaucaaauuua

SEQ ID NO: 109530 - RNA, 19 nt, Homo sapiens
cgaaaccacuugauagaag

SEQ ID NO: 109531 - RNA, 19 nt, Homo sapiens
gggacauccugguuuaauu

SEQ ID NO: 109532 - RNA, 19 nt, Homo sapiens
gggagcagauggugucaga

SEQ ID NO: 109533 - RNA, 19 nt, Homo sapiens
gagcaauuguugauaccaa

SEQ ID NO: 109534 - RNA, 19 nt, Homo sapiens
gaagaacgcaaaccaucaa

SEQ ID NO: 109535 - RNA, 19 nt, Homo sapiens
caagguugcucaggagauu

SEQ ID NO: 109536 - RNA, 19 nt, Homo sapiens
gauggugaauauuggauug

SEQ ID NO: 109537 - RNA, 19 nt, Homo sapiens
ggauggaauggaagaaaua

SEQ ID NO: 109538 - RNA, 19 nt, Homo sapiens
gaggagaaguuggucaaau

SEQ ID NO: 109539 - RNA, 19 nt, Homo sapiens
gaaaggacagaaaggagaa

SEQ ID NO: 109540 - RNA, 19 nt, Homo sapiens
caagacaucgagcauauga

SEQ ID NO: 109541 - RNA, 19 nt, Homo sapiens
cuucagaacuguuaacauc

SEQ ID NO: 109542 - RNA, 19 nt, Homo sapiens
ggauucugaucuucuggua

SEQ ID NO: 109543 - RNA, 19 nt, Homo sapiens
caagguaucucagggaaag

SEQ ID NO: 109544 - RNA, 19 nt, Homo sapiens
aggagaaguuggucaaauu

SEQ ID NO: 109545 - RNA, 19 nt, Homo sapiens
gaagcuggcccacgagguu

SEQ ID NO: 109546 - RNA, 19 nt, Homo sapiens
gaagugagagagcaauugu

SEQ ID NO: 109547 - RNA, 19 nt, Homo sapiens
uaacaacccucgcauugac

SEQ ID NO: 109548 - RNA, 19 nt, Homo sapiens
cauauacagguaccauuua

SEQ ID NO: 109549 - RNA, 19 nt, Homo sapiens
ggagaaguuggucaaauug

SEQ ID NO: 109550 - RNA, 19 nt, Homo sapiens
gcagauggaggaagaggaa

SEQ ID NO: 109551 - RNA, 19 nt, Homo sapiens
gauacugcuuacagaguuu

SEQ ID NO: 109552 - RNA, 19 nt, Homo sapiens
gaaauaccgaugccuuugu

SEQ ID NO: 109553 - RNA, 19 nt, Homo sapiens
caucgagcauaugaaauuu

SEQ ID NO: 109554 - RNA, 19 nt, Homo sapiens
aacaagacaucgagcauau

SEQ ID NO: 109555 - RNA, 19 nt, Homo sapiens
cacaagguccuauuggaua

SEQ ID NO: 109556 - RNA, 19 nt, Homo sapiens
ggagaucgaggguuugaug

SEQ ID NO: 109557 - RNA, 19 nt, Homo sapiens
ggucugcagucgcaauuuc

SEQ ID NO: 109558 - RNA, 19 nt, Homo sapiens
ggaaauaccgaugccuuug

SEQ ID NO: 109559 - RNA, 19 nt, Homo sapiens
gaaaacaacgcugcauaua

SEQ ID NO: 109560 - RNA, 19 nt, Homo sapiens
ggugagacuugcauuuauc

SEQ ID NO: 109561 - RNA, 19 nt, Homo sapiens
ggaauggaagaaauauuug

SEQ ID NO: 109562 - RNA, 19 nt, Homo sapiens
gcagaugcagaugauaaua

SEQ ID NO: 109563 - RNA, 19 nt, Homo sapiens
auacaacuauggaacaaug

SEQ ID NO: 109564 - RNA, 19 nt, Homo sapiens
ugacuuuggugaucagaau

SEQ ID NO: 109565 - RNA, 19 nt, Homo sapiens
gcaaucagcguggagaaga

SEQ ID NO: 109566 - RNA, 19 nt, Homo sapiens
guucuauacuguuaucugu

SEQ ID NO: 109567 - RNA, 19 nt, Homo sapiens
gaaaagacugucauugaaa

SEQ ID NO: 109568 - RNA, 19 nt, Homo sapiens
ugaaaagacugucauugaa

SEQ ID NO: 109569 - RNA, 19 nt, Homo sapiens
gcagaagguccuccuggaa

SEQ ID NO: 109570 - RNA, 19 nt, Homo sapiens
gggugcaccuggacugaaa

SEQ ID NO: 109571 - RNA, 19 nt, Homo sapiens
agaauuugguccaggugua

SEQ ID NO: 109572 - RNA, 19 nt, Homo sapiens
auggaacaauggaaaguua

SEQ ID NO: 109573 - RNA, 19 nt, Homo sapiens
ucaggaaccucagauagau

SEQ ID NO: 109574 - RNA, 19 nt, Homo sapiens
cagcauaugacuacuguga

SEQ ID NO: 109575 - RNA, 19 nt, Homo sapiens
gcacuagauuuucacaauu

SEQ ID NO: 109576 - RNA, 19 nt, Homo sapiens
caucauggccaaaggagaa

SEQ ID NO: 109577 - RNA, 19 nt, Homo sapiens
guggugagacuugcauuua

SEQ ID NO: 109578 - RNA, 19 nt, Homo sapiens
agacaucgagcauaugaaa

SEQ ID NO: 109579 - RNA, 19 nt, Homo sapiens
agacaagggugaaauuggu

SEQ ID NO: 109580 - RNA, 19 nt, Homo sapiens
gauguuaccguuccguuau

SEQ ID NO: 109581 - RNA, 19 nt, Homo sapiens
uaacgggagaggauuauga

SEQ ID NO: 109582 - RNA, 19 nt, Homo sapiens
ugaaguugguccuguuugu

SEQ ID NO: 109583 - RNA, 19 nt, Homo sapiens
ggaguaagaauuucaucau

SEQ ID NO: 109584 - RNA, 19 nt, Homo sapiens
aaggagagaugguggauua

SEQ ID NO: 109585 - RNA, 19 nt, Homo sapiens
ccaaggagcgccuggauua

SEQ ID NO: 109586 - RNA, 19 nt, Homo sapiens
gaacaagugaugccucuaa

SEQ ID NO: 109587 - RNA, 19 nt, Homo sapiens
ggaacguucuucgaaauaa

SEQ ID NO: 109588 - RNA, 19 nt, Homo sapiens
cagcugggcuuccugguuu

SEQ ID NO: 109589 - RNA, 19 nt, Homo sapiens
cguaaugucugcaugauau

SEQ ID NO: 109590 - RNA, 19 nt, Homo sapiens
gcucugcgcuccagccaaa

SEQ ID NO: 109591 - RNA, 19 nt, Homo sapiens
gcacauuuauuaaguaucg

SEQ ID NO: 109592 - RNA, 19 nt, Homo sapiens
ccaaagacaucuccaggau

SEQ ID NO: 109593 - RNA, 19 nt, Homo sapiens
gcagacacuugaagggaaa

SEQ ID NO: 109594 - RNA, 19 nt, Homo sapiens
cagggagugugucaaguua

SEQ ID NO: 109595 - RNA, 19 nt, Homo sapiens
gaaaugaaacauggcaauu

SEQ ID NO: 109596 - RNA, 19 nt, Homo sapiens
aaagggaccucgcgguaaa

SEQ ID NO: 109597 - RNA, 19 nt, Homo sapiens
gagagaugguggauuacaa

SEQ ID NO: 109598 - RNA, 19 nt, Homo sapiens
caugauauuugcuaagcua

SEQ ID NO: 109599 - RNA, 19 nt, Homo sapiens
gaaaaugccagaaguauga

SEQ ID NO: 109600 - RNA, 19 nt, Homo sapiens
gaugguggauuacaaugga

SEQ ID NO: 109601 - RNA, 19 nt, Homo sapiens
agaaguaugaugcaucuua

SEQ ID NO: 109602 - RNA, 19 nt, Homo sapiens
ccaaauaauugcccugaag

SEQ ID NO: 109603 - RNA, 19 nt, Homo sapiens
gaaguaugaugcaucuuac

SEQ ID NO: 109604 - RNA, 19 nt, Homo sapiens
gcugucgccuuuauuuauu

SEQ ID NO: 109605 - RNA, 19 nt, Homo sapiens
guagagguccaugauauuu

SEQ ID NO: 109606 - RNA, 19 nt, Homo sapiens
uaacugcccaccagcauuu

SEQ ID NO: 109607 - RNA, 19 nt, Homo sapiens
uaacuuuccuggacuugga

SEQ ID NO: 109608 - RNA, 19 nt, Homo sapiens
ggauuacaauggaaacauc

SEQ ID NO: 109609 - RNA, 19 nt, Homo sapiens
cuaggugugucuaagagua

SEQ ID NO: 109610 - RNA, 19 nt, Homo sapiens
gggcgaagauggcuuacca

SEQ ID NO: 109611 - RNA, 19 nt, Homo sapiens
gcagggagugugucaaguu

SEQ ID NO: 109612 - RNA, 19 nt, Homo sapiens
caugauauuugugcacauu

SEQ ID NO: 109613 - RNA, 19 nt, Homo sapiens
ggaaaugaaacauggcaau

SEQ ID NO: 109614 - RNA, 19 nt, Homo sapiens
ccagaaguaugaugcaucu

SEQ ID NO: 109615 - RNA, 19 nt, Homo sapiens
aaggagagccggucagauu

SEQ ID NO: 109616 - RNA, 19 nt, Homo sapiens
gcugggcuguccaucauug

SEQ ID NO: 109617 - RNA, 19 nt, Homo sapiens
gaacguucuucgaaauaac

SEQ ID NO: 109618 - RNA, 19 nt, Homo sapiens
caagggagaaccagggaaa

SEQ ID NO: 109619 - RNA, 19 nt, Homo sapiens
gguccaugauauuugcuaa

SEQ ID NO: 109620 - RNA, 19 nt, Homo sapiens
cuggcuagcucauguguga

SEQ ID NO: 109621 - RNA, 19 nt, Homo sapiens
gggagugugucaaguuaca

SEQ ID NO: 109622 - RNA, 19 nt, Homo sapiens
ggaagcaggacuagaugga

SEQ ID NO: 109623 - RNA, 19 nt, Homo sapiens
gauauuugcuaagcuaggu

SEQ ID NO: 109624 - RNA, 19 nt, Homo sapiens
caaggcugcuggaacaagu

SEQ ID NO: 109625 - RNA, 19 nt, Homo sapiens
guauaagccuaugucucua

SEQ ID NO: 109626 - RNA, 19 nt, Homo sapiens
ggauaagggagaccaagga

SEQ ID NO: 109627 - RNA, 19 nt, Homo sapiens
acccggagcuucagguuug

SEQ ID NO: 109628 - RNA, 19 nt, Homo sapiens
gggagaagcaggugucgau

SEQ ID NO: 109629 - RNA, 19 nt, Homo sapiens
auaucaaccucuucccuuu

SEQ ID NO: 109630 - RNA, 19 nt, Homo sapiens
acaauggaaacaucaauga

SEQ ID NO: 109631 - RNA, 19 nt, Homo sapiens
ggagaacagggaccagaug

SEQ ID NO: 109632 - RNA, 19 nt, Homo sapiens
gaaaggagagaugguggau

SEQ ID NO: 109633 - RNA, 19 nt, Homo sapiens
caguuuggauagagccuuu

SEQ ID NO: 109634 - RNA, 19 nt, Homo sapiens
ggugcuggcuagcucaugu

SEQ ID NO: 109635 - RNA, 19 nt, Homo sapiens
uguauaagccuaugucucu

SEQ ID NO: 109636 - RNA, 19 nt, Homo sapiens
gcugcugccucuccucaau

SEQ ID NO: 109637 - RNA, 19 nt, Homo sapiens
gccaaauaauugcccugaa

SEQ ID NO: 109638 - RNA, 19 nt, Homo sapiens
gcgcuccagccaaauaauu

SEQ ID NO: 109639 - RNA, 19 nt, Homo sapiens
cuagagguuucccuggauu

SEQ ID NO: 109640 - RNA, 19 nt, Homo sapiens
gcaaauggagacggcuauu

SEQ ID NO: 109641 - RNA, 19 nt, Homo sapiens
ggucguaaugucugcauga

SEQ ID NO: 109642 - RNA, 19 nt, Homo sapiens
aagccuaugucucuaauac

SEQ ID NO: 109643 - RNA, 19 nt, Homo sapiens
gaaaggcuuccagggagaa

SEQ ID NO: 109644 - RNA, 19 nt, Homo sapiens
gcggcugucgccuuuauuu

SEQ ID NO: 109645 - RNA, 19 nt, Homo sapiens
gcagcugggcuuccugguu

SEQ ID NO: 109646 - RNA, 19 nt, Homo sapiens
uauaagccuaugucucuaa

SEQ ID NO: 109647 - RNA, 19 nt, Homo sapiens
guguguguguuuguacaua

SEQ ID NO: 109648 - RNA, 19 nt, Homo sapiens
cuuggaacguucuucgaaa

SEQ ID NO: 109649 - RNA, 19 nt, Homo sapiens
gaaagacugggcggagaga

SEQ ID NO: 109650 - RNA, 19 nt, Homo sapiens
auguagagguccaugauau

SEQ ID NO: 109651 - RNA, 19 nt, Homo sapiens
uaaauguagagguccauga

SEQ ID NO: 109652 - RNA, 19 nt, Homo sapiens
gggaagaaaggcucuagag

SEQ ID NO: 109653 - RNA, 19 nt, Homo sapiens
ccucuccuacugcuaauuu

SEQ ID NO: 109654 - RNA, 19 nt, Homo sapiens
ggagagaugguggauuaca

SEQ ID NO: 109655 - RNA, 19 nt, Homo sapiens
ggcugucgccuuuauuuau

SEQ ID NO: 109656 - RNA, 19 nt, Homo sapiens
uaagcuaggugugucuaag

SEQ ID NO: 109657 - RNA, 19 nt, Homo sapiens
uggaacguucuucgaaaua

SEQ ID NO: 109658 - RNA, 19 nt, Homo sapiens
cggcugucgccuuuauuua

SEQ ID NO: 109659 - RNA, 19 nt, Homo sapiens
uagcucaugugugaauuca

SEQ ID NO: 109660 - RNA, 19 nt, Homo sapiens
cagaaaauaucaaccucuu

SEQ ID NO: 109661 - RNA, 19 nt, Homo sapiens
guaugaugcaucuuacaga

SEQ ID NO: 109662 - RNA, 19 nt, Homo sapiens
gcguggagcagcuggagaa

SEQ ID NO: 109663 - RNA, 19 nt, Homo sapiens
gaugcuggcaacuccauug

SEQ ID NO: 109664 - RNA, 19 nt, Homo sapiens
guaacugcccaccagcauu

SEQ ID NO: 109665 - RNA, 19 nt, Homo sapiens
gggacuacccggagcuuca

SEQ ID NO: 109666 - RNA, 19 nt, Homo sapiens
uggagcagcuggagaacag

SEQ ID NO: 109667 - RNA, 19 nt, Homo sapiens
aaaugaaacauggcaauuc

SEQ ID NO: 109668 - RNA, 19 nt, Homo sapiens
ggucuuccugggcaaauug

SEQ ID NO: 109669 - RNA, 19 nt, Homo sapiens
gagaugguggauuacaaug

SEQ ID NO: 109670 - RNA, 19 nt, Homo sapiens
gggagaaccagggaaagga

SEQ ID NO: 109671 - RNA, 19 nt, Homo sapiens
gagccaggccagcauccaa

SEQ ID NO: 109672 - RNA, 19 nt, Homo sapiens
ggauuuccgggucccauug

SEQ ID NO: 109673 - RNA, 19 nt, Homo sapiens
uagcggagcgcacccacaa

SEQ ID NO: 109674 - RNA, 19 nt, Homo sapiens
gcuagcucaugugugaauu

SEQ ID NO: 109675 - RNA, 19 nt, Homo sapiens
guaaugucugcaugauauu

SEQ ID NO: 109676 - RNA, 19 nt, Homo sapiens
ccaauuaccgcugguugug

SEQ ID NO: 109677 - RNA, 19 nt, Homo sapiens
uggauuggccugugugugu

SEQ ID NO: 109678 - RNA, 19 nt, Homo sapiens
aaaggagacccugggauga

SEQ ID NO: 109679 - RNA, 19 nt, Homo sapiens
gguacuccaggaccaauug

SEQ ID NO: 109680 - RNA, 19 nt, Homo sapiens
ccacaccgggagugccuaa

SEQ ID NO: 109681 - RNA, 19 nt, Homo sapiens
gaaccagggaaaggagaga

SEQ ID NO: 109682 - RNA, 19 nt, Homo sapiens
gagccagggaucccaggaa

SEQ ID NO: 109683 - RNA, 19 nt, Homo sapiens
uguagagguccaugauauu

SEQ ID NO: 109684 - RNA, 19 nt, Homo sapiens
aaggagagaugguggauua

SEQ ID NO: 109685 - RNA, 19 nt, Homo sapiens
ccaaggagcgccuggauua

SEQ ID NO: 109686 - RNA, 19 nt, Homo sapiens
gaacaagugaugccucuaa

SEQ ID NO: 109687 - RNA, 19 nt, Homo sapiens
ggaacguucuucgaaauaa

SEQ ID NO: 109688 - RNA, 19 nt, Homo sapiens
cagcugggcuuccugguuu

SEQ ID NO: 109689 - RNA, 19 nt, Homo sapiens
cguaaugucugcaugauau

SEQ ID NO: 109690 - RNA, 19 nt, Homo sapiens
gcucugcgcuccagccaaa

SEQ ID NO: 109691 - RNA, 19 nt, Homo sapiens
gcacauuuauuaaguaucg

SEQ ID NO: 109692 - RNA, 19 nt, Homo sapiens
ccaaagacaucuccaggau

SEQ ID NO: 109693 - RNA, 19 nt, Homo sapiens
gcagacacuugaagggaaa

SEQ ID NO: 109694 - RNA, 19 nt, Homo sapiens
cagggagugugucaaguua

SEQ ID NO: 109695 - RNA, 19 nt, Homo sapiens
gaaaugaaacauggcaauu

SEQ ID NO: 109696 - RNA, 19 nt, Homo sapiens
aaagggaccucgcgguaaa

SEQ ID NO: 109697 - RNA, 19 nt, Homo sapiens
gagagaugguggauuacaa

SEQ ID NO: 109698 - RNA, 19 nt, Homo sapiens
caugauauuugcuaagcua

SEQ ID NO: 109699 - RNA, 19 nt, Homo sapiens
gaaaaugccagaaguauga

SEQ ID NO: 109700 - RNA, 19 nt, Homo sapiens
gaugguggauuacaaugga

SEQ ID NO: 109701 - RNA, 19 nt, Homo sapiens
agaaguaugaugcaucuua

SEQ ID NO: 109702 - RNA, 19 nt, Homo sapiens
ccaaauaauugcccugaag

SEQ ID NO: 109703 - RNA, 19 nt, Homo sapiens
gaaguaugaugcaucuuac

SEQ ID NO: 109704 - RNA, 19 nt, Homo sapiens
gcugucgccuuuauuuauu

SEQ ID NO: 109705 - RNA, 19 nt, Homo sapiens
guagagguccaugauauuu

SEQ ID NO: 109706 - RNA, 19 nt, Homo sapiens
uaacugcccaccagcauuu

SEQ ID NO: 109707 - RNA, 19 nt, Homo sapiens
uaacuuuccuggacuugga

SEQ ID NO: 109708 - RNA, 19 nt, Homo sapiens
ggauuacaauggaaacauc

SEQ ID NO: 109709 - RNA, 19 nt, Homo sapiens
cuaggugugucuaagagua

SEQ ID NO: 109710 - RNA, 19 nt, Homo sapiens
gggcgaagauggcuuacca

SEQ ID NO: 109711 - RNA, 19 nt, Homo sapiens
gcagggagugugucaaguu

SEQ ID NO: 109712 - RNA, 19 nt, Homo sapiens
caugauauuugugcacauu

SEQ ID NO: 109713 - RNA, 19 nt, Homo sapiens
ggaaaugaaacauggcaau

SEQ ID NO: 109714 - RNA, 19 nt, Homo sapiens
ccagaaguaugaugcaucu

SEQ ID NO: 109715 - RNA, 19 nt, Homo sapiens
aaggagagccggucagauu

SEQ ID NO: 109716 - RNA, 19 nt, Homo sapiens
gcugggcuguccaucauug

SEQ ID NO: 109717 - RNA, 19 nt, Homo sapiens
gaacguucuucgaaauaac

SEQ ID NO: 109718 - RNA, 19 nt, Homo sapiens
caagggagaaccagggaaa

SEQ ID NO: 109719 - RNA, 19 nt, Homo sapiens
gguccaugauauuugcuaa

SEQ ID NO: 109720 - RNA, 19 nt, Homo sapiens
cuggcuagcucauguguga

SEQ ID NO: 109721 - RNA, 19 nt, Homo sapiens
gggagugugucaaguuaca

SEQ ID NO: 109722 - RNA, 19 nt, Homo sapiens
ggaagcaggacuagaugga

SEQ ID NO: 109723 - RNA, 19 nt, Homo sapiens
gauauuugcuaagcuaggu

SEQ ID NO: 109724 - RNA, 19 nt, Homo sapiens
caaggcugcuggaacaagu

SEQ ID NO: 109725 - RNA, 19 nt, Homo sapiens
guauaagccuaugucucua

SEQ ID NO: 109726 - RNA, 19 nt, Homo sapiens
ggauaagggagaccaagga

SEQ ID NO: 109727 - RNA, 19 nt, Homo sapiens
acccggagcuucagguuug

SEQ ID NO: 109728 - RNA, 19 nt, Homo sapiens
gggagaagcaggugucgau

SEQ ID NO: 109729 - RNA, 19 nt, Homo sapiens
auaucaaccucuucccuuu

SEQ ID NO: 109730 - RNA, 19 nt, Homo sapiens
acaauggaaacaucaauga

SEQ ID NO: 109731 - RNA, 19 nt, Homo sapiens
ggagaacagggaccagaug

SEQ ID NO: 109732 - RNA, 19 nt, Homo sapiens
gaaaggagagaugguggau

SEQ ID NO: 109733 - RNA, 19 nt, Homo sapiens
caguuuggauagagccuuu

SEQ ID NO: 109734 - RNA, 19 nt, Homo sapiens
ggugcuggcuagcucaugu

SEQ ID NO: 109735 - RNA, 19 nt, Homo sapiens
uguauaagccuaugucucu

SEQ ID NO: 109736 - RNA, 19 nt, Homo sapiens
gcugcugccucuccucaau

SEQ ID NO: 109737 - RNA, 19 nt, Homo sapiens
gccaaauaauugcccugaa

SEQ ID NO: 109738 - RNA, 19 nt, Homo sapiens
gcgcuccagccaaauaauu

SEQ ID NO: 109739 - RNA, 19 nt, Homo sapiens
cuagagguuucccuggauu

SEQ ID NO: 109740 - RNA, 19 nt, Homo sapiens
gcaaauggagacggcuauu

SEQ ID NO: 109741 - RNA, 19 nt, Homo sapiens
ggucguaaugucugcauga

SEQ ID NO: 109742 - RNA, 19 nt, Homo sapiens
aagccuaugucucuaauac

SEQ ID NO: 109743 - RNA, 19 nt, Homo sapiens
gaaaggcuuccagggagaa

SEQ ID NO: 109744 - RNA, 19 nt, Homo sapiens
gcggcugucgccuuuauuu

SEQ ID NO: 109745 - RNA, 19 nt, Homo sapiens
gcagcugggcuuccugguu

SEQ ID NO: 109746 - RNA, 19 nt, Homo sapiens
uauaagccuaugucucuaa

SEQ ID NO: 109747 - RNA, 19 nt, Homo sapiens
guguguguguuuguacaua

SEQ ID NO: 109748 - RNA, 19 nt, Homo sapiens
cuuggaacguucuucgaaa

SEQ ID NO: 109749 - RNA, 19 nt, Homo sapiens
gaaagacugggcggagaga

SEQ ID NO: 109750 - RNA, 19 nt, Homo sapiens
auguagagguccaugauau

SEQ ID NO: 109751 - RNA, 19 nt, Homo sapiens
uaaauguagagguccauga

SEQ ID NO: 109752 - RNA, 19 nt, Homo sapiens
gggaagaaaggcucuagag

SEQ ID NO: 109753 - RNA, 19 nt, Homo sapiens
ccucuccuacugcuaauuu

SEQ ID NO: 109754 - RNA, 19 nt, Homo sapiens
ggagagaugguggauuaca

SEQ ID NO: 109755 - RNA, 19 nt, Homo sapiens
ggcugucgccuuuauuuau

SEQ ID NO: 109756 - RNA, 19 nt, Homo sapiens
uaagcuaggugugucuaag

SEQ ID NO: 109757 - RNA, 19 nt, Homo sapiens
uggaacguucuucgaaaua

SEQ ID NO: 109758 - RNA, 19 nt, Homo sapiens
cggcugucgccuuuauuua

SEQ ID NO: 109759 - RNA, 19 nt, Homo sapiens
uagcucaugugugaauuca

SEQ ID NO: 109760 - RNA, 19 nt, Homo sapiens
cagaaaauaucaaccucuu

SEQ ID NO: 109761 - RNA, 19 nt, Homo sapiens
guaugaugcaucuuacaga

SEQ ID NO: 109762 - RNA, 19 nt, Homo sapiens
gcguggagcagcuggagaa

SEQ ID NO: 109763 - RNA, 19 nt, Homo sapiens
gaugcuggcaacuccauug

SEQ ID NO: 109764 - RNA, 19 nt, Homo sapiens
guaacugcccaccagcauu

SEQ ID NO: 109765 - RNA, 19 nt, Homo sapiens
gggacuacccggagcuuca

SEQ ID NO: 109766 - RNA, 19 nt, Homo sapiens
uggagcagcuggagaacag

SEQ ID NO: 109767 - RNA, 19 nt, Homo sapiens
aaaugaaacauggcaauuc

SEQ ID NO: 109768 - RNA, 19 nt, Homo sapiens
ggucuuccugggcaaauug

SEQ ID NO: 109769 - RNA, 19 nt, Homo sapiens
gagaugguggauuacaaug

SEQ ID NO: 109770 - RNA, 19 nt, Homo sapiens
gggagaaccagggaaagga

SEQ ID NO: 109771 - RNA, 19 nt, Homo sapiens
gagccaggccagcauccaa

SEQ ID NO: 109772 - RNA, 19 nt, Homo sapiens
ggauuuccgggucccauug

SEQ ID NO: 109773 - RNA, 19 nt, Homo sapiens
uagcggagcgcacccacaa

SEQ ID NO: 109774 - RNA, 19 nt, Homo sapiens
gcuagcucaugugugaauu

SEQ ID NO: 109775 - RNA, 19 nt, Homo sapiens
guaaugucugcaugauauu

SEQ ID NO: 109776 - RNA, 19 nt, Homo sapiens
ccaauuaccgcugguugug

SEQ ID NO: 109777 - RNA, 19 nt, Homo sapiens
uggauuggccugugugugu

SEQ ID NO: 109778 - RNA, 19 nt, Homo sapiens
aaaggagacccugggauga

SEQ ID NO: 109779 - RNA, 19 nt, Homo sapiens
gguacuccaggaccaauug

SEQ ID NO: 109780 - RNA, 19 nt, Homo sapiens
ccacaccgggagugccuaa

SEQ ID NO: 109781 - RNA, 19 nt, Homo sapiens
gaaccagggaaaggagaga

SEQ ID NO: 109782 - RNA, 19 nt, Homo sapiens
gagccagggaucccaggaa

SEQ ID NO: 109783 - RNA, 19 nt, Homo sapiens
uguagagguccaugauauu

SEQ ID NO: 109784 - RNA, 19 nt, Homo sapiens
aaggagagaugguggauua

SEQ ID NO: 109785 - RNA, 19 nt, Homo sapiens
ccaaggagcgccuggauua

SEQ ID NO: 109786 - RNA, 19 nt, Homo sapiens
gaacaagugaugccucuaa

SEQ ID NO: 109787 - RNA, 19 nt, Homo sapiens
ggaacguucuucgaaauaa

SEQ ID NO: 109788 - RNA, 19 nt, Homo sapiens
cagcugggcuuccugguuu

SEQ ID NO: 109789 - RNA, 19 nt, Homo sapiens
cguaaugucugcaugauau

SEQ ID NO: 109790 - RNA, 19 nt, Homo sapiens
gcucugcgcuccagccaaa

SEQ ID NO: 109791 - RNA, 19 nt, Homo sapiens
gcacauuuauuaaguaucg

SEQ ID NO: 109792 - RNA, 19 nt, Homo sapiens
ccaaagacaucuccaggau

SEQ ID NO: 109793 - RNA, 19 nt, Homo sapiens
gcagacacuugaagggaaa

SEQ ID NO: 109794 - RNA, 19 nt, Homo sapiens
cagggagugugucaaguua

SEQ ID NO: 109795 - RNA, 19 nt, Homo sapiens
gaaaugaaacauggcaauu

SEQ ID NO: 109796 - RNA, 19 nt, Homo sapiens
aaagggaccucgcgguaaa

SEQ ID NO: 109797 - RNA, 19 nt, Homo sapiens
gagagaugguggauuacaa

SEQ ID NO: 109798 - RNA, 19 nt, Homo sapiens
caugauauuugcuaagcua

SEQ ID NO: 109799 - RNA, 19 nt, Homo sapiens
gaaaaugccagaaguauga

SEQ ID NO: 109800 - RNA, 19 nt, Homo sapiens
gaugguggauuacaaugga

SEQ ID NO: 109801 - RNA, 19 nt, Homo sapiens
agaaguaugaugcaucuua

SEQ ID NO: 109802 - RNA, 19 nt, Homo sapiens
ccaaauaauugcccugaag

SEQ ID NO: 109803 - RNA, 19 nt, Homo sapiens
gaaguaugaugcaucuuac

SEQ ID NO: 109804 - RNA, 19 nt, Homo sapiens
gcugucgccuuuauuuauu

SEQ ID NO: 109805 - RNA, 19 nt, Homo sapiens
guagagguccaugauauuu

SEQ ID NO: 109806 - RNA, 19 nt, Homo sapiens
uaacugcccaccagcauuu

SEQ ID NO: 109807 - RNA, 19 nt, Homo sapiens
uaacuuuccuggacuugga

SEQ ID NO: 109808 - RNA, 19 nt, Homo sapiens
ggauuacaauggaaacauc

SEQ ID NO: 109809 - RNA, 19 nt, Homo sapiens
cuaggugugucuaagagua

SEQ ID NO: 109810 - RNA, 19 nt, Homo sapiens
gggcgaagauggcuuacca

SEQ ID NO: 109811 - RNA, 19 nt, Homo sapiens
gcagggagugugucaaguu

SEQ ID NO: 109812 - RNA, 19 nt, Homo sapiens
caugauauuugugcacauu

SEQ ID NO: 109813 - RNA, 19 nt, Homo sapiens
ggaaaugaaacauggcaau

SEQ ID NO: 109814 - RNA, 19 nt, Homo sapiens
ccagaaguaugaugcaucu

SEQ ID NO: 109815 - RNA, 19 nt, Homo sapiens
aaggagagccggucagauu

SEQ ID NO: 109816 - RNA, 19 nt, Homo sapiens
gaacguucuucgaaauaac

SEQ ID NO: 109817 - RNA, 19 nt, Homo sapiens
caagggagaaccagggaaa

SEQ ID NO: 109818 - RNA, 19 nt, Homo sapiens
gguccaugauauuugcuaa

SEQ ID NO: 109819 - RNA, 19 nt, Homo sapiens
cuggcuagcucauguguga

SEQ ID NO: 109820 - RNA, 19 nt, Homo sapiens
gggagugugucaaguuaca

SEQ ID NO: 109821 - RNA, 19 nt, Homo sapiens
ggaagcaggacuagaugga

SEQ ID NO: 109822 - RNA, 19 nt, Homo sapiens
gauauuugcuaagcuaggu

SEQ ID NO: 109823 - RNA, 19 nt, Homo sapiens
caaggcugcuggaacaagu

SEQ ID NO: 109824 - RNA, 19 nt, Homo sapiens
guauaagccuaugucucua

SEQ ID NO: 109825 - RNA, 19 nt, Homo sapiens
ggauaagggagaccaagga

SEQ ID NO: 109826 - RNA, 19 nt, Homo sapiens
acccggagcuucagguuug

SEQ ID NO: 109827 - RNA, 19 nt, Homo sapiens
gggagaagcaggugucgau

SEQ ID NO: 109828 - RNA, 19 nt, Homo sapiens
auaucaaccucuucccuuu

SEQ ID NO: 109829 - RNA, 19 nt, Homo sapiens
acaauggaaacaucaauga

SEQ ID NO: 109830 - RNA, 19 nt, Homo sapiens
ggagaacagggaccagaug

SEQ ID NO: 109831 - RNA, 19 nt, Homo sapiens
gaaaggagagaugguggau

SEQ ID NO: 109832 - RNA, 19 nt, Homo sapiens
caguuuggauagagccuuu

SEQ ID NO: 109833 - RNA, 19 nt, Homo sapiens
ggugcuggcuagcucaugu

SEQ ID NO: 109834 - RNA, 19 nt, Homo sapiens
uguauaagccuaugucucu

SEQ ID NO: 109835 - RNA, 19 nt, Homo sapiens
gcugcugccucuccucaau

SEQ ID NO: 109836 - RNA, 19 nt, Homo sapiens
gccaaauaauugcccugaa

SEQ ID NO: 109837 - RNA, 19 nt, Homo sapiens
gcgcuccagccaaauaauu

SEQ ID NO: 109838 - RNA, 19 nt, Homo sapiens
cuagagguuucccuggauu

SEQ ID NO: 109839 - RNA, 19 nt, Homo sapiens
gcaaauggagacggcuauu

SEQ ID NO: 109840 - RNA, 19 nt, Homo sapiens
ggucguaaugucugcauga

SEQ ID NO: 109841 - RNA, 19 nt, Homo sapiens
aagccuaugucucuaauac

SEQ ID NO: 109842 - RNA, 19 nt, Homo sapiens
gaaaggcuuccagggagaa

SEQ ID NO: 109843 - RNA, 19 nt, Homo sapiens
gcggcugucgccuuuauuu

SEQ ID NO: 109844 - RNA, 19 nt, Homo sapiens
gcagcugggcuuccugguu

SEQ ID NO: 109845 - RNA, 19 nt, Homo sapiens
uauaagccuaugucucuaa

SEQ ID NO: 109846 - RNA, 19 nt, Homo sapiens
guguguguguuuguacaua

SEQ ID NO: 109847 - RNA, 19 nt, Homo sapiens
cuuggaacguucuucgaaa

SEQ ID NO: 109848 - RNA, 19 nt, Homo sapiens
gaaagacugggcggagaga

SEQ ID NO: 109849 - RNA, 19 nt, Homo sapiens
auguagagguccaugauau

SEQ ID NO: 109850 - RNA, 19 nt, Homo sapiens
uaaauguagagguccauga

SEQ ID NO: 109851 - RNA, 19 nt, Homo sapiens
gggaagaaaggcucuagag

SEQ ID NO: 109852 - RNA, 19 nt, Homo sapiens
ggagagaugguggauuaca

SEQ ID NO: 109853 - RNA, 19 nt, Homo sapiens
ccucuccuacugcuaauuu

SEQ ID NO: 109854 - RNA, 19 nt, Homo sapiens
ggcugucgccuuuauuuau

SEQ ID NO: 109855 - RNA, 19 nt, Homo sapiens
uaagcuaggugugucuaag

SEQ ID NO: 109856 - RNA, 19 nt, Homo sapiens
uggaacguucuucgaaaua

SEQ ID NO: 109857 - RNA, 19 nt, Homo sapiens
cggcugucgccuuuauuua

SEQ ID NO: 109858 - RNA, 19 nt, Homo sapiens
uagcucaugugugaauuca

SEQ ID NO: 109859 - RNA, 19 nt, Homo sapiens
cagaaaauaucaaccucuu

SEQ ID NO: 109860 - RNA, 19 nt, Homo sapiens
guaugaugcaucuuacaga

SEQ ID NO: 109861 - RNA, 19 nt, Homo sapiens
gcguggagcagcuggagaa

SEQ ID NO: 109862 - RNA, 19 nt, Homo sapiens
gaugcuggcaacuccauug

SEQ ID NO: 109863 - RNA, 19 nt, Homo sapiens
guaacugcccaccagcauu

SEQ ID NO: 109864 - RNA, 19 nt, Homo sapiens
gggacuacccggagcuuca

SEQ ID NO: 109865 - RNA, 19 nt, Homo sapiens
uggagcagcuggagaacag

SEQ ID NO: 109866 - RNA, 19 nt, Homo sapiens
aaaugaaacauggcaauuc

SEQ ID NO: 109867 - RNA, 19 nt, Homo sapiens
ggucuuccugggcaaauug

SEQ ID NO: 109868 - RNA, 19 nt, Homo sapiens
gagaugguggauuacaaug

SEQ ID NO: 109869 - RNA, 19 nt, Homo sapiens
gggagaaccagggaaagga

SEQ ID NO: 109870 - RNA, 19 nt, Homo sapiens
gagccaggccagcauccaa

SEQ ID NO: 109871 - RNA, 19 nt, Homo sapiens
ggauuuccgggucccauug

SEQ ID NO: 109872 - RNA, 19 nt, Homo sapiens
uagcggagcgcacccacaa

SEQ ID NO: 109873 - RNA, 19 nt, Homo sapiens
gcuagcucaugugugaauu

SEQ ID NO: 109874 - RNA, 19 nt, Homo sapiens
guaaugucugcaugauauu

SEQ ID NO: 109875 - RNA, 19 nt, Homo sapiens
ccaauuaccgcugguugug

SEQ ID NO: 109876 - RNA, 19 nt, Homo sapiens
uggauuggccugugugugu

SEQ ID NO: 109877 - RNA, 19 nt, Homo sapiens
aaaggagacccugggauga

SEQ ID NO: 109878 - RNA, 19 nt, Homo sapiens
gguacuccaggaccaauug

SEQ ID NO: 109879 - RNA, 19 nt, Homo sapiens
ccacaccgggagugccuaa

SEQ ID NO: 109880 - RNA, 19 nt, Homo sapiens
gaaccagggaaaggagaga

SEQ ID NO: 109881 - RNA, 19 nt, Homo sapiens
gagccagggaucccaggaa

SEQ ID NO: 109882 - RNA, 19 nt, Homo sapiens
uguagagguccaugauauu

SEQ ID NO: 109883 - RNA, 19 nt, Homo sapiens
gauuacaauggaaacauca

SEQ ID NO: 109884 - RNA, 19 nt, Homo sapiens
aaggagagaugguggauua

SEQ ID NO: 109885 - RNA, 19 nt, Homo sapiens
ccaaggagcgccuggauua

SEQ ID NO: 109886 - RNA, 19 nt, Homo sapiens
gaacaagugaugccucuaa

SEQ ID NO: 109887 - RNA, 19 nt, Homo sapiens
ggaacguucuucgaaauaa

SEQ ID NO: 109888 - RNA, 19 nt, Homo sapiens
cagcugggcuuccugguuu

SEQ ID NO: 109889 - RNA, 19 nt, Homo sapiens
cguaaugucugcaugauau

SEQ ID NO: 109890 - RNA, 19 nt, Homo sapiens
gcacauuuauuaaguaucg

SEQ ID NO: 109891 - RNA, 19 nt, Homo sapiens
ccaaagacaucuccaggau

SEQ ID NO: 109892 - RNA, 19 nt, Homo sapiens
gcagacacuugaagggaaa

SEQ ID NO: 109893 - RNA, 19 nt, Homo sapiens
cagggagugugucaaguua

SEQ ID NO: 109894 - RNA, 19 nt, Homo sapiens
gaaaugaaacauggcaauu

SEQ ID NO: 109895 - RNA, 19 nt, Homo sapiens
aaagggaccucgcgguaaa

SEQ ID NO: 109896 - RNA, 19 nt, Homo sapiens
gagagaugguggauuacaa

SEQ ID NO: 109897 - RNA, 19 nt, Homo sapiens
caugauauuugcuaagcua

SEQ ID NO: 109898 - RNA, 19 nt, Homo sapiens
gaaaaugccagaaguauga

SEQ ID NO: 109899 - RNA, 19 nt, Homo sapiens
gaugguggauuacaaugga

SEQ ID NO: 109900 - RNA, 19 nt, Homo sapiens
agaaguaugaugcaucuua

SEQ ID NO: 109901 - RNA, 19 nt, Homo sapiens
gaaguaugaugcaucuuac

SEQ ID NO: 109902 - RNA, 19 nt, Homo sapiens
gcugucgccuuuauuuauu

SEQ ID NO: 109903 - RNA, 19 nt, Homo sapiens
guagagguccaugauauuu

SEQ ID NO: 109904 - RNA, 19 nt, Homo sapiens
uaacugcccaccagcauuu

SEQ ID NO: 109905 - RNA, 19 nt, Homo sapiens
uaacuuuccuggacuugga

SEQ ID NO: 109906 - RNA, 19 nt, Homo sapiens
ggauuacaauggaaacauc

SEQ ID NO: 109907 - RNA, 19 nt, Homo sapiens
cuaggugugucuaagagua

SEQ ID NO: 109908 - RNA, 19 nt, Homo sapiens
gggcgaagauggcuuacca

SEQ ID NO: 109909 - RNA, 19 nt, Homo sapiens
gcagggagugugucaaguu

SEQ ID NO: 109910 - RNA, 19 nt, Homo sapiens
caugauauuugugcacauu

SEQ ID NO: 109911 - RNA, 19 nt, Homo sapiens
ggaaaugaaacauggcaau

SEQ ID NO: 109912 - RNA, 19 nt, Homo sapiens
ccagaaguaugaugcaucu

SEQ ID NO: 109913 - RNA, 19 nt, Homo sapiens
aaggagagccggucagauu

SEQ ID NO: 109914 - RNA, 19 nt, Homo sapiens
gcugggcuguccaucauug

SEQ ID NO: 109915 - RNA, 19 nt, Homo sapiens
gaacguucuucgaaauaac

SEQ ID NO: 109916 - RNA, 19 nt, Homo sapiens
caagggagaaccagggaaa

SEQ ID NO: 109917 - RNA, 19 nt, Homo sapiens
gguccaugauauuugcuaa

SEQ ID NO: 109918 - RNA, 19 nt, Homo sapiens
cuggcuagcucauguguga

SEQ ID NO: 109919 - RNA, 19 nt, Homo sapiens
gggagugugucaaguuaca

SEQ ID NO: 109920 - RNA, 19 nt, Homo sapiens
ggaagcaggacuagaugga

SEQ ID NO: 109921 - RNA, 19 nt, Homo sapiens
gauauuugcuaagcuaggu

SEQ ID NO: 109922 - RNA, 19 nt, Homo sapiens
caaggcugcuggaacaagu

SEQ ID NO: 109923 - RNA, 19 nt, Homo sapiens
guauaagccuaugucucua

SEQ ID NO: 109924 - RNA, 19 nt, Homo sapiens
ggauaagggagaccaagga

SEQ ID NO: 109925 - RNA, 19 nt, Homo sapiens
acccggagcuucagguuug

SEQ ID NO: 109926 - RNA, 19 nt, Homo sapiens
gggagaagcaggugucgau

SEQ ID NO: 109927 - RNA, 19 nt, Homo sapiens
auaucaaccucuucccuuu

SEQ ID NO: 109928 - RNA, 19 nt, Homo sapiens
acaauggaaacaucaauga

SEQ ID NO: 109929 - RNA, 19 nt, Homo sapiens
ggagaacagggaccagaug

SEQ ID NO: 109930 - RNA, 19 nt, Homo sapiens
gaaaggagagaugguggau

SEQ ID NO: 109931 - RNA, 19 nt, Homo sapiens
caguuuggauagagccuuu

SEQ ID NO: 109932 - RNA, 19 nt, Homo sapiens
ggugcuggcuagcucaugu

SEQ ID NO: 109933 - RNA, 19 nt, Homo sapiens
uguauaagccuaugucucu

SEQ ID NO: 109934 - RNA, 19 nt, Homo sapiens
gcugcugccucuccucaau

SEQ ID NO: 109935 - RNA, 19 nt, Homo sapiens
cuagagguuucccuggauu

SEQ ID NO: 109936 - RNA, 19 nt, Homo sapiens
gcaaauggagacggcuauu

SEQ ID NO: 109937 - RNA, 19 nt, Homo sapiens
ggucguaaugucugcauga

SEQ ID NO: 109938 - RNA, 19 nt, Homo sapiens
aagccuaugucucuaauac

SEQ ID NO: 109939 - RNA, 19 nt, Homo sapiens
gaaaggcuuccagggagaa

SEQ ID NO: 109940 - RNA, 19 nt, Homo sapiens
gcggcugucgccuuuauuu

SEQ ID NO: 109941 - RNA, 19 nt, Homo sapiens
gcagcugggcuuccugguu

SEQ ID NO: 109942 - RNA, 19 nt, Homo sapiens
uauaagccuaugucucuaa

SEQ ID NO: 109943 - RNA, 19 nt, Homo sapiens
cuuggaacguucuucgaaa

SEQ ID NO: 109944 - RNA, 19 nt, Homo sapiens
guguguguguuuguacaua

SEQ ID NO: 109945 - RNA, 19 nt, Homo sapiens
gaaagacugggcggagaga

SEQ ID NO: 109946 - RNA, 19 nt, Homo sapiens
auguagagguccaugauau

SEQ ID NO: 109947 - RNA, 19 nt, Homo sapiens
uaaauguagagguccauga

SEQ ID NO: 109948 - RNA, 19 nt, Homo sapiens
gggaagaaaggcucuagag

SEQ ID NO: 109949 - RNA, 19 nt, Homo sapiens
ggagagaugguggauuaca

SEQ ID NO: 109950 - RNA, 19 nt, Homo sapiens
ggcugucgccuuuauuuau

SEQ ID NO: 109951 - RNA, 19 nt, Homo sapiens
ccucuccuacugcuaauuu

SEQ ID NO: 109952 - RNA, 19 nt, Homo sapiens
uaagcuaggugugucuaag

SEQ ID NO: 109953 - RNA, 19 nt, Homo sapiens
uggaacguucuucgaaaua

SEQ ID NO: 109954 - RNA, 19 nt, Homo sapiens
cggcugucgccuuuauuua

SEQ ID NO: 109955 - RNA, 19 nt, Homo sapiens
uagcucaugugugaauuca

SEQ ID NO: 109956 - RNA, 19 nt, Homo sapiens
cagaaaauaucaaccucuu

SEQ ID NO: 109957 - RNA, 19 nt, Homo sapiens
guaugaugcaucuuacaga

SEQ ID NO: 109958 - RNA, 19 nt, Homo sapiens
gcguggagcagcuggagaa

SEQ ID NO: 109959 - RNA, 19 nt, Homo sapiens
gaugcuggcaacuccauug

SEQ ID NO: 109960 - RNA, 19 nt, Homo sapiens
guaacugcccaccagcauu

SEQ ID NO: 109961 - RNA, 19 nt, Homo sapiens
gggacuacccggagcuuca

SEQ ID NO: 109962 - RNA, 19 nt, Homo sapiens
uggagcagcuggagaacag

SEQ ID NO: 109963 - RNA, 19 nt, Homo sapiens
aaaugaaacauggcaauuc

SEQ ID NO: 109964 - RNA, 19 nt, Homo sapiens
ggucuuccugggcaaauug

SEQ ID NO: 109965 - RNA, 19 nt, Homo sapiens
gagaugguggauuacaaug

SEQ ID NO: 109966 - RNA, 19 nt, Homo sapiens
gggagaaccagggaaagga

SEQ ID NO: 109967 - RNA, 19 nt, Homo sapiens
gagccaggccagcauccaa

SEQ ID NO: 109968 - RNA, 19 nt, Homo sapiens
ggauuuccgggucccauug

SEQ ID NO: 109969 - RNA, 19 nt, Homo sapiens
uagcggagcgcacccacaa

SEQ ID NO: 109970 - RNA, 19 nt, Homo sapiens
gcuagcucaugugugaauu

SEQ ID NO: 109971 - RNA, 19 nt, Homo sapiens
guaaugucugcaugauauu

SEQ ID NO: 109972 - RNA, 19 nt, Homo sapiens
uggauuggccugugugugu

SEQ ID NO: 109973 - RNA, 19 nt, Homo sapiens
ccaauuaccgcugguugug

SEQ ID NO: 109974 - RNA, 19 nt, Homo sapiens
aaaggagacccugggauga

SEQ ID NO: 109975 - RNA, 19 nt, Homo sapiens
gguacuccaggaccaauug

SEQ ID NO: 109976 - RNA, 19 nt, Homo sapiens
gaaccagggaaaggagaga

SEQ ID NO: 109977 - RNA, 19 nt, Homo sapiens
gagccagggaucccaggaa

SEQ ID NO: 109978 - RNA, 19 nt, Homo sapiens
uguagagguccaugauauu

SEQ ID NO: 109979 - RNA, 19 nt, Homo sapiens
gauuacaauggaaacauca

SEQ ID NO: 109980 - RNA, 19 nt, Homo sapiens
gaaggagagccggucagau

SEQ ID NO: 109981 - RNA, 19 nt, Homo sapiens
uagagguccaugauauuug

SEQ ID NO: 109982 - RNA, 19 nt, Homo sapiens
gaccaaggagcgccuggau

SEQ ID NO: 109983 - RNA, 19 nt, Homo sapiens
uuggaacguucuucgaaau

SEQ ID NO: 109984 - RNA, 19 nt, Homo sapiens
aaggagagaugguggauua

SEQ ID NO: 109985 - RNA, 19 nt, Homo sapiens
ccaaggagcgccuggauua

SEQ ID NO: 109986 - RNA, 19 nt, Homo sapiens
gaacaagugaugccucuaa

SEQ ID NO: 109987 - RNA, 19 nt, Homo sapiens
ggaacguucuucgaaauaa

SEQ ID NO: 109988 - RNA, 19 nt, Homo sapiens
cagcugggcuuccugguuu

SEQ ID NO: 109989 - RNA, 19 nt, Homo sapiens
cguaaugucugcaugauau

SEQ ID NO: 109990 - RNA, 19 nt, Homo sapiens
gcucugcgcuccagccaaa

SEQ ID NO: 109991 - RNA, 19 nt, Homo sapiens
gcacauuuauuaaguaucg

SEQ ID NO: 109992 - RNA, 19 nt, Homo sapiens
ccaaagacaucuccaggau

SEQ ID NO: 109993 - RNA, 19 nt, Homo sapiens
gcagacacuugaagggaaa

SEQ ID NO: 109994 - RNA, 19 nt, Homo sapiens
cagggagugugucaaguua

SEQ ID NO: 109995 - RNA, 19 nt, Homo sapiens
gaaaugaaacauggcaauu

SEQ ID NO: 109996 - RNA, 19 nt, Homo sapiens
aaagggaccucgcgguaaa

SEQ ID NO: 109997 - RNA, 19 nt, Homo sapiens
gagagaugguggauuacaa

SEQ ID NO: 109998 - RNA, 19 nt, Homo sapiens
caugauauuugcuaagcua

SEQ ID NO: 109999 - RNA, 19 nt, Homo sapiens
gaaaaugccagaaguauga

SEQ ID NO: 110000 - RNA, 19 nt, Homo sapiens
gaugguggauuacaaugga

SEQ ID NO: 110001 - RNA, 19 nt, Homo sapiens
agaaguaugaugcaucuua

SEQ ID NO: 110002 - RNA, 19 nt, Homo sapiens
ccaaauaauugcccugaag

SEQ ID NO: 110003 - RNA, 19 nt, Homo sapiens
gaaguaugaugcaucuuac

SEQ ID NO: 110004 - RNA, 19 nt, Homo sapiens
gcugucgccuuuauuuauu

SEQ ID NO: 110005 - RNA, 19 nt, Homo sapiens
guagagguccaugauauuu

SEQ ID NO: 110006 - RNA, 19 nt, Homo sapiens
uaacugcccaccagcauuu

SEQ ID NO: 110007 - RNA, 19 nt, Homo sapiens
uaacuuuccuggacuugga

SEQ ID NO: 110008 - RNA, 19 nt, Homo sapiens
ggauuacaauggaaacauc

SEQ ID NO: 110009 - RNA, 19 nt, Homo sapiens
cuaggugugucuaagagua

SEQ ID NO: 110010 - RNA, 19 nt, Homo sapiens
gggcgaagauggcuuacca

SEQ ID NO: 110011 - RNA, 19 nt, Homo sapiens
gcagggagugugucaaguu

SEQ ID NO: 110012 - RNA, 19 nt, Homo sapiens
caugauauuugugcacauu

SEQ ID NO: 110013 - RNA, 19 nt, Homo sapiens
ggaaaugaaacauggcaau

SEQ ID NO: 110014 - RNA, 19 nt, Homo sapiens
ccagaaguaugaugcaucu

SEQ ID NO: 110015 - RNA, 19 nt, Homo sapiens
aaggagagccggucagauu

SEQ ID NO: 110016 - RNA, 19 nt, Homo sapiens
gcugggcuguccaucauug

SEQ ID NO: 110017 - RNA, 19 nt, Homo sapiens
gaacguucuucgaaauaac

SEQ ID NO: 110018 - RNA, 19 nt, Homo sapiens
caagggagaaccagggaaa

SEQ ID NO: 110019 - RNA, 19 nt, Homo sapiens
gguccaugauauuugcuaa

SEQ ID NO: 110020 - RNA, 19 nt, Homo sapiens
cuggcuagcucauguguga

SEQ ID NO: 110021 - RNA, 19 nt, Homo sapiens
gggagugugucaaguuaca

SEQ ID NO: 110022 - RNA, 19 nt, Homo sapiens
ggaagcaggacuagaugga

SEQ ID NO: 110023 - RNA, 19 nt, Homo sapiens
gauauuugcuaagcuaggu

SEQ ID NO: 110024 - RNA, 19 nt, Homo sapiens
caaggcugcuggaacaagu

SEQ ID NO: 110025 - RNA, 19 nt, Homo sapiens
guauaagccuaugucucua

SEQ ID NO: 110026 - RNA, 19 nt, Homo sapiens
ggauaagggagaccaagga

SEQ ID NO: 110027 - RNA, 19 nt, Homo sapiens
acccggagcuucagguuug

SEQ ID NO: 110028 - RNA, 19 nt, Homo sapiens
gggagaagcaggugucgau

SEQ ID NO: 110029 - RNA, 19 nt, Homo sapiens
auaucaaccucuucccuuu

SEQ ID NO: 110030 - RNA, 19 nt, Homo sapiens
acaauggaaacaucaauga

SEQ ID NO: 110031 - RNA, 19 nt, Homo sapiens
ggagaacagggaccagaug

SEQ ID NO: 110032 - RNA, 19 nt, Homo sapiens
gaaaggagagaugguggau

SEQ ID NO: 110033 - RNA, 19 nt, Homo sapiens
caguuuggauagagccuuu

SEQ ID NO: 110034 - RNA, 19 nt, Homo sapiens
ggugcuggcuagcucaugu

SEQ ID NO: 110035 - RNA, 19 nt, Homo sapiens
uguauaagccuaugucucu

SEQ ID NO: 110036 - RNA, 19 nt, Homo sapiens
gccaaauaauugcccugaa

SEQ ID NO: 110037 - RNA, 19 nt, Homo sapiens
gcgcuccagccaaauaauu

SEQ ID NO: 110038 - RNA, 19 nt, Homo sapiens
cuagagguuucccuggauu

SEQ ID NO: 110039 - RNA, 19 nt, Homo sapiens
gcaaauggagacggcuauu

SEQ ID NO: 110040 - RNA, 19 nt, Homo sapiens
ggucguaaugucugcauga

SEQ ID NO: 110041 - RNA, 19 nt, Homo sapiens
aagccuaugucucuaauac

SEQ ID NO: 110042 - RNA, 19 nt, Homo sapiens
gaaaggcuuccagggagaa

SEQ ID NO: 110043 - RNA, 19 nt, Homo sapiens
gcggcugucgccuuuauuu

SEQ ID NO: 110044 - RNA, 19 nt, Homo sapiens
gcagcugggcuuccugguu

SEQ ID NO: 110045 - RNA, 19 nt, Homo sapiens
uauaagccuaugucucuaa

SEQ ID NO: 110046 - RNA, 19 nt, Homo sapiens
guguguguguuuguacaua

SEQ ID NO: 110047 - RNA, 19 nt, Homo sapiens
cuuggaacguucuucgaaa

SEQ ID NO: 110048 - RNA, 19 nt, Homo sapiens
gaaagacugggcggagaga

SEQ ID NO: 110049 - RNA, 19 nt, Homo sapiens
auguagagguccaugauau

SEQ ID NO: 110050 - RNA, 19 nt, Homo sapiens
uaaauguagagguccauga

SEQ ID NO: 110051 - RNA, 19 nt, Homo sapiens
gggaagaaaggcucuagag

SEQ ID NO: 110052 - RNA, 19 nt, Homo sapiens
ggagagaugguggauuaca

SEQ ID NO: 110053 - RNA, 19 nt, Homo sapiens
ccucuccuacugcuaauuu

SEQ ID NO: 110054 - RNA, 19 nt, Homo sapiens
ggcugucgccuuuauuuau

SEQ ID NO: 110055 - RNA, 19 nt, Homo sapiens
uaagcuaggugugucuaag

SEQ ID NO: 110056 - RNA, 19 nt, Homo sapiens
uggaacguucuucgaaaua

SEQ ID NO: 110057 - RNA, 19 nt, Homo sapiens
cggcugucgccuuuauuua

SEQ ID NO: 110058 - RNA, 19 nt, Homo sapiens
uagcucaugugugaauuca

SEQ ID NO: 110059 - RNA, 19 nt, Homo sapiens
cagaaaauaucaaccucuu

SEQ ID NO: 110060 - RNA, 19 nt, Homo sapiens
guaugaugcaucuuacaga

SEQ ID NO: 110061 - RNA, 19 nt, Homo sapiens
gcguggagcagcuggagaa

SEQ ID NO: 110062 - RNA, 19 nt, Homo sapiens
gaugcuggcaacuccauug

SEQ ID NO: 110063 - RNA, 19 nt, Homo sapiens
guaacugcccaccagcauu

SEQ ID NO: 110064 - RNA, 19 nt, Homo sapiens
gggacuacccggagcuuca

SEQ ID NO: 110065 - RNA, 19 nt, Homo sapiens
uggagcagcuggagaacag

SEQ ID NO: 110066 - RNA, 19 nt, Homo sapiens
aaaugaaacauggcaauuc

SEQ ID NO: 110067 - RNA, 19 nt, Homo sapiens
ggucuuccugggcaaauug

SEQ ID NO: 110068 - RNA, 19 nt, Homo sapiens
gagaugguggauuacaaug

SEQ ID NO: 110069 - RNA, 19 nt, Homo sapiens
gggagaaccagggaaagga

SEQ ID NO: 110070 - RNA, 19 nt, Homo sapiens
gagccaggccagcauccaa

SEQ ID NO: 110071 - RNA, 19 nt, Homo sapiens
ggauuuccgggucccauug

SEQ ID NO: 110072 - RNA, 19 nt, Homo sapiens
uagcggagcgcacccacaa

SEQ ID NO: 110073 - RNA, 19 nt, Homo sapiens
gcuagcucaugugugaauu

SEQ ID NO: 110074 - RNA, 19 nt, Homo sapiens
guaaugucugcaugauauu

SEQ ID NO: 110075 - RNA, 19 nt, Homo sapiens
ccaauuaccgcugguugug

SEQ ID NO: 110076 - RNA, 19 nt, Homo sapiens
uggauuggccugugugugu

SEQ ID NO: 110077 - RNA, 19 nt, Homo sapiens
aaaggagacccugggauga

SEQ ID NO: 110078 - RNA, 19 nt, Homo sapiens
gguacuccaggaccaauug

SEQ ID NO: 110079 - RNA, 19 nt, Homo sapiens
ccacaccgggagugccuaa

SEQ ID NO: 110080 - RNA, 19 nt, Homo sapiens
gaaccagggaaaggagaga

SEQ ID NO: 110081 - RNA, 19 nt, Homo sapiens
gagccagggaucccaggaa

SEQ ID NO: 110082 - RNA, 19 nt, Homo sapiens
uguagagguccaugauauu

SEQ ID NO: 110083 - RNA, 19 nt, Homo sapiens
gauuacaauggaaacauca

SEQ ID NO: 110084 - RNA, 19 nt, Homo sapiens
aaggagagaugguggauua

SEQ ID NO: 110085 - RNA, 19 nt, Homo sapiens
ccaaggagcgccuggauua

SEQ ID NO: 110086 - RNA, 19 nt, Homo sapiens
gaacaagugaugccucuaa

SEQ ID NO: 110087 - RNA, 19 nt, Homo sapiens
ggaacguucuucgaaauaa

SEQ ID NO: 110088 - RNA, 19 nt, Homo sapiens
cagcugggcuuccugguuu

SEQ ID NO: 110089 - RNA, 19 nt, Homo sapiens
cguaaugucugcaugauau

SEQ ID NO: 110090 - RNA, 19 nt, Homo sapiens
gcucugcgcuccagccaaa

SEQ ID NO: 110091 - RNA, 19 nt, Homo sapiens
gcacauuuauuaaguaucg

SEQ ID NO: 110092 - RNA, 19 nt, Homo sapiens
ccaaagacaucuccaggau

SEQ ID NO: 110093 - RNA, 19 nt, Homo sapiens
gcagacacuugaagggaaa

SEQ ID NO: 110094 - RNA, 19 nt, Homo sapiens
cagggagugugucaaguua

SEQ ID NO: 110095 - RNA, 19 nt, Homo sapiens
gaaaugaaacauggcaauu

SEQ ID NO: 110096 - RNA, 19 nt, Homo sapiens
aaagggaccucgcgguaaa

SEQ ID NO: 110097 - RNA, 19 nt, Homo sapiens
gagagaugguggauuacaa

SEQ ID NO: 110098 - RNA, 19 nt, Homo sapiens
caugauauuugcuaagcua

SEQ ID NO: 110099 - RNA, 19 nt, Homo sapiens
gaaaaugccagaaguauga

SEQ ID NO: 110100 - RNA, 19 nt, Homo sapiens
gaugguggauuacaaugga

SEQ ID NO: 110101 - RNA, 19 nt, Homo sapiens
agaaguaugaugcaucuua

SEQ ID NO: 110102 - RNA, 19 nt, Homo sapiens
ccaaauaauugcccugaag

SEQ ID NO: 110103 - RNA, 19 nt, Homo sapiens
gaaguaugaugcaucuuac

SEQ ID NO: 110104 - RNA, 19 nt, Homo sapiens
gcugucgccuuuauuuauu

SEQ ID NO: 110105 - RNA, 19 nt, Homo sapiens
guagagguccaugauauuu

SEQ ID NO: 110106 - RNA, 19 nt, Homo sapiens
uaacugcccaccagcauuu

SEQ ID NO: 110107 - RNA, 19 nt, Homo sapiens
uaacuuuccuggacuugga

SEQ ID NO: 110108 - RNA, 19 nt, Homo sapiens
ggauuacaauggaaacauc

SEQ ID NO: 110109 - RNA, 19 nt, Homo sapiens
cuaggugugucuaagagua

SEQ ID NO: 110110 - RNA, 19 nt, Homo sapiens
gggcgaagauggcuuacca

SEQ ID NO: 110111 - RNA, 19 nt, Homo sapiens
gcagggagugugucaaguu

SEQ ID NO: 110112 - RNA, 19 nt, Homo sapiens
caugauauuugugcacauu

SEQ ID NO: 110113 - RNA, 19 nt, Homo sapiens
ggaaaugaaacauggcaau

SEQ ID NO: 110114 - RNA, 19 nt, Homo sapiens
ccagaaguaugaugcaucu

SEQ ID NO: 110115 - RNA, 19 nt, Homo sapiens
aaggagagccggucagauu

SEQ ID NO: 110116 - RNA, 19 nt, Homo sapiens
gcugggcuguccaucauug

SEQ ID NO: 110117 - RNA, 19 nt, Homo sapiens
gaacguucuucgaaauaac

SEQ ID NO: 110118 - RNA, 19 nt, Homo sapiens
caagggagaaccagggaaa

SEQ ID NO: 110119 - RNA, 19 nt, Homo sapiens
gguccaugauauuugcuaa

SEQ ID NO: 110120 - RNA, 19 nt, Homo sapiens
cuggcuagcucauguguga

SEQ ID NO: 110121 - RNA, 19 nt, Homo sapiens
gggagugugucaaguuaca

SEQ ID NO: 110122 - RNA, 19 nt, Homo sapiens
ggaagcaggacuagaugga

SEQ ID NO: 110123 - RNA, 19 nt, Homo sapiens
gauauuugcuaagcuaggu

SEQ ID NO: 110124 - RNA, 19 nt, Homo sapiens
caaggcugcuggaacaagu

SEQ ID NO: 110125 - RNA, 19 nt, Homo sapiens
guauaagccuaugucucua

SEQ ID NO: 110126 - RNA, 19 nt, Homo sapiens
ggauaagggagaccaagga

SEQ ID NO: 110127 - RNA, 19 nt, Homo sapiens
acccggagcuucagguuug

SEQ ID NO: 110128 - RNA, 19 nt, Homo sapiens
gggagaagcaggugucgau

SEQ ID NO: 110129 - RNA, 19 nt, Homo sapiens
auaucaaccucuucccuuu

SEQ ID NO: 110130 - RNA, 19 nt, Homo sapiens
acaauggaaacaucaauga

SEQ ID NO: 110131 - RNA, 19 nt, Homo sapiens
ggagaacagggaccagaug

SEQ ID NO: 110132 - RNA, 19 nt, Homo sapiens
gaaaggagagaugguggau

SEQ ID NO: 110133 - RNA, 19 nt, Homo sapiens
caguuuggauagagccuuu

SEQ ID NO: 110134 - RNA, 19 nt, Homo sapiens
ggugcuggcuagcucaugu

SEQ ID NO: 110135 - RNA, 19 nt, Homo sapiens
uguauaagccuaugucucu

SEQ ID NO: 110136 - RNA, 19 nt, Homo sapiens
gcugcugccucuccucaau

SEQ ID NO: 110137 - RNA, 19 nt, Homo sapiens
gccaaauaauugcccugaa

SEQ ID NO: 110138 - RNA, 19 nt, Homo sapiens
gcgcuccagccaaauaauu

SEQ ID NO: 110139 - RNA, 19 nt, Homo sapiens
cuagagguuucccuggauu

SEQ ID NO: 110140 - RNA, 19 nt, Homo sapiens
gcaaauggagacggcuauu

SEQ ID NO: 110141 - RNA, 19 nt, Homo sapiens
ggucguaaugucugcauga

SEQ ID NO: 110142 - RNA, 19 nt, Homo sapiens
aagccuaugucucuaauac

SEQ ID NO: 110143 - RNA, 19 nt, Homo sapiens
gaaaggcuuccagggagaa

SEQ ID NO: 110144 - RNA, 19 nt, Homo sapiens
gcggcugucgccuuuauuu

SEQ ID NO: 110145 - RNA, 19 nt, Homo sapiens
gcagcugggcuuccugguu

SEQ ID NO: 110146 - RNA, 19 nt, Homo sapiens
uauaagccuaugucucuaa

SEQ ID NO: 110147 - RNA, 19 nt, Homo sapiens
guguguguguuuguacaua

SEQ ID NO: 110148 - RNA, 19 nt, Homo sapiens
cuuggaacguucuucgaaa

SEQ ID NO: 110149 - RNA, 19 nt, Homo sapiens
gaaagacugggcggagaga

SEQ ID NO: 110150 - RNA, 19 nt, Homo sapiens
auguagagguccaugauau

SEQ ID NO: 110151 - RNA, 19 nt, Homo sapiens
uaaauguagagguccauga

SEQ ID NO: 110152 - RNA, 19 nt, Homo sapiens
gggaagaaaggcucuagag

SEQ ID NO: 110153 - RNA, 19 nt, Homo sapiens
ccucuccuacugcuaauuu

SEQ ID NO: 110154 - RNA, 19 nt, Homo sapiens
ggagagaugguggauuaca

SEQ ID NO: 110155 - RNA, 19 nt, Homo sapiens
ggcugucgccuuuauuuau

SEQ ID NO: 110156 - RNA, 19 nt, Homo sapiens
uaagcuaggugugucuaag

SEQ ID NO: 110157 - RNA, 19 nt, Homo sapiens
uggaacguucuucgaaaua

SEQ ID NO: 110158 - RNA, 19 nt, Homo sapiens
cggcugucgccuuuauuua

SEQ ID NO: 110159 - RNA, 19 nt, Homo sapiens
uagcucaugugugaauuca

SEQ ID NO: 110160 - RNA, 19 nt, Homo sapiens
cagaaaauaucaaccucuu

SEQ ID NO: 110161 - RNA, 19 nt, Homo sapiens
guaugaugcaucuuacaga

SEQ ID NO: 110162 - RNA, 19 nt, Homo sapiens
gcguggagcagcuggagaa

SEQ ID NO: 110163 - RNA, 19 nt, Homo sapiens
gaugcuggcaacuccauug

SEQ ID NO: 110164 - RNA, 19 nt, Homo sapiens
guaacugcccaccagcauu

SEQ ID NO: 110165 - RNA, 19 nt, Homo sapiens
gggacuacccggagcuuca

SEQ ID NO: 110166 - RNA, 19 nt, Homo sapiens
uggagcagcuggagaacag

SEQ ID NO: 110167 - RNA, 19 nt, Homo sapiens
aaaugaaacauggcaauuc

SEQ ID NO: 110168 - RNA, 19 nt, Homo sapiens
ggucuuccugggcaaauug

SEQ ID NO: 110169 - RNA, 19 nt, Homo sapiens
gagaugguggauuacaaug

SEQ ID NO: 110170 - RNA, 19 nt, Homo sapiens
gggagaaccagggaaagga

SEQ ID NO: 110171 - RNA, 19 nt, Homo sapiens
gagccaggccagcauccaa

SEQ ID NO: 110172 - RNA, 19 nt, Homo sapiens
ggauuuccgggucccauug

SEQ ID NO: 110173 - RNA, 19 nt, Homo sapiens
uagcggagcgcacccacaa

SEQ ID NO: 110174 - RNA, 19 nt, Homo sapiens
gcuagcucaugugugaauu

SEQ ID NO: 110175 - RNA, 19 nt, Homo sapiens
guaaugucugcaugauauu

SEQ ID NO: 110176 - RNA, 19 nt, Homo sapiens
ccaauuaccgcugguugug

SEQ ID NO: 110177 - RNA, 19 nt, Homo sapiens
uggauuggccugugugugu

SEQ ID NO: 110178 - RNA, 19 nt, Homo sapiens
aaaggagacccugggauga

SEQ ID NO: 110179 - RNA, 19 nt, Homo sapiens
gguacuccaggaccaauug

SEQ ID NO: 110180 - RNA, 19 nt, Homo sapiens
ccacaccgggagugccuaa

SEQ ID NO: 110181 - RNA, 19 nt, Homo sapiens
gaaccagggaaaggagaga

SEQ ID NO: 110182 - RNA, 19 nt, Homo sapiens
gagccagggaucccaggaa

SEQ ID NO: 110183 - RNA, 19 nt, Homo sapiens
uguagagguccaugauauu

SEQ ID NO: 110184 - RNA, 19 nt, Homo sapiens
aaggagagaugguggauua

SEQ ID NO: 110185 - RNA, 19 nt, Homo sapiens
ccaaggagcgccuggauua

SEQ ID NO: 110186 - RNA, 19 nt, Homo sapiens
gaacaagugaugccucuaa

SEQ ID NO: 110187 - RNA, 19 nt, Homo sapiens
ggaacguucuucgaaauaa

SEQ ID NO: 110188 - RNA, 19 nt, Homo sapiens
cagcugggcuuccugguuu

SEQ ID NO: 110189 - RNA, 19 nt, Homo sapiens
cguaaugucugcaugauau

SEQ ID NO: 110190 - RNA, 19 nt, Homo sapiens
gcucugcgcuccagccaaa

SEQ ID NO: 110191 - RNA, 19 nt, Homo sapiens
gcacauuuauuaaguaucg

SEQ ID NO: 110192 - RNA, 19 nt, Homo sapiens
ccaaagacaucuccaggau

SEQ ID NO: 110193 - RNA, 19 nt, Homo sapiens
gcagacacuugaagggaaa

SEQ ID NO: 110194 - RNA, 19 nt, Homo sapiens
cagggagugugucaaguua

SEQ ID NO: 110195 - RNA, 19 nt, Homo sapiens
gaaaugaaacauggcaauu

SEQ ID NO: 110196 - RNA, 19 nt, Homo sapiens
aaagggaccucgcgguaaa

SEQ ID NO: 110197 - RNA, 19 nt, Homo sapiens
gagagaugguggauuacaa

SEQ ID NO: 110198 - RNA, 19 nt, Homo sapiens
caugauauuugcuaagcua

SEQ ID NO: 110199 - RNA, 19 nt, Homo sapiens
gaaaaugccagaaguauga

SEQ ID NO: 110200 - RNA, 19 nt, Homo sapiens
gaugguggauuacaaugga

SEQ ID NO: 110201 - RNA, 19 nt, Homo sapiens
agaaguaugaugcaucuua

SEQ ID NO: 110202 - RNA, 19 nt, Homo sapiens
ccaaauaauugcccugaag

SEQ ID NO: 110203 - RNA, 19 nt, Homo sapiens
gaaguaugaugcaucuuac

SEQ ID NO: 110204 - RNA, 19 nt, Homo sapiens
gcugucgccuuuauuuauu

SEQ ID NO: 110205 - RNA, 19 nt, Homo sapiens
guagagguccaugauauuu

SEQ ID NO: 110206 - RNA, 19 nt, Homo sapiens
uaacugcccaccagcauuu

SEQ ID NO: 110207 - RNA, 19 nt, Homo sapiens
uaacuuuccuggacuugga

SEQ ID NO: 110208 - RNA, 19 nt, Homo sapiens
ggauuacaauggaaacauc

SEQ ID NO: 110209 - RNA, 19 nt, Homo sapiens
cuaggugugucuaagagua

SEQ ID NO: 110210 - RNA, 19 nt, Homo sapiens
gggcgaagauggcuuacca

SEQ ID NO: 110211 - RNA, 19 nt, Homo sapiens
gcagggagugugucaaguu

SEQ ID NO: 110212 - RNA, 19 nt, Homo sapiens
caugauauuugugcacauu

SEQ ID NO: 110213 - RNA, 19 nt, Homo sapiens
ggaaaugaaacauggcaau

SEQ ID NO: 110214 - RNA, 19 nt, Homo sapiens
ccagaaguaugaugcaucu

SEQ ID NO: 110215 - RNA, 19 nt, Homo sapiens
aaggagagccggucagauu

SEQ ID NO: 110216 - RNA, 19 nt, Homo sapiens
gcugggcuguccaucauug

SEQ ID NO: 110217 - RNA, 19 nt, Homo sapiens
gaacguucuucgaaauaac

SEQ ID NO: 110218 - RNA, 19 nt, Homo sapiens
caagggagaaccagggaaa

SEQ ID NO: 110219 - RNA, 19 nt, Homo sapiens
gguccaugauauuugcuaa

SEQ ID NO: 110220 - RNA, 19 nt, Homo sapiens
cuggcuagcucauguguga

SEQ ID NO: 110221 - RNA, 19 nt, Homo sapiens
gggagugugucaaguuaca

SEQ ID NO: 110222 - RNA, 19 nt, Homo sapiens
ggaagcaggacuagaugga

SEQ ID NO: 110223 - RNA, 19 nt, Homo sapiens
gauauuugcuaagcuaggu

SEQ ID NO: 110224 - RNA, 19 nt, Homo sapiens
caaggcugcuggaacaagu

SEQ ID NO: 110225 - RNA, 19 nt, Homo sapiens
guauaagccuaugucucua

SEQ ID NO: 110226 - RNA, 19 nt, Homo sapiens
ggauaagggagaccaagga

SEQ ID NO: 110227 - RNA, 19 nt, Homo sapiens
acccggagcuucagguuug

SEQ ID NO: 110228 - RNA, 19 nt, Homo sapiens
gggagaagcaggugucgau

SEQ ID NO: 110229 - RNA, 19 nt, Homo sapiens
auaucaaccucuucccuuu

SEQ ID NO: 110230 - RNA, 19 nt, Homo sapiens
acaauggaaacaucaauga

SEQ ID NO: 110231 - RNA, 19 nt, Homo sapiens
ggagaacagggaccagaug

SEQ ID NO: 110232 - RNA, 19 nt, Homo sapiens
gaaaggagagaugguggau

SEQ ID NO: 110233 - RNA, 19 nt, Homo sapiens
caguuuggauagagccuuu

SEQ ID NO: 110234 - RNA, 19 nt, Homo sapiens
ggugcuggcuagcucaugu

SEQ ID NO: 110235 - RNA, 19 nt, Homo sapiens
uguauaagccuaugucucu

SEQ ID NO: 110236 - RNA, 19 nt, Homo sapiens
gcugcugccucuccucaau

SEQ ID NO: 110237 - RNA, 19 nt, Homo sapiens
gccaaauaauugcccugaa

SEQ ID NO: 110238 - RNA, 19 nt, Homo sapiens
gcgcuccagccaaauaauu

SEQ ID NO: 110239 - RNA, 19 nt, Homo sapiens
cuagagguuucccuggauu

SEQ ID NO: 110240 - RNA, 19 nt, Homo sapiens
gcaaauggagacggcuauu

SEQ ID NO: 110241 - RNA, 19 nt, Homo sapiens
ggucguaaugucugcauga

SEQ ID NO: 110242 - RNA, 19 nt, Homo sapiens
aagccuaugucucuaauac

SEQ ID NO: 110243 - RNA, 19 nt, Homo sapiens
gaaaggcuuccagggagaa

SEQ ID NO: 110244 - RNA, 19 nt, Homo sapiens
gcggcugucgccuuuauuu

SEQ ID NO: 110245 - RNA, 19 nt, Homo sapiens
gcagcugggcuuccugguu

SEQ ID NO: 110246 - RNA, 19 nt, Homo sapiens
uauaagccuaugucucuaa

SEQ ID NO: 110247 - RNA, 19 nt, Homo sapiens
guguguguguuuguacaua

SEQ ID NO: 110248 - RNA, 19 nt, Homo sapiens
cuuggaacguucuucgaaa

SEQ ID NO: 110249 - RNA, 19 nt, Homo sapiens
gaaagacugggcggagaga

SEQ ID NO: 110250 - RNA, 19 nt, Homo sapiens
auguagagguccaugauau

SEQ ID NO: 110251 - RNA, 19 nt, Homo sapiens
uaaauguagagguccauga

SEQ ID NO: 110252 - RNA, 19 nt, Homo sapiens
gggaagaaaggcucuagag

SEQ ID NO: 110253 - RNA, 19 nt, Homo sapiens
ccucuccuacugcuaauuu

SEQ ID NO: 110254 - RNA, 19 nt, Homo sapiens
ggagagaugguggauuaca

SEQ ID NO: 110255 - RNA, 19 nt, Homo sapiens
ggcugucgccuuuauuuau

SEQ ID NO: 110256 - RNA, 19 nt, Homo sapiens
uaagcuaggugugucuaag

SEQ ID NO: 110257 - RNA, 19 nt, Homo sapiens
uggaacguucuucgaaaua

SEQ ID NO: 110258 - RNA, 19 nt, Homo sapiens
cggcugucgccuuuauuua

SEQ ID NO: 110259 - RNA, 19 nt, Homo sapiens
uagcucaugugugaauuca

SEQ ID NO: 110260 - RNA, 19 nt, Homo sapiens
cagaaaauaucaaccucuu

SEQ ID NO: 110261 - RNA, 19 nt, Homo sapiens
guaugaugcaucuuacaga

SEQ ID NO: 110262 - RNA, 19 nt, Homo sapiens
gcguggagcagcuggagaa

SEQ ID NO: 110263 - RNA, 19 nt, Homo sapiens
gaugcuggcaacuccauug

SEQ ID NO: 110264 - RNA, 19 nt, Homo sapiens
guaacugcccaccagcauu

SEQ ID NO: 110265 - RNA, 19 nt, Homo sapiens
gggacuacccggagcuuca

SEQ ID NO: 110266 - RNA, 19 nt, Homo sapiens
uggagcagcuggagaacag

SEQ ID NO: 110267 - RNA, 19 nt, Homo sapiens
aaaugaaacauggcaauuc

SEQ ID NO: 110268 - RNA, 19 nt, Homo sapiens
ggucuuccugggcaaauug

SEQ ID NO: 110269 - RNA, 19 nt, Homo sapiens
gagaugguggauuacaaug

SEQ ID NO: 110270 - RNA, 19 nt, Homo sapiens
gggagaaccagggaaagga

SEQ ID NO: 110271 - RNA, 19 nt, Homo sapiens
gagccaggccagcauccaa

SEQ ID NO: 110272 - RNA, 19 nt, Homo sapiens
ggauuuccgggucccauug

SEQ ID NO: 110273 - RNA, 19 nt, Homo sapiens
uagcggagcgcacccacaa

SEQ ID NO: 110274 - RNA, 19 nt, Homo sapiens
gcuagcucaugugugaauu

SEQ ID NO: 110275 - RNA, 19 nt, Homo sapiens
guaaugucugcaugauauu

SEQ ID NO: 110276 - RNA, 19 nt, Homo sapiens
ccaauuaccgcugguugug

SEQ ID NO: 110277 - RNA, 19 nt, Homo sapiens
uggauuggccugugugugu

SEQ ID NO: 110278 - RNA, 19 nt, Homo sapiens
aaaggagacccugggauga

SEQ ID NO: 110279 - RNA, 19 nt, Homo sapiens
gguacuccaggaccaauug

SEQ ID NO: 110280 - RNA, 19 nt, Homo sapiens
ccacaccgggagugccuaa

SEQ ID NO: 110281 - RNA, 19 nt, Homo sapiens
gaaccagggaaaggagaga

SEQ ID NO: 110282 - RNA, 19 nt, Homo sapiens
gagccagggaucccaggaa

SEQ ID NO: 110283 - RNA, 19 nt, Homo sapiens
uguagagguccaugauauu

SEQ ID NO: 110284 - RNA, 19 nt, Homo sapiens
aaggagagaugguggauua

SEQ ID NO: 110285 - RNA, 19 nt, Homo sapiens
ccaaggagcgccuggauua

SEQ ID NO: 110286 - RNA, 19 nt, Homo sapiens
gaacaagugaugccucuaa

SEQ ID NO: 110287 - RNA, 19 nt, Homo sapiens
ggaacguucuucgaaauaa

SEQ ID NO: 110288 - RNA, 19 nt, Homo sapiens
cagcugggcuuccugguuu

SEQ ID NO: 110289 - RNA, 19 nt, Homo sapiens
cguaaugucugcaugauau

SEQ ID NO: 110290 - RNA, 19 nt, Homo sapiens
gcucugcgcuccagccaaa

SEQ ID NO: 110291 - RNA, 19 nt, Homo sapiens
gcacauuuauuaaguaucg

SEQ ID NO: 110292 - RNA, 19 nt, Homo sapiens
ccaaagacaucuccaggau

SEQ ID NO: 110293 - RNA, 19 nt, Homo sapiens
gcagacacuugaagggaaa

SEQ ID NO: 110294 - RNA, 19 nt, Homo sapiens
cagggagugugucaaguua

SEQ ID NO: 110295 - RNA, 19 nt, Homo sapiens
gaaaugaaacauggcaauu

SEQ ID NO: 110296 - RNA, 19 nt, Homo sapiens
aaagggaccucgcgguaaa

SEQ ID NO: 110297 - RNA, 19 nt, Homo sapiens
gagagaugguggauuacaa

SEQ ID NO: 110298 - RNA, 19 nt, Homo sapiens
caugauauuugcuaagcua

SEQ ID NO: 110299 - RNA, 19 nt, Homo sapiens
gaaaaugccagaaguauga

SEQ ID NO: 110300 - RNA, 19 nt, Homo sapiens
gaugguggauuacaaugga

SEQ ID NO: 110301 - RNA, 19 nt, Homo sapiens
agaaguaugaugcaucuua

SEQ ID NO: 110302 - RNA, 19 nt, Homo sapiens
ccaaauaauugcccugaag

SEQ ID NO: 110303 - RNA, 19 nt, Homo sapiens
gaaguaugaugcaucuuac

SEQ ID NO: 110304 - RNA, 19 nt, Homo sapiens
gcugucgccuuuauuuauu

SEQ ID NO: 110305 - RNA, 19 nt, Homo sapiens
guagagguccaugauauuu

SEQ ID NO: 110306 - RNA, 19 nt, Homo sapiens
uaacugcccaccagcauuu

SEQ ID NO: 110307 - RNA, 19 nt, Homo sapiens
uaacuuuccuggacuugga

SEQ ID NO: 110308 - RNA, 19 nt, Homo sapiens
ggauuacaauggaaacauc

SEQ ID NO: 110309 - RNA, 19 nt, Homo sapiens
cuaggugugucuaagagua

SEQ ID NO: 110310 - RNA, 19 nt, Homo sapiens
gggcgaagauggcuuacca

SEQ ID NO: 110311 - RNA, 19 nt, Homo sapiens
gcagggagugugucaaguu

SEQ ID NO: 110312 - RNA, 19 nt, Homo sapiens
caugauauuugugcacauu

SEQ ID NO: 110313 - RNA, 19 nt, Homo sapiens
ggaaaugaaacauggcaau

SEQ ID NO: 110314 - RNA, 19 nt, Homo sapiens
ccagaaguaugaugcaucu

SEQ ID NO: 110315 - RNA, 19 nt, Homo sapiens
aaggagagccggucagauu

SEQ ID NO: 110316 - RNA, 19 nt, Homo sapiens
gcugggcuguccaucauug

SEQ ID NO: 110317 - RNA, 19 nt, Homo sapiens
gaacguucuucgaaauaac

SEQ ID NO: 110318 - RNA, 19 nt, Homo sapiens
caagggagaaccagggaaa

SEQ ID NO: 110319 - RNA, 19 nt, Homo sapiens
gguccaugauauuugcuaa

SEQ ID NO: 110320 - RNA, 19 nt, Homo sapiens
cuggcuagcucauguguga

SEQ ID NO: 110321 - RNA, 19 nt, Homo sapiens
gggagugugucaaguuaca

SEQ ID NO: 110322 - RNA, 19 nt, Homo sapiens
ggaagcaggacuagaugga

SEQ ID NO: 110323 - RNA, 19 nt, Homo sapiens
gauauuugcuaagcuaggu

SEQ ID NO: 110324 - RNA, 19 nt, Homo sapiens
caaggcugcuggaacaagu

SEQ ID NO: 110325 - RNA, 19 nt, Homo sapiens
guauaagccuaugucucua

SEQ ID NO: 110326 - RNA, 19 nt, Homo sapiens
ggauaagggagaccaagga

SEQ ID NO: 110327 - RNA, 19 nt, Homo sapiens
gggagaagcaggugucgau

SEQ ID NO: 110328 - RNA, 19 nt, Homo sapiens
auaucaaccucuucccuuu

SEQ ID NO: 110329 - RNA, 19 nt, Homo sapiens
acaauggaaacaucaauga

SEQ ID NO: 110330 - RNA, 19 nt, Homo sapiens
ggagaacagggaccagaug

SEQ ID NO: 110331 - RNA, 19 nt, Homo sapiens
gaaaggagagaugguggau

SEQ ID NO: 110332 - RNA, 19 nt, Homo sapiens
caguuuggauagagccuuu

SEQ ID NO: 110333 - RNA, 19 nt, Homo sapiens
ggugcuggcuagcucaugu

SEQ ID NO: 110334 - RNA, 19 nt, Homo sapiens
uguauaagccuaugucucu

SEQ ID NO: 110335 - RNA, 19 nt, Homo sapiens
gcugcugccucuccucaau

SEQ ID NO: 110336 - RNA, 19 nt, Homo sapiens
gccaaauaauugcccugaa

SEQ ID NO: 110337 - RNA, 19 nt, Homo sapiens
gcgcuccagccaaauaauu

SEQ ID NO: 110338 - RNA, 19 nt, Homo sapiens
cuagagguuucccuggauu

SEQ ID NO: 110339 - RNA, 19 nt, Homo sapiens
gcaaauggagacggcuauu

SEQ ID NO: 110340 - RNA, 19 nt, Homo sapiens
ggucguaaugucugcauga

SEQ ID NO: 110341 - RNA, 19 nt, Homo sapiens
aagccuaugucucuaauac

SEQ ID NO: 110342 - RNA, 19 nt, Homo sapiens
gaaaggcuuccagggagaa

SEQ ID NO: 110343 - RNA, 19 nt, Homo sapiens
gcggcugucgccuuuauuu

SEQ ID NO: 110344 - RNA, 19 nt, Homo sapiens
gcagcugggcuuccugguu

SEQ ID NO: 110345 - RNA, 19 nt, Homo sapiens
uauaagccuaugucucuaa

SEQ ID NO: 110346 - RNA, 19 nt, Homo sapiens
guguguguguuuguacaua

SEQ ID NO: 110347 - RNA, 19 nt, Homo sapiens
cuuggaacguucuucgaaa

SEQ ID NO: 110348 - RNA, 19 nt, Homo sapiens
gaaagacugggcggagaga

SEQ ID NO: 110349 - RNA, 19 nt, Homo sapiens
auguagagguccaugauau

SEQ ID NO: 110350 - RNA, 19 nt, Homo sapiens
uaaauguagagguccauga

SEQ ID NO: 110351 - RNA, 19 nt, Homo sapiens
gggaagaaaggcucuagag

SEQ ID NO: 110352 - RNA, 19 nt, Homo sapiens
ggagagaugguggauuaca

SEQ ID NO: 110353 - RNA, 19 nt, Homo sapiens
ccucuccuacugcuaauuu

SEQ ID NO: 110354 - RNA, 19 nt, Homo sapiens
ggcugucgccuuuauuuau

SEQ ID NO: 110355 - RNA, 19 nt, Homo sapiens
uaagcuaggugugucuaag

SEQ ID NO: 110356 - RNA, 19 nt, Homo sapiens
uggaacguucuucgaaaua

SEQ ID NO: 110357 - RNA, 19 nt, Homo sapiens
cggcugucgccuuuauuua

SEQ ID NO: 110358 - RNA, 19 nt, Homo sapiens
uagcucaugugugaauuca

SEQ ID NO: 110359 - RNA, 19 nt, Homo sapiens
cagaaaauaucaaccucuu

SEQ ID NO: 110360 - RNA, 19 nt, Homo sapiens
guaugaugcaucuuacaga

SEQ ID NO: 110361 - RNA, 19 nt, Homo sapiens
gcguggagcagcuggagaa

SEQ ID NO: 110362 - RNA, 19 nt, Homo sapiens
gaugcuggcaacuccauug

SEQ ID NO: 110363 - RNA, 19 nt, Homo sapiens
guaacugcccaccagcauu

SEQ ID NO: 110364 - RNA, 19 nt, Homo sapiens
uggagcagcuggagaacag

SEQ ID NO: 110365 - RNA, 19 nt, Homo sapiens
aaaugaaacauggcaauuc

SEQ ID NO: 110366 - RNA, 19 nt, Homo sapiens
ggucuuccugggcaaauug

SEQ ID NO: 110367 - RNA, 19 nt, Homo sapiens
gagaugguggauuacaaug

SEQ ID NO: 110368 - RNA, 19 nt, Homo sapiens
gggagaaccagggaaagga

SEQ ID NO: 110369 - RNA, 19 nt, Homo sapiens
gagccaggccagcauccaa

SEQ ID NO: 110370 - RNA, 19 nt, Homo sapiens
ggauuuccgggucccauug

SEQ ID NO: 110371 - RNA, 19 nt, Homo sapiens
uagcggagcgcacccacaa

SEQ ID NO: 110372 - RNA, 19 nt, Homo sapiens
gcuagcucaugugugaauu

SEQ ID NO: 110373 - RNA, 19 nt, Homo sapiens
guaaugucugcaugauauu

SEQ ID NO: 110374 - RNA, 19 nt, Homo sapiens
ccaauuaccgcugguugug

SEQ ID NO: 110375 - RNA, 19 nt, Homo sapiens
uggauuggccugugugugu

SEQ ID NO: 110376 - RNA, 19 nt, Homo sapiens
aaaggagacccugggauga

SEQ ID NO: 110377 - RNA, 19 nt, Homo sapiens
gguacuccaggaccaauug

SEQ ID NO: 110378 - RNA, 19 nt, Homo sapiens
ccacaccgggagugccuaa

SEQ ID NO: 110379 - RNA, 19 nt, Homo sapiens
gaaccagggaaaggagaga

SEQ ID NO: 110380 - RNA, 19 nt, Homo sapiens
gagccagggaucccaggaa

SEQ ID NO: 110381 - RNA, 19 nt, Homo sapiens
uguagagguccaugauauu

SEQ ID NO: 110382 - RNA, 19 nt, Homo sapiens
gauuacaauggaaacauca

SEQ ID NO: 110383 - RNA, 19 nt, Homo sapiens
uagagguccaugauauuug

SEQ ID NO: 110384 - RNA, 19 nt, Homo sapiens
aaggagagaugguggauua

SEQ ID NO: 110385 - RNA, 19 nt, Homo sapiens
ccaaggagcgccuggauua

SEQ ID NO: 110386 - RNA, 19 nt, Homo sapiens
gaacaagugaugccucuaa

SEQ ID NO: 110387 - RNA, 19 nt, Homo sapiens
ggaacguucuucgaaauaa

SEQ ID NO: 110388 - RNA, 19 nt, Homo sapiens
cagcugggcuuccugguuu

SEQ ID NO: 110389 - RNA, 19 nt, Homo sapiens
cguaaugucugcaugauau

SEQ ID NO: 110390 - RNA, 19 nt, Homo sapiens
gcucugcgcuccagccaaa

SEQ ID NO: 110391 - RNA, 19 nt, Homo sapiens
gcacauuuauuaaguaucg

SEQ ID NO: 110392 - RNA, 19 nt, Homo sapiens
ccaaagacaucuccaggau

SEQ ID NO: 110393 - RNA, 19 nt, Homo sapiens
gcagacacuugaagggaaa

SEQ ID NO: 110394 - RNA, 19 nt, Homo sapiens
cagggagugugucaaguua

SEQ ID NO: 110395 - RNA, 19 nt, Homo sapiens
gaaaugaaacauggcaauu

SEQ ID NO: 110396 - RNA, 19 nt, Homo sapiens
aaagggaccucgcgguaaa

SEQ ID NO: 110397 - RNA, 19 nt, Homo sapiens
gagagaugguggauuacaa

SEQ ID NO: 110398 - RNA, 19 nt, Homo sapiens
caugauauuugcuaagcua

SEQ ID NO: 110399 - RNA, 19 nt, Homo sapiens
gaaaaugccagaaguauga

SEQ ID NO: 110400 - RNA, 19 nt, Homo sapiens
gaugguggauuacaaugga

SEQ ID NO: 110401 - RNA, 19 nt, Homo sapiens
agaaguaugaugcaucuua

SEQ ID NO: 110402 - RNA, 19 nt, Homo sapiens
ccaaauaauugcccugaag

SEQ ID NO: 110403 - RNA, 19 nt, Homo sapiens
gaaguaugaugcaucuuac

SEQ ID NO: 110404 - RNA, 19 nt, Homo sapiens
gcugucgccuuuauuuauu

SEQ ID NO: 110405 - RNA, 19 nt, Homo sapiens
guagagguccaugauauuu

SEQ ID NO: 110406 - RNA, 19 nt, Homo sapiens
uaacugcccaccagcauuu

SEQ ID NO: 110407 - RNA, 19 nt, Homo sapiens
uaacuuuccuggacuugga

SEQ ID NO: 110408 - RNA, 19 nt, Homo sapiens
ggauuacaauggaaacauc

SEQ ID NO: 110409 - RNA, 19 nt, Homo sapiens
cuaggugugucuaagagua

SEQ ID NO: 110410 - RNA, 19 nt, Homo sapiens
gggcgaagauggcuuacca

SEQ ID NO: 110411 - RNA, 19 nt, Homo sapiens
gcagggagugugucaaguu

SEQ ID NO: 110412 - RNA, 19 nt, Homo sapiens
caugauauuugugcacauu

SEQ ID NO: 110413 - RNA, 19 nt, Homo sapiens
ggaaaugaaacauggcaau

SEQ ID NO: 110414 - RNA, 19 nt, Homo sapiens
ccagaaguaugaugcaucu

SEQ ID NO: 110415 - RNA, 19 nt, Homo sapiens
aaggagagccggucagauu

SEQ ID NO: 110416 - RNA, 19 nt, Homo sapiens
gaacguucuucgaaauaac

SEQ ID NO: 110417 - RNA, 19 nt, Homo sapiens
caagggagaaccagggaaa

SEQ ID NO: 110418 - RNA, 19 nt, Homo sapiens
gguccaugauauuugcuaa

SEQ ID NO: 110419 - RNA, 19 nt, Homo sapiens
cuggcuagcucauguguga

SEQ ID NO: 110420 - RNA, 19 nt, Homo sapiens
gggagugugucaaguuaca

SEQ ID NO: 110421 - RNA, 19 nt, Homo sapiens
ggaagcaggacuagaugga

SEQ ID NO: 110422 - RNA, 19 nt, Homo sapiens
gauauuugcuaagcuaggu

SEQ ID NO: 110423 - RNA, 19 nt, Homo sapiens
caaggcugcuggaacaagu

SEQ ID NO: 110424 - RNA, 19 nt, Homo sapiens
guauaagccuaugucucua

SEQ ID NO: 110425 - RNA, 19 nt, Homo sapiens
ggauaagggagaccaagga

SEQ ID NO: 110426 - RNA, 19 nt, Homo sapiens
acccggagcuucagguuug

SEQ ID NO: 110427 - RNA, 19 nt, Homo sapiens
gggagaagcaggugucgau

SEQ ID NO: 110428 - RNA, 19 nt, Homo sapiens
auaucaaccucuucccuuu

SEQ ID NO: 110429 - RNA, 19 nt, Homo sapiens
acaauggaaacaucaauga

SEQ ID NO: 110430 - RNA, 19 nt, Homo sapiens
ggagaacagggaccagaug

SEQ ID NO: 110431 - RNA, 19 nt, Homo sapiens
gaaaggagagaugguggau

SEQ ID NO: 110432 - RNA, 19 nt, Homo sapiens
caguuuggauagagccuuu

SEQ ID NO: 110433 - RNA, 19 nt, Homo sapiens
ggugcuggcuagcucaugu

SEQ ID NO: 110434 - RNA, 19 nt, Homo sapiens
uguauaagccuaugucucu

SEQ ID NO: 110435 - RNA, 19 nt, Homo sapiens
gcugcugccucuccucaau

SEQ ID NO: 110436 - RNA, 19 nt, Homo sapiens
gccaaauaauugcccugaa

SEQ ID NO: 110437 - RNA, 19 nt, Homo sapiens
gcgcuccagccaaauaauu

SEQ ID NO: 110438 - RNA, 19 nt, Homo sapiens
cuagagguuucccuggauu

SEQ ID NO: 110439 - RNA, 19 nt, Homo sapiens
gcaaauggagacggcuauu

SEQ ID NO: 110440 - RNA, 19 nt, Homo sapiens
ggucguaaugucugcauga

SEQ ID NO: 110441 - RNA, 19 nt, Homo sapiens
aagccuaugucucuaauac

SEQ ID NO: 110442 - RNA, 19 nt, Homo sapiens
gaaaggcuuccagggagaa

SEQ ID NO: 110443 - RNA, 19 nt, Homo sapiens
gcggcugucgccuuuauuu

SEQ ID NO: 110444 - RNA, 19 nt, Homo sapiens
gcagcugggcuuccugguu

SEQ ID NO: 110445 - RNA, 19 nt, Homo sapiens
uauaagccuaugucucuaa

SEQ ID NO: 110446 - RNA, 19 nt, Homo sapiens
guguguguguuuguacaua

SEQ ID NO: 110447 - RNA, 19 nt, Homo sapiens
cuuggaacguucuucgaaa

SEQ ID NO: 110448 - RNA, 19 nt, Homo sapiens
gaaagacugggcggagaga

SEQ ID NO: 110449 - RNA, 19 nt, Homo sapiens
auguagagguccaugauau

SEQ ID NO: 110450 - RNA, 19 nt, Homo sapiens
uaaauguagagguccauga

SEQ ID NO: 110451 - RNA, 19 nt, Homo sapiens
gggaagaaaggcucuagag

SEQ ID NO: 110452 - RNA, 19 nt, Homo sapiens
ggagagaugguggauuaca

SEQ ID NO: 110453 - RNA, 19 nt, Homo sapiens
ccucuccuacugcuaauuu

SEQ ID NO: 110454 - RNA, 19 nt, Homo sapiens
ggcugucgccuuuauuuau

SEQ ID NO: 110455 - RNA, 19 nt, Homo sapiens
uaagcuaggugugucuaag

SEQ ID NO: 110456 - RNA, 19 nt, Homo sapiens
uggaacguucuucgaaaua

SEQ ID NO: 110457 - RNA, 19 nt, Homo sapiens
cggcugucgccuuuauuua

SEQ ID NO: 110458 - RNA, 19 nt, Homo sapiens
uagcucaugugugaauuca

SEQ ID NO: 110459 - RNA, 19 nt, Homo sapiens
cagaaaauaucaaccucuu

SEQ ID NO: 110460 - RNA, 19 nt, Homo sapiens
guaugaugcaucuuacaga

SEQ ID NO: 110461 - RNA, 19 nt, Homo sapiens
gcguggagcagcuggagaa

SEQ ID NO: 110462 - RNA, 19 nt, Homo sapiens
gaugcuggcaacuccauug

SEQ ID NO: 110463 - RNA, 19 nt, Homo sapiens
guaacugcccaccagcauu

SEQ ID NO: 110464 - RNA, 19 nt, Homo sapiens
gggacuacccggagcuuca

SEQ ID NO: 110465 - RNA, 19 nt, Homo sapiens
uggagcagcuggagaacag

SEQ ID NO: 110466 - RNA, 19 nt, Homo sapiens
aaaugaaacauggcaauuc

SEQ ID NO: 110467 - RNA, 19 nt, Homo sapiens
ggucuuccugggcaaauug

SEQ ID NO: 110468 - RNA, 19 nt, Homo sapiens
gagaugguggauuacaaug

SEQ ID NO: 110469 - RNA, 19 nt, Homo sapiens
gggagaaccagggaaagga

SEQ ID NO: 110470 - RNA, 19 nt, Homo sapiens
gagccaggccagcauccaa

SEQ ID NO: 110471 - RNA, 19 nt, Homo sapiens
ggauuuccgggucccauug

SEQ ID NO: 110472 - RNA, 19 nt, Homo sapiens
uagcggagcgcacccacaa

SEQ ID NO: 110473 - RNA, 19 nt, Homo sapiens
gcuagcucaugugugaauu

SEQ ID NO: 110474 - RNA, 19 nt, Homo sapiens
guaaugucugcaugauauu

SEQ ID NO: 110475 - RNA, 19 nt, Homo sapiens
ccaauuaccgcugguugug

SEQ ID NO: 110476 - RNA, 19 nt, Homo sapiens
uggauuggccugugugugu

SEQ ID NO: 110477 - RNA, 19 nt, Homo sapiens
aaaggagacccugggauga

SEQ ID NO: 110478 - RNA, 19 nt, Homo sapiens
gguacuccaggaccaauug

SEQ ID NO: 110479 - RNA, 19 nt, Homo sapiens
ccacaccgggagugccuaa

SEQ ID NO: 110480 - RNA, 19 nt, Homo sapiens
gaaccagggaaaggagaga

SEQ ID NO: 110481 - RNA, 19 nt, Homo sapiens
gagccagggaucccaggaa

SEQ ID NO: 110482 - RNA, 19 nt, Homo sapiens
uguagagguccaugauauu

SEQ ID NO: 110483 - RNA, 19 nt, Homo sapiens
gauuacaauggaaacauca

SEQ ID NO: 110484 - RNA, 19 nt, Homo sapiens
aaggagagaugguggauua

SEQ ID NO: 110485 - RNA, 19 nt, Homo sapiens
ccaaggagcgccuggauua

SEQ ID NO: 110486 - RNA, 19 nt, Homo sapiens
gaacaagugaugccucuaa

SEQ ID NO: 110487 - RNA, 19 nt, Homo sapiens
ggaacguucuucgaaauaa

SEQ ID NO: 110488 - RNA, 19 nt, Homo sapiens
cagcugggcuuccugguuu

SEQ ID NO: 110489 - RNA, 19 nt, Homo sapiens
cguaaugucugcaugauau

SEQ ID NO: 110490 - RNA, 19 nt, Homo sapiens
gcacauuuauuaaguaucg

SEQ ID NO: 110491 - RNA, 19 nt, Homo sapiens
ccaaagacaucuccaggau

SEQ ID NO: 110492 - RNA, 19 nt, Homo sapiens
gcagacacuugaagggaaa

SEQ ID NO: 110493 - RNA, 19 nt, Homo sapiens
cagggagugugucaaguua

SEQ ID NO: 110494 - RNA, 19 nt, Homo sapiens
gaaaugaaacauggcaauu

SEQ ID NO: 110495 - RNA, 19 nt, Homo sapiens
aaagggaccucgcgguaaa

SEQ ID NO: 110496 - RNA, 19 nt, Homo sapiens
gagagaugguggauuacaa

SEQ ID NO: 110497 - RNA, 19 nt, Homo sapiens
caugauauuugcuaagcua

SEQ ID NO: 110498 - RNA, 19 nt, Homo sapiens
gaaaaugccagaaguauga

SEQ ID NO: 110499 - RNA, 19 nt, Homo sapiens
gaugguggauuacaaugga

SEQ ID NO: 110500 - RNA, 19 nt, Homo sapiens
agaaguaugaugcaucuua

SEQ ID NO: 110501 - RNA, 19 nt, Homo sapiens
gaaguaugaugcaucuuac

SEQ ID NO: 110502 - RNA, 19 nt, Homo sapiens
gcugucgccuuuauuuauu

SEQ ID NO: 110503 - RNA, 19 nt, Homo sapiens
guagagguccaugauauuu

SEQ ID NO: 110504 - RNA, 19 nt, Homo sapiens
uaacugcccaccagcauuu

SEQ ID NO: 110505 - RNA, 19 nt, Homo sapiens
uaacuuuccuggacuugga

SEQ ID NO: 110506 - RNA, 19 nt, Homo sapiens
ggauuacaauggaaacauc

SEQ ID NO: 110507 - RNA, 19 nt, Homo sapiens
cuaggugugucuaagagua

SEQ ID NO: 110508 - RNA, 19 nt, Homo sapiens
gggcgaagauggcuuacca

SEQ ID NO: 110509 - RNA, 19 nt, Homo sapiens
gcagggagugugucaaguu

SEQ ID NO: 110510 - RNA, 19 nt, Homo sapiens
caugauauuugugcacauu

SEQ ID NO: 110511 - RNA, 19 nt, Homo sapiens
ggaaaugaaacauggcaau

SEQ ID NO: 110512 - RNA, 19 nt, Homo sapiens
ccagaaguaugaugcaucu

SEQ ID NO: 110513 - RNA, 19 nt, Homo sapiens
aaggagagccggucagauu

SEQ ID NO: 110514 - RNA, 19 nt, Homo sapiens
gcugggcuguccaucauug

SEQ ID NO: 110515 - RNA, 19 nt, Homo sapiens
gaacguucuucgaaauaac

SEQ ID NO: 110516 - RNA, 19 nt, Homo sapiens
caagggagaaccagggaaa

SEQ ID NO: 110517 - RNA, 19 nt, Homo sapiens
gguccaugauauuugcuaa

SEQ ID NO: 110518 - RNA, 19 nt, Homo sapiens
cuggcuagcucauguguga

SEQ ID NO: 110519 - RNA, 19 nt, Homo sapiens
gggagugugucaaguuaca

SEQ ID NO: 110520 - RNA, 19 nt, Homo sapiens
ggaagcaggacuagaugga

SEQ ID NO: 110521 - RNA, 19 nt, Homo sapiens
gauauuugcuaagcuaggu

SEQ ID NO: 110522 - RNA, 19 nt, Homo sapiens
caaggcugcuggaacaagu

SEQ ID NO: 110523 - RNA, 19 nt, Homo sapiens
guauaagccuaugucucua

SEQ ID NO: 110524 - RNA, 19 nt, Homo sapiens
ggauaagggagaccaagga

SEQ ID NO: 110525 - RNA, 19 nt, Homo sapiens
acccggagcuucagguuug

SEQ ID NO: 110526 - RNA, 19 nt, Homo sapiens
gggagaagcaggugucgau

SEQ ID NO: 110527 - RNA, 19 nt, Homo sapiens
auaucaaccucuucccuuu

SEQ ID NO: 110528 - RNA, 19 nt, Homo sapiens
acaauggaaacaucaauga

SEQ ID NO: 110529 - RNA, 19 nt, Homo sapiens
ggagaacagggaccagaug

SEQ ID NO: 110530 - RNA, 19 nt, Homo sapiens
gaaaggagagaugguggau

SEQ ID NO: 110531 - RNA, 19 nt, Homo sapiens
caguuuggauagagccuuu

SEQ ID NO: 110532 - RNA, 19 nt, Homo sapiens
ggugcuggcuagcucaugu

SEQ ID NO: 110533 - RNA, 19 nt, Homo sapiens
uguauaagccuaugucucu

SEQ ID NO: 110534 - RNA, 19 nt, Homo sapiens
cuagagguuucccuggauu

SEQ ID NO: 110535 - RNA, 19 nt, Homo sapiens
gcaaauggagacggcuauu

SEQ ID NO: 110536 - RNA, 19 nt, Homo sapiens
ggucguaaugucugcauga

SEQ ID NO: 110537 - RNA, 19 nt, Homo sapiens
aagccuaugucucuaauac

SEQ ID NO: 110538 - RNA, 19 nt, Homo sapiens
gaaaggcuuccagggagaa

SEQ ID NO: 110539 - RNA, 19 nt, Homo sapiens
gcggcugucgccuuuauuu

SEQ ID NO: 110540 - RNA, 19 nt, Homo sapiens
gcagcugggcuuccugguu

SEQ ID NO: 110541 - RNA, 19 nt, Homo sapiens
uauaagccuaugucucuaa

SEQ ID NO: 110542 - RNA, 19 nt, Homo sapiens
cuuggaacguucuucgaaa

SEQ ID NO: 110543 - RNA, 19 nt, Homo sapiens
guguguguguuuguacaua

SEQ ID NO: 110544 - RNA, 19 nt, Homo sapiens
gaaagacugggcggagaga

SEQ ID NO: 110545 - RNA, 19 nt, Homo sapiens
auguagagguccaugauau

SEQ ID NO: 110546 - RNA, 19 nt, Homo sapiens
uaaauguagagguccauga

SEQ ID NO: 110547 - RNA, 19 nt, Homo sapiens
gggaagaaaggcucuagag

SEQ ID NO: 110548 - RNA, 19 nt, Homo sapiens
ggagagaugguggauuaca

SEQ ID NO: 110549 - RNA, 19 nt, Homo sapiens
ggcugucgccuuuauuuau

SEQ ID NO: 110550 - RNA, 19 nt, Homo sapiens
ccucuccuacugcuaauuu

SEQ ID NO: 110551 - RNA, 19 nt, Homo sapiens
uaagcuaggugugucuaag

SEQ ID NO: 110552 - RNA, 19 nt, Homo sapiens
uggaacguucuucgaaaua

SEQ ID NO: 110553 - RNA, 19 nt, Homo sapiens
cggcugucgccuuuauuua

SEQ ID NO: 110554 - RNA, 19 nt, Homo sapiens
uagcucaugugugaauuca

SEQ ID NO: 110555 - RNA, 19 nt, Homo sapiens
cagaaaauaucaaccucuu

SEQ ID NO: 110556 - RNA, 19 nt, Homo sapiens
guaugaugcaucuuacaga

SEQ ID NO: 110557 - RNA, 19 nt, Homo sapiens
gcguggagcagcuggagaa

SEQ ID NO: 110558 - RNA, 19 nt, Homo sapiens
gaugcuggcaacuccauug

SEQ ID NO: 110559 - RNA, 19 nt, Homo sapiens
guaacugcccaccagcauu

SEQ ID NO: 110560 - RNA, 19 nt, Homo sapiens
gggacuacccggagcuuca

SEQ ID NO: 110561 - RNA, 19 nt, Homo sapiens
uggagcagcuggagaacag

SEQ ID NO: 110562 - RNA, 19 nt, Homo sapiens
aaaugaaacauggcaauuc

SEQ ID NO: 110563 - RNA, 19 nt, Homo sapiens
ggucuuccugggcaaauug

SEQ ID NO: 110564 - RNA, 19 nt, Homo sapiens
gagaugguggauuacaaug

SEQ ID NO: 110565 - RNA, 19 nt, Homo sapiens
gggagaaccagggaaagga

SEQ ID NO: 110566 - RNA, 19 nt, Homo sapiens
gagccaggccagcauccaa

SEQ ID NO: 110567 - RNA, 19 nt, Homo sapiens
ggauuuccgggucccauug

SEQ ID NO: 110568 - RNA, 19 nt, Homo sapiens
uagcggagcgcacccacaa

SEQ ID NO: 110569 - RNA, 19 nt, Homo sapiens
gcuagcucaugugugaauu

SEQ ID NO: 110570 - RNA, 19 nt, Homo sapiens
guaaugucugcaugauauu

SEQ ID NO: 110571 - RNA, 19 nt, Homo sapiens
ccaauuaccgcugguugug

SEQ ID NO: 110572 - RNA, 19 nt, Homo sapiens
uggauuggccugugugugu

SEQ ID NO: 110573 - RNA, 19 nt, Homo sapiens
aaaggagacccugggauga

SEQ ID NO: 110574 - RNA, 19 nt, Homo sapiens
gguacuccaggaccaauug

SEQ ID NO: 110575 - RNA, 19 nt, Homo sapiens
gaaccagggaaaggagaga

SEQ ID NO: 110576 - RNA, 19 nt, Homo sapiens
gagccagggaucccaggaa

SEQ ID NO: 110577 - RNA, 19 nt, Homo sapiens
uguagagguccaugauauu

SEQ ID NO: 110578 - RNA, 19 nt, Homo sapiens
gauuacaauggaaacauca

SEQ ID NO: 110579 - RNA, 19 nt, Homo sapiens
gaaggagagccggucagau

SEQ ID NO: 110580 - RNA, 19 nt, Homo sapiens
uagagguccaugauauuug

SEQ ID NO: 110581 - RNA, 19 nt, Homo sapiens
gaccaaggagcgccuggau

SEQ ID NO: 110582 - RNA, 19 nt, Homo sapiens
uuggaacguucuucgaaau

SEQ ID NO: 110583 - RNA, 19 nt, Homo sapiens
agagguccaugauauuugc

SEQ ID NO: 110584 - RNA, 19 nt, Homo sapiens
aaggagagaugguggauua

SEQ ID NO: 110585 - RNA, 19 nt, Homo sapiens
ccaaggagcgccuggauua

SEQ ID NO: 110586 - RNA, 19 nt, Homo sapiens
gaacaagugaugccucuaa

SEQ ID NO: 110587 - RNA, 19 nt, Homo sapiens
ggaacguucuucgaaauaa

SEQ ID NO: 110588 - RNA, 19 nt, Homo sapiens
cagcugggcuuccugguuu

SEQ ID NO: 110589 - RNA, 19 nt, Homo sapiens
cguaaugucugcaugauau

SEQ ID NO: 110590 - RNA, 19 nt, Homo sapiens
gcacauuuauuaaguaucg

SEQ ID NO: 110591 - RNA, 19 nt, Homo sapiens
ccaaagacaucuccaggau

SEQ ID NO: 110592 - RNA, 19 nt, Homo sapiens
gcagacacuugaagggaaa

SEQ ID NO: 110593 - RNA, 19 nt, Homo sapiens
cagggagugugucaaguua

SEQ ID NO: 110594 - RNA, 19 nt, Homo sapiens
gaaaugaaacauggcaauu

SEQ ID NO: 110595 - RNA, 19 nt, Homo sapiens
aaagggaccucgcgguaaa

SEQ ID NO: 110596 - RNA, 19 nt, Homo sapiens
gagagaugguggauuacaa

SEQ ID NO: 110597 - RNA, 19 nt, Homo sapiens
caugauauuugcuaagcua

SEQ ID NO: 110598 - RNA, 19 nt, Homo sapiens
gaaaaugccagaaguauga

SEQ ID NO: 110599 - RNA, 19 nt, Homo sapiens
gaugguggauuacaaugga

SEQ ID NO: 110600 - RNA, 19 nt, Homo sapiens
agaaguaugaugcaucuua

SEQ ID NO: 110601 - RNA, 19 nt, Homo sapiens
gaaguaugaugcaucuuac

SEQ ID NO: 110602 - RNA, 19 nt, Homo sapiens
gcugucgccuuuauuuauu

SEQ ID NO: 110603 - RNA, 19 nt, Homo sapiens
guagagguccaugauauuu

SEQ ID NO: 110604 - RNA, 19 nt, Homo sapiens
uaacugcccaccagcauuu

SEQ ID NO: 110605 - RNA, 19 nt, Homo sapiens
uaacuuuccuggacuugga

SEQ ID NO: 110606 - RNA, 19 nt, Homo sapiens
ggauuacaauggaaacauc

SEQ ID NO: 110607 - RNA, 19 nt, Homo sapiens
cuaggugugucuaagagua

SEQ ID NO: 110608 - RNA, 19 nt, Homo sapiens
gggcgaagauggcuuacca

SEQ ID NO: 110609 - RNA, 19 nt, Homo sapiens
gcagggagugugucaaguu

SEQ ID NO: 110610 - RNA, 19 nt, Homo sapiens
caugauauuugugcacauu

SEQ ID NO: 110611 - RNA, 19 nt, Homo sapiens
ggaaaugaaacauggcaau

SEQ ID NO: 110612 - RNA, 19 nt, Homo sapiens
ccagaaguaugaugcaucu

SEQ ID NO: 110613 - RNA, 19 nt, Homo sapiens
aaggagagccggucagauu

SEQ ID NO: 110614 - RNA, 19 nt, Homo sapiens
gcugggcuguccaucauug

SEQ ID NO: 110615 - RNA, 19 nt, Homo sapiens
gaacguucuucgaaauaac

SEQ ID NO: 110616 - RNA, 19 nt, Homo sapiens
caagggagaaccagggaaa

SEQ ID NO: 110617 - RNA, 19 nt, Homo sapiens
gguccaugauauuugcuaa

SEQ ID NO: 110618 - RNA, 19 nt, Homo sapiens
cuggcuagcucauguguga

SEQ ID NO: 110619 - RNA, 19 nt, Homo sapiens
gggagugugucaaguuaca

SEQ ID NO: 110620 - RNA, 19 nt, Homo sapiens
ggaagcaggacuagaugga

SEQ ID NO: 110621 - RNA, 19 nt, Homo sapiens
gauauuugcuaagcuaggu

SEQ ID NO: 110622 - RNA, 19 nt, Homo sapiens
caaggcugcuggaacaagu

SEQ ID NO: 110623 - RNA, 19 nt, Homo sapiens
guauaagccuaugucucua

SEQ ID NO: 110624 - RNA, 19 nt, Homo sapiens
ggauaagggagaccaagga

SEQ ID NO: 110625 - RNA, 19 nt, Homo sapiens
gggagaagcaggugucgau

SEQ ID NO: 110626 - RNA, 19 nt, Homo sapiens
auaucaaccucuucccuuu

SEQ ID NO: 110627 - RNA, 19 nt, Homo sapiens
acaauggaaacaucaauga

SEQ ID NO: 110628 - RNA, 19 nt, Homo sapiens
ggagaacagggaccagaug

SEQ ID NO: 110629 - RNA, 19 nt, Homo sapiens
gaaaggagagaugguggau

SEQ ID NO: 110630 - RNA, 19 nt, Homo sapiens
caguuuggauagagccuuu

SEQ ID NO: 110631 - RNA, 19 nt, Homo sapiens
ggugcuggcuagcucaugu

SEQ ID NO: 110632 - RNA, 19 nt, Homo sapiens
uguauaagccuaugucucu

SEQ ID NO: 110633 - RNA, 19 nt, Homo sapiens
gcugcugccucuccucaau

SEQ ID NO: 110634 - RNA, 19 nt, Homo sapiens
cuagagguuucccuggauu

SEQ ID NO: 110635 - RNA, 19 nt, Homo sapiens
gcaaauggagacggcuauu

SEQ ID NO: 110636 - RNA, 19 nt, Homo sapiens
ggucguaaugucugcauga

SEQ ID NO: 110637 - RNA, 19 nt, Homo sapiens
aagccuaugucucuaauac

SEQ ID NO: 110638 - RNA, 19 nt, Homo sapiens
gaaaggcuuccagggagaa

SEQ ID NO: 110639 - RNA, 19 nt, Homo sapiens
gcggcugucgccuuuauuu

SEQ ID NO: 110640 - RNA, 19 nt, Homo sapiens
gcagcugggcuuccugguu

SEQ ID NO: 110641 - RNA, 19 nt, Homo sapiens
uauaagccuaugucucuaa

SEQ ID NO: 110642 - RNA, 19 nt, Homo sapiens
guguguguguuuguacaua

SEQ ID NO: 110643 - RNA, 19 nt, Homo sapiens
cuuggaacguucuucgaaa

SEQ ID NO: 110644 - RNA, 19 nt, Homo sapiens
gaaagacugggcggagaga

SEQ ID NO: 110645 - RNA, 19 nt, Homo sapiens
auguagagguccaugauau

SEQ ID NO: 110646 - RNA, 19 nt, Homo sapiens
uaaauguagagguccauga

SEQ ID NO: 110647 - RNA, 19 nt, Homo sapiens
gggaagaaaggcucuagag

SEQ ID NO: 110648 - RNA, 19 nt, Homo sapiens
ggagagaugguggauuaca

SEQ ID NO: 110649 - RNA, 19 nt, Homo sapiens
ggcugucgccuuuauuuau

SEQ ID NO: 110650 - RNA, 19 nt, Homo sapiens
ccucuccuacugcuaauuu

SEQ ID NO: 110651 - RNA, 19 nt, Homo sapiens
uaagcuaggugugucuaag

SEQ ID NO: 110652 - RNA, 19 nt, Homo sapiens
uggaacguucuucgaaaua

SEQ ID NO: 110653 - RNA, 19 nt, Homo sapiens
cggcugucgccuuuauuua

SEQ ID NO: 110654 - RNA, 19 nt, Homo sapiens
uagcucaugugugaauuca

SEQ ID NO: 110655 - RNA, 19 nt, Homo sapiens
cagaaaauaucaaccucuu

SEQ ID NO: 110656 - RNA, 19 nt, Homo sapiens
guaugaugcaucuuacaga

SEQ ID NO: 110657 - RNA, 19 nt, Homo sapiens
gcguggagcagcuggagaa

SEQ ID NO: 110658 - RNA, 19 nt, Homo sapiens
gaugcuggcaacuccauug

SEQ ID NO: 110659 - RNA, 19 nt, Homo sapiens
guaacugcccaccagcauu

SEQ ID NO: 110660 - RNA, 19 nt, Homo sapiens
uggagcagcuggagaacag

SEQ ID NO: 110661 - RNA, 19 nt, Homo sapiens
aaaugaaacauggcaauuc

SEQ ID NO: 110662 - RNA, 19 nt, Homo sapiens
ggucuuccugggcaaauug

SEQ ID NO: 110663 - RNA, 19 nt, Homo sapiens
gagaugguggauuacaaug

SEQ ID NO: 110664 - RNA, 19 nt, Homo sapiens
gggagaaccagggaaagga

SEQ ID NO: 110665 - RNA, 19 nt, Homo sapiens
gagccaggccagcauccaa

SEQ ID NO: 110666 - RNA, 19 nt, Homo sapiens
ggauuuccgggucccauug

SEQ ID NO: 110667 - RNA, 19 nt, Homo sapiens
uagcggagcgcacccacaa

SEQ ID NO: 110668 - RNA, 19 nt, Homo sapiens
gcuagcucaugugugaauu

SEQ ID NO: 110669 - RNA, 19 nt, Homo sapiens
guaaugucugcaugauauu

SEQ ID NO: 110670 - RNA, 19 nt, Homo sapiens
ccaauuaccgcugguugug

SEQ ID NO: 110671 - RNA, 19 nt, Homo sapiens
uggauuggccugugugugu

SEQ ID NO: 110672 - RNA, 19 nt, Homo sapiens
aaaggagacccugggauga

SEQ ID NO: 110673 - RNA, 19 nt, Homo sapiens
gguacuccaggaccaauug

SEQ ID NO: 110674 - RNA, 19 nt, Homo sapiens
gaaccagggaaaggagaga

SEQ ID NO: 110675 - RNA, 19 nt, Homo sapiens
gagccagggaucccaggaa

SEQ ID NO: 110676 - RNA, 19 nt, Homo sapiens
uguagagguccaugauauu

SEQ ID NO: 110677 - RNA, 19 nt, Homo sapiens
gauuacaauggaaacauca

SEQ ID NO: 110678 - RNA, 19 nt, Homo sapiens
gaaggagagccggucagau

SEQ ID NO: 110679 - RNA, 19 nt, Homo sapiens
uagagguccaugauauuug

SEQ ID NO: 110680 - RNA, 19 nt, Homo sapiens
gaccaaggagcgccuggau

SEQ ID NO: 110681 - RNA, 19 nt, Homo sapiens
uuggaacguucuucgaaau

SEQ ID NO: 110682 - RNA, 19 nt, Homo sapiens
agagguccaugauauuugc

SEQ ID NO: 110683 - RNA, 19 nt, Homo sapiens
aauguagagguccaugaua

SEQ ID NO: 110684 - RNA, 19 nt, Homo sapiens
aaggagagaugguggauua

SEQ ID NO: 110685 - RNA, 19 nt, Homo sapiens
ccaaggagcgccuggauua

SEQ ID NO: 110686 - RNA, 19 nt, Homo sapiens
gaacaagugaugccucuaa

SEQ ID NO: 110687 - RNA, 19 nt, Homo sapiens
ggaacguucuucgaaauaa

SEQ ID NO: 110688 - RNA, 19 nt, Homo sapiens
cagcugggcuuccugguuu

SEQ ID NO: 110689 - RNA, 19 nt, Homo sapiens
cguaaugucugcaugauau

SEQ ID NO: 110690 - RNA, 19 nt, Homo sapiens
gcucugcgcuccagccaaa

SEQ ID NO: 110691 - RNA, 19 nt, Homo sapiens
gcacauuuauuaaguaucg

SEQ ID NO: 110692 - RNA, 19 nt, Homo sapiens
ccaaagacaucuccaggau

SEQ ID NO: 110693 - RNA, 19 nt, Homo sapiens
gcagacacuugaagggaaa

SEQ ID NO: 110694 - RNA, 19 nt, Homo sapiens
cagggagugugucaaguua

SEQ ID NO: 110695 - RNA, 19 nt, Homo sapiens
gaaaugaaacauggcaauu

SEQ ID NO: 110696 - RNA, 19 nt, Homo sapiens
aaagggaccucgcgguaaa

SEQ ID NO: 110697 - RNA, 19 nt, Homo sapiens
gagagaugguggauuacaa

SEQ ID NO: 110698 - RNA, 19 nt, Homo sapiens
caugauauuugcuaagcua

SEQ ID NO: 110699 - RNA, 19 nt, Homo sapiens
gaaaaugccagaaguauga

SEQ ID NO: 110700 - RNA, 19 nt, Homo sapiens
gaugguggauuacaaugga

SEQ ID NO: 110701 - RNA, 19 nt, Homo sapiens
agaaguaugaugcaucuua

SEQ ID NO: 110702 - RNA, 19 nt, Homo sapiens
ccaaauaauugcccugaag

SEQ ID NO: 110703 - RNA, 19 nt, Homo sapiens
gaaguaugaugcaucuuac

SEQ ID NO: 110704 - RNA, 19 nt, Homo sapiens
gcugucgccuuuauuuauu

SEQ ID NO: 110705 - RNA, 19 nt, Homo sapiens
guagagguccaugauauuu

SEQ ID NO: 110706 - RNA, 19 nt, Homo sapiens
uaacugcccaccagcauuu

SEQ ID NO: 110707 - RNA, 19 nt, Homo sapiens
uaacuuuccuggacuugga

SEQ ID NO: 110708 - RNA, 19 nt, Homo sapiens
ggauuacaauggaaacauc

SEQ ID NO: 110709 - RNA, 19 nt, Homo sapiens
cuaggugugucuaagagua

SEQ ID NO: 110710 - RNA, 19 nt, Homo sapiens
gggcgaagauggcuuacca

SEQ ID NO: 110711 - RNA, 19 nt, Homo sapiens
gcagggagugugucaaguu

SEQ ID NO: 110712 - RNA, 19 nt, Homo sapiens
caugauauuugugcacauu

SEQ ID NO: 110713 - RNA, 19 nt, Homo sapiens
ggaaaugaaacauggcaau

SEQ ID NO: 110714 - RNA, 19 nt, Homo sapiens
ccagaaguaugaugcaucu

SEQ ID NO: 110715 - RNA, 19 nt, Homo sapiens
aaggagagccggucagauu

SEQ ID NO: 110716 - RNA, 19 nt, Homo sapiens
gcugggcuguccaucauug

SEQ ID NO: 110717 - RNA, 19 nt, Homo sapiens
gaacguucuucgaaauaac

SEQ ID NO: 110718 - RNA, 19 nt, Homo sapiens
caagggagaaccagggaaa

SEQ ID NO: 110719 - RNA, 19 nt, Homo sapiens
gguccaugauauuugcuaa

SEQ ID NO: 110720 - RNA, 19 nt, Homo sapiens
cuggcuagcucauguguga

SEQ ID NO: 110721 - RNA, 19 nt, Homo sapiens
gggagugugucaaguuaca

SEQ ID NO: 110722 - RNA, 19 nt, Homo sapiens
ggaagcaggacuagaugga

SEQ ID NO: 110723 - RNA, 19 nt, Homo sapiens
gauauuugcuaagcuaggu

SEQ ID NO: 110724 - RNA, 19 nt, Homo sapiens
caaggcugcuggaacaagu

SEQ ID NO: 110725 - RNA, 19 nt, Homo sapiens
guauaagccuaugucucua

SEQ ID NO: 110726 - RNA, 19 nt, Homo sapiens
ggauaagggagaccaagga

SEQ ID NO: 110727 - RNA, 19 nt, Homo sapiens
gggagaagcaggugucgau

SEQ ID NO: 110728 - RNA, 19 nt, Homo sapiens
auaucaaccucuucccuuu

SEQ ID NO: 110729 - RNA, 19 nt, Homo sapiens
acaauggaaacaucaauga

SEQ ID NO: 110730 - RNA, 19 nt, Homo sapiens
ggagaacagggaccagaug

SEQ ID NO: 110731 - RNA, 19 nt, Homo sapiens
gaaaggagagaugguggau

SEQ ID NO: 110732 - RNA, 19 nt, Homo sapiens
caguuuggauagagccuuu

SEQ ID NO: 110733 - RNA, 19 nt, Homo sapiens
ggugcuggcuagcucaugu

SEQ ID NO: 110734 - RNA, 19 nt, Homo sapiens
uguauaagccuaugucucu

SEQ ID NO: 110735 - RNA, 19 nt, Homo sapiens
gcugcugccucuccucaau

SEQ ID NO: 110736 - RNA, 19 nt, Homo sapiens
gccaaauaauugcccugaa

SEQ ID NO: 110737 - RNA, 19 nt, Homo sapiens
gcgcuccagccaaauaauu

SEQ ID NO: 110738 - RNA, 19 nt, Homo sapiens
cuagagguuucccuggauu

SEQ ID NO: 110739 - RNA, 19 nt, Homo sapiens
gcaaauggagacggcuauu

SEQ ID NO: 110740 - RNA, 19 nt, Homo sapiens
ggucguaaugucugcauga

SEQ ID NO: 110741 - RNA, 19 nt, Homo sapiens
aagccuaugucucuaauac

SEQ ID NO: 110742 - RNA, 19 nt, Homo sapiens
gaaaggcuuccagggagaa

SEQ ID NO: 110743 - RNA, 19 nt, Homo sapiens
gcggcugucgccuuuauuu

SEQ ID NO: 110744 - RNA, 19 nt, Homo sapiens
gcagcugggcuuccugguu

SEQ ID NO: 110745 - RNA, 19 nt, Homo sapiens
uauaagccuaugucucuaa

SEQ ID NO: 110746 - RNA, 19 nt, Homo sapiens
guguguguguuuguacaua

SEQ ID NO: 110747 - RNA, 19 nt, Homo sapiens
cuuggaacguucuucgaaa

SEQ ID NO: 110748 - RNA, 19 nt, Homo sapiens
gaaagacugggcggagaga

SEQ ID NO: 110749 - RNA, 19 nt, Homo sapiens
auguagagguccaugauau

SEQ ID NO: 110750 - RNA, 19 nt, Homo sapiens
uaaauguagagguccauga

SEQ ID NO: 110751 - RNA, 19 nt, Homo sapiens
gggaagaaaggcucuagag

SEQ ID NO: 110752 - RNA, 19 nt, Homo sapiens
ggagagaugguggauuaca

SEQ ID NO: 110753 - RNA, 19 nt, Homo sapiens
ccucuccuacugcuaauuu

SEQ ID NO: 110754 - RNA, 19 nt, Homo sapiens
ggcugucgccuuuauuuau

SEQ ID NO: 110755 - RNA, 19 nt, Homo sapiens
uaagcuaggugugucuaag

SEQ ID NO: 110756 - RNA, 19 nt, Homo sapiens
uggaacguucuucgaaaua

SEQ ID NO: 110757 - RNA, 19 nt, Homo sapiens
cggcugucgccuuuauuua

SEQ ID NO: 110758 - RNA, 19 nt, Homo sapiens
uagcucaugugugaauuca

SEQ ID NO: 110759 - RNA, 19 nt, Homo sapiens
cagaaaauaucaaccucuu

SEQ ID NO: 110760 - RNA, 19 nt, Homo sapiens
guaugaugcaucuuacaga

SEQ ID NO: 110761 - RNA, 19 nt, Homo sapiens
gcguggagcagcuggagaa

SEQ ID NO: 110762 - RNA, 19 nt, Homo sapiens
gaugcuggcaacuccauug

SEQ ID NO: 110763 - RNA, 19 nt, Homo sapiens
guaacugcccaccagcauu

SEQ ID NO: 110764 - RNA, 19 nt, Homo sapiens
uggagcagcuggagaacag

SEQ ID NO: 110765 - RNA, 19 nt, Homo sapiens
aaaugaaacauggcaauuc

SEQ ID NO: 110766 - RNA, 19 nt, Homo sapiens
ggucuuccugggcaaauug

SEQ ID NO: 110767 - RNA, 19 nt, Homo sapiens
gagaugguggauuacaaug

SEQ ID NO: 110768 - RNA, 19 nt, Homo sapiens
gggagaaccagggaaagga

SEQ ID NO: 110769 - RNA, 19 nt, Homo sapiens
gagccaggccagcauccaa

SEQ ID NO: 110770 - RNA, 19 nt, Homo sapiens
ggauuuccgggucccauug

SEQ ID NO: 110771 - RNA, 19 nt, Homo sapiens
uagcggagcgcacccacaa

SEQ ID NO: 110772 - RNA, 19 nt, Homo sapiens
gcuagcucaugugugaauu

SEQ ID NO: 110773 - RNA, 19 nt, Homo sapiens
guaaugucugcaugauauu

SEQ ID NO: 110774 - RNA, 19 nt, Homo sapiens
ccaauuaccgcugguugug

SEQ ID NO: 110775 - RNA, 19 nt, Homo sapiens
uggauuggccugugugugu

SEQ ID NO: 110776 - RNA, 19 nt, Homo sapiens
aaaggagacccugggauga

SEQ ID NO: 110777 - RNA, 19 nt, Homo sapiens
gguacuccaggaccaauug

SEQ ID NO: 110778 - RNA, 19 nt, Homo sapiens
ccacaccgggagugccuaa

SEQ ID NO: 110779 - RNA, 19 nt, Homo sapiens
gaaccagggaaaggagaga

SEQ ID NO: 110780 - RNA, 19 nt, Homo sapiens
gagccagggaucccaggaa

SEQ ID NO: 110781 - RNA, 19 nt, Homo sapiens
uguagagguccaugauauu

SEQ ID NO: 110782 - RNA, 19 nt, Homo sapiens
gauuacaauggaaacauca

SEQ ID NO: 110783 - RNA, 19 nt, Homo sapiens
uagagguccaugauauuug

SEQ ID NO: 110784 - RNA, 19 nt, Homo sapiens
aaggagagaugguggauua

SEQ ID NO: 110785 - RNA, 19 nt, Homo sapiens
ccaaggagcgccuggauua

SEQ ID NO: 110786 - RNA, 19 nt, Homo sapiens
gaacaagugaugccucuaa

SEQ ID NO: 110787 - RNA, 19 nt, Homo sapiens
ggaacguucuucgaaauaa

SEQ ID NO: 110788 - RNA, 19 nt, Homo sapiens
cagcugggcuuccugguuu

SEQ ID NO: 110789 - RNA, 19 nt, Homo sapiens
cguaaugucugcaugauau

SEQ ID NO: 110790 - RNA, 19 nt, Homo sapiens
gcucugcgcuccagccaaa

SEQ ID NO: 110791 - RNA, 19 nt, Homo sapiens
gcacauuuauuaaguaucg

SEQ ID NO: 110792 - RNA, 19 nt, Homo sapiens
ccaaagacaucuccaggau

SEQ ID NO: 110793 - RNA, 19 nt, Homo sapiens
gcagacacuugaagggaaa

SEQ ID NO: 110794 - RNA, 19 nt, Homo sapiens
cagggagugugucaaguua

SEQ ID NO: 110795 - RNA, 19 nt, Homo sapiens
gaaaugaaacauggcaauu

SEQ ID NO: 110796 - RNA, 19 nt, Homo sapiens
aaagggaccucgcgguaaa

SEQ ID NO: 110797 - RNA, 19 nt, Homo sapiens
gagagaugguggauuacaa

SEQ ID NO: 110798 - RNA, 19 nt, Homo sapiens
caugauauuugcuaagcua

SEQ ID NO: 110799 - RNA, 19 nt, Homo sapiens
gaaaaugccagaaguauga

SEQ ID NO: 110800 - RNA, 19 nt, Homo sapiens
gaugguggauuacaaugga

SEQ ID NO: 110801 - RNA, 19 nt, Homo sapiens
agaaguaugaugcaucuua

SEQ ID NO: 110802 - RNA, 19 nt, Homo sapiens
ccaaauaauugcccugaag

SEQ ID NO: 110803 - RNA, 19 nt, Homo sapiens
gaaguaugaugcaucuuac

SEQ ID NO: 110804 - RNA, 19 nt, Homo sapiens
gcugucgccuuuauuuauu

SEQ ID NO: 110805 - RNA, 19 nt, Homo sapiens
guagagguccaugauauuu

SEQ ID NO: 110806 - RNA, 19 nt, Homo sapiens
uaacugcccaccagcauuu

SEQ ID NO: 110807 - RNA, 19 nt, Homo sapiens
uaacuuuccuggacuugga

SEQ ID NO: 110808 - RNA, 19 nt, Homo sapiens
ggauuacaauggaaacauc

SEQ ID NO: 110809 - RNA, 19 nt, Homo sapiens
cuaggugugucuaagagua

SEQ ID NO: 110810 - RNA, 19 nt, Homo sapiens
gggcgaagauggcuuacca

SEQ ID NO: 110811 - RNA, 19 nt, Homo sapiens
gcagggagugugucaaguu

SEQ ID NO: 110812 - RNA, 19 nt, Homo sapiens
caugauauuugugcacauu

SEQ ID NO: 110813 - RNA, 19 nt, Homo sapiens
ggaaaugaaacauggcaau

SEQ ID NO: 110814 - RNA, 19 nt, Homo sapiens
ccagaaguaugaugcaucu

SEQ ID NO: 110815 - RNA, 19 nt, Homo sapiens
aaggagagccggucagauu

SEQ ID NO: 110816 - RNA, 19 nt, Homo sapiens
gcugggcuguccaucauug

SEQ ID NO: 110817 - RNA, 19 nt, Homo sapiens
gaacguucuucgaaauaac

SEQ ID NO: 110818 - RNA, 19 nt, Homo sapiens
caagggagaaccagggaaa

SEQ ID NO: 110819 - RNA, 19 nt, Homo sapiens
gguccaugauauuugcuaa

SEQ ID NO: 110820 - RNA, 19 nt, Homo sapiens
cuggcuagcucauguguga

SEQ ID NO: 110821 - RNA, 19 nt, Homo sapiens
gggagugugucaaguuaca

SEQ ID NO: 110822 - RNA, 19 nt, Homo sapiens
ggaagcaggacuagaugga

SEQ ID NO: 110823 - RNA, 19 nt, Homo sapiens
gauauuugcuaagcuaggu

SEQ ID NO: 110824 - RNA, 19 nt, Homo sapiens
caaggcugcuggaacaagu

SEQ ID NO: 110825 - RNA, 19 nt, Homo sapiens
guauaagccuaugucucua

SEQ ID NO: 110826 - RNA, 19 nt, Homo sapiens
ggauaagggagaccaagga

SEQ ID NO: 110827 - RNA, 19 nt, Homo sapiens
gggagaagcaggugucgau

SEQ ID NO: 110828 - RNA, 19 nt, Homo sapiens
auaucaaccucuucccuuu

SEQ ID NO: 110829 - RNA, 19 nt, Homo sapiens
acaauggaaacaucaauga

SEQ ID NO: 110830 - RNA, 19 nt, Homo sapiens
ggagaacagggaccagaug

SEQ ID NO: 110831 - RNA, 19 nt, Homo sapiens
gaaaggagagaugguggau

SEQ ID NO: 110832 - RNA, 19 nt, Homo sapiens
caguuuggauagagccuuu

SEQ ID NO: 110833 - RNA, 19 nt, Homo sapiens
ggugcuggcuagcucaugu

SEQ ID NO: 110834 - RNA, 19 nt, Homo sapiens
uguauaagccuaugucucu

SEQ ID NO: 110835 - RNA, 19 nt, Homo sapiens
gcugcugccucuccucaau

SEQ ID NO: 110836 - RNA, 19 nt, Homo sapiens
gccaaauaauugcccugaa

SEQ ID NO: 110837 - RNA, 19 nt, Homo sapiens
gcgcuccagccaaauaauu

SEQ ID NO: 110838 - RNA, 19 nt, Homo sapiens
cuagagguuucccuggauu

SEQ ID NO: 110839 - RNA, 19 nt, Homo sapiens
gcaaauggagacggcuauu

SEQ ID NO: 110840 - RNA, 19 nt, Homo sapiens
ggucguaaugucugcauga

SEQ ID NO: 110841 - RNA, 19 nt, Homo sapiens
aagccuaugucucuaauac

SEQ ID NO: 110842 - RNA, 19 nt, Homo sapiens
gaaaggcuuccagggagaa

SEQ ID NO: 110843 - RNA, 19 nt, Homo sapiens
gcggcugucgccuuuauuu

SEQ ID NO: 110844 - RNA, 19 nt, Homo sapiens
gcagcugggcuuccugguu

SEQ ID NO: 110845 - RNA, 19 nt, Homo sapiens
uauaagccuaugucucuaa

SEQ ID NO: 110846 - RNA, 19 nt, Homo sapiens
guguguguguuuguacaua

SEQ ID NO: 110847 - RNA, 19 nt, Homo sapiens
cuuggaacguucuucgaaa

SEQ ID NO: 110848 - RNA, 19 nt, Homo sapiens
gaaagacugggcggagaga

SEQ ID NO: 110849 - RNA, 19 nt, Homo sapiens
auguagagguccaugauau

SEQ ID NO: 110850 - RNA, 19 nt, Homo sapiens
uaaauguagagguccauga

SEQ ID NO: 110851 - RNA, 19 nt, Homo sapiens
gggaagaaaggcucuagag

SEQ ID NO: 110852 - RNA, 19 nt, Homo sapiens
ggagagaugguggauuaca

SEQ ID NO: 110853 - RNA, 19 nt, Homo sapiens
ccucuccuacugcuaauuu

SEQ ID NO: 110854 - RNA, 19 nt, Homo sapiens
ggcugucgccuuuauuuau

SEQ ID NO: 110855 - RNA, 19 nt, Homo sapiens
uaagcuaggugugucuaag

SEQ ID NO: 110856 - RNA, 19 nt, Homo sapiens
uggaacguucuucgaaaua

SEQ ID NO: 110857 - RNA, 19 nt, Homo sapiens
cggcugucgccuuuauuua

SEQ ID NO: 110858 - RNA, 19 nt, Homo sapiens
uagcucaugugugaauuca

SEQ ID NO: 110859 - RNA, 19 nt, Homo sapiens
cagaaaauaucaaccucuu

SEQ ID NO: 110860 - RNA, 19 nt, Homo sapiens
guaugaugcaucuuacaga

SEQ ID NO: 110861 - RNA, 19 nt, Homo sapiens
gcguggagcagcuggagaa

SEQ ID NO: 110862 - RNA, 19 nt, Homo sapiens
gaugcuggcaacuccauug

SEQ ID NO: 110863 - RNA, 19 nt, Homo sapiens
guaacugcccaccagcauu

SEQ ID NO: 110864 - RNA, 19 nt, Homo sapiens
uggagcagcuggagaacag

SEQ ID NO: 110865 - RNA, 19 nt, Homo sapiens
aaaugaaacauggcaauuc

SEQ ID NO: 110866 - RNA, 19 nt, Homo sapiens
ggucuuccugggcaaauug

SEQ ID NO: 110867 - RNA, 19 nt, Homo sapiens
gagaugguggauuacaaug

SEQ ID NO: 110868 - RNA, 19 nt, Homo sapiens
gggagaaccagggaaagga

SEQ ID NO: 110869 - RNA, 19 nt, Homo sapiens
gagccaggccagcauccaa

SEQ ID NO: 110870 - RNA, 19 nt, Homo sapiens
ggauuuccgggucccauug

SEQ ID NO: 110871 - RNA, 19 nt, Homo sapiens
uagcggagcgcacccacaa

SEQ ID NO: 110872 - RNA, 19 nt, Homo sapiens
gcuagcucaugugugaauu

SEQ ID NO: 110873 - RNA, 19 nt, Homo sapiens
guaaugucugcaugauauu

SEQ ID NO: 110874 - RNA, 19 nt, Homo sapiens
ccaauuaccgcugguugug

SEQ ID NO: 110875 - RNA, 19 nt, Homo sapiens
uggauuggccugugugugu

SEQ ID NO: 110876 - RNA, 19 nt, Homo sapiens
aaaggagacccugggauga

SEQ ID NO: 110877 - RNA, 19 nt, Homo sapiens
gguacuccaggaccaauug

SEQ ID NO: 110878 - RNA, 19 nt, Homo sapiens
ccacaccgggagugccuaa

SEQ ID NO: 110879 - RNA, 19 nt, Homo sapiens
gaaccagggaaaggagaga

SEQ ID NO: 110880 - RNA, 19 nt, Homo sapiens
gagccagggaucccaggaa

SEQ ID NO: 110881 - RNA, 19 nt, Homo sapiens
uguagagguccaugauauu

SEQ ID NO: 110882 - RNA, 19 nt, Homo sapiens
gauuacaauggaaacauca

SEQ ID NO: 110883 - RNA, 19 nt, Homo sapiens
uagagguccaugauauuug

SEQ ID NO: 110884 - RNA, 19 nt, Homo sapiens
aaggagagaugguggauua

SEQ ID NO: 110885 - RNA, 19 nt, Homo sapiens
ccaaggagcgccuggauua

SEQ ID NO: 110886 - RNA, 19 nt, Homo sapiens
gaacaagugaugccucuaa

SEQ ID NO: 110887 - RNA, 19 nt, Homo sapiens
ggaacguucuucgaaauaa

SEQ ID NO: 110888 - RNA, 19 nt, Homo sapiens
cagcugggcuuccugguuu

SEQ ID NO: 110889 - RNA, 19 nt, Homo sapiens
cguaaugucugcaugauau

SEQ ID NO: 110890 - RNA, 19 nt, Homo sapiens
gcacauuuauuaaguaucg

SEQ ID NO: 110891 - RNA, 19 nt, Homo sapiens
ccaaagacaucuccaggau

SEQ ID NO: 110892 - RNA, 19 nt, Homo sapiens
gcagacacuugaagggaaa

SEQ ID NO: 110893 - RNA, 19 nt, Homo sapiens
cagggagugugucaaguua

SEQ ID NO: 110894 - RNA, 19 nt, Homo sapiens
gaaaugaaacauggcaauu

SEQ ID NO: 110895 - RNA, 19 nt, Homo sapiens
aaagggaccucgcgguaaa

SEQ ID NO: 110896 - RNA, 19 nt, Homo sapiens
gagagaugguggauuacaa

SEQ ID NO: 110897 - RNA, 19 nt, Homo sapiens
caugauauuugcuaagcua

SEQ ID NO: 110898 - RNA, 19 nt, Homo sapiens
gaaaaugccagaaguauga

SEQ ID NO: 110899 - RNA, 19 nt, Homo sapiens
gaugguggauuacaaugga

SEQ ID NO: 110900 - RNA, 19 nt, Homo sapiens
agaaguaugaugcaucuua

SEQ ID NO: 110901 - RNA, 19 nt, Homo sapiens
gaaguaugaugcaucuuac

SEQ ID NO: 110902 - RNA, 19 nt, Homo sapiens
gcugucgccuuuauuuauu

SEQ ID NO: 110903 - RNA, 19 nt, Homo sapiens
guagagguccaugauauuu

SEQ ID NO: 110904 - RNA, 19 nt, Homo sapiens
uaacugcccaccagcauuu

SEQ ID NO: 110905 - RNA, 19 nt, Homo sapiens
uaacuuuccuggacuugga

SEQ ID NO: 110906 - RNA, 19 nt, Homo sapiens
ggauuacaauggaaacauc

SEQ ID NO: 110907 - RNA, 19 nt, Homo sapiens
cuaggugugucuaagagua

SEQ ID NO: 110908 - RNA, 19 nt, Homo sapiens
gggcgaagauggcuuacca

SEQ ID NO: 110909 - RNA, 19 nt, Homo sapiens
gcagggagugugucaaguu

SEQ ID NO: 110910 - RNA, 19 nt, Homo sapiens
caugauauuugugcacauu

SEQ ID NO: 110911 - RNA, 19 nt, Homo sapiens
ggaaaugaaacauggcaau

SEQ ID NO: 110912 - RNA, 19 nt, Homo sapiens
ccagaaguaugaugcaucu

SEQ ID NO: 110913 - RNA, 19 nt, Homo sapiens
aaggagagccggucagauu

SEQ ID NO: 110914 - RNA, 19 nt, Homo sapiens
gcugggcuguccaucauug

SEQ ID NO: 110915 - RNA, 19 nt, Homo sapiens
gaacguucuucgaaauaac

SEQ ID NO: 110916 - RNA, 19 nt, Homo sapiens
caagggagaaccagggaaa

SEQ ID NO: 110917 - RNA, 19 nt, Homo sapiens
gguccaugauauuugcuaa

SEQ ID NO: 110918 - RNA, 19 nt, Homo sapiens
cuggcuagcucauguguga

SEQ ID NO: 110919 - RNA, 19 nt, Homo sapiens
gggagugugucaaguuaca

SEQ ID NO: 110920 - RNA, 19 nt, Homo sapiens
ggaagcaggacuagaugga

SEQ ID NO: 110921 - RNA, 19 nt, Homo sapiens
gauauuugcuaagcuaggu

SEQ ID NO: 110922 - RNA, 19 nt, Homo sapiens
caaggcugcuggaacaagu

SEQ ID NO: 110923 - RNA, 19 nt, Homo sapiens
guauaagccuaugucucua

SEQ ID NO: 110924 - RNA, 19 nt, Homo sapiens
ggauaagggagaccaagga

SEQ ID NO: 110925 - RNA, 19 nt, Homo sapiens
acccggagcuucagguuug

SEQ ID NO: 110926 - RNA, 19 nt, Homo sapiens
gggagaagcaggugucgau

SEQ ID NO: 110927 - RNA, 19 nt, Homo sapiens
auaucaaccucuucccuuu

SEQ ID NO: 110928 - RNA, 19 nt, Homo sapiens
acaauggaaacaucaauga

SEQ ID NO: 110929 - RNA, 19 nt, Homo sapiens
ggagaacagggaccagaug

SEQ ID NO: 110930 - RNA, 19 nt, Homo sapiens
gaaaggagagaugguggau

SEQ ID NO: 110931 - RNA, 19 nt, Homo sapiens
caguuuggauagagccuuu

SEQ ID NO: 110932 - RNA, 19 nt, Homo sapiens
ggugcuggcuagcucaugu

SEQ ID NO: 110933 - RNA, 19 nt, Homo sapiens
uguauaagccuaugucucu

SEQ ID NO: 110934 - RNA, 19 nt, Homo sapiens
cuagagguuucccuggauu

SEQ ID NO: 110935 - RNA, 19 nt, Homo sapiens
gcaaauggagacggcuauu

SEQ ID NO: 110936 - RNA, 19 nt, Homo sapiens
ggucguaaugucugcauga

SEQ ID NO: 110937 - RNA, 19 nt, Homo sapiens
aagccuaugucucuaauac

SEQ ID NO: 110938 - RNA, 19 nt, Homo sapiens
gaaaggcuuccagggagaa

SEQ ID NO: 110939 - RNA, 19 nt, Homo sapiens
gcggcugucgccuuuauuu

SEQ ID NO: 110940 - RNA, 19 nt, Homo sapiens
gcagcugggcuuccugguu

SEQ ID NO: 110941 - RNA, 19 nt, Homo sapiens
uauaagccuaugucucuaa

SEQ ID NO: 110942 - RNA, 19 nt, Homo sapiens
cuuggaacguucuucgaaa

SEQ ID NO: 110943 - RNA, 19 nt, Homo sapiens
guguguguguuuguacaua

SEQ ID NO: 110944 - RNA, 19 nt, Homo sapiens
gaaagacugggcggagaga

SEQ ID NO: 110945 - RNA, 19 nt, Homo sapiens
auguagagguccaugauau

SEQ ID NO: 110946 - RNA, 19 nt, Homo sapiens
uaaauguagagguccauga

SEQ ID NO: 110947 - RNA, 19 nt, Homo sapiens
gggaagaaaggcucuagag

SEQ ID NO: 110948 - RNA, 19 nt, Homo sapiens
ggagagaugguggauuaca

SEQ ID NO: 110949 - RNA, 19 nt, Homo sapiens
ggcugucgccuuuauuuau

SEQ ID NO: 110950 - RNA, 19 nt, Homo sapiens
ccucuccuacugcuaauuu

SEQ ID NO: 110951 - RNA, 19 nt, Homo sapiens
uaagcuaggugugucuaag

SEQ ID NO: 110952 - RNA, 19 nt, Homo sapiens
uggaacguucuucgaaaua

SEQ ID NO: 110953 - RNA, 19 nt, Homo sapiens
cggcugucgccuuuauuua

SEQ ID NO: 110954 - RNA, 19 nt, Homo sapiens
uagcucaugugugaauuca

SEQ ID NO: 110955 - RNA, 19 nt, Homo sapiens
cagaaaauaucaaccucuu

SEQ ID NO: 110956 - RNA, 19 nt, Homo sapiens
guaugaugcaucuuacaga

SEQ ID NO: 110957 - RNA, 19 nt, Homo sapiens
gcguggagcagcuggagaa

SEQ ID NO: 110958 - RNA, 19 nt, Homo sapiens
gaugcuggcaacuccauug

SEQ ID NO: 110959 - RNA, 19 nt, Homo sapiens
guaacugcccaccagcauu

SEQ ID NO: 110960 - RNA, 19 nt, Homo sapiens
gggacuacccggagcuuca

SEQ ID NO: 110961 - RNA, 19 nt, Homo sapiens
uggagcagcuggagaacag

SEQ ID NO: 110962 - RNA, 19 nt, Homo sapiens
aaaugaaacauggcaauuc

SEQ ID NO: 110963 - RNA, 19 nt, Homo sapiens
ggucuuccugggcaaauug

SEQ ID NO: 110964 - RNA, 19 nt, Homo sapiens
gagaugguggauuacaaug

SEQ ID NO: 110965 - RNA, 19 nt, Homo sapiens
gggagaaccagggaaagga

SEQ ID NO: 110966 - RNA, 19 nt, Homo sapiens
gagccaggccagcauccaa

SEQ ID NO: 110967 - RNA, 19 nt, Homo sapiens
ggauuuccgggucccauug

SEQ ID NO: 110968 - RNA, 19 nt, Homo sapiens
uagcggagcgcacccacaa

SEQ ID NO: 110969 - RNA, 19 nt, Homo sapiens
gcuagcucaugugugaauu

SEQ ID NO: 110970 - RNA, 19 nt, Homo sapiens
guaaugucugcaugauauu

SEQ ID NO: 110971 - RNA, 19 nt, Homo sapiens
ccaauuaccgcugguugug

SEQ ID NO: 110972 - RNA, 19 nt, Homo sapiens
uggauuggccugugugugu

SEQ ID NO: 110973 - RNA, 19 nt, Homo sapiens
aaaggagacccugggauga

SEQ ID NO: 110974 - RNA, 19 nt, Homo sapiens
gguacuccaggaccaauug

SEQ ID NO: 110975 - RNA, 19 nt, Homo sapiens
gaaccagggaaaggagaga

SEQ ID NO: 110976 - RNA, 19 nt, Homo sapiens
gagccagggaucccaggaa

SEQ ID NO: 110977 - RNA, 19 nt, Homo sapiens
uguagagguccaugauauu

SEQ ID NO: 110978 - RNA, 19 nt, Homo sapiens
gauuacaauggaaacauca

SEQ ID NO: 110979 - RNA, 19 nt, Homo sapiens
gaaggagagccggucagau

SEQ ID NO: 110980 - RNA, 19 nt, Homo sapiens
uagagguccaugauauuug

SEQ ID NO: 110981 - RNA, 19 nt, Homo sapiens
gaccaaggagcgccuggau

SEQ ID NO: 110982 - RNA, 19 nt, Homo sapiens
uuggaacguucuucgaaau

SEQ ID NO: 110983 - RNA, 19 nt, Homo sapiens
agagguccaugauauuugc

SEQ ID NO: 110984 - RNA, 19 nt, Homo sapiens
aaggagagaugguggauua

SEQ ID NO: 110985 - RNA, 19 nt, Homo sapiens
ccaaggagcgccuggauua

SEQ ID NO: 110986 - RNA, 19 nt, Homo sapiens
gaacaagugaugccucuaa

SEQ ID NO: 110987 - RNA, 19 nt, Homo sapiens
ggaacguucuucgaaauaa

SEQ ID NO: 110988 - RNA, 19 nt, Homo sapiens
cagcugggcuuccugguuu

SEQ ID NO: 110989 - RNA, 19 nt, Homo sapiens
cguaaugucugcaugauau

SEQ ID NO: 110990 - RNA, 19 nt, Homo sapiens
gcucugcgcuccagccaaa

SEQ ID NO: 110991 - RNA, 19 nt, Homo sapiens
gcacauuuauuaaguaucg

SEQ ID NO: 110992 - RNA, 19 nt, Homo sapiens
ccaaagacaucuccaggau

SEQ ID NO: 110993 - RNA, 19 nt, Homo sapiens
gcagacacuugaagggaaa

SEQ ID NO: 110994 - RNA, 19 nt, Homo sapiens
cagggagugugucaaguua

SEQ ID NO: 110995 - RNA, 19 nt, Homo sapiens
gaaaugaaacauggcaauu

SEQ ID NO: 110996 - RNA, 19 nt, Homo sapiens
aaagggaccucgcgguaaa

SEQ ID NO: 110997 - RNA, 19 nt, Homo sapiens
gagagaugguggauuacaa

SEQ ID NO: 110998 - RNA, 19 nt, Homo sapiens
caugauauuugcuaagcua

SEQ ID NO: 110999 - RNA, 19 nt, Homo sapiens
gaaaaugccagaaguauga

SEQ ID NO: 111000 - RNA, 19 nt, Homo sapiens
gaugguggauuacaaugga

SEQ ID NO: 111001 - RNA, 19 nt, Homo sapiens
agaaguaugaugcaucuua

SEQ ID NO: 111002 - RNA, 19 nt, Homo sapiens
ccaaauaauugcccugaag

SEQ ID NO: 111003 - RNA, 19 nt, Homo sapiens
gaaguaugaugcaucuuac

SEQ ID NO: 111004 - RNA, 19 nt, Homo sapiens
gcugucgccuuuauuuauu

SEQ ID NO: 111005 - RNA, 19 nt, Homo sapiens
guagagguccaugauauuu

SEQ ID NO: 111006 - RNA, 19 nt, Homo sapiens
uaacugcccaccagcauuu

SEQ ID NO: 111007 - RNA, 19 nt, Homo sapiens
uaacuuuccuggacuugga

SEQ ID NO: 111008 - RNA, 19 nt, Homo sapiens
ggauuacaauggaaacauc

SEQ ID NO: 111009 - RNA, 19 nt, Homo sapiens
cuaggugugucuaagagua

SEQ ID NO: 111010 - RNA, 19 nt, Homo sapiens
gggcgaagauggcuuacca

SEQ ID NO: 111011 - RNA, 19 nt, Homo sapiens
gcagggagugugucaaguu

SEQ ID NO: 111012 - RNA, 19 nt, Homo sapiens
caugauauuugugcacauu

SEQ ID NO: 111013 - RNA, 19 nt, Homo sapiens
ggaaaugaaacauggcaau

SEQ ID NO: 111014 - RNA, 19 nt, Homo sapiens
ccagaaguaugaugcaucu

SEQ ID NO: 111015 - RNA, 19 nt, Homo sapiens
aaggagagccggucagauu

SEQ ID NO: 111016 - RNA, 19 nt, Homo sapiens
gcugggcuguccaucauug

SEQ ID NO: 111017 - RNA, 19 nt, Homo sapiens
gaacguucuucgaaauaac

SEQ ID NO: 111018 - RNA, 19 nt, Homo sapiens
caagggagaaccagggaaa

SEQ ID NO: 111019 - RNA, 19 nt, Homo sapiens
gguccaugauauuugcuaa

SEQ ID NO: 111020 - RNA, 19 nt, Homo sapiens
cuggcuagcucauguguga

SEQ ID NO: 111021 - RNA, 19 nt, Homo sapiens
gggagugugucaaguuaca

SEQ ID NO: 111022 - RNA, 19 nt, Homo sapiens
ggaagcaggacuagaugga

SEQ ID NO: 111023 - RNA, 19 nt, Homo sapiens
gauauuugcuaagcuaggu

SEQ ID NO: 111024 - RNA, 19 nt, Homo sapiens
caaggcugcuggaacaagu

SEQ ID NO: 111025 - RNA, 19 nt, Homo sapiens
guauaagccuaugucucua

SEQ ID NO: 111026 - RNA, 19 nt, Homo sapiens
ggauaagggagaccaagga

SEQ ID NO: 111027 - RNA, 19 nt, Homo sapiens
gggagaagcaggugucgau

SEQ ID NO: 111028 - RNA, 19 nt, Homo sapiens
auaucaaccucuucccuuu

SEQ ID NO: 111029 - RNA, 19 nt, Homo sapiens
acaauggaaacaucaauga

SEQ ID NO: 111030 - RNA, 19 nt, Homo sapiens
ggagaacagggaccagaug

SEQ ID NO: 111031 - RNA, 19 nt, Homo sapiens
gaaaggagagaugguggau

SEQ ID NO: 111032 - RNA, 19 nt, Homo sapiens
caguuuggauagagccuuu

SEQ ID NO: 111033 - RNA, 19 nt, Homo sapiens
ggugcuggcuagcucaugu

SEQ ID NO: 111034 - RNA, 19 nt, Homo sapiens
uguauaagccuaugucucu

SEQ ID NO: 111035 - RNA, 19 nt, Homo sapiens
gccaaauaauugcccugaa

SEQ ID NO: 111036 - RNA, 19 nt, Homo sapiens
gcgcuccagccaaauaauu

SEQ ID NO: 111037 - RNA, 19 nt, Homo sapiens
cuagagguuucccuggauu

SEQ ID NO: 111038 - RNA, 19 nt, Homo sapiens
gcaaauggagacggcuauu

SEQ ID NO: 111039 - RNA, 19 nt, Homo sapiens
ggucguaaugucugcauga

SEQ ID NO: 111040 - RNA, 19 nt, Homo sapiens
aagccuaugucucuaauac

SEQ ID NO: 111041 - RNA, 19 nt, Homo sapiens
gaaaggcuuccagggagaa

SEQ ID NO: 111042 - RNA, 19 nt, Homo sapiens
gcggcugucgccuuuauuu

SEQ ID NO: 111043 - RNA, 19 nt, Homo sapiens
gcagcugggcuuccugguu

SEQ ID NO: 111044 - RNA, 19 nt, Homo sapiens
uauaagccuaugucucuaa

SEQ ID NO: 111045 - RNA, 19 nt, Homo sapiens
guguguguguuuguacaua

SEQ ID NO: 111046 - RNA, 19 nt, Homo sapiens
cuuggaacguucuucgaaa

SEQ ID NO: 111047 - RNA, 19 nt, Homo sapiens
gaaagacugggcggagaga

SEQ ID NO: 111048 - RNA, 19 nt, Homo sapiens
auguagagguccaugauau

SEQ ID NO: 111049 - RNA, 19 nt, Homo sapiens
uaaauguagagguccauga

SEQ ID NO: 111050 - RNA, 19 nt, Homo sapiens
gggaagaaaggcucuagag

SEQ ID NO: 111051 - RNA, 19 nt, Homo sapiens
ggagagaugguggauuaca

SEQ ID NO: 111052 - RNA, 19 nt, Homo sapiens
ggcugucgccuuuauuuau

SEQ ID NO: 111053 - RNA, 19 nt, Homo sapiens
ccucuccuacugcuaauuu

SEQ ID NO: 111054 - RNA, 19 nt, Homo sapiens
uaagcuaggugugucuaag

SEQ ID NO: 111055 - RNA, 19 nt, Homo sapiens
uggaacguucuucgaaaua

SEQ ID NO: 111056 - RNA, 19 nt, Homo sapiens
cggcugucgccuuuauuua

SEQ ID NO: 111057 - RNA, 19 nt, Homo sapiens
uagcucaugugugaauuca

SEQ ID NO: 111058 - RNA, 19 nt, Homo sapiens
cagaaaauaucaaccucuu

SEQ ID NO: 111059 - RNA, 19 nt, Homo sapiens
guaugaugcaucuuacaga

SEQ ID NO: 111060 - RNA, 19 nt, Homo sapiens
gcguggagcagcuggagaa

SEQ ID NO: 111061 - RNA, 19 nt, Homo sapiens
gaugcuggcaacuccauug

SEQ ID NO: 111062 - RNA, 19 nt, Homo sapiens
guaacugcccaccagcauu

SEQ ID NO: 111063 - RNA, 19 nt, Homo sapiens
uggagcagcuggagaacag

SEQ ID NO: 111064 - RNA, 19 nt, Homo sapiens
aaaugaaacauggcaauuc

SEQ ID NO: 111065 - RNA, 19 nt, Homo sapiens
ggucuuccugggcaaauug

SEQ ID NO: 111066 - RNA, 19 nt, Homo sapiens
gagaugguggauuacaaug

SEQ ID NO: 111067 - RNA, 19 nt, Homo sapiens
gggagaaccagggaaagga

SEQ ID NO: 111068 - RNA, 19 nt, Homo sapiens
gagccaggccagcauccaa

SEQ ID NO: 111069 - RNA, 19 nt, Homo sapiens
ggauuuccgggucccauug

SEQ ID NO: 111070 - RNA, 19 nt, Homo sapiens
uagcggagcgcacccacaa

SEQ ID NO: 111071 - RNA, 19 nt, Homo sapiens
gcuagcucaugugugaauu

SEQ ID NO: 111072 - RNA, 19 nt, Homo sapiens
guaaugucugcaugauauu

SEQ ID NO: 111073 - RNA, 19 nt, Homo sapiens
uggauuggccugugugugu

SEQ ID NO: 111074 - RNA, 19 nt, Homo sapiens
aaaggagacccugggauga

SEQ ID NO: 111075 - RNA, 19 nt, Homo sapiens
gguacuccaggaccaauug

SEQ ID NO: 111076 - RNA, 19 nt, Homo sapiens
ccaauuaccgcugguugug

SEQ ID NO: 111077 - RNA, 19 nt, Homo sapiens
ccacaccgggagugccuaa

SEQ ID NO: 111078 - RNA, 19 nt, Homo sapiens
gaaccagggaaaggagaga

SEQ ID NO: 111079 - RNA, 19 nt, Homo sapiens
gagccagggaucccaggaa

SEQ ID NO: 111080 - RNA, 19 nt, Homo sapiens
uguagagguccaugauauu

SEQ ID NO: 111081 - RNA, 19 nt, Homo sapiens
gauuacaauggaaacauca

SEQ ID NO: 111082 - RNA, 19 nt, Homo sapiens
uagagguccaugauauuug

SEQ ID NO: 111083 - RNA, 19 nt, Homo sapiens
uuggaacguucuucgaaau

SEQ ID NO: 111084 - RNA, 19 nt, Homo sapiens
aaggagagaugguggauua

SEQ ID NO: 111085 - RNA, 19 nt, Homo sapiens
ccaaggagcgccuggauua

SEQ ID NO: 111086 - RNA, 19 nt, Homo sapiens
gaacaagugaugccucuaa

SEQ ID NO: 111087 - RNA, 19 nt, Homo sapiens
ggaacguucuucgaaauaa

SEQ ID NO: 111088 - RNA, 19 nt, Homo sapiens
cagcugggcuuccugguuu

SEQ ID NO: 111089 - RNA, 19 nt, Homo sapiens
cguaaugucugcaugauau

SEQ ID NO: 111090 - RNA, 19 nt, Homo sapiens
gcacauuuauuaaguaucg

SEQ ID NO: 111091 - RNA, 19 nt, Homo sapiens
ccaaagacaucuccaggau

SEQ ID NO: 111092 - RNA, 19 nt, Homo sapiens
gcagacacuugaagggaaa

SEQ ID NO: 111093 - RNA, 19 nt, Homo sapiens
cagggagugugucaaguua

SEQ ID NO: 111094 - RNA, 19 nt, Homo sapiens
gaaaugaaacauggcaauu

SEQ ID NO: 111095 - RNA, 19 nt, Homo sapiens
aaagggaccucgcgguaaa

SEQ ID NO: 111096 - RNA, 19 nt, Homo sapiens
gagagaugguggauuacaa

SEQ ID NO: 111097 - RNA, 19 nt, Homo sapiens
caugauauuugcuaagcua

SEQ ID NO: 111098 - RNA, 19 nt, Homo sapiens
gaaaaugccagaaguauga

SEQ ID NO: 111099 - RNA, 19 nt, Homo sapiens
gaugguggauuacaaugga

SEQ ID NO: 111100 - RNA, 19 nt, Homo sapiens
agaaguaugaugcaucuua

SEQ ID NO: 111101 - RNA, 19 nt, Homo sapiens
gaaguaugaugcaucuuac

SEQ ID NO: 111102 - RNA, 19 nt, Homo sapiens
gcugucgccuuuauuuauu

SEQ ID NO: 111103 - RNA, 19 nt, Homo sapiens
guagagguccaugauauuu

SEQ ID NO: 111104 - RNA, 19 nt, Homo sapiens
uaacuuuccuggacuugga

SEQ ID NO: 111105 - RNA, 19 nt, Homo sapiens
ggauuacaauggaaacauc

SEQ ID NO: 111106 - RNA, 19 nt, Homo sapiens
cuaggugugucuaagagua

SEQ ID NO: 111107 - RNA, 19 nt, Homo sapiens
gggcgaagauggcuuacca

SEQ ID NO: 111108 - RNA, 19 nt, Homo sapiens
gcagggagugugucaaguu

SEQ ID NO: 111109 - RNA, 19 nt, Homo sapiens
caugauauuugugcacauu

SEQ ID NO: 111110 - RNA, 19 nt, Homo sapiens
ggaaaugaaacauggcaau

SEQ ID NO: 111111 - RNA, 19 nt, Homo sapiens
ccagaaguaugaugcaucu

SEQ ID NO: 111112 - RNA, 19 nt, Homo sapiens
aaggagagccggucagauu

SEQ ID NO: 111113 - RNA, 19 nt, Homo sapiens
gaacguucuucgaaauaac

SEQ ID NO: 111114 - RNA, 19 nt, Homo sapiens
caagggagaaccagggaaa

SEQ ID NO: 111115 - RNA, 19 nt, Homo sapiens
gguccaugauauuugcuaa

SEQ ID NO: 111116 - RNA, 19 nt, Homo sapiens
cuggcuagcucauguguga

SEQ ID NO: 111117 - RNA, 19 nt, Homo sapiens
gggagugugucaaguuaca

SEQ ID NO: 111118 - RNA, 19 nt, Homo sapiens
ggaagcaggacuagaugga

SEQ ID NO: 111119 - RNA, 19 nt, Homo sapiens
gauauuugcuaagcuaggu

SEQ ID NO: 111120 - RNA, 19 nt, Homo sapiens
caaggcugcuggaacaagu

SEQ ID NO: 111121 - RNA, 19 nt, Homo sapiens
guauaagccuaugucucua

SEQ ID NO: 111122 - RNA, 19 nt, Homo sapiens
ggauaagggagaccaagga

SEQ ID NO: 111123 - RNA, 19 nt, Homo sapiens
acccggagcuucagguuug

SEQ ID NO: 111124 - RNA, 19 nt, Homo sapiens
gggagaagcaggugucgau

SEQ ID NO: 111125 - RNA, 19 nt, Homo sapiens
auaucaaccucuucccuuu

SEQ ID NO: 111126 - RNA, 19 nt, Homo sapiens
acaauggaaacaucaauga

SEQ ID NO: 111127 - RNA, 19 nt, Homo sapiens
ggagaacagggaccagaug

SEQ ID NO: 111128 - RNA, 19 nt, Homo sapiens
gaaaggagagaugguggau

SEQ ID NO: 111129 - RNA, 19 nt, Homo sapiens
caguuuggauagagccuuu

SEQ ID NO: 111130 - RNA, 19 nt, Homo sapiens
ggugcuggcuagcucaugu

SEQ ID NO: 111131 - RNA, 19 nt, Homo sapiens
uguauaagccuaugucucu

SEQ ID NO: 111132 - RNA, 19 nt, Homo sapiens
gcugcugccucuccucaau

SEQ ID NO: 111133 - RNA, 19 nt, Homo sapiens
cuagagguuucccuggauu

SEQ ID NO: 111134 - RNA, 19 nt, Homo sapiens
gcaaauggagacggcuauu

SEQ ID NO: 111135 - RNA, 19 nt, Homo sapiens
ggucguaaugucugcauga

SEQ ID NO: 111136 - RNA, 19 nt, Homo sapiens
aagccuaugucucuaauac

SEQ ID NO: 111137 - RNA, 19 nt, Homo sapiens
gaaaggcuuccagggagaa

SEQ ID NO: 111138 - RNA, 19 nt, Homo sapiens
gcggcugucgccuuuauuu

SEQ ID NO: 111139 - RNA, 19 nt, Homo sapiens
gcagcugggcuuccugguu

SEQ ID NO: 111140 - RNA, 19 nt, Homo sapiens
uauaagccuaugucucuaa

SEQ ID NO: 111141 - RNA, 19 nt, Homo sapiens
guguguguguuuguacaua

SEQ ID NO: 111142 - RNA, 19 nt, Homo sapiens
cuuggaacguucuucgaaa

SEQ ID NO: 111143 - RNA, 19 nt, Homo sapiens
gaaagacugggcggagaga

SEQ ID NO: 111144 - RNA, 19 nt, Homo sapiens
auguagagguccaugauau

SEQ ID NO: 111145 - RNA, 19 nt, Homo sapiens
uaaauguagagguccauga

SEQ ID NO: 111146 - RNA, 19 nt, Homo sapiens
gggaagaaaggcucuagag

SEQ ID NO: 111147 - RNA, 19 nt, Homo sapiens
ggagagaugguggauuaca

SEQ ID NO: 111148 - RNA, 19 nt, Homo sapiens
ggcugucgccuuuauuuau

SEQ ID NO: 111149 - RNA, 19 nt, Homo sapiens
ccucuccuacugcuaauuu

SEQ ID NO: 111150 - RNA, 19 nt, Homo sapiens
uaagcuaggugugucuaag

SEQ ID NO: 111151 - RNA, 19 nt, Homo sapiens
cggcugucgccuuuauuua

SEQ ID NO: 111152 - RNA, 19 nt, Homo sapiens
uggaacguucuucgaaaua

SEQ ID NO: 111153 - RNA, 19 nt, Homo sapiens
uagcucaugugugaauuca

SEQ ID NO: 111154 - RNA, 19 nt, Homo sapiens
cagaaaauaucaaccucuu

SEQ ID NO: 111155 - RNA, 19 nt, Homo sapiens
guaugaugcaucuuacaga

SEQ ID NO: 111156 - RNA, 19 nt, Homo sapiens
gcguggagcagcuggagaa

SEQ ID NO: 111157 - RNA, 19 nt, Homo sapiens
gaugcuggcaacuccauug

SEQ ID NO: 111158 - RNA, 19 nt, Homo sapiens
gggacuacccggagcuuca

SEQ ID NO: 111159 - RNA, 19 nt, Homo sapiens
uggagcagcuggagaacag

SEQ ID NO: 111160 - RNA, 19 nt, Homo sapiens
aaaugaaacauggcaauuc

SEQ ID NO: 111161 - RNA, 19 nt, Homo sapiens
ggucuuccugggcaaauug

SEQ ID NO: 111162 - RNA, 19 nt, Homo sapiens
gagaugguggauuacaaug

SEQ ID NO: 111163 - RNA, 19 nt, Homo sapiens
gggagaaccagggaaagga

SEQ ID NO: 111164 - RNA, 19 nt, Homo sapiens
gagccaggccagcauccaa

SEQ ID NO: 111165 - RNA, 19 nt, Homo sapiens
ggauuuccgggucccauug

SEQ ID NO: 111166 - RNA, 19 nt, Homo sapiens
uagcggagcgcacccacaa

SEQ ID NO: 111167 - RNA, 19 nt, Homo sapiens
gcuagcucaugugugaauu

SEQ ID NO: 111168 - RNA, 19 nt, Homo sapiens
guaaugucugcaugauauu

SEQ ID NO: 111169 - RNA, 19 nt, Homo sapiens
ccaauuaccgcugguugug

SEQ ID NO: 111170 - RNA, 19 nt, Homo sapiens
uggauuggccugugugugu

SEQ ID NO: 111171 - RNA, 19 nt, Homo sapiens
aaaggagacccugggauga

SEQ ID NO: 111172 - RNA, 19 nt, Homo sapiens
gguacuccaggaccaauug

SEQ ID NO: 111173 - RNA, 19 nt, Homo sapiens
gaaccagggaaaggagaga

SEQ ID NO: 111174 - RNA, 19 nt, Homo sapiens
gagccagggaucccaggaa

SEQ ID NO: 111175 - RNA, 19 nt, Homo sapiens
uguagagguccaugauauu

SEQ ID NO: 111176 - RNA, 19 nt, Homo sapiens
gauuacaauggaaacauca

SEQ ID NO: 111177 - RNA, 19 nt, Homo sapiens
uagagguccaugauauuug

SEQ ID NO: 111178 - RNA, 19 nt, Homo sapiens
gaaggagagccggucagau

SEQ ID NO: 111179 - RNA, 19 nt, Homo sapiens
gaccaaggagcgccuggau

SEQ ID NO: 111180 - RNA, 19 nt, Homo sapiens
uuggaacguucuucgaaau

SEQ ID NO: 111181 - RNA, 19 nt, Homo sapiens
agagguccaugauauuugc

SEQ ID NO: 111182 - RNA, 19 nt, Homo sapiens
aauguagagguccaugaua

SEQ ID NO: 111183 - RNA, 19 nt, Homo sapiens
gcaugauauuugugcacau

SEQ ID NO: 111184 - RNA, 19 nt, Homo sapiens
aaggagagaugguggauua

SEQ ID NO: 111185 - RNA, 19 nt, Homo sapiens
ccaaggagcgccuggauua

SEQ ID NO: 111186 - RNA, 19 nt, Homo sapiens
gaacaagugaugccucuaa

SEQ ID NO: 111187 - RNA, 19 nt, Homo sapiens
ggaacguucuucgaaauaa

SEQ ID NO: 111188 - RNA, 19 nt, Homo sapiens
cagcugggcuuccugguuu

SEQ ID NO: 111189 - RNA, 19 nt, Homo sapiens
cguaaugucugcaugauau

SEQ ID NO: 111190 - RNA, 19 nt, Homo sapiens
gcucugcgcuccagccaaa

SEQ ID NO: 111191 - RNA, 19 nt, Homo sapiens
gcacauuuauuaaguaucg

SEQ ID NO: 111192 - RNA, 19 nt, Homo sapiens
ccaaagacaucuccaggau

SEQ ID NO: 111193 - RNA, 19 nt, Homo sapiens
gcagacacuugaagggaaa

SEQ ID NO: 111194 - RNA, 19 nt, Homo sapiens
cagggagugugucaaguua

SEQ ID NO: 111195 - RNA, 19 nt, Homo sapiens
gaaaugaaacauggcaauu

SEQ ID NO: 111196 - RNA, 19 nt, Homo sapiens
aaagggaccucgcgguaaa

SEQ ID NO: 111197 - RNA, 19 nt, Homo sapiens
gagagaugguggauuacaa

SEQ ID NO: 111198 - RNA, 19 nt, Homo sapiens
caugauauuugcuaagcua

SEQ ID NO: 111199 - RNA, 19 nt, Homo sapiens
gaaaaugccagaaguauga

SEQ ID NO: 111200 - RNA, 19 nt, Homo sapiens
gaugguggauuacaaugga

SEQ ID NO: 111201 - RNA, 19 nt, Homo sapiens
agaaguaugaugcaucuua

SEQ ID NO: 111202 - RNA, 19 nt, Homo sapiens
ccaaauaauugcccugaag

SEQ ID NO: 111203 - RNA, 19 nt, Homo sapiens
gaaguaugaugcaucuuac

SEQ ID NO: 111204 - RNA, 19 nt, Homo sapiens
gcugucgccuuuauuuauu

SEQ ID NO: 111205 - RNA, 19 nt, Homo sapiens
guagagguccaugauauuu

SEQ ID NO: 111206 - RNA, 19 nt, Homo sapiens
uaacuuuccuggacuugga

SEQ ID NO: 111207 - RNA, 19 nt, Homo sapiens
ggauuacaauggaaacauc

SEQ ID NO: 111208 - RNA, 19 nt, Homo sapiens
cuaggugugucuaagagua

SEQ ID NO: 111209 - RNA, 19 nt, Homo sapiens
gggcgaagauggcuuacca

SEQ ID NO: 111210 - RNA, 19 nt, Homo sapiens
gcagggagugugucaaguu

SEQ ID NO: 111211 - RNA, 19 nt, Homo sapiens
caugauauuugugcacauu

SEQ ID NO: 111212 - RNA, 19 nt, Homo sapiens
ggaaaugaaacauggcaau

SEQ ID NO: 111213 - RNA, 19 nt, Homo sapiens
aaggagagccggucagauu

SEQ ID NO: 111214 - RNA, 19 nt, Homo sapiens
ccagaaguaugaugcaucu

SEQ ID NO: 111215 - RNA, 19 nt, Homo sapiens
gaacguucuucgaaauaac

SEQ ID NO: 111216 - RNA, 19 nt, Homo sapiens
caagggagaaccagggaaa

SEQ ID NO: 111217 - RNA, 19 nt, Homo sapiens
gguccaugauauuugcuaa

SEQ ID NO: 111218 - RNA, 19 nt, Homo sapiens
cuggcuagcucauguguga

SEQ ID NO: 111219 - RNA, 19 nt, Homo sapiens
gggagugugucaaguuaca

SEQ ID NO: 111220 - RNA, 19 nt, Homo sapiens
ggaagcaggacuagaugga

SEQ ID NO: 111221 - RNA, 19 nt, Homo sapiens
gauauuugcuaagcuaggu

SEQ ID NO: 111222 - RNA, 19 nt, Homo sapiens
caaggcugcuggaacaagu

SEQ ID NO: 111223 - RNA, 19 nt, Homo sapiens
guauaagccuaugucucua

SEQ ID NO: 111224 - RNA, 19 nt, Homo sapiens
ggauaagggagaccaagga

SEQ ID NO: 111225 - RNA, 19 nt, Homo sapiens
acccggagcuucagguuug

SEQ ID NO: 111226 - RNA, 19 nt, Homo sapiens
gggagaagcaggugucgau

SEQ ID NO: 111227 - RNA, 19 nt, Homo sapiens
auaucaaccucuucccuuu

SEQ ID NO: 111228 - RNA, 19 nt, Homo sapiens
acaauggaaacaucaauga

SEQ ID NO: 111229 - RNA, 19 nt, Homo sapiens
ggagaacagggaccagaug

SEQ ID NO: 111230 - RNA, 19 nt, Homo sapiens
gaaaggagagaugguggau

SEQ ID NO: 111231 - RNA, 19 nt, Homo sapiens
caguuuggauagagccuuu

SEQ ID NO: 111232 - RNA, 19 nt, Homo sapiens
ggugcuggcuagcucaugu

SEQ ID NO: 111233 - RNA, 19 nt, Homo sapiens
uguauaagccuaugucucu

SEQ ID NO: 111234 - RNA, 19 nt, Homo sapiens
gccaaauaauugcccugaa

SEQ ID NO: 111235 - RNA, 19 nt, Homo sapiens
gcgcuccagccaaauaauu

SEQ ID NO: 111236 - RNA, 19 nt, Homo sapiens
cuagagguuucccuggauu

SEQ ID NO: 111237 - RNA, 19 nt, Homo sapiens
gcaaauggagacggcuauu

SEQ ID NO: 111238 - RNA, 19 nt, Homo sapiens
ggucguaaugucugcauga

SEQ ID NO: 111239 - RNA, 19 nt, Homo sapiens
aagccuaugucucuaauac

SEQ ID NO: 111240 - RNA, 19 nt, Homo sapiens
gaaaggcuuccagggagaa

SEQ ID NO: 111241 - RNA, 19 nt, Homo sapiens
gcggcugucgccuuuauuu

SEQ ID NO: 111242 - RNA, 19 nt, Homo sapiens
gcagcugggcuuccugguu

SEQ ID NO: 111243 - RNA, 19 nt, Homo sapiens
uauaagccuaugucucuaa

SEQ ID NO: 111244 - RNA, 19 nt, Homo sapiens
cuuggaacguucuucgaaa

SEQ ID NO: 111245 - RNA, 19 nt, Homo sapiens
guguguguguuuguacaua

SEQ ID NO: 111246 - RNA, 19 nt, Homo sapiens
gaaagacugggcggagaga

SEQ ID NO: 111247 - RNA, 19 nt, Homo sapiens
auguagagguccaugauau

SEQ ID NO: 111248 - RNA, 19 nt, Homo sapiens
uaaauguagagguccauga

SEQ ID NO: 111249 - RNA, 19 nt, Homo sapiens
gggaagaaaggcucuagag

SEQ ID NO: 111250 - RNA, 19 nt, Homo sapiens
ggagagaugguggauuaca

SEQ ID NO: 111251 - RNA, 19 nt, Homo sapiens
ggcugucgccuuuauuuau

SEQ ID NO: 111252 - RNA, 19 nt, Homo sapiens
ccucuccuacugcuaauuu

SEQ ID NO: 111253 - RNA, 19 nt, Homo sapiens
uaagcuaggugugucuaag

SEQ ID NO: 111254 - RNA, 19 nt, Homo sapiens
uggaacguucuucgaaaua

SEQ ID NO: 111255 - RNA, 19 nt, Homo sapiens
cggcugucgccuuuauuua

SEQ ID NO: 111256 - RNA, 19 nt, Homo sapiens
uagcucaugugugaauuca

SEQ ID NO: 111257 - RNA, 19 nt, Homo sapiens
cagaaaauaucaaccucuu

SEQ ID NO: 111258 - RNA, 19 nt, Homo sapiens
guaugaugcaucuuacaga

SEQ ID NO: 111259 - RNA, 19 nt, Homo sapiens
gcguggagcagcuggagaa

SEQ ID NO: 111260 - RNA, 19 nt, Homo sapiens
gaugcuggcaacuccauug

SEQ ID NO: 111261 - RNA, 19 nt, Homo sapiens
gggacuacccggagcuuca

SEQ ID NO: 111262 - RNA, 19 nt, Homo sapiens
uggagcagcuggagaacag

SEQ ID NO: 111263 - RNA, 19 nt, Homo sapiens
aaaugaaacauggcaauuc

SEQ ID NO: 111264 - RNA, 19 nt, Homo sapiens
ggucuuccugggcaaauug

SEQ ID NO: 111265 - RNA, 19 nt, Homo sapiens
gagaugguggauuacaaug

SEQ ID NO: 111266 - RNA, 19 nt, Homo sapiens
gggagaaccagggaaagga

SEQ ID NO: 111267 - RNA, 19 nt, Homo sapiens
gagccaggccagcauccaa

SEQ ID NO: 111268 - RNA, 19 nt, Homo sapiens
ggauuuccgggucccauug

SEQ ID NO: 111269 - RNA, 19 nt, Homo sapiens
uagcggagcgcacccacaa

SEQ ID NO: 111270 - RNA, 19 nt, Homo sapiens
gcuagcucaugugugaauu

SEQ ID NO: 111271 - RNA, 19 nt, Homo sapiens
guaaugucugcaugauauu

SEQ ID NO: 111272 - RNA, 19 nt, Homo sapiens
uggauuggccugugugugu

SEQ ID NO: 111273 - RNA, 19 nt, Homo sapiens
ccaauuaccgcugguugug

SEQ ID NO: 111274 - RNA, 19 nt, Homo sapiens
aaaggagacccugggauga

SEQ ID NO: 111275 - RNA, 19 nt, Homo sapiens
gguacuccaggaccaauug

SEQ ID NO: 111276 - RNA, 19 nt, Homo sapiens
ccacaccgggagugccuaa

SEQ ID NO: 111277 - RNA, 19 nt, Homo sapiens
gaaccagggaaaggagaga

SEQ ID NO: 111278 - RNA, 19 nt, Homo sapiens
gagccagggaucccaggaa

SEQ ID NO: 111279 - RNA, 19 nt, Homo sapiens
uguagagguccaugauauu

SEQ ID NO: 111280 - RNA, 19 nt, Homo sapiens
gauuacaauggaaacauca

SEQ ID NO: 111281 - RNA, 19 nt, Homo sapiens
uagagguccaugauauuug

SEQ ID NO: 111282 - RNA, 19 nt, Homo sapiens
gaccaaggagcgccuggau

SEQ ID NO: 111283 - RNA, 19 nt, Homo sapiens
uuggaacguucuucgaaau

SEQ ID NO: 111284 - RNA, 19 nt, Homo sapiens
aaggagagaugguggauua

SEQ ID NO: 111285 - RNA, 19 nt, Homo sapiens
ccaaggagcgccuggauua

SEQ ID NO: 111286 - RNA, 19 nt, Homo sapiens
gaacaagugaugccucuaa

SEQ ID NO: 111287 - RNA, 19 nt, Homo sapiens
ggaacguucuucgaaauaa

SEQ ID NO: 111288 - RNA, 19 nt, Homo sapiens
cagcugggcuuccugguuu

SEQ ID NO: 111289 - RNA, 19 nt, Homo sapiens
cguaaugucugcaugauau

SEQ ID NO: 111290 - RNA, 19 nt, Homo sapiens
gcacauuuauuaaguaucg

SEQ ID NO: 111291 - RNA, 19 nt, Homo sapiens
ccaaagacaucuccaggau

SEQ ID NO: 111292 - RNA, 19 nt, Homo sapiens
gcagacacuugaagggaaa

SEQ ID NO: 111293 - RNA, 19 nt, Homo sapiens
cagggagugugucaaguua

SEQ ID NO: 111294 - RNA, 19 nt, Homo sapiens
gaaaugaaacauggcaauu

SEQ ID NO: 111295 - RNA, 19 nt, Homo sapiens
aaagggaccucgcgguaaa

SEQ ID NO: 111296 - RNA, 19 nt, Homo sapiens
gagagaugguggauuacaa

SEQ ID NO: 111297 - RNA, 19 nt, Homo sapiens
caugauauuugcuaagcua

SEQ ID NO: 111298 - RNA, 19 nt, Homo sapiens
gaaaaugccagaaguauga

SEQ ID NO: 111299 - RNA, 19 nt, Homo sapiens
gaugguggauuacaaugga

SEQ ID NO: 111300 - RNA, 19 nt, Homo sapiens
agaaguaugaugcaucuua

SEQ ID NO: 111301 - RNA, 19 nt, Homo sapiens
gaaguaugaugcaucuuac

SEQ ID NO: 111302 - RNA, 19 nt, Homo sapiens
gcugucgccuuuauuuauu

SEQ ID NO: 111303 - RNA, 19 nt, Homo sapiens
guagagguccaugauauuu

SEQ ID NO: 111304 - RNA, 19 nt, Homo sapiens
uaacuuuccuggacuugga

SEQ ID NO: 111305 - RNA, 19 nt, Homo sapiens
ggauuacaauggaaacauc

SEQ ID NO: 111306 - RNA, 19 nt, Homo sapiens
cuaggugugucuaagagua

SEQ ID NO: 111307 - RNA, 19 nt, Homo sapiens
gggcgaagauggcuuacca

SEQ ID NO: 111308 - RNA, 19 nt, Homo sapiens
gcagggagugugucaaguu

SEQ ID NO: 111309 - RNA, 19 nt, Homo sapiens
caugauauuugugcacauu

SEQ ID NO: 111310 - RNA, 19 nt, Homo sapiens
ggaaaugaaacauggcaau

SEQ ID NO: 111311 - RNA, 19 nt, Homo sapiens
ccagaaguaugaugcaucu

SEQ ID NO: 111312 - RNA, 19 nt, Homo sapiens
aaggagagccggucagauu

SEQ ID NO: 111313 - RNA, 19 nt, Homo sapiens
gcugggcuguccaucauug

SEQ ID NO: 111314 - RNA, 19 nt, Homo sapiens
gaacguucuucgaaauaac

SEQ ID NO: 111315 - RNA, 19 nt, Homo sapiens
caagggagaaccagggaaa

SEQ ID NO: 111316 - RNA, 19 nt, Homo sapiens
gguccaugauauuugcuaa

SEQ ID NO: 111317 - RNA, 19 nt, Homo sapiens
cuggcuagcucauguguga

SEQ ID NO: 111318 - RNA, 19 nt, Homo sapiens
gggagugugucaaguuaca

SEQ ID NO: 111319 - RNA, 19 nt, Homo sapiens
ggaagcaggacuagaugga

SEQ ID NO: 111320 - RNA, 19 nt, Homo sapiens
gauauuugcuaagcuaggu

SEQ ID NO: 111321 - RNA, 19 nt, Homo sapiens
caaggcugcuggaacaagu

SEQ ID NO: 111322 - RNA, 19 nt, Homo sapiens
guauaagccuaugucucua

SEQ ID NO: 111323 - RNA, 19 nt, Homo sapiens
ggauaagggagaccaagga

SEQ ID NO: 111324 - RNA, 19 nt, Homo sapiens
acccggagcuucagguuug

SEQ ID NO: 111325 - RNA, 19 nt, Homo sapiens
gggagaagcaggugucgau

SEQ ID NO: 111326 - RNA, 19 nt, Homo sapiens
auaucaaccucuucccuuu

SEQ ID NO: 111327 - RNA, 19 nt, Homo sapiens
acaauggaaacaucaauga

SEQ ID NO: 111328 - RNA, 19 nt, Homo sapiens
ggagaacagggaccagaug

SEQ ID NO: 111329 - RNA, 19 nt, Homo sapiens
gaaaggagagaugguggau

SEQ ID NO: 111330 - RNA, 19 nt, Homo sapiens
caguuuggauagagccuuu

SEQ ID NO: 111331 - RNA, 19 nt, Homo sapiens
ggugcuggcuagcucaugu

SEQ ID NO: 111332 - RNA, 19 nt, Homo sapiens
uguauaagccuaugucucu

SEQ ID NO: 111333 - RNA, 19 nt, Homo sapiens
cuagagguuucccuggauu

SEQ ID NO: 111334 - RNA, 19 nt, Homo sapiens
gcaaauggagacggcuauu

SEQ ID NO: 111335 - RNA, 19 nt, Homo sapiens
ggucguaaugucugcauga

SEQ ID NO: 111336 - RNA, 19 nt, Homo sapiens
aagccuaugucucuaauac

SEQ ID NO: 111337 - RNA, 19 nt, Homo sapiens
gaaaggcuuccagggagaa

SEQ ID NO: 111338 - RNA, 19 nt, Homo sapiens
gcggcugucgccuuuauuu

SEQ ID NO: 111339 - RNA, 19 nt, Homo sapiens
gcagcugggcuuccugguu

SEQ ID NO: 111340 - RNA, 19 nt, Homo sapiens
uauaagccuaugucucuaa

SEQ ID NO: 111341 - RNA, 19 nt, Homo sapiens
guguguguguuuguacaua

SEQ ID NO: 111342 - RNA, 19 nt, Homo sapiens
cuuggaacguucuucgaaa

SEQ ID NO: 111343 - RNA, 19 nt, Homo sapiens
gaaagacugggcggagaga

SEQ ID NO: 111344 - RNA, 19 nt, Homo sapiens
auguagagguccaugauau

SEQ ID NO: 111345 - RNA, 19 nt, Homo sapiens
uaaauguagagguccauga

SEQ ID NO: 111346 - RNA, 19 nt, Homo sapiens
gggaagaaaggcucuagag

SEQ ID NO: 111347 - RNA, 19 nt, Homo sapiens
ggagagaugguggauuaca

SEQ ID NO: 111348 - RNA, 19 nt, Homo sapiens
ggcugucgccuuuauuuau

SEQ ID NO: 111349 - RNA, 19 nt, Homo sapiens
ccucuccuacugcuaauuu

SEQ ID NO: 111350 - RNA, 19 nt, Homo sapiens
uaagcuaggugugucuaag

SEQ ID NO: 111351 - RNA, 19 nt, Homo sapiens
uggaacguucuucgaaaua

SEQ ID NO: 111352 - RNA, 19 nt, Homo sapiens
cggcugucgccuuuauuua

SEQ ID NO: 111353 - RNA, 19 nt, Homo sapiens
uagcucaugugugaauuca

SEQ ID NO: 111354 - RNA, 19 nt, Homo sapiens
cagaaaauaucaaccucuu

SEQ ID NO: 111355 - RNA, 19 nt, Homo sapiens
guaugaugcaucuuacaga

SEQ ID NO: 111356 - RNA, 19 nt, Homo sapiens
gcguggagcagcuggagaa

SEQ ID NO: 111357 - RNA, 19 nt, Homo sapiens
gaugcuggcaacuccauug

SEQ ID NO: 111358 - RNA, 19 nt, Homo sapiens
gggacuacccggagcuuca

SEQ ID NO: 111359 - RNA, 19 nt, Homo sapiens
uggagcagcuggagaacag

SEQ ID NO: 111360 - RNA, 19 nt, Homo sapiens
aaaugaaacauggcaauuc

SEQ ID NO: 111361 - RNA, 19 nt, Homo sapiens
ggucuuccugggcaaauug

SEQ ID NO: 111362 - RNA, 19 nt, Homo sapiens
gagaugguggauuacaaug

SEQ ID NO: 111363 - RNA, 19 nt, Homo sapiens
gggagaaccagggaaagga

SEQ ID NO: 111364 - RNA, 19 nt, Homo sapiens
gagccaggccagcauccaa

SEQ ID NO: 111365 - RNA, 19 nt, Homo sapiens
ggauuuccgggucccauug

SEQ ID NO: 111366 - RNA, 19 nt, Homo sapiens
uagcggagcgcacccacaa

SEQ ID NO: 111367 - RNA, 19 nt, Homo sapiens
gcuagcucaugugugaauu

SEQ ID NO: 111368 - RNA, 19 nt, Homo sapiens
guaaugucugcaugauauu

SEQ ID NO: 111369 - RNA, 19 nt, Homo sapiens
ccaauuaccgcugguugug

SEQ ID NO: 111370 - RNA, 19 nt, Homo sapiens
uggauuggccugugugugu

SEQ ID NO: 111371 - RNA, 19 nt, Homo sapiens
aaaggagacccugggauga

SEQ ID NO: 111372 - RNA, 19 nt, Homo sapiens
gguacuccaggaccaauug

SEQ ID NO: 111373 - RNA, 19 nt, Homo sapiens
gaaccagggaaaggagaga

SEQ ID NO: 111374 - RNA, 19 nt, Homo sapiens
gagccagggaucccaggaa

SEQ ID NO: 111375 - RNA, 19 nt, Homo sapiens
uguagagguccaugauauu

SEQ ID NO: 111376 - RNA, 19 nt, Homo sapiens
gauuacaauggaaacauca

SEQ ID NO: 111377 - RNA, 19 nt, Homo sapiens
uagagguccaugauauuug

SEQ ID NO: 111378 - RNA, 19 nt, Homo sapiens
gaaggagagccggucagau

SEQ ID NO: 111379 - RNA, 19 nt, Homo sapiens
gaccaaggagcgccuggau

SEQ ID NO: 111380 - RNA, 19 nt, Homo sapiens
uuggaacguucuucgaaau

SEQ ID NO: 111381 - RNA, 19 nt, Homo sapiens
agagguccaugauauuugc

SEQ ID NO: 111382 - RNA, 19 nt, Homo sapiens
aauguagagguccaugaua

SEQ ID NO: 111383 - RNA, 19 nt, Homo sapiens
gcaugauauuugugcacau

SEQ ID NO: 111384 - RNA, 19 nt, Homo sapiens
aaggagagaugguggauua

SEQ ID NO: 111385 - RNA, 19 nt, Homo sapiens
gaacaagugaugccucuaa

SEQ ID NO: 111386 - RNA, 19 nt, Homo sapiens
ggaacguucuucgaaauaa

SEQ ID NO: 111387 - RNA, 19 nt, Homo sapiens
cagcugggcuuccugguuu

SEQ ID NO: 111388 - RNA, 19 nt, Homo sapiens
cguaaugucugcaugauau

SEQ ID NO: 111389 - RNA, 19 nt, Homo sapiens
gcucugcgcuccagccaaa

SEQ ID NO: 111390 - RNA, 19 nt, Homo sapiens
gcacauuuauuaaguaucg

SEQ ID NO: 111391 - RNA, 19 nt, Homo sapiens
ccaaagacaucuccaggau

SEQ ID NO: 111392 - RNA, 19 nt, Homo sapiens
gcagacacuugaagggaaa

SEQ ID NO: 111393 - RNA, 19 nt, Homo sapiens
cagggagugugucaaguua

SEQ ID NO: 111394 - RNA, 19 nt, Homo sapiens
gaaaugaaacauggcaauu

SEQ ID NO: 111395 - RNA, 19 nt, Homo sapiens
aaagggaccucgcgguaaa

SEQ ID NO: 111396 - RNA, 19 nt, Homo sapiens
gagagaugguggauuacaa

SEQ ID NO: 111397 - RNA, 19 nt, Homo sapiens
caugauauuugcuaagcua

SEQ ID NO: 111398 - RNA, 19 nt, Homo sapiens
gaaaaugccagaaguauga

SEQ ID NO: 111399 - RNA, 19 nt, Homo sapiens
gaugguggauuacaaugga

SEQ ID NO: 111400 - RNA, 19 nt, Homo sapiens
agaaguaugaugcaucuua

SEQ ID NO: 111401 - RNA, 19 nt, Homo sapiens
ccaaauaauugcccugaag

SEQ ID NO: 111402 - RNA, 19 nt, Homo sapiens
gaaguaugaugcaucuuac

SEQ ID NO: 111403 - RNA, 19 nt, Homo sapiens
gcugucgccuuuauuuauu

SEQ ID NO: 111404 - RNA, 19 nt, Homo sapiens
guagagguccaugauauuu

SEQ ID NO: 111405 - RNA, 19 nt, Homo sapiens
uaacugcccaccagcauuu

SEQ ID NO: 111406 - RNA, 19 nt, Homo sapiens
uaacuuuccuggacuugga

SEQ ID NO: 111407 - RNA, 19 nt, Homo sapiens
ggauuacaauggaaacauc

SEQ ID NO: 111408 - RNA, 19 nt, Homo sapiens
cuaggugugucuaagagua

SEQ ID NO: 111409 - RNA, 19 nt, Homo sapiens
gggcgaagauggcuuacca

SEQ ID NO: 111410 - RNA, 19 nt, Homo sapiens
gcagggagugugucaaguu

SEQ ID NO: 111411 - RNA, 19 nt, Homo sapiens
caugauauuugugcacauu

SEQ ID NO: 111412 - RNA, 19 nt, Homo sapiens
ggaaaugaaacauggcaau

SEQ ID NO: 111413 - RNA, 19 nt, Homo sapiens
aaggagagccggucagauu

SEQ ID NO: 111414 - RNA, 19 nt, Homo sapiens
ccagaaguaugaugcaucu

SEQ ID NO: 111415 - RNA, 19 nt, Homo sapiens
gaacguucuucgaaauaac

SEQ ID NO: 111416 - RNA, 19 nt, Homo sapiens
caagggagaaccagggaaa

SEQ ID NO: 111417 - RNA, 19 nt, Homo sapiens
gguccaugauauuugcuaa

SEQ ID NO: 111418 - RNA, 19 nt, Homo sapiens
cuggcuagcucauguguga

SEQ ID NO: 111419 - RNA, 19 nt, Homo sapiens
gggagugugucaaguuaca

SEQ ID NO: 111420 - RNA, 19 nt, Homo sapiens
ggaagcaggacuagaugga

SEQ ID NO: 111421 - RNA, 19 nt, Homo sapiens
gauauuugcuaagcuaggu

SEQ ID NO: 111422 - RNA, 19 nt, Homo sapiens
caaggcugcuggaacaagu

SEQ ID NO: 111423 - RNA, 19 nt, Homo sapiens
guauaagccuaugucucua

SEQ ID NO: 111424 - RNA, 19 nt, Homo sapiens
gggagaagcaggugucgau

SEQ ID NO: 111425 - RNA, 19 nt, Homo sapiens
auaucaaccucuucccuuu

SEQ ID NO: 111426 - RNA, 19 nt, Homo sapiens
acaauggaaacaucaauga

SEQ ID NO: 111427 - RNA, 19 nt, Homo sapiens
ggagaacagggaccagaug

SEQ ID NO: 111428 - RNA, 19 nt, Homo sapiens
gaaaggagagaugguggau

SEQ ID NO: 111429 - RNA, 19 nt, Homo sapiens
caguuuggauagagccuuu

SEQ ID NO: 111430 - RNA, 19 nt, Homo sapiens
ggugcuggcuagcucaugu

SEQ ID NO: 111431 - RNA, 19 nt, Homo sapiens
uguauaagccuaugucucu

SEQ ID NO: 111432 - RNA, 19 nt, Homo sapiens
gccaaauaauugcccugaa

SEQ ID NO: 111433 - RNA, 19 nt, Homo sapiens
gcgcuccagccaaauaauu

SEQ ID NO: 111434 - RNA, 19 nt, Homo sapiens
cuagagguuucccuggauu

SEQ ID NO: 111435 - RNA, 19 nt, Homo sapiens
gcaaauggagacggcuauu

SEQ ID NO: 111436 - RNA, 19 nt, Homo sapiens
ggucguaaugucugcauga

SEQ ID NO: 111437 - RNA, 19 nt, Homo sapiens
aagccuaugucucuaauac

SEQ ID NO: 111438 - RNA, 19 nt, Homo sapiens
gaaaggcuuccagggagaa

SEQ ID NO: 111439 - RNA, 19 nt, Homo sapiens
gcggcugucgccuuuauuu

SEQ ID NO: 111440 - RNA, 19 nt, Homo sapiens
gcagcugggcuuccugguu

SEQ ID NO: 111441 - RNA, 19 nt, Homo sapiens
uauaagccuaugucucuaa

SEQ ID NO: 111442 - RNA, 19 nt, Homo sapiens
gaaagacugggcggagaga

SEQ ID NO: 111443 - RNA, 19 nt, Homo sapiens
guguguguguuuguacaua

SEQ ID NO: 111444 - RNA, 19 nt, Homo sapiens
cuuggaacguucuucgaaa

SEQ ID NO: 111445 - RNA, 19 nt, Homo sapiens
auguagagguccaugauau

SEQ ID NO: 111446 - RNA, 19 nt, Homo sapiens
uaaauguagagguccauga

SEQ ID NO: 111447 - RNA, 19 nt, Homo sapiens
ggagagaugguggauuaca

SEQ ID NO: 111448 - RNA, 19 nt, Homo sapiens
ggcugucgccuuuauuuau

SEQ ID NO: 111449 - RNA, 19 nt, Homo sapiens
ccucuccuacugcuaauuu

SEQ ID NO: 111450 - RNA, 19 nt, Homo sapiens
uaagcuaggugugucuaag

SEQ ID NO: 111451 - RNA, 19 nt, Homo sapiens
cggcugucgccuuuauuua

SEQ ID NO: 111452 - RNA, 19 nt, Homo sapiens
uggaacguucuucgaaaua

SEQ ID NO: 111453 - RNA, 19 nt, Homo sapiens
uagcucaugugugaauuca

SEQ ID NO: 111454 - RNA, 19 nt, Homo sapiens
cagaaaauaucaaccucuu

SEQ ID NO: 111455 - RNA, 19 nt, Homo sapiens
guaugaugcaucuuacaga

SEQ ID NO: 111456 - RNA, 19 nt, Homo sapiens
gcguggagcagcuggagaa

SEQ ID NO: 111457 - RNA, 19 nt, Homo sapiens
gaugcuggcaacuccauug

SEQ ID NO: 111458 - RNA, 19 nt, Homo sapiens
guaacugcccaccagcauu

SEQ ID NO: 111459 - RNA, 19 nt, Homo sapiens
uggagcagcuggagaacag

SEQ ID NO: 111460 - RNA, 19 nt, Homo sapiens
aaaugaaacauggcaauuc

SEQ ID NO: 111461 - RNA, 19 nt, Homo sapiens
ggucuuccugggcaaauug

SEQ ID NO: 111462 - RNA, 19 nt, Homo sapiens
gagaugguggauuacaaug

SEQ ID NO: 111463 - RNA, 19 nt, Homo sapiens
gggagaaccagggaaagga

SEQ ID NO: 111464 - RNA, 19 nt, Homo sapiens
gagccaggccagcauccaa

SEQ ID NO: 111465 - RNA, 19 nt, Homo sapiens
ggauuuccgggucccauug

SEQ ID NO: 111466 - RNA, 19 nt, Homo sapiens
uagcggagcgcacccacaa

SEQ ID NO: 111467 - RNA, 19 nt, Homo sapiens
gcuagcucaugugugaauu

SEQ ID NO: 111468 - RNA, 19 nt, Homo sapiens
guaaugucugcaugauauu

SEQ ID NO: 111469 - RNA, 19 nt, Homo sapiens
ccaauuaccgcugguugug

SEQ ID NO: 111470 - RNA, 19 nt, Homo sapiens
uggauuggccugugugugu

SEQ ID NO: 111471 - RNA, 19 nt, Homo sapiens
aaaggagacccugggauga

SEQ ID NO: 111472 - RNA, 19 nt, Homo sapiens
gguacuccaggaccaauug

SEQ ID NO: 111473 - RNA, 19 nt, Homo sapiens
ccacaccgggagugccuaa

SEQ ID NO: 111474 - RNA, 19 nt, Homo sapiens
gaaccagggaaaggagaga

SEQ ID NO: 111475 - RNA, 19 nt, Homo sapiens
gagccagggaucccaggaa

SEQ ID NO: 111476 - RNA, 19 nt, Homo sapiens
uguagagguccaugauauu

SEQ ID NO: 111477 - RNA, 19 nt, Homo sapiens
gauuacaauggaaacauca

SEQ ID NO: 111478 - RNA, 19 nt, Homo sapiens
uagagguccaugauauuug

SEQ ID NO: 111479 - RNA, 19 nt, Homo sapiens
gaaggagagccggucagau

SEQ ID NO: 111480 - RNA, 19 nt, Homo sapiens
uuggaacguucuucgaaau

SEQ ID NO: 111481 - RNA, 19 nt, Homo sapiens
ccaggucaaccaggaacua

SEQ ID NO: 111482 - RNA, 19 nt, Homo sapiens
agagguccaugauauuugc

SEQ ID NO: 111483 - RNA, 19 nt, Homo sapiens
aauguagagguccaugaua

SEQ ID NO: 111484 - RNA, 19 nt, Homo sapiens
gcacuuaucugaaaucuuc

SEQ ID NO: 111485 - RNA, 19 nt, Homo sapiens
gaaauuagccuccacaugu

SEQ ID NO: 111486 - RNA, 19 nt, Homo sapiens
gaagggaaguuaggaagaa

SEQ ID NO: 111487 - RNA, 19 nt, Homo sapiens
gcagaaauauaugagauga

SEQ ID NO: 111488 - RNA, 19 nt, Homo sapiens
cgaauucggugcucaguga

SEQ ID NO: 111489 - RNA, 19 nt, Homo sapiens
gaacacaagaagagaaauu

SEQ ID NO: 111490 - RNA, 19 nt, Homo sapiens
ccugauaucuccugaauuc

SEQ ID NO: 111491 - RNA, 19 nt, Homo sapiens
ccaaaaugcuccccaaaua

SEQ ID NO: 111492 - RNA, 19 nt, Homo sapiens
gaaaagcgguggaaagaga

SEQ ID NO: 111493 - RNA, 19 nt, Homo sapiens
ucacacagcugaacagaag

SEQ ID NO: 111494 - RNA, 19 nt, Homo sapiens
ggagaacauugcauaggaa

SEQ ID NO: 111495 - RNA, 19 nt, Homo sapiens
gcauaggaaugucuggaaa

SEQ ID NO: 111496 - RNA, 19 nt, Homo sapiens
cauaguccuucuaacaaua

SEQ ID NO: 111497 - RNA, 19 nt, Homo sapiens
ucugaaaucuucccucuug

SEQ ID NO: 111498 - RNA, 19 nt, Homo sapiens
agaugaagcugcaagugua

SEQ ID NO: 111499 - RNA, 19 nt, Homo sapiens
guagguagauaacauccaa

SEQ ID NO: 111500 - RNA, 19 nt, Homo sapiens
gagccagacucaguaauug

SEQ ID NO: 111501 - RNA, 19 nt, Homo sapiens
ccacagagcucacauuccu

SEQ ID NO: 111502 - RNA, 19 nt, Homo sapiens
gaagcaggguucugggaau

SEQ ID NO: 111503 - RNA, 19 nt, Homo sapiens
gaaauugcuggguuuagaa

SEQ ID NO: 111504 - RNA, 19 nt, Homo sapiens
gauaacauccaaucacugu

SEQ ID NO: 111505 - RNA, 19 nt, Homo sapiens
gagcucaggucccucaaag

SEQ ID NO: 111506 - RNA, 19 nt, Homo sapiens
ggagucacaggcaucuuua

SEQ ID NO: 111507 - RNA, 19 nt, Homo sapiens
caauagauguagggaaaga

SEQ ID NO: 111508 - RNA, 19 nt, Homo sapiens
guuacagccuucacauuug

SEQ ID NO: 111509 - RNA, 19 nt, Homo sapiens
caaucacuguuugcacuua

SEQ ID NO: 111510 - RNA, 19 nt, Homo sapiens
acaggcaucuuuauaguuc

SEQ ID NO: 111511 - RNA, 19 nt, Homo sapiens
ucacaggcaucuuuauagu

SEQ ID NO: 111512 - RNA, 19 nt, Homo sapiens
gaucagcauugccaacaca

SEQ ID NO: 111513 - RNA, 19 nt, Homo sapiens
agaaauugcuggguuuaga

SEQ ID NO: 111514 - RNA, 19 nt, Homo sapiens
ucacagcucugguuguaag

SEQ ID NO: 111515 - RNA, 19 nt, Homo sapiens
cucaauagauguagggaaa

SEQ ID NO: 111516 - RNA, 19 nt, Homo sapiens
gucaauaagcaguggauua

SEQ ID NO: 111517 - RNA, 19 nt, Homo sapiens
gauuguagguagauaacau

SEQ ID NO: 111518 - RNA, 19 nt, Homo sapiens
ccacacauucucaaccaua

SEQ ID NO: 111519 - RNA, 19 nt, Homo sapiens
gcacuuuagcuuccucaaa

SEQ ID NO: 111520 - RNA, 19 nt, Homo sapiens
gauuacauuucagcacuuu

SEQ ID NO: 111521 - RNA, 19 nt, Homo sapiens
guauugagaagggaaguua

SEQ ID NO: 111522 - RNA, 19 nt, Homo sapiens
ggucgccacuccucugcua

SEQ ID NO: 111523 - RNA, 19 nt, Homo sapiens
ggacagaucagcccauugc

SEQ ID NO: 111524 - RNA, 19 nt, Homo sapiens
acucacagcucugguugua

SEQ ID NO: 111525 - RNA, 19 nt, Homo sapiens
gagaugaagcugcaagugu

SEQ ID NO: 111526 - RNA, 19 nt, Homo sapiens
gaaaaggaauugauagaac

SEQ ID NO: 111527 - RNA, 19 nt, Homo sapiens
ccaaagcagaaauauauga

SEQ ID NO: 111528 - RNA, 19 nt, Homo sapiens
ucaggaaugucaauaagca

SEQ ID NO: 111529 - RNA, 19 nt, Homo sapiens
cacaaguucuuacaucuuc

SEQ ID NO: 111530 - RNA, 19 nt, Homo sapiens
uaaagggauuguagguaga

SEQ ID NO: 111531 - RNA, 19 nt, Homo sapiens
gcccaaaggucuugaagcu

SEQ ID NO: 111532 - RNA, 19 nt, Homo sapiens
gcaguuuccucauuucaac

SEQ ID NO: 111533 - RNA, 19 nt, Homo sapiens
caaaggucuugaagcuuga

SEQ ID NO: 111534 - RNA, 19 nt, Homo sapiens
ccauaguccuucuaacaau

SEQ ID NO: 111535 - RNA, 19 nt, Homo sapiens
gaucugcugucuguaguuc

SEQ ID NO: 111536 - RNA, 19 nt, Homo sapiens
aagagaaauugcuggguuu

SEQ ID NO: 111537 - RNA, 19 nt, Homo sapiens
ggguagcccuggacuuaau

SEQ ID NO: 111538 - RNA, 19 nt, Homo sapiens
guuaacauauagacacugu

SEQ ID NO: 111539 - RNA, 19 nt, Homo sapiens
uggagaacauugcauagga

SEQ ID NO: 111540 - RNA, 19 nt, Homo sapiens
auacauguccauccugaua

SEQ ID NO: 111541 - RNA, 19 nt, Homo sapiens
gccccagacucguaaauua

SEQ ID NO: 111542 - RNA, 19 nt, Homo sapiens
ccaaauaagaaaugcauca

SEQ ID NO: 111543 - RNA, 19 nt, Homo sapiens
ccacaaccagcaaguaaga

SEQ ID NO: 111544 - RNA, 19 nt, Homo sapiens
ggagaguuaaacaacauuu

SEQ ID NO: 111545 - RNA, 19 nt, Homo sapiens
ccuggcaguuuccucauuu

SEQ ID NO: 111546 - RNA, 19 nt, Homo sapiens
agccaaagcagaaauauau

SEQ ID NO: 111547 - RNA, 19 nt, Homo sapiens
uagcaucuccuuuccuuga

SEQ ID NO: 111548 - RNA, 19 nt, Homo sapiens
ggauuacauuucagcacuu

SEQ ID NO: 111549 - RNA, 19 nt, Homo sapiens
ccacaugugcaauggcuuu

SEQ ID NO: 111550 - RNA, 19 nt, Homo sapiens
auacacagcuuccucuuuu

SEQ ID NO: 111551 - RNA, 19 nt, Homo sapiens
gcgagcauguugugguaau

SEQ ID NO: 111552 - RNA, 19 nt, Homo sapiens
ccucacaaguucuuacauc

SEQ ID NO: 111553 - RNA, 19 nt, Homo sapiens
cuucacauuuguacaauuc

SEQ ID NO: 111554 - RNA, 19 nt, Homo sapiens
uguuacagccuucacauuu

SEQ ID NO: 111555 - RNA, 19 nt, Homo sapiens
ugaagacucaauagaugua

SEQ ID NO: 111556 - RNA, 19 nt, Homo sapiens
uguuugcacuuaucugaaa

SEQ ID NO: 111557 - RNA, 19 nt, Homo sapiens
aaauuagccuccacaugug

SEQ ID NO: 111558 - RNA, 19 nt, Homo sapiens
caaaaugcuccccaaauaa

SEQ ID NO: 111559 - RNA, 19 nt, Homo sapiens
ccagaaagccaaaugaaaa

SEQ ID NO: 111560 - RNA, 19 nt, Homo sapiens
ucaagccaaagcagaaaua

SEQ ID NO: 111561 - RNA, 19 nt, Homo sapiens
uuacagccuucacauuugu

SEQ ID NO: 111562 - RNA, 19 nt, Homo sapiens
uagauaacauccaaucacu

SEQ ID NO: 111563 - RNA, 19 nt, Homo sapiens
cuaacaauaccaauagcua

SEQ ID NO: 111564 - RNA, 19 nt, Homo sapiens
uuauacaucucuccuccaa

SEQ ID NO: 111565 - RNA, 19 nt, Homo sapiens
ucuuacaucuucucaggaa

SEQ ID NO: 111566 - RNA, 19 nt, Homo sapiens
aauaagcaguggauuacau

SEQ ID NO: 111567 - RNA, 19 nt, Homo sapiens
gagcauuucagaacuccaa

SEQ ID NO: 111568 - RNA, 19 nt, Homo sapiens
ucagcucagucagugaaua

SEQ ID NO: 111569 - RNA, 19 nt, Homo sapiens
ggguuuagaacaagauuau

SEQ ID NO: 111570 - RNA, 19 nt, Homo sapiens
caaacucacagcucugguu

SEQ ID NO: 111571 - RNA, 19 nt, Homo sapiens
ucuugaagcuugacaggau

SEQ ID NO: 111572 - RNA, 19 nt, Homo sapiens
ggacuccccucacaaguuc

SEQ ID NO: 111573 - RNA, 19 nt, Homo sapiens
gaguugccauucugaccuu

SEQ ID NO: 111574 - RNA, 19 nt, Homo sapiens
gcugccaacuccaucaauc

SEQ ID NO: 111575 - RNA, 19 nt, Homo sapiens
agucacaggcaucuuuaua

SEQ ID NO: 111576 - RNA, 19 nt, Homo sapiens
cucaugaucugcugucugu

SEQ ID NO: 111577 - RNA, 19 nt, Homo sapiens
gaauaggacaaagaacaga

SEQ ID NO: 111578 - RNA, 19 nt, Homo sapiens
gcagcuggauuugcauugg

SEQ ID NO: 111579 - RNA, 19 nt, Homo sapiens
gaaccaguagcaucuccuu

SEQ ID NO: 111580 - RNA, 19 nt, Homo sapiens
ucucaggaaugucaauaag

SEQ ID NO: 111581 - RNA, 19 nt, Homo sapiens
cacuuuagcuuccucaaac

SEQ ID NO: 111582 - RNA, 19 nt, Homo sapiens
guggacagaucagcccauu

SEQ ID NO: 111583 - RNA, 19 nt, Homo sapiens
aaacaugaauaggacaaag

SEQ ID NO: 111584 - RNA, 19 nt, Homo sapiens
gaaaggagccaauugauuu

SEQ ID NO: 111585 - RNA, 19 nt, Homo sapiens
gaagacaacuguagacgaa

SEQ ID NO: 111586 - RNA, 19 nt, Homo sapiens
gaucugagcuucauaaagu

SEQ ID NO: 111587 - RNA, 19 nt, Homo sapiens
ggacaucuuugaauuauga

SEQ ID NO: 111588 - RNA, 19 nt, Homo sapiens
gguacgaucuucuuuauuu

SEQ ID NO: 111589 - RNA, 19 nt, Homo sapiens
ggagaacggucaauauauu

SEQ ID NO: 111590 - RNA, 19 nt, Homo sapiens
gaugaaggguuccgauuaa

SEQ ID NO: 111591 - RNA, 19 nt, Homo sapiens
gcaaagaaguaaauuguag

SEQ ID NO: 111592 - RNA, 19 nt, Homo sapiens
cagcaaagaugaucaaguu

SEQ ID NO: 111593 - RNA, 19 nt, Homo sapiens
gagcagaacccuagucuuu

SEQ ID NO: 111594 - RNA, 19 nt, Homo sapiens
gauaaccacuccuaauauu

SEQ ID NO: 111595 - RNA, 19 nt, Homo sapiens
ggaaugggcucaguaagaa

SEQ ID NO: 111596 - RNA, 19 nt, Homo sapiens
gaagugaaauccugugaug

SEQ ID NO: 111597 - RNA, 19 nt, Homo sapiens
gaagugaaauccugugaug

SEQ ID NO: 111598 - RNA, 19 nt, Homo sapiens
agaaguggcuauccauuua

SEQ ID NO: 111599 - RNA, 19 nt, Homo sapiens
gcacgaagccgccaauuug

SEQ ID NO: 111600 - RNA, 19 nt, Homo sapiens
aaagaugucuguaaacgua

SEQ ID NO: 111601 - RNA, 19 nt, Homo sapiens
gcacgaagccgccaauuug

SEQ ID NO: 111602 - RNA, 19 nt, Homo sapiens
aaagaugucuguaaacgua

SEQ ID NO: 111603 - RNA, 19 nt, Homo sapiens
gaacauaucuuuuguccaa

SEQ ID NO: 111604 - RNA, 19 nt, Homo sapiens
gagauuaugugacuuugaa

SEQ ID NO: 111605 - RNA, 19 nt, Homo sapiens
gaugaaggguuucgcuuaa

SEQ ID NO: 111606 - RNA, 19 nt, Homo sapiens
gauaagaaggcaccuauuu

SEQ ID NO: 111607 - RNA, 19 nt, Homo sapiens
gaacaucucgaauacaauu

SEQ ID NO: 111608 - RNA, 19 nt, Homo sapiens
uaaaugaaguuguggaguu

SEQ ID NO: 111609 - RNA, 19 nt, Homo sapiens
uaaaugaaguuguggaguu

SEQ ID NO: 111610 - RNA, 19 nt, Homo sapiens
uaaaugaaguuguggaguu

SEQ ID NO: 111611 - RNA, 19 nt, Homo sapiens
gcagugaaauccugugaug

SEQ ID NO: 111612 - RNA, 19 nt, Homo sapiens
ucucauaguuggcacuuua

SEQ ID NO: 111613 - RNA, 19 nt, Homo sapiens
gaaauccugugaugacuuc

SEQ ID NO: 111614 - RNA, 19 nt, Homo sapiens
ugagaagccuuuggaauaa

SEQ ID NO: 111615 - RNA, 19 nt, Homo sapiens
gaaauccugugaugacuuc

SEQ ID NO: 111616 - RNA, 19 nt, Homo sapiens
gaaauccugugaugacuuc

SEQ ID NO: 111617 - RNA, 19 nt, Homo sapiens
gaaauccugugaugacuuc

SEQ ID NO: 111618 - RNA, 19 nt, Homo sapiens
gcagacaugugcacuugaa

SEQ ID NO: 111619 - RNA, 19 nt, Homo sapiens
ggagccaauuggaucauua

SEQ ID NO: 111620 - RNA, 19 nt, Homo sapiens
caaaugggagccagaguua

SEQ ID NO: 111621 - RNA, 19 nt, Homo sapiens
agacguaaaucaugucgua

SEQ ID NO: 111622 - RNA, 19 nt, Homo sapiens
gaagagugguuaagacuac

SEQ ID NO: 111623 - RNA, 19 nt, Homo sapiens
ggaaaggagccaauugauu

SEQ ID NO: 111624 - RNA, 19 nt, Homo sapiens
gcagaacccuagucuuuua

SEQ ID NO: 111625 - RNA, 19 nt, Homo sapiens
ccagaacccuucaauggaa

SEQ ID NO: 111626 - RNA, 19 nt, Homo sapiens
gcaauuagaguaccaggaa

SEQ ID NO: 111627 - RNA, 19 nt, Homo sapiens
caguuuggaucaacaguua

SEQ ID NO: 111628 - RNA, 19 nt, Homo sapiens
ucacucaucugcugaaugu

SEQ ID NO: 111629 - RNA, 19 nt, Homo sapiens
ucacucaucugcugaaugu

SEQ ID NO: 111630 - RNA, 19 nt, Homo sapiens
acacguaucucuauaucuu

SEQ ID NO: 111631 - RNA, 19 nt, Homo sapiens
ggacacguaucucuauauc

SEQ ID NO: 111632 - RNA, 19 nt, Homo sapiens
gaggacacguaucucuaua

SEQ ID NO: 111633 - RNA, 19 nt, Homo sapiens
uaagacuacugaagagaaa

SEQ ID NO: 111634 - RNA, 19 nt, Homo sapiens
cgaaggaguuagaaaugaa

SEQ ID NO: 111635 - RNA, 19 nt, Homo sapiens
ccagagcaguuuccauuug

SEQ ID NO: 111636 - RNA, 19 nt, Homo sapiens
uggaauuucugguuuguaa

SEQ ID NO: 111637 - RNA, 19 nt, Homo sapiens
aagaacaucucgaauacaa

SEQ ID NO: 111638 - RNA, 19 nt, Homo sapiens
ugaagaacaucucgaauac

SEQ ID NO: 111639 - RNA, 19 nt, Homo sapiens
ugucuuggcuggaaugaaa

SEQ ID NO: 111640 - RNA, 19 nt, Homo sapiens
gcaucugacuuucccauug

SEQ ID NO: 111641 - RNA, 19 nt, Homo sapiens
gcaucugacuuucccauug

SEQ ID NO: 111642 - RNA, 19 nt, Homo sapiens
gaaagguguuugagcuugu

SEQ ID NO: 111643 - RNA, 19 nt, Homo sapiens
ggacaucuuuaaaguacga

SEQ ID NO: 111644 - RNA, 19 nt, Homo sapiens
gaaagguguuugagcuugu

SEQ ID NO: 111645 - RNA, 19 nt, Homo sapiens
ggacaucuuuaaaguacga

SEQ ID NO: 111646 - RNA, 19 nt, Homo sapiens
gaaagguguuugagcuugu

SEQ ID NO: 111647 - RNA, 19 nt, Homo sapiens
uaaaggauaccgacucauu

SEQ ID NO: 111648 - RNA, 19 nt, Homo sapiens
caguucggaucccaaauua

SEQ ID NO: 111649 - RNA, 19 nt, Homo sapiens
gaacucugcaaacaaauga

SEQ ID NO: 111650 - RNA, 19 nt, Homo sapiens
gcacagcuccagaaguuga

SEQ ID NO: 111651 - RNA, 19 nt, Homo sapiens
uuaaagggcaguuccguua

SEQ ID NO: 111652 - RNA, 19 nt, Homo sapiens
gaauauugguaucugacaa

SEQ ID NO: 111653 - RNA, 19 nt, Homo sapiens
gaauauugguaucugacaa

SEQ ID NO: 111654 - RNA, 19 nt, Homo sapiens
gaauauugguaucugacaa

SEQ ID NO: 111655 - RNA, 19 nt, Homo sapiens
gaucaaaggcauccaguuc

SEQ ID NO: 111656 - RNA, 19 nt, Homo sapiens
ucaauggaauggugcauau

SEQ ID NO: 111657 - RNA, 19 nt, Homo sapiens
guccuacgaucccaauuaa

SEQ ID NO: 111658 - RNA, 19 nt, Homo sapiens
cgugugcuauuuccacuua

SEQ ID NO: 111659 - RNA, 19 nt, Homo sapiens
cuaccaaccuaacugauga

SEQ ID NO: 111660 - RNA, 19 nt, Homo sapiens
ggagugcaguggcguaauc

SEQ ID NO: 111661 - RNA, 19 nt, Homo sapiens
gcaacaauagaacaucuuu

SEQ ID NO: 111662 - RNA, 19 nt, Homo sapiens
ggaaugagaagccuuugga

SEQ ID NO: 111663 - RNA, 19 nt, Homo sapiens
gcaguuccguuagucauug

SEQ ID NO: 111664 - RNA, 19 nt, Homo sapiens
gcaccaacagagagaauuu

SEQ ID NO: 111665 - RNA, 19 nt, Homo sapiens
gcaccaacagagagaauuu

SEQ ID NO: 111666 - RNA, 19 nt, Homo sapiens
gcaccaacagagagaauuu

SEQ ID NO: 111667 - RNA, 19 nt, Homo sapiens
guucggaucccaaauuaaa

SEQ ID NO: 111668 - RNA, 19 nt, Homo sapiens
ccauuuacauucucaagga

SEQ ID NO: 111669 - RNA, 19 nt, Homo sapiens
gggaggccauucucuauca

SEQ ID NO: 111670 - RNA, 19 nt, Homo sapiens
gggaggccauucucuauca

SEQ ID NO: 111671 - RNA, 19 nt, Homo sapiens
uaauuaugcuaccuacuga

SEQ ID NO: 111672 - RNA, 19 nt, Homo sapiens
ucacagagacgcagacaug

SEQ ID NO: 111673 - RNA, 19 nt, Homo sapiens
cgaugaaggguuccgauua

SEQ ID NO: 111674 - RNA, 19 nt, Homo sapiens
gaucccaauuaaugacuuu

SEQ ID NO: 111675 - RNA, 19 nt, Homo sapiens
ucccaaagaugucuguaaa

SEQ ID NO: 111676 - RNA, 19 nt, Homo sapiens
ucccaaagaugucuguaaa

SEQ ID NO: 111677 - RNA, 19 nt, Homo sapiens
ugaauggaaucucgaagga

SEQ ID NO: 111678 - RNA, 19 nt, Homo sapiens
gaguuugaguuucccauug

SEQ ID NO: 111679 - RNA, 19 nt, Homo sapiens
guauaucacuauggagauu

SEQ ID NO: 111680 - RNA, 19 nt, Homo sapiens
cagguuggauccagaauca

SEQ ID NO: 111681 - RNA, 19 nt, Homo sapiens
ugucuuggcuggaauggaa

SEQ ID NO: 111682 - RNA, 19 nt, Homo sapiens
cagguuggauccagaauca

SEQ ID NO: 111683 - RNA, 19 nt, Homo sapiens
ugucuuggcuggaauggaa

SEQ ID NO: 111684 - RNA, 19 nt, Homo sapiens
caaccuaacugaugaauuu

SEQ ID NO: 111685 - RNA, 19 nt, Homo sapiens
gaaaggagccaauugauuu

SEQ ID NO: 111686 - RNA, 19 nt, Homo sapiens
gaagacaacuguagacgaa

SEQ ID NO: 111687 - RNA, 19 nt, Homo sapiens
gaucugagcuucauaaagu

SEQ ID NO: 111688 - RNA, 19 nt, Homo sapiens
ggacaucuuugaauuauga

SEQ ID NO: 111689 - RNA, 19 nt, Homo sapiens
gguacgaucuucuuuauuu

SEQ ID NO: 111690 - RNA, 19 nt, Homo sapiens
ggagaacggucaauauauu

SEQ ID NO: 111691 - RNA, 19 nt, Homo sapiens
gaugaaggguuccgauuaa

SEQ ID NO: 111692 - RNA, 19 nt, Homo sapiens
gcaaagaaguaaauuguag

SEQ ID NO: 111693 - RNA, 19 nt, Homo sapiens
cagcaaagaugaucaaguu

SEQ ID NO: 111694 - RNA, 19 nt, Homo sapiens
gagcagaacccuagucuuu

SEQ ID NO: 111695 - RNA, 19 nt, Homo sapiens
gauaaccacuccuaauauu

SEQ ID NO: 111696 - RNA, 19 nt, Homo sapiens
ggaaugggcucaguaagaa

SEQ ID NO: 111697 - RNA, 19 nt, Homo sapiens
gaagugaaauccugugaug

SEQ ID NO: 111698 - RNA, 19 nt, Homo sapiens
gaagugaaauccugugaug

SEQ ID NO: 111699 - RNA, 19 nt, Homo sapiens
gaagugaaauccugugaug

SEQ ID NO: 111700 - RNA, 19 nt, Homo sapiens
agaaguggcuauccauuua

SEQ ID NO: 111701 - RNA, 19 nt, Homo sapiens
gcacgaagccgccaauuug

SEQ ID NO: 111702 - RNA, 19 nt, Homo sapiens
aaagaugucuguaaacgua

SEQ ID NO: 111703 - RNA, 19 nt, Homo sapiens
gcacgaagccgccaauuug

SEQ ID NO: 111704 - RNA, 19 nt, Homo sapiens
aaagaugucuguaaacgua

SEQ ID NO: 111705 - RNA, 19 nt, Homo sapiens
gcacgaagccgccaauuug

SEQ ID NO: 111706 - RNA, 19 nt, Homo sapiens
aaagaugucuguaaacgua

SEQ ID NO: 111707 - RNA, 19 nt, Homo sapiens
gaacauaucuuuuguccaa

SEQ ID NO: 111708 - RNA, 19 nt, Homo sapiens
gagauuaugugacuuugaa

SEQ ID NO: 111709 - RNA, 19 nt, Homo sapiens
gaugaaggguuucgcuuaa

SEQ ID NO: 111710 - RNA, 19 nt, Homo sapiens
gauaagaaggcaccuauuu

SEQ ID NO: 111711 - RNA, 19 nt, Homo sapiens
uaaaugaaguuguggaguu

SEQ ID NO: 111712 - RNA, 19 nt, Homo sapiens
uaaaugaaguuguggaguu

SEQ ID NO: 111713 - RNA, 19 nt, Homo sapiens
uaaaugaaguuguggaguu

SEQ ID NO: 111714 - RNA, 19 nt, Homo sapiens
uaaaugaaguuguggaguu

SEQ ID NO: 111715 - RNA, 19 nt, Homo sapiens
gaauuugaguuucccauug

SEQ ID NO: 111716 - RNA, 19 nt, Homo sapiens
gcagugaaauccugugaug

SEQ ID NO: 111717 - RNA, 19 nt, Homo sapiens
ucucauaguuggcacuuua

SEQ ID NO: 111718 - RNA, 19 nt, Homo sapiens
gaaauccugugaugacuuc

SEQ ID NO: 111719 - RNA, 19 nt, Homo sapiens
ugagaagccuuuggaauaa

SEQ ID NO: 111720 - RNA, 19 nt, Homo sapiens
gaaauccugugaugacuuc

SEQ ID NO: 111721 - RNA, 19 nt, Homo sapiens
gaaauccugugaugacuuc

SEQ ID NO: 111722 - RNA, 19 nt, Homo sapiens
gaaauccugugaugacuuc

SEQ ID NO: 111723 - RNA, 19 nt, Homo sapiens
gaaauccugugaugacuuc

SEQ ID NO: 111724 - RNA, 19 nt, Homo sapiens
gcagacaugugcacuugaa

SEQ ID NO: 111725 - RNA, 19 nt, Homo sapiens
ggagccaauuggaucauua

SEQ ID NO: 111726 - RNA, 19 nt, Homo sapiens
caaaugggagccagaguua

SEQ ID NO: 111727 - RNA, 19 nt, Homo sapiens
agacguaaaucaugucgua

SEQ ID NO: 111728 - RNA, 19 nt, Homo sapiens
gaagagugguuaagacuac

SEQ ID NO: 111729 - RNA, 19 nt, Homo sapiens
ggaaaggagccaauugauu

SEQ ID NO: 111730 - RNA, 19 nt, Homo sapiens
gcagaacccuagucuuuua

SEQ ID NO: 111731 - RNA, 19 nt, Homo sapiens
ccagaacccuucaauggaa

SEQ ID NO: 111732 - RNA, 19 nt, Homo sapiens
gaacaucucgaauacaguu

SEQ ID NO: 111733 - RNA, 19 nt, Homo sapiens
gcaauuagaguaccaggaa

SEQ ID NO: 111734 - RNA, 19 nt, Homo sapiens
caguuuggaucaacaguua

SEQ ID NO: 111735 - RNA, 19 nt, Homo sapiens
ucacucaucugcugaaugu

SEQ ID NO: 111736 - RNA, 19 nt, Homo sapiens
ucacucaucugcugaaugu

SEQ ID NO: 111737 - RNA, 19 nt, Homo sapiens
ucacucaucugcugaaugu

SEQ ID NO: 111738 - RNA, 19 nt, Homo sapiens
acacguaucucuauaucuu

SEQ ID NO: 111739 - RNA, 19 nt, Homo sapiens
ggacacguaucucuauauc

SEQ ID NO: 111740 - RNA, 19 nt, Homo sapiens
gaggacacguaucucuaua

SEQ ID NO: 111741 - RNA, 19 nt, Homo sapiens
uaagacuacugaagagaaa

SEQ ID NO: 111742 - RNA, 19 nt, Homo sapiens
cgaaggaguuagaaaugaa

SEQ ID NO: 111743 - RNA, 19 nt, Homo sapiens
ccagagcaguuuccauuug

SEQ ID NO: 111744 - RNA, 19 nt, Homo sapiens
uggaauuucugguuuguaa

SEQ ID NO: 111745 - RNA, 19 nt, Homo sapiens
ugaagaacaucucgaauac

SEQ ID NO: 111746 - RNA, 19 nt, Homo sapiens
ugucuuggcuggaaugaaa

SEQ ID NO: 111747 - RNA, 19 nt, Homo sapiens
gcaucugacuuucccauug

SEQ ID NO: 111748 - RNA, 19 nt, Homo sapiens
gcaucugacuuucccauug

SEQ ID NO: 111749 - RNA, 19 nt, Homo sapiens
gcaucugacuuucccauug

SEQ ID NO: 111750 - RNA, 19 nt, Homo sapiens
gaaagguguuugagcuugu

SEQ ID NO: 111751 - RNA, 19 nt, Homo sapiens
ggacaucuuuaaaguacga

SEQ ID NO: 111752 - RNA, 19 nt, Homo sapiens
gaaagguguuugagcuugu

SEQ ID NO: 111753 - RNA, 19 nt, Homo sapiens
ggacaucuuuaaaguacga

SEQ ID NO: 111754 - RNA, 19 nt, Homo sapiens
gaaagguguuugagcuugu

SEQ ID NO: 111755 - RNA, 19 nt, Homo sapiens
ggacaucuuuaaaguacga

SEQ ID NO: 111756 - RNA, 19 nt, Homo sapiens
gaaagguguuugagcuugu

SEQ ID NO: 111757 - RNA, 19 nt, Homo sapiens
uaaaggauaccgacucauu

SEQ ID NO: 111758 - RNA, 19 nt, Homo sapiens
caguucggaucccaaauua

SEQ ID NO: 111759 - RNA, 19 nt, Homo sapiens
gaacucugcaaacaaauga

SEQ ID NO: 111760 - RNA, 19 nt, Homo sapiens
gcacagcuccagaaguuga

SEQ ID NO: 111761 - RNA, 19 nt, Homo sapiens
uuaaagggcaguuccguua

SEQ ID NO: 111762 - RNA, 19 nt, Homo sapiens
gaauauugguaucugacaa

SEQ ID NO: 111763 - RNA, 19 nt, Homo sapiens
gaauauugguaucugacaa

SEQ ID NO: 111764 - RNA, 19 nt, Homo sapiens
gaauauugguaucugacaa

SEQ ID NO: 111765 - RNA, 19 nt, Homo sapiens
gaauauugguaucugacaa

SEQ ID NO: 111766 - RNA, 19 nt, Homo sapiens
gaucaaaggcauccaguuc

SEQ ID NO: 111767 - RNA, 19 nt, Homo sapiens
ucaauggaauggugcauau

SEQ ID NO: 111768 - RNA, 19 nt, Homo sapiens
cuaccaaccuaacugauga

SEQ ID NO: 111769 - RNA, 19 nt, Homo sapiens
guccuacgaucccaauuaa

SEQ ID NO: 111770 - RNA, 19 nt, Homo sapiens
cgugugcuauuuccacuua

SEQ ID NO: 111771 - RNA, 19 nt, Homo sapiens
ggagugcaguggcguaauc

SEQ ID NO: 111772 - RNA, 19 nt, Homo sapiens
gcaacaauagaacaucuuu

SEQ ID NO: 111773 - RNA, 19 nt, Homo sapiens
ggaaugagaagccuuugga

SEQ ID NO: 111774 - RNA, 19 nt, Homo sapiens
gcaguuccguuagucauug

SEQ ID NO: 111775 - RNA, 19 nt, Homo sapiens
gcaccaacagagagaauuu

SEQ ID NO: 111776 - RNA, 19 nt, Homo sapiens
gcaccaacagagagaauuu

SEQ ID NO: 111777 - RNA, 19 nt, Homo sapiens
gcaccaacagagagaauuu

SEQ ID NO: 111778 - RNA, 19 nt, Homo sapiens
gcaccaacagagagaauuu

SEQ ID NO: 111779 - RNA, 19 nt, Homo sapiens
guucggaucccaaauuaaa

SEQ ID NO: 111780 - RNA, 19 nt, Homo sapiens
ccauuuacauucucaagga

SEQ ID NO: 111781 - RNA, 19 nt, Homo sapiens
gggaggccauucucuauca

SEQ ID NO: 111782 - RNA, 19 nt, Homo sapiens
gggaggccauucucuauca

SEQ ID NO: 111783 - RNA, 19 nt, Homo sapiens
gggaggccauucucuauca

SEQ ID NO: 111784 - RNA, 19 nt, Homo sapiens
gaaagaaacugcucuaaua

SEQ ID NO: 111785 - RNA, 19 nt, Homo sapiens
gaaaugaagucucuuauga

SEQ ID NO: 111786 - RNA, 19 nt, Homo sapiens
gcaaaugucucauauggaa

SEQ ID NO: 111787 - RNA, 19 nt, Homo sapiens
gaaggcaacucuugacaaa

SEQ ID NO: 111788 - RNA, 19 nt, Homo sapiens
gauauuugcuugcauguuu

SEQ ID NO: 111789 - RNA, 19 nt, Homo sapiens
gcaaauggauacaagauau

SEQ ID NO: 111790 - RNA, 19 nt, Homo sapiens
caagauaucuggcaaggaa

SEQ ID NO: 111791 - RNA, 19 nt, Homo sapiens
ggauaaaccugcuccuaaa

SEQ ID NO: 111792 - RNA, 19 nt, Homo sapiens
uaacgacacugugauauuu

SEQ ID NO: 111793 - RNA, 19 nt, Homo sapiens
guaaagagguaaacuguag

SEQ ID NO: 111794 - RNA, 19 nt, Homo sapiens
gaaaucagcauacucaaug

SEQ ID NO: 111795 - RNA, 19 nt, Homo sapiens
acagagaacgcaauuauua

SEQ ID NO: 111796 - RNA, 19 nt, Homo sapiens
ugaagucucuuaugaaugu

SEQ ID NO: 111797 - RNA, 19 nt, Homo sapiens
gccaguaugugaagaaauu

SEQ ID NO: 111798 - RNA, 19 nt, Homo sapiens
uaaauggccggauuaguua

SEQ ID NO: 111799 - RNA, 19 nt, Homo sapiens
gagauuugguguacaauuc

SEQ ID NO: 111800 - RNA, 19 nt, Homo sapiens
cauaagcgaucacuuccua

SEQ ID NO: 111801 - RNA, 19 nt, Homo sapiens
cagcaagucucuuuauaug

SEQ ID NO: 111802 - RNA, 19 nt, Homo sapiens
gagaggcacuccuucuuug

SEQ ID NO: 111803 - RNA, 19 nt, Homo sapiens
gaccagaugucaacucuuc

SEQ ID NO: 111804 - RNA, 19 nt, Homo sapiens
gcugugaacuuucuacuuc

SEQ ID NO: 111805 - RNA, 19 nt, Homo sapiens
ggccuuaccuuuauuagga

SEQ ID NO: 111806 - RNA, 19 nt, Homo sapiens
gaaauaccaguuugugaaa

SEQ ID NO: 111807 - RNA, 19 nt, Homo sapiens
caccugggauccugaaaua

SEQ ID NO: 111808 - RNA, 19 nt, Homo sapiens
gcaacucacuagcaaaugu

SEQ ID NO: 111809 - RNA, 19 nt, Homo sapiens
ccauggcuauaaacaauua

SEQ ID NO: 111810 - RNA, 19 nt, Homo sapiens
gaagggcaguagucagauu

SEQ ID NO: 111811 - RNA, 19 nt, Homo sapiens
ggagauucgucuuuguaaa

SEQ ID NO: 111812 - RNA, 19 nt, Homo sapiens
guaaaguuauucacuguca

SEQ ID NO: 111813 - RNA, 19 nt, Homo sapiens
caagauggguaccaguuga

SEQ ID NO: 111814 - RNA, 19 nt, Homo sapiens
ggagaagaauccauacagu

SEQ ID NO: 111815 - RNA, 19 nt, Homo sapiens
uaugauggccuuaccuuua

SEQ ID NO: 111816 - RNA, 19 nt, Homo sapiens
agaaacugcucuaauauca

SEQ ID NO: 111817 - RNA, 19 nt, Homo sapiens
uaucagaugugucaagaug

SEQ ID NO: 111818 - RNA, 19 nt, Homo sapiens
ggaguuccuuagaagauuu

SEQ ID NO: 111819 - RNA, 19 nt, Homo sapiens
gggauaaaccugcuccuaa

SEQ ID NO: 111820 - RNA, 19 nt, Homo sapiens
acaauuacauggcucuaaa

SEQ ID NO: 111821 - RNA, 19 nt, Homo sapiens
guauggagcuguuguaacu

SEQ ID NO: 111822 - RNA, 19 nt, Homo sapiens
ggugaaggguacaaguuaa

SEQ ID NO: 111823 - RNA, 19 nt, Homo sapiens
gaagaggcacgcuguaaau

SEQ ID NO: 111824 - RNA, 19 nt, Homo sapiens
cuucuuaccuucuugauug

SEQ ID NO: 111825 - RNA, 19 nt, Homo sapiens
ggccauggcuauaaacaau

SEQ ID NO: 111826 - RNA, 19 nt, Homo sapiens
gaugucaacucuucuugug

SEQ ID NO: 111827 - RNA, 19 nt, Homo sapiens
gcagaaagaucgauauacc

SEQ ID NO: 111828 - RNA, 19 nt, Homo sapiens
uagcaaaugucucauaugg

SEQ ID NO: 111829 - RNA, 19 nt, Homo sapiens
gagaaaagaucauuaacug

SEQ ID NO: 111830 - RNA, 19 nt, Homo sapiens
ucugaagccucacuuauga

SEQ ID NO: 111831 - RNA, 19 nt, Homo sapiens
ggauguuucuuuagcaguu

SEQ ID NO: 111832 - RNA, 19 nt, Homo sapiens
aaaggaagauagacacaug

SEQ ID NO: 111833 - RNA, 19 nt, Homo sapiens
ggcuuuggauguuucuuua

SEQ ID NO: 111834 - RNA, 19 nt, Homo sapiens
cagcagauauggauggaau

SEQ ID NO: 111835 - RNA, 19 nt, Homo sapiens
gugauuaggugucauacug

SEQ ID NO: 111836 - RNA, 19 nt, Homo sapiens
ggaaaugaagucucuuaug

SEQ ID NO: 111837 - RNA, 19 nt, Homo sapiens
gcuccaggauugucuguga

SEQ ID NO: 111838 - RNA, 19 nt, Homo sapiens
caaggaaaauguaucagua

SEQ ID NO: 111839 - RNA, 19 nt, Homo sapiens
gugauaagguacaguuguu

SEQ ID NO: 111840 - RNA, 19 nt, Homo sapiens
caaguguuauaguggauuu

SEQ ID NO: 111841 - RNA, 19 nt, Homo sapiens
gguguacaauucaggcuuu

SEQ ID NO: 111842 - RNA, 19 nt, Homo sapiens
aaacauagcucgauuuucu

SEQ ID NO: 111843 - RNA, 19 nt, Homo sapiens
gaaugguagucgcgugauu

SEQ ID NO: 111844 - RNA, 19 nt, Homo sapiens
gagcuguccugguaucuag

SEQ ID NO: 111845 - RNA, 19 nt, Homo sapiens
ccuuauacgugauaucaaa

SEQ ID NO: 111846 - RNA, 19 nt, Homo sapiens
aagcaaugaucaagaaaga

SEQ ID NO: 111847 - RNA, 19 nt, Homo sapiens
ccuaagaggccgaauggua

SEQ ID NO: 111848 - RNA, 19 nt, Homo sapiens
uaaaccugcuccuaaaugu

SEQ ID NO: 111849 - RNA, 19 nt, Homo sapiens
gcagguuugauacuucuua

SEQ ID NO: 111850 - RNA, 19 nt, Homo sapiens
ccauacugguggaaacaua

SEQ ID NO: 111851 - RNA, 19 nt, Homo sapiens
ugaaauaccaguuugugaa

SEQ ID NO: 111852 - RNA, 19 nt, Homo sapiens
uacaagcaaugaucaagaa

SEQ ID NO: 111853 - RNA, 19 nt, Homo sapiens
gcacaauuccuugguuuau

SEQ ID NO: 111854 - RNA, 19 nt, Homo sapiens
gggcagaaagaucgauaua

SEQ ID NO: 111855 - RNA, 19 nt, Homo sapiens
cauagucacuuacacuugu

SEQ ID NO: 111856 - RNA, 19 nt, Homo sapiens
ugguguaacugcaaacuuu

SEQ ID NO: 111857 - RNA, 19 nt, Homo sapiens
cuacagacauggugauucu

SEQ ID NO: 111858 - RNA, 19 nt, Homo sapiens
gcuccuaaaugugaauauu

SEQ ID NO: 111859 - RNA, 19 nt, Homo sapiens
ccaggaggauacaaaauua

SEQ ID NO: 111860 - RNA, 19 nt, Homo sapiens
cuagagauuugguguacaa

SEQ ID NO: 111861 - RNA, 19 nt, Homo sapiens
gaacgcaauuauuauacag

SEQ ID NO: 111862 - RNA, 19 nt, Homo sapiens
caauguuacuaucugcuuu

SEQ ID NO: 111863 - RNA, 19 nt, Homo sapiens
gcaaggaagccccauauuu

SEQ ID NO: 111864 - RNA, 19 nt, Homo sapiens
gagagcaccauccguugua

SEQ ID NO: 111865 - RNA, 19 nt, Homo sapiens
gaaccacggucacuuacac

SEQ ID NO: 111866 - RNA, 19 nt, Homo sapiens
gcaagcaaauccgaugcaa

SEQ ID NO: 111867 - RNA, 19 nt, Homo sapiens
gaacuucauccuuauugga

SEQ ID NO: 111868 - RNA, 19 nt, Homo sapiens
ucucucacauuacuguaua

SEQ ID NO: 111869 - RNA, 19 nt, Homo sapiens
acacagagaacgcaauuau

SEQ ID NO: 111870 - RNA, 19 nt, Homo sapiens
gugcucacauguccauauu

SEQ ID NO: 111871 - RNA, 19 nt, Homo sapiens
caacucuucuuguggugaa

SEQ ID NO: 111872 - RNA, 19 nt, Homo sapiens
uauauggccucaagaucaa

SEQ ID NO: 111873 - RNA, 19 nt, Homo sapiens
cagcugaucagaagacaaa

SEQ ID NO: 111874 - RNA, 19 nt, Homo sapiens
ccaaucggaucaccaaugg

SEQ ID NO: 111875 - RNA, 19 nt, Homo sapiens
gauggaaccugggauaaac

SEQ ID NO: 111876 - RNA, 19 nt, Homo sapiens
gcaaaguggcagcguguga

SEQ ID NO: 111877 - RNA, 19 nt, Homo sapiens
caauggacaucacacaagu

SEQ ID NO: 111878 - RNA, 19 nt, Homo sapiens
uaagcgaucacuuccuaua

SEQ ID NO: 111879 - RNA, 19 nt, Homo sapiens
gcggaauauugauuagaaa

SEQ ID NO: 111880 - RNA, 19 nt, Homo sapiens
ccacagugcuuacgaucuc

SEQ ID NO: 111881 - RNA, 19 nt, Homo sapiens
gaaagaggaguggaauuca

SEQ ID NO: 111882 - RNA, 19 nt, Homo sapiens
caaguuaagugggaguguu

SEQ ID NO: 111883 - RNA, 19 nt, Homo sapiens
agaaagaucgauauaccua

SEQ ID NO: 111884 - RNA, 19 nt, Homo sapiens
gaacuuauccugacguuug

SEQ ID NO: 111885 - RNA, 19 nt, Homo sapiens
ccacugagaucaacuucaa

SEQ ID NO: 111886 - RNA, 19 nt, Homo sapiens
ggacgcaagugcaggaguu

SEQ ID NO: 111887 - RNA, 19 nt, Homo sapiens
gaucaguucuacaucaaga

SEQ ID NO: 111888 - RNA, 19 nt, Homo sapiens
gaauuuauguccgggaaug

SEQ ID NO: 111889 - RNA, 19 nt, Homo sapiens
ggccaacgaugaacuuauc

SEQ ID NO: 111890 - RNA, 19 nt, Homo sapiens
gaagucauuaaacugguua

SEQ ID NO: 111891 - RNA, 19 nt, Homo sapiens
cacccaaacucuucuugaa

SEQ ID NO: 111892 - RNA, 19 nt, Homo sapiens
gggaucaguucuacaucaa

SEQ ID NO: 111893 - RNA, 19 nt, Homo sapiens
gcaggaguuuagccacuug

SEQ ID NO: 111894 - RNA, 19 nt, Homo sapiens
cgaagucauuaaacugguu

SEQ ID NO: 111895 - RNA, 19 nt, Homo sapiens
gcacccaaacucuucuuga

SEQ ID NO: 111896 - RNA, 19 nt, Homo sapiens
caaggucggagaaggcuuu

SEQ ID NO: 111897 - RNA, 19 nt, Homo sapiens
ccacuugggagaaugagaa

SEQ ID NO: 111898 - RNA, 19 nt, Homo sapiens
caacuucaaggucggagaa

SEQ ID NO: 111899 - RNA, 19 nt, Homo sapiens
gcacgguuucgaagucauu

SEQ ID NO: 111900 - RNA, 19 nt, Homo sapiens
ugaacgccaugcugaggaa

SEQ ID NO: 111901 - RNA, 19 nt, Homo sapiens
ugaaggcacugggugugaa

SEQ ID NO: 111902 - RNA, 19 nt, Homo sapiens
gcauuugcacgguuucgaa

SEQ ID NO: 111903 - RNA, 19 nt, Homo sapiens
aagauccacugcacccaaa

SEQ ID NO: 111904 - RNA, 19 nt, Homo sapiens
gggagaaugagaacaagau

SEQ ID NO: 111905 - RNA, 19 nt, Homo sapiens
gcaccacugagaucaacuu

SEQ ID NO: 111906 - RNA, 19 nt, Homo sapiens
ccacugcacccaaacucuu

SEQ ID NO: 111907 - RNA, 19 nt, Homo sapiens
cuaccaauauuaggugauc

SEQ ID NO: 111908 - RNA, 19 nt, Homo sapiens
ggagaaugagaacaagauc

SEQ ID NO: 111909 - RNA, 19 nt, Homo sapiens
gcgcaccacugagaucaac

SEQ ID NO: 111910 - RNA, 19 nt, Homo sapiens
ggggaucaguucuacauca

SEQ ID NO: 111911 - RNA, 19 nt, Homo sapiens
gcgcagcagcgagaauuuc

SEQ ID NO: 111912 - RNA, 19 nt, Homo sapiens
ggucggagaaggcuuugag

SEQ ID NO: 111913 - RNA, 19 nt, Homo sapiens
ggccuuggugccucuugua

SEQ ID NO: 111914 - RNA, 19 nt, Homo sapiens
ggacggggaucaguucuac

SEQ ID NO: 111915 - RNA, 19 nt, Homo sapiens
gaacugauccugaccauga

SEQ ID NO: 111916 - RNA, 19 nt, Homo sapiens
ccacagagauuaacuucaa

SEQ ID NO: 111917 - RNA, 19 nt, Homo sapiens
guaagagccuggugaaaug

SEQ ID NO: 111918 - RNA, 19 nt, Homo sapiens
ccagagaacugaccaacga

SEQ ID NO: 111919 - RNA, 19 nt, Homo sapiens
ggagacacuuucuacauca

SEQ ID NO: 111920 - RNA, 19 nt, Homo sapiens
gggagacacuuucuacauc

SEQ ID NO: 111921 - RNA, 19 nt, Homo sapiens
gcagggucuugcuuucuuu

SEQ ID NO: 111922 - RNA, 19 nt, Homo sapiens
gagcccagaucacccauuc

SEQ ID NO: 111923 - RNA, 19 nt, Homo sapiens
cgacgucucuuuugacuaa

SEQ ID NO: 111924 - RNA, 19 nt, Homo sapiens
gaugggaggcccuguaaga

SEQ ID NO: 111925 - RNA, 19 nt, Homo sapiens
gaaaugggagagugagaau

SEQ ID NO: 111926 - RNA, 19 nt, Homo sapiens
ugaaugugaugcugaggaa

SEQ ID NO: 111927 - RNA, 19 nt, Homo sapiens
ggaaagacuggcccucuag

SEQ ID NO: 111928 - RNA, 19 nt, Homo sapiens
gagcagggucucucuaaag

SEQ ID NO: 111929 - RNA, 19 nt, Homo sapiens
aaugggagagugagaauaa

SEQ ID NO: 111930 - RNA, 19 nt, Homo sapiens
gccuauacaguuuagaaua

SEQ ID NO: 111931 - RNA, 19 nt, Homo sapiens
gagacacuuucuacaucaa

SEQ ID NO: 111932 - RNA, 19 nt, Homo sapiens
agaauaaaauggucuguga

SEQ ID NO: 111933 - RNA, 19 nt, Homo sapiens
ggagggagacacuuucuac

SEQ ID NO: 111934 - RNA, 19 nt, Homo sapiens
aggaaagacuggcccucua

SEQ ID NO: 111935 - RNA, 19 nt, Homo sapiens
ccucuagcuucuacccuuu

SEQ ID NO: 111936 - RNA, 19 nt, Homo sapiens
ggucuacguccgagaguga

SEQ ID NO: 111937 - RNA, 19 nt, Homo sapiens
uguaagagccuggugaaau

SEQ ID NO: 111938 - RNA, 19 nt, Homo sapiens
gcaccacagagauuaacuu

SEQ ID NO: 111939 - RNA, 19 nt, Homo sapiens
gugcgcaccacagagauua

SEQ ID NO: 111940 - RNA, 19 nt, Homo sapiens
ucgaggaauugcucaaagu

SEQ ID NO: 111941 - RNA, 19 nt, Homo sapiens
gggaacugauccugaccau

SEQ ID NO: 111942 - RNA, 19 nt, Homo sapiens
ugaaaugggagagugagaa

SEQ ID NO: 111943 - RNA, 19 nt, Homo sapiens
uaggauagcgcuccccuua

SEQ ID NO: 111944 - RNA, 19 nt, Homo sapiens
uagccuauacaguuuagaa

SEQ ID NO: 111945 - RNA, 19 nt, Homo sapiens
cggaaaacuucgaggaauu

SEQ ID NO: 111946 - RNA, 19 nt, Homo sapiens
gacggcggaugacguugug

SEQ ID NO: 111947 - RNA, 19 nt, Homo sapiens
caaagaggaauggcugcaa

SEQ ID NO: 111948 - RNA, 19 nt, Homo sapiens
ugcagggucuugcuuucuu

SEQ ID NO: 111949 - RNA, 19 nt, Homo sapiens
ggaaaacuucgaggaauug

SEQ ID NO: 111950 - RNA, 19 nt, Homo sapiens
caugacggcggaugacguu

SEQ ID NO: 111951 - RNA, 19 nt, Homo sapiens
ccagugcuccagccuagga

SEQ ID NO: 111952 - RNA, 19 nt, Homo sapiens
cgaggaauugcucaaagug

SEQ ID NO: 111953 - RNA, 19 nt, Homo sapiens
gugaguggccacagguaga

SEQ ID NO: 111954 - RNA, 19 nt, Homo sapiens
gagugaguggccacaggua

SEQ ID NO: 111955 - RNA, 19 nt, Homo sapiens
uggaugggaggcccuguaa

SEQ ID NO: 111956 - RNA, 19 nt, Homo sapiens
agagauuaacuucaagguu

SEQ ID NO: 111957 - RNA, 19 nt, Homo sapiens
gugaugcugaggaagauug

SEQ ID NO: 111958 - RNA, 19 nt, Homo sapiens
gagggagacacuuucuaca

SEQ ID NO: 111959 - RNA, 19 nt, Homo sapiens
cagcaguggagaucaaaca

SEQ ID NO: 111960 - RNA, 19 nt, Homo sapiens
gcugcaagagcccagauca

SEQ ID NO: 111961 - RNA, 19 nt, Homo sapiens
aaugugaugcugaggaaga

SEQ ID NO: 111962 - RNA, 19 nt, Homo sapiens
ccaagcagcugguggauga

SEQ ID NO: 111963 - RNA, 19 nt, Homo sapiens
gagaagaucuggaacucau

SEQ ID NO: 111964 - RNA, 19 nt, Homo sapiens
uguggaaggucaucaauaa

SEQ ID NO: 111965 - RNA, 19 nt, Homo sapiens
ccaagaagcugcgguucaa

SEQ ID NO: 111966 - RNA, 19 nt, Homo sapiens
gaagaaacccgagcuugug

SEQ ID NO: 111967 - RNA, 19 nt, Homo sapiens
gagcaugcccgacaucuuc

SEQ ID NO: 111968 - RNA, 19 nt, Homo sapiens
ggaagccacugugcaugaa

SEQ ID NO: 111969 - RNA, 19 nt, Homo sapiens
acaacacccucaucaaaga

SEQ ID NO: 111970 - RNA, 19 nt, Homo sapiens
gcaugaaccaguacuauca

SEQ ID NO: 111971 - RNA, 19 nt, Homo sapiens
ggaaggucaucaauaaagg

SEQ ID NO: 111972 - RNA, 19 nt, Homo sapiens
gcccugcuguaugauauua

SEQ ID NO: 111973 - RNA, 19 nt, Homo sapiens
gcuacggugucugcuauaa

SEQ ID NO: 111974 - RNA, 19 nt, Homo sapiens
gcugugcuccuguggauaa

SEQ ID NO: 111975 - RNA, 19 nt, Homo sapiens
ggacacagucagcaacuuc

SEQ ID NO: 111976 - RNA, 19 nt, Homo sapiens
gaaccaguacuaucagauc

SEQ ID NO: 111977 - RNA, 19 nt, Homo sapiens
cgaagaaacccgagcuugu

SEQ ID NO: 111978 - RNA, 19 nt, Homo sapiens
uggacuaugucaucgagua

SEQ ID NO: 111979 - RNA, 19 nt, Homo sapiens
acaagacgcugcaguucau

SEQ ID NO: 111980 - RNA, 19 nt, Homo sapiens
auacaacacccucaucaaa

SEQ ID NO: 111981 - RNA, 19 nt, Homo sapiens
gucagcaacuucagcaaga

SEQ ID NO: 111982 - RNA, 19 nt, Homo sapiens
ccaguacuaucagaucuug

SEQ ID NO: 111983 - RNA, 19 nt, Homo sapiens
gggaagccacugugcauga

SEQ ID NO: 111984 - RNA, 19 nt, Homo sapiens
gcaugugccaccuaugaaa

SEQ ID NO: 111985 - RNA, 19 nt, Homo sapiens
gcauacaacacccucauca

SEQ ID NO: 111986 - RNA, 19 nt, Homo sapiens
aagcagaaccucagcauca

SEQ ID NO: 111987 - RNA, 19 nt, Homo sapiens
aagcugcgguucaacauca

SEQ ID NO: 111988 - RNA, 19 nt, Homo sapiens
ggaauuguguuggugaaaa

SEQ ID NO: 111989 - RNA, 19 nt, Homo sapiens
gaccaggccaccaucugua

SEQ ID NO: 111990 - RNA, 19 nt, Homo sapiens
agaaggcgcuccuggacau

SEQ ID NO: 111991 - RNA, 19 nt, Homo sapiens
gacaagacgcugcaguuca

SEQ ID NO: 111992 - RNA, 19 nt, Homo sapiens
ggacucaggccugccaaug

SEQ ID NO: 111993 - RNA, 19 nt, Homo sapiens
cggcuacggugucugcuau

SEQ ID NO: 111994 - RNA, 19 nt, Homo sapiens
gagaagcuaagcccagaug

SEQ ID NO: 111995 - RNA, 19 nt, Homo sapiens
ccugugggcuuguguacga

SEQ ID NO: 111996 - RNA, 19 nt, Homo sapiens
ggauuucaaggucaugauu

SEQ ID NO: 111997 - RNA, 19 nt, Homo sapiens
gaggguguguuggauuuca

SEQ ID NO: 111998 - RNA, 19 nt, Homo sapiens
gcagcugguggaugaguuu

SEQ ID NO: 111999 - RNA, 19 nt, Homo sapiens
gggccagggugugagguuu

SEQ ID NO: 112000 - RNA, 19 nt, Homo sapiens
cuuugcagcuggccuacua

SEQ ID NO: 112001 - RNA, 19 nt, Homo sapiens
ucaccgugguacacaacua

SEQ ID NO: 112002 - RNA, 19 nt, Homo sapiens
uugaggguguguuggauuu

SEQ ID NO: 112003 - RNA, 19 nt, Homo sapiens
ucacggagcaccagaaggu

SEQ ID NO: 112004 - RNA, 19 nt, Homo sapiens
cagaaccucagcaucauga

SEQ ID NO: 112005 - RNA, 19 nt, Homo sapiens
ccaggaagacggagaacug

SEQ ID NO: 112006 - RNA, 19 nt, Homo sapiens
gcuguaugauauuaaugug

SEQ ID NO: 112007 - RNA, 19 nt, Homo sapiens
gcuccuugguucccucuuc

SEQ ID NO: 112008 - RNA, 19 nt, Homo sapiens
caccagggcucagcuccuu

SEQ ID NO: 112009 - RNA, 19 nt, Homo sapiens
gaaccucagcaucaugauc

SEQ ID NO: 112010 - RNA, 19 nt, Homo sapiens
guacccugcuucccaaacu

SEQ ID NO: 112011 - RNA, 19 nt, Homo sapiens
ggacgggcagcgaagaugu

SEQ ID NO: 112012 - RNA, 19 nt, Homo sapiens
cagacugugucauguucuu

SEQ ID NO: 112013 - RNA, 19 nt, Homo sapiens
caagagcgacaucgagaag

SEQ ID NO: 112014 - RNA, 19 nt, Homo sapiens
ucacccuucuggacuaugu

SEQ ID NO: 112015 - RNA, 19 nt, Homo sapiens
gcagggucagcuccgauuu

SEQ ID NO: 112016 - RNA, 19 nt, Homo sapiens
gcagaaccucagcaucaug

SEQ ID NO: 112017 - RNA, 19 nt, Homo sapiens
gccagccuguggucaucua

SEQ ID NO: 112018 - RNA, 19 nt, Homo sapiens
ucgaggaccuggugagcau

SEQ ID NO: 112019 - RNA, 19 nt, Homo sapiens
ucgagaaggccaagcagaa

SEQ ID NO: 112020 - RNA, 19 nt, Homo sapiens
gauuucaaggucaugauug

SEQ ID NO: 112021 - RNA, 19 nt, Homo sapiens
uggacucacucaccuuugu

SEQ ID NO: 112022 - RNA, 19 nt, Homo sapiens
cauggacucacucaccuuu

SEQ ID NO: 112023 - RNA, 19 nt, Homo sapiens
cgacaagacgcugcaguuc

SEQ ID NO: 112024 - RNA, 19 nt, Homo sapiens
acucaucccuacagaccaa

SEQ ID NO: 112025 - RNA, 19 nt, Homo sapiens
ggagaagaucuggaacuca

SEQ ID NO: 112026 - RNA, 19 nt, Homo sapiens
cggcugugcuccuguggau

SEQ ID NO: 112027 - RNA, 19 nt, Homo sapiens
gcacaucaccgugguacac

SEQ ID NO: 112028 - RNA, 19 nt, Homo sapiens
ccgcccugcuguaugauau

SEQ ID NO: 112029 - RNA, 19 nt, Homo sapiens
guggaaggucaucaauaaa

SEQ ID NO: 112030 - RNA, 19 nt, Homo sapiens
ccauggaggcccacaucaa

SEQ ID NO: 112031 - RNA, 19 nt, Homo sapiens
uggaaggucaucaauaaag

SEQ ID NO: 112032 - RNA, 19 nt, Homo sapiens
ccugcuguaugauauuaau

SEQ ID NO: 112033 - RNA, 19 nt, Homo sapiens
gagaacuggcugucugagu

SEQ ID NO: 112034 - RNA, 19 nt, Homo sapiens
caccaucuguacccugcuu

SEQ ID NO: 112035 - RNA, 19 nt, Homo sapiens
gaagcugcgguucaacauc

SEQ ID NO: 112036 - RNA, 19 nt, Homo sapiens
gguucccucuuccuugguu

SEQ ID NO: 112037 - RNA, 19 nt, Homo sapiens
cauacaacacccucaucaa

SEQ ID NO: 112038 - RNA, 19 nt, Homo sapiens
gugcaugaaccaguacuau

SEQ ID NO: 112039 - RNA, 19 nt, Homo sapiens
gagcccaggcgugaugcua

SEQ ID NO: 112040 - RNA, 19 nt, Homo sapiens
gagcaggagacuggcaaga

SEQ ID NO: 112041 - RNA, 19 nt, Homo sapiens
gaucuacggacaggcaugu

SEQ ID NO: 112042 - RNA, 19 nt, Homo sapiens
ucaagagcgacaucgagaa

SEQ ID NO: 112043 - RNA, 19 nt, Homo sapiens
uacaacacccucaucaaag

SEQ ID NO: 112044 - RNA, 19 nt, Homo sapiens
uggagaagaucuggaacuc

SEQ ID NO: 112045 - RNA, 19 nt, Homo sapiens
gugcuccuguggauaacau

SEQ ID NO: 112046 - RNA, 19 nt, Homo sapiens
gccagggugugagguuuca

SEQ ID NO: 112047 - RNA, 19 nt, Homo sapiens
ugaccaggccaccaucugu

SEQ ID NO: 112048 - RNA, 19 nt, Homo sapiens
aagcccuucuccuugauga

SEQ ID NO: 112049 - RNA, 19 nt, Homo sapiens
ggacuaugucaucgaguac

SEQ ID NO: 112050 - RNA, 19 nt, Homo sapiens
ccaagcagcugguggauga

SEQ ID NO: 112051 - RNA, 19 nt, Homo sapiens
gagaagaucuggaacucau

SEQ ID NO: 112052 - RNA, 19 nt, Homo sapiens
uguggaaggucaucaauaa

SEQ ID NO: 112053 - RNA, 19 nt, Homo sapiens
ccaagaagcugcgguucaa

SEQ ID NO: 112054 - RNA, 19 nt, Homo sapiens
gaagaaacccgagcuugug

SEQ ID NO: 112055 - RNA, 19 nt, Homo sapiens
aaucuuggcucuugucuuc

SEQ ID NO: 112056 - RNA, 19 nt, Homo sapiens
gagcaugcccgacaucuuc

SEQ ID NO: 112057 - RNA, 19 nt, Homo sapiens
ggaagccacugugcaugaa

SEQ ID NO: 112058 - RNA, 19 nt, Homo sapiens
acaacacccucaucaaaga

SEQ ID NO: 112059 - RNA, 19 nt, Homo sapiens
gcaugaaccaguacuauca

SEQ ID NO: 112060 - RNA, 19 nt, Homo sapiens
ggaaggucaucaauaaagg

SEQ ID NO: 112061 - RNA, 19 nt, Homo sapiens
gcccugcuguaugauauua

SEQ ID NO: 112062 - RNA, 19 nt, Homo sapiens
gcuacggugucugcuauaa

SEQ ID NO: 112063 - RNA, 19 nt, Homo sapiens
gcugugcuccuguggauaa

SEQ ID NO: 112064 - RNA, 19 nt, Homo sapiens
ggacacagucagcaacuuc

SEQ ID NO: 112065 - RNA, 19 nt, Homo sapiens
gaaccaguacuaucagauc

SEQ ID NO: 112066 - RNA, 19 nt, Homo sapiens
cgaagaaacccgagcuugu

SEQ ID NO: 112067 - RNA, 19 nt, Homo sapiens
uggacuaugucaucgagua

SEQ ID NO: 112068 - RNA, 19 nt, Homo sapiens
acaagacgcugcaguucau

SEQ ID NO: 112069 - RNA, 19 nt, Homo sapiens
auacaacacccucaucaaa

SEQ ID NO: 112070 - RNA, 19 nt, Homo sapiens
gucagcaacuucagcaaga

SEQ ID NO: 112071 - RNA, 19 nt, Homo sapiens
ccaguacuaucagaucuug

SEQ ID NO: 112072 - RNA, 19 nt, Homo sapiens
gggaagccacugugcauga

SEQ ID NO: 112073 - RNA, 19 nt, Homo sapiens
gcaugugccaccuaugaaa

SEQ ID NO: 112074 - RNA, 19 nt, Homo sapiens
gcauacaacacccucauca

SEQ ID NO: 112075 - RNA, 19 nt, Homo sapiens
aagcagaaccucagcauca

SEQ ID NO: 112076 - RNA, 19 nt, Homo sapiens
aagcugcgguucaacauca

SEQ ID NO: 112077 - RNA, 19 nt, Homo sapiens
ggaauuguguuggugaaaa

SEQ ID NO: 112078 - RNA, 19 nt, Homo sapiens
gaccaggccaccaucugua

SEQ ID NO: 112079 - RNA, 19 nt, Homo sapiens
agaaggcgcuccuggacau

SEQ ID NO: 112080 - RNA, 19 nt, Homo sapiens
gacaagacgcugcaguuca

SEQ ID NO: 112081 - RNA, 19 nt, Homo sapiens
ggacucaggccugccaaug

SEQ ID NO: 112082 - RNA, 19 nt, Homo sapiens
cggcuacggugucugcuau

SEQ ID NO: 112083 - RNA, 19 nt, Homo sapiens
gagaagcuaagcccagaug

SEQ ID NO: 112084 - RNA, 19 nt, Homo sapiens
ccugugggcuuguguacga

SEQ ID NO: 112085 - RNA, 19 nt, Homo sapiens
gcucuugucuucucuuucc

SEQ ID NO: 112086 - RNA, 19 nt, Homo sapiens
ggauuucaaggucaugauu

SEQ ID NO: 112087 - RNA, 19 nt, Homo sapiens
gaggguguguuggauuuca

SEQ ID NO: 112088 - RNA, 19 nt, Homo sapiens
gggccagggugugagguuu

SEQ ID NO: 112089 - RNA, 19 nt, Homo sapiens
cuuugcagcuggccuacua

SEQ ID NO: 112090 - RNA, 19 nt, Homo sapiens
gcagcugguggaugaguuu

SEQ ID NO: 112091 - RNA, 19 nt, Homo sapiens
ucaccgugguacacaacua

SEQ ID NO: 112092 - RNA, 19 nt, Homo sapiens
uugaggguguguuggauuu

SEQ ID NO: 112093 - RNA, 19 nt, Homo sapiens
ucacggagcaccagaaggu

SEQ ID NO: 112094 - RNA, 19 nt, Homo sapiens
ccaggaagacggagaacug

SEQ ID NO: 112095 - RNA, 19 nt, Homo sapiens
cagaaccucagcaucauga

SEQ ID NO: 112096 - RNA, 19 nt, Homo sapiens
gcuguaugauauuaaugug

SEQ ID NO: 112097 - RNA, 19 nt, Homo sapiens
gcuccuugguucccucuuc

SEQ ID NO: 112098 - RNA, 19 nt, Homo sapiens
caccagggcucagcuccuu

SEQ ID NO: 112099 - RNA, 19 nt, Homo sapiens
gaaccucagcaucaugauc

SEQ ID NO: 112100 - RNA, 19 nt, Homo sapiens
guacccugcuucccaaacu

SEQ ID NO: 112101 - RNA, 19 nt, Homo sapiens
cagacugugucauguucuu

SEQ ID NO: 112102 - RNA, 19 nt, Homo sapiens
caagagcgacaucgagaag

SEQ ID NO: 112103 - RNA, 19 nt, Homo sapiens
ucacccuucuggacuaugu

SEQ ID NO: 112104 - RNA, 19 nt, Homo sapiens
gcagggucagcuccgauuu

SEQ ID NO: 112105 - RNA, 19 nt, Homo sapiens
gcagaaccucagcaucaug

SEQ ID NO: 112106 - RNA, 19 nt, Homo sapiens
gccagccuguggucaucua

SEQ ID NO: 112107 - RNA, 19 nt, Homo sapiens
ucgaggaccuggugagcau

SEQ ID NO: 112108 - RNA, 19 nt, Homo sapiens
ucgagaaggccaagcagaa

SEQ ID NO: 112109 - RNA, 19 nt, Homo sapiens
gauuucaaggucaugauug

SEQ ID NO: 112110 - RNA, 19 nt, Homo sapiens
uggacucacucaccuuugu

SEQ ID NO: 112111 - RNA, 19 nt, Homo sapiens
cauggacucacucaccuuu

SEQ ID NO: 112112 - RNA, 19 nt, Homo sapiens
cgacaagacgcugcaguuc

SEQ ID NO: 112113 - RNA, 19 nt, Homo sapiens
acucaucccuacagaccaa

SEQ ID NO: 112114 - RNA, 19 nt, Homo sapiens
ggagaagaucuggaacuca

SEQ ID NO: 112115 - RNA, 19 nt, Homo sapiens
cggcugugcuccuguggau

SEQ ID NO: 112116 - RNA, 19 nt, Homo sapiens
gcacaucaccgugguacac

SEQ ID NO: 112117 - RNA, 19 nt, Homo sapiens
ccgcccugcuguaugauau

SEQ ID NO: 112118 - RNA, 19 nt, Homo sapiens
guggaaggucaucaauaaa

SEQ ID NO: 112119 - RNA, 19 nt, Homo sapiens
ccauggaggcccacaucaa

SEQ ID NO: 112120 - RNA, 19 nt, Homo sapiens
uggcucuugucuucucuuu

SEQ ID NO: 112121 - RNA, 19 nt, Homo sapiens
uggaaggucaucaauaaag

SEQ ID NO: 112122 - RNA, 19 nt, Homo sapiens
gagaacuggcugucugagu

SEQ ID NO: 112123 - RNA, 19 nt, Homo sapiens
ccugcuguaugauauuaau

SEQ ID NO: 112124 - RNA, 19 nt, Homo sapiens
caccaucuguacccugcuu

SEQ ID NO: 112125 - RNA, 19 nt, Homo sapiens
gaagcugcgguucaacauc

SEQ ID NO: 112126 - RNA, 19 nt, Homo sapiens
gguucccucuuccuugguu

SEQ ID NO: 112127 - RNA, 19 nt, Homo sapiens
cauacaacacccucaucaa

SEQ ID NO: 112128 - RNA, 19 nt, Homo sapiens
gugcaugaaccaguacuau

SEQ ID NO: 112129 - RNA, 19 nt, Homo sapiens
gagcaggagacuggcaaga

SEQ ID NO: 112130 - RNA, 19 nt, Homo sapiens
gagcccaggcgugaugcua

SEQ ID NO: 112131 - RNA, 19 nt, Homo sapiens
gaucuacggacaggcaugu

SEQ ID NO: 112132 - RNA, 19 nt, Homo sapiens
ucaagagcgacaucgagaa

SEQ ID NO: 112133 - RNA, 19 nt, Homo sapiens
gcugaaucuuggcucuugu

SEQ ID NO: 112134 - RNA, 19 nt, Homo sapiens
uacaacacccucaucaaag

SEQ ID NO: 112135 - RNA, 19 nt, Homo sapiens
uggagaagaucuggaacuc

SEQ ID NO: 112136 - RNA, 19 nt, Homo sapiens
gugcuccuguggauaacau

SEQ ID NO: 112137 - RNA, 19 nt, Homo sapiens
gccagggugugagguuuca

SEQ ID NO: 112138 - RNA, 19 nt, Homo sapiens
ugaccaggccaccaucugu

SEQ ID NO: 112139 - RNA, 19 nt, Homo sapiens
cgcugaaucuuggcucuug

SEQ ID NO: 112140 - RNA, 19 nt, Homo sapiens
aagcccuucuccuugauga

SEQ ID NO: 112141 - RNA, 19 nt, Homo sapiens
ggacuaugucaucgaguac

SEQ ID NO: 112142 - RNA, 19 nt, Homo sapiens
ccaagcagcugguggauga

SEQ ID NO: 112143 - RNA, 19 nt, Homo sapiens
gagaagaucuggaacucau

SEQ ID NO: 112144 - RNA, 19 nt, Homo sapiens
uguggaaggucaucaauaa

SEQ ID NO: 112145 - RNA, 19 nt, Homo sapiens
ccaagaagcugcgguucaa

SEQ ID NO: 112146 - RNA, 19 nt, Homo sapiens
gaagaaacccgagcuugug

SEQ ID NO: 112147 - RNA, 19 nt, Homo sapiens
gagcaugcccgacaucuuc

SEQ ID NO: 112148 - RNA, 19 nt, Homo sapiens
ggaagccacugugcaugaa

SEQ ID NO: 112149 - RNA, 19 nt, Homo sapiens
acaacacccucaucaaaga

SEQ ID NO: 112150 - RNA, 19 nt, Homo sapiens
gcaugaaccaguacuauca

SEQ ID NO: 112151 - RNA, 19 nt, Homo sapiens
ggaaggucaucaauaaagg

SEQ ID NO: 112152 - RNA, 19 nt, Homo sapiens
gcccugcuguaugauauua

SEQ ID NO: 112153 - RNA, 19 nt, Homo sapiens
gcuacggugucugcuauaa

SEQ ID NO: 112154 - RNA, 19 nt, Homo sapiens
gcugugcuccuguggauaa

SEQ ID NO: 112155 - RNA, 19 nt, Homo sapiens
ggacacagucagcaacuuc

SEQ ID NO: 112156 - RNA, 19 nt, Homo sapiens
gaaccaguacuaucagauc

SEQ ID NO: 112157 - RNA, 19 nt, Homo sapiens
auacaacacccucaucaaa

SEQ ID NO: 112158 - RNA, 19 nt, Homo sapiens
gucagcaacuucagcaaga

SEQ ID NO: 112159 - RNA, 19 nt, Homo sapiens
ccaguacuaucagaucuug

SEQ ID NO: 112160 - RNA, 19 nt, Homo sapiens
gggaagccacugugcauga

SEQ ID NO: 112161 - RNA, 19 nt, Homo sapiens
gcaugugccaccuaugaaa

SEQ ID NO: 112162 - RNA, 19 nt, Homo sapiens
gcauacaacacccucauca

SEQ ID NO: 112163 - RNA, 19 nt, Homo sapiens
aagcagaaccucagcauca

SEQ ID NO: 112164 - RNA, 19 nt, Homo sapiens
aagcugcgguucaacauca

SEQ ID NO: 112165 - RNA, 19 nt, Homo sapiens
ggaauuguguuggugaaaa

SEQ ID NO: 112166 - RNA, 19 nt, Homo sapiens
gaccaggccaccaucugua

SEQ ID NO: 112167 - RNA, 19 nt, Homo sapiens
agaaggcgcuccuggacau

SEQ ID NO: 112168 - RNA, 19 nt, Homo sapiens
ggacucaggccugccaaug

SEQ ID NO: 112169 - RNA, 19 nt, Homo sapiens
cggcuacggugucugcuau

SEQ ID NO: 112170 - RNA, 19 nt, Homo sapiens
gagaagcuaagcccagaug

SEQ ID NO: 112171 - RNA, 19 nt, Homo sapiens
ggauuucaaggucaugauu

SEQ ID NO: 112172 - RNA, 19 nt, Homo sapiens
gaggguguguuggauuuca

SEQ ID NO: 112173 - RNA, 19 nt, Homo sapiens
gggccagggugugagguuu

SEQ ID NO: 112174 - RNA, 19 nt, Homo sapiens
gcagcugguggaugaguuu

SEQ ID NO: 112175 - RNA, 19 nt, Homo sapiens
cuuugcagcuggccuacua

SEQ ID NO: 112176 - RNA, 19 nt, Homo sapiens
ucaccgugguacacaacua

SEQ ID NO: 112177 - RNA, 19 nt, Homo sapiens
uugaggguguguuggauuu

SEQ ID NO: 112178 - RNA, 19 nt, Homo sapiens
ucacggagcaccagaaggu

SEQ ID NO: 112179 - RNA, 19 nt, Homo sapiens
cagaaccucagcaucauga

SEQ ID NO: 112180 - RNA, 19 nt, Homo sapiens
agaagaaacccgagcuugu

SEQ ID NO: 112181 - RNA, 19 nt, Homo sapiens
ccaggaagacggagaacug

SEQ ID NO: 112182 - RNA, 19 nt, Homo sapiens
gcuguaugauauuaaugug

SEQ ID NO: 112183 - RNA, 19 nt, Homo sapiens
gcuccuugguucccucuuc

SEQ ID NO: 112184 - RNA, 19 nt, Homo sapiens
caccagggcucagcuccuu

SEQ ID NO: 112185 - RNA, 19 nt, Homo sapiens
gaaccucagcaucaugauc

SEQ ID NO: 112186 - RNA, 19 nt, Homo sapiens
guacccugcuucccaaacu

SEQ ID NO: 112187 - RNA, 19 nt, Homo sapiens
ggacgggcagcgaagaugu

SEQ ID NO: 112188 - RNA, 19 nt, Homo sapiens
cagacugugucauguucuu

SEQ ID NO: 112189 - RNA, 19 nt, Homo sapiens
caagagcgacaucgagaag

SEQ ID NO: 112190 - RNA, 19 nt, Homo sapiens
gcagggucagcuccgauuu

SEQ ID NO: 112191 - RNA, 19 nt, Homo sapiens
gccagccuguggucaucua

SEQ ID NO: 112192 - RNA, 19 nt, Homo sapiens
gcagaaccucagcaucaug

SEQ ID NO: 112193 - RNA, 19 nt, Homo sapiens
ucgaggaccuggugagcau

SEQ ID NO: 112194 - RNA, 19 nt, Homo sapiens
ucgagaaggccaagcagaa

SEQ ID NO: 112195 - RNA, 19 nt, Homo sapiens
gauuucaaggucaugauug

SEQ ID NO: 112196 - RNA, 19 nt, Homo sapiens
uggacucacucaccuuugu

SEQ ID NO: 112197 - RNA, 19 nt, Homo sapiens
cauggacucacucaccuuu

SEQ ID NO: 112198 - RNA, 19 nt, Homo sapiens
acucaucccuacagaccaa

SEQ ID NO: 112199 - RNA, 19 nt, Homo sapiens
ggagaagaucuggaacuca

SEQ ID NO: 112200 - RNA, 19 nt, Homo sapiens
cggcugugcuccuguggau

SEQ ID NO: 112201 - RNA, 19 nt, Homo sapiens
gcacaucaccgugguacac

SEQ ID NO: 112202 - RNA, 19 nt, Homo sapiens
ccgcccugcuguaugauau

SEQ ID NO: 112203 - RNA, 19 nt, Homo sapiens
guggaaggucaucaauaaa

SEQ ID NO: 112204 - RNA, 19 nt, Homo sapiens
ccauggaggcccacaucaa

SEQ ID NO: 112205 - RNA, 19 nt, Homo sapiens
uggaaggucaucaauaaag

SEQ ID NO: 112206 - RNA, 19 nt, Homo sapiens
ccugcuguaugauauuaau

SEQ ID NO: 112207 - RNA, 19 nt, Homo sapiens
caccaucuguacccugcuu

SEQ ID NO: 112208 - RNA, 19 nt, Homo sapiens
gagaacuggcugucugagu

SEQ ID NO: 112209 - RNA, 19 nt, Homo sapiens
gaagcugcgguucaacauc

SEQ ID NO: 112210 - RNA, 19 nt, Homo sapiens
gguucccucuuccuugguu

SEQ ID NO: 112211 - RNA, 19 nt, Homo sapiens
cauacaacacccucaucaa

SEQ ID NO: 112212 - RNA, 19 nt, Homo sapiens
gugcaugaaccaguacuau

SEQ ID NO: 112213 - RNA, 19 nt, Homo sapiens
gagcaggagacuggcaaga

SEQ ID NO: 112214 - RNA, 19 nt, Homo sapiens
gaucuacggacaggcaugu

SEQ ID NO: 112215 - RNA, 19 nt, Homo sapiens
gagcccaggcgugaugcua

SEQ ID NO: 112216 - RNA, 19 nt, Homo sapiens
ucaagagcgacaucgagaa

SEQ ID NO: 112217 - RNA, 19 nt, Homo sapiens
uacaacacccucaucaaag

SEQ ID NO: 112218 - RNA, 19 nt, Homo sapiens
uggagaagaucuggaacuc

SEQ ID NO: 112219 - RNA, 19 nt, Homo sapiens
gugcuccuguggauaacau

SEQ ID NO: 112220 - RNA, 19 nt, Homo sapiens
gccagggugugagguuuca

SEQ ID NO: 112221 - RNA, 19 nt, Homo sapiens
ugaccaggccaccaucugu

SEQ ID NO: 112222 - RNA, 19 nt, Homo sapiens
aagcccuucuccuugauga

SEQ ID NO: 112223 - RNA, 19 nt, Homo sapiens
gaaagaaguuguaaggaua

SEQ ID NO: 112224 - RNA, 19 nt, Homo sapiens
gaaagcaacuacagaauuu

SEQ ID NO: 112225 - RNA, 19 nt, Homo sapiens
ucacuaagcucgauaaauc

SEQ ID NO: 112226 - RNA, 19 nt, Homo sapiens
ggaagcagcucgagagugu

SEQ ID NO: 112227 - RNA, 19 nt, Homo sapiens
caagaaagccuucaagaug

SEQ ID NO: 112228 - RNA, 19 nt, Homo sapiens
caauacagcuggcuaacaa

SEQ ID NO: 112229 - RNA, 19 nt, Homo sapiens
gugcugagcuccuugauug

SEQ ID NO: 112230 - RNA, 19 nt, Homo sapiens
guacaaacauaccagauuc

SEQ ID NO: 112231 - RNA, 19 nt, Homo sapiens
aaaccaaucccuugaguua

SEQ ID NO: 112232 - RNA, 19 nt, Homo sapiens
gggcaguuguugcuucuua

SEQ ID NO: 112233 - RNA, 19 nt, Homo sapiens
guucagauuucaacuauug

SEQ ID NO: 112234 - RNA, 19 nt, Homo sapiens
uaauacagcucuuccauag

SEQ ID NO: 112235 - RNA, 19 nt, Homo sapiens
guaaaaugcugaucaguaa

SEQ ID NO: 112236 - RNA, 19 nt, Homo sapiens
ugaaagaaguuguaaggau

SEQ ID NO: 112237 - RNA, 19 nt, Homo sapiens
uaaguaaggugcaaugaag

SEQ ID NO: 112238 - RNA, 19 nt, Homo sapiens
gaguggagaugcagcugua

SEQ ID NO: 112239 - RNA, 19 nt, Homo sapiens
ugacuuaucuucugaugca

SEQ ID NO: 112240 - RNA, 19 nt, Homo sapiens
guaacuaaaugaccaugga

SEQ ID NO: 112241 - RNA, 19 nt, Homo sapiens
guacugcaauauuuggauu

SEQ ID NO: 112242 - RNA, 19 nt, Homo sapiens
ugacugcuguacugcaaua

SEQ ID NO: 112243 - RNA, 19 nt, Homo sapiens
gaagaagcagcacgaaaga

SEQ ID NO: 112244 - RNA, 19 nt, Homo sapiens
cugcaaacauuaaccauga

SEQ ID NO: 112245 - RNA, 19 nt, Homo sapiens
ccuucaagaugucaaauaa

SEQ ID NO: 112246 - RNA, 19 nt, Homo sapiens
guaaccaacugaacgacaa

SEQ ID NO: 112247 - RNA, 19 nt, Homo sapiens
cggcggagguguaguuuga

SEQ ID NO: 112248 - RNA, 19 nt, Homo sapiens
ucaaguccauggagucauu

SEQ ID NO: 112249 - RNA, 19 nt, Homo sapiens
gagccgagauagcaccauu

SEQ ID NO: 112250 - RNA, 19 nt, Homo sapiens
guaaaguuguuaagagaca

SEQ ID NO: 112251 - RNA, 19 nt, Homo sapiens
gcucgagagugucguagaa

SEQ ID NO: 112252 - RNA, 19 nt, Homo sapiens
ugaaugacuuaucuucuga

SEQ ID NO: 112253 - RNA, 19 nt, Homo sapiens
accaaucccuugaguuaua

SEQ ID NO: 112254 - RNA, 19 nt, Homo sapiens
guaaauugaugggagaaau

SEQ ID NO: 112255 - RNA, 19 nt, Homo sapiens
gacaguauauugccauuac

SEQ ID NO: 112256 - RNA, 19 nt, Homo sapiens
aagaaagccuucaagaugu

SEQ ID NO: 112257 - RNA, 19 nt, Homo sapiens
agacuaagguggauuuuaa

SEQ ID NO: 112258 - RNA, 19 nt, Homo sapiens
ucacaggagucaguggaua

SEQ ID NO: 112259 - RNA, 19 nt, Homo sapiens
gauuucaacuauugcagaa

SEQ ID NO: 112260 - RNA, 19 nt, Homo sapiens
ccaaacaguucagauuuca

SEQ ID NO: 112261 - RNA, 19 nt, Homo sapiens
gcagacaguucaaguccau

SEQ ID NO: 112262 - RNA, 19 nt, Homo sapiens
ugaaagcaacuacagaauu

SEQ ID NO: 112263 - RNA, 19 nt, Homo sapiens
ugcuuuagcuuuccaauau

SEQ ID NO: 112264 - RNA, 19 nt, Homo sapiens
cugcuguacugcaauauuu

SEQ ID NO: 112265 - RNA, 19 nt, Homo sapiens
guaaaccaaucccuugagu

SEQ ID NO: 112266 - RNA, 19 nt, Homo sapiens
gaacgacaaagcaugguau

SEQ ID NO: 112267 - RNA, 19 nt, Homo sapiens
gaaguaaccaacugaacga

SEQ ID NO: 112268 - RNA, 19 nt, Homo sapiens
uguauagccuuugucauuu

SEQ ID NO: 112269 - RNA, 19 nt, Homo sapiens
aaaguacaguguuagaugu

SEQ ID NO: 112270 - RNA, 19 nt, Homo sapiens
guaaguaaggugcaaugaa

SEQ ID NO: 112271 - RNA, 19 nt, Homo sapiens
ccacccuccucaagaagua

SEQ ID NO: 112272 - RNA, 19 nt, Homo sapiens
gcaacuacagaauuucauu

SEQ ID NO: 112273 - RNA, 19 nt, Homo sapiens
gaccuuuacugccacaaau

SEQ ID NO: 112274 - RNA, 19 nt, Homo sapiens
agagagguccgucuaauga

SEQ ID NO: 112275 - RNA, 19 nt, Homo sapiens
gccagcagcucaugcaaca

SEQ ID NO: 112276 - RNA, 19 nt, Homo sapiens
gccacaaccugaaagacaa

SEQ ID NO: 112277 - RNA, 19 nt, Homo sapiens
gagcaauacagcuggcuaa

SEQ ID NO: 112278 - RNA, 19 nt, Homo sapiens
gccacagauugccacauua

SEQ ID NO: 112279 - RNA, 19 nt, Homo sapiens
cuggagacguacaaacaua

SEQ ID NO: 112280 - RNA, 19 nt, Homo sapiens
gcagugagccgagauagca

SEQ ID NO: 112281 - RNA, 19 nt, Homo sapiens
gaaaccccaucucuacuaa

SEQ ID NO: 112282 - RNA, 19 nt, Homo sapiens
gaucaccuguggucaagag

SEQ ID NO: 112283 - RNA, 19 nt, Homo sapiens
ccaagaaagccuucaagau

SEQ ID NO: 112284 - RNA, 19 nt, Homo sapiens
uaaaguaaguaaggugcaa

SEQ ID NO: 112285 - RNA, 19 nt, Homo sapiens
ggacaguauauugccauua

SEQ ID NO: 112286 - RNA, 19 nt, Homo sapiens
ccacaaguccaaacaguuc

SEQ ID NO: 112287 - RNA, 19 nt, Homo sapiens
gagagagguccgucuaaug

SEQ ID NO: 112288 - RNA, 19 nt, Homo sapiens
gcaugguauugaaggaauu

SEQ ID NO: 112289 - RNA, 19 nt, Homo sapiens
guuauuaguucugcuuuag

SEQ ID NO: 112290 - RNA, 19 nt, Homo sapiens
uuacauaccaccaccaaga

SEQ ID NO: 112291 - RNA, 19 nt, Homo sapiens
cuaauacagcucuuccaua

SEQ ID NO: 112292 - RNA, 19 nt, Homo sapiens
gaacuuuagcaugguauug

SEQ ID NO: 112293 - RNA, 19 nt, Homo sapiens
gcggaguguuggugaguga

SEQ ID NO: 112294 - RNA, 19 nt, Homo sapiens
caacuccaauuuaccaaac

SEQ ID NO: 112295 - RNA, 19 nt, Homo sapiens
uaguacagcugcccaaugg

SEQ ID NO: 112296 - RNA, 19 nt, Homo sapiens
auuggaaacugacauaaug

SEQ ID NO: 112297 - RNA, 19 nt, Homo sapiens
gaugucaaauaaagcaaag

SEQ ID NO: 112298 - RNA, 19 nt, Homo sapiens
gguauugaaggaauuagaa

SEQ ID NO: 112299 - RNA, 19 nt, Homo sapiens
ugccaaggauugaagaaga

SEQ ID NO: 112300 - RNA, 19 nt, Homo sapiens
guccaaacaguucagauuu

SEQ ID NO: 112301 - RNA, 19 nt, Homo sapiens
gcacaaggaaaguuauuuu

SEQ ID NO: 112302 - RNA, 19 nt, Homo sapiens
ggcaguuguugcuucuuaa

SEQ ID NO: 112303 - RNA, 19 nt, Homo sapiens
gagagugucguagaaagaa

SEQ ID NO: 112304 - RNA, 19 nt, Homo sapiens
ugaagaagcagcacgaaag

SEQ ID NO: 112305 - RNA, 19 nt, Homo sapiens
cuguauagccuuugucauu

SEQ ID NO: 112306 - RNA, 19 nt, Homo sapiens
aaagagagagguccgucua

SEQ ID NO: 112307 - RNA, 19 nt, Homo sapiens
ggagucaguggauagugua

SEQ ID NO: 112308 - RNA, 19 nt, Homo sapiens
gcccagccaucaguuauuc

SEQ ID NO: 112309 - RNA, 19 nt, Homo sapiens
caccguaacucuaguacag

SEQ ID NO: 112310 - RNA, 19 nt, Homo sapiens
aauaugcuguauagccuuu

SEQ ID NO: 112311 - RNA, 19 nt, Homo sapiens
gcugaucaguaaaccaauc

SEQ ID NO: 112312 - RNA, 19 nt, Homo sapiens
cauuugugcuuuugcauua

SEQ ID NO: 112313 - RNA, 19 nt, Homo sapiens
gcgcaaaacugccugaaag

SEQ ID NO: 112314 - RNA, 19 nt, Homo sapiens
aagaagagaagucugaaga

SEQ ID NO: 112315 - RNA, 19 nt, Homo sapiens
agccacagauugccacauu

SEQ ID NO: 112316 - RNA, 19 nt, Homo sapiens
caagaugucaaauaaagca

SEQ ID NO: 112317 - RNA, 19 nt, Homo sapiens
ccaaucccuugaguuauau

SEQ ID NO: 112318 - RNA, 19 nt, Homo sapiens
caaugaagaaguguugauu

SEQ ID NO: 112319 - RNA, 19 nt, Homo sapiens
gcaaugaagaaguguugau

SEQ ID NO: 112320 - RNA, 19 nt, Homo sapiens
gcaugcauaaaguaaguaa

SEQ ID NO: 112321 - RNA, 19 nt, Homo sapiens
cucuugagcugaaguaaug

SEQ ID NO: 112322 - RNA, 19 nt, Homo sapiens
gguugaggcagcagaauug

SEQ ID NO: 112323 - RNA, 19 nt, Homo sapiens
gaaagaaguuguaaggaua

SEQ ID NO: 112324 - RNA, 19 nt, Homo sapiens
gaaagcaacuacagaauuu

SEQ ID NO: 112325 - RNA, 19 nt, Homo sapiens
gaacacagauuucaacuau

SEQ ID NO: 112326 - RNA, 19 nt, Homo sapiens
ucacuaagcucgauaaauc

SEQ ID NO: 112327 - RNA, 19 nt, Homo sapiens
ggaagcagcucgagagugu

SEQ ID NO: 112328 - RNA, 19 nt, Homo sapiens
caagaaagccuucaagaug

SEQ ID NO: 112329 - RNA, 19 nt, Homo sapiens
caauacagcuggcuaacaa

SEQ ID NO: 112330 - RNA, 19 nt, Homo sapiens
gugcugagcuccuugauug

SEQ ID NO: 112331 - RNA, 19 nt, Homo sapiens
guacaaacauaccagauuc

SEQ ID NO: 112332 - RNA, 19 nt, Homo sapiens
acacagauuucaacuauug

SEQ ID NO: 112333 - RNA, 19 nt, Homo sapiens
aaaccaaucccuugaguua

SEQ ID NO: 112334 - RNA, 19 nt, Homo sapiens
gggcaguuguugcuucuua

SEQ ID NO: 112335 - RNA, 19 nt, Homo sapiens
uaauacagcucuuccauag

SEQ ID NO: 112336 - RNA, 19 nt, Homo sapiens
guaaaaugcugaucaguaa

SEQ ID NO: 112337 - RNA, 19 nt, Homo sapiens
ugaaagaaguuguaaggau

SEQ ID NO: 112338 - RNA, 19 nt, Homo sapiens
uaaguaaggugcaaugaag

SEQ ID NO: 112339 - RNA, 19 nt, Homo sapiens
gaguggagaugcagcugua

SEQ ID NO: 112340 - RNA, 19 nt, Homo sapiens
ugacuuaucuucugaugca

SEQ ID NO: 112341 - RNA, 19 nt, Homo sapiens
guaacuaaaugaccaugga

SEQ ID NO: 112342 - RNA, 19 nt, Homo sapiens
guacugcaauauuuggauu

SEQ ID NO: 112343 - RNA, 19 nt, Homo sapiens
ugacugcuguacugcaaua

SEQ ID NO: 112344 - RNA, 19 nt, Homo sapiens
gaagaagcagcacgaaaga

SEQ ID NO: 112345 - RNA, 19 nt, Homo sapiens
cugcaaacauuaaccauga

SEQ ID NO: 112346 - RNA, 19 nt, Homo sapiens
ccuucaagaugucaaauaa

SEQ ID NO: 112347 - RNA, 19 nt, Homo sapiens
guaaccaacugaacgacaa

SEQ ID NO: 112348 - RNA, 19 nt, Homo sapiens
cggcggagguguaguuuga

SEQ ID NO: 112349 - RNA, 19 nt, Homo sapiens
ucaaguccauggagucauu

SEQ ID NO: 112350 - RNA, 19 nt, Homo sapiens
gagccgagauagcaccauu

SEQ ID NO: 112351 - RNA, 19 nt, Homo sapiens
guaaaguuguuaagagaca

SEQ ID NO: 112352 - RNA, 19 nt, Homo sapiens
gcucgagagugucguagaa

SEQ ID NO: 112353 - RNA, 19 nt, Homo sapiens
ugaaugacuuaucuucuga

SEQ ID NO: 112354 - RNA, 19 nt, Homo sapiens
accaaucccuugaguuaua

SEQ ID NO: 112355 - RNA, 19 nt, Homo sapiens
guaaauugaugggagaaau

SEQ ID NO: 112356 - RNA, 19 nt, Homo sapiens
gacaguauauugccauuac

SEQ ID NO: 112357 - RNA, 19 nt, Homo sapiens
aagaaagccuucaagaugu

SEQ ID NO: 112358 - RNA, 19 nt, Homo sapiens
agacuaagguggauuuuaa

SEQ ID NO: 112359 - RNA, 19 nt, Homo sapiens
ucacaggagucaguggaua

SEQ ID NO: 112360 - RNA, 19 nt, Homo sapiens
gauuucaacuauugcagaa

SEQ ID NO: 112361 - RNA, 19 nt, Homo sapiens
gcagacaguucaaguccau

SEQ ID NO: 112362 - RNA, 19 nt, Homo sapiens
ugaaagcaacuacagaauu

SEQ ID NO: 112363 - RNA, 19 nt, Homo sapiens
ugcuuuagcuuuccaauau

SEQ ID NO: 112364 - RNA, 19 nt, Homo sapiens
cugcuguacugcaauauuu

SEQ ID NO: 112365 - RNA, 19 nt, Homo sapiens
guaaaccaaucccuugagu

SEQ ID NO: 112366 - RNA, 19 nt, Homo sapiens
gaacgacaaagcaugguau

SEQ ID NO: 112367 - RNA, 19 nt, Homo sapiens
gaaguaaccaacugaacga

SEQ ID NO: 112368 - RNA, 19 nt, Homo sapiens
uguauagccuuugucauuu

SEQ ID NO: 112369 - RNA, 19 nt, Homo sapiens
aaaguacaguguuagaugu

SEQ ID NO: 112370 - RNA, 19 nt, Homo sapiens
guaaguaaggugcaaugaa

SEQ ID NO: 112371 - RNA, 19 nt, Homo sapiens
ccacccuccucaagaagua

SEQ ID NO: 112372 - RNA, 19 nt, Homo sapiens
gcaacuacagaauuucauu

SEQ ID NO: 112373 - RNA, 19 nt, Homo sapiens
gaccuuuacugccacaaau

SEQ ID NO: 112374 - RNA, 19 nt, Homo sapiens
agagagguccgucuaauga

SEQ ID NO: 112375 - RNA, 19 nt, Homo sapiens
ggaacacagauuucaacua

SEQ ID NO: 112376 - RNA, 19 nt, Homo sapiens
gccagcagcucaugcaaca

SEQ ID NO: 112377 - RNA, 19 nt, Homo sapiens
gccacaaccugaaagacaa

SEQ ID NO: 112378 - RNA, 19 nt, Homo sapiens
gagcaauacagcuggcuaa

SEQ ID NO: 112379 - RNA, 19 nt, Homo sapiens
gccacagauugccacauua

SEQ ID NO: 112380 - RNA, 19 nt, Homo sapiens
cuggagacguacaaacaua

SEQ ID NO: 112381 - RNA, 19 nt, Homo sapiens
gcagugagccgagauagca

SEQ ID NO: 112382 - RNA, 19 nt, Homo sapiens
gaaaccccaucucuacuaa

SEQ ID NO: 112383 - RNA, 19 nt, Homo sapiens
gaucaccuguggucaagag

SEQ ID NO: 112384 - RNA, 19 nt, Homo sapiens
ccaagaaagccuucaagau

SEQ ID NO: 112385 - RNA, 19 nt, Homo sapiens
uaaaguaaguaaggugcaa

SEQ ID NO: 112386 - RNA, 19 nt, Homo sapiens
ggacaguauauugccauua

SEQ ID NO: 112387 - RNA, 19 nt, Homo sapiens
ccacaaguccaaacaguuc

SEQ ID NO: 112388 - RNA, 19 nt, Homo sapiens
gagagagguccgucuaaug

SEQ ID NO: 112389 - RNA, 19 nt, Homo sapiens
gcaugguauugaaggaauu

SEQ ID NO: 112390 - RNA, 19 nt, Homo sapiens
guuauuaguucugcuuuag

SEQ ID NO: 112391 - RNA, 19 nt, Homo sapiens
gcggaguguuggugaguga

SEQ ID NO: 112392 - RNA, 19 nt, Homo sapiens
uuacauaccaccaccaaga

SEQ ID NO: 112393 - RNA, 19 nt, Homo sapiens
cuaauacagcucuuccaua

SEQ ID NO: 112394 - RNA, 19 nt, Homo sapiens
gaacuuuagcaugguauug

SEQ ID NO: 112395 - RNA, 19 nt, Homo sapiens
caacuccaauuuaccaaac

SEQ ID NO: 112396 - RNA, 19 nt, Homo sapiens
uaguacagcugcccaaugg

SEQ ID NO: 112397 - RNA, 19 nt, Homo sapiens
auuggaaacugacauaaug

SEQ ID NO: 112398 - RNA, 19 nt, Homo sapiens
gaugucaaauaaagcaaag

SEQ ID NO: 112399 - RNA, 19 nt, Homo sapiens
gguauugaaggaauuagaa

SEQ ID NO: 112400 - RNA, 19 nt, Homo sapiens
ugccaaggauugaagaaga

SEQ ID NO: 112401 - RNA, 19 nt, Homo sapiens
gcacaaggaaaguuauuuu

SEQ ID NO: 112402 - RNA, 19 nt, Homo sapiens
ggcaguuguugcuucuuaa

SEQ ID NO: 112403 - RNA, 19 nt, Homo sapiens
gagagugucguagaaagaa

SEQ ID NO: 112404 - RNA, 19 nt, Homo sapiens
ugaagaagcagcacgaaag

SEQ ID NO: 112405 - RNA, 19 nt, Homo sapiens
cuguauagccuuugucauu

SEQ ID NO: 112406 - RNA, 19 nt, Homo sapiens
aaagagagagguccgucua

SEQ ID NO: 112407 - RNA, 19 nt, Homo sapiens
ggagucaguggauagugua

SEQ ID NO: 112408 - RNA, 19 nt, Homo sapiens
gcccagccaucaguuauuc

SEQ ID NO: 112409 - RNA, 19 nt, Homo sapiens
caccguaacucuaguacag

SEQ ID NO: 112410 - RNA, 19 nt, Homo sapiens
aauaugcuguauagccuuu

SEQ ID NO: 112411 - RNA, 19 nt, Homo sapiens
gcugaucaguaaaccaauc

SEQ ID NO: 112412 - RNA, 19 nt, Homo sapiens
cauuugugcuuuugcauua

SEQ ID NO: 112413 - RNA, 19 nt, Homo sapiens
gcgcaaaacugccugaaag

SEQ ID NO: 112414 - RNA, 19 nt, Homo sapiens
aagaagagaagucugaaga

SEQ ID NO: 112415 - RNA, 19 nt, Homo sapiens
caagaugucaaauaaagca

SEQ ID NO: 112416 - RNA, 19 nt, Homo sapiens
ccaaucccuugaguuauau

SEQ ID NO: 112417 - RNA, 19 nt, Homo sapiens
agccacagauugccacauu

SEQ ID NO: 112418 - RNA, 19 nt, Homo sapiens
caaugaagaaguguugauu

SEQ ID NO: 112419 - RNA, 19 nt, Homo sapiens
gcaaugaagaaguguugau

SEQ ID NO: 112420 - RNA, 19 nt, Homo sapiens
gcaugcauaaaguaaguaa

SEQ ID NO: 112421 - RNA, 19 nt, Homo sapiens
cucuugagcugaaguaaug

SEQ ID NO: 112422 - RNA, 19 nt, Homo sapiens
gguugaggcagcagaauug

SEQ ID NO: 112423 - RNA, 19 nt, Homo sapiens
gaagaaagcugaagacuug

SEQ ID NO: 112424 - RNA, 19 nt, Homo sapiens
gaagaaaucuggcuaucau

SEQ ID NO: 112425 - RNA, 19 nt, Homo sapiens
gacaaacccuuucuaugua

SEQ ID NO: 112426 - RNA, 19 nt, Homo sapiens
gaauaugagugaugacaaa

SEQ ID NO: 112427 - RNA, 19 nt, Homo sapiens
gaaguggguuuguuuaaug

SEQ ID NO: 112428 - RNA, 19 nt, Homo sapiens
uaacgaagauccugaugaa

SEQ ID NO: 112429 - RNA, 19 nt, Homo sapiens
gauaacagcuaagguauuc

SEQ ID NO: 112430 - RNA, 19 nt, Homo sapiens
ggacaaaccaugccuguug

SEQ ID NO: 112431 - RNA, 19 nt, Homo sapiens
gaagaaguggguuuguuua

SEQ ID NO: 112432 - RNA, 19 nt, Homo sapiens
agaaaggacugcuuauuga

SEQ ID NO: 112433 - RNA, 19 nt, Homo sapiens
gagaaaggacugcuuauug

SEQ ID NO: 112434 - RNA, 19 nt, Homo sapiens
aaagaccaguuuccauuua

SEQ ID NO: 112435 - RNA, 19 nt, Homo sapiens
gagaagagcagcuaacgaa

SEQ ID NO: 112436 - RNA, 19 nt, Homo sapiens
gguacuagauggaaacuug

SEQ ID NO: 112437 - RNA, 19 nt, Homo sapiens
cgaaaucugugguuguaaa

SEQ ID NO: 112438 - RNA, 19 nt, Homo sapiens
aaauuuggcucuaaaguug

SEQ ID NO: 112439 - RNA, 19 nt, Homo sapiens
ucauaaagauugcccugua

SEQ ID NO: 112440 - RNA, 19 nt, Homo sapiens
ugacaaacccuuucuaugu

SEQ ID NO: 112441 - RNA, 19 nt, Homo sapiens
ccgaaaggaucaugaacua

SEQ ID NO: 112442 - RNA, 19 nt, Homo sapiens
gaaguaccauuggcacaaa

SEQ ID NO: 112443 - RNA, 19 nt, Homo sapiens
gauggaaacuugagaaagg

SEQ ID NO: 112444 - RNA, 19 nt, Homo sapiens
cauaaagauugcccuguaa

SEQ ID NO: 112445 - RNA, 19 nt, Homo sapiens
gagaugacacugaaauuug

SEQ ID NO: 112446 - RNA, 19 nt, Homo sapiens
ucauuuggcuguccauaaa

SEQ ID NO: 112447 - RNA, 19 nt, Homo sapiens
ugaggagccuucuguugua

SEQ ID NO: 112448 - RNA, 19 nt, Homo sapiens
acaaggaccuguggaauau

SEQ ID NO: 112449 - RNA, 19 nt, Homo sapiens
gaagucacccugcugagaa

SEQ ID NO: 112450 - RNA, 19 nt, Homo sapiens
gaagagcagcuaacgaaga

SEQ ID NO: 112451 - RNA, 19 nt, Homo sapiens
gaaaguauucuugccauga

SEQ ID NO: 112452 - RNA, 19 nt, Homo sapiens
gaaaggaucaugaacuagu

SEQ ID NO: 112453 - RNA, 19 nt, Homo sapiens
gcacagcccacaucagcua

SEQ ID NO: 112454 - RNA, 19 nt, Homo sapiens
caugguagcggauugguua

SEQ ID NO: 112455 - RNA, 19 nt, Homo sapiens
caacaccuaucauaagaag

SEQ ID NO: 112456 - RNA, 19 nt, Homo sapiens
ucacagcccucaggaaguu

SEQ ID NO: 112457 - RNA, 19 nt, Homo sapiens
gcucauggcccaccagcua

SEQ ID NO: 112458 - RNA, 19 nt, Homo sapiens
ccacagacccaaaguacaa

SEQ ID NO: 112459 - RNA, 19 nt, Homo sapiens
gaugauaguucagaagaca

SEQ ID NO: 112460 - RNA, 19 nt, Homo sapiens
gaaacaacucaccaggaua

SEQ ID NO: 112461 - RNA, 19 nt, Homo sapiens
agaaacaacucaccaggau

SEQ ID NO: 112462 - RNA, 19 nt, Homo sapiens
ggaagcagaguaaauaaag

SEQ ID NO: 112463 - RNA, 19 nt, Homo sapiens
uaaccgccaugcagaagaa

SEQ ID NO: 112464 - RNA, 19 nt, Homo sapiens
cccauuuccucuucuguua

SEQ ID NO: 112465 - RNA, 19 nt, Homo sapiens
ccaaugugcugcuuacaag

SEQ ID NO: 112466 - RNA, 19 nt, Homo sapiens
gaaauucaaguuacaugug

SEQ ID NO: 112467 - RNA, 19 nt, Homo sapiens
gcuauuccugcaucaauua

SEQ ID NO: 112468 - RNA, 19 nt, Homo sapiens
ucaccaaccucaaguacug

SEQ ID NO: 112469 - RNA, 19 nt, Homo sapiens
gaagacuugaguucauuaa

SEQ ID NO: 112470 - RNA, 19 nt, Homo sapiens
gcuucaagaugccgacaaa

SEQ ID NO: 112471 - RNA, 19 nt, Homo sapiens
ugaagaaguggguuuguuu

SEQ ID NO: 112472 - RNA, 19 nt, Homo sapiens
gaugacaaacccuuucuau

SEQ ID NO: 112473 - RNA, 19 nt, Homo sapiens
gaaaggguacuagauggaa

SEQ ID NO: 112474 - RNA, 19 nt, Homo sapiens
cagcaacauccuccaguua

SEQ ID NO: 112475 - RNA, 19 nt, Homo sapiens
aaaggacugcuuauugaua

SEQ ID NO: 112476 - RNA, 19 nt, Homo sapiens
aaagggaaaucaaggaaag

SEQ ID NO: 112477 - RNA, 19 nt, Homo sapiens
uacaaggaccuguggaaua

SEQ ID NO: 112478 - RNA, 19 nt, Homo sapiens
gugaagaaguggguuuguu

SEQ ID NO: 112479 - RNA, 19 nt, Homo sapiens
caaguuacaugugaauucu

SEQ ID NO: 112480 - RNA, 19 nt, Homo sapiens
gaaaggacugcuuauugau

SEQ ID NO: 112481 - RNA, 19 nt, Homo sapiens
gggagcccguggccuuuaa

SEQ ID NO: 112482 - RNA, 19 nt, Homo sapiens
gagcagcagcuucaagaug

SEQ ID NO: 112483 - RNA, 19 nt, Homo sapiens
caauggugauacugucaaa

SEQ ID NO: 112484 - RNA, 19 nt, Homo sapiens
ugagaugacacugaaauuu

SEQ ID NO: 112485 - RNA, 19 nt, Homo sapiens
ccagcaacauccuccaguu

SEQ ID NO: 112486 - RNA, 19 nt, Homo sapiens
ggaaaggguacuagaugga

SEQ ID NO: 112487 - RNA, 19 nt, Homo sapiens
gcuuacaaguucugacuca

SEQ ID NO: 112488 - RNA, 19 nt, Homo sapiens
aaacaugagaugacacuga

SEQ ID NO: 112489 - RNA, 19 nt, Homo sapiens
aaccaugccuguugcuauu

SEQ ID NO: 112490 - RNA, 19 nt, Homo sapiens
ggaaguaccauuggcacaa

SEQ ID NO: 112491 - RNA, 19 nt, Homo sapiens
ccuggaagcagaguaaaua

SEQ ID NO: 112492 - RNA, 19 nt, Homo sapiens
caaagggaaaucaaggaaa

SEQ ID NO: 112493 - RNA, 19 nt, Homo sapiens
ugcaacaccuaucauaaga

SEQ ID NO: 112494 - RNA, 19 nt, Homo sapiens
ucauacugcugauaaagau

SEQ ID NO: 112495 - RNA, 19 nt, Homo sapiens
aagagcagcuaacgaagau

SEQ ID NO: 112496 - RNA, 19 nt, Homo sapiens
aaacaacucaccaggauag

SEQ ID NO: 112497 - RNA, 19 nt, Homo sapiens
agaaguggguuuguuuaau

SEQ ID NO: 112498 - RNA, 19 nt, Homo sapiens
aacaugagaugacacugaa

SEQ ID NO: 112499 - RNA, 19 nt, Homo sapiens
gaaaucugugguuguaaau

SEQ ID NO: 112500 - RNA, 19 nt, Homo sapiens
ugcgaaaucugugguugua

SEQ ID NO: 112501 - RNA, 19 nt, Homo sapiens
cugcaucaauuacaaguuc

SEQ ID NO: 112502 - RNA, 19 nt, Homo sapiens
ccucuucuguuacaucuuc

SEQ ID NO: 112503 - RNA, 19 nt, Homo sapiens
gaacuagugaccuggaaag

SEQ ID NO: 112504 - RNA, 19 nt, Homo sapiens
ggaauaugagugaugacaa

SEQ ID NO: 112505 - RNA, 19 nt, Homo sapiens
gaaagucuggguucagucu

SEQ ID NO: 112506 - RNA, 19 nt, Homo sapiens
ugagaaggaaguaccauug

SEQ ID NO: 112507 - RNA, 19 nt, Homo sapiens
gaagcagaguaaauaaagc

SEQ ID NO: 112508 - RNA, 19 nt, Homo sapiens
aaggaccuguggaauauga

SEQ ID NO: 112509 - RNA, 19 nt, Homo sapiens
aaaggguacuagauggaaa

SEQ ID NO: 112510 - RNA, 19 nt, Homo sapiens
uuucugugcucaaugugua

SEQ ID NO: 112511 - RNA, 19 nt, Homo sapiens
gauacucauuagugacuuc

SEQ ID NO: 112512 - RNA, 19 nt, Homo sapiens
gcccucaggaaguugauua

SEQ ID NO: 112513 - RNA, 19 nt, Homo sapiens
uacagaagcuauacagcau

SEQ ID NO: 112514 - RNA, 19 nt, Homo sapiens
aaauagagcagcagcuuca

SEQ ID NO: 112515 - RNA, 19 nt, Homo sapiens
gcccguggccuuuaaagug

SEQ ID NO: 112516 - RNA, 19 nt, Homo sapiens
ccauaaacauaaacaugag

SEQ ID NO: 112517 - RNA, 19 nt, Homo sapiens
acucauuagugacuucaaa

SEQ ID NO: 112518 - RNA, 19 nt, Homo sapiens
guacaacaguuuuagauac

SEQ ID NO: 112519 - RNA, 19 nt, Homo sapiens
aaaggaucaugaacuagug

SEQ ID NO: 112520 - RNA, 19 nt, Homo sapiens
ucacccugcugagaaauga

SEQ ID NO: 112521 - RNA, 19 nt, Homo sapiens
ugagaaaggacugcuuauu

SEQ ID NO: 112522 - RNA, 19 nt, Homo sapiens
gcaacaccuaucauaagaa

SEQ ID NO: 112523 - RNA, 19 nt, Homo sapiens
gcaaggagcuucccaaguu

SEQ ID NO: 112524 - RNA, 19 nt, Homo sapiens
ccaaggaacugcccuauuu

SEQ ID NO: 112525 - RNA, 19 nt, Homo sapiens
aaagaaaccugaagugaaa

SEQ ID NO: 112526 - RNA, 19 nt, Homo sapiens
ggccauagcuuaauuaauc

SEQ ID NO: 112527 - RNA, 19 nt, Homo sapiens
gcacagccguuuaccauga

SEQ ID NO: 112528 - RNA, 19 nt, Homo sapiens
gaaugcacguccaagaaua

SEQ ID NO: 112529 - RNA, 19 nt, Homo sapiens
ccacacacaucuaucuaua

SEQ ID NO: 112530 - RNA, 19 nt, Homo sapiens
ggacagcccuuuagucaag

SEQ ID NO: 112531 - RNA, 19 nt, Homo sapiens
gaacugauuccugaaauaa

SEQ ID NO: 112532 - RNA, 19 nt, Homo sapiens
ccaaugaccugucccagaa

SEQ ID NO: 112533 - RNA, 19 nt, Homo sapiens
gaauagguaucauuucugu

SEQ ID NO: 112534 - RNA, 19 nt, Homo sapiens
caaaucaucucucauugga

SEQ ID NO: 112535 - RNA, 19 nt, Homo sapiens
gaagugaaaguagaaguua

SEQ ID NO: 112536 - RNA, 19 nt, Homo sapiens
gggaaagccugccaaguug

SEQ ID NO: 112537 - RNA, 19 nt, Homo sapiens
gaaaauggcugagaacuug

SEQ ID NO: 112538 - RNA, 19 nt, Homo sapiens
gcaagaaugccaagaagaa

SEQ ID NO: 112539 - RNA, 19 nt, Homo sapiens
caaggagcuucccaaguua

SEQ ID NO: 112540 - RNA, 19 nt, Homo sapiens
cagcagggaugaauauuau

SEQ ID NO: 112541 - RNA, 19 nt, Homo sapiens
gaaaagcaauucuagugua

SEQ ID NO: 112542 - RNA, 19 nt, Homo sapiens
gaaaacaaauucagugcua

SEQ ID NO: 112543 - RNA, 19 nt, Homo sapiens
ggaggucgcguuuacauaa

SEQ ID NO: 112544 - RNA, 19 nt, Homo sapiens
gaaauuaggguaugugaca

SEQ ID NO: 112545 - RNA, 19 nt, Homo sapiens
gaaaguagaaguuaaagag

SEQ ID NO: 112546 - RNA, 19 nt, Homo sapiens
cgacaaaucaucucucauu

SEQ ID NO: 112547 - RNA, 19 nt, Homo sapiens
ccaaguacguggccaauca

SEQ ID NO: 112548 - RNA, 19 nt, Homo sapiens
ggagccaucuagugcauaa

SEQ ID NO: 112549 - RNA, 19 nt, Homo sapiens
cuacagauaucaagaauac

SEQ ID NO: 112550 - RNA, 19 nt, Homo sapiens
gaaaucagaaccaauggaa

SEQ ID NO: 112551 - RNA, 19 nt, Homo sapiens
gcagaaaucagaaccaaug

SEQ ID NO: 112552 - RNA, 19 nt, Homo sapiens
gccaagcacugccaagaaa

SEQ ID NO: 112553 - RNA, 19 nt, Homo sapiens
gaagaagaacaacaagaaa

SEQ ID NO: 112554 - RNA, 19 nt, Homo sapiens
guacauuucuuaucuggau

SEQ ID NO: 112555 - RNA, 19 nt, Homo sapiens
aaacuugucuugcagaugu

SEQ ID NO: 112556 - RNA, 19 nt, Homo sapiens
gaagagccaugcccauaag

SEQ ID NO: 112557 - RNA, 19 nt, Homo sapiens
ggaacuagaacaagaagaa

SEQ ID NO: 112558 - RNA, 19 nt, Homo sapiens
gaagaagagaguagcagua

SEQ ID NO: 112559 - RNA, 19 nt, Homo sapiens
uuaaauaucuggucucucu

SEQ ID NO: 112560 - RNA, 19 nt, Homo sapiens
ggaggcagcggcucuagua

SEQ ID NO: 112561 - RNA, 19 nt, Homo sapiens
ggaaguggaugaaaagaaa

SEQ ID NO: 112562 - RNA, 19 nt, Homo sapiens
gagcagaaaucagaaccaa

SEQ ID NO: 112563 - RNA, 19 nt, Homo sapiens
ggaaauaauccaaugaaca

SEQ ID NO: 112564 - RNA, 19 nt, Homo sapiens
gagaaguguuucacagaga

SEQ ID NO: 112565 - RNA, 19 nt, Homo sapiens
ucaccaacgugccaaauau

SEQ ID NO: 112566 - RNA, 19 nt, Homo sapiens
guauauaaaguaccgcuua

SEQ ID NO: 112567 - RNA, 19 nt, Homo sapiens
gcuggugacucaugccuuu

SEQ ID NO: 112568 - RNA, 19 nt, Homo sapiens
gggaugaagucacgguuug

SEQ ID NO: 112569 - RNA, 19 nt, Homo sapiens
ggaagaugcaucagauuug

SEQ ID NO: 112570 - RNA, 19 nt, Homo sapiens
gcacacaccaacaacauga

SEQ ID NO: 112571 - RNA, 19 nt, Homo sapiens
gacaaaucaucucucauug

SEQ ID NO: 112572 - RNA, 19 nt, Homo sapiens
gggaauaacugggaacaca

SEQ ID NO: 112573 - RNA, 19 nt, Homo sapiens
guggagggcuuguagcauu

SEQ ID NO: 112574 - RNA, 19 nt, Homo sapiens
uuaaggaacuagaacaaga

SEQ ID NO: 112575 - RNA, 19 nt, Homo sapiens
caagugaaggagaugauua

SEQ ID NO: 112576 - RNA, 19 nt, Homo sapiens
ugaaucacaugacgcauug

SEQ ID NO: 112577 - RNA, 19 nt, Homo sapiens
aaaaugaucuuccugauga

SEQ ID NO: 112578 - RNA, 19 nt, Homo sapiens
gcaauucuaguguaaauca

SEQ ID NO: 112579 - RNA, 19 nt, Homo sapiens
aauggcagcuuucaucaaa

SEQ ID NO: 112580 - RNA, 19 nt, Homo sapiens
gcacaaggaggucuucuuc

SEQ ID NO: 112581 - RNA, 19 nt, Homo sapiens
gugaaucgcaugcaaguuu

SEQ ID NO: 112582 - RNA, 19 nt, Homo sapiens
aaggguggauugauguuua

SEQ ID NO: 112583 - RNA, 19 nt, Homo sapiens
ggaagcagcuguguaccau

SEQ ID NO: 112584 - RNA, 19 nt, Homo sapiens
caacagcagggaugaauau

SEQ ID NO: 112585 - RNA, 19 nt, Homo sapiens
gcaaacaucagugggaauu

SEQ ID NO: 112586 - RNA, 19 nt, Homo sapiens
aauaguaacucuggccaua

SEQ ID NO: 112587 - RNA, 19 nt, Homo sapiens
gaucauuguuugacuugga

SEQ ID NO: 112588 - RNA, 19 nt, Homo sapiens
agaacugauuccugaaaua

SEQ ID NO: 112589 - RNA, 19 nt, Homo sapiens
gggacacgcuagagaaguu

SEQ ID NO: 112590 - RNA, 19 nt, Homo sapiens
ggaggaggauuugcaagga

SEQ ID NO: 112591 - RNA, 19 nt, Homo sapiens
ccacaaacccacugaugaa

SEQ ID NO: 112592 - RNA, 19 nt, Homo sapiens
ggaggagaauuaggccuuu

SEQ ID NO: 112593 - RNA, 19 nt, Homo sapiens
auacgaaacucgagaagau

SEQ ID NO: 112594 - RNA, 19 nt, Homo sapiens
guggauugauguuuaaaga

SEQ ID NO: 112595 - RNA, 19 nt, Homo sapiens
gcugaacauucucaaauca

SEQ ID NO: 112596 - RNA, 19 nt, Homo sapiens
gcucagcugugaccucaug

SEQ ID NO: 112597 - RNA, 19 nt, Homo sapiens
uacuacagcuaucagaaua

SEQ ID NO: 112598 - RNA, 19 nt, Homo sapiens
aacaaugccuggcucuaua

SEQ ID NO: 112599 - RNA, 19 nt, Homo sapiens
cgaaugacagcacagauuu

SEQ ID NO: 112600 - RNA, 19 nt, Homo sapiens
caacauggcgaguaugaau

SEQ ID NO: 112601 - RNA, 19 nt, Homo sapiens
ugacguaccugugcuggaa

SEQ ID NO: 112602 - RNA, 19 nt, Homo sapiens
gaugcugcuuccaaacaua

SEQ ID NO: 112603 - RNA, 19 nt, Homo sapiens
guauuacccuggaugauag

SEQ ID NO: 112604 - RNA, 19 nt, Homo sapiens
uaucuggucucucucuuug

SEQ ID NO: 112605 - RNA, 19 nt, Homo sapiens
ccaagaagaagaacaacaa

SEQ ID NO: 112606 - RNA, 19 nt, Homo sapiens
uagcagagcagaaaucaga

SEQ ID NO: 112607 - RNA, 19 nt, Homo sapiens
acacacaucuaucuauaca

SEQ ID NO: 112608 - RNA, 19 nt, Homo sapiens
ggacacagggcaauaccaa

SEQ ID NO: 112609 - RNA, 19 nt, Homo sapiens
aaucagcucuuccgacuuc

SEQ ID NO: 112610 - RNA, 19 nt, Homo sapiens
ggcagcggcucuaguauca

SEQ ID NO: 112611 - RNA, 19 nt, Homo sapiens
ggaaugcacguccaagaau

SEQ ID NO: 112612 - RNA, 19 nt, Homo sapiens
gaagaugcaucagauuugc

SEQ ID NO: 112613 - RNA, 19 nt, Homo sapiens
caacuccugugucgucuuc

SEQ ID NO: 112614 - RNA, 19 nt, Homo sapiens
ccugguaucugcaugaaug

SEQ ID NO: 112615 - RNA, 19 nt, Homo sapiens
cugaaauaaugcaagcuua

SEQ ID NO: 112616 - RNA, 19 nt, Homo sapiens
gcgaaugacagcacagauu

SEQ ID NO: 112617 - RNA, 19 nt, Homo sapiens
cgaagagccaugcccauaa

SEQ ID NO: 112618 - RNA, 19 nt, Homo sapiens
agaagaagaacaacaagaa

SEQ ID NO: 112619 - RNA, 19 nt, Homo sapiens
gaagaccgagugaacaaau

SEQ ID NO: 112620 - RNA, 19 nt, Homo sapiens
agacgacaauuucaaagga

SEQ ID NO: 112621 - RNA, 19 nt, Homo sapiens
caacaaugccuggcucuau

SEQ ID NO: 112622 - RNA, 19 nt, Homo sapiens
gcagcagccagcauugaua

SEQ ID NO: 112623 - RNA, 19 nt, Homo sapiens
ggagaaagaagaaagagua

SEQ ID NO: 112624 - RNA, 19 nt, Homo sapiens
gaaccugucucuccauguu

SEQ ID NO: 112625 - RNA, 19 nt, Homo sapiens
gcccaaaccuguagugcua

SEQ ID NO: 112626 - RNA, 19 nt, Homo sapiens
gaagucaccuccaguuaag

SEQ ID NO: 112627 - RNA, 19 nt, Homo sapiens
aaacagcgagcucaaguua

SEQ ID NO: 112628 - RNA, 19 nt, Homo sapiens
guggugagcugcugcauau

SEQ ID NO: 112629 - RNA, 19 nt, Homo sapiens
ccacagaccagcccaguuu

SEQ ID NO: 112630 - RNA, 19 nt, Homo sapiens
gaaagaagaaagaguaucu

SEQ ID NO: 112631 - RNA, 19 nt, Homo sapiens
ggagcaggaugucccguuu

SEQ ID NO: 112632 - RNA, 19 nt, Homo sapiens
gaagaagucaccuccaguu

SEQ ID NO: 112633 - RNA, 19 nt, Homo sapiens
gaauauagggcuccucuca

SEQ ID NO: 112634 - RNA, 19 nt, Homo sapiens
gugggacuguuucaaauuu

SEQ ID NO: 112635 - RNA, 19 nt, Homo sapiens
ccaaggagcuacuacuaag

SEQ ID NO: 112636 - RNA, 19 nt, Homo sapiens
gcuaaccacugucccaaug

SEQ ID NO: 112637 - RNA, 19 nt, Homo sapiens
ccaacauccucauuugaaa

SEQ ID NO: 112638 - RNA, 19 nt, Homo sapiens
gacccaacauccucauuug

SEQ ID NO: 112639 - RNA, 19 nt, Homo sapiens
caguggaggugggaauuua

SEQ ID NO: 112640 - RNA, 19 nt, Homo sapiens
gaacagcaccuuguauucu

SEQ ID NO: 112641 - RNA, 19 nt, Homo sapiens
ggugagcugcugcauauuu

SEQ ID NO: 112642 - RNA, 19 nt, Homo sapiens
ggucuuccuucucuucauu

SEQ ID NO: 112643 - RNA, 19 nt, Homo sapiens
gaggcuugcugacgaguug

SEQ ID NO: 112644 - RNA, 19 nt, Homo sapiens
aguccuggcuucuuuguuu

SEQ ID NO: 112645 - RNA, 19 nt, Homo sapiens
auauagggcuccucucauu

SEQ ID NO: 112646 - RNA, 19 nt, Homo sapiens
guucuuccgucaacucuga

SEQ ID NO: 112647 - RNA, 19 nt, Homo sapiens
gaagguggucugcaucaug

SEQ ID NO: 112648 - RNA, 19 nt, Homo sapiens
ugaugcagaucgaguguga

SEQ ID NO: 112649 - RNA, 19 nt, Homo sapiens
cagaacagcaccuuguauu

SEQ ID NO: 112650 - RNA, 19 nt, Homo sapiens
ccucagauguccagaccaa

SEQ ID NO: 112651 - RNA, 19 nt, Homo sapiens
gccaaggagcuacuacuaa

SEQ ID NO: 112652 - RNA, 19 nt, Homo sapiens
caagauagaaccugucucu

SEQ ID NO: 112653 - RNA, 19 nt, Homo sapiens
agaagucaccuccaguuaa

SEQ ID NO: 112654 - RNA, 19 nt, Homo sapiens
gcagaacagcaccuuguau

SEQ ID NO: 112655 - RNA, 19 nt, Homo sapiens
guucaccucucuucucauc

SEQ ID NO: 112656 - RNA, 19 nt, Homo sapiens
gaucgagugugaggucaug

SEQ ID NO: 112657 - RNA, 19 nt, Homo sapiens
gagaaagaagaaagaguau

SEQ ID NO: 112658 - RNA, 19 nt, Homo sapiens
ccucugccauucacacuga

SEQ ID NO: 112659 - RNA, 19 nt, Homo sapiens
cuucauugccuucaacuuu

SEQ ID NO: 112660 - RNA, 19 nt, Homo sapiens
cauucacacugacuuagaa

SEQ ID NO: 112661 - RNA, 19 nt, Homo sapiens
caucgcgucucuccacaga

SEQ ID NO: 112662 - RNA, 19 nt, Homo sapiens
gaaaccguccagaucaaug

SEQ ID NO: 112663 - RNA, 19 nt, Homo sapiens
ugggccagcugcaacuaua

SEQ ID NO: 112664 - RNA, 19 nt, Homo sapiens
caagaugucccuggugaug

SEQ ID NO: 112665 - RNA, 19 nt, Homo sapiens
cagagaggccggaggaaga

SEQ ID NO: 112666 - RNA, 19 nt, Homo sapiens
gcaguggaggugggaauuu

SEQ ID NO: 112667 - RNA, 19 nt, Homo sapiens
ugacccaacauccucauuu

SEQ ID NO: 112668 - RNA, 19 nt, Homo sapiens
aagaagucaccuccaguua

SEQ ID NO: 112669 - RNA, 19 nt, Homo sapiens
gaaagauggcggagcugau

SEQ ID NO: 112670 - RNA, 19 nt, Homo sapiens
ggaguucagguuuaugugu

SEQ ID NO: 112671 - RNA, 19 nt, Homo sapiens
cagcagcgaaugaucaaga

SEQ ID NO: 112672 - RNA, 19 nt, Homo sapiens
gggaacuccugccgaucuu

SEQ ID NO: 112673 - RNA, 19 nt, Homo sapiens
cgccugaaguggaugcaaa

SEQ ID NO: 112674 - RNA, 19 nt, Homo sapiens
ugugugagguucaguugug

SEQ ID NO: 112675 - RNA, 19 nt, Homo sapiens
caggugggacuguuucaaa

SEQ ID NO: 112676 - RNA, 19 nt, Homo sapiens
acagcgagcucaaguuagg

SEQ ID NO: 112677 - RNA, 19 nt, Homo sapiens
ggugaagucugagccaucu

SEQ ID NO: 112678 - RNA, 19 nt, Homo sapiens
ccucucuucucaucccuuu

SEQ ID NO: 112679 - RNA, 19 nt, Homo sapiens
guguucaccucucuucuca

SEQ ID NO: 112680 - RNA, 19 nt, Homo sapiens
ggugggacuguuucaaauu

SEQ ID NO: 112681 - RNA, 19 nt, Homo sapiens
acaggaagguggucugcau

SEQ ID NO: 112682 - RNA, 19 nt, Homo sapiens
aagcaguacuggcugacaa

SEQ ID NO: 112683 - RNA, 19 nt, Homo sapiens
ggaagguggucugcaucau

SEQ ID NO: 112684 - RNA, 19 nt, Homo sapiens
gcaauugguaaaggaaaga

SEQ ID NO: 112685 - RNA, 19 nt, Homo sapiens
gccaucagccacaacaaga

SEQ ID NO: 112686 - RNA, 19 nt, Homo sapiens
gcagccagcauucuuggau

SEQ ID NO: 112687 - RNA, 19 nt, Homo sapiens
gaucaagaaccgggaguca

SEQ ID NO: 112688 - RNA, 19 nt, Homo sapiens
ucagauguccagaccaaga

SEQ ID NO: 112689 - RNA, 19 nt, Homo sapiens
gguggugagcugcugcaua

SEQ ID NO: 112690 - RNA, 19 nt, Homo sapiens
gcuccucucauuccuguga

SEQ ID NO: 112691 - RNA, 19 nt, Homo sapiens
ggcaauugguaaaggaaag

SEQ ID NO: 112692 - RNA, 19 nt, Homo sapiens
cccaacauccucauuugaa

SEQ ID NO: 112693 - RNA, 19 nt, Homo sapiens
caaguuagggucuggaaac

SEQ ID NO: 112694 - RNA, 19 nt, Homo sapiens
gaaaacagcgagcucaagu

SEQ ID NO: 112695 - RNA, 19 nt, Homo sapiens
agcaggaugucccguuuga

SEQ ID NO: 112696 - RNA, 19 nt, Homo sapiens
caaggagcuacuacuaaga

SEQ ID NO: 112697 - RNA, 19 nt, Homo sapiens
cauccagggugcuauucga

SEQ ID NO: 112698 - RNA, 19 nt, Homo sapiens
ucagagggcccaggagaga

SEQ ID NO: 112699 - RNA, 19 nt, Homo sapiens
ggacuaugaggagaugaug

SEQ ID NO: 112700 - RNA, 19 nt, Homo sapiens
gagcaggaugucccguuug

SEQ ID NO: 112701 - RNA, 19 nt, Homo sapiens
uucauugccuucaacuuug

SEQ ID NO: 112702 - RNA, 19 nt, Homo sapiens
aaagauggcggagcugaug

SEQ ID NO: 112703 - RNA, 19 nt, Homo sapiens
gggcaauugguaaaggaaa

SEQ ID NO: 112704 - RNA, 19 nt, Homo sapiens
augaggagaugaugcagau

SEQ ID NO: 112705 - RNA, 19 nt, Homo sapiens
gugagcugcugcauauuuu

SEQ ID NO: 112706 - RNA, 19 nt, Homo sapiens
cgccaaggagcuacuacua

SEQ ID NO: 112707 - RNA, 19 nt, Homo sapiens
guuuaugugugugcauuuc

SEQ ID NO: 112708 - RNA, 19 nt, Homo sapiens
ggugggacaagggaaguuu

SEQ ID NO: 112709 - RNA, 19 nt, Homo sapiens
guccuggcuucuuuguuug

SEQ ID NO: 112710 - RNA, 19 nt, Homo sapiens
agaacagcaccuuguauuc

SEQ ID NO: 112711 - RNA, 19 nt, Homo sapiens
uugcugacccgacgcguuu

SEQ ID NO: 112712 - RNA, 19 nt, Homo sapiens
aacagcaccuuguauucug

SEQ ID NO: 112713 - RNA, 19 nt, Homo sapiens
caacauccucauuugaaac

SEQ ID NO: 112714 - RNA, 19 nt, Homo sapiens
ccgcuccuaugccuggaaa

SEQ ID NO: 112715 - RNA, 19 nt, Homo sapiens
uaccacggccugagaggaa

SEQ ID NO: 112716 - RNA, 19 nt, Homo sapiens
ucucaucccuuuucagaau

SEQ ID NO: 112717 - RNA, 19 nt, Homo sapiens
ccauucacacugacuuaga

SEQ ID NO: 112718 - RNA, 19 nt, Homo sapiens
ucccugaccucugccauuc

SEQ ID NO: 112719 - RNA, 19 nt, Homo sapiens
guucgcagccagcauucuu

SEQ ID NO: 112720 - RNA, 19 nt, Homo sapiens
uuaugugugugcauuucuu

SEQ ID NO: 112721 - RNA, 19 nt, Homo sapiens
gaugaugcagaucgagugu

SEQ ID NO: 112722 - RNA, 19 nt, Homo sapiens
gacgggaagacacauuuua

SEQ ID NO: 112723 - RNA, 19 nt, Homo sapiens
gaaauuagcugcugagauu

SEQ ID NO: 112724 - RNA, 19 nt, Homo sapiens
caaaugagcugauuacuga

SEQ ID NO: 112725 - RNA, 19 nt, Homo sapiens
ggacuuaccuugaguuaaa

SEQ ID NO: 112726 - RNA, 19 nt, Homo sapiens
caagacagcuucuaguuaa

SEQ ID NO: 112727 - RNA, 19 nt, Homo sapiens
gagaggaacuggaaaugua

SEQ ID NO: 112728 - RNA, 19 nt, Homo sapiens
ggagucaccuugaauuauu

SEQ ID NO: 112729 - RNA, 19 nt, Homo sapiens
gggaagaacuacauuaaau

SEQ ID NO: 112730 - RNA, 19 nt, Homo sapiens
gaacaaaucucagcagaac

SEQ ID NO: 112731 - RNA, 19 nt, Homo sapiens
gaaugucgcucuucaaugg

SEQ ID NO: 112732 - RNA, 19 nt, Homo sapiens
ccacauugcuuuauugguu

SEQ ID NO: 112733 - RNA, 19 nt, Homo sapiens
caacuaaauuggagaaugu

SEQ ID NO: 112734 - RNA, 19 nt, Homo sapiens
uaaaacagcuggagcauuu

SEQ ID NO: 112735 - RNA, 19 nt, Homo sapiens
gaauaaagugccucccuua

SEQ ID NO: 112736 - RNA, 19 nt, Homo sapiens
gcaaauauuuagcuuccaa

SEQ ID NO: 112737 - RNA, 19 nt, Homo sapiens
gagaagagcagaacaaauc

SEQ ID NO: 112738 - RNA, 19 nt, Homo sapiens
ccacauaguuuaagauuac

SEQ ID NO: 112739 - RNA, 19 nt, Homo sapiens
caagaaaucaguugcauau

SEQ ID NO: 112740 - RNA, 19 nt, Homo sapiens
guaucaaccugcuguauau

SEQ ID NO: 112741 - RNA, 19 nt, Homo sapiens
caaaacaacccaaaacuua

SEQ ID NO: 112742 - RNA, 19 nt, Homo sapiens
gaaaccaaaugagcugauu

SEQ ID NO: 112743 - RNA, 19 nt, Homo sapiens
gaagagcaguagaggaugu

SEQ ID NO: 112744 - RNA, 19 nt, Homo sapiens
caaauggagugacgguuga

SEQ ID NO: 112745 - RNA, 19 nt, Homo sapiens
guaauugguaggcuaaaua

SEQ ID NO: 112746 - RNA, 19 nt, Homo sapiens
gccaaauucugucauuauu

SEQ ID NO: 112747 - RNA, 19 nt, Homo sapiens
gaaauaaaggcccuacuca

SEQ ID NO: 112748 - RNA, 19 nt, Homo sapiens
ugagucaccuugaguuauu

SEQ ID NO: 112749 - RNA, 19 nt, Homo sapiens
gaggagucaccuugaauua

SEQ ID NO: 112750 - RNA, 19 nt, Homo sapiens
guacuugguugcaaacuca

SEQ ID NO: 112751 - RNA, 19 nt, Homo sapiens
gaagauggaugggcaagag

SEQ ID NO: 112752 - RNA, 19 nt, Homo sapiens
ucaagacagcuucuaguua

SEQ ID NO: 112753 - RNA, 19 nt, Homo sapiens
ggaggcagccagaaccaua

SEQ ID NO: 112754 - RNA, 19 nt, Homo sapiens
ugaaggagcagcauaguga

SEQ ID NO: 112755 - RNA, 19 nt, Homo sapiens
gggcgaaguuaaauuacaa

SEQ ID NO: 112756 - RNA, 19 nt, Homo sapiens
gaacgucuuuauugugcuu

SEQ ID NO: 112757 - RNA, 19 nt, Homo sapiens
agauugaguuucugccuua

SEQ ID NO: 112758 - RNA, 19 nt, Homo sapiens
gcuguccucucaaacuaua

SEQ ID NO: 112759 - RNA, 19 nt, Homo sapiens
gaucuugcuuuaacuuuca

SEQ ID NO: 112760 - RNA, 19 nt, Homo sapiens
gcauucagauuguaauugg

SEQ ID NO: 112761 - RNA, 19 nt, Homo sapiens
uauaaguucucagccuuua

SEQ ID NO: 112762 - RNA, 19 nt, Homo sapiens
gugcugcucuccuugcuuu

SEQ ID NO: 112763 - RNA, 19 nt, Homo sapiens
caagguacuuucccucuuc

SEQ ID NO: 112764 - RNA, 19 nt, Homo sapiens
ucagggaagcgaacuguua

SEQ ID NO: 112765 - RNA, 19 nt, Homo sapiens
ugaagaaucaagcucauaa

SEQ ID NO: 112766 - RNA, 19 nt, Homo sapiens
ggguauauauguauguaug

SEQ ID NO: 112767 - RNA, 19 nt, Homo sapiens
acaaagagaaaccaaauga

SEQ ID NO: 112768 - RNA, 19 nt, Homo sapiens
cuaaauaggaguuacagaa

SEQ ID NO: 112769 - RNA, 19 nt, Homo sapiens
uggaggagaucacacacua

SEQ ID NO: 112770 - RNA, 19 nt, Homo sapiens
aaacucagaucucuagucu

SEQ ID NO: 112771 - RNA, 19 nt, Homo sapiens
cacauugcuuuauugguua

SEQ ID NO: 112772 - RNA, 19 nt, Homo sapiens
guagucaucucuguaaauc

SEQ ID NO: 112773 - RNA, 19 nt, Homo sapiens
cagccaaauucugucauua

SEQ ID NO: 112774 - RNA, 19 nt, Homo sapiens
acaaauugcugguagaucu

SEQ ID NO: 112775 - RNA, 19 nt, Homo sapiens
ggauaugccuguuuuaaau

SEQ ID NO: 112776 - RNA, 19 nt, Homo sapiens
aaacacaggaguagagaaa

SEQ ID NO: 112777 - RNA, 19 nt, Homo sapiens
gagucaccuugaauuauuu

SEQ ID NO: 112778 - RNA, 19 nt, Homo sapiens
ggaggagucaccuugaauu

SEQ ID NO: 112779 - RNA, 19 nt, Homo sapiens
cuucagaauuuaaggguuu

SEQ ID NO: 112780 - RNA, 19 nt, Homo sapiens
cucugucgcugcuaaauua

SEQ ID NO: 112781 - RNA, 19 nt, Homo sapiens
caggguaguucuuuccauu

SEQ ID NO: 112782 - RNA, 19 nt, Homo sapiens
gggaagagcaguagaggau

SEQ ID NO: 112783 - RNA, 19 nt, Homo sapiens
cagaagaguuguuuucaaa

SEQ ID NO: 112784 - RNA, 19 nt, Homo sapiens
gagauaccguagucuagau

SEQ ID NO: 112785 - RNA, 19 nt, Homo sapiens
gacagacccagaaaucuuu

SEQ ID NO: 112786 - RNA, 19 nt, Homo sapiens
gccaucaccagaacacuua

SEQ ID NO: 112787 - RNA, 19 nt, Homo sapiens
gacaaucuaggguauauau

SEQ ID NO: 112788 - RNA, 19 nt, Homo sapiens
uaaggugguuggaggcaaa

SEQ ID NO: 112789 - RNA, 19 nt, Homo sapiens
ggaucuugcuuuaacuuuc

SEQ ID NO: 112790 - RNA, 19 nt, Homo sapiens
aaagaugagucagugauug

SEQ ID NO: 112791 - RNA, 19 nt, Homo sapiens
gguauccagucgagaaaga

SEQ ID NO: 112792 - RNA, 19 nt, Homo sapiens
ggccaugcauuugaauaaa

SEQ ID NO: 112793 - RNA, 19 nt, Homo sapiens
gaggagauaccguagucua

SEQ ID NO: 112794 - RNA, 19 nt, Homo sapiens
agacaugaauuuccugaca

SEQ ID NO: 112795 - RNA, 19 nt, Homo sapiens
gucaccaccuuucauguuu

SEQ ID NO: 112796 - RNA, 19 nt, Homo sapiens
ggaagacagaugcuaauag

SEQ ID NO: 112797 - RNA, 19 nt, Homo sapiens
aaacuggacuuaccuugag

SEQ ID NO: 112798 - RNA, 19 nt, Homo sapiens
caguagaggauguauaauu

SEQ ID NO: 112799 - RNA, 19 nt, Homo sapiens
aauccauacuugcagaaua

SEQ ID NO: 112800 - RNA, 19 nt, Homo sapiens
ccagccaaauucugucauu

SEQ ID NO: 112801 - RNA, 19 nt, Homo sapiens
gaccacauaguuuaagauu

SEQ ID NO: 112802 - RNA, 19 nt, Homo sapiens
ugauggaccacauaguuua

SEQ ID NO: 112803 - RNA, 19 nt, Homo sapiens
gcugauuacugacuauaag

SEQ ID NO: 112804 - RNA, 19 nt, Homo sapiens
guaaacacccagagacugu

SEQ ID NO: 112805 - RNA, 19 nt, Homo sapiens
cauuuaacauguugugaug

SEQ ID NO: 112806 - RNA, 19 nt, Homo sapiens
gcaucacuauguagcauuc

SEQ ID NO: 112807 - RNA, 19 nt, Homo sapiens
uagucuagauugucuuuga

SEQ ID NO: 112808 - RNA, 19 nt, Homo sapiens
gcugcuaaauuauucuuca

SEQ ID NO: 112809 - RNA, 19 nt, Homo sapiens
gcucaguagucaucucugu

SEQ ID NO: 112810 - RNA, 19 nt, Homo sapiens
gggaagacagaugcuaaua

SEQ ID NO: 112811 - RNA, 19 nt, Homo sapiens
ggagauaccguagucuaga

SEQ ID NO: 112812 - RNA, 19 nt, Homo sapiens
gagugacgguugaagaauc

SEQ ID NO: 112813 - RNA, 19 nt, Homo sapiens
gcacagcaccgcagcuagu

SEQ ID NO: 112814 - RNA, 19 nt, Homo sapiens
ugagauaucaguauuugga

SEQ ID NO: 112815 - RNA, 19 nt, Homo sapiens
uagggaagaacuacauuaa

SEQ ID NO: 112816 - RNA, 19 nt, Homo sapiens
uaaacuggacuuaccuuga

SEQ ID NO: 112817 - RNA, 19 nt, Homo sapiens
ggagaucacacacuaagag

SEQ ID NO: 112818 - RNA, 19 nt, Homo sapiens
ucaauggaacgucuuuauu

SEQ ID NO: 112819 - RNA, 19 nt, Homo sapiens
ggguaguucuuuccauuuc

SEQ ID NO: 112820 - RNA, 19 nt, Homo sapiens
ucaacuaaauuggagaaug

SEQ ID NO: 112821 - RNA, 19 nt, Homo sapiens
ucaguagucaucucuguaa

SEQ ID NO: 112822 - RNA, 19 nt, Homo sapiens
ugaagccaauauucugauu

SEQ ID NO: 112823 - RNA, 19 nt, Homo sapiens
ugaaugaacuguccucuga

SEQ ID NO: 112824 - RNA, 19 nt, Homo sapiens
gaaggaacaccaccuagua

SEQ ID NO: 112825 - RNA, 19 nt, Homo sapiens
gcaggaagaagaaagaaua

SEQ ID NO: 112826 - RNA, 19 nt, Homo sapiens
ggacacgugugacccuuaa

SEQ ID NO: 112827 - RNA, 19 nt, Homo sapiens
cagggaagcugccaaagaa

SEQ ID NO: 112828 - RNA, 19 nt, Homo sapiens
uauaacagcuucuuugaca

SEQ ID NO: 112829 - RNA, 19 nt, Homo sapiens
gcacacagcaguucuuugu

SEQ ID NO: 112830 - RNA, 19 nt, Homo sapiens
ggaagaagaaagaauaugu

SEQ ID NO: 112831 - RNA, 19 nt, Homo sapiens
gaagaaggaacaccaccua

SEQ ID NO: 112832 - RNA, 19 nt, Homo sapiens
gagcuuacuuugaucuguu

SEQ ID NO: 112833 - RNA, 19 nt, Homo sapiens
ggauuaguguuugaaauug

SEQ ID NO: 112834 - RNA, 19 nt, Homo sapiens
uagaggaacuugaaaccuu

SEQ ID NO: 112835 - RNA, 19 nt, Homo sapiens
gcagcaguccuacuuauug

SEQ ID NO: 112836 - RNA, 19 nt, Homo sapiens
gaauaugucaaaugucuug

SEQ ID NO: 112837 - RNA, 19 nt, Homo sapiens
guuauucagucaucagaaa

SEQ ID NO: 112838 - RNA, 19 nt, Homo sapiens
acuaugaacugauuacaga

SEQ ID NO: 112839 - RNA, 19 nt, Homo sapiens
gaacaagaagcuuauagag

SEQ ID NO: 112840 - RNA, 19 nt, Homo sapiens
ccaacuagcauauaucaga

SEQ ID NO: 112841 - RNA, 19 nt, Homo sapiens
ggaacaccaccuaguauug

SEQ ID NO: 112842 - RNA, 19 nt, Homo sapiens
uuaccgagcuuacuuugau

SEQ ID NO: 112843 - RNA, 19 nt, Homo sapiens
cuggugacaugccaacuua

SEQ ID NO: 112844 - RNA, 19 nt, Homo sapiens
ccacagccauggguuauuc

SEQ ID NO: 112845 - RNA, 19 nt, Homo sapiens
caagaagcuuauagaggaa

SEQ ID NO: 112846 - RNA, 19 nt, Homo sapiens
gcagccagguuguuguuca

SEQ ID NO: 112847 - RNA, 19 nt, Homo sapiens
gaguaacugucuuugacuu

SEQ ID NO: 112848 - RNA, 19 nt, Homo sapiens
cagaagguguaauugauuc

SEQ ID NO: 112849 - RNA, 19 nt, Homo sapiens
gaauguuguuccaggaugu

SEQ ID NO: 112850 - RNA, 19 nt, Homo sapiens
aaacguagagaaauccuuu

SEQ ID NO: 112851 - RNA, 19 nt, Homo sapiens
aaauuucaaucccugcuuu

SEQ ID NO: 112852 - RNA, 19 nt, Homo sapiens
ucaaggcccucaaagaucu

SEQ ID NO: 112853 - RNA, 19 nt, Homo sapiens
ccagcaugauggaaguaua

SEQ ID NO: 112854 - RNA, 19 nt, Homo sapiens
gaacuugaaaccuugaaag

SEQ ID NO: 112855 - RNA, 19 nt, Homo sapiens
ucauaaacguagagaaauc

SEQ ID NO: 112856 - RNA, 19 nt, Homo sapiens
cuugaaaccuugaaagaca

SEQ ID NO: 112857 - RNA, 19 nt, Homo sapiens
uaaaguagaguaacugucu

SEQ ID NO: 112858 - RNA, 19 nt, Homo sapiens
gaagaagaaagaauauguc

SEQ ID NO: 112859 - RNA, 19 nt, Homo sapiens
agaaucagaagguguaauu

SEQ ID NO: 112860 - RNA, 19 nt, Homo sapiens
guccagaacaagaagcuua

SEQ ID NO: 112861 - RNA, 19 nt, Homo sapiens
ggaccuuguuuacucuaau

SEQ ID NO: 112862 - RNA, 19 nt, Homo sapiens
uaacagcuucuuugacaga

SEQ ID NO: 112863 - RNA, 19 nt, Homo sapiens
ggacugcaggcauuaacaa

SEQ ID NO: 112864 - RNA, 19 nt, Homo sapiens
gagaucagaggaagaagga

SEQ ID NO: 112865 - RNA, 19 nt, Homo sapiens
cagcaugauggaaguauaa

SEQ ID NO: 112866 - RNA, 19 nt, Homo sapiens
ggaagcugccaaagaaugu

SEQ ID NO: 112867 - RNA, 19 nt, Homo sapiens
gaucacacuuaccgagcuu

SEQ ID NO: 112868 - RNA, 19 nt, Homo sapiens
uagaguaacugucuuugac

SEQ ID NO: 112869 - RNA, 19 nt, Homo sapiens
guagaguaacugucuuuga

SEQ ID NO: 112870 - RNA, 19 nt, Homo sapiens
gcuuauagaggaacuugaa

SEQ ID NO: 112871 - RNA, 19 nt, Homo sapiens
gagcugaggcuaaugaaaa

SEQ ID NO: 112872 - RNA, 19 nt, Homo sapiens
gcaguaccaacuagcauau

SEQ ID NO: 112873 - RNA, 19 nt, Homo sapiens
gaugcagcaguccuacuua

SEQ ID NO: 112874 - RNA, 19 nt, Homo sapiens
aaacgagagcugaggcuaa

SEQ ID NO: 112875 - RNA, 19 nt, Homo sapiens
caagauugaagaagagaga

SEQ ID NO: 112876 - RNA, 19 nt, Homo sapiens
aaucagaagguguaauuga

SEQ ID NO: 112877 - RNA, 19 nt, Homo sapiens
gggccaaacuauacauguc

SEQ ID NO: 112878 - RNA, 19 nt, Homo sapiens
gggaagcugccaaagaaug

SEQ ID NO: 112879 - RNA, 19 nt, Homo sapiens
gaacucaaggcccucaaag

SEQ ID NO: 112880 - RNA, 19 nt, Homo sapiens
cgagagcugaggcuaauga

SEQ ID NO: 112881 - RNA, 19 nt, Homo sapiens
agaagaagcaacacgcaaa

SEQ ID NO: 112882 - RNA, 19 nt, Homo sapiens
cccaggaucugaugguguu

SEQ ID NO: 112883 - RNA, 19 nt, Homo sapiens
gagaucaggcaccagaaga

SEQ ID NO: 112884 - RNA, 19 nt, Homo sapiens
ggaacucaaggcccucaaa

SEQ ID NO: 112885 - RNA, 19 nt, Homo sapiens
gaacaccaccuaguauugc

SEQ ID NO: 112886 - RNA, 19 nt, Homo sapiens
ggaaaauacugaaugaacu

SEQ ID NO: 112887 - RNA, 19 nt, Homo sapiens
gaccuuguuuacucuaauc

SEQ ID NO: 112888 - RNA, 19 nt, Homo sapiens
ggcaguaccaacuagcaua

SEQ ID NO: 112889 - RNA, 19 nt, Homo sapiens
ucagaagguguaauugauu

SEQ ID NO: 112890 - RNA, 19 nt, Homo sapiens
ucagggaagcugccaaaga

SEQ ID NO: 112891 - RNA, 19 nt, Homo sapiens
ccaguuuggauuaguguuu

SEQ ID NO: 112892 - RNA, 19 nt, Homo sapiens
uaacugucuuugacuugga

SEQ ID NO: 112893 - RNA, 19 nt, Homo sapiens
gccauaaaguagaguaacu

SEQ ID NO: 112894 - RNA, 19 nt, Homo sapiens
gagcuccuacugcugcuuu

SEQ ID NO: 112895 - RNA, 19 nt, Homo sapiens
aaugaacuguccucugaug

SEQ ID NO: 112896 - RNA, 19 nt, Homo sapiens
gguguaauugauucucaua

SEQ ID NO: 112897 - RNA, 19 nt, Homo sapiens
gaagaagcaacacgcaaac

SEQ ID NO: 112898 - RNA, 19 nt, Homo sapiens
aguaccaacuagcauauau

SEQ ID NO: 112899 - RNA, 19 nt, Homo sapiens
gauggaaguauaacagcuu

SEQ ID NO: 112900 - RNA, 19 nt, Homo sapiens
gcaauugcagagacagaug

SEQ ID NO: 112901 - RNA, 19 nt, Homo sapiens
ggaacuugaaaccuugaaa

SEQ ID NO: 112902 - RNA, 19 nt, Homo sapiens
agaacaagaagcuuauaga

SEQ ID NO: 112903 - RNA, 19 nt, Homo sapiens
gagugucgcaggaagaaga

SEQ ID NO: 112904 - RNA, 19 nt, Homo sapiens
gaccauggaaacaguugaa

SEQ ID NO: 112905 - RNA, 19 nt, Homo sapiens
gacucagacugggcaaauu

SEQ ID NO: 112906 - RNA, 19 nt, Homo sapiens
caugccaacuuaccagauc

SEQ ID NO: 112907 - RNA, 19 nt, Homo sapiens
acaguacgcagcacaauca

SEQ ID NO: 112908 - RNA, 19 nt, Homo sapiens
agagagaucagaggaagaa

SEQ ID NO: 112909 - RNA, 19 nt, Homo sapiens
gccauggguuauucaguca

SEQ ID NO: 112910 - RNA, 19 nt, Homo sapiens
ugacuuggaccuuguuuac

SEQ ID NO: 112911 - RNA, 19 nt, Homo sapiens
gcagcuggcagaagaagca

SEQ ID NO: 112912 - RNA, 19 nt, Homo sapiens
gaguugcagugcuggaagu

SEQ ID NO: 112913 - RNA, 19 nt, Homo sapiens
gcagcgugaucacacuuac

SEQ ID NO: 112914 - RNA, 19 nt, Homo sapiens
gcucaugugcagacucaga

SEQ ID NO: 112915 - RNA, 19 nt, Homo sapiens
acucaaggcccucaaagau

SEQ ID NO: 112916 - RNA, 19 nt, Homo sapiens
acacuuaccgagcuuacuu

SEQ ID NO: 112917 - RNA, 19 nt, Homo sapiens
caguuuggauuaguguuug

SEQ ID NO: 112918 - RNA, 19 nt, Homo sapiens
acaccacagccauggguua

SEQ ID NO: 112919 - RNA, 19 nt, Homo sapiens
acucagacugggcaaauuu

SEQ ID NO: 112920 - RNA, 19 nt, Homo sapiens
cagccagguuguuguucaa

SEQ ID NO: 112921 - RNA, 19 nt, Homo sapiens
gaaucagaagguguaauug

SEQ ID NO: 112922 - RNA, 19 nt, Homo sapiens
caauugcagagacagauga

SEQ ID NO: 112923 - RNA, 19 nt, Homo sapiens
agaagucacucaauuguuu

SEQ ID NO: 112924 - RNA, 19 nt, Homo sapiens
agacagaagucacucaauu

SEQ ID NO: 112925 - RNA, 19 nt, Homo sapiens
gaagacaaccuccagagaa

SEQ ID NO: 112926 - RNA, 19 nt, Homo sapiens
guaagagaauguugaauac

SEQ ID NO: 112927 - RNA, 19 nt, Homo sapiens
ggaaacucauggagauuau

SEQ ID NO: 112928 - RNA, 19 nt, Homo sapiens
gcucuuaugccauuuguuu

SEQ ID NO: 112929 - RNA, 19 nt, Homo sapiens
gcgcugcucuuaugccauu

SEQ ID NO: 112930 - RNA, 19 nt, Homo sapiens
ggguaagacuaaaucugua

SEQ ID NO: 112931 - RNA, 19 nt, Homo sapiens
aagacaaccuccagagaaa

SEQ ID NO: 112932 - RNA, 19 nt, Homo sapiens
gagaccaaguccauugaga

SEQ ID NO: 112933 - RNA, 19 nt, Homo sapiens
gaaagagaggagagaaaga

SEQ ID NO: 112934 - RNA, 19 nt, Homo sapiens
ucaguuugguuguguaaga

SEQ ID NO: 112935 - RNA, 19 nt, Homo sapiens
cuaaaucuguaagcucuuu

SEQ ID NO: 112936 - RNA, 19 nt, Homo sapiens
gaauguagaccugugagaa

SEQ ID NO: 112937 - RNA, 19 nt, Homo sapiens
gaaucugcauuuagcacaa

SEQ ID NO: 112938 - RNA, 19 nt, Homo sapiens
ggucugagccaaagagaau

SEQ ID NO: 112939 - RNA, 19 nt, Homo sapiens
uaccauagcgcugcucuua

SEQ ID NO: 112940 - RNA, 19 nt, Homo sapiens
ggaagacaaccuccagaga

SEQ ID NO: 112941 - RNA, 19 nt, Homo sapiens
aaacaucuuuccaguccuu

SEQ ID NO: 112942 - RNA, 19 nt, Homo sapiens
acaggaaacucauggagau

SEQ ID NO: 112943 - RNA, 19 nt, Homo sapiens
gacagaagucacucaauug

SEQ ID NO: 112944 - RNA, 19 nt, Homo sapiens
aaagagagugggaacagua

SEQ ID NO: 112945 - RNA, 19 nt, Homo sapiens
gguaagacuaaaucuguaa

SEQ ID NO: 112946 - RNA, 19 nt, Homo sapiens
ggaaagagaggagagaaag

SEQ ID NO: 112947 - RNA, 19 nt, Homo sapiens
uguaagcucuuugaaacaa

SEQ ID NO: 112948 - RNA, 19 nt, Homo sapiens
ucuguaagcucuuugaaac

SEQ ID NO: 112949 - RNA, 19 nt, Homo sapiens
gaccaaguccauugagaga

SEQ ID NO: 112950 - RNA, 19 nt, Homo sapiens
aaagagaggagagaaagaa

SEQ ID NO: 112951 - RNA, 19 nt, Homo sapiens
gggaaagagaggagagaaa

SEQ ID NO: 112952 - RNA, 19 nt, Homo sapiens
gaacaguaaagagaaagga

SEQ ID NO: 112953 - RNA, 19 nt, Homo sapiens
gcagacagaagucacucaa

SEQ ID NO: 112954 - RNA, 19 nt, Homo sapiens
ucagagaccaaguccauug

SEQ ID NO: 112955 - RNA, 19 nt, Homo sapiens
cuuguaaacguuucaguaa

SEQ ID NO: 112956 - RNA, 19 nt, Homo sapiens
uuacuuagcaugcacaaag

SEQ ID NO: 112957 - RNA, 19 nt, Homo sapiens
aaacucauggagauuauug

SEQ ID NO: 112958 - RNA, 19 nt, Homo sapiens
ugggaacaguaaagagaaa

SEQ ID NO: 112959 - RNA, 19 nt, Homo sapiens
gaaacucauggagauuauu

SEQ ID NO: 112960 - RNA, 19 nt, Homo sapiens
guaaagagaaaggaagaca

SEQ ID NO: 112961 - RNA, 19 nt, Homo sapiens
uaaagagaaaggaagacaa

SEQ ID NO: 112962 - RNA, 19 nt, Homo sapiens
aggaaacucauggagauua

SEQ ID NO: 112963 - RNA, 19 nt, Homo sapiens
ggucaguuugguuguguaa

SEQ ID NO: 112964 - RNA, 19 nt, Homo sapiens
aauguagaccugugagaaa

SEQ ID NO: 112965 - RNA, 19 nt, Homo sapiens
gcaguuagcacagcaagcu

SEQ ID NO: 112966 - RNA, 19 nt, Homo sapiens
cgggaagucuuggaaaugg

SEQ ID NO: 112967 - RNA, 19 nt, Homo sapiens
gagagugggaacaguaaag

SEQ ID NO: 112968 - RNA, 19 nt, Homo sapiens
cagaagucacucaauuguu

SEQ ID NO: 112969 - RNA, 19 nt, Homo sapiens
acagaagucacucaauugu

SEQ ID NO: 112970 - RNA, 19 nt, Homo sapiens
uagcaugcacaaaguguau

SEQ ID NO: 112971 - RNA, 19 nt, Homo sapiens
aaaagaaucugcauuuagc

SEQ ID NO: 112972 - RNA, 19 nt, Homo sapiens
ccucagcccuuggauuucu

SEQ ID NO: 112973 - RNA, 19 nt, Homo sapiens
uggguaagacuaaaucugu

SEQ ID NO: 112974 - RNA, 19 nt, Homo sapiens
gagagggagagagccuaua

SEQ ID NO: 112975 - RNA, 19 nt, Homo sapiens
aaucugcauuuagcacaaa

SEQ ID NO: 112976 - RNA, 19 nt, Homo sapiens
cauggagauuauugggaaa

SEQ ID NO: 112977 - RNA, 19 nt, Homo sapiens
acccucagcccuuggauuu

SEQ ID NO: 112978 - RNA, 19 nt, Homo sapiens
gcaacaggaaacucaugga

SEQ ID NO: 112979 - RNA, 19 nt, Homo sapiens
cagagaccaaguccauuga

SEQ ID NO: 112980 - RNA, 19 nt, Homo sapiens
uccaguccuuggucaguuu

SEQ ID NO: 112981 - RNA, 19 nt, Homo sapiens
caguaaagagaaaggaaga

SEQ ID NO: 112982 - RNA, 19 nt, Homo sapiens
ggaggcaccggagagagaa

SEQ ID NO: 112983 - RNA, 19 nt, Homo sapiens
ucuuguaaacguuucagua

SEQ ID NO: 112984 - RNA, 19 nt, Homo sapiens
gcaugcacaaaguguauuc

SEQ ID NO: 112985 - RNA, 19 nt, Homo sapiens
aagagagugggaacaguaa

SEQ ID NO: 112986 - RNA, 19 nt, Homo sapiens
aaagagaaaggaagacaac

SEQ ID NO: 112987 - RNA, 19 nt, Homo sapiens
gcucacagcaacaggaaac

SEQ ID NO: 112988 - RNA, 19 nt, Homo sapiens
gcaugggagaggaguacuu

SEQ ID NO: 112989 - RNA, 19 nt, Homo sapiens
gugggaacaguaaagagaa

SEQ ID NO: 112990 - RNA, 19 nt, Homo sapiens
uaagcucuuugaaacaacu

SEQ ID NO: 112991 - RNA, 19 nt, Homo sapiens
ggauucacauuaaccauaa

SEQ ID NO: 112992 - RNA, 19 nt, Homo sapiens
caucagaucuucccagaau

SEQ ID NO: 112993 - RNA, 19 nt, Homo sapiens
cguaaauggucuucaguua

SEQ ID NO: 112994 - RNA, 19 nt, Homo sapiens
uaaccaacccagugauuua

SEQ ID NO: 112995 - RNA, 19 nt, Homo sapiens
guaaauggucuucaguuaa

SEQ ID NO: 112996 - RNA, 19 nt, Homo sapiens
gcugauagcuaagugaguu

SEQ ID NO: 112997 - RNA, 19 nt, Homo sapiens
gcugagcgguacauagauu

SEQ ID NO: 112998 - RNA, 19 nt, Homo sapiens
gguauuugaugguuggauu

SEQ ID NO: 112999 - RNA, 19 nt, Homo sapiens
gcacugcgcagccuucuuc

SEQ ID NO: 113000 - RNA, 19 nt, Homo sapiens
auacacacacgcauuauuu

SEQ ID NO: 113001 - RNA, 19 nt, Homo sapiens
gcacacaccacacacauac

SEQ ID NO: 113002 - RNA, 19 nt, Homo sapiens
caucgaaacugcagcuucu

SEQ ID NO: 113003 - RNA, 19 nt, Homo sapiens
cacauacacacacgcauua

SEQ ID NO: 113004 - RNA, 19 nt, Homo sapiens
aaacugcagcuucuccaua

SEQ ID NO: 113005 - RNA, 19 nt, Homo sapiens
ggaggagcaucagaucuuc

SEQ ID NO: 113006 - RNA, 19 nt, Homo sapiens
cagcugagcgguacauaga

SEQ ID NO: 113007 - RNA, 19 nt, Homo sapiens
ucacuucauucucaucuuc

SEQ ID NO: 113008 - RNA, 19 nt, Homo sapiens
gaacacauggcagaaaaua

SEQ ID NO: 113009 - RNA, 19 nt, Homo sapiens
gaugacgccuuuagcugau

SEQ ID NO: 113010 - RNA, 19 nt, Homo sapiens
gggaauaggagacuuugug

SEQ ID NO: 113011 - RNA, 19 nt, Homo sapiens
gcaugucgcccaacuucaa

SEQ ID NO: 113012 - RNA, 19 nt, Homo sapiens
aaaauaacccugauuggua

SEQ ID NO: 113013 - RNA, 19 nt, Homo sapiens
ugaauaaccaacccaguga

SEQ ID NO: 113014 - RNA, 19 nt, Homo sapiens
cuuccaagaugacgccuuu

SEQ ID NO: 113015 - RNA, 19 nt, Homo sapiens
gcagcuucuccauaauuua

SEQ ID NO: 113016 - RNA, 19 nt, Homo sapiens
aacugcagcuucuccauaa

SEQ ID NO: 113017 - RNA, 19 nt, Homo sapiens
caaaauaucugaucuuacc

SEQ ID NO: 113018 - RNA, 19 nt, Homo sapiens
caacuucaaacuucagugu

SEQ ID NO: 113019 - RNA, 19 nt, Homo sapiens
caaccucuuuccuugcaau

SEQ ID NO: 113020 - RNA, 19 nt, Homo sapiens
gaauguggccaugaucuuc

SEQ ID NO: 113021 - RNA, 19 nt, Homo sapiens
aaacccaaauggaaacagu

SEQ ID NO: 113022 - RNA, 19 nt, Homo sapiens
cauuaaccauaaagacaga

SEQ ID NO: 113023 - RNA, 19 nt, Homo sapiens
ggaaagccgguaccuagag

SEQ ID NO: 113024 - RNA, 19 nt, Homo sapiens
acacauacacacacgcauu

SEQ ID NO: 113025 - RNA, 19 nt, Homo sapiens
uuuacaugcugauagcuaa

SEQ ID NO: 113026 - RNA, 19 nt, Homo sapiens
ugcagcuucuccauaauuu

SEQ ID NO: 113027 - RNA, 19 nt, Homo sapiens
gaaaauaacccugauuggu

SEQ ID NO: 113028 - RNA, 19 nt, Homo sapiens
gaaacaguaucggggaauu

SEQ ID NO: 113029 - RNA, 19 nt, Homo sapiens
cgagggaauaggagacuuu

SEQ ID NO: 113030 - RNA, 19 nt, Homo sapiens
uggauucacauuaaccaua

SEQ ID NO: 113031 - RNA, 19 nt, Homo sapiens
uaaaucgugugacuuuuga

SEQ ID NO: 113032 - RNA, 19 nt, Homo sapiens
uaauuuauccuguggugau

SEQ ID NO: 113033 - RNA, 19 nt, Homo sapiens
gggaaagccgguaccuaga

SEQ ID NO: 113034 - RNA, 19 nt, Homo sapiens
ucagcgagcccgaggaguu

SEQ ID NO: 113035 - RNA, 19 nt, Homo sapiens
ucgcccaacuucaaacuuc

SEQ ID NO: 113036 - RNA, 19 nt, Homo sapiens
agaugaaaguuggcuguga

SEQ ID NO: 113037 - RNA, 19 nt, Homo sapiens
acacguaaauggucuucag

SEQ ID NO: 113038 - RNA, 19 nt, Homo sapiens
gcaggaggagcaucagauc

SEQ ID NO: 113039 - RNA, 19 nt, Homo sapiens
cagcaugucgcccaacuuc

SEQ ID NO: 113040 - RNA, 19 nt, Homo sapiens
ccgaggaguucauuaccau

SEQ ID NO: 113041 - RNA, 19 nt, Homo sapiens
cauacacacacgcauuauu

SEQ ID NO: 113042 - RNA, 19 nt, Homo sapiens
cuguuugucuggucuuuga

SEQ ID NO: 113043 - RNA, 19 nt, Homo sapiens
uacauagauuucugugaga

SEQ ID NO: 113044 - RNA, 19 nt, Homo sapiens
caagaugacgccuuuagcu

SEQ ID NO: 113045 - RNA, 19 nt, Homo sapiens
aagaaauccucagcagguu

SEQ ID NO: 113046 - RNA, 19 nt, Homo sapiens
cacauuaaccauaaagaca

SEQ ID NO: 113047 - RNA, 19 nt, Homo sapiens
uggccauuguguaugauuu

SEQ ID NO: 113048 - RNA, 19 nt, Homo sapiens
ccaacccagugauuuacau

SEQ ID NO: 113049 - RNA, 19 nt, Homo sapiens
acguaaaucgugugacuuu

SEQ ID NO: 113050 - RNA, 19 nt, Homo sapiens
ucauuaccauccacuacga

SEQ ID NO: 113051 - RNA, 19 nt, Homo sapiens
gaauaaccaacccagugau

SEQ ID NO: 113052 - RNA, 19 nt, Homo sapiens
gaaccaggaaauggauuca

SEQ ID NO: 113053 - RNA, 19 nt, Homo sapiens
ucagaucuucccagaaugu

SEQ ID NO: 113054 - RNA, 19 nt, Homo sapiens
cugaagguauuugaugguu

SEQ ID NO: 113055 - RNA, 19 nt, Homo sapiens
ccaaauggaaacaguaucg

SEQ ID NO: 113056 - RNA, 19 nt, Homo sapiens
uuugucuggucuuugaaua

SEQ ID NO: 113057 - RNA, 19 nt, Homo sapiens
gaaacugcagcuucuccau

SEQ ID NO: 113058 - RNA, 19 nt, Homo sapiens
uuugaugguuggauucuca

SEQ ID NO: 113059 - RNA, 19 nt, Homo sapiens
gagcccgaggaguucauua

SEQ ID NO: 113060 - RNA, 19 nt, Homo sapiens
uuugaugcacaacuaguua

SEQ ID NO: 113061 - RNA, 19 nt, Homo sapiens
gcgaggguguaggaaggaa

SEQ ID NO: 113062 - RNA, 19 nt, Homo sapiens
aauaaccaacccagugauu

SEQ ID NO: 113063 - RNA, 19 nt, Homo sapiens
cccagaauguggccaugau

SEQ ID NO: 113064 - RNA, 19 nt, Homo sapiens
ugauuuacaugcugauagc

SEQ ID NO: 113065 - RNA, 19 nt, Homo sapiens
guaaaucgugugacuuuug

SEQ ID NO: 113066 - RNA, 19 nt, Homo sapiens
acuucaaacuucaguguca

SEQ ID NO: 113067 - RNA, 19 nt, Homo sapiens
ccucuuuccuugcaauguc

SEQ ID NO: 113068 - RNA, 19 nt, Homo sapiens
gauccuuuccugcucuuca

SEQ ID NO: 113069 - RNA, 19 nt, Homo sapiens
gcgcagccuucuucaucag

SEQ ID NO: 113070 - RNA, 19 nt, Homo sapiens
gagggaauaggagacuuug

SEQ ID NO: 113071 - RNA, 19 nt, Homo sapiens
cugcagcuucuccauaauu

SEQ ID NO: 113072 - RNA, 19 nt, Homo sapiens
ccaggucuccaucgacugu

SEQ ID NO: 113073 - RNA, 19 nt, Homo sapiens
ucauuucucagacuccaaa

SEQ ID NO: 113074 - RNA, 19 nt, Homo sapiens
caacccagugauuuacaug

SEQ ID NO: 113075 - RNA, 19 nt, Homo sapiens
accaggaaauggauucaca

SEQ ID NO: 113076 - RNA, 19 nt, Homo sapiens
gaagucaggugucaucauc

SEQ ID NO: 113077 - RNA, 19 nt, Homo sapiens
gcaggacucuagcucauga

SEQ ID NO: 113078 - RNA, 19 nt, Homo sapiens
gaagggacaugggaaugaa

SEQ ID NO: 113079 - RNA, 19 nt, Homo sapiens
gcggguggcugguauaaau

SEQ ID NO: 113080 - RNA, 19 nt, Homo sapiens
gcucaugaguggaaaguca

SEQ ID NO: 113081 - RNA, 19 nt, Homo sapiens
gcugaucaauuucaucuuc

SEQ ID NO: 113082 - RNA, 19 nt, Homo sapiens
ccacugaccugcccauguc

SEQ ID NO: 113083 - RNA, 19 nt, Homo sapiens
ggacaugggaaugaauuga

SEQ ID NO: 113084 - RNA, 19 nt, Homo sapiens
aaugagaagugcugguuug

SEQ ID NO: 113085 - RNA, 19 nt, Homo sapiens
gggcaggaccacuagcuaa

SEQ ID NO: 113086 - RNA, 19 nt, Homo sapiens
ugacagccgccuacaacua

SEQ ID NO: 113087 - RNA, 19 nt, Homo sapiens
gcaaggugcacuaccaugu

SEQ ID NO: 113088 - RNA, 19 nt, Homo sapiens
guucuacuguuuccucaau

SEQ ID NO: 113089 - RNA, 19 nt, Homo sapiens
ucaccuacaugcuguucuu

SEQ ID NO: 113090 - RNA, 19 nt, Homo sapiens
uaugguguccgcuacaaua

SEQ ID NO: 113091 - RNA, 19 nt, Homo sapiens
gaagaccccugcccaagug

SEQ ID NO: 113092 - RNA, 19 nt, Homo sapiens
acaugggaaugaauugaaa

SEQ ID NO: 113093 - RNA, 19 nt, Homo sapiens
gggcauccaccacgucuga

SEQ ID NO: 113094 - RNA, 19 nt, Homo sapiens
gaagcuguacuacgacaau

SEQ ID NO: 113095 - RNA, 19 nt, Homo sapiens
uacaacuacuuccauguga

SEQ ID NO: 113096 - RNA, 19 nt, Homo sapiens
ucgcagucaucaucaacua

SEQ ID NO: 113097 - RNA, 19 nt, Homo sapiens
gcuacaauaccacaaacaa

SEQ ID NO: 113098 - RNA, 19 nt, Homo sapiens
cgacaccacugggaaccaa

SEQ ID NO: 113099 - RNA, 19 nt, Homo sapiens
ggagaagggacaugggaau

SEQ ID NO: 113100 - RNA, 19 nt, Homo sapiens
uacaauaccacaaacaaug

SEQ ID NO: 113101 - RNA, 19 nt, Homo sapiens
gacaugggaaugaauugaa

SEQ ID NO: 113102 - RNA, 19 nt, Homo sapiens
gcaguccacagcagucuga

SEQ ID NO: 113103 - RNA, 19 nt, Homo sapiens
ugucuguguucuacuguuu

SEQ ID NO: 113104 - RNA, 19 nt, Homo sapiens
guacaccgacuacaucuac

SEQ ID NO: 113105 - RNA, 19 nt, Homo sapiens
aaagcaaggugcacuacca

SEQ ID NO: 113106 - RNA, 19 nt, Homo sapiens
ggccacagcacuagaguca

SEQ ID NO: 113107 - RNA, 19 nt, Homo sapiens
uugggaagcuguacuacga

SEQ ID NO: 113108 - RNA, 19 nt, Homo sapiens
gguggccuuuguccucuuu

SEQ ID NO: 113109 - RNA, 19 nt, Homo sapiens
cagaguggccugugagcaa

SEQ ID NO: 113110 - RNA, 19 nt, Homo sapiens
ggugucaucaucagacuug

SEQ ID NO: 113111 - RNA, 19 nt, Homo sapiens
uuccagggcuucuuugugu

SEQ ID NO: 113112 - RNA, 19 nt, Homo sapiens
gcagcuccgucucgucaag

SEQ ID NO: 113113 - RNA, 19 nt, Homo sapiens
gugcaggacucuagcucau

SEQ ID NO: 113114 - RNA, 19 nt, Homo sapiens
gcaaaaggccuggggugua

SEQ ID NO: 113115 - RNA, 19 nt, Homo sapiens
guacuacgacaaugagaag

SEQ ID NO: 113116 - RNA, 19 nt, Homo sapiens
ugaccaacuucuucuggau

SEQ ID NO: 113117 - RNA, 19 nt, Homo sapiens
gcuaagcaagccaggagaa

SEQ ID NO: 113118 - RNA, 19 nt, Homo sapiens
ccaggccuccagaaccuua

SEQ ID NO: 113119 - RNA, 19 nt, Homo sapiens
cgugacagccucugacuca

SEQ ID NO: 113120 - RNA, 19 nt, Homo sapiens
gagaagggacaugggaaug

SEQ ID NO: 113121 - RNA, 19 nt, Homo sapiens
ggguggcugguauaaauaa

SEQ ID NO: 113122 - RNA, 19 nt, Homo sapiens
gggacaacgugcugcuuac

SEQ ID NO: 113123 - RNA, 19 nt, Homo sapiens
ugggacaacgugcugcuua

SEQ ID NO: 113124 - RNA, 19 nt, Homo sapiens
acuguuuccucaauaguga

SEQ ID NO: 113125 - RNA, 19 nt, Homo sapiens
cuacaacuacuuccaugug

SEQ ID NO: 113126 - RNA, 19 nt, Homo sapiens
caaugagaagugcugguuu

SEQ ID NO: 113127 - RNA, 19 nt, Homo sapiens
ccauugggaagcuguacua

SEQ ID NO: 113128 - RNA, 19 nt, Homo sapiens
guggcugguauaaauaaua

SEQ ID NO: 113129 - RNA, 19 nt, Homo sapiens
ugaggcggguggcugguau

SEQ ID NO: 113130 - RNA, 19 nt, Homo sapiens
cuacaauaccacaaacaau

SEQ ID NO: 113131 - RNA, 19 nt, Homo sapiens
ggugacagccgccuacaac

SEQ ID NO: 113132 - RNA, 19 nt, Homo sapiens
uaagcaagccaggagaaga

SEQ ID NO: 113133 - RNA, 19 nt, Homo sapiens
gguguccgcuacaauacca

SEQ ID NO: 113134 - RNA, 19 nt, Homo sapiens
cccaacccgugucagcuuu

SEQ ID NO: 113135 - RNA, 19 nt, Homo sapiens
ggacaacgugcugcuuaca

SEQ ID NO: 113136 - RNA, 19 nt, Homo sapiens
caggaccacuagcuaagca

SEQ ID NO: 113137 - RNA, 19 nt, Homo sapiens
agaagggacaugggaauga

SEQ ID NO: 113138 - RNA, 19 nt, Homo sapiens
gacagccgccuacaacuac

SEQ ID NO: 113139 - RNA, 19 nt, Homo sapiens
caacccgugucagcuuuca

SEQ ID NO: 113140 - RNA, 19 nt, Homo sapiens
caacuucuucuggauguuc

SEQ ID NO: 113141 - RNA, 19 nt, Homo sapiens
ccucaucuccgccuucauc

SEQ ID NO: 113142 - RNA, 19 nt, Homo sapiens
gguggcugguauaaauaau

SEQ ID NO: 113143 - RNA, 19 nt, Homo sapiens
ugguccugcugaucaauuu

SEQ ID NO: 113144 - RNA, 19 nt, Homo sapiens
caaaaggccugggguguac

SEQ ID NO: 113145 - RNA, 19 nt, Homo sapiens
acaaugagaagugcugguu

SEQ ID NO: 113146 - RNA, 19 nt, Homo sapiens
acaacgugcugcuuacacu

SEQ ID NO: 113147 - RNA, 19 nt, Homo sapiens
cagccaucgugcucaccua

SEQ ID NO: 113148 - RNA, 19 nt, Homo sapiens
ucacccugaacauuuagua

SEQ ID NO: 113149 - RNA, 19 nt, Homo sapiens
ucuacuguuuccucaauag

SEQ ID NO: 113150 - RNA, 19 nt, Homo sapiens
ucaucuacuucaacuccuu

SEQ ID NO: 113151 - RNA, 19 nt, Homo sapiens
gcauccaccacgucugaga

SEQ ID NO: 113152 - RNA, 19 nt, Homo sapiens
gaucaauuucaucuuccuu

SEQ ID NO: 113153 - RNA, 19 nt, Homo sapiens
caaggugcacuaccauguc

SEQ ID NO: 113154 - RNA, 19 nt, Homo sapiens
ccaugucgcagucaucauc

SEQ ID NO: 113155 - RNA, 19 nt, Homo sapiens
ccaugugaccaacuucuuc

SEQ ID NO: 113156 - RNA, 19 nt, Homo sapiens
caacacacacagcuauuua

SEQ ID NO: 113157 - RNA, 19 nt, Homo sapiens
aaacaucucugcucucugu

SEQ ID NO: 113158 - RNA, 19 nt, Homo sapiens
gagaagagccagucagaug

SEQ ID NO: 113159 - RNA, 19 nt, Homo sapiens
ccugaucaauuucguauuu

SEQ ID NO: 113160 - RNA, 19 nt, Homo sapiens
gcaagugccucuuccucuu

SEQ ID NO: 113161 - RNA, 19 nt, Homo sapiens
caccaugucuucagugauu

SEQ ID NO: 113162 - RNA, 19 nt, Homo sapiens
gaagccacauccuuaguca

SEQ ID NO: 113163 - RNA, 19 nt, Homo sapiens
gaaccaccaugucuucagu

SEQ ID NO: 113164 - RNA, 19 nt, Homo sapiens
ucggcaagcucuacuauga

SEQ ID NO: 113165 - RNA, 19 nt, Homo sapiens
ggaaguaugaccugcacua

SEQ ID NO: 113166 - RNA, 19 nt, Homo sapiens
gagaaugcuuggagaaugg

SEQ ID NO: 113167 - RNA, 19 nt, Homo sapiens
cuagagaggcucacuugua

SEQ ID NO: 113168 - RNA, 19 nt, Homo sapiens
cagggaagccacauccuua

SEQ ID NO: 113169 - RNA, 19 nt, Homo sapiens
gaaugaacagugcugguuu

SEQ ID NO: 113170 - RNA, 19 nt, Homo sapiens
gcacacggccauugucaug

SEQ ID NO: 113171 - RNA, 19 nt, Homo sapiens
ccucaaagaucaacuacuc

SEQ ID NO: 113172 - RNA, 19 nt, Homo sapiens
ggcaagcucuacuaugaga

SEQ ID NO: 113173 - RNA, 19 nt, Homo sapiens
ucaccaccaucuucaacua

SEQ ID NO: 113174 - RNA, 19 nt, Homo sapiens
ggacgugggccucaaagau

SEQ ID NO: 113175 - RNA, 19 nt, Homo sapiens
gcagcucguugaccaugaa

SEQ ID NO: 113176 - RNA, 19 nt, Homo sapiens
gaucaacuacucacagugu

SEQ ID NO: 113177 - RNA, 19 nt, Homo sapiens
cgagaaugcuuggagaaug

SEQ ID NO: 113178 - RNA, 19 nt, Homo sapiens
gaaauaaaccaugccucuu

SEQ ID NO: 113179 - RNA, 19 nt, Homo sapiens
gcagaaccaccaugucuuc

SEQ ID NO: 113180 - RNA, 19 nt, Homo sapiens
uagagaggcucacuuguac

SEQ ID NO: 113181 - RNA, 19 nt, Homo sapiens
acacacacagcuauuuaua

SEQ ID NO: 113182 - RNA, 19 nt, Homo sapiens
gauccuaaugacaaaguua

SEQ ID NO: 113183 - RNA, 19 nt, Homo sapiens
aaauaaaccaugccucuug

SEQ ID NO: 113184 - RNA, 19 nt, Homo sapiens
ccaagcaaaggaucaguuu

SEQ ID NO: 113185 - RNA, 19 nt, Homo sapiens
gcucuacuaugagaaugaa

SEQ ID NO: 113186 - RNA, 19 nt, Homo sapiens
ucaccuacaugcucuucuu

SEQ ID NO: 113187 - RNA, 19 nt, Homo sapiens
cggaaugccuaucgagaau

SEQ ID NO: 113188 - RNA, 19 nt, Homo sapiens
ucaggauccuaaugacaaa

SEQ ID NO: 113189 - RNA, 19 nt, Homo sapiens
gaagugcacgagagcaaug

SEQ ID NO: 113190 - RNA, 19 nt, Homo sapiens
acaagcagaggaaguauga

SEQ ID NO: 113191 - RNA, 19 nt, Homo sapiens
gaaugccuaucgagaaugc

SEQ ID NO: 113192 - RNA, 19 nt, Homo sapiens
caacuucuucuggauguuu

SEQ ID NO: 113193 - RNA, 19 nt, Homo sapiens
agaaacaucucugcucucu

SEQ ID NO: 113194 - RNA, 19 nt, Homo sapiens
gaucaguuuggcugccuua

SEQ ID NO: 113195 - RNA, 19 nt, Homo sapiens
gaucauguucaucuauuuc

SEQ ID NO: 113196 - RNA, 19 nt, Homo sapiens
ucaacggcgucaaguacaa

SEQ ID NO: 113197 - RNA, 19 nt, Homo sapiens
caucucugcucucugugaa

SEQ ID NO: 113198 - RNA, 19 nt, Homo sapiens
gaaccucaucaccaccuuu

SEQ ID NO: 113199 - RNA, 19 nt, Homo sapiens
ccaacacacacagcuauuu

SEQ ID NO: 113200 - RNA, 19 nt, Homo sapiens
cauccgagacaauccagua

SEQ ID NO: 113201 - RNA, 19 nt, Homo sapiens
ucugcucucugugaaauaa

SEQ ID NO: 113202 - RNA, 19 nt, Homo sapiens
ugucacagaucauguucau

SEQ ID NO: 113203 - RNA, 19 nt, Homo sapiens
aaugaacagugcugguuug

SEQ ID NO: 113204 - RNA, 19 nt, Homo sapiens
gaagagccagucagauguc

SEQ ID NO: 113205 - RNA, 19 nt, Homo sapiens
ccaccuuuauccugcgaaa

SEQ ID NO: 113206 - RNA, 19 nt, Homo sapiens
gcaucgcccuugucgucaa

SEQ ID NO: 113207 - RNA, 19 nt, Homo sapiens
ggaagccacauccuuaguc

SEQ ID NO: 113208 - RNA, 19 nt, Homo sapiens
ugcgaaaugucaugugguu

SEQ ID NO: 113209 - RNA, 19 nt, Homo sapiens
gcaguuggguggguuaacg

SEQ ID NO: 113210 - RNA, 19 nt, Homo sapiens
ggauccuaaugacaaaguu

SEQ ID NO: 113211 - RNA, 19 nt, Homo sapiens
caacaucgucaggauccua

SEQ ID NO: 113212 - RNA, 19 nt, Homo sapiens
ugaccaacuucuucuggau

SEQ ID NO: 113213 - RNA, 19 nt, Homo sapiens
cugccuaguccacagauua

SEQ ID NO: 113214 - RNA, 19 nt, Homo sapiens
ggccuggcuuccucucuug

SEQ ID NO: 113215 - RNA, 19 nt, Homo sapiens
ucagugauugaaacucaua

SEQ ID NO: 113216 - RNA, 19 nt, Homo sapiens
gacgugggccucaaagauc

SEQ ID NO: 113217 - RNA, 19 nt, Homo sapiens
ccacauccuuagucaacca

SEQ ID NO: 113218 - RNA, 19 nt, Homo sapiens
aagaucaacuacucacagu

SEQ ID NO: 113219 - RNA, 19 nt, Homo sapiens
ccagggcugucaccuagag

SEQ ID NO: 113220 - RNA, 19 nt, Homo sapiens
agaggaagcagagggaauu

SEQ ID NO: 113221 - RNA, 19 nt, Homo sapiens
caagcucuacuaugagaau

SEQ ID NO: 113222 - RNA, 19 nt, Homo sapiens
guacaacacgacccggaau

SEQ ID NO: 113223 - RNA, 19 nt, Homo sapiens
ggaaccucaucaccaccuu

SEQ ID NO: 113224 - RNA, 19 nt, Homo sapiens
guacuucaacggcgucaag

SEQ ID NO: 113225 - RNA, 19 nt, Homo sapiens
cuucgugucugucuucuac

SEQ ID NO: 113226 - RNA, 19 nt, Homo sapiens
guacaggaaggcagugaag

SEQ ID NO: 113227 - RNA, 19 nt, Homo sapiens
gcucguugaccaugaagug

SEQ ID NO: 113228 - RNA, 19 nt, Homo sapiens
ucucugcucucugugaaau

SEQ ID NO: 113229 - RNA, 19 nt, Homo sapiens
uagcagaaccaccaugucu

SEQ ID NO: 113230 - RNA, 19 nt, Homo sapiens
cauccuuagucaaccaguu

SEQ ID NO: 113231 - RNA, 19 nt, Homo sapiens
caauuucguauuucuguuc

SEQ ID NO: 113232 - RNA, 19 nt, Homo sapiens
ccaccaucuucaacuacuu

SEQ ID NO: 113233 - RNA, 19 nt, Homo sapiens
caguuuggcugccuuaucc

SEQ ID NO: 113234 - RNA, 19 nt, Homo sapiens
gaagcagagggaauucaca

SEQ ID NO: 113235 - RNA, 19 nt, Homo sapiens
agacaauccaguacaggaa

SEQ ID NO: 113236 - RNA, 19 nt, Homo sapiens
aaccucaucaccaccuuua

SEQ ID NO: 113237 - RNA, 19 nt, Homo sapiens
gaaguaugaccugcacuac

SEQ ID NO: 113238 - RNA, 19 nt, Homo sapiens
ugcagucguuccaggguuu

SEQ ID NO: 113239 - RNA, 19 nt, Homo sapiens
ccggaaugccuaucgagaa

SEQ ID NO: 113240 - RNA, 19 nt, Homo sapiens
cuggcgaccugguggacua

SEQ ID NO: 113241 - RNA, 19 nt, Homo sapiens
gggccucaaagaucaacua

SEQ ID NO: 113242 - RNA, 19 nt, Homo sapiens
agaaugaacagugcugguu

SEQ ID NO: 113243 - RNA, 19 nt, Homo sapiens
caagugccucuuccucuuc

SEQ ID NO: 113244 - RNA, 19 nt, Homo sapiens
gcaagggacagggaugagu

SEQ ID NO: 113245 - RNA, 19 nt, Homo sapiens
gacaagcagaggaaguaug

SEQ ID NO: 113246 - RNA, 19 nt, Homo sapiens
ucaucuauuucaacuccuu

SEQ ID NO: 113247 - RNA, 19 nt, Homo sapiens
gaucaauuucguauuucug

SEQ ID NO: 113248 - RNA, 19 nt, Homo sapiens
ucgugcuccugaucaauuu

SEQ ID NO: 113249 - RNA, 19 nt, Homo sapiens
gccaagcaaaggaucaguu

SEQ ID NO: 113250 - RNA, 19 nt, Homo sapiens
agaagagccagucagaugu

SEQ ID NO: 113251 - RNA, 19 nt, Homo sapiens
gaaaugucaugugguuccu

SEQ ID NO: 113252 - RNA, 19 nt, Homo sapiens
ucagggaagccacauccuu

SEQ ID NO: 113253 - RNA, 19 nt, Homo sapiens
gacccggaaugccuaucga

SEQ ID NO: 113254 - RNA, 19 nt, Homo sapiens
caucggcaagcucuacuau

SEQ ID NO: 113255 - RNA, 19 nt, Homo sapiens
gaugacaagcagaggaagu

SEQ ID NO: 113256 - RNA, 19 nt, Homo sapiens
caguaaaccugaacacuug

SEQ ID NO: 113257 - RNA, 19 nt, Homo sapiens
gcaacaaggagguguacuu

SEQ ID NO: 113258 - RNA, 19 nt, Homo sapiens
gagccgagagccacacuuu

SEQ ID NO: 113259 - RNA, 19 nt, Homo sapiens
gcaaaugccaggccuuguc

SEQ ID NO: 113260 - RNA, 19 nt, Homo sapiens
caacaaggagguguacuuc

SEQ ID NO: 113261 - RNA, 19 nt, Homo sapiens
ccaagugucccaagugcaa

SEQ ID NO: 113262 - RNA, 19 nt, Homo sapiens
caucggcccugccugaagu

SEQ ID NO: 113263 - RNA, 19 nt, Homo sapiens
gccgagagccacacuuuca

SEQ ID NO: 113264 - RNA, 19 nt, Homo sapiens
gggccacuguccaggcaaa

SEQ ID NO: 113265 - RNA, 19 nt, Homo sapiens
ugaccucucugggcaagga

SEQ ID NO: 113266 - RNA, 19 nt, Homo sapiens
cccuaaugcucucaguaaa

SEQ ID NO: 113267 - RNA, 19 nt, Homo sapiens
gggaaggacuggcacaagu

SEQ ID NO: 113268 - RNA, 19 nt, Homo sapiens
gcuccuacaucuacgagaa

SEQ ID NO: 113269 - RNA, 19 nt, Homo sapiens
cacaagcccugcuauggaa

SEQ ID NO: 113270 - RNA, 19 nt, Homo sapiens
ggaaggacuggcacaaguu

SEQ ID NO: 113271 - RNA, 19 nt, Homo sapiens
caugaucccuucugugucu

SEQ ID NO: 113272 - RNA, 19 nt, Homo sapiens
gaccauggccuccaaaugc

SEQ ID NO: 113273 - RNA, 19 nt, Homo sapiens
cagcggcucucaugaugug

SEQ ID NO: 113274 - RNA, 19 nt, Homo sapiens
ccacaagcccugcuaugga

SEQ ID NO: 113275 - RNA, 19 nt, Homo sapiens
gcagcaagaagguguacuu

SEQ ID NO: 113276 - RNA, 19 nt, Homo sapiens
gccuugugcugucaauaaa

SEQ ID NO: 113277 - RNA, 19 nt, Homo sapiens
ccacccaccugccaguguu

SEQ ID NO: 113278 - RNA, 19 nt, Homo sapiens
ugacgucucugggcaagga

SEQ ID NO: 113279 - RNA, 19 nt, Homo sapiens
gaaggacuggcacaaguuc

SEQ ID NO: 113280 - RNA, 19 nt, Homo sapiens
cgacaagaccguguacuuc

SEQ ID NO: 113281 - RNA, 19 nt, Homo sapiens
gcgacaagaccguguacuu

SEQ ID NO: 113282 - RNA, 19 nt, Homo sapiens
gcacaaguucugccucaag

SEQ ID NO: 113283 - RNA, 19 nt, Homo sapiens
uacagcggcucucaugaug

SEQ ID NO: 113284 - RNA, 19 nt, Homo sapiens
caccugccaguguuauuua

SEQ ID NO: 113285 - RNA, 19 nt, Homo sapiens
ggaagccguucugccacaa

SEQ ID NO: 113286 - RNA, 19 nt, Homo sapiens
ccaccugccaguguuauuu

SEQ ID NO: 113287 - RNA, 19 nt, Homo sapiens
gugggcagcuacaucuaug

SEQ ID NO: 113288 - RNA, 19 nt, Homo sapiens
ugcgagcgcugcagcaaga

SEQ ID NO: 113289 - RNA, 19 nt, Homo sapiens
cacaaguucugccucaagu

SEQ ID NO: 113290 - RNA, 19 nt, Homo sapiens
ccgagucucuggugugucu

SEQ ID NO: 113291 - RNA, 19 nt, Homo sapiens
cuacagcggcucucaugau

SEQ ID NO: 113292 - RNA, 19 nt, Homo sapiens
ggugggcagcuacaucuau

SEQ ID NO: 113293 - RNA, 19 nt, Homo sapiens
cccaugaucccuucugugu

SEQ ID NO: 113294 - RNA, 19 nt, Homo sapiens
cgaccauggccuccaaaug

SEQ ID NO: 113295 - RNA, 19 nt, Homo sapiens
gugcuacgccacccuguuc

SEQ ID NO: 113296 - RNA, 19 nt, Homo sapiens
caccgaccauggccuccaa

SEQ ID NO: 113297 - RNA, 19 nt, Homo sapiens
gaguauaguucaacaguuu

SEQ ID NO: 113298 - RNA, 19 nt, Homo sapiens
gaagagcagugguggaaug

SEQ ID NO: 113299 - RNA, 19 nt, Homo sapiens
aauaggagaucaagaguuu

SEQ ID NO: 113300 - RNA, 19 nt, Homo sapiens
gaaaggagacaucuugaga

SEQ ID NO: 113301 - RNA, 19 nt, Homo sapiens
uguguuagcuucugaauug

SEQ ID NO: 113302 - RNA, 19 nt, Homo sapiens
caggauugcuuucauugua

SEQ ID NO: 113303 - RNA, 19 nt, Homo sapiens
cuggagggcuuguguguua

SEQ ID NO: 113304 - RNA, 19 nt, Homo sapiens
caacugccaucuauacaau

SEQ ID NO: 113305 - RNA, 19 nt, Homo sapiens
agacugaacugcuccauuc

SEQ ID NO: 113306 - RNA, 19 nt, Homo sapiens
ggagacaucuugagaaucc

SEQ ID NO: 113307 - RNA, 19 nt, Homo sapiens
ggaggucggugagcuggua

SEQ ID NO: 113308 - RNA, 19 nt, Homo sapiens
gcaaaucacccuguggaaa

SEQ ID NO: 113309 - RNA, 19 nt, Homo sapiens
ucuguuaccugugauauuu

SEQ ID NO: 113310 - RNA, 19 nt, Homo sapiens
gaaaaccgauggacaggaa

SEQ ID NO: 113311 - RNA, 19 nt, Homo sapiens
ggacuucagcugaguauag

SEQ ID NO: 113312 - RNA, 19 nt, Homo sapiens
ggacagcgaaggcaagaga

SEQ ID NO: 113313 - RNA, 19 nt, Homo sapiens
ggaaccauacuaucaaaug

SEQ ID NO: 113314 - RNA, 19 nt, Homo sapiens
cgaggucacuucccauuca

SEQ ID NO: 113315 - RNA, 19 nt, Homo sapiens
gcaggguaguggagugauu

SEQ ID NO: 113316 - RNA, 19 nt, Homo sapiens
caaaagcagucuaguuuau

SEQ ID NO: 113317 - RNA, 19 nt, Homo sapiens
ucccuuacgucgagaagua

SEQ ID NO: 113318 - RNA, 19 nt, Homo sapiens
gaauaggagaucaagaguu

SEQ ID NO: 113319 - RNA, 19 nt, Homo sapiens
uaaugggaaugaugaggaa

SEQ ID NO: 113320 - RNA, 19 nt, Homo sapiens
aaggagacaucuugagaau

SEQ ID NO: 113321 - RNA, 19 nt, Homo sapiens
gaacugcuccauuccuagu

SEQ ID NO: 113322 - RNA, 19 nt, Homo sapiens
gcugacagaugggaacaau

SEQ ID NO: 113323 - RNA, 19 nt, Homo sapiens
ggugagcugguaaagguua

SEQ ID NO: 113324 - RNA, 19 nt, Homo sapiens
ggaaugaugaggaagaucu

SEQ ID NO: 113325 - RNA, 19 nt, Homo sapiens
ggauugcuuucauuguaug

SEQ ID NO: 113326 - RNA, 19 nt, Homo sapiens
cgagcccucuuugacuuua

SEQ ID NO: 113327 - RNA, 19 nt, Homo sapiens
uaucuugccuccuuucucu

SEQ ID NO: 113328 - RNA, 19 nt, Homo sapiens
auagguaucuugccuccuu

SEQ ID NO: 113329 - RNA, 19 nt, Homo sapiens
ggaugauuccagucccuua

SEQ ID NO: 113330 - RNA, 19 nt, Homo sapiens
cugcuuacccugauuuauu

SEQ ID NO: 113331 - RNA, 19 nt, Homo sapiens
ccauuccuagucuuaauua

SEQ ID NO: 113332 - RNA, 19 nt, Homo sapiens
ucggugagcugguaaaggu

SEQ ID NO: 113333 - RNA, 19 nt, Homo sapiens
ggcaagagagggaugauuc

SEQ ID NO: 113334 - RNA, 19 nt, Homo sapiens
guaaucaugcaccguguga

SEQ ID NO: 113335 - RNA, 19 nt, Homo sapiens
gcagucuaguuuauauaag

SEQ ID NO: 113336 - RNA, 19 nt, Homo sapiens
ugaguauaguucaacaguu

SEQ ID NO: 113337 - RNA, 19 nt, Homo sapiens
gaaccaguuuccagaucca

SEQ ID NO: 113338 - RNA, 19 nt, Homo sapiens
gagcgugaccaggguauga

SEQ ID NO: 113339 - RNA, 19 nt, Homo sapiens
cugaacugcuccauuccua

SEQ ID NO: 113340 - RNA, 19 nt, Homo sapiens
gacauucagauccuaagaa

SEQ ID NO: 113341 - RNA, 19 nt, Homo sapiens
caaaucacccuguggaaaa

SEQ ID NO: 113342 - RNA, 19 nt, Homo sapiens
acugccaucuauacaauuu

SEQ ID NO: 113343 - RNA, 19 nt, Homo sapiens
gagcccucuuugacuuuaa

SEQ ID NO: 113344 - RNA, 19 nt, Homo sapiens
ggacacuacaacguugaua

SEQ ID NO: 113345 - RNA, 19 nt, Homo sapiens
cugcuuuacuggaauucua

SEQ ID NO: 113346 - RNA, 19 nt, Homo sapiens
gaaggcaagagagggauga

SEQ ID NO: 113347 - RNA, 19 nt, Homo sapiens
gguaguggagugauucuca

SEQ ID NO: 113348 - RNA, 19 nt, Homo sapiens
gugccuguguguaucagaa

SEQ ID NO: 113349 - RNA, 19 nt, Homo sapiens
gcaauuggaggcgguagug

SEQ ID NO: 113350 - RNA, 19 nt, Homo sapiens
gaaucccgaugaggacuuc

SEQ ID NO: 113351 - RNA, 19 nt, Homo sapiens
aaaggagacaucuugagaa

SEQ ID NO: 113352 - RNA, 19 nt, Homo sapiens
uagaaccaguuuccagauc

SEQ ID NO: 113353 - RNA, 19 nt, Homo sapiens
acacacugcuuacccugau

SEQ ID NO: 113354 - RNA, 19 nt, Homo sapiens
ccaacugccaucuauacaa

SEQ ID NO: 113355 - RNA, 19 nt, Homo sapiens
gcaggauugcuuucauugu

SEQ ID NO: 113356 - RNA, 19 nt, Homo sapiens
gucaaaagcagucuaguuu

SEQ ID NO: 113357 - RNA, 19 nt, Homo sapiens
gacuucagcugaguauagu

SEQ ID NO: 113358 - RNA, 19 nt, Homo sapiens
guuacgaagauuaauguga

SEQ ID NO: 113359 - RNA, 19 nt, Homo sapiens
cuggaaccauacuaucaaa

SEQ ID NO: 113360 - RNA, 19 nt, Homo sapiens
acacuacaacguugauaga

SEQ ID NO: 113361 - RNA, 19 nt, Homo sapiens
ggucgugccuguguguauc

SEQ ID NO: 113362 - RNA, 19 nt, Homo sapiens
acuaucaaauggcgacaga

SEQ ID NO: 113363 - RNA, 19 nt, Homo sapiens
gcgcgucucccacuacauc

SEQ ID NO: 113364 - RNA, 19 nt, Homo sapiens
gaaugaugaggaagaucuu

SEQ ID NO: 113365 - RNA, 19 nt, Homo sapiens
aggauugcuuucauuguau

SEQ ID NO: 113366 - RNA, 19 nt, Homo sapiens
guaguggucgugccugugu

SEQ ID NO: 113367 - RNA, 19 nt, Homo sapiens
ccgaauaggagaucaagag

SEQ ID NO: 113368 - RNA, 19 nt, Homo sapiens
ugcuuacccugauuuauuc

SEQ ID NO: 113369 - RNA, 19 nt, Homo sapiens
uggacaggaaggaguguua

SEQ ID NO: 113370 - RNA, 19 nt, Homo sapiens
agcauucuguuaccuguga

SEQ ID NO: 113371 - RNA, 19 nt, Homo sapiens
ucaaaagcagucuaguuua

SEQ ID NO: 113372 - RNA, 19 nt, Homo sapiens
ggaggaggcggaguaugug

SEQ ID NO: 113373 - RNA, 19 nt, Homo sapiens
ugacucauucugacauuca

SEQ ID NO: 113374 - RNA, 19 nt, Homo sapiens
aauaguaucaagcaggauu

SEQ ID NO: 113375 - RNA, 19 nt, Homo sapiens
gcaggaggaggcggaguau

SEQ ID NO: 113376 - RNA, 19 nt, Homo sapiens
caacaguuuugcugacaga

SEQ ID NO: 113377 - RNA, 19 nt, Homo sapiens
gaggacuucagcugaguau

SEQ ID NO: 113378 - RNA, 19 nt, Homo sapiens
gaggacagcgaaggcaaga

SEQ ID NO: 113379 - RNA, 19 nt, Homo sapiens
gcgagcccucuuugacuuu

SEQ ID NO: 113380 - RNA, 19 nt, Homo sapiens
uugauucauugccugcuuu

SEQ ID NO: 113381 - RNA, 19 nt, Homo sapiens
guaugugcgagcccucuuu

SEQ ID NO: 113382 - RNA, 19 nt, Homo sapiens
gacacuacaacguugauag

SEQ ID NO: 113383 - RNA, 19 nt, Homo sapiens
acacugcuuacccugauuu

SEQ ID NO: 113384 - RNA, 19 nt, Homo sapiens
aggaggaggcggaguaugu

SEQ ID NO: 113385 - RNA, 19 nt, Homo sapiens
ugcgagcccucuuugacuu

SEQ ID NO: 113386 - RNA, 19 nt, Homo sapiens
ucaacagaaucccgaugag

SEQ ID NO: 113387 - RNA, 19 nt, Homo sapiens
ugacauucagauccuaaga

SEQ ID NO: 113388 - RNA, 19 nt, Homo sapiens
aaucaugcaccgugugaau

SEQ ID NO: 113389 - RNA, 19 nt, Homo sapiens
cugaagagcagugguggaa

SEQ ID NO: 113390 - RNA, 19 nt, Homo sapiens
cgaauaggagaucaagagu

SEQ ID NO: 113391 - RNA, 19 nt, Homo sapiens
ugacuuuaaugggaaugau

SEQ ID NO: 113392 - RNA, 19 nt, Homo sapiens
uagguaucuugccuccuuu

SEQ ID NO: 113393 - RNA, 19 nt, Homo sapiens
cagucuaguuuauauaagc

SEQ ID NO: 113394 - RNA, 19 nt, Homo sapiens
ucagcugaguauaguucaa

SEQ ID NO: 113395 - RNA, 19 nt, Homo sapiens
gaguauaguucaacaguuu

SEQ ID NO: 113396 - RNA, 19 nt, Homo sapiens
gaagagcagugguggaaug

SEQ ID NO: 113397 - RNA, 19 nt, Homo sapiens
aauaggagaucaagaguuu

SEQ ID NO: 113398 - RNA, 19 nt, Homo sapiens
gaaaggagacaucuugaga

SEQ ID NO: 113399 - RNA, 19 nt, Homo sapiens
uguguuagcuucugaauug

SEQ ID NO: 113400 - RNA, 19 nt, Homo sapiens
caggauugcuuucauugua

SEQ ID NO: 113401 - RNA, 19 nt, Homo sapiens
cuggagggcuuguguguua

SEQ ID NO: 113402 - RNA, 19 nt, Homo sapiens
caacugccaucuauacaau

SEQ ID NO: 113403 - RNA, 19 nt, Homo sapiens
agacugaacugcuccauuc

SEQ ID NO: 113404 - RNA, 19 nt, Homo sapiens
ggagacaucuugagaaucc

SEQ ID NO: 113405 - RNA, 19 nt, Homo sapiens
ggaggucggugagcuggua

SEQ ID NO: 113406 - RNA, 19 nt, Homo sapiens
gcaaaucacccuguggaaa

SEQ ID NO: 113407 - RNA, 19 nt, Homo sapiens
ucuguuaccugugauauuu

SEQ ID NO: 113408 - RNA, 19 nt, Homo sapiens
gaaaaccgauggacaggaa

SEQ ID NO: 113409 - RNA, 19 nt, Homo sapiens
ggacuucagcugaguauag

SEQ ID NO: 113410 - RNA, 19 nt, Homo sapiens
ggacagcgaaggcaagaga

SEQ ID NO: 113411 - RNA, 19 nt, Homo sapiens
ggaaccauacuaucaaaug

SEQ ID NO: 113412 - RNA, 19 nt, Homo sapiens
cgaggucacuucccauuca

SEQ ID NO: 113413 - RNA, 19 nt, Homo sapiens
gcaggguaguggagugauu

SEQ ID NO: 113414 - RNA, 19 nt, Homo sapiens
caaaagcagucuaguuuau

SEQ ID NO: 113415 - RNA, 19 nt, Homo sapiens
ucccuuacgucgagaagua

SEQ ID NO: 113416 - RNA, 19 nt, Homo sapiens
gaauaggagaucaagaguu

SEQ ID NO: 113417 - RNA, 19 nt, Homo sapiens
uaaugggaaugaugaggaa

SEQ ID NO: 113418 - RNA, 19 nt, Homo sapiens
aaggagacaucuugagaau

SEQ ID NO: 113419 - RNA, 19 nt, Homo sapiens
gaacugcuccauuccuagu

SEQ ID NO: 113420 - RNA, 19 nt, Homo sapiens
gcugacagaugggaacaau

SEQ ID NO: 113421 - RNA, 19 nt, Homo sapiens
ggugagcugguaaagguua

SEQ ID NO: 113422 - RNA, 19 nt, Homo sapiens
ggaaugaugaggaagaucu

SEQ ID NO: 113423 - RNA, 19 nt, Homo sapiens
ggauugcuuucauuguaug

SEQ ID NO: 113424 - RNA, 19 nt, Homo sapiens
cgagcccucuuugacuuua

SEQ ID NO: 113425 - RNA, 19 nt, Homo sapiens
uaucuugccuccuuucucu

SEQ ID NO: 113426 - RNA, 19 nt, Homo sapiens
auagguaucuugccuccuu

SEQ ID NO: 113427 - RNA, 19 nt, Homo sapiens
ggaugauuccagucccuua

SEQ ID NO: 113428 - RNA, 19 nt, Homo sapiens
cugcuuacccugauuuauu

SEQ ID NO: 113429 - RNA, 19 nt, Homo sapiens
ccauuccuagucuuaauua

SEQ ID NO: 113430 - RNA, 19 nt, Homo sapiens
ucggugagcugguaaaggu

SEQ ID NO: 113431 - RNA, 19 nt, Homo sapiens
ggcaagagagggaugauuc

SEQ ID NO: 113432 - RNA, 19 nt, Homo sapiens
guaaucaugcaccguguga

SEQ ID NO: 113433 - RNA, 19 nt, Homo sapiens
gcagucuaguuuauauaag

SEQ ID NO: 113434 - RNA, 19 nt, Homo sapiens
ugaguauaguucaacaguu

SEQ ID NO: 113435 - RNA, 19 nt, Homo sapiens
gaaccaguuuccagaucca

SEQ ID NO: 113436 - RNA, 19 nt, Homo sapiens
gagcgugaccaggguauga

SEQ ID NO: 113437 - RNA, 19 nt, Homo sapiens
cugaacugcuccauuccua

SEQ ID NO: 113438 - RNA, 19 nt, Homo sapiens
gacauucagauccuaagaa

SEQ ID NO: 113439 - RNA, 19 nt, Homo sapiens
caaaucacccuguggaaaa

SEQ ID NO: 113440 - RNA, 19 nt, Homo sapiens
acugccaucuauacaauuu

SEQ ID NO: 113441 - RNA, 19 nt, Homo sapiens
ucccuaaccuccagaaugg

SEQ ID NO: 113442 - RNA, 19 nt, Homo sapiens
ucaacacuccgcucccuaa

SEQ ID NO: 113443 - RNA, 19 nt, Homo sapiens
gagcccucuuugacuuuaa

SEQ ID NO: 113444 - RNA, 19 nt, Homo sapiens
ggacacuacaacguugaua

SEQ ID NO: 113445 - RNA, 19 nt, Homo sapiens
cugcuuuacuggaauucua

SEQ ID NO: 113446 - RNA, 19 nt, Homo sapiens
gaaggcaagagagggauga

SEQ ID NO: 113447 - RNA, 19 nt, Homo sapiens
gguaguggagugauucuca

SEQ ID NO: 113448 - RNA, 19 nt, Homo sapiens
gugccuguguguaucagaa

SEQ ID NO: 113449 - RNA, 19 nt, Homo sapiens
gcaauuggaggcgguagug

SEQ ID NO: 113450 - RNA, 19 nt, Homo sapiens
gaaucccgaugaggacuuc

SEQ ID NO: 113451 - RNA, 19 nt, Homo sapiens
aaaggagacaucuugagaa

SEQ ID NO: 113452 - RNA, 19 nt, Homo sapiens
uagaaccaguuuccagauc

SEQ ID NO: 113453 - RNA, 19 nt, Homo sapiens
acacacugcuuacccugau

SEQ ID NO: 113454 - RNA, 19 nt, Homo sapiens
ccaacugccaucuauacaa

SEQ ID NO: 113455 - RNA, 19 nt, Homo sapiens
gcaggauugcuuucauugu

SEQ ID NO: 113456 - RNA, 19 nt, Homo sapiens
gucaaaagcagucuaguuu

SEQ ID NO: 113457 - RNA, 19 nt, Homo sapiens
gacuucagcugaguauagu

SEQ ID NO: 113458 - RNA, 19 nt, Homo sapiens
guuacgaagauuaauguga

SEQ ID NO: 113459 - RNA, 19 nt, Homo sapiens
cuggaaccauacuaucaaa

SEQ ID NO: 113460 - RNA, 19 nt, Homo sapiens
ggucgugccuguguguauc

SEQ ID NO: 113461 - RNA, 19 nt, Homo sapiens
acacuacaacguugauaga

SEQ ID NO: 113462 - RNA, 19 nt, Homo sapiens
acuaucaaauggcgacaga

SEQ ID NO: 113463 - RNA, 19 nt, Homo sapiens
gcgcgucucccacuacauc

SEQ ID NO: 113464 - RNA, 19 nt, Homo sapiens
gaaugaugaggaagaucuu

SEQ ID NO: 113465 - RNA, 19 nt, Homo sapiens
aggauugcuuucauuguau

SEQ ID NO: 113466 - RNA, 19 nt, Homo sapiens
guaguggucgugccugugu

SEQ ID NO: 113467 - RNA, 19 nt, Homo sapiens
ccgaauaggagaucaagag

SEQ ID NO: 113468 - RNA, 19 nt, Homo sapiens
ugcuuacccugauuuauuc

SEQ ID NO: 113469 - RNA, 19 nt, Homo sapiens
uggacaggaaggaguguua

SEQ ID NO: 113470 - RNA, 19 nt, Homo sapiens
agcauucuguuaccuguga

SEQ ID NO: 113471 - RNA, 19 nt, Homo sapiens
ucaaaagcagucuaguuua

SEQ ID NO: 113472 - RNA, 19 nt, Homo sapiens
ggaggaggcggaguaugug

SEQ ID NO: 113473 - RNA, 19 nt, Homo sapiens
ugacucauucugacauuca

SEQ ID NO: 113474 - RNA, 19 nt, Homo sapiens
aauaguaucaagcaggauu

SEQ ID NO: 113475 - RNA, 19 nt, Homo sapiens
caacaguuuugcugacaga

SEQ ID NO: 113476 - RNA, 19 nt, Homo sapiens
gcaggaggaggcggaguau

SEQ ID NO: 113477 - RNA, 19 nt, Homo sapiens
gaggacuucagcugaguau

SEQ ID NO: 113478 - RNA, 19 nt, Homo sapiens
gaggacagcgaaggcaaga

SEQ ID NO: 113479 - RNA, 19 nt, Homo sapiens
gcgagcccucuuugacuuu

SEQ ID NO: 113480 - RNA, 19 nt, Homo sapiens
guaugugcgagcccucuuu

SEQ ID NO: 113481 - RNA, 19 nt, Homo sapiens
uugauucauugccugcuuu

SEQ ID NO: 113482 - RNA, 19 nt, Homo sapiens
gacacuacaacguugauag

SEQ ID NO: 113483 - RNA, 19 nt, Homo sapiens
aggaggaggcggaguaugu

SEQ ID NO: 113484 - RNA, 19 nt, Homo sapiens
acacugcuuacccugauuu

SEQ ID NO: 113485 - RNA, 19 nt, Homo sapiens
ugcgagcccucuuugacuu

SEQ ID NO: 113486 - RNA, 19 nt, Homo sapiens
ucaacagaaucccgaugag

SEQ ID NO: 113487 - RNA, 19 nt, Homo sapiens
ccauauaugccaggguuau

SEQ ID NO: 113488 - RNA, 19 nt, Homo sapiens
ugacauucagauccuaaga

SEQ ID NO: 113489 - RNA, 19 nt, Homo sapiens
aaucaugcaccgugugaau

SEQ ID NO: 113490 - RNA, 19 nt, Homo sapiens
cccaaugccuacgacaaga

SEQ ID NO: 113491 - RNA, 19 nt, Homo sapiens
acacuccgcucccuaaccu

SEQ ID NO: 113492 - RNA, 19 nt, Homo sapiens
cugaagagcagugguggaa

SEQ ID NO: 113493 - RNA, 19 nt, Homo sapiens
ugacuuuaaugggaaugau

SEQ ID NO: 113494 - RNA, 19 nt, Homo sapiens
cgaauaggagaucaagagu

SEQ ID NO: 113495 - RNA, 19 nt, Homo sapiens
ccgaagaccugcccuuuaa

SEQ ID NO: 113496 - RNA, 19 nt, Homo sapiens
gagagaaguugacguggaa

SEQ ID NO: 113497 - RNA, 19 nt, Homo sapiens
gaagauaaccuggaauaug

SEQ ID NO: 113498 - RNA, 19 nt, Homo sapiens
caacaggaagugaaccuua

SEQ ID NO: 113499 - RNA, 19 nt, Homo sapiens
gcacacaaguggagagaag

SEQ ID NO: 113500 - RNA, 19 nt, Homo sapiens
aagauaaccuggaauaugu

SEQ ID NO: 113501 - RNA, 19 nt, Homo sapiens
gaugauuccugucccuuau

SEQ ID NO: 113502 - RNA, 19 nt, Homo sapiens
cagaagauaaccuggaaua

SEQ ID NO: 113503 - RNA, 19 nt, Homo sapiens
ggugagauccuagugauaa

SEQ ID NO: 113504 - RNA, 19 nt, Homo sapiens
ccaggaauuugaccauuug

SEQ ID NO: 113505 - RNA, 19 nt, Homo sapiens
ggaagugaaccuuaaggaa

SEQ ID NO: 113506 - RNA, 19 nt, Homo sapiens
gcgagauacugcauguuug

SEQ ID NO: 113507 - RNA, 19 nt, Homo sapiens
gaucauaaacuggaaauac

SEQ ID NO: 113508 - RNA, 19 nt, Homo sapiens
ggaugauuccugucccuua

SEQ ID NO: 113509 - RNA, 19 nt, Homo sapiens
uacggacucuguaugauuu

SEQ ID NO: 113510 - RNA, 19 nt, Homo sapiens
guacggacucuguaugauu

SEQ ID NO: 113511 - RNA, 19 nt, Homo sapiens
gaauauguacggacucugu

SEQ ID NO: 113512 - RNA, 19 nt, Homo sapiens
gaaauaggaauuccaacag

SEQ ID NO: 113513 - RNA, 19 nt, Homo sapiens
gaaagcauggaaauaggaa

SEQ ID NO: 113514 - RNA, 19 nt, Homo sapiens
gaccaggaauuugaccauu

SEQ ID NO: 113515 - RNA, 19 nt, Homo sapiens
ggcgagauacugcauguuu

SEQ ID NO: 113516 - RNA, 19 nt, Homo sapiens
ggaaagcauggaaauagga

SEQ ID NO: 113517 - RNA, 19 nt, Homo sapiens
aacaggaagugaaccuuaa

SEQ ID NO: 113518 - RNA, 19 nt, Homo sapiens
ggacugauucugucguguu

SEQ ID NO: 113519 - RNA, 19 nt, Homo sapiens
gcaaagaguagccgauuuu

SEQ ID NO: 113520 - RNA, 19 nt, Homo sapiens
gccgaagaccugcccuuua

SEQ ID NO: 113521 - RNA, 19 nt, Homo sapiens
ggcagucgcacacacauuu

SEQ ID NO: 113522 - RNA, 19 nt, Homo sapiens
uagagaagccugaagaaca

SEQ ID NO: 113523 - RNA, 19 nt, Homo sapiens
uaauagagaagccugaaga

SEQ ID NO: 113524 - RNA, 19 nt, Homo sapiens
ucucauugcugcccguuug

SEQ ID NO: 113525 - RNA, 19 nt, Homo sapiens
aagugaaccuuaaggaaga

SEQ ID NO: 113526 - RNA, 19 nt, Homo sapiens
cauguuugcuguuccacaa

SEQ ID NO: 113527 - RNA, 19 nt, Homo sapiens
aauaggaauuccaacaguu

SEQ ID NO: 113528 - RNA, 19 nt, Homo sapiens
gucacaaggaugaauauaa

SEQ ID NO: 113529 - RNA, 19 nt, Homo sapiens
aaagucacaaggaugaaua

SEQ ID NO: 113530 - RNA, 19 nt, Homo sapiens
gaccacaacuccucuaccu

SEQ ID NO: 113531 - RNA, 19 nt, Homo sapiens
gaaagucacaaggaugaau

SEQ ID NO: 113532 - RNA, 19 nt, Homo sapiens
aaauaggaauuccaacagu

SEQ ID NO: 113533 - RNA, 19 nt, Homo sapiens
ggaacaagcugggcaaaag

SEQ ID NO: 113534 - RNA, 19 nt, Homo sapiens
auaggaauuccaacaguua

SEQ ID NO: 113535 - RNA, 19 nt, Homo sapiens
ggagugcccggaacaagga

SEQ ID NO: 113536 - RNA, 19 nt, Homo sapiens
aaagaguacccugugcuua

SEQ ID NO: 113537 - RNA, 19 nt, Homo sapiens
agagaagccugaagaacag

SEQ ID NO: 113538 - RNA, 19 nt, Homo sapiens
gauaauagagaagccugaa

SEQ ID NO: 113539 - RNA, 19 nt, Homo sapiens
gcgggucucccacuacauu

SEQ ID NO: 113540 - RNA, 19 nt, Homo sapiens
gcggcugccuccugauguu

SEQ ID NO: 113541 - RNA, 19 nt, Homo sapiens
cagaaccugcucaugcaua

SEQ ID NO: 113542 - RNA, 19 nt, Homo sapiens
gaagaccugcccuuuaaaa

SEQ ID NO: 113543 - RNA, 19 nt, Homo sapiens
ugcaaagaguagccgauuu

SEQ ID NO: 113544 - RNA, 19 nt, Homo sapiens
ucgaaaagcuugugagauc

SEQ ID NO: 113545 - RNA, 19 nt, Homo sapiens
ggacaccaccacccucauc

SEQ ID NO: 113546 - RNA, 19 nt, Homo sapiens
accaggaauuugaccauuu

SEQ ID NO: 113547 - RNA, 19 nt, Homo sapiens
gaaccuuaaggaagagaga

SEQ ID NO: 113548 - RNA, 19 nt, Homo sapiens
uugaggccauggcgagaua

SEQ ID NO: 113549 - RNA, 19 nt, Homo sapiens
cauaaacuggaaauacuga

SEQ ID NO: 113550 - RNA, 19 nt, Homo sapiens
gauugcuguugcccuguuu

SEQ ID NO: 113551 - RNA, 19 nt, Homo sapiens
aagaguacccugugcuuau

SEQ ID NO: 113552 - RNA, 19 nt, Homo sapiens
uauccaagcccaccaaugg

SEQ ID NO: 113553 - RNA, 19 nt, Homo sapiens
guccuagucuccuuugaag

SEQ ID NO: 113554 - RNA, 19 nt, Homo sapiens
cgaaagcaauccagaaaag

SEQ ID NO: 113555 - RNA, 19 nt, Homo sapiens
gagauccuagugauaauag

SEQ ID NO: 113556 - RNA, 19 nt, Homo sapiens
gacugauucugucguguuc

SEQ ID NO: 113557 - RNA, 19 nt, Homo sapiens
gggcagcaaucaccccuuu

SEQ ID NO: 113558 - RNA, 19 nt, Homo sapiens
gugagauccuagugauaau

SEQ ID NO: 113559 - RNA, 19 nt, Homo sapiens
caaggaugaauauaaaugg

SEQ ID NO: 113560 - RNA, 19 nt, Homo sapiens
agaguacccugugcuuaug

SEQ ID NO: 113561 - RNA, 19 nt, Homo sapiens
gauccucaccacacggaaa

SEQ ID NO: 113562 - RNA, 19 nt, Homo sapiens
ccuagucuccuuugaagug

SEQ ID NO: 113563 - RNA, 19 nt, Homo sapiens
cagaauggaccugucuuug

SEQ ID NO: 113564 - RNA, 19 nt, Homo sapiens
ugagauccuagugauaaua

SEQ ID NO: 113565 - RNA, 19 nt, Homo sapiens
ggaauuccaacaguuaugg

SEQ ID NO: 113566 - RNA, 19 nt, Homo sapiens
cggaaagcauggaaauagg

SEQ ID NO: 113567 - RNA, 19 nt, Homo sapiens
gugcaaagaguagccgauu

SEQ ID NO: 113568 - RNA, 19 nt, Homo sapiens
cccagaaccugcucaugca

SEQ ID NO: 113569 - RNA, 19 nt, Homo sapiens
agcagaagauaaccuggaa

SEQ ID NO: 113570 - RNA, 19 nt, Homo sapiens
uaaacuggaaauacugaug

SEQ ID NO: 113571 - RNA, 19 nt, Homo sapiens
gcagucgcacacacauuug

SEQ ID NO: 113572 - RNA, 19 nt, Homo sapiens
cauuagagguuggugacau

SEQ ID NO: 113573 - RNA, 19 nt, Homo sapiens
aagcauggaaauaggaauu

SEQ ID NO: 113574 - RNA, 19 nt, Homo sapiens
ugauuccugucccuuaugu

SEQ ID NO: 113575 - RNA, 19 nt, Homo sapiens
gcacccaaccugccuacag

SEQ ID NO: 113576 - RNA, 19 nt, Homo sapiens
gcgacgcuccuucgaguuc

SEQ ID NO: 113577 - RNA, 19 nt, Homo sapiens
ccuguuuccugcugcuuug

SEQ ID NO: 113578 - RNA, 19 nt, Homo sapiens
cgaagaccugcccuuuaaa

SEQ ID NO: 113579 - RNA, 19 nt, Homo sapiens
ggaccaggaauuugaccau

SEQ ID NO: 113580 - RNA, 19 nt, Homo sapiens
acacggaaagcauggaaau

SEQ ID NO: 113581 - RNA, 19 nt, Homo sapiens
ggaaauacugauggaagca

SEQ ID NO: 113582 - RNA, 19 nt, Homo sapiens
acacugcauugccgaaguc

SEQ ID NO: 113583 - RNA, 19 nt, Homo sapiens
ugauugcuguugcccuguu

SEQ ID NO: 113584 - RNA, 19 nt, Homo sapiens
gggugagauccuagugaua

SEQ ID NO: 113585 - RNA, 19 nt, Homo sapiens
acacaaguggagagaaguu

SEQ ID NO: 113586 - RNA, 19 nt, Homo sapiens
ugcgaaagcaauccagaaa

SEQ ID NO: 113587 - RNA, 19 nt, Homo sapiens
gaucggggaccaggaauuu

SEQ ID NO: 113588 - RNA, 19 nt, Homo sapiens
ccacacggaaagcauggaa

SEQ ID NO: 113589 - RNA, 19 nt, Homo sapiens
caaagaguagccgauuuua

SEQ ID NO: 113590 - RNA, 19 nt, Homo sapiens
guacaugggacugauucug

SEQ ID NO: 113591 - RNA, 19 nt, Homo sapiens
ggaucauaaacuggaaaua

SEQ ID NO: 113592 - RNA, 19 nt, Homo sapiens
uuggugacaucgugaaagu

SEQ ID NO: 113593 - RNA, 19 nt, Homo sapiens
agaaccugcucaugcauac

SEQ ID NO: 113594 - RNA, 19 nt, Homo sapiens
cacggaaagcauggaaaua

SEQ ID NO: 113595 - RNA, 19 nt, Homo sapiens
ccagauagaugacaacaau

SEQ ID NO: 113596 - RNA, 19 nt, Homo sapiens
ggaccacgaugaucauuga

SEQ ID NO: 113597 - RNA, 19 nt, Homo sapiens
guacuagugugguguguuu

SEQ ID NO: 113598 - RNA, 19 nt, Homo sapiens
gugaagauguuuacucauu

SEQ ID NO: 113599 - RNA, 19 nt, Homo sapiens
cgaagcagcugacaccaaa

SEQ ID NO: 113600 - RNA, 19 nt, Homo sapiens
gagcuagccugaaggauuc

SEQ ID NO: 113601 - RNA, 19 nt, Homo sapiens
ggacuuaucaaacaaauag

SEQ ID NO: 113602 - RNA, 19 nt, Homo sapiens
ggagcuagccugaaggauu

SEQ ID NO: 113603 - RNA, 19 nt, Homo sapiens
acaaauaggagagaacuua

SEQ ID NO: 113604 - RNA, 19 nt, Homo sapiens
gcacuagguugcagagaag

SEQ ID NO: 113605 - RNA, 19 nt, Homo sapiens
ggacaucgccaaggacuga

SEQ ID NO: 113606 - RNA, 19 nt, Homo sapiens
gaugaucauugaccauguu

SEQ ID NO: 113607 - RNA, 19 nt, Homo sapiens
ggaagaagugguacuagug

SEQ ID NO: 113608 - RNA, 19 nt, Homo sapiens
aaaaugaacugcccacuga

SEQ ID NO: 113609 - RNA, 19 nt, Homo sapiens
ugaagauguuuacucauug

SEQ ID NO: 113610 - RNA, 19 nt, Homo sapiens
ccaaaucuucgccuucuaa

SEQ ID NO: 113611 - RNA, 19 nt, Homo sapiens
ggacaacuuuacccugauc

SEQ ID NO: 113612 - RNA, 19 nt, Homo sapiens
gaugaccaaucccuuuaug

SEQ ID NO: 113613 - RNA, 19 nt, Homo sapiens
cagugaagauguuuacuca

SEQ ID NO: 113614 - RNA, 19 nt, Homo sapiens
uaggauaguugaugcaugu

SEQ ID NO: 113615 - RNA, 19 nt, Homo sapiens
gaagaagugguacuagugu

SEQ ID NO: 113616 - RNA, 19 nt, Homo sapiens
ucaccaaggucaugagcaa

SEQ ID NO: 113617 - RNA, 19 nt, Homo sapiens
gaucauugaccauguuguu

SEQ ID NO: 113618 - RNA, 19 nt, Homo sapiens
caaauaggagagaacuuaa

SEQ ID NO: 113619 - RNA, 19 nt, Homo sapiens
guugaugcauguuacuaaa

SEQ ID NO: 113620 - RNA, 19 nt, Homo sapiens
ggauaguugaugcauguua

SEQ ID NO: 113621 - RNA, 19 nt, Homo sapiens
gguaccagcuacacccaaa

SEQ ID NO: 113622 - RNA, 19 nt, Homo sapiens
caacugcccuguguacauc

SEQ ID NO: 113623 - RNA, 19 nt, Homo sapiens
ggacaaaggcgucaauucc

SEQ ID NO: 113624 - RNA, 19 nt, Homo sapiens
ggauggacuuaucaaacaa

SEQ ID NO: 113625 - RNA, 19 nt, Homo sapiens
gaagauguuuacucauugc

SEQ ID NO: 113626 - RNA, 19 nt, Homo sapiens
cuacagcacugcccagaag

SEQ ID NO: 113627 - RNA, 19 nt, Homo sapiens
gcucuuauuucugaauuca

SEQ ID NO: 113628 - RNA, 19 nt, Homo sapiens
gauaguugaugcauguuac

SEQ ID NO: 113629 - RNA, 19 nt, Homo sapiens
ccugggagcugugaucuug

SEQ ID NO: 113630 - RNA, 19 nt, Homo sapiens
auaaggaugucuaccaaau

SEQ ID NO: 113631 - RNA, 19 nt, Homo sapiens
cuacauggccuauaaggau

SEQ ID NO: 113632 - RNA, 19 nt, Homo sapiens
uaaauuacguaugcaaguc

SEQ ID NO: 113633 - RNA, 19 nt, Homo sapiens
gguggccgcuccaacauca

SEQ ID NO: 113634 - RNA, 19 nt, Homo sapiens
ccaagaucuuuaaccugua

SEQ ID NO: 113635 - RNA, 19 nt, Homo sapiens
ccagcucuaugaagccuuu

SEQ ID NO: 113636 - RNA, 19 nt, Homo sapiens
cuauaaggaugucuaccaa

SEQ ID NO: 113637 - RNA, 19 nt, Homo sapiens
gaucuugguccaugcagaa

SEQ ID NO: 113638 - RNA, 19 nt, Homo sapiens
aaggaugucuaccaaaugu

SEQ ID NO: 113639 - RNA, 19 nt, Homo sapiens
ucaauuccuuccaagucua

SEQ ID NO: 113640 - RNA, 19 nt, Homo sapiens
ucaaacaaauaggagagaa

SEQ ID NO: 113641 - RNA, 19 nt, Homo sapiens
ccaaaacccuuacagugaa

SEQ ID NO: 113642 - RNA, 19 nt, Homo sapiens
uuugauagcucaggaacaa

SEQ ID NO: 113643 - RNA, 19 nt, Homo sapiens
ggaggauggacuuaucaaa

SEQ ID NO: 113644 - RNA, 19 nt, Homo sapiens
ccugugagauccgugaauu

SEQ ID NO: 113645 - RNA, 19 nt, Homo sapiens
guuacuaaauuacguaugc

SEQ ID NO: 113646 - RNA, 19 nt, Homo sapiens
caagaucuuuaaccuguac

SEQ ID NO: 113647 - RNA, 19 nt, Homo sapiens
aagucuacauggccuauaa

SEQ ID NO: 113648 - RNA, 19 nt, Homo sapiens
cgagccagguucacacuca

SEQ ID NO: 113649 - RNA, 19 nt, Homo sapiens
aggauggacuuaucaaaca

SEQ ID NO: 113650 - RNA, 19 nt, Homo sapiens
ccaaggaaagggcggauug

SEQ ID NO: 113651 - RNA, 19 nt, Homo sapiens
cggaucaacugcccugugu

SEQ ID NO: 113652 - RNA, 19 nt, Homo sapiens
cggaggagcuagccugaag

SEQ ID NO: 113653 - RNA, 19 nt, Homo sapiens
caaugcagccaagaucuuu

SEQ ID NO: 113654 - RNA, 19 nt, Homo sapiens
aaucuucgccuucuaaaca

SEQ ID NO: 113655 - RNA, 19 nt, Homo sapiens
guaugacgguccuguguac

SEQ ID NO: 113656 - RNA, 19 nt, Homo sapiens
acaagucggcgguggagua

SEQ ID NO: 113657 - RNA, 19 nt, Homo sapiens
uuacuuaacaaccaacuug

SEQ ID NO: 113658 - RNA, 19 nt, Homo sapiens
ccaguccaacuucagcuua

SEQ ID NO: 113659 - RNA, 19 nt, Homo sapiens
ggcgguggcuacuggcaaa

SEQ ID NO: 113660 - RNA, 19 nt, Homo sapiens
gaucaacugcccuguguac

SEQ ID NO: 113661 - RNA, 19 nt, Homo sapiens
gaggauggacuuaucaaac

SEQ ID NO: 113662 - RNA, 19 nt, Homo sapiens
ccagccuacugaccucuuu

SEQ ID NO: 113663 - RNA, 19 nt, Homo sapiens
gacugcggcugaugacuuc

SEQ ID NO: 113664 - RNA, 19 nt, Homo sapiens
gggaagccuugcacuaggu

SEQ ID NO: 113665 - RNA, 19 nt, Homo sapiens
aaacaucaacgucaacaag

SEQ ID NO: 113666 - RNA, 19 nt, Homo sapiens
guacaucaccaaggucaug

SEQ ID NO: 113667 - RNA, 19 nt, Homo sapiens
ggaugacugcggcugauga

SEQ ID NO: 113668 - RNA, 19 nt, Homo sapiens
ucugaguggugguuccuuu

SEQ ID NO: 113669 - RNA, 19 nt, Homo sapiens
ggagugaagaccauugaag

SEQ ID NO: 113670 - RNA, 19 nt, Homo sapiens
gaaacaucaacgucaacaa

SEQ ID NO: 113671 - RNA, 19 nt, Homo sapiens
gcaccaaugcagccaagau

SEQ ID NO: 113672 - RNA, 19 nt, Homo sapiens
gguccacacuagaaagaag

SEQ ID NO: 113673 - RNA, 19 nt, Homo sapiens
gcauguuacuaaauuacgu

SEQ ID NO: 113674 - RNA, 19 nt, Homo sapiens
uaccagcuacacccaaaua

SEQ ID NO: 113675 - RNA, 19 nt, Homo sapiens
cgacagccagcucuaugaa

SEQ ID NO: 113676 - RNA, 19 nt, Homo sapiens
gauguucuaggauaguuga

SEQ ID NO: 113677 - RNA, 19 nt, Homo sapiens
gccaaaucuucgccuucua

SEQ ID NO: 113678 - RNA, 19 nt, Homo sapiens
ggaaacaucaacgucaaca

SEQ ID NO: 113679 - RNA, 19 nt, Homo sapiens
aaagguggacggaucauca

SEQ ID NO: 113680 - RNA, 19 nt, Homo sapiens
caaaucuucgccuucuaaa

SEQ ID NO: 113681 - RNA, 19 nt, Homo sapiens
uaaccuguacccaaggaaa

SEQ ID NO: 113682 - RNA, 19 nt, Homo sapiens
gauggacuuaucaaacaaa

SEQ ID NO: 113683 - RNA, 19 nt, Homo sapiens
cagccaagaucuuuaaccu

SEQ ID NO: 113684 - RNA, 19 nt, Homo sapiens
guggacggaucaucaacga

SEQ ID NO: 113685 - RNA, 19 nt, Homo sapiens
gagaagcauccuccacauc

SEQ ID NO: 113686 - RNA, 19 nt, Homo sapiens
gagugcagccgacaucauc

SEQ ID NO: 113687 - RNA, 19 nt, Homo sapiens
caagagugcagccgacauc

SEQ ID NO: 113688 - RNA, 19 nt, Homo sapiens
gaccgacuccucaucaaag

SEQ ID NO: 113689 - RNA, 19 nt, Homo sapiens
gcuccaugauucucugagu

SEQ ID NO: 113690 - RNA, 19 nt, Homo sapiens
gaaucauguccaucccuuu

SEQ ID NO: 113691 - RNA, 19 nt, Homo sapiens
agaaggcggugggcaagga

SEQ ID NO: 113692 - RNA, 19 nt, Homo sapiens
uaaggaugucuaccaaaug

SEQ ID NO: 113693 - RNA, 19 nt, Homo sapiens
gucaauuccuuccaagucu

SEQ ID NO: 113694 - RNA, 19 nt, Homo sapiens
ugaccucuuucgagaagug

SEQ ID NO: 113695 - RNA, 19 nt, Homo sapiens
gaacuuaaaugacugguuu

SEQ ID NO: 113696 - RNA, 19 nt, Homo sapiens
gcgcugaucuucuauuuaa

SEQ ID NO: 113697 - RNA, 19 nt, Homo sapiens
ucacagggcucuucaguau

SEQ ID NO: 113698 - RNA, 19 nt, Homo sapiens
gaaaggagaaaugauguua

SEQ ID NO: 113699 - RNA, 19 nt, Homo sapiens
gggugggucugaaauauua

SEQ ID NO: 113700 - RNA, 19 nt, Homo sapiens
ggaaaggccauuagaauug

SEQ ID NO: 113701 - RNA, 19 nt, Homo sapiens
uggagaagcuguuguguuu

SEQ ID NO: 113702 - RNA, 19 nt, Homo sapiens
gauaauuucuuaccucaca

SEQ ID NO: 113703 - RNA, 19 nt, Homo sapiens
gaggaaggcuuuuguguuu

SEQ ID NO: 113704 - RNA, 19 nt, Homo sapiens
gaagcacuagguauaaaua

SEQ ID NO: 113705 - RNA, 19 nt, Homo sapiens
ggcaagagcugagaaggaa

SEQ ID NO: 113706 - RNA, 19 nt, Homo sapiens
gaagguaccucccgguuuu

SEQ ID NO: 113707 - RNA, 19 nt, Homo sapiens
ucugggagcucguuaacua

SEQ ID NO: 113708 - RNA, 19 nt, Homo sapiens
ccagaaagcaggagcauug

SEQ ID NO: 113709 - RNA, 19 nt, Homo sapiens
gaauggagguaaagugucu

SEQ ID NO: 113710 - RNA, 19 nt, Homo sapiens
ggucuaaggauauaggaua

SEQ ID NO: 113711 - RNA, 19 nt, Homo sapiens
gccaagaacuuaaaugacu

SEQ ID NO: 113712 - RNA, 19 nt, Homo sapiens
uugcagugcuuucuuaauu

SEQ ID NO: 113713 - RNA, 19 nt, Homo sapiens
gcacuagguauaaauaugu

SEQ ID NO: 113714 - RNA, 19 nt, Homo sapiens
ccaaagagucggauacuuc

SEQ ID NO: 113715 - RNA, 19 nt, Homo sapiens
aaaugaagcacuagguaua

SEQ ID NO: 113716 - RNA, 19 nt, Homo sapiens
cagaugagauuaacaccau

SEQ ID NO: 113717 - RNA, 19 nt, Homo sapiens
gaacaugugggacuuugug

SEQ ID NO: 113718 - RNA, 19 nt, Homo sapiens
ggugggaacuuugaaggaa

SEQ ID NO: 113719 - RNA, 19 nt, Homo sapiens
gagacaagacaaugagauu

SEQ ID NO: 113720 - RNA, 19 nt, Homo sapiens
ucaaagcaccguuaacgaa

SEQ ID NO: 113721 - RNA, 19 nt, Homo sapiens
gaaaggccauuagaauugc

SEQ ID NO: 113722 - RNA, 19 nt, Homo sapiens
acagggcucuucaguauca

SEQ ID NO: 113723 - RNA, 19 nt, Homo sapiens
gagaauggagguaaagugu

SEQ ID NO: 113724 - RNA, 19 nt, Homo sapiens
uaacgaagccucucaaagc

SEQ ID NO: 113725 - RNA, 19 nt, Homo sapiens
ccagaaaggagaaaugaug

SEQ ID NO: 113726 - RNA, 19 nt, Homo sapiens
ccucagggaucguggaguu

SEQ ID NO: 113727 - RNA, 19 nt, Homo sapiens
gggaaacgguccaaaagaa

SEQ ID NO: 113728 - RNA, 19 nt, Homo sapiens
ccagagugcucaucaucau

SEQ ID NO: 113729 - RNA, 19 nt, Homo sapiens
uuucuuaccucacauagau

SEQ ID NO: 113730 - RNA, 19 nt, Homo sapiens
ccaagagacaagacaauga

SEQ ID NO: 113731 - RNA, 19 nt, Homo sapiens
gcagugcuuucuuaauuuu

SEQ ID NO: 113732 - RNA, 19 nt, Homo sapiens
ucucaaagcacacuggaaa

SEQ ID NO: 113733 - RNA, 19 nt, Homo sapiens
aagcgcugaucuucuauuu

SEQ ID NO: 113734 - RNA, 19 nt, Homo sapiens
aaucagaauuugagguguu

SEQ ID NO: 113735 - RNA, 19 nt, Homo sapiens
ugaggaagagucugaagaa

SEQ ID NO: 113736 - RNA, 19 nt, Homo sapiens
uggaaaggccauuagaauu

SEQ ID NO: 113737 - RNA, 19 nt, Homo sapiens
ugcagugcuuucuuaauuu

SEQ ID NO: 113738 - RNA, 19 nt, Homo sapiens
caggagcauugcccacauu

SEQ ID NO: 113739 - RNA, 19 nt, Homo sapiens
gcaggagcauugcccacau

SEQ ID NO: 113740 - RNA, 19 nt, Homo sapiens
gcucuucaguaucagaauc

SEQ ID NO: 113741 - RNA, 19 nt, Homo sapiens
cacaguagcuccaguacac

SEQ ID NO: 113742 - RNA, 19 nt, Homo sapiens
gugggugggucugaaauau

SEQ ID NO: 113743 - RNA, 19 nt, Homo sapiens
gaauucaggcccuuguauc

SEQ ID NO: 113744 - RNA, 19 nt, Homo sapiens
gaggaagagucugaagaag

SEQ ID NO: 113745 - RNA, 19 nt, Homo sapiens
ggauauaggauacaguuuu

SEQ ID NO: 113746 - RNA, 19 nt, Homo sapiens
gugaacaugugggacuuug

SEQ ID NO: 113747 - RNA, 19 nt, Homo sapiens
cgagguuccugaagucaca

SEQ ID NO: 113748 - RNA, 19 nt, Homo sapiens
gucggauacuuccuaugua

SEQ ID NO: 113749 - RNA, 19 nt, Homo sapiens
uuauggcucuucugggaaa

SEQ ID NO: 113750 - RNA, 19 nt, Homo sapiens
aaacuaacacccagaaagg

SEQ ID NO: 113751 - RNA, 19 nt, Homo sapiens
gaagcuguuguguuucuug

SEQ ID NO: 113752 - RNA, 19 nt, Homo sapiens
guccuaauguccugaacug

SEQ ID NO: 113753 - RNA, 19 nt, Homo sapiens
gauuaacaccaucuaucuu

SEQ ID NO: 113754 - RNA, 19 nt, Homo sapiens
gcugucaccagaugagauu

SEQ ID NO: 113755 - RNA, 19 nt, Homo sapiens
gacaagacaaugagauucu

SEQ ID NO: 113756 - RNA, 19 nt, Homo sapiens
ugaagguaccucccgguuu

SEQ ID NO: 113757 - RNA, 19 nt, Homo sapiens
cucaaagccuucacugugu

SEQ ID NO: 113758 - RNA, 19 nt, Homo sapiens
caaaaugaagcacuaggua

SEQ ID NO: 113759 - RNA, 19 nt, Homo sapiens
cguuaacuaugcugggaaa

SEQ ID NO: 113760 - RNA, 19 nt, Homo sapiens
caagagacaagacaaugag

SEQ ID NO: 113761 - RNA, 19 nt, Homo sapiens
ggugggagacauuggaaau

SEQ ID NO: 113762 - RNA, 19 nt, Homo sapiens
gcagaagcaagcaucaucu

SEQ ID NO: 113763 - RNA, 19 nt, Homo sapiens
ugaagaagggauacacugu

SEQ ID NO: 113764 - RNA, 19 nt, Homo sapiens
guagcuccaguacacauuu

SEQ ID NO: 113765 - RNA, 19 nt, Homo sapiens
ugcuugcagugcuuucuua

SEQ ID NO: 113766 - RNA, 19 nt, Homo sapiens
gguacaguauuuucucgua

SEQ ID NO: 113767 - RNA, 19 nt, Homo sapiens
aaugaagcacuagguauaa

SEQ ID NO: 113768 - RNA, 19 nt, Homo sapiens
cagaaaggagaaaugaugu

SEQ ID NO: 113769 - RNA, 19 nt, Homo sapiens
ggcugugaauucuuucuuc

SEQ ID NO: 113770 - RNA, 19 nt, Homo sapiens
cugccaagaacuuaaauga

SEQ ID NO: 113771 - RNA, 19 nt, Homo sapiens
ucacauagaugagaaaacu

SEQ ID NO: 113772 - RNA, 19 nt, Homo sapiens
ugaauucaggcccuuguau

SEQ ID NO: 113773 - RNA, 19 nt, Homo sapiens
uagcuccaguacacauuug

SEQ ID NO: 113774 - RNA, 19 nt, Homo sapiens
gagaaggaagcgcugaucu

SEQ ID NO: 113775 - RNA, 19 nt, Homo sapiens
caauauacccaggccacaa

SEQ ID NO: 113776 - RNA, 19 nt, Homo sapiens
cuggaaaggccauuagaau

SEQ ID NO: 113777 - RNA, 19 nt, Homo sapiens
ccgaauacaucuuuuccaa

SEQ ID NO: 113778 - RNA, 19 nt, Homo sapiens
agaaggaagcgcugaucuu

SEQ ID NO: 113779 - RNA, 19 nt, Homo sapiens
gcccuucaguccuaauguc

SEQ ID NO: 113780 - RNA, 19 nt, Homo sapiens
ggaagcccagggugaggaa

SEQ ID NO: 113781 - RNA, 19 nt, Homo sapiens
uuacugccaagaacuuaaa

SEQ ID NO: 113782 - RNA, 19 nt, Homo sapiens
ucaucaucaugucauagaa

SEQ ID NO: 113783 - RNA, 19 nt, Homo sapiens
gccugagaauggagguaaa

SEQ ID NO: 113784 - RNA, 19 nt, Homo sapiens
acugaaguaugaagugcaa

SEQ ID NO: 113785 - RNA, 19 nt, Homo sapiens
ggcagaagcaagcaucauc

SEQ ID NO: 113786 - RNA, 19 nt, Homo sapiens
gugaggaagagucugaaga

SEQ ID NO: 113787 - RNA, 19 nt, Homo sapiens
aaggauauaggauacaguu

SEQ ID NO: 113788 - RNA, 19 nt, Homo sapiens
augaagcacuagguauaaa

SEQ ID NO: 113789 - RNA, 19 nt, Homo sapiens
gagcauugcccacauucac

SEQ ID NO: 113790 - RNA, 19 nt, Homo sapiens
agagucggauacuuccuau

SEQ ID NO: 113791 - RNA, 19 nt, Homo sapiens
gaagugcaaggcgaagugu

SEQ ID NO: 113792 - RNA, 19 nt, Homo sapiens
cuauguaucccucaaagca

SEQ ID NO: 113793 - RNA, 19 nt, Homo sapiens
guggaguucuggguagaug

SEQ ID NO: 113794 - RNA, 19 nt, Homo sapiens
ugaagcacuagguauaaau

SEQ ID NO: 113795 - RNA, 19 nt, Homo sapiens
ccaccaaacugaccuauga

SEQ ID NO: 113796 - RNA, 19 nt, Homo sapiens
gauauuugcugccuggaaa

SEQ ID NO: 113797 - RNA, 19 nt, Homo sapiens
ugacagagcuauucacauc

SEQ ID NO: 113798 - RNA, 19 nt, Homo sapiens
acacagagguggcaauguu

SEQ ID NO: 113799 - RNA, 19 nt, Homo sapiens
ggacuuacaagguguggua

SEQ ID NO: 113800 - RNA, 19 nt, Homo sapiens
ugaggugauugaaggauua

SEQ ID NO: 113801 - RNA, 19 nt, Homo sapiens
agaaggcgcugcaguccua

SEQ ID NO: 113802 - RNA, 19 nt, Homo sapiens
ggugcaagcuugucucaau

SEQ ID NO: 113803 - RNA, 19 nt, Homo sapiens
ggaccaggaugcugugauc

SEQ ID NO: 113804 - RNA, 19 nt, Homo sapiens
gaagauuaugggagauaua

SEQ ID NO: 113805 - RNA, 19 nt, Homo sapiens
gggcuggacuggugcaaug

SEQ ID NO: 113806 - RNA, 19 nt, Homo sapiens
ggaaaauucucggauauga

SEQ ID NO: 113807 - RNA, 19 nt, Homo sapiens
ggaagauuaugggagauau

SEQ ID NO: 113808 - RNA, 19 nt, Homo sapiens
ggagaaagagcgcuagcuu

SEQ ID NO: 113809 - RNA, 19 nt, Homo sapiens
caaugauggugcucagauu

SEQ ID NO: 113810 - RNA, 19 nt, Homo sapiens
caaacugaccuaugaugaa

SEQ ID NO: 113811 - RNA, 19 nt, Homo sapiens
caacuuaagcagaacuuga

SEQ ID NO: 113812 - RNA, 19 nt, Homo sapiens
cuauaaagaugaagagucu

SEQ ID NO: 113813 - RNA, 19 nt, Homo sapiens
ggauaugaccgcugugaug

SEQ ID NO: 113814 - RNA, 19 nt, Homo sapiens
gauaaaagcagauaugaug

SEQ ID NO: 113815 - RNA, 19 nt, Homo sapiens
acuauacucuggaucauga

SEQ ID NO: 113816 - RNA, 19 nt, Homo sapiens
cggauuaccucaaggaagu

SEQ ID NO: 113817 - RNA, 19 nt, Homo sapiens
gcacacacacucacacaca

SEQ ID NO: 113818 - RNA, 19 nt, Homo sapiens
aagcagaacuugagagcau

SEQ ID NO: 113819 - RNA, 19 nt, Homo sapiens
gaagggaggcagugauagu

SEQ ID NO: 113820 - RNA, 19 nt, Homo sapiens
gaucaugacagagcuauuc

SEQ ID NO: 113821 - RNA, 19 nt, Homo sapiens
agaaagagcgcuagcuuca

SEQ ID NO: 113822 - RNA, 19 nt, Homo sapiens
gguauucccuuacuuucca

SEQ ID NO: 113823 - RNA, 19 nt, Homo sapiens
caagcuaacuucggauuac

SEQ ID NO: 113824 - RNA, 19 nt, Homo sapiens
ucgagacccuacagcauuu

SEQ ID NO: 113825 - RNA, 19 nt, Homo sapiens
caggacaagugaagaagau

SEQ ID NO: 113826 - RNA, 19 nt, Homo sapiens
ccuuagagcgcacuaguuu

SEQ ID NO: 113827 - RNA, 19 nt, Homo sapiens
aaacugaccuaugaugaag

SEQ ID NO: 113828 - RNA, 19 nt, Homo sapiens
ugcaauaucccaucacaaa

SEQ ID NO: 113829 - RNA, 19 nt, Homo sapiens
ggacaagugaagaagauuc

SEQ ID NO: 113830 - RNA, 19 nt, Homo sapiens
aaagugggccagauauuug

SEQ ID NO: 113831 - RNA, 19 nt, Homo sapiens
ccaaacugaccuaugauga

SEQ ID NO: 113832 - RNA, 19 nt, Homo sapiens
gugaggugauugaaggauu

SEQ ID NO: 113833 - RNA, 19 nt, Homo sapiens
ccaagcuaacuucggauua

SEQ ID NO: 113834 - RNA, 19 nt, Homo sapiens
aaagagcgcuagcuucacu

SEQ ID NO: 113835 - RNA, 19 nt, Homo sapiens
gagacauucugcacacaca

SEQ ID NO: 113836 - RNA, 19 nt, Homo sapiens
gcaagcuugucucaaugau

SEQ ID NO: 113837 - RNA, 19 nt, Homo sapiens
gugcaagcuugucucaaug

SEQ ID NO: 113838 - RNA, 19 nt, Homo sapiens
gcuacaaucucaauuuuca

SEQ ID NO: 113839 - RNA, 19 nt, Homo sapiens
gcgcuacaaucucaauuuu

SEQ ID NO: 113840 - RNA, 19 nt, Homo sapiens
agaugauacuguuguggua

SEQ ID NO: 113841 - RNA, 19 nt, Homo sapiens
ucaaggaaguggauguuuu

SEQ ID NO: 113842 - RNA, 19 nt, Homo sapiens
aaacuuaaggugaggagaa

SEQ ID NO: 113843 - RNA, 19 nt, Homo sapiens
acaacugaaugugcccuua

SEQ ID NO: 113844 - RNA, 19 nt, Homo sapiens
ugauggcucugugcaauau

SEQ ID NO: 113845 - RNA, 19 nt, Homo sapiens
gauuagaagaugauacugu

SEQ ID NO: 113846 - RNA, 19 nt, Homo sapiens
gauugaaggauuagaagau

SEQ ID NO: 113847 - RNA, 19 nt, Homo sapiens
gcucaggaauccauaaaau

SEQ ID NO: 113848 - RNA, 19 nt, Homo sapiens
caggguagaguguuucuga

SEQ ID NO: 113849 - RNA, 19 nt, Homo sapiens
gcauuuggcucaggaaucc

SEQ ID NO: 113850 - RNA, 19 nt, Homo sapiens
caacuauacucuggaucau

SEQ ID NO: 113851 - RNA, 19 nt, Homo sapiens
agacaacuauacucuggau

SEQ ID NO: 113852 - RNA, 19 nt, Homo sapiens
cugcugggcugaucaucuu

SEQ ID NO: 113853 - RNA, 19 nt, Homo sapiens
ugugguagcacuggacuua

SEQ ID NO: 113854 - RNA, 19 nt, Homo sapiens
ggugauugaaggauuagaa

SEQ ID NO: 113855 - RNA, 19 nt, Homo sapiens
gcaauaucccaucacaaag

SEQ ID NO: 113856 - RNA, 19 nt, Homo sapiens
gaaggauuagaagaugaua

SEQ ID NO: 113857 - RNA, 19 nt, Homo sapiens
acacugccauguaaauuuu

SEQ ID NO: 113858 - RNA, 19 nt, Homo sapiens
gcgcuagcuucacuugauc

SEQ ID NO: 113859 - RNA, 19 nt, Homo sapiens
uuaagaacaugugaaaggu

SEQ ID NO: 113860 - RNA, 19 nt, Homo sapiens
gagcauacaacugaaugug

SEQ ID NO: 113861 - RNA, 19 nt, Homo sapiens
ggauuugggaggagaacuu

SEQ ID NO: 113862 - RNA, 19 nt, Homo sapiens
gauauaagugugaggugau

SEQ ID NO: 113863 - RNA, 19 nt, Homo sapiens
gggaggcagugauagugau

SEQ ID NO: 113864 - RNA, 19 nt, Homo sapiens
cacagagguggcaauguua

SEQ ID NO: 113865 - RNA, 19 nt, Homo sapiens
gaucaucuuucagacaacu

SEQ ID NO: 113866 - RNA, 19 nt, Homo sapiens
uaagcuguauggugucuac

SEQ ID NO: 113867 - RNA, 19 nt, Homo sapiens
gugauggcucugugcaaua

SEQ ID NO: 113868 - RNA, 19 nt, Homo sapiens
cuuacaaggugugguauuc

SEQ ID NO: 113869 - RNA, 19 nt, Homo sapiens
cugaagggaggcagugaua

SEQ ID NO: 113870 - RNA, 19 nt, Homo sapiens
uaacuucggauuaccucaa

SEQ ID NO: 113871 - RNA, 19 nt, Homo sapiens
gaucuccagcuuccaacuu

SEQ ID NO: 113872 - RNA, 19 nt, Homo sapiens
agucaggaacuacggauuu

SEQ ID NO: 113873 - RNA, 19 nt, Homo sapiens
gcccagagacaaacuuaag

SEQ ID NO: 113874 - RNA, 19 nt, Homo sapiens
uuagagcgcacuaguuuua

SEQ ID NO: 113875 - RNA, 19 nt, Homo sapiens
aagcagauaugauguuuuc

SEQ ID NO: 113876 - RNA, 19 nt, Homo sapiens
ggcgcuacaaucucaauuu

SEQ ID NO: 113877 - RNA, 19 nt, Homo sapiens
agaagaugauacuguugug

SEQ ID NO: 113878 - RNA, 19 nt, Homo sapiens
acaacuauacucuggauca

SEQ ID NO: 113879 - RNA, 19 nt, Homo sapiens
caacugaaugugcccuuag

SEQ ID NO: 113880 - RNA, 19 nt, Homo sapiens
caauuucaauggccguuuu

SEQ ID NO: 113881 - RNA, 19 nt, Homo sapiens
uagaagaugauacuguugu

SEQ ID NO: 113882 - RNA, 19 nt, Homo sapiens
gaauuaaguggaccaagcu

SEQ ID NO: 113883 - RNA, 19 nt, Homo sapiens
uauggugucuacugcuuca

SEQ ID NO: 113884 - RNA, 19 nt, Homo sapiens
uguauggugucuacugcuu

SEQ ID NO: 113885 - RNA, 19 nt, Homo sapiens
gauuugggaggagaacuuu

SEQ ID NO: 113886 - RNA, 19 nt, Homo sapiens
ggugagaaagugccuccuu

SEQ ID NO: 113887 - RNA, 19 nt, Homo sapiens
uugaaggauuagaagauga

SEQ ID NO: 113888 - RNA, 19 nt, Homo sapiens
agaccucacucuggaagau

SEQ ID NO: 113889 - RNA, 19 nt, Homo sapiens
gcaaaagugggccagauau

SEQ ID NO: 113890 - RNA, 19 nt, Homo sapiens
ucaaugauggugcucagau

SEQ ID NO: 113891 - RNA, 19 nt, Homo sapiens
ggugugguauucccuuacu

SEQ ID NO: 113892 - RNA, 19 nt, Homo sapiens
accucacucuggaagauua

SEQ ID NO: 113893 - RNA, 19 nt, Homo sapiens
agagcaagccaagguguuu

SEQ ID NO: 113894 - RNA, 19 nt, Homo sapiens
ccuggaaaauucucggaua

SEQ ID NO: 113895 - RNA, 19 nt, Homo sapiens
ccaagacccuccacagaug

SEQ ID NO: 113896 - RNA, 19 nt, Homo sapiens
guggauagcuuggaauuca

SEQ ID NO: 113897 - RNA, 19 nt, Homo sapiens
ggaaguuucagaucuugua

SEQ ID NO: 113898 - RNA, 19 nt, Homo sapiens
ggagguggcucugaagauc

SEQ ID NO: 113899 - RNA, 19 nt, Homo sapiens
ucuccgagcuccuauuuca

SEQ ID NO: 113900 - RNA, 19 nt, Homo sapiens
gugaggagguggcucugaa

SEQ ID NO: 113901 - RNA, 19 nt, Homo sapiens
cagagugccuggaaguuuc

SEQ ID NO: 113902 - RNA, 19 nt, Homo sapiens
guucagguuugguucaaga

SEQ ID NO: 113903 - RNA, 19 nt, Homo sapiens
ggagcuggaggcacuguuu

SEQ ID NO: 113904 - RNA, 19 nt, Homo sapiens
ggucuccgagcuccuauuu

SEQ ID NO: 113905 - RNA, 19 nt, Homo sapiens
gaucagagugccuggaagu

SEQ ID NO: 113906 - RNA, 19 nt, Homo sapiens
ccauggacccucuggacua

SEQ ID NO: 113907 - RNA, 19 nt, Homo sapiens
ucagagugccuggaaguuu

SEQ ID NO: 113908 - RNA, 19 nt, Homo sapiens
gcaccuggaaauucaccua

SEQ ID NO: 113909 - RNA, 19 nt, Homo sapiens
ccuggaaguuucagaucuu

SEQ ID NO: 113910 - RNA, 19 nt, Homo sapiens
ggacuacaaggaucagagu

SEQ ID NO: 113911 - RNA, 19 nt, Homo sapiens
ccuggaaauucaccuacaa

SEQ ID NO: 113912 - RNA, 19 nt, Homo sapiens
ucaagaaccggagggcuaa

SEQ ID NO: 113913 - RNA, 19 nt, Homo sapiens
ggaaauucaccuacaaucc

SEQ ID NO: 113914 - RNA, 19 nt, Homo sapiens
ccaguacccagacgucuau

SEQ ID NO: 113915 - RNA, 19 nt, Homo sapiens
gucaacgccuuggcccuaa

SEQ ID NO: 113916 - RNA, 19 nt, Homo sapiens
ccacgggcaccuggaaauu

SEQ ID NO: 113917 - RNA, 19 nt, Homo sapiens
gaggagguggcucugaaga

SEQ ID NO: 113918 - RNA, 19 nt, Homo sapiens
gagcuggaggcacuguuug

SEQ ID NO: 113919 - RNA, 19 nt, Homo sapiens
gaaccggagggcuaaaugc

SEQ ID NO: 113920 - RNA, 19 nt, Homo sapiens
gaaguuucagaucuuguag

SEQ ID NO: 113921 - RNA, 19 nt, Homo sapiens
gccuggaaguuucagaucu

SEQ ID NO: 113922 - RNA, 19 nt, Homo sapiens
acgggcaccuggaaauuca

SEQ ID NO: 113923 - RNA, 19 nt, Homo sapiens
gcagcgacagcagcagaaa

SEQ ID NO: 113924 - RNA, 19 nt, Homo sapiens
ggguucagguuugguucaa

SEQ ID NO: 113925 - RNA, 19 nt, Homo sapiens
cccaagacccuccacagau

SEQ ID NO: 113926 - RNA, 19 nt, Homo sapiens
uggauagcuuggaauucaa

SEQ ID NO: 113927 - RNA, 19 nt, Homo sapiens
aguccaggguucagguuug

SEQ ID NO: 113928 - RNA, 19 nt, Homo sapiens
gagguggcucugaagauca

SEQ ID NO: 113929 - RNA, 19 nt, Homo sapiens
caagacccuccacagaugu

SEQ ID NO: 113930 - RNA, 19 nt, Homo sapiens
ggaaagcaguuacauauug

SEQ ID NO: 113931 - RNA, 19 nt, Homo sapiens
gaaagcaguuacauauuga

SEQ ID NO: 113932 - RNA, 19 nt, Homo sapiens
caagagaauuugcuuaaug

SEQ ID NO: 113933 - RNA, 19 nt, Homo sapiens
gaaugaagguauuugaaga

SEQ ID NO: 113934 - RNA, 19 nt, Homo sapiens
ugaaagaccucgaaugaau

SEQ ID NO: 113935 - RNA, 19 nt, Homo sapiens
gaacgagacgcagcuauua

SEQ ID NO: 113936 - RNA, 19 nt, Homo sapiens
gaagaauuauugcuugaug

SEQ ID NO: 113937 - RNA, 19 nt, Homo sapiens
gcacaacuccucugucuga

SEQ ID NO: 113938 - RNA, 19 nt, Homo sapiens
ggaaaggcauuuggaaaga

SEQ ID NO: 113939 - RNA, 19 nt, Homo sapiens
gacaaccgccucuaacuua

SEQ ID NO: 113940 - RNA, 19 nt, Homo sapiens
gaagaggacacacagagua

SEQ ID NO: 113941 - RNA, 19 nt, Homo sapiens
caacuccucugucugauga

SEQ ID NO: 113942 - RNA, 19 nt, Homo sapiens
guggaaguaucauguguua

SEQ ID NO: 113943 - RNA, 19 nt, Homo sapiens
gagaacagaucccaaugga

SEQ ID NO: 113944 - RNA, 19 nt, Homo sapiens
gaggcaagccguuugaaua

SEQ ID NO: 113945 - RNA, 19 nt, Homo sapiens
gacugaagcuggaguagaa

SEQ ID NO: 113946 - RNA, 19 nt, Homo sapiens
uuaagaaacuggcgacuga

SEQ ID NO: 113947 - RNA, 19 nt, Homo sapiens
gaaaggcauuuggaaagaa

SEQ ID NO: 113948 - RNA, 19 nt, Homo sapiens
gagacuauaucaggcguua

SEQ ID NO: 113949 - RNA, 19 nt, Homo sapiens
ggauguggcugucuuguag

SEQ ID NO: 113950 - RNA, 19 nt, Homo sapiens
agacgcagcuauuaagaaa

SEQ ID NO: 113951 - RNA, 19 nt, Homo sapiens
cagcagcuuucacgauaua

SEQ ID NO: 113952 - RNA, 19 nt, Homo sapiens
aagcuuggguggcaaauuu

SEQ ID NO: 113953 - RNA, 19 nt, Homo sapiens
gauaaugucguaauccaaa

SEQ ID NO: 113954 - RNA, 19 nt, Homo sapiens
gaagaaggaaugaagguau

SEQ ID NO: 113955 - RNA, 19 nt, Homo sapiens
ucacagaggacaauuggua

SEQ ID NO: 113956 - RNA, 19 nt, Homo sapiens
agagacagagcacuaauua

SEQ ID NO: 113957 - RNA, 19 nt, Homo sapiens
gaaaauaucccagguugua

SEQ ID NO: 113958 - RNA, 19 nt, Homo sapiens
acagagcacuaauuagaaa

SEQ ID NO: 113959 - RNA, 19 nt, Homo sapiens
uaaguucucugucucuguu

SEQ ID NO: 113960 - RNA, 19 nt, Homo sapiens
ggaaguaucauguguuaag

SEQ ID NO: 113961 - RNA, 19 nt, Homo sapiens
agacagagcacuaauuaga

SEQ ID NO: 113962 - RNA, 19 nt, Homo sapiens
ucagcaaacucaccuguug

SEQ ID NO: 113963 - RNA, 19 nt, Homo sapiens
ggaaggaaacccuaucugu

SEQ ID NO: 113964 - RNA, 19 nt, Homo sapiens
acuaacagaucucuacaaa

SEQ ID NO: 113965 - RNA, 19 nt, Homo sapiens
uaacacagacaguauaugu

SEQ ID NO: 113966 - RNA, 19 nt, Homo sapiens
gauggaaagcaguuacaua

SEQ ID NO: 113967 - RNA, 19 nt, Homo sapiens
aaacucaccuguugaagca

SEQ ID NO: 113968 - RNA, 19 nt, Homo sapiens
ggaugaaacagaucuauca

SEQ ID NO: 113969 - RNA, 19 nt, Homo sapiens
ggacaggcuuuccauggau

SEQ ID NO: 113970 - RNA, 19 nt, Homo sapiens
gcacuuacucguuuggaaa

SEQ ID NO: 113971 - RNA, 19 nt, Homo sapiens
ggaacgagacgcagcuauu

SEQ ID NO: 113972 - RNA, 19 nt, Homo sapiens
aaauuaaacucccgucugu

SEQ ID NO: 113973 - RNA, 19 nt, Homo sapiens
acacagacaguauauguuu

SEQ ID NO: 113974 - RNA, 19 nt, Homo sapiens
cuaagaggcuucccugcaa

SEQ ID NO: 113975 - RNA, 19 nt, Homo sapiens
cugaagcacuuacucguuu

SEQ ID NO: 113976 - RNA, 19 nt, Homo sapiens
ggacaaccgccucuaacuu

SEQ ID NO: 113977 - RNA, 19 nt, Homo sapiens
ggaguagaagucauuguaa

SEQ ID NO: 113978 - RNA, 19 nt, Homo sapiens
gcgaaggugucggcuauga

SEQ ID NO: 113979 - RNA, 19 nt, Homo sapiens
uauaugaccuagacaagau

SEQ ID NO: 113980 - RNA, 19 nt, Homo sapiens
gaaagaccucgaaugaaug

SEQ ID NO: 113981 - RNA, 19 nt, Homo sapiens
gguauuguagccucuguua

SEQ ID NO: 113982 - RNA, 19 nt, Homo sapiens
ggaguuaauuauccuaaac

SEQ ID NO: 113983 - RNA, 19 nt, Homo sapiens
gcuauugcccuguugguuu

SEQ ID NO: 113984 - RNA, 19 nt, Homo sapiens
ggaagaaggaaugaaggua

SEQ ID NO: 113985 - RNA, 19 nt, Homo sapiens
cggagaaacugaagcacuu

SEQ ID NO: 113986 - RNA, 19 nt, Homo sapiens
caacuguuauggcgugaau

SEQ ID NO: 113987 - RNA, 19 nt, Homo sapiens
gaaguaucauguguuaagu

SEQ ID NO: 113988 - RNA, 19 nt, Homo sapiens
ggaaugcaccagaagguau

SEQ ID NO: 113989 - RNA, 19 nt, Homo sapiens
ggaaugaagguauuugaag

SEQ ID NO: 113990 - RNA, 19 nt, Homo sapiens
caaccuccauucaucuuuc

SEQ ID NO: 113991 - RNA, 19 nt, Homo sapiens
aaaggcauuuggaaagaaa

SEQ ID NO: 113992 - RNA, 19 nt, Homo sapiens
gaguagaagucauuguaag

SEQ ID NO: 113993 - RNA, 19 nt, Homo sapiens
gcaagccguuugaauaucg

SEQ ID NO: 113994 - RNA, 19 nt, Homo sapiens
uaagaggcuucccugcaaa

SEQ ID NO: 113995 - RNA, 19 nt, Homo sapiens
gcagauuggagcauaaaug

SEQ ID NO: 113996 - RNA, 19 nt, Homo sapiens
aagaaggaaugaagguauu

SEQ ID NO: 113997 - RNA, 19 nt, Homo sapiens
uagagacaauuacuucaga

SEQ ID NO: 113998 - RNA, 19 nt, Homo sapiens
gaucauagaacucaauggu

SEQ ID NO: 113999 - RNA, 19 nt, Homo sapiens
ucaagggagugguauuuua

SEQ ID NO: 114000 - RNA, 19 nt, Homo sapiens
aauaauccacgcuuugaua

SEQ ID NO: 114001 - RNA, 19 nt, Homo sapiens
ggagaaacugaagcacuua

SEQ ID NO: 114002 - RNA, 19 nt, Homo sapiens
gagccuccuuccuugaauu

SEQ ID NO: 114003 - RNA, 19 nt, Homo sapiens
uaguauagacccaucgaua

SEQ ID NO: 114004 - RNA, 19 nt, Homo sapiens
uggcaucaguaccuucuaa

SEQ ID NO: 114005 - RNA, 19 nt, Homo sapiens
aagcgaaggugucggcuau

SEQ ID NO: 114006 - RNA, 19 nt, Homo sapiens
ucagauuccuugggauaaa

SEQ ID NO: 114007 - RNA, 19 nt, Homo sapiens
guucagauuccuugggaua

SEQ ID NO: 114008 - RNA, 19 nt, Homo sapiens
gugcacaacuccucugucu

SEQ ID NO: 114009 - RNA, 19 nt, Homo sapiens
ggaucuugaugccaaucua

SEQ ID NO: 114010 - RNA, 19 nt, Homo sapiens
gacagagcacuaauuagaa

SEQ ID NO: 114011 - RNA, 19 nt, Homo sapiens
gaggacacacagaguauug

SEQ ID NO: 114012 - RNA, 19 nt, Homo sapiens
gaaaggaugaaacagaucu

SEQ ID NO: 114013 - RNA, 19 nt, Homo sapiens
gacuauaucaggcguuauu

SEQ ID NO: 114014 - RNA, 19 nt, Homo sapiens
gaagagcuagguuuugaua

SEQ ID NO: 114015 - RNA, 19 nt, Homo sapiens
caaccgccucuaacuuaua

SEQ ID NO: 114016 - RNA, 19 nt, Homo sapiens
guagaagucauuguaagaa

SEQ ID NO: 114017 - RNA, 19 nt, Homo sapiens
caauugaguaugauucuga

SEQ ID NO: 114018 - RNA, 19 nt, Homo sapiens
gaauacuguugcagcugaa

SEQ ID NO: 114019 - RNA, 19 nt, Homo sapiens
gaguauugguccuaaaguc

SEQ ID NO: 114020 - RNA, 19 nt, Homo sapiens
ucgaaaggaugaaacagau

SEQ ID NO: 114021 - RNA, 19 nt, Homo sapiens
uuauuugccuguccuaaga

SEQ ID NO: 114022 - RNA, 19 nt, Homo sapiens
ugaugaccaugaugagaaa

SEQ ID NO: 114023 - RNA, 19 nt, Homo sapiens
caaacuaacagaucucuac

SEQ ID NO: 114024 - RNA, 19 nt, Homo sapiens
gaaauauggagucccuuca

SEQ ID NO: 114025 - RNA, 19 nt, Homo sapiens
gacaagaucauagaacuca

SEQ ID NO: 114026 - RNA, 19 nt, Homo sapiens
ucaguaccuucuaauccua

SEQ ID NO: 114027 - RNA, 19 nt, Homo sapiens
gaauaucgaaaggaugaaa

SEQ ID NO: 114028 - RNA, 19 nt, Homo sapiens
ucacugcuauugcccuguu

SEQ ID NO: 114029 - RNA, 19 nt, Homo sapiens
gacaggcuuuccauggauu

SEQ ID NO: 114030 - RNA, 19 nt, Homo sapiens
ggaaugaggguuugagaga

SEQ ID NO: 114031 - RNA, 19 nt, Homo sapiens
uaccaaagcugaacaugga

SEQ ID NO: 114032 - RNA, 19 nt, Homo sapiens
gaaggugcaggacgacuuu

SEQ ID NO: 114033 - RNA, 19 nt, Homo sapiens
ggacgaccacggcuacauu

SEQ ID NO: 114034 - RNA, 19 nt, Homo sapiens
ggacaaguucgucaucuuc

SEQ ID NO: 114035 - RNA, 19 nt, Homo sapiens
ucacauggaaugaggguuu

SEQ ID NO: 114036 - RNA, 19 nt, Homo sapiens
caauaaacagcaggugaua

SEQ ID NO: 114037 - RNA, 19 nt, Homo sapiens
gggacaaguucgucaucuu

SEQ ID NO: 114038 - RNA, 19 nt, Homo sapiens
gauccgaccgggacaaguu

SEQ ID NO: 114039 - RNA, 19 nt, Homo sapiens
gagcagccaggagagcuua

SEQ ID NO: 114040 - RNA, 19 nt, Homo sapiens
ccucacacuccuuuagaua

SEQ ID NO: 114041 - RNA, 19 nt, Homo sapiens
ggacgacuuuguggagauc

SEQ ID NO: 114042 - RNA, 19 nt, Homo sapiens
gcaccucacacuccuuuag

SEQ ID NO: 114043 - RNA, 19 nt, Homo sapiens
gacgaccacggcuacauuu

SEQ ID NO: 114044 - RNA, 19 nt, Homo sapiens
cuacauuucccgugaguuc

SEQ ID NO: 114045 - RNA, 19 nt, Homo sapiens
gggugucugucuuccuuug

SEQ ID NO: 114046 - RNA, 19 nt, Homo sapiens
ucaauaaacagcaggugau

SEQ ID NO: 114047 - RNA, 19 nt, Homo sapiens
auaaacagcaggugauaca

SEQ ID NO: 114048 - RNA, 19 nt, Homo sapiens
aaacagcaggugauacaag

SEQ ID NO: 114049 - RNA, 19 nt, Homo sapiens
ucacacuccuuuagauagc

SEQ ID NO: 114050 - RNA, 19 nt, Homo sapiens
ccgauggcaugcugaccuu

SEQ ID NO: 114051 - RNA, 19 nt, Homo sapiens
cggcaucucugagguucga

SEQ ID NO: 114052 - RNA, 19 nt, Homo sapiens
cacauggaaugaggguuug

SEQ ID NO: 114053 - RNA, 19 nt, Homo sapiens
ccgcaccucacacuccuuu

SEQ ID NO: 114054 - RNA, 19 nt, Homo sapiens
gcacccagcugguuugaca

SEQ ID NO: 114055 - RNA, 19 nt, Homo sapiens
cuucaucccugucaucuga

SEQ ID NO: 114056 - RNA, 19 nt, Homo sapiens
ugauugaggugcauggaaa

SEQ ID NO: 114057 - RNA, 19 nt, Homo sapiens
uagaugcccuuucuugaau

SEQ ID NO: 114058 - RNA, 19 nt, Homo sapiens
gaagagaagccugcuguca

SEQ ID NO: 114059 - RNA, 19 nt, Homo sapiens
ugacuagugcugaagcuua

SEQ ID NO: 114060 - RNA, 19 nt, Homo sapiens
gaucccagcugauguagac

SEQ ID NO: 114061 - RNA, 19 nt, Homo sapiens
gacuagugcugaagcuuau

SEQ ID NO: 114062 - RNA, 19 nt, Homo sapiens
guagacccucucaccauua

SEQ ID NO: 114063 - RNA, 19 nt, Homo sapiens
gugcugaagcuuauuaaug

SEQ ID NO: 114064 - RNA, 19 nt, Homo sapiens
aaauagaugcccuuucuug

SEQ ID NO: 114065 - RNA, 19 nt, Homo sapiens
uguagacccucucaccauu

SEQ ID NO: 114066 - RNA, 19 nt, Homo sapiens
gaugcccuuucuugaauug

SEQ ID NO: 114067 - RNA, 19 nt, Homo sapiens
gcccaaauuaucaagcuaa

SEQ ID NO: 114068 - RNA, 19 nt, Homo sapiens
gagcgcaccauucccauca

SEQ ID NO: 114069 - RNA, 19 nt, Homo sapiens
gugaaugaaagucuuguga

SEQ ID NO: 114070 - RNA, 19 nt, Homo sapiens
caagaaauagaugcccuuu

SEQ ID NO: 114071 - RNA, 19 nt, Homo sapiens
guuaagguguugggagaug

SEQ ID NO: 114072 - RNA, 19 nt, Homo sapiens
cuagugcugaagcuuauua

SEQ ID NO: 114073 - RNA, 19 nt, Homo sapiens
guuugacacuggacucuca

SEQ ID NO: 114074 - RNA, 19 nt, Homo sapiens
gaagagcgccaggaugaac

SEQ ID NO: 114075 - RNA, 19 nt, Homo sapiens
gguguugggagaugugauu

SEQ ID NO: 114076 - RNA, 19 nt, Homo sapiens
acucaaaguuaagguguug

SEQ ID NO: 114077 - RNA, 19 nt, Homo sapiens
ggcccaaauuaucaagcua

SEQ ID NO: 114078 - RNA, 19 nt, Homo sapiens
auagaugcccuuucuugaa

SEQ ID NO: 114079 - RNA, 19 nt, Homo sapiens
augaagagcgccaggauga

SEQ ID NO: 114080 - RNA, 19 nt, Homo sapiens
ugcugaagcuuauuaaugc

SEQ ID NO: 114081 - RNA, 19 nt, Homo sapiens
aauagaugcccuuucuuga

SEQ ID NO: 114082 - RNA, 19 nt, Homo sapiens
gcgccaggaugaacauggu

SEQ ID NO: 114083 - RNA, 19 nt, Homo sapiens
gcacuucuccccagaggaa

SEQ ID NO: 114084 - RNA, 19 nt, Homo sapiens
ccggaucccagcugaugua

SEQ ID NO: 114085 - RNA, 19 nt, Homo sapiens
acacucaccuagccaccau

SEQ ID NO: 114086 - RNA, 19 nt, Homo sapiens
gugaauggaccaaggaaac

SEQ ID NO: 114087 - RNA, 19 nt, Homo sapiens
gacccucucaccauuacuu

SEQ ID NO: 114088 - RNA, 19 nt, Homo sapiens
ccagugaaugaaagucuug

SEQ ID NO: 114089 - RNA, 19 nt, Homo sapiens
gccaggaugaacaugguuu

SEQ ID NO: 114090 - RNA, 19 nt, Homo sapiens
guugggagaugugauugag

SEQ ID NO: 114091 - RNA, 19 nt, Homo sapiens
cagagaugcgccuggagaa

SEQ ID NO: 114092 - RNA, 19 nt, Homo sapiens
ucggagagcaccuguugga

SEQ ID NO: 114093 - RNA, 19 nt, Homo sapiens
agaugcgccuggagaagga

SEQ ID NO: 114094 - RNA, 19 nt, Homo sapiens
cuucggagagcaccuguug

SEQ ID NO: 114095 - RNA, 19 nt, Homo sapiens
gauaauuccucaagcauga

SEQ ID NO: 114096 - RNA, 19 nt, Homo sapiens
gaagucggcuccaugaaga

SEQ ID NO: 114097 - RNA, 19 nt, Homo sapiens
ggaggagacuauaaacauu

SEQ ID NO: 114098 - RNA, 19 nt, Homo sapiens
gaaaguggcgccuggauug

SEQ ID NO: 114099 - RNA, 19 nt, Homo sapiens
gcuaagcacucuagaaagu

SEQ ID NO: 114100 - RNA, 19 nt, Homo sapiens
ggagaucucugacgacuac

SEQ ID NO: 114101 - RNA, 19 nt, Homo sapiens
cauaaggagucuaagauga

SEQ ID NO: 114102 - RNA, 19 nt, Homo sapiens
ucacagacauugcuuucaa

SEQ ID NO: 114103 - RNA, 19 nt, Homo sapiens
uaagcacucuagaaaguuu

SEQ ID NO: 114104 - RNA, 19 nt, Homo sapiens
aauguuagcuggugaaauc

SEQ ID NO: 114105 - RNA, 19 nt, Homo sapiens
cuggugaaauccacaauaa

SEQ ID NO: 114106 - RNA, 19 nt, Homo sapiens
uaucguggguaucaguaua

SEQ ID NO: 114107 - RNA, 19 nt, Homo sapiens
ggaaaguggcgccuggauu

SEQ ID NO: 114108 - RNA, 19 nt, Homo sapiens
gccaugggcugguucaaca

SEQ ID NO: 114109 - RNA, 19 nt, Homo sapiens
gcgccuggauugguuauga

SEQ ID NO: 114110 - RNA, 19 nt, Homo sapiens
gaggagacuauaaacauug

SEQ ID NO: 114111 - RNA, 19 nt, Homo sapiens
gcaagaggauggaguucac

SEQ ID NO: 114112 - RNA, 19 nt, Homo sapiens
caguauaucuuggaaugug

SEQ ID NO: 114113 - RNA, 19 nt, Homo sapiens
ggugaaauccacaauaaac

SEQ ID NO: 114114 - RNA, 19 nt, Homo sapiens
cacagacauugcuuucaaa

SEQ ID NO: 114115 - RNA, 19 nt, Homo sapiens
gaccaucuuugagaaggaa

SEQ ID NO: 114116 - RNA, 19 nt, Homo sapiens
cuaaucauaaggagucuaa

SEQ ID NO: 114117 - RNA, 19 nt, Homo sapiens
gcuggugaaauccacaaua

SEQ ID NO: 114118 - RNA, 19 nt, Homo sapiens
uauaaacauuggagagagu

SEQ ID NO: 114119 - RNA, 19 nt, Homo sapiens
ggaguaaugccuaccacau

SEQ ID NO: 114120 - RNA, 19 nt, Homo sapiens
caucauggaggagacuaua

SEQ ID NO: 114121 - RNA, 19 nt, Homo sapiens
gaaggaaaacuuuauugga

SEQ ID NO: 114122 - RNA, 19 nt, Homo sapiens
gcucacagacauugcuuuc

SEQ ID NO: 114123 - RNA, 19 nt, Homo sapiens
gcuccaaguacgauaauuc

SEQ ID NO: 114124 - RNA, 19 nt, Homo sapiens
ucauggaggagacuauaaa

SEQ ID NO: 114125 - RNA, 19 nt, Homo sapiens
caacaguagcugauuaaaa

SEQ ID NO: 114126 - RNA, 19 nt, Homo sapiens
auccaacaguagcugauua

SEQ ID NO: 114127 - RNA, 19 nt, Homo sapiens
guaucaguauaucuuggaa

SEQ ID NO: 114128 - RNA, 19 nt, Homo sapiens
ucgcagauccaaucgauuc

SEQ ID NO: 114129 - RNA, 19 nt, Homo sapiens
ggccuggguuugcuaccaa

SEQ ID NO: 114130 - RNA, 19 nt, Homo sapiens
cgaagucggcuccaugaag

SEQ ID NO: 114131 - RNA, 19 nt, Homo sapiens
aaucauaaggagucuaaga

SEQ ID NO: 114132 - RNA, 19 nt, Homo sapiens
ucuaugaucaggagaacuu

SEQ ID NO: 114133 - RNA, 19 nt, Homo sapiens
caccagcuccuguccaaau

SEQ ID NO: 114134 - RNA, 19 nt, Homo sapiens
guucagcuaaucauaagga

SEQ ID NO: 114135 - RNA, 19 nt, Homo sapiens
uacgauaauuccucaagca

SEQ ID NO: 114136 - RNA, 19 nt, Homo sapiens
aacaguagcugauuaaaag

SEQ ID NO: 114137 - RNA, 19 nt, Homo sapiens
agacuucgcagauccaauc

SEQ ID NO: 114138 - RNA, 19 nt, Homo sapiens
gcucucaugcccagacuuc

SEQ ID NO: 114139 - RNA, 19 nt, Homo sapiens
ucauaaggagucuaagaug

SEQ ID NO: 114140 - RNA, 19 nt, Homo sapiens
ucuguucagcuaaucauaa

SEQ ID NO: 114141 - RNA, 19 nt, Homo sapiens
cuucgcagauccaaucgau

SEQ ID NO: 114142 - RNA, 19 nt, Homo sapiens
uggaggagacuauaaacau

SEQ ID NO: 114143 - RNA, 19 nt, Homo sapiens
gccagugggagaucucuga

SEQ ID NO: 114144 - RNA, 19 nt, Homo sapiens
gagcgcaguuuugauaaug

SEQ ID NO: 114145 - RNA, 19 nt, Homo sapiens
ggacgccagugggagaucu

SEQ ID NO: 114146 - RNA, 19 nt, Homo sapiens
aaagcuccaaguacgauaa

SEQ ID NO: 114147 - RNA, 19 nt, Homo sapiens
gguaucaguauaucuugga

SEQ ID NO: 114148 - RNA, 19 nt, Homo sapiens
guggguaucaguauaucuu

SEQ ID NO: 114149 - RNA, 19 nt, Homo sapiens
ccaagauggcucagaccaa

SEQ ID NO: 114150 - RNA, 19 nt, Homo sapiens
caaauguuagcuggugaaa

SEQ ID NO: 114151 - RNA, 19 nt, Homo sapiens
aucaguauaucuuggaaug

SEQ ID NO: 114152 - RNA, 19 nt, Homo sapiens
gagaaggaaaacuuuauug

SEQ ID NO: 114153 - RNA, 19 nt, Homo sapiens
ugaccaucuuugagaagga

SEQ ID NO: 114154 - RNA, 19 nt, Homo sapiens
aguauaucuuggaauguga

SEQ ID NO: 114155 - RNA, 19 nt, Homo sapiens
ugaaauccacaauaaacgu

SEQ ID NO: 114156 - RNA, 19 nt, Homo sapiens
ucaaauguuagcuggugaa

SEQ ID NO: 114157 - RNA, 19 nt, Homo sapiens
uccaacaguagcugauuaa

SEQ ID NO: 114158 - RNA, 19 nt, Homo sapiens
gaauccaacaguagcugau

SEQ ID NO: 114159 - RNA, 19 nt, Homo sapiens
gcggagaguucuguacuua

SEQ ID NO: 114160 - RNA, 19 nt, Homo sapiens
caauaaagguuccugaauc

SEQ ID NO: 114161 - RNA, 19 nt, Homo sapiens
ggauguggguucccucaaa

SEQ ID NO: 114162 - RNA, 19 nt, Homo sapiens
gcguuuggguggccuuuga

SEQ ID NO: 114163 - RNA, 19 nt, Homo sapiens
aauaaagguuccugaaucu

SEQ ID NO: 114164 - RNA, 19 nt, Homo sapiens
ggagaguucuguacuuacg

SEQ ID NO: 114165 - RNA, 19 nt, Homo sapiens
uaaagguuccugaaucuuc

SEQ ID NO: 114166 - RNA, 19 nt, Homo sapiens
gauguggguucccucaaag

SEQ ID NO: 114167 - RNA, 19 nt, Homo sapiens
aguuugaccucguugauga

SEQ ID NO: 114168 - RNA, 19 nt, Homo sapiens
uuccaaggcugcaaguuug

SEQ ID NO: 114169 - RNA, 19 nt, Homo sapiens
ucaauaaagguuccugaau

SEQ ID NO: 114170 - RNA, 19 nt, Homo sapiens
cuaccgaggcuaccaguau

SEQ ID NO: 114171 - RNA, 19 nt, Homo sapiens
gcaaguuugaccucguuga

SEQ ID NO: 114172 - RNA, 19 nt, Homo sapiens
cuuccaaggcugcaaguuu

SEQ ID NO: 114173 - RNA, 19 nt, Homo sapiens
gaggcuaccaguauguguu

SEQ ID NO: 114174 - RNA, 19 nt, Homo sapiens
uaccgaggcuaccaguaug

SEQ ID NO: 114175 - RNA, 19 nt, Homo sapiens
ugaccucguugaugacuac

SEQ ID NO: 114176 - RNA, 19 nt, Homo sapiens
caaguuugaccucguugau

SEQ ID NO: 114177 - RNA, 19 nt, Homo sapiens
cugcaaguuugaccucguu

SEQ ID NO: 114178 - RNA, 19 nt, Homo sapiens
gcucugcgcgaaccacaau

SEQ ID NO: 114179 - RNA, 19 nt, Homo sapiens
gcagcagccacaacagcaa

SEQ ID NO: 114180 - RNA, 19 nt, Homo sapiens
ccagggacagcaguucauu

SEQ ID NO: 114181 - RNA, 19 nt, Homo sapiens
gcggagaguucuguacuua

SEQ ID NO: 114182 - RNA, 19 nt, Homo sapiens
caauaaagguuccugaauc

SEQ ID NO: 114183 - RNA, 19 nt, Homo sapiens
ggauguggguucccucaaa

SEQ ID NO: 114184 - RNA, 19 nt, Homo sapiens
gcguuuggguggccuuuga

SEQ ID NO: 114185 - RNA, 19 nt, Homo sapiens
aauaaagguuccugaaucu

SEQ ID NO: 114186 - RNA, 19 nt, Homo sapiens
ggagaguucuguacuuacg

SEQ ID NO: 114187 - RNA, 19 nt, Homo sapiens
uaaagguuccugaaucuuc

SEQ ID NO: 114188 - RNA, 19 nt, Homo sapiens
gauguggguucccucaaag

SEQ ID NO: 114189 - RNA, 19 nt, Homo sapiens
aguuugaccucguugauga

SEQ ID NO: 114190 - RNA, 19 nt, Homo sapiens
uuccaaggcugcaaguuug

SEQ ID NO: 114191 - RNA, 19 nt, Homo sapiens
ucaauaaagguuccugaau

SEQ ID NO: 114192 - RNA, 19 nt, Homo sapiens
cuaccgaggcuaccaguau

SEQ ID NO: 114193 - RNA, 19 nt, Homo sapiens
gcaaguuugaccucguuga

SEQ ID NO: 114194 - RNA, 19 nt, Homo sapiens
cuuccaaggcugcaaguuu

SEQ ID NO: 114195 - RNA, 19 nt, Homo sapiens
gaggcuaccaguauguguu

SEQ ID NO: 114196 - RNA, 19 nt, Homo sapiens
uaccgaggcuaccaguaug

SEQ ID NO: 114197 - RNA, 19 nt, Homo sapiens
ugaccucguugaugacuac

SEQ ID NO: 114198 - RNA, 19 nt, Homo sapiens
caaguuugaccucguugau

SEQ ID NO: 114199 - RNA, 19 nt, Homo sapiens
cugcaaguuugaccucguu

SEQ ID NO: 114200 - RNA, 19 nt, Homo sapiens
gcucugcgcgaaccacaau

SEQ ID NO: 114201 - RNA, 19 nt, Homo sapiens
gcagcagccacaacagcaa

SEQ ID NO: 114202 - RNA, 19 nt, Homo sapiens
ggcuguguguggcucgaaa

SEQ ID NO: 114203 - RNA, 19 nt, Homo sapiens
ccagggacagcaguucauu

SEQ ID NO: 114204 - RNA, 19 nt, Homo sapiens
gcggagaguucuguacuua

SEQ ID NO: 114205 - RNA, 19 nt, Homo sapiens
caauaaagguuccugaauc

SEQ ID NO: 114206 - RNA, 19 nt, Homo sapiens
ggauguggguucccucaaa

SEQ ID NO: 114207 - RNA, 19 nt, Homo sapiens
gcguuuggguggccuuuga

SEQ ID NO: 114208 - RNA, 19 nt, Homo sapiens
aauaaagguuccugaaucu

SEQ ID NO: 114209 - RNA, 19 nt, Homo sapiens
ggagaguucuguacuuacg

SEQ ID NO: 114210 - RNA, 19 nt, Homo sapiens
uaaagguuccugaaucuuc

SEQ ID NO: 114211 - RNA, 19 nt, Homo sapiens
gauguggguucccucaaag

SEQ ID NO: 114212 - RNA, 19 nt, Homo sapiens
aguuugaccucguugauga

SEQ ID NO: 114213 - RNA, 19 nt, Homo sapiens
uuccaaggcugcaaguuug

SEQ ID NO: 114214 - RNA, 19 nt, Homo sapiens
ucaauaaagguuccugaau

SEQ ID NO: 114215 - RNA, 19 nt, Homo sapiens
cuaccgaggcuaccaguau

SEQ ID NO: 114216 - RNA, 19 nt, Homo sapiens
gcaaguuugaccucguuga

SEQ ID NO: 114217 - RNA, 19 nt, Homo sapiens
cuuccaaggcugcaaguuu

SEQ ID NO: 114218 - RNA, 19 nt, Homo sapiens
gaggcuaccaguauguguu

SEQ ID NO: 114219 - RNA, 19 nt, Homo sapiens
uaccgaggcuaccaguaug

SEQ ID NO: 114220 - RNA, 19 nt, Homo sapiens
ugaccucguugaugacuac

SEQ ID NO: 114221 - RNA, 19 nt, Homo sapiens
caaguuugaccucguugau

SEQ ID NO: 114222 - RNA, 19 nt, Homo sapiens
cugcaaguuugaccucguu

SEQ ID NO: 114223 - RNA, 19 nt, Homo sapiens
gcucugcgcgaaccacaau

SEQ ID NO: 114224 - RNA, 19 nt, Homo sapiens
gcagcagccacaacagcaa

SEQ ID NO: 114225 - RNA, 19 nt, Homo sapiens
ccagggacagcaguucauu

SEQ ID NO: 114226 - RNA, 19 nt, Homo sapiens
gaacccagcacccauguga

SEQ ID NO: 114227 - RNA, 19 nt, Homo sapiens
gaacgaggcgaauauccaa

SEQ ID NO: 114228 - RNA, 19 nt, Homo sapiens
aaggagagcugagcgauga

SEQ ID NO: 114229 - RNA, 19 nt, Homo sapiens
gcaaugaaguaggguccuu

SEQ ID NO: 114230 - RNA, 19 nt, Homo sapiens
gaacuuccugggcaagaaa

SEQ ID NO: 114231 - RNA, 19 nt, Homo sapiens
gcgcaugcgugccuuaucu

SEQ ID NO: 114232 - RNA, 19 nt, Homo sapiens
ccauuccggugacuacaaa

SEQ ID NO: 114233 - RNA, 19 nt, Homo sapiens
ccacaaugacccugcaaug

SEQ ID NO: 114234 - RNA, 19 nt, Homo sapiens
gagacugugcgaucuuuga

SEQ ID NO: 114235 - RNA, 19 nt, Homo sapiens
ggaacgaggcgaauaucca

SEQ ID NO: 114236 - RNA, 19 nt, Homo sapiens
uaccgaggauuucaguaug

SEQ ID NO: 114237 - RNA, 19 nt, Homo sapiens
acucgaggcugaccaucuu

SEQ ID NO: 114238 - RNA, 19 nt, Homo sapiens
gcaguacauucuggaacga

SEQ ID NO: 114239 - RNA, 19 nt, Homo sapiens
cgagcaugcuggcuuccaa

SEQ ID NO: 114240 - RNA, 19 nt, Homo sapiens
cuaccgaggauuucaguau

SEQ ID NO: 114241 - RNA, 19 nt, Homo sapiens
gggaugggaaggcaaugaa

SEQ ID NO: 114242 - RNA, 19 nt, Homo sapiens
ucgagacugugcgaucuuu

SEQ ID NO: 114243 - RNA, 19 nt, Homo sapiens
gguguguucucuccuucug

SEQ ID NO: 114244 - RNA, 19 nt, Homo sapiens
ggagcgcaugcgugccuua

SEQ ID NO: 114245 - RNA, 19 nt, Homo sapiens
gaugggaaggcaaugaagu

SEQ ID NO: 114246 - RNA, 19 nt, Homo sapiens
gcugagcgaugacuauccu

SEQ ID NO: 114247 - RNA, 19 nt, Homo sapiens
uggaggcugugguguguuc

SEQ ID NO: 114248 - RNA, 19 nt, Homo sapiens
agaacuuccugggcaagaa

SEQ ID NO: 114249 - RNA, 19 nt, Homo sapiens
gcagcaguacauucuggaa

SEQ ID NO: 114250 - RNA, 19 nt, Homo sapiens
caagggcagcaguacauuc

SEQ ID NO: 114251 - RNA, 19 nt, Homo sapiens
uccggugacuacaaacauu

SEQ ID NO: 114252 - RNA, 19 nt, Homo sapiens
uucaguaugugcuggaaug

SEQ ID NO: 114253 - RNA, 19 nt, Homo sapiens
gagcugagcgaugacuauc

SEQ ID NO: 114254 - RNA, 19 nt, Homo sapiens
gagaacuuccugggcaaga

SEQ ID NO: 114255 - RNA, 19 nt, Homo sapiens
gagagcugagcgaugacua

SEQ ID NO: 114256 - RNA, 19 nt, Homo sapiens
ucuggaggcuguggugugu

SEQ ID NO: 114257 - RNA, 19 nt, Homo sapiens
gaacauggguuggcuauca

SEQ ID NO: 114258 - RNA, 19 nt, Homo sapiens
ccaacaaccgugccuauua

SEQ ID NO: 114259 - RNA, 19 nt, Homo sapiens
caacaaccgugccuauuac

SEQ ID NO: 114260 - RNA, 19 nt, Homo sapiens
gcacaaaaucucccuguuu

SEQ ID NO: 114261 - RNA, 19 nt, Homo sapiens
ccuagagccuggugacuuc

SEQ ID NO: 114262 - RNA, 19 nt, Homo sapiens
gugaucggcucauguccuu

SEQ ID NO: 114263 - RNA, 19 nt, Homo sapiens
caacccuucuucauguuca

SEQ ID NO: 114264 - RNA, 19 nt, Homo sapiens
ccuucuucauguucaauua

SEQ ID NO: 114265 - RNA, 19 nt, Homo sapiens
gcagugaucggcucauguc

SEQ ID NO: 114266 - RNA, 19 nt, Homo sapiens
gggcaacaccauagagauc

SEQ ID NO: 114267 - RNA, 19 nt, Homo sapiens
gcaggaacauccccuaguc

SEQ ID NO: 114268 - RNA, 19 nt, Homo sapiens
gcaacaccauagagaucca

SEQ ID NO: 114269 - RNA, 19 nt, Homo sapiens
gagcagcuaccgcagugau

SEQ ID NO: 114270 - RNA, 19 nt, Homo sapiens
cuucaagggcaacaccaua

SEQ ID NO: 114271 - RNA, 19 nt, Homo sapiens
cgugugcgcagcaucauug

SEQ ID NO: 114272 - RNA, 19 nt, Homo sapiens
gaccgugugcgcagcauca

SEQ ID NO: 114273 - RNA, 19 nt, Homo sapiens
ucaagggcaacaccauaga

SEQ ID NO: 114274 - RNA, 19 nt, Homo sapiens
ccuuugagcaguccaacuu

SEQ ID NO: 114275 - RNA, 19 nt, Homo sapiens
ccgcagugaucggcucaug

SEQ ID NO: 114276 - RNA, 19 nt, Homo sapiens
gaaggcagguucuguccua

SEQ ID NO: 114277 - RNA, 19 nt, Homo sapiens
ggaagaagauggaaaucau

SEQ ID NO: 114278 - RNA, 19 nt, Homo sapiens
gaagaagauggaaaucaua

SEQ ID NO: 114279 - RNA, 19 nt, Homo sapiens
gcgagcaguuuguguuuga

SEQ ID NO: 114280 - RNA, 19 nt, Homo sapiens
gaagauggaaaucauagau

SEQ ID NO: 114281 - RNA, 19 nt, Homo sapiens
gcacaagaucauccucuau

SEQ ID NO: 114282 - RNA, 19 nt, Homo sapiens
gcacguggguuggcuacca

SEQ ID NO: 114283 - RNA, 19 nt, Homo sapiens
aggagaaggugucaucugu

SEQ ID NO: 114284 - RNA, 19 nt, Homo sapiens
ggagaagggagacuacaag

SEQ ID NO: 114285 - RNA, 19 nt, Homo sapiens
cuccagaccuccaagugaa

SEQ ID NO: 114286 - RNA, 19 nt, Homo sapiens
caaggacagcagcgacuuu

SEQ ID NO: 114287 - RNA, 19 nt, Homo sapiens
gggaagaagauggaaauca

SEQ ID NO: 114288 - RNA, 19 nt, Homo sapiens
gggcgagcaguuuguguuu

SEQ ID NO: 114289 - RNA, 19 nt, Homo sapiens
gcuaugaacaggccaacug

SEQ ID NO: 114290 - RNA, 19 nt, Homo sapiens
ggcagguucuguccuagug

SEQ ID NO: 114291 - RNA, 19 nt, Homo sapiens
gccaagagcacaagaucau

SEQ ID NO: 114292 - RNA, 19 nt, Homo sapiens
caucaucuuugagcaggaa

SEQ ID NO: 114293 - RNA, 19 nt, Homo sapiens
caagugaagaauaaagugu

SEQ ID NO: 114294 - RNA, 19 nt, Homo sapiens
gaccuccaagugaagaaua

SEQ ID NO: 114295 - RNA, 19 nt, Homo sapiens
cacaagaucauccucuaug

SEQ ID NO: 114296 - RNA, 19 nt, Homo sapiens
gcaagggcgagcaguuugu

SEQ ID NO: 114297 - RNA, 19 nt, Homo sapiens
caaaguggacagccaagag

SEQ ID NO: 114298 - RNA, 19 nt, Homo sapiens
caggucugcugcccaggaa

SEQ ID NO: 114299 - RNA, 19 nt, Homo sapiens
ggcgagcaguuuguguuug

SEQ ID NO: 114300 - RNA, 19 nt, Homo sapiens
ccaagugaagaauaaagug

SEQ ID NO: 114301 - RNA, 19 nt, Homo sapiens
gcaagccacagucccucaa

SEQ ID NO: 114302 - RNA, 19 nt, Homo sapiens
gagcaguuuguguuugaga

SEQ ID NO: 114303 - RNA, 19 nt, Homo sapiens
ccacucgcaugagcucaau

SEQ ID NO: 114304 - RNA, 19 nt, Homo sapiens
agcacaagaucauccucua

SEQ ID NO: 114305 - RNA, 19 nt, Homo sapiens
ccuccagaccuccaaguga

SEQ ID NO: 114306 - RNA, 19 nt, Homo sapiens
ggacagccaagagcacaag

SEQ ID NO: 114307 - RNA, 19 nt, Homo sapiens
aagaagauggaaaucauag

SEQ ID NO: 114308 - RNA, 19 nt, Homo sapiens
ccuggaaucugcucaauaa

SEQ ID NO: 114309 - RNA, 19 nt, Homo sapiens
ggacguggguuggcuauga

SEQ ID NO: 114310 - RNA, 19 nt, Homo sapiens
ggccguggcuggcauuuga

SEQ ID NO: 114311 - RNA, 19 nt, Homo sapiens
ggaaucugcucaauaaagc

SEQ ID NO: 114312 - RNA, 19 nt, Homo sapiens
caagagccauggagaccuu

SEQ ID NO: 114313 - RNA, 19 nt, Homo sapiens
gaaggugggcuccauccaa

SEQ ID NO: 114314 - RNA, 19 nt, Homo sapiens
gaauauugauaguccacau

SEQ ID NO: 114315 - RNA, 19 nt, Homo sapiens
gaaaggcacccagacuuca

SEQ ID NO: 114316 - RNA, 19 nt, Homo sapiens
agauggagauaguggauga

SEQ ID NO: 114317 - RNA, 19 nt, Homo sapiens
gcgaguaccgccacuggaa

SEQ ID NO: 114318 - RNA, 19 nt, Homo sapiens
ucacaagcugcaucuguuu

SEQ ID NO: 114319 - RNA, 19 nt, Homo sapiens
uguacgaacuagagaacuu

SEQ ID NO: 114320 - RNA, 19 nt, Homo sapiens
ugaaaggcacccagacuuc

SEQ ID NO: 114321 - RNA, 19 nt, Homo sapiens
ccaacagccgugauaguga

SEQ ID NO: 114322 - RNA, 19 nt, Homo sapiens
gaucuuguacgaacuagag

SEQ ID NO: 114323 - RNA, 19 nt, Homo sapiens
caucacaagcugcaucugu

SEQ ID NO: 114324 - RNA, 19 nt, Homo sapiens
ggagauaguggaugaugac

SEQ ID NO: 114325 - RNA, 19 nt, Homo sapiens
uggagauaguggaugauga

SEQ ID NO: 114326 - RNA, 19 nt, Homo sapiens
gccgcaagauggagauagu

SEQ ID NO: 114327 - RNA, 19 nt, Homo sapiens
ggugaucuuguacgaacua

SEQ ID NO: 114328 - RNA, 19 nt, Homo sapiens
caagauggagauaguggau

SEQ ID NO: 114329 - RNA, 19 nt, Homo sapiens
ugggaugccugguccaaca

SEQ ID NO: 114330 - RNA, 19 nt, Homo sapiens
ccgcauccgugaccagaag

SEQ ID NO: 114331 - RNA, 19 nt, Homo sapiens
ccuccggccucugaauauu

SEQ ID NO: 114332 - RNA, 19 nt, Homo sapiens
gcagcuacaaggugaucuu

SEQ ID NO: 114333 - RNA, 19 nt, Homo sapiens
gaguaccgccacuggaaug

SEQ ID NO: 114334 - RNA, 19 nt, Homo sapiens
cgaacuagagaacuuccaa

SEQ ID NO: 114335 - RNA, 19 nt, Homo sapiens
agccgcagcugcagucugu

SEQ ID NO: 114336 - RNA, 19 nt, Homo sapiens
acaagcugcaucuguuuga

SEQ ID NO: 114337 - RNA, 19 nt, Homo sapiens
uggaaucugcucaauaaag

SEQ ID NO: 114338 - RNA, 19 nt, Homo sapiens
ugagaacccagcuuucagu

SEQ ID NO: 114339 - RNA, 19 nt, Homo sapiens
guacgaacuagagaacuuc

SEQ ID NO: 114340 - RNA, 19 nt, Homo sapiens
gcgaguguccgugccauca

SEQ ID NO: 114341 - RNA, 19 nt, Homo sapiens
uccggccucugaauauuga

SEQ ID NO: 114342 - RNA, 19 nt, Homo sapiens
gacguggguuggcuaugag

SEQ ID NO: 114343 - RNA, 19 nt, Homo sapiens
gaguguccgugccaucaac

SEQ ID NO: 114344 - RNA, 19 nt, Homo sapiens
aucacaagcugcaucuguu

SEQ ID NO: 114345 - RNA, 19 nt, Homo sapiens
ugucugagcucacugauga

SEQ ID NO: 114346 - RNA, 19 nt, Homo sapiens
cagcuucccugcuauauau

SEQ ID NO: 114347 - RNA, 19 nt, Homo sapiens
ucuaugagcgucccaauua

SEQ ID NO: 114348 - RNA, 19 nt, Homo sapiens
ggucaccgauuuguacuaa

SEQ ID NO: 114349 - RNA, 19 nt, Homo sapiens
cagggucgcugcuacaauu

SEQ ID NO: 114350 - RNA, 19 nt, Homo sapiens
guccaauccugccguauaa

SEQ ID NO: 114351 - RNA, 19 nt, Homo sapiens
ugagacgggucaccgauuu

SEQ ID NO: 114352 - RNA, 19 nt, Homo sapiens
ucuaugaaaugcccaacua

SEQ ID NO: 114353 - RNA, 19 nt, Homo sapiens
gcugcuggaugcucuauga

SEQ ID NO: 114354 - RNA, 19 nt, Homo sapiens
gcugcuggguccucuauga

SEQ ID NO: 114355 - RNA, 19 nt, Homo sapiens
gaucuauucccuccacgua

SEQ ID NO: 114356 - RNA, 19 nt, Homo sapiens
gguccaauccugccguaua

SEQ ID NO: 114357 - RNA, 19 nt, Homo sapiens
uaccagcucgcacaaguua

SEQ ID NO: 114358 - RNA, 19 nt, Homo sapiens
gcaaguaccccgacuauca

SEQ ID NO: 114359 - RNA, 19 nt, Homo sapiens
cuacgaggaccgagacuuu

SEQ ID NO: 114360 - RNA, 19 nt, Homo sapiens
cauaccagcucgcacaagu

SEQ ID NO: 114361 - RNA, 19 nt, Homo sapiens
ccaauccugccguauaauu

SEQ ID NO: 114362 - RNA, 19 nt, Homo sapiens
gcuggguccucuaugaaau

SEQ ID NO: 114363 - RNA, 19 nt, Homo sapiens
gcuaaucacccucugucaa

SEQ ID NO: 114364 - RNA, 19 nt, Homo sapiens
gaugacuaccgaggccuua

SEQ ID NO: 114365 - RNA, 19 nt, Homo sapiens
gggugcagaugccaaaguc

SEQ ID NO: 114366 - RNA, 19 nt, Homo sapiens
accgaggccuuaugucuga

SEQ ID NO: 114367 - RNA, 19 nt, Homo sapiens
cauacuagaugcuaaucac

SEQ ID NO: 114368 - RNA, 19 nt, Homo sapiens
gcuacaauugcaucaguga

SEQ ID NO: 114369 - RNA, 19 nt, Homo sapiens
ucaccgauuuguacuaagc

SEQ ID NO: 114370 - RNA, 19 nt, Homo sapiens
cuuugucccuaucauacua

SEQ ID NO: 114371 - RNA, 19 nt, Homo sapiens
ccugcuauauauaccaguu

SEQ ID NO: 114372 - RNA, 19 nt, Homo sapiens
gaugacugcgccuguguuc

SEQ ID NO: 114373 - RNA, 19 nt, Homo sapiens
ugccguauaauuccucaua

SEQ ID NO: 114374 - RNA, 19 nt, Homo sapiens
caauccugccguauaauuc

SEQ ID NO: 114375 - RNA, 19 nt, Homo sapiens
caacaaccauggggaagau

SEQ ID NO: 114376 - RNA, 19 nt, Homo sapiens
gugccugccuuguugugau

SEQ ID NO: 114377 - RNA, 19 nt, Homo sapiens
cuaucauacuagaugcuaa

SEQ ID NO: 114378 - RNA, 19 nt, Homo sapiens
ggucgcugcuacaauugca

SEQ ID NO: 114379 - RNA, 19 nt, Homo sapiens
gagacgggucaccgauuug

SEQ ID NO: 114380 - RNA, 19 nt, Homo sapiens
ugacugcgccuguguucca

SEQ ID NO: 114381 - RNA, 19 nt, Homo sapiens
guacgagagagaugacuac

SEQ ID NO: 114382 - RNA, 19 nt, Homo sapiens
uaaucacccucugucaaca

SEQ ID NO: 114383 - RNA, 19 nt, Homo sapiens
caaccugcgggucuacuuc

SEQ ID NO: 114384 - RNA, 19 nt, Homo sapiens
cuaaucacccucugucaac

SEQ ID NO: 114385 - RNA, 19 nt, Homo sapiens
gggcugcuggguccucuau

SEQ ID NO: 114386 - RNA, 19 nt, Homo sapiens
cuaccgaggccuuaugucu

SEQ ID NO: 114387 - RNA, 19 nt, Homo sapiens
cugcuacaauugcaucagu

SEQ ID NO: 114388 - RNA, 19 nt, Homo sapiens
gaaauucacucccucaaug

SEQ ID NO: 114389 - RNA, 19 nt, Homo sapiens
gcagcuggauccucuauga

SEQ ID NO: 114390 - RNA, 19 nt, Homo sapiens
gaaaacaucugcucacuuc

SEQ ID NO: 114391 - RNA, 19 nt, Homo sapiens
gagagcggcugcuggauga

SEQ ID NO: 114392 - RNA, 19 nt, Homo sapiens
ucuaugagaugcccaacua

SEQ ID NO: 114393 - RNA, 19 nt, Homo sapiens
uacaggagguuucuugauu

SEQ ID NO: 114394 - RNA, 19 nt, Homo sapiens
gcugcuggaugaucuauga

SEQ ID NO: 114395 - RNA, 19 nt, Homo sapiens
ugggaaagaucaccuucua

SEQ ID NO: 114396 - RNA, 19 nt, Homo sapiens
gacgagucauggauuugua

SEQ ID NO: 114397 - RNA, 19 nt, Homo sapiens
aaaguuggcucucuuagac

SEQ ID NO: 114398 - RNA, 19 nt, Homo sapiens
uuagacgagucauggauuu

SEQ ID NO: 114399 - RNA, 19 nt, Homo sapiens
caaaguuggcucucuuaga

SEQ ID NO: 114400 - RNA, 19 nt, Homo sapiens
acaggagguuucuugauug

SEQ ID NO: 114401 - RNA, 19 nt, Homo sapiens
gaaagaucaccuucuacga

SEQ ID NO: 114402 - RNA, 19 nt, Homo sapiens
agucauggauuuguacuga

SEQ ID NO: 114403 - RNA, 19 nt, Homo sapiens
gaguacaggagguuucuug

SEQ ID NO: 114404 - RNA, 19 nt, Homo sapiens
caaccuacaacccuauuuc

SEQ ID NO: 114405 - RNA, 19 nt, Homo sapiens
gcuggauccucuaugagau

SEQ ID NO: 114406 - RNA, 19 nt, Homo sapiens
ucugcucacuuccuucaaa

SEQ ID NO: 114407 - RNA, 19 nt, Homo sapiens
guacaggagguuucuugau

SEQ ID NO: 114408 - RNA, 19 nt, Homo sapiens
cuacgacagagaugaauug

SEQ ID NO: 114409 - RNA, 19 nt, Homo sapiens
gcuuccaccucacugaaau

SEQ ID NO: 114410 - RNA, 19 nt, Homo sapiens
gaauugaggggacaaaugu

SEQ ID NO: 114411 - RNA, 19 nt, Homo sapiens
cuuacagaaugaagaucua

SEQ ID NO: 114412 - RNA, 19 nt, Homo sapiens
ucauggauuuguacugaag

SEQ ID NO: 114413 - RNA, 19 nt, Homo sapiens
caggagguuucuugauugg

SEQ ID NO: 114414 - RNA, 19 nt, Homo sapiens
gcgcuuacagaaugaagau

SEQ ID NO: 114415 - RNA, 19 nt, Homo sapiens
guauuuacguuuuccacuu

SEQ ID NO: 114416 - RNA, 19 nt, Homo sapiens
gcuccaaaugccaaaguug

SEQ ID NO: 114417 - RNA, 19 nt, Homo sapiens
gucauggauuuguacugaa

SEQ ID NO: 114418 - RNA, 19 nt, Homo sapiens
gcuacgaaugcaccacuga

SEQ ID NO: 114419 - RNA, 19 nt, Homo sapiens
ggcuccaaaugccaaaguu

SEQ ID NO: 114420 - RNA, 19 nt, Homo sapiens
caucugcucacuuccuuca

SEQ ID NO: 114421 - RNA, 19 nt, Homo sapiens
gggcagcuggauccucuau

SEQ ID NO: 114422 - RNA, 19 nt, Homo sapiens
ggagagugguggauuugua

SEQ ID NO: 114423 - RNA, 19 nt, Homo sapiens
ccacaaaggccucaugaug

SEQ ID NO: 114424 - RNA, 19 nt, Homo sapiens
acacugaacucgcaucauc

SEQ ID NO: 114425 - RNA, 19 nt, Homo sapiens
acaaaggccucaugaugga

SEQ ID NO: 114426 - RNA, 19 nt, Homo sapiens
gcugcuggaugcucuauga

SEQ ID NO: 114427 - RNA, 19 nt, Homo sapiens
cuaccaaggucaacaauac

SEQ ID NO: 114428 - RNA, 19 nt, Homo sapiens
gcuuaacacuaccaauuuc

SEQ ID NO: 114429 - RNA, 19 nt, Homo sapiens
gagugguggauuuguauua

SEQ ID NO: 114430 - RNA, 19 nt, Homo sapiens
ugauggagcugagugaaga

SEQ ID NO: 114431 - RNA, 19 nt, Homo sapiens
uagcuuaacacuaccaauu

SEQ ID NO: 114432 - RNA, 19 nt, Homo sapiens
ucuaugagcgucccaacua

SEQ ID NO: 114433 - RNA, 19 nt, Homo sapiens
cgagagggaagaccacaaa

SEQ ID NO: 114434 - RNA, 19 nt, Homo sapiens
gugguggauuuguauuaaa

SEQ ID NO: 114435 - RNA, 19 nt, Homo sapiens
gagagugguggauuuguau

SEQ ID NO: 114436 - RNA, 19 nt, Homo sapiens
caacuaccaaggucaacaa

SEQ ID NO: 114437 - RNA, 19 nt, Homo sapiens
gcuacgaaaccaccacuga

SEQ ID NO: 114438 - RNA, 19 nt, Homo sapiens
cagccauccugcuauauag

SEQ ID NO: 114439 - RNA, 19 nt, Homo sapiens
gaccacaaaggccucauga

SEQ ID NO: 114440 - RNA, 19 nt, Homo sapiens
cacuaccaauuucccauuu

SEQ ID NO: 114441 - RNA, 19 nt, Homo sapiens
agugguggauuuguauuaa

SEQ ID NO: 114442 - RNA, 19 nt, Homo sapiens
ccaaccugcagccguauuu

SEQ ID NO: 114443 - RNA, 19 nt, Homo sapiens
gcugcuggguccucuacga

SEQ ID NO: 114444 - RNA, 19 nt, Homo sapiens
ucuacgagcuccccaacua

SEQ ID NO: 114445 - RNA, 19 nt, Homo sapiens
ugcggagagugguggauuu

SEQ ID NO: 114446 - RNA, 19 nt, Homo sapiens
gcggagagugguggauuug

SEQ ID NO: 114447 - RNA, 19 nt, Homo sapiens
acacuaccaauuucccauu

SEQ ID NO: 114448 - RNA, 19 nt, Homo sapiens
ugaaauauguccuccuuug

SEQ ID NO: 114449 - RNA, 19 nt, Homo sapiens
ucuacgagcuguccaacua

SEQ ID NO: 114450 - RNA, 19 nt, Homo sapiens
ugaggagagucauagauuu

SEQ ID NO: 114451 - RNA, 19 nt, Homo sapiens
cuacagaggccagaugaua

SEQ ID NO: 114452 - RNA, 19 nt, Homo sapiens
gcugcuggaugcucuauga

SEQ ID NO: 114453 - RNA, 19 nt, Homo sapiens
gaggccagaugauagaguu

SEQ ID NO: 114454 - RNA, 19 nt, Homo sapiens
gaaauauguccuccuuugu

SEQ ID NO: 114455 - RNA, 19 nt, Homo sapiens
ccuccuuuguuguuucuua

SEQ ID NO: 114456 - RNA, 19 nt, Homo sapiens
aauauguccuccuuuguug

SEQ ID NO: 114457 - RNA, 19 nt, Homo sapiens
ccugaaauauguccuccuu

SEQ ID NO: 114458 - RNA, 19 nt, Homo sapiens
gaggagagucauagauuuc

SEQ ID NO: 114459 - RNA, 19 nt, Homo sapiens
ucuaugagcagcccaacua

SEQ ID NO: 114460 - RNA, 19 nt, Homo sapiens
aaauauguccuccuuuguu

SEQ ID NO: 114461 - RNA, 19 nt, Homo sapiens
caggaccgcuuccgcuuca

SEQ ID NO: 114462 - RNA, 19 nt, Homo sapiens
gcuccuggguccucuacga

SEQ ID NO: 114463 - RNA, 19 nt, Homo sapiens
ggacuacagaggccagaug

SEQ ID NO: 114464 - RNA, 19 nt, Homo sapiens
ggacugcuccugucuucag

SEQ ID NO: 114465 - RNA, 19 nt, Homo sapiens
ggaagaucacccucuacga

SEQ ID NO: 114466 - RNA, 19 nt, Homo sapiens
ugagagggaggacuacaga

SEQ ID NO: 114467 - RNA, 19 nt, Homo sapiens
acucgggccuccaguacuu

SEQ ID NO: 114468 - RNA, 19 nt, Homo sapiens
caaccugcagcccuacuug

SEQ ID NO: 114469 - RNA, 19 nt, Homo sapiens
cugaggagagucauagauu

SEQ ID NO: 114470 - RNA, 19 nt, Homo sapiens
gacuacagaggccagauga

SEQ ID NO: 114471 - RNA, 19 nt, Homo sapiens
ucuaugagagggaggacua

SEQ ID NO: 114472 - RNA, 19 nt, Homo sapiens
acagaggccagaugauaga

SEQ ID NO: 114473 - RNA, 19 nt, Homo sapiens
ucacaggaucagacucuau

SEQ ID NO: 114474 - RNA, 19 nt, Homo sapiens
gucauagauuucuccugaa

SEQ ID NO: 114475 - RNA, 19 nt, Homo sapiens
ggaccgcuuccgcuucaau

SEQ ID NO: 114476 - RNA, 19 nt, Homo sapiens
cacaggaucagacucuaug

SEQ ID NO: 114477 - RNA, 19 nt, Homo sapiens
cuccuuuguuguuucuuaa

SEQ ID NO: 114478 - RNA, 19 nt, Homo sapiens
ugaaauccacucccucaac

SEQ ID NO: 114479 - RNA, 19 nt, Homo sapiens
gaaccaagauuacuuucua

SEQ ID NO: 114480 - RNA, 19 nt, Homo sapiens
caaauaggcaucaucaaua

SEQ ID NO: 114481 - RNA, 19 nt, Homo sapiens
uauaaugccucuccuuaaa

SEQ ID NO: 114482 - RNA, 19 nt, Homo sapiens
gugcagauuuccacacaua

SEQ ID NO: 114483 - RNA, 19 nt, Homo sapiens
ucuaugagcuacccaacua

SEQ ID NO: 114484 - RNA, 19 nt, Homo sapiens
ggaggcaccugggcuguuu

SEQ ID NO: 114485 - RNA, 19 nt, Homo sapiens
gcaccugggcuguuuauga

SEQ ID NO: 114486 - RNA, 19 nt, Homo sapiens
caacuuugcuggguacaug

SEQ ID NO: 114487 - RNA, 19 nt, Homo sapiens
acacaaagcuacccaucug

SEQ ID NO: 114488 - RNA, 19 nt, Homo sapiens
ucaccaaucuagaucuuug

SEQ ID NO: 114489 - RNA, 19 nt, Homo sapiens
ccaaauaggcaucaucaau

SEQ ID NO: 114490 - RNA, 19 nt, Homo sapiens
caccugggcuguuuaugaa

SEQ ID NO: 114491 - RNA, 19 nt, Homo sapiens
uaaugccucuccuuaaaug

SEQ ID NO: 114492 - RNA, 19 nt, Homo sapiens
ggcaguaccuccuggacaa

SEQ ID NO: 114493 - RNA, 19 nt, Homo sapiens
gagauccacuccuguaagg

SEQ ID NO: 114494 - RNA, 19 nt, Homo sapiens
cgagagauccacuccugua

SEQ ID NO: 114495 - RNA, 19 nt, Homo sapiens
gcuggagggugucuggauu

SEQ ID NO: 114496 - RNA, 19 nt, Homo sapiens
gagaguacccugaauacca

SEQ ID NO: 114497 - RNA, 19 nt, Homo sapiens
ccaagauuacuuucuauga

SEQ ID NO: 114498 - RNA, 19 nt, Homo sapiens
gagagauccacuccuguaa

SEQ ID NO: 114499 - RNA, 19 nt, Homo sapiens
ggaguaaugacaugaaugg

SEQ ID NO: 114500 - RNA, 19 nt, Homo sapiens
gcaucccacugcugacuau

SEQ ID NO: 114501 - RNA, 19 nt, Homo sapiens
ggaggccaguauaagauuc

SEQ ID NO: 114502 - RNA, 19 nt, Homo sapiens
ugacugugauugcgacugu

SEQ ID NO: 114503 - RNA, 19 nt, Homo sapiens
acuauaaugccucuccuua

SEQ ID NO: 114504 - RNA, 19 nt, Homo sapiens
cuauaaugccucuccuuaa

SEQ ID NO: 114505 - RNA, 19 nt, Homo sapiens
agauugcccuuccaucaug

SEQ ID NO: 114506 - RNA, 19 nt, Homo sapiens
gauugcgacugugcagauu

SEQ ID NO: 114507 - RNA, 19 nt, Homo sapiens
auacagugcucgccacagu

SEQ ID NO: 114508 - RNA, 19 nt, Homo sapiens
ggucagauguaugaaacca

SEQ ID NO: 114509 - RNA, 19 nt, Homo sapiens
caauuucacaugcgagaga

SEQ ID NO: 114510 - RNA, 19 nt, Homo sapiens
guaugaaaccaccgaagau

SEQ ID NO: 114511 - RNA, 19 nt, Homo sapiens
uuaguggucagauguauga

SEQ ID NO: 114512 - RNA, 19 nt, Homo sapiens
guggaguaaugacaugaau

SEQ ID NO: 114513 - RNA, 19 nt, Homo sapiens
uaugaaaccaccgaagauu

SEQ ID NO: 114514 - RNA, 19 nt, Homo sapiens
cuaguggaggccaguauaa

SEQ ID NO: 114515 - RNA, 19 nt, Homo sapiens
gauuuccacacauaccuaa

SEQ ID NO: 114516 - RNA, 19 nt, Homo sapiens
guggucagauguaugaaac

SEQ ID NO: 114517 - RNA, 19 nt, Homo sapiens
aaacuggaaccaagauuac

SEQ ID NO: 114518 - RNA, 19 nt, Homo sapiens
ccuaguggaggccaguaua

SEQ ID NO: 114519 - RNA, 19 nt, Homo sapiens
gggagaguacccugaauac

SEQ ID NO: 114520 - RNA, 19 nt, Homo sapiens
uguaugaaaccaccgaaga

SEQ ID NO: 114521 - RNA, 19 nt, Homo sapiens
ggaaccaagauuacuuucu

SEQ ID NO: 114522 - RNA, 19 nt, Homo sapiens
cuucuagggaccagcaaua

SEQ ID NO: 114523 - RNA, 19 nt, Homo sapiens
ucccacugcugacuauaau

SEQ ID NO: 114524 - RNA, 19 nt, Homo sapiens
guccaaauaggcaucauca

SEQ ID NO: 114525 - RNA, 19 nt, Homo sapiens
aaaccagucuaugcaccaa

SEQ ID NO: 114526 - RNA, 19 nt, Homo sapiens
aaaacuggaaccaagauua

SEQ ID NO: 114527 - RNA, 19 nt, Homo sapiens
uaaaacaguuggcaugcau

SEQ ID NO: 114528 - RNA, 19 nt, Homo sapiens
aaugcuggcuggccuugug

SEQ ID NO: 114529 - RNA, 19 nt, Homo sapiens
ugaaaccaccgaagauugc

SEQ ID NO: 114530 - RNA, 19 nt, Homo sapiens
gggcagucacacaaagcua

SEQ ID NO: 114531 - RNA, 19 nt, Homo sapiens
gagggugucuggauuuucu

SEQ ID NO: 114532 - RNA, 19 nt, Homo sapiens
gauucagaucuuugagaaa

SEQ ID NO: 114533 - RNA, 19 nt, Homo sapiens
gccaguauaagauucagau

SEQ ID NO: 114534 - RNA, 19 nt, Homo sapiens
guggaggccaguauaagau

SEQ ID NO: 114535 - RNA, 19 nt, Homo sapiens
ucgcugcaacuccauuaaa

SEQ ID NO: 114536 - RNA, 19 nt, Homo sapiens
ccugggcuguuuaugaaag

SEQ ID NO: 114537 - RNA, 19 nt, Homo sapiens
cugcaacuccauuaaagug

SEQ ID NO: 114538 - RNA, 19 nt, Homo sapiens
gcaaaggagucgaguauaa

SEQ ID NO: 114539 - RNA, 19 nt, Homo sapiens
cagaguagauuuagaguua

SEQ ID NO: 114540 - RNA, 19 nt, Homo sapiens
gaugagagcuguuagaguu

SEQ ID NO: 114541 - RNA, 19 nt, Homo sapiens
gcauuugucugguaacaua

SEQ ID NO: 114542 - RNA, 19 nt, Homo sapiens
caagaaaggugacagaguu

SEQ ID NO: 114543 - RNA, 19 nt, Homo sapiens
gaaauuggcugguugaaac

SEQ ID NO: 114544 - RNA, 19 nt, Homo sapiens
gcuuauggcuuaaagauuu

SEQ ID NO: 114545 - RNA, 19 nt, Homo sapiens
gauagaagcuguuggagau

SEQ ID NO: 114546 - RNA, 19 nt, Homo sapiens
gaaauaaacccacgagaca

SEQ ID NO: 114547 - RNA, 19 nt, Homo sapiens
gguaauacuucgcaauuga

SEQ ID NO: 114548 - RNA, 19 nt, Homo sapiens
ggccagaaguccugaaauu

SEQ ID NO: 114549 - RNA, 19 nt, Homo sapiens
gaaguauguuggugagaaa

SEQ ID NO: 114550 - RNA, 19 nt, Homo sapiens
ugugauagguucucaauau

SEQ ID NO: 114551 - RNA, 19 nt, Homo sapiens
aaaccacucuuacccuaua

SEQ ID NO: 114552 - RNA, 19 nt, Homo sapiens
cagcagagguacuauugaa

SEQ ID NO: 114553 - RNA, 19 nt, Homo sapiens
gcgaucagauauugcagua

SEQ ID NO: 114554 - RNA, 19 nt, Homo sapiens
ggaggaauuucagcaauau

SEQ ID NO: 114555 - RNA, 19 nt, Homo sapiens
gaaauugcgaucagauauu

SEQ ID NO: 114556 - RNA, 19 nt, Homo sapiens
ucaaagagucaucauagua

SEQ ID NO: 114557 - RNA, 19 nt, Homo sapiens
ccaaauugcuagagcuuau

SEQ ID NO: 114558 - RNA, 19 nt, Homo sapiens
cagcagaccacacuguuua

SEQ ID NO: 114559 - RNA, 19 nt, Homo sapiens
ccaggacaauuuauuaguu

SEQ ID NO: 114560 - RNA, 19 nt, Homo sapiens
ugcuagagcuuauggcuua

SEQ ID NO: 114561 - RNA, 19 nt, Homo sapiens
gagcagaagcagaagagua

SEQ ID NO: 114562 - RNA, 19 nt, Homo sapiens
aaacuggacuuuaaacaag

SEQ ID NO: 114563 - RNA, 19 nt, Homo sapiens
gaauggaaauuggcugguu

SEQ ID NO: 114564 - RNA, 19 nt, Homo sapiens
agaauuaucugcauuuguc

SEQ ID NO: 114565 - RNA, 19 nt, Homo sapiens
ggugagaaaggaauugaua

SEQ ID NO: 114566 - RNA, 19 nt, Homo sapiens
gauaaugcaucugcuuuca

SEQ ID NO: 114567 - RNA, 19 nt, Homo sapiens
agaccacacuguuuacaaa

SEQ ID NO: 114568 - RNA, 19 nt, Homo sapiens
gauuagccaugacuguauu

SEQ ID NO: 114569 - RNA, 19 nt, Homo sapiens
ucauggauuuccuauguaa

SEQ ID NO: 114570 - RNA, 19 nt, Homo sapiens
gagaauaguagcuuuaucu

SEQ ID NO: 114571 - RNA, 19 nt, Homo sapiens
guauuggacuuugaacauu

SEQ ID NO: 114572 - RNA, 19 nt, Homo sapiens
aauuagagguacugucuuu

SEQ ID NO: 114573 - RNA, 19 nt, Homo sapiens
gcagagguacuauugaaau

SEQ ID NO: 114574 - RNA, 19 nt, Homo sapiens
gagaagugaauuacauuga

SEQ ID NO: 114575 - RNA, 19 nt, Homo sapiens
ggaaauuggcugguugaaa

SEQ ID NO: 114576 - RNA, 19 nt, Homo sapiens
gagagaguguucugguuca

SEQ ID NO: 114577 - RNA, 19 nt, Homo sapiens
uagaagcuguuggagauaa

SEQ ID NO: 114578 - RNA, 19 nt, Homo sapiens
ccaucugucucaaaucaaa

SEQ ID NO: 114579 - RNA, 19 nt, Homo sapiens
acagagaagugaauuacau

SEQ ID NO: 114580 - RNA, 19 nt, Homo sapiens
ugugaaagcuggagagagu

SEQ ID NO: 114581 - RNA, 19 nt, Homo sapiens
guucucuagucucugauua

SEQ ID NO: 114582 - RNA, 19 nt, Homo sapiens
uaaagguucucuagucucu

SEQ ID NO: 114583 - RNA, 19 nt, Homo sapiens
caaagagucaucauaguag

SEQ ID NO: 114584 - RNA, 19 nt, Homo sapiens
gaagaagcccacgcagauu

SEQ ID NO: 114585 - RNA, 19 nt, Homo sapiens
ccaucggcauuccauauuu

SEQ ID NO: 114586 - RNA, 19 nt, Homo sapiens
aaauugcgaucagauauug

SEQ ID NO: 114587 - RNA, 19 nt, Homo sapiens
uuauaaagguucucuaguc

SEQ ID NO: 114588 - RNA, 19 nt, Homo sapiens
gcauuccaguaauucuuaa

SEQ ID NO: 114589 - RNA, 19 nt, Homo sapiens
uuucauggauuuccuaugu

SEQ ID NO: 114590 - RNA, 19 nt, Homo sapiens
aggaggaauuucagcaaua

SEQ ID NO: 114591 - RNA, 19 nt, Homo sapiens
gagacaccauggcaaagga

SEQ ID NO: 114592 - RNA, 19 nt, Homo sapiens
ggaggacgagugauaguug

SEQ ID NO: 114593 - RNA, 19 nt, Homo sapiens
uaucugcauuugucuggua

SEQ ID NO: 114594 - RNA, 19 nt, Homo sapiens
uggugagggucaaauauuu

SEQ ID NO: 114595 - RNA, 19 nt, Homo sapiens
uccaugagcuucuuaugug

SEQ ID NO: 114596 - RNA, 19 nt, Homo sapiens
ugaagaagcccacgcagau

SEQ ID NO: 114597 - RNA, 19 nt, Homo sapiens
guaauuagagguacugucu

SEQ ID NO: 114598 - RNA, 19 nt, Homo sapiens
caaccaaggaggaauuuca

SEQ ID NO: 114599 - RNA, 19 nt, Homo sapiens
agaaguauguuggugagaa

SEQ ID NO: 114600 - RNA, 19 nt, Homo sapiens
gagcuuauggcuuaaagau

SEQ ID NO: 114601 - RNA, 19 nt, Homo sapiens
uaaugcaucugcuuucaag

SEQ ID NO: 114602 - RNA, 19 nt, Homo sapiens
cauagucuccaaauaggua

SEQ ID NO: 114603 - RNA, 19 nt, Homo sapiens
ucauuucuguggaaucuga

SEQ ID NO: 114604 - RNA, 19 nt, Homo sapiens
gcagcagaccacacuguuu

SEQ ID NO: 114605 - RNA, 19 nt, Homo sapiens
uauaaagguucucuagucu

SEQ ID NO: 114606 - RNA, 19 nt, Homo sapiens
cauguuaguugucauuugg

SEQ ID NO: 114607 - RNA, 19 nt, Homo sapiens
uuagagagcagaagcagaa

SEQ ID NO: 114608 - RNA, 19 nt, Homo sapiens
gaguagauuuagaguuauc

SEQ ID NO: 114609 - RNA, 19 nt, Homo sapiens
auacauagucuccaaauag

SEQ ID NO: 114610 - RNA, 19 nt, Homo sapiens
caagccuacuuaccuuuau

SEQ ID NO: 114611 - RNA, 19 nt, Homo sapiens
ucaagccuacuuaccuuua

SEQ ID NO: 114612 - RNA, 19 nt, Homo sapiens
caaaggagucgaguauaau

SEQ ID NO: 114613 - RNA, 19 nt, Homo sapiens
ugacuguauuggacuuuga

SEQ ID NO: 114614 - RNA, 19 nt, Homo sapiens
ccuucaagcuggaauggaa

SEQ ID NO: 114615 - RNA, 19 nt, Homo sapiens
gaggacgagugauaguugu

SEQ ID NO: 114616 - RNA, 19 nt, Homo sapiens
ggaguuggauuagcagcau

SEQ ID NO: 114617 - RNA, 19 nt, Homo sapiens
ccaugagcuucuuauguga

SEQ ID NO: 114618 - RNA, 19 nt, Homo sapiens
ggagucgaguauaauugga

SEQ ID NO: 114619 - RNA, 19 nt, Homo sapiens
ugaaauugcgaucagauau

SEQ ID NO: 114620 - RNA, 19 nt, Homo sapiens
gaccaucagguucuaauca

SEQ ID NO: 114621 - RNA, 19 nt, Homo sapiens
aagccuacuuaccuuuaua

SEQ ID NO: 114622 - RNA, 19 nt, Homo sapiens
aaucaaagagucaucauag

SEQ ID NO: 114623 - RNA, 19 nt, Homo sapiens
ugagugugcauuccaguaa

SEQ ID NO: 114624 - RNA, 19 nt, Homo sapiens
aaaggagucgaguauaauu

SEQ ID NO: 114625 - RNA, 19 nt, Homo sapiens
ggugauagaagcuguugga

SEQ ID NO: 114626 - RNA, 19 nt, Homo sapiens
uagguaauacuucgcaauu

SEQ ID NO: 114627 - RNA, 19 nt, Homo sapiens
aaucucauuuggaugugua

SEQ ID NO: 114628 - RNA, 19 nt, Homo sapiens
aagguucucuagucucuga

SEQ ID NO: 114629 - RNA, 19 nt, Homo sapiens
ugccaucugucucaaauca

SEQ ID NO: 114630 - RNA, 19 nt, Homo sapiens
guacuuacccuaucuuuuc

SEQ ID NO: 114631 - RNA, 19 nt, Homo sapiens
aagaagcccacgcagauuu

SEQ ID NO: 114632 - RNA, 19 nt, Homo sapiens
uacauucgcucugguacuu

SEQ ID NO: 114633 - RNA, 19 nt, Homo sapiens
gauauugcaguaccgauuc

SEQ ID NO: 114634 - RNA, 19 nt, Homo sapiens
uuaauucccacucuagauu

SEQ ID NO: 114635 - RNA, 19 nt, Homo sapiens
cauaguaggaaauaacaug

SEQ ID NO: 114636 - RNA, 19 nt, Homo sapiens
ggacgagugauaguuguug

SEQ ID NO: 114637 - RNA, 19 nt, Homo sapiens
uuagcagcaugccaaauug

SEQ ID NO: 114638 - RNA, 19 nt, Homo sapiens
gcaaagaugugucagauga

SEQ ID NO: 114639 - RNA, 19 nt, Homo sapiens
gcaaagaucuaccgaaauc

SEQ ID NO: 114640 - RNA, 19 nt, Homo sapiens
uaacacagcugcagaagga

SEQ ID NO: 114641 - RNA, 19 nt, Homo sapiens
cauauuggcugaccugaua

SEQ ID NO: 114642 - RNA, 19 nt, Homo sapiens
ugaaacaccugccuaauga

SEQ ID NO: 114643 - RNA, 19 nt, Homo sapiens
ugacggagaugaauuacua

SEQ ID NO: 114644 - RNA, 19 nt, Homo sapiens
ggacuggucucacaauuuc

SEQ ID NO: 114645 - RNA, 19 nt, Homo sapiens
gaaggaaguuggcaaagau

SEQ ID NO: 114646 - RNA, 19 nt, Homo sapiens
gaaugcaucuugucuuguu

SEQ ID NO: 114647 - RNA, 19 nt, Homo sapiens
cagcaaagaucuaccgaaa

SEQ ID NO: 114648 - RNA, 19 nt, Homo sapiens
gcaugacggagaugaauua

SEQ ID NO: 114649 - RNA, 19 nt, Homo sapiens
gcaaagcuaccuuguguug

SEQ ID NO: 114650 - RNA, 19 nt, Homo sapiens
uuacagcccucaacaguga

SEQ ID NO: 114651 - RNA, 19 nt, Homo sapiens
caauuucaccaacauguua

SEQ ID NO: 114652 - RNA, 19 nt, Homo sapiens
ccaaaucacuguggacaug

SEQ ID NO: 114653 - RNA, 19 nt, Homo sapiens
gggugcugcuccaguauua

SEQ ID NO: 114654 - RNA, 19 nt, Homo sapiens
ggacaacuuucccaccaau

SEQ ID NO: 114655 - RNA, 19 nt, Homo sapiens
uggcugaccugauaccuaa

SEQ ID NO: 114656 - RNA, 19 nt, Homo sapiens
ggaguugauuuaugaagau

SEQ ID NO: 114657 - RNA, 19 nt, Homo sapiens
gagcaggccagaauuaaga

SEQ ID NO: 114658 - RNA, 19 nt, Homo sapiens
caauguagaugcucacagu

SEQ ID NO: 114659 - RNA, 19 nt, Homo sapiens
gcucagcuguacaagauug

SEQ ID NO: 114660 - RNA, 19 nt, Homo sapiens
ugaaguuuguggacucuaa

SEQ ID NO: 114661 - RNA, 19 nt, Homo sapiens
gaaaggcccaaguccauga

SEQ ID NO: 114662 - RNA, 19 nt, Homo sapiens
gggaguugauuuaugaaga

SEQ ID NO: 114663 - RNA, 19 nt, Homo sapiens
ugaagggauugguguauga

SEQ ID NO: 114664 - RNA, 19 nt, Homo sapiens
gaagacugauccgcgauau

SEQ ID NO: 114665 - RNA, 19 nt, Homo sapiens
gaugagaaguuacgagacu

SEQ ID NO: 114666 - RNA, 19 nt, Homo sapiens
uaacuuugcccaagcauau

SEQ ID NO: 114667 - RNA, 19 nt, Homo sapiens
ccaugaggguggcaaugua

SEQ ID NO: 114668 - RNA, 19 nt, Homo sapiens
gcagaaggaaguuggcaaa

SEQ ID NO: 114669 - RNA, 19 nt, Homo sapiens
gcugguaacuggauguauc

SEQ ID NO: 114670 - RNA, 19 nt, Homo sapiens
ggaagacugauccgcgaua

SEQ ID NO: 114671 - RNA, 19 nt, Homo sapiens
uaugaaacaucaguucuug

SEQ ID NO: 114672 - RNA, 19 nt, Homo sapiens
gauguaugguggcaugaga

SEQ ID NO: 114673 - RNA, 19 nt, Homo sapiens
gaaguuacgagacuacauc

SEQ ID NO: 114674 - RNA, 19 nt, Homo sapiens
agaaggaaguuggcaaaga

SEQ ID NO: 114675 - RNA, 19 nt, Homo sapiens
ugagaggcaugaagggauu

SEQ ID NO: 114676 - RNA, 19 nt, Homo sapiens
ugugucagaugagaaguua

SEQ ID NO: 114677 - RNA, 19 nt, Homo sapiens
acugggaguugauuuauga

SEQ ID NO: 114678 - RNA, 19 nt, Homo sapiens
ccacgaauuugaaagacau

SEQ ID NO: 114679 - RNA, 19 nt, Homo sapiens
ucaccaugcuggacaacuu

SEQ ID NO: 114680 - RNA, 19 nt, Homo sapiens
cagaggaacagguaucuug

SEQ ID NO: 114681 - RNA, 19 nt, Homo sapiens
aaagaugugucagaugaga

SEQ ID NO: 114682 - RNA, 19 nt, Homo sapiens
gaagugcuugucuggcuaa

SEQ ID NO: 114683 - RNA, 19 nt, Homo sapiens
aaagcuaccuuguguugca

SEQ ID NO: 114684 - RNA, 19 nt, Homo sapiens
gguaucagccgaaccaagu

SEQ ID NO: 114685 - RNA, 19 nt, Homo sapiens
acagguaucuuggcucuca

SEQ ID NO: 114686 - RNA, 19 nt, Homo sapiens
ccaaguccaugagcacaga

SEQ ID NO: 114687 - RNA, 19 nt, Homo sapiens
caacuuucccaccaaucua

SEQ ID NO: 114688 - RNA, 19 nt, Homo sapiens
cuaaggagcaggccagaau

SEQ ID NO: 114689 - RNA, 19 nt, Homo sapiens
caucuggagccgagccuua

SEQ ID NO: 114690 - RNA, 19 nt, Homo sapiens
uugcucagcuguacaagau

SEQ ID NO: 114691 - RNA, 19 nt, Homo sapiens
gaaguuggcaaagaugugu

SEQ ID NO: 114692 - RNA, 19 nt, Homo sapiens
caacagaggaacagguauc

SEQ ID NO: 114693 - RNA, 19 nt, Homo sapiens
gcaugaagggauuggugua

SEQ ID NO: 114694 - RNA, 19 nt, Homo sapiens
uuacuacacgguccuguuu

SEQ ID NO: 114695 - RNA, 19 nt, Homo sapiens
uuaugaagauucuguggau

SEQ ID NO: 114696 - RNA, 19 nt, Homo sapiens
gcuuuaguaucccugaaug

SEQ ID NO: 114697 - RNA, 19 nt, Homo sapiens
guacuaaggaagacugauc

SEQ ID NO: 114698 - RNA, 19 nt, Homo sapiens
cuauggccaugcaguacua

SEQ ID NO: 114699 - RNA, 19 nt, Homo sapiens
uggcaaagaugugucagau

SEQ ID NO: 114700 - RNA, 19 nt, Homo sapiens
uccauggacuggcaaauca

SEQ ID NO: 114701 - RNA, 19 nt, Homo sapiens
gaaccaaguacugggaguu

SEQ ID NO: 114702 - RNA, 19 nt, Homo sapiens
cuaaugaccccauguuuaa

SEQ ID NO: 114703 - RNA, 19 nt, Homo sapiens
aaggagcaggccagaauua

SEQ ID NO: 114704 - RNA, 19 nt, Homo sapiens
guacugggaguugauuuau

SEQ ID NO: 114705 - RNA, 19 nt, Homo sapiens
guaugaaacaucaguucuu

SEQ ID NO: 114706 - RNA, 19 nt, Homo sapiens
gccaugcaguacuaaggaa

SEQ ID NO: 114707 - RNA, 19 nt, Homo sapiens
aggccagaauuaagacuuu

SEQ ID NO: 114708 - RNA, 19 nt, Homo sapiens
gaagggauugguguaugaa

SEQ ID NO: 114709 - RNA, 19 nt, Homo sapiens
cugaaacaccugccuaaug

SEQ ID NO: 114710 - RNA, 19 nt, Homo sapiens
caugaggguggcaauguaa

SEQ ID NO: 114711 - RNA, 19 nt, Homo sapiens
guaacuuugcccaagcaua

SEQ ID NO: 114712 - RNA, 19 nt, Homo sapiens
gugcuuccuccacgaauuu

SEQ ID NO: 114713 - RNA, 19 nt, Homo sapiens
ggaaguuggcaaagaugug

SEQ ID NO: 114714 - RNA, 19 nt, Homo sapiens
uagaaaggcccaaguccau

SEQ ID NO: 114715 - RNA, 19 nt, Homo sapiens
gguaaagccaagaauccuu

SEQ ID NO: 114716 - RNA, 19 nt, Homo sapiens
ggagcaggccagaauuaag

SEQ ID NO: 114717 - RNA, 19 nt, Homo sapiens
gaugaaguuuguggacucu

SEQ ID NO: 114718 - RNA, 19 nt, Homo sapiens
gcccucaacagugaaagua

SEQ ID NO: 114719 - RNA, 19 nt, Homo sapiens
ccuaaugaccccauguuua

SEQ ID NO: 114720 - RNA, 19 nt, Homo sapiens
uaaggagcaggccagaauu

SEQ ID NO: 114721 - RNA, 19 nt, Homo sapiens
caaaucaggaagugcuugu

SEQ ID NO: 114722 - RNA, 19 nt, Homo sapiens
ucucacaauuucaccaaca

SEQ ID NO: 114723 - RNA, 19 nt, Homo sapiens
gggauugguguaugaaaca

SEQ ID NO: 114724 - RNA, 19 nt, Homo sapiens
ugugcccaauguccucuua

SEQ ID NO: 114725 - RNA, 19 nt, Homo sapiens
agacugauccgcgauauac

SEQ ID NO: 114726 - RNA, 19 nt, Homo sapiens
cauguuaggcuauacugau

SEQ ID NO: 114727 - RNA, 19 nt, Homo sapiens
cuguggaucuaauagcaaa

SEQ ID NO: 114728 - RNA, 19 nt, Homo sapiens
gugcuugucuggcuaacac

SEQ ID NO: 114729 - RNA, 19 nt, Homo sapiens
cccaacagaggaacaggua

SEQ ID NO: 114730 - RNA, 19 nt, Homo sapiens
gagggucugaugaaguuug

SEQ ID NO: 114731 - RNA, 19 nt, Homo sapiens
caaaucacuguggacauga

SEQ ID NO: 114732 - RNA, 19 nt, Homo sapiens
accaacauguuaggcuaua

SEQ ID NO: 114733 - RNA, 19 nt, Homo sapiens
aguacugggaguugauuua

SEQ ID NO: 114734 - RNA, 19 nt, Homo sapiens
ccucaacagugaaaguaac

SEQ ID NO: 114735 - RNA, 19 nt, Homo sapiens
ggauugguguaugaaacau

SEQ ID NO: 114736 - RNA, 19 nt, Homo sapiens
ggccagaauuaagacuuuc

SEQ ID NO: 114737 - RNA, 19 nt, Homo sapiens
uggacuggucucacaauuu

SEQ ID NO: 114738 - RNA, 19 nt, Homo sapiens
gcacacagaugaugaaaug

SEQ ID NO: 114739 - RNA, 19 nt, Homo sapiens
gaacuuggcuguaaucagu

SEQ ID NO: 114740 - RNA, 19 nt, Homo sapiens
gugauuaacuugcuuagua

SEQ ID NO: 114741 - RNA, 19 nt, Homo sapiens
ggaauucaaugauguguau

SEQ ID NO: 114742 - RNA, 19 nt, Homo sapiens
gcagggaccuccuuauaga

SEQ ID NO: 114743 - RNA, 19 nt, Homo sapiens
gcaagaaacuauauucagu

SEQ ID NO: 114744 - RNA, 19 nt, Homo sapiens
gaacugcgguuacuuaaac

SEQ ID NO: 114745 - RNA, 19 nt, Homo sapiens
gaacacaauugauacuuca

SEQ ID NO: 114746 - RNA, 19 nt, Homo sapiens
gaaauacugcucugaauau

SEQ ID NO: 114747 - RNA, 19 nt, Homo sapiens
gaaacaaguuauucucuuc

SEQ ID NO: 114748 - RNA, 19 nt, Homo sapiens
gaacuuugcgaauguauuu

SEQ ID NO: 114749 - RNA, 19 nt, Homo sapiens
gcagagguuucuugaauau

SEQ ID NO: 114750 - RNA, 19 nt, Homo sapiens
ggagaaagggcaaauuauu

SEQ ID NO: 114751 - RNA, 19 nt, Homo sapiens
ggaaacaaguuauucucuu

SEQ ID NO: 114752 - RNA, 19 nt, Homo sapiens
ggaaaagccugaccuauga

SEQ ID NO: 114753 - RNA, 19 nt, Homo sapiens
gucagaagcuuacagauga

SEQ ID NO: 114754 - RNA, 19 nt, Homo sapiens
caaggucucuggaggaauu

SEQ ID NO: 114755 - RNA, 19 nt, Homo sapiens
cacgggaacucuccaaaua

SEQ ID NO: 114756 - RNA, 19 nt, Homo sapiens
gggcagaucugaacaacau

SEQ ID NO: 114757 - RNA, 19 nt, Homo sapiens
gauauuauggcaagugaua

SEQ ID NO: 114758 - RNA, 19 nt, Homo sapiens
ucucagaucuugacaguau

SEQ ID NO: 114759 - RNA, 19 nt, Homo sapiens
ggaauauguucaaugcaaa

SEQ ID NO: 114760 - RNA, 19 nt, Homo sapiens
gacagaaucuuguauuugg

SEQ ID NO: 114761 - RNA, 19 nt, Homo sapiens
gugcagagguuucuugaau

SEQ ID NO: 114762 - RNA, 19 nt, Homo sapiens
ggacucagauaagagaauu

SEQ ID NO: 114763 - RNA, 19 nt, Homo sapiens
ggccucaucuccuuuauug

SEQ ID NO: 114764 - RNA, 19 nt, Homo sapiens
gaaagcagggaccuccuua

SEQ ID NO: 114765 - RNA, 19 nt, Homo sapiens
acauucagcugacauaauu

SEQ ID NO: 114766 - RNA, 19 nt, Homo sapiens
gaaaagaaccuacagagaa

SEQ ID NO: 114767 - RNA, 19 nt, Homo sapiens
gaagaaaguguagauaguu

SEQ ID NO: 114768 - RNA, 19 nt, Homo sapiens
gugacagaaucuuguauuu

SEQ ID NO: 114769 - RNA, 19 nt, Homo sapiens
ccaggaauaucccaaacuu

SEQ ID NO: 114770 - RNA, 19 nt, Homo sapiens
uguaaaugcucgugugauu

SEQ ID NO: 114771 - RNA, 19 nt, Homo sapiens
gggccaagguguuuccauu

SEQ ID NO: 114772 - RNA, 19 nt, Homo sapiens
gaucuugacaguauauuug

SEQ ID NO: 114773 - RNA, 19 nt, Homo sapiens
caaauucuccgaggucuaa

SEQ ID NO: 114774 - RNA, 19 nt, Homo sapiens
ggaaucccuuugagaaugu

SEQ ID NO: 114775 - RNA, 19 nt, Homo sapiens
guaggaaucccuuugagaa

SEQ ID NO: 114776 - RNA, 19 nt, Homo sapiens
caccucagcugauauuaug

SEQ ID NO: 114777 - RNA, 19 nt, Homo sapiens
cgggaacucuccaaauauu

SEQ ID NO: 114778 - RNA, 19 nt, Homo sapiens
gaggaauuaucaugggaaa

SEQ ID NO: 114779 - RNA, 19 nt, Homo sapiens
gaagaugaacuuugcgaau

SEQ ID NO: 114780 - RNA, 19 nt, Homo sapiens
gaagcucuccagaccauuu

SEQ ID NO: 114781 - RNA, 19 nt, Homo sapiens
ggaaggaggcagacugaug

SEQ ID NO: 114782 - RNA, 19 nt, Homo sapiens
aggaacagguggauguaua

SEQ ID NO: 114783 - RNA, 19 nt, Homo sapiens
gagaagaaaguguagauag

SEQ ID NO: 114784 - RNA, 19 nt, Homo sapiens
uaugaucaguccuuugaaa

SEQ ID NO: 114785 - RNA, 19 nt, Homo sapiens
ccacgauccugaugaugaa

SEQ ID NO: 114786 - RNA, 19 nt, Homo sapiens
uggagaagaugcuuguauu

SEQ ID NO: 114787 - RNA, 19 nt, Homo sapiens
gcagagugaggauguguuu

SEQ ID NO: 114788 - RNA, 19 nt, Homo sapiens
ggaacucuccaaauauuau

SEQ ID NO: 114789 - RNA, 19 nt, Homo sapiens
gaugaacuuugcgaaugua

SEQ ID NO: 114790 - RNA, 19 nt, Homo sapiens
ugacucagaugccgaagau

SEQ ID NO: 114791 - RNA, 19 nt, Homo sapiens
ugaacuggaugcauuacaa

SEQ ID NO: 114792 - RNA, 19 nt, Homo sapiens
uaaucuagcugugaaugaa

SEQ ID NO: 114793 - RNA, 19 nt, Homo sapiens
gcuuacagaugaccauguu

SEQ ID NO: 114794 - RNA, 19 nt, Homo sapiens
ugagucaacuggagcaaga

SEQ ID NO: 114795 - RNA, 19 nt, Homo sapiens
ccacagggccaccuucuug

SEQ ID NO: 114796 - RNA, 19 nt, Homo sapiens
uaacauugacuucuugguu

SEQ ID NO: 114797 - RNA, 19 nt, Homo sapiens
gcuaagaaaugcugaaaau

SEQ ID NO: 114798 - RNA, 19 nt, Homo sapiens
caugucaccucagcugaua

SEQ ID NO: 114799 - RNA, 19 nt, Homo sapiens
gguaagacaauaugaacaa

SEQ ID NO: 114800 - RNA, 19 nt, Homo sapiens
guauuggacucagauaaga

SEQ ID NO: 114801 - RNA, 19 nt, Homo sapiens
guacagaccauauuaacca

SEQ ID NO: 114802 - RNA, 19 nt, Homo sapiens
agaaauacugcucugaaua

SEQ ID NO: 114803 - RNA, 19 nt, Homo sapiens
agaagaaaguguagauagu

SEQ ID NO: 114804 - RNA, 19 nt, Homo sapiens
agaagaugcuuguauugga

SEQ ID NO: 114805 - RNA, 19 nt, Homo sapiens
ggagaagaugcuuguauug

SEQ ID NO: 114806 - RNA, 19 nt, Homo sapiens
agagaacugcgguuacuua

SEQ ID NO: 114807 - RNA, 19 nt, Homo sapiens
gcucccaucuccugauuuc

SEQ ID NO: 114808 - RNA, 19 nt, Homo sapiens
gccaagguguuuccauuuc

SEQ ID NO: 114809 - RNA, 19 nt, Homo sapiens
aacauugacuucuugguuu

SEQ ID NO: 114810 - RNA, 19 nt, Homo sapiens
gcacuagccugugauuaac

SEQ ID NO: 114811 - RNA, 19 nt, Homo sapiens
ggcaggagcugaacaagac

SEQ ID NO: 114812 - RNA, 19 nt, Homo sapiens
gagaacugcgguuacuuaa

SEQ ID NO: 114813 - RNA, 19 nt, Homo sapiens
aaagagagaaugagggaaa

SEQ ID NO: 114814 - RNA, 19 nt, Homo sapiens
gaacagaaaacaaaagaga

SEQ ID NO: 114815 - RNA, 19 nt, Homo sapiens
cuggaagccuggacucuaa

SEQ ID NO: 114816 - RNA, 19 nt, Homo sapiens
cuuggcagcuuaacauuga

SEQ ID NO: 114817 - RNA, 19 nt, Homo sapiens
ccagacaguugauauuugg

SEQ ID NO: 114818 - RNA, 19 nt, Homo sapiens
ugaacacaauugauacuuc

SEQ ID NO: 114819 - RNA, 19 nt, Homo sapiens
guaccacgauccugaugau

SEQ ID NO: 114820 - RNA, 19 nt, Homo sapiens
cuacagagaacugcgguua

SEQ ID NO: 114821 - RNA, 19 nt, Homo sapiens
gcuuaacauugacuucuug

SEQ ID NO: 114822 - RNA, 19 nt, Homo sapiens
cuagugcuauucuguguug

SEQ ID NO: 114823 - RNA, 19 nt, Homo sapiens
gaagcagguucuugauguc

SEQ ID NO: 114824 - RNA, 19 nt, Homo sapiens
uaacuugcuuaguaugguu

SEQ ID NO: 114825 - RNA, 19 nt, Homo sapiens
gggaacucuccaaauauua

SEQ ID NO: 114826 - RNA, 19 nt, Homo sapiens
aagcagggaccuccuuaua

SEQ ID NO: 114827 - RNA, 19 nt, Homo sapiens
ucagugggaugcauaaugg

SEQ ID NO: 114828 - RNA, 19 nt, Homo sapiens
aggaauauguucaaugcaa

SEQ ID NO: 114829 - RNA, 19 nt, Homo sapiens
aagaugaacuuugcgaaug

SEQ ID NO: 114830 - RNA, 19 nt, Homo sapiens
gagcugaagauucuggauu

SEQ ID NO: 114831 - RNA, 19 nt, Homo sapiens
ucuccgaggucuaaaguau

SEQ ID NO: 114832 - RNA, 19 nt, Homo sapiens
gagagaaugagggaaauug

SEQ ID NO: 114833 - RNA, 19 nt, Homo sapiens
uaguuuagaucccauguca

SEQ ID NO: 114834 - RNA, 19 nt, Homo sapiens
ccgcuuaucucauuaacag

SEQ ID NO: 114835 - RNA, 19 nt, Homo sapiens
cauaauggccgagcuguug

SEQ ID NO: 114836 - RNA, 19 nt, Homo sapiens
ugcagagguuucuugaaua

SEQ ID NO: 114837 - RNA, 19 nt, Homo sapiens
gagagaagaaaguguagau

SEQ ID NO: 114838 - RNA, 19 nt, Homo sapiens
gcacacagaugaugaaaug

SEQ ID NO: 114839 - RNA, 19 nt, Homo sapiens
gaacuuggcuguaaucagu

SEQ ID NO: 114840 - RNA, 19 nt, Homo sapiens
gugauuaacuugcuuagua

SEQ ID NO: 114841 - RNA, 19 nt, Homo sapiens
ggaauucaaugauguguau

SEQ ID NO: 114842 - RNA, 19 nt, Homo sapiens
gcagggaccuccuuauaga

SEQ ID NO: 114843 - RNA, 19 nt, Homo sapiens
gcaagaaacuauauucagu

SEQ ID NO: 114844 - RNA, 19 nt, Homo sapiens
gaacugcgguuacuuaaac

SEQ ID NO: 114845 - RNA, 19 nt, Homo sapiens
gaacacaauugauacuuca

SEQ ID NO: 114846 - RNA, 19 nt, Homo sapiens
gaaauacugcucugaauau

SEQ ID NO: 114847 - RNA, 19 nt, Homo sapiens
gaaacaaguuauucucuuc

SEQ ID NO: 114848 - RNA, 19 nt, Homo sapiens
gaacuuugcgaauguauuu

SEQ ID NO: 114849 - RNA, 19 nt, Homo sapiens
gcagagguuucuugaauau

SEQ ID NO: 114850 - RNA, 19 nt, Homo sapiens
ggagaaagggcaaauuauu

SEQ ID NO: 114851 - RNA, 19 nt, Homo sapiens
ggaaacaaguuauucucuu

SEQ ID NO: 114852 - RNA, 19 nt, Homo sapiens
ggaaaagccugaccuauga

SEQ ID NO: 114853 - RNA, 19 nt, Homo sapiens
gucagaagcuuacagauga

SEQ ID NO: 114854 - RNA, 19 nt, Homo sapiens
caaggucucuggaggaauu

SEQ ID NO: 114855 - RNA, 19 nt, Homo sapiens
cacgggaacucuccaaaua

SEQ ID NO: 114856 - RNA, 19 nt, Homo sapiens
gggcagaucugaacaacau

SEQ ID NO: 114857 - RNA, 19 nt, Homo sapiens
gauauuauggcaagugaua

SEQ ID NO: 114858 - RNA, 19 nt, Homo sapiens
ucucagaucuugacaguau

SEQ ID NO: 114859 - RNA, 19 nt, Homo sapiens
ggaauauguucaaugcaaa

SEQ ID NO: 114860 - RNA, 19 nt, Homo sapiens
gacagaaucuuguauuugg

SEQ ID NO: 114861 - RNA, 19 nt, Homo sapiens
gugcagagguuucuugaau

SEQ ID NO: 114862 - RNA, 19 nt, Homo sapiens
ggacucagauaagagaauu

SEQ ID NO: 114863 - RNA, 19 nt, Homo sapiens
ggccucaucuccuuuauug

SEQ ID NO: 114864 - RNA, 19 nt, Homo sapiens
gaaagcagggaccuccuua

SEQ ID NO: 114865 - RNA, 19 nt, Homo sapiens
guacagaccauauugauca

SEQ ID NO: 114866 - RNA, 19 nt, Homo sapiens
acauucagcugacauaauu

SEQ ID NO: 114867 - RNA, 19 nt, Homo sapiens
gaaaagaaccuacagagaa

SEQ ID NO: 114868 - RNA, 19 nt, Homo sapiens
gaagaaaguguagauaguu

SEQ ID NO: 114869 - RNA, 19 nt, Homo sapiens
gugacagaaucuuguauuu

SEQ ID NO: 114870 - RNA, 19 nt, Homo sapiens
ccaggaauaucccaaacuu

SEQ ID NO: 114871 - RNA, 19 nt, Homo sapiens
gggcugagcuuuugaagaa

SEQ ID NO: 114872 - RNA, 19 nt, Homo sapiens
uguaaaugcucgugugauu

SEQ ID NO: 114873 - RNA, 19 nt, Homo sapiens
gggccaagguguuuccauu

SEQ ID NO: 114874 - RNA, 19 nt, Homo sapiens
gaucuugacaguauauuug

SEQ ID NO: 114875 - RNA, 19 nt, Homo sapiens
caaauucuccgaggucuaa

SEQ ID NO: 114876 - RNA, 19 nt, Homo sapiens
ggaaucccuuugagaaugu

SEQ ID NO: 114877 - RNA, 19 nt, Homo sapiens
guaggaaucccuuugagaa

SEQ ID NO: 114878 - RNA, 19 nt, Homo sapiens
caccucagcugauauuaug

SEQ ID NO: 114879 - RNA, 19 nt, Homo sapiens
cgggaacucuccaaauauu

SEQ ID NO: 114880 - RNA, 19 nt, Homo sapiens
gaggaauuaucaugggaaa

SEQ ID NO: 114881 - RNA, 19 nt, Homo sapiens
gaagaugaacuuugcgaau

SEQ ID NO: 114882 - RNA, 19 nt, Homo sapiens
gaagcucuccagaccauuu

SEQ ID NO: 114883 - RNA, 19 nt, Homo sapiens
ggaaggaggcagacugaug

SEQ ID NO: 114884 - RNA, 19 nt, Homo sapiens
aggaacagguggauguaua

SEQ ID NO: 114885 - RNA, 19 nt, Homo sapiens
gagaagaaaguguagauag

SEQ ID NO: 114886 - RNA, 19 nt, Homo sapiens
uaugaucaguccuuugaaa

SEQ ID NO: 114887 - RNA, 19 nt, Homo sapiens
ccacgauccugaugaugaa

SEQ ID NO: 114888 - RNA, 19 nt, Homo sapiens
uggagaagaugcuuguauu

SEQ ID NO: 114889 - RNA, 19 nt, Homo sapiens
gcagagugaggauguguuu

SEQ ID NO: 114890 - RNA, 19 nt, Homo sapiens
ggaacucuccaaauauuau

SEQ ID NO: 114891 - RNA, 19 nt, Homo sapiens
gaugaacuuugcgaaugua

SEQ ID NO: 114892 - RNA, 19 nt, Homo sapiens
ugacucagaugccgaagau

SEQ ID NO: 114893 - RNA, 19 nt, Homo sapiens
ugaacuggaugcauuacaa

SEQ ID NO: 114894 - RNA, 19 nt, Homo sapiens
uaaucuagcugugaaugaa

SEQ ID NO: 114895 - RNA, 19 nt, Homo sapiens
gcuuacagaugaccauguu

SEQ ID NO: 114896 - RNA, 19 nt, Homo sapiens
ugagucaacuggagcaaga

SEQ ID NO: 114897 - RNA, 19 nt, Homo sapiens
ccacagggccaccuucuug

SEQ ID NO: 114898 - RNA, 19 nt, Homo sapiens
uaacauugacuucuugguu

SEQ ID NO: 114899 - RNA, 19 nt, Homo sapiens
gcuaagaaaugcugaaaau

SEQ ID NO: 114900 - RNA, 19 nt, Homo sapiens
caugucaccucagcugaua

SEQ ID NO: 114901 - RNA, 19 nt, Homo sapiens
gguaagacaauaugaacaa

SEQ ID NO: 114902 - RNA, 19 nt, Homo sapiens
guauuggacucagauaaga

SEQ ID NO: 114903 - RNA, 19 nt, Homo sapiens
agaaauacugcucugaaua

SEQ ID NO: 114904 - RNA, 19 nt, Homo sapiens
agaagaaaguguagauagu

SEQ ID NO: 114905 - RNA, 19 nt, Homo sapiens
agaagaugcuuguauugga

SEQ ID NO: 114906 - RNA, 19 nt, Homo sapiens
ggagaagaugcuuguauug

SEQ ID NO: 114907 - RNA, 19 nt, Homo sapiens
agagaacugcgguuacuua

SEQ ID NO: 114908 - RNA, 19 nt, Homo sapiens
gcucccaucuccugauuuc

SEQ ID NO: 114909 - RNA, 19 nt, Homo sapiens
gccaagguguuuccauuuc

SEQ ID NO: 114910 - RNA, 19 nt, Homo sapiens
aacauugacuucuugguuu

SEQ ID NO: 114911 - RNA, 19 nt, Homo sapiens
gcacuagccugugauuaac

SEQ ID NO: 114912 - RNA, 19 nt, Homo sapiens
ggcaggagcugaacaagac

SEQ ID NO: 114913 - RNA, 19 nt, Homo sapiens
gagaacugcgguuacuuaa

SEQ ID NO: 114914 - RNA, 19 nt, Homo sapiens
aaagagagaaugagggaaa

SEQ ID NO: 114915 - RNA, 19 nt, Homo sapiens
gaacagaaaacaaaagaga

SEQ ID NO: 114916 - RNA, 19 nt, Homo sapiens
cuggaagccuggacucuaa

SEQ ID NO: 114917 - RNA, 19 nt, Homo sapiens
cuuggcagcuuaacauuga

SEQ ID NO: 114918 - RNA, 19 nt, Homo sapiens
ccagacaguugauauuugg

SEQ ID NO: 114919 - RNA, 19 nt, Homo sapiens
ugaacacaauugauacuuc

SEQ ID NO: 114920 - RNA, 19 nt, Homo sapiens
guaccacgauccugaugau

SEQ ID NO: 114921 - RNA, 19 nt, Homo sapiens
cuacagagaacugcgguua

SEQ ID NO: 114922 - RNA, 19 nt, Homo sapiens
gcuuaacauugacuucuug

SEQ ID NO: 114923 - RNA, 19 nt, Homo sapiens
cuagugcuauucuguguug

SEQ ID NO: 114924 - RNA, 19 nt, Homo sapiens
gaagcagguucuugauguc

SEQ ID NO: 114925 - RNA, 19 nt, Homo sapiens
uaacuugcuuaguaugguu

SEQ ID NO: 114926 - RNA, 19 nt, Homo sapiens
gggaacucuccaaauauua

SEQ ID NO: 114927 - RNA, 19 nt, Homo sapiens
aagcagggaccuccuuaua

SEQ ID NO: 114928 - RNA, 19 nt, Homo sapiens
ucagugggaugcauaaugg

SEQ ID NO: 114929 - RNA, 19 nt, Homo sapiens
aggaauauguucaaugcaa

SEQ ID NO: 114930 - RNA, 19 nt, Homo sapiens
aagaugaacuuugcgaaug

SEQ ID NO: 114931 - RNA, 19 nt, Homo sapiens
gagcugaagauucuggauu

SEQ ID NO: 114932 - RNA, 19 nt, Homo sapiens
ucuccgaggucuaaaguau

SEQ ID NO: 114933 - RNA, 19 nt, Homo sapiens
gagagaaugagggaaauug

SEQ ID NO: 114934 - RNA, 19 nt, Homo sapiens
uaguuuagaucccauguca

SEQ ID NO: 114935 - RNA, 19 nt, Homo sapiens
cauaauggccgagcuguug

SEQ ID NO: 114936 - RNA, 19 nt, Homo sapiens
ugcagagguuucuugaaua

SEQ ID NO: 114937 - RNA, 19 nt, Homo sapiens
gagagaagaaaguguagau

SEQ ID NO: 114938 - RNA, 19 nt, Homo sapiens
gcacacagaugaugaaaug

SEQ ID NO: 114939 - RNA, 19 nt, Homo sapiens
ggaauucaaugauguguau

SEQ ID NO: 114940 - RNA, 19 nt, Homo sapiens
gcaagaaacuauauucagu

SEQ ID NO: 114941 - RNA, 19 nt, Homo sapiens
gaacugcgguuacuuaaac

SEQ ID NO: 114942 - RNA, 19 nt, Homo sapiens
gaacuuugcgaauguauuu

SEQ ID NO: 114943 - RNA, 19 nt, Homo sapiens
gucagaagcuuacagauga

SEQ ID NO: 114944 - RNA, 19 nt, Homo sapiens
caaggucucuggaggaauu

SEQ ID NO: 114945 - RNA, 19 nt, Homo sapiens
gggcagaucugaacaacau

SEQ ID NO: 114946 - RNA, 19 nt, Homo sapiens
guacagaccauauugauca

SEQ ID NO: 114947 - RNA, 19 nt, Homo sapiens
acauucagcugacauaauu

SEQ ID NO: 114948 - RNA, 19 nt, Homo sapiens
gaaaagaaccuacagagaa

SEQ ID NO: 114949 - RNA, 19 nt, Homo sapiens
ccucauggauauugaauug

SEQ ID NO: 114950 - RNA, 19 nt, Homo sapiens
gggcugagcuuuugaagaa

SEQ ID NO: 114951 - RNA, 19 nt, Homo sapiens
caaauucuccgaggucuaa

SEQ ID NO: 114952 - RNA, 19 nt, Homo sapiens
gaagaugaacuuugcgaau

SEQ ID NO: 114953 - RNA, 19 nt, Homo sapiens
gaagcucuccagaccauuu

SEQ ID NO: 114954 - RNA, 19 nt, Homo sapiens
uggguaaguugaccauaua

SEQ ID NO: 114955 - RNA, 19 nt, Homo sapiens
gaugaacuuugcgaaugua

SEQ ID NO: 114956 - RNA, 19 nt, Homo sapiens
ugacucagaugccgaagau

SEQ ID NO: 114957 - RNA, 19 nt, Homo sapiens
ugaacuggaugcauuacaa

SEQ ID NO: 114958 - RNA, 19 nt, Homo sapiens
uaaucuagcugugaaugaa

SEQ ID NO: 114959 - RNA, 19 nt, Homo sapiens
gcuuacagaugaccauguu

SEQ ID NO: 114960 - RNA, 19 nt, Homo sapiens
ccacagggccaccuucuug

SEQ ID NO: 114961 - RNA, 19 nt, Homo sapiens
ccaaauaaaguaccauuag

SEQ ID NO: 114962 - RNA, 19 nt, Homo sapiens
agagaacugcgguuacuua

SEQ ID NO: 114963 - RNA, 19 nt, Homo sapiens
gagaacugcgguuacuuaa

SEQ ID NO: 114964 - RNA, 19 nt, Homo sapiens
ggcaggagcugaacaagac

SEQ ID NO: 114965 - RNA, 19 nt, Homo sapiens
ccagacaguugauauuugg

SEQ ID NO: 114966 - RNA, 19 nt, Homo sapiens
cauauauccucaccucaug

SEQ ID NO: 114967 - RNA, 19 nt, Homo sapiens
cuacagagaacugcgguua

SEQ ID NO: 114968 - RNA, 19 nt, Homo sapiens
ucagugggaugcauaaugg

SEQ ID NO: 114969 - RNA, 19 nt, Homo sapiens
aagaugaacuuugcgaaug

SEQ ID NO: 114970 - RNA, 19 nt, Homo sapiens
gagcugaagauucuggauu

SEQ ID NO: 114971 - RNA, 19 nt, Homo sapiens
ucuccgaggucuaaaguau

SEQ ID NO: 114972 - RNA, 19 nt, Homo sapiens
cauaauggccgagcuguug

SEQ ID NO: 114973 - RNA, 19 nt, Homo sapiens
gcagaucugaacaacauug

SEQ ID NO: 114974 - RNA, 19 nt, Homo sapiens
cagaccauauugaucaguu

SEQ ID NO: 114975 - RNA, 19 nt, Homo sapiens
gaccauguucaguuccuua

SEQ ID NO: 114976 - RNA, 19 nt, Homo sapiens
cagaugaccauguucaguu

SEQ ID NO: 114977 - RNA, 19 nt, Homo sapiens
gggauuugaagaagaguuu

SEQ ID NO: 114978 - RNA, 19 nt, Homo sapiens
gagcugaacaagacaaucu

SEQ ID NO: 114979 - RNA, 19 nt, Homo sapiens
gcgguuacuuaaacauaug

SEQ ID NO: 114980 - RNA, 19 nt, Homo sapiens
ccauuucaguccaucauuc

SEQ ID NO: 114981 - RNA, 19 nt, Homo sapiens
gaccaaauaaaguaccauu

SEQ ID NO: 114982 - RNA, 19 nt, Homo sapiens
gaaaaucuccucagagucu

SEQ ID NO: 114983 - RNA, 19 nt, Homo sapiens
guaaucuagcugugaauga

SEQ ID NO: 114984 - RNA, 19 nt, Homo sapiens
ccuaaaaccuaguaaucua

SEQ ID NO: 114985 - RNA, 19 nt, Homo sapiens
gaucaguugaagcucauuu

SEQ ID NO: 114986 - RNA, 19 nt, Homo sapiens
gccgagcuguugacuggaa

SEQ ID NO: 114987 - RNA, 19 nt, Homo sapiens
cgcgaccacuggagccuua

SEQ ID NO: 114988 - RNA, 19 nt, Homo sapiens
cauguucaguuccuuaucu

SEQ ID NO: 114989 - RNA, 19 nt, Homo sapiens
acugugagcugaagauucu

SEQ ID NO: 114990 - RNA, 19 nt, Homo sapiens
uccgaggucuaaaguauau

SEQ ID NO: 114991 - RNA, 19 nt, Homo sapiens
aaaugugauuggucuguug

SEQ ID NO: 114992 - RNA, 19 nt, Homo sapiens
ugaagaaaaucuccucaga

SEQ ID NO: 114993 - RNA, 19 nt, Homo sapiens
uuccuuaucuaccaaauuc

SEQ ID NO: 114994 - RNA, 19 nt, Homo sapiens
cuggguaaguugaccauau

SEQ ID NO: 114995 - RNA, 19 nt, Homo sapiens
aagaagcucuccagaccau

SEQ ID NO: 114996 - RNA, 19 nt, Homo sapiens
agaugaacuuugcgaaugu

SEQ ID NO: 114997 - RNA, 19 nt, Homo sapiens
agcugaagauucuggauuu

SEQ ID NO: 114998 - RNA, 19 nt, Homo sapiens
uggaggaauucaaugaugu

SEQ ID NO: 114999 - RNA, 19 nt, Homo sapiens
guccaucauucaugcgaaa

SEQ ID NO: 115000 - RNA, 19 nt, Homo sapiens
ucauggauauugaauuggu

SEQ ID NO: 115001 - RNA, 19 nt, Homo sapiens
ugucagaagcuuacagaug

SEQ ID NO: 115002 - RNA, 19 nt, Homo sapiens
gugaaaugucagaagcuua

SEQ ID NO: 115003 - RNA, 19 nt, Homo sapiens
acucagaugccgaagauga

SEQ ID NO: 115004 - RNA, 19 nt, Homo sapiens
cacagaugaugaaaugaca

SEQ ID NO: 115005 - RNA, 19 nt, Homo sapiens
ggaggaauucaaugaugug

SEQ ID NO: 115006 - RNA, 19 nt, Homo sapiens
gaccauauugaucaguuga

SEQ ID NO: 115007 - RNA, 19 nt, Homo sapiens
cuccugagaucaugcugaa

SEQ ID NO: 115008 - RNA, 19 nt, Homo sapiens
cuggaggaauucaaugaug

SEQ ID NO: 115009 - RNA, 19 nt, Homo sapiens
acagagaacugcgguuacu

SEQ ID NO: 115010 - RNA, 19 nt, Homo sapiens
gcauaauggccgagcuguu

SEQ ID NO: 115011 - RNA, 19 nt, Homo sapiens
gaacuggaugcauuacaac

SEQ ID NO: 115012 - RNA, 19 nt, Homo sapiens
ugaaaugucagaagcuuac

SEQ ID NO: 115013 - RNA, 19 nt, Homo sapiens
aagaaaaucuccucagagu

SEQ ID NO: 115014 - RNA, 19 nt, Homo sapiens
aaccagacaguugauauuu

SEQ ID NO: 115015 - RNA, 19 nt, Homo sapiens
agaugaccauguucaguuc

SEQ ID NO: 115016 - RNA, 19 nt, Homo sapiens
ccauauauccucaccucau

SEQ ID NO: 115017 - RNA, 19 nt, Homo sapiens
accagacaguugauauuug

SEQ ID NO: 115018 - RNA, 19 nt, Homo sapiens
cauggauauugaauugguu

SEQ ID NO: 115019 - RNA, 19 nt, Homo sapiens
caggcuacguggccacuag

SEQ ID NO: 115020 - RNA, 19 nt, Homo sapiens
uauacauucagcugacaua

SEQ ID NO: 115021 - RNA, 19 nt, Homo sapiens
uuacagaugaccauguuca

SEQ ID NO: 115022 - RNA, 19 nt, Homo sapiens
ugugaaaugucagaagcuu

SEQ ID NO: 115023 - RNA, 19 nt, Homo sapiens
guaaguugaccauauaucc

SEQ ID NO: 115024 - RNA, 19 nt, Homo sapiens
ccauauugaucaguugaag

SEQ ID NO: 115025 - RNA, 19 nt, Homo sapiens
agaccauauugaucaguug

SEQ ID NO: 115026 - RNA, 19 nt, Homo sapiens
ugaagacugugagcugaag

SEQ ID NO: 115027 - RNA, 19 nt, Homo sapiens
ggauauugaauugguuaug

SEQ ID NO: 115028 - RNA, 19 nt, Homo sapiens
gguuacguguggcagugaa

SEQ ID NO: 115029 - RNA, 19 nt, Homo sapiens
ugcaaggucucuggaggaa

SEQ ID NO: 115030 - RNA, 19 nt, Homo sapiens
ugcgguuacuuaaacauau

SEQ ID NO: 115031 - RNA, 19 nt, Homo sapiens
ugccgaagaugaacuuugc

SEQ ID NO: 115032 - RNA, 19 nt, Homo sapiens
aggagaggcccacguucua

SEQ ID NO: 115033 - RNA, 19 nt, Homo sapiens
gcauuacaaccagacaguu

SEQ ID NO: 115034 - RNA, 19 nt, Homo sapiens
gaagaguuucuccuuuuga

SEQ ID NO: 115035 - RNA, 19 nt, Homo sapiens
ucaguuccuuaucuaccaa

SEQ ID NO: 115036 - RNA, 19 nt, Homo sapiens
cggcaggagcugaacaaga

SEQ ID NO: 115037 - RNA, 19 nt, Homo sapiens
gagucugcaagaaacuaua

SEQ ID NO: 115038 - RNA, 19 nt, Homo sapiens
gcacacagaugaugaaaug

SEQ ID NO: 115039 - RNA, 19 nt, Homo sapiens
gaacuuggcuguaaucagu

SEQ ID NO: 115040 - RNA, 19 nt, Homo sapiens
gugauuaacuugcuuagua

SEQ ID NO: 115041 - RNA, 19 nt, Homo sapiens
ggaauucaaugauguguau

SEQ ID NO: 115042 - RNA, 19 nt, Homo sapiens
gcagggaccuccuuauaga

SEQ ID NO: 115043 - RNA, 19 nt, Homo sapiens
gaacugcgguuacuuaaac

SEQ ID NO: 115044 - RNA, 19 nt, Homo sapiens
gaacacaauugauacuuca

SEQ ID NO: 115045 - RNA, 19 nt, Homo sapiens
gaaauacugcucugaauau

SEQ ID NO: 115046 - RNA, 19 nt, Homo sapiens
gaaacaaguuauucucuuc

SEQ ID NO: 115047 - RNA, 19 nt, Homo sapiens
gcagagguuucuugaauau

SEQ ID NO: 115048 - RNA, 19 nt, Homo sapiens
ggagaaagggcaaauuauu

SEQ ID NO: 115049 - RNA, 19 nt, Homo sapiens
ggaaacaaguuauucucuu

SEQ ID NO: 115050 - RNA, 19 nt, Homo sapiens
ggaaaagccugaccuauga

SEQ ID NO: 115051 - RNA, 19 nt, Homo sapiens
gucagaagcuuacagauga

SEQ ID NO: 115052 - RNA, 19 nt, Homo sapiens
caaggucucuggaggaauu

SEQ ID NO: 115053 - RNA, 19 nt, Homo sapiens
gggcagaucugaacaacau

SEQ ID NO: 115054 - RNA, 19 nt, Homo sapiens
gauauuauggcaagugaua

SEQ ID NO: 115055 - RNA, 19 nt, Homo sapiens
gggaaccucuccaaauauu

SEQ ID NO: 115056 - RNA, 19 nt, Homo sapiens
ucucagaucuugacaguau

SEQ ID NO: 115057 - RNA, 19 nt, Homo sapiens
ggaauauguucaaugcaaa

SEQ ID NO: 115058 - RNA, 19 nt, Homo sapiens
gacagaaucuuguauuugg

SEQ ID NO: 115059 - RNA, 19 nt, Homo sapiens
gugcagagguuucuugaau

SEQ ID NO: 115060 - RNA, 19 nt, Homo sapiens
ggacucagauaagagaauu

SEQ ID NO: 115061 - RNA, 19 nt, Homo sapiens
ggccucaucuccuuuauug

SEQ ID NO: 115062 - RNA, 19 nt, Homo sapiens
gaaagcagggaccuccuua

SEQ ID NO: 115063 - RNA, 19 nt, Homo sapiens
guacagaccauauugauca

SEQ ID NO: 115064 - RNA, 19 nt, Homo sapiens
acauucagcugacauaauu

SEQ ID NO: 115065 - RNA, 19 nt, Homo sapiens
gaaaagaaccuacagagaa

SEQ ID NO: 115066 - RNA, 19 nt, Homo sapiens
gaagaaaguguagauaguu

SEQ ID NO: 115067 - RNA, 19 nt, Homo sapiens
gaaccucuccaaauauuau

SEQ ID NO: 115068 - RNA, 19 nt, Homo sapiens
acgggaaccucuccaaaua

SEQ ID NO: 115069 - RNA, 19 nt, Homo sapiens
gugacagaaucuuguauuu

SEQ ID NO: 115070 - RNA, 19 nt, Homo sapiens
ccaggaauaucccaaacuu

SEQ ID NO: 115071 - RNA, 19 nt, Homo sapiens
gggcugagcuuuugaagaa

SEQ ID NO: 115072 - RNA, 19 nt, Homo sapiens
uguaaaugcucgugugauu

SEQ ID NO: 115073 - RNA, 19 nt, Homo sapiens
gggccaagguguuuccauu

SEQ ID NO: 115074 - RNA, 19 nt, Homo sapiens
gaucuugacaguauauuug

SEQ ID NO: 115075 - RNA, 19 nt, Homo sapiens
caaauucuccgaggucuaa

SEQ ID NO: 115076 - RNA, 19 nt, Homo sapiens
ggaaucccuuugagaaugu

SEQ ID NO: 115077 - RNA, 19 nt, Homo sapiens
guaggaaucccuuugagaa

SEQ ID NO: 115078 - RNA, 19 nt, Homo sapiens
caccucagcugauauuaug

SEQ ID NO: 115079 - RNA, 19 nt, Homo sapiens
gaggaauuaucaugggaaa

SEQ ID NO: 115080 - RNA, 19 nt, Homo sapiens
gaagcucuccagaccauuu

SEQ ID NO: 115081 - RNA, 19 nt, Homo sapiens
ggaaggaggcagacugaug

SEQ ID NO: 115082 - RNA, 19 nt, Homo sapiens
aggaacagguggauguaua

SEQ ID NO: 115083 - RNA, 19 nt, Homo sapiens
gagaagaaaguguagauag

SEQ ID NO: 115084 - RNA, 19 nt, Homo sapiens
uaugaucaguccuuugaaa

SEQ ID NO: 115085 - RNA, 19 nt, Homo sapiens
ccacgauccugaugaugaa

SEQ ID NO: 115086 - RNA, 19 nt, Homo sapiens
uggagaagaugcuuguauu

SEQ ID NO: 115087 - RNA, 19 nt, Homo sapiens
gcagagugaggauguguuu

SEQ ID NO: 115088 - RNA, 19 nt, Homo sapiens
ugaacuggaugcauuacaa

SEQ ID NO: 115089 - RNA, 19 nt, Homo sapiens
uaaucuagcugugaaugaa

SEQ ID NO: 115090 - RNA, 19 nt, Homo sapiens
gcuuacagaugaccauguu

SEQ ID NO: 115091 - RNA, 19 nt, Homo sapiens
ugagucaacuggagcaaga

SEQ ID NO: 115092 - RNA, 19 nt, Homo sapiens
ccacagggccaccuucuug

SEQ ID NO: 115093 - RNA, 19 nt, Homo sapiens
uaacauugacuucuugguu

SEQ ID NO: 115094 - RNA, 19 nt, Homo sapiens
gcuaagaaaugcugaaaau

SEQ ID NO: 115095 - RNA, 19 nt, Homo sapiens
caugucaccucagcugaua

SEQ ID NO: 115096 - RNA, 19 nt, Homo sapiens
gguaagacaauaugaacaa

SEQ ID NO: 115097 - RNA, 19 nt, Homo sapiens
guauuggacucagauaaga

SEQ ID NO: 115098 - RNA, 19 nt, Homo sapiens
agaaauacugcucugaaua

SEQ ID NO: 115099 - RNA, 19 nt, Homo sapiens
agaagaaaguguagauagu

SEQ ID NO: 115100 - RNA, 19 nt, Homo sapiens
agaagaugcuuguauugga

SEQ ID NO: 115101 - RNA, 19 nt, Homo sapiens
ggagaagaugcuuguauug

SEQ ID NO: 115102 - RNA, 19 nt, Homo sapiens
agagaacugcgguuacuua

SEQ ID NO: 115103 - RNA, 19 nt, Homo sapiens
gcucccaucuccugauuuc

SEQ ID NO: 115104 - RNA, 19 nt, Homo sapiens
gccaagguguuuccauuuc

SEQ ID NO: 115105 - RNA, 19 nt, Homo sapiens
aacauugacuucuugguuu

SEQ ID NO: 115106 - RNA, 19 nt, Homo sapiens
gcacuagccugugauuaac

SEQ ID NO: 115107 - RNA, 19 nt, Homo sapiens
ggcaggagcugaacaagac

SEQ ID NO: 115108 - RNA, 19 nt, Homo sapiens
gagaacugcgguuacuuaa

SEQ ID NO: 115109 - RNA, 19 nt, Homo sapiens
aaagagagaaugagggaaa

SEQ ID NO: 115110 - RNA, 19 nt, Homo sapiens
gaacagaaaacaaaagaga

SEQ ID NO: 115111 - RNA, 19 nt, Homo sapiens
cuggaagccuggacucuaa

SEQ ID NO: 115112 - RNA, 19 nt, Homo sapiens
cuuggcagcuuaacauuga

SEQ ID NO: 115113 - RNA, 19 nt, Homo sapiens
ccagacaguugauauuugg

SEQ ID NO: 115114 - RNA, 19 nt, Homo sapiens
ugaacacaauugauacuuc

SEQ ID NO: 115115 - RNA, 19 nt, Homo sapiens
guaccacgauccugaugau

SEQ ID NO: 115116 - RNA, 19 nt, Homo sapiens
cuacagagaacugcgguua

SEQ ID NO: 115117 - RNA, 19 nt, Homo sapiens
gcuuaacauugacuucuug

SEQ ID NO: 115118 - RNA, 19 nt, Homo sapiens
cuagugcuauucuguguug

SEQ ID NO: 115119 - RNA, 19 nt, Homo sapiens
gaagcagguucuugauguc

SEQ ID NO: 115120 - RNA, 19 nt, Homo sapiens
uaacuugcuuaguaugguu

SEQ ID NO: 115121 - RNA, 19 nt, Homo sapiens
ggaaccucuccaaauauua

SEQ ID NO: 115122 - RNA, 19 nt, Homo sapiens
aagcagggaccuccuuaua

SEQ ID NO: 115123 - RNA, 19 nt, Homo sapiens
ucagugggaugcauaaugg

SEQ ID NO: 115124 - RNA, 19 nt, Homo sapiens
aggaauauguucaaugcaa

SEQ ID NO: 115125 - RNA, 19 nt, Homo sapiens
gagcugaagauucuggauu

SEQ ID NO: 115126 - RNA, 19 nt, Homo sapiens
ucuccgaggucuaaaguau

SEQ ID NO: 115127 - RNA, 19 nt, Homo sapiens
gagagaaugagggaaauug

SEQ ID NO: 115128 - RNA, 19 nt, Homo sapiens
uaguuuagaucccauguca

SEQ ID NO: 115129 - RNA, 19 nt, Homo sapiens
cauaauggccgagcuguug

SEQ ID NO: 115130 - RNA, 19 nt, Homo sapiens
ugcagagguuucuugaaua

SEQ ID NO: 115131 - RNA, 19 nt, Homo sapiens
gagagaagaaaguguagau

SEQ ID NO: 115132 - RNA, 19 nt, Homo sapiens
guucucagaucuugacagu

SEQ ID NO: 115133 - RNA, 19 nt, Homo sapiens
gcaccugguuucuguucug

SEQ ID NO: 115134 - RNA, 19 nt, Homo sapiens
gcagaucugaacaacauug

SEQ ID NO: 115135 - RNA, 19 nt, Homo sapiens
gcagguucuugaugucaug

SEQ ID NO: 115136 - RNA, 19 nt, Homo sapiens
cagaccauauugaucaguu

SEQ ID NO: 115137 - RNA, 19 nt, Homo sapiens
gaccauguucaguuccuua

SEQ ID NO: 115138 - RNA, 19 nt, Homo sapiens
gaagguaucuggaaaugua

SEQ ID NO: 115139 - RNA, 19 nt, Homo sapiens
gcacaugccuccugaauca

SEQ ID NO: 115140 - RNA, 19 nt, Homo sapiens
gaagaagcauuugaagaua

SEQ ID NO: 115141 - RNA, 19 nt, Homo sapiens
caaaguaugugcuucagua

SEQ ID NO: 115142 - RNA, 19 nt, Homo sapiens
ggacaaguauuaauaguuc

SEQ ID NO: 115143 - RNA, 19 nt, Homo sapiens
ggaaggaucugauauugau

SEQ ID NO: 115144 - RNA, 19 nt, Homo sapiens
ggaaagaacaggaaauauu

SEQ ID NO: 115145 - RNA, 19 nt, Homo sapiens
gcaguuaagugaugcaauu

SEQ ID NO: 115146 - RNA, 19 nt, Homo sapiens
gucaagagguuaaauauga

SEQ ID NO: 115147 - RNA, 19 nt, Homo sapiens
gaacggcucuuuacuaugc

SEQ ID NO: 115148 - RNA, 19 nt, Homo sapiens
guauuucucuuguccuuua

SEQ ID NO: 115149 - RNA, 19 nt, Homo sapiens
gaaagaacaggaaauauuc

SEQ ID NO: 115150 - RNA, 19 nt, Homo sapiens
gguguuuacugaaaucuua

SEQ ID NO: 115151 - RNA, 19 nt, Homo sapiens
gaucugauauugauacuag

SEQ ID NO: 115152 - RNA, 19 nt, Homo sapiens
ggacugaaauuaagcuugu

SEQ ID NO: 115153 - RNA, 19 nt, Homo sapiens
gagcacagcugcauuaaaa

SEQ ID NO: 115154 - RNA, 19 nt, Homo sapiens
ggaaacaaaucuucauucu

SEQ ID NO: 115155 - RNA, 19 nt, Homo sapiens
ucacucagcuuacacagaa

SEQ ID NO: 115156 - RNA, 19 nt, Homo sapiens
ggagaauuguugaagauga

SEQ ID NO: 115157 - RNA, 19 nt, Homo sapiens
cagcuaaugugaaugaauu

SEQ ID NO: 115158 - RNA, 19 nt, Homo sapiens
caagggacaaguauuaaua

SEQ ID NO: 115159 - RNA, 19 nt, Homo sapiens
ggaaaucacaggcuucuga

SEQ ID NO: 115160 - RNA, 19 nt, Homo sapiens
cuacauguuugaagcaaua

SEQ ID NO: 115161 - RNA, 19 nt, Homo sapiens
gcaaaucugcaaacacuaa

SEQ ID NO: 115162 - RNA, 19 nt, Homo sapiens
caaaugaacuuguaaaccu

SEQ ID NO: 115163 - RNA, 19 nt, Homo sapiens
ugaaucaguugaccaauau

SEQ ID NO: 115164 - RNA, 19 nt, Homo sapiens
caaaugaccaccaagguuu

SEQ ID NO: 115165 - RNA, 19 nt, Homo sapiens
caagcaaaccucacuuuaa

SEQ ID NO: 115166 - RNA, 19 nt, Homo sapiens
aaaguacgaugaagaauuc

SEQ ID NO: 115167 - RNA, 19 nt, Homo sapiens
ccaaguuuaucaagaguuu

SEQ ID NO: 115168 - RNA, 19 nt, Homo sapiens
aagcaaaccucacuuuaau

SEQ ID NO: 115169 - RNA, 19 nt, Homo sapiens
ggagauuuccauguuauua

SEQ ID NO: 115170 - RNA, 19 nt, Homo sapiens
gagaauuguugaagaugaa

SEQ ID NO: 115171 - RNA, 19 nt, Homo sapiens
cagaagcgcuccaguaucu

SEQ ID NO: 115172 - RNA, 19 nt, Homo sapiens
guacagcacauucauuauu

SEQ ID NO: 115173 - RNA, 19 nt, Homo sapiens
gcaaaccucacuuuaauca

SEQ ID NO: 115174 - RNA, 19 nt, Homo sapiens
uaacaaugccacucucuuu

SEQ ID NO: 115175 - RNA, 19 nt, Homo sapiens
ugaauuuccuguccuuaaa

SEQ ID NO: 115176 - RNA, 19 nt, Homo sapiens
ccaaauuacuaacagaaug

SEQ ID NO: 115177 - RNA, 19 nt, Homo sapiens
gcacuagcacuacaagaaa

SEQ ID NO: 115178 - RNA, 19 nt, Homo sapiens
gcagaaaucgcaccguuug

SEQ ID NO: 115179 - RNA, 19 nt, Homo sapiens
gaaaucaagugccaaaaga

SEQ ID NO: 115180 - RNA, 19 nt, Homo sapiens
guacgaggauuaugcaagu

SEQ ID NO: 115181 - RNA, 19 nt, Homo sapiens
gcaaaugaccaccaagguu

SEQ ID NO: 115182 - RNA, 19 nt, Homo sapiens
caaagcaaaugaccaccaa

SEQ ID NO: 115183 - RNA, 19 nt, Homo sapiens
gaaugaauuuccuguccuu

SEQ ID NO: 115184 - RNA, 19 nt, Homo sapiens
caucuggaauuuacuaguu

SEQ ID NO: 115185 - RNA, 19 nt, Homo sapiens
aagauaccgucaugaauuu

SEQ ID NO: 115186 - RNA, 19 nt, Homo sapiens
aaaaggaacuggagaauug

SEQ ID NO: 115187 - RNA, 19 nt, Homo sapiens
gcuuuaaccugaaccuuga

SEQ ID NO: 115188 - RNA, 19 nt, Homo sapiens
uaggucaaauggugaauaa

SEQ ID NO: 115189 - RNA, 19 nt, Homo sapiens
caaccaaguuuaucaagag

SEQ ID NO: 115190 - RNA, 19 nt, Homo sapiens
gcaguacccaugcaaauga

SEQ ID NO: 115191 - RNA, 19 nt, Homo sapiens
aaagauaccgucaugaauu

SEQ ID NO: 115192 - RNA, 19 nt, Homo sapiens
gagacuuucuguuacuaaa

SEQ ID NO: 115193 - RNA, 19 nt, Homo sapiens
gcagccaucuaccuaguga

SEQ ID NO: 115194 - RNA, 19 nt, Homo sapiens
acaggaaucuucucugguu

SEQ ID NO: 115195 - RNA, 19 nt, Homo sapiens
agaacacgcugacaaguau

SEQ ID NO: 115196 - RNA, 19 nt, Homo sapiens
auagugcacuugaugcuua

SEQ ID NO: 115197 - RNA, 19 nt, Homo sapiens
cgaauuccaucuuguaaag

SEQ ID NO: 115198 - RNA, 19 nt, Homo sapiens
ccauacgucuuucaaguga

SEQ ID NO: 115199 - RNA, 19 nt, Homo sapiens
gaagcaauauguuuaucca

SEQ ID NO: 115200 - RNA, 19 nt, Homo sapiens
cgauuccucucuugauuaa

SEQ ID NO: 115201 - RNA, 19 nt, Homo sapiens
ugacagaaauggugaaucg

SEQ ID NO: 115202 - RNA, 19 nt, Homo sapiens
caacauagugcacuugaug

SEQ ID NO: 115203 - RNA, 19 nt, Homo sapiens
gaugauaccauuccugaug

SEQ ID NO: 115204 - RNA, 19 nt, Homo sapiens
agaauaacuugcaaagcua

SEQ ID NO: 115205 - RNA, 19 nt, Homo sapiens
ccaagcaaaccucacuuua

SEQ ID NO: 115206 - RNA, 19 nt, Homo sapiens
uuucaaagcucucacacuu

SEQ ID NO: 115207 - RNA, 19 nt, Homo sapiens
gaaaucgcaccguuuguug

SEQ ID NO: 115208 - RNA, 19 nt, Homo sapiens
gaauuacacaagcaaauga

SEQ ID NO: 115209 - RNA, 19 nt, Homo sapiens
uuacagccaucuggaauuu

SEQ ID NO: 115210 - RNA, 19 nt, Homo sapiens
cagaagcaguuaagugaug

SEQ ID NO: 115211 - RNA, 19 nt, Homo sapiens
ugcaaacacuaacagaaua

SEQ ID NO: 115212 - RNA, 19 nt, Homo sapiens
gaagcugauugcauccaaa

SEQ ID NO: 115213 - RNA, 19 nt, Homo sapiens
ugaagaagcauuugaagau

SEQ ID NO: 115214 - RNA, 19 nt, Homo sapiens
uaacccugcugcuguugua

SEQ ID NO: 115215 - RNA, 19 nt, Homo sapiens
ucacauccucccugauuua

SEQ ID NO: 115216 - RNA, 19 nt, Homo sapiens
acacagaagcauggaauua

SEQ ID NO: 115217 - RNA, 19 nt, Homo sapiens
ugaaagcuaucaugagaag

SEQ ID NO: 115218 - RNA, 19 nt, Homo sapiens
guacauaaggagagauuug

SEQ ID NO: 115219 - RNA, 19 nt, Homo sapiens
cuucaagggacaaguauua

SEQ ID NO: 115220 - RNA, 19 nt, Homo sapiens
ugacaaaauuccuggguua

SEQ ID NO: 115221 - RNA, 19 nt, Homo sapiens
cugcugcuguuguaaauuu

SEQ ID NO: 115222 - RNA, 19 nt, Homo sapiens
aagaauaacuugcaaagcu

SEQ ID NO: 115223 - RNA, 19 nt, Homo sapiens
aaucuucucugguuauguu

SEQ ID NO: 115224 - RNA, 19 nt, Homo sapiens
cagaacacgcugacaagua

SEQ ID NO: 115225 - RNA, 19 nt, Homo sapiens
ggaauuuacuaguuacaac

SEQ ID NO: 115226 - RNA, 19 nt, Homo sapiens
ccacagaaauggccugacu

SEQ ID NO: 115227 - RNA, 19 nt, Homo sapiens
ugacauuacuggagaaguc

SEQ ID NO: 115228 - RNA, 19 nt, Homo sapiens
guggguggcuucuaguuug

SEQ ID NO: 115229 - RNA, 19 nt, Homo sapiens
gacaucccgucuuccuaua

SEQ ID NO: 115230 - RNA, 19 nt, Homo sapiens
gcucuugaacggcucuuua

SEQ ID NO: 115231 - RNA, 19 nt, Homo sapiens
gguaaguaaugcaauucaa

SEQ ID NO: 115232 - RNA, 19 nt, Homo sapiens
guuauggacugaaauuaag

SEQ ID NO: 115233 - RNA, 19 nt, Homo sapiens
caaacgaguuauggacuga

SEQ ID NO: 115234 - RNA, 19 nt, Homo sapiens
ucaaaucuguaaucagcaa

SEQ ID NO: 115235 - RNA, 19 nt, Homo sapiens
uggcauaaccaaauuacua

SEQ ID NO: 115236 - RNA, 19 nt, Homo sapiens
gaucugugcgguuggcaua

SEQ ID NO: 115237 - RNA, 19 nt, Homo sapiens
gaauaacuugcaaagcuaa

SEQ ID NO: 115238 - RNA, 19 nt, Homo sapiens
gacaaggacuggaauauuu

SEQ ID NO: 115239 - RNA, 19 nt, Homo sapiens
caaagaaucuccuugacaa

SEQ ID NO: 115240 - RNA, 19 nt, Homo sapiens
gaaggcauuucuccuggua

SEQ ID NO: 115241 - RNA, 19 nt, Homo sapiens
gauccagugugcuaccuua

SEQ ID NO: 115242 - RNA, 19 nt, Homo sapiens
gaacugcaacaacagcuuu

SEQ ID NO: 115243 - RNA, 19 nt, Homo sapiens
aaacaaagaaucuccuuga

SEQ ID NO: 115244 - RNA, 19 nt, Homo sapiens
gagaccucgugccaaauua

SEQ ID NO: 115245 - RNA, 19 nt, Homo sapiens
ggaagccauugcacuguga

SEQ ID NO: 115246 - RNA, 19 nt, Homo sapiens
ggacagcgucggccugauu

SEQ ID NO: 115247 - RNA, 19 nt, Homo sapiens
gaagacagaccauccaucu

SEQ ID NO: 115248 - RNA, 19 nt, Homo sapiens
uggagaaggucaagaaugu

SEQ ID NO: 115249 - RNA, 19 nt, Homo sapiens
ugaaagauccagugugcua

SEQ ID NO: 115250 - RNA, 19 nt, Homo sapiens
ggagaccucgugccaaauu

SEQ ID NO: 115251 - RNA, 19 nt, Homo sapiens
ccagugugcuaccuuaaga

SEQ ID NO: 115252 - RNA, 19 nt, Homo sapiens
accaugcgcuucagagaua

SEQ ID NO: 115253 - RNA, 19 nt, Homo sapiens
gguggacgcugaggaguga

SEQ ID NO: 115254 - RNA, 19 nt, Homo sapiens
ggaguacuguagccacaug

SEQ ID NO: 115255 - RNA, 19 nt, Homo sapiens
gcagacccuugacugaaug

SEQ ID NO: 115256 - RNA, 19 nt, Homo sapiens
ggauggaggauauucuuga

SEQ ID NO: 115257 - RNA, 19 nt, Homo sapiens
gagagaggagccugaaguu

SEQ ID NO: 115258 - RNA, 19 nt, Homo sapiens
ggaggccucuuguucuaca

SEQ ID NO: 115259 - RNA, 19 nt, Homo sapiens
caccaaggauuaugaagag

SEQ ID NO: 115260 - RNA, 19 nt, Homo sapiens
ugaccaagccugauugcaa

SEQ ID NO: 115261 - RNA, 19 nt, Homo sapiens
ugacaaggacuggaauauu

SEQ ID NO: 115262 - RNA, 19 nt, Homo sapiens
uaagugcccugugcugguu

SEQ ID NO: 115263 - RNA, 19 nt, Homo sapiens
ucggaggccucuuguucua

SEQ ID NO: 115264 - RNA, 19 nt, Homo sapiens
caacagccggcagauguaa

SEQ ID NO: 115265 - RNA, 19 nt, Homo sapiens
caggaacaguugaaagauc

SEQ ID NO: 115266 - RNA, 19 nt, Homo sapiens
gaaggaggaccagcaagug

SEQ ID NO: 115267 - RNA, 19 nt, Homo sapiens
gccaacagccggcagaugu

SEQ ID NO: 115268 - RNA, 19 nt, Homo sapiens
agcaagaacugcaacaaca

SEQ ID NO: 115269 - RNA, 19 nt, Homo sapiens
guaccugccugcugaacag

SEQ ID NO: 115270 - RNA, 19 nt, Homo sapiens
guacuguagccacaugauu

SEQ ID NO: 115271 - RNA, 19 nt, Homo sapiens
ggccugauuucccguaaag

SEQ ID NO: 115272 - RNA, 19 nt, Homo sapiens
guccgaacuuucuaugaga

SEQ ID NO: 115273 - RNA, 19 nt, Homo sapiens
ucaccaaggauuaugaaga

SEQ ID NO: 115274 - RNA, 19 nt, Homo sapiens
ggaggacucugagggaacu

SEQ ID NO: 115275 - RNA, 19 nt, Homo sapiens
guggacaccugcagucucu

SEQ ID NO: 115276 - RNA, 19 nt, Homo sapiens
ccaacagccggcagaugua

SEQ ID NO: 115277 - RNA, 19 nt, Homo sapiens
ggagaggccagugagauuc

SEQ ID NO: 115278 - RNA, 19 nt, Homo sapiens
auggagaccucgugccaaa

SEQ ID NO: 115279 - RNA, 19 nt, Homo sapiens
ggaggauauucuugacucu

SEQ ID NO: 115280 - RNA, 19 nt, Homo sapiens
gagaaggucaagaaugucu

SEQ ID NO: 115281 - RNA, 19 nt, Homo sapiens
caaggauuaugaagagcau

SEQ ID NO: 115282 - RNA, 19 nt, Homo sapiens
gacagcgucggccugauuu

SEQ ID NO: 115283 - RNA, 19 nt, Homo sapiens
cccaugcugccacuauuua

SEQ ID NO: 115284 - RNA, 19 nt, Homo sapiens
cgcagacccuugacugaau

SEQ ID NO: 115285 - RNA, 19 nt, Homo sapiens
cguccgaacuuucuaugag

SEQ ID NO: 115286 - RNA, 19 nt, Homo sapiens
cugccacuauuuauuguga

SEQ ID NO: 115287 - RNA, 19 nt, Homo sapiens
gagcggauucucccuugga

SEQ ID NO: 115288 - RNA, 19 nt, Homo sapiens
uaacuccguuccuuugacu

SEQ ID NO: 115289 - RNA, 19 nt, Homo sapiens
gauggaggauauucuugac

SEQ ID NO: 115290 - RNA, 19 nt, Homo sapiens
gcaccugccagagcuuuga

SEQ ID NO: 115291 - RNA, 19 nt, Homo sapiens
acaaagaaucuccuugaca

SEQ ID NO: 115292 - RNA, 19 nt, Homo sapiens
agccacagcuuuccagaag

SEQ ID NO: 115293 - RNA, 19 nt, Homo sapiens
gaggacaccaugcgcuuca

SEQ ID NO: 115294 - RNA, 19 nt, Homo sapiens
cgucggaggccucuuguuc

SEQ ID NO: 115295 - RNA, 19 nt, Homo sapiens
gcaagaacugcaacaacag

SEQ ID NO: 115296 - RNA, 19 nt, Homo sapiens
gcugcuucaccaaggauua

SEQ ID NO: 115297 - RNA, 19 nt, Homo sapiens
ggacaccaugcgcuucaga

SEQ ID NO: 115298 - RNA, 19 nt, Homo sapiens
gagcaccugccagagcuuu

SEQ ID NO: 115299 - RNA, 19 nt, Homo sapiens
ugaaugcuccagccaagau

SEQ ID NO: 115300 - RNA, 19 nt, Homo sapiens
ccagaaggaggaccagcaa

SEQ ID NO: 115301 - RNA, 19 nt, Homo sapiens
uggagaggccagugagauu

SEQ ID NO: 115302 - RNA, 19 nt, Homo sapiens
acucugcaaugggcacuaa

SEQ ID NO: 115303 - RNA, 19 nt, Homo sapiens
ugcaggaacucucuuugag

SEQ ID NO: 115304 - RNA, 19 nt, Homo sapiens
cugcuggucugcacugaca

SEQ ID NO: 115305 - RNA, 19 nt, Homo sapiens
ggaggugucggaguacugu

SEQ ID NO: 115306 - RNA, 19 nt, Homo sapiens
caacuuccucucagcaucu

SEQ ID NO: 115307 - RNA, 19 nt, Homo sapiens
gccugugguuugugggaaa

SEQ ID NO: 115308 - RNA, 19 nt, Homo sapiens
gggauggaggauauucuug

SEQ ID NO: 115309 - RNA, 19 nt, Homo sapiens
agacaccucuccaguugcu

SEQ ID NO: 115310 - RNA, 19 nt, Homo sapiens
cugcaggaacucucuuuga

SEQ ID NO: 115311 - RNA, 19 nt, Homo sapiens
uacuguagccacaugauug

SEQ ID NO: 115312 - RNA, 19 nt, Homo sapiens
ccagagagaggagccugaa

SEQ ID NO: 115313 - RNA, 19 nt, Homo sapiens
caugcugccacuauuuauu

SEQ ID NO: 115314 - RNA, 19 nt, Homo sapiens
ccgcagacccuugacugaa

SEQ ID NO: 115315 - RNA, 19 nt, Homo sapiens
ugacucaggaugacagaca

SEQ ID NO: 115316 - RNA, 19 nt, Homo sapiens
ugaccugggaggacucuga

SEQ ID NO: 115317 - RNA, 19 nt, Homo sapiens
ggaauauuuucagcaagaa

SEQ ID NO: 115318 - RNA, 19 nt, Homo sapiens
ugaaacaaagaaucuccuu

SEQ ID NO: 115319 - RNA, 19 nt, Homo sapiens
agagagaggagccugaagu

SEQ ID NO: 115320 - RNA, 19 nt, Homo sapiens
gaggcucccaugugcuuga

SEQ ID NO: 115321 - RNA, 19 nt, Homo sapiens
ugacugacacaggccauga

SEQ ID NO: 115322 - RNA, 19 nt, Homo sapiens
agaaggaggaccagcaagu

SEQ ID NO: 115323 - RNA, 19 nt, Homo sapiens
gcauuucuccugguacaag

SEQ ID NO: 115324 - RNA, 19 nt, Homo sapiens
cauuucuccugguacaaga

SEQ ID NO: 115325 - RNA, 19 nt, Homo sapiens
ccugguacaagacauaaug

SEQ ID NO: 115326 - RNA, 19 nt, Homo sapiens
gaccaggaacaguugaaag

SEQ ID NO: 115327 - RNA, 19 nt, Homo sapiens
gacccuugacugaaugaga

SEQ ID NO: 115328 - RNA, 19 nt, Homo sapiens
ggaggaccagcaagugaag

SEQ ID NO: 115329 - RNA, 19 nt, Homo sapiens
aaggaggaccagcaaguga

SEQ ID NO: 115330 - RNA, 19 nt, Homo sapiens
uggaauauuuucagcaaga

SEQ ID NO: 115331 - RNA, 19 nt, Homo sapiens
ccucgugccaaauuacauu

SEQ ID NO: 115332 - RNA, 19 nt, Homo sapiens
gacaaggacuggaauauuu

SEQ ID NO: 115333 - RNA, 19 nt, Homo sapiens
caaagaaucuccuugacaa

SEQ ID NO: 115334 - RNA, 19 nt, Homo sapiens
gaaggcauuucuccuggua

SEQ ID NO: 115335 - RNA, 19 nt, Homo sapiens
gauccagugugcuaccuua

SEQ ID NO: 115336 - RNA, 19 nt, Homo sapiens
gaacugcaacaacagcuuu

SEQ ID NO: 115337 - RNA, 19 nt, Homo sapiens
aaacaaagaaucuccuuga

SEQ ID NO: 115338 - RNA, 19 nt, Homo sapiens
gagaccucgugccaaauua

SEQ ID NO: 115339 - RNA, 19 nt, Homo sapiens
uggagaaggucaagaaugu

SEQ ID NO: 115340 - RNA, 19 nt, Homo sapiens
ugaaagauccagugugcua

SEQ ID NO: 115341 - RNA, 19 nt, Homo sapiens
ggagaccucgugccaaauu

SEQ ID NO: 115342 - RNA, 19 nt, Homo sapiens
ccagugugcuaccuuaaga

SEQ ID NO: 115343 - RNA, 19 nt, Homo sapiens
accaugcgcuucagagaua

SEQ ID NO: 115344 - RNA, 19 nt, Homo sapiens
ggaguacuguagccacaug

SEQ ID NO: 115345 - RNA, 19 nt, Homo sapiens
ggauggaggauauucuuga

SEQ ID NO: 115346 - RNA, 19 nt, Homo sapiens
ggaggccucuuguucuaca

SEQ ID NO: 115347 - RNA, 19 nt, Homo sapiens
caccaaggauuaugaagag

SEQ ID NO: 115348 - RNA, 19 nt, Homo sapiens
ugaccaagccugauugcaa

SEQ ID NO: 115349 - RNA, 19 nt, Homo sapiens
ugacaaggacuggaauauu

SEQ ID NO: 115350 - RNA, 19 nt, Homo sapiens
ucggaggccucuuguucua

SEQ ID NO: 115351 - RNA, 19 nt, Homo sapiens
caacagccggcagauguaa

SEQ ID NO: 115352 - RNA, 19 nt, Homo sapiens
caggaacaguugaaagauc

SEQ ID NO: 115353 - RNA, 19 nt, Homo sapiens
gccaacagccggcagaugu

SEQ ID NO: 115354 - RNA, 19 nt, Homo sapiens
agcaagaacugcaacaaca

SEQ ID NO: 115355 - RNA, 19 nt, Homo sapiens
guacuguagccacaugauu

SEQ ID NO: 115356 - RNA, 19 nt, Homo sapiens
guccgaacuuucuaugaga

SEQ ID NO: 115357 - RNA, 19 nt, Homo sapiens
ucaccaaggauuaugaaga

SEQ ID NO: 115358 - RNA, 19 nt, Homo sapiens
ggaggacucugagggaacu

SEQ ID NO: 115359 - RNA, 19 nt, Homo sapiens
guggacaccugcagucucu

SEQ ID NO: 115360 - RNA, 19 nt, Homo sapiens
ccaacagccggcagaugua

SEQ ID NO: 115361 - RNA, 19 nt, Homo sapiens
ggagaggccagugagauuc

SEQ ID NO: 115362 - RNA, 19 nt, Homo sapiens
auggagaccucgugccaaa

SEQ ID NO: 115363 - RNA, 19 nt, Homo sapiens
ggaggauauucuugacucu

SEQ ID NO: 115364 - RNA, 19 nt, Homo sapiens
gagaaggucaagaaugucu

SEQ ID NO: 115365 - RNA, 19 nt, Homo sapiens
caaggauuaugaagagcau

SEQ ID NO: 115366 - RNA, 19 nt, Homo sapiens
cguccgaacuuucuaugag

SEQ ID NO: 115367 - RNA, 19 nt, Homo sapiens
gagcggauucucccuugga

SEQ ID NO: 115368 - RNA, 19 nt, Homo sapiens
gauggaggauauucuugac

SEQ ID NO: 115369 - RNA, 19 nt, Homo sapiens
gcaccugccagagcuuuga

SEQ ID NO: 115370 - RNA, 19 nt, Homo sapiens
acaaagaaucuccuugaca

SEQ ID NO: 115371 - RNA, 19 nt, Homo sapiens
gaggacaccaugcgcuuca

SEQ ID NO: 115372 - RNA, 19 nt, Homo sapiens
cgucggaggccucuuguuc

SEQ ID NO: 115373 - RNA, 19 nt, Homo sapiens
agauguaacuggccaugag

SEQ ID NO: 115374 - RNA, 19 nt, Homo sapiens
gauguaacuggccaugaga

SEQ ID NO: 115375 - RNA, 19 nt, Homo sapiens
gcaagaacugcaacaacag

SEQ ID NO: 115376 - RNA, 19 nt, Homo sapiens
gcugcuucaccaaggauua

SEQ ID NO: 115377 - RNA, 19 nt, Homo sapiens
ggacaccaugcgcuucaga

SEQ ID NO: 115378 - RNA, 19 nt, Homo sapiens
gagcaccugccagagcuuu

SEQ ID NO: 115379 - RNA, 19 nt, Homo sapiens
ugaaugcuccagccaagau

SEQ ID NO: 115380 - RNA, 19 nt, Homo sapiens
uggagaggccagugagauu

SEQ ID NO: 115381 - RNA, 19 nt, Homo sapiens
acucugcaaugggcacuaa

SEQ ID NO: 115382 - RNA, 19 nt, Homo sapiens
ugcaggaacucucuuugag

SEQ ID NO: 115383 - RNA, 19 nt, Homo sapiens
caacuuccucucagcaucu

SEQ ID NO: 115384 - RNA, 19 nt, Homo sapiens
ggaggugucggaguacugu

SEQ ID NO: 115385 - RNA, 19 nt, Homo sapiens
gggauggaggauauucuug

SEQ ID NO: 115386 - RNA, 19 nt, Homo sapiens
agacaccucuccaguugcu

SEQ ID NO: 115387 - RNA, 19 nt, Homo sapiens
cugcaggaacucucuuuga

SEQ ID NO: 115388 - RNA, 19 nt, Homo sapiens
ugacucaggaugacagaca

SEQ ID NO: 115389 - RNA, 19 nt, Homo sapiens
ugaccugggaggacucuga

SEQ ID NO: 115390 - RNA, 19 nt, Homo sapiens
ggaauauuuucagcaagaa

SEQ ID NO: 115391 - RNA, 19 nt, Homo sapiens
ugaaacaaagaaucuccuu

SEQ ID NO: 115392 - RNA, 19 nt, Homo sapiens
uacuguagccacaugauug

SEQ ID NO: 115393 - RNA, 19 nt, Homo sapiens
ccugguacaagacauaaug

SEQ ID NO: 115394 - RNA, 19 nt, Homo sapiens
cauuucuccugguacaaga

SEQ ID NO: 115395 - RNA, 19 nt, Homo sapiens
gcauuucuccugguacaag

SEQ ID NO: 115396 - RNA, 19 nt, Homo sapiens
ccucgugccaaauuacauu

SEQ ID NO: 115397 - RNA, 19 nt, Homo sapiens
uggaauauuuucagcaaga

SEQ ID NO: 115398 - RNA, 19 nt, Homo sapiens
gaccaggaacaguugaaag

SEQ ID NO: 115399 - RNA, 19 nt, Homo sapiens
gacaaggacuggaauauuu

SEQ ID NO: 115400 - RNA, 19 nt, Homo sapiens
caaagaaucuccuugacaa

SEQ ID NO: 115401 - RNA, 19 nt, Homo sapiens
gaaggcauuucuccuggua

SEQ ID NO: 115402 - RNA, 19 nt, Homo sapiens
gauccagugugcuaccuua

SEQ ID NO: 115403 - RNA, 19 nt, Homo sapiens
gaacugcaacaacagcuuu

SEQ ID NO: 115404 - RNA, 19 nt, Homo sapiens
aaacaaagaaucuccuuga

SEQ ID NO: 115405 - RNA, 19 nt, Homo sapiens
gagaccucgugccaaauua

SEQ ID NO: 115406 - RNA, 19 nt, Homo sapiens
ggaagccauugcacuguga

SEQ ID NO: 115407 - RNA, 19 nt, Homo sapiens
ggacagcgucggccugauu

SEQ ID NO: 115408 - RNA, 19 nt, Homo sapiens
uggagaaggucaagaaugu

SEQ ID NO: 115409 - RNA, 19 nt, Homo sapiens
ugaaagauccagugugcua

SEQ ID NO: 115410 - RNA, 19 nt, Homo sapiens
ggagaccucgugccaaauu

SEQ ID NO: 115411 - RNA, 19 nt, Homo sapiens
ccagugugcuaccuuaaga

SEQ ID NO: 115412 - RNA, 19 nt, Homo sapiens
accaugcgcuucagagaua

SEQ ID NO: 115413 - RNA, 19 nt, Homo sapiens
gguggacgcugaggaguga

SEQ ID NO: 115414 - RNA, 19 nt, Homo sapiens
ggaguacuguagccacaug

SEQ ID NO: 115415 - RNA, 19 nt, Homo sapiens
gcagacccuugacugaaug

SEQ ID NO: 115416 - RNA, 19 nt, Homo sapiens
gagagaggagccugaaguu

SEQ ID NO: 115417 - RNA, 19 nt, Homo sapiens
ggaggccucuuguucuaca

SEQ ID NO: 115418 - RNA, 19 nt, Homo sapiens
caccaaggauuaugaagag

SEQ ID NO: 115419 - RNA, 19 nt, Homo sapiens
ugacaaggacuggaauauu

SEQ ID NO: 115420 - RNA, 19 nt, Homo sapiens
uaagugcccugugcugguu

SEQ ID NO: 115421 - RNA, 19 nt, Homo sapiens
ucggaggccucuuguucua

SEQ ID NO: 115422 - RNA, 19 nt, Homo sapiens
caggaacaguugaaagauc

SEQ ID NO: 115423 - RNA, 19 nt, Homo sapiens
agcaagaacugcaacaaca

SEQ ID NO: 115424 - RNA, 19 nt, Homo sapiens
guaccugccugcugaacag

SEQ ID NO: 115425 - RNA, 19 nt, Homo sapiens
guacuguagccacaugauu

SEQ ID NO: 115426 - RNA, 19 nt, Homo sapiens
ggccugauuucccguaaag

SEQ ID NO: 115427 - RNA, 19 nt, Homo sapiens
guccgaacuuucuaugaga

SEQ ID NO: 115428 - RNA, 19 nt, Homo sapiens
ucaccaaggauuaugaaga

SEQ ID NO: 115429 - RNA, 19 nt, Homo sapiens
guggacaccugcagucucu

SEQ ID NO: 115430 - RNA, 19 nt, Homo sapiens
gagaaggucaagaaugucu

SEQ ID NO: 115431 - RNA, 19 nt, Homo sapiens
auggagaccucgugccaaa

SEQ ID NO: 115432 - RNA, 19 nt, Homo sapiens
caaggauuaugaagagcau

SEQ ID NO: 115433 - RNA, 19 nt, Homo sapiens
gacagcgucggccugauuu

SEQ ID NO: 115434 - RNA, 19 nt, Homo sapiens
cccaugcugccacuauuua

SEQ ID NO: 115435 - RNA, 19 nt, Homo sapiens
cgcagacccuugacugaau

SEQ ID NO: 115436 - RNA, 19 nt, Homo sapiens
cguccgaacuuucuaugag

SEQ ID NO: 115437 - RNA, 19 nt, Homo sapiens
cugccacuauuuauuguga

SEQ ID NO: 115438 - RNA, 19 nt, Homo sapiens
gagcggauucucccuugga

SEQ ID NO: 115439 - RNA, 19 nt, Homo sapiens
acaaagaaucuccuugaca

SEQ ID NO: 115440 - RNA, 19 nt, Homo sapiens
gaggacaccaugcgcuuca

SEQ ID NO: 115441 - RNA, 19 nt, Homo sapiens
cgucggaggccucuuguuc

SEQ ID NO: 115442 - RNA, 19 nt, Homo sapiens
gcaagaacugcaacaacag

SEQ ID NO: 115443 - RNA, 19 nt, Homo sapiens
gcugcuucaccaaggauua

SEQ ID NO: 115444 - RNA, 19 nt, Homo sapiens
ggacaccaugcgcuucaga

SEQ ID NO: 115445 - RNA, 19 nt, Homo sapiens
ugcaggaacucucuuugag

SEQ ID NO: 115446 - RNA, 19 nt, Homo sapiens
cugcuggucugcacugaca

SEQ ID NO: 115447 - RNA, 19 nt, Homo sapiens
ggaggugucggaguacugu

SEQ ID NO: 115448 - RNA, 19 nt, Homo sapiens
gccugugguuugugggaaa

SEQ ID NO: 115449 - RNA, 19 nt, Homo sapiens
agacaccucuccaguugcu

SEQ ID NO: 115450 - RNA, 19 nt, Homo sapiens
cugcaggaacucucuuuga

SEQ ID NO: 115451 - RNA, 19 nt, Homo sapiens
ccagagagaggagccugaa

SEQ ID NO: 115452 - RNA, 19 nt, Homo sapiens
caugcugccacuauuuauu

SEQ ID NO: 115453 - RNA, 19 nt, Homo sapiens
ccgcagacccuugacugaa

SEQ ID NO: 115454 - RNA, 19 nt, Homo sapiens
ugacucaggaugacagaca

SEQ ID NO: 115455 - RNA, 19 nt, Homo sapiens
uacuguagccacaugauug

SEQ ID NO: 115456 - RNA, 19 nt, Homo sapiens
ggaauauuuucagcaagaa

SEQ ID NO: 115457 - RNA, 19 nt, Homo sapiens
ugaaacaaagaaucuccuu

SEQ ID NO: 115458 - RNA, 19 nt, Homo sapiens
agagagaggagccugaagu

SEQ ID NO: 115459 - RNA, 19 nt, Homo sapiens
gaggcucccaugugcuuga

SEQ ID NO: 115460 - RNA, 19 nt, Homo sapiens
ccugguacaagacauaaug

SEQ ID NO: 115461 - RNA, 19 nt, Homo sapiens
cauuucuccugguacaaga

SEQ ID NO: 115462 - RNA, 19 nt, Homo sapiens
gcauuucuccugguacaag

SEQ ID NO: 115463 - RNA, 19 nt, Homo sapiens
ccucgugccaaauuacauu

SEQ ID NO: 115464 - RNA, 19 nt, Homo sapiens
gacccuugacugaaugaga

SEQ ID NO: 115465 - RNA, 19 nt, Homo sapiens
uggaauauuuucagcaaga

SEQ ID NO: 115466 - RNA, 19 nt, Homo sapiens
gaccaggaacaguugaaag

SEQ ID NO: 115467 - RNA, 19 nt, Homo sapiens
gacaaggacuggaauauuu

SEQ ID NO: 115468 - RNA, 19 nt, Homo sapiens
ggacaguauucuucuauuu

SEQ ID NO: 115469 - RNA, 19 nt, Homo sapiens
caaagaaucuccuugacaa

SEQ ID NO: 115470 - RNA, 19 nt, Homo sapiens
gaaguugugugaaauccua

SEQ ID NO: 115471 - RNA, 19 nt, Homo sapiens
gaaggcauuucuccuggua

SEQ ID NO: 115472 - RNA, 19 nt, Homo sapiens
gauccagugugcuaccuua

SEQ ID NO: 115473 - RNA, 19 nt, Homo sapiens
cuacugaaguugugugaaa

SEQ ID NO: 115474 - RNA, 19 nt, Homo sapiens
uaaccaaagugcaguuuau

SEQ ID NO: 115475 - RNA, 19 nt, Homo sapiens
gcaucauacuguugucaua

SEQ ID NO: 115476 - RNA, 19 nt, Homo sapiens
acuguuaccuuccuugaua

SEQ ID NO: 115477 - RNA, 19 nt, Homo sapiens
gaacugcaacaacagcuuu

SEQ ID NO: 115478 - RNA, 19 nt, Homo sapiens
aaacaaagaaucuccuuga

SEQ ID NO: 115479 - RNA, 19 nt, Homo sapiens
gagaccucgugccaaauua

SEQ ID NO: 115480 - RNA, 19 nt, Homo sapiens
cuaguuccauuucccauaa

SEQ ID NO: 115481 - RNA, 19 nt, Homo sapiens
gaagacagaccauccaucu

SEQ ID NO: 115482 - RNA, 19 nt, Homo sapiens
uggagaaggucaagaaugu

SEQ ID NO: 115483 - RNA, 19 nt, Homo sapiens
ugaaagauccagugugcua

SEQ ID NO: 115484 - RNA, 19 nt, Homo sapiens
gcagauuaagauugcauua

SEQ ID NO: 115485 - RNA, 19 nt, Homo sapiens
ggagaccucgugccaaauu

SEQ ID NO: 115486 - RNA, 19 nt, Homo sapiens
ccagugugcuaccuuaaga

SEQ ID NO: 115487 - RNA, 19 nt, Homo sapiens
acacaguacuccagauguu

SEQ ID NO: 115488 - RNA, 19 nt, Homo sapiens
accaugcgcuucagagaua

SEQ ID NO: 115489 - RNA, 19 nt, Homo sapiens
gauauggacaguauucuuc

SEQ ID NO: 115490 - RNA, 19 nt, Homo sapiens
ggaguacuguagccacaug

SEQ ID NO: 115491 - RNA, 19 nt, Homo sapiens
ccaaagugcaguuuauguu

SEQ ID NO: 115492 - RNA, 19 nt, Homo sapiens
gacaguauucuucuauuug

SEQ ID NO: 115493 - RNA, 19 nt, Homo sapiens
ggacacaguacuccagaug

SEQ ID NO: 115494 - RNA, 19 nt, Homo sapiens
ggauggaggauauucuuga

SEQ ID NO: 115495 - RNA, 19 nt, Homo sapiens
gaccaucucuacccuguac

SEQ ID NO: 115496 - RNA, 19 nt, Homo sapiens
ggaggccucuuguucuaca

SEQ ID NO: 115497 - RNA, 19 nt, Homo sapiens
caccaaggauuaugaagag

SEQ ID NO: 115498 - RNA, 19 nt, Homo sapiens
caguuuauguucaccuuug

SEQ ID NO: 115499 - RNA, 19 nt, Homo sapiens
aaagugcaguuuauguuca

SEQ ID NO: 115500 - RNA, 19 nt, Homo sapiens
ugaccaagccugauugcaa

SEQ ID NO: 115501 - RNA, 19 nt, Homo sapiens
ugacaaggacuggaauauu

SEQ ID NO: 115502 - RNA, 19 nt, Homo sapiens
caaagugcaguuuauguuc

SEQ ID NO: 115503 - RNA, 19 nt, Homo sapiens
cccauaaacuucugucaag

SEQ ID NO: 115504 - RNA, 19 nt, Homo sapiens
cuuaacaacugcaucauac

SEQ ID NO: 115505 - RNA, 19 nt, Homo sapiens
ucggaggccucuuguucua

SEQ ID NO: 115506 - RNA, 19 nt, Homo sapiens
caacagccggcagauguaa

SEQ ID NO: 115507 - RNA, 19 nt, Homo sapiens
caggaacaguugaaagauc

SEQ ID NO: 115508 - RNA, 19 nt, Homo sapiens
ggacuguuaccuuccuuga

SEQ ID NO: 115509 - RNA, 19 nt, Homo sapiens
gaaggaggaccagcaagug

SEQ ID NO: 115510 - RNA, 19 nt, Homo sapiens
gccaacagccggcagaugu

SEQ ID NO: 115511 - RNA, 19 nt, Homo sapiens
ugugaaauccuaauucugu

SEQ ID NO: 115512 - RNA, 19 nt, Homo sapiens
agcaagaacugcaacaaca

SEQ ID NO: 115513 - RNA, 19 nt, Homo sapiens
guacuguagccacaugauu

SEQ ID NO: 115514 - RNA, 19 nt, Homo sapiens
gaugagugccugcuguugu

SEQ ID NO: 115515 - RNA, 19 nt, Homo sapiens
guccgaacuuucuaugaga

SEQ ID NO: 115516 - RNA, 19 nt, Homo sapiens
ucaccaaggauuaugaaga

SEQ ID NO: 115517 - RNA, 19 nt, Homo sapiens
ucucuacccuguacuugga

SEQ ID NO: 115518 - RNA, 19 nt, Homo sapiens
auacuguugucauauguug

SEQ ID NO: 115519 - RNA, 19 nt, Homo sapiens
gaccagcucagagagagua

SEQ ID NO: 115520 - RNA, 19 nt, Homo sapiens
uaacaacugcaucauacug

SEQ ID NO: 115521 - RNA, 19 nt, Homo sapiens
guggacaccugcagucucu

SEQ ID NO: 115522 - RNA, 19 nt, Homo sapiens
ggaggacucugagggaacu

SEQ ID NO: 115523 - RNA, 19 nt, Homo sapiens
ccaacagccggcagaugua

SEQ ID NO: 115524 - RNA, 19 nt, Homo sapiens
ggagaggccagugagauuc

SEQ ID NO: 115525 - RNA, 19 nt, Homo sapiens
guacuuggacaacuuaacu

SEQ ID NO: 115526 - RNA, 19 nt, Homo sapiens
auggagaccucgugccaaa

SEQ ID NO: 115527 - RNA, 19 nt, Homo sapiens
gagccugugguucuauaaa

SEQ ID NO: 115528 - RNA, 19 nt, Homo sapiens
uauggacaguauucuucua

SEQ ID NO: 115529 - RNA, 19 nt, Homo sapiens
ggaggauauucuugacucu

SEQ ID NO: 115530 - RNA, 19 nt, Homo sapiens
gagaaggucaagaaugucu

SEQ ID NO: 115531 - RNA, 19 nt, Homo sapiens
caaggauuaugaagagcau

SEQ ID NO: 115532 - RNA, 19 nt, Homo sapiens
uaaaaccccuaguuccauu

SEQ ID NO: 115533 - RNA, 19 nt, Homo sapiens
acaacugcaucauacuguu

SEQ ID NO: 115534 - RNA, 19 nt, Homo sapiens
cacacucguuugucaaugu

SEQ ID NO: 115535 - RNA, 19 nt, Homo sapiens
cguccgaacuuucuaugag

SEQ ID NO: 115536 - RNA, 19 nt, Homo sapiens
ccccugcucuuuuguauuu

SEQ ID NO: 115537 - RNA, 19 nt, Homo sapiens
gagcggauucucccuugga

SEQ ID NO: 115538 - RNA, 19 nt, Homo sapiens
uaacuccguuccuuugacu

SEQ ID NO: 115539 - RNA, 19 nt, Homo sapiens
gauggaggauauucuugac

SEQ ID NO: 115540 - RNA, 19 nt, Homo sapiens
gcaccugccagagcuuuga

SEQ ID NO: 115541 - RNA, 19 nt, Homo sapiens
acaaagaaucuccuugaca

SEQ ID NO: 115542 - RNA, 19 nt, Homo sapiens
agccacagcuuuccagaag

SEQ ID NO: 115543 - RNA, 19 nt, Homo sapiens
gaggacaccaugcgcuuca

SEQ ID NO: 115544 - RNA, 19 nt, Homo sapiens
uccacaaccuucugacugu

SEQ ID NO: 115545 - RNA, 19 nt, Homo sapiens
ugugugaaauccuaauucu

SEQ ID NO: 115546 - RNA, 19 nt, Homo sapiens
uggacaguauucuucuauu

SEQ ID NO: 115547 - RNA, 19 nt, Homo sapiens
cgucggaggccucuuguuc

SEQ ID NO: 115548 - RNA, 19 nt, Homo sapiens
cuuccuggcuucuccacaa

SEQ ID NO: 115549 - RNA, 19 nt, Homo sapiens
caccugaaccuacugaagu

SEQ ID NO: 115550 - RNA, 19 nt, Homo sapiens
gcaguuuauguucaccuuu

SEQ ID NO: 115551 - RNA, 19 nt, Homo sapiens
ucuuaacaacugcaucaua

SEQ ID NO: 115552 - RNA, 19 nt, Homo sapiens
gcaagaacugcaacaacag

SEQ ID NO: 115553 - RNA, 19 nt, Homo sapiens
ggacaccaugcgcuucaga

SEQ ID NO: 115554 - RNA, 19 nt, Homo sapiens
gcugcuucaccaaggauua

SEQ ID NO: 115555 - RNA, 19 nt, Homo sapiens
uuaaccaaagugcaguuua

SEQ ID NO: 115556 - RNA, 19 nt, Homo sapiens
uuaccuuccuugauaugga

SEQ ID NO: 115557 - RNA, 19 nt, Homo sapiens
gagcaccugccagagcuuu

SEQ ID NO: 115558 - RNA, 19 nt, Homo sapiens
ugaaugcuccagccaagau

SEQ ID NO: 115559 - RNA, 19 nt, Homo sapiens
gaaauccuaauucugucau

SEQ ID NO: 115560 - RNA, 19 nt, Homo sapiens
caucauacuguugucauau

SEQ ID NO: 115561 - RNA, 19 nt, Homo sapiens
ccagaaggaggaccagcaa

SEQ ID NO: 115562 - RNA, 19 nt, Homo sapiens
ugcaggaacucucuuugag

SEQ ID NO: 115563 - RNA, 19 nt, Homo sapiens
uggagaggccagugagauu

SEQ ID NO: 115564 - RNA, 19 nt, Homo sapiens
acucugcaaugggcacuaa

SEQ ID NO: 115565 - RNA, 19 nt, Homo sapiens
ugaaccuacugaaguugug

SEQ ID NO: 115566 - RNA, 19 nt, Homo sapiens
ggaggugucggaguacugu

SEQ ID NO: 115567 - RNA, 19 nt, Homo sapiens
gaaauggacugacuuuaug

SEQ ID NO: 115568 - RNA, 19 nt, Homo sapiens
ggagagcucugacguuuga

SEQ ID NO: 115569 - RNA, 19 nt, Homo sapiens
ggaaauggacugacuuuau

SEQ ID NO: 115570 - RNA, 19 nt, Homo sapiens
caacaacgcuaccuuccaa

SEQ ID NO: 115571 - RNA, 19 nt, Homo sapiens
gaagguggcugugaagaug

SEQ ID NO: 115572 - RNA, 19 nt, Homo sapiens
ggacugacuuuaugccuau

SEQ ID NO: 115573 - RNA, 19 nt, Homo sapiens
ccacgcagcugccuuacaa

SEQ ID NO: 115574 - RNA, 19 nt, Homo sapiens
ggaacaaccugcaguuugg

SEQ ID NO: 115575 - RNA, 19 nt, Homo sapiens
gcuaugagggcaacaguua

SEQ ID NO: 115576 - RNA, 19 nt, Homo sapiens
ccucggagcuggagccuuu

SEQ ID NO: 115577 - RNA, 19 nt, Homo sapiens
ucaaguagauuuccaacau

SEQ ID NO: 115578 - RNA, 19 nt, Homo sapiens
ggagagagcgggacuauac

SEQ ID NO: 115579 - RNA, 19 nt, Homo sapiens
ggaagaucaucgagagcua

SEQ ID NO: 115580 - RNA, 19 nt, Homo sapiens
cccaggagcuacacugaua

SEQ ID NO: 115581 - RNA, 19 nt, Homo sapiens
caaccucgaucaaguagau

SEQ ID NO: 115582 - RNA, 19 nt, Homo sapiens
cagcguugauguuaacuuu

SEQ ID NO: 115583 - RNA, 19 nt, Homo sapiens
gcaggaaggugauguccau

SEQ ID NO: 115584 - RNA, 19 nt, Homo sapiens
gaauauauacagcaucaug

SEQ ID NO: 115585 - RNA, 19 nt, Homo sapiens
ucuauaaacuggugaagga

SEQ ID NO: 115586 - RNA, 19 nt, Homo sapiens
gcguugauguuaacuuuga

SEQ ID NO: 115587 - RNA, 19 nt, Homo sapiens
caaaugacuccuucucuga

SEQ ID NO: 115588 - RNA, 19 nt, Homo sapiens
gggcaacaguuauacuuuc

SEQ ID NO: 115589 - RNA, 19 nt, Homo sapiens
gauguuaacuuugaugucu

SEQ ID NO: 115590 - RNA, 19 nt, Homo sapiens
ggugaaggauggauaccaa

SEQ ID NO: 115591 - RNA, 19 nt, Homo sapiens
gaacauccaccucgagaag

SEQ ID NO: 115592 - RNA, 19 nt, Homo sapiens
gagagaagaggaagaggaa

SEQ ID NO: 115593 - RNA, 19 nt, Homo sapiens
caaguagauuuccaacaug

SEQ ID NO: 115594 - RNA, 19 nt, Homo sapiens
ggagcuacacugauacuga

SEQ ID NO: 115595 - RNA, 19 nt, Homo sapiens
gagcgggacuauaccaauc

SEQ ID NO: 115596 - RNA, 19 nt, Homo sapiens
guaacgugcuguugaccaa

SEQ ID NO: 115597 - RNA, 19 nt, Homo sapiens
ggacaccuauguggagaug

SEQ ID NO: 115598 - RNA, 19 nt, Homo sapiens
caacaguuauacuuucauc

SEQ ID NO: 115599 - RNA, 19 nt, Homo sapiens
gagaagaggaagaggaaga

SEQ ID NO: 115600 - RNA, 19 nt, Homo sapiens
ucaacaaucugacuuucau

SEQ ID NO: 115601 - RNA, 19 nt, Homo sapiens
gagguaagcgucauaugga

SEQ ID NO: 115602 - RNA, 19 nt, Homo sapiens
gaacugcggccaggcuaaa

SEQ ID NO: 115603 - RNA, 19 nt, Homo sapiens
gaaggauggauaccaaaug

SEQ ID NO: 115604 - RNA, 19 nt, Homo sapiens
gcugacucauccuaacuaa

SEQ ID NO: 115605 - RNA, 19 nt, Homo sapiens
cuggagagcucugacguuu

SEQ ID NO: 115606 - RNA, 19 nt, Homo sapiens
gcacuccaccuccauguuc

SEQ ID NO: 115607 - RNA, 19 nt, Homo sapiens
ggucagaggaucccacuuc

SEQ ID NO: 115608 - RNA, 19 nt, Homo sapiens
gaagagagaagaggaagag

SEQ ID NO: 115609 - RNA, 19 nt, Homo sapiens
ucaaugcagugcccugaug

SEQ ID NO: 115610 - RNA, 19 nt, Homo sapiens
ugacucauccuaacuaaca

SEQ ID NO: 115611 - RNA, 19 nt, Homo sapiens
ggcaacaguuauacuuuca

SEQ ID NO: 115612 - RNA, 19 nt, Homo sapiens
ccagcagcguugauguuaa

SEQ ID NO: 115613 - RNA, 19 nt, Homo sapiens
gggagaacauacaaacucu

SEQ ID NO: 115614 - RNA, 19 nt, Homo sapiens
gaacaucgucaaccuucug

SEQ ID NO: 115615 - RNA, 19 nt, Homo sapiens
ggagaagagagaagaggaa

SEQ ID NO: 115616 - RNA, 19 nt, Homo sapiens
ccacagggccaaguucauu

SEQ ID NO: 115617 - RNA, 19 nt, Homo sapiens
cuacacugauacugagaaa

SEQ ID NO: 115618 - RNA, 19 nt, Homo sapiens
uaugagggcaacaguuaua

SEQ ID NO: 115619 - RNA, 19 nt, Homo sapiens
gagagugccuacuugaacu

SEQ ID NO: 115620 - RNA, 19 nt, Homo sapiens
gccagcagcguugauguua

SEQ ID NO: 115621 - RNA, 19 nt, Homo sapiens
ggaccuaucgcugcacuga

SEQ ID NO: 115622 - RNA, 19 nt, Homo sapiens
gcgcguaacgugcuguuga

SEQ ID NO: 115623 - RNA, 19 nt, Homo sapiens
agcaagaccuggacaagga

SEQ ID NO: 115624 - RNA, 19 nt, Homo sapiens
agggaggcgucgacuauaa

SEQ ID NO: 115625 - RNA, 19 nt, Homo sapiens
cgagggaggcgucgacuau

SEQ ID NO: 115626 - RNA, 19 nt, Homo sapiens
cacaggagguggucguguu

SEQ ID NO: 115627 - RNA, 19 nt, Homo sapiens
ggauggcuccucuaagaau

SEQ ID NO: 115628 - RNA, 19 nt, Homo sapiens
cagguccgcuggaagauca

SEQ ID NO: 115629 - RNA, 19 nt, Homo sapiens
gggcucaaccucaaaguca

SEQ ID NO: 115630 - RNA, 19 nt, Homo sapiens
cgcaaucccucaacaaucu

SEQ ID NO: 115631 - RNA, 19 nt, Homo sapiens
cuacuguucucaugguguu

SEQ ID NO: 115632 - RNA, 19 nt, Homo sapiens
guacaaguauaagcagaag

SEQ ID NO: 115633 - RNA, 19 nt, Homo sapiens
caacaaucugacuuucaua

SEQ ID NO: 115634 - RNA, 19 nt, Homo sapiens
ccagagagcaucuuugacu

SEQ ID NO: 115635 - RNA, 19 nt, Homo sapiens
gccaggagcccuuccacaa

SEQ ID NO: 115636 - RNA, 19 nt, Homo sapiens
ucccugagcuggucgugaa

SEQ ID NO: 115637 - RNA, 19 nt, Homo sapiens
ggucauguggccaagauug

SEQ ID NO: 115638 - RNA, 19 nt, Homo sapiens
ccacggcccaugcugauga

SEQ ID NO: 115639 - RNA, 19 nt, Homo sapiens
gagggcaacaguuauacuu

SEQ ID NO: 115640 - RNA, 19 nt, Homo sapiens
gaaagugcagaaagucauc

SEQ ID NO: 115641 - RNA, 19 nt, Homo sapiens
gcaauggcagcguggaaug

SEQ ID NO: 115642 - RNA, 19 nt, Homo sapiens
ucacaggaccucuuagucu

SEQ ID NO: 115643 - RNA, 19 nt, Homo sapiens
gaagaucaucgagagcuau

SEQ ID NO: 115644 - RNA, 19 nt, Homo sapiens
gaccuuagagcacaaccaa

SEQ ID NO: 115645 - RNA, 19 nt, Homo sapiens
gcuagggacaucaugaaug

SEQ ID NO: 115646 - RNA, 19 nt, Homo sapiens
gagggaggcgucgacuaua

SEQ ID NO: 115647 - RNA, 19 nt, Homo sapiens
caaggaggaggaagaggaa

SEQ ID NO: 115648 - RNA, 19 nt, Homo sapiens
cagcagcguugauguuaac

SEQ ID NO: 115649 - RNA, 19 nt, Homo sapiens
gauggcuccucuaagaauc

SEQ ID NO: 115650 - RNA, 19 nt, Homo sapiens
gcuaugccaacuaguagaa

SEQ ID NO: 115651 - RNA, 19 nt, Homo sapiens
cggaacaaccugcaguuug

SEQ ID NO: 115652 - RNA, 19 nt, Homo sapiens
gcugacuguugagaccuua

SEQ ID NO: 115653 - RNA, 19 nt, Homo sapiens
acccaggccugcaagguuu

SEQ ID NO: 115654 - RNA, 19 nt, Homo sapiens
ccucaaccucgaucaagua

SEQ ID NO: 115655 - RNA, 19 nt, Homo sapiens
gcagagcuggugcggauuc

SEQ ID NO: 115656 - RNA, 19 nt, Homo sapiens
ggaccaggacgcacuacug

SEQ ID NO: 115657 - RNA, 19 nt, Homo sapiens
cuuagucucugcccuauac

SEQ ID NO: 115658 - RNA, 19 nt, Homo sapiens
gcucggcccagcucugaaa

SEQ ID NO: 115659 - RNA, 19 nt, Homo sapiens
ugucuccacuucuucaaau

SEQ ID NO: 115660 - RNA, 19 nt, Homo sapiens
caagcugacucauccuaac

SEQ ID NO: 115661 - RNA, 19 nt, Homo sapiens
aaucucacaggaccucuua

SEQ ID NO: 115662 - RNA, 19 nt, Homo sapiens
ggaacugcggccaggcuaa

SEQ ID NO: 115663 - RNA, 19 nt, Homo sapiens
acuggacccuguacucuga

SEQ ID NO: 115664 - RNA, 19 nt, Homo sapiens
cuuccucgcuuccaagaau

SEQ ID NO: 115665 - RNA, 19 nt, Homo sapiens
acauccaccucgagaagaa

SEQ ID NO: 115666 - RNA, 19 nt, Homo sapiens
uguccgagcugaagaucau

SEQ ID NO: 115667 - RNA, 19 nt, Homo sapiens
gaagucaucucagaaaugu

SEQ ID NO: 115668 - RNA, 19 nt, Homo sapiens
ugagaugaaugaaacagua

SEQ ID NO: 115669 - RNA, 19 nt, Homo sapiens
gcagaagaaugggaauauu

SEQ ID NO: 115670 - RNA, 19 nt, Homo sapiens
gagccgaccugccuacaga

SEQ ID NO: 115671 - RNA, 19 nt, Homo sapiens
caacccagauuaucaccuu

SEQ ID NO: 115672 - RNA, 19 nt, Homo sapiens
cagaagaaugggaauauuu

SEQ ID NO: 115673 - RNA, 19 nt, Homo sapiens
aacaagagcuagaaacuca

SEQ ID NO: 115674 - RNA, 19 nt, Homo sapiens
guagaagucaucucagaaa

SEQ ID NO: 115675 - RNA, 19 nt, Homo sapiens
cagauuaucaccuuugaaa

SEQ ID NO: 115676 - RNA, 19 nt, Homo sapiens
aaaguucucuggaggaugu

SEQ ID NO: 115677 - RNA, 19 nt, Homo sapiens
gaaacaagagcuagaaacu

SEQ ID NO: 115678 - RNA, 19 nt, Homo sapiens
gaaugaaacaguagaaguc

SEQ ID NO: 115679 - RNA, 19 nt, Homo sapiens
ucaaagagaaccugaagga

SEQ ID NO: 115680 - RNA, 19 nt, Homo sapiens
aagagaaccugaaggacuu

SEQ ID NO: 115681 - RNA, 19 nt, Homo sapiens
caguagaagucaucucaga

SEQ ID NO: 115682 - RNA, 19 nt, Homo sapiens
gagagaaaggcuaaaguuc

SEQ ID NO: 115683 - RNA, 19 nt, Homo sapiens
agacacugcugcugagaug

SEQ ID NO: 115684 - RNA, 19 nt, Homo sapiens
gcugcucucucaugaaaca

SEQ ID NO: 115685 - RNA, 19 nt, Homo sapiens
gcuagaaacucaggauggu

SEQ ID NO: 115686 - RNA, 19 nt, Homo sapiens
ugaaggacuuucugcuugu

SEQ ID NO: 115687 - RNA, 19 nt, Homo sapiens
auacaggcauggcagaaga

SEQ ID NO: 115688 - RNA, 19 nt, Homo sapiens
gccuggagcuguacaagca

SEQ ID NO: 115689 - RNA, 19 nt, Homo sapiens
uagaagucaucucagaaau

SEQ ID NO: 115690 - RNA, 19 nt, Homo sapiens
gaaccugaguagagacacu

SEQ ID NO: 115691 - RNA, 19 nt, Homo sapiens
agagagaaaggcuaaaguu

SEQ ID NO: 115692 - RNA, 19 nt, Homo sapiens
agucaucucagaaauguuu

SEQ ID NO: 115693 - RNA, 19 nt, Homo sapiens
gaugaaugaaacaguagaa

SEQ ID NO: 115694 - RNA, 19 nt, Homo sapiens
gcucucucaugaaacaaga

SEQ ID NO: 115695 - RNA, 19 nt, Homo sapiens
gaaggacuuucugcuuguc

SEQ ID NO: 115696 - RNA, 19 nt, Homo sapiens
ggcagaagaaugggaauau

SEQ ID NO: 115697 - RNA, 19 nt, Homo sapiens
cugcugagaugaaugaaac

SEQ ID NO: 115698 - RNA, 19 nt, Homo sapiens
cuaaaguucucuggaggau

SEQ ID NO: 115699 - RNA, 19 nt, Homo sapiens
ggagugagaccggccagau

SEQ ID NO: 115700 - RNA, 19 nt, Homo sapiens
agacccgccuggagcugua

SEQ ID NO: 115701 - RNA, 19 nt, Homo sapiens
ugaaugaaacaguagaagu

SEQ ID NO: 115702 - RNA, 19 nt, Homo sapiens
gggccacacugacccugau

SEQ ID NO: 115703 - RNA, 19 nt, Homo sapiens
gaaccugaaggacuuucug

SEQ ID NO: 115704 - RNA, 19 nt, Homo sapiens
ugaaacaguagaagucauc

SEQ ID NO: 115705 - RNA, 19 nt, Homo sapiens
gagaugaaugaaacaguag

SEQ ID NO: 115706 - RNA, 19 nt, Homo sapiens
caugaaacaagagcuagaa

SEQ ID NO: 115707 - RNA, 19 nt, Homo sapiens
agaagucaucucagaaaug

SEQ ID NO: 115708 - RNA, 19 nt, Homo sapiens
gagugagaccggccagaug

SEQ ID NO: 115709 - RNA, 19 nt, Homo sapiens
cccagauuaucaccuuuga

SEQ ID NO: 115710 - RNA, 19 nt, Homo sapiens
acacugcugcugagaugaa

SEQ ID NO: 115711 - RNA, 19 nt, Homo sapiens
ucucaugaaacaagagcua

SEQ ID NO: 115712 - RNA, 19 nt, Homo sapiens
agugagaccggccagauga

SEQ ID NO: 115713 - RNA, 19 nt, Homo sapiens
ccugaaggacuuucugcuu

SEQ ID NO: 115714 - RNA, 19 nt, Homo sapiens
ccacacugacccugauaca

SEQ ID NO: 115715 - RNA, 19 nt, Homo sapiens
gcaauuacuuucugguuaa

SEQ ID NO: 115716 - RNA, 19 nt, Homo sapiens
caaagaggauuucaacaga

SEQ ID NO: 115717 - RNA, 19 nt, Homo sapiens
gcaaguguuucuuaacuga

SEQ ID NO: 115718 - RNA, 19 nt, Homo sapiens
ggauuaacgucucgcaauu

SEQ ID NO: 115719 - RNA, 19 nt, Homo sapiens
gagugaagccauugaauuu

SEQ ID NO: 115720 - RNA, 19 nt, Homo sapiens
gcucuucccuucucucuga

SEQ ID NO: 115721 - RNA, 19 nt, Homo sapiens
gagccaagaucgcaccauu

SEQ ID NO: 115722 - RNA, 19 nt, Homo sapiens
ugaaggaaauuaccugaga

SEQ ID NO: 115723 - RNA, 19 nt, Homo sapiens
gagauccgguguccuuauu

SEQ ID NO: 115724 - RNA, 19 nt, Homo sapiens
gaaacugcuuuauccaaau

SEQ ID NO: 115725 - RNA, 19 nt, Homo sapiens
gcaccagccucuagucuca

SEQ ID NO: 115726 - RNA, 19 nt, Homo sapiens
gaucaaagacaaacugaau

SEQ ID NO: 115727 - RNA, 19 nt, Homo sapiens
ggaaacagcccaggaccua

SEQ ID NO: 115728 - RNA, 19 nt, Homo sapiens
ggagugaagccauugaauu

SEQ ID NO: 115729 - RNA, 19 nt, Homo sapiens
auacgaaacucaaagagaa

SEQ ID NO: 115730 - RNA, 19 nt, Homo sapiens
caucuacaaugcggauuua

SEQ ID NO: 115731 - RNA, 19 nt, Homo sapiens
caacagaaacugcuuuauc

SEQ ID NO: 115732 - RNA, 19 nt, Homo sapiens
gcaugaaggagucacauuu

SEQ ID NO: 115733 - RNA, 19 nt, Homo sapiens
cgcaauuacuuucugguua

SEQ ID NO: 115734 - RNA, 19 nt, Homo sapiens
agaaacugcuuuauccaaa

SEQ ID NO: 115735 - RNA, 19 nt, Homo sapiens
gcugugaaccuuuauauca

SEQ ID NO: 115736 - RNA, 19 nt, Homo sapiens
ggaaccagccgagaaauug

SEQ ID NO: 115737 - RNA, 19 nt, Homo sapiens
guccucggcuuccucuuua

SEQ ID NO: 115738 - RNA, 19 nt, Homo sapiens
gaaaucggaucugcgaaca

SEQ ID NO: 115739 - RNA, 19 nt, Homo sapiens
gauuaacgucucgcaauua

SEQ ID NO: 115740 - RNA, 19 nt, Homo sapiens
gaacccaggcucaguaaca

SEQ ID NO: 115741 - RNA, 19 nt, Homo sapiens
uaauguuucuggugauuug

SEQ ID NO: 115742 - RNA, 19 nt, Homo sapiens
ucaaagacaaacugaauga

SEQ ID NO: 115743 - RNA, 19 nt, Homo sapiens
gaauuucuccuguuucauc

SEQ ID NO: 115744 - RNA, 19 nt, Homo sapiens
aaagaggauuucaacagaa

SEQ ID NO: 115745 - RNA, 19 nt, Homo sapiens
gaagaacagagucguggaa

SEQ ID NO: 115746 - RNA, 19 nt, Homo sapiens
ugucguaccuggacuuuca

SEQ ID NO: 115747 - RNA, 19 nt, Homo sapiens
guaccgcugcucagaauuu

SEQ ID NO: 115748 - RNA, 19 nt, Homo sapiens
ccaauucuuugauucacuu

SEQ ID NO: 115749 - RNA, 19 nt, Homo sapiens
ccgguguccuuauuacaua

SEQ ID NO: 115750 - RNA, 19 nt, Homo sapiens
ccaggacgaugaauuuaag

SEQ ID NO: 115751 - RNA, 19 nt, Homo sapiens
gcagacguccgcaucuuga

SEQ ID NO: 115752 - RNA, 19 nt, Homo sapiens
ggaauggcauggacaucuc

SEQ ID NO: 115753 - RNA, 19 nt, Homo sapiens
uaacggaaccagccgagaa

SEQ ID NO: 115754 - RNA, 19 nt, Homo sapiens
cagcaaguguuucuuaacu

SEQ ID NO: 115755 - RNA, 19 nt, Homo sapiens
gcaggagaauugcuugaac

SEQ ID NO: 115756 - RNA, 19 nt, Homo sapiens
caaacugaaugauaaccau

SEQ ID NO: 115757 - RNA, 19 nt, Homo sapiens
cggaaaaccuacugauuaa

SEQ ID NO: 115758 - RNA, 19 nt, Homo sapiens
uaacgucucgcaauuacuu

SEQ ID NO: 115759 - RNA, 19 nt, Homo sapiens
cccgugacguccaguauuu

SEQ ID NO: 115760 - RNA, 19 nt, Homo sapiens
cuacaaugcggauuuaaug

SEQ ID NO: 115761 - RNA, 19 nt, Homo sapiens
ggcauccaauucuuugauu

SEQ ID NO: 115762 - RNA, 19 nt, Homo sapiens
gaaaggcuaccgcgaagag

SEQ ID NO: 115763 - RNA, 19 nt, Homo sapiens
gaaauuugucugcaugaag

SEQ ID NO: 115764 - RNA, 19 nt, Homo sapiens
gaaccucggcucuguguac

SEQ ID NO: 115765 - RNA, 19 nt, Homo sapiens
gugaagccauugaauuugg

SEQ ID NO: 115766 - RNA, 19 nt, Homo sapiens
gaaaaccuacugauuaaug

SEQ ID NO: 115767 - RNA, 19 nt, Homo sapiens
ggguaccgcugcucagaau

SEQ ID NO: 115768 - RNA, 19 nt, Homo sapiens
gauugcaucucaaaacaaa

SEQ ID NO: 115769 - RNA, 19 nt, Homo sapiens
caagccuucugcucuguga

SEQ ID NO: 115770 - RNA, 19 nt, Homo sapiens
gaaaauagaacgauucaac

SEQ ID NO: 115771 - RNA, 19 nt, Homo sapiens
gcauccaauucuuugauuc

SEQ ID NO: 115772 - RNA, 19 nt, Homo sapiens
gauccgguguccuuauuac

SEQ ID NO: 115773 - RNA, 19 nt, Homo sapiens
cgugaauacuagucaaaga

SEQ ID NO: 115774 - RNA, 19 nt, Homo sapiens
ugaaauuugucugcaugaa

SEQ ID NO: 115775 - RNA, 19 nt, Homo sapiens
ucggcucuguguacauuua

SEQ ID NO: 115776 - RNA, 19 nt, Homo sapiens
ccauugaauuugguucuga

SEQ ID NO: 115777 - RNA, 19 nt, Homo sapiens
gcagguggaaggagaggaa

SEQ ID NO: 115778 - RNA, 19 nt, Homo sapiens
ccucggcucuguguacauu

SEQ ID NO: 115779 - RNA, 19 nt, Homo sapiens
ggacguccacagaaagaau

SEQ ID NO: 115780 - RNA, 19 nt, Homo sapiens
gaugucaccuggauaaccu

SEQ ID NO: 115781 - RNA, 19 nt, Homo sapiens
cuucagcaaguguuucuua

SEQ ID NO: 115782 - RNA, 19 nt, Homo sapiens
augaugcugugaaccuuua

SEQ ID NO: 115783 - RNA, 19 nt, Homo sapiens
guccgcaucuugaauugga

SEQ ID NO: 115784 - RNA, 19 nt, Homo sapiens
ucaccuggauaaccuguca

SEQ ID NO: 115785 - RNA, 19 nt, Homo sapiens
ggagauccgguguccuuau

SEQ ID NO: 115786 - RNA, 19 nt, Homo sapiens
ucaaagaggauuucaacag

SEQ ID NO: 115787 - RNA, 19 nt, Homo sapiens
caugaaggagucacauuug

SEQ ID NO: 115788 - RNA, 19 nt, Homo sapiens
ggaacuguuuucuugauga

SEQ ID NO: 115789 - RNA, 19 nt, Homo sapiens
gacguccacagaaagaaua

SEQ ID NO: 115790 - RNA, 19 nt, Homo sapiens
gagaagcggcgauguuugc

SEQ ID NO: 115791 - RNA, 19 nt, Homo sapiens
guacauacgaaacucaaag

SEQ ID NO: 115792 - RNA, 19 nt, Homo sapiens
gaugaugcugugaaccuuu

SEQ ID NO: 115793 - RNA, 19 nt, Homo sapiens
cagaaacugcuuuauccaa

SEQ ID NO: 115794 - RNA, 19 nt, Homo sapiens
augaaggagucacauuuga

SEQ ID NO: 115795 - RNA, 19 nt, Homo sapiens
gaucaucugggaggaauuc

SEQ ID NO: 115796 - RNA, 19 nt, Homo sapiens
ccgagaagcggcgauguuu

SEQ ID NO: 115797 - RNA, 19 nt, Homo sapiens
cauacgaaacucaaagaga

SEQ ID NO: 115798 - RNA, 19 nt, Homo sapiens
caaugcggauuuaaugaac

SEQ ID NO: 115799 - RNA, 19 nt, Homo sapiens
acaaugcggauuuaaugaa

SEQ ID NO: 115800 - RNA, 19 nt, Homo sapiens
ucacgugaauacuagucaa

SEQ ID NO: 115801 - RNA, 19 nt, Homo sapiens
ccuguaaucccagcacuuu

SEQ ID NO: 115802 - RNA, 19 nt, Homo sapiens
cccagaggguguaggaaug

SEQ ID NO: 115803 - RNA, 19 nt, Homo sapiens
ggaauucaccccagaggaa

SEQ ID NO: 115804 - RNA, 19 nt, Homo sapiens
gacguccgcaucuugaauu

SEQ ID NO: 115805 - RNA, 19 nt, Homo sapiens
agauacaacuuuccaagcu

SEQ ID NO: 115806 - RNA, 19 nt, Homo sapiens
gauuaauguuucuggugau

SEQ ID NO: 115807 - RNA, 19 nt, Homo sapiens
gaaacagcccaggaccuau

SEQ ID NO: 115808 - RNA, 19 nt, Homo sapiens
aacagaaacugcuuuaucc

SEQ ID NO: 115809 - RNA, 19 nt, Homo sapiens
caaccuucagcaaguguuu

SEQ ID NO: 115810 - RNA, 19 nt, Homo sapiens
cggcgauguuugcguagaa

SEQ ID NO: 115811 - RNA, 19 nt, Homo sapiens
ccuaucagaagcugucgua

SEQ ID NO: 115812 - RNA, 19 nt, Homo sapiens
gacaagccuucugcucugu

SEQ ID NO: 115813 - RNA, 19 nt, Homo sapiens
gaaccagccgagaaauugg

SEQ ID NO: 115814 - RNA, 19 nt, Homo sapiens
aaucggaucugcgaacagu

SEQ ID NO: 115815 - RNA, 19 nt, Homo sapiens
gcaauuacuuucugguuaa

SEQ ID NO: 115816 - RNA, 19 nt, Homo sapiens
caaagaggauuucaacaga

SEQ ID NO: 115817 - RNA, 19 nt, Homo sapiens
gcaaguguuucuuaacuga

SEQ ID NO: 115818 - RNA, 19 nt, Homo sapiens
ggauuaacgucucgcaauu

SEQ ID NO: 115819 - RNA, 19 nt, Homo sapiens
gagugaagccauugaauuu

SEQ ID NO: 115820 - RNA, 19 nt, Homo sapiens
gagccaagaucgcaccauu

SEQ ID NO: 115821 - RNA, 19 nt, Homo sapiens
ugaaggaaauuaccugaga

SEQ ID NO: 115822 - RNA, 19 nt, Homo sapiens
gagauccgguguccuuauu

SEQ ID NO: 115823 - RNA, 19 nt, Homo sapiens
gaaacugcuuuauccaaau

SEQ ID NO: 115824 - RNA, 19 nt, Homo sapiens
gcaccagccucuagucuca

SEQ ID NO: 115825 - RNA, 19 nt, Homo sapiens
gaucaaagacaaacugaau

SEQ ID NO: 115826 - RNA, 19 nt, Homo sapiens
ggaaacagcccaggaccua

SEQ ID NO: 115827 - RNA, 19 nt, Homo sapiens
ggagugaagccauugaauu

SEQ ID NO: 115828 - RNA, 19 nt, Homo sapiens
auacgaaacucaaagagaa

SEQ ID NO: 115829 - RNA, 19 nt, Homo sapiens
caucuacaaugcggauuua

SEQ ID NO: 115830 - RNA, 19 nt, Homo sapiens
caacagaaacugcuuuauc

SEQ ID NO: 115831 - RNA, 19 nt, Homo sapiens
gcaugaaggagucacauuu

SEQ ID NO: 115832 - RNA, 19 nt, Homo sapiens
cgcaauuacuuucugguua

SEQ ID NO: 115833 - RNA, 19 nt, Homo sapiens
agaaacugcuuuauccaaa

SEQ ID NO: 115834 - RNA, 19 nt, Homo sapiens
gcugugaaccuuuauauca

SEQ ID NO: 115835 - RNA, 19 nt, Homo sapiens
ggaaccagccgagaaauug

SEQ ID NO: 115836 - RNA, 19 nt, Homo sapiens
guccucggcuuccucuuua

SEQ ID NO: 115837 - RNA, 19 nt, Homo sapiens
gaaaucggaucugcgaaca

SEQ ID NO: 115838 - RNA, 19 nt, Homo sapiens
gauuaacgucucgcaauua

SEQ ID NO: 115839 - RNA, 19 nt, Homo sapiens
gaacccaggcucaguaaca

SEQ ID NO: 115840 - RNA, 19 nt, Homo sapiens
uaauguuucuggugauuug

SEQ ID NO: 115841 - RNA, 19 nt, Homo sapiens
ucaaagacaaacugaauga

SEQ ID NO: 115842 - RNA, 19 nt, Homo sapiens
gaauuucuccuguuucauc

SEQ ID NO: 115843 - RNA, 19 nt, Homo sapiens
aaagaggauuucaacagaa

SEQ ID NO: 115844 - RNA, 19 nt, Homo sapiens
gaagaacagagucguggaa

SEQ ID NO: 115845 - RNA, 19 nt, Homo sapiens
ugucguaccuggacuuuca

SEQ ID NO: 115846 - RNA, 19 nt, Homo sapiens
guaccgcugcucagaauuu

SEQ ID NO: 115847 - RNA, 19 nt, Homo sapiens
ucucuucccuucucucuga

SEQ ID NO: 115848 - RNA, 19 nt, Homo sapiens
ccaauucuuugauucacuu

SEQ ID NO: 115849 - RNA, 19 nt, Homo sapiens
ccgguguccuuauuacaua

SEQ ID NO: 115850 - RNA, 19 nt, Homo sapiens
ccaggacgaugaauuuaag

SEQ ID NO: 115851 - RNA, 19 nt, Homo sapiens
gcagacguccgcaucuuga

SEQ ID NO: 115852 - RNA, 19 nt, Homo sapiens
ggaauggcauggacaucuc

SEQ ID NO: 115853 - RNA, 19 nt, Homo sapiens
uaacggaaccagccgagaa

SEQ ID NO: 115854 - RNA, 19 nt, Homo sapiens
cagcaaguguuucuuaacu

SEQ ID NO: 115855 - RNA, 19 nt, Homo sapiens
gcaggagaauugcuugaac

SEQ ID NO: 115856 - RNA, 19 nt, Homo sapiens
caaacugaaugauaaccau

SEQ ID NO: 115857 - RNA, 19 nt, Homo sapiens
cggaaaaccuacugauuaa

SEQ ID NO: 115858 - RNA, 19 nt, Homo sapiens
uaacgucucgcaauuacuu

SEQ ID NO: 115859 - RNA, 19 nt, Homo sapiens
cccgugacguccaguauuu

SEQ ID NO: 115860 - RNA, 19 nt, Homo sapiens
cuacaaugcggauuuaaug

SEQ ID NO: 115861 - RNA, 19 nt, Homo sapiens
ggcauccaauucuuugauu

SEQ ID NO: 115862 - RNA, 19 nt, Homo sapiens
gaaaggcuaccgcgaagag

SEQ ID NO: 115863 - RNA, 19 nt, Homo sapiens
gaaauuugucugcaugaag

SEQ ID NO: 115864 - RNA, 19 nt, Homo sapiens
gaaccucggcucuguguac

SEQ ID NO: 115865 - RNA, 19 nt, Homo sapiens
gugaagccauugaauuugg

SEQ ID NO: 115866 - RNA, 19 nt, Homo sapiens
gaaaaccuacugauuaaug

SEQ ID NO: 115867 - RNA, 19 nt, Homo sapiens
ggguaccgcugcucagaau

SEQ ID NO: 115868 - RNA, 19 nt, Homo sapiens
gauugcaucucaaaacaaa

SEQ ID NO: 115869 - RNA, 19 nt, Homo sapiens
gaaaauagaacgauucaac

SEQ ID NO: 115870 - RNA, 19 nt, Homo sapiens
gcauccaauucuuugauuc

SEQ ID NO: 115871 - RNA, 19 nt, Homo sapiens
caagccuucugcucuguga

SEQ ID NO: 115872 - RNA, 19 nt, Homo sapiens
gauccgguguccuuauuac

SEQ ID NO: 115873 - RNA, 19 nt, Homo sapiens
cgugaauacuagucaaaga

SEQ ID NO: 115874 - RNA, 19 nt, Homo sapiens
ugaaauuugucugcaugaa

SEQ ID NO: 115875 - RNA, 19 nt, Homo sapiens
ucggcucuguguacauuua

SEQ ID NO: 115876 - RNA, 19 nt, Homo sapiens
ccauugaauuugguucuga

SEQ ID NO: 115877 - RNA, 19 nt, Homo sapiens
gcagguggaaggagaggaa

SEQ ID NO: 115878 - RNA, 19 nt, Homo sapiens
ccucggcucuguguacauu

SEQ ID NO: 115879 - RNA, 19 nt, Homo sapiens
ggacguccacagaaagaau

SEQ ID NO: 115880 - RNA, 19 nt, Homo sapiens
gaugucaccuggauaaccu

SEQ ID NO: 115881 - RNA, 19 nt, Homo sapiens
cuucagcaaguguuucuua

SEQ ID NO: 115882 - RNA, 19 nt, Homo sapiens
augaugcugugaaccuuua

SEQ ID NO: 115883 - RNA, 19 nt, Homo sapiens
guccgcaucuugaauugga

SEQ ID NO: 115884 - RNA, 19 nt, Homo sapiens
ucaccuggauaaccuguca

SEQ ID NO: 115885 - RNA, 19 nt, Homo sapiens
ggagauccgguguccuuau

SEQ ID NO: 115886 - RNA, 19 nt, Homo sapiens
ucaaagaggauuucaacag

SEQ ID NO: 115887 - RNA, 19 nt, Homo sapiens
caugaaggagucacauuug

SEQ ID NO: 115888 - RNA, 19 nt, Homo sapiens
ggaacuguuuucuugauga

SEQ ID NO: 115889 - RNA, 19 nt, Homo sapiens
gacguccacagaaagaaua

SEQ ID NO: 115890 - RNA, 19 nt, Homo sapiens
guacauacgaaacucaaag

SEQ ID NO: 115891 - RNA, 19 nt, Homo sapiens
gagaagcggcgauguuugc

SEQ ID NO: 115892 - RNA, 19 nt, Homo sapiens
gaugaugcugugaaccuuu

SEQ ID NO: 115893 - RNA, 19 nt, Homo sapiens
cagaaacugcuuuauccaa

SEQ ID NO: 115894 - RNA, 19 nt, Homo sapiens
augaaggagucacauuuga

SEQ ID NO: 115895 - RNA, 19 nt, Homo sapiens
gaucaucugggaggaauuc

SEQ ID NO: 115896 - RNA, 19 nt, Homo sapiens
ccgagaagcggcgauguuu

SEQ ID NO: 115897 - RNA, 19 nt, Homo sapiens
cauacgaaacucaaagaga

SEQ ID NO: 115898 - RNA, 19 nt, Homo sapiens
caaugcggauuuaaugaac

SEQ ID NO: 115899 - RNA, 19 nt, Homo sapiens
acaaugcggauuuaaugaa

SEQ ID NO: 115900 - RNA, 19 nt, Homo sapiens
ucacgugaauacuagucaa

SEQ ID NO: 115901 - RNA, 19 nt, Homo sapiens
ccuguaaucccagcacuuu

SEQ ID NO: 115902 - RNA, 19 nt, Homo sapiens
cccagaggguguaggaaug

SEQ ID NO: 115903 - RNA, 19 nt, Homo sapiens
ggaauucaccccagaggaa

SEQ ID NO: 115904 - RNA, 19 nt, Homo sapiens
gacguccgcaucuugaauu

SEQ ID NO: 115905 - RNA, 19 nt, Homo sapiens
agauacaacuuuccaagcu

SEQ ID NO: 115906 - RNA, 19 nt, Homo sapiens
gauuaauguuucuggugau

SEQ ID NO: 115907 - RNA, 19 nt, Homo sapiens
gaaacagcccaggaccuau

SEQ ID NO: 115908 - RNA, 19 nt, Homo sapiens
aacagaaacugcuuuaucc

SEQ ID NO: 115909 - RNA, 19 nt, Homo sapiens
caaccuucagcaaguguuu

SEQ ID NO: 115910 - RNA, 19 nt, Homo sapiens
cggcgauguuugcguagaa

SEQ ID NO: 115911 - RNA, 19 nt, Homo sapiens
gacaagccuucugcucugu

SEQ ID NO: 115912 - RNA, 19 nt, Homo sapiens
ccuaucagaagcugucgua

SEQ ID NO: 115913 - RNA, 19 nt, Homo sapiens
gaaccagccgagaaauugg

SEQ ID NO: 115914 - RNA, 19 nt, Homo sapiens
guggaacccaggcucagua

SEQ ID NO: 115915 - RNA, 19 nt, Homo sapiens
gcaauuacuuucugguuaa

SEQ ID NO: 115916 - RNA, 19 nt, Homo sapiens
caaagaggauuucaacaga

SEQ ID NO: 115917 - RNA, 19 nt, Homo sapiens
gcaaguguuucuuaacuga

SEQ ID NO: 115918 - RNA, 19 nt, Homo sapiens
ggauuaacgucucgcaauu

SEQ ID NO: 115919 - RNA, 19 nt, Homo sapiens
gagugaagccauugaauuu

SEQ ID NO: 115920 - RNA, 19 nt, Homo sapiens
gcucuucccuucucucuga

SEQ ID NO: 115921 - RNA, 19 nt, Homo sapiens
gagccaagaucgcaccauu

SEQ ID NO: 115922 - RNA, 19 nt, Homo sapiens
ugaaggaaauuaccugaga

SEQ ID NO: 115923 - RNA, 19 nt, Homo sapiens
gagauccgguguccuuauu

SEQ ID NO: 115924 - RNA, 19 nt, Homo sapiens
gaaacugcuuuauccaaau

SEQ ID NO: 115925 - RNA, 19 nt, Homo sapiens
gcaccagccucuagucuca

SEQ ID NO: 115926 - RNA, 19 nt, Homo sapiens
ggaaacagcccaggaccua

SEQ ID NO: 115927 - RNA, 19 nt, Homo sapiens
gugaagccauugaauuuga

SEQ ID NO: 115928 - RNA, 19 nt, Homo sapiens
ggagugaagccauugaauu

SEQ ID NO: 115929 - RNA, 19 nt, Homo sapiens
auacgaaacucaaagagaa

SEQ ID NO: 115930 - RNA, 19 nt, Homo sapiens
caucuacaaugcggauuua

SEQ ID NO: 115931 - RNA, 19 nt, Homo sapiens
caacagaaacugcuuuauc

SEQ ID NO: 115932 - RNA, 19 nt, Homo sapiens
gcaugaaggagucacauuu

SEQ ID NO: 115933 - RNA, 19 nt, Homo sapiens
cgcaauuacuuucugguua

SEQ ID NO: 115934 - RNA, 19 nt, Homo sapiens
agaaacugcuuuauccaaa

SEQ ID NO: 115935 - RNA, 19 nt, Homo sapiens
gcugugaaccuuuauauca

SEQ ID NO: 115936 - RNA, 19 nt, Homo sapiens
ggaaccagccgagaaauug

SEQ ID NO: 115937 - RNA, 19 nt, Homo sapiens
gaaaucggaucugcgaaca

SEQ ID NO: 115938 - RNA, 19 nt, Homo sapiens
gauuaacgucucgcaauua

SEQ ID NO: 115939 - RNA, 19 nt, Homo sapiens
gaacccaggcucaguaaca

SEQ ID NO: 115940 - RNA, 19 nt, Homo sapiens
uaauguuucuggugauuug

SEQ ID NO: 115941 - RNA, 19 nt, Homo sapiens
gaauuucuccuguuucauc

SEQ ID NO: 115942 - RNA, 19 nt, Homo sapiens
aaagaggauuucaacagaa

SEQ ID NO: 115943 - RNA, 19 nt, Homo sapiens
gaagaacagagucguggaa

SEQ ID NO: 115944 - RNA, 19 nt, Homo sapiens
ugucguaccuggacuuuca

SEQ ID NO: 115945 - RNA, 19 nt, Homo sapiens
guaccgcugcucagaauuu

SEQ ID NO: 115946 - RNA, 19 nt, Homo sapiens
ccaauucuuugauucacuu

SEQ ID NO: 115947 - RNA, 19 nt, Homo sapiens
ccgguguccuuauuacaua

SEQ ID NO: 115948 - RNA, 19 nt, Homo sapiens
ccaggacgaugaauuuaag

SEQ ID NO: 115949 - RNA, 19 nt, Homo sapiens
gcagacguccgcaucuuga

SEQ ID NO: 115950 - RNA, 19 nt, Homo sapiens
ggaauggcauggacaucuc

SEQ ID NO: 115951 - RNA, 19 nt, Homo sapiens
uaacggaaccagccgagaa

SEQ ID NO: 115952 - RNA, 19 nt, Homo sapiens
cagcaaguguuucuuaacu

SEQ ID NO: 115953 - RNA, 19 nt, Homo sapiens
gcaggagaauugcuugaac

SEQ ID NO: 115954 - RNA, 19 nt, Homo sapiens
cggaaaaccuacugauuaa

SEQ ID NO: 115955 - RNA, 19 nt, Homo sapiens
uaacgucucgcaauuacuu

SEQ ID NO: 115956 - RNA, 19 nt, Homo sapiens
cccgugacguccaguauuu

SEQ ID NO: 115957 - RNA, 19 nt, Homo sapiens
cuacaaugcggauuuaaug

SEQ ID NO: 115958 - RNA, 19 nt, Homo sapiens
ggcauccaauucuuugauu

SEQ ID NO: 115959 - RNA, 19 nt, Homo sapiens
gaaaggcuaccgcgaagag

SEQ ID NO: 115960 - RNA, 19 nt, Homo sapiens
gaaauuugucugcaugaag

SEQ ID NO: 115961 - RNA, 19 nt, Homo sapiens
gaaaaccuacugauuaaug

SEQ ID NO: 115962 - RNA, 19 nt, Homo sapiens
ggguaccgcugcucagaau

SEQ ID NO: 115963 - RNA, 19 nt, Homo sapiens
gauugcaucucaaaacaaa

SEQ ID NO: 115964 - RNA, 19 nt, Homo sapiens
gaaaauagaacgauucaac

SEQ ID NO: 115965 - RNA, 19 nt, Homo sapiens
gcauccaauucuuugauuc

SEQ ID NO: 115966 - RNA, 19 nt, Homo sapiens
gauccgguguccuuauuac

SEQ ID NO: 115967 - RNA, 19 nt, Homo sapiens
caagccuucugcucuguga

SEQ ID NO: 115968 - RNA, 19 nt, Homo sapiens
cgugaauacuagucaaaga

SEQ ID NO: 115969 - RNA, 19 nt, Homo sapiens
ugaaauuugucugcaugaa

SEQ ID NO: 115970 - RNA, 19 nt, Homo sapiens
gcagguggaaggagaggaa

SEQ ID NO: 115971 - RNA, 19 nt, Homo sapiens
ggacguccacagaaagaau

SEQ ID NO: 115972 - RNA, 19 nt, Homo sapiens
gaugucaccuggauaaccu

SEQ ID NO: 115973 - RNA, 19 nt, Homo sapiens
cuucagcaaguguuucuua

SEQ ID NO: 115974 - RNA, 19 nt, Homo sapiens
augaugcugugaaccuuua

SEQ ID NO: 115975 - RNA, 19 nt, Homo sapiens
guccgcaucuugaauugga

SEQ ID NO: 115976 - RNA, 19 nt, Homo sapiens
ucaccuggauaaccuguca

SEQ ID NO: 115977 - RNA, 19 nt, Homo sapiens
ggagauccgguguccuuau

SEQ ID NO: 115978 - RNA, 19 nt, Homo sapiens
ucaaagaggauuucaacag

SEQ ID NO: 115979 - RNA, 19 nt, Homo sapiens
caugaaggagucacauuug

SEQ ID NO: 115980 - RNA, 19 nt, Homo sapiens
ggaacuguuuucuugauga

SEQ ID NO: 115981 - RNA, 19 nt, Homo sapiens
ccauugaauuugaucaucu

SEQ ID NO: 115982 - RNA, 19 nt, Homo sapiens
gacguccacagaaagaaua

SEQ ID NO: 115983 - RNA, 19 nt, Homo sapiens
guacauacgaaacucaaag

SEQ ID NO: 115984 - RNA, 19 nt, Homo sapiens
gagaagcggcgauguuugc

SEQ ID NO: 115985 - RNA, 19 nt, Homo sapiens
gaugaugcugugaaccuuu

SEQ ID NO: 115986 - RNA, 19 nt, Homo sapiens
cagaaacugcuuuauccaa

SEQ ID NO: 115987 - RNA, 19 nt, Homo sapiens
augaaggagucacauuuga

SEQ ID NO: 115988 - RNA, 19 nt, Homo sapiens
gaucaucugggaggaauuc

SEQ ID NO: 115989 - RNA, 19 nt, Homo sapiens
cauacgaaacucaaagaga

SEQ ID NO: 115990 - RNA, 19 nt, Homo sapiens
ccgagaagcggcgauguuu

SEQ ID NO: 115991 - RNA, 19 nt, Homo sapiens
caaugcggauuuaaugaac

SEQ ID NO: 115992 - RNA, 19 nt, Homo sapiens
acaaugcggauuuaaugaa

SEQ ID NO: 115993 - RNA, 19 nt, Homo sapiens
ucacgugaauacuagucaa

SEQ ID NO: 115994 - RNA, 19 nt, Homo sapiens
ccuguaaucccagcacuuu

SEQ ID NO: 115995 - RNA, 19 nt, Homo sapiens
cccagaggguguaggaaug

SEQ ID NO: 115996 - RNA, 19 nt, Homo sapiens
ggaauucaccccagaggaa

SEQ ID NO: 115997 - RNA, 19 nt, Homo sapiens
gacguccgcaucuugaauu

SEQ ID NO: 115998 - RNA, 19 nt, Homo sapiens
agauacaacuuuccaagcu

SEQ ID NO: 115999 - RNA, 19 nt, Homo sapiens
gauuaauguuucuggugau

SEQ ID NO: 116000 - RNA, 19 nt, Homo sapiens
gaaacagcccaggaccuau

SEQ ID NO: 116001 - RNA, 19 nt, Homo sapiens
aacagaaacugcuuuaucc

SEQ ID NO: 116002 - RNA, 19 nt, Homo sapiens
caaccuucagcaaguguuu

SEQ ID NO: 116003 - RNA, 19 nt, Homo sapiens
aaucggaucugcgaacagu

SEQ ID NO: 116004 - RNA, 19 nt, Homo sapiens
gacaagccuucugcucugu

SEQ ID NO: 116005 - RNA, 19 nt, Homo sapiens
ccuaucagaagcugucgua

SEQ ID NO: 116006 - RNA, 19 nt, Homo sapiens
gaaccagccgagaaauugg

SEQ ID NO: 116007 - RNA, 19 nt, Homo sapiens
cggcgauguuugcguagaa

SEQ ID NO: 116008 - RNA, 19 nt, Homo sapiens
guggaacccaggcucagua

SEQ ID NO: 116009 - RNA, 19 nt, Homo sapiens
gaaaccccaucuggacuaa

SEQ ID NO: 116010 - RNA, 19 nt, Homo sapiens
gccauugaauuugaucauc

SEQ ID NO: 116011 - RNA, 19 nt, Homo sapiens
ugaagccauugaauuugau

SEQ ID NO: 116012 - RNA, 19 nt, Homo sapiens
ggacacaaagaaaauagaa

SEQ ID NO: 116013 - RNA, 19 nt, Homo sapiens
ugggaugucaccuggauaa

SEQ ID NO: 116014 - RNA, 19 nt, Homo sapiens
uaacugacaagaagaacag

SEQ ID NO: 116015 - RNA, 19 nt, Homo sapiens
gcaauuacuuucugguuaa

SEQ ID NO: 116016 - RNA, 19 nt, Homo sapiens
caaagaggauuucaacaga

SEQ ID NO: 116017 - RNA, 19 nt, Homo sapiens
gcaaguguuucuuaacuga

SEQ ID NO: 116018 - RNA, 19 nt, Homo sapiens
ggauuaacgucucgcaauu

SEQ ID NO: 116019 - RNA, 19 nt, Homo sapiens
gagugaagccauugaauuu

SEQ ID NO: 116020 - RNA, 19 nt, Homo sapiens
gagccaagaucgcaccauu

SEQ ID NO: 116021 - RNA, 19 nt, Homo sapiens
ugaaggaaauuaccugaga

SEQ ID NO: 116022 - RNA, 19 nt, Homo sapiens
gagauccgguguccuuauu

SEQ ID NO: 116023 - RNA, 19 nt, Homo sapiens
gaaacugcuuuauccaaau

SEQ ID NO: 116024 - RNA, 19 nt, Homo sapiens
gcaccagccucuagucuca

SEQ ID NO: 116025 - RNA, 19 nt, Homo sapiens
gaucaaagacaaacugaau

SEQ ID NO: 116026 - RNA, 19 nt, Homo sapiens
ggaaacagcccaggaccua

SEQ ID NO: 116027 - RNA, 19 nt, Homo sapiens
ggagugaagccauugaauu

SEQ ID NO: 116028 - RNA, 19 nt, Homo sapiens
auacgaaacucaaagagaa

SEQ ID NO: 116029 - RNA, 19 nt, Homo sapiens
caucuacaaugcggauuua

SEQ ID NO: 116030 - RNA, 19 nt, Homo sapiens
caacagaaacugcuuuauc

SEQ ID NO: 116031 - RNA, 19 nt, Homo sapiens
gcaugaaggagucacauuu

SEQ ID NO: 116032 - RNA, 19 nt, Homo sapiens
cgcaauuacuuucugguua

SEQ ID NO: 116033 - RNA, 19 nt, Homo sapiens
agaaacugcuuuauccaaa

SEQ ID NO: 116034 - RNA, 19 nt, Homo sapiens
gcugugaaccuuuauauca

SEQ ID NO: 116035 - RNA, 19 nt, Homo sapiens
ggaaccagccgagaaauug

SEQ ID NO: 116036 - RNA, 19 nt, Homo sapiens
cauugaauuugguuccuua

SEQ ID NO: 116037 - RNA, 19 nt, Homo sapiens
gaaaucggaucugcgaaca

SEQ ID NO: 116038 - RNA, 19 nt, Homo sapiens
gauuaacgucucgcaauua

SEQ ID NO: 116039 - RNA, 19 nt, Homo sapiens
gaacccaggcucaguaaca

SEQ ID NO: 116040 - RNA, 19 nt, Homo sapiens
uaauguuucuggugauuug

SEQ ID NO: 116041 - RNA, 19 nt, Homo sapiens
ucaaagacaaacugaauga

SEQ ID NO: 116042 - RNA, 19 nt, Homo sapiens
gaauuucuccuguuucauc

SEQ ID NO: 116043 - RNA, 19 nt, Homo sapiens
aaagaggauuucaacagaa

SEQ ID NO: 116044 - RNA, 19 nt, Homo sapiens
gaagaacagagucguggaa

SEQ ID NO: 116045 - RNA, 19 nt, Homo sapiens
ugucguaccuggacuuuca

SEQ ID NO: 116046 - RNA, 19 nt, Homo sapiens
guaccgcugcucagaauuu

SEQ ID NO: 116047 - RNA, 19 nt, Homo sapiens
ccaauucuuugauucacuu

SEQ ID NO: 116048 - RNA, 19 nt, Homo sapiens
ccgguguccuuauuacaua

SEQ ID NO: 116049 - RNA, 19 nt, Homo sapiens
ccaggacgaugaauuuaag

SEQ ID NO: 116050 - RNA, 19 nt, Homo sapiens
gcagacguccgcaucuuga

SEQ ID NO: 116051 - RNA, 19 nt, Homo sapiens
ggaauggcauggacaucuc

SEQ ID NO: 116052 - RNA, 19 nt, Homo sapiens
uaacggaaccagccgagaa

SEQ ID NO: 116053 - RNA, 19 nt, Homo sapiens
cagcaaguguuucuuaacu

SEQ ID NO: 116054 - RNA, 19 nt, Homo sapiens
gcaggagaauugcuugaac

SEQ ID NO: 116055 - RNA, 19 nt, Homo sapiens
caaacugaaugauaaccau

SEQ ID NO: 116056 - RNA, 19 nt, Homo sapiens
cggaaaaccuacugauuaa

SEQ ID NO: 116057 - RNA, 19 nt, Homo sapiens
uaacgucucgcaauuacuu

SEQ ID NO: 116058 - RNA, 19 nt, Homo sapiens
cccgugacguccaguauuu

SEQ ID NO: 116059 - RNA, 19 nt, Homo sapiens
cuacaaugcggauuuaaug

SEQ ID NO: 116060 - RNA, 19 nt, Homo sapiens
ggcauccaauucuuugauu

SEQ ID NO: 116061 - RNA, 19 nt, Homo sapiens
gaaaggcuaccgcgaagag

SEQ ID NO: 116062 - RNA, 19 nt, Homo sapiens
gaaauuugucugcaugaag

SEQ ID NO: 116063 - RNA, 19 nt, Homo sapiens
gugaagccauugaauuugg

SEQ ID NO: 116064 - RNA, 19 nt, Homo sapiens
gaaaaccuacugauuaaug

SEQ ID NO: 116065 - RNA, 19 nt, Homo sapiens
ggguaccgcugcucagaau

SEQ ID NO: 116066 - RNA, 19 nt, Homo sapiens
gauugcaucucaaaacaaa

SEQ ID NO: 116067 - RNA, 19 nt, Homo sapiens
gaaaauagaacgauucaac

SEQ ID NO: 116068 - RNA, 19 nt, Homo sapiens
gcauccaauucuuugauuc

SEQ ID NO: 116069 - RNA, 19 nt, Homo sapiens
gauccgguguccuuauuac

SEQ ID NO: 116070 - RNA, 19 nt, Homo sapiens
caagccuucugcucuguga

SEQ ID NO: 116071 - RNA, 19 nt, Homo sapiens
cgugaauacuagucaaaga

SEQ ID NO: 116072 - RNA, 19 nt, Homo sapiens
ugaaauuugucugcaugaa

SEQ ID NO: 116073 - RNA, 19 nt, Homo sapiens
ggacguccacagaaagaau

SEQ ID NO: 116074 - RNA, 19 nt, Homo sapiens
gaugucaccuggauaaccu

SEQ ID NO: 116075 - RNA, 19 nt, Homo sapiens
cuucagcaaguguuucuua

SEQ ID NO: 116076 - RNA, 19 nt, Homo sapiens
augaugcugugaaccuuua

SEQ ID NO: 116077 - RNA, 19 nt, Homo sapiens
guccgcaucuugaauugga

SEQ ID NO: 116078 - RNA, 19 nt, Homo sapiens
ucaccuggauaaccuguca

SEQ ID NO: 116079 - RNA, 19 nt, Homo sapiens
ggagauccgguguccuuau

SEQ ID NO: 116080 - RNA, 19 nt, Homo sapiens
ucaaagaggauuucaacag

SEQ ID NO: 116081 - RNA, 19 nt, Homo sapiens
caugaaggagucacauuug

SEQ ID NO: 116082 - RNA, 19 nt, Homo sapiens
ggaacuguuuucuugauga

SEQ ID NO: 116083 - RNA, 19 nt, Homo sapiens
gacguccacagaaagaaua

SEQ ID NO: 116084 - RNA, 19 nt, Homo sapiens
guacauacgaaacucaaag

SEQ ID NO: 116085 - RNA, 19 nt, Homo sapiens
gaugaugcugugaaccuuu

SEQ ID NO: 116086 - RNA, 19 nt, Homo sapiens
cagaaacugcuuuauccaa

SEQ ID NO: 116087 - RNA, 19 nt, Homo sapiens
augaaggagucacauuuga

SEQ ID NO: 116088 - RNA, 19 nt, Homo sapiens
gaucaucugggaggaauuc

SEQ ID NO: 116089 - RNA, 19 nt, Homo sapiens
cauacgaaacucaaagaga

SEQ ID NO: 116090 - RNA, 19 nt, Homo sapiens
caaugcggauuuaaugaac

SEQ ID NO: 116091 - RNA, 19 nt, Homo sapiens
acaaugcggauuuaaugaa

SEQ ID NO: 116092 - RNA, 19 nt, Homo sapiens
ucacgugaauacuagucaa

SEQ ID NO: 116093 - RNA, 19 nt, Homo sapiens
ccuguaaucccagcacuuu

SEQ ID NO: 116094 - RNA, 19 nt, Homo sapiens
cccagaggguguaggaaug

SEQ ID NO: 116095 - RNA, 19 nt, Homo sapiens
ggaauucaccccagaggaa

SEQ ID NO: 116096 - RNA, 19 nt, Homo sapiens
caaccuucagcaaguguuu

SEQ ID NO: 116097 - RNA, 19 nt, Homo sapiens
gacguccgcaucuugaauu

SEQ ID NO: 116098 - RNA, 19 nt, Homo sapiens
agauacaacuuuccaagcu

SEQ ID NO: 116099 - RNA, 19 nt, Homo sapiens
gauuaauguuucuggugau

SEQ ID NO: 116100 - RNA, 19 nt, Homo sapiens
gaaacagcccaggaccuau

SEQ ID NO: 116101 - RNA, 19 nt, Homo sapiens
aacagaaacugcuuuaucc

SEQ ID NO: 116102 - RNA, 19 nt, Homo sapiens
gacaagccuucugcucugu

SEQ ID NO: 116103 - RNA, 19 nt, Homo sapiens
aaucggaucugcgaacagu

SEQ ID NO: 116104 - RNA, 19 nt, Homo sapiens
ccuaucagaagcugucgua

SEQ ID NO: 116105 - RNA, 19 nt, Homo sapiens
gaaccagccgagaaauugg

SEQ ID NO: 116106 - RNA, 19 nt, Homo sapiens
guggaacccaggcucagua

SEQ ID NO: 116107 - RNA, 19 nt, Homo sapiens
gaaaccccaucuggacuaa

SEQ ID NO: 116108 - RNA, 19 nt, Homo sapiens
ugauaaccaugagguggaa

SEQ ID NO: 116109 - RNA, 19 nt, Homo sapiens
acacaaccuucagcaagug

SEQ ID NO: 116110 - RNA, 19 nt, Homo sapiens
uaacugacaagaagaacag

SEQ ID NO: 116111 - RNA, 19 nt, Homo sapiens
ggacacaaagaaaauagaa

SEQ ID NO: 116112 - RNA, 19 nt, Homo sapiens
ugggaugucaccuggauaa

SEQ ID NO: 116113 - RNA, 19 nt, Homo sapiens
agaccagccugcccaacau

SEQ ID NO: 116114 - RNA, 19 nt, Homo sapiens
gaugcugugaaccuuuaua

SEQ ID NO: 116115 - RNA, 19 nt, Homo sapiens
gcaauuacuuucugguuaa

SEQ ID NO: 116116 - RNA, 19 nt, Homo sapiens
caaagaggauuucaacaga

SEQ ID NO: 116117 - RNA, 19 nt, Homo sapiens
gcaaguguuucuuaacuga

SEQ ID NO: 116118 - RNA, 19 nt, Homo sapiens
ggauuaacgucucgcaauu

SEQ ID NO: 116119 - RNA, 19 nt, Homo sapiens
gcucuucccuucucucuga

SEQ ID NO: 116120 - RNA, 19 nt, Homo sapiens
gagccaagaucgcaccauu

SEQ ID NO: 116121 - RNA, 19 nt, Homo sapiens
ugaaggaaauuaccugaga

SEQ ID NO: 116122 - RNA, 19 nt, Homo sapiens
gagauccgguguccuuauu

SEQ ID NO: 116123 - RNA, 19 nt, Homo sapiens
gaaacugcuuuauccaaau

SEQ ID NO: 116124 - RNA, 19 nt, Homo sapiens
gcaccagccucuagucuca

SEQ ID NO: 116125 - RNA, 19 nt, Homo sapiens
gaucaaagacaaacugaau

SEQ ID NO: 116126 - RNA, 19 nt, Homo sapiens
ggaaacagcccaggaccua

SEQ ID NO: 116127 - RNA, 19 nt, Homo sapiens
auacgaaacucaaagagaa

SEQ ID NO: 116128 - RNA, 19 nt, Homo sapiens
caucuacaaugcggauuua

SEQ ID NO: 116129 - RNA, 19 nt, Homo sapiens
caacagaaacugcuuuauc

SEQ ID NO: 116130 - RNA, 19 nt, Homo sapiens
gcaugaaggagucacauuu

SEQ ID NO: 116131 - RNA, 19 nt, Homo sapiens
cgcaauuacuuucugguua

SEQ ID NO: 116132 - RNA, 19 nt, Homo sapiens
agaaacugcuuuauccaaa

SEQ ID NO: 116133 - RNA, 19 nt, Homo sapiens
gcugugaaccuuuauauca

SEQ ID NO: 116134 - RNA, 19 nt, Homo sapiens
ggaaccagccgagaaauug

SEQ ID NO: 116135 - RNA, 19 nt, Homo sapiens
guccucggcuuccucuuua

SEQ ID NO: 116136 - RNA, 19 nt, Homo sapiens
gaaaucggaucugcgaaca

SEQ ID NO: 116137 - RNA, 19 nt, Homo sapiens
gauuaacgucucgcaauua

SEQ ID NO: 116138 - RNA, 19 nt, Homo sapiens
gaacccaggcucaguaaca

SEQ ID NO: 116139 - RNA, 19 nt, Homo sapiens
ucaaagacaaacugaauga

SEQ ID NO: 116140 - RNA, 19 nt, Homo sapiens
gaauuucuccuguuucauc

SEQ ID NO: 116141 - RNA, 19 nt, Homo sapiens
aaagaggauuucaacagaa

SEQ ID NO: 116142 - RNA, 19 nt, Homo sapiens
gaagaacagagucguggaa

SEQ ID NO: 116143 - RNA, 19 nt, Homo sapiens
ugucguaccuggacuuuca

SEQ ID NO: 116144 - RNA, 19 nt, Homo sapiens
guaccgcugcucagaauuu

SEQ ID NO: 116145 - RNA, 19 nt, Homo sapiens
ccaauucuuugauucacuu

SEQ ID NO: 116146 - RNA, 19 nt, Homo sapiens
ccgguguccuuauuacaua

SEQ ID NO: 116147 - RNA, 19 nt, Homo sapiens
ccaggacgaugaauuuaag

SEQ ID NO: 116148 - RNA, 19 nt, Homo sapiens
ggaauggcauggacaucuc

SEQ ID NO: 116149 - RNA, 19 nt, Homo sapiens
uaacggaaccagccgagaa

SEQ ID NO: 116150 - RNA, 19 nt, Homo sapiens
cagcaaguguuucuuaacu

SEQ ID NO: 116151 - RNA, 19 nt, Homo sapiens
gcaggagaauugcuugaac

SEQ ID NO: 116152 - RNA, 19 nt, Homo sapiens
caaacugaaugauaaccau

SEQ ID NO: 116153 - RNA, 19 nt, Homo sapiens
uaacgucucgcaauuacuu

SEQ ID NO: 116154 - RNA, 19 nt, Homo sapiens
cccgugacguccaguauuu

SEQ ID NO: 116155 - RNA, 19 nt, Homo sapiens
cuacaaugcggauuuaaug

SEQ ID NO: 116156 - RNA, 19 nt, Homo sapiens
ggcauccaauucuuugauu

SEQ ID NO: 116157 - RNA, 19 nt, Homo sapiens
gaaaggcuaccgcgaagag

SEQ ID NO: 116158 - RNA, 19 nt, Homo sapiens
gaaauuugucugcaugaag

SEQ ID NO: 116159 - RNA, 19 nt, Homo sapiens
gaaccucggcucuguguac

SEQ ID NO: 116160 - RNA, 19 nt, Homo sapiens
ggguaccgcugcucagaau

SEQ ID NO: 116161 - RNA, 19 nt, Homo sapiens
gauugcaucucaaaacaaa

SEQ ID NO: 116162 - RNA, 19 nt, Homo sapiens
gaaaauagaacgauucaac

SEQ ID NO: 116163 - RNA, 19 nt, Homo sapiens
caagccuucugcucuguga

SEQ ID NO: 116164 - RNA, 19 nt, Homo sapiens
gcauccaauucuuugauuc

SEQ ID NO: 116165 - RNA, 19 nt, Homo sapiens
gauccgguguccuuauuac

SEQ ID NO: 116166 - RNA, 19 nt, Homo sapiens
cgugaauacuagucaaaga

SEQ ID NO: 116167 - RNA, 19 nt, Homo sapiens
ugaaauuugucugcaugaa

SEQ ID NO: 116168 - RNA, 19 nt, Homo sapiens
ucggcucuguguacauuua

SEQ ID NO: 116169 - RNA, 19 nt, Homo sapiens
gcagguggaaggagaggaa

SEQ ID NO: 116170 - RNA, 19 nt, Homo sapiens
ccucggcucuguguacauu

SEQ ID NO: 116171 - RNA, 19 nt, Homo sapiens
ggacguccacagaaagaau

SEQ ID NO: 116172 - RNA, 19 nt, Homo sapiens
gaugucaccuggauaaccu

SEQ ID NO: 116173 - RNA, 19 nt, Homo sapiens
cuucagcaaguguuucuua

SEQ ID NO: 116174 - RNA, 19 nt, Homo sapiens
augaugcugugaaccuuua

SEQ ID NO: 116175 - RNA, 19 nt, Homo sapiens
ucaccuggauaaccuguca

SEQ ID NO: 116176 - RNA, 19 nt, Homo sapiens
ggagauccgguguccuuau

SEQ ID NO: 116177 - RNA, 19 nt, Homo sapiens
ucaaagaggauuucaacag

SEQ ID NO: 116178 - RNA, 19 nt, Homo sapiens
caugaaggagucacauuug

SEQ ID NO: 116179 - RNA, 19 nt, Homo sapiens
ggaacuguuuucuugauga

SEQ ID NO: 116180 - RNA, 19 nt, Homo sapiens
gagaagcggcgauguuugc

SEQ ID NO: 116181 - RNA, 19 nt, Homo sapiens
gacguccacagaaagaaua

SEQ ID NO: 116182 - RNA, 19 nt, Homo sapiens
guacauacgaaacucaaag

SEQ ID NO: 116183 - RNA, 19 nt, Homo sapiens
gaugaugcugugaaccuuu

SEQ ID NO: 116184 - RNA, 19 nt, Homo sapiens
cagaaacugcuuuauccaa

SEQ ID NO: 116185 - RNA, 19 nt, Homo sapiens
augaaggagucacauuuga

SEQ ID NO: 116186 - RNA, 19 nt, Homo sapiens
gaucaucugggaggaauuc

SEQ ID NO: 116187 - RNA, 19 nt, Homo sapiens
ccgagaagcggcgauguuu

SEQ ID NO: 116188 - RNA, 19 nt, Homo sapiens
cauacgaaacucaaagaga

SEQ ID NO: 116189 - RNA, 19 nt, Homo sapiens
caaugcggauuuaaugaac

SEQ ID NO: 116190 - RNA, 19 nt, Homo sapiens
acaaugcggauuuaaugaa

SEQ ID NO: 116191 - RNA, 19 nt, Homo sapiens
ucacgugaauacuagucaa

SEQ ID NO: 116192 - RNA, 19 nt, Homo sapiens
ccuguaaucccagcacuuu

SEQ ID NO: 116193 - RNA, 19 nt, Homo sapiens
cccagaggguguaggaaug

SEQ ID NO: 116194 - RNA, 19 nt, Homo sapiens
ggaauucaccccagaggaa

SEQ ID NO: 116195 - RNA, 19 nt, Homo sapiens
gaaacagcccaggaccuau

SEQ ID NO: 116196 - RNA, 19 nt, Homo sapiens
aacagaaacugcuuuaucc

SEQ ID NO: 116197 - RNA, 19 nt, Homo sapiens
caaccuucagcaaguguuu

SEQ ID NO: 116198 - RNA, 19 nt, Homo sapiens
gacaagccuucugcucugu

SEQ ID NO: 116199 - RNA, 19 nt, Homo sapiens
ccuaucagaagcugucgua

SEQ ID NO: 116200 - RNA, 19 nt, Homo sapiens
gaaccagccgagaaauugg

SEQ ID NO: 116201 - RNA, 19 nt, Homo sapiens
cggcgauguuugcguagaa

SEQ ID NO: 116202 - RNA, 19 nt, Homo sapiens
aaucggaucugcgaacagu

SEQ ID NO: 116203 - RNA, 19 nt, Homo sapiens
guggaacccaggcucagua

SEQ ID NO: 116204 - RNA, 19 nt, Homo sapiens
gaaaccccaucuggacuaa

SEQ ID NO: 116205 - RNA, 19 nt, Homo sapiens
ugauaaccaugagguggaa

SEQ ID NO: 116206 - RNA, 19 nt, Homo sapiens
ggacacaaagaaaauagaa

SEQ ID NO: 116207 - RNA, 19 nt, Homo sapiens
ugggaugucaccuggauaa

SEQ ID NO: 116208 - RNA, 19 nt, Homo sapiens
uaacugacaagaagaacag

SEQ ID NO: 116209 - RNA, 19 nt, Homo sapiens
acacaaccuucagcaagug

SEQ ID NO: 116210 - RNA, 19 nt, Homo sapiens
agaccagccugcccaacau

SEQ ID NO: 116211 - RNA, 19 nt, Homo sapiens
aagcugggacugccaagaa

SEQ ID NO: 116212 - RNA, 19 nt, Homo sapiens
gaugcugugaaccuuuaua

SEQ ID NO: 116213 - RNA, 19 nt, Homo sapiens
uuccacagaucaaagacaa

SEQ ID NO: 116214 - RNA, 19 nt, Homo sapiens
gcccaggaccuaucagaag

SEQ ID NO: 116215 - RNA, 19 nt, Homo sapiens
gcaauuacuuucugguuaa

SEQ ID NO: 116216 - RNA, 19 nt, Homo sapiens
caaagaggauuucaacaga

SEQ ID NO: 116217 - RNA, 19 nt, Homo sapiens
gcaaguguuucuuaacuga

SEQ ID NO: 116218 - RNA, 19 nt, Homo sapiens
ggauuaacgucucgcaauu

SEQ ID NO: 116219 - RNA, 19 nt, Homo sapiens
gcucuucccuucucucuga

SEQ ID NO: 116220 - RNA, 19 nt, Homo sapiens
gagccaagaucgcaccauu

SEQ ID NO: 116221 - RNA, 19 nt, Homo sapiens
ugaaggaaauuaccugaga

SEQ ID NO: 116222 - RNA, 19 nt, Homo sapiens
gagauccgguguccuuauu

SEQ ID NO: 116223 - RNA, 19 nt, Homo sapiens
gaaacugcuuuauccaaau

SEQ ID NO: 116224 - RNA, 19 nt, Homo sapiens
gcaccagccucuagucuca

SEQ ID NO: 116225 - RNA, 19 nt, Homo sapiens
gaucaaagacaaacugaau

SEQ ID NO: 116226 - RNA, 19 nt, Homo sapiens
auacgaaacucaaagagaa

SEQ ID NO: 116227 - RNA, 19 nt, Homo sapiens
caucuacaaugcggauuua

SEQ ID NO: 116228 - RNA, 19 nt, Homo sapiens
caacagaaacugcuuuauc

SEQ ID NO: 116229 - RNA, 19 nt, Homo sapiens
gcaugaaggagucacauuu

SEQ ID NO: 116230 - RNA, 19 nt, Homo sapiens
cgcaauuacuuucugguua

SEQ ID NO: 116231 - RNA, 19 nt, Homo sapiens
agaaacugcuuuauccaaa

SEQ ID NO: 116232 - RNA, 19 nt, Homo sapiens
gcugugaaccuuuauauca

SEQ ID NO: 116233 - RNA, 19 nt, Homo sapiens
ggaaccagccgagaaauug

SEQ ID NO: 116234 - RNA, 19 nt, Homo sapiens
gaaaucggaucugcgaaca

SEQ ID NO: 116235 - RNA, 19 nt, Homo sapiens
gauuaacgucucgcaauua

SEQ ID NO: 116236 - RNA, 19 nt, Homo sapiens
gaacccaggcucaguaaca

SEQ ID NO: 116237 - RNA, 19 nt, Homo sapiens
ucaaagacaaacugaauga

SEQ ID NO: 116238 - RNA, 19 nt, Homo sapiens
gaauuucuccuguuucauc

SEQ ID NO: 116239 - RNA, 19 nt, Homo sapiens
aaagaggauuucaacagaa

SEQ ID NO: 116240 - RNA, 19 nt, Homo sapiens
gaagaacagagucguggaa

SEQ ID NO: 116241 - RNA, 19 nt, Homo sapiens
guaccgcugcucagaauuu

SEQ ID NO: 116242 - RNA, 19 nt, Homo sapiens
ccaauucuuugauucacuu

SEQ ID NO: 116243 - RNA, 19 nt, Homo sapiens
ccgguguccuuauuacaua

SEQ ID NO: 116244 - RNA, 19 nt, Homo sapiens
ccaggacgaugaauuuaag

SEQ ID NO: 116245 - RNA, 19 nt, Homo sapiens
ggaauggcauggacaucuc

SEQ ID NO: 116246 - RNA, 19 nt, Homo sapiens
uaacggaaccagccgagaa

SEQ ID NO: 116247 - RNA, 19 nt, Homo sapiens
cagcaaguguuucuuaacu

SEQ ID NO: 116248 - RNA, 19 nt, Homo sapiens
gcaggagaauugcuugaac

SEQ ID NO: 116249 - RNA, 19 nt, Homo sapiens
caaacugaaugauaaccau

SEQ ID NO: 116250 - RNA, 19 nt, Homo sapiens
uaacgucucgcaauuacuu

SEQ ID NO: 116251 - RNA, 19 nt, Homo sapiens
cccgugacguccaguauuu

SEQ ID NO: 116252 - RNA, 19 nt, Homo sapiens
cuacaaugcggauuuaaug

SEQ ID NO: 116253 - RNA, 19 nt, Homo sapiens
ggcauccaauucuuugauu

SEQ ID NO: 116254 - RNA, 19 nt, Homo sapiens
gaaaggcuaccgcgaagag

SEQ ID NO: 116255 - RNA, 19 nt, Homo sapiens
gaaauuugucugcaugaag

SEQ ID NO: 116256 - RNA, 19 nt, Homo sapiens
ggguaccgcugcucagaau

SEQ ID NO: 116257 - RNA, 19 nt, Homo sapiens
gauugcaucucaaaacaaa

SEQ ID NO: 116258 - RNA, 19 nt, Homo sapiens
gcauccaauucuuugauuc

SEQ ID NO: 116259 - RNA, 19 nt, Homo sapiens
gauccgguguccuuauuac

SEQ ID NO: 116260 - RNA, 19 nt, Homo sapiens
cgugaauacuagucaaaga

SEQ ID NO: 116261 - RNA, 19 nt, Homo sapiens
ugaaauuugucugcaugaa

SEQ ID NO: 116262 - RNA, 19 nt, Homo sapiens
caagccuucugcucuguga

SEQ ID NO: 116263 - RNA, 19 nt, Homo sapiens
gcagguggaaggagaggaa

SEQ ID NO: 116264 - RNA, 19 nt, Homo sapiens
gaugucaccuggauaaccu

SEQ ID NO: 116265 - RNA, 19 nt, Homo sapiens
cuucagcaaguguuucuua

SEQ ID NO: 116266 - RNA, 19 nt, Homo sapiens
augaugcugugaaccuuua

SEQ ID NO: 116267 - RNA, 19 nt, Homo sapiens
ucaccuggauaaccuguca

SEQ ID NO: 116268 - RNA, 19 nt, Homo sapiens
ggagauccgguguccuuau

SEQ ID NO: 116269 - RNA, 19 nt, Homo sapiens
ucaaagaggauuucaacag

SEQ ID NO: 116270 - RNA, 19 nt, Homo sapiens
caugaaggagucacauuug

SEQ ID NO: 116271 - RNA, 19 nt, Homo sapiens
ggaacuguuuucuugauga

SEQ ID NO: 116272 - RNA, 19 nt, Homo sapiens
guacauacgaaacucaaag

SEQ ID NO: 116273 - RNA, 19 nt, Homo sapiens
gagaagcggcgauguuugc

SEQ ID NO: 116274 - RNA, 19 nt, Homo sapiens
gaugaugcugugaaccuuu

SEQ ID NO: 116275 - RNA, 19 nt, Homo sapiens
cagaaacugcuuuauccaa

SEQ ID NO: 116276 - RNA, 19 nt, Homo sapiens
augaaggagucacauuuga

SEQ ID NO: 116277 - RNA, 19 nt, Homo sapiens
gaucaucugggaggaauuc

SEQ ID NO: 116278 - RNA, 19 nt, Homo sapiens
ccgagaagcggcgauguuu

SEQ ID NO: 116279 - RNA, 19 nt, Homo sapiens
cauacgaaacucaaagaga

SEQ ID NO: 116280 - RNA, 19 nt, Homo sapiens
caaugcggauuuaaugaac

SEQ ID NO: 116281 - RNA, 19 nt, Homo sapiens
acaaugcggauuuaaugaa

SEQ ID NO: 116282 - RNA, 19 nt, Homo sapiens
ucacgugaauacuagucaa

SEQ ID NO: 116283 - RNA, 19 nt, Homo sapiens
ccuguaaucccagcacuuu

SEQ ID NO: 116284 - RNA, 19 nt, Homo sapiens
cccagaggguguaggaaug

SEQ ID NO: 116285 - RNA, 19 nt, Homo sapiens
ggaauucaccccagaggaa

SEQ ID NO: 116286 - RNA, 19 nt, Homo sapiens
aacagaaacugcuuuaucc

SEQ ID NO: 116287 - RNA, 19 nt, Homo sapiens
caaccuucagcaaguguuu

SEQ ID NO: 116288 - RNA, 19 nt, Homo sapiens
aaucggaucugcgaacagu

SEQ ID NO: 116289 - RNA, 19 nt, Homo sapiens
gaaccagccgagaaauugg

SEQ ID NO: 116290 - RNA, 19 nt, Homo sapiens
cggcgauguuugcguagaa

SEQ ID NO: 116291 - RNA, 19 nt, Homo sapiens
gacaagccuucugcucugu

SEQ ID NO: 116292 - RNA, 19 nt, Homo sapiens
guggaacccaggcucagua

SEQ ID NO: 116293 - RNA, 19 nt, Homo sapiens
gaaaccccaucuggacuaa

SEQ ID NO: 116294 - RNA, 19 nt, Homo sapiens
ugauaaccaugagguggaa

SEQ ID NO: 116295 - RNA, 19 nt, Homo sapiens
ugggaugucaccuggauaa

SEQ ID NO: 116296 - RNA, 19 nt, Homo sapiens
uaacugacaagaagaacag

SEQ ID NO: 116297 - RNA, 19 nt, Homo sapiens
acacaaccuucagcaagug

SEQ ID NO: 116298 - RNA, 19 nt, Homo sapiens
agaccagccugcccaacau

SEQ ID NO: 116299 - RNA, 19 nt, Homo sapiens
gaugcugugaaccuuuaua

SEQ ID NO: 116300 - RNA, 19 nt, Homo sapiens
uuccacagaucaaagacaa

SEQ ID NO: 116301 - RNA, 19 nt, Homo sapiens
aacacaaccuucagcaagu

SEQ ID NO: 116302 - RNA, 19 nt, Homo sapiens
aagcugggacugccaagaa

SEQ ID NO: 116303 - RNA, 19 nt, Homo sapiens
acuccaggacgaugaauuu

SEQ ID NO: 116304 - RNA, 19 nt, Homo sapiens
gaacuguuuucuugaugau

SEQ ID NO: 116305 - RNA, 19 nt, Homo sapiens
cggaaccagccgagaaauu

SEQ ID NO: 116306 - RNA, 19 nt, Homo sapiens
gcucaguaacaacgaaugu

SEQ ID NO: 116307 - RNA, 19 nt, Homo sapiens
uucagcaaguguuucuuaa

SEQ ID NO: 116308 - RNA, 19 nt, Homo sapiens
cauccaauucuuugauuca

SEQ ID NO: 116309 - RNA, 19 nt, Homo sapiens
gaggguaccgcugcucaga

SEQ ID NO: 116310 - RNA, 19 nt, Homo sapiens
caagaaaacacaaccuuca

SEQ ID NO: 116311 - RNA, 19 nt, Homo sapiens
ggcugaggcaggagaauug

SEQ ID NO: 116312 - RNA, 19 nt, Homo sapiens
ggaaaggcuaccgcgaaga

SEQ ID NO: 116313 - RNA, 19 nt, Homo sapiens
cagaucaaagacaaacuga

SEQ ID NO: 116314 - RNA, 19 nt, Homo sapiens
gggagauccgguguccuua

SEQ ID NO: 116315 - RNA, 19 nt, Homo sapiens
gaaacaggcuuccagcuuu

SEQ ID NO: 116316 - RNA, 19 nt, Homo sapiens
acacauagaccacacauuu

SEQ ID NO: 116317 - RNA, 19 nt, Homo sapiens
uguagguucugcauuauua

SEQ ID NO: 116318 - RNA, 19 nt, Homo sapiens
cagguuaacuuauuuguag

SEQ ID NO: 116319 - RNA, 19 nt, Homo sapiens
gcagagaaacacauaaaga

SEQ ID NO: 116320 - RNA, 19 nt, Homo sapiens
gaaccuggagugcuucuuu

SEQ ID NO: 116321 - RNA, 19 nt, Homo sapiens
acacguacaugcacacauu

SEQ ID NO: 116322 - RNA, 19 nt, Homo sapiens
ucacugacguugacuacuu

SEQ ID NO: 116323 - RNA, 19 nt, Homo sapiens
gccaauacaucgucucugu

SEQ ID NO: 116324 - RNA, 19 nt, Homo sapiens
gaaagugggaggagaagau

SEQ ID NO: 116325 - RNA, 19 nt, Homo sapiens
ccucagaucuacccacaga

SEQ ID NO: 116326 - RNA, 19 nt, Homo sapiens
auaaagagcucagugaaca

SEQ ID NO: 116327 - RNA, 19 nt, Homo sapiens
ggaguggccucugguuaug

SEQ ID NO: 116328 - RNA, 19 nt, Homo sapiens
gguguucccuguaggauuc

SEQ ID NO: 116329 - RNA, 19 nt, Homo sapiens
gcagaaagugggaggagaa

SEQ ID NO: 116330 - RNA, 19 nt, Homo sapiens
gggcagagaaacacauaaa

SEQ ID NO: 116331 - RNA, 19 nt, Homo sapiens
aaacaggcuuccagcuuug

SEQ ID NO: 116332 - RNA, 19 nt, Homo sapiens
gguacaggcugcgcagaaa

SEQ ID NO: 116333 - RNA, 19 nt, Homo sapiens
auuuguagguucugcauua

SEQ ID NO: 116334 - RNA, 19 nt, Homo sapiens
gcagccuccugucaaggua

SEQ ID NO: 116335 - RNA, 19 nt, Homo sapiens
gaacgggagcgcagagcuu

SEQ ID NO: 116336 - RNA, 19 nt, Homo sapiens
gagggcagagaaacacaua

SEQ ID NO: 116337 - RNA, 19 nt, Homo sapiens
ccugugaccucagugauga

SEQ ID NO: 116338 - RNA, 19 nt, Homo sapiens
ccacacaccugagaaacag

SEQ ID NO: 116339 - RNA, 19 nt, Homo sapiens
caauacaucgucucuguuc

SEQ ID NO: 116340 - RNA, 19 nt, Homo sapiens
ugucaccucucaccauaga

SEQ ID NO: 116341 - RNA, 19 nt, Homo sapiens
gucauucccugccagaguu

SEQ ID NO: 116342 - RNA, 19 nt, Homo sapiens
acauagaccacacauuuga

SEQ ID NO: 116343 - RNA, 19 nt, Homo sapiens
ugaccucagugaugacaug

SEQ ID NO: 116344 - RNA, 19 nt, Homo sapiens
ccucagucauuucugcaaa

SEQ ID NO: 116345 - RNA, 19 nt, Homo sapiens
gcaccgaccaggaccacuu

SEQ ID NO: 116346 - RNA, 19 nt, Homo sapiens
cuagaggccugggaaagga

SEQ ID NO: 116347 - RNA, 19 nt, Homo sapiens
ucauucagcucuucaaagc

SEQ ID NO: 116348 - RNA, 19 nt, Homo sapiens
ggucuccuuuggccuauuc

SEQ ID NO: 116349 - RNA, 19 nt, Homo sapiens
gaacacauagaccacacau

SEQ ID NO: 116350 - RNA, 19 nt, Homo sapiens
cagagaaacacauaaagag

SEQ ID NO: 116351 - RNA, 19 nt, Homo sapiens
agaaacaggcuuccagcuu

SEQ ID NO: 116352 - RNA, 19 nt, Homo sapiens
gcaugucggccuucacuag

SEQ ID NO: 116353 - RNA, 19 nt, Homo sapiens
agagccaccuguuccagaa

SEQ ID NO: 116354 - RNA, 19 nt, Homo sapiens
acacacacacacacacgua

SEQ ID NO: 116355 - RNA, 19 nt, Homo sapiens
gcagcaagugggcgacuau

SEQ ID NO: 116356 - RNA, 19 nt, Homo sapiens
caaaagcccuguccugaac

SEQ ID NO: 116357 - RNA, 19 nt, Homo sapiens
cauuugagauccaguacag

SEQ ID NO: 116358 - RNA, 19 nt, Homo sapiens
ggccagcucggucuccuuu

SEQ ID NO: 116359 - RNA, 19 nt, Homo sapiens
caggggaucuggaguuuga

SEQ ID NO: 116360 - RNA, 19 nt, Homo sapiens
gaaccuagaccaggcuuuu

SEQ ID NO: 116361 - RNA, 19 nt, Homo sapiens
gagauccaguacaggaaag

SEQ ID NO: 116362 - RNA, 19 nt, Homo sapiens
gcgcugggaaacaaugaaa

SEQ ID NO: 116363 - RNA, 19 nt, Homo sapiens
caaggagggcagagaaaca

SEQ ID NO: 116364 - RNA, 19 nt, Homo sapiens
caaguggagcccagagguu

SEQ ID NO: 116365 - RNA, 19 nt, Homo sapiens
cccaggagaugugucauuc

SEQ ID NO: 116366 - RNA, 19 nt, Homo sapiens
ccaaggauggagacagcua

SEQ ID NO: 116367 - RNA, 19 nt, Homo sapiens
ucacacagacacacacaca

SEQ ID NO: 116368 - RNA, 19 nt, Homo sapiens
ugacguugacuacuucuca

SEQ ID NO: 116369 - RNA, 19 nt, Homo sapiens
cagcaagagccaccuguuc

SEQ ID NO: 116370 - RNA, 19 nt, Homo sapiens
aaugcgauacgaacacaua

SEQ ID NO: 116371 - RNA, 19 nt, Homo sapiens
cacauaaagagcucaguga

SEQ ID NO: 116372 - RNA, 19 nt, Homo sapiens
aguuugagguggucuacaa

SEQ ID NO: 116373 - RNA, 19 nt, Homo sapiens
agaccgagacccuccagaa

SEQ ID NO: 116374 - RNA, 19 nt, Homo sapiens
acacauuugagauccagua

SEQ ID NO: 116375 - RNA, 19 nt, Homo sapiens
ccagcucggucuccuuugg

SEQ ID NO: 116376 - RNA, 19 nt, Homo sapiens
cccuugaccuucagcaaau

SEQ ID NO: 116377 - RNA, 19 nt, Homo sapiens
gacuccagcugccucagau

SEQ ID NO: 116378 - RNA, 19 nt, Homo sapiens
cacauagaccacacauuug

SEQ ID NO: 116379 - RNA, 19 nt, Homo sapiens
ccugggaggugaggaagga

SEQ ID NO: 116380 - RNA, 19 nt, Homo sapiens
gcccaggagaugugucauu

SEQ ID NO: 116381 - RNA, 19 nt, Homo sapiens
gcaagagccaccuguucca

SEQ ID NO: 116382 - RNA, 19 nt, Homo sapiens
ugagauccaguacaggaaa

SEQ ID NO: 116383 - RNA, 19 nt, Homo sapiens
guccugagaucaagaaccu

SEQ ID NO: 116384 - RNA, 19 nt, Homo sapiens
uggaguggccucugguuau

SEQ ID NO: 116385 - RNA, 19 nt, Homo sapiens
cgacuacaccagccacauc

SEQ ID NO: 116386 - RNA, 19 nt, Homo sapiens
ggguacaggcugcgcagaa

SEQ ID NO: 116387 - RNA, 19 nt, Homo sapiens
ccacguggaaggacagcaa

SEQ ID NO: 116388 - RNA, 19 nt, Homo sapiens
acauaaagagcucagugaa

SEQ ID NO: 116389 - RNA, 19 nt, Homo sapiens
gccaaggagggcagagaaa

SEQ ID NO: 116390 - RNA, 19 nt, Homo sapiens
acacagacacacacacaca

SEQ ID NO: 116391 - RNA, 19 nt, Homo sapiens
ccaauacaucgucucuguu

SEQ ID NO: 116392 - RNA, 19 nt, Homo sapiens
ccuuuggccuauucuacaa

SEQ ID NO: 116393 - RNA, 19 nt, Homo sapiens
cagccauccuccucuccaa

SEQ ID NO: 116394 - RNA, 19 nt, Homo sapiens
gacguugacuacuucucau

SEQ ID NO: 116395 - RNA, 19 nt, Homo sapiens
gcuuccagcuuugacuuca

SEQ ID NO: 116396 - RNA, 19 nt, Homo sapiens
caacgugaccaaggaugga

SEQ ID NO: 116397 - RNA, 19 nt, Homo sapiens
uggagccaguguccuguga

SEQ ID NO: 116398 - RNA, 19 nt, Homo sapiens
aaccuggagugcuucuuug

SEQ ID NO: 116399 - RNA, 19 nt, Homo sapiens
cugcagaccugguauucac

SEQ ID NO: 116400 - RNA, 19 nt, Homo sapiens
ccgcuucuguggcaucuac

SEQ ID NO: 116401 - RNA, 19 nt, Homo sapiens
cggcucaccgucacucuga

SEQ ID NO: 116402 - RNA, 19 nt, Homo sapiens
gcuagaggccugggaaagg

SEQ ID NO: 116403 - RNA, 19 nt, Homo sapiens
ugacuacuucucauuccaa

SEQ ID NO: 116404 - RNA, 19 nt, Homo sapiens
cauaaagagcucagugaac

SEQ ID NO: 116405 - RNA, 19 nt, Homo sapiens
gacuacaccagccacauca

SEQ ID NO: 116406 - RNA, 19 nt, Homo sapiens
agucggugcugccuaugug

SEQ ID NO: 116407 - RNA, 19 nt, Homo sapiens
gcucagugaacauccagau

SEQ ID NO: 116408 - RNA, 19 nt, Homo sapiens
gacaagaaaucccuguuua

SEQ ID NO: 116409 - RNA, 19 nt, Homo sapiens
ggagguagauagguaaaua

SEQ ID NO: 116410 - RNA, 19 nt, Homo sapiens
aaaggaagcuccacuguca

SEQ ID NO: 116411 - RNA, 19 nt, Homo sapiens
gaacaucaccgacgugucu

SEQ ID NO: 116412 - RNA, 19 nt, Homo sapiens
aggagaagcuggugaguga

SEQ ID NO: 116413 - RNA, 19 nt, Homo sapiens
caagaaaucccuguuuaau

SEQ ID NO: 116414 - RNA, 19 nt, Homo sapiens
gcaaugggcacugggauga

SEQ ID NO: 116415 - RNA, 19 nt, Homo sapiens
gcagacaggaggaaucaug

SEQ ID NO: 116416 - RNA, 19 nt, Homo sapiens
gaacuucaggauaauaaag

SEQ ID NO: 116417 - RNA, 19 nt, Homo sapiens
acaagaaaucccuguuuaa

SEQ ID NO: 116418 - RNA, 19 nt, Homo sapiens
agacaagaaaucccuguuu

SEQ ID NO: 116419 - RNA, 19 nt, Homo sapiens
ccacgugggagacaagaaa

SEQ ID NO: 116420 - RNA, 19 nt, Homo sapiens
gagcagacaggaggaauca

SEQ ID NO: 116421 - RNA, 19 nt, Homo sapiens
ccacgagggucaggacugu

SEQ ID NO: 116422 - RNA, 19 nt, Homo sapiens
ccuccacugucacauugua

SEQ ID NO: 116423 - RNA, 19 nt, Homo sapiens
acugggagguagauaggua

SEQ ID NO: 116424 - RNA, 19 nt, Homo sapiens
gcuuagagcaagugaggaa

SEQ ID NO: 116425 - RNA, 19 nt, Homo sapiens
ucccauguauuuaucucua

SEQ ID NO: 116426 - RNA, 19 nt, Homo sapiens
acugucacauuguaacuga

SEQ ID NO: 116427 - RNA, 19 nt, Homo sapiens
gcauuucugaguuucauuc

SEQ ID NO: 116428 - RNA, 19 nt, Homo sapiens
cugggacccuugagaguau

SEQ ID NO: 116429 - RNA, 19 nt, Homo sapiens
ggacugggagguagauagg

SEQ ID NO: 116430 - RNA, 19 nt, Homo sapiens
gauggaagaacugggaaug

SEQ ID NO: 116431 - RNA, 19 nt, Homo sapiens
ggcagcagauggaagaacu

SEQ ID NO: 116432 - RNA, 19 nt, Homo sapiens
gagaagcuggugagugagu

SEQ ID NO: 116433 - RNA, 19 nt, Homo sapiens
gagacaagaaaucccuguu

SEQ ID NO: 116434 - RNA, 19 nt, Homo sapiens
ucccugcauuucugaguuu

SEQ ID NO: 116435 - RNA, 19 nt, Homo sapiens
ggccuucgccucugcuuuc

SEQ ID NO: 116436 - RNA, 19 nt, Homo sapiens
ugaaaggaagcuccacugu

SEQ ID NO: 116437 - RNA, 19 nt, Homo sapiens
ugucaggccugugugugaa

SEQ ID NO: 116438 - RNA, 19 nt, Homo sapiens
guccuucccugcauuucug

SEQ ID NO: 116439 - RNA, 19 nt, Homo sapiens
ccucccaucugcagagcuu

SEQ ID NO: 116440 - RNA, 19 nt, Homo sapiens
ugagugagugugccaccua

SEQ ID NO: 116441 - RNA, 19 nt, Homo sapiens
uagagcaagugaggaagau

SEQ ID NO: 116442 - RNA, 19 nt, Homo sapiens
ggagcagacaggaggaauc

SEQ ID NO: 116443 - RNA, 19 nt, Homo sapiens
ccugggacccuugagagua

SEQ ID NO: 116444 - RNA, 19 nt, Homo sapiens
aaucaugucaggccugugu

SEQ ID NO: 116445 - RNA, 19 nt, Homo sapiens
ucaggacugugacucuuuu

SEQ ID NO: 116446 - RNA, 19 nt, Homo sapiens
gugagugugccaccuacaa

SEQ ID NO: 116447 - RNA, 19 nt, Homo sapiens
gacaagaaaucccuguuua

SEQ ID NO: 116448 - RNA, 19 nt, Homo sapiens
ggagguagauagguaaaua

SEQ ID NO: 116449 - RNA, 19 nt, Homo sapiens
aaaggaagcuccacuguca

SEQ ID NO: 116450 - RNA, 19 nt, Homo sapiens
gaacaucaccgacgugucu

SEQ ID NO: 116451 - RNA, 19 nt, Homo sapiens
caagaaaucccuguuuaau

SEQ ID NO: 116452 - RNA, 19 nt, Homo sapiens
gcaaugggcacugggauga

SEQ ID NO: 116453 - RNA, 19 nt, Homo sapiens
gcagacaggaggaaucaug

SEQ ID NO: 116454 - RNA, 19 nt, Homo sapiens
gaacuucaggauaauaaag

SEQ ID NO: 116455 - RNA, 19 nt, Homo sapiens
acaagaaaucccuguuuaa

SEQ ID NO: 116456 - RNA, 19 nt, Homo sapiens
agacaagaaaucccuguuu

SEQ ID NO: 116457 - RNA, 19 nt, Homo sapiens
ccacgugggagacaagaaa

SEQ ID NO: 116458 - RNA, 19 nt, Homo sapiens
gagcagacaggaggaauca

SEQ ID NO: 116459 - RNA, 19 nt, Homo sapiens
ccacgagggucaggacugu

SEQ ID NO: 116460 - RNA, 19 nt, Homo sapiens
ccuccacugucacauugua

SEQ ID NO: 116461 - RNA, 19 nt, Homo sapiens
acugggagguagauaggua

SEQ ID NO: 116462 - RNA, 19 nt, Homo sapiens
gcuuagagcaagugaggaa

SEQ ID NO: 116463 - RNA, 19 nt, Homo sapiens
ucccauguauuuaucucua

SEQ ID NO: 116464 - RNA, 19 nt, Homo sapiens
acugucacauuguaacuga

SEQ ID NO: 116465 - RNA, 19 nt, Homo sapiens
gcauuucugaguuucauuc

SEQ ID NO: 116466 - RNA, 19 nt, Homo sapiens
cugggacccuugagaguau

SEQ ID NO: 116467 - RNA, 19 nt, Homo sapiens
ggacugggagguagauagg

SEQ ID NO: 116468 - RNA, 19 nt, Homo sapiens
gauggaagaacugggaaug

SEQ ID NO: 116469 - RNA, 19 nt, Homo sapiens
ggcagcagauggaagaacu

SEQ ID NO: 116470 - RNA, 19 nt, Homo sapiens
gagacaagaaaucccuguu

SEQ ID NO: 116471 - RNA, 19 nt, Homo sapiens
ucccugcauuucugaguuu

SEQ ID NO: 116472 - RNA, 19 nt, Homo sapiens
ggccuucgccucugcuuuc

SEQ ID NO: 116473 - RNA, 19 nt, Homo sapiens
ugaaaggaagcuccacugu

SEQ ID NO: 116474 - RNA, 19 nt, Homo sapiens
ugucaggccugugugugaa

SEQ ID NO: 116475 - RNA, 19 nt, Homo sapiens
guccuucccugcauuucug

SEQ ID NO: 116476 - RNA, 19 nt, Homo sapiens
ccucccaucugcagagcuu

SEQ ID NO: 116477 - RNA, 19 nt, Homo sapiens
uagagcaagugaggaagau

SEQ ID NO: 116478 - RNA, 19 nt, Homo sapiens
ggagcagacaggaggaauc

SEQ ID NO: 116479 - RNA, 19 nt, Homo sapiens
ccugggacccuugagagua

SEQ ID NO: 116480 - RNA, 19 nt, Homo sapiens
aaucaugucaggccugugu

SEQ ID NO: 116481 - RNA, 19 nt, Homo sapiens
ucaggacugugacucuuuu

SEQ ID NO: 116482 - RNA, 19 nt, Homo sapiens
gacaagaaaucccuguuua

SEQ ID NO: 116483 - RNA, 19 nt, Homo sapiens
ggagguagauagguaaaua

SEQ ID NO: 116484 - RNA, 19 nt, Homo sapiens
aaaggaagcuccacuguca

SEQ ID NO: 116485 - RNA, 19 nt, Homo sapiens
gaacaucaccgacgugucu

SEQ ID NO: 116486 - RNA, 19 nt, Homo sapiens
caagaaaucccuguuuaau

SEQ ID NO: 116487 - RNA, 19 nt, Homo sapiens
gagggaggcuggugugaca

SEQ ID NO: 116488 - RNA, 19 nt, Homo sapiens
gcaaugggcacugggauga

SEQ ID NO: 116489 - RNA, 19 nt, Homo sapiens
gcagacaggaggaaucaug

SEQ ID NO: 116490 - RNA, 19 nt, Homo sapiens
gaacuucaggauaauaaag

SEQ ID NO: 116491 - RNA, 19 nt, Homo sapiens
acaagaaaucccuguuuaa

SEQ ID NO: 116492 - RNA, 19 nt, Homo sapiens
agacaagaaaucccuguuu

SEQ ID NO: 116493 - RNA, 19 nt, Homo sapiens
ccacgugggagacaagaaa

SEQ ID NO: 116494 - RNA, 19 nt, Homo sapiens
gagcagacaggaggaauca

SEQ ID NO: 116495 - RNA, 19 nt, Homo sapiens
ccacgagggucaggacugu

SEQ ID NO: 116496 - RNA, 19 nt, Homo sapiens
ccuccacugucacauugua

SEQ ID NO: 116497 - RNA, 19 nt, Homo sapiens
gauuaaaggcacccagugu

SEQ ID NO: 116498 - RNA, 19 nt, Homo sapiens
acugggagguagauaggua

SEQ ID NO: 116499 - RNA, 19 nt, Homo sapiens
gcuuagagcaagugaggaa

SEQ ID NO: 116500 - RNA, 19 nt, Homo sapiens
ucccauguauuuaucucua

SEQ ID NO: 116501 - RNA, 19 nt, Homo sapiens
gcugaugggugagugucuu

SEQ ID NO: 116502 - RNA, 19 nt, Homo sapiens
acugucacauuguaacuga

SEQ ID NO: 116503 - RNA, 19 nt, Homo sapiens
gcauuucugaguuucauuc

SEQ ID NO: 116504 - RNA, 19 nt, Homo sapiens
cugggacccuugagaguau

SEQ ID NO: 116505 - RNA, 19 nt, Homo sapiens
ggacugggagguagauagg

SEQ ID NO: 116506 - RNA, 19 nt, Homo sapiens
gauggaagaacugggaaug

SEQ ID NO: 116507 - RNA, 19 nt, Homo sapiens
ggcagcagauggaagaacu

SEQ ID NO: 116508 - RNA, 19 nt, Homo sapiens
auaaaguguuugccuccaa

SEQ ID NO: 116509 - RNA, 19 nt, Homo sapiens
gagacaagaaaucccuguu

SEQ ID NO: 116510 - RNA, 19 nt, Homo sapiens
ucccugcauuucugaguuu

SEQ ID NO: 116511 - RNA, 19 nt, Homo sapiens
ggccuucgccucugcuuuc

SEQ ID NO: 116512 - RNA, 19 nt, Homo sapiens
ugaaaggaagcuccacugu

SEQ ID NO: 116513 - RNA, 19 nt, Homo sapiens
ugucaggccugugugugaa

SEQ ID NO: 116514 - RNA, 19 nt, Homo sapiens
guccuucccugcauuucug

SEQ ID NO: 116515 - RNA, 19 nt, Homo sapiens
ccucccaucugcagagcuu

SEQ ID NO: 116516 - RNA, 19 nt, Homo sapiens
uagagcaagugaggaagau

SEQ ID NO: 116517 - RNA, 19 nt, Homo sapiens
ggagcagacaggaggaauc

SEQ ID NO: 116518 - RNA, 19 nt, Homo sapiens
ccugggacccuugagagua

SEQ ID NO: 116519 - RNA, 19 nt, Homo sapiens
aaucaugucaggccugugu

SEQ ID NO: 116520 - RNA, 19 nt, Homo sapiens
ucaggacugugacucuuuu

SEQ ID NO: 116521 - RNA, 19 nt, Homo sapiens
gcacauaaaucagaagugu

SEQ ID NO: 116522 - RNA, 19 nt, Homo sapiens
gauccaagguuaugugguu

SEQ ID NO: 116523 - RNA, 19 nt, Homo sapiens
gcggacggauccaagguua

SEQ ID NO: 116524 - RNA, 19 nt, Homo sapiens
ggaggacgacugugucuuu

SEQ ID NO: 116525 - RNA, 19 nt, Homo sapiens
caggcgaucugcauacuuu

SEQ ID NO: 116526 - RNA, 19 nt, Homo sapiens
ggccagaggugccaacaug

SEQ ID NO: 116527 - RNA, 19 nt, Homo sapiens
ggaacugccuggcucuguu

SEQ ID NO: 116528 - RNA, 19 nt, Homo sapiens
gcgaucagguccuuuaugg

SEQ ID NO: 116529 - RNA, 19 nt, Homo sapiens
caaccacacucaggccuuu

SEQ ID NO: 116530 - RNA, 19 nt, Homo sapiens
uccuauaacuucaguauug

SEQ ID NO: 116531 - RNA, 19 nt, Homo sapiens
uggaggcccuucaguauga

SEQ ID NO: 116532 - RNA, 19 nt, Homo sapiens
gaacaucaaguuggugcua

SEQ ID NO: 116533 - RNA, 19 nt, Homo sapiens
ggucggagcuacacaucau

SEQ ID NO: 116534 - RNA, 19 nt, Homo sapiens
uccauaagcccaugacuaa

SEQ ID NO: 116535 - RNA, 19 nt, Homo sapiens
ugagcuagcuggagaagag

SEQ ID NO: 116536 - RNA, 19 nt, Homo sapiens
aagguuaugugguuucuug

SEQ ID NO: 116537 - RNA, 19 nt, Homo sapiens
ucccauggauguugugaaa

SEQ ID NO: 116538 - RNA, 19 nt, Homo sapiens
guacaguccucacccugau

SEQ ID NO: 116539 - RNA, 19 nt, Homo sapiens
caaagcuggugaacaucaa

SEQ ID NO: 116540 - RNA, 19 nt, Homo sapiens
ccucagggcuaugugauug

SEQ ID NO: 116541 - RNA, 19 nt, Homo sapiens
cagugcagcuguucuggaa

SEQ ID NO: 116542 - RNA, 19 nt, Homo sapiens
gaaacugcagccugacuug

SEQ ID NO: 116543 - RNA, 19 nt, Homo sapiens
gaggacgacugugucuuug

SEQ ID NO: 116544 - RNA, 19 nt, Homo sapiens
ccagcgaucagguccuuua

SEQ ID NO: 116545 - RNA, 19 nt, Homo sapiens
ggacggauccaagguuaug

SEQ ID NO: 116546 - RNA, 19 nt, Homo sapiens
cagccaggccugcacauaa

SEQ ID NO: 116547 - RNA, 19 nt, Homo sapiens
gaacugccuggcucuguug

SEQ ID NO: 116548 - RNA, 19 nt, Homo sapiens
caucgugacucccuuguac

SEQ ID NO: 116549 - RNA, 19 nt, Homo sapiens
acauaaaucagaaguguga

SEQ ID NO: 116550 - RNA, 19 nt, Homo sapiens
ggcacuaucuccgcuguga

SEQ ID NO: 116551 - RNA, 19 nt, Homo sapiens
gagaacaucaggcccuuuc

SEQ ID NO: 116552 - RNA, 19 nt, Homo sapiens
ugccuacucucaagaaaug

SEQ ID NO: 116553 - RNA, 19 nt, Homo sapiens
cccaccagcuucacucuga

SEQ ID NO: 116554 - RNA, 19 nt, Homo sapiens
caaccucuccugccucaug

SEQ ID NO: 116555 - RNA, 19 nt, Homo sapiens
ucggaaaggugaaguaacu

SEQ ID NO: 116556 - RNA, 19 nt, Homo sapiens
ggaaacugcagccugacuu

SEQ ID NO: 116557 - RNA, 19 nt, Homo sapiens
gcacgccacccaucaccaa

SEQ ID NO: 116558 - RNA, 19 nt, Homo sapiens
ccauggauguugugaaacu

SEQ ID NO: 116559 - RNA, 19 nt, Homo sapiens
ccuggaggauggaacagaa

SEQ ID NO: 116560 - RNA, 19 nt, Homo sapiens
agccaggccugcacauaaa

SEQ ID NO: 116561 - RNA, 19 nt, Homo sapiens
gcucggaaaggugaaguaa

SEQ ID NO: 116562 - RNA, 19 nt, Homo sapiens
guccauaagcccaugacua

SEQ ID NO: 116563 - RNA, 19 nt, Homo sapiens
ggcagcagcgucugucuga

SEQ ID NO: 116564 - RNA, 19 nt, Homo sapiens
gcaacaagaccuggaggau

SEQ ID NO: 116565 - RNA, 19 nt, Homo sapiens
ccccagagcugcaucuaaa

SEQ ID NO: 116566 - RNA, 19 nt, Homo sapiens
ccuuucagcucuaugagau

SEQ ID NO: 116567 - RNA, 19 nt, Homo sapiens
gaacaucaggcccuuucag

SEQ ID NO: 116568 - RNA, 19 nt, Homo sapiens
gcaacagccugcagauccu

SEQ ID NO: 116569 - RNA, 19 nt, Homo sapiens
ggaggaggaugaaaagaag

SEQ ID NO: 116570 - RNA, 19 nt, Homo sapiens
ggccuacacccugcagaua

SEQ ID NO: 116571 - RNA, 19 nt, Homo sapiens
uggcaaggcugggaaacug

SEQ ID NO: 116572 - RNA, 19 nt, Homo sapiens
gaucugcauacuuuaagga

SEQ ID NO: 116573 - RNA, 19 nt, Homo sapiens
gcagcugguuucaggaacu

SEQ ID NO: 116574 - RNA, 19 nt, Homo sapiens
ggaccaacgcucagaacca

SEQ ID NO: 116575 - RNA, 19 nt, Homo sapiens
ccuauaacuucaguauugu

SEQ ID NO: 116576 - RNA, 19 nt, Homo sapiens
ccaauggccuuuugugcuu

SEQ ID NO: 116577 - RNA, 19 nt, Homo sapiens
ggcgaucugcauacuuuaa

SEQ ID NO: 116578 - RNA, 19 nt, Homo sapiens
ggacccggagccacagauu

SEQ ID NO: 116579 - RNA, 19 nt, Homo sapiens
uaaagcacauuggcaagac

SEQ ID NO: 116580 - RNA, 19 nt, Homo sapiens
cagcagcgucugucugaug

SEQ ID NO: 116581 - RNA, 19 nt, Homo sapiens
ucuugggccugccucuuaa

SEQ ID NO: 116582 - RNA, 19 nt, Homo sapiens
ggccugcacauaaaucaga

SEQ ID NO: 116583 - RNA, 19 nt, Homo sapiens
gugcuuguuuccuauaacu

SEQ ID NO: 116584 - RNA, 19 nt, Homo sapiens
cauaagcccaugacuaaaa

SEQ ID NO: 116585 - RNA, 19 nt, Homo sapiens
caccagcgaucagguccuu

SEQ ID NO: 116586 - RNA, 19 nt, Homo sapiens
cuaaagcacauuggcaaga

SEQ ID NO: 116587 - RNA, 19 nt, Homo sapiens
cgagaagagagaccaagga

SEQ ID NO: 116588 - RNA, 19 nt, Homo sapiens
acaaagcuggugaacauca

SEQ ID NO: 116589 - RNA, 19 nt, Homo sapiens
gccuggagcugagaacuac

SEQ ID NO: 116590 - RNA, 19 nt, Homo sapiens
ccuuggaggcccuucagua

SEQ ID NO: 116591 - RNA, 19 nt, Homo sapiens
cugcuguuguaccagaaua

SEQ ID NO: 116592 - RNA, 19 nt, Homo sapiens
acccaggaaucuaucauca

SEQ ID NO: 116593 - RNA, 19 nt, Homo sapiens
uuaaaggccugagcuagcu

SEQ ID NO: 116594 - RNA, 19 nt, Homo sapiens
uguccaagaucacaaagcu

SEQ ID NO: 116595 - RNA, 19 nt, Homo sapiens
ucccauaacagcucagaga

SEQ ID NO: 116596 - RNA, 19 nt, Homo sapiens
uaugccuacucucaagaaa

SEQ ID NO: 116597 - RNA, 19 nt, Homo sapiens
ggagaacaucaggcccuuu

SEQ ID NO: 116598 - RNA, 19 nt, Homo sapiens
gcuggugaacaucaaguug

SEQ ID NO: 116599 - RNA, 19 nt, Homo sapiens
gccaggaggacgacugugu

SEQ ID NO: 116600 - RNA, 19 nt, Homo sapiens
cagcugguuucaggaacuu

SEQ ID NO: 116601 - RNA, 19 nt, Homo sapiens
gcuuguuuccuauaacuuc

SEQ ID NO: 116602 - RNA, 19 nt, Homo sapiens
gaagaggggaggguccaua

SEQ ID NO: 116603 - RNA, 19 nt, Homo sapiens
acaucaaguuggugcuaug

SEQ ID NO: 116604 - RNA, 19 nt, Homo sapiens
cuucaguauuguaaacuag

SEQ ID NO: 116605 - RNA, 19 nt, Homo sapiens
uuucagcucuaugagauca

SEQ ID NO: 116606 - RNA, 19 nt, Homo sapiens
ccuuguggccuauaacuca

SEQ ID NO: 116607 - RNA, 19 nt, Homo sapiens
ccaagguuaugugguuucu

SEQ ID NO: 116608 - RNA, 19 nt, Homo sapiens
cuuggaggcccuucaguau

SEQ ID NO: 116609 - RNA, 19 nt, Homo sapiens
gcacauaaaucagaagugu

SEQ ID NO: 116610 - RNA, 19 nt, Homo sapiens
gauccaagguuaugugguu

SEQ ID NO: 116611 - RNA, 19 nt, Homo sapiens
gcggacggauccaagguua

SEQ ID NO: 116612 - RNA, 19 nt, Homo sapiens
ggaggacgacugugucuuu

SEQ ID NO: 116613 - RNA, 19 nt, Homo sapiens
caggcgaucugcauacuuu

SEQ ID NO: 116614 - RNA, 19 nt, Homo sapiens
ggccagaggugccaacaug

SEQ ID NO: 116615 - RNA, 19 nt, Homo sapiens
gcgaucagguccuuuaugg

SEQ ID NO: 116616 - RNA, 19 nt, Homo sapiens
caaccacacucaggccuuu

SEQ ID NO: 116617 - RNA, 19 nt, Homo sapiens
uccuauaacuucaguauug

SEQ ID NO: 116618 - RNA, 19 nt, Homo sapiens
uggaggcccuucaguauga

SEQ ID NO: 116619 - RNA, 19 nt, Homo sapiens
gaacaucaaguuggugcua

SEQ ID NO: 116620 - RNA, 19 nt, Homo sapiens
uccauaagcccaugacuaa

SEQ ID NO: 116621 - RNA, 19 nt, Homo sapiens
ugagcuagcuggagaagag

SEQ ID NO: 116622 - RNA, 19 nt, Homo sapiens
aagguuaugugguuucuug

SEQ ID NO: 116623 - RNA, 19 nt, Homo sapiens
ucccauggauguugugaaa

SEQ ID NO: 116624 - RNA, 19 nt, Homo sapiens
guacaguccucacccugau

SEQ ID NO: 116625 - RNA, 19 nt, Homo sapiens
caaagcuggugaacaucaa

SEQ ID NO: 116626 - RNA, 19 nt, Homo sapiens
ccucagggcuaugugauug

SEQ ID NO: 116627 - RNA, 19 nt, Homo sapiens
cagugcagcuguucuggaa

SEQ ID NO: 116628 - RNA, 19 nt, Homo sapiens
gaaacugcagccugacuug

SEQ ID NO: 116629 - RNA, 19 nt, Homo sapiens
gaggacgacugugucuuug

SEQ ID NO: 116630 - RNA, 19 nt, Homo sapiens
ccagcgaucagguccuuua

SEQ ID NO: 116631 - RNA, 19 nt, Homo sapiens
ggacggauccaagguuaug

SEQ ID NO: 116632 - RNA, 19 nt, Homo sapiens
cagccaggccugcacauaa

SEQ ID NO: 116633 - RNA, 19 nt, Homo sapiens
caucgugacucccuuguac

SEQ ID NO: 116634 - RNA, 19 nt, Homo sapiens
acauaaaucagaaguguga

SEQ ID NO: 116635 - RNA, 19 nt, Homo sapiens
ggcacuaucuccgcuguga

SEQ ID NO: 116636 - RNA, 19 nt, Homo sapiens
gagaacaucaggcccuuuc

SEQ ID NO: 116637 - RNA, 19 nt, Homo sapiens
ugccuacucucaagaaaug

SEQ ID NO: 116638 - RNA, 19 nt, Homo sapiens
cccaccagcuucacucuga

SEQ ID NO: 116639 - RNA, 19 nt, Homo sapiens
caaccucuccugccucaug

SEQ ID NO: 116640 - RNA, 19 nt, Homo sapiens
ucggaaaggugaaguaacu

SEQ ID NO: 116641 - RNA, 19 nt, Homo sapiens
ggaaacugcagccugacuu

SEQ ID NO: 116642 - RNA, 19 nt, Homo sapiens
gcacgccacccaucaccaa

SEQ ID NO: 116643 - RNA, 19 nt, Homo sapiens
ccauggauguugugaaacu

SEQ ID NO: 116644 - RNA, 19 nt, Homo sapiens
ccuggaggauggaacagaa

SEQ ID NO: 116645 - RNA, 19 nt, Homo sapiens
agccaggccugcacauaaa

SEQ ID NO: 116646 - RNA, 19 nt, Homo sapiens
gcucggaaaggugaaguaa

SEQ ID NO: 116647 - RNA, 19 nt, Homo sapiens
guccauaagcccaugacua

SEQ ID NO: 116648 - RNA, 19 nt, Homo sapiens
ggcagcagcgucugucuga

SEQ ID NO: 116649 - RNA, 19 nt, Homo sapiens
gcaacaagaccuggaggau

SEQ ID NO: 116650 - RNA, 19 nt, Homo sapiens
ccccagagcugcaucuaaa

SEQ ID NO: 116651 - RNA, 19 nt, Homo sapiens
ccuuucagcucuaugagau

SEQ ID NO: 116652 - RNA, 19 nt, Homo sapiens
gaacaucaggcccuuucag

SEQ ID NO: 116653 - RNA, 19 nt, Homo sapiens
gcaacagccugcagauccu

SEQ ID NO: 116654 - RNA, 19 nt, Homo sapiens
ggaggaggaugaaaagaag

SEQ ID NO: 116655 - RNA, 19 nt, Homo sapiens
ggccuacacccugcagaua

SEQ ID NO: 116656 - RNA, 19 nt, Homo sapiens
uggcaaggcugggaaacug

SEQ ID NO: 116657 - RNA, 19 nt, Homo sapiens
gaucugcauacuuuaagga

SEQ ID NO: 116658 - RNA, 19 nt, Homo sapiens
gcagcugguuucaggaacu

SEQ ID NO: 116659 - RNA, 19 nt, Homo sapiens
ggaccaacgcucagaacca

SEQ ID NO: 116660 - RNA, 19 nt, Homo sapiens
ccuauaacuucaguauugu

SEQ ID NO: 116661 - RNA, 19 nt, Homo sapiens
ccaauggccuuuugugcuu

SEQ ID NO: 116662 - RNA, 19 nt, Homo sapiens
ggcgaucugcauacuuuaa

SEQ ID NO: 116663 - RNA, 19 nt, Homo sapiens
ggacccggagccacagauu

SEQ ID NO: 116664 - RNA, 19 nt, Homo sapiens
uaaagcacauuggcaagac

SEQ ID NO: 116665 - RNA, 19 nt, Homo sapiens
cagcagcgucugucugaug

SEQ ID NO: 116666 - RNA, 19 nt, Homo sapiens
ucuugggccugccucuuaa

SEQ ID NO: 116667 - RNA, 19 nt, Homo sapiens
ggccugcacauaaaucaga

SEQ ID NO: 116668 - RNA, 19 nt, Homo sapiens
gugcuuguuuccuauaacu

SEQ ID NO: 116669 - RNA, 19 nt, Homo sapiens
acaaagcuggugaacauca

SEQ ID NO: 116670 - RNA, 19 nt, Homo sapiens
cauaagcccaugacuaaaa

SEQ ID NO: 116671 - RNA, 19 nt, Homo sapiens
caccagcgaucagguccuu

SEQ ID NO: 116672 - RNA, 19 nt, Homo sapiens
cgagaagagagaccaagga

SEQ ID NO: 116673 - RNA, 19 nt, Homo sapiens
cuaaagcacauuggcaaga

SEQ ID NO: 116674 - RNA, 19 nt, Homo sapiens
gccuggagcugagaacuac

SEQ ID NO: 116675 - RNA, 19 nt, Homo sapiens
ccuuggaggcccuucagua

SEQ ID NO: 116676 - RNA, 19 nt, Homo sapiens
cugcuguuguaccagaaua

SEQ ID NO: 116677 - RNA, 19 nt, Homo sapiens
acccaggaaucuaucauca

SEQ ID NO: 116678 - RNA, 19 nt, Homo sapiens
uuaaaggccugagcuagcu

SEQ ID NO: 116679 - RNA, 19 nt, Homo sapiens
uguccaagaucacaaagcu

SEQ ID NO: 116680 - RNA, 19 nt, Homo sapiens
ucccauaacagcucagaga

SEQ ID NO: 116681 - RNA, 19 nt, Homo sapiens
uaugccuacucucaagaaa

SEQ ID NO: 116682 - RNA, 19 nt, Homo sapiens
gcuggugaacaucaaguug

SEQ ID NO: 116683 - RNA, 19 nt, Homo sapiens
ggagaacaucaggcccuuu

SEQ ID NO: 116684 - RNA, 19 nt, Homo sapiens
cagcugguuucaggaacuu

SEQ ID NO: 116685 - RNA, 19 nt, Homo sapiens
gccaggaggacgacugugu

SEQ ID NO: 116686 - RNA, 19 nt, Homo sapiens
gcuuguuuccuauaacuuc

SEQ ID NO: 116687 - RNA, 19 nt, Homo sapiens
gaagaggggaggguccaua

SEQ ID NO: 116688 - RNA, 19 nt, Homo sapiens
acaucaaguuggugcuaug

SEQ ID NO: 116689 - RNA, 19 nt, Homo sapiens
cuucaguauuguaaacuag

SEQ ID NO: 116690 - RNA, 19 nt, Homo sapiens
uuucagcucuaugagauca

SEQ ID NO: 116691 - RNA, 19 nt, Homo sapiens
ccuuguggccuauaacuca

SEQ ID NO: 116692 - RNA, 19 nt, Homo sapiens
ccaagguuaugugguuucu

SEQ ID NO: 116693 - RNA, 19 nt, Homo sapiens
cuuggaggcccuucaguau

SEQ ID NO: 116694 - RNA, 19 nt, Homo sapiens
gcacauaaaucagaagugu

SEQ ID NO: 116695 - RNA, 19 nt, Homo sapiens
gauccaagguuaugugguu

SEQ ID NO: 116696 - RNA, 19 nt, Homo sapiens
gcggacggauccaagguua

SEQ ID NO: 116697 - RNA, 19 nt, Homo sapiens
ggaggacgacugugucuuu

SEQ ID NO: 116698 - RNA, 19 nt, Homo sapiens
caggcgaucugcauacuuu

SEQ ID NO: 116699 - RNA, 19 nt, Homo sapiens
ggccagaggugccaacaug

SEQ ID NO: 116700 - RNA, 19 nt, Homo sapiens
ggaacugccuggcucuguu

SEQ ID NO: 116701 - RNA, 19 nt, Homo sapiens
gcgaucagguccuuuaugg

SEQ ID NO: 116702 - RNA, 19 nt, Homo sapiens
caaccacacucaggccuuu

SEQ ID NO: 116703 - RNA, 19 nt, Homo sapiens
uccuauaacuucaguauug

SEQ ID NO: 116704 - RNA, 19 nt, Homo sapiens
uggaggcccuucaguauga

SEQ ID NO: 116705 - RNA, 19 nt, Homo sapiens
gaacaucaaguuggugcua

SEQ ID NO: 116706 - RNA, 19 nt, Homo sapiens
ggucggagcuacacaucau

SEQ ID NO: 116707 - RNA, 19 nt, Homo sapiens
uccauaagcccaugacuaa

SEQ ID NO: 116708 - RNA, 19 nt, Homo sapiens
ugagcuagcuggagaagag

SEQ ID NO: 116709 - RNA, 19 nt, Homo sapiens
aagguuaugugguuucuug

SEQ ID NO: 116710 - RNA, 19 nt, Homo sapiens
ucccauggauguugugaaa

SEQ ID NO: 116711 - RNA, 19 nt, Homo sapiens
guacaguccucacccugau

SEQ ID NO: 116712 - RNA, 19 nt, Homo sapiens
caaagcuggugaacaucaa

SEQ ID NO: 116713 - RNA, 19 nt, Homo sapiens
ccucagggcuaugugauug

SEQ ID NO: 116714 - RNA, 19 nt, Homo sapiens
cagugcagcuguucuggaa

SEQ ID NO: 116715 - RNA, 19 nt, Homo sapiens
gaaacugcagccugacuug

SEQ ID NO: 116716 - RNA, 19 nt, Homo sapiens
gaggacgacugugucuuug

SEQ ID NO: 116717 - RNA, 19 nt, Homo sapiens
ccagcgaucagguccuuua

SEQ ID NO: 116718 - RNA, 19 nt, Homo sapiens
ggacggauccaagguuaug

SEQ ID NO: 116719 - RNA, 19 nt, Homo sapiens
cagccaggccugcacauaa

SEQ ID NO: 116720 - RNA, 19 nt, Homo sapiens
gaacugccuggcucuguug

SEQ ID NO: 116721 - RNA, 19 nt, Homo sapiens
caucgugacucccuuguac

SEQ ID NO: 116722 - RNA, 19 nt, Homo sapiens
acauaaaucagaaguguga

SEQ ID NO: 116723 - RNA, 19 nt, Homo sapiens
ggcacuaucuccgcuguga

SEQ ID NO: 116724 - RNA, 19 nt, Homo sapiens
gagaacaucaggcccuuuc

SEQ ID NO: 116725 - RNA, 19 nt, Homo sapiens
ugccuacucucaagaaaug

SEQ ID NO: 116726 - RNA, 19 nt, Homo sapiens
cccaccagcuucacucuga

SEQ ID NO: 116727 - RNA, 19 nt, Homo sapiens
caaccucuccugccucaug

SEQ ID NO: 116728 - RNA, 19 nt, Homo sapiens
ucggaaaggugaaguaacu

SEQ ID NO: 116729 - RNA, 19 nt, Homo sapiens
ggaaacugcagccugacuu

SEQ ID NO: 116730 - RNA, 19 nt, Homo sapiens
gcacgccacccaucaccaa

SEQ ID NO: 116731 - RNA, 19 nt, Homo sapiens
ccauggauguugugaaacu

SEQ ID NO: 116732 - RNA, 19 nt, Homo sapiens
ccuggaggauggaacagaa

SEQ ID NO: 116733 - RNA, 19 nt, Homo sapiens
agccaggccugcacauaaa

SEQ ID NO: 116734 - RNA, 19 nt, Homo sapiens
gcucggaaaggugaaguaa

SEQ ID NO: 116735 - RNA, 19 nt, Homo sapiens
guccauaagcccaugacua

SEQ ID NO: 116736 - RNA, 19 nt, Homo sapiens
ggcagcagcgucugucuga

SEQ ID NO: 116737 - RNA, 19 nt, Homo sapiens
gcaacaagaccuggaggau

SEQ ID NO: 116738 - RNA, 19 nt, Homo sapiens
ccccagagcugcaucuaaa

SEQ ID NO: 116739 - RNA, 19 nt, Homo sapiens
ccuuucagcucuaugagau

SEQ ID NO: 116740 - RNA, 19 nt, Homo sapiens
gaacaucaggcccuuucag

SEQ ID NO: 116741 - RNA, 19 nt, Homo sapiens
gcaacagccugcagauccu

SEQ ID NO: 116742 - RNA, 19 nt, Homo sapiens
ggaggaggaugaaaagaag

SEQ ID NO: 116743 - RNA, 19 nt, Homo sapiens
ggccuacacccugcagaua

SEQ ID NO: 116744 - RNA, 19 nt, Homo sapiens
uggcaaggcugggaaacug

SEQ ID NO: 116745 - RNA, 19 nt, Homo sapiens
gaucugcauacuuuaagga

SEQ ID NO: 116746 - RNA, 19 nt, Homo sapiens
gcagcugguuucaggaacu

SEQ ID NO: 116747 - RNA, 19 nt, Homo sapiens
ggaccaacgcucagaacca

SEQ ID NO: 116748 - RNA, 19 nt, Homo sapiens
ccuauaacuucaguauugu

SEQ ID NO: 116749 - RNA, 19 nt, Homo sapiens
ccaauggccuuuugugcuu

SEQ ID NO: 116750 - RNA, 19 nt, Homo sapiens
ggcgaucugcauacuuuaa

SEQ ID NO: 116751 - RNA, 19 nt, Homo sapiens
ggacccggagccacagauu

SEQ ID NO: 116752 - RNA, 19 nt, Homo sapiens
uaaagcacauuggcaagac

SEQ ID NO: 116753 - RNA, 19 nt, Homo sapiens
cagcagcgucugucugaug

SEQ ID NO: 116754 - RNA, 19 nt, Homo sapiens
ucuugggccugccucuuaa

SEQ ID NO: 116755 - RNA, 19 nt, Homo sapiens
ggccugcacauaaaucaga

SEQ ID NO: 116756 - RNA, 19 nt, Homo sapiens
gugcuuguuuccuauaacu

SEQ ID NO: 116757 - RNA, 19 nt, Homo sapiens
cauaagcccaugacuaaaa

SEQ ID NO: 116758 - RNA, 19 nt, Homo sapiens
caccagcgaucagguccuu

SEQ ID NO: 116759 - RNA, 19 nt, Homo sapiens
cuaaagcacauuggcaaga

SEQ ID NO: 116760 - RNA, 19 nt, Homo sapiens
cgagaagagagaccaagga

SEQ ID NO: 116761 - RNA, 19 nt, Homo sapiens
acaaagcuggugaacauca

SEQ ID NO: 116762 - RNA, 19 nt, Homo sapiens
gccuggagcugagaacuac

SEQ ID NO: 116763 - RNA, 19 nt, Homo sapiens
ccuuggaggcccuucagua

SEQ ID NO: 116764 - RNA, 19 nt, Homo sapiens
cugcuguuguaccagaaua

SEQ ID NO: 116765 - RNA, 19 nt, Homo sapiens
acccaggaaucuaucauca

SEQ ID NO: 116766 - RNA, 19 nt, Homo sapiens
uuaaaggccugagcuagcu

SEQ ID NO: 116767 - RNA, 19 nt, Homo sapiens
uguccaagaucacaaagcu

SEQ ID NO: 116768 - RNA, 19 nt, Homo sapiens
ucccauaacagcucagaga

SEQ ID NO: 116769 - RNA, 19 nt, Homo sapiens
uaugccuacucucaagaaa

SEQ ID NO: 116770 - RNA, 19 nt, Homo sapiens
ggagaacaucaggcccuuu

SEQ ID NO: 116771 - RNA, 19 nt, Homo sapiens
gcuggugaacaucaaguug

SEQ ID NO: 116772 - RNA, 19 nt, Homo sapiens
gccaggaggacgacugugu

SEQ ID NO: 116773 - RNA, 19 nt, Homo sapiens
cagcugguuucaggaacuu

SEQ ID NO: 116774 - RNA, 19 nt, Homo sapiens
gcuuguuuccuauaacuuc

SEQ ID NO: 116775 - RNA, 19 nt, Homo sapiens
gaagaggggaggguccaua

SEQ ID NO: 116776 - RNA, 19 nt, Homo sapiens
acaucaaguuggugcuaug

SEQ ID NO: 116777 - RNA, 19 nt, Homo sapiens
cuucaguauuguaaacuag

SEQ ID NO: 116778 - RNA, 19 nt, Homo sapiens
uuucagcucuaugagauca

SEQ ID NO: 116779 - RNA, 19 nt, Homo sapiens
ccuuguggccuauaacuca

SEQ ID NO: 116780 - RNA, 19 nt, Homo sapiens
ccaagguuaugugguuucu

SEQ ID NO: 116781 - RNA, 19 nt, Homo sapiens
cuuggaggcccuucaguau

SEQ ID NO: 116782 - RNA, 19 nt, Homo sapiens
gcacauaaaucagaagugu

SEQ ID NO: 116783 - RNA, 19 nt, Homo sapiens
gauccaagguuaugugguu

SEQ ID NO: 116784 - RNA, 19 nt, Homo sapiens
gcggacggauccaagguua

SEQ ID NO: 116785 - RNA, 19 nt, Homo sapiens
caggcgaucugcauacuuu

SEQ ID NO: 116786 - RNA, 19 nt, Homo sapiens
ggccagaggugccaacaug

SEQ ID NO: 116787 - RNA, 19 nt, Homo sapiens
ggaacugccuggcucuguu

SEQ ID NO: 116788 - RNA, 19 nt, Homo sapiens
caaccacacucaggccuuu

SEQ ID NO: 116789 - RNA, 19 nt, Homo sapiens
uccuauaacuucaguauug

SEQ ID NO: 116790 - RNA, 19 nt, Homo sapiens
uggaggcccuucaguauga

SEQ ID NO: 116791 - RNA, 19 nt, Homo sapiens
gaacaucaaguuggugcua

SEQ ID NO: 116792 - RNA, 19 nt, Homo sapiens
ggucggagcuacacaucau

SEQ ID NO: 116793 - RNA, 19 nt, Homo sapiens
aagguuaugugguuucuug

SEQ ID NO: 116794 - RNA, 19 nt, Homo sapiens
ucccauggauguugugaaa

SEQ ID NO: 116795 - RNA, 19 nt, Homo sapiens
guacaguccucacccugau

SEQ ID NO: 116796 - RNA, 19 nt, Homo sapiens
caaagcuggugaacaucaa

SEQ ID NO: 116797 - RNA, 19 nt, Homo sapiens
ccucagggcuaugugauug

SEQ ID NO: 116798 - RNA, 19 nt, Homo sapiens
cagugcagcuguucuggaa

SEQ ID NO: 116799 - RNA, 19 nt, Homo sapiens
gaaacugcagccugacuug

SEQ ID NO: 116800 - RNA, 19 nt, Homo sapiens
ggacggauccaagguuaug

SEQ ID NO: 116801 - RNA, 19 nt, Homo sapiens
cagccaggccugcacauaa

SEQ ID NO: 116802 - RNA, 19 nt, Homo sapiens
gaacugccuggcucuguug

SEQ ID NO: 116803 - RNA, 19 nt, Homo sapiens
caucgugacucccuuguac

SEQ ID NO: 116804 - RNA, 19 nt, Homo sapiens
acauaaaucagaaguguga

SEQ ID NO: 116805 - RNA, 19 nt, Homo sapiens
gagaacaucaggcccuuuc

SEQ ID NO: 116806 - RNA, 19 nt, Homo sapiens
ugccuacucucaagaaaug

SEQ ID NO: 116807 - RNA, 19 nt, Homo sapiens
cccaccagcuucacucuga

SEQ ID NO: 116808 - RNA, 19 nt, Homo sapiens
caaccucuccugccucaug

SEQ ID NO: 116809 - RNA, 19 nt, Homo sapiens
ucggaaaggugaaguaacu

SEQ ID NO: 116810 - RNA, 19 nt, Homo sapiens
ggaaacugcagccugacuu

SEQ ID NO: 116811 - RNA, 19 nt, Homo sapiens
gcacgccacccaucaccaa

SEQ ID NO: 116812 - RNA, 19 nt, Homo sapiens
ccauggauguugugaaacu

SEQ ID NO: 116813 - RNA, 19 nt, Homo sapiens
ccuggaggauggaacagaa

SEQ ID NO: 116814 - RNA, 19 nt, Homo sapiens
agccaggccugcacauaaa

SEQ ID NO: 116815 - RNA, 19 nt, Homo sapiens
gcucggaaaggugaaguaa

SEQ ID NO: 116816 - RNA, 19 nt, Homo sapiens
ggcagcagcgucugucuga

SEQ ID NO: 116817 - RNA, 19 nt, Homo sapiens
gcaacaagaccuggaggau

SEQ ID NO: 116818 - RNA, 19 nt, Homo sapiens
ccccagagcugcaucuaaa

SEQ ID NO: 116819 - RNA, 19 nt, Homo sapiens
ccuuucagcucuaugagau

SEQ ID NO: 116820 - RNA, 19 nt, Homo sapiens
gaacaucaggcccuuucag

SEQ ID NO: 116821 - RNA, 19 nt, Homo sapiens
gcaacagccugcagauccu

SEQ ID NO: 116822 - RNA, 19 nt, Homo sapiens
ggaggaggaugaaaagaag

SEQ ID NO: 116823 - RNA, 19 nt, Homo sapiens
ggccuacacccugcagaua

SEQ ID NO: 116824 - RNA, 19 nt, Homo sapiens
uggcaaggcugggaaacug

SEQ ID NO: 116825 - RNA, 19 nt, Homo sapiens
gaucugcauacuuuaagga

SEQ ID NO: 116826 - RNA, 19 nt, Homo sapiens
ggaccaacgcucagaacca

SEQ ID NO: 116827 - RNA, 19 nt, Homo sapiens
gcagcugguuucaggaacu

SEQ ID NO: 116828 - RNA, 19 nt, Homo sapiens
ccuauaacuucaguauugu

SEQ ID NO: 116829 - RNA, 19 nt, Homo sapiens
ccaauggccuuuugugcuu

SEQ ID NO: 116830 - RNA, 19 nt, Homo sapiens
ggcgaucugcauacuuuaa

SEQ ID NO: 116831 - RNA, 19 nt, Homo sapiens
ggacccggagccacagauu

SEQ ID NO: 116832 - RNA, 19 nt, Homo sapiens
uaaagcacauuggcaagac

SEQ ID NO: 116833 - RNA, 19 nt, Homo sapiens
cagcagcgucugucugaug

SEQ ID NO: 116834 - RNA, 19 nt, Homo sapiens
ggccugcacauaaaucaga

SEQ ID NO: 116835 - RNA, 19 nt, Homo sapiens
gugcuuguuuccuauaacu

SEQ ID NO: 116836 - RNA, 19 nt, Homo sapiens
cuaaagcacauuggcaaga

SEQ ID NO: 116837 - RNA, 19 nt, Homo sapiens
acaaagcuggugaacauca

SEQ ID NO: 116838 - RNA, 19 nt, Homo sapiens
cgagaagagagaccaagga

SEQ ID NO: 116839 - RNA, 19 nt, Homo sapiens
gccuggagcugagaacuac

SEQ ID NO: 116840 - RNA, 19 nt, Homo sapiens
ccuuggaggcccuucagua

SEQ ID NO: 116841 - RNA, 19 nt, Homo sapiens
cugcuguuguaccagaaua

SEQ ID NO: 116842 - RNA, 19 nt, Homo sapiens
acccaggaaucuaucauca

SEQ ID NO: 116843 - RNA, 19 nt, Homo sapiens
uguccaagaucacaaagcu

SEQ ID NO: 116844 - RNA, 19 nt, Homo sapiens
ucccauaacagcucagaga

SEQ ID NO: 116845 - RNA, 19 nt, Homo sapiens
uaugccuacucucaagaaa

SEQ ID NO: 116846 - RNA, 19 nt, Homo sapiens
ggagaacaucaggcccuuu

SEQ ID NO: 116847 - RNA, 19 nt, Homo sapiens
gcuggugaacaucaaguug

SEQ ID NO: 116848 - RNA, 19 nt, Homo sapiens
cagcugguuucaggaacuu

SEQ ID NO: 116849 - RNA, 19 nt, Homo sapiens
acaucaaguuggugcuaug

SEQ ID NO: 116850 - RNA, 19 nt, Homo sapiens
gcuuguuuccuauaacuuc

SEQ ID NO: 116851 - RNA, 19 nt, Homo sapiens
cuucaguauuguaaacuag

SEQ ID NO: 116852 - RNA, 19 nt, Homo sapiens
uuucagcucuaugagauca

SEQ ID NO: 116853 - RNA, 19 nt, Homo sapiens
ccuuguggccuauaacuca

SEQ ID NO: 116854 - RNA, 19 nt, Homo sapiens
ccaagguuaugugguuucu

SEQ ID NO: 116855 - RNA, 19 nt, Homo sapiens
cuuggaggcccuucaguau

SEQ ID NO: 116856 - RNA, 19 nt, Homo sapiens
caacagaaauccaaucuag

SEQ ID NO: 116857 - RNA, 19 nt, Homo sapiens
ccaacaaccugguguauga

SEQ ID NO: 116858 - RNA, 19 nt, Homo sapiens
ggaaggacauggacaaggu

SEQ ID NO: 116859 - RNA, 19 nt, Homo sapiens
caaaggaccagaaguauuc

SEQ ID NO: 116860 - RNA, 19 nt, Homo sapiens
ggaggaaacgcaacagaaa

SEQ ID NO: 116861 - RNA, 19 nt, Homo sapiens
caccagccuuguccuaaua

SEQ ID NO: 116862 - RNA, 19 nt, Homo sapiens
aaaccuauaucccaaagga

SEQ ID NO: 116863 - RNA, 19 nt, Homo sapiens
guggacagcucaccuagug

SEQ ID NO: 116864 - RNA, 19 nt, Homo sapiens
caaacucgcacaaccauga

SEQ ID NO: 116865 - RNA, 19 nt, Homo sapiens
ggacagcgaugacuaucac

SEQ ID NO: 116866 - RNA, 19 nt, Homo sapiens
gaacuggccaggguauaaa

SEQ ID NO: 116867 - RNA, 19 nt, Homo sapiens
gcuucuaggugcccgagua

SEQ ID NO: 116868 - RNA, 19 nt, Homo sapiens
gggcagcuguggcuucuag

SEQ ID NO: 116869 - RNA, 19 nt, Homo sapiens
ccaaaggaccagaaguauu

SEQ ID NO: 116870 - RNA, 19 nt, Homo sapiens
uggacaaggucgagacauu

SEQ ID NO: 116871 - RNA, 19 nt, Homo sapiens
gcagaccuacagcaaguuu

SEQ ID NO: 116872 - RNA, 19 nt, Homo sapiens
cguccaaaccguuccguua

SEQ ID NO: 116873 - RNA, 19 nt, Homo sapiens
ggacugggcagauccucaa

SEQ ID NO: 116874 - RNA, 19 nt, Homo sapiens
ccaccagccuuguccuaau

SEQ ID NO: 116875 - RNA, 19 nt, Homo sapiens
ggacaaggucgagacauuc

SEQ ID NO: 116876 - RNA, 19 nt, Homo sapiens
aagcagaccuacagcaagu

SEQ ID NO: 116877 - RNA, 19 nt, Homo sapiens
cgaugacuaucaccuccua

SEQ ID NO: 116878 - RNA, 19 nt, Homo sapiens
gcaacagaaauccaaucua

SEQ ID NO: 116879 - RNA, 19 nt, Homo sapiens
acgcacugcucaagaacua

SEQ ID NO: 116880 - RNA, 19 nt, Homo sapiens
gaggaaacgcaacagaaau

SEQ ID NO: 116881 - RNA, 19 nt, Homo sapiens
gggcugcucuacugcuuca

SEQ ID NO: 116882 - RNA, 19 nt, Homo sapiens
ccuaaaggaccuagaggaa

SEQ ID NO: 116883 - RNA, 19 nt, Homo sapiens
ggaccagaaguauucauuc

SEQ ID NO: 116884 - RNA, 19 nt, Homo sapiens
ucccaaaggaccagaagua

SEQ ID NO: 116885 - RNA, 19 nt, Homo sapiens
gaccagaaguauucauucc

SEQ ID NO: 116886 - RNA, 19 nt, Homo sapiens
uaccaggaguuugaagaaa

SEQ ID NO: 116887 - RNA, 19 nt, Homo sapiens
cgcaccagcuggccauuga

SEQ ID NO: 116888 - RNA, 19 nt, Homo sapiens
aaacgcaacagaaauccaa

SEQ ID NO: 116889 - RNA, 19 nt, Homo sapiens
cagcucaccuaguggcaau

SEQ ID NO: 116890 - RNA, 19 nt, Homo sapiens
ucaagcagaccuacagcaa

SEQ ID NO: 116891 - RNA, 19 nt, Homo sapiens
acaccuaccaggaguuuga

SEQ ID NO: 116892 - RNA, 19 nt, Homo sapiens
gagggcagcuguggcuucu

SEQ ID NO: 116893 - RNA, 19 nt, Homo sapiens
gaacuacgggcugcucuac

SEQ ID NO: 116894 - RNA, 19 nt, Homo sapiens
acagaaauccaaucuagag

SEQ ID NO: 116895 - RNA, 19 nt, Homo sapiens
gaaguauucauuccugcau

SEQ ID NO: 116896 - RNA, 19 nt, Homo sapiens
agaacuggccaggguauaa

SEQ ID NO: 116897 - RNA, 19 nt, Homo sapiens
guccaaaccguuccguuau

SEQ ID NO: 116898 - RNA, 19 nt, Homo sapiens
gagaacuggccaggguaua

SEQ ID NO: 116899 - RNA, 19 nt, Homo sapiens
ugacaccuaccaggaguuu

SEQ ID NO: 116900 - RNA, 19 nt, Homo sapiens
agaaaccuauaucccaaag

SEQ ID NO: 116901 - RNA, 19 nt, Homo sapiens
guuccguuauccaggcuuu

SEQ ID NO: 116902 - RNA, 19 nt, Homo sapiens
cuaccaggaguuugaagaa

SEQ ID NO: 116903 - RNA, 19 nt, Homo sapiens
ucaggaaggacauggacaa

SEQ ID NO: 116904 - RNA, 19 nt, Homo sapiens
agaccuacagcaaguuuga

SEQ ID NO: 116905 - RNA, 19 nt, Homo sapiens
ugaccacgcuaugcuccaa

SEQ ID NO: 116906 - RNA, 19 nt, Homo sapiens
ccagccuuguccuaauaaa

SEQ ID NO: 116907 - RNA, 19 nt, Homo sapiens
gcaucucccugcugcucau

SEQ ID NO: 116908 - RNA, 19 nt, Homo sapiens
cgucccugcuccuggcuuu

SEQ ID NO: 116909 - RNA, 19 nt, Homo sapiens
gacuaucaccuccuaaagg

SEQ ID NO: 116910 - RNA, 19 nt, Homo sapiens
uggaggaaacgcaacagaa

SEQ ID NO: 116911 - RNA, 19 nt, Homo sapiens
acuacgggcugcucuacug

SEQ ID NO: 116912 - RNA, 19 nt, Homo sapiens
augacgcacugcucaagaa

SEQ ID NO: 116913 - RNA, 19 nt, Homo sapiens
cuacagcaaguuugacaca

SEQ ID NO: 116914 - RNA, 19 nt, Homo sapiens
gaaacgcaacagaaaucca

SEQ ID NO: 116915 - RNA, 19 nt, Homo sapiens
uccaaaccguuccguuauc

SEQ ID NO: 116916 - RNA, 19 nt, Homo sapiens
caagagaacucaccuuauu

SEQ ID NO: 116917 - RNA, 19 nt, Homo sapiens
gaacucaccuuauucuuca

SEQ ID NO: 116918 - RNA, 19 nt, Homo sapiens
caacagaaauccaaucuag

SEQ ID NO: 116919 - RNA, 19 nt, Homo sapiens
ccaacaaccugguguauga

SEQ ID NO: 116920 - RNA, 19 nt, Homo sapiens
guaaggcgcugacccaaga

SEQ ID NO: 116921 - RNA, 19 nt, Homo sapiens
ggaaggacauggacaaggu

SEQ ID NO: 116922 - RNA, 19 nt, Homo sapiens
caaaggaccagaaguauuc

SEQ ID NO: 116923 - RNA, 19 nt, Homo sapiens
ggaggaaacgcaacagaaa

SEQ ID NO: 116924 - RNA, 19 nt, Homo sapiens
caccagccuuguccuaaua

SEQ ID NO: 116925 - RNA, 19 nt, Homo sapiens
aaaccuauaucccaaagga

SEQ ID NO: 116926 - RNA, 19 nt, Homo sapiens
guggacagcucaccuagug

SEQ ID NO: 116927 - RNA, 19 nt, Homo sapiens
ggaggaaaauggauaaaug

SEQ ID NO: 116928 - RNA, 19 nt, Homo sapiens
aaauacugcugcccucuuu

SEQ ID NO: 116929 - RNA, 19 nt, Homo sapiens
caaacucgcacaaccauga

SEQ ID NO: 116930 - RNA, 19 nt, Homo sapiens
ggacagcgaugacuaucac

SEQ ID NO: 116931 - RNA, 19 nt, Homo sapiens
gaacuggccaggguauaaa

SEQ ID NO: 116932 - RNA, 19 nt, Homo sapiens
gcuucuaggugcccgagua

SEQ ID NO: 116933 - RNA, 19 nt, Homo sapiens
gggcagcuguggcuucuag

SEQ ID NO: 116934 - RNA, 19 nt, Homo sapiens
ccaaaggaccagaaguauu

SEQ ID NO: 116935 - RNA, 19 nt, Homo sapiens
uggacaaggucgagacauu

SEQ ID NO: 116936 - RNA, 19 nt, Homo sapiens
gaaauacugcugcccucuu

SEQ ID NO: 116937 - RNA, 19 nt, Homo sapiens
gcagaccuacagcaaguuu

SEQ ID NO: 116938 - RNA, 19 nt, Homo sapiens
cccaagagaacucaccuua

SEQ ID NO: 116939 - RNA, 19 nt, Homo sapiens
cguccaaaccguuccguua

SEQ ID NO: 116940 - RNA, 19 nt, Homo sapiens
ggacugggcagauccucaa

SEQ ID NO: 116941 - RNA, 19 nt, Homo sapiens
ccaccagccuuguccuaau

SEQ ID NO: 116942 - RNA, 19 nt, Homo sapiens
ggacaaggucgagacauuc

SEQ ID NO: 116943 - RNA, 19 nt, Homo sapiens
aagcagaccuacagcaagu

SEQ ID NO: 116944 - RNA, 19 nt, Homo sapiens
cgaugacuaucaccuccua

SEQ ID NO: 116945 - RNA, 19 nt, Homo sapiens
gcaacagaaauccaaucua

SEQ ID NO: 116946 - RNA, 19 nt, Homo sapiens
acgcacugcucaagaacua

SEQ ID NO: 116947 - RNA, 19 nt, Homo sapiens
gaggaaacgcaacagaaau

SEQ ID NO: 116948 - RNA, 19 nt, Homo sapiens
gggcugcucuacugcuuca

SEQ ID NO: 116949 - RNA, 19 nt, Homo sapiens
ccuaaaggaccuagaggaa

SEQ ID NO: 116950 - RNA, 19 nt, Homo sapiens
ggaccagaaguauucauuc

SEQ ID NO: 116951 - RNA, 19 nt, Homo sapiens
ucccaaaggaccagaagua

SEQ ID NO: 116952 - RNA, 19 nt, Homo sapiens
ccaagagaacucaccuuau

SEQ ID NO: 116953 - RNA, 19 nt, Homo sapiens
cgcaccagcuggccauuga

SEQ ID NO: 116954 - RNA, 19 nt, Homo sapiens
gaccagaaguauucauucc

SEQ ID NO: 116955 - RNA, 19 nt, Homo sapiens
uaccaggaguuugaagaaa

SEQ ID NO: 116956 - RNA, 19 nt, Homo sapiens
aaacgcaacagaaauccaa

SEQ ID NO: 116957 - RNA, 19 nt, Homo sapiens
cagcucaccuaguggcaau

SEQ ID NO: 116958 - RNA, 19 nt, Homo sapiens
ucaagcagaccuacagcaa

SEQ ID NO: 116959 - RNA, 19 nt, Homo sapiens
acaccuaccaggaguuuga

SEQ ID NO: 116960 - RNA, 19 nt, Homo sapiens
gagggcagcuguggcuucu

SEQ ID NO: 116961 - RNA, 19 nt, Homo sapiens
gaacuacgggcugcucuac

SEQ ID NO: 116962 - RNA, 19 nt, Homo sapiens
acagaaauccaaucuagag

SEQ ID NO: 116963 - RNA, 19 nt, Homo sapiens
gaaguauucauuccugcau

SEQ ID NO: 116964 - RNA, 19 nt, Homo sapiens
guccaaaccguuccguuau

SEQ ID NO: 116965 - RNA, 19 nt, Homo sapiens
gagaacuggccaggguaua

SEQ ID NO: 116966 - RNA, 19 nt, Homo sapiens
agaacuggccaggguauaa

SEQ ID NO: 116967 - RNA, 19 nt, Homo sapiens
ggaaaauggauaaaugaga

SEQ ID NO: 116968 - RNA, 19 nt, Homo sapiens
gaggaaaauggauaaauga

SEQ ID NO: 116969 - RNA, 19 nt, Homo sapiens
cuaccaggaguuugaagaa

SEQ ID NO: 116970 - RNA, 19 nt, Homo sapiens
guuccguuauccaggcuuu

SEQ ID NO: 116971 - RNA, 19 nt, Homo sapiens
agaaaccuauaucccaaag

SEQ ID NO: 116972 - RNA, 19 nt, Homo sapiens
ugacaccuaccaggaguuu

SEQ ID NO: 116973 - RNA, 19 nt, Homo sapiens
ucaggaaggacauggacaa

SEQ ID NO: 116974 - RNA, 19 nt, Homo sapiens
ugaccacgcuaugcuccaa

SEQ ID NO: 116975 - RNA, 19 nt, Homo sapiens
agaccuacagcaaguuuga

SEQ ID NO: 116976 - RNA, 19 nt, Homo sapiens
gcgcuuggccucuccuucu

SEQ ID NO: 116977 - RNA, 19 nt, Homo sapiens
ucaccuuauucuucauuuc

SEQ ID NO: 116978 - RNA, 19 nt, Homo sapiens
ccagccuuguccuaauaaa

SEQ ID NO: 116979 - RNA, 19 nt, Homo sapiens
ggagggaggaaaauggaua

SEQ ID NO: 116980 - RNA, 19 nt, Homo sapiens
cgucccugcuccuggcuuu

SEQ ID NO: 116981 - RNA, 19 nt, Homo sapiens
gcaucucccugcugcucau

SEQ ID NO: 116982 - RNA, 19 nt, Homo sapiens
gacuaucaccuccuaaagg

SEQ ID NO: 116983 - RNA, 19 nt, Homo sapiens
uggaggaaacgcaacagaa

SEQ ID NO: 116984 - RNA, 19 nt, Homo sapiens
acuacgggcugcucuacug

SEQ ID NO: 116985 - RNA, 19 nt, Homo sapiens
augacgcacugcucaagaa

SEQ ID NO: 116986 - RNA, 19 nt, Homo sapiens
cuacagcaaguuugacaca

SEQ ID NO: 116987 - RNA, 19 nt, Homo sapiens
uccaaaccguuccguuauc

SEQ ID NO: 116988 - RNA, 19 nt, Homo sapiens
gaaacgcaacagaaaucca

SEQ ID NO: 116989 - RNA, 19 nt, Homo sapiens
ggaaggacauggacaaggu

SEQ ID NO: 116990 - RNA, 19 nt, Homo sapiens
caccagccuuguccuaaua

SEQ ID NO: 116991 - RNA, 19 nt, Homo sapiens
guggacagcucaccuagug

SEQ ID NO: 116992 - RNA, 19 nt, Homo sapiens
caaacucgcacaaccauga

SEQ ID NO: 116993 - RNA, 19 nt, Homo sapiens
gaacuggccaggguauaaa

SEQ ID NO: 116994 - RNA, 19 nt, Homo sapiens
gcuucuaggugcccgagua

SEQ ID NO: 116995 - RNA, 19 nt, Homo sapiens
gggcagcuguggcuucuag

SEQ ID NO: 116996 - RNA, 19 nt, Homo sapiens
uggacaaggucgagacauu

SEQ ID NO: 116997 - RNA, 19 nt, Homo sapiens
gcagaccuacagcaaguuu

SEQ ID NO: 116998 - RNA, 19 nt, Homo sapiens
cguccaaaccguuccguua

SEQ ID NO: 116999 - RNA, 19 nt, Homo sapiens
ggacugggcagauccucaa

SEQ ID NO: 117000 - RNA, 19 nt, Homo sapiens
ccaccagccuuguccuaau

SEQ ID NO: 117001 - RNA, 19 nt, Homo sapiens
ggacaaggucgagacauuc

SEQ ID NO: 117002 - RNA, 19 nt, Homo sapiens
aagcagaccuacagcaagu

SEQ ID NO: 117003 - RNA, 19 nt, Homo sapiens
acgcacugcucaagaacua

SEQ ID NO: 117004 - RNA, 19 nt, Homo sapiens
gggcugcucuacugcuuca

SEQ ID NO: 117005 - RNA, 19 nt, Homo sapiens
cgcaccagcuggccauuga

SEQ ID NO: 117006 - RNA, 19 nt, Homo sapiens
cagcucaccuaguggcaau

SEQ ID NO: 117007 - RNA, 19 nt, Homo sapiens
ucaagcagaccuacagcaa

SEQ ID NO: 117008 - RNA, 19 nt, Homo sapiens
gagggcagcuguggcuucu

SEQ ID NO: 117009 - RNA, 19 nt, Homo sapiens
gaacuacgggcugcucuac

SEQ ID NO: 117010 - RNA, 19 nt, Homo sapiens
gagaacuggccaggguaua

SEQ ID NO: 117011 - RNA, 19 nt, Homo sapiens
guccaaaccguuccguuau

SEQ ID NO: 117012 - RNA, 19 nt, Homo sapiens
agaacuggccaggguauaa

SEQ ID NO: 117013 - RNA, 19 nt, Homo sapiens
ugacaccuaccaggaguuu

SEQ ID NO: 117014 - RNA, 19 nt, Homo sapiens
guuccguuauccaggcuuu

SEQ ID NO: 117015 - RNA, 19 nt, Homo sapiens
ucaggaaggacauggacaa

SEQ ID NO: 117016 - RNA, 19 nt, Homo sapiens
agaccuacagcaaguuuga

SEQ ID NO: 117017 - RNA, 19 nt, Homo sapiens
ugaccacgcuaugcuccaa

SEQ ID NO: 117018 - RNA, 19 nt, Homo sapiens
ccagccuuguccuaauaaa

SEQ ID NO: 117019 - RNA, 19 nt, Homo sapiens
cgucccugcuccuggcuuu

SEQ ID NO: 117020 - RNA, 19 nt, Homo sapiens
acuacgggcugcucuacug

SEQ ID NO: 117021 - RNA, 19 nt, Homo sapiens
augacgcacugcucaagaa

SEQ ID NO: 117022 - RNA, 19 nt, Homo sapiens
acaccuaccaggaguuuag

SEQ ID NO: 117023 - RNA, 19 nt, Homo sapiens
cuacagcaaguuugacaca

SEQ ID NO: 117024 - RNA, 19 nt, Homo sapiens
uccaaaccguuccguuauc

SEQ ID NO: 117025 - RNA, 19 nt, Homo sapiens
ggaaggacauggacaaggu

SEQ ID NO: 117026 - RNA, 19 nt, Homo sapiens
caccagccuuguccuaaua

SEQ ID NO: 117027 - RNA, 19 nt, Homo sapiens
guggacagcucaccuagug

SEQ ID NO: 117028 - RNA, 19 nt, Homo sapiens
caaacucgcacaaccauga

SEQ ID NO: 117029 - RNA, 19 nt, Homo sapiens
gaacuggccaggguauaaa

SEQ ID NO: 117030 - RNA, 19 nt, Homo sapiens
gcuucuaggugcccgagua

SEQ ID NO: 117031 - RNA, 19 nt, Homo sapiens
gggcagcuguggcuucuag

SEQ ID NO: 117032 - RNA, 19 nt, Homo sapiens
uggacaaggucgagacauu

SEQ ID NO: 117033 - RNA, 19 nt, Homo sapiens
gcagaccuacagcaaguuu

SEQ ID NO: 117034 - RNA, 19 nt, Homo sapiens
ggacugggcagauccucaa

SEQ ID NO: 117035 - RNA, 19 nt, Homo sapiens
ccaccagccuuguccuaau

SEQ ID NO: 117036 - RNA, 19 nt, Homo sapiens
ggacaaggucgagacauuc

SEQ ID NO: 117037 - RNA, 19 nt, Homo sapiens
aagcagaccuacagcaagu

SEQ ID NO: 117038 - RNA, 19 nt, Homo sapiens
acgcacugcucaagaacua

SEQ ID NO: 117039 - RNA, 19 nt, Homo sapiens
gggcugcucuacugcuuca

SEQ ID NO: 117040 - RNA, 19 nt, Homo sapiens
cagcucaccuaguggcaau

SEQ ID NO: 117041 - RNA, 19 nt, Homo sapiens
ucaagcagaccuacagcaa

SEQ ID NO: 117042 - RNA, 19 nt, Homo sapiens
gagggcagcuguggcuucu

SEQ ID NO: 117043 - RNA, 19 nt, Homo sapiens
gaacuacgggcugcucuac

SEQ ID NO: 117044 - RNA, 19 nt, Homo sapiens
gagaacuggccaggguaua

SEQ ID NO: 117045 - RNA, 19 nt, Homo sapiens
agaacuggccaggguauaa

SEQ ID NO: 117046 - RNA, 19 nt, Homo sapiens
ucaggaaggacauggacaa

SEQ ID NO: 117047 - RNA, 19 nt, Homo sapiens
agaccuacagcaaguuuga

SEQ ID NO: 117048 - RNA, 19 nt, Homo sapiens
ccagccuuguccuaauaaa

SEQ ID NO: 117049 - RNA, 19 nt, Homo sapiens
acuacgggcugcucuacug

SEQ ID NO: 117050 - RNA, 19 nt, Homo sapiens
augacgcacugcucaagaa

SEQ ID NO: 117051 - RNA, 19 nt, Homo sapiens
cuacagcaaguuugacaca

SEQ ID NO: 117052 - RNA, 19 nt, Homo sapiens
caacagaaauccaaucuag

SEQ ID NO: 117053 - RNA, 19 nt, Homo sapiens
ccaacaaccugguguauga

SEQ ID NO: 117054 - RNA, 19 nt, Homo sapiens
caucagccuuguccuaaua

SEQ ID NO: 117055 - RNA, 19 nt, Homo sapiens
ggaaggacauggacaaggu

SEQ ID NO: 117056 - RNA, 19 nt, Homo sapiens
caaaggaccagaaguauuc

SEQ ID NO: 117057 - RNA, 19 nt, Homo sapiens
ggaggaaacgcaacagaaa

SEQ ID NO: 117058 - RNA, 19 nt, Homo sapiens
aaaccuauaucccaaagga

SEQ ID NO: 117059 - RNA, 19 nt, Homo sapiens
gaacuggccaggguauaaa

SEQ ID NO: 117060 - RNA, 19 nt, Homo sapiens
ggacagcgaugacuaucac

SEQ ID NO: 117061 - RNA, 19 nt, Homo sapiens
caaacucacacaaccauga

SEQ ID NO: 117062 - RNA, 19 nt, Homo sapiens
ccaaaggaccagaaguauu

SEQ ID NO: 117063 - RNA, 19 nt, Homo sapiens
uggacaaggucgagacauu

SEQ ID NO: 117064 - RNA, 19 nt, Homo sapiens
gcagaccuacagcaaguuu

SEQ ID NO: 117065 - RNA, 19 nt, Homo sapiens
cguccaaaccguuccguua

SEQ ID NO: 117066 - RNA, 19 nt, Homo sapiens
gaggguagcuguggcuucu

SEQ ID NO: 117067 - RNA, 19 nt, Homo sapiens
ggacugggcagauccucaa

SEQ ID NO: 117068 - RNA, 19 nt, Homo sapiens
ggacaaggucgagacauuc

SEQ ID NO: 117069 - RNA, 19 nt, Homo sapiens
aagcagaccuacagcaagu

SEQ ID NO: 117070 - RNA, 19 nt, Homo sapiens
cgaugacuaucaccuccua

SEQ ID NO: 117071 - RNA, 19 nt, Homo sapiens
gcaacagaaauccaaucua

SEQ ID NO: 117072 - RNA, 19 nt, Homo sapiens
acgcacugcucaagaacua

SEQ ID NO: 117073 - RNA, 19 nt, Homo sapiens
gaggaaacgcaacagaaau

SEQ ID NO: 117074 - RNA, 19 nt, Homo sapiens
gggcugcucuacugcuuca

SEQ ID NO: 117075 - RNA, 19 nt, Homo sapiens
ccuaaaggaccuagaggaa

SEQ ID NO: 117076 - RNA, 19 nt, Homo sapiens
ggaccagaaguauucauuc

SEQ ID NO: 117077 - RNA, 19 nt, Homo sapiens
ucccaaaggaccagaagua

SEQ ID NO: 117078 - RNA, 19 nt, Homo sapiens
gaccagaaguauucauucc

SEQ ID NO: 117079 - RNA, 19 nt, Homo sapiens
uaccaggaguuugaagaaa

SEQ ID NO: 117080 - RNA, 19 nt, Homo sapiens
cgcaccagcuggccauuga

SEQ ID NO: 117081 - RNA, 19 nt, Homo sapiens
ggguagcuguggcuucuag

SEQ ID NO: 117082 - RNA, 19 nt, Homo sapiens
aaacgcaacagaaauccaa

SEQ ID NO: 117083 - RNA, 19 nt, Homo sapiens
ucaagcagaccuacagcaa

SEQ ID NO: 117084 - RNA, 19 nt, Homo sapiens
acaccuaccaggaguuuga

SEQ ID NO: 117085 - RNA, 19 nt, Homo sapiens
gaacuacgggcugcucuac

SEQ ID NO: 117086 - RNA, 19 nt, Homo sapiens
cagcucaccuagcggcaau

SEQ ID NO: 117087 - RNA, 19 nt, Homo sapiens
acagaaauccaaucuagag

SEQ ID NO: 117088 - RNA, 19 nt, Homo sapiens
gaaguauucauuccugcau

SEQ ID NO: 117089 - RNA, 19 nt, Homo sapiens
agaacuggccaggguauaa

SEQ ID NO: 117090 - RNA, 19 nt, Homo sapiens
gcccaucagccuuguccua

SEQ ID NO: 117091 - RNA, 19 nt, Homo sapiens
gagaacuggccaggguaua

SEQ ID NO: 117092 - RNA, 19 nt, Homo sapiens
guccaaaccguuccguuau

SEQ ID NO: 117093 - RNA, 19 nt, Homo sapiens
ccaucagccuuguccuaau

SEQ ID NO: 117094 - RNA, 19 nt, Homo sapiens
ugacaccuaccaggaguuu

SEQ ID NO: 117095 - RNA, 19 nt, Homo sapiens
gugcagugccgcucuguag

SEQ ID NO: 117096 - RNA, 19 nt, Homo sapiens
cuaccaggaguuugaagaa

SEQ ID NO: 117097 - RNA, 19 nt, Homo sapiens
guuccguuauccaggcuuu

SEQ ID NO: 117098 - RNA, 19 nt, Homo sapiens
agaaaccuauaucccaaag

SEQ ID NO: 117099 - RNA, 19 nt, Homo sapiens
ucaggaaggacauggacaa

SEQ ID NO: 117100 - RNA, 19 nt, Homo sapiens
agaccuacagcaaguuuga

SEQ ID NO: 117101 - RNA, 19 nt, Homo sapiens
ugaccacgcuaugcuccaa

SEQ ID NO: 117102 - RNA, 19 nt, Homo sapiens
cgucccugcuccuggcuuu

SEQ ID NO: 117103 - RNA, 19 nt, Homo sapiens
ugacacaaacucacacaac

SEQ ID NO: 117104 - RNA, 19 nt, Homo sapiens
gcaucucccugcugcucau

SEQ ID NO: 117105 - RNA, 19 nt, Homo sapiens
gacuaucaccuccuaaagg

SEQ ID NO: 117106 - RNA, 19 nt, Homo sapiens
uggaggaaacgcaacagaa

SEQ ID NO: 117107 - RNA, 19 nt, Homo sapiens
acuacgggcugcucuacug

SEQ ID NO: 117108 - RNA, 19 nt, Homo sapiens
augacgcacugcucaagaa

SEQ ID NO: 117109 - RNA, 19 nt, Homo sapiens
ucagccuuguccuaauaaa

SEQ ID NO: 117110 - RNA, 19 nt, Homo sapiens
cuacagcaaguuugacaca

SEQ ID NO: 117111 - RNA, 19 nt, Homo sapiens
uccaaaccguuccguuauc

SEQ ID NO: 117112 - RNA, 19 nt, Homo sapiens
gaaacgcaacagaaaucca

SEQ ID NO: 117113 - RNA, 19 nt, Homo sapiens
cccaucagccuuguccuaa

SEQ ID NO: 117114 - RNA, 19 nt, Homo sapiens
caagagaacucaccuuauu

SEQ ID NO: 117115 - RNA, 19 nt, Homo sapiens
gaaacaugcugcccucuuu

SEQ ID NO: 117116 - RNA, 19 nt, Homo sapiens
gaacucaccuuauucuuca

SEQ ID NO: 117117 - RNA, 19 nt, Homo sapiens
caacagaaauccaaucuag

SEQ ID NO: 117118 - RNA, 19 nt, Homo sapiens
ccaacaaccugguguauga

SEQ ID NO: 117119 - RNA, 19 nt, Homo sapiens
caucagccuuguccuaaua

SEQ ID NO: 117120 - RNA, 19 nt, Homo sapiens
ggaaggacauggacaaggu

SEQ ID NO: 117121 - RNA, 19 nt, Homo sapiens
caaaggaccagaaguauuc

SEQ ID NO: 117122 - RNA, 19 nt, Homo sapiens
ggaggaaacgcaacagaaa

SEQ ID NO: 117123 - RNA, 19 nt, Homo sapiens
aaaccuauaucccaaagga

SEQ ID NO: 117124 - RNA, 19 nt, Homo sapiens
ggacagcgaugacuaucac

SEQ ID NO: 117125 - RNA, 19 nt, Homo sapiens
gaacuggccaggguauaaa

SEQ ID NO: 117126 - RNA, 19 nt, Homo sapiens
caaacucacacaaccauga

SEQ ID NO: 117127 - RNA, 19 nt, Homo sapiens
ccaaaggaccagaaguauu

SEQ ID NO: 117128 - RNA, 19 nt, Homo sapiens
uggacaaggucgagacauu

SEQ ID NO: 117129 - RNA, 19 nt, Homo sapiens
ggaggaaaauggaugaaug

SEQ ID NO: 117130 - RNA, 19 nt, Homo sapiens
gcagaccuacagcaaguuu

SEQ ID NO: 117131 - RNA, 19 nt, Homo sapiens
cccaagagaacucaccuua

SEQ ID NO: 117132 - RNA, 19 nt, Homo sapiens
cguccaaaccguuccguua

SEQ ID NO: 117133 - RNA, 19 nt, Homo sapiens
gaggguagcuguggcuucu

SEQ ID NO: 117134 - RNA, 19 nt, Homo sapiens
ggacugggcagauccucaa

SEQ ID NO: 117135 - RNA, 19 nt, Homo sapiens
ggacaaggucgagacauuc

SEQ ID NO: 117136 - RNA, 19 nt, Homo sapiens
aagcagaccuacagcaagu

SEQ ID NO: 117137 - RNA, 19 nt, Homo sapiens
cgaugacuaucaccuccua

SEQ ID NO: 117138 - RNA, 19 nt, Homo sapiens
gcaacagaaauccaaucua

SEQ ID NO: 117139 - RNA, 19 nt, Homo sapiens
acgcacugcucaagaacua

SEQ ID NO: 117140 - RNA, 19 nt, Homo sapiens
gaggaaacgcaacagaaau

SEQ ID NO: 117141 - RNA, 19 nt, Homo sapiens
gggcugcucuacugcuuca

SEQ ID NO: 117142 - RNA, 19 nt, Homo sapiens
ccuaaaggaccuagaggaa

SEQ ID NO: 117143 - RNA, 19 nt, Homo sapiens
ggaccagaaguauucauuc

SEQ ID NO: 117144 - RNA, 19 nt, Homo sapiens
ucccaaaggaccagaagua

SEQ ID NO: 117145 - RNA, 19 nt, Homo sapiens
ccaagagaacucaccuuau

SEQ ID NO: 117146 - RNA, 19 nt, Homo sapiens
cgcaccagcuggccauuga

SEQ ID NO: 117147 - RNA, 19 nt, Homo sapiens
gaccagaaguauucauucc

SEQ ID NO: 117148 - RNA, 19 nt, Homo sapiens
uaccaggaguuugaagaaa

SEQ ID NO: 117149 - RNA, 19 nt, Homo sapiens
ggguagcuguggcuucuag

SEQ ID NO: 117150 - RNA, 19 nt, Homo sapiens
aaacgcaacagaaauccaa

SEQ ID NO: 117151 - RNA, 19 nt, Homo sapiens
ucaagcagaccuacagcaa

SEQ ID NO: 117152 - RNA, 19 nt, Homo sapiens
acaccuaccaggaguuuga

SEQ ID NO: 117153 - RNA, 19 nt, Homo sapiens
gaacuacgggcugcucuac

SEQ ID NO: 117154 - RNA, 19 nt, Homo sapiens
acagaaauccaaucuagag

SEQ ID NO: 117155 - RNA, 19 nt, Homo sapiens
cagcucaccuagcggcaau

SEQ ID NO: 117156 - RNA, 19 nt, Homo sapiens
gaaguauucauuccugcau

SEQ ID NO: 117157 - RNA, 19 nt, Homo sapiens
gcccaucagccuuguccua

SEQ ID NO: 117158 - RNA, 19 nt, Homo sapiens
agaacuggccaggguauaa

SEQ ID NO: 117159 - RNA, 19 nt, Homo sapiens
gagaacuggccaggguaua

SEQ ID NO: 117160 - RNA, 19 nt, Homo sapiens
guccaaaccguuccguuau

SEQ ID NO: 117161 - RNA, 19 nt, Homo sapiens
ccaucagccuuguccuaau

SEQ ID NO: 117162 - RNA, 19 nt, Homo sapiens
agaaaccuauaucccaaag

SEQ ID NO: 117163 - RNA, 19 nt, Homo sapiens
cuaccaggaguuugaagaa

SEQ ID NO: 117164 - RNA, 19 nt, Homo sapiens
gugcagugccgcucuguag

SEQ ID NO: 117165 - RNA, 19 nt, Homo sapiens
ugacaccuaccaggaguuu

SEQ ID NO: 117166 - RNA, 19 nt, Homo sapiens
guuccguuauccaggcuuu

SEQ ID NO: 117167 - RNA, 19 nt, Homo sapiens
ucaggaaggacauggacaa

SEQ ID NO: 117168 - RNA, 19 nt, Homo sapiens
ugaccacgcuaugcuccaa

SEQ ID NO: 117169 - RNA, 19 nt, Homo sapiens
agaccuacagcaaguuuga

SEQ ID NO: 117170 - RNA, 19 nt, Homo sapiens
gcgcuuggccucuccuucu

SEQ ID NO: 117171 - RNA, 19 nt, Homo sapiens
ucaccuuauucuucauuuc

SEQ ID NO: 117172 - RNA, 19 nt, Homo sapiens
ggaaaauggaugaaugaga

SEQ ID NO: 117173 - RNA, 19 nt, Homo sapiens
gaggaaaauggaugaauga

SEQ ID NO: 117174 - RNA, 19 nt, Homo sapiens
ugacacaaacucacacaac

SEQ ID NO: 117175 - RNA, 19 nt, Homo sapiens
gaaccccacuggcuuagag

SEQ ID NO: 117176 - RNA, 19 nt, Homo sapiens
gcaucucccugcugcucau

SEQ ID NO: 117177 - RNA, 19 nt, Homo sapiens
cgucccugcuccuggcuuu

SEQ ID NO: 117178 - RNA, 19 nt, Homo sapiens
aaacaugcugcccucuuug

SEQ ID NO: 117179 - RNA, 19 nt, Homo sapiens
gacuaucaccuccuaaagg

SEQ ID NO: 117180 - RNA, 19 nt, Homo sapiens
uggaggaaacgcaacagaa

SEQ ID NO: 117181 - RNA, 19 nt, Homo sapiens
acuacgggcugcucuacug

SEQ ID NO: 117182 - RNA, 19 nt, Homo sapiens
augacgcacugcucaagaa

SEQ ID NO: 117183 - RNA, 19 nt, Homo sapiens
ucagccuuguccuaauaaa

SEQ ID NO: 117184 - RNA, 19 nt, Homo sapiens
uccaaaccguuccguuauc

SEQ ID NO: 117185 - RNA, 19 nt, Homo sapiens
cuacagcaaguuugacaca

SEQ ID NO: 117186 - RNA, 19 nt, Homo sapiens
gaaacgcaacagaaaucca

SEQ ID NO: 117187 - RNA, 19 nt, Homo sapiens
cccaucagccuuguccuaa

SEQ ID NO: 117188 - RNA, 19 nt, Homo sapiens
caucagccuuguccuaaua

SEQ ID NO: 117189 - RNA, 19 nt, Homo sapiens
ggaaggacauggacaaggu

SEQ ID NO: 117190 - RNA, 19 nt, Homo sapiens
gaacuggccaggguauaaa

SEQ ID NO: 117191 - RNA, 19 nt, Homo sapiens
caaacucacacaaccauga

SEQ ID NO: 117192 - RNA, 19 nt, Homo sapiens
uggacaaggucgagacauu

SEQ ID NO: 117193 - RNA, 19 nt, Homo sapiens
gcagaccuacagcaaguuu

SEQ ID NO: 117194 - RNA, 19 nt, Homo sapiens
cguccaaaccguuccguua

SEQ ID NO: 117195 - RNA, 19 nt, Homo sapiens
gaggguagcuguggcuucu

SEQ ID NO: 117196 - RNA, 19 nt, Homo sapiens
ggacugggcagauccucaa

SEQ ID NO: 117197 - RNA, 19 nt, Homo sapiens
ggacaaggucgagacauuc

SEQ ID NO: 117198 - RNA, 19 nt, Homo sapiens
aagcagaccuacagcaagu

SEQ ID NO: 117199 - RNA, 19 nt, Homo sapiens
acgcacugcucaagaacua

SEQ ID NO: 117200 - RNA, 19 nt, Homo sapiens
gggcugcucuacugcuuca

SEQ ID NO: 117201 - RNA, 19 nt, Homo sapiens
cgcaccagcuggccauuga

SEQ ID NO: 117202 - RNA, 19 nt, Homo sapiens
ggguagcuguggcuucuag

SEQ ID NO: 117203 - RNA, 19 nt, Homo sapiens
ucaagcagaccuacagcaa

SEQ ID NO: 117204 - RNA, 19 nt, Homo sapiens
gaacuacgggcugcucuac

SEQ ID NO: 117205 - RNA, 19 nt, Homo sapiens
cagcucaccuagcggcaau

SEQ ID NO: 117206 - RNA, 19 nt, Homo sapiens
gcccaucagccuuguccua

SEQ ID NO: 117207 - RNA, 19 nt, Homo sapiens
gagaacuggccaggguaua

SEQ ID NO: 117208 - RNA, 19 nt, Homo sapiens
agaacuggccaggguauaa

SEQ ID NO: 117209 - RNA, 19 nt, Homo sapiens
guccaaaccguuccguuau

SEQ ID NO: 117210 - RNA, 19 nt, Homo sapiens
ccaucagccuuguccuaau

SEQ ID NO: 117211 - RNA, 19 nt, Homo sapiens
gugcagugccgcucuguag

SEQ ID NO: 117212 - RNA, 19 nt, Homo sapiens
ugacaccuaccaggaguuu

SEQ ID NO: 117213 - RNA, 19 nt, Homo sapiens
guuccguuauccaggcuuu

SEQ ID NO: 117214 - RNA, 19 nt, Homo sapiens
ucaggaaggacauggacaa

SEQ ID NO: 117215 - RNA, 19 nt, Homo sapiens
agaccuacagcaaguuuga

SEQ ID NO: 117216 - RNA, 19 nt, Homo sapiens
ugaccacgcuaugcuccaa

SEQ ID NO: 117217 - RNA, 19 nt, Homo sapiens
cgucccugcuccuggcuuu

SEQ ID NO: 117218 - RNA, 19 nt, Homo sapiens
ugacacaaacucacacaac

SEQ ID NO: 117219 - RNA, 19 nt, Homo sapiens
acuacgggcugcucuacug

SEQ ID NO: 117220 - RNA, 19 nt, Homo sapiens
augacgcacugcucaagaa

SEQ ID NO: 117221 - RNA, 19 nt, Homo sapiens
acaccuaccaggaguuuag

SEQ ID NO: 117222 - RNA, 19 nt, Homo sapiens
ucagccuuguccuaauaaa

SEQ ID NO: 117223 - RNA, 19 nt, Homo sapiens
uccaaaccguuccguuauc

SEQ ID NO: 117224 - RNA, 19 nt, Homo sapiens
cuacagcaaguuugacaca

SEQ ID NO: 117225 - RNA, 19 nt, Homo sapiens
cccaucagccuuguccuaa

SEQ ID NO: 117226 - RNA, 19 nt, Homo sapiens
caucagccuuguccuaaua

SEQ ID NO: 117227 - RNA, 19 nt, Homo sapiens
ggaaggacauggacaaggu

SEQ ID NO: 117228 - RNA, 19 nt, Homo sapiens
gaacuggccaggguauaaa

SEQ ID NO: 117229 - RNA, 19 nt, Homo sapiens
caaacucacacaaccauga

SEQ ID NO: 117230 - RNA, 19 nt, Homo sapiens
uggacaaggucgagacauu

SEQ ID NO: 117231 - RNA, 19 nt, Homo sapiens
gcagaccuacagcaaguuu

SEQ ID NO: 117232 - RNA, 19 nt, Homo sapiens
gaggguagcuguggcuucu

SEQ ID NO: 117233 - RNA, 19 nt, Homo sapiens
ggacugggcagauccucaa

SEQ ID NO: 117234 - RNA, 19 nt, Homo sapiens
ggacaaggucgagacauuc

SEQ ID NO: 117235 - RNA, 19 nt, Homo sapiens
aagcagaccuacagcaagu

SEQ ID NO: 117236 - RNA, 19 nt, Homo sapiens
acgcacugcucaagaacua

SEQ ID NO: 117237 - RNA, 19 nt, Homo sapiens
gggcugcucuacugcuuca

SEQ ID NO: 117238 - RNA, 19 nt, Homo sapiens
ggguagcuguggcuucuag

SEQ ID NO: 117239 - RNA, 19 nt, Homo sapiens
ucaagcagaccuacagcaa

SEQ ID NO: 117240 - RNA, 19 nt, Homo sapiens
cagcucaccuagcggcaau

SEQ ID NO: 117241 - RNA, 19 nt, Homo sapiens
gaacuacgggcugcucuac

SEQ ID NO: 117242 - RNA, 19 nt, Homo sapiens
gcccaucagccuuguccua

SEQ ID NO: 117243 - RNA, 19 nt, Homo sapiens
gagaacuggccaggguaua

SEQ ID NO: 117244 - RNA, 19 nt, Homo sapiens
agaacuggccaggguauaa

SEQ ID NO: 117245 - RNA, 19 nt, Homo sapiens
ccaucagccuuguccuaau

SEQ ID NO: 117246 - RNA, 19 nt, Homo sapiens
gugcagugccgcucuguag

SEQ ID NO: 117247 - RNA, 19 nt, Homo sapiens
ucaggaaggacauggacaa

SEQ ID NO: 117248 - RNA, 19 nt, Homo sapiens
agaccuacagcaaguuuga

SEQ ID NO: 117249 - RNA, 19 nt, Homo sapiens
ugacacaaacucacacaac

SEQ ID NO: 117250 - RNA, 19 nt, Homo sapiens
acuacgggcugcucuacug

SEQ ID NO: 117251 - RNA, 19 nt, Homo sapiens
augacgcacugcucaagaa

SEQ ID NO: 117252 - RNA, 19 nt, Homo sapiens
ucagccuuguccuaauaaa

SEQ ID NO: 117253 - RNA, 19 nt, Homo sapiens
cuacagcaaguuugacaca

SEQ ID NO: 117254 - RNA, 19 nt, Homo sapiens
cccaucagccuuguccuaa

SEQ ID NO: 117255 - RNA, 19 nt, Homo sapiens
ccaacaaccugguguauga

SEQ ID NO: 117256 - RNA, 19 nt, Homo sapiens
gaagaagccuauaucacaa

SEQ ID NO: 117257 - RNA, 19 nt, Homo sapiens
ggaagaagccuauaucaca

SEQ ID NO: 117258 - RNA, 19 nt, Homo sapiens
caaaggaacagaaguauuc

SEQ ID NO: 117259 - RNA, 19 nt, Homo sapiens
ggaaggacauggacaaggu

SEQ ID NO: 117260 - RNA, 19 nt, Homo sapiens
gaacagaaguauucauucc

SEQ ID NO: 117261 - RNA, 19 nt, Homo sapiens
ggcaauggcugcaggaaga

SEQ ID NO: 117262 - RNA, 19 nt, Homo sapiens
caccagccuugucuuaaua

SEQ ID NO: 117263 - RNA, 19 nt, Homo sapiens
ucacaaaggaacagaagua

SEQ ID NO: 117264 - RNA, 19 nt, Homo sapiens
cagcagaaauccaacuuag

SEQ ID NO: 117265 - RNA, 19 nt, Homo sapiens
gcagaaauccaacuuagag

SEQ ID NO: 117266 - RNA, 19 nt, Homo sapiens
caaacucgcacaaccauga

SEQ ID NO: 117267 - RNA, 19 nt, Homo sapiens
ggacagcgaugacuaucac

SEQ ID NO: 117268 - RNA, 19 nt, Homo sapiens
ggaguaccuucaccaacaa

SEQ ID NO: 117269 - RNA, 19 nt, Homo sapiens
ccaccagccuugucuuaau

SEQ ID NO: 117270 - RNA, 19 nt, Homo sapiens
gcagcagaaauccaacuua

SEQ ID NO: 117271 - RNA, 19 nt, Homo sapiens
gggcagcuguggcuucuag

SEQ ID NO: 117272 - RNA, 19 nt, Homo sapiens
ggaggaaacgcagcagaaa

SEQ ID NO: 117273 - RNA, 19 nt, Homo sapiens
uggacaaggucgagacauu

SEQ ID NO: 117274 - RNA, 19 nt, Homo sapiens
gcaggaagaagccuauauc

SEQ ID NO: 117275 - RNA, 19 nt, Homo sapiens
gcagaccuacagcaaguuu

SEQ ID NO: 117276 - RNA, 19 nt, Homo sapiens
ggacaaggucgagacauuc

SEQ ID NO: 117277 - RNA, 19 nt, Homo sapiens
aagcagaccuacagcaagu

SEQ ID NO: 117278 - RNA, 19 nt, Homo sapiens
cgaugacuaucaccuccua

SEQ ID NO: 117279 - RNA, 19 nt, Homo sapiens
acgcacugcucaagaacua

SEQ ID NO: 117280 - RNA, 19 nt, Homo sapiens
gcccaccagccuugucuua

SEQ ID NO: 117281 - RNA, 19 nt, Homo sapiens
aagccuauaucacaaagga

SEQ ID NO: 117282 - RNA, 19 nt, Homo sapiens
aaacgcagcagaaauccaa

SEQ ID NO: 117283 - RNA, 19 nt, Homo sapiens
ggaacagaaguauucauuc

SEQ ID NO: 117284 - RNA, 19 nt, Homo sapiens
aggaguaccuucaccaaca

SEQ ID NO: 117285 - RNA, 19 nt, Homo sapiens
gaggaaacgcagcagaaau

SEQ ID NO: 117286 - RNA, 19 nt, Homo sapiens
ccuaaaggaccuagaggaa

SEQ ID NO: 117287 - RNA, 19 nt, Homo sapiens
ucaagcagaccuacagcaa

SEQ ID NO: 117288 - RNA, 19 nt, Homo sapiens
gagggcagcuguggcuucu

SEQ ID NO: 117289 - RNA, 19 nt, Homo sapiens
agaggaaggcauccaaaug

SEQ ID NO: 117290 - RNA, 19 nt, Homo sapiens
cagcucaccuagcggcaau

SEQ ID NO: 117291 - RNA, 19 nt, Homo sapiens
gaaguauucauuccugcau

SEQ ID NO: 117292 - RNA, 19 nt, Homo sapiens
acaaaggaacagaaguauu

SEQ ID NO: 117293 - RNA, 19 nt, Homo sapiens
aggaacagaaguauucauu

SEQ ID NO: 117294 - RNA, 19 nt, Homo sapiens
cagacucuauuccgacauc

SEQ ID NO: 117295 - RNA, 19 nt, Homo sapiens
ccagccuugucuuaauaaa

SEQ ID NO: 117296 - RNA, 19 nt, Homo sapiens
caggaagaagccuauauca

SEQ ID NO: 117297 - RNA, 19 nt, Homo sapiens
ucaggaaggacauggacaa

SEQ ID NO: 117298 - RNA, 19 nt, Homo sapiens
agaccuacagcaaguuuga

SEQ ID NO: 117299 - RNA, 19 nt, Homo sapiens
gcaauggcugcaggaagaa

SEQ ID NO: 117300 - RNA, 19 nt, Homo sapiens
aggaaacgcagcagaaauc

SEQ ID NO: 117301 - RNA, 19 nt, Homo sapiens
gacuaucaccuccuaaagg

SEQ ID NO: 117302 - RNA, 19 nt, Homo sapiens
augacgcacugcucaagaa

SEQ ID NO: 117303 - RNA, 19 nt, Homo sapiens
ugacugggcagacccucaa

SEQ ID NO: 117304 - RNA, 19 nt, Homo sapiens
cuacagcaaguuugacaca

SEQ ID NO: 117305 - RNA, 19 nt, Homo sapiens
uagaggaaggcauccaaau

SEQ ID NO: 117306 - RNA, 19 nt, Homo sapiens
aagaagccuauaucacaaa

SEQ ID NO: 117307 - RNA, 19 nt, Homo sapiens
uggaggaaacgcagcagaa

SEQ ID NO: 117308 - RNA, 19 nt, Homo sapiens
cacaaaggaacagaaguau

SEQ ID NO: 117309 - RNA, 19 nt, Homo sapiens
ggaaggacauggacaaggu

SEQ ID NO: 117310 - RNA, 19 nt, Homo sapiens
caccagccuugucuuaaua

SEQ ID NO: 117311 - RNA, 19 nt, Homo sapiens
caaacucgcacaaccauga

SEQ ID NO: 117312 - RNA, 19 nt, Homo sapiens
ccaccagccuugucuuaau

SEQ ID NO: 117313 - RNA, 19 nt, Homo sapiens
gggcagcuguggcuucuag

SEQ ID NO: 117314 - RNA, 19 nt, Homo sapiens
uggacaaggucgagacauu

SEQ ID NO: 117315 - RNA, 19 nt, Homo sapiens
gcagaccuacagcaaguuu

SEQ ID NO: 117316 - RNA, 19 nt, Homo sapiens
ggacaaggucgagacauuc

SEQ ID NO: 117317 - RNA, 19 nt, Homo sapiens
aagcagaccuacagcaagu

SEQ ID NO: 117318 - RNA, 19 nt, Homo sapiens
acgcacugcucaagaacua

SEQ ID NO: 117319 - RNA, 19 nt, Homo sapiens
gcccaccagccuugucuua

SEQ ID NO: 117320 - RNA, 19 nt, Homo sapiens
ucaagcagaccuacagcaa

SEQ ID NO: 117321 - RNA, 19 nt, Homo sapiens
gagggcagcuguggcuucu

SEQ ID NO: 117322 - RNA, 19 nt, Homo sapiens
cagcucaccuagcggcaau

SEQ ID NO: 117323 - RNA, 19 nt, Homo sapiens
ccagccuugucuuaauaaa

SEQ ID NO: 117324 - RNA, 19 nt, Homo sapiens
ucaggaaggacauggacaa

SEQ ID NO: 117325 - RNA, 19 nt, Homo sapiens
agaccuacagcaaguuuga

SEQ ID NO: 117326 - RNA, 19 nt, Homo sapiens
ugacugggcagacccucaa

SEQ ID NO: 117327 - RNA, 19 nt, Homo sapiens
augacgcacugcucaagaa

SEQ ID NO: 117328 - RNA, 19 nt, Homo sapiens
cuacagcaaguuugacaca

SEQ ID NO: 117329 - RNA, 19 nt, Homo sapiens
ccaacaaccugguguauga

SEQ ID NO: 117330 - RNA, 19 nt, Homo sapiens
caaaggaacagaaguauuc

SEQ ID NO: 117331 - RNA, 19 nt, Homo sapiens
ggaaggacauggacaaggu

SEQ ID NO: 117332 - RNA, 19 nt, Homo sapiens
gaacagaaguauucauucc

SEQ ID NO: 117333 - RNA, 19 nt, Homo sapiens
caccagccuugucuuaaua

SEQ ID NO: 117334 - RNA, 19 nt, Homo sapiens
ucacaaaggaacagaagua

SEQ ID NO: 117335 - RNA, 19 nt, Homo sapiens
cagcagaaauccaacuuag

SEQ ID NO: 117336 - RNA, 19 nt, Homo sapiens
gcagaaauccaacuuagag

SEQ ID NO: 117337 - RNA, 19 nt, Homo sapiens
caaacucgcacaaccauga

SEQ ID NO: 117338 - RNA, 19 nt, Homo sapiens
ggacagcgaugacuaucac

SEQ ID NO: 117339 - RNA, 19 nt, Homo sapiens
ggaguaccuucaccaacaa

SEQ ID NO: 117340 - RNA, 19 nt, Homo sapiens
ccaccagccuugucuuaau

SEQ ID NO: 117341 - RNA, 19 nt, Homo sapiens
gcagcagaaauccaacuua

SEQ ID NO: 117342 - RNA, 19 nt, Homo sapiens
ggaauggaagccuauauca

SEQ ID NO: 117343 - RNA, 19 nt, Homo sapiens
uaaagaggcuaugcuccaa

SEQ ID NO: 117344 - RNA, 19 nt, Homo sapiens
gggcagcuguggcuucuag

SEQ ID NO: 117345 - RNA, 19 nt, Homo sapiens
ggaggaaacgcagcagaaa

SEQ ID NO: 117346 - RNA, 19 nt, Homo sapiens
cacaccagcuggccauuga

SEQ ID NO: 117347 - RNA, 19 nt, Homo sapiens
uggacaaggucgagacauu

SEQ ID NO: 117348 - RNA, 19 nt, Homo sapiens
cguccaaaccguucccuua

SEQ ID NO: 117349 - RNA, 19 nt, Homo sapiens
gcagaccuacagcaaguuu

SEQ ID NO: 117350 - RNA, 19 nt, Homo sapiens
ggaagccuauaucacaaag

SEQ ID NO: 117351 - RNA, 19 nt, Homo sapiens
ggacaaggucgagacauuc

SEQ ID NO: 117352 - RNA, 19 nt, Homo sapiens
aagcagaccuacagcaagu

SEQ ID NO: 117353 - RNA, 19 nt, Homo sapiens
cgaugacuaucaccuccua

SEQ ID NO: 117354 - RNA, 19 nt, Homo sapiens
acgcacugcucaagaacua

SEQ ID NO: 117355 - RNA, 19 nt, Homo sapiens
gcccaccagccuugucuua

SEQ ID NO: 117356 - RNA, 19 nt, Homo sapiens
aaacgcagcagaaauccaa

SEQ ID NO: 117357 - RNA, 19 nt, Homo sapiens
ggaacagaaguauucauuc

SEQ ID NO: 117358 - RNA, 19 nt, Homo sapiens
aagccuauaucacaaagga

SEQ ID NO: 117359 - RNA, 19 nt, Homo sapiens
aggaguaccuucaccaaca

SEQ ID NO: 117360 - RNA, 19 nt, Homo sapiens
gaggaaacgcagcagaaau

SEQ ID NO: 117361 - RNA, 19 nt, Homo sapiens
ccuaaaggaccuagaggaa

SEQ ID NO: 117362 - RNA, 19 nt, Homo sapiens
gcacaccagcuggccauug

SEQ ID NO: 117363 - RNA, 19 nt, Homo sapiens
aauggaagccuauaucaca

SEQ ID NO: 117364 - RNA, 19 nt, Homo sapiens
gggaauggaagccuauauc

SEQ ID NO: 117365 - RNA, 19 nt, Homo sapiens
ucaagcagaccuacagcaa

SEQ ID NO: 117366 - RNA, 19 nt, Homo sapiens
ccaaaccguucccuuaucc

SEQ ID NO: 117367 - RNA, 19 nt, Homo sapiens
gagggcagcuguggcuucu

SEQ ID NO: 117368 - RNA, 19 nt, Homo sapiens
agaggaaggcauccaaaug

SEQ ID NO: 117369 - RNA, 19 nt, Homo sapiens
acaccuaccaggaguuuau

SEQ ID NO: 117370 - RNA, 19 nt, Homo sapiens
cagcucaccuagcggcaau

SEQ ID NO: 117371 - RNA, 19 nt, Homo sapiens
gaaguauucauuccugcau

SEQ ID NO: 117372 - RNA, 19 nt, Homo sapiens
guccaaaccguucccuuau

SEQ ID NO: 117373 - RNA, 19 nt, Homo sapiens
acaaaggaacagaaguauu

SEQ ID NO: 117374 - RNA, 19 nt, Homo sapiens
cagacucuauuccgacauc

SEQ ID NO: 117375 - RNA, 19 nt, Homo sapiens
aggaacagaaguauucauu

SEQ ID NO: 117376 - RNA, 19 nt, Homo sapiens
ccagccuugucuuaauaaa

SEQ ID NO: 117377 - RNA, 19 nt, Homo sapiens
ugacaccuaccaggaguuu

SEQ ID NO: 117378 - RNA, 19 nt, Homo sapiens
ucaggaaggacauggacaa

SEQ ID NO: 117379 - RNA, 19 nt, Homo sapiens
agaccuacagcaaguuuga

SEQ ID NO: 117380 - RNA, 19 nt, Homo sapiens
uaccaggaguuuauaagcu

SEQ ID NO: 117381 - RNA, 19 nt, Homo sapiens
gaauggaagccuauaucac

SEQ ID NO: 117382 - RNA, 19 nt, Homo sapiens
aggaaacgcagcagaaauc

SEQ ID NO: 117383 - RNA, 19 nt, Homo sapiens
cgucccugcuccuggcuuu

SEQ ID NO: 117384 - RNA, 19 nt, Homo sapiens
gacuaucaccuccuaaagg

SEQ ID NO: 117385 - RNA, 19 nt, Homo sapiens
augacgcacugcucaagaa

SEQ ID NO: 117386 - RNA, 19 nt, Homo sapiens
ugacugggcagacccucaa

SEQ ID NO: 117387 - RNA, 19 nt, Homo sapiens
uccaaaccguucccuuauc

SEQ ID NO: 117388 - RNA, 19 nt, Homo sapiens
cuacagcaaguuugacaca

SEQ ID NO: 117389 - RNA, 19 nt, Homo sapiens
uagaggaaggcauccaaau

SEQ ID NO: 117390 - RNA, 19 nt, Homo sapiens
uggaggaaacgcagcagaa

SEQ ID NO: 117391 - RNA, 19 nt, Homo sapiens
cacaaaggaacagaaguau

SEQ ID NO: 117392 - RNA, 19 nt, Homo sapiens
ccaacaaccugguguauga

SEQ ID NO: 117393 - RNA, 19 nt, Homo sapiens
ggaaggacauggacaaggu

SEQ ID NO: 117394 - RNA, 19 nt, Homo sapiens
caccagccuugucuuaaua

SEQ ID NO: 117395 - RNA, 19 nt, Homo sapiens
cagcagaaauccaacuuag

SEQ ID NO: 117396 - RNA, 19 nt, Homo sapiens
gcagaaauccaacuuagag

SEQ ID NO: 117397 - RNA, 19 nt, Homo sapiens
caaacucgcacaaccauga

SEQ ID NO: 117398 - RNA, 19 nt, Homo sapiens
ggacagcgaugacuaucac

SEQ ID NO: 117399 - RNA, 19 nt, Homo sapiens
ggaguaccuucaccaacaa

SEQ ID NO: 117400 - RNA, 19 nt, Homo sapiens
ggcaauggcugcagacucu

SEQ ID NO: 117401 - RNA, 19 nt, Homo sapiens
ccaccagccuugucuuaau

SEQ ID NO: 117402 - RNA, 19 nt, Homo sapiens
gcagcagaaauccaacuua

SEQ ID NO: 117403 - RNA, 19 nt, Homo sapiens
gggcagcuguggcuucuag

SEQ ID NO: 117404 - RNA, 19 nt, Homo sapiens
ggaggaaacgcagcagaaa

SEQ ID NO: 117405 - RNA, 19 nt, Homo sapiens
uggacaaggucgagacauu

SEQ ID NO: 117406 - RNA, 19 nt, Homo sapiens
gcagaccuacagcaaguuu

SEQ ID NO: 117407 - RNA, 19 nt, Homo sapiens
ggacaaggucgagacauuc

SEQ ID NO: 117408 - RNA, 19 nt, Homo sapiens
aagcagaccuacagcaagu

SEQ ID NO: 117409 - RNA, 19 nt, Homo sapiens
cgaugacuaucaccuccua

SEQ ID NO: 117410 - RNA, 19 nt, Homo sapiens
acgcacugcucaagaacua

SEQ ID NO: 117411 - RNA, 19 nt, Homo sapiens
gcccaccagccuugucuua

SEQ ID NO: 117412 - RNA, 19 nt, Homo sapiens
aaacgcagcagaaauccaa

SEQ ID NO: 117413 - RNA, 19 nt, Homo sapiens
gaggaaacgcagcagaaau

SEQ ID NO: 117414 - RNA, 19 nt, Homo sapiens
aggaguaccuucaccaaca

SEQ ID NO: 117415 - RNA, 19 nt, Homo sapiens
ccuaaaggaccuagaggaa

SEQ ID NO: 117416 - RNA, 19 nt, Homo sapiens
ucaagcagaccuacagcaa

SEQ ID NO: 117417 - RNA, 19 nt, Homo sapiens
gagggcagcuguggcuucu

SEQ ID NO: 117418 - RNA, 19 nt, Homo sapiens
agaggaaggcauccaaaug

SEQ ID NO: 117419 - RNA, 19 nt, Homo sapiens
cagcucaccuagcggcaau

SEQ ID NO: 117420 - RNA, 19 nt, Homo sapiens
cagacucuauuccgacauc

SEQ ID NO: 117421 - RNA, 19 nt, Homo sapiens
ccagccuugucuuaauaaa

SEQ ID NO: 117422 - RNA, 19 nt, Homo sapiens
ucaggaaggacauggacaa

SEQ ID NO: 117423 - RNA, 19 nt, Homo sapiens
agaccuacagcaaguuuga

SEQ ID NO: 117424 - RNA, 19 nt, Homo sapiens
aggaaacgcagcagaaauc

SEQ ID NO: 117425 - RNA, 19 nt, Homo sapiens
gacuaucaccuccuaaagg

SEQ ID NO: 117426 - RNA, 19 nt, Homo sapiens
augacgcacugcucaagaa

SEQ ID NO: 117427 - RNA, 19 nt, Homo sapiens
ugacugggcagacccucaa

SEQ ID NO: 117428 - RNA, 19 nt, Homo sapiens
cuacagcaaguuugacaca

SEQ ID NO: 117429 - RNA, 19 nt, Homo sapiens
uagaggaaggcauccaaau

SEQ ID NO: 117430 - RNA, 19 nt, Homo sapiens
uggaggaaacgcagcagaa

SEQ ID NO: 117431 - RNA, 19 nt, Homo sapiens
caauggcugcagacucuau

SEQ ID NO: 117432 - RNA, 19 nt, Homo sapiens
ccaacaaccugguguauga

SEQ ID NO: 117433 - RNA, 19 nt, Homo sapiens
ggaaggacauggacaaggu

SEQ ID NO: 117434 - RNA, 19 nt, Homo sapiens
caccagccuugucuuaaua

SEQ ID NO: 117435 - RNA, 19 nt, Homo sapiens
cagcagaaauccaacuuag

SEQ ID NO: 117436 - RNA, 19 nt, Homo sapiens
gcagaaauccaacuuagag

SEQ ID NO: 117437 - RNA, 19 nt, Homo sapiens
caaacucgcacaaccauga

SEQ ID NO: 117438 - RNA, 19 nt, Homo sapiens
ggacagcgaugacuaucac

SEQ ID NO: 117439 - RNA, 19 nt, Homo sapiens
ggaguaccuucaccaacaa

SEQ ID NO: 117440 - RNA, 19 nt, Homo sapiens
ccaccagccuugucuuaau

SEQ ID NO: 117441 - RNA, 19 nt, Homo sapiens
gcagcagaaauccaacuua

SEQ ID NO: 117442 - RNA, 19 nt, Homo sapiens
uaaagaggcuaugcuccaa

SEQ ID NO: 117443 - RNA, 19 nt, Homo sapiens
gggcagcuguggcuucuag

SEQ ID NO: 117444 - RNA, 19 nt, Homo sapiens
ggaggaaacgcagcagaaa

SEQ ID NO: 117445 - RNA, 19 nt, Homo sapiens
cacaccagcuggccauuga

SEQ ID NO: 117446 - RNA, 19 nt, Homo sapiens
uggacaaggucgagacauu

SEQ ID NO: 117447 - RNA, 19 nt, Homo sapiens
gcagaccuacagcaaguuu

SEQ ID NO: 117448 - RNA, 19 nt, Homo sapiens
cguccaaaccguucccuua

SEQ ID NO: 117449 - RNA, 19 nt, Homo sapiens
ggacaaggucgagacauuc

SEQ ID NO: 117450 - RNA, 19 nt, Homo sapiens
aagcagaccuacagcaagu

SEQ ID NO: 117451 - RNA, 19 nt, Homo sapiens
cgaugacuaucaccuccua

SEQ ID NO: 117452 - RNA, 19 nt, Homo sapiens
acgcacugcucaagaacua

SEQ ID NO: 117453 - RNA, 19 nt, Homo sapiens
gcccaccagccuugucuua

SEQ ID NO: 117454 - RNA, 19 nt, Homo sapiens
aaacgcagcagaaauccaa

SEQ ID NO: 117455 - RNA, 19 nt, Homo sapiens
aggaguaccuucaccaaca

SEQ ID NO: 117456 - RNA, 19 nt, Homo sapiens
gaggaaacgcagcagaaau

SEQ ID NO: 117457 - RNA, 19 nt, Homo sapiens
ccuaaaggaccuagaggaa

SEQ ID NO: 117458 - RNA, 19 nt, Homo sapiens
gcacaccagcuggccauug

SEQ ID NO: 117459 - RNA, 19 nt, Homo sapiens
ucaagcagaccuacagcaa

SEQ ID NO: 117460 - RNA, 19 nt, Homo sapiens
ccaaaccguucccuuaucc

SEQ ID NO: 117461 - RNA, 19 nt, Homo sapiens
gagggcagcuguggcuucu

SEQ ID NO: 117462 - RNA, 19 nt, Homo sapiens
agaggaaggcauccaaaug

SEQ ID NO: 117463 - RNA, 19 nt, Homo sapiens
cagcucaccuagcggcaau

SEQ ID NO: 117464 - RNA, 19 nt, Homo sapiens
acaccuaccaggaguuuau

SEQ ID NO: 117465 - RNA, 19 nt, Homo sapiens
guccaaaccguucccuuau

SEQ ID NO: 117466 - RNA, 19 nt, Homo sapiens
ccagccuugucuuaauaaa

SEQ ID NO: 117467 - RNA, 19 nt, Homo sapiens
ugacaccuaccaggaguuu

SEQ ID NO: 117468 - RNA, 19 nt, Homo sapiens
ucaggaaggacauggacaa

SEQ ID NO: 117469 - RNA, 19 nt, Homo sapiens
agaccuacagcaaguuuga

SEQ ID NO: 117470 - RNA, 19 nt, Homo sapiens
cgucccugcuccuggcuuu

SEQ ID NO: 117471 - RNA, 19 nt, Homo sapiens
uaccaggaguuuauaagcu

SEQ ID NO: 117472 - RNA, 19 nt, Homo sapiens
aggaaacgcagcagaaauc

SEQ ID NO: 117473 - RNA, 19 nt, Homo sapiens
gacuaucaccuccuaaagg

SEQ ID NO: 117474 - RNA, 19 nt, Homo sapiens
augacgcacugcucaagaa

SEQ ID NO: 117475 - RNA, 19 nt, Homo sapiens
ugacugggcagacccucaa

SEQ ID NO: 117476 - RNA, 19 nt, Homo sapiens
uccaaaccguucccuuauc

SEQ ID NO: 117477 - RNA, 19 nt, Homo sapiens
cuacagcaaguuugacaca

SEQ ID NO: 117478 - RNA, 19 nt, Homo sapiens
uagaggaaggcauccaaau

SEQ ID NO: 117479 - RNA, 19 nt, Homo sapiens
uggaggaaacgcagcagaa

SEQ ID NO: 117480 - RNA, 19 nt, Homo sapiens
gcaaugugcuggugucuga

SEQ ID NO: 117481 - RNA, 19 nt, Homo sapiens
cagaauguauugccaagua

SEQ ID NO: 117482 - RNA, 19 nt, Homo sapiens
gagauggaaucguaauaaa

SEQ ID NO: 117483 - RNA, 19 nt, Homo sapiens
gaaagaaaguacccagcaa

SEQ ID NO: 117484 - RNA, 19 nt, Homo sapiens
gaaaguacccagcaaaugg

SEQ ID NO: 117485 - RNA, 19 nt, Homo sapiens
cagguuggcuuuacuguga

SEQ ID NO: 117486 - RNA, 19 nt, Homo sapiens
gaacaaagucgccgucaag

SEQ ID NO: 117487 - RNA, 19 nt, Homo sapiens
gagaagaugucagcaauac

SEQ ID NO: 117488 - RNA, 19 nt, Homo sapiens
gcgagugccuuauccaaga

SEQ ID NO: 117489 - RNA, 19 nt, Homo sapiens
gagagcagcuugagcacau

SEQ ID NO: 117490 - RNA, 19 nt, Homo sapiens
ggagaagggcuacaagaug

SEQ ID NO: 117491 - RNA, 19 nt, Homo sapiens
gaaauucuccacuaagucu

SEQ ID NO: 117492 - RNA, 19 nt, Homo sapiens
ggaacaaagucgccgucaa

SEQ ID NO: 117493 - RNA, 19 nt, Homo sapiens
caagauaaggagaaagaaa

SEQ ID NO: 117494 - RNA, 19 nt, Homo sapiens
gacugaaccuggaagauca

SEQ ID NO: 117495 - RNA, 19 nt, Homo sapiens
cuugugagauggaaucgua

SEQ ID NO: 117496 - RNA, 19 nt, Homo sapiens
gaggagguguacuuugaga

SEQ ID NO: 117497 - RNA, 19 nt, Homo sapiens
gagacgugcucaccauugu

SEQ ID NO: 117498 - RNA, 19 nt, Homo sapiens
gcacccauaccucuuugua

SEQ ID NO: 117499 - RNA, 19 nt, Homo sapiens
acgaggagguguacuuuga

SEQ ID NO: 117500 - RNA, 19 nt, Homo sapiens
gcugggcccugaacaugaa

SEQ ID NO: 117501 - RNA, 19 nt, Homo sapiens
guaauaaaccacgccauga

SEQ ID NO: 117502 - RNA, 19 nt, Homo sapiens
ggacugaaccuggaagauc

SEQ ID NO: 117503 - RNA, 19 nt, Homo sapiens
ucaagugcauuaagaacga

SEQ ID NO: 117504 - RNA, 19 nt, Homo sapiens
ggaccugcccuucugcaaa

SEQ ID NO: 117505 - RNA, 19 nt, Homo sapiens
gaagaugucagcaauacag

SEQ ID NO: 117506 - RNA, 19 nt, Homo sapiens
cgccagagcuccugagaag

SEQ ID NO: 117507 - RNA, 19 nt, Homo sapiens
gaccugcccuucugcaaag

SEQ ID NO: 117508 - RNA, 19 nt, Homo sapiens
caagugacagguuggcuuu

SEQ ID NO: 117509 - RNA, 19 nt, Homo sapiens
ugagauggaaucguaauaa

SEQ ID NO: 117510 - RNA, 19 nt, Homo sapiens
ugggaaaucuacuccuuug

SEQ ID NO: 117511 - RNA, 19 nt, Homo sapiens
gaaccuggaagaucaugga

SEQ ID NO: 117512 - RNA, 19 nt, Homo sapiens
gggcaacaauuucgugcau

SEQ ID NO: 117513 - RNA, 19 nt, Homo sapiens
ugaccauguugcacuguuu

SEQ ID NO: 117514 - RNA, 19 nt, Homo sapiens
gauaaggagaaagaaagua

SEQ ID NO: 117515 - RNA, 19 nt, Homo sapiens
caucgucacugaguacaug

SEQ ID NO: 117516 - RNA, 19 nt, Homo sapiens
ggagacgugcucaccauug

SEQ ID NO: 117517 - RNA, 19 nt, Homo sapiens
gccgucaagugcauuaaga

SEQ ID NO: 117518 - RNA, 19 nt, Homo sapiens
ccagagcuccugagaagau

SEQ ID NO: 117519 - RNA, 19 nt, Homo sapiens
aaagaaaguacccagcaaa

SEQ ID NO: 117520 - RNA, 19 nt, Homo sapiens
gaaggcggguaccaaacuc

SEQ ID NO: 117521 - RNA, 19 nt, Homo sapiens
caacugguacaaagccaaa

SEQ ID NO: 117522 - RNA, 19 nt, Homo sapiens
ccacccgccuugugagaug

SEQ ID NO: 117523 - RNA, 19 nt, Homo sapiens
ggaguucggagacgugaug

SEQ ID NO: 117524 - RNA, 19 nt, Homo sapiens
gcucuaaugguaccaagug

SEQ ID NO: 117525 - RNA, 19 nt, Homo sapiens
cgagugccuuauccaagaa

SEQ ID NO: 117526 - RNA, 19 nt, Homo sapiens
gaacaugaaggagcugaag

SEQ ID NO: 117527 - RNA, 19 nt, Homo sapiens
ugagaagaugucagcaaua

SEQ ID NO: 117528 - RNA, 19 nt, Homo sapiens
guggagcacuaccgcauca

SEQ ID NO: 117529 - RNA, 19 nt, Homo sapiens
ccagcaagcucagcaucga

SEQ ID NO: 117530 - RNA, 19 nt, Homo sapiens
ggaauccuucucugggaaa

SEQ ID NO: 117531 - RNA, 19 nt, Homo sapiens
agucugacguguggaguuu

SEQ ID NO: 117532 - RNA, 19 nt, Homo sapiens
gcaagcugccagucaagug

SEQ ID NO: 117533 - RNA, 19 nt, Homo sapiens
agaccuggcugcccgcaau

SEQ ID NO: 117534 - RNA, 19 nt, Homo sapiens
cgacgaggagguguacuuu

SEQ ID NO: 117535 - RNA, 19 nt, Homo sapiens
gagcacuaccgcaucaugu

SEQ ID NO: 117536 - RNA, 19 nt, Homo sapiens
guaccaaacucagccucau

SEQ ID NO: 117537 - RNA, 19 nt, Homo sapiens
ccaaggaccccaacuggua

SEQ ID NO: 117538 - RNA, 19 nt, Homo sapiens
guacgcgccucauuaaacc

SEQ ID NO: 117539 - RNA, 19 nt, Homo sapiens
gccauccgguacagaaugu

SEQ ID NO: 117540 - RNA, 19 nt, Homo sapiens
gugagauggaaucguaaua

SEQ ID NO: 117541 - RNA, 19 nt, Homo sapiens
uguuugcgcuugaccaugu

SEQ ID NO: 117542 - RNA, 19 nt, Homo sapiens
ggcucuacaucgucacuga

SEQ ID NO: 117543 - RNA, 19 nt, Homo sapiens
uaaaccacgccaugaggaa

SEQ ID NO: 117544 - RNA, 19 nt, Homo sapiens
ucugggaaaucuacuccuu

SEQ ID NO: 117545 - RNA, 19 nt, Homo sapiens
ggccaaggucagcgacuuu

SEQ ID NO: 117546 - RNA, 19 nt, Homo sapiens
ucuguacgcgccucauuaa

SEQ ID NO: 117547 - RNA, 19 nt, Homo sapiens
gcacuaccgcaucauguac

SEQ ID NO: 117548 - RNA, 19 nt, Homo sapiens
ggagcacuaccgcaucaug

SEQ ID NO: 117549 - RNA, 19 nt, Homo sapiens
gauggaaucguaauaaacc

SEQ ID NO: 117550 - RNA, 19 nt, Homo sapiens
ucugcgaggccauggaaua

SEQ ID NO: 117551 - RNA, 19 nt, Homo sapiens
ggagguguacuuugagaac

SEQ ID NO: 117552 - RNA, 19 nt, Homo sapiens
uaauaaaccacgccaugag

SEQ ID NO: 117553 - RNA, 19 nt, Homo sapiens
agaaaguacccagcaaaug

SEQ ID NO: 117554 - RNA, 19 nt, Homo sapiens
caaguucucgcuagauguc

SEQ ID NO: 117555 - RNA, 19 nt, Homo sapiens
aggcugagcggcuucugua

SEQ ID NO: 117556 - RNA, 19 nt, Homo sapiens
cgugaaggcggguaccaaa

SEQ ID NO: 117557 - RNA, 19 nt, Homo sapiens
gaauccuucucugggaaau

SEQ ID NO: 117558 - RNA, 19 nt, Homo sapiens
aagaaaguacccagcaaau

SEQ ID NO: 117559 - RNA, 19 nt, Homo sapiens
cucaaguucucgcuagaug

SEQ ID NO: 117560 - RNA, 19 nt, Homo sapiens
acggcaagguggagcacua

SEQ ID NO: 117561 - RNA, 19 nt, Homo sapiens
caucaucccagccaacuac

SEQ ID NO: 117562 - RNA, 19 nt, Homo sapiens
gaccauguugcacuguuug

SEQ ID NO: 117563 - RNA, 19 nt, Homo sapiens
aaggagacgugcucaccau

SEQ ID NO: 117564 - RNA, 19 nt, Homo sapiens
aagauaaggagaaagaaag

SEQ ID NO: 117565 - RNA, 19 nt, Homo sapiens
guggagaagggcuacaaga

SEQ ID NO: 117566 - RNA, 19 nt, Homo sapiens
ucuacaucgucacugagua

SEQ ID NO: 117567 - RNA, 19 nt, Homo sapiens
gcaucgacgaggaggugua

SEQ ID NO: 117568 - RNA, 19 nt, Homo sapiens
cccauucugugucccaugu

SEQ ID NO: 117569 - RNA, 19 nt, Homo sapiens
uuacaagaaguacgaaucu

SEQ ID NO: 117570 - RNA, 19 nt, Homo sapiens
gggcgagugccuuauccaa

SEQ ID NO: 117571 - RNA, 19 nt, Homo sapiens
ccugaggcccugagagaga

SEQ ID NO: 117572 - RNA, 19 nt, Homo sapiens
acgugaugcugggcgauua

SEQ ID NO: 117573 - RNA, 19 nt, Homo sapiens
cuaaugguaccaagugaca

SEQ ID NO: 117574 - RNA, 19 nt, Homo sapiens
gcccugagagagaagaaau

SEQ ID NO: 117575 - RNA, 19 nt, Homo sapiens
gcgaggccauggaauaccu

SEQ ID NO: 117576 - RNA, 19 nt, Homo sapiens
gacgaggagguguacuuug

SEQ ID NO: 117577 - RNA, 19 nt, Homo sapiens
cguguggaguuucggaauc

SEQ ID NO: 117578 - RNA, 19 nt, Homo sapiens
gcgauuaccgagggaacaa

SEQ ID NO: 117579 - RNA, 19 nt, Homo sapiens
gcaucaucccagccaacua

SEQ ID NO: 117580 - RNA, 19 nt, Homo sapiens
gaggaaaugucucucagua

SEQ ID NO: 117581 - RNA, 19 nt, Homo sapiens
ggaaaugucucucaguaag

SEQ ID NO: 117582 - RNA, 19 nt, Homo sapiens
gcagugagccuauaccauu

SEQ ID NO: 117583 - RNA, 19 nt, Homo sapiens
gaacgaauacaaccaacuu

SEQ ID NO: 117584 - RNA, 19 nt, Homo sapiens
ggaaaaccaucuuaucuga

SEQ ID NO: 117585 - RNA, 19 nt, Homo sapiens
cuacaguggugauaugauu

SEQ ID NO: 117586 - RNA, 19 nt, Homo sapiens
aaacagccauguccaagug

SEQ ID NO: 117587 - RNA, 19 nt, Homo sapiens
gaacaggcagagaaacauu

SEQ ID NO: 117588 - RNA, 19 nt, Homo sapiens
guaagugccaucaauuaaa

SEQ ID NO: 117589 - RNA, 19 nt, Homo sapiens
cagugagccuauaccauua

SEQ ID NO: 117590 - RNA, 19 nt, Homo sapiens
ucaguugugucuugccaua

SEQ ID NO: 117591 - RNA, 19 nt, Homo sapiens
ggacuguuguuuuagaaua

SEQ ID NO: 117592 - RNA, 19 nt, Homo sapiens
agacuggacuguuguuuua

SEQ ID NO: 117593 - RNA, 19 nt, Homo sapiens
ccacaaaucaugcaguaug

SEQ ID NO: 117594 - RNA, 19 nt, Homo sapiens
ugaauugccaguucuguaa

SEQ ID NO: 117595 - RNA, 19 nt, Homo sapiens
caagagaggaauacaugaa

SEQ ID NO: 117596 - RNA, 19 nt, Homo sapiens
gggcuuaaggcucugauaa

SEQ ID NO: 117597 - RNA, 19 nt, Homo sapiens
aaauuucaguugugucuug

SEQ ID NO: 117598 - RNA, 19 nt, Homo sapiens
ucugaagacuggacuguug

SEQ ID NO: 117599 - RNA, 19 nt, Homo sapiens
uuuguagacugaacgaaua

SEQ ID NO: 117600 - RNA, 19 nt, Homo sapiens
gaaaucaaggauacuagga

SEQ ID NO: 117601 - RNA, 19 nt, Homo sapiens
gaugaaaucaaggauacua

SEQ ID NO: 117602 - RNA, 19 nt, Homo sapiens
gaggaauacaugaauggua

SEQ ID NO: 117603 - RNA, 19 nt, Homo sapiens
gguaugaacaggcagagaa

SEQ ID NO: 117604 - RNA, 19 nt, Homo sapiens
ccagaacgccuucagaauc

SEQ ID NO: 117605 - RNA, 19 nt, Homo sapiens
uaagugugcggaacaguuu

SEQ ID NO: 117606 - RNA, 19 nt, Homo sapiens
ucaaggauacuaggaauga

SEQ ID NO: 117607 - RNA, 19 nt, Homo sapiens
cagaggguauuaaaguguu

SEQ ID NO: 117608 - RNA, 19 nt, Homo sapiens
ccacugcucaugaaaauua

SEQ ID NO: 117609 - RNA, 19 nt, Homo sapiens
uaaacuuccucuuagauac

SEQ ID NO: 117610 - RNA, 19 nt, Homo sapiens
gagccuauaccauuagaau

SEQ ID NO: 117611 - RNA, 19 nt, Homo sapiens
uggcagagccugagaagau

SEQ ID NO: 117612 - RNA, 19 nt, Homo sapiens
caaaucaugcaguauguuc

SEQ ID NO: 117613 - RNA, 19 nt, Homo sapiens
cacaaaucaugcaguaugu

SEQ ID NO: 117614 - RNA, 19 nt, Homo sapiens
guaagugugcggaacaguu

SEQ ID NO: 117615 - RNA, 19 nt, Homo sapiens
gaaaugucucucaguaagu

SEQ ID NO: 117616 - RNA, 19 nt, Homo sapiens
uguaagugccaucaauuaa

SEQ ID NO: 117617 - RNA, 19 nt, Homo sapiens
gaagacuggacuguuguuu

SEQ ID NO: 117618 - RNA, 19 nt, Homo sapiens
aaucaaggauacuaggaau

SEQ ID NO: 117619 - RNA, 19 nt, Homo sapiens
agagaggaauacaugaaug

SEQ ID NO: 117620 - RNA, 19 nt, Homo sapiens
agagagcagugagccuaua

SEQ ID NO: 117621 - RNA, 19 nt, Homo sapiens
uuaaggcucugauaaccau

SEQ ID NO: 117622 - RNA, 19 nt, Homo sapiens
aaucagaggguauuaaagu

SEQ ID NO: 117623 - RNA, 19 nt, Homo sapiens
uugcuucucuccagacuug

SEQ ID NO: 117624 - RNA, 19 nt, Homo sapiens
caaucccacugcucaugaa

SEQ ID NO: 117625 - RNA, 19 nt, Homo sapiens
guacuauccacaaaucaug

SEQ ID NO: 117626 - RNA, 19 nt, Homo sapiens
ccuaugcuguuugguacua

SEQ ID NO: 117627 - RNA, 19 nt, Homo sapiens
gccuauaccauuagaauca

SEQ ID NO: 117628 - RNA, 19 nt, Homo sapiens
aaaugucucucaguaagug

SEQ ID NO: 117629 - RNA, 19 nt, Homo sapiens
uagaaucaagagaggaaua

SEQ ID NO: 117630 - RNA, 19 nt, Homo sapiens
caaccaacuucagcugcaa

SEQ ID NO: 117631 - RNA, 19 nt, Homo sapiens
guaugaacaggcagagaaa

SEQ ID NO: 117632 - RNA, 19 nt, Homo sapiens
cuguaagugccaucaauua

SEQ ID NO: 117633 - RNA, 19 nt, Homo sapiens
ugucuaaauuucaguugug

SEQ ID NO: 117634 - RNA, 19 nt, Homo sapiens
ggcagagccugagaagaug

SEQ ID NO: 117635 - RNA, 19 nt, Homo sapiens
gagaggaauacaugaaugg

SEQ ID NO: 117636 - RNA, 19 nt, Homo sapiens
ccauauggagggcaccuaa

SEQ ID NO: 117637 - RNA, 19 nt, Homo sapiens
aaucccauauugaaggaaa

SEQ ID NO: 117638 - RNA, 19 nt, Homo sapiens
aggccuaaacuuccucuua

SEQ ID NO: 117639 - RNA, 19 nt, Homo sapiens
cagaacgccuucagaaucc

SEQ ID NO: 117640 - RNA, 19 nt, Homo sapiens
ccuagagaguuuauugucu

SEQ ID NO: 117641 - RNA, 19 nt, Homo sapiens
ccaaucccacugcucauga

SEQ ID NO: 117642 - RNA, 19 nt, Homo sapiens
cagcagcucaaccaacuug

SEQ ID NO: 117643 - RNA, 19 nt, Homo sapiens
guucaucgagugaggaaau

SEQ ID NO: 117644 - RNA, 19 nt, Homo sapiens
ccucuuagauacccagaac

SEQ ID NO: 117645 - RNA, 19 nt, Homo sapiens
gcaccuaaucagaggguau

SEQ ID NO: 117646 - RNA, 19 nt, Homo sapiens
guggugauaugauugaaaa

SEQ ID NO: 117647 - RNA, 19 nt, Homo sapiens
aaaacagacugaugaaauc

SEQ ID NO: 117648 - RNA, 19 nt, Homo sapiens
auccacaaaucaugcagua

SEQ ID NO: 117649 - RNA, 19 nt, Homo sapiens
gaauccagcaucaguucau

SEQ ID NO: 117650 - RNA, 19 nt, Homo sapiens
cugaauuucuccucucaag

SEQ ID NO: 117651 - RNA, 19 nt, Homo sapiens
agaggguauuaaaguguuu

SEQ ID NO: 117652 - RNA, 19 nt, Homo sapiens
ccuauaccauuagaaucaa

SEQ ID NO: 117653 - RNA, 19 nt, Homo sapiens
ucaagagaggaauacauga

SEQ ID NO: 117654 - RNA, 19 nt, Homo sapiens
gugagccuauaccauuaga

SEQ ID NO: 117655 - RNA, 19 nt, Homo sapiens
ucuccagacuugggcuuaa

SEQ ID NO: 117656 - RNA, 19 nt, Homo sapiens
aaaauaacgucaugcuaca

SEQ ID NO: 117657 - RNA, 19 nt, Homo sapiens
guagacugaacgaauacaa

SEQ ID NO: 117658 - RNA, 19 nt, Homo sapiens
ucagaggguauuaaagugu

SEQ ID NO: 117659 - RNA, 19 nt, Homo sapiens
caugcaguauguuccuuuc

SEQ ID NO: 117660 - RNA, 19 nt, Homo sapiens
ggaauccagcaucaguuca

SEQ ID NO: 117661 - RNA, 19 nt, Homo sapiens
aaaucaaggauacuaggaa

SEQ ID NO: 117662 - RNA, 19 nt, Homo sapiens
gcuuaaggcucugauaacc

SEQ ID NO: 117663 - RNA, 19 nt, Homo sapiens
gguacuauccacaaaucau

SEQ ID NO: 117664 - RNA, 19 nt, Homo sapiens
gaaaaccaucuuaucugaa

SEQ ID NO: 117665 - RNA, 19 nt, Homo sapiens
aggaaaugucucucaguaa

SEQ ID NO: 117666 - RNA, 19 nt, Homo sapiens
cuaaauuucaguugugucu

SEQ ID NO: 117667 - RNA, 19 nt, Homo sapiens
gagcagugagccuauacca

SEQ ID NO: 117668 - RNA, 19 nt, Homo sapiens
aaaaccaucuuaucugaag

SEQ ID NO: 117669 - RNA, 19 nt, Homo sapiens
cuucagaauccaucagaga

SEQ ID NO: 117670 - RNA, 19 nt, Homo sapiens
gauacuaggaaugagucua

SEQ ID NO: 117671 - RNA, 19 nt, Homo sapiens
gaauugccaguucuguaag

SEQ ID NO: 117672 - RNA, 19 nt, Homo sapiens
aguugugucuugccauaug

SEQ ID NO: 117673 - RNA, 19 nt, Homo sapiens
ccauauugaaggaaauugu

SEQ ID NO: 117674 - RNA, 19 nt, Homo sapiens
acaguggugauaugauuga

SEQ ID NO: 117675 - RNA, 19 nt, Homo sapiens
gaaguucaauacucauuug

SEQ ID NO: 117676 - RNA, 19 nt, Homo sapiens
gaacuuugucccuuuauuu

SEQ ID NO: 117677 - RNA, 19 nt, Homo sapiens
ggaagucccuaaagcuaaa

SEQ ID NO: 117678 - RNA, 19 nt, Homo sapiens
gcagaaaguugagaagguu

SEQ ID NO: 117679 - RNA, 19 nt, Homo sapiens
ccuuaaaucuccaacgaua

SEQ ID NO: 117680 - RNA, 19 nt, Homo sapiens
uggaaaugcuacaaacaua

SEQ ID NO: 117681 - RNA, 19 nt, Homo sapiens
ccacagaaguucaauacuc

SEQ ID NO: 117682 - RNA, 19 nt, Homo sapiens
ugaggaaucuauuacagaa

SEQ ID NO: 117683 - RNA, 19 nt, Homo sapiens
caccagaucuacccuguga

SEQ ID NO: 117684 - RNA, 19 nt, Homo sapiens
guucaauacucauuuggaa

SEQ ID NO: 117685 - RNA, 19 nt, Homo sapiens
uugagaagguuaaacauga

SEQ ID NO: 117686 - RNA, 19 nt, Homo sapiens
ucagagagcugugccuguu

SEQ ID NO: 117687 - RNA, 19 nt, Homo sapiens
ggaaaugcuacaaacauau

SEQ ID NO: 117688 - RNA, 19 nt, Homo sapiens
gcaggucccucagccuauu

SEQ ID NO: 117689 - RNA, 19 nt, Homo sapiens
gaauacaagcagaaaguug

SEQ ID NO: 117690 - RNA, 19 nt, Homo sapiens
gaaaugcuacaaacauauc

SEQ ID NO: 117691 - RNA, 19 nt, Homo sapiens
cacagaaguucaauacuca

SEQ ID NO: 117692 - RNA, 19 nt, Homo sapiens
aaugaacuuugucccuuua

SEQ ID NO: 117693 - RNA, 19 nt, Homo sapiens
aaaugaacuuugucccuuu

SEQ ID NO: 117694 - RNA, 19 nt, Homo sapiens
cuggaaauaugaugccuuu

SEQ ID NO: 117695 - RNA, 19 nt, Homo sapiens
ugacugagacuggaaauau

SEQ ID NO: 117696 - RNA, 19 nt, Homo sapiens
gcaagggagaccauagaaa

SEQ ID NO: 117697 - RNA, 19 nt, Homo sapiens
gaaauuugacucaugaacu

SEQ ID NO: 117698 - RNA, 19 nt, Homo sapiens
caagggagaccauagaaag

SEQ ID NO: 117699 - RNA, 19 nt, Homo sapiens
gacugagacuggaaauaug

SEQ ID NO: 117700 - RNA, 19 nt, Homo sapiens
agugaugccuguccuuaaa

SEQ ID NO: 117701 - RNA, 19 nt, Homo sapiens
gcuacaaacauaucaaaca

SEQ ID NO: 117702 - RNA, 19 nt, Homo sapiens
ucacugaucuugaaaaucu

SEQ ID NO: 117703 - RNA, 19 nt, Homo sapiens
gaggaugaacaccaggaua

SEQ ID NO: 117704 - RNA, 19 nt, Homo sapiens
gauaaaaucuaccccucuu

SEQ ID NO: 117705 - RNA, 19 nt, Homo sapiens
ugaacuuugucccuuuauu

SEQ ID NO: 117706 - RNA, 19 nt, Homo sapiens
gaaaguugagaagguuaaa

SEQ ID NO: 117707 - RNA, 19 nt, Homo sapiens
guccuuaaaucuccaacga

SEQ ID NO: 117708 - RNA, 19 nt, Homo sapiens
gagugaugccuguccuuaa

SEQ ID NO: 117709 - RNA, 19 nt, Homo sapiens
ggaugaacaccaggauaaa

SEQ ID NO: 117710 - RNA, 19 nt, Homo sapiens
gaccauagaaagccuguca

SEQ ID NO: 117711 - RNA, 19 nt, Homo sapiens
caacuaguaccacagaagu

SEQ ID NO: 117712 - RNA, 19 nt, Homo sapiens
cagaauacaagcagaaagu

SEQ ID NO: 117713 - RNA, 19 nt, Homo sapiens
auagaaagccugucaagca

SEQ ID NO: 117714 - RNA, 19 nt, Homo sapiens
gaucuauccauucguugaa

SEQ ID NO: 117715 - RNA, 19 nt, Homo sapiens
ucugaucuauccauucguu

SEQ ID NO: 117716 - RNA, 19 nt, Homo sapiens
gcagugaggaaucuauuac

SEQ ID NO: 117717 - RNA, 19 nt, Homo sapiens
gcaaggagaggaugaacac

SEQ ID NO: 117718 - RNA, 19 nt, Homo sapiens
ucuauuuccuuuccaguca

SEQ ID NO: 117719 - RNA, 19 nt, Homo sapiens
guaccacagaaguucaaua

SEQ ID NO: 117720 - RNA, 19 nt, Homo sapiens
uaauggaagucccuaaagc

SEQ ID NO: 117721 - RNA, 19 nt, Homo sapiens
aauacaagcagaaaguuga

SEQ ID NO: 117722 - RNA, 19 nt, Homo sapiens
aggaugaacaccaggauaa

SEQ ID NO: 117723 - RNA, 19 nt, Homo sapiens
agagagcugugccuguuca

SEQ ID NO: 117724 - RNA, 19 nt, Homo sapiens
cagaaaguugagaagguua

SEQ ID NO: 117725 - RNA, 19 nt, Homo sapiens
gugaggaaucuauuacaga

SEQ ID NO: 117726 - RNA, 19 nt, Homo sapiens
aaaacucacugaucuugaa

SEQ ID NO: 117727 - RNA, 19 nt, Homo sapiens
aauaauggaagucccuaaa

SEQ ID NO: 117728 - RNA, 19 nt, Homo sapiens
guugagaagguuaaacaug

SEQ ID NO: 117729 - RNA, 19 nt, Homo sapiens
cagaaguucaauacucauu

SEQ ID NO: 117730 - RNA, 19 nt, Homo sapiens
agagugaugccuguccuua

SEQ ID NO: 117731 - RNA, 19 nt, Homo sapiens
uggaagucccuaaagcuaa

SEQ ID NO: 117732 - RNA, 19 nt, Homo sapiens
ccugguggcucuugcucuu

SEQ ID NO: 117733 - RNA, 19 nt, Homo sapiens
ccucugaucuauccauucg

SEQ ID NO: 117734 - RNA, 19 nt, Homo sapiens
gccacagccucugaucuau

SEQ ID NO: 117735 - RNA, 19 nt, Homo sapiens
gaauugacugagacuggaa

SEQ ID NO: 117736 - RNA, 19 nt, Homo sapiens
uuacagaauacaagcagaa

SEQ ID NO: 117737 - RNA, 19 nt, Homo sapiens
ugagaagguuaaacaugag

SEQ ID NO: 117738 - RNA, 19 nt, Homo sapiens
guggugcccuacccucaga

SEQ ID NO: 117739 - RNA, 19 nt, Homo sapiens
gcagcaaggagaggaugaa

SEQ ID NO: 117740 - RNA, 19 nt, Homo sapiens
agaaaguugagaagguuaa

SEQ ID NO: 117741 - RNA, 19 nt, Homo sapiens
ucuggaauugugcuuauuu

SEQ ID NO: 117742 - RNA, 19 nt, Homo sapiens
uuucuggaauugugcuuau

SEQ ID NO: 117743 - RNA, 19 nt, Homo sapiens
guucauaaccccauuagug

SEQ ID NO: 117744 - RNA, 19 nt, Homo sapiens
aagaaucuauuuccuuucc

SEQ ID NO: 117745 - RNA, 19 nt, Homo sapiens
caagcagugaggaaucuau

SEQ ID NO: 117746 - RNA, 19 nt, Homo sapiens
caaaacauucugccucuug

SEQ ID NO: 117747 - RNA, 19 nt, Homo sapiens
agccacagccucugaucua

SEQ ID NO: 117748 - RNA, 19 nt, Homo sapiens
ugaugccuguccuuaaauc

SEQ ID NO: 117749 - RNA, 19 nt, Homo sapiens
cccuaaagcuaaagacacu

SEQ ID NO: 117750 - RNA, 19 nt, Homo sapiens
acaagcagaaaguugagaa

SEQ ID NO: 117751 - RNA, 19 nt, Homo sapiens
aaacucacugaucuugaaa

SEQ ID NO: 117752 - RNA, 19 nt, Homo sapiens
uaccacagaaguucaauac

SEQ ID NO: 117753 - RNA, 19 nt, Homo sapiens
gucaagcagugaggaaucu

SEQ ID NO: 117754 - RNA, 19 nt, Homo sapiens
ccucaaaucccaaaacuca

SEQ ID NO: 117755 - RNA, 19 nt, Homo sapiens
ugaucuauccauucguuga

SEQ ID NO: 117756 - RNA, 19 nt, Homo sapiens
gaggaaaggugcaauaaug

SEQ ID NO: 117757 - RNA, 19 nt, Homo sapiens
gaaagaccauucuaucaga

SEQ ID NO: 117758 - RNA, 19 nt, Homo sapiens
gaaaccaaauuacuacuuc

SEQ ID NO: 117759 - RNA, 19 nt, Homo sapiens
gcucuucucuccuuacauu

SEQ ID NO: 117760 - RNA, 19 nt, Homo sapiens
ccaaggaaauaucaaagaa

SEQ ID NO: 117761 - RNA, 19 nt, Homo sapiens
gaccagcuauagcaauuaa

SEQ ID NO: 117762 - RNA, 19 nt, Homo sapiens
gaaaacagcuccauauguc

SEQ ID NO: 117763 - RNA, 19 nt, Homo sapiens
gaacacaacgcaggacuug

SEQ ID NO: 117764 - RNA, 19 nt, Homo sapiens
aaaccugcauccaucauuu

SEQ ID NO: 117765 - RNA, 19 nt, Homo sapiens
gugcaauaaugaagaguuu

SEQ ID NO: 117766 - RNA, 19 nt, Homo sapiens
caugccacauucaauauuu

SEQ ID NO: 117767 - RNA, 19 nt, Homo sapiens
ggaaaggugcaauaaugaa

SEQ ID NO: 117768 - RNA, 19 nt, Homo sapiens
cauaugucccaauguauua

SEQ ID NO: 117769 - RNA, 19 nt, Homo sapiens
cugcauccaucauuuauug

SEQ ID NO: 117770 - RNA, 19 nt, Homo sapiens
ccagcuauagcaauuaaua

SEQ ID NO: 117771 - RNA, 19 nt, Homo sapiens
caacguagaccagcuauag

SEQ ID NO: 117772 - RNA, 19 nt, Homo sapiens
gaugaaagaccauucuauc

SEQ ID NO: 117773 - RNA, 19 nt, Homo sapiens
gcaaacccagcuguaguua

SEQ ID NO: 117774 - RNA, 19 nt, Homo sapiens
uagaccagcuauagcaauu

SEQ ID NO: 117775 - RNA, 19 nt, Homo sapiens
ccaugagaaugaugaaaga

SEQ ID NO: 117776 - RNA, 19 nt, Homo sapiens
gcacaauaaagccaacuga

SEQ ID NO: 117777 - RNA, 19 nt, Homo sapiens
acaauaaagccaacugauu

SEQ ID NO: 117778 - RNA, 19 nt, Homo sapiens
ggaaauaucaaagaacaca

SEQ ID NO: 117779 - RNA, 19 nt, Homo sapiens
cuccauaugucccaaugua

SEQ ID NO: 117780 - RNA, 19 nt, Homo sapiens
gaaaggugcaauaaugaag

SEQ ID NO: 117781 - RNA, 19 nt, Homo sapiens
aaucaucccuaccaucaau

SEQ ID NO: 117782 - RNA, 19 nt, Homo sapiens
aaacccagcuguaguuagg

SEQ ID NO: 117783 - RNA, 19 nt, Homo sapiens
ccauaugucccaauguauu

SEQ ID NO: 117784 - RNA, 19 nt, Homo sapiens
uaccauugcuacuguugaa

SEQ ID NO: 117785 - RNA, 19 nt, Homo sapiens
uagcuauccuuauuaugga

SEQ ID NO: 117786 - RNA, 19 nt, Homo sapiens
uuacauucaugccacauuc

SEQ ID NO: 117787 - RNA, 19 nt, Homo sapiens
ccauuugucugccuucagu

SEQ ID NO: 117788 - RNA, 19 nt, Homo sapiens
caacgcaggacuugcugaa

SEQ ID NO: 117789 - RNA, 19 nt, Homo sapiens
aaacaccaaggaaauauca

SEQ ID NO: 117790 - RNA, 19 nt, Homo sapiens
ccaaagaaaauucaggaua

SEQ ID NO: 117791 - RNA, 19 nt, Homo sapiens
ugccaaauagcuauccuua

SEQ ID NO: 117792 - RNA, 19 nt, Homo sapiens
caccagcuccugccacuga

SEQ ID NO: 117793 - RNA, 19 nt, Homo sapiens
aaccaacgguggacagugu

SEQ ID NO: 117794 - RNA, 19 nt, Homo sapiens
caaaccugcauccaucauu

SEQ ID NO: 117795 - RNA, 19 nt, Homo sapiens
uaggccacaugcccaaauu

SEQ ID NO: 117796 - RNA, 19 nt, Homo sapiens
acacucuccuucagccauu

SEQ ID NO: 117797 - RNA, 19 nt, Homo sapiens
gcugaaaccaaauuacuac

SEQ ID NO: 117798 - RNA, 19 nt, Homo sapiens
ugaaagaccauucuaucag

SEQ ID NO: 117799 - RNA, 19 nt, Homo sapiens
auucaugccacauucaaua

SEQ ID NO: 117800 - RNA, 19 nt, Homo sapiens
ugccuucagucaacagaaa

SEQ ID NO: 117801 - RNA, 19 nt, Homo sapiens
uuacuccaccuacggcaua

SEQ ID NO: 117802 - RNA, 19 nt, Homo sapiens
acaccaaggaaauaucaaa

SEQ ID NO: 117803 - RNA, 19 nt, Homo sapiens
cgaggaaaggugcaauaau

SEQ ID NO: 117804 - RNA, 19 nt, Homo sapiens
auucagcucuucucuccuu

SEQ ID NO: 117805 - RNA, 19 nt, Homo sapiens
uuucacagauucagcucuu

SEQ ID NO: 117806 - RNA, 19 nt, Homo sapiens
auaaucaucccuaccauca

SEQ ID NO: 117807 - RNA, 19 nt, Homo sapiens
caauguauuaugugccaaa

SEQ ID NO: 117808 - RNA, 19 nt, Homo sapiens
gccaugagaaugaugaaag

SEQ ID NO: 117809 - RNA, 19 nt, Homo sapiens
caaauuacuacuucacacu

SEQ ID NO: 117810 - RNA, 19 nt, Homo sapiens
aggacuugcugaaaccaaa

SEQ ID NO: 117811 - RNA, 19 nt, Homo sapiens
caauuuguaccaacguaga

SEQ ID NO: 117812 - RNA, 19 nt, Homo sapiens
cagcucuucucuccuuaca

SEQ ID NO: 117813 - RNA, 19 nt, Homo sapiens
aggaaaggugcaauaauga

SEQ ID NO: 117814 - RNA, 19 nt, Homo sapiens
cacgaggaaaggugcaaua

SEQ ID NO: 117815 - RNA, 19 nt, Homo sapiens
ugaugaaagaccauucuau

SEQ ID NO: 117816 - RNA, 19 nt, Homo sapiens
aaaggugcaauaaugaaga

SEQ ID NO: 117817 - RNA, 19 nt, Homo sapiens
ggacuugcugaaaccaaau

SEQ ID NO: 117818 - RNA, 19 nt, Homo sapiens
acgcaggacuugcugaaac

SEQ ID NO: 117819 - RNA, 19 nt, Homo sapiens
aaccugcauccaucauuua

SEQ ID NO: 117820 - RNA, 19 nt, Homo sapiens
gacaggccaacucaaccua

SEQ ID NO: 117821 - RNA, 19 nt, Homo sapiens
guagaccagcuauagcaau

SEQ ID NO: 117822 - RNA, 19 nt, Homo sapiens
uguagucacuccagaagcu

SEQ ID NO: 117823 - RNA, 19 nt, Homo sapiens
ggugcaauaaugaagaguu

SEQ ID NO: 117824 - RNA, 19 nt, Homo sapiens
ucaaccuacugccaaccaa

SEQ ID NO: 117825 - RNA, 19 nt, Homo sapiens
cagcugacaggccaacuca

SEQ ID NO: 117826 - RNA, 19 nt, Homo sapiens
auagcuauccuuauuaugg

SEQ ID NO: 117827 - RNA, 19 nt, Homo sapiens
gccaaauagcuauccuuau

SEQ ID NO: 117828 - RNA, 19 nt, Homo sapiens
gcaauaaugaagaguuuuc

SEQ ID NO: 117829 - RNA, 19 nt, Homo sapiens
caaggaaauaucaaagaac

SEQ ID NO: 117830 - RNA, 19 nt, Homo sapiens
aaauaaucaucccuaccau

SEQ ID NO: 117831 - RNA, 19 nt, Homo sapiens
ucagaaaacagcuccauau

SEQ ID NO: 117832 - RNA, 19 nt, Homo sapiens
gcugacaggccaacucaac

SEQ ID NO: 117833 - RNA, 19 nt, Homo sapiens
gaaagacucugccugcuua

SEQ ID NO: 117834 - RNA, 19 nt, Homo sapiens
ucaagaagguucacaauga

SEQ ID NO: 117835 - RNA, 19 nt, Homo sapiens
gaacuauacugcuuugaga

SEQ ID NO: 117836 - RNA, 19 nt, Homo sapiens
guuaacaucuuacaacuga

SEQ ID NO: 117837 - RNA, 19 nt, Homo sapiens
caagccagcugauauggua

SEQ ID NO: 117838 - RNA, 19 nt, Homo sapiens
ccagauaacuuccuaaugg

SEQ ID NO: 117839 - RNA, 19 nt, Homo sapiens
uaacugagauagugaaaca

SEQ ID NO: 117840 - RNA, 19 nt, Homo sapiens
gcuaaaggcugcaacaaag

SEQ ID NO: 117841 - RNA, 19 nt, Homo sapiens
caauaugacuacacauuug

SEQ ID NO: 117842 - RNA, 19 nt, Homo sapiens
gaaauaacagcaucuaaag

SEQ ID NO: 117843 - RNA, 19 nt, Homo sapiens
ggacaauguuaaagcagaa

SEQ ID NO: 117844 - RNA, 19 nt, Homo sapiens
uauguuagcugaccagaug

SEQ ID NO: 117845 - RNA, 19 nt, Homo sapiens
guuaaaugcucacaauugu

SEQ ID NO: 117846 - RNA, 19 nt, Homo sapiens
gaucggagcagcauuuguu

SEQ ID NO: 117847 - RNA, 19 nt, Homo sapiens
guggagaaauugugcauau

SEQ ID NO: 117848 - RNA, 19 nt, Homo sapiens
agaguaacaugaaagguuu

SEQ ID NO: 117849 - RNA, 19 nt, Homo sapiens
gcgauguacuuaaacuauu

SEQ ID NO: 117850 - RNA, 19 nt, Homo sapiens
gggcgucacuguaauaagu

SEQ ID NO: 117851 - RNA, 19 nt, Homo sapiens
gaugaucaguagaauugaa

SEQ ID NO: 117852 - RNA, 19 nt, Homo sapiens
uaaaccagauaacuuccua

SEQ ID NO: 117853 - RNA, 19 nt, Homo sapiens
cagaugaucaguagaauug

SEQ ID NO: 117854 - RNA, 19 nt, Homo sapiens
guauguauguugcuuagau

SEQ ID NO: 117855 - RNA, 19 nt, Homo sapiens
gguaaaggccuccguguuc

SEQ ID NO: 117856 - RNA, 19 nt, Homo sapiens
gaugaucggagcagcauuu

SEQ ID NO: 117857 - RNA, 19 nt, Homo sapiens
gaauugaggaacagaagaa

SEQ ID NO: 117858 - RNA, 19 nt, Homo sapiens
cuccaaggcugaauucauu

SEQ ID NO: 117859 - RNA, 19 nt, Homo sapiens
cuaaaugguugacacacaa

SEQ ID NO: 117860 - RNA, 19 nt, Homo sapiens
caaggcaacacauaccaua

SEQ ID NO: 117861 - RNA, 19 nt, Homo sapiens
uguaaucacuguaaacauc

SEQ ID NO: 117862 - RNA, 19 nt, Homo sapiens
aagcauauuugucacagaa

SEQ ID NO: 117863 - RNA, 19 nt, Homo sapiens
cgauguacuuaaacuauug

SEQ ID NO: 117864 - RNA, 19 nt, Homo sapiens
gagcagagucgccgagaug

SEQ ID NO: 117865 - RNA, 19 nt, Homo sapiens
caaugcacaucuugguauu

SEQ ID NO: 117866 - RNA, 19 nt, Homo sapiens
acacauaccauacagagaa

SEQ ID NO: 117867 - RNA, 19 nt, Homo sapiens
gaccagaugaucaguagaa

SEQ ID NO: 117868 - RNA, 19 nt, Homo sapiens
gcgaggaaguggcagugaa

SEQ ID NO: 117869 - RNA, 19 nt, Homo sapiens
gaugcuguauccugaguug

SEQ ID NO: 117870 - RNA, 19 nt, Homo sapiens
gaagaagcagagcagauga

SEQ ID NO: 117871 - RNA, 19 nt, Homo sapiens
cagugaagcuagaaucuca

SEQ ID NO: 117872 - RNA, 19 nt, Homo sapiens
ggaaguggcagugaagcua

SEQ ID NO: 117873 - RNA, 19 nt, Homo sapiens
aaccaaagauuccaguguu

SEQ ID NO: 117874 - RNA, 19 nt, Homo sapiens
gaauuugcgauguacuuaa

SEQ ID NO: 117875 - RNA, 19 nt, Homo sapiens
cugcagaauuugcgaugua

SEQ ID NO: 117876 - RNA, 19 nt, Homo sapiens
guauugggcgucacuguaa

SEQ ID NO: 117877 - RNA, 19 nt, Homo sapiens
uaaaaugguuggcuucuug

SEQ ID NO: 117878 - RNA, 19 nt, Homo sapiens
gacucugccugcuuaauug

SEQ ID NO: 117879 - RNA, 19 nt, Homo sapiens
guuguagccucuguaauug

SEQ ID NO: 117880 - RNA, 19 nt, Homo sapiens
gacauggaaucauuaggau

SEQ ID NO: 117881 - RNA, 19 nt, Homo sapiens
gagaucucauuucagaaga

SEQ ID NO: 117882 - RNA, 19 nt, Homo sapiens
agggaaauauaaacuggua

SEQ ID NO: 117883 - RNA, 19 nt, Homo sapiens
ugacauggaaucauuagga

SEQ ID NO: 117884 - RNA, 19 nt, Homo sapiens
gcgucacuguaauaaguua

SEQ ID NO: 117885 - RNA, 19 nt, Homo sapiens
gaagcuagaaucucagaag

SEQ ID NO: 117886 - RNA, 19 nt, Homo sapiens
ccucuguaauugugaauau

SEQ ID NO: 117887 - RNA, 19 nt, Homo sapiens
guccacgccuguugaaguu

SEQ ID NO: 117888 - RNA, 19 nt, Homo sapiens
gguauugggcgucacugua

SEQ ID NO: 117889 - RNA, 19 nt, Homo sapiens
cauggaaucauuaggauau

SEQ ID NO: 117890 - RNA, 19 nt, Homo sapiens
aauaacagcaucuaaagug

SEQ ID NO: 117891 - RNA, 19 nt, Homo sapiens
aaaccaagaguaacaugaa

SEQ ID NO: 117892 - RNA, 19 nt, Homo sapiens
cagcuauuccgcauucuuu

SEQ ID NO: 117893 - RNA, 19 nt, Homo sapiens
ggaaucauuaggauauguu

SEQ ID NO: 117894 - RNA, 19 nt, Homo sapiens
ggacucugcauuaacucua

SEQ ID NO: 117895 - RNA, 19 nt, Homo sapiens
ccuuaggacucugcauuaa

SEQ ID NO: 117896 - RNA, 19 nt, Homo sapiens
ccacaggcaagcaaacuga

SEQ ID NO: 117897 - RNA, 19 nt, Homo sapiens
uaaaggcugcaacaaagaa

SEQ ID NO: 117898 - RNA, 19 nt, Homo sapiens
uaacagcaucuaaagugaa

SEQ ID NO: 117899 - RNA, 19 nt, Homo sapiens
cagaagaacggcaugaaca

SEQ ID NO: 117900 - RNA, 19 nt, Homo sapiens
ggcuaaaggcugcaacaaa

SEQ ID NO: 117901 - RNA, 19 nt, Homo sapiens
auaacagcaucuaaaguga

SEQ ID NO: 117902 - RNA, 19 nt, Homo sapiens
aagcaugaauugaggaaca

SEQ ID NO: 117903 - RNA, 19 nt, Homo sapiens
caguagaauugaauaugug

SEQ ID NO: 117904 - RNA, 19 nt, Homo sapiens
caguugugaugguuguuaa

SEQ ID NO: 117905 - RNA, 19 nt, Homo sapiens
ggagaaauugugcauaugc

SEQ ID NO: 117906 - RNA, 19 nt, Homo sapiens
ucgccgagaugacauggaa

SEQ ID NO: 117907 - RNA, 19 nt, Homo sapiens
cauuaaaccagauaacuuc

SEQ ID NO: 117908 - RNA, 19 nt, Homo sapiens
agacucugccugcuuaauu

SEQ ID NO: 117909 - RNA, 19 nt, Homo sapiens
aaccaagaguaacaugaaa

SEQ ID NO: 117910 - RNA, 19 nt, Homo sapiens
ggacccugaaccaucaaua

SEQ ID NO: 117911 - RNA, 19 nt, Homo sapiens
gaagauguccacgccuguu

SEQ ID NO: 117912 - RNA, 19 nt, Homo sapiens
ucuauaugaucugggauuu

SEQ ID NO: 117913 - RNA, 19 nt, Homo sapiens
gcuuaauugugcuagaaau

SEQ ID NO: 117914 - RNA, 19 nt, Homo sapiens
caaccaaagauuccagugu

SEQ ID NO: 117915 - RNA, 19 nt, Homo sapiens
aguuguagccucuguaauu

SEQ ID NO: 117916 - RNA, 19 nt, Homo sapiens
ccaucaauaugacuacaca

SEQ ID NO: 117917 - RNA, 19 nt, Homo sapiens
caggacaaggcaacacaua

SEQ ID NO: 117918 - RNA, 19 nt, Homo sapiens
ccucuucaauuucuguuca

SEQ ID NO: 117919 - RNA, 19 nt, Homo sapiens
gaagaacggcaugaacagu

SEQ ID NO: 117920 - RNA, 19 nt, Homo sapiens
aagaguaacaugaaagguu

SEQ ID NO: 117921 - RNA, 19 nt, Homo sapiens
ucaaugcacaucuugguau

SEQ ID NO: 117922 - RNA, 19 nt, Homo sapiens
aaacuguacuuauguuagc

SEQ ID NO: 117923 - RNA, 19 nt, Homo sapiens
uuaggacucugcauuaacu

SEQ ID NO: 117924 - RNA, 19 nt, Homo sapiens
uguuaaaugcucacaauug

SEQ ID NO: 117925 - RNA, 19 nt, Homo sapiens
guggacaaccauuuacuug

SEQ ID NO: 117926 - RNA, 19 nt, Homo sapiens
gacccugaaccaucaauau

SEQ ID NO: 117927 - RNA, 19 nt, Homo sapiens
acuacuagauuauccuuag

SEQ ID NO: 117928 - RNA, 19 nt, Homo sapiens
accaaagauuccaguguuu

SEQ ID NO: 117929 - RNA, 19 nt, Homo sapiens
agaauuugcgauguacuua

SEQ ID NO: 117930 - RNA, 19 nt, Homo sapiens
gggguuuccugcagaauuu

SEQ ID NO: 117931 - RNA, 19 nt, Homo sapiens
uaccauacagagaagauaa

SEQ ID NO: 117932 - RNA, 19 nt, Homo sapiens
gacucugcauuaacucuau

SEQ ID NO: 117933 - RNA, 19 nt, Homo sapiens
ggacauugcugcaggagaa

SEQ ID NO: 117934 - RNA, 19 nt, Homo sapiens
caagauaccucucgcaugu

SEQ ID NO: 117935 - RNA, 19 nt, Homo sapiens
gagaagagguugccaucaa

SEQ ID NO: 117936 - RNA, 19 nt, Homo sapiens
ccacauaccugaauuucug

SEQ ID NO: 117937 - RNA, 19 nt, Homo sapiens
uggcugaucuacucuguua

SEQ ID NO: 117938 - RNA, 19 nt, Homo sapiens
gaucuacucuguuaccaau

SEQ ID NO: 117939 - RNA, 19 nt, Homo sapiens
ggaaagcgauggugaaagc

SEQ ID NO: 117940 - RNA, 19 nt, Homo sapiens
gaacaaucccgaagagaug

SEQ ID NO: 117941 - RNA, 19 nt, Homo sapiens
gcuuaaaucuguguaaaga

SEQ ID NO: 117942 - RNA, 19 nt, Homo sapiens
gagagagaauugcagagaa

SEQ ID NO: 117943 - RNA, 19 nt, Homo sapiens
ggucuaggaucgaaauguu

SEQ ID NO: 117944 - RNA, 19 nt, Homo sapiens
ggaacaugcucaaauuugg

SEQ ID NO: 117945 - RNA, 19 nt, Homo sapiens
ccaauggcuuuacuaguga

SEQ ID NO: 117946 - RNA, 19 nt, Homo sapiens
aggcuacccuuccgaauuu

SEQ ID NO: 117947 - RNA, 19 nt, Homo sapiens
ccaucgaaguguuguguaa

SEQ ID NO: 117948 - RNA, 19 nt, Homo sapiens
ccaccaagagacagaaaua

SEQ ID NO: 117949 - RNA, 19 nt, Homo sapiens
ccaguggucuucagucugu

SEQ ID NO: 117950 - RNA, 19 nt, Homo sapiens
cagagaaucagacuccuuu

SEQ ID NO: 117951 - RNA, 19 nt, Homo sapiens
cacgugaacucgguuguaa

SEQ ID NO: 117952 - RNA, 19 nt, Homo sapiens
cagaaauacgaaaggauua

SEQ ID NO: 117953 - RNA, 19 nt, Homo sapiens
caacacgcaccuuggaauu

SEQ ID NO: 117954 - RNA, 19 nt, Homo sapiens
gacaaugcauggcugaucu

SEQ ID NO: 117955 - RNA, 19 nt, Homo sapiens
gagagagagcggaaaguga

SEQ ID NO: 117956 - RNA, 19 nt, Homo sapiens
gagaggagcggcugagaca

SEQ ID NO: 117957 - RNA, 19 nt, Homo sapiens
acacgcaccuuggaauuga

SEQ ID NO: 117958 - RNA, 19 nt, Homo sapiens
agagagaauugcagagaau

SEQ ID NO: 117959 - RNA, 19 nt, Homo sapiens
accaauggcuuuacuagug

SEQ ID NO: 117960 - RNA, 19 nt, Homo sapiens
gcugcuugcugaccaaaug

SEQ ID NO: 117961 - RNA, 19 nt, Homo sapiens
caacuucugcuccaggaaa

SEQ ID NO: 117962 - RNA, 19 nt, Homo sapiens
acuggaacaugcucaaauu

SEQ ID NO: 117963 - RNA, 19 nt, Homo sapiens
agacagaaauacgaaagga

SEQ ID NO: 117964 - RNA, 19 nt, Homo sapiens
caagagacagaaauacgaa

SEQ ID NO: 117965 - RNA, 19 nt, Homo sapiens
ggagagagagcggaaagug

SEQ ID NO: 117966 - RNA, 19 nt, Homo sapiens
acagaaauacgaaaggauu

SEQ ID NO: 117967 - RNA, 19 nt, Homo sapiens
gcuacgugcuaauguacuu

SEQ ID NO: 117968 - RNA, 19 nt, Homo sapiens
gccagggcuucuccuauga

SEQ ID NO: 117969 - RNA, 19 nt, Homo sapiens
gaaaggauuagcgagaaga

SEQ ID NO: 117970 - RNA, 19 nt, Homo sapiens
cgccagggcuucuccuaug

SEQ ID NO: 117971 - RNA, 19 nt, Homo sapiens
acccucagcuccacauuga

SEQ ID NO: 117972 - RNA, 19 nt, Homo sapiens
gaacaugcucaaauuuggu

SEQ ID NO: 117973 - RNA, 19 nt, Homo sapiens
cuuccgaauuugccacaua

SEQ ID NO: 117974 - RNA, 19 nt, Homo sapiens
uaacggggcugggaagaaa

SEQ ID NO: 117975 - RNA, 19 nt, Homo sapiens
aaugaucagucgcaucgaa

SEQ ID NO: 117976 - RNA, 19 nt, Homo sapiens
uggcuuaaaucuguguaaa

SEQ ID NO: 117977 - RNA, 19 nt, Homo sapiens
gcagagaaucagacuccuu

SEQ ID NO: 117978 - RNA, 19 nt, Homo sapiens
ccaagagacagaaauacga

SEQ ID NO: 117979 - RNA, 19 nt, Homo sapiens
cgaaaggauuagcgagaag

SEQ ID NO: 117980 - RNA, 19 nt, Homo sapiens
gaaggcugccaccaagaga

SEQ ID NO: 117981 - RNA, 19 nt, Homo sapiens
gaagaaaagcagagagaga

SEQ ID NO: 117982 - RNA, 19 nt, Homo sapiens
ugaacaaucccgaagagau

SEQ ID NO: 117983 - RNA, 19 nt, Homo sapiens
ccugacgauuccacuguaa

SEQ ID NO: 117984 - RNA, 19 nt, Homo sapiens
agaagagguugccaucaag

SEQ ID NO: 117985 - RNA, 19 nt, Homo sapiens
ugggcuacgugcuaaugua

SEQ ID NO: 117986 - RNA, 19 nt, Homo sapiens
caggaaagcgauggugaaa

SEQ ID NO: 117987 - RNA, 19 nt, Homo sapiens
uggaacaugcucaaauuug

SEQ ID NO: 117988 - RNA, 19 nt, Homo sapiens
gggcuucuccuaugacuac

SEQ ID NO: 117989 - RNA, 19 nt, Homo sapiens
acgaaaggauuagcgagaa

SEQ ID NO: 117990 - RNA, 19 nt, Homo sapiens
ucucugggcuacgugcuaa

SEQ ID NO: 117991 - RNA, 19 nt, Homo sapiens
ucuaggaucgaaauguuaa

SEQ ID NO: 117992 - RNA, 19 nt, Homo sapiens
gagcggaaagugaguaugc

SEQ ID NO: 117993 - RNA, 19 nt, Homo sapiens
ccacgugaacucgguugua

SEQ ID NO: 117994 - RNA, 19 nt, Homo sapiens
gcaaccugguguacaucau

SEQ ID NO: 117995 - RNA, 19 nt, Homo sapiens
guaacuaccaaucuucuac

SEQ ID NO: 117996 - RNA, 19 nt, Homo sapiens
caucaacacgcaccuugga

SEQ ID NO: 117997 - RNA, 19 nt, Homo sapiens
augcauggcugaucuacuc

SEQ ID NO: 117998 - RNA, 19 nt, Homo sapiens
caggaaauucagccucaaa

SEQ ID NO: 117999 - RNA, 19 nt, Homo sapiens
cuacuugguuaagacaguu

SEQ ID NO: 118000 - RNA, 19 nt, Homo sapiens
cacuguaacuaccaaucuu

SEQ ID NO: 118001 - RNA, 19 nt, Homo sapiens
gaaaagcagagagagaauu

SEQ ID NO: 118002 - RNA, 19 nt, Homo sapiens
cauguccaccucacagauu

SEQ ID NO: 118003 - RNA, 19 nt, Homo sapiens
ccucacaggccgacaagau

SEQ ID NO: 118004 - RNA, 19 nt, Homo sapiens
ggagaagagguugccauca

SEQ ID NO: 118005 - RNA, 19 nt, Homo sapiens
aaacggacagacuccaaga

SEQ ID NO: 118006 - RNA, 19 nt, Homo sapiens
gagagcggaaagugaguau

SEQ ID NO: 118007 - RNA, 19 nt, Homo sapiens
gacuggaacaugcucaaau

SEQ ID NO: 118008 - RNA, 19 nt, Homo sapiens
gagcugagagucgggaaca

SEQ ID NO: 118009 - RNA, 19 nt, Homo sapiens
ugaucagucgcaucgaaua

SEQ ID NO: 118010 - RNA, 19 nt, Homo sapiens
agagagagaauugcagaga

SEQ ID NO: 118011 - RNA, 19 nt, Homo sapiens
gucuaggaucgaaauguua

SEQ ID NO: 118012 - RNA, 19 nt, Homo sapiens
gugaagggcagacaaugca

SEQ ID NO: 118013 - RNA, 19 nt, Homo sapiens
gaucagucgcaucgaauac

SEQ ID NO: 118014 - RNA, 19 nt, Homo sapiens
cuaccucacacacggcuaa

SEQ ID NO: 118015 - RNA, 19 nt, Homo sapiens
gaggagcggcugagacacu

SEQ ID NO: 118016 - RNA, 19 nt, Homo sapiens
gcaccuuggaauugaacaa

SEQ ID NO: 118017 - RNA, 19 nt, Homo sapiens
ucagucgcaucgaauacau

SEQ ID NO: 118018 - RNA, 19 nt, Homo sapiens
ccaggaaauucagccucaa

SEQ ID NO: 118019 - RNA, 19 nt, Homo sapiens
ccacuguaacuaccaaucu

SEQ ID NO: 118020 - RNA, 19 nt, Homo sapiens
cauggcugaucuacucugu

SEQ ID NO: 118021 - RNA, 19 nt, Homo sapiens
cucacaggccgacaagaua

SEQ ID NO: 118022 - RNA, 19 nt, Homo sapiens
gaagggcaaccugguguac

SEQ ID NO: 118023 - RNA, 19 nt, Homo sapiens
gacgauuccacuguaacua

SEQ ID NO: 118024 - RNA, 19 nt, Homo sapiens
ucuacucuguuaccaaugg

SEQ ID NO: 118025 - RNA, 19 nt, Homo sapiens
gcugugaagggcagacaau

SEQ ID NO: 118026 - RNA, 19 nt, Homo sapiens
gcauguccaccucacagau

SEQ ID NO: 118027 - RNA, 19 nt, Homo sapiens
caucgaaguguuguguaaa

SEQ ID NO: 118028 - RNA, 19 nt, Homo sapiens
ucaacacgcaccuuggaau

SEQ ID NO: 118029 - RNA, 19 nt, Homo sapiens
gccagacaacuuccucaug

SEQ ID NO: 118030 - RNA, 19 nt, Homo sapiens
acaggaaagcgauggugaa

SEQ ID NO: 118031 - RNA, 19 nt, Homo sapiens
cccugacgauuccacugua

SEQ ID NO: 118032 - RNA, 19 nt, Homo sapiens
gugcaccgaugagaacucu

SEQ ID NO: 118033 - RNA, 19 nt, Homo sapiens
ggacauugcugcaggagaa

SEQ ID NO: 118034 - RNA, 19 nt, Homo sapiens
caagauaccucucgcaugu

SEQ ID NO: 118035 - RNA, 19 nt, Homo sapiens
gagaagagguugccaucaa

SEQ ID NO: 118036 - RNA, 19 nt, Homo sapiens
ccacauaccugaauuucug

SEQ ID NO: 118037 - RNA, 19 nt, Homo sapiens
uggcugaucuacucuguua

SEQ ID NO: 118038 - RNA, 19 nt, Homo sapiens
gaucuacucuguuaccaau

SEQ ID NO: 118039 - RNA, 19 nt, Homo sapiens
ggaaagcgauggugaaagc

SEQ ID NO: 118040 - RNA, 19 nt, Homo sapiens
gaacaaucccgaagagaug

SEQ ID NO: 118041 - RNA, 19 nt, Homo sapiens
gcuuaaaucuguguaaaga

SEQ ID NO: 118042 - RNA, 19 nt, Homo sapiens
gagagagaauugcagagaa

SEQ ID NO: 118043 - RNA, 19 nt, Homo sapiens
ggucuaggaucgaaauguu

SEQ ID NO: 118044 - RNA, 19 nt, Homo sapiens
ggaacaugcucaaauuugg

SEQ ID NO: 118045 - RNA, 19 nt, Homo sapiens
ccaauggcuuuacuaguga

SEQ ID NO: 118046 - RNA, 19 nt, Homo sapiens
aggcuacccuuccgaauuu

SEQ ID NO: 118047 - RNA, 19 nt, Homo sapiens
ccaucgaaguguuguguaa

SEQ ID NO: 118048 - RNA, 19 nt, Homo sapiens
ccaccaagagacagaaaua

SEQ ID NO: 118049 - RNA, 19 nt, Homo sapiens
ccaguggucuucagucugu

SEQ ID NO: 118050 - RNA, 19 nt, Homo sapiens
cagagaaucagacuccuuu

SEQ ID NO: 118051 - RNA, 19 nt, Homo sapiens
cacgugaacucgguuguaa

SEQ ID NO: 118052 - RNA, 19 nt, Homo sapiens
cagaaauacgaaaggauua

SEQ ID NO: 118053 - RNA, 19 nt, Homo sapiens
caacacgcaccuuggaauu

SEQ ID NO: 118054 - RNA, 19 nt, Homo sapiens
gacaaugcauggcugaucu

SEQ ID NO: 118055 - RNA, 19 nt, Homo sapiens
gagagagagcggaaaguga

SEQ ID NO: 118056 - RNA, 19 nt, Homo sapiens
gagaggagcggcugagaca

SEQ ID NO: 118057 - RNA, 19 nt, Homo sapiens
acacgcaccuuggaauuga

SEQ ID NO: 118058 - RNA, 19 nt, Homo sapiens
agagagaauugcagagaau

SEQ ID NO: 118059 - RNA, 19 nt, Homo sapiens
accaauggcuuuacuagug

SEQ ID NO: 118060 - RNA, 19 nt, Homo sapiens
gcugcuugcugaccaaaug

SEQ ID NO: 118061 - RNA, 19 nt, Homo sapiens
caacuucugcuccaggaaa

SEQ ID NO: 118062 - RNA, 19 nt, Homo sapiens
acuggaacaugcucaaauu

SEQ ID NO: 118063 - RNA, 19 nt, Homo sapiens
agacagaaauacgaaagga

SEQ ID NO: 118064 - RNA, 19 nt, Homo sapiens
caagagacagaaauacgaa

SEQ ID NO: 118065 - RNA, 19 nt, Homo sapiens
ggagagagagcggaaagug

SEQ ID NO: 118066 - RNA, 19 nt, Homo sapiens
acagaaauacgaaaggauu

SEQ ID NO: 118067 - RNA, 19 nt, Homo sapiens
gcuacgugcuaauguacuu

SEQ ID NO: 118068 - RNA, 19 nt, Homo sapiens
gccagggcuucuccuauga

SEQ ID NO: 118069 - RNA, 19 nt, Homo sapiens
gaaaggauuagcgagaaga

SEQ ID NO: 118070 - RNA, 19 nt, Homo sapiens
cgccagggcuucuccuaug

SEQ ID NO: 118071 - RNA, 19 nt, Homo sapiens
acccucagcuccacauuga

SEQ ID NO: 118072 - RNA, 19 nt, Homo sapiens
gaacaugcucaaauuuggu

SEQ ID NO: 118073 - RNA, 19 nt, Homo sapiens
cuuccgaauuugccacaua

SEQ ID NO: 118074 - RNA, 19 nt, Homo sapiens
uaacggggcugggaagaaa

SEQ ID NO: 118075 - RNA, 19 nt, Homo sapiens
aaugaucagucgcaucgaa

SEQ ID NO: 118076 - RNA, 19 nt, Homo sapiens
uggcuuaaaucuguguaaa

SEQ ID NO: 118077 - RNA, 19 nt, Homo sapiens
gcagagaaucagacuccuu

SEQ ID NO: 118078 - RNA, 19 nt, Homo sapiens
ggaaggcagcacuggauuc

SEQ ID NO: 118079 - RNA, 19 nt, Homo sapiens
ccaagagacagaaauacga

SEQ ID NO: 118080 - RNA, 19 nt, Homo sapiens
cgaaaggauuagcgagaag

SEQ ID NO: 118081 - RNA, 19 nt, Homo sapiens
gaaggcugccaccaagaga

SEQ ID NO: 118082 - RNA, 19 nt, Homo sapiens
gaagaaaagcagagagaga

SEQ ID NO: 118083 - RNA, 19 nt, Homo sapiens
ugaacaaucccgaagagau

SEQ ID NO: 118084 - RNA, 19 nt, Homo sapiens
ccugacgauuccacuguaa

SEQ ID NO: 118085 - RNA, 19 nt, Homo sapiens
agaagagguugccaucaag

SEQ ID NO: 118086 - RNA, 19 nt, Homo sapiens
ugggcuacgugcuaaugua

SEQ ID NO: 118087 - RNA, 19 nt, Homo sapiens
caggaaagcgauggugaaa

SEQ ID NO: 118088 - RNA, 19 nt, Homo sapiens
gcauguccaccucacagaa

SEQ ID NO: 118089 - RNA, 19 nt, Homo sapiens
uggaacaugcucaaauuug

SEQ ID NO: 118090 - RNA, 19 nt, Homo sapiens
gggcuucuccuaugacuac

SEQ ID NO: 118091 - RNA, 19 nt, Homo sapiens
acgaaaggauuagcgagaa

SEQ ID NO: 118092 - RNA, 19 nt, Homo sapiens
ucucugggcuacgugcuaa

SEQ ID NO: 118093 - RNA, 19 nt, Homo sapiens
ucuaggaucgaaauguuaa

SEQ ID NO: 118094 - RNA, 19 nt, Homo sapiens
gagcggaaagugaguaugc

SEQ ID NO: 118095 - RNA, 19 nt, Homo sapiens
ccacgugaacucgguugua

SEQ ID NO: 118096 - RNA, 19 nt, Homo sapiens
gcaaccugguguacaucau

SEQ ID NO: 118097 - RNA, 19 nt, Homo sapiens
guaacuaccaaucuucuac

SEQ ID NO: 118098 - RNA, 19 nt, Homo sapiens
caucaacacgcaccuugga

SEQ ID NO: 118099 - RNA, 19 nt, Homo sapiens
augcauggcugaucuacuc

SEQ ID NO: 118100 - RNA, 19 nt, Homo sapiens
caggaaauucagccucaaa

SEQ ID NO: 118101 - RNA, 19 nt, Homo sapiens
cuacuugguuaagacaguu

SEQ ID NO: 118102 - RNA, 19 nt, Homo sapiens
cacuguaacuaccaaucuu

SEQ ID NO: 118103 - RNA, 19 nt, Homo sapiens
gaaaagcagagagagaauu

SEQ ID NO: 118104 - RNA, 19 nt, Homo sapiens
ccucacaggccgacaagau

SEQ ID NO: 118105 - RNA, 19 nt, Homo sapiens
ggagaagagguugccauca

SEQ ID NO: 118106 - RNA, 19 nt, Homo sapiens
aaacggacagacuccaaga

SEQ ID NO: 118107 - RNA, 19 nt, Homo sapiens
uagcauuccuuucgaacac

SEQ ID NO: 118108 - RNA, 19 nt, Homo sapiens
gagagcggaaagugaguau

SEQ ID NO: 118109 - RNA, 19 nt, Homo sapiens
gacuggaacaugcucaaau

SEQ ID NO: 118110 - RNA, 19 nt, Homo sapiens
gagcugagagucgggaaca

SEQ ID NO: 118111 - RNA, 19 nt, Homo sapiens
ugaucagucgcaucgaaua

SEQ ID NO: 118112 - RNA, 19 nt, Homo sapiens
agagagagaauugcagaga

SEQ ID NO: 118113 - RNA, 19 nt, Homo sapiens
gucuaggaucgaaauguua

SEQ ID NO: 118114 - RNA, 19 nt, Homo sapiens
gugaagggcagacaaugca

SEQ ID NO: 118115 - RNA, 19 nt, Homo sapiens
gaucagucgcaucgaauac

SEQ ID NO: 118116 - RNA, 19 nt, Homo sapiens
cuaccucacacacggcuaa

SEQ ID NO: 118117 - RNA, 19 nt, Homo sapiens
gaggagcggcugagacacu

SEQ ID NO: 118118 - RNA, 19 nt, Homo sapiens
gcaccuuggaauugaacaa

SEQ ID NO: 118119 - RNA, 19 nt, Homo sapiens
ucagucgcaucgaauacau

SEQ ID NO: 118120 - RNA, 19 nt, Homo sapiens
ccaggaaauucagccucaa

SEQ ID NO: 118121 - RNA, 19 nt, Homo sapiens
ccacuguaacuaccaaucu

SEQ ID NO: 118122 - RNA, 19 nt, Homo sapiens
cauggcugaucuacucugu

SEQ ID NO: 118123 - RNA, 19 nt, Homo sapiens
ucgaacaccacggcaagua

SEQ ID NO: 118124 - RNA, 19 nt, Homo sapiens
cucacaggccgacaagaua

SEQ ID NO: 118125 - RNA, 19 nt, Homo sapiens
gaagggcaaccugguguac

SEQ ID NO: 118126 - RNA, 19 nt, Homo sapiens
gacgauuccacuguaacua

SEQ ID NO: 118127 - RNA, 19 nt, Homo sapiens
ucuacucuguuaccaaugg

SEQ ID NO: 118128 - RNA, 19 nt, Homo sapiens
gcugugaagggcagacaau

SEQ ID NO: 118129 - RNA, 19 nt, Homo sapiens
caucgaaguguuguguaaa

SEQ ID NO: 118130 - RNA, 19 nt, Homo sapiens
ucaacacgcaccuuggaau

SEQ ID NO: 118131 - RNA, 19 nt, Homo sapiens
gccagacaacuuccucaug

SEQ ID NO: 118132 - RNA, 19 nt, Homo sapiens
acaggaaagcgauggugaa

SEQ ID NO: 118133 - RNA, 19 nt, Homo sapiens
caacauaccucaacuucug

SEQ ID NO: 118134 - RNA, 19 nt, Homo sapiens
gagcaaagccgucgagaug

SEQ ID NO: 118135 - RNA, 19 nt, Homo sapiens
ggaggagaaucaagaguga

SEQ ID NO: 118136 - RNA, 19 nt, Homo sapiens
caacuucuguucccgcaaa

SEQ ID NO: 118137 - RNA, 19 nt, Homo sapiens
gagagcaaguucuacaaga

SEQ ID NO: 118138 - RNA, 19 nt, Homo sapiens
agacaagugugccauuuga

SEQ ID NO: 118139 - RNA, 19 nt, Homo sapiens
ccaccaagcgccagaagua

SEQ ID NO: 118140 - RNA, 19 nt, Homo sapiens
gagaggaaggugaguauga

SEQ ID NO: 118141 - RNA, 19 nt, Homo sapiens
gaacggaucagcgagaaga

SEQ ID NO: 118142 - RNA, 19 nt, Homo sapiens
ccaucaagcuggagugugu

SEQ ID NO: 118143 - RNA, 19 nt, Homo sapiens
ucgaggaccuguucaacuu

SEQ ID NO: 118144 - RNA, 19 nt, Homo sapiens
cggcagggcuucuccuaug

SEQ ID NO: 118145 - RNA, 19 nt, Homo sapiens
cgacuacucuuaccuacgu

SEQ ID NO: 118146 - RNA, 19 nt, Homo sapiens
gcuacgugcucauguacuu

SEQ ID NO: 118147 - RNA, 19 nt, Homo sapiens
ccuccgaauucucaacaua

SEQ ID NO: 118148 - RNA, 19 nt, Homo sapiens
gcaaagccgucgagaugac

SEQ ID NO: 118149 - RNA, 19 nt, Homo sapiens
caucacaguuugagcuuca

SEQ ID NO: 118150 - RNA, 19 nt, Homo sapiens
gcacaucgagagcaaguuc

SEQ ID NO: 118151 - RNA, 19 nt, Homo sapiens
gaccaguguuugcuuagug

SEQ ID NO: 118152 - RNA, 19 nt, Homo sapiens
gagcugagggcgacuacaa

SEQ ID NO: 118153 - RNA, 19 nt, Homo sapiens
acagacaagugugccauuu

SEQ ID NO: 118154 - RNA, 19 nt, Homo sapiens
acuggaacaugcugaaauu

SEQ ID NO: 118155 - RNA, 19 nt, Homo sapiens
gcucuuggccgaccagaug

SEQ ID NO: 118156 - RNA, 19 nt, Homo sapiens
gagcaaguucuacaagaug

SEQ ID NO: 118157 - RNA, 19 nt, Homo sapiens
ggcagggcuucuccuauga

SEQ ID NO: 118158 - RNA, 19 nt, Homo sapiens
gugaggaagucgccaucaa

SEQ ID NO: 118159 - RNA, 19 nt, Homo sapiens
aguuugagcuucagggaaa

SEQ ID NO: 118160 - RNA, 19 nt, Homo sapiens
acacgcaccugggcauuga

SEQ ID NO: 118161 - RNA, 19 nt, Homo sapiens
uggagugugugaagacaaa

SEQ ID NO: 118162 - RNA, 19 nt, Homo sapiens
ccaagcgccagaaguauga

SEQ ID NO: 118163 - RNA, 19 nt, Homo sapiens
gaucagccgcaucgaguau

SEQ ID NO: 118164 - RNA, 19 nt, Homo sapiens
gaucccagccucacagaca

SEQ ID NO: 118165 - RNA, 19 nt, Homo sapiens
cgacaagcccgacuacucu

SEQ ID NO: 118166 - RNA, 19 nt, Homo sapiens
agagcaaguucuacaagau

SEQ ID NO: 118167 - RNA, 19 nt, Homo sapiens
ggaccaguguuugcuuagu

SEQ ID NO: 118168 - RNA, 19 nt, Homo sapiens
ccgcuacgcuuccaucaac

SEQ ID NO: 118169 - RNA, 19 nt, Homo sapiens
gggagaggaaggugaguau

SEQ ID NO: 118170 - RNA, 19 nt, Homo sapiens
gagcggguccuucggagau

SEQ ID NO: 118171 - RNA, 19 nt, Homo sapiens
gggcuucuccuaugacuac

SEQ ID NO: 118172 - RNA, 19 nt, Homo sapiens
cgucaagcccgacaacuuc

SEQ ID NO: 118173 - RNA, 19 nt, Homo sapiens
gaggaccuguucaacuucu

SEQ ID NO: 118174 - RNA, 19 nt, Homo sapiens
uuggaccaguguuugcuua

SEQ ID NO: 118175 - RNA, 19 nt, Homo sapiens
cuaccugggugccaacauc

SEQ ID NO: 118176 - RNA, 19 nt, Homo sapiens
ugggcuacgugcucaugua

SEQ ID NO: 118177 - RNA, 19 nt, Homo sapiens
gcaaccuggucuacaucau

SEQ ID NO: 118178 - RNA, 19 nt, Homo sapiens
ucagccgcaucgaguauau

SEQ ID NO: 118179 - RNA, 19 nt, Homo sapiens
acaagcccgacuacucuua

SEQ ID NO: 118180 - RNA, 19 nt, Homo sapiens
gcaccugggcauugagcaa

SEQ ID NO: 118181 - RNA, 19 nt, Homo sapiens
caaccuggucuacaucauc

SEQ ID NO: 118182 - RNA, 19 nt, Homo sapiens
gcgagaagaagaugucaac

SEQ ID NO: 118183 - RNA, 19 nt, Homo sapiens
gaucagcgagaagaagaug

SEQ ID NO: 118184 - RNA, 19 nt, Homo sapiens
uauauccacuccaagaacu

SEQ ID NO: 118185 - RNA, 19 nt, Homo sapiens
gggaucccguccaucaagu

SEQ ID NO: 118186 - RNA, 19 nt, Homo sapiens
agcaaguucuacaagauga

SEQ ID NO: 118187 - RNA, 19 nt, Homo sapiens
cagacaagugugccauuug

SEQ ID NO: 118188 - RNA, 19 nt, Homo sapiens
gacuggaacaugcugaaau

SEQ ID NO: 118189 - RNA, 19 nt, Homo sapiens
gcccgacuacucuuaccua

SEQ ID NO: 118190 - RNA, 19 nt, Homo sapiens
uuaccuacgucagcucuuc

SEQ ID NO: 118191 - RNA, 19 nt, Homo sapiens
acaacgugauggucaugga

SEQ ID NO: 118192 - RNA, 19 nt, Homo sapiens
agaggaaggugaguaugag

SEQ ID NO: 118193 - RNA, 19 nt, Homo sapiens
aaggcuaucccuccgaauu

SEQ ID NO: 118194 - RNA, 19 nt, Homo sapiens
agagugagccauggagcua

SEQ ID NO: 118195 - RNA, 19 nt, Homo sapiens
caacacgcaccugggcauu

SEQ ID NO: 118196 - RNA, 19 nt, Homo sapiens
gcaaauucagccucaagac

SEQ ID NO: 118197 - RNA, 19 nt, Homo sapiens
gaagggcaaccuggucuac

SEQ ID NO: 118198 - RNA, 19 nt, Homo sapiens
ccuaugacuacgucuuuga

SEQ ID NO: 118199 - RNA, 19 nt, Homo sapiens
ggagaggaaggugaguaug

SEQ ID NO: 118200 - RNA, 19 nt, Homo sapiens
gcuggagugugugaagaca

SEQ ID NO: 118201 - RNA, 19 nt, Homo sapiens
ggaccuguucaacuucugu

SEQ ID NO: 118202 - RNA, 19 nt, Homo sapiens
aagcuggagugugugaaga

SEQ ID NO: 118203 - RNA, 19 nt, Homo sapiens
caacauaccucaacuucug

SEQ ID NO: 118204 - RNA, 19 nt, Homo sapiens
gagcaaagccgucgagaug

SEQ ID NO: 118205 - RNA, 19 nt, Homo sapiens
caacuucuguucccgcaaa

SEQ ID NO: 118206 - RNA, 19 nt, Homo sapiens
gagagcaaguucuacaaga

SEQ ID NO: 118207 - RNA, 19 nt, Homo sapiens
agacaagugugccauuuga

SEQ ID NO: 118208 - RNA, 19 nt, Homo sapiens
ccaccaagcgccagaagua

SEQ ID NO: 118209 - RNA, 19 nt, Homo sapiens
gagaggaaggugaguauga

SEQ ID NO: 118210 - RNA, 19 nt, Homo sapiens
gaacggaucagcgagaaga

SEQ ID NO: 118211 - RNA, 19 nt, Homo sapiens
ccaucaagcuggagugugu

SEQ ID NO: 118212 - RNA, 19 nt, Homo sapiens
ucgaggaccuguucaacuu

SEQ ID NO: 118213 - RNA, 19 nt, Homo sapiens
cggcagggcuucuccuaug

SEQ ID NO: 118214 - RNA, 19 nt, Homo sapiens
cgacuacucuuaccuacgu

SEQ ID NO: 118215 - RNA, 19 nt, Homo sapiens
gcuacgugcucauguacuu

SEQ ID NO: 118216 - RNA, 19 nt, Homo sapiens
ccuccgaauucucaacaua

SEQ ID NO: 118217 - RNA, 19 nt, Homo sapiens
gcaaagccgucgagaugac

SEQ ID NO: 118218 - RNA, 19 nt, Homo sapiens
gcacaucgagagcaaguuc

SEQ ID NO: 118219 - RNA, 19 nt, Homo sapiens
gaccaguguuugcuuagug

SEQ ID NO: 118220 - RNA, 19 nt, Homo sapiens
gagcugagggcgacuacaa

SEQ ID NO: 118221 - RNA, 19 nt, Homo sapiens
acagacaagugugccauuu

SEQ ID NO: 118222 - RNA, 19 nt, Homo sapiens
acuggaacaugcugaaauu

SEQ ID NO: 118223 - RNA, 19 nt, Homo sapiens
gcucuuggccgaccagaug

SEQ ID NO: 118224 - RNA, 19 nt, Homo sapiens
gagcaaguucuacaagaug

SEQ ID NO: 118225 - RNA, 19 nt, Homo sapiens
ggcagggcuucuccuauga

SEQ ID NO: 118226 - RNA, 19 nt, Homo sapiens
gugaggaagucgccaucaa

SEQ ID NO: 118227 - RNA, 19 nt, Homo sapiens
acacgcaccugggcauuga

SEQ ID NO: 118228 - RNA, 19 nt, Homo sapiens
uggagugugugaagacaaa

SEQ ID NO: 118229 - RNA, 19 nt, Homo sapiens
ccaagcgccagaaguauga

SEQ ID NO: 118230 - RNA, 19 nt, Homo sapiens
gaucagccgcaucgaguau

SEQ ID NO: 118231 - RNA, 19 nt, Homo sapiens
gaucccagccucacagaca

SEQ ID NO: 118232 - RNA, 19 nt, Homo sapiens
cgacaagcccgacuacucu

SEQ ID NO: 118233 - RNA, 19 nt, Homo sapiens
agagcaaguucuacaagau

SEQ ID NO: 118234 - RNA, 19 nt, Homo sapiens
ggaccaguguuugcuuagu

SEQ ID NO: 118235 - RNA, 19 nt, Homo sapiens
ccgcuacgcuuccaucaac

SEQ ID NO: 118236 - RNA, 19 nt, Homo sapiens
gggagaggaaggugaguau

SEQ ID NO: 118237 - RNA, 19 nt, Homo sapiens
gagcggguccuucggagau

SEQ ID NO: 118238 - RNA, 19 nt, Homo sapiens
gggcuucuccuaugacuac

SEQ ID NO: 118239 - RNA, 19 nt, Homo sapiens
cgucaagcccgacaacuuc

SEQ ID NO: 118240 - RNA, 19 nt, Homo sapiens
gaggaccuguucaacuucu

SEQ ID NO: 118241 - RNA, 19 nt, Homo sapiens
uuggaccaguguuugcuua

SEQ ID NO: 118242 - RNA, 19 nt, Homo sapiens
cuaccugggugccaacauc

SEQ ID NO: 118243 - RNA, 19 nt, Homo sapiens
ugggcuacgugcucaugua

SEQ ID NO: 118244 - RNA, 19 nt, Homo sapiens
gcaaccuggucuacaucau

SEQ ID NO: 118245 - RNA, 19 nt, Homo sapiens
ucagccgcaucgaguauau

SEQ ID NO: 118246 - RNA, 19 nt, Homo sapiens
acaagcccgacuacucuua

SEQ ID NO: 118247 - RNA, 19 nt, Homo sapiens
gcaccugggcauugagcaa

SEQ ID NO: 118248 - RNA, 19 nt, Homo sapiens
caaccuggucuacaucauc

SEQ ID NO: 118249 - RNA, 19 nt, Homo sapiens
gcgagaagaagaugucaac

SEQ ID NO: 118250 - RNA, 19 nt, Homo sapiens
gaucagcgagaagaagaug

SEQ ID NO: 118251 - RNA, 19 nt, Homo sapiens
uauauccacuccaagaacu

SEQ ID NO: 118252 - RNA, 19 nt, Homo sapiens
gggaucccguccaucaagu

SEQ ID NO: 118253 - RNA, 19 nt, Homo sapiens
agcaaguucuacaagauga

SEQ ID NO: 118254 - RNA, 19 nt, Homo sapiens
cagacaagugugccauuug

SEQ ID NO: 118255 - RNA, 19 nt, Homo sapiens
gacuggaacaugcugaaau

SEQ ID NO: 118256 - RNA, 19 nt, Homo sapiens
gcccgacuacucuuaccua

SEQ ID NO: 118257 - RNA, 19 nt, Homo sapiens
uuaccuacgucagcucuuc

SEQ ID NO: 118258 - RNA, 19 nt, Homo sapiens
acaacgugauggucaugga

SEQ ID NO: 118259 - RNA, 19 nt, Homo sapiens
agaggaaggugaguaugag

SEQ ID NO: 118260 - RNA, 19 nt, Homo sapiens
aaggcuaucccuccgaauu

SEQ ID NO: 118261 - RNA, 19 nt, Homo sapiens
agagugagccauggagcua

SEQ ID NO: 118262 - RNA, 19 nt, Homo sapiens
caacacgcaccugggcauu

SEQ ID NO: 118263 - RNA, 19 nt, Homo sapiens
gcaaauucagccucaagac

SEQ ID NO: 118264 - RNA, 19 nt, Homo sapiens
gaagggcaaccuggucuac

SEQ ID NO: 118265 - RNA, 19 nt, Homo sapiens
ccuaugacuacgucuuuga

SEQ ID NO: 118266 - RNA, 19 nt, Homo sapiens
ggagaggaaggugaguaug

SEQ ID NO: 118267 - RNA, 19 nt, Homo sapiens
gcuggagugugugaagaca

SEQ ID NO: 118268 - RNA, 19 nt, Homo sapiens
aagcuggagugugugaaga

SEQ ID NO: 118269 - RNA, 19 nt, Homo sapiens
ggaccuguucaacuucugu

SEQ ID NO: 118270 - RNA, 19 nt, Homo sapiens
ccaagagcauuaacuauuu

SEQ ID NO: 118271 - RNA, 19 nt, Homo sapiens
gcaagcagccggagacaaa

SEQ ID NO: 118272 - RNA, 19 nt, Homo sapiens
cagaggagauggccacgua

SEQ ID NO: 118273 - RNA, 19 nt, Homo sapiens
ggaaagaaucucuauacaa

SEQ ID NO: 118274 - RNA, 19 nt, Homo sapiens
gaaaccaaaugcugcuguu

SEQ ID NO: 118275 - RNA, 19 nt, Homo sapiens
gcccagcccugcagguaua

SEQ ID NO: 118276 - RNA, 19 nt, Homo sapiens
auacguggcuaucaaauug

SEQ ID NO: 118277 - RNA, 19 nt, Homo sapiens
ccacguaccugcgcuaugu

SEQ ID NO: 118278 - RNA, 19 nt, Homo sapiens
ucacuuccuucauguaaga

SEQ ID NO: 118279 - RNA, 19 nt, Homo sapiens
ucgagaagcccgacuauga

SEQ ID NO: 118280 - RNA, 19 nt, Homo sapiens
gcauuuacguuucucugau

SEQ ID NO: 118281 - RNA, 19 nt, Homo sapiens
guaagacuuuggccgaaau

SEQ ID NO: 118282 - RNA, 19 nt, Homo sapiens
ucaaggagcgguaccagaa

SEQ ID NO: 118283 - RNA, 19 nt, Homo sapiens
ggucacuuccuucauguaa

SEQ ID NO: 118284 - RNA, 19 nt, Homo sapiens
caaaugcugcuguuucuuc

SEQ ID NO: 118285 - RNA, 19 nt, Homo sapiens
ucaagacggugcugaugau

SEQ ID NO: 118286 - RNA, 19 nt, Homo sapiens
ccuugaagccauagaauuu

SEQ ID NO: 118287 - RNA, 19 nt, Homo sapiens
gaacuucccagaggagaug

SEQ ID NO: 118288 - RNA, 19 nt, Homo sapiens
gccaggguaucacaaacuu

SEQ ID NO: 118289 - RNA, 19 nt, Homo sapiens
gguggccgaugaaaccaaa

SEQ ID NO: 118290 - RNA, 19 nt, Homo sapiens
caaaugaauacguggcuau

SEQ ID NO: 118291 - RNA, 19 nt, Homo sapiens
uaccaaguguacagaaaug

SEQ ID NO: 118292 - RNA, 19 nt, Homo sapiens
uccaagagcauuaacuauu

SEQ ID NO: 118293 - RNA, 19 nt, Homo sapiens
gcucuucaccgaccucuuc

SEQ ID NO: 118294 - RNA, 19 nt, Homo sapiens
ucacgcgcauggaguaugu

SEQ ID NO: 118295 - RNA, 19 nt, Homo sapiens
gagcuccgccuaggaaaga

SEQ ID NO: 118296 - RNA, 19 nt, Homo sapiens
ggaauuacaacgccauggu

SEQ ID NO: 118297 - RNA, 19 nt, Homo sapiens
gucauaaaguccagcuugu

SEQ ID NO: 118298 - RNA, 19 nt, Homo sapiens
ugaagugaguagugugauc

SEQ ID NO: 118299 - RNA, 19 nt, Homo sapiens
gcaguggcuucguguucga

SEQ ID NO: 118300 - RNA, 19 nt, Homo sapiens
uggaguaugugcacaccaa

SEQ ID NO: 118301 - RNA, 19 nt, Homo sapiens
ugaauacguggcuaucaaa

SEQ ID NO: 118302 - RNA, 19 nt, Homo sapiens
uaggaaagaaucucuauac

SEQ ID NO: 118303 - RNA, 19 nt, Homo sapiens
cauuuacguuucucugaug

SEQ ID NO: 118304 - RNA, 19 nt, Homo sapiens
ucaagaggagaaagagaaa

SEQ ID NO: 118305 - RNA, 19 nt, Homo sapiens
gaauacguggcuaucaaau

SEQ ID NO: 118306 - RNA, 19 nt, Homo sapiens
gaucggcugcggcaacuuc

SEQ ID NO: 118307 - RNA, 19 nt, Homo sapiens
gcugaagugaguaguguga

SEQ ID NO: 118308 - RNA, 19 nt, Homo sapiens
ccuccaagagcauuaacua

SEQ ID NO: 118309 - RNA, 19 nt, Homo sapiens
caggguaucacaaacuuau

SEQ ID NO: 118310 - RNA, 19 nt, Homo sapiens
ugacaagaaaggagggaaa

SEQ ID NO: 118311 - RNA, 19 nt, Homo sapiens
cagcaugccauccacauca

SEQ ID NO: 118312 - RNA, 19 nt, Homo sapiens
aggaaagaaucucuauaca

SEQ ID NO: 118313 - RNA, 19 nt, Homo sapiens
ccaaaaugcugcaccaaag

SEQ ID NO: 118314 - RNA, 19 nt, Homo sapiens
acacgcaccugggcaagga

SEQ ID NO: 118315 - RNA, 19 nt, Homo sapiens
acaccaagagccuaaucua

SEQ ID NO: 118316 - RNA, 19 nt, Homo sapiens
augaauacguggcuaucaa

SEQ ID NO: 118317 - RNA, 19 nt, Homo sapiens
uguaagacuuuggccgaaa

SEQ ID NO: 118318 - RNA, 19 nt, Homo sapiens
aaacccagccgcacagcaa

SEQ ID NO: 118319 - RNA, 19 nt, Homo sapiens
aaggagcgguaccagaaga

SEQ ID NO: 118320 - RNA, 19 nt, Homo sapiens
ggcgguggcugugagucua

SEQ ID NO: 118321 - RNA, 19 nt, Homo sapiens
gaggccaggguaucacaaa

SEQ ID NO: 118322 - RNA, 19 nt, Homo sapiens
aaaugcugcuguuucuuca

SEQ ID NO: 118323 - RNA, 19 nt, Homo sapiens
ggagguggccgaugaaacc

SEQ ID NO: 118324 - RNA, 19 nt, Homo sapiens
gaagaucggggacaccaaa

SEQ ID NO: 118325 - RNA, 19 nt, Homo sapiens
ucccucaggucuacuacuu

SEQ ID NO: 118326 - RNA, 19 nt, Homo sapiens
cuugaagccauagaauuua

SEQ ID NO: 118327 - RNA, 19 nt, Homo sapiens
gaagcccgacuaugacuac

SEQ ID NO: 118328 - RNA, 19 nt, Homo sapiens
cuaggaaagaaucucuaua

SEQ ID NO: 118329 - RNA, 19 nt, Homo sapiens
gcacaccaagagccuaauc

SEQ ID NO: 118330 - RNA, 19 nt, Homo sapiens
gugcacaccaagagccuaa

SEQ ID NO: 118331 - RNA, 19 nt, Homo sapiens
cauaaaguccagcuugucu

SEQ ID NO: 118332 - RNA, 19 nt, Homo sapiens
gcuucguguucgacuauga

SEQ ID NO: 118333 - RNA, 19 nt, Homo sapiens
gcgcugggccacauguuca

SEQ ID NO: 118334 - RNA, 19 nt, Homo sapiens
ggcauuuacguuucucuga

SEQ ID NO: 118335 - RNA, 19 nt, Homo sapiens
uuuaccaaguguacagaaa

SEQ ID NO: 118336 - RNA, 19 nt, Homo sapiens
agguggagguggccgauga

SEQ ID NO: 118337 - RNA, 19 nt, Homo sapiens
gaggugcucugcgagaacu

SEQ ID NO: 118338 - RNA, 19 nt, Homo sapiens
ccaggguaucacaaacuua

SEQ ID NO: 118339 - RNA, 19 nt, Homo sapiens
gcucaagacggugcugaug

SEQ ID NO: 118340 - RNA, 19 nt, Homo sapiens
uggaguaccgguucuacaa

SEQ ID NO: 118341 - RNA, 19 nt, Homo sapiens
uuucuuugcugaagugagu

SEQ ID NO: 118342 - RNA, 19 nt, Homo sapiens
gacuuuggccgaaauuucu

SEQ ID NO: 118343 - RNA, 19 nt, Homo sapiens
uugaagccauagaauuuag

SEQ ID NO: 118344 - RNA, 19 nt, Homo sapiens
ggaguaccgguucuacaag

SEQ ID NO: 118345 - RNA, 19 nt, Homo sapiens
agacuuuggccgaaauuuc

SEQ ID NO: 118346 - RNA, 19 nt, Homo sapiens
gaguaugugcacaccaaga

SEQ ID NO: 118347 - RNA, 19 nt, Homo sapiens
aauacguggcuaucaaauu

SEQ ID NO: 118348 - RNA, 19 nt, Homo sapiens
ucucugaugcucccuugaa

SEQ ID NO: 118349 - RNA, 19 nt, Homo sapiens
ggagacaaaacgccuuaaa

SEQ ID NO: 118350 - RNA, 19 nt, Homo sapiens
ucaaauuggagccgaucaa

SEQ ID NO: 118351 - RNA, 19 nt, Homo sapiens
caaauuggagccgaucaag

SEQ ID NO: 118352 - RNA, 19 nt, Homo sapiens
ugaucacgcgcauggagua

SEQ ID NO: 118353 - RNA, 19 nt, Homo sapiens
accaaaugcugcuguuucu

SEQ ID NO: 118354 - RNA, 19 nt, Homo sapiens
gagaagcccgacuaugacu

SEQ ID NO: 118355 - RNA, 19 nt, Homo sapiens
ccauccacaucaucgacuu

SEQ ID NO: 118356 - RNA, 19 nt, Homo sapiens
gagaggccaggguaucaca

SEQ ID NO: 118357 - RNA, 19 nt, Homo sapiens
ucgaggugcucugcgagaa

SEQ ID NO: 118358 - RNA, 19 nt, Homo sapiens
ccuaggaaagaaucucuau

SEQ ID NO: 118359 - RNA, 19 nt, Homo sapiens
aaacagaguugcccaaaua

SEQ ID NO: 118360 - RNA, 19 nt, Homo sapiens
gaauaugacuggauuggua

SEQ ID NO: 118361 - RNA, 19 nt, Homo sapiens
gaaacuuacugcugaauga

SEQ ID NO: 118362 - RNA, 19 nt, Homo sapiens
cuuaaaggcugacacauua

SEQ ID NO: 118363 - RNA, 19 nt, Homo sapiens
caauagaaguguuauguga

SEQ ID NO: 118364 - RNA, 19 nt, Homo sapiens
gagauaagaugcaacaauc

SEQ ID NO: 118365 - RNA, 19 nt, Homo sapiens
ggucauauguucauguauu

SEQ ID NO: 118366 - RNA, 19 nt, Homo sapiens
caaagaaacacauaccaua

SEQ ID NO: 118367 - RNA, 19 nt, Homo sapiens
gaggugguaucaaugaaua

SEQ ID NO: 118368 - RNA, 19 nt, Homo sapiens
gaaguacuguguugcagaa

SEQ ID NO: 118369 - RNA, 19 nt, Homo sapiens
ccaaugaggugguaucaau

SEQ ID NO: 118370 - RNA, 19 nt, Homo sapiens
guagaaagcaguacaguau

SEQ ID NO: 118371 - RNA, 19 nt, Homo sapiens
gcaaaggaauauauugauc

SEQ ID NO: 118372 - RNA, 19 nt, Homo sapiens
guagugaccacguauauuu

SEQ ID NO: 118373 - RNA, 19 nt, Homo sapiens
gcacaucaacacagagaua

SEQ ID NO: 118374 - RNA, 19 nt, Homo sapiens
gaaaucucaccgaaacuua

SEQ ID NO: 118375 - RNA, 19 nt, Homo sapiens
uaaggagugugguaaauau

SEQ ID NO: 118376 - RNA, 19 nt, Homo sapiens
gcaagauccugcucuguca

SEQ ID NO: 118377 - RNA, 19 nt, Homo sapiens
caugauagcuauacaacug

SEQ ID NO: 118378 - RNA, 19 nt, Homo sapiens
gaaccuuguugcaguguau

SEQ ID NO: 118379 - RNA, 19 nt, Homo sapiens
gaaagacaaggacaaauca

SEQ ID NO: 118380 - RNA, 19 nt, Homo sapiens
uagaagagacgauuuagaa

SEQ ID NO: 118381 - RNA, 19 nt, Homo sapiens
gaugguauaccucaaguuu

SEQ ID NO: 118382 - RNA, 19 nt, Homo sapiens
aauggugucuguguaauua

SEQ ID NO: 118383 - RNA, 19 nt, Homo sapiens
aaagaaaucucaccgaaac

SEQ ID NO: 118384 - RNA, 19 nt, Homo sapiens
cagaguugcccaaauauuu

SEQ ID NO: 118385 - RNA, 19 nt, Homo sapiens
ggacacaacacucgaggaa

SEQ ID NO: 118386 - RNA, 19 nt, Homo sapiens
uacaguaucuuaaguguca

SEQ ID NO: 118387 - RNA, 19 nt, Homo sapiens
guaagagcauaaucaaaca

SEQ ID NO: 118388 - RNA, 19 nt, Homo sapiens
gaaauggcaacauaucuuc

SEQ ID NO: 118389 - RNA, 19 nt, Homo sapiens
ggagacaaagaaacacaua

SEQ ID NO: 118390 - RNA, 19 nt, Homo sapiens
caaagaacuugauauacag

SEQ ID NO: 118391 - RNA, 19 nt, Homo sapiens
uaaaggagagguaucagaa

SEQ ID NO: 118392 - RNA, 19 nt, Homo sapiens
cacaagagccuuacaggaa

SEQ ID NO: 118393 - RNA, 19 nt, Homo sapiens
gguggaagccuaaagaaau

SEQ ID NO: 118394 - RNA, 19 nt, Homo sapiens
ggagagguaguaaauguga

SEQ ID NO: 118395 - RNA, 19 nt, Homo sapiens
gcccagagguacugaggaa

SEQ ID NO: 118396 - RNA, 19 nt, Homo sapiens
gcaguacaguaucuuaagu

SEQ ID NO: 118397 - RNA, 19 nt, Homo sapiens
caucugcugucuugugauu

SEQ ID NO: 118398 - RNA, 19 nt, Homo sapiens
gggaguuacuuacauguuc

SEQ ID NO: 118399 - RNA, 19 nt, Homo sapiens
gagacgauuuagaagcuuu

SEQ ID NO: 118400 - RNA, 19 nt, Homo sapiens
cagauucuauaagcaguua

SEQ ID NO: 118401 - RNA, 19 nt, Homo sapiens
gagcaccacagcuacauuu

SEQ ID NO: 118402 - RNA, 19 nt, Homo sapiens
ugugacaucugcauugauu

SEQ ID NO: 118403 - RNA, 19 nt, Homo sapiens
gcugggaccuaguuuggaa

SEQ ID NO: 118404 - RNA, 19 nt, Homo sapiens
gaugguacuguuauucaua

SEQ ID NO: 118405 - RNA, 19 nt, Homo sapiens
uaacuucuguaagagcaua

SEQ ID NO: 118406 - RNA, 19 nt, Homo sapiens
ggcaacauaucuucguuau

SEQ ID NO: 118407 - RNA, 19 nt, Homo sapiens
gaauggaauggaccaauga

SEQ ID NO: 118408 - RNA, 19 nt, Homo sapiens
ugaauggaauggaccaaug

SEQ ID NO: 118409 - RNA, 19 nt, Homo sapiens
ggaguuacuuacauguuca

SEQ ID NO: 118410 - RNA, 19 nt, Homo sapiens
gcuuaaaggcugacacauu

SEQ ID NO: 118411 - RNA, 19 nt, Homo sapiens
augauuacauucucccuua

SEQ ID NO: 118412 - RNA, 19 nt, Homo sapiens
aaggagagguaguaaaugu

SEQ ID NO: 118413 - RNA, 19 nt, Homo sapiens
ccaguuauauaccuaaucu

SEQ ID NO: 118414 - RNA, 19 nt, Homo sapiens
uaaccuuuauggaagcuuu

SEQ ID NO: 118415 - RNA, 19 nt, Homo sapiens
uuccagaaauggcaacaua

SEQ ID NO: 118416 - RNA, 19 nt, Homo sapiens
acacauaccauacagagaa

SEQ ID NO: 118417 - RNA, 19 nt, Homo sapiens
ccgcaaacuugauauggaa

SEQ ID NO: 118418 - RNA, 19 nt, Homo sapiens
uaggucauauguucaugua

SEQ ID NO: 118419 - RNA, 19 nt, Homo sapiens
cagcaaguuauucacauua

SEQ ID NO: 118420 - RNA, 19 nt, Homo sapiens
ccagcaaguuauucacauu

SEQ ID NO: 118421 - RNA, 19 nt, Homo sapiens
gcaauggugucuguguaau

SEQ ID NO: 118422 - RNA, 19 nt, Homo sapiens
uaaagaaaucucaccgaaa

SEQ ID NO: 118423 - RNA, 19 nt, Homo sapiens
gaaguuauuccuugagaag

SEQ ID NO: 118424 - RNA, 19 nt, Homo sapiens
agaguugcccaaauauuua

SEQ ID NO: 118425 - RNA, 19 nt, Homo sapiens
caaggacucacucuuagaa

SEQ ID NO: 118426 - RNA, 19 nt, Homo sapiens
aaacagagaagcacaucaa

SEQ ID NO: 118427 - RNA, 19 nt, Homo sapiens
gguaguaaaugugaaccuu

SEQ ID NO: 118428 - RNA, 19 nt, Homo sapiens
guaacuuuaugcuuccaaa

SEQ ID NO: 118429 - RNA, 19 nt, Homo sapiens
guacuguguugcagaagug

SEQ ID NO: 118430 - RNA, 19 nt, Homo sapiens
gauagaauggcacgaccua

SEQ ID NO: 118431 - RNA, 19 nt, Homo sapiens
gagcauaaucaaacaggaa

SEQ ID NO: 118432 - RNA, 19 nt, Homo sapiens
uuucaaggacucacucuua

SEQ ID NO: 118433 - RNA, 19 nt, Homo sapiens
accagacuaugaauacuua

SEQ ID NO: 118434 - RNA, 19 nt, Homo sapiens
aggaacagcuagauauaug

SEQ ID NO: 118435 - RNA, 19 nt, Homo sapiens
caccacagcuacauuugga

SEQ ID NO: 118436 - RNA, 19 nt, Homo sapiens
gaauauguggcaauuaagu

SEQ ID NO: 118437 - RNA, 19 nt, Homo sapiens
caaaguggaguaccgcaaa

SEQ ID NO: 118438 - RNA, 19 nt, Homo sapiens
aaguagaagugauggauga

SEQ ID NO: 118439 - RNA, 19 nt, Homo sapiens
agaagcacaucaacacaga

SEQ ID NO: 118440 - RNA, 19 nt, Homo sapiens
gguaaacaguugccuacuc

SEQ ID NO: 118441 - RNA, 19 nt, Homo sapiens
caaaguagaagagacgauu

SEQ ID NO: 118442 - RNA, 19 nt, Homo sapiens
acuuacugcugaaugauua

SEQ ID NO: 118443 - RNA, 19 nt, Homo sapiens
ggagugugguaaauaugug

SEQ ID NO: 118444 - RNA, 19 nt, Homo sapiens
acacagagauaagaugcaa

SEQ ID NO: 118445 - RNA, 19 nt, Homo sapiens
guggaagccuaaagaaauc

SEQ ID NO: 118446 - RNA, 19 nt, Homo sapiens
cuaaggagagguaguaaau

SEQ ID NO: 118447 - RNA, 19 nt, Homo sapiens
ggagagguaucagaaaauu

SEQ ID NO: 118448 - RNA, 19 nt, Homo sapiens
ggaagacuuguuugacuug

SEQ ID NO: 118449 - RNA, 19 nt, Homo sapiens
gcagaaaacuuuggaugug

SEQ ID NO: 118450 - RNA, 19 nt, Homo sapiens
agugauauauguuggaguu

SEQ ID NO: 118451 - RNA, 19 nt, Homo sapiens
uaugugaaguacuguguug

SEQ ID NO: 118452 - RNA, 19 nt, Homo sapiens
ggacucacucuuagaaaca

SEQ ID NO: 118453 - RNA, 19 nt, Homo sapiens
uaaaggcugacacauuaaa

SEQ ID NO: 118454 - RNA, 19 nt, Homo sapiens
ggaacagcuagauauauga

SEQ ID NO: 118455 - RNA, 19 nt, Homo sapiens
ugacuugugugacagaaca

SEQ ID NO: 118456 - RNA, 19 nt, Homo sapiens
gagaugguauaccucaagu

SEQ ID NO: 118457 - RNA, 19 nt, Homo sapiens
guaaaugugaaccuuguug

SEQ ID NO: 118458 - RNA, 19 nt, Homo sapiens
acacaacacucgaggaacu

SEQ ID NO: 118459 - RNA, 19 nt, Homo sapiens
ggacagaagauuuauauga

SEQ ID NO: 118460 - RNA, 19 nt, Homo sapiens
gauccacguuucaaugaua

SEQ ID NO: 118461 - RNA, 19 nt, Homo sapiens
ugaaggcccuggauuauug

SEQ ID NO: 118462 - RNA, 19 nt, Homo sapiens
gcauuuagguggagacuuc

SEQ ID NO: 118463 - RNA, 19 nt, Homo sapiens
gauguacgauuauaguuug

SEQ ID NO: 118464 - RNA, 19 nt, Homo sapiens
acacagaccucgagaauac

SEQ ID NO: 118465 - RNA, 19 nt, Homo sapiens
aaacuucuguucaguaaga

SEQ ID NO: 118466 - RNA, 19 nt, Homo sapiens
ugaauuagauccacguuuc

SEQ ID NO: 118467 - RNA, 19 nt, Homo sapiens
acuaucagauguacgauua

SEQ ID NO: 118468 - RNA, 19 nt, Homo sapiens
gagaggaggucccaacauc

SEQ ID NO: 118469 - RNA, 19 nt, Homo sapiens
ccaucaacaucacaaauaa

SEQ ID NO: 118470 - RNA, 19 nt, Homo sapiens
gcacagaaagcuacgacua

SEQ ID NO: 118471 - RNA, 19 nt, Homo sapiens
acacagacuucaagcaauu

SEQ ID NO: 118472 - RNA, 19 nt, Homo sapiens
gaucuaacccuaaauccaa

SEQ ID NO: 118473 - RNA, 19 nt, Homo sapiens
gaagggaggacccaaucua

SEQ ID NO: 118474 - RNA, 19 nt, Homo sapiens
acacagauguuaauacaca

SEQ ID NO: 118475 - RNA, 19 nt, Homo sapiens
gaccaccagucacggcuua

SEQ ID NO: 118476 - RNA, 19 nt, Homo sapiens
ugacaauuaugaucaguug

SEQ ID NO: 118477 - RNA, 19 nt, Homo sapiens
caaauuuaguuccucauca

SEQ ID NO: 118478 - RNA, 19 nt, Homo sapiens
gcaauuguaccagacguua

SEQ ID NO: 118479 - RNA, 19 nt, Homo sapiens
caacacagacuucaagcaa

SEQ ID NO: 118480 - RNA, 19 nt, Homo sapiens
uuacugaucuaacccuaaa

SEQ ID NO: 118481 - RNA, 19 nt, Homo sapiens
gaaaacaggucugaaacaa

SEQ ID NO: 118482 - RNA, 19 nt, Homo sapiens
cuucaaagguccugagcua

SEQ ID NO: 118483 - RNA, 19 nt, Homo sapiens
ggcaaaaucuuucuuaguu

SEQ ID NO: 118484 - RNA, 19 nt, Homo sapiens
ggaagugugucuuaguuac

SEQ ID NO: 118485 - RNA, 19 nt, Homo sapiens
ccuaguggcucuuguggaa

SEQ ID NO: 118486 - RNA, 19 nt, Homo sapiens
gaauauaauguccgaguug

SEQ ID NO: 118487 - RNA, 19 nt, Homo sapiens
gacagaagauuuauaugac

SEQ ID NO: 118488 - RNA, 19 nt, Homo sapiens
ggaauuaugcacagagaug

SEQ ID NO: 118489 - RNA, 19 nt, Homo sapiens
gccaucaacaucacaaaua

SEQ ID NO: 118490 - RNA, 19 nt, Homo sapiens
gaagaaaacaggucugaaa

SEQ ID NO: 118491 - RNA, 19 nt, Homo sapiens
uggacaaacugcugcgaua

SEQ ID NO: 118492 - RNA, 19 nt, Homo sapiens
acaaacugcugcgauauga

SEQ ID NO: 118493 - RNA, 19 nt, Homo sapiens
guggaagugugucuuaguu

SEQ ID NO: 118494 - RNA, 19 nt, Homo sapiens
aauaugaugucagggauuu

SEQ ID NO: 118495 - RNA, 19 nt, Homo sapiens
ggacaugacaauuaugauc

SEQ ID NO: 118496 - RNA, 19 nt, Homo sapiens
cccauaaugucaugauuga

SEQ ID NO: 118497 - RNA, 19 nt, Homo sapiens
ggccagaguuuacacagau

SEQ ID NO: 118498 - RNA, 19 nt, Homo sapiens
gaagaaaggaaggaaggaa

SEQ ID NO: 118499 - RNA, 19 nt, Homo sapiens
gcccugaggccuuggauuu

SEQ ID NO: 118500 - RNA, 19 nt, Homo sapiens
ugucacagcaugggaauua

SEQ ID NO: 118501 - RNA, 19 nt, Homo sapiens
uuacaucacuuuacuccau

SEQ ID NO: 118502 - RNA, 19 nt, Homo sapiens
gaaaggaaggaaggaaaga

SEQ ID NO: 118503 - RNA, 19 nt, Homo sapiens
cgaauggguucaucuagca

SEQ ID NO: 118504 - RNA, 19 nt, Homo sapiens
guuguaugcuggcaaguau

SEQ ID NO: 118505 - RNA, 19 nt, Homo sapiens
caaagguccugagcuacuu

SEQ ID NO: 118506 - RNA, 19 nt, Homo sapiens
caacaugcugugcuccaua

SEQ ID NO: 118507 - RNA, 19 nt, Homo sapiens
ggucugaaacaaggucuua

SEQ ID NO: 118508 - RNA, 19 nt, Homo sapiens
gcagguggaauauuucaug

SEQ ID NO: 118509 - RNA, 19 nt, Homo sapiens
gcuuguggauuuauaguag

SEQ ID NO: 118510 - RNA, 19 nt, Homo sapiens
aaccguugcuuguggauuu

SEQ ID NO: 118511 - RNA, 19 nt, Homo sapiens
gaaggcaaaaucuuucuua

SEQ ID NO: 118512 - RNA, 19 nt, Homo sapiens
cagaaagcuacgacuaaua

SEQ ID NO: 118513 - RNA, 19 nt, Homo sapiens
ccaagcagggccagaguuu

SEQ ID NO: 118514 - RNA, 19 nt, Homo sapiens
gggaggacccaaucuauag

SEQ ID NO: 118515 - RNA, 19 nt, Homo sapiens
ggaaggaaggaaagaagga

SEQ ID NO: 118516 - RNA, 19 nt, Homo sapiens
aaacaucaaguccagcuuu

SEQ ID NO: 118517 - RNA, 19 nt, Homo sapiens
acagaaagcuacgacuaau

SEQ ID NO: 118518 - RNA, 19 nt, Homo sapiens
cacagaaagcuacgacuaa

SEQ ID NO: 118519 - RNA, 19 nt, Homo sapiens
gcuggucgcuuacaucacu

SEQ ID NO: 118520 - RNA, 19 nt, Homo sapiens
guggagacuucuucccauu

SEQ ID NO: 118521 - RNA, 19 nt, Homo sapiens
aaucccggcugcugcauuu

SEQ ID NO: 118522 - RNA, 19 nt, Homo sapiens
uggaauauuucauggacaa

SEQ ID NO: 118523 - RNA, 19 nt, Homo sapiens
ugccagaucuccaaacauc

SEQ ID NO: 118524 - RNA, 19 nt, Homo sapiens
auacugggauuacgaguca

SEQ ID NO: 118525 - RNA, 19 nt, Homo sapiens
gaaggaaggaaagaaggaa

SEQ ID NO: 118526 - RNA, 19 nt, Homo sapiens
cagcagcgccaauaugaug

SEQ ID NO: 118527 - RNA, 19 nt, Homo sapiens
ggacaaacugcugcgauau

SEQ ID NO: 118528 - RNA, 19 nt, Homo sapiens
ccaccacaguuugaagaaa

SEQ ID NO: 118529 - RNA, 19 nt, Homo sapiens
gaaaucaagaugacuacca

SEQ ID NO: 118530 - RNA, 19 nt, Homo sapiens
guugguaucucgugcucuu

SEQ ID NO: 118531 - RNA, 19 nt, Homo sapiens
ugucagggauuucuucagu

SEQ ID NO: 118532 - RNA, 19 nt, Homo sapiens
gacaugacaauuaugauca

SEQ ID NO: 118533 - RNA, 19 nt, Homo sapiens
agaaagcuacgacuaauag

SEQ ID NO: 118534 - RNA, 19 nt, Homo sapiens
gggccagaguuuacacaga

SEQ ID NO: 118535 - RNA, 19 nt, Homo sapiens
cgagguaaauacagugaag

SEQ ID NO: 118536 - RNA, 19 nt, Homo sapiens
ccagcugguucgaaaauua

SEQ ID NO: 118537 - RNA, 19 nt, Homo sapiens
uacaucacuuuacuccaua

SEQ ID NO: 118538 - RNA, 19 nt, Homo sapiens
gaguuuacacagauguuaa

SEQ ID NO: 118539 - RNA, 19 nt, Homo sapiens
gagaauacugggauuacga

SEQ ID NO: 118540 - RNA, 19 nt, Homo sapiens
agaauauaauguccgaguu

SEQ ID NO: 118541 - RNA, 19 nt, Homo sapiens
gcucgaauggguucaucua

SEQ ID NO: 118542 - RNA, 19 nt, Homo sapiens
gacaaacugcugcgauaug

SEQ ID NO: 118543 - RNA, 19 nt, Homo sapiens
ggaacgcuuuguccacagu

SEQ ID NO: 118544 - RNA, 19 nt, Homo sapiens
guuuggauauguggaguuu

SEQ ID NO: 118545 - RNA, 19 nt, Homo sapiens
cauaaugucaugauugauc

SEQ ID NO: 118546 - RNA, 19 nt, Homo sapiens
gaaggaccaggcucgaaug

SEQ ID NO: 118547 - RNA, 19 nt, Homo sapiens
aaacaacacagacuucaag

SEQ ID NO: 118548 - RNA, 19 nt, Homo sapiens
gaagugugucuuaguuaca

SEQ ID NO: 118549 - RNA, 19 nt, Homo sapiens
caauggagcaccccuauuu

SEQ ID NO: 118550 - RNA, 19 nt, Homo sapiens
gaauuagauccacguuuca

SEQ ID NO: 118551 - RNA, 19 nt, Homo sapiens
gcuggcaaguaugaucuuu

SEQ ID NO: 118552 - RNA, 19 nt, Homo sapiens
guacgauuauaguuuggau

SEQ ID NO: 118553 - RNA, 19 nt, Homo sapiens
gaaagcuacgacuaauaga

SEQ ID NO: 118554 - RNA, 19 nt, Homo sapiens
acacacagaccucgagaau

SEQ ID NO: 118555 - RNA, 19 nt, Homo sapiens
aaaugcagacagauacuaa

SEQ ID NO: 118556 - RNA, 19 nt, Homo sapiens
gucagcagcgccaauauga

SEQ ID NO: 118557 - RNA, 19 nt, Homo sapiens
gggcagacacucucgaaag

SEQ ID NO: 118558 - RNA, 19 nt, Homo sapiens
caagcagggccagaguuua

SEQ ID NO: 118559 - RNA, 19 nt, Homo sapiens
gaacaagaaccaaaucaaa

SEQ ID NO: 118560 - RNA, 19 nt, Homo sapiens
gauccacacuucaacgaua

SEQ ID NO: 118561 - RNA, 19 nt, Homo sapiens
ggacaacuaugaccagcuu

SEQ ID NO: 118562 - RNA, 19 nt, Homo sapiens
gauuauagcuuggacaugu

SEQ ID NO: 118563 - RNA, 19 nt, Homo sapiens
gaagaaguaucacauagac

SEQ ID NO: 118564 - RNA, 19 nt, Homo sapiens
cuaacuagcugaccacaga

SEQ ID NO: 118565 - RNA, 19 nt, Homo sapiens
uggcggcaguuacauauua

SEQ ID NO: 118566 - RNA, 19 nt, Homo sapiens
gaguuugggcuguauguua

SEQ ID NO: 118567 - RNA, 19 nt, Homo sapiens
aaaccucacuuccgaaugu

SEQ ID NO: 118568 - RNA, 19 nt, Homo sapiens
cagcaaaccacgcuaacua

SEQ ID NO: 118569 - RNA, 19 nt, Homo sapiens
ccauuaauaucaccaacaa

SEQ ID NO: 118570 - RNA, 19 nt, Homo sapiens
gggaaaauauagugaagua

SEQ ID NO: 118571 - RNA, 19 nt, Homo sapiens
ggacaaacuucugcgauac

SEQ ID NO: 118572 - RNA, 19 nt, Homo sapiens
uggacaaacuucugcgaua

SEQ ID NO: 118573 - RNA, 19 nt, Homo sapiens
uuaaagcucuggauuacug

SEQ ID NO: 118574 - RNA, 19 nt, Homo sapiens
ugcagaauguuguugguua

SEQ ID NO: 118575 - RNA, 19 nt, Homo sapiens
ugaaggguaugcagaaugu

SEQ ID NO: 118576 - RNA, 19 nt, Homo sapiens
gaaagcgacgggucuguug

SEQ ID NO: 118577 - RNA, 19 nt, Homo sapiens
gggacaacauucacggaaa

SEQ ID NO: 118578 - RNA, 19 nt, Homo sapiens
ggacaacauucacggaaac

SEQ ID NO: 118579 - RNA, 19 nt, Homo sapiens
gaauguuguugguuacugu

SEQ ID NO: 118580 - RNA, 19 nt, Homo sapiens
agaccuagauccacacuuc

SEQ ID NO: 118581 - RNA, 19 nt, Homo sapiens
gcucaggaguacaauguuc

SEQ ID NO: 118582 - RNA, 19 nt, Homo sapiens
auggguaucugaagaagua

SEQ ID NO: 118583 - RNA, 19 nt, Homo sapiens
gguggaacaaauaucauua

SEQ ID NO: 118584 - RNA, 19 nt, Homo sapiens
gagacugacugccaaagag

SEQ ID NO: 118585 - RNA, 19 nt, Homo sapiens
gcauggcggcaguuacaua

SEQ ID NO: 118586 - RNA, 19 nt, Homo sapiens
aaccaaaucaaacgucuua

SEQ ID NO: 118587 - RNA, 19 nt, Homo sapiens
ggagugcaguggcgcaauc

SEQ ID NO: 118588 - RNA, 19 nt, Homo sapiens
gcaagcaugaucuuucgaa

SEQ ID NO: 118589 - RNA, 19 nt, Homo sapiens
gaaccuucgugguggaaca

SEQ ID NO: 118590 - RNA, 19 nt, Homo sapiens
gcagaauguuguugguuac

SEQ ID NO: 118591 - RNA, 19 nt, Homo sapiens
uuaagcaacucuaccagau

SEQ ID NO: 118592 - RNA, 19 nt, Homo sapiens
ucaagaugauuaccaacug

SEQ ID NO: 118593 - RNA, 19 nt, Homo sapiens
cggcaguuacauauuauua

SEQ ID NO: 118594 - RNA, 19 nt, Homo sapiens
gaagaacuguauggguauc

SEQ ID NO: 118595 - RNA, 19 nt, Homo sapiens
gcuuggacauguggaguuu

SEQ ID NO: 118596 - RNA, 19 nt, Homo sapiens
gccuuuggcuuccuguuga

SEQ ID NO: 118597 - RNA, 19 nt, Homo sapiens
gauagaucaccaacagaaa

SEQ ID NO: 118598 - RNA, 19 nt, Homo sapiens
agacuuugauauccgguuu

SEQ ID NO: 118599 - RNA, 19 nt, Homo sapiens
ggaaagcgacgggucuguu

SEQ ID NO: 118600 - RNA, 19 nt, Homo sapiens
ugggaaaacuuuauccaua

SEQ ID NO: 118601 - RNA, 19 nt, Homo sapiens
gaacuguauggguaucuga

SEQ ID NO: 118602 - RNA, 19 nt, Homo sapiens
ugaaguauuugaggccauu

SEQ ID NO: 118603 - RNA, 19 nt, Homo sapiens
gcacgaugaagacuggaaa

SEQ ID NO: 118604 - RNA, 19 nt, Homo sapiens
gaaguaucacauagaccua

SEQ ID NO: 118605 - RNA, 19 nt, Homo sapiens
ugaagaaguaucacauaga

SEQ ID NO: 118606 - RNA, 19 nt, Homo sapiens
uaagcugauugacacugua

SEQ ID NO: 118607 - RNA, 19 nt, Homo sapiens
gaccaucaacagagacuga

SEQ ID NO: 118608 - RNA, 19 nt, Homo sapiens
ucacggaaacgcugggaaa

SEQ ID NO: 118609 - RNA, 19 nt, Homo sapiens
ucacauagaccuagaucca

SEQ ID NO: 118610 - RNA, 19 nt, Homo sapiens
cugaagaaguaucacauag

SEQ ID NO: 118611 - RNA, 19 nt, Homo sapiens
gaagauaaaacgagagguu

SEQ ID NO: 118612 - RNA, 19 nt, Homo sapiens
gcagaacaagaaccaaauc

SEQ ID NO: 118613 - RNA, 19 nt, Homo sapiens
uccauaagcagaacaagaa

SEQ ID NO: 118614 - RNA, 19 nt, Homo sapiens
auacgaccaucaacagaga

SEQ ID NO: 118615 - RNA, 19 nt, Homo sapiens
uaaaggaccccgugucaaa

SEQ ID NO: 118616 - RNA, 19 nt, Homo sapiens
gggaaaacuuuauccauag

SEQ ID NO: 118617 - RNA, 19 nt, Homo sapiens
uacuuaaagcucuggauua

SEQ ID NO: 118618 - RNA, 19 nt, Homo sapiens
aacgagagguuaagauucu

SEQ ID NO: 118619 - RNA, 19 nt, Homo sapiens
caacaaugagagagugguu

SEQ ID NO: 118620 - RNA, 19 nt, Homo sapiens
ucagauguaugauuauagc

SEQ ID NO: 118621 - RNA, 19 nt, Homo sapiens
uggacuaucagauguauga

SEQ ID NO: 118622 - RNA, 19 nt, Homo sapiens
ccacagcaagggaaucaug

SEQ ID NO: 118623 - RNA, 19 nt, Homo sapiens
cuacuuaaagcucuggauu

SEQ ID NO: 118624 - RNA, 19 nt, Homo sapiens
uguaugaacuacuuaaagc

SEQ ID NO: 118625 - RNA, 19 nt, Homo sapiens
uaacgcguauagagagauc

SEQ ID NO: 118626 - RNA, 19 nt, Homo sapiens
gaaccaaaucaaacgucuu

SEQ ID NO: 118627 - RNA, 19 nt, Homo sapiens
cccuagaucuucuggacaa

SEQ ID NO: 118628 - RNA, 19 nt, Homo sapiens
gauauccugggacaacauu

SEQ ID NO: 118629 - RNA, 19 nt, Homo sapiens
cagagcuccucguggacua

SEQ ID NO: 118630 - RNA, 19 nt, Homo sapiens
caaaucaaacgucuuaacg

SEQ ID NO: 118631 - RNA, 19 nt, Homo sapiens
aagcugcgacugauagauu

SEQ ID NO: 118632 - RNA, 19 nt, Homo sapiens
aagcagaacaagaaccaaa

SEQ ID NO: 118633 - RNA, 19 nt, Homo sapiens
aaugagagagugguuguaa

SEQ ID NO: 118634 - RNA, 19 nt, Homo sapiens
uagcaagcaugaucuuucg

SEQ ID NO: 118635 - RNA, 19 nt, Homo sapiens
ucuaccagauccugacaga

SEQ ID NO: 118636 - RNA, 19 nt, Homo sapiens
ggcggcaguuacauauuau

SEQ ID NO: 118637 - RNA, 19 nt, Homo sapiens
gaaagcauggggaauguga

SEQ ID NO: 118638 - RNA, 19 nt, Homo sapiens
ucugaagaaguaucacaua

SEQ ID NO: 118639 - RNA, 19 nt, Homo sapiens
ugaccagcuuguucgcauu

SEQ ID NO: 118640 - RNA, 19 nt, Homo sapiens
caacuaugaccagcuuguu

SEQ ID NO: 118641 - RNA, 19 nt, Homo sapiens
aaacgagagguuaagauuc

SEQ ID NO: 118642 - RNA, 19 nt, Homo sapiens
gaaguauuugaggccauua

SEQ ID NO: 118643 - RNA, 19 nt, Homo sapiens
ugauugacacuguaaagga

SEQ ID NO: 118644 - RNA, 19 nt, Homo sapiens
guauaucaaaccucacuuc

SEQ ID NO: 118645 - RNA, 19 nt, Homo sapiens
gcagcccaccaccguauau

SEQ ID NO: 118646 - RNA, 19 nt, Homo sapiens
gcagacaaugcugugcuuu

SEQ ID NO: 118647 - RNA, 19 nt, Homo sapiens
ggaaaacuuuauccauagu

SEQ ID NO: 118648 - RNA, 19 nt, Homo sapiens
gaaacgcugggaaaacuuu

SEQ ID NO: 118649 - RNA, 19 nt, Homo sapiens
uuaagcugauugacacugu

SEQ ID NO: 118650 - RNA, 19 nt, Homo sapiens
cagaacaagaaccaaauca

SEQ ID NO: 118651 - RNA, 19 nt, Homo sapiens
gaucuucuggacaaacuuc

SEQ ID NO: 118652 - RNA, 19 nt, Homo sapiens
gaccagcuuguucgcauug

SEQ ID NO: 118653 - RNA, 19 nt, Homo sapiens
agaacaagaaccaaaucaa

SEQ ID NO: 118654 - RNA, 19 nt, Homo sapiens
gagcugggguaaucaagau

SEQ ID NO: 118655 - RNA, 19 nt, Homo sapiens
cacaaugucaugauagauc

SEQ ID NO: 118656 - RNA, 19 nt, Homo sapiens
acuuaaagcucuggauuac

SEQ ID NO: 118657 - RNA, 19 nt, Homo sapiens
gauccugacagacuuugau

SEQ ID NO: 118658 - RNA, 19 nt, Homo sapiens
cuucgugguggaacaaaua

SEQ ID NO: 118659 - RNA, 19 nt, Homo sapiens
gcaaugaauucuucuguga

SEQ ID NO: 118660 - RNA, 19 nt, Homo sapiens
ccaagugcauggaugugua

SEQ ID NO: 118661 - RNA, 19 nt, Homo sapiens
caaccagagugaccugauu

SEQ ID NO: 118662 - RNA, 19 nt, Homo sapiens
cgagaugcuuuauggauug

SEQ ID NO: 118663 - RNA, 19 nt, Homo sapiens
gcucuacgguuucaagauc

SEQ ID NO: 118664 - RNA, 19 nt, Homo sapiens
ccgacaagcucuagacaug

SEQ ID NO: 118665 - RNA, 19 nt, Homo sapiens
gcaaggagacuuugguuac

SEQ ID NO: 118666 - RNA, 19 nt, Homo sapiens
ucauuuagccaguuucuuu

SEQ ID NO: 118667 - RNA, 19 nt, Homo sapiens
ucaagacgauucgcugauu

SEQ ID NO: 118668 - RNA, 19 nt, Homo sapiens
gacaagcucuagacaugau

SEQ ID NO: 118669 - RNA, 19 nt, Homo sapiens
uuaaaggagucguuauugu

SEQ ID NO: 118670 - RNA, 19 nt, Homo sapiens
guaguucgcuuucucucau

SEQ ID NO: 118671 - RNA, 19 nt, Homo sapiens
cuacauccaggacaaauuu

SEQ ID NO: 118672 - RNA, 19 nt, Homo sapiens
ugaaguggaugaagacuac

SEQ ID NO: 118673 - RNA, 19 nt, Homo sapiens
gugggaauaugaaauaaag

SEQ ID NO: 118674 - RNA, 19 nt, Homo sapiens
ccgagaugcuuuauggauu

SEQ ID NO: 118675 - RNA, 19 nt, Homo sapiens
cagccgagaugcuuuaugg

SEQ ID NO: 118676 - RNA, 19 nt, Homo sapiens
uaaaggagucguuauugug

SEQ ID NO: 118677 - RNA, 19 nt, Homo sapiens
caccuguccugcagucuuu

SEQ ID NO: 118678 - RNA, 19 nt, Homo sapiens
caagacgauucgcugauuc

SEQ ID NO: 118679 - RNA, 19 nt, Homo sapiens
ccuggagccugaugaagaa

SEQ ID NO: 118680 - RNA, 19 nt, Homo sapiens
guggugggaauaugaaaua

SEQ ID NO: 118681 - RNA, 19 nt, Homo sapiens
augaagaacuggaagacaa

SEQ ID NO: 118682 - RNA, 19 nt, Homo sapiens
gcacugguuucccucacau

SEQ ID NO: 118683 - RNA, 19 nt, Homo sapiens
gagaugcuuuauggauuga

SEQ ID NO: 118684 - RNA, 19 nt, Homo sapiens
ccuuggcgcuugcguguug

SEQ ID NO: 118685 - RNA, 19 nt, Homo sapiens
ggaccuggagccugaugaa

SEQ ID NO: 118686 - RNA, 19 nt, Homo sapiens
ucugugaaguggaugaaga

SEQ ID NO: 118687 - RNA, 19 nt, Homo sapiens
caaggagacuuugguuacu

SEQ ID NO: 118688 - RNA, 19 nt, Homo sapiens
guacacacccaagucauca

SEQ ID NO: 118689 - RNA, 19 nt, Homo sapiens
guaccagcaaggagacuuu

SEQ ID NO: 118690 - RNA, 19 nt, Homo sapiens
gcaggcagccgagaugcuu

SEQ ID NO: 118691 - RNA, 19 nt, Homo sapiens
ggugggaauaugaaauaaa

SEQ ID NO: 118692 - RNA, 19 nt, Homo sapiens
uaaucuuacuggacucaau

SEQ ID NO: 118693 - RNA, 19 nt, Homo sapiens
ugcccaggcucuacgguuu

SEQ ID NO: 118694 - RNA, 19 nt, Homo sapiens
ccauuggccuuucagacau

SEQ ID NO: 118695 - RNA, 19 nt, Homo sapiens
gggauugguaguucgcuuu

SEQ ID NO: 118696 - RNA, 19 nt, Homo sapiens
ucucucauuuagccaguuu

SEQ ID NO: 118697 - RNA, 19 nt, Homo sapiens
caaugaauucuucugugaa

SEQ ID NO: 118698 - RNA, 19 nt, Homo sapiens
gagaccugccaaccaguuu

SEQ ID NO: 118699 - RNA, 19 nt, Homo sapiens
gaugcuuuauggauugauc

SEQ ID NO: 118700 - RNA, 19 nt, Homo sapiens
uguccuggauuuccugguu

SEQ ID NO: 118701 - RNA, 19 nt, Homo sapiens
ggagccugaugaagaacug

SEQ ID NO: 118702 - RNA, 19 nt, Homo sapiens
cgacaagcucuagacauga

SEQ ID NO: 118703 - RNA, 19 nt, Homo sapiens
aagacuacauccaggacaa

SEQ ID NO: 118704 - RNA, 19 nt, Homo sapiens
ccaagccgccagcaacuuc

SEQ ID NO: 118705 - RNA, 19 nt, Homo sapiens
gugaagccauggugaagcu

SEQ ID NO: 118706 - RNA, 19 nt, Homo sapiens
ccaagagaccugccaacca

SEQ ID NO: 118707 - RNA, 19 nt, Homo sapiens
guccucguguguacuguga

SEQ ID NO: 118708 - RNA, 19 nt, Homo sapiens
uuacuguccucguguguac

SEQ ID NO: 118709 - RNA, 19 nt, Homo sapiens
ccucguguguacugugaga

SEQ ID NO: 118710 - RNA, 19 nt, Homo sapiens
cagcaaggagacuuugguu

SEQ ID NO: 118711 - RNA, 19 nt, Homo sapiens
gugaaguggaugaagacua

SEQ ID NO: 118712 - RNA, 19 nt, Homo sapiens
ccgcugacgugaagaugag

SEQ ID NO: 118713 - RNA, 19 nt, Homo sapiens
gccgagaugcuuuauggau

SEQ ID NO: 118714 - RNA, 19 nt, Homo sapiens
uagccaguuucuuucucua

SEQ ID NO: 118715 - RNA, 19 nt, Homo sapiens
gaugaagaacuggaagaca

SEQ ID NO: 118716 - RNA, 19 nt, Homo sapiens
cauggugcaucccgaguac

SEQ ID NO: 118717 - RNA, 19 nt, Homo sapiens
guucgcuuucucucauuua

SEQ ID NO: 118718 - RNA, 19 nt, Homo sapiens
gguaguucgcuuucucuca

SEQ ID NO: 118719 - RNA, 19 nt, Homo sapiens
ccaggacaaauuuaaucuu

SEQ ID NO: 118720 - RNA, 19 nt, Homo sapiens
caggugaagccauggugaa

SEQ ID NO: 118721 - RNA, 19 nt, Homo sapiens
cauccaggacaaauuuaau

SEQ ID NO: 118722 - RNA, 19 nt, Homo sapiens
ccguggcaaugaauucuuc

SEQ ID NO: 118723 - RNA, 19 nt, Homo sapiens
ggacaaggauuuaauauug

SEQ ID NO: 118724 - RNA, 19 nt, Homo sapiens
gaacaagacucuaacaaga

SEQ ID NO: 118725 - RNA, 19 nt, Homo sapiens
gcagaugaauuuacucuua

SEQ ID NO: 118726 - RNA, 19 nt, Homo sapiens
gauagaagauccaccauuu

SEQ ID NO: 118727 - RNA, 19 nt, Homo sapiens
ccacagaacucauagaauu

SEQ ID NO: 118728 - RNA, 19 nt, Homo sapiens
gcaaauaucugucuacuac

SEQ ID NO: 118729 - RNA, 19 nt, Homo sapiens
gaaaguaccucaagugaca

SEQ ID NO: 118730 - RNA, 19 nt, Homo sapiens
gaagaaauccagacuagua

SEQ ID NO: 118731 - RNA, 19 nt, Homo sapiens
gccaagauguucauaaaua

SEQ ID NO: 118732 - RNA, 19 nt, Homo sapiens
gaugaaaccucguuaugaa

SEQ ID NO: 118733 - RNA, 19 nt, Homo sapiens
gaacagauacuuauacaga

SEQ ID NO: 118734 - RNA, 19 nt, Homo sapiens
caacuggcgucucucauua

SEQ ID NO: 118735 - RNA, 19 nt, Homo sapiens
caaauacagugucauauga

SEQ ID NO: 118736 - RNA, 19 nt, Homo sapiens
gacaagaaauugaaaguga

SEQ ID NO: 118737 - RNA, 19 nt, Homo sapiens
ggagaagacuguguuguaa

SEQ ID NO: 118738 - RNA, 19 nt, Homo sapiens
caaauggcuuggaaucuua

SEQ ID NO: 118739 - RNA, 19 nt, Homo sapiens
ucacagacauuuacugaaa

SEQ ID NO: 118740 - RNA, 19 nt, Homo sapiens
gaaaacagaugaaguggua

SEQ ID NO: 118741 - RNA, 19 nt, Homo sapiens
gcaguuugcuucuacauga

SEQ ID NO: 118742 - RNA, 19 nt, Homo sapiens
gaacaacucaggaagaauu

SEQ ID NO: 118743 - RNA, 19 nt, Homo sapiens
gcaaaggacaauucaauaa

SEQ ID NO: 118744 - RNA, 19 nt, Homo sapiens
uaacugagccucccucuuu

SEQ ID NO: 118745 - RNA, 19 nt, Homo sapiens
uaacagaggugccugaugu

SEQ ID NO: 118746 - RNA, 19 nt, Homo sapiens
gaagaugggcuauaccuaa

SEQ ID NO: 118747 - RNA, 19 nt, Homo sapiens
gcaaauggcuuggaaucuu

SEQ ID NO: 118748 - RNA, 19 nt, Homo sapiens
ggauuuacaucaucuuuga

SEQ ID NO: 118749 - RNA, 19 nt, Homo sapiens
ggaauucccuguaacugaa

SEQ ID NO: 118750 - RNA, 19 nt, Homo sapiens
caaaggacuuauucuauga

SEQ ID NO: 118751 - RNA, 19 nt, Homo sapiens
gcaaacagauauagauaca

SEQ ID NO: 118752 - RNA, 19 nt, Homo sapiens
caacagagucagugaauuu

SEQ ID NO: 118753 - RNA, 19 nt, Homo sapiens
ggaacaaauucaagaagaa

SEQ ID NO: 118754 - RNA, 19 nt, Homo sapiens
gaaagcagcaccacauuug

SEQ ID NO: 118755 - RNA, 19 nt, Homo sapiens
gaacuaaggacuccaaugu

SEQ ID NO: 118756 - RNA, 19 nt, Homo sapiens
gaagaaaccacuacugaga

SEQ ID NO: 118757 - RNA, 19 nt, Homo sapiens
gaaagagacuacuguccuu

SEQ ID NO: 118758 - RNA, 19 nt, Homo sapiens
ggaggcaccuguuauccua

SEQ ID NO: 118759 - RNA, 19 nt, Homo sapiens
uaaagaagaugaaccuugu

SEQ ID NO: 118760 - RNA, 19 nt, Homo sapiens
gaaagaacagaaacacuaa

SEQ ID NO: 118761 - RNA, 19 nt, Homo sapiens
aaacagaaaugacacauag

SEQ ID NO: 118762 - RNA, 19 nt, Homo sapiens
ccaaauuccugaagucauu

SEQ ID NO: 118763 - RNA, 19 nt, Homo sapiens
ccaaaggacuuauucuaug

SEQ ID NO: 118764 - RNA, 19 nt, Homo sapiens
gaacccaucugcauaccaa

SEQ ID NO: 118765 - RNA, 19 nt, Homo sapiens
gagaagcaaucaagauguu

SEQ ID NO: 118766 - RNA, 19 nt, Homo sapiens
gaagaagagugugcaaaug

SEQ ID NO: 118767 - RNA, 19 nt, Homo sapiens
uaagagauauggaggaaga

SEQ ID NO: 118768 - RNA, 19 nt, Homo sapiens
gaugaagacagaacacuua

SEQ ID NO: 118769 - RNA, 19 nt, Homo sapiens
gagaaguaauuaucaguug

SEQ ID NO: 118770 - RNA, 19 nt, Homo sapiens
ucaacucccugauuagaua

SEQ ID NO: 118771 - RNA, 19 nt, Homo sapiens
ggaggaguaugaagacaaa

SEQ ID NO: 118772 - RNA, 19 nt, Homo sapiens
gcaauaagccgccuuccaa

SEQ ID NO: 118773 - RNA, 19 nt, Homo sapiens
uuucuuagcuacugcauua

SEQ ID NO: 118774 - RNA, 19 nt, Homo sapiens
cauggaagccugagacuua

SEQ ID NO: 118775 - RNA, 19 nt, Homo sapiens
ggacagcucugaaagugau

SEQ ID NO: 118776 - RNA, 19 nt, Homo sapiens
ccacuacccuugaagauau

SEQ ID NO: 118777 - RNA, 19 nt, Homo sapiens
gaacauguagucacagauu

SEQ ID NO: 118778 - RNA, 19 nt, Homo sapiens
caggagagauugccauuga

SEQ ID NO: 118779 - RNA, 19 nt, Homo sapiens
auaaagacaucccaaguuu

SEQ ID NO: 118780 - RNA, 19 nt, Homo sapiens
gaagagagacaaacuagug

SEQ ID NO: 118781 - RNA, 19 nt, Homo sapiens
gagagcaccuugaucuuug

SEQ ID NO: 118782 - RNA, 19 nt, Homo sapiens
ggauauggaugacuacuca

SEQ ID NO: 118783 - RNA, 19 nt, Homo sapiens
gagcagaaaguaagcauuu

SEQ ID NO: 118784 - RNA, 19 nt, Homo sapiens
gcaauuaccaucucaccua

SEQ ID NO: 118785 - RNA, 19 nt, Homo sapiens
gagcaugacuuccguugga

SEQ ID NO: 118786 - RNA, 19 nt, Homo sapiens
ucacacaacuucagcauuc

SEQ ID NO: 118787 - RNA, 19 nt, Homo sapiens
cccaagagccuacuacuua

SEQ ID NO: 118788 - RNA, 19 nt, Homo sapiens
gcacugaaggccaaguuua

SEQ ID NO: 118789 - RNA, 19 nt, Homo sapiens
gaagaagugcuccagagua

SEQ ID NO: 118790 - RNA, 19 nt, Homo sapiens
gaagauagaagccaacuag

SEQ ID NO: 118791 - RNA, 19 nt, Homo sapiens
ucauagaccuggacaaaga

SEQ ID NO: 118792 - RNA, 19 nt, Homo sapiens
caucugacuuguauuauga

SEQ ID NO: 118793 - RNA, 19 nt, Homo sapiens
ccaacuacaucaacuggua

SEQ ID NO: 118794 - RNA, 19 nt, Homo sapiens
caacagaaguaagagauau

SEQ ID NO: 118795 - RNA, 19 nt, Homo sapiens
ccacaaaugguuucugaua

SEQ ID NO: 118796 - RNA, 19 nt, Homo sapiens
ugagaacccuguaucguuu

SEQ ID NO: 118797 - RNA, 19 nt, Homo sapiens
cagccuaucuaauuucuuu

SEQ ID NO: 118798 - RNA, 19 nt, Homo sapiens
gaaaguauuggcauucaaa

SEQ ID NO: 118799 - RNA, 19 nt, Homo sapiens
gauacaacauuagcaguuu

SEQ ID NO: 118800 - RNA, 19 nt, Homo sapiens
ccuagaggauauugauuua

SEQ ID NO: 118801 - RNA, 19 nt, Homo sapiens
uagaggagguuacugauga

SEQ ID NO: 118802 - RNA, 19 nt, Homo sapiens
gaggaagacuuuacagcaa

SEQ ID NO: 118803 - RNA, 19 nt, Homo sapiens
gguaagcacuguuucugaa

SEQ ID NO: 118804 - RNA, 19 nt, Homo sapiens
gaagguagugggucaguaa

SEQ ID NO: 118805 - RNA, 19 nt, Homo sapiens
gaaguggaacaaaucaaua

SEQ ID NO: 118806 - RNA, 19 nt, Homo sapiens
gauaaucacagaaagcuuu

SEQ ID NO: 118807 - RNA, 19 nt, Homo sapiens
gagaacagauacuuauaca

SEQ ID NO: 118808 - RNA, 19 nt, Homo sapiens
ugguaaaccugaguuauua

SEQ ID NO: 118809 - RNA, 19 nt, Homo sapiens
ggaaauccuuggccagaug

SEQ ID NO: 118810 - RNA, 19 nt, Homo sapiens
ccuaucaccucgagaagua

SEQ ID NO: 118811 - RNA, 19 nt, Homo sapiens
caacgucaccuuccaacua

SEQ ID NO: 118812 - RNA, 19 nt, Homo sapiens
gcaaagaugguuucauuca

SEQ ID NO: 118813 - RNA, 19 nt, Homo sapiens
cugcaaagaugguuucauu

SEQ ID NO: 118814 - RNA, 19 nt, Homo sapiens
ggauaggccucaaugacaa

SEQ ID NO: 118815 - RNA, 19 nt, Homo sapiens
ccacuuguguugaugguuu

SEQ ID NO: 118816 - RNA, 19 nt, Homo sapiens
gcacagaaacagaauuaga

SEQ ID NO: 118817 - RNA, 19 nt, Homo sapiens
aaacagaaaccgauauuga

SEQ ID NO: 118818 - RNA, 19 nt, Homo sapiens
gcagguacacacugaauuu

SEQ ID NO: 118819 - RNA, 19 nt, Homo sapiens
uauaccagcugaacaugua

SEQ ID NO: 118820 - RNA, 19 nt, Homo sapiens
ccaagaaucucagaaaaua

SEQ ID NO: 118821 - RNA, 19 nt, Homo sapiens
gaaccuguaucucuguuuc

SEQ ID NO: 118822 - RNA, 19 nt, Homo sapiens
gagaguauuucacgacuuc

SEQ ID NO: 118823 - RNA, 19 nt, Homo sapiens
gaacacagcuucauuaaua

SEQ ID NO: 118824 - RNA, 19 nt, Homo sapiens
gagaggagauugaaauaua

SEQ ID NO: 118825 - RNA, 19 nt, Homo sapiens
gacaacagcucucccuuua

SEQ ID NO: 118826 - RNA, 19 nt, Homo sapiens
gaacagggcacacaggaua

SEQ ID NO: 118827 - RNA, 19 nt, Homo sapiens
gggcugaucugaccaauga

SEQ ID NO: 118828 - RNA, 19 nt, Homo sapiens
caccagaaauucagacuua

SEQ ID NO: 118829 - RNA, 19 nt, Homo sapiens
gcuaaagacuuacauacaa

SEQ ID NO: 118830 - RNA, 19 nt, Homo sapiens
gcacauacccaguccuuaa

SEQ ID NO: 118831 - RNA, 19 nt, Homo sapiens
guuaagaaguguaaacuga

SEQ ID NO: 118832 - RNA, 19 nt, Homo sapiens
ggaguaaggauuuggaaua

SEQ ID NO: 118833 - RNA, 19 nt, Homo sapiens
guagagagaugcucagugu

SEQ ID NO: 118834 - RNA, 19 nt, Homo sapiens
gaguaaggauuuggaauaa

SEQ ID NO: 118835 - RNA, 19 nt, Homo sapiens
gucauuagcuuugggaaua

SEQ ID NO: 118836 - RNA, 19 nt, Homo sapiens
gaggaacacagcuucauua

SEQ ID NO: 118837 - RNA, 19 nt, Homo sapiens
ggaggcaccuguauugaug

SEQ ID NO: 118838 - RNA, 19 nt, Homo sapiens
gaauggcccucuucaggaa

SEQ ID NO: 118839 - RNA, 19 nt, Homo sapiens
gaagaagaaacccugauuu

SEQ ID NO: 118840 - RNA, 19 nt, Homo sapiens
gcugugagcugcaguguuc

SEQ ID NO: 118841 - RNA, 19 nt, Homo sapiens
gaaagguacuggcuugaag

SEQ ID NO: 118842 - RNA, 19 nt, Homo sapiens
gaaguagacaccaugcuaa

SEQ ID NO: 118843 - RNA, 19 nt, Homo sapiens
gagagaugcucaguguuaa

SEQ ID NO: 118844 - RNA, 19 nt, Homo sapiens
gcccugcccugucucuuua

SEQ ID NO: 118845 - RNA, 19 nt, Homo sapiens
auacagguuugucuucuua

SEQ ID NO: 118846 - RNA, 19 nt, Homo sapiens
ccagugcaaugaaggauuu

SEQ ID NO: 118847 - RNA, 19 nt, Homo sapiens
aguguaaacugaacccuua

SEQ ID NO: 118848 - RNA, 19 nt, Homo sapiens
uaacacaucuuuggucauc

SEQ ID NO: 118849 - RNA, 19 nt, Homo sapiens
acaccaugcuaaagacuua

SEQ ID NO: 118850 - RNA, 19 nt, Homo sapiens
agagagaugcucaguguua

SEQ ID NO: 118851 - RNA, 19 nt, Homo sapiens
caaauugucugcaccaaac

SEQ ID NO: 118852 - RNA, 19 nt, Homo sapiens
gaucccagguguuugaaga

SEQ ID NO: 118853 - RNA, 19 nt, Homo sapiens
ggaagaagaaacccugauu

SEQ ID NO: 118854 - RNA, 19 nt, Homo sapiens
cuccaugccuucagaguua

SEQ ID NO: 118855 - RNA, 19 nt, Homo sapiens
gaauguggcuguagguuuu

SEQ ID NO: 118856 - RNA, 19 nt, Homo sapiens
ggugacagguguuguguuc

SEQ ID NO: 118857 - RNA, 19 nt, Homo sapiens
ggucaucuaugucacacaa

SEQ ID NO: 118858 - RNA, 19 nt, Homo sapiens
ggaaaugguuaagaagugu

SEQ ID NO: 118859 - RNA, 19 nt, Homo sapiens
caggaaagauccacagcuu

SEQ ID NO: 118860 - RNA, 19 nt, Homo sapiens
ccacugagacugccacuga

SEQ ID NO: 118861 - RNA, 19 nt, Homo sapiens
guaaggauuuggaauaagg

SEQ ID NO: 118862 - RNA, 19 nt, Homo sapiens
gcucagauauaaaggaaag

SEQ ID NO: 118863 - RNA, 19 nt, Homo sapiens
gagggagaguguauugcua

SEQ ID NO: 118864 - RNA, 19 nt, Homo sapiens
gagaaugaucaaagcaaua

SEQ ID NO: 118865 - RNA, 19 nt, Homo sapiens
acaccgggcugcaauuuga

SEQ ID NO: 118866 - RNA, 19 nt, Homo sapiens
ggauuuggaauaaggauuu

SEQ ID NO: 118867 - RNA, 19 nt, Homo sapiens
cauacaaucuccuugaauc

SEQ ID NO: 118868 - RNA, 19 nt, Homo sapiens
gaauagaaggcuacacaga

SEQ ID NO: 118869 - RNA, 19 nt, Homo sapiens
gaugaaggacccacuguga

SEQ ID NO: 118870 - RNA, 19 nt, Homo sapiens
ggaauguggcuguagguuu

SEQ ID NO: 118871 - RNA, 19 nt, Homo sapiens
gcacccucauacacauuua

SEQ ID NO: 118872 - RNA, 19 nt, Homo sapiens
gaaagaaauguguuaacug

SEQ ID NO: 118873 - RNA, 19 nt, Homo sapiens
ccucaucucuggcaggaaa

SEQ ID NO: 118874 - RNA, 19 nt, Homo sapiens
gcgcugagauuuggugguu

SEQ ID NO: 118875 - RNA, 19 nt, Homo sapiens
aauguuggcugaauuccua

SEQ ID NO: 118876 - RNA, 19 nt, Homo sapiens
gaaacaagagaguccagaa

SEQ ID NO: 118877 - RNA, 19 nt, Homo sapiens
gggcgagucugccucaguu

SEQ ID NO: 118878 - RNA, 19 nt, Homo sapiens
gaacucaccuugccuuccu

SEQ ID NO: 118879 - RNA, 19 nt, Homo sapiens
acaccuaccugcggucaua

SEQ ID NO: 118880 - RNA, 19 nt, Homo sapiens
acaaauagacgagaggaua

SEQ ID NO: 118881 - RNA, 19 nt, Homo sapiens
gaucccacguacugcauuu

SEQ ID NO: 118882 - RNA, 19 nt, Homo sapiens
cacaggaacucuacgaugu

SEQ ID NO: 118883 - RNA, 19 nt, Homo sapiens
guagacaccaugcuaaaga

SEQ ID NO: 118884 - RNA, 19 nt, Homo sapiens
gugcaugaguguauguuug

SEQ ID NO: 118885 - RNA, 19 nt, Homo sapiens
agaaccagccggacaauuu

SEQ ID NO: 118886 - RNA, 19 nt, Homo sapiens
caucuuuggucaucuaugu

SEQ ID NO: 118887 - RNA, 19 nt, Homo sapiens
aaacugaacccuuauccuu

SEQ ID NO: 118888 - RNA, 19 nt, Homo sapiens
ccaaaugugcaaccuguaa

SEQ ID NO: 118889 - RNA, 19 nt, Homo sapiens
aaagaaagcacaacaccuu

SEQ ID NO: 118890 - RNA, 19 nt, Homo sapiens
gagaauggaggcaccugua

SEQ ID NO: 118891 - RNA, 19 nt, Homo sapiens
acacaucuuuggucaucua

SEQ ID NO: 118892 - RNA, 19 nt, Homo sapiens
uaccugcggucauauugua

SEQ ID NO: 118893 - RNA, 19 nt, Homo sapiens
gaacugugagauugacauu

SEQ ID NO: 118894 - RNA, 19 nt, Homo sapiens
gggcauagaggacuucgaa

SEQ ID NO: 118895 - RNA, 19 nt, Homo sapiens
gacagaacccagagagaaa

SEQ ID NO: 118896 - RNA, 19 nt, Homo sapiens
caauguccaugccacugua

SEQ ID NO: 118897 - RNA, 19 nt, Homo sapiens
ggagaaugccucacucauc

SEQ ID NO: 118898 - RNA, 19 nt, Homo sapiens
ggaggaacacagcuucauu

SEQ ID NO: 118899 - RNA, 19 nt, Homo sapiens
gaauggaggcaccuguauu

SEQ ID NO: 118900 - RNA, 19 nt, Homo sapiens
gauacagguuugucuucuu

SEQ ID NO: 118901 - RNA, 19 nt, Homo sapiens
ucauuggucuggucucuug

SEQ ID NO: 118902 - RNA, 19 nt, Homo sapiens
gaaccagccggacaauuuc

SEQ ID NO: 118903 - RNA, 19 nt, Homo sapiens
acugugagauugacauuga

SEQ ID NO: 118904 - RNA, 19 nt, Homo sapiens
cggaggaggugcacucaga

SEQ ID NO: 118905 - RNA, 19 nt, Homo sapiens
gcccauggccuucuguaaa

SEQ ID NO: 118906 - RNA, 19 nt, Homo sapiens
gcugagggaagcacaagua

SEQ ID NO: 118907 - RNA, 19 nt, Homo sapiens
ggagaaggacgaagggaau

SEQ ID NO: 118908 - RNA, 19 nt, Homo sapiens
ggacauguaaugccaaugg

SEQ ID NO: 118909 - RNA, 19 nt, Homo sapiens
gaggauggcuuugacaacu

SEQ ID NO: 118910 - RNA, 19 nt, Homo sapiens
ggaacucuacgauguguau

SEQ ID NO: 118911 - RNA, 19 nt, Homo sapiens
ccaaauccuuacuccaaau

SEQ ID NO: 118912 - RNA, 19 nt, Homo sapiens
caaauagacgagaggauau

SEQ ID NO: 118913 - RNA, 19 nt, Homo sapiens
gaaucucuuucacacaaau

SEQ ID NO: 118914 - RNA, 19 nt, Homo sapiens
ggagugagaaugaucaaag

SEQ ID NO: 118915 - RNA, 19 nt, Homo sapiens
caacagcucucccuuuacc

SEQ ID NO: 118916 - RNA, 19 nt, Homo sapiens
gggaagaugccgagaagga

SEQ ID NO: 118917 - RNA, 19 nt, Homo sapiens
cgacaggaguaaggauuug

SEQ ID NO: 118918 - RNA, 19 nt, Homo sapiens
ggaaagguacuggcuugaa

SEQ ID NO: 118919 - RNA, 19 nt, Homo sapiens
cagcccaaguuccgucuuu

SEQ ID NO: 118920 - RNA, 19 nt, Homo sapiens
gcaaggccaagaacaaugu

SEQ ID NO: 118921 - RNA, 19 nt, Homo sapiens
caacaccgggcugcaauuu

SEQ ID NO: 118922 - RNA, 19 nt, Homo sapiens
gaaaugguuaagaagugua

SEQ ID NO: 118923 - RNA, 19 nt, Homo sapiens
gaaggaacccuagaguuua

SEQ ID NO: 118924 - RNA, 19 nt, Homo sapiens
gaugauaucccauuuguug

SEQ ID NO: 118925 - RNA, 19 nt, Homo sapiens
caaggaagcuauuuaacau

SEQ ID NO: 118926 - RNA, 19 nt, Homo sapiens
uaagggagauugcaaggaa

SEQ ID NO: 118927 - RNA, 19 nt, Homo sapiens
cgaaggaacccuagaguuu

SEQ ID NO: 118928 - RNA, 19 nt, Homo sapiens
gggcugugcugaagaguuu

SEQ ID NO: 118929 - RNA, 19 nt, Homo sapiens
cagagacgcugcugaguga

SEQ ID NO: 118930 - RNA, 19 nt, Homo sapiens
gcaaggaagcuauuuaaca

SEQ ID NO: 118931 - RNA, 19 nt, Homo sapiens
ugacauccuucaccaauga

SEQ ID NO: 118932 - RNA, 19 nt, Homo sapiens
ggucuacgcugggaauauu

SEQ ID NO: 118933 - RNA, 19 nt, Homo sapiens
ugucacagcuccaccauau

SEQ ID NO: 118934 - RNA, 19 nt, Homo sapiens
ucacagcuccaccauauuu

SEQ ID NO: 118935 - RNA, 19 nt, Homo sapiens
ggcauaagccaauaggaua

SEQ ID NO: 118936 - RNA, 19 nt, Homo sapiens
caggauggcuuccacuuuc

SEQ ID NO: 118937 - RNA, 19 nt, Homo sapiens
gcauaagccaauaggauaa

SEQ ID NO: 118938 - RNA, 19 nt, Homo sapiens
ccacugagccuuacaaugc

SEQ ID NO: 118939 - RNA, 19 nt, Homo sapiens
gggaggcccuggugaacuu

SEQ ID NO: 118940 - RNA, 19 nt, Homo sapiens
gaagaugauaucccauuug

SEQ ID NO: 118941 - RNA, 19 nt, Homo sapiens
gcccggugcugucugagua

SEQ ID NO: 118942 - RNA, 19 nt, Homo sapiens
ugagguaccugagcacuga

SEQ ID NO: 118943 - RNA, 19 nt, Homo sapiens
gacaucguauucucaguga

SEQ ID NO: 118944 - RNA, 19 nt, Homo sapiens
agaagaugauaucccauuu

SEQ ID NO: 118945 - RNA, 19 nt, Homo sapiens
gcaaaucccaggugcuguu

SEQ ID NO: 118946 - RNA, 19 nt, Homo sapiens
gcuaagagggcaaggagaa

SEQ ID NO: 118947 - RNA, 19 nt, Homo sapiens
gggacaggcuugcccaugu

SEQ ID NO: 118948 - RNA, 19 nt, Homo sapiens
gcaagccgauguggauuca

SEQ ID NO: 118949 - RNA, 19 nt, Homo sapiens
gcaggauggcuuccacuuu

SEQ ID NO: 118950 - RNA, 19 nt, Homo sapiens
gggaugagguccacuacca

SEQ ID NO: 118951 - RNA, 19 nt, Homo sapiens
gagagcgccuccagucuag

SEQ ID NO: 118952 - RNA, 19 nt, Homo sapiens
caagguggaggcaggcuua

SEQ ID NO: 118953 - RNA, 19 nt, Homo sapiens
cgagagcaguggugacaug

SEQ ID NO: 118954 - RNA, 19 nt, Homo sapiens
cugggaauauucuguauga

SEQ ID NO: 118955 - RNA, 19 nt, Homo sapiens
gaagaggcgaguacuguuc

SEQ ID NO: 118956 - RNA, 19 nt, Homo sapiens
aagaugauaucccauuugu

SEQ ID NO: 118957 - RNA, 19 nt, Homo sapiens
cauggagccuggauaaaca

SEQ ID NO: 118958 - RNA, 19 nt, Homo sapiens
gauaucccauuuguugcua

SEQ ID NO: 118959 - RNA, 19 nt, Homo sapiens
cacaucaucuucccacaug

SEQ ID NO: 118960 - RNA, 19 nt, Homo sapiens
gaccaguacccuacgcaua

SEQ ID NO: 118961 - RNA, 19 nt, Homo sapiens
gggauggguuuauuuaagg

SEQ ID NO: 118962 - RNA, 19 nt, Homo sapiens
uagaaggcauaagccaaua

SEQ ID NO: 118963 - RNA, 19 nt, Homo sapiens
ggacagaguggagucaaga

SEQ ID NO: 118964 - RNA, 19 nt, Homo sapiens
gaccuccucuuuggcagua

SEQ ID NO: 118965 - RNA, 19 nt, Homo sapiens
ccacuauggugacauccuu

SEQ ID NO: 118966 - RNA, 19 nt, Homo sapiens
gggccaggguaccguauug

SEQ ID NO: 118967 - RNA, 19 nt, Homo sapiens
cagcugagcaugucugaug

SEQ ID NO: 118968 - RNA, 19 nt, Homo sapiens
ggugagggauguaaaugag

SEQ ID NO: 118969 - RNA, 19 nt, Homo sapiens
aaaccaggguaaccuccua

SEQ ID NO: 118970 - RNA, 19 nt, Homo sapiens
ggaagaggcgaguacuguu

SEQ ID NO: 118971 - RNA, 19 nt, Homo sapiens
gccaagggcuaaacaugca

SEQ ID NO: 118972 - RNA, 19 nt, Homo sapiens
ugagggcucugcugcaugu

SEQ ID NO: 118973 - RNA, 19 nt, Homo sapiens
ggaggcaggcuuaaguuca

SEQ ID NO: 118974 - RNA, 19 nt, Homo sapiens
ucagaggccuuugccauca

SEQ ID NO: 118975 - RNA, 19 nt, Homo sapiens
cagaagaugauaucccauu

SEQ ID NO: 118976 - RNA, 19 nt, Homo sapiens
ggauaaacagugcuuugga

SEQ ID NO: 118977 - RNA, 19 nt, Homo sapiens
ccacggcucugaccgacau

SEQ ID NO: 118978 - RNA, 19 nt, Homo sapiens
gaaccucccucagcucacu

SEQ ID NO: 118979 - RNA, 19 nt, Homo sapiens
gaugccacccuacaaguga

SEQ ID NO: 118980 - RNA, 19 nt, Homo sapiens
gaggacaccuuccguuucc

SEQ ID NO: 118981 - RNA, 19 nt, Homo sapiens
ccacagcucgugccucaga

SEQ ID NO: 118982 - RNA, 19 nt, Homo sapiens
gguucaggcucccaggaaa

SEQ ID NO: 118983 - RNA, 19 nt, Homo sapiens
aaucuguccuucccaguga

SEQ ID NO: 118984 - RNA, 19 nt, Homo sapiens
gagcugcagaagcauagua

SEQ ID NO: 118985 - RNA, 19 nt, Homo sapiens
gcuuugacccugacuaugu

SEQ ID NO: 118986 - RNA, 19 nt, Homo sapiens
caagagagaccuggagaca

SEQ ID NO: 118987 - RNA, 19 nt, Homo sapiens
ucacucagcaggaccuuga

SEQ ID NO: 118988 - RNA, 19 nt, Homo sapiens
gagguggucuuugccuuca

SEQ ID NO: 118989 - RNA, 19 nt, Homo sapiens
gcaguaucguggccguaga

SEQ ID NO: 118990 - RNA, 19 nt, Homo sapiens
gcucugccaugcccaucuu

SEQ ID NO: 118991 - RNA, 19 nt, Homo sapiens
gagcuagccaggacugaug

SEQ ID NO: 118992 - RNA, 19 nt, Homo sapiens
ggucugaggaucuggucua

SEQ ID NO: 118993 - RNA, 19 nt, Homo sapiens
ggagcgagacacugacaga

SEQ ID NO: 118994 - RNA, 19 nt, Homo sapiens
gaagaccucagugucaaug

SEQ ID NO: 118995 - RNA, 19 nt, Homo sapiens
caggguaaccuccuacaug

SEQ ID NO: 118996 - RNA, 19 nt, Homo sapiens
caccguggcugcucuggau

SEQ ID NO: 118997 - RNA, 19 nt, Homo sapiens
ggacaccaaccucgacauc

SEQ ID NO: 118998 - RNA, 19 nt, Homo sapiens
ccauccagcccgugaauga

SEQ ID NO: 118999 - RNA, 19 nt, Homo sapiens
gaggcaggcuuaaguucag

SEQ ID NO: 119000 - RNA, 19 nt, Homo sapiens
ggaggguccugggagauag

SEQ ID NO: 119001 - RNA, 19 nt, Homo sapiens
caacaagacgggcaagcau

SEQ ID NO: 119002 - RNA, 19 nt, Homo sapiens
ggacgaaggaacccuagag

SEQ ID NO: 119003 - RNA, 19 nt, Homo sapiens
caugagggcugugcugaag

SEQ ID NO: 119004 - RNA, 19 nt, Homo sapiens
ggaggaguaugaggacgau

SEQ ID NO: 119005 - RNA, 19 nt, Homo sapiens
agagagcgccuccagucua

SEQ ID NO: 119006 - RNA, 19 nt, Homo sapiens
caacccaggccacccuuug

SEQ ID NO: 119007 - RNA, 19 nt, Homo sapiens
gacgggagcgagacacuga

SEQ ID NO: 119008 - RNA, 19 nt, Homo sapiens
gaccacagaagaugauauc

SEQ ID NO: 119009 - RNA, 19 nt, Homo sapiens
gacgaugccuauggccauu

SEQ ID NO: 119010 - RNA, 19 nt, Homo sapiens
gagcgccuccagucuagaa

SEQ ID NO: 119011 - RNA, 19 nt, Homo sapiens
ccuguggccuucacuguca

SEQ ID NO: 119012 - RNA, 19 nt, Homo sapiens
gaugcugacucgggcuuug

SEQ ID NO: 119013 - RNA, 19 nt, Homo sapiens
acacuguggugcugacugu

SEQ ID NO: 119014 - RNA, 19 nt, Homo sapiens
aggcugagcugcgcaaauc

SEQ ID NO: 119015 - RNA, 19 nt, Homo sapiens
aaaucuccguggaccagua

SEQ ID NO: 119016 - RNA, 19 nt, Homo sapiens
gagauugcaaggaagcuau

SEQ ID NO: 119017 - RNA, 19 nt, Homo sapiens
gaugguauccccuggagua

SEQ ID NO: 119018 - RNA, 19 nt, Homo sapiens
gggcaaggagaaggaagua

SEQ ID NO: 119019 - RNA, 19 nt, Homo sapiens
gcaacaagacgggcaagca

SEQ ID NO: 119020 - RNA, 19 nt, Homo sapiens
uggaggaggaggaguauga

SEQ ID NO: 119021 - RNA, 19 nt, Homo sapiens
uggaagaccucagugucaa

SEQ ID NO: 119022 - RNA, 19 nt, Homo sapiens
uuaacauggugcugagcua

SEQ ID NO: 119023 - RNA, 19 nt, Homo sapiens
gagaauaacccaggucuua

SEQ ID NO: 119024 - RNA, 19 nt, Homo sapiens
caaaggauguuaugcuaaa

SEQ ID NO: 119025 - RNA, 19 nt, Homo sapiens
ggaggauccuaaugaaaua

SEQ ID NO: 119026 - RNA, 19 nt, Homo sapiens
ggcaacagcuuccauaaau

SEQ ID NO: 119027 - RNA, 19 nt, Homo sapiens
agacaaggauggcgagauu

SEQ ID NO: 119028 - RNA, 19 nt, Homo sapiens
ucauuuaucucuggccuua

SEQ ID NO: 119029 - RNA, 19 nt, Homo sapiens
uuucucaucuggucaauaa

SEQ ID NO: 119030 - RNA, 19 nt, Homo sapiens
gcugggaaguccuggcaua

SEQ ID NO: 119031 - RNA, 19 nt, Homo sapiens
gaugggaggauccuaauga

SEQ ID NO: 119032 - RNA, 19 nt, Homo sapiens
gugaggagauuuacugcaa

SEQ ID NO: 119033 - RNA, 19 nt, Homo sapiens
cucagaaucuucccuuuaa

SEQ ID NO: 119034 - RNA, 19 nt, Homo sapiens
guaggagaccucaguguuu

SEQ ID NO: 119035 - RNA, 19 nt, Homo sapiens
gcaaaggauguuaugcuaa

SEQ ID NO: 119036 - RNA, 19 nt, Homo sapiens
agaagaaucuggacaguac

SEQ ID NO: 119037 - RNA, 19 nt, Homo sapiens
gagauuuacugcaaaggau

SEQ ID NO: 119038 - RNA, 19 nt, Homo sapiens
ggccagggcucuguucuug

SEQ ID NO: 119039 - RNA, 19 nt, Homo sapiens
cauaaggccugcuuucgau

SEQ ID NO: 119040 - RNA, 19 nt, Homo sapiens
gggaggauccuaaugaaau

SEQ ID NO: 119041 - RNA, 19 nt, Homo sapiens
gcaacagcuuccauaaauc

SEQ ID NO: 119042 - RNA, 19 nt, Homo sapiens
caaccacccuggcagacaa

SEQ ID NO: 119043 - RNA, 19 nt, Homo sapiens
acaaggauggcgagauuua

SEQ ID NO: 119044 - RNA, 19 nt, Homo sapiens
ucagaagacgguuuacuuu

SEQ ID NO: 119045 - RNA, 19 nt, Homo sapiens
uacccaagcugauuucuca

SEQ ID NO: 119046 - RNA, 19 nt, Homo sapiens
ggaagcaagaccaagauga

SEQ ID NO: 119047 - RNA, 19 nt, Homo sapiens
caaauuugcccagaagauu

SEQ ID NO: 119048 - RNA, 19 nt, Homo sapiens
caagaaguaugggcccaaa

SEQ ID NO: 119049 - RNA, 19 nt, Homo sapiens
gaaaggacaacacuaucug

SEQ ID NO: 119050 - RNA, 19 nt, Homo sapiens
ccugaggagucccagcuua

SEQ ID NO: 119051 - RNA, 19 nt, Homo sapiens
caagacaccugaggacaca

SEQ ID NO: 119052 - RNA, 19 nt, Homo sapiens
acauaucacuaaugacuug

SEQ ID NO: 119053 - RNA, 19 nt, Homo sapiens
ugucagcccugccacauau

SEQ ID NO: 119054 - RNA, 19 nt, Homo sapiens
ugccacauaucacuaauga

SEQ ID NO: 119055 - RNA, 19 nt, Homo sapiens
cgagccagcugccagaaug

SEQ ID NO: 119056 - RNA, 19 nt, Homo sapiens
ccucagaaucuucccuuua

SEQ ID NO: 119057 - RNA, 19 nt, Homo sapiens
ugcaaaggauguuaugcua

SEQ ID NO: 119058 - RNA, 19 nt, Homo sapiens
gcauaaggccugcuuucga

SEQ ID NO: 119059 - RNA, 19 nt, Homo sapiens
gggagucgcuggguaucaa

SEQ ID NO: 119060 - RNA, 19 nt, Homo sapiens
cccaaugcauccaaauuug

SEQ ID NO: 119061 - RNA, 19 nt, Homo sapiens
gaggagauuuacugcaagu

SEQ ID NO: 119062 - RNA, 19 nt, Homo sapiens
gaauaacccaggucuuaag

SEQ ID NO: 119063 - RNA, 19 nt, Homo sapiens
gaagcaagaccaagaugag

SEQ ID NO: 119064 - RNA, 19 nt, Homo sapiens
ccacauaucacuaaugacu

SEQ ID NO: 119065 - RNA, 19 nt, Homo sapiens
gggaaguccuggcauaagg

SEQ ID NO: 119066 - RNA, 19 nt, Homo sapiens
gagggaagcaagaccaaga

SEQ ID NO: 119067 - RNA, 19 nt, Homo sapiens
caagaagaaucuggacagu

SEQ ID NO: 119068 - RNA, 19 nt, Homo sapiens
cauccaaauuugcccagaa

SEQ ID NO: 119069 - RNA, 19 nt, Homo sapiens
gcaucuggcucccuuuggu

SEQ ID NO: 119070 - RNA, 19 nt, Homo sapiens
cagaagacgguuuacuuug

SEQ ID NO: 119071 - RNA, 19 nt, Homo sapiens
ucacuaaugacuugaacuu

SEQ ID NO: 119072 - RNA, 19 nt, Homo sapiens
gggccuugguccacucuga

SEQ ID NO: 119073 - RNA, 19 nt, Homo sapiens
agaagacgguuuacuuugc

SEQ ID NO: 119074 - RNA, 19 nt, Homo sapiens
aucaauggcucaaaucuuc

SEQ ID NO: 119075 - RNA, 19 nt, Homo sapiens
gucaggauguuguuugauc

SEQ ID NO: 119076 - RNA, 19 nt, Homo sapiens
gcuuagggagucacuauug

SEQ ID NO: 119077 - RNA, 19 nt, Homo sapiens
cuaaugaaauaccugaaac

SEQ ID NO: 119078 - RNA, 19 nt, Homo sapiens
gaucuucucaaacaucuag

SEQ ID NO: 119079 - RNA, 19 nt, Homo sapiens
caucaucagcugaccaaga

SEQ ID NO: 119080 - RNA, 19 nt, Homo sapiens
ggaggaggcaagaaaugug

SEQ ID NO: 119081 - RNA, 19 nt, Homo sapiens
uggcaaaggccuugaguca

SEQ ID NO: 119082 - RNA, 19 nt, Homo sapiens
ccaagcugauuucucaucu

SEQ ID NO: 119083 - RNA, 19 nt, Homo sapiens
ccuaaugaaauaccugaaa

SEQ ID NO: 119084 - RNA, 19 nt, Homo sapiens
agaauaacccaggucuuaa

SEQ ID NO: 119085 - RNA, 19 nt, Homo sapiens
gucagaagacgguuuacuu

SEQ ID NO: 119086 - RNA, 19 nt, Homo sapiens
cagaggagcagcagcaaca

SEQ ID NO: 119087 - RNA, 19 nt, Homo sapiens
gagaccuccaggauuauuu

SEQ ID NO: 119088 - RNA, 19 nt, Homo sapiens
caaagucaggauguuguuu

SEQ ID NO: 119089 - RNA, 19 nt, Homo sapiens
gaaagagguugagcuuccu

SEQ ID NO: 119090 - RNA, 19 nt, Homo sapiens
ccaaauuugcccagaagau

SEQ ID NO: 119091 - RNA, 19 nt, Homo sapiens
gcuguacccaagcugauuu

SEQ ID NO: 119092 - RNA, 19 nt, Homo sapiens
caacugaaaggacaacacu

SEQ ID NO: 119093 - RNA, 19 nt, Homo sapiens
uccaaacaccuuucccuuu

SEQ ID NO: 119094 - RNA, 19 nt, Homo sapiens
cagcuuagggagucacuau

SEQ ID NO: 119095 - RNA, 19 nt, Homo sapiens
caccugaggacacaucuug

SEQ ID NO: 119096 - RNA, 19 nt, Homo sapiens
ugaaaggacaacacuaucu

SEQ ID NO: 119097 - RNA, 19 nt, Homo sapiens
aaagucaggauguuguuug

SEQ ID NO: 119098 - RNA, 19 nt, Homo sapiens
uuacuuugccgaagagguu

SEQ ID NO: 119099 - RNA, 19 nt, Homo sapiens
caggauuauuucucuguca

SEQ ID NO: 119100 - RNA, 19 nt, Homo sapiens
gggaggaggcaagaaaugu

SEQ ID NO: 119101 - RNA, 19 nt, Homo sapiens
gauguuguuugaucuucuc

SEQ ID NO: 119102 - RNA, 19 nt, Homo sapiens
cgagauuuacugcaaagga

SEQ ID NO: 119103 - RNA, 19 nt, Homo sapiens
ggaauaguggugggaggaa

SEQ ID NO: 119104 - RNA, 19 nt, Homo sapiens
ggauguuguuugaucuucu

SEQ ID NO: 119105 - RNA, 19 nt, Homo sapiens
ggauagccucccacuagga

SEQ ID NO: 119106 - RNA, 19 nt, Homo sapiens
caacagcuuccauaaaucc

SEQ ID NO: 119107 - RNA, 19 nt, Homo sapiens
gacuugaacuugggcaucu

SEQ ID NO: 119108 - RNA, 19 nt, Homo sapiens
ccuccaggauuauuucucu

SEQ ID NO: 119109 - RNA, 19 nt, Homo sapiens
aaauuugcccagaagauug

SEQ ID NO: 119110 - RNA, 19 nt, Homo sapiens
gccucagucuucauccaaa

SEQ ID NO: 119111 - RNA, 19 nt, Homo sapiens
aagucaggauguuguuuga

SEQ ID NO: 119112 - RNA, 19 nt, Homo sapiens
ccaaagucaggauguuguu

SEQ ID NO: 119113 - RNA, 19 nt, Homo sapiens
ccuggugucccucagagua

SEQ ID NO: 119114 - RNA, 19 nt, Homo sapiens
caagaaauguggggugugu

SEQ ID NO: 119115 - RNA, 19 nt, Homo sapiens
caagcugauuucucaucug

SEQ ID NO: 119116 - RNA, 19 nt, Homo sapiens
uaucaauggcucaaaucuu

SEQ ID NO: 119117 - RNA, 19 nt, Homo sapiens
aagaagaaucuggacagua

SEQ ID NO: 119118 - RNA, 19 nt, Homo sapiens
ggagaauaacccaggucuu

SEQ ID NO: 119119 - RNA, 19 nt, Homo sapiens
uggcgagauuuacugcaaa

SEQ ID NO: 119120 - RNA, 19 nt, Homo sapiens
acugaaaggacaacacuau

SEQ ID NO: 119121 - RNA, 19 nt, Homo sapiens
gagagggaagcaagaccaa

SEQ ID NO: 119122 - RNA, 19 nt, Homo sapiens
uaggagaccucaguguuuu

SEQ ID NO: 119123 - RNA, 19 nt, Homo sapiens
gaagagaucuacugcaaau

SEQ ID NO: 119124 - RNA, 19 nt, Homo sapiens
cagaagaggugcaguguga

SEQ ID NO: 119125 - RNA, 19 nt, Homo sapiens
gcacaacaguggcaauuca

SEQ ID NO: 119126 - RNA, 19 nt, Homo sapiens
acacuaaacuacugugaaa

SEQ ID NO: 119127 - RNA, 19 nt, Homo sapiens
caacaaauccaaacacuuc

SEQ ID NO: 119128 - RNA, 19 nt, Homo sapiens
ggugaaaucuauuguaaag

SEQ ID NO: 119129 - RNA, 19 nt, Homo sapiens
gaaauucuaccagcauuaa

SEQ ID NO: 119130 - RNA, 19 nt, Homo sapiens
caacaacucugacugaaaa

SEQ ID NO: 119131 - RNA, 19 nt, Homo sapiens
ggaaagcccuggcacaaaa

SEQ ID NO: 119132 - RNA, 19 nt, Homo sapiens
gaaggugaaaucuauugua

SEQ ID NO: 119133 - RNA, 19 nt, Homo sapiens
gauguaaacccugaacuaa

SEQ ID NO: 119134 - RNA, 19 nt, Homo sapiens
gaacuaaacaucacacacu

SEQ ID NO: 119135 - RNA, 19 nt, Homo sapiens
ucacaggccuacaacaaau

SEQ ID NO: 119136 - RNA, 19 nt, Homo sapiens
agagagcacuguaugguau

SEQ ID NO: 119137 - RNA, 19 nt, Homo sapiens
gcugagaaguguuccagau

SEQ ID NO: 119138 - RNA, 19 nt, Homo sapiens
gaaagaaguaugggccaaa

SEQ ID NO: 119139 - RNA, 19 nt, Homo sapiens
gaagagagcacuguauggu

SEQ ID NO: 119140 - RNA, 19 nt, Homo sapiens
gagaaguguuccagaugug

SEQ ID NO: 119141 - RNA, 19 nt, Homo sapiens
aaacaucacacacugagaa

SEQ ID NO: 119142 - RNA, 19 nt, Homo sapiens
ugagaaguguuccagaugu

SEQ ID NO: 119143 - RNA, 19 nt, Homo sapiens
caaauccaaacacuucuaa

SEQ ID NO: 119144 - RNA, 19 nt, Homo sapiens
uguaaaggaugcuaugcaa

SEQ ID NO: 119145 - RNA, 19 nt, Homo sapiens
gaagaggugcagugugaug

SEQ ID NO: 119146 - RNA, 19 nt, Homo sapiens
gugaaauucuaccagcauu

SEQ ID NO: 119147 - RNA, 19 nt, Homo sapiens
uguaaacccugaacuaaac

SEQ ID NO: 119148 - RNA, 19 nt, Homo sapiens
guauaucgcccuguacuug

SEQ ID NO: 119149 - RNA, 19 nt, Homo sapiens
uaaaggaugcuaugcaaag

SEQ ID NO: 119150 - RNA, 19 nt, Homo sapiens
gcaaauccugcuacggaaa

SEQ ID NO: 119151 - RNA, 19 nt, Homo sapiens
cuaaacuacugugaaauuc

SEQ ID NO: 119152 - RNA, 19 nt, Homo sapiens
gcgagaggcugggcaucaa

SEQ ID NO: 119153 - RNA, 19 nt, Homo sapiens
ugaaauucuaccagcauua

SEQ ID NO: 119154 - RNA, 19 nt, Homo sapiens
augaagagaucuacugcaa

SEQ ID NO: 119155 - RNA, 19 nt, Homo sapiens
aaaggaugcuaugcaaaga

SEQ ID NO: 119156 - RNA, 19 nt, Homo sapiens
guaaaggaugcuaugcaaa

SEQ ID NO: 119157 - RNA, 19 nt, Homo sapiens
guaggaagagagcacugua

SEQ ID NO: 119158 - RNA, 19 nt, Homo sapiens
ggaagagagcacuguaugg

SEQ ID NO: 119159 - RNA, 19 nt, Homo sapiens
aaucaacaacucugacuga

SEQ ID NO: 119160 - RNA, 19 nt, Homo sapiens
caguggcaauucacgauga

SEQ ID NO: 119161 - RNA, 19 nt, Homo sapiens
uggauaggcuggcuaacuc

SEQ ID NO: 119162 - RNA, 19 nt, Homo sapiens
cagcauuaaguacuguaua

SEQ ID NO: 119163 - RNA, 19 nt, Homo sapiens
ucaacaacucugacugaaa

SEQ ID NO: 119164 - RNA, 19 nt, Homo sapiens
gcacuguaugguauccuuu

SEQ ID NO: 119165 - RNA, 19 nt, Homo sapiens
ccucacaggccuacaacaa

SEQ ID NO: 119166 - RNA, 19 nt, Homo sapiens
uaacacuaaacuacuguga

SEQ ID NO: 119167 - RNA, 19 nt, Homo sapiens
caucacacacugagaaucu

SEQ ID NO: 119168 - RNA, 19 nt, Homo sapiens
agauguaaacccugaacua

SEQ ID NO: 119169 - RNA, 19 nt, Homo sapiens
guucaugcccaguaagaug

SEQ ID NO: 119170 - RNA, 19 nt, Homo sapiens
gcaucaaaccagagagugu

SEQ ID NO: 119171 - RNA, 19 nt, Homo sapiens
cuaccagcauuaaguacug

SEQ ID NO: 119172 - RNA, 19 nt, Homo sapiens
gauaauuggagcuggaaag

SEQ ID NO: 119173 - RNA, 19 nt, Homo sapiens
gaugcuaugcaaagaacuu

SEQ ID NO: 119174 - RNA, 19 nt, Homo sapiens
uguauaugcugccgagaag

SEQ ID NO: 119175 - RNA, 19 nt, Homo sapiens
caucaaaccagagaguguu

SEQ ID NO: 119176 - RNA, 19 nt, Homo sapiens
ccaaaaggcuacgguuaug

SEQ ID NO: 119177 - RNA, 19 nt, Homo sapiens
aagagagcacuguauggua

SEQ ID NO: 119178 - RNA, 19 nt, Homo sapiens
uacuguauaucgcccugua

SEQ ID NO: 119179 - RNA, 19 nt, Homo sapiens
ugaagagaucuacugcaaa

SEQ ID NO: 119180 - RNA, 19 nt, Homo sapiens
uacaacaaauccaaacacu

SEQ ID NO: 119181 - RNA, 19 nt, Homo sapiens
gcuuuauucaccagcauuu

SEQ ID NO: 119182 - RNA, 19 nt, Homo sapiens
uagcacaacaguggcaauu

SEQ ID NO: 119183 - RNA, 19 nt, Homo sapiens
aagaaggugaaaucuauug

SEQ ID NO: 119184 - RNA, 19 nt, Homo sapiens
caaagugugggaagagucu

SEQ ID NO: 119185 - RNA, 19 nt, Homo sapiens
caaauccugcuacggaaag

SEQ ID NO: 119186 - RNA, 19 nt, Homo sapiens
acaaauccaaacacuucua

SEQ ID NO: 119187 - RNA, 19 nt, Homo sapiens
ugcuuucucugcaugguuu

SEQ ID NO: 119188 - RNA, 19 nt, Homo sapiens
auauggaggugcugagaag

SEQ ID NO: 119189 - RNA, 19 nt, Homo sapiens
gcauuaaguacuguauauc

SEQ ID NO: 119190 - RNA, 19 nt, Homo sapiens
gaggugcugagaaguguuc

SEQ ID NO: 119191 - RNA, 19 nt, Homo sapiens
uggaaagcccuggcacaaa

SEQ ID NO: 119192 - RNA, 19 nt, Homo sapiens
cgagaggcugggcaucaaa

SEQ ID NO: 119193 - RNA, 19 nt, Homo sapiens
gggaacauuucuuuuacau

SEQ ID NO: 119194 - RNA, 19 nt, Homo sapiens
aaagaaguaugggccaaaa

SEQ ID NO: 119195 - RNA, 19 nt, Homo sapiens
gagaucuacugcaaauccu

SEQ ID NO: 119196 - RNA, 19 nt, Homo sapiens
uuuccgaugugcaaagugu

SEQ ID NO: 119197 - RNA, 19 nt, Homo sapiens
gggcaucaaaccagagagu

SEQ ID NO: 119198 - RNA, 19 nt, Homo sapiens
cuggcacgcuuaacaugga

SEQ ID NO: 119199 - RNA, 19 nt, Homo sapiens
gggcugcgguuccuccuua

SEQ ID NO: 119200 - RNA, 19 nt, Homo sapiens
gcagacagaugaccuacuc

SEQ ID NO: 119201 - RNA, 19 nt, Homo sapiens
gggcugcaaucaauaaaug

SEQ ID NO: 119202 - RNA, 19 nt, Homo sapiens
ccaagcagcugguccuuag

SEQ ID NO: 119203 - RNA, 19 nt, Homo sapiens
gcugaagacucgccugaug

SEQ ID NO: 119204 - RNA, 19 nt, Homo sapiens
gccaaagccucuccacuca

SEQ ID NO: 119205 - RNA, 19 nt, Homo sapiens
gacaacaucuucacucacu

SEQ ID NO: 119206 - RNA, 19 nt, Homo sapiens
guaccucucugacaacauc

SEQ ID NO: 119207 - RNA, 19 nt, Homo sapiens
caacaucuucacucacuuu

SEQ ID NO: 119208 - RNA, 19 nt, Homo sapiens
ccgcguagcucgugaagag

SEQ ID NO: 119209 - RNA, 19 nt, Homo sapiens
gaagggcagugugcucugu

SEQ ID NO: 119210 - RNA, 19 nt, Homo sapiens
caucuucacucacuuuguc

SEQ ID NO: 119211 - RNA, 19 nt, Homo sapiens
gaggugaagcugcgcauga

SEQ ID NO: 119212 - RNA, 19 nt, Homo sapiens
gcaaccagaccuuccaugu

SEQ ID NO: 119213 - RNA, 19 nt, Homo sapiens
ugcaguggcuuuaacaguu

SEQ ID NO: 119214 - RNA, 19 nt, Homo sapiens
ccggguaccucucugacaa

SEQ ID NO: 119215 - RNA, 19 nt, Homo sapiens
ugacucgguucgccaucua

SEQ ID NO: 119216 - RNA, 19 nt, Homo sapiens
cacgcuagguucuuccaaa

SEQ ID NO: 119217 - RNA, 19 nt, Homo sapiens
ugaagacucgccugaugaa

SEQ ID NO: 119218 - RNA, 19 nt, Homo sapiens
gcaccggguaccucucuga

SEQ ID NO: 119219 - RNA, 19 nt, Homo sapiens
gccaagcagcugguccuua

SEQ ID NO: 119220 - RNA, 19 nt, Homo sapiens
caaccagaccuuccauguc

SEQ ID NO: 119221 - RNA, 19 nt, Homo sapiens
cagacacgcuagguucuuc

SEQ ID NO: 119222 - RNA, 19 nt, Homo sapiens
cugacaacaucuucacuca

SEQ ID NO: 119223 - RNA, 19 nt, Homo sapiens
gggugguucuggagccauu

SEQ ID NO: 119224 - RNA, 19 nt, Homo sapiens
ugggccagcuguccugcua

SEQ ID NO: 119225 - RNA, 19 nt, Homo sapiens
agacucgccugaugaacuc

SEQ ID NO: 119226 - RNA, 19 nt, Homo sapiens
gcaggcggucucugucuuc

SEQ ID NO: 119227 - RNA, 19 nt, Homo sapiens
cagcaucuuccagcacuuu

SEQ ID NO: 119228 - RNA, 19 nt, Homo sapiens
cccacaccgugcucacuuu

SEQ ID NO: 119229 - RNA, 19 nt, Homo sapiens
ucacuuugucgccagcuuu

SEQ ID NO: 119230 - RNA, 19 nt, Homo sapiens
ggaugcagaacgacgugaa

SEQ ID NO: 119231 - RNA, 19 nt, Homo sapiens
ccgcagacuuggucaacgu

SEQ ID NO: 119232 - RNA, 19 nt, Homo sapiens
agacgcagcaggaggugaa

SEQ ID NO: 119233 - RNA, 19 nt, Homo sapiens
gggcuccgucagcgguuua

SEQ ID NO: 119234 - RNA, 19 nt, Homo sapiens
gcagcugggugggaugaac

SEQ ID NO: 119235 - RNA, 19 nt, Homo sapiens
gcagcaucuuccagcacuu

SEQ ID NO: 119236 - RNA, 19 nt, Homo sapiens
cugaagacucgccugauga

SEQ ID NO: 119237 - RNA, 19 nt, Homo sapiens
ugggugggaugaacaagca

SEQ ID NO: 119238 - RNA, 19 nt, Homo sapiens
gcuaccagaggcugauuuc

SEQ ID NO: 119239 - RNA, 19 nt, Homo sapiens
aagcaacgcagaccacaag

SEQ ID NO: 119240 - RNA, 19 nt, Homo sapiens
gaaggucccuggugaaauc

SEQ ID NO: 119241 - RNA, 19 nt, Homo sapiens
acgcagaccucaaugauga

SEQ ID NO: 119242 - RNA, 19 nt, Homo sapiens
agaaacaguugugcucuuu

SEQ ID NO: 119243 - RNA, 19 nt, Homo sapiens
caccaaagaugacuacuac

SEQ ID NO: 119244 - RNA, 19 nt, Homo sapiens
uaacaaggccaccaaagau

SEQ ID NO: 119245 - RNA, 19 nt, Homo sapiens
gaaauccaggugucaagaa

SEQ ID NO: 119246 - RNA, 19 nt, Homo sapiens
agccagaacugcagaagaa

SEQ ID NO: 119247 - RNA, 19 nt, Homo sapiens
uagcaucgccucccucuga

SEQ ID NO: 119248 - RNA, 19 nt, Homo sapiens
gaauuacuucuucgacgua

SEQ ID NO: 119249 - RNA, 19 nt, Homo sapiens
caaagaugacuacuacaga

SEQ ID NO: 119250 - RNA, 19 nt, Homo sapiens
caaggaggaggauaggaua

SEQ ID NO: 119251 - RNA, 19 nt, Homo sapiens
ggaggaggauaggauaauc

SEQ ID NO: 119252 - RNA, 19 nt, Homo sapiens
ggacaccugugccuuccau

SEQ ID NO: 119253 - RNA, 19 nt, Homo sapiens
ccaccaaagaugacuacua

SEQ ID NO: 119254 - RNA, 19 nt, Homo sapiens
ccaagagacagacagagaa

SEQ ID NO: 119255 - RNA, 19 nt, Homo sapiens
gccaagagacagacagaga

SEQ ID NO: 119256 - RNA, 19 nt, Homo sapiens
uaacgcagaccucaaugau

SEQ ID NO: 119257 - RNA, 19 nt, Homo sapiens
guugugcucuuucgagauc

SEQ ID NO: 119258 - RNA, 19 nt, Homo sapiens
cagaaggucccuggugaaa

SEQ ID NO: 119259 - RNA, 19 nt, Homo sapiens
cuccugcaauuaaacagua

SEQ ID NO: 119260 - RNA, 19 nt, Homo sapiens
ccaaggaggaggauaggau

SEQ ID NO: 119261 - RNA, 19 nt, Homo sapiens
aaauccaggugucaagaau

SEQ ID NO: 119262 - RNA, 19 nt, Homo sapiens
gcccuucacuucgccauca

SEQ ID NO: 119263 - RNA, 19 nt, Homo sapiens
ccaaagaugacuacuacag

SEQ ID NO: 119264 - RNA, 19 nt, Homo sapiens
acaaggccaccaaagauga

SEQ ID NO: 119265 - RNA, 19 nt, Homo sapiens
auaacaaggccaccaaaga

SEQ ID NO: 119266 - RNA, 19 nt, Homo sapiens
aaacaguugugcucuuucg

SEQ ID NO: 119267 - RNA, 19 nt, Homo sapiens
aggagaccauggcccagua

SEQ ID NO: 119268 - RNA, 19 nt, Homo sapiens
caucagcgaguauaacaag

SEQ ID NO: 119269 - RNA, 19 nt, Homo sapiens
ucuaauagcccugguacau

SEQ ID NO: 119270 - RNA, 19 nt, Homo sapiens
caagagacagacagagaag

SEQ ID NO: 119271 - RNA, 19 nt, Homo sapiens
ccaugugccugcgccaaga

SEQ ID NO: 119272 - RNA, 19 nt, Homo sapiens
guauaacaaggccaccaaa

SEQ ID NO: 119273 - RNA, 19 nt, Homo sapiens
gaccauggcccaguaucug

SEQ ID NO: 119274 - RNA, 19 nt, Homo sapiens
cuaagagccaggcaacaga

SEQ ID NO: 119275 - RNA, 19 nt, Homo sapiens
cuauaacgcagaccucaau

SEQ ID NO: 119276 - RNA, 19 nt, Homo sapiens
ccaggugucaagaauccua

SEQ ID NO: 119277 - RNA, 19 nt, Homo sapiens
cagaacugcagaagaaaca

SEQ ID NO: 119278 - RNA, 19 nt, Homo sapiens
gccaucagcgaguauaaca

SEQ ID NO: 119279 - RNA, 19 nt, Homo sapiens
cuaauagcccugguacaug

SEQ ID NO: 119280 - RNA, 19 nt, Homo sapiens
ggagaccauggcccaguau

SEQ ID NO: 119281 - RNA, 19 nt, Homo sapiens
caccugugccuuccaugaa

SEQ ID NO: 119282 - RNA, 19 nt, Homo sapiens
aaucccggguggcaucuau

SEQ ID NO: 119283 - RNA, 19 nt, Homo sapiens
gcgccaagagacagacaga

SEQ ID NO: 119284 - RNA, 19 nt, Homo sapiens
gaucugugccaggccauuc

SEQ ID NO: 119285 - RNA, 19 nt, Homo sapiens
ugaaauccaggugucaaga

SEQ ID NO: 119286 - RNA, 19 nt, Homo sapiens
gaauuacuucuucgacaua

SEQ ID NO: 119287 - RNA, 19 nt, Homo sapiens
agaaacaguugugcucuuu

SEQ ID NO: 119288 - RNA, 19 nt, Homo sapiens
uaacaaggccacugaagau

SEQ ID NO: 119289 - RNA, 19 nt, Homo sapiens
augcagaccucaaugauga

SEQ ID NO: 119290 - RNA, 19 nt, Homo sapiens
agccagaacugcagaagaa

SEQ ID NO: 119291 - RNA, 19 nt, Homo sapiens
gaggugggccgaaccauau

SEQ ID NO: 119292 - RNA, 19 nt, Homo sapiens
ccacugaagaugaguacua

SEQ ID NO: 119293 - RNA, 19 nt, Homo sapiens
caauuaaacaguagcauca

SEQ ID NO: 119294 - RNA, 19 nt, Homo sapiens
ggacaccugugccuuccau

SEQ ID NO: 119295 - RNA, 19 nt, Homo sapiens
aaucgaggguggcaucuau

SEQ ID NO: 119296 - RNA, 19 nt, Homo sapiens
ugaauuacuucuucgacau

SEQ ID NO: 119297 - RNA, 19 nt, Homo sapiens
cgaaccauauguaccaagu

SEQ ID NO: 119298 - RNA, 19 nt, Homo sapiens
gcccuucacuuugucauca

SEQ ID NO: 119299 - RNA, 19 nt, Homo sapiens
guugugcucuuuccagauc

SEQ ID NO: 119300 - RNA, 19 nt, Homo sapiens
caaggccacugaagaugag

SEQ ID NO: 119301 - RNA, 19 nt, Homo sapiens
ccaggaggaggacaggaua

SEQ ID NO: 119302 - RNA, 19 nt, Homo sapiens
gaugcagaccucaaugaug

SEQ ID NO: 119303 - RNA, 19 nt, Homo sapiens
cuccugcaauuaaacagua

SEQ ID NO: 119304 - RNA, 19 nt, Homo sapiens
caagaagccuagggaucug

SEQ ID NO: 119305 - RNA, 19 nt, Homo sapiens
ucaagaagccuagggaucu

SEQ ID NO: 119306 - RNA, 19 nt, Homo sapiens
gaauuccaggugucaagaa

SEQ ID NO: 119307 - RNA, 19 nt, Homo sapiens
gcaggaggccuuuguugcu

SEQ ID NO: 119308 - RNA, 19 nt, Homo sapiens
acaaggccacugaagauga

SEQ ID NO: 119309 - RNA, 19 nt, Homo sapiens
cagcgugcccuucacuuug

SEQ ID NO: 119310 - RNA, 19 nt, Homo sapiens
agaggugggccgaaccaua

SEQ ID NO: 119311 - RNA, 19 nt, Homo sapiens
gaggaggacaggauaaucg

SEQ ID NO: 119312 - RNA, 19 nt, Homo sapiens
caucagcgaguauaacaag

SEQ ID NO: 119313 - RNA, 19 nt, Homo sapiens
cagaaugucccuggugaau

SEQ ID NO: 119314 - RNA, 19 nt, Homo sapiens
ucacacugaccaccuccua

SEQ ID NO: 119315 - RNA, 19 nt, Homo sapiens
ugaagaugaguacuacaga

SEQ ID NO: 119316 - RNA, 19 nt, Homo sapiens
auaacaaggccacugaaga

SEQ ID NO: 119317 - RNA, 19 nt, Homo sapiens
ucucauagcccugguacau

SEQ ID NO: 119318 - RNA, 19 nt, Homo sapiens
cagaacugcagaagaaaca

SEQ ID NO: 119319 - RNA, 19 nt, Homo sapiens
ggaggaggacaggauaauc

SEQ ID NO: 119320 - RNA, 19 nt, Homo sapiens
aaacaguugugcucuuucc

SEQ ID NO: 119321 - RNA, 19 nt, Homo sapiens
acagcgugcccuucacuuu

SEQ ID NO: 119322 - RNA, 19 nt, Homo sapiens
ugcccucccuccuuccuuu

SEQ ID NO: 119323 - RNA, 19 nt, Homo sapiens
caccugugccuuccaugaa

SEQ ID NO: 119324 - RNA, 19 nt, Homo sapiens
caggaggaggacaggauaa

SEQ ID NO: 119325 - RNA, 19 nt, Homo sapiens
guauaacaaggccacugaa

SEQ ID NO: 119326 - RNA, 19 nt, Homo sapiens
cgaaccacguguaccaaga

SEQ ID NO: 119327 - RNA, 19 nt, Homo sapiens
caaugaccuugucgaaauc

SEQ ID NO: 119328 - RNA, 19 nt, Homo sapiens
ccaagacccagcccaacuu

SEQ ID NO: 119329 - RNA, 19 nt, Homo sapiens
ccaggagacagacagagaa

SEQ ID NO: 119330 - RNA, 19 nt, Homo sapiens
ugaccagccacaucugaaa

SEQ ID NO: 119331 - RNA, 19 nt, Homo sapiens
gcaccaggagacagacaga

SEQ ID NO: 119332 - RNA, 19 nt, Homo sapiens
cagcggguccucucuaucu

SEQ ID NO: 119333 - RNA, 19 nt, Homo sapiens
gugccuaucaccucuuaug

SEQ ID NO: 119334 - RNA, 19 nt, Homo sapiens
gaucguagcuggggugaac

SEQ ID NO: 119335 - RNA, 19 nt, Homo sapiens
cgucggcgaguacaacaaa

SEQ ID NO: 119336 - RNA, 19 nt, Homo sapiens
cugugccuaucaccucuua

SEQ ID NO: 119337 - RNA, 19 nt, Homo sapiens
caugaccagccacaucuga

SEQ ID NO: 119338 - RNA, 19 nt, Homo sapiens
gaaccacguguaccaagac

SEQ ID NO: 119339 - RNA, 19 nt, Homo sapiens
caaagccagcaacgacaug

SEQ ID NO: 119340 - RNA, 19 nt, Homo sapiens
ggcgugcacuggacuuugc

SEQ ID NO: 119341 - RNA, 19 nt, Homo sapiens
agaaacaguugugcucuuu

SEQ ID NO: 119342 - RNA, 19 nt, Homo sapiens
caacaaggccaccgaagau

SEQ ID NO: 119343 - RNA, 19 nt, Homo sapiens
augcagaccucaaugauga

SEQ ID NO: 119344 - RNA, 19 nt, Homo sapiens
agccagaacugcagaagaa

SEQ ID NO: 119345 - RNA, 19 nt, Homo sapiens
gaauuacuucuucgacgua

SEQ ID NO: 119346 - RNA, 19 nt, Homo sapiens
ggacaccugugccuuccau

SEQ ID NO: 119347 - RNA, 19 nt, Homo sapiens
caaggaggagaauaggaua

SEQ ID NO: 119348 - RNA, 19 nt, Homo sapiens
ggaggagaauaggauaauc

SEQ ID NO: 119349 - RNA, 19 nt, Homo sapiens
ccaagagacagacagagaa

SEQ ID NO: 119350 - RNA, 19 nt, Homo sapiens
gccaagagacagacagaga

SEQ ID NO: 119351 - RNA, 19 nt, Homo sapiens
guugugcucuuucgagauc

SEQ ID NO: 119352 - RNA, 19 nt, Homo sapiens
ccaccgaagaugaguacua

SEQ ID NO: 119353 - RNA, 19 nt, Homo sapiens
ccaaggaggagaauaggau

SEQ ID NO: 119354 - RNA, 19 nt, Homo sapiens
gaugcagaccucaaugaug

SEQ ID NO: 119355 - RNA, 19 nt, Homo sapiens
aaucccagguggcaucuau

SEQ ID NO: 119356 - RNA, 19 nt, Homo sapiens
cuccugcaauuaaacagua

SEQ ID NO: 119357 - RNA, 19 nt, Homo sapiens
gaauuccaggugucaagaa

SEQ ID NO: 119358 - RNA, 19 nt, Homo sapiens
gcccuucacuucgccauca

SEQ ID NO: 119359 - RNA, 19 nt, Homo sapiens
aaacaguugugcucuuucg

SEQ ID NO: 119360 - RNA, 19 nt, Homo sapiens
ccagggagcagaccuuugg

SEQ ID NO: 119361 - RNA, 19 nt, Homo sapiens
caccgaagaugaguacuac

SEQ ID NO: 119362 - RNA, 19 nt, Homo sapiens
acaacaaggccaccgaaga

SEQ ID NO: 119363 - RNA, 19 nt, Homo sapiens
ccaugugccugugccaaga

SEQ ID NO: 119364 - RNA, 19 nt, Homo sapiens
cgaagaugaguacuacaga

SEQ ID NO: 119365 - RNA, 19 nt, Homo sapiens
acaaggccaccgaagauga

SEQ ID NO: 119366 - RNA, 19 nt, Homo sapiens
cagaaugucccuggugaau

SEQ ID NO: 119367 - RNA, 19 nt, Homo sapiens
caagagacagacagagaag

SEQ ID NO: 119368 - RNA, 19 nt, Homo sapiens
cuaauagaccugguacaug

SEQ ID NO: 119369 - RNA, 19 nt, Homo sapiens
caucagcgaguacaacaag

SEQ ID NO: 119370 - RNA, 19 nt, Homo sapiens
cagaacugcagaagaaaca

SEQ ID NO: 119371 - RNA, 19 nt, Homo sapiens
caccugugccuuccaugaa

SEQ ID NO: 119372 - RNA, 19 nt, Homo sapiens
ccacagaccucaaugacaa

SEQ ID NO: 119373 - RNA, 19 nt, Homo sapiens
gaacuacuacuucaaugug

SEQ ID NO: 119374 - RNA, 19 nt, Homo sapiens
gaacuacaagugccggaaa

SEQ ID NO: 119375 - RNA, 19 nt, Homo sapiens
guacaacaaggucauuaau

SEQ ID NO: 119376 - RNA, 19 nt, Homo sapiens
gcagugugcccuggacuuu

SEQ ID NO: 119377 - RNA, 19 nt, Homo sapiens
acaacugucccuucaauga

SEQ ID NO: 119378 - RNA, 19 nt, Homo sapiens
gcucuuuccagaucaauga

SEQ ID NO: 119379 - RNA, 19 nt, Homo sapiens
uaauaaggaugaguacuac

SEQ ID NO: 119380 - RNA, 19 nt, Homo sapiens
acaaggucauuaauaagga

SEQ ID NO: 119381 - RNA, 19 nt, Homo sapiens
caacaaggucauuaauaag

SEQ ID NO: 119382 - RNA, 19 nt, Homo sapiens
gcugcugacugccuugaug

SEQ ID NO: 119383 - RNA, 19 nt, Homo sapiens
gaguacaacaaggucauua

SEQ ID NO: 119384 - RNA, 19 nt, Homo sapiens
ugacaagagugugcagugu

SEQ ID NO: 119385 - RNA, 19 nt, Homo sapiens
gcaaggccugucacacuga

SEQ ID NO: 119386 - RNA, 19 nt, Homo sapiens
caaggucauuaauaaggau

SEQ ID NO: 119387 - RNA, 19 nt, Homo sapiens
cgaaccacaugcaccaagu

SEQ ID NO: 119388 - RNA, 19 nt, Homo sapiens
gcccuggacuuugccauca

SEQ ID NO: 119389 - RNA, 19 nt, Homo sapiens
ggauaaaauuuccauucug

SEQ ID NO: 119390 - RNA, 19 nt, Homo sapiens
ugaaagaggaagaguucug

SEQ ID NO: 119391 - RNA, 19 nt, Homo sapiens
gugcaaggccugucacacu

SEQ ID NO: 119392 - RNA, 19 nt, Homo sapiens
caucagcgaguacaacaag

SEQ ID NO: 119393 - RNA, 19 nt, Homo sapiens
agaccucaaugacaagagu

SEQ ID NO: 119394 - RNA, 19 nt, Homo sapiens
acaagugccggaaagucua

SEQ ID NO: 119395 - RNA, 19 nt, Homo sapiens
gaaccacaugcaccaaguc

SEQ ID NO: 119396 - RNA, 19 nt, Homo sapiens
gaggauaaaauuuccauuc

SEQ ID NO: 119397 - RNA, 19 nt, Homo sapiens
acugaaagaggaagaguuc

SEQ ID NO: 119398 - RNA, 19 nt, Homo sapiens
caacugucccuucaaugac

SEQ ID NO: 119399 - RNA, 19 nt, Homo sapiens
ggccguaucugucacaaua

SEQ ID NO: 119400 - RNA, 19 nt, Homo sapiens
gaacuccucucagcuccua

SEQ ID NO: 119401 - RNA, 19 nt, Homo sapiens
gcaacagcaucuacuacuu

SEQ ID NO: 119402 - RNA, 19 nt, Homo sapiens
gaagcugcgcugugacuuu

SEQ ID NO: 119403 - RNA, 19 nt, Homo sapiens
ccucucagcuccuaaagca

SEQ ID NO: 119404 - RNA, 19 nt, Homo sapiens
caacagcaucuacuacuuc

SEQ ID NO: 119405 - RNA, 19 nt, Homo sapiens
gcagcaacagcaucuacua

SEQ ID NO: 119406 - RNA, 19 nt, Homo sapiens
aggagaagcugcgcuguga

SEQ ID NO: 119407 - RNA, 19 nt, Homo sapiens
ucaaguacuuccugacgau

SEQ ID NO: 119408 - RNA, 19 nt, Homo sapiens
ccguaucugucacaauaaa

SEQ ID NO: 119409 - RNA, 19 nt, Homo sapiens
aagcugcgcugugacuuug

SEQ ID NO: 119410 - RNA, 19 nt, Homo sapiens
gagacacgcacaucaucaa

SEQ ID NO: 119411 - RNA, 19 nt, Homo sapiens
ggcgaaggccauuggguuu

SEQ ID NO: 119412 - RNA, 19 nt, Homo sapiens
guaucugucacaauaaaug

SEQ ID NO: 119413 - RNA, 19 nt, Homo sapiens
gcuacaacaugggcagcaa

SEQ ID NO: 119414 - RNA, 19 nt, Homo sapiens
cagugcugcuucuugcaaa

SEQ ID NO: 119415 - RNA, 19 nt, Homo sapiens
cgaaggccauuggguuugg

SEQ ID NO: 119416 - RNA, 19 nt, Homo sapiens
acaacugugugcagaugug

SEQ ID NO: 119417 - RNA, 19 nt, Homo sapiens
gagaagcugcgcugugacu

SEQ ID NO: 119418 - RNA, 19 nt, Homo sapiens
gcgaaggccauuggguuug

SEQ ID NO: 119419 - RNA, 19 nt, Homo sapiens
gcuccuaaagcacaacugu

SEQ ID NO: 119420 - RNA, 19 nt, Homo sapiens
cgagacacgcacaucauca

SEQ ID NO: 119421 - RNA, 19 nt, Homo sapiens
ccagugcugcuucuugcaa

SEQ ID NO: 119422 - RNA, 19 nt, Homo sapiens
gauccuugcugauaaauau

SEQ ID NO: 119423 - RNA, 19 nt, Homo sapiens
aaugauaccuggaggcuua

SEQ ID NO: 119424 - RNA, 19 nt, Homo sapiens
caaaugagacuuauggaaa

SEQ ID NO: 119425 - RNA, 19 nt, Homo sapiens
gagcaggugauaauaaaua

SEQ ID NO: 119426 - RNA, 19 nt, Homo sapiens
ggagauuguugauaagguu

SEQ ID NO: 119427 - RNA, 19 nt, Homo sapiens
uggaagcugugcaguauaa

SEQ ID NO: 119428 - RNA, 19 nt, Homo sapiens
aaugaggacuugguacuua

SEQ ID NO: 119429 - RNA, 19 nt, Homo sapiens
uccaggagauuguugauaa

SEQ ID NO: 119430 - RNA, 19 nt, Homo sapiens
ucaugauccuugcugauaa

SEQ ID NO: 119431 - RNA, 19 nt, Homo sapiens
caugauccuugcugauaaa

SEQ ID NO: 119432 - RNA, 19 nt, Homo sapiens
ucaacuggcuacugaguca

SEQ ID NO: 119433 - RNA, 19 nt, Homo sapiens
aaacaaaugagacuuaugg

SEQ ID NO: 119434 - RNA, 19 nt, Homo sapiens
acgagcaggugauaauaaa

SEQ ID NO: 119435 - RNA, 19 nt, Homo sapiens
gcauguacccaaaguguuc

SEQ ID NO: 119436 - RNA, 19 nt, Homo sapiens
guacgagcaggugauaaua

SEQ ID NO: 119437 - RNA, 19 nt, Homo sapiens
gagauuguugauaagguua

SEQ ID NO: 119438 - RNA, 19 nt, Homo sapiens
uacccaaaguguucugauu

SEQ ID NO: 119439 - RNA, 19 nt, Homo sapiens
gucaugauccuugcugaua

SEQ ID NO: 119440 - RNA, 19 nt, Homo sapiens
gguacgagcaggugauaau

SEQ ID NO: 119441 - RNA, 19 nt, Homo sapiens
caaaguguucugauuccuu

SEQ ID NO: 119442 - RNA, 19 nt, Homo sapiens
aaccacagcuugaagaaaa

SEQ ID NO: 119443 - RNA, 19 nt, Homo sapiens
gaagcaaucagccaaaaug

SEQ ID NO: 119444 - RNA, 19 nt, Homo sapiens
acaaaugagacuuauggaa

SEQ ID NO: 119445 - RNA, 19 nt, Homo sapiens
uaaaccacagcuugaagaa

SEQ ID NO: 119446 - RNA, 19 nt, Homo sapiens
aggcuuaucugaggccaaa

SEQ ID NO: 119447 - RNA, 19 nt, Homo sapiens
cagcauguacccaaagugu

SEQ ID NO: 119448 - RNA, 19 nt, Homo sapiens
ccaggagauuguugauaag

SEQ ID NO: 119449 - RNA, 19 nt, Homo sapiens
aaagaagcaaucagccaaa

SEQ ID NO: 119450 - RNA, 19 nt, Homo sapiens
caaacccgccacuccagaa

SEQ ID NO: 119451 - RNA, 19 nt, Homo sapiens
uacgagcaggugauaauaa

SEQ ID NO: 119452 - RNA, 19 nt, Homo sapiens
auuggaagcugugcaguau

SEQ ID NO: 119453 - RNA, 19 nt, Homo sapiens
uuaaaccacagcuugaaga

SEQ ID NO: 119454 - RNA, 19 nt, Homo sapiens
cauccuguccagcaaagaa

SEQ ID NO: 119455 - RNA, 19 nt, Homo sapiens
ccagcauccuguccagcaa

SEQ ID NO: 119456 - RNA, 19 nt, Homo sapiens
uuagcagcauguacccaaa

SEQ ID NO: 119457 - RNA, 19 nt, Homo sapiens
caucaauaaagaagcauuc

SEQ ID NO: 119458 - RNA, 19 nt, Homo sapiens
acuugguacuuacuggaua

SEQ ID NO: 119459 - RNA, 19 nt, Homo sapiens
aaccaucaauaaagaagca

SEQ ID NO: 119460 - RNA, 19 nt, Homo sapiens
uccuucaacuggcuacuga

SEQ ID NO: 119461 - RNA, 19 nt, Homo sapiens
gaagcugugcaguauaaaa

SEQ ID NO: 119462 - RNA, 19 nt, Homo sapiens
aaaccacagcuugaagaaa

SEQ ID NO: 119463 - RNA, 19 nt, Homo sapiens
guucugauuccuucaacug

SEQ ID NO: 119464 - RNA, 19 nt, Homo sapiens
aauuggaagcugugcagua

SEQ ID NO: 119465 - RNA, 19 nt, Homo sapiens
augaugagcugaccuauuu

SEQ ID NO: 119466 - RNA, 19 nt, Homo sapiens
ggucccagcuugaagagaa

SEQ ID NO: 119467 - RNA, 19 nt, Homo sapiens
gaaguucccuguguuuaag

SEQ ID NO: 119468 - RNA, 19 nt, Homo sapiens
gagcugaccuauuucugau

SEQ ID NO: 119469 - RNA, 19 nt, Homo sapiens
cccaauaggugaucuuaau

SEQ ID NO: 119470 - RNA, 19 nt, Homo sapiens
gggacaaacuacuucauca

SEQ ID NO: 119471 - RNA, 19 nt, Homo sapiens
caagaaguucccuguguuu

SEQ ID NO: 119472 - RNA, 19 nt, Homo sapiens
caacaaagccaagcaugau

SEQ ID NO: 119473 - RNA, 19 nt, Homo sapiens
caaacuacuucaucaaggu

SEQ ID NO: 119474 - RNA, 19 nt, Homo sapiens
ggacaaacuacuucaucaa

SEQ ID NO: 119475 - RNA, 19 nt, Homo sapiens
acaagaaguucccuguguu

SEQ ID NO: 119476 - RNA, 19 nt, Homo sapiens
uccaaucucucccucauga

SEQ ID NO: 119477 - RNA, 19 nt, Homo sapiens
ccaacaaagccaagcauga

SEQ ID NO: 119478 - RNA, 19 nt, Homo sapiens
agaaguucccuguguuuaa

SEQ ID NO: 119479 - RNA, 19 nt, Homo sapiens
aacaagaaguucccugugu

SEQ ID NO: 119480 - RNA, 19 nt, Homo sapiens
ccaauaggugaucuuaauu

SEQ ID NO: 119481 - RNA, 19 nt, Homo sapiens
gccagaagacugacaaagu

SEQ ID NO: 119482 - RNA, 19 nt, Homo sapiens
gauccugacuuuggacaag

SEQ ID NO: 119483 - RNA, 19 nt, Homo sapiens
caaucucucccucaugaaa

SEQ ID NO: 119484 - RNA, 19 nt, Homo sapiens
uugcauuucucuuccuaaa

SEQ ID NO: 119485 - RNA, 19 nt, Homo sapiens
gacaaacuacuucaucaag

SEQ ID NO: 119486 - RNA, 19 nt, Homo sapiens
ugagcugaccuauuucuga

SEQ ID NO: 119487 - RNA, 19 nt, Homo sapiens
acaaagccaagcaugauga

SEQ ID NO: 119488 - RNA, 19 nt, Homo sapiens
uuaaggccgugucauucaa

SEQ ID NO: 119489 - RNA, 19 nt, Homo sapiens
caaagucauccuccgucua

SEQ ID NO: 119490 - RNA, 19 nt, Homo sapiens
uaacuaccagaccaacaaa

SEQ ID NO: 119491 - RNA, 19 nt, Homo sapiens
gaagagaaagaaaacaaga

SEQ ID NO: 119492 - RNA, 19 nt, Homo sapiens
gugcacuugugauccuaaa

SEQ ID NO: 119493 - RNA, 19 nt, Homo sapiens
ccagagcgugcacuuguga

SEQ ID NO: 119494 - RNA, 19 nt, Homo sapiens
cuaacuaccagaccaacaa

SEQ ID NO: 119495 - RNA, 19 nt, Homo sapiens
aagaaguucccuguguuua

SEQ ID NO: 119496 - RNA, 19 nt, Homo sapiens
uauuucugauccugacuuu

SEQ ID NO: 119497 - RNA, 19 nt, Homo sapiens
cuuccuaaauuucauugug

SEQ ID NO: 119498 - RNA, 19 nt, Homo sapiens
caugaugagcugaccuauu

SEQ ID NO: 119499 - RNA, 19 nt, Homo sapiens
guuccaaucucucccucau

SEQ ID NO: 119500 - RNA, 19 nt, Homo sapiens
uuucuuuccuucccaauag

SEQ ID NO: 119501 - RNA, 19 nt, Homo sapiens
uaccagagcgugcacuugu

SEQ ID NO: 119502 - RNA, 19 nt, Homo sapiens
ggugaggucccagcuugaa

SEQ ID NO: 119503 - RNA, 19 nt, Homo sapiens
aaagucauccuccgucuac

SEQ ID NO: 119504 - RNA, 19 nt, Homo sapiens
gaaagaaaacaagaaguuc

SEQ ID NO: 119505 - RNA, 19 nt, Homo sapiens
gaugagcugaccuauuucu

SEQ ID NO: 119506 - RNA, 19 nt, Homo sapiens
cagcuugaagagaaagaaa

SEQ ID NO: 119507 - RNA, 19 nt, Homo sapiens
uguuuaaggccgugucauu

SEQ ID NO: 119508 - RNA, 19 nt, Homo sapiens
ugaggucccagcuugaaga

SEQ ID NO: 119509 - RNA, 19 nt, Homo sapiens
gcacuugugauccuaaaau

SEQ ID NO: 119510 - RNA, 19 nt, Homo sapiens
cccuugaccuuaucuaacu

SEQ ID NO: 119511 - RNA, 19 nt, Homo sapiens
gucccagcuugaagagaaa

SEQ ID NO: 119512 - RNA, 19 nt, Homo sapiens
ggagaaaccugcugucguu

SEQ ID NO: 119513 - RNA, 19 nt, Homo sapiens
ggauugaccuggaauuuga

SEQ ID NO: 119514 - RNA, 19 nt, Homo sapiens
gaaggaggauagggcauua

SEQ ID NO: 119515 - RNA, 19 nt, Homo sapiens
gacgaacacuggucagaua

SEQ ID NO: 119516 - RNA, 19 nt, Homo sapiens
uaguagagauggacaguua

SEQ ID NO: 119517 - RNA, 19 nt, Homo sapiens
gaugcuauauguuccguua

SEQ ID NO: 119518 - RNA, 19 nt, Homo sapiens
ggaauuugaugcagauguu

SEQ ID NO: 119519 - RNA, 19 nt, Homo sapiens
ggacggcugcaucaaauua

SEQ ID NO: 119520 - RNA, 19 nt, Homo sapiens
gcaauuggucguucagaua

SEQ ID NO: 119521 - RNA, 19 nt, Homo sapiens
guacaggacuugccguuuc

SEQ ID NO: 119522 - RNA, 19 nt, Homo sapiens
guucuacauucacugauua

SEQ ID NO: 119523 - RNA, 19 nt, Homo sapiens
ucaaaucgaugcaucacaa

SEQ ID NO: 119524 - RNA, 19 nt, Homo sapiens
uaaagauacuugacacaga

SEQ ID NO: 119525 - RNA, 19 nt, Homo sapiens
gaaccaaagugggcuugaa

SEQ ID NO: 119526 - RNA, 19 nt, Homo sapiens
gaaguuuguucugccauuu

SEQ ID NO: 119527 - RNA, 19 nt, Homo sapiens
ucaagggauuauacucuua

SEQ ID NO: 119528 - RNA, 19 nt, Homo sapiens
gauggacaguuaauagcua

SEQ ID NO: 119529 - RNA, 19 nt, Homo sapiens
ccacauucuucuuggauuu

SEQ ID NO: 119530 - RNA, 19 nt, Homo sapiens
cuaaauacauucucucaag

SEQ ID NO: 119531 - RNA, 19 nt, Homo sapiens
ggagagagcgggauaccaa

SEQ ID NO: 119532 - RNA, 19 nt, Homo sapiens
gaagucacgugccuugcuu

SEQ ID NO: 119533 - RNA, 19 nt, Homo sapiens
gauccuggcuucugguuca

SEQ ID NO: 119534 - RNA, 19 nt, Homo sapiens
ugucucagcugcagucgua

SEQ ID NO: 119535 - RNA, 19 nt, Homo sapiens
gaacucagcauccuacucu

SEQ ID NO: 119536 - RNA, 19 nt, Homo sapiens
ggagugggaccgaucgaua

SEQ ID NO: 119537 - RNA, 19 nt, Homo sapiens
gugcagcgaugacuucaga

SEQ ID NO: 119538 - RNA, 19 nt, Homo sapiens
gagaggacgaucagucuuu

SEQ ID NO: 119539 - RNA, 19 nt, Homo sapiens
gcuaaacuuugggaaauau

SEQ ID NO: 119540 - RNA, 19 nt, Homo sapiens
acacaccgaugcuauaugu

SEQ ID NO: 119541 - RNA, 19 nt, Homo sapiens
gcaguucaguaugcaauug

SEQ ID NO: 119542 - RNA, 19 nt, Homo sapiens
gcugaugcuucgauaaaga

SEQ ID NO: 119543 - RNA, 19 nt, Homo sapiens
uaaaggaccaugccgugua

SEQ ID NO: 119544 - RNA, 19 nt, Homo sapiens
gaaaagacucuguagcuaa

SEQ ID NO: 119545 - RNA, 19 nt, Homo sapiens
ggaaaagacucuguagcua

SEQ ID NO: 119546 - RNA, 19 nt, Homo sapiens
ugacggugcugaaguuugu

SEQ ID NO: 119547 - RNA, 19 nt, Homo sapiens
gaaugagaccgcacaacaa

SEQ ID NO: 119548 - RNA, 19 nt, Homo sapiens
ucuacaagcugaucauuag

SEQ ID NO: 119549 - RNA, 19 nt, Homo sapiens
gaggauagggcauuaaagu

SEQ ID NO: 119550 - RNA, 19 nt, Homo sapiens
uagcuaaacuuugggaaau

SEQ ID NO: 119551 - RNA, 19 nt, Homo sapiens
caucacaacuuuugagaaa

SEQ ID NO: 119552 - RNA, 19 nt, Homo sapiens
uaucaacaccuuucaaugu

SEQ ID NO: 119553 - RNA, 19 nt, Homo sapiens
caaggacggcugcaucaaa

SEQ ID NO: 119554 - RNA, 19 nt, Homo sapiens
gcuccugcaucucaucaaa

SEQ ID NO: 119555 - RNA, 19 nt, Homo sapiens
gauaucaacaccuuucaau

SEQ ID NO: 119556 - RNA, 19 nt, Homo sapiens
acucuucgccuuuaugaua

SEQ ID NO: 119557 - RNA, 19 nt, Homo sapiens
gcuauauguuccguuaauu

SEQ ID NO: 119558 - RNA, 19 nt, Homo sapiens
uacauucucucaaguggaa

SEQ ID NO: 119559 - RNA, 19 nt, Homo sapiens
ucuggagacuuuauacuug

SEQ ID NO: 119560 - RNA, 19 nt, Homo sapiens
caaauuaugggaugguguu

SEQ ID NO: 119561 - RNA, 19 nt, Homo sapiens
ccagugauucgaacucuuu

SEQ ID NO: 119562 - RNA, 19 nt, Homo sapiens
aaagugccaugccaauaga

SEQ ID NO: 119563 - RNA, 19 nt, Homo sapiens
caagggauuauacucuuaa

SEQ ID NO: 119564 - RNA, 19 nt, Homo sapiens
caacacaccgaugcuauau

SEQ ID NO: 119565 - RNA, 19 nt, Homo sapiens
ucaacacaccgaugcuaua

SEQ ID NO: 119566 - RNA, 19 nt, Homo sapiens
gcugaaauguuacguucca

SEQ ID NO: 119567 - RNA, 19 nt, Homo sapiens
ugaaguuuguucugccauu

SEQ ID NO: 119568 - RNA, 19 nt, Homo sapiens
gccaauagaggucaugaug

SEQ ID NO: 119569 - RNA, 19 nt, Homo sapiens
caagauguacagaaccaaa

SEQ ID NO: 119570 - RNA, 19 nt, Homo sapiens
gaucaacacaccgaugcua

SEQ ID NO: 119571 - RNA, 19 nt, Homo sapiens
gaaauguuacguuccaucu

SEQ ID NO: 119572 - RNA, 19 nt, Homo sapiens
ugacaccgcaguucaguau

SEQ ID NO: 119573 - RNA, 19 nt, Homo sapiens
aaaagacucuguagcuaaa

SEQ ID NO: 119574 - RNA, 19 nt, Homo sapiens
gggaugguguuucaaaucg

SEQ ID NO: 119575 - RNA, 19 nt, Homo sapiens
ugaaugagaccgcacaaca

SEQ ID NO: 119576 - RNA, 19 nt, Homo sapiens
augcagauguucagacuau

SEQ ID NO: 119577 - RNA, 19 nt, Homo sapiens
guagcuaaacuuugggaaa

SEQ ID NO: 119578 - RNA, 19 nt, Homo sapiens
acaugacggugcugaaguu

SEQ ID NO: 119579 - RNA, 19 nt, Homo sapiens
gaugguguuucaaaucgau

SEQ ID NO: 119580 - RNA, 19 nt, Homo sapiens
aaagagccuucaaauacau

SEQ ID NO: 119581 - RNA, 19 nt, Homo sapiens
caucaaacucggaauggaa

SEQ ID NO: 119582 - RNA, 19 nt, Homo sapiens
aaggacggcugcaucaaau

SEQ ID NO: 119583 - RNA, 19 nt, Homo sapiens
gaagcugaaauguuacguu

SEQ ID NO: 119584 - RNA, 19 nt, Homo sapiens
gcagauguucagacuaugu

SEQ ID NO: 119585 - RNA, 19 nt, Homo sapiens
gagaucgaccacugacuga

SEQ ID NO: 119586 - RNA, 19 nt, Homo sapiens
aaugagaccgcacaacaaa

SEQ ID NO: 119587 - RNA, 19 nt, Homo sapiens
aaaggaccaugccguguag

SEQ ID NO: 119588 - RNA, 19 nt, Homo sapiens
gggauugaccuggaauuug

SEQ ID NO: 119589 - RNA, 19 nt, Homo sapiens
gcaccauccuugacguuuu

SEQ ID NO: 119590 - RNA, 19 nt, Homo sapiens
gaacacuggucagauacac

SEQ ID NO: 119591 - RNA, 19 nt, Homo sapiens
gauucgaacucuuuaugac

SEQ ID NO: 119592 - RNA, 19 nt, Homo sapiens
ggaaaaccacccagugauu

SEQ ID NO: 119593 - RNA, 19 nt, Homo sapiens
ggacagccgagcggagaaa

SEQ ID NO: 119594 - RNA, 19 nt, Homo sapiens
ggacgaacacuggucagau

SEQ ID NO: 119595 - RNA, 19 nt, Homo sapiens
ucacgugccuugcuuucca

SEQ ID NO: 119596 - RNA, 19 nt, Homo sapiens
aaaucaagccucagucugu

SEQ ID NO: 119597 - RNA, 19 nt, Homo sapiens
acaauucuagugccaauau

SEQ ID NO: 119598 - RNA, 19 nt, Homo sapiens
uuacaauucuagugccaau

SEQ ID NO: 119599 - RNA, 19 nt, Homo sapiens
gagaggauguuggccaaaa

SEQ ID NO: 119600 - RNA, 19 nt, Homo sapiens
guagagauggacaguuaau

SEQ ID NO: 119601 - RNA, 19 nt, Homo sapiens
ggaccaugccguguagcua

SEQ ID NO: 119602 - RNA, 19 nt, Homo sapiens
gaucugugcaguucuacau

SEQ ID NO: 119603 - RNA, 19 nt, Homo sapiens
ugccaccucuguccacauu

SEQ ID NO: 119604 - RNA, 19 nt, Homo sapiens
gccaauauguacguaacug

SEQ ID NO: 119605 - RNA, 19 nt, Homo sapiens
gauaaagauacuugacaca

SEQ ID NO: 119606 - RNA, 19 nt, Homo sapiens
ccaaagugggcuugaagga

SEQ ID NO: 119607 - RNA, 19 nt, Homo sapiens
aaaagagccuucaaauaca

SEQ ID NO: 119608 - RNA, 19 nt, Homo sapiens
gcuacugggucugcugaug

SEQ ID NO: 119609 - RNA, 19 nt, Homo sapiens
agagauggacaguuaauag

SEQ ID NO: 119610 - RNA, 19 nt, Homo sapiens
ggacuugccguuucuuuug

SEQ ID NO: 119611 - RNA, 19 nt, Homo sapiens
guagaaucaugguggaaaa

SEQ ID NO: 119612 - RNA, 19 nt, Homo sapiens
gauggaagcucgugcaaug

SEQ ID NO: 119613 - RNA, 19 nt, Homo sapiens
ugagaaggcugcuuugauu

SEQ ID NO: 119614 - RNA, 19 nt, Homo sapiens
ggacaaugcugccagugaa

SEQ ID NO: 119615 - RNA, 19 nt, Homo sapiens
gaacauuccuuaugaagcu

SEQ ID NO: 119616 - RNA, 19 nt, Homo sapiens
gauccaaugugucaaugaa

SEQ ID NO: 119617 - RNA, 19 nt, Homo sapiens
ggcaagaaaucuggaaauu

SEQ ID NO: 119618 - RNA, 19 nt, Homo sapiens
caggaaagccaaaggguua

SEQ ID NO: 119619 - RNA, 19 nt, Homo sapiens
gcacggaacauguuacuuc

SEQ ID NO: 119620 - RNA, 19 nt, Homo sapiens
ucaacuggcuuaugcuuug

SEQ ID NO: 119621 - RNA, 19 nt, Homo sapiens
gguuauggcuucugugaau

SEQ ID NO: 119622 - RNA, 19 nt, Homo sapiens
gagaaggcugcuuugauua

SEQ ID NO: 119623 - RNA, 19 nt, Homo sapiens
gaaggcugcuuugauuaug

SEQ ID NO: 119624 - RNA, 19 nt, Homo sapiens
gaacaaagaagagcugaag

SEQ ID NO: 119625 - RNA, 19 nt, Homo sapiens
cauccuaacccuugaauga

SEQ ID NO: 119626 - RNA, 19 nt, Homo sapiens
gaacaaauacagaaaucca

SEQ ID NO: 119627 - RNA, 19 nt, Homo sapiens
ccaagucacuccacaggau

SEQ ID NO: 119628 - RNA, 19 nt, Homo sapiens
ggaccuauaccuaguggaa

SEQ ID NO: 119629 - RNA, 19 nt, Homo sapiens
gcacagguagugaugagaa

SEQ ID NO: 119630 - RNA, 19 nt, Homo sapiens
gagcugaugaaacaaauga

SEQ ID NO: 119631 - RNA, 19 nt, Homo sapiens
caccagagcagauguuuga

SEQ ID NO: 119632 - RNA, 19 nt, Homo sapiens
gcaguugaaggacaucuuu

SEQ ID NO: 119633 - RNA, 19 nt, Homo sapiens
gcaagaaaucuggaaauuc

SEQ ID NO: 119634 - RNA, 19 nt, Homo sapiens
gggaggcacuuuacuuucu

SEQ ID NO: 119635 - RNA, 19 nt, Homo sapiens
cggaacauguuacuucaga

SEQ ID NO: 119636 - RNA, 19 nt, Homo sapiens
cugcaucgccagacaaaua

SEQ ID NO: 119637 - RNA, 19 nt, Homo sapiens
cagggucccaguccaauua

SEQ ID NO: 119638 - RNA, 19 nt, Homo sapiens
guuagaugccagaggauua

SEQ ID NO: 119639 - RNA, 19 nt, Homo sapiens
gcagauguuugagcugaug

SEQ ID NO: 119640 - RNA, 19 nt, Homo sapiens
ggaaugcaaggagcaagua

SEQ ID NO: 119641 - RNA, 19 nt, Homo sapiens
gcagggaacaggaaugcaa

SEQ ID NO: 119642 - RNA, 19 nt, Homo sapiens
gaggacccaugcuagauca

SEQ ID NO: 119643 - RNA, 19 nt, Homo sapiens
caagaggacccaugcuaga

SEQ ID NO: 119644 - RNA, 19 nt, Homo sapiens
acagagcuauggcggguuu

SEQ ID NO: 119645 - RNA, 19 nt, Homo sapiens
ggaggcacggaacauguua

SEQ ID NO: 119646 - RNA, 19 nt, Homo sapiens
gguauacgauagagagaca

SEQ ID NO: 119647 - RNA, 19 nt, Homo sapiens
gcaaggagcaaguauacag

SEQ ID NO: 119648 - RNA, 19 nt, Homo sapiens
ggaacauguuacuucagaa

SEQ ID NO: 119649 - RNA, 19 nt, Homo sapiens
ggaggcccgugcaauggaa

SEQ ID NO: 119650 - RNA, 19 nt, Homo sapiens
gauggaggcccgugcaaug

SEQ ID NO: 119651 - RNA, 19 nt, Homo sapiens
gguuggaccuguuguuagu

SEQ ID NO: 119652 - RNA, 19 nt, Homo sapiens
cagaccagauugccauguu

SEQ ID NO: 119653 - RNA, 19 nt, Homo sapiens
ggacaucuuuucugagguu

SEQ ID NO: 119654 - RNA, 19 nt, Homo sapiens
ugaaggacaucuuuucuga

SEQ ID NO: 119655 - RNA, 19 nt, Homo sapiens
guggaucguucucuacguu

SEQ ID NO: 119656 - RNA, 19 nt, Homo sapiens
guuauggcuucugugaaua

SEQ ID NO: 119657 - RNA, 19 nt, Homo sapiens
ccacuggagcaccuugaua

SEQ ID NO: 119658 - RNA, 19 nt, Homo sapiens
gcaagcacagguagugaug

SEQ ID NO: 119659 - RNA, 19 nt, Homo sapiens
gaccaagagacagcacuua

SEQ ID NO: 119660 - RNA, 19 nt, Homo sapiens
cagaguauccugauuuuaa

SEQ ID NO: 119661 - RNA, 19 nt, Homo sapiens
cagaggaccuauaccuagu

SEQ ID NO: 119662 - RNA, 19 nt, Homo sapiens
ggaggcacuuuacuuucug

SEQ ID NO: 119663 - RNA, 19 nt, Homo sapiens
gauccuugccugcgaaugu

SEQ ID NO: 119664 - RNA, 19 nt, Homo sapiens
guuguuaguuucagauugg

SEQ ID NO: 119665 - RNA, 19 nt, Homo sapiens
gcaaguauacaggguggaa

SEQ ID NO: 119666 - RNA, 19 nt, Homo sapiens
gaacauguuacuucagaac

SEQ ID NO: 119667 - RNA, 19 nt, Homo sapiens
ucagauugguauacgauag

SEQ ID NO: 119668 - RNA, 19 nt, Homo sapiens
cugaagagcaguugaagga

SEQ ID NO: 119669 - RNA, 19 nt, Homo sapiens
cccaucaccuucucucaga

SEQ ID NO: 119670 - RNA, 19 nt, Homo sapiens
gagcaaaggcagaguaucc

SEQ ID NO: 119671 - RNA, 19 nt, Homo sapiens
ucaaugaaccagcagaauc

SEQ ID NO: 119672 - RNA, 19 nt, Homo sapiens
gugaauaccaagaccaaga

SEQ ID NO: 119673 - RNA, 19 nt, Homo sapiens
uuaugaagcuacugaagag

SEQ ID NO: 119674 - RNA, 19 nt, Homo sapiens
ccagacaggucccagucau

SEQ ID NO: 119675 - RNA, 19 nt, Homo sapiens
cauggaggcaagaggguua

SEQ ID NO: 119676 - RNA, 19 nt, Homo sapiens
ucuaauggcagaaccaaga

SEQ ID NO: 119677 - RNA, 19 nt, Homo sapiens
ggacucccaucaccuucuc

SEQ ID NO: 119678 - RNA, 19 nt, Homo sapiens
gguagagccuagagguuac

SEQ ID NO: 119679 - RNA, 19 nt, Homo sapiens
gucauugagucaccuuaug

SEQ ID NO: 119680 - RNA, 19 nt, Homo sapiens
gaacacaauuuuaguacac

SEQ ID NO: 119681 - RNA, 19 nt, Homo sapiens
gcagggucccaguccaauu

SEQ ID NO: 119682 - RNA, 19 nt, Homo sapiens
uggcgcaccuccucugaug

SEQ ID NO: 119683 - RNA, 19 nt, Homo sapiens
cacggaacauguuacuuca

SEQ ID NO: 119684 - RNA, 19 nt, Homo sapiens
agaaggcugcuuugauuau

SEQ ID NO: 119685 - RNA, 19 nt, Homo sapiens
gaggcaagaggguuagaug

SEQ ID NO: 119686 - RNA, 19 nt, Homo sapiens
gagcccagaccucuaaugg

SEQ ID NO: 119687 - RNA, 19 nt, Homo sapiens
aggaacaaauacagaaauc

SEQ ID NO: 119688 - RNA, 19 nt, Homo sapiens
aggcagaguauccugauuu

SEQ ID NO: 119689 - RNA, 19 nt, Homo sapiens
agaccagauugccauguug

SEQ ID NO: 119690 - RNA, 19 nt, Homo sapiens
gagguagagccuagagguu

SEQ ID NO: 119691 - RNA, 19 nt, Homo sapiens
aaaggguuauggcuucugu

SEQ ID NO: 119692 - RNA, 19 nt, Homo sapiens
gauuaugcagguucuacaa

SEQ ID NO: 119693 - RNA, 19 nt, Homo sapiens
ucacuccacaggaucauga

SEQ ID NO: 119694 - RNA, 19 nt, Homo sapiens
gaaugcaaggagcaaguau

SEQ ID NO: 119695 - RNA, 19 nt, Homo sapiens
gaggccagaggcauggaua

SEQ ID NO: 119696 - RNA, 19 nt, Homo sapiens
agguagagccuagagguua

SEQ ID NO: 119697 - RNA, 19 nt, Homo sapiens
gacaaugcugccagugaaa

SEQ ID NO: 119698 - RNA, 19 nt, Homo sapiens
gaauuguggauccggaaau

SEQ ID NO: 119699 - RNA, 19 nt, Homo sapiens
uuggaccuguuguuaguuu

SEQ ID NO: 119700 - RNA, 19 nt, Homo sapiens
ggcagaguauccugauuuu

SEQ ID NO: 119701 - RNA, 19 nt, Homo sapiens
ccaagagacagcacuuagu

SEQ ID NO: 119702 - RNA, 19 nt, Homo sapiens
uggcuucugugaauaccaa

SEQ ID NO: 119703 - RNA, 19 nt, Homo sapiens
uucuguaacuggagaggua

SEQ ID NO: 119704 - RNA, 19 nt, Homo sapiens
ggaccuguuguuaguuuca

SEQ ID NO: 119705 - RNA, 19 nt, Homo sapiens
ggacccaugcuagaucaga

SEQ ID NO: 119706 - RNA, 19 nt, Homo sapiens
ggaaagccaaaggguuaug

SEQ ID NO: 119707 - RNA, 19 nt, Homo sapiens
cagguagugaugagaauug

SEQ ID NO: 119708 - RNA, 19 nt, Homo sapiens
acaaagaagagcugaagag

SEQ ID NO: 119709 - RNA, 19 nt, Homo sapiens
gaauaccaagaccaagaga

SEQ ID NO: 119710 - RNA, 19 nt, Homo sapiens
gagagacaggaaagccaaa

SEQ ID NO: 119711 - RNA, 19 nt, Homo sapiens
cuuaugaagcuacugaaga

SEQ ID NO: 119712 - RNA, 19 nt, Homo sapiens
ggacaaaucuguugccuuu

SEQ ID NO: 119713 - RNA, 19 nt, Homo sapiens
ucaagaagcucaacaagua

SEQ ID NO: 119714 - RNA, 19 nt, Homo sapiens
gaacagaccuaugcucuaa

SEQ ID NO: 119715 - RNA, 19 nt, Homo sapiens
gaaauuauguccuaucaga

SEQ ID NO: 119716 - RNA, 19 nt, Homo sapiens
ugaugaagcugcuaauaua

SEQ ID NO: 119717 - RNA, 19 nt, Homo sapiens
agaaacggcuuuacuagua

SEQ ID NO: 119718 - RNA, 19 nt, Homo sapiens
gaauggaaauuauguccua

SEQ ID NO: 119719 - RNA, 19 nt, Homo sapiens
gauacaaguucauggauuu

SEQ ID NO: 119720 - RNA, 19 nt, Homo sapiens
caucaaaucuggaagaaug

SEQ ID NO: 119721 - RNA, 19 nt, Homo sapiens
gaaucaaccuauagacaaa

SEQ ID NO: 119722 - RNA, 19 nt, Homo sapiens
gaucagacccuuauaacaa

SEQ ID NO: 119723 - RNA, 19 nt, Homo sapiens
aagcagagauuaaagcuaa

SEQ ID NO: 119724 - RNA, 19 nt, Homo sapiens
guaugaagcugcccaguau

SEQ ID NO: 119725 - RNA, 19 nt, Homo sapiens
guagauauguggaagaaau

SEQ ID NO: 119726 - RNA, 19 nt, Homo sapiens
acaaaucuguugccuuuaa

SEQ ID NO: 119727 - RNA, 19 nt, Homo sapiens
guagaguccugccuuauug

SEQ ID NO: 119728 - RNA, 19 nt, Homo sapiens
guagauagauacaaguuca

SEQ ID NO: 119729 - RNA, 19 nt, Homo sapiens
gaagaucggaguagagauu

SEQ ID NO: 119730 - RNA, 19 nt, Homo sapiens
cagcacucauggaauauua

SEQ ID NO: 119731 - RNA, 19 nt, Homo sapiens
ggagagacuauaacaagua

SEQ ID NO: 119732 - RNA, 19 nt, Homo sapiens
uuucagagaugccuuauga

SEQ ID NO: 119733 - RNA, 19 nt, Homo sapiens
gcacuuuauugaagaagaa

SEQ ID NO: 119734 - RNA, 19 nt, Homo sapiens
aauaacagcuguccgaaga

SEQ ID NO: 119735 - RNA, 19 nt, Homo sapiens
gaagaaagcggaaaagaaa

SEQ ID NO: 119736 - RNA, 19 nt, Homo sapiens
uauagugccuguucugaaa

SEQ ID NO: 119737 - RNA, 19 nt, Homo sapiens
cugcagcacucauggaaua

SEQ ID NO: 119738 - RNA, 19 nt, Homo sapiens
gaagaggguaucaauauuc

SEQ ID NO: 119739 - RNA, 19 nt, Homo sapiens
gagagacuauaacaaguau

SEQ ID NO: 119740 - RNA, 19 nt, Homo sapiens
ugagaagucuggagaaauc

SEQ ID NO: 119741 - RNA, 19 nt, Homo sapiens
gagcaacccucuucguaca

SEQ ID NO: 119742 - RNA, 19 nt, Homo sapiens
ugaagaggguaucaauauu

SEQ ID NO: 119743 - RNA, 19 nt, Homo sapiens
acaaagcacggaagacuua

SEQ ID NO: 119744 - RNA, 19 nt, Homo sapiens
ucagaauacuccucaagaa

SEQ ID NO: 119745 - RNA, 19 nt, Homo sapiens
uagaagagaauccauauga

SEQ ID NO: 119746 - RNA, 19 nt, Homo sapiens
aaaccaaccugugugaauu

SEQ ID NO: 119747 - RNA, 19 nt, Homo sapiens
gaagcugugaggaucauua

SEQ ID NO: 119748 - RNA, 19 nt, Homo sapiens
gaaacggcuuuacuaguag

SEQ ID NO: 119749 - RNA, 19 nt, Homo sapiens
ggacaauaauacccgaguu

SEQ ID NO: 119750 - RNA, 19 nt, Homo sapiens
gaagagagucgcaugaagu

SEQ ID NO: 119751 - RNA, 19 nt, Homo sapiens
ggaaguguuaucuuucaua

SEQ ID NO: 119752 - RNA, 19 nt, Homo sapiens
aagaugaaguggauagaaa

SEQ ID NO: 119753 - RNA, 19 nt, Homo sapiens
aaaggaauaugagacagua

SEQ ID NO: 119754 - RNA, 19 nt, Homo sapiens
uguaggaucuuaugcagaa

SEQ ID NO: 119755 - RNA, 19 nt, Homo sapiens
gaagaugcaagauaccaaa

SEQ ID NO: 119756 - RNA, 19 nt, Homo sapiens
gaaagagccauaagcacuu

SEQ ID NO: 119757 - RNA, 19 nt, Homo sapiens
ucuggaaacuguacauuga

SEQ ID NO: 119758 - RNA, 19 nt, Homo sapiens
gcacagaaucaaccuauag

SEQ ID NO: 119759 - RNA, 19 nt, Homo sapiens
ucuguugccuuuaagauuu

SEQ ID NO: 119760 - RNA, 19 nt, Homo sapiens
gaggaucagacccuuauaa

SEQ ID NO: 119761 - RNA, 19 nt, Homo sapiens
ugaaaggcuuggaccguaa

SEQ ID NO: 119762 - RNA, 19 nt, Homo sapiens
gagacuauaacaaguauga

SEQ ID NO: 119763 - RNA, 19 nt, Homo sapiens
acaaguggaugaacugaug

SEQ ID NO: 119764 - RNA, 19 nt, Homo sapiens
gaaaagggagauaugaaua

SEQ ID NO: 119765 - RNA, 19 nt, Homo sapiens
gaugcaagauaccaaauac

SEQ ID NO: 119766 - RNA, 19 nt, Homo sapiens
uggaugaacugauggaaau

SEQ ID NO: 119767 - RNA, 19 nt, Homo sapiens
gaguuauguuugcuuauga

SEQ ID NO: 119768 - RNA, 19 nt, Homo sapiens
aguuguagcuccuucuaua

SEQ ID NO: 119769 - RNA, 19 nt, Homo sapiens
ccgaagaguuuaucaacga

SEQ ID NO: 119770 - RNA, 19 nt, Homo sapiens
uauguagaguccugccuua

SEQ ID NO: 119771 - RNA, 19 nt, Homo sapiens
gguaugaagcugcccagua

SEQ ID NO: 119772 - RNA, 19 nt, Homo sapiens
guucuugguuugcuuaugu

SEQ ID NO: 119773 - RNA, 19 nt, Homo sapiens
gacaauaauacccgaguuu

SEQ ID NO: 119774 - RNA, 19 nt, Homo sapiens
gagcagaaggcaucaaauc

SEQ ID NO: 119775 - RNA, 19 nt, Homo sapiens
gaucggaguagagauuaua

SEQ ID NO: 119776 - RNA, 19 nt, Homo sapiens
gaggguaucaauauucauu

SEQ ID NO: 119777 - RNA, 19 nt, Homo sapiens
cuaccaaguuacaaagaaa

SEQ ID NO: 119778 - RNA, 19 nt, Homo sapiens
ggaacagaccuaugcucua

SEQ ID NO: 119779 - RNA, 19 nt, Homo sapiens
agaagaguaugaagggaaa

SEQ ID NO: 119780 - RNA, 19 nt, Homo sapiens
gaauaugagacaguaauga

SEQ ID NO: 119781 - RNA, 19 nt, Homo sapiens
gaauguaugaaauccguuu

SEQ ID NO: 119782 - RNA, 19 nt, Homo sapiens
caagauaccaaauacuguu

SEQ ID NO: 119783 - RNA, 19 nt, Homo sapiens
gcaggcagcugaguauguc

SEQ ID NO: 119784 - RNA, 19 nt, Homo sapiens
gagagcagaaggcaucaaa

SEQ ID NO: 119785 - RNA, 19 nt, Homo sapiens
guacauugaagcagagauu

SEQ ID NO: 119786 - RNA, 19 nt, Homo sapiens
gaaggcaucaaaucuggaa

SEQ ID NO: 119787 - RNA, 19 nt, Homo sapiens
gugaugaagcugcuaauau

SEQ ID NO: 119788 - RNA, 19 nt, Homo sapiens
cagagaaggugaagaaagc

SEQ ID NO: 119789 - RNA, 19 nt, Homo sapiens
gaaauccguuuuguaguuu

SEQ ID NO: 119790 - RNA, 19 nt, Homo sapiens
guaaugcaguacucaccaa

SEQ ID NO: 119791 - RNA, 19 nt, Homo sapiens
gaugaacugauggaaauuu

SEQ ID NO: 119792 - RNA, 19 nt, Homo sapiens
aaacuucucccuccuccua

SEQ ID NO: 119793 - RNA, 19 nt, Homo sapiens
uuacagcauucaaagaaga

SEQ ID NO: 119794 - RNA, 19 nt, Homo sapiens
aaagacgguuuacagcauu

SEQ ID NO: 119795 - RNA, 19 nt, Homo sapiens
ggcccgauuucuagcauuu

SEQ ID NO: 119796 - RNA, 19 nt, Homo sapiens
gaagcugcccaguaucuug

SEQ ID NO: 119797 - RNA, 19 nt, Homo sapiens
uaugaaugcuagacgugua

SEQ ID NO: 119798 - RNA, 19 nt, Homo sapiens
cuggauggcuuaugauugu

SEQ ID NO: 119799 - RNA, 19 nt, Homo sapiens
gcuugaagauuugugaguu

SEQ ID NO: 119800 - RNA, 19 nt, Homo sapiens
ucugaaagaugaaguggau

SEQ ID NO: 119801 - RNA, 19 nt, Homo sapiens
guaguaaggacaaaucugu

SEQ ID NO: 119802 - RNA, 19 nt, Homo sapiens
gagagucgcaugaaguaug

SEQ ID NO: 119803 - RNA, 19 nt, Homo sapiens
ggucagugcgcacguugua

SEQ ID NO: 119804 - RNA, 19 nt, Homo sapiens
gaauccauaugaccuugau

SEQ ID NO: 119805 - RNA, 19 nt, Homo sapiens
gcaacccucuucguacaga

SEQ ID NO: 119806 - RNA, 19 nt, Homo sapiens
ggcacagaaucaaccuaua

SEQ ID NO: 119807 - RNA, 19 nt, Homo sapiens
caaaccaaccugugugaau

SEQ ID NO: 119808 - RNA, 19 nt, Homo sapiens
ccaacgaggauucagauga

SEQ ID NO: 119809 - RNA, 19 nt, Homo sapiens
aaggaugucucccgugcua

SEQ ID NO: 119810 - RNA, 19 nt, Homo sapiens
ucaaugaggacaauaauac

SEQ ID NO: 119811 - RNA, 19 nt, Homo sapiens
gauugaagaucggaguaga

SEQ ID NO: 119812 - RNA, 19 nt, Homo sapiens
gcggagaccuaggaacuuu

SEQ ID NO: 119813 - RNA, 19 nt, Homo sapiens
gcacccacccguauuuaug

SEQ ID NO: 119814 - RNA, 19 nt, Homo sapiens
ccugcagccuggugucuua

SEQ ID NO: 119815 - RNA, 19 nt, Homo sapiens
ucaaagacauccuaaaccu

SEQ ID NO: 119816 - RNA, 19 nt, Homo sapiens
ccacgcaggucaagaucug

SEQ ID NO: 119817 - RNA, 19 nt, Homo sapiens
caagugugcgucugccuuu

SEQ ID NO: 119818 - RNA, 19 nt, Homo sapiens
acaacaacuucgugaacuu

SEQ ID NO: 119819 - RNA, 19 nt, Homo sapiens
caacaacaacuucgugaac

SEQ ID NO: 119820 - RNA, 19 nt, Homo sapiens
uguccacgcugcaugguau

SEQ ID NO: 119821 - RNA, 19 nt, Homo sapiens
ccacgcgcguuuguucuug

SEQ ID NO: 119822 - RNA, 19 nt, Homo sapiens
caacaacuucgugaacuuc

SEQ ID NO: 119823 - RNA, 19 nt, Homo sapiens
gccucaaucccuacgguua

SEQ ID NO: 119824 - RNA, 19 nt, Homo sapiens
cagcugcacugccgcuuac

SEQ ID NO: 119825 - RNA, 19 nt, Homo sapiens
cucaaucccuacgguuaua

SEQ ID NO: 119826 - RNA, 19 nt, Homo sapiens
ccacgcacccacccguauu

SEQ ID NO: 119827 - RNA, 19 nt, Homo sapiens
agaaggggcucccaacaug

SEQ ID NO: 119828 - RNA, 19 nt, Homo sapiens
cuauugcuguaagaaauga

SEQ ID NO: 119829 - RNA, 19 nt, Homo sapiens
ccaacaacaacuucgugaa

SEQ ID NO: 119830 - RNA, 19 nt, Homo sapiens
cgcaggcgcaggucuauga

SEQ ID NO: 119831 - RNA, 19 nt, Homo sapiens
gaagacagaggcggacaac

SEQ ID NO: 119832 - RNA, 19 nt, Homo sapiens
cgguggagcuggagaagac

SEQ ID NO: 119833 - RNA, 19 nt, Homo sapiens
ccucaaucccuacgguuau

SEQ ID NO: 119834 - RNA, 19 nt, Homo sapiens
gaggacggcuuacauguuu

SEQ ID NO: 119835 - RNA, 19 nt, Homo sapiens
gcccugaccuucucucuga

SEQ ID NO: 119836 - RNA, 19 nt, Homo sapiens
ggaggacggcuuacauguu

SEQ ID NO: 119837 - RNA, 19 nt, Homo sapiens
cggcuuacauguuuguuuc

SEQ ID NO: 119838 - RNA, 19 nt, Homo sapiens
cagcagcuuucccuguuga

SEQ ID NO: 119839 - RNA, 19 nt, Homo sapiens
caacugcagcucuccauca

SEQ ID NO: 119840 - RNA, 19 nt, Homo sapiens
guaccgagaauacgagaau

SEQ ID NO: 119841 - RNA, 19 nt, Homo sapiens
gaggaggacggcuuacaug

SEQ ID NO: 119842 - RNA, 19 nt, Homo sapiens
ggaggaggacggcuuacau

SEQ ID NO: 119843 - RNA, 19 nt, Homo sapiens
gcuggaggaggacggcuua

SEQ ID NO: 119844 - RNA, 19 nt, Homo sapiens
cagcacgaguggccaguuc

SEQ ID NO: 119845 - RNA, 19 nt, Homo sapiens
cugaauggaugcugcagau

SEQ ID NO: 119846 - RNA, 19 nt, Homo sapiens
gagagccgccugcuugagu

SEQ ID NO: 119847 - RNA, 19 nt, Homo sapiens
uccagcagcuuucccuguu

SEQ ID NO: 119848 - RNA, 19 nt, Homo sapiens
ggacggcuuacauguuugu

SEQ ID NO: 119849 - RNA, 19 nt, Homo sapiens
ccagcagcuuucccuguug

SEQ ID NO: 119850 - RNA, 19 nt, Homo sapiens
uaccgagaauacgagaaua

SEQ ID NO: 119851 - RNA, 19 nt, Homo sapiens
cgaguggccaguucauugu

SEQ ID NO: 119852 - RNA, 19 nt, Homo sapiens
cacuguguccggcaacaua

SEQ ID NO: 119853 - RNA, 19 nt, Homo sapiens
cagcuuucccuguugaugu

SEQ ID NO: 119854 - RNA, 19 nt, Homo sapiens
ccggcaacauacugacuau

SEQ ID NO: 119855 - RNA, 19 nt, Homo sapiens
aaauaaaacugagcuacga

SEQ ID NO: 119856 - RNA, 19 nt, Homo sapiens
gcuuacauguuuguuucug

SEQ ID NO: 119857 - RNA, 19 nt, Homo sapiens
acgaguggccaguucauug

SEQ ID NO: 119858 - RNA, 19 nt, Homo sapiens
agagccgccugcuugaguu

SEQ ID NO: 119859 - RNA, 19 nt, Homo sapiens
gcacgaguggccaguucau

SEQ ID NO: 119860 - RNA, 19 nt, Homo sapiens
gccgccugcuugaguucua

SEQ ID NO: 119861 - RNA, 19 nt, Homo sapiens
gaggacggcuuacauguuu

SEQ ID NO: 119862 - RNA, 19 nt, Homo sapiens
gcccugaccuucucucuga

SEQ ID NO: 119863 - RNA, 19 nt, Homo sapiens
ggaggacggcuuacauguu

SEQ ID NO: 119864 - RNA, 19 nt, Homo sapiens
cggcuuacauguuuguuuc

SEQ ID NO: 119865 - RNA, 19 nt, Homo sapiens
cagcagcuuucccuguuga

SEQ ID NO: 119866 - RNA, 19 nt, Homo sapiens
caacugcagcucuccauca

SEQ ID NO: 119867 - RNA, 19 nt, Homo sapiens
gaggaggacggcuuacaug

SEQ ID NO: 119868 - RNA, 19 nt, Homo sapiens
ggaggaggacggcuuacau

SEQ ID NO: 119869 - RNA, 19 nt, Homo sapiens
gcuggaggaggacggcuua

SEQ ID NO: 119870 - RNA, 19 nt, Homo sapiens
cagcacgaguggccaguuc

SEQ ID NO: 119871 - RNA, 19 nt, Homo sapiens
cugaauggaugcugcagau

SEQ ID NO: 119872 - RNA, 19 nt, Homo sapiens
gagagccgccugcuugagu

SEQ ID NO: 119873 - RNA, 19 nt, Homo sapiens
uccagcagcuuucccuguu

SEQ ID NO: 119874 - RNA, 19 nt, Homo sapiens
ggacggcuuacauguuugu

SEQ ID NO: 119875 - RNA, 19 nt, Homo sapiens
ccagcagcuuucccuguug

SEQ ID NO: 119876 - RNA, 19 nt, Homo sapiens
cgaguggccaguucauugu

SEQ ID NO: 119877 - RNA, 19 nt, Homo sapiens
cacuguguccggcaacaua

SEQ ID NO: 119878 - RNA, 19 nt, Homo sapiens
cagcuuucccuguugaugu

SEQ ID NO: 119879 - RNA, 19 nt, Homo sapiens
ccggcaacauacugacuau

SEQ ID NO: 119880 - RNA, 19 nt, Homo sapiens
aaauaaaacugagcuacga

SEQ ID NO: 119881 - RNA, 19 nt, Homo sapiens
gcuuacauguuuguuucug

SEQ ID NO: 119882 - RNA, 19 nt, Homo sapiens
agagccgccugcuugaguu

SEQ ID NO: 119883 - RNA, 19 nt, Homo sapiens
acgaguggccaguucauug

SEQ ID NO: 119884 - RNA, 19 nt, Homo sapiens
gcacgaguggccaguucau

SEQ ID NO: 119885 - RNA, 19 nt, Homo sapiens
gccgccugcuugaguucua

SEQ ID NO: 119886 - RNA, 19 nt, Homo sapiens
caacagaucuaguuucuug

SEQ ID NO: 119887 - RNA, 19 nt, Homo sapiens
gacagaagaugcuauaauu

SEQ ID NO: 119888 - RNA, 19 nt, Homo sapiens
gaucuaguuucuugcauuu

SEQ ID NO: 119889 - RNA, 19 nt, Homo sapiens
gucaaaccauuaagaguua

SEQ ID NO: 119890 - RNA, 19 nt, Homo sapiens
gaucauguuuguaccauug

SEQ ID NO: 119891 - RNA, 19 nt, Homo sapiens
gagcauuaauccuaagaaa

SEQ ID NO: 119892 - RNA, 19 nt, Homo sapiens
gaaauuguuugcuuagagu

SEQ ID NO: 119893 - RNA, 19 nt, Homo sapiens
caaagaaacuacagacucu

SEQ ID NO: 119894 - RNA, 19 nt, Homo sapiens
uaugauuggucacagauua

SEQ ID NO: 119895 - RNA, 19 nt, Homo sapiens
gaagaaaugugggaagucu

SEQ ID NO: 119896 - RNA, 19 nt, Homo sapiens
acucagaacuuaugugcua

SEQ ID NO: 119897 - RNA, 19 nt, Homo sapiens
ggaaauuguuugcuuagag

SEQ ID NO: 119898 - RNA, 19 nt, Homo sapiens
uguauaaucugaaguggaa

SEQ ID NO: 119899 - RNA, 19 nt, Homo sapiens
caaagaacauagacagaag

SEQ ID NO: 119900 - RNA, 19 nt, Homo sapiens
acacgaauguccucaguau

SEQ ID NO: 119901 - RNA, 19 nt, Homo sapiens
acagcaaacugaagaaaug

SEQ ID NO: 119902 - RNA, 19 nt, Homo sapiens
uaugauaacccucagagua

SEQ ID NO: 119903 - RNA, 19 nt, Homo sapiens
uuacaacuguggcaacauu

SEQ ID NO: 119904 - RNA, 19 nt, Homo sapiens
ccaaugcucccuauaauca

SEQ ID NO: 119905 - RNA, 19 nt, Homo sapiens
aauauaugcucacgaauca

SEQ ID NO: 119906 - RNA, 19 nt, Homo sapiens
agaaaugugggaagucuua

SEQ ID NO: 119907 - RNA, 19 nt, Homo sapiens
caaacugucuugacuacuc

SEQ ID NO: 119908 - RNA, 19 nt, Homo sapiens
ggaaaccuaugggauaaag

SEQ ID NO: 119909 - RNA, 19 nt, Homo sapiens
ucagcgggcuccuuauuau

SEQ ID NO: 119910 - RNA, 19 nt, Homo sapiens
gaucagcgggcuccuuauu

SEQ ID NO: 119911 - RNA, 19 nt, Homo sapiens
uaauggguguuccuuggua

SEQ ID NO: 119912 - RNA, 19 nt, Homo sapiens
cacaauauauggauggaau

SEQ ID NO: 119913 - RNA, 19 nt, Homo sapiens
gcauuaauccuaagaaacu

SEQ ID NO: 119914 - RNA, 19 nt, Homo sapiens
ugugaugucuuaugaugaa

SEQ ID NO: 119915 - RNA, 19 nt, Homo sapiens
gauauagagcaagaaguua

SEQ ID NO: 119916 - RNA, 19 nt, Homo sapiens
ccaaacagcaaacugaaga

SEQ ID NO: 119917 - RNA, 19 nt, Homo sapiens
ccucagaguauuucuuuaa

SEQ ID NO: 119918 - RNA, 19 nt, Homo sapiens
aaucagacauuaacuggau

SEQ ID NO: 119919 - RNA, 19 nt, Homo sapiens
ccaaagaacauagacagaa

SEQ ID NO: 119920 - RNA, 19 nt, Homo sapiens
gagcaagaaguuaauuguu

SEQ ID NO: 119921 - RNA, 19 nt, Homo sapiens
gagaugcuguagccaaaca

SEQ ID NO: 119922 - RNA, 19 nt, Homo sapiens
aaucugaaguggaaauugu

SEQ ID NO: 119923 - RNA, 19 nt, Homo sapiens
aagaugagcauuaauccua

SEQ ID NO: 119924 - RNA, 19 nt, Homo sapiens
cagccaaugcucccuauaa

SEQ ID NO: 119925 - RNA, 19 nt, Homo sapiens
guuuaucaccugaauauga

SEQ ID NO: 119926 - RNA, 19 nt, Homo sapiens
ccauuaagaguuagaaaga

SEQ ID NO: 119927 - RNA, 19 nt, Homo sapiens
cagaguauuucuuuaaagg

SEQ ID NO: 119928 - RNA, 19 nt, Homo sapiens
gauaacccucagaguauuu

SEQ ID NO: 119929 - RNA, 19 nt, Homo sapiens
gacgucaggugcccuacaa

SEQ ID NO: 119930 - RNA, 19 nt, Homo sapiens
gcuugugacuuccucuuug

SEQ ID NO: 119931 - RNA, 19 nt, Homo sapiens
aguggaaauuguuugcuua

SEQ ID NO: 119932 - RNA, 19 nt, Homo sapiens
aaacgaucaugaagcaaau

SEQ ID NO: 119933 - RNA, 19 nt, Homo sapiens
gcaguuugugcuauacuuu

SEQ ID NO: 119934 - RNA, 19 nt, Homo sapiens
gauuacaacuguggcaaca

SEQ ID NO: 119935 - RNA, 19 nt, Homo sapiens
ugccauauuucccuucauu

SEQ ID NO: 119936 - RNA, 19 nt, Homo sapiens
agaugagcauuaauccuaa

SEQ ID NO: 119937 - RNA, 19 nt, Homo sapiens
aaaaggagccagaguagua

SEQ ID NO: 119938 - RNA, 19 nt, Homo sapiens
gugcuacgcucauucaaaa

SEQ ID NO: 119939 - RNA, 19 nt, Homo sapiens
ugucaaaccauuaagaguu

SEQ ID NO: 119940 - RNA, 19 nt, Homo sapiens
ugauaacccucagaguauu

SEQ ID NO: 119941 - RNA, 19 nt, Homo sapiens
aagaucagcgggcuccuua

SEQ ID NO: 119942 - RNA, 19 nt, Homo sapiens
cuggaaaccuaugggauaa

SEQ ID NO: 119943 - RNA, 19 nt, Homo sapiens
ugcauuaacugcuuuaguc

SEQ ID NO: 119944 - RNA, 19 nt, Homo sapiens
uaugaugcauuaacugcuu

SEQ ID NO: 119945 - RNA, 19 nt, Homo sapiens
guacuuaaaggagauguau

SEQ ID NO: 119946 - RNA, 19 nt, Homo sapiens
uggagaugcuguagccaaa

SEQ ID NO: 119947 - RNA, 19 nt, Homo sapiens
gaugucuuaugaugaacaa

SEQ ID NO: 119948 - RNA, 19 nt, Homo sapiens
accugaauaugaugcauua

SEQ ID NO: 119949 - RNA, 19 nt, Homo sapiens
agauauagagcaagaaguu

SEQ ID NO: 119950 - RNA, 19 nt, Homo sapiens
ucuggaaaccuaugggaua

SEQ ID NO: 119951 - RNA, 19 nt, Homo sapiens
gaaaugugggaagucuuaa

SEQ ID NO: 119952 - RNA, 19 nt, Homo sapiens
cauguggaaugcaaacugu

SEQ ID NO: 119953 - RNA, 19 nt, Homo sapiens
ccauauuucccuucauuau

SEQ ID NO: 119954 - RNA, 19 nt, Homo sapiens
ggaucauguuuguaccauu

SEQ ID NO: 119955 - RNA, 19 nt, Homo sapiens
agacagaagaugcuauaau

SEQ ID NO: 119956 - RNA, 19 nt, Homo sapiens
gguguuccuugguaugguu

SEQ ID NO: 119957 - RNA, 19 nt, Homo sapiens
cuugguaugguuaugauua

SEQ ID NO: 119958 - RNA, 19 nt, Homo sapiens
gaauaugaugcauuaacug

SEQ ID NO: 119959 - RNA, 19 nt, Homo sapiens
aaauauaugcucacgaauc

SEQ ID NO: 119960 - RNA, 19 nt, Homo sapiens
agaucuaguuucuugcauu

SEQ ID NO: 119961 - RNA, 19 nt, Homo sapiens
gggaagucuuaaagccaaa

SEQ ID NO: 119962 - RNA, 19 nt, Homo sapiens
ugacuacucuggagaugcu

SEQ ID NO: 119963 - RNA, 19 nt, Homo sapiens
cagcgggcuccuuauuaua

SEQ ID NO: 119964 - RNA, 19 nt, Homo sapiens
auugagggaucacagguaa

SEQ ID NO: 119965 - RNA, 19 nt, Homo sapiens
gccauauuucccuucauua

SEQ ID NO: 119966 - RNA, 19 nt, Homo sapiens
aaacagcaaacugaagaaa

SEQ ID NO: 119967 - RNA, 19 nt, Homo sapiens
uagccaaacagcaaacuga

SEQ ID NO: 119968 - RNA, 19 nt, Homo sapiens
ggaaugcaaacugucuuga

SEQ ID NO: 119969 - RNA, 19 nt, Homo sapiens
gcuggccacuuucaucaag

SEQ ID NO: 119970 - RNA, 19 nt, Homo sapiens
gaaucugucugaggaucau

SEQ ID NO: 119971 - RNA, 19 nt, Homo sapiens
ggauauaaugacuacauca

SEQ ID NO: 119972 - RNA, 19 nt, Homo sapiens
ucuuugugaugucuuauga

SEQ ID NO: 119973 - RNA, 19 nt, Homo sapiens
cgcagaugcuugugacuuc

SEQ ID NO: 119974 - RNA, 19 nt, Homo sapiens
ggacagaaaacuuggaaau

SEQ ID NO: 119975 - RNA, 19 nt, Homo sapiens
ucaguauccaggaacauaa

SEQ ID NO: 119976 - RNA, 19 nt, Homo sapiens
gcauuaacugcuuuaguca

SEQ ID NO: 119977 - RNA, 19 nt, Homo sapiens
cauugauccugcuuucaga

SEQ ID NO: 119978 - RNA, 19 nt, Homo sapiens
acacacgaauguccucagu

SEQ ID NO: 119979 - RNA, 19 nt, Homo sapiens
gaugagcauuaauccuaag

SEQ ID NO: 119980 - RNA, 19 nt, Homo sapiens
uuugugaugucuuaugaug

SEQ ID NO: 119981 - RNA, 19 nt, Homo sapiens
gaaucgcagaugcuuguga

SEQ ID NO: 119982 - RNA, 19 nt, Homo sapiens
uguaucaacagaucuaguu

SEQ ID NO: 119983 - RNA, 19 nt, Homo sapiens
caaacagcaaacugaagaa

SEQ ID NO: 119984 - RNA, 19 nt, Homo sapiens
aaaccuaugggauaaagau

SEQ ID NO: 119985 - RNA, 19 nt, Homo sapiens
uggaaaauaugacucagaa

SEQ ID NO: 119986 - RNA, 19 nt, Homo sapiens
cagaagaagucaguaguua

SEQ ID NO: 119987 - RNA, 19 nt, Homo sapiens
gaagaagucaguaguuauu

SEQ ID NO: 119988 - RNA, 19 nt, Homo sapiens
gggaggaccuggagaaguu

SEQ ID NO: 119989 - RNA, 19 nt, Homo sapiens
gaagaacugugucaacaag

SEQ ID NO: 119990 - RNA, 19 nt, Homo sapiens
gaacguucuugucugugua

SEQ ID NO: 119991 - RNA, 19 nt, Homo sapiens
uugcuuagcugucaacaaa

SEQ ID NO: 119992 - RNA, 19 nt, Homo sapiens
ucggaacccuucagcuuua

SEQ ID NO: 119993 - RNA, 19 nt, Homo sapiens
aaacuucucaggacaauga

SEQ ID NO: 119994 - RNA, 19 nt, Homo sapiens
gaaugaggcaguuggcaaa

SEQ ID NO: 119995 - RNA, 19 nt, Homo sapiens
caacaaggaccaucugaca

SEQ ID NO: 119996 - RNA, 19 nt, Homo sapiens
gcaaacuucucaggacaau

SEQ ID NO: 119997 - RNA, 19 nt, Homo sapiens
gcagaagaagucaguaguu

SEQ ID NO: 119998 - RNA, 19 nt, Homo sapiens
gugguaggcuagcaauauu

SEQ ID NO: 119999 - RNA, 19 nt, Homo sapiens
cuaccugcuugucuuauuu

SEQ ID NO: 120000 - RNA, 19 nt, Homo sapiens
ugaaggacguggccacugu

SEQ ID NO: 120001 - RNA, 19 nt, Homo sapiens
gaaggagcauuuggaaguc

SEQ ID NO: 120002 - RNA, 19 nt, Homo sapiens
caaugaaucuucccguuuu

SEQ ID NO: 120003 - RNA, 19 nt, Homo sapiens
gcacaaccaccaccucauc

SEQ ID NO: 120004 - RNA, 19 nt, Homo sapiens
gccacacagugcauuguuu

SEQ ID NO: 120005 - RNA, 19 nt, Homo sapiens
gcauuuggaagucaauuug

SEQ ID NO: 120006 - RNA, 19 nt, Homo sapiens
caugaacguucuugucugu

SEQ ID NO: 120007 - RNA, 19 nt, Homo sapiens
cgcaggagauccaugagaa

SEQ ID NO: 120008 - RNA, 19 nt, Homo sapiens
cgaagcagcuccaaaagga

SEQ ID NO: 120009 - RNA, 19 nt, Homo sapiens
ugaaggagcauuuggaagu

SEQ ID NO: 120010 - RNA, 19 nt, Homo sapiens
ccacgccagugaccaguug

SEQ ID NO: 120011 - RNA, 19 nt, Homo sapiens
gcucgcacuugcucaacaa

SEQ ID NO: 120012 - RNA, 19 nt, Homo sapiens
ucaacgugcucuucuacga

SEQ ID NO: 120013 - RNA, 19 nt, Homo sapiens
guaguuauucucccaugaa

SEQ ID NO: 120014 - RNA, 19 nt, Homo sapiens
ccacgcaggagauccauga

SEQ ID NO: 120015 - RNA, 19 nt, Homo sapiens
acaaugaaucuucccguuu

SEQ ID NO: 120016 - RNA, 19 nt, Homo sapiens
ugaacguucuugucugugu

SEQ ID NO: 120017 - RNA, 19 nt, Homo sapiens
gcuucaacgugcucuucua

SEQ ID NO: 120018 - RNA, 19 nt, Homo sapiens
agaacugugucaacaagga

SEQ ID NO: 120019 - RNA, 19 nt, Homo sapiens
cugaagaacugugucaaca

SEQ ID NO: 120020 - RNA, 19 nt, Homo sapiens
cagacagccugaagaacug

SEQ ID NO: 120021 - RNA, 19 nt, Homo sapiens
ccagacagccugaagaacu

SEQ ID NO: 120022 - RNA, 19 nt, Homo sapiens
gccacauccugaaccugua

SEQ ID NO: 120023 - RNA, 19 nt, Homo sapiens
ucaaagcccuccgcaucau

SEQ ID NO: 120024 - RNA, 19 nt, Homo sapiens
cauuacaaaggaucuguuu

SEQ ID NO: 120025 - RNA, 19 nt, Homo sapiens
gccaaggccuucggcuuca

SEQ ID NO: 120026 - RNA, 19 nt, Homo sapiens
ucuaccugcuugucuuauu

SEQ ID NO: 120027 - RNA, 19 nt, Homo sapiens
auagagaccacgccaguga

SEQ ID NO: 120028 - RNA, 19 nt, Homo sapiens
gucggaacccuucagcuuu

SEQ ID NO: 120029 - RNA, 19 nt, Homo sapiens
agaagaagucaguaguuau

SEQ ID NO: 120030 - RNA, 19 nt, Homo sapiens
ugaagaacugugucaacaa

SEQ ID NO: 120031 - RNA, 19 nt, Homo sapiens
ucacgaagcagcuccaaaa

SEQ ID NO: 120032 - RNA, 19 nt, Homo sapiens
ggaacgugccccagaauga

SEQ ID NO: 120033 - RNA, 19 nt, Homo sapiens
gaagucaguaguuauucuc

SEQ ID NO: 120034 - RNA, 19 nt, Homo sapiens
ucaacgacuucaccgucaa

SEQ ID NO: 120035 - RNA, 19 nt, Homo sapiens
augagaagguccugaacga

SEQ ID NO: 120036 - RNA, 19 nt, Homo sapiens
cguccgaccuccgaucaug

SEQ ID NO: 120037 - RNA, 19 nt, Homo sapiens
gaacauuacaaaggaucug

SEQ ID NO: 120038 - RNA, 19 nt, Homo sapiens
gcagcucgcacuugcucaa

SEQ ID NO: 120039 - RNA, 19 nt, Homo sapiens
ggaccuggagaaguucaaa

SEQ ID NO: 120040 - RNA, 19 nt, Homo sapiens
ccagggcccucugaaggau

SEQ ID NO: 120041 - RNA, 19 nt, Homo sapiens
gacaacaucgacaucaagu

SEQ ID NO: 120042 - RNA, 19 nt, Homo sapiens
ggaaacccucgaccagagu

SEQ ID NO: 120043 - RNA, 19 nt, Homo sapiens
aagacggcaucaucacgaa

SEQ ID NO: 120044 - RNA, 19 nt, Homo sapiens
cuucuacgacccuuacuug

SEQ ID NO: 120045 - RNA, 19 nt, Homo sapiens
ccagugccguccugcugau

SEQ ID NO: 120046 - RNA, 19 nt, Homo sapiens
gcaggagauccaugagaag

SEQ ID NO: 120047 - RNA, 19 nt, Homo sapiens
gagauccgcagagccauca

SEQ ID NO: 120048 - RNA, 19 nt, Homo sapiens
ugacaacaucgacaucaag

SEQ ID NO: 120049 - RNA, 19 nt, Homo sapiens
ugugguaggcuagcaauau

SEQ ID NO: 120050 - RNA, 19 nt, Homo sapiens
ccugaaggagcauuuggaa

SEQ ID NO: 120051 - RNA, 19 nt, Homo sapiens
guuauucucccaugaacgu

SEQ ID NO: 120052 - RNA, 19 nt, Homo sapiens
ccaaggccuucggcuucaa

SEQ ID NO: 120053 - RNA, 19 nt, Homo sapiens
ggggagaccuugggcauca

SEQ ID NO: 120054 - RNA, 19 nt, Homo sapiens
ccagaaagcuuaagaaauu

SEQ ID NO: 120055 - RNA, 19 nt, Homo sapiens
gaauggcccuuguggauaa

SEQ ID NO: 120056 - RNA, 19 nt, Homo sapiens
gcaagucgguuguaaguuc

SEQ ID NO: 120057 - RNA, 19 nt, Homo sapiens
guagacaccugcacgcaua

SEQ ID NO: 120058 - RNA, 19 nt, Homo sapiens
caucugaacugcauacuga

SEQ ID NO: 120059 - RNA, 19 nt, Homo sapiens
gggaggaccuggagaaguu

SEQ ID NO: 120060 - RNA, 19 nt, Homo sapiens
ggacagaauuugugaaggu

SEQ ID NO: 120061 - RNA, 19 nt, Homo sapiens
gcacugcaaucucaacgaa

SEQ ID NO: 120062 - RNA, 19 nt, Homo sapiens
cggaagcgcugaaagacua

SEQ ID NO: 120063 - RNA, 19 nt, Homo sapiens
ggaauucuuugucacauca

SEQ ID NO: 120064 - RNA, 19 nt, Homo sapiens
gaagguaaucacucagaua

SEQ ID NO: 120065 - RNA, 19 nt, Homo sapiens
gaaagacuaggaugugauu

SEQ ID NO: 120066 - RNA, 19 nt, Homo sapiens
cgagaaagccuuagcacaa

SEQ ID NO: 120067 - RNA, 19 nt, Homo sapiens
ugaaggaccuggccacugu

SEQ ID NO: 120068 - RNA, 19 nt, Homo sapiens
ucagagcccuucagcuuug

SEQ ID NO: 120069 - RNA, 19 nt, Homo sapiens
gagaaagccuuagcacaag

SEQ ID NO: 120070 - RNA, 19 nt, Homo sapiens
gcucuacaauguugcauca

SEQ ID NO: 120071 - RNA, 19 nt, Homo sapiens
gacagaauuugugaaggua

SEQ ID NO: 120072 - RNA, 19 nt, Homo sapiens
gcaaaguuccauaaagaau

SEQ ID NO: 120073 - RNA, 19 nt, Homo sapiens
uugcaaaguuccauaaaga

SEQ ID NO: 120074 - RNA, 19 nt, Homo sapiens
gcagggagcauuccuugug

SEQ ID NO: 120075 - RNA, 19 nt, Homo sapiens
caucaaugacuuuaccaua

SEQ ID NO: 120076 - RNA, 19 nt, Homo sapiens
gccagaagguaaucacuca

SEQ ID NO: 120077 - RNA, 19 nt, Homo sapiens
ugaacacccugcucuacaa

SEQ ID NO: 120078 - RNA, 19 nt, Homo sapiens
gaaacuacaagagcuagaa

SEQ ID NO: 120079 - RNA, 19 nt, Homo sapiens
guaacugauucuggacaua

SEQ ID NO: 120080 - RNA, 19 nt, Homo sapiens
ggaccaagagacagugaaa

SEQ ID NO: 120081 - RNA, 19 nt, Homo sapiens
cgaccaacuucuguuauug

SEQ ID NO: 120082 - RNA, 19 nt, Homo sapiens
agacuaggaugugauuuau

SEQ ID NO: 120083 - RNA, 19 nt, Homo sapiens
cuacaauguugcaucaaga

SEQ ID NO: 120084 - RNA, 19 nt, Homo sapiens
cuucuguuauuguguguua

SEQ ID NO: 120085 - RNA, 19 nt, Homo sapiens
ggaugugauuuauuaacga

SEQ ID NO: 120086 - RNA, 19 nt, Homo sapiens
cgacugcacuguggagaug

SEQ ID NO: 120087 - RNA, 19 nt, Homo sapiens
agacagcgauuggacagaa

SEQ ID NO: 120088 - RNA, 19 nt, Homo sapiens
cauaaagaauggcccuugu

SEQ ID NO: 120089 - RNA, 19 nt, Homo sapiens
guggacagauuuauauugg

SEQ ID NO: 120090 - RNA, 19 nt, Homo sapiens
aagacuaggaugugauuua

SEQ ID NO: 120091 - RNA, 19 nt, Homo sapiens
gaagaugucgucugcuuac

SEQ ID NO: 120092 - RNA, 19 nt, Homo sapiens
ggaaauccacgagaagguu

SEQ ID NO: 120093 - RNA, 19 nt, Homo sapiens
gcauaggauugaagacagu

SEQ ID NO: 120094 - RNA, 19 nt, Homo sapiens
gcacgcauaggauugaaga

SEQ ID NO: 120095 - RNA, 19 nt, Homo sapiens
gcucaauggugccacauac

SEQ ID NO: 120096 - RNA, 19 nt, Homo sapiens
ucuacacccugcaggauuu

SEQ ID NO: 120097 - RNA, 19 nt, Homo sapiens
gagaaugccagaagguaau

SEQ ID NO: 120098 - RNA, 19 nt, Homo sapiens
caaaguuccauaaagaaug

SEQ ID NO: 120099 - RNA, 19 nt, Homo sapiens
ucugagaguugcaaaguuc

SEQ ID NO: 120100 - RNA, 19 nt, Homo sapiens
guucuuagaggacugcuuu

SEQ ID NO: 120101 - RNA, 19 nt, Homo sapiens
caucaagaguucaaacaac

SEQ ID NO: 120102 - RNA, 19 nt, Homo sapiens
ggauggucuuuguaacuga

SEQ ID NO: 120103 - RNA, 19 nt, Homo sapiens
cagaaagcuuaagaaauug

SEQ ID NO: 120104 - RNA, 19 nt, Homo sapiens
cagggagcauuccuuguga

SEQ ID NO: 120105 - RNA, 19 nt, Homo sapiens
guauuaaguuucacaagcu

SEQ ID NO: 120106 - RNA, 19 nt, Homo sapiens
gaaguucaaggcccugaga

SEQ ID NO: 120107 - RNA, 19 nt, Homo sapiens
caagucgguuguaaguuca

SEQ ID NO: 120108 - RNA, 19 nt, Homo sapiens
caagaguucaaacaacaaa

SEQ ID NO: 120109 - RNA, 19 nt, Homo sapiens
gcaucaagaguucaaacaa

SEQ ID NO: 120110 - RNA, 19 nt, Homo sapiens
agaaucggauggucuuugu

SEQ ID NO: 120111 - RNA, 19 nt, Homo sapiens
gcaaucucaacgaacauaa

SEQ ID NO: 120112 - RNA, 19 nt, Homo sapiens
ucauugauguugcaguguu

SEQ ID NO: 120113 - RNA, 19 nt, Homo sapiens
ucgcaucccagaaagcuua

SEQ ID NO: 120114 - RNA, 19 nt, Homo sapiens
gcgggcaagucgguuguaa

SEQ ID NO: 120115 - RNA, 19 nt, Homo sapiens
aagcgccucucacaucuga

SEQ ID NO: 120116 - RNA, 19 nt, Homo sapiens
uagaguuuguggacagauu

SEQ ID NO: 120117 - RNA, 19 nt, Homo sapiens
ugaagaugucgucugcuua

SEQ ID NO: 120118 - RNA, 19 nt, Homo sapiens
guaauagaccagcaagcaa

SEQ ID NO: 120119 - RNA, 19 nt, Homo sapiens
ggacugcuuugccuuuuga

SEQ ID NO: 120120 - RNA, 19 nt, Homo sapiens
guaaaacccucugaugaug

SEQ ID NO: 120121 - RNA, 19 nt, Homo sapiens
gggcaagucgguuguaagu

SEQ ID NO: 120122 - RNA, 19 nt, Homo sapiens
cugaagaugucgucugcuu

SEQ ID NO: 120123 - RNA, 19 nt, Homo sapiens
ggaggaacacguggcugua

SEQ ID NO: 120124 - RNA, 19 nt, Homo sapiens
gaucugagaguugcaaagu

SEQ ID NO: 120125 - RNA, 19 nt, Homo sapiens
gguuguaaguucaguaaaa

SEQ ID NO: 120126 - RNA, 19 nt, Homo sapiens
gaacacccugcucuacaau

SEQ ID NO: 120127 - RNA, 19 nt, Homo sapiens
acgaccaacuucuguuauu

SEQ ID NO: 120128 - RNA, 19 nt, Homo sapiens
cuggacauaugcaucauug

SEQ ID NO: 120129 - RNA, 19 nt, Homo sapiens
uaacugauucuggacauau

SEQ ID NO: 120130 - RNA, 19 nt, Homo sapiens
gguaaucacucagauacac

SEQ ID NO: 120131 - RNA, 19 nt, Homo sapiens
cuuaagaaauugugugaac

SEQ ID NO: 120132 - RNA, 19 nt, Homo sapiens
uggauucagcgucauauuu

SEQ ID NO: 120133 - RNA, 19 nt, Homo sapiens
ucucacaucugaacugcau

SEQ ID NO: 120134 - RNA, 19 nt, Homo sapiens
ggaaauccccauccuguga

SEQ ID NO: 120135 - RNA, 19 nt, Homo sapiens
ggacagcccaucgugugaa

SEQ ID NO: 120136 - RNA, 19 nt, Homo sapiens
uuacggaagcgcugaaaga

SEQ ID NO: 120137 - RNA, 19 nt, Homo sapiens
aaucggauggucuuuguaa

SEQ ID NO: 120138 - RNA, 19 nt, Homo sapiens
uaauagaccagcaagcaau

SEQ ID NO: 120139 - RNA, 19 nt, Homo sapiens
caaggaauucuuugucaca

SEQ ID NO: 120140 - RNA, 19 nt, Homo sapiens
cgcaggaaauccacgagaa

SEQ ID NO: 120141 - RNA, 19 nt, Homo sapiens
guugcaaaguuccauaaag

SEQ ID NO: 120142 - RNA, 19 nt, Homo sapiens
gaguuuguggacagauuua

SEQ ID NO: 120143 - RNA, 19 nt, Homo sapiens
gaguugcaaaguuccauaa

SEQ ID NO: 120144 - RNA, 19 nt, Homo sapiens
caucugcacuccucacacu

SEQ ID NO: 120145 - RNA, 19 nt, Homo sapiens
caggguccguugaaagaug

SEQ ID NO: 120146 - RNA, 19 nt, Homo sapiens
gauucagcgucauauuuua

SEQ ID NO: 120147 - RNA, 19 nt, Homo sapiens
gauaagcacaaagucaaga

SEQ ID NO: 120148 - RNA, 19 nt, Homo sapiens
acacccugcucuacaaugu

SEQ ID NO: 120149 - RNA, 19 nt, Homo sapiens
cagagaaugccagaaggua

SEQ ID NO: 120150 - RNA, 19 nt, Homo sapiens
agucagagcccuucagcuu

SEQ ID NO: 120151 - RNA, 19 nt, Homo sapiens
ggauucagcgucauauuuu

SEQ ID NO: 120152 - RNA, 19 nt, Homo sapiens
gcccaucgugugaacuaua

SEQ ID NO: 120153 - RNA, 19 nt, Homo sapiens
cagaauuugugaagguauc

SEQ ID NO: 120154 - RNA, 19 nt, Homo sapiens
ccagaaagcuuaagaaauu

SEQ ID NO: 120155 - RNA, 19 nt, Homo sapiens
gcaagucgguuguaaguuc

SEQ ID NO: 120156 - RNA, 19 nt, Homo sapiens
guagacaccugcacgcaua

SEQ ID NO: 120157 - RNA, 19 nt, Homo sapiens
caucugaacugcauacuga

SEQ ID NO: 120158 - RNA, 19 nt, Homo sapiens
gggaggaccuggagaaguu

SEQ ID NO: 120159 - RNA, 19 nt, Homo sapiens
gcacugcaaucucaacgaa

SEQ ID NO: 120160 - RNA, 19 nt, Homo sapiens
gaaagcaucccauccaaga

SEQ ID NO: 120161 - RNA, 19 nt, Homo sapiens
cggaagcgcugaaagacua

SEQ ID NO: 120162 - RNA, 19 nt, Homo sapiens
ggaauucuuugucacauca

SEQ ID NO: 120163 - RNA, 19 nt, Homo sapiens
gaagguaaucacucagaua

SEQ ID NO: 120164 - RNA, 19 nt, Homo sapiens
caagauggcuuacgagacu

SEQ ID NO: 120165 - RNA, 19 nt, Homo sapiens
gaaagacuaggaugugauu

SEQ ID NO: 120166 - RNA, 19 nt, Homo sapiens
gaagcucccugacguaugg

SEQ ID NO: 120167 - RNA, 19 nt, Homo sapiens
cgagaaagccuuagcacaa

SEQ ID NO: 120168 - RNA, 19 nt, Homo sapiens
ugaaggaccuggccacugu

SEQ ID NO: 120169 - RNA, 19 nt, Homo sapiens
ggaccgugcucccugaguu

SEQ ID NO: 120170 - RNA, 19 nt, Homo sapiens
ucagagcccuucagcuuug

SEQ ID NO: 120171 - RNA, 19 nt, Homo sapiens
gagaaagccuuagcacaag

SEQ ID NO: 120172 - RNA, 19 nt, Homo sapiens
gcucuacaauguugcauca

SEQ ID NO: 120173 - RNA, 19 nt, Homo sapiens
ccauggagcugcuaaagag

SEQ ID NO: 120174 - RNA, 19 nt, Homo sapiens
gcagggagcauuccuugug

SEQ ID NO: 120175 - RNA, 19 nt, Homo sapiens
caucaaugacuuuaccaua

SEQ ID NO: 120176 - RNA, 19 nt, Homo sapiens
ggaggccguuuauaacuca

SEQ ID NO: 120177 - RNA, 19 nt, Homo sapiens
gccagaagguaaucacuca

SEQ ID NO: 120178 - RNA, 19 nt, Homo sapiens
ugaacacccugcucuacaa

SEQ ID NO: 120179 - RNA, 19 nt, Homo sapiens
gaaacuacaagagcuagaa

SEQ ID NO: 120180 - RNA, 19 nt, Homo sapiens
guaacugauucuggacaua

SEQ ID NO: 120181 - RNA, 19 nt, Homo sapiens
ggaccaagagacagugaaa

SEQ ID NO: 120182 - RNA, 19 nt, Homo sapiens
cgaccaacuucuguuauug

SEQ ID NO: 120183 - RNA, 19 nt, Homo sapiens
agacuaggaugugauuuau

SEQ ID NO: 120184 - RNA, 19 nt, Homo sapiens
cuacaauguugcaucaaga

SEQ ID NO: 120185 - RNA, 19 nt, Homo sapiens
cuucuguuauuguguguua

SEQ ID NO: 120186 - RNA, 19 nt, Homo sapiens
ggaugugauuuauuaacga

SEQ ID NO: 120187 - RNA, 19 nt, Homo sapiens
cgacugcacuguggagaug

SEQ ID NO: 120188 - RNA, 19 nt, Homo sapiens
aagacuaggaugugauuua

SEQ ID NO: 120189 - RNA, 19 nt, Homo sapiens
gaagaugucgucugcuuac

SEQ ID NO: 120190 - RNA, 19 nt, Homo sapiens
ggaaauccacgagaagguu

SEQ ID NO: 120191 - RNA, 19 nt, Homo sapiens
gcauaggauugaagacagu

SEQ ID NO: 120192 - RNA, 19 nt, Homo sapiens
gcacgcauaggauugaaga

SEQ ID NO: 120193 - RNA, 19 nt, Homo sapiens
gcucaauggugccacauac

SEQ ID NO: 120194 - RNA, 19 nt, Homo sapiens
ucuacacccugcaggauuu

SEQ ID NO: 120195 - RNA, 19 nt, Homo sapiens
ggacgcggauaucaagucu

SEQ ID NO: 120196 - RNA, 19 nt, Homo sapiens
gagaaugccagaagguaau

SEQ ID NO: 120197 - RNA, 19 nt, Homo sapiens
guucccagcaggcauauaa

SEQ ID NO: 120198 - RNA, 19 nt, Homo sapiens
aagcugaccuguccaccuu

SEQ ID NO: 120199 - RNA, 19 nt, Homo sapiens
caucaagaguucaaacaac

SEQ ID NO: 120200 - RNA, 19 nt, Homo sapiens
ggauggucuuuguaacuga

SEQ ID NO: 120201 - RNA, 19 nt, Homo sapiens
cagaaagcuuaagaaauug

SEQ ID NO: 120202 - RNA, 19 nt, Homo sapiens
cagggagcauuccuuguga

SEQ ID NO: 120203 - RNA, 19 nt, Homo sapiens
guauuaaguuucacaagcu

SEQ ID NO: 120204 - RNA, 19 nt, Homo sapiens
gaaguucaaggcccugaga

SEQ ID NO: 120205 - RNA, 19 nt, Homo sapiens
caagucgguuguaaguuca

SEQ ID NO: 120206 - RNA, 19 nt, Homo sapiens
caagaguucaaacaacaaa

SEQ ID NO: 120207 - RNA, 19 nt, Homo sapiens
gcaucaagaguucaaacaa

SEQ ID NO: 120208 - RNA, 19 nt, Homo sapiens
gagaagcucccugacguau

SEQ ID NO: 120209 - RNA, 19 nt, Homo sapiens
agaaucggauggucuuugu

SEQ ID NO: 120210 - RNA, 19 nt, Homo sapiens
gcaaucucaacgaacauaa

SEQ ID NO: 120211 - RNA, 19 nt, Homo sapiens
ggagacggcagccaccuau

SEQ ID NO: 120212 - RNA, 19 nt, Homo sapiens
ucauugauguugcaguguu

SEQ ID NO: 120213 - RNA, 19 nt, Homo sapiens
ucgcaucccagaaagcuua

SEQ ID NO: 120214 - RNA, 19 nt, Homo sapiens
ggaggacgcggauaucaag

SEQ ID NO: 120215 - RNA, 19 nt, Homo sapiens
gcgggcaagucgguuguaa

SEQ ID NO: 120216 - RNA, 19 nt, Homo sapiens
aagcgccucucacaucuga

SEQ ID NO: 120217 - RNA, 19 nt, Homo sapiens
ugaagaugucgucugcuua

SEQ ID NO: 120218 - RNA, 19 nt, Homo sapiens
guaauagaccagcaagcaa

SEQ ID NO: 120219 - RNA, 19 nt, Homo sapiens
guaaaacccucugaugaug

SEQ ID NO: 120220 - RNA, 19 nt, Homo sapiens
gggcaagucgguuguaagu

SEQ ID NO: 120221 - RNA, 19 nt, Homo sapiens
cugaagaugucgucugcuu

SEQ ID NO: 120222 - RNA, 19 nt, Homo sapiens
ggaggaacacguggcugua

SEQ ID NO: 120223 - RNA, 19 nt, Homo sapiens
gguuguaaguucaguaaaa

SEQ ID NO: 120224 - RNA, 19 nt, Homo sapiens
gaacacccugcucuacaau

SEQ ID NO: 120225 - RNA, 19 nt, Homo sapiens
acgaccaacuucuguuauu

SEQ ID NO: 120226 - RNA, 19 nt, Homo sapiens
cuggacauaugcaucauug

SEQ ID NO: 120227 - RNA, 19 nt, Homo sapiens
uaacugauucuggacauau

SEQ ID NO: 120228 - RNA, 19 nt, Homo sapiens
gguaaucacucagauacac

SEQ ID NO: 120229 - RNA, 19 nt, Homo sapiens
cuuaagaaauugugugaac

SEQ ID NO: 120230 - RNA, 19 nt, Homo sapiens
uggauucagcgucauauuu

SEQ ID NO: 120231 - RNA, 19 nt, Homo sapiens
ucucacaucugaacugcau

SEQ ID NO: 120232 - RNA, 19 nt, Homo sapiens
ggaaauccccauccuguga

SEQ ID NO: 120233 - RNA, 19 nt, Homo sapiens
uuacggaagcgcugaaaga

SEQ ID NO: 120234 - RNA, 19 nt, Homo sapiens
aaucggauggucuuuguaa

SEQ ID NO: 120235 - RNA, 19 nt, Homo sapiens
uaauagaccagcaagcaau

SEQ ID NO: 120236 - RNA, 19 nt, Homo sapiens
caaggaauucuuugucaca

SEQ ID NO: 120237 - RNA, 19 nt, Homo sapiens
ccaguucccagcaggcaua

SEQ ID NO: 120238 - RNA, 19 nt, Homo sapiens
gggaggccguuuauaacuc

SEQ ID NO: 120239 - RNA, 19 nt, Homo sapiens
cgcaggaaauccacgagaa

SEQ ID NO: 120240 - RNA, 19 nt, Homo sapiens
cagcuuacuccacggcaua

SEQ ID NO: 120241 - RNA, 19 nt, Homo sapiens
caucugcacuccucacacu

SEQ ID NO: 120242 - RNA, 19 nt, Homo sapiens
caggguccguugaaagaug

SEQ ID NO: 120243 - RNA, 19 nt, Homo sapiens
gauucagcgucauauuuua

SEQ ID NO: 120244 - RNA, 19 nt, Homo sapiens
gucaugggauccaaugcaa

SEQ ID NO: 120245 - RNA, 19 nt, Homo sapiens
acacccugcucuacaaugu

SEQ ID NO: 120246 - RNA, 19 nt, Homo sapiens
cccagcaggcauauaaaua

SEQ ID NO: 120247 - RNA, 19 nt, Homo sapiens
cagagaaugccagaaggua

SEQ ID NO: 120248 - RNA, 19 nt, Homo sapiens
agucagagcccuucagcuu

SEQ ID NO: 120249 - RNA, 19 nt, Homo sapiens
ggauucagcgucauauuuu

SEQ ID NO: 120250 - RNA, 19 nt, Homo sapiens
uuucaucugugcaucaaau

SEQ ID NO: 120251 - RNA, 19 nt, Homo sapiens
gaacgucaugggauccaau

SEQ ID NO: 120252 - RNA, 19 nt, Homo sapiens
gaccaacuucuguuauugu

SEQ ID NO: 120253 - RNA, 19 nt, Homo sapiens
cugaaagacuaggauguga

SEQ ID NO: 120254 - RNA, 19 nt, Homo sapiens
gcucuuagcugucuccauu

SEQ ID NO: 120255 - RNA, 19 nt, Homo sapiens
caccacagccggcuaauuu

SEQ ID NO: 120256 - RNA, 19 nt, Homo sapiens
ccucagcccugucccuuug

SEQ ID NO: 120257 - RNA, 19 nt, Homo sapiens
guacaucucagccuuaucu

SEQ ID NO: 120258 - RNA, 19 nt, Homo sapiens
cccguucucuuaacucuug

SEQ ID NO: 120259 - RNA, 19 nt, Homo sapiens
gacgagguuucgccauguu

SEQ ID NO: 120260 - RNA, 19 nt, Homo sapiens
caucucagccuuaucucaa

SEQ ID NO: 120261 - RNA, 19 nt, Homo sapiens
ggaaggcuacuccgcaucu

SEQ ID NO: 120262 - RNA, 19 nt, Homo sapiens
cccagccucucuuugcuuu

SEQ ID NO: 120263 - RNA, 19 nt, Homo sapiens
ccucggccuucuuugcuuu

SEQ ID NO: 120264 - RNA, 19 nt, Homo sapiens
gcgcaccuccucaccaaau

SEQ ID NO: 120265 - RNA, 19 nt, Homo sapiens
gcuucagccucccuaagug

SEQ ID NO: 120266 - RNA, 19 nt, Homo sapiens
guguacaucucagccuuau

SEQ ID NO: 120267 - RNA, 19 nt, Homo sapiens
gauguccuccuuuccuuca

SEQ ID NO: 120268 - RNA, 19 nt, Homo sapiens
gcaugguaacuccgucuga

SEQ ID NO: 120269 - RNA, 19 nt, Homo sapiens
cgcaccuccucaccaaaua

SEQ ID NO: 120270 - RNA, 19 nt, Homo sapiens
ggacccuccucgucugcau

SEQ ID NO: 120271 - RNA, 19 nt, Homo sapiens
gucugucugucugcucuua

SEQ ID NO: 120272 - RNA, 19 nt, Homo sapiens
ccuuugauguccuccuuuc

SEQ ID NO: 120273 - RNA, 19 nt, Homo sapiens
ccgucugagucuaccauuu

SEQ ID NO: 120274 - RNA, 19 nt, Homo sapiens
cuccucgucugcaugguaa

SEQ ID NO: 120275 - RNA, 19 nt, Homo sapiens
agacgagguuucgccaugu

SEQ ID NO: 120276 - RNA, 19 nt, Homo sapiens
ccuugggccugccucaguu

SEQ ID NO: 120277 - RNA, 19 nt, Homo sapiens
ccuaagugcugggauugca

SEQ ID NO: 120278 - RNA, 19 nt, Homo sapiens
gggagggaagucuggaaga

SEQ ID NO: 120279 - RNA, 19 nt, Homo sapiens
caucuggccgucucucugu

SEQ ID NO: 120280 - RNA, 19 nt, Homo sapiens
gaacaaauggccuuuauua

SEQ ID NO: 120281 - RNA, 19 nt, Homo sapiens
gcaagugaauuuccuguaa

SEQ ID NO: 120282 - RNA, 19 nt, Homo sapiens
cuauauagcugaucaguuu

SEQ ID NO: 120283 - RNA, 19 nt, Homo sapiens
gcaccagaauguauauuaa

SEQ ID NO: 120284 - RNA, 19 nt, Homo sapiens
ucagauagcucuuauacga

SEQ ID NO: 120285 - RNA, 19 nt, Homo sapiens
gcaccagcaugaagacaua

SEQ ID NO: 120286 - RNA, 19 nt, Homo sapiens
gaaugacacuguucaggaa

SEQ ID NO: 120287 - RNA, 19 nt, Homo sapiens
ugaagaauguuaagacuug

SEQ ID NO: 120288 - RNA, 19 nt, Homo sapiens
gagagacauuaacucauua

SEQ ID NO: 120289 - RNA, 19 nt, Homo sapiens
caccauagguagaauguaa

SEQ ID NO: 120290 - RNA, 19 nt, Homo sapiens
uaaauucuguggaguaugu

SEQ ID NO: 120291 - RNA, 19 nt, Homo sapiens
gaaguguaauugagaagga

SEQ ID NO: 120292 - RNA, 19 nt, Homo sapiens
ugagucaaguuguuccuua

SEQ ID NO: 120293 - RNA, 19 nt, Homo sapiens
gcagaaagguuaguaucau

SEQ ID NO: 120294 - RNA, 19 nt, Homo sapiens
guacacagcaccagaaugu

SEQ ID NO: 120295 - RNA, 19 nt, Homo sapiens
gaagacauaccgagcuaaa

SEQ ID NO: 120296 - RNA, 19 nt, Homo sapiens
gacauuaacucauuagacu

SEQ ID NO: 120297 - RNA, 19 nt, Homo sapiens
gaccaaaaguuacauguuu

SEQ ID NO: 120298 - RNA, 19 nt, Homo sapiens
gcaggcugauuucuaggua

SEQ ID NO: 120299 - RNA, 19 nt, Homo sapiens
gcauuuguuucuacuuuga

SEQ ID NO: 120300 - RNA, 19 nt, Homo sapiens
gcacaagggccucuucugu

SEQ ID NO: 120301 - RNA, 19 nt, Homo sapiens
acaagggccucuucuguga

SEQ ID NO: 120302 - RNA, 19 nt, Homo sapiens
gcaugaagccagagaguga

SEQ ID NO: 120303 - RNA, 19 nt, Homo sapiens
agcaugaaauggauacuua

SEQ ID NO: 120304 - RNA, 19 nt, Homo sapiens
gaauguaaagcuugucuga

SEQ ID NO: 120305 - RNA, 19 nt, Homo sapiens
cgaguaauaugccugcuau

SEQ ID NO: 120306 - RNA, 19 nt, Homo sapiens
gagucaaguuguuccuuaa

SEQ ID NO: 120307 - RNA, 19 nt, Homo sapiens
acaaugacaucuuugaauc

SEQ ID NO: 120308 - RNA, 19 nt, Homo sapiens
gcuaaauucuguggaguau

SEQ ID NO: 120309 - RNA, 19 nt, Homo sapiens
aagcugaccuggaagagaa

SEQ ID NO: 120310 - RNA, 19 nt, Homo sapiens
cggagacaaugacaucuuu

SEQ ID NO: 120311 - RNA, 19 nt, Homo sapiens
gguaccagcagaaagguua

SEQ ID NO: 120312 - RNA, 19 nt, Homo sapiens
gaagaauguuaagacuuga

SEQ ID NO: 120313 - RNA, 19 nt, Homo sapiens
agacauaccgagcuaaauu

SEQ ID NO: 120314 - RNA, 19 nt, Homo sapiens
ccacccggguuaccaauga

SEQ ID NO: 120315 - RNA, 19 nt, Homo sapiens
gguagaauguaaagcuugu

SEQ ID NO: 120316 - RNA, 19 nt, Homo sapiens
guguguguguguauauaua

SEQ ID NO: 120317 - RNA, 19 nt, Homo sapiens
ucauuagacuggaacuuga

SEQ ID NO: 120318 - RNA, 19 nt, Homo sapiens
gaaauggauacuuauaugg

SEQ ID NO: 120319 - RNA, 19 nt, Homo sapiens
guaaauauugugugugugu

SEQ ID NO: 120320 - RNA, 19 nt, Homo sapiens
gcucuuauacgaguaauau

SEQ ID NO: 120321 - RNA, 19 nt, Homo sapiens
gcgaggucaugaagaagaa

SEQ ID NO: 120322 - RNA, 19 nt, Homo sapiens
uugcgaagcugaccuggaa

SEQ ID NO: 120323 - RNA, 19 nt, Homo sapiens
gacaaugacaucuuugaau

SEQ ID NO: 120324 - RNA, 19 nt, Homo sapiens
ugacaguggaacuacauua

SEQ ID NO: 120325 - RNA, 19 nt, Homo sapiens
gagacaaugacaucuuuga

SEQ ID NO: 120326 - RNA, 19 nt, Homo sapiens
uggaagagaacauuaagaa

SEQ ID NO: 120327 - RNA, 19 nt, Homo sapiens
guuugcaccuuucuaguug

SEQ ID NO: 120328 - RNA, 19 nt, Homo sapiens
ggaaauucucucagauaga

SEQ ID NO: 120329 - RNA, 19 nt, Homo sapiens
auauuaagguguggcuuua

SEQ ID NO: 120330 - RNA, 19 nt, Homo sapiens
auaccgagcuaaauucugu

SEQ ID NO: 120331 - RNA, 19 nt, Homo sapiens
ccagacccaacuaugauua

SEQ ID NO: 120332 - RNA, 19 nt, Homo sapiens
ucggacaguuuauuuguug

SEQ ID NO: 120333 - RNA, 19 nt, Homo sapiens
gcucugacauucugauucg

SEQ ID NO: 120334 - RNA, 19 nt, Homo sapiens
gacacugguuugaagaaug

SEQ ID NO: 120335 - RNA, 19 nt, Homo sapiens
ggucaggccuugcgaagcu

SEQ ID NO: 120336 - RNA, 19 nt, Homo sapiens
gaacaccauagguagaaug

SEQ ID NO: 120337 - RNA, 19 nt, Homo sapiens
cagaaagguuaguaucauc

SEQ ID NO: 120338 - RNA, 19 nt, Homo sapiens
acacugguuugaagaaugu

SEQ ID NO: 120339 - RNA, 19 nt, Homo sapiens
ggaagcauuuguuucuacu

SEQ ID NO: 120340 - RNA, 19 nt, Homo sapiens
cgauuagacuggacagcuu

SEQ ID NO: 120341 - RNA, 19 nt, Homo sapiens
cuccaagccuaucaaguuu

SEQ ID NO: 120342 - RNA, 19 nt, Homo sapiens
uggaaauucucucagauag

SEQ ID NO: 120343 - RNA, 19 nt, Homo sapiens
ccugcuauuugaaguguaa

SEQ ID NO: 120344 - RNA, 19 nt, Homo sapiens
caguagcacaaguuauuua

SEQ ID NO: 120345 - RNA, 19 nt, Homo sapiens
ucuccaagccuaucaaguu

SEQ ID NO: 120346 - RNA, 19 nt, Homo sapiens
gaccuggaagagaacauua

SEQ ID NO: 120347 - RNA, 19 nt, Homo sapiens
gacuggaacuugaacugau

SEQ ID NO: 120348 - RNA, 19 nt, Homo sapiens
aagcuugucugaucguuca

SEQ ID NO: 120349 - RNA, 19 nt, Homo sapiens
caagugaauuuccuguaac

SEQ ID NO: 120350 - RNA, 19 nt, Homo sapiens
caucagauagcucuuauac

SEQ ID NO: 120351 - RNA, 19 nt, Homo sapiens
acacagcaccagaauguau

SEQ ID NO: 120352 - RNA, 19 nt, Homo sapiens
ucaauguuagccucaauuu

SEQ ID NO: 120353 - RNA, 19 nt, Homo sapiens
uauauuaagguguggcuuu

SEQ ID NO: 120354 - RNA, 19 nt, Homo sapiens
gugcauccguacucccaaa

SEQ ID NO: 120355 - RNA, 19 nt, Homo sapiens
ggaagagaacauuaagaag

SEQ ID NO: 120356 - RNA, 19 nt, Homo sapiens
gauagcucuuauacgagua

SEQ ID NO: 120357 - RNA, 19 nt, Homo sapiens
gaagcugaccuggaagaga

SEQ ID NO: 120358 - RNA, 19 nt, Homo sapiens
uuacauguuugcaccuuuc

SEQ ID NO: 120359 - RNA, 19 nt, Homo sapiens
ucaaguuguuccuuaaguc

SEQ ID NO: 120360 - RNA, 19 nt, Homo sapiens
gacaguuuauuuguugaga

SEQ ID NO: 120361 - RNA, 19 nt, Homo sapiens
gcgaggaguggguguguga

SEQ ID NO: 120362 - RNA, 19 nt, Homo sapiens
ccagagagugagagacauu

SEQ ID NO: 120363 - RNA, 19 nt, Homo sapiens
guccuuggcaggcugauuu

SEQ ID NO: 120364 - RNA, 19 nt, Homo sapiens
auauggaaauucucucaga

SEQ ID NO: 120365 - RNA, 19 nt, Homo sapiens
ggcccagacccaacuauga

SEQ ID NO: 120366 - RNA, 19 nt, Homo sapiens
guuacauguuugcaccuuu

SEQ ID NO: 120367 - RNA, 19 nt, Homo sapiens
augaacaaauggccuuuau

SEQ ID NO: 120368 - RNA, 19 nt, Homo sapiens
auguaaagcuugucugauc

SEQ ID NO: 120369 - RNA, 19 nt, Homo sapiens
uagguagaauguaaagcuu

SEQ ID NO: 120370 - RNA, 19 nt, Homo sapiens
caaguuguuccuuaaguca

SEQ ID NO: 120371 - RNA, 19 nt, Homo sapiens
gaacugauucacaucucau

SEQ ID NO: 120372 - RNA, 19 nt, Homo sapiens
cuagguaggaaauguggua

SEQ ID NO: 120373 - RNA, 19 nt, Homo sapiens
gcugauuucuagguaggaa

SEQ ID NO: 120374 - RNA, 19 nt, Homo sapiens
gcaugaaauggauacuuau

SEQ ID NO: 120375 - RNA, 19 nt, Homo sapiens
aauguuagccucaauuucu

SEQ ID NO: 120376 - RNA, 19 nt, Homo sapiens
guguguguguguguauaua

SEQ ID NO: 120377 - RNA, 19 nt, Homo sapiens
cacagcaccagaauguaua

SEQ ID NO: 120378 - RNA, 19 nt, Homo sapiens
gaaaagauucccacccaau

SEQ ID NO: 120379 - RNA, 19 nt, Homo sapiens
gacauaccgagcuaaauuc

SEQ ID NO: 120380 - RNA, 19 nt, Homo sapiens
gaucaaaucuuccugagua

SEQ ID NO: 120381 - RNA, 19 nt, Homo sapiens
gagcugauauuucuaugua

SEQ ID NO: 120382 - RNA, 19 nt, Homo sapiens
gcaaguggcaucugaauuu

SEQ ID NO: 120383 - RNA, 19 nt, Homo sapiens
gaauauagccguucuggaa

SEQ ID NO: 120384 - RNA, 19 nt, Homo sapiens
gcaguuccaucuccuauug

SEQ ID NO: 120385 - RNA, 19 nt, Homo sapiens
aagcaaugguuuacacuua

SEQ ID NO: 120386 - RNA, 19 nt, Homo sapiens
guaauuaaauggaccaaca

SEQ ID NO: 120387 - RNA, 19 nt, Homo sapiens
ggaaaucccacuaggaauu

SEQ ID NO: 120388 - RNA, 19 nt, Homo sapiens
ccacagugauguuguaaug

SEQ ID NO: 120389 - RNA, 19 nt, Homo sapiens
gugcacauauuguccauaa

SEQ ID NO: 120390 - RNA, 19 nt, Homo sapiens
guucuuaaaucaaguguga

SEQ ID NO: 120391 - RNA, 19 nt, Homo sapiens
caucuccuauugauuguua

SEQ ID NO: 120392 - RNA, 19 nt, Homo sapiens
ucaagaaccuaaagcuauu

SEQ ID NO: 120393 - RNA, 19 nt, Homo sapiens
gaaggugauugacauugaa

SEQ ID NO: 120394 - RNA, 19 nt, Homo sapiens
ggccuuugcuucagguuua

SEQ ID NO: 120395 - RNA, 19 nt, Homo sapiens
guacagggauggucaccuu

SEQ ID NO: 120396 - RNA, 19 nt, Homo sapiens
uaauagacuucguuucuug

SEQ ID NO: 120397 - RNA, 19 nt, Homo sapiens
ggucaauucuguuaauauc

SEQ ID NO: 120398 - RNA, 19 nt, Homo sapiens
uuaaauggaccaacaauga

SEQ ID NO: 120399 - RNA, 19 nt, Homo sapiens
uaaggcaccucauuaucuu

SEQ ID NO: 120400 - RNA, 19 nt, Homo sapiens
agagauguccuuggaauua

SEQ ID NO: 120401 - RNA, 19 nt, Homo sapiens
ugaaggcugugcacauauu

SEQ ID NO: 120402 - RNA, 19 nt, Homo sapiens
ggaagucacagcuaguauu

SEQ ID NO: 120403 - RNA, 19 nt, Homo sapiens
caaaucuuccugaguaauu

SEQ ID NO: 120404 - RNA, 19 nt, Homo sapiens
cgaauguucuuaaaucaag

SEQ ID NO: 120405 - RNA, 19 nt, Homo sapiens
ugaaggaggugagauuugu

SEQ ID NO: 120406 - RNA, 19 nt, Homo sapiens
uuagggaucaucucuguua

SEQ ID NO: 120407 - RNA, 19 nt, Homo sapiens
gaagucacagcuaguauuc

SEQ ID NO: 120408 - RNA, 19 nt, Homo sapiens
agaaggugauugacauuga

SEQ ID NO: 120409 - RNA, 19 nt, Homo sapiens
gguuauaucuucgguguuc

SEQ ID NO: 120410 - RNA, 19 nt, Homo sapiens
gaaaucccacuaggaauug

SEQ ID NO: 120411 - RNA, 19 nt, Homo sapiens
gcacucggguuuugaauau

SEQ ID NO: 120412 - RNA, 19 nt, Homo sapiens
uuccagagcugcuauuaga

SEQ ID NO: 120413 - RNA, 19 nt, Homo sapiens
gcaucugaauuuggauuaa

SEQ ID NO: 120414 - RNA, 19 nt, Homo sapiens
caaguggcaucugaauuug

SEQ ID NO: 120415 - RNA, 19 nt, Homo sapiens
gaugauguguauggaggua

SEQ ID NO: 120416 - RNA, 19 nt, Homo sapiens
ggaccaacaaugagccuuu

SEQ ID NO: 120417 - RNA, 19 nt, Homo sapiens
agacuucguuucuugcaaa

SEQ ID NO: 120418 - RNA, 19 nt, Homo sapiens
cauaauagacuucguuucu

SEQ ID NO: 120419 - RNA, 19 nt, Homo sapiens
gcagccacuguaacuauua

SEQ ID NO: 120420 - RNA, 19 nt, Homo sapiens
gcucuauguuugccucuga

SEQ ID NO: 120421 - RNA, 19 nt, Homo sapiens
acucaugcaucaguucuua

SEQ ID NO: 120422 - RNA, 19 nt, Homo sapiens
cuacauguccgaauggaaa

SEQ ID NO: 120423 - RNA, 19 nt, Homo sapiens
uaaguacuguuuggccuuu

SEQ ID NO: 120424 - RNA, 19 nt, Homo sapiens
caggucaauucuguuaaua

SEQ ID NO: 120425 - RNA, 19 nt, Homo sapiens
gugcuacuuugggagauua

SEQ ID NO: 120426 - RNA, 19 nt, Homo sapiens
acagagauguccuuggaau

SEQ ID NO: 120427 - RNA, 19 nt, Homo sapiens
gaccaacaaugagccuuug

SEQ ID NO: 120428 - RNA, 19 nt, Homo sapiens
aggaagaccuacuggaaga

SEQ ID NO: 120429 - RNA, 19 nt, Homo sapiens
gagauguccuuggaauuag

SEQ ID NO: 120430 - RNA, 19 nt, Homo sapiens
uaaugggccuggugucugu

SEQ ID NO: 120431 - RNA, 19 nt, Homo sapiens
ugagauuugugcuacuuug

SEQ ID NO: 120432 - RNA, 19 nt, Homo sapiens
gggcuuagaggaugaggaa

SEQ ID NO: 120433 - RNA, 19 nt, Homo sapiens
uaagggcacucuucagcau

SEQ ID NO: 120434 - RNA, 19 nt, Homo sapiens
ucugggagcugauauuucu

SEQ ID NO: 120435 - RNA, 19 nt, Homo sapiens
ggugagauuugugcuacuu

SEQ ID NO: 120436 - RNA, 19 nt, Homo sapiens
ugaggaagaccuacuggaa

SEQ ID NO: 120437 - RNA, 19 nt, Homo sapiens
ggccuggugucuguuaauu

SEQ ID NO: 120438 - RNA, 19 nt, Homo sapiens
aagcauggagacauuauuu

SEQ ID NO: 120439 - RNA, 19 nt, Homo sapiens
aaagcaggagaccaaauua

SEQ ID NO: 120440 - RNA, 19 nt, Homo sapiens
gagcuugggaggauucgaa

SEQ ID NO: 120441 - RNA, 19 nt, Homo sapiens
gccgagagcuugggaggau

SEQ ID NO: 120442 - RNA, 19 nt, Homo sapiens
ccuggugucuguuaauugu

SEQ ID NO: 120443 - RNA, 19 nt, Homo sapiens
gcaacaaaauacaugaaug

SEQ ID NO: 120444 - RNA, 19 nt, Homo sapiens
auugaaggcugugcacaua

SEQ ID NO: 120445 - RNA, 19 nt, Homo sapiens
agcaaugguuuacacuuaa

SEQ ID NO: 120446 - RNA, 19 nt, Homo sapiens
aaagacgccuccucacaag

SEQ ID NO: 120447 - RNA, 19 nt, Homo sapiens
ggaggugagauuugugcua

SEQ ID NO: 120448 - RNA, 19 nt, Homo sapiens
gggaucaucucuguuaaaa

SEQ ID NO: 120449 - RNA, 19 nt, Homo sapiens
caacaaugagccuuugcaa

SEQ ID NO: 120450 - RNA, 19 nt, Homo sapiens
gagcuuccggcaaucauga

SEQ ID NO: 120451 - RNA, 19 nt, Homo sapiens
gcacauauuguccauaagc

SEQ ID NO: 120452 - RNA, 19 nt, Homo sapiens
acuaggaauugccuugaaa

SEQ ID NO: 120453 - RNA, 19 nt, Homo sapiens
acaaugagccuuugcaaaa

SEQ ID NO: 120454 - RNA, 19 nt, Homo sapiens
gggccaggauccagagcaa

SEQ ID NO: 120455 - RNA, 19 nt, Homo sapiens
gcagcacacccuccaagug

SEQ ID NO: 120456 - RNA, 19 nt, Homo sapiens
ugccacacuuccaacauuu

SEQ ID NO: 120457 - RNA, 19 nt, Homo sapiens
gagcaguuccaucuccuau

SEQ ID NO: 120458 - RNA, 19 nt, Homo sapiens
gcaauuacaccagaaacca

SEQ ID NO: 120459 - RNA, 19 nt, Homo sapiens
gcagcaauuacaccagaaa

SEQ ID NO: 120460 - RNA, 19 nt, Homo sapiens
gcuuagaggaugaggaaga

SEQ ID NO: 120461 - RNA, 19 nt, Homo sapiens
gaaggcugugcacauauug

SEQ ID NO: 120462 - RNA, 19 nt, Homo sapiens
ccacgcaggcgauccaugu

SEQ ID NO: 120463 - RNA, 19 nt, Homo sapiens
cugccacacuuccaacauu

SEQ ID NO: 120464 - RNA, 19 nt, Homo sapiens
ccucaagaaccuaaagcua

SEQ ID NO: 120465 - RNA, 19 nt, Homo sapiens
cauaagcauggagacauua

SEQ ID NO: 120466 - RNA, 19 nt, Homo sapiens
uagcagccacuguaacuau

SEQ ID NO: 120467 - RNA, 19 nt, Homo sapiens
caaguggaagucacagcua

SEQ ID NO: 120468 - RNA, 19 nt, Homo sapiens
aagcgucaguguacagguu

SEQ ID NO: 120469 - RNA, 19 nt, Homo sapiens
gacucuacauguccgaaug

SEQ ID NO: 120470 - RNA, 19 nt, Homo sapiens
auacaugaauggccacagu

SEQ ID NO: 120471 - RNA, 19 nt, Homo sapiens
uuacuagaggcagcaauua

SEQ ID NO: 120472 - RNA, 19 nt, Homo sapiens
uuugggagauuauguucuu

SEQ ID NO: 120473 - RNA, 19 nt, Homo sapiens
uagggaucaucucuguuaa

SEQ ID NO: 120474 - RNA, 19 nt, Homo sapiens
ggcaucugaauuuggauua

SEQ ID NO: 120475 - RNA, 19 nt, Homo sapiens
caagaaccuaaagcuauuu

SEQ ID NO: 120476 - RNA, 19 nt, Homo sapiens
ucugaagacucuacauguc

SEQ ID NO: 120477 - RNA, 19 nt, Homo sapiens
uggccacagugauguugua

SEQ ID NO: 120478 - RNA, 19 nt, Homo sapiens
gaauggccacagugauguu

SEQ ID NO: 120479 - RNA, 19 nt, Homo sapiens
ggucguggauaacacuuuu

SEQ ID NO: 120480 - RNA, 19 nt, Homo sapiens
gaucaaaucuuccugagua

SEQ ID NO: 120481 - RNA, 19 nt, Homo sapiens
gagcugauauuucuaugua

SEQ ID NO: 120482 - RNA, 19 nt, Homo sapiens
gcaaguggcaucugaauuu

SEQ ID NO: 120483 - RNA, 19 nt, Homo sapiens
gaauauagccguucuggaa

SEQ ID NO: 120484 - RNA, 19 nt, Homo sapiens
gcaguuccaucuccuauug

SEQ ID NO: 120485 - RNA, 19 nt, Homo sapiens
aagcaaugguuuacacuua

SEQ ID NO: 120486 - RNA, 19 nt, Homo sapiens
guaauuaaauggaccaaca

SEQ ID NO: 120487 - RNA, 19 nt, Homo sapiens
ggaaaucccacuaggaauu

SEQ ID NO: 120488 - RNA, 19 nt, Homo sapiens
ccacagugauguuguaaug

SEQ ID NO: 120489 - RNA, 19 nt, Homo sapiens
guucuuaaaucaaguguga

SEQ ID NO: 120490 - RNA, 19 nt, Homo sapiens
caucuccuauugauuguua

SEQ ID NO: 120491 - RNA, 19 nt, Homo sapiens
ucaagaaccuaaagcuauu

SEQ ID NO: 120492 - RNA, 19 nt, Homo sapiens
ggccuuugcuucagguuua

SEQ ID NO: 120493 - RNA, 19 nt, Homo sapiens
guacagggauggucaccuu

SEQ ID NO: 120494 - RNA, 19 nt, Homo sapiens
uaauagacuucguuucuug

SEQ ID NO: 120495 - RNA, 19 nt, Homo sapiens
ggucaauucuguuaauauc

SEQ ID NO: 120496 - RNA, 19 nt, Homo sapiens
uuaaauggaccaacaauga

SEQ ID NO: 120497 - RNA, 19 nt, Homo sapiens
uaaggcaccucauuaucuu

SEQ ID NO: 120498 - RNA, 19 nt, Homo sapiens
agagauguccuuggaauua

SEQ ID NO: 120499 - RNA, 19 nt, Homo sapiens
ggaagucacagcuaguauu

SEQ ID NO: 120500 - RNA, 19 nt, Homo sapiens
caaaucuuccugaguaauu

SEQ ID NO: 120501 - RNA, 19 nt, Homo sapiens
cgaauguucuuaaaucaag

SEQ ID NO: 120502 - RNA, 19 nt, Homo sapiens
ugaaggaggugagauuugu

SEQ ID NO: 120503 - RNA, 19 nt, Homo sapiens
uuagggaucaucucuguua

SEQ ID NO: 120504 - RNA, 19 nt, Homo sapiens
gaagucacagcuaguauuc

SEQ ID NO: 120505 - RNA, 19 nt, Homo sapiens
gguuauaucuucgguguuc

SEQ ID NO: 120506 - RNA, 19 nt, Homo sapiens
gaaaucccacuaggaauug

SEQ ID NO: 120507 - RNA, 19 nt, Homo sapiens
gcacucggguuuugaauau

SEQ ID NO: 120508 - RNA, 19 nt, Homo sapiens
uuccagagcugcuauuaga

SEQ ID NO: 120509 - RNA, 19 nt, Homo sapiens
gcaucugaauuuggauuaa

SEQ ID NO: 120510 - RNA, 19 nt, Homo sapiens
caaguggcaucugaauuug

SEQ ID NO: 120511 - RNA, 19 nt, Homo sapiens
gaugauguguauggaggua

SEQ ID NO: 120512 - RNA, 19 nt, Homo sapiens
ggaccaacaaugagccuuu

SEQ ID NO: 120513 - RNA, 19 nt, Homo sapiens
agacuucguuucuugcaaa

SEQ ID NO: 120514 - RNA, 19 nt, Homo sapiens
cauaauagacuucguuucu

SEQ ID NO: 120515 - RNA, 19 nt, Homo sapiens
gcagccacuguaacuauua

SEQ ID NO: 120516 - RNA, 19 nt, Homo sapiens
gcucuauguuugccucuga

SEQ ID NO: 120517 - RNA, 19 nt, Homo sapiens
acucaugcaucaguucuua

SEQ ID NO: 120518 - RNA, 19 nt, Homo sapiens
cuacauguccgaauggaaa

SEQ ID NO: 120519 - RNA, 19 nt, Homo sapiens
uaaguacuguuuggccuuu

SEQ ID NO: 120520 - RNA, 19 nt, Homo sapiens
caggucaauucuguuaaua

SEQ ID NO: 120521 - RNA, 19 nt, Homo sapiens
gugcuacuuugggagauua

SEQ ID NO: 120522 - RNA, 19 nt, Homo sapiens
acagagauguccuuggaau

SEQ ID NO: 120523 - RNA, 19 nt, Homo sapiens
gaccaacaaugagccuuug

SEQ ID NO: 120524 - RNA, 19 nt, Homo sapiens
aggaagaccuacuggaaga

SEQ ID NO: 120525 - RNA, 19 nt, Homo sapiens
gagauguccuuggaauuag

SEQ ID NO: 120526 - RNA, 19 nt, Homo sapiens
uaaugggccuggugucugu

SEQ ID NO: 120527 - RNA, 19 nt, Homo sapiens
ugagauuugugcuacuuug

SEQ ID NO: 120528 - RNA, 19 nt, Homo sapiens
gggcuuagaggaugaggaa

SEQ ID NO: 120529 - RNA, 19 nt, Homo sapiens
uaagggcacucuucagcau

SEQ ID NO: 120530 - RNA, 19 nt, Homo sapiens
ucugggagcugauauuucu

SEQ ID NO: 120531 - RNA, 19 nt, Homo sapiens
ggugagauuugugcuacuu

SEQ ID NO: 120532 - RNA, 19 nt, Homo sapiens
ugaggaagaccuacuggaa

SEQ ID NO: 120533 - RNA, 19 nt, Homo sapiens
ggccuggugucuguuaauu

SEQ ID NO: 120534 - RNA, 19 nt, Homo sapiens
aaagcaggagaccaaauua

SEQ ID NO: 120535 - RNA, 19 nt, Homo sapiens
gagcuugggaggauucgaa

SEQ ID NO: 120536 - RNA, 19 nt, Homo sapiens
gccgagagcuugggaggau

SEQ ID NO: 120537 - RNA, 19 nt, Homo sapiens
ccuggugucuguuaauugu

SEQ ID NO: 120538 - RNA, 19 nt, Homo sapiens
gcaacaaaauacaugaaug

SEQ ID NO: 120539 - RNA, 19 nt, Homo sapiens
agcaaugguuuacacuuaa

SEQ ID NO: 120540 - RNA, 19 nt, Homo sapiens
ggaggugagauuugugcua

SEQ ID NO: 120541 - RNA, 19 nt, Homo sapiens
gggaucaucucuguuaaaa

SEQ ID NO: 120542 - RNA, 19 nt, Homo sapiens
caacaaugagccuuugcaa

SEQ ID NO: 120543 - RNA, 19 nt, Homo sapiens
gagcuuccggcaaucauga

SEQ ID NO: 120544 - RNA, 19 nt, Homo sapiens
aaagacgccuccucacaag

SEQ ID NO: 120545 - RNA, 19 nt, Homo sapiens
acuaggaauugccuugaaa

SEQ ID NO: 120546 - RNA, 19 nt, Homo sapiens
acaaugagccuuugcaaaa

SEQ ID NO: 120547 - RNA, 19 nt, Homo sapiens
gggccaggauccagagcaa

SEQ ID NO: 120548 - RNA, 19 nt, Homo sapiens
gcagcacacccuccaagug

SEQ ID NO: 120549 - RNA, 19 nt, Homo sapiens
gagcaguuccaucuccuau

SEQ ID NO: 120550 - RNA, 19 nt, Homo sapiens
gcaauuacaccagaaacca

SEQ ID NO: 120551 - RNA, 19 nt, Homo sapiens
ugccacacuuccaacauuu

SEQ ID NO: 120552 - RNA, 19 nt, Homo sapiens
gcagcaauuacaccagaaa

SEQ ID NO: 120553 - RNA, 19 nt, Homo sapiens
gcuuagaggaugaggaaga

SEQ ID NO: 120554 - RNA, 19 nt, Homo sapiens
ccacgcaggcgauccaugu

SEQ ID NO: 120555 - RNA, 19 nt, Homo sapiens
ccucaagaaccuaaagcua

SEQ ID NO: 120556 - RNA, 19 nt, Homo sapiens
cugccacacuuccaacauu

SEQ ID NO: 120557 - RNA, 19 nt, Homo sapiens
uagcagccacuguaacuau

SEQ ID NO: 120558 - RNA, 19 nt, Homo sapiens
caaguggaagucacagcua

SEQ ID NO: 120559 - RNA, 19 nt, Homo sapiens
aagcgucaguguacagguu

SEQ ID NO: 120560 - RNA, 19 nt, Homo sapiens
gacucuacauguccgaaug

SEQ ID NO: 120561 - RNA, 19 nt, Homo sapiens
auacaugaauggccacagu

SEQ ID NO: 120562 - RNA, 19 nt, Homo sapiens
uuacuagaggcagcaauua

SEQ ID NO: 120563 - RNA, 19 nt, Homo sapiens
uuugggagauuauguucuu

SEQ ID NO: 120564 - RNA, 19 nt, Homo sapiens
uagggaucaucucuguuaa

SEQ ID NO: 120565 - RNA, 19 nt, Homo sapiens
ggcaucugaauuuggauua

SEQ ID NO: 120566 - RNA, 19 nt, Homo sapiens
caagaaccuaaagcuauuu

SEQ ID NO: 120567 - RNA, 19 nt, Homo sapiens
ucugaagacucuacauguc

SEQ ID NO: 120568 - RNA, 19 nt, Homo sapiens
uggccacagugauguugua

SEQ ID NO: 120569 - RNA, 19 nt, Homo sapiens
gaauggccacagugauguu

SEQ ID NO: 120570 - RNA, 19 nt, Homo sapiens
gcucuaccugcgugcuuua

SEQ ID NO: 120571 - RNA, 19 nt, Homo sapiens
uuguauggaugauguguau

SEQ ID NO: 120572 - RNA, 19 nt, Homo sapiens
ucuuagggaucaucucugu

SEQ ID NO: 120573 - RNA, 19 nt, Homo sapiens
gcaccucauuaucuuucau

SEQ ID NO: 120574 - RNA, 19 nt, Homo sapiens
uuaaggcaccucauuaucu

SEQ ID NO: 120575 - RNA, 19 nt, Homo sapiens
cucaagaaccuaaagcuau

SEQ ID NO: 120576 - RNA, 19 nt, Homo sapiens
cuggaaaucccacuaggaa

SEQ ID NO: 120577 - RNA, 19 nt, Homo sapiens
gccaggauccagagcaaug

SEQ ID NO: 120578 - RNA, 19 nt, Homo sapiens
gaagaccuacuggaagauc

SEQ ID NO: 120579 - RNA, 19 nt, Homo sapiens
gacacacugauucgacuuu

SEQ ID NO: 120580 - RNA, 19 nt, Homo sapiens
gaacaccgcucccauaaag

SEQ ID NO: 120581 - RNA, 19 nt, Homo sapiens
gagaaaccauuaugaagaa

SEQ ID NO: 120582 - RNA, 19 nt, Homo sapiens
caacagagccagaauguga

SEQ ID NO: 120583 - RNA, 19 nt, Homo sapiens
agacagagcugggauguuu

SEQ ID NO: 120584 - RNA, 19 nt, Homo sapiens
guacacaccuuauauuuac

SEQ ID NO: 120585 - RNA, 19 nt, Homo sapiens
gaacccagauuuauguaau

SEQ ID NO: 120586 - RNA, 19 nt, Homo sapiens
gaagagaguccauauuuca

SEQ ID NO: 120587 - RNA, 19 nt, Homo sapiens
ggaauuaaguuagggaaug

SEQ ID NO: 120588 - RNA, 19 nt, Homo sapiens
gggaauucaucucucuuua

SEQ ID NO: 120589 - RNA, 19 nt, Homo sapiens
gaaccucacuauccaagga

SEQ ID NO: 120590 - RNA, 19 nt, Homo sapiens
gggagaagacuauauugua

SEQ ID NO: 120591 - RNA, 19 nt, Homo sapiens
ggagaagacuauauuguac

SEQ ID NO: 120592 - RNA, 19 nt, Homo sapiens
gagaguccauauuucaauu

SEQ ID NO: 120593 - RNA, 19 nt, Homo sapiens
ccucacagcuguuucuuug

SEQ ID NO: 120594 - RNA, 19 nt, Homo sapiens
gaaagcaucacuugggauu

SEQ ID NO: 120595 - RNA, 19 nt, Homo sapiens
ggaauucaucucucuuuaa

SEQ ID NO: 120596 - RNA, 19 nt, Homo sapiens
gcaacggaacccagauuua

SEQ ID NO: 120597 - RNA, 19 nt, Homo sapiens
gcaaaggaguagaaagaca

SEQ ID NO: 120598 - RNA, 19 nt, Homo sapiens
gaguugaccuuccuagaug

SEQ ID NO: 120599 - RNA, 19 nt, Homo sapiens
caaggucauuugcuaacua

SEQ ID NO: 120600 - RNA, 19 nt, Homo sapiens
auacauaucugggaucaaa

SEQ ID NO: 120601 - RNA, 19 nt, Homo sapiens
gaacccaaauuacguguac

SEQ ID NO: 120602 - RNA, 19 nt, Homo sapiens
gaagaagagaguccauauu

SEQ ID NO: 120603 - RNA, 19 nt, Homo sapiens
gcacaaggcucagcugaac

SEQ ID NO: 120604 - RNA, 19 nt, Homo sapiens
aagaagagaguccauauuu

SEQ ID NO: 120605 - RNA, 19 nt, Homo sapiens
gcccugcacucuccuguuu

SEQ ID NO: 120606 - RNA, 19 nt, Homo sapiens
aagcaucacuugggauuaa

SEQ ID NO: 120607 - RNA, 19 nt, Homo sapiens
caacggaacccagauuuau

SEQ ID NO: 120608 - RNA, 19 nt, Homo sapiens
ucgaugggcccaauucuua

SEQ ID NO: 120609 - RNA, 19 nt, Homo sapiens
ccagaaccgugcccagauu

SEQ ID NO: 120610 - RNA, 19 nt, Homo sapiens
gaggagcucaggacacuaa

SEQ ID NO: 120611 - RNA, 19 nt, Homo sapiens
cacaucagcuccacuuuca

SEQ ID NO: 120612 - RNA, 19 nt, Homo sapiens
ggaugcggaacccaaauua

SEQ ID NO: 120613 - RNA, 19 nt, Homo sapiens
guaugcaucuccaggcaaa

SEQ ID NO: 120614 - RNA, 19 nt, Homo sapiens
ggaucaaagcuaucuauau

SEQ ID NO: 120615 - RNA, 19 nt, Homo sapiens
ugagaaaccauuaugaaga

SEQ ID NO: 120616 - RNA, 19 nt, Homo sapiens
gcaaaaugcuaaagaaaag

SEQ ID NO: 120617 - RNA, 19 nt, Homo sapiens
cuaggaagcuccaguucga

SEQ ID NO: 120618 - RNA, 19 nt, Homo sapiens
uaucugggaucaaagcuau

SEQ ID NO: 120619 - RNA, 19 nt, Homo sapiens
uccaagagcugaggcaauu

SEQ ID NO: 120620 - RNA, 19 nt, Homo sapiens
gcuaaagguuguauugcau

SEQ ID NO: 120621 - RNA, 19 nt, Homo sapiens
gaauuaaguuagggaaugg

SEQ ID NO: 120622 - RNA, 19 nt, Homo sapiens
ugaugugggucaaggaauu

SEQ ID NO: 120623 - RNA, 19 nt, Homo sapiens
gaaaaugcaacaacaugua

SEQ ID NO: 120624 - RNA, 19 nt, Homo sapiens
caccuuauauuuacguaug

SEQ ID NO: 120625 - RNA, 19 nt, Homo sapiens
gaauggcacagcccaaaga

SEQ ID NO: 120626 - RNA, 19 nt, Homo sapiens
agaagagaguccauauuuc

SEQ ID NO: 120627 - RNA, 19 nt, Homo sapiens
acaaacaugugguuaaugc

SEQ ID NO: 120628 - RNA, 19 nt, Homo sapiens
uaucugaguugacuugaca

SEQ ID NO: 120629 - RNA, 19 nt, Homo sapiens
cuaacuagcuuggaaacug

SEQ ID NO: 120630 - RNA, 19 nt, Homo sapiens
caaacacauuucaaagcuu

SEQ ID NO: 120631 - RNA, 19 nt, Homo sapiens
cgagggagaagacuauauu

SEQ ID NO: 120632 - RNA, 19 nt, Homo sapiens
ucaaacacauuucaaagcu

SEQ ID NO: 120633 - RNA, 19 nt, Homo sapiens
gcaagguggagcucaugua

SEQ ID NO: 120634 - RNA, 19 nt, Homo sapiens
cugaggcaauucuaacuuu

SEQ ID NO: 120635 - RNA, 19 nt, Homo sapiens
gcccaauucuuacaaacau

SEQ ID NO: 120636 - RNA, 19 nt, Homo sapiens
gaugcuaaagguuguauug

SEQ ID NO: 120637 - RNA, 19 nt, Homo sapiens
aagcaaaggaguagaaaga

SEQ ID NO: 120638 - RNA, 19 nt, Homo sapiens
caacaggggucuaugugaa

SEQ ID NO: 120639 - RNA, 19 nt, Homo sapiens
auaaaguccuugauucugu

SEQ ID NO: 120640 - RNA, 19 nt, Homo sapiens
ggcagugucuuuccaccuu

SEQ ID NO: 120641 - RNA, 19 nt, Homo sapiens
ggcagcagguggcagaaug

SEQ ID NO: 120642 - RNA, 19 nt, Homo sapiens
gaugugggucaaggaauua

SEQ ID NO: 120643 - RNA, 19 nt, Homo sapiens
ucacagcuguuucuuugag

SEQ ID NO: 120644 - RNA, 19 nt, Homo sapiens
ggaacccagauuuauguaa

SEQ ID NO: 120645 - RNA, 19 nt, Homo sapiens
ccaguuccuuucaaugguu

SEQ ID NO: 120646 - RNA, 19 nt, Homo sapiens
aacacaaggucauuugcua

SEQ ID NO: 120647 - RNA, 19 nt, Homo sapiens
guuuauagccgaaaugauc

SEQ ID NO: 120648 - RNA, 19 nt, Homo sapiens
gagcgagggagaagacuau

SEQ ID NO: 120649 - RNA, 19 nt, Homo sapiens
gaaaccauuaugaagaaga

SEQ ID NO: 120650 - RNA, 19 nt, Homo sapiens
gggaucaaagcuaucuaua

SEQ ID NO: 120651 - RNA, 19 nt, Homo sapiens
gaguccauauuucaauuuc

SEQ ID NO: 120652 - RNA, 19 nt, Homo sapiens
uaauacauaucugggauca

SEQ ID NO: 120653 - RNA, 19 nt, Homo sapiens
ugaagaagagaguccauau

SEQ ID NO: 120654 - RNA, 19 nt, Homo sapiens
gaguugacuugacagaaca

SEQ ID NO: 120655 - RNA, 19 nt, Homo sapiens
ggagcucaggacacuaaua

SEQ ID NO: 120656 - RNA, 19 nt, Homo sapiens
aaaagcaauuucagccuua

SEQ ID NO: 120657 - RNA, 19 nt, Homo sapiens
ugaagacaauggcuuacuc

SEQ ID NO: 120658 - RNA, 19 nt, Homo sapiens
ugaguugacuugacagaac

SEQ ID NO: 120659 - RNA, 19 nt, Homo sapiens
guagaacacaaggucauuu

SEQ ID NO: 120660 - RNA, 19 nt, Homo sapiens
gagcucaggacacuaauac

SEQ ID NO: 120661 - RNA, 19 nt, Homo sapiens
ggucaaggaauuaaguuag

SEQ ID NO: 120662 - RNA, 19 nt, Homo sapiens
guggaauugugcugaguug

SEQ ID NO: 120663 - RNA, 19 nt, Homo sapiens
gaacacaaggucauuugcu

SEQ ID NO: 120664 - RNA, 19 nt, Homo sapiens
cuaaagguuguauugcaua

SEQ ID NO: 120665 - RNA, 19 nt, Homo sapiens
acacgggacucuacaucug

SEQ ID NO: 120666 - RNA, 19 nt, Homo sapiens
ggacacgggacucuacauc

SEQ ID NO: 120667 - RNA, 19 nt, Homo sapiens
gaguugguguugacaugug

SEQ ID NO: 120668 - RNA, 19 nt, Homo sapiens
acacaaggucauuugcuaa

SEQ ID NO: 120669 - RNA, 19 nt, Homo sapiens
gagaagacuauauuguaca

SEQ ID NO: 120670 - RNA, 19 nt, Homo sapiens
gcacagcccaaagaaggaa

SEQ ID NO: 120671 - RNA, 19 nt, Homo sapiens
gggucaaggaauuaaguua

SEQ ID NO: 120672 - RNA, 19 nt, Homo sapiens
gcaucacuugggauuaaua

SEQ ID NO: 120673 - RNA, 19 nt, Homo sapiens
uuacaccaguuccuuucaa

SEQ ID NO: 120674 - RNA, 19 nt, Homo sapiens
ggaauugugcugaguuggu

SEQ ID NO: 120675 - RNA, 19 nt, Homo sapiens
ccugaacaccgcucccaua

SEQ ID NO: 120676 - RNA, 19 nt, Homo sapiens
caauugagaaaccauuaug

SEQ ID NO: 120677 - RNA, 19 nt, Homo sapiens
gggaauggcacagcccaaa

SEQ ID NO: 120678 - RNA, 19 nt, Homo sapiens
gguucaaacacauuucaaa

SEQ ID NO: 120679 - RNA, 19 nt, Homo sapiens
uuaaagcaaaggaguagaa

SEQ ID NO: 120680 - RNA, 19 nt, Homo sapiens
guaaagggcccucuaauaa

SEQ ID NO: 120681 - RNA, 19 nt, Homo sapiens
cacauuagcuuguuaguaa

SEQ ID NO: 120682 - RNA, 19 nt, Homo sapiens
ucuaauaacugcaguguuu

SEQ ID NO: 120683 - RNA, 19 nt, Homo sapiens
aagcagaugugcaugauua

SEQ ID NO: 120684 - RNA, 19 nt, Homo sapiens
gaagagaggucguucuaag

SEQ ID NO: 120685 - RNA, 19 nt, Homo sapiens
gaacaagacuuagggaauc

SEQ ID NO: 120686 - RNA, 19 nt, Homo sapiens
gaugguauauugaaacuga

SEQ ID NO: 120687 - RNA, 19 nt, Homo sapiens
caacaggaauugaaagaug

SEQ ID NO: 120688 - RNA, 19 nt, Homo sapiens
ccacuaagcugcucuccaa

SEQ ID NO: 120689 - RNA, 19 nt, Homo sapiens
ccucagagauggacaacua

SEQ ID NO: 120690 - RNA, 19 nt, Homo sapiens
gauugaagcugcaaagaau

SEQ ID NO: 120691 - RNA, 19 nt, Homo sapiens
ggaagaugguauauugaaa

SEQ ID NO: 120692 - RNA, 19 nt, Homo sapiens
gaacaugccaacaaauuga

SEQ ID NO: 120693 - RNA, 19 nt, Homo sapiens
gaauggaaaugagaaagaa

SEQ ID NO: 120694 - RNA, 19 nt, Homo sapiens
uaaggaauaugcccaaguu

SEQ ID NO: 120695 - RNA, 19 nt, Homo sapiens
gagaaggcauguuccagaa

SEQ ID NO: 120696 - RNA, 19 nt, Homo sapiens
caucagugcugccaagaaa

SEQ ID NO: 120697 - RNA, 19 nt, Homo sapiens
gaggagaacuggcauaugc

SEQ ID NO: 120698 - RNA, 19 nt, Homo sapiens
gaggaaugcuggcaaugaa

SEQ ID NO: 120699 - RNA, 19 nt, Homo sapiens
ucauugggcucacuucuaa

SEQ ID NO: 120700 - RNA, 19 nt, Homo sapiens
ggacaaacucacucaguaa

SEQ ID NO: 120701 - RNA, 19 nt, Homo sapiens
gaaaacugauucucuauga

SEQ ID NO: 120702 - RNA, 19 nt, Homo sapiens
ggaauuggcucaacuucag

SEQ ID NO: 120703 - RNA, 19 nt, Homo sapiens
gcugauagcuggccagagu

SEQ ID NO: 120704 - RNA, 19 nt, Homo sapiens
ugaagaagguguaaagcuu

SEQ ID NO: 120705 - RNA, 19 nt, Homo sapiens
gcagaugucuacaaauuac

SEQ ID NO: 120706 - RNA, 19 nt, Homo sapiens
uggcagaugucuacaaauu

SEQ ID NO: 120707 - RNA, 19 nt, Homo sapiens
ccagacagcuugacugcuu

SEQ ID NO: 120708 - RNA, 19 nt, Homo sapiens
gggcaaugcuggacguaaa

SEQ ID NO: 120709 - RNA, 19 nt, Homo sapiens
ggaccugcguuucggagua

SEQ ID NO: 120710 - RNA, 19 nt, Homo sapiens
cauaugcacucaauaacuu

SEQ ID NO: 120711 - RNA, 19 nt, Homo sapiens
aaagggcccucuaauaaga

SEQ ID NO: 120712 - RNA, 19 nt, Homo sapiens
gaucaggacucuggcaguu

SEQ ID NO: 120713 - RNA, 19 nt, Homo sapiens
guggauaagcugaacauua

SEQ ID NO: 120714 - RNA, 19 nt, Homo sapiens
gauccacauuagcuuguua

SEQ ID NO: 120715 - RNA, 19 nt, Homo sapiens
gaaggcauguuccagaaag

SEQ ID NO: 120716 - RNA, 19 nt, Homo sapiens
ccaagaacauaguuuaagu

SEQ ID NO: 120717 - RNA, 19 nt, Homo sapiens
uggaagaugugaacaaaug

SEQ ID NO: 120718 - RNA, 19 nt, Homo sapiens
uguggaagaugguauauug

SEQ ID NO: 120719 - RNA, 19 nt, Homo sapiens
agacacagaccaagauuaa

SEQ ID NO: 120720 - RNA, 19 nt, Homo sapiens
gaugaaggcaccagagaaa

SEQ ID NO: 120721 - RNA, 19 nt, Homo sapiens
ggaaaugagaaagaaguua

SEQ ID NO: 120722 - RNA, 19 nt, Homo sapiens
gcaaagaauggaaaugaga

SEQ ID NO: 120723 - RNA, 19 nt, Homo sapiens
gcaggacauuaauaaaguu

SEQ ID NO: 120724 - RNA, 19 nt, Homo sapiens
gacauuacuuccauugaug

SEQ ID NO: 120725 - RNA, 19 nt, Homo sapiens
guguaaagcuuguucgaau

SEQ ID NO: 120726 - RNA, 19 nt, Homo sapiens
ccaaagaugaccuguggua

SEQ ID NO: 120727 - RNA, 19 nt, Homo sapiens
agaguaaacuggcccaaga

SEQ ID NO: 120728 - RNA, 19 nt, Homo sapiens
cauggcagaugucuacaaa

SEQ ID NO: 120729 - RNA, 19 nt, Homo sapiens
gaacaagcaacugagaauu

SEQ ID NO: 120730 - RNA, 19 nt, Homo sapiens
gagccuacuucuagcugua

SEQ ID NO: 120731 - RNA, 19 nt, Homo sapiens
ccuguuccaucucaaauaa

SEQ ID NO: 120732 - RNA, 19 nt, Homo sapiens
ucacagggauuuccaaugc

SEQ ID NO: 120733 - RNA, 19 nt, Homo sapiens
gcuuugcucucugcuguua

SEQ ID NO: 120734 - RNA, 19 nt, Homo sapiens
caacacugauacuagauuc

SEQ ID NO: 120735 - RNA, 19 nt, Homo sapiens
guucgucacucaaaugaau

SEQ ID NO: 120736 - RNA, 19 nt, Homo sapiens
gaugaucccugcucuucug

SEQ ID NO: 120737 - RNA, 19 nt, Homo sapiens
auacaacacugauacuaga

SEQ ID NO: 120738 - RNA, 19 nt, Homo sapiens
gaagagagagaaacaggau

SEQ ID NO: 120739 - RNA, 19 nt, Homo sapiens
gggaacagguggccagcuu

SEQ ID NO: 120740 - RNA, 19 nt, Homo sapiens
ugacauuacuuccauugau

SEQ ID NO: 120741 - RNA, 19 nt, Homo sapiens
gcacucaauucugcaauag

SEQ ID NO: 120742 - RNA, 19 nt, Homo sapiens
gaacuggcauaugcacuca

SEQ ID NO: 120743 - RNA, 19 nt, Homo sapiens
gaucccugcucuucuguga

SEQ ID NO: 120744 - RNA, 19 nt, Homo sapiens
aaacgggcaucucagaaga

SEQ ID NO: 120745 - RNA, 19 nt, Homo sapiens
caagcuggaugcugaagug

SEQ ID NO: 120746 - RNA, 19 nt, Homo sapiens
gaaaccaauguuccacuuu

SEQ ID NO: 120747 - RNA, 19 nt, Homo sapiens
ggacuugcguagacagcuu

SEQ ID NO: 120748 - RNA, 19 nt, Homo sapiens
aggacaaacucacucagua

SEQ ID NO: 120749 - RNA, 19 nt, Homo sapiens
aaaggucucugaggacaaa

SEQ ID NO: 120750 - RNA, 19 nt, Homo sapiens
gagacacagaccaagauua

SEQ ID NO: 120751 - RNA, 19 nt, Homo sapiens
ugagaaagaaguuaaggaa

SEQ ID NO: 120752 - RNA, 19 nt, Homo sapiens
ucaggacucuggcaguuga

SEQ ID NO: 120753 - RNA, 19 nt, Homo sapiens
gauucucuaugacaugaaa

SEQ ID NO: 120754 - RNA, 19 nt, Homo sapiens
aguaaagggcccucuaaua

SEQ ID NO: 120755 - RNA, 19 nt, Homo sapiens
caaccuuccugcuguguca

SEQ ID NO: 120756 - RNA, 19 nt, Homo sapiens
gugaacaugccaacaaauu

SEQ ID NO: 120757 - RNA, 19 nt, Homo sapiens
gggauaaaauugcaaaaga

SEQ ID NO: 120758 - RNA, 19 nt, Homo sapiens
gacaaacucacucaguaaa

SEQ ID NO: 120759 - RNA, 19 nt, Homo sapiens
gcuaaauacaacacugaua

SEQ ID NO: 120760 - RNA, 19 nt, Homo sapiens
ggaccacguuucagauucu

SEQ ID NO: 120761 - RNA, 19 nt, Homo sapiens
gcugaaaguuguggaagau

SEQ ID NO: 120762 - RNA, 19 nt, Homo sapiens
ggcagaugucuacaaauua

SEQ ID NO: 120763 - RNA, 19 nt, Homo sapiens
gaagcgaggcaacaugguu

SEQ ID NO: 120764 - RNA, 19 nt, Homo sapiens
caaccuggcaucuuaggaa

SEQ ID NO: 120765 - RNA, 19 nt, Homo sapiens
gaaggaauuggcucaacuu

SEQ ID NO: 120766 - RNA, 19 nt, Homo sapiens
ggaugacucugacuuugag

SEQ ID NO: 120767 - RNA, 19 nt, Homo sapiens
ccaggagucuacacagaga

SEQ ID NO: 120768 - RNA, 19 nt, Homo sapiens
caaagaauggaaaugagaa

SEQ ID NO: 120769 - RNA, 19 nt, Homo sapiens
ggacguaaagaaagaagug

SEQ ID NO: 120770 - RNA, 19 nt, Homo sapiens
caguccagguggugaauuu

SEQ ID NO: 120771 - RNA, 19 nt, Homo sapiens
ugauggagaugacagacuu

SEQ ID NO: 120772 - RNA, 19 nt, Homo sapiens
cagaugugcaugauuauga

SEQ ID NO: 120773 - RNA, 19 nt, Homo sapiens
acacagucaugccacguuu

SEQ ID NO: 120774 - RNA, 19 nt, Homo sapiens
gaauuguggcagaguguaa

SEQ ID NO: 120775 - RNA, 19 nt, Homo sapiens
uggcauaugcacucaauaa

SEQ ID NO: 120776 - RNA, 19 nt, Homo sapiens
guaaacaccaauaguaaag

SEQ ID NO: 120777 - RNA, 19 nt, Homo sapiens
acaagcaacugagaauuuc

SEQ ID NO: 120778 - RNA, 19 nt, Homo sapiens
gaugaccugugguaagcaa

SEQ ID NO: 120779 - RNA, 19 nt, Homo sapiens
caacaaauugauugagguu

SEQ ID NO: 120780 - RNA, 19 nt, Homo sapiens
gaaagaauaugcccaaguu

SEQ ID NO: 120781 - RNA, 19 nt, Homo sapiens
gcaaagagcggaaaugaaa

SEQ ID NO: 120782 - RNA, 19 nt, Homo sapiens
gaagaagaaugccacaaug

SEQ ID NO: 120783 - RNA, 19 nt, Homo sapiens
gcccagugguggaauauua

SEQ ID NO: 120784 - RNA, 19 nt, Homo sapiens
gcaggaagauuaugaugug

SEQ ID NO: 120785 - RNA, 19 nt, Homo sapiens
gaauaauacuggaaggaaa

SEQ ID NO: 120786 - RNA, 19 nt, Homo sapiens
aaagaaagcccauguacua

SEQ ID NO: 120787 - RNA, 19 nt, Homo sapiens
gauauuccaucaagagaaa

SEQ ID NO: 120788 - RNA, 19 nt, Homo sapiens
ucacauaucugacucuuuc

SEQ ID NO: 120789 - RNA, 19 nt, Homo sapiens
ccaauacgcuuaagugugu

SEQ ID NO: 120790 - RNA, 19 nt, Homo sapiens
gcagguauaugcauaagug

SEQ ID NO: 120791 - RNA, 19 nt, Homo sapiens
gagaugagaucaauacuac

SEQ ID NO: 120792 - RNA, 19 nt, Homo sapiens
cagaagaacuagaggauga

SEQ ID NO: 120793 - RNA, 19 nt, Homo sapiens
caaccgagauuauguguuc

SEQ ID NO: 120794 - RNA, 19 nt, Homo sapiens
gcagaugucaugagacuuu

SEQ ID NO: 120795 - RNA, 19 nt, Homo sapiens
ggacauuccuguacuaagg

SEQ ID NO: 120796 - RNA, 19 nt, Homo sapiens
gaugaaggcuccagagaag

SEQ ID NO: 120797 - RNA, 19 nt, Homo sapiens
gaaaggcugugcugaugau

SEQ ID NO: 120798 - RNA, 19 nt, Homo sapiens
uaacauggacgucuucaaa

SEQ ID NO: 120799 - RNA, 19 nt, Homo sapiens
gucaagaucucaaagaaga

SEQ ID NO: 120800 - RNA, 19 nt, Homo sapiens
gaaauuaagggaacagugu

SEQ ID NO: 120801 - RNA, 19 nt, Homo sapiens
gcgaguacaugaauaauac

SEQ ID NO: 120802 - RNA, 19 nt, Homo sapiens
gagucaagaucucaaagaa

SEQ ID NO: 120803 - RNA, 19 nt, Homo sapiens
gggcagggcuagucaacuu

SEQ ID NO: 120804 - RNA, 19 nt, Homo sapiens
gguagauugugaugucaua

SEQ ID NO: 120805 - RNA, 19 nt, Homo sapiens
ggugaaacuuaacuaugua

SEQ ID NO: 120806 - RNA, 19 nt, Homo sapiens
gagaaaagccugaagaauu

SEQ ID NO: 120807 - RNA, 19 nt, Homo sapiens
cgaagcagguucucgaaug

SEQ ID NO: 120808 - RNA, 19 nt, Homo sapiens
acgcuucgcugaacaagua

SEQ ID NO: 120809 - RNA, 19 nt, Homo sapiens
ugguagagguugccaauuu

SEQ ID NO: 120810 - RNA, 19 nt, Homo sapiens
gaaagggaggucaaagaaa

SEQ ID NO: 120811 - RNA, 19 nt, Homo sapiens
guacaggcuuuaagugaau

SEQ ID NO: 120812 - RNA, 19 nt, Homo sapiens
ugacaacgugugaaaguua

SEQ ID NO: 120813 - RNA, 19 nt, Homo sapiens
gugaacagaucgcuaagga

SEQ ID NO: 120814 - RNA, 19 nt, Homo sapiens
guucagagcacuuucacua

SEQ ID NO: 120815 - RNA, 19 nt, Homo sapiens
gagaagguguuggaagcua

SEQ ID NO: 120816 - RNA, 19 nt, Homo sapiens
ugacagaggccguggauga

SEQ ID NO: 120817 - RNA, 19 nt, Homo sapiens
gguagagguugccaauuug

SEQ ID NO: 120818 - RNA, 19 nt, Homo sapiens
gacgacagcggcaaugaua

SEQ ID NO: 120819 - RNA, 19 nt, Homo sapiens
ccgggcagcucgagucaua

SEQ ID NO: 120820 - RNA, 19 nt, Homo sapiens
gagcaagccacucagaauu

SEQ ID NO: 120821 - RNA, 19 nt, Homo sapiens
aaacuuguauugcuucugu

SEQ ID NO: 120822 - RNA, 19 nt, Homo sapiens
gaaguguaaugguagaaca

SEQ ID NO: 120823 - RNA, 19 nt, Homo sapiens
ccaaauaccagaaggucua

SEQ ID NO: 120824 - RNA, 19 nt, Homo sapiens
cauuaaugcugccaagaaa

SEQ ID NO: 120825 - RNA, 19 nt, Homo sapiens
ggaaaugacagacuucaca

SEQ ID NO: 120826 - RNA, 19 nt, Homo sapiens
cagaaaggcugugcugaug

SEQ ID NO: 120827 - RNA, 19 nt, Homo sapiens
gcaagccacucagaauuuc

SEQ ID NO: 120828 - RNA, 19 nt, Homo sapiens
ucaaagcaauggauuccuu

SEQ ID NO: 120829 - RNA, 19 nt, Homo sapiens
aagcagauguguaugauca

SEQ ID NO: 120830 - RNA, 19 nt, Homo sapiens
caagagaucuaaggagaca

SEQ ID NO: 120831 - RNA, 19 nt, Homo sapiens
gcugaaggauccucacugu

SEQ ID NO: 120832 - RNA, 19 nt, Homo sapiens
gaagacaacaggagcugaa

SEQ ID NO: 120833 - RNA, 19 nt, Homo sapiens
gaagcagguucucgaaugg

SEQ ID NO: 120834 - RNA, 19 nt, Homo sapiens
uguacuagcugccucugua

SEQ ID NO: 120835 - RNA, 19 nt, Homo sapiens
aaagggaggucaaagaaag

SEQ ID NO: 120836 - RNA, 19 nt, Homo sapiens
guacuagccaauacgcuua

SEQ ID NO: 120837 - RNA, 19 nt, Homo sapiens
cauguaagcaggauuuauu

SEQ ID NO: 120838 - RNA, 19 nt, Homo sapiens
gccaucagcuuaauaucug

SEQ ID NO: 120839 - RNA, 19 nt, Homo sapiens
gaaaugacagacuucacaa

SEQ ID NO: 120840 - RNA, 19 nt, Homo sapiens
caagcuggaugcagaagug

SEQ ID NO: 120841 - RNA, 19 nt, Homo sapiens
aaguagagguugccauuga

SEQ ID NO: 120842 - RNA, 19 nt, Homo sapiens
ggcuuuaagugaauucaaa

SEQ ID NO: 120843 - RNA, 19 nt, Homo sapiens
agaggaugauucugacuuu

SEQ ID NO: 120844 - RNA, 19 nt, Homo sapiens
gacccuugcucgucgguaa

SEQ ID NO: 120845 - RNA, 19 nt, Homo sapiens
ggaaaagggugaacagauc

SEQ ID NO: 120846 - RNA, 19 nt, Homo sapiens
gaccaaucuugcuuucauu

SEQ ID NO: 120847 - RNA, 19 nt, Homo sapiens
cauguaagaugagaugaga

SEQ ID NO: 120848 - RNA, 19 nt, Homo sapiens
guucucgaauggacaaauu

SEQ ID NO: 120849 - RNA, 19 nt, Homo sapiens
gcagauguguaugaucaug

SEQ ID NO: 120850 - RNA, 19 nt, Homo sapiens
gaucgccuccuccgaguuu

SEQ ID NO: 120851 - RNA, 19 nt, Homo sapiens
gaaagcccauguacuagcu

SEQ ID NO: 120852 - RNA, 19 nt, Homo sapiens
acaauacggugaccaaucu

SEQ ID NO: 120853 - RNA, 19 nt, Homo sapiens
gguauaugcauaagugaaa

SEQ ID NO: 120854 - RNA, 19 nt, Homo sapiens
gacagugccacaucgcuua

SEQ ID NO: 120855 - RNA, 19 nt, Homo sapiens
ugagguagauugugauguc

SEQ ID NO: 120856 - RNA, 19 nt, Homo sapiens
ucaacgaauugccuuguau

SEQ ID NO: 120857 - RNA, 19 nt, Homo sapiens
caacuucaccuaucauucu

SEQ ID NO: 120858 - RNA, 19 nt, Homo sapiens
caacaaacugguagagguu

SEQ ID NO: 120859 - RNA, 19 nt, Homo sapiens
ugaccaaucuugcuuucau

SEQ ID NO: 120860 - RNA, 19 nt, Homo sapiens
ggugaaagcauccuaugug

SEQ ID NO: 120861 - RNA, 19 nt, Homo sapiens
guuggcagguauaugcaua

SEQ ID NO: 120862 - RNA, 19 nt, Homo sapiens
caaaggcccaucugguaaa

SEQ ID NO: 120863 - RNA, 19 nt, Homo sapiens
ccucucgccugguguauga

SEQ ID NO: 120864 - RNA, 19 nt, Homo sapiens
gaugugaacaaguguguga

SEQ ID NO: 120865 - RNA, 19 nt, Homo sapiens
gaucacauaucugacucuu

SEQ ID NO: 120866 - RNA, 19 nt, Homo sapiens
aaacugacaacgugugaaa

SEQ ID NO: 120867 - RNA, 19 nt, Homo sapiens
uuaaguguguggcccauga

SEQ ID NO: 120868 - RNA, 19 nt, Homo sapiens
aaagcaaacucuaaugcau

SEQ ID NO: 120869 - RNA, 19 nt, Homo sapiens
uuuaugagguagauuguga

SEQ ID NO: 120870 - RNA, 19 nt, Homo sapiens
ggagauauuccaucaagag

SEQ ID NO: 120871 - RNA, 19 nt, Homo sapiens
augcugagauggagaacua

SEQ ID NO: 120872 - RNA, 19 nt, Homo sapiens
uggugaaacuuaacuaugu

SEQ ID NO: 120873 - RNA, 19 nt, Homo sapiens
ggaaacugacaacguguga

SEQ ID NO: 120874 - RNA, 19 nt, Homo sapiens
ggaaggaaacugacaacgu

SEQ ID NO: 120875 - RNA, 19 nt, Homo sapiens
guugugccauuacuaguga

SEQ ID NO: 120876 - RNA, 19 nt, Homo sapiens
gaugagaugagaucaauac

SEQ ID NO: 120877 - RNA, 19 nt, Homo sapiens
gagcggaaaugaaaaggaa

SEQ ID NO: 120878 - RNA, 19 nt, Homo sapiens
guacacggccucucaagca

SEQ ID NO: 120879 - RNA, 19 nt, Homo sapiens
gggcacagaguucgcauug

SEQ ID NO: 120880 - RNA, 19 nt, Homo sapiens
ggaaaucacuccaaucaga

SEQ ID NO: 120881 - RNA, 19 nt, Homo sapiens
ccaguaacauugaggauua

SEQ ID NO: 120882 - RNA, 19 nt, Homo sapiens
ggaauuggcugacuauuuu

SEQ ID NO: 120883 - RNA, 19 nt, Homo sapiens
ggaaguggcuuacucucuu

SEQ ID NO: 120884 - RNA, 19 nt, Homo sapiens
gggccuguaucuugaauua

SEQ ID NO: 120885 - RNA, 19 nt, Homo sapiens
cauaguaacuccuuucaga

SEQ ID NO: 120886 - RNA, 19 nt, Homo sapiens
cgagaaacaugauaaggaa

SEQ ID NO: 120887 - RNA, 19 nt, Homo sapiens
gcccaacccugaucucaaa

SEQ ID NO: 120888 - RNA, 19 nt, Homo sapiens
gaacagcaacgacgucuuc

SEQ ID NO: 120889 - RNA, 19 nt, Homo sapiens
gaaacaugauaaggaauug

SEQ ID NO: 120890 - RNA, 19 nt, Homo sapiens
gccuguaucuugaauuaaa

SEQ ID NO: 120891 - RNA, 19 nt, Homo sapiens
ccaaagcuguccuuccuau

SEQ ID NO: 120892 - RNA, 19 nt, Homo sapiens
ucacgcuggucaaguauuu

SEQ ID NO: 120893 - RNA, 19 nt, Homo sapiens
uuggacaacuuacuguuua

SEQ ID NO: 120894 - RNA, 19 nt, Homo sapiens
gaaaucgagaaacaugaua

SEQ ID NO: 120895 - RNA, 19 nt, Homo sapiens
ccacugaguuuccuucuac

SEQ ID NO: 120896 - RNA, 19 nt, Homo sapiens
gguaugaccagcugaacua

SEQ ID NO: 120897 - RNA, 19 nt, Homo sapiens
gcaacgugcuccuggacuu

SEQ ID NO: 120898 - RNA, 19 nt, Homo sapiens
aggauacgcuuucuuguga

SEQ ID NO: 120899 - RNA, 19 nt, Homo sapiens
caacccuggugaucacuuu

SEQ ID NO: 120900 - RNA, 19 nt, Homo sapiens
gcgcucagauugcuuugga

SEQ ID NO: 120901 - RNA, 19 nt, Homo sapiens
ggagggacguuuggaagug

SEQ ID NO: 120902 - RNA, 19 nt, Homo sapiens
ucacguggcugcaguuucu

SEQ ID NO: 120903 - RNA, 19 nt, Homo sapiens
gagaccaccucacacaauc

SEQ ID NO: 120904 - RNA, 19 nt, Homo sapiens
cagucacgcuggucaagua

SEQ ID NO: 120905 - RNA, 19 nt, Homo sapiens
guagagaaaugugagucaa

SEQ ID NO: 120906 - RNA, 19 nt, Homo sapiens
gagccucagauaaguauuu

SEQ ID NO: 120907 - RNA, 19 nt, Homo sapiens
caagugacaucucaaaaug

SEQ ID NO: 120908 - RNA, 19 nt, Homo sapiens
auacaugacuugagcuugu

SEQ ID NO: 120909 - RNA, 19 nt, Homo sapiens
ccucagauaaguauuugua

SEQ ID NO: 120910 - RNA, 19 nt, Homo sapiens
gaguauuucugagccauga

SEQ ID NO: 120911 - RNA, 19 nt, Homo sapiens
acugagggcuggagcauug

SEQ ID NO: 120912 - RNA, 19 nt, Homo sapiens
guucaggagccucagauaa

SEQ ID NO: 120913 - RNA, 19 nt, Homo sapiens
ucgcguggcucuucgcauu

SEQ ID NO: 120914 - RNA, 19 nt, Homo sapiens
gaggauacgcuuucuugug

SEQ ID NO: 120915 - RNA, 19 nt, Homo sapiens
ucugagaaaucgagaaaca

SEQ ID NO: 120916 - RNA, 19 nt, Homo sapiens
aguaacuccuuucagauuu

SEQ ID NO: 120917 - RNA, 19 nt, Homo sapiens
gcaacgacgucuucuucag

SEQ ID NO: 120918 - RNA, 19 nt, Homo sapiens
ccacaggccuacaugaacu

SEQ ID NO: 120919 - RNA, 19 nt, Homo sapiens
agcaguuucuccucaaaua

SEQ ID NO: 120920 - RNA, 19 nt, Homo sapiens
auaaggaauuggcugacua

SEQ ID NO: 120921 - RNA, 19 nt, Homo sapiens
gagaaaucgagaaacauga

SEQ ID NO: 120922 - RNA, 19 nt, Homo sapiens
gcccaaagcuguccuuccu

SEQ ID NO: 120923 - RNA, 19 nt, Homo sapiens
aaucacauuucguuccaaa

SEQ ID NO: 120924 - RNA, 19 nt, Homo sapiens
uaacauugaggauuacugu

SEQ ID NO: 120925 - RNA, 19 nt, Homo sapiens
cagcaacgacgucuucuuc

SEQ ID NO: 120926 - RNA, 19 nt, Homo sapiens
gcuaccagucugugccuua

SEQ ID NO: 120927 - RNA, 19 nt, Homo sapiens
ggugaucacuuuugaaauc

SEQ ID NO: 120928 - RNA, 19 nt, Homo sapiens
gauaaggaauuggcugacu

SEQ ID NO: 120929 - RNA, 19 nt, Homo sapiens
ugagaaaucgagaaacaug

SEQ ID NO: 120930 - RNA, 19 nt, Homo sapiens
gauugguucugaauuggau

SEQ ID NO: 120931 - RNA, 19 nt, Homo sapiens
guccgugacugcaguaaca

SEQ ID NO: 120932 - RNA, 19 nt, Homo sapiens
ccacuuuccugacguacuc

SEQ ID NO: 120933 - RNA, 19 nt, Homo sapiens
gaaagagaccgggguauga

SEQ ID NO: 120934 - RNA, 19 nt, Homo sapiens
gauacgcuuucuugugauc

SEQ ID NO: 120935 - RNA, 19 nt, Homo sapiens
cccugaagcucguagagaa

SEQ ID NO: 120936 - RNA, 19 nt, Homo sapiens
ggauuacuguguuuuguga

SEQ ID NO: 120937 - RNA, 19 nt, Homo sapiens
caacuuacuguuuaucuac

SEQ ID NO: 120938 - RNA, 19 nt, Homo sapiens
gcucugccucuuccaguaa

SEQ ID NO: 120939 - RNA, 19 nt, Homo sapiens
uaguaacuccuuucagauu

SEQ ID NO: 120940 - RNA, 19 nt, Homo sapiens
ccagcgcauuagcauagua

SEQ ID NO: 120941 - RNA, 19 nt, Homo sapiens
cgccaucucuuuucuuuaa

SEQ ID NO: 120942 - RNA, 19 nt, Homo sapiens
cauugaggauuacuguguu

SEQ ID NO: 120943 - RNA, 19 nt, Homo sapiens
gugauuggcuggaucuacu

SEQ ID NO: 120944 - RNA, 19 nt, Homo sapiens
aggaauuggcugacuauuu

SEQ ID NO: 120945 - RNA, 19 nt, Homo sapiens
ucaggagccucagauaagu

SEQ ID NO: 120946 - RNA, 19 nt, Homo sapiens
gcccagcgcauuagcauag

SEQ ID NO: 120947 - RNA, 19 nt, Homo sapiens
gccagaggccauucaauag

SEQ ID NO: 120948 - RNA, 19 nt, Homo sapiens
cagcgccauuagcaucaua

SEQ ID NO: 120949 - RNA, 19 nt, Homo sapiens
ccaccucacacaaucugua

SEQ ID NO: 120950 - RNA, 19 nt, Homo sapiens
ccgaggauacgcuuucuug

SEQ ID NO: 120951 - RNA, 19 nt, Homo sapiens
guaacuccuuucagauuuu

SEQ ID NO: 120952 - RNA, 19 nt, Homo sapiens
uaaggaauuggcugacuau

SEQ ID NO: 120953 - RNA, 19 nt, Homo sapiens
gcccuaagcaacagaguuc

SEQ ID NO: 120954 - RNA, 19 nt, Homo sapiens
ggucuucuccaucgucuuc

SEQ ID NO: 120955 - RNA, 19 nt, Homo sapiens
gcguggcucuucgcauuug

SEQ ID NO: 120956 - RNA, 19 nt, Homo sapiens
ucgagaaacaugauaagga

SEQ ID NO: 120957 - RNA, 19 nt, Homo sapiens
cagcacuucuguuuguaca

SEQ ID NO: 120958 - RNA, 19 nt, Homo sapiens
ggagacccaaccaaguuug

SEQ ID NO: 120959 - RNA, 19 nt, Homo sapiens
cucaggugaucaugaauug

SEQ ID NO: 120960 - RNA, 19 nt, Homo sapiens
ccugguccaucuccuucua

SEQ ID NO: 120961 - RNA, 19 nt, Homo sapiens
cuguuuaucuacauggaaa

SEQ ID NO: 120962 - RNA, 19 nt, Homo sapiens
ucauccagcacuucuguuu

SEQ ID NO: 120963 - RNA, 19 nt, Homo sapiens
ccauuagcaucauaaacca

SEQ ID NO: 120964 - RNA, 19 nt, Homo sapiens
uaacucagcguccgugacu

SEQ ID NO: 120965 - RNA, 19 nt, Homo sapiens
agauguuccuccaguccua

SEQ ID NO: 120966 - RNA, 19 nt, Homo sapiens
gaucacguggcugcaguuu

SEQ ID NO: 120967 - RNA, 19 nt, Homo sapiens
gagcaguuucuccucaaau

SEQ ID NO: 120968 - RNA, 19 nt, Homo sapiens
cuacaucaaggagcaguuu

SEQ ID NO: 120969 - RNA, 19 nt, Homo sapiens
caggugaucaugaauugga

SEQ ID NO: 120970 - RNA, 19 nt, Homo sapiens
ggauacgcuuucuugugau

SEQ ID NO: 120971 - RNA, 19 nt, Homo sapiens
aaacuccucuuuucaagug

SEQ ID NO: 120972 - RNA, 19 nt, Homo sapiens
gaguuuccuucuacgagau

SEQ ID NO: 120973 - RNA, 19 nt, Homo sapiens
ccucaggugaucaugaauu

SEQ ID NO: 120974 - RNA, 19 nt, Homo sapiens
cagcgcauuagcauaguaa

SEQ ID NO: 120975 - RNA, 19 nt, Homo sapiens
ugaagcucguagagaaaug

SEQ ID NO: 120976 - RNA, 19 nt, Homo sapiens
ucggagacccaaccaaguu

SEQ ID NO: 120977 - RNA, 19 nt, Homo sapiens
ggacaacuuacuguuuauc

SEQ ID NO: 120978 - RNA, 19 nt, Homo sapiens
caggagccucagauaagua

SEQ ID NO: 120979 - RNA, 19 nt, Homo sapiens
guacaggacauagcucucu

SEQ ID NO: 120980 - RNA, 19 nt, Homo sapiens
gcaaucagcuggccugguu

SEQ ID NO: 120981 - RNA, 19 nt, Homo sapiens
gauggugucugcuauugua

SEQ ID NO: 120982 - RNA, 19 nt, Homo sapiens
gcacaagaauggaucacaa

SEQ ID NO: 120983 - RNA, 19 nt, Homo sapiens
gauaaaggcuacuguugga

SEQ ID NO: 120984 - RNA, 19 nt, Homo sapiens
gcugaaacaugcaguugua

SEQ ID NO: 120985 - RNA, 19 nt, Homo sapiens
guuguaaccugcugugaua

SEQ ID NO: 120986 - RNA, 19 nt, Homo sapiens
guacguaccaugcagaaua

SEQ ID NO: 120987 - RNA, 19 nt, Homo sapiens
ccacuaauguccagcguuu

SEQ ID NO: 120988 - RNA, 19 nt, Homo sapiens
gaacuugcauugugauugg

SEQ ID NO: 120989 - RNA, 19 nt, Homo sapiens
cagcuggccugguuugaua

SEQ ID NO: 120990 - RNA, 19 nt, Homo sapiens
ugacaaaacugcuaaauga

SEQ ID NO: 120991 - RNA, 19 nt, Homo sapiens
acaaguagcugauauugau

SEQ ID NO: 120992 - RNA, 19 nt, Homo sapiens
gguacgagcugcuauguuc

SEQ ID NO: 120993 - RNA, 19 nt, Homo sapiens
uaacaauuguguagccuuu

SEQ ID NO: 120994 - RNA, 19 nt, Homo sapiens
gaccagcucucucuucaga

SEQ ID NO: 120995 - RNA, 19 nt, Homo sapiens
gaucccaucuacacaguuu

SEQ ID NO: 120996 - RNA, 19 nt, Homo sapiens
uaagagguguuauuuggaa

SEQ ID NO: 120997 - RNA, 19 nt, Homo sapiens
gaaugagacugcugaucuu

SEQ ID NO: 120998 - RNA, 19 nt, Homo sapiens
ggacacagcagcaauuugu

SEQ ID NO: 120999 - RNA, 19 nt, Homo sapiens
gauccuagcuaucguucuu

SEQ ID NO: 121000 - RNA, 19 nt, Homo sapiens
cagcuggaauucuuucuaa

SEQ ID NO: 121001 - RNA, 19 nt, Homo sapiens
gccacaagauuacaagaaa

SEQ ID NO: 121002 - RNA, 19 nt, Homo sapiens
gaacaaguagcugauauug

SEQ ID NO: 121003 - RNA, 19 nt, Homo sapiens
guggaucuauuucauguuu

SEQ ID NO: 121004 - RNA, 19 nt, Homo sapiens
ugacuuugcuugcuuugaa

SEQ ID NO: 121005 - RNA, 19 nt, Homo sapiens
caaccgaauuguuaucaga

SEQ ID NO: 121006 - RNA, 19 nt, Homo sapiens
uaaccucacuugcaauaau

SEQ ID NO: 121007 - RNA, 19 nt, Homo sapiens
uaaugaggaccuauacuua

SEQ ID NO: 121008 - RNA, 19 nt, Homo sapiens
uguagaagcugguggaaug

SEQ ID NO: 121009 - RNA, 19 nt, Homo sapiens
agaaauaguugaagguugu

SEQ ID NO: 121010 - RNA, 19 nt, Homo sapiens
gaucacaagauggaauuua

SEQ ID NO: 121011 - RNA, 19 nt, Homo sapiens
gaagaaugcacaagaaugg

SEQ ID NO: 121012 - RNA, 19 nt, Homo sapiens
ggaaugagacugcugaucu

SEQ ID NO: 121013 - RNA, 19 nt, Homo sapiens
gaacagggauuuucucagu

SEQ ID NO: 121014 - RNA, 19 nt, Homo sapiens
ggacaaggaagcugcagaa

SEQ ID NO: 121015 - RNA, 19 nt, Homo sapiens
aagcagagauggcccagaa

SEQ ID NO: 121016 - RNA, 19 nt, Homo sapiens
caagaaagcaagcucauca

SEQ ID NO: 121017 - RNA, 19 nt, Homo sapiens
gcagguggaucuauuucau

SEQ ID NO: 121018 - RNA, 19 nt, Homo sapiens
guacugacuuugcuugcuu

SEQ ID NO: 121019 - RNA, 19 nt, Homo sapiens
gaagaaauaguugaagguu

SEQ ID NO: 121020 - RNA, 19 nt, Homo sapiens
aagaauggaucacaagaug

SEQ ID NO: 121021 - RNA, 19 nt, Homo sapiens
gaucuuggacuugauauug

SEQ ID NO: 121022 - RNA, 19 nt, Homo sapiens
guuaucagaggacuaaaua

SEQ ID NO: 121023 - RNA, 19 nt, Homo sapiens
guagaaacagcucguugua

SEQ ID NO: 121024 - RNA, 19 nt, Homo sapiens
gugauacgaugcuucaaga

SEQ ID NO: 121025 - RNA, 19 nt, Homo sapiens
caagauggaauuuagcaaa

SEQ ID NO: 121026 - RNA, 19 nt, Homo sapiens
uuacuucacucuaggaaug

SEQ ID NO: 121027 - RNA, 19 nt, Homo sapiens
ggguucagaugauauaaau

SEQ ID NO: 121028 - RNA, 19 nt, Homo sapiens
gauacugaccuguaaauca

SEQ ID NO: 121029 - RNA, 19 nt, Homo sapiens
gcaguucgccuucacuaug

SEQ ID NO: 121030 - RNA, 19 nt, Homo sapiens
gaaaaugguccaauuaguu

SEQ ID NO: 121031 - RNA, 19 nt, Homo sapiens
ggacuucaccugacagauc

SEQ ID NO: 121032 - RNA, 19 nt, Homo sapiens
gaaagcaagcucaucauac

SEQ ID NO: 121033 - RNA, 19 nt, Homo sapiens
gcugguaucucagaaagug

SEQ ID NO: 121034 - RNA, 19 nt, Homo sapiens
ccaagugggugguauagag

SEQ ID NO: 121035 - RNA, 19 nt, Homo sapiens
gaauggaucacaagaugga

SEQ ID NO: 121036 - RNA, 19 nt, Homo sapiens
ggacaagccacaagauuac

SEQ ID NO: 121037 - RNA, 19 nt, Homo sapiens
cuaaauaccauuccauugu

SEQ ID NO: 121038 - RNA, 19 nt, Homo sapiens
ucaagaugaugcagaacuu

SEQ ID NO: 121039 - RNA, 19 nt, Homo sapiens
ucacagaugcugaaacaug

SEQ ID NO: 121040 - RNA, 19 nt, Homo sapiens
gcguuuggcugaaccauca

SEQ ID NO: 121041 - RNA, 19 nt, Homo sapiens
acccuagccuugcuuguua

SEQ ID NO: 121042 - RNA, 19 nt, Homo sapiens
gacaauggcuacucaagcu

SEQ ID NO: 121043 - RNA, 19 nt, Homo sapiens
ucugucugcucuaguaaua

SEQ ID NO: 121044 - RNA, 19 nt, Homo sapiens
ugauuggccuguagaguug

SEQ ID NO: 121045 - RNA, 19 nt, Homo sapiens
uaagccggcuauuguagaa

SEQ ID NO: 121046 - RNA, 19 nt, Homo sapiens
aaagcaagcucaucauacu

SEQ ID NO: 121047 - RNA, 19 nt, Homo sapiens
guuaauaaggcugcaguua

SEQ ID NO: 121048 - RNA, 19 nt, Homo sapiens
aguaagagguguuauuugg

SEQ ID NO: 121049 - RNA, 19 nt, Homo sapiens
uuaagucucucguaguguu

SEQ ID NO: 121050 - RNA, 19 nt, Homo sapiens
ggaguaacaauacaaaugg

SEQ ID NO: 121051 - RNA, 19 nt, Homo sapiens
ugucugaacuugcauugug

SEQ ID NO: 121052 - RNA, 19 nt, Homo sapiens
gaggacaagccacaagauu

SEQ ID NO: 121053 - RNA, 19 nt, Homo sapiens
gcagagauggcccagaaug

SEQ ID NO: 121054 - RNA, 19 nt, Homo sapiens
cuaucugucugcucuagua

SEQ ID NO: 121055 - RNA, 19 nt, Homo sapiens
ugauauugauggacaguau

SEQ ID NO: 121056 - RNA, 19 nt, Homo sapiens
auacgaugcuucaagagaa

SEQ ID NO: 121057 - RNA, 19 nt, Homo sapiens
ucaguaagagguguuauuu

SEQ ID NO: 121058 - RNA, 19 nt, Homo sapiens
gggaacaauugaaguaaac

SEQ ID NO: 121059 - RNA, 19 nt, Homo sapiens
agaaagcaagcucaucaua

SEQ ID NO: 121060 - RNA, 19 nt, Homo sapiens
acagacugccuucaaauuu

SEQ ID NO: 121061 - RNA, 19 nt, Homo sapiens
gacagacugccuucaaauu

SEQ ID NO: 121062 - RNA, 19 nt, Homo sapiens
gauacgaugcuucaagaga

SEQ ID NO: 121063 - RNA, 19 nt, Homo sapiens
auaagcagguggaucuauu

SEQ ID NO: 121064 - RNA, 19 nt, Homo sapiens
gaaaagcggcuguuaguca

SEQ ID NO: 121065 - RNA, 19 nt, Homo sapiens
agaauugaguaauggugua

SEQ ID NO: 121066 - RNA, 19 nt, Homo sapiens
ccgcaaaucaugcaccuuu

SEQ ID NO: 121067 - RNA, 19 nt, Homo sapiens
ccacuggccucugauaaag

SEQ ID NO: 121068 - RNA, 19 nt, Homo sapiens
gauggacaguaugcaauga

SEQ ID NO: 121069 - RNA, 19 nt, Homo sapiens
caagaacaaguagcugaua

SEQ ID NO: 121070 - RNA, 19 nt, Homo sapiens
guccuucacucaagaacaa

SEQ ID NO: 121071 - RNA, 19 nt, Homo sapiens
gagaaaaugcgguuauaaa

SEQ ID NO: 121072 - RNA, 19 nt, Homo sapiens
gucaacgucuuguucagaa

SEQ ID NO: 121073 - RNA, 19 nt, Homo sapiens
gaggaccuauacuuacgaa

SEQ ID NO: 121074 - RNA, 19 nt, Homo sapiens
gaguaacaauacaaaugga

SEQ ID NO: 121075 - RNA, 19 nt, Homo sapiens
auacugaccuguaaaucau

SEQ ID NO: 121076 - RNA, 19 nt, Homo sapiens
uaaaggcuacuguuggauu

SEQ ID NO: 121077 - RNA, 19 nt, Homo sapiens
aaugcaagcuuuaggacuu

SEQ ID NO: 121078 - RNA, 19 nt, Homo sapiens
ugcauaaccuuucccauca

SEQ ID NO: 121079 - RNA, 19 nt, Homo sapiens
gaaacaugcaguuguaaac

SEQ ID NO: 121080 - RNA, 19 nt, Homo sapiens
caagaaaccugacucaauu

SEQ ID NO: 121081 - RNA, 19 nt, Homo sapiens
gcuaugagcucuuauuuca

SEQ ID NO: 121082 - RNA, 19 nt, Homo sapiens
gaauguacaugaagcaauu

SEQ ID NO: 121083 - RNA, 19 nt, Homo sapiens
caacugcccugcuggauuu

SEQ ID NO: 121084 - RNA, 19 nt, Homo sapiens
gaauguggcugaaguugaa

SEQ ID NO: 121085 - RNA, 19 nt, Homo sapiens
ggaaugugaugguuuaguu

SEQ ID NO: 121086 - RNA, 19 nt, Homo sapiens
caugggagcuuauugcuaa

SEQ ID NO: 121087 - RNA, 19 nt, Homo sapiens
cuaaguggcugccuucuuu

SEQ ID NO: 121088 - RNA, 19 nt, Homo sapiens
gaagugaucauuccucauu

SEQ ID NO: 121089 - RNA, 19 nt, Homo sapiens
gcucuucccuuauuccuaa

SEQ ID NO: 121090 - RNA, 19 nt, Homo sapiens
gauaaacugacgauucuua

SEQ ID NO: 121091 - RNA, 19 nt, Homo sapiens
uagcugaccuccugacuaa

SEQ ID NO: 121092 - RNA, 19 nt, Homo sapiens
auacguagcucucuuaaau

SEQ ID NO: 121093 - RNA, 19 nt, Homo sapiens
cugcagagaucaaggguua

SEQ ID NO: 121094 - RNA, 19 nt, Homo sapiens
gaauucuucugcaacauuu

SEQ ID NO: 121095 - RNA, 19 nt, Homo sapiens
gaauaggaaucuucacuag

SEQ ID NO: 121096 - RNA, 19 nt, Homo sapiens
ggaccuuacugaaguuauu

SEQ ID NO: 121097 - RNA, 19 nt, Homo sapiens
gauaggaaacugaagcaua

SEQ ID NO: 121098 - RNA, 19 nt, Homo sapiens
auaggaaacugaagcauaa

SEQ ID NO: 121099 - RNA, 19 nt, Homo sapiens
caucaucucugaaggaguu

SEQ ID NO: 121100 - RNA, 19 nt, Homo sapiens
gcaggaaucucuggaggaa

SEQ ID NO: 121101 - RNA, 19 nt, Homo sapiens
gaacuccucuuggaauuuc

SEQ ID NO: 121102 - RNA, 19 nt, Homo sapiens
gagugaagcucgccggaaa

SEQ ID NO: 121103 - RNA, 19 nt, Homo sapiens
gaaagaagagcaggaaaga

SEQ ID NO: 121104 - RNA, 19 nt, Homo sapiens
ugaauaaggcccacuguaa

SEQ ID NO: 121105 - RNA, 19 nt, Homo sapiens
cagcagaacuccucuugga

SEQ ID NO: 121106 - RNA, 19 nt, Homo sapiens
guaaacaugcuauuccuaa

SEQ ID NO: 121107 - RNA, 19 nt, Homo sapiens
cuaaauagcagaaagaaga

SEQ ID NO: 121108 - RNA, 19 nt, Homo sapiens
agugugagcucuucccuua

SEQ ID NO: 121109 - RNA, 19 nt, Homo sapiens
gggcuuauauguacuuuua

SEQ ID NO: 121110 - RNA, 19 nt, Homo sapiens
aaagaaggauggaagaaau

SEQ ID NO: 121111 - RNA, 19 nt, Homo sapiens
guggagcucucaagaauau

SEQ ID NO: 121112 - RNA, 19 nt, Homo sapiens
acaacuauauccagacuuu

SEQ ID NO: 121113 - RNA, 19 nt, Homo sapiens
ggagcuuauugcuaauuua

SEQ ID NO: 121114 - RNA, 19 nt, Homo sapiens
gggagaaugucaaggaaga

SEQ ID NO: 121115 - RNA, 19 nt, Homo sapiens
gaacaacacccuugaugca

SEQ ID NO: 121116 - RNA, 19 nt, Homo sapiens
ggaacccuguggaaucuuu

SEQ ID NO: 121117 - RNA, 19 nt, Homo sapiens
ccaagaggcuguagaaagg

SEQ ID NO: 121118 - RNA, 19 nt, Homo sapiens
ggaacaagaggcccaguuu

SEQ ID NO: 121119 - RNA, 19 nt, Homo sapiens
gaccauauuaccuggauua

SEQ ID NO: 121120 - RNA, 19 nt, Homo sapiens
guaauacguagcucucuua

SEQ ID NO: 121121 - RNA, 19 nt, Homo sapiens
gaauaaggcccacuguaau

SEQ ID NO: 121122 - RNA, 19 nt, Homo sapiens
cuaugcggguugauuauua

SEQ ID NO: 121123 - RNA, 19 nt, Homo sapiens
ccagagcagucauucauau

SEQ ID NO: 121124 - RNA, 19 nt, Homo sapiens
gaacuguguuugccuucuu

SEQ ID NO: 121125 - RNA, 19 nt, Homo sapiens
gcuaugaugaccuggauua

SEQ ID NO: 121126 - RNA, 19 nt, Homo sapiens
gaccuucucuuaacagugu

SEQ ID NO: 121127 - RNA, 19 nt, Homo sapiens
gcagucucauuucucauaa

SEQ ID NO: 121128 - RNA, 19 nt, Homo sapiens
auaggaaucuucacuagaa

SEQ ID NO: 121129 - RNA, 19 nt, Homo sapiens
gagaggagaccacaauaga

SEQ ID NO: 121130 - RNA, 19 nt, Homo sapiens
ugauaugucugcugaguug

SEQ ID NO: 121131 - RNA, 19 nt, Homo sapiens
gagguuauaccaggauuua

SEQ ID NO: 121132 - RNA, 19 nt, Homo sapiens
gcagaaagaagagaaguga

SEQ ID NO: 121133 - RNA, 19 nt, Homo sapiens
ggaagaagaagaccucuag

SEQ ID NO: 121134 - RNA, 19 nt, Homo sapiens
caucugggcuuauauguac

SEQ ID NO: 121135 - RNA, 19 nt, Homo sapiens
acagcaagcuuguagagaa

SEQ ID NO: 121136 - RNA, 19 nt, Homo sapiens
cauauuaccuggauuacca

SEQ ID NO: 121137 - RNA, 19 nt, Homo sapiens
gaaacugaagcauaaagaa

SEQ ID NO: 121138 - RNA, 19 nt, Homo sapiens
ggauauacaucucacuucu

SEQ ID NO: 121139 - RNA, 19 nt, Homo sapiens
ucgaaaggcucgugauaug

SEQ ID NO: 121140 - RNA, 19 nt, Homo sapiens
ucugaugaaucucaaagua

SEQ ID NO: 121141 - RNA, 19 nt, Homo sapiens
ggaagggacuuuuauuuuc

SEQ ID NO: 121142 - RNA, 19 nt, Homo sapiens
ccaagaaaccugacucaau

SEQ ID NO: 121143 - RNA, 19 nt, Homo sapiens
gaaaggcucgugauaugga

SEQ ID NO: 121144 - RNA, 19 nt, Homo sapiens
gaggaugaccagcguagua

SEQ ID NO: 121145 - RNA, 19 nt, Homo sapiens
gaacaagaggcccaguuug

SEQ ID NO: 121146 - RNA, 19 nt, Homo sapiens
agacugggcuguucucugu

SEQ ID NO: 121147 - RNA, 19 nt, Homo sapiens
gggagcuuauugcuaauuu

SEQ ID NO: 121148 - RNA, 19 nt, Homo sapiens
gugugacucuuacuccuua

SEQ ID NO: 121149 - RNA, 19 nt, Homo sapiens
uuucuucgcuggacuauug

SEQ ID NO: 121150 - RNA, 19 nt, Homo sapiens
gguuaucgcugagaacuug

SEQ ID NO: 121151 - RNA, 19 nt, Homo sapiens
gccauaauguugcuucuca

SEQ ID NO: 121152 - RNA, 19 nt, Homo sapiens
ggaauucuucugcaacauu

SEQ ID NO: 121153 - RNA, 19 nt, Homo sapiens
gaaguggucuccccaauuc

SEQ ID NO: 121154 - RNA, 19 nt, Homo sapiens
acagucaccuucuauauag

SEQ ID NO: 121155 - RNA, 19 nt, Homo sapiens
gggcgaugcugaccuugaa

SEQ ID NO: 121156 - RNA, 19 nt, Homo sapiens
guuaagaucuaugggaaga

SEQ ID NO: 121157 - RNA, 19 nt, Homo sapiens
agaccuggcuccacucuug

SEQ ID NO: 121158 - RNA, 19 nt, Homo sapiens
caagacuccugccauccua

SEQ ID NO: 121159 - RNA, 19 nt, Homo sapiens
caaacgauacaguggauuu

SEQ ID NO: 121160 - RNA, 19 nt, Homo sapiens
gguaugaugucugauuaug

SEQ ID NO: 121161 - RNA, 19 nt, Homo sapiens
ccaacuacguaauaggaaa

SEQ ID NO: 121162 - RNA, 19 nt, Homo sapiens
gcggguugauuauuauuau

SEQ ID NO: 121163 - RNA, 19 nt, Homo sapiens
gaaccucagauucuucauu

SEQ ID NO: 121164 - RNA, 19 nt, Homo sapiens
gaaugucaaggaagacuuu

SEQ ID NO: 121165 - RNA, 19 nt, Homo sapiens
gcagaacuccucuuggaau

SEQ ID NO: 121166 - RNA, 19 nt, Homo sapiens
ucgggaaugugaugguuua

SEQ ID NO: 121167 - RNA, 19 nt, Homo sapiens
aauaaggcccacuguaaua

SEQ ID NO: 121168 - RNA, 19 nt, Homo sapiens
caggaaagaucccgaaagg

SEQ ID NO: 121169 - RNA, 19 nt, Homo sapiens
cagaacuccucuuggaauu

SEQ ID NO: 121170 - RNA, 19 nt, Homo sapiens
gccuuggguuucuuucuua

SEQ ID NO: 121171 - RNA, 19 nt, Homo sapiens
ccacugggccauaauguug

SEQ ID NO: 121172 - RNA, 19 nt, Homo sapiens
ggaaacugaagcauaaaga

SEQ ID NO: 121173 - RNA, 19 nt, Homo sapiens
gaacaugggagcuuauugc

SEQ ID NO: 121174 - RNA, 19 nt, Homo sapiens
caucuuuguuacuuccuua

SEQ ID NO: 121175 - RNA, 19 nt, Homo sapiens
aaagaaggccagcaacauu

SEQ ID NO: 121176 - RNA, 19 nt, Homo sapiens
gcaaagaaggccagcaaca

SEQ ID NO: 121177 - RNA, 19 nt, Homo sapiens
gaaaccugacucaauuauu

SEQ ID NO: 121178 - RNA, 19 nt, Homo sapiens
gaaguuuaauugucucaac

SEQ ID NO: 121179 - RNA, 19 nt, Homo sapiens
gaaggcucuuucugccaua

SEQ ID NO: 121180 - RNA, 19 nt, Homo sapiens
gaacaggaauuacaguuug

SEQ ID NO: 121181 - RNA, 19 nt, Homo sapiens
gagaagugcuuuauacuga

SEQ ID NO: 121182 - RNA, 19 nt, Homo sapiens
cuaaaugaaucgcaaguua

SEQ ID NO: 121183 - RNA, 19 nt, Homo sapiens
guagaaagcuaaagugauc

SEQ ID NO: 121184 - RNA, 19 nt, Homo sapiens
ggaaaucaguagaaagcua

SEQ ID NO: 121185 - RNA, 19 nt, Homo sapiens
gaacugaacuaugaaacga

SEQ ID NO: 121186 - RNA, 19 nt, Homo sapiens
gcagugagaucgauagcaa

SEQ ID NO: 121187 - RNA, 19 nt, Homo sapiens
gaaagaucccagagaauuu

SEQ ID NO: 121188 - RNA, 19 nt, Homo sapiens
gcaaggccaugucggauga

SEQ ID NO: 121189 - RNA, 19 nt, Homo sapiens
ucagaaagaucccagagaa

SEQ ID NO: 121190 - RNA, 19 nt, Homo sapiens
ggccaacgaugauaacaaa

SEQ ID NO: 121191 - RNA, 19 nt, Homo sapiens
gaaaucaguagaaagcuaa

SEQ ID NO: 121192 - RNA, 19 nt, Homo sapiens
caucacaggugcugcguaa

SEQ ID NO: 121193 - RNA, 19 nt, Homo sapiens
gauaaccaguaaggaaaua

SEQ ID NO: 121194 - RNA, 19 nt, Homo sapiens
caaaggagauaaacacucu

SEQ ID NO: 121195 - RNA, 19 nt, Homo sapiens
ugagaaaccugguguaugg

SEQ ID NO: 121196 - RNA, 19 nt, Homo sapiens
ugaagggucuuuccaguau

SEQ ID NO: 121197 - RNA, 19 nt, Homo sapiens
gcuaaagugauccuaaaua

SEQ ID NO: 121198 - RNA, 19 nt, Homo sapiens
acacuggaauuucaacuuu

SEQ ID NO: 121199 - RNA, 19 nt, Homo sapiens
gaaaugaucagccucaaag

SEQ ID NO: 121200 - RNA, 19 nt, Homo sapiens
gcguaaggguuaucguuaa

SEQ ID NO: 121201 - RNA, 19 nt, Homo sapiens
guuaaagccuguuccauag

SEQ ID NO: 121202 - RNA, 19 nt, Homo sapiens
gaaauuacgaugaguccuu

SEQ ID NO: 121203 - RNA, 19 nt, Homo sapiens
ggagaacgccaaggccuua

SEQ ID NO: 121204 - RNA, 19 nt, Homo sapiens
aaauacagcugcauucauc

SEQ ID NO: 121205 - RNA, 19 nt, Homo sapiens
cugguggacuccuguauua

SEQ ID NO: 121206 - RNA, 19 nt, Homo sapiens
ggaagugauucagauguug

SEQ ID NO: 121207 - RNA, 19 nt, Homo sapiens
caggaaagaugccaugaca

SEQ ID NO: 121208 - RNA, 19 nt, Homo sapiens
ggaaguggucaguauauau

SEQ ID NO: 121209 - RNA, 19 nt, Homo sapiens
ggaaggccaacgaugauaa

SEQ ID NO: 121210 - RNA, 19 nt, Homo sapiens
uaacgagaagugcuuuaua

SEQ ID NO: 121211 - RNA, 19 nt, Homo sapiens
cagcaugaguucagcagaa

SEQ ID NO: 121212 - RNA, 19 nt, Homo sapiens
agcgugagcuguaaaguaa

SEQ ID NO: 121213 - RNA, 19 nt, Homo sapiens
guucugauaugugaauuug

SEQ ID NO: 121214 - RNA, 19 nt, Homo sapiens
caagacacagaauaguuua

SEQ ID NO: 121215 - RNA, 19 nt, Homo sapiens
ccucaucuaugguucuaaa

SEQ ID NO: 121216 - RNA, 19 nt, Homo sapiens
aagcuaaagugauccuaaa

SEQ ID NO: 121217 - RNA, 19 nt, Homo sapiens
gauaaacacucuccaaaag

SEQ ID NO: 121218 - RNA, 19 nt, Homo sapiens
gaaguggucaguauauauc

SEQ ID NO: 121219 - RNA, 19 nt, Homo sapiens
uaacaaaauugcccugaaa

SEQ ID NO: 121220 - RNA, 19 nt, Homo sapiens
uaaagccuguuccauagga

SEQ ID NO: 121221 - RNA, 19 nt, Homo sapiens
ggaaaugaucagccucaaa
